United States Patent 7,691,997 (FUNCTIONAL AND HYPERFUNCTIONAL SIRNA) - sequence listing, part 5

SEQ ID NO: 163405 - RNA, 19 nt, Homo sapiens
ggacuuucgcuaucgaucu

SEQ ID NO: 163406 - RNA, 19 nt, Homo sapiens
cagcuggucaggaaagaga

SEQ ID NO: 163407 - RNA, 19 nt, Homo sapiens
ggcagggacacuucucuug

SEQ ID NO: 163408 - RNA, 19 nt, Homo sapiens
ggagaauagcagacuguag

SEQ ID NO: 163409 - RNA, 19 nt, Homo sapiens
uggcuuacaugaaccacau

SEQ ID NO: 163410 - RNA, 19 nt, Homo sapiens
ggaguccuacccucuguca

SEQ ID NO: 163411 - RNA, 19 nt, Homo sapiens
ucaagugggcugaaaauga

SEQ ID NO: 163412 - RNA, 19 nt, Homo sapiens
gaagucagaugaugaauua

SEQ ID NO: 163413 - RNA, 19 nt, Homo sapiens
gaaauagacucucuuagaa

SEQ ID NO: 163414 - RNA, 19 nt, Homo sapiens
ggaaacagauggcaaauau

SEQ ID NO: 163415 - RNA, 19 nt, Homo sapiens
gcacaggccuccaugauga

SEQ ID NO: 163416 - RNA, 19 nt, Homo sapiens
caaggaagcuguugaugaa

SEQ ID NO: 163417 - RNA, 19 nt, Homo sapiens
gaauagaaaugugcccuaa

SEQ ID NO: 163418 - RNA, 19 nt, Homo sapiens
caaagaagaugcuaaagag

SEQ ID NO: 163419 - RNA, 19 nt, Homo sapiens
ggaagagugugacuacuug

SEQ ID NO: 163420 - RNA, 19 nt, Homo sapiens
cggaagaacugguuguuaa

SEQ ID NO: 163421 - RNA, 19 nt, Homo sapiens
gaacagcuaaucgauaaua

SEQ ID NO: 163422 - RNA, 19 nt, Homo sapiens
gaagaggccuuucccaucu

SEQ ID NO: 163423 - RNA, 19 nt, Homo sapiens
ggacagggaugacuucaag

SEQ ID NO: 163424 - RNA, 19 nt, Homo sapiens
uaaaagaccugcugcauuu

SEQ ID NO: 163425 - RNA, 19 nt, Homo sapiens
uggaauugcucccugauua

SEQ ID NO: 163426 - RNA, 19 nt, Homo sapiens
acacacagauacauaauga

SEQ ID NO: 163427 - RNA, 19 nt, Homo sapiens
ggacagagaaagaauagaa

SEQ ID NO: 163428 - RNA, 19 nt, Homo sapiens
ucaagaauuuggagucuaa

SEQ ID NO: 163429 - RNA, 19 nt, Homo sapiens
gaaaauugcuccuuugaug

SEQ ID NO: 163430 - RNA, 19 nt, Homo sapiens
gaagggcuauugugcgauu

SEQ ID NO: 163431 - RNA, 19 nt, Homo sapiens
gcuaaucgauaauauggaa

SEQ ID NO: 163432 - RNA, 19 nt, Homo sapiens
caaacgagcuguucauaac

SEQ ID NO: 163433 - RNA, 19 nt, Homo sapiens
gcaaauauccagcacuuuc

SEQ ID NO: 163434 - RNA, 19 nt, Homo sapiens
ugaaauagacucucuuaga

SEQ ID NO: 163435 - RNA, 19 nt, Homo sapiens
gugcugagauuaggcguua

SEQ ID NO: 163436 - RNA, 19 nt, Homo sapiens
cugaacagcuaaucgauaa

SEQ ID NO: 163437 - RNA, 19 nt, Homo sapiens
gagcaccucugccuucuuc

SEQ ID NO: 163438 - RNA, 19 nt, Homo sapiens
agaauacucugaacagcua

SEQ ID NO: 163439 - RNA, 19 nt, Homo sapiens
gaggacacuuagaauauga

SEQ ID NO: 163440 - RNA, 19 nt, Homo sapiens
gagaaagaauagaaaugug

SEQ ID NO: 163441 - RNA, 19 nt, Homo sapiens
ugacuguacuggacauaaa

SEQ ID NO: 163442 - RNA, 19 nt, Homo sapiens
ccucagcacugugaacaua

SEQ ID NO: 163443 - RNA, 19 nt, Homo sapiens
ggaauugcucccugauuaa

SEQ ID NO: 163444 - RNA, 19 nt, Homo sapiens
uaacagcgauuuugccuaa

SEQ ID NO: 163445 - RNA, 19 nt, Homo sapiens
aaugagauauggcuauuug

SEQ ID NO: 163446 - RNA, 19 nt, Homo sapiens
gaucucggcucauggcaau

SEQ ID NO: 163447 - RNA, 19 nt, Homo sapiens
ccagugggcucuccaaagu

SEQ ID NO: 163448 - RNA, 19 nt, Homo sapiens
ggaagaacugguuguuaaa

SEQ ID NO: 163449 - RNA, 19 nt, Homo sapiens
gugagaggauggaaaauua

SEQ ID NO: 163450 - RNA, 19 nt, Homo sapiens
ucgauaauauggaagcuuu

SEQ ID NO: 163451 - RNA, 19 nt, Homo sapiens
caccagcgaugacagguuu

SEQ ID NO: 163452 - RNA, 19 nt, Homo sapiens
ucagagcgcuuccuucagu

SEQ ID NO: 163453 - RNA, 19 nt, Homo sapiens
gaagagagaagugcagaug

SEQ ID NO: 163454 - RNA, 19 nt, Homo sapiens
ucaaagaagaugcuaaaga

SEQ ID NO: 163455 - RNA, 19 nt, Homo sapiens
ggaagcuguugaugaaugu

SEQ ID NO: 163456 - RNA, 19 nt, Homo sapiens
aaugacaccugcagaaaug

SEQ ID NO: 163457 - RNA, 19 nt, Homo sapiens
ccaaacgagcuguucauaa

SEQ ID NO: 163458 - RNA, 19 nt, Homo sapiens
agugggcucuccaaaguua

SEQ ID NO: 163459 - RNA, 19 nt, Homo sapiens
gaggacacacagauacaua

SEQ ID NO: 163460 - RNA, 19 nt, Homo sapiens
guggaacucucucggaaga

SEQ ID NO: 163461 - RNA, 19 nt, Homo sapiens
ggaagacacugcauuuuag

SEQ ID NO: 163462 - RNA, 19 nt, Homo sapiens
gaauugcucccugauuaaa

SEQ ID NO: 163463 - RNA, 19 nt, Homo sapiens
ccaaagggaacgugucauu

SEQ ID NO: 163464 - RNA, 19 nt, Homo sapiens
gccgguggcuuucuauaau

SEQ ID NO: 163465 - RNA, 19 nt, Homo sapiens
guauauaaccaacaacuca

SEQ ID NO: 163466 - RNA, 19 nt, Homo sapiens
ugacguguguauaguaaau

SEQ ID NO: 163467 - RNA, 19 nt, Homo sapiens
gagaagaagcaacuuguag

SEQ ID NO: 163468 - RNA, 19 nt, Homo sapiens
gagaagugcagaugucgaa

SEQ ID NO: 163469 - RNA, 19 nt, Homo sapiens
uaucuacagccuucacuua

SEQ ID NO: 163470 - RNA, 19 nt, Homo sapiens
gaccagcccucucacuaca

SEQ ID NO: 163471 - RNA, 19 nt, Homo sapiens
gaccagcccucucacuaca

SEQ ID NO: 163472 - RNA, 19 nt, Homo sapiens
aaacacgucucugugaguu

SEQ ID NO: 163473 - RNA, 19 nt, Homo sapiens
gaagauccuuucaaaacaa

SEQ ID NO: 163474 - RNA, 19 nt, Homo sapiens
ggacaaggaagcuguugau

SEQ ID NO: 163475 - RNA, 19 nt, Homo sapiens
gaugaauuauaccagaaga

SEQ ID NO: 163476 - RNA, 19 nt, Homo sapiens
gaaacuggcuccccaucaa

SEQ ID NO: 163477 - RNA, 19 nt, Homo sapiens
acaggaagcugaacagaac

SEQ ID NO: 163478 - RNA, 19 nt, Homo sapiens
gcagguggcgcucaugaga

SEQ ID NO: 163479 - RNA, 19 nt, Homo sapiens
ggcaggaaguccaggagaa

SEQ ID NO: 163480 - RNA, 19 nt, Homo sapiens
caauguggcugcuuugacu

SEQ ID NO: 163481 - RNA, 19 nt, Homo sapiens
caaagggaacgugucauuu

SEQ ID NO: 163482 - RNA, 19 nt, Homo sapiens
ggagugcaguggcgugauc

SEQ ID NO: 163483 - RNA, 19 nt, Homo sapiens
ggccaaaacuuaaucauca

SEQ ID NO: 163484 - RNA, 19 nt, Homo sapiens
cagcaaaucggaaggauca

SEQ ID NO: 163485 - RNA, 19 nt, Homo sapiens
accagaagauccuuucaaa

SEQ ID NO: 163486 - RNA, 19 nt, Homo sapiens
ggaaaagcauaugauguuu

SEQ ID NO: 163487 - RNA, 19 nt, Homo sapiens
uaagcguguuccaauguuu

SEQ ID NO: 163488 - RNA, 19 nt, Homo sapiens
gagauauggcuauuuggaa

SEQ ID NO: 163489 - RNA, 19 nt, Homo sapiens
aaagggaacgugucauuug

SEQ ID NO: 163490 - RNA, 19 nt, Homo sapiens
caucagagcgcuuccuuca

SEQ ID NO: 163491 - RNA, 19 nt, Homo sapiens
gcacgcgacaccagaaaga

SEQ ID NO: 163492 - RNA, 19 nt, Homo sapiens
aaaccugcuuugcauagaa

SEQ ID NO: 163493 - RNA, 19 nt, Homo sapiens
gagggacagagaaagaaua

SEQ ID NO: 163494 - RNA, 19 nt, Homo sapiens
gaggacagcggcaucucua

SEQ ID NO: 163495 - RNA, 19 nt, Homo sapiens
guucguggaugcccuguuc

SEQ ID NO: 163496 - RNA, 19 nt, Homo sapiens
uggcaaauauccagcacuu

SEQ ID NO: 163497 - RNA, 19 nt, Homo sapiens
acaaggaagcuguugauga

SEQ ID NO: 163498 - RNA, 19 nt, Homo sapiens
aagaacugguuguuaaaga

SEQ ID NO: 163499 - RNA, 19 nt, Homo sapiens
ggacauagccguggauacg

SEQ ID NO: 163500 - RNA, 19 nt, Homo sapiens
gcaccugcucucccugaua

SEQ ID NO: 163501 - RNA, 19 nt, Homo sapiens
acacuuagaauaugaggaa

SEQ ID NO: 163502 - RNA, 19 nt, Homo sapiens
gcaggcguauuaccagcaa

SEQ ID NO: 163503 - RNA, 19 nt, Homo sapiens
ggaagaggagaaugucaga

SEQ ID NO: 163504 - RNA, 19 nt, Homo sapiens
ucuacagccuucacuuaaa

SEQ ID NO: 163505 - RNA, 19 nt, Homo sapiens
ccucgaagauguuguacuc

SEQ ID NO: 163506 - RNA, 19 nt, Homo sapiens
ccagaaagacgacacucaa

SEQ ID NO: 163507 - RNA, 19 nt, Homo sapiens
gagggaaaauugcuccuuu

SEQ ID NO: 163508 - RNA, 19 nt, Homo sapiens
gagagcauccagaaacuuc

SEQ ID NO: 163509 - RNA, 19 nt, Homo sapiens
ugaggacacuuagaauaug

SEQ ID NO: 163510 - RNA, 19 nt, Homo sapiens
ggacacacagauacauaau

SEQ ID NO: 163511 - RNA, 19 nt, Homo sapiens
gccaggagcuguacuucag

SEQ ID NO: 163512 - RNA, 19 nt, Homo sapiens
gaagucagaugaugaauua

SEQ ID NO: 163513 - RNA, 19 nt, Homo sapiens
gaaauagacucucuuagaa

SEQ ID NO: 163514 - RNA, 19 nt, Homo sapiens
caugagagaugauguauua

SEQ ID NO: 163515 - RNA, 19 nt, Homo sapiens
ggaaacagauggcaaauau

SEQ ID NO: 163516 - RNA, 19 nt, Homo sapiens
gcacaggccuccaugauga

SEQ ID NO: 163517 - RNA, 19 nt, Homo sapiens
caaggaagcuguugaugaa

SEQ ID NO: 163518 - RNA, 19 nt, Homo sapiens
gagagaugauguauuauga

SEQ ID NO: 163519 - RNA, 19 nt, Homo sapiens
gaauagaaaugugcccuaa

SEQ ID NO: 163520 - RNA, 19 nt, Homo sapiens
caaagaagaugcuaaagag

SEQ ID NO: 163521 - RNA, 19 nt, Homo sapiens
ggaagagugugacuacuug

SEQ ID NO: 163522 - RNA, 19 nt, Homo sapiens
gaacagcuaaucgauaaua

SEQ ID NO: 163523 - RNA, 19 nt, Homo sapiens
gaagaggccuuucccaucu

SEQ ID NO: 163524 - RNA, 19 nt, Homo sapiens
ggacagggaugacuucaag

SEQ ID NO: 163525 - RNA, 19 nt, Homo sapiens
uaaaagaccugcugcauuu

SEQ ID NO: 163526 - RNA, 19 nt, Homo sapiens
uggaauugcucccugauua

SEQ ID NO: 163527 - RNA, 19 nt, Homo sapiens
acacacagauacauaauga

SEQ ID NO: 163528 - RNA, 19 nt, Homo sapiens
ggacagagaaagaauagaa

SEQ ID NO: 163529 - RNA, 19 nt, Homo sapiens
ucaagaauuuggagucuaa

SEQ ID NO: 163530 - RNA, 19 nt, Homo sapiens
gaaaauugcuccuuugaug

SEQ ID NO: 163531 - RNA, 19 nt, Homo sapiens
gaagggcuauugugcgauu

SEQ ID NO: 163532 - RNA, 19 nt, Homo sapiens
gagaugauguauuaugaug

SEQ ID NO: 163533 - RNA, 19 nt, Homo sapiens
gcuaaucgauaauauggaa

SEQ ID NO: 163534 - RNA, 19 nt, Homo sapiens
gcaaauauccagcacuuuc

SEQ ID NO: 163535 - RNA, 19 nt, Homo sapiens
ugaaauagacucucuuaga

SEQ ID NO: 163536 - RNA, 19 nt, Homo sapiens
gugcugagauuaggcguua

SEQ ID NO: 163537 - RNA, 19 nt, Homo sapiens
cugaacagcuaaucgauaa

SEQ ID NO: 163538 - RNA, 19 nt, Homo sapiens
agaauacucugaacagcua

SEQ ID NO: 163539 - RNA, 19 nt, Homo sapiens
gaggacacuuagaauauga

SEQ ID NO: 163540 - RNA, 19 nt, Homo sapiens
gagaaagaauagaaaugug

SEQ ID NO: 163541 - RNA, 19 nt, Homo sapiens
ccucagcacugugaacaua

SEQ ID NO: 163542 - RNA, 19 nt, Homo sapiens
ggaauugcucccugauuaa

SEQ ID NO: 163543 - RNA, 19 nt, Homo sapiens
aaugagauauggcuauuug

SEQ ID NO: 163544 - RNA, 19 nt, Homo sapiens
gaucucggcucauggcaau

SEQ ID NO: 163545 - RNA, 19 nt, Homo sapiens
ccagugggcucuccaaagu

SEQ ID NO: 163546 - RNA, 19 nt, Homo sapiens
ggauggauguggauuugga

SEQ ID NO: 163547 - RNA, 19 nt, Homo sapiens
gugagaggauggaaaauua

SEQ ID NO: 163548 - RNA, 19 nt, Homo sapiens
ucgauaauauggaagcuuu

SEQ ID NO: 163549 - RNA, 19 nt, Homo sapiens
caccagcgaugacagguuu

SEQ ID NO: 163550 - RNA, 19 nt, Homo sapiens
ucagagcgcuuccuucagu

SEQ ID NO: 163551 - RNA, 19 nt, Homo sapiens
gaagagagaagugcagaug

SEQ ID NO: 163552 - RNA, 19 nt, Homo sapiens
ucaaagaagaugcuaaaga

SEQ ID NO: 163553 - RNA, 19 nt, Homo sapiens
ggaagcuguugaugaaugu

SEQ ID NO: 163554 - RNA, 19 nt, Homo sapiens
aaugacaccugcagaaaug

SEQ ID NO: 163555 - RNA, 19 nt, Homo sapiens
agugggcucuccaaaguua

SEQ ID NO: 163556 - RNA, 19 nt, Homo sapiens
gaggacacacagauacaua

SEQ ID NO: 163557 - RNA, 19 nt, Homo sapiens
ggaagacacugcauuuuag

SEQ ID NO: 163558 - RNA, 19 nt, Homo sapiens
gaauugcucccugauuaaa

SEQ ID NO: 163559 - RNA, 19 nt, Homo sapiens
ccaaagggaacgugucauu

SEQ ID NO: 163560 - RNA, 19 nt, Homo sapiens
ugacguguguauaguaaau

SEQ ID NO: 163561 - RNA, 19 nt, Homo sapiens
gagaagaagcaacuuguag

SEQ ID NO: 163562 - RNA, 19 nt, Homo sapiens
uaucuacagccuucacuua

SEQ ID NO: 163563 - RNA, 19 nt, Homo sapiens
gagaagugcagaugucgaa

SEQ ID NO: 163564 - RNA, 19 nt, Homo sapiens
gaccagcccucucacuaca

SEQ ID NO: 163565 - RNA, 19 nt, Homo sapiens
gaaacuggcuccccaucaa

SEQ ID NO: 163566 - RNA, 19 nt, Homo sapiens
gaccagcccucucacuaca

SEQ ID NO: 163567 - RNA, 19 nt, Homo sapiens
aaacacgucucugugaguu

SEQ ID NO: 163568 - RNA, 19 nt, Homo sapiens
gaagauccuuucaaaacaa

SEQ ID NO: 163569 - RNA, 19 nt, Homo sapiens
gaugaauuauaccagaaga

SEQ ID NO: 163570 - RNA, 19 nt, Homo sapiens
ggacaaggaagcuguugau

SEQ ID NO: 163571 - RNA, 19 nt, Homo sapiens
acaggaagcugaacagaac

SEQ ID NO: 163572 - RNA, 19 nt, Homo sapiens
gcagguggcgcucaugaga

SEQ ID NO: 163573 - RNA, 19 nt, Homo sapiens
ggcaggaaguccaggagaa

SEQ ID NO: 163574 - RNA, 19 nt, Homo sapiens
caaagggaacgugucauuu

SEQ ID NO: 163575 - RNA, 19 nt, Homo sapiens
ggagugcaguggcgugauc

SEQ ID NO: 163576 - RNA, 19 nt, Homo sapiens
ggccaaaacuuaaucauca

SEQ ID NO: 163577 - RNA, 19 nt, Homo sapiens
cagcaaaucggaaggauca

SEQ ID NO: 163578 - RNA, 19 nt, Homo sapiens
accagaagauccuuucaaa

SEQ ID NO: 163579 - RNA, 19 nt, Homo sapiens
ggaaaagcauaugauguuu

SEQ ID NO: 163580 - RNA, 19 nt, Homo sapiens
gagauauggcuauuuggaa

SEQ ID NO: 163581 - RNA, 19 nt, Homo sapiens
aaagggaacgugucauuug

SEQ ID NO: 163582 - RNA, 19 nt, Homo sapiens
caucagagcgcuuccuuca

SEQ ID NO: 163583 - RNA, 19 nt, Homo sapiens
acaaggaagcuguugauga

SEQ ID NO: 163584 - RNA, 19 nt, Homo sapiens
aaaccugcuuugcauagaa

SEQ ID NO: 163585 - RNA, 19 nt, Homo sapiens
gagggacagagaaagaaua

SEQ ID NO: 163586 - RNA, 19 nt, Homo sapiens
gaggacagcggcaucucua

SEQ ID NO: 163587 - RNA, 19 nt, Homo sapiens
guucguggaugcccuguuc

SEQ ID NO: 163588 - RNA, 19 nt, Homo sapiens
uggcaaauauccagcacuu

SEQ ID NO: 163589 - RNA, 19 nt, Homo sapiens
gcacgcgacaccagaaaga

SEQ ID NO: 163590 - RNA, 19 nt, Homo sapiens
gaccaugagagaugaugua

SEQ ID NO: 163591 - RNA, 19 nt, Homo sapiens
ggacauagccguggauacg

SEQ ID NO: 163592 - RNA, 19 nt, Homo sapiens
gcaccugcucucccugaua

SEQ ID NO: 163593 - RNA, 19 nt, Homo sapiens
acacuuagaauaugaggaa

SEQ ID NO: 163594 - RNA, 19 nt, Homo sapiens
gcaggcguauuaccagcaa

SEQ ID NO: 163595 - RNA, 19 nt, Homo sapiens
ggaagaggagaaugucaga

SEQ ID NO: 163596 - RNA, 19 nt, Homo sapiens
ucuacagccuucacuuaaa

SEQ ID NO: 163597 - RNA, 19 nt, Homo sapiens
ccagaaagacgacacucaa

SEQ ID NO: 163598 - RNA, 19 nt, Homo sapiens
gagggaaaauugcuccuuu

SEQ ID NO: 163599 - RNA, 19 nt, Homo sapiens
gagagcauccagaaacuuc

SEQ ID NO: 163600 - RNA, 19 nt, Homo sapiens
ugaggacacuuagaauaug

SEQ ID NO: 163601 - RNA, 19 nt, Homo sapiens
ggacacacagauacauaau

SEQ ID NO: 163602 - RNA, 19 nt, Homo sapiens
gccaggagcuguacuucag

SEQ ID NO: 163603 - RNA, 19 nt, Homo sapiens
aaagaagucagaugaugaa

SEQ ID NO: 163604 - RNA, 19 nt, Homo sapiens
aagaagaugcuaaagagaa

SEQ ID NO: 163605 - RNA, 19 nt, Homo sapiens
agugggaacucaaagaaga

SEQ ID NO: 163606 - RNA, 19 nt, Homo sapiens
ggugaacgccuucccugaa

SEQ ID NO: 163607 - RNA, 19 nt, Homo sapiens
ugugacguguguauaguaa

SEQ ID NO: 163608 - RNA, 19 nt, Homo sapiens
ccaaagugcugagauuagg

SEQ ID NO: 163609 - RNA, 19 nt, Homo sapiens
ccugaaauagacucucuua

SEQ ID NO: 163610 - RNA, 19 nt, Homo sapiens
cauaaugacaccugcagaa

SEQ ID NO: 163611 - RNA, 19 nt, Homo sapiens
ucagcaccguggacacuuu

SEQ ID NO: 163612 - RNA, 19 nt, Homo sapiens
gagcuaaacuguguaauuu

SEQ ID NO: 163613 - RNA, 19 nt, Homo sapiens
gaagucaguugguauuuaa

SEQ ID NO: 163614 - RNA, 19 nt, Homo sapiens
ggagaaguaugccugcuua

SEQ ID NO: 163615 - RNA, 19 nt, Homo sapiens
caacauggcuaugcuaauu

SEQ ID NO: 163616 - RNA, 19 nt, Homo sapiens
caacaguccuucaacagua

SEQ ID NO: 163617 - RNA, 19 nt, Homo sapiens
ugaaacaucucacaucgua

SEQ ID NO: 163618 - RNA, 19 nt, Homo sapiens
gaauagguccuuuaucuuu

SEQ ID NO: 163619 - RNA, 19 nt, Homo sapiens
ugagaaggcuuauggagua

SEQ ID NO: 163620 - RNA, 19 nt, Homo sapiens
gaaaagaagugguuuauca

SEQ ID NO: 163621 - RNA, 19 nt, Homo sapiens
caaagucucuucucucaga

SEQ ID NO: 163622 - RNA, 19 nt, Homo sapiens
ccaagucuauucugcuuua

SEQ ID NO: 163623 - RNA, 19 nt, Homo sapiens
gaaguaugccugcuuaauu

SEQ ID NO: 163624 - RNA, 19 nt, Homo sapiens
ggaaacugauuaauagaga

SEQ ID NO: 163625 - RNA, 19 nt, Homo sapiens
ugaggaaacugauuaauag

SEQ ID NO: 163626 - RNA, 19 nt, Homo sapiens
ccaaguauaugcuuuaaca

SEQ ID NO: 163627 - RNA, 19 nt, Homo sapiens
aaguaugccugcuuaauua

SEQ ID NO: 163628 - RNA, 19 nt, Homo sapiens
ugguagaccuugcaauuua

SEQ ID NO: 163629 - RNA, 19 nt, Homo sapiens
gaacaggagcuuuauauac

SEQ ID NO: 163630 - RNA, 19 nt, Homo sapiens
ggaaagaaaugugucaucu

SEQ ID NO: 163631 - RNA, 19 nt, Homo sapiens
uagaauagguccuuuaucu

SEQ ID NO: 163632 - RNA, 19 nt, Homo sapiens
uaacuaagcauuugaggaa

SEQ ID NO: 163633 - RNA, 19 nt, Homo sapiens
ggacauuaccuacaucuug

SEQ ID NO: 163634 - RNA, 19 nt, Homo sapiens
gaagucaaauuccuaaugc

SEQ ID NO: 163635 - RNA, 19 nt, Homo sapiens
ugaagucaguugguauuua

SEQ ID NO: 163636 - RNA, 19 nt, Homo sapiens
aaagaaaugugucaucugu

SEQ ID NO: 163637 - RNA, 19 nt, Homo sapiens
ccaaaguguuguucugauu

SEQ ID NO: 163638 - RNA, 19 nt, Homo sapiens
aaacaugccugaaacaucu

SEQ ID NO: 163639 - RNA, 19 nt, Homo sapiens
agagagagcuaaacugugu

SEQ ID NO: 163640 - RNA, 19 nt, Homo sapiens
caucguagcuuuaacuucu

SEQ ID NO: 163641 - RNA, 19 nt, Homo sapiens
caaaguguuguucugauua

SEQ ID NO: 163642 - RNA, 19 nt, Homo sapiens
caaccaacacagcuaauuu

SEQ ID NO: 163643 - RNA, 19 nt, Homo sapiens
gcaaugagaaggcuuaugg

SEQ ID NO: 163644 - RNA, 19 nt, Homo sapiens
cccuauaacuccugaagua

SEQ ID NO: 163645 - RNA, 19 nt, Homo sapiens
gaugaucuuugucugaaug

SEQ ID NO: 163646 - RNA, 19 nt, Homo sapiens
caaacaaagucucuucucu

SEQ ID NO: 163647 - RNA, 19 nt, Homo sapiens
gauagcaagggauaauuaa

SEQ ID NO: 163648 - RNA, 19 nt, Homo sapiens
caucucacaucguagcuuu

SEQ ID NO: 163649 - RNA, 19 nt, Homo sapiens
gcuuuaacaucaaauggaa

SEQ ID NO: 163650 - RNA, 19 nt, Homo sapiens
acagauagguuagugaaga

SEQ ID NO: 163651 - RNA, 19 nt, Homo sapiens
ucaaauggaagucaaauuc

SEQ ID NO: 163652 - RNA, 19 nt, Homo sapiens
gaucuuugucugaauguaa

SEQ ID NO: 163653 - RNA, 19 nt, Homo sapiens
gagaaggcuuauggaguaa

SEQ ID NO: 163654 - RNA, 19 nt, Homo sapiens
ucaaauuccuaaugcauag

SEQ ID NO: 163655 - RNA, 19 nt, Homo sapiens
caacagugguuagaugauc

SEQ ID NO: 163656 - RNA, 19 nt, Homo sapiens
caaaagucauggugaaauu

SEQ ID NO: 163657 - RNA, 19 nt, Homo sapiens
uuaccuacaucuugccuuu

SEQ ID NO: 163658 - RNA, 19 nt, Homo sapiens
uagcaacagugguuagaug

SEQ ID NO: 163659 - RNA, 19 nt, Homo sapiens
ggugagacagggagaagua

SEQ ID NO: 163660 - RNA, 19 nt, Homo sapiens
cagauagguuagugaagaa

SEQ ID NO: 163661 - RNA, 19 nt, Homo sapiens
aaucugaacaggagcuuua

SEQ ID NO: 163662 - RNA, 19 nt, Homo sapiens
cuacaaacaugccugaaac

SEQ ID NO: 163663 - RNA, 19 nt, Homo sapiens
gguccuuuaucuuuccaua

SEQ ID NO: 163664 - RNA, 19 nt, Homo sapiens
caugguagaccuugcaauu

SEQ ID NO: 163665 - RNA, 19 nt, Homo sapiens
gguauuuaaucccaaagug

SEQ ID NO: 163666 - RNA, 19 nt, Homo sapiens
gaugaagaaggaacugaaa

SEQ ID NO: 163667 - RNA, 19 nt, Homo sapiens
ggaaagaaaagaugaagaa

SEQ ID NO: 163668 - RNA, 19 nt, Homo sapiens
aacaaagucucuucucuca

SEQ ID NO: 163669 - RNA, 19 nt, Homo sapiens
gauaaauugaggaaacuga

SEQ ID NO: 163670 - RNA, 19 nt, Homo sapiens
cagcaacaguccuucaaca

SEQ ID NO: 163671 - RNA, 19 nt, Homo sapiens
ugaacaggagcuuuauaua

SEQ ID NO: 163672 - RNA, 19 nt, Homo sapiens
cuccugaaguagauuauaa

SEQ ID NO: 163673 - RNA, 19 nt, Homo sapiens
ccauauggcacacguaaga

SEQ ID NO: 163674 - RNA, 19 nt, Homo sapiens
agauagcaagggauaauua

SEQ ID NO: 163675 - RNA, 19 nt, Homo sapiens
gaaucaagcaggugagaca

SEQ ID NO: 163676 - RNA, 19 nt, Homo sapiens
gaaagaaaugugucaucug

SEQ ID NO: 163677 - RNA, 19 nt, Homo sapiens
guagcaaugagaaggcuua

SEQ ID NO: 163678 - RNA, 19 nt, Homo sapiens
aaacagauagguuagugaa

SEQ ID NO: 163679 - RNA, 19 nt, Homo sapiens
cagaauccacaccagcuua

SEQ ID NO: 163680 - RNA, 19 nt, Homo sapiens
ccuaaugcauagauagaga

SEQ ID NO: 163681 - RNA, 19 nt, Homo sapiens
gguagaccuugcaauuuag

SEQ ID NO: 163682 - RNA, 19 nt, Homo sapiens
uuucuuaucuguaccuuuc

SEQ ID NO: 163683 - RNA, 19 nt, Homo sapiens
caacaacauggcuaugcua

SEQ ID NO: 163684 - RNA, 19 nt, Homo sapiens
gcaacaguccuucaacagu

SEQ ID NO: 163685 - RNA, 19 nt, Homo sapiens
gaacaaaagcaaacuauac

SEQ ID NO: 163686 - RNA, 19 nt, Homo sapiens
gaccaagcauuuuguaaga

SEQ ID NO: 163687 - RNA, 19 nt, Homo sapiens
ugucaucugugguuugguu

SEQ ID NO: 163688 - RNA, 19 nt, Homo sapiens
acaaacagauagguuagug

SEQ ID NO: 163689 - RNA, 19 nt, Homo sapiens
uaacuccugaaguagauua

SEQ ID NO: 163690 - RNA, 19 nt, Homo sapiens
uaacacaaacccuauaacu

SEQ ID NO: 163691 - RNA, 19 nt, Homo sapiens
gcauagauagagagagcua

SEQ ID NO: 163692 - RNA, 19 nt, Homo sapiens
gcuaugcuaauuugcuuaa

SEQ ID NO: 163693 - RNA, 19 nt, Homo sapiens
uauaacuccugaaguagau

SEQ ID NO: 163694 - RNA, 19 nt, Homo sapiens
gucaaauuccuaaugcaua

SEQ ID NO: 163695 - RNA, 19 nt, Homo sapiens
aagaaaagaugaagaagga

SEQ ID NO: 163696 - RNA, 19 nt, Homo sapiens
gcucacaggacccaaccua

SEQ ID NO: 163697 - RNA, 19 nt, Homo sapiens
gcagaaaccaaaaugaaaa

SEQ ID NO: 163698 - RNA, 19 nt, Homo sapiens
acacacaggacauuaccua

SEQ ID NO: 163699 - RNA, 19 nt, Homo sapiens
caacaguacagagcauuga

SEQ ID NO: 163700 - RNA, 19 nt, Homo sapiens
caaacaugccugaaacauc

SEQ ID NO: 163701 - RNA, 19 nt, Homo sapiens
gggauucaguuauucaaaa

SEQ ID NO: 163702 - RNA, 19 nt, Homo sapiens
aaaacuagcugcacauauc

SEQ ID NO: 163703 - RNA, 19 nt, Homo sapiens
gaaggcuuauggaguaaaa

SEQ ID NO: 163704 - RNA, 19 nt, Homo sapiens
cacaggacauuaccuacau

SEQ ID NO: 163705 - RNA, 19 nt, Homo sapiens
caagacaggcagaaaccaa

SEQ ID NO: 163706 - RNA, 19 nt, Homo sapiens
agagcuaaacuguguaauu

SEQ ID NO: 163707 - RNA, 19 nt, Homo sapiens
gagauagcaagggauaauu

SEQ ID NO: 163708 - RNA, 19 nt, Homo sapiens
aaaaugaagucaguuggua

SEQ ID NO: 163709 - RNA, 19 nt, Homo sapiens
acauggcuaugcuaauuug

SEQ ID NO: 163710 - RNA, 19 nt, Homo sapiens
ugaaucagacacuuggaaa

SEQ ID NO: 163711 - RNA, 19 nt, Homo sapiens
gggcuaacaguacuucuuc

SEQ ID NO: 163712 - RNA, 19 nt, Homo sapiens
gcagaugacuuagaaauua

SEQ ID NO: 163713 - RNA, 19 nt, Homo sapiens
gcagguagaucuccauuug

SEQ ID NO: 163714 - RNA, 19 nt, Homo sapiens
gaaguuaacagcugagaua

SEQ ID NO: 163715 - RNA, 19 nt, Homo sapiens
gaggaaauauucugaaaug

SEQ ID NO: 163716 - RNA, 19 nt, Homo sapiens
ugaaauggaucccaaauau

SEQ ID NO: 163717 - RNA, 19 nt, Homo sapiens
gaacugcuguuucuucuuc

SEQ ID NO: 163718 - RNA, 19 nt, Homo sapiens
ccaagaagauuccaaccuu

SEQ ID NO: 163719 - RNA, 19 nt, Homo sapiens
uaagaacucugaaacaauc

SEQ ID NO: 163720 - RNA, 19 nt, Homo sapiens
gaucuuccauccucaaaug

SEQ ID NO: 163721 - RNA, 19 nt, Homo sapiens
gaaaguaaccaaucugaca

SEQ ID NO: 163722 - RNA, 19 nt, Homo sapiens
caaagucacugcuggacaa

SEQ ID NO: 163723 - RNA, 19 nt, Homo sapiens
ucaaagacagagacaauua

SEQ ID NO: 163724 - RNA, 19 nt, Homo sapiens
cugcagaacuguuauaaau

SEQ ID NO: 163725 - RNA, 19 nt, Homo sapiens
ucaaguaaaugguacauca

SEQ ID NO: 163726 - RNA, 19 nt, Homo sapiens
ccaguuagaacaagaauuu

SEQ ID NO: 163727 - RNA, 19 nt, Homo sapiens
caaccaacaucaacuguca

SEQ ID NO: 163728 - RNA, 19 nt, Homo sapiens
ggaauaagagacuaaguau

SEQ ID NO: 163729 - RNA, 19 nt, Homo sapiens
gaaauggaucccaaauauu

SEQ ID NO: 163730 - RNA, 19 nt, Homo sapiens
uucaauagcugccauacua

SEQ ID NO: 163731 - RNA, 19 nt, Homo sapiens
ggaaauauucugaaaugga

SEQ ID NO: 163732 - RNA, 19 nt, Homo sapiens
ucacagguauuggcuaauu

SEQ ID NO: 163733 - RNA, 19 nt, Homo sapiens
uaucuccucuuccaaauga

SEQ ID NO: 163734 - RNA, 19 nt, Homo sapiens
caaacaaccaacaccaaua

SEQ ID NO: 163735 - RNA, 19 nt, Homo sapiens
gacaaccacuugccuacaa

SEQ ID NO: 163736 - RNA, 19 nt, Homo sapiens
guacaucaaucauuucacu

SEQ ID NO: 163737 - RNA, 19 nt, Homo sapiens
gagauaacgaggaaauauu

SEQ ID NO: 163738 - RNA, 19 nt, Homo sapiens
gucuauaccucuucugaaa

SEQ ID NO: 163739 - RNA, 19 nt, Homo sapiens
gguauuggcuaauucucaa

SEQ ID NO: 163740 - RNA, 19 nt, Homo sapiens
cagcugagauaacgaggaa

SEQ ID NO: 163741 - RNA, 19 nt, Homo sapiens
caacagagaagcagucaca

SEQ ID NO: 163742 - RNA, 19 nt, Homo sapiens
cuaaguauaugcuucaagu

SEQ ID NO: 163743 - RNA, 19 nt, Homo sapiens
ggagaggaauaagagacua

SEQ ID NO: 163744 - RNA, 19 nt, Homo sapiens
gugcauagaugaaacuuuu

SEQ ID NO: 163745 - RNA, 19 nt, Homo sapiens
ccaaaugauucuacuaguc

SEQ ID NO: 163746 - RNA, 19 nt, Homo sapiens
ggcaacugauagucaauuu

SEQ ID NO: 163747 - RNA, 19 nt, Homo sapiens
guugguagcuauaaucauc

SEQ ID NO: 163748 - RNA, 19 nt, Homo sapiens
cagagacaauuacaacaga

SEQ ID NO: 163749 - RNA, 19 nt, Homo sapiens
gaagauagugcugaugguu

SEQ ID NO: 163750 - RNA, 19 nt, Homo sapiens
gcagucacagccuaccuua

SEQ ID NO: 163751 - RNA, 19 nt, Homo sapiens
acaauuguaucuccucuuc

SEQ ID NO: 163752 - RNA, 19 nt, Homo sapiens
guccagaucccuucuagaa

SEQ ID NO: 163753 - RNA, 19 nt, Homo sapiens
ucaccaaaauguccaguua

SEQ ID NO: 163754 - RNA, 19 nt, Homo sapiens
ugucacagguauuggcuaa

SEQ ID NO: 163755 - RNA, 19 nt, Homo sapiens
guggacaccugaacaauac

SEQ ID NO: 163756 - RNA, 19 nt, Homo sapiens
ugucaggaguucucuauuc

SEQ ID NO: 163757 - RNA, 19 nt, Homo sapiens
aaugguacaucagaagaua

SEQ ID NO: 163758 - RNA, 19 nt, Homo sapiens
ccagaucccuucuagaaaa

SEQ ID NO: 163759 - RNA, 19 nt, Homo sapiens
ccugacauuuguauggaua

SEQ ID NO: 163760 - RNA, 19 nt, Homo sapiens
uuuagcagaugacuuagaa

SEQ ID NO: 163761 - RNA, 19 nt, Homo sapiens
gcuauaaucaucauuguac

SEQ ID NO: 163762 - RNA, 19 nt, Homo sapiens
cauacuaauugguguacuu

SEQ ID NO: 163763 - RNA, 19 nt, Homo sapiens
caauaucaccugccaaagu

SEQ ID NO: 163764 - RNA, 19 nt, Homo sapiens
uaacgaggaaauauucuga

SEQ ID NO: 163765 - RNA, 19 nt, Homo sapiens
gagaggaauaagagacuaa

SEQ ID NO: 163766 - RNA, 19 nt, Homo sapiens
gaagauuccaaccuugaga

SEQ ID NO: 163767 - RNA, 19 nt, Homo sapiens
ugacaaacccacaaugaca

SEQ ID NO: 163768 - RNA, 19 nt, Homo sapiens
ggacaggaaaguaaccaau

SEQ ID NO: 163769 - RNA, 19 nt, Homo sapiens
caaaugauucuacuagucu

SEQ ID NO: 163770 - RNA, 19 nt, Homo sapiens
cagccuaccuuauucacau

SEQ ID NO: 163771 - RNA, 19 nt, Homo sapiens
ggagaaaccccugacauuu

SEQ ID NO: 163772 - RNA, 19 nt, Homo sapiens
caacaccuccucccagcaa

SEQ ID NO: 163773 - RNA, 19 nt, Homo sapiens
agucacagccuaccuuauu

SEQ ID NO: 163774 - RNA, 19 nt, Homo sapiens
aggaauaagagacuaagua

SEQ ID NO: 163775 - RNA, 19 nt, Homo sapiens
acgaggaaauauucugaaa

SEQ ID NO: 163776 - RNA, 19 nt, Homo sapiens
guacuucugacuucuaugu

SEQ ID NO: 163777 - RNA, 19 nt, Homo sapiens
caccaggauuuaucuuaga

SEQ ID NO: 163778 - RNA, 19 nt, Homo sapiens
gaaauauccacaaaacgua

SEQ ID NO: 163779 - RNA, 19 nt, Homo sapiens
gaucaaaauugggcaggua

SEQ ID NO: 163780 - RNA, 19 nt, Homo sapiens
guagcuauaaucaucauug

SEQ ID NO: 163781 - RNA, 19 nt, Homo sapiens
cauaauccauccacacaac

SEQ ID NO: 163782 - RNA, 19 nt, Homo sapiens
aaacaaccaacaccaauag

SEQ ID NO: 163783 - RNA, 19 nt, Homo sapiens
aauaucaccugccaaaguc

SEQ ID NO: 163784 - RNA, 19 nt, Homo sapiens
aaaugcauguuugagagua

SEQ ID NO: 163785 - RNA, 19 nt, Homo sapiens
ucccaacucugaucaagau

SEQ ID NO: 163786 - RNA, 19 nt, Homo sapiens
gacaaacccacaaugacaa

SEQ ID NO: 163787 - RNA, 19 nt, Homo sapiens
uggaaggacaggaaaguaa

SEQ ID NO: 163788 - RNA, 19 nt, Homo sapiens
ccaaacaaccaacaccaau

SEQ ID NO: 163789 - RNA, 19 nt, Homo sapiens
caacaccagcugucuauac

SEQ ID NO: 163790 - RNA, 19 nt, Homo sapiens
uaaaugguacaucagaaga

SEQ ID NO: 163791 - RNA, 19 nt, Homo sapiens
acaccaggauuuaucuuag

SEQ ID NO: 163792 - RNA, 19 nt, Homo sapiens
gaucccaaauauuucaucu

SEQ ID NO: 163793 - RNA, 19 nt, Homo sapiens
agaccaggguggagaggaa

SEQ ID NO: 163794 - RNA, 19 nt, Homo sapiens
gagaaaccccugacauuug

SEQ ID NO: 163795 - RNA, 19 nt, Homo sapiens
ugagauaacgaggaaauau

SEQ ID NO: 163796 - RNA, 19 nt, Homo sapiens
cugaaaagcuguguauaaa

SEQ ID NO: 163797 - RNA, 19 nt, Homo sapiens
ccgcuugacucacuuaacu

SEQ ID NO: 163798 - RNA, 19 nt, Homo sapiens
uggacugucucaaucaaga

SEQ ID NO: 163799 - RNA, 19 nt, Homo sapiens
agauagugcugaugguuca

SEQ ID NO: 163800 - RNA, 19 nt, Homo sapiens
guaaaugguacaucagaag

SEQ ID NO: 163801 - RNA, 19 nt, Homo sapiens
uggaaaugcuuaaggaaac

SEQ ID NO: 163802 - RNA, 19 nt, Homo sapiens
ggaguacaccaggauuuau

SEQ ID NO: 163803 - RNA, 19 nt, Homo sapiens
ccacacaaccaccaaaguc

SEQ ID NO: 163804 - RNA, 19 nt, Homo sapiens
ucucuggacugucucaauc

SEQ ID NO: 163805 - RNA, 19 nt, Homo sapiens
acaggaaaguaaccaaucu

SEQ ID NO: 163806 - RNA, 19 nt, Homo sapiens
uguggacaccugaacaaua

SEQ ID NO: 163807 - RNA, 19 nt, Homo sapiens
ggauuuggaaggacaggaa

SEQ ID NO: 163808 - RNA, 19 nt, Homo sapiens
guacuuuggaaaugcuuaa

SEQ ID NO: 163809 - RNA, 19 nt, Homo sapiens
gauccagugucaggaguuc

SEQ ID NO: 163810 - RNA, 19 nt, Homo sapiens
ucaagacuguggagaucau

SEQ ID NO: 163811 - RNA, 19 nt, Homo sapiens
aaucaagacuguggagauc

SEQ ID NO: 163812 - RNA, 19 nt, Homo sapiens
gguauaagcugguagauaa

SEQ ID NO: 163813 - RNA, 19 nt, Homo sapiens
ccacagagcugcugcaaca

SEQ ID NO: 163814 - RNA, 19 nt, Homo sapiens
gagaacaccuccacacaga

SEQ ID NO: 163815 - RNA, 19 nt, Homo sapiens
ggagggagcugcuggaaca

SEQ ID NO: 163816 - RNA, 19 nt, Homo sapiens
guacaccucuugccucaga

SEQ ID NO: 163817 - RNA, 19 nt, Homo sapiens
gaugacagcuucccuaucg

SEQ ID NO: 163818 - RNA, 19 nt, Homo sapiens
ggaggaagcccgaggagaa

SEQ ID NO: 163819 - RNA, 19 nt, Homo sapiens
ggagaagaaucuggaaaug

SEQ ID NO: 163820 - RNA, 19 nt, Homo sapiens
ugaaagagguagucaaggu

SEQ ID NO: 163821 - RNA, 19 nt, Homo sapiens
gacaacaagugcagcauca

SEQ ID NO: 163822 - RNA, 19 nt, Homo sapiens
ugaaggaggugaagaaggu

SEQ ID NO: 163823 - RNA, 19 nt, Homo sapiens
gcuacaggcucgcaucgaa

SEQ ID NO: 163824 - RNA, 19 nt, Homo sapiens
uggaagggcugaagaagga

SEQ ID NO: 163825 - RNA, 19 nt, Homo sapiens
agaaggaagugguagaguu

SEQ ID NO: 163826 - RNA, 19 nt, Homo sapiens
uucaagaacugcaaggaua

SEQ ID NO: 163827 - RNA, 19 nt, Homo sapiens
gaaggacccaugaugcaaa

SEQ ID NO: 163828 - RNA, 19 nt, Homo sapiens
ggacagcagccacucaguu

SEQ ID NO: 163829 - RNA, 19 nt, Homo sapiens
gaaggaagugguagaguuc

SEQ ID NO: 163830 - RNA, 19 nt, Homo sapiens
ugcaggagcucgaguguga

SEQ ID NO: 163831 - RNA, 19 nt, Homo sapiens
agaagaaucuggaaauggu

SEQ ID NO: 163832 - RNA, 19 nt, Homo sapiens
ggagaucacucggcucaag

SEQ ID NO: 163833 - RNA, 19 nt, Homo sapiens
uggcgaagcucaacuccaa

SEQ ID NO: 163834 - RNA, 19 nt, Homo sapiens
gcugguagauaacacugaa

SEQ ID NO: 163835 - RNA, 19 nt, Homo sapiens
ccacacagaggcugcuuaa

SEQ ID NO: 163836 - RNA, 19 nt, Homo sapiens
gcaagagcgggaagcagua

SEQ ID NO: 163837 - RNA, 19 nt, Homo sapiens
gaagcucaacuccaacuug

SEQ ID NO: 163838 - RNA, 19 nt, Homo sapiens
ccaaggaacggcugagcua

SEQ ID NO: 163839 - RNA, 19 nt, Homo sapiens
agaccaaccuuuccaccaa

SEQ ID NO: 163840 - RNA, 19 nt, Homo sapiens
aggcagcgcuccaggacua

SEQ ID NO: 163841 - RNA, 19 nt, Homo sapiens
gagcaccaguuucuucucu

SEQ ID NO: 163842 - RNA, 19 nt, Homo sapiens
agaagaccaucuacaagga

SEQ ID NO: 163843 - RNA, 19 nt, Homo sapiens
gggccaagguggagaccaa

SEQ ID NO: 163844 - RNA, 19 nt, Homo sapiens
cugaggagauugagaagga

SEQ ID NO: 163845 - RNA, 19 nt, Homo sapiens
ccaagacggugagcaagga

SEQ ID NO: 163846 - RNA, 19 nt, Homo sapiens
uggagaggcuggaggagaa

SEQ ID NO: 163847 - RNA, 19 nt, Homo sapiens
gaagaccaucuacaaggaa

SEQ ID NO: 163848 - RNA, 19 nt, Homo sapiens
ggagcgguguggagaagga

SEQ ID NO: 163849 - RNA, 19 nt, Homo sapiens
gcgagaaggaccagaucua

SEQ ID NO: 163850 - RNA, 19 nt, Homo sapiens
ggaaguggcagcccagaag

SEQ ID NO: 163851 - RNA, 19 nt, Homo sapiens
ggaggagaaggaaguggua

SEQ ID NO: 163852 - RNA, 19 nt, Homo sapiens
cagaagcuccugacacaga

SEQ ID NO: 163853 - RNA, 19 nt, Homo sapiens
cccagaagcuccugacaca

SEQ ID NO: 163854 - RNA, 19 nt, Homo sapiens
uggcggagcuggagcaaca

SEQ ID NO: 163855 - RNA, 19 nt, Homo sapiens
ggagaagaccaucuacaag

SEQ ID NO: 163856 - RNA, 19 nt, Homo sapiens
ucaagaacugcaaggauaa

SEQ ID NO: 163857 - RNA, 19 nt, Homo sapiens
ggacuggagcgaccucaug

SEQ ID NO: 163858 - RNA, 19 nt, Homo sapiens
gagccaauaccgagaccua

SEQ ID NO: 163859 - RNA, 19 nt, Homo sapiens
uguacgagcugcagagcaa

SEQ ID NO: 163860 - RNA, 19 nt, Homo sapiens
ccaaggucaucgugaagga

SEQ ID NO: 163861 - RNA, 19 nt, Homo sapiens
ggagaaggucguggugaaa

SEQ ID NO: 163862 - RNA, 19 nt, Homo sapiens
agagggagguggacgugaa

SEQ ID NO: 163863 - RNA, 19 nt, Homo sapiens
agaagaaggagcucaguga

SEQ ID NO: 163864 - RNA, 19 nt, Homo sapiens
ggagaagaaccuugcaaag

SEQ ID NO: 163865 - RNA, 19 nt, Homo sapiens
ucaacagcgugaagaacaa

SEQ ID NO: 163866 - RNA, 19 nt, Homo sapiens
aggagaagaucaucaugga

SEQ ID NO: 163867 - RNA, 19 nt, Homo sapiens
ccagccagaucgccuacaa

SEQ ID NO: 163868 - RNA, 19 nt, Homo sapiens
cgacugggacucaggagaa

SEQ ID NO: 163869 - RNA, 19 nt, Homo sapiens
agaaggagguggagaagcu

SEQ ID NO: 163870 - RNA, 19 nt, Homo sapiens
ugagcgaccugcacagcaa

SEQ ID NO: 163871 - RNA, 19 nt, Homo sapiens
uagucaagguggagaagaa

SEQ ID NO: 163872 - RNA, 19 nt, Homo sapiens
uccaaccacuguuuuauua

SEQ ID NO: 163873 - RNA, 19 nt, Homo sapiens
cagcuggaguuugcuagaa

SEQ ID NO: 163874 - RNA, 19 nt, Homo sapiens
uugcaaaggccuauacuga

SEQ ID NO: 163875 - RNA, 19 nt, Homo sapiens
gaaggagugcgaggcguuu

SEQ ID NO: 163876 - RNA, 19 nt, Homo sapiens
aagccaagcuccucacucu

SEQ ID NO: 163877 - RNA, 19 nt, Homo sapiens
agaaggucguggugaaaga

SEQ ID NO: 163878 - RNA, 19 nt, Homo sapiens
gaaggagacagcccagaag

SEQ ID NO: 163879 - RNA, 19 nt, Homo sapiens
ggagcuggcccuucucauc

SEQ ID NO: 163880 - RNA, 19 nt, Homo sapiens
gaggagcgguguggagaag

SEQ ID NO: 163881 - RNA, 19 nt, Homo sapiens
gagaagaaucuggaaaugg

SEQ ID NO: 163882 - RNA, 19 nt, Homo sapiens
gaaggagaucgacgccuau

SEQ ID NO: 163883 - RNA, 19 nt, Homo sapiens
gacagcagccacucaguuc

SEQ ID NO: 163884 - RNA, 19 nt, Homo sapiens
ccaaaucgcaggagaagac

SEQ ID NO: 163885 - RNA, 19 nt, Homo sapiens
agauugacguccuccagaa

SEQ ID NO: 163886 - RNA, 19 nt, Homo sapiens
ucuccgggaugaucaguga

SEQ ID NO: 163887 - RNA, 19 nt, Homo sapiens
gagcuggcccuucucaucu

SEQ ID NO: 163888 - RNA, 19 nt, Homo sapiens
ccagagcaccaguuucuuc

SEQ ID NO: 163889 - RNA, 19 nt, Homo sapiens
ggugaaagagguagucaag

SEQ ID NO: 163890 - RNA, 19 nt, Homo sapiens
aggagaaggucguggugaa

SEQ ID NO: 163891 - RNA, 19 nt, Homo sapiens
gcgcuacucugugcacaag

SEQ ID NO: 163892 - RNA, 19 nt, Homo sapiens
gcucuaucaucuccaaguc

SEQ ID NO: 163893 - RNA, 19 nt, Homo sapiens
ggagagcgagcgacagaag

SEQ ID NO: 163894 - RNA, 19 nt, Homo sapiens
gcaagaggaagaccaugca

SEQ ID NO: 163895 - RNA, 19 nt, Homo sapiens
ccagcuacgagaaggauuu

SEQ ID NO: 163896 - RNA, 19 nt, Homo sapiens
caacaagugcagcaucaag

SEQ ID NO: 163897 - RNA, 19 nt, Homo sapiens
caggagaagacccagguaa

SEQ ID NO: 163898 - RNA, 19 nt, Homo sapiens
gagccagcacuugccuuua

SEQ ID NO: 163899 - RNA, 19 nt, Homo sapiens
ccacacccuuggaggacuu

SEQ ID NO: 163900 - RNA, 19 nt, Homo sapiens
ggaguacgagcacuucaag

SEQ ID NO: 163901 - RNA, 19 nt, Homo sapiens
ccagugaucccaauaaacg

SEQ ID NO: 163902 - RNA, 19 nt, Homo sapiens
gauugacguccuccagaaa

SEQ ID NO: 163903 - RNA, 19 nt, Homo sapiens
uggucaagcuggagaagga

SEQ ID NO: 163904 - RNA, 19 nt, Homo sapiens
gaagaucaucauggaggaa

SEQ ID NO: 163905 - RNA, 19 nt, Homo sapiens
agaaggagacagcccagaa

SEQ ID NO: 163906 - RNA, 19 nt, Homo sapiens
cccaauaaacgaauucugu

SEQ ID NO: 163907 - RNA, 19 nt, Homo sapiens
cagugggucuucccucugu

SEQ ID NO: 163908 - RNA, 19 nt, Homo sapiens
agaaggaccagaucuacga

SEQ ID NO: 163909 - RNA, 19 nt, Homo sapiens
caggaggaccgcagcaaga

SEQ ID NO: 163910 - RNA, 19 nt, Homo sapiens
ccagugcuguggagucucu

SEQ ID NO: 163911 - RNA, 19 nt, Homo sapiens
ccaggaagaggccgacuca

SEQ ID NO: 163912 - RNA, 19 nt, Homo sapiens
gaaaggacaugguuguguu

SEQ ID NO: 163913 - RNA, 19 nt, Homo sapiens
ggacaugguuguguuucug

SEQ ID NO: 163914 - RNA, 19 nt, Homo sapiens
cgagucggauuucuaugaa

SEQ ID NO: 163915 - RNA, 19 nt, Homo sapiens
gaaaggagagggcggaaaa

SEQ ID NO: 163916 - RNA, 19 nt, Homo sapiens
cuucuacacuuacaugaug

SEQ ID NO: 163917 - RNA, 19 nt, Homo sapiens
gugaccagaugcgucguua

SEQ ID NO: 163918 - RNA, 19 nt, Homo sapiens
gcccuaaaccugccggaaa

SEQ ID NO: 163919 - RNA, 19 nt, Homo sapiens
agucggauuucuaugaaga

SEQ ID NO: 163920 - RNA, 19 nt, Homo sapiens
ggaaaggagagggcggaaa

SEQ ID NO: 163921 - RNA, 19 nt, Homo sapiens
ggaggagccgguagaugga

SEQ ID NO: 163922 - RNA, 19 nt, Homo sapiens
ggaacucacuuggggcuuu

SEQ ID NO: 163923 - RNA, 19 nt, Homo sapiens
ggacaggggcaacccagua

SEQ ID NO: 163924 - RNA, 19 nt, Homo sapiens
gagccgaaaggacaugguu

SEQ ID NO: 163925 - RNA, 19 nt, Homo sapiens
cgaaaggacaugguugugu

SEQ ID NO: 163926 - RNA, 19 nt, Homo sapiens
cagcgccagugaccagaug

SEQ ID NO: 163927 - RNA, 19 nt, Homo sapiens
aaaggacaugguuguguuu

SEQ ID NO: 163928 - RNA, 19 nt, Homo sapiens
ggauggagagccgaaagga

SEQ ID NO: 163929 - RNA, 19 nt, Homo sapiens
gccgaaaggacaugguugu

SEQ ID NO: 163930 - RNA, 19 nt, Homo sapiens
gcaggagucuggaggauuu

SEQ ID NO: 163931 - RNA, 19 nt, Homo sapiens
ggaagaagccuccaaugaa

SEQ ID NO: 163932 - RNA, 19 nt, Homo sapiens
guacaaggauuaaaugaca

SEQ ID NO: 163933 - RNA, 19 nt, Homo sapiens
cuacacagccgacuaguua

SEQ ID NO: 163934 - RNA, 19 nt, Homo sapiens
ggagagaaccggagcauga

SEQ ID NO: 163935 - RNA, 19 nt, Homo sapiens
gaagaagccuccaaugaac

SEQ ID NO: 163936 - RNA, 19 nt, Homo sapiens
gcagagaucggcccuacua

SEQ ID NO: 163937 - RNA, 19 nt, Homo sapiens
ugacaacagugcaauuuau

SEQ ID NO: 163938 - RNA, 19 nt, Homo sapiens
ggaaugguuugaugggaaa

SEQ ID NO: 163939 - RNA, 19 nt, Homo sapiens
gaacagaugggaggaagaa

SEQ ID NO: 163940 - RNA, 19 nt, Homo sapiens
caacagugcaauuuaugua

SEQ ID NO: 163941 - RNA, 19 nt, Homo sapiens
ggaaacaagcccacugaga

SEQ ID NO: 163942 - RNA, 19 nt, Homo sapiens
guucaugguugugauguuu

SEQ ID NO: 163943 - RNA, 19 nt, Homo sapiens
gcauugacuaccagauuua

SEQ ID NO: 163944 - RNA, 19 nt, Homo sapiens
gaacuucgccuggagaaca

SEQ ID NO: 163945 - RNA, 19 nt, Homo sapiens
caacaaagcuauggaaccu

SEQ ID NO: 163946 - RNA, 19 nt, Homo sapiens
ggaccgagguggcuuuggu

SEQ ID NO: 163947 - RNA, 19 nt, Homo sapiens
gaguagcuauggucaacaa

SEQ ID NO: 163948 - RNA, 19 nt, Homo sapiens
acaaagcuauggaaccuau

SEQ ID NO: 163949 - RNA, 19 nt, Homo sapiens
ugaagacucugacaacagu

SEQ ID NO: 163950 - RNA, 19 nt, Homo sapiens
gaugaagacucugacaaca

SEQ ID NO: 163951 - RNA, 19 nt, Homo sapiens
ccaguagcauggguguuua

SEQ ID NO: 163952 - RNA, 19 nt, Homo sapiens
guuaugaucagagcaguua

SEQ ID NO: 163953 - RNA, 19 nt, Homo sapiens
cagccaagcuccaagucaa

SEQ ID NO: 163954 - RNA, 19 nt, Homo sapiens
cggaagaagccuccaauga

SEQ ID NO: 163955 - RNA, 19 nt, Homo sapiens
gagcgagguggcuucaaua

SEQ ID NO: 163956 - RNA, 19 nt, Homo sapiens
caagggagcaaacuuaaag

SEQ ID NO: 163957 - RNA, 19 nt, Homo sapiens
gcacucagccugcuuaucc

SEQ ID NO: 163958 - RNA, 19 nt, Homo sapiens
ucagaccacugcaaccuau

SEQ ID NO: 163959 - RNA, 19 nt, Homo sapiens
gauuauuccuugucuguac

SEQ ID NO: 163960 - RNA, 19 nt, Homo sapiens
ggagacggacguugagaga

SEQ ID NO: 163961 - RNA, 19 nt, Homo sapiens
gagcaugaguggcccugau

SEQ ID NO: 163962 - RNA, 19 nt, Homo sapiens
gcaguuacucucagcagaa

SEQ ID NO: 163963 - RNA, 19 nt, Homo sapiens
gauauggacagaguaacua

SEQ ID NO: 163964 - RNA, 19 nt, Homo sapiens
gagaucggcccuacuagau

SEQ ID NO: 163965 - RNA, 19 nt, Homo sapiens
ggacguggaggaccuggaa

SEQ ID NO: 163966 - RNA, 19 nt, Homo sapiens
gacagccucccacugguua

SEQ ID NO: 163967 - RNA, 19 nt, Homo sapiens
gaugaaggaccagaucuug

SEQ ID NO: 163968 - RNA, 19 nt, Homo sapiens
caagaccgcaggauggaaa

SEQ ID NO: 163969 - RNA, 19 nt, Homo sapiens
ucacugcaccuccauccua

SEQ ID NO: 163970 - RNA, 19 nt, Homo sapiens
ggacagccucccacugguu

SEQ ID NO: 163971 - RNA, 19 nt, Homo sapiens
ugcauugacuaccagauuu

SEQ ID NO: 163972 - RNA, 19 nt, Homo sapiens
gaccuuugauggaacagau

SEQ ID NO: 163973 - RNA, 19 nt, Homo sapiens
ugccaaggcugccguggaa

SEQ ID NO: 163974 - RNA, 19 nt, Homo sapiens
ggacagcagaguagcuaug

SEQ ID NO: 163975 - RNA, 19 nt, Homo sapiens
ggacaaggaaacaggaaag

SEQ ID NO: 163976 - RNA, 19 nt, Homo sapiens
caagcuccaagucaauaua

SEQ ID NO: 163977 - RNA, 19 nt, Homo sapiens
gggcagaccgccuaugcaa

SEQ ID NO: 163978 - RNA, 19 nt, Homo sapiens
ccagcccacucaaggauau

SEQ ID NO: 163979 - RNA, 19 nt, Homo sapiens
uuucaagggagcaaacuua

SEQ ID NO: 163980 - RNA, 19 nt, Homo sapiens
uaugauaccaccacugcua

SEQ ID NO: 163981 - RNA, 19 nt, Homo sapiens
aaauggcguccacggauua

SEQ ID NO: 163982 - RNA, 19 nt, Homo sapiens
gcagcagccucccacuagu

SEQ ID NO: 163983 - RNA, 19 nt, Homo sapiens
ccuaggauauggacagagu

SEQ ID NO: 163984 - RNA, 19 nt, Homo sapiens
cuaugcaacuucuuaugga

SEQ ID NO: 163985 - RNA, 19 nt, Homo sapiens
gguuugaugggaaagauuu

SEQ ID NO: 163986 - RNA, 19 nt, Homo sapiens
ggaaacaggaaagcccaaa

SEQ ID NO: 163987 - RNA, 19 nt, Homo sapiens
acaucuaccuggacaagga

SEQ ID NO: 163988 - RNA, 19 nt, Homo sapiens
gacaacagugcaauuuaug

SEQ ID NO: 163989 - RNA, 19 nt, Homo sapiens
agagcgagguggcuucaau

SEQ ID NO: 163990 - RNA, 19 nt, Homo sapiens
gcaugaguggcccugauaa

SEQ ID NO: 163991 - RNA, 19 nt, Homo sapiens
gcagaccgccuaugcaacu

SEQ ID NO: 163992 - RNA, 19 nt, Homo sapiens
ucaguaucauuguggagaa

SEQ ID NO: 163993 - RNA, 19 nt, Homo sapiens
caccauuugugaagaaaca

SEQ ID NO: 163994 - RNA, 19 nt, Homo sapiens
ggaugaaggaccagaucuu

SEQ ID NO: 163995 - RNA, 19 nt, Homo sapiens
gccaagcuccaagucaaua

SEQ ID NO: 163996 - RNA, 19 nt, Homo sapiens
cauaugggcaacaaagcua

SEQ ID NO: 163997 - RNA, 19 nt, Homo sapiens
uggcagacuucuuuaagca

SEQ ID NO: 163998 - RNA, 19 nt, Homo sapiens
cagaguagcuauggucaac

SEQ ID NO: 163999 - RNA, 19 nt, Homo sapiens
ccuaccagcuauuccucua

SEQ ID NO: 164000 - RNA, 19 nt, Homo sapiens
ccacaguguccuaugaaga

SEQ ID NO: 164001 - RNA, 19 nt, Homo sapiens
uaaaugacagugugacucu

SEQ ID NO: 164002 - RNA, 19 nt, Homo sapiens
ugaaggaccagaucuugau

SEQ ID NO: 164003 - RNA, 19 nt, Homo sapiens
gggcaacaaagcuauggaa

SEQ ID NO: 164004 - RNA, 19 nt, Homo sapiens
cgaggaggaaggagagaaa

SEQ ID NO: 164005 - RNA, 19 nt, Homo sapiens
agacggacguugagagaac

SEQ ID NO: 164006 - RNA, 19 nt, Homo sapiens
ccgccuaugcaacuucuua

SEQ ID NO: 164007 - RNA, 19 nt, Homo sapiens
cagagugcaaccaguguaa

SEQ ID NO: 164008 - RNA, 19 nt, Homo sapiens
ucaagggagcaaacuuaaa

SEQ ID NO: 164009 - RNA, 19 nt, Homo sapiens
gccguggaaugguuugaug

SEQ ID NO: 164010 - RNA, 19 nt, Homo sapiens
guuaagaugaacaagagaa

SEQ ID NO: 164011 - RNA, 19 nt, Homo sapiens
uaggauauggacagaguaa

SEQ ID NO: 164012 - RNA, 19 nt, Homo sapiens
ccaggcauaugggcaacaa

SEQ ID NO: 164013 - RNA, 19 nt, Homo sapiens
cagugugacucuagaugau

SEQ ID NO: 164014 - RNA, 19 nt, Homo sapiens
ggauuaaaugacaguguga

SEQ ID NO: 164015 - RNA, 19 nt, Homo sapiens
ggauauggacagaguaacu

SEQ ID NO: 164016 - RNA, 19 nt, Homo sapiens
gagacuagucaaccucaau

SEQ ID NO: 164017 - RNA, 19 nt, Homo sapiens
gaaacaggaaagcccaaag

SEQ ID NO: 164018 - RNA, 19 nt, Homo sapiens
gcuauggacagcagaguag

SEQ ID NO: 164019 - RNA, 19 nt, Homo sapiens
acagugcaauuuauguaca

SEQ ID NO: 164020 - RNA, 19 nt, Homo sapiens
cugacaacagugcaauuua

SEQ ID NO: 164021 - RNA, 19 nt, Homo sapiens
ccaaggcugccguggaaug

SEQ ID NO: 164022 - RNA, 19 nt, Homo sapiens
cagugcaauuuauguacaa

SEQ ID NO: 164023 - RNA, 19 nt, Homo sapiens
gggcaggagucuggaggau

SEQ ID NO: 164024 - RNA, 19 nt, Homo sapiens
caaccagcccagccuagga

SEQ ID NO: 164025 - RNA, 19 nt, Homo sapiens
ugcaauuuauguacaagga

SEQ ID NO: 164026 - RNA, 19 nt, Homo sapiens
cggauuacaguaccuauag

SEQ ID NO: 164027 - RNA, 19 nt, Homo sapiens
gcagaguagcuauggucaa

SEQ ID NO: 164028 - RNA, 19 nt, Homo sapiens
uggcuuugguggaggaaga

SEQ ID NO: 164029 - RNA, 19 nt, Homo sapiens
gcuacgggcagcagaguuc

SEQ ID NO: 164030 - RNA, 19 nt, Homo sapiens
ggaagaagccuccaaugaa

SEQ ID NO: 164031 - RNA, 19 nt, Homo sapiens
guacaaggauuaaaugaca

SEQ ID NO: 164032 - RNA, 19 nt, Homo sapiens
cuacacagccgacuaguua

SEQ ID NO: 164033 - RNA, 19 nt, Homo sapiens
gaagaagccuccaaugaac

SEQ ID NO: 164034 - RNA, 19 nt, Homo sapiens
gcagagaucggcccuacua

SEQ ID NO: 164035 - RNA, 19 nt, Homo sapiens
ugacaacagugcaauuuau

SEQ ID NO: 164036 - RNA, 19 nt, Homo sapiens
ggaaugguuugaugggaaa

SEQ ID NO: 164037 - RNA, 19 nt, Homo sapiens
gaacagaugggaggaagaa

SEQ ID NO: 164038 - RNA, 19 nt, Homo sapiens
caacagugcaauuuaugua

SEQ ID NO: 164039 - RNA, 19 nt, Homo sapiens
ggaaacaagcccacugaga

SEQ ID NO: 164040 - RNA, 19 nt, Homo sapiens
gaacuucgccuggagaaca

SEQ ID NO: 164041 - RNA, 19 nt, Homo sapiens
caacaaagcuauggaaccu

SEQ ID NO: 164042 - RNA, 19 nt, Homo sapiens
ggaccgagguggcuuuggu

SEQ ID NO: 164043 - RNA, 19 nt, Homo sapiens
gaguagcuauggucaacaa

SEQ ID NO: 164044 - RNA, 19 nt, Homo sapiens
acaaagcuauggaaccuau

SEQ ID NO: 164045 - RNA, 19 nt, Homo sapiens
ugaagacucugacaacagu

SEQ ID NO: 164046 - RNA, 19 nt, Homo sapiens
gaugaagacucugacaaca

SEQ ID NO: 164047 - RNA, 19 nt, Homo sapiens
guuaugaucagagcaguua

SEQ ID NO: 164048 - RNA, 19 nt, Homo sapiens
cagccaagcuccaagucaa

SEQ ID NO: 164049 - RNA, 19 nt, Homo sapiens
cggaagaagccuccaauga

SEQ ID NO: 164050 - RNA, 19 nt, Homo sapiens
caagggagcaaacuuaaag

SEQ ID NO: 164051 - RNA, 19 nt, Homo sapiens
gcacucagccugcuuaucc

SEQ ID NO: 164052 - RNA, 19 nt, Homo sapiens
ucagaccacugcaaccuau

SEQ ID NO: 164053 - RNA, 19 nt, Homo sapiens
ggagacggacguugagaga

SEQ ID NO: 164054 - RNA, 19 nt, Homo sapiens
gcagagacccauggaugaa

SEQ ID NO: 164055 - RNA, 19 nt, Homo sapiens
gcaguuacucucagcagaa

SEQ ID NO: 164056 - RNA, 19 nt, Homo sapiens
gauauggacagaguaacua

SEQ ID NO: 164057 - RNA, 19 nt, Homo sapiens
ggacguggaggaccuggaa

SEQ ID NO: 164058 - RNA, 19 nt, Homo sapiens
gacagccucccacugguua

SEQ ID NO: 164059 - RNA, 19 nt, Homo sapiens
gaugaaggaccagaucuug

SEQ ID NO: 164060 - RNA, 19 nt, Homo sapiens
caagaccgcaggauggaaa

SEQ ID NO: 164061 - RNA, 19 nt, Homo sapiens
ucacugcaccuccauccua

SEQ ID NO: 164062 - RNA, 19 nt, Homo sapiens
ggacagccucccacugguu

SEQ ID NO: 164063 - RNA, 19 nt, Homo sapiens
gaccuuugauggaacagau

SEQ ID NO: 164064 - RNA, 19 nt, Homo sapiens
ugccaaggcugccguggaa

SEQ ID NO: 164065 - RNA, 19 nt, Homo sapiens
ggacagcagaguagcuaug

SEQ ID NO: 164066 - RNA, 19 nt, Homo sapiens
ggacaaggaaacaggaaag

SEQ ID NO: 164067 - RNA, 19 nt, Homo sapiens
caagcuccaagucaauaua

SEQ ID NO: 164068 - RNA, 19 nt, Homo sapiens
gggcagaccgccuaugcaa

SEQ ID NO: 164069 - RNA, 19 nt, Homo sapiens
uuucaagggagcaaacuua

SEQ ID NO: 164070 - RNA, 19 nt, Homo sapiens
ccagcccacucaaggauau

SEQ ID NO: 164071 - RNA, 19 nt, Homo sapiens
uaugauaccaccacugcua

SEQ ID NO: 164072 - RNA, 19 nt, Homo sapiens
gcagcagccucccacuagu

SEQ ID NO: 164073 - RNA, 19 nt, Homo sapiens
aaauggcguccacggauua

SEQ ID NO: 164074 - RNA, 19 nt, Homo sapiens
ccuaggauauggacagagu

SEQ ID NO: 164075 - RNA, 19 nt, Homo sapiens
cuaugcaacuucuuaugga

SEQ ID NO: 164076 - RNA, 19 nt, Homo sapiens
gguuugaugggaaagauuu

SEQ ID NO: 164077 - RNA, 19 nt, Homo sapiens
ggaaacaggaaagcccaaa

SEQ ID NO: 164078 - RNA, 19 nt, Homo sapiens
acaucuaccuggacaagga

SEQ ID NO: 164079 - RNA, 19 nt, Homo sapiens
gacaacagugcaauuuaug

SEQ ID NO: 164080 - RNA, 19 nt, Homo sapiens
gcagaccgccuaugcaacu

SEQ ID NO: 164081 - RNA, 19 nt, Homo sapiens
ggaugaaggaccagaucuu

SEQ ID NO: 164082 - RNA, 19 nt, Homo sapiens
gccaagcuccaagucaaua

SEQ ID NO: 164083 - RNA, 19 nt, Homo sapiens
uggcagacuucuuuaagca

SEQ ID NO: 164084 - RNA, 19 nt, Homo sapiens
cauaugggcaacaaagcua

SEQ ID NO: 164085 - RNA, 19 nt, Homo sapiens
cagaguagcuauggucaac

SEQ ID NO: 164086 - RNA, 19 nt, Homo sapiens
ccuaccagcuauuccucua

SEQ ID NO: 164087 - RNA, 19 nt, Homo sapiens
ccacaguguccuaugaaga

SEQ ID NO: 164088 - RNA, 19 nt, Homo sapiens
uaaaugacagugugacucu

SEQ ID NO: 164089 - RNA, 19 nt, Homo sapiens
ugaaggaccagaucuugau

SEQ ID NO: 164090 - RNA, 19 nt, Homo sapiens
gggcaacaaagcuauggaa

SEQ ID NO: 164091 - RNA, 19 nt, Homo sapiens
agacggacguugagagaac

SEQ ID NO: 164092 - RNA, 19 nt, Homo sapiens
cgaggaggaaggagagaaa

SEQ ID NO: 164093 - RNA, 19 nt, Homo sapiens
ccgccuaugcaacuucuua

SEQ ID NO: 164094 - RNA, 19 nt, Homo sapiens
cagagugcaaccaguguaa

SEQ ID NO: 164095 - RNA, 19 nt, Homo sapiens
ucaagggagcaaacuuaaa

SEQ ID NO: 164096 - RNA, 19 nt, Homo sapiens
gccguggaaugguuugaug

SEQ ID NO: 164097 - RNA, 19 nt, Homo sapiens
guuaagaugaacaagagaa

SEQ ID NO: 164098 - RNA, 19 nt, Homo sapiens
uaggauauggacagaguaa

SEQ ID NO: 164099 - RNA, 19 nt, Homo sapiens
ccaggcauaugggcaacaa

SEQ ID NO: 164100 - RNA, 19 nt, Homo sapiens
cagugugacucuagaugau

SEQ ID NO: 164101 - RNA, 19 nt, Homo sapiens
ggauuaaaugacaguguga

SEQ ID NO: 164102 - RNA, 19 nt, Homo sapiens
ggauauggacagaguaacu

SEQ ID NO: 164103 - RNA, 19 nt, Homo sapiens
gagacuagucaaccucaau

SEQ ID NO: 164104 - RNA, 19 nt, Homo sapiens
gaaacaggaaagcccaaag

SEQ ID NO: 164105 - RNA, 19 nt, Homo sapiens
agagggagacggacguuga

SEQ ID NO: 164106 - RNA, 19 nt, Homo sapiens
gcuauggacagcagaguag

SEQ ID NO: 164107 - RNA, 19 nt, Homo sapiens
acagugcaauuuauguaca

SEQ ID NO: 164108 - RNA, 19 nt, Homo sapiens
cugacaacagugcaauuua

SEQ ID NO: 164109 - RNA, 19 nt, Homo sapiens
ccaaggcugccguggaaug

SEQ ID NO: 164110 - RNA, 19 nt, Homo sapiens
cagugcaauuuauguacaa

SEQ ID NO: 164111 - RNA, 19 nt, Homo sapiens
caaccagcccagccuagga

SEQ ID NO: 164112 - RNA, 19 nt, Homo sapiens
ugcaauuuauguacaagga

SEQ ID NO: 164113 - RNA, 19 nt, Homo sapiens
gcagaguagcuauggucaa

SEQ ID NO: 164114 - RNA, 19 nt, Homo sapiens
cggauuacaguaccuauag

SEQ ID NO: 164115 - RNA, 19 nt, Homo sapiens
uggcuuugguggaggaaga

SEQ ID NO: 164116 - RNA, 19 nt, Homo sapiens
cagcagccucccacuaguu

SEQ ID NO: 164117 - RNA, 19 nt, Homo sapiens
ggucaacaaagcagcuaug

SEQ ID NO: 164118 - RNA, 19 nt, Homo sapiens
acagaugggaggaagaaga

SEQ ID NO: 164119 - RNA, 19 nt, Homo sapiens
ucugacaacagugcaauuu

SEQ ID NO: 164120 - RNA, 19 nt, Homo sapiens
uaccagcuauuccucuaca

SEQ ID NO: 164121 - RNA, 19 nt, Homo sapiens
acagugugacucuagauga

SEQ ID NO: 164122 - RNA, 19 nt, Homo sapiens
ggaacagaugggaggaaga

SEQ ID NO: 164123 - RNA, 19 nt, Homo sapiens
gacagugugacucuagaug

SEQ ID NO: 164124 - RNA, 19 nt, Homo sapiens
ccuauggacagcccacuga

SEQ ID NO: 164125 - RNA, 19 nt, Homo sapiens
gcauaugggcaacaaagcu

SEQ ID NO: 164126 - RNA, 19 nt, Homo sapiens
gcgaugccacaguguccua

SEQ ID NO: 164127 - RNA, 19 nt, Homo sapiens
aaaugacagugugacucua

SEQ ID NO: 164128 - RNA, 19 nt, Homo sapiens
gcaauuuauguacaaggau

SEQ ID NO: 164129 - RNA, 19 nt, Homo sapiens
ggauuacaguaccuauagc

SEQ ID NO: 164130 - RNA, 19 nt, Homo sapiens
gaaccaagcugccgucaua

SEQ ID NO: 164131 - RNA, 19 nt, Homo sapiens
cgacagagcugcaugaaua

SEQ ID NO: 164132 - RNA, 19 nt, Homo sapiens
ggaaguacaugcugguauu

SEQ ID NO: 164133 - RNA, 19 nt, Homo sapiens
gaagaaauaccgagacauu

SEQ ID NO: 164134 - RNA, 19 nt, Homo sapiens
ggagaaaguuaaagaaauc

SEQ ID NO: 164135 - RNA, 19 nt, Homo sapiens
gaugagagauuguuauuac

SEQ ID NO: 164136 - RNA, 19 nt, Homo sapiens
gaacacagcgguaggaaug

SEQ ID NO: 164137 - RNA, 19 nt, Homo sapiens
ccacaaauauuaucacuac

SEQ ID NO: 164138 - RNA, 19 nt, Homo sapiens
aaagagagaugcagggauu

SEQ ID NO: 164139 - RNA, 19 nt, Homo sapiens
caaauucacugcagucauc

SEQ ID NO: 164140 - RNA, 19 nt, Homo sapiens
gacaggagcugcuauuuac

SEQ ID NO: 164141 - RNA, 19 nt, Homo sapiens
gggagaaaguuaaagaaau

SEQ ID NO: 164142 - RNA, 19 nt, Homo sapiens
gcagggauuugugagguua

SEQ ID NO: 164143 - RNA, 19 nt, Homo sapiens
ggaaaggcauccagagaag

SEQ ID NO: 164144 - RNA, 19 nt, Homo sapiens
gcacauaucacguaacagu

SEQ ID NO: 164145 - RNA, 19 nt, Homo sapiens
ggagagugguggaugaguu

SEQ ID NO: 164146 - RNA, 19 nt, Homo sapiens
ugacaggagcugcuauuua

SEQ ID NO: 164147 - RNA, 19 nt, Homo sapiens
uggcagagcuucccugaga

SEQ ID NO: 164148 - RNA, 19 nt, Homo sapiens
gggaucggcugacuuguug

SEQ ID NO: 164149 - RNA, 19 nt, Homo sapiens
ggagagagcaagguuauga

SEQ ID NO: 164150 - RNA, 19 nt, Homo sapiens
ucucugaagugauuaauug

SEQ ID NO: 164151 - RNA, 19 nt, Homo sapiens
gccauucucugaagugauu

SEQ ID NO: 164152 - RNA, 19 nt, Homo sapiens
cauaucacguaacaguuua

SEQ ID NO: 164153 - RNA, 19 nt, Homo sapiens
aaacuuagaugagcagaau

SEQ ID NO: 164154 - RNA, 19 nt, Homo sapiens
gaaggagagagcaagguua

SEQ ID NO: 164155 - RNA, 19 nt, Homo sapiens
caacaacagagguggauuu

SEQ ID NO: 164156 - RNA, 19 nt, Homo sapiens
gauaaaauccuagcacuua

SEQ ID NO: 164157 - RNA, 19 nt, Homo sapiens
gagagauuguuauuacaga

SEQ ID NO: 164158 - RNA, 19 nt, Homo sapiens
cgacccaacuuugauguuu

SEQ ID NO: 164159 - RNA, 19 nt, Homo sapiens
gagcugcuauuuaccacaa

SEQ ID NO: 164160 - RNA, 19 nt, Homo sapiens
caaaguggacgaacgacua

SEQ ID NO: 164161 - RNA, 19 nt, Homo sapiens
gcucucagcuggcucuugu

SEQ ID NO: 164162 - RNA, 19 nt, Homo sapiens
gggaaaugcugcacaaugc

SEQ ID NO: 164163 - RNA, 19 nt, Homo sapiens
gagacaacaccgaguauga

SEQ ID NO: 164164 - RNA, 19 nt, Homo sapiens
caccaggaaugccuuauau

SEQ ID NO: 164165 - RNA, 19 nt, Homo sapiens
aaacuugggugauucuugu

SEQ ID NO: 164166 - RNA, 19 nt, Homo sapiens
gacuggagcugaaaguguu

SEQ ID NO: 164167 - RNA, 19 nt, Homo sapiens
gagcuucccugagaggauu

SEQ ID NO: 164168 - RNA, 19 nt, Homo sapiens
ucagauuccuggaggcuuu

SEQ ID NO: 164169 - RNA, 19 nt, Homo sapiens
gcacaaugccacuuucugu

SEQ ID NO: 164170 - RNA, 19 nt, Homo sapiens
gagcugaaaguguugauug

SEQ ID NO: 164171 - RNA, 19 nt, Homo sapiens
ucaagcacauaucacguaa

SEQ ID NO: 164172 - RNA, 19 nt, Homo sapiens
agaagaagcaguauaagga

SEQ ID NO: 164173 - RNA, 19 nt, Homo sapiens
guacugugcccagaucaua

SEQ ID NO: 164174 - RNA, 19 nt, Homo sapiens
cucaguaugugcacaauuu

SEQ ID NO: 164175 - RNA, 19 nt, Homo sapiens
acaaucaggucuauucauc

SEQ ID NO: 164176 - RNA, 19 nt, Homo sapiens
gcuucaaagucuacguaua

SEQ ID NO: 164177 - RNA, 19 nt, Homo sapiens
gggaaaggcauccagagaa

SEQ ID NO: 164178 - RNA, 19 nt, Homo sapiens
ccagacugcuccaaacuca

SEQ ID NO: 164179 - RNA, 19 nt, Homo sapiens
caaucaaagugacccagaa

SEQ ID NO: 164180 - RNA, 19 nt, Homo sapiens
gcaccagacugcuccaaac

SEQ ID NO: 164181 - RNA, 19 nt, Homo sapiens
cguaacaguuuaauaugga

SEQ ID NO: 164182 - RNA, 19 nt, Homo sapiens
gauccaaagugcagagucu

SEQ ID NO: 164183 - RNA, 19 nt, Homo sapiens
gaaacuugggugauucuug

SEQ ID NO: 164184 - RNA, 19 nt, Homo sapiens
gcggagaguuugaagucuu

SEQ ID NO: 164185 - RNA, 19 nt, Homo sapiens
agaaauaccgagacauuga

SEQ ID NO: 164186 - RNA, 19 nt, Homo sapiens
cauaggcgaugagagauug

SEQ ID NO: 164187 - RNA, 19 nt, Homo sapiens
gaacaaugguaggaaucau

SEQ ID NO: 164188 - RNA, 19 nt, Homo sapiens
ccaggaaugccuuauauca

SEQ ID NO: 164189 - RNA, 19 nt, Homo sapiens
agacuagguugguacaguu

SEQ ID NO: 164190 - RNA, 19 nt, Homo sapiens
gcgaugagagauuguuauu

SEQ ID NO: 164191 - RNA, 19 nt, Homo sapiens
gaagaacacagcgguagga

SEQ ID NO: 164192 - RNA, 19 nt, Homo sapiens
ggacuggagcugaaagugu

SEQ ID NO: 164193 - RNA, 19 nt, Homo sapiens
gcagaagggaauaaagaga

SEQ ID NO: 164194 - RNA, 19 nt, Homo sapiens
gguugguacaguuuaauua

SEQ ID NO: 164195 - RNA, 19 nt, Homo sapiens
ucaaagugacccagaagaa

SEQ ID NO: 164196 - RNA, 19 nt, Homo sapiens
aagcacauaucacguaaca

SEQ ID NO: 164197 - RNA, 19 nt, Homo sapiens
cggagaguuugaagucuuu

SEQ ID NO: 164198 - RNA, 19 nt, Homo sapiens
uuaaagaaaucgcccacau

SEQ ID NO: 164199 - RNA, 19 nt, Homo sapiens
ucaccucacuggcuucugu

SEQ ID NO: 164200 - RNA, 19 nt, Homo sapiens
ggucuauucaucaggauaa

SEQ ID NO: 164201 - RNA, 19 nt, Homo sapiens
gaaaaucgccgaaaguuac

SEQ ID NO: 164202 - RNA, 19 nt, Homo sapiens
cuagguugguacaguuuaa

SEQ ID NO: 164203 - RNA, 19 nt, Homo sapiens
ggcugacccugaccacuuu

SEQ ID NO: 164204 - RNA, 19 nt, Homo sapiens
ugacagggauaggaucaga

SEQ ID NO: 164205 - RNA, 19 nt, Homo sapiens
gagcggagaguuugaaguc

SEQ ID NO: 164206 - RNA, 19 nt, Homo sapiens
gcuccaaacucaccucacu

SEQ ID NO: 164207 - RNA, 19 nt, Homo sapiens
gagaugcagggauuuguga

SEQ ID NO: 164208 - RNA, 19 nt, Homo sapiens
cccagaagaagcaguauaa

SEQ ID NO: 164209 - RNA, 19 nt, Homo sapiens
uaccacaguauucaucuua

SEQ ID NO: 164210 - RNA, 19 nt, Homo sapiens
uuagacagcagacacaauu

SEQ ID NO: 164211 - RNA, 19 nt, Homo sapiens
cugaagugauuaauuggaa

SEQ ID NO: 164212 - RNA, 19 nt, Homo sapiens
gccaaagccagcaucagua

SEQ ID NO: 164213 - RNA, 19 nt, Homo sapiens
gcacuuggccugacuacac

SEQ ID NO: 164214 - RNA, 19 nt, Homo sapiens
gggugauucuuguguuuau

SEQ ID NO: 164215 - RNA, 19 nt, Homo sapiens
uaaagaaaucgcccacaug

SEQ ID NO: 164216 - RNA, 19 nt, Homo sapiens
uagaugagcagaaugacaa

SEQ ID NO: 164217 - RNA, 19 nt, Homo sapiens
gcagccacuucugggauaa

SEQ ID NO: 164218 - RNA, 19 nt, Homo sapiens
gauuucgccuucacagugu

SEQ ID NO: 164219 - RNA, 19 nt, Homo sapiens
ccacaguauucaucuuauc

SEQ ID NO: 164220 - RNA, 19 nt, Homo sapiens
agaagggaauaaagagaga

SEQ ID NO: 164221 - RNA, 19 nt, Homo sapiens
ggaguugccauucucugaa

SEQ ID NO: 164222 - RNA, 19 nt, Homo sapiens
gaaaguguugauugggaaa

SEQ ID NO: 164223 - RNA, 19 nt, Homo sapiens
gggcugacccugaccacuu

SEQ ID NO: 164224 - RNA, 19 nt, Homo sapiens
acauaucacguaacaguuu

SEQ ID NO: 164225 - RNA, 19 nt, Homo sapiens
aaacuuccgacccaacuuu

SEQ ID NO: 164226 - RNA, 19 nt, Homo sapiens
gauuucacccuuugcaaga

SEQ ID NO: 164227 - RNA, 19 nt, Homo sapiens
gauuccagcgugcacauuu

SEQ ID NO: 164228 - RNA, 19 nt, Homo sapiens
uucggaggcuugcaguuua

SEQ ID NO: 164229 - RNA, 19 nt, Homo sapiens
gagagugguggaugaguug

SEQ ID NO: 164230 - RNA, 19 nt, Homo sapiens
gaacaagaaccuagaauga

SEQ ID NO: 164231 - RNA, 19 nt, Homo sapiens
guaagaaggucccaaauca

SEQ ID NO: 164232 - RNA, 19 nt, Homo sapiens
gaagagagcaucugugguu

SEQ ID NO: 164233 - RNA, 19 nt, Homo sapiens
cauaugaacugugaagaua

SEQ ID NO: 164234 - RNA, 19 nt, Homo sapiens
guaacaaucuggaaggaaa

SEQ ID NO: 164235 - RNA, 19 nt, Homo sapiens
ggacgagugucuuuaaugu

SEQ ID NO: 164236 - RNA, 19 nt, Homo sapiens
ucaaaugacuggaauguag

SEQ ID NO: 164237 - RNA, 19 nt, Homo sapiens
gugcgucggucaaguauaa

SEQ ID NO: 164238 - RNA, 19 nt, Homo sapiens
ggucaaacauggagaguca

SEQ ID NO: 164239 - RNA, 19 nt, Homo sapiens
acgagugucuuuaauguua

SEQ ID NO: 164240 - RNA, 19 nt, Homo sapiens
gagagcaucugugguugua

SEQ ID NO: 164241 - RNA, 19 nt, Homo sapiens
guuaaaugcugcuauacaa

SEQ ID NO: 164242 - RNA, 19 nt, Homo sapiens
caaguuugcuucagucuuc

SEQ ID NO: 164243 - RNA, 19 nt, Homo sapiens
ucagauguguacaguauuu

SEQ ID NO: 164244 - RNA, 19 nt, Homo sapiens
guacagagaggaccuagaa

SEQ ID NO: 164245 - RNA, 19 nt, Homo sapiens
gugaagauauugccaugaa

SEQ ID NO: 164246 - RNA, 19 nt, Homo sapiens
guauaucuaugcucugaaa

SEQ ID NO: 164247 - RNA, 19 nt, Homo sapiens
gaagacugcuggagaagag

SEQ ID NO: 164248 - RNA, 19 nt, Homo sapiens
gcagaaugcacacguguuu

SEQ ID NO: 164249 - RNA, 19 nt, Homo sapiens
gaggcugucugugucauua

SEQ ID NO: 164250 - RNA, 19 nt, Homo sapiens
cgaaucaccuguuguucaa

SEQ ID NO: 164251 - RNA, 19 nt, Homo sapiens
ccaccuuucucccuugaua

SEQ ID NO: 164252 - RNA, 19 nt, Homo sapiens
ucuguuugcuuccugauua

SEQ ID NO: 164253 - RNA, 19 nt, Homo sapiens
gagcugacccuguccugua

SEQ ID NO: 164254 - RNA, 19 nt, Homo sapiens
aacaguugcugguauauuu

SEQ ID NO: 164255 - RNA, 19 nt, Homo sapiens
caaccucuguucuuguauu

SEQ ID NO: 164256 - RNA, 19 nt, Homo sapiens
acaagaaccuagaaugaau

SEQ ID NO: 164257 - RNA, 19 nt, Homo sapiens
ggacagagggagagaacaa

SEQ ID NO: 164258 - RNA, 19 nt, Homo sapiens
ugucagauguguacaguau

SEQ ID NO: 164259 - RNA, 19 nt, Homo sapiens
caccgaaucuacuauauca

SEQ ID NO: 164260 - RNA, 19 nt, Homo sapiens
aagaacagaugacucagaa

SEQ ID NO: 164261 - RNA, 19 nt, Homo sapiens
ggagaagagaagcguguua

SEQ ID NO: 164262 - RNA, 19 nt, Homo sapiens
caacauuggcagcuuauga

SEQ ID NO: 164263 - RNA, 19 nt, Homo sapiens
uuaaagguauugucagaga

SEQ ID NO: 164264 - RNA, 19 nt, Homo sapiens
aagaaggucccaaaucaua

SEQ ID NO: 164265 - RNA, 19 nt, Homo sapiens
uagaugggcuuucacuaga

SEQ ID NO: 164266 - RNA, 19 nt, Homo sapiens
gaaaagaugucagaugugu

SEQ ID NO: 164267 - RNA, 19 nt, Homo sapiens
gaacagaugacucagaaac

SEQ ID NO: 164268 - RNA, 19 nt, Homo sapiens
caggaagacugcuggagaa

SEQ ID NO: 164269 - RNA, 19 nt, Homo sapiens
guggcaugcuccagauuua

SEQ ID NO: 164270 - RNA, 19 nt, Homo sapiens
cagagugcaucaacaaguu

SEQ ID NO: 164271 - RNA, 19 nt, Homo sapiens
ugaauaaguggaaguauga

SEQ ID NO: 164272 - RNA, 19 nt, Homo sapiens
guacgaaucaccuguuguu

SEQ ID NO: 164273 - RNA, 19 nt, Homo sapiens
ccaagcaccucgagcuaug

SEQ ID NO: 164274 - RNA, 19 nt, Homo sapiens
caagaaccuagaaugaaua

SEQ ID NO: 164275 - RNA, 19 nt, Homo sapiens
gaaaagcaguuaucaaggu

SEQ ID NO: 164276 - RNA, 19 nt, Homo sapiens
gauuagauccagucaaugu

SEQ ID NO: 164277 - RNA, 19 nt, Homo sapiens
aaacaccaauuccugauag

SEQ ID NO: 164278 - RNA, 19 nt, Homo sapiens
gaagcguguuagcccauuu

SEQ ID NO: 164279 - RNA, 19 nt, Homo sapiens
guaaccguuucuucccuua

SEQ ID NO: 164280 - RNA, 19 nt, Homo sapiens
gaucucaguugcagaaugc

SEQ ID NO: 164281 - RNA, 19 nt, Homo sapiens
ucauuaugcugaccucuga

SEQ ID NO: 164282 - RNA, 19 nt, Homo sapiens
ccaaagacagauugaagaa

SEQ ID NO: 164283 - RNA, 19 nt, Homo sapiens
gaacacacgccaggaggaa

SEQ ID NO: 164284 - RNA, 19 nt, Homo sapiens
caugagcuauuccucuuug

SEQ ID NO: 164285 - RNA, 19 nt, Homo sapiens
gcacccaccuaacccacuu

SEQ ID NO: 164286 - RNA, 19 nt, Homo sapiens
cgaaugaaguguccauggu

SEQ ID NO: 164287 - RNA, 19 nt, Homo sapiens
cuacuugucgucuggaaua

SEQ ID NO: 164288 - RNA, 19 nt, Homo sapiens
cugauuagauccagucaau

SEQ ID NO: 164289 - RNA, 19 nt, Homo sapiens
ggaaccaaacccagaauuc

SEQ ID NO: 164290 - RNA, 19 nt, Homo sapiens
guacuuccagucaauuaaa

SEQ ID NO: 164291 - RNA, 19 nt, Homo sapiens
ccaaggggaugccaaaauu

SEQ ID NO: 164292 - RNA, 19 nt, Homo sapiens
gaaccuagaaugaauaucc

SEQ ID NO: 164293 - RNA, 19 nt, Homo sapiens
gguagaugcucauaugaac

SEQ ID NO: 164294 - RNA, 19 nt, Homo sapiens
cuauacaacugcuuugcaa

SEQ ID NO: 164295 - RNA, 19 nt, Homo sapiens
uaaagguauugucagagaa

SEQ ID NO: 164296 - RNA, 19 nt, Homo sapiens
ccaggaggaaugucugaua

SEQ ID NO: 164297 - RNA, 19 nt, Homo sapiens
uaaacaccaauuccugaua

SEQ ID NO: 164298 - RNA, 19 nt, Homo sapiens
ucaacaaguuugcuucagu

SEQ ID NO: 164299 - RNA, 19 nt, Homo sapiens
cagcauuccugucuauagu

SEQ ID NO: 164300 - RNA, 19 nt, Homo sapiens
aacguuaaaugcugcuaua

SEQ ID NO: 164301 - RNA, 19 nt, Homo sapiens
gguucuggcuaacguuaaa

SEQ ID NO: 164302 - RNA, 19 nt, Homo sapiens
gagguucuggcuaacguua

SEQ ID NO: 164303 - RNA, 19 nt, Homo sapiens
gagcuauuccucuuugguu

SEQ ID NO: 164304 - RNA, 19 nt, Homo sapiens
ggucagagugcaucaacaa

SEQ ID NO: 164305 - RNA, 19 nt, Homo sapiens
acauggagagucaguguua

SEQ ID NO: 164306 - RNA, 19 nt, Homo sapiens
ugcaaccucuguucuugua

SEQ ID NO: 164307 - RNA, 19 nt, Homo sapiens
ggccauugaugaugauauc

SEQ ID NO: 164308 - RNA, 19 nt, Homo sapiens
ucgaugugcuuaaccagaa

SEQ ID NO: 164309 - RNA, 19 nt, Homo sapiens
guguauaucuaugcucuga

SEQ ID NO: 164310 - RNA, 19 nt, Homo sapiens
ggaucucaguugcagaaug

SEQ ID NO: 164311 - RNA, 19 nt, Homo sapiens
gauccugucaguuccauga

SEQ ID NO: 164312 - RNA, 19 nt, Homo sapiens
caaaauccggguuccauua

SEQ ID NO: 164313 - RNA, 19 nt, Homo sapiens
uagaagcccuccaggucaa

SEQ ID NO: 164314 - RNA, 19 nt, Homo sapiens
gcaauacuuccuccuguca

SEQ ID NO: 164315 - RNA, 19 nt, Homo sapiens
ugacuggaauguagagaag

SEQ ID NO: 164316 - RNA, 19 nt, Homo sapiens
gaugucagauguguacagu

SEQ ID NO: 164317 - RNA, 19 nt, Homo sapiens
uaaaugcaccaaccucuca

SEQ ID NO: 164318 - RNA, 19 nt, Homo sapiens
ucaguuccauguaacaauc

SEQ ID NO: 164319 - RNA, 19 nt, Homo sapiens
ccaagcaccgaaucuacua

SEQ ID NO: 164320 - RNA, 19 nt, Homo sapiens
caagaacaagaaccuagaa

SEQ ID NO: 164321 - RNA, 19 nt, Homo sapiens
cuaacccacuuucucaaga

SEQ ID NO: 164322 - RNA, 19 nt, Homo sapiens
gaagauauugccaugaacu

SEQ ID NO: 164323 - RNA, 19 nt, Homo sapiens
accaugagaugaauaagug

SEQ ID NO: 164324 - RNA, 19 nt, Homo sapiens
uuucuucccuuaugaugaa

SEQ ID NO: 164325 - RNA, 19 nt, Homo sapiens
gaaacuucacggacaggaa

SEQ ID NO: 164326 - RNA, 19 nt, Homo sapiens
ggcaugagccggugaccaa

SEQ ID NO: 164327 - RNA, 19 nt, Homo sapiens
gaagaggcugucuguguca

SEQ ID NO: 164328 - RNA, 19 nt, Homo sapiens
aagcuguucuggccauuga

SEQ ID NO: 164329 - RNA, 19 nt, Homo sapiens
gaaccaaacccagaauucg

SEQ ID NO: 164330 - RNA, 19 nt, Homo sapiens
gaaggcaacuacccaaaga

SEQ ID NO: 164331 - RNA, 19 nt, Homo sapiens
gcugaaagcugggaagaga

SEQ ID NO: 164332 - RNA, 19 nt, Homo sapiens
ggaaaaggcuggcuugguu

SEQ ID NO: 164333 - RNA, 19 nt, Homo sapiens
gagcuggaauuaucacuuc

SEQ ID NO: 164334 - RNA, 19 nt, Homo sapiens
gaagagaaaucugaagaac

SEQ ID NO: 164335 - RNA, 19 nt, Homo sapiens
gcgauggccuuaagguauu

SEQ ID NO: 164336 - RNA, 19 nt, Homo sapiens
gcagacagcccuccucuca

SEQ ID NO: 164337 - RNA, 19 nt, Homo sapiens
gaaagggaugggagugaua

SEQ ID NO: 164338 - RNA, 19 nt, Homo sapiens
gaucgcuucuacccauaua

SEQ ID NO: 164339 - RNA, 19 nt, Homo sapiens
ggaagagaaaucugaagaa

SEQ ID NO: 164340 - RNA, 19 nt, Homo sapiens
gaccaaggcagccaucgua

SEQ ID NO: 164341 - RNA, 19 nt, Homo sapiens
gaugagaggcucccacuuc

SEQ ID NO: 164342 - RNA, 19 nt, Homo sapiens
caacugggaaucuugcuuu

SEQ ID NO: 164343 - RNA, 19 nt, Homo sapiens
ggaaagggaugggagugau

SEQ ID NO: 164344 - RNA, 19 nt, Homo sapiens
ugaggacccuggcagauga

SEQ ID NO: 164345 - RNA, 19 nt, Homo sapiens
agagaaaucugaagaacag

SEQ ID NO: 164346 - RNA, 19 nt, Homo sapiens
ccauauagcaccaucagaa

SEQ ID NO: 164347 - RNA, 19 nt, Homo sapiens
gcagcagucuuuccacaag

SEQ ID NO: 164348 - RNA, 19 nt, Homo sapiens
gaugggcacaggaagguua

SEQ ID NO: 164349 - RNA, 19 nt, Homo sapiens
gauccuggcuuccauugag

SEQ ID NO: 164350 - RNA, 19 nt, Homo sapiens
gaugcagggucuaauuuua

SEQ ID NO: 164351 - RNA, 19 nt, Homo sapiens
gcaggugugccgcaaauau

SEQ ID NO: 164352 - RNA, 19 nt, Homo sapiens
caacgaauucuccaugguu

SEQ ID NO: 164353 - RNA, 19 nt, Homo sapiens
cagcagacccaguuucuau

SEQ ID NO: 164354 - RNA, 19 nt, Homo sapiens
caaugccucugcaauggaa

SEQ ID NO: 164355 - RNA, 19 nt, Homo sapiens
gguaaaaccuaucauguca

SEQ ID NO: 164356 - RNA, 19 nt, Homo sapiens
gcucaaugccucugcaaug

SEQ ID NO: 164357 - RNA, 19 nt, Homo sapiens
gggaagagaaaucugaaga

SEQ ID NO: 164358 - RNA, 19 nt, Homo sapiens
agacagcccuccucucagu

SEQ ID NO: 164359 - RNA, 19 nt, Homo sapiens
cuucccaucuguacaauga

SEQ ID NO: 164360 - RNA, 19 nt, Homo sapiens
gggaugcagggucuaauuu

SEQ ID NO: 164361 - RNA, 19 nt, Homo sapiens
gcccagaucuugguucucu

SEQ ID NO: 164362 - RNA, 19 nt, Homo sapiens
uggacguccugaugaauuu

SEQ ID NO: 164363 - RNA, 19 nt, Homo sapiens
cccagaagaugccguuuca

SEQ ID NO: 164364 - RNA, 19 nt, Homo sapiens
ccaccuggagcuggaauua

SEQ ID NO: 164365 - RNA, 19 nt, Homo sapiens
gccuuaagguauucgugua

SEQ ID NO: 164366 - RNA, 19 nt, Homo sapiens
aaauaaagcgcguguccuu

SEQ ID NO: 164367 - RNA, 19 nt, Homo sapiens
cagcaagaagggacuguuu

SEQ ID NO: 164368 - RNA, 19 nt, Homo sapiens
ugaaagcugggaagagaaa

SEQ ID NO: 164369 - RNA, 19 nt, Homo sapiens
gagguggacuuugccuuuc

SEQ ID NO: 164370 - RNA, 19 nt, Homo sapiens
ucuaugggaugccuacuuc

SEQ ID NO: 164371 - RNA, 19 nt, Homo sapiens
gcucucgcuucuacacauu

SEQ ID NO: 164372 - RNA, 19 nt, Homo sapiens
ggaaggcaacuacccaaag

SEQ ID NO: 164373 - RNA, 19 nt, Homo sapiens
gcagaguggauaaggauca

SEQ ID NO: 164374 - RNA, 19 nt, Homo sapiens
gagcugguauaggugagaa

SEQ ID NO: 164375 - RNA, 19 nt, Homo sapiens
ugagguggacuuugccuuu

SEQ ID NO: 164376 - RNA, 19 nt, Homo sapiens
ggcgauggccuuaagguau

SEQ ID NO: 164377 - RNA, 19 nt, Homo sapiens
gauggauggcagacauuaa

SEQ ID NO: 164378 - RNA, 19 nt, Homo sapiens
ugagaggaccaacgaauuc

SEQ ID NO: 164379 - RNA, 19 nt, Homo sapiens
gagaaggucauccauacca

SEQ ID NO: 164380 - RNA, 19 nt, Homo sapiens
gucccgagcugguauaggu

SEQ ID NO: 164381 - RNA, 19 nt, Homo sapiens
gcuaacuucugcucgucuu

SEQ ID NO: 164382 - RNA, 19 nt, Homo sapiens
gcucuugggacaccgguaa

SEQ ID NO: 164383 - RNA, 19 nt, Homo sapiens
ugagggcucucgcuucuac

SEQ ID NO: 164384 - RNA, 19 nt, Homo sapiens
gggcgauggccuuaaggua

SEQ ID NO: 164385 - RNA, 19 nt, Homo sapiens
gaauuaucacuuccgaaau

SEQ ID NO: 164386 - RNA, 19 nt, Homo sapiens
gaagggacuguuucuaggu

SEQ ID NO: 164387 - RNA, 19 nt, Homo sapiens
gcugggaagagaaaucuga

SEQ ID NO: 164388 - RNA, 19 nt, Homo sapiens
ggacaccgguaaaaccuau

SEQ ID NO: 164389 - RNA, 19 nt, Homo sapiens
cgacugcaucaaccagaua

SEQ ID NO: 164390 - RNA, 19 nt, Homo sapiens
gcacaggaagguuagugau

SEQ ID NO: 164391 - RNA, 19 nt, Homo sapiens
ggagagugcagcucaaugc

SEQ ID NO: 164392 - RNA, 19 nt, Homo sapiens
aaagacgccuggguuguca

SEQ ID NO: 164393 - RNA, 19 nt, Homo sapiens
acagccgccuucuaccaua

SEQ ID NO: 164394 - RNA, 19 nt, Homo sapiens
gugaucgcuucuacccaua

SEQ ID NO: 164395 - RNA, 19 nt, Homo sapiens
ggacacggcccugcauucu

SEQ ID NO: 164396 - RNA, 19 nt, Homo sapiens
cuaccaaggccgaccacua

SEQ ID NO: 164397 - RNA, 19 nt, Homo sapiens
gaaagcgggaugggaacaa

SEQ ID NO: 164398 - RNA, 19 nt, Homo sapiens
ugggaaucuugcuuugaua

SEQ ID NO: 164399 - RNA, 19 nt, Homo sapiens
caggugugccgcaaauauu

SEQ ID NO: 164400 - RNA, 19 nt, Homo sapiens
gaugcccgcagcagucuuu

SEQ ID NO: 164401 - RNA, 19 nt, Homo sapiens
auaccacucuggagguuau

SEQ ID NO: 164402 - RNA, 19 nt, Homo sapiens
cugggaaucuugcuuugau

SEQ ID NO: 164403 - RNA, 19 nt, Homo sapiens
caaagacgccuggguuguc

SEQ ID NO: 164404 - RNA, 19 nt, Homo sapiens
gggaaggcaacuacccaaa

SEQ ID NO: 164405 - RNA, 19 nt, Homo sapiens
guguggacguccugaugaa

SEQ ID NO: 164406 - RNA, 19 nt, Homo sapiens
gcugagaggaccaacgaau

SEQ ID NO: 164407 - RNA, 19 nt, Homo sapiens
cucacuaucugaccuuaga

SEQ ID NO: 164408 - RNA, 19 nt, Homo sapiens
ggagcuggaauuaucacuu

SEQ ID NO: 164409 - RNA, 19 nt, Homo sapiens
ccuggccucugcacuguga

SEQ ID NO: 164410 - RNA, 19 nt, Homo sapiens
gagcggagagacagaacug

SEQ ID NO: 164411 - RNA, 19 nt, Homo sapiens
uggacccggugcuguuuaa

SEQ ID NO: 164412 - RNA, 19 nt, Homo sapiens
cuaucaaggugcccuaugg

SEQ ID NO: 164413 - RNA, 19 nt, Homo sapiens
guggacguccugaugaauu

SEQ ID NO: 164414 - RNA, 19 nt, Homo sapiens
ccaacgaauucuccauggu

SEQ ID NO: 164415 - RNA, 19 nt, Homo sapiens
gguuagugaucgcuucuac

SEQ ID NO: 164416 - RNA, 19 nt, Homo sapiens
ccauaccacucuggagguu

SEQ ID NO: 164417 - RNA, 19 nt, Homo sapiens
gcggcagaguggauaagga

SEQ ID NO: 164418 - RNA, 19 nt, Homo sapiens
gacucacuaucugaccuua

SEQ ID NO: 164419 - RNA, 19 nt, Homo sapiens
uaaagcgcguguccuugca

SEQ ID NO: 164420 - RNA, 19 nt, Homo sapiens
gaacagccccaucucuuuc

SEQ ID NO: 164421 - RNA, 19 nt, Homo sapiens
uaccaaggccgaccacuag

SEQ ID NO: 164422 - RNA, 19 nt, Homo sapiens
ugacagcacaggacuagca

SEQ ID NO: 164423 - RNA, 19 nt, Homo sapiens
ccuccuggcuccugcuugu

SEQ ID NO: 164424 - RNA, 19 nt, Homo sapiens
ugacgccgaugauccacau

SEQ ID NO: 164425 - RNA, 19 nt, Homo sapiens
gcagacccaguuucuaugg

SEQ ID NO: 164426 - RNA, 19 nt, Homo sapiens
caggagacgcugcccaaug

SEQ ID NO: 164427 - RNA, 19 nt, Homo sapiens
cugccuggcuggugacuca

SEQ ID NO: 164428 - RNA, 19 nt, Homo sapiens
gcagaggggugcggguaaa

SEQ ID NO: 164429 - RNA, 19 nt, Homo sapiens
auagauggauggcagacau

SEQ ID NO: 164430 - RNA, 19 nt, Homo sapiens
gaacagaucucuuauugaa

SEQ ID NO: 164431 - RNA, 19 nt, Homo sapiens
gcagaggucuuauuguaua

SEQ ID NO: 164432 - RNA, 19 nt, Homo sapiens
caacagaacagaucucuua

SEQ ID NO: 164433 - RNA, 19 nt, Homo sapiens
uaacuaagcugcagggaaa

SEQ ID NO: 164434 - RNA, 19 nt, Homo sapiens
gaaggcaccagaugaauua

SEQ ID NO: 164435 - RNA, 19 nt, Homo sapiens
caucagguaucuacaguua

SEQ ID NO: 164436 - RNA, 19 nt, Homo sapiens
cagaacagaucucuuauug

SEQ ID NO: 164437 - RNA, 19 nt, Homo sapiens
gaaagcacgucucuacuuc

SEQ ID NO: 164438 - RNA, 19 nt, Homo sapiens
gaguauaugugucuuaaug

SEQ ID NO: 164439 - RNA, 19 nt, Homo sapiens
gcaaagcugugagaauauu

SEQ ID NO: 164440 - RNA, 19 nt, Homo sapiens
ggaaaccaaugcaguguug

SEQ ID NO: 164441 - RNA, 19 nt, Homo sapiens
gcaaggaauucuuaacuag

SEQ ID NO: 164442 - RNA, 19 nt, Homo sapiens
guaaagccauguaagaaga

SEQ ID NO: 164443 - RNA, 19 nt, Homo sapiens
gcaaggaguaaauguguua

SEQ ID NO: 164444 - RNA, 19 nt, Homo sapiens
ccagaagucucuacaauag

SEQ ID NO: 164445 - RNA, 19 nt, Homo sapiens
ugaauuagcgucuguguuu

SEQ ID NO: 164446 - RNA, 19 nt, Homo sapiens
ccaaggaacuauucauaau

SEQ ID NO: 164447 - RNA, 19 nt, Homo sapiens
gcacgucucuacuucauca

SEQ ID NO: 164448 - RNA, 19 nt, Homo sapiens
ccaguuaggucuucuuaug

SEQ ID NO: 164449 - RNA, 19 nt, Homo sapiens
gugcagugcuucuaggaua

SEQ ID NO: 164450 - RNA, 19 nt, Homo sapiens
ggucauccucguauuauua

SEQ ID NO: 164451 - RNA, 19 nt, Homo sapiens
cugcaucaauucauucuua

SEQ ID NO: 164452 - RNA, 19 nt, Homo sapiens
ugaaaugccucuuuagcaa

SEQ ID NO: 164453 - RNA, 19 nt, Homo sapiens
uugcaaagcugugagaaua

SEQ ID NO: 164454 - RNA, 19 nt, Homo sapiens
ggcaaggaauucuuaacua

SEQ ID NO: 164455 - RNA, 19 nt, Homo sapiens
cugcagaggucuuauugua

SEQ ID NO: 164456 - RNA, 19 nt, Homo sapiens
gaugguagaugaugacaca

SEQ ID NO: 164457 - RNA, 19 nt, Homo sapiens
guagagcacugguuaucuu

SEQ ID NO: 164458 - RNA, 19 nt, Homo sapiens
gaaaucgacuccaggucuu

SEQ ID NO: 164459 - RNA, 19 nt, Homo sapiens
gaagaacgucuaguuguuu

SEQ ID NO: 164460 - RNA, 19 nt, Homo sapiens
ugaagaacgucuaguuguu

SEQ ID NO: 164461 - RNA, 19 nt, Homo sapiens
ggaacaauauuggagagaa

SEQ ID NO: 164462 - RNA, 19 nt, Homo sapiens
aaucugaccuugagaaugu

SEQ ID NO: 164463 - RNA, 19 nt, Homo sapiens
gcaaacaggaugagaaauc

SEQ ID NO: 164464 - RNA, 19 nt, Homo sapiens
gaacaauauuggagagaag

SEQ ID NO: 164465 - RNA, 19 nt, Homo sapiens
ggacuccuuuacucucaua

SEQ ID NO: 164466 - RNA, 19 nt, Homo sapiens
uggcaagacuucagggaua

SEQ ID NO: 164467 - RNA, 19 nt, Homo sapiens
caagugagccugcuucugu

SEQ ID NO: 164468 - RNA, 19 nt, Homo sapiens
uuacaaagccaaacacuug

SEQ ID NO: 164469 - RNA, 19 nt, Homo sapiens
gaugcacgcuacuugguuu

SEQ ID NO: 164470 - RNA, 19 nt, Homo sapiens
uaccaaaucugcacaaagu

SEQ ID NO: 164471 - RNA, 19 nt, Homo sapiens
ccucuuccuucuuauauaa

SEQ ID NO: 164472 - RNA, 19 nt, Homo sapiens
uaacagaggaauucuauag

SEQ ID NO: 164473 - RNA, 19 nt, Homo sapiens
gaaaugccucuuuagcaaa

SEQ ID NO: 164474 - RNA, 19 nt, Homo sapiens
gugaugauauugccaugaa

SEQ ID NO: 164475 - RNA, 19 nt, Homo sapiens
gucaauuacugaagcuaua

SEQ ID NO: 164476 - RNA, 19 nt, Homo sapiens
guuguuugcuugauauuug

SEQ ID NO: 164477 - RNA, 19 nt, Homo sapiens
ucagguaucuacaguuaug

SEQ ID NO: 164478 - RNA, 19 nt, Homo sapiens
gcuaauguuccaauaauga

SEQ ID NO: 164479 - RNA, 19 nt, Homo sapiens
aaccugaaaugccucuuua

SEQ ID NO: 164480 - RNA, 19 nt, Homo sapiens
gagagaaggcaccagauga

SEQ ID NO: 164481 - RNA, 19 nt, Homo sapiens
cuucuccucuuccuucuua

SEQ ID NO: 164482 - RNA, 19 nt, Homo sapiens
cuguaaacauggacaauuu

SEQ ID NO: 164483 - RNA, 19 nt, Homo sapiens
uaugauagcaugcccuuaa

SEQ ID NO: 164484 - RNA, 19 nt, Homo sapiens
gauuggagccucauucuuc

SEQ ID NO: 164485 - RNA, 19 nt, Homo sapiens
cuacugcacucgagaaaca

SEQ ID NO: 164486 - RNA, 19 nt, Homo sapiens
aauaagaacccagucauaa

SEQ ID NO: 164487 - RNA, 19 nt, Homo sapiens
gaacauuuacugcauggau

SEQ ID NO: 164488 - RNA, 19 nt, Homo sapiens
gcauuuaguuccgcauaug

SEQ ID NO: 164489 - RNA, 19 nt, Homo sapiens
uuaacuaggccucuguuua

SEQ ID NO: 164490 - RNA, 19 nt, Homo sapiens
uagcaaagccugugguaug

SEQ ID NO: 164491 - RNA, 19 nt, Homo sapiens
ggagccucauucuucaaua

SEQ ID NO: 164492 - RNA, 19 nt, Homo sapiens
gaagacaagaugcucaugu

SEQ ID NO: 164493 - RNA, 19 nt, Homo sapiens
uaacuaggccucuguuuac

SEQ ID NO: 164494 - RNA, 19 nt, Homo sapiens
ccuacucucuguuauguga

SEQ ID NO: 164495 - RNA, 19 nt, Homo sapiens
acagaggaauucuauagga

SEQ ID NO: 164496 - RNA, 19 nt, Homo sapiens
ccaaacacuugcauucaca

SEQ ID NO: 164497 - RNA, 19 nt, Homo sapiens
cacuaaaggucaguuguuu

SEQ ID NO: 164498 - RNA, 19 nt, Homo sapiens
gaaaacugcuuggcauuug

SEQ ID NO: 164499 - RNA, 19 nt, Homo sapiens
gaugauauugccaugaauu

SEQ ID NO: 164500 - RNA, 19 nt, Homo sapiens
gcagcaauuuccugaucaa

SEQ ID NO: 164501 - RNA, 19 nt, Homo sapiens
caaacuuccugggagagua

SEQ ID NO: 164502 - RNA, 19 nt, Homo sapiens
cgagaaacaucacagaaaa

SEQ ID NO: 164503 - RNA, 19 nt, Homo sapiens
cauuaugauuucccaguuu

SEQ ID NO: 164504 - RNA, 19 nt, Homo sapiens
aaacauggacaauuuggaa

SEQ ID NO: 164505 - RNA, 19 nt, Homo sapiens
cauaacagaggaauucuau

SEQ ID NO: 164506 - RNA, 19 nt, Homo sapiens
aaauaagaacccagucaua

SEQ ID NO: 164507 - RNA, 19 nt, Homo sapiens
gauagaugcacgcuacuug

SEQ ID NO: 164508 - RNA, 19 nt, Homo sapiens
acacuugcauucacaacuu

SEQ ID NO: 164509 - RNA, 19 nt, Homo sapiens
gagccucauucuucaauag

SEQ ID NO: 164510 - RNA, 19 nt, Homo sapiens
ggagagaaggcaccagaug

SEQ ID NO: 164511 - RNA, 19 nt, Homo sapiens
ugaggucuuugugcauuua

SEQ ID NO: 164512 - RNA, 19 nt, Homo sapiens
auaggagucugcaucaauu

SEQ ID NO: 164513 - RNA, 19 nt, Homo sapiens
aguaagaacuggcagaagu

SEQ ID NO: 164514 - RNA, 19 nt, Homo sapiens
cagcaaacaggaugagaaa

SEQ ID NO: 164515 - RNA, 19 nt, Homo sapiens
ucaaacaacagacagcaaa

SEQ ID NO: 164516 - RNA, 19 nt, Homo sapiens
aagacaagaugcucauguu

SEQ ID NO: 164517 - RNA, 19 nt, Homo sapiens
gguggucauccucguauua

SEQ ID NO: 164518 - RNA, 19 nt, Homo sapiens
gcacgcuacuugguuuaga

SEQ ID NO: 164519 - RNA, 19 nt, Homo sapiens
ccaaaucugcacaaaguga

SEQ ID NO: 164520 - RNA, 19 nt, Homo sapiens
acagaucucuuauugaaac

SEQ ID NO: 164521 - RNA, 19 nt, Homo sapiens
uggcuaauguuccaauaau

SEQ ID NO: 164522 - RNA, 19 nt, Homo sapiens
gagucugcaucaauucauu

SEQ ID NO: 164523 - RNA, 19 nt, Homo sapiens
ucuaguuguuugcuugaua

SEQ ID NO: 164524 - RNA, 19 nt, Homo sapiens
ugugaagccuguaaacaug

SEQ ID NO: 164525 - RNA, 19 nt, Homo sapiens
guauaugugucuuaaugca

SEQ ID NO: 164526 - RNA, 19 nt, Homo sapiens
caaagcugugagaauauua

SEQ ID NO: 164527 - RNA, 19 nt, Homo sapiens
uaagaacccagucauaaca

SEQ ID NO: 164528 - RNA, 19 nt, Homo sapiens
caaggaacuauucauaaug

SEQ ID NO: 164529 - RNA, 19 nt, Homo sapiens
acugguagcuggugcuuug

SEQ ID NO: 164530 - RNA, 19 nt, Homo sapiens
ggaaauaucucuucaccuu

SEQ ID NO: 164531 - RNA, 19 nt, Homo sapiens
gaagauggcucccaagguu

SEQ ID NO: 164532 - RNA, 19 nt, Homo sapiens
gcacacacuugcauacaua

SEQ ID NO: 164533 - RNA, 19 nt, Homo sapiens
ggaaugaaauugagacaga

SEQ ID NO: 164534 - RNA, 19 nt, Homo sapiens
gcaagaauguggcaccuuu

SEQ ID NO: 164535 - RNA, 19 nt, Homo sapiens
ccagauaccuccgcaauuu

SEQ ID NO: 164536 - RNA, 19 nt, Homo sapiens
ggaauacguucuccucuga

SEQ ID NO: 164537 - RNA, 19 nt, Homo sapiens
ggaaaccgcugccuuuauc

SEQ ID NO: 164538 - RNA, 19 nt, Homo sapiens
cuacacaacugcuuugauu

SEQ ID NO: 164539 - RNA, 19 nt, Homo sapiens
gaagugcucuuucuuggau

SEQ ID NO: 164540 - RNA, 19 nt, Homo sapiens
caagagcuauggcauuuga

SEQ ID NO: 164541 - RNA, 19 nt, Homo sapiens
gaacucacauacugacuuc

SEQ ID NO: 164542 - RNA, 19 nt, Homo sapiens
gcaaaggcaucauaagaag

SEQ ID NO: 164543 - RNA, 19 nt, Homo sapiens
gacaggugcugccuucuuu

SEQ ID NO: 164544 - RNA, 19 nt, Homo sapiens
gacccucgcuugguuauuu

SEQ ID NO: 164545 - RNA, 19 nt, Homo sapiens
ucagguaccuccucccuuu

SEQ ID NO: 164546 - RNA, 19 nt, Homo sapiens
guucuaaccuauuacugua

SEQ ID NO: 164547 - RNA, 19 nt, Homo sapiens
ugaaacacauggccugauu

SEQ ID NO: 164548 - RNA, 19 nt, Homo sapiens
gugcugagguguaaugcua

SEQ ID NO: 164549 - RNA, 19 nt, Homo sapiens
gcugugauuugcuguguaa

SEQ ID NO: 164550 - RNA, 19 nt, Homo sapiens
gggaggaagugcuuaugaa

SEQ ID NO: 164551 - RNA, 19 nt, Homo sapiens
gagcccaacuucauggaaa

SEQ ID NO: 164552 - RNA, 19 nt, Homo sapiens
ccagauggcucuuucuauc

SEQ ID NO: 164553 - RNA, 19 nt, Homo sapiens
caaagagugagaaagaaua

SEQ ID NO: 164554 - RNA, 19 nt, Homo sapiens
ccauuucucucuuguuuga

SEQ ID NO: 164555 - RNA, 19 nt, Homo sapiens
ggcacugacugauagcuua

SEQ ID NO: 164556 - RNA, 19 nt, Homo sapiens
guacagaccuggcuuugac

SEQ ID NO: 164557 - RNA, 19 nt, Homo sapiens
gaucgaagccuguaagaag

SEQ ID NO: 164558 - RNA, 19 nt, Homo sapiens
gaaugucacugguggaucu

SEQ ID NO: 164559 - RNA, 19 nt, Homo sapiens
gagaagaacaguuugaaca

SEQ ID NO: 164560 - RNA, 19 nt, Homo sapiens
cauaagaagcuggcauuua

SEQ ID NO: 164561 - RNA, 19 nt, Homo sapiens
gaaaggaacacuggcuuga

SEQ ID NO: 164562 - RNA, 19 nt, Homo sapiens
gauaauuccuuggugaaau

SEQ ID NO: 164563 - RNA, 19 nt, Homo sapiens
guaagaagagcauugagaa

SEQ ID NO: 164564 - RNA, 19 nt, Homo sapiens
acacauggccugauuguug

SEQ ID NO: 164565 - RNA, 19 nt, Homo sapiens
caacccgaguuaccacuuu

SEQ ID NO: 164566 - RNA, 19 nt, Homo sapiens
gggacaugguggaugaaua

SEQ ID NO: 164567 - RNA, 19 nt, Homo sapiens
ucaucaaucugucacguaa

SEQ ID NO: 164568 - RNA, 19 nt, Homo sapiens
aacaagagcuauggcauuu

SEQ ID NO: 164569 - RNA, 19 nt, Homo sapiens
cacauucucuucccaguga

SEQ ID NO: 164570 - RNA, 19 nt, Homo sapiens
augccuaccuguauucuua

SEQ ID NO: 164571 - RNA, 19 nt, Homo sapiens
gguaugugcuagaacaaug

SEQ ID NO: 164572 - RNA, 19 nt, Homo sapiens
gcaaagagugagaaagaau

SEQ ID NO: 164573 - RNA, 19 nt, Homo sapiens
gaagaacaguuugaacaac

SEQ ID NO: 164574 - RNA, 19 nt, Homo sapiens
ucagaagccucuccgauag

SEQ ID NO: 164575 - RNA, 19 nt, Homo sapiens
gcagcaagguggccacagu

SEQ ID NO: 164576 - RNA, 19 nt, Homo sapiens
gcuguggucugaagugguu

SEQ ID NO: 164577 - RNA, 19 nt, Homo sapiens
gaaggguccugaaacacau

SEQ ID NO: 164578 - RNA, 19 nt, Homo sapiens
ggcaaaggcaucauaagaa

SEQ ID NO: 164579 - RNA, 19 nt, Homo sapiens
ccacguggguccucuucaa

SEQ ID NO: 164580 - RNA, 19 nt, Homo sapiens
ggaaggguccugaaacaca

SEQ ID NO: 164581 - RNA, 19 nt, Homo sapiens
gucacuggcuuauccuuaa

SEQ ID NO: 164582 - RNA, 19 nt, Homo sapiens
gccaugaacuuccuugucu

SEQ ID NO: 164583 - RNA, 19 nt, Homo sapiens
gugaggacauugccaugaa

SEQ ID NO: 164584 - RNA, 19 nt, Homo sapiens
cuuaaaaucugcuggaaua

SEQ ID NO: 164585 - RNA, 19 nt, Homo sapiens
ggucaacagccagaacuua

SEQ ID NO: 164586 - RNA, 19 nt, Homo sapiens
caacugcuuugauuauucu

SEQ ID NO: 164587 - RNA, 19 nt, Homo sapiens
cacacuaacucuucuggaa

SEQ ID NO: 164588 - RNA, 19 nt, Homo sapiens
guauaacugugaauagaca

SEQ ID NO: 164589 - RNA, 19 nt, Homo sapiens
cuaccugacuccugacuug

SEQ ID NO: 164590 - RNA, 19 nt, Homo sapiens
ggacuguguuuccaaaggu

SEQ ID NO: 164591 - RNA, 19 nt, Homo sapiens
ccaggacuguguuuccaaa

SEQ ID NO: 164592 - RNA, 19 nt, Homo sapiens
gugcuucuauuucuuggaa

SEQ ID NO: 164593 - RNA, 19 nt, Homo sapiens
gcauucacaacccgaguua

SEQ ID NO: 164594 - RNA, 19 nt, Homo sapiens
caucaacugugaggacauu

SEQ ID NO: 164595 - RNA, 19 nt, Homo sapiens
augaauacaucaacuguga

SEQ ID NO: 164596 - RNA, 19 nt, Homo sapiens
ccagggccuuuccaucuuu

SEQ ID NO: 164597 - RNA, 19 nt, Homo sapiens
ggacaugguggaugaauac

SEQ ID NO: 164598 - RNA, 19 nt, Homo sapiens
gcucaucgcccacuauuac

SEQ ID NO: 164599 - RNA, 19 nt, Homo sapiens
gagagaaugaggaagcaaa

SEQ ID NO: 164600 - RNA, 19 nt, Homo sapiens
ucccauuucucucuuguuu

SEQ ID NO: 164601 - RNA, 19 nt, Homo sapiens
gggaggaccgcuuggaauu

SEQ ID NO: 164602 - RNA, 19 nt, Homo sapiens
acacaaccaugucaucauc

SEQ ID NO: 164603 - RNA, 19 nt, Homo sapiens
gaagcuggcauuuauuucu

SEQ ID NO: 164604 - RNA, 19 nt, Homo sapiens
aagcaaagagugagaaaga

SEQ ID NO: 164605 - RNA, 19 nt, Homo sapiens
ggacagcugguucgugguu

SEQ ID NO: 164606 - RNA, 19 nt, Homo sapiens
guggugauguugacuuaug

SEQ ID NO: 164607 - RNA, 19 nt, Homo sapiens
gcaaggcggcuggaacuga

SEQ ID NO: 164608 - RNA, 19 nt, Homo sapiens
aaacaagagcuauggcauu

SEQ ID NO: 164609 - RNA, 19 nt, Homo sapiens
uauuguggcugcuauuuca

SEQ ID NO: 164610 - RNA, 19 nt, Homo sapiens
gccauucaaggcuuauuua

SEQ ID NO: 164611 - RNA, 19 nt, Homo sapiens
ucgccaagcugaaucugaa

SEQ ID NO: 164612 - RNA, 19 nt, Homo sapiens
gauaaagauuaaggacaug

SEQ ID NO: 164613 - RNA, 19 nt, Homo sapiens
ggaagcaaagagugagaaa

SEQ ID NO: 164614 - RNA, 19 nt, Homo sapiens
uagacacuaugcauauuug

SEQ ID NO: 164615 - RNA, 19 nt, Homo sapiens
caggaggaguggaaggaaa

SEQ ID NO: 164616 - RNA, 19 nt, Homo sapiens
ggacauugccaugaacuuc

SEQ ID NO: 164617 - RNA, 19 nt, Homo sapiens
gugccaaagccucguguua

SEQ ID NO: 164618 - RNA, 19 nt, Homo sapiens
uuaaggacauguucuuugg

SEQ ID NO: 164619 - RNA, 19 nt, Homo sapiens
ccggaaggaugggaucuuu

SEQ ID NO: 164620 - RNA, 19 nt, Homo sapiens
cguggguccucuucaagua

SEQ ID NO: 164621 - RNA, 19 nt, Homo sapiens
cuaugacagugaccaguuu

SEQ ID NO: 164622 - RNA, 19 nt, Homo sapiens
acacaacugcuuugauuau

SEQ ID NO: 164623 - RNA, 19 nt, Homo sapiens
gaagaucgaagccuguaag

SEQ ID NO: 164624 - RNA, 19 nt, Homo sapiens
gggagucggugagugaaga

SEQ ID NO: 164625 - RNA, 19 nt, Homo sapiens
cagacgcccuuccucagaa

SEQ ID NO: 164626 - RNA, 19 nt, Homo sapiens
gaggcagugugguuauguu

SEQ ID NO: 164627 - RNA, 19 nt, Homo sapiens
gcaagccaguguccuucga

SEQ ID NO: 164628 - RNA, 19 nt, Homo sapiens
aagaagcuggcauuuauuu

SEQ ID NO: 164629 - RNA, 19 nt, Homo sapiens
ucacuggcuuauccuuaaa

SEQ ID NO: 164630 - RNA, 19 nt, Homo sapiens
gaaauuacccuuaggauga

SEQ ID NO: 164631 - RNA, 19 nt, Homo sapiens
gcgcaaagcuguuaccaaa

SEQ ID NO: 164632 - RNA, 19 nt, Homo sapiens
auaaacagcuucuccaaua

SEQ ID NO: 164633 - RNA, 19 nt, Homo sapiens
ggaaauaauucacucacaa

SEQ ID NO: 164634 - RNA, 19 nt, Homo sapiens
uaacagcgcucggcacuuu

SEQ ID NO: 164635 - RNA, 19 nt, Homo sapiens
gcaacaagcuacagccuau

SEQ ID NO: 164636 - RNA, 19 nt, Homo sapiens
cgaaguaguugaagagcua

SEQ ID NO: 164637 - RNA, 19 nt, Homo sapiens
uaacacagcaguuucuuaa

SEQ ID NO: 164638 - RNA, 19 nt, Homo sapiens
gcaaacgcuucaguuguua

SEQ ID NO: 164639 - RNA, 19 nt, Homo sapiens
ccacaaagaauauagauga

SEQ ID NO: 164640 - RNA, 19 nt, Homo sapiens
uauaggagaugguguagaa

SEQ ID NO: 164641 - RNA, 19 nt, Homo sapiens
gcaaacaguugacaauuuu

SEQ ID NO: 164642 - RNA, 19 nt, Homo sapiens
gaagguggauugucacagu

SEQ ID NO: 164643 - RNA, 19 nt, Homo sapiens
ggaugagucuucuuuaauc

SEQ ID NO: 164644 - RNA, 19 nt, Homo sapiens
caacauggcaaguacagua

SEQ ID NO: 164645 - RNA, 19 nt, Homo sapiens
gagaauagcugugguuugc

SEQ ID NO: 164646 - RNA, 19 nt, Homo sapiens
gaauaccaguggaggaauu

SEQ ID NO: 164647 - RNA, 19 nt, Homo sapiens
caacagagacugaaaugug

SEQ ID NO: 164648 - RNA, 19 nt, Homo sapiens
gaagaaaagugguguaugu

SEQ ID NO: 164649 - RNA, 19 nt, Homo sapiens
ggacaaacugugugaauau

SEQ ID NO: 164650 - RNA, 19 nt, Homo sapiens
caacacccauuaaagauuc

SEQ ID NO: 164651 - RNA, 19 nt, Homo sapiens
cgacgggucuuuaaacaau

SEQ ID NO: 164652 - RNA, 19 nt, Homo sapiens
gacaggaccuaagcacaua

SEQ ID NO: 164653 - RNA, 19 nt, Homo sapiens
ccaaugagcagcagugaaa

SEQ ID NO: 164654 - RNA, 19 nt, Homo sapiens
gggaugagauucugcuguu

SEQ ID NO: 164655 - RNA, 19 nt, Homo sapiens
gcacauugcauaguaguuu

SEQ ID NO: 164656 - RNA, 19 nt, Homo sapiens
gggcaggcaucaagacuga

SEQ ID NO: 164657 - RNA, 19 nt, Homo sapiens
ggaagacacacgaugcuaa

SEQ ID NO: 164658 - RNA, 19 nt, Homo sapiens
gcauggaugucaaguguca

SEQ ID NO: 164659 - RNA, 19 nt, Homo sapiens
gaucuaaccagcccgcaua

SEQ ID NO: 164660 - RNA, 19 nt, Homo sapiens
uaggaugagucuucuuuaa

SEQ ID NO: 164661 - RNA, 19 nt, Homo sapiens
guacaucacugagacaauc

SEQ ID NO: 164662 - RNA, 19 nt, Homo sapiens
aaagaaagcuguuuugaga

SEQ ID NO: 164663 - RNA, 19 nt, Homo sapiens
ccauauagaugauguuucu

SEQ ID NO: 164664 - RNA, 19 nt, Homo sapiens
ggacagacaggauuucuca

SEQ ID NO: 164665 - RNA, 19 nt, Homo sapiens
gagauucugcuguuucuuu

SEQ ID NO: 164666 - RNA, 19 nt, Homo sapiens
caugugcucagaauuauua

SEQ ID NO: 164667 - RNA, 19 nt, Homo sapiens
aaacagcuuuauugaggua

SEQ ID NO: 164668 - RNA, 19 nt, Homo sapiens
ccacgucuauuucaucaga

SEQ ID NO: 164669 - RNA, 19 nt, Homo sapiens
ccaccugcauuauguacua

SEQ ID NO: 164670 - RNA, 19 nt, Homo sapiens
gacaaacugugugaauauu

SEQ ID NO: 164671 - RNA, 19 nt, Homo sapiens
uagaugauguuucuucaga

SEQ ID NO: 164672 - RNA, 19 nt, Homo sapiens
ggacuuggaugagacaauc

SEQ ID NO: 164673 - RNA, 19 nt, Homo sapiens
caucaacacccauuaaaga

SEQ ID NO: 164674 - RNA, 19 nt, Homo sapiens
gaagguucauugccauugu

SEQ ID NO: 164675 - RNA, 19 nt, Homo sapiens
ugaaauaacacagcaguuu

SEQ ID NO: 164676 - RNA, 19 nt, Homo sapiens
ugagggccuugaugaaaua

SEQ ID NO: 164677 - RNA, 19 nt, Homo sapiens
gaugauguuucuucagaug

SEQ ID NO: 164678 - RNA, 19 nt, Homo sapiens
gauuuacccuuccaacaga

SEQ ID NO: 164679 - RNA, 19 nt, Homo sapiens
gcaauugggagcaguaguu

SEQ ID NO: 164680 - RNA, 19 nt, Homo sapiens
caauacagcaaaccuaauu

SEQ ID NO: 164681 - RNA, 19 nt, Homo sapiens
cuccagaacuuagcaauuu

SEQ ID NO: 164682 - RNA, 19 nt, Homo sapiens
ggaacuggaguaccuguaa

SEQ ID NO: 164683 - RNA, 19 nt, Homo sapiens
cgaaaguccugcuguaugg

SEQ ID NO: 164684 - RNA, 19 nt, Homo sapiens
guacggcauuuccucauau

SEQ ID NO: 164685 - RNA, 19 nt, Homo sapiens
gaagcaaacaguugacaau

SEQ ID NO: 164686 - RNA, 19 nt, Homo sapiens
uauaacagcucaccguauc

SEQ ID NO: 164687 - RNA, 19 nt, Homo sapiens
cucgguaacucucauauaa

SEQ ID NO: 164688 - RNA, 19 nt, Homo sapiens
guucagauguugcuguuuc

SEQ ID NO: 164689 - RNA, 19 nt, Homo sapiens
agacaaucauguacagaaa

SEQ ID NO: 164690 - RNA, 19 nt, Homo sapiens
ucacugagacaaucaugua

SEQ ID NO: 164691 - RNA, 19 nt, Homo sapiens
ugaagagacaauagcauua

SEQ ID NO: 164692 - RNA, 19 nt, Homo sapiens
gagaugguguagaagaaga

SEQ ID NO: 164693 - RNA, 19 nt, Homo sapiens
cggacaaacugugugaaua

SEQ ID NO: 164694 - RNA, 19 nt, Homo sapiens
gaugagucuucuuuaauca

SEQ ID NO: 164695 - RNA, 19 nt, Homo sapiens
gguaaucuguacaucucua

SEQ ID NO: 164696 - RNA, 19 nt, Homo sapiens
gguguggacuggaugagaa

SEQ ID NO: 164697 - RNA, 19 nt, Homo sapiens
cuacaaggcugcgcaaaca

SEQ ID NO: 164698 - RNA, 19 nt, Homo sapiens
gcgaauggaagaaaugauu

SEQ ID NO: 164699 - RNA, 19 nt, Homo sapiens
ccaauaagguuaggacaag

SEQ ID NO: 164700 - RNA, 19 nt, Homo sapiens
ccauaagaguuucuccaaa

SEQ ID NO: 164701 - RNA, 19 nt, Homo sapiens
gaagaaaggaccugcaaac

SEQ ID NO: 164702 - RNA, 19 nt, Homo sapiens
gaaaauaagccaugagaau

SEQ ID NO: 164703 - RNA, 19 nt, Homo sapiens
gcugauggcuccgaguuug

SEQ ID NO: 164704 - RNA, 19 nt, Homo sapiens
gaagacacacgaugcuaau

SEQ ID NO: 164705 - RNA, 19 nt, Homo sapiens
ggcagcacgugcacaaauu

SEQ ID NO: 164706 - RNA, 19 nt, Homo sapiens
gaccacgucuauuucauca

SEQ ID NO: 164707 - RNA, 19 nt, Homo sapiens
aaagugguguauguuguua

SEQ ID NO: 164708 - RNA, 19 nt, Homo sapiens
caccguauccagcacauua

SEQ ID NO: 164709 - RNA, 19 nt, Homo sapiens
gacaggauuucucagcuau

SEQ ID NO: 164710 - RNA, 19 nt, Homo sapiens
agcaaacaguugacaauuu

SEQ ID NO: 164711 - RNA, 19 nt, Homo sapiens
ugucagaccauaagaguuu

SEQ ID NO: 164712 - RNA, 19 nt, Homo sapiens
gagacaaucauguacagaa

SEQ ID NO: 164713 - RNA, 19 nt, Homo sapiens
ugcaaacgcuucaguuguu

SEQ ID NO: 164714 - RNA, 19 nt, Homo sapiens
ccuaagcacauauaacuuu

SEQ ID NO: 164715 - RNA, 19 nt, Homo sapiens
ggacaggaccuaagcacau

SEQ ID NO: 164716 - RNA, 19 nt, Homo sapiens
ggcagacacacauuuauuu

SEQ ID NO: 164717 - RNA, 19 nt, Homo sapiens
ucaggaauauauacaggaa

SEQ ID NO: 164718 - RNA, 19 nt, Homo sapiens
gacugaagguggauuguca

SEQ ID NO: 164719 - RNA, 19 nt, Homo sapiens
gaaggaacacauuaaacug

SEQ ID NO: 164720 - RNA, 19 nt, Homo sapiens
cauaagaguuucuccaaaa

SEQ ID NO: 164721 - RNA, 19 nt, Homo sapiens
aagcauggaugucaagugu

SEQ ID NO: 164722 - RNA, 19 nt, Homo sapiens
gagacaauagcauuagaaa

SEQ ID NO: 164723 - RNA, 19 nt, Homo sapiens
gcacaacagagacugaaau

SEQ ID NO: 164724 - RNA, 19 nt, Homo sapiens
gaaaagugguguauguugu

SEQ ID NO: 164725 - RNA, 19 nt, Homo sapiens
ccacuuaccagcuucaaga

SEQ ID NO: 164726 - RNA, 19 nt, Homo sapiens
cgguaacucucauauaaau

SEQ ID NO: 164727 - RNA, 19 nt, Homo sapiens
uaucuuggccuuacuguau

SEQ ID NO: 164728 - RNA, 19 nt, Homo sapiens
acaaucauguacagaaaga

SEQ ID NO: 164729 - RNA, 19 nt, Homo sapiens
gaagagacaauagcauuag

SEQ ID NO: 164730 - RNA, 19 nt, Homo sapiens
gaaauuacccuuaggauga

SEQ ID NO: 164731 - RNA, 19 nt, Homo sapiens
caugugcucuguauaauua

SEQ ID NO: 164732 - RNA, 19 nt, Homo sapiens
auaaacagcuucuccaaua

SEQ ID NO: 164733 - RNA, 19 nt, Homo sapiens
ggaaauaauucacucacaa

SEQ ID NO: 164734 - RNA, 19 nt, Homo sapiens
uaacagcgcucggcacuuu

SEQ ID NO: 164735 - RNA, 19 nt, Homo sapiens
gcaacaagcuacagccuau

SEQ ID NO: 164736 - RNA, 19 nt, Homo sapiens
cgaaguaguugaagagcua

SEQ ID NO: 164737 - RNA, 19 nt, Homo sapiens
uaacacagcaguuucuuaa

SEQ ID NO: 164738 - RNA, 19 nt, Homo sapiens
gcaaacgcuucaguuguua

SEQ ID NO: 164739 - RNA, 19 nt, Homo sapiens
ccacaaagaauauagauga

SEQ ID NO: 164740 - RNA, 19 nt, Homo sapiens
uauaggagaugguguagaa

SEQ ID NO: 164741 - RNA, 19 nt, Homo sapiens
gaucacaggugcaaacauc

SEQ ID NO: 164742 - RNA, 19 nt, Homo sapiens
gcaaacaguugacaauuuu

SEQ ID NO: 164743 - RNA, 19 nt, Homo sapiens
gaagguggauugucacagu

SEQ ID NO: 164744 - RNA, 19 nt, Homo sapiens
ggaugagucuucuuuaauc

SEQ ID NO: 164745 - RNA, 19 nt, Homo sapiens
caacauggcaaguacagua

SEQ ID NO: 164746 - RNA, 19 nt, Homo sapiens
gaauaccaguggaggaauu

SEQ ID NO: 164747 - RNA, 19 nt, Homo sapiens
caacagagacugaaaugug

SEQ ID NO: 164748 - RNA, 19 nt, Homo sapiens
gaagaaaagugguguaugu

SEQ ID NO: 164749 - RNA, 19 nt, Homo sapiens
ggacaaacugugugaauau

SEQ ID NO: 164750 - RNA, 19 nt, Homo sapiens
caacacccauuaaagauuc

SEQ ID NO: 164751 - RNA, 19 nt, Homo sapiens
cgacgggucuuuaaacaau

SEQ ID NO: 164752 - RNA, 19 nt, Homo sapiens
gacaggaccuaagcacaua

SEQ ID NO: 164753 - RNA, 19 nt, Homo sapiens
ccaaugagcagcagugaaa

SEQ ID NO: 164754 - RNA, 19 nt, Homo sapiens
gcacauugcauaguaguuu

SEQ ID NO: 164755 - RNA, 19 nt, Homo sapiens
gggcaggcaucaagacuga

SEQ ID NO: 164756 - RNA, 19 nt, Homo sapiens
ggaagacacacgaugcuaa

SEQ ID NO: 164757 - RNA, 19 nt, Homo sapiens
gcauggaugucaaguguca

SEQ ID NO: 164758 - RNA, 19 nt, Homo sapiens
gaucuaaccagcccgcaua

SEQ ID NO: 164759 - RNA, 19 nt, Homo sapiens
uaggaugagucuucuuuaa

SEQ ID NO: 164760 - RNA, 19 nt, Homo sapiens
guacaucacugagacaauc

SEQ ID NO: 164761 - RNA, 19 nt, Homo sapiens
aaagaaagcuguuuugaga

SEQ ID NO: 164762 - RNA, 19 nt, Homo sapiens
ccauauagaugauguuucu

SEQ ID NO: 164763 - RNA, 19 nt, Homo sapiens
ggacagacaggauuucuca

SEQ ID NO: 164764 - RNA, 19 nt, Homo sapiens
caugugcucagaauuauua

SEQ ID NO: 164765 - RNA, 19 nt, Homo sapiens
aaacagcuuuauugaggua

SEQ ID NO: 164766 - RNA, 19 nt, Homo sapiens
ccacgucuauuucaucaga

SEQ ID NO: 164767 - RNA, 19 nt, Homo sapiens
ccaccugcauuauguacua

SEQ ID NO: 164768 - RNA, 19 nt, Homo sapiens
gacaaacugugugaauauu

SEQ ID NO: 164769 - RNA, 19 nt, Homo sapiens
uagaugauguuucuucaga

SEQ ID NO: 164770 - RNA, 19 nt, Homo sapiens
ggacuuggaugagacaauc

SEQ ID NO: 164771 - RNA, 19 nt, Homo sapiens
caucaacacccauuaaaga

SEQ ID NO: 164772 - RNA, 19 nt, Homo sapiens
gaagguucauugccauugu

SEQ ID NO: 164773 - RNA, 19 nt, Homo sapiens
ugaaauaacacagcaguuu

SEQ ID NO: 164774 - RNA, 19 nt, Homo sapiens
ugagggccuugaugaaaua

SEQ ID NO: 164775 - RNA, 19 nt, Homo sapiens
gaugauguuucuucagaug

SEQ ID NO: 164776 - RNA, 19 nt, Homo sapiens
gauuuacccuuccaacaga

SEQ ID NO: 164777 - RNA, 19 nt, Homo sapiens
gcaauugggagcaguaguu

SEQ ID NO: 164778 - RNA, 19 nt, Homo sapiens
caauacagcaaaccuaauu

SEQ ID NO: 164779 - RNA, 19 nt, Homo sapiens
cuccagaacuuagcaauuu

SEQ ID NO: 164780 - RNA, 19 nt, Homo sapiens
ggaacuggaguaccuguaa

SEQ ID NO: 164781 - RNA, 19 nt, Homo sapiens
cgaaaguccugcuguaugg

SEQ ID NO: 164782 - RNA, 19 nt, Homo sapiens
guacggcauuuccucauau

SEQ ID NO: 164783 - RNA, 19 nt, Homo sapiens
gaagcaaacaguugacaau

SEQ ID NO: 164784 - RNA, 19 nt, Homo sapiens
uauaacagcucaccguauc

SEQ ID NO: 164785 - RNA, 19 nt, Homo sapiens
cucgguaacucucauauaa

SEQ ID NO: 164786 - RNA, 19 nt, Homo sapiens
guucagauguugcuguuuc

SEQ ID NO: 164787 - RNA, 19 nt, Homo sapiens
agacaaucauguacagaaa

SEQ ID NO: 164788 - RNA, 19 nt, Homo sapiens
ucacugagacaaucaugua

SEQ ID NO: 164789 - RNA, 19 nt, Homo sapiens
ugaagagacaauagcauua

SEQ ID NO: 164790 - RNA, 19 nt, Homo sapiens
gagaugguguagaagaaga

SEQ ID NO: 164791 - RNA, 19 nt, Homo sapiens
cggacaaacugugugaaua

SEQ ID NO: 164792 - RNA, 19 nt, Homo sapiens
gaugagucuucuuuaauca

SEQ ID NO: 164793 - RNA, 19 nt, Homo sapiens
gguaaucuguacaucucua

SEQ ID NO: 164794 - RNA, 19 nt, Homo sapiens
gguguggacuggaugagaa

SEQ ID NO: 164795 - RNA, 19 nt, Homo sapiens
gcgaauggaagaaaugauu

SEQ ID NO: 164796 - RNA, 19 nt, Homo sapiens
ccauaagaguuucuccaaa

SEQ ID NO: 164797 - RNA, 19 nt, Homo sapiens
gaagaaaggaccugcaaac

SEQ ID NO: 164798 - RNA, 19 nt, Homo sapiens
gaaaauaagccaugagaau

SEQ ID NO: 164799 - RNA, 19 nt, Homo sapiens
gaagacacacgaugcuaau

SEQ ID NO: 164800 - RNA, 19 nt, Homo sapiens
ggcagcacgugcacaaauu

SEQ ID NO: 164801 - RNA, 19 nt, Homo sapiens
gaccacgucuauuucauca

SEQ ID NO: 164802 - RNA, 19 nt, Homo sapiens
aaagugguguauguuguua

SEQ ID NO: 164803 - RNA, 19 nt, Homo sapiens
auuaagagcugacacugaa

SEQ ID NO: 164804 - RNA, 19 nt, Homo sapiens
caccguauccagcacauua

SEQ ID NO: 164805 - RNA, 19 nt, Homo sapiens
gacaggauuucucagcuau

SEQ ID NO: 164806 - RNA, 19 nt, Homo sapiens
agcaaacaguugacaauuu

SEQ ID NO: 164807 - RNA, 19 nt, Homo sapiens
ugucagaccauaagaguuu

SEQ ID NO: 164808 - RNA, 19 nt, Homo sapiens
gagacaaucauguacagaa

SEQ ID NO: 164809 - RNA, 19 nt, Homo sapiens
ugcaaacgcuucaguuguu

SEQ ID NO: 164810 - RNA, 19 nt, Homo sapiens
ccuaagcacauauaacuuu

SEQ ID NO: 164811 - RNA, 19 nt, Homo sapiens
ggacaggaccuaagcacau

SEQ ID NO: 164812 - RNA, 19 nt, Homo sapiens
ggcagacacacauuuauuu

SEQ ID NO: 164813 - RNA, 19 nt, Homo sapiens
ucaggaauauauacaggaa

SEQ ID NO: 164814 - RNA, 19 nt, Homo sapiens
gacugaagguggauuguca

SEQ ID NO: 164815 - RNA, 19 nt, Homo sapiens
cauaagaguuucuccaaaa

SEQ ID NO: 164816 - RNA, 19 nt, Homo sapiens
aagcauggaugucaagugu

SEQ ID NO: 164817 - RNA, 19 nt, Homo sapiens
gagacaauagcauuagaaa

SEQ ID NO: 164818 - RNA, 19 nt, Homo sapiens
gcacaacagagacugaaau

SEQ ID NO: 164819 - RNA, 19 nt, Homo sapiens
gaaaagugguguauguugu

SEQ ID NO: 164820 - RNA, 19 nt, Homo sapiens
ccacuuaccagcuucaaga

SEQ ID NO: 164821 - RNA, 19 nt, Homo sapiens
cgguaacucucauauaaau

SEQ ID NO: 164822 - RNA, 19 nt, Homo sapiens
uaucuuggccuuacuguau

SEQ ID NO: 164823 - RNA, 19 nt, Homo sapiens
acaaucauguacagaaaga

SEQ ID NO: 164824 - RNA, 19 nt, Homo sapiens
gaagagacaauagcauuag

SEQ ID NO: 164825 - RNA, 19 nt, Homo sapiens
gcuguugacucuaguacug

SEQ ID NO: 164826 - RNA, 19 nt, Homo sapiens
agaagaaugugaccaaguc

SEQ ID NO: 164827 - RNA, 19 nt, Homo sapiens
agacaggauuucucagcua

SEQ ID NO: 164828 - RNA, 19 nt, Homo sapiens
uuucaugugcucagaauua

SEQ ID NO: 164829 - RNA, 19 nt, Homo sapiens
gcaggucuauggaaaugca

SEQ ID NO: 164830 - RNA, 19 nt, Homo sapiens
gaaauuacccuuaggauga

SEQ ID NO: 164831 - RNA, 19 nt, Homo sapiens
auaaacagcuucuccaaua

SEQ ID NO: 164832 - RNA, 19 nt, Homo sapiens
ggaaauaauucacucacaa

SEQ ID NO: 164833 - RNA, 19 nt, Homo sapiens
uaacagcgcucggcacuuu

SEQ ID NO: 164834 - RNA, 19 nt, Homo sapiens
gcaacaagcuacagccuau

SEQ ID NO: 164835 - RNA, 19 nt, Homo sapiens
cgaaguaguugaagagcua

SEQ ID NO: 164836 - RNA, 19 nt, Homo sapiens
uaacacagcaguuucuuaa

SEQ ID NO: 164837 - RNA, 19 nt, Homo sapiens
gcaaacgcuucaguuguua

SEQ ID NO: 164838 - RNA, 19 nt, Homo sapiens
ccacaaagaauauagauga

SEQ ID NO: 164839 - RNA, 19 nt, Homo sapiens
uauaggagaugguguagaa

SEQ ID NO: 164840 - RNA, 19 nt, Homo sapiens
gcaaacaguugacaauuuu

SEQ ID NO: 164841 - RNA, 19 nt, Homo sapiens
gaagguggauugucacagu

SEQ ID NO: 164842 - RNA, 19 nt, Homo sapiens
ggaugagucuucuuuaauc

SEQ ID NO: 164843 - RNA, 19 nt, Homo sapiens
caacauggcaaguacagua

SEQ ID NO: 164844 - RNA, 19 nt, Homo sapiens
gaauaccaguggaggaauu

SEQ ID NO: 164845 - RNA, 19 nt, Homo sapiens
caacagagacugaaaugug

SEQ ID NO: 164846 - RNA, 19 nt, Homo sapiens
gaagaaaagugguguaugu

SEQ ID NO: 164847 - RNA, 19 nt, Homo sapiens
ggacaaacugugugaauau

SEQ ID NO: 164848 - RNA, 19 nt, Homo sapiens
caacacccauuaaagauuc

SEQ ID NO: 164849 - RNA, 19 nt, Homo sapiens
cgacgggucuuuaaacaau

SEQ ID NO: 164850 - RNA, 19 nt, Homo sapiens
gacaggaccuaagcacaua

SEQ ID NO: 164851 - RNA, 19 nt, Homo sapiens
ccaaugagcagcagugaaa

SEQ ID NO: 164852 - RNA, 19 nt, Homo sapiens
gcacauugcauaguaguuu

SEQ ID NO: 164853 - RNA, 19 nt, Homo sapiens
ggaagacacacgaugcuaa

SEQ ID NO: 164854 - RNA, 19 nt, Homo sapiens
gcauggaugucaaguguca

SEQ ID NO: 164855 - RNA, 19 nt, Homo sapiens
gaucuaaccagcccgcaua

SEQ ID NO: 164856 - RNA, 19 nt, Homo sapiens
uaggaugagucuucuuuaa

SEQ ID NO: 164857 - RNA, 19 nt, Homo sapiens
guacaucacugagacaauc

SEQ ID NO: 164858 - RNA, 19 nt, Homo sapiens
aaagaaagcuguuuugaga

SEQ ID NO: 164859 - RNA, 19 nt, Homo sapiens
ccauauagaugauguuucu

SEQ ID NO: 164860 - RNA, 19 nt, Homo sapiens
ggacagacaggauuucuca

SEQ ID NO: 164861 - RNA, 19 nt, Homo sapiens
caugugcucagaauuauua

SEQ ID NO: 164862 - RNA, 19 nt, Homo sapiens
aaacagcuuuauugaggua

SEQ ID NO: 164863 - RNA, 19 nt, Homo sapiens
ccacgucuauuucaucaga

SEQ ID NO: 164864 - RNA, 19 nt, Homo sapiens
ccaccugcauuauguacua

SEQ ID NO: 164865 - RNA, 19 nt, Homo sapiens
gacaaacugugugaauauu

SEQ ID NO: 164866 - RNA, 19 nt, Homo sapiens
uagaugauguuucuucaga

SEQ ID NO: 164867 - RNA, 19 nt, Homo sapiens
ggacuuggaugagacaauc

SEQ ID NO: 164868 - RNA, 19 nt, Homo sapiens
caucaacacccauuaaaga

SEQ ID NO: 164869 - RNA, 19 nt, Homo sapiens
gaagguucauugccauugu

SEQ ID NO: 164870 - RNA, 19 nt, Homo sapiens
ugaaauaacacagcaguuu

SEQ ID NO: 164871 - RNA, 19 nt, Homo sapiens
ugagggccuugaugaaaua

SEQ ID NO: 164872 - RNA, 19 nt, Homo sapiens
gaugauguuucuucagaug

SEQ ID NO: 164873 - RNA, 19 nt, Homo sapiens
gauuuacccuuccaacaga

SEQ ID NO: 164874 - RNA, 19 nt, Homo sapiens
gcaauugggagcaguaguu

SEQ ID NO: 164875 - RNA, 19 nt, Homo sapiens
caauacagcaaaccuaauu

SEQ ID NO: 164876 - RNA, 19 nt, Homo sapiens
cuccagaacuuagcaauuu

SEQ ID NO: 164877 - RNA, 19 nt, Homo sapiens
ggaacuggaguaccuguaa

SEQ ID NO: 164878 - RNA, 19 nt, Homo sapiens
cgaaaguccugcuguaugg

SEQ ID NO: 164879 - RNA, 19 nt, Homo sapiens
cauauggcaucaagacuga

SEQ ID NO: 164880 - RNA, 19 nt, Homo sapiens
guacggcauuuccucauau

SEQ ID NO: 164881 - RNA, 19 nt, Homo sapiens
gaagcaaacaguugacaau

SEQ ID NO: 164882 - RNA, 19 nt, Homo sapiens
cucgguaacucucauauaa

SEQ ID NO: 164883 - RNA, 19 nt, Homo sapiens
uauaacagcucaccguauc

SEQ ID NO: 164884 - RNA, 19 nt, Homo sapiens
agacaaucauguacagaaa

SEQ ID NO: 164885 - RNA, 19 nt, Homo sapiens
ucacugagacaaucaugua

SEQ ID NO: 164886 - RNA, 19 nt, Homo sapiens
ugaagagacaauagcauua

SEQ ID NO: 164887 - RNA, 19 nt, Homo sapiens
gagaugguguagaagaaga

SEQ ID NO: 164888 - RNA, 19 nt, Homo sapiens
cggacaaacugugugaaua

SEQ ID NO: 164889 - RNA, 19 nt, Homo sapiens
gaugagucuucuuuaauca

SEQ ID NO: 164890 - RNA, 19 nt, Homo sapiens
gguaaucuguacaucucua

SEQ ID NO: 164891 - RNA, 19 nt, Homo sapiens
gguguggacuggaugagaa

SEQ ID NO: 164892 - RNA, 19 nt, Homo sapiens
ccauaagaguuucuccaaa

SEQ ID NO: 164893 - RNA, 19 nt, Homo sapiens
gaagaaaggaccugcaaac

SEQ ID NO: 164894 - RNA, 19 nt, Homo sapiens
gaaaauaagccaugagaau

SEQ ID NO: 164895 - RNA, 19 nt, Homo sapiens
gagggaaugugaccaaguc

SEQ ID NO: 164896 - RNA, 19 nt, Homo sapiens
gaagacacacgaugcuaau

SEQ ID NO: 164897 - RNA, 19 nt, Homo sapiens
ggcagcacgugcacaaauu

SEQ ID NO: 164898 - RNA, 19 nt, Homo sapiens
gaccacgucuauuucauca

SEQ ID NO: 164899 - RNA, 19 nt, Homo sapiens
aaagugguguauguuguua

SEQ ID NO: 164900 - RNA, 19 nt, Homo sapiens
caccguauccagcacauua

SEQ ID NO: 164901 - RNA, 19 nt, Homo sapiens
gacaggauuucucagcuau

SEQ ID NO: 164902 - RNA, 19 nt, Homo sapiens
agcaaacaguugacaauuu

SEQ ID NO: 164903 - RNA, 19 nt, Homo sapiens
ugucagaccauaagaguuu

SEQ ID NO: 164904 - RNA, 19 nt, Homo sapiens
gagacaaucauguacagaa

SEQ ID NO: 164905 - RNA, 19 nt, Homo sapiens
ugcaaacgcuucaguuguu

SEQ ID NO: 164906 - RNA, 19 nt, Homo sapiens
ccuaagcacauauaacuuu

SEQ ID NO: 164907 - RNA, 19 nt, Homo sapiens
ggacaggaccuaagcacau

SEQ ID NO: 164908 - RNA, 19 nt, Homo sapiens
gauaugggagggaauguga

SEQ ID NO: 164909 - RNA, 19 nt, Homo sapiens
ucaggaauauauacaggaa

SEQ ID NO: 164910 - RNA, 19 nt, Homo sapiens
gacugaagguggauuguca

SEQ ID NO: 164911 - RNA, 19 nt, Homo sapiens
cauaagaguuucuccaaaa

SEQ ID NO: 164912 - RNA, 19 nt, Homo sapiens
aagcauggaugucaagugu

SEQ ID NO: 164913 - RNA, 19 nt, Homo sapiens
gagacaauagcauuagaaa

SEQ ID NO: 164914 - RNA, 19 nt, Homo sapiens
gcacaacagagacugaaau

SEQ ID NO: 164915 - RNA, 19 nt, Homo sapiens
gaaaagugguguauguugu

SEQ ID NO: 164916 - RNA, 19 nt, Homo sapiens
ccacuuaccagcuucaaga

SEQ ID NO: 164917 - RNA, 19 nt, Homo sapiens
cgguaacucucauauaaau

SEQ ID NO: 164918 - RNA, 19 nt, Homo sapiens
uaucuuggccuuacuguau

SEQ ID NO: 164919 - RNA, 19 nt, Homo sapiens
acaaucauguacagaaaga

SEQ ID NO: 164920 - RNA, 19 nt, Homo sapiens
gaagagacaauagcauuag

SEQ ID NO: 164921 - RNA, 19 nt, Homo sapiens
gcuguugacucuaguacug

SEQ ID NO: 164922 - RNA, 19 nt, Homo sapiens
agacaggauuucucagcua

SEQ ID NO: 164923 - RNA, 19 nt, Homo sapiens
uuucaugugcucagaauua

SEQ ID NO: 164924 - RNA, 19 nt, Homo sapiens
gcaggucuauggaaaugca

SEQ ID NO: 164925 - RNA, 19 nt, Homo sapiens
gguccuacgccaacagaua

SEQ ID NO: 164926 - RNA, 19 nt, Homo sapiens
caacagaccauacccacau

SEQ ID NO: 164927 - RNA, 19 nt, Homo sapiens
ccggaaaucagcaaacuuu

SEQ ID NO: 164928 - RNA, 19 nt, Homo sapiens
caauggcaccgaaguuaaa

SEQ ID NO: 164929 - RNA, 19 nt, Homo sapiens
gcaucaaucuggggaaaua

SEQ ID NO: 164930 - RNA, 19 nt, Homo sapiens
gaaauuacccuuaggauga

SEQ ID NO: 164931 - RNA, 19 nt, Homo sapiens
caugugcucuguauaauua

SEQ ID NO: 164932 - RNA, 19 nt, Homo sapiens
auaaacagcuucuccaaua

SEQ ID NO: 164933 - RNA, 19 nt, Homo sapiens
ggaaauaauucacucacaa

SEQ ID NO: 164934 - RNA, 19 nt, Homo sapiens
uaacagcgcucggcacuuu

SEQ ID NO: 164935 - RNA, 19 nt, Homo sapiens
gcaacaagcuacagccuau

SEQ ID NO: 164936 - RNA, 19 nt, Homo sapiens
cgaaguaguugaagagcua

SEQ ID NO: 164937 - RNA, 19 nt, Homo sapiens
uaacacagcaguuucuuaa

SEQ ID NO: 164938 - RNA, 19 nt, Homo sapiens
gcaaacgcuucaguuguua

SEQ ID NO: 164939 - RNA, 19 nt, Homo sapiens
ccacaaagaauauagauga

SEQ ID NO: 164940 - RNA, 19 nt, Homo sapiens
uauaggagaugguguagaa

SEQ ID NO: 164941 - RNA, 19 nt, Homo sapiens
gaucacaggugcaaacauc

SEQ ID NO: 164942 - RNA, 19 nt, Homo sapiens
gcaaacaguugacaauuuu

SEQ ID NO: 164943 - RNA, 19 nt, Homo sapiens
gaagguggauugucacagu

SEQ ID NO: 164944 - RNA, 19 nt, Homo sapiens
ggaugagucuucuuuaauc

SEQ ID NO: 164945 - RNA, 19 nt, Homo sapiens
caacauggcaaguacagua

SEQ ID NO: 164946 - RNA, 19 nt, Homo sapiens
gaauaccaguggaggaauu

SEQ ID NO: 164947 - RNA, 19 nt, Homo sapiens
caacagagacugaaaugug

SEQ ID NO: 164948 - RNA, 19 nt, Homo sapiens
gaagaaaagugguguaugu

SEQ ID NO: 164949 - RNA, 19 nt, Homo sapiens
ggacaaacugugugaauau

SEQ ID NO: 164950 - RNA, 19 nt, Homo sapiens
caacacccauuaaagauuc

SEQ ID NO: 164951 - RNA, 19 nt, Homo sapiens
cgacgggucuuuaaacaau

SEQ ID NO: 164952 - RNA, 19 nt, Homo sapiens
gacaggaccuaagcacaua

SEQ ID NO: 164953 - RNA, 19 nt, Homo sapiens
ccaaugagcagcagugaaa

SEQ ID NO: 164954 - RNA, 19 nt, Homo sapiens
gcacauugcauaguaguuu

SEQ ID NO: 164955 - RNA, 19 nt, Homo sapiens
gggcaggcaucaagacuga

SEQ ID NO: 164956 - RNA, 19 nt, Homo sapiens
ggaagacacacgaugcuaa

SEQ ID NO: 164957 - RNA, 19 nt, Homo sapiens
gcauggaugucaaguguca

SEQ ID NO: 164958 - RNA, 19 nt, Homo sapiens
uaggaugagucuucuuuaa

SEQ ID NO: 164959 - RNA, 19 nt, Homo sapiens
guacaucacugagacaauc

SEQ ID NO: 164960 - RNA, 19 nt, Homo sapiens
aaagaaagcuguuuugaga

SEQ ID NO: 164961 - RNA, 19 nt, Homo sapiens
ccauauagaugauguuucu

SEQ ID NO: 164962 - RNA, 19 nt, Homo sapiens
ggacagacaggauuucuca

SEQ ID NO: 164963 - RNA, 19 nt, Homo sapiens
caugugcucagaauuauua

SEQ ID NO: 164964 - RNA, 19 nt, Homo sapiens
aaacagcuuuauugaggua

SEQ ID NO: 164965 - RNA, 19 nt, Homo sapiens
ccacgucuauuucaucaga

SEQ ID NO: 164966 - RNA, 19 nt, Homo sapiens
ccaccugcauuauguacua

SEQ ID NO: 164967 - RNA, 19 nt, Homo sapiens
gacaaacugugugaauauu

SEQ ID NO: 164968 - RNA, 19 nt, Homo sapiens
uagaugauguuucuucaga

SEQ ID NO: 164969 - RNA, 19 nt, Homo sapiens
ggacuuggaugagacaauc

SEQ ID NO: 164970 - RNA, 19 nt, Homo sapiens
caucaacacccauuaaaga

SEQ ID NO: 164971 - RNA, 19 nt, Homo sapiens
gaagguucauugccauugu

SEQ ID NO: 164972 - RNA, 19 nt, Homo sapiens
ugaaauaacacagcaguuu

SEQ ID NO: 164973 - RNA, 19 nt, Homo sapiens
ugagggccuugaugaaaua

SEQ ID NO: 164974 - RNA, 19 nt, Homo sapiens
gaugauguuucuucagaug

SEQ ID NO: 164975 - RNA, 19 nt, Homo sapiens
gauuuacccuuccaacaga

SEQ ID NO: 164976 - RNA, 19 nt, Homo sapiens
gcaauugggagcaguaguu

SEQ ID NO: 164977 - RNA, 19 nt, Homo sapiens
caauacagcaaaccuaauu

SEQ ID NO: 164978 - RNA, 19 nt, Homo sapiens
cuccagaacuuagcaauuu

SEQ ID NO: 164979 - RNA, 19 nt, Homo sapiens
ggaacuggaguaccuguaa

SEQ ID NO: 164980 - RNA, 19 nt, Homo sapiens
cgaaaguccugcuguaugg

SEQ ID NO: 164981 - RNA, 19 nt, Homo sapiens
guacggcauuuccucauau

SEQ ID NO: 164982 - RNA, 19 nt, Homo sapiens
gaagcaaacaguugacaau

SEQ ID NO: 164983 - RNA, 19 nt, Homo sapiens
uauaacagcucaccguauc

SEQ ID NO: 164984 - RNA, 19 nt, Homo sapiens
guucagauguugcuguuuc

SEQ ID NO: 164985 - RNA, 19 nt, Homo sapiens
agacaaucauguacagaaa

SEQ ID NO: 164986 - RNA, 19 nt, Homo sapiens
ucacugagacaaucaugua

SEQ ID NO: 164987 - RNA, 19 nt, Homo sapiens
ugaagagacaauagcauua

SEQ ID NO: 164988 - RNA, 19 nt, Homo sapiens
gagaugguguagaagaaga

SEQ ID NO: 164989 - RNA, 19 nt, Homo sapiens
cggacaaacugugugaaua

SEQ ID NO: 164990 - RNA, 19 nt, Homo sapiens
gaugagucuucuuuaauca

SEQ ID NO: 164991 - RNA, 19 nt, Homo sapiens
gguaaucuguacaucucua

SEQ ID NO: 164992 - RNA, 19 nt, Homo sapiens
gguguggacuggaugagaa

SEQ ID NO: 164993 - RNA, 19 nt, Homo sapiens
gcgaauggaagaaaugauu

SEQ ID NO: 164994 - RNA, 19 nt, Homo sapiens
ccauaagaguuucuccaaa

SEQ ID NO: 164995 - RNA, 19 nt, Homo sapiens
gaagaaaggaccugcaaac

SEQ ID NO: 164996 - RNA, 19 nt, Homo sapiens
gaaaauaagccaugagaau

SEQ ID NO: 164997 - RNA, 19 nt, Homo sapiens
gaagacacacgaugcuaau

SEQ ID NO: 164998 - RNA, 19 nt, Homo sapiens
ggcagcacgugcacaaauu

SEQ ID NO: 164999 - RNA, 19 nt, Homo sapiens
gaccacgucuauuucauca

SEQ ID NO: 165000 - RNA, 19 nt, Homo sapiens
aaagugguguauguuguua

SEQ ID NO: 165001 - RNA, 19 nt, Homo sapiens
auuaagagcugacacugaa

SEQ ID NO: 165002 - RNA, 19 nt, Homo sapiens
caccguauccagcacauua

SEQ ID NO: 165003 - RNA, 19 nt, Homo sapiens
gacaggauuucucagcuau

SEQ ID NO: 165004 - RNA, 19 nt, Homo sapiens
agcaaacaguugacaauuu

SEQ ID NO: 165005 - RNA, 19 nt, Homo sapiens
ugucagaccauaagaguuu

SEQ ID NO: 165006 - RNA, 19 nt, Homo sapiens
gagacaaucauguacagaa

SEQ ID NO: 165007 - RNA, 19 nt, Homo sapiens
ugcaaacgcuucaguuguu

SEQ ID NO: 165008 - RNA, 19 nt, Homo sapiens
ccuaagcacauauaacuuu

SEQ ID NO: 165009 - RNA, 19 nt, Homo sapiens
ggacaggaccuaagcacau

SEQ ID NO: 165010 - RNA, 19 nt, Homo sapiens
ggcagacacacauuuauuu

SEQ ID NO: 165011 - RNA, 19 nt, Homo sapiens
ucaggaauauauacaggaa

SEQ ID NO: 165012 - RNA, 19 nt, Homo sapiens
gacugaagguggauuguca

SEQ ID NO: 165013 - RNA, 19 nt, Homo sapiens
cauaagaguuucuccaaaa

SEQ ID NO: 165014 - RNA, 19 nt, Homo sapiens
aagcauggaugucaagugu

SEQ ID NO: 165015 - RNA, 19 nt, Homo sapiens
gagacaauagcauuagaaa

SEQ ID NO: 165016 - RNA, 19 nt, Homo sapiens
gcacaacagagacugaaau

SEQ ID NO: 165017 - RNA, 19 nt, Homo sapiens
gaaaagugguguauguugu

SEQ ID NO: 165018 - RNA, 19 nt, Homo sapiens
ccacuuaccagcuucaaga

SEQ ID NO: 165019 - RNA, 19 nt, Homo sapiens
uaucuuggccuuacuguau

SEQ ID NO: 165020 - RNA, 19 nt, Homo sapiens
acaaucauguacagaaaga

SEQ ID NO: 165021 - RNA, 19 nt, Homo sapiens
gaagagacaauagcauuag

SEQ ID NO: 165022 - RNA, 19 nt, Homo sapiens
gcuguugacucuaguacug

SEQ ID NO: 165023 - RNA, 19 nt, Homo sapiens
agaagaaugugaccaaguc

SEQ ID NO: 165024 - RNA, 19 nt, Homo sapiens
agacaggauuucucagcua

SEQ ID NO: 165025 - RNA, 19 nt, Homo sapiens
uuucaugugcucagaauua

SEQ ID NO: 165026 - RNA, 19 nt, Homo sapiens
gguccuacgccaacagaua

SEQ ID NO: 165027 - RNA, 19 nt, Homo sapiens
caacagaccauacccacau

SEQ ID NO: 165028 - RNA, 19 nt, Homo sapiens
ccggaaaucagcaaacuuu

SEQ ID NO: 165029 - RNA, 19 nt, Homo sapiens
gaagcagaguaacaacauc

SEQ ID NO: 165030 - RNA, 19 nt, Homo sapiens
gaagacagcuugaaccauu

SEQ ID NO: 165031 - RNA, 19 nt, Homo sapiens
ggacuuggaugagacaaua

SEQ ID NO: 165032 - RNA, 19 nt, Homo sapiens
guucacaguucuaauguaa

SEQ ID NO: 165033 - RNA, 19 nt, Homo sapiens
ggacagugcacgugccuua

SEQ ID NO: 165034 - RNA, 19 nt, Homo sapiens
ugaaggagauguacaauac

SEQ ID NO: 165035 - RNA, 19 nt, Homo sapiens
gagaacaucuacagugcaa

SEQ ID NO: 165036 - RNA, 19 nt, Homo sapiens
gaaggcaguucaagcuguu

SEQ ID NO: 165037 - RNA, 19 nt, Homo sapiens
ugacaauggccaagauuua

SEQ ID NO: 165038 - RNA, 19 nt, Homo sapiens
gaaggaaaguacccaacau

SEQ ID NO: 165039 - RNA, 19 nt, Homo sapiens
gagacgacguguccaguga

SEQ ID NO: 165040 - RNA, 19 nt, Homo sapiens
gcacgugccuuacgcuaca

SEQ ID NO: 165041 - RNA, 19 nt, Homo sapiens
caacauuggcuucggagua

SEQ ID NO: 165042 - RNA, 19 nt, Homo sapiens
aaacagcgauugucuggau

SEQ ID NO: 165043 - RNA, 19 nt, Homo sapiens
ccaaaguccugcuauaugg

SEQ ID NO: 165044 - RNA, 19 nt, Homo sapiens
caccaccacucaacuaauu

SEQ ID NO: 165045 - RNA, 19 nt, Homo sapiens
gcauuggccuuaugaugga

SEQ ID NO: 165046 - RNA, 19 nt, Homo sapiens
ggacauuugcauccagaua

SEQ ID NO: 165047 - RNA, 19 nt, Homo sapiens
gaauacaacacacacaaug

SEQ ID NO: 165048 - RNA, 19 nt, Homo sapiens
gacaaggcaucaccaaauc

SEQ ID NO: 165049 - RNA, 19 nt, Homo sapiens
gcacuaaaccucaucaacu

SEQ ID NO: 165050 - RNA, 19 nt, Homo sapiens
gcugacggcuuccacaguu

SEQ ID NO: 165051 - RNA, 19 nt, Homo sapiens
acacaucuguucuucaaug

SEQ ID NO: 165052 - RNA, 19 nt, Homo sapiens
gcacaacaggguucuauca

SEQ ID NO: 165053 - RNA, 19 nt, Homo sapiens
ggacaaucauucuuugaac

SEQ ID NO: 165054 - RNA, 19 nt, Homo sapiens
cccuggagcuggaguauuu

SEQ ID NO: 165055 - RNA, 19 nt, Homo sapiens
gaucggugaugguguggaa

SEQ ID NO: 165056 - RNA, 19 nt, Homo sapiens
gaaaugguagaacuaguga

SEQ ID NO: 165057 - RNA, 19 nt, Homo sapiens
gacaauggccaagauuuaa

SEQ ID NO: 165058 - RNA, 19 nt, Homo sapiens
ggaaaugguagaacuagug

SEQ ID NO: 165059 - RNA, 19 nt, Homo sapiens
gcgauugucuggauaaacu

SEQ ID NO: 165060 - RNA, 19 nt, Homo sapiens
auacacaucuguucuucaa

SEQ ID NO: 165061 - RNA, 19 nt, Homo sapiens
gggaaggaaugggugcuuu

SEQ ID NO: 165062 - RNA, 19 nt, Homo sapiens
gacaaucauucuuugaaca

SEQ ID NO: 165063 - RNA, 19 nt, Homo sapiens
ucacccagccucacuguaa

SEQ ID NO: 165064 - RNA, 19 nt, Homo sapiens
ggucuguguuuccuauuga

SEQ ID NO: 165065 - RNA, 19 nt, Homo sapiens
gccaagauuuaagcacaua

SEQ ID NO: 165066 - RNA, 19 nt, Homo sapiens
aggaaugggugcuuuguga

SEQ ID NO: 165067 - RNA, 19 nt, Homo sapiens
caaccagaguuccgaguca

SEQ ID NO: 165068 - RNA, 19 nt, Homo sapiens
gaauuaugcucuuguaccu

SEQ ID NO: 165069 - RNA, 19 nt, Homo sapiens
uacaauaccuacaagaaca

SEQ ID NO: 165070 - RNA, 19 nt, Homo sapiens
caaggaaaugguagaacua

SEQ ID NO: 165071 - RNA, 19 nt, Homo sapiens
gugaaggagauguacaaua

SEQ ID NO: 165072 - RNA, 19 nt, Homo sapiens
cgaaagagggagacacaga

SEQ ID NO: 165073 - RNA, 19 nt, Homo sapiens
gcacaagccuauggaaucc

SEQ ID NO: 165074 - RNA, 19 nt, Homo sapiens
gaacaaaagcaaggaauug

SEQ ID NO: 165075 - RNA, 19 nt, Homo sapiens
gaaugggugcuuugugaug

SEQ ID NO: 165076 - RNA, 19 nt, Homo sapiens
ggaaggaaugggugcuuug

SEQ ID NO: 165077 - RNA, 19 nt, Homo sapiens
gggacaaucauucuuugaa

SEQ ID NO: 165078 - RNA, 19 nt, Homo sapiens
agacaaggcaucaccaaau

SEQ ID NO: 165079 - RNA, 19 nt, Homo sapiens
guaagacucacagaacaaa

SEQ ID NO: 165080 - RNA, 19 nt, Homo sapiens
gccaaaguccugcuauaug

SEQ ID NO: 165081 - RNA, 19 nt, Homo sapiens
gguucacaguucuaaugua

SEQ ID NO: 165082 - RNA, 19 nt, Homo sapiens
ggguuugucuugucuucuu

SEQ ID NO: 165083 - RNA, 19 nt, Homo sapiens
ggagcuggaguauuuauag

SEQ ID NO: 165084 - RNA, 19 nt, Homo sapiens
uggccaaaguccugcuaua

SEQ ID NO: 165085 - RNA, 19 nt, Homo sapiens
gcccaacugugucaaugug

SEQ ID NO: 165086 - RNA, 19 nt, Homo sapiens
ggaggauugugaccagauc

SEQ ID NO: 165087 - RNA, 19 nt, Homo sapiens
ggagugugcaccaggacua

SEQ ID NO: 165088 - RNA, 19 nt, Homo sapiens
ggugcuuugugauggauaa

SEQ ID NO: 165089 - RNA, 19 nt, Homo sapiens
acaaggaaaugguagaacu

SEQ ID NO: 165090 - RNA, 19 nt, Homo sapiens
ggucaccaccacucaacua

SEQ ID NO: 165091 - RNA, 19 nt, Homo sapiens
gugaccagauccacguuga

SEQ ID NO: 165092 - RNA, 19 nt, Homo sapiens
gggucuguguuuccuauug

SEQ ID NO: 165093 - RNA, 19 nt, Homo sapiens
guacaaggaaaugguagaa

SEQ ID NO: 165094 - RNA, 19 nt, Homo sapiens
gcugcuguguggacucuga

SEQ ID NO: 165095 - RNA, 19 nt, Homo sapiens
ggccaaaguccugcuauau

SEQ ID NO: 165096 - RNA, 19 nt, Homo sapiens
guacaauaccuacaagaac

SEQ ID NO: 165097 - RNA, 19 nt, Homo sapiens
gaaggaaugggugcuuugu

SEQ ID NO: 165098 - RNA, 19 nt, Homo sapiens
uuuauggacuagucucauu

SEQ ID NO: 165099 - RNA, 19 nt, Homo sapiens
gggauggguuugucuuguc

SEQ ID NO: 165100 - RNA, 19 nt, Homo sapiens
gagaggauaaugcagagau

SEQ ID NO: 165101 - RNA, 19 nt, Homo sapiens
cacuaaaccucaucaacuc

SEQ ID NO: 165102 - RNA, 19 nt, Homo sapiens
gcgcauuggccuuaugaug

SEQ ID NO: 165103 - RNA, 19 nt, Homo sapiens
ggucuaagaggagcaguga

SEQ ID NO: 165104 - RNA, 19 nt, Homo sapiens
ucacaguucuaauguaagc

SEQ ID NO: 165105 - RNA, 19 nt, Homo sapiens
aacauuggcuucggaguau

SEQ ID NO: 165106 - RNA, 19 nt, Homo sapiens
agaggauaaugcagagauu

SEQ ID NO: 165107 - RNA, 19 nt, Homo sapiens
gauuuaagcacauacaacu

SEQ ID NO: 165108 - RNA, 19 nt, Homo sapiens
acaacaggguucuaucaag

SEQ ID NO: 165109 - RNA, 19 nt, Homo sapiens
agaccuacuugacgucaug

SEQ ID NO: 165110 - RNA, 19 nt, Homo sapiens
cacccagccucacuguaaa

SEQ ID NO: 165111 - RNA, 19 nt, Homo sapiens
gaugacaauggccaagauu

SEQ ID NO: 165112 - RNA, 19 nt, Homo sapiens
gaccagauccacguugaug

SEQ ID NO: 165113 - RNA, 19 nt, Homo sapiens
cacaucuguucuucaauga

SEQ ID NO: 165114 - RNA, 19 nt, Homo sapiens
gacagagcccauacaccua

SEQ ID NO: 165115 - RNA, 19 nt, Homo sapiens
gguuugucuugucuucuuu

SEQ ID NO: 165116 - RNA, 19 nt, Homo sapiens
guugauaggcacucccaaa

SEQ ID NO: 165117 - RNA, 19 nt, Homo sapiens
ggauggguuugucuugucu

SEQ ID NO: 165118 - RNA, 19 nt, Homo sapiens
ccaccgagaacuccagaga

SEQ ID NO: 165119 - RNA, 19 nt, Homo sapiens
gugaauacaacacacacaa

SEQ ID NO: 165120 - RNA, 19 nt, Homo sapiens
gaggaaggcaguucaagcu

SEQ ID NO: 165121 - RNA, 19 nt, Homo sapiens
cuuagucguugguuugguu

SEQ ID NO: 165122 - RNA, 19 nt, Homo sapiens
uuacccaccuccagcacaa

SEQ ID NO: 165123 - RNA, 19 nt, Homo sapiens
gagcuggaguauuuauagc

SEQ ID NO: 165124 - RNA, 19 nt, Homo sapiens
gcagagauucggcagaaaa

SEQ ID NO: 165125 - RNA, 19 nt, Homo sapiens
ccacuggacagagcccaua

SEQ ID NO: 165126 - RNA, 19 nt, Homo sapiens
agaguggauuccucagcua

SEQ ID NO: 165127 - RNA, 19 nt, Homo sapiens
ccuacagcaucaagacaga

SEQ ID NO: 165128 - RNA, 19 nt, Homo sapiens
gcgguacaaggaaauggua

SEQ ID NO: 165129 - RNA, 19 nt, Homo sapiens
ugaaggcacuaaaccucau

SEQ ID NO: 165130 - RNA, 19 nt, Homo sapiens
ggacuuggaugagacaaua

SEQ ID NO: 165131 - RNA, 19 nt, Homo sapiens
guucacaguucuaauguaa

SEQ ID NO: 165132 - RNA, 19 nt, Homo sapiens
ggacagugcacgugccuua

SEQ ID NO: 165133 - RNA, 19 nt, Homo sapiens
ugaaggagauguacaauac

SEQ ID NO: 165134 - RNA, 19 nt, Homo sapiens
gagaacaucuacagugcaa

SEQ ID NO: 165135 - RNA, 19 nt, Homo sapiens
gaaggcaguucaagcuguu

SEQ ID NO: 165136 - RNA, 19 nt, Homo sapiens
ugacaauggccaagauuua

SEQ ID NO: 165137 - RNA, 19 nt, Homo sapiens
gaaggaaaguacccaacau

SEQ ID NO: 165138 - RNA, 19 nt, Homo sapiens
gagacgacguguccaguga

SEQ ID NO: 165139 - RNA, 19 nt, Homo sapiens
gcacgugccuuacgcuaca

SEQ ID NO: 165140 - RNA, 19 nt, Homo sapiens
caacauuggcuucggagua

SEQ ID NO: 165141 - RNA, 19 nt, Homo sapiens
aaacagcgauugucuggau

SEQ ID NO: 165142 - RNA, 19 nt, Homo sapiens
ccaaaguccugcuauaugg

SEQ ID NO: 165143 - RNA, 19 nt, Homo sapiens
caccaccacucaacuaauu

SEQ ID NO: 165144 - RNA, 19 nt, Homo sapiens
gcauuggccuuaugaugga

SEQ ID NO: 165145 - RNA, 19 nt, Homo sapiens
ggacauuugcauccagaua

SEQ ID NO: 165146 - RNA, 19 nt, Homo sapiens
gaauacaacacacacaaug

SEQ ID NO: 165147 - RNA, 19 nt, Homo sapiens
gacaaggcaucaccaaauc

SEQ ID NO: 165148 - RNA, 19 nt, Homo sapiens
gcacuaaaccucaucaacu

SEQ ID NO: 165149 - RNA, 19 nt, Homo sapiens
gcugacggcuuccacaguu

SEQ ID NO: 165150 - RNA, 19 nt, Homo sapiens
acacaucuguucuucaaug

SEQ ID NO: 165151 - RNA, 19 nt, Homo sapiens
gcacaacaggguucuauca

SEQ ID NO: 165152 - RNA, 19 nt, Homo sapiens
ggacaaucauucuuugaac

SEQ ID NO: 165153 - RNA, 19 nt, Homo sapiens
cccuggagcuggaguauuu

SEQ ID NO: 165154 - RNA, 19 nt, Homo sapiens
gaucggugaugguguggaa

SEQ ID NO: 165155 - RNA, 19 nt, Homo sapiens
gaaaugguagaacuaguga

SEQ ID NO: 165156 - RNA, 19 nt, Homo sapiens
gacaauggccaagauuuaa

SEQ ID NO: 165157 - RNA, 19 nt, Homo sapiens
ggaaaugguagaacuagug

SEQ ID NO: 165158 - RNA, 19 nt, Homo sapiens
gcgauugucuggauaaacu

SEQ ID NO: 165159 - RNA, 19 nt, Homo sapiens
auacacaucuguucuucaa

SEQ ID NO: 165160 - RNA, 19 nt, Homo sapiens
gggaaggaaugggugcuuu

SEQ ID NO: 165161 - RNA, 19 nt, Homo sapiens
gacaaucauucuuugaaca

SEQ ID NO: 165162 - RNA, 19 nt, Homo sapiens
ucacccagccucacuguaa

SEQ ID NO: 165163 - RNA, 19 nt, Homo sapiens
ggucuguguuuccuauuga

SEQ ID NO: 165164 - RNA, 19 nt, Homo sapiens
gccaagauuuaagcacaua

SEQ ID NO: 165165 - RNA, 19 nt, Homo sapiens
aggaaugggugcuuuguga

SEQ ID NO: 165166 - RNA, 19 nt, Homo sapiens
caaccagaguuccgaguca

SEQ ID NO: 165167 - RNA, 19 nt, Homo sapiens
gaauuaugcucuuguaccu

SEQ ID NO: 165168 - RNA, 19 nt, Homo sapiens
uacaauaccuacaagaaca

SEQ ID NO: 165169 - RNA, 19 nt, Homo sapiens
caaggaaaugguagaacua

SEQ ID NO: 165170 - RNA, 19 nt, Homo sapiens
gugaaggagauguacaaua

SEQ ID NO: 165171 - RNA, 19 nt, Homo sapiens
cgaaagagggagacacaga

SEQ ID NO: 165172 - RNA, 19 nt, Homo sapiens
gcacaagccuauggaaucc

SEQ ID NO: 165173 - RNA, 19 nt, Homo sapiens
gaacaaaagcaaggaauug

SEQ ID NO: 165174 - RNA, 19 nt, Homo sapiens
gaaugggugcuuugugaug

SEQ ID NO: 165175 - RNA, 19 nt, Homo sapiens
agacaaggcaucaccaaau

SEQ ID NO: 165176 - RNA, 19 nt, Homo sapiens
ggaaggaaugggugcuuug

SEQ ID NO: 165177 - RNA, 19 nt, Homo sapiens
gggacaaucauucuuugaa

SEQ ID NO: 165178 - RNA, 19 nt, Homo sapiens
guaagacucacagaacaaa

SEQ ID NO: 165179 - RNA, 19 nt, Homo sapiens
gccaaaguccugcuauaug

SEQ ID NO: 165180 - RNA, 19 nt, Homo sapiens
gguucacaguucuaaugua

SEQ ID NO: 165181 - RNA, 19 nt, Homo sapiens
ggguuugucuugucuucuu

SEQ ID NO: 165182 - RNA, 19 nt, Homo sapiens
ggagcuggaguauuuauag

SEQ ID NO: 165183 - RNA, 19 nt, Homo sapiens
uggccaaaguccugcuaua

SEQ ID NO: 165184 - RNA, 19 nt, Homo sapiens
gcccaacugugucaaugug

SEQ ID NO: 165185 - RNA, 19 nt, Homo sapiens
ggaggauugugaccagauc

SEQ ID NO: 165186 - RNA, 19 nt, Homo sapiens
ggagugugcaccaggacua

SEQ ID NO: 165187 - RNA, 19 nt, Homo sapiens
ggugcuuugugauggauaa

SEQ ID NO: 165188 - RNA, 19 nt, Homo sapiens
acaaggaaaugguagaacu

SEQ ID NO: 165189 - RNA, 19 nt, Homo sapiens
ggucaccaccacucaacua

SEQ ID NO: 165190 - RNA, 19 nt, Homo sapiens
gugaccagauccacguuga

SEQ ID NO: 165191 - RNA, 19 nt, Homo sapiens
guacaaggaaaugguagaa

SEQ ID NO: 165192 - RNA, 19 nt, Homo sapiens
gggucuguguuuccuauug

SEQ ID NO: 165193 - RNA, 19 nt, Homo sapiens
ggccaaaguccugcuauau

SEQ ID NO: 165194 - RNA, 19 nt, Homo sapiens
guacaauaccuacaagaac

SEQ ID NO: 165195 - RNA, 19 nt, Homo sapiens
gcugcuguguggacucuga

SEQ ID NO: 165196 - RNA, 19 nt, Homo sapiens
gaaggaaugggugcuuugu

SEQ ID NO: 165197 - RNA, 19 nt, Homo sapiens
uuuauggacuagucucauu

SEQ ID NO: 165198 - RNA, 19 nt, Homo sapiens
gggauggguuugucuuguc

SEQ ID NO: 165199 - RNA, 19 nt, Homo sapiens
gagaggauaaugcagagau

SEQ ID NO: 165200 - RNA, 19 nt, Homo sapiens
cacuaaaccucaucaacuc

SEQ ID NO: 165201 - RNA, 19 nt, Homo sapiens
gcgcauuggccuuaugaug

SEQ ID NO: 165202 - RNA, 19 nt, Homo sapiens
ggucuaagaggagcaguga

SEQ ID NO: 165203 - RNA, 19 nt, Homo sapiens
ucacaguucuaauguaagc

SEQ ID NO: 165204 - RNA, 19 nt, Homo sapiens
aacauuggcuucggaguau

SEQ ID NO: 165205 - RNA, 19 nt, Homo sapiens
agaggauaaugcagagauu

SEQ ID NO: 165206 - RNA, 19 nt, Homo sapiens
gauuuaagcacauacaacu

SEQ ID NO: 165207 - RNA, 19 nt, Homo sapiens
acaacaggguucuaucaag

SEQ ID NO: 165208 - RNA, 19 nt, Homo sapiens
agaccuacuugacgucaug

SEQ ID NO: 165209 - RNA, 19 nt, Homo sapiens
gacagagcccauacaccua

SEQ ID NO: 165210 - RNA, 19 nt, Homo sapiens
cacccagccucacuguaaa

SEQ ID NO: 165211 - RNA, 19 nt, Homo sapiens
gaugacaauggccaagauu

SEQ ID NO: 165212 - RNA, 19 nt, Homo sapiens
gaccagauccacguugaug

SEQ ID NO: 165213 - RNA, 19 nt, Homo sapiens
cacaucuguucuucaauga

SEQ ID NO: 165214 - RNA, 19 nt, Homo sapiens
gguuugucuugucuucuuu

SEQ ID NO: 165215 - RNA, 19 nt, Homo sapiens
guugauaggcacucccaaa

SEQ ID NO: 165216 - RNA, 19 nt, Homo sapiens
ggauggguuugucuugucu

SEQ ID NO: 165217 - RNA, 19 nt, Homo sapiens
ccaccgagaacuccagaga

SEQ ID NO: 165218 - RNA, 19 nt, Homo sapiens
gugaauacaacacacacaa

SEQ ID NO: 165219 - RNA, 19 nt, Homo sapiens
gaggaaggcaguucaagcu

SEQ ID NO: 165220 - RNA, 19 nt, Homo sapiens
cuuagucguugguuugguu

SEQ ID NO: 165221 - RNA, 19 nt, Homo sapiens
gagcuggaguauuuauagc

SEQ ID NO: 165222 - RNA, 19 nt, Homo sapiens
gcagagauucggcagaaaa

SEQ ID NO: 165223 - RNA, 19 nt, Homo sapiens
ccacuggacagagcccaua

SEQ ID NO: 165224 - RNA, 19 nt, Homo sapiens
uuacccaccuccagcacaa

SEQ ID NO: 165225 - RNA, 19 nt, Homo sapiens
cagcgauugucuggauaaa

SEQ ID NO: 165226 - RNA, 19 nt, Homo sapiens
gcgguacaaggaaauggua

SEQ ID NO: 165227 - RNA, 19 nt, Homo sapiens
gcccauacaccuaccagau

SEQ ID NO: 165228 - RNA, 19 nt, Homo sapiens
ugaaggcacuaaaccucau

SEQ ID NO: 165229 - RNA, 19 nt, Homo sapiens
gauaggcacucccaaaagg

SEQ ID NO: 165230 - RNA, 19 nt, Homo sapiens
gaagacagcuugaaccauu

SEQ ID NO: 165231 - RNA, 19 nt, Homo sapiens
ggacuuggaugagacaaua

SEQ ID NO: 165232 - RNA, 19 nt, Homo sapiens
guucacaguucuaauguaa

SEQ ID NO: 165233 - RNA, 19 nt, Homo sapiens
ggacagugcacgugccuua

SEQ ID NO: 165234 - RNA, 19 nt, Homo sapiens
ugaaggagauguacaauac

SEQ ID NO: 165235 - RNA, 19 nt, Homo sapiens
agaauaagcuggucuccaa

SEQ ID NO: 165236 - RNA, 19 nt, Homo sapiens
gagaacaucuacagugcaa

SEQ ID NO: 165237 - RNA, 19 nt, Homo sapiens
gaaggcaguucaagcuguu

SEQ ID NO: 165238 - RNA, 19 nt, Homo sapiens
ugacaauggccaagauuua

SEQ ID NO: 165239 - RNA, 19 nt, Homo sapiens
gaaggaaaguacccaacau

SEQ ID NO: 165240 - RNA, 19 nt, Homo sapiens
gagacgacguguccaguga

SEQ ID NO: 165241 - RNA, 19 nt, Homo sapiens
gcacgugccuuacgcuaca

SEQ ID NO: 165242 - RNA, 19 nt, Homo sapiens
caacauuggcuucggagua

SEQ ID NO: 165243 - RNA, 19 nt, Homo sapiens
aaacagcgauugucuggau

SEQ ID NO: 165244 - RNA, 19 nt, Homo sapiens
ccaaaguccugcuauaugg

SEQ ID NO: 165245 - RNA, 19 nt, Homo sapiens
caccaccacucaacuaauu

SEQ ID NO: 165246 - RNA, 19 nt, Homo sapiens
gcauuggccuuaugaugga

SEQ ID NO: 165247 - RNA, 19 nt, Homo sapiens
ggacauuugcauccagaua

SEQ ID NO: 165248 - RNA, 19 nt, Homo sapiens
gaauacaacacacacaaug

SEQ ID NO: 165249 - RNA, 19 nt, Homo sapiens
gacaaggcaucaccaaauc

SEQ ID NO: 165250 - RNA, 19 nt, Homo sapiens
gcacuaaaccucaucaacu

SEQ ID NO: 165251 - RNA, 19 nt, Homo sapiens
gcugacggcuuccacaguu

SEQ ID NO: 165252 - RNA, 19 nt, Homo sapiens
acacaucuguucuucaaug

SEQ ID NO: 165253 - RNA, 19 nt, Homo sapiens
gcacaacaggguucuauca

SEQ ID NO: 165254 - RNA, 19 nt, Homo sapiens
ggacaaucauucuuugaac

SEQ ID NO: 165255 - RNA, 19 nt, Homo sapiens
cccuggagcuggaguauuu

SEQ ID NO: 165256 - RNA, 19 nt, Homo sapiens
gaucggugaugguguggaa

SEQ ID NO: 165257 - RNA, 19 nt, Homo sapiens
gaaaugguagaacuaguga

SEQ ID NO: 165258 - RNA, 19 nt, Homo sapiens
gacaauggccaagauuuaa

SEQ ID NO: 165259 - RNA, 19 nt, Homo sapiens
gcgauugucuggauaaacu

SEQ ID NO: 165260 - RNA, 19 nt, Homo sapiens
ggaaaugguagaacuagug

SEQ ID NO: 165261 - RNA, 19 nt, Homo sapiens
auacacaucuguucuucaa

SEQ ID NO: 165262 - RNA, 19 nt, Homo sapiens
gggaaggaaugggugcuuu

SEQ ID NO: 165263 - RNA, 19 nt, Homo sapiens
gacaaucauucuuugaaca

SEQ ID NO: 165264 - RNA, 19 nt, Homo sapiens
ggucuguguuuccuauuga

SEQ ID NO: 165265 - RNA, 19 nt, Homo sapiens
gccaagauuuaagcacaua

SEQ ID NO: 165266 - RNA, 19 nt, Homo sapiens
ucacccagccucacuguaa

SEQ ID NO: 165267 - RNA, 19 nt, Homo sapiens
aggaaugggugcuuuguga

SEQ ID NO: 165268 - RNA, 19 nt, Homo sapiens
caaccagaguuccgaguca

SEQ ID NO: 165269 - RNA, 19 nt, Homo sapiens
gaauuaugcucuuguaccu

SEQ ID NO: 165270 - RNA, 19 nt, Homo sapiens
uacaauaccuacaagaaca

SEQ ID NO: 165271 - RNA, 19 nt, Homo sapiens
cuugaaggcugucugaguu

SEQ ID NO: 165272 - RNA, 19 nt, Homo sapiens
caaggaaaugguagaacua

SEQ ID NO: 165273 - RNA, 19 nt, Homo sapiens
gugaaggagauguacaaua

SEQ ID NO: 165274 - RNA, 19 nt, Homo sapiens
aagcuggucuccaauuuca

SEQ ID NO: 165275 - RNA, 19 nt, Homo sapiens
cgaaagagggagacacaga

SEQ ID NO: 165276 - RNA, 19 nt, Homo sapiens
gcacaagccuauggaaucc

SEQ ID NO: 165277 - RNA, 19 nt, Homo sapiens
auaagcuggucuccaauuu

SEQ ID NO: 165278 - RNA, 19 nt, Homo sapiens
gaacaaaagcaaggaauug

SEQ ID NO: 165279 - RNA, 19 nt, Homo sapiens
gaaugggugcuuugugaug

SEQ ID NO: 165280 - RNA, 19 nt, Homo sapiens
ggaaggaaugggugcuuug

SEQ ID NO: 165281 - RNA, 19 nt, Homo sapiens
gggacaaucauucuuugaa

SEQ ID NO: 165282 - RNA, 19 nt, Homo sapiens
guaagacucacagaacaaa

SEQ ID NO: 165283 - RNA, 19 nt, Homo sapiens
gccaaaguccugcuauaug

SEQ ID NO: 165284 - RNA, 19 nt, Homo sapiens
agacaaggcaucaccaaau

SEQ ID NO: 165285 - RNA, 19 nt, Homo sapiens
gguucacaguucuaaugua

SEQ ID NO: 165286 - RNA, 19 nt, Homo sapiens
ggguuugucuugucuucuu

SEQ ID NO: 165287 - RNA, 19 nt, Homo sapiens
ggagcuggaguauuuauag

SEQ ID NO: 165288 - RNA, 19 nt, Homo sapiens
uggccaaaguccugcuaua

SEQ ID NO: 165289 - RNA, 19 nt, Homo sapiens
gcccaacugugucaaugug

SEQ ID NO: 165290 - RNA, 19 nt, Homo sapiens
ggaggauugugaccagauc

SEQ ID NO: 165291 - RNA, 19 nt, Homo sapiens
gaaagggaagcuaagucuu

SEQ ID NO: 165292 - RNA, 19 nt, Homo sapiens
ggagugugcaccaggacua

SEQ ID NO: 165293 - RNA, 19 nt, Homo sapiens
ggugcuuugugauggauaa

SEQ ID NO: 165294 - RNA, 19 nt, Homo sapiens
ggucaccaccacucaacua

SEQ ID NO: 165295 - RNA, 19 nt, Homo sapiens
acaaggaaaugguagaacu

SEQ ID NO: 165296 - RNA, 19 nt, Homo sapiens
gugaccagauccacguuga

SEQ ID NO: 165297 - RNA, 19 nt, Homo sapiens
gggucuguguuuccuauug

SEQ ID NO: 165298 - RNA, 19 nt, Homo sapiens
guacaaggaaaugguagaa

SEQ ID NO: 165299 - RNA, 19 nt, Homo sapiens
ggccaaaguccugcuauau

SEQ ID NO: 165300 - RNA, 19 nt, Homo sapiens
guacaauaccuacaagaac

SEQ ID NO: 165301 - RNA, 19 nt, Homo sapiens
gcugcuguguggacucuga

SEQ ID NO: 165302 - RNA, 19 nt, Homo sapiens
gaaggaaugggugcuuugu

SEQ ID NO: 165303 - RNA, 19 nt, Homo sapiens
uuuauggacuagucucauu

SEQ ID NO: 165304 - RNA, 19 nt, Homo sapiens
gggauggguuugucuuguc

SEQ ID NO: 165305 - RNA, 19 nt, Homo sapiens
gagaggauaaugcagagau

SEQ ID NO: 165306 - RNA, 19 nt, Homo sapiens
cacuaaaccucaucaacuc

SEQ ID NO: 165307 - RNA, 19 nt, Homo sapiens
gcgcauuggccuuaugaug

SEQ ID NO: 165308 - RNA, 19 nt, Homo sapiens
ggucuaagaggagcaguga

SEQ ID NO: 165309 - RNA, 19 nt, Homo sapiens
ucacaguucuaauguaagc

SEQ ID NO: 165310 - RNA, 19 nt, Homo sapiens
aacauuggcuucggaguau

SEQ ID NO: 165311 - RNA, 19 nt, Homo sapiens
agaggauaaugcagagauu

SEQ ID NO: 165312 - RNA, 19 nt, Homo sapiens
gauuuaagcacauacaacu

SEQ ID NO: 165313 - RNA, 19 nt, Homo sapiens
acaacaggguucuaucaag

SEQ ID NO: 165314 - RNA, 19 nt, Homo sapiens
agaccuacuugacgucaug

SEQ ID NO: 165315 - RNA, 19 nt, Homo sapiens
gaugacaauggccaagauu

SEQ ID NO: 165316 - RNA, 19 nt, Homo sapiens
gaccagauccacguugaug

SEQ ID NO: 165317 - RNA, 19 nt, Homo sapiens
cacaucuguucuucaauga

SEQ ID NO: 165318 - RNA, 19 nt, Homo sapiens
aagcuaagucuuucuccua

SEQ ID NO: 165319 - RNA, 19 nt, Homo sapiens
gacagagcccauacaccua

SEQ ID NO: 165320 - RNA, 19 nt, Homo sapiens
cacccagccucacuguaaa

SEQ ID NO: 165321 - RNA, 19 nt, Homo sapiens
gguuugucuugucuucuuu

SEQ ID NO: 165322 - RNA, 19 nt, Homo sapiens
guugauaggcacucccaaa

SEQ ID NO: 165323 - RNA, 19 nt, Homo sapiens
ggauggguuugucuugucu

SEQ ID NO: 165324 - RNA, 19 nt, Homo sapiens
ccaccgagaacuccagaga

SEQ ID NO: 165325 - RNA, 19 nt, Homo sapiens
gugaauacaacacacacaa

SEQ ID NO: 165326 - RNA, 19 nt, Homo sapiens
gaggaaggcaguucaagcu

SEQ ID NO: 165327 - RNA, 19 nt, Homo sapiens
cuuagucguugguuugguu

SEQ ID NO: 165328 - RNA, 19 nt, Homo sapiens
gagcuggaguauuuauagc

SEQ ID NO: 165329 - RNA, 19 nt, Homo sapiens
gcagagauucggcagaaaa

SEQ ID NO: 165330 - RNA, 19 nt, Homo sapiens
gaagacagcuugaaccauu

SEQ ID NO: 165331 - RNA, 19 nt, Homo sapiens
ggacuuggaugagacaaua

SEQ ID NO: 165332 - RNA, 19 nt, Homo sapiens
guucacaguucuaauguaa

SEQ ID NO: 165333 - RNA, 19 nt, Homo sapiens
ggacagugcacgugccuua

SEQ ID NO: 165334 - RNA, 19 nt, Homo sapiens
ugaaggagauguacaauac

SEQ ID NO: 165335 - RNA, 19 nt, Homo sapiens
gagaacaucuacagugcaa

SEQ ID NO: 165336 - RNA, 19 nt, Homo sapiens
gaaggcaguucaagcuguu

SEQ ID NO: 165337 - RNA, 19 nt, Homo sapiens
ugacaauggccaagauuua

SEQ ID NO: 165338 - RNA, 19 nt, Homo sapiens
gaaggaaaguacccaacau

SEQ ID NO: 165339 - RNA, 19 nt, Homo sapiens
gagacgacguguccaguga

SEQ ID NO: 165340 - RNA, 19 nt, Homo sapiens
gcacgugccuuacgcuaca

SEQ ID NO: 165341 - RNA, 19 nt, Homo sapiens
caacauuggcuucggagua

SEQ ID NO: 165342 - RNA, 19 nt, Homo sapiens
aaacagcgauugucuggau

SEQ ID NO: 165343 - RNA, 19 nt, Homo sapiens
ccaaaguccugcuauaugg

SEQ ID NO: 165344 - RNA, 19 nt, Homo sapiens
caccaccacucaacuaauu

SEQ ID NO: 165345 - RNA, 19 nt, Homo sapiens
gcauuggccuuaugaugga

SEQ ID NO: 165346 - RNA, 19 nt, Homo sapiens
ggacauuugcauccagaua

SEQ ID NO: 165347 - RNA, 19 nt, Homo sapiens
gaauacaacacacacaaug

SEQ ID NO: 165348 - RNA, 19 nt, Homo sapiens
gacaaggcaucaccaaauc

SEQ ID NO: 165349 - RNA, 19 nt, Homo sapiens
gcacuaaaccucaucaacu

SEQ ID NO: 165350 - RNA, 19 nt, Homo sapiens
gcugacggcuuccacaguu

SEQ ID NO: 165351 - RNA, 19 nt, Homo sapiens
acacaucuguucuucaaug

SEQ ID NO: 165352 - RNA, 19 nt, Homo sapiens
gcacaacaggguucuauca

SEQ ID NO: 165353 - RNA, 19 nt, Homo sapiens
ggacaaucauucuuugaac

SEQ ID NO: 165354 - RNA, 19 nt, Homo sapiens
cccuggagcuggaguauuu

SEQ ID NO: 165355 - RNA, 19 nt, Homo sapiens
gaucggugaugguguggaa

SEQ ID NO: 165356 - RNA, 19 nt, Homo sapiens
gaaaugguagaacuaguga

SEQ ID NO: 165357 - RNA, 19 nt, Homo sapiens
gacaauggccaagauuuaa

SEQ ID NO: 165358 - RNA, 19 nt, Homo sapiens
gcgauugucuggauaaacu

SEQ ID NO: 165359 - RNA, 19 nt, Homo sapiens
ggaaaugguagaacuagug

SEQ ID NO: 165360 - RNA, 19 nt, Homo sapiens
auacacaucuguucuucaa

SEQ ID NO: 165361 - RNA, 19 nt, Homo sapiens
gggaaggaaugggugcuuu

SEQ ID NO: 165362 - RNA, 19 nt, Homo sapiens
gacaaucauucuuugaaca

SEQ ID NO: 165363 - RNA, 19 nt, Homo sapiens
ggucuguguuuccuauuga

SEQ ID NO: 165364 - RNA, 19 nt, Homo sapiens
gccaagauuuaagcacaua

SEQ ID NO: 165365 - RNA, 19 nt, Homo sapiens
ucacccagccucacuguaa

SEQ ID NO: 165366 - RNA, 19 nt, Homo sapiens
aggaaugggugcuuuguga

SEQ ID NO: 165367 - RNA, 19 nt, Homo sapiens
caaccagaguuccgaguca

SEQ ID NO: 165368 - RNA, 19 nt, Homo sapiens
gaauuaugcucuuguaccu

SEQ ID NO: 165369 - RNA, 19 nt, Homo sapiens
uacaauaccuacaagaaca

SEQ ID NO: 165370 - RNA, 19 nt, Homo sapiens
gaaacgaaugguacaagga

SEQ ID NO: 165371 - RNA, 19 nt, Homo sapiens
caaggaaaugguagaacua

SEQ ID NO: 165372 - RNA, 19 nt, Homo sapiens
gugucuaccuggaaugaaa

SEQ ID NO: 165373 - RNA, 19 nt, Homo sapiens
gugaaggagauguacaaua

SEQ ID NO: 165374 - RNA, 19 nt, Homo sapiens
cgaaagagggagacacaga

SEQ ID NO: 165375 - RNA, 19 nt, Homo sapiens
gcacaagccuauggaaucc

SEQ ID NO: 165376 - RNA, 19 nt, Homo sapiens
gaacaaaagcaaggaauug

SEQ ID NO: 165377 - RNA, 19 nt, Homo sapiens
ccucaaaccacaauaggaa

SEQ ID NO: 165378 - RNA, 19 nt, Homo sapiens
gaaugggugcuuugugaug

SEQ ID NO: 165379 - RNA, 19 nt, Homo sapiens
ggaaggaaugggugcuuug

SEQ ID NO: 165380 - RNA, 19 nt, Homo sapiens
gggacaaucauucuuugaa

SEQ ID NO: 165381 - RNA, 19 nt, Homo sapiens
guaagacucacagaacaaa

SEQ ID NO: 165382 - RNA, 19 nt, Homo sapiens
gccaaaguccugcuauaug

SEQ ID NO: 165383 - RNA, 19 nt, Homo sapiens
agacaaggcaucaccaaau

SEQ ID NO: 165384 - RNA, 19 nt, Homo sapiens
gguucacaguucuaaugua

SEQ ID NO: 165385 - RNA, 19 nt, Homo sapiens
ggguuugucuugucuucuu

SEQ ID NO: 165386 - RNA, 19 nt, Homo sapiens
ggagcuggaguauuuauag

SEQ ID NO: 165387 - RNA, 19 nt, Homo sapiens
uggccaaaguccugcuaua

SEQ ID NO: 165388 - RNA, 19 nt, Homo sapiens
gcccaacugugucaaugug

SEQ ID NO: 165389 - RNA, 19 nt, Homo sapiens
ggaggauugugaccagauc

SEQ ID NO: 165390 - RNA, 19 nt, Homo sapiens
ggagugugcaccaggacua

SEQ ID NO: 165391 - RNA, 19 nt, Homo sapiens
aaacgaaugguacaaggaa

SEQ ID NO: 165392 - RNA, 19 nt, Homo sapiens
ggugcuuugugauggauaa

SEQ ID NO: 165393 - RNA, 19 nt, Homo sapiens
acaaggaaaugguagaacu

SEQ ID NO: 165394 - RNA, 19 nt, Homo sapiens
ggucaccaccacucaacua

SEQ ID NO: 165395 - RNA, 19 nt, Homo sapiens
gugaccagauccacguuga

SEQ ID NO: 165396 - RNA, 19 nt, Homo sapiens
gggucuguguuuccuauug

SEQ ID NO: 165397 - RNA, 19 nt, Homo sapiens
guacaaggaaaugguagaa

SEQ ID NO: 165398 - RNA, 19 nt, Homo sapiens
ggccaaaguccugcuauau

SEQ ID NO: 165399 - RNA, 19 nt, Homo sapiens
guacaauaccuacaagaac

SEQ ID NO: 165400 - RNA, 19 nt, Homo sapiens
gcugcuguguggacucuga

SEQ ID NO: 165401 - RNA, 19 nt, Homo sapiens
gaaggaaugggugcuuugu

SEQ ID NO: 165402 - RNA, 19 nt, Homo sapiens
uuuauggacuagucucauu

SEQ ID NO: 165403 - RNA, 19 nt, Homo sapiens
gggauggguuugucuuguc

SEQ ID NO: 165404 - RNA, 19 nt, Homo sapiens
gaaugaaacgaaugguaca

SEQ ID NO: 165405 - RNA, 19 nt, Homo sapiens
gagaggauaaugcagagau

SEQ ID NO: 165406 - RNA, 19 nt, Homo sapiens
cacuaaaccucaucaacuc

SEQ ID NO: 165407 - RNA, 19 nt, Homo sapiens
gcgcauuggccuuaugaug

SEQ ID NO: 165408 - RNA, 19 nt, Homo sapiens
ggucuaagaggagcaguga

SEQ ID NO: 165409 - RNA, 19 nt, Homo sapiens
ucacaguucuaauguaagc

SEQ ID NO: 165410 - RNA, 19 nt, Homo sapiens
aacauuggcuucggaguau

SEQ ID NO: 165411 - RNA, 19 nt, Homo sapiens
agaggauaaugcagagauu

SEQ ID NO: 165412 - RNA, 19 nt, Homo sapiens
gauuuaagcacauacaacu

SEQ ID NO: 165413 - RNA, 19 nt, Homo sapiens
acaacaggguucuaucaag

SEQ ID NO: 165414 - RNA, 19 nt, Homo sapiens
agaccuacuugacgucaug

SEQ ID NO: 165415 - RNA, 19 nt, Homo sapiens
gaugacaauggccaagauu

SEQ ID NO: 165416 - RNA, 19 nt, Homo sapiens
gaccagauccacguugaug

SEQ ID NO: 165417 - RNA, 19 nt, Homo sapiens
cacccagccucacuguaaa

SEQ ID NO: 165418 - RNA, 19 nt, Homo sapiens
cacaucuguucuucaauga

SEQ ID NO: 165419 - RNA, 19 nt, Homo sapiens
gacagagcccauacaccua

SEQ ID NO: 165420 - RNA, 19 nt, Homo sapiens
gguuugucuugucuucuuu

SEQ ID NO: 165421 - RNA, 19 nt, Homo sapiens
guugauaggcacucccaaa

SEQ ID NO: 165422 - RNA, 19 nt, Homo sapiens
ggauggguuugucuugucu

SEQ ID NO: 165423 - RNA, 19 nt, Homo sapiens
ccaccgagaacuccagaga

SEQ ID NO: 165424 - RNA, 19 nt, Homo sapiens
gugaauacaacacacacaa

SEQ ID NO: 165425 - RNA, 19 nt, Homo sapiens
gaggaaggcaguucaagcu

SEQ ID NO: 165426 - RNA, 19 nt, Homo sapiens
ugaugacaguuuccagugu

SEQ ID NO: 165427 - RNA, 19 nt, Homo sapiens
cuuagucguugguuugguu

SEQ ID NO: 165428 - RNA, 19 nt, Homo sapiens
gagcuggaguauuuauagc

SEQ ID NO: 165429 - RNA, 19 nt, Homo sapiens
gcagagauucggcagaaaa

SEQ ID NO: 165430 - RNA, 19 nt, Homo sapiens
gaagacagcuugaaccauu

SEQ ID NO: 165431 - RNA, 19 nt, Homo sapiens
ggacuuggaugagacaaua

SEQ ID NO: 165432 - RNA, 19 nt, Homo sapiens
ggaaagccgucagagguua

SEQ ID NO: 165433 - RNA, 19 nt, Homo sapiens
guucacaguucuaauguaa

SEQ ID NO: 165434 - RNA, 19 nt, Homo sapiens
ggacagugcacgugccuua

SEQ ID NO: 165435 - RNA, 19 nt, Homo sapiens
ugaaggagauguacaauac

SEQ ID NO: 165436 - RNA, 19 nt, Homo sapiens
ggaaucagauauuggacaa

SEQ ID NO: 165437 - RNA, 19 nt, Homo sapiens
gagaacaucuacagugcaa

SEQ ID NO: 165438 - RNA, 19 nt, Homo sapiens
gaaggcaguucaagcuguu

SEQ ID NO: 165439 - RNA, 19 nt, Homo sapiens
ugacaauggccaagauuua

SEQ ID NO: 165440 - RNA, 19 nt, Homo sapiens
gaaggaaaguacccaacau

SEQ ID NO: 165441 - RNA, 19 nt, Homo sapiens
gagacgacguguccaguga

SEQ ID NO: 165442 - RNA, 19 nt, Homo sapiens
cgucagagguuauaagcaa

SEQ ID NO: 165443 - RNA, 19 nt, Homo sapiens
gcacgugccuuacgcuaca

SEQ ID NO: 165444 - RNA, 19 nt, Homo sapiens
caacauuggcuucggagua

SEQ ID NO: 165445 - RNA, 19 nt, Homo sapiens
aaacagcgauugucuggau

SEQ ID NO: 165446 - RNA, 19 nt, Homo sapiens
ccaaaguccugcuauaugg

SEQ ID NO: 165447 - RNA, 19 nt, Homo sapiens
caccaccacucaacuaauu

SEQ ID NO: 165448 - RNA, 19 nt, Homo sapiens
gcauuggccuuaugaugga

SEQ ID NO: 165449 - RNA, 19 nt, Homo sapiens
ggacauuugcauccagaua

SEQ ID NO: 165450 - RNA, 19 nt, Homo sapiens
gaauacaacacacacaaug

SEQ ID NO: 165451 - RNA, 19 nt, Homo sapiens
gacaaggcaucaccaaauc

SEQ ID NO: 165452 - RNA, 19 nt, Homo sapiens
gcacuaaaccucaucaacu

SEQ ID NO: 165453 - RNA, 19 nt, Homo sapiens
gcugacggcuuccacaguu

SEQ ID NO: 165454 - RNA, 19 nt, Homo sapiens
acacaucuguucuucaaug

SEQ ID NO: 165455 - RNA, 19 nt, Homo sapiens
gcacaacaggguucuauca

SEQ ID NO: 165456 - RNA, 19 nt, Homo sapiens
ggacaaucauucuuugaac

SEQ ID NO: 165457 - RNA, 19 nt, Homo sapiens
cccuggagcuggaguauuu

SEQ ID NO: 165458 - RNA, 19 nt, Homo sapiens
gaucggugaugguguggaa

SEQ ID NO: 165459 - RNA, 19 nt, Homo sapiens
gaaaugguagaacuaguga

SEQ ID NO: 165460 - RNA, 19 nt, Homo sapiens
caaaggcccuguggcaaga

SEQ ID NO: 165461 - RNA, 19 nt, Homo sapiens
ggagggaaaucgcuuacuc

SEQ ID NO: 165462 - RNA, 19 nt, Homo sapiens
gacaauggccaagauuuaa

SEQ ID NO: 165463 - RNA, 19 nt, Homo sapiens
gaccuagggaaauuaaaua

SEQ ID NO: 165464 - RNA, 19 nt, Homo sapiens
gcgauugucuggauaaacu

SEQ ID NO: 165465 - RNA, 19 nt, Homo sapiens
ggaaaugguagaacuagug

SEQ ID NO: 165466 - RNA, 19 nt, Homo sapiens
auacacaucuguucuucaa

SEQ ID NO: 165467 - RNA, 19 nt, Homo sapiens
ggaacucuuugcuuuaucu

SEQ ID NO: 165468 - RNA, 19 nt, Homo sapiens
gggaaggaaugggugcuuu

SEQ ID NO: 165469 - RNA, 19 nt, Homo sapiens
gacaaucauucuuugaaca

SEQ ID NO: 165470 - RNA, 19 nt, Homo sapiens
ggucuguguuuccuauuga

SEQ ID NO: 165471 - RNA, 19 nt, Homo sapiens
gccaagauuuaagcacaua

SEQ ID NO: 165472 - RNA, 19 nt, Homo sapiens
ucacccagccucacuguaa

SEQ ID NO: 165473 - RNA, 19 nt, Homo sapiens
ggaacagcauguacaaagg

SEQ ID NO: 165474 - RNA, 19 nt, Homo sapiens
aggaaugggugcuuuguga

SEQ ID NO: 165475 - RNA, 19 nt, Homo sapiens
ggagaccuagggaaauuaa

SEQ ID NO: 165476 - RNA, 19 nt, Homo sapiens
caaccagaguuccgaguca

SEQ ID NO: 165477 - RNA, 19 nt, Homo sapiens
gaauuaugcucuuguaccu

SEQ ID NO: 165478 - RNA, 19 nt, Homo sapiens
gcaggagggaaaucgcuua

SEQ ID NO: 165479 - RNA, 19 nt, Homo sapiens
uacaauaccuacaagaaca

SEQ ID NO: 165480 - RNA, 19 nt, Homo sapiens
gaaagcugcaggagggaaa

SEQ ID NO: 165481 - RNA, 19 nt, Homo sapiens
caaggaaaugguagaacua

SEQ ID NO: 165482 - RNA, 19 nt, Homo sapiens
gcagagggaacagcaugua

SEQ ID NO: 165483 - RNA, 19 nt, Homo sapiens
gugaaggagauguacaaua

SEQ ID NO: 165484 - RNA, 19 nt, Homo sapiens
cgaaagagggagacacaga

SEQ ID NO: 165485 - RNA, 19 nt, Homo sapiens
gcacaagccuauggaaucc

SEQ ID NO: 165486 - RNA, 19 nt, Homo sapiens
gugcuggaaucagauauug

SEQ ID NO: 165487 - RNA, 19 nt, Homo sapiens
gaacaaaagcaaggaauug

SEQ ID NO: 165488 - RNA, 19 nt, Homo sapiens
gggaacagcauguacaaag

SEQ ID NO: 165489 - RNA, 19 nt, Homo sapiens
gaaugggugcuuugugaug

SEQ ID NO: 165490 - RNA, 19 nt, Homo sapiens
ggaaggaaugggugcuuug

SEQ ID NO: 165491 - RNA, 19 nt, Homo sapiens
gggacaaucauucuuugaa

SEQ ID NO: 165492 - RNA, 19 nt, Homo sapiens
guaagacucacagaacaaa

SEQ ID NO: 165493 - RNA, 19 nt, Homo sapiens
gccaaaguccugcuauaug

SEQ ID NO: 165494 - RNA, 19 nt, Homo sapiens
agacaaggcaucaccaaau

SEQ ID NO: 165495 - RNA, 19 nt, Homo sapiens
gaaauccugccggaacuga

SEQ ID NO: 165496 - RNA, 19 nt, Homo sapiens
gguucacaguucuaaugua

SEQ ID NO: 165497 - RNA, 19 nt, Homo sapiens
ggguuugucuugucuucuu

SEQ ID NO: 165498 - RNA, 19 nt, Homo sapiens
ggagcuggaguauuuauag

SEQ ID NO: 165499 - RNA, 19 nt, Homo sapiens
uggccaaaguccugcuaua

SEQ ID NO: 165500 - RNA, 19 nt, Homo sapiens
gcccaacugugucaaugug

SEQ ID NO: 165501 - RNA, 19 nt, Homo sapiens
ggaggauugugaccagauc

SEQ ID NO: 165502 - RNA, 19 nt, Homo sapiens
caagccacguggacugaga

SEQ ID NO: 165503 - RNA, 19 nt, Homo sapiens
ggagugugcaccaggacua

SEQ ID NO: 165504 - RNA, 19 nt, Homo sapiens
gcaauggaaagccgucaga

SEQ ID NO: 165505 - RNA, 19 nt, Homo sapiens
ggugcuuugugauggauaa

SEQ ID NO: 165506 - RNA, 19 nt, Homo sapiens
ggucaccaccacucaacua

SEQ ID NO: 165507 - RNA, 19 nt, Homo sapiens
acaaggaaaugguagaacu

SEQ ID NO: 165508 - RNA, 19 nt, Homo sapiens
gagguacaaggaaauggua

SEQ ID NO: 165509 - RNA, 19 nt, Homo sapiens
gugaccagauccacguuga

SEQ ID NO: 165510 - RNA, 19 nt, Homo sapiens
aagcaaggaugagguacaa

SEQ ID NO: 165511 - RNA, 19 nt, Homo sapiens
gggucuguguuuccuauug

SEQ ID NO: 165512 - RNA, 19 nt, Homo sapiens
guacaaggaaaugguagaa

SEQ ID NO: 165513 - RNA, 19 nt, Homo sapiens
aggaugagguacaaggaaa

SEQ ID NO: 165514 - RNA, 19 nt, Homo sapiens
ggccaaaguccugcuauau

SEQ ID NO: 165515 - RNA, 19 nt, Homo sapiens
guacaauaccuacaagaac

SEQ ID NO: 165516 - RNA, 19 nt, Homo sapiens
gcugcuguguggacucuga

SEQ ID NO: 165517 - RNA, 19 nt, Homo sapiens
uauaagcaaggaugaggua

SEQ ID NO: 165518 - RNA, 19 nt, Homo sapiens
gaaggaaugggugcuuugu

SEQ ID NO: 165519 - RNA, 19 nt, Homo sapiens
gagggaacagcauguacaa

SEQ ID NO: 165520 - RNA, 19 nt, Homo sapiens
uuuauggacuagucucauu

SEQ ID NO: 165521 - RNA, 19 nt, Homo sapiens
gggauggguuugucuuguc

SEQ ID NO: 165522 - RNA, 19 nt, Homo sapiens
gagaggauaaugcagagau

SEQ ID NO: 165523 - RNA, 19 nt, Homo sapiens
cacuaaaccucaucaacuc

SEQ ID NO: 165524 - RNA, 19 nt, Homo sapiens
gcgcauuggccuuaugaug

SEQ ID NO: 165525 - RNA, 19 nt, Homo sapiens
ggucuaagaggagcaguga

SEQ ID NO: 165526 - RNA, 19 nt, Homo sapiens
gaaagccgucagagguuau

SEQ ID NO: 165527 - RNA, 19 nt, Homo sapiens
ucggaacucuuugcuuuau

SEQ ID NO: 165528 - RNA, 19 nt, Homo sapiens
ucacaguucuaauguaagc

SEQ ID NO: 165529 - RNA, 19 nt, Homo sapiens
aacauuggcuucggaguau

SEQ ID NO: 165530 - RNA, 19 nt, Homo sapiens
gaaagaaagucacauaugu

SEQ ID NO: 165531 - RNA, 19 nt, Homo sapiens
ggaagaagagcaagauuua

SEQ ID NO: 165532 - RNA, 19 nt, Homo sapiens
gaaagugguuuaauucaga

SEQ ID NO: 165533 - RNA, 19 nt, Homo sapiens
gauuauaccucacaaaugu

SEQ ID NO: 165534 - RNA, 19 nt, Homo sapiens
gagaacaucuauagugcua

SEQ ID NO: 165535 - RNA, 19 nt, Homo sapiens
ggaaccaacugagaacuuu

SEQ ID NO: 165536 - RNA, 19 nt, Homo sapiens
ccaagacagugaauuagaa

SEQ ID NO: 165537 - RNA, 19 nt, Homo sapiens
ggagaagccuagugucaug

SEQ ID NO: 165538 - RNA, 19 nt, Homo sapiens
gaaagucacauauguagug

SEQ ID NO: 165539 - RNA, 19 nt, Homo sapiens
gauccuaugcccagaaaua

SEQ ID NO: 165540 - RNA, 19 nt, Homo sapiens
ggaaagaaagucacauaug

SEQ ID NO: 165541 - RNA, 19 nt, Homo sapiens
gcagagagcaccacauuag

SEQ ID NO: 165542 - RNA, 19 nt, Homo sapiens
gaaagaauugugugaaugu

SEQ ID NO: 165543 - RNA, 19 nt, Homo sapiens
guuaggaacugcauuaaag

SEQ ID NO: 165544 - RNA, 19 nt, Homo sapiens
ggaaaggacccaacaguag

SEQ ID NO: 165545 - RNA, 19 nt, Homo sapiens
aaggagagcugcuuugaga

SEQ ID NO: 165546 - RNA, 19 nt, Homo sapiens
gagcagaaauugaaguuuu

SEQ ID NO: 165547 - RNA, 19 nt, Homo sapiens
gagauuaagagcagaaauu

SEQ ID NO: 165548 - RNA, 19 nt, Homo sapiens
gugauuggcucagguuuaa

SEQ ID NO: 165549 - RNA, 19 nt, Homo sapiens
gcacauauucucucaguuc

SEQ ID NO: 165550 - RNA, 19 nt, Homo sapiens
gaaagugagagaaaucuau

SEQ ID NO: 165551 - RNA, 19 nt, Homo sapiens
cagaggaaauuaugacaug

SEQ ID NO: 165552 - RNA, 19 nt, Homo sapiens
gcccagcacauuauucuua

SEQ ID NO: 165553 - RNA, 19 nt, Homo sapiens
ggccaagguucuccuauau

SEQ ID NO: 165554 - RNA, 19 nt, Homo sapiens
ucacaaauguauucugcaa

SEQ ID NO: 165555 - RNA, 19 nt, Homo sapiens
gcaauccagucacauaagu

SEQ ID NO: 165556 - RNA, 19 nt, Homo sapiens
cagaaagaauugugugaau

SEQ ID NO: 165557 - RNA, 19 nt, Homo sapiens
gaacugcauuaaaguccuu

SEQ ID NO: 165558 - RNA, 19 nt, Homo sapiens
uggacgagaugaagaaauu

SEQ ID NO: 165559 - RNA, 19 nt, Homo sapiens
ugaagaaauugcagccaaa

SEQ ID NO: 165560 - RNA, 19 nt, Homo sapiens
gaaggaagcacugcagaga

SEQ ID NO: 165561 - RNA, 19 nt, Homo sapiens
ccacauaccagucggagaa

SEQ ID NO: 165562 - RNA, 19 nt, Homo sapiens
gaaaggacccaacaguagu

SEQ ID NO: 165563 - RNA, 19 nt, Homo sapiens
ugaauuagaacggguauuu

SEQ ID NO: 165564 - RNA, 19 nt, Homo sapiens
ucaccaggcuuuagagcuu

SEQ ID NO: 165565 - RNA, 19 nt, Homo sapiens
gauuggagauggacgagau

SEQ ID NO: 165566 - RNA, 19 nt, Homo sapiens
ccaagguucuccuauaugg

SEQ ID NO: 165567 - RNA, 19 nt, Homo sapiens
caaguaagcaauccagaug

SEQ ID NO: 165568 - RNA, 19 nt, Homo sapiens
ggagagcugcuuugagaga

SEQ ID NO: 165569 - RNA, 19 nt, Homo sapiens
uggccaagguucuccuaua

SEQ ID NO: 165570 - RNA, 19 nt, Homo sapiens
aggaagcacugcagagauu

SEQ ID NO: 165571 - RNA, 19 nt, Homo sapiens
ggacccaacaguagugauu

SEQ ID NO: 165572 - RNA, 19 nt, Homo sapiens
gauuaucccaccuauacua

SEQ ID NO: 165573 - RNA, 19 nt, Homo sapiens
gagagagacuugcaaucca

SEQ ID NO: 165574 - RNA, 19 nt, Homo sapiens
agaauugugucaagguuug

SEQ ID NO: 165575 - RNA, 19 nt, Homo sapiens
ggcugauacucaucuauuu

SEQ ID NO: 165576 - RNA, 19 nt, Homo sapiens
aaacaugacuagcaagaac

SEQ ID NO: 165577 - RNA, 19 nt, Homo sapiens
cacaaaccauggagaccua

SEQ ID NO: 165578 - RNA, 19 nt, Homo sapiens
gaagcacugcagagauuaa

SEQ ID NO: 165579 - RNA, 19 nt, Homo sapiens
ggaaagugagagaaaucua

SEQ ID NO: 165580 - RNA, 19 nt, Homo sapiens
ugaaguggcugauacucau

SEQ ID NO: 165581 - RNA, 19 nt, Homo sapiens
ggaaagcugaugccacuuc

SEQ ID NO: 165582 - RNA, 19 nt, Homo sapiens
gagcugcuuugagagaauu

SEQ ID NO: 165583 - RNA, 19 nt, Homo sapiens
agaaagaauugugugaaug

SEQ ID NO: 165584 - RNA, 19 nt, Homo sapiens
gaaagcugaugccacuucu

SEQ ID NO: 165585 - RNA, 19 nt, Homo sapiens
gagagcaaacuauaaguca

SEQ ID NO: 165586 - RNA, 19 nt, Homo sapiens
gcaggaaucaggagagcaa

SEQ ID NO: 165587 - RNA, 19 nt, Homo sapiens
gagagcugcuuugagagaa

SEQ ID NO: 165588 - RNA, 19 nt, Homo sapiens
guucuuaccugcacuacag

SEQ ID NO: 165589 - RNA, 19 nt, Homo sapiens
cguauggacuaccuccuuu

SEQ ID NO: 165590 - RNA, 19 nt, Homo sapiens
guaaggagagcugcuuuga

SEQ ID NO: 165591 - RNA, 19 nt, Homo sapiens
ggaagcacugcagagauua

SEQ ID NO: 165592 - RNA, 19 nt, Homo sapiens
gucaagguuuggaaagaaa

SEQ ID NO: 165593 - RNA, 19 nt, Homo sapiens
ugaauguucugaucacuac

SEQ ID NO: 165594 - RNA, 19 nt, Homo sapiens
gauaucuacuucuucuaca

SEQ ID NO: 165595 - RNA, 19 nt, Homo sapiens
gagaauugugucaagguuu

SEQ ID NO: 165596 - RNA, 19 nt, Homo sapiens
agaggagugugaccaggua

SEQ ID NO: 165597 - RNA, 19 nt, Homo sapiens
uggcucagguuuaacaaug

SEQ ID NO: 165598 - RNA, 19 nt, Homo sapiens
ggagacccuucuacaaguc

SEQ ID NO: 165599 - RNA, 19 nt, Homo sapiens
uaucccaccuauacuauuc

SEQ ID NO: 165600 - RNA, 19 nt, Homo sapiens
gcaucucaaaccaggauua

SEQ ID NO: 165601 - RNA, 19 nt, Homo sapiens
cuucaaaccuucccauguc

SEQ ID NO: 165602 - RNA, 19 nt, Homo sapiens
caucuauagugcuaccaaa

SEQ ID NO: 165603 - RNA, 19 nt, Homo sapiens
gagagaaaucuaugauaag

SEQ ID NO: 165604 - RNA, 19 nt, Homo sapiens
gaugaucaguccaggaaaa

SEQ ID NO: 165605 - RNA, 19 nt, Homo sapiens
gcaauccagaugucaguga

SEQ ID NO: 165606 - RNA, 19 nt, Homo sapiens
uggacuaggagaaauauuu

SEQ ID NO: 165607 - RNA, 19 nt, Homo sapiens
uggaagaagagcaagauuu

SEQ ID NO: 165608 - RNA, 19 nt, Homo sapiens
gugagagaaaucuaugaua

SEQ ID NO: 165609 - RNA, 19 nt, Homo sapiens
ccagguacauguggaagau

SEQ ID NO: 165610 - RNA, 19 nt, Homo sapiens
uggaaaggacccaacagua

SEQ ID NO: 165611 - RNA, 19 nt, Homo sapiens
acaaaugccagccugauau

SEQ ID NO: 165612 - RNA, 19 nt, Homo sapiens
cacaaaugccagccugaua

SEQ ID NO: 165613 - RNA, 19 nt, Homo sapiens
gcucagguuuaacaaugga

SEQ ID NO: 165614 - RNA, 19 nt, Homo sapiens
ggagagcaaacuauaaguc

SEQ ID NO: 165615 - RNA, 19 nt, Homo sapiens
aaauauugguccucaugga

SEQ ID NO: 165616 - RNA, 19 nt, Homo sapiens
ugucaagguuuggaaagaa

SEQ ID NO: 165617 - RNA, 19 nt, Homo sapiens
gauuaagagcagaaauuga

SEQ ID NO: 165618 - RNA, 19 nt, Homo sapiens
gcagagauuaagagcagaa

SEQ ID NO: 165619 - RNA, 19 nt, Homo sapiens
gagcaaacuauaagucaag

SEQ ID NO: 165620 - RNA, 19 nt, Homo sapiens
ucaggagagcaaacuauaa

SEQ ID NO: 165621 - RNA, 19 nt, Homo sapiens
agagaauugugucaagguu

SEQ ID NO: 165622 - RNA, 19 nt, Homo sapiens
gagauggacgagaugaaga

SEQ ID NO: 165623 - RNA, 19 nt, Homo sapiens
gguuaggaacugcauuaaa

SEQ ID NO: 165624 - RNA, 19 nt, Homo sapiens
gaaucaggagagcaaacua

SEQ ID NO: 165625 - RNA, 19 nt, Homo sapiens
caggucagacuaacaguga

SEQ ID NO: 165626 - RNA, 19 nt, Homo sapiens
ccugauaucuacuucuucu

SEQ ID NO: 165627 - RNA, 19 nt, Homo sapiens
gcacaaaugccagccugau

SEQ ID NO: 165628 - RNA, 19 nt, Homo sapiens
gacaugcaccgauuacauc

SEQ ID NO: 165629 - RNA, 19 nt, Homo sapiens
gcaaacuauaagucaagua

SEQ ID NO: 165630 - RNA, 19 nt, Homo sapiens
ggaagaagagcaagauuua

SEQ ID NO: 165631 - RNA, 19 nt, Homo sapiens
gaaagugguuuaauucaga

SEQ ID NO: 165632 - RNA, 19 nt, Homo sapiens
gauuauaccucacaaaugu

SEQ ID NO: 165633 - RNA, 19 nt, Homo sapiens
gagaacaucuauagugcua

SEQ ID NO: 165634 - RNA, 19 nt, Homo sapiens
ucacuggccuugcaauaaa

SEQ ID NO: 165635 - RNA, 19 nt, Homo sapiens
ccaagacagugaauuagaa

SEQ ID NO: 165636 - RNA, 19 nt, Homo sapiens
ggagaagccuagugucaug

SEQ ID NO: 165637 - RNA, 19 nt, Homo sapiens
gauccuaugcccagaaaua

SEQ ID NO: 165638 - RNA, 19 nt, Homo sapiens
ucaaugacuuagagacaua

SEQ ID NO: 165639 - RNA, 19 nt, Homo sapiens
gcagagagcaccacauuag

SEQ ID NO: 165640 - RNA, 19 nt, Homo sapiens
gaaagaauugugugaaugu

SEQ ID NO: 165641 - RNA, 19 nt, Homo sapiens
guuaggaacugcauuaaag

SEQ ID NO: 165642 - RNA, 19 nt, Homo sapiens
ggaaaggacccaacaguag

SEQ ID NO: 165643 - RNA, 19 nt, Homo sapiens
gagcagaaauugaaguuuu

SEQ ID NO: 165644 - RNA, 19 nt, Homo sapiens
gagauuaagagcagaaauu

SEQ ID NO: 165645 - RNA, 19 nt, Homo sapiens
gugauuggcucagguuuaa

SEQ ID NO: 165646 - RNA, 19 nt, Homo sapiens
gcacauauucucucaguuc

SEQ ID NO: 165647 - RNA, 19 nt, Homo sapiens
gaaagugagagaaaucuau

SEQ ID NO: 165648 - RNA, 19 nt, Homo sapiens
cagaggaaauuaugacaug

SEQ ID NO: 165649 - RNA, 19 nt, Homo sapiens
gcccagcacauuauucuua

SEQ ID NO: 165650 - RNA, 19 nt, Homo sapiens
ggccaagguucuccuauau

SEQ ID NO: 165651 - RNA, 19 nt, Homo sapiens
ucacaaauguauucugcaa

SEQ ID NO: 165652 - RNA, 19 nt, Homo sapiens
gcaauccagucacauaagu

SEQ ID NO: 165653 - RNA, 19 nt, Homo sapiens
cagaaagaauugugugaau

SEQ ID NO: 165654 - RNA, 19 nt, Homo sapiens
gaacugcauuaaaguccuu

SEQ ID NO: 165655 - RNA, 19 nt, Homo sapiens
gaaggaagcacugcagaga

SEQ ID NO: 165656 - RNA, 19 nt, Homo sapiens
gaauuugaccugaaugugu

SEQ ID NO: 165657 - RNA, 19 nt, Homo sapiens
ugaagaauuugaccugaau

SEQ ID NO: 165658 - RNA, 19 nt, Homo sapiens
ccacauaccagucggagaa

SEQ ID NO: 165659 - RNA, 19 nt, Homo sapiens
gaaaggacccaacaguagu

SEQ ID NO: 165660 - RNA, 19 nt, Homo sapiens
ugaauuagaacggguauuu

SEQ ID NO: 165661 - RNA, 19 nt, Homo sapiens
ccaggagugugaccaggua

SEQ ID NO: 165662 - RNA, 19 nt, Homo sapiens
ccaagguucuccuauaugg

SEQ ID NO: 165663 - RNA, 19 nt, Homo sapiens
gugaagaauuugaccugaa

SEQ ID NO: 165664 - RNA, 19 nt, Homo sapiens
caaguaagcaauccagaug

SEQ ID NO: 165665 - RNA, 19 nt, Homo sapiens
uggccaagguucuccuaua

SEQ ID NO: 165666 - RNA, 19 nt, Homo sapiens
aggaagcacugcagagauu

SEQ ID NO: 165667 - RNA, 19 nt, Homo sapiens
ggacccaacaguagugauu

SEQ ID NO: 165668 - RNA, 19 nt, Homo sapiens
gauuaucccaccuauacua

SEQ ID NO: 165669 - RNA, 19 nt, Homo sapiens
gagagagacuugcaaucca

SEQ ID NO: 165670 - RNA, 19 nt, Homo sapiens
ggcugauacucaucuauuu

SEQ ID NO: 165671 - RNA, 19 nt, Homo sapiens
aaacaugacuagcaagaac

SEQ ID NO: 165672 - RNA, 19 nt, Homo sapiens
gaagcacugcagagauuaa

SEQ ID NO: 165673 - RNA, 19 nt, Homo sapiens
ggaaagugagagaaaucua

SEQ ID NO: 165674 - RNA, 19 nt, Homo sapiens
ugaaguggcugauacucau

SEQ ID NO: 165675 - RNA, 19 nt, Homo sapiens
ggaaagcugaugccacuuc

SEQ ID NO: 165676 - RNA, 19 nt, Homo sapiens
agaaagaauugugugaaug

SEQ ID NO: 165677 - RNA, 19 nt, Homo sapiens
gaaagcugaugccacuucu

SEQ ID NO: 165678 - RNA, 19 nt, Homo sapiens
gagagcaaacuauaaguca

SEQ ID NO: 165679 - RNA, 19 nt, Homo sapiens
gcaggaaucaggagagcaa

SEQ ID NO: 165680 - RNA, 19 nt, Homo sapiens
guucuuaccugcacuacag

SEQ ID NO: 165681 - RNA, 19 nt, Homo sapiens
cguauggacuaccuccuuu

SEQ ID NO: 165682 - RNA, 19 nt, Homo sapiens
ggaagcacugcagagauua

SEQ ID NO: 165683 - RNA, 19 nt, Homo sapiens
ugaauguucugaucacuac

SEQ ID NO: 165684 - RNA, 19 nt, Homo sapiens
gauaucuacuucuucuaca

SEQ ID NO: 165685 - RNA, 19 nt, Homo sapiens
uggcucagguuuaacaaug

SEQ ID NO: 165686 - RNA, 19 nt, Homo sapiens
ggagacccuucuacaaguc

SEQ ID NO: 165687 - RNA, 19 nt, Homo sapiens
uaucccaccuauacuauuc

SEQ ID NO: 165688 - RNA, 19 nt, Homo sapiens
gcaucucaaaccaggauua

SEQ ID NO: 165689 - RNA, 19 nt, Homo sapiens
cuucaaaccuucccauguc

SEQ ID NO: 165690 - RNA, 19 nt, Homo sapiens
caucuauagugcuaccaaa

SEQ ID NO: 165691 - RNA, 19 nt, Homo sapiens
gagagaaaucuaugauaag

SEQ ID NO: 165692 - RNA, 19 nt, Homo sapiens
gaugaucaguccaggaaaa

SEQ ID NO: 165693 - RNA, 19 nt, Homo sapiens
gcaauccagaugucaguga

SEQ ID NO: 165694 - RNA, 19 nt, Homo sapiens
uggacuaggagaaauauuu

SEQ ID NO: 165695 - RNA, 19 nt, Homo sapiens
gugagagaaaucuaugaua

SEQ ID NO: 165696 - RNA, 19 nt, Homo sapiens
ccagguacauguggaagau

SEQ ID NO: 165697 - RNA, 19 nt, Homo sapiens
uggaaaggacccaacagua

SEQ ID NO: 165698 - RNA, 19 nt, Homo sapiens
acaaaugccagccugauau

SEQ ID NO: 165699 - RNA, 19 nt, Homo sapiens
cacaaaugccagccugaua

SEQ ID NO: 165700 - RNA, 19 nt, Homo sapiens
uggaagaagagcaagauuu

SEQ ID NO: 165701 - RNA, 19 nt, Homo sapiens
gcucagguuuaacaaugga

SEQ ID NO: 165702 - RNA, 19 nt, Homo sapiens
ggagagcaaacuauaaguc

SEQ ID NO: 165703 - RNA, 19 nt, Homo sapiens
gauuaagagcagaaauuga

SEQ ID NO: 165704 - RNA, 19 nt, Homo sapiens
gcagagauuaagagcagaa

SEQ ID NO: 165705 - RNA, 19 nt, Homo sapiens
aauuugaccugaauguguu

SEQ ID NO: 165706 - RNA, 19 nt, Homo sapiens
gagacauaguccucacuca

SEQ ID NO: 165707 - RNA, 19 nt, Homo sapiens
aaauauugguccucaugga

SEQ ID NO: 165708 - RNA, 19 nt, Homo sapiens
gagcaaacuauaagucaag

SEQ ID NO: 165709 - RNA, 19 nt, Homo sapiens
ucaggagagcaaacuauaa

SEQ ID NO: 165710 - RNA, 19 nt, Homo sapiens
ucuaugcuguuucuuguca

SEQ ID NO: 165711 - RNA, 19 nt, Homo sapiens
gguuaggaacugcauuaaa

SEQ ID NO: 165712 - RNA, 19 nt, Homo sapiens
caggucagacuaacaguga

SEQ ID NO: 165713 - RNA, 19 nt, Homo sapiens
ccugauaucuacuucuucu

SEQ ID NO: 165714 - RNA, 19 nt, Homo sapiens
gcacaaaugccagccugau

SEQ ID NO: 165715 - RNA, 19 nt, Homo sapiens
gacaugcaccgauuacauc

SEQ ID NO: 165716 - RNA, 19 nt, Homo sapiens
gcaaacuauaagucaagua

SEQ ID NO: 165717 - RNA, 19 nt, Homo sapiens
gaaucaggagagcaaacua

SEQ ID NO: 165718 - RNA, 19 nt, Homo sapiens
aagccaagaugcaggaauc

SEQ ID NO: 165719 - RNA, 19 nt, Homo sapiens
ggaugaggaaacuagcuuu

SEQ ID NO: 165720 - RNA, 19 nt, Homo sapiens
uacaguuucucaacagaug

SEQ ID NO: 165721 - RNA, 19 nt, Homo sapiens
ccagaaagaauugugugaa

SEQ ID NO: 165722 - RNA, 19 nt, Homo sapiens
gcacugcagagauuaagag

SEQ ID NO: 165723 - RNA, 19 nt, Homo sapiens
gaauuagaacggguauuuc

SEQ ID NO: 165724 - RNA, 19 nt, Homo sapiens
uccagucacauaaguauaa

SEQ ID NO: 165725 - RNA, 19 nt, Homo sapiens
gccaagcccagcacauuau

SEQ ID NO: 165726 - RNA, 19 nt, Homo sapiens
cagccaagcccagcacauu

SEQ ID NO: 165727 - RNA, 19 nt, Homo sapiens
cuacaggguuaaccacaag

SEQ ID NO: 165728 - RNA, 19 nt, Homo sapiens
ccugaaagugguuuaauuc

SEQ ID NO: 165729 - RNA, 19 nt, Homo sapiens
gguaugaaaccugaaagug

SEQ ID NO: 165730 - RNA, 19 nt, Homo sapiens
ggagauagauggagaagug

SEQ ID NO: 165731 - RNA, 19 nt, Homo sapiens
gaacacaguugcauugguu

SEQ ID NO: 165732 - RNA, 19 nt, Homo sapiens
gaaaguccauggugaagaa

SEQ ID NO: 165733 - RNA, 19 nt, Homo sapiens
ggaguuaggucuauuugaa

SEQ ID NO: 165734 - RNA, 19 nt, Homo sapiens
caaagaagaucugccagua

SEQ ID NO: 165735 - RNA, 19 nt, Homo sapiens
gaaagaguguggguucuaa

SEQ ID NO: 165736 - RNA, 19 nt, Homo sapiens
gcaaggugguuuccuguaa

SEQ ID NO: 165737 - RNA, 19 nt, Homo sapiens
ggacagagaguuacagaaa

SEQ ID NO: 165738 - RNA, 19 nt, Homo sapiens
ggagagguaucgagaacua

SEQ ID NO: 165739 - RNA, 19 nt, Homo sapiens
gcaagcaggucuuucaguu

SEQ ID NO: 165740 - RNA, 19 nt, Homo sapiens
gagaugaagugaaagaaga

SEQ ID NO: 165741 - RNA, 19 nt, Homo sapiens
caagaguccuuauguuauu

SEQ ID NO: 165742 - RNA, 19 nt, Homo sapiens
gacuguggguuccaaauua

SEQ ID NO: 165743 - RNA, 19 nt, Homo sapiens
gaaagggugaguuagaaua

SEQ ID NO: 165744 - RNA, 19 nt, Homo sapiens
gcgcuagccuguaauugua

SEQ ID NO: 165745 - RNA, 19 nt, Homo sapiens
gcacaaaacugucucaaug

SEQ ID NO: 165746 - RNA, 19 nt, Homo sapiens
ggagaaagauugguguaau

SEQ ID NO: 165747 - RNA, 19 nt, Homo sapiens
agaaacaguucccaaauga

SEQ ID NO: 165748 - RNA, 19 nt, Homo sapiens
gacaugaucuucagugcaa

SEQ ID NO: 165749 - RNA, 19 nt, Homo sapiens
ggaaaggucuaugacaaau

SEQ ID NO: 165750 - RNA, 19 nt, Homo sapiens
gcaaaccucugugguccua

SEQ ID NO: 165751 - RNA, 19 nt, Homo sapiens
caugggagaugaagugaaa

SEQ ID NO: 165752 - RNA, 19 nt, Homo sapiens
aaacccagauccucaauga

SEQ ID NO: 165753 - RNA, 19 nt, Homo sapiens
uagaauauguuccaagguu

SEQ ID NO: 165754 - RNA, 19 nt, Homo sapiens
gcggaaaggucuaugacaa

SEQ ID NO: 165755 - RNA, 19 nt, Homo sapiens
gcagaagaacgaauucauu

SEQ ID NO: 165756 - RNA, 19 nt, Homo sapiens
gcaccuacuucaacaacuu

SEQ ID NO: 165757 - RNA, 19 nt, Homo sapiens
caauaacuaugaugggaaa

SEQ ID NO: 165758 - RNA, 19 nt, Homo sapiens
ccaaauguaucacuuacug

SEQ ID NO: 165759 - RNA, 19 nt, Homo sapiens
gcaggcuucucccuucuuu

SEQ ID NO: 165760 - RNA, 19 nt, Homo sapiens
gcacuuuaaccauuucuuu

SEQ ID NO: 165761 - RNA, 19 nt, Homo sapiens
gaaaggucuaugacaaaua

SEQ ID NO: 165762 - RNA, 19 nt, Homo sapiens
gaaagcgacaugcuauuga

SEQ ID NO: 165763 - RNA, 19 nt, Homo sapiens
gauccguucugauuaguga

SEQ ID NO: 165764 - RNA, 19 nt, Homo sapiens
acagaagaauuucauguga

SEQ ID NO: 165765 - RNA, 19 nt, Homo sapiens
gaagagagggugggagauu

SEQ ID NO: 165766 - RNA, 19 nt, Homo sapiens
acaaauacauguccagcuu

SEQ ID NO: 165767 - RNA, 19 nt, Homo sapiens
cagaagaacgaauucauuu

SEQ ID NO: 165768 - RNA, 19 nt, Homo sapiens
uuaaacggcuucaggcaaa

SEQ ID NO: 165769 - RNA, 19 nt, Homo sapiens
caucaagaguccuuauguu

SEQ ID NO: 165770 - RNA, 19 nt, Homo sapiens
caaggugguuuccuguaaa

SEQ ID NO: 165771 - RNA, 19 nt, Homo sapiens
ggacaccuguucugcuguu

SEQ ID NO: 165772 - RNA, 19 nt, Homo sapiens
gcuacgccauccuuccuua

SEQ ID NO: 165773 - RNA, 19 nt, Homo sapiens
gaaagaagaagaugagacu

SEQ ID NO: 165774 - RNA, 19 nt, Homo sapiens
ccuccaaaguucuggcuua

SEQ ID NO: 165775 - RNA, 19 nt, Homo sapiens
caucaugacucagaauuuc

SEQ ID NO: 165776 - RNA, 19 nt, Homo sapiens
gcagucaaagaaucacuua

SEQ ID NO: 165777 - RNA, 19 nt, Homo sapiens
caaaugacaugaucuucag

SEQ ID NO: 165778 - RNA, 19 nt, Homo sapiens
cuugugaccucuuaauaaa

SEQ ID NO: 165779 - RNA, 19 nt, Homo sapiens
ggaacaaggagcaguaugu

SEQ ID NO: 165780 - RNA, 19 nt, Homo sapiens
ccaaaguucuggcuuagca

SEQ ID NO: 165781 - RNA, 19 nt, Homo sapiens
aacaagcgcuagccuguaa

SEQ ID NO: 165782 - RNA, 19 nt, Homo sapiens
acagagaguuacagaaaug

SEQ ID NO: 165783 - RNA, 19 nt, Homo sapiens
ccaaaguggucauggugaa

SEQ ID NO: 165784 - RNA, 19 nt, Homo sapiens
caacuguuaugccaaagug

SEQ ID NO: 165785 - RNA, 19 nt, Homo sapiens
aagaaucacuuauccugaa

SEQ ID NO: 165786 - RNA, 19 nt, Homo sapiens
aagcaggucuuucaguuug

SEQ ID NO: 165787 - RNA, 19 nt, Homo sapiens
uuaaugaggucacugaaca

SEQ ID NO: 165788 - RNA, 19 nt, Homo sapiens
agugaaaucugaauacaug

SEQ ID NO: 165789 - RNA, 19 nt, Homo sapiens
gcacaggcuuggacuagag

SEQ ID NO: 165790 - RNA, 19 nt, Homo sapiens
gaaagcaggaugacagcaa

SEQ ID NO: 165791 - RNA, 19 nt, Homo sapiens
gcuugugaccucuuaauaa

SEQ ID NO: 165792 - RNA, 19 nt, Homo sapiens
ggacuguggguuccaaauu

SEQ ID NO: 165793 - RNA, 19 nt, Homo sapiens
cagcaacuccugacagaaa

SEQ ID NO: 165794 - RNA, 19 nt, Homo sapiens
ggagaaguguuuucagauu

SEQ ID NO: 165795 - RNA, 19 nt, Homo sapiens
gacagagaguuacagaaau

SEQ ID NO: 165796 - RNA, 19 nt, Homo sapiens
gaaaagaaagcacagauug

SEQ ID NO: 165797 - RNA, 19 nt, Homo sapiens
aagaaacaguucccaaaug

SEQ ID NO: 165798 - RNA, 19 nt, Homo sapiens
ccaagaaacaguucccaaa

SEQ ID NO: 165799 - RNA, 19 nt, Homo sapiens
ggaaggagcaaaggaguau

SEQ ID NO: 165800 - RNA, 19 nt, Homo sapiens
uguaagacccagugcaaua

SEQ ID NO: 165801 - RNA, 19 nt, Homo sapiens
agaauggugucccagauga

SEQ ID NO: 165802 - RNA, 19 nt, Homo sapiens
gauccucaaugaagaaugg

SEQ ID NO: 165803 - RNA, 19 nt, Homo sapiens
gaggaggaguuaggucuau

SEQ ID NO: 165804 - RNA, 19 nt, Homo sapiens
gcaguauguugaguagaaa

SEQ ID NO: 165805 - RNA, 19 nt, Homo sapiens
ggagcaguauguugaguag

SEQ ID NO: 165806 - RNA, 19 nt, Homo sapiens
ggacuagagaggagaaaga

SEQ ID NO: 165807 - RNA, 19 nt, Homo sapiens
ggaaagcuacgccauccuu

SEQ ID NO: 165808 - RNA, 19 nt, Homo sapiens
uggcagggcucaaacugaa

SEQ ID NO: 165809 - RNA, 19 nt, Homo sapiens
acaaggagcaguauguuga

SEQ ID NO: 165810 - RNA, 19 nt, Homo sapiens
guaaucugcuuuccugucu

SEQ ID NO: 165811 - RNA, 19 nt, Homo sapiens
gauagauggagaaguguuu

SEQ ID NO: 165812 - RNA, 19 nt, Homo sapiens
gagaggacaggcuaaguga

SEQ ID NO: 165813 - RNA, 19 nt, Homo sapiens
ggagaaggcaccacauagu

SEQ ID NO: 165814 - RNA, 19 nt, Homo sapiens
caagaaacaguucccaaau

SEQ ID NO: 165815 - RNA, 19 nt, Homo sapiens
aaagcgacaugcuauugaa

SEQ ID NO: 165816 - RNA, 19 nt, Homo sapiens
gaagaucugccaguaacaa

SEQ ID NO: 165817 - RNA, 19 nt, Homo sapiens
ggaggaguuaggucuauuu

SEQ ID NO: 165818 - RNA, 19 nt, Homo sapiens
gggagaaccagccagauga

SEQ ID NO: 165819 - RNA, 19 nt, Homo sapiens
ggagaggacaggcuaagug

SEQ ID NO: 165820 - RNA, 19 nt, Homo sapiens
aaaggucuaugacaaauac

SEQ ID NO: 165821 - RNA, 19 nt, Homo sapiens
ggcacagacugcuuccuuu

SEQ ID NO: 165822 - RNA, 19 nt, Homo sapiens
ucuucaaccucaauaauga

SEQ ID NO: 165823 - RNA, 19 nt, Homo sapiens
ggacaugcacacacacuca

SEQ ID NO: 165824 - RNA, 19 nt, Homo sapiens
cuagagaggagaaagauug

SEQ ID NO: 165825 - RNA, 19 nt, Homo sapiens
ucaagaguccuuauguuau

SEQ ID NO: 165826 - RNA, 19 nt, Homo sapiens
gcaucaugacucagaauuu

SEQ ID NO: 165827 - RNA, 19 nt, Homo sapiens
gcacacugcaggaagauuc

SEQ ID NO: 165828 - RNA, 19 nt, Homo sapiens
uaaauacgacugcuuccuu

SEQ ID NO: 165829 - RNA, 19 nt, Homo sapiens
aaagcaggaugacagcaaa

SEQ ID NO: 165830 - RNA, 19 nt, Homo sapiens
caaagaaucuagcaucaua

SEQ ID NO: 165831 - RNA, 19 nt, Homo sapiens
caacauagauggaccaaau

SEQ ID NO: 165832 - RNA, 19 nt, Homo sapiens
gaggacggcuucccaauaa

SEQ ID NO: 165833 - RNA, 19 nt, Homo sapiens
gaauguggguuuauaaaug

SEQ ID NO: 165834 - RNA, 19 nt, Homo sapiens
gcugaagccucaauguuua

SEQ ID NO: 165835 - RNA, 19 nt, Homo sapiens
gagggaaaguguaugauaa

SEQ ID NO: 165836 - RNA, 19 nt, Homo sapiens
caauaaagaugaagccaaa

SEQ ID NO: 165837 - RNA, 19 nt, Homo sapiens
cagacgagcugaugaagua

SEQ ID NO: 165838 - RNA, 19 nt, Homo sapiens
gaacaugcaguuugaaauu

SEQ ID NO: 165839 - RNA, 19 nt, Homo sapiens
gaacggaaaucuuaaacca

SEQ ID NO: 165840 - RNA, 19 nt, Homo sapiens
gcagaaagauacagcugaa

SEQ ID NO: 165841 - RNA, 19 nt, Homo sapiens
ggaaaucccuugacaucug

SEQ ID NO: 165842 - RNA, 19 nt, Homo sapiens
gaaugcaguugcuucagua

SEQ ID NO: 165843 - RNA, 19 nt, Homo sapiens
caacacaagucaucccauu

SEQ ID NO: 165844 - RNA, 19 nt, Homo sapiens
guagacagguguaugaguu

SEQ ID NO: 165845 - RNA, 19 nt, Homo sapiens
gcacuuacuaugacaauuu

SEQ ID NO: 165846 - RNA, 19 nt, Homo sapiens
ucaccgagaugauaaagaa

SEQ ID NO: 165847 - RNA, 19 nt, Homo sapiens
caucguaagugcaauuauu

SEQ ID NO: 165848 - RNA, 19 nt, Homo sapiens
gauagagaauguggguuua

SEQ ID NO: 165849 - RNA, 19 nt, Homo sapiens
gcaauaaugcaguauggua

SEQ ID NO: 165850 - RNA, 19 nt, Homo sapiens
uaacggugaucacaggaua

SEQ ID NO: 165851 - RNA, 19 nt, Homo sapiens
gaagagggaaaguguauga

SEQ ID NO: 165852 - RNA, 19 nt, Homo sapiens
aaacagcucuagacaacaa

SEQ ID NO: 165853 - RNA, 19 nt, Homo sapiens
ugaaugcccuuggucaaua

SEQ ID NO: 165854 - RNA, 19 nt, Homo sapiens
ucaaagauccugugcagaa

SEQ ID NO: 165855 - RNA, 19 nt, Homo sapiens
uuaaugugcuggaaucaaa

SEQ ID NO: 165856 - RNA, 19 nt, Homo sapiens
ucagagagagcaaagcuua

SEQ ID NO: 165857 - RNA, 19 nt, Homo sapiens
ggauagagaauguggguuu

SEQ ID NO: 165858 - RNA, 19 nt, Homo sapiens
gaucacaggauagguauuu

SEQ ID NO: 165859 - RNA, 19 nt, Homo sapiens
gcaaaucauucgguaaauc

SEQ ID NO: 165860 - RNA, 19 nt, Homo sapiens
caagucaucccauuaaaga

SEQ ID NO: 165861 - RNA, 19 nt, Homo sapiens
caacacccaacacuuauaa

SEQ ID NO: 165862 - RNA, 19 nt, Homo sapiens
gggcacagcagaagaacua

SEQ ID NO: 165863 - RNA, 19 nt, Homo sapiens
uagagaauguggguuuaua

SEQ ID NO: 165864 - RNA, 19 nt, Homo sapiens
gguggaagaugaaacuguu

SEQ ID NO: 165865 - RNA, 19 nt, Homo sapiens
agaugaagcugacagaaga

SEQ ID NO: 165866 - RNA, 19 nt, Homo sapiens
caaagauccugugcagaaa

SEQ ID NO: 165867 - RNA, 19 nt, Homo sapiens
gagagaacaaugauaaaga

SEQ ID NO: 165868 - RNA, 19 nt, Homo sapiens
auaaagaacucaccgaaca

SEQ ID NO: 165869 - RNA, 19 nt, Homo sapiens
gcagaagaacuaaaggaaa

SEQ ID NO: 165870 - RNA, 19 nt, Homo sapiens
gagcuccucugaagcaaau

SEQ ID NO: 165871 - RNA, 19 nt, Homo sapiens
gaacacagaaacagcucua

SEQ ID NO: 165872 - RNA, 19 nt, Homo sapiens
agaaacagcucuagacaac

SEQ ID NO: 165873 - RNA, 19 nt, Homo sapiens
gagaauguggguuuauaaa

SEQ ID NO: 165874 - RNA, 19 nt, Homo sapiens
caaaggauacagacaguga

SEQ ID NO: 165875 - RNA, 19 nt, Homo sapiens
gugcuggaaucaaaggaua

SEQ ID NO: 165876 - RNA, 19 nt, Homo sapiens
cgauugggcugccgcguuu

SEQ ID NO: 165877 - RNA, 19 nt, Homo sapiens
agaauacuguggagagauu

SEQ ID NO: 165878 - RNA, 19 nt, Homo sapiens
gcagcuuucuguucaacuu

SEQ ID NO: 165879 - RNA, 19 nt, Homo sapiens
gacccugaccucugucuua

SEQ ID NO: 165880 - RNA, 19 nt, Homo sapiens
cuaaccauguuuacaacua

SEQ ID NO: 165881 - RNA, 19 nt, Homo sapiens
ccucaauguuuccagauaa

SEQ ID NO: 165882 - RNA, 19 nt, Homo sapiens
gaaugcccuuggucaauau

SEQ ID NO: 165883 - RNA, 19 nt, Homo sapiens
cgaguacugugggcaauuu

SEQ ID NO: 165884 - RNA, 19 nt, Homo sapiens
gaagagaagaaagaugaaa

SEQ ID NO: 165885 - RNA, 19 nt, Homo sapiens
gcaacacccaacacuuaua

SEQ ID NO: 165886 - RNA, 19 nt, Homo sapiens
gaccaaaugcuaaaucugu

SEQ ID NO: 165887 - RNA, 19 nt, Homo sapiens
acacaagucaucccauuaa

SEQ ID NO: 165888 - RNA, 19 nt, Homo sapiens
ucaggaaccucgaguacug

SEQ ID NO: 165889 - RNA, 19 nt, Homo sapiens
agacgauccugaagaaaga

SEQ ID NO: 165890 - RNA, 19 nt, Homo sapiens
uaugggagaugaaguuuua

SEQ ID NO: 165891 - RNA, 19 nt, Homo sapiens
ggaguggaguggugcugaa

SEQ ID NO: 165892 - RNA, 19 nt, Homo sapiens
ggagggagcaaaggaguuu

SEQ ID NO: 165893 - RNA, 19 nt, Homo sapiens
cagaagaacuaaaggaaaa

SEQ ID NO: 165894 - RNA, 19 nt, Homo sapiens
agacagguguaugaguuua

SEQ ID NO: 165895 - RNA, 19 nt, Homo sapiens
gcaaauucucggugucaaa

SEQ ID NO: 165896 - RNA, 19 nt, Homo sapiens
aagaagagaagaaagauga

SEQ ID NO: 165897 - RNA, 19 nt, Homo sapiens
gagaugaaguuuuagauca

SEQ ID NO: 165898 - RNA, 19 nt, Homo sapiens
gggaaaguguaugauaaau

SEQ ID NO: 165899 - RNA, 19 nt, Homo sapiens
uaaauaugacugcuuccua

SEQ ID NO: 165900 - RNA, 19 nt, Homo sapiens
aaaagaacaugcaguuuga

SEQ ID NO: 165901 - RNA, 19 nt, Homo sapiens
ggugaucacaggauaggua

SEQ ID NO: 165902 - RNA, 19 nt, Homo sapiens
gaagaagagaagaaagaug

SEQ ID NO: 165903 - RNA, 19 nt, Homo sapiens
uaaagaagaagaagagaag

SEQ ID NO: 165904 - RNA, 19 nt, Homo sapiens
uggagacgauccugaagaa

SEQ ID NO: 165905 - RNA, 19 nt, Homo sapiens
aagaugaagccaaauauug

SEQ ID NO: 165906 - RNA, 19 nt, Homo sapiens
ugucaaacaccaauaaaga

SEQ ID NO: 165907 - RNA, 19 nt, Homo sapiens
gucaaagaaucuagcauca

SEQ ID NO: 165908 - RNA, 19 nt, Homo sapiens
gagaagggaccaguuuguu

SEQ ID NO: 165909 - RNA, 19 nt, Homo sapiens
aauccaaacugcuaugcaa

SEQ ID NO: 165910 - RNA, 19 nt, Homo sapiens
uauugaaccuccugagaau

SEQ ID NO: 165911 - RNA, 19 nt, Homo sapiens
ccauuaaugugcuggaauc

SEQ ID NO: 165912 - RNA, 19 nt, Homo sapiens
gcacagcagaagaacuaaa

SEQ ID NO: 165913 - RNA, 19 nt, Homo sapiens
cacaagucaucccauuaaa

SEQ ID NO: 165914 - RNA, 19 nt, Homo sapiens
ugacuucugugagcucauu

SEQ ID NO: 165915 - RNA, 19 nt, Homo sapiens
caagagagccauccagacu

SEQ ID NO: 165916 - RNA, 19 nt, Homo sapiens
gaugaagccaaauauugaa

SEQ ID NO: 165917 - RNA, 19 nt, Homo sapiens
caaacaccaauaaagauga

SEQ ID NO: 165918 - RNA, 19 nt, Homo sapiens
gaauggaaacagcgaagga

SEQ ID NO: 165919 - RNA, 19 nt, Homo sapiens
gagacgauccugaagaaag

SEQ ID NO: 165920 - RNA, 19 nt, Homo sapiens
gcugaugaaguaaagagua

SEQ ID NO: 165921 - RNA, 19 nt, Homo sapiens
cagaagagggaaaguguau

SEQ ID NO: 165922 - RNA, 19 nt, Homo sapiens
agaugaagccaaauauuga

SEQ ID NO: 165923 - RNA, 19 nt, Homo sapiens
ggagagaacaaugauaaag

SEQ ID NO: 165924 - RNA, 19 nt, Homo sapiens
ccacaguguuaccagcauu

SEQ ID NO: 165925 - RNA, 19 nt, Homo sapiens
aaauggaaaucccuugaca

SEQ ID NO: 165926 - RNA, 19 nt, Homo sapiens
gaaguaugucggcaucgaa

SEQ ID NO: 165927 - RNA, 19 nt, Homo sapiens
cugaugcccugaaguaugu

SEQ ID NO: 165928 - RNA, 19 nt, Homo sapiens
agagggaaaguguaugaua

SEQ ID NO: 165929 - RNA, 19 nt, Homo sapiens
aaacuucgagcuccucuga

SEQ ID NO: 165930 - RNA, 19 nt, Homo sapiens
caaagaaucuagcaucaua

SEQ ID NO: 165931 - RNA, 19 nt, Homo sapiens
caacauagauggaccaaau

SEQ ID NO: 165932 - RNA, 19 nt, Homo sapiens
gaggacggcuucccaauaa

SEQ ID NO: 165933 - RNA, 19 nt, Homo sapiens
gaauguggguuuauaaaug

SEQ ID NO: 165934 - RNA, 19 nt, Homo sapiens
gcugaagccucaauguuua

SEQ ID NO: 165935 - RNA, 19 nt, Homo sapiens
gagggaaaguguaugauaa

SEQ ID NO: 165936 - RNA, 19 nt, Homo sapiens
caauaaagaugaagccaaa

SEQ ID NO: 165937 - RNA, 19 nt, Homo sapiens
cagacgagcugaugaagua

SEQ ID NO: 165938 - RNA, 19 nt, Homo sapiens
gaacaugcaguuugaaauu

SEQ ID NO: 165939 - RNA, 19 nt, Homo sapiens
gaacggaaaucuuaaacca

SEQ ID NO: 165940 - RNA, 19 nt, Homo sapiens
gcagaaagauacagcugaa

SEQ ID NO: 165941 - RNA, 19 nt, Homo sapiens
ggaaaucccuugacaucug

SEQ ID NO: 165942 - RNA, 19 nt, Homo sapiens
guagacagguguaugaguu

SEQ ID NO: 165943 - RNA, 19 nt, Homo sapiens
gcacuuacuaugacaauuu

SEQ ID NO: 165944 - RNA, 19 nt, Homo sapiens
ucaccgagaugauaaagaa

SEQ ID NO: 165945 - RNA, 19 nt, Homo sapiens
gauagagaauguggguuua

SEQ ID NO: 165946 - RNA, 19 nt, Homo sapiens
gcaauaaugcaguauggua

SEQ ID NO: 165947 - RNA, 19 nt, Homo sapiens
uaacggugaucacaggaua

SEQ ID NO: 165948 - RNA, 19 nt, Homo sapiens
gaagagggaaaguguauga

SEQ ID NO: 165949 - RNA, 19 nt, Homo sapiens
aaacagcucuagacaacaa

SEQ ID NO: 165950 - RNA, 19 nt, Homo sapiens
ugaaugcccuuggucaaua

SEQ ID NO: 165951 - RNA, 19 nt, Homo sapiens
ucaaagauccugugcagaa

SEQ ID NO: 165952 - RNA, 19 nt, Homo sapiens
uuaaugugcuggaaucaaa

SEQ ID NO: 165953 - RNA, 19 nt, Homo sapiens
ucagagagagcaaagcuua

SEQ ID NO: 165954 - RNA, 19 nt, Homo sapiens
ggauagagaauguggguuu

SEQ ID NO: 165955 - RNA, 19 nt, Homo sapiens
gaucacaggauagguauuu

SEQ ID NO: 165956 - RNA, 19 nt, Homo sapiens
gcaaaucauucgguaaauc

SEQ ID NO: 165957 - RNA, 19 nt, Homo sapiens
cuagggagguggaagauga

SEQ ID NO: 165958 - RNA, 19 nt, Homo sapiens
caacacccaacacuuauaa

SEQ ID NO: 165959 - RNA, 19 nt, Homo sapiens
gggcacagcagaagaacua

SEQ ID NO: 165960 - RNA, 19 nt, Homo sapiens
uagagaauguggguuuaua

SEQ ID NO: 165961 - RNA, 19 nt, Homo sapiens
gguggaagaugaaacuguu

SEQ ID NO: 165962 - RNA, 19 nt, Homo sapiens
agaugaagcugacagaaga

SEQ ID NO: 165963 - RNA, 19 nt, Homo sapiens
caaagauccugugcagaaa

SEQ ID NO: 165964 - RNA, 19 nt, Homo sapiens
gagagaacaaugauaaaga

SEQ ID NO: 165965 - RNA, 19 nt, Homo sapiens
auaaagaacucaccgaaca

SEQ ID NO: 165966 - RNA, 19 nt, Homo sapiens
gcagaagaacuaaaggaaa

SEQ ID NO: 165967 - RNA, 19 nt, Homo sapiens
gagcuccucugaagcaaau

SEQ ID NO: 165968 - RNA, 19 nt, Homo sapiens
gaacacagaaacagcucua

SEQ ID NO: 165969 - RNA, 19 nt, Homo sapiens
agaaacagcucuagacaac

SEQ ID NO: 165970 - RNA, 19 nt, Homo sapiens
gagaauguggguuuauaaa

SEQ ID NO: 165971 - RNA, 19 nt, Homo sapiens
caaaggauacagacaguga

SEQ ID NO: 165972 - RNA, 19 nt, Homo sapiens
gugcuggaaucaaaggaua

SEQ ID NO: 165973 - RNA, 19 nt, Homo sapiens
cgauugggcugccgcguuu

SEQ ID NO: 165974 - RNA, 19 nt, Homo sapiens
agaauacuguggagagauu

SEQ ID NO: 165975 - RNA, 19 nt, Homo sapiens
gcagcuuucuguucaacuu

SEQ ID NO: 165976 - RNA, 19 nt, Homo sapiens
gacccugaccucugucuua

SEQ ID NO: 165977 - RNA, 19 nt, Homo sapiens
cuaaccauguuuacaacua

SEQ ID NO: 165978 - RNA, 19 nt, Homo sapiens
ccucaauguuuccagauaa

SEQ ID NO: 165979 - RNA, 19 nt, Homo sapiens
gaaugcccuuggucaauau

SEQ ID NO: 165980 - RNA, 19 nt, Homo sapiens
cgaguacugugggcaauuu

SEQ ID NO: 165981 - RNA, 19 nt, Homo sapiens
gaagagaagaaagaugaaa

SEQ ID NO: 165982 - RNA, 19 nt, Homo sapiens
gcaacacccaacacuuaua

SEQ ID NO: 165983 - RNA, 19 nt, Homo sapiens
gaccaaaugcuaaaucugu

SEQ ID NO: 165984 - RNA, 19 nt, Homo sapiens
ucaggaaccucgaguacug

SEQ ID NO: 165985 - RNA, 19 nt, Homo sapiens
agacgauccugaagaaaga

SEQ ID NO: 165986 - RNA, 19 nt, Homo sapiens
uaugggagaugaaguuuua

SEQ ID NO: 165987 - RNA, 19 nt, Homo sapiens
ggaguggaguggugcugaa

SEQ ID NO: 165988 - RNA, 19 nt, Homo sapiens
ggagggagcaaaggaguuu

SEQ ID NO: 165989 - RNA, 19 nt, Homo sapiens
cagaagaacuaaaggaaaa

SEQ ID NO: 165990 - RNA, 19 nt, Homo sapiens
agacagguguaugaguuua

SEQ ID NO: 165991 - RNA, 19 nt, Homo sapiens
gcaaauucucggugucaaa

SEQ ID NO: 165992 - RNA, 19 nt, Homo sapiens
aagaagagaagaaagauga

SEQ ID NO: 165993 - RNA, 19 nt, Homo sapiens
gagaugaaguuuuagauca

SEQ ID NO: 165994 - RNA, 19 nt, Homo sapiens
gggaaaguguaugauaaau

SEQ ID NO: 165995 - RNA, 19 nt, Homo sapiens
uaaauaugacugcuuccua

SEQ ID NO: 165996 - RNA, 19 nt, Homo sapiens
aaaagaacaugcaguuuga

SEQ ID NO: 165997 - RNA, 19 nt, Homo sapiens
ggugaucacaggauaggua

SEQ ID NO: 165998 - RNA, 19 nt, Homo sapiens
gaagaagagaagaaagaug

SEQ ID NO: 165999 - RNA, 19 nt, Homo sapiens
uaaagaagaagaagagaag

SEQ ID NO: 166000 - RNA, 19 nt, Homo sapiens
uggagacgauccugaagaa

SEQ ID NO: 166001 - RNA, 19 nt, Homo sapiens
ggacuagggagguggaaga

SEQ ID NO: 166002 - RNA, 19 nt, Homo sapiens
aagaugaagccaaauauug

SEQ ID NO: 166003 - RNA, 19 nt, Homo sapiens
ugucaaacaccaauaaaga

SEQ ID NO: 166004 - RNA, 19 nt, Homo sapiens
gucaaagaaucuagcauca

SEQ ID NO: 166005 - RNA, 19 nt, Homo sapiens
aauccaaacugcuaugcaa

SEQ ID NO: 166006 - RNA, 19 nt, Homo sapiens
uauugaaccuccugagaau

SEQ ID NO: 166007 - RNA, 19 nt, Homo sapiens
ccauuaaugugcuggaauc

SEQ ID NO: 166008 - RNA, 19 nt, Homo sapiens
gcacagcagaagaacuaaa

SEQ ID NO: 166009 - RNA, 19 nt, Homo sapiens
gagaagggaccaguuuguu

SEQ ID NO: 166010 - RNA, 19 nt, Homo sapiens
ugacuucugugagcucauu

SEQ ID NO: 166011 - RNA, 19 nt, Homo sapiens
caagagagccauccagacu

SEQ ID NO: 166012 - RNA, 19 nt, Homo sapiens
gaauggaaacagcgaagga

SEQ ID NO: 166013 - RNA, 19 nt, Homo sapiens
gcugaugaaguaaagagua

SEQ ID NO: 166014 - RNA, 19 nt, Homo sapiens
gaugaagccaaauauugaa

SEQ ID NO: 166015 - RNA, 19 nt, Homo sapiens
caaacaccaauaaagauga

SEQ ID NO: 166016 - RNA, 19 nt, Homo sapiens
gagacgauccugaagaaag

SEQ ID NO: 166017 - RNA, 19 nt, Homo sapiens
cagaagagggaaaguguau

SEQ ID NO: 166018 - RNA, 19 nt, Homo sapiens
agaugaagccaaauauuga

SEQ ID NO: 166019 - RNA, 19 nt, Homo sapiens
ggagagaacaaugauaaag

SEQ ID NO: 166020 - RNA, 19 nt, Homo sapiens
ccacaguguuaccagcauu

SEQ ID NO: 166021 - RNA, 19 nt, Homo sapiens
aaauggaaaucccuugaca

SEQ ID NO: 166022 - RNA, 19 nt, Homo sapiens
gaaguaugucggcaucgaa

SEQ ID NO: 166023 - RNA, 19 nt, Homo sapiens
cugaugcccugaaguaugu

SEQ ID NO: 166024 - RNA, 19 nt, Homo sapiens
agagggaaaguguaugaua

SEQ ID NO: 166025 - RNA, 19 nt, Homo sapiens
aaacuucgagcuccucuga

SEQ ID NO: 166026 - RNA, 19 nt, Homo sapiens
gauaaagaccccaccaaaa

SEQ ID NO: 166027 - RNA, 19 nt, Homo sapiens
augcaacacccaacacuua

SEQ ID NO: 166028 - RNA, 19 nt, Homo sapiens
aaauacaugugcagcuuuc

SEQ ID NO: 166029 - RNA, 19 nt, Homo sapiens
gacagaagagggaaagugu

SEQ ID NO: 166030 - RNA, 19 nt, Homo sapiens
gaaggucauugaucaguuu

SEQ ID NO: 166031 - RNA, 19 nt, Homo sapiens
gaaccaaucccgugaaaga

SEQ ID NO: 166032 - RNA, 19 nt, Homo sapiens
aaacuaugguucccaauaa

SEQ ID NO: 166033 - RNA, 19 nt, Homo sapiens
aaagagagcuccuggaauc

SEQ ID NO: 166034 - RNA, 19 nt, Homo sapiens
guaccagacuuucuucaau

SEQ ID NO: 166035 - RNA, 19 nt, Homo sapiens
cccaggagcugacacacua

SEQ ID NO: 166036 - RNA, 19 nt, Homo sapiens
ccaaucccgugaaagaauu

SEQ ID NO: 166037 - RNA, 19 nt, Homo sapiens
gaaauauggcuucuacaca

SEQ ID NO: 166038 - RNA, 19 nt, Homo sapiens
ccgcaucacugacaacaug

SEQ ID NO: 166039 - RNA, 19 nt, Homo sapiens
cgaaagagagcuccuggaa

SEQ ID NO: 166040 - RNA, 19 nt, Homo sapiens
agaagucgcuggaggacaa

SEQ ID NO: 166041 - RNA, 19 nt, Homo sapiens
cugcaugucuggaagguaa

SEQ ID NO: 166042 - RNA, 19 nt, Homo sapiens
uacagaaggucauugauca

SEQ ID NO: 166043 - RNA, 19 nt, Homo sapiens
gggccagccucaucaguga

SEQ ID NO: 166044 - RNA, 19 nt, Homo sapiens
guacugcgaccucaacuau

SEQ ID NO: 166045 - RNA, 19 nt, Homo sapiens
cgggaagccuggcgacuuu

SEQ ID NO: 166046 - RNA, 19 nt, Homo sapiens
ggauacagaaggucauuga

SEQ ID NO: 166047 - RNA, 19 nt, Homo sapiens
aacaaccgcugguaucaaa

SEQ ID NO: 166048 - RNA, 19 nt, Homo sapiens
gagagcuccuggaauccua

SEQ ID NO: 166049 - RNA, 19 nt, Homo sapiens
gaaagagagcuccuggaau

SEQ ID NO: 166050 - RNA, 19 nt, Homo sapiens
cugaagaaguggauacaga

SEQ ID NO: 166051 - RNA, 19 nt, Homo sapiens
ccacauaagccugaaauca

SEQ ID NO: 166052 - RNA, 19 nt, Homo sapiens
aggagucgcuacccacaua

SEQ ID NO: 166053 - RNA, 19 nt, Homo sapiens
gcgaaacauugaaaagaua

SEQ ID NO: 166054 - RNA, 19 nt, Homo sapiens
acaagaacuucaccgagaa

SEQ ID NO: 166055 - RNA, 19 nt, Homo sapiens
gcaccaggacuucaacuca

SEQ ID NO: 166056 - RNA, 19 nt, Homo sapiens
ggacccuggugcuacacua

SEQ ID NO: 166057 - RNA, 19 nt, Homo sapiens
gggccgaccuacaggagaa

SEQ ID NO: 166058 - RNA, 19 nt, Homo sapiens
cacauaagccugaaaucaa

SEQ ID NO: 166059 - RNA, 19 nt, Homo sapiens
gaaccuggaccgggacauu

SEQ ID NO: 166060 - RNA, 19 nt, Homo sapiens
gcaagcaccaggacuucaa

SEQ ID NO: 166061 - RNA, 19 nt, Homo sapiens
ugaccgggaugggaaauau

SEQ ID NO: 166062 - RNA, 19 nt, Homo sapiens
gguacgagcgaaacauuga

SEQ ID NO: 166063 - RNA, 19 nt, Homo sapiens
ccagugaguaccagacuuu

SEQ ID NO: 166064 - RNA, 19 nt, Homo sapiens
uccgaaggcuccaguguga

SEQ ID NO: 166065 - RNA, 19 nt, Homo sapiens
ggucauugaucaguuugga

SEQ ID NO: 166066 - RNA, 19 nt, Homo sapiens
ggaaauauggcuucuacac

SEQ ID NO: 166067 - RNA, 19 nt, Homo sapiens
ggacauugcccugaugaag

SEQ ID NO: 166068 - RNA, 19 nt, Homo sapiens
acugcgaccucaacuauug

SEQ ID NO: 166069 - RNA, 19 nt, Homo sapiens
gaaucugucaccuccauug

SEQ ID NO: 166070 - RNA, 19 nt, Homo sapiens
guuccuggcuccucagcaa

SEQ ID NO: 166071 - RNA, 19 nt, Homo sapiens
guucugugcugguuacaag

SEQ ID NO: 166072 - RNA, 19 nt, Homo sapiens
gacaggagaugggcuggau

SEQ ID NO: 166073 - RNA, 19 nt, Homo sapiens
ugaagaaguggauacagaa

SEQ ID NO: 166074 - RNA, 19 nt, Homo sapiens
agaaggucauugaucaguu

SEQ ID NO: 166075 - RNA, 19 nt, Homo sapiens
guggugaaccugcccauug

SEQ ID NO: 166076 - RNA, 19 nt, Homo sapiens
uaccagacuuucuucaauc

SEQ ID NO: 166077 - RNA, 19 nt, Homo sapiens
uggaaccaaucccgugaaa

SEQ ID NO: 166078 - RNA, 19 nt, Homo sapiens
ucaaaugggcaucgucuca

SEQ ID NO: 166079 - RNA, 19 nt, Homo sapiens
gggcucggaugcagagauc

SEQ ID NO: 166080 - RNA, 19 nt, Homo sapiens
gaccucuguucgagaagaa

SEQ ID NO: 166081 - RNA, 19 nt, Homo sapiens
ccaaggcccugagcaagca

SEQ ID NO: 166082 - RNA, 19 nt, Homo sapiens
agaaguggauacagaaggu

SEQ ID NO: 166083 - RNA, 19 nt, Homo sapiens
gaagaaguggauacagaag

SEQ ID NO: 166084 - RNA, 19 nt, Homo sapiens
ugggaaauauggcuucuac

SEQ ID NO: 166085 - RNA, 19 nt, Homo sapiens
caagccugaugaagggaaa

SEQ ID NO: 166086 - RNA, 19 nt, Homo sapiens
aaaugggcaucgucucaug

SEQ ID NO: 166087 - RNA, 19 nt, Homo sapiens
caaccgcugguaucaaaug

SEQ ID NO: 166088 - RNA, 19 nt, Homo sapiens
gaacuucaccgagaaugac

SEQ ID NO: 166089 - RNA, 19 nt, Homo sapiens
gagaucggcaugucaccuu

SEQ ID NO: 166090 - RNA, 19 nt, Homo sapiens
acauaagccugaaaucaac

SEQ ID NO: 166091 - RNA, 19 nt, Homo sapiens
caggagaugggcuggauga

SEQ ID NO: 166092 - RNA, 19 nt, Homo sapiens
cgaaggcuccagugugaau

SEQ ID NO: 166093 - RNA, 19 nt, Homo sapiens
ugccuucagugacuacauu

SEQ ID NO: 166094 - RNA, 19 nt, Homo sapiens
cgaccucuguucgagaaga

SEQ ID NO: 166095 - RNA, 19 nt, Homo sapiens
gugaguaccagacuuucuu

SEQ ID NO: 166096 - RNA, 19 nt, Homo sapiens
gagcaagcaccaggacuuc

SEQ ID NO: 166097 - RNA, 19 nt, Homo sapiens
ggagcagugugucccugau

SEQ ID NO: 166098 - RNA, 19 nt, Homo sapiens
aacuaugguucccaauaaa

SEQ ID NO: 166099 - RNA, 19 nt, Homo sapiens
uaacaaccgcugguaucaa

SEQ ID NO: 166100 - RNA, 19 nt, Homo sapiens
ccugaaaucaacuccacua

SEQ ID NO: 166101 - RNA, 19 nt, Homo sapiens
uggugaaccugcccauugu

SEQ ID NO: 166102 - RNA, 19 nt, Homo sapiens
ggagucgcuacccacauaa

SEQ ID NO: 166103 - RNA, 19 nt, Homo sapiens
gcauugagugccagcuaug

SEQ ID NO: 166104 - RNA, 19 nt, Homo sapiens
caaucccgugaaagaauua

SEQ ID NO: 166105 - RNA, 19 nt, Homo sapiens
guacgagcgaaacauugaa

SEQ ID NO: 166106 - RNA, 19 nt, Homo sapiens
gauguguucugggccaagu

SEQ ID NO: 166107 - RNA, 19 nt, Homo sapiens
gaccuucuggugcgcauug

SEQ ID NO: 166108 - RNA, 19 nt, Homo sapiens
caagaacuucaccgagaau

SEQ ID NO: 166109 - RNA, 19 nt, Homo sapiens
agauaagcuugcugcaugu

SEQ ID NO: 166110 - RNA, 19 nt, Homo sapiens
gaagagccccuuuaacaac

SEQ ID NO: 166111 - RNA, 19 nt, Homo sapiens
ggauccgcaucacugacaa

SEQ ID NO: 166112 - RNA, 19 nt, Homo sapiens
gaacuaccgagggcaugug

SEQ ID NO: 166113 - RNA, 19 nt, Homo sapiens
cugugcagcugguggagaa

SEQ ID NO: 166114 - RNA, 19 nt, Homo sapiens
ccacggcuacggauguguu

SEQ ID NO: 166115 - RNA, 19 nt, Homo sapiens
uugaucaguuuggagagua

SEQ ID NO: 166116 - RNA, 19 nt, Homo sapiens
gaugggaaauauggcuucu

SEQ ID NO: 166117 - RNA, 19 nt, Homo sapiens
gagcgaaacauugaaaaga

SEQ ID NO: 166118 - RNA, 19 nt, Homo sapiens
ugagcaagcaccaggacuu

SEQ ID NO: 166119 - RNA, 19 nt, Homo sapiens
auacagaaggucauugauc

SEQ ID NO: 166120 - RNA, 19 nt, Homo sapiens
gcgcaagggcaaccuagag

SEQ ID NO: 166121 - RNA, 19 nt, Homo sapiens
aauauggcuucuacacaca

SEQ ID NO: 166122 - RNA, 19 nt, Homo sapiens
guaccgccaccagugagua

SEQ ID NO: 166123 - RNA, 19 nt, Homo sapiens
gguacugcgaccucaacua

SEQ ID NO: 166124 - RNA, 19 nt, Homo sapiens
ucccgugaaagaauuauuu

SEQ ID NO: 166125 - RNA, 19 nt, Homo sapiens
cauguucugugcugguuac

SEQ ID NO: 166126 - RNA, 19 nt, Homo sapiens
aaaacuaugguucccaaua

SEQ ID NO: 166127 - RNA, 19 nt, Homo sapiens
ucacugacaacauguucug

SEQ ID NO: 166128 - RNA, 19 nt, Homo sapiens
ugcgaccucuguucgagaa

SEQ ID NO: 166129 - RNA, 19 nt, Homo sapiens
gccaggaucaagucacugu

SEQ ID NO: 166130 - RNA, 19 nt, Homo sapiens
gaaaguggguuaacugaau

SEQ ID NO: 166131 - RNA, 19 nt, Homo sapiens
caaaguagaucaugcauag

SEQ ID NO: 166132 - RNA, 19 nt, Homo sapiens
guaaacacaucuaguaguu

SEQ ID NO: 166133 - RNA, 19 nt, Homo sapiens
gaaugucacuucuggauau

SEQ ID NO: 166134 - RNA, 19 nt, Homo sapiens
gaagaugccuccggauauu

SEQ ID NO: 166135 - RNA, 19 nt, Homo sapiens
gagcauaaguccucuagug

SEQ ID NO: 166136 - RNA, 19 nt, Homo sapiens
ggugacauauacauacuua

SEQ ID NO: 166137 - RNA, 19 nt, Homo sapiens
gaucaugcauagaguguga

SEQ ID NO: 166138 - RNA, 19 nt, Homo sapiens
cugauucccugauuuaaua

SEQ ID NO: 166139 - RNA, 19 nt, Homo sapiens
gcgcauuacucauuccuuu

SEQ ID NO: 166140 - RNA, 19 nt, Homo sapiens
gugagagacuccauaguuu

SEQ ID NO: 166141 - RNA, 19 nt, Homo sapiens
gcugugaacugaucauguu

SEQ ID NO: 166142 - RNA, 19 nt, Homo sapiens
caacaaaugccaccuuaga

SEQ ID NO: 166143 - RNA, 19 nt, Homo sapiens
ugaaacccgucucuacuaa

SEQ ID NO: 166144 - RNA, 19 nt, Homo sapiens
aaacaaggccugucagcua

SEQ ID NO: 166145 - RNA, 19 nt, Homo sapiens
gggauuggcugugaacuga

SEQ ID NO: 166146 - RNA, 19 nt, Homo sapiens
ccuuuaagaucagcuauua

SEQ ID NO: 166147 - RNA, 19 nt, Homo sapiens
ggucauuucuucucaggaa

SEQ ID NO: 166148 - RNA, 19 nt, Homo sapiens
cacccaaacuuuauugauu

SEQ ID NO: 166149 - RNA, 19 nt, Homo sapiens
agauuagucuccaucaaua

SEQ ID NO: 166150 - RNA, 19 nt, Homo sapiens
gguugaaacauaucucuua

SEQ ID NO: 166151 - RNA, 19 nt, Homo sapiens
guacgucuacaguaucuua

SEQ ID NO: 166152 - RNA, 19 nt, Homo sapiens
aaacacaucuaguaguugu

SEQ ID NO: 166153 - RNA, 19 nt, Homo sapiens
gcagugcaguauagaauag

SEQ ID NO: 166154 - RNA, 19 nt, Homo sapiens
aaaguggguuaacugaaua

SEQ ID NO: 166155 - RNA, 19 nt, Homo sapiens
ucauggaauucacaaagua

SEQ ID NO: 166156 - RNA, 19 nt, Homo sapiens
ucuaguaguuguucugaaa

SEQ ID NO: 166157 - RNA, 19 nt, Homo sapiens
ggcaagguuuaaguuauua

SEQ ID NO: 166158 - RNA, 19 nt, Homo sapiens
cggcaagguuuaaguuauu

SEQ ID NO: 166159 - RNA, 19 nt, Homo sapiens
uaaccugaauaacagcaua

SEQ ID NO: 166160 - RNA, 19 nt, Homo sapiens
gaacauuuggguuacuauu

SEQ ID NO: 166161 - RNA, 19 nt, Homo sapiens
gcaaaguagaucaugcaua

SEQ ID NO: 166162 - RNA, 19 nt, Homo sapiens
ugccaaugcuacaguaaua

SEQ ID NO: 166163 - RNA, 19 nt, Homo sapiens
cauaaguccucuagugaau

SEQ ID NO: 166164 - RNA, 19 nt, Homo sapiens
guagauguaugcacacaca

SEQ ID NO: 166165 - RNA, 19 nt, Homo sapiens
uaacagcagugggcaguug

SEQ ID NO: 166166 - RNA, 19 nt, Homo sapiens
cauaagcauugaccgguuu

SEQ ID NO: 166167 - RNA, 19 nt, Homo sapiens
ucagucugcuuagaaauaa

SEQ ID NO: 166168 - RNA, 19 nt, Homo sapiens
ggcaguugauggcaaguaa

SEQ ID NO: 166169 - RNA, 19 nt, Homo sapiens
ccacaaacguccuccugau

SEQ ID NO: 166170 - RNA, 19 nt, Homo sapiens
gcuuagaaauaacagaaga

SEQ ID NO: 166171 - RNA, 19 nt, Homo sapiens
guguguauauguagaugua

SEQ ID NO: 166172 - RNA, 19 nt, Homo sapiens
ggauauagcuaggugacau

SEQ ID NO: 166173 - RNA, 19 nt, Homo sapiens
cgacuugcauaccugcuuu

SEQ ID NO: 166174 - RNA, 19 nt, Homo sapiens
cagaagaugccuccggaua

SEQ ID NO: 166175 - RNA, 19 nt, Homo sapiens
uaggcuggcuuucagagua

SEQ ID NO: 166176 - RNA, 19 nt, Homo sapiens
caacaucacuaccugucau

SEQ ID NO: 166177 - RNA, 19 nt, Homo sapiens
agagguacgucuacaguau

SEQ ID NO: 166178 - RNA, 19 nt, Homo sapiens
cuucgucacugcagcauuu

SEQ ID NO: 166179 - RNA, 19 nt, Homo sapiens
uggguuaacugaauacaga

SEQ ID NO: 166180 - RNA, 19 nt, Homo sapiens
aacaaggccugucagcuaa

SEQ ID NO: 166181 - RNA, 19 nt, Homo sapiens
gaccugcccucaagagcaa

SEQ ID NO: 166182 - RNA, 19 nt, Homo sapiens
gcauaaguccucuagugaa

SEQ ID NO: 166183 - RNA, 19 nt, Homo sapiens
ccugucagcuaaagaaguu

SEQ ID NO: 166184 - RNA, 19 nt, Homo sapiens
uaaguccucuagugaaugu

SEQ ID NO: 166185 - RNA, 19 nt, Homo sapiens
gaguuuagcccugaacauu

SEQ ID NO: 166186 - RNA, 19 nt, Homo sapiens
guauagaauaggcacuuua

SEQ ID NO: 166187 - RNA, 19 nt, Homo sapiens
uaaccugaggauucuauua

SEQ ID NO: 166188 - RNA, 19 nt, Homo sapiens
gcagaugugcuguuugugu

SEQ ID NO: 166189 - RNA, 19 nt, Homo sapiens
cggcagaugugcuguuugu

SEQ ID NO: 166190 - RNA, 19 nt, Homo sapiens
gcaggagacuggcgugaac

SEQ ID NO: 166191 - RNA, 19 nt, Homo sapiens
aaucaugucagucugcuua

SEQ ID NO: 166192 - RNA, 19 nt, Homo sapiens
acagagaccugcccucaag

SEQ ID NO: 166193 - RNA, 19 nt, Homo sapiens
gugaacugaucauguuuau

SEQ ID NO: 166194 - RNA, 19 nt, Homo sapiens
caacagagcaagacuccau

SEQ ID NO: 166195 - RNA, 19 nt, Homo sapiens
agacacagauuggccagaa

SEQ ID NO: 166196 - RNA, 19 nt, Homo sapiens
gauauagcuaggugacaua

SEQ ID NO: 166197 - RNA, 19 nt, Homo sapiens
gaaccccaaugauaaauau

SEQ ID NO: 166198 - RNA, 19 nt, Homo sapiens
caguacaggacauauauuu

SEQ ID NO: 166199 - RNA, 19 nt, Homo sapiens
uccaauaggugcugagugu

SEQ ID NO: 166200 - RNA, 19 nt, Homo sapiens
gaauguaggcuggcuuuca

SEQ ID NO: 166201 - RNA, 19 nt, Homo sapiens
guuuagcccugaacauuuc

SEQ ID NO: 166202 - RNA, 19 nt, Homo sapiens
gugaaacccgucucuacua

SEQ ID NO: 166203 - RNA, 19 nt, Homo sapiens
gcuaggugacauauacaua

SEQ ID NO: 166204 - RNA, 19 nt, Homo sapiens
uaugggagcugucaagcau

SEQ ID NO: 166205 - RNA, 19 nt, Homo sapiens
agcaacaaaugccaccuua

SEQ ID NO: 166206 - RNA, 19 nt, Homo sapiens
gaucccagcaguuauaaca

SEQ ID NO: 166207 - RNA, 19 nt, Homo sapiens
gccucuaucuugcucauga

SEQ ID NO: 166208 - RNA, 19 nt, Homo sapiens
gaaacccgucucuacuaaa

SEQ ID NO: 166209 - RNA, 19 nt, Homo sapiens
caaagcagaaugugauauc

SEQ ID NO: 166210 - RNA, 19 nt, Homo sapiens
gacggcaagguuuaaguua

SEQ ID NO: 166211 - RNA, 19 nt, Homo sapiens
ucacuugucuggccaucug

SEQ ID NO: 166212 - RNA, 19 nt, Homo sapiens
gcuccuggcugacacucuu

SEQ ID NO: 166213 - RNA, 19 nt, Homo sapiens
ccaggaggcggaccuugua

SEQ ID NO: 166214 - RNA, 19 nt, Homo sapiens
gucagucugcuuagaaaua

SEQ ID NO: 166215 - RNA, 19 nt, Homo sapiens
guuacuauuucuugugguu

SEQ ID NO: 166216 - RNA, 19 nt, Homo sapiens
acauuuggguuacuauuuc

SEQ ID NO: 166217 - RNA, 19 nt, Homo sapiens
agagugugauguaugugua

SEQ ID NO: 166218 - RNA, 19 nt, Homo sapiens
ucucugauucccugauuua

SEQ ID NO: 166219 - RNA, 19 nt, Homo sapiens
ccaaugcuacaguaauaaa

SEQ ID NO: 166220 - RNA, 19 nt, Homo sapiens
uaaugaccaugaaagacuu

SEQ ID NO: 166221 - RNA, 19 nt, Homo sapiens
guuccgaucccagcaguua

SEQ ID NO: 166222 - RNA, 19 nt, Homo sapiens
cuucucugcugucuucuuu

SEQ ID NO: 166223 - RNA, 19 nt, Homo sapiens
aagaaucaaucaugucagu

SEQ ID NO: 166224 - RNA, 19 nt, Homo sapiens
cgaaagaaggcauggacuu

SEQ ID NO: 166225 - RNA, 19 nt, Homo sapiens
guaaugaccaugaaagacu

SEQ ID NO: 166226 - RNA, 19 nt, Homo sapiens
guaccacuuuugcaaauaa

SEQ ID NO: 166227 - RNA, 19 nt, Homo sapiens
aaagauaacaggacgagau

SEQ ID NO: 166228 - RNA, 19 nt, Homo sapiens
gauuagucuccaucaauaa

SEQ ID NO: 166229 - RNA, 19 nt, Homo sapiens
acaaacguccuccugauug

SEQ ID NO: 166230 - RNA, 19 nt, Homo sapiens
gaagaagccuuauugguaa

SEQ ID NO: 166231 - RNA, 19 nt, Homo sapiens
ggaagaagccuuauuggua

SEQ ID NO: 166232 - RNA, 19 nt, Homo sapiens
gaagauugccuaucacaua

SEQ ID NO: 166233 - RNA, 19 nt, Homo sapiens
ugggagacauguucaauua

SEQ ID NO: 166234 - RNA, 19 nt, Homo sapiens
caauauggcugcugauucu

SEQ ID NO: 166235 - RNA, 19 nt, Homo sapiens
gggaagcucuuuguaaugu

SEQ ID NO: 166236 - RNA, 19 nt, Homo sapiens
gccaacaacuggauuuaug

SEQ ID NO: 166237 - RNA, 19 nt, Homo sapiens
gaaaaggaguuacaguuga

SEQ ID NO: 166238 - RNA, 19 nt, Homo sapiens
uggaaccuguuuaauguua

SEQ ID NO: 166239 - RNA, 19 nt, Homo sapiens
caaagaaacacuccaggaa

SEQ ID NO: 166240 - RNA, 19 nt, Homo sapiens
gaggacgugucuguuauuu

SEQ ID NO: 166241 - RNA, 19 nt, Homo sapiens
gaaccuguuuaauguuaug

SEQ ID NO: 166242 - RNA, 19 nt, Homo sapiens
uaaagcagaugcaaguauc

SEQ ID NO: 166243 - RNA, 19 nt, Homo sapiens
guuaagaccuccuauugag

SEQ ID NO: 166244 - RNA, 19 nt, Homo sapiens
ggagacauguucaauuacu

SEQ ID NO: 166245 - RNA, 19 nt, Homo sapiens
ggacgugucuguuauuucc

SEQ ID NO: 166246 - RNA, 19 nt, Homo sapiens
gguauugggucaucgugaa

SEQ ID NO: 166247 - RNA, 19 nt, Homo sapiens
aagaaacacuccaggaaau

SEQ ID NO: 166248 - RNA, 19 nt, Homo sapiens
uguggaaccuguuuaaugu

SEQ ID NO: 166249 - RNA, 19 nt, Homo sapiens
gaagagggccaucaaacuc

SEQ ID NO: 166250 - RNA, 19 nt, Homo sapiens
ucacauacaugccaacaac

SEQ ID NO: 166251 - RNA, 19 nt, Homo sapiens
ccauguaccugaucugcuu

SEQ ID NO: 166252 - RNA, 19 nt, Homo sapiens
gaugggaauugcacaguag

SEQ ID NO: 166253 - RNA, 19 nt, Homo sapiens
cuaguaaccuucugcuugu

SEQ ID NO: 166254 - RNA, 19 nt, Homo sapiens
uaugaggacgugucuguua

SEQ ID NO: 166255 - RNA, 19 nt, Homo sapiens
ggauguggaaccuguuuaa

SEQ ID NO: 166256 - RNA, 19 nt, Homo sapiens
caaguucaaccacuguuaa

SEQ ID NO: 166257 - RNA, 19 nt, Homo sapiens
gcaucucccuggcaauaug

SEQ ID NO: 166258 - RNA, 19 nt, Homo sapiens
aaagaaacacuccaggaaa

SEQ ID NO: 166259 - RNA, 19 nt, Homo sapiens
guaaagcagaugcaaguau

SEQ ID NO: 166260 - RNA, 19 nt, Homo sapiens
gcaauauggcugcugauuc

SEQ ID NO: 166261 - RNA, 19 nt, Homo sapiens
gugguggguuugccaagua

SEQ ID NO: 166262 - RNA, 19 nt, Homo sapiens
gagacauguucaauuacuu

SEQ ID NO: 166263 - RNA, 19 nt, Homo sapiens
gcagagguauugggucauc

SEQ ID NO: 166264 - RNA, 19 nt, Homo sapiens
ccuugaagauugccuauca

SEQ ID NO: 166265 - RNA, 19 nt, Homo sapiens
caucuguccucacuggaaa

SEQ ID NO: 166266 - RNA, 19 nt, Homo sapiens
uaagaccuccuauugaguu

SEQ ID NO: 166267 - RNA, 19 nt, Homo sapiens
ggaagagggccaucaaacu

SEQ ID NO: 166268 - RNA, 19 nt, Homo sapiens
gaugaaaacucagagaaga

SEQ ID NO: 166269 - RNA, 19 nt, Homo sapiens
ggaaccuguuuaauguuau

SEQ ID NO: 166270 - RNA, 19 nt, Homo sapiens
gaauugcacaguaggaugu

SEQ ID NO: 166271 - RNA, 19 nt, Homo sapiens
aaguaucccucaccucaaa

SEQ ID NO: 166272 - RNA, 19 nt, Homo sapiens
ucagggaucaugcaaagaa

SEQ ID NO: 166273 - RNA, 19 nt, Homo sapiens
ucaauuacuuccucucucu

SEQ ID NO: 166274 - RNA, 19 nt, Homo sapiens
uggcugaccuccucucugu

SEQ ID NO: 166275 - RNA, 19 nt, Homo sapiens
gaaauccagcucuuacucu

SEQ ID NO: 166276 - RNA, 19 nt, Homo sapiens
ucuaugcccuguacauugu

SEQ ID NO: 166277 - RNA, 19 nt, Homo sapiens
ggaaaaggaguuacaguug

SEQ ID NO: 166278 - RNA, 19 nt, Homo sapiens
ccaggaaauccagcucuua

SEQ ID NO: 166279 - RNA, 19 nt, Homo sapiens
caggugagaggcugacuuu

SEQ ID NO: 166280 - RNA, 19 nt, Homo sapiens
agaugggaauugcacagua

SEQ ID NO: 166281 - RNA, 19 nt, Homo sapiens
ucaaguucaaccacuguua

SEQ ID NO: 166282 - RNA, 19 nt, Homo sapiens
ccaguggagcucugaguuu

SEQ ID NO: 166283 - RNA, 19 nt, Homo sapiens
gaguuacaguugaaacagu

SEQ ID NO: 166284 - RNA, 19 nt, Homo sapiens
gcucuuacucuucaaguuc

SEQ ID NO: 166285 - RNA, 19 nt, Homo sapiens
ggaaauccagcucuuacuc

SEQ ID NO: 166286 - RNA, 19 nt, Homo sapiens
ccucacagccucugccuau

SEQ ID NO: 166287 - RNA, 19 nt, Homo sapiens
ggugagaggcugacuuucu

SEQ ID NO: 166288 - RNA, 19 nt, Homo sapiens
gaacaucacgaccugucau

SEQ ID NO: 166289 - RNA, 19 nt, Homo sapiens
aagcagaccaucuucauuc

SEQ ID NO: 166290 - RNA, 19 nt, Homo sapiens
uaaugugcuuauuggcuuu

SEQ ID NO: 166291 - RNA, 19 nt, Homo sapiens
ggaagcucuuuguaaugug

SEQ ID NO: 166292 - RNA, 19 nt, Homo sapiens
aaauccagcucuuacucuu

SEQ ID NO: 166293 - RNA, 19 nt, Homo sapiens
ccacgucacuggaaaagga

SEQ ID NO: 166294 - RNA, 19 nt, Homo sapiens
caguggagcucugaguuuc

SEQ ID NO: 166295 - RNA, 19 nt, Homo sapiens
guagcccucugccucucua

SEQ ID NO: 166296 - RNA, 19 nt, Homo sapiens
caucccacgucacuggaaa

SEQ ID NO: 166297 - RNA, 19 nt, Homo sapiens
guacuguuccauucucuuc

SEQ ID NO: 166298 - RNA, 19 nt, Homo sapiens
gcaucuguccucacuggaa

SEQ ID NO: 166299 - RNA, 19 nt, Homo sapiens
uggcaucucccuggcaaua

SEQ ID NO: 166300 - RNA, 19 nt, Homo sapiens
gcacccugcugugauuuac

SEQ ID NO: 166301 - RNA, 19 nt, Homo sapiens
guuaugaggacgugucugu

SEQ ID NO: 166302 - RNA, 19 nt, Homo sapiens
aaaaggaguuacaguugaa

SEQ ID NO: 166303 - RNA, 19 nt, Homo sapiens
uuucagggaucaugcaaag

SEQ ID NO: 166304 - RNA, 19 nt, Homo sapiens
aagauugccuaucacauac

SEQ ID NO: 166305 - RNA, 19 nt, Homo sapiens
ggucuuccuuccaauuguc

SEQ ID NO: 166306 - RNA, 19 nt, Homo sapiens
cugaucugcuucacuccua

SEQ ID NO: 166307 - RNA, 19 nt, Homo sapiens
ucacagccucugccuaugu

SEQ ID NO: 166308 - RNA, 19 nt, Homo sapiens
gcucuccuuugccgaagug

SEQ ID NO: 166309 - RNA, 19 nt, Homo sapiens
aaaggaagagggccaucaa

SEQ ID NO: 166310 - RNA, 19 nt, Homo sapiens
caggaagaaggcaaacauu

SEQ ID NO: 166311 - RNA, 19 nt, Homo sapiens
ccaggaagaaggcaaacau

SEQ ID NO: 166312 - RNA, 19 nt, Homo sapiens
gauugccuaucacauacau

SEQ ID NO: 166313 - RNA, 19 nt, Homo sapiens
ugucuguuauuuccuaauc

SEQ ID NO: 166314 - RNA, 19 nt, Homo sapiens
caccaucccuuuguauguc

SEQ ID NO: 166315 - RNA, 19 nt, Homo sapiens
gcauggcccugugggucuu

SEQ ID NO: 166316 - RNA, 19 nt, Homo sapiens
uguuaagaccuccuauuga

SEQ ID NO: 166317 - RNA, 19 nt, Homo sapiens
gugggagacauguucaauu

SEQ ID NO: 166318 - RNA, 19 nt, Homo sapiens
ggucaccaucccuuuguau

SEQ ID NO: 166319 - RNA, 19 nt, Homo sapiens
ggcaauauggcugcugauu

SEQ ID NO: 166320 - RNA, 19 nt, Homo sapiens
aggaagaaggcaaacauug

SEQ ID NO: 166321 - RNA, 19 nt, Homo sapiens
cagcagaggcuccgauucg

SEQ ID NO: 166322 - RNA, 19 nt, Homo sapiens
cuguuaagaccuccuauug

SEQ ID NO: 166323 - RNA, 19 nt, Homo sapiens
ccaugucuaugcccuguac

SEQ ID NO: 166324 - RNA, 19 nt, Homo sapiens
ggccagagccaugucuaug

SEQ ID NO: 166325 - RNA, 19 nt, Homo sapiens
ugcuuguggugcauuauuu

SEQ ID NO: 166326 - RNA, 19 nt, Homo sapiens
cacgaccugucaugauguu

SEQ ID NO: 166327 - RNA, 19 nt, Homo sapiens
ucaccaucccuuuguaugu

SEQ ID NO: 166328 - RNA, 19 nt, Homo sapiens
augaggacgugucuguuau

SEQ ID NO: 166329 - RNA, 19 nt, Homo sapiens
caaguaucccucaccucaa

SEQ ID NO: 166330 - RNA, 19 nt, Homo sapiens
caacaacacugauggcuua

SEQ ID NO: 166331 - RNA, 19 nt, Homo sapiens
gaacugaggugaaauugug

SEQ ID NO: 166332 - RNA, 19 nt, Homo sapiens
cuucaaaggucaaacauua

SEQ ID NO: 166333 - RNA, 19 nt, Homo sapiens
gcaggaauauuaucuuguu

SEQ ID NO: 166334 - RNA, 19 nt, Homo sapiens
ggacagccaucacagagaa

SEQ ID NO: 166335 - RNA, 19 nt, Homo sapiens
gcacaccuaugccuuggua

SEQ ID NO: 166336 - RNA, 19 nt, Homo sapiens
caacacugauggcuuauau

SEQ ID NO: 166337 - RNA, 19 nt, Homo sapiens
gaaaucacuccacugcuua

SEQ ID NO: 166338 - RNA, 19 nt, Homo sapiens
gaaauugugcuccaugauu

SEQ ID NO: 166339 - RNA, 19 nt, Homo sapiens
aagccaaccuuacccauua

SEQ ID NO: 166340 - RNA, 19 nt, Homo sapiens
uaucacaacucuauggaaa

SEQ ID NO: 166341 - RNA, 19 nt, Homo sapiens
gaaaagauaucacaacucu

SEQ ID NO: 166342 - RNA, 19 nt, Homo sapiens
ggcauucuuuggauucuua

SEQ ID NO: 166343 - RNA, 19 nt, Homo sapiens
gggaacaacuggguauuug

SEQ ID NO: 166344 - RNA, 19 nt, Homo sapiens
ccaaguagcugggauuaca

SEQ ID NO: 166345 - RNA, 19 nt, Homo sapiens
gaccaaggcuuccauuugc

SEQ ID NO: 166346 - RNA, 19 nt, Homo sapiens
uaagugcccugaagaaagu

SEQ ID NO: 166347 - RNA, 19 nt, Homo sapiens
agaaaucacuccacugcuu

SEQ ID NO: 166348 - RNA, 19 nt, Homo sapiens
gcuuagauccauuccuuua

SEQ ID NO: 166349 - RNA, 19 nt, Homo sapiens
gcacuaucuuggcucauug

SEQ ID NO: 166350 - RNA, 19 nt, Homo sapiens
gaacaacuggguauuugga

SEQ ID NO: 166351 - RNA, 19 nt, Homo sapiens
gccaucauccggacacuua

SEQ ID NO: 166352 - RNA, 19 nt, Homo sapiens
uguguuacauugcccuuua

SEQ ID NO: 166353 - RNA, 19 nt, Homo sapiens
ccaaagugcuggauuacag

SEQ ID NO: 166354 - RNA, 19 nt, Homo sapiens
caagaacaacauaagcaua

SEQ ID NO: 166355 - RNA, 19 nt, Homo sapiens
ggacucaggucaucaaaau

SEQ ID NO: 166356 - RNA, 19 nt, Homo sapiens
acacugauggcuuauauuu

SEQ ID NO: 166357 - RNA, 19 nt, Homo sapiens
cugaccagcuccuuaagua

SEQ ID NO: 166358 - RNA, 19 nt, Homo sapiens
caacauaagcauagugcaa

SEQ ID NO: 166359 - RNA, 19 nt, Homo sapiens
gggcaacaguuuucuuaua

SEQ ID NO: 166360 - RNA, 19 nt, Homo sapiens
uacugaagcaggaauauua

SEQ ID NO: 166361 - RNA, 19 nt, Homo sapiens
caggucagccucccaagua

SEQ ID NO: 166362 - RNA, 19 nt, Homo sapiens
cugcuuaccuuacaaaaua

SEQ ID NO: 166363 - RNA, 19 nt, Homo sapiens
gugaaauugugcuccauga

SEQ ID NO: 166364 - RNA, 19 nt, Homo sapiens
ccacagucaucuucuaugg

SEQ ID NO: 166365 - RNA, 19 nt, Homo sapiens
ccaccacagucaucuucua

SEQ ID NO: 166366 - RNA, 19 nt, Homo sapiens
cauuugugcuuaucaucua

SEQ ID NO: 166367 - RNA, 19 nt, Homo sapiens
gcacaggagagcaaacuuc

SEQ ID NO: 166368 - RNA, 19 nt, Homo sapiens
cuuaauaguugcuuagauc

SEQ ID NO: 166369 - RNA, 19 nt, Homo sapiens
uggguagucuuaauaguug

SEQ ID NO: 166370 - RNA, 19 nt, Homo sapiens
aagcaggaauauuaucuug

SEQ ID NO: 166371 - RNA, 19 nt, Homo sapiens
uacauugcccuuuaagaua

SEQ ID NO: 166372 - RNA, 19 nt, Homo sapiens
guaccugaccagcuccuua

SEQ ID NO: 166373 - RNA, 19 nt, Homo sapiens
gacauuuccauuugccuua

SEQ ID NO: 166374 - RNA, 19 nt, Homo sapiens
gagagcaaacuucuacaga

SEQ ID NO: 166375 - RNA, 19 nt, Homo sapiens
ggcacuaucuuggcucauu

SEQ ID NO: 166376 - RNA, 19 nt, Homo sapiens
gaacaacauaagcauagug

SEQ ID NO: 166377 - RNA, 19 nt, Homo sapiens
ccaacucuauuacuucauc

SEQ ID NO: 166378 - RNA, 19 nt, Homo sapiens
ggaauauuaucuuguucag

SEQ ID NO: 166379 - RNA, 19 nt, Homo sapiens
ucacuccacugcuuaccuu

SEQ ID NO: 166380 - RNA, 19 nt, Homo sapiens
agaugguugugguauguua

SEQ ID NO: 166381 - RNA, 19 nt, Homo sapiens
gaagcaggaauauuaucuu

SEQ ID NO: 166382 - RNA, 19 nt, Homo sapiens
ggacaggagccacgauuac

SEQ ID NO: 166383 - RNA, 19 nt, Homo sapiens
acauggaacugaggugaaa

SEQ ID NO: 166384 - RNA, 19 nt, Homo sapiens
cucccaaagugcuggauua

SEQ ID NO: 166385 - RNA, 19 nt, Homo sapiens
agaaagugcuucacaucuc

SEQ ID NO: 166386 - RNA, 19 nt, Homo sapiens
ucuuauauaugcugccauu

SEQ ID NO: 166387 - RNA, 19 nt, Homo sapiens
uuacauugcccuuuaagau

SEQ ID NO: 166388 - RNA, 19 nt, Homo sapiens
uccgagcuccuaagaaaua

SEQ ID NO: 166389 - RNA, 19 nt, Homo sapiens
gcacggcacaggagagcaa

SEQ ID NO: 166390 - RNA, 19 nt, Homo sapiens
ggcaacaguuuucuuauau

SEQ ID NO: 166391 - RNA, 19 nt, Homo sapiens
acauugcccuuuaagauag

SEQ ID NO: 166392 - RNA, 19 nt, Homo sapiens
ccaucuaccuccugguguu

SEQ ID NO: 166393 - RNA, 19 nt, Homo sapiens
gagaaaagauaucacaacu

SEQ ID NO: 166394 - RNA, 19 nt, Homo sapiens
gaacuccugaccucaagug

SEQ ID NO: 166395 - RNA, 19 nt, Homo sapiens
uugcuuagauccauuccuu

SEQ ID NO: 166396 - RNA, 19 nt, Homo sapiens
gcuaacuacuacuacaaca

SEQ ID NO: 166397 - RNA, 19 nt, Homo sapiens
uccggacacuuaaugcaua

SEQ ID NO: 166398 - RNA, 19 nt, Homo sapiens
caccaugcccagcuacuaa

SEQ ID NO: 166399 - RNA, 19 nt, Homo sapiens
cuuaaugcauacgaucaua

SEQ ID NO: 166400 - RNA, 19 nt, Homo sapiens
acugauaccugccaucuac

SEQ ID NO: 166401 - RNA, 19 nt, Homo sapiens
acuucaagcucuuuaaauc

SEQ ID NO: 166402 - RNA, 19 nt, Homo sapiens
caaggacagccaucacaga

SEQ ID NO: 166403 - RNA, 19 nt, Homo sapiens
uagcuuaucaucucaaugg

SEQ ID NO: 166404 - RNA, 19 nt, Homo sapiens
ucuauuacuucaucuccuu

SEQ ID NO: 166405 - RNA, 19 nt, Homo sapiens
guccucaucucccuuccaa

SEQ ID NO: 166406 - RNA, 19 nt, Homo sapiens
guguuacauugcccuuuaa

SEQ ID NO: 166407 - RNA, 19 nt, Homo sapiens
acaaacaacuuggcaaagc

SEQ ID NO: 166408 - RNA, 19 nt, Homo sapiens
cuacuucaagcucuuuaaa

SEQ ID NO: 166409 - RNA, 19 nt, Homo sapiens
gauaucacaacucuaugga

SEQ ID NO: 166410 - RNA, 19 nt, Homo sapiens
ggaacugaggugaaauugu

SEQ ID NO: 166411 - RNA, 19 nt, Homo sapiens
gaacaaggacagccaucac

SEQ ID NO: 166412 - RNA, 19 nt, Homo sapiens
auacaaacaacuuggcaaa

SEQ ID NO: 166413 - RNA, 19 nt, Homo sapiens
caaccuggccauugcagau

SEQ ID NO: 166414 - RNA, 19 nt, Homo sapiens
aaauguuaaugcaggagaa

SEQ ID NO: 166415 - RNA, 19 nt, Homo sapiens
ggccucagccucccaaagu

SEQ ID NO: 166416 - RNA, 19 nt, Homo sapiens
acaccaccaugcccagcua

SEQ ID NO: 166417 - RNA, 19 nt, Homo sapiens
ggacuggugugggcaacag

SEQ ID NO: 166418 - RNA, 19 nt, Homo sapiens
acaccaaccuggccauugc

SEQ ID NO: 166419 - RNA, 19 nt, Homo sapiens
aucaccaucuucccuauuu

SEQ ID NO: 166420 - RNA, 19 nt, Homo sapiens
ggucaaacauuacaaaagc

SEQ ID NO: 166421 - RNA, 19 nt, Homo sapiens
ucaaaggucaaacauuaca

SEQ ID NO: 166422 - RNA, 19 nt, Homo sapiens
aagaacaacauaagcauag

SEQ ID NO: 166423 - RNA, 19 nt, Homo sapiens
uaacuacuacuacaacaac

SEQ ID NO: 166424 - RNA, 19 nt, Homo sapiens
caugcuaacuacuacuaca

SEQ ID NO: 166425 - RNA, 19 nt, Homo sapiens
ucaccaugcuaacuacuac

SEQ ID NO: 166426 - RNA, 19 nt, Homo sapiens
ccacugcuuaccuuacaaa

SEQ ID NO: 166427 - RNA, 19 nt, Homo sapiens
uaaggcgagucuccucauc

SEQ ID NO: 166428 - RNA, 19 nt, Homo sapiens
uaaugcauacgaucauaga

SEQ ID NO: 166429 - RNA, 19 nt, Homo sapiens
ccuaugccuugguaacaug

SEQ ID NO: 166430 - RNA, 19 nt, Homo sapiens
ggcaaggacuuaauuuaua

SEQ ID NO: 166431 - RNA, 19 nt, Homo sapiens
gaacaacacuuuccuaagc

SEQ ID NO: 166432 - RNA, 19 nt, Homo sapiens
gcacauaacaugcuuuaga

SEQ ID NO: 166433 - RNA, 19 nt, Homo sapiens
caaauacuguggcagcaua

SEQ ID NO: 166434 - RNA, 19 nt, Homo sapiens
caaagaugcuaguauuaug

SEQ ID NO: 166435 - RNA, 19 nt, Homo sapiens
agucuacacuguucaaaua

SEQ ID NO: 166436 - RNA, 19 nt, Homo sapiens
gcaaggacuuaauuuauac

SEQ ID NO: 166437 - RNA, 19 nt, Homo sapiens
cauuggagcugugguauuu

SEQ ID NO: 166438 - RNA, 19 nt, Homo sapiens
caccuuaccuggagacaaa

SEQ ID NO: 166439 - RNA, 19 nt, Homo sapiens
gauuauauauuccgcacuu

SEQ ID NO: 166440 - RNA, 19 nt, Homo sapiens
gaaggaaauugggugcauu

SEQ ID NO: 166441 - RNA, 19 nt, Homo sapiens
gaggauagaauacauggaa

SEQ ID NO: 166442 - RNA, 19 nt, Homo sapiens
gauaugaccuguuauuacc

SEQ ID NO: 166443 - RNA, 19 nt, Homo sapiens
acuuaaagcuucuaugguu

SEQ ID NO: 166444 - RNA, 19 nt, Homo sapiens
caucagcauuagucacuuu

SEQ ID NO: 166445 - RNA, 19 nt, Homo sapiens
ucccaaagaugcuaguauu

SEQ ID NO: 166446 - RNA, 19 nt, Homo sapiens
ccaaagaugcuaguauuau

SEQ ID NO: 166447 - RNA, 19 nt, Homo sapiens
gaaugugaccguagaagau

SEQ ID NO: 166448 - RNA, 19 nt, Homo sapiens
ggacagccaacaauucaga

SEQ ID NO: 166449 - RNA, 19 nt, Homo sapiens
gggagccucuguaugagaa

SEQ ID NO: 166450 - RNA, 19 nt, Homo sapiens
ucaaucaagucuacacugu

SEQ ID NO: 166451 - RNA, 19 nt, Homo sapiens
cacauaacaugcuuuagau

SEQ ID NO: 166452 - RNA, 19 nt, Homo sapiens
acaguuaaccggaagagua

SEQ ID NO: 166453 - RNA, 19 nt, Homo sapiens
ggaaggaaauugggugcau

SEQ ID NO: 166454 - RNA, 19 nt, Homo sapiens
gcacuaccacgccaagcua

SEQ ID NO: 166455 - RNA, 19 nt, Homo sapiens
gcaugaagacccuggaguu

SEQ ID NO: 166456 - RNA, 19 nt, Homo sapiens
uacaaccaauuccaaguuu

SEQ ID NO: 166457 - RNA, 19 nt, Homo sapiens
ugaaauguaacgaauggua

SEQ ID NO: 166458 - RNA, 19 nt, Homo sapiens
ucagaaggaacaacacuuu

SEQ ID NO: 166459 - RNA, 19 nt, Homo sapiens
cugggcagcuuccuaauau

SEQ ID NO: 166460 - RNA, 19 nt, Homo sapiens
cagcauuagucacuuugaa

SEQ ID NO: 166461 - RNA, 19 nt, Homo sapiens
aaucaagucuacacuguuc

SEQ ID NO: 166462 - RNA, 19 nt, Homo sapiens
uguggcagcauauaauuua

SEQ ID NO: 166463 - RNA, 19 nt, Homo sapiens
ggcuauaucucuacacaag

SEQ ID NO: 166464 - RNA, 19 nt, Homo sapiens
guacuuaaagcuucuaugg

SEQ ID NO: 166465 - RNA, 19 nt, Homo sapiens
cauccuggcuauaucucua

SEQ ID NO: 166466 - RNA, 19 nt, Homo sapiens
ucaaauaagcacuaaguca

SEQ ID NO: 166467 - RNA, 19 nt, Homo sapiens
gcacugugaccgagaacuu

SEQ ID NO: 166468 - RNA, 19 nt, Homo sapiens
cauaaaggaagcacuguug

SEQ ID NO: 166469 - RNA, 19 nt, Homo sapiens
ccgacgagauugugaagga

SEQ ID NO: 166470 - RNA, 19 nt, Homo sapiens
gcacuaagucaggagauug

SEQ ID NO: 166471 - RNA, 19 nt, Homo sapiens
gacggagucuugcucuguu

SEQ ID NO: 166472 - RNA, 19 nt, Homo sapiens
guuauuaccauuagcauuc

SEQ ID NO: 166473 - RNA, 19 nt, Homo sapiens
ccaaacccgucaaucaagu

SEQ ID NO: 166474 - RNA, 19 nt, Homo sapiens
gcuucaggcacuacaaaua

SEQ ID NO: 166475 - RNA, 19 nt, Homo sapiens
aaacaauugggcaaacuuu

SEQ ID NO: 166476 - RNA, 19 nt, Homo sapiens
ggacuuuucuaacauaugu

SEQ ID NO: 166477 - RNA, 19 nt, Homo sapiens
ccgaguagcugggauuaca

SEQ ID NO: 166478 - RNA, 19 nt, Homo sapiens
cuauaucucuacacaagug

SEQ ID NO: 166479 - RNA, 19 nt, Homo sapiens
uuggaaaucuucaaguuca

SEQ ID NO: 166480 - RNA, 19 nt, Homo sapiens
agccaacaauucagaguuu

SEQ ID NO: 166481 - RNA, 19 nt, Homo sapiens
guacuacaaccaauuccaa

SEQ ID NO: 166482 - RNA, 19 nt, Homo sapiens
gcauuagucacuuugaaau

SEQ ID NO: 166483 - RNA, 19 nt, Homo sapiens
gaccuguuauuaccauuag

SEQ ID NO: 166484 - RNA, 19 nt, Homo sapiens
caucauccuugucaucauc

SEQ ID NO: 166485 - RNA, 19 nt, Homo sapiens
gcuuuacaaucugcacuuu

SEQ ID NO: 166486 - RNA, 19 nt, Homo sapiens
uggcaaggacuuaauuuau

SEQ ID NO: 166487 - RNA, 19 nt, Homo sapiens
aaaggugacugggaauugu

SEQ ID NO: 166488 - RNA, 19 nt, Homo sapiens
ccuaauaugcuuuacaauc

SEQ ID NO: 166489 - RNA, 19 nt, Homo sapiens
guuaagugcaggagacauu

SEQ ID NO: 166490 - RNA, 19 nt, Homo sapiens
cucuugauaugaccuguua

SEQ ID NO: 166491 - RNA, 19 nt, Homo sapiens
gaauacauggaaacgcaaa

SEQ ID NO: 166492 - RNA, 19 nt, Homo sapiens
guacagacagcccgguaga

SEQ ID NO: 166493 - RNA, 19 nt, Homo sapiens
gcagcuuccuaauaugcuu

SEQ ID NO: 166494 - RNA, 19 nt, Homo sapiens
gcaggagacauugguauuc

SEQ ID NO: 166495 - RNA, 19 nt, Homo sapiens
caaaugggaaaaugucuua

SEQ ID NO: 166496 - RNA, 19 nt, Homo sapiens
caaccaauuccaaguuuua

SEQ ID NO: 166497 - RNA, 19 nt, Homo sapiens
uaaaggugacugggaauug

SEQ ID NO: 166498 - RNA, 19 nt, Homo sapiens
uaagucaggagauuggaaa

SEQ ID NO: 166499 - RNA, 19 nt, Homo sapiens
cuacaaccaauuccaaguu

SEQ ID NO: 166500 - RNA, 19 nt, Homo sapiens
ugauguggauaaaggagaa

SEQ ID NO: 166501 - RNA, 19 nt, Homo sapiens
ugauugauguggauaaagg

SEQ ID NO: 166502 - RNA, 19 nt, Homo sapiens
gaaaacagccaaaacaaac

SEQ ID NO: 166503 - RNA, 19 nt, Homo sapiens
guucaaauaagcacuaagu

SEQ ID NO: 166504 - RNA, 19 nt, Homo sapiens
cccaaagaugcuaguauua

SEQ ID NO: 166505 - RNA, 19 nt, Homo sapiens
guggcagcauauaauuuaa

SEQ ID NO: 166506 - RNA, 19 nt, Homo sapiens
uggcacgggucuucuccua

SEQ ID NO: 166507 - RNA, 19 nt, Homo sapiens
caauccauguaggaaagua

SEQ ID NO: 166508 - RNA, 19 nt, Homo sapiens
ugaccuguuauuaccauua

SEQ ID NO: 166509 - RNA, 19 nt, Homo sapiens
uaaaggaagcacuguugga

SEQ ID NO: 166510 - RNA, 19 nt, Homo sapiens
caucauuggagcuguggua

SEQ ID NO: 166511 - RNA, 19 nt, Homo sapiens
gaaaggggaauucagagaa

SEQ ID NO: 166512 - RNA, 19 nt, Homo sapiens
ggagaaaggggaauucaga

SEQ ID NO: 166513 - RNA, 19 nt, Homo sapiens
ugaccucaccgacgagauu

SEQ ID NO: 166514 - RNA, 19 nt, Homo sapiens
cagaguuuaugauuuaagg

SEQ ID NO: 166515 - RNA, 19 nt, Homo sapiens
gauuacaggugcgcacuac

SEQ ID NO: 166516 - RNA, 19 nt, Homo sapiens
uacugcaaaugcuauauug

SEQ ID NO: 166517 - RNA, 19 nt, Homo sapiens
uugaacaggugggaacaaa

SEQ ID NO: 166518 - RNA, 19 nt, Homo sapiens
agacuacuauacaaacuac

SEQ ID NO: 166519 - RNA, 19 nt, Homo sapiens
caggagacauugguauucu

SEQ ID NO: 166520 - RNA, 19 nt, Homo sapiens
ucaggaauacauuuggaaa

SEQ ID NO: 166521 - RNA, 19 nt, Homo sapiens
guaggaaaguaaaauggaa

SEQ ID NO: 166522 - RNA, 19 nt, Homo sapiens
gagcuacugcaaaugcuau

SEQ ID NO: 166523 - RNA, 19 nt, Homo sapiens
uguuggagcuacugcaaau

SEQ ID NO: 166524 - RNA, 19 nt, Homo sapiens
guacuuggcacgggucuuc

SEQ ID NO: 166525 - RNA, 19 nt, Homo sapiens
caaucugcacuuuaacuga

SEQ ID NO: 166526 - RNA, 19 nt, Homo sapiens
cuacugcaaaugcuauauu

SEQ ID NO: 166527 - RNA, 19 nt, Homo sapiens
ggagcuacugcaaaugcua

SEQ ID NO: 166528 - RNA, 19 nt, Homo sapiens
ugaaugugaccguagaaga

SEQ ID NO: 166529 - RNA, 19 nt, Homo sapiens
ccccagaguucacaccuua

SEQ ID NO: 166530 - RNA, 19 nt, Homo sapiens
ggacgaagcuguucuggau

SEQ ID NO: 166531 - RNA, 19 nt, Homo sapiens
acacagagauggaauagaa

SEQ ID NO: 166532 - RNA, 19 nt, Homo sapiens
caaagagacuccaagauuc

SEQ ID NO: 166533 - RNA, 19 nt, Homo sapiens
gaacuguccuggcaccaaa

SEQ ID NO: 166534 - RNA, 19 nt, Homo sapiens
gaauggagcucaguugugu

SEQ ID NO: 166535 - RNA, 19 nt, Homo sapiens
ggagagagacucaaagaga

SEQ ID NO: 166536 - RNA, 19 nt, Homo sapiens
ucaaagagacuccaagauu

SEQ ID NO: 166537 - RNA, 19 nt, Homo sapiens
ucaaagagacuaauagaga

SEQ ID NO: 166538 - RNA, 19 nt, Homo sapiens
gcacagagauaugcacaca

SEQ ID NO: 166539 - RNA, 19 nt, Homo sapiens
cuucccagcuucacaauaa

SEQ ID NO: 166540 - RNA, 19 nt, Homo sapiens
caucuucacuucagacaau

SEQ ID NO: 166541 - RNA, 19 nt, Homo sapiens
gcagagauuucaucauggu

SEQ ID NO: 166542 - RNA, 19 nt, Homo sapiens
caccaaaucccauauauuc

SEQ ID NO: 166543 - RNA, 19 nt, Homo sapiens
gcacacgcacauagagaua

SEQ ID NO: 166544 - RNA, 19 nt, Homo sapiens
cugcagagauuucaucaug

SEQ ID NO: 166545 - RNA, 19 nt, Homo sapiens
gcacacccacaguugaaua

SEQ ID NO: 166546 - RNA, 19 nt, Homo sapiens
acacagauaugcacacaca

SEQ ID NO: 166547 - RNA, 19 nt, Homo sapiens
acacacagauauacacaug

SEQ ID NO: 166548 - RNA, 19 nt, Homo sapiens
cauauauucuucugcaguu

SEQ ID NO: 166549 - RNA, 19 nt, Homo sapiens
gcaccaaaucccauauauu

SEQ ID NO: 166550 - RNA, 19 nt, Homo sapiens
caaaucccauauauucuuc

SEQ ID NO: 166551 - RNA, 19 nt, Homo sapiens
acacacagaugcacacaca

SEQ ID NO: 166552 - RNA, 19 nt, Homo sapiens
acacacagaugcacacaca

SEQ ID NO: 166553 - RNA, 19 nt, Homo sapiens
acacacagaugcacacaca

SEQ ID NO: 166554 - RNA, 19 nt, Homo sapiens
acacacagauggucacaca

SEQ ID NO: 166555 - RNA, 19 nt, Homo sapiens
acacauggaugcacacaca

SEQ ID NO: 166556 - RNA, 19 nt, Homo sapiens
guagaggcaugaacacaca

SEQ ID NO: 166557 - RNA, 19 nt, Homo sapiens
caugugugcuguccucuga

SEQ ID NO: 166558 - RNA, 19 nt, Homo sapiens
acacagauauacacaugga

SEQ ID NO: 166559 - RNA, 19 nt, Homo sapiens
gcacgcacaugccaaugca

SEQ ID NO: 166560 - RNA, 19 nt, Homo sapiens
gcacacacacagagauaug

SEQ ID NO: 166561 - RNA, 19 nt, Homo sapiens
ucaaguccaugccagaaug

SEQ ID NO: 166562 - RNA, 19 nt, Homo sapiens
acgaagcuguucuggauuu

SEQ ID NO: 166563 - RNA, 19 nt, Homo sapiens
acagagauaugcacacaca

SEQ ID NO: 166564 - RNA, 19 nt, Homo sapiens
ggagggagacagagacaga

SEQ ID NO: 166565 - RNA, 19 nt, Homo sapiens
ccaaaucccauauauucuu

SEQ ID NO: 166566 - RNA, 19 nt, Homo sapiens
gaccagcuccaguccuaua

SEQ ID NO: 166567 - RNA, 19 nt, Homo sapiens
acacagagauacgcaaaca

SEQ ID NO: 166568 - RNA, 19 nt, Homo sapiens
ggacauggagagagacuca

SEQ ID NO: 166569 - RNA, 19 nt, Homo sapiens
acaccagggucucccagua

SEQ ID NO: 166570 - RNA, 19 nt, Homo sapiens
agacagagacagaaacaga

SEQ ID NO: 166571 - RNA, 19 nt, Homo sapiens
ggcaccaaaucccauauau

SEQ ID NO: 166572 - RNA, 19 nt, Homo sapiens
ggaccagugugccucaagu

SEQ ID NO: 166573 - RNA, 19 nt, Homo sapiens
gagacacagagauggaaua

SEQ ID NO: 166574 - RNA, 19 nt, Homo sapiens
uaauagagacacagagaug

SEQ ID NO: 166575 - RNA, 19 nt, Homo sapiens
acacaccgauguacacaca

SEQ ID NO: 166576 - RNA, 19 nt, Homo sapiens
gcacacacaccgauguaca

SEQ ID NO: 166577 - RNA, 19 nt, Homo sapiens
gauaugcacacaccgaugu

SEQ ID NO: 166578 - RNA, 19 nt, Homo sapiens
acacagagauaugcacaca

SEQ ID NO: 166579 - RNA, 19 nt, Homo sapiens
cugcugcucugccuucauu

SEQ ID NO: 166580 - RNA, 19 nt, Homo sapiens
acuccaagauucaaagaga

SEQ ID NO: 166581 - RNA, 19 nt, Homo sapiens
ggagacagagacagaaaca

SEQ ID NO: 166582 - RNA, 19 nt, Homo sapiens
auagagauaugcacacaca

SEQ ID NO: 166583 - RNA, 19 nt, Homo sapiens
ugaaggcgguuguuuagcu

SEQ ID NO: 166584 - RNA, 19 nt, Homo sapiens
acacacggaugcacacaca

SEQ ID NO: 166585 - RNA, 19 nt, Homo sapiens
gugagacgcacaaggauga

SEQ ID NO: 166586 - RNA, 19 nt, Homo sapiens
gauaugcacacacauggau

SEQ ID NO: 166587 - RNA, 19 nt, Homo sapiens
gcacacacagauauacaca

SEQ ID NO: 166588 - RNA, 19 nt, Homo sapiens
caagauucaaagagacuaa

SEQ ID NO: 166589 - RNA, 19 nt, Homo sapiens
aaagagacuccaagauuca

SEQ ID NO: 166590 - RNA, 19 nt, Homo sapiens
ggcccacuguuucgacaaa

SEQ ID NO: 166591 - RNA, 19 nt, Homo sapiens
guucuuauccauuaucauc

SEQ ID NO: 166592 - RNA, 19 nt, Homo sapiens
gcgcacacacaccgaugua

SEQ ID NO: 166593 - RNA, 19 nt, Homo sapiens
ccaaugcacgcacacauca

SEQ ID NO: 166594 - RNA, 19 nt, Homo sapiens
ccucacagagucuucguaa

SEQ ID NO: 166595 - RNA, 19 nt, Homo sapiens
agacagaaacagagagaga

SEQ ID NO: 166596 - RNA, 19 nt, Homo sapiens
gcacugcagagauuucauc

SEQ ID NO: 166597 - RNA, 19 nt, Homo sapiens
gaccagcugaucuguguga

SEQ ID NO: 166598 - RNA, 19 nt, Homo sapiens
cagaugcacacacagauau

SEQ ID NO: 166599 - RNA, 19 nt, Homo sapiens
acacagauggucacacaga

SEQ ID NO: 166600 - RNA, 19 nt, Homo sapiens
gacaguagaggcaugaaca

SEQ ID NO: 166601 - RNA, 19 nt, Homo sapiens
cugaggacauggagagaga

SEQ ID NO: 166602 - RNA, 19 nt, Homo sapiens
cccgggagaucuucaagga

SEQ ID NO: 166603 - RNA, 19 nt, Homo sapiens
acagaugcacacacagaua

SEQ ID NO: 166604 - RNA, 19 nt, Homo sapiens
gagauaugcacacacagau

SEQ ID NO: 166605 - RNA, 19 nt, Homo sapiens
ggagacaguagaggcauga

SEQ ID NO: 166606 - RNA, 19 nt, Homo sapiens
acacagaugcacacacaga

SEQ ID NO: 166607 - RNA, 19 nt, Homo sapiens
acacagaugcacacacaga

SEQ ID NO: 166608 - RNA, 19 nt, Homo sapiens
ucacacagagauacgcaaa

SEQ ID NO: 166609 - RNA, 19 nt, Homo sapiens
cuucauugcuggagacagu

SEQ ID NO: 166610 - RNA, 19 nt, Homo sapiens
ccauuaucaucuucacuuc

SEQ ID NO: 166611 - RNA, 19 nt, Homo sapiens
gcccagcugagccuccuua

SEQ ID NO: 166612 - RNA, 19 nt, Homo sapiens
gaacuggaggaaccugauc

SEQ ID NO: 166613 - RNA, 19 nt, Homo sapiens
ccaaauaucacggaguaca

SEQ ID NO: 166614 - RNA, 19 nt, Homo sapiens
cagcuccaguccuauaucu

SEQ ID NO: 166615 - RNA, 19 nt, Homo sapiens
aagcuguucuggauuucuu

SEQ ID NO: 166616 - RNA, 19 nt, Homo sapiens
acagagauacgcaaacaca

SEQ ID NO: 166617 - RNA, 19 nt, Homo sapiens
guucuggauuucuuacagu

SEQ ID NO: 166618 - RNA, 19 nt, Homo sapiens
ucacuucagacaauucaga

SEQ ID NO: 166619 - RNA, 19 nt, Homo sapiens
agagauaugcacacacaga

SEQ ID NO: 166620 - RNA, 19 nt, Homo sapiens
caaauaucacggaguacau

SEQ ID NO: 166621 - RNA, 19 nt, Homo sapiens
ggacccugaucaacaccau

SEQ ID NO: 166622 - RNA, 19 nt, Homo sapiens
agacaauucagaagcauca

SEQ ID NO: 166623 - RNA, 19 nt, Homo sapiens
acagauaugcacacacaug

SEQ ID NO: 166624 - RNA, 19 nt, Homo sapiens
gauucaaagagacuaauag

SEQ ID NO: 166625 - RNA, 19 nt, Homo sapiens
gcccacaugccacccacua

SEQ ID NO: 166626 - RNA, 19 nt, Homo sapiens
ccccaaauaucacggagua

SEQ ID NO: 166627 - RNA, 19 nt, Homo sapiens
gagauggaauagaaaagau

SEQ ID NO: 166628 - RNA, 19 nt, Homo sapiens
ggugaauggagcucaguug

SEQ ID NO: 166629 - RNA, 19 nt, Homo sapiens
acaccgauguacacacaca

SEQ ID NO: 166630 - RNA, 19 nt, Homo sapiens
ggacgaagcuguucuggau

SEQ ID NO: 166631 - RNA, 19 nt, Homo sapiens
acacagagauggaauagaa

SEQ ID NO: 166632 - RNA, 19 nt, Homo sapiens
caaagagacuccaagauuc

SEQ ID NO: 166633 - RNA, 19 nt, Homo sapiens
gaacuguccuggcaccaaa

SEQ ID NO: 166634 - RNA, 19 nt, Homo sapiens
gaauggagcucaguugugu

SEQ ID NO: 166635 - RNA, 19 nt, Homo sapiens
ggagagagacucaaagaga

SEQ ID NO: 166636 - RNA, 19 nt, Homo sapiens
ucaaagagacuccaagauu

SEQ ID NO: 166637 - RNA, 19 nt, Homo sapiens
ucaaagagacuaauagaga

SEQ ID NO: 166638 - RNA, 19 nt, Homo sapiens
gcacagagauaugcacaca

SEQ ID NO: 166639 - RNA, 19 nt, Homo sapiens
cuucccagcuucacaauaa

SEQ ID NO: 166640 - RNA, 19 nt, Homo sapiens
caucuucacuucagacaau

SEQ ID NO: 166641 - RNA, 19 nt, Homo sapiens
gcagagauuucaucauggu

SEQ ID NO: 166642 - RNA, 19 nt, Homo sapiens
caccaaaucccauauauuc

SEQ ID NO: 166643 - RNA, 19 nt, Homo sapiens
gcacacgcacauagagaua

SEQ ID NO: 166644 - RNA, 19 nt, Homo sapiens
cugcagagauuucaucaug

SEQ ID NO: 166645 - RNA, 19 nt, Homo sapiens
gcacacccacaguugaaua

SEQ ID NO: 166646 - RNA, 19 nt, Homo sapiens
acacagauaugcacacaca

SEQ ID NO: 166647 - RNA, 19 nt, Homo sapiens
acacacagauauacacaug

SEQ ID NO: 166648 - RNA, 19 nt, Homo sapiens
cauauauucuucugcaguu

SEQ ID NO: 166649 - RNA, 19 nt, Homo sapiens
gcaccaaaucccauauauu

SEQ ID NO: 166650 - RNA, 19 nt, Homo sapiens
caaaucccauauauucuuc

SEQ ID NO: 166651 - RNA, 19 nt, Homo sapiens
acacacagaugcacacaca

SEQ ID NO: 166652 - RNA, 19 nt, Homo sapiens
acacacagaugcacacaca

SEQ ID NO: 166653 - RNA, 19 nt, Homo sapiens
acacacagaugcacacaca

SEQ ID NO: 166654 - RNA, 19 nt, Homo sapiens
acacacagauggucacaca

SEQ ID NO: 166655 - RNA, 19 nt, Homo sapiens
acacauggaugcacacaca

SEQ ID NO: 166656 - RNA, 19 nt, Homo sapiens
guagaggcaugaacacaca

SEQ ID NO: 166657 - RNA, 19 nt, Homo sapiens
caugugugcuguccucuga

SEQ ID NO: 166658 - RNA, 19 nt, Homo sapiens
acacagauauacacaugga

SEQ ID NO: 166659 - RNA, 19 nt, Homo sapiens
gcacgcacaugccaaugca

SEQ ID NO: 166660 - RNA, 19 nt, Homo sapiens
acgaagcuguucuggauuu

SEQ ID NO: 166661 - RNA, 19 nt, Homo sapiens
gcacacacacagagauaug

SEQ ID NO: 166662 - RNA, 19 nt, Homo sapiens
ucaaguccaugccagaaug

SEQ ID NO: 166663 - RNA, 19 nt, Homo sapiens
acagagauaugcacacaca

SEQ ID NO: 166664 - RNA, 19 nt, Homo sapiens
ggagggagacagagacaga

SEQ ID NO: 166665 - RNA, 19 nt, Homo sapiens
ccaaaucccauauauucuu

SEQ ID NO: 166666 - RNA, 19 nt, Homo sapiens
gaccagcuccaguccuaua

SEQ ID NO: 166667 - RNA, 19 nt, Homo sapiens
acacagagauacgcaaaca

SEQ ID NO: 166668 - RNA, 19 nt, Homo sapiens
ggacauggagagagacuca

SEQ ID NO: 166669 - RNA, 19 nt, Homo sapiens
acaccagggucucccagua

SEQ ID NO: 166670 - RNA, 19 nt, Homo sapiens
agacagagacagaaacaga

SEQ ID NO: 166671 - RNA, 19 nt, Homo sapiens
ggcaccaaaucccauauau

SEQ ID NO: 166672 - RNA, 19 nt, Homo sapiens
ggaccagugugccucaagu

SEQ ID NO: 166673 - RNA, 19 nt, Homo sapiens
gagacacagagauggaaua

SEQ ID NO: 166674 - RNA, 19 nt, Homo sapiens
uaauagagacacagagaug

SEQ ID NO: 166675 - RNA, 19 nt, Homo sapiens
acacaccgauguacacaca

SEQ ID NO: 166676 - RNA, 19 nt, Homo sapiens
gcacacacaccgauguaca

SEQ ID NO: 166677 - RNA, 19 nt, Homo sapiens
gauaugcacacaccgaugu

SEQ ID NO: 166678 - RNA, 19 nt, Homo sapiens
acacagagauaugcacaca

SEQ ID NO: 166679 - RNA, 19 nt, Homo sapiens
cugcugcucugccuucauu

SEQ ID NO: 166680 - RNA, 19 nt, Homo sapiens
acuccaagauucaaagaga

SEQ ID NO: 166681 - RNA, 19 nt, Homo sapiens
ggagacagagacagaaaca

SEQ ID NO: 166682 - RNA, 19 nt, Homo sapiens
auagagauaugcacacaca

SEQ ID NO: 166683 - RNA, 19 nt, Homo sapiens
ugaaggcgguuguuuagcu

SEQ ID NO: 166684 - RNA, 19 nt, Homo sapiens
acacacggaugcacacaca

SEQ ID NO: 166685 - RNA, 19 nt, Homo sapiens
gugagacgcacaaggauga

SEQ ID NO: 166686 - RNA, 19 nt, Homo sapiens
gauaugcacacacauggau

SEQ ID NO: 166687 - RNA, 19 nt, Homo sapiens
gcacacacagauauacaca

SEQ ID NO: 166688 - RNA, 19 nt, Homo sapiens
caagauucaaagagacuaa

SEQ ID NO: 166689 - RNA, 19 nt, Homo sapiens
aaagagacuccaagauuca

SEQ ID NO: 166690 - RNA, 19 nt, Homo sapiens
ggcccacuguuucgacaaa

SEQ ID NO: 166691 - RNA, 19 nt, Homo sapiens
guucuuauccauuaucauc

SEQ ID NO: 166692 - RNA, 19 nt, Homo sapiens
gcgcacacacaccgaugua

SEQ ID NO: 166693 - RNA, 19 nt, Homo sapiens
ccaaugcacgcacacauca

SEQ ID NO: 166694 - RNA, 19 nt, Homo sapiens
agacagaaacagagagaga

SEQ ID NO: 166695 - RNA, 19 nt, Homo sapiens
gcacugcagagauuucauc

SEQ ID NO: 166696 - RNA, 19 nt, Homo sapiens
gaccagcugaucuguguga

SEQ ID NO: 166697 - RNA, 19 nt, Homo sapiens
cagaugcacacacagauau

SEQ ID NO: 166698 - RNA, 19 nt, Homo sapiens
acacagauggucacacaga

SEQ ID NO: 166699 - RNA, 19 nt, Homo sapiens
gacaguagaggcaugaaca

SEQ ID NO: 166700 - RNA, 19 nt, Homo sapiens
cugaggacauggagagaga

SEQ ID NO: 166701 - RNA, 19 nt, Homo sapiens
acagaugcacacacagaua

SEQ ID NO: 166702 - RNA, 19 nt, Homo sapiens
gagauaugcacacacagau

SEQ ID NO: 166703 - RNA, 19 nt, Homo sapiens
ggagacaguagaggcauga

SEQ ID NO: 166704 - RNA, 19 nt, Homo sapiens
cccgggagaucuucaagga

SEQ ID NO: 166705 - RNA, 19 nt, Homo sapiens
acacagaugcacacacaga

SEQ ID NO: 166706 - RNA, 19 nt, Homo sapiens
acacagaugcacacacaga

SEQ ID NO: 166707 - RNA, 19 nt, Homo sapiens
ucacacagagauacgcaaa

SEQ ID NO: 166708 - RNA, 19 nt, Homo sapiens
cuucauugcuggagacagu

SEQ ID NO: 166709 - RNA, 19 nt, Homo sapiens
ccauuaucaucuucacuuc

SEQ ID NO: 166710 - RNA, 19 nt, Homo sapiens
gcccagcugagccuccuua

SEQ ID NO: 166711 - RNA, 19 nt, Homo sapiens
gaacuggaggaaccugauc

SEQ ID NO: 166712 - RNA, 19 nt, Homo sapiens
ccaaauaucacggaguaca

SEQ ID NO: 166713 - RNA, 19 nt, Homo sapiens
cagcuccaguccuauaucu

SEQ ID NO: 166714 - RNA, 19 nt, Homo sapiens
aagcuguucuggauuucuu

SEQ ID NO: 166715 - RNA, 19 nt, Homo sapiens
acagagauacgcaaacaca

SEQ ID NO: 166716 - RNA, 19 nt, Homo sapiens
guucuggauuucuuacagu

SEQ ID NO: 166717 - RNA, 19 nt, Homo sapiens
ucacuucagacaauucaga

SEQ ID NO: 166718 - RNA, 19 nt, Homo sapiens
agagauaugcacacacaga

SEQ ID NO: 166719 - RNA, 19 nt, Homo sapiens
caaauaucacggaguacau

SEQ ID NO: 166720 - RNA, 19 nt, Homo sapiens
ggacccugaucaacaccau

SEQ ID NO: 166721 - RNA, 19 nt, Homo sapiens
agacaauucagaagcauca

SEQ ID NO: 166722 - RNA, 19 nt, Homo sapiens
acagauaugcacacacaug

SEQ ID NO: 166723 - RNA, 19 nt, Homo sapiens
gauucaaagagacuaauag

SEQ ID NO: 166724 - RNA, 19 nt, Homo sapiens
gcccacaugccacccacua

SEQ ID NO: 166725 - RNA, 19 nt, Homo sapiens
ccccaaauaucacggagua

SEQ ID NO: 166726 - RNA, 19 nt, Homo sapiens
gagauggaauagaaaagau

SEQ ID NO: 166727 - RNA, 19 nt, Homo sapiens
ggugaauggagcucaguug

SEQ ID NO: 166728 - RNA, 19 nt, Homo sapiens
acaccgauguacacacaca

SEQ ID NO: 166729 - RNA, 19 nt, Homo sapiens
ggagaggacgaagcuguuc

SEQ ID NO: 166730 - RNA, 19 nt, Homo sapiens
gaaagaagaugauaaaguc

SEQ ID NO: 166731 - RNA, 19 nt, Homo sapiens
gagcagaaguugaagauaa

SEQ ID NO: 166732 - RNA, 19 nt, Homo sapiens
gcaaauagaucuccauuac

SEQ ID NO: 166733 - RNA, 19 nt, Homo sapiens
gauaggagauacaaacuuu

SEQ ID NO: 166734 - RNA, 19 nt, Homo sapiens
ggaacuagcucuuuuauuu

SEQ ID NO: 166735 - RNA, 19 nt, Homo sapiens
ccagauaugucguucuuua

SEQ ID NO: 166736 - RNA, 19 nt, Homo sapiens
gaaaggcugugcucucaaa

SEQ ID NO: 166737 - RNA, 19 nt, Homo sapiens
caagagaagucaccagaaa

SEQ ID NO: 166738 - RNA, 19 nt, Homo sapiens
gcaaagguaucaucauuuc

SEQ ID NO: 166739 - RNA, 19 nt, Homo sapiens
ggaaagaacucucugaacu

SEQ ID NO: 166740 - RNA, 19 nt, Homo sapiens
ugaaagcaaucaugcaaua

SEQ ID NO: 166741 - RNA, 19 nt, Homo sapiens
caagaacacuggugauuau

SEQ ID NO: 166742 - RNA, 19 nt, Homo sapiens
ggagaaaccugcaugaaag

SEQ ID NO: 166743 - RNA, 19 nt, Homo sapiens
gaacagagggagcgauuaa

SEQ ID NO: 166744 - RNA, 19 nt, Homo sapiens
uaagagagcuuugaaacaa

SEQ ID NO: 166745 - RNA, 19 nt, Homo sapiens
ggagagagaucuagcuuca

SEQ ID NO: 166746 - RNA, 19 nt, Homo sapiens
gaaagagaaugguccaaug

SEQ ID NO: 166747 - RNA, 19 nt, Homo sapiens
ggacaguuaugaagauauu

SEQ ID NO: 166748 - RNA, 19 nt, Homo sapiens
cauggaagcuuaugucaaa

SEQ ID NO: 166749 - RNA, 19 nt, Homo sapiens
ggaaauaacucguacuacu

SEQ ID NO: 166750 - RNA, 19 nt, Homo sapiens
ggauauaccuucaaacaca

SEQ ID NO: 166751 - RNA, 19 nt, Homo sapiens
ggagacacacuguugauua

SEQ ID NO: 166752 - RNA, 19 nt, Homo sapiens
ugacaacucuccuuccuuu

SEQ ID NO: 166753 - RNA, 19 nt, Homo sapiens
gacuaaagauaaugccuua

SEQ ID NO: 166754 - RNA, 19 nt, Homo sapiens
ggagaaagaagaugauaaa

SEQ ID NO: 166755 - RNA, 19 nt, Homo sapiens
gaaggaagauuuugacauu

SEQ ID NO: 166756 - RNA, 19 nt, Homo sapiens
guacuacucuucagucaga

SEQ ID NO: 166757 - RNA, 19 nt, Homo sapiens
ggagaugacuggugaucaa

SEQ ID NO: 166758 - RNA, 19 nt, Homo sapiens
gaaaccagauaaugucaga

SEQ ID NO: 166759 - RNA, 19 nt, Homo sapiens
gaagaugggccaacuaaau

SEQ ID NO: 166760 - RNA, 19 nt, Homo sapiens
caaauucagucacauacaa

SEQ ID NO: 166761 - RNA, 19 nt, Homo sapiens
ggaagcuuaugucaaagua

SEQ ID NO: 166762 - RNA, 19 nt, Homo sapiens
cuugaagccuccugaauua

SEQ ID NO: 166763 - RNA, 19 nt, Homo sapiens
gcacuaagaauuucaugaa

SEQ ID NO: 166764 - RNA, 19 nt, Homo sapiens
acacagaccuugcacaaau

SEQ ID NO: 166765 - RNA, 19 nt, Homo sapiens
gaggaagcauccaaagauu

SEQ ID NO: 166766 - RNA, 19 nt, Homo sapiens
ggaaaugguccaacagaaa

SEQ ID NO: 166767 - RNA, 19 nt, Homo sapiens
gagacacacuguugauuau

SEQ ID NO: 166768 - RNA, 19 nt, Homo sapiens
ccucgaaggucacacauuu

SEQ ID NO: 166769 - RNA, 19 nt, Homo sapiens
gcaauaagucaugcaaaua

SEQ ID NO: 166770 - RNA, 19 nt, Homo sapiens
gaaauuauauaccgugacu

SEQ ID NO: 166771 - RNA, 19 nt, Homo sapiens
ugacgaguguccauagaua

SEQ ID NO: 166772 - RNA, 19 nt, Homo sapiens
gagggugcauccaauuuaa

SEQ ID NO: 166773 - RNA, 19 nt, Homo sapiens
ggacauguguucacuguac

SEQ ID NO: 166774 - RNA, 19 nt, Homo sapiens
guuagcaucucuuuguuaa

SEQ ID NO: 166775 - RNA, 19 nt, Homo sapiens
gaacacuggugauuauuac

SEQ ID NO: 166776 - RNA, 19 nt, Homo sapiens
gauuacagcuucaggacaa

SEQ ID NO: 166777 - RNA, 19 nt, Homo sapiens
gaagaaacagaacuugaaa

SEQ ID NO: 166778 - RNA, 19 nt, Homo sapiens
uaucugaccucuuuggaaa

SEQ ID NO: 166779 - RNA, 19 nt, Homo sapiens
ggaguaaaaucucugcuua

SEQ ID NO: 166780 - RNA, 19 nt, Homo sapiens
gaaggaaacauuaauccaa

SEQ ID NO: 166781 - RNA, 19 nt, Homo sapiens
caagcaagcagaccauaua

SEQ ID NO: 166782 - RNA, 19 nt, Homo sapiens
gaggcuaacuuacagaaau

SEQ ID NO: 166783 - RNA, 19 nt, Homo sapiens
cagaaucuccugauaguaa

SEQ ID NO: 166784 - RNA, 19 nt, Homo sapiens
ggagggugcauccaauuua

SEQ ID NO: 166785 - RNA, 19 nt, Homo sapiens
uaucaucaguccugcauuu

SEQ ID NO: 166786 - RNA, 19 nt, Homo sapiens
gcauguaugugaaggaguu

SEQ ID NO: 166787 - RNA, 19 nt, Homo sapiens
aagaggaaauugacuauga

SEQ ID NO: 166788 - RNA, 19 nt, Homo sapiens
ggacaagugccacaaauuc

SEQ ID NO: 166789 - RNA, 19 nt, Homo sapiens
gaaaucaaaccaagcaaau

SEQ ID NO: 166790 - RNA, 19 nt, Homo sapiens
caaguaugccaguucauua

SEQ ID NO: 166791 - RNA, 19 nt, Homo sapiens
auacacagaugaaaccuuu

SEQ ID NO: 166792 - RNA, 19 nt, Homo sapiens
ucaaggaggucagaagaaa

SEQ ID NO: 166793 - RNA, 19 nt, Homo sapiens
gguuaagccucauacguuu

SEQ ID NO: 166794 - RNA, 19 nt, Homo sapiens
gcaaggagcagaaccuaga

SEQ ID NO: 166795 - RNA, 19 nt, Homo sapiens
gcugguaccucacagagaa

SEQ ID NO: 166796 - RNA, 19 nt, Homo sapiens
gaaggucacacauuucuug

SEQ ID NO: 166797 - RNA, 19 nt, Homo sapiens
ggagagaauacaauaacua

SEQ ID NO: 166798 - RNA, 19 nt, Homo sapiens
gaacauuuguagcaauaag

SEQ ID NO: 166799 - RNA, 19 nt, Homo sapiens
ccacuaugguacucagaua

SEQ ID NO: 166800 - RNA, 19 nt, Homo sapiens
ugagggagcugaauaugau

SEQ ID NO: 166801 - RNA, 19 nt, Homo sapiens
gaucaagcauggaacaaag

SEQ ID NO: 166802 - RNA, 19 nt, Homo sapiens
aaacagaccuggaaaaguu

SEQ ID NO: 166803 - RNA, 19 nt, Homo sapiens
ucacacagauagacuacaa

SEQ ID NO: 166804 - RNA, 19 nt, Homo sapiens
gagagugguagguuauuua

SEQ ID NO: 166805 - RNA, 19 nt, Homo sapiens
gcaagcagaccauauaaca

SEQ ID NO: 166806 - RNA, 19 nt, Homo sapiens
ggaggaagcauccaaagau

SEQ ID NO: 166807 - RNA, 19 nt, Homo sapiens
gaugggcugugauuuaaau

SEQ ID NO: 166808 - RNA, 19 nt, Homo sapiens
caaaguuucuaguacauca

SEQ ID NO: 166809 - RNA, 19 nt, Homo sapiens
ugagucaggccuccaauua

SEQ ID NO: 166810 - RNA, 19 nt, Homo sapiens
gcaauagacaguaauaaca

SEQ ID NO: 166811 - RNA, 19 nt, Homo sapiens
ucaaagaggaaaccagaua

SEQ ID NO: 166812 - RNA, 19 nt, Homo sapiens
agacaacucuucucaucuu

SEQ ID NO: 166813 - RNA, 19 nt, Homo sapiens
ucagcaagguggauacaaa

SEQ ID NO: 166814 - RNA, 19 nt, Homo sapiens
gaggacaguuaugaagaua

SEQ ID NO: 166815 - RNA, 19 nt, Homo sapiens
acucauaucuuucucaugu

SEQ ID NO: 166816 - RNA, 19 nt, Homo sapiens
auaaagccauuuggucuua

SEQ ID NO: 166817 - RNA, 19 nt, Homo sapiens
ccacaaauucagucacaua

SEQ ID NO: 166818 - RNA, 19 nt, Homo sapiens
gaccugcuuuguugacuaa

SEQ ID NO: 166819 - RNA, 19 nt, Homo sapiens
ucauggaccugcuuuguug

SEQ ID NO: 166820 - RNA, 19 nt, Homo sapiens
gacacacuguugauuauau

SEQ ID NO: 166821 - RNA, 19 nt, Homo sapiens
gaagugcacucaauauucc

SEQ ID NO: 166822 - RNA, 19 nt, Homo sapiens
guugaugggcugugauuua

SEQ ID NO: 166823 - RNA, 19 nt, Homo sapiens
ggaaagugcaacaucauau

SEQ ID NO: 166824 - RNA, 19 nt, Homo sapiens
uauaagagcagaaguugaa

SEQ ID NO: 166825 - RNA, 19 nt, Homo sapiens
ccugggagcuaaagauauu

SEQ ID NO: 166826 - RNA, 19 nt, Homo sapiens
gaugacuggugaucaaaga

SEQ ID NO: 166827 - RNA, 19 nt, Homo sapiens
ggaaaucaaaccaagcaaa

SEQ ID NO: 166828 - RNA, 19 nt, Homo sapiens
gaggcuaaaucauauguca

SEQ ID NO: 166829 - RNA, 19 nt, Homo sapiens
gcuuugaggcuaaaucaua

SEQ ID NO: 166830 - RNA, 19 nt, Homo sapiens
gauaggagauacaaacuuu

SEQ ID NO: 166831 - RNA, 19 nt, Homo sapiens
ggaacuagcucuuuuauuu

SEQ ID NO: 166832 - RNA, 19 nt, Homo sapiens
ggagaaaccugcaugaaag

SEQ ID NO: 166833 - RNA, 19 nt, Homo sapiens
cuugaagccuccugaauua

SEQ ID NO: 166834 - RNA, 19 nt, Homo sapiens
gaggaagcauccaaagauu

SEQ ID NO: 166835 - RNA, 19 nt, Homo sapiens
gaaauuauauaccgugacu

SEQ ID NO: 166836 - RNA, 19 nt, Homo sapiens
ugacgaguguccauagaua

SEQ ID NO: 166837 - RNA, 19 nt, Homo sapiens
gagggugcauccaauuuaa

SEQ ID NO: 166838 - RNA, 19 nt, Homo sapiens
uaucugaccucuuuggaaa

SEQ ID NO: 166839 - RNA, 19 nt, Homo sapiens
ggaguaaaaucucugcuua

SEQ ID NO: 166840 - RNA, 19 nt, Homo sapiens
gaggcuaacuuacagaaau

SEQ ID NO: 166841 - RNA, 19 nt, Homo sapiens
cagaaucuccugauaguaa

SEQ ID NO: 166842 - RNA, 19 nt, Homo sapiens
ggagggugcauccaauuua

SEQ ID NO: 166843 - RNA, 19 nt, Homo sapiens
uaucaucaguccugcauuu

SEQ ID NO: 166844 - RNA, 19 nt, Homo sapiens
gcauguaugugaaggaguu

SEQ ID NO: 166845 - RNA, 19 nt, Homo sapiens
ucaaggaggucagaagaaa

SEQ ID NO: 166846 - RNA, 19 nt, Homo sapiens
gguuaagccucauacguuu

SEQ ID NO: 166847 - RNA, 19 nt, Homo sapiens
ggagagaauacaauaacua

SEQ ID NO: 166848 - RNA, 19 nt, Homo sapiens
gaucaagcauggaacaaag

SEQ ID NO: 166849 - RNA, 19 nt, Homo sapiens
ggaggaagcauccaaagau

SEQ ID NO: 166850 - RNA, 19 nt, Homo sapiens
gaugggcugugauuuaaau

SEQ ID NO: 166851 - RNA, 19 nt, Homo sapiens
auaaagccauuuggucuua

SEQ ID NO: 166852 - RNA, 19 nt, Homo sapiens
guugaugggcugugauuua

SEQ ID NO: 166853 - RNA, 19 nt, Homo sapiens
cuagaguccuacuuacaua

SEQ ID NO: 166854 - RNA, 19 nt, Homo sapiens
aauaucagaugcacagauu

SEQ ID NO: 166855 - RNA, 19 nt, Homo sapiens
uuucuaugcuggaguauuu

SEQ ID NO: 166856 - RNA, 19 nt, Homo sapiens
cauuuggucuuaauucuga

SEQ ID NO: 166857 - RNA, 19 nt, Homo sapiens
ccauagauauaaagccauu

SEQ ID NO: 166858 - RNA, 19 nt, Homo sapiens
gcacauucuuaucuccaaa

SEQ ID NO: 166859 - RNA, 19 nt, Homo sapiens
gugcauccaauuuaacuua

SEQ ID NO: 166860 - RNA, 19 nt, Homo sapiens
gcugguuucuucaguaaug

SEQ ID NO: 166861 - RNA, 19 nt, Homo sapiens
acccuuaucugaccucuuu

SEQ ID NO: 166862 - RNA, 19 nt, Homo sapiens
ucaggaggaugcaauuguu

SEQ ID NO: 166863 - RNA, 19 nt, Homo sapiens
gaaagucacaggaguaacu

SEQ ID NO: 166864 - RNA, 19 nt, Homo sapiens
gcugugauuuaaauaguug

SEQ ID NO: 166865 - RNA, 19 nt, Homo sapiens
cacagaaucuccugauagu

SEQ ID NO: 166866 - RNA, 19 nt, Homo sapiens
gaaaauccaugguuaucug

SEQ ID NO: 166867 - RNA, 19 nt, Homo sapiens
uggcuugccuucuaccuuu

SEQ ID NO: 166868 - RNA, 19 nt, Homo sapiens
gaauggagaguaaagcaau

SEQ ID NO: 166869 - RNA, 19 nt, Homo sapiens
uaauccugcuugacccuua

SEQ ID NO: 166870 - RNA, 19 nt, Homo sapiens
cuaauaaugcacucaguuu

SEQ ID NO: 166871 - RNA, 19 nt, Homo sapiens
gaguguccauagauauaaa

SEQ ID NO: 166872 - RNA, 19 nt, Homo sapiens
gaaagcauucuucccugaa

SEQ ID NO: 166873 - RNA, 19 nt, Homo sapiens
caucaguccugcauuucuu

SEQ ID NO: 166874 - RNA, 19 nt, Homo sapiens
gcacccaacucauuauagc

SEQ ID NO: 166875 - RNA, 19 nt, Homo sapiens
aaaccugcaugaaagcauu

SEQ ID NO: 166876 - RNA, 19 nt, Homo sapiens
cuacuaauuuccugcugaa

SEQ ID NO: 166877 - RNA, 19 nt, Homo sapiens
guucaagaaucccuaaguc

SEQ ID NO: 166878 - RNA, 19 nt, Homo sapiens
ugaggaaaauccaugguua

SEQ ID NO: 166879 - RNA, 19 nt, Homo sapiens
uaaguccccugaaauuaua

SEQ ID NO: 166880 - RNA, 19 nt, Homo sapiens
aaagcauucuucccugaaa

SEQ ID NO: 166881 - RNA, 19 nt, Homo sapiens
gggcugugauuuaaauagu

SEQ ID NO: 166882 - RNA, 19 nt, Homo sapiens
uugaugggcugugauuuaa

SEQ ID NO: 166883 - RNA, 19 nt, Homo sapiens
gaaagaaaaugaugaugac

SEQ ID NO: 166884 - RNA, 19 nt, Homo sapiens
ccugugaaguucuuaaagu

SEQ ID NO: 166885 - RNA, 19 nt, Homo sapiens
uacacagaaucuccugaua

SEQ ID NO: 166886 - RNA, 19 nt, Homo sapiens
gaguaaagcaauaucagau

SEQ ID NO: 166887 - RNA, 19 nt, Homo sapiens
ggagaguaaagcaauauca

SEQ ID NO: 166888 - RNA, 19 nt, Homo sapiens
agaaucuccugauaguaaa

SEQ ID NO: 166889 - RNA, 19 nt, Homo sapiens
gagagaauacaauaacuac

SEQ ID NO: 166890 - RNA, 19 nt, Homo sapiens
ccaggagggugcauccaau

SEQ ID NO: 166891 - RNA, 19 nt, Homo sapiens
aauggagaguaaagcaaua

SEQ ID NO: 166892 - RNA, 19 nt, Homo sapiens
aaacuagaguccuacuuac

SEQ ID NO: 166893 - RNA, 19 nt, Homo sapiens
uaaagccauuuggucuuaa

SEQ ID NO: 166894 - RNA, 19 nt, Homo sapiens
ugcagcugcucccagauua

SEQ ID NO: 166895 - RNA, 19 nt, Homo sapiens
gaagccuccugaauuaacu

SEQ ID NO: 166896 - RNA, 19 nt, Homo sapiens
ggaauggagaguaaagcaa

SEQ ID NO: 166897 - RNA, 19 nt, Homo sapiens
caaaggugauaugguuuua

SEQ ID NO: 166898 - RNA, 19 nt, Homo sapiens
ugaccucuuuggaaacuau

SEQ ID NO: 166899 - RNA, 19 nt, Homo sapiens
gagauccuaauaugaaaga

SEQ ID NO: 166900 - RNA, 19 nt, Homo sapiens
ccuccugaauuaacuauca

SEQ ID NO: 166901 - RNA, 19 nt, Homo sapiens
gaauggcaaaguaaagguu

SEQ ID NO: 166902 - RNA, 19 nt, Homo sapiens
ggauucaucugggauaaaa

SEQ ID NO: 166903 - RNA, 19 nt, Homo sapiens
gcagcacucuucgcaugga

SEQ ID NO: 166904 - RNA, 19 nt, Homo sapiens
uuauauaccgugacugaaa

SEQ ID NO: 166905 - RNA, 19 nt, Homo sapiens
gaggagaaaccugcaugaa

SEQ ID NO: 166906 - RNA, 19 nt, Homo sapiens
ggucuucuuuggcaaugug

SEQ ID NO: 166907 - RNA, 19 nt, Homo sapiens
aggagaaaccugcaugaaa

SEQ ID NO: 166908 - RNA, 19 nt, Homo sapiens
gauuacuccuuccuuccaa

SEQ ID NO: 166909 - RNA, 19 nt, Homo sapiens
ccuugaagccuccugaauu

SEQ ID NO: 166910 - RNA, 19 nt, Homo sapiens
ggaaaucaagacuccuuca

SEQ ID NO: 166911 - RNA, 19 nt, Homo sapiens
ggaagcauccaaagauugc

SEQ ID NO: 166912 - RNA, 19 nt, Homo sapiens
auaagauugugaaggguuu

SEQ ID NO: 166913 - RNA, 19 nt, Homo sapiens
aaaacuagaguccuacuua

SEQ ID NO: 166914 - RNA, 19 nt, Homo sapiens
ggaggaugcaauuguugaa

SEQ ID NO: 166915 - RNA, 19 nt, Homo sapiens
acuccuuccuuccaauaua

SEQ ID NO: 166916 - RNA, 19 nt, Homo sapiens
guuacugacucgcuaccuu

SEQ ID NO: 166917 - RNA, 19 nt, Homo sapiens
cugcugguuucuucaguaa

SEQ ID NO: 166918 - RNA, 19 nt, Homo sapiens
gagaaaaggcaaaagaaug

SEQ ID NO: 166919 - RNA, 19 nt, Homo sapiens
auacaaucuuggagucaaa

SEQ ID NO: 166920 - RNA, 19 nt, Homo sapiens
guuaagccucauacguuua

SEQ ID NO: 166921 - RNA, 19 nt, Homo sapiens
cugugaaguucuuaaaguu

SEQ ID NO: 166922 - RNA, 19 nt, Homo sapiens
ucacaauccacaaaugaug

SEQ ID NO: 166923 - RNA, 19 nt, Homo sapiens
caacccagggcaaauggaa

SEQ ID NO: 166924 - RNA, 19 nt, Homo sapiens
ucacuaugacuacacagaa

SEQ ID NO: 166925 - RNA, 19 nt, Homo sapiens
ccauaucaccacacaauag

SEQ ID NO: 166926 - RNA, 19 nt, Homo sapiens
gaguccuacuuacauaguu

SEQ ID NO: 166927 - RNA, 19 nt, Homo sapiens
gucuguuucugcuuccuua

SEQ ID NO: 166928 - RNA, 19 nt, Homo sapiens
cuccuuccuuccaauauaa

SEQ ID NO: 166929 - RNA, 19 nt, Homo sapiens
aauuauugcucgauacauc

SEQ ID NO: 166930 - RNA, 19 nt, Homo sapiens
gcaacuaacucacucaauu

SEQ ID NO: 166931 - RNA, 19 nt, Homo sapiens
ggaaagaacugugaauuag

SEQ ID NO: 166932 - RNA, 19 nt, Homo sapiens
gaacaucuuccucaaauuu

SEQ ID NO: 166933 - RNA, 19 nt, Homo sapiens
gcaauaagccauucuaaga

SEQ ID NO: 166934 - RNA, 19 nt, Homo sapiens
uaacagggccucucacuaa

SEQ ID NO: 166935 - RNA, 19 nt, Homo sapiens
gagaucagcuuuaguucuu

SEQ ID NO: 166936 - RNA, 19 nt, Homo sapiens
gaaaggcaaauauggaaua

SEQ ID NO: 166937 - RNA, 19 nt, Homo sapiens
ggaagggaccaguuucuua

SEQ ID NO: 166938 - RNA, 19 nt, Homo sapiens
ucuaagagcuuguaugguu

SEQ ID NO: 166939 - RNA, 19 nt, Homo sapiens
gaacauagggaugaaguaa

SEQ ID NO: 166940 - RNA, 19 nt, Homo sapiens
caaagcacccaaucauuua

SEQ ID NO: 166941 - RNA, 19 nt, Homo sapiens
gaagggaccaguuucuuaa

SEQ ID NO: 166942 - RNA, 19 nt, Homo sapiens
ggacgaacccuuagugcua

SEQ ID NO: 166943 - RNA, 19 nt, Homo sapiens
cuacaaaguucaccaucua

SEQ ID NO: 166944 - RNA, 19 nt, Homo sapiens
guaccacacucaugaagaa

SEQ ID NO: 166945 - RNA, 19 nt, Homo sapiens
gaaguaaggugccugaaaa

SEQ ID NO: 166946 - RNA, 19 nt, Homo sapiens
caacuacaaugcagcuauu

SEQ ID NO: 166947 - RNA, 19 nt, Homo sapiens
ucaaagcacccaaucauuu

SEQ ID NO: 166948 - RNA, 19 nt, Homo sapiens
gaucuuuggucuacucuau

SEQ ID NO: 166949 - RNA, 19 nt, Homo sapiens
gaacugugaauuagaugua

SEQ ID NO: 166950 - RNA, 19 nt, Homo sapiens
ggaacuggacgaacccuua

SEQ ID NO: 166951 - RNA, 19 nt, Homo sapiens
guagagacuuugaggaaga

SEQ ID NO: 166952 - RNA, 19 nt, Homo sapiens
gcaaggaugacauuaauuc

SEQ ID NO: 166953 - RNA, 19 nt, Homo sapiens
caacuaacucacucaauuu

SEQ ID NO: 166954 - RNA, 19 nt, Homo sapiens
ggagcaucauucuguuaua

SEQ ID NO: 166955 - RNA, 19 nt, Homo sapiens
ugacguauguuucccuuug

SEQ ID NO: 166956 - RNA, 19 nt, Homo sapiens
ugaagagugugcaaugaaa

SEQ ID NO: 166957 - RNA, 19 nt, Homo sapiens
caaaguucaccaucuauaa

SEQ ID NO: 166958 - RNA, 19 nt, Homo sapiens
gaaagaacugugaauuaga

SEQ ID NO: 166959 - RNA, 19 nt, Homo sapiens
gaagaagcacgagaaguuu

SEQ ID NO: 166960 - RNA, 19 nt, Homo sapiens
uguggaggcucuaucguua

SEQ ID NO: 166961 - RNA, 19 nt, Homo sapiens
gauguggacuauguaaauu

SEQ ID NO: 166962 - RNA, 19 nt, Homo sapiens
cuaagagcuuguaugguua

SEQ ID NO: 166963 - RNA, 19 nt, Homo sapiens
gaggcucuaucguuaauga

SEQ ID NO: 166964 - RNA, 19 nt, Homo sapiens
uaaaguugaugcauucugu

SEQ ID NO: 166965 - RNA, 19 nt, Homo sapiens
ugaagaagcacgagaaguu

SEQ ID NO: 166966 - RNA, 19 nt, Homo sapiens
gagagaauguauggaagaa

SEQ ID NO: 166967 - RNA, 19 nt, Homo sapiens
gcaaugaaaggcaaauaug

SEQ ID NO: 166968 - RNA, 19 nt, Homo sapiens
gagcuuguaugguuaugga

SEQ ID NO: 166969 - RNA, 19 nt, Homo sapiens
gaauguuggugucccuuug

SEQ ID NO: 166970 - RNA, 19 nt, Homo sapiens
gaagcaguauguugaugga

SEQ ID NO: 166971 - RNA, 19 nt, Homo sapiens
gaccagaggacauaaguau

SEQ ID NO: 166972 - RNA, 19 nt, Homo sapiens
gugcuaaacagcuacguua

SEQ ID NO: 166973 - RNA, 19 nt, Homo sapiens
gcauaagucauuccaauca

SEQ ID NO: 166974 - RNA, 19 nt, Homo sapiens
ugacauugacccagacaua

SEQ ID NO: 166975 - RNA, 19 nt, Homo sapiens
ggaauauaauguguuagga

SEQ ID NO: 166976 - RNA, 19 nt, Homo sapiens
gagaauguauggaagaaaa

SEQ ID NO: 166977 - RNA, 19 nt, Homo sapiens
ccaaagagguauaauucag

SEQ ID NO: 166978 - RNA, 19 nt, Homo sapiens
uuaauaaacugguguucug

SEQ ID NO: 166979 - RNA, 19 nt, Homo sapiens
uaucaugucuccuuuaacu

SEQ ID NO: 166980 - RNA, 19 nt, Homo sapiens
ggcauaucauuguaacuaa

SEQ ID NO: 166981 - RNA, 19 nt, Homo sapiens
uaccugagcaaauugauua

SEQ ID NO: 166982 - RNA, 19 nt, Homo sapiens
caagguuaauucauuggaa

SEQ ID NO: 166983 - RNA, 19 nt, Homo sapiens
caaugcagcuauuaauaag

SEQ ID NO: 166984 - RNA, 19 nt, Homo sapiens
ugaguccaauccauguuua

SEQ ID NO: 166985 - RNA, 19 nt, Homo sapiens
uaaguaucaugucuccuuu

SEQ ID NO: 166986 - RNA, 19 nt, Homo sapiens
ggugaagagugugcaauga

SEQ ID NO: 166987 - RNA, 19 nt, Homo sapiens
gcaggugaacauaauauug

SEQ ID NO: 166988 - RNA, 19 nt, Homo sapiens
uggaagaguuucuguuuca

SEQ ID NO: 166989 - RNA, 19 nt, Homo sapiens
gcagugccauuuccaugug

SEQ ID NO: 166990 - RNA, 19 nt, Homo sapiens
aggaaagaacugugaauua

SEQ ID NO: 166991 - RNA, 19 nt, Homo sapiens
gaagcaauaagccauucua

SEQ ID NO: 166992 - RNA, 19 nt, Homo sapiens
ccacacucaugaagaaaga

SEQ ID NO: 166993 - RNA, 19 nt, Homo sapiens
guuaaauucuccacucugu

SEQ ID NO: 166994 - RNA, 19 nt, Homo sapiens
ggccaaagagguauaauuc

SEQ ID NO: 166995 - RNA, 19 nt, Homo sapiens
guuaauccuucuaucuuga

SEQ ID NO: 166996 - RNA, 19 nt, Homo sapiens
acacacgcauacacacaua

SEQ ID NO: 166997 - RNA, 19 nt, Homo sapiens
ccacaugucuucgaucuac

SEQ ID NO: 166998 - RNA, 19 nt, Homo sapiens
cagcuuuaguucuucagua

SEQ ID NO: 166999 - RNA, 19 nt, Homo sapiens
guacacaguuauacauguc

SEQ ID NO: 167000 - RNA, 19 nt, Homo sapiens
gcaucauucuguuauacuu

SEQ ID NO: 167001 - RNA, 19 nt, Homo sapiens
uggaaccacuagaggaaua

SEQ ID NO: 167002 - RNA, 19 nt, Homo sapiens
gauaacaucacucaaagca

SEQ ID NO: 167003 - RNA, 19 nt, Homo sapiens
gagguauaauucagguaaa

SEQ ID NO: 167004 - RNA, 19 nt, Homo sapiens
cuagagaguugcugaccaa

SEQ ID NO: 167005 - RNA, 19 nt, Homo sapiens
caagcaagaaguugaaguu

SEQ ID NO: 167006 - RNA, 19 nt, Homo sapiens
uaaggugccugaaaaguuu

SEQ ID NO: 167007 - RNA, 19 nt, Homo sapiens
ccagacauauuguacucuu

SEQ ID NO: 167008 - RNA, 19 nt, Homo sapiens
gagcaucauucuguuauac

SEQ ID NO: 167009 - RNA, 19 nt, Homo sapiens
gaucagcuuuaguucuuca

SEQ ID NO: 167010 - RNA, 19 nt, Homo sapiens
ggaauacacgaacaucuuc

SEQ ID NO: 167011 - RNA, 19 nt, Homo sapiens
gacagaacauacagagcaa

SEQ ID NO: 167012 - RNA, 19 nt, Homo sapiens
aaauagugcugauaacaag

SEQ ID NO: 167013 - RNA, 19 nt, Homo sapiens
gaccaacugacguauguuu

SEQ ID NO: 167014 - RNA, 19 nt, Homo sapiens
aguaucaugucuccuuuaa

SEQ ID NO: 167015 - RNA, 19 nt, Homo sapiens
ccagaggacauaaguauca

SEQ ID NO: 167016 - RNA, 19 nt, Homo sapiens
ugacauugcccuucuggaa

SEQ ID NO: 167017 - RNA, 19 nt, Homo sapiens
caggugaacauaauauuga

SEQ ID NO: 167018 - RNA, 19 nt, Homo sapiens
uacugaagcugaaaccauu

SEQ ID NO: 167019 - RNA, 19 nt, Homo sapiens
ggauaucgacuugcagaaa

SEQ ID NO: 167020 - RNA, 19 nt, Homo sapiens
ugagagagaauguauggaa

SEQ ID NO: 167021 - RNA, 19 nt, Homo sapiens
aaacugguguucugguuca

SEQ ID NO: 167022 - RNA, 19 nt, Homo sapiens
cagggccucucacuaacua

SEQ ID NO: 167023 - RNA, 19 nt, Homo sapiens
acgaacaucuuccucaaau

SEQ ID NO: 167024 - RNA, 19 nt, Homo sapiens
ucaauucccuuggcagguu

SEQ ID NO: 167025 - RNA, 19 nt, Homo sapiens
caagauuggcauaucauug

SEQ ID NO: 167026 - RNA, 19 nt, Homo sapiens
cagguaaauuggaagaguu

SEQ ID NO: 167027 - RNA, 19 nt, Homo sapiens
ggggagaauuucauauuuu

SEQ ID NO: 167028 - RNA, 19 nt, Homo sapiens
gcauugcugacaaggaaua

SEQ ID NO: 167029 - RNA, 19 nt, Homo sapiens
uaaguacaaccaugacauu

SEQ ID NO: 167030 - RNA, 19 nt, Homo sapiens
gaaaggacaccucgaaaga

SEQ ID NO: 167031 - RNA, 19 nt, Homo sapiens
gaauacaccugcaccuguu

SEQ ID NO: 167032 - RNA, 19 nt, Homo sapiens
gaagagaccugcucauacg

SEQ ID NO: 167033 - RNA, 19 nt, Homo sapiens
gaagaaaggacaccucgaa

SEQ ID NO: 167034 - RNA, 19 nt, Homo sapiens
ucacaaaggagaccuauga

SEQ ID NO: 167035 - RNA, 19 nt, Homo sapiens
cauaacguccucuccauua

SEQ ID NO: 167036 - RNA, 19 nt, Homo sapiens
caaaggagaccuaugacuu

SEQ ID NO: 167037 - RNA, 19 nt, Homo sapiens
cgaaagagagugcauggaa

SEQ ID NO: 167038 - RNA, 19 nt, Homo sapiens
gaaccauucugagcgaguu

SEQ ID NO: 167039 - RNA, 19 nt, Homo sapiens
gaaccagggcaaauguaaa

SEQ ID NO: 167040 - RNA, 19 nt, Homo sapiens
gcgacaagacgaaugaauu

SEQ ID NO: 167041 - RNA, 19 nt, Homo sapiens
ggaagagaccugcucauac

SEQ ID NO: 167042 - RNA, 19 nt, Homo sapiens
gcaccuguuuagaaggauu

SEQ ID NO: 167043 - RNA, 19 nt, Homo sapiens
aaggacaccucgaaagaga

SEQ ID NO: 167044 - RNA, 19 nt, Homo sapiens
gcacgucacccgcuucaag

SEQ ID NO: 167045 - RNA, 19 nt, Homo sapiens
acaacaaccucaccaggau

SEQ ID NO: 167046 - RNA, 19 nt, Homo sapiens
uugaagagaugaagaaagg

SEQ ID NO: 167047 - RNA, 19 nt, Homo sapiens
gccaauuccuuucuugaag

SEQ ID NO: 167048 - RNA, 19 nt, Homo sapiens
gguacacccuggcugacaa

SEQ ID NO: 167049 - RNA, 19 nt, Homo sapiens
uggaagagaccugcucaua

SEQ ID NO: 167050 - RNA, 19 nt, Homo sapiens
uaacguccucuccauuaaa

SEQ ID NO: 167051 - RNA, 19 nt, Homo sapiens
gaucgacagguccaugaaa

SEQ ID NO: 167052 - RNA, 19 nt, Homo sapiens
cccaucaccuuccgcauga

SEQ ID NO: 167053 - RNA, 19 nt, Homo sapiens
auaacguccucuccauuaa

SEQ ID NO: 167054 - RNA, 19 nt, Homo sapiens
uccagcagcuucaucauca

SEQ ID NO: 167055 - RNA, 19 nt, Homo sapiens
gcacaaccgguucacaaag

SEQ ID NO: 167056 - RNA, 19 nt, Homo sapiens
ccacgcugaugacgcagaa

SEQ ID NO: 167057 - RNA, 19 nt, Homo sapiens
aaaggagaccuaugacuuc

SEQ ID NO: 167058 - RNA, 19 nt, Homo sapiens
aaagagagugcauggaaga

SEQ ID NO: 167059 - RNA, 19 nt, Homo sapiens
gagcgaguucuacauccua

SEQ ID NO: 167060 - RNA, 19 nt, Homo sapiens
gaggguuucugugguggaa

SEQ ID NO: 167061 - RNA, 19 nt, Homo sapiens
caaagauggcgaccagugu

SEQ ID NO: 167062 - RNA, 19 nt, Homo sapiens
gagggccaauuccuuucuu

SEQ ID NO: 167063 - RNA, 19 nt, Homo sapiens
caccugcaccuguuuagaa

SEQ ID NO: 167064 - RNA, 19 nt, Homo sapiens
gaccaguccuugccagaac

SEQ ID NO: 167065 - RNA, 19 nt, Homo sapiens
ccaccaggcucaagaugcu

SEQ ID NO: 167066 - RNA, 19 nt, Homo sapiens
ggccaauuccuuucuugaa

SEQ ID NO: 167067 - RNA, 19 nt, Homo sapiens
gaucgugggaggccaggaa

SEQ ID NO: 167068 - RNA, 19 nt, Homo sapiens
ggucaccgccuuccucaag

SEQ ID NO: 167069 - RNA, 19 nt, Homo sapiens
caucaucacccagaacaug

SEQ ID NO: 167070 - RNA, 19 nt, Homo sapiens
agaaccagggcaaauguaa

SEQ ID NO: 167071 - RNA, 19 nt, Homo sapiens
ggacagcgacaagacgaau

SEQ ID NO: 167072 - RNA, 19 nt, Homo sapiens
caacggcaaggccugcauu

SEQ ID NO: 167073 - RNA, 19 nt, Homo sapiens
cacgagggccaauuccuuu

SEQ ID NO: 167074 - RNA, 19 nt, Homo sapiens
cacaaccgguucacaaagg

SEQ ID NO: 167075 - RNA, 19 nt, Homo sapiens
ggacaccucgaaagagagu

SEQ ID NO: 167076 - RNA, 19 nt, Homo sapiens
ucacgagggccaauuccuu

SEQ ID NO: 167077 - RNA, 19 nt, Homo sapiens
agaaggauucgaaggcaaa

SEQ ID NO: 167078 - RNA, 19 nt, Homo sapiens
ccagaaccagggcaaaugu

SEQ ID NO: 167079 - RNA, 19 nt, Homo sapiens
ggaaguacgggaucuacac

SEQ ID NO: 167080 - RNA, 19 nt, Homo sapiens
aagcacaaccgguucacaa

SEQ ID NO: 167081 - RNA, 19 nt, Homo sapiens
cagaaccagggcaaaugua

SEQ ID NO: 167082 - RNA, 19 nt, Homo sapiens
gggccaauuccuuucuuga

SEQ ID NO: 167083 - RNA, 19 nt, Homo sapiens
cugcaccuguuuagaagga

SEQ ID NO: 167084 - RNA, 19 nt, Homo sapiens
gucauaacguccucuccau

SEQ ID NO: 167085 - RNA, 19 nt, Homo sapiens
aagaaaggacaccucgaaa

SEQ ID NO: 167086 - RNA, 19 nt, Homo sapiens
ucaccgccuuccucaagug

SEQ ID NO: 167087 - RNA, 19 nt, Homo sapiens
agaaaggacaccucgaaag

SEQ ID NO: 167088 - RNA, 19 nt, Homo sapiens
acaaccgguucacaaagga

SEQ ID NO: 167089 - RNA, 19 nt, Homo sapiens
ccaguucugccacgaggaa

SEQ ID NO: 167090 - RNA, 19 nt, Homo sapiens
ucauaacguccucuccauu

SEQ ID NO: 167091 - RNA, 19 nt, Homo sapiens
ggaucgacagguccaugaa

SEQ ID NO: 167092 - RNA, 19 nt, Homo sapiens
gaccuaugacuucgacauc

SEQ ID NO: 167093 - RNA, 19 nt, Homo sapiens
cuaccaagccaagagauuc

SEQ ID NO: 167094 - RNA, 19 nt, Homo sapiens
gccagaaccagggcaaaug

SEQ ID NO: 167095 - RNA, 19 nt, Homo sapiens
acagcgacaagacgaauga

SEQ ID NO: 167096 - RNA, 19 nt, Homo sapiens
gaccugcucauacgaagag

SEQ ID NO: 167097 - RNA, 19 nt, Homo sapiens
ccuucgaccugcuugacuu

SEQ ID NO: 167098 - RNA, 19 nt, Homo sapiens
ccugacagcaucacaugga

SEQ ID NO: 167099 - RNA, 19 nt, Homo sapiens
auacaccugcaccuguuua

SEQ ID NO: 167100 - RNA, 19 nt, Homo sapiens
uaacggcagcccacugucu

SEQ ID NO: 167101 - RNA, 19 nt, Homo sapiens
gauggcgaccagugugaga

SEQ ID NO: 167102 - RNA, 19 nt, Homo sapiens
caaaggagauagaaaugua

SEQ ID NO: 167103 - RNA, 19 nt, Homo sapiens
gcagaaagcggguaugaua

SEQ ID NO: 167104 - RNA, 19 nt, Homo sapiens
uaacgaagcucgauaaagu

SEQ ID NO: 167105 - RNA, 19 nt, Homo sapiens
ggaaaccaguggauauuaa

SEQ ID NO: 167106 - RNA, 19 nt, Homo sapiens
gaaagacaguguuacagaa

SEQ ID NO: 167107 - RNA, 19 nt, Homo sapiens
gcaaugcucacaccaaaua

SEQ ID NO: 167108 - RNA, 19 nt, Homo sapiens
aaacggaucuccaacuaaa

SEQ ID NO: 167109 - RNA, 19 nt, Homo sapiens
gagaguggauugcccagua

SEQ ID NO: 167110 - RNA, 19 nt, Homo sapiens
aauaagcgcuugcaacaaa

SEQ ID NO: 167111 - RNA, 19 nt, Homo sapiens
gauguuuacucuucacuuu

SEQ ID NO: 167112 - RNA, 19 nt, Homo sapiens
guacugagagagaauguua

SEQ ID NO: 167113 - RNA, 19 nt, Homo sapiens
gcucaagaaugccaagaaa

SEQ ID NO: 167114 - RNA, 19 nt, Homo sapiens
gaaagcggguaugauauug

SEQ ID NO: 167115 - RNA, 19 nt, Homo sapiens
gaauaacgaagcucgauaa

SEQ ID NO: 167116 - RNA, 19 nt, Homo sapiens
gaggaggcaucucuggaua

SEQ ID NO: 167117 - RNA, 19 nt, Homo sapiens
ucaaacggaucuccaacua

SEQ ID NO: 167118 - RNA, 19 nt, Homo sapiens
agaaaucuuugucuccuua

SEQ ID NO: 167119 - RNA, 19 nt, Homo sapiens
gguaugauauugccuuguu

SEQ ID NO: 167120 - RNA, 19 nt, Homo sapiens
ugaagggcauaaacuauaa

SEQ ID NO: 167121 - RNA, 19 nt, Homo sapiens
gaggacacaucuuucuuug

SEQ ID NO: 167122 - RNA, 19 nt, Homo sapiens
gaaggacaccugcuuugaa

SEQ ID NO: 167123 - RNA, 19 nt, Homo sapiens
ccaaagaaucucaaagaaa

SEQ ID NO: 167124 - RNA, 19 nt, Homo sapiens
caagagugcucaagaaugc

SEQ ID NO: 167125 - RNA, 19 nt, Homo sapiens
caaauaagcgcuugcaaca

SEQ ID NO: 167126 - RNA, 19 nt, Homo sapiens
gauauugccuuguugaaac

SEQ ID NO: 167127 - RNA, 19 nt, Homo sapiens
guucugccauucuucauuu

SEQ ID NO: 167128 - RNA, 19 nt, Homo sapiens
gcacuuaccacccaagaug

SEQ ID NO: 167129 - RNA, 19 nt, Homo sapiens
ccaugacacugauuucuug

SEQ ID NO: 167130 - RNA, 19 nt, Homo sapiens
aaagugaagugaccauuuc

SEQ ID NO: 167131 - RNA, 19 nt, Homo sapiens
ggauacacauuaagguugu

SEQ ID NO: 167132 - RNA, 19 nt, Homo sapiens
gaucccacccgaugguuua

SEQ ID NO: 167133 - RNA, 19 nt, Homo sapiens
gggagaggguguugaguuc

SEQ ID NO: 167134 - RNA, 19 nt, Homo sapiens
uuacacagauucucaacga

SEQ ID NO: 167135 - RNA, 19 nt, Homo sapiens
cagaaacacugccaagagu

SEQ ID NO: 167136 - RNA, 19 nt, Homo sapiens
cagaaacugugcaccaaug

SEQ ID NO: 167137 - RNA, 19 nt, Homo sapiens
ggacauuacuacggucuuc

SEQ ID NO: 167138 - RNA, 19 nt, Homo sapiens
gaaagccaagauacccuua

SEQ ID NO: 167139 - RNA, 19 nt, Homo sapiens
uuucuaaucuggcuuguau

SEQ ID NO: 167140 - RNA, 19 nt, Homo sapiens
ucaagaaugccaagaaaga

SEQ ID NO: 167141 - RNA, 19 nt, Homo sapiens
ugacucaguuguugaagga

SEQ ID NO: 167142 - RNA, 19 nt, Homo sapiens
gugaaugugugacucaguu

SEQ ID NO: 167143 - RNA, 19 nt, Homo sapiens
uaaagugaagugaccauuu

SEQ ID NO: 167144 - RNA, 19 nt, Homo sapiens
gcccaaagaaucucaaaga

SEQ ID NO: 167145 - RNA, 19 nt, Homo sapiens
uaacauuugucuacugaag

SEQ ID NO: 167146 - RNA, 19 nt, Homo sapiens
gaagugaccauuuccuaca

SEQ ID NO: 167147 - RNA, 19 nt, Homo sapiens
gaauaggacagcagcgauu

SEQ ID NO: 167148 - RNA, 19 nt, Homo sapiens
gcaaguaagccaacaaggu

SEQ ID NO: 167149 - RNA, 19 nt, Homo sapiens
aagaaaagcacccuuauua

SEQ ID NO: 167150 - RNA, 19 nt, Homo sapiens
ggacauaaaauaacccaua

SEQ ID NO: 167151 - RNA, 19 nt, Homo sapiens
ucacgaggccugccagaaa

SEQ ID NO: 167152 - RNA, 19 nt, Homo sapiens
ggccgaaucugcacucauc

SEQ ID NO: 167153 - RNA, 19 nt, Homo sapiens
cguaacauuugucuacuga

SEQ ID NO: 167154 - RNA, 19 nt, Homo sapiens
uuacuuguguccugaaaga

SEQ ID NO: 167155 - RNA, 19 nt, Homo sapiens
guaagaaaaugcuagaaga

SEQ ID NO: 167156 - RNA, 19 nt, Homo sapiens
ggcgaaggcugugcucaaa

SEQ ID NO: 167157 - RNA, 19 nt, Homo sapiens
gccaagauacccuuaguga

SEQ ID NO: 167158 - RNA, 19 nt, Homo sapiens
gguauucuuucaagcaaug

SEQ ID NO: 167159 - RNA, 19 nt, Homo sapiens
cccaaagaaucucaaagaa

SEQ ID NO: 167160 - RNA, 19 nt, Homo sapiens
uaaaguggugucuggauuu

SEQ ID NO: 167161 - RNA, 19 nt, Homo sapiens
caagugguacauuucauuu

SEQ ID NO: 167162 - RNA, 19 nt, Homo sapiens
gaagagugccagaagagau

SEQ ID NO: 167163 - RNA, 19 nt, Homo sapiens
ccauaugccugccuuccaa

SEQ ID NO: 167164 - RNA, 19 nt, Homo sapiens
guagagucaccuaagauuu

SEQ ID NO: 167165 - RNA, 19 nt, Homo sapiens
ggaggcaucucuggauaca

SEQ ID NO: 167166 - RNA, 19 nt, Homo sapiens
ggacaccugcuuugaagga

SEQ ID NO: 167167 - RNA, 19 nt, Homo sapiens
ggaauggcccaaagaaucu

SEQ ID NO: 167168 - RNA, 19 nt, Homo sapiens
ugaaagacaguguuacaga

SEQ ID NO: 167169 - RNA, 19 nt, Homo sapiens
gaagagauacagaggacau

SEQ ID NO: 167170 - RNA, 19 nt, Homo sapiens
uggaaaccacagugaauua

SEQ ID NO: 167171 - RNA, 19 nt, Homo sapiens
gagaacuaguacaaguaaa

SEQ ID NO: 167172 - RNA, 19 nt, Homo sapiens
ccaagcauccugcaacgaa

SEQ ID NO: 167173 - RNA, 19 nt, Homo sapiens
gagauacagaggacauaaa

SEQ ID NO: 167174 - RNA, 19 nt, Homo sapiens
gguagagucaccuaagauu

SEQ ID NO: 167175 - RNA, 19 nt, Homo sapiens
gcacagcaucccaguguuc

SEQ ID NO: 167176 - RNA, 19 nt, Homo sapiens
ugagaacuaguacaaguaa

SEQ ID NO: 167177 - RNA, 19 nt, Homo sapiens
agaaagcggguaugauauu

SEQ ID NO: 167178 - RNA, 19 nt, Homo sapiens
gaagggaagggcaaguguu

SEQ ID NO: 167179 - RNA, 19 nt, Homo sapiens
ggaaucaccaucugaggau

SEQ ID NO: 167180 - RNA, 19 nt, Homo sapiens
caacgaagagugccagaag

SEQ ID NO: 167181 - RNA, 19 nt, Homo sapiens
caaacggaucuccaacuaa

SEQ ID NO: 167182 - RNA, 19 nt, Homo sapiens
auaaaguggugucuggauu

SEQ ID NO: 167183 - RNA, 19 nt, Homo sapiens
caugcuuccuccacaguaa

SEQ ID NO: 167184 - RNA, 19 nt, Homo sapiens
gaagaaaagcacccuuauu

SEQ ID NO: 167185 - RNA, 19 nt, Homo sapiens
acagugaauuacacagauu

SEQ ID NO: 167186 - RNA, 19 nt, Homo sapiens
aagggaagggcaaguguua

SEQ ID NO: 167187 - RNA, 19 nt, Homo sapiens
gccagaaacugugcaccaa

SEQ ID NO: 167188 - RNA, 19 nt, Homo sapiens
cgaaggcugugcucaaagg

SEQ ID NO: 167189 - RNA, 19 nt, Homo sapiens
aaagacaguguuacagaaa

SEQ ID NO: 167190 - RNA, 19 nt, Homo sapiens
gaaaccacagugaauuaca

SEQ ID NO: 167191 - RNA, 19 nt, Homo sapiens
ccaguguucugccauucuu

SEQ ID NO: 167192 - RNA, 19 nt, Homo sapiens
gcagcgauuucuggguauu

SEQ ID NO: 167193 - RNA, 19 nt, Homo sapiens
ccugugcacuuucuaaucu

SEQ ID NO: 167194 - RNA, 19 nt, Homo sapiens
cuacacaagcucauucaga

SEQ ID NO: 167195 - RNA, 19 nt, Homo sapiens
gccagguagucugcacuua

SEQ ID NO: 167196 - RNA, 19 nt, Homo sapiens
ccacagugaauuacacaga

SEQ ID NO: 167197 - RNA, 19 nt, Homo sapiens
agaggacacaucuuucuuu

SEQ ID NO: 167198 - RNA, 19 nt, Homo sapiens
gaaaucuuugucuccuuaa

SEQ ID NO: 167199 - RNA, 19 nt, Homo sapiens
ccaagagugcucaagaaug

SEQ ID NO: 167200 - RNA, 19 nt, Homo sapiens
gcuugguguuuguaagaaa

SEQ ID NO: 167201 - RNA, 19 nt, Homo sapiens
acaaugaggucuggcaucu

SEQ ID NO: 167202 - RNA, 19 nt, Homo sapiens
caaaggagauagaaaugua

SEQ ID NO: 167203 - RNA, 19 nt, Homo sapiens
gcagaaagcggguaugaua

SEQ ID NO: 167204 - RNA, 19 nt, Homo sapiens
uaacgaagcucgauaaagu

SEQ ID NO: 167205 - RNA, 19 nt, Homo sapiens
ggaaaccaguggauauuaa

SEQ ID NO: 167206 - RNA, 19 nt, Homo sapiens
gaaagacaguguuacagaa

SEQ ID NO: 167207 - RNA, 19 nt, Homo sapiens
gcaaugcucacaccaaaua

SEQ ID NO: 167208 - RNA, 19 nt, Homo sapiens
aaacggaucuccaacuaaa

SEQ ID NO: 167209 - RNA, 19 nt, Homo sapiens
gagaguggauugcccagua

SEQ ID NO: 167210 - RNA, 19 nt, Homo sapiens
gauguuuacucuucacuuu

SEQ ID NO: 167211 - RNA, 19 nt, Homo sapiens
guacugagagagaauguua

SEQ ID NO: 167212 - RNA, 19 nt, Homo sapiens
gaaagcggguaugauauug

SEQ ID NO: 167213 - RNA, 19 nt, Homo sapiens
gaauaacgaagcucgauaa

SEQ ID NO: 167214 - RNA, 19 nt, Homo sapiens
gaggaggcaucucuggaua

SEQ ID NO: 167215 - RNA, 19 nt, Homo sapiens
ucaaacggaucuccaacua

SEQ ID NO: 167216 - RNA, 19 nt, Homo sapiens
agaaaucuuugucuccuua

SEQ ID NO: 167217 - RNA, 19 nt, Homo sapiens
gguaugauauugccuuguu

SEQ ID NO: 167218 - RNA, 19 nt, Homo sapiens
gaggacacaucuuucuuug

SEQ ID NO: 167219 - RNA, 19 nt, Homo sapiens
gaaggacaccugcuuugaa

SEQ ID NO: 167220 - RNA, 19 nt, Homo sapiens
ccaaagaaucucaaagaaa

SEQ ID NO: 167221 - RNA, 19 nt, Homo sapiens
gauauugccuuguugaaac

SEQ ID NO: 167222 - RNA, 19 nt, Homo sapiens
guucugccauucuucauuu

SEQ ID NO: 167223 - RNA, 19 nt, Homo sapiens
gcacuuaccacccaagaug

SEQ ID NO: 167224 - RNA, 19 nt, Homo sapiens
ccaugacacugauuucuug

SEQ ID NO: 167225 - RNA, 19 nt, Homo sapiens
aaagugaagugaccauuuc

SEQ ID NO: 167226 - RNA, 19 nt, Homo sapiens
ggauacacauuaagguugu

SEQ ID NO: 167227 - RNA, 19 nt, Homo sapiens
gaucccacccgaugguuua

SEQ ID NO: 167228 - RNA, 19 nt, Homo sapiens
gggagaggguguugaguuc

SEQ ID NO: 167229 - RNA, 19 nt, Homo sapiens
uuacacagauucucaacga

SEQ ID NO: 167230 - RNA, 19 nt, Homo sapiens
cagaaacacugccaagagu

SEQ ID NO: 167231 - RNA, 19 nt, Homo sapiens
cagaaacugugcaccaaug

SEQ ID NO: 167232 - RNA, 19 nt, Homo sapiens
gcucacaccaaauaaguaa

SEQ ID NO: 167233 - RNA, 19 nt, Homo sapiens
ggacauuacuacggucuuc

SEQ ID NO: 167234 - RNA, 19 nt, Homo sapiens
gaaagccaagauacccuua

SEQ ID NO: 167235 - RNA, 19 nt, Homo sapiens
uuucuaaucuggcuuguau

SEQ ID NO: 167236 - RNA, 19 nt, Homo sapiens
ugacucaguuguugaagga

SEQ ID NO: 167237 - RNA, 19 nt, Homo sapiens
gugaaugugugacucaguu

SEQ ID NO: 167238 - RNA, 19 nt, Homo sapiens
gaagugaccauuuccuaca

SEQ ID NO: 167239 - RNA, 19 nt, Homo sapiens
gcccaaagaaucucaaaga

SEQ ID NO: 167240 - RNA, 19 nt, Homo sapiens
uaacauuugucuacugaag

SEQ ID NO: 167241 - RNA, 19 nt, Homo sapiens
gaauaggacagcagcgauu

SEQ ID NO: 167242 - RNA, 19 nt, Homo sapiens
uaaagugaagugaccauuu

SEQ ID NO: 167243 - RNA, 19 nt, Homo sapiens
gcaaguaagccaacaaggu

SEQ ID NO: 167244 - RNA, 19 nt, Homo sapiens
aagaaaagcacccuuauua

SEQ ID NO: 167245 - RNA, 19 nt, Homo sapiens
ggacauaaaauaacccaua

SEQ ID NO: 167246 - RNA, 19 nt, Homo sapiens
ucacgaggccugccagaaa

SEQ ID NO: 167247 - RNA, 19 nt, Homo sapiens
ggccgaaucugcacucauc

SEQ ID NO: 167248 - RNA, 19 nt, Homo sapiens
uuacuuguguccugaaaga

SEQ ID NO: 167249 - RNA, 19 nt, Homo sapiens
guaagaaaaugcuagaaga

SEQ ID NO: 167250 - RNA, 19 nt, Homo sapiens
ggcgaaggcugugcucaaa

SEQ ID NO: 167251 - RNA, 19 nt, Homo sapiens
gccaagauacccuuaguga

SEQ ID NO: 167252 - RNA, 19 nt, Homo sapiens
gguauucuuucaagcaaug

SEQ ID NO: 167253 - RNA, 19 nt, Homo sapiens
cccaaagaaucucaaagaa

SEQ ID NO: 167254 - RNA, 19 nt, Homo sapiens
uaaaguggugucuggauuu

SEQ ID NO: 167255 - RNA, 19 nt, Homo sapiens
caagugguacauuucauuu

SEQ ID NO: 167256 - RNA, 19 nt, Homo sapiens
gaagagugccagaagagau

SEQ ID NO: 167257 - RNA, 19 nt, Homo sapiens
ccauaugccugccuuccaa

SEQ ID NO: 167258 - RNA, 19 nt, Homo sapiens
guagagucaccuaagauuu

SEQ ID NO: 167259 - RNA, 19 nt, Homo sapiens
ggaggcaucucuggauaca

SEQ ID NO: 167260 - RNA, 19 nt, Homo sapiens
ggacaccugcuuugaagga

SEQ ID NO: 167261 - RNA, 19 nt, Homo sapiens
ggaauggcccaaagaaucu

SEQ ID NO: 167262 - RNA, 19 nt, Homo sapiens
ugaaagacaguguuacaga

SEQ ID NO: 167263 - RNA, 19 nt, Homo sapiens
gaagagauacagaggacau

SEQ ID NO: 167264 - RNA, 19 nt, Homo sapiens
uggaaaccacagugaauua

SEQ ID NO: 167265 - RNA, 19 nt, Homo sapiens
ccaagcauccugcaacgaa

SEQ ID NO: 167266 - RNA, 19 nt, Homo sapiens
gagaacuaguacaaguaaa

SEQ ID NO: 167267 - RNA, 19 nt, Homo sapiens
gagauacagaggacauaaa

SEQ ID NO: 167268 - RNA, 19 nt, Homo sapiens
gguagagucaccuaagauu

SEQ ID NO: 167269 - RNA, 19 nt, Homo sapiens
ugagaacuaguacaaguaa

SEQ ID NO: 167270 - RNA, 19 nt, Homo sapiens
gcacagcaucccaguguuc

SEQ ID NO: 167271 - RNA, 19 nt, Homo sapiens
agaaagcggguaugauauu

SEQ ID NO: 167272 - RNA, 19 nt, Homo sapiens
gaagggaagggcaaguguu

SEQ ID NO: 167273 - RNA, 19 nt, Homo sapiens
ggaaucaccaucugaggau

SEQ ID NO: 167274 - RNA, 19 nt, Homo sapiens
caacgaagagugccagaag

SEQ ID NO: 167275 - RNA, 19 nt, Homo sapiens
caaacggaucuccaacuaa

SEQ ID NO: 167276 - RNA, 19 nt, Homo sapiens
auaaaguggugucuggauu

SEQ ID NO: 167277 - RNA, 19 nt, Homo sapiens
caugcuuccuccacaguaa

SEQ ID NO: 167278 - RNA, 19 nt, Homo sapiens
gaagaaaagcacccuuauu

SEQ ID NO: 167279 - RNA, 19 nt, Homo sapiens
acagugaauuacacagauu

SEQ ID NO: 167280 - RNA, 19 nt, Homo sapiens
aagggaagggcaaguguua

SEQ ID NO: 167281 - RNA, 19 nt, Homo sapiens
gccagaaacugugcaccaa

SEQ ID NO: 167282 - RNA, 19 nt, Homo sapiens
cgaaggcugugcucaaagg

SEQ ID NO: 167283 - RNA, 19 nt, Homo sapiens
aaagacaguguuacagaaa

SEQ ID NO: 167284 - RNA, 19 nt, Homo sapiens
gaaaccacagugaauuaca

SEQ ID NO: 167285 - RNA, 19 nt, Homo sapiens
ccaguguucugccauucuu

SEQ ID NO: 167286 - RNA, 19 nt, Homo sapiens
gcagcgauuucuggguauu

SEQ ID NO: 167287 - RNA, 19 nt, Homo sapiens
cuacacaagcucauucaga

SEQ ID NO: 167288 - RNA, 19 nt, Homo sapiens
ccugugcacuuucuaaucu

SEQ ID NO: 167289 - RNA, 19 nt, Homo sapiens
gccagguagucugcacuua

SEQ ID NO: 167290 - RNA, 19 nt, Homo sapiens
ccacagugaauuacacaga

SEQ ID NO: 167291 - RNA, 19 nt, Homo sapiens
agaggacacaucuuucuuu

SEQ ID NO: 167292 - RNA, 19 nt, Homo sapiens
gaaaucuuugucuccuuaa

SEQ ID NO: 167293 - RNA, 19 nt, Homo sapiens
gcuugguguuuguaagaaa

SEQ ID NO: 167294 - RNA, 19 nt, Homo sapiens
acaaugaggucuggcaucu

SEQ ID NO: 167295 - RNA, 19 nt, Homo sapiens
aagagugccagaagagaua

SEQ ID NO: 167296 - RNA, 19 nt, Homo sapiens
acaaaauacucuccagaaa

SEQ ID NO: 167297 - RNA, 19 nt, Homo sapiens
uaaugaguguaccaccaaa

SEQ ID NO: 167298 - RNA, 19 nt, Homo sapiens
aggcaucucuggauacaca

SEQ ID NO: 167299 - RNA, 19 nt, Homo sapiens
cugaaauccugugcacuuu

SEQ ID NO: 167300 - RNA, 19 nt, Homo sapiens
ucaagugguacauuucauu

SEQ ID NO: 167301 - RNA, 19 nt, Homo sapiens
cacccaagauguuuacucu

SEQ ID NO: 167302 - RNA, 19 nt, Homo sapiens
gaacgugacugccgagcaa

SEQ ID NO: 167303 - RNA, 19 nt, Homo sapiens
gcgaggaacucaauaaagu

SEQ ID NO: 167304 - RNA, 19 nt, Homo sapiens
gcacaccguuuccugauug

SEQ ID NO: 167305 - RNA, 19 nt, Homo sapiens
ggaaaccacugccagaaag

SEQ ID NO: 167306 - RNA, 19 nt, Homo sapiens
gaucuggacuccuggauag

SEQ ID NO: 167307 - RNA, 19 nt, Homo sapiens
gaaagaccacugcagcaaa

SEQ ID NO: 167308 - RNA, 19 nt, Homo sapiens
ccaaggagcauaaguacaa

SEQ ID NO: 167309 - RNA, 19 nt, Homo sapiens
gcaagauugugucccauuc

SEQ ID NO: 167310 - RNA, 19 nt, Homo sapiens
cacaacaccucacuggaaa

SEQ ID NO: 167311 - RNA, 19 nt, Homo sapiens
ggagggaccugugugaaca

SEQ ID NO: 167312 - RNA, 19 nt, Homo sapiens
ccacaacaccucacuggaa

SEQ ID NO: 167313 - RNA, 19 nt, Homo sapiens
ccacaaauguacccacaag

SEQ ID NO: 167314 - RNA, 19 nt, Homo sapiens
guauagaacugagcaagca

SEQ ID NO: 167315 - RNA, 19 nt, Homo sapiens
ccucagcccuggugugcua

SEQ ID NO: 167316 - RNA, 19 nt, Homo sapiens
ggaacucaauaaagugcuu

SEQ ID NO: 167317 - RNA, 19 nt, Homo sapiens
acaccgauguggccuacua

SEQ ID NO: 167318 - RNA, 19 nt, Homo sapiens
agaaugagauaugguauag

SEQ ID NO: 167319 - RNA, 19 nt, Homo sapiens
ccacaagaaugagauaugg

SEQ ID NO: 167320 - RNA, 19 nt, Homo sapiens
ggagucaacacuuucgauu

SEQ ID NO: 167321 - RNA, 19 nt, Homo sapiens
gagauaugguauagaacug

SEQ ID NO: 167322 - RNA, 19 nt, Homo sapiens
gggcauggaaggcaagauu

SEQ ID NO: 167323 - RNA, 19 nt, Homo sapiens
aaggcaagcugcuaugaug

SEQ ID NO: 167324 - RNA, 19 nt, Homo sapiens
acaagaaugagauauggua

SEQ ID NO: 167325 - RNA, 19 nt, Homo sapiens
caaggagcauaaguacaaa

SEQ ID NO: 167326 - RNA, 19 nt, Homo sapiens
gcucagggacucaucuuuc

SEQ ID NO: 167327 - RNA, 19 nt, Homo sapiens
gaaaccacugccagaaaga

SEQ ID NO: 167328 - RNA, 19 nt, Homo sapiens
caacaagccaggcgucuac

SEQ ID NO: 167329 - RNA, 19 nt, Homo sapiens
gcaacaagccaggcgucua

SEQ ID NO: 167330 - RNA, 19 nt, Homo sapiens
gcacacagucguucucacu

SEQ ID NO: 167331 - RNA, 19 nt, Homo sapiens
gcagcuguaccacaaaugu

SEQ ID NO: 167332 - RNA, 19 nt, Homo sapiens
gagcuuggagucaacacuu

SEQ ID NO: 167333 - RNA, 19 nt, Homo sapiens
aagcagcuguggccagaug

SEQ ID NO: 167334 - RNA, 19 nt, Homo sapiens
aaagaccacugcagcaaac

SEQ ID NO: 167335 - RNA, 19 nt, Homo sapiens
gagcacaccguuuccugau

SEQ ID NO: 167336 - RNA, 19 nt, Homo sapiens
ccuacuaccuggccuggau

SEQ ID NO: 167337 - RNA, 19 nt, Homo sapiens
gcacgaccuggcucuguug

SEQ ID NO: 167338 - RNA, 19 nt, Homo sapiens
gcauggaaggcaagauugu

SEQ ID NO: 167339 - RNA, 19 nt, Homo sapiens
gcauaaguacaaagcugaa

SEQ ID NO: 167340 - RNA, 19 nt, Homo sapiens
caagaaugagauaugguau

SEQ ID NO: 167341 - RNA, 19 nt, Homo sapiens
ugaaagaccacugcagcaa

SEQ ID NO: 167342 - RNA, 19 nt, Homo sapiens
aaaggagggaccuguguga

SEQ ID NO: 167343 - RNA, 19 nt, Homo sapiens
cagcuguaccacaaaugua

SEQ ID NO: 167344 - RNA, 19 nt, Homo sapiens
cggcagcuguaccacaaau

SEQ ID NO: 167345 - RNA, 19 nt, Homo sapiens
ggauggcgaggaacucaau

SEQ ID NO: 167346 - RNA, 19 nt, Homo sapiens
gagucaacacuuucgauuc

SEQ ID NO: 167347 - RNA, 19 nt, Homo sapiens
uggaaaccacugccagaaa

SEQ ID NO: 167348 - RNA, 19 nt, Homo sapiens
gaacccggacaacgacauc

SEQ ID NO: 167349 - RNA, 19 nt, Homo sapiens
caaggcaagcugcuaugau

SEQ ID NO: 167350 - RNA, 19 nt, Homo sapiens
ccaaggcaagcugcuauga

SEQ ID NO: 167351 - RNA, 19 nt, Homo sapiens
ggcaagauugugucccauu

SEQ ID NO: 167352 - RNA, 19 nt, Homo sapiens
gagcacacagucguucuca

SEQ ID NO: 167353 - RNA, 19 nt, Homo sapiens
cgaggaacucaauaaagug

SEQ ID NO: 167354 - RNA, 19 nt, Homo sapiens
gauggcgaggaacucaaua

SEQ ID NO: 167355 - RNA, 19 nt, Homo sapiens
ugaucuggacuccuggaua

SEQ ID NO: 167356 - RNA, 19 nt, Homo sapiens
ugagauaugguauagaacu

SEQ ID NO: 167357 - RNA, 19 nt, Homo sapiens
caacggacggacgccauga

SEQ ID NO: 167358 - RNA, 19 nt, Homo sapiens
uggcgaggaacucaauaaa

SEQ ID NO: 167359 - RNA, 19 nt, Homo sapiens
agucaacacuuucgauucc

SEQ ID NO: 167360 - RNA, 19 nt, Homo sapiens
gcuccugucgccuuacguu

SEQ ID NO: 167361 - RNA, 19 nt, Homo sapiens
ggcgaggaacucaauaaag

SEQ ID NO: 167362 - RNA, 19 nt, Homo sapiens
ggcauggaaggcaagauug

SEQ ID NO: 167363 - RNA, 19 nt, Homo sapiens
caccaaggcaagcugcuau

SEQ ID NO: 167364 - RNA, 19 nt, Homo sapiens
ugaagagcacacagucguu

SEQ ID NO: 167365 - RNA, 19 nt, Homo sapiens
ggaaugcucuggucuauau

SEQ ID NO: 167366 - RNA, 19 nt, Homo sapiens
ccaagaaggucaagaagaa

SEQ ID NO: 167367 - RNA, 19 nt, Homo sapiens
gaguaacagucaucauuua

SEQ ID NO: 167368 - RNA, 19 nt, Homo sapiens
uaaguaaucucacagcauu

SEQ ID NO: 167369 - RNA, 19 nt, Homo sapiens
gccaauaucccuuacuuua

SEQ ID NO: 167370 - RNA, 19 nt, Homo sapiens
gcugacaucauuuguauua

SEQ ID NO: 167371 - RNA, 19 nt, Homo sapiens
ggagauggcaugauggaua

SEQ ID NO: 167372 - RNA, 19 nt, Homo sapiens
gaaagaaagagaagaguau

SEQ ID NO: 167373 - RNA, 19 nt, Homo sapiens
gauuugggcucuagaauuc

SEQ ID NO: 167374 - RNA, 19 nt, Homo sapiens
ggaaauuaauugugaccaa

SEQ ID NO: 167375 - RNA, 19 nt, Homo sapiens
ggaaguaaagugaagaauu

SEQ ID NO: 167376 - RNA, 19 nt, Homo sapiens
ggaauaauagcacaugauu

SEQ ID NO: 167377 - RNA, 19 nt, Homo sapiens
gaacgugaauuccaaacuc

SEQ ID NO: 167378 - RNA, 19 nt, Homo sapiens
gaauuucccucugauaugu

SEQ ID NO: 167379 - RNA, 19 nt, Homo sapiens
gugcaacacucaagucuau

SEQ ID NO: 167380 - RNA, 19 nt, Homo sapiens
gagauggcaugauggauau

SEQ ID NO: 167381 - RNA, 19 nt, Homo sapiens
gaccagauauauagaagga

SEQ ID NO: 167382 - RNA, 19 nt, Homo sapiens
uaaacuggcuuaacuuagu

SEQ ID NO: 167383 - RNA, 19 nt, Homo sapiens
ucucauagcucauaagagu

SEQ ID NO: 167384 - RNA, 19 nt, Homo sapiens
cacagaaggugucaugaaa

SEQ ID NO: 167385 - RNA, 19 nt, Homo sapiens
ugaagaagcuggcggaucu

SEQ ID NO: 167386 - RNA, 19 nt, Homo sapiens
aagaagauguuccgugaaa

SEQ ID NO: 167387 - RNA, 19 nt, Homo sapiens
uaacaagaccaaugaagaa

SEQ ID NO: 167388 - RNA, 19 nt, Homo sapiens
aagaguauguccugaauga

SEQ ID NO: 167389 - RNA, 19 nt, Homo sapiens
gcagagggcagucuuucua

SEQ ID NO: 167390 - RNA, 19 nt, Homo sapiens
gagaugaacccuggcauuu

SEQ ID NO: 167391 - RNA, 19 nt, Homo sapiens
ggaguaacaagaccaauga

SEQ ID NO: 167392 - RNA, 19 nt, Homo sapiens
aaagaaacccugcgaaaug

SEQ ID NO: 167393 - RNA, 19 nt, Homo sapiens
gcagaaugaugcagguuca

SEQ ID NO: 167394 - RNA, 19 nt, Homo sapiens
ggaauaccagcaagaauug

SEQ ID NO: 167395 - RNA, 19 nt, Homo sapiens
ccaccacacugacaaguau

SEQ ID NO: 167396 - RNA, 19 nt, Homo sapiens
ggacuagagcacaacauaa

SEQ ID NO: 167397 - RNA, 19 nt, Homo sapiens
gaugaacccuggcauuugg

SEQ ID NO: 167398 - RNA, 19 nt, Homo sapiens
aaauagcgauggcauguau

SEQ ID NO: 167399 - RNA, 19 nt, Homo sapiens
gagcaguuccacccaauaa

SEQ ID NO: 167400 - RNA, 19 nt, Homo sapiens
aaacuggcuuaacuuagua

SEQ ID NO: 167401 - RNA, 19 nt, Homo sapiens
auaauaagcccaacaaguu

SEQ ID NO: 167402 - RNA, 19 nt, Homo sapiens
ccaauaucccuuacuuuaa

SEQ ID NO: 167403 - RNA, 19 nt, Homo sapiens
uaagaaagauggcacucau

SEQ ID NO: 167404 - RNA, 19 nt, Homo sapiens
guaacaagaccaaugaaga

SEQ ID NO: 167405 - RNA, 19 nt, Homo sapiens
caaauggaccucucuggaa

SEQ ID NO: 167406 - RNA, 19 nt, Homo sapiens
caauaucccuuacuuuaac

SEQ ID NO: 167407 - RNA, 19 nt, Homo sapiens
caagaccaaugaagaagau

SEQ ID NO: 167408 - RNA, 19 nt, Homo sapiens
cagaaggugucaugaaauc

SEQ ID NO: 167409 - RNA, 19 nt, Homo sapiens
ccuagaaacugcccugaug

SEQ ID NO: 167410 - RNA, 19 nt, Homo sapiens
ggagaucccacauauuuca

SEQ ID NO: 167411 - RNA, 19 nt, Homo sapiens
ucacagcucgcaucaauga

SEQ ID NO: 167412 - RNA, 19 nt, Homo sapiens
ugucacagcucgcaucaau

SEQ ID NO: 167413 - RNA, 19 nt, Homo sapiens
gaaaucaagguccaacguu

SEQ ID NO: 167414 - RNA, 19 nt, Homo sapiens
gacaauaucuaugccuaug

SEQ ID NO: 167415 - RNA, 19 nt, Homo sapiens
ugaagaugaugcuguguau

SEQ ID NO: 167416 - RNA, 19 nt, Homo sapiens
gaaacagacacguacauuc

SEQ ID NO: 167417 - RNA, 19 nt, Homo sapiens
uaagaaagcaggugcaaca

SEQ ID NO: 167418 - RNA, 19 nt, Homo sapiens
ugaccuuccuguuggauuu

SEQ ID NO: 167419 - RNA, 19 nt, Homo sapiens
cagcaagaauuguuaccaa

SEQ ID NO: 167420 - RNA, 19 nt, Homo sapiens
cuucagcacuaaccuauga

SEQ ID NO: 167421 - RNA, 19 nt, Homo sapiens
gcaggaccuuguaaaguca

SEQ ID NO: 167422 - RNA, 19 nt, Homo sapiens
gcacaugauuugggcucua

SEQ ID NO: 167423 - RNA, 19 nt, Homo sapiens
gaagauguuccgugaaauc

SEQ ID NO: 167424 - RNA, 19 nt, Homo sapiens
gaaggugucaugaaaucaa

SEQ ID NO: 167425 - RNA, 19 nt, Homo sapiens
gauauaauaagcccaacaa

SEQ ID NO: 167426 - RNA, 19 nt, Homo sapiens
cucaauaccuggccucauu

SEQ ID NO: 167427 - RNA, 19 nt, Homo sapiens
aagacgaccuuccauguga

SEQ ID NO: 167428 - RNA, 19 nt, Homo sapiens
ggauauuacugauacuuac

SEQ ID NO: 167429 - RNA, 19 nt, Homo sapiens
ggacaaugagaaagaaaga

SEQ ID NO: 167430 - RNA, 19 nt, Homo sapiens
acacguacauucucuucaa

SEQ ID NO: 167431 - RNA, 19 nt, Homo sapiens
gcauuuugcuagacaguua

SEQ ID NO: 167432 - RNA, 19 nt, Homo sapiens
caaagacgaccuuccaugu

SEQ ID NO: 167433 - RNA, 19 nt, Homo sapiens
caaacaaauuggaggagau

SEQ ID NO: 167434 - RNA, 19 nt, Homo sapiens
caacagcgaccucauuuac

SEQ ID NO: 167435 - RNA, 19 nt, Homo sapiens
ugauaaugaugccaauuug

SEQ ID NO: 167436 - RNA, 19 nt, Homo sapiens
gccuauagucucagaguua

SEQ ID NO: 167437 - RNA, 19 nt, Homo sapiens
gaacaagggaaccuacauc

SEQ ID NO: 167438 - RNA, 19 nt, Homo sapiens
gaccucagcuuggcacuca

SEQ ID NO: 167439 - RNA, 19 nt, Homo sapiens
gcaacacucaagucuauug

SEQ ID NO: 167440 - RNA, 19 nt, Homo sapiens
aaacaagacuucagauucc

SEQ ID NO: 167441 - RNA, 19 nt, Homo sapiens
caucacaaauggcuacauc

SEQ ID NO: 167442 - RNA, 19 nt, Homo sapiens
gguaguugguucugacaug

SEQ ID NO: 167443 - RNA, 19 nt, Homo sapiens
gaacuaccacugcuggaau

SEQ ID NO: 167444 - RNA, 19 nt, Homo sapiens
ccacauuucugagccuuug

SEQ ID NO: 167445 - RNA, 19 nt, Homo sapiens
gauuauauuucacccaucu

SEQ ID NO: 167446 - RNA, 19 nt, Homo sapiens
cagggagauuugcucaaua

SEQ ID NO: 167447 - RNA, 19 nt, Homo sapiens
ccagggagauuugcucaau

SEQ ID NO: 167448 - RNA, 19 nt, Homo sapiens
guaguugguucugacauga

SEQ ID NO: 167449 - RNA, 19 nt, Homo sapiens
cagccaacaucaccuucua

SEQ ID NO: 167450 - RNA, 19 nt, Homo sapiens
gagauuggcccuagaaacu

SEQ ID NO: 167451 - RNA, 19 nt, Homo sapiens
ggccaugucugcuuccaau

SEQ ID NO: 167452 - RNA, 19 nt, Homo sapiens
uugcaaggcugauuuaugg

SEQ ID NO: 167453 - RNA, 19 nt, Homo sapiens
gaagcuggcggaucuagug

SEQ ID NO: 167454 - RNA, 19 nt, Homo sapiens
gcacucaugugguggaaaa

SEQ ID NO: 167455 - RNA, 19 nt, Homo sapiens
gagaagaguauguccugaa

SEQ ID NO: 167456 - RNA, 19 nt, Homo sapiens
ccaagauugucaugagaga

SEQ ID NO: 167457 - RNA, 19 nt, Homo sapiens
ggaugguccuggaguaaca

SEQ ID NO: 167458 - RNA, 19 nt, Homo sapiens
gauggcaugauggauauua

SEQ ID NO: 167459 - RNA, 19 nt, Homo sapiens
uggaggagauggcaugaug

SEQ ID NO: 167460 - RNA, 19 nt, Homo sapiens
gagcuauggucaguuugaa

SEQ ID NO: 167461 - RNA, 19 nt, Homo sapiens
cuguguaucuggacaauga

SEQ ID NO: 167462 - RNA, 19 nt, Homo sapiens
ggacugcagccacugauuc

SEQ ID NO: 167463 - RNA, 19 nt, Homo sapiens
cuagagcacaacauaauuu

SEQ ID NO: 167464 - RNA, 19 nt, Homo sapiens
uuucugggaugcaauacua

SEQ ID NO: 167465 - RNA, 19 nt, Homo sapiens
gaaaugaaguggaaauaug

SEQ ID NO: 167466 - RNA, 19 nt, Homo sapiens
cgaaugagauaacuuguaa

SEQ ID NO: 167467 - RNA, 19 nt, Homo sapiens
gaagguagccugugaggaa

SEQ ID NO: 167468 - RNA, 19 nt, Homo sapiens
gaaaauggcucuucaguag

SEQ ID NO: 167469 - RNA, 19 nt, Homo sapiens
guguuuggcuccugaauua

SEQ ID NO: 167470 - RNA, 19 nt, Homo sapiens
caacagaggagaagugaaa

SEQ ID NO: 167471 - RNA, 19 nt, Homo sapiens
gcaaaccuaugaagaagga

SEQ ID NO: 167472 - RNA, 19 nt, Homo sapiens
gaaauacguugugaagaug

SEQ ID NO: 167473 - RNA, 19 nt, Homo sapiens
agaaagaggagucauauuu

SEQ ID NO: 167474 - RNA, 19 nt, Homo sapiens
caagaacccuuaagaacau

SEQ ID NO: 167475 - RNA, 19 nt, Homo sapiens
ggacaaaguacaauacgaa

SEQ ID NO: 167476 - RNA, 19 nt, Homo sapiens
gcacaucuccuccucuuau

SEQ ID NO: 167477 - RNA, 19 nt, Homo sapiens
agucuuacauggagauuua

SEQ ID NO: 167478 - RNA, 19 nt, Homo sapiens
gaaaugaauggcagaaaga

SEQ ID NO: 167479 - RNA, 19 nt, Homo sapiens
agaaauacguugugaagau

SEQ ID NO: 167480 - RNA, 19 nt, Homo sapiens
ggagaaauaguucauauag

SEQ ID NO: 167481 - RNA, 19 nt, Homo sapiens
gacaacagaccacacauuu

SEQ ID NO: 167482 - RNA, 19 nt, Homo sapiens
caaccaaccuguaggaaag

SEQ ID NO: 167483 - RNA, 19 nt, Homo sapiens
caagauguauuccaagaca

SEQ ID NO: 167484 - RNA, 19 nt, Homo sapiens
cuaaguggaucugauuuaa

SEQ ID NO: 167485 - RNA, 19 nt, Homo sapiens
gaaauuauuccacaacaca

SEQ ID NO: 167486 - RNA, 19 nt, Homo sapiens
gagcaaaccacguguacaa

SEQ ID NO: 167487 - RNA, 19 nt, Homo sapiens
uaaacagggauaugacuua

SEQ ID NO: 167488 - RNA, 19 nt, Homo sapiens
cuacacagcuggaggaaag

SEQ ID NO: 167489 - RNA, 19 nt, Homo sapiens
caaagugaaggacaaagua

SEQ ID NO: 167490 - RNA, 19 nt, Homo sapiens
guggaaauaugaagggaaa

SEQ ID NO: 167491 - RNA, 19 nt, Homo sapiens
aaagaggagucauauuuca

SEQ ID NO: 167492 - RNA, 19 nt, Homo sapiens
gaaggaagaagaaacagau

SEQ ID NO: 167493 - RNA, 19 nt, Homo sapiens
caaaguacaauacgaaugu

SEQ ID NO: 167494 - RNA, 19 nt, Homo sapiens
aaauggcucuucaguagaa

SEQ ID NO: 167495 - RNA, 19 nt, Homo sapiens
gaagggaaagucuuacaug

SEQ ID NO: 167496 - RNA, 19 nt, Homo sapiens
uggauuacaugaacagaaa

SEQ ID NO: 167497 - RNA, 19 nt, Homo sapiens
gauccucaguggaauauag

SEQ ID NO: 167498 - RNA, 19 nt, Homo sapiens
ggacagaaccuccaaaaug

SEQ ID NO: 167499 - RNA, 19 nt, Homo sapiens
gcuauaacuuugguuggua

SEQ ID NO: 167500 - RNA, 19 nt, Homo sapiens
gaucgaaugagauaacuug

SEQ ID NO: 167501 - RNA, 19 nt, Homo sapiens
gggauaaagugacauaugc

SEQ ID NO: 167502 - RNA, 19 nt, Homo sapiens
gcagaaagaggagucauau

SEQ ID NO: 167503 - RNA, 19 nt, Homo sapiens
aaagcacucugucuuauca

SEQ ID NO: 167504 - RNA, 19 nt, Homo sapiens
gaggagaagugaaauaucc

SEQ ID NO: 167505 - RNA, 19 nt, Homo sapiens
ugagauaacuuguaaucgu

SEQ ID NO: 167506 - RNA, 19 nt, Homo sapiens
gcagaaauacguugugaag

SEQ ID NO: 167507 - RNA, 19 nt, Homo sapiens
gaagagcaaaccacgugua

SEQ ID NO: 167508 - RNA, 19 nt, Homo sapiens
gaagacagaggagguagaa

SEQ ID NO: 167509 - RNA, 19 nt, Homo sapiens
acauagaaaugaaguggaa

SEQ ID NO: 167510 - RNA, 19 nt, Homo sapiens
caaacacauucaacaacuu

SEQ ID NO: 167511 - RNA, 19 nt, Homo sapiens
gaaaguggaagacaagaag

SEQ ID NO: 167512 - RNA, 19 nt, Homo sapiens
ggaggccuauuguuuagau

SEQ ID NO: 167513 - RNA, 19 nt, Homo sapiens
ggaaccauguacuguuaau

SEQ ID NO: 167514 - RNA, 19 nt, Homo sapiens
uauccaagauguauuccaa

SEQ ID NO: 167515 - RNA, 19 nt, Homo sapiens
uaagcauccuccuguugua

SEQ ID NO: 167516 - RNA, 19 nt, Homo sapiens
cagcagaaauacguuguga

SEQ ID NO: 167517 - RNA, 19 nt, Homo sapiens
aaagcaaaccuaugaagaa

SEQ ID NO: 167518 - RNA, 19 nt, Homo sapiens
cagaaaacauucaaaguga

SEQ ID NO: 167519 - RNA, 19 nt, Homo sapiens
acaaagcacucugucuuau

SEQ ID NO: 167520 - RNA, 19 nt, Homo sapiens
gaauacagauguuuugauc

SEQ ID NO: 167521 - RNA, 19 nt, Homo sapiens
ugacuuaucuccauuaacc

SEQ ID NO: 167522 - RNA, 19 nt, Homo sapiens
uuggaaccauguacuguua

SEQ ID NO: 167523 - RNA, 19 nt, Homo sapiens
ucaagaacccuuaagaaca

SEQ ID NO: 167524 - RNA, 19 nt, Homo sapiens
aaacagggauaugacuuau

SEQ ID NO: 167525 - RNA, 19 nt, Homo sapiens
uaaagcaaaccuaugaaga

SEQ ID NO: 167526 - RNA, 19 nt, Homo sapiens
ggagaacucuaugcagaag

SEQ ID NO: 167527 - RNA, 19 nt, Homo sapiens
agaaaugaauggcagaaag

SEQ ID NO: 167528 - RNA, 19 nt, Homo sapiens
caucuccuccucuuauuaa

SEQ ID NO: 167529 - RNA, 19 nt, Homo sapiens
ucaaacacauucaacaacu

SEQ ID NO: 167530 - RNA, 19 nt, Homo sapiens
ugaaggacaaaguacaaua

SEQ ID NO: 167531 - RNA, 19 nt, Homo sapiens
gagccaaggugcuucaaaa

SEQ ID NO: 167532 - RNA, 19 nt, Homo sapiens
uuagagccaugcacauuau

SEQ ID NO: 167533 - RNA, 19 nt, Homo sapiens
gaggaaccacccuucauug

SEQ ID NO: 167534 - RNA, 19 nt, Homo sapiens
aaggagaugucguucaguu

SEQ ID NO: 167535 - RNA, 19 nt, Homo sapiens
ggagguagaaugucucaca

SEQ ID NO: 167536 - RNA, 19 nt, Homo sapiens
gagaacaugcauuaugguu

SEQ ID NO: 167537 - RNA, 19 nt, Homo sapiens
gcaaaccacguguacaaca

SEQ ID NO: 167538 - RNA, 19 nt, Homo sapiens
gaaggacaaaguacaauac

SEQ ID NO: 167539 - RNA, 19 nt, Homo sapiens
uaucaagaacccuuaagaa

SEQ ID NO: 167540 - RNA, 19 nt, Homo sapiens
caacagaccacacauuuug

SEQ ID NO: 167541 - RNA, 19 nt, Homo sapiens
gugcacaucuccuccucuu

SEQ ID NO: 167542 - RNA, 19 nt, Homo sapiens
gagaagugaaauauccuuu

SEQ ID NO: 167543 - RNA, 19 nt, Homo sapiens
ccaugggucagcagaaaua

SEQ ID NO: 167544 - RNA, 19 nt, Homo sapiens
ggacuacaccaccauugug

SEQ ID NO: 167545 - RNA, 19 nt, Homo sapiens
gaucaccauuuccuagaag

SEQ ID NO: 167546 - RNA, 19 nt, Homo sapiens
ugaagaaggagaugucguu

SEQ ID NO: 167547 - RNA, 19 nt, Homo sapiens
cagaggagguagaaugucu

SEQ ID NO: 167548 - RNA, 19 nt, Homo sapiens
gaaggaugaagaagugguu

SEQ ID NO: 167549 - RNA, 19 nt, Homo sapiens
ggcagaaagaggagucaua

SEQ ID NO: 167550 - RNA, 19 nt, Homo sapiens
guaagcauccuccuguugu

SEQ ID NO: 167551 - RNA, 19 nt, Homo sapiens
ccauggaucgaaugagaua

SEQ ID NO: 167552 - RNA, 19 nt, Homo sapiens
gcauuaugguugcgcuuca

SEQ ID NO: 167553 - RNA, 19 nt, Homo sapiens
agacagaggagguagaaug

SEQ ID NO: 167554 - RNA, 19 nt, Homo sapiens
ggaagaagaaacagauguc

SEQ ID NO: 167555 - RNA, 19 nt, Homo sapiens
gaagaagugguucaauguc

SEQ ID NO: 167556 - RNA, 19 nt, Homo sapiens
ccaugcacauuaucuuuua

SEQ ID NO: 167557 - RNA, 19 nt, Homo sapiens
ggaauauagaugcaaugaa

SEQ ID NO: 167558 - RNA, 19 nt, Homo sapiens
ugaggaaccacccuucauu

SEQ ID NO: 167559 - RNA, 19 nt, Homo sapiens
ucuaaguggaucugauuua

SEQ ID NO: 167560 - RNA, 19 nt, Homo sapiens
guacaauacgaaugugcua

SEQ ID NO: 167561 - RNA, 19 nt, Homo sapiens
auacuuauccagcugaauu

SEQ ID NO: 167562 - RNA, 19 nt, Homo sapiens
gauggaauguggacuacac

SEQ ID NO: 167563 - RNA, 19 nt, Homo sapiens
ucaguagaauacagauguu

SEQ ID NO: 167564 - RNA, 19 nt, Homo sapiens
cccauugucugaauuaucu

SEQ ID NO: 167565 - RNA, 19 nt, Homo sapiens
ggaaaggccugggaaguga

SEQ ID NO: 167566 - RNA, 19 nt, Homo sapiens
gugcagaaguuacacagua

SEQ ID NO: 167567 - RNA, 19 nt, Homo sapiens
gaacaaagggaccaacugu

SEQ ID NO: 167568 - RNA, 19 nt, Homo sapiens
gaagggcugugucuaugga

SEQ ID NO: 167569 - RNA, 19 nt, Homo sapiens
gggacaagaugcugcagaa

SEQ ID NO: 167570 - RNA, 19 nt, Homo sapiens
caggugggcucuucaguga

SEQ ID NO: 167571 - RNA, 19 nt, Homo sapiens
ggccacaccuuccuacaga

SEQ ID NO: 167572 - RNA, 19 nt, Homo sapiens
gaacuucaaaggugauuuc

SEQ ID NO: 167573 - RNA, 19 nt, Homo sapiens
ccaacuaacagucaagaaa

SEQ ID NO: 167574 - RNA, 19 nt, Homo sapiens
ggacgaggcccagauggaa

SEQ ID NO: 167575 - RNA, 19 nt, Homo sapiens
ggugggcucuucagugaug

SEQ ID NO: 167576 - RNA, 19 nt, Homo sapiens
aggcccagauggaacauua

SEQ ID NO: 167577 - RNA, 19 nt, Homo sapiens
cagaagggcaugaagaaga

SEQ ID NO: 167578 - RNA, 19 nt, Homo sapiens
acacuaugcuguacaacug

SEQ ID NO: 167579 - RNA, 19 nt, Homo sapiens
cuaugagacugacaacuau

SEQ ID NO: 167580 - RNA, 19 nt, Homo sapiens
ccaacugugugaccuccua

SEQ ID NO: 167581 - RNA, 19 nt, Homo sapiens
gggaaccgccucagcaaga

SEQ ID NO: 167582 - RNA, 19 nt, Homo sapiens
gaaaagcagucauccugau

SEQ ID NO: 167583 - RNA, 19 nt, Homo sapiens
acuaugagacugacaacua

SEQ ID NO: 167584 - RNA, 19 nt, Homo sapiens
cacaguccauguucagcua

SEQ ID NO: 167585 - RNA, 19 nt, Homo sapiens
gggaaaggccugggaagug

SEQ ID NO: 167586 - RNA, 19 nt, Homo sapiens
cagcaagaguggccugaag

SEQ ID NO: 167587 - RNA, 19 nt, Homo sapiens
acaaagggaccaacugugu

SEQ ID NO: 167588 - RNA, 19 nt, Homo sapiens
caacuaacagucaagaaac

SEQ ID NO: 167589 - RNA, 19 nt, Homo sapiens
gagguggagcgacugauga

SEQ ID NO: 167590 - RNA, 19 nt, Homo sapiens
ggagguggagcgacugaug

SEQ ID NO: 167591 - RNA, 19 nt, Homo sapiens
ugccucagcuggugcagaa

SEQ ID NO: 167592 - RNA, 19 nt, Homo sapiens
ucaaggagugcuucaccua

SEQ ID NO: 167593 - RNA, 19 nt, Homo sapiens
ggacucagaggcgcugcua

SEQ ID NO: 167594 - RNA, 19 nt, Homo sapiens
ggagugcgacagcguagug

SEQ ID NO: 167595 - RNA, 19 nt, Homo sapiens
aaagggaccaacuguguga

SEQ ID NO: 167596 - RNA, 19 nt, Homo sapiens
gaaaggccugggaagugaa

SEQ ID NO: 167597 - RNA, 19 nt, Homo sapiens
gccgugcucuucaccuaug

SEQ ID NO: 167598 - RNA, 19 nt, Homo sapiens
agaagggcaugaagaagag

SEQ ID NO: 167599 - RNA, 19 nt, Homo sapiens
guacaacugccuggacuuc

SEQ ID NO: 167600 - RNA, 19 nt, Homo sapiens
gaucgagguguaccgcaaa

SEQ ID NO: 167601 - RNA, 19 nt, Homo sapiens
gggcuuaggcacugauauc

SEQ ID NO: 167602 - RNA, 19 nt, Homo sapiens
ggaucauggugcaguacga

SEQ ID NO: 167603 - RNA, 19 nt, Homo sapiens
cugaagggcugugucuaug

SEQ ID NO: 167604 - RNA, 19 nt, Homo sapiens
gcagaaguuacacaguaga

SEQ ID NO: 167605 - RNA, 19 nt, Homo sapiens
gccgucagcuacacuaugc

SEQ ID NO: 167606 - RNA, 19 nt, Homo sapiens
gucaacaggugggcucuuc

SEQ ID NO: 167607 - RNA, 19 nt, Homo sapiens
ggaaccgccucagcaagag

SEQ ID NO: 167608 - RNA, 19 nt, Homo sapiens
ggggauaucugggacaaga

SEQ ID NO: 167609 - RNA, 19 nt, Homo sapiens
ccugaagggcugugucuau

SEQ ID NO: 167610 - RNA, 19 nt, Homo sapiens
ccugggaagugaacaaagg

SEQ ID NO: 167611 - RNA, 19 nt, Homo sapiens
guggagagccuggcacugu

SEQ ID NO: 167612 - RNA, 19 nt, Homo sapiens
ggucucaauucugaagcuu

SEQ ID NO: 167613 - RNA, 19 nt, Homo sapiens
gugccucccuugcccuuca

SEQ ID NO: 167614 - RNA, 19 nt, Homo sapiens
aaggagugcuucaccuaca

SEQ ID NO: 167615 - RNA, 19 nt, Homo sapiens
agcacgagaucgaggugua

SEQ ID NO: 167616 - RNA, 19 nt, Homo sapiens
cuaacagucaagaaacaaa

SEQ ID NO: 167617 - RNA, 19 nt, Homo sapiens
gcagaagggcaugaagaag

SEQ ID NO: 167618 - RNA, 19 nt, Homo sapiens
ugucagcuuuccucagcaa

SEQ ID NO: 167619 - RNA, 19 nt, Homo sapiens
acaccuuccuacagaacuu

SEQ ID NO: 167620 - RNA, 19 nt, Homo sapiens
aagggaucauggugcagua

SEQ ID NO: 167621 - RNA, 19 nt, Homo sapiens
guuccacaguccauguuca

SEQ ID NO: 167622 - RNA, 19 nt, Homo sapiens
gccacaccuuccuacagaa

SEQ ID NO: 167623 - RNA, 19 nt, Homo sapiens
uaugagacugacaacuaua

SEQ ID NO: 167624 - RNA, 19 nt, Homo sapiens
gguacuaugagacugacaa

SEQ ID NO: 167625 - RNA, 19 nt, Homo sapiens
ggcaagaagaguugugucu

SEQ ID NO: 167626 - RNA, 19 nt, Homo sapiens
aggccgugcucuucaccua

SEQ ID NO: 167627 - RNA, 19 nt, Homo sapiens
ugcagaaguuacacaguag

SEQ ID NO: 167628 - RNA, 19 nt, Homo sapiens
ggaacugcagcacgagauc

SEQ ID NO: 167629 - RNA, 19 nt, Homo sapiens
gcugugcgaggacauguuc

SEQ ID NO: 167630 - RNA, 19 nt, Homo sapiens
aacuaacagucaagaaaca

SEQ ID NO: 167631 - RNA, 19 nt, Homo sapiens
ugcagaagggcaugaagaa

SEQ ID NO: 167632 - RNA, 19 nt, Homo sapiens
cagcuuuccucagcaacau

SEQ ID NO: 167633 - RNA, 19 nt, Homo sapiens
cggaagagcucauccagaa

SEQ ID NO: 167634 - RNA, 19 nt, Homo sapiens
gcaagagaauuuaaacaag

SEQ ID NO: 167635 - RNA, 19 nt, Homo sapiens
guuggaaggugacaauaaa

SEQ ID NO: 167636 - RNA, 19 nt, Homo sapiens
gaacucaacggcgacauaa

SEQ ID NO: 167637 - RNA, 19 nt, Homo sapiens
aaacaagucugcauuucau

SEQ ID NO: 167638 - RNA, 19 nt, Homo sapiens
aaugugagcuggagacaau

SEQ ID NO: 167639 - RNA, 19 nt, Homo sapiens
agaaucagcaagagaauuu

SEQ ID NO: 167640 - RNA, 19 nt, Homo sapiens
acaauaaacuggugacaac

SEQ ID NO: 167641 - RNA, 19 nt, Homo sapiens
gggagaaagucaagacagu

SEQ ID NO: 167642 - RNA, 19 nt, Homo sapiens
ucaagacagugguucaguu

SEQ ID NO: 167643 - RNA, 19 nt, Homo sapiens
auaaacuggugacaacuuu

SEQ ID NO: 167644 - RNA, 19 nt, Homo sapiens
gcaggucagucgugaagag

SEQ ID NO: 167645 - RNA, 19 nt, Homo sapiens
uaaacaagucugcauuuca

SEQ ID NO: 167646 - RNA, 19 nt, Homo sapiens
gaaagucaagacagugguu

SEQ ID NO: 167647 - RNA, 19 nt, Homo sapiens
caagacagugguucaguug

SEQ ID NO: 167648 - RNA, 19 nt, Homo sapiens
ucaccaauaccaugacauu

SEQ ID NO: 167649 - RNA, 19 nt, Homo sapiens
agacagugguucaguugga

SEQ ID NO: 167650 - RNA, 19 nt, Homo sapiens
caaucggucugccggaaga

SEQ ID NO: 167651 - RNA, 19 nt, Homo sapiens
gaaucagcaagagaauuua

SEQ ID NO: 167652 - RNA, 19 nt, Homo sapiens
cgaacucaacggcgacaua

SEQ ID NO: 167653 - RNA, 19 nt, Homo sapiens
caagucugcauuucauauu

SEQ ID NO: 167654 - RNA, 19 nt, Homo sapiens
uuaaacaagucugcauuuc

SEQ ID NO: 167655 - RNA, 19 nt, Homo sapiens
caagagaaucagcaagaga

SEQ ID NO: 167656 - RNA, 19 nt, Homo sapiens
gagaaucagcaagagaauu

SEQ ID NO: 167657 - RNA, 19 nt, Homo sapiens
gacagugguucaguuggaa

SEQ ID NO: 167658 - RNA, 19 nt, Homo sapiens
gacaauaaacuggugacaa

SEQ ID NO: 167659 - RNA, 19 nt, Homo sapiens
gacauaaucaccaauacca

SEQ ID NO: 167660 - RNA, 19 nt, Homo sapiens
ggcgacauaaucaccaaua

SEQ ID NO: 167661 - RNA, 19 nt, Homo sapiens
ggaaggugacaauaaacug

SEQ ID NO: 167662 - RNA, 19 nt, Homo sapiens
caacugcagagccaggaaa

SEQ ID NO: 167663 - RNA, 19 nt, Homo sapiens
ggagcucuauugccaccau

SEQ ID NO: 167664 - RNA, 19 nt, Homo sapiens
aagagaaucagcaagagaa

SEQ ID NO: 167665 - RNA, 19 nt, Homo sapiens
gguccaaagugauccaaaa

SEQ ID NO: 167666 - RNA, 19 nt, Homo sapiens
gcgacauaaucaccaauac

SEQ ID NO: 167667 - RNA, 19 nt, Homo sapiens
ucaagucugugaccgaacu

SEQ ID NO: 167668 - RNA, 19 nt, Homo sapiens
ucaagagaaucagcaagag

SEQ ID NO: 167669 - RNA, 19 nt, Homo sapiens
ccaaagugauccaaaacga

SEQ ID NO: 167670 - RNA, 19 nt, Homo sapiens
gcagagccaggaaaacuuu

SEQ ID NO: 167671 - RNA, 19 nt, Homo sapiens
aaacuggugacaacuuuca

SEQ ID NO: 167672 - RNA, 19 nt, Homo sapiens
acaagucugcauuucauau

SEQ ID NO: 167673 - RNA, 19 nt, Homo sapiens
ugacauugggugacauugu

SEQ ID NO: 167674 - RNA, 19 nt, Homo sapiens
cuauugccaccaugaguuu

SEQ ID NO: 167675 - RNA, 19 nt, Homo sapiens
cagcaagagaauuuaaaca

SEQ ID NO: 167676 - RNA, 19 nt, Homo sapiens
gaguuucuccggcaaguac

SEQ ID NO: 167677 - RNA, 19 nt, Homo sapiens
auaaucaccaauaccauga

SEQ ID NO: 167678 - RNA, 19 nt, Homo sapiens
acucaacggcgacauaauc

SEQ ID NO: 167679 - RNA, 19 nt, Homo sapiens
aauaaacuggugacaacuu

SEQ ID NO: 167680 - RNA, 19 nt, Homo sapiens
gaaugugagcuggagacaa

SEQ ID NO: 167681 - RNA, 19 nt, Homo sapiens
ucaguuggaaggugacaau

SEQ ID NO: 167682 - RNA, 19 nt, Homo sapiens
ggaagagcucauccagaag

SEQ ID NO: 167683 - RNA, 19 nt, Homo sapiens
ggaaauaaauucacaguca

SEQ ID NO: 167684 - RNA, 19 nt, Homo sapiens
ggacagaccugaaucucua

SEQ ID NO: 167685 - RNA, 19 nt, Homo sapiens
gaaacgaacugaauacugu

SEQ ID NO: 167686 - RNA, 19 nt, Homo sapiens
ggacagaagaucuauauug

SEQ ID NO: 167687 - RNA, 19 nt, Homo sapiens
gaucauagcucacuguaac

SEQ ID NO: 167688 - RNA, 19 nt, Homo sapiens
gagaguauguaaucuuuga

SEQ ID NO: 167689 - RNA, 19 nt, Homo sapiens
gaaccaagaauucuagaaa

SEQ ID NO: 167690 - RNA, 19 nt, Homo sapiens
gacagaagaucuauauugu

SEQ ID NO: 167691 - RNA, 19 nt, Homo sapiens
gaauagagaguauguaauc

SEQ ID NO: 167692 - RNA, 19 nt, Homo sapiens
ugaauaggaugauaggaaa

SEQ ID NO: 167693 - RNA, 19 nt, Homo sapiens
ggauugagcauuauucuug

SEQ ID NO: 167694 - RNA, 19 nt, Homo sapiens
ugauguagauaacagcuua

SEQ ID NO: 167695 - RNA, 19 nt, Homo sapiens
gcuaauagaaccaagaauu

SEQ ID NO: 167696 - RNA, 19 nt, Homo sapiens
ugacucaacugaaaucaug

SEQ ID NO: 167697 - RNA, 19 nt, Homo sapiens
gaugcagccuguccacuaa

SEQ ID NO: 167698 - RNA, 19 nt, Homo sapiens
ugacagcacuuggaaggua

SEQ ID NO: 167699 - RNA, 19 nt, Homo sapiens
gcacugguuguaaguaaua

SEQ ID NO: 167700 - RNA, 19 nt, Homo sapiens
gaacugguugugaauaauu

SEQ ID NO: 167701 - RNA, 19 nt, Homo sapiens
uaagguuacugauugauug

SEQ ID NO: 167702 - RNA, 19 nt, Homo sapiens
cagaagaucuauauuguac

SEQ ID NO: 167703 - RNA, 19 nt, Homo sapiens
gauaauugccauucugauu

SEQ ID NO: 167704 - RNA, 19 nt, Homo sapiens
gaagaucuauauuguacca

SEQ ID NO: 167705 - RNA, 19 nt, Homo sapiens
gaggcugacucaacugaaa

SEQ ID NO: 167706 - RNA, 19 nt, Homo sapiens
caauggagauaucaguuau

SEQ ID NO: 167707 - RNA, 19 nt, Homo sapiens
gcauaugagucuuuaacau

SEQ ID NO: 167708 - RNA, 19 nt, Homo sapiens
gaauaugaauugacagacu

SEQ ID NO: 167709 - RNA, 19 nt, Homo sapiens
ggagcuaaauaauguauac

SEQ ID NO: 167710 - RNA, 19 nt, Homo sapiens
gaucaucugagaaacuuaa

SEQ ID NO: 167711 - RNA, 19 nt, Homo sapiens
guauaagguuacugauuga

SEQ ID NO: 167712 - RNA, 19 nt, Homo sapiens
gcccagacuuuaccacuau

SEQ ID NO: 167713 - RNA, 19 nt, Homo sapiens
cugcaacucuauagacuuu

SEQ ID NO: 167714 - RNA, 19 nt, Homo sapiens
uaacuugucuuugagaaca

SEQ ID NO: 167715 - RNA, 19 nt, Homo sapiens
gacagacaauggaaacgaa

SEQ ID NO: 167716 - RNA, 19 nt, Homo sapiens
aauagacacuggagacuug

SEQ ID NO: 167717 - RNA, 19 nt, Homo sapiens
gaacaauggagauaucagu

SEQ ID NO: 167718 - RNA, 19 nt, Homo sapiens
ggaauguaguggagagauc

SEQ ID NO: 167719 - RNA, 19 nt, Homo sapiens
ccaugcugcuuuauaugua

SEQ ID NO: 167720 - RNA, 19 nt, Homo sapiens
guagauaacagcuuaacau

SEQ ID NO: 167721 - RNA, 19 nt, Homo sapiens
gcuugcagcucaugacaau

SEQ ID NO: 167722 - RNA, 19 nt, Homo sapiens
gagauggggucuugcuaua

SEQ ID NO: 167723 - RNA, 19 nt, Homo sapiens
gaucuauauuguaccagaa

SEQ ID NO: 167724 - RNA, 19 nt, Homo sapiens
gagaaauuauaggugauga

SEQ ID NO: 167725 - RNA, 19 nt, Homo sapiens
gagauaauugccauucuga

SEQ ID NO: 167726 - RNA, 19 nt, Homo sapiens
gaagguagaccggagugaa

SEQ ID NO: 167727 - RNA, 19 nt, Homo sapiens
acaauggagauaucaguua

SEQ ID NO: 167728 - RNA, 19 nt, Homo sapiens
ccacagugcccagcuaauu

SEQ ID NO: 167729 - RNA, 19 nt, Homo sapiens
cguccaugcugcuuuauau

SEQ ID NO: 167730 - RNA, 19 nt, Homo sapiens
gguuacagcccagacuuua

SEQ ID NO: 167731 - RNA, 19 nt, Homo sapiens
gaaaucauggcguuugaca

SEQ ID NO: 167732 - RNA, 19 nt, Homo sapiens
ugagaacaauggagauauc

SEQ ID NO: 167733 - RNA, 19 nt, Homo sapiens
gcugacaauuacacaagaa

SEQ ID NO: 167734 - RNA, 19 nt, Homo sapiens
agugggagcuaaauaaugu

SEQ ID NO: 167735 - RNA, 19 nt, Homo sapiens
aaucuccacuguuauucua

SEQ ID NO: 167736 - RNA, 19 nt, Homo sapiens
uucuuaaucuccacuguua

SEQ ID NO: 167737 - RNA, 19 nt, Homo sapiens
ucaaacuccuggacucaug

SEQ ID NO: 167738 - RNA, 19 nt, Homo sapiens
gaauacuguccgagaaauu

SEQ ID NO: 167739 - RNA, 19 nt, Homo sapiens
ggaaacgaacugaauacug

SEQ ID NO: 167740 - RNA, 19 nt, Homo sapiens
gggcgaugauaauuuacuu

SEQ ID NO: 167741 - RNA, 19 nt, Homo sapiens
cagcuuaacauuuacauag

SEQ ID NO: 167742 - RNA, 19 nt, Homo sapiens
cacauaaacacauacauug

SEQ ID NO: 167743 - RNA, 19 nt, Homo sapiens
uccacuaacuugucuuuga

SEQ ID NO: 167744 - RNA, 19 nt, Homo sapiens
caauacauaccacuuugaa

SEQ ID NO: 167745 - RNA, 19 nt, Homo sapiens
uugaacugguugugaauaa

SEQ ID NO: 167746 - RNA, 19 nt, Homo sapiens
ccacuaacuugucuuugag

SEQ ID NO: 167747 - RNA, 19 nt, Homo sapiens
uggcacugguuguaaguaa

SEQ ID NO: 167748 - RNA, 19 nt, Homo sapiens
auaagugggagcuaaauaa

SEQ ID NO: 167749 - RNA, 19 nt, Homo sapiens
gauggggucuugcuauauu

SEQ ID NO: 167750 - RNA, 19 nt, Homo sapiens
cccaucaaguauaagguua

SEQ ID NO: 167751 - RNA, 19 nt, Homo sapiens
uuuagcaggguacauauua

SEQ ID NO: 167752 - RNA, 19 nt, Homo sapiens
cuaauagaaccaagaauuc

SEQ ID NO: 167753 - RNA, 19 nt, Homo sapiens
gagaucauagcucacugua

SEQ ID NO: 167754 - RNA, 19 nt, Homo sapiens
uauguagccuugccuuuua

SEQ ID NO: 167755 - RNA, 19 nt, Homo sapiens
ggacagacaauggaaacga

SEQ ID NO: 167756 - RNA, 19 nt, Homo sapiens
gccacacacuguucuaagu

SEQ ID NO: 167757 - RNA, 19 nt, Homo sapiens
uuauguguaugaaggagua

SEQ ID NO: 167758 - RNA, 19 nt, Homo sapiens
gaaauuauaggugaugaac

SEQ ID NO: 167759 - RNA, 19 nt, Homo sapiens
aauacuguccgagaaauua

SEQ ID NO: 167760 - RNA, 19 nt, Homo sapiens
uauaagugggagcuaaaua

SEQ ID NO: 167761 - RNA, 19 nt, Homo sapiens
cccaauacauaccacuuug

SEQ ID NO: 167762 - RNA, 19 nt, Homo sapiens
cauaauccagagauaauug

SEQ ID NO: 167763 - RNA, 19 nt, Homo sapiens
cauaugagucuuuaacauc

SEQ ID NO: 167764 - RNA, 19 nt, Homo sapiens
caauggaaacgaacugaau

SEQ ID NO: 167765 - RNA, 19 nt, Homo sapiens
ugcguguucucacuuauaa

SEQ ID NO: 167766 - RNA, 19 nt, Homo sapiens
uaucagaaucgcuaauaga

SEQ ID NO: 167767 - RNA, 19 nt, Homo sapiens
caaauuggacagaagaucu

SEQ ID NO: 167768 - RNA, 19 nt, Homo sapiens
accagaguguagaauaaua

SEQ ID NO: 167769 - RNA, 19 nt, Homo sapiens
gugcuucacauaauuguau

SEQ ID NO: 167770 - RNA, 19 nt, Homo sapiens
cacagugcccagcuaauuu

SEQ ID NO: 167771 - RNA, 19 nt, Homo sapiens
ggucuuacucuuucacuca

SEQ ID NO: 167772 - RNA, 19 nt, Homo sapiens
uugcguccaugcugcuuua

SEQ ID NO: 167773 - RNA, 19 nt, Homo sapiens
gacaauuacacaagaagga

SEQ ID NO: 167774 - RNA, 19 nt, Homo sapiens
ugaauacuguccgagaaau

SEQ ID NO: 167775 - RNA, 19 nt, Homo sapiens
caccuuuaauuacaaccua

SEQ ID NO: 167776 - RNA, 19 nt, Homo sapiens
ccuagaggcugacucaacu

SEQ ID NO: 167777 - RNA, 19 nt, Homo sapiens
gauauccucucagcucucu

SEQ ID NO: 167778 - RNA, 19 nt, Homo sapiens
agagauaauugccauucug

SEQ ID NO: 167779 - RNA, 19 nt, Homo sapiens
gccagaaaacuuagaaaua

SEQ ID NO: 167780 - RNA, 19 nt, Homo sapiens
uugcagcucaugacaauuu

SEQ ID NO: 167781 - RNA, 19 nt, Homo sapiens
ccuggagccuugagggaaa

SEQ ID NO: 167782 - RNA, 19 nt, Homo sapiens
gaguguagaauaauagaca

SEQ ID NO: 167783 - RNA, 19 nt, Homo sapiens
gcaagaauuucgaugacua

SEQ ID NO: 167784 - RNA, 19 nt, Homo sapiens
gaauuucgaugacuacaug

SEQ ID NO: 167785 - RNA, 19 nt, Homo sapiens
acacagagaucagcuuuaa

SEQ ID NO: 167786 - RNA, 19 nt, Homo sapiens
gaacacagagaucagcuuu

SEQ ID NO: 167787 - RNA, 19 nt, Homo sapiens
gcaccacauugccucauuu

SEQ ID NO: 167788 - RNA, 19 nt, Homo sapiens
gcucugaggucaauaaagc

SEQ ID NO: 167789 - RNA, 19 nt, Homo sapiens
ugaccugacugcacuguug

SEQ ID NO: 167790 - RNA, 19 nt, Homo sapiens
ucacuaugguggacgcuuu

SEQ ID NO: 167791 - RNA, 19 nt, Homo sapiens
cacauugccucauuucuuc

SEQ ID NO: 167792 - RNA, 19 nt, Homo sapiens
gcacuguugcugacuacua

SEQ ID NO: 167793 - RNA, 19 nt, Homo sapiens
ggaguucgaugagacaaca

SEQ ID NO: 167794 - RNA, 19 nt, Homo sapiens
gaccaagccuaccacaauc

SEQ ID NO: 167795 - RNA, 19 nt, Homo sapiens
ccacauugccucauuucuu

SEQ ID NO: 167796 - RNA, 19 nt, Homo sapiens
gacacuggauggagggaaa

SEQ ID NO: 167797 - RNA, 19 nt, Homo sapiens
ugaccaagccuaccacaau

SEQ ID NO: 167798 - RNA, 19 nt, Homo sapiens
aaacucauccugacacuca

SEQ ID NO: 167799 - RNA, 19 nt, Homo sapiens
caacagcagaugacaggaa

SEQ ID NO: 167800 - RNA, 19 nt, Homo sapiens
acacacagcaccuucaaga

SEQ ID NO: 167801 - RNA, 19 nt, Homo sapiens
ccacggcacugcaguuugc

SEQ ID NO: 167802 - RNA, 19 nt, Homo sapiens
ggaagcuaguggacagcaa

SEQ ID NO: 167803 - RNA, 19 nt, Homo sapiens
guacaaauccacgaauucu

SEQ ID NO: 167804 - RNA, 19 nt, Homo sapiens
gaaaugggacgggcaagag

SEQ ID NO: 167805 - RNA, 19 nt, Homo sapiens
cacagcaccuucaagaaca

SEQ ID NO: 167806 - RNA, 19 nt, Homo sapiens
acaaauccacgaauucuuc

SEQ ID NO: 167807 - RNA, 19 nt, Homo sapiens
acagagaucagcuuuaagu

SEQ ID NO: 167808 - RNA, 19 nt, Homo sapiens
ggagcuaauugauggaaaa

SEQ ID NO: 167809 - RNA, 19 nt, Homo sapiens
gaaggucaaguccauugug

SEQ ID NO: 167810 - RNA, 19 nt, Homo sapiens
acaggaaggucaaguccau

SEQ ID NO: 167811 - RNA, 19 nt, Homo sapiens
agagaucagcuuuaaguug

SEQ ID NO: 167812 - RNA, 19 nt, Homo sapiens
aaggucaaguccauuguga

SEQ ID NO: 167813 - RNA, 19 nt, Homo sapiens
gggagcuaauugauggaaa

SEQ ID NO: 167814 - RNA, 19 nt, Homo sapiens
ccacaaucaucgaaaagaa

SEQ ID NO: 167815 - RNA, 19 nt, Homo sapiens
ggacagcaagaauuucgau

SEQ ID NO: 167816 - RNA, 19 nt, Homo sapiens
ggauggagggaaacuuguu

SEQ ID NO: 167817 - RNA, 19 nt, Homo sapiens
gcaguuugcacucgcacuu

SEQ ID NO: 167818 - RNA, 19 nt, Homo sapiens
cagcaagaauuucgaugac

SEQ ID NO: 167819 - RNA, 19 nt, Homo sapiens
ucaaguccauugugacacu

SEQ ID NO: 167820 - RNA, 19 nt, Homo sapiens
aaagaggcaugaccugacu

SEQ ID NO: 167821 - RNA, 19 nt, Homo sapiens
ccucauuucuuccucugau

SEQ ID NO: 167822 - RNA, 19 nt, Homo sapiens
acagcaagaauuucgauga

SEQ ID NO: 167823 - RNA, 19 nt, Homo sapiens
gcuaguggacagcaagaau

SEQ ID NO: 167824 - RNA, 19 nt, Homo sapiens
cuaguggacagcaagaauu

SEQ ID NO: 167825 - RNA, 19 nt, Homo sapiens
uaguggacagcaagaauuu

SEQ ID NO: 167826 - RNA, 19 nt, Homo sapiens
gaugagacaacagcagaug

SEQ ID NO: 167827 - RNA, 19 nt, Homo sapiens
ggugcucugaggucaauaa

SEQ ID NO: 167828 - RNA, 19 nt, Homo sapiens
ggaaggucaaguccauugu

SEQ ID NO: 167829 - RNA, 19 nt, Homo sapiens
acacagcaccuucaagaac

SEQ ID NO: 167830 - RNA, 19 nt, Homo sapiens
uuguacaaauccacgaauu

SEQ ID NO: 167831 - RNA, 19 nt, Homo sapiens
ucauuucuuccucugauuu

SEQ ID NO: 167832 - RNA, 19 nt, Homo sapiens
gauggagggaaacuuguuc

SEQ ID NO: 167833 - RNA, 19 nt, Homo sapiens
ggcacgagguagcuucucu

SEQ ID NO: 167834 - RNA, 19 nt, Homo sapiens
ugacuacuacucugccaau

SEQ ID NO: 167835 - RNA, 19 nt, Homo sapiens
uuguucaccugcagaaaug

SEQ ID NO: 167836 - RNA, 19 nt, Homo sapiens
gcaccuucaagaacacaga

SEQ ID NO: 167837 - RNA, 19 nt, Homo sapiens
caguucccaugguguaugu

SEQ ID NO: 167838 - RNA, 19 nt, Homo sapiens
ugaccgggauccaguucca

SEQ ID NO: 167839 - RNA, 19 nt, Homo sapiens
gcuaauugauggaaaacuc

SEQ ID NO: 167840 - RNA, 19 nt, Homo sapiens
gugcgggagcuaauugaug

SEQ ID NO: 167841 - RNA, 19 nt, Homo sapiens
caagaauuucgaugacuac

SEQ ID NO: 167842 - RNA, 19 nt, Homo sapiens
ggacaggaguuaauuaaga

SEQ ID NO: 167843 - RNA, 19 nt, Homo sapiens
gagcaaaucuccauacugu

SEQ ID NO: 167844 - RNA, 19 nt, Homo sapiens
gcaaaucuccauacuguuu

SEQ ID NO: 167845 - RNA, 19 nt, Homo sapiens
ggagagaaguuugaagaaa

SEQ ID NO: 167846 - RNA, 19 nt, Homo sapiens
cagauuguaucaucacuug

SEQ ID NO: 167847 - RNA, 19 nt, Homo sapiens
gggaauagcuuugcgaaaa

SEQ ID NO: 167848 - RNA, 19 nt, Homo sapiens
caaaguguguuggauuaau

SEQ ID NO: 167849 - RNA, 19 nt, Homo sapiens
ugaccaagcucaguucaau

SEQ ID NO: 167850 - RNA, 19 nt, Homo sapiens
ggagugggaugggaaggaa

SEQ ID NO: 167851 - RNA, 19 nt, Homo sapiens
uucaaaguguguuggauua

SEQ ID NO: 167852 - RNA, 19 nt, Homo sapiens
caagccagauuguaucauc

SEQ ID NO: 167853 - RNA, 19 nt, Homo sapiens
ggaguuaauuaagagaaug

SEQ ID NO: 167854 - RNA, 19 nt, Homo sapiens
aaacugagagcacuuugaa

SEQ ID NO: 167855 - RNA, 19 nt, Homo sapiens
gaaauuagugguggagugu

SEQ ID NO: 167856 - RNA, 19 nt, Homo sapiens
gacaggaguuaauuaagag

SEQ ID NO: 167857 - RNA, 19 nt, Homo sapiens
ccauacuguuucuuucuuu

SEQ ID NO: 167858 - RNA, 19 nt, Homo sapiens
gugcauugguucagcauca

SEQ ID NO: 167859 - RNA, 19 nt, Homo sapiens
gaaagaugggaaauuagug

SEQ ID NO: 167860 - RNA, 19 nt, Homo sapiens
ggagcuaggagugggaaua

SEQ ID NO: 167861 - RNA, 19 nt, Homo sapiens
uguguuggauuaauuagga

SEQ ID NO: 167862 - RNA, 19 nt, Homo sapiens
guacucggaucuaugaaaa

SEQ ID NO: 167863 - RNA, 19 nt, Homo sapiens
ugaaagaugggaaauuagu

SEQ ID NO: 167864 - RNA, 19 nt, Homo sapiens
caacacaguuuucuuguac

SEQ ID NO: 167865 - RNA, 19 nt, Homo sapiens
cuuuacagauggugcauug

SEQ ID NO: 167866 - RNA, 19 nt, Homo sapiens
gggagagaaguuugaagaa

SEQ ID NO: 167867 - RNA, 19 nt, Homo sapiens
gauuguaucaucacuugug

SEQ ID NO: 167868 - RNA, 19 nt, Homo sapiens
uggagugugucaugaacaa

SEQ ID NO: 167869 - RNA, 19 nt, Homo sapiens
gaaugaccaagcucaguuc

SEQ ID NO: 167870 - RNA, 19 nt, Homo sapiens
ucaguucaaugagcaaauc

SEQ ID NO: 167871 - RNA, 19 nt, Homo sapiens
acaugcagcuauuucaaag

SEQ ID NO: 167872 - RNA, 19 nt, Homo sapiens
ucaaugagcaaaucuccau

SEQ ID NO: 167873 - RNA, 19 nt, Homo sapiens
gagcuaggagugggaauag

SEQ ID NO: 167874 - RNA, 19 nt, Homo sapiens
agaaugaccaagcucaguu

SEQ ID NO: 167875 - RNA, 19 nt, Homo sapiens
gagugugucaugaacaaug

SEQ ID NO: 167876 - RNA, 19 nt, Homo sapiens
uacagauggugcauugguu

SEQ ID NO: 167877 - RNA, 19 nt, Homo sapiens
augcagcuauuucaaagug

SEQ ID NO: 167878 - RNA, 19 nt, Homo sapiens
aggcuuugaugaauacaug

SEQ ID NO: 167879 - RNA, 19 nt, Homo sapiens
gagagcacuuugaaaacaa

SEQ ID NO: 167880 - RNA, 19 nt, Homo sapiens
gagaaugaccaagcucagu

SEQ ID NO: 167881 - RNA, 19 nt, Homo sapiens
ucaaaguguguuggauuaa

SEQ ID NO: 167882 - RNA, 19 nt, Homo sapiens
uacaugcagcuauuucaaa

SEQ ID NO: 167883 - RNA, 19 nt, Homo sapiens
ugggagagaaguuugaaga

SEQ ID NO: 167884 - RNA, 19 nt, Homo sapiens
caaugagcaaaucuccaua

SEQ ID NO: 167885 - RNA, 19 nt, Homo sapiens
uuaagagaaugaccaagcu

SEQ ID NO: 167886 - RNA, 19 nt, Homo sapiens
gguggagugugucaugaac

SEQ ID NO: 167887 - RNA, 19 nt, Homo sapiens
gugguggagugugucauga

SEQ ID NO: 167888 - RNA, 19 nt, Homo sapiens
caaaucuccauacuguuuc

SEQ ID NO: 167889 - RNA, 19 nt, Homo sapiens
accaagcucaguucaauga

SEQ ID NO: 167890 - RNA, 19 nt, Homo sapiens
uuggacaggaguuaauuaa

SEQ ID NO: 167891 - RNA, 19 nt, Homo sapiens
uccauacuguuucuuucuu

SEQ ID NO: 167892 - RNA, 19 nt, Homo sapiens
uuacaugcagcuauuucaa

SEQ ID NO: 167893 - RNA, 19 nt, Homo sapiens
gaccaagcucaguucaaug

SEQ ID NO: 167894 - RNA, 19 nt, Homo sapiens
uuucaaaguguguuggauu

SEQ ID NO: 167895 - RNA, 19 nt, Homo sapiens
ugagagcacuuugaaaaca

SEQ ID NO: 167896 - RNA, 19 nt, Homo sapiens
aauuagugguggagugugu

SEQ ID NO: 167897 - RNA, 19 nt, Homo sapiens
ggaagcugguggugaauuu

SEQ ID NO: 167898 - RNA, 19 nt, Homo sapiens
gaagaauuaugaugaguuc

SEQ ID NO: 167899 - RNA, 19 nt, Homo sapiens
gcuacaaacccaccaauaa

SEQ ID NO: 167900 - RNA, 19 nt, Homo sapiens
gaaagcaacauacagacaa

SEQ ID NO: 167901 - RNA, 19 nt, Homo sapiens
gcgggaagcugguggugaa

SEQ ID NO: 167902 - RNA, 19 nt, Homo sapiens
gcaagagacuggccuaagc

SEQ ID NO: 167903 - RNA, 19 nt, Homo sapiens
cuacaaacccaccaauaaa

SEQ ID NO: 167904 - RNA, 19 nt, Homo sapiens
gugagaagaauuaugauga

SEQ ID NO: 167905 - RNA, 19 nt, Homo sapiens
gggcaggacuucacuuggu

SEQ ID NO: 167906 - RNA, 19 nt, Homo sapiens
agagugagaagaauuauga

SEQ ID NO: 167907 - RNA, 19 nt, Homo sapiens
gcaaggaaagcaacauaca

SEQ ID NO: 167908 - RNA, 19 nt, Homo sapiens
ggaaagcaacauacagaca

SEQ ID NO: 167909 - RNA, 19 nt, Homo sapiens
gagaagaauuaugaugagu

SEQ ID NO: 167910 - RNA, 19 nt, Homo sapiens
gaguuuauaagcugggaua

SEQ ID NO: 167911 - RNA, 19 nt, Homo sapiens
ugagaagaauuaugaugag

SEQ ID NO: 167912 - RNA, 19 nt, Homo sapiens
ucggaggcgugaccuauga

SEQ ID NO: 167913 - RNA, 19 nt, Homo sapiens
uggagagugagaagaauua

SEQ ID NO: 167914 - RNA, 19 nt, Homo sapiens
aaagcaacauacagacaau

SEQ ID NO: 167915 - RNA, 19 nt, Homo sapiens
gauggagagugagaagaau

SEQ ID NO: 167916 - RNA, 19 nt, Homo sapiens
caaggccacugugcagaug

SEQ ID NO: 167917 - RNA, 19 nt, Homo sapiens
uuuauaagcugggauagca

SEQ ID NO: 167918 - RNA, 19 nt, Homo sapiens
gagcaagagacuggccuaa

SEQ ID NO: 167919 - RNA, 19 nt, Homo sapiens
aaggaaagcaacauacaga

SEQ ID NO: 167920 - RNA, 19 nt, Homo sapiens
ucacuuggucccagcacua

SEQ ID NO: 167921 - RNA, 19 nt, Homo sapiens
gaucuccagcgauguaauc

SEQ ID NO: 167922 - RNA, 19 nt, Homo sapiens
uaugagcgcgugagcaaga

SEQ ID NO: 167923 - RNA, 19 nt, Homo sapiens
uggcaaggaaagcaacaua

SEQ ID NO: 167924 - RNA, 19 nt, Homo sapiens
gccacaccaugaccaacaa

SEQ ID NO: 167925 - RNA, 19 nt, Homo sapiens
ccuaugagcgcgugagcaa

SEQ ID NO: 167926 - RNA, 19 nt, Homo sapiens
guucacuguuggcaaggaa

SEQ ID NO: 167927 - RNA, 19 nt, Homo sapiens
gagagugagaagaauuaug

SEQ ID NO: 167928 - RNA, 19 nt, Homo sapiens
caagagacuggccuaagca

SEQ ID NO: 167929 - RNA, 19 nt, Homo sapiens
agauggagagugagaagaa

SEQ ID NO: 167930 - RNA, 19 nt, Homo sapiens
caccaugaccaacaaguuc

SEQ ID NO: 167931 - RNA, 19 nt, Homo sapiens
ccucaucccucugcucucu

SEQ ID NO: 167932 - RNA, 19 nt, Homo sapiens
ggagagugagaagaauuau

SEQ ID NO: 167933 - RNA, 19 nt, Homo sapiens
aguucgagauggagaguga

SEQ ID NO: 167934 - RNA, 19 nt, Homo sapiens
gagcuacaaacccaccaau

SEQ ID NO: 167935 - RNA, 19 nt, Homo sapiens
caucggaggcgugaccuau

SEQ ID NO: 167936 - RNA, 19 nt, Homo sapiens
gggaagcugguggugaauu

SEQ ID NO: 167937 - RNA, 19 nt, Homo sapiens
caaggaaagcaacauacag

SEQ ID NO: 167938 - RNA, 19 nt, Homo sapiens
ucaccagaccucagagauc

SEQ ID NO: 167939 - RNA, 19 nt, Homo sapiens
ugaccaacaaguucacugu

SEQ ID NO: 167940 - RNA, 19 nt, Homo sapiens
gagauggagagugagaaga

SEQ ID NO: 167941 - RNA, 19 nt, Homo sapiens
acaccaugaccaacaaguu

SEQ ID NO: 167942 - RNA, 19 nt, Homo sapiens
ggccacaccaugaccaaca

SEQ ID NO: 167943 - RNA, 19 nt, Homo sapiens
ugggaucuccagcgaugua

SEQ ID NO: 167944 - RNA, 19 nt, Homo sapiens
caacauggcugaucauuaa

SEQ ID NO: 167945 - RNA, 19 nt, Homo sapiens
gaaaugggauggcaaagaa

SEQ ID NO: 167946 - RNA, 19 nt, Homo sapiens
ucucagugcuauccuauua

SEQ ID NO: 167947 - RNA, 19 nt, Homo sapiens
ggagaagaguuugaugaaa

SEQ ID NO: 167948 - RNA, 19 nt, Homo sapiens
gaacuuugaugaguacaug

SEQ ID NO: 167949 - RNA, 19 nt, Homo sapiens
cauggcugaucauuaauua

SEQ ID NO: 167950 - RNA, 19 nt, Homo sapiens
gaccaacagucagaacuuu

SEQ ID NO: 167951 - RNA, 19 nt, Homo sapiens
caacgguaauuaucaguca

SEQ ID NO: 167952 - RNA, 19 nt, Homo sapiens
caaggaugguggaggcuuu

SEQ ID NO: 167953 - RNA, 19 nt, Homo sapiens
gagcugcaguggcaauuag

SEQ ID NO: 167954 - RNA, 19 nt, Homo sapiens
gcaauuagaccagaagauc

SEQ ID NO: 167955 - RNA, 19 nt, Homo sapiens
guaauuaucagucaagaag

SEQ ID NO: 167956 - RNA, 19 nt, Homo sapiens
ugaaaccacugcagaugau

SEQ ID NO: 167957 - RNA, 19 nt, Homo sapiens
gucagaacuuugaugagua

SEQ ID NO: 167958 - RNA, 19 nt, Homo sapiens
gcuauccuauuacaacaug

SEQ ID NO: 167959 - RNA, 19 nt, Homo sapiens
gggagaagaguuugaugaa

SEQ ID NO: 167960 - RNA, 19 nt, Homo sapiens
ggaaaugugaccaaaccaa

SEQ ID NO: 167961 - RNA, 19 nt, Homo sapiens
gaugauagaaacuguaagu

SEQ ID NO: 167962 - RNA, 19 nt, Homo sapiens
uagccuggauggagacaaa

SEQ ID NO: 167963 - RNA, 19 nt, Homo sapiens
gaacacggagauuaguuuc

SEQ ID NO: 167964 - RNA, 19 nt, Homo sapiens
ggguguguuugcaauuuaa

SEQ ID NO: 167965 - RNA, 19 nt, Homo sapiens
gcagaugauagaaacugua

SEQ ID NO: 167966 - RNA, 19 nt, Homo sapiens
ucaggacucucagcacauu

SEQ ID NO: 167967 - RNA, 19 nt, Homo sapiens
ucaagaaggagacaaagug

SEQ ID NO: 167968 - RNA, 19 nt, Homo sapiens
ccaaaccaacgguaauuau

SEQ ID NO: 167969 - RNA, 19 nt, Homo sapiens
gaccaaaccaacgguaauu

SEQ ID NO: 167970 - RNA, 19 nt, Homo sapiens
cagaugauagaaacuguaa

SEQ ID NO: 167971 - RNA, 19 nt, Homo sapiens
cccacccucuuuccaaaua

SEQ ID NO: 167972 - RNA, 19 nt, Homo sapiens
ggugggaaaugugaccaaa

SEQ ID NO: 167973 - RNA, 19 nt, Homo sapiens
acaacauggcugaucauua

SEQ ID NO: 167974 - RNA, 19 nt, Homo sapiens
ccucaagucucagugcuau

SEQ ID NO: 167975 - RNA, 19 nt, Homo sapiens
gaugaaaccacugcagaug

SEQ ID NO: 167976 - RNA, 19 nt, Homo sapiens
gcugcuugcugagguguaa

SEQ ID NO: 167977 - RNA, 19 nt, Homo sapiens
gaaaccacugcagaugaua

SEQ ID NO: 167978 - RNA, 19 nt, Homo sapiens
ucaagaacacggagauuag

SEQ ID NO: 167979 - RNA, 19 nt, Homo sapiens
ccaacagucagaacuuuga

SEQ ID NO: 167980 - RNA, 19 nt, Homo sapiens
ucagugcuauccuauuaca

SEQ ID NO: 167981 - RNA, 19 nt, Homo sapiens
ccacccucuuuccaaauaa

SEQ ID NO: 167982 - RNA, 19 nt, Homo sapiens
ccacugcagaugauagaaa

SEQ ID NO: 167983 - RNA, 19 nt, Homo sapiens
aaaccaacgguaauuauca

SEQ ID NO: 167984 - RNA, 19 nt, Homo sapiens
gauggcaaagaaacaaauu

SEQ ID NO: 167985 - RNA, 19 nt, Homo sapiens
gaaacuguaagucuguugu

SEQ ID NO: 167986 - RNA, 19 nt, Homo sapiens
gagacaaaguggucaucag

SEQ ID NO: 167987 - RNA, 19 nt, Homo sapiens
ccuggaagcugaccaacag

SEQ ID NO: 167988 - RNA, 19 nt, Homo sapiens
caaaccaacgguaauuauc

SEQ ID NO: 167989 - RNA, 19 nt, Homo sapiens
gguguaaagggucuucuga

SEQ ID NO: 167990 - RNA, 19 nt, Homo sapiens
ucagaacuuugaugaguac

SEQ ID NO: 167991 - RNA, 19 nt, Homo sapiens
agucagaacuuugaugagu

SEQ ID NO: 167992 - RNA, 19 nt, Homo sapiens
gcuguucgccacuaugaga

SEQ ID NO: 167993 - RNA, 19 nt, Homo sapiens
aacuguaagucuguuguua

SEQ ID NO: 167994 - RNA, 19 nt, Homo sapiens
guggaggcuuucugugcua

SEQ ID NO: 167995 - RNA, 19 nt, Homo sapiens
gcugaucauuaauuagaag

SEQ ID NO: 167996 - RNA, 19 nt, Homo sapiens
uggcugaucauuaauuaga

SEQ ID NO: 167997 - RNA, 19 nt, Homo sapiens
agaacacggagauuaguuu

SEQ ID NO: 167998 - RNA, 19 nt, Homo sapiens
aauuaucagucaagaagga

SEQ ID NO: 167999 - RNA, 19 nt, Homo sapiens
cuaggcaggugggaaaugu

SEQ ID NO: 168000 - RNA, 19 nt, Homo sapiens
ccgcuccugucucuaaaga

SEQ ID NO: 168001 - RNA, 19 nt, Homo sapiens
caaacuuguucacauacag

SEQ ID NO: 168002 - RNA, 19 nt, Homo sapiens
acagaaaugggauggcaaa

SEQ ID NO: 168003 - RNA, 19 nt, Homo sapiens
gcaauuuaaaucacuggau

SEQ ID NO: 168004 - RNA, 19 nt, Homo sapiens
acagucagaacuuugauga

SEQ ID NO: 168005 - RNA, 19 nt, Homo sapiens
ggcugaucauuaauuagaa

SEQ ID NO: 168006 - RNA, 19 nt, Homo sapiens
gugcuauccuauuacaaca

SEQ ID NO: 168007 - RNA, 19 nt, Homo sapiens
ccagcugggagaagaguuu

SEQ ID NO: 168008 - RNA, 19 nt, Homo sapiens
acacggagauuaguuucca

SEQ ID NO: 168009 - RNA, 19 nt, Homo sapiens
ggagacaaaguggucauca

SEQ ID NO: 168010 - RNA, 19 nt, Homo sapiens
gaugguggaggcuuucugu

SEQ ID NO: 168011 - RNA, 19 nt, Homo sapiens
gggguguguuugcaauuua

SEQ ID NO: 168012 - RNA, 19 nt, Homo sapiens
agaaaugggauggcaaaga

SEQ ID NO: 168013 - RNA, 19 nt, Homo sapiens
ggauggcaaagaaacaaau

SEQ ID NO: 168014 - RNA, 19 nt, Homo sapiens
ugauagaaacuguaagucu

SEQ ID NO: 168015 - RNA, 19 nt, Homo sapiens
uucaagaacacggagauua

SEQ ID NO: 168016 - RNA, 19 nt, Homo sapiens
gguaauuaucagucaagaa

SEQ ID NO: 168017 - RNA, 19 nt, Homo sapiens
guuaugacccuuacuuuug

SEQ ID NO: 168018 - RNA, 19 nt, Homo sapiens
caagaacacggagauuagu

SEQ ID NO: 168019 - RNA, 19 nt, Homo sapiens
gggauggcaaagaaacaaa

SEQ ID NO: 168020 - RNA, 19 nt, Homo sapiens
uagaaacuguaagucuguu

SEQ ID NO: 168021 - RNA, 19 nt, Homo sapiens
ucuguuuccucaagucuca

SEQ ID NO: 168022 - RNA, 19 nt, Homo sapiens
gaaauuaaggauggcaaaa

SEQ ID NO: 168023 - RNA, 19 nt, Homo sapiens
ugggagaagaguuugauga

SEQ ID NO: 168024 - RNA, 19 nt, Homo sapiens
aaacuuguucacauacaga

SEQ ID NO: 168025 - RNA, 19 nt, Homo sapiens
ugaccaaaccaacgguaau

SEQ ID NO: 168026 - RNA, 19 nt, Homo sapiens
gcucuaggcgugggcuuug

SEQ ID NO: 168027 - RNA, 19 nt, Homo sapiens
agaaauuaaggauggcaaa

SEQ ID NO: 168028 - RNA, 19 nt, Homo sapiens
acucucagcacauucaaga

SEQ ID NO: 168029 - RNA, 19 nt, Homo sapiens
gugaccaaaccaacgguaa

SEQ ID NO: 168030 - RNA, 19 nt, Homo sapiens
caacuugcccaauuuuaau

SEQ ID NO: 168031 - RNA, 19 nt, Homo sapiens
ugcccacccucuuuccaaa

SEQ ID NO: 168032 - RNA, 19 nt, Homo sapiens
ggagggguguguuugcaau

SEQ ID NO: 168033 - RNA, 19 nt, Homo sapiens
aaacuguaagucuguuguu

SEQ ID NO: 168034 - RNA, 19 nt, Homo sapiens
ugagcugcaguggcaauua

SEQ ID NO: 168035 - RNA, 19 nt, Homo sapiens
gcacagaaauuaaaggaau

SEQ ID NO: 168036 - RNA, 19 nt, Homo sapiens
gcaaagugauugacuguga

SEQ ID NO: 168037 - RNA, 19 nt, Homo sapiens
ggacaucacugcccacuuc

SEQ ID NO: 168038 - RNA, 19 nt, Homo sapiens
agaggaagauguucacuua

SEQ ID NO: 168039 - RNA, 19 nt, Homo sapiens
gaucguggcucuucaggaa

SEQ ID NO: 168040 - RNA, 19 nt, Homo sapiens
ggacagaggcagauaagaa

SEQ ID NO: 168041 - RNA, 19 nt, Homo sapiens
agagggagcugcuaaugua

SEQ ID NO: 168042 - RNA, 19 nt, Homo sapiens
caccaaagcucaaggaguu

SEQ ID NO: 168043 - RNA, 19 nt, Homo sapiens
ggaaagccaucccgacaug

SEQ ID NO: 168044 - RNA, 19 nt, Homo sapiens
ugaaagggcacagaaauua

SEQ ID NO: 168045 - RNA, 19 nt, Homo sapiens
ggacgacgaugacaaugug

SEQ ID NO: 168046 - RNA, 19 nt, Homo sapiens
guacagcagcaauuucuua

SEQ ID NO: 168047 - RNA, 19 nt, Homo sapiens
gaaagggcacagaaauuaa

SEQ ID NO: 168048 - RNA, 19 nt, Homo sapiens
gcccuggucuuccuguuua

SEQ ID NO: 168049 - RNA, 19 nt, Homo sapiens
ugucagaacucgugccuuu

SEQ ID NO: 168050 - RNA, 19 nt, Homo sapiens
cagcaauccucgaguguuu

SEQ ID NO: 168051 - RNA, 19 nt, Homo sapiens
ucaacgcacugauggauuu

SEQ ID NO: 168052 - RNA, 19 nt, Homo sapiens
ggaguugguuggccauuug

SEQ ID NO: 168053 - RNA, 19 nt, Homo sapiens
gguagaagguccacugugu

SEQ ID NO: 168054 - RNA, 19 nt, Homo sapiens
gcacugcacuuugcgauuc

SEQ ID NO: 168055 - RNA, 19 nt, Homo sapiens
gggccaugcuuucugauuu

SEQ ID NO: 168056 - RNA, 19 nt, Homo sapiens
caucugaccucaaauagca

SEQ ID NO: 168057 - RNA, 19 nt, Homo sapiens
cagcccagcucccguguaa

SEQ ID NO: 168058 - RNA, 19 nt, Homo sapiens
agaguuugcucaguauuua

SEQ ID NO: 168059 - RNA, 19 nt, Homo sapiens
gagaggagcuauugguuuu

SEQ ID NO: 168060 - RNA, 19 nt, Homo sapiens
gaagacauuucugcacaug

SEQ ID NO: 168061 - RNA, 19 nt, Homo sapiens
ggucaacucugagaugaga

SEQ ID NO: 168062 - RNA, 19 nt, Homo sapiens
ucacuuaacuuaccaagac

SEQ ID NO: 168063 - RNA, 19 nt, Homo sapiens
ccacauucgucacagauau

SEQ ID NO: 168064 - RNA, 19 nt, Homo sapiens
ucacaucugaccucaaaua

SEQ ID NO: 168065 - RNA, 19 nt, Homo sapiens
gcacaggaaaugaggauau

SEQ ID NO: 168066 - RNA, 19 nt, Homo sapiens
gacgagggauuccuuguuc

SEQ ID NO: 168067 - RNA, 19 nt, Homo sapiens
gggaaaggaaucaauuauu

SEQ ID NO: 168068 - RNA, 19 nt, Homo sapiens
ggauauuauuuccagauug

SEQ ID NO: 168069 - RNA, 19 nt, Homo sapiens
gaagagaagccagaagaug

SEQ ID NO: 168070 - RNA, 19 nt, Homo sapiens
gaagagagcagauaaaauc

SEQ ID NO: 168071 - RNA, 19 nt, Homo sapiens
gccaagcucuucaggaugu

SEQ ID NO: 168072 - RNA, 19 nt, Homo sapiens
ugacagcagcguugagaua

SEQ ID NO: 168073 - RNA, 19 nt, Homo sapiens
gagcugagagccuccauga

SEQ ID NO: 168074 - RNA, 19 nt, Homo sapiens
uaccauggcugcagcaaga

SEQ ID NO: 168075 - RNA, 19 nt, Homo sapiens
gcaguguaauuuccacaga

SEQ ID NO: 168076 - RNA, 19 nt, Homo sapiens
gauauuauuuccagauugc

SEQ ID NO: 168077 - RNA, 19 nt, Homo sapiens
gcaggucacgguugaugua

SEQ ID NO: 168078 - RNA, 19 nt, Homo sapiens
ccaggagccucaucucuuc

SEQ ID NO: 168079 - RNA, 19 nt, Homo sapiens
ucaggaagcagcuaaagaa

SEQ ID NO: 168080 - RNA, 19 nt, Homo sapiens
cagccaagcucuucaggau

SEQ ID NO: 168081 - RNA, 19 nt, Homo sapiens
gcagagagaguggagcuuu

SEQ ID NO: 168082 - RNA, 19 nt, Homo sapiens
gguguggcaucuucacgua

SEQ ID NO: 168083 - RNA, 19 nt, Homo sapiens
gcacuuccucuuugagauu

SEQ ID NO: 168084 - RNA, 19 nt, Homo sapiens
ggaagauguucacuuaacu

SEQ ID NO: 168085 - RNA, 19 nt, Homo sapiens
cagccagcgugauguuaua

SEQ ID NO: 168086 - RNA, 19 nt, Homo sapiens
ccucugcguuccugucaua

SEQ ID NO: 168087 - RNA, 19 nt, Homo sapiens
ccguggaacugauaacaaa

SEQ ID NO: 168088 - RNA, 19 nt, Homo sapiens
caacaagucagggaagaaa

SEQ ID NO: 168089 - RNA, 19 nt, Homo sapiens
gcagcaagaccucauagug

SEQ ID NO: 168090 - RNA, 19 nt, Homo sapiens
gcugagagccuccaugaca

SEQ ID NO: 168091 - RNA, 19 nt, Homo sapiens
ugacucagauacucacuca

SEQ ID NO: 168092 - RNA, 19 nt, Homo sapiens
ccagggccaugcuuucuga

SEQ ID NO: 168093 - RNA, 19 nt, Homo sapiens
guucugaggccuaugcuaa

SEQ ID NO: 168094 - RNA, 19 nt, Homo sapiens
caucacagcugggaagaca

SEQ ID NO: 168095 - RNA, 19 nt, Homo sapiens
gaagauguucacuuaacuu

SEQ ID NO: 168096 - RNA, 19 nt, Homo sapiens
uaaagaaaccucagaaagc

SEQ ID NO: 168097 - RNA, 19 nt, Homo sapiens
ggaagacauuucugcacau

SEQ ID NO: 168098 - RNA, 19 nt, Homo sapiens
ggacgagggauuccuuguu

SEQ ID NO: 168099 - RNA, 19 nt, Homo sapiens
gcacagguggcagugauuu

SEQ ID NO: 168100 - RNA, 19 nt, Homo sapiens
uguuagaguuugcucagua

SEQ ID NO: 168101 - RNA, 19 nt, Homo sapiens
uccgagagguguugaaaga

SEQ ID NO: 168102 - RNA, 19 nt, Homo sapiens
caaaucuccucgacugcuu

SEQ ID NO: 168103 - RNA, 19 nt, Homo sapiens
gaagcuggacugcgagaga

SEQ ID NO: 168104 - RNA, 19 nt, Homo sapiens
uagaagguccacuguguaa

SEQ ID NO: 168105 - RNA, 19 nt, Homo sapiens
ugcaagagcugcuggaaag

SEQ ID NO: 168106 - RNA, 19 nt, Homo sapiens
aaagaaaccucagaaagcu

SEQ ID NO: 168107 - RNA, 19 nt, Homo sapiens
gcacuuugcgauucaacaa

SEQ ID NO: 168108 - RNA, 19 nt, Homo sapiens
cagcagcguugagauauca

SEQ ID NO: 168109 - RNA, 19 nt, Homo sapiens
guagaagguccacugugua

SEQ ID NO: 168110 - RNA, 19 nt, Homo sapiens
ugucuucccuguuagaguu

SEQ ID NO: 168111 - RNA, 19 nt, Homo sapiens
cgagagagaggagcuauug

SEQ ID NO: 168112 - RNA, 19 nt, Homo sapiens
gagagaggagcuauugguu

SEQ ID NO: 168113 - RNA, 19 nt, Homo sapiens
gcgagcaguucuuccacuu

SEQ ID NO: 168114 - RNA, 19 nt, Homo sapiens
cacaggaaaugaggauauu

SEQ ID NO: 168115 - RNA, 19 nt, Homo sapiens
cagcagcaauuucuuacuc

SEQ ID NO: 168116 - RNA, 19 nt, Homo sapiens
gcuaaucauucuaguucau

SEQ ID NO: 168117 - RNA, 19 nt, Homo sapiens
cagagagaguggagcuuug

SEQ ID NO: 168118 - RNA, 19 nt, Homo sapiens
gggccucguuuauuaagau

SEQ ID NO: 168119 - RNA, 19 nt, Homo sapiens
aggcuuggcucccgaaugu

SEQ ID NO: 168120 - RNA, 19 nt, Homo sapiens
ggaagggucaagagggaaa

SEQ ID NO: 168121 - RNA, 19 nt, Homo sapiens
gcagaggaaggcuacuuga

SEQ ID NO: 168122 - RNA, 19 nt, Homo sapiens
gagcucuuguugcacuaaa

SEQ ID NO: 168123 - RNA, 19 nt, Homo sapiens
ccagcucccguguaaauaa

SEQ ID NO: 168124 - RNA, 19 nt, Homo sapiens
ccaagugccagacgaaaug

SEQ ID NO: 168125 - RNA, 19 nt, Homo sapiens
cuacgaggauuugucauca

SEQ ID NO: 168126 - RNA, 19 nt, Homo sapiens
ucacagacuacaucucauu

SEQ ID NO: 168127 - RNA, 19 nt, Homo sapiens
cugcagagaaugcugauuu

SEQ ID NO: 168128 - RNA, 19 nt, Homo sapiens
aaaauugucucucagcaaa

SEQ ID NO: 168129 - RNA, 19 nt, Homo sapiens
guuagaguuugcucaguau

SEQ ID NO: 168130 - RNA, 19 nt, Homo sapiens
gggagcugcuaauguacaa

SEQ ID NO: 168131 - RNA, 19 nt, Homo sapiens
aaagggcacagaaauuaaa

SEQ ID NO: 168132 - RNA, 19 nt, Homo sapiens
ggucacgguugauguacug

SEQ ID NO: 168133 - RNA, 19 nt, Homo sapiens
gaagguuuguccacauucg

SEQ ID NO: 168134 - RNA, 19 nt, Homo sapiens
acauggagcucuuguugca

SEQ ID NO: 168135 - RNA, 19 nt, Homo sapiens
ugaaagagauggauucuaa

SEQ ID NO: 168136 - RNA, 19 nt, Homo sapiens
caagauggcucaagauuca

SEQ ID NO: 168137 - RNA, 19 nt, Homo sapiens
gagaaaugcugcagucaga

SEQ ID NO: 168138 - RNA, 19 nt, Homo sapiens
ggucauugccuucauauaa

SEQ ID NO: 168139 - RNA, 19 nt, Homo sapiens
gauaaagcaugcugguaaa

SEQ ID NO: 168140 - RNA, 19 nt, Homo sapiens
gcaauggcaugcaucugua

SEQ ID NO: 168141 - RNA, 19 nt, Homo sapiens
gguaugcaccuauagauua

SEQ ID NO: 168142 - RNA, 19 nt, Homo sapiens
gcaagacccucaagauauc

SEQ ID NO: 168143 - RNA, 19 nt, Homo sapiens
gcuaauagauccacugaag

SEQ ID NO: 168144 - RNA, 19 nt, Homo sapiens
gugcuuauguugucuaauu

SEQ ID NO: 168145 - RNA, 19 nt, Homo sapiens
gaaauugucugagaaggau

SEQ ID NO: 168146 - RNA, 19 nt, Homo sapiens
gcagagcaauuacugaugu

SEQ ID NO: 168147 - RNA, 19 nt, Homo sapiens
caguagaucuuucuuguga

SEQ ID NO: 168148 - RNA, 19 nt, Homo sapiens
gaccagaccuuguacagau

SEQ ID NO: 168149 - RNA, 19 nt, Homo sapiens
agaaugagcuguacacauc

SEQ ID NO: 168150 - RNA, 19 nt, Homo sapiens
gagagaaauugucugagaa

SEQ ID NO: 168151 - RNA, 19 nt, Homo sapiens
guuagucucuuguuaaaug

SEQ ID NO: 168152 - RNA, 19 nt, Homo sapiens
gaugcuaacugcuaccaaa

SEQ ID NO: 168153 - RNA, 19 nt, Homo sapiens
gcacucagauuugauaaag

SEQ ID NO: 168154 - RNA, 19 nt, Homo sapiens
aaacuuaacuccuggauac

SEQ ID NO: 168155 - RNA, 19 nt, Homo sapiens
gacagggucuggaaucuga

SEQ ID NO: 168156 - RNA, 19 nt, Homo sapiens
gauccuugccuucauauaa

SEQ ID NO: 168157 - RNA, 19 nt, Homo sapiens
ugagagaaauugucugaga

SEQ ID NO: 168158 - RNA, 19 nt, Homo sapiens
guagaucuuucuugugauu

SEQ ID NO: 168159 - RNA, 19 nt, Homo sapiens
ggaaucgucuuggcauuga

SEQ ID NO: 168160 - RNA, 19 nt, Homo sapiens
guacacaucuugggacaau

SEQ ID NO: 168161 - RNA, 19 nt, Homo sapiens
uuaaagagcugcgaacuca

SEQ ID NO: 168162 - RNA, 19 nt, Homo sapiens
ccucagagcuccugcacaa

SEQ ID NO: 168163 - RNA, 19 nt, Homo sapiens
guuaguuagucucuuguua

SEQ ID NO: 168164 - RNA, 19 nt, Homo sapiens
gaagguagaggauguguuc

SEQ ID NO: 168165 - RNA, 19 nt, Homo sapiens
accgucagcuugauaauua

SEQ ID NO: 168166 - RNA, 19 nt, Homo sapiens
agucagacauguucacuaa

SEQ ID NO: 168167 - RNA, 19 nt, Homo sapiens
gcgaggaccacccgauuua

SEQ ID NO: 168168 - RNA, 19 nt, Homo sapiens
guacaggguuggccucuuc

SEQ ID NO: 168169 - RNA, 19 nt, Homo sapiens
cccgagagcuccuuaaaga

SEQ ID NO: 168170 - RNA, 19 nt, Homo sapiens
ugaaagcccuagaucagaa

SEQ ID NO: 168171 - RNA, 19 nt, Homo sapiens
uaaaugaugcuaacugcua

SEQ ID NO: 168172 - RNA, 19 nt, Homo sapiens
ucagacauguucacuaaug

SEQ ID NO: 168173 - RNA, 19 nt, Homo sapiens
gaugguggcagagcaauua

SEQ ID NO: 168174 - RNA, 19 nt, Homo sapiens
caggguguauuaucucaua

SEQ ID NO: 168175 - RNA, 19 nt, Homo sapiens
uaacaaagaaccacagaau

SEQ ID NO: 168176 - RNA, 19 nt, Homo sapiens
ucaagaggcugaggcauga

SEQ ID NO: 168177 - RNA, 19 nt, Homo sapiens
cgugacaucuguggaauuu

SEQ ID NO: 168178 - RNA, 19 nt, Homo sapiens
uguagaagcucuggagaaa

SEQ ID NO: 168179 - RNA, 19 nt, Homo sapiens
gagagaaucaucuuaaugg

SEQ ID NO: 168180 - RNA, 19 nt, Homo sapiens
uaugaagccuugaaagaga

SEQ ID NO: 168181 - RNA, 19 nt, Homo sapiens
ucagagagaaucaucuuaa

SEQ ID NO: 168182 - RNA, 19 nt, Homo sapiens
ugauaaagcaugcugguaa

SEQ ID NO: 168183 - RNA, 19 nt, Homo sapiens
ggucaugaaccauuaaaga

SEQ ID NO: 168184 - RNA, 19 nt, Homo sapiens
ucaagcugcacaucuauua

SEQ ID NO: 168185 - RNA, 19 nt, Homo sapiens
caagugagcuucgguacuc

SEQ ID NO: 168186 - RNA, 19 nt, Homo sapiens
acaaagaaccacagaauuc

SEQ ID NO: 168187 - RNA, 19 nt, Homo sapiens
gacucucccugauaguuua

SEQ ID NO: 168188 - RNA, 19 nt, Homo sapiens
ucaguuaguuagucucuug

SEQ ID NO: 168189 - RNA, 19 nt, Homo sapiens
ugagaaggaucgaaugcuu

SEQ ID NO: 168190 - RNA, 19 nt, Homo sapiens
ggaauuguauugguuguac

SEQ ID NO: 168191 - RNA, 19 nt, Homo sapiens
uagaggauguguuccagaa

SEQ ID NO: 168192 - RNA, 19 nt, Homo sapiens
ucagaagggugugcuggua

SEQ ID NO: 168193 - RNA, 19 nt, Homo sapiens
ggaaaugggaauuggaaau

SEQ ID NO: 168194 - RNA, 19 nt, Homo sapiens
gcucagagaagcaguugaa

SEQ ID NO: 168195 - RNA, 19 nt, Homo sapiens
agagauggauucuaauaca

SEQ ID NO: 168196 - RNA, 19 nt, Homo sapiens
gagaaggaucgaaugcuuu

SEQ ID NO: 168197 - RNA, 19 nt, Homo sapiens
caacagagcgagaccaucu

SEQ ID NO: 168198 - RNA, 19 nt, Homo sapiens
uaacccagcuauucaagag

SEQ ID NO: 168199 - RNA, 19 nt, Homo sapiens
uaacauggcaauacccuau

SEQ ID NO: 168200 - RNA, 19 nt, Homo sapiens
ggauaaagccacacugucu

SEQ ID NO: 168201 - RNA, 19 nt, Homo sapiens
gggacaaucugcuaguauc

SEQ ID NO: 168202 - RNA, 19 nt, Homo sapiens
gcugcgaacucaagucuag

SEQ ID NO: 168203 - RNA, 19 nt, Homo sapiens
gguuugcacucaagaccua

SEQ ID NO: 168204 - RNA, 19 nt, Homo sapiens
agaaggaucgaaugcuuua

SEQ ID NO: 168205 - RNA, 19 nt, Homo sapiens
ggacgugaaccucaggaaa

SEQ ID NO: 168206 - RNA, 19 nt, Homo sapiens
cagagagaaucaucuuaau

SEQ ID NO: 168207 - RNA, 19 nt, Homo sapiens
cuaauauggugcuuauguu

SEQ ID NO: 168208 - RNA, 19 nt, Homo sapiens
cauggucauugccuucaua

SEQ ID NO: 168209 - RNA, 19 nt, Homo sapiens
gcaauacccuaucucuacu

SEQ ID NO: 168210 - RNA, 19 nt, Homo sapiens
cagcgaagguagaggaugu

SEQ ID NO: 168211 - RNA, 19 nt, Homo sapiens
gcagagagcacagacuaug

SEQ ID NO: 168212 - RNA, 19 nt, Homo sapiens
gagccgagaucaugacacu

SEQ ID NO: 168213 - RNA, 19 nt, Homo sapiens
gaacucagagagaaucauc

SEQ ID NO: 168214 - RNA, 19 nt, Homo sapiens
guagugagccgagaucaug

SEQ ID NO: 168215 - RNA, 19 nt, Homo sapiens
gcaugaggaucucuugaac

SEQ ID NO: 168216 - RNA, 19 nt, Homo sapiens
gaaagauuccccacaauug

SEQ ID NO: 168217 - RNA, 19 nt, Homo sapiens
gaaggaauggcaucgagau

SEQ ID NO: 168218 - RNA, 19 nt, Homo sapiens
uaauagauccacugaagau

SEQ ID NO: 168219 - RNA, 19 nt, Homo sapiens
gaggauguguuccagaaac

SEQ ID NO: 168220 - RNA, 19 nt, Homo sapiens
ucagggaucugggauaaag

SEQ ID NO: 168221 - RNA, 19 nt, Homo sapiens
cauguucacuaaugacuca

SEQ ID NO: 168222 - RNA, 19 nt, Homo sapiens
cagacauguucacuaauga

SEQ ID NO: 168223 - RNA, 19 nt, Homo sapiens
cugcaagacccucaagaua

SEQ ID NO: 168224 - RNA, 19 nt, Homo sapiens
aggaucgaaugcuuuauaa

SEQ ID NO: 168225 - RNA, 19 nt, Homo sapiens
ggcaaaagcuuguuggaau

SEQ ID NO: 168226 - RNA, 19 nt, Homo sapiens
cuaauacagucauugaaag

SEQ ID NO: 168227 - RNA, 19 nt, Homo sapiens
gaaucugaccuuacucuag

SEQ ID NO: 168228 - RNA, 19 nt, Homo sapiens
agaagggugugcugguaaa

SEQ ID NO: 168229 - RNA, 19 nt, Homo sapiens
ggcaauacccuaucucuac

SEQ ID NO: 168230 - RNA, 19 nt, Homo sapiens
acaaucugcuaguaucuau

SEQ ID NO: 168231 - RNA, 19 nt, Homo sapiens
agggugugcugguaaagua

SEQ ID NO: 168232 - RNA, 19 nt, Homo sapiens
ugagguaugagcaaaguuu

SEQ ID NO: 168233 - RNA, 19 nt, Homo sapiens
agucagggaucugggauaa

SEQ ID NO: 168234 - RNA, 19 nt, Homo sapiens
gaauuuagagagaacuuag

SEQ ID NO: 168235 - RNA, 19 nt, Homo sapiens
caacauaccucgacucauu

SEQ ID NO: 168236 - RNA, 19 nt, Homo sapiens
ggucagagcuguauuauuc

SEQ ID NO: 168237 - RNA, 19 nt, Homo sapiens
gauaaguugucgucuauua

SEQ ID NO: 168238 - RNA, 19 nt, Homo sapiens
ggauuuaccugugauaaua

SEQ ID NO: 168239 - RNA, 19 nt, Homo sapiens
gcagaacuuugccuacuua

SEQ ID NO: 168240 - RNA, 19 nt, Homo sapiens
gaaugaagcugaaguugau

SEQ ID NO: 168241 - RNA, 19 nt, Homo sapiens
ggaagugguuggugccuua

SEQ ID NO: 168242 - RNA, 19 nt, Homo sapiens
gaugaaugcugucuuugua

SEQ ID NO: 168243 - RNA, 19 nt, Homo sapiens
gaaggugacuuuccauuuc

SEQ ID NO: 168244 - RNA, 19 nt, Homo sapiens
gaucaacucuccuaaagau

SEQ ID NO: 168245 - RNA, 19 nt, Homo sapiens
ggagauugauggucuacua

SEQ ID NO: 168246 - RNA, 19 nt, Homo sapiens
gaugaugaaugcugucuuu

SEQ ID NO: 168247 - RNA, 19 nt, Homo sapiens
gcaaggaccucaccaccaa

SEQ ID NO: 168248 - RNA, 19 nt, Homo sapiens
gcacgugccuguuaucuca

SEQ ID NO: 168249 - RNA, 19 nt, Homo sapiens
gagcaaagccacugaggua

SEQ ID NO: 168250 - RNA, 19 nt, Homo sapiens
gucagaagcugccaccuua

SEQ ID NO: 168251 - RNA, 19 nt, Homo sapiens
gaacuuugccuacuuaugu

SEQ ID NO: 168252 - RNA, 19 nt, Homo sapiens
guucugagcuuacuggaaa

SEQ ID NO: 168253 - RNA, 19 nt, Homo sapiens
gaacagcugcuccagagua

SEQ ID NO: 168254 - RNA, 19 nt, Homo sapiens
aaacaacgacacaaucuua

SEQ ID NO: 168255 - RNA, 19 nt, Homo sapiens
gcagauucaugaagagaaa

SEQ ID NO: 168256 - RNA, 19 nt, Homo sapiens
gacccaaacuuccuauuga

SEQ ID NO: 168257 - RNA, 19 nt, Homo sapiens
cagagaaccugcagcauga

SEQ ID NO: 168258 - RNA, 19 nt, Homo sapiens
gaugauggcugaacuagag

SEQ ID NO: 168259 - RNA, 19 nt, Homo sapiens
ggagaacauucacaacuau

SEQ ID NO: 168260 - RNA, 19 nt, Homo sapiens
gcagucuccuauacaaaua

SEQ ID NO: 168261 - RNA, 19 nt, Homo sapiens
gacagaagaugccuccaaa

SEQ ID NO: 168262 - RNA, 19 nt, Homo sapiens
acacaaggcugcuucauca

SEQ ID NO: 168263 - RNA, 19 nt, Homo sapiens
gaauuuccaucaaagcauu

SEQ ID NO: 168264 - RNA, 19 nt, Homo sapiens
aaaggaagccggaauauug

SEQ ID NO: 168265 - RNA, 19 nt, Homo sapiens
gaacugaucaacucuccua

SEQ ID NO: 168266 - RNA, 19 nt, Homo sapiens
guuacaggcuucccaagua

SEQ ID NO: 168267 - RNA, 19 nt, Homo sapiens
caagaacagugaugaaauc

SEQ ID NO: 168268 - RNA, 19 nt, Homo sapiens
cagcuucugugcuuauaua

SEQ ID NO: 168269 - RNA, 19 nt, Homo sapiens
cauaaugucuuccugcuau

SEQ ID NO: 168270 - RNA, 19 nt, Homo sapiens
gcaaagcugcacaacauaa

SEQ ID NO: 168271 - RNA, 19 nt, Homo sapiens
guaguggacuccuguguug

SEQ ID NO: 168272 - RNA, 19 nt, Homo sapiens
ggaagauguucugagcuua

SEQ ID NO: 168273 - RNA, 19 nt, Homo sapiens
ccucugcacuuuacuauga

SEQ ID NO: 168274 - RNA, 19 nt, Homo sapiens
ggaaugaagcugaaguuga

SEQ ID NO: 168275 - RNA, 19 nt, Homo sapiens
ugacgaaguucaucuuaga

SEQ ID NO: 168276 - RNA, 19 nt, Homo sapiens
cauguguucucucauauuu

SEQ ID NO: 168277 - RNA, 19 nt, Homo sapiens
gacaugcacuuggugauaa

SEQ ID NO: 168278 - RNA, 19 nt, Homo sapiens
uuaguggccuggagucuua

SEQ ID NO: 168279 - RNA, 19 nt, Homo sapiens
gggaagauguucugagcuu

SEQ ID NO: 168280 - RNA, 19 nt, Homo sapiens
gaagggagaagucaucgaa

SEQ ID NO: 168281 - RNA, 19 nt, Homo sapiens
gaagaaacaacgacacaau

SEQ ID NO: 168282 - RNA, 19 nt, Homo sapiens
uaaagagcguucauucaug

SEQ ID NO: 168283 - RNA, 19 nt, Homo sapiens
cagaugcuuucgacaauuu

SEQ ID NO: 168284 - RNA, 19 nt, Homo sapiens
gagaagucaucgaaguauu

SEQ ID NO: 168285 - RNA, 19 nt, Homo sapiens
gagauuaagucccaaaauu

SEQ ID NO: 168286 - RNA, 19 nt, Homo sapiens
gaacacagccagccuuugg

SEQ ID NO: 168287 - RNA, 19 nt, Homo sapiens
ccaagaaauuguucauugu

SEQ ID NO: 168288 - RNA, 19 nt, Homo sapiens
cauaccaucuguaaugauu

SEQ ID NO: 168289 - RNA, 19 nt, Homo sapiens
gcaccaauacucagacaaa

SEQ ID NO: 168290 - RNA, 19 nt, Homo sapiens
gaucaaauagcuuuccaaa

SEQ ID NO: 168291 - RNA, 19 nt, Homo sapiens
gcauguauguuugaaguau

SEQ ID NO: 168292 - RNA, 19 nt, Homo sapiens
uggaagaucucucccagaa

SEQ ID NO: 168293 - RNA, 19 nt, Homo sapiens
guacauucucuguucauua

SEQ ID NO: 168294 - RNA, 19 nt, Homo sapiens
gggcauaccaucuguaaug

SEQ ID NO: 168295 - RNA, 19 nt, Homo sapiens
gagccaaccugagcgauga

SEQ ID NO: 168296 - RNA, 19 nt, Homo sapiens
ugaaguugauacugccuua

SEQ ID NO: 168297 - RNA, 19 nt, Homo sapiens
gcucaugcuuguaauccua

SEQ ID NO: 168298 - RNA, 19 nt, Homo sapiens
ggagauugcugguguuggu

SEQ ID NO: 168299 - RNA, 19 nt, Homo sapiens
caucaaagcauucccaguu

SEQ ID NO: 168300 - RNA, 19 nt, Homo sapiens
cccaagaaauuguucauug

SEQ ID NO: 168301 - RNA, 19 nt, Homo sapiens
gaaaagacaucauuguuac

SEQ ID NO: 168302 - RNA, 19 nt, Homo sapiens
uaagaaagcagcucucuag

SEQ ID NO: 168303 - RNA, 19 nt, Homo sapiens
gcacaagacauuggucaaa

SEQ ID NO: 168304 - RNA, 19 nt, Homo sapiens
caacauaacaagacccuau

SEQ ID NO: 168305 - RNA, 19 nt, Homo sapiens
gaagcaaccacuuuccaaa

SEQ ID NO: 168306 - RNA, 19 nt, Homo sapiens
gaacaaaggaagccggaau

SEQ ID NO: 168307 - RNA, 19 nt, Homo sapiens
ugaaugcugucuuuguaaa

SEQ ID NO: 168308 - RNA, 19 nt, Homo sapiens
gacagggugcuaagaaaua

SEQ ID NO: 168309 - RNA, 19 nt, Homo sapiens
agacaaagaaguacauuga

SEQ ID NO: 168310 - RNA, 19 nt, Homo sapiens
gaaagaacucagugaccua

SEQ ID NO: 168311 - RNA, 19 nt, Homo sapiens
caaaaugguuuccaaaaga

SEQ ID NO: 168312 - RNA, 19 nt, Homo sapiens
guucaggaguaccacauaa

SEQ ID NO: 168313 - RNA, 19 nt, Homo sapiens
uggagaacauucacaacua

SEQ ID NO: 168314 - RNA, 19 nt, Homo sapiens
guauuauucuccucuuuga

SEQ ID NO: 168315 - RNA, 19 nt, Homo sapiens
ucaugcagcugaucaguau

SEQ ID NO: 168316 - RNA, 19 nt, Homo sapiens
guacagaugcuuucgacaa

SEQ ID NO: 168317 - RNA, 19 nt, Homo sapiens
gaaagcauuuggugaaagc

SEQ ID NO: 168318 - RNA, 19 nt, Homo sapiens
gcacagcagaugagaguga

SEQ ID NO: 168319 - RNA, 19 nt, Homo sapiens
auacugaaaugcacacuga

SEQ ID NO: 168320 - RNA, 19 nt, Homo sapiens
ggauacacuugagguaauu

SEQ ID NO: 168321 - RNA, 19 nt, Homo sapiens
gagaucugcccaagaaauu

SEQ ID NO: 168322 - RNA, 19 nt, Homo sapiens
gaaaugcacacugaagcua

SEQ ID NO: 168323 - RNA, 19 nt, Homo sapiens
uccgagagcuggacauuga

SEQ ID NO: 168324 - RNA, 19 nt, Homo sapiens
gauauguguucauccauuc

SEQ ID NO: 168325 - RNA, 19 nt, Homo sapiens
gaaguaugggcgucucuuu

SEQ ID NO: 168326 - RNA, 19 nt, Homo sapiens
aaagagcguucauucaugu

SEQ ID NO: 168327 - RNA, 19 nt, Homo sapiens
cuacuagauuguccuauau

SEQ ID NO: 168328 - RNA, 19 nt, Homo sapiens
gccaguuggugauggauaa

SEQ ID NO: 168329 - RNA, 19 nt, Homo sapiens
guguuuagcugcugagaau

SEQ ID NO: 168330 - RNA, 19 nt, Homo sapiens
acauugaggucuucucuau

SEQ ID NO: 168331 - RNA, 19 nt, Homo sapiens
cuacauaauucccaugcuu

SEQ ID NO: 168332 - RNA, 19 nt, Homo sapiens
uugagaaguugccagaaua

SEQ ID NO: 168333 - RNA, 19 nt, Homo sapiens
aggcaaagcugcacaacau

SEQ ID NO: 168334 - RNA, 19 nt, Homo sapiens
aaagagagccugacagaag

SEQ ID NO: 168335 - RNA, 19 nt, Homo sapiens
ggaagugcaucuccuauua

SEQ ID NO: 168336 - RNA, 19 nt, Homo sapiens
gaacauaagucacuggaau

SEQ ID NO: 168337 - RNA, 19 nt, Homo sapiens
gaaguucagugucuuaaug

SEQ ID NO: 168338 - RNA, 19 nt, Homo sapiens
ggaagaagaucaugagaag

SEQ ID NO: 168339 - RNA, 19 nt, Homo sapiens
ggucagggcuggucuugaa

SEQ ID NO: 168340 - RNA, 19 nt, Homo sapiens
gcacacuccucaucaauuc

SEQ ID NO: 168341 - RNA, 19 nt, Homo sapiens
ugacagugaugaccaagua

SEQ ID NO: 168342 - RNA, 19 nt, Homo sapiens
ggacggauccucuccuuga

SEQ ID NO: 168343 - RNA, 19 nt, Homo sapiens
gaaucuggaugaugcuaaa

SEQ ID NO: 168344 - RNA, 19 nt, Homo sapiens
cccaaaguguugagauuua

SEQ ID NO: 168345 - RNA, 19 nt, Homo sapiens
gaucauggcucacuguaac

SEQ ID NO: 168346 - RNA, 19 nt, Homo sapiens
ggacaaacuuuccgauagg

SEQ ID NO: 168347 - RNA, 19 nt, Homo sapiens
caacugcccugaccuccuu

SEQ ID NO: 168348 - RNA, 19 nt, Homo sapiens
gaagugcaucuccuauuaa

SEQ ID NO: 168349 - RNA, 19 nt, Homo sapiens
gggacaaacuuuccgauag

SEQ ID NO: 168350 - RNA, 19 nt, Homo sapiens
ggagugcagugaugcgauu

SEQ ID NO: 168351 - RNA, 19 nt, Homo sapiens
gaucucagccucagcaaug

SEQ ID NO: 168352 - RNA, 19 nt, Homo sapiens
ggagagacccgaacauaag

SEQ ID NO: 168353 - RNA, 19 nt, Homo sapiens
auuaugaccuucuguguuu

SEQ ID NO: 168354 - RNA, 19 nt, Homo sapiens
aaagugggcuccucucugu

SEQ ID NO: 168355 - RNA, 19 nt, Homo sapiens
ggagccagaugcacagguu

SEQ ID NO: 168356 - RNA, 19 nt, Homo sapiens
ccagagcuauauuuccaaa

SEQ ID NO: 168357 - RNA, 19 nt, Homo sapiens
caugucagccucccaagua

SEQ ID NO: 168358 - RNA, 19 nt, Homo sapiens
gaaaggacucagaggaaga

SEQ ID NO: 168359 - RNA, 19 nt, Homo sapiens
uaauggagaagcucuguaa

SEQ ID NO: 168360 - RNA, 19 nt, Homo sapiens
ggccagagcuauauuucca

SEQ ID NO: 168361 - RNA, 19 nt, Homo sapiens
gcaacugccucccuguuac

SEQ ID NO: 168362 - RNA, 19 nt, Homo sapiens
gagcuucuccacugucuga

SEQ ID NO: 168363 - RNA, 19 nt, Homo sapiens
gcucuugugcucauguaua

SEQ ID NO: 168364 - RNA, 19 nt, Homo sapiens
ugaagggcauuucuuucuu

SEQ ID NO: 168365 - RNA, 19 nt, Homo sapiens
gggcucagaugaagcucuu

SEQ ID NO: 168366 - RNA, 19 nt, Homo sapiens
cacccaaaguguugagauu

SEQ ID NO: 168367 - RNA, 19 nt, Homo sapiens
gcucgauccucccauguca

SEQ ID NO: 168368 - RNA, 19 nt, Homo sapiens
cagaaaggacucagaggaa

SEQ ID NO: 168369 - RNA, 19 nt, Homo sapiens
gcucagcuauauuuucuuu

SEQ ID NO: 168370 - RNA, 19 nt, Homo sapiens
gcccuagccugaggauaaa

SEQ ID NO: 168371 - RNA, 19 nt, Homo sapiens
gaauugcugcgaagggauu

SEQ ID NO: 168372 - RNA, 19 nt, Homo sapiens
cuugugcucauguauauua

SEQ ID NO: 168373 - RNA, 19 nt, Homo sapiens
ccaaguaucaggcuaacau

SEQ ID NO: 168374 - RNA, 19 nt, Homo sapiens
ugagaaguucagugucuua

SEQ ID NO: 168375 - RNA, 19 nt, Homo sapiens
aagaagaucaugagaagga

SEQ ID NO: 168376 - RNA, 19 nt, Homo sapiens
gggaagaggaagaagauca

SEQ ID NO: 168377 - RNA, 19 nt, Homo sapiens
cuacugugcugaccagaag

SEQ ID NO: 168378 - RNA, 19 nt, Homo sapiens
ggaagaggguccccaaaag

SEQ ID NO: 168379 - RNA, 19 nt, Homo sapiens
cgauagggcucaguaggau

SEQ ID NO: 168380 - RNA, 19 nt, Homo sapiens
gagaaguucagugucuuaa

SEQ ID NO: 168381 - RNA, 19 nt, Homo sapiens
ccagugggcucagaugaag

SEQ ID NO: 168382 - RNA, 19 nt, Homo sapiens
gaacuccugagcucaagug

SEQ ID NO: 168383 - RNA, 19 nt, Homo sapiens
ucuuggagcugcccuggaa

SEQ ID NO: 168384 - RNA, 19 nt, Homo sapiens
aaauauacauacccugucu

SEQ ID NO: 168385 - RNA, 19 nt, Homo sapiens
cuccugagcucaagugauc

SEQ ID NO: 168386 - RNA, 19 nt, Homo sapiens
uuacuguguugccuuguga

SEQ ID NO: 168387 - RNA, 19 nt, Homo sapiens
ggaagaggaagaagaucau

SEQ ID NO: 168388 - RNA, 19 nt, Homo sapiens
cuauggcccuagaaccuaa

SEQ ID NO: 168389 - RNA, 19 nt, Homo sapiens
aaggagagacccgaacaua

SEQ ID NO: 168390 - RNA, 19 nt, Homo sapiens
gcuacagcuucuucacgaa

SEQ ID NO: 168391 - RNA, 19 nt, Homo sapiens
ccuggaaggaggaaacuuu

SEQ ID NO: 168392 - RNA, 19 nt, Homo sapiens
gaagaggguccccaaaaga

SEQ ID NO: 168393 - RNA, 19 nt, Homo sapiens
ccaaaguguugagauuuac

SEQ ID NO: 168394 - RNA, 19 nt, Homo sapiens
acacuaugcccagcuaauu

SEQ ID NO: 168395 - RNA, 19 nt, Homo sapiens
uguguugccuugugaagau

SEQ ID NO: 168396 - RNA, 19 nt, Homo sapiens
gcagauggaggaagugcau

SEQ ID NO: 168397 - RNA, 19 nt, Homo sapiens
gcuauggcccuagaaccua

SEQ ID NO: 168398 - RNA, 19 nt, Homo sapiens
ugaccaaguaucaggcuaa

SEQ ID NO: 168399 - RNA, 19 nt, Homo sapiens
ccagagacagcuccaaagu

SEQ ID NO: 168400 - RNA, 19 nt, Homo sapiens
ggcacacuccucaucaauu

SEQ ID NO: 168401 - RNA, 19 nt, Homo sapiens
agagcuauauuuccaaagg

SEQ ID NO: 168402 - RNA, 19 nt, Homo sapiens
acaccaggccagagcuaua

SEQ ID NO: 168403 - RNA, 19 nt, Homo sapiens
ggaaagugggcuccucucu

SEQ ID NO: 168404 - RNA, 19 nt, Homo sapiens
gagagacccgaacauaagu

SEQ ID NO: 168405 - RNA, 19 nt, Homo sapiens
aggagagacccgaacauaa

SEQ ID NO: 168406 - RNA, 19 nt, Homo sapiens
gaagaggaagaagaucaug

SEQ ID NO: 168407 - RNA, 19 nt, Homo sapiens
cacuaugcccagcuaauuu

SEQ ID NO: 168408 - RNA, 19 nt, Homo sapiens
caggcacacuccucaucaa

SEQ ID NO: 168409 - RNA, 19 nt, Homo sapiens
ccaggccagagcuauauuu

SEQ ID NO: 168410 - RNA, 19 nt, Homo sapiens
ugcaacugccucccuguua

SEQ ID NO: 168411 - RNA, 19 nt, Homo sapiens
cuccuucugugccaaauau

SEQ ID NO: 168412 - RNA, 19 nt, Homo sapiens
cggauccucuccuugacuu

SEQ ID NO: 168413 - RNA, 19 nt, Homo sapiens
ggagcugaaaccacuguug

SEQ ID NO: 168414 - RNA, 19 nt, Homo sapiens
gaaggagagacccgaacau

SEQ ID NO: 168415 - RNA, 19 nt, Homo sapiens
gaggguccccaaaagauua

SEQ ID NO: 168416 - RNA, 19 nt, Homo sapiens
gagcucaagugaucuuccu

SEQ ID NO: 168417 - RNA, 19 nt, Homo sapiens
ggaguugcccaaagcuauc

SEQ ID NO: 168418 - RNA, 19 nt, Homo sapiens
gaggaagaagaucaugaga

SEQ ID NO: 168419 - RNA, 19 nt, Homo sapiens
gaucaagccgacccagagu

SEQ ID NO: 168420 - RNA, 19 nt, Homo sapiens
agcccuagccugaggauaa

SEQ ID NO: 168421 - RNA, 19 nt, Homo sapiens
ccaccuccauggccuaugc

SEQ ID NO: 168422 - RNA, 19 nt, Homo sapiens
ccagaugcacagguucuaa

SEQ ID NO: 168423 - RNA, 19 nt, Homo sapiens
guaucaggcuaacaucacu

SEQ ID NO: 168424 - RNA, 19 nt, Homo sapiens
ccagauggacuugcugugu

SEQ ID NO: 168425 - RNA, 19 nt, Homo sapiens
gcuaaaggucuggcugaga

SEQ ID NO: 168426 - RNA, 19 nt, Homo sapiens
cgaaucuggaugaugcuaa

SEQ ID NO: 168427 - RNA, 19 nt, Homo sapiens
cagccugucauggcaguua

SEQ ID NO: 168428 - RNA, 19 nt, Homo sapiens
ccgaggagagcuuguaaca

SEQ ID NO: 168429 - RNA, 19 nt, Homo sapiens
cuccagacccugaagaaga

SEQ ID NO: 168430 - RNA, 19 nt, Homo sapiens
guuacuguguugccuugug

SEQ ID NO: 168431 - RNA, 19 nt, Homo sapiens
aagcucuugugcucaugua

SEQ ID NO: 168432 - RNA, 19 nt, Homo sapiens
gcacccaaaguguugagau

SEQ ID NO: 168433 - RNA, 19 nt, Homo sapiens
gaagguauugcucugucau

SEQ ID NO: 168434 - RNA, 19 nt, Homo sapiens
agaagguauugcucuguca

SEQ ID NO: 168435 - RNA, 19 nt, Homo sapiens
gaagaaagcucagaggaaa

SEQ ID NO: 168436 - RNA, 19 nt, Homo sapiens
ggauacaggugucaaauaa

SEQ ID NO: 168437 - RNA, 19 nt, Homo sapiens
ggacaaagacggcugguua

SEQ ID NO: 168438 - RNA, 19 nt, Homo sapiens
caacaaagcugaacucucu

SEQ ID NO: 168439 - RNA, 19 nt, Homo sapiens
gaacaaggaugcuuugcuu

SEQ ID NO: 168440 - RNA, 19 nt, Homo sapiens
gaggaacugugcagaaaua

SEQ ID NO: 168441 - RNA, 19 nt, Homo sapiens
gcaaaugggugcugcauca

SEQ ID NO: 168442 - RNA, 19 nt, Homo sapiens
gaaaugaagccaucacgua

SEQ ID NO: 168443 - RNA, 19 nt, Homo sapiens
gaaggauucuggucugaaa

SEQ ID NO: 168444 - RNA, 19 nt, Homo sapiens
ccugauaacugucuacuuu

SEQ ID NO: 168445 - RNA, 19 nt, Homo sapiens
gaagauauggugagacuug

SEQ ID NO: 168446 - RNA, 19 nt, Homo sapiens
gcugaacucucucugguuu

SEQ ID NO: 168447 - RNA, 19 nt, Homo sapiens
gaaggccaaacucuuauua

SEQ ID NO: 168448 - RNA, 19 nt, Homo sapiens
ggccagagcugcggaacua

SEQ ID NO: 168449 - RNA, 19 nt, Homo sapiens
gagcauaagguuuccagua

SEQ ID NO: 168450 - RNA, 19 nt, Homo sapiens
uaaacagguugcagaauug

SEQ ID NO: 168451 - RNA, 19 nt, Homo sapiens
caaauaauggcccuuguuu

SEQ ID NO: 168452 - RNA, 19 nt, Homo sapiens
auaaacagguugcagaauu

SEQ ID NO: 168453 - RNA, 19 nt, Homo sapiens
gaaacagaacacugccuua

SEQ ID NO: 168454 - RNA, 19 nt, Homo sapiens
caaggaugcuuugcuuauu

SEQ ID NO: 168455 - RNA, 19 nt, Homo sapiens
uuacgaaacucauguucuu

SEQ ID NO: 168456 - RNA, 19 nt, Homo sapiens
gcacgaagauccgcacuac

SEQ ID NO: 168457 - RNA, 19 nt, Homo sapiens
ugagagaguuguagagugu

SEQ ID NO: 168458 - RNA, 19 nt, Homo sapiens
gcugauggccuucauguug

SEQ ID NO: 168459 - RNA, 19 nt, Homo sapiens
ggucaaaggcaucacauug

SEQ ID NO: 168460 - RNA, 19 nt, Homo sapiens
ggugaucguuccacuuuau

SEQ ID NO: 168461 - RNA, 19 nt, Homo sapiens
gaagacaagcauuucaaga

SEQ ID NO: 168462 - RNA, 19 nt, Homo sapiens
gcagcggcaucaucagaaa

SEQ ID NO: 168463 - RNA, 19 nt, Homo sapiens
gaagaucuugcaguaauuu

SEQ ID NO: 168464 - RNA, 19 nt, Homo sapiens
gaaccacucacucugugua

SEQ ID NO: 168465 - RNA, 19 nt, Homo sapiens
cagaggaaauggcacaguu

SEQ ID NO: 168466 - RNA, 19 nt, Homo sapiens
caacagagaauacagucaa

SEQ ID NO: 168467 - RNA, 19 nt, Homo sapiens
gaaaccagaccaacccuau

SEQ ID NO: 168468 - RNA, 19 nt, Homo sapiens
ucacguacauagucaacaa

SEQ ID NO: 168469 - RNA, 19 nt, Homo sapiens
auacaggugucaaauaaug

SEQ ID NO: 168470 - RNA, 19 nt, Homo sapiens
auacgaagguuuccagaga

SEQ ID NO: 168471 - RNA, 19 nt, Homo sapiens
agcauaagguuuccaguaa

SEQ ID NO: 168472 - RNA, 19 nt, Homo sapiens
ucaucaagguuuaguguga

SEQ ID NO: 168473 - RNA, 19 nt, Homo sapiens
ggacaaugcaagcccauga

SEQ ID NO: 168474 - RNA, 19 nt, Homo sapiens
gccuucauguuguuaauuu

SEQ ID NO: 168475 - RNA, 19 nt, Homo sapiens
aaagacggcugguuacaca

SEQ ID NO: 168476 - RNA, 19 nt, Homo sapiens
ugaaagggccaaauguauu

SEQ ID NO: 168477 - RNA, 19 nt, Homo sapiens
gaaacauagugagcgauug

SEQ ID NO: 168478 - RNA, 19 nt, Homo sapiens
gaacugugcagaaauaagg

SEQ ID NO: 168479 - RNA, 19 nt, Homo sapiens
gaaaacagcagaagcuuug

SEQ ID NO: 168480 - RNA, 19 nt, Homo sapiens
gaggaaagaagcagacguu

SEQ ID NO: 168481 - RNA, 19 nt, Homo sapiens
gggauacaggugucaaaua

SEQ ID NO: 168482 - RNA, 19 nt, Homo sapiens
gggcagauccaacucagaa

SEQ ID NO: 168483 - RNA, 19 nt, Homo sapiens
gcacaaggagaauacauag

SEQ ID NO: 168484 - RNA, 19 nt, Homo sapiens
gagaauacagucaauccuu

SEQ ID NO: 168485 - RNA, 19 nt, Homo sapiens
cugaagaucuugcaguaau

SEQ ID NO: 168486 - RNA, 19 nt, Homo sapiens
ucaguucauuggcaucuuu

SEQ ID NO: 168487 - RNA, 19 nt, Homo sapiens
gaagauccgcacuacuuga

SEQ ID NO: 168488 - RNA, 19 nt, Homo sapiens
cacauugcacccugaauua

SEQ ID NO: 168489 - RNA, 19 nt, Homo sapiens
gaauggcuuucauauaaac

SEQ ID NO: 168490 - RNA, 19 nt, Homo sapiens
uuagagaacuaucaacaca

SEQ ID NO: 168491 - RNA, 19 nt, Homo sapiens
gcuaauuauuugagacuuc

SEQ ID NO: 168492 - RNA, 19 nt, Homo sapiens
gguaauacacacuuccaaa

SEQ ID NO: 168493 - RNA, 19 nt, Homo sapiens
ugaagaucuugcaguaauu

SEQ ID NO: 168494 - RNA, 19 nt, Homo sapiens
ggaggagaaucagcuuaga

SEQ ID NO: 168495 - RNA, 19 nt, Homo sapiens
gcgacgagcccuuggugua

SEQ ID NO: 168496 - RNA, 19 nt, Homo sapiens
gagacuuccucaguuuaaa

SEQ ID NO: 168497 - RNA, 19 nt, Homo sapiens
gguuuagugugaagaagaa

SEQ ID NO: 168498 - RNA, 19 nt, Homo sapiens
gaaucagcuuagagaacua

SEQ ID NO: 168499 - RNA, 19 nt, Homo sapiens
gcaaggcauuucuuuuaaa

SEQ ID NO: 168500 - RNA, 19 nt, Homo sapiens
gcauaagguuuccaguaag

SEQ ID NO: 168501 - RNA, 19 nt, Homo sapiens
ucacauugcacccugaauu

SEQ ID NO: 168502 - RNA, 19 nt, Homo sapiens
gcagaaauaaggaugucaa

SEQ ID NO: 168503 - RNA, 19 nt, Homo sapiens
gugaaagggccaaauguau

SEQ ID NO: 168504 - RNA, 19 nt, Homo sapiens
gcaguuggaagaaaugaau

SEQ ID NO: 168505 - RNA, 19 nt, Homo sapiens
cggcugaucuuccacaaag

SEQ ID NO: 168506 - RNA, 19 nt, Homo sapiens
cugagugggugauuauuga

SEQ ID NO: 168507 - RNA, 19 nt, Homo sapiens
gaacgcguggauucucuuu

SEQ ID NO: 168508 - RNA, 19 nt, Homo sapiens
caucagaacgcguggauuc

SEQ ID NO: 168509 - RNA, 19 nt, Homo sapiens
ucaaaggcaucacauugca

SEQ ID NO: 168510 - RNA, 19 nt, Homo sapiens
gaacaggucaaaggcauca

SEQ ID NO: 168511 - RNA, 19 nt, Homo sapiens
aauggcaccuugaaaauua

SEQ ID NO: 168512 - RNA, 19 nt, Homo sapiens
gcugaucuuccacaaagua

SEQ ID NO: 168513 - RNA, 19 nt, Homo sapiens
gaaagcaacagagaauaca

SEQ ID NO: 168514 - RNA, 19 nt, Homo sapiens
caugagcuguuccgguauu

SEQ ID NO: 168515 - RNA, 19 nt, Homo sapiens
aaauaauggcccuuguuua

SEQ ID NO: 168516 - RNA, 19 nt, Homo sapiens
gaaagaguuaccuggauca

SEQ ID NO: 168517 - RNA, 19 nt, Homo sapiens
auaaggagccucuggcaaa

SEQ ID NO: 168518 - RNA, 19 nt, Homo sapiens
gguaccagauguugagaca

SEQ ID NO: 168519 - RNA, 19 nt, Homo sapiens
gcaauugugguaccagaug

SEQ ID NO: 168520 - RNA, 19 nt, Homo sapiens
gacgagcccuugguguauu

SEQ ID NO: 168521 - RNA, 19 nt, Homo sapiens
ggcacaaggagaauacaua

SEQ ID NO: 168522 - RNA, 19 nt, Homo sapiens
ggaagaaaugaauuacaug

SEQ ID NO: 168523 - RNA, 19 nt, Homo sapiens
ccagacgacucaccaccuu

SEQ ID NO: 168524 - RNA, 19 nt, Homo sapiens
aauaauggcccuuguuuag

SEQ ID NO: 168525 - RNA, 19 nt, Homo sapiens
gggaaggauucuggucuga

SEQ ID NO: 168526 - RNA, 19 nt, Homo sapiens
agaccugagugggugauua

SEQ ID NO: 168527 - RNA, 19 nt, Homo sapiens
uaaggagccucuggcaaau

SEQ ID NO: 168528 - RNA, 19 nt, Homo sapiens
cugcaggcauuucucauug

SEQ ID NO: 168529 - RNA, 19 nt, Homo sapiens
ccgaugccgugcaauuuga

SEQ ID NO: 168530 - RNA, 19 nt, Homo sapiens
gaucuugcaguaauuuguu

SEQ ID NO: 168531 - RNA, 19 nt, Homo sapiens
aggccaaacucuuauuaga

SEQ ID NO: 168532 - RNA, 19 nt, Homo sapiens
aagaucauguugggauuaa

SEQ ID NO: 168533 - RNA, 19 nt, Homo sapiens
aagacaagcauuucaagaa

SEQ ID NO: 168534 - RNA, 19 nt, Homo sapiens
ucagaaccaugcagauaag

SEQ ID NO: 168535 - RNA, 19 nt, Homo sapiens
gaauacaggugucaaauaa

SEQ ID NO: 168536 - RNA, 19 nt, Homo sapiens
gaagaaagcucagaggaaa

SEQ ID NO: 168537 - RNA, 19 nt, Homo sapiens
ggacaaagacggcugguua

SEQ ID NO: 168538 - RNA, 19 nt, Homo sapiens
gaauugagcugucauuugu

SEQ ID NO: 168539 - RNA, 19 nt, Homo sapiens
caacaaagcugaacucucu

SEQ ID NO: 168540 - RNA, 19 nt, Homo sapiens
caacagggcuugcacuaaa

SEQ ID NO: 168541 - RNA, 19 nt, Homo sapiens
gaacaaggaugcuuugcuu

SEQ ID NO: 168542 - RNA, 19 nt, Homo sapiens
guagaaaucuggaaaguuc

SEQ ID NO: 168543 - RNA, 19 nt, Homo sapiens
gaggaacugugcagaaaua

SEQ ID NO: 168544 - RNA, 19 nt, Homo sapiens
gaaaugaagccaucacgua

SEQ ID NO: 168545 - RNA, 19 nt, Homo sapiens
gaaggauucuggucugaaa

SEQ ID NO: 168546 - RNA, 19 nt, Homo sapiens
cugaauaacugucuacuuu

SEQ ID NO: 168547 - RNA, 19 nt, Homo sapiens
uaacagcaguucacuuuau

SEQ ID NO: 168548 - RNA, 19 nt, Homo sapiens
gaacaccgccuuacaguca

SEQ ID NO: 168549 - RNA, 19 nt, Homo sapiens
ggaauacaggugucaaaua

SEQ ID NO: 168550 - RNA, 19 nt, Homo sapiens
gaagauauggugagacuug

SEQ ID NO: 168551 - RNA, 19 nt, Homo sapiens
guaauaacacuacuuggua

SEQ ID NO: 168552 - RNA, 19 nt, Homo sapiens
gcugaacucucucugguuu

SEQ ID NO: 168553 - RNA, 19 nt, Homo sapiens
gaacccuucugauucguaa

SEQ ID NO: 168554 - RNA, 19 nt, Homo sapiens
gaaggccaaacucuuauua

SEQ ID NO: 168555 - RNA, 19 nt, Homo sapiens
gcugucauuuguacauuua

SEQ ID NO: 168556 - RNA, 19 nt, Homo sapiens
ggccagagcugcggaacua

SEQ ID NO: 168557 - RNA, 19 nt, Homo sapiens
gagcauaagguuuccagua

SEQ ID NO: 168558 - RNA, 19 nt, Homo sapiens
uaaacagguugcagaauug

SEQ ID NO: 168559 - RNA, 19 nt, Homo sapiens
caaauaauggcccuuguuu

SEQ ID NO: 168560 - RNA, 19 nt, Homo sapiens
auaaacagguugcagaauu

SEQ ID NO: 168561 - RNA, 19 nt, Homo sapiens
gcaaaugggugcucaucag

SEQ ID NO: 168562 - RNA, 19 nt, Homo sapiens
caaggaugcuuugcuuauu

SEQ ID NO: 168563 - RNA, 19 nt, Homo sapiens
uuacgaaacucauguucuu

SEQ ID NO: 168564 - RNA, 19 nt, Homo sapiens
gcacgaagauccgcacuac

SEQ ID NO: 168565 - RNA, 19 nt, Homo sapiens
gaugaccucuauuccacua

SEQ ID NO: 168566 - RNA, 19 nt, Homo sapiens
ugagagaguuguagagugu

SEQ ID NO: 168567 - RNA, 19 nt, Homo sapiens
uagccuaacuucauauaug

SEQ ID NO: 168568 - RNA, 19 nt, Homo sapiens
gaaacagaacaccgccuua

SEQ ID NO: 168569 - RNA, 19 nt, Homo sapiens
gcugauggccuucauguug

SEQ ID NO: 168570 - RNA, 19 nt, Homo sapiens
ggucaaaggcaucacauug

SEQ ID NO: 168571 - RNA, 19 nt, Homo sapiens
ggugaucguuccacuuuau

SEQ ID NO: 168572 - RNA, 19 nt, Homo sapiens
gaagacaagcauuucaaga

SEQ ID NO: 168573 - RNA, 19 nt, Homo sapiens
gcagcggcaucaucagaaa

SEQ ID NO: 168574 - RNA, 19 nt, Homo sapiens
gaagaucuugcaguaauuu

SEQ ID NO: 168575 - RNA, 19 nt, Homo sapiens
gaaccacucacucugugua

SEQ ID NO: 168576 - RNA, 19 nt, Homo sapiens
cagaggaaauggcacaguu

SEQ ID NO: 168577 - RNA, 19 nt, Homo sapiens
caacagagaauacagucaa

SEQ ID NO: 168578 - RNA, 19 nt, Homo sapiens
gaaaccagaccaacccuau

SEQ ID NO: 168579 - RNA, 19 nt, Homo sapiens
ggacaguaauaagcaaaug

SEQ ID NO: 168580 - RNA, 19 nt, Homo sapiens
ucacguacauagucaacaa

SEQ ID NO: 168581 - RNA, 19 nt, Homo sapiens
auacaggugucaaauaaug

SEQ ID NO: 168582 - RNA, 19 nt, Homo sapiens
agcauaagguuuccaguaa

SEQ ID NO: 168583 - RNA, 19 nt, Homo sapiens
ggacaaugcaagcccauga

SEQ ID NO: 168584 - RNA, 19 nt, Homo sapiens
guaauacacacuuuccaaa

SEQ ID NO: 168585 - RNA, 19 nt, Homo sapiens
gccuucauguuguuaauuu

SEQ ID NO: 168586 - RNA, 19 nt, Homo sapiens
aaagacggcugguuacaca

SEQ ID NO: 168587 - RNA, 19 nt, Homo sapiens
ugaaagggccaaauguauu

SEQ ID NO: 168588 - RNA, 19 nt, Homo sapiens
gaaacauagugagcgauug

SEQ ID NO: 168589 - RNA, 19 nt, Homo sapiens
ugugagaguacauguauua

SEQ ID NO: 168590 - RNA, 19 nt, Homo sapiens
gaacugugcagaaauaagg

SEQ ID NO: 168591 - RNA, 19 nt, Homo sapiens
gaaaacagcagaagcuuug

SEQ ID NO: 168592 - RNA, 19 nt, Homo sapiens
gaaauggacaguaauaagc

SEQ ID NO: 168593 - RNA, 19 nt, Homo sapiens
gaagauccgcacuacuuga

SEQ ID NO: 168594 - RNA, 19 nt, Homo sapiens
gcaagcauuucuuuaaagc

SEQ ID NO: 168595 - RNA, 19 nt, Homo sapiens
gggcagauccaacucagaa

SEQ ID NO: 168596 - RNA, 19 nt, Homo sapiens
gcacaaggagaauacauag

SEQ ID NO: 168597 - RNA, 19 nt, Homo sapiens
gagaauacagucaauccuu

SEQ ID NO: 168598 - RNA, 19 nt, Homo sapiens
cugaagaucuugcaguaau

SEQ ID NO: 168599 - RNA, 19 nt, Homo sapiens
ucaguucauuggcaucuuu

SEQ ID NO: 168600 - RNA, 19 nt, Homo sapiens
gcaaauguucuuauaaugc

SEQ ID NO: 168601 - RNA, 19 nt, Homo sapiens
cuaucaagguuuaguguga

SEQ ID NO: 168602 - RNA, 19 nt, Homo sapiens
cacauugcacccugaauua

SEQ ID NO: 168603 - RNA, 19 nt, Homo sapiens
aaucauaguugucauggau

SEQ ID NO: 168604 - RNA, 19 nt, Homo sapiens
gaauggcuuucauauaaac

SEQ ID NO: 168605 - RNA, 19 nt, Homo sapiens
gugagucuuugccacauuu

SEQ ID NO: 168606 - RNA, 19 nt, Homo sapiens
caggcaagcauuucuuuaa

SEQ ID NO: 168607 - RNA, 19 nt, Homo sapiens
gcgacgagcccuuggugua

SEQ ID NO: 168608 - RNA, 19 nt, Homo sapiens
ugaagaucuugcaguaauu

SEQ ID NO: 168609 - RNA, 19 nt, Homo sapiens
aaugcuaccugauuucuau

SEQ ID NO: 168610 - RNA, 19 nt, Homo sapiens
aggcaagcauuucuuuaaa

SEQ ID NO: 168611 - RNA, 19 nt, Homo sapiens
gagacuuccucaguuuaaa

SEQ ID NO: 168612 - RNA, 19 nt, Homo sapiens
gguuuagugugaagaagaa

SEQ ID NO: 168613 - RNA, 19 nt, Homo sapiens
gagcugucauuuguacauu

SEQ ID NO: 168614 - RNA, 19 nt, Homo sapiens
gaaauuaacagcaguucac

SEQ ID NO: 168615 - RNA, 19 nt, Homo sapiens
gcuauuaagggaguauaua

SEQ ID NO: 168616 - RNA, 19 nt, Homo sapiens
gcauaagguuuccaguaag

SEQ ID NO: 168617 - RNA, 19 nt, Homo sapiens
ucacauugcacccugaauu

SEQ ID NO: 168618 - RNA, 19 nt, Homo sapiens
gcagaaauaaggaugucaa

SEQ ID NO: 168619 - RNA, 19 nt, Homo sapiens
gugaaagggccaaauguau

SEQ ID NO: 168620 - RNA, 19 nt, Homo sapiens
cggcugaucuuccacaaag

SEQ ID NO: 168621 - RNA, 19 nt, Homo sapiens
cugagugggugauuauuga

SEQ ID NO: 168622 - RNA, 19 nt, Homo sapiens
caugagcuguuccgguauu

SEQ ID NO: 168623 - RNA, 19 nt, Homo sapiens
gaacgcguggauucucuuu

SEQ ID NO: 168624 - RNA, 19 nt, Homo sapiens
caucagaacgcguggauuc

SEQ ID NO: 168625 - RNA, 19 nt, Homo sapiens
ucaaaggcaucacauugca

SEQ ID NO: 168626 - RNA, 19 nt, Homo sapiens
gaacaggucaaaggcauca

SEQ ID NO: 168627 - RNA, 19 nt, Homo sapiens
aauggcaccuugaaaauua

SEQ ID NO: 168628 - RNA, 19 nt, Homo sapiens
gcugaucuuccacaaagua

SEQ ID NO: 168629 - RNA, 19 nt, Homo sapiens
gaaagcaacagagaauaca

SEQ ID NO: 168630 - RNA, 19 nt, Homo sapiens
aaauaauggcccuuguuua

SEQ ID NO: 168631 - RNA, 19 nt, Homo sapiens
ggcaagcauuucuuuaaag

SEQ ID NO: 168632 - RNA, 19 nt, Homo sapiens
gaaagaguuaccuggauca

SEQ ID NO: 168633 - RNA, 19 nt, Homo sapiens
auaaggagccucuggcaaa

SEQ ID NO: 168634 - RNA, 19 nt, Homo sapiens
gguaccagauguugagaca

SEQ ID NO: 168635 - RNA, 19 nt, Homo sapiens
ggaaacagcuguaacauuu

SEQ ID NO: 168636 - RNA, 19 nt, Homo sapiens
gaagguggauacuuuaaua

SEQ ID NO: 168637 - RNA, 19 nt, Homo sapiens
ggacaaagguggcucugua

SEQ ID NO: 168638 - RNA, 19 nt, Homo sapiens
ggaggaagguggauacuuu

SEQ ID NO: 168639 - RNA, 19 nt, Homo sapiens
gauggaugcuuaaagauua

SEQ ID NO: 168640 - RNA, 19 nt, Homo sapiens
ggaaauggauuacagaugu

SEQ ID NO: 168641 - RNA, 19 nt, Homo sapiens
caaacaaaguugaaggaua

SEQ ID NO: 168642 - RNA, 19 nt, Homo sapiens
ugaacuagcucgaaagaaa

SEQ ID NO: 168643 - RNA, 19 nt, Homo sapiens
guugagaucuugugaauau

SEQ ID NO: 168644 - RNA, 19 nt, Homo sapiens
gcaaagagcuuaaaacaca

SEQ ID NO: 168645 - RNA, 19 nt, Homo sapiens
gucaugaucucacauagua

SEQ ID NO: 168646 - RNA, 19 nt, Homo sapiens
caagagaggguuauaguuu

SEQ ID NO: 168647 - RNA, 19 nt, Homo sapiens
caacuuacuuuaccaccua

SEQ ID NO: 168648 - RNA, 19 nt, Homo sapiens
uaacugaacuagcucgaaa

SEQ ID NO: 168649 - RNA, 19 nt, Homo sapiens
auaauuggcuuuccuauga

SEQ ID NO: 168650 - RNA, 19 nt, Homo sapiens
gaugauagcauucucacua

SEQ ID NO: 168651 - RNA, 19 nt, Homo sapiens
aaaccuugcuugugugaua

SEQ ID NO: 168652 - RNA, 19 nt, Homo sapiens
cauaguaagucucuucauu

SEQ ID NO: 168653 - RNA, 19 nt, Homo sapiens
ucagaaaccuugcuugugu

SEQ ID NO: 168654 - RNA, 19 nt, Homo sapiens
gaaagagaggauagaauuu

SEQ ID NO: 168655 - RNA, 19 nt, Homo sapiens
gcaaacaguuaucauucuu

SEQ ID NO: 168656 - RNA, 19 nt, Homo sapiens
aaacagaggugaccaacau

SEQ ID NO: 168657 - RNA, 19 nt, Homo sapiens
gauaauuggucucuaguag

SEQ ID NO: 168658 - RNA, 19 nt, Homo sapiens
aaaccaaccucauagcaaa

SEQ ID NO: 168659 - RNA, 19 nt, Homo sapiens
ugguuuggcuucaguauua

SEQ ID NO: 168660 - RNA, 19 nt, Homo sapiens
aagagaggguuauaguuua

SEQ ID NO: 168661 - RNA, 19 nt, Homo sapiens
gaaauggauuacagauguu

SEQ ID NO: 168662 - RNA, 19 nt, Homo sapiens
caauuaagaugugcucaaa

SEQ ID NO: 168663 - RNA, 19 nt, Homo sapiens
gcucaaaucaggacuuaaa

SEQ ID NO: 168664 - RNA, 19 nt, Homo sapiens
ggaacuaacugaacuagcu

SEQ ID NO: 168665 - RNA, 19 nt, Homo sapiens
gaucucacauaguaacauu

SEQ ID NO: 168666 - RNA, 19 nt, Homo sapiens
ugaggaagaugaaguacaa

SEQ ID NO: 168667 - RNA, 19 nt, Homo sapiens
gagcucacaucaaauagga

SEQ ID NO: 168668 - RNA, 19 nt, Homo sapiens
gaauaaagucagugaaaug

SEQ ID NO: 168669 - RNA, 19 nt, Homo sapiens
ccgcgugaguuaagauuua

SEQ ID NO: 168670 - RNA, 19 nt, Homo sapiens
ugaaagagaggauagaauu

SEQ ID NO: 168671 - RNA, 19 nt, Homo sapiens
aagcaaagccuguaaauuc

SEQ ID NO: 168672 - RNA, 19 nt, Homo sapiens
uaacugacaggauuaguaa

SEQ ID NO: 168673 - RNA, 19 nt, Homo sapiens
caaacuccauuccucauau

SEQ ID NO: 168674 - RNA, 19 nt, Homo sapiens
uaacaguugugaaauggaa

SEQ ID NO: 168675 - RNA, 19 nt, Homo sapiens
gaggugaccaacaucauua

SEQ ID NO: 168676 - RNA, 19 nt, Homo sapiens
gcaauagugcaccaauuaa

SEQ ID NO: 168677 - RNA, 19 nt, Homo sapiens
gucagugucuucuuuauau

SEQ ID NO: 168678 - RNA, 19 nt, Homo sapiens
gauacgggcucacugaauc

SEQ ID NO: 168679 - RNA, 19 nt, Homo sapiens
caacguaaucuguuuauuc

SEQ ID NO: 168680 - RNA, 19 nt, Homo sapiens
gugagucagugguagcuua

SEQ ID NO: 168681 - RNA, 19 nt, Homo sapiens
ggaagaauucugaaagaga

SEQ ID NO: 168682 - RNA, 19 nt, Homo sapiens
gcaaacuccauuccucaua

SEQ ID NO: 168683 - RNA, 19 nt, Homo sapiens
ggaagauucucgcugaagu

SEQ ID NO: 168684 - RNA, 19 nt, Homo sapiens
guggauacuuuaauacuga

SEQ ID NO: 168685 - RNA, 19 nt, Homo sapiens
caacaucgccaucuucugu

SEQ ID NO: 168686 - RNA, 19 nt, Homo sapiens
caaagccuguaaauucaaa

SEQ ID NO: 168687 - RNA, 19 nt, Homo sapiens
caaaucaggacuuaaauca

SEQ ID NO: 168688 - RNA, 19 nt, Homo sapiens
ucagugaaaugaguaguuu

SEQ ID NO: 168689 - RNA, 19 nt, Homo sapiens
gaaguacaaccaaauggaa

SEQ ID NO: 168690 - RNA, 19 nt, Homo sapiens
cauaaccuuuguacacuaa

SEQ ID NO: 168691 - RNA, 19 nt, Homo sapiens
agaaaggauuccagaacua

SEQ ID NO: 168692 - RNA, 19 nt, Homo sapiens
cugcuugccuguuguuaua

SEQ ID NO: 168693 - RNA, 19 nt, Homo sapiens
gagcgaauguauggaagaa

SEQ ID NO: 168694 - RNA, 19 nt, Homo sapiens
gcugaagucuguuaauucu

SEQ ID NO: 168695 - RNA, 19 nt, Homo sapiens
gugcugagcuugucugucu

SEQ ID NO: 168696 - RNA, 19 nt, Homo sapiens
gggaacacgugaaguuuua

SEQ ID NO: 168697 - RNA, 19 nt, Homo sapiens
caucaacccuauucuuuua

SEQ ID NO: 168698 - RNA, 19 nt, Homo sapiens
cuaagacacaugagaauuu

SEQ ID NO: 168699 - RNA, 19 nt, Homo sapiens
uagcaccaguugauaauug

SEQ ID NO: 168700 - RNA, 19 nt, Homo sapiens
ugaacccgauggaugcuua

SEQ ID NO: 168701 - RNA, 19 nt, Homo sapiens
uaaagucagugaaaugagu

SEQ ID NO: 168702 - RNA, 19 nt, Homo sapiens
uaacugggauggcagaaag

SEQ ID NO: 168703 - RNA, 19 nt, Homo sapiens
guaaucauguacacaagug

SEQ ID NO: 168704 - RNA, 19 nt, Homo sapiens
gcaguaaucauguacacaa

SEQ ID NO: 168705 - RNA, 19 nt, Homo sapiens
gugcucaaaucaggacuua

SEQ ID NO: 168706 - RNA, 19 nt, Homo sapiens
agagaggguuauaguuuaa

SEQ ID NO: 168707 - RNA, 19 nt, Homo sapiens
ggagucaugaucucacaua

SEQ ID NO: 168708 - RNA, 19 nt, Homo sapiens
guuaauaguuuggaugguu

SEQ ID NO: 168709 - RNA, 19 nt, Homo sapiens
gauaacauuugugcauaug

SEQ ID NO: 168710 - RNA, 19 nt, Homo sapiens
gaggaagguggauacuuua

SEQ ID NO: 168711 - RNA, 19 nt, Homo sapiens
ggcccauguucuagaauua

SEQ ID NO: 168712 - RNA, 19 nt, Homo sapiens
caaaccgaauuaaagcaaa

SEQ ID NO: 168713 - RNA, 19 nt, Homo sapiens
gcaagagaggguuauaguu

SEQ ID NO: 168714 - RNA, 19 nt, Homo sapiens
uagcagaucagucuucaaa

SEQ ID NO: 168715 - RNA, 19 nt, Homo sapiens
gcccucagauauugcagua

SEQ ID NO: 168716 - RNA, 19 nt, Homo sapiens
aaagauuuguugcugugua

SEQ ID NO: 168717 - RNA, 19 nt, Homo sapiens
acaaggguauugauaugaa

SEQ ID NO: 168718 - RNA, 19 nt, Homo sapiens
caucuaccaugaagcuaaa

SEQ ID NO: 168719 - RNA, 19 nt, Homo sapiens
agaauuaagugcugagcuu

SEQ ID NO: 168720 - RNA, 19 nt, Homo sapiens
ugaccaacaucauuacuag

SEQ ID NO: 168721 - RNA, 19 nt, Homo sapiens
gcacaggcguguuuuaugu

SEQ ID NO: 168722 - RNA, 19 nt, Homo sapiens
gaagaugaaguacaaccaa

SEQ ID NO: 168723 - RNA, 19 nt, Homo sapiens
caaggguauugauaugaaa

SEQ ID NO: 168724 - RNA, 19 nt, Homo sapiens
gggaaacagcuguaacauu

SEQ ID NO: 168725 - RNA, 19 nt, Homo sapiens
gaagugugggacuacaaua

SEQ ID NO: 168726 - RNA, 19 nt, Homo sapiens
gagcuugucugucuuucuc

SEQ ID NO: 168727 - RNA, 19 nt, Homo sapiens
ccucagauauugcaguaau

SEQ ID NO: 168728 - RNA, 19 nt, Homo sapiens
aaucauaggcaccacauuu

SEQ ID NO: 168729 - RNA, 19 nt, Homo sapiens
uacccaaacuuaaauggaa

SEQ ID NO: 168730 - RNA, 19 nt, Homo sapiens
gauucucgcugaagucugu

SEQ ID NO: 168731 - RNA, 19 nt, Homo sapiens
gaaauauucgucuccuguu

SEQ ID NO: 168732 - RNA, 19 nt, Homo sapiens
cagacuaguuacuuuguug

SEQ ID NO: 168733 - RNA, 19 nt, Homo sapiens
gaaacaaaauagcaagaga

SEQ ID NO: 168734 - RNA, 19 nt, Homo sapiens
ggugacagaugccuucaag

SEQ ID NO: 168735 - RNA, 19 nt, Homo sapiens
gcagagauaucuugcuuua

SEQ ID NO: 168736 - RNA, 19 nt, Homo sapiens
gcacagaccugcuuuaagu

SEQ ID NO: 168737 - RNA, 19 nt, Homo sapiens
gcacucaaaucuuaagaaa

SEQ ID NO: 168738 - RNA, 19 nt, Homo sapiens
gaaggcgguuauacaauua

SEQ ID NO: 168739 - RNA, 19 nt, Homo sapiens
caacugaucuguuauaggu

SEQ ID NO: 168740 - RNA, 19 nt, Homo sapiens
gaagaauuguccacuuauu

SEQ ID NO: 168741 - RNA, 19 nt, Homo sapiens
gggcagaguuacuugauaa

SEQ ID NO: 168742 - RNA, 19 nt, Homo sapiens
gaaggaacuuggguugaua

SEQ ID NO: 168743 - RNA, 19 nt, Homo sapiens
gaacuuggguugauaucug

SEQ ID NO: 168744 - RNA, 19 nt, Homo sapiens
agaaagaucuagugaaguu

SEQ ID NO: 168745 - RNA, 19 nt, Homo sapiens
gauaggguaugauuacaaa

SEQ ID NO: 168746 - RNA, 19 nt, Homo sapiens
gaauguaguuugaggaaau

SEQ ID NO: 168747 - RNA, 19 nt, Homo sapiens
ggaguagaauguaguuuga

SEQ ID NO: 168748 - RNA, 19 nt, Homo sapiens
uaagaaagaucuagugaag

SEQ ID NO: 168749 - RNA, 19 nt, Homo sapiens
guacugaagcccacacuua

SEQ ID NO: 168750 - RNA, 19 nt, Homo sapiens
gauggauguuuacagauua

SEQ ID NO: 168751 - RNA, 19 nt, Homo sapiens
gagaacagauaaagauugu

SEQ ID NO: 168752 - RNA, 19 nt, Homo sapiens
gauagcauaugacaaaugu

SEQ ID NO: 168753 - RNA, 19 nt, Homo sapiens
gaagagugaaauaccauua

SEQ ID NO: 168754 - RNA, 19 nt, Homo sapiens
guugauaucugcaauaauc

SEQ ID NO: 168755 - RNA, 19 nt, Homo sapiens
caaaggagacuguacugua

SEQ ID NO: 168756 - RNA, 19 nt, Homo sapiens
gggaagagcuuagaaacug

SEQ ID NO: 168757 - RNA, 19 nt, Homo sapiens
gcaauaauccugcuaugga

SEQ ID NO: 168758 - RNA, 19 nt, Homo sapiens
guauguaucucuugggaaa

SEQ ID NO: 168759 - RNA, 19 nt, Homo sapiens
ccauuuaucuugaaggaaa

SEQ ID NO: 168760 - RNA, 19 nt, Homo sapiens
ggaaugaguuucuuagacu

SEQ ID NO: 168761 - RNA, 19 nt, Homo sapiens
gacaauaaggcuaucaaua

SEQ ID NO: 168762 - RNA, 19 nt, Homo sapiens
gaacaccauugccaucuuc

SEQ ID NO: 168763 - RNA, 19 nt, Homo sapiens
gacaaauguuucuaaggua

SEQ ID NO: 168764 - RNA, 19 nt, Homo sapiens
gagguauaauugugugaua

SEQ ID NO: 168765 - RNA, 19 nt, Homo sapiens
gaaagaaauucgagaagcu

SEQ ID NO: 168766 - RNA, 19 nt, Homo sapiens
gauauucguguucuucuua

SEQ ID NO: 168767 - RNA, 19 nt, Homo sapiens
gaugaacuaucuugaagug

SEQ ID NO: 168768 - RNA, 19 nt, Homo sapiens
ugacaaauguuucuaaggu

SEQ ID NO: 168769 - RNA, 19 nt, Homo sapiens
ggaaggagcugaggaacca

SEQ ID NO: 168770 - RNA, 19 nt, Homo sapiens
cugaagaauuguccacuua

SEQ ID NO: 168771 - RNA, 19 nt, Homo sapiens
ccagggaaauccuaaguga

SEQ ID NO: 168772 - RNA, 19 nt, Homo sapiens
gaacagauaaagauugugu

SEQ ID NO: 168773 - RNA, 19 nt, Homo sapiens
gaaauaaauccacccaugu

SEQ ID NO: 168774 - RNA, 19 nt, Homo sapiens
cuagaacacugccaacuga

SEQ ID NO: 168775 - RNA, 19 nt, Homo sapiens
gauaagggacuugauguuu

SEQ ID NO: 168776 - RNA, 19 nt, Homo sapiens
uaacacuacucaaagcaaa

SEQ ID NO: 168777 - RNA, 19 nt, Homo sapiens
caaaugccaugaaauugga

SEQ ID NO: 168778 - RNA, 19 nt, Homo sapiens
agaaggcgguuauacaauu

SEQ ID NO: 168779 - RNA, 19 nt, Homo sapiens
gcugugaaauuaagcuaaa

SEQ ID NO: 168780 - RNA, 19 nt, Homo sapiens
gaaaugcagccaaauggaa

SEQ ID NO: 168781 - RNA, 19 nt, Homo sapiens
gagugcauguacuaucuua

SEQ ID NO: 168782 - RNA, 19 nt, Homo sapiens
gcacugaaccugggaaaga

SEQ ID NO: 168783 - RNA, 19 nt, Homo sapiens
caacauauacaacaccaaa

SEQ ID NO: 168784 - RNA, 19 nt, Homo sapiens
gugaauaacuuugguagug

SEQ ID NO: 168785 - RNA, 19 nt, Homo sapiens
gaacuaucuugaagugaau

SEQ ID NO: 168786 - RNA, 19 nt, Homo sapiens
ugaacuaucuugaagugaa

SEQ ID NO: 168787 - RNA, 19 nt, Homo sapiens
guaacaagaugagaacaga

SEQ ID NO: 168788 - RNA, 19 nt, Homo sapiens
cccuuuagcuguguuauua

SEQ ID NO: 168789 - RNA, 19 nt, Homo sapiens
gcaagaaggcgguuauaca

SEQ ID NO: 168790 - RNA, 19 nt, Homo sapiens
agaguacccugaaggauuu

SEQ ID NO: 168791 - RNA, 19 nt, Homo sapiens
ggagguagccuggugguuu

SEQ ID NO: 168792 - RNA, 19 nt, Homo sapiens
gguaacugaugcuuucaaa

SEQ ID NO: 168793 - RNA, 19 nt, Homo sapiens
gaacaucuccaugggauau

SEQ ID NO: 168794 - RNA, 19 nt, Homo sapiens
gcaaucuguuacuguuuaa

SEQ ID NO: 168795 - RNA, 19 nt, Homo sapiens
ggauauucuucuccgcuua

SEQ ID NO: 168796 - RNA, 19 nt, Homo sapiens
gaagugaaucgcagaguga

SEQ ID NO: 168797 - RNA, 19 nt, Homo sapiens
gcugaaauacugaaagaaa

SEQ ID NO: 168798 - RNA, 19 nt, Homo sapiens
uauggaagcugaaauacug

SEQ ID NO: 168799 - RNA, 19 nt, Homo sapiens
caauaauccugcuauggaa

SEQ ID NO: 168800 - RNA, 19 nt, Homo sapiens
aagcugcacugaagaauug

SEQ ID NO: 168801 - RNA, 19 nt, Homo sapiens
cgauggauguuuacagauu

SEQ ID NO: 168802 - RNA, 19 nt, Homo sapiens
gaaaacagcagaagauuau

SEQ ID NO: 168803 - RNA, 19 nt, Homo sapiens
caagaaggcgguuauacaa

SEQ ID NO: 168804 - RNA, 19 nt, Homo sapiens
gagcaaaguccaagagaug

SEQ ID NO: 168805 - RNA, 19 nt, Homo sapiens
gaugagaacagauaaagau

SEQ ID NO: 168806 - RNA, 19 nt, Homo sapiens
gaguagagguauaauugug

SEQ ID NO: 168807 - RNA, 19 nt, Homo sapiens
acuuaagacugcauuguua

SEQ ID NO: 168808 - RNA, 19 nt, Homo sapiens
gaggcuuccuaucugauua

SEQ ID NO: 168809 - RNA, 19 nt, Homo sapiens
uaguaagucuugccuauau

SEQ ID NO: 168810 - RNA, 19 nt, Homo sapiens
gaacuuacagugauuaacu

SEQ ID NO: 168811 - RNA, 19 nt, Homo sapiens
gguuagauauagagucauu

SEQ ID NO: 168812 - RNA, 19 nt, Homo sapiens
ggaaaucauggauagaauu

SEQ ID NO: 168813 - RNA, 19 nt, Homo sapiens
ggguugauaucugcaauaa

SEQ ID NO: 168814 - RNA, 19 nt, Homo sapiens
uguuauagguccuuuagaa

SEQ ID NO: 168815 - RNA, 19 nt, Homo sapiens
gaggugaaaucguaauugg

SEQ ID NO: 168816 - RNA, 19 nt, Homo sapiens
ccauauccauagugacuuu

SEQ ID NO: 168817 - RNA, 19 nt, Homo sapiens
gaaauuugcagcuuccaau

SEQ ID NO: 168818 - RNA, 19 nt, Homo sapiens
gcaaaugccaugaaauugg

SEQ ID NO: 168819 - RNA, 19 nt, Homo sapiens
ugcaaucuguuacuguuua

SEQ ID NO: 168820 - RNA, 19 nt, Homo sapiens
acacauauauuggcuacuu

SEQ ID NO: 168821 - RNA, 19 nt, Homo sapiens
gcaaagaagcaguaguuca

SEQ ID NO: 168822 - RNA, 19 nt, Homo sapiens
gaaugaguuucuuagacuu

SEQ ID NO: 168823 - RNA, 19 nt, Homo sapiens
caacuugccuuugaagagu

SEQ ID NO: 168824 - RNA, 19 nt, Homo sapiens
gaacugacagcagagauau

SEQ ID NO: 168825 - RNA, 19 nt, Homo sapiens
gaccgaaggacacauauau

SEQ ID NO: 168826 - RNA, 19 nt, Homo sapiens
gcaauuugauagcuggaau

SEQ ID NO: 168827 - RNA, 19 nt, Homo sapiens
caaagaagcaguaguucau

SEQ ID NO: 168828 - RNA, 19 nt, Homo sapiens
uaaagauugugugguguuu

SEQ ID NO: 168829 - RNA, 19 nt, Homo sapiens
ccugauagcauaugacaaa

SEQ ID NO: 168830 - RNA, 19 nt, Homo sapiens
uagaguagagguauaauug

SEQ ID NO: 168831 - RNA, 19 nt, Homo sapiens
caucagccaucaacuaaag

SEQ ID NO: 168832 - RNA, 19 nt, Homo sapiens
gcaaagagaauaaaagcua

SEQ ID NO: 168833 - RNA, 19 nt, Homo sapiens
gcaaucaguagaagaguug

SEQ ID NO: 168834 - RNA, 19 nt, Homo sapiens
guaagucuugccuauauuu

SEQ ID NO: 168835 - RNA, 19 nt, Homo sapiens
gcagagauaucuugcuuua

SEQ ID NO: 168836 - RNA, 19 nt, Homo sapiens
gcacagaccugcuuuaagu

SEQ ID NO: 168837 - RNA, 19 nt, Homo sapiens
gcacucaaaucuuaagaaa

SEQ ID NO: 168838 - RNA, 19 nt, Homo sapiens
gaaggcgguuauacaauua

SEQ ID NO: 168839 - RNA, 19 nt, Homo sapiens
caacugaucuguuauaggu

SEQ ID NO: 168840 - RNA, 19 nt, Homo sapiens
gaagaauuguccacuuauu

SEQ ID NO: 168841 - RNA, 19 nt, Homo sapiens
gggcagaguuacuugauaa

SEQ ID NO: 168842 - RNA, 19 nt, Homo sapiens
gaaggaacuuggguugaua

SEQ ID NO: 168843 - RNA, 19 nt, Homo sapiens
gaacuuggguugauaucug

SEQ ID NO: 168844 - RNA, 19 nt, Homo sapiens
agaaagaucuagugaaguu

SEQ ID NO: 168845 - RNA, 19 nt, Homo sapiens
gauaggguaugauuacaaa

SEQ ID NO: 168846 - RNA, 19 nt, Homo sapiens
gaauguaguuugaggaaau

SEQ ID NO: 168847 - RNA, 19 nt, Homo sapiens
ggaguagaauguaguuuga

SEQ ID NO: 168848 - RNA, 19 nt, Homo sapiens
uaagaaagaucuagugaag

SEQ ID NO: 168849 - RNA, 19 nt, Homo sapiens
guacugaagcccacacuua

SEQ ID NO: 168850 - RNA, 19 nt, Homo sapiens
gauggauguuuacagauua

SEQ ID NO: 168851 - RNA, 19 nt, Homo sapiens
gagaacagauaaagauugu

SEQ ID NO: 168852 - RNA, 19 nt, Homo sapiens
gauagcauaugacaaaugu

SEQ ID NO: 168853 - RNA, 19 nt, Homo sapiens
gaagagugaaauaccauua

SEQ ID NO: 168854 - RNA, 19 nt, Homo sapiens
guugauaucugcaauaauc

SEQ ID NO: 168855 - RNA, 19 nt, Homo sapiens
caaaggagacuguacugua

SEQ ID NO: 168856 - RNA, 19 nt, Homo sapiens
gggaagagcuuagaaacug

SEQ ID NO: 168857 - RNA, 19 nt, Homo sapiens
gcaauaauccugcuaugga

SEQ ID NO: 168858 - RNA, 19 nt, Homo sapiens
guauguaucucuugggaaa

SEQ ID NO: 168859 - RNA, 19 nt, Homo sapiens
ccauuuaucuugaaggaaa

SEQ ID NO: 168860 - RNA, 19 nt, Homo sapiens
ggaaugaguuucuuagacu

SEQ ID NO: 168861 - RNA, 19 nt, Homo sapiens
gacaauaaggcuaucaaua

SEQ ID NO: 168862 - RNA, 19 nt, Homo sapiens
gaacaccauugccaucuuc

SEQ ID NO: 168863 - RNA, 19 nt, Homo sapiens
gacaaauguuucuaaggua

SEQ ID NO: 168864 - RNA, 19 nt, Homo sapiens
gagguauaauugugugaua

SEQ ID NO: 168865 - RNA, 19 nt, Homo sapiens
gaaagaaauucgagaagcu

SEQ ID NO: 168866 - RNA, 19 nt, Homo sapiens
gauauucguguucuucuua

SEQ ID NO: 168867 - RNA, 19 nt, Homo sapiens
gaugaacuaucuugaagug

SEQ ID NO: 168868 - RNA, 19 nt, Homo sapiens
ugacaaauguuucuaaggu

SEQ ID NO: 168869 - RNA, 19 nt, Homo sapiens
ggaaggagcugaggaacca

SEQ ID NO: 168870 - RNA, 19 nt, Homo sapiens
cugaagaauuguccacuua

SEQ ID NO: 168871 - RNA, 19 nt, Homo sapiens
ccagggaaauccuaaguga

SEQ ID NO: 168872 - RNA, 19 nt, Homo sapiens
gaacagauaaagauugugu

SEQ ID NO: 168873 - RNA, 19 nt, Homo sapiens
gaaauaaauccacccaugu

SEQ ID NO: 168874 - RNA, 19 nt, Homo sapiens
cuagaacacugccaacuga

SEQ ID NO: 168875 - RNA, 19 nt, Homo sapiens
gauaagggacuugauguuu

SEQ ID NO: 168876 - RNA, 19 nt, Homo sapiens
uaacacuacucaaagcaaa

SEQ ID NO: 168877 - RNA, 19 nt, Homo sapiens
caaaugccaugaaauugga

SEQ ID NO: 168878 - RNA, 19 nt, Homo sapiens
agaaggcgguuauacaauu

SEQ ID NO: 168879 - RNA, 19 nt, Homo sapiens
gcugugaaauuaagcuaaa

SEQ ID NO: 168880 - RNA, 19 nt, Homo sapiens
gaaaugcagccaaauggaa

SEQ ID NO: 168881 - RNA, 19 nt, Homo sapiens
gagugcauguacuaucuua

SEQ ID NO: 168882 - RNA, 19 nt, Homo sapiens
gcacugaaccugggaaaga

SEQ ID NO: 168883 - RNA, 19 nt, Homo sapiens
caacauauacaacaccaaa

SEQ ID NO: 168884 - RNA, 19 nt, Homo sapiens
gugaauaacuuugguagug

SEQ ID NO: 168885 - RNA, 19 nt, Homo sapiens
gaacuaucuugaagugaau

SEQ ID NO: 168886 - RNA, 19 nt, Homo sapiens
ugaacuaucuugaagugaa

SEQ ID NO: 168887 - RNA, 19 nt, Homo sapiens
guaacaagaugagaacaga

SEQ ID NO: 168888 - RNA, 19 nt, Homo sapiens
cccuuuagcuguguuauua

SEQ ID NO: 168889 - RNA, 19 nt, Homo sapiens
gcaagaaggcgguuauaca

SEQ ID NO: 168890 - RNA, 19 nt, Homo sapiens
agaguacccugaaggauuu

SEQ ID NO: 168891 - RNA, 19 nt, Homo sapiens
ggagguagccuggugguuu

SEQ ID NO: 168892 - RNA, 19 nt, Homo sapiens
gguaacugaugcuuucaaa

SEQ ID NO: 168893 - RNA, 19 nt, Homo sapiens
gaacaucuccaugggauau

SEQ ID NO: 168894 - RNA, 19 nt, Homo sapiens
gcaaucuguuacuguuuaa

SEQ ID NO: 168895 - RNA, 19 nt, Homo sapiens
ggauauucuucuccgcuua

SEQ ID NO: 168896 - RNA, 19 nt, Homo sapiens
gaagugaaucgcagaguga

SEQ ID NO: 168897 - RNA, 19 nt, Homo sapiens
gcugaaauacugaaagaaa

SEQ ID NO: 168898 - RNA, 19 nt, Homo sapiens
uauggaagcugaaauacug

SEQ ID NO: 168899 - RNA, 19 nt, Homo sapiens
caauaauccugcuauggaa

SEQ ID NO: 168900 - RNA, 19 nt, Homo sapiens
aagcugcacugaagaauug

SEQ ID NO: 168901 - RNA, 19 nt, Homo sapiens
cgauggauguuuacagauu

SEQ ID NO: 168902 - RNA, 19 nt, Homo sapiens
gaaaacagcagaagauuau

SEQ ID NO: 168903 - RNA, 19 nt, Homo sapiens
caagaaggcgguuauacaa

SEQ ID NO: 168904 - RNA, 19 nt, Homo sapiens
gagcaaaguccaagagaug

SEQ ID NO: 168905 - RNA, 19 nt, Homo sapiens
gaugagaacagauaaagau

SEQ ID NO: 168906 - RNA, 19 nt, Homo sapiens
gaguagagguauaauugug

SEQ ID NO: 168907 - RNA, 19 nt, Homo sapiens
acuuaagacugcauuguua

SEQ ID NO: 168908 - RNA, 19 nt, Homo sapiens
gaggcuuccuaucugauua

SEQ ID NO: 168909 - RNA, 19 nt, Homo sapiens
uaguaagucuugccuauau

SEQ ID NO: 168910 - RNA, 19 nt, Homo sapiens
gaacuuacagugauuaacu

SEQ ID NO: 168911 - RNA, 19 nt, Homo sapiens
gguuagauauagagucauu

SEQ ID NO: 168912 - RNA, 19 nt, Homo sapiens
ggaaaucauggauagaauu

SEQ ID NO: 168913 - RNA, 19 nt, Homo sapiens
uuagaagccuuuccacuau

SEQ ID NO: 168914 - RNA, 19 nt, Homo sapiens
ggguugauaucugcaauaa

SEQ ID NO: 168915 - RNA, 19 nt, Homo sapiens
acagugcccuuauauuuau

SEQ ID NO: 168916 - RNA, 19 nt, Homo sapiens
auacagugcccuuauauuu

SEQ ID NO: 168917 - RNA, 19 nt, Homo sapiens
ccuguccacuuguuaauaa

SEQ ID NO: 168918 - RNA, 19 nt, Homo sapiens
gccaaagaauaacaagaaa

SEQ ID NO: 168919 - RNA, 19 nt, Homo sapiens
uguuauagguccuuuagaa

SEQ ID NO: 168920 - RNA, 19 nt, Homo sapiens
gaggugaaaucguaauugg

SEQ ID NO: 168921 - RNA, 19 nt, Homo sapiens
ccauauccauagugacuuu

SEQ ID NO: 168922 - RNA, 19 nt, Homo sapiens
gaaauuugcagcuuccaau

SEQ ID NO: 168923 - RNA, 19 nt, Homo sapiens
gcaaaugccaugaaauugg

SEQ ID NO: 168924 - RNA, 19 nt, Homo sapiens
ugcaaucuguuacuguuua

SEQ ID NO: 168925 - RNA, 19 nt, Homo sapiens
acacauauauuggcuacuu

SEQ ID NO: 168926 - RNA, 19 nt, Homo sapiens
gcaaagaagcaguaguuca

SEQ ID NO: 168927 - RNA, 19 nt, Homo sapiens
gaaugaguuucuuagacuu

SEQ ID NO: 168928 - RNA, 19 nt, Homo sapiens
caacuugccuuugaagagu

SEQ ID NO: 168929 - RNA, 19 nt, Homo sapiens
gaacugacagcagagauau

SEQ ID NO: 168930 - RNA, 19 nt, Homo sapiens
gaccgaaggacacauauau

SEQ ID NO: 168931 - RNA, 19 nt, Homo sapiens
gcaauuugauagcuggaau

SEQ ID NO: 168932 - RNA, 19 nt, Homo sapiens
caaagaagcaguaguucau

SEQ ID NO: 168933 - RNA, 19 nt, Homo sapiens
uaaagauugugugguguuu

SEQ ID NO: 168934 - RNA, 19 nt, Homo sapiens
ccugauagcauaugacaaa

SEQ ID NO: 168935 - RNA, 19 nt, Homo sapiens
gaugaaaccugaugacucu

SEQ ID NO: 168936 - RNA, 19 nt, Homo sapiens
gacaucaaccucucuguua

SEQ ID NO: 168937 - RNA, 19 nt, Homo sapiens
gaggauagguguggccauu

SEQ ID NO: 168938 - RNA, 19 nt, Homo sapiens
gaaugguccuuaugaacga

SEQ ID NO: 168939 - RNA, 19 nt, Homo sapiens
gacgagcccuacacauuug

SEQ ID NO: 168940 - RNA, 19 nt, Homo sapiens
ugacgagcccuacacauuu

SEQ ID NO: 168941 - RNA, 19 nt, Homo sapiens
ggacagaugaaaccugaug

SEQ ID NO: 168942 - RNA, 19 nt, Homo sapiens
caaauuggcugcacuuacc

SEQ ID NO: 168943 - RNA, 19 nt, Homo sapiens
gaccagaggcgacccaaga

SEQ ID NO: 168944 - RNA, 19 nt, Homo sapiens
ggacauggagcuggaaaug

SEQ ID NO: 168945 - RNA, 19 nt, Homo sapiens
gaagggaacgaagcccaua

SEQ ID NO: 168946 - RNA, 19 nt, Homo sapiens
acaucaaccucucuguuaa

SEQ ID NO: 168947 - RNA, 19 nt, Homo sapiens
aaacuucggcuccauguug

SEQ ID NO: 168948 - RNA, 19 nt, Homo sapiens
gaaggaggcgagaguguuc

SEQ ID NO: 168949 - RNA, 19 nt, Homo sapiens
agaaugcguugaugccaaa

SEQ ID NO: 168950 - RNA, 19 nt, Homo sapiens
gcagcucacucaccacucu

SEQ ID NO: 168951 - RNA, 19 nt, Homo sapiens
cacgagacauucagaagug

SEQ ID NO: 168952 - RNA, 19 nt, Homo sapiens
acucuaagccucccguaua

SEQ ID NO: 168953 - RNA, 19 nt, Homo sapiens
ggauagguguggccauugg

SEQ ID NO: 168954 - RNA, 19 nt, Homo sapiens
gcacgagacauucagaagu

SEQ ID NO: 168955 - RNA, 19 nt, Homo sapiens
ggaaggaggcgagaguguu

SEQ ID NO: 168956 - RNA, 19 nt, Homo sapiens
ccauaugcaaguccaauuu

SEQ ID NO: 168957 - RNA, 19 nt, Homo sapiens
ggccgaggauuccgacuuc

SEQ ID NO: 168958 - RNA, 19 nt, Homo sapiens
caucaucaagcaccucuuu

SEQ ID NO: 168959 - RNA, 19 nt, Homo sapiens
gaaaccugaugacucuaag

SEQ ID NO: 168960 - RNA, 19 nt, Homo sapiens
caaggagaaugcguugaug

SEQ ID NO: 168961 - RNA, 19 nt, Homo sapiens
acaccaggaugucuucaau

SEQ ID NO: 168962 - RNA, 19 nt, Homo sapiens
uguaggcccuggaaacaga

SEQ ID NO: 168963 - RNA, 19 nt, Homo sapiens
ucaaucagccuacacucaa

SEQ ID NO: 168964 - RNA, 19 nt, Homo sapiens
gcaaguccaauuuuaagua

SEQ ID NO: 168965 - RNA, 19 nt, Homo sapiens
ugaaaccugaugacucuaa

SEQ ID NO: 168966 - RNA, 19 nt, Homo sapiens
gagacuacacagacuucua

SEQ ID NO: 168967 - RNA, 19 nt, Homo sapiens
gcaccuuccagccaccaua

SEQ ID NO: 168968 - RNA, 19 nt, Homo sapiens
uaaagccauugugcucuga

SEQ ID NO: 168969 - RNA, 19 nt, Homo sapiens
uguuggaacugucguggaa

SEQ ID NO: 168970 - RNA, 19 nt, Homo sapiens
caaggcccaugagcacauu

SEQ ID NO: 168971 - RNA, 19 nt, Homo sapiens
caacgucggaaucauguuc

SEQ ID NO: 168972 - RNA, 19 nt, Homo sapiens
agacuacacagacuucuau

SEQ ID NO: 168973 - RNA, 19 nt, Homo sapiens
ugacaucaaccucucuguu

SEQ ID NO: 168974 - RNA, 19 nt, Homo sapiens
ugccguaucugugccauga

SEQ ID NO: 168975 - RNA, 19 nt, Homo sapiens
accaggaugucuucaauca

SEQ ID NO: 168976 - RNA, 19 nt, Homo sapiens
ccaaacaccaggaugucuu

SEQ ID NO: 168977 - RNA, 19 nt, Homo sapiens
gacccaagaccgaggauag

SEQ ID NO: 168978 - RNA, 19 nt, Homo sapiens
ggagugcacgagacauuca

SEQ ID NO: 168979 - RNA, 19 nt, Homo sapiens
gaaggcccaugggacagau

SEQ ID NO: 168980 - RNA, 19 nt, Homo sapiens
ccaggcggcuaccauaugc

SEQ ID NO: 168981 - RNA, 19 nt, Homo sapiens
ccugaaaggagaaggaaug

SEQ ID NO: 168982 - RNA, 19 nt, Homo sapiens
caucggcuuuggccagugu

SEQ ID NO: 168983 - RNA, 19 nt, Homo sapiens
cucuaagccucccguauau

SEQ ID NO: 168984 - RNA, 19 nt, Homo sapiens
augcguugaugccaaauug

SEQ ID NO: 168985 - RNA, 19 nt, Homo sapiens
caaacaccaggaugucuuc

SEQ ID NO: 168986 - RNA, 19 nt, Homo sapiens
caccauaggagacuacaca

SEQ ID NO: 168987 - RNA, 19 nt, Homo sapiens
guccuguccucuccaaaca

SEQ ID NO: 168988 - RNA, 19 nt, Homo sapiens
acaaggagaaugcguugau

SEQ ID NO: 168989 - RNA, 19 nt, Homo sapiens
agugacaaauaaagccauu

SEQ ID NO: 168990 - RNA, 19 nt, Homo sapiens
ucggaagugugcauucauc

SEQ ID NO: 168991 - RNA, 19 nt, Homo sapiens
cuccugccaucaugagauu

SEQ ID NO: 168992 - RNA, 19 nt, Homo sapiens
gccaggcggcuaccauaug

SEQ ID NO: 168993 - RNA, 19 nt, Homo sapiens
uaaccugaaaggagaagga

SEQ ID NO: 168994 - RNA, 19 nt, Homo sapiens
gaugcucucaugcccuuug

SEQ ID NO: 168995 - RNA, 19 nt, Homo sapiens
uuggaaugguccuuaugaa

SEQ ID NO: 168996 - RNA, 19 nt, Homo sapiens
gagagccgauccccauuuc

SEQ ID NO: 168997 - RNA, 19 nt, Homo sapiens
gcccaugggacagaugaaa

SEQ ID NO: 168998 - RNA, 19 nt, Homo sapiens
gaaucauguucagggacaa

SEQ ID NO: 168999 - RNA, 19 nt, Homo sapiens
augacgagcccuacacauu

SEQ ID NO: 169000 - RNA, 19 nt, Homo sapiens
cuaagccucccguauaugg

SEQ ID NO: 169001 - RNA, 19 nt, Homo sapiens
gacagaugaaaccugauga

SEQ ID NO: 169002 - RNA, 19 nt, Homo sapiens
ggaagugugcauucaucuc

SEQ ID NO: 169003 - RNA, 19 nt, Homo sapiens
caaucagccuacacucaac

SEQ ID NO: 169004 - RNA, 19 nt, Homo sapiens
ggagagccgauccccauuu

SEQ ID NO: 169005 - RNA, 19 nt, Homo sapiens
cuacacagacuucuauucc

SEQ ID NO: 169006 - RNA, 19 nt, Homo sapiens
gaacauggcugaccucaua

SEQ ID NO: 169007 - RNA, 19 nt, Homo sapiens
ggaccacgcugcucuauuu

SEQ ID NO: 169008 - RNA, 19 nt, Homo sapiens
gaaccaagcuauuccuuuc

SEQ ID NO: 169009 - RNA, 19 nt, Homo sapiens
gcagacuuauucccaauua

SEQ ID NO: 169010 - RNA, 19 nt, Homo sapiens
ggacauggcaggccgauuu

SEQ ID NO: 169011 - RNA, 19 nt, Homo sapiens
caaaggaggugucuugcuu

SEQ ID NO: 169012 - RNA, 19 nt, Homo sapiens
uauaagagauccuugcaaa

SEQ ID NO: 169013 - RNA, 19 nt, Homo sapiens
caaagcagaugcaggagaa

SEQ ID NO: 169014 - RNA, 19 nt, Homo sapiens
ucagagagcugcagcauag

SEQ ID NO: 169015 - RNA, 19 nt, Homo sapiens
uaguagggcuuccguguua

SEQ ID NO: 169016 - RNA, 19 nt, Homo sapiens
gaauaggacuagcaacuuc

SEQ ID NO: 169017 - RNA, 19 nt, Homo sapiens
ccacugugauuguaaguuu

SEQ ID NO: 169018 - RNA, 19 nt, Homo sapiens
ggacgaggacuauuacaaa

SEQ ID NO: 169019 - RNA, 19 nt, Homo sapiens
gcaccgauguuucugcauu

SEQ ID NO: 169020 - RNA, 19 nt, Homo sapiens
uggcagagcucaucaacaa

SEQ ID NO: 169021 - RNA, 19 nt, Homo sapiens
gaguauccaucucccguua

SEQ ID NO: 169022 - RNA, 19 nt, Homo sapiens
auucaaggauggaacauua

SEQ ID NO: 169023 - RNA, 19 nt, Homo sapiens
agaaacugcucaacaaaga

SEQ ID NO: 169024 - RNA, 19 nt, Homo sapiens
caccaaggcucucucauca

SEQ ID NO: 169025 - RNA, 19 nt, Homo sapiens
gugaacacuugauaaacua

SEQ ID NO: 169026 - RNA, 19 nt, Homo sapiens
gaacaagaacucccugaag

SEQ ID NO: 169027 - RNA, 19 nt, Homo sapiens
caucauccauccuaggaaa

SEQ ID NO: 169028 - RNA, 19 nt, Homo sapiens
caccuucccuugccacuuu

SEQ ID NO: 169029 - RNA, 19 nt, Homo sapiens
ccaaggcucucucaucauc

SEQ ID NO: 169030 - RNA, 19 nt, Homo sapiens
gagagaugcggccaagaua

SEQ ID NO: 169031 - RNA, 19 nt, Homo sapiens
ccacccaccugcagaguga

SEQ ID NO: 169032 - RNA, 19 nt, Homo sapiens
gaugugguccugaaucgua

SEQ ID NO: 169033 - RNA, 19 nt, Homo sapiens
gcccggagguccacaguau

SEQ ID NO: 169034 - RNA, 19 nt, Homo sapiens
gcagagcucaucaacaaga

SEQ ID NO: 169035 - RNA, 19 nt, Homo sapiens
gagcccaccuggaucauca

SEQ ID NO: 169036 - RNA, 19 nt, Homo sapiens
ggacugaugaccuggugua

SEQ ID NO: 169037 - RNA, 19 nt, Homo sapiens
gugaagaugugguccugaa

SEQ ID NO: 169038 - RNA, 19 nt, Homo sapiens
gcagaugcaggagaacuua

SEQ ID NO: 169039 - RNA, 19 nt, Homo sapiens
ccucagaugucccuugaug

SEQ ID NO: 169040 - RNA, 19 nt, Homo sapiens
gcccaagccugaucucugu

SEQ ID NO: 169041 - RNA, 19 nt, Homo sapiens
caacuucgagcuccuagaa

SEQ ID NO: 169042 - RNA, 19 nt, Homo sapiens
gucaagaccugcaagaaag

SEQ ID NO: 169043 - RNA, 19 nt, Homo sapiens
uaggaaagauggugagaag

SEQ ID NO: 169044 - RNA, 19 nt, Homo sapiens
caagcuagacggcagauga

SEQ ID NO: 169045 - RNA, 19 nt, Homo sapiens
ggaugggccuggcauucuu

SEQ ID NO: 169046 - RNA, 19 nt, Homo sapiens
gcgaggcagugaucaugaa

SEQ ID NO: 169047 - RNA, 19 nt, Homo sapiens
aaacaguuccggaagauga

SEQ ID NO: 169048 - RNA, 19 nt, Homo sapiens
aaccagagaugccaacuuc

SEQ ID NO: 169049 - RNA, 19 nt, Homo sapiens
cccagaaacugcucaacaa

SEQ ID NO: 169050 - RNA, 19 nt, Homo sapiens
gaggaggagugcgucauga

SEQ ID NO: 169051 - RNA, 19 nt, Homo sapiens
cucaaggucugcuucuaua

SEQ ID NO: 169052 - RNA, 19 nt, Homo sapiens
ggcaaauccuggacaaaca

SEQ ID NO: 169053 - RNA, 19 nt, Homo sapiens
gcaccaaggcucucucauc

SEQ ID NO: 169054 - RNA, 19 nt, Homo sapiens
gaacuuaaagcccaaacag

SEQ ID NO: 169055 - RNA, 19 nt, Homo sapiens
ggccaaauccgcucucuuc

SEQ ID NO: 169056 - RNA, 19 nt, Homo sapiens
gcccucagaugucccuuga

SEQ ID NO: 169057 - RNA, 19 nt, Homo sapiens
gccgugaccucccuaagug

SEQ ID NO: 169058 - RNA, 19 nt, Homo sapiens
ugcuggagcucaagaauga

SEQ ID NO: 169059 - RNA, 19 nt, Homo sapiens
agaaggacauugccaugga

SEQ ID NO: 169060 - RNA, 19 nt, Homo sapiens
ucagugacguuuaucagau

SEQ ID NO: 169061 - RNA, 19 nt, Homo sapiens
gcaaagccauggccuaccu

SEQ ID NO: 169062 - RNA, 19 nt, Homo sapiens
ggaucaucauggaauugua

SEQ ID NO: 169063 - RNA, 19 nt, Homo sapiens
gcuaugggcugaggcugaa

SEQ ID NO: 169064 - RNA, 19 nt, Homo sapiens
cagcuucaauccugggaaa

SEQ ID NO: 169065 - RNA, 19 nt, Homo sapiens
gaguaaaguugggcacguu

SEQ ID NO: 169066 - RNA, 19 nt, Homo sapiens
gaacugaauaggacuagca

SEQ ID NO: 169067 - RNA, 19 nt, Homo sapiens
gcuuuucccucuuuucuua

SEQ ID NO: 169068 - RNA, 19 nt, Homo sapiens
ccaagguucuggccaaucu

SEQ ID NO: 169069 - RNA, 19 nt, Homo sapiens
ggaacaagaacucccugaa

SEQ ID NO: 169070 - RNA, 19 nt, Homo sapiens
ccaccuggaucaucaugga

SEQ ID NO: 169071 - RNA, 19 nt, Homo sapiens
ccaaacaguuccggaagau

SEQ ID NO: 169072 - RNA, 19 nt, Homo sapiens
ugaaaguucuuggcacaga

SEQ ID NO: 169073 - RNA, 19 nt, Homo sapiens
ggacuagcaacuucauaga

SEQ ID NO: 169074 - RNA, 19 nt, Homo sapiens
gaauucuugucucuccaaa

SEQ ID NO: 169075 - RNA, 19 nt, Homo sapiens
gacuugugguugaauuaaa

SEQ ID NO: 169076 - RNA, 19 nt, Homo sapiens
gacgaggacuauuacaaag

SEQ ID NO: 169077 - RNA, 19 nt, Homo sapiens
gaucaucauggaauuguau

SEQ ID NO: 169078 - RNA, 19 nt, Homo sapiens
gaagaugugguccugaauc

SEQ ID NO: 169079 - RNA, 19 nt, Homo sapiens
ggacgugcguauccucaag

SEQ ID NO: 169080 - RNA, 19 nt, Homo sapiens
ggaggaggacuucauccaa

SEQ ID NO: 169081 - RNA, 19 nt, Homo sapiens
gaucgagggcacccagaaa

SEQ ID NO: 169082 - RNA, 19 nt, Homo sapiens
uuacaaagccucugugacu

SEQ ID NO: 169083 - RNA, 19 nt, Homo sapiens
ugucaagaccugcaagaaa

SEQ ID NO: 169084 - RNA, 19 nt, Homo sapiens
cuaccgcugugaacucauu

SEQ ID NO: 169085 - RNA, 19 nt, Homo sapiens
ccagaaacugcucaacaaa

SEQ ID NO: 169086 - RNA, 19 nt, Homo sapiens
aggcagugaucaugaagaa

SEQ ID NO: 169087 - RNA, 19 nt, Homo sapiens
gcagaacugaauaggacua

SEQ ID NO: 169088 - RNA, 19 nt, Homo sapiens
gggaagaagcagagagaug

SEQ ID NO: 169089 - RNA, 19 nt, Homo sapiens
ucaccagcccuauggagua

SEQ ID NO: 169090 - RNA, 19 nt, Homo sapiens
cgauguuucugcauugaau

SEQ ID NO: 169091 - RNA, 19 nt, Homo sapiens
cagcauagagucagacauc

SEQ ID NO: 169092 - RNA, 19 nt, Homo sapiens
gaccugguguaccucaaug

SEQ ID NO: 169093 - RNA, 19 nt, Homo sapiens
cagccucagugacguuuau

SEQ ID NO: 169094 - RNA, 19 nt, Homo sapiens
aguaguggcugggucuuaa

SEQ ID NO: 169095 - RNA, 19 nt, Homo sapiens
ggacaacaaggagaaguuc

SEQ ID NO: 169096 - RNA, 19 nt, Homo sapiens
gaagccgaguggagguaug

SEQ ID NO: 169097 - RNA, 19 nt, Homo sapiens
cauagacgguugugaagac

SEQ ID NO: 169098 - RNA, 19 nt, Homo sapiens
gggugacggugacaaagau

SEQ ID NO: 169099 - RNA, 19 nt, Homo sapiens
ggucuuucccgguacauug

SEQ ID NO: 169100 - RNA, 19 nt, Homo sapiens
gcagagauucccgacgaaa

SEQ ID NO: 169101 - RNA, 19 nt, Homo sapiens
ucagacaucuacgcagaga

SEQ ID NO: 169102 - RNA, 19 nt, Homo sapiens
gagcucaggcgguucuuca

SEQ ID NO: 169103 - RNA, 19 nt, Homo sapiens
acaaacagcagaagcagau

SEQ ID NO: 169104 - RNA, 19 nt, Homo sapiens
uuuaucagauggagaagga

SEQ ID NO: 169105 - RNA, 19 nt, Homo sapiens
uagcagaggcugagaacau

SEQ ID NO: 169106 - RNA, 19 nt, Homo sapiens
gaacauggcugaccucaua

SEQ ID NO: 169107 - RNA, 19 nt, Homo sapiens
ggaccacgcugcucuauuu

SEQ ID NO: 169108 - RNA, 19 nt, Homo sapiens
gaaccaagcuauuccuuuc

SEQ ID NO: 169109 - RNA, 19 nt, Homo sapiens
gcagacuuauucccaauua

SEQ ID NO: 169110 - RNA, 19 nt, Homo sapiens
ggacauggcaggccgauuu

SEQ ID NO: 169111 - RNA, 19 nt, Homo sapiens
caaaggaggugucuugcuu

SEQ ID NO: 169112 - RNA, 19 nt, Homo sapiens
uauaagagauccuugcaaa

SEQ ID NO: 169113 - RNA, 19 nt, Homo sapiens
caaagcagaugcaggagaa

SEQ ID NO: 169114 - RNA, 19 nt, Homo sapiens
ucagagagcugcagcauag

SEQ ID NO: 169115 - RNA, 19 nt, Homo sapiens
uaguagggcuuccguguua

SEQ ID NO: 169116 - RNA, 19 nt, Homo sapiens
gaauaggacuagcaacuuc

SEQ ID NO: 169117 - RNA, 19 nt, Homo sapiens
ccacugugauuguaaguuu

SEQ ID NO: 169118 - RNA, 19 nt, Homo sapiens
ggacgaggacuauuacaaa

SEQ ID NO: 169119 - RNA, 19 nt, Homo sapiens
gcaccgauguuucugcauu

SEQ ID NO: 169120 - RNA, 19 nt, Homo sapiens
uggcagagcucaucaacaa

SEQ ID NO: 169121 - RNA, 19 nt, Homo sapiens
gaguauccaucucccguua

SEQ ID NO: 169122 - RNA, 19 nt, Homo sapiens
auucaaggauggaacauua

SEQ ID NO: 169123 - RNA, 19 nt, Homo sapiens
agaaacugcucaacaaaga

SEQ ID NO: 169124 - RNA, 19 nt, Homo sapiens
caccaaggcucucucauca

SEQ ID NO: 169125 - RNA, 19 nt, Homo sapiens
gugaacacuugauaaacua

SEQ ID NO: 169126 - RNA, 19 nt, Homo sapiens
gcaauaugagccaggguua

SEQ ID NO: 169127 - RNA, 19 nt, Homo sapiens
gaacaagaacucccugaag

SEQ ID NO: 169128 - RNA, 19 nt, Homo sapiens
caucauccauccuaggaaa

SEQ ID NO: 169129 - RNA, 19 nt, Homo sapiens
caccuucccuugccacuuu

SEQ ID NO: 169130 - RNA, 19 nt, Homo sapiens
ccaaggcucucucaucauc

SEQ ID NO: 169131 - RNA, 19 nt, Homo sapiens
gagagaugcggccaagaua

SEQ ID NO: 169132 - RNA, 19 nt, Homo sapiens
ccacccaccugcagaguga

SEQ ID NO: 169133 - RNA, 19 nt, Homo sapiens
gaugugguccugaaucgua

SEQ ID NO: 169134 - RNA, 19 nt, Homo sapiens
gcccggagguccacaguau

SEQ ID NO: 169135 - RNA, 19 nt, Homo sapiens
gaacggggcuuguuugaag

SEQ ID NO: 169136 - RNA, 19 nt, Homo sapiens
gcagagcucaucaacaaga

SEQ ID NO: 169137 - RNA, 19 nt, Homo sapiens
gagcccaccuggaucauca

SEQ ID NO: 169138 - RNA, 19 nt, Homo sapiens
ggacugaugaccuggugua

SEQ ID NO: 169139 - RNA, 19 nt, Homo sapiens
gugaagaugugguccugaa

SEQ ID NO: 169140 - RNA, 19 nt, Homo sapiens
gcagaugcaggagaacuua

SEQ ID NO: 169141 - RNA, 19 nt, Homo sapiens
ccucagaugucccuugaug

SEQ ID NO: 169142 - RNA, 19 nt, Homo sapiens
gcccaagccugaucucugu

SEQ ID NO: 169143 - RNA, 19 nt, Homo sapiens
caacuucgagcuccuagaa

SEQ ID NO: 169144 - RNA, 19 nt, Homo sapiens
gucaagaccugcaagaaag

SEQ ID NO: 169145 - RNA, 19 nt, Homo sapiens
uaggaaagauggugagaag

SEQ ID NO: 169146 - RNA, 19 nt, Homo sapiens
caagcuagacggcagauga

SEQ ID NO: 169147 - RNA, 19 nt, Homo sapiens
ggaugggccuggcauucuu

SEQ ID NO: 169148 - RNA, 19 nt, Homo sapiens
aaccagagaugccaacuuc

SEQ ID NO: 169149 - RNA, 19 nt, Homo sapiens
gcgaggcagugaucaugaa

SEQ ID NO: 169150 - RNA, 19 nt, Homo sapiens
aaacaguuccggaagauga

SEQ ID NO: 169151 - RNA, 19 nt, Homo sapiens
cccagaaacugcucaacaa

SEQ ID NO: 169152 - RNA, 19 nt, Homo sapiens
gaggaggagugcgucauga

SEQ ID NO: 169153 - RNA, 19 nt, Homo sapiens
cucaaggucugcuucuaua

SEQ ID NO: 169154 - RNA, 19 nt, Homo sapiens
ggcaaauccuggacaaaca

SEQ ID NO: 169155 - RNA, 19 nt, Homo sapiens
gcaccaaggcucucucauc

SEQ ID NO: 169156 - RNA, 19 nt, Homo sapiens
gaacuuaaagcccaaacag

SEQ ID NO: 169157 - RNA, 19 nt, Homo sapiens
ggccaaauccgcucucuuc

SEQ ID NO: 169158 - RNA, 19 nt, Homo sapiens
gcccucagaugucccuuga

SEQ ID NO: 169159 - RNA, 19 nt, Homo sapiens
gccgugaccucccuaagug

SEQ ID NO: 169160 - RNA, 19 nt, Homo sapiens
ugcuggagcucaagaauga

SEQ ID NO: 169161 - RNA, 19 nt, Homo sapiens
agaaggacauugccaugga

SEQ ID NO: 169162 - RNA, 19 nt, Homo sapiens
ucagugacguuuaucagau

SEQ ID NO: 169163 - RNA, 19 nt, Homo sapiens
gcaaagccauggccuaccu

SEQ ID NO: 169164 - RNA, 19 nt, Homo sapiens
ggaucaucauggaauugua

SEQ ID NO: 169165 - RNA, 19 nt, Homo sapiens
gcuaugggcugaggcugaa

SEQ ID NO: 169166 - RNA, 19 nt, Homo sapiens
cagcuucaauccugggaaa

SEQ ID NO: 169167 - RNA, 19 nt, Homo sapiens
gaguaaaguugggcacguu

SEQ ID NO: 169168 - RNA, 19 nt, Homo sapiens
gcugaaaggacauuuguuc

SEQ ID NO: 169169 - RNA, 19 nt, Homo sapiens
gaacugaauaggacuagca

SEQ ID NO: 169170 - RNA, 19 nt, Homo sapiens
gcuuuucccucuuuucuua

SEQ ID NO: 169171 - RNA, 19 nt, Homo sapiens
ccaagguucuggccaaucu

SEQ ID NO: 169172 - RNA, 19 nt, Homo sapiens
ggaacaagaacucccugaa

SEQ ID NO: 169173 - RNA, 19 nt, Homo sapiens
ccaccuggaucaucaugga

SEQ ID NO: 169174 - RNA, 19 nt, Homo sapiens
ccaaacaguuccggaagau

SEQ ID NO: 169175 - RNA, 19 nt, Homo sapiens
ugaaaguucuuggcacaga

SEQ ID NO: 169176 - RNA, 19 nt, Homo sapiens
ggacuagcaacuucauaga

SEQ ID NO: 169177 - RNA, 19 nt, Homo sapiens
gaauucuugucucuccaaa

SEQ ID NO: 169178 - RNA, 19 nt, Homo sapiens
gacuugugguugaauuaaa

SEQ ID NO: 169179 - RNA, 19 nt, Homo sapiens
gacgaggacuauuacaaag

SEQ ID NO: 169180 - RNA, 19 nt, Homo sapiens
gaucaucauggaauuguau

SEQ ID NO: 169181 - RNA, 19 nt, Homo sapiens
gaagaugugguccugaauc

SEQ ID NO: 169182 - RNA, 19 nt, Homo sapiens
ggacgugcguauccucaag

SEQ ID NO: 169183 - RNA, 19 nt, Homo sapiens
ggaggaggacuucauccaa

SEQ ID NO: 169184 - RNA, 19 nt, Homo sapiens
gaucgagggcacccagaaa

SEQ ID NO: 169185 - RNA, 19 nt, Homo sapiens
aauaugagccaggguuaua

SEQ ID NO: 169186 - RNA, 19 nt, Homo sapiens
uuacaaagccucugugacu

SEQ ID NO: 169187 - RNA, 19 nt, Homo sapiens
ugucaagaccugcaagaaa

SEQ ID NO: 169188 - RNA, 19 nt, Homo sapiens
cuaccgcugugaacucauu

SEQ ID NO: 169189 - RNA, 19 nt, Homo sapiens
ccagaaacugcucaacaaa

SEQ ID NO: 169190 - RNA, 19 nt, Homo sapiens
aggcagugaucaugaagaa

SEQ ID NO: 169191 - RNA, 19 nt, Homo sapiens
gcagaacugaauaggacua

SEQ ID NO: 169192 - RNA, 19 nt, Homo sapiens
gggaagaagcagagagaug

SEQ ID NO: 169193 - RNA, 19 nt, Homo sapiens
ucaccagcccuauggagua

SEQ ID NO: 169194 - RNA, 19 nt, Homo sapiens
cgauguuucugcauugaau

SEQ ID NO: 169195 - RNA, 19 nt, Homo sapiens
cagcauagagucagacauc

SEQ ID NO: 169196 - RNA, 19 nt, Homo sapiens
gaccugguguaccucaaug

SEQ ID NO: 169197 - RNA, 19 nt, Homo sapiens
cagccucagugacguuuau

SEQ ID NO: 169198 - RNA, 19 nt, Homo sapiens
ggacaacaaggagaaguuc

SEQ ID NO: 169199 - RNA, 19 nt, Homo sapiens
gaagccgaguggagguaug

SEQ ID NO: 169200 - RNA, 19 nt, Homo sapiens
gggcuuguuugaagagcaa

SEQ ID NO: 169201 - RNA, 19 nt, Homo sapiens
aguaguggcugggucuuaa

SEQ ID NO: 169202 - RNA, 19 nt, Homo sapiens
cauagacgguugugaagac

SEQ ID NO: 169203 - RNA, 19 nt, Homo sapiens
gggugacggugacaaagau

SEQ ID NO: 169204 - RNA, 19 nt, Homo sapiens
ggucuuucccgguacauug

SEQ ID NO: 169205 - RNA, 19 nt, Homo sapiens
gcagagauucccgacgaaa

SEQ ID NO: 169206 - RNA, 19 nt, Homo sapiens
gaacauggcugaccucaua

SEQ ID NO: 169207 - RNA, 19 nt, Homo sapiens
ggaccacgcugcucuauuu

SEQ ID NO: 169208 - RNA, 19 nt, Homo sapiens
gaaccaagcuauuccuuuc

SEQ ID NO: 169209 - RNA, 19 nt, Homo sapiens
ggacauggcaggccgauuu

SEQ ID NO: 169210 - RNA, 19 nt, Homo sapiens
caaagcagaugcaggagaa

SEQ ID NO: 169211 - RNA, 19 nt, Homo sapiens
ucagagagcugcagcauag

SEQ ID NO: 169212 - RNA, 19 nt, Homo sapiens
ggacgaggacuauuacaaa

SEQ ID NO: 169213 - RNA, 19 nt, Homo sapiens
uggcagagcucaucaacaa

SEQ ID NO: 169214 - RNA, 19 nt, Homo sapiens
auucaaggauggaacauua

SEQ ID NO: 169215 - RNA, 19 nt, Homo sapiens
agaaacugcucaacaaaga

SEQ ID NO: 169216 - RNA, 19 nt, Homo sapiens
caccaaggcucucucauca

SEQ ID NO: 169217 - RNA, 19 nt, Homo sapiens
gaacaagaacucccugaag

SEQ ID NO: 169218 - RNA, 19 nt, Homo sapiens
caucauccauccuaggaaa

SEQ ID NO: 169219 - RNA, 19 nt, Homo sapiens
caccuucccuugccacuuu

SEQ ID NO: 169220 - RNA, 19 nt, Homo sapiens
ccaaggcucucucaucauc

SEQ ID NO: 169221 - RNA, 19 nt, Homo sapiens
gagagaugcggccaagaua

SEQ ID NO: 169222 - RNA, 19 nt, Homo sapiens
ccacccaccugcagaguga

SEQ ID NO: 169223 - RNA, 19 nt, Homo sapiens
gaugugguccugaaucgua

SEQ ID NO: 169224 - RNA, 19 nt, Homo sapiens
gcccggagguccacaguau

SEQ ID NO: 169225 - RNA, 19 nt, Homo sapiens
gcagagcucaucaacaaga

SEQ ID NO: 169226 - RNA, 19 nt, Homo sapiens
gagcccaccuggaucauca

SEQ ID NO: 169227 - RNA, 19 nt, Homo sapiens
ggacugaugaccuggugua

SEQ ID NO: 169228 - RNA, 19 nt, Homo sapiens
gugaagaugugguccugaa

SEQ ID NO: 169229 - RNA, 19 nt, Homo sapiens
gcagaugcaggagaacuua

SEQ ID NO: 169230 - RNA, 19 nt, Homo sapiens
ccucagaugucccuugaug

SEQ ID NO: 169231 - RNA, 19 nt, Homo sapiens
gcccaagccugaucucugu

SEQ ID NO: 169232 - RNA, 19 nt, Homo sapiens
caacuucgagcuccuagaa

SEQ ID NO: 169233 - RNA, 19 nt, Homo sapiens
gucaagaccugcaagaaag

SEQ ID NO: 169234 - RNA, 19 nt, Homo sapiens
uaggaaagauggugagaag

SEQ ID NO: 169235 - RNA, 19 nt, Homo sapiens
ggaugggccuggcauucuu

SEQ ID NO: 169236 - RNA, 19 nt, Homo sapiens
gcgaggcagugaucaugaa

SEQ ID NO: 169237 - RNA, 19 nt, Homo sapiens
aaacaguuccggaagauga

SEQ ID NO: 169238 - RNA, 19 nt, Homo sapiens
cccagaaacugcucaacaa

SEQ ID NO: 169239 - RNA, 19 nt, Homo sapiens
gaggaggagugcgucauga

SEQ ID NO: 169240 - RNA, 19 nt, Homo sapiens
cucaaggucugcuucuaua

SEQ ID NO: 169241 - RNA, 19 nt, Homo sapiens
ggcaaauccuggacaaaca

SEQ ID NO: 169242 - RNA, 19 nt, Homo sapiens
gcaccaaggcucucucauc

SEQ ID NO: 169243 - RNA, 19 nt, Homo sapiens
gaacuuaaagcccaaacag

SEQ ID NO: 169244 - RNA, 19 nt, Homo sapiens
ggccaaauccgcucucuuc

SEQ ID NO: 169245 - RNA, 19 nt, Homo sapiens
gcccucagaugucccuuga

SEQ ID NO: 169246 - RNA, 19 nt, Homo sapiens
gccgugaccucccuaagug

SEQ ID NO: 169247 - RNA, 19 nt, Homo sapiens
ugcuggagcucaagaauga

SEQ ID NO: 169248 - RNA, 19 nt, Homo sapiens
agaaggacauugccaugga

SEQ ID NO: 169249 - RNA, 19 nt, Homo sapiens
ucagugacguuuaucagau

SEQ ID NO: 169250 - RNA, 19 nt, Homo sapiens
gcaaagccauggccuaccu

SEQ ID NO: 169251 - RNA, 19 nt, Homo sapiens
ggaucaucauggaauugua

SEQ ID NO: 169252 - RNA, 19 nt, Homo sapiens
gaguaaaguugggcacguu

SEQ ID NO: 169253 - RNA, 19 nt, Homo sapiens
gcuaugggcugaggcugaa

SEQ ID NO: 169254 - RNA, 19 nt, Homo sapiens
cagcuucaauccugggaaa

SEQ ID NO: 169255 - RNA, 19 nt, Homo sapiens
gcuuuucccucuuuucuua

SEQ ID NO: 169256 - RNA, 19 nt, Homo sapiens
ccaagguucuggccaaucu

SEQ ID NO: 169257 - RNA, 19 nt, Homo sapiens
ggaacaagaacucccugaa

SEQ ID NO: 169258 - RNA, 19 nt, Homo sapiens
ccaccuggaucaucaugga

SEQ ID NO: 169259 - RNA, 19 nt, Homo sapiens
ccaaacaguuccggaagau

SEQ ID NO: 169260 - RNA, 19 nt, Homo sapiens
gacuugugguugaauuaaa

SEQ ID NO: 169261 - RNA, 19 nt, Homo sapiens
gacgaggacuauuacaaag

SEQ ID NO: 169262 - RNA, 19 nt, Homo sapiens
gaucaucauggaauuguau

SEQ ID NO: 169263 - RNA, 19 nt, Homo sapiens
gaagaugugguccugaauc

SEQ ID NO: 169264 - RNA, 19 nt, Homo sapiens
ggacgugcguauccucaag

SEQ ID NO: 169265 - RNA, 19 nt, Homo sapiens
ggaggaggacuucauccaa

SEQ ID NO: 169266 - RNA, 19 nt, Homo sapiens
gaucgagggcacccagaaa

SEQ ID NO: 169267 - RNA, 19 nt, Homo sapiens
uuacaaagccucugugacu

SEQ ID NO: 169268 - RNA, 19 nt, Homo sapiens
ugucaagaccugcaagaaa

SEQ ID NO: 169269 - RNA, 19 nt, Homo sapiens
cuaccgcugugaacucauu

SEQ ID NO: 169270 - RNA, 19 nt, Homo sapiens
ccagaaacugcucaacaaa

SEQ ID NO: 169271 - RNA, 19 nt, Homo sapiens
aggcagugaucaugaagaa

SEQ ID NO: 169272 - RNA, 19 nt, Homo sapiens
gggaagaagcagagagaug

SEQ ID NO: 169273 - RNA, 19 nt, Homo sapiens
cagcauagagucagacauc

SEQ ID NO: 169274 - RNA, 19 nt, Homo sapiens
gaccugguguaccucaaug

SEQ ID NO: 169275 - RNA, 19 nt, Homo sapiens
cagccucagugacguuuau

SEQ ID NO: 169276 - RNA, 19 nt, Homo sapiens
ggacaacaaggagaaguuc

SEQ ID NO: 169277 - RNA, 19 nt, Homo sapiens
gaagccgaguggagguaug

SEQ ID NO: 169278 - RNA, 19 nt, Homo sapiens
gggugacggugacaaagau

SEQ ID NO: 169279 - RNA, 19 nt, Homo sapiens
ggucuuucccgguacauug

SEQ ID NO: 169280 - RNA, 19 nt, Homo sapiens
gcagagauucccgacgaaa

SEQ ID NO: 169281 - RNA, 19 nt, Homo sapiens
ucagacaucuacgcagaga

SEQ ID NO: 169282 - RNA, 19 nt, Homo sapiens
gagcucaggcgguucuuca

SEQ ID NO: 169283 - RNA, 19 nt, Homo sapiens
acaaacagcagaagcagau

SEQ ID NO: 169284 - RNA, 19 nt, Homo sapiens
uuuaucagauggagaagga

SEQ ID NO: 169285 - RNA, 19 nt, Homo sapiens
uagcagaggcugagaacau

SEQ ID NO: 169286 - RNA, 19 nt, Homo sapiens
ggaggaggagugcgucaug

SEQ ID NO: 169287 - RNA, 19 nt, Homo sapiens
gugaggugcaggacaagua

SEQ ID NO: 169288 - RNA, 19 nt, Homo sapiens
gccccuagcuuuauauaug

SEQ ID NO: 169289 - RNA, 19 nt, Homo sapiens
uugaggacgaggacuauua

SEQ ID NO: 169290 - RNA, 19 nt, Homo sapiens
aggcgguucuucaaggaua

SEQ ID NO: 169291 - RNA, 19 nt, Homo sapiens
uguacucacugcagauaug

SEQ ID NO: 169292 - RNA, 19 nt, Homo sapiens
gaggagcccaccuggauca

SEQ ID NO: 169293 - RNA, 19 nt, Homo sapiens
cccaaacaguuccggaaga

SEQ ID NO: 169294 - RNA, 19 nt, Homo sapiens
ucaagaaugagcucuguca

SEQ ID NO: 169295 - RNA, 19 nt, Homo sapiens
gagcgaggcagugaucaug

SEQ ID NO: 169296 - RNA, 19 nt, Homo sapiens
caacaaggagaaguucaug

SEQ ID NO: 169297 - RNA, 19 nt, Homo sapiens
aagcagaucagguccauca

SEQ ID NO: 169298 - RNA, 19 nt, Homo sapiens
cacaugaaguccgaugaga

SEQ ID NO: 169299 - RNA, 19 nt, Homo sapiens
gcaggacaaguaugagugu

SEQ ID NO: 169300 - RNA, 19 nt, Homo sapiens
ugaguuuggucuggacuga

SEQ ID NO: 169301 - RNA, 19 nt, Homo sapiens
guccaccgguccuuuauac

SEQ ID NO: 169302 - RNA, 19 nt, Homo sapiens
ugugggagauccugagcuu

SEQ ID NO: 169303 - RNA, 19 nt, Homo sapiens
gcacaugaaguccgaugag

SEQ ID NO: 169304 - RNA, 19 nt, Homo sapiens
acuuaaagcccaaacaguu

SEQ ID NO: 169305 - RNA, 19 nt, Homo sapiens
ccauccagcccacagcuaa

SEQ ID NO: 169306 - RNA, 19 nt, Homo sapiens
gaacauggcugaccucaua

SEQ ID NO: 169307 - RNA, 19 nt, Homo sapiens
ggaccacgcugcucuauuu

SEQ ID NO: 169308 - RNA, 19 nt, Homo sapiens
gaaccaagcuauuccuuuc

SEQ ID NO: 169309 - RNA, 19 nt, Homo sapiens
ggacauggcaggccgauuu

SEQ ID NO: 169310 - RNA, 19 nt, Homo sapiens
caaagcagaugcaggagaa

SEQ ID NO: 169311 - RNA, 19 nt, Homo sapiens
ucagagagcugcagcauag

SEQ ID NO: 169312 - RNA, 19 nt, Homo sapiens
ggacgaggacuauuacaaa

SEQ ID NO: 169313 - RNA, 19 nt, Homo sapiens
uggcagagcucaucaacaa

SEQ ID NO: 169314 - RNA, 19 nt, Homo sapiens
gaguauccaucucccguua

SEQ ID NO: 169315 - RNA, 19 nt, Homo sapiens
auucaaggauggaacauua

SEQ ID NO: 169316 - RNA, 19 nt, Homo sapiens
agaaacugcucaacaaaga

SEQ ID NO: 169317 - RNA, 19 nt, Homo sapiens
caccaaggcucucucauca

SEQ ID NO: 169318 - RNA, 19 nt, Homo sapiens
gaacaagaacucccugaag

SEQ ID NO: 169319 - RNA, 19 nt, Homo sapiens
caucauccauccuaggaaa

SEQ ID NO: 169320 - RNA, 19 nt, Homo sapiens
caccuucccuugccacuuu

SEQ ID NO: 169321 - RNA, 19 nt, Homo sapiens
ccaaggcucucucaucauc

SEQ ID NO: 169322 - RNA, 19 nt, Homo sapiens
gagagaugcggccaagaua

SEQ ID NO: 169323 - RNA, 19 nt, Homo sapiens
ccacccaccugcagaguga

SEQ ID NO: 169324 - RNA, 19 nt, Homo sapiens
gaugugguccugaaucgua

SEQ ID NO: 169325 - RNA, 19 nt, Homo sapiens
gcccggagguccacaguau

SEQ ID NO: 169326 - RNA, 19 nt, Homo sapiens
gcagagcucaucaacaaga

SEQ ID NO: 169327 - RNA, 19 nt, Homo sapiens
gagcccaccuggaucauca

SEQ ID NO: 169328 - RNA, 19 nt, Homo sapiens
ggacugaugaccuggugua

SEQ ID NO: 169329 - RNA, 19 nt, Homo sapiens
gugaagaugugguccugaa

SEQ ID NO: 169330 - RNA, 19 nt, Homo sapiens
gcagaugcaggagaacuua

SEQ ID NO: 169331 - RNA, 19 nt, Homo sapiens
ccucagaugucccuugaug

SEQ ID NO: 169332 - RNA, 19 nt, Homo sapiens
gcccaagccugaucucugu

SEQ ID NO: 169333 - RNA, 19 nt, Homo sapiens
caacuucgagcuccuagaa

SEQ ID NO: 169334 - RNA, 19 nt, Homo sapiens
gucaagaccugcaagaaag

SEQ ID NO: 169335 - RNA, 19 nt, Homo sapiens
uaggaaagauggugagaag

SEQ ID NO: 169336 - RNA, 19 nt, Homo sapiens
ggaugggccuggcauucuu

SEQ ID NO: 169337 - RNA, 19 nt, Homo sapiens
gcgaggcagugaucaugaa

SEQ ID NO: 169338 - RNA, 19 nt, Homo sapiens
aaacaguuccggaagauga

SEQ ID NO: 169339 - RNA, 19 nt, Homo sapiens
cccagaaacugcucaacaa

SEQ ID NO: 169340 - RNA, 19 nt, Homo sapiens
gaggaggagugcgucauga

SEQ ID NO: 169341 - RNA, 19 nt, Homo sapiens
cucaaggucugcuucuaua

SEQ ID NO: 169342 - RNA, 19 nt, Homo sapiens
ggcaaauccuggacaaaca

SEQ ID NO: 169343 - RNA, 19 nt, Homo sapiens
gcaccaaggcucucucauc

SEQ ID NO: 169344 - RNA, 19 nt, Homo sapiens
gaacuuaaagcccaaacag

SEQ ID NO: 169345 - RNA, 19 nt, Homo sapiens
ggccaaauccgcucucuuc

SEQ ID NO: 169346 - RNA, 19 nt, Homo sapiens
gcccucagaugucccuuga

SEQ ID NO: 169347 - RNA, 19 nt, Homo sapiens
gccgugaccucccuaagug

SEQ ID NO: 169348 - RNA, 19 nt, Homo sapiens
ugcuggagcucaagaauga

SEQ ID NO: 169349 - RNA, 19 nt, Homo sapiens
agaaggacauugccaugga

SEQ ID NO: 169350 - RNA, 19 nt, Homo sapiens
ucagugacguuuaucagau

SEQ ID NO: 169351 - RNA, 19 nt, Homo sapiens
gcaaagccauggccuaccu

SEQ ID NO: 169352 - RNA, 19 nt, Homo sapiens
ggaucaucauggaauugua

SEQ ID NO: 169353 - RNA, 19 nt, Homo sapiens
gaguaaaguugggcacguu

SEQ ID NO: 169354 - RNA, 19 nt, Homo sapiens
gcuaugggcugaggcugaa

SEQ ID NO: 169355 - RNA, 19 nt, Homo sapiens
cagcuucaauccugggaaa

SEQ ID NO: 169356 - RNA, 19 nt, Homo sapiens
gcuuuucccucuuuucuua

SEQ ID NO: 169357 - RNA, 19 nt, Homo sapiens
ccaagguucuggccaaucu

SEQ ID NO: 169358 - RNA, 19 nt, Homo sapiens
ggaacaagaacucccugaa

SEQ ID NO: 169359 - RNA, 19 nt, Homo sapiens
ccaccuggaucaucaugga

SEQ ID NO: 169360 - RNA, 19 nt, Homo sapiens
ccaaacaguuccggaagau

SEQ ID NO: 169361 - RNA, 19 nt, Homo sapiens
gacuugugguugaauuaaa

SEQ ID NO: 169362 - RNA, 19 nt, Homo sapiens
gacgaggacuauuacaaag

SEQ ID NO: 169363 - RNA, 19 nt, Homo sapiens
gaucaucauggaauuguau

SEQ ID NO: 169364 - RNA, 19 nt, Homo sapiens
gaagaugugguccugaauc

SEQ ID NO: 169365 - RNA, 19 nt, Homo sapiens
ggacgugcguauccucaag

SEQ ID NO: 169366 - RNA, 19 nt, Homo sapiens
ggaggaggacuucauccaa

SEQ ID NO: 169367 - RNA, 19 nt, Homo sapiens
gaucgagggcacccagaaa

SEQ ID NO: 169368 - RNA, 19 nt, Homo sapiens
uuacaaagccucugugacu

SEQ ID NO: 169369 - RNA, 19 nt, Homo sapiens
ugucaagaccugcaagaaa

SEQ ID NO: 169370 - RNA, 19 nt, Homo sapiens
cuaccgcugugaacucauu

SEQ ID NO: 169371 - RNA, 19 nt, Homo sapiens
ccagaaacugcucaacaaa

SEQ ID NO: 169372 - RNA, 19 nt, Homo sapiens
aggcagugaucaugaagaa

SEQ ID NO: 169373 - RNA, 19 nt, Homo sapiens
gggaagaagcagagagaug

SEQ ID NO: 169374 - RNA, 19 nt, Homo sapiens
ucaccagcccuauggagua

SEQ ID NO: 169375 - RNA, 19 nt, Homo sapiens
cagcauagagucagacauc

SEQ ID NO: 169376 - RNA, 19 nt, Homo sapiens
gaccugguguaccucaaug

SEQ ID NO: 169377 - RNA, 19 nt, Homo sapiens
cagccucagugacguuuau

SEQ ID NO: 169378 - RNA, 19 nt, Homo sapiens
ggacaacaaggagaaguuc

SEQ ID NO: 169379 - RNA, 19 nt, Homo sapiens
gaagccgaguggagguaug

SEQ ID NO: 169380 - RNA, 19 nt, Homo sapiens
gggugacggugacaaagau

SEQ ID NO: 169381 - RNA, 19 nt, Homo sapiens
ggucuuucccgguacauug

SEQ ID NO: 169382 - RNA, 19 nt, Homo sapiens
gcagagauucccgacgaaa

SEQ ID NO: 169383 - RNA, 19 nt, Homo sapiens
ucagacaucuacgcagaga

SEQ ID NO: 169384 - RNA, 19 nt, Homo sapiens
gagcucaggcgguucuuca

SEQ ID NO: 169385 - RNA, 19 nt, Homo sapiens
acaaacagcagaagcagau

SEQ ID NO: 169386 - RNA, 19 nt, Homo sapiens
uuuaucagauggagaagga

SEQ ID NO: 169387 - RNA, 19 nt, Homo sapiens
uagcagaggcugagaacau

SEQ ID NO: 169388 - RNA, 19 nt, Homo sapiens
ggaggaggagugcgucaug

SEQ ID NO: 169389 - RNA, 19 nt, Homo sapiens
gugaggugcaggacaagua

SEQ ID NO: 169390 - RNA, 19 nt, Homo sapiens
gccccuagcuuuauauaug

SEQ ID NO: 169391 - RNA, 19 nt, Homo sapiens
uugaggacgaggacuauua

SEQ ID NO: 169392 - RNA, 19 nt, Homo sapiens
aggcgguucuucaaggaua

SEQ ID NO: 169393 - RNA, 19 nt, Homo sapiens
uguacucacugcagauaug

SEQ ID NO: 169394 - RNA, 19 nt, Homo sapiens
gaggagcccaccuggauca

SEQ ID NO: 169395 - RNA, 19 nt, Homo sapiens
cccaaacaguuccggaaga

SEQ ID NO: 169396 - RNA, 19 nt, Homo sapiens
ucaagaaugagcucuguca

SEQ ID NO: 169397 - RNA, 19 nt, Homo sapiens
gagcgaggcagugaucaug

SEQ ID NO: 169398 - RNA, 19 nt, Homo sapiens
caacaaggagaaguucaug

SEQ ID NO: 169399 - RNA, 19 nt, Homo sapiens
aagcagaucagguccauca

SEQ ID NO: 169400 - RNA, 19 nt, Homo sapiens
cacaugaaguccgaugaga

SEQ ID NO: 169401 - RNA, 19 nt, Homo sapiens
gcaggacaaguaugagugu

SEQ ID NO: 169402 - RNA, 19 nt, Homo sapiens
ugaguuuggucuggacuga

SEQ ID NO: 169403 - RNA, 19 nt, Homo sapiens
guccaccgguccuuuauac

SEQ ID NO: 169404 - RNA, 19 nt, Homo sapiens
ugugggagauccugagcuu

SEQ ID NO: 169405 - RNA, 19 nt, Homo sapiens
gcacaugaaguccgaugag

SEQ ID NO: 169406 - RNA, 19 nt, Homo sapiens
gaucaaaguucuacaguuu

SEQ ID NO: 169407 - RNA, 19 nt, Homo sapiens
gcacauaaguucugucuga

SEQ ID NO: 169408 - RNA, 19 nt, Homo sapiens
gaaggcaucuugcacauaa

SEQ ID NO: 169409 - RNA, 19 nt, Homo sapiens
gagaaugacucuaaagaug

SEQ ID NO: 169410 - RNA, 19 nt, Homo sapiens
gcagugaacuaaauucuuc

SEQ ID NO: 169411 - RNA, 19 nt, Homo sapiens
gaaccgaagacucauaaua

SEQ ID NO: 169412 - RNA, 19 nt, Homo sapiens
cugaagaccugaccaauaa

SEQ ID NO: 169413 - RNA, 19 nt, Homo sapiens
gguccaacuugcagaauua

SEQ ID NO: 169414 - RNA, 19 nt, Homo sapiens
ggagaaauuucacgguuga

SEQ ID NO: 169415 - RNA, 19 nt, Homo sapiens
gaagaccagucccuugaaa

SEQ ID NO: 169416 - RNA, 19 nt, Homo sapiens
gaaacaacaucccuucauc

SEQ ID NO: 169417 - RNA, 19 nt, Homo sapiens
gagaggaauugaugucuga

SEQ ID NO: 169418 - RNA, 19 nt, Homo sapiens
gaagugaucaugaaaggaa

SEQ ID NO: 169419 - RNA, 19 nt, Homo sapiens
gcaaagagguacugguagu

SEQ ID NO: 169420 - RNA, 19 nt, Homo sapiens
agaagaagguggcaucuga

SEQ ID NO: 169421 - RNA, 19 nt, Homo sapiens
gacaugaaccuauuggaua

SEQ ID NO: 169422 - RNA, 19 nt, Homo sapiens
gaagaaaugcgugaagaaa

SEQ ID NO: 169423 - RNA, 19 nt, Homo sapiens
gaaccuauuggauaugaua

SEQ ID NO: 169424 - RNA, 19 nt, Homo sapiens
gcagaggacuacccauaug

SEQ ID NO: 169425 - RNA, 19 nt, Homo sapiens
ugacaucaauugaaagaga

SEQ ID NO: 169426 - RNA, 19 nt, Homo sapiens
guccaaaguucuuaccaua

SEQ ID NO: 169427 - RNA, 19 nt, Homo sapiens
uagcaaacccagagaauuu

SEQ ID NO: 169428 - RNA, 19 nt, Homo sapiens
gcacaugaagcaaauaaau

SEQ ID NO: 169429 - RNA, 19 nt, Homo sapiens
agaaugagacugagaauga

SEQ ID NO: 169430 - RNA, 19 nt, Homo sapiens
gaagaaauccaccgacaca

SEQ ID NO: 169431 - RNA, 19 nt, Homo sapiens
ugagacauguucagcagua

SEQ ID NO: 169432 - RNA, 19 nt, Homo sapiens
gaucaaggcaguucagaug

SEQ ID NO: 169433 - RNA, 19 nt, Homo sapiens
ccaaaguucuuaccauauc

SEQ ID NO: 169434 - RNA, 19 nt, Homo sapiens
gggcaaagagguacuggua

SEQ ID NO: 169435 - RNA, 19 nt, Homo sapiens
gcaucuggcucaacucgaa

SEQ ID NO: 169436 - RNA, 19 nt, Homo sapiens
gcagcaacauggcagagaa

SEQ ID NO: 169437 - RNA, 19 nt, Homo sapiens
gcgagaaucuuuaggacau

SEQ ID NO: 169438 - RNA, 19 nt, Homo sapiens
caggagaguucaaauggaa

SEQ ID NO: 169439 - RNA, 19 nt, Homo sapiens
gaagagauaguaggugauu

SEQ ID NO: 169440 - RNA, 19 nt, Homo sapiens
caacaaaugcaacuucaga

SEQ ID NO: 169441 - RNA, 19 nt, Homo sapiens
gcacagagaagaccaugau

SEQ ID NO: 169442 - RNA, 19 nt, Homo sapiens
cagcagcagugaacuaaau

SEQ ID NO: 169443 - RNA, 19 nt, Homo sapiens
ggaaauacugguucuugaa

SEQ ID NO: 169444 - RNA, 19 nt, Homo sapiens
guucagcaguauaccauuu

SEQ ID NO: 169445 - RNA, 19 nt, Homo sapiens
gagcauauaaugaauguca

SEQ ID NO: 169446 - RNA, 19 nt, Homo sapiens
gcaggagaguucaaaugga

SEQ ID NO: 169447 - RNA, 19 nt, Homo sapiens
gaagacucauaauagaaga

SEQ ID NO: 169448 - RNA, 19 nt, Homo sapiens
caauauggcgagaaucuuu

SEQ ID NO: 169449 - RNA, 19 nt, Homo sapiens
agaaaugcgugaagaaauc

SEQ ID NO: 169450 - RNA, 19 nt, Homo sapiens
aaauauugcucgagaggaa

SEQ ID NO: 169451 - RNA, 19 nt, Homo sapiens
uaccauaucuacucugaga

SEQ ID NO: 169452 - RNA, 19 nt, Homo sapiens
gagaagaccaugauaagag

SEQ ID NO: 169453 - RNA, 19 nt, Homo sapiens
aaucaauacuccaccaauu

SEQ ID NO: 169454 - RNA, 19 nt, Homo sapiens
gaauccagauagcaaacuu

SEQ ID NO: 169455 - RNA, 19 nt, Homo sapiens
ucauacaccugucucuauu

SEQ ID NO: 169456 - RNA, 19 nt, Homo sapiens
cagcaaaucuuggcgacaa

SEQ ID NO: 169457 - RNA, 19 nt, Homo sapiens
gggauuugcuuugcuguga

SEQ ID NO: 169458 - RNA, 19 nt, Homo sapiens
ggaguaccaucacguucuu

SEQ ID NO: 169459 - RNA, 19 nt, Homo sapiens
ugaaagauagcguuaauuc

SEQ ID NO: 169460 - RNA, 19 nt, Homo sapiens
guaacucugugucagcaaa

SEQ ID NO: 169461 - RNA, 19 nt, Homo sapiens
agacugagaaugacucuaa

SEQ ID NO: 169462 - RNA, 19 nt, Homo sapiens
gacaucaauugaaagagaa

SEQ ID NO: 169463 - RNA, 19 nt, Homo sapiens
gagaaggcaucuugcacau

SEQ ID NO: 169464 - RNA, 19 nt, Homo sapiens
agaagaaccuaacaagaca

SEQ ID NO: 169465 - RNA, 19 nt, Homo sapiens
gaugaccauuguaggguuu

SEQ ID NO: 169466 - RNA, 19 nt, Homo sapiens
gcaguuaaaccaguuguga

SEQ ID NO: 169467 - RNA, 19 nt, Homo sapiens
gauagaagucggaggaaau

SEQ ID NO: 169468 - RNA, 19 nt, Homo sapiens
ggaaagaggaggacauggu

SEQ ID NO: 169469 - RNA, 19 nt, Homo sapiens
agaagaccaugauaagaga

SEQ ID NO: 169470 - RNA, 19 nt, Homo sapiens
uagaagaaaugcgugaaga

SEQ ID NO: 169471 - RNA, 19 nt, Homo sapiens
gaauuugcauuggcuuuag

SEQ ID NO: 169472 - RNA, 19 nt, Homo sapiens
uaacagcagcagugaacua

SEQ ID NO: 169473 - RNA, 19 nt, Homo sapiens
ggcggcagcuaaugaagaa

SEQ ID NO: 169474 - RNA, 19 nt, Homo sapiens
caacuugcagaauuaauug

SEQ ID NO: 169475 - RNA, 19 nt, Homo sapiens
aaagagguacugguaguua

SEQ ID NO: 169476 - RNA, 19 nt, Homo sapiens
gaaccuaacaagacaugug

SEQ ID NO: 169477 - RNA, 19 nt, Homo sapiens
gaggaaauacugguucuug

SEQ ID NO: 169478 - RNA, 19 nt, Homo sapiens
acaugaaccuauuggauau

SEQ ID NO: 169479 - RNA, 19 nt, Homo sapiens
uggcagagaugcauguugu

SEQ ID NO: 169480 - RNA, 19 nt, Homo sapiens
ggaaguaucgcgucuacca

SEQ ID NO: 169481 - RNA, 19 nt, Homo sapiens
ccaacuugcagaauuaauu

SEQ ID NO: 169482 - RNA, 19 nt, Homo sapiens
guucagauguguagcaaac

SEQ ID NO: 169483 - RNA, 19 nt, Homo sapiens
ucacauagggcaaauugga

SEQ ID NO: 169484 - RNA, 19 nt, Homo sapiens
gacuaucacccaauuagaa

SEQ ID NO: 169485 - RNA, 19 nt, Homo sapiens
guccauggguccaaaguuc

SEQ ID NO: 169486 - RNA, 19 nt, Homo sapiens
cuacccauauggaccagua

SEQ ID NO: 169487 - RNA, 19 nt, Homo sapiens
acagagaagaccaugauaa

SEQ ID NO: 169488 - RNA, 19 nt, Homo sapiens
aagagguacugguaguuaa

SEQ ID NO: 169489 - RNA, 19 nt, Homo sapiens
uuuaggacauaccagguua

SEQ ID NO: 169490 - RNA, 19 nt, Homo sapiens
cgagaaucuuuaggacaua

SEQ ID NO: 169491 - RNA, 19 nt, Homo sapiens
cuaccaauauggcgagaau

SEQ ID NO: 169492 - RNA, 19 nt, Homo sapiens
ccagauagcaaacuuaguc

SEQ ID NO: 169493 - RNA, 19 nt, Homo sapiens
aaccauauauucgacauga

SEQ ID NO: 169494 - RNA, 19 nt, Homo sapiens
ucugaaagauagcguuaau

SEQ ID NO: 169495 - RNA, 19 nt, Homo sapiens
gcacacucauggcagagau

SEQ ID NO: 169496 - RNA, 19 nt, Homo sapiens
uaaaccaguugugaugcua

SEQ ID NO: 169497 - RNA, 19 nt, Homo sapiens
caucacauagggcaaauug

SEQ ID NO: 169498 - RNA, 19 nt, Homo sapiens
uaaauucuucccagaguga

SEQ ID NO: 169499 - RNA, 19 nt, Homo sapiens
ucaaggcaguucagaugug

SEQ ID NO: 169500 - RNA, 19 nt, Homo sapiens
gacugacuaucacccaauu

SEQ ID NO: 169501 - RNA, 19 nt, Homo sapiens
gaucaugaaaggaaauauc

SEQ ID NO: 169502 - RNA, 19 nt, Homo sapiens
cagaagaaccuaacaagac

SEQ ID NO: 169503 - RNA, 19 nt, Homo sapiens
cacaacaaaugcaacuuca

SEQ ID NO: 169504 - RNA, 19 nt, Homo sapiens
gaaugacucuaaagaugcu

SEQ ID NO: 169505 - RNA, 19 nt, Homo sapiens
caaggugccuggugugacu

SEQ ID NO: 169506 - RNA, 19 nt, Homo sapiens
gaacuuacuucccuauauu

SEQ ID NO: 169507 - RNA, 19 nt, Homo sapiens
caaaguagcuggcauguag

SEQ ID NO: 169508 - RNA, 19 nt, Homo sapiens
gaaaaugaaucaccacaua

SEQ ID NO: 169509 - RNA, 19 nt, Homo sapiens
gaaaauauguguaccguuu

SEQ ID NO: 169510 - RNA, 19 nt, Homo sapiens
gaaccuaguuguguuaguu

SEQ ID NO: 169511 - RNA, 19 nt, Homo sapiens
ggacagaccucuuauuagc

SEQ ID NO: 169512 - RNA, 19 nt, Homo sapiens
acaauguucucaccaaaua

SEQ ID NO: 169513 - RNA, 19 nt, Homo sapiens
caagggcaauuuauucauu

SEQ ID NO: 169514 - RNA, 19 nt, Homo sapiens
acaguugccuuauauguaa

SEQ ID NO: 169515 - RNA, 19 nt, Homo sapiens
uauaggcaaugcuguguua

SEQ ID NO: 169516 - RNA, 19 nt, Homo sapiens
ggaagucuuugcugccuuu

SEQ ID NO: 169517 - RNA, 19 nt, Homo sapiens
ggaagugauuggaaguauu

SEQ ID NO: 169518 - RNA, 19 nt, Homo sapiens
gaacugagucccaagaugu

SEQ ID NO: 169519 - RNA, 19 nt, Homo sapiens
cuagggagauagaccuuua

SEQ ID NO: 169520 - RNA, 19 nt, Homo sapiens
ggauggagauuuugaagua

SEQ ID NO: 169521 - RNA, 19 nt, Homo sapiens
gugauugccuugaauaaau

SEQ ID NO: 169522 - RNA, 19 nt, Homo sapiens
ugacucagccucccaagua

SEQ ID NO: 169523 - RNA, 19 nt, Homo sapiens
gaagaguucuaccauagca

SEQ ID NO: 169524 - RNA, 19 nt, Homo sapiens
ccaaguagcugggauuaca

SEQ ID NO: 169525 - RNA, 19 nt, Homo sapiens
gccuuuggauacuaaauua

SEQ ID NO: 169526 - RNA, 19 nt, Homo sapiens
aggcaaugcuguguuauua

SEQ ID NO: 169527 - RNA, 19 nt, Homo sapiens
gggaggaguugcacaauag

SEQ ID NO: 169528 - RNA, 19 nt, Homo sapiens
caggaggacucucugauga

SEQ ID NO: 169529 - RNA, 19 nt, Homo sapiens
ucaaacaccugaccuugug

SEQ ID NO: 169530 - RNA, 19 nt, Homo sapiens
gugaagaguucuaccauag

SEQ ID NO: 169531 - RNA, 19 nt, Homo sapiens
ggccacaguugccuuauau

SEQ ID NO: 169532 - RNA, 19 nt, Homo sapiens
gcacuaugaccuucagaaa

SEQ ID NO: 169533 - RNA, 19 nt, Homo sapiens
ggaacugagucccaagaug

SEQ ID NO: 169534 - RNA, 19 nt, Homo sapiens
gcagcuguaucucacacua

SEQ ID NO: 169535 - RNA, 19 nt, Homo sapiens
gaaggcccauuuguaagaa

SEQ ID NO: 169536 - RNA, 19 nt, Homo sapiens
gaagugauuggaaguauuc

SEQ ID NO: 169537 - RNA, 19 nt, Homo sapiens
gcaaugcuguguuauuacu

SEQ ID NO: 169538 - RNA, 19 nt, Homo sapiens
ugaacuuacuucccuauau

SEQ ID NO: 169539 - RNA, 19 nt, Homo sapiens
guaguguaaucuuguagaa

SEQ ID NO: 169540 - RNA, 19 nt, Homo sapiens
gggccacaguugccuuaua

SEQ ID NO: 169541 - RNA, 19 nt, Homo sapiens
gcauuuggguuggaacuga

SEQ ID NO: 169542 - RNA, 19 nt, Homo sapiens
agauagaccuuuacagcaa

SEQ ID NO: 169543 - RNA, 19 nt, Homo sapiens
gauagugauugccuugaau

SEQ ID NO: 169544 - RNA, 19 nt, Homo sapiens
gcuuuaaagugacaaacaa

SEQ ID NO: 169545 - RNA, 19 nt, Homo sapiens
cauguagugucacggauuu

SEQ ID NO: 169546 - RNA, 19 nt, Homo sapiens
ggucaacguuugcacuaug

SEQ ID NO: 169547 - RNA, 19 nt, Homo sapiens
auagaaggcccauuuguaa

SEQ ID NO: 169548 - RNA, 19 nt, Homo sapiens
gcgcuucaauggcuauaga

SEQ ID NO: 169549 - RNA, 19 nt, Homo sapiens
caauaugaguaguguaauc

SEQ ID NO: 169550 - RNA, 19 nt, Homo sapiens
gcacagacaaauguuuaaa

SEQ ID NO: 169551 - RNA, 19 nt, Homo sapiens
gaaacaacccagugaagag

SEQ ID NO: 169552 - RNA, 19 nt, Homo sapiens
ccacauccaucggcgcuuu

SEQ ID NO: 169553 - RNA, 19 nt, Homo sapiens
ugaguaguguaaucuugua

SEQ ID NO: 169554 - RNA, 19 nt, Homo sapiens
ggagugcaguggugugauc

SEQ ID NO: 169555 - RNA, 19 nt, Homo sapiens
ccucaguagugaagaguuu

SEQ ID NO: 169556 - RNA, 19 nt, Homo sapiens
cuggacagaccucuuauua

SEQ ID NO: 169557 - RNA, 19 nt, Homo sapiens
gaaaggcauuuggguugga

SEQ ID NO: 169558 - RNA, 19 nt, Homo sapiens
ccaaagugcugggauuaca

SEQ ID NO: 169559 - RNA, 19 nt, Homo sapiens
aauagaaggcccauuugua

SEQ ID NO: 169560 - RNA, 19 nt, Homo sapiens
ccaugaaggccaucuugua

SEQ ID NO: 169561 - RNA, 19 nt, Homo sapiens
gauagaccuuuacagcaau

SEQ ID NO: 169562 - RNA, 19 nt, Homo sapiens
ugggaggaguugcacaaua

SEQ ID NO: 169563 - RNA, 19 nt, Homo sapiens
ccaguagucaguacacuuu

SEQ ID NO: 169564 - RNA, 19 nt, Homo sapiens
ggaggacucucugaugaag

SEQ ID NO: 169565 - RNA, 19 nt, Homo sapiens
ucaggaauauugguuugaa

SEQ ID NO: 169566 - RNA, 19 nt, Homo sapiens
gcgcaggccucaguucugu

SEQ ID NO: 169567 - RNA, 19 nt, Homo sapiens
cuuauuagcucuucguagu

SEQ ID NO: 169568 - RNA, 19 nt, Homo sapiens
ugaaguaccuggucuuagc

SEQ ID NO: 169569 - RNA, 19 nt, Homo sapiens
auagcaaggccuaauguua

SEQ ID NO: 169570 - RNA, 19 nt, Homo sapiens
gcaaaguagcuggcaugua

SEQ ID NO: 169571 - RNA, 19 nt, Homo sapiens
uuacaauguucucaccaaa

SEQ ID NO: 169572 - RNA, 19 nt, Homo sapiens
ggaguugcacaauagguuu

SEQ ID NO: 169573 - RNA, 19 nt, Homo sapiens
gaacccggcauccacaaau

SEQ ID NO: 169574 - RNA, 19 nt, Homo sapiens
uaugaguaguguaaucuug

SEQ ID NO: 169575 - RNA, 19 nt, Homo sapiens
cuccaccucugaaagauaa

SEQ ID NO: 169576 - RNA, 19 nt, Homo sapiens
ugggagcgcuugccucaga

SEQ ID NO: 169577 - RNA, 19 nt, Homo sapiens
agugaagaguucuaccaua

SEQ ID NO: 169578 - RNA, 19 nt, Homo sapiens
ugauagugauugccuugaa

SEQ ID NO: 169579 - RNA, 19 nt, Homo sapiens
guaugucccuuuaaagcau

SEQ ID NO: 169580 - RNA, 19 nt, Homo sapiens
cacaguugccuuauaugua

SEQ ID NO: 169581 - RNA, 19 nt, Homo sapiens
gcauugacgcacagacaaa

SEQ ID NO: 169582 - RNA, 19 nt, Homo sapiens
caguuaaccagccuuagua

SEQ ID NO: 169583 - RNA, 19 nt, Homo sapiens
caggaauauugguuugaaa

SEQ ID NO: 169584 - RNA, 19 nt, Homo sapiens
uuuaauagaaggcccauuu

SEQ ID NO: 169585 - RNA, 19 nt, Homo sapiens
acuuaaagccauggaauua

SEQ ID NO: 169586 - RNA, 19 nt, Homo sapiens
cuuguggucugauuccuuu

SEQ ID NO: 169587 - RNA, 19 nt, Homo sapiens
uaagaaacaacccagugaa

SEQ ID NO: 169588 - RNA, 19 nt, Homo sapiens
ccacaguugccuuauaugu

SEQ ID NO: 169589 - RNA, 19 nt, Homo sapiens
ggcagugucaggaauauug

SEQ ID NO: 169590 - RNA, 19 nt, Homo sapiens
uguguaccguuuaaagaaa

SEQ ID NO: 169591 - RNA, 19 nt, Homo sapiens
gaggaagugauuggaagua

SEQ ID NO: 169592 - RNA, 19 nt, Homo sapiens
ggacgccgaugaggagaca

SEQ ID NO: 169593 - RNA, 19 nt, Homo sapiens
uagcuggcauguaguguca

SEQ ID NO: 169594 - RNA, 19 nt, Homo sapiens
gcuguguuauuacuugaau

SEQ ID NO: 169595 - RNA, 19 nt, Homo sapiens
gucaacguuugcacuauga

SEQ ID NO: 169596 - RNA, 19 nt, Homo sapiens
guaucucacacuaugauuu

SEQ ID NO: 169597 - RNA, 19 nt, Homo sapiens
cagcuucugccguuaacua

SEQ ID NO: 169598 - RNA, 19 nt, Homo sapiens
gcacaugcugcgcuucaau

SEQ ID NO: 169599 - RNA, 19 nt, Homo sapiens
acgcacagacaaauguuua

SEQ ID NO: 169600 - RNA, 19 nt, Homo sapiens
agaaggcccauuuguaaga

SEQ ID NO: 169601 - RNA, 19 nt, Homo sapiens
gcauguagugucacggauu

SEQ ID NO: 169602 - RNA, 19 nt, Homo sapiens
gcaggccucaguucuguau

SEQ ID NO: 169603 - RNA, 19 nt, Homo sapiens
uuaagaaacaacccaguga

SEQ ID NO: 169604 - RNA, 19 nt, Homo sapiens
caauuccuccugucaguug

SEQ ID NO: 169605 - RNA, 19 nt, Homo sapiens
uauaugccuuuggauacua

SEQ ID NO: 169606 - RNA, 19 nt, Homo sapiens
ggaauuagaugcuccauug

SEQ ID NO: 169607 - RNA, 19 nt, Homo sapiens
ggacaucucugccaaaguc

SEQ ID NO: 169608 - RNA, 19 nt, Homo sapiens
gcaagcaggugccuacaga

SEQ ID NO: 169609 - RNA, 19 nt, Homo sapiens
gaucugcuguuacuucuga

SEQ ID NO: 169610 - RNA, 19 nt, Homo sapiens
gcacuaagcagccuucaug

SEQ ID NO: 169611 - RNA, 19 nt, Homo sapiens
ccaaggaacugccauacug

SEQ ID NO: 169612 - RNA, 19 nt, Homo sapiens
gugcagaugugcccaggua

SEQ ID NO: 169613 - RNA, 19 nt, Homo sapiens
gaugggaaauccacagaga

SEQ ID NO: 169614 - RNA, 19 nt, Homo sapiens
gaccauuccuauauaauuc

SEQ ID NO: 169615 - RNA, 19 nt, Homo sapiens
gaaccaaggaacugccaua

SEQ ID NO: 169616 - RNA, 19 nt, Homo sapiens
gggcagcuuucaacuguga

SEQ ID NO: 169617 - RNA, 19 nt, Homo sapiens
agagagcacuguuguacuu

SEQ ID NO: 169618 - RNA, 19 nt, Homo sapiens
gaccuggccuuguuacuag

SEQ ID NO: 169619 - RNA, 19 nt, Homo sapiens
ggaccuggccuuguuacua

SEQ ID NO: 169620 - RNA, 19 nt, Homo sapiens
gaaauuugcccuaguuacu

SEQ ID NO: 169621 - RNA, 19 nt, Homo sapiens
gagagagcgucccaucugu

SEQ ID NO: 169622 - RNA, 19 nt, Homo sapiens
ggagagagcgucccaucug

SEQ ID NO: 169623 - RNA, 19 nt, Homo sapiens
cagguaaucgagacacuua

SEQ ID NO: 169624 - RNA, 19 nt, Homo sapiens
cuaaggaucugcuguuacu

SEQ ID NO: 169625 - RNA, 19 nt, Homo sapiens
gcaguuggcucaggaugca

SEQ ID NO: 169626 - RNA, 19 nt, Homo sapiens
gugguaggccugugaaauu

SEQ ID NO: 169627 - RNA, 19 nt, Homo sapiens
ugugaaauuugcccuaguu

SEQ ID NO: 169628 - RNA, 19 nt, Homo sapiens
guaccuagaaagcuauuug

SEQ ID NO: 169629 - RNA, 19 nt, Homo sapiens
gagacgcugcagagcauua

SEQ ID NO: 169630 - RNA, 19 nt, Homo sapiens
gucuggagcugcuaguuga

SEQ ID NO: 169631 - RNA, 19 nt, Homo sapiens
ugugaccauuccuauauaa

SEQ ID NO: 169632 - RNA, 19 nt, Homo sapiens
uaaucgagacacuuacuuu

SEQ ID NO: 169633 - RNA, 19 nt, Homo sapiens
gcacucagagccagaccaa

SEQ ID NO: 169634 - RNA, 19 nt, Homo sapiens
gaguggagccucuaaggau

SEQ ID NO: 169635 - RNA, 19 nt, Homo sapiens
ugguaggccugugaaauuu

SEQ ID NO: 169636 - RNA, 19 nt, Homo sapiens
agagagugcuggagacaca

SEQ ID NO: 169637 - RNA, 19 nt, Homo sapiens
gcagggauguaagucagau

SEQ ID NO: 169638 - RNA, 19 nt, Homo sapiens
gaggaucaggcccaggaua

SEQ ID NO: 169639 - RNA, 19 nt, Homo sapiens
guuacuaccauucucguuu

SEQ ID NO: 169640 - RNA, 19 nt, Homo sapiens
gcagaugugcccagguaau

SEQ ID NO: 169641 - RNA, 19 nt, Homo sapiens
ccaaagccuuacaggacuu

SEQ ID NO: 169642 - RNA, 19 nt, Homo sapiens
gaauuagaugcuccauuga

SEQ ID NO: 169643 - RNA, 19 nt, Homo sapiens
guagccagcggccaggaua

SEQ ID NO: 169644 - RNA, 19 nt, Homo sapiens
ccaggauaccaaagccuua

SEQ ID NO: 169645 - RNA, 19 nt, Homo sapiens
gaagaugccagaaaaggaa

SEQ ID NO: 169646 - RNA, 19 nt, Homo sapiens
gcaggcagagcccaagaug

SEQ ID NO: 169647 - RNA, 19 nt, Homo sapiens
gaacccagacaaggcacua

SEQ ID NO: 169648 - RNA, 19 nt, Homo sapiens
gcaggaugcccagggauug

SEQ ID NO: 169649 - RNA, 19 nt, Homo sapiens
caaagucuugugaccugua

SEQ ID NO: 169650 - RNA, 19 nt, Homo sapiens
cgucccaucuguccuggaa

SEQ ID NO: 169651 - RNA, 19 nt, Homo sapiens
ggcuggaggcccaaacuaa

SEQ ID NO: 169652 - RNA, 19 nt, Homo sapiens
gagccagaccaagcacaua

SEQ ID NO: 169653 - RNA, 19 nt, Homo sapiens
guugagugcugaccgucuu

SEQ ID NO: 169654 - RNA, 19 nt, Homo sapiens
gugaaauuugcccuaguua

SEQ ID NO: 169655 - RNA, 19 nt, Homo sapiens
gcuuucugcuucaccauca

SEQ ID NO: 169656 - RNA, 19 nt, Homo sapiens
accuguagcugccacguuu

SEQ ID NO: 169657 - RNA, 19 nt, Homo sapiens
cugcagagcauuacuugga

SEQ ID NO: 169658 - RNA, 19 nt, Homo sapiens
gggagggcuuucugcuuca

SEQ ID NO: 169659 - RNA, 19 nt, Homo sapiens
ugaagaauuucggacaucu

SEQ ID NO: 169660 - RNA, 19 nt, Homo sapiens
gugggaagaugccagaaaa

SEQ ID NO: 169661 - RNA, 19 nt, Homo sapiens
ccgcacaucaucucugcua

SEQ ID NO: 169662 - RNA, 19 nt, Homo sapiens
gagcacuguuguacuuggu

SEQ ID NO: 169663 - RNA, 19 nt, Homo sapiens
gcuucaccaucauuaggaa

SEQ ID NO: 169664 - RNA, 19 nt, Homo sapiens
ccagaccaagcacauacua

SEQ ID NO: 169665 - RNA, 19 nt, Homo sapiens
ucauugagguagaauuacu

SEQ ID NO: 169666 - RNA, 19 nt, Homo sapiens
ucacagggaacccagacaa

SEQ ID NO: 169667 - RNA, 19 nt, Homo sapiens
cucuaaggaucugcuguua

SEQ ID NO: 169668 - RNA, 19 nt, Homo sapiens
uuccuggacuggugagauu

SEQ ID NO: 169669 - RNA, 19 nt, Homo sapiens
cuguaugccugagguguuu

SEQ ID NO: 169670 - RNA, 19 nt, Homo sapiens
uaguugaggccuugaaugu

SEQ ID NO: 169671 - RNA, 19 nt, Homo sapiens
gcuucacccuuccuaaguc

SEQ ID NO: 169672 - RNA, 19 nt, Homo sapiens
guaggccugugaaauuugc

SEQ ID NO: 169673 - RNA, 19 nt, Homo sapiens
cccuguaccuagaaagcua

SEQ ID NO: 169674 - RNA, 19 nt, Homo sapiens
caagcuuggcccaggguuu

SEQ ID NO: 169675 - RNA, 19 nt, Homo sapiens
ggugguaggccugugaaau

SEQ ID NO: 169676 - RNA, 19 nt, Homo sapiens
gcuccuccauagucugcaa

SEQ ID NO: 169677 - RNA, 19 nt, Homo sapiens
aaacuaaggggucacauga

SEQ ID NO: 169678 - RNA, 19 nt, Homo sapiens
uuacuaccauucucguuuu

SEQ ID NO: 169679 - RNA, 19 nt, Homo sapiens
gguaggccugugaaauuug

SEQ ID NO: 169680 - RNA, 19 nt, Homo sapiens
gcuggaggcccaaacuaag

SEQ ID NO: 169681 - RNA, 19 nt, Homo sapiens
uugaaugucccaugcaguu

SEQ ID NO: 169682 - RNA, 19 nt, Homo sapiens
caucucugccaaagucuug

SEQ ID NO: 169683 - RNA, 19 nt, Homo sapiens
gacugucaccugcaacuuc

SEQ ID NO: 169684 - RNA, 19 nt, Homo sapiens
gaaaaggaaccaaggaacu

SEQ ID NO: 169685 - RNA, 19 nt, Homo sapiens
aggagacgcugcagagcau

SEQ ID NO: 169686 - RNA, 19 nt, Homo sapiens
gaccaagcacauacuagca

SEQ ID NO: 169687 - RNA, 19 nt, Homo sapiens
ccucuaaggaucugcuguu

SEQ ID NO: 169688 - RNA, 19 nt, Homo sapiens
augugaccauuccuauaua

SEQ ID NO: 169689 - RNA, 19 nt, Homo sapiens
aaagucuugugaccuguag

SEQ ID NO: 169690 - RNA, 19 nt, Homo sapiens
gaagaauuucggacaucuc

SEQ ID NO: 169691 - RNA, 19 nt, Homo sapiens
ggaagaugccagaaaagga

SEQ ID NO: 169692 - RNA, 19 nt, Homo sapiens
gaugugcccagguaaucga

SEQ ID NO: 169693 - RNA, 19 nt, Homo sapiens
gaacaaggggcagcuuuca

SEQ ID NO: 169694 - RNA, 19 nt, Homo sapiens
aaaguggcaauuagugaau

SEQ ID NO: 169695 - RNA, 19 nt, Homo sapiens
acugucaccugcaacuuca

SEQ ID NO: 169696 - RNA, 19 nt, Homo sapiens
aagaugccuugacucuaug

SEQ ID NO: 169697 - RNA, 19 nt, Homo sapiens
cgcgggaacuaacucuuca

SEQ ID NO: 169698 - RNA, 19 nt, Homo sapiens
gaagaaacaucuacagaau

SEQ ID NO: 169699 - RNA, 19 nt, Homo sapiens
aaagaaaggugccaauauu

SEQ ID NO: 169700 - RNA, 19 nt, Homo sapiens
ggacaaucauauaccauuu

SEQ ID NO: 169701 - RNA, 19 nt, Homo sapiens
gaaagaaaggugccaauau

SEQ ID NO: 169702 - RNA, 19 nt, Homo sapiens
gcacugaucaagaaauuaa

SEQ ID NO: 169703 - RNA, 19 nt, Homo sapiens
ugacaaggauggcuacaaa

SEQ ID NO: 169704 - RNA, 19 nt, Homo sapiens
gaagaaagcagaacuggau

SEQ ID NO: 169705 - RNA, 19 nt, Homo sapiens
gaaacaggacaaucauaua

SEQ ID NO: 169706 - RNA, 19 nt, Homo sapiens
gaacuggucuuuucaaaug

SEQ ID NO: 169707 - RNA, 19 nt, Homo sapiens
gcugguggauucuuuguuu

SEQ ID NO: 169708 - RNA, 19 nt, Homo sapiens
gaacagcagaugauaaugu

SEQ ID NO: 169709 - RNA, 19 nt, Homo sapiens
ggaaagaaaggugccaaua

SEQ ID NO: 169710 - RNA, 19 nt, Homo sapiens
gaugaacaauauccuagaa

SEQ ID NO: 169711 - RNA, 19 nt, Homo sapiens
caacaaaggaugauaaucu

SEQ ID NO: 169712 - RNA, 19 nt, Homo sapiens
aaggauggcuacaaacaua

SEQ ID NO: 169713 - RNA, 19 nt, Homo sapiens
ucacguggguuacugauga

SEQ ID NO: 169714 - RNA, 19 nt, Homo sapiens
ggaguaaauuagcauaugu

SEQ ID NO: 169715 - RNA, 19 nt, Homo sapiens
gaaguugaagaccagauua

SEQ ID NO: 169716 - RNA, 19 nt, Homo sapiens
gcacucacacugaaggaua

SEQ ID NO: 169717 - RNA, 19 nt, Homo sapiens
aaagaaguaucccuugcua

SEQ ID NO: 169718 - RNA, 19 nt, Homo sapiens
ggccauaaauauauucaga

SEQ ID NO: 169719 - RNA, 19 nt, Homo sapiens
agaauacccuggaagaaga

SEQ ID NO: 169720 - RNA, 19 nt, Homo sapiens
gcuaugaugccauuucgua

SEQ ID NO: 169721 - RNA, 19 nt, Homo sapiens
ccacuuacccugcguaugu

SEQ ID NO: 169722 - RNA, 19 nt, Homo sapiens
gaagaggaaaugcuugcua

SEQ ID NO: 169723 - RNA, 19 nt, Homo sapiens
acucagaaguucaagcuaa

SEQ ID NO: 169724 - RNA, 19 nt, Homo sapiens
ccacaugacccacuuccua

SEQ ID NO: 169725 - RNA, 19 nt, Homo sapiens
cuaaagcucugguuaaugc

SEQ ID NO: 169726 - RNA, 19 nt, Homo sapiens
gauucuuccuccucaauuu

SEQ ID NO: 169727 - RNA, 19 nt, Homo sapiens
gaagcuauccuccaagcaa

SEQ ID NO: 169728 - RNA, 19 nt, Homo sapiens
gauaaugugcacuuucaaa

SEQ ID NO: 169729 - RNA, 19 nt, Homo sapiens
caaaggaugauaaucuuga

SEQ ID NO: 169730 - RNA, 19 nt, Homo sapiens
gaaagcuggguguuuauga

SEQ ID NO: 169731 - RNA, 19 nt, Homo sapiens
gaacaauauccuagaacaa

SEQ ID NO: 169732 - RNA, 19 nt, Homo sapiens
gaugcaagccuguaucaga

SEQ ID NO: 169733 - RNA, 19 nt, Homo sapiens
ggcaagagcagaauauuuc

SEQ ID NO: 169734 - RNA, 19 nt, Homo sapiens
gaggauacguuucaucacu

SEQ ID NO: 169735 - RNA, 19 nt, Homo sapiens
gaaguaucccuugcuaauu

SEQ ID NO: 169736 - RNA, 19 nt, Homo sapiens
gaaaggugccaauauuaca

SEQ ID NO: 169737 - RNA, 19 nt, Homo sapiens
gaagaauacccuggaagaa

SEQ ID NO: 169738 - RNA, 19 nt, Homo sapiens
gcaagugggaggccauaaa

SEQ ID NO: 169739 - RNA, 19 nt, Homo sapiens
gauuacagcugucagaaaa

SEQ ID NO: 169740 - RNA, 19 nt, Homo sapiens
gggaggccauaaauauauu

SEQ ID NO: 169741 - RNA, 19 nt, Homo sapiens
gcaaugauagccucaagug

SEQ ID NO: 169742 - RNA, 19 nt, Homo sapiens
aggaaaugcuugcuacaaa

SEQ ID NO: 169743 - RNA, 19 nt, Homo sapiens
gggaguaaauuagcauaug

SEQ ID NO: 169744 - RNA, 19 nt, Homo sapiens
aagaaaggugccaauauua

SEQ ID NO: 169745 - RNA, 19 nt, Homo sapiens
ggaaaugcuugcuacaaaa

SEQ ID NO: 169746 - RNA, 19 nt, Homo sapiens
caauggagaauuuguaaga

SEQ ID NO: 169747 - RNA, 19 nt, Homo sapiens
ccuuagcaauggagaauuu

SEQ ID NO: 169748 - RNA, 19 nt, Homo sapiens
gcagauaacaauauaguac

SEQ ID NO: 169749 - RNA, 19 nt, Homo sapiens
ucagaaauguagacuaucu

SEQ ID NO: 169750 - RNA, 19 nt, Homo sapiens
gaaagugauuauucaaagc

SEQ ID NO: 169751 - RNA, 19 nt, Homo sapiens
gaguguaaggucuguauuu

SEQ ID NO: 169752 - RNA, 19 nt, Homo sapiens
guuauugccuauuccuauu

SEQ ID NO: 169753 - RNA, 19 nt, Homo sapiens
ggugaugugcauugucuua

SEQ ID NO: 169754 - RNA, 19 nt, Homo sapiens
caaagacccaggagcauau

SEQ ID NO: 169755 - RNA, 19 nt, Homo sapiens
ccaaagacccaggagcaua

SEQ ID NO: 169756 - RNA, 19 nt, Homo sapiens
ugaacaauauccuagaaca

SEQ ID NO: 169757 - RNA, 19 nt, Homo sapiens
ugaaacaggacaaucauau

SEQ ID NO: 169758 - RNA, 19 nt, Homo sapiens
agacagaauuagcuaacuu

SEQ ID NO: 169759 - RNA, 19 nt, Homo sapiens
gcuacaaacauauucacua

SEQ ID NO: 169760 - RNA, 19 nt, Homo sapiens
uggcauaugcggaauuuaa

SEQ ID NO: 169761 - RNA, 19 nt, Homo sapiens
cagacuggguuuaugaaga

SEQ ID NO: 169762 - RNA, 19 nt, Homo sapiens
augauaaucuugagcacua

SEQ ID NO: 169763 - RNA, 19 nt, Homo sapiens
aaagcuggguguuuaugaa

SEQ ID NO: 169764 - RNA, 19 nt, Homo sapiens
gguggucccugcagucaga

SEQ ID NO: 169765 - RNA, 19 nt, Homo sapiens
ccaggagcauauagaagaa

SEQ ID NO: 169766 - RNA, 19 nt, Homo sapiens
gguacucugugaaagaaga

SEQ ID NO: 169767 - RNA, 19 nt, Homo sapiens
cagaaguucaagcuaaaua

SEQ ID NO: 169768 - RNA, 19 nt, Homo sapiens
gcuguuaauuggauaucuu

SEQ ID NO: 169769 - RNA, 19 nt, Homo sapiens
uuauggcgaugaacaauau

SEQ ID NO: 169770 - RNA, 19 nt, Homo sapiens
uuuaucaccuguucauuug

SEQ ID NO: 169771 - RNA, 19 nt, Homo sapiens
aaguaucccuugcuaauuc

SEQ ID NO: 169772 - RNA, 19 nt, Homo sapiens
agaagaaacaucuacagaa

SEQ ID NO: 169773 - RNA, 19 nt, Homo sapiens
gacagaauuagcuaacuuu

SEQ ID NO: 169774 - RNA, 19 nt, Homo sapiens
cuaaagcaguguuucucuu

SEQ ID NO: 169775 - RNA, 19 nt, Homo sapiens
ggucuguauuugcuguuaa

SEQ ID NO: 169776 - RNA, 19 nt, Homo sapiens
ccaagcaagaaguguguua

SEQ ID NO: 169777 - RNA, 19 nt, Homo sapiens
uggaugggcugguggauuc

SEQ ID NO: 169778 - RNA, 19 nt, Homo sapiens
gaucggcaauuuguauauc

SEQ ID NO: 169779 - RNA, 19 nt, Homo sapiens
gcaagccuguaucagaauc

SEQ ID NO: 169780 - RNA, 19 nt, Homo sapiens
uguguuacuugccaucuaa

SEQ ID NO: 169781 - RNA, 19 nt, Homo sapiens
cuacagaauuagcauugga

SEQ ID NO: 169782 - RNA, 19 nt, Homo sapiens
ugaagaauacccuggaaga

SEQ ID NO: 169783 - RNA, 19 nt, Homo sapiens
gugggaggccauaaauaua

SEQ ID NO: 169784 - RNA, 19 nt, Homo sapiens
uaucaaagacacuguggaa

SEQ ID NO: 169785 - RNA, 19 nt, Homo sapiens
gauacggauauaccaguua

SEQ ID NO: 169786 - RNA, 19 nt, Homo sapiens
gaaacaaagaccaggagau

SEQ ID NO: 169787 - RNA, 19 nt, Homo sapiens
cuugagcacuauaagaauu

SEQ ID NO: 169788 - RNA, 19 nt, Homo sapiens
gugacaaacuccucuaugc

SEQ ID NO: 169789 - RNA, 19 nt, Homo sapiens
acuaugcacuugucugcua

SEQ ID NO: 169790 - RNA, 19 nt, Homo sapiens
ggaagaagaaacaucuaca

SEQ ID NO: 169791 - RNA, 19 nt, Homo sapiens
gagaauuuguaagaggaaa

SEQ ID NO: 169792 - RNA, 19 nt, Homo sapiens
gaaaagggagucaugcauu

SEQ ID NO: 169793 - RNA, 19 nt, Homo sapiens
gauaaucuugagcacuaua

SEQ ID NO: 169794 - RNA, 19 nt, Homo sapiens
gaagacagaauuagcuaac

SEQ ID NO: 169795 - RNA, 19 nt, Homo sapiens
gcuggguguuuaugaaguu

SEQ ID NO: 169796 - RNA, 19 nt, Homo sapiens
gagcuaagaaucccguugu

SEQ ID NO: 169797 - RNA, 19 nt, Homo sapiens
gauuucaggacaagaauau

SEQ ID NO: 169798 - RNA, 19 nt, Homo sapiens
gacaauagcugcaaagaua

SEQ ID NO: 169799 - RNA, 19 nt, Homo sapiens
gcaagacggguuacuauuu

SEQ ID NO: 169800 - RNA, 19 nt, Homo sapiens
cuaggcaacuguauugaua

SEQ ID NO: 169801 - RNA, 19 nt, Homo sapiens
gugcaagaguggcuuuaua

SEQ ID NO: 169802 - RNA, 19 nt, Homo sapiens
gugaagaugucaaugaaug

SEQ ID NO: 169803 - RNA, 19 nt, Homo sapiens
gugaagaggugcugccauu

SEQ ID NO: 169804 - RNA, 19 nt, Homo sapiens
caagaggacccauaucuga

SEQ ID NO: 169805 - RNA, 19 nt, Homo sapiens
ggagaauccugcaucaaca

SEQ ID NO: 169806 - RNA, 19 nt, Homo sapiens
ggaacgcgcuguguugaug

SEQ ID NO: 169807 - RNA, 19 nt, Homo sapiens
caagcugccucugagaaua

SEQ ID NO: 169808 - RNA, 19 nt, Homo sapiens
ggacaucgcugcgugaacu

SEQ ID NO: 169809 - RNA, 19 nt, Homo sapiens
ggaacaagaggacccauau

SEQ ID NO: 169810 - RNA, 19 nt, Homo sapiens
gacccaagcuacagugcaa

SEQ ID NO: 169811 - RNA, 19 nt, Homo sapiens
caagacggguuacuauuuu

SEQ ID NO: 169812 - RNA, 19 nt, Homo sapiens
gauggugucuccugugaag

SEQ ID NO: 169813 - RNA, 19 nt, Homo sapiens
gauggcaggucaugugaag

SEQ ID NO: 169814 - RNA, 19 nt, Homo sapiens
aagaguggcuuuauacaag

SEQ ID NO: 169815 - RNA, 19 nt, Homo sapiens
aaacggauaagaucauuga

SEQ ID NO: 169816 - RNA, 19 nt, Homo sapiens
gcgaaugcaagacggguua

SEQ ID NO: 169817 - RNA, 19 nt, Homo sapiens
gcucuaggcaacuguauug

SEQ ID NO: 169818 - RNA, 19 nt, Homo sapiens
caagaguggcuuuauacaa

SEQ ID NO: 169819 - RNA, 19 nt, Homo sapiens
auacaugcaucaacacaga

SEQ ID NO: 169820 - RNA, 19 nt, Homo sapiens
ggacaauagcugcaaagau

SEQ ID NO: 169821 - RNA, 19 nt, Homo sapiens
gaagaacgugcccaacugu

SEQ ID NO: 169822 - RNA, 19 nt, Homo sapiens
caaagauauugacgagugu

SEQ ID NO: 169823 - RNA, 19 nt, Homo sapiens
ccaagaaacggauaagauc

SEQ ID NO: 169824 - RNA, 19 nt, Homo sapiens
gcucagcgauguggaugga

SEQ ID NO: 169825 - RNA, 19 nt, Homo sapiens
ggccguggcuaccaucuca

SEQ ID NO: 169826 - RNA, 19 nt, Homo sapiens
agaagaacgugcccaacug

SEQ ID NO: 169827 - RNA, 19 nt, Homo sapiens
ggccagagcugcgaguaca

SEQ ID NO: 169828 - RNA, 19 nt, Homo sapiens
gcuacggaauccaaagaau

SEQ ID NO: 169829 - RNA, 19 nt, Homo sapiens
gagggaacgcgcuguguug

SEQ ID NO: 169830 - RNA, 19 nt, Homo sapiens
gaacaagaggacccauauc

SEQ ID NO: 169831 - RNA, 19 nt, Homo sapiens
caagaaacggauaagauca

SEQ ID NO: 169832 - RNA, 19 nt, Homo sapiens
ggagggaacgcgcuguguu

SEQ ID NO: 169833 - RNA, 19 nt, Homo sapiens
gaggacccauaucugaaug

SEQ ID NO: 169834 - RNA, 19 nt, Homo sapiens
agaaacggauaagaucauu

SEQ ID NO: 169835 - RNA, 19 nt, Homo sapiens
gcuaccagcucagcgaugu

SEQ ID NO: 169836 - RNA, 19 nt, Homo sapiens
ggaugugugucgaugucaa

SEQ ID NO: 169837 - RNA, 19 nt, Homo sapiens
ccaggagaccggagauuug

SEQ ID NO: 169838 - RNA, 19 nt, Homo sapiens
ugacuggcauccacaacug

SEQ ID NO: 169839 - RNA, 19 nt, Homo sapiens
gauauugacgagugugaga

SEQ ID NO: 169840 - RNA, 19 nt, Homo sapiens
gcaucagccuggccaacga

SEQ ID NO: 169841 - RNA, 19 nt, Homo sapiens
gaccggagauuuggauguc

SEQ ID NO: 169842 - RNA, 19 nt, Homo sapiens
gcgcuugccuugccaugag

SEQ ID NO: 169843 - RNA, 19 nt, Homo sapiens
gcaagaguggcuuuauaca

SEQ ID NO: 169844 - RNA, 19 nt, Homo sapiens
ucaacacagugggcucuuu

SEQ ID NO: 169845 - RNA, 19 nt, Homo sapiens
ggacugcucgcugccauau

SEQ ID NO: 169846 - RNA, 19 nt, Homo sapiens
agaacacgcugggcuccua

SEQ ID NO: 169847 - RNA, 19 nt, Homo sapiens
gaagaggugcugccauugc

SEQ ID NO: 169848 - RNA, 19 nt, Homo sapiens
ugugagagugguauucaua

SEQ ID NO: 169849 - RNA, 19 nt, Homo sapiens
aacgagaccugcuucaaca

SEQ ID NO: 169850 - RNA, 19 nt, Homo sapiens
caacgagaccugcuucaac

SEQ ID NO: 169851 - RNA, 19 nt, Homo sapiens
agaauacucugggauccuu

SEQ ID NO: 169852 - RNA, 19 nt, Homo sapiens
gccaggagaccggagauuu

SEQ ID NO: 169853 - RNA, 19 nt, Homo sapiens
aaugaguguuugaguauca

SEQ ID NO: 169854 - RNA, 19 nt, Homo sapiens
gugagagugguauucauaa

SEQ ID NO: 169855 - RNA, 19 nt, Homo sapiens
caacacagugggcucuuuc

SEQ ID NO: 169856 - RNA, 19 nt, Homo sapiens
gaaacggauaagaucauug

SEQ ID NO: 169857 - RNA, 19 nt, Homo sapiens
ccuacuaccaccucucuuu

SEQ ID NO: 169858 - RNA, 19 nt, Homo sapiens
ugauaucaaugaguguuug

SEQ ID NO: 169859 - RNA, 19 nt, Homo sapiens
agagugguauucauaacug

SEQ ID NO: 169860 - RNA, 19 nt, Homo sapiens
cugugaagaugucaaugaa

SEQ ID NO: 169861 - RNA, 19 nt, Homo sapiens
gcaugcagcuggccaucac

SEQ ID NO: 169862 - RNA, 19 nt, Homo sapiens
agaguggcuuuauacaaga

SEQ ID NO: 169863 - RNA, 19 nt, Homo sapiens
cugauggugucuccuguga

SEQ ID NO: 169864 - RNA, 19 nt, Homo sapiens
ucgagugcccugagaacua

SEQ ID NO: 169865 - RNA, 19 nt, Homo sapiens
cuacggaauccaaagaaug

SEQ ID NO: 169866 - RNA, 19 nt, Homo sapiens
auaagaucauugagguuga

SEQ ID NO: 169867 - RNA, 19 nt, Homo sapiens
gacaccggauggccacuca

SEQ ID NO: 169868 - RNA, 19 nt, Homo sapiens
cgagugcccugagaacuac

SEQ ID NO: 169869 - RNA, 19 nt, Homo sapiens
ggauaagaucauugagguu

SEQ ID NO: 169870 - RNA, 19 nt, Homo sapiens
ggagaccggagauuuggau

SEQ ID NO: 169871 - RNA, 19 nt, Homo sapiens
caggaugugugucgauguc

SEQ ID NO: 169872 - RNA, 19 nt, Homo sapiens
agaggacaauagcugcaaa

SEQ ID NO: 169873 - RNA, 19 nt, Homo sapiens
gaagaugucaaugaaugca

SEQ ID NO: 169874 - RNA, 19 nt, Homo sapiens
ccugugaagaugucaauga

SEQ ID NO: 169875 - RNA, 19 nt, Homo sapiens
ggccaagcuuuucaucuuu

SEQ ID NO: 169876 - RNA, 19 nt, Homo sapiens
aagcugccucugagaauaa

SEQ ID NO: 169877 - RNA, 19 nt, Homo sapiens
ccaagcugccucugagaau

SEQ ID NO: 169878 - RNA, 19 nt, Homo sapiens
cuacggcuccuaccagugu

SEQ ID NO: 169879 - RNA, 19 nt, Homo sapiens
gaacgcgcuguguugaugu

SEQ ID NO: 169880 - RNA, 19 nt, Homo sapiens
gagcucacagaggacaaua

SEQ ID NO: 169881 - RNA, 19 nt, Homo sapiens
aagcagcagugccgagaca

SEQ ID NO: 169882 - RNA, 19 nt, Homo sapiens
ggagugugccaacgucuac

SEQ ID NO: 169883 - RNA, 19 nt, Homo sapiens
cagaagaacgugcccaacu

SEQ ID NO: 169884 - RNA, 19 nt, Homo sapiens
gaguggcuuuauacaagau

SEQ ID NO: 169885 - RNA, 19 nt, Homo sapiens
cgaguacagccucaugguu

SEQ ID NO: 169886 - RNA, 19 nt, Homo sapiens
gagagugguauucauaacu

SEQ ID NO: 169887 - RNA, 19 nt, Homo sapiens
ccacaacugcuccaucaac

SEQ ID NO: 169888 - RNA, 19 nt, Homo sapiens
cauaugcuacggaauccaa

SEQ ID NO: 169889 - RNA, 19 nt, Homo sapiens
caaugaguguuugaguauc

SEQ ID NO: 169890 - RNA, 19 nt, Homo sapiens
ugagagugguauucauaac

SEQ ID NO: 169891 - RNA, 19 nt, Homo sapiens
ggccacaagugcgagaaca

SEQ ID NO: 169892 - RNA, 19 nt, Homo sapiens
ggacccauaucugaaugac

SEQ ID NO: 169893 - RNA, 19 nt, Homo sapiens
uaagaucauugagguugag

SEQ ID NO: 169894 - RNA, 19 nt, Homo sapiens
uccaagaaacggauaagau

SEQ ID NO: 169895 - RNA, 19 nt, Homo sapiens
auccacaacugcuccauca

SEQ ID NO: 169896 - RNA, 19 nt, Homo sapiens
aagaggacccauaucugaa

SEQ ID NO: 169897 - RNA, 19 nt, Homo sapiens
guggauggcaggucaugug

SEQ ID NO: 169898 - RNA, 19 nt, Homo sapiens
gacaauagcugcaaagaua

SEQ ID NO: 169899 - RNA, 19 nt, Homo sapiens
ggucugagcuuccuuagaa

SEQ ID NO: 169900 - RNA, 19 nt, Homo sapiens
gaauaaacaugcagguuga

SEQ ID NO: 169901 - RNA, 19 nt, Homo sapiens
gauugugucugguuaauuu

SEQ ID NO: 169902 - RNA, 19 nt, Homo sapiens
gcaagacggguuacuauuu

SEQ ID NO: 169903 - RNA, 19 nt, Homo sapiens
cuaggcaacuguauugaua

SEQ ID NO: 169904 - RNA, 19 nt, Homo sapiens
gugcaagaguggcuuuaua

SEQ ID NO: 169905 - RNA, 19 nt, Homo sapiens
gugaagaugucaaugaaug

SEQ ID NO: 169906 - RNA, 19 nt, Homo sapiens
gugaagaggugcugccauu

SEQ ID NO: 169907 - RNA, 19 nt, Homo sapiens
gaagaaggagcucaguaaa

SEQ ID NO: 169908 - RNA, 19 nt, Homo sapiens
caagaggacccauaucuga

SEQ ID NO: 169909 - RNA, 19 nt, Homo sapiens
ggagaauccugcaucaaca

SEQ ID NO: 169910 - RNA, 19 nt, Homo sapiens
ggaacgcgcuguguugaug

SEQ ID NO: 169911 - RNA, 19 nt, Homo sapiens
agaaggagcucaguaaaca

SEQ ID NO: 169912 - RNA, 19 nt, Homo sapiens
ggacaucgcugcgugaacu

SEQ ID NO: 169913 - RNA, 19 nt, Homo sapiens
ugaagaaggagcucaguaa

SEQ ID NO: 169914 - RNA, 19 nt, Homo sapiens
gcucauccaugugcuugua

SEQ ID NO: 169915 - RNA, 19 nt, Homo sapiens
ggaacaagaggacccauau

SEQ ID NO: 169916 - RNA, 19 nt, Homo sapiens
aagcauagccuccuuggaa

SEQ ID NO: 169917 - RNA, 19 nt, Homo sapiens
gaagauggaccuggacaga

SEQ ID NO: 169918 - RNA, 19 nt, Homo sapiens
gacccaagcuacagugcaa

SEQ ID NO: 169919 - RNA, 19 nt, Homo sapiens
caagacggguuacuauuuu

SEQ ID NO: 169920 - RNA, 19 nt, Homo sapiens
gauggugucuccugugaag

SEQ ID NO: 169921 - RNA, 19 nt, Homo sapiens
ccucgagucucccauguug

SEQ ID NO: 169922 - RNA, 19 nt, Homo sapiens
gaggauacccaccuugaug

SEQ ID NO: 169923 - RNA, 19 nt, Homo sapiens
gauggcaggucaugugaag

SEQ ID NO: 169924 - RNA, 19 nt, Homo sapiens
aagaguggcuuuauacaag

SEQ ID NO: 169925 - RNA, 19 nt, Homo sapiens
aaacggauaagaucauuga

SEQ ID NO: 169926 - RNA, 19 nt, Homo sapiens
uguauucucugcaacuuug

SEQ ID NO: 169927 - RNA, 19 nt, Homo sapiens
ccaccuugaugccuaguga

SEQ ID NO: 169928 - RNA, 19 nt, Homo sapiens
gcgaaugcaagacggguua

SEQ ID NO: 169929 - RNA, 19 nt, Homo sapiens
gcucuaggcaacuguauug

SEQ ID NO: 169930 - RNA, 19 nt, Homo sapiens
caagaguggcuuuauacaa

SEQ ID NO: 169931 - RNA, 19 nt, Homo sapiens
auacaugcaucaacacaga

SEQ ID NO: 169932 - RNA, 19 nt, Homo sapiens
ggacaauagcugcaaagau

SEQ ID NO: 169933 - RNA, 19 nt, Homo sapiens
gaagaacgugcccaacugu

SEQ ID NO: 169934 - RNA, 19 nt, Homo sapiens
caaagauauugacgagugu

SEQ ID NO: 169935 - RNA, 19 nt, Homo sapiens
ccaagaaacggauaagauc

SEQ ID NO: 169936 - RNA, 19 nt, Homo sapiens
guaguacauucuccaagau

SEQ ID NO: 169937 - RNA, 19 nt, Homo sapiens
acagucagcuccacaccuu

SEQ ID NO: 169938 - RNA, 19 nt, Homo sapiens
cagggauugugucugguua

SEQ ID NO: 169939 - RNA, 19 nt, Homo sapiens
gaugaagcauagccuccuu

SEQ ID NO: 169940 - RNA, 19 nt, Homo sapiens
gcucagcgauguggaugga

SEQ ID NO: 169941 - RNA, 19 nt, Homo sapiens
uguuguggcuguuccuuaa

SEQ ID NO: 169942 - RNA, 19 nt, Homo sapiens
gauggucugagcuuccuua

SEQ ID NO: 169943 - RNA, 19 nt, Homo sapiens
ggccguggcuaccaucuca

SEQ ID NO: 169944 - RNA, 19 nt, Homo sapiens
agaagaacgugcccaacug

SEQ ID NO: 169945 - RNA, 19 nt, Homo sapiens
ggccagagcugcgaguaca

SEQ ID NO: 169946 - RNA, 19 nt, Homo sapiens
gcuacggaauccaaagaau

SEQ ID NO: 169947 - RNA, 19 nt, Homo sapiens
gagggaacgcgcuguguug

SEQ ID NO: 169948 - RNA, 19 nt, Homo sapiens
gaacaagaggacccauauc

SEQ ID NO: 169949 - RNA, 19 nt, Homo sapiens
caagaaacggauaagauca

SEQ ID NO: 169950 - RNA, 19 nt, Homo sapiens
ggagggaacgcgcuguguu

SEQ ID NO: 169951 - RNA, 19 nt, Homo sapiens
gaggacccauaucugaaug

SEQ ID NO: 169952 - RNA, 19 nt, Homo sapiens
agaaacggauaagaucauu

SEQ ID NO: 169953 - RNA, 19 nt, Homo sapiens
ccaggagaccggagauuug

SEQ ID NO: 169954 - RNA, 19 nt, Homo sapiens
ccagcgggaucaaguaaag

SEQ ID NO: 169955 - RNA, 19 nt, Homo sapiens
gcuaccagcucagcgaugu

SEQ ID NO: 169956 - RNA, 19 nt, Homo sapiens
ggaugugugucgaugucaa

SEQ ID NO: 169957 - RNA, 19 nt, Homo sapiens
gcaucagccuggccaacga

SEQ ID NO: 169958 - RNA, 19 nt, Homo sapiens
ugacuggcauccacaacug

SEQ ID NO: 169959 - RNA, 19 nt, Homo sapiens
gauauugacgagugugaga

SEQ ID NO: 169960 - RNA, 19 nt, Homo sapiens
gaccggagauuuggauguc

SEQ ID NO: 169961 - RNA, 19 nt, Homo sapiens
ggacugcucgcugccauau

SEQ ID NO: 169962 - RNA, 19 nt, Homo sapiens
gcaagaguggcuuuauaca

SEQ ID NO: 169963 - RNA, 19 nt, Homo sapiens
ucaacacagugggcucuuu

SEQ ID NO: 169964 - RNA, 19 nt, Homo sapiens
gggauugugucugguuaau

SEQ ID NO: 169965 - RNA, 19 nt, Homo sapiens
agaacacgcugggcuccua

SEQ ID NO: 169966 - RNA, 19 nt, Homo sapiens
gaagaggugcugccauugc

SEQ ID NO: 169967 - RNA, 19 nt, Homo sapiens
ugugagagugguauucaua

SEQ ID NO: 169968 - RNA, 19 nt, Homo sapiens
aacgagaccugcuucaaca

SEQ ID NO: 169969 - RNA, 19 nt, Homo sapiens
caacgagaccugcuucaac

SEQ ID NO: 169970 - RNA, 19 nt, Homo sapiens
gccaggagaccggagauuu

SEQ ID NO: 169971 - RNA, 19 nt, Homo sapiens
agaauacucugggauccuu

SEQ ID NO: 169972 - RNA, 19 nt, Homo sapiens
cugguuaauuucuguauuc

SEQ ID NO: 169973 - RNA, 19 nt, Homo sapiens
agucucccauguuguagua

SEQ ID NO: 169974 - RNA, 19 nt, Homo sapiens
agauggaccuggacagaca

SEQ ID NO: 169975 - RNA, 19 nt, Homo sapiens
gaaacggauaagaucauug

SEQ ID NO: 169976 - RNA, 19 nt, Homo sapiens
aaugaguguuugaguauca

SEQ ID NO: 169977 - RNA, 19 nt, Homo sapiens
gugagagugguauucauaa

SEQ ID NO: 169978 - RNA, 19 nt, Homo sapiens
caacacagugggcucuuuc

SEQ ID NO: 169979 - RNA, 19 nt, Homo sapiens
gcagggauugugucugguu

SEQ ID NO: 169980 - RNA, 19 nt, Homo sapiens
ggaccuggacagacaguca

SEQ ID NO: 169981 - RNA, 19 nt, Homo sapiens
ccacgcagaaauccaagaa

SEQ ID NO: 169982 - RNA, 19 nt, Homo sapiens
ugauaucaaugaguguuug

SEQ ID NO: 169983 - RNA, 19 nt, Homo sapiens
agagugguauucauaacug

SEQ ID NO: 169984 - RNA, 19 nt, Homo sapiens
cugugaagaugucaaugaa

SEQ ID NO: 169985 - RNA, 19 nt, Homo sapiens
ucuuguggcuuuagcaugu

SEQ ID NO: 169986 - RNA, 19 nt, Homo sapiens
ucgagucucccauguugua

SEQ ID NO: 169987 - RNA, 19 nt, Homo sapiens
agaguggcuuuauacaaga

SEQ ID NO: 169988 - RNA, 19 nt, Homo sapiens
cugauggugucuccuguga

SEQ ID NO: 169989 - RNA, 19 nt, Homo sapiens
cccagcagaugaagcauag

SEQ ID NO: 169990 - RNA, 19 nt, Homo sapiens
uugcagacuuggcucagaa

SEQ ID NO: 169991 - RNA, 19 nt, Homo sapiens
gcauagccuccuuggaaug

SEQ ID NO: 169992 - RNA, 19 nt, Homo sapiens
cuacggaauccaaagaaug

SEQ ID NO: 169993 - RNA, 19 nt, Homo sapiens
ucgagugcccugagaacua

SEQ ID NO: 169994 - RNA, 19 nt, Homo sapiens
auaagaucauugagguuga

SEQ ID NO: 169995 - RNA, 19 nt, Homo sapiens
gacaccggauggccacuca

SEQ ID NO: 169996 - RNA, 19 nt, Homo sapiens
ggagcucaguaaacaucug

SEQ ID NO: 169997 - RNA, 19 nt, Homo sapiens
ggauaagaucauugagguu

SEQ ID NO: 169998 - RNA, 19 nt, Homo sapiens
gacaauagcugcaaagaua

SEQ ID NO: 169999 - RNA, 19 nt, Homo sapiens
gcaagacggguuacuauuu

SEQ ID NO: 170000 - RNA, 19 nt, Homo sapiens
cuaggcaacuguauugaua

SEQ ID NO: 170001 - RNA, 19 nt, Homo sapiens
gugcaagaguggcuuuaua

SEQ ID NO: 170002 - RNA, 19 nt, Homo sapiens
gugaagaugucaaugaaug

SEQ ID NO: 170003 - RNA, 19 nt, Homo sapiens
gugaagaggugcugccauu

SEQ ID NO: 170004 - RNA, 19 nt, Homo sapiens
caagaggacccauaucuga

SEQ ID NO: 170005 - RNA, 19 nt, Homo sapiens
ggagaauccugcaucaaca

SEQ ID NO: 170006 - RNA, 19 nt, Homo sapiens
ggaacgcgcuguguugaug

SEQ ID NO: 170007 - RNA, 19 nt, Homo sapiens
ggacaucgcugcgugaacu

SEQ ID NO: 170008 - RNA, 19 nt, Homo sapiens
gcauaaggccaacauguau

SEQ ID NO: 170009 - RNA, 19 nt, Homo sapiens
ggaacaagaggacccauau

SEQ ID NO: 170010 - RNA, 19 nt, Homo sapiens
aagcugagccagaugaaua

SEQ ID NO: 170011 - RNA, 19 nt, Homo sapiens
ggucuguacuuguuuauac

SEQ ID NO: 170012 - RNA, 19 nt, Homo sapiens
guuuauacccucagacuuu

SEQ ID NO: 170013 - RNA, 19 nt, Homo sapiens
gacccaagcuacagugcaa

SEQ ID NO: 170014 - RNA, 19 nt, Homo sapiens
caagacggguuacuauuuu

SEQ ID NO: 170015 - RNA, 19 nt, Homo sapiens
gauggugucuccugugaag

SEQ ID NO: 170016 - RNA, 19 nt, Homo sapiens
gauggcaggucaugugaag

SEQ ID NO: 170017 - RNA, 19 nt, Homo sapiens
aagaguggcuuuauacaag

SEQ ID NO: 170018 - RNA, 19 nt, Homo sapiens
aaacggauaagaucauuga

SEQ ID NO: 170019 - RNA, 19 nt, Homo sapiens
gcgaaugcaagacggguua

SEQ ID NO: 170020 - RNA, 19 nt, Homo sapiens
gcucuaggcaacuguauug

SEQ ID NO: 170021 - RNA, 19 nt, Homo sapiens
caagaguggcuuuauacaa

SEQ ID NO: 170022 - RNA, 19 nt, Homo sapiens
auacaugcaucaacacaga

SEQ ID NO: 170023 - RNA, 19 nt, Homo sapiens
ggacaauagcugcaaagau

SEQ ID NO: 170024 - RNA, 19 nt, Homo sapiens
gaagaacgugcccaacugu

SEQ ID NO: 170025 - RNA, 19 nt, Homo sapiens
caaagauauugacgagugu

SEQ ID NO: 170026 - RNA, 19 nt, Homo sapiens
ccaagaaacggauaagauc

SEQ ID NO: 170027 - RNA, 19 nt, Homo sapiens
gcucagcgauguggaugga

SEQ ID NO: 170028 - RNA, 19 nt, Homo sapiens
ggccguggcuaccaucuca

SEQ ID NO: 170029 - RNA, 19 nt, Homo sapiens
agaagaacgugcccaacug

SEQ ID NO: 170030 - RNA, 19 nt, Homo sapiens
ggccagagcugcgaguaca

SEQ ID NO: 170031 - RNA, 19 nt, Homo sapiens
gcuacggaauccaaagaau

SEQ ID NO: 170032 - RNA, 19 nt, Homo sapiens
gagggaacgcgcuguguug

SEQ ID NO: 170033 - RNA, 19 nt, Homo sapiens
gaacaagaggacccauauc

SEQ ID NO: 170034 - RNA, 19 nt, Homo sapiens
caagaaacggauaagauca

SEQ ID NO: 170035 - RNA, 19 nt, Homo sapiens
uugaaaaccuugcucauuu

SEQ ID NO: 170036 - RNA, 19 nt, Homo sapiens
guuagguauuuguagcaua

SEQ ID NO: 170037 - RNA, 19 nt, Homo sapiens
ggagggaacgcgcuguguu

SEQ ID NO: 170038 - RNA, 19 nt, Homo sapiens
gaggacccauaucugaaug

SEQ ID NO: 170039 - RNA, 19 nt, Homo sapiens
agaaacggauaagaucauu

SEQ ID NO: 170040 - RNA, 19 nt, Homo sapiens
gcuaccagcucagcgaugu

SEQ ID NO: 170041 - RNA, 19 nt, Homo sapiens
ggaugugugucgaugucaa

SEQ ID NO: 170042 - RNA, 19 nt, Homo sapiens
ccaggagaccggagauuug

SEQ ID NO: 170043 - RNA, 19 nt, Homo sapiens
ugacuguggucuguacuug

SEQ ID NO: 170044 - RNA, 19 nt, Homo sapiens
ggaaccugcgggacucuuu

SEQ ID NO: 170045 - RNA, 19 nt, Homo sapiens
ugacuggcauccacaacug

SEQ ID NO: 170046 - RNA, 19 nt, Homo sapiens
gcaucagccuggccaacga

SEQ ID NO: 170047 - RNA, 19 nt, Homo sapiens
gauauugacgagugugaga

SEQ ID NO: 170048 - RNA, 19 nt, Homo sapiens
gaccggagauuuggauguc

SEQ ID NO: 170049 - RNA, 19 nt, Homo sapiens
guaucaagcugagccagau

SEQ ID NO: 170050 - RNA, 19 nt, Homo sapiens
gcaagaguggcuuuauaca

SEQ ID NO: 170051 - RNA, 19 nt, Homo sapiens
ucaacacagugggcucuuu

SEQ ID NO: 170052 - RNA, 19 nt, Homo sapiens
ggacugcucgcugccauau

SEQ ID NO: 170053 - RNA, 19 nt, Homo sapiens
agaacacgcugggcuccua

SEQ ID NO: 170054 - RNA, 19 nt, Homo sapiens
ugugagagugguauucaua

SEQ ID NO: 170055 - RNA, 19 nt, Homo sapiens
gaagaggugcugccauugc

SEQ ID NO: 170056 - RNA, 19 nt, Homo sapiens
ugagccagaugaauaaguc

SEQ ID NO: 170057 - RNA, 19 nt, Homo sapiens
uguggucuguacuuguuua

SEQ ID NO: 170058 - RNA, 19 nt, Homo sapiens
uaacaucaucuucgacauc

SEQ ID NO: 170059 - RNA, 19 nt, Homo sapiens
aacgagaccugcuucaaca

SEQ ID NO: 170060 - RNA, 19 nt, Homo sapiens
caacgagaccugcuucaac

SEQ ID NO: 170061 - RNA, 19 nt, Homo sapiens
gccaggagaccggagauuu

SEQ ID NO: 170062 - RNA, 19 nt, Homo sapiens
agaauacucugggauccuu

SEQ ID NO: 170063 - RNA, 19 nt, Homo sapiens
gaaacggauaagaucauug

SEQ ID NO: 170064 - RNA, 19 nt, Homo sapiens
aaugaguguuugaguauca

SEQ ID NO: 170065 - RNA, 19 nt, Homo sapiens
gugagagugguauucauaa

SEQ ID NO: 170066 - RNA, 19 nt, Homo sapiens
caacacagugggcucuuuc

SEQ ID NO: 170067 - RNA, 19 nt, Homo sapiens
ugauaucaaugaguguuug

SEQ ID NO: 170068 - RNA, 19 nt, Homo sapiens
agagugguauucauaacug

SEQ ID NO: 170069 - RNA, 19 nt, Homo sapiens
cugugaagaugucaaugaa

SEQ ID NO: 170070 - RNA, 19 nt, Homo sapiens
gcaccuccaggccaaauca

SEQ ID NO: 170071 - RNA, 19 nt, Homo sapiens
uccugaagcuggagaugaa

SEQ ID NO: 170072 - RNA, 19 nt, Homo sapiens
agaguggcuuuauacaaga

SEQ ID NO: 170073 - RNA, 19 nt, Homo sapiens
cugauggugucuccuguga

SEQ ID NO: 170074 - RNA, 19 nt, Homo sapiens
ucaucucgcugccuaccuu

SEQ ID NO: 170075 - RNA, 19 nt, Homo sapiens
uagcauaaggccaacaugu

SEQ ID NO: 170076 - RNA, 19 nt, Homo sapiens
acuguggucuguacuuguu

SEQ ID NO: 170077 - RNA, 19 nt, Homo sapiens
caucaucaagcguuacaug

SEQ ID NO: 170078 - RNA, 19 nt, Homo sapiens
ucgagugcccugagaacua

SEQ ID NO: 170079 - RNA, 19 nt, Homo sapiens
cuacggaauccaaagaaug

SEQ ID NO: 170080 - RNA, 19 nt, Homo sapiens
auaagaucauugagguuga

SEQ ID NO: 170081 - RNA, 19 nt, Homo sapiens
gacaccggauggccacuca

SEQ ID NO: 170082 - RNA, 19 nt, Homo sapiens
ggagaccggagauuuggau

SEQ ID NO: 170083 - RNA, 19 nt, Homo sapiens
cgagugcccugagaacuac

SEQ ID NO: 170084 - RNA, 19 nt, Homo sapiens
caggaugugugucgauguc

SEQ ID NO: 170085 - RNA, 19 nt, Homo sapiens
ggauaagaucauugagguu

SEQ ID NO: 170086 - RNA, 19 nt, Homo sapiens
agaggacaauagcugcaaa

SEQ ID NO: 170087 - RNA, 19 nt, Homo sapiens
gaagaugucaaugaaugca

SEQ ID NO: 170088 - RNA, 19 nt, Homo sapiens
ccugugaagaugucaauga

SEQ ID NO: 170089 - RNA, 19 nt, Homo sapiens
agcauaaggccaacaugua

SEQ ID NO: 170090 - RNA, 19 nt, Homo sapiens
cuacggcuccuaccagugu

SEQ ID NO: 170091 - RNA, 19 nt, Homo sapiens
aagcagcagugccgagaca

SEQ ID NO: 170092 - RNA, 19 nt, Homo sapiens
gaacgcgcuguguugaugu

SEQ ID NO: 170093 - RNA, 19 nt, Homo sapiens
gagcucacagaggacaaua

SEQ ID NO: 170094 - RNA, 19 nt, Homo sapiens
cgaguacagccucaugguu

SEQ ID NO: 170095 - RNA, 19 nt, Homo sapiens
ggagugugccaacgucuac

SEQ ID NO: 170096 - RNA, 19 nt, Homo sapiens
cagaagaacgugcccaacu

SEQ ID NO: 170097 - RNA, 19 nt, Homo sapiens
gaguggcuuuauacaagau

SEQ ID NO: 170098 - RNA, 19 nt, Homo sapiens
gacaauagcugcaaagaua

SEQ ID NO: 170099 - RNA, 19 nt, Homo sapiens
caauaaaugugcuggagua

SEQ ID NO: 170100 - RNA, 19 nt, Homo sapiens
gcaagacggguuacuauuu

SEQ ID NO: 170101 - RNA, 19 nt, Homo sapiens
cuaggcaacuguauugaua

SEQ ID NO: 170102 - RNA, 19 nt, Homo sapiens
uaaaugugcuggaguaaca

SEQ ID NO: 170103 - RNA, 19 nt, Homo sapiens
gaaagcacccaguucauga

SEQ ID NO: 170104 - RNA, 19 nt, Homo sapiens
gugcaagaguggcuuuaua

SEQ ID NO: 170105 - RNA, 19 nt, Homo sapiens
gagaagagaaggcaaguug

SEQ ID NO: 170106 - RNA, 19 nt, Homo sapiens
gugaagaugucaaugaaug

SEQ ID NO: 170107 - RNA, 19 nt, Homo sapiens
gugaagaggugcugccauu

SEQ ID NO: 170108 - RNA, 19 nt, Homo sapiens
guauauaccacuuccauuu

SEQ ID NO: 170109 - RNA, 19 nt, Homo sapiens
ucaggucacucaauaaaug

SEQ ID NO: 170110 - RNA, 19 nt, Homo sapiens
caagaggacccauaucuga

SEQ ID NO: 170111 - RNA, 19 nt, Homo sapiens
ggagaauccugcaucaaca

SEQ ID NO: 170112 - RNA, 19 nt, Homo sapiens
ggaacgcgcuguguugaug

SEQ ID NO: 170113 - RNA, 19 nt, Homo sapiens
ggaauguguugccuccaaa

SEQ ID NO: 170114 - RNA, 19 nt, Homo sapiens
ggaaugcugcuguucauga

SEQ ID NO: 170115 - RNA, 19 nt, Homo sapiens
ggacaucgcugcgugaacu

SEQ ID NO: 170116 - RNA, 19 nt, Homo sapiens
gcucaagcccgaucacgua

SEQ ID NO: 170117 - RNA, 19 nt, Homo sapiens
ggaacaagaggacccauau

SEQ ID NO: 170118 - RNA, 19 nt, Homo sapiens
caagcccgaucacguauau

SEQ ID NO: 170119 - RNA, 19 nt, Homo sapiens
ucauguaacuuaacuugug

SEQ ID NO: 170120 - RNA, 19 nt, Homo sapiens
gacccaagcuacagugcaa

SEQ ID NO: 170121 - RNA, 19 nt, Homo sapiens
caagacggguuacuauuuu

SEQ ID NO: 170122 - RNA, 19 nt, Homo sapiens
gauggugucuccugugaag

SEQ ID NO: 170123 - RNA, 19 nt, Homo sapiens
ccuuucaggucacucaaua

SEQ ID NO: 170124 - RNA, 19 nt, Homo sapiens
gauggcaggucaugugaag

SEQ ID NO: 170125 - RNA, 19 nt, Homo sapiens
aagaguggcuuuauacaag

SEQ ID NO: 170126 - RNA, 19 nt, Homo sapiens
aaacggauaagaucauuga

SEQ ID NO: 170127 - RNA, 19 nt, Homo sapiens
gaucacguauauaccacuu

SEQ ID NO: 170128 - RNA, 19 nt, Homo sapiens
ggagaccacaggcauuuga

SEQ ID NO: 170129 - RNA, 19 nt, Homo sapiens
gcgaaugcaagacggguua

SEQ ID NO: 170130 - RNA, 19 nt, Homo sapiens
gcucuaggcaacuguauug

SEQ ID NO: 170131 - RNA, 19 nt, Homo sapiens
caagaguggcuuuauacaa

SEQ ID NO: 170132 - RNA, 19 nt, Homo sapiens
auacaugcaucaacacaga

SEQ ID NO: 170133 - RNA, 19 nt, Homo sapiens
ggacaauagcugcaaagau

SEQ ID NO: 170134 - RNA, 19 nt, Homo sapiens
gcagggccuugcuccgaaa

SEQ ID NO: 170135 - RNA, 19 nt, Homo sapiens
gaagaacgugcccaacugu

SEQ ID NO: 170136 - RNA, 19 nt, Homo sapiens
caaagauauugacgagugu

SEQ ID NO: 170137 - RNA, 19 nt, Homo sapiens
ccaagaaacggauaagauc

SEQ ID NO: 170138 - RNA, 19 nt, Homo sapiens
ccacuuccauuugaugaug

SEQ ID NO: 170139 - RNA, 19 nt, Homo sapiens
gcucagcgauguggaugga

SEQ ID NO: 170140 - RNA, 19 nt, Homo sapiens
ucagaaagcacccaguuca

SEQ ID NO: 170141 - RNA, 19 nt, Homo sapiens
ggccagagcugcgaguaca

SEQ ID NO: 170142 - RNA, 19 nt, Homo sapiens
ggccguggcuaccaucuca

SEQ ID NO: 170143 - RNA, 19 nt, Homo sapiens
agaagaacgugcccaacug

SEQ ID NO: 170144 - RNA, 19 nt, Homo sapiens
gcuacggaauccaaagaau

SEQ ID NO: 170145 - RNA, 19 nt, Homo sapiens
gagggaacgcgcuguguug

SEQ ID NO: 170146 - RNA, 19 nt, Homo sapiens
gaacaagaggacccauauc

SEQ ID NO: 170147 - RNA, 19 nt, Homo sapiens
caagaaacggauaagauca

SEQ ID NO: 170148 - RNA, 19 nt, Homo sapiens
cuagagaccgccacuguga

SEQ ID NO: 170149 - RNA, 19 nt, Homo sapiens
gacccagagucaaacauuc

SEQ ID NO: 170150 - RNA, 19 nt, Homo sapiens
gcacccaguucaugauagg

SEQ ID NO: 170151 - RNA, 19 nt, Homo sapiens
ggucagaaagcacccaguu

SEQ ID NO: 170152 - RNA, 19 nt, Homo sapiens
ggagggaacgcgcuguguu

SEQ ID NO: 170153 - RNA, 19 nt, Homo sapiens
gaggacccauaucugaaug

SEQ ID NO: 170154 - RNA, 19 nt, Homo sapiens
agaaacggauaagaucauu

SEQ ID NO: 170155 - RNA, 19 nt, Homo sapiens
gcuaccagcucagcgaugu

SEQ ID NO: 170156 - RNA, 19 nt, Homo sapiens
ggaugugugucgaugucaa

SEQ ID NO: 170157 - RNA, 19 nt, Homo sapiens
ccaggagaccggagauuug

SEQ ID NO: 170158 - RNA, 19 nt, Homo sapiens
gaccggagauuuggauguc

SEQ ID NO: 170159 - RNA, 19 nt, Homo sapiens
auauaccacuuccauuuga

SEQ ID NO: 170160 - RNA, 19 nt, Homo sapiens
guagggaacucugcaugag

SEQ ID NO: 170161 - RNA, 19 nt, Homo sapiens
ugacuggcauccacaacug

SEQ ID NO: 170162 - RNA, 19 nt, Homo sapiens
gauauugacgagugugaga

SEQ ID NO: 170163 - RNA, 19 nt, Homo sapiens
gcaucagccuggccaacga

SEQ ID NO: 170164 - RNA, 19 nt, Homo sapiens
ggacugcucgcugccauau

SEQ ID NO: 170165 - RNA, 19 nt, Homo sapiens
ccacugacaccucaagcaa

SEQ ID NO: 170166 - RNA, 19 nt, Homo sapiens
gcaagaguggcuuuauaca

SEQ ID NO: 170167 - RNA, 19 nt, Homo sapiens
ucaacacagugggcucuuu

SEQ ID NO: 170168 - RNA, 19 nt, Homo sapiens
ggaccugucauagagcuuu

SEQ ID NO: 170169 - RNA, 19 nt, Homo sapiens
gauaggcaguucaggucau

SEQ ID NO: 170170 - RNA, 19 nt, Homo sapiens
ccaacuuuauggcuagaug

SEQ ID NO: 170171 - RNA, 19 nt, Homo sapiens
guucaugaccaacuuuaug

SEQ ID NO: 170172 - RNA, 19 nt, Homo sapiens
gagccacuuccucauguaa

SEQ ID NO: 170173 - RNA, 19 nt, Homo sapiens
agaacacgcugggcuccua

SEQ ID NO: 170174 - RNA, 19 nt, Homo sapiens
gaagaggugcugccauugc

SEQ ID NO: 170175 - RNA, 19 nt, Homo sapiens
ugugagagugguauucaua

SEQ ID NO: 170176 - RNA, 19 nt, Homo sapiens
gcagccagcauccuuaucu

SEQ ID NO: 170177 - RNA, 19 nt, Homo sapiens
aaagaagaguaguuaucug

SEQ ID NO: 170178 - RNA, 19 nt, Homo sapiens
gauggaaugcugcuguuca

SEQ ID NO: 170179 - RNA, 19 nt, Homo sapiens
ggugcaggcuggagaagag

SEQ ID NO: 170180 - RNA, 19 nt, Homo sapiens
aacgagaccugcuucaaca

SEQ ID NO: 170181 - RNA, 19 nt, Homo sapiens
caacgagaccugcuucaac

SEQ ID NO: 170182 - RNA, 19 nt, Homo sapiens
gccaggagaccggagauuu

SEQ ID NO: 170183 - RNA, 19 nt, Homo sapiens
agaauacucugggauccuu

SEQ ID NO: 170184 - RNA, 19 nt, Homo sapiens
gaaugcugcuguucaugac

SEQ ID NO: 170185 - RNA, 19 nt, Homo sapiens
uauauaccacuuccauuug

SEQ ID NO: 170186 - RNA, 19 nt, Homo sapiens
gaaacggauaagaucauug

SEQ ID NO: 170187 - RNA, 19 nt, Homo sapiens
aaugaguguuugaguauca

SEQ ID NO: 170188 - RNA, 19 nt, Homo sapiens
gugagagugguauucauaa

SEQ ID NO: 170189 - RNA, 19 nt, Homo sapiens
caacacagugggcucuuuc

SEQ ID NO: 170190 - RNA, 19 nt, Homo sapiens
ugauaucaaugaguguuug

SEQ ID NO: 170191 - RNA, 19 nt, Homo sapiens
agagugguauucauaacug

SEQ ID NO: 170192 - RNA, 19 nt, Homo sapiens
cugugaagaugucaaugaa

SEQ ID NO: 170193 - RNA, 19 nt, Homo sapiens
cauagagcuuucuccuguu

SEQ ID NO: 170194 - RNA, 19 nt, Homo sapiens
agaguggcuuuauacaaga

SEQ ID NO: 170195 - RNA, 19 nt, Homo sapiens
ccaccaaagcccaguaaca

SEQ ID NO: 170196 - RNA, 19 nt, Homo sapiens
acauucaguuuccaccaaa

SEQ ID NO: 170197 - RNA, 19 nt, Homo sapiens
cuagaugggucagaaagca

SEQ ID NO: 170198 - RNA, 19 nt, Homo sapiens
gcccaacgaugaucaaaua

SEQ ID NO: 170199 - RNA, 19 nt, Homo sapiens
ccagugaccuuguauuuau

SEQ ID NO: 170200 - RNA, 19 nt, Homo sapiens
gcauggagguguucagcua

SEQ ID NO: 170201 - RNA, 19 nt, Homo sapiens
gaucaaauauggcaucaac

SEQ ID NO: 170202 - RNA, 19 nt, Homo sapiens
gcaaggccauguccaacaa

SEQ ID NO: 170203 - RNA, 19 nt, Homo sapiens
caacgaugaucaaauaugg

SEQ ID NO: 170204 - RNA, 19 nt, Homo sapiens
ucaccgagaugccgacuga

SEQ ID NO: 170205 - RNA, 19 nt, Homo sapiens
gagcugagcccagagauga

SEQ ID NO: 170206 - RNA, 19 nt, Homo sapiens
ccacgcaccuggcugaguu

SEQ ID NO: 170207 - RNA, 19 nt, Homo sapiens
gguagcagguuccuucugu

SEQ ID NO: 170208 - RNA, 19 nt, Homo sapiens
acugauaacuucauugaga

SEQ ID NO: 170209 - RNA, 19 nt, Homo sapiens
gaacuuugacgcccucuuc

SEQ ID NO: 170210 - RNA, 19 nt, Homo sapiens
gcacgacaccuucuuccuu

SEQ ID NO: 170211 - RNA, 19 nt, Homo sapiens
cuaauaaagugggcaguug

SEQ ID NO: 170212 - RNA, 19 nt, Homo sapiens
cgacugauaacuucauuga

SEQ ID NO: 170213 - RNA, 19 nt, Homo sapiens
ggagcgagcugaggaagag

SEQ ID NO: 170214 - RNA, 19 nt, Homo sapiens
ucaaauauggcaucaacaa

SEQ ID NO: 170215 - RNA, 19 nt, Homo sapiens
gagaacgugucggucauug

SEQ ID NO: 170216 - RNA, 19 nt, Homo sapiens
ggccagugaccuuguauuu

SEQ ID NO: 170217 - RNA, 19 nt, Homo sapiens
gccagugaccuuguauuua

SEQ ID NO: 170218 - RNA, 19 nt, Homo sapiens
ggucuuccguccagagaug

SEQ ID NO: 170219 - RNA, 19 nt, Homo sapiens
ucacuccggucaaguacuu

SEQ ID NO: 170220 - RNA, 19 nt, Homo sapiens
ccaugaggcccguguguuu

SEQ ID NO: 170221 - RNA, 19 nt, Homo sapiens
gcagguuccuucuguuguc

SEQ ID NO: 170222 - RNA, 19 nt, Homo sapiens
gaugccgacugauaacuuc

SEQ ID NO: 170223 - RNA, 19 nt, Homo sapiens
gcuguuggcugaagugacu

SEQ ID NO: 170224 - RNA, 19 nt, Homo sapiens
uugcaucccuggccaguga

SEQ ID NO: 170225 - RNA, 19 nt, Homo sapiens
ucaaguacuucuccaucga

SEQ ID NO: 170226 - RNA, 19 nt, Homo sapiens
gcaaagugggcuucagcaa

SEQ ID NO: 170227 - RNA, 19 nt, Homo sapiens
ucacagggguacaaguaua

SEQ ID NO: 170228 - RNA, 19 nt, Homo sapiens
ggucaucgaggcugaacuu

SEQ ID NO: 170229 - RNA, 19 nt, Homo sapiens
guaccagcaucuccaagca

SEQ ID NO: 170230 - RNA, 19 nt, Homo sapiens
ccgagaugccgacugauaa

SEQ ID NO: 170231 - RNA, 19 nt, Homo sapiens
gacaugggccacucuagga

SEQ ID NO: 170232 - RNA, 19 nt, Homo sapiens
caaauauggcaucaacaau

SEQ ID NO: 170233 - RNA, 19 nt, Homo sapiens
acacagagcccagcaugga

SEQ ID NO: 170234 - RNA, 19 nt, Homo sapiens
ucacgcaacuccgcuucaa

SEQ ID NO: 170235 - RNA, 19 nt, Homo sapiens
ggaagcuguuggcugaagu

SEQ ID NO: 170236 - RNA, 19 nt, Homo sapiens
ggauucggguggacaagag

SEQ ID NO: 170237 - RNA, 19 nt, Homo sapiens
guagcagguuccuucuguu

SEQ ID NO: 170238 - RNA, 19 nt, Homo sapiens
uggcugaagugacucugaa

SEQ ID NO: 170239 - RNA, 19 nt, Homo sapiens
gcagaugguguaugacagu

SEQ ID NO: 170240 - RNA, 19 nt, Homo sapiens
ccaacgaugaucaaauaug

SEQ ID NO: 170241 - RNA, 19 nt, Homo sapiens
aagugacucugaagaccua

SEQ ID NO: 170242 - RNA, 19 nt, Homo sapiens
caccaaggccugaagaagu

SEQ ID NO: 170243 - RNA, 19 nt, Homo sapiens
gguacaaguauaacuggaa

SEQ ID NO: 170244 - RNA, 19 nt, Homo sapiens
uguggugugucuacuguga

SEQ ID NO: 170245 - RNA, 19 nt, Homo sapiens
accaaggccugaagaagug

SEQ ID NO: 170246 - RNA, 19 nt, Homo sapiens
gcccguguguuucgaagca

SEQ ID NO: 170247 - RNA, 19 nt, Homo sapiens
gccgacugauaacuucauu

SEQ ID NO: 170248 - RNA, 19 nt, Homo sapiens
ugggccaccuauugucuaa

SEQ ID NO: 170249 - RNA, 19 nt, Homo sapiens
uggcugaguuccaccagau

SEQ ID NO: 170250 - RNA, 19 nt, Homo sapiens
gagagcuccuucuggaacu

SEQ ID NO: 170251 - RNA, 19 nt, Homo sapiens
caagguccgcucccaguuc

SEQ ID NO: 170252 - RNA, 19 nt, Homo sapiens
cuggagcgcccaacgauga

SEQ ID NO: 170253 - RNA, 19 nt, Homo sapiens
gcucacagggguacaagua

SEQ ID NO: 170254 - RNA, 19 nt, Homo sapiens
cuucaagcccuacaacuuc

SEQ ID NO: 170255 - RNA, 19 nt, Homo sapiens
uagcagguuccuucuguug

SEQ ID NO: 170256 - RNA, 19 nt, Homo sapiens
uggacagcauggaggauga

SEQ ID NO: 170257 - RNA, 19 nt, Homo sapiens
ugaggaagaggaagcuguu

SEQ ID NO: 170258 - RNA, 19 nt, Homo sapiens
gcugaagugacucugaaga

SEQ ID NO: 170259 - RNA, 19 nt, Homo sapiens
gcccagagcgagcuuaugc

SEQ ID NO: 170260 - RNA, 19 nt, Homo sapiens
cagugaccuuguauuuaug

SEQ ID NO: 170261 - RNA, 19 nt, Homo sapiens
ccuggccagugaccuugua

SEQ ID NO: 170262 - RNA, 19 nt, Homo sapiens
cugcugcgcuccuuugcau

SEQ ID NO: 170263 - RNA, 19 nt, Homo sapiens
gaagcuguuggcugaagug

SEQ ID NO: 170264 - RNA, 19 nt, Homo sapiens
ucaagcggacccacucuca

SEQ ID NO: 170265 - RNA, 19 nt, Homo sapiens
gagcuccuucuggaacuuu

SEQ ID NO: 170266 - RNA, 19 nt, Homo sapiens
ucagcaaggccauguccaa

SEQ ID NO: 170267 - RNA, 19 nt, Homo sapiens
gaaccugcagaugguguau

SEQ ID NO: 170268 - RNA, 19 nt, Homo sapiens
ccuacaacccauacacaga

SEQ ID NO: 170269 - RNA, 19 nt, Homo sapiens
ucaccaagcuggguaucac

SEQ ID NO: 170270 - RNA, 19 nt, Homo sapiens
gcccuucacuccggucaag

SEQ ID NO: 170271 - RNA, 19 nt, Homo sapiens
uguguggugugucuacugu

SEQ ID NO: 170272 - RNA, 19 nt, Homo sapiens
accugcagaugguguauga

SEQ ID NO: 170273 - RNA, 19 nt, Homo sapiens
accgagaugccgacugaua

SEQ ID NO: 170274 - RNA, 19 nt, Homo sapiens
ccuucaagcccuacaacuu

SEQ ID NO: 170275 - RNA, 19 nt, Homo sapiens
caccagagcugccgacuug

SEQ ID NO: 170276 - RNA, 19 nt, Homo sapiens
ucaaauugcugcuuggauu

SEQ ID NO: 170277 - RNA, 19 nt, Homo sapiens
gcuuggauuugcauauuua

SEQ ID NO: 170278 - RNA, 19 nt, Homo sapiens
gcccugagcuggacuacuu

SEQ ID NO: 170279 - RNA, 19 nt, Homo sapiens
gcagcugccugugguguuu

SEQ ID NO: 170280 - RNA, 19 nt, Homo sapiens
caauacagauggcuucaag

SEQ ID NO: 170281 - RNA, 19 nt, Homo sapiens
ggccuggacucgcucauga

SEQ ID NO: 170282 - RNA, 19 nt, Homo sapiens
cgacuuggcugcugucaac

SEQ ID NO: 170283 - RNA, 19 nt, Homo sapiens
ggaagcacauuggcaaagu

SEQ ID NO: 170284 - RNA, 19 nt, Homo sapiens
gaacaugcccagccugaag

SEQ ID NO: 170285 - RNA, 19 nt, Homo sapiens
gggacaaccuggaguucuu

SEQ ID NO: 170286 - RNA, 19 nt, Homo sapiens
gaggaaggaggguguguuu

SEQ ID NO: 170287 - RNA, 19 nt, Homo sapiens
gagcguaucugugagaaac

SEQ ID NO: 170288 - RNA, 19 nt, Homo sapiens
ggcagaagcuguacacacu

SEQ ID NO: 170289 - RNA, 19 nt, Homo sapiens
ucacggacauggagcacaa

SEQ ID NO: 170290 - RNA, 19 nt, Homo sapiens
gagauggcuugcuggagaa

SEQ ID NO: 170291 - RNA, 19 nt, Homo sapiens
caugguggcugcccugaga

SEQ ID NO: 170292 - RNA, 19 nt, Homo sapiens
gagagcaccuuugaugaca

SEQ ID NO: 170293 - RNA, 19 nt, Homo sapiens
gacgagagcaccuuugaug

SEQ ID NO: 170294 - RNA, 19 nt, Homo sapiens
ggacagugcaucaaagaag

SEQ ID NO: 170295 - RNA, 19 nt, Homo sapiens
acaauuaaaccgcauguga

SEQ ID NO: 170296 - RNA, 19 nt, Homo sapiens
gugcuuggauuugcauauu

SEQ ID NO: 170297 - RNA, 19 nt, Homo sapiens
ggacuacuuuguggucuuc

SEQ ID NO: 170298 - RNA, 19 nt, Homo sapiens
ugacaucguccauucguuu

SEQ ID NO: 170299 - RNA, 19 nt, Homo sapiens
gcauggcuaucuuccugaa

SEQ ID NO: 170300 - RNA, 19 nt, Homo sapiens
ggucugcgcuuggucuuuc

SEQ ID NO: 170301 - RNA, 19 nt, Homo sapiens
ccauggagcguaucuguga

SEQ ID NO: 170302 - RNA, 19 nt, Homo sapiens
aagccgagcugcaccauca

SEQ ID NO: 170303 - RNA, 19 nt, Homo sapiens
gaagcacauuggcaaaguc

SEQ ID NO: 170304 - RNA, 19 nt, Homo sapiens
gcucucagccucccacaau

SEQ ID NO: 170305 - RNA, 19 nt, Homo sapiens
caacuacggcuuugccaau

SEQ ID NO: 170306 - RNA, 19 nt, Homo sapiens
gguaugcgacgggaaagua

SEQ ID NO: 170307 - RNA, 19 nt, Homo sapiens
agggagaccuggugaugaa

SEQ ID NO: 170308 - RNA, 19 nt, Homo sapiens
gggcaccaacuccauguuu

SEQ ID NO: 170309 - RNA, 19 nt, Homo sapiens
gggagacgcugcucaucca

SEQ ID NO: 170310 - RNA, 19 nt, Homo sapiens
caacuuccgcgacaucaug

SEQ ID NO: 170311 - RNA, 19 nt, Homo sapiens
ccaaccggcucuccuucuu

SEQ ID NO: 170312 - RNA, 19 nt, Homo sapiens
ucucagccucccacaauua

SEQ ID NO: 170313 - RNA, 19 nt, Homo sapiens
ggcaccaacuccauguuug

SEQ ID NO: 170314 - RNA, 19 nt, Homo sapiens
gcuuugugcuggcugagaa

SEQ ID NO: 170315 - RNA, 19 nt, Homo sapiens
gcaaauucgaccuuucuca

SEQ ID NO: 170316 - RNA, 19 nt, Homo sapiens
ggugugugcugcucuccaa

SEQ ID NO: 170317 - RNA, 19 nt, Homo sapiens
ggugagcccugugcuguuc

SEQ ID NO: 170318 - RNA, 19 nt, Homo sapiens
gcaacucacgcuccggaaa

SEQ ID NO: 170319 - RNA, 19 nt, Homo sapiens
gccguggucuugagagaug

SEQ ID NO: 170320 - RNA, 19 nt, Homo sapiens
ugaagaacgugacauucca

SEQ ID NO: 170321 - RNA, 19 nt, Homo sapiens
ucuccgggcuccacacuga

SEQ ID NO: 170322 - RNA, 19 nt, Homo sapiens
gaacggcaaccugguagug

SEQ ID NO: 170323 - RNA, 19 nt, Homo sapiens
ggaaggaggguguguuugc

SEQ ID NO: 170324 - RNA, 19 nt, Homo sapiens
cuuccgagauuccauccua

SEQ ID NO: 170325 - RNA, 19 nt, Homo sapiens
caaccuggccguggucuug

SEQ ID NO: 170326 - RNA, 19 nt, Homo sapiens
ggaggcugcuguggaagga

SEQ ID NO: 170327 - RNA, 19 nt, Homo sapiens
cgacuacggcccucauuuc

SEQ ID NO: 170328 - RNA, 19 nt, Homo sapiens
aggcugaaguuuacaagga

SEQ ID NO: 170329 - RNA, 19 nt, Homo sapiens
ggaggcaucaacccagauu

SEQ ID NO: 170330 - RNA, 19 nt, Homo sapiens
gaggacgccuuccgcuaca

SEQ ID NO: 170331 - RNA, 19 nt, Homo sapiens
gcugaaggccaucaacugu

SEQ ID NO: 170332 - RNA, 19 nt, Homo sapiens
ugcaggagcucaagaaggu

SEQ ID NO: 170333 - RNA, 19 nt, Homo sapiens
caauuaaaccgcaugugau

SEQ ID NO: 170334 - RNA, 19 nt, Homo sapiens
cuggaccgcuuccgagauu

SEQ ID NO: 170335 - RNA, 19 nt, Homo sapiens
ggcccaggcugaaguuuac

SEQ ID NO: 170336 - RNA, 19 nt, Homo sapiens
ccagauaggccucauagac

SEQ ID NO: 170337 - RNA, 19 nt, Homo sapiens
ggauuugcauauuuauugc

SEQ ID NO: 170338 - RNA, 19 nt, Homo sapiens
ccagguaugcgacgggaaa

SEQ ID NO: 170339 - RNA, 19 nt, Homo sapiens
cgaguacaaugucaacaac

SEQ ID NO: 170340 - RNA, 19 nt, Homo sapiens
guauggccuuccacuccua

SEQ ID NO: 170341 - RNA, 19 nt, Homo sapiens
gcacagacgagagcaccuu

SEQ ID NO: 170342 - RNA, 19 nt, Homo sapiens
ugagucauuugaauacauc

SEQ ID NO: 170343 - RNA, 19 nt, Homo sapiens
caacaccuccgugcaguuc

SEQ ID NO: 170344 - RNA, 19 nt, Homo sapiens
agacggaggccauaugcuu

SEQ ID NO: 170345 - RNA, 19 nt, Homo sapiens
cauccuggcugacgaagac

SEQ ID NO: 170346 - RNA, 19 nt, Homo sapiens
aggcugcuguggaaggaua

SEQ ID NO: 170347 - RNA, 19 nt, Homo sapiens
gcauauuuauugcauugcu

SEQ ID NO: 170348 - RNA, 19 nt, Homo sapiens
uggagcagcugaggaagga

SEQ ID NO: 170349 - RNA, 19 nt, Homo sapiens
caucggcgguguggacaug

SEQ ID NO: 170350 - RNA, 19 nt, Homo sapiens
cagacgagagcaccuuuga

SEQ ID NO: 170351 - RNA, 19 nt, Homo sapiens
gcuccaacgugcacaucau

SEQ ID NO: 170352 - RNA, 19 nt, Homo sapiens
acagagcaacuacggcuuu

SEQ ID NO: 170353 - RNA, 19 nt, Homo sapiens
gcaaugcgggacagagcaa

SEQ ID NO: 170354 - RNA, 19 nt, Homo sapiens
cagaagcucguguugacuu

SEQ ID NO: 170355 - RNA, 19 nt, Homo sapiens
agagaacggcaaccuggua

SEQ ID NO: 170356 - RNA, 19 nt, Homo sapiens
gcucugggaugggcacaca

SEQ ID NO: 170357 - RNA, 19 nt, Homo sapiens
cagagcaacuacggcuuug

SEQ ID NO: 170358 - RNA, 19 nt, Homo sapiens
ggacagccugcuagguaug

SEQ ID NO: 170359 - RNA, 19 nt, Homo sapiens
gcaccagcuucgccaacuc

SEQ ID NO: 170360 - RNA, 19 nt, Homo sapiens
gggaugugccuuccaacug

SEQ ID NO: 170361 - RNA, 19 nt, Homo sapiens
ccucagcucucagcaacau

SEQ ID NO: 170362 - RNA, 19 nt, Homo sapiens
acacugccguggagaacau

SEQ ID NO: 170363 - RNA, 19 nt, Homo sapiens
ugacugccauccagauagg

SEQ ID NO: 170364 - RNA, 19 nt, Homo sapiens
guggucuucuccucuguga

SEQ ID NO: 170365 - RNA, 19 nt, Homo sapiens
ugaacuccuuggcggaaga

SEQ ID NO: 170366 - RNA, 19 nt, Homo sapiens
ccgagucuccugaccacua

SEQ ID NO: 170367 - RNA, 19 nt, Homo sapiens
ugcuggaagucaccuauga

SEQ ID NO: 170368 - RNA, 19 nt, Homo sapiens
gcaggacaaggcccaagug

SEQ ID NO: 170369 - RNA, 19 nt, Homo sapiens
ccuucgaggugucagagaa

SEQ ID NO: 170370 - RNA, 19 nt, Homo sapiens
uggaggagguggugauugc

SEQ ID NO: 170371 - RNA, 19 nt, Homo sapiens
auacagauggcuucaagga

SEQ ID NO: 170372 - RNA, 19 nt, Homo sapiens
guguuugucuguguuuguu

SEQ ID NO: 170373 - RNA, 19 nt, Homo sapiens
gcuggaagucaccuaugaa

SEQ ID NO: 170374 - RNA, 19 nt, Homo sapiens
uguacacacugcaggacaa

SEQ ID NO: 170375 - RNA, 19 nt, Homo sapiens
ggagaaagaucauuacuua

SEQ ID NO: 170376 - RNA, 19 nt, Homo sapiens
gaaaucaccuacucaauaa

SEQ ID NO: 170377 - RNA, 19 nt, Homo sapiens
caucagagccuguuuauua

SEQ ID NO: 170378 - RNA, 19 nt, Homo sapiens
gaacacauauuagagguua

SEQ ID NO: 170379 - RNA, 19 nt, Homo sapiens
gaacuaacauggcugguuu

SEQ ID NO: 170380 - RNA, 19 nt, Homo sapiens
gaacaugcuuugacaguuu

SEQ ID NO: 170381 - RNA, 19 nt, Homo sapiens
gaacgaauaugaaguggaa

SEQ ID NO: 170382 - RNA, 19 nt, Homo sapiens
ggucagaggugucagcuua

SEQ ID NO: 170383 - RNA, 19 nt, Homo sapiens
gaaacaaucuggaccgaaa

SEQ ID NO: 170384 - RNA, 19 nt, Homo sapiens
gaaagaagaugcaccuguu

SEQ ID NO: 170385 - RNA, 19 nt, Homo sapiens
uaaaggaacuugaccauga

SEQ ID NO: 170386 - RNA, 19 nt, Homo sapiens
gaaacaggcuggauuacaa

SEQ ID NO: 170387 - RNA, 19 nt, Homo sapiens
gaacagaagucaaacuaca

SEQ ID NO: 170388 - RNA, 19 nt, Homo sapiens
gaaugagcauggcaaauuu

SEQ ID NO: 170389 - RNA, 19 nt, Homo sapiens
ggacagauauuuacuuugg

SEQ ID NO: 170390 - RNA, 19 nt, Homo sapiens
gaauauacaggacucauua

SEQ ID NO: 170391 - RNA, 19 nt, Homo sapiens
caagauggguguuuacauu

SEQ ID NO: 170392 - RNA, 19 nt, Homo sapiens
gaaccuuucuauaccuuua

SEQ ID NO: 170393 - RNA, 19 nt, Homo sapiens
gaagguauaugugaagaaa

SEQ ID NO: 170394 - RNA, 19 nt, Homo sapiens
gaacauuuacucagacaua

SEQ ID NO: 170395 - RNA, 19 nt, Homo sapiens
ggaaggagaaagaucauua

SEQ ID NO: 170396 - RNA, 19 nt, Homo sapiens
gaggacagauauuuacuuu

SEQ ID NO: 170397 - RNA, 19 nt, Homo sapiens
gauaaagacucaaaugcuu

SEQ ID NO: 170398 - RNA, 19 nt, Homo sapiens
gauaguugcuucaugauug

SEQ ID NO: 170399 - RNA, 19 nt, Homo sapiens
gaggauaguugcuucauga

SEQ ID NO: 170400 - RNA, 19 nt, Homo sapiens
ggaagugaauggaaacuau

SEQ ID NO: 170401 - RNA, 19 nt, Homo sapiens
caaggaagcucguucacaa

SEQ ID NO: 170402 - RNA, 19 nt, Homo sapiens
uagaagaugugaacgauaa

SEQ ID NO: 170403 - RNA, 19 nt, Homo sapiens
ggaguaugauuuaauggua

SEQ ID NO: 170404 - RNA, 19 nt, Homo sapiens
ucacaugauuggaguaaua

SEQ ID NO: 170405 - RNA, 19 nt, Homo sapiens
gaaucgaccucccauuauu

SEQ ID NO: 170406 - RNA, 19 nt, Homo sapiens
gaaaugaacaugggaaauu

SEQ ID NO: 170407 - RNA, 19 nt, Homo sapiens
gcaagaugaacacauauua

SEQ ID NO: 170408 - RNA, 19 nt, Homo sapiens
gauugaagcuggaaaugaa

SEQ ID NO: 170409 - RNA, 19 nt, Homo sapiens
gaauaguacuuguagagaa

SEQ ID NO: 170410 - RNA, 19 nt, Homo sapiens
ggcaauaccuucucaaugu

SEQ ID NO: 170411 - RNA, 19 nt, Homo sapiens
gcaaccggcucucucuaua

SEQ ID NO: 170412 - RNA, 19 nt, Homo sapiens
uaaaggccauuccugcuua

SEQ ID NO: 170413 - RNA, 19 nt, Homo sapiens
gagauccgauacuccauua

SEQ ID NO: 170414 - RNA, 19 nt, Homo sapiens
gaaaguaucacuagaagau

SEQ ID NO: 170415 - RNA, 19 nt, Homo sapiens
ggcaggagcucccuuuaaa

SEQ ID NO: 170416 - RNA, 19 nt, Homo sapiens
caacccagaucgcagauuu

SEQ ID NO: 170417 - RNA, 19 nt, Homo sapiens
caaagaaagucaccuaaag

SEQ ID NO: 170418 - RNA, 19 nt, Homo sapiens
gcaauggucuuguaaaggu

SEQ ID NO: 170419 - RNA, 19 nt, Homo sapiens
ggagagaucagauacauga

SEQ ID NO: 170420 - RNA, 19 nt, Homo sapiens
ggaaggaauuggaaucguu

SEQ ID NO: 170421 - RNA, 19 nt, Homo sapiens
gaugaacccuguaagaaug

SEQ ID NO: 170422 - RNA, 19 nt, Homo sapiens
ggaagucauugaauccuuu

SEQ ID NO: 170423 - RNA, 19 nt, Homo sapiens
ggaaacagcuacgugaaau

SEQ ID NO: 170424 - RNA, 19 nt, Homo sapiens
gagaucaacagacaaguua

SEQ ID NO: 170425 - RNA, 19 nt, Homo sapiens
gaacuaucaucacucagaa

SEQ ID NO: 170426 - RNA, 19 nt, Homo sapiens
ggaaugagcauggcaaauu

SEQ ID NO: 170427 - RNA, 19 nt, Homo sapiens
gaacugaugccucggguuu

SEQ ID NO: 170428 - RNA, 19 nt, Homo sapiens
gagagacaauuaccagauu

SEQ ID NO: 170429 - RNA, 19 nt, Homo sapiens
gcaagagucaugaucauuu

SEQ ID NO: 170430 - RNA, 19 nt, Homo sapiens
gagcuugacaccuuaaaua

SEQ ID NO: 170431 - RNA, 19 nt, Homo sapiens
ugacauacauugacauuag

SEQ ID NO: 170432 - RNA, 19 nt, Homo sapiens
gaaguaagguacaaaauug

SEQ ID NO: 170433 - RNA, 19 nt, Homo sapiens
gguccacccuucuucuuua

SEQ ID NO: 170434 - RNA, 19 nt, Homo sapiens
gaagcucguucacaauuga

SEQ ID NO: 170435 - RNA, 19 nt, Homo sapiens
ccaguucucuucuguuaaa

SEQ ID NO: 170436 - RNA, 19 nt, Homo sapiens
gaggaaaucauuggaguua

SEQ ID NO: 170437 - RNA, 19 nt, Homo sapiens
agacacaggugaacugaaa

SEQ ID NO: 170438 - RNA, 19 nt, Homo sapiens
ggaaguagaguaauucaga

SEQ ID NO: 170439 - RNA, 19 nt, Homo sapiens
gagagaggacagauauuua

SEQ ID NO: 170440 - RNA, 19 nt, Homo sapiens
gagaagagccucagcuguu

SEQ ID NO: 170441 - RNA, 19 nt, Homo sapiens
gagcaaauaaccacuguuu

SEQ ID NO: 170442 - RNA, 19 nt, Homo sapiens
gagcagaaauaagugaauu

SEQ ID NO: 170443 - RNA, 19 nt, Homo sapiens
ggaagaaguccucaaguug

SEQ ID NO: 170444 - RNA, 19 nt, Homo sapiens
gaaagaucauuacuuacug

SEQ ID NO: 170445 - RNA, 19 nt, Homo sapiens
agaaaucaccuacucaaua

SEQ ID NO: 170446 - RNA, 19 nt, Homo sapiens
gaugguggcuucuguagau

SEQ ID NO: 170447 - RNA, 19 nt, Homo sapiens
gcaaaucagugcuguggau

SEQ ID NO: 170448 - RNA, 19 nt, Homo sapiens
gaagauacagcgccagaaa

SEQ ID NO: 170449 - RNA, 19 nt, Homo sapiens
uuacaacacuggucucauu

SEQ ID NO: 170450 - RNA, 19 nt, Homo sapiens
ccaagugacucaagaaaca

SEQ ID NO: 170451 - RNA, 19 nt, Homo sapiens
gcaaagaugaacccuguaa

SEQ ID NO: 170452 - RNA, 19 nt, Homo sapiens
ggagcaagcuguuuaucau

SEQ ID NO: 170453 - RNA, 19 nt, Homo sapiens
gcacaguccugcuuuccuu

SEQ ID NO: 170454 - RNA, 19 nt, Homo sapiens
ggaacaucaugaacacuuu

SEQ ID NO: 170455 - RNA, 19 nt, Homo sapiens
gcaaagaaagucaccuaaa

SEQ ID NO: 170456 - RNA, 19 nt, Homo sapiens
gagcacuccuuaaagauug

SEQ ID NO: 170457 - RNA, 19 nt, Homo sapiens
ggauacaaaugacuugaga

SEQ ID NO: 170458 - RNA, 19 nt, Homo sapiens
acagcaagaugaacacaua

SEQ ID NO: 170459 - RNA, 19 nt, Homo sapiens
caugagcacuccuuaaaga

SEQ ID NO: 170460 - RNA, 19 nt, Homo sapiens
gaugaggauucuucccaua

SEQ ID NO: 170461 - RNA, 19 nt, Homo sapiens
caacagacaaguuacauau

SEQ ID NO: 170462 - RNA, 19 nt, Homo sapiens
ggaaccaacggccaaguua

SEQ ID NO: 170463 - RNA, 19 nt, Homo sapiens
ugauaacccuccuguguuu

SEQ ID NO: 170464 - RNA, 19 nt, Homo sapiens
gaaucagccucaauuaaca

SEQ ID NO: 170465 - RNA, 19 nt, Homo sapiens
caacccaccuacauuuauu

SEQ ID NO: 170466 - RNA, 19 nt, Homo sapiens
ggacagggacccagcauau

SEQ ID NO: 170467 - RNA, 19 nt, Homo sapiens
caacuugaaucaguauuug

SEQ ID NO: 170468 - RNA, 19 nt, Homo sapiens
ggaaguggcccuggaauug

SEQ ID NO: 170469 - RNA, 19 nt, Homo sapiens
caacuucugcacaagauua

SEQ ID NO: 170470 - RNA, 19 nt, Homo sapiens
gacaaccuguucucuguuu

SEQ ID NO: 170471 - RNA, 19 nt, Homo sapiens
gaaagaaagcaaagaaagu

SEQ ID NO: 170472 - RNA, 19 nt, Homo sapiens
auacaggacucauuaguga

SEQ ID NO: 170473 - RNA, 19 nt, Homo sapiens
gaaauacaggugaugcuuu

SEQ ID NO: 170474 - RNA, 19 nt, Homo sapiens
gaaguaaccaagcggagua

SEQ ID NO: 170475 - RNA, 19 nt, Homo sapiens
gcaaugaacuagaguauuu

SEQ ID NO: 170476 - RNA, 19 nt, Homo sapiens
gaaccaaggugauugauuu

SEQ ID NO: 170477 - RNA, 19 nt, Homo sapiens
gaacaggccucuaguuauu

SEQ ID NO: 170478 - RNA, 19 nt, Homo sapiens
caacaacacuuucauguga

SEQ ID NO: 170479 - RNA, 19 nt, Homo sapiens
ggacuuggcuuauuucuuc

SEQ ID NO: 170480 - RNA, 19 nt, Homo sapiens
ggaaaucgauaaugacuau

SEQ ID NO: 170481 - RNA, 19 nt, Homo sapiens
ggauagagcuccagaaaca

SEQ ID NO: 170482 - RNA, 19 nt, Homo sapiens
gcacaagggucuuagagaa

SEQ ID NO: 170483 - RNA, 19 nt, Homo sapiens
gacaggcacuucuucauua

SEQ ID NO: 170484 - RNA, 19 nt, Homo sapiens
uaucagagauggauuauga

SEQ ID NO: 170485 - RNA, 19 nt, Homo sapiens
ccacaaagcucauggacuu

SEQ ID NO: 170486 - RNA, 19 nt, Homo sapiens
ucaaagccaucaagucuua

SEQ ID NO: 170487 - RNA, 19 nt, Homo sapiens
ucacucagcuccauuauga

SEQ ID NO: 170488 - RNA, 19 nt, Homo sapiens
gcacauaucagauuaauca

SEQ ID NO: 170489 - RNA, 19 nt, Homo sapiens
ggacauaucacucaagaaa

SEQ ID NO: 170490 - RNA, 19 nt, Homo sapiens
uuaagcaucugcccuauua

SEQ ID NO: 170491 - RNA, 19 nt, Homo sapiens
ggagaugaguggaggauuu

SEQ ID NO: 170492 - RNA, 19 nt, Homo sapiens
gaaguuaccuaugaguuaa

SEQ ID NO: 170493 - RNA, 19 nt, Homo sapiens
gaaaugugcucuuccaauc

SEQ ID NO: 170494 - RNA, 19 nt, Homo sapiens
ggucaaaucugccauaaca

SEQ ID NO: 170495 - RNA, 19 nt, Homo sapiens
gaaauuggaccaugagaaa

SEQ ID NO: 170496 - RNA, 19 nt, Homo sapiens
guagggaaaucgauaauga

SEQ ID NO: 170497 - RNA, 19 nt, Homo sapiens
caacaaggauggugucuuc

SEQ ID NO: 170498 - RNA, 19 nt, Homo sapiens
gauggagucuucucuauga

SEQ ID NO: 170499 - RNA, 19 nt, Homo sapiens
gcucagauguuuccaaguu

SEQ ID NO: 170500 - RNA, 19 nt, Homo sapiens
gaggauggcucagauguuu

SEQ ID NO: 170501 - RNA, 19 nt, Homo sapiens
agagagagcuggacuuuga

SEQ ID NO: 170502 - RNA, 19 nt, Homo sapiens
gaaggacacugccuaguca

SEQ ID NO: 170503 - RNA, 19 nt, Homo sapiens
ggacauggacuuugacauu

SEQ ID NO: 170504 - RNA, 19 nt, Homo sapiens
ucaauaaacuagcaaguga

SEQ ID NO: 170505 - RNA, 19 nt, Homo sapiens
caagaaacccuuugauuau

SEQ ID NO: 170506 - RNA, 19 nt, Homo sapiens
gaaaggcacuggugauucu

SEQ ID NO: 170507 - RNA, 19 nt, Homo sapiens
ccaaggaagcccuguauua

SEQ ID NO: 170508 - RNA, 19 nt, Homo sapiens
caacaucaaugcccugcua

SEQ ID NO: 170509 - RNA, 19 nt, Homo sapiens
ggagaaggucgaacuauaa

SEQ ID NO: 170510 - RNA, 19 nt, Homo sapiens
caacaggucuuccuaugau

SEQ ID NO: 170511 - RNA, 19 nt, Homo sapiens
caaacugucuucccucaaa

SEQ ID NO: 170512 - RNA, 19 nt, Homo sapiens
caacacagcucuucugaac

SEQ ID NO: 170513 - RNA, 19 nt, Homo sapiens
gaacucaggugauuguagu

SEQ ID NO: 170514 - RNA, 19 nt, Homo sapiens
ggacuggacuuggcuuauu

SEQ ID NO: 170515 - RNA, 19 nt, Homo sapiens
ccaaggagauggagcauuc

SEQ ID NO: 170516 - RNA, 19 nt, Homo sapiens
ccaaguggcugaugucaau

SEQ ID NO: 170517 - RNA, 19 nt, Homo sapiens
gggaacaggccucuaguua

SEQ ID NO: 170518 - RNA, 19 nt, Homo sapiens
ggacucuucuuacaauuug

SEQ ID NO: 170519 - RNA, 19 nt, Homo sapiens
ugacgucucuuaucagauu

SEQ ID NO: 170520 - RNA, 19 nt, Homo sapiens
ugaagcagcuccacuguau

SEQ ID NO: 170521 - RNA, 19 nt, Homo sapiens
gggaauaauuucuauguuc

SEQ ID NO: 170522 - RNA, 19 nt, Homo sapiens
ggaauucacuucuuuaagc

SEQ ID NO: 170523 - RNA, 19 nt, Homo sapiens
ccacagacuuggacacuga

SEQ ID NO: 170524 - RNA, 19 nt, Homo sapiens
gagcaacugugccugugua

SEQ ID NO: 170525 - RNA, 19 nt, Homo sapiens
uaacagggccuuuggacua

SEQ ID NO: 170526 - RNA, 19 nt, Homo sapiens
guucacagcuucucuauac

SEQ ID NO: 170527 - RNA, 19 nt, Homo sapiens
gaaaauaucacccucuaua

SEQ ID NO: 170528 - RNA, 19 nt, Homo sapiens
aggaagcccuguauuauuu

SEQ ID NO: 170529 - RNA, 19 nt, Homo sapiens
gcacauccauuucuaucug

SEQ ID NO: 170530 - RNA, 19 nt, Homo sapiens
caagagguguggcguuuga

SEQ ID NO: 170531 - RNA, 19 nt, Homo sapiens
gacaagagguguggcguuu

SEQ ID NO: 170532 - RNA, 19 nt, Homo sapiens
ugacaaugcuccuauguuc

SEQ ID NO: 170533 - RNA, 19 nt, Homo sapiens
gaaguuggaaccacaauug

SEQ ID NO: 170534 - RNA, 19 nt, Homo sapiens
ccaaacccauggacuauga

SEQ ID NO: 170535 - RNA, 19 nt, Homo sapiens
ccacagggcugcugcuuca

SEQ ID NO: 170536 - RNA, 19 nt, Homo sapiens
ccgaggagcuggugaguga

SEQ ID NO: 170537 - RNA, 19 nt, Homo sapiens
cagaggaccuaguuaaaga

SEQ ID NO: 170538 - RNA, 19 nt, Homo sapiens
cuacaaaugccaacaagua

SEQ ID NO: 170539 - RNA, 19 nt, Homo sapiens
gaagugcgauauguucuga

SEQ ID NO: 170540 - RNA, 19 nt, Homo sapiens
gaggagggcugcuuugaca

SEQ ID NO: 170541 - RNA, 19 nt, Homo sapiens
gagggaagcugaggauaga

SEQ ID NO: 170542 - RNA, 19 nt, Homo sapiens
ggaacuggcacauccauuu

SEQ ID NO: 170543 - RNA, 19 nt, Homo sapiens
gccauaagcuggacaucaa

SEQ ID NO: 170544 - RNA, 19 nt, Homo sapiens
ggacagaccauccagcuau

SEQ ID NO: 170545 - RNA, 19 nt, Homo sapiens
gagagagucauugcuauua

SEQ ID NO: 170546 - RNA, 19 nt, Homo sapiens
ggacaggcacuucuucauu

SEQ ID NO: 170547 - RNA, 19 nt, Homo sapiens
gcagaagauuacacauauu

SEQ ID NO: 170548 - RNA, 19 nt, Homo sapiens
caaccaagauacaggaaug

SEQ ID NO: 170549 - RNA, 19 nt, Homo sapiens
ggauguggccaauguauuu

SEQ ID NO: 170550 - RNA, 19 nt, Homo sapiens
gaagauggaccccuaaaua

SEQ ID NO: 170551 - RNA, 19 nt, Homo sapiens
aguaaagacucuccgguua

SEQ ID NO: 170552 - RNA, 19 nt, Homo sapiens
ccucugaaguuaccuauga

SEQ ID NO: 170553 - RNA, 19 nt, Homo sapiens
gcagugagguaccggauca

SEQ ID NO: 170554 - RNA, 19 nt, Homo sapiens
gugaggaggucauguucua

SEQ ID NO: 170555 - RNA, 19 nt, Homo sapiens
gaagggagaacuguacuuu

SEQ ID NO: 170556 - RNA, 19 nt, Homo sapiens
ucagaguccuuauuacaaa

SEQ ID NO: 170557 - RNA, 19 nt, Homo sapiens
gaacugguggcgacucuaa

SEQ ID NO: 170558 - RNA, 19 nt, Homo sapiens
cagacaaccucaauaugaa

SEQ ID NO: 170559 - RNA, 19 nt, Homo sapiens
gaauggcacagauauguuu

SEQ ID NO: 170560 - RNA, 19 nt, Homo sapiens
gcaggugcauuuacugaug

SEQ ID NO: 170561 - RNA, 19 nt, Homo sapiens
ucaaagacaucaacuggau

SEQ ID NO: 170562 - RNA, 19 nt, Homo sapiens
gaagcacugugaacaagga

SEQ ID NO: 170563 - RNA, 19 nt, Homo sapiens
gaggaucugugguugagaa

SEQ ID NO: 170564 - RNA, 19 nt, Homo sapiens
caaugugucugauaucaau

SEQ ID NO: 170565 - RNA, 19 nt, Homo sapiens
uucaagaacuggauuauga

SEQ ID NO: 170566 - RNA, 19 nt, Homo sapiens
caauauggcaggugcauuu

SEQ ID NO: 170567 - RNA, 19 nt, Homo sapiens
ugaaguuaccuaugaguua

SEQ ID NO: 170568 - RNA, 19 nt, Homo sapiens
ccacacagguccacaucuu

SEQ ID NO: 170569 - RNA, 19 nt, Homo sapiens
caaugacaauccaccuaua

SEQ ID NO: 170570 - RNA, 19 nt, Homo sapiens
gaacuacaugggauucuuu

SEQ ID NO: 170571 - RNA, 19 nt, Homo sapiens
ugacaacgcacccagauuu

SEQ ID NO: 170572 - RNA, 19 nt, Homo sapiens
uggcugaugucaaugauaa

SEQ ID NO: 170573 - RNA, 19 nt, Homo sapiens
agacaucgcuauccaagug

SEQ ID NO: 170574 - RNA, 19 nt, Homo sapiens
ccacgaauccaccaaauug

SEQ ID NO: 170575 - RNA, 19 nt, Homo sapiens
ggagguaaaguccaugguu

SEQ ID NO: 170576 - RNA, 19 nt, Homo sapiens
gaaacggucgcccagauca

SEQ ID NO: 170577 - RNA, 19 nt, Homo sapiens
ugagaggucagacuccuaa

SEQ ID NO: 170578 - RNA, 19 nt, Homo sapiens
ccagaucaaggcucaugua

SEQ ID NO: 170579 - RNA, 19 nt, Homo sapiens
gaggugaccggccaggaaa

SEQ ID NO: 170580 - RNA, 19 nt, Homo sapiens
cccaggagcuacacaccuu

SEQ ID NO: 170581 - RNA, 19 nt, Homo sapiens
ggaaacggucgcccagauc

SEQ ID NO: 170582 - RNA, 19 nt, Homo sapiens
gaggucagacuccuaaggu

SEQ ID NO: 170583 - RNA, 19 nt, Homo sapiens
ggcccugacuacccuggaa

SEQ ID NO: 170584 - RNA, 19 nt, Homo sapiens
aggaaacggucgcccagau

SEQ ID NO: 170585 - RNA, 19 nt, Homo sapiens
gcgcauaucuuccgcauug

SEQ ID NO: 170586 - RNA, 19 nt, Homo sapiens
gagcagggcuacaccauga

SEQ ID NO: 170587 - RNA, 19 nt, Homo sapiens
guggagagcucaucugcua

SEQ ID NO: 170588 - RNA, 19 nt, Homo sapiens
ucaauacuguggguucuua

SEQ ID NO: 170589 - RNA, 19 nt, Homo sapiens
ggacagcagugggccauug

SEQ ID NO: 170590 - RNA, 19 nt, Homo sapiens
gcugagaccugccacaaca

SEQ ID NO: 170591 - RNA, 19 nt, Homo sapiens
gggcaaggccugaagagaa

SEQ ID NO: 170592 - RNA, 19 nt, Homo sapiens
gggcacaccugcacagaca

SEQ ID NO: 170593 - RNA, 19 nt, Homo sapiens
cagcaccuuugcaucaaua

SEQ ID NO: 170594 - RNA, 19 nt, Homo sapiens
gcaacuguguggacaucaa

SEQ ID NO: 170595 - RNA, 19 nt, Homo sapiens
ccaacucuguccauucuau

SEQ ID NO: 170596 - RNA, 19 nt, Homo sapiens
gguggugcguucccaugua

SEQ ID NO: 170597 - RNA, 19 nt, Homo sapiens
cccaauaccugcaaagaca

SEQ ID NO: 170598 - RNA, 19 nt, Homo sapiens
cgaguguccucccaacuau

SEQ ID NO: 170599 - RNA, 19 nt, Homo sapiens
ccaaguguguggacgugaa

SEQ ID NO: 170600 - RNA, 19 nt, Homo sapiens
cacgggaacuucucagaug

SEQ ID NO: 170601 - RNA, 19 nt, Homo sapiens
gggacugggucacuauugu

SEQ ID NO: 170602 - RNA, 19 nt, Homo sapiens
gggagggacugggucacua

SEQ ID NO: 170603 - RNA, 19 nt, Homo sapiens
ggagugugccaacaucuau

SEQ ID NO: 170604 - RNA, 19 nt, Homo sapiens
aagaucagcugccaguuca

SEQ ID NO: 170605 - RNA, 19 nt, Homo sapiens
gcaaugaggagggcuacuu

SEQ ID NO: 170606 - RNA, 19 nt, Homo sapiens
gcaucucccuguacaagca

SEQ ID NO: 170607 - RNA, 19 nt, Homo sapiens
caagaucagcugccaguuc

SEQ ID NO: 170608 - RNA, 19 nt, Homo sapiens
aaacguugacauuccauuu

SEQ ID NO: 170609 - RNA, 19 nt, Homo sapiens
caaugaggagggcuacuuu

SEQ ID NO: 170610 - RNA, 19 nt, Homo sapiens
gcacuaccagcucaacuuc

SEQ ID NO: 170611 - RNA, 19 nt, Homo sapiens
gcugugaagacgugaauga

SEQ ID NO: 170612 - RNA, 19 nt, Homo sapiens
ggcuaucccugcaaucaug

SEQ ID NO: 170613 - RNA, 19 nt, Homo sapiens
gggugaggcugggugauga

SEQ ID NO: 170614 - RNA, 19 nt, Homo sapiens
cagaggcacugcugugucu

SEQ ID NO: 170615 - RNA, 19 nt, Homo sapiens
ggcaaggccugaagagaac

SEQ ID NO: 170616 - RNA, 19 nt, Homo sapiens
ggacagugaggaggaagaa

SEQ ID NO: 170617 - RNA, 19 nt, Homo sapiens
cggauggcguguccuguga

SEQ ID NO: 170618 - RNA, 19 nt, Homo sapiens
ccaccuuccuggccaagau

SEQ ID NO: 170619 - RNA, 19 nt, Homo sapiens
ccaggagugugccaacauc

SEQ ID NO: 170620 - RNA, 19 nt, Homo sapiens
uuaccacugugccugcuuu

SEQ ID NO: 170621 - RNA, 19 nt, Homo sapiens
caacauccuguccacauca

SEQ ID NO: 170622 - RNA, 19 nt, Homo sapiens
ggagggacugggucacuau

SEQ ID NO: 170623 - RNA, 19 nt, Homo sapiens
ggcuucagcugcaucaaca

SEQ ID NO: 170624 - RNA, 19 nt, Homo sapiens
ccaggaagccgcaaguucu

SEQ ID NO: 170625 - RNA, 19 nt, Homo sapiens
gaucagcugccaguucaug

SEQ ID NO: 170626 - RNA, 19 nt, Homo sapiens
cuaccgcugugacugcaaa

SEQ ID NO: 170627 - RNA, 19 nt, Homo sapiens
gacaucaacgaguguguga

SEQ ID NO: 170628 - RNA, 19 nt, Homo sapiens
ggacugggucacuauugug

SEQ ID NO: 170629 - RNA, 19 nt, Homo sapiens
ucaacacggugggcuccua

SEQ ID NO: 170630 - RNA, 19 nt, Homo sapiens
cagcgcgcaucacgcacua

SEQ ID NO: 170631 - RNA, 19 nt, Homo sapiens
agaacacacucggcuccua

SEQ ID NO: 170632 - RNA, 19 nt, Homo sapiens
guaugaaaggguuauaaag

SEQ ID NO: 170633 - RNA, 19 nt, Homo sapiens
ucgaguguccucccaacua

SEQ ID NO: 170634 - RNA, 19 nt, Homo sapiens
cagaggaacccgcugaucu

SEQ ID NO: 170635 - RNA, 19 nt, Homo sapiens
uuucccagguggccucuaa

SEQ ID NO: 170636 - RNA, 19 nt, Homo sapiens
gccagcaccuuugcaucaa

SEQ ID NO: 170637 - RNA, 19 nt, Homo sapiens
gcugcggcaucucccugua

SEQ ID NO: 170638 - RNA, 19 nt, Homo sapiens
cccgagaagugcccaggaa

SEQ ID NO: 170639 - RNA, 19 nt, Homo sapiens
ggaggaggagagagaggaa

SEQ ID NO: 170640 - RNA, 19 nt, Homo sapiens
gaagaccccuacagcuaug

SEQ ID NO: 170641 - RNA, 19 nt, Homo sapiens
ggacggcaagcgcugugaa

SEQ ID NO: 170642 - RNA, 19 nt, Homo sapiens
cgugugaguccaauccuaa

SEQ ID NO: 170643 - RNA, 19 nt, Homo sapiens
cgaggacagugaggaggaa

SEQ ID NO: 170644 - RNA, 19 nt, Homo sapiens
gaacaucaucaagggcaau

SEQ ID NO: 170645 - RNA, 19 nt, Homo sapiens
gggacaccaucgcccugaa

SEQ ID NO: 170646 - RNA, 19 nt, Homo sapiens
caccaccuuugcccuguga

SEQ ID NO: 170647 - RNA, 19 nt, Homo sapiens
gcacaccugcacagacauc

SEQ ID NO: 170648 - RNA, 19 nt, Homo sapiens
gauggcguguccugugaag

SEQ ID NO: 170649 - RNA, 19 nt, Homo sapiens
gacccagucuuccuaucca

SEQ ID NO: 170650 - RNA, 19 nt, Homo sapiens
acagugaggaggaagaaga

SEQ ID NO: 170651 - RNA, 19 nt, Homo sapiens
ugaacacacugggcuccuu

SEQ ID NO: 170652 - RNA, 19 nt, Homo sapiens
ggcgagcacugugugaaca

SEQ ID NO: 170653 - RNA, 19 nt, Homo sapiens
guggugcguucccauguag

SEQ ID NO: 170654 - RNA, 19 nt, Homo sapiens
ccagcaccuuugcaucaau

SEQ ID NO: 170655 - RNA, 19 nt, Homo sapiens
gacagcagugggccauuga

SEQ ID NO: 170656 - RNA, 19 nt, Homo sapiens
gaucccacccacccgagaa

SEQ ID NO: 170657 - RNA, 19 nt, Homo sapiens
acaacauccuguccacauc

SEQ ID NO: 170658 - RNA, 19 nt, Homo sapiens
ccacgggaacuucucagau

SEQ ID NO: 170659 - RNA, 19 nt, Homo sapiens
gccaggcuaugcccucaag

SEQ ID NO: 170660 - RNA, 19 nt, Homo sapiens
ucagccauaugcuccuguu

SEQ ID NO: 170661 - RNA, 19 nt, Homo sapiens
gagggccagucgugugagu

SEQ ID NO: 170662 - RNA, 19 nt, Homo sapiens
ggaggagagagaggaaaug

SEQ ID NO: 170663 - RNA, 19 nt, Homo sapiens
caaggacguggaugagugu

SEQ ID NO: 170664 - RNA, 19 nt, Homo sapiens
cgaagacguggaugagugu

SEQ ID NO: 170665 - RNA, 19 nt, Homo sapiens
gagagugaccgaggacagu

SEQ ID NO: 170666 - RNA, 19 nt, Homo sapiens
caucaauacuguggguucu

SEQ ID NO: 170667 - RNA, 19 nt, Homo sapiens
gcugcaccacggagaguuu

SEQ ID NO: 170668 - RNA, 19 nt, Homo sapiens
caacugcaucgaggcugua

SEQ ID NO: 170669 - RNA, 19 nt, Homo sapiens
gaggagagagaggaaaugg

SEQ ID NO: 170670 - RNA, 19 nt, Homo sapiens
gagggacugggucacuauu

SEQ ID NO: 170671 - RNA, 19 nt, Homo sapiens
ucccaacuauguccaaguc

SEQ ID NO: 170672 - RNA, 19 nt, Homo sapiens
cugcuuuccuggcuucuca

SEQ ID NO: 170673 - RNA, 19 nt, Homo sapiens
acguugacauuccauuuca

SEQ ID NO: 170674 - RNA, 19 nt, Homo sapiens
guacuaugacugccuacag

SEQ ID NO: 170675 - RNA, 19 nt, Homo sapiens
ggacacagaccccaacucu

SEQ ID NO: 170676 - RNA, 19 nt, Homo sapiens
guugacauuccauuucaug

SEQ ID NO: 170677 - RNA, 19 nt, Homo sapiens
caaacguugacauuccauu

SEQ ID NO: 170678 - RNA, 19 nt, Homo sapiens
cugggucacuauugugguu

SEQ ID NO: 170679 - RNA, 19 nt, Homo sapiens
gcgagggcuaccaguacua

SEQ ID NO: 170680 - RNA, 19 nt, Homo sapiens
gccauaugcuccuguuuuc

SEQ ID NO: 170681 - RNA, 19 nt, Homo sapiens
ggaaggaucugucuugaua

SEQ ID NO: 170682 - RNA, 19 nt, Homo sapiens
gcaggaagcuucaaaugua

SEQ ID NO: 170683 - RNA, 19 nt, Homo sapiens
ggaaauaauugcauggaua

SEQ ID NO: 170684 - RNA, 19 nt, Homo sapiens
gaaaguggcugucucaaug

SEQ ID NO: 170685 - RNA, 19 nt, Homo sapiens
ggaagaaggugccaagauu

SEQ ID NO: 170686 - RNA, 19 nt, Homo sapiens
ggaggaaauugcauuaaua

SEQ ID NO: 170687 - RNA, 19 nt, Homo sapiens
ggaaugugcuuucaauuga

SEQ ID NO: 170688 - RNA, 19 nt, Homo sapiens
gaaaggaacugcacagaca

SEQ ID NO: 170689 - RNA, 19 nt, Homo sapiens
ggaaggagcugcaaagauc

SEQ ID NO: 170690 - RNA, 19 nt, Homo sapiens
guacuagguuguccauuua

SEQ ID NO: 170691 - RNA, 19 nt, Homo sapiens
gaaagaacuuaaccaacua

SEQ ID NO: 170692 - RNA, 19 nt, Homo sapiens
gcacugaucuggacgaaug

SEQ ID NO: 170693 - RNA, 19 nt, Homo sapiens
gaucgaaucuggaaaugaa

SEQ ID NO: 170694 - RNA, 19 nt, Homo sapiens
ccaaauaucugccuaagug

SEQ ID NO: 170695 - RNA, 19 nt, Homo sapiens
gggaagaacugugaagaua

SEQ ID NO: 170696 - RNA, 19 nt, Homo sapiens
aaacaugacuguacugaaa

SEQ ID NO: 170697 - RNA, 19 nt, Homo sapiens
gaugacaugugaagauaua

SEQ ID NO: 170698 - RNA, 19 nt, Homo sapiens
gaacaucugugucuuugga

SEQ ID NO: 170699 - RNA, 19 nt, Homo sapiens
guacagacaucaaugaaug

SEQ ID NO: 170700 - RNA, 19 nt, Homo sapiens
gaagaacugugaagauaug

SEQ ID NO: 170701 - RNA, 19 nt, Homo sapiens
gagcagauaucgaugaaug

SEQ ID NO: 170702 - RNA, 19 nt, Homo sapiens
aaaggguacucaagaauua

SEQ ID NO: 170703 - RNA, 19 nt, Homo sapiens
gaaagccugugaagauauu

SEQ ID NO: 170704 - RNA, 19 nt, Homo sapiens
gaaggcagcuaugaaugua

SEQ ID NO: 170705 - RNA, 19 nt, Homo sapiens
cgaaugagcuacuguuaug

SEQ ID NO: 170706 - RNA, 19 nt, Homo sapiens
ccaaagacuuguuaaaugu

SEQ ID NO: 170707 - RNA, 19 nt, Homo sapiens
ucacaacaaugacuguaua

SEQ ID NO: 170708 - RNA, 19 nt, Homo sapiens
gaaauacuccuggaaguuu

SEQ ID NO: 170709 - RNA, 19 nt, Homo sapiens
uaacaagguucgaauccua

SEQ ID NO: 170710 - RNA, 19 nt, Homo sapiens
gaacacauccgaguacaaa

SEQ ID NO: 170711 - RNA, 19 nt, Homo sapiens
gggaaagccugugaagaua

SEQ ID NO: 170712 - RNA, 19 nt, Homo sapiens
aauaaagucuccuggauuu

SEQ ID NO: 170713 - RNA, 19 nt, Homo sapiens
ggagaaggcuguguagaug

SEQ ID NO: 170714 - RNA, 19 nt, Homo sapiens
gaaccaguguguugaugaa

SEQ ID NO: 170715 - RNA, 19 nt, Homo sapiens
gacagaggaucauaucauu

SEQ ID NO: 170716 - RNA, 19 nt, Homo sapiens
caaugaaugucuucuagaa

SEQ ID NO: 170717 - RNA, 19 nt, Homo sapiens
gcagugauauaaaugaaug

SEQ ID NO: 170718 - RNA, 19 nt, Homo sapiens
gcaaugaucguaaugaaug

SEQ ID NO: 170719 - RNA, 19 nt, Homo sapiens
cgaguuggcuguguugaua

SEQ ID NO: 170720 - RNA, 19 nt, Homo sapiens
gaauguguaucaaugaaga

SEQ ID NO: 170721 - RNA, 19 nt, Homo sapiens
gggaaugaauguguagaua

SEQ ID NO: 170722 - RNA, 19 nt, Homo sapiens
ccagugggauucuucuaua

SEQ ID NO: 170723 - RNA, 19 nt, Homo sapiens
gguaaaggguacucaagaa

SEQ ID NO: 170724 - RNA, 19 nt, Homo sapiens
uagcuuaucucaguuauga

SEQ ID NO: 170725 - RNA, 19 nt, Homo sapiens
gcggagaccugauggagaa

SEQ ID NO: 170726 - RNA, 19 nt, Homo sapiens
guauagauguugaugaaug

SEQ ID NO: 170727 - RNA, 19 nt, Homo sapiens
gugaagauauugaugaaug

SEQ ID NO: 170728 - RNA, 19 nt, Homo sapiens
uuacaacucugacgaauca

SEQ ID NO: 170729 - RNA, 19 nt, Homo sapiens
gcaaauguccucccggauu

SEQ ID NO: 170730 - RNA, 19 nt, Homo sapiens
gaagaaggugccaagauuu

SEQ ID NO: 170731 - RNA, 19 nt, Homo sapiens
gcuacuaccugaaugaaga

SEQ ID NO: 170732 - RNA, 19 nt, Homo sapiens
gguggucagugcacaaaua

SEQ ID NO: 170733 - RNA, 19 nt, Homo sapiens
gaacuuaaccaacuagaag

SEQ ID NO: 170734 - RNA, 19 nt, Homo sapiens
ugacacaguuggaagcuuu

SEQ ID NO: 170735 - RNA, 19 nt, Homo sapiens
ggccggaucugcaauaaug

SEQ ID NO: 170736 - RNA, 19 nt, Homo sapiens
caaacacagucagcaguua

SEQ ID NO: 170737 - RNA, 19 nt, Homo sapiens
uaaauaaagucuccuggau

SEQ ID NO: 170738 - RNA, 19 nt, Homo sapiens
gaaccucauuggcacauau

SEQ ID NO: 170739 - RNA, 19 nt, Homo sapiens
caauacagaugguuccuau

SEQ ID NO: 170740 - RNA, 19 nt, Homo sapiens
gaaauuggaguugguguuu

SEQ ID NO: 170741 - RNA, 19 nt, Homo sapiens
cuacaaaccugaucuaaaa

SEQ ID NO: 170742 - RNA, 19 nt, Homo sapiens
gugaagauauggaugaaug

SEQ ID NO: 170743 - RNA, 19 nt, Homo sapiens
auacaacacugcaauauuc

SEQ ID NO: 170744 - RNA, 19 nt, Homo sapiens
uaagcuaccuugucauaug

SEQ ID NO: 170745 - RNA, 19 nt, Homo sapiens
ugacgaaucacaacagaua

SEQ ID NO: 170746 - RNA, 19 nt, Homo sapiens
gggaggaccuguguggaua

SEQ ID NO: 170747 - RNA, 19 nt, Homo sapiens
cgacauuuauaccgguuua

SEQ ID NO: 170748 - RNA, 19 nt, Homo sapiens
gaacaugugccuuaaugga

SEQ ID NO: 170749 - RNA, 19 nt, Homo sapiens
ggagaucgcccugggauuu

SEQ ID NO: 170750 - RNA, 19 nt, Homo sapiens
gccaagacaucaaugaaug

SEQ ID NO: 170751 - RNA, 19 nt, Homo sapiens
gaagggaguuaccaguguu

SEQ ID NO: 170752 - RNA, 19 nt, Homo sapiens
gggaggaaauugcauuaau

SEQ ID NO: 170753 - RNA, 19 nt, Homo sapiens
gaucauaucauugcauuug

SEQ ID NO: 170754 - RNA, 19 nt, Homo sapiens
caaagaacccgaugucugu

SEQ ID NO: 170755 - RNA, 19 nt, Homo sapiens
ccagauauguccuuaugga

SEQ ID NO: 170756 - RNA, 19 nt, Homo sapiens
ugagaagugugaagauauu

SEQ ID NO: 170757 - RNA, 19 nt, Homo sapiens
caagggauuuaucuacaaa

SEQ ID NO: 170758 - RNA, 19 nt, Homo sapiens
gcuaagcuaccuugucaua

SEQ ID NO: 170759 - RNA, 19 nt, Homo sapiens
agaaagaacuuaaccaacu

SEQ ID NO: 170760 - RNA, 19 nt, Homo sapiens
cguaaugaaugucaagaaa

SEQ ID NO: 170761 - RNA, 19 nt, Homo sapiens
aaugcgggcuuucauguua

SEQ ID NO: 170762 - RNA, 19 nt, Homo sapiens
ggacguguauuuccauugg

SEQ ID NO: 170763 - RNA, 19 nt, Homo sapiens
ccagagaccaaauaauuaa

SEQ ID NO: 170764 - RNA, 19 nt, Homo sapiens
agacagccaucuuugcuuu

SEQ ID NO: 170765 - RNA, 19 nt, Homo sapiens
ggaaauggaaccugcaaga

SEQ ID NO: 170766 - RNA, 19 nt, Homo sapiens
gggaaucuuugcagaaaug

SEQ ID NO: 170767 - RNA, 19 nt, Homo sapiens
gaccugugauggagaauug

SEQ ID NO: 170768 - RNA, 19 nt, Homo sapiens
ugaacagucuccuuuguga

SEQ ID NO: 170769 - RNA, 19 nt, Homo sapiens
guauugauguugaugaaug

SEQ ID NO: 170770 - RNA, 19 nt, Homo sapiens
caagggugcugccaguaaa

SEQ ID NO: 170771 - RNA, 19 nt, Homo sapiens
ggaaauugcauuaauacug

SEQ ID NO: 170772 - RNA, 19 nt, Homo sapiens
gaaugaauguguagauacu

SEQ ID NO: 170773 - RNA, 19 nt, Homo sapiens
gcgagugucccuuugguua

SEQ ID NO: 170774 - RNA, 19 nt, Homo sapiens
augaagaacugcauggaua

SEQ ID NO: 170775 - RNA, 19 nt, Homo sapiens
caacacagauggcaguuuu

SEQ ID NO: 170776 - RNA, 19 nt, Homo sapiens
agacauugaugaguguuua

SEQ ID NO: 170777 - RNA, 19 nt, Homo sapiens
gcacuguguuucuggaaug

SEQ ID NO: 170778 - RNA, 19 nt, Homo sapiens
ggauuuacccaacaccaua

SEQ ID NO: 170779 - RNA, 19 nt, Homo sapiens
gcaagguuauucacgaugu

SEQ ID NO: 170780 - RNA, 19 nt, Homo sapiens
gagugucccuuugguuaua

SEQ ID NO: 170781 - RNA, 19 nt, Homo sapiens
ggacggagaugcuuugaua

SEQ ID NO: 170782 - RNA, 19 nt, Homo sapiens
ggaggaaacuguaucaaua

SEQ ID NO: 170783 - RNA, 19 nt, Homo sapiens
gcaaagaccuugaugaaug

SEQ ID NO: 170784 - RNA, 19 nt, Homo sapiens
gcaaagaucuggaugaaug

SEQ ID NO: 170785 - RNA, 19 nt, Homo sapiens
ggagggaacuguacagaua

SEQ ID NO: 170786 - RNA, 19 nt, Homo sapiens
gaagagauauugaugaaug

SEQ ID NO: 170787 - RNA, 19 nt, Homo sapiens
gaagagauaucaaugaaug

SEQ ID NO: 170788 - RNA, 19 nt, Homo sapiens
gaaacaaccuuggaucuuu

SEQ ID NO: 170789 - RNA, 19 nt, Homo sapiens
gaccaaaccucauauguga

SEQ ID NO: 170790 - RNA, 19 nt, Homo sapiens
ggaagaaacuguauugaca

SEQ ID NO: 170791 - RNA, 19 nt, Homo sapiens
gaagagaaguauucaugaa

SEQ ID NO: 170792 - RNA, 19 nt, Homo sapiens
gaaacugcaucaacacuuu

SEQ ID NO: 170793 - RNA, 19 nt, Homo sapiens
gaacguaacccucuccuuu

SEQ ID NO: 170794 - RNA, 19 nt, Homo sapiens
guacagauauugaugaaug

SEQ ID NO: 170795 - RNA, 19 nt, Homo sapiens
gcaaacaaaucaugcaaug

SEQ ID NO: 170796 - RNA, 19 nt, Homo sapiens
gaaacuguauugacauuga

SEQ ID NO: 170797 - RNA, 19 nt, Homo sapiens
ccacaacaccucauucuua

SEQ ID NO: 170798 - RNA, 19 nt, Homo sapiens
gaagugggaugaagaugaa

SEQ ID NO: 170799 - RNA, 19 nt, Homo sapiens
gcugugaggugaauauuaa

SEQ ID NO: 170800 - RNA, 19 nt, Homo sapiens
gggcagugcuaaucaauaa

SEQ ID NO: 170801 - RNA, 19 nt, Homo sapiens
ccaggaagcuucaagugua

SEQ ID NO: 170802 - RNA, 19 nt, Homo sapiens
gaacagaucagccuagaga

SEQ ID NO: 170803 - RNA, 19 nt, Homo sapiens
gggcaaagcugggaacaaa

SEQ ID NO: 170804 - RNA, 19 nt, Homo sapiens
gaacaugauuggaaccuau

SEQ ID NO: 170805 - RNA, 19 nt, Homo sapiens
gacaaucucugcagaaaug

SEQ ID NO: 170806 - RNA, 19 nt, Homo sapiens
guaccaggaugugcuauua

SEQ ID NO: 170807 - RNA, 19 nt, Homo sapiens
ggacugaacugugaagaug

SEQ ID NO: 170808 - RNA, 19 nt, Homo sapiens
ugaaugugcugaaggguua

SEQ ID NO: 170809 - RNA, 19 nt, Homo sapiens
ggacgaauguucuaaugga

SEQ ID NO: 170810 - RNA, 19 nt, Homo sapiens
guauagaccuugaugaaug

SEQ ID NO: 170811 - RNA, 19 nt, Homo sapiens
gaaaauggacguuguguua

SEQ ID NO: 170812 - RNA, 19 nt, Homo sapiens
ggaguacgcuguguggaua

SEQ ID NO: 170813 - RNA, 19 nt, Homo sapiens
gaaguugcauuucaggauu

SEQ ID NO: 170814 - RNA, 19 nt, Homo sapiens
gcaaaaugcugcuguagua

SEQ ID NO: 170815 - RNA, 19 nt, Homo sapiens
caacauuccuggagaguau

SEQ ID NO: 170816 - RNA, 19 nt, Homo sapiens
ucaaaucccugcacuaaug

SEQ ID NO: 170817 - RNA, 19 nt, Homo sapiens
gaaagauguuuguacaaug

SEQ ID NO: 170818 - RNA, 19 nt, Homo sapiens
gguuugaacucacucauaa

SEQ ID NO: 170819 - RNA, 19 nt, Homo sapiens
guacugauguugaugaaug

SEQ ID NO: 170820 - RNA, 19 nt, Homo sapiens
uaacacaccugguuccuau

SEQ ID NO: 170821 - RNA, 19 nt, Homo sapiens
gaaacggcaucaaguguau

SEQ ID NO: 170822 - RNA, 19 nt, Homo sapiens
gaagaaggagcuuaagaaa

SEQ ID NO: 170823 - RNA, 19 nt, Homo sapiens
ggagaaggcuguguagaug

SEQ ID NO: 170824 - RNA, 19 nt, Homo sapiens
uaaccugccuggaauguuu

SEQ ID NO: 170825 - RNA, 19 nt, Homo sapiens
guaauaaccugccuggaau

SEQ ID NO: 170826 - RNA, 19 nt, Homo sapiens
ggacguguguguguugaua

SEQ ID NO: 170827 - RNA, 19 nt, Homo sapiens
ggaaugggcucagcuacuu

SEQ ID NO: 170828 - RNA, 19 nt, Homo sapiens
gaugaaugcuccuuccaaa

SEQ ID NO: 170829 - RNA, 19 nt, Homo sapiens
uacaagagauguuuccuuu

SEQ ID NO: 170830 - RNA, 19 nt, Homo sapiens
gcaagaggauggaaagaca

SEQ ID NO: 170831 - RNA, 19 nt, Homo sapiens
ggauugaucuguauugaca

SEQ ID NO: 170832 - RNA, 19 nt, Homo sapiens
uaaacagacugcuuuguga

SEQ ID NO: 170833 - RNA, 19 nt, Homo sapiens
gaaaauggaugucagaaug

SEQ ID NO: 170834 - RNA, 19 nt, Homo sapiens
uaagagcacguauccauua

SEQ ID NO: 170835 - RNA, 19 nt, Homo sapiens
auacacaccugaucgauuu

SEQ ID NO: 170836 - RNA, 19 nt, Homo sapiens
ggaaagggaaucugucaaa

SEQ ID NO: 170837 - RNA, 19 nt, Homo sapiens
gaaaagcuguugacauuga

SEQ ID NO: 170838 - RNA, 19 nt, Homo sapiens
gagaaugaguugccuuuca

SEQ ID NO: 170839 - RNA, 19 nt, Homo sapiens
uaugggaagugcagaaaua

SEQ ID NO: 170840 - RNA, 19 nt, Homo sapiens
acaaagacaucaaugaaug

SEQ ID NO: 170841 - RNA, 19 nt, Homo sapiens
gagccacucugaaaucuga

SEQ ID NO: 170842 - RNA, 19 nt, Homo sapiens
gaaagcaacccauguguca

SEQ ID NO: 170843 - RNA, 19 nt, Homo sapiens
gaaacacgccaggaaguua

SEQ ID NO: 170844 - RNA, 19 nt, Homo sapiens
gcaaugcagccaaggaaua

SEQ ID NO: 170845 - RNA, 19 nt, Homo sapiens
ccaggaaucugcaugaaug

SEQ ID NO: 170846 - RNA, 19 nt, Homo sapiens
guauagauguugaugaaug

SEQ ID NO: 170847 - RNA, 19 nt, Homo sapiens
gaaaggauauauuggaacu

SEQ ID NO: 170848 - RNA, 19 nt, Homo sapiens
gagcacguauccauuauuc

SEQ ID NO: 170849 - RNA, 19 nt, Homo sapiens
caacacggcugccagaaca

SEQ ID NO: 170850 - RNA, 19 nt, Homo sapiens
gaaugugcaucaaugaaga

SEQ ID NO: 170851 - RNA, 19 nt, Homo sapiens
caagagauguuuccuuugg

SEQ ID NO: 170852 - RNA, 19 nt, Homo sapiens
gcaacuacaucugcaagaa

SEQ ID NO: 170853 - RNA, 19 nt, Homo sapiens
gccaagauauugaugaaug

SEQ ID NO: 170854 - RNA, 19 nt, Homo sapiens
caaugaaugugaccuaaau

SEQ ID NO: 170855 - RNA, 19 nt, Homo sapiens
cgccagggcuguacagaua

SEQ ID NO: 170856 - RNA, 19 nt, Homo sapiens
agaaggagcuuaagaaacu

SEQ ID NO: 170857 - RNA, 19 nt, Homo sapiens
gugaagauguugaugaaug

SEQ ID NO: 170858 - RNA, 19 nt, Homo sapiens
gugaagauaucaacgaaug

SEQ ID NO: 170859 - RNA, 19 nt, Homo sapiens
guauugaucuggacgaaug

SEQ ID NO: 170860 - RNA, 19 nt, Homo sapiens
gcaguaauauauggagaaa

SEQ ID NO: 170861 - RNA, 19 nt, Homo sapiens
gagaaugaaugcuccaauc

SEQ ID NO: 170862 - RNA, 19 nt, Homo sapiens
aggaacagcugacuuuaaa

SEQ ID NO: 170863 - RNA, 19 nt, Homo sapiens
ggaaacggcaucaagugua

SEQ ID NO: 170864 - RNA, 19 nt, Homo sapiens
ggacuggccguguauguuu

SEQ ID NO: 170865 - RNA, 19 nt, Homo sapiens
caugaugaauguacaacua

SEQ ID NO: 170866 - RNA, 19 nt, Homo sapiens
ggacagggaccuaucauca

SEQ ID NO: 170867 - RNA, 19 nt, Homo sapiens
caaagaccuugaugaaugu

SEQ ID NO: 170868 - RNA, 19 nt, Homo sapiens
ggucaggugugcagaaaug

SEQ ID NO: 170869 - RNA, 19 nt, Homo sapiens
caacacgccuggucgcuau

SEQ ID NO: 170870 - RNA, 19 nt, Homo sapiens
agagaaggcuggauuggaa

SEQ ID NO: 170871 - RNA, 19 nt, Homo sapiens
aaacaauccugauaucugu

SEQ ID NO: 170872 - RNA, 19 nt, Homo sapiens
gaaauacaaucggaagcuu

SEQ ID NO: 170873 - RNA, 19 nt, Homo sapiens
aagcaagcaugcauugaua

SEQ ID NO: 170874 - RNA, 19 nt, Homo sapiens
gccaagauguugaugaaug

SEQ ID NO: 170875 - RNA, 19 nt, Homo sapiens
gaauugauguuuaguuugc

SEQ ID NO: 170876 - RNA, 19 nt, Homo sapiens
gccaaaccguacuguauuu

SEQ ID NO: 170877 - RNA, 19 nt, Homo sapiens
gaaugugggucucaaccuu

SEQ ID NO: 170878 - RNA, 19 nt, Homo sapiens
ugaauuaacuacagaugga

SEQ ID NO: 170879 - RNA, 19 nt, Homo sapiens
cagaaaggauauauuggaa

SEQ ID NO: 170880 - RNA, 19 nt, Homo sapiens
caaaauaccuugacugcuu

SEQ ID NO: 170881 - RNA, 19 nt, Homo sapiens
gcaaagauauugaugaaug

SEQ ID NO: 170882 - RNA, 19 nt, Homo sapiens
gaacugaccugaagaagca

SEQ ID NO: 170883 - RNA, 19 nt, Homo sapiens
gaagauugcucuccgaguu

SEQ ID NO: 170884 - RNA, 19 nt, Homo sapiens
gaugaaauguguuggaauu

SEQ ID NO: 170885 - RNA, 19 nt, Homo sapiens
caagaucccuacauucuaa

SEQ ID NO: 170886 - RNA, 19 nt, Homo sapiens
gcaaugcacugacggauau

SEQ ID NO: 170887 - RNA, 19 nt, Homo sapiens
gauaugagcuaagcaguga

SEQ ID NO: 170888 - RNA, 19 nt, Homo sapiens
agacagcaaugcaaagaua

SEQ ID NO: 170889 - RNA, 19 nt, Homo sapiens
aaacuuggauucuuuccua

SEQ ID NO: 170890 - RNA, 19 nt, Homo sapiens
ggugaaacuuggauucuuu

SEQ ID NO: 170891 - RNA, 19 nt, Homo sapiens
caagcuaccugugucaaua

SEQ ID NO: 170892 - RNA, 19 nt, Homo sapiens
ccacuaaacuggucuucuu

SEQ ID NO: 170893 - RNA, 19 nt, Homo sapiens
gaucuucuguggugcuuaa

SEQ ID NO: 170894 - RNA, 19 nt, Homo sapiens
ccagagaaccgauguguuu

SEQ ID NO: 170895 - RNA, 19 nt, Homo sapiens
gcucaacugugaagacauu

SEQ ID NO: 170896 - RNA, 19 nt, Homo sapiens
uagcuaagauucacaaugu

SEQ ID NO: 170897 - RNA, 19 nt, Homo sapiens
gggaaauucucauguaugu

SEQ ID NO: 170898 - RNA, 19 nt, Homo sapiens
caccaaagaugcgugaaua

SEQ ID NO: 170899 - RNA, 19 nt, Homo sapiens
gaaauguguuggaauuauc

SEQ ID NO: 170900 - RNA, 19 nt, Homo sapiens
gaauacaccaggcucauuu

SEQ ID NO: 170901 - RNA, 19 nt, Homo sapiens
gaccaagugugcaucaauu

SEQ ID NO: 170902 - RNA, 19 nt, Homo sapiens
gaagcaaacucggaaaaua

SEQ ID NO: 170903 - RNA, 19 nt, Homo sapiens
caagagagcuaaguauaca

SEQ ID NO: 170904 - RNA, 19 nt, Homo sapiens
ccuaacacuucacuaauuu

SEQ ID NO: 170905 - RNA, 19 nt, Homo sapiens
guauuucacuggagaaguu

SEQ ID NO: 170906 - RNA, 19 nt, Homo sapiens
ccaacaccaucaauacuuu

SEQ ID NO: 170907 - RNA, 19 nt, Homo sapiens
gagcagcaauucauauuac

SEQ ID NO: 170908 - RNA, 19 nt, Homo sapiens
cgacaaacaaguccuguaa

SEQ ID NO: 170909 - RNA, 19 nt, Homo sapiens
caaugaaccugggaaauuc

SEQ ID NO: 170910 - RNA, 19 nt, Homo sapiens
caacgugugccaagacaua

SEQ ID NO: 170911 - RNA, 19 nt, Homo sapiens
acagugaacuuaagcaaau

SEQ ID NO: 170912 - RNA, 19 nt, Homo sapiens
aguagaacaugucaagaua

SEQ ID NO: 170913 - RNA, 19 nt, Homo sapiens
gaagaaaccaucacguaca

SEQ ID NO: 170914 - RNA, 19 nt, Homo sapiens
caucauaaccauugaauag

SEQ ID NO: 170915 - RNA, 19 nt, Homo sapiens
uaaggaggcagccaucaua

SEQ ID NO: 170916 - RNA, 19 nt, Homo sapiens
uaagucagccaaagaauau

SEQ ID NO: 170917 - RNA, 19 nt, Homo sapiens
caagcucuguguuaagauu

SEQ ID NO: 170918 - RNA, 19 nt, Homo sapiens
caacauucuugguucauuc

SEQ ID NO: 170919 - RNA, 19 nt, Homo sapiens
ccaagugugcaucaauuua

SEQ ID NO: 170920 - RNA, 19 nt, Homo sapiens
uuauacgucuccuuguuua

SEQ ID NO: 170921 - RNA, 19 nt, Homo sapiens
ucaaugaaccugggaaauu

SEQ ID NO: 170922 - RNA, 19 nt, Homo sapiens
gaaaacagcccagauuauu

SEQ ID NO: 170923 - RNA, 19 nt, Homo sapiens
uacuagaacuggaagauug

SEQ ID NO: 170924 - RNA, 19 nt, Homo sapiens
acaauuacaccaugguaua

SEQ ID NO: 170925 - RNA, 19 nt, Homo sapiens
acaaacaaguccuguaagu

SEQ ID NO: 170926 - RNA, 19 nt, Homo sapiens
ggugagaaguagaacaugu

SEQ ID NO: 170927 - RNA, 19 nt, Homo sapiens
ccugggaaauucucaugua

SEQ ID NO: 170928 - RNA, 19 nt, Homo sapiens
gcguagauauaaaugaaug

SEQ ID NO: 170929 - RNA, 19 nt, Homo sapiens
ucagugcccuccuggauau

SEQ ID NO: 170930 - RNA, 19 nt, Homo sapiens
ggaaacacaaccagcagaa

SEQ ID NO: 170931 - RNA, 19 nt, Homo sapiens
gcugugcugugcaagguaa

SEQ ID NO: 170932 - RNA, 19 nt, Homo sapiens
gaucugccauauuuguguu

SEQ ID NO: 170933 - RNA, 19 nt, Homo sapiens
uacuagagcuccacuaaca

SEQ ID NO: 170934 - RNA, 19 nt, Homo sapiens
ucagugcaaucaaggauau

SEQ ID NO: 170935 - RNA, 19 nt, Homo sapiens
caauaucaaugugucaaug

SEQ ID NO: 170936 - RNA, 19 nt, Homo sapiens
gggaggauaugagaaaaua

SEQ ID NO: 170937 - RNA, 19 nt, Homo sapiens
auacaggccacaacuauuu

SEQ ID NO: 170938 - RNA, 19 nt, Homo sapiens
ggagcagugcguagacaua

SEQ ID NO: 170939 - RNA, 19 nt, Homo sapiens
ugagugggauccugugaga

SEQ ID NO: 170940 - RNA, 19 nt, Homo sapiens
ccgaagaaaccaucacgua

SEQ ID NO: 170941 - RNA, 19 nt, Homo sapiens
uaaaccacauuggaacuga

SEQ ID NO: 170942 - RNA, 19 nt, Homo sapiens
cuuggauucuuuccuauaa

SEQ ID NO: 170943 - RNA, 19 nt, Homo sapiens
gaacagccucagcaggaaa

SEQ ID NO: 170944 - RNA, 19 nt, Homo sapiens
uaacucugcuagcuaagau

SEQ ID NO: 170945 - RNA, 19 nt, Homo sapiens
gcaaggguaagaaugaguu

SEQ ID NO: 170946 - RNA, 19 nt, Homo sapiens
gcuaagauucacaauguug

SEQ ID NO: 170947 - RNA, 19 nt, Homo sapiens
gcguagacauagaugaaug

SEQ ID NO: 170948 - RNA, 19 nt, Homo sapiens
gaagaagcaaacucggaaa

SEQ ID NO: 170949 - RNA, 19 nt, Homo sapiens
acuguacacucacccauaa

SEQ ID NO: 170950 - RNA, 19 nt, Homo sapiens
uuaagucagccaaagaaua

SEQ ID NO: 170951 - RNA, 19 nt, Homo sapiens
cugcguagauauaaaugaa

SEQ ID NO: 170952 - RNA, 19 nt, Homo sapiens
uggaaaaggucaauaaaga

SEQ ID NO: 170953 - RNA, 19 nt, Homo sapiens
gaauagcaugcaaggguaa

SEQ ID NO: 170954 - RNA, 19 nt, Homo sapiens
caagguaacucugcuagcu

SEQ ID NO: 170955 - RNA, 19 nt, Homo sapiens
gauacaggccacaacuauu

SEQ ID NO: 170956 - RNA, 19 nt, Homo sapiens
gcagcaggcuacgagcaaa

SEQ ID NO: 170957 - RNA, 19 nt, Homo sapiens
aaacagcccagauuauugu

SEQ ID NO: 170958 - RNA, 19 nt, Homo sapiens
caaccacuauggaggauac

SEQ ID NO: 170959 - RNA, 19 nt, Homo sapiens
uccuaacacuucacuaauu

SEQ ID NO: 170960 - RNA, 19 nt, Homo sapiens
gcagccaucauaaccauug

SEQ ID NO: 170961 - RNA, 19 nt, Homo sapiens
aaagugggcauuuaauaug

SEQ ID NO: 170962 - RNA, 19 nt, Homo sapiens
caauuacaccaugguauaa

SEQ ID NO: 170963 - RNA, 19 nt, Homo sapiens
aaucaaggauaugagcuaa

SEQ ID NO: 170964 - RNA, 19 nt, Homo sapiens
aacuauaccugcguagaua

SEQ ID NO: 170965 - RNA, 19 nt, Homo sapiens
caacuauaccugcguagau

SEQ ID NO: 170966 - RNA, 19 nt, Homo sapiens
guaccaucccuccauauug

SEQ ID NO: 170967 - RNA, 19 nt, Homo sapiens
ucugacugcuuuacuuuga

SEQ ID NO: 170968 - RNA, 19 nt, Homo sapiens
aaaucugacugcuuuacuu

SEQ ID NO: 170969 - RNA, 19 nt, Homo sapiens
cagagugacagugaacuua

SEQ ID NO: 170970 - RNA, 19 nt, Homo sapiens
gcauuuaagucagccaaag

SEQ ID NO: 170971 - RNA, 19 nt, Homo sapiens
ugagcagcaauucauauua

SEQ ID NO: 170972 - RNA, 19 nt, Homo sapiens
cuacaacauucuugguuca

SEQ ID NO: 170973 - RNA, 19 nt, Homo sapiens
gcaauucauauuacuguca

SEQ ID NO: 170974 - RNA, 19 nt, Homo sapiens
gcagggacgcacaacugua

SEQ ID NO: 170975 - RNA, 19 nt, Homo sapiens
gcugguuucuguaggguau

SEQ ID NO: 170976 - RNA, 19 nt, Homo sapiens
cagccaaagaauauuguua

SEQ ID NO: 170977 - RNA, 19 nt, Homo sapiens
cauggcggcuuccguuguu

SEQ ID NO: 170978 - RNA, 19 nt, Homo sapiens
uaagcaaauuacccuccua

SEQ ID NO: 170979 - RNA, 19 nt, Homo sapiens
ggaagaaaaugaugauggu

SEQ ID NO: 170980 - RNA, 19 nt, Homo sapiens
ucauaaccauugaauagca

SEQ ID NO: 170981 - RNA, 19 nt, Homo sapiens
gcaaagauauugaugaaug

SEQ ID NO: 170982 - RNA, 19 nt, Homo sapiens
gaacugaccugaagaagca

SEQ ID NO: 170983 - RNA, 19 nt, Homo sapiens
gaugaaauguguuggaauu

SEQ ID NO: 170984 - RNA, 19 nt, Homo sapiens
caagaucccuacauucuaa

SEQ ID NO: 170985 - RNA, 19 nt, Homo sapiens
ccaauagagugcagaauaa

SEQ ID NO: 170986 - RNA, 19 nt, Homo sapiens
gauaugagcuaagcaguga

SEQ ID NO: 170987 - RNA, 19 nt, Homo sapiens
agacagcaaugcaaagaua

SEQ ID NO: 170988 - RNA, 19 nt, Homo sapiens
aaacuuggauucuuuccua

SEQ ID NO: 170989 - RNA, 19 nt, Homo sapiens
ggugaaacuuggauucuuu

SEQ ID NO: 170990 - RNA, 19 nt, Homo sapiens
caagcuaccugugucaaua

SEQ ID NO: 170991 - RNA, 19 nt, Homo sapiens
ccacuaaacuggucuucuu

SEQ ID NO: 170992 - RNA, 19 nt, Homo sapiens
gaucuucuguggugcuuaa

SEQ ID NO: 170993 - RNA, 19 nt, Homo sapiens
ccagagaaccgauguguuu

SEQ ID NO: 170994 - RNA, 19 nt, Homo sapiens
gcucaacugugaagacauu

SEQ ID NO: 170995 - RNA, 19 nt, Homo sapiens
gggaaauucucauguaugu

SEQ ID NO: 170996 - RNA, 19 nt, Homo sapiens
caccaaagaugcgugaaua

SEQ ID NO: 170997 - RNA, 19 nt, Homo sapiens
gaaauguguuggaauuauc

SEQ ID NO: 170998 - RNA, 19 nt, Homo sapiens
gaauacaccaggcucauuu

SEQ ID NO: 170999 - RNA, 19 nt, Homo sapiens
gaccaagugugcaucaauu

SEQ ID NO: 171000 - RNA, 19 nt, Homo sapiens
gaagcaaacucggaaaaua

SEQ ID NO: 171001 - RNA, 19 nt, Homo sapiens
caagagagcuaaguauaca

SEQ ID NO: 171002 - RNA, 19 nt, Homo sapiens
ccuaacacuucacuaauuu

SEQ ID NO: 171003 - RNA, 19 nt, Homo sapiens
guauuucacuggagaaguu

SEQ ID NO: 171004 - RNA, 19 nt, Homo sapiens
ccaacaccaucaauacuuu

SEQ ID NO: 171005 - RNA, 19 nt, Homo sapiens
cgacaaacaaguccuguaa

SEQ ID NO: 171006 - RNA, 19 nt, Homo sapiens
ugacaugcauucucaacaa

SEQ ID NO: 171007 - RNA, 19 nt, Homo sapiens
caaugaaccugggaaauuc

SEQ ID NO: 171008 - RNA, 19 nt, Homo sapiens
caacgugugccaagacaua

SEQ ID NO: 171009 - RNA, 19 nt, Homo sapiens
acagugaacuuaagcaaau

SEQ ID NO: 171010 - RNA, 19 nt, Homo sapiens
aguagaacaugucaagaua

SEQ ID NO: 171011 - RNA, 19 nt, Homo sapiens
acaaugcacugacggauau

SEQ ID NO: 171012 - RNA, 19 nt, Homo sapiens
caucauaaccauugaauag

SEQ ID NO: 171013 - RNA, 19 nt, Homo sapiens
uaaggaggcagccaucaua

SEQ ID NO: 171014 - RNA, 19 nt, Homo sapiens
uaagucagccaaagaauau

SEQ ID NO: 171015 - RNA, 19 nt, Homo sapiens
caagcucuguguuaagauu

SEQ ID NO: 171016 - RNA, 19 nt, Homo sapiens
caacauucuugguucauuc

SEQ ID NO: 171017 - RNA, 19 nt, Homo sapiens
ccaagugugcaucaauuua

SEQ ID NO: 171018 - RNA, 19 nt, Homo sapiens
uuauacgucuccuuguuua

SEQ ID NO: 171019 - RNA, 19 nt, Homo sapiens
ucaaugaaccugggaaauu

SEQ ID NO: 171020 - RNA, 19 nt, Homo sapiens
gaaaacagcccagauuauu

SEQ ID NO: 171021 - RNA, 19 nt, Homo sapiens
acaauuacaccaugguaua

SEQ ID NO: 171022 - RNA, 19 nt, Homo sapiens
acaaacaaguccuguaagu

SEQ ID NO: 171023 - RNA, 19 nt, Homo sapiens
ggugagaaguagaacaugu

SEQ ID NO: 171024 - RNA, 19 nt, Homo sapiens
ccugggaaauucucaugua

SEQ ID NO: 171025 - RNA, 19 nt, Homo sapiens
gcguagauauaaaugaaug

SEQ ID NO: 171026 - RNA, 19 nt, Homo sapiens
ucagugcccuccuggauau

SEQ ID NO: 171027 - RNA, 19 nt, Homo sapiens
ggaaacacaaccagcagaa

SEQ ID NO: 171028 - RNA, 19 nt, Homo sapiens
gaucugccauauuuguguu

SEQ ID NO: 171029 - RNA, 19 nt, Homo sapiens
uacuagagcuccacuaaca

SEQ ID NO: 171030 - RNA, 19 nt, Homo sapiens
ucagugcaaucaaggauau

SEQ ID NO: 171031 - RNA, 19 nt, Homo sapiens
caauaucaaugugucaaug

SEQ ID NO: 171032 - RNA, 19 nt, Homo sapiens
gggaggauaugagaaaaua

SEQ ID NO: 171033 - RNA, 19 nt, Homo sapiens
auacaggccacaacuauuu

SEQ ID NO: 171034 - RNA, 19 nt, Homo sapiens
ggagcagugcguagacaua

SEQ ID NO: 171035 - RNA, 19 nt, Homo sapiens
ugagugggauccugugaga

SEQ ID NO: 171036 - RNA, 19 nt, Homo sapiens
uaaaccacauuggaacuga

SEQ ID NO: 171037 - RNA, 19 nt, Homo sapiens
cuuggauucuuuccuauaa

SEQ ID NO: 171038 - RNA, 19 nt, Homo sapiens
gaacagccucagcaggaaa

SEQ ID NO: 171039 - RNA, 19 nt, Homo sapiens
gcaaggguaagaaugaguu

SEQ ID NO: 171040 - RNA, 19 nt, Homo sapiens
gcguagacauagaugaaug

SEQ ID NO: 171041 - RNA, 19 nt, Homo sapiens
gaagaagcaaacucggaaa

SEQ ID NO: 171042 - RNA, 19 nt, Homo sapiens
acuguacacucacccauaa

SEQ ID NO: 171043 - RNA, 19 nt, Homo sapiens
uuaagucagccaaagaaua

SEQ ID NO: 171044 - RNA, 19 nt, Homo sapiens
cugcguagauauaaaugaa

SEQ ID NO: 171045 - RNA, 19 nt, Homo sapiens
uggaaaaggucaauaaaga

SEQ ID NO: 171046 - RNA, 19 nt, Homo sapiens
gaauagcaugcaaggguaa

SEQ ID NO: 171047 - RNA, 19 nt, Homo sapiens
gauacaggccacaacuauu

SEQ ID NO: 171048 - RNA, 19 nt, Homo sapiens
gcagcaggcuacgagcaaa

SEQ ID NO: 171049 - RNA, 19 nt, Homo sapiens
aaacagcccagauuauugu

SEQ ID NO: 171050 - RNA, 19 nt, Homo sapiens
caaccacuauggaggauac

SEQ ID NO: 171051 - RNA, 19 nt, Homo sapiens
gacaugcauucucaacaau

SEQ ID NO: 171052 - RNA, 19 nt, Homo sapiens
uccuaacacuucacuaauu

SEQ ID NO: 171053 - RNA, 19 nt, Homo sapiens
gcagccaucauaaccauug

SEQ ID NO: 171054 - RNA, 19 nt, Homo sapiens
aaagugggcauuuaauaug

SEQ ID NO: 171055 - RNA, 19 nt, Homo sapiens
caauuacaccaugguauaa

SEQ ID NO: 171056 - RNA, 19 nt, Homo sapiens
aaucaaggauaugagcuaa

SEQ ID NO: 171057 - RNA, 19 nt, Homo sapiens
aacuauaccugcguagaua

SEQ ID NO: 171058 - RNA, 19 nt, Homo sapiens
caacuauaccugcguagau

SEQ ID NO: 171059 - RNA, 19 nt, Homo sapiens
guaccaucccuccauauug

SEQ ID NO: 171060 - RNA, 19 nt, Homo sapiens
ucugacugcuuuacuuuga

SEQ ID NO: 171061 - RNA, 19 nt, Homo sapiens
aaaucugacugcuuuacuu

SEQ ID NO: 171062 - RNA, 19 nt, Homo sapiens
cagagugacagugaacuua

SEQ ID NO: 171063 - RNA, 19 nt, Homo sapiens
gcauuuaagucagccaaag

SEQ ID NO: 171064 - RNA, 19 nt, Homo sapiens
cuacaacauucuugguuca

SEQ ID NO: 171065 - RNA, 19 nt, Homo sapiens
gcagggacgcacaacugua

SEQ ID NO: 171066 - RNA, 19 nt, Homo sapiens
gcugguuucuguaggguau

SEQ ID NO: 171067 - RNA, 19 nt, Homo sapiens
cagccaaagaauauuguua

SEQ ID NO: 171068 - RNA, 19 nt, Homo sapiens
cauggcggcuuccguuguu

SEQ ID NO: 171069 - RNA, 19 nt, Homo sapiens
uaagcaaauuacccuccua

SEQ ID NO: 171070 - RNA, 19 nt, Homo sapiens
ggaagaaaaugaugauggu

SEQ ID NO: 171071 - RNA, 19 nt, Homo sapiens
ucauaaccauugaauagca

SEQ ID NO: 171072 - RNA, 19 nt, Homo sapiens
gacagugaacuuaagcaaa

SEQ ID NO: 171073 - RNA, 19 nt, Homo sapiens
aauccuaacacuucacuaa

SEQ ID NO: 171074 - RNA, 19 nt, Homo sapiens
cauuggaacugaccugaag

SEQ ID NO: 171075 - RNA, 19 nt, Homo sapiens
guaagaaaauggaaaaggu

SEQ ID NO: 171076 - RNA, 19 nt, Homo sapiens
cuaaacuggucuucuucaa

SEQ ID NO: 171077 - RNA, 19 nt, Homo sapiens
gcaucuacaucucuauacu

SEQ ID NO: 171078 - RNA, 19 nt, Homo sapiens
ugaaugugaugccagcaau

SEQ ID NO: 171079 - RNA, 19 nt, Homo sapiens
aauguaccaucccuccaua

SEQ ID NO: 171080 - RNA, 19 nt, Homo sapiens
uaaacaccauaaagacaca

SEQ ID NO: 171081 - RNA, 19 nt, Homo sapiens
guaaauauguggucuguuu

SEQ ID NO: 171082 - RNA, 19 nt, Homo sapiens
ggacaaggaugugaagaua

SEQ ID NO: 171083 - RNA, 19 nt, Homo sapiens
ccacugguguuaagauaua

SEQ ID NO: 171084 - RNA, 19 nt, Homo sapiens
caacaucgauugccuugug

SEQ ID NO: 171085 - RNA, 19 nt, Homo sapiens
acaaggaugugaagauaaa

SEQ ID NO: 171086 - RNA, 19 nt, Homo sapiens
ccaacgaccugguuaugaa

SEQ ID NO: 171087 - RNA, 19 nt, Homo sapiens
gguaaaaucuacagccuua

SEQ ID NO: 171088 - RNA, 19 nt, Homo sapiens
caaaugcugucuccauaau

SEQ ID NO: 171089 - RNA, 19 nt, Homo sapiens
ggaaggaggccguguuaga

SEQ ID NO: 171090 - RNA, 19 nt, Homo sapiens
gaaaagggguaaauaugug

SEQ ID NO: 171091 - RNA, 19 nt, Homo sapiens
caacugaugagccuucuga

SEQ ID NO: 171092 - RNA, 19 nt, Homo sapiens
caaaugcuguagaaugcuu

SEQ ID NO: 171093 - RNA, 19 nt, Homo sapiens
gauaaacacgccaucauag

SEQ ID NO: 171094 - RNA, 19 nt, Homo sapiens
cgugacaggugaucaaguu

SEQ ID NO: 171095 - RNA, 19 nt, Homo sapiens
ugagaaggaugcucugcaa

SEQ ID NO: 171096 - RNA, 19 nt, Homo sapiens
caucaaaugcuguagaaug

SEQ ID NO: 171097 - RNA, 19 nt, Homo sapiens
cauaaugccacugguguua

SEQ ID NO: 171098 - RNA, 19 nt, Homo sapiens
caccuuacauuccuagaga

SEQ ID NO: 171099 - RNA, 19 nt, Homo sapiens
gaagauaaacacgccauca

SEQ ID NO: 171100 - RNA, 19 nt, Homo sapiens
gggcaucgcgcaccucuau

SEQ ID NO: 171101 - RNA, 19 nt, Homo sapiens
ugagacugcuguacgaaug

SEQ ID NO: 171102 - RNA, 19 nt, Homo sapiens
gaaggaugcucugcaacca

SEQ ID NO: 171103 - RNA, 19 nt, Homo sapiens
agauaaacacgccaucaua

SEQ ID NO: 171104 - RNA, 19 nt, Homo sapiens
uggaggagaaauaaacuua

SEQ ID NO: 171105 - RNA, 19 nt, Homo sapiens
ccaaaugcugucuccauaa

SEQ ID NO: 171106 - RNA, 19 nt, Homo sapiens
accaaaugcugucuccaua

SEQ ID NO: 171107 - RNA, 19 nt, Homo sapiens
uggcaucuauagaaagaaa

SEQ ID NO: 171108 - RNA, 19 nt, Homo sapiens
gacaaggaugugaagauaa

SEQ ID NO: 171109 - RNA, 19 nt, Homo sapiens
gaucuuccaacaucgauug

SEQ ID NO: 171110 - RNA, 19 nt, Homo sapiens
cagauaauucagcuccuua

SEQ ID NO: 171111 - RNA, 19 nt, Homo sapiens
ugacaggugaucaaguuaa

SEQ ID NO: 171112 - RNA, 19 nt, Homo sapiens
uaaacacgccaucauagug

SEQ ID NO: 171113 - RNA, 19 nt, Homo sapiens
caugguggcugauguucau

SEQ ID NO: 171114 - RNA, 19 nt, Homo sapiens
gacaggugaucaaguuaag

SEQ ID NO: 171115 - RNA, 19 nt, Homo sapiens
caacgugacaggugaucaa

SEQ ID NO: 171116 - RNA, 19 nt, Homo sapiens
gcgcaccucuauggcauug

SEQ ID NO: 171117 - RNA, 19 nt, Homo sapiens
cuagagagcagaaauaaaa

SEQ ID NO: 171118 - RNA, 19 nt, Homo sapiens
ggucuacggagggauauuu

SEQ ID NO: 171119 - RNA, 19 nt, Homo sapiens
ccagauaauucagcuccuu

SEQ ID NO: 171120 - RNA, 19 nt, Homo sapiens
ugacccagcugcucaacuc

SEQ ID NO: 171121 - RNA, 19 nt, Homo sapiens
ggguaaauauguggucugu

SEQ ID NO: 171122 - RNA, 19 nt, Homo sapiens
ggagaaaagggguaaauau

SEQ ID NO: 171123 - RNA, 19 nt, Homo sapiens
cugaguacauccagaggaa

SEQ ID NO: 171124 - RNA, 19 nt, Homo sapiens
ggcacucccuaaccaaaug

SEQ ID NO: 171125 - RNA, 19 nt, Homo sapiens
ggauggaggagaaauaaac

SEQ ID NO: 171126 - RNA, 19 nt, Homo sapiens
ugccacugguguuaagaua

SEQ ID NO: 171127 - RNA, 19 nt, Homo sapiens
gagaaaagggguaaauaug

SEQ ID NO: 171128 - RNA, 19 nt, Homo sapiens
gaaggaggccguguuagac

SEQ ID NO: 171129 - RNA, 19 nt, Homo sapiens
ucgaguuccugaaggugua

SEQ ID NO: 171130 - RNA, 19 nt, Homo sapiens
gaguacauccagaggaaga

SEQ ID NO: 171131 - RNA, 19 nt, Homo sapiens
caggugaucaaguuaagaa

SEQ ID NO: 171132 - RNA, 19 nt, Homo sapiens
gggcuacgccagggacuuu

SEQ ID NO: 171133 - RNA, 19 nt, Homo sapiens
guggauggaggagaaauaa

SEQ ID NO: 171134 - RNA, 19 nt, Homo sapiens
gaaagcugagacugcugua

SEQ ID NO: 171135 - RNA, 19 nt, Homo sapiens
uaaugccacugguguuaag

SEQ ID NO: 171136 - RNA, 19 nt, Homo sapiens
gcaccucuauggcauugcu

SEQ ID NO: 171137 - RNA, 19 nt, Homo sapiens
ugggaaggaggccguguua

SEQ ID NO: 171138 - RNA, 19 nt, Homo sapiens
acggagggauauuucugua

SEQ ID NO: 171139 - RNA, 19 nt, Homo sapiens
gcuccaugguggcugaugu

SEQ ID NO: 171140 - RNA, 19 nt, Homo sapiens
uugaguggauggaggagaa

SEQ ID NO: 171141 - RNA, 19 nt, Homo sapiens
gugaucaaguuaagaagcu

SEQ ID NO: 171142 - RNA, 19 nt, Homo sapiens
ccgacgacgugcucgaguu

SEQ ID NO: 171143 - RNA, 19 nt, Homo sapiens
uggccuacgucauggagaa

SEQ ID NO: 171144 - RNA, 19 nt, Homo sapiens
uuuggcaucuauagaaaga

SEQ ID NO: 171145 - RNA, 19 nt, Homo sapiens
gaccugcugugcaccuuac

SEQ ID NO: 171146 - RNA, 19 nt, Homo sapiens
cguguguucucgugucaga

SEQ ID NO: 171147 - RNA, 19 nt, Homo sapiens
uccugaagguguaugagaa

SEQ ID NO: 171148 - RNA, 19 nt, Homo sapiens
gcuuggcacucccuaacca

SEQ ID NO: 171149 - RNA, 19 nt, Homo sapiens
gcaucuauagaaagaaauc

SEQ ID NO: 171150 - RNA, 19 nt, Homo sapiens
aagaagagccccaauggaa

SEQ ID NO: 171151 - RNA, 19 nt, Homo sapiens
gcucuacccgguucaagca

SEQ ID NO: 171152 - RNA, 19 nt, Homo sapiens
gcaucgcgcaccucuaugg

SEQ ID NO: 171153 - RNA, 19 nt, Homo sapiens
cgugucagaagaagauaaa

SEQ ID NO: 171154 - RNA, 19 nt, Homo sapiens
cgaccugguuaugaacaug

SEQ ID NO: 171155 - RNA, 19 nt, Homo sapiens
gcaccuuacauuccuagag

SEQ ID NO: 171156 - RNA, 19 nt, Homo sapiens
cgucauucccacagacauu

SEQ ID NO: 171157 - RNA, 19 nt, Homo sapiens
gugacaggugaucaaguua

SEQ ID NO: 171158 - RNA, 19 nt, Homo sapiens
gcagucaaagccaucucuu

SEQ ID NO: 171159 - RNA, 19 nt, Homo sapiens
ccuagagagcagaaauaaa

SEQ ID NO: 171160 - RNA, 19 nt, Homo sapiens
cgacgacgugcucgaguuc

SEQ ID NO: 171161 - RNA, 19 nt, Homo sapiens
acccugccgucacugagua

SEQ ID NO: 171162 - RNA, 19 nt, Homo sapiens
cauaguggaaccggagaaa

SEQ ID NO: 171163 - RNA, 19 nt, Homo sapiens
gcacacaucccauuugaua

SEQ ID NO: 171164 - RNA, 19 nt, Homo sapiens
gagaaaagcucacuaagaa

SEQ ID NO: 171165 - RNA, 19 nt, Homo sapiens
caucuuaucugucuucuga

SEQ ID NO: 171166 - RNA, 19 nt, Homo sapiens
ccaaagugcugagauuaua

SEQ ID NO: 171167 - RNA, 19 nt, Homo sapiens
ccaaguagcuggaauuaca

SEQ ID NO: 171168 - RNA, 19 nt, Homo sapiens
ggcaauagauguggaaauu

SEQ ID NO: 171169 - RNA, 19 nt, Homo sapiens
cuaagaagcuugaaucuac

SEQ ID NO: 171170 - RNA, 19 nt, Homo sapiens
ccaagugucugcaaguaaa

SEQ ID NO: 171171 - RNA, 19 nt, Homo sapiens
ggauugaccuuugcacgaa

SEQ ID NO: 171172 - RNA, 19 nt, Homo sapiens
cagcacacaucccauuuga

SEQ ID NO: 171173 - RNA, 19 nt, Homo sapiens
gcagaagacugaaguuuug

SEQ ID NO: 171174 - RNA, 19 nt, Homo sapiens
gagauaggcagaagacuga

SEQ ID NO: 171175 - RNA, 19 nt, Homo sapiens
ggauagggcacuacagauu

SEQ ID NO: 171176 - RNA, 19 nt, Homo sapiens
gaaggacacaagagagaaa

SEQ ID NO: 171177 - RNA, 19 nt, Homo sapiens
ggagugcaguggagcaauc

SEQ ID NO: 171178 - RNA, 19 nt, Homo sapiens
augcaggacugaucgauuu

SEQ ID NO: 171179 - RNA, 19 nt, Homo sapiens
caucccauuugauagauuu

SEQ ID NO: 171180 - RNA, 19 nt, Homo sapiens
caccaagugucugcaagua

SEQ ID NO: 171181 - RNA, 19 nt, Homo sapiens
cuucauuguucuucucuuu

SEQ ID NO: 171182 - RNA, 19 nt, Homo sapiens
auacggcacugaacaagga

SEQ ID NO: 171183 - RNA, 19 nt, Homo sapiens
gauccugaguucgucauug

SEQ ID NO: 171184 - RNA, 19 nt, Homo sapiens
ccacugcacccagcuaauu

SEQ ID NO: 171185 - RNA, 19 nt, Homo sapiens
uuucauaucugccaaaucg

SEQ ID NO: 171186 - RNA, 19 nt, Homo sapiens
caaaugguguuuucuuaug

SEQ ID NO: 171187 - RNA, 19 nt, Homo sapiens
cagccaggauugaccuuug

SEQ ID NO: 171188 - RNA, 19 nt, Homo sapiens
gauagggcacuacagauuc

SEQ ID NO: 171189 - RNA, 19 nt, Homo sapiens
caagagcaaccuggaacua

SEQ ID NO: 171190 - RNA, 19 nt, Homo sapiens
guaaugccuuggagcuugu

SEQ ID NO: 171191 - RNA, 19 nt, Homo sapiens
gcucagcacacaucccauu

SEQ ID NO: 171192 - RNA, 19 nt, Homo sapiens
ccacauggacgcaaacaag

SEQ ID NO: 171193 - RNA, 19 nt, Homo sapiens
acacaucccauuugauaga

SEQ ID NO: 171194 - RNA, 19 nt, Homo sapiens
ucacuaagaagcuugaauc

SEQ ID NO: 171195 - RNA, 19 nt, Homo sapiens
gguagugacaggcuuguau

SEQ ID NO: 171196 - RNA, 19 nt, Homo sapiens
caaggaagccucggcagau

SEQ ID NO: 171197 - RNA, 19 nt, Homo sapiens
cgcuaucagugccaauaua

SEQ ID NO: 171198 - RNA, 19 nt, Homo sapiens
ucccaugccuuucauaucu

SEQ ID NO: 171199 - RNA, 19 nt, Homo sapiens
ucuuaucugucuucugauu

SEQ ID NO: 171200 - RNA, 19 nt, Homo sapiens
guucaaaccaaucaaaugg

SEQ ID NO: 171201 - RNA, 19 nt, Homo sapiens
gagcuggagccaacagaug

SEQ ID NO: 171202 - RNA, 19 nt, Homo sapiens
ugagacugauccugaguuc

SEQ ID NO: 171203 - RNA, 19 nt, Homo sapiens
ccaccuuucugcacauaag

SEQ ID NO: 171204 - RNA, 19 nt, Homo sapiens
cagacuccauccaccaaga

SEQ ID NO: 171205 - RNA, 19 nt, Homo sapiens
ugccucagccucccaagua

SEQ ID NO: 171206 - RNA, 19 nt, Homo sapiens
uaucagugccaauauagga

SEQ ID NO: 171207 - RNA, 19 nt, Homo sapiens
gcaauagauguggaaauuc

SEQ ID NO: 171208 - RNA, 19 nt, Homo sapiens
ggagccaacagauguguca

SEQ ID NO: 171209 - RNA, 19 nt, Homo sapiens
uaggauagggcacuacaga

SEQ ID NO: 171210 - RNA, 19 nt, Homo sapiens
ggauggaucugugaaaauc

SEQ ID NO: 171211 - RNA, 19 nt, Homo sapiens
ccaaucaaaugguguuuuc

SEQ ID NO: 171212 - RNA, 19 nt, Homo sapiens
uaagaagcuugaaucuacu

SEQ ID NO: 171213 - RNA, 19 nt, Homo sapiens
aaacaaggcagggcgcuau

SEQ ID NO: 171214 - RNA, 19 nt, Homo sapiens
ccagaugcauguucaaacc

SEQ ID NO: 171215 - RNA, 19 nt, Homo sapiens
ucagugccaauauaggaua

SEQ ID NO: 171216 - RNA, 19 nt, Homo sapiens
agagcaaccuggaacuaag

SEQ ID NO: 171217 - RNA, 19 nt, Homo sapiens
ggaagccucggcagaugug

SEQ ID NO: 171218 - RNA, 19 nt, Homo sapiens
agacugaaguuuuggaaug

SEQ ID NO: 171219 - RNA, 19 nt, Homo sapiens
gagcaaccuggaacuaagu

SEQ ID NO: 171220 - RNA, 19 nt, Homo sapiens
gugauucccuuggauggau

SEQ ID NO: 171221 - RNA, 19 nt, Homo sapiens
ccaaaucgaguccugugau

SEQ ID NO: 171222 - RNA, 19 nt, Homo sapiens
aagagcaaccuggaacuaa

SEQ ID NO: 171223 - RNA, 19 nt, Homo sapiens
aagauuacacgacgcagaa

SEQ ID NO: 171224 - RNA, 19 nt, Homo sapiens
ccaaggagggagaacuuuc

SEQ ID NO: 171225 - RNA, 19 nt, Homo sapiens
guagugacaggcuuguaug

SEQ ID NO: 171226 - RNA, 19 nt, Homo sapiens
aauauaggauagggcacua

SEQ ID NO: 171227 - RNA, 19 nt, Homo sapiens
gaugcauguucaaaccaau

SEQ ID NO: 171228 - RNA, 19 nt, Homo sapiens
caaagugcugagauuauag

SEQ ID NO: 171229 - RNA, 19 nt, Homo sapiens
cauguucaaaccaaucaaa

SEQ ID NO: 171230 - RNA, 19 nt, Homo sapiens
gacaaagcuacuugaagga

SEQ ID NO: 171231 - RNA, 19 nt, Homo sapiens
ggccaaggagggagaacuu

SEQ ID NO: 171232 - RNA, 19 nt, Homo sapiens
uggcaaacccuuccucucu

SEQ ID NO: 171233 - RNA, 19 nt, Homo sapiens
uaccugacccagcugauga

SEQ ID NO: 171234 - RNA, 19 nt, Homo sapiens
agaugcauguucaaaccaa

SEQ ID NO: 171235 - RNA, 19 nt, Homo sapiens
ggccagaugcauguucaaa

SEQ ID NO: 171236 - RNA, 19 nt, Homo sapiens
ucccaaagugcugagauua

SEQ ID NO: 171237 - RNA, 19 nt, Homo sapiens
gauuuucacuggccaagga

SEQ ID NO: 171238 - RNA, 19 nt, Homo sapiens
aaggaagccucggcagaug

SEQ ID NO: 171239 - RNA, 19 nt, Homo sapiens
acacgacgcagaacuugau

SEQ ID NO: 171240 - RNA, 19 nt, Homo sapiens
auccugaguucgucauuga

SEQ ID NO: 171241 - RNA, 19 nt, Homo sapiens
gcugagauuauaggcauga

SEQ ID NO: 171242 - RNA, 19 nt, Homo sapiens
cucccaaagugcugagauu

SEQ ID NO: 171243 - RNA, 19 nt, Homo sapiens
acagauuccgguacaguga

SEQ ID NO: 171244 - RNA, 19 nt, Homo sapiens
gcgcuaucagugccaauau

SEQ ID NO: 171245 - RNA, 19 nt, Homo sapiens
gauuugcacccaccuuucu

SEQ ID NO: 171246 - RNA, 19 nt, Homo sapiens
cccaaagugcugagauuau

SEQ ID NO: 171247 - RNA, 19 nt, Homo sapiens
gaauuacaggcacauacca

SEQ ID NO: 171248 - RNA, 19 nt, Homo sapiens
acuaagaagcuugaaucua

SEQ ID NO: 171249 - RNA, 19 nt, Homo sapiens
ccauacugguugaaaauug

SEQ ID NO: 171250 - RNA, 19 nt, Homo sapiens
ucucuuggccauacugguu

SEQ ID NO: 171251 - RNA, 19 nt, Homo sapiens
uaucugucauccugcuaau

SEQ ID NO: 171252 - RNA, 19 nt, Homo sapiens
ggcagaagacugaaguuuu

SEQ ID NO: 171253 - RNA, 19 nt, Homo sapiens
ucugucauccugcuaaugu

SEQ ID NO: 171254 - RNA, 19 nt, Homo sapiens
ggaauuacaggcacauacc

SEQ ID NO: 171255 - RNA, 19 nt, Homo sapiens
ucccaaguagcuggaauua

SEQ ID NO: 171256 - RNA, 19 nt, Homo sapiens
guugaugccaggagagaau

SEQ ID NO: 171257 - RNA, 19 nt, Homo sapiens
agacugauccugaguucgu

SEQ ID NO: 171258 - RNA, 19 nt, Homo sapiens
ccuguuuaauuucuuccuu

SEQ ID NO: 171259 - RNA, 19 nt, Homo sapiens
ccuuucugcacauaaguua

SEQ ID NO: 171260 - RNA, 19 nt, Homo sapiens
gaggauucaggcacaggaa

SEQ ID NO: 171261 - RNA, 19 nt, Homo sapiens
guccugugauucccuugga

SEQ ID NO: 171262 - RNA, 19 nt, Homo sapiens
ugaaggacacaagagagaa

SEQ ID NO: 171263 - RNA, 19 nt, Homo sapiens
gcacacaucccauuugaua

SEQ ID NO: 171264 - RNA, 19 nt, Homo sapiens
gagaaaagcucacuaagaa

SEQ ID NO: 171265 - RNA, 19 nt, Homo sapiens
caucuuaucugucuucuga

SEQ ID NO: 171266 - RNA, 19 nt, Homo sapiens
ccaaagugcugagauuaua

SEQ ID NO: 171267 - RNA, 19 nt, Homo sapiens
ccaaguagcuggaauuaca

SEQ ID NO: 171268 - RNA, 19 nt, Homo sapiens
ggcaauagauguggaaauu

SEQ ID NO: 171269 - RNA, 19 nt, Homo sapiens
cuaagaagcuugaaucuac

SEQ ID NO: 171270 - RNA, 19 nt, Homo sapiens
ccaagugucugcaaguaaa

SEQ ID NO: 171271 - RNA, 19 nt, Homo sapiens
gaagugcaguggagcaauc

SEQ ID NO: 171272 - RNA, 19 nt, Homo sapiens
ggauugaccuuugcacgaa

SEQ ID NO: 171273 - RNA, 19 nt, Homo sapiens
cagcacacaucccauuuga

SEQ ID NO: 171274 - RNA, 19 nt, Homo sapiens
gcagaagacugaaguuuug

SEQ ID NO: 171275 - RNA, 19 nt, Homo sapiens
gagauaggcagaagacuga

SEQ ID NO: 171276 - RNA, 19 nt, Homo sapiens
ggauagggcacuacagauu

SEQ ID NO: 171277 - RNA, 19 nt, Homo sapiens
gaaggacacaagagagaaa

SEQ ID NO: 171278 - RNA, 19 nt, Homo sapiens
augcaggacugaucgauuu

SEQ ID NO: 171279 - RNA, 19 nt, Homo sapiens
caucccauuugauagauuu

SEQ ID NO: 171280 - RNA, 19 nt, Homo sapiens
caccaagugucugcaagua

SEQ ID NO: 171281 - RNA, 19 nt, Homo sapiens
cuucauuguucuucucuuu

SEQ ID NO: 171282 - RNA, 19 nt, Homo sapiens
auacggcacugaacaagga

SEQ ID NO: 171283 - RNA, 19 nt, Homo sapiens
gauccugaguucgucauug

SEQ ID NO: 171284 - RNA, 19 nt, Homo sapiens
ccacugcacccagcuaauu

SEQ ID NO: 171285 - RNA, 19 nt, Homo sapiens
uuucauaucugccaaaucg

SEQ ID NO: 171286 - RNA, 19 nt, Homo sapiens
caaaugguguuuucuuaug

SEQ ID NO: 171287 - RNA, 19 nt, Homo sapiens
cagccaggauugaccuuug

SEQ ID NO: 171288 - RNA, 19 nt, Homo sapiens
gauagggcacuacagauuc

SEQ ID NO: 171289 - RNA, 19 nt, Homo sapiens
caagagcaaccuggaacua

SEQ ID NO: 171290 - RNA, 19 nt, Homo sapiens
gcucagcacacaucccauu

SEQ ID NO: 171291 - RNA, 19 nt, Homo sapiens
ccacauggacgcaaacaag

SEQ ID NO: 171292 - RNA, 19 nt, Homo sapiens
acacaucccauuugauaga

SEQ ID NO: 171293 - RNA, 19 nt, Homo sapiens
ucacuaagaagcuugaauc

SEQ ID NO: 171294 - RNA, 19 nt, Homo sapiens
gguagugacaggcuuguau

SEQ ID NO: 171295 - RNA, 19 nt, Homo sapiens
caaggaagccucggcagau

SEQ ID NO: 171296 - RNA, 19 nt, Homo sapiens
cgcuaucagugccaauaua

SEQ ID NO: 171297 - RNA, 19 nt, Homo sapiens
ucccaugccuuucauaucu

SEQ ID NO: 171298 - RNA, 19 nt, Homo sapiens
ucuuaucugucuucugauu

SEQ ID NO: 171299 - RNA, 19 nt, Homo sapiens
guucaaaccaaucaaaugg

SEQ ID NO: 171300 - RNA, 19 nt, Homo sapiens
gagcuggagccaacagaug

SEQ ID NO: 171301 - RNA, 19 nt, Homo sapiens
ugagacugauccugaguuc

SEQ ID NO: 171302 - RNA, 19 nt, Homo sapiens
ccaccuuucugcacauaag

SEQ ID NO: 171303 - RNA, 19 nt, Homo sapiens
ugccucagccucccaagua

SEQ ID NO: 171304 - RNA, 19 nt, Homo sapiens
uaucagugccaauauagga

SEQ ID NO: 171305 - RNA, 19 nt, Homo sapiens
gcaauagauguggaaauuc

SEQ ID NO: 171306 - RNA, 19 nt, Homo sapiens
ggagccaacagauguguca

SEQ ID NO: 171307 - RNA, 19 nt, Homo sapiens
uaggauagggcacuacaga

SEQ ID NO: 171308 - RNA, 19 nt, Homo sapiens
ggauggaucugugaaaauc

SEQ ID NO: 171309 - RNA, 19 nt, Homo sapiens
ccaaucaaaugguguuuuc

SEQ ID NO: 171310 - RNA, 19 nt, Homo sapiens
uaagaagcuugaaucuacu

SEQ ID NO: 171311 - RNA, 19 nt, Homo sapiens
aaacaaggcagggcgcuau

SEQ ID NO: 171312 - RNA, 19 nt, Homo sapiens
ccagaugcauguucaaacc

SEQ ID NO: 171313 - RNA, 19 nt, Homo sapiens
ucagugccaauauaggaua

SEQ ID NO: 171314 - RNA, 19 nt, Homo sapiens
agagcaaccuggaacuaag

SEQ ID NO: 171315 - RNA, 19 nt, Homo sapiens
ggaagccucggcagaugug

SEQ ID NO: 171316 - RNA, 19 nt, Homo sapiens
gagcaaccuggaacuaagu

SEQ ID NO: 171317 - RNA, 19 nt, Homo sapiens
agacugaaguuuuggaaug

SEQ ID NO: 171318 - RNA, 19 nt, Homo sapiens
gugauucccuuggauggau

SEQ ID NO: 171319 - RNA, 19 nt, Homo sapiens
ccaaaucgaguccugugau

SEQ ID NO: 171320 - RNA, 19 nt, Homo sapiens
aagagcaaccuggaacuaa

SEQ ID NO: 171321 - RNA, 19 nt, Homo sapiens
aagauuacacgacgcagaa

SEQ ID NO: 171322 - RNA, 19 nt, Homo sapiens
ccaaggagggagaacuuuc

SEQ ID NO: 171323 - RNA, 19 nt, Homo sapiens
guagugacaggcuuguaug

SEQ ID NO: 171324 - RNA, 19 nt, Homo sapiens
aauauaggauagggcacua

SEQ ID NO: 171325 - RNA, 19 nt, Homo sapiens
gaugcauguucaaaccaau

SEQ ID NO: 171326 - RNA, 19 nt, Homo sapiens
caaagugcugagauuauag

SEQ ID NO: 171327 - RNA, 19 nt, Homo sapiens
cauguucaaaccaaucaaa

SEQ ID NO: 171328 - RNA, 19 nt, Homo sapiens
gacaaagcuacuugaagga

SEQ ID NO: 171329 - RNA, 19 nt, Homo sapiens
ggccaaggagggagaacuu

SEQ ID NO: 171330 - RNA, 19 nt, Homo sapiens
uggcaaacccuuccucucu

SEQ ID NO: 171331 - RNA, 19 nt, Homo sapiens
uaccugacccagcugauga

SEQ ID NO: 171332 - RNA, 19 nt, Homo sapiens
agaugcauguucaaaccaa

SEQ ID NO: 171333 - RNA, 19 nt, Homo sapiens
ggccagaugcauguucaaa

SEQ ID NO: 171334 - RNA, 19 nt, Homo sapiens
ucccaaagugcugagauua

SEQ ID NO: 171335 - RNA, 19 nt, Homo sapiens
gauuuucacuggccaagga

SEQ ID NO: 171336 - RNA, 19 nt, Homo sapiens
aaggaagccucggcagaug

SEQ ID NO: 171337 - RNA, 19 nt, Homo sapiens
acacgacgcagaacuugau

SEQ ID NO: 171338 - RNA, 19 nt, Homo sapiens
auccugaguucgucauuga

SEQ ID NO: 171339 - RNA, 19 nt, Homo sapiens
gcugagauuauaggcauga

SEQ ID NO: 171340 - RNA, 19 nt, Homo sapiens
cucccaaagugcugagauu

SEQ ID NO: 171341 - RNA, 19 nt, Homo sapiens
acagauuccgguacaguga

SEQ ID NO: 171342 - RNA, 19 nt, Homo sapiens
gcgcuaucagugccaauau

SEQ ID NO: 171343 - RNA, 19 nt, Homo sapiens
gauuugcacccaccuuucu

SEQ ID NO: 171344 - RNA, 19 nt, Homo sapiens
cccaaagugcugagauuau

SEQ ID NO: 171345 - RNA, 19 nt, Homo sapiens
gaauuacaggcacauacca

SEQ ID NO: 171346 - RNA, 19 nt, Homo sapiens
acuaagaagcuugaaucua

SEQ ID NO: 171347 - RNA, 19 nt, Homo sapiens
ccauacugguugaaaauug

SEQ ID NO: 171348 - RNA, 19 nt, Homo sapiens
ucucuuggccauacugguu

SEQ ID NO: 171349 - RNA, 19 nt, Homo sapiens
uaucugucauccugcuaau

SEQ ID NO: 171350 - RNA, 19 nt, Homo sapiens
ggcagaagacugaaguuuu

SEQ ID NO: 171351 - RNA, 19 nt, Homo sapiens
ucugucauccugcuaaugu

SEQ ID NO: 171352 - RNA, 19 nt, Homo sapiens
ggaauuacaggcacauacc

SEQ ID NO: 171353 - RNA, 19 nt, Homo sapiens
ucccaaguagcuggaauua

SEQ ID NO: 171354 - RNA, 19 nt, Homo sapiens
guugaugccaggagagaau

SEQ ID NO: 171355 - RNA, 19 nt, Homo sapiens
agacugauccugaguucgu

SEQ ID NO: 171356 - RNA, 19 nt, Homo sapiens
ccuguuuaauuucuuccuu

SEQ ID NO: 171357 - RNA, 19 nt, Homo sapiens
ccuuucugcacauaaguua

SEQ ID NO: 171358 - RNA, 19 nt, Homo sapiens
guccugugauucccuugga

SEQ ID NO: 171359 - RNA, 19 nt, Homo sapiens
gaggauucaggcacaggaa

SEQ ID NO: 171360 - RNA, 19 nt, Homo sapiens
ugaaggacacaagagagaa

SEQ ID NO: 171361 - RNA, 19 nt, Homo sapiens
gccauacggcacugaacaa

SEQ ID NO: 171362 - RNA, 19 nt, Homo sapiens
gccaaggagggagaacuuu

SEQ ID NO: 171363 - RNA, 19 nt, Homo sapiens
gagaaaagcucacuaagaa

SEQ ID NO: 171364 - RNA, 19 nt, Homo sapiens
caucuuaucugucuucuga

SEQ ID NO: 171365 - RNA, 19 nt, Homo sapiens
ccaaagugcugagauuaua

SEQ ID NO: 171366 - RNA, 19 nt, Homo sapiens
ccaaguagcuggaauuaca

SEQ ID NO: 171367 - RNA, 19 nt, Homo sapiens
ggcaauagauguggaaauu

SEQ ID NO: 171368 - RNA, 19 nt, Homo sapiens
cuaagaagcuugaaucuac

SEQ ID NO: 171369 - RNA, 19 nt, Homo sapiens
ccaagugucugcaaguaaa

SEQ ID NO: 171370 - RNA, 19 nt, Homo sapiens
gaagugcaguggagcaauc

SEQ ID NO: 171371 - RNA, 19 nt, Homo sapiens
ggauugaccuuugcacgaa

SEQ ID NO: 171372 - RNA, 19 nt, Homo sapiens
gcagaagacugaaguuuug

SEQ ID NO: 171373 - RNA, 19 nt, Homo sapiens
gagauaggcagaagacuga

SEQ ID NO: 171374 - RNA, 19 nt, Homo sapiens
ggauagggcacuacagauu

SEQ ID NO: 171375 - RNA, 19 nt, Homo sapiens
gaaggacacaagagagaaa

SEQ ID NO: 171376 - RNA, 19 nt, Homo sapiens
augcaggacugaucgauuu

SEQ ID NO: 171377 - RNA, 19 nt, Homo sapiens
caccaagugucugcaagua

SEQ ID NO: 171378 - RNA, 19 nt, Homo sapiens
cuucauuguucuucucuuu

SEQ ID NO: 171379 - RNA, 19 nt, Homo sapiens
auacggcacugaacaagga

SEQ ID NO: 171380 - RNA, 19 nt, Homo sapiens
gauccugaguucgucauug

SEQ ID NO: 171381 - RNA, 19 nt, Homo sapiens
ccacugcacccagcuaauu

SEQ ID NO: 171382 - RNA, 19 nt, Homo sapiens
uuucauaucugccaaaucg

SEQ ID NO: 171383 - RNA, 19 nt, Homo sapiens
caaaugguguuuucuuaug

SEQ ID NO: 171384 - RNA, 19 nt, Homo sapiens
cagccaggauugaccuuug

SEQ ID NO: 171385 - RNA, 19 nt, Homo sapiens
gauagggcacuacagauuc

SEQ ID NO: 171386 - RNA, 19 nt, Homo sapiens
caagagcaaccuggaacua

SEQ ID NO: 171387 - RNA, 19 nt, Homo sapiens
ccacauggacgcaaacaag

SEQ ID NO: 171388 - RNA, 19 nt, Homo sapiens
ucacuaagaagcuugaauc

SEQ ID NO: 171389 - RNA, 19 nt, Homo sapiens
caaggaagccucggcagau

SEQ ID NO: 171390 - RNA, 19 nt, Homo sapiens
cgcuaucagugccaauaua

SEQ ID NO: 171391 - RNA, 19 nt, Homo sapiens
ucccaugccuuucauaucu

SEQ ID NO: 171392 - RNA, 19 nt, Homo sapiens
ucuuaucugucuucugauu

SEQ ID NO: 171393 - RNA, 19 nt, Homo sapiens
guucaaaccaaucaaaugg

SEQ ID NO: 171394 - RNA, 19 nt, Homo sapiens
gagcuggagccaacagaug

SEQ ID NO: 171395 - RNA, 19 nt, Homo sapiens
ugagacugauccugaguuc

SEQ ID NO: 171396 - RNA, 19 nt, Homo sapiens
ccaccuuucugcacauaag

SEQ ID NO: 171397 - RNA, 19 nt, Homo sapiens
cagacuccauccaccaaga

SEQ ID NO: 171398 - RNA, 19 nt, Homo sapiens
ugccucagccucccaagua

SEQ ID NO: 171399 - RNA, 19 nt, Homo sapiens
gcaauagauguggaaauuc

SEQ ID NO: 171400 - RNA, 19 nt, Homo sapiens
uaucagugccaauauagga

SEQ ID NO: 171401 - RNA, 19 nt, Homo sapiens
ggagccaacagauguguca

SEQ ID NO: 171402 - RNA, 19 nt, Homo sapiens
uaggauagggcacuacaga

SEQ ID NO: 171403 - RNA, 19 nt, Homo sapiens
ggauggaucugugaaaauc

SEQ ID NO: 171404 - RNA, 19 nt, Homo sapiens
ccaaucaaaugguguuuuc

SEQ ID NO: 171405 - RNA, 19 nt, Homo sapiens
uaagaagcuugaaucuacu

SEQ ID NO: 171406 - RNA, 19 nt, Homo sapiens
aaacaaggcagggcgcuau

SEQ ID NO: 171407 - RNA, 19 nt, Homo sapiens
ccagaugcauguucaaacc

SEQ ID NO: 171408 - RNA, 19 nt, Homo sapiens
ucagugccaauauaggaua

SEQ ID NO: 171409 - RNA, 19 nt, Homo sapiens
gagcaaccuggaacuaagu

SEQ ID NO: 171410 - RNA, 19 nt, Homo sapiens
ggaagccucggcagaugug

SEQ ID NO: 171411 - RNA, 19 nt, Homo sapiens
agacugaaguuuuggaaug

SEQ ID NO: 171412 - RNA, 19 nt, Homo sapiens
agagcaaccuggaacuaag

SEQ ID NO: 171413 - RNA, 19 nt, Homo sapiens
gugauucccuuggauggau

SEQ ID NO: 171414 - RNA, 19 nt, Homo sapiens
ccaaaucgaguccugugau

SEQ ID NO: 171415 - RNA, 19 nt, Homo sapiens
aagagcaaccuggaacuaa

SEQ ID NO: 171416 - RNA, 19 nt, Homo sapiens
aagauuacacgacgcagaa

SEQ ID NO: 171417 - RNA, 19 nt, Homo sapiens
aauauaggauagggcacua

SEQ ID NO: 171418 - RNA, 19 nt, Homo sapiens
gaugcauguucaaaccaau

SEQ ID NO: 171419 - RNA, 19 nt, Homo sapiens
caaagugcugagauuauag

SEQ ID NO: 171420 - RNA, 19 nt, Homo sapiens
cauguucaaaccaaucaaa

SEQ ID NO: 171421 - RNA, 19 nt, Homo sapiens
gacaaagcuacuugaagga

SEQ ID NO: 171422 - RNA, 19 nt, Homo sapiens
uaccugacccagcugauga

SEQ ID NO: 171423 - RNA, 19 nt, Homo sapiens
agaugcauguucaaaccaa

SEQ ID NO: 171424 - RNA, 19 nt, Homo sapiens
ggccagaugcauguucaaa

SEQ ID NO: 171425 - RNA, 19 nt, Homo sapiens
ucccaaagugcugagauua

SEQ ID NO: 171426 - RNA, 19 nt, Homo sapiens
aaggaagccucggcagaug

SEQ ID NO: 171427 - RNA, 19 nt, Homo sapiens
acacgacgcagaacuugau

SEQ ID NO: 171428 - RNA, 19 nt, Homo sapiens
gacagacuccauccaccaa

SEQ ID NO: 171429 - RNA, 19 nt, Homo sapiens
auccugaguucgucauuga

SEQ ID NO: 171430 - RNA, 19 nt, Homo sapiens
gcugagauuauaggcauga

SEQ ID NO: 171431 - RNA, 19 nt, Homo sapiens
cucccaaagugcugagauu

SEQ ID NO: 171432 - RNA, 19 nt, Homo sapiens
acagauuccgguacaguga

SEQ ID NO: 171433 - RNA, 19 nt, Homo sapiens
gcgcuaucagugccaauau

SEQ ID NO: 171434 - RNA, 19 nt, Homo sapiens
gauuugcacccaccuuucu

SEQ ID NO: 171435 - RNA, 19 nt, Homo sapiens
cccaaagugcugagauuau

SEQ ID NO: 171436 - RNA, 19 nt, Homo sapiens
gaauuacaggcacauacca

SEQ ID NO: 171437 - RNA, 19 nt, Homo sapiens
acuaagaagcuugaaucua

SEQ ID NO: 171438 - RNA, 19 nt, Homo sapiens
ccauacugguugaaaauug

SEQ ID NO: 171439 - RNA, 19 nt, Homo sapiens
ucucuuggccauacugguu

SEQ ID NO: 171440 - RNA, 19 nt, Homo sapiens
uaucugucauccugcuaau

SEQ ID NO: 171441 - RNA, 19 nt, Homo sapiens
ggcagaagacugaaguuuu

SEQ ID NO: 171442 - RNA, 19 nt, Homo sapiens
ggaauuacaggcacauacc

SEQ ID NO: 171443 - RNA, 19 nt, Homo sapiens
ucccaaguagcuggaauua

SEQ ID NO: 171444 - RNA, 19 nt, Homo sapiens
ucugucauccugcuaaugu

SEQ ID NO: 171445 - RNA, 19 nt, Homo sapiens
agacugauccugaguucgu

SEQ ID NO: 171446 - RNA, 19 nt, Homo sapiens
ccuguuuaauuucuuccuu

SEQ ID NO: 171447 - RNA, 19 nt, Homo sapiens
ccuuucugcacauaaguua

SEQ ID NO: 171448 - RNA, 19 nt, Homo sapiens
gucguaagaauaucuguca

SEQ ID NO: 171449 - RNA, 19 nt, Homo sapiens
ugaaggacacaagagagaa

SEQ ID NO: 171450 - RNA, 19 nt, Homo sapiens
gccauacggcacugaacaa

SEQ ID NO: 171451 - RNA, 19 nt, Homo sapiens
gaggauucaggcacaggaa

SEQ ID NO: 171452 - RNA, 19 nt, Homo sapiens
cacuacagauuccgguaca

SEQ ID NO: 171453 - RNA, 19 nt, Homo sapiens
guccugugauucccuugga

SEQ ID NO: 171454 - RNA, 19 nt, Homo sapiens
gcacacaucccauuugaua

SEQ ID NO: 171455 - RNA, 19 nt, Homo sapiens
gagaaaagcucacuaagaa

SEQ ID NO: 171456 - RNA, 19 nt, Homo sapiens
caucuuaucugucuucuga

SEQ ID NO: 171457 - RNA, 19 nt, Homo sapiens
ccaaagugcugagauuaua

SEQ ID NO: 171458 - RNA, 19 nt, Homo sapiens
ccaaguagcuggaauuaca

SEQ ID NO: 171459 - RNA, 19 nt, Homo sapiens
ggcaauagauguggaaauu

SEQ ID NO: 171460 - RNA, 19 nt, Homo sapiens
cuaagaagcuugaaucuac

SEQ ID NO: 171461 - RNA, 19 nt, Homo sapiens
ccaagugucugcaaguaaa

SEQ ID NO: 171462 - RNA, 19 nt, Homo sapiens
gaagugcaguggagcaauc

SEQ ID NO: 171463 - RNA, 19 nt, Homo sapiens
ggauugaccuuugcacgaa

SEQ ID NO: 171464 - RNA, 19 nt, Homo sapiens
cagcacacaucccauuuga

SEQ ID NO: 171465 - RNA, 19 nt, Homo sapiens
gcagaagacugaaguuuug

SEQ ID NO: 171466 - RNA, 19 nt, Homo sapiens
gagauaggcagaagacuga

SEQ ID NO: 171467 - RNA, 19 nt, Homo sapiens
ggauagggcacuacagauu

SEQ ID NO: 171468 - RNA, 19 nt, Homo sapiens
gaaggacacaagagagaaa

SEQ ID NO: 171469 - RNA, 19 nt, Homo sapiens
augcaggacugaucgauuu

SEQ ID NO: 171470 - RNA, 19 nt, Homo sapiens
caucccauuugauagauuu

SEQ ID NO: 171471 - RNA, 19 nt, Homo sapiens
caccaagugucugcaagua

SEQ ID NO: 171472 - RNA, 19 nt, Homo sapiens
cuucauuguucuucucuuu

SEQ ID NO: 171473 - RNA, 19 nt, Homo sapiens
auacggcacugaacaagga

SEQ ID NO: 171474 - RNA, 19 nt, Homo sapiens
gauccugaguucgucauug

SEQ ID NO: 171475 - RNA, 19 nt, Homo sapiens
ccacugcacccagcuaauu

SEQ ID NO: 171476 - RNA, 19 nt, Homo sapiens
uuucauaucugccaaaucg

SEQ ID NO: 171477 - RNA, 19 nt, Homo sapiens
caaaugguguuuucuuaug

SEQ ID NO: 171478 - RNA, 19 nt, Homo sapiens
cagccaggauugaccuuug

SEQ ID NO: 171479 - RNA, 19 nt, Homo sapiens
gauagggcacuacagauuc

SEQ ID NO: 171480 - RNA, 19 nt, Homo sapiens
caagagcaaccuggaacua

SEQ ID NO: 171481 - RNA, 19 nt, Homo sapiens
guaaugccuuggagcuugu

SEQ ID NO: 171482 - RNA, 19 nt, Homo sapiens
gcucagcacacaucccauu

SEQ ID NO: 171483 - RNA, 19 nt, Homo sapiens
ccacauggacgcaaacaag

SEQ ID NO: 171484 - RNA, 19 nt, Homo sapiens
acacaucccauuugauaga

SEQ ID NO: 171485 - RNA, 19 nt, Homo sapiens
ucacuaagaagcuugaauc

SEQ ID NO: 171486 - RNA, 19 nt, Homo sapiens
gguagugacaggcuuguau

SEQ ID NO: 171487 - RNA, 19 nt, Homo sapiens
caaggaagccucggcagau

SEQ ID NO: 171488 - RNA, 19 nt, Homo sapiens
cgcuaucagugccaauaua

SEQ ID NO: 171489 - RNA, 19 nt, Homo sapiens
ucccaugccuuucauaucu

SEQ ID NO: 171490 - RNA, 19 nt, Homo sapiens
ucuuaucugucuucugauu

SEQ ID NO: 171491 - RNA, 19 nt, Homo sapiens
guucaaaccaaucaaaugg

SEQ ID NO: 171492 - RNA, 19 nt, Homo sapiens
gagcuggagccaacagaug

SEQ ID NO: 171493 - RNA, 19 nt, Homo sapiens
ugagacugauccugaguuc

SEQ ID NO: 171494 - RNA, 19 nt, Homo sapiens
ccaccuuucugcacauaag

SEQ ID NO: 171495 - RNA, 19 nt, Homo sapiens
cagacuccauccaccaaga

SEQ ID NO: 171496 - RNA, 19 nt, Homo sapiens
ugccucagccucccaagua

SEQ ID NO: 171497 - RNA, 19 nt, Homo sapiens
uaucagugccaauauagga

SEQ ID NO: 171498 - RNA, 19 nt, Homo sapiens
gcaauagauguggaaauuc

SEQ ID NO: 171499 - RNA, 19 nt, Homo sapiens
ggagccaacagauguguca

SEQ ID NO: 171500 - RNA, 19 nt, Homo sapiens
uaggauagggcacuacaga

SEQ ID NO: 171501 - RNA, 19 nt, Homo sapiens
ggauggaucugugaaaauc

SEQ ID NO: 171502 - RNA, 19 nt, Homo sapiens
ccaaucaaaugguguuuuc

SEQ ID NO: 171503 - RNA, 19 nt, Homo sapiens
uaagaagcuugaaucuacu

SEQ ID NO: 171504 - RNA, 19 nt, Homo sapiens
aaacaaggcagggcgcuau

SEQ ID NO: 171505 - RNA, 19 nt, Homo sapiens
ccagaugcauguucaaacc

SEQ ID NO: 171506 - RNA, 19 nt, Homo sapiens
ucagugccaauauaggaua

SEQ ID NO: 171507 - RNA, 19 nt, Homo sapiens
agagcaaccuggaacuaag

SEQ ID NO: 171508 - RNA, 19 nt, Homo sapiens
ggaagccucggcagaugug

SEQ ID NO: 171509 - RNA, 19 nt, Homo sapiens
gagcaaccuggaacuaagu

SEQ ID NO: 171510 - RNA, 19 nt, Homo sapiens
agacugaaguuuuggaaug

SEQ ID NO: 171511 - RNA, 19 nt, Homo sapiens
gugauucccuuggauggau

SEQ ID NO: 171512 - RNA, 19 nt, Homo sapiens
ccaaaucgaguccugugau

SEQ ID NO: 171513 - RNA, 19 nt, Homo sapiens
aagagcaaccuggaacuaa

SEQ ID NO: 171514 - RNA, 19 nt, Homo sapiens
aagauuacacgacgcagaa

SEQ ID NO: 171515 - RNA, 19 nt, Homo sapiens
ccaaggagggagaacuuuc

SEQ ID NO: 171516 - RNA, 19 nt, Homo sapiens
guagugacaggcuuguaug

SEQ ID NO: 171517 - RNA, 19 nt, Homo sapiens
aauauaggauagggcacua

SEQ ID NO: 171518 - RNA, 19 nt, Homo sapiens
gaugcauguucaaaccaau

SEQ ID NO: 171519 - RNA, 19 nt, Homo sapiens
caaagugcugagauuauag

SEQ ID NO: 171520 - RNA, 19 nt, Homo sapiens
cauguucaaaccaaucaaa

SEQ ID NO: 171521 - RNA, 19 nt, Homo sapiens
gacaaagcuacuugaagga

SEQ ID NO: 171522 - RNA, 19 nt, Homo sapiens
ggccaaggagggagaacuu

SEQ ID NO: 171523 - RNA, 19 nt, Homo sapiens
uggcaaacccuuccucucu

SEQ ID NO: 171524 - RNA, 19 nt, Homo sapiens
uaccugacccagcugauga

SEQ ID NO: 171525 - RNA, 19 nt, Homo sapiens
agaugcauguucaaaccaa

SEQ ID NO: 171526 - RNA, 19 nt, Homo sapiens
ggccagaugcauguucaaa

SEQ ID NO: 171527 - RNA, 19 nt, Homo sapiens
ucccaaagugcugagauua

SEQ ID NO: 171528 - RNA, 19 nt, Homo sapiens
gauuuucacuggccaagga

SEQ ID NO: 171529 - RNA, 19 nt, Homo sapiens
aaggaagccucggcagaug

SEQ ID NO: 171530 - RNA, 19 nt, Homo sapiens
acacgacgcagaacuugau

SEQ ID NO: 171531 - RNA, 19 nt, Homo sapiens
auccugaguucgucauuga

SEQ ID NO: 171532 - RNA, 19 nt, Homo sapiens
gcugagauuauaggcauga

SEQ ID NO: 171533 - RNA, 19 nt, Homo sapiens
cucccaaagugcugagauu

SEQ ID NO: 171534 - RNA, 19 nt, Homo sapiens
acagauuccgguacaguga

SEQ ID NO: 171535 - RNA, 19 nt, Homo sapiens
gcgcuaucagugccaauau

SEQ ID NO: 171536 - RNA, 19 nt, Homo sapiens
gauuugcacccaccuuucu

SEQ ID NO: 171537 - RNA, 19 nt, Homo sapiens
cccaaagugcugagauuau

SEQ ID NO: 171538 - RNA, 19 nt, Homo sapiens
gaauuacaggcacauacca

SEQ ID NO: 171539 - RNA, 19 nt, Homo sapiens
acuaagaagcuugaaucua

SEQ ID NO: 171540 - RNA, 19 nt, Homo sapiens
ccauacugguugaaaauug

SEQ ID NO: 171541 - RNA, 19 nt, Homo sapiens
ucucuuggccauacugguu

SEQ ID NO: 171542 - RNA, 19 nt, Homo sapiens
uaucugucauccugcuaau

SEQ ID NO: 171543 - RNA, 19 nt, Homo sapiens
ggcagaagacugaaguuuu

SEQ ID NO: 171544 - RNA, 19 nt, Homo sapiens
ucugucauccugcuaaugu

SEQ ID NO: 171545 - RNA, 19 nt, Homo sapiens
ggaauuacaggcacauacc

SEQ ID NO: 171546 - RNA, 19 nt, Homo sapiens
ucccaaguagcuggaauua

SEQ ID NO: 171547 - RNA, 19 nt, Homo sapiens
guugaugccaggagagaau

SEQ ID NO: 171548 - RNA, 19 nt, Homo sapiens
agacugauccugaguucgu

SEQ ID NO: 171549 - RNA, 19 nt, Homo sapiens
ccuguuuaauuucuuccuu

SEQ ID NO: 171550 - RNA, 19 nt, Homo sapiens
ccuuucugcacauaaguua

SEQ ID NO: 171551 - RNA, 19 nt, Homo sapiens
guccugugauucccuugga

SEQ ID NO: 171552 - RNA, 19 nt, Homo sapiens
ugaaggacacaagagagaa

SEQ ID NO: 171553 - RNA, 19 nt, Homo sapiens
gccauacggcacugaacaa

SEQ ID NO: 171554 - RNA, 19 nt, Homo sapiens
gagaaaagcucacuaagaa

SEQ ID NO: 171555 - RNA, 19 nt, Homo sapiens
caucuuaucugucuucuga

SEQ ID NO: 171556 - RNA, 19 nt, Homo sapiens
ccaaagugcugagauuaua

SEQ ID NO: 171557 - RNA, 19 nt, Homo sapiens
ccaaguagcuggaauuaca

SEQ ID NO: 171558 - RNA, 19 nt, Homo sapiens
ggcaauagauguggaaauu

SEQ ID NO: 171559 - RNA, 19 nt, Homo sapiens
cuaagaagcuugaaucuac

SEQ ID NO: 171560 - RNA, 19 nt, Homo sapiens
ccaagugucugcaaguaaa

SEQ ID NO: 171561 - RNA, 19 nt, Homo sapiens
gaagugcaguggagcaauc

SEQ ID NO: 171562 - RNA, 19 nt, Homo sapiens
ggauugaccuuugcacgaa

SEQ ID NO: 171563 - RNA, 19 nt, Homo sapiens
gcagaagacugaaguuuug

SEQ ID NO: 171564 - RNA, 19 nt, Homo sapiens
gagauaggcagaagacuga

SEQ ID NO: 171565 - RNA, 19 nt, Homo sapiens
ggauagggcacuacagauu

SEQ ID NO: 171566 - RNA, 19 nt, Homo sapiens
gaaggacacaagagagaaa

SEQ ID NO: 171567 - RNA, 19 nt, Homo sapiens
augcaggacugaucgauuu

SEQ ID NO: 171568 - RNA, 19 nt, Homo sapiens
caccaagugucugcaagua

SEQ ID NO: 171569 - RNA, 19 nt, Homo sapiens
cuucauuguucuucucuuu

SEQ ID NO: 171570 - RNA, 19 nt, Homo sapiens
auacggcacugaacaagga

SEQ ID NO: 171571 - RNA, 19 nt, Homo sapiens
gauccugaguucgucauug

SEQ ID NO: 171572 - RNA, 19 nt, Homo sapiens
ccacugcacccagcuaauu

SEQ ID NO: 171573 - RNA, 19 nt, Homo sapiens
uuucauaucugccaaaucg

SEQ ID NO: 171574 - RNA, 19 nt, Homo sapiens
caaaugguguuuucuuaug

SEQ ID NO: 171575 - RNA, 19 nt, Homo sapiens
cagccaggauugaccuuug

SEQ ID NO: 171576 - RNA, 19 nt, Homo sapiens
gauagggcacuacagauuc

SEQ ID NO: 171577 - RNA, 19 nt, Homo sapiens
caagagcaaccuggaacua

SEQ ID NO: 171578 - RNA, 19 nt, Homo sapiens
ccacauggacgcaaacaag

SEQ ID NO: 171579 - RNA, 19 nt, Homo sapiens
ucacuaagaagcuugaauc

SEQ ID NO: 171580 - RNA, 19 nt, Homo sapiens
caaggaagccucggcagau

SEQ ID NO: 171581 - RNA, 19 nt, Homo sapiens
cgcuaucagugccaauaua

SEQ ID NO: 171582 - RNA, 19 nt, Homo sapiens
ucccaugccuuucauaucu

SEQ ID NO: 171583 - RNA, 19 nt, Homo sapiens
ucuuaucugucuucugauu

SEQ ID NO: 171584 - RNA, 19 nt, Homo sapiens
guucaaaccaaucaaaugg

SEQ ID NO: 171585 - RNA, 19 nt, Homo sapiens
gagcuggagccaacagaug

SEQ ID NO: 171586 - RNA, 19 nt, Homo sapiens
ugagacugauccugaguuc

SEQ ID NO: 171587 - RNA, 19 nt, Homo sapiens
ccaccuuucugcacauaag

SEQ ID NO: 171588 - RNA, 19 nt, Homo sapiens
cagacuccauccaccaaga

SEQ ID NO: 171589 - RNA, 19 nt, Homo sapiens
ugccucagccucccaagua

SEQ ID NO: 171590 - RNA, 19 nt, Homo sapiens
gcaauagauguggaaauuc

SEQ ID NO: 171591 - RNA, 19 nt, Homo sapiens
uaucagugccaauauagga

SEQ ID NO: 171592 - RNA, 19 nt, Homo sapiens
ggagccaacagauguguca

SEQ ID NO: 171593 - RNA, 19 nt, Homo sapiens
uaggauagggcacuacaga

SEQ ID NO: 171594 - RNA, 19 nt, Homo sapiens
ggauggaucugugaaaauc

SEQ ID NO: 171595 - RNA, 19 nt, Homo sapiens
ccaaucaaaugguguuuuc

SEQ ID NO: 171596 - RNA, 19 nt, Homo sapiens
uaagaagcuugaaucuacu

SEQ ID NO: 171597 - RNA, 19 nt, Homo sapiens
aaacaaggcagggcgcuau

SEQ ID NO: 171598 - RNA, 19 nt, Homo sapiens
ccagaugcauguucaaacc

SEQ ID NO: 171599 - RNA, 19 nt, Homo sapiens
ucagugccaauauaggaua

SEQ ID NO: 171600 - RNA, 19 nt, Homo sapiens
gagcaaccuggaacuaagu

SEQ ID NO: 171601 - RNA, 19 nt, Homo sapiens
ggaagccucggcagaugug

SEQ ID NO: 171602 - RNA, 19 nt, Homo sapiens
agacugaaguuuuggaaug

SEQ ID NO: 171603 - RNA, 19 nt, Homo sapiens
agagcaaccuggaacuaag

SEQ ID NO: 171604 - RNA, 19 nt, Homo sapiens
gugauucccuuggauggau

SEQ ID NO: 171605 - RNA, 19 nt, Homo sapiens
ccaaaucgaguccugugau

SEQ ID NO: 171606 - RNA, 19 nt, Homo sapiens
aagagcaaccuggaacuaa

SEQ ID NO: 171607 - RNA, 19 nt, Homo sapiens
aagauuacacgacgcagaa

SEQ ID NO: 171608 - RNA, 19 nt, Homo sapiens
aauauaggauagggcacua

SEQ ID NO: 171609 - RNA, 19 nt, Homo sapiens
gaugcauguucaaaccaau

SEQ ID NO: 171610 - RNA, 19 nt, Homo sapiens
caaagugcugagauuauag

SEQ ID NO: 171611 - RNA, 19 nt, Homo sapiens
cauguucaaaccaaucaaa

SEQ ID NO: 171612 - RNA, 19 nt, Homo sapiens
gacaaagcuacuugaagga

SEQ ID NO: 171613 - RNA, 19 nt, Homo sapiens
uaccugacccagcugauga

SEQ ID NO: 171614 - RNA, 19 nt, Homo sapiens
agaugcauguucaaaccaa

SEQ ID NO: 171615 - RNA, 19 nt, Homo sapiens
ggccagaugcauguucaaa

SEQ ID NO: 171616 - RNA, 19 nt, Homo sapiens
ucccaaagugcugagauua

SEQ ID NO: 171617 - RNA, 19 nt, Homo sapiens
aaggaagccucggcagaug

SEQ ID NO: 171618 - RNA, 19 nt, Homo sapiens
acacgacgcagaacuugau

SEQ ID NO: 171619 - RNA, 19 nt, Homo sapiens
gacagacuccauccaccaa

SEQ ID NO: 171620 - RNA, 19 nt, Homo sapiens
auccugaguucgucauuga

SEQ ID NO: 171621 - RNA, 19 nt, Homo sapiens
gcugagauuauaggcauga

SEQ ID NO: 171622 - RNA, 19 nt, Homo sapiens
cucccaaagugcugagauu

SEQ ID NO: 171623 - RNA, 19 nt, Homo sapiens
acagauuccgguacaguga

SEQ ID NO: 171624 - RNA, 19 nt, Homo sapiens
gcgcuaucagugccaauau

SEQ ID NO: 171625 - RNA, 19 nt, Homo sapiens
gauuugcacccaccuuucu

SEQ ID NO: 171626 - RNA, 19 nt, Homo sapiens
cccaaagugcugagauuau

SEQ ID NO: 171627 - RNA, 19 nt, Homo sapiens
gaauuacaggcacauacca

SEQ ID NO: 171628 - RNA, 19 nt, Homo sapiens
acuaagaagcuugaaucua

SEQ ID NO: 171629 - RNA, 19 nt, Homo sapiens
ccauacugguugaaaauug

SEQ ID NO: 171630 - RNA, 19 nt, Homo sapiens
ucucuuggccauacugguu

SEQ ID NO: 171631 - RNA, 19 nt, Homo sapiens
uaucugucauccugcuaau

SEQ ID NO: 171632 - RNA, 19 nt, Homo sapiens
ggcagaagacugaaguuuu

SEQ ID NO: 171633 - RNA, 19 nt, Homo sapiens
ggaauuacaggcacauacc

SEQ ID NO: 171634 - RNA, 19 nt, Homo sapiens
ucccaaguagcuggaauua

SEQ ID NO: 171635 - RNA, 19 nt, Homo sapiens
ucugucauccugcuaaugu

SEQ ID NO: 171636 - RNA, 19 nt, Homo sapiens
agacugauccugaguucgu

SEQ ID NO: 171637 - RNA, 19 nt, Homo sapiens
ccuguuuaauuucuuccuu

SEQ ID NO: 171638 - RNA, 19 nt, Homo sapiens
ccuuucugcacauaaguua

SEQ ID NO: 171639 - RNA, 19 nt, Homo sapiens
gucguaagaauaucuguca

SEQ ID NO: 171640 - RNA, 19 nt, Homo sapiens
ugaaggacacaagagagaa

SEQ ID NO: 171641 - RNA, 19 nt, Homo sapiens
gccauacggcacugaacaa

SEQ ID NO: 171642 - RNA, 19 nt, Homo sapiens
cacuacagauuccgguaca

SEQ ID NO: 171643 - RNA, 19 nt, Homo sapiens
guccugugauucccuugga

SEQ ID NO: 171644 - RNA, 19 nt, Homo sapiens
gcacacaucccauuugaua

SEQ ID NO: 171645 - RNA, 19 nt, Homo sapiens
gagaaaagcucacuaagaa

SEQ ID NO: 171646 - RNA, 19 nt, Homo sapiens
caucuuaucugucuucuga

SEQ ID NO: 171647 - RNA, 19 nt, Homo sapiens
ccaaagugcugagauuaua

SEQ ID NO: 171648 - RNA, 19 nt, Homo sapiens
ccaaguagcuggaauuaca

SEQ ID NO: 171649 - RNA, 19 nt, Homo sapiens
ggcaauagauguggaaauu

SEQ ID NO: 171650 - RNA, 19 nt, Homo sapiens
cuaagaagcuugaaucuac

SEQ ID NO: 171651 - RNA, 19 nt, Homo sapiens
ccaagugucugcaaguaaa

SEQ ID NO: 171652 - RNA, 19 nt, Homo sapiens
gaagugcaguggagcaauc

SEQ ID NO: 171653 - RNA, 19 nt, Homo sapiens
ggauugaccuuugcacgaa

SEQ ID NO: 171654 - RNA, 19 nt, Homo sapiens
cagcacacaucccauuuga

SEQ ID NO: 171655 - RNA, 19 nt, Homo sapiens
gcagaagacugaaguuuug

SEQ ID NO: 171656 - RNA, 19 nt, Homo sapiens
gagauaggcagaagacuga

SEQ ID NO: 171657 - RNA, 19 nt, Homo sapiens
ggauagggcacuacagauu

SEQ ID NO: 171658 - RNA, 19 nt, Homo sapiens
gaaggacacaagagagaaa

SEQ ID NO: 171659 - RNA, 19 nt, Homo sapiens
augcaggacugaucgauuu

SEQ ID NO: 171660 - RNA, 19 nt, Homo sapiens
caucccauuugauagauuu

SEQ ID NO: 171661 - RNA, 19 nt, Homo sapiens
caccaagugucugcaagua

SEQ ID NO: 171662 - RNA, 19 nt, Homo sapiens
cuucauuguucuucucuuu

SEQ ID NO: 171663 - RNA, 19 nt, Homo sapiens
auacggcacugaacaagga

SEQ ID NO: 171664 - RNA, 19 nt, Homo sapiens
gauccugaguucgucauug

SEQ ID NO: 171665 - RNA, 19 nt, Homo sapiens
ccacugcacccagcuaauu

SEQ ID NO: 171666 - RNA, 19 nt, Homo sapiens
uuucauaucugccaaaucg

SEQ ID NO: 171667 - RNA, 19 nt, Homo sapiens
caaaugguguuuucuuaug

SEQ ID NO: 171668 - RNA, 19 nt, Homo sapiens
cagccaggauugaccuuug

SEQ ID NO: 171669 - RNA, 19 nt, Homo sapiens
gauagggcacuacagauuc

SEQ ID NO: 171670 - RNA, 19 nt, Homo sapiens
caagagcaaccuggaacua

SEQ ID NO: 171671 - RNA, 19 nt, Homo sapiens
gcucagcacacaucccauu

SEQ ID NO: 171672 - RNA, 19 nt, Homo sapiens
ccacauggacgcaaacaag

SEQ ID NO: 171673 - RNA, 19 nt, Homo sapiens
acacaucccauuugauaga

SEQ ID NO: 171674 - RNA, 19 nt, Homo sapiens
ucacuaagaagcuugaauc

SEQ ID NO: 171675 - RNA, 19 nt, Homo sapiens
gguagugacaggcuuguau

SEQ ID NO: 171676 - RNA, 19 nt, Homo sapiens
caaggaagccucggcagau

SEQ ID NO: 171677 - RNA, 19 nt, Homo sapiens
cgcuaucagugccaauaua

SEQ ID NO: 171678 - RNA, 19 nt, Homo sapiens
ucccaugccuuucauaucu

SEQ ID NO: 171679 - RNA, 19 nt, Homo sapiens
ucuuaucugucuucugauu

SEQ ID NO: 171680 - RNA, 19 nt, Homo sapiens
guucaaaccaaucaaaugg

SEQ ID NO: 171681 - RNA, 19 nt, Homo sapiens
gagcuggagccaacagaug

SEQ ID NO: 171682 - RNA, 19 nt, Homo sapiens
ugagacugauccugaguuc

SEQ ID NO: 171683 - RNA, 19 nt, Homo sapiens
ccaccuuucugcacauaag

SEQ ID NO: 171684 - RNA, 19 nt, Homo sapiens
cagacuccauccaccaaga

SEQ ID NO: 171685 - RNA, 19 nt, Homo sapiens
ugccucagccucccaagua

SEQ ID NO: 171686 - RNA, 19 nt, Homo sapiens
uaucagugccaauauagga

SEQ ID NO: 171687 - RNA, 19 nt, Homo sapiens
gcaauagauguggaaauuc

SEQ ID NO: 171688 - RNA, 19 nt, Homo sapiens
ggagccaacagauguguca

SEQ ID NO: 171689 - RNA, 19 nt, Homo sapiens
uaggauagggcacuacaga

SEQ ID NO: 171690 - RNA, 19 nt, Homo sapiens
ggauggaucugugaaaauc

SEQ ID NO: 171691 - RNA, 19 nt, Homo sapiens
ccaaucaaaugguguuuuc

SEQ ID NO: 171692 - RNA, 19 nt, Homo sapiens
uaagaagcuugaaucuacu

SEQ ID NO: 171693 - RNA, 19 nt, Homo sapiens
aaacaaggcagggcgcuau

SEQ ID NO: 171694 - RNA, 19 nt, Homo sapiens
ccagaugcauguucaaacc

SEQ ID NO: 171695 - RNA, 19 nt, Homo sapiens
ucagugccaauauaggaua

SEQ ID NO: 171696 - RNA, 19 nt, Homo sapiens
agagcaaccuggaacuaag

SEQ ID NO: 171697 - RNA, 19 nt, Homo sapiens
ggaagccucggcagaugug

SEQ ID NO: 171698 - RNA, 19 nt, Homo sapiens
ucucagggaucuacagacu

SEQ ID NO: 171699 - RNA, 19 nt, Homo sapiens
gagcaaccuggaacuaagu

SEQ ID NO: 171700 - RNA, 19 nt, Homo sapiens
agacugaaguuuuggaaug

SEQ ID NO: 171701 - RNA, 19 nt, Homo sapiens
gugauucccuuggauggau

SEQ ID NO: 171702 - RNA, 19 nt, Homo sapiens
ccaaaucgaguccugugau

SEQ ID NO: 171703 - RNA, 19 nt, Homo sapiens
aagagcaaccuggaacuaa

SEQ ID NO: 171704 - RNA, 19 nt, Homo sapiens
aagauuacacgacgcagaa

SEQ ID NO: 171705 - RNA, 19 nt, Homo sapiens
ccaaggagggagaacuuuc

SEQ ID NO: 171706 - RNA, 19 nt, Homo sapiens
guagugacaggcuuguaug

SEQ ID NO: 171707 - RNA, 19 nt, Homo sapiens
aauauaggauagggcacua

SEQ ID NO: 171708 - RNA, 19 nt, Homo sapiens
gaugcauguucaaaccaau

SEQ ID NO: 171709 - RNA, 19 nt, Homo sapiens
caaagugcugagauuauag

SEQ ID NO: 171710 - RNA, 19 nt, Homo sapiens
cauguucaaaccaaucaaa

SEQ ID NO: 171711 - RNA, 19 nt, Homo sapiens
gacaaagcuacuugaagga

SEQ ID NO: 171712 - RNA, 19 nt, Homo sapiens
ggccaaggagggagaacuu

SEQ ID NO: 171713 - RNA, 19 nt, Homo sapiens
uggcaaacccuuccucucu

SEQ ID NO: 171714 - RNA, 19 nt, Homo sapiens
uaccugacccagcugauga

SEQ ID NO: 171715 - RNA, 19 nt, Homo sapiens
agaugcauguucaaaccaa

SEQ ID NO: 171716 - RNA, 19 nt, Homo sapiens
ggccagaugcauguucaaa

SEQ ID NO: 171717 - RNA, 19 nt, Homo sapiens
ucccaaagugcugagauua

SEQ ID NO: 171718 - RNA, 19 nt, Homo sapiens
gauuuucacuggccaagga

SEQ ID NO: 171719 - RNA, 19 nt, Homo sapiens
aaggaagccucggcagaug

SEQ ID NO: 171720 - RNA, 19 nt, Homo sapiens
acacgacgcagaacuugau

SEQ ID NO: 171721 - RNA, 19 nt, Homo sapiens
auccugaguucgucauuga

SEQ ID NO: 171722 - RNA, 19 nt, Homo sapiens
gcugagauuauaggcauga

SEQ ID NO: 171723 - RNA, 19 nt, Homo sapiens
cucccaaagugcugagauu

SEQ ID NO: 171724 - RNA, 19 nt, Homo sapiens
acagauuccgguacaguga

SEQ ID NO: 171725 - RNA, 19 nt, Homo sapiens
gcgcuaucagugccaauau

SEQ ID NO: 171726 - RNA, 19 nt, Homo sapiens
gauuugcacccaccuuucu

SEQ ID NO: 171727 - RNA, 19 nt, Homo sapiens
cccaaagugcugagauuau

SEQ ID NO: 171728 - RNA, 19 nt, Homo sapiens
gaauuacaggcacauacca

SEQ ID NO: 171729 - RNA, 19 nt, Homo sapiens
acuaagaagcuugaaucua

SEQ ID NO: 171730 - RNA, 19 nt, Homo sapiens
ccauacugguugaaaauug

SEQ ID NO: 171731 - RNA, 19 nt, Homo sapiens
ucucuuggccauacugguu

SEQ ID NO: 171732 - RNA, 19 nt, Homo sapiens
uaucugucauccugcuaau

SEQ ID NO: 171733 - RNA, 19 nt, Homo sapiens
ggcagaagacugaaguuuu

SEQ ID NO: 171734 - RNA, 19 nt, Homo sapiens
ucugucauccugcuaaugu

SEQ ID NO: 171735 - RNA, 19 nt, Homo sapiens
ggaauuacaggcacauacc

SEQ ID NO: 171736 - RNA, 19 nt, Homo sapiens
ucccaaguagcuggaauua

SEQ ID NO: 171737 - RNA, 19 nt, Homo sapiens
guugaugccaggagagaau

SEQ ID NO: 171738 - RNA, 19 nt, Homo sapiens
agacugauccugaguucgu

SEQ ID NO: 171739 - RNA, 19 nt, Homo sapiens
ccuguuuaauuucuuccuu

SEQ ID NO: 171740 - RNA, 19 nt, Homo sapiens
ccuuucugcacauaaguua

SEQ ID NO: 171741 - RNA, 19 nt, Homo sapiens
guccugugauucccuugga

SEQ ID NO: 171742 - RNA, 19 nt, Homo sapiens
ugaaggacacaagagagaa

SEQ ID NO: 171743 - RNA, 19 nt, Homo sapiens
gccauacggcacugaacaa

SEQ ID NO: 171744 - RNA, 19 nt, Homo sapiens
gcacacaucccauuugaua

SEQ ID NO: 171745 - RNA, 19 nt, Homo sapiens
gagaaaagcucacuaagaa

SEQ ID NO: 171746 - RNA, 19 nt, Homo sapiens
caucuuaucugucuucuga

SEQ ID NO: 171747 - RNA, 19 nt, Homo sapiens
ccaaagugcugagauuaua

SEQ ID NO: 171748 - RNA, 19 nt, Homo sapiens
ccaaguagcuggaauuaca

SEQ ID NO: 171749 - RNA, 19 nt, Homo sapiens
ggcaauagauguggaaauu

SEQ ID NO: 171750 - RNA, 19 nt, Homo sapiens
cuaagaagcuugaaucuac

SEQ ID NO: 171751 - RNA, 19 nt, Homo sapiens
ccaagugucugcaaguaaa

SEQ ID NO: 171752 - RNA, 19 nt, Homo sapiens
gaagugcaguggagcaauc

SEQ ID NO: 171753 - RNA, 19 nt, Homo sapiens
ggauugaccuuugcacgaa

SEQ ID NO: 171754 - RNA, 19 nt, Homo sapiens
cagcacacaucccauuuga

SEQ ID NO: 171755 - RNA, 19 nt, Homo sapiens
gaaggacacaagagagaaa

SEQ ID NO: 171756 - RNA, 19 nt, Homo sapiens
augcaggacugaucgauuu

SEQ ID NO: 171757 - RNA, 19 nt, Homo sapiens
caucccauuugauagauuu

SEQ ID NO: 171758 - RNA, 19 nt, Homo sapiens
caccaagugucugcaagua

SEQ ID NO: 171759 - RNA, 19 nt, Homo sapiens
cuucauuguucuucucuuu

SEQ ID NO: 171760 - RNA, 19 nt, Homo sapiens
auacggcacugaacaagga

SEQ ID NO: 171761 - RNA, 19 nt, Homo sapiens
ccacugcacccagcuaauu

SEQ ID NO: 171762 - RNA, 19 nt, Homo sapiens
caaaugguguuuucuuaug

SEQ ID NO: 171763 - RNA, 19 nt, Homo sapiens
cagccaggauugaccuuug

SEQ ID NO: 171764 - RNA, 19 nt, Homo sapiens
caagagcaaccuggaacua

SEQ ID NO: 171765 - RNA, 19 nt, Homo sapiens
guaaugccuuggagcuugu

SEQ ID NO: 171766 - RNA, 19 nt, Homo sapiens
gcucagcacacaucccauu

SEQ ID NO: 171767 - RNA, 19 nt, Homo sapiens
acacaucccauuugauaga

SEQ ID NO: 171768 - RNA, 19 nt, Homo sapiens
ucacuaagaagcuugaauc

SEQ ID NO: 171769 - RNA, 19 nt, Homo sapiens
caaggaagccucggcagau

SEQ ID NO: 171770 - RNA, 19 nt, Homo sapiens
ucuuaucugucuucugauu

SEQ ID NO: 171771 - RNA, 19 nt, Homo sapiens
guucaaaccaaucaaaugg

SEQ ID NO: 171772 - RNA, 19 nt, Homo sapiens
gagcuggagccaacagaug

SEQ ID NO: 171773 - RNA, 19 nt, Homo sapiens
ccaccuuucugcacauaag

SEQ ID NO: 171774 - RNA, 19 nt, Homo sapiens
cagacuccauccaccaaga

SEQ ID NO: 171775 - RNA, 19 nt, Homo sapiens
ugccucagccucccaagua

SEQ ID NO: 171776 - RNA, 19 nt, Homo sapiens
gcaauagauguggaaauuc

SEQ ID NO: 171777 - RNA, 19 nt, Homo sapiens
ggagccaacagauguguca

SEQ ID NO: 171778 - RNA, 19 nt, Homo sapiens
ccaaucaaaugguguuuuc

SEQ ID NO: 171779 - RNA, 19 nt, Homo sapiens
uaagaagcuugaaucuacu

SEQ ID NO: 171780 - RNA, 19 nt, Homo sapiens
ccagaugcauguucaaacc

SEQ ID NO: 171781 - RNA, 19 nt, Homo sapiens
agagcaaccuggaacuaag

SEQ ID NO: 171782 - RNA, 19 nt, Homo sapiens
ggaagccucggcagaugug

SEQ ID NO: 171783 - RNA, 19 nt, Homo sapiens
gagcaaccuggaacuaagu

SEQ ID NO: 171784 - RNA, 19 nt, Homo sapiens
aagagcaaccuggaacuaa

SEQ ID NO: 171785 - RNA, 19 nt, Homo sapiens
aagauuacacgacgcagaa

SEQ ID NO: 171786 - RNA, 19 nt, Homo sapiens
ccaaggagggagaacuuuc

SEQ ID NO: 171787 - RNA, 19 nt, Homo sapiens
gaugcauguucaaaccaau

SEQ ID NO: 171788 - RNA, 19 nt, Homo sapiens
caaagugcugagauuauag

SEQ ID NO: 171789 - RNA, 19 nt, Homo sapiens
cauguucaaaccaaucaaa

SEQ ID NO: 171790 - RNA, 19 nt, Homo sapiens
gacaaagcuacuugaagga

SEQ ID NO: 171791 - RNA, 19 nt, Homo sapiens
ggccaaggagggagaacuu

SEQ ID NO: 171792 - RNA, 19 nt, Homo sapiens
uggcaaacccuuccucucu

SEQ ID NO: 171793 - RNA, 19 nt, Homo sapiens
agaugcauguucaaaccaa

SEQ ID NO: 171794 - RNA, 19 nt, Homo sapiens
ggccagaugcauguucaaa

SEQ ID NO: 171795 - RNA, 19 nt, Homo sapiens
ucccaaagugcugagauua

SEQ ID NO: 171796 - RNA, 19 nt, Homo sapiens
gauuuucacuggccaagga

SEQ ID NO: 171797 - RNA, 19 nt, Homo sapiens
aaggaagccucggcagaug

SEQ ID NO: 171798 - RNA, 19 nt, Homo sapiens
acacgacgcagaacuugau

SEQ ID NO: 171799 - RNA, 19 nt, Homo sapiens
gcugagauuauaggcauga

SEQ ID NO: 171800 - RNA, 19 nt, Homo sapiens
cucccaaagugcugagauu

SEQ ID NO: 171801 - RNA, 19 nt, Homo sapiens
gauuugcacccaccuuucu

SEQ ID NO: 171802 - RNA, 19 nt, Homo sapiens
uaucugucauccugcuaau

SEQ ID NO: 171803 - RNA, 19 nt, Homo sapiens
cccaaagugcugagauuau

SEQ ID NO: 171804 - RNA, 19 nt, Homo sapiens
gaauuacaggcacauacca

SEQ ID NO: 171805 - RNA, 19 nt, Homo sapiens
acuaagaagcuugaaucua

SEQ ID NO: 171806 - RNA, 19 nt, Homo sapiens
ccauacugguugaaaauug

SEQ ID NO: 171807 - RNA, 19 nt, Homo sapiens
ucucuuggccauacugguu

SEQ ID NO: 171808 - RNA, 19 nt, Homo sapiens
ucugucauccugcuaaugu

SEQ ID NO: 171809 - RNA, 19 nt, Homo sapiens
ggaauuacaggcacauacc

SEQ ID NO: 171810 - RNA, 19 nt, Homo sapiens
guugaugccaggagagaau

SEQ ID NO: 171811 - RNA, 19 nt, Homo sapiens
ucccaaguagcuggaauua

SEQ ID NO: 171812 - RNA, 19 nt, Homo sapiens
ccuguuuaauuucuuccuu

SEQ ID NO: 171813 - RNA, 19 nt, Homo sapiens
ccuuucugcacauaaguua

SEQ ID NO: 171814 - RNA, 19 nt, Homo sapiens
ugaaggacacaagagagaa

SEQ ID NO: 171815 - RNA, 19 nt, Homo sapiens
gucguaagaauaucuguca

SEQ ID NO: 171816 - RNA, 19 nt, Homo sapiens
gccauacggcacugaacaa

SEQ ID NO: 171817 - RNA, 19 nt, Homo sapiens
gccaaggagggagaacuuu

SEQ ID NO: 171818 - RNA, 19 nt, Homo sapiens
ucagcacacaucccauuug

SEQ ID NO: 171819 - RNA, 19 nt, Homo sapiens
gcacacaucccauuugaua

SEQ ID NO: 171820 - RNA, 19 nt, Homo sapiens
gagaaaagcucacuaagaa

SEQ ID NO: 171821 - RNA, 19 nt, Homo sapiens
caucuuaucugucuucuga

SEQ ID NO: 171822 - RNA, 19 nt, Homo sapiens
ccaaagugcugagauuaua

SEQ ID NO: 171823 - RNA, 19 nt, Homo sapiens
ccaaguagcuggaauuaca

SEQ ID NO: 171824 - RNA, 19 nt, Homo sapiens
ggcaauagauguggaaauu

SEQ ID NO: 171825 - RNA, 19 nt, Homo sapiens
cuaagaagcuugaaucuac

SEQ ID NO: 171826 - RNA, 19 nt, Homo sapiens
ccaagugucugcaaguaaa

SEQ ID NO: 171827 - RNA, 19 nt, Homo sapiens
gaagugcaguggagcaauc

SEQ ID NO: 171828 - RNA, 19 nt, Homo sapiens
ggauugaccuuugcacgaa

SEQ ID NO: 171829 - RNA, 19 nt, Homo sapiens
cagcacacaucccauuuga

SEQ ID NO: 171830 - RNA, 19 nt, Homo sapiens
gcagaagacugaaguuuug

SEQ ID NO: 171831 - RNA, 19 nt, Homo sapiens
gagauaggcagaagacuga

SEQ ID NO: 171832 - RNA, 19 nt, Homo sapiens
ggauagggcacuacagauu

SEQ ID NO: 171833 - RNA, 19 nt, Homo sapiens
gaaggacacaagagagaaa

SEQ ID NO: 171834 - RNA, 19 nt, Homo sapiens
augcaggacugaucgauuu

SEQ ID NO: 171835 - RNA, 19 nt, Homo sapiens
caucccauuugauagauuu

SEQ ID NO: 171836 - RNA, 19 nt, Homo sapiens
caccaagugucugcaagua

SEQ ID NO: 171837 - RNA, 19 nt, Homo sapiens
cuucauuguucuucucuuu

SEQ ID NO: 171838 - RNA, 19 nt, Homo sapiens
auacggcacugaacaagga

SEQ ID NO: 171839 - RNA, 19 nt, Homo sapiens
gauccugaguucgucauug

SEQ ID NO: 171840 - RNA, 19 nt, Homo sapiens
ccacugcacccagcuaauu

SEQ ID NO: 171841 - RNA, 19 nt, Homo sapiens
uuucauaucugccaaaucg

SEQ ID NO: 171842 - RNA, 19 nt, Homo sapiens
caaaugguguuuucuuaug

SEQ ID NO: 171843 - RNA, 19 nt, Homo sapiens
cagccaggauugaccuuug

SEQ ID NO: 171844 - RNA, 19 nt, Homo sapiens
gauagggcacuacagauuc

SEQ ID NO: 171845 - RNA, 19 nt, Homo sapiens
caagagcaaccuggaacua

SEQ ID NO: 171846 - RNA, 19 nt, Homo sapiens
gcucagcacacaucccauu

SEQ ID NO: 171847 - RNA, 19 nt, Homo sapiens
ccacauggacgcaaacaag

SEQ ID NO: 171848 - RNA, 19 nt, Homo sapiens
acacaucccauuugauaga

SEQ ID NO: 171849 - RNA, 19 nt, Homo sapiens
ucacuaagaagcuugaauc

SEQ ID NO: 171850 - RNA, 19 nt, Homo sapiens
gguagugacaggcuuguau

SEQ ID NO: 171851 - RNA, 19 nt, Homo sapiens
caaggaagccucggcagau

SEQ ID NO: 171852 - RNA, 19 nt, Homo sapiens
cgcuaucagugccaauaua

SEQ ID NO: 171853 - RNA, 19 nt, Homo sapiens
ucccaugccuuucauaucu

SEQ ID NO: 171854 - RNA, 19 nt, Homo sapiens
ucuuaucugucuucugauu

SEQ ID NO: 171855 - RNA, 19 nt, Homo sapiens
guucaaaccaaucaaaugg

SEQ ID NO: 171856 - RNA, 19 nt, Homo sapiens
gagcuggagccaacagaug

SEQ ID NO: 171857 - RNA, 19 nt, Homo sapiens
ugagacugauccugaguuc

SEQ ID NO: 171858 - RNA, 19 nt, Homo sapiens
ccaccuuucugcacauaag

SEQ ID NO: 171859 - RNA, 19 nt, Homo sapiens
ugccucagccucccaagua

SEQ ID NO: 171860 - RNA, 19 nt, Homo sapiens
uaucagugccaauauagga

SEQ ID NO: 171861 - RNA, 19 nt, Homo sapiens
gcaauagauguggaaauuc

SEQ ID NO: 171862 - RNA, 19 nt, Homo sapiens
ggagccaacagauguguca

SEQ ID NO: 171863 - RNA, 19 nt, Homo sapiens
uaggauagggcacuacaga

SEQ ID NO: 171864 - RNA, 19 nt, Homo sapiens
ggauggaucugugaaaauc

SEQ ID NO: 171865 - RNA, 19 nt, Homo sapiens
ccaaucaaaugguguuuuc

SEQ ID NO: 171866 - RNA, 19 nt, Homo sapiens
uaagaagcuugaaucuacu

SEQ ID NO: 171867 - RNA, 19 nt, Homo sapiens
aaacaaggcagggcgcuau

SEQ ID NO: 171868 - RNA, 19 nt, Homo sapiens
ccagaugcauguucaaacc

SEQ ID NO: 171869 - RNA, 19 nt, Homo sapiens
ucagugccaauauaggaua

SEQ ID NO: 171870 - RNA, 19 nt, Homo sapiens
agagcaaccuggaacuaag

SEQ ID NO: 171871 - RNA, 19 nt, Homo sapiens
ggaagccucggcagaugug

SEQ ID NO: 171872 - RNA, 19 nt, Homo sapiens
gagcaaccuggaacuaagu

SEQ ID NO: 171873 - RNA, 19 nt, Homo sapiens
agacugaaguuuuggaaug

SEQ ID NO: 171874 - RNA, 19 nt, Homo sapiens
gugauucccuuggauggau

SEQ ID NO: 171875 - RNA, 19 nt, Homo sapiens
ccaaaucgaguccugugau

SEQ ID NO: 171876 - RNA, 19 nt, Homo sapiens
aagagcaaccuggaacuaa

SEQ ID NO: 171877 - RNA, 19 nt, Homo sapiens
aagauuacacgacgcagaa

SEQ ID NO: 171878 - RNA, 19 nt, Homo sapiens
ccaaggagggagaacuuuc

SEQ ID NO: 171879 - RNA, 19 nt, Homo sapiens
guagugacaggcuuguaug

SEQ ID NO: 171880 - RNA, 19 nt, Homo sapiens
aauauaggauagggcacua

SEQ ID NO: 171881 - RNA, 19 nt, Homo sapiens
gaugcauguucaaaccaau

SEQ ID NO: 171882 - RNA, 19 nt, Homo sapiens
caaagugcugagauuauag

SEQ ID NO: 171883 - RNA, 19 nt, Homo sapiens
cauguucaaaccaaucaaa

SEQ ID NO: 171884 - RNA, 19 nt, Homo sapiens
gacaaagcuacuugaagga

SEQ ID NO: 171885 - RNA, 19 nt, Homo sapiens
ggccaaggagggagaacuu

SEQ ID NO: 171886 - RNA, 19 nt, Homo sapiens
uggcaaacccuuccucucu

SEQ ID NO: 171887 - RNA, 19 nt, Homo sapiens
uaccugacccagcugauga

SEQ ID NO: 171888 - RNA, 19 nt, Homo sapiens
agaugcauguucaaaccaa

SEQ ID NO: 171889 - RNA, 19 nt, Homo sapiens
ggccagaugcauguucaaa

SEQ ID NO: 171890 - RNA, 19 nt, Homo sapiens
ucccaaagugcugagauua

SEQ ID NO: 171891 - RNA, 19 nt, Homo sapiens
gauuuucacuggccaagga

SEQ ID NO: 171892 - RNA, 19 nt, Homo sapiens
aaggaagccucggcagaug

SEQ ID NO: 171893 - RNA, 19 nt, Homo sapiens
acacgacgcagaacuugau

SEQ ID NO: 171894 - RNA, 19 nt, Homo sapiens
auccugaguucgucauuga

SEQ ID NO: 171895 - RNA, 19 nt, Homo sapiens
gcugagauuauaggcauga

SEQ ID NO: 171896 - RNA, 19 nt, Homo sapiens
cucccaaagugcugagauu

SEQ ID NO: 171897 - RNA, 19 nt, Homo sapiens
acagauuccgguacaguga

SEQ ID NO: 171898 - RNA, 19 nt, Homo sapiens
gcgcuaucagugccaauau

SEQ ID NO: 171899 - RNA, 19 nt, Homo sapiens
gauuugcacccaccuuucu

SEQ ID NO: 171900 - RNA, 19 nt, Homo sapiens
uaucugucauccugcuaau

SEQ ID NO: 171901 - RNA, 19 nt, Homo sapiens
cccaaagugcugagauuau

SEQ ID NO: 171902 - RNA, 19 nt, Homo sapiens
gaauuacaggcacauacca

SEQ ID NO: 171903 - RNA, 19 nt, Homo sapiens
acuaagaagcuugaaucua

SEQ ID NO: 171904 - RNA, 19 nt, Homo sapiens
ccauacugguugaaaauug

SEQ ID NO: 171905 - RNA, 19 nt, Homo sapiens
ucucuuggccauacugguu

SEQ ID NO: 171906 - RNA, 19 nt, Homo sapiens
ggcagaagacugaaguuuu

SEQ ID NO: 171907 - RNA, 19 nt, Homo sapiens
ucugucauccugcuaaugu

SEQ ID NO: 171908 - RNA, 19 nt, Homo sapiens
ggaauuacaggcacauacc

SEQ ID NO: 171909 - RNA, 19 nt, Homo sapiens
ucccaaguagcuggaauua

SEQ ID NO: 171910 - RNA, 19 nt, Homo sapiens
guugaugccaggagagaau

SEQ ID NO: 171911 - RNA, 19 nt, Homo sapiens
agacugauccugaguucgu

SEQ ID NO: 171912 - RNA, 19 nt, Homo sapiens
ccuguuuaauuucuuccuu

SEQ ID NO: 171913 - RNA, 19 nt, Homo sapiens
ccuuucugcacauaaguua

SEQ ID NO: 171914 - RNA, 19 nt, Homo sapiens
ugaaggacacaagagagaa

SEQ ID NO: 171915 - RNA, 19 nt, Homo sapiens
gccauacggcacugaacaa

SEQ ID NO: 171916 - RNA, 19 nt, Homo sapiens
gccaaggagggagaacuuu

SEQ ID NO: 171917 - RNA, 19 nt, Homo sapiens
guccugugauucccuugga

SEQ ID NO: 171918 - RNA, 19 nt, Homo sapiens
ucagcacacaucccauuug

SEQ ID NO: 171919 - RNA, 19 nt, Homo sapiens
gcacacaucccauuugaua

SEQ ID NO: 171920 - RNA, 19 nt, Homo sapiens
guagagaugugauuaggua

SEQ ID NO: 171921 - RNA, 19 nt, Homo sapiens
gaacgagacuccaccucaa

SEQ ID NO: 171922 - RNA, 19 nt, Homo sapiens
ggcaauagauguggaaauu

SEQ ID NO: 171923 - RNA, 19 nt, Homo sapiens
gagaugugauuagguauuu

SEQ ID NO: 171924 - RNA, 19 nt, Homo sapiens
gaacagaagggcuaacuca

SEQ ID NO: 171925 - RNA, 19 nt, Homo sapiens
gugauuagguauuuaguga

SEQ ID NO: 171926 - RNA, 19 nt, Homo sapiens
gagccaagaucacgccauu

SEQ ID NO: 171927 - RNA, 19 nt, Homo sapiens
ccaccacacuuuccgcuuu

SEQ ID NO: 171928 - RNA, 19 nt, Homo sapiens
cagcacacaucccauuuga

SEQ ID NO: 171929 - RNA, 19 nt, Homo sapiens
gcagaagacugaaguuuug

SEQ ID NO: 171930 - RNA, 19 nt, Homo sapiens
gagauaggcagaagacuga

SEQ ID NO: 171931 - RNA, 19 nt, Homo sapiens
gcacacauucuuauuagga

SEQ ID NO: 171932 - RNA, 19 nt, Homo sapiens
gcugcacacauucuuauua

SEQ ID NO: 171933 - RNA, 19 nt, Homo sapiens
ggauagggcacuacagguu

SEQ ID NO: 171934 - RNA, 19 nt, Homo sapiens
ccaaagugcugggauuaca

SEQ ID NO: 171935 - RNA, 19 nt, Homo sapiens
aaacuuagucuguggagaa

SEQ ID NO: 171936 - RNA, 19 nt, Homo sapiens
caucccauuugauagauuu

SEQ ID NO: 171937 - RNA, 19 nt, Homo sapiens
agacaggguuucaccaugu

SEQ ID NO: 171938 - RNA, 19 nt, Homo sapiens
gcaggagaaucacuugaac

SEQ ID NO: 171939 - RNA, 19 nt, Homo sapiens
ugccucagcuccucgagua

SEQ ID NO: 171940 - RNA, 19 nt, Homo sapiens
ccaccgggcaggaauauga

SEQ ID NO: 171941 - RNA, 19 nt, Homo sapiens
gauccugaguucgucauug

SEQ ID NO: 171942 - RNA, 19 nt, Homo sapiens
ccaggacaguggagagaga

SEQ ID NO: 171943 - RNA, 19 nt, Homo sapiens
uuucauaucugccaaaucg

SEQ ID NO: 171944 - RNA, 19 nt, Homo sapiens
caagagcaaccuggaacua

SEQ ID NO: 171945 - RNA, 19 nt, Homo sapiens
uggccaggcugcacacauu

SEQ ID NO: 171946 - RNA, 19 nt, Homo sapiens
gacaggguuucaccauguu

SEQ ID NO: 171947 - RNA, 19 nt, Homo sapiens
guaaugccuuggagcuugu

SEQ ID NO: 171948 - RNA, 19 nt, Homo sapiens
gcucagcacacaucccauu

SEQ ID NO: 171949 - RNA, 19 nt, Homo sapiens
ccacauggacgcaaacaag

SEQ ID NO: 171950 - RNA, 19 nt, Homo sapiens
acacaucccauuugauaga

SEQ ID NO: 171951 - RNA, 19 nt, Homo sapiens
gagacuccaccucaagaaa

SEQ ID NO: 171952 - RNA, 19 nt, Homo sapiens
gguagugacaggcuuguau

SEQ ID NO: 171953 - RNA, 19 nt, Homo sapiens
cugcacacauucuuauuag

SEQ ID NO: 171954 - RNA, 19 nt, Homo sapiens
cgcuaucagugccaauaua

SEQ ID NO: 171955 - RNA, 19 nt, Homo sapiens
ucccaugccuuucauaucu

SEQ ID NO: 171956 - RNA, 19 nt, Homo sapiens
caagugaggagagaaugaa

SEQ ID NO: 171957 - RNA, 19 nt, Homo sapiens
ugagacugauccugaguuc

SEQ ID NO: 171958 - RNA, 19 nt, Homo sapiens
gaggagagaaugaaaagaa

SEQ ID NO: 171959 - RNA, 19 nt, Homo sapiens
guucugguguuguagagau

SEQ ID NO: 171960 - RNA, 19 nt, Homo sapiens
ggcaggagaaucacuugaa

SEQ ID NO: 171961 - RNA, 19 nt, Homo sapiens
ccaagugaggagagaauga

SEQ ID NO: 171962 - RNA, 19 nt, Homo sapiens
augaagacgugcacugaga

SEQ ID NO: 171963 - RNA, 19 nt, Homo sapiens
uaucagugccaauauagga

SEQ ID NO: 171964 - RNA, 19 nt, Homo sapiens
gcaauagauguggaaauuc

SEQ ID NO: 171965 - RNA, 19 nt, Homo sapiens
ggauggaucugugaaaauc

SEQ ID NO: 171966 - RNA, 19 nt, Homo sapiens
gaugugauuagguauuuag

SEQ ID NO: 171967 - RNA, 19 nt, Homo sapiens
aaacaaggcagggcgcuau

SEQ ID NO: 171968 - RNA, 19 nt, Homo sapiens
gagccugucgucccagcua

SEQ ID NO: 171969 - RNA, 19 nt, Homo sapiens
ucagugccaauauaggaua

SEQ ID NO: 171970 - RNA, 19 nt, Homo sapiens
agagcaaccuggaacuaag

SEQ ID NO: 171971 - RNA, 19 nt, Homo sapiens
ggcacgaucucgacucacu

SEQ ID NO: 171972 - RNA, 19 nt, Homo sapiens
gagcaaccuggaacuaagu

SEQ ID NO: 171973 - RNA, 19 nt, Homo sapiens
gaagugaagagaggcaaag

SEQ ID NO: 171974 - RNA, 19 nt, Homo sapiens
agacugaaguuuuggaaug

SEQ ID NO: 171975 - RNA, 19 nt, Homo sapiens
gugauucccuuggauggau

SEQ ID NO: 171976 - RNA, 19 nt, Homo sapiens
ccaaaucgaguccugugau

SEQ ID NO: 171977 - RNA, 19 nt, Homo sapiens
ccaaggagggagaacuuuc

SEQ ID NO: 171978 - RNA, 19 nt, Homo sapiens
guagugacaggcuuguaug

SEQ ID NO: 171979 - RNA, 19 nt, Homo sapiens
aauauaggauagggcacua

SEQ ID NO: 171980 - RNA, 19 nt, Homo sapiens
aagagcaaccuggaacuaa

SEQ ID NO: 171981 - RNA, 19 nt, Homo sapiens
gaagacgugcacugagagu

SEQ ID NO: 171982 - RNA, 19 nt, Homo sapiens
gaccacacagacaggguuu

SEQ ID NO: 171983 - RNA, 19 nt, Homo sapiens
guggcacgaucucgacuca

SEQ ID NO: 171984 - RNA, 19 nt, Homo sapiens
ggccaaggagggagaacuu

SEQ ID NO: 171985 - RNA, 19 nt, Homo sapiens
uggcaaacccuuccucucu

SEQ ID NO: 171986 - RNA, 19 nt, Homo sapiens
uaccugacccagcugauga

SEQ ID NO: 171987 - RNA, 19 nt, Homo sapiens
ccacacagacaggguuuca

SEQ ID NO: 171988 - RNA, 19 nt, Homo sapiens
caccacacuuuccgcuuuc

SEQ ID NO: 171989 - RNA, 19 nt, Homo sapiens
gauuuucacuggccaagga

SEQ ID NO: 171990 - RNA, 19 nt, Homo sapiens
cacacauucuuauuaggau

SEQ ID NO: 171991 - RNA, 19 nt, Homo sapiens
ccucccagguucaagcaau

SEQ ID NO: 171992 - RNA, 19 nt, Homo sapiens
auccugaguucgucauuga

SEQ ID NO: 171993 - RNA, 19 nt, Homo sapiens
agagaugugauuagguauu

SEQ ID NO: 171994 - RNA, 19 nt, Homo sapiens
caggcugcacacauucuua

SEQ ID NO: 171995 - RNA, 19 nt, Homo sapiens
acagaagggcuaacucagu

SEQ ID NO: 171996 - RNA, 19 nt, Homo sapiens
gagaacagaagggcuaacu

SEQ ID NO: 171997 - RNA, 19 nt, Homo sapiens
gcgcuaucagugccaauau

SEQ ID NO: 171998 - RNA, 19 nt, Homo sapiens
uaucugucauccugcuaau

SEQ ID NO: 171999 - RNA, 19 nt, Homo sapiens
ggcagaagacugaaguuuu

SEQ ID NO: 172000 - RNA, 19 nt, Homo sapiens
cgagacuccaccucaagaa

SEQ ID NO: 172001 - RNA, 19 nt, Homo sapiens
gccaagaucacgccauugc

SEQ ID NO: 172002 - RNA, 19 nt, Homo sapiens
ggagagaaugaaaagaaaa

SEQ ID NO: 172003 - RNA, 19 nt, Homo sapiens
ucacuuccucgcuagaguu

SEQ ID NO: 172004 - RNA, 19 nt, Homo sapiens
ggacaguggagagagaaag

SEQ ID NO: 172005 - RNA, 19 nt, Homo sapiens
guugaugccaggagagaau

SEQ ID NO: 172006 - RNA, 19 nt, Homo sapiens
agacugauccugaguucgu

SEQ ID NO: 172007 - RNA, 19 nt, Homo sapiens
ucugucauccugcuaaugu

SEQ ID NO: 172008 - RNA, 19 nt, Homo sapiens
gaggauucaggcacaggaa

SEQ ID NO: 172009 - RNA, 19 nt, Homo sapiens
gucguaagaauaucuguca

SEQ ID NO: 172010 - RNA, 19 nt, Homo sapiens
gccaaggagggagaacuuu

SEQ ID NO: 172011 - RNA, 19 nt, Homo sapiens
guccugugauucccuugga

SEQ ID NO: 172012 - RNA, 19 nt, Homo sapiens
ucagcacacaucccauuug

SEQ ID NO: 172013 - RNA, 19 nt, Homo sapiens
gcacacaucccauuugaua

SEQ ID NO: 172014 - RNA, 19 nt, Homo sapiens
gaacgagacuccaccucaa

SEQ ID NO: 172015 - RNA, 19 nt, Homo sapiens
ggcaauagauguggaaauu

SEQ ID NO: 172016 - RNA, 19 nt, Homo sapiens
gaacagaagggcuaacuca

SEQ ID NO: 172017 - RNA, 19 nt, Homo sapiens
gagccaagaucacgccauu

SEQ ID NO: 172018 - RNA, 19 nt, Homo sapiens
ccaccacacuuuccgcuuu

SEQ ID NO: 172019 - RNA, 19 nt, Homo sapiens
cagcacacaucccauuuga

SEQ ID NO: 172020 - RNA, 19 nt, Homo sapiens
gcagaagacugaaguuuug

SEQ ID NO: 172021 - RNA, 19 nt, Homo sapiens
gagauaggcagaagacuga

SEQ ID NO: 172022 - RNA, 19 nt, Homo sapiens
ggauagggcacuacagguu

SEQ ID NO: 172023 - RNA, 19 nt, Homo sapiens
aaacuuagucuguggagaa

SEQ ID NO: 172024 - RNA, 19 nt, Homo sapiens
caucccauuugauagauuu

SEQ ID NO: 172025 - RNA, 19 nt, Homo sapiens
ccaccgggcaggaauauga

SEQ ID NO: 172026 - RNA, 19 nt, Homo sapiens
gauccugaguucgucauug

SEQ ID NO: 172027 - RNA, 19 nt, Homo sapiens
ccaggacaguggagagaga

SEQ ID NO: 172028 - RNA, 19 nt, Homo sapiens
uuucauaucugccaaaucg

SEQ ID NO: 172029 - RNA, 19 nt, Homo sapiens
caagagcaaccuggaacua

SEQ ID NO: 172030 - RNA, 19 nt, Homo sapiens
guaaugccuuggagcuugu

SEQ ID NO: 172031 - RNA, 19 nt, Homo sapiens
gcucagcacacaucccauu

SEQ ID NO: 172032 - RNA, 19 nt, Homo sapiens
ccacauggacgcaaacaag

SEQ ID NO: 172033 - RNA, 19 nt, Homo sapiens
acacaucccauuugauaga

SEQ ID NO: 172034 - RNA, 19 nt, Homo sapiens
gagacuccaccucaagaaa

SEQ ID NO: 172035 - RNA, 19 nt, Homo sapiens
gguagugacaggcuuguau

SEQ ID NO: 172036 - RNA, 19 nt, Homo sapiens
cgcuaucagugccaauaua

SEQ ID NO: 172037 - RNA, 19 nt, Homo sapiens
ucccaugccuuucauaucu

SEQ ID NO: 172038 - RNA, 19 nt, Homo sapiens
ugagacugauccugaguuc

SEQ ID NO: 172039 - RNA, 19 nt, Homo sapiens
augaagacgugcacugaga

SEQ ID NO: 172040 - RNA, 19 nt, Homo sapiens
gcaauagauguggaaauuc

SEQ ID NO: 172041 - RNA, 19 nt, Homo sapiens
uaucagugccaauauagga

SEQ ID NO: 172042 - RNA, 19 nt, Homo sapiens
ggauggaucugugaaaauc

SEQ ID NO: 172043 - RNA, 19 nt, Homo sapiens
ccaggagaaucacuugaac

SEQ ID NO: 172044 - RNA, 19 nt, Homo sapiens
aaacaaggcagggcgcuau

SEQ ID NO: 172045 - RNA, 19 nt, Homo sapiens
ucagugccaauauaggaua

SEQ ID NO: 172046 - RNA, 19 nt, Homo sapiens
agagcaaccuggaacuaag

SEQ ID NO: 172047 - RNA, 19 nt, Homo sapiens
ggcacgaucucgacucacu

SEQ ID NO: 172048 - RNA, 19 nt, Homo sapiens
gagcaaccuggaacuaagu

SEQ ID NO: 172049 - RNA, 19 nt, Homo sapiens
gaagugaagagaggcaaag

SEQ ID NO: 172050 - RNA, 19 nt, Homo sapiens
agacugaaguuuuggaaug

SEQ ID NO: 172051 - RNA, 19 nt, Homo sapiens
gugauucccuuggauggau

SEQ ID NO: 172052 - RNA, 19 nt, Homo sapiens
ccaaaucgaguccugugau

SEQ ID NO: 172053 - RNA, 19 nt, Homo sapiens
aagagcaaccuggaacuaa

SEQ ID NO: 172054 - RNA, 19 nt, Homo sapiens
ccaaggagggagaacuuuc

SEQ ID NO: 172055 - RNA, 19 nt, Homo sapiens
guagugacaggcuuguaug

SEQ ID NO: 172056 - RNA, 19 nt, Homo sapiens
aauauaggauagggcacua

SEQ ID NO: 172057 - RNA, 19 nt, Homo sapiens
gaagacgugcacugagagu

SEQ ID NO: 172058 - RNA, 19 nt, Homo sapiens
guggcacgaucucgacuca

SEQ ID NO: 172059 - RNA, 19 nt, Homo sapiens
ggccaaggagggagaacuu

SEQ ID NO: 172060 - RNA, 19 nt, Homo sapiens
uggcaaacccuuccucucu

SEQ ID NO: 172061 - RNA, 19 nt, Homo sapiens
uaccugacccagcugauga

SEQ ID NO: 172062 - RNA, 19 nt, Homo sapiens
caccacacuuuccgcuuuc

SEQ ID NO: 172063 - RNA, 19 nt, Homo sapiens
gauuuucacuggccaagga

SEQ ID NO: 172064 - RNA, 19 nt, Homo sapiens
auccugaguucgucauuga

SEQ ID NO: 172065 - RNA, 19 nt, Homo sapiens
acagaagggcuaacucagu

SEQ ID NO: 172066 - RNA, 19 nt, Homo sapiens
gagaacagaagggcuaacu

SEQ ID NO: 172067 - RNA, 19 nt, Homo sapiens
gcgcuaucagugccaauau

SEQ ID NO: 172068 - RNA, 19 nt, Homo sapiens
uaucugucauccugcuaau

SEQ ID NO: 172069 - RNA, 19 nt, Homo sapiens
ggcagaagacugaaguuuu

SEQ ID NO: 172070 - RNA, 19 nt, Homo sapiens
cgagacuccaccucaagaa

SEQ ID NO: 172071 - RNA, 19 nt, Homo sapiens
gccaagaucacgccauugc

SEQ ID NO: 172072 - RNA, 19 nt, Homo sapiens
ucacuuccucgcuagaguu

SEQ ID NO: 172073 - RNA, 19 nt, Homo sapiens
ggacaguggagagagaaag

SEQ ID NO: 172074 - RNA, 19 nt, Homo sapiens
ucugucauccugcuaaugu

SEQ ID NO: 172075 - RNA, 19 nt, Homo sapiens
guugaugccaggagagaau

SEQ ID NO: 172076 - RNA, 19 nt, Homo sapiens
agacugauccugaguucgu

SEQ ID NO: 172077 - RNA, 19 nt, Homo sapiens
gccaaggagggagaacuuu

SEQ ID NO: 172078 - RNA, 19 nt, Homo sapiens
ucagcacacaucccauuug

SEQ ID NO: 172079 - RNA, 19 nt, Homo sapiens
gucguaagaauaucuguca

SEQ ID NO: 172080 - RNA, 19 nt, Homo sapiens
guccugugauucccuugga

SEQ ID NO: 172081 - RNA, 19 nt, Homo sapiens
aaacacagcuugcaauaua

SEQ ID NO: 172082 - RNA, 19 nt, Homo sapiens
gcucaaggauuuauagaaa

SEQ ID NO: 172083 - RNA, 19 nt, Homo sapiens
uguacaaggugaucuauua

SEQ ID NO: 172084 - RNA, 19 nt, Homo sapiens
uaaguggcauguaauagua

SEQ ID NO: 172085 - RNA, 19 nt, Homo sapiens
gaagucaguuccaccaaau

SEQ ID NO: 172086 - RNA, 19 nt, Homo sapiens
gaaguacuggcuacaauuu

SEQ ID NO: 172087 - RNA, 19 nt, Homo sapiens
gagugaaacugguuaagug

SEQ ID NO: 172088 - RNA, 19 nt, Homo sapiens
gagaaguacuggcuacaau

SEQ ID NO: 172089 - RNA, 19 nt, Homo sapiens
gaagagacaaauucaaguu

SEQ ID NO: 172090 - RNA, 19 nt, Homo sapiens
gagcaugggccuauauuug

SEQ ID NO: 172091 - RNA, 19 nt, Homo sapiens
gaacugggauguguacaag

SEQ ID NO: 172092 - RNA, 19 nt, Homo sapiens
cacaacaucuccauuacaa

SEQ ID NO: 172093 - RNA, 19 nt, Homo sapiens
ccaaaugguuccacaaugg

SEQ ID NO: 172094 - RNA, 19 nt, Homo sapiens
ggaacaauuucuuugaagu

SEQ ID NO: 172095 - RNA, 19 nt, Homo sapiens
cgucugugcucaaggauuu

SEQ ID NO: 172096 - RNA, 19 nt, Homo sapiens
caacaucuccauuacaaau

SEQ ID NO: 172097 - RNA, 19 nt, Homo sapiens
ggacacaggauuauuuauc

SEQ ID NO: 172098 - RNA, 19 nt, Homo sapiens
gccuauauuugaagccuua

SEQ ID NO: 172099 - RNA, 19 nt, Homo sapiens
gcaugggccuauauuugaa

SEQ ID NO: 172100 - RNA, 19 nt, Homo sapiens
uguggcagcuggacuauga

SEQ ID NO: 172101 - RNA, 19 nt, Homo sapiens
gugaagcucucaaguacug

SEQ ID NO: 172102 - RNA, 19 nt, Homo sapiens
ucaaacacagcuugcaaua

SEQ ID NO: 172103 - RNA, 19 nt, Homo sapiens
aggaaaggcuucagacuuc

SEQ ID NO: 172104 - RNA, 19 nt, Homo sapiens
gcaggucacauuucucuug

SEQ ID NO: 172105 - RNA, 19 nt, Homo sapiens
gacacaggauuauuuaucu

SEQ ID NO: 172106 - RNA, 19 nt, Homo sapiens
ugaagucaguuccaccaaa

SEQ ID NO: 172107 - RNA, 19 nt, Homo sapiens
aaacgucugugcucaagga

SEQ ID NO: 172108 - RNA, 19 nt, Homo sapiens
ggugaucuauuauaaggau

SEQ ID NO: 172109 - RNA, 19 nt, Homo sapiens
gaacaauuucuuugaaguc

SEQ ID NO: 172110 - RNA, 19 nt, Homo sapiens
cauguaaugggaacaauuu

SEQ ID NO: 172111 - RNA, 19 nt, Homo sapiens
aguaagugcucaauuaaca

SEQ ID NO: 172112 - RNA, 19 nt, Homo sapiens
ugucagcaccaacaaguua

SEQ ID NO: 172113 - RNA, 19 nt, Homo sapiens
ugaagacaguggagaauac

SEQ ID NO: 172114 - RNA, 19 nt, Homo sapiens
gggaacaauuucuuugaag

SEQ ID NO: 172115 - RNA, 19 nt, Homo sapiens
gcuacucaauugucaaaca

SEQ ID NO: 172116 - RNA, 19 nt, Homo sapiens
cugguuaaguggcauguaa

SEQ ID NO: 172117 - RNA, 19 nt, Homo sapiens
gguuaaguggcauguaaua

SEQ ID NO: 172118 - RNA, 19 nt, Homo sapiens
ggucacauuucucuugaag

SEQ ID NO: 172119 - RNA, 19 nt, Homo sapiens
guggacacaggauuauuua

SEQ ID NO: 172120 - RNA, 19 nt, Homo sapiens
uuacaaaugccacaguuga

SEQ ID NO: 172121 - RNA, 19 nt, Homo sapiens
aaccacaacaucuccauua

SEQ ID NO: 172122 - RNA, 19 nt, Homo sapiens
gaaccacaacaucuccauu

SEQ ID NO: 172123 - RNA, 19 nt, Homo sapiens
caggucacauuucucuuga

SEQ ID NO: 172124 - RNA, 19 nt, Homo sapiens
guacaaggugaucuauuau

SEQ ID NO: 172125 - RNA, 19 nt, Homo sapiens
ggaacugggauguguacaa

SEQ ID NO: 172126 - RNA, 19 nt, Homo sapiens
ccaacaaguuaaugagagu

SEQ ID NO: 172127 - RNA, 19 nt, Homo sapiens
caccaggaguccaugaaga

SEQ ID NO: 172128 - RNA, 19 nt, Homo sapiens
guaaugggaacaauuucuu

SEQ ID NO: 172129 - RNA, 19 nt, Homo sapiens
cagaagagacaaauucaag

SEQ ID NO: 172130 - RNA, 19 nt, Homo sapiens
ugggaacaauuucuuugaa

SEQ ID NO: 172131 - RNA, 19 nt, Homo sapiens
caggaaaggcuucagacuu

SEQ ID NO: 172132 - RNA, 19 nt, Homo sapiens
caaaugccacaguugaaga

SEQ ID NO: 172133 - RNA, 19 nt, Homo sapiens
ggaggaacugggaugugua

SEQ ID NO: 172134 - RNA, 19 nt, Homo sapiens
gugacuggcugcuccuuca

SEQ ID NO: 172135 - RNA, 19 nt, Homo sapiens
ggaaaggcuucagacuucu

SEQ ID NO: 172136 - RNA, 19 nt, Homo sapiens
caaacacagcuugcaauau

SEQ ID NO: 172137 - RNA, 19 nt, Homo sapiens
gaucucuccagcacaguaa

SEQ ID NO: 172138 - RNA, 19 nt, Homo sapiens
gguaugagaaccacaacau

SEQ ID NO: 172139 - RNA, 19 nt, Homo sapiens
gcucucaaguacugguaug

SEQ ID NO: 172140 - RNA, 19 nt, Homo sapiens
auacaaaugucagcaccaa

SEQ ID NO: 172141 - RNA, 19 nt, Homo sapiens
caauuucuuugaagucagu

SEQ ID NO: 172142 - RNA, 19 nt, Homo sapiens
guguguagccuuacuguuc

SEQ ID NO: 172143 - RNA, 19 nt, Homo sapiens
aguggaaccuacuacugua

SEQ ID NO: 172144 - RNA, 19 nt, Homo sapiens
aaggugaucuauuauaagg

SEQ ID NO: 172145 - RNA, 19 nt, Homo sapiens
cugcugagguggugaugga

SEQ ID NO: 172146 - RNA, 19 nt, Homo sapiens
cuucugaacccacauccua

SEQ ID NO: 172147 - RNA, 19 nt, Homo sapiens
uggugaagcucucaaguac

SEQ ID NO: 172148 - RNA, 19 nt, Homo sapiens
agacaguggagaauacaaa

SEQ ID NO: 172149 - RNA, 19 nt, Homo sapiens
guuugaauauugugaaugc

SEQ ID NO: 172150 - RNA, 19 nt, Homo sapiens
uggaggaacugggaugugu

SEQ ID NO: 172151 - RNA, 19 nt, Homo sapiens
gaagacaguggagaauaca

SEQ ID NO: 172152 - RNA, 19 nt, Homo sapiens
aaacugagugaaacugguu

SEQ ID NO: 172153 - RNA, 19 nt, Homo sapiens
ucauuaaacugagugaaac

SEQ ID NO: 172154 - RNA, 19 nt, Homo sapiens
aagcuccgcgugagaagua

SEQ ID NO: 172155 - RNA, 19 nt, Homo sapiens
ccacaacaucuccauuaca

SEQ ID NO: 172156 - RNA, 19 nt, Homo sapiens
ucaaguacugguaugagaa

SEQ ID NO: 172157 - RNA, 19 nt, Homo sapiens
guuagcagucccucagaaa

SEQ ID NO: 172158 - RNA, 19 nt, Homo sapiens
agaaguacuggcuacaauu

SEQ ID NO: 172159 - RNA, 19 nt, Homo sapiens
gcaccaacaaguuaaugag

SEQ ID NO: 172160 - RNA, 19 nt, Homo sapiens
acaaaugucagcaccaaca

SEQ ID NO: 172161 - RNA, 19 nt, Homo sapiens
uuaaguggcauguaauagu

SEQ ID NO: 172162 - RNA, 19 nt, Homo sapiens
agaaacgucugugcucaag

SEQ ID NO: 172163 - RNA, 19 nt, Homo sapiens
cuugaacccuccauggaau

SEQ ID NO: 172164 - RNA, 19 nt, Homo sapiens
caaaugucagcaccaacaa

SEQ ID NO: 172165 - RNA, 19 nt, Homo sapiens
caguggagaauacaaaugu

SEQ ID NO: 172166 - RNA, 19 nt, Homo sapiens
caauggcagccuuucagaa

SEQ ID NO: 172167 - RNA, 19 nt, Homo sapiens
cgcuccagauggcguguua

SEQ ID NO: 172168 - RNA, 19 nt, Homo sapiens
cgagcaugggccuauauuu

SEQ ID NO: 172169 - RNA, 19 nt, Homo sapiens
gcaccaggaguccaugaag

SEQ ID NO: 172170 - RNA, 19 nt, Homo sapiens
ccacaauggcagccuuuca

SEQ ID NO: 172171 - RNA, 19 nt, Homo sapiens
caccgagcaugggccuaua

SEQ ID NO: 172172 - RNA, 19 nt, Homo sapiens
gaagacaguggaaccuacu

SEQ ID NO: 172173 - RNA, 19 nt, Homo sapiens
caaggugaucuauuauaag

SEQ ID NO: 172174 - RNA, 19 nt, Homo sapiens
uaaaggagagaaugugacu

SEQ ID NO: 172175 - RNA, 19 nt, Homo sapiens
agcaugggccuauauuuga

SEQ ID NO: 172176 - RNA, 19 nt, Homo sapiens
cagcaggucacauuucucu

SEQ ID NO: 172177 - RNA, 19 nt, Homo sapiens
uaugagaaccacaacaucu

SEQ ID NO: 172178 - RNA, 19 nt, Homo sapiens
gacaguggagaauacaaau

SEQ ID NO: 172179 - RNA, 19 nt, Homo sapiens
uuucagaagagacaaauuc

SEQ ID NO: 172180 - RNA, 19 nt, Homo sapiens
aggaguccaugaagaagau

SEQ ID NO: 172181 - RNA, 19 nt, Homo sapiens
gaaaggagaacacugguua

SEQ ID NO: 172182 - RNA, 19 nt, Homo sapiens
gggaagaacucaaaggaaa

SEQ ID NO: 172183 - RNA, 19 nt, Homo sapiens
gaaauaaagugaguggaaa

SEQ ID NO: 172184 - RNA, 19 nt, Homo sapiens
ggaauuaaggcaucaauaa

SEQ ID NO: 172185 - RNA, 19 nt, Homo sapiens
gaccugagcugaaauaaag

SEQ ID NO: 172186 - RNA, 19 nt, Homo sapiens
gaaagagaaugggagcaua

SEQ ID NO: 172187 - RNA, 19 nt, Homo sapiens
aagaguaacugguagauuu

SEQ ID NO: 172188 - RNA, 19 nt, Homo sapiens
gaagaccacugaaugaaca

SEQ ID NO: 172189 - RNA, 19 nt, Homo sapiens
gacaaucacacaacaaaua

SEQ ID NO: 172190 - RNA, 19 nt, Homo sapiens
gugcagagauuaacauuuc

SEQ ID NO: 172191 - RNA, 19 nt, Homo sapiens
ucaauuaccuguauuugug

SEQ ID NO: 172192 - RNA, 19 nt, Homo sapiens
aaacagcaauagugaauga

SEQ ID NO: 172193 - RNA, 19 nt, Homo sapiens
ucuggaauguugucaauua

SEQ ID NO: 172194 - RNA, 19 nt, Homo sapiens
uaaagcagguuauccauuc

SEQ ID NO: 172195 - RNA, 19 nt, Homo sapiens
ggaaauaucuccccaggaa

SEQ ID NO: 172196 - RNA, 19 nt, Homo sapiens
caacuucaaugucaucuuc

SEQ ID NO: 172197 - RNA, 19 nt, Homo sapiens
gaauaaaguuagacaagca

SEQ ID NO: 172198 - RNA, 19 nt, Homo sapiens
cacauucacugacaugaua

SEQ ID NO: 172199 - RNA, 19 nt, Homo sapiens
aagaagagcuuggccuaua

SEQ ID NO: 172200 - RNA, 19 nt, Homo sapiens
gcuggaaagucaacaugua

SEQ ID NO: 172201 - RNA, 19 nt, Homo sapiens
gcuaugauaugccuuuguu

SEQ ID NO: 172202 - RNA, 19 nt, Homo sapiens
gaucaucuguagguauuaa

SEQ ID NO: 172203 - RNA, 19 nt, Homo sapiens
gaaauuccacacaugagua

SEQ ID NO: 172204 - RNA, 19 nt, Homo sapiens
aaagggaaaugcagccaua

SEQ ID NO: 172205 - RNA, 19 nt, Homo sapiens
ucauaaacaugcauuguga

SEQ ID NO: 172206 - RNA, 19 nt, Homo sapiens
ggaauuaccauccugauca

SEQ ID NO: 172207 - RNA, 19 nt, Homo sapiens
gaagcaaguuaacacucua

SEQ ID NO: 172208 - RNA, 19 nt, Homo sapiens
aaacuucacaugccuauaa

SEQ ID NO: 172209 - RNA, 19 nt, Homo sapiens
ggacagcucgguuaaugaa

SEQ ID NO: 172210 - RNA, 19 nt, Homo sapiens
ccaccaagucucaauauaa

SEQ ID NO: 172211 - RNA, 19 nt, Homo sapiens
acagguagauguuaauuuc

SEQ ID NO: 172212 - RNA, 19 nt, Homo sapiens
ggugacagguagauguuaa

SEQ ID NO: 172213 - RNA, 19 nt, Homo sapiens
ggaaagucaacauguagua

SEQ ID NO: 172214 - RNA, 19 nt, Homo sapiens
gacuugguaugcuuuauuu

SEQ ID NO: 172215 - RNA, 19 nt, Homo sapiens
gauaagcaacuccaccuaa

SEQ ID NO: 172216 - RNA, 19 nt, Homo sapiens
ggaggaagaguacaaauag

SEQ ID NO: 172217 - RNA, 19 nt, Homo sapiens
aaagaaggcuggcugaaag

SEQ ID NO: 172218 - RNA, 19 nt, Homo sapiens
gccaagacaugaaguuuua

SEQ ID NO: 172219 - RNA, 19 nt, Homo sapiens
gauguuaauuucccuagau

SEQ ID NO: 172220 - RNA, 19 nt, Homo sapiens
ggaaauccaccaagucuca

SEQ ID NO: 172221 - RNA, 19 nt, Homo sapiens
caccaagucucaauauaau

SEQ ID NO: 172222 - RNA, 19 nt, Homo sapiens
ggaaauggaaauaaugguu

SEQ ID NO: 172223 - RNA, 19 nt, Homo sapiens
gaaagucaacauguaguaa

SEQ ID NO: 172224 - RNA, 19 nt, Homo sapiens
gaugcaguauuguaucauu

SEQ ID NO: 172225 - RNA, 19 nt, Homo sapiens
caaauuugacagcagaaua

SEQ ID NO: 172226 - RNA, 19 nt, Homo sapiens
aauagaagguagugaagaa

SEQ ID NO: 172227 - RNA, 19 nt, Homo sapiens
ucacaugccuauaauugga

SEQ ID NO: 172228 - RNA, 19 nt, Homo sapiens
uaauuucccuagauuguga

SEQ ID NO: 172229 - RNA, 19 nt, Homo sapiens
cagguuuggugucauuaua

SEQ ID NO: 172230 - RNA, 19 nt, Homo sapiens
gaggaagaguacaaauaga

SEQ ID NO: 172231 - RNA, 19 nt, Homo sapiens
gaguggaaauggaaauaau

SEQ ID NO: 172232 - RNA, 19 nt, Homo sapiens
uaaagugaguggaaaugga

SEQ ID NO: 172233 - RNA, 19 nt, Homo sapiens
gagcugaaauaaagugagu

SEQ ID NO: 172234 - RNA, 19 nt, Homo sapiens
gaaauuauaagugcagaga

SEQ ID NO: 172235 - RNA, 19 nt, Homo sapiens
cagaggaucguguuuauga

SEQ ID NO: 172236 - RNA, 19 nt, Homo sapiens
gcucuguacuugauauuuc

SEQ ID NO: 172237 - RNA, 19 nt, Homo sapiens
ugaaagugaucacgacaau

SEQ ID NO: 172238 - RNA, 19 nt, Homo sapiens
aaacaugcauugugaaacu

SEQ ID NO: 172239 - RNA, 19 nt, Homo sapiens
aaggagaaaugcaacauau

SEQ ID NO: 172240 - RNA, 19 nt, Homo sapiens
cuuaauuucuugcuccaua

SEQ ID NO: 172241 - RNA, 19 nt, Homo sapiens
cuugugaccuccuuaugua

SEQ ID NO: 172242 - RNA, 19 nt, Homo sapiens
gaggaagccugggagcaaa

SEQ ID NO: 172243 - RNA, 19 nt, Homo sapiens
gaaaguaauaggagagcaa

SEQ ID NO: 172244 - RNA, 19 nt, Homo sapiens
ugaguauugugaugaguaa

SEQ ID NO: 172245 - RNA, 19 nt, Homo sapiens
caacauguaguaagcaaga

SEQ ID NO: 172246 - RNA, 19 nt, Homo sapiens
acacaucucugcuggaaag

SEQ ID NO: 172247 - RNA, 19 nt, Homo sapiens
aaacaagguuccagaggau

SEQ ID NO: 172248 - RNA, 19 nt, Homo sapiens
ggagaaaugcaacauaucu

SEQ ID NO: 172249 - RNA, 19 nt, Homo sapiens
guucacauacagacucuua

SEQ ID NO: 172250 - RNA, 19 nt, Homo sapiens
gaaguggggaauuuuauua

SEQ ID NO: 172251 - RNA, 19 nt, Homo sapiens
gaguggauccaaucuauau

SEQ ID NO: 172252 - RNA, 19 nt, Homo sapiens
gaguacaaauagaccuaaa

SEQ ID NO: 172253 - RNA, 19 nt, Homo sapiens
cgaagucaguaguuugaga

SEQ ID NO: 172254 - RNA, 19 nt, Homo sapiens
ugaaauaaagugaguggaa

SEQ ID NO: 172255 - RNA, 19 nt, Homo sapiens
gagaguauuagucacaauu

SEQ ID NO: 172256 - RNA, 19 nt, Homo sapiens
gcugagaaauuccacacau

SEQ ID NO: 172257 - RNA, 19 nt, Homo sapiens
acacacaucucugcuggaa

SEQ ID NO: 172258 - RNA, 19 nt, Homo sapiens
gaauuaccauccugaucau

SEQ ID NO: 172259 - RNA, 19 nt, Homo sapiens
ggaguggauccaaucuaua

SEQ ID NO: 172260 - RNA, 19 nt, Homo sapiens
cagcaauagugaaugaaug

SEQ ID NO: 172261 - RNA, 19 nt, Homo sapiens
gagauagaagugaagcuaa

SEQ ID NO: 172262 - RNA, 19 nt, Homo sapiens
uaagaccugagcugaaaua

SEQ ID NO: 172263 - RNA, 19 nt, Homo sapiens
cacacacacauauguauua

SEQ ID NO: 172264 - RNA, 19 nt, Homo sapiens
gagaccaagugcuuuaugg

SEQ ID NO: 172265 - RNA, 19 nt, Homo sapiens
caagaucauucugagaguu

SEQ ID NO: 172266 - RNA, 19 nt, Homo sapiens
ggcugaaaguugaguuaaa

SEQ ID NO: 172267 - RNA, 19 nt, Homo sapiens
guauaagaguccuacagau

SEQ ID NO: 172268 - RNA, 19 nt, Homo sapiens
gaaaagcaagcuaagaaaa

SEQ ID NO: 172269 - RNA, 19 nt, Homo sapiens
uagccuagaagauacaaua

SEQ ID NO: 172270 - RNA, 19 nt, Homo sapiens
gcguuugagucuaagauga

SEQ ID NO: 172271 - RNA, 19 nt, Homo sapiens
agaagagcuuggccuauau

SEQ ID NO: 172272 - RNA, 19 nt, Homo sapiens
gaacgggaauuaccauccu

SEQ ID NO: 172273 - RNA, 19 nt, Homo sapiens
cacaaauucugacugcuau

SEQ ID NO: 172274 - RNA, 19 nt, Homo sapiens
gggaauuaaggcaucaaua

SEQ ID NO: 172275 - RNA, 19 nt, Homo sapiens
cauccagccuuaauuucuu

SEQ ID NO: 172276 - RNA, 19 nt, Homo sapiens
caugaagaccacugaauga

SEQ ID NO: 172277 - RNA, 19 nt, Homo sapiens
gaauagaagguagugaaga

SEQ ID NO: 172278 - RNA, 19 nt, Homo sapiens
ugagaaauuccacacauga

SEQ ID NO: 172279 - RNA, 19 nt, Homo sapiens
auuaagcguuugagucuaa

SEQ ID NO: 172280 - RNA, 19 nt, Homo sapiens
guauuaaucacaucacuuc

SEQ ID NO: 172281 - RNA, 19 nt, Homo sapiens
gauccuguguccuaaauua

SEQ ID NO: 172282 - RNA, 19 nt, Homo sapiens
gaaaucagaugguguuuac

SEQ ID NO: 172283 - RNA, 19 nt, Homo sapiens
uagaauagaugcggucaua

SEQ ID NO: 172284 - RNA, 19 nt, Homo sapiens
cacaguagcuuuagaauag

SEQ ID NO: 172285 - RNA, 19 nt, Homo sapiens
ccaggaaccaggagacuua

SEQ ID NO: 172286 - RNA, 19 nt, Homo sapiens
cagaugcuguuuacggaua

SEQ ID NO: 172287 - RNA, 19 nt, Homo sapiens
ccacaguagcuuuagaaua

SEQ ID NO: 172288 - RNA, 19 nt, Homo sapiens
gcaguggucuugcucuuac

SEQ ID NO: 172289 - RNA, 19 nt, Homo sapiens
ccuguguccuaaauuaaua

SEQ ID NO: 172290 - RNA, 19 nt, Homo sapiens
gcuauaaccagcuaugaga

SEQ ID NO: 172291 - RNA, 19 nt, Homo sapiens
gcggucauauucuucuuug

SEQ ID NO: 172292 - RNA, 19 nt, Homo sapiens
uagaugcggucauauucuu

SEQ ID NO: 172293 - RNA, 19 nt, Homo sapiens
auaaugauccuguguccua

SEQ ID NO: 172294 - RNA, 19 nt, Homo sapiens
acgagacucugaagcauga

SEQ ID NO: 172295 - RNA, 19 nt, Homo sapiens
ugagaaaucagaugguguu

SEQ ID NO: 172296 - RNA, 19 nt, Homo sapiens
ugagaaaccaccacaguag

SEQ ID NO: 172297 - RNA, 19 nt, Homo sapiens
uaaugauccuguguccuaa

SEQ ID NO: 172298 - RNA, 19 nt, Homo sapiens
ccaggagacuuacgagacu

SEQ ID NO: 172299 - RNA, 19 nt, Homo sapiens
ccaccacaguagcuuuaga

SEQ ID NO: 172300 - RNA, 19 nt, Homo sapiens
aaagacuaaugcucagaug

SEQ ID NO: 172301 - RNA, 19 nt, Homo sapiens
ccucaugguuggcaucaca

SEQ ID NO: 172302 - RNA, 19 nt, Homo sapiens
gucuugcucuuacuccuuu

SEQ ID NO: 172303 - RNA, 19 nt, Homo sapiens
agaaaucagaugguguuua

SEQ ID NO: 172304 - RNA, 19 nt, Homo sapiens
ccucagcucugcuauaucc

SEQ ID NO: 172305 - RNA, 19 nt, Homo sapiens
uauaaccagcuaugagaaa

SEQ ID NO: 172306 - RNA, 19 nt, Homo sapiens
ggaaccaggagacuuacga

SEQ ID NO: 172307 - RNA, 19 nt, Homo sapiens
gaaaccaccacaguagcuu

SEQ ID NO: 172308 - RNA, 19 nt, Homo sapiens
gugcgaaaggcagcuauaa

SEQ ID NO: 172309 - RNA, 19 nt, Homo sapiens
agccucagcucugcuauau

SEQ ID NO: 172310 - RNA, 19 nt, Homo sapiens
gcuguuuacggauauuuau

SEQ ID NO: 172311 - RNA, 19 nt, Homo sapiens
uaaagacuaaugcucagau

SEQ ID NO: 172312 - RNA, 19 nt, Homo sapiens
aaccagcuaugagaaauca

SEQ ID NO: 172313 - RNA, 19 nt, Homo sapiens
caugagaaaccaccacagu

SEQ ID NO: 172314 - RNA, 19 nt, Homo sapiens
gaagauccaagugcgaaag

SEQ ID NO: 172315 - RNA, 19 nt, Homo sapiens
gccauccuguuucuguaug

SEQ ID NO: 172316 - RNA, 19 nt, Homo sapiens
caccacaguagcuuuagaa

SEQ ID NO: 172317 - RNA, 19 nt, Homo sapiens
gagaaaucagaugguguuu

SEQ ID NO: 172318 - RNA, 19 nt, Homo sapiens
ccucuacugucgacugaag

SEQ ID NO: 172319 - RNA, 19 nt, Homo sapiens
cuaaugcucagaugcuguu

SEQ ID NO: 172320 - RNA, 19 nt, Homo sapiens
aaccaccacaguagcuuua

SEQ ID NO: 172321 - RNA, 19 nt, Homo sapiens
ccagcuaugagaaaucaga

SEQ ID NO: 172322 - RNA, 19 nt, Homo sapiens
gcgaaaggcagcuauaacc

SEQ ID NO: 172323 - RNA, 19 nt, Homo sapiens
auaaccagcuaugagaaau

SEQ ID NO: 172324 - RNA, 19 nt, Homo sapiens
caguagcuuuagaauagau

SEQ ID NO: 172325 - RNA, 19 nt, Homo sapiens
aaaccaccacaguagcuuu

SEQ ID NO: 172326 - RNA, 19 nt, Homo sapiens
agacuuacgagacucugaa

SEQ ID NO: 172327 - RNA, 19 nt, Homo sapiens
cgaaaggcagcuauaacca

SEQ ID NO: 172328 - RNA, 19 nt, Homo sapiens
gaugcuguuuacggauauu

SEQ ID NO: 172329 - RNA, 19 nt, Homo sapiens
acaguagcuuuagaauaga

SEQ ID NO: 172330 - RNA, 19 nt, Homo sapiens
uuacgagacucugaagcau

SEQ ID NO: 172331 - RNA, 19 nt, Homo sapiens
gagacuuacgagacucuga

SEQ ID NO: 172332 - RNA, 19 nt, Homo sapiens
augagaaaccaccacagua

SEQ ID NO: 172333 - RNA, 19 nt, Homo sapiens
gaacgaagcuucagauuug

SEQ ID NO: 172334 - RNA, 19 nt, Homo sapiens
ggaggaaggucaauauuca

SEQ ID NO: 172335 - RNA, 19 nt, Homo sapiens
ggaacgaagcuucagauuu

SEQ ID NO: 172336 - RNA, 19 nt, Homo sapiens
gaaggucaauauucagaga

SEQ ID NO: 172337 - RNA, 19 nt, Homo sapiens
ggaggcagcugacacaucu

SEQ ID NO: 172338 - RNA, 19 nt, Homo sapiens
gaaaggucccugugacauu

SEQ ID NO: 172339 - RNA, 19 nt, Homo sapiens
gaacgucucucaaguuucc

SEQ ID NO: 172340 - RNA, 19 nt, Homo sapiens
gaacagcagagauugaaau

SEQ ID NO: 172341 - RNA, 19 nt, Homo sapiens
caugggaccugauucaaga

SEQ ID NO: 172342 - RNA, 19 nt, Homo sapiens
ugacaaagcuaaggaugga

SEQ ID NO: 172343 - RNA, 19 nt, Homo sapiens
aaaggucccugugacauuu

SEQ ID NO: 172344 - RNA, 19 nt, Homo sapiens
ggaggaacuucgagcugaa

SEQ ID NO: 172345 - RNA, 19 nt, Homo sapiens
gaucugagcagcuucaagu

SEQ ID NO: 172346 - RNA, 19 nt, Homo sapiens
uguccagccugcaucaaua

SEQ ID NO: 172347 - RNA, 19 nt, Homo sapiens
caacggaagugcuacuacu

SEQ ID NO: 172348 - RNA, 19 nt, Homo sapiens
gggaggaggugacaaagcu

SEQ ID NO: 172349 - RNA, 19 nt, Homo sapiens
ggauuggccuucggaacuu

SEQ ID NO: 172350 - RNA, 19 nt, Homo sapiens
ucucucaaguuuccaagaa

SEQ ID NO: 172351 - RNA, 19 nt, Homo sapiens
gcagguguccagcggcuuu

SEQ ID NO: 172352 - RNA, 19 nt, Homo sapiens
gcagugauggccucccaaa

SEQ ID NO: 172353 - RNA, 19 nt, Homo sapiens
gaggaggugacaaagcuaa

SEQ ID NO: 172354 - RNA, 19 nt, Homo sapiens
aaccagagcugugauugug

SEQ ID NO: 172355 - RNA, 19 nt, Homo sapiens
ccacuaaccagagcuguga

SEQ ID NO: 172356 - RNA, 19 nt, Homo sapiens
ggcgaggacugcgugauga

SEQ ID NO: 172357 - RNA, 19 nt, Homo sapiens
cagauuugcuggaaagacu

SEQ ID NO: 172358 - RNA, 19 nt, Homo sapiens
ugaaaucucaggacuugga

SEQ ID NO: 172359 - RNA, 19 nt, Homo sapiens
gugaccagauggcgcagaa

SEQ ID NO: 172360 - RNA, 19 nt, Homo sapiens
ccacaccggcuccuggauu

SEQ ID NO: 172361 - RNA, 19 nt, Homo sapiens
acuuggagcuguccuggaa

SEQ ID NO: 172362 - RNA, 19 nt, Homo sapiens
cacaggaacuggaggaacu

SEQ ID NO: 172363 - RNA, 19 nt, Homo sapiens
gaccagauggcgcagaaau

SEQ ID NO: 172364 - RNA, 19 nt, Homo sapiens
gcuccaaacuccacuaacc

SEQ ID NO: 172365 - RNA, 19 nt, Homo sapiens
cacaccggcuccuggauug

SEQ ID NO: 172366 - RNA, 19 nt, Homo sapiens
ggacagacacaggcuccaa

SEQ ID NO: 172367 - RNA, 19 nt, Homo sapiens
auugaaaucucaggacuug

SEQ ID NO: 172368 - RNA, 19 nt, Homo sapiens
ugaguggacugcguuguca

SEQ ID NO: 172369 - RNA, 19 nt, Homo sapiens
ugcaacacgugcccugaaa

SEQ ID NO: 172370 - RNA, 19 nt, Homo sapiens
gacagacacaggcuccaaa

SEQ ID NO: 172371 - RNA, 19 nt, Homo sapiens
gaggaacgaagcuucagau

SEQ ID NO: 172372 - RNA, 19 nt, Homo sapiens
gcagaucugagcagcuuca

SEQ ID NO: 172373 - RNA, 19 nt, Homo sapiens
ggacaccacacagagucua

SEQ ID NO: 172374 - RNA, 19 nt, Homo sapiens
cauggaggaaggucaauau

SEQ ID NO: 172375 - RNA, 19 nt, Homo sapiens
acagcacccucuccagaug

SEQ ID NO: 172376 - RNA, 19 nt, Homo sapiens
acagcacccucuccagaug

SEQ ID NO: 172377 - RNA, 19 nt, Homo sapiens
acagcacccucuccagaug

SEQ ID NO: 172378 - RNA, 19 nt, Homo sapiens
acagcacccucuccagaug

SEQ ID NO: 172379 - RNA, 19 nt, Homo sapiens
guaugccugugacgacaug

SEQ ID NO: 172380 - RNA, 19 nt, Homo sapiens
cuucagauuugcuggaaag

SEQ ID NO: 172381 - RNA, 19 nt, Homo sapiens
uaaccagagcugugauugu

SEQ ID NO: 172382 - RNA, 19 nt, Homo sapiens
ggaggaggugacaaagcua

SEQ ID NO: 172383 - RNA, 19 nt, Homo sapiens
ggaacuggaggaacuucga

SEQ ID NO: 172384 - RNA, 19 nt, Homo sapiens
gaggugacaaagcuaagga

SEQ ID NO: 172385 - RNA, 19 nt, Homo sapiens
cgagaggaacgaagcuuca

SEQ ID NO: 172386 - RNA, 19 nt, Homo sapiens
cuucaagucccaggaauug

SEQ ID NO: 172387 - RNA, 19 nt, Homo sapiens
gacaccacacagagucuaa

SEQ ID NO: 172388 - RNA, 19 nt, Homo sapiens
guccagccugcaucaauaa

SEQ ID NO: 172389 - RNA, 19 nt, Homo sapiens
gauuggccuucggaacuug

SEQ ID NO: 172390 - RNA, 19 nt, Homo sapiens
agacacaggcuccaaacuc

SEQ ID NO: 172391 - RNA, 19 nt, Homo sapiens
uggaggaaggucaauauuc

SEQ ID NO: 172392 - RNA, 19 nt, Homo sapiens
gugcaacacgugcccugaa

SEQ ID NO: 172393 - RNA, 19 nt, Homo sapiens
gcuucaagucccaggaauu

SEQ ID NO: 172394 - RNA, 19 nt, Homo sapiens
ccauggaggaaggucaaua

SEQ ID NO: 172395 - RNA, 19 nt, Homo sapiens
caagcaggaccgccaugga

SEQ ID NO: 172396 - RNA, 19 nt, Homo sapiens
gcagauuucacaggaacug

SEQ ID NO: 172397 - RNA, 19 nt, Homo sapiens
caucaucgggagaauccaa

SEQ ID NO: 172398 - RNA, 19 nt, Homo sapiens
gcuucagauuugcuggaaa

SEQ ID NO: 172399 - RNA, 19 nt, Homo sapiens
gaacgagaggaacgaagcu

SEQ ID NO: 172400 - RNA, 19 nt, Homo sapiens
gaauguaacuguucuguuu

SEQ ID NO: 172401 - RNA, 19 nt, Homo sapiens
gaaauguggucaucaaaga

SEQ ID NO: 172402 - RNA, 19 nt, Homo sapiens
gcaaauaaaugaacugacu

SEQ ID NO: 172403 - RNA, 19 nt, Homo sapiens
gaacacauccucugaauac

SEQ ID NO: 172404 - RNA, 19 nt, Homo sapiens
agacagacauuuagaagaa

SEQ ID NO: 172405 - RNA, 19 nt, Homo sapiens
aagaagagcugaaauguca

SEQ ID NO: 172406 - RNA, 19 nt, Homo sapiens
uaacauagcugagguaaaa

SEQ ID NO: 172407 - RNA, 19 nt, Homo sapiens
cuaauuagcuucaggauac

SEQ ID NO: 172408 - RNA, 19 nt, Homo sapiens
ucaagaagacagacauuua

SEQ ID NO: 172409 - RNA, 19 nt, Homo sapiens
gaugagaaauggauguguu

SEQ ID NO: 172410 - RNA, 19 nt, Homo sapiens
gcaaagagacgcuucaagu

SEQ ID NO: 172411 - RNA, 19 nt, Homo sapiens
ugacaacucugcuccuuug

SEQ ID NO: 172412 - RNA, 19 nt, Homo sapiens
gagaagcggcgauaccaua

SEQ ID NO: 172413 - RNA, 19 nt, Homo sapiens
gcauauguacagaagauua

SEQ ID NO: 172414 - RNA, 19 nt, Homo sapiens
gagacaagagggaauagua

SEQ ID NO: 172415 - RNA, 19 nt, Homo sapiens
guacaaacauccaaaaguu

SEQ ID NO: 172416 - RNA, 19 nt, Homo sapiens
gacaacaugugguucuuga

SEQ ID NO: 172417 - RNA, 19 nt, Homo sapiens
aggauacgcugcucucaua

SEQ ID NO: 172418 - RNA, 19 nt, Homo sapiens
agaaauggauguguuauuc

SEQ ID NO: 172419 - RNA, 19 nt, Homo sapiens
gugagugggugcauaugua

SEQ ID NO: 172420 - RNA, 19 nt, Homo sapiens
ggaaggaaauaguacuuac

SEQ ID NO: 172421 - RNA, 19 nt, Homo sapiens
caacugggauacauuugga

SEQ ID NO: 172422 - RNA, 19 nt, Homo sapiens
aaacaaaguugcucuugca

SEQ ID NO: 172423 - RNA, 19 nt, Homo sapiens
guaggaaggcagaauguaa

SEQ ID NO: 172424 - RNA, 19 nt, Homo sapiens
guucauggcuuuucucuuu

SEQ ID NO: 172425 - RNA, 19 nt, Homo sapiens
auacuuaguucauggcuuu

SEQ ID NO: 172426 - RNA, 19 nt, Homo sapiens
uacagaagauuaagacaga

SEQ ID NO: 172427 - RNA, 19 nt, Homo sapiens
aggauaagcugguguacaa

SEQ ID NO: 172428 - RNA, 19 nt, Homo sapiens
gacaagagggaauaguaua

SEQ ID NO: 172429 - RNA, 19 nt, Homo sapiens
ggaaggauaagcuggugua

SEQ ID NO: 172430 - RNA, 19 nt, Homo sapiens
gagaagacucuggguuaua

SEQ ID NO: 172431 - RNA, 19 nt, Homo sapiens
cuacacaucagcaggaaua

SEQ ID NO: 172432 - RNA, 19 nt, Homo sapiens
gaaagcaucgcuacacauc

SEQ ID NO: 172433 - RNA, 19 nt, Homo sapiens
gggaauaguauagacaaua

SEQ ID NO: 172434 - RNA, 19 nt, Homo sapiens
gaagacagacauuuagaag

SEQ ID NO: 172435 - RNA, 19 nt, Homo sapiens
ggauggaaauguccuuaag

SEQ ID NO: 172436 - RNA, 19 nt, Homo sapiens
aaagaugacuugaaaugag

SEQ ID NO: 172437 - RNA, 19 nt, Homo sapiens
aauacuaacugcuagaaga

SEQ ID NO: 172438 - RNA, 19 nt, Homo sapiens
ccacagaggcuggcuacua

SEQ ID NO: 172439 - RNA, 19 nt, Homo sapiens
ggaacacauccucugaaua

SEQ ID NO: 172440 - RNA, 19 nt, Homo sapiens
gaaggcagaauguaacugu

SEQ ID NO: 172441 - RNA, 19 nt, Homo sapiens
gagaaauggauguguuauu

SEQ ID NO: 172442 - RNA, 19 nt, Homo sapiens
gugcauauguacagaagau

SEQ ID NO: 172443 - RNA, 19 nt, Homo sapiens
agucaagccuagccugaua

SEQ ID NO: 172444 - RNA, 19 nt, Homo sapiens
caaagaugacuugaaauga

SEQ ID NO: 172445 - RNA, 19 nt, Homo sapiens
acacagugguuucucaaug

SEQ ID NO: 172446 - RNA, 19 nt, Homo sapiens
gacaauaaggaaggaaaua

SEQ ID NO: 172447 - RNA, 19 nt, Homo sapiens
gggaaagcaucgcuacaca

SEQ ID NO: 172448 - RNA, 19 nt, Homo sapiens
uguacaaugugcuuuacua

SEQ ID NO: 172449 - RNA, 19 nt, Homo sapiens
ugucaugcguggaaggaua

SEQ ID NO: 172450 - RNA, 19 nt, Homo sapiens
gaagaagagcugaaauguc

SEQ ID NO: 172451 - RNA, 19 nt, Homo sapiens
caagaagacagacauuuag

SEQ ID NO: 172452 - RNA, 19 nt, Homo sapiens
caaagagacgcuucaagug

SEQ ID NO: 172453 - RNA, 19 nt, Homo sapiens
ggccugguuugcagcuuua

SEQ ID NO: 172454 - RNA, 19 nt, Homo sapiens
cauacgcguucuaggcaua

SEQ ID NO: 172455 - RNA, 19 nt, Homo sapiens
gagaaccucuggccuugag

SEQ ID NO: 172456 - RNA, 19 nt, Homo sapiens
ggaaauguggucaucaaag

SEQ ID NO: 172457 - RNA, 19 nt, Homo sapiens
acaaugugcuuuacuaucg

SEQ ID NO: 172458 - RNA, 19 nt, Homo sapiens
gauaagcugguguacaaug

SEQ ID NO: 172459 - RNA, 19 nt, Homo sapiens
caaugacaguggugaauac

SEQ ID NO: 172460 - RNA, 19 nt, Homo sapiens
guaacuguucuguuuguuu

SEQ ID NO: 172461 - RNA, 19 nt, Homo sapiens
gaaggaaauaguacuuaca

SEQ ID NO: 172462 - RNA, 19 nt, Homo sapiens
ccacagaggauggaaaugu

SEQ ID NO: 172463 - RNA, 19 nt, Homo sapiens
ggaggaguaugacacaaaa

SEQ ID NO: 172464 - RNA, 19 nt, Homo sapiens
ugcuuuaccuuccugauuu

SEQ ID NO: 172465 - RNA, 19 nt, Homo sapiens
gugcuuuacuaucgaaaug

SEQ ID NO: 172466 - RNA, 19 nt, Homo sapiens
gagacaacaugugguucuu

SEQ ID NO: 172467 - RNA, 19 nt, Homo sapiens
uaaccucaccauucugaaa

SEQ ID NO: 172468 - RNA, 19 nt, Homo sapiens
uagaagaagagcugaaaug

SEQ ID NO: 172469 - RNA, 19 nt, Homo sapiens
uaccaaauacuaacugcua

SEQ ID NO: 172470 - RNA, 19 nt, Homo sapiens
ucaaugacaguggugaaua

SEQ ID NO: 172471 - RNA, 19 nt, Homo sapiens
guacaaugugcuuuacuau

SEQ ID NO: 172472 - RNA, 19 nt, Homo sapiens
aaaggugagugggugcaua

SEQ ID NO: 172473 - RNA, 19 nt, Homo sapiens
caacaugugguucuugaca

SEQ ID NO: 172474 - RNA, 19 nt, Homo sapiens
cacagaggcuggcuacuac

SEQ ID NO: 172475 - RNA, 19 nt, Homo sapiens
gaaauggauguguuauucu

SEQ ID NO: 172476 - RNA, 19 nt, Homo sapiens
gcccugaguuggagcuuca

SEQ ID NO: 172477 - RNA, 19 nt, Homo sapiens
agaagacucuggguuauac

SEQ ID NO: 172478 - RNA, 19 nt, Homo sapiens
caacuccugucugguuuca

SEQ ID NO: 172479 - RNA, 19 nt, Homo sapiens
caaauacuaacugcuagaa

SEQ ID NO: 172480 - RNA, 19 nt, Homo sapiens
caagagggaauaguauaga

SEQ ID NO: 172481 - RNA, 19 nt, Homo sapiens
ucucauaaccccucuauuu

SEQ ID NO: 172482 - RNA, 19 nt, Homo sapiens
gagggaauaguauagacaa

SEQ ID NO: 172483 - RNA, 19 nt, Homo sapiens
agaaagagacacacacaca

SEQ ID NO: 172484 - RNA, 19 nt, Homo sapiens
uuacuucuccuucuacaug

SEQ ID NO: 172485 - RNA, 19 nt, Homo sapiens
ggagacaacaugugguucu

SEQ ID NO: 172486 - RNA, 19 nt, Homo sapiens
ccagagauuugcuuuaccu

SEQ ID NO: 172487 - RNA, 19 nt, Homo sapiens
cauaaccccucuauuucua

SEQ ID NO: 172488 - RNA, 19 nt, Homo sapiens
gaaaccguaaccuugcauu

SEQ ID NO: 172489 - RNA, 19 nt, Homo sapiens
gcucacgccucuguguuca

SEQ ID NO: 172490 - RNA, 19 nt, Homo sapiens
acagacauuuagaagaaga

SEQ ID NO: 172491 - RNA, 19 nt, Homo sapiens
ggucaugagaagaagguaa

SEQ ID NO: 172492 - RNA, 19 nt, Homo sapiens
cacauccucugaauaccaa

SEQ ID NO: 172493 - RNA, 19 nt, Homo sapiens
ggaaagcaucgcuacacau

SEQ ID NO: 172494 - RNA, 19 nt, Homo sapiens
caauaaggaaggaaauagu

SEQ ID NO: 172495 - RNA, 19 nt, Homo sapiens
agacaagagggaauaguau

SEQ ID NO: 172496 - RNA, 19 nt, Homo sapiens
gaauaccaaauacuaacug

SEQ ID NO: 172497 - RNA, 19 nt, Homo sapiens
gcucaggcaugggaaagca

SEQ ID NO: 172498 - RNA, 19 nt, Homo sapiens
cacagugguuucucaaugg

SEQ ID NO: 172499 - RNA, 19 nt, Homo sapiens
auacgcugcucucauacuu

SEQ ID NO: 172500 - RNA, 19 nt, Homo sapiens
gguaaaugcuuauguuaga

SEQ ID NO: 172501 - RNA, 19 nt, Homo sapiens
ccaaaugucucagaaugua

SEQ ID NO: 172502 - RNA, 19 nt, Homo sapiens
caugaaagacgcuauguua

SEQ ID NO: 172503 - RNA, 19 nt, Homo sapiens
gaacaaagagcccaauuac

SEQ ID NO: 172504 - RNA, 19 nt, Homo sapiens
caucauacccagcuaauuu

SEQ ID NO: 172505 - RNA, 19 nt, Homo sapiens
ugugaaggcugcccaauuu

SEQ ID NO: 172506 - RNA, 19 nt, Homo sapiens
cauuaagucuccauuguuu

SEQ ID NO: 172507 - RNA, 19 nt, Homo sapiens
caagcagccuacuaacaua

SEQ ID NO: 172508 - RNA, 19 nt, Homo sapiens
gcaaucauguaagucuaua

SEQ ID NO: 172509 - RNA, 19 nt, Homo sapiens
gggcagcucuucaccaaug

SEQ ID NO: 172510 - RNA, 19 nt, Homo sapiens
gacgcuauguuacagguua

SEQ ID NO: 172511 - RNA, 19 nt, Homo sapiens
ccacacagccaauacaauu

SEQ ID NO: 172512 - RNA, 19 nt, Homo sapiens
gaaauucucccguuuggau

SEQ ID NO: 172513 - RNA, 19 nt, Homo sapiens
uaucuuggcucacugcaaa

SEQ ID NO: 172514 - RNA, 19 nt, Homo sapiens
agacuaaccucuaacaaca

SEQ ID NO: 172515 - RNA, 19 nt, Homo sapiens
gaaauagcuuuaacuuugc

SEQ ID NO: 172516 - RNA, 19 nt, Homo sapiens
cuauaugacuucagaaaug

SEQ ID NO: 172517 - RNA, 19 nt, Homo sapiens
gaaagacgcuauguuacag

SEQ ID NO: 172518 - RNA, 19 nt, Homo sapiens
gaccaugucaacaguaaua

SEQ ID NO: 172519 - RNA, 19 nt, Homo sapiens
gagcaaucauguaagucua

SEQ ID NO: 172520 - RNA, 19 nt, Homo sapiens
ggacaagccucuggucaag

SEQ ID NO: 172521 - RNA, 19 nt, Homo sapiens
gaaagagacaacuugaaga

SEQ ID NO: 172522 - RNA, 19 nt, Homo sapiens
gucggaagcuccagaagaa

SEQ ID NO: 172523 - RNA, 19 nt, Homo sapiens
cagaauguaugucccagaa

SEQ ID NO: 172524 - RNA, 19 nt, Homo sapiens
gcagccuacuaacauauaa

SEQ ID NO: 172525 - RNA, 19 nt, Homo sapiens
aauaaauacuugccuguga

SEQ ID NO: 172526 - RNA, 19 nt, Homo sapiens
gaauguaugucccagaaac

SEQ ID NO: 172527 - RNA, 19 nt, Homo sapiens
caacaaugacuaugaaaca

SEQ ID NO: 172528 - RNA, 19 nt, Homo sapiens
ugacugugcuuuccgaaug

SEQ ID NO: 172529 - RNA, 19 nt, Homo sapiens
ccacugcacaggaaacaua

SEQ ID NO: 172530 - RNA, 19 nt, Homo sapiens
gaaagccacagacaauaug

SEQ ID NO: 172531 - RNA, 19 nt, Homo sapiens
ggauuugagaagagaauua

SEQ ID NO: 172532 - RNA, 19 nt, Homo sapiens
caacgaccaugucaacagu

SEQ ID NO: 172533 - RNA, 19 nt, Homo sapiens
gauuaccacugcacaggaa

SEQ ID NO: 172534 - RNA, 19 nt, Homo sapiens
ugagagcaaucauguaagu

SEQ ID NO: 172535 - RNA, 19 nt, Homo sapiens
agucaaaccacuguuauua

SEQ ID NO: 172536 - RNA, 19 nt, Homo sapiens
aaagcucccuguccugaaa

SEQ ID NO: 172537 - RNA, 19 nt, Homo sapiens
agaacaaagagcccaauua

SEQ ID NO: 172538 - RNA, 19 nt, Homo sapiens
caccuggcccuuagaaaua

SEQ ID NO: 172539 - RNA, 19 nt, Homo sapiens
caaaggcugugcugaaacu

SEQ ID NO: 172540 - RNA, 19 nt, Homo sapiens
cagacaauauggucccaaa

SEQ ID NO: 172541 - RNA, 19 nt, Homo sapiens
acaaagagcccaauuacca

SEQ ID NO: 172542 - RNA, 19 nt, Homo sapiens
gccaauacaauuagucaaa

SEQ ID NO: 172543 - RNA, 19 nt, Homo sapiens
cacuaaacuucaugaauug

SEQ ID NO: 172544 - RNA, 19 nt, Homo sapiens
gaagaaaccaacaaugacu

SEQ ID NO: 172545 - RNA, 19 nt, Homo sapiens
aaagagacaacuugaagaa

SEQ ID NO: 172546 - RNA, 19 nt, Homo sapiens
gagagcgacuccauucagu

SEQ ID NO: 172547 - RNA, 19 nt, Homo sapiens
cacauuaagucuccauugu

SEQ ID NO: 172548 - RNA, 19 nt, Homo sapiens
auacuugccugugacauuu

SEQ ID NO: 172549 - RNA, 19 nt, Homo sapiens
gaauugcgccucagauuuu

SEQ ID NO: 172550 - RNA, 19 nt, Homo sapiens
gcccuuagaaauagcuuua

SEQ ID NO: 172551 - RNA, 19 nt, Homo sapiens
ccaccuggacgucaaauga

SEQ ID NO: 172552 - RNA, 19 nt, Homo sapiens
cccaaaggcugugcugaaa

SEQ ID NO: 172553 - RNA, 19 nt, Homo sapiens
ugaauugcgccucagauuu

SEQ ID NO: 172554 - RNA, 19 nt, Homo sapiens
gaacacuaaacuucaugaa

SEQ ID NO: 172555 - RNA, 19 nt, Homo sapiens
aaaccaacaaugacuauga

SEQ ID NO: 172556 - RNA, 19 nt, Homo sapiens
ugaaagacgcuauguuaca

SEQ ID NO: 172557 - RNA, 19 nt, Homo sapiens
gucaaaccacuguuauuaa

SEQ ID NO: 172558 - RNA, 19 nt, Homo sapiens
ugaaagccacagacaauau

SEQ ID NO: 172559 - RNA, 19 nt, Homo sapiens
gaggugaggaucugguauu

SEQ ID NO: 172560 - RNA, 19 nt, Homo sapiens
agagacaacuugaagaaac

SEQ ID NO: 172561 - RNA, 19 nt, Homo sapiens
uugaagaaaccaacaauga

SEQ ID NO: 172562 - RNA, 19 nt, Homo sapiens
ucugguaaaugcuuauguu

SEQ ID NO: 172563 - RNA, 19 nt, Homo sapiens
ggagggagaaaccaucaug

SEQ ID NO: 172564 - RNA, 19 nt, Homo sapiens
acuaaccucuaacaacaaa

SEQ ID NO: 172565 - RNA, 19 nt, Homo sapiens
caacaugaaagacgcuaug

SEQ ID NO: 172566 - RNA, 19 nt, Homo sapiens
ccaggccgaucucgaacuu

SEQ ID NO: 172567 - RNA, 19 nt, Homo sapiens
ccaccuggcccuuagaaau

SEQ ID NO: 172568 - RNA, 19 nt, Homo sapiens
aaccaacaaugacuaugaa

SEQ ID NO: 172569 - RNA, 19 nt, Homo sapiens
gcgacuccauucagugguu

SEQ ID NO: 172570 - RNA, 19 nt, Homo sapiens
guucaaggccaacaacaau

SEQ ID NO: 172571 - RNA, 19 nt, Homo sapiens
cauuguggcuguggucauu

SEQ ID NO: 172572 - RNA, 19 nt, Homo sapiens
acgaagggaugcugcaguu

SEQ ID NO: 172573 - RNA, 19 nt, Homo sapiens
gagaggugaggaucuggua

SEQ ID NO: 172574 - RNA, 19 nt, Homo sapiens
uaacaucuucuuuccuaug

SEQ ID NO: 172575 - RNA, 19 nt, Homo sapiens
ucagaaagagacaacuuga

SEQ ID NO: 172576 - RNA, 19 nt, Homo sapiens
ucaaggccaacaacaauga

SEQ ID NO: 172577 - RNA, 19 nt, Homo sapiens
uguuacagguuacaugaga

SEQ ID NO: 172578 - RNA, 19 nt, Homo sapiens
gugaggaucugguauuucc

SEQ ID NO: 172579 - RNA, 19 nt, Homo sapiens
ccuauucacugcuuaugca

SEQ ID NO: 172580 - RNA, 19 nt, Homo sapiens
ggaacacuaaacuucauga

SEQ ID NO: 172581 - RNA, 19 nt, Homo sapiens
agaaagagacaacuugaag

SEQ ID NO: 172582 - RNA, 19 nt, Homo sapiens
ugaaggcugcccaauuuga

SEQ ID NO: 172583 - RNA, 19 nt, Homo sapiens
acccaaaugucucagaaug

SEQ ID NO: 172584 - RNA, 19 nt, Homo sapiens
gaacaaaaucaccuauuca

SEQ ID NO: 172585 - RNA, 19 nt, Homo sapiens
acaagcagccuacuaacau

SEQ ID NO: 172586 - RNA, 19 nt, Homo sapiens
gcggcuacaugacucugaa

SEQ ID NO: 172587 - RNA, 19 nt, Homo sapiens
cauuguugcugcuguagug

SEQ ID NO: 172588 - RNA, 19 nt, Homo sapiens
cacacagccaauacaauua

SEQ ID NO: 172589 - RNA, 19 nt, Homo sapiens
ccugaaagccacagacaau

SEQ ID NO: 172590 - RNA, 19 nt, Homo sapiens
ccacauuaagucuccauug

SEQ ID NO: 172591 - RNA, 19 nt, Homo sapiens
ccaauuaccagaaccacau

SEQ ID NO: 172592 - RNA, 19 nt, Homo sapiens
ccaauacaauuagucaaac

SEQ ID NO: 172593 - RNA, 19 nt, Homo sapiens
aggcugugcugaaacuuga

SEQ ID NO: 172594 - RNA, 19 nt, Homo sapiens
gggcaccuacugacgauga

SEQ ID NO: 172595 - RNA, 19 nt, Homo sapiens
ggucauugcgacugcugua

SEQ ID NO: 172596 - RNA, 19 nt, Homo sapiens
caacuauggagacccaaau

SEQ ID NO: 172597 - RNA, 19 nt, Homo sapiens
auuaacagauguagcaaca

SEQ ID NO: 172598 - RNA, 19 nt, Homo sapiens
ggaagcuccagaagaacaa

SEQ ID NO: 172599 - RNA, 19 nt, Homo sapiens
acgaccaugucaacaguaa

SEQ ID NO: 172600 - RNA, 19 nt, Homo sapiens
gagggaagaucugguauuu

SEQ ID NO: 172601 - RNA, 19 nt, Homo sapiens
gaagcucccuguccugaaa

SEQ ID NO: 172602 - RNA, 19 nt, Homo sapiens
gagagacccucccugagaa

SEQ ID NO: 172603 - RNA, 19 nt, Homo sapiens
gggaaaugcuuauguuaca

SEQ ID NO: 172604 - RNA, 19 nt, Homo sapiens
ccacacagccaauccaauu

SEQ ID NO: 172605 - RNA, 19 nt, Homo sapiens
ugaugaggcugacaaaguu

SEQ ID NO: 172606 - RNA, 19 nt, Homo sapiens
ggacaagccucuggucaag

SEQ ID NO: 172607 - RNA, 19 nt, Homo sapiens
ccacugcacaggaaacaua

SEQ ID NO: 172608 - RNA, 19 nt, Homo sapiens
gaaagccacagacaauaug

SEQ ID NO: 172609 - RNA, 19 nt, Homo sapiens
gguagaaucgccaagcuuu

SEQ ID NO: 172610 - RNA, 19 nt, Homo sapiens
gaccagaaccguauuuagu

SEQ ID NO: 172611 - RNA, 19 nt, Homo sapiens
gaacacaaucaccuauuca

SEQ ID NO: 172612 - RNA, 19 nt, Homo sapiens
gauuaccacugcacaggaa

SEQ ID NO: 172613 - RNA, 19 nt, Homo sapiens
gcauugggauuugagaaga

SEQ ID NO: 172614 - RNA, 19 nt, Homo sapiens
gcacccggaugcucuggaa

SEQ ID NO: 172615 - RNA, 19 nt, Homo sapiens
augcuuauguuacagguua

SEQ ID NO: 172616 - RNA, 19 nt, Homo sapiens
acagggagaugcucgaguu

SEQ ID NO: 172617 - RNA, 19 nt, Homo sapiens
caaaggcugugcugaaacu

SEQ ID NO: 172618 - RNA, 19 nt, Homo sapiens
guggacagcugugcuauuc

SEQ ID NO: 172619 - RNA, 19 nt, Homo sapiens
acaaucaccuauucacuuc

SEQ ID NO: 172620 - RNA, 19 nt, Homo sapiens
uuucagcucucccaggaua

SEQ ID NO: 172621 - RNA, 19 nt, Homo sapiens
gagagcgacuccauucagu

SEQ ID NO: 172622 - RNA, 19 nt, Homo sapiens
gaccaucacuguccaagcu

SEQ ID NO: 172623 - RNA, 19 nt, Homo sapiens
gauuguuucugggugauuu

SEQ ID NO: 172624 - RNA, 19 nt, Homo sapiens
gagaacacaaucaccuauu

SEQ ID NO: 172625 - RNA, 19 nt, Homo sapiens
cccaaaggcugugcugaaa

SEQ ID NO: 172626 - RNA, 19 nt, Homo sapiens
agaacacaaucaccuauuc

SEQ ID NO: 172627 - RNA, 19 nt, Homo sapiens
ugaaagccacagacaauau

SEQ ID NO: 172628 - RNA, 19 nt, Homo sapiens
ggacagcugugcuauuccu

SEQ ID NO: 172629 - RNA, 19 nt, Homo sapiens
guuucugggugauuuauug

SEQ ID NO: 172630 - RNA, 19 nt, Homo sapiens
gcaacuugggaaaugcuua

SEQ ID NO: 172631 - RNA, 19 nt, Homo sapiens
aauagcaacuugggaaaug

SEQ ID NO: 172632 - RNA, 19 nt, Homo sapiens
acacagccaauccaauuaa

SEQ ID NO: 172633 - RNA, 19 nt, Homo sapiens
ggccauuguugcugcugua

SEQ ID NO: 172634 - RNA, 19 nt, Homo sapiens
caacuucuccaucccacaa

SEQ ID NO: 172635 - RNA, 19 nt, Homo sapiens
guucaaggccaacaacaau

SEQ ID NO: 172636 - RNA, 19 nt, Homo sapiens
ugaugggaauccugucauu

SEQ ID NO: 172637 - RNA, 19 nt, Homo sapiens
gcgacuccauucagugguu

SEQ ID NO: 172638 - RNA, 19 nt, Homo sapiens
gccaauccaauuaaucaaa

SEQ ID NO: 172639 - RNA, 19 nt, Homo sapiens
cagccaauccaauuaauca

SEQ ID NO: 172640 - RNA, 19 nt, Homo sapiens
ccaauccaauuaaucaaac

SEQ ID NO: 172641 - RNA, 19 nt, Homo sapiens
ucgccaagcuuugagagaa

SEQ ID NO: 172642 - RNA, 19 nt, Homo sapiens
ucaaggccaacaacaauga

SEQ ID NO: 172643 - RNA, 19 nt, Homo sapiens
caacuugggaaaugcuuau

SEQ ID NO: 172644 - RNA, 19 nt, Homo sapiens
ccagaaccguauuuagucu

SEQ ID NO: 172645 - RNA, 19 nt, Homo sapiens
ccuauucacuucucaugca

SEQ ID NO: 172646 - RNA, 19 nt, Homo sapiens
gagaugcucgaguuccaaa

SEQ ID NO: 172647 - RNA, 19 nt, Homo sapiens
cauuguugcugcuguagug

SEQ ID NO: 172648 - RNA, 19 nt, Homo sapiens
ggaaaugcuuauguuacag

SEQ ID NO: 172649 - RNA, 19 nt, Homo sapiens
caauuaaucaaaccacugu

SEQ ID NO: 172650 - RNA, 19 nt, Homo sapiens
ucaaggcucuuccguucca

SEQ ID NO: 172651 - RNA, 19 nt, Homo sapiens
ccugaaagccacagacaau

SEQ ID NO: 172652 - RNA, 19 nt, Homo sapiens
agagagggaagaucuggua

SEQ ID NO: 172653 - RNA, 19 nt, Homo sapiens
gaugaccagaaccguauuu

SEQ ID NO: 172654 - RNA, 19 nt, Homo sapiens
cacaaucaccuauucacuu

SEQ ID NO: 172655 - RNA, 19 nt, Homo sapiens
uguuacagguuaccguuga

SEQ ID NO: 172656 - RNA, 19 nt, Homo sapiens
cuugggaaaugcuuauguu

SEQ ID NO: 172657 - RNA, 19 nt, Homo sapiens
uagaaucgccaagcuuuga

SEQ ID NO: 172658 - RNA, 19 nt, Homo sapiens
gggagaugcucgaguucca

SEQ ID NO: 172659 - RNA, 19 nt, Homo sapiens
gagagugacugggcugacu

SEQ ID NO: 172660 - RNA, 19 nt, Homo sapiens
uaccuguccuugccacuga

SEQ ID NO: 172661 - RNA, 19 nt, Homo sapiens
cacacagccaauccaauua

SEQ ID NO: 172662 - RNA, 19 nt, Homo sapiens
cuucagcucuucuugacau

SEQ ID NO: 172663 - RNA, 19 nt, Homo sapiens
cauugggauuugagaagaa

SEQ ID NO: 172664 - RNA, 19 nt, Homo sapiens
ggucaaggucacauucuuc

SEQ ID NO: 172665 - RNA, 19 nt, Homo sapiens
cagcccagcuacagguuca

SEQ ID NO: 172666 - RNA, 19 nt, Homo sapiens
acaagccucuggucaaggu

SEQ ID NO: 172667 - RNA, 19 nt, Homo sapiens
caagcaaaccacagucaca

SEQ ID NO: 172668 - RNA, 19 nt, Homo sapiens
guagaaucgccaagcuuug

SEQ ID NO: 172669 - RNA, 19 nt, Homo sapiens
uauuuagucuccauugucu

SEQ ID NO: 172670 - RNA, 19 nt, Homo sapiens
cguauuuagucuccauugu

SEQ ID NO: 172671 - RNA, 19 nt, Homo sapiens
cacagccaauccaauuaau

SEQ ID NO: 172672 - RNA, 19 nt, Homo sapiens
cauccaagccugugaccau

SEQ ID NO: 172673 - RNA, 19 nt, Homo sapiens
gcaucugacugugcuuucu

SEQ ID NO: 172674 - RNA, 19 nt, Homo sapiens
ucugggugauuuauugaug

SEQ ID NO: 172675 - RNA, 19 nt, Homo sapiens
ugucuugcauugggauuug

SEQ ID NO: 172676 - RNA, 19 nt, Homo sapiens
ccugagagcgacuccauuc

SEQ ID NO: 172677 - RNA, 19 nt, Homo sapiens
guauuuagucuccauuguc

SEQ ID NO: 172678 - RNA, 19 nt, Homo sapiens
ugagaacacaaucaccuau

SEQ ID NO: 172679 - RNA, 19 nt, Homo sapiens
gguucaaggccaacaacaa

SEQ ID NO: 172680 - RNA, 19 nt, Homo sapiens
cugggugauuuauugauga

SEQ ID NO: 172681 - RNA, 19 nt, Homo sapiens
cugaaagccacagacaaua

SEQ ID NO: 172682 - RNA, 19 nt, Homo sapiens
aaucagagagggaagaucu

SEQ ID NO: 172683 - RNA, 19 nt, Homo sapiens
gaaucgccaagcuuugaga

SEQ ID NO: 172684 - RNA, 19 nt, Homo sapiens
uaaccucuaccagcacauu

SEQ ID NO: 172685 - RNA, 19 nt, Homo sapiens
cugaugaggcugacaaagu

SEQ ID NO: 172686 - RNA, 19 nt, Homo sapiens
ccacauccacacagccaau

SEQ ID NO: 172687 - RNA, 19 nt, Homo sapiens
gaugaggcugacaaaguug

SEQ ID NO: 172688 - RNA, 19 nt, Homo sapiens
ggaguacacgugccagacu

SEQ ID NO: 172689 - RNA, 19 nt, Homo sapiens
gagagggaagaucugguau

SEQ ID NO: 172690 - RNA, 19 nt, Homo sapiens
ccucuaccagcacauuaaa

SEQ ID NO: 172691 - RNA, 19 nt, Homo sapiens
cagcgacccugugcaucug

SEQ ID NO: 172692 - RNA, 19 nt, Homo sapiens
ggagaugcucgaguuccaa

SEQ ID NO: 172693 - RNA, 19 nt, Homo sapiens
guucggaucccaacuucuc

SEQ ID NO: 172694 - RNA, 19 nt, Homo sapiens
gaacauuucucuggauuug

SEQ ID NO: 172695 - RNA, 19 nt, Homo sapiens
gggaaaggcuguuuacuuc

SEQ ID NO: 172696 - RNA, 19 nt, Homo sapiens
gagaaagccugagaagaaa

SEQ ID NO: 172697 - RNA, 19 nt, Homo sapiens
gugaguagcugcauuccua

SEQ ID NO: 172698 - RNA, 19 nt, Homo sapiens
gaagacaauuguugcuuau

SEQ ID NO: 172699 - RNA, 19 nt, Homo sapiens
gaaaggacccucaagacaa

SEQ ID NO: 172700 - RNA, 19 nt, Homo sapiens
gcaaaggcaggaaguauuu

SEQ ID NO: 172701 - RNA, 19 nt, Homo sapiens
gaagaacacugcucugcau

SEQ ID NO: 172702 - RNA, 19 nt, Homo sapiens
agaagacaauuguugcuua

SEQ ID NO: 172703 - RNA, 19 nt, Homo sapiens
ugagaaagccugagaagaa

SEQ ID NO: 172704 - RNA, 19 nt, Homo sapiens
gaacaaacccugugucacu

SEQ ID NO: 172705 - RNA, 19 nt, Homo sapiens
ugcauaaggucacauauuu

SEQ ID NO: 172706 - RNA, 19 nt, Homo sapiens
cagcaucucugaacauuuc

SEQ ID NO: 172707 - RNA, 19 nt, Homo sapiens
ggucacauauuuacagaau

SEQ ID NO: 172708 - RNA, 19 nt, Homo sapiens
ggaaaaccaugguaauaaa

SEQ ID NO: 172709 - RNA, 19 nt, Homo sapiens
aaaggacccucaagacaaa

SEQ ID NO: 172710 - RNA, 19 nt, Homo sapiens
ggacuauauuucucuguga

SEQ ID NO: 172711 - RNA, 19 nt, Homo sapiens
gcauaaggucacauauuua

SEQ ID NO: 172712 - RNA, 19 nt, Homo sapiens
agacaauuguugcuuauga

SEQ ID NO: 172713 - RNA, 19 nt, Homo sapiens
ggacacaggacuauauuuc

SEQ ID NO: 172714 - RNA, 19 nt, Homo sapiens
ggauaucuuuggugacuug

SEQ ID NO: 172715 - RNA, 19 nt, Homo sapiens
ggagaaaggacccucaaga

SEQ ID NO: 172716 - RNA, 19 nt, Homo sapiens
gaacacugcucugcauaag

SEQ ID NO: 172717 - RNA, 19 nt, Homo sapiens
ggaaagcgcaggaggugaa

SEQ ID NO: 172718 - RNA, 19 nt, Homo sapiens
uaucagaacuggaccaucu

SEQ ID NO: 172719 - RNA, 19 nt, Homo sapiens
guaguggaauuaacaggaa

SEQ ID NO: 172720 - RNA, 19 nt, Homo sapiens
gaacaucaccaucacucaa

SEQ ID NO: 172721 - RNA, 19 nt, Homo sapiens
gacaauuguugcuuaugaa

SEQ ID NO: 172722 - RNA, 19 nt, Homo sapiens
caacugcucugcuacuucu

SEQ ID NO: 172723 - RNA, 19 nt, Homo sapiens
ggaauuaacaggaaaucau

SEQ ID NO: 172724 - RNA, 19 nt, Homo sapiens
acaagcagcaggaaacaua

SEQ ID NO: 172725 - RNA, 19 nt, Homo sapiens
caccaucacucaagguuug

SEQ ID NO: 172726 - RNA, 19 nt, Homo sapiens
ucacauauuuacagaaugg

SEQ ID NO: 172727 - RNA, 19 nt, Homo sapiens
ggacugaagaucucccaaa

SEQ ID NO: 172728 - RNA, 19 nt, Homo sapiens
gaauuaacaggaaaucaug

SEQ ID NO: 172729 - RNA, 19 nt, Homo sapiens
aagcauggcugagaaauag

SEQ ID NO: 172730 - RNA, 19 nt, Homo sapiens
gaaauuggugggugacaga

SEQ ID NO: 172731 - RNA, 19 nt, Homo sapiens
cacagugguuucacaauga

SEQ ID NO: 172732 - RNA, 19 nt, Homo sapiens
guaguaagaauuagagguu

SEQ ID NO: 172733 - RNA, 19 nt, Homo sapiens
uuucagagcuacacaaaca

SEQ ID NO: 172734 - RNA, 19 nt, Homo sapiens
guagcugcauuccuagaaa

SEQ ID NO: 172735 - RNA, 19 nt, Homo sapiens
gaaagccugagaagaaaga

SEQ ID NO: 172736 - RNA, 19 nt, Homo sapiens
uaucucagcaucagaauga

SEQ ID NO: 172737 - RNA, 19 nt, Homo sapiens
gguaauccuuuaaacauac

SEQ ID NO: 172738 - RNA, 19 nt, Homo sapiens
ugucaaccaucucaucauu

SEQ ID NO: 172739 - RNA, 19 nt, Homo sapiens
ugucacagcuggaagaaca

SEQ ID NO: 172740 - RNA, 19 nt, Homo sapiens
gaguacaggugccagacaa

SEQ ID NO: 172741 - RNA, 19 nt, Homo sapiens
acacagugguuucacaaug

SEQ ID NO: 172742 - RNA, 19 nt, Homo sapiens
gaucuugcaugcuacucuu

SEQ ID NO: 172743 - RNA, 19 nt, Homo sapiens
gcucugcuacuucuaguuu

SEQ ID NO: 172744 - RNA, 19 nt, Homo sapiens
gccaggguaguaagaauua

SEQ ID NO: 172745 - RNA, 19 nt, Homo sapiens
gaccaucuccaaguauaua

SEQ ID NO: 172746 - RNA, 19 nt, Homo sapiens
agauaagggugucuuccua

SEQ ID NO: 172747 - RNA, 19 nt, Homo sapiens
gaaaggcuguuuacuuccu

SEQ ID NO: 172748 - RNA, 19 nt, Homo sapiens
cuacugagcuucgcugagu

SEQ ID NO: 172749 - RNA, 19 nt, Homo sapiens
uaaauguacuacugagcuu

SEQ ID NO: 172750 - RNA, 19 nt, Homo sapiens
ucaugagggugacguagaa

SEQ ID NO: 172751 - RNA, 19 nt, Homo sapiens
ggaauucagugggaccaau

SEQ ID NO: 172752 - RNA, 19 nt, Homo sapiens
gcaggaccauacagagugu

SEQ ID NO: 172753 - RNA, 19 nt, Homo sapiens
gguacagggugcucgagaa

SEQ ID NO: 172754 - RNA, 19 nt, Homo sapiens
gacguagaauugagucuuc

SEQ ID NO: 172755 - RNA, 19 nt, Homo sapiens
gagacuggaaggaccauaa

SEQ ID NO: 172756 - RNA, 19 nt, Homo sapiens
uaagugaacagaacuaucu

SEQ ID NO: 172757 - RNA, 19 nt, Homo sapiens
ccaaguauauaacgaugag

SEQ ID NO: 172758 - RNA, 19 nt, Homo sapiens
gacuauauuucucugugaa

SEQ ID NO: 172759 - RNA, 19 nt, Homo sapiens
gcaggaaacauagaacuca

SEQ ID NO: 172760 - RNA, 19 nt, Homo sapiens
ugagaagucagaugaaguu

SEQ ID NO: 172761 - RNA, 19 nt, Homo sapiens
acacugcucugcauaaggu

SEQ ID NO: 172762 - RNA, 19 nt, Homo sapiens
ggauggagaagacaauugu

SEQ ID NO: 172763 - RNA, 19 nt, Homo sapiens
ucaaccaucucaucauucu

SEQ ID NO: 172764 - RNA, 19 nt, Homo sapiens
gcaugcuacucuuagauag

SEQ ID NO: 172765 - RNA, 19 nt, Homo sapiens
gaugguaauccuuuaaaca

SEQ ID NO: 172766 - RNA, 19 nt, Homo sapiens
gcagcagcaucucugaaca

SEQ ID NO: 172767 - RNA, 19 nt, Homo sapiens
ggcaaaggcaggaaguauu

SEQ ID NO: 172768 - RNA, 19 nt, Homo sapiens
gaggacaauuccacacagu

SEQ ID NO: 172769 - RNA, 19 nt, Homo sapiens
gacugaagaucucccaaag

SEQ ID NO: 172770 - RNA, 19 nt, Homo sapiens
gaaaagaaaguacagaaca

SEQ ID NO: 172771 - RNA, 19 nt, Homo sapiens
ccucaggccucucuacaag

SEQ ID NO: 172772 - RNA, 19 nt, Homo sapiens
caucaugucaguuccaaug

SEQ ID NO: 172773 - RNA, 19 nt, Homo sapiens
ucaaauccuucaucauguc

SEQ ID NO: 172774 - RNA, 19 nt, Homo sapiens
guuaaugcagggacuguaa

SEQ ID NO: 172775 - RNA, 19 nt, Homo sapiens
gucccaaguugcuaaguga

SEQ ID NO: 172776 - RNA, 19 nt, Homo sapiens
aaagcauggcugagaaaua

SEQ ID NO: 172777 - RNA, 19 nt, Homo sapiens
cgacgacaguggagaguac

SEQ ID NO: 172778 - RNA, 19 nt, Homo sapiens
uuagauagaagaugggaaa

SEQ ID NO: 172779 - RNA, 19 nt, Homo sapiens
uuucaaauccuucaucaug

SEQ ID NO: 172780 - RNA, 19 nt, Homo sapiens
gagaaaggacccucaagac

SEQ ID NO: 172781 - RNA, 19 nt, Homo sapiens
gccucgagcuacuucauug

SEQ ID NO: 172782 - RNA, 19 nt, Homo sapiens
aacauuagccguaguggaa

SEQ ID NO: 172783 - RNA, 19 nt, Homo sapiens
acagggugcucgagaagga

SEQ ID NO: 172784 - RNA, 19 nt, Homo sapiens
ccucccaacugcucugcua

SEQ ID NO: 172785 - RNA, 19 nt, Homo sapiens
cuguguagcuuuguucauu

SEQ ID NO: 172786 - RNA, 19 nt, Homo sapiens
gaaugagaaagccugagaa

SEQ ID NO: 172787 - RNA, 19 nt, Homo sapiens
gaaagcauggcugagaaau

SEQ ID NO: 172788 - RNA, 19 nt, Homo sapiens
cugcauuccuagaaauuga

SEQ ID NO: 172789 - RNA, 19 nt, Homo sapiens
acacaggacuauauuucuc

SEQ ID NO: 172790 - RNA, 19 nt, Homo sapiens
ucauaauucugacuucuac

SEQ ID NO: 172791 - RNA, 19 nt, Homo sapiens
gggaaaaccaugguaauaa

SEQ ID NO: 172792 - RNA, 19 nt, Homo sapiens
gagaagacaauuguugcuu

SEQ ID NO: 172793 - RNA, 19 nt, Homo sapiens
uagcuuuguucauugcauu

SEQ ID NO: 172794 - RNA, 19 nt, Homo sapiens
gcaaagacaggaaguauuu

SEQ ID NO: 172795 - RNA, 19 nt, Homo sapiens
gaacauuucucuggauuug

SEQ ID NO: 172796 - RNA, 19 nt, Homo sapiens
gaaaggacccucaagacaa

SEQ ID NO: 172797 - RNA, 19 nt, Homo sapiens
gaagaacacugcucugcau

SEQ ID NO: 172798 - RNA, 19 nt, Homo sapiens
ugcauaaggucacauauuu

SEQ ID NO: 172799 - RNA, 19 nt, Homo sapiens
cagcaucucugaacauuuc

SEQ ID NO: 172800 - RNA, 19 nt, Homo sapiens
ggucacauauuuacagaau

SEQ ID NO: 172801 - RNA, 19 nt, Homo sapiens
aaaggacccucaagacaaa

SEQ ID NO: 172802 - RNA, 19 nt, Homo sapiens
ggacuauauuucucuguga

SEQ ID NO: 172803 - RNA, 19 nt, Homo sapiens
gcauaaggucacauauuua

SEQ ID NO: 172804 - RNA, 19 nt, Homo sapiens
ggacacaggacuauauuuc

SEQ ID NO: 172805 - RNA, 19 nt, Homo sapiens
ggagaaaggacccucaaga

SEQ ID NO: 172806 - RNA, 19 nt, Homo sapiens
gaacacugcucugcauaag

SEQ ID NO: 172807 - RNA, 19 nt, Homo sapiens
gaacaucaccaucacucaa

SEQ ID NO: 172808 - RNA, 19 nt, Homo sapiens
caacugcucugcuacuucu

SEQ ID NO: 172809 - RNA, 19 nt, Homo sapiens
caccaucacucaagguuug

SEQ ID NO: 172810 - RNA, 19 nt, Homo sapiens
ucacauauuuacagaaugg

SEQ ID NO: 172811 - RNA, 19 nt, Homo sapiens
ggacugaagaucucccaaa

SEQ ID NO: 172812 - RNA, 19 nt, Homo sapiens
cacagugguuucacaauga

SEQ ID NO: 172813 - RNA, 19 nt, Homo sapiens
ugucaaccaucucaucauu

SEQ ID NO: 172814 - RNA, 19 nt, Homo sapiens
ugucacagcuggaagaaca

SEQ ID NO: 172815 - RNA, 19 nt, Homo sapiens
gaguacaggugccagacaa

SEQ ID NO: 172816 - RNA, 19 nt, Homo sapiens
caacgacaguggagaguac

SEQ ID NO: 172817 - RNA, 19 nt, Homo sapiens
acacagugguuucacaaug

SEQ ID NO: 172818 - RNA, 19 nt, Homo sapiens
gcucugcuacuucuaguuu

SEQ ID NO: 172819 - RNA, 19 nt, Homo sapiens
gauagcggcuccuacuucu

SEQ ID NO: 172820 - RNA, 19 nt, Homo sapiens
gagacuggaaggaccauaa

SEQ ID NO: 172821 - RNA, 19 nt, Homo sapiens
gacuauauuucucugugaa

SEQ ID NO: 172822 - RNA, 19 nt, Homo sapiens
acacugcucugcauaaggu

SEQ ID NO: 172823 - RNA, 19 nt, Homo sapiens
ucaaccaucucaucauucu

SEQ ID NO: 172824 - RNA, 19 nt, Homo sapiens
gcagcagcaucucugaaca

SEQ ID NO: 172825 - RNA, 19 nt, Homo sapiens
gacugaagaucucccaaag

SEQ ID NO: 172826 - RNA, 19 nt, Homo sapiens
gaggacaauuccacacagu

SEQ ID NO: 172827 - RNA, 19 nt, Homo sapiens
gguacagcgugcuugagaa

SEQ ID NO: 172828 - RNA, 19 nt, Homo sapiens
gagaaaggacccucaagac

SEQ ID NO: 172829 - RNA, 19 nt, Homo sapiens
gccucgagcuacuucauug

SEQ ID NO: 172830 - RNA, 19 nt, Homo sapiens
ccucccaacugcucugcua

SEQ ID NO: 172831 - RNA, 19 nt, Homo sapiens
acacaggacuauauuucuc

SEQ ID NO: 172832 - RNA, 19 nt, Homo sapiens
aaagccacacucaaagaua

SEQ ID NO: 172833 - RNA, 19 nt, Homo sapiens
cccaaaggcugugguguuc

SEQ ID NO: 172834 - RNA, 19 nt, Homo sapiens
ggcaaagacaggaaguauu

SEQ ID NO: 172835 - RNA, 19 nt, Homo sapiens
caaggaggaagacccuauu

SEQ ID NO: 172836 - RNA, 19 nt, Homo sapiens
gcagcuagaaguccauauc

SEQ ID NO: 172837 - RNA, 19 nt, Homo sapiens
agaaaggacccucaagaca

SEQ ID NO: 172838 - RNA, 19 nt, Homo sapiens
cauaaggucacauauuuac

SEQ ID NO: 172839 - RNA, 19 nt, Homo sapiens
aagccacacucaaagauag

SEQ ID NO: 172840 - RNA, 19 nt, Homo sapiens
cugaacauuucucuggauu

SEQ ID NO: 172841 - RNA, 19 nt, Homo sapiens
gcaguggacacaggacuau

SEQ ID NO: 172842 - RNA, 19 nt, Homo sapiens
acagcgugcuugagaagga

SEQ ID NO: 172843 - RNA, 19 nt, Homo sapiens
caacaagagacuggaagga

SEQ ID NO: 172844 - RNA, 19 nt, Homo sapiens
agaacacugcucugcauaa

SEQ ID NO: 172845 - RNA, 19 nt, Homo sapiens
caagccaggccucgagcua

SEQ ID NO: 172846 - RNA, 19 nt, Homo sapiens
cagcuggcaugcggacuga

SEQ ID NO: 172847 - RNA, 19 nt, Homo sapiens
cuauauuucucugugaaga

SEQ ID NO: 172848 - RNA, 19 nt, Homo sapiens
ucaaagauagcggcuccua

SEQ ID NO: 172849 - RNA, 19 nt, Homo sapiens
gcagcaucucugaacauuu

SEQ ID NO: 172850 - RNA, 19 nt, Homo sapiens
gguaccaagucucuuucug

SEQ ID NO: 172851 - RNA, 19 nt, Homo sapiens
cugcauaaggucacauauu

SEQ ID NO: 172852 - RNA, 19 nt, Homo sapiens
ggaggaagacccuauucac

SEQ ID NO: 172853 - RNA, 19 nt, Homo sapiens
caaaggcugugguguuccu

SEQ ID NO: 172854 - RNA, 19 nt, Homo sapiens
aaagauagcggcuccuacu

SEQ ID NO: 172855 - RNA, 19 nt, Homo sapiens
guacagcgugcuugagaag

SEQ ID NO: 172856 - RNA, 19 nt, Homo sapiens
acauuucucuggauuugca

SEQ ID NO: 172857 - RNA, 19 nt, Homo sapiens
ccaccuggguaccaagucu

SEQ ID NO: 172858 - RNA, 19 nt, Homo sapiens
ucaaggaggaagacccuau

SEQ ID NO: 172859 - RNA, 19 nt, Homo sapiens
ggacccucaagacaaauga

SEQ ID NO: 172860 - RNA, 19 nt, Homo sapiens
agacuggaaggaccauaaa

SEQ ID NO: 172861 - RNA, 19 nt, Homo sapiens
gcucaacaagagacuggaa

SEQ ID NO: 172862 - RNA, 19 nt, Homo sapiens
ucagagacugugaacauca

SEQ ID NO: 172863 - RNA, 19 nt, Homo sapiens
aaggucacauauuuacaga

SEQ ID NO: 172864 - RNA, 19 nt, Homo sapiens
gacacaggacuauauuucu

SEQ ID NO: 172865 - RNA, 19 nt, Homo sapiens
uaaggucacauauuuacag

SEQ ID NO: 172866 - RNA, 19 nt, Homo sapiens
guggacacaggacuauauu

SEQ ID NO: 172867 - RNA, 19 nt, Homo sapiens
caaaagccacacucaaaga

SEQ ID NO: 172868 - RNA, 19 nt, Homo sapiens
ccauaucggcuggcuguug

SEQ ID NO: 172869 - RNA, 19 nt, Homo sapiens
uccuggagccucaauggua

SEQ ID NO: 172870 - RNA, 19 nt, Homo sapiens
aauucugacuuccacauuc

SEQ ID NO: 172871 - RNA, 19 nt, Homo sapiens
uaauucugacuuccacauu

SEQ ID NO: 172872 - RNA, 19 nt, Homo sapiens
cagcugcuccucccaacug

SEQ ID NO: 172873 - RNA, 19 nt, Homo sapiens
ugaacauuucucuggauuu

SEQ ID NO: 172874 - RNA, 19 nt, Homo sapiens
agcagcaucucugaacauu

SEQ ID NO: 172875 - RNA, 19 nt, Homo sapiens
uggcaaagacaggaaguau

SEQ ID NO: 172876 - RNA, 19 nt, Homo sapiens
agauagcggcuccuacuuc

SEQ ID NO: 172877 - RNA, 19 nt, Homo sapiens
gacaggaaguauuuucauc

SEQ ID NO: 172878 - RNA, 19 nt, Homo sapiens
gcgaggaguucaugaauuu

SEQ ID NO: 172879 - RNA, 19 nt, Homo sapiens
gcggaaaccuggaguggaa

SEQ ID NO: 172880 - RNA, 19 nt, Homo sapiens
gagcucaccuuccugcuau

SEQ ID NO: 172881 - RNA, 19 nt, Homo sapiens
cgucaucggugucuugcua

SEQ ID NO: 172882 - RNA, 19 nt, Homo sapiens
gaacugggcccugacaaca

SEQ ID NO: 172883 - RNA, 19 nt, Homo sapiens
ggagcucuguuguggagaa

SEQ ID NO: 172884 - RNA, 19 nt, Homo sapiens
ccaccucgauaauauaaca

SEQ ID NO: 172885 - RNA, 19 nt, Homo sapiens
ggcgaggaguucaugaauu

SEQ ID NO: 172886 - RNA, 19 nt, Homo sapiens
gaaagagaccacagaucug

SEQ ID NO: 172887 - RNA, 19 nt, Homo sapiens
ccaggaugcugauuugaag

SEQ ID NO: 172888 - RNA, 19 nt, Homo sapiens
ggagcucaccuuccugcua

SEQ ID NO: 172889 - RNA, 19 nt, Homo sapiens
gaucaaggagaagcucuuu

SEQ ID NO: 172890 - RNA, 19 nt, Homo sapiens
ggagaaagagaccacagau

SEQ ID NO: 172891 - RNA, 19 nt, Homo sapiens
ggcccaggaugcugauuug

SEQ ID NO: 172892 - RNA, 19 nt, Homo sapiens
gcgaugagcaccacuacug

SEQ ID NO: 172893 - RNA, 19 nt, Homo sapiens
agaaagagaccacagaucu

SEQ ID NO: 172894 - RNA, 19 nt, Homo sapiens
ugugagaccuccuggaaca

SEQ ID NO: 172895 - RNA, 19 nt, Homo sapiens
ugaaggauguaaaugugau

SEQ ID NO: 172896 - RNA, 19 nt, Homo sapiens
gcagcgccuucuccuucua

SEQ ID NO: 172897 - RNA, 19 nt, Homo sapiens
aaagagaccacagaucuga

SEQ ID NO: 172898 - RNA, 19 nt, Homo sapiens
gcugugagaccuccuggaa

SEQ ID NO: 172899 - RNA, 19 nt, Homo sapiens
ggaacacuggcaucucuga

SEQ ID NO: 172900 - RNA, 19 nt, Homo sapiens
gcucuguuguggagaagga

SEQ ID NO: 172901 - RNA, 19 nt, Homo sapiens
gcaccacuacugcugcauu

SEQ ID NO: 172902 - RNA, 19 nt, Homo sapiens
caccacuacugcugcauug

SEQ ID NO: 172903 - RNA, 19 nt, Homo sapiens
gaaaaggucccuacacucu

SEQ ID NO: 172904 - RNA, 19 nt, Homo sapiens
gaaggauguaaaugugauu

SEQ ID NO: 172905 - RNA, 19 nt, Homo sapiens
ccuguggucugccucaguu

SEQ ID NO: 172906 - RNA, 19 nt, Homo sapiens
gagaaagagaccacagauc

SEQ ID NO: 172907 - RNA, 19 nt, Homo sapiens
ggauguaaaugugauucca

SEQ ID NO: 172908 - RNA, 19 nt, Homo sapiens
gggagaaagagaccacaga

SEQ ID NO: 172909 - RNA, 19 nt, Homo sapiens
uuugaaggauguaaaugug

SEQ ID NO: 172910 - RNA, 19 nt, Homo sapiens
gagcuugggucugggaaaa

SEQ ID NO: 172911 - RNA, 19 nt, Homo sapiens
ccacuacugcugcauugug

SEQ ID NO: 172912 - RNA, 19 nt, Homo sapiens
uguaggaggagcucuguug

SEQ ID NO: 172913 - RNA, 19 nt, Homo sapiens
cgucgucacuaacagucaa

SEQ ID NO: 172914 - RNA, 19 nt, Homo sapiens
guccugguauugggagaaa

SEQ ID NO: 172915 - RNA, 19 nt, Homo sapiens
ucaugaauuucgaccucaa

SEQ ID NO: 172916 - RNA, 19 nt, Homo sapiens
cuggaacacuggcaucucu

SEQ ID NO: 172917 - RNA, 19 nt, Homo sapiens
ccgccaaguucgcccugaa

SEQ ID NO: 172918 - RNA, 19 nt, Homo sapiens
agcaguaccugagcuacaa

SEQ ID NO: 172919 - RNA, 19 nt, Homo sapiens
gguggcagcagcaggacaa

SEQ ID NO: 172920 - RNA, 19 nt, Homo sapiens
guaggaggagcucuguugu

SEQ ID NO: 172921 - RNA, 19 nt, Homo sapiens
gcuaaaagcgaauguaguc

SEQ ID NO: 172922 - RNA, 19 nt, Homo sapiens
ggaucaaggagaagcucuu

SEQ ID NO: 172923 - RNA, 19 nt, Homo sapiens
gaagaaaucuggaauacuu

SEQ ID NO: 172924 - RNA, 19 nt, Homo sapiens
gaacaaggcauuauucuuu

SEQ ID NO: 172925 - RNA, 19 nt, Homo sapiens
gaaaggaagcugaaucuua

SEQ ID NO: 172926 - RNA, 19 nt, Homo sapiens
guaauucucucacuuagua

SEQ ID NO: 172927 - RNA, 19 nt, Homo sapiens
caacuaaucuuauguggaa

SEQ ID NO: 172928 - RNA, 19 nt, Homo sapiens
ggagaaauauucccucaaa

SEQ ID NO: 172929 - RNA, 19 nt, Homo sapiens
gggaauaguucauauguuu

SEQ ID NO: 172930 - RNA, 19 nt, Homo sapiens
uaucagagcuuauuacuug

SEQ ID NO: 172931 - RNA, 19 nt, Homo sapiens
ggugagagcuuauuuguau

SEQ ID NO: 172932 - RNA, 19 nt, Homo sapiens
cauuuaagcugguauguua

SEQ ID NO: 172933 - RNA, 19 nt, Homo sapiens
gaagacagcuuggaacuau

SEQ ID NO: 172934 - RNA, 19 nt, Homo sapiens
uaaagaagcucgagcauuc

SEQ ID NO: 172935 - RNA, 19 nt, Homo sapiens
gaauggagcugguuuguca

SEQ ID NO: 172936 - RNA, 19 nt, Homo sapiens
cuaaauagcugacccuaaa

SEQ ID NO: 172937 - RNA, 19 nt, Homo sapiens
gaacucagacuucuacuuu

SEQ ID NO: 172938 - RNA, 19 nt, Homo sapiens
gcaguugucuccuaauauu

SEQ ID NO: 172939 - RNA, 19 nt, Homo sapiens
gguaagaccuggaagauuc

SEQ ID NO: 172940 - RNA, 19 nt, Homo sapiens
ggaaugggcugguagacuu

SEQ ID NO: 172941 - RNA, 19 nt, Homo sapiens
guaccacacucuagguuua

SEQ ID NO: 172942 - RNA, 19 nt, Homo sapiens
agaaugaucugaacaagaa

SEQ ID NO: 172943 - RNA, 19 nt, Homo sapiens
gaacuugucuaggauggua

SEQ ID NO: 172944 - RNA, 19 nt, Homo sapiens
gaaacagacuaauucaaug

SEQ ID NO: 172945 - RNA, 19 nt, Homo sapiens
gaagaaacuuuaugcuugu

SEQ ID NO: 172946 - RNA, 19 nt, Homo sapiens
ucagagacauuaccaguuu

SEQ ID NO: 172947 - RNA, 19 nt, Homo sapiens
ugacacagguucuauauuc

SEQ ID NO: 172948 - RNA, 19 nt, Homo sapiens
cgacugagauacuuucaaa

SEQ ID NO: 172949 - RNA, 19 nt, Homo sapiens
aaaggaagcugaaucuuau

SEQ ID NO: 172950 - RNA, 19 nt, Homo sapiens
ggaaggauauacuaguuga

SEQ ID NO: 172951 - RNA, 19 nt, Homo sapiens
gaacauauuccuuuacuca

SEQ ID NO: 172952 - RNA, 19 nt, Homo sapiens
ugaagaaacugaucacaug

SEQ ID NO: 172953 - RNA, 19 nt, Homo sapiens
uagcaaagauguugaccua

SEQ ID NO: 172954 - RNA, 19 nt, Homo sapiens
gggaaaagaugauguaaaa

SEQ ID NO: 172955 - RNA, 19 nt, Homo sapiens
gccuaaagauugagaguaa

SEQ ID NO: 172956 - RNA, 19 nt, Homo sapiens
aauggaaucuggccuauuu

SEQ ID NO: 172957 - RNA, 19 nt, Homo sapiens
gaagagugcaaaggaauua

SEQ ID NO: 172958 - RNA, 19 nt, Homo sapiens
caagagacuuuacugcauu

SEQ ID NO: 172959 - RNA, 19 nt, Homo sapiens
gcaccaaccugcuaaaugc

SEQ ID NO: 172960 - RNA, 19 nt, Homo sapiens
guaccaguguuucuuauug

SEQ ID NO: 172961 - RNA, 19 nt, Homo sapiens
gcugacaaguucugcauuu

SEQ ID NO: 172962 - RNA, 19 nt, Homo sapiens
guacagauaguuuguggua

SEQ ID NO: 172963 - RNA, 19 nt, Homo sapiens
gggauuaaaugaaguauac

SEQ ID NO: 172964 - RNA, 19 nt, Homo sapiens
gauguaauucucucacuua

SEQ ID NO: 172965 - RNA, 19 nt, Homo sapiens
ggucagaacauauuccuuu

SEQ ID NO: 172966 - RNA, 19 nt, Homo sapiens
ugggacagcugauuucuuu

SEQ ID NO: 172967 - RNA, 19 nt, Homo sapiens
gaagcuaaaugguggacuu

SEQ ID NO: 172968 - RNA, 19 nt, Homo sapiens
ugacaaaucauucaaguga

SEQ ID NO: 172969 - RNA, 19 nt, Homo sapiens
ggacugaguuuguagacau

SEQ ID NO: 172970 - RNA, 19 nt, Homo sapiens
gcaaguuacuguugaugga

SEQ ID NO: 172971 - RNA, 19 nt, Homo sapiens
gaaauuuguucccuuccaa

SEQ ID NO: 172972 - RNA, 19 nt, Homo sapiens
auaagcagcucucacagua

SEQ ID NO: 172973 - RNA, 19 nt, Homo sapiens
ugacugaauuugcuuaaga

SEQ ID NO: 172974 - RNA, 19 nt, Homo sapiens
ucacaacacaguaucuuua

SEQ ID NO: 172975 - RNA, 19 nt, Homo sapiens
gaucauagaguuuguaaag

SEQ ID NO: 172976 - RNA, 19 nt, Homo sapiens
gagcagcacagacuaauga

SEQ ID NO: 172977 - RNA, 19 nt, Homo sapiens
gauaaaugcagguaguuaa

SEQ ID NO: 172978 - RNA, 19 nt, Homo sapiens
gaucagacuuugagugaca

SEQ ID NO: 172979 - RNA, 19 nt, Homo sapiens
gcaaagcuaaggaaggaua

SEQ ID NO: 172980 - RNA, 19 nt, Homo sapiens
gagccaagaucgcggcauu

SEQ ID NO: 172981 - RNA, 19 nt, Homo sapiens
gcacauagauaggcaggau

SEQ ID NO: 172982 - RNA, 19 nt, Homo sapiens
gcagaauuauugggucuuu

SEQ ID NO: 172983 - RNA, 19 nt, Homo sapiens
gaagcugaaucuuauaucu

SEQ ID NO: 172984 - RNA, 19 nt, Homo sapiens
gaaucuggccuauuucuga

SEQ ID NO: 172985 - RNA, 19 nt, Homo sapiens
ggauuucagugccuaaaga

SEQ ID NO: 172986 - RNA, 19 nt, Homo sapiens
gaucaccucuaacaucuca

SEQ ID NO: 172987 - RNA, 19 nt, Homo sapiens
ucaagaaagugccacauuc

SEQ ID NO: 172988 - RNA, 19 nt, Homo sapiens
gagaagaaacuuuaugcuu

SEQ ID NO: 172989 - RNA, 19 nt, Homo sapiens
gagcauucuuucagcagua

SEQ ID NO: 172990 - RNA, 19 nt, Homo sapiens
gacagaauguuugccagua

SEQ ID NO: 172991 - RNA, 19 nt, Homo sapiens
ggacagcugauuucuuuga

SEQ ID NO: 172992 - RNA, 19 nt, Homo sapiens
gaacaauaguagucucaag

SEQ ID NO: 172993 - RNA, 19 nt, Homo sapiens
gacaaauaccuacuucuuu

SEQ ID NO: 172994 - RNA, 19 nt, Homo sapiens
gcaacauuauuccuuauag

SEQ ID NO: 172995 - RNA, 19 nt, Homo sapiens
guaguggucucauucacaa

SEQ ID NO: 172996 - RNA, 19 nt, Homo sapiens
cacauacaaugcuagguua

SEQ ID NO: 172997 - RNA, 19 nt, Homo sapiens
gaagaaguaccacacucua

SEQ ID NO: 172998 - RNA, 19 nt, Homo sapiens
gagaaggcauccagugcuu

SEQ ID NO: 172999 - RNA, 19 nt, Homo sapiens
gaaguacaaagucuuaaga

SEQ ID NO: 173000 - RNA, 19 nt, Homo sapiens
gaaaauguaggcacaauaa

SEQ ID NO: 173001 - RNA, 19 nt, Homo sapiens
gagguuauccaguuauauu

SEQ ID NO: 173002 - RNA, 19 nt, Homo sapiens
aagcaguugucuccuaaua

SEQ ID NO: 173003 - RNA, 19 nt, Homo sapiens
gucagaacauauuccuuua

SEQ ID NO: 173004 - RNA, 19 nt, Homo sapiens
ccagcaacguucccucuuu

SEQ ID NO: 173005 - RNA, 19 nt, Homo sapiens
gauacucucugauaaaugc

SEQ ID NO: 173006 - RNA, 19 nt, Homo sapiens
cagcacagacuaaugagua

SEQ ID NO: 173007 - RNA, 19 nt, Homo sapiens
gagaagccaagaugaauga

SEQ ID NO: 173008 - RNA, 19 nt, Homo sapiens
gaagccaacuaugguaaga

SEQ ID NO: 173009 - RNA, 19 nt, Homo sapiens
gcacugcaguaucaccuau

SEQ ID NO: 173010 - RNA, 19 nt, Homo sapiens
gcucacaccuguaauacca

SEQ ID NO: 173011 - RNA, 19 nt, Homo sapiens
guuaagcaguugucuccua

SEQ ID NO: 173012 - RNA, 19 nt, Homo sapiens
ggaaaggagacuagaguau

SEQ ID NO: 173013 - RNA, 19 nt, Homo sapiens
uagagugcauucccaaauu

SEQ ID NO: 173014 - RNA, 19 nt, Homo sapiens
gggaagaaaucuggaauac

SEQ ID NO: 173015 - RNA, 19 nt, Homo sapiens
ucagcaaacuugucccaaa

SEQ ID NO: 173016 - RNA, 19 nt, Homo sapiens
ccaguuauauugagauagu

SEQ ID NO: 173017 - RNA, 19 nt, Homo sapiens
gaagcgcucuccucccaau

SEQ ID NO: 173018 - RNA, 19 nt, Homo sapiens
gauguugaccuaggaauuu

SEQ ID NO: 173019 - RNA, 19 nt, Homo sapiens
caaagauguugaccuagga

SEQ ID NO: 173020 - RNA, 19 nt, Homo sapiens
agcaguaccuugaugauaa

SEQ ID NO: 173021 - RNA, 19 nt, Homo sapiens
gcagguaguuaagaauaga

SEQ ID NO: 173022 - RNA, 19 nt, Homo sapiens
guccagagaccuuggguua

SEQ ID NO: 173023 - RNA, 19 nt, Homo sapiens
gaugugaguucuucgaauu

SEQ ID NO: 173024 - RNA, 19 nt, Homo sapiens
ccaaagaccaagacaauga

SEQ ID NO: 173025 - RNA, 19 nt, Homo sapiens
gaauugugcugagaaguuc

SEQ ID NO: 173026 - RNA, 19 nt, Homo sapiens
gguuuccucugcccuguua

SEQ ID NO: 173027 - RNA, 19 nt, Homo sapiens
gcagcgagcuccguguaga

SEQ ID NO: 173028 - RNA, 19 nt, Homo sapiens
caugagagcuaugccaaug

SEQ ID NO: 173029 - RNA, 19 nt, Homo sapiens
gcgaagggguacaaauaua

SEQ ID NO: 173030 - RNA, 19 nt, Homo sapiens
ccaagacaaugaugugagu

SEQ ID NO: 173031 - RNA, 19 nt, Homo sapiens
cgaauugugcugagaaguu

SEQ ID NO: 173032 - RNA, 19 nt, Homo sapiens
acaaugaugugaguucuuc

SEQ ID NO: 173033 - RNA, 19 nt, Homo sapiens
gggagaggcaggugucauu

SEQ ID NO: 173034 - RNA, 19 nt, Homo sapiens
ggauggcucuguggacuuc

SEQ ID NO: 173035 - RNA, 19 nt, Homo sapiens
caccaaagaccaagacaau

SEQ ID NO: 173036 - RNA, 19 nt, Homo sapiens
guguagaccugguggacuu

SEQ ID NO: 173037 - RNA, 19 nt, Homo sapiens
caacuucuucuccaccaaa

SEQ ID NO: 173038 - RNA, 19 nt, Homo sapiens
uaacgggccacaacaacaa

SEQ ID NO: 173039 - RNA, 19 nt, Homo sapiens
ucaauggucucuaccucau

SEQ ID NO: 173040 - RNA, 19 nt, Homo sapiens
ccacaacaacaacuucuuc

SEQ ID NO: 173041 - RNA, 19 nt, Homo sapiens
caacugcaaggaccugcua

SEQ ID NO: 173042 - RNA, 19 nt, Homo sapiens
agaggcaggugucauugga

SEQ ID NO: 173043 - RNA, 19 nt, Homo sapiens
aaaccucaauggucucuac

SEQ ID NO: 173044 - RNA, 19 nt, Homo sapiens
cugacaagcucaccauucu

SEQ ID NO: 173045 - RNA, 19 nt, Homo sapiens
ugagagcuaugccaauggu

SEQ ID NO: 173046 - RNA, 19 nt, Homo sapiens
ugagggcaaccaccaguuu

SEQ ID NO: 173047 - RNA, 19 nt, Homo sapiens
caaagaccaagacaaugau

SEQ ID NO: 173048 - RNA, 19 nt, Homo sapiens
ggagaggcaggugucauug

SEQ ID NO: 173049 - RNA, 19 nt, Homo sapiens
ccagagggagaauuauguu

SEQ ID NO: 173050 - RNA, 19 nt, Homo sapiens
gcagugcggguaauucucu

SEQ ID NO: 173051 - RNA, 19 nt, Homo sapiens
gcaggugucauuggagaga

SEQ ID NO: 173052 - RNA, 19 nt, Homo sapiens
gaccaagacaaugauguga

SEQ ID NO: 173053 - RNA, 19 nt, Homo sapiens
gcuaaguacaaaucauuca

SEQ ID NO: 173054 - RNA, 19 nt, Homo sapiens
gagggcaaccaccaguuug

SEQ ID NO: 173055 - RNA, 19 nt, Homo sapiens
cuagucuuguuccugcaua

SEQ ID NO: 173056 - RNA, 19 nt, Homo sapiens
gccagacacacucccauga

SEQ ID NO: 173057 - RNA, 19 nt, Homo sapiens
caacauccacgcccugacu

SEQ ID NO: 173058 - RNA, 19 nt, Homo sapiens
cagagggagaauuauguuu

SEQ ID NO: 173059 - RNA, 19 nt, Homo sapiens
cgacugucaugcuucaaac

SEQ ID NO: 173060 - RNA, 19 nt, Homo sapiens
ugaugugaguucuucgaau

SEQ ID NO: 173061 - RNA, 19 nt, Homo sapiens
ccaccaguuugcuaaguac

SEQ ID NO: 173062 - RNA, 19 nt, Homo sapiens
acacauguccagaggugaa

SEQ ID NO: 173063 - RNA, 19 nt, Homo sapiens
gagcuaugccaaugguauc

SEQ ID NO: 173064 - RNA, 19 nt, Homo sapiens
ggugguacgccgacuguca

SEQ ID NO: 173065 - RNA, 19 nt, Homo sapiens
ugacugugcucugugacau

SEQ ID NO: 173066 - RNA, 19 nt, Homo sapiens
agagggagaauuauguuuc

SEQ ID NO: 173067 - RNA, 19 nt, Homo sapiens
caccagagggagaauuaug

SEQ ID NO: 173068 - RNA, 19 nt, Homo sapiens
ccacaugcaccugcuagug

SEQ ID NO: 173069 - RNA, 19 nt, Homo sapiens
accaccaguuugcuaagua

SEQ ID NO: 173070 - RNA, 19 nt, Homo sapiens
ggggaugcguggagagaaa

SEQ ID NO: 173071 - RNA, 19 nt, Homo sapiens
gggcagugcggguaauucu

SEQ ID NO: 173072 - RNA, 19 nt, Homo sapiens
uagaccugguggacuuuga

SEQ ID NO: 173073 - RNA, 19 nt, Homo sapiens
ccaccaaagaccaagacaa

SEQ ID NO: 173074 - RNA, 19 nt, Homo sapiens
gacaaugaugugaguucuu

SEQ ID NO: 173075 - RNA, 19 nt, Homo sapiens
agacaaugaugugaguucu

SEQ ID NO: 173076 - RNA, 19 nt, Homo sapiens
cugacgaggcagagaagua

SEQ ID NO: 173077 - RNA, 19 nt, Homo sapiens
aagcagcgagcuccgugua

SEQ ID NO: 173078 - RNA, 19 nt, Homo sapiens
gcggcuggcacaccaucua

SEQ ID NO: 173079 - RNA, 19 nt, Homo sapiens
cggcgaagggguacaaaua

SEQ ID NO: 173080 - RNA, 19 nt, Homo sapiens
gcugguacugggagccuuu

SEQ ID NO: 173081 - RNA, 19 nt, Homo sapiens
gggaaaggauacaauuaua

SEQ ID NO: 173082 - RNA, 19 nt, Homo sapiens
ccaaagaccaggacaauga

SEQ ID NO: 173083 - RNA, 19 nt, Homo sapiens
caaauggcaucaacuggaa

SEQ ID NO: 173084 - RNA, 19 nt, Homo sapiens
gaaauugugcugugauguu

SEQ ID NO: 173085 - RNA, 19 nt, Homo sapiens
agaaacacaugucgugauu

SEQ ID NO: 173086 - RNA, 19 nt, Homo sapiens
gagcuuggcccuacgguuu

SEQ ID NO: 173087 - RNA, 19 nt, Homo sapiens
caggacgccuccacacaua

SEQ ID NO: 173088 - RNA, 19 nt, Homo sapiens
gaucuuaacaccggaaauu

SEQ ID NO: 173089 - RNA, 19 nt, Homo sapiens
ggaaaggauacaauuauag

SEQ ID NO: 173090 - RNA, 19 nt, Homo sapiens
aaacacaugucgugauucu

SEQ ID NO: 173091 - RNA, 19 nt, Homo sapiens
gcuacaaggugucagagau

SEQ ID NO: 173092 - RNA, 19 nt, Homo sapiens
ccacccugcugcucucuuu

SEQ ID NO: 173093 - RNA, 19 nt, Homo sapiens
cauggcagcuuugcaaaug

SEQ ID NO: 173094 - RNA, 19 nt, Homo sapiens
aaauugugcugugauguuu

SEQ ID NO: 173095 - RNA, 19 nt, Homo sapiens
gagauucccugacguucca

SEQ ID NO: 173096 - RNA, 19 nt, Homo sapiens
gaaaggauacaauuauagc

SEQ ID NO: 173097 - RNA, 19 nt, Homo sapiens
gaccaggacaaugaucuua

SEQ ID NO: 173098 - RNA, 19 nt, Homo sapiens
ggauggcucuguggacuuc

SEQ ID NO: 173099 - RNA, 19 nt, Homo sapiens
guguagaccugguggacuu

SEQ ID NO: 173100 - RNA, 19 nt, Homo sapiens
guccagaggugaagauggu

SEQ ID NO: 173101 - RNA, 19 nt, Homo sapiens
ccagcgagcuccguguaga

SEQ ID NO: 173102 - RNA, 19 nt, Homo sapiens
acuaccaguuugcuaagua

SEQ ID NO: 173103 - RNA, 19 nt, Homo sapiens
ggauacaauuauagcuaca

SEQ ID NO: 173104 - RNA, 19 nt, Homo sapiens
ccgacgaggcggagaagua

SEQ ID NO: 173105 - RNA, 19 nt, Homo sapiens
gcuaaguacagaucauuca

SEQ ID NO: 173106 - RNA, 19 nt, Homo sapiens
ccaguuugcuaaguacaga

SEQ ID NO: 173107 - RNA, 19 nt, Homo sapiens
ggagaggcaggcaccaaug

SEQ ID NO: 173108 - RNA, 19 nt, Homo sapiens
uacaaggugucagagauga

SEQ ID NO: 173109 - RNA, 19 nt, Homo sapiens
cggaaauugugcugugaug

SEQ ID NO: 173110 - RNA, 19 nt, Homo sapiens
cugacaagcucaccauucu

SEQ ID NO: 173111 - RNA, 19 nt, Homo sapiens
ccaggacaaugaucuuaac

SEQ ID NO: 173112 - RNA, 19 nt, Homo sapiens
ggaagucggggaaaggaua

SEQ ID NO: 173113 - RNA, 19 nt, Homo sapiens
ggacuuugaggacaacuac

SEQ ID NO: 173114 - RNA, 19 nt, Homo sapiens
gaggcaggcaccaauggaa

SEQ ID NO: 173115 - RNA, 19 nt, Homo sapiens
caaagaccaggacaaugau

SEQ ID NO: 173116 - RNA, 19 nt, Homo sapiens
ggacugggccacguacaag

SEQ ID NO: 173117 - RNA, 19 nt, Homo sapiens
ggagcuuggugguacaaaa

SEQ ID NO: 173118 - RNA, 19 nt, Homo sapiens
gggagaggcaggcaccaau

SEQ ID NO: 173119 - RNA, 19 nt, Homo sapiens
ggacgccuccacacauagu

SEQ ID NO: 173120 - RNA, 19 nt, Homo sapiens
cuacaaggugucagagaug

SEQ ID NO: 173121 - RNA, 19 nt, Homo sapiens
ggaaauugugcugugaugu

SEQ ID NO: 173122 - RNA, 19 nt, Homo sapiens
caccaaagaccaggacaau

SEQ ID NO: 173123 - RNA, 19 nt, Homo sapiens
gcaggcaccaauggaaaga

SEQ ID NO: 173124 - RNA, 19 nt, Homo sapiens
ugacugugcucugugacau

SEQ ID NO: 173125 - RNA, 19 nt, Homo sapiens
acaauuauagcuacaaggu

SEQ ID NO: 173126 - RNA, 19 nt, Homo sapiens
aggcaccaauggaaagaga

SEQ ID NO: 173127 - RNA, 19 nt, Homo sapiens
gggacugggccacguacaa

SEQ ID NO: 173128 - RNA, 19 nt, Homo sapiens
aaacugccaugugucaaac

SEQ ID NO: 173129 - RNA, 19 nt, Homo sapiens
caauggaaagagaggagaa

SEQ ID NO: 173130 - RNA, 19 nt, Homo sapiens
uagaccugguggacuuuga

SEQ ID NO: 173131 - RNA, 19 nt, Homo sapiens
gaaacacaugucgugauuc

SEQ ID NO: 173132 - RNA, 19 nt, Homo sapiens
ggggaaaggauacaauuau

SEQ ID NO: 173133 - RNA, 19 nt, Homo sapiens
gagaggcaggcaccaaugg

SEQ ID NO: 173134 - RNA, 19 nt, Homo sapiens
gcggcuggcacaccaucua

SEQ ID NO: 173135 - RNA, 19 nt, Homo sapiens
ucccugacguuccacaaca

SEQ ID NO: 173136 - RNA, 19 nt, Homo sapiens
uaaguacagaucauucaag

SEQ ID NO: 173137 - RNA, 19 nt, Homo sapiens
cuaaguacagaucauucaa

SEQ ID NO: 173138 - RNA, 19 nt, Homo sapiens
gggaaaggauacaauuaua

SEQ ID NO: 173139 - RNA, 19 nt, Homo sapiens
ccaaagaccaggacaauga

SEQ ID NO: 173140 - RNA, 19 nt, Homo sapiens
caaauggcaucaacuggaa

SEQ ID NO: 173141 - RNA, 19 nt, Homo sapiens
gaaauugugcugugauguu

SEQ ID NO: 173142 - RNA, 19 nt, Homo sapiens
agaaacacaugucgugauu

SEQ ID NO: 173143 - RNA, 19 nt, Homo sapiens
gagcuuggcccuacgguuu

SEQ ID NO: 173144 - RNA, 19 nt, Homo sapiens
caggacgccuccacacaua

SEQ ID NO: 173145 - RNA, 19 nt, Homo sapiens
gaucuuaacaccggaaauu

SEQ ID NO: 173146 - RNA, 19 nt, Homo sapiens
ggaaaggauacaauuauag

SEQ ID NO: 173147 - RNA, 19 nt, Homo sapiens
aaacacaugucgugauucu

SEQ ID NO: 173148 - RNA, 19 nt, Homo sapiens
gcuacaaggugucagagau

SEQ ID NO: 173149 - RNA, 19 nt, Homo sapiens
ccacccugcugcucucuuu

SEQ ID NO: 173150 - RNA, 19 nt, Homo sapiens
cauggcagcuuugcaaaug

SEQ ID NO: 173151 - RNA, 19 nt, Homo sapiens
aaauugugcugugauguuu

SEQ ID NO: 173152 - RNA, 19 nt, Homo sapiens
gagauucccugacguucca

SEQ ID NO: 173153 - RNA, 19 nt, Homo sapiens
gaaaggauacaauuauagc

SEQ ID NO: 173154 - RNA, 19 nt, Homo sapiens
gaccaggacaaugaucuua

SEQ ID NO: 173155 - RNA, 19 nt, Homo sapiens
ggauggcucuguggacuuc

SEQ ID NO: 173156 - RNA, 19 nt, Homo sapiens
guguagaccugguggacuu

SEQ ID NO: 173157 - RNA, 19 nt, Homo sapiens
ccagcgagcuccguguaga

SEQ ID NO: 173158 - RNA, 19 nt, Homo sapiens
acuaccaguuugcuaagua

SEQ ID NO: 173159 - RNA, 19 nt, Homo sapiens
ggauacaauuauagcuaca

SEQ ID NO: 173160 - RNA, 19 nt, Homo sapiens
ccgacgaggcggagaagua

SEQ ID NO: 173161 - RNA, 19 nt, Homo sapiens
gcuaaguacagaucauuca

SEQ ID NO: 173162 - RNA, 19 nt, Homo sapiens
ccaguuugcuaaguacaga

SEQ ID NO: 173163 - RNA, 19 nt, Homo sapiens
uacaaggugucagagauga

SEQ ID NO: 173164 - RNA, 19 nt, Homo sapiens
cggaaauugugcugugaug

SEQ ID NO: 173165 - RNA, 19 nt, Homo sapiens
ccaggacaaugaucuuaac

SEQ ID NO: 173166 - RNA, 19 nt, Homo sapiens
ggaagucggggaaaggaua

SEQ ID NO: 173167 - RNA, 19 nt, Homo sapiens
ggacuuugaggacaacuac

SEQ ID NO: 173168 - RNA, 19 nt, Homo sapiens
caaagaccaggacaaugau

SEQ ID NO: 173169 - RNA, 19 nt, Homo sapiens
ggacugggccacguacaag

SEQ ID NO: 173170 - RNA, 19 nt, Homo sapiens
ggagcuuggugguacaaaa

SEQ ID NO: 173171 - RNA, 19 nt, Homo sapiens
ggacgccuccacacauagu

SEQ ID NO: 173172 - RNA, 19 nt, Homo sapiens
cuacaaggugucagagaug

SEQ ID NO: 173173 - RNA, 19 nt, Homo sapiens
ugacugugcucugugacau

SEQ ID NO: 173174 - RNA, 19 nt, Homo sapiens
ggaaauugugcugugaugu

SEQ ID NO: 173175 - RNA, 19 nt, Homo sapiens
caccaaagaccaggacaau

SEQ ID NO: 173176 - RNA, 19 nt, Homo sapiens
acaauuauagcuacaaggu

SEQ ID NO: 173177 - RNA, 19 nt, Homo sapiens
gggacugggccacguacaa

SEQ ID NO: 173178 - RNA, 19 nt, Homo sapiens
aaacugccaugugucaaac

SEQ ID NO: 173179 - RNA, 19 nt, Homo sapiens
uagaccugguggacuuuga

SEQ ID NO: 173180 - RNA, 19 nt, Homo sapiens
gaaacacaugucgugauuc

SEQ ID NO: 173181 - RNA, 19 nt, Homo sapiens
ggggaaaggauacaauuau

SEQ ID NO: 173182 - RNA, 19 nt, Homo sapiens
gcggcuggcacaccaucua

SEQ ID NO: 173183 - RNA, 19 nt, Homo sapiens
ucccugacguuccacaaca

SEQ ID NO: 173184 - RNA, 19 nt, Homo sapiens
uaaguacagaucauucaag

SEQ ID NO: 173185 - RNA, 19 nt, Homo sapiens
cuaaguacagaucauucaa

SEQ ID NO: 173186 - RNA, 19 nt, Homo sapiens
gggaaaggauacaauuaua

SEQ ID NO: 173187 - RNA, 19 nt, Homo sapiens
ccaaagaccaggacaauga

SEQ ID NO: 173188 - RNA, 19 nt, Homo sapiens
caaauggcaucaacuggaa

SEQ ID NO: 173189 - RNA, 19 nt, Homo sapiens
gaaauugugcugugauguu

SEQ ID NO: 173190 - RNA, 19 nt, Homo sapiens
ggagaugaccgguggguaa

SEQ ID NO: 173191 - RNA, 19 nt, Homo sapiens
agaaacacaugucgugauu

SEQ ID NO: 173192 - RNA, 19 nt, Homo sapiens
gagcuuggcccuacgguuu

SEQ ID NO: 173193 - RNA, 19 nt, Homo sapiens
gagaacacacucuggaauu

SEQ ID NO: 173194 - RNA, 19 nt, Homo sapiens
caggacgccuccacacaua

SEQ ID NO: 173195 - RNA, 19 nt, Homo sapiens
gaucuuaacaccggaaauu

SEQ ID NO: 173196 - RNA, 19 nt, Homo sapiens
ggaaaggauacaauuauag

SEQ ID NO: 173197 - RNA, 19 nt, Homo sapiens
aaacacaugucgugauucu

SEQ ID NO: 173198 - RNA, 19 nt, Homo sapiens
gcuacaaggugucagagau

SEQ ID NO: 173199 - RNA, 19 nt, Homo sapiens
ccacccugcugcucucuuu

SEQ ID NO: 173200 - RNA, 19 nt, Homo sapiens
cauggcagcuuugcaaaug

SEQ ID NO: 173201 - RNA, 19 nt, Homo sapiens
aaauugugcugugauguuu

SEQ ID NO: 173202 - RNA, 19 nt, Homo sapiens
gagauucccugacguucca

SEQ ID NO: 173203 - RNA, 19 nt, Homo sapiens
gaaaggauacaauuauagc

SEQ ID NO: 173204 - RNA, 19 nt, Homo sapiens
gaccaggacaaugaucuua

SEQ ID NO: 173205 - RNA, 19 nt, Homo sapiens
ggauggcucuguggacuuc

SEQ ID NO: 173206 - RNA, 19 nt, Homo sapiens
ggagaacacacucuggaau

SEQ ID NO: 173207 - RNA, 19 nt, Homo sapiens
guguagaccugguggacuu

SEQ ID NO: 173208 - RNA, 19 nt, Homo sapiens
gaucucugccaacuacaaa

SEQ ID NO: 173209 - RNA, 19 nt, Homo sapiens
guccagaggugaagauggu

SEQ ID NO: 173210 - RNA, 19 nt, Homo sapiens
ccagcgagcuccguguaga

SEQ ID NO: 173211 - RNA, 19 nt, Homo sapiens
agaacacacucuggaauuc

SEQ ID NO: 173212 - RNA, 19 nt, Homo sapiens
acuaccaguuugcuaagua

SEQ ID NO: 173213 - RNA, 19 nt, Homo sapiens
gagaugaccgguggguaaa

SEQ ID NO: 173214 - RNA, 19 nt, Homo sapiens
ggauacaauuauagcuaca

SEQ ID NO: 173215 - RNA, 19 nt, Homo sapiens
ccgacgaggcggagaagua

SEQ ID NO: 173216 - RNA, 19 nt, Homo sapiens
gcuaaguacagaucauuca

SEQ ID NO: 173217 - RNA, 19 nt, Homo sapiens
ccaguuugcuaaguacaga

SEQ ID NO: 173218 - RNA, 19 nt, Homo sapiens
gaacacacucuggaauucu

SEQ ID NO: 173219 - RNA, 19 nt, Homo sapiens
ggagaggcaggcaccaaug

SEQ ID NO: 173220 - RNA, 19 nt, Homo sapiens
uacaaggugucagagauga

SEQ ID NO: 173221 - RNA, 19 nt, Homo sapiens
cggaaauugugcugugaug

SEQ ID NO: 173222 - RNA, 19 nt, Homo sapiens
cugacaagcucaccauucu

SEQ ID NO: 173223 - RNA, 19 nt, Homo sapiens
ccaggacaaugaucuuaac

SEQ ID NO: 173224 - RNA, 19 nt, Homo sapiens
ugugaucucugccaacuac

SEQ ID NO: 173225 - RNA, 19 nt, Homo sapiens
gggagaacacacucuggaa

SEQ ID NO: 173226 - RNA, 19 nt, Homo sapiens
ggaagucggggaaaggaua

SEQ ID NO: 173227 - RNA, 19 nt, Homo sapiens
ggacuuugaggacaacuac

SEQ ID NO: 173228 - RNA, 19 nt, Homo sapiens
gaggcaggcaccaauggaa

SEQ ID NO: 173229 - RNA, 19 nt, Homo sapiens
caaagaccaggacaaugau

SEQ ID NO: 173230 - RNA, 19 nt, Homo sapiens
ggacugggccacguacaag

SEQ ID NO: 173231 - RNA, 19 nt, Homo sapiens
ggagcuuggugguacaaaa

SEQ ID NO: 173232 - RNA, 19 nt, Homo sapiens
ggacgccuccacacauagu

SEQ ID NO: 173233 - RNA, 19 nt, Homo sapiens
ugacugugcucugugacau

SEQ ID NO: 173234 - RNA, 19 nt, Homo sapiens
cuacaaggugucagagaug

SEQ ID NO: 173235 - RNA, 19 nt, Homo sapiens
ggaaauugugcugugaugu

SEQ ID NO: 173236 - RNA, 19 nt, Homo sapiens
caccaaagaccaggacaau

SEQ ID NO: 173237 - RNA, 19 nt, Homo sapiens
gcaggcaccaauggaaaga

SEQ ID NO: 173238 - RNA, 19 nt, Homo sapiens
gggagaggcaggcaccaau

SEQ ID NO: 173239 - RNA, 19 nt, Homo sapiens
acaauuauagcuacaaggu

SEQ ID NO: 173240 - RNA, 19 nt, Homo sapiens
aggcaccaauggaaagaga

SEQ ID NO: 173241 - RNA, 19 nt, Homo sapiens
gggacugggccacguacaa

SEQ ID NO: 173242 - RNA, 19 nt, Homo sapiens
aaacugccaugugucaaac

SEQ ID NO: 173243 - RNA, 19 nt, Homo sapiens
caauggaaagagaggagaa

SEQ ID NO: 173244 - RNA, 19 nt, Homo sapiens
uagaccugguggacuuuga

SEQ ID NO: 173245 - RNA, 19 nt, Homo sapiens
gaaacacaugucgugauuc

SEQ ID NO: 173246 - RNA, 19 nt, Homo sapiens
ggggaaaggauacaauuau

SEQ ID NO: 173247 - RNA, 19 nt, Homo sapiens
gagaggcaggcaccaaugg

SEQ ID NO: 173248 - RNA, 19 nt, Homo sapiens
gcggcuggcacaccaucua

SEQ ID NO: 173249 - RNA, 19 nt, Homo sapiens
ucccugacguuccacaaca

SEQ ID NO: 173250 - RNA, 19 nt, Homo sapiens
uaaguacagaucauucaag

SEQ ID NO: 173251 - RNA, 19 nt, Homo sapiens
cuaaguacagaucauucaa

SEQ ID NO: 173252 - RNA, 19 nt, Homo sapiens
ucaaggaagugacaaauau

SEQ ID NO: 173253 - RNA, 19 nt, Homo sapiens
ugacaaauaugaacagaag

SEQ ID NO: 173254 - RNA, 19 nt, Homo sapiens
ggagaugaccgguggguaa

SEQ ID NO: 173255 - RNA, 19 nt, Homo sapiens
gagaacacacucuggaauu

SEQ ID NO: 173256 - RNA, 19 nt, Homo sapiens
cagaaugaagugacaaaua

SEQ ID NO: 173257 - RNA, 19 nt, Homo sapiens
caacuuacauacacuccau

SEQ ID NO: 173258 - RNA, 19 nt, Homo sapiens
ccacccugcugcucucuuu

SEQ ID NO: 173259 - RNA, 19 nt, Homo sapiens
ccagacaacuuacauacac

SEQ ID NO: 173260 - RNA, 19 nt, Homo sapiens
ggauggcucuguggacuuc

SEQ ID NO: 173261 - RNA, 19 nt, Homo sapiens
ggagaacacacucuggaau

SEQ ID NO: 173262 - RNA, 19 nt, Homo sapiens
gaagugacaaauaugaaca

SEQ ID NO: 173263 - RNA, 19 nt, Homo sapiens
guguagaccugguggacuu

SEQ ID NO: 173264 - RNA, 19 nt, Homo sapiens
gagucccgcucuguucaua

SEQ ID NO: 173265 - RNA, 19 nt, Homo sapiens
caaggaagugacaaauauu

SEQ ID NO: 173266 - RNA, 19 nt, Homo sapiens
gaaugaagugacaaauaug

SEQ ID NO: 173267 - RNA, 19 nt, Homo sapiens
gaucucugccaacuacaaa

SEQ ID NO: 173268 - RNA, 19 nt, Homo sapiens
aaugguugcuugcccguuu

SEQ ID NO: 173269 - RNA, 19 nt, Homo sapiens
ccagcgagcuccguguaga

SEQ ID NO: 173270 - RNA, 19 nt, Homo sapiens
agaacacacucuggaauuc

SEQ ID NO: 173271 - RNA, 19 nt, Homo sapiens
guccagaggugaagauggu

SEQ ID NO: 173272 - RNA, 19 nt, Homo sapiens
acuaccaguuugcuaagua

SEQ ID NO: 173273 - RNA, 19 nt, Homo sapiens
gagaugaccgguggguaaa

SEQ ID NO: 173274 - RNA, 19 nt, Homo sapiens
ccgacgaggcggagaagua

SEQ ID NO: 173275 - RNA, 19 nt, Homo sapiens
gcuaaguacagaucauuca

SEQ ID NO: 173276 - RNA, 19 nt, Homo sapiens
ccaguuugcuaaguacaga

SEQ ID NO: 173277 - RNA, 19 nt, Homo sapiens
ggagaggcaggcaccaaug

SEQ ID NO: 173278 - RNA, 19 nt, Homo sapiens
gaacacacucuggaauucu

SEQ ID NO: 173279 - RNA, 19 nt, Homo sapiens
cugacaagcucaccauucu

SEQ ID NO: 173280 - RNA, 19 nt, Homo sapiens
ugugaucucugccaacuac

SEQ ID NO: 173281 - RNA, 19 nt, Homo sapiens
gggagaacacacucuggaa

SEQ ID NO: 173282 - RNA, 19 nt, Homo sapiens
ggacuuugaggacaacuac

SEQ ID NO: 173283 - RNA, 19 nt, Homo sapiens
gaggcaggcaccaauggaa

SEQ ID NO: 173284 - RNA, 19 nt, Homo sapiens
ggacugggccacguacaag

SEQ ID NO: 173285 - RNA, 19 nt, Homo sapiens
uuuauaaucuacgccagaa

SEQ ID NO: 173286 - RNA, 19 nt, Homo sapiens
aaggaagugacaaauauug

SEQ ID NO: 173287 - RNA, 19 nt, Homo sapiens
gcaggcaccaauggaaaga

SEQ ID NO: 173288 - RNA, 19 nt, Homo sapiens
gggagaggcaggcaccaau

SEQ ID NO: 173289 - RNA, 19 nt, Homo sapiens
ugacugugcucugugacau

SEQ ID NO: 173290 - RNA, 19 nt, Homo sapiens
gccagaaugaagugacaaa

SEQ ID NO: 173291 - RNA, 19 nt, Homo sapiens
gaaguccagggucauacga

SEQ ID NO: 173292 - RNA, 19 nt, Homo sapiens
gggacugggccacguacaa

SEQ ID NO: 173293 - RNA, 19 nt, Homo sapiens
aggcaccaauggaaagaga

SEQ ID NO: 173294 - RNA, 19 nt, Homo sapiens
ccuauggcccugcuucuuc

SEQ ID NO: 173295 - RNA, 19 nt, Homo sapiens
ccuaauuauucaaggaagu

SEQ ID NO: 173296 - RNA, 19 nt, Homo sapiens
uagaccugguggacuuuga

SEQ ID NO: 173297 - RNA, 19 nt, Homo sapiens
caauggaaagagaggagaa

SEQ ID NO: 173298 - RNA, 19 nt, Homo sapiens
uucaaggaagugacaaaua

SEQ ID NO: 173299 - RNA, 19 nt, Homo sapiens
gagaggcaggcaccaaugg

SEQ ID NO: 173300 - RNA, 19 nt, Homo sapiens
gcggcuggcacaccaucua

SEQ ID NO: 173301 - RNA, 19 nt, Homo sapiens
gucccgcucuguucauaca

SEQ ID NO: 173302 - RNA, 19 nt, Homo sapiens
uaaguacagaucauucaag

SEQ ID NO: 173303 - RNA, 19 nt, Homo sapiens
cuaaguacagaucauucaa

SEQ ID NO: 173304 - RNA, 19 nt, Homo sapiens
ggucauacgacgccauugc

SEQ ID NO: 173305 - RNA, 19 nt, Homo sapiens
uggcugcccuuggcuggaa

SEQ ID NO: 173306 - RNA, 19 nt, Homo sapiens
gaacacugaucccaaauuu

SEQ ID NO: 173307 - RNA, 19 nt, Homo sapiens
gagaagaaccuaaacauaa

SEQ ID NO: 173308 - RNA, 19 nt, Homo sapiens
gcagguauguuaagaaguu

SEQ ID NO: 173309 - RNA, 19 nt, Homo sapiens
ggagaacacugaucccaaa

SEQ ID NO: 173310 - RNA, 19 nt, Homo sapiens
gauccuggcuagaaugaua

SEQ ID NO: 173311 - RNA, 19 nt, Homo sapiens
gaaaucuggcugagaaaua

SEQ ID NO: 173312 - RNA, 19 nt, Homo sapiens
ggaagagauuuaucauaga

SEQ ID NO: 173313 - RNA, 19 nt, Homo sapiens
ucaaagccaucauauauca

SEQ ID NO: 173314 - RNA, 19 nt, Homo sapiens
ggauggaguucgugaaaug

SEQ ID NO: 173315 - RNA, 19 nt, Homo sapiens
uagcugaaguccaccauaa

SEQ ID NO: 173316 - RNA, 19 nt, Homo sapiens
uuagaaaucuggcugagaa

SEQ ID NO: 173317 - RNA, 19 nt, Homo sapiens
gauguuguguucucuuuau

SEQ ID NO: 173318 - RNA, 19 nt, Homo sapiens
uggaagagauuuaucauag

SEQ ID NO: 173319 - RNA, 19 nt, Homo sapiens
ggacaaguacugccacuau

SEQ ID NO: 173320 - RNA, 19 nt, Homo sapiens
gaaaugcaggugagaagaa

SEQ ID NO: 173321 - RNA, 19 nt, Homo sapiens
gagcagguauguuaagaag

SEQ ID NO: 173322 - RNA, 19 nt, Homo sapiens
ggaaggugaugcccaagau

SEQ ID NO: 173323 - RNA, 19 nt, Homo sapiens
gaacaggagugggacaagu

SEQ ID NO: 173324 - RNA, 19 nt, Homo sapiens
gcauugggauggcagaguu

SEQ ID NO: 173325 - RNA, 19 nt, Homo sapiens
ugucaaagccaucauauau

SEQ ID NO: 173326 - RNA, 19 nt, Homo sapiens
ugagaagaaccuaaacaua

SEQ ID NO: 173327 - RNA, 19 nt, Homo sapiens
gaaauaccaaacagugauu

SEQ ID NO: 173328 - RNA, 19 nt, Homo sapiens
ccacuuuggcugccuguua

SEQ ID NO: 173329 - RNA, 19 nt, Homo sapiens
guguuuaacuucugugcua

SEQ ID NO: 173330 - RNA, 19 nt, Homo sapiens
gaucccaaauuuguccaua

SEQ ID NO: 173331 - RNA, 19 nt, Homo sapiens
gugccugaaugaacuuaua

SEQ ID NO: 173332 - RNA, 19 nt, Homo sapiens
ccaacgaucucccuugagu

SEQ ID NO: 173333 - RNA, 19 nt, Homo sapiens
guuuggagcagguauguua

SEQ ID NO: 173334 - RNA, 19 nt, Homo sapiens
gagaaauaccaaacaguga

SEQ ID NO: 173335 - RNA, 19 nt, Homo sapiens
uuacacaacuuucacucuu

SEQ ID NO: 173336 - RNA, 19 nt, Homo sapiens
gacaaguacugccacuaug

SEQ ID NO: 173337 - RNA, 19 nt, Homo sapiens
gcaaggaggaagagaguuc

SEQ ID NO: 173338 - RNA, 19 nt, Homo sapiens
agacccaucuucuagcaaa

SEQ ID NO: 173339 - RNA, 19 nt, Homo sapiens
acacugaucccaaauuugu

SEQ ID NO: 173340 - RNA, 19 nt, Homo sapiens
ccagguaacagaagacuau

SEQ ID NO: 173341 - RNA, 19 nt, Homo sapiens
gcagaaucuucccaacugu

SEQ ID NO: 173342 - RNA, 19 nt, Homo sapiens
caauaugccagcugucaaa

SEQ ID NO: 173343 - RNA, 19 nt, Homo sapiens
ccagcaaccuguccuugug

SEQ ID NO: 173344 - RNA, 19 nt, Homo sapiens
ggcaguaccugaccacucu

SEQ ID NO: 173345 - RNA, 19 nt, Homo sapiens
gaacgugccaacucuaugg

SEQ ID NO: 173346 - RNA, 19 nt, Homo sapiens
aaggauggauguuguguuc

SEQ ID NO: 173347 - RNA, 19 nt, Homo sapiens
ccaucuaccugucguuugu

SEQ ID NO: 173348 - RNA, 19 nt, Homo sapiens
gucaugagauccuacuuag

SEQ ID NO: 173349 - RNA, 19 nt, Homo sapiens
cuacuacuuuaaucccuaa

SEQ ID NO: 173350 - RNA, 19 nt, Homo sapiens
uugcuaagccggagaauau

SEQ ID NO: 173351 - RNA, 19 nt, Homo sapiens
auaagcaugugaccucuga

SEQ ID NO: 173352 - RNA, 19 nt, Homo sapiens
ggauggauguuguguucuc

SEQ ID NO: 173353 - RNA, 19 nt, Homo sapiens
uuggcugccuguuauaaua

SEQ ID NO: 173354 - RNA, 19 nt, Homo sapiens
aaacagugauugccgacau

SEQ ID NO: 173355 - RNA, 19 nt, Homo sapiens
uacacaacuuucacucuuu

SEQ ID NO: 173356 - RNA, 19 nt, Homo sapiens
aaagaaggucccgcuguua

SEQ ID NO: 173357 - RNA, 19 nt, Homo sapiens
ugucaugagauccuacuua

SEQ ID NO: 173358 - RNA, 19 nt, Homo sapiens
uaacuucugugcuauucca

SEQ ID NO: 173359 - RNA, 19 nt, Homo sapiens
ucaccuaccuuucgagacu

SEQ ID NO: 173360 - RNA, 19 nt, Homo sapiens
acacaacuuucacucuuuc

SEQ ID NO: 173361 - RNA, 19 nt, Homo sapiens
guaugauccuggcuagaau

SEQ ID NO: 173362 - RNA, 19 nt, Homo sapiens
uggacacacuggaagauga

SEQ ID NO: 173363 - RNA, 19 nt, Homo sapiens
caucauccgugacuaucug

SEQ ID NO: 173364 - RNA, 19 nt, Homo sapiens
aaacaucauccgugacuau

SEQ ID NO: 173365 - RNA, 19 nt, Homo sapiens
cuggcuagaaugauaauua

SEQ ID NO: 173366 - RNA, 19 nt, Homo sapiens
cgcagaaucuucccaacug

SEQ ID NO: 173367 - RNA, 19 nt, Homo sapiens
caaguacugccacuauguu

SEQ ID NO: 173368 - RNA, 19 nt, Homo sapiens
gcugagaaauaccaaacag

SEQ ID NO: 173369 - RNA, 19 nt, Homo sapiens
uggauguuguguucucuuu

SEQ ID NO: 173370 - RNA, 19 nt, Homo sapiens
gcagcagccugaaaacuug

SEQ ID NO: 173371 - RNA, 19 nt, Homo sapiens
ggauguuguguucucuuua

SEQ ID NO: 173372 - RNA, 19 nt, Homo sapiens
acagaagacuauguucaga

SEQ ID NO: 173373 - RNA, 19 nt, Homo sapiens
gcuaagccggagaauauug

SEQ ID NO: 173374 - RNA, 19 nt, Homo sapiens
uuucucagccucagaguuu

SEQ ID NO: 173375 - RNA, 19 nt, Homo sapiens
ucccaacgaucucccuuga

SEQ ID NO: 173376 - RNA, 19 nt, Homo sapiens
caggauggaguucgugaaa

SEQ ID NO: 173377 - RNA, 19 nt, Homo sapiens
gcagugaagauucggaaag

SEQ ID NO: 173378 - RNA, 19 nt, Homo sapiens
cagguauguuaagaaguua

SEQ ID NO: 173379 - RNA, 19 nt, Homo sapiens
ggagcagguauguuaagaa

SEQ ID NO: 173380 - RNA, 19 nt, Homo sapiens
caaacaucauccgugacua

SEQ ID NO: 173381 - RNA, 19 nt, Homo sapiens
cgaucucccuugaguuuag

SEQ ID NO: 173382 - RNA, 19 nt, Homo sapiens
ugauggaugccaccaauau

SEQ ID NO: 173383 - RNA, 19 nt, Homo sapiens
cacuuuggcugccuguuau

SEQ ID NO: 173384 - RNA, 19 nt, Homo sapiens
aaucagaccagucgcaguu

SEQ ID NO: 173385 - RNA, 19 nt, Homo sapiens
ugaaguccaccauaaagug

SEQ ID NO: 173386 - RNA, 19 nt, Homo sapiens
cagaguguguuuaacuucu

SEQ ID NO: 173387 - RNA, 19 nt, Homo sapiens
aaaagaaggucccgcuguu

SEQ ID NO: 173388 - RNA, 19 nt, Homo sapiens
gccggagaauauugacuug

SEQ ID NO: 173389 - RNA, 19 nt, Homo sapiens
gaaggugaugcccaagaug

SEQ ID NO: 173390 - RNA, 19 nt, Homo sapiens
aacuuucacucuuuccuuu

SEQ ID NO: 173391 - RNA, 19 nt, Homo sapiens
caacuuucacucuuuccuu

SEQ ID NO: 173392 - RNA, 19 nt, Homo sapiens
gcugaaguccaccauaaag

SEQ ID NO: 173393 - RNA, 19 nt, Homo sapiens
ucagacccaucuucuagca

SEQ ID NO: 173394 - RNA, 19 nt, Homo sapiens
gauggaugccaccaauaug

SEQ ID NO: 173395 - RNA, 19 nt, Homo sapiens
aaaucuggcugagaaauac

SEQ ID NO: 173396 - RNA, 19 nt, Homo sapiens
gaucucccuugaguuuaga

SEQ ID NO: 173397 - RNA, 19 nt, Homo sapiens
aacgaucucccuugaguuu

SEQ ID NO: 173398 - RNA, 19 nt, Homo sapiens
gugcauauuuuaucugguu

SEQ ID NO: 173399 - RNA, 19 nt, Homo sapiens
gaaccuaaacauaaaagga

SEQ ID NO: 173400 - RNA, 19 nt, Homo sapiens
agaagacuauguucagacu

SEQ ID NO: 173401 - RNA, 19 nt, Homo sapiens
ccgaagaguucuacaaccu

SEQ ID NO: 173402 - RNA, 19 nt, Homo sapiens
ucagaccagucgcaguuuc

SEQ ID NO: 173403 - RNA, 19 nt, Homo sapiens
agagaguucuggccucaag

SEQ ID NO: 173404 - RNA, 19 nt, Homo sapiens
gccgacauuugccggagaa

SEQ ID NO: 173405 - RNA, 19 nt, Homo sapiens
gugagaagaaccuaaacau

SEQ ID NO: 173406 - RNA, 19 nt, Homo sapiens
ggacagaucugcugguauc

SEQ ID NO: 173407 - RNA, 19 nt, Homo sapiens
gaaaagagguacaaaucua

SEQ ID NO: 173408 - RNA, 19 nt, Homo sapiens
gaaggaggcugagaaagug

SEQ ID NO: 173409 - RNA, 19 nt, Homo sapiens
gcacugacauccaggacaa

SEQ ID NO: 173410 - RNA, 19 nt, Homo sapiens
gaaacaggaugcugauagu

SEQ ID NO: 173411 - RNA, 19 nt, Homo sapiens
gaaagugaccuagagauug

SEQ ID NO: 173412 - RNA, 19 nt, Homo sapiens
aggaggcucucaauaaaua

SEQ ID NO: 173413 - RNA, 19 nt, Homo sapiens
gaccagaauucagauguuu

SEQ ID NO: 173414 - RNA, 19 nt, Homo sapiens
gcaguguucuugcaauaug

SEQ ID NO: 173415 - RNA, 19 nt, Homo sapiens
gaacggagaccagaauuca

SEQ ID NO: 173416 - RNA, 19 nt, Homo sapiens
cauuauggcucucauugaa

SEQ ID NO: 173417 - RNA, 19 nt, Homo sapiens
cagcaguguucuugcaaua

SEQ ID NO: 173418 - RNA, 19 nt, Homo sapiens
caauguggaucuugucaga

SEQ ID NO: 173419 - RNA, 19 nt, Homo sapiens
gccgggagcagcccuauua

SEQ ID NO: 173420 - RNA, 19 nt, Homo sapiens
gcagaaggaggcugagaaa

SEQ ID NO: 173421 - RNA, 19 nt, Homo sapiens
ggaaacaggaugcugauag

SEQ ID NO: 173422 - RNA, 19 nt, Homo sapiens
guacauggcaggaauugau

SEQ ID NO: 173423 - RNA, 19 nt, Homo sapiens
gacaguuacagccacauua

SEQ ID NO: 173424 - RNA, 19 nt, Homo sapiens
aauaugaggaagacaguua

SEQ ID NO: 173425 - RNA, 19 nt, Homo sapiens
gggugaaggcgcuauauga

SEQ ID NO: 173426 - RNA, 19 nt, Homo sapiens
cugcagaguuccuaucaga

SEQ ID NO: 173427 - RNA, 19 nt, Homo sapiens
gcacuucucccagaucguu

SEQ ID NO: 173428 - RNA, 19 nt, Homo sapiens
ggagaaagugaccuagaga

SEQ ID NO: 173429 - RNA, 19 nt, Homo sapiens
gcacgccaaugccaagaag

SEQ ID NO: 173430 - RNA, 19 nt, Homo sapiens
ccuauuaccugaaccugau

SEQ ID NO: 173431 - RNA, 19 nt, Homo sapiens
gcaacgggccacuccagaa

SEQ ID NO: 173432 - RNA, 19 nt, Homo sapiens
guacaagacagcuuucuac

SEQ ID NO: 173433 - RNA, 19 nt, Homo sapiens
ucaaguacaagacagcuuu

SEQ ID NO: 173434 - RNA, 19 nt, Homo sapiens
uggaacugcugcaagcuuu

SEQ ID NO: 173435 - RNA, 19 nt, Homo sapiens
agaaagugaccuagagauu

SEQ ID NO: 173436 - RNA, 19 nt, Homo sapiens
ugauuaccuugaccucuuu

SEQ ID NO: 173437 - RNA, 19 nt, Homo sapiens
gauucaggaugauuaccuu

SEQ ID NO: 173438 - RNA, 19 nt, Homo sapiens
aaagugaccuagagauugc

SEQ ID NO: 173439 - RNA, 19 nt, Homo sapiens
ugacauccaggacaacaaa

SEQ ID NO: 173440 - RNA, 19 nt, Homo sapiens
agaaggaggcugagaaagu

SEQ ID NO: 173441 - RNA, 19 nt, Homo sapiens
ggauuucguucagcacuuc

SEQ ID NO: 173442 - RNA, 19 nt, Homo sapiens
gaggaggcucucaauaaau

SEQ ID NO: 173443 - RNA, 19 nt, Homo sapiens
agacagcuuucuacuccuu

SEQ ID NO: 173444 - RNA, 19 nt, Homo sapiens
ccagaauucagauguuuau

SEQ ID NO: 173445 - RNA, 19 nt, Homo sapiens
agaccagaauucagauguu

SEQ ID NO: 173446 - RNA, 19 nt, Homo sapiens
gcuccucccucagaaugaa

SEQ ID NO: 173447 - RNA, 19 nt, Homo sapiens
ucuuucagauucaggauga

SEQ ID NO: 173448 - RNA, 19 nt, Homo sapiens
ugacggugguaguagcauu

SEQ ID NO: 173449 - RNA, 19 nt, Homo sapiens
cggagaaagugaccuagag

SEQ ID NO: 173450 - RNA, 19 nt, Homo sapiens
gaaugaacggagaccagaa

SEQ ID NO: 173451 - RNA, 19 nt, Homo sapiens
gccauuggaggcaaguaua

SEQ ID NO: 173452 - RNA, 19 nt, Homo sapiens
gagaaagugaccuagagau

SEQ ID NO: 173453 - RNA, 19 nt, Homo sapiens
gcaauaugaggaagacagu

SEQ ID NO: 173454 - RNA, 19 nt, Homo sapiens
ccauuggaggcaaguauaa

SEQ ID NO: 173455 - RNA, 19 nt, Homo sapiens
gggaguucuuucagauuca

SEQ ID NO: 173456 - RNA, 19 nt, Homo sapiens
agaagauccugcuggagau

SEQ ID NO: 173457 - RNA, 19 nt, Homo sapiens
caaaucuauugucaaguac

SEQ ID NO: 173458 - RNA, 19 nt, Homo sapiens
gcagaguuccuaucagacu

SEQ ID NO: 173459 - RNA, 19 nt, Homo sapiens
gagaccagaauucagaugu

SEQ ID NO: 173460 - RNA, 19 nt, Homo sapiens
gggccacuccagaacagua

SEQ ID NO: 173461 - RNA, 19 nt, Homo sapiens
ggaggcucucaauaaauaa

SEQ ID NO: 173462 - RNA, 19 nt, Homo sapiens
uuauggcucucauugaaca

SEQ ID NO: 173463 - RNA, 19 nt, Homo sapiens
cacauuauggcucucauug

SEQ ID NO: 173464 - RNA, 19 nt, Homo sapiens
ggcagaaggaggcugagaa

SEQ ID NO: 173465 - RNA, 19 nt, Homo sapiens
ccagagauaggagaugcua

SEQ ID NO: 173466 - RNA, 19 nt, Homo sapiens
ccagcaguguucuugcaau

SEQ ID NO: 173467 - RNA, 19 nt, Homo sapiens
gcggagaaagugaccuaga

SEQ ID NO: 173468 - RNA, 19 nt, Homo sapiens
caguguucuugcaauauga

SEQ ID NO: 173469 - RNA, 19 nt, Homo sapiens
augauuaccuugaccucuu

SEQ ID NO: 173470 - RNA, 19 nt, Homo sapiens
ucguuagggugcugacuga

SEQ ID NO: 173471 - RNA, 19 nt, Homo sapiens
acaguuacagccacauuau

SEQ ID NO: 173472 - RNA, 19 nt, Homo sapiens
ggugaaggcgcuauaugag

SEQ ID NO: 173473 - RNA, 19 nt, Homo sapiens
gaagauccugcuggagaug

SEQ ID NO: 173474 - RNA, 19 nt, Homo sapiens
agauguuuaugcccaagaa

SEQ ID NO: 173475 - RNA, 19 nt, Homo sapiens
ccacauuauggcucucauu

SEQ ID NO: 173476 - RNA, 19 nt, Homo sapiens
cuacaagcggagaaaguga

SEQ ID NO: 173477 - RNA, 19 nt, Homo sapiens
gaaccugaucgagcucuuc

SEQ ID NO: 173478 - RNA, 19 nt, Homo sapiens
uggcucucauugaacagua

SEQ ID NO: 173479 - RNA, 19 nt, Homo sapiens
ggagaccagaauucagaug

SEQ ID NO: 173480 - RNA, 19 nt, Homo sapiens
ccagggcaauguggaucuu

SEQ ID NO: 173481 - RNA, 19 nt, Homo sapiens
gcagcccuauuaccugaac

SEQ ID NO: 173482 - RNA, 19 nt, Homo sapiens
ggggacagaucugcuggua

SEQ ID NO: 173483 - RNA, 19 nt, Homo sapiens
gaacugcugcaagcuuucu

SEQ ID NO: 173484 - RNA, 19 nt, Homo sapiens
gggcugguguguggaacug

SEQ ID NO: 173485 - RNA, 19 nt, Homo sapiens
ggggaguucuuucagauuc

SEQ ID NO: 173486 - RNA, 19 nt, Homo sapiens
gggagcagcccuauuaccu

SEQ ID NO: 173487 - RNA, 19 nt, Homo sapiens
ccuggaagcauguaucuac

SEQ ID NO: 173488 - RNA, 19 nt, Homo sapiens
gcugguggagccaaggaaa

SEQ ID NO: 173489 - RNA, 19 nt, Homo sapiens
guucuugcaauaugaggaa

SEQ ID NO: 173490 - RNA, 19 nt, Homo sapiens
aaagcaggauuucguucag

SEQ ID NO: 173491 - RNA, 19 nt, Homo sapiens
uauaugaggagcuggaucu

SEQ ID NO: 173492 - RNA, 19 nt, Homo sapiens
caacgggccacuccagaac

SEQ ID NO: 173493 - RNA, 19 nt, Homo sapiens
gugcugggccuuggaggaa

SEQ ID NO: 173494 - RNA, 19 nt, Homo sapiens
gaggcucucaauaaauaau

SEQ ID NO: 173495 - RNA, 19 nt, Homo sapiens
aggaauugauggcgagaag

SEQ ID NO: 173496 - RNA, 19 nt, Homo sapiens
gcacccagagauaggagau

SEQ ID NO: 173497 - RNA, 19 nt, Homo sapiens
gaagauagguuaaggaaau

SEQ ID NO: 173498 - RNA, 19 nt, Homo sapiens
gaucuaaccuggcuuguuu

SEQ ID NO: 173499 - RNA, 19 nt, Homo sapiens
ggcaagaccuccugaacua

SEQ ID NO: 173500 - RNA, 19 nt, Homo sapiens
caaagaaguugaucucugu

SEQ ID NO: 173501 - RNA, 19 nt, Homo sapiens
gaaguuagaugcaaucacu

SEQ ID NO: 173502 - RNA, 19 nt, Homo sapiens
gcagaaugguuuaacuuug

SEQ ID NO: 173503 - RNA, 19 nt, Homo sapiens
cugcuuaacuucaaagaua

SEQ ID NO: 173504 - RNA, 19 nt, Homo sapiens
gacugaaacuggagaaauu

SEQ ID NO: 173505 - RNA, 19 nt, Homo sapiens
gaagaucacauauaugaga

SEQ ID NO: 173506 - RNA, 19 nt, Homo sapiens
guaaacugcuuaacuucaa

SEQ ID NO: 173507 - RNA, 19 nt, Homo sapiens
uaaaugagaacauggauga

SEQ ID NO: 173508 - RNA, 19 nt, Homo sapiens
gaaacuggagaaauuauga

SEQ ID NO: 173509 - RNA, 19 nt, Homo sapiens
ugaguggacuucauauuau

SEQ ID NO: 173510 - RNA, 19 nt, Homo sapiens
gaacuagaacaaauaggaa

SEQ ID NO: 173511 - RNA, 19 nt, Homo sapiens
cagaaugguuuaacuuugu

SEQ ID NO: 173512 - RNA, 19 nt, Homo sapiens
aaucucaucuguuuaccua

SEQ ID NO: 173513 - RNA, 19 nt, Homo sapiens
ggugaaacauuaacaacca

SEQ ID NO: 173514 - RNA, 19 nt, Homo sapiens
gaucuggcauauggacuaa

SEQ ID NO: 173515 - RNA, 19 nt, Homo sapiens
gaauguguauggacuaaaa

SEQ ID NO: 173516 - RNA, 19 nt, Homo sapiens
ccauaccacuaauuagaaa

SEQ ID NO: 173517 - RNA, 19 nt, Homo sapiens
gugauucucugcuagaugu

SEQ ID NO: 173518 - RNA, 19 nt, Homo sapiens
guaguuaaaucugaaugug

SEQ ID NO: 173519 - RNA, 19 nt, Homo sapiens
cuggagaaauuaugacuau

SEQ ID NO: 173520 - RNA, 19 nt, Homo sapiens
uagaaccugugucuuauuc

SEQ ID NO: 173521 - RNA, 19 nt, Homo sapiens
ucacugaugaggagaauga

SEQ ID NO: 173522 - RNA, 19 nt, Homo sapiens
ccugucaccucaucuuuga

SEQ ID NO: 173523 - RNA, 19 nt, Homo sapiens
ggccauaccacuaauuaga

SEQ ID NO: 173524 - RNA, 19 nt, Homo sapiens
gugauuaaaugagaacaug

SEQ ID NO: 173525 - RNA, 19 nt, Homo sapiens
ugacuaaacuagaggaaaa

SEQ ID NO: 173526 - RNA, 19 nt, Homo sapiens
uaauucaccuugcauaacu

SEQ ID NO: 173527 - RNA, 19 nt, Homo sapiens
gcauauggacuaacagaca

SEQ ID NO: 173528 - RNA, 19 nt, Homo sapiens
ggugaaggcagagaucuaa

SEQ ID NO: 173529 - RNA, 19 nt, Homo sapiens
agaaugacaugcucgaucu

SEQ ID NO: 173530 - RNA, 19 nt, Homo sapiens
gaucacauauaugagaagu

SEQ ID NO: 173531 - RNA, 19 nt, Homo sapiens
uauaagcuauguguucaga

SEQ ID NO: 173532 - RNA, 19 nt, Homo sapiens
ccuauaagcuauguguuca

SEQ ID NO: 173533 - RNA, 19 nt, Homo sapiens
uagaagauagguuaaggaa

SEQ ID NO: 173534 - RNA, 19 nt, Homo sapiens
ugaacuagaacaaauagga

SEQ ID NO: 173535 - RNA, 19 nt, Homo sapiens
caagaccuccugaacuaga

SEQ ID NO: 173536 - RNA, 19 nt, Homo sapiens
gaaccugugucuuauuccu

SEQ ID NO: 173537 - RNA, 19 nt, Homo sapiens
ucucaucuguuuaccuaga

SEQ ID NO: 173538 - RNA, 19 nt, Homo sapiens
uaugagaaguuagaugcaa

SEQ ID NO: 173539 - RNA, 19 nt, Homo sapiens
gccauaccacuaauuagaa

SEQ ID NO: 173540 - RNA, 19 nt, Homo sapiens
caccuugcauaacuacuga

SEQ ID NO: 173541 - RNA, 19 nt, Homo sapiens
uaagcuauguguucagacu

SEQ ID NO: 173542 - RNA, 19 nt, Homo sapiens
gauuaaaugagaacaugga

SEQ ID NO: 173543 - RNA, 19 nt, Homo sapiens
uaagcagaaugguuuaacu

SEQ ID NO: 173544 - RNA, 19 nt, Homo sapiens
ucugcuagauguugugguu

SEQ ID NO: 173545 - RNA, 19 nt, Homo sapiens
gugaaacauuaacaaccaa

SEQ ID NO: 173546 - RNA, 19 nt, Homo sapiens
gauggugaaacauuaacaa

SEQ ID NO: 173547 - RNA, 19 nt, Homo sapiens
gguuuaacuuuguacucaa

SEQ ID NO: 173548 - RNA, 19 nt, Homo sapiens
cugaauguguauggacuaa

SEQ ID NO: 173549 - RNA, 19 nt, Homo sapiens
gacaaaaucuauggacaau

SEQ ID NO: 173550 - RNA, 19 nt, Homo sapiens
gcuagauguugugguugaa

SEQ ID NO: 173551 - RNA, 19 nt, Homo sapiens
cuccugaacuagaacaaau

SEQ ID NO: 173552 - RNA, 19 nt, Homo sapiens
guuuagcgacuuuagcaaa

SEQ ID NO: 173553 - RNA, 19 nt, Homo sapiens
cagcucagaagauaaaaua

SEQ ID NO: 173554 - RNA, 19 nt, Homo sapiens
caaccugucaccucaucuu

SEQ ID NO: 173555 - RNA, 19 nt, Homo sapiens
ugguuuaacuuuguacuca

SEQ ID NO: 173556 - RNA, 19 nt, Homo sapiens
gaaacauuaacaaccaaag

SEQ ID NO: 173557 - RNA, 19 nt, Homo sapiens
gggcaagaccuccugaacu

SEQ ID NO: 173558 - RNA, 19 nt, Homo sapiens
guuuagggccauaccacua

SEQ ID NO: 173559 - RNA, 19 nt, Homo sapiens
gcauaacuacugaauuuug

SEQ ID NO: 173560 - RNA, 19 nt, Homo sapiens
cauuaacaaccaaaggaaa

SEQ ID NO: 173561 - RNA, 19 nt, Homo sapiens
gaaguugaucucuguuuug

SEQ ID NO: 173562 - RNA, 19 nt, Homo sapiens
agaaguugaucucuguuuu

SEQ ID NO: 173563 - RNA, 19 nt, Homo sapiens
gggugaaggcagagaucua

SEQ ID NO: 173564 - RNA, 19 nt, Homo sapiens
ugcuagauguugugguuga

SEQ ID NO: 173565 - RNA, 19 nt, Homo sapiens
ugaaacuggagaaauuaug

SEQ ID NO: 173566 - RNA, 19 nt, Homo sapiens
acugaaacuggagaaauua

SEQ ID NO: 173567 - RNA, 19 nt, Homo sapiens
ucuggcauauggacuaaca

SEQ ID NO: 173568 - RNA, 19 nt, Homo sapiens
cgaucuggcauauggacua

SEQ ID NO: 173569 - RNA, 19 nt, Homo sapiens
aagcagaaugguuuaacuu

SEQ ID NO: 173570 - RNA, 19 nt, Homo sapiens
aagaaguugaucucuguuu

SEQ ID NO: 173571 - RNA, 19 nt, Homo sapiens
cuguuuaccuagaagauag

SEQ ID NO: 173572 - RNA, 19 nt, Homo sapiens
gcaagaccuccugaacuag

SEQ ID NO: 173573 - RNA, 19 nt, Homo sapiens
uaaaucugaauguguaugg

SEQ ID NO: 173574 - RNA, 19 nt, Homo sapiens
agacugaaacuggagaaau

SEQ ID NO: 173575 - RNA, 19 nt, Homo sapiens
aagaccuccugaacuagaa

SEQ ID NO: 173576 - RNA, 19 nt, Homo sapiens
gauuggaugaguuuauucu

SEQ ID NO: 173577 - RNA, 19 nt, Homo sapiens
agggccauaccacuaauua

SEQ ID NO: 173578 - RNA, 19 nt, Homo sapiens
agcagaaugguuuaacuuu

SEQ ID NO: 173579 - RNA, 19 nt, Homo sapiens
cuagaaccugugucuuauu

SEQ ID NO: 173580 - RNA, 19 nt, Homo sapiens
ugucauucuugaaaguaug

SEQ ID NO: 173581 - RNA, 19 nt, Homo sapiens
caaguggccuucaccauua

SEQ ID NO: 173582 - RNA, 19 nt, Homo sapiens
ggaacaugcuggaaauaaa

SEQ ID NO: 173583 - RNA, 19 nt, Homo sapiens
gcaaguggccuucaccauu

SEQ ID NO: 173584 - RNA, 19 nt, Homo sapiens
ggaagcggcugacggaacu

SEQ ID NO: 173585 - RNA, 19 nt, Homo sapiens
gaaggcagcccugggugua

SEQ ID NO: 173586 - RNA, 19 nt, Homo sapiens
gggaacaugcuggaaauaa

SEQ ID NO: 173587 - RNA, 19 nt, Homo sapiens
acaacgggcuuccugagaa

SEQ ID NO: 173588 - RNA, 19 nt, Homo sapiens
gugcugcccucaccagaug

SEQ ID NO: 173589 - RNA, 19 nt, Homo sapiens
uuaaggagcuucgggagau

SEQ ID NO: 173590 - RNA, 19 nt, Homo sapiens
gaacaugcuggaaauaaaa

SEQ ID NO: 173591 - RNA, 19 nt, Homo sapiens
ugaagaaugucaucaacac

SEQ ID NO: 173592 - RNA, 19 nt, Homo sapiens
ucagcagcauuggguauaa

SEQ ID NO: 173593 - RNA, 19 nt, Homo sapiens
ggugaagaaugucaucaac

SEQ ID NO: 173594 - RNA, 19 nt, Homo sapiens
gagcuucugccaccauuuc

SEQ ID NO: 173595 - RNA, 19 nt, Homo sapiens
gcagggaagggaugagugu

SEQ ID NO: 173596 - RNA, 19 nt, Homo sapiens
gggccgaucuaaccccuua

SEQ ID NO: 173597 - RNA, 19 nt, Homo sapiens
gaagaaugucaucaacaca

SEQ ID NO: 173598 - RNA, 19 nt, Homo sapiens
gacccaagcgugcccuuug

SEQ ID NO: 173599 - RNA, 19 nt, Homo sapiens
gaagacaguguggcuagug

SEQ ID NO: 173600 - RNA, 19 nt, Homo sapiens
agccagaccugagcuguga

SEQ ID NO: 173601 - RNA, 19 nt, Homo sapiens
caacgggcuuccugagaac

SEQ ID NO: 173602 - RNA, 19 nt, Homo sapiens
ggaggugugggccgaucua

SEQ ID NO: 173603 - RNA, 19 nt, Homo sapiens
gagcuucgggagaugauuc

SEQ ID NO: 173604 - RNA, 19 nt, Homo sapiens
ggacaucuacgagaaacag

SEQ ID NO: 173605 - RNA, 19 nt, Homo sapiens
guugggaacaugcuggaaa

SEQ ID NO: 173606 - RNA, 19 nt, Homo sapiens
gacuggagggugucgauga

SEQ ID NO: 173607 - RNA, 19 nt, Homo sapiens
gaggcagagucgagugaag

SEQ ID NO: 173608 - RNA, 19 nt, Homo sapiens
ugacacagccgugauucug

SEQ ID NO: 173609 - RNA, 19 nt, Homo sapiens
uguggagggucaccagguu

SEQ ID NO: 173610 - RNA, 19 nt, Homo sapiens
gcucagcagcauuggguau

SEQ ID NO: 173611 - RNA, 19 nt, Homo sapiens
caaccaugacugacagcuu

SEQ ID NO: 173612 - RNA, 19 nt, Homo sapiens
cauggaagaccucccuugu

SEQ ID NO: 173613 - RNA, 19 nt, Homo sapiens
agagaacggacaucacgaa

SEQ ID NO: 173614 - RNA, 19 nt, Homo sapiens
gcgcaagguuuuagcuuuc

SEQ ID NO: 173615 - RNA, 19 nt, Homo sapiens
acccaagcgugcccuuuga

SEQ ID NO: 173616 - RNA, 19 nt, Homo sapiens
uucgggagaugauucaguu

SEQ ID NO: 173617 - RNA, 19 nt, Homo sapiens
ccacgggagacauggaaga

SEQ ID NO: 173618 - RNA, 19 nt, Homo sapiens
uaaggagcuucgggagaug

SEQ ID NO: 173619 - RNA, 19 nt, Homo sapiens
uggcccagcuggcuucuac

SEQ ID NO: 173620 - RNA, 19 nt, Homo sapiens
ucaccagguugggaacaug

SEQ ID NO: 173621 - RNA, 19 nt, Homo sapiens
gugaagagaggaccuacag

SEQ ID NO: 173622 - RNA, 19 nt, Homo sapiens
aaguggccuucaccauuaa

SEQ ID NO: 173623 - RNA, 19 nt, Homo sapiens
gugaagaaugucaucaaca

SEQ ID NO: 173624 - RNA, 19 nt, Homo sapiens
ccgagcuucugccaccauu

SEQ ID NO: 173625 - RNA, 19 nt, Homo sapiens
uugggaacaugcuggaaau

SEQ ID NO: 173626 - RNA, 19 nt, Homo sapiens
cagcagcauuggguauaag

SEQ ID NO: 173627 - RNA, 19 nt, Homo sapiens
gcccaacaccugcuaaagc

SEQ ID NO: 173628 - RNA, 19 nt, Homo sapiens
acgcuguggugcugagcua

SEQ ID NO: 173629 - RNA, 19 nt, Homo sapiens
caaguggccuucaccauua

SEQ ID NO: 173630 - RNA, 19 nt, Homo sapiens
ggaacaugcuggaaauaaa

SEQ ID NO: 173631 - RNA, 19 nt, Homo sapiens
gcaaguggccuucaccauu

SEQ ID NO: 173632 - RNA, 19 nt, Homo sapiens
ggaagcggcugacggaacu

SEQ ID NO: 173633 - RNA, 19 nt, Homo sapiens
gaaggcagcccugggugua

SEQ ID NO: 173634 - RNA, 19 nt, Homo sapiens
gggaacaugcuggaaauaa

SEQ ID NO: 173635 - RNA, 19 nt, Homo sapiens
acaacgggcuuccugagaa

SEQ ID NO: 173636 - RNA, 19 nt, Homo sapiens
gugcugcccucaccagaug

SEQ ID NO: 173637 - RNA, 19 nt, Homo sapiens
uuaaggagcuucgggagau

SEQ ID NO: 173638 - RNA, 19 nt, Homo sapiens
gaacaugcuggaaauaaaa

SEQ ID NO: 173639 - RNA, 19 nt, Homo sapiens
ugaagaaugucaucaacac

SEQ ID NO: 173640 - RNA, 19 nt, Homo sapiens
ucagcagcauuggguauaa

SEQ ID NO: 173641 - RNA, 19 nt, Homo sapiens
ggugaagaaugucaucaac

SEQ ID NO: 173642 - RNA, 19 nt, Homo sapiens
gagcuucugccaccauuuc

SEQ ID NO: 173643 - RNA, 19 nt, Homo sapiens
gcagggaagggaugagugu

SEQ ID NO: 173644 - RNA, 19 nt, Homo sapiens
gggccgaucuaaccccuua

SEQ ID NO: 173645 - RNA, 19 nt, Homo sapiens
gaagaaugucaucaacaca

SEQ ID NO: 173646 - RNA, 19 nt, Homo sapiens
gacccaagcgugcccuuug

SEQ ID NO: 173647 - RNA, 19 nt, Homo sapiens
gaagacaguguggcuagug

SEQ ID NO: 173648 - RNA, 19 nt, Homo sapiens
agccagaccugagcuguga

SEQ ID NO: 173649 - RNA, 19 nt, Homo sapiens
caacgggcuuccugagaac

SEQ ID NO: 173650 - RNA, 19 nt, Homo sapiens
ggaggugugggccgaucua

SEQ ID NO: 173651 - RNA, 19 nt, Homo sapiens
gagcuucgggagaugauuc

SEQ ID NO: 173652 - RNA, 19 nt, Homo sapiens
ggacaucuacgagaaacag

SEQ ID NO: 173653 - RNA, 19 nt, Homo sapiens
guugggaacaugcuggaaa

SEQ ID NO: 173654 - RNA, 19 nt, Homo sapiens
gacuggagggugucgauga

SEQ ID NO: 173655 - RNA, 19 nt, Homo sapiens
gaggcagagucgagugaag

SEQ ID NO: 173656 - RNA, 19 nt, Homo sapiens
ugacacagccgugauucug

SEQ ID NO: 173657 - RNA, 19 nt, Homo sapiens
uguggagggucaccagguu

SEQ ID NO: 173658 - RNA, 19 nt, Homo sapiens
gcucagcagcauuggguau

SEQ ID NO: 173659 - RNA, 19 nt, Homo sapiens
caaccaugacugacagcuu

SEQ ID NO: 173660 - RNA, 19 nt, Homo sapiens
cauggaagaccucccuugu

SEQ ID NO: 173661 - RNA, 19 nt, Homo sapiens
agagaacggacaucacgaa

SEQ ID NO: 173662 - RNA, 19 nt, Homo sapiens
gcgcaagguuuuagcuuuc

SEQ ID NO: 173663 - RNA, 19 nt, Homo sapiens
acccaagcgugcccuuuga

SEQ ID NO: 173664 - RNA, 19 nt, Homo sapiens
uucgggagaugauucaguu

SEQ ID NO: 173665 - RNA, 19 nt, Homo sapiens
ccacgggagacauggaaga

SEQ ID NO: 173666 - RNA, 19 nt, Homo sapiens
uaaggagcuucgggagaug

SEQ ID NO: 173667 - RNA, 19 nt, Homo sapiens
uggcccagcuggcuucuac

SEQ ID NO: 173668 - RNA, 19 nt, Homo sapiens
ucaccagguugggaacaug

SEQ ID NO: 173669 - RNA, 19 nt, Homo sapiens
gugaagagaggaccuacag

SEQ ID NO: 173670 - RNA, 19 nt, Homo sapiens
aaguggccuucaccauuaa

SEQ ID NO: 173671 - RNA, 19 nt, Homo sapiens
gugaagaaugucaucaaca

SEQ ID NO: 173672 - RNA, 19 nt, Homo sapiens
ccgagcuucugccaccauu

SEQ ID NO: 173673 - RNA, 19 nt, Homo sapiens
uugggaacaugcuggaaau

SEQ ID NO: 173674 - RNA, 19 nt, Homo sapiens
cagcagcauuggguauaag

SEQ ID NO: 173675 - RNA, 19 nt, Homo sapiens
gcccaacaccugcuaaagc

SEQ ID NO: 173676 - RNA, 19 nt, Homo sapiens
acgcuguggugcugagcua

SEQ ID NO: 173677 - RNA, 19 nt, Homo sapiens
uaaaggaacuggaccauuu

SEQ ID NO: 173678 - RNA, 19 nt, Homo sapiens
ggagagagauggccuagaa

SEQ ID NO: 173679 - RNA, 19 nt, Homo sapiens
gaacacaguugaguauuug

SEQ ID NO: 173680 - RNA, 19 nt, Homo sapiens
gaaauccauuguucucuaa

SEQ ID NO: 173681 - RNA, 19 nt, Homo sapiens
ggaaauccauuguucucua

SEQ ID NO: 173682 - RNA, 19 nt, Homo sapiens
caaauugugugguuucuug

SEQ ID NO: 173683 - RNA, 19 nt, Homo sapiens
agaauaagcuggcaccauu

SEQ ID NO: 173684 - RNA, 19 nt, Homo sapiens
caacagaggcgacccauau

SEQ ID NO: 173685 - RNA, 19 nt, Homo sapiens
ggacagugcugcuggaaag

SEQ ID NO: 173686 - RNA, 19 nt, Homo sapiens
gccgaaaacuggaauauua

SEQ ID NO: 173687 - RNA, 19 nt, Homo sapiens
caacaauacuuugcuugaa

SEQ ID NO: 173688 - RNA, 19 nt, Homo sapiens
gcaauuugguuaccugcaa

SEQ ID NO: 173689 - RNA, 19 nt, Homo sapiens
gaaucucacuuuccucaau

SEQ ID NO: 173690 - RNA, 19 nt, Homo sapiens
caaacgagcuguguuccaa

SEQ ID NO: 173691 - RNA, 19 nt, Homo sapiens
gaagcgagguggucauucu

SEQ ID NO: 173692 - RNA, 19 nt, Homo sapiens
caucuucucuaucuuaguu

SEQ ID NO: 173693 - RNA, 19 nt, Homo sapiens
gguauaaguuacuaguuug

SEQ ID NO: 173694 - RNA, 19 nt, Homo sapiens
ggacggaagcccacgauga

SEQ ID NO: 173695 - RNA, 19 nt, Homo sapiens
guacguccauccuuuaaca

SEQ ID NO: 173696 - RNA, 19 nt, Homo sapiens
cauccuuccuugauauaua

SEQ ID NO: 173697 - RNA, 19 nt, Homo sapiens
guggagaggguguuauuua

SEQ ID NO: 173698 - RNA, 19 nt, Homo sapiens
gagacuaaauccuucuuca

SEQ ID NO: 173699 - RNA, 19 nt, Homo sapiens
guucacgacuuccuucuga

SEQ ID NO: 173700 - RNA, 19 nt, Homo sapiens
ggauuggacucuugaugga

SEQ ID NO: 173701 - RNA, 19 nt, Homo sapiens
cgaguacucucaaguuuua

SEQ ID NO: 173702 - RNA, 19 nt, Homo sapiens
ucacuuuccucaauguaaa

SEQ ID NO: 173703 - RNA, 19 nt, Homo sapiens
gcccauggguuacagaaug

SEQ ID NO: 173704 - RNA, 19 nt, Homo sapiens
cagcaucuucucuaucuua

SEQ ID NO: 173705 - RNA, 19 nt, Homo sapiens
gcagggagacuaaauccuu

SEQ ID NO: 173706 - RNA, 19 nt, Homo sapiens
caaggaguguggaguugaa

SEQ ID NO: 173707 - RNA, 19 nt, Homo sapiens
cagaucauauucuaaagga

SEQ ID NO: 173708 - RNA, 19 nt, Homo sapiens
ugaagcugcuggaugaauu

SEQ ID NO: 173709 - RNA, 19 nt, Homo sapiens
gagaggguguuauuuagag

SEQ ID NO: 173710 - RNA, 19 nt, Homo sapiens
uugaaugccuucuuucuga

SEQ ID NO: 173711 - RNA, 19 nt, Homo sapiens
guaauaaacguguacaagu

SEQ ID NO: 173712 - RNA, 19 nt, Homo sapiens
uaacagaagaagcaauuga

SEQ ID NO: 173713 - RNA, 19 nt, Homo sapiens
uuaguugaaugccuucuuu

SEQ ID NO: 173714 - RNA, 19 nt, Homo sapiens
ugaaugagaucuguuuagu

SEQ ID NO: 173715 - RNA, 19 nt, Homo sapiens
uaugagacacaccuauuua

SEQ ID NO: 173716 - RNA, 19 nt, Homo sapiens
gaagagauggagagagaug

SEQ ID NO: 173717 - RNA, 19 nt, Homo sapiens
guccuugccuguagauauu

SEQ ID NO: 173718 - RNA, 19 nt, Homo sapiens
caaguacaguguucaugau

SEQ ID NO: 173719 - RNA, 19 nt, Homo sapiens
aaugagaucuguuuagucu

SEQ ID NO: 173720 - RNA, 19 nt, Homo sapiens
uugaagagauggagagaga

SEQ ID NO: 173721 - RNA, 19 nt, Homo sapiens
gagcaguaccgcaggauug

SEQ ID NO: 173722 - RNA, 19 nt, Homo sapiens
ggaccaagaccucaugaca

SEQ ID NO: 173723 - RNA, 19 nt, Homo sapiens
gagcugagucucuuaaugg

SEQ ID NO: 173724 - RNA, 19 nt, Homo sapiens
uggaaaggcuggaguacug

SEQ ID NO: 173725 - RNA, 19 nt, Homo sapiens
ggacaucgaguacucucaa

SEQ ID NO: 173726 - RNA, 19 nt, Homo sapiens
uguaugagcuggacaucga

SEQ ID NO: 173727 - RNA, 19 nt, Homo sapiens
cgauagcauuuaccaguga

SEQ ID NO: 173728 - RNA, 19 nt, Homo sapiens
gacggaagcccacgaugaa

SEQ ID NO: 173729 - RNA, 19 nt, Homo sapiens
uggugaagcugcuggauga

SEQ ID NO: 173730 - RNA, 19 nt, Homo sapiens
ggagaggguguuauuuaga

SEQ ID NO: 173731 - RNA, 19 nt, Homo sapiens
caacacagccccucacaaa

SEQ ID NO: 173732 - RNA, 19 nt, Homo sapiens
gcauuuaccagugaccaua

SEQ ID NO: 173733 - RNA, 19 nt, Homo sapiens
ucaugacacuuccuauuca

SEQ ID NO: 173734 - RNA, 19 nt, Homo sapiens
gauacaaugggacauguga

SEQ ID NO: 173735 - RNA, 19 nt, Homo sapiens
cugagucucuuaauggaaa

SEQ ID NO: 173736 - RNA, 19 nt, Homo sapiens
cagauacuauaaucaagug

SEQ ID NO: 173737 - RNA, 19 nt, Homo sapiens
caaggguaauaaacgugua

SEQ ID NO: 173738 - RNA, 19 nt, Homo sapiens
gggaggcccugaaacucuu

SEQ ID NO: 173739 - RNA, 19 nt, Homo sapiens
gaagaagcaauugaagaga

SEQ ID NO: 173740 - RNA, 19 nt, Homo sapiens
ucacacaguauccacagua

SEQ ID NO: 173741 - RNA, 19 nt, Homo sapiens
cauccagcaucuucucuau

SEQ ID NO: 173742 - RNA, 19 nt, Homo sapiens
cagaagaagcaauugaaga

SEQ ID NO: 173743 - RNA, 19 nt, Homo sapiens
ccacuuuaaugcaauaacu

SEQ ID NO: 173744 - RNA, 19 nt, Homo sapiens
guaaccacuuuaaugcaau

SEQ ID NO: 173745 - RNA, 19 nt, Homo sapiens
ugaaugccuucuuucugaa

SEQ ID NO: 173746 - RNA, 19 nt, Homo sapiens
acaaguacaguguucauga

SEQ ID NO: 173747 - RNA, 19 nt, Homo sapiens
gguaagcgccacuguccaa

SEQ ID NO: 173748 - RNA, 19 nt, Homo sapiens
gcgagguggucauucuguu

SEQ ID NO: 173749 - RNA, 19 nt, Homo sapiens
gagaagcgagguggucauu

SEQ ID NO: 173750 - RNA, 19 nt, Homo sapiens
agaagcaauugaagagaug

SEQ ID NO: 173751 - RNA, 19 nt, Homo sapiens
aagaagcaauugaagagau

SEQ ID NO: 173752 - RNA, 19 nt, Homo sapiens
caaugggacaugugaagaa

SEQ ID NO: 173753 - RNA, 19 nt, Homo sapiens
uggagaggguguuauuuag

SEQ ID NO: 173754 - RNA, 19 nt, Homo sapiens
caaacagacgaaucuauca

SEQ ID NO: 173755 - RNA, 19 nt, Homo sapiens
ucaaacagacgaaucuauc

SEQ ID NO: 173756 - RNA, 19 nt, Homo sapiens
gugcauauaguugcuguuu

SEQ ID NO: 173757 - RNA, 19 nt, Homo sapiens
gguguuauuuagagaucaa

SEQ ID NO: 173758 - RNA, 19 nt, Homo sapiens
caaguucaaccgcagaaga

SEQ ID NO: 173759 - RNA, 19 nt, Homo sapiens
gccaaggaguguggaguug

SEQ ID NO: 173760 - RNA, 19 nt, Homo sapiens
gaagcugcuggaugaauug

SEQ ID NO: 173761 - RNA, 19 nt, Homo sapiens
aguaaccacuuuaaugcaa

SEQ ID NO: 173762 - RNA, 19 nt, Homo sapiens
gcuauugcuuucacacagu

SEQ ID NO: 173763 - RNA, 19 nt, Homo sapiens
caagaccucaugacacuuc

SEQ ID NO: 173764 - RNA, 19 nt, Homo sapiens
uaccugcaauggcugcuuu

SEQ ID NO: 173765 - RNA, 19 nt, Homo sapiens
caucgaguacucucaaguu

SEQ ID NO: 173766 - RNA, 19 nt, Homo sapiens
ggaagcccacgaugaagug

SEQ ID NO: 173767 - RNA, 19 nt, Homo sapiens
caccacaggcagcagcuua

SEQ ID NO: 173768 - RNA, 19 nt, Homo sapiens
acacagccccucacaaaua

SEQ ID NO: 173769 - RNA, 19 nt, Homo sapiens
gagagggcauggugaagcu

SEQ ID NO: 173770 - RNA, 19 nt, Homo sapiens
cauugucaccuuggauuua

SEQ ID NO: 173771 - RNA, 19 nt, Homo sapiens
gguaguccuugccuguaga

SEQ ID NO: 173772 - RNA, 19 nt, Homo sapiens
gcgaggccaccauucauug

SEQ ID NO: 173773 - RNA, 19 nt, Homo sapiens
auucacacauccagucaaa

SEQ ID NO: 173774 - RNA, 19 nt, Homo sapiens
cuauugcuuucacacagua

SEQ ID NO: 173775 - RNA, 19 nt, Homo sapiens
gguaauaaacguguacaag

SEQ ID NO: 173776 - RNA, 19 nt, Homo sapiens
uagggaggcaauuugguua

SEQ ID NO: 173777 - RNA, 19 nt, Homo sapiens
ggaguaagauggugauguu

SEQ ID NO: 173778 - RNA, 19 nt, Homo sapiens
aagaagagcugaucaaguu

SEQ ID NO: 173779 - RNA, 19 nt, Homo sapiens
gaagagagagggagauaaa

SEQ ID NO: 173780 - RNA, 19 nt, Homo sapiens
gcaaucagcugaguugaga

SEQ ID NO: 173781 - RNA, 19 nt, Homo sapiens
gagagaagaugggcagaaa

SEQ ID NO: 173782 - RNA, 19 nt, Homo sapiens
gggaugugcugcagaauga

SEQ ID NO: 173783 - RNA, 19 nt, Homo sapiens
gggaggaacugcugagaga

SEQ ID NO: 173784 - RNA, 19 nt, Homo sapiens
ucacuaagcagcacaauga

SEQ ID NO: 173785 - RNA, 19 nt, Homo sapiens
gaguugagacuuuggaaua

SEQ ID NO: 173786 - RNA, 19 nt, Homo sapiens
cagaauauuugccgucuug

SEQ ID NO: 173787 - RNA, 19 nt, Homo sapiens
caagaaggccacagaggua

SEQ ID NO: 173788 - RNA, 19 nt, Homo sapiens
agaaugacaucaagagcua

SEQ ID NO: 173789 - RNA, 19 nt, Homo sapiens
gggcaucccuuaucuugau

SEQ ID NO: 173790 - RNA, 19 nt, Homo sapiens
ggugaaggcuggcaaaguc

SEQ ID NO: 173791 - RNA, 19 nt, Homo sapiens
cgaacuugcuauguaauuu

SEQ ID NO: 173792 - RNA, 19 nt, Homo sapiens
gaacuugcuauguaauuug

SEQ ID NO: 173793 - RNA, 19 nt, Homo sapiens
ccacuucucaggcaguuua

SEQ ID NO: 173794 - RNA, 19 nt, Homo sapiens
gccguaagguggccauuga

SEQ ID NO: 173795 - RNA, 19 nt, Homo sapiens
gagaagagagagggagaua

SEQ ID NO: 173796 - RNA, 19 nt, Homo sapiens
gaauauuugccgucuugua

SEQ ID NO: 173797 - RNA, 19 nt, Homo sapiens
gcaucaagcccguguaugu

SEQ ID NO: 173798 - RNA, 19 nt, Homo sapiens
caaacuaauugcugaugug

SEQ ID NO: 173799 - RNA, 19 nt, Homo sapiens
gaagaagagcugaucaagu

SEQ ID NO: 173800 - RNA, 19 nt, Homo sapiens
ggagcgagccaaaugaaga

SEQ ID NO: 173801 - RNA, 19 nt, Homo sapiens
ccacuaagaagaaggcaaa

SEQ ID NO: 173802 - RNA, 19 nt, Homo sapiens
caaguacccugugccagaa

SEQ ID NO: 173803 - RNA, 19 nt, Homo sapiens
caugagagcagccgucuga

SEQ ID NO: 173804 - RNA, 19 nt, Homo sapiens
cccaagggauccacuaaga

SEQ ID NO: 173805 - RNA, 19 nt, Homo sapiens
cuaagcagcacaaugauga

SEQ ID NO: 173806 - RNA, 19 nt, Homo sapiens
ucagcugaguugagacuuu

SEQ ID NO: 173807 - RNA, 19 nt, Homo sapiens
ugaaagugauagauagcaa

SEQ ID NO: 173808 - RNA, 19 nt, Homo sapiens
uaaguccauuguuacauga

SEQ ID NO: 173809 - RNA, 19 nt, Homo sapiens
gaagggagagcgagcuuag

SEQ ID NO: 173810 - RNA, 19 nt, Homo sapiens
gucaagaggcugaguaaga

SEQ ID NO: 173811 - RNA, 19 nt, Homo sapiens
acucgaacuugcuauguaa

SEQ ID NO: 173812 - RNA, 19 nt, Homo sapiens
gaaacucgaacuugcuaug

SEQ ID NO: 173813 - RNA, 19 nt, Homo sapiens
gaaaauaugucaggcucaa

SEQ ID NO: 173814 - RNA, 19 nt, Homo sapiens
gaagagcugaucaaguuca

SEQ ID NO: 173815 - RNA, 19 nt, Homo sapiens
ucaagaggcugaguaagag

SEQ ID NO: 173816 - RNA, 19 nt, Homo sapiens
aaaauuggcuccacaagga

SEQ ID NO: 173817 - RNA, 19 nt, Homo sapiens
ccaaacuaauugcugaugu

SEQ ID NO: 173818 - RNA, 19 nt, Homo sapiens
gggcagcagggaaguuuaa

SEQ ID NO: 173819 - RNA, 19 nt, Homo sapiens
gagcugaucaaguucaugu

SEQ ID NO: 173820 - RNA, 19 nt, Homo sapiens
ggaauaagacacugguuuu

SEQ ID NO: 173821 - RNA, 19 nt, Homo sapiens
gaacccaagggauccacua

SEQ ID NO: 173822 - RNA, 19 nt, Homo sapiens
cagcugaguugagacuuug

SEQ ID NO: 173823 - RNA, 19 nt, Homo sapiens
gggcagaaacucgaacuug

SEQ ID NO: 173824 - RNA, 19 nt, Homo sapiens
gauagauagcaacaaguuu

SEQ ID NO: 173825 - RNA, 19 nt, Homo sapiens
acaugaaagugauagauag

SEQ ID NO: 173826 - RNA, 19 nt, Homo sapiens
caguagugcuagucccuuu

SEQ ID NO: 173827 - RNA, 19 nt, Homo sapiens
gagcgagccaaaugaagaa

SEQ ID NO: 173828 - RNA, 19 nt, Homo sapiens
cggcagcccugugcuaaug

SEQ ID NO: 173829 - RNA, 19 nt, Homo sapiens
cuaagcggcuggugaaggu

SEQ ID NO: 173830 - RNA, 19 nt, Homo sapiens
uaugagcauuuaucaguuc

SEQ ID NO: 173831 - RNA, 19 nt, Homo sapiens
ugacaucaagagcuacuuu

SEQ ID NO: 173832 - RNA, 19 nt, Homo sapiens
agucaucccuccucugugu

SEQ ID NO: 173833 - RNA, 19 nt, Homo sapiens
caagggauccacuaagaag

SEQ ID NO: 173834 - RNA, 19 nt, Homo sapiens
gggacugguugccaugaga

SEQ ID NO: 173835 - RNA, 19 nt, Homo sapiens
ggccauugaugccucuaug

SEQ ID NO: 173836 - RNA, 19 nt, Homo sapiens
gaacugcugagagaagaug

SEQ ID NO: 173837 - RNA, 19 nt, Homo sapiens
ggaccuagacugugcuuuu

SEQ ID NO: 173838 - RNA, 19 nt, Homo sapiens
gaugguggaccuagacugu

SEQ ID NO: 173839 - RNA, 19 nt, Homo sapiens
ugauagauagcaacaaguu

SEQ ID NO: 173840 - RNA, 19 nt, Homo sapiens
cuuguacccuuaagagcua

SEQ ID NO: 173841 - RNA, 19 nt, Homo sapiens
gauguucaccuggcaauca

SEQ ID NO: 173842 - RNA, 19 nt, Homo sapiens
cuaugagcauuuaucaguu

SEQ ID NO: 173843 - RNA, 19 nt, Homo sapiens
cagaaacucgaacuugcua

SEQ ID NO: 173844 - RNA, 19 nt, Homo sapiens
ccaagggauccacuaagaa

SEQ ID NO: 173845 - RNA, 19 nt, Homo sapiens
uggaauaagacacugguuu

SEQ ID NO: 173846 - RNA, 19 nt, Homo sapiens
cuauguaauuugugucuag

SEQ ID NO: 173847 - RNA, 19 nt, Homo sapiens
ccgccuggaugauuucuuc

SEQ ID NO: 173848 - RNA, 19 nt, Homo sapiens
aguugagacuuuggaauaa

SEQ ID NO: 173849 - RNA, 19 nt, Homo sapiens
gcuauguaauuugugucua

SEQ ID NO: 173850 - RNA, 19 nt, Homo sapiens
gugaaaagcaguucucuga

SEQ ID NO: 173851 - RNA, 19 nt, Homo sapiens
acaagagcaucgaggagau

SEQ ID NO: 173852 - RNA, 19 nt, Homo sapiens
aacucgaacuugcuaugua

SEQ ID NO: 173853 - RNA, 19 nt, Homo sapiens
gagaagaugggcagaaagc

SEQ ID NO: 173854 - RNA, 19 nt, Homo sapiens
gagcuacuuuggccguaag

SEQ ID NO: 173855 - RNA, 19 nt, Homo sapiens
gaaggcuggcaaagucuau

SEQ ID NO: 173856 - RNA, 19 nt, Homo sapiens
gcccguguaugucuuugau

SEQ ID NO: 173857 - RNA, 19 nt, Homo sapiens
ucuaugagcauuuaucagu

SEQ ID NO: 173858 - RNA, 19 nt, Homo sapiens
ccagucaucccuccucugu

SEQ ID NO: 173859 - RNA, 19 nt, Homo sapiens
gaaguggagcgagccaaau

SEQ ID NO: 173860 - RNA, 19 nt, Homo sapiens
ugucuugggugggcagaaa

SEQ ID NO: 173861 - RNA, 19 nt, Homo sapiens
ugucuguguuugugacuga

SEQ ID NO: 173862 - RNA, 19 nt, Homo sapiens
agugauagauagcaacaag

SEQ ID NO: 173863 - RNA, 19 nt, Homo sapiens
gagaucgugcggcgacuug

SEQ ID NO: 173864 - RNA, 19 nt, Homo sapiens
gcaagccgccacagcucaa

SEQ ID NO: 173865 - RNA, 19 nt, Homo sapiens
gaggaacugcugagagaag

SEQ ID NO: 173866 - RNA, 19 nt, Homo sapiens
ugaaguggagcgagccaaa

SEQ ID NO: 173867 - RNA, 19 nt, Homo sapiens
gagaguauccgggguauug

SEQ ID NO: 173868 - RNA, 19 nt, Homo sapiens
gaaccaggaacaguuugug

SEQ ID NO: 173869 - RNA, 19 nt, Homo sapiens
uggaugauuucuucaaggu

SEQ ID NO: 173870 - RNA, 19 nt, Homo sapiens
gagaagggagagcgagcuu

SEQ ID NO: 173871 - RNA, 19 nt, Homo sapiens
gggucaagaggcugaguaa

SEQ ID NO: 173872 - RNA, 19 nt, Homo sapiens
cgagccaaaugaagaagag

SEQ ID NO: 173873 - RNA, 19 nt, Homo sapiens
uugagacuuuggaauaaga

SEQ ID NO: 173874 - RNA, 19 nt, Homo sapiens
guuauucagaggaguaaga

SEQ ID NO: 173875 - RNA, 19 nt, Homo sapiens
gcagaaacucgaacuugcu

SEQ ID NO: 173876 - RNA, 19 nt, Homo sapiens
cuguguuugugacugauua

SEQ ID NO: 173877 - RNA, 19 nt, Homo sapiens
gaagacauauggccauuua

SEQ ID NO: 173878 - RNA, 19 nt, Homo sapiens
ggacaacaauguacaguuu

SEQ ID NO: 173879 - RNA, 19 nt, Homo sapiens
gaucucgccuuguuucuua

SEQ ID NO: 173880 - RNA, 19 nt, Homo sapiens
gaagauuucugaugcuauu

SEQ ID NO: 173881 - RNA, 19 nt, Homo sapiens
gcagugcccuucagaguuu

SEQ ID NO: 173882 - RNA, 19 nt, Homo sapiens
gcagagaaaucccugaaug

SEQ ID NO: 173883 - RNA, 19 nt, Homo sapiens
guaaacagaggcuuaauuu

SEQ ID NO: 173884 - RNA, 19 nt, Homo sapiens
ccauuaagaucccaacuaa

SEQ ID NO: 173885 - RNA, 19 nt, Homo sapiens
agaaguagccaguuauuua

SEQ ID NO: 173886 - RNA, 19 nt, Homo sapiens
uuaaauagcuguacagaag

SEQ ID NO: 173887 - RNA, 19 nt, Homo sapiens
gacguggacuucuuugaua

SEQ ID NO: 173888 - RNA, 19 nt, Homo sapiens
agaaaucccugaaugauau

SEQ ID NO: 173889 - RNA, 19 nt, Homo sapiens
gggaauagcugucaacacu

SEQ ID NO: 173890 - RNA, 19 nt, Homo sapiens
gaggaugacuguuggaaug

SEQ ID NO: 173891 - RNA, 19 nt, Homo sapiens
uggaagaaaugcuaaauga

SEQ ID NO: 173892 - RNA, 19 nt, Homo sapiens
gagaaaucccugaaugaua

SEQ ID NO: 173893 - RNA, 19 nt, Homo sapiens
caagaaguuugaugaauuc

SEQ ID NO: 173894 - RNA, 19 nt, Homo sapiens
ggaagagacugcagacuac

SEQ ID NO: 173895 - RNA, 19 nt, Homo sapiens
gcaaugaggaugacuguug

SEQ ID NO: 173896 - RNA, 19 nt, Homo sapiens
gaacuagguguccagauuu

SEQ ID NO: 173897 - RNA, 19 nt, Homo sapiens
aaacguggcuaacagugua

SEQ ID NO: 173898 - RNA, 19 nt, Homo sapiens
gaagagugccaaugagaaa

SEQ ID NO: 173899 - RNA, 19 nt, Homo sapiens
aguauaaggugucucauuu

SEQ ID NO: 173900 - RNA, 19 nt, Homo sapiens
gaugaagaaugcauacaau

SEQ ID NO: 173901 - RNA, 19 nt, Homo sapiens
gaaguagccaguuauuuau

SEQ ID NO: 173902 - RNA, 19 nt, Homo sapiens
caaaggacuugccaugguu

SEQ ID NO: 173903 - RNA, 19 nt, Homo sapiens
gaacgacguggacuucuuu

SEQ ID NO: 173904 - RNA, 19 nt, Homo sapiens
ugaaacaggccaagaaauu

SEQ ID NO: 173905 - RNA, 19 nt, Homo sapiens
ccaaaggcuucaacaagaa

SEQ ID NO: 173906 - RNA, 19 nt, Homo sapiens
caaaggaguucccagaagu

SEQ ID NO: 173907 - RNA, 19 nt, Homo sapiens
uauaaggugucucauuuga

SEQ ID NO: 173908 - RNA, 19 nt, Homo sapiens
gcagagagaguggagauaa

SEQ ID NO: 173909 - RNA, 19 nt, Homo sapiens
uauuagaaguagccaguua

SEQ ID NO: 173910 - RNA, 19 nt, Homo sapiens
gcauguguaucuccauuug

SEQ ID NO: 173911 - RNA, 19 nt, Homo sapiens
agaacuagguguccagauu

SEQ ID NO: 173912 - RNA, 19 nt, Homo sapiens
uaucacauguucacacuug

SEQ ID NO: 173913 - RNA, 19 nt, Homo sapiens
ggaaguggcugugaguauc

SEQ ID NO: 173914 - RNA, 19 nt, Homo sapiens
ggaacgacguggacuucuu

SEQ ID NO: 173915 - RNA, 19 nt, Homo sapiens
gaagaaaugcuaaaugacu

SEQ ID NO: 173916 - RNA, 19 nt, Homo sapiens
agacauauggccauuuaua

SEQ ID NO: 173917 - RNA, 19 nt, Homo sapiens
ggagagacguggaggugau

SEQ ID NO: 173918 - RNA, 19 nt, Homo sapiens
ggacuucuuugauaucagu

SEQ ID NO: 173919 - RNA, 19 nt, Homo sapiens
gaggauggcugcaggaaac

SEQ ID NO: 173920 - RNA, 19 nt, Homo sapiens
gauaauaguguucaagugu

SEQ ID NO: 173921 - RNA, 19 nt, Homo sapiens
gugcuacgauccaagauau

SEQ ID NO: 173922 - RNA, 19 nt, Homo sapiens
gcaagaugaagaaugcaua

SEQ ID NO: 173923 - RNA, 19 nt, Homo sapiens
gaaccuggaagaaaugcua

SEQ ID NO: 173924 - RNA, 19 nt, Homo sapiens
ggagaugucccucgcaaau

SEQ ID NO: 173925 - RNA, 19 nt, Homo sapiens
gguuauguguacuucauuu

SEQ ID NO: 173926 - RNA, 19 nt, Homo sapiens
agaaggagguuauguguac

SEQ ID NO: 173927 - RNA, 19 nt, Homo sapiens
gaaacaggccaagaaauuc

SEQ ID NO: 173928 - RNA, 19 nt, Homo sapiens
uuacugaugucaaggagaa

SEQ ID NO: 173929 - RNA, 19 nt, Homo sapiens
ggauaauaguguucaagug

SEQ ID NO: 173930 - RNA, 19 nt, Homo sapiens
gaacaugcaggauaauagu

SEQ ID NO: 173931 - RNA, 19 nt, Homo sapiens
gagcaaggucuccguggua

SEQ ID NO: 173932 - RNA, 19 nt, Homo sapiens
gaacucccaguaccacuuu

SEQ ID NO: 173933 - RNA, 19 nt, Homo sapiens
ucguagaguugaaacguua

SEQ ID NO: 173934 - RNA, 19 nt, Homo sapiens
gaaaagggacugugcauug

SEQ ID NO: 173935 - RNA, 19 nt, Homo sapiens
gaagccauguuacaacuac

SEQ ID NO: 173936 - RNA, 19 nt, Homo sapiens
caacggugaucauuugaag

SEQ ID NO: 173937 - RNA, 19 nt, Homo sapiens
ggaagagugccaaugagaa

SEQ ID NO: 173938 - RNA, 19 nt, Homo sapiens
uccaaaggcuucaacaaga

SEQ ID NO: 173939 - RNA, 19 nt, Homo sapiens
gaaaguaguggagaaggaa

SEQ ID NO: 173940 - RNA, 19 nt, Homo sapiens
uacuuucgcucaaggcuua

SEQ ID NO: 173941 - RNA, 19 nt, Homo sapiens
gaaaugugaaccuggaaga

SEQ ID NO: 173942 - RNA, 19 nt, Homo sapiens
cugagaauacuacaucuua

SEQ ID NO: 173943 - RNA, 19 nt, Homo sapiens
gagguuauguguacuucau

SEQ ID NO: 173944 - RNA, 19 nt, Homo sapiens
cuucagaguuugacuacaa

SEQ ID NO: 173945 - RNA, 19 nt, Homo sapiens
gaggguccuuucaacauug

SEQ ID NO: 173946 - RNA, 19 nt, Homo sapiens
guagguagagcugagaaua

SEQ ID NO: 173947 - RNA, 19 nt, Homo sapiens
gagauuucaaacccaauua

SEQ ID NO: 173948 - RNA, 19 nt, Homo sapiens
uagaaagcauucaggaugu

SEQ ID NO: 173949 - RNA, 19 nt, Homo sapiens
caaagcaucaauccaagaa

SEQ ID NO: 173950 - RNA, 19 nt, Homo sapiens
gaauggaacaauuucauag

SEQ ID NO: 173951 - RNA, 19 nt, Homo sapiens
gcgaacagugcaaucauuu

SEQ ID NO: 173952 - RNA, 19 nt, Homo sapiens
gagguuguuuguguuauug

SEQ ID NO: 173953 - RNA, 19 nt, Homo sapiens
gcaaugugcuacgauccaa

SEQ ID NO: 173954 - RNA, 19 nt, Homo sapiens
ugaaaguaguggagaagga

SEQ ID NO: 173955 - RNA, 19 nt, Homo sapiens
gaaacggcaaugaggauga

SEQ ID NO: 173956 - RNA, 19 nt, Homo sapiens
ucaagugucucagaagguu

SEQ ID NO: 173957 - RNA, 19 nt, Homo sapiens
agaugucccucgcaaauug

SEQ ID NO: 173958 - RNA, 19 nt, Homo sapiens
gaaugugugagcaaguaua

SEQ ID NO: 173959 - RNA, 19 nt, Homo sapiens
aaagagguuguuuguguua

SEQ ID NO: 173960 - RNA, 19 nt, Homo sapiens
gagcugagaauacuacauc

SEQ ID NO: 173961 - RNA, 19 nt, Homo sapiens
gaaauggauuagccaacca

SEQ ID NO: 173962 - RNA, 19 nt, Homo sapiens
ccucccagcuggacgaauu

SEQ ID NO: 173963 - RNA, 19 nt, Homo sapiens
aaauugaagcuccagguua

SEQ ID NO: 173964 - RNA, 19 nt, Homo sapiens
ucaaaggaguucccagaag

SEQ ID NO: 173965 - RNA, 19 nt, Homo sapiens
acacugacccuauuugaau

SEQ ID NO: 173966 - RNA, 19 nt, Homo sapiens
ccagcaagaugaagaaugc

SEQ ID NO: 173967 - RNA, 19 nt, Homo sapiens
auacugauccuucgucaaa

SEQ ID NO: 173968 - RNA, 19 nt, Homo sapiens
gcaaaguaaagaugauuuc

SEQ ID NO: 173969 - RNA, 19 nt, Homo sapiens
gugaagauuucugaugcua

SEQ ID NO: 173970 - RNA, 19 nt, Homo sapiens
ccaaggggaucucgauuuu

SEQ ID NO: 173971 - RNA, 19 nt, Homo sapiens
gaguauaaggugucucauu

SEQ ID NO: 173972 - RNA, 19 nt, Homo sapiens
caagaaggagguuaugugu

SEQ ID NO: 173973 - RNA, 19 nt, Homo sapiens
cagccaaggagcccacuua

SEQ ID NO: 173974 - RNA, 19 nt, Homo sapiens
acaaaggacuugccauggu

SEQ ID NO: 173975 - RNA, 19 nt, Homo sapiens
cucaagagauggaggagaa

SEQ ID NO: 173976 - RNA, 19 nt, Homo sapiens
ugacugugaagccauguua

SEQ ID NO: 173977 - RNA, 19 nt, Homo sapiens
gcagaaaguuugcaaguaa

SEQ ID NO: 173978 - RNA, 19 nt, Homo sapiens
ggagugaccugaagaauuc

SEQ ID NO: 173979 - RNA, 19 nt, Homo sapiens
gaagaagucugauauugug

SEQ ID NO: 173980 - RNA, 19 nt, Homo sapiens
uaaagcagauucccauuaa

SEQ ID NO: 173981 - RNA, 19 nt, Homo sapiens
gaagaugcacgaucaguua

SEQ ID NO: 173982 - RNA, 19 nt, Homo sapiens
ggaaaguacuguccaaaug

SEQ ID NO: 173983 - RNA, 19 nt, Homo sapiens
gagaagaagucugauauug

SEQ ID NO: 173984 - RNA, 19 nt, Homo sapiens
gaacaacggcugcuaaaga

SEQ ID NO: 173985 - RNA, 19 nt, Homo sapiens
gaagagaauugaagaaucu

SEQ ID NO: 173986 - RNA, 19 nt, Homo sapiens
gaacagauagauccuagua

SEQ ID NO: 173987 - RNA, 19 nt, Homo sapiens
gaagaaggaugaacuaaaa

SEQ ID NO: 173988 - RNA, 19 nt, Homo sapiens
gaucaucacuauacaacaa

SEQ ID NO: 173989 - RNA, 19 nt, Homo sapiens
guauucaucuucuggcuua

SEQ ID NO: 173990 - RNA, 19 nt, Homo sapiens
gaaaucagguguaguucug

SEQ ID NO: 173991 - RNA, 19 nt, Homo sapiens
gaauuacgguuacuggaaa

SEQ ID NO: 173992 - RNA, 19 nt, Homo sapiens
gcaaugaacaguaguaaga

SEQ ID NO: 173993 - RNA, 19 nt, Homo sapiens
gggcacagcuccaucagaa

SEQ ID NO: 173994 - RNA, 19 nt, Homo sapiens
gaaagaggauaccggaugu

SEQ ID NO: 173995 - RNA, 19 nt, Homo sapiens
cgacaaagccacaaugaaa

SEQ ID NO: 173996 - RNA, 19 nt, Homo sapiens
aaacagaauuggagaaguu

SEQ ID NO: 173997 - RNA, 19 nt, Homo sapiens
gcagagaugaucaagguua

SEQ ID NO: 173998 - RNA, 19 nt, Homo sapiens
gaauauguccuuucuguau

SEQ ID NO: 173999 - RNA, 19 nt, Homo sapiens
gaacaacuuaguaggauaa

SEQ ID NO: 174000 - RNA, 19 nt, Homo sapiens
gaaaguacuguccaaauga

SEQ ID NO: 174001 - RNA, 19 nt, Homo sapiens
uaagauaugugcugauuag

SEQ ID NO: 174002 - RNA, 19 nt, Homo sapiens
caaaacaggucaucacuaa

SEQ ID NO: 174003 - RNA, 19 nt, Homo sapiens
gaggauaaccagugccuua

SEQ ID NO: 174004 - RNA, 19 nt, Homo sapiens
gagaggcuauccaaauuug

SEQ ID NO: 174005 - RNA, 19 nt, Homo sapiens
ugaagaagaugcacgauca

SEQ ID NO: 174006 - RNA, 19 nt, Homo sapiens
gaaagagccaccuccagua

SEQ ID NO: 174007 - RNA, 19 nt, Homo sapiens
agaaagagcucacuaucau

SEQ ID NO: 174008 - RNA, 19 nt, Homo sapiens
caacuuaguaggauaauga

SEQ ID NO: 174009 - RNA, 19 nt, Homo sapiens
ggaagaaggaugaacuaaa

SEQ ID NO: 174010 - RNA, 19 nt, Homo sapiens
aaacuucuguugcuguuaa

SEQ ID NO: 174011 - RNA, 19 nt, Homo sapiens
gaggagacauuuuaucaua

SEQ ID NO: 174012 - RNA, 19 nt, Homo sapiens
gaauaugcaucuacuuuac

SEQ ID NO: 174013 - RNA, 19 nt, Homo sapiens
ggacagaggagacauuuua

SEQ ID NO: 174014 - RNA, 19 nt, Homo sapiens
gaauguccauaaagagauu

SEQ ID NO: 174015 - RNA, 19 nt, Homo sapiens
uaagaaaucagguguaguu

SEQ ID NO: 174016 - RNA, 19 nt, Homo sapiens
gaaaggagaggcuauccaa

SEQ ID NO: 174017 - RNA, 19 nt, Homo sapiens
gaucauguggaauaacuua

SEQ ID NO: 174018 - RNA, 19 nt, Homo sapiens
gauaugugcugauuagaag

SEQ ID NO: 174019 - RNA, 19 nt, Homo sapiens
cagccugucuacaucauua

SEQ ID NO: 174020 - RNA, 19 nt, Homo sapiens
gcaauaugaucaucccaau

SEQ ID NO: 174021 - RNA, 19 nt, Homo sapiens
ugggaaaccuggugaauau

SEQ ID NO: 174022 - RNA, 19 nt, Homo sapiens
gugaauauguccuuucugu

SEQ ID NO: 174023 - RNA, 19 nt, Homo sapiens
gaacaguaguaagauaugu

SEQ ID NO: 174024 - RNA, 19 nt, Homo sapiens
ucaaacauuccucaacuua

SEQ ID NO: 174025 - RNA, 19 nt, Homo sapiens
aauagaagcucaagaacug

SEQ ID NO: 174026 - RNA, 19 nt, Homo sapiens
gagaugcacugaagcaaag

SEQ ID NO: 174027 - RNA, 19 nt, Homo sapiens
uaaccagucuugucacaga

SEQ ID NO: 174028 - RNA, 19 nt, Homo sapiens
gaaaugaauucugccaaag

SEQ ID NO: 174029 - RNA, 19 nt, Homo sapiens
gaaccuuuguaaucaaguu

SEQ ID NO: 174030 - RNA, 19 nt, Homo sapiens
gauaaccagugccuuacaa

SEQ ID NO: 174031 - RNA, 19 nt, Homo sapiens
ucaguuacaucuauggaaa

SEQ ID NO: 174032 - RNA, 19 nt, Homo sapiens
caccggaagcucuuaauua

SEQ ID NO: 174033 - RNA, 19 nt, Homo sapiens
gaugcaagaagaaaugaua

SEQ ID NO: 174034 - RNA, 19 nt, Homo sapiens
gcagauagaggcagagaug

SEQ ID NO: 174035 - RNA, 19 nt, Homo sapiens
guacuguccaaaugaauua

SEQ ID NO: 174036 - RNA, 19 nt, Homo sapiens
ccaaaauucucaagcaaua

SEQ ID NO: 174037 - RNA, 19 nt, Homo sapiens
ggucaucacuaagaaauca

SEQ ID NO: 174038 - RNA, 19 nt, Homo sapiens
cagaauagaagcucaagaa

SEQ ID NO: 174039 - RNA, 19 nt, Homo sapiens
gcaagaaaaugaugggaaa

SEQ ID NO: 174040 - RNA, 19 nt, Homo sapiens
gaagaaaaguuacauaggu

SEQ ID NO: 174041 - RNA, 19 nt, Homo sapiens
cuugaacucuggaccuuua

SEQ ID NO: 174042 - RNA, 19 nt, Homo sapiens
ggaauuacgguuacuggaa

SEQ ID NO: 174043 - RNA, 19 nt, Homo sapiens
cggaagcucuuaauuaugg

SEQ ID NO: 174044 - RNA, 19 nt, Homo sapiens
gaaaaucagugacuuugga

SEQ ID NO: 174045 - RNA, 19 nt, Homo sapiens
uuucauagauguucacaga

SEQ ID NO: 174046 - RNA, 19 nt, Homo sapiens
gauagauccuaguacagaa

SEQ ID NO: 174047 - RNA, 19 nt, Homo sapiens
gaauaaugacgcauaccua

SEQ ID NO: 174048 - RNA, 19 nt, Homo sapiens
ggagaggcuauccaaauuu

SEQ ID NO: 174049 - RNA, 19 nt, Homo sapiens
gauauugugcuucugcuaa

SEQ ID NO: 174050 - RNA, 19 nt, Homo sapiens
gaccagcaaugaacaguag

SEQ ID NO: 174051 - RNA, 19 nt, Homo sapiens
gaugaaguguugggauuau

SEQ ID NO: 174052 - RNA, 19 nt, Homo sapiens
guauauaagggcacauuaa

SEQ ID NO: 174053 - RNA, 19 nt, Homo sapiens
aaacaggucaucacuaaga

SEQ ID NO: 174054 - RNA, 19 nt, Homo sapiens
cagaggaaauagugaaugu

SEQ ID NO: 174055 - RNA, 19 nt, Homo sapiens
gagauacaguucagagagu

SEQ ID NO: 174056 - RNA, 19 nt, Homo sapiens
uguuguaucucgagaguaa

SEQ ID NO: 174057 - RNA, 19 nt, Homo sapiens
gagaucauguggaauaacu

SEQ ID NO: 174058 - RNA, 19 nt, Homo sapiens
gaacaagaaauagaguuug

SEQ ID NO: 174059 - RNA, 19 nt, Homo sapiens
gauaaccagucuugucaca

SEQ ID NO: 174060 - RNA, 19 nt, Homo sapiens
cagcagacagaacaacuua

SEQ ID NO: 174061 - RNA, 19 nt, Homo sapiens
ucacuaucaucaagagaaa

SEQ ID NO: 174062 - RNA, 19 nt, Homo sapiens
gaaaaucgcccuaaguuca

SEQ ID NO: 174063 - RNA, 19 nt, Homo sapiens
cggaagaacuuaugcaaac

SEQ ID NO: 174064 - RNA, 19 nt, Homo sapiens
acagauagauccuaguaca

SEQ ID NO: 174065 - RNA, 19 nt, Homo sapiens
ugucauauugggagaauua

SEQ ID NO: 174066 - RNA, 19 nt, Homo sapiens
gaaauggauucucagucau

SEQ ID NO: 174067 - RNA, 19 nt, Homo sapiens
gaaagaaaggagaggcuau

SEQ ID NO: 174068 - RNA, 19 nt, Homo sapiens
caccuccaguaguaaauua

SEQ ID NO: 174069 - RNA, 19 nt, Homo sapiens
gcacagaaggaauuacuag

SEQ ID NO: 174070 - RNA, 19 nt, Homo sapiens
cagcugagaugcacugaag

SEQ ID NO: 174071 - RNA, 19 nt, Homo sapiens
ggaagaacuuaugcaaaca

SEQ ID NO: 174072 - RNA, 19 nt, Homo sapiens
gaugaauacagccagauaa

SEQ ID NO: 174073 - RNA, 19 nt, Homo sapiens
uaaaagcacucaaagguau

SEQ ID NO: 174074 - RNA, 19 nt, Homo sapiens
aaaguacuguccaaaugaa

SEQ ID NO: 174075 - RNA, 19 nt, Homo sapiens
aaacggccaucacugaaga

SEQ ID NO: 174076 - RNA, 19 nt, Homo sapiens
gcuaaggcaugaccagcaa

SEQ ID NO: 174077 - RNA, 19 nt, Homo sapiens
ggaacugccuggugacaga

SEQ ID NO: 174078 - RNA, 19 nt, Homo sapiens
agaagaauguccugaagau

SEQ ID NO: 174079 - RNA, 19 nt, Homo sapiens
cgaggauccugaagcagua

SEQ ID NO: 174080 - RNA, 19 nt, Homo sapiens
aggaauaccuggagauuag

SEQ ID NO: 174081 - RNA, 19 nt, Homo sapiens
caacaucgugcgucucauu

SEQ ID NO: 174082 - RNA, 19 nt, Homo sapiens
ccagagcuguguccugaug

SEQ ID NO: 174083 - RNA, 19 nt, Homo sapiens
caagaagagugguguuguc

SEQ ID NO: 174084 - RNA, 19 nt, Homo sapiens
aacaggagcuccggaauga

SEQ ID NO: 174085 - RNA, 19 nt, Homo sapiens
gagaagaauguccugaaga

SEQ ID NO: 174086 - RNA, 19 nt, Homo sapiens
ccacaucucaggaaucuuc

SEQ ID NO: 174087 - RNA, 19 nt, Homo sapiens
caacaggagcuccggaaug

SEQ ID NO: 174088 - RNA, 19 nt, Homo sapiens
ugaccucagugacagauga

SEQ ID NO: 174089 - RNA, 19 nt, Homo sapiens
caccugaggcccuuaacua

SEQ ID NO: 174090 - RNA, 19 nt, Homo sapiens
uggaguaccuggagagcaa

SEQ ID NO: 174091 - RNA, 19 nt, Homo sapiens
ggccaaguuucuacaggaa

SEQ ID NO: 174092 - RNA, 19 nt, Homo sapiens
gguguugggugagcagauu

SEQ ID NO: 174093 - RNA, 19 nt, Homo sapiens
gcucuuugcucaccacaac

SEQ ID NO: 174094 - RNA, 19 nt, Homo sapiens
aagaauguccugaagauca

SEQ ID NO: 174095 - RNA, 19 nt, Homo sapiens
gcacuaugggcuucucuuc

SEQ ID NO: 174096 - RNA, 19 nt, Homo sapiens
gcucaucgaccaccuacug

SEQ ID NO: 174097 - RNA, 19 nt, Homo sapiens
guggagcuuuggcaucuug

SEQ ID NO: 174098 - RNA, 19 nt, Homo sapiens
cacgggaguuuguggagaa

SEQ ID NO: 174099 - RNA, 19 nt, Homo sapiens
agagaagaauguccugaag

SEQ ID NO: 174100 - RNA, 19 nt, Homo sapiens
gcucccaccugaccucaag

SEQ ID NO: 174101 - RNA, 19 nt, Homo sapiens
cagagaagaauguccugaa

SEQ ID NO: 174102 - RNA, 19 nt, Homo sapiens
acaagugggugcugaacca

SEQ ID NO: 174103 - RNA, 19 nt, Homo sapiens
gagaucaccagccaaacug

SEQ ID NO: 174104 - RNA, 19 nt, Homo sapiens
gaagcagcccaucuacauc

SEQ ID NO: 174105 - RNA, 19 nt, Homo sapiens
agaagcagcccaucuacau

SEQ ID NO: 174106 - RNA, 19 nt, Homo sapiens
agaggcaagugcugcaaga

SEQ ID NO: 174107 - RNA, 19 nt, Homo sapiens
aagcgaggauccugaagca

SEQ ID NO: 174108 - RNA, 19 nt, Homo sapiens
ugcaugagcagcuguggua

SEQ ID NO: 174109 - RNA, 19 nt, Homo sapiens
ggacacccacgcuggagau

SEQ ID NO: 174110 - RNA, 19 nt, Homo sapiens
gccaggacauugagaagcu

SEQ ID NO: 174111 - RNA, 19 nt, Homo sapiens
gaagaauguccugaagauc

SEQ ID NO: 174112 - RNA, 19 nt, Homo sapiens
gugaagucuugucgagaga

SEQ ID NO: 174113 - RNA, 19 nt, Homo sapiens
agugggugcugaaccauga

SEQ ID NO: 174114 - RNA, 19 nt, Homo sapiens
cagcaggagcucaccaaga

SEQ ID NO: 174115 - RNA, 19 nt, Homo sapiens
uaaccuguaccgacuggaa

SEQ ID NO: 174116 - RNA, 19 nt, Homo sapiens
ggaaugaagaggagaacac

SEQ ID NO: 174117 - RNA, 19 nt, Homo sapiens
agacaaggaccgugacaag

SEQ ID NO: 174118 - RNA, 19 nt, Homo sapiens
gaaacaauaaaaccacuug

SEQ ID NO: 174119 - RNA, 19 nt, Homo sapiens
cccagaagcagcccaucua

SEQ ID NO: 174120 - RNA, 19 nt, Homo sapiens
ggacugcuucaccacaugu

SEQ ID NO: 174121 - RNA, 19 nt, Homo sapiens
gcaacaggagcuccggaau

SEQ ID NO: 174122 - RNA, 19 nt, Homo sapiens
guaccaggaggccagcaaa

SEQ ID NO: 174123 - RNA, 19 nt, Homo sapiens
cuuccgggcagaaacaaua

SEQ ID NO: 174124 - RNA, 19 nt, Homo sapiens
cccagcgggucaagaguga

SEQ ID NO: 174125 - RNA, 19 nt, Homo sapiens
caucgugcgucucauuggu

SEQ ID NO: 174126 - RNA, 19 nt, Homo sapiens
ccucaaggccaaguuucua

SEQ ID NO: 174127 - RNA, 19 nt, Homo sapiens
cagcggcuccagcucauau

SEQ ID NO: 174128 - RNA, 19 nt, Homo sapiens
cagcagacacgggaguuug

SEQ ID NO: 174129 - RNA, 19 nt, Homo sapiens
guguggagcuuuggcaucu

SEQ ID NO: 174130 - RNA, 19 nt, Homo sapiens
ugaccucaaggccaaguuu

SEQ ID NO: 174131 - RNA, 19 nt, Homo sapiens
ggccgcuacuccuccgaaa

SEQ ID NO: 174132 - RNA, 19 nt, Homo sapiens
caggacugcuucaccacau

SEQ ID NO: 174133 - RNA, 19 nt, Homo sapiens
ccaagaagagugguguugu

SEQ ID NO: 174134 - RNA, 19 nt, Homo sapiens
aggaguugcugcagaccaa

SEQ ID NO: 174135 - RNA, 19 nt, Homo sapiens
acgaggagauggcuugcau

SEQ ID NO: 174136 - RNA, 19 nt, Homo sapiens
ggaagccgauggggucuau

SEQ ID NO: 174137 - RNA, 19 nt, Homo sapiens
ugguggcggugaagucuug

SEQ ID NO: 174138 - RNA, 19 nt, Homo sapiens
ggaggccgagcuucgucua

SEQ ID NO: 174139 - RNA, 19 nt, Homo sapiens
ggcagcagcuucgcaagac

SEQ ID NO: 174140 - RNA, 19 nt, Homo sapiens
agcaggagcucaccaagac

SEQ ID NO: 174141 - RNA, 19 nt, Homo sapiens
accaggagcugcagagcau

SEQ ID NO: 174142 - RNA, 19 nt, Homo sapiens
caggagcuccggaaugaag

SEQ ID NO: 174143 - RNA, 19 nt, Homo sapiens
ccucagcaaucagcagaca

SEQ ID NO: 174144 - RNA, 19 nt, Homo sapiens
gcauuccuuugcucaucga

SEQ ID NO: 174145 - RNA, 19 nt, Homo sapiens
gaaggcuuuccuagcauuc

SEQ ID NO: 174146 - RNA, 19 nt, Homo sapiens
guccuuggauaaccuguac

SEQ ID NO: 174147 - RNA, 19 nt, Homo sapiens
caagagugacagggaguau

SEQ ID NO: 174148 - RNA, 19 nt, Homo sapiens
gaaagccucucacuaagua

SEQ ID NO: 174149 - RNA, 19 nt, Homo sapiens
gaaugaagcuuaugcagaa

SEQ ID NO: 174150 - RNA, 19 nt, Homo sapiens
gaucuaaguugcaucuuua

SEQ ID NO: 174151 - RNA, 19 nt, Homo sapiens
uaaacaaucucccaaguau

SEQ ID NO: 174152 - RNA, 19 nt, Homo sapiens
caaagaaguuaccaaagaa

SEQ ID NO: 174153 - RNA, 19 nt, Homo sapiens
uaacaguccuuaugagauu

SEQ ID NO: 174154 - RNA, 19 nt, Homo sapiens
ggagcacucugucuucuuu

SEQ ID NO: 174155 - RNA, 19 nt, Homo sapiens
acaaagaaguuaccaaaga

SEQ ID NO: 174156 - RNA, 19 nt, Homo sapiens
ccaauaggcugaagaagug

SEQ ID NO: 174157 - RNA, 19 nt, Homo sapiens
gaagagaacugugcagaag

SEQ ID NO: 174158 - RNA, 19 nt, Homo sapiens
gcaaacaauuuacuaguag

SEQ ID NO: 174159 - RNA, 19 nt, Homo sapiens
gaaaccaguuccagacuug

SEQ ID NO: 174160 - RNA, 19 nt, Homo sapiens
ggaggcuggugguauaaua

SEQ ID NO: 174161 - RNA, 19 nt, Homo sapiens
uuacuucccucuagagaua

SEQ ID NO: 174162 - RNA, 19 nt, Homo sapiens
ggcuuuagcucgugaagua

SEQ ID NO: 174163 - RNA, 19 nt, Homo sapiens
ggacugggcugggaaugaa

SEQ ID NO: 174164 - RNA, 19 nt, Homo sapiens
gaagaggugucaggaaaug

SEQ ID NO: 174165 - RNA, 19 nt, Homo sapiens
ugaaaggguugauugauga

SEQ ID NO: 174166 - RNA, 19 nt, Homo sapiens
gaagugaagccgaucauga

SEQ ID NO: 174167 - RNA, 19 nt, Homo sapiens
ggacauugauauuaagauc

SEQ ID NO: 174168 - RNA, 19 nt, Homo sapiens
gccaauaaccgugauaaua

SEQ ID NO: 174169 - RNA, 19 nt, Homo sapiens
ggucauugccaaagacuua

SEQ ID NO: 174170 - RNA, 19 nt, Homo sapiens
gagcucaguugguugauau

SEQ ID NO: 174171 - RNA, 19 nt, Homo sapiens
cuagagaaguggagagaaa

SEQ ID NO: 174172 - RNA, 19 nt, Homo sapiens
gaacugugcagaagucuau

SEQ ID NO: 174173 - RNA, 19 nt, Homo sapiens
gaucaugaaggaacacaua

SEQ ID NO: 174174 - RNA, 19 nt, Homo sapiens
uaacagacaugccgcagau

SEQ ID NO: 174175 - RNA, 19 nt, Homo sapiens
caaaggggcucuguucuua

SEQ ID NO: 174176 - RNA, 19 nt, Homo sapiens
caagagaggccaugcuaaa

SEQ ID NO: 174177 - RNA, 19 nt, Homo sapiens
ucuggcaucuucacaaaua

SEQ ID NO: 174178 - RNA, 19 nt, Homo sapiens
guaaagcaguugagauucu

SEQ ID NO: 174179 - RNA, 19 nt, Homo sapiens
aaccauagcugaccuuugu

SEQ ID NO: 174180 - RNA, 19 nt, Homo sapiens
uaggagaguuugucaguga

SEQ ID NO: 174181 - RNA, 19 nt, Homo sapiens
agagagaccugguggaaau

SEQ ID NO: 174182 - RNA, 19 nt, Homo sapiens
gaugaagacuggaacuaca

SEQ ID NO: 174183 - RNA, 19 nt, Homo sapiens
ucacaaagaaguuaccaaa

SEQ ID NO: 174184 - RNA, 19 nt, Homo sapiens
gagguggacauugauauua

SEQ ID NO: 174185 - RNA, 19 nt, Homo sapiens
guaagucguuaguucgaaa

SEQ ID NO: 174186 - RNA, 19 nt, Homo sapiens
ucaguugguugauaugaaa

SEQ ID NO: 174187 - RNA, 19 nt, Homo sapiens
gaacuggaaguacuggaaa

SEQ ID NO: 174188 - RNA, 19 nt, Homo sapiens
gacuggagguggacauuga

SEQ ID NO: 174189 - RNA, 19 nt, Homo sapiens
gaagacuauugguuugaga

SEQ ID NO: 174190 - RNA, 19 nt, Homo sapiens
gcaaagaauggauggauca

SEQ ID NO: 174191 - RNA, 19 nt, Homo sapiens
gagaggccaugcuaaaucu

SEQ ID NO: 174192 - RNA, 19 nt, Homo sapiens
gagaauggaguuagagaga

SEQ ID NO: 174193 - RNA, 19 nt, Homo sapiens
gaguacaccucucacaaca

SEQ ID NO: 174194 - RNA, 19 nt, Homo sapiens
caaugacuaccuccacuua

SEQ ID NO: 174195 - RNA, 19 nt, Homo sapiens
caaguuacagcaaacaauu

SEQ ID NO: 174196 - RNA, 19 nt, Homo sapiens
aaguagaucugaaggacua

SEQ ID NO: 174197 - RNA, 19 nt, Homo sapiens
ugaucuaaguugcaucuuu

SEQ ID NO: 174198 - RNA, 19 nt, Homo sapiens
ggucuggguuuccuuuaga

SEQ ID NO: 174199 - RNA, 19 nt, Homo sapiens
ggaagagaacugugcagaa

SEQ ID NO: 174200 - RNA, 19 nt, Homo sapiens
aaauguaagucguuaguuc

SEQ ID NO: 174201 - RNA, 19 nt, Homo sapiens
guacaccucucacaacaac

SEQ ID NO: 174202 - RNA, 19 nt, Homo sapiens
caaaguggcauuuucaaua

SEQ ID NO: 174203 - RNA, 19 nt, Homo sapiens
cgugguaaaucuucaaguu

SEQ ID NO: 174204 - RNA, 19 nt, Homo sapiens
aggcaacacuuaccacuga

SEQ ID NO: 174205 - RNA, 19 nt, Homo sapiens
ccaauaaccgugauaauac

SEQ ID NO: 174206 - RNA, 19 nt, Homo sapiens
ccauuuacuuuggucaaua

SEQ ID NO: 174207 - RNA, 19 nt, Homo sapiens
ccuuuaaacucuuccacua

SEQ ID NO: 174208 - RNA, 19 nt, Homo sapiens
ggagagaguaccacacaga

SEQ ID NO: 174209 - RNA, 19 nt, Homo sapiens
uugaagaggugucaggaaa

SEQ ID NO: 174210 - RNA, 19 nt, Homo sapiens
caacacuuaccacugauaa

SEQ ID NO: 174211 - RNA, 19 nt, Homo sapiens
ggagguggacauugauauu

SEQ ID NO: 174212 - RNA, 19 nt, Homo sapiens
cagccaaucucaauggaau

SEQ ID NO: 174213 - RNA, 19 nt, Homo sapiens
gaacacauagcaccaagag

SEQ ID NO: 174214 - RNA, 19 nt, Homo sapiens
gaauucccuucccguggua

SEQ ID NO: 174215 - RNA, 19 nt, Homo sapiens
gacacugccucaacuggaa

SEQ ID NO: 174216 - RNA, 19 nt, Homo sapiens
cgaagaugguucugacugu

SEQ ID NO: 174217 - RNA, 19 nt, Homo sapiens
gaaggacuaugaagaucag

SEQ ID NO: 174218 - RNA, 19 nt, Homo sapiens
caauaaggauucucauucg

SEQ ID NO: 174219 - RNA, 19 nt, Homo sapiens
ggucuugccuucugauuuu

SEQ ID NO: 174220 - RNA, 19 nt, Homo sapiens
cuuaugagauugagaaugg

SEQ ID NO: 174221 - RNA, 19 nt, Homo sapiens
gggcugggaaugaagcuua

SEQ ID NO: 174222 - RNA, 19 nt, Homo sapiens
ugaagccgaucaugaagga

SEQ ID NO: 174223 - RNA, 19 nt, Homo sapiens
gugguaaaucuucaaguua

SEQ ID NO: 174224 - RNA, 19 nt, Homo sapiens
ggaaguacuggaaaccaaa

SEQ ID NO: 174225 - RNA, 19 nt, Homo sapiens
cccaaggaguaaccaauuu

SEQ ID NO: 174226 - RNA, 19 nt, Homo sapiens
ccaagucuccuccuaugaa

SEQ ID NO: 174227 - RNA, 19 nt, Homo sapiens
cuaccgggauccaguaaga

SEQ ID NO: 174228 - RNA, 19 nt, Homo sapiens
ugucgagggucaugcagua

SEQ ID NO: 174229 - RNA, 19 nt, Homo sapiens
guugaccacuaauauaaug

SEQ ID NO: 174230 - RNA, 19 nt, Homo sapiens
gcuauaaaauggcagauga

SEQ ID NO: 174231 - RNA, 19 nt, Homo sapiens
gaaggcaagagaaacauuc

SEQ ID NO: 174232 - RNA, 19 nt, Homo sapiens
uagcugaccuuuguaguag

SEQ ID NO: 174233 - RNA, 19 nt, Homo sapiens
aaucuggcaucuucacaaa

SEQ ID NO: 174234 - RNA, 19 nt, Homo sapiens
gcagaugagaauggaguua

SEQ ID NO: 174235 - RNA, 19 nt, Homo sapiens
ggaugaaaggguugauuga

SEQ ID NO: 174236 - RNA, 19 nt, Homo sapiens
gaacaggucauugccaaag

SEQ ID NO: 174237 - RNA, 19 nt, Homo sapiens
cagaagaacaauaaggauu

SEQ ID NO: 174238 - RNA, 19 nt, Homo sapiens
ggaguaaccaauuucuuuc

SEQ ID NO: 174239 - RNA, 19 nt, Homo sapiens
caagggccauucaguacau

SEQ ID NO: 174240 - RNA, 19 nt, Homo sapiens
ugaagcuuaugcagaauau

SEQ ID NO: 174241 - RNA, 19 nt, Homo sapiens
gcugaccuuuguaguagaa

SEQ ID NO: 174242 - RNA, 19 nt, Homo sapiens
gacaauggcacucugaauc

SEQ ID NO: 174243 - RNA, 19 nt, Homo sapiens
gcaacacuuaccacugaua

SEQ ID NO: 174244 - RNA, 19 nt, Homo sapiens
gcccaaggguuguggaaag

SEQ ID NO: 174245 - RNA, 19 nt, Homo sapiens
ucucccaaguauugauuua

SEQ ID NO: 174246 - RNA, 19 nt, Homo sapiens
ggaaggcaagagaaacauu

SEQ ID NO: 174247 - RNA, 19 nt, Homo sapiens
gcuguucgcaugaaaauua

SEQ ID NO: 174248 - RNA, 19 nt, Homo sapiens
caaagaaguuaccaaagaa

SEQ ID NO: 174249 - RNA, 19 nt, Homo sapiens
acaaagaaguuaccaaaga

SEQ ID NO: 174250 - RNA, 19 nt, Homo sapiens
gcaaacaauuuacuaguag

SEQ ID NO: 174251 - RNA, 19 nt, Homo sapiens
gaaaccaguuccagacuug

SEQ ID NO: 174252 - RNA, 19 nt, Homo sapiens
uuacuucccucuagagaua

SEQ ID NO: 174253 - RNA, 19 nt, Homo sapiens
ggcuuuagcucgugaagua

SEQ ID NO: 174254 - RNA, 19 nt, Homo sapiens
gaagaggugucaggaaaug

SEQ ID NO: 174255 - RNA, 19 nt, Homo sapiens
ugaaaggguugauugauga

SEQ ID NO: 174256 - RNA, 19 nt, Homo sapiens
gaagugaagccgaucauga

SEQ ID NO: 174257 - RNA, 19 nt, Homo sapiens
ggacauugauauuaagauc

SEQ ID NO: 174258 - RNA, 19 nt, Homo sapiens
gccaauaaccgugauaaua

SEQ ID NO: 174259 - RNA, 19 nt, Homo sapiens
ggucauugccaaagacuua

SEQ ID NO: 174260 - RNA, 19 nt, Homo sapiens
gagcucaguugguugauau

SEQ ID NO: 174261 - RNA, 19 nt, Homo sapiens
agccaugacucaauaaaua

SEQ ID NO: 174262 - RNA, 19 nt, Homo sapiens
gaucaugaaggaacacaua

SEQ ID NO: 174263 - RNA, 19 nt, Homo sapiens
uaacagacaugccgcagau

SEQ ID NO: 174264 - RNA, 19 nt, Homo sapiens
caagagaggccaugcuaaa

SEQ ID NO: 174265 - RNA, 19 nt, Homo sapiens
acagagccaugacucaaua

SEQ ID NO: 174266 - RNA, 19 nt, Homo sapiens
ucuggcaucuucacaaaua

SEQ ID NO: 174267 - RNA, 19 nt, Homo sapiens
uaggagaguuugucaguga

SEQ ID NO: 174268 - RNA, 19 nt, Homo sapiens
agagagaccugguggaaau

SEQ ID NO: 174269 - RNA, 19 nt, Homo sapiens
gaugaagacuggaacuaca

SEQ ID NO: 174270 - RNA, 19 nt, Homo sapiens
ucacaaagaaguuaccaaa

SEQ ID NO: 174271 - RNA, 19 nt, Homo sapiens
gagguggacauugauauua

SEQ ID NO: 174272 - RNA, 19 nt, Homo sapiens
cauguuaaauggaugaaug

SEQ ID NO: 174273 - RNA, 19 nt, Homo sapiens
ucaguugguugauaugaaa

SEQ ID NO: 174274 - RNA, 19 nt, Homo sapiens
gaacuggaaguacuggaaa

SEQ ID NO: 174275 - RNA, 19 nt, Homo sapiens
gacuggagguggacauuga

SEQ ID NO: 174276 - RNA, 19 nt, Homo sapiens
gagaggccaugcuaaaucu

SEQ ID NO: 174277 - RNA, 19 nt, Homo sapiens
gagaauggaguuagagaga

SEQ ID NO: 174278 - RNA, 19 nt, Homo sapiens
caaguuacagcaaacaauu

SEQ ID NO: 174279 - RNA, 19 nt, Homo sapiens
aaguagaucugaaggacua

SEQ ID NO: 174280 - RNA, 19 nt, Homo sapiens
ccaaaugccuaacaguaca

SEQ ID NO: 174281 - RNA, 19 nt, Homo sapiens
cgugguaaaucuucaaguu

SEQ ID NO: 174282 - RNA, 19 nt, Homo sapiens
aggcaacacuuaccacuga

SEQ ID NO: 174283 - RNA, 19 nt, Homo sapiens
ccaauaaccgugauaauac

SEQ ID NO: 174284 - RNA, 19 nt, Homo sapiens
ggagagaguaccacacaga

SEQ ID NO: 174285 - RNA, 19 nt, Homo sapiens
uugaagaggugucaggaaa

SEQ ID NO: 174286 - RNA, 19 nt, Homo sapiens
caacacuuaccacugauaa

SEQ ID NO: 174287 - RNA, 19 nt, Homo sapiens
ggagguggacauugauauu

SEQ ID NO: 174288 - RNA, 19 nt, Homo sapiens
gggcagggccuuugucugu

SEQ ID NO: 174289 - RNA, 19 nt, Homo sapiens
gaacacauagcaccaagag

SEQ ID NO: 174290 - RNA, 19 nt, Homo sapiens
gaauucccuucccguggua

SEQ ID NO: 174291 - RNA, 19 nt, Homo sapiens
gacacugccucaacuggaa

SEQ ID NO: 174292 - RNA, 19 nt, Homo sapiens
cgaagaugguucugacugu

SEQ ID NO: 174293 - RNA, 19 nt, Homo sapiens
gaaggacuaugaagaucag

SEQ ID NO: 174294 - RNA, 19 nt, Homo sapiens
caauaaggauucucauucg

SEQ ID NO: 174295 - RNA, 19 nt, Homo sapiens
ucagagguauccacacuuc

SEQ ID NO: 174296 - RNA, 19 nt, Homo sapiens
ugaagccgaucaugaagga

SEQ ID NO: 174297 - RNA, 19 nt, Homo sapiens
gugguaaaucuucaaguua

SEQ ID NO: 174298 - RNA, 19 nt, Homo sapiens
ggaaguacuggaaaccaaa

SEQ ID NO: 174299 - RNA, 19 nt, Homo sapiens
ugucgagggucaugcagua

SEQ ID NO: 174300 - RNA, 19 nt, Homo sapiens
guugaccacuaauauaaug

SEQ ID NO: 174301 - RNA, 19 nt, Homo sapiens
gcuauaaaauggcagauga

SEQ ID NO: 174302 - RNA, 19 nt, Homo sapiens
aaauauuucugcacagugu

SEQ ID NO: 174303 - RNA, 19 nt, Homo sapiens
aaucuggcaucuucacaaa

SEQ ID NO: 174304 - RNA, 19 nt, Homo sapiens
gcagaugagaauggaguua

SEQ ID NO: 174305 - RNA, 19 nt, Homo sapiens
gaacaggucauugccaaag

SEQ ID NO: 174306 - RNA, 19 nt, Homo sapiens
cagaagaacaauaaggauu

SEQ ID NO: 174307 - RNA, 19 nt, Homo sapiens
ggaugaaaggguugauuga

SEQ ID NO: 174308 - RNA, 19 nt, Homo sapiens
gacaauggcacucugaauc

SEQ ID NO: 174309 - RNA, 19 nt, Homo sapiens
gcccaaggguuguggaaag

SEQ ID NO: 174310 - RNA, 19 nt, Homo sapiens
gcaacacuuaccacugaua

SEQ ID NO: 174311 - RNA, 19 nt, Homo sapiens
uauccacacuucuccuuug

SEQ ID NO: 174312 - RNA, 19 nt, Homo sapiens
gaaagcaagagcuauaaaa

SEQ ID NO: 174313 - RNA, 19 nt, Homo sapiens
gagagaguaccacacagaa

SEQ ID NO: 174314 - RNA, 19 nt, Homo sapiens
ggacaauggcacucugaau

SEQ ID NO: 174315 - RNA, 19 nt, Homo sapiens
ggaacuggaaguacuggaa

SEQ ID NO: 174316 - RNA, 19 nt, Homo sapiens
ugaaaccaguuccagacuu

SEQ ID NO: 174317 - RNA, 19 nt, Homo sapiens
gaagcgcaaagucauagaa

SEQ ID NO: 174318 - RNA, 19 nt, Homo sapiens
acaauaaggauucucauuc

SEQ ID NO: 174319 - RNA, 19 nt, Homo sapiens
guacagagccaugacucaa

SEQ ID NO: 174320 - RNA, 19 nt, Homo sapiens
gauggucacaaagaaguua

SEQ ID NO: 174321 - RNA, 19 nt, Homo sapiens
uagcacgaguuacaacaga

SEQ ID NO: 174322 - RNA, 19 nt, Homo sapiens
uuacuaguagcacgaguua

SEQ ID NO: 174323 - RNA, 19 nt, Homo sapiens
agacuuacuucccucuaga

SEQ ID NO: 174324 - RNA, 19 nt, Homo sapiens
ucacaaauacaaaggaauc

SEQ ID NO: 174325 - RNA, 19 nt, Homo sapiens
gaaucuggcaucuucacaa

SEQ ID NO: 174326 - RNA, 19 nt, Homo sapiens
ggaccuggaaguacuggaa

SEQ ID NO: 174327 - RNA, 19 nt, Homo sapiens
acaucaaucugccugcaaa

SEQ ID NO: 174328 - RNA, 19 nt, Homo sapiens
uguuagagcucaguugguu

SEQ ID NO: 174329 - RNA, 19 nt, Homo sapiens
agguggacauugauauuaa

SEQ ID NO: 174330 - RNA, 19 nt, Homo sapiens
gaaaggguugauugaugaa

SEQ ID NO: 174331 - RNA, 19 nt, Homo sapiens
gcauuuccuucuuaacucu

SEQ ID NO: 174332 - RNA, 19 nt, Homo sapiens
cagcauggacugcagauag

SEQ ID NO: 174333 - RNA, 19 nt, Homo sapiens
uggcauagguacucuggau

SEQ ID NO: 174334 - RNA, 19 nt, Homo sapiens
gaaguacuggaaaccgaaa

SEQ ID NO: 174335 - RNA, 19 nt, Homo sapiens
uggugaaggugacuuucua

SEQ ID NO: 174336 - RNA, 19 nt, Homo sapiens
ggaaggcauuaacagacau

SEQ ID NO: 174337 - RNA, 19 nt, Homo sapiens
gaucagcagaagcaacuug

SEQ ID NO: 174338 - RNA, 19 nt, Homo sapiens
gagccaugacucaauaaau

SEQ ID NO: 174339 - RNA, 19 nt, Homo sapiens
cacauugucuggcauaggu

SEQ ID NO: 174340 - RNA, 19 nt, Homo sapiens
uuacuaagacuguuauugg

SEQ ID NO: 174341 - RNA, 19 nt, Homo sapiens
ggaacgcgaggccuaacaa

SEQ ID NO: 174342 - RNA, 19 nt, Homo sapiens
augaaaggguugauugaug

SEQ ID NO: 174343 - RNA, 19 nt, Homo sapiens
gaccacuaauauaauggaa

SEQ ID NO: 174344 - RNA, 19 nt, Homo sapiens
gcagggccuuugucugucu

SEQ ID NO: 174345 - RNA, 19 nt, Homo sapiens
caaggguuguggaaagaca

SEQ ID NO: 174346 - RNA, 19 nt, Homo sapiens
uuucuucucaccuauguua

SEQ ID NO: 174347 - RNA, 19 nt, Homo sapiens
aaacuggucacuucuaaag

SEQ ID NO: 174348 - RNA, 19 nt, Homo sapiens
gaaaggaggugaaacaucu

SEQ ID NO: 174349 - RNA, 19 nt, Homo sapiens
gaaauaguguugaugaguu

SEQ ID NO: 174350 - RNA, 19 nt, Homo sapiens
caaagaaugugaggaaauu

SEQ ID NO: 174351 - RNA, 19 nt, Homo sapiens
gaaaggccaaucagaaaua

SEQ ID NO: 174352 - RNA, 19 nt, Homo sapiens
gaguugguguucauaauuu

SEQ ID NO: 174353 - RNA, 19 nt, Homo sapiens
gaaaggagacaaaguaaag

SEQ ID NO: 174354 - RNA, 19 nt, Homo sapiens
acacagaugggaagaauua

SEQ ID NO: 174355 - RNA, 19 nt, Homo sapiens
guacauguauuugcugaaa

SEQ ID NO: 174356 - RNA, 19 nt, Homo sapiens
gguggauggugguauaaua

SEQ ID NO: 174357 - RNA, 19 nt, Homo sapiens
guuagaaucugaugucuca

SEQ ID NO: 174358 - RNA, 19 nt, Homo sapiens
caaagcagcugccacucaa

SEQ ID NO: 174359 - RNA, 19 nt, Homo sapiens
agaaugaagccaacaaaua

SEQ ID NO: 174360 - RNA, 19 nt, Homo sapiens
caacacagaugggaagaau

SEQ ID NO: 174361 - RNA, 19 nt, Homo sapiens
uguaggaucugucaaagaa

SEQ ID NO: 174362 - RNA, 19 nt, Homo sapiens
cagcucaaauggaauauug

SEQ ID NO: 174363 - RNA, 19 nt, Homo sapiens
gaaugaagccaacaaauac

SEQ ID NO: 174364 - RNA, 19 nt, Homo sapiens
aauauuggcuuggaaauga

SEQ ID NO: 174365 - RNA, 19 nt, Homo sapiens
ggugguggauggugguaua

SEQ ID NO: 174366 - RNA, 19 nt, Homo sapiens
ccacagaacuuuugauaga

SEQ ID NO: 174367 - RNA, 19 nt, Homo sapiens
gugaggaaauuaucaggaa

SEQ ID NO: 174368 - RNA, 19 nt, Homo sapiens
gaccuccucuucuuccuuu

SEQ ID NO: 174369 - RNA, 19 nt, Homo sapiens
gguguaguauggaugaauu

SEQ ID NO: 174370 - RNA, 19 nt, Homo sapiens
ggaaaggagacaaaguaaa

SEQ ID NO: 174371 - RNA, 19 nt, Homo sapiens
gauggacagugauucagaa

SEQ ID NO: 174372 - RNA, 19 nt, Homo sapiens
caaaguaaaggcucacuau

SEQ ID NO: 174373 - RNA, 19 nt, Homo sapiens
gcaaagaaugugaggaaau

SEQ ID NO: 174374 - RNA, 19 nt, Homo sapiens
ugucucagcucaaauggaa

SEQ ID NO: 174375 - RNA, 19 nt, Homo sapiens
gaagaugaguaugaagauc

SEQ ID NO: 174376 - RNA, 19 nt, Homo sapiens
cacagaugaugguguagua

SEQ ID NO: 174377 - RNA, 19 nt, Homo sapiens
ugacagaguugguguucau

SEQ ID NO: 174378 - RNA, 19 nt, Homo sapiens
uggcacagaugauggugua

SEQ ID NO: 174379 - RNA, 19 nt, Homo sapiens
ggaaaggccaaucagaaau

SEQ ID NO: 174380 - RNA, 19 nt, Homo sapiens
uaacaucagaucccagaaa

SEQ ID NO: 174381 - RNA, 19 nt, Homo sapiens
gacaaugacggcugguuaa

SEQ ID NO: 174382 - RNA, 19 nt, Homo sapiens
aguaaaggcucacuaugga

SEQ ID NO: 174383 - RNA, 19 nt, Homo sapiens
ggacuggaaaggagacaaa

SEQ ID NO: 174384 - RNA, 19 nt, Homo sapiens
ugucaaaccguauagagua

SEQ ID NO: 174385 - RNA, 19 nt, Homo sapiens
ucagaaauaguguugauga

SEQ ID NO: 174386 - RNA, 19 nt, Homo sapiens
caacaggaaaggccaauca

SEQ ID NO: 174387 - RNA, 19 nt, Homo sapiens
uaguauggaugaauuggaa

SEQ ID NO: 174388 - RNA, 19 nt, Homo sapiens
uagaugagacugugaauag

SEQ ID NO: 174389 - RNA, 19 nt, Homo sapiens
ggaaaagcaccaauuauau

SEQ ID NO: 174390 - RNA, 19 nt, Homo sapiens
agacaaugacggcugguua

SEQ ID NO: 174391 - RNA, 19 nt, Homo sapiens
agacgguaguguugacuuu

SEQ ID NO: 174392 - RNA, 19 nt, Homo sapiens
caggaaaggccaaucagaa

SEQ ID NO: 174393 - RNA, 19 nt, Homo sapiens
gaauuacuguggccuacca

SEQ ID NO: 174394 - RNA, 19 nt, Homo sapiens
gcacaugauuuucuuuugu

SEQ ID NO: 174395 - RNA, 19 nt, Homo sapiens
caaagcauggcacagauga

SEQ ID NO: 174396 - RNA, 19 nt, Homo sapiens
gaauauuggcuuggaaaug

SEQ ID NO: 174397 - RNA, 19 nt, Homo sapiens
ggaggugaaacaucugaaa

SEQ ID NO: 174398 - RNA, 19 nt, Homo sapiens
ggaaaggaggugaaacauc

SEQ ID NO: 174399 - RNA, 19 nt, Homo sapiens
cagaguugguguucauaau

SEQ ID NO: 174400 - RNA, 19 nt, Homo sapiens
gagcuuccacaaacuuaaa

SEQ ID NO: 174401 - RNA, 19 nt, Homo sapiens
ugaaagaccuguggcaaaa

SEQ ID NO: 174402 - RNA, 19 nt, Homo sapiens
ggauggugguauaauagau

SEQ ID NO: 174403 - RNA, 19 nt, Homo sapiens
ggagaaaacaggaccauga

SEQ ID NO: 174404 - RNA, 19 nt, Homo sapiens
uugcuacuauuguguguuu

SEQ ID NO: 174405 - RNA, 19 nt, Homo sapiens
aauggaggauggacaguga

SEQ ID NO: 174406 - RNA, 19 nt, Homo sapiens
ugaggaaauuaucaggaaa

SEQ ID NO: 174407 - RNA, 19 nt, Homo sapiens
acauguauuugcugaaaga

SEQ ID NO: 174408 - RNA, 19 nt, Homo sapiens
caucugaaauguaucucau

SEQ ID NO: 174409 - RNA, 19 nt, Homo sapiens
ggcaaagaaugugaggaaa

SEQ ID NO: 174410 - RNA, 19 nt, Homo sapiens
uguggugucuggcaaagaa

SEQ ID NO: 174411 - RNA, 19 nt, Homo sapiens
ugaggaggguuucuucagu

SEQ ID NO: 174412 - RNA, 19 nt, Homo sapiens
gcaaagcauggcacagaug

SEQ ID NO: 174413 - RNA, 19 nt, Homo sapiens
ccaaucagaaauaguguug

SEQ ID NO: 174414 - RNA, 19 nt, Homo sapiens
ggaaaaccaugacggaaag

SEQ ID NO: 174415 - RNA, 19 nt, Homo sapiens
gauaaaauuagccagcuua

SEQ ID NO: 174416 - RNA, 19 nt, Homo sapiens
gaggauggacagugauuca

SEQ ID NO: 174417 - RNA, 19 nt, Homo sapiens
gucaaaccguauagaguau

SEQ ID NO: 174418 - RNA, 19 nt, Homo sapiens
ucccagaccuccucuucuu

SEQ ID NO: 174419 - RNA, 19 nt, Homo sapiens
ccaaagcagcugccacuca

SEQ ID NO: 174420 - RNA, 19 nt, Homo sapiens
ggcaaagcauggcacagau

SEQ ID NO: 174421 - RNA, 19 nt, Homo sapiens
cuggaaaggagacaaagua

SEQ ID NO: 174422 - RNA, 19 nt, Homo sapiens
gaaugugaggaaauuauca

SEQ ID NO: 174423 - RNA, 19 nt, Homo sapiens
caagaggcuuugcuacaac

SEQ ID NO: 174424 - RNA, 19 nt, Homo sapiens
gaugguguaguauggauga

SEQ ID NO: 174425 - RNA, 19 nt, Homo sapiens
agaaauggaggacuggaaa

SEQ ID NO: 174426 - RNA, 19 nt, Homo sapiens
ggauggacagugauucaga

SEQ ID NO: 174427 - RNA, 19 nt, Homo sapiens
ggugaauauuggcuuggaa

SEQ ID NO: 174428 - RNA, 19 nt, Homo sapiens
uagaguauacugugacaug

SEQ ID NO: 174429 - RNA, 19 nt, Homo sapiens
gaggugaaacaucugaaau

SEQ ID NO: 174430 - RNA, 19 nt, Homo sapiens
gagacugugaauagcaaua

SEQ ID NO: 174431 - RNA, 19 nt, Homo sapiens
uggaaaagcaccaauuaua

SEQ ID NO: 174432 - RNA, 19 nt, Homo sapiens
caagcagacgugaguguga

SEQ ID NO: 174433 - RNA, 19 nt, Homo sapiens
aaugacggcugguuaacau

SEQ ID NO: 174434 - RNA, 19 nt, Homo sapiens
caggaaaggaggugaaaca

SEQ ID NO: 174435 - RNA, 19 nt, Homo sapiens
ucucagcucaaauggaaua

SEQ ID NO: 174436 - RNA, 19 nt, Homo sapiens
gaggauucacuguacagaa

SEQ ID NO: 174437 - RNA, 19 nt, Homo sapiens
ggagcuuccacaaacuuaa

SEQ ID NO: 174438 - RNA, 19 nt, Homo sapiens
agaguauacugugacauga

SEQ ID NO: 174439 - RNA, 19 nt, Homo sapiens
uggcaaagaaugugaggaa

SEQ ID NO: 174440 - RNA, 19 nt, Homo sapiens
aggaaaggccaaucagaaa

SEQ ID NO: 174441 - RNA, 19 nt, Homo sapiens
guacuccucagaacuggaa

SEQ ID NO: 174442 - RNA, 19 nt, Homo sapiens
uuucaguucuaguugauug

SEQ ID NO: 174443 - RNA, 19 nt, Homo sapiens
gcacguaugacagagacaa

SEQ ID NO: 174444 - RNA, 19 nt, Homo sapiens
ggaccaugaccauucacaa

SEQ ID NO: 174445 - RNA, 19 nt, Homo sapiens
acaggaccaugaccauuca

SEQ ID NO: 174446 - RNA, 19 nt, Homo sapiens
uauggaggauucacuguac

SEQ ID NO: 174447 - RNA, 19 nt, Homo sapiens
gccaacaaauaccagaucu

SEQ ID NO: 174448 - RNA, 19 nt, Homo sapiens
gaagguauaugagcuguua

SEQ ID NO: 174449 - RNA, 19 nt, Homo sapiens
gacaauggauacucaguuu

SEQ ID NO: 174450 - RNA, 19 nt, Homo sapiens
gacaagaccuagaggguuu

SEQ ID NO: 174451 - RNA, 19 nt, Homo sapiens
ccaaagagcucauaaaaga

SEQ ID NO: 174452 - RNA, 19 nt, Homo sapiens
ggagaaggguggcaaagga

SEQ ID NO: 174453 - RNA, 19 nt, Homo sapiens
ccacaaagcaccagaggua

SEQ ID NO: 174454 - RNA, 19 nt, Homo sapiens
caagauguauggugaguau

SEQ ID NO: 174455 - RNA, 19 nt, Homo sapiens
caacaaacagggaagauga

SEQ ID NO: 174456 - RNA, 19 nt, Homo sapiens
ggacugaggaggagaagaa

SEQ ID NO: 174457 - RNA, 19 nt, Homo sapiens
ccaaugagcuccugcaaac

SEQ ID NO: 174458 - RNA, 19 nt, Homo sapiens
ggaggacaauggauacuca

SEQ ID NO: 174459 - RNA, 19 nt, Homo sapiens
gaagagaaggacagagaaa

SEQ ID NO: 174460 - RNA, 19 nt, Homo sapiens
gcccagaucuauucccauu

SEQ ID NO: 174461 - RNA, 19 nt, Homo sapiens
aaagagagccugugauugu

SEQ ID NO: 174462 - RNA, 19 nt, Homo sapiens
caggagcccuucaauucua

SEQ ID NO: 174463 - RNA, 19 nt, Homo sapiens
cccaagagguugacaguga

SEQ ID NO: 174464 - RNA, 19 nt, Homo sapiens
ucucaaggacuaucuguua

SEQ ID NO: 174465 - RNA, 19 nt, Homo sapiens
ugaaagagagccugugauu

SEQ ID NO: 174466 - RNA, 19 nt, Homo sapiens
gugaguaugugaagaacuu

SEQ ID NO: 174467 - RNA, 19 nt, Homo sapiens
ggagagcccagaucuauuc

SEQ ID NO: 174468 - RNA, 19 nt, Homo sapiens
ccaaggcuacccaguauuu

SEQ ID NO: 174469 - RNA, 19 nt, Homo sapiens
aacagacgcuggagacuuu

SEQ ID NO: 174470 - RNA, 19 nt, Homo sapiens
ggaccgcuauccacgcauu

SEQ ID NO: 174471 - RNA, 19 nt, Homo sapiens
uaacaucugcuccaucuau

SEQ ID NO: 174472 - RNA, 19 nt, Homo sapiens
caaaagguguuucacauug

SEQ ID NO: 174473 - RNA, 19 nt, Homo sapiens
gccaggagcccuucaauuc

SEQ ID NO: 174474 - RNA, 19 nt, Homo sapiens
gaacagacgcuggagacuu

SEQ ID NO: 174475 - RNA, 19 nt, Homo sapiens
gaaagagagccugugauug

SEQ ID NO: 174476 - RNA, 19 nt, Homo sapiens
ggacaauggauacucaguu

SEQ ID NO: 174477 - RNA, 19 nt, Homo sapiens
ggaguugacugugcagcaa

SEQ ID NO: 174478 - RNA, 19 nt, Homo sapiens
uaggagaccuggauucaag

SEQ ID NO: 174479 - RNA, 19 nt, Homo sapiens
gcuggagacuuucaaacug

SEQ ID NO: 174480 - RNA, 19 nt, Homo sapiens
ccucccagcucagucaaua

SEQ ID NO: 174481 - RNA, 19 nt, Homo sapiens
ucaacgaccgccuccuuua

SEQ ID NO: 174482 - RNA, 19 nt, Homo sapiens
ccuagagccucauccagaa

SEQ ID NO: 174483 - RNA, 19 nt, Homo sapiens
guagauggcauggagcuaa

SEQ ID NO: 174484 - RNA, 19 nt, Homo sapiens
caaagaaugggaccacuca

SEQ ID NO: 174485 - RNA, 19 nt, Homo sapiens
auaagcugcugaagguaua

SEQ ID NO: 174486 - RNA, 19 nt, Homo sapiens
aaauggagcgaaugcauaa

SEQ ID NO: 174487 - RNA, 19 nt, Homo sapiens
ccagcucagucaauacuug

SEQ ID NO: 174488 - RNA, 19 nt, Homo sapiens
caccucagcugguacuuca

SEQ ID NO: 174489 - RNA, 19 nt, Homo sapiens
ggaagagaaggacagagaa

SEQ ID NO: 174490 - RNA, 19 nt, Homo sapiens
caaggacuaucuguuaaag

SEQ ID NO: 174491 - RNA, 19 nt, Homo sapiens
ucaauacccuaccacagau

SEQ ID NO: 174492 - RNA, 19 nt, Homo sapiens
caagaccgauaccucauac

SEQ ID NO: 174493 - RNA, 19 nt, Homo sapiens
ggagacauccugcagaaac

SEQ ID NO: 174494 - RNA, 19 nt, Homo sapiens
caggagagcccagaucuau

SEQ ID NO: 174495 - RNA, 19 nt, Homo sapiens
uagauggcauggagcuaaa

SEQ ID NO: 174496 - RNA, 19 nt, Homo sapiens
gggcacgcauugauguaga

SEQ ID NO: 174497 - RNA, 19 nt, Homo sapiens
ggaccacucaagaccgaua

SEQ ID NO: 174498 - RNA, 19 nt, Homo sapiens
cgggacagcggcauugaua

SEQ ID NO: 174499 - RNA, 19 nt, Homo sapiens
acaguuuauuucaggcuua

SEQ ID NO: 174500 - RNA, 19 nt, Homo sapiens
cuacagugaugucaauuuu

SEQ ID NO: 174501 - RNA, 19 nt, Homo sapiens
accgauaccucauacuauu

SEQ ID NO: 174502 - RNA, 19 nt, Homo sapiens
ucaagaccgauaccucaua

SEQ ID NO: 174503 - RNA, 19 nt, Homo sapiens
ugcauaagcugcugaaggu

SEQ ID NO: 174504 - RNA, 19 nt, Homo sapiens
ucuaacaucugcuccaucu

SEQ ID NO: 174505 - RNA, 19 nt, Homo sapiens
cagcagagcacucgaaugc

SEQ ID NO: 174506 - RNA, 19 nt, Homo sapiens
uugagaaguuugaaagaga

SEQ ID NO: 174507 - RNA, 19 nt, Homo sapiens
cucaaggacuaucuguuaa

SEQ ID NO: 174508 - RNA, 19 nt, Homo sapiens
cagcguccuucaccacuga

SEQ ID NO: 174509 - RNA, 19 nt, Homo sapiens
uccaugaggugcagaagga

SEQ ID NO: 174510 - RNA, 19 nt, Homo sapiens
ccacccuccugaagcauga

SEQ ID NO: 174511 - RNA, 19 nt, Homo sapiens
ccaccgccguucucucuuc

SEQ ID NO: 174512 - RNA, 19 nt, Homo sapiens
gaccgauaccucauacuau

SEQ ID NO: 174513 - RNA, 19 nt, Homo sapiens
agaccgauaccucauacua

SEQ ID NO: 174514 - RNA, 19 nt, Homo sapiens
ccaccaaagagcucauaaa

SEQ ID NO: 174515 - RNA, 19 nt, Homo sapiens
ucaaggacuaucuguuaaa

SEQ ID NO: 174516 - RNA, 19 nt, Homo sapiens
gagacauccugcagaaacu

SEQ ID NO: 174517 - RNA, 19 nt, Homo sapiens
ggaggaaugggaccgcuau

SEQ ID NO: 174518 - RNA, 19 nt, Homo sapiens
cacggcaucuucucuaaca

SEQ ID NO: 174519 - RNA, 19 nt, Homo sapiens
ccagaucuauucccauucg

SEQ ID NO: 174520 - RNA, 19 nt, Homo sapiens
gccaguccuaccugaauua

SEQ ID NO: 174521 - RNA, 19 nt, Homo sapiens
ucaauucuaucaccaaacg

SEQ ID NO: 174522 - RNA, 19 nt, Homo sapiens
gcagagaacagcgucaucu

SEQ ID NO: 174523 - RNA, 19 nt, Homo sapiens
cauaagcugcugaagguau

SEQ ID NO: 174524 - RNA, 19 nt, Homo sapiens
gguaggagaccuggauuca

SEQ ID NO: 174525 - RNA, 19 nt, Homo sapiens
ccuuggugcuguauaucua

SEQ ID NO: 174526 - RNA, 19 nt, Homo sapiens
ugugugcacugauugcuau

SEQ ID NO: 174527 - RNA, 19 nt, Homo sapiens
cuucaauucuaucaccaaa

SEQ ID NO: 174528 - RNA, 19 nt, Homo sapiens
agaaugggaccacucaaga

SEQ ID NO: 174529 - RNA, 19 nt, Homo sapiens
gagaagcgcauggaggaau

SEQ ID NO: 174530 - RNA, 19 nt, Homo sapiens
gcaaaagguguuucacauu

SEQ ID NO: 174531 - RNA, 19 nt, Homo sapiens
gugauugucgccucggaua

SEQ ID NO: 174532 - RNA, 19 nt, Homo sapiens
gagcgcuccacccaguuua

SEQ ID NO: 174533 - RNA, 19 nt, Homo sapiens
ggaaugggaccgcuaucca

SEQ ID NO: 174534 - RNA, 19 nt, Homo sapiens
gauugagaaguuugaaaga

SEQ ID NO: 174535 - RNA, 19 nt, Homo sapiens
gauguauggugaguaugug

SEQ ID NO: 174536 - RNA, 19 nt, Homo sapiens
caaagcaccagagguagga

SEQ ID NO: 174537 - RNA, 19 nt, Homo sapiens
aaugcugggucuuggguuu

SEQ ID NO: 174538 - RNA, 19 nt, Homo sapiens
gcacuuucaaucccgaaug

SEQ ID NO: 174539 - RNA, 19 nt, Homo sapiens
uuggagacauccugcagaa

SEQ ID NO: 174540 - RNA, 19 nt, Homo sapiens
gagaaggccuacguuucca

SEQ ID NO: 174541 - RNA, 19 nt, Homo sapiens
aggcaccgguggcugcuuu

SEQ ID NO: 174542 - RNA, 19 nt, Homo sapiens
gaacccuuggugcuguaua

SEQ ID NO: 174543 - RNA, 19 nt, Homo sapiens
gugcacugauugcuaugug

SEQ ID NO: 174544 - RNA, 19 nt, Homo sapiens
gaaaaggaagucaccaugu

SEQ ID NO: 174545 - RNA, 19 nt, Homo sapiens
caacuccacccuccugaag

SEQ ID NO: 174546 - RNA, 19 nt, Homo sapiens
ccacauccuuaagcuguca

SEQ ID NO: 174547 - RNA, 19 nt, Homo sapiens
gaaugcauaagcugcugaa

SEQ ID NO: 174548 - RNA, 19 nt, Homo sapiens
uaaauacacuuccugcuua

SEQ ID NO: 174549 - RNA, 19 nt, Homo sapiens
ccagguggcuagcaaauua

SEQ ID NO: 174550 - RNA, 19 nt, Homo sapiens
gagaagaauugguuuguug

SEQ ID NO: 174551 - RNA, 19 nt, Homo sapiens
gcacugagaaugauaguaa

SEQ ID NO: 174552 - RNA, 19 nt, Homo sapiens
gaacagagggaccaaauug

SEQ ID NO: 174553 - RNA, 19 nt, Homo sapiens
ugacaauacugcugccuua

SEQ ID NO: 174554 - RNA, 19 nt, Homo sapiens
gaaacaccauucaucucua

SEQ ID NO: 174555 - RNA, 19 nt, Homo sapiens
uaucagagcugggaaauuc

SEQ ID NO: 174556 - RNA, 19 nt, Homo sapiens
ccacagagccugaauuugu

SEQ ID NO: 174557 - RNA, 19 nt, Homo sapiens
guacuaaggagcaugauuu

SEQ ID NO: 174558 - RNA, 19 nt, Homo sapiens
gccagucucuucugauuaa

SEQ ID NO: 174559 - RNA, 19 nt, Homo sapiens
gcaucuccauguagaauaa

SEQ ID NO: 174560 - RNA, 19 nt, Homo sapiens
uagaagugguuuccugaua

SEQ ID NO: 174561 - RNA, 19 nt, Homo sapiens
gaagcuucaugccagguua

SEQ ID NO: 174562 - RNA, 19 nt, Homo sapiens
ccagaaagcaaucuuguuu

SEQ ID NO: 174563 - RNA, 19 nt, Homo sapiens
gaguaaacccuaucuguga

SEQ ID NO: 174564 - RNA, 19 nt, Homo sapiens
aaacaccauucaucucuaa

SEQ ID NO: 174565 - RNA, 19 nt, Homo sapiens
agaagugguuuccugauaa

SEQ ID NO: 174566 - RNA, 19 nt, Homo sapiens
ucacagcccugaccgagaa

SEQ ID NO: 174567 - RNA, 19 nt, Homo sapiens
gaccucaacuaacccuuaa

SEQ ID NO: 174568 - RNA, 19 nt, Homo sapiens
ccauucaucucuaacauau

SEQ ID NO: 174569 - RNA, 19 nt, Homo sapiens
gaaaagagagauuggauuu

SEQ ID NO: 174570 - RNA, 19 nt, Homo sapiens
cacagagccugaauuugua

SEQ ID NO: 174571 - RNA, 19 nt, Homo sapiens
ccaagaagcaugcagagaa

SEQ ID NO: 174572 - RNA, 19 nt, Homo sapiens
gcaggaaggcagaauaaau

SEQ ID NO: 174573 - RNA, 19 nt, Homo sapiens
gaucuccaauugccucuug

SEQ ID NO: 174574 - RNA, 19 nt, Homo sapiens
uggaaaggcuggaggagaa

SEQ ID NO: 174575 - RNA, 19 nt, Homo sapiens
uaggaacucuuaagcaaug

SEQ ID NO: 174576 - RNA, 19 nt, Homo sapiens
ccacugugcuauuacaaau

SEQ ID NO: 174577 - RNA, 19 nt, Homo sapiens
gaggaugauuucagaagga

SEQ ID NO: 174578 - RNA, 19 nt, Homo sapiens
gaaaguaggaacucuuaag

SEQ ID NO: 174579 - RNA, 19 nt, Homo sapiens
gacaauaguuaugccugua

SEQ ID NO: 174580 - RNA, 19 nt, Homo sapiens
gcucacagacaccaaauga

SEQ ID NO: 174581 - RNA, 19 nt, Homo sapiens
caaauuagaaacaccauuc

SEQ ID NO: 174582 - RNA, 19 nt, Homo sapiens
caagaagcaugcagagaag

SEQ ID NO: 174583 - RNA, 19 nt, Homo sapiens
gaaacuggcugaggggaua

SEQ ID NO: 174584 - RNA, 19 nt, Homo sapiens
ggaaaucaccaccuucaca

SEQ ID NO: 174585 - RNA, 19 nt, Homo sapiens
gcagcacugacaauaguua

SEQ ID NO: 174586 - RNA, 19 nt, Homo sapiens
gaagacaccaaguggauuc

SEQ ID NO: 174587 - RNA, 19 nt, Homo sapiens
gaaacagggacaaagaaau

SEQ ID NO: 174588 - RNA, 19 nt, Homo sapiens
uaaaugaaguguguuaagg

SEQ ID NO: 174589 - RNA, 19 nt, Homo sapiens
gcaaauauuagcaaagaag

SEQ ID NO: 174590 - RNA, 19 nt, Homo sapiens
gagaagaagacaccaagug

SEQ ID NO: 174591 - RNA, 19 nt, Homo sapiens
ccuacaagcucuuuagucu

SEQ ID NO: 174592 - RNA, 19 nt, Homo sapiens
gcccacagagccugaauuu

SEQ ID NO: 174593 - RNA, 19 nt, Homo sapiens
acaccuauauauccaagaa

SEQ ID NO: 174594 - RNA, 19 nt, Homo sapiens
ggagguguauauaaagagu

SEQ ID NO: 174595 - RNA, 19 nt, Homo sapiens
aaauacacuuccugcuuaa

SEQ ID NO: 174596 - RNA, 19 nt, Homo sapiens
gcagagaaagaaagggaaa

SEQ ID NO: 174597 - RNA, 19 nt, Homo sapiens
cagaacagaggcauuuaaa

SEQ ID NO: 174598 - RNA, 19 nt, Homo sapiens
gaggagaaccauuacaaca

SEQ ID NO: 174599 - RNA, 19 nt, Homo sapiens
guuaaacccuuaccaacag

SEQ ID NO: 174600 - RNA, 19 nt, Homo sapiens
gaagugguuuccugauaac

SEQ ID NO: 174601 - RNA, 19 nt, Homo sapiens
cugcaaauauuagcaaaga

SEQ ID NO: 174602 - RNA, 19 nt, Homo sapiens
gaucuguucuggguguuga

SEQ ID NO: 174603 - RNA, 19 nt, Homo sapiens
gaacucuuaagcaauggua

SEQ ID NO: 174604 - RNA, 19 nt, Homo sapiens
aguaggaacucuuaagcaa

SEQ ID NO: 174605 - RNA, 19 nt, Homo sapiens
ugauacugaugccauguaa

SEQ ID NO: 174606 - RNA, 19 nt, Homo sapiens
ccagaaacagggacaaaga

SEQ ID NO: 174607 - RNA, 19 nt, Homo sapiens
ccugugcccugcaaauauu

SEQ ID NO: 174608 - RNA, 19 nt, Homo sapiens
gcagagaagaauugguuug

SEQ ID NO: 174609 - RNA, 19 nt, Homo sapiens
gaaccucaccugaccucaa

SEQ ID NO: 174610 - RNA, 19 nt, Homo sapiens
gcccagugcuucuccaaca

SEQ ID NO: 174611 - RNA, 19 nt, Homo sapiens
caccaaaugaggaauguuu

SEQ ID NO: 174612 - RNA, 19 nt, Homo sapiens
aaacagggacaaagaaauc

SEQ ID NO: 174613 - RNA, 19 nt, Homo sapiens
uaaaugcccaguucacuuc

SEQ ID NO: 174614 - RNA, 19 nt, Homo sapiens
gagaaugauaguaauagga

SEQ ID NO: 174615 - RNA, 19 nt, Homo sapiens
cugaagugcuugcagauca

SEQ ID NO: 174616 - RNA, 19 nt, Homo sapiens
ggaaauucauguggaucug

SEQ ID NO: 174617 - RNA, 19 nt, Homo sapiens
guacagcccucggccuaca

SEQ ID NO: 174618 - RNA, 19 nt, Homo sapiens
ugaccucaacuaacccuua

SEQ ID NO: 174619 - RNA, 19 nt, Homo sapiens
aaagagagauuggauuuug

SEQ ID NO: 174620 - RNA, 19 nt, Homo sapiens
gcccugaccgagaaguuua

SEQ ID NO: 174621 - RNA, 19 nt, Homo sapiens
aaaagaggaugauuucaga

SEQ ID NO: 174622 - RNA, 19 nt, Homo sapiens
caggaaggcagaauaaauc

SEQ ID NO: 174623 - RNA, 19 nt, Homo sapiens
ucagaacagaggcauuuaa

SEQ ID NO: 174624 - RNA, 19 nt, Homo sapiens
gggaccaaauugcuucuag

SEQ ID NO: 174625 - RNA, 19 nt, Homo sapiens
gaagaaugggagcugcaaa

SEQ ID NO: 174626 - RNA, 19 nt, Homo sapiens
cuaaggagcaugauuuuaa

SEQ ID NO: 174627 - RNA, 19 nt, Homo sapiens
gcacaccucaugagucuac

SEQ ID NO: 174628 - RNA, 19 nt, Homo sapiens
gaugauuucagaaggagaa

SEQ ID NO: 174629 - RNA, 19 nt, Homo sapiens
gcaaauuagaaacaccauu

SEQ ID NO: 174630 - RNA, 19 nt, Homo sapiens
gagucuaccugagcauuca

SEQ ID NO: 174631 - RNA, 19 nt, Homo sapiens
ggagcgaccagcacauuca

SEQ ID NO: 174632 - RNA, 19 nt, Homo sapiens
gcacacuauuucccucuac

SEQ ID NO: 174633 - RNA, 19 nt, Homo sapiens
uuaagaggcuuuggccaau

SEQ ID NO: 174634 - RNA, 19 nt, Homo sapiens
cagaaacagggacaaagaa

SEQ ID NO: 174635 - RNA, 19 nt, Homo sapiens
gaccaaauugcuucuagga

SEQ ID NO: 174636 - RNA, 19 nt, Homo sapiens
gggcuacucugagaagaag

SEQ ID NO: 174637 - RNA, 19 nt, Homo sapiens
agagaagaauugguuuguu

SEQ ID NO: 174638 - RNA, 19 nt, Homo sapiens
ggcuggaggagaaccauua

SEQ ID NO: 174639 - RNA, 19 nt, Homo sapiens
ugacccagguggcuagcaa

SEQ ID NO: 174640 - RNA, 19 nt, Homo sapiens
ccgcaggaaggcagaauaa

SEQ ID NO: 174641 - RNA, 19 nt, Homo sapiens
agaaacagggacaaagaaa

SEQ ID NO: 174642 - RNA, 19 nt, Homo sapiens
gaaggcagcauuccaugac

SEQ ID NO: 174643 - RNA, 19 nt, Homo sapiens
cugagucccuccaugcaaa

SEQ ID NO: 174644 - RNA, 19 nt, Homo sapiens
ggcuaaaugaaguguguua

SEQ ID NO: 174645 - RNA, 19 nt, Homo sapiens
gcuucuaaaugcccaguuc

SEQ ID NO: 174646 - RNA, 19 nt, Homo sapiens
uugaaaguaggaacucuua

SEQ ID NO: 174647 - RNA, 19 nt, Homo sapiens
uaagaggcuuuggccaaug

SEQ ID NO: 174648 - RNA, 19 nt, Homo sapiens
uaaauacacuuccugcuua

SEQ ID NO: 174649 - RNA, 19 nt, Homo sapiens
ccagguggcuagcaaauua

SEQ ID NO: 174650 - RNA, 19 nt, Homo sapiens
gagaagaauugguuuguug

SEQ ID NO: 174651 - RNA, 19 nt, Homo sapiens
gcacugagaaugauaguaa

SEQ ID NO: 174652 - RNA, 19 nt, Homo sapiens
gaacagagggaccaaauug

SEQ ID NO: 174653 - RNA, 19 nt, Homo sapiens
ugacaauacugcugccuua

SEQ ID NO: 174654 - RNA, 19 nt, Homo sapiens
gcacacagacaccaaauga

SEQ ID NO: 174655 - RNA, 19 nt, Homo sapiens
gaaacaccauucaucucua

SEQ ID NO: 174656 - RNA, 19 nt, Homo sapiens
uaucagagcugggaaauuc

SEQ ID NO: 174657 - RNA, 19 nt, Homo sapiens
ccacagagccugaauuugu

SEQ ID NO: 174658 - RNA, 19 nt, Homo sapiens
guacuaaggagcaugauuu

SEQ ID NO: 174659 - RNA, 19 nt, Homo sapiens
gccagucucuucugauuaa

SEQ ID NO: 174660 - RNA, 19 nt, Homo sapiens
gcaucuccauguagaauaa

SEQ ID NO: 174661 - RNA, 19 nt, Homo sapiens
uagaagugguuuccugaua

SEQ ID NO: 174662 - RNA, 19 nt, Homo sapiens
gaagcuucaugccagguua

SEQ ID NO: 174663 - RNA, 19 nt, Homo sapiens
ccagaaagcaaucuuguuu

SEQ ID NO: 174664 - RNA, 19 nt, Homo sapiens
gaguaaacccuaucuguga

SEQ ID NO: 174665 - RNA, 19 nt, Homo sapiens
aaacaccauucaucucuaa

SEQ ID NO: 174666 - RNA, 19 nt, Homo sapiens
agaagugguuuccugauaa

SEQ ID NO: 174667 - RNA, 19 nt, Homo sapiens
ucacagcccugaccgagaa

SEQ ID NO: 174668 - RNA, 19 nt, Homo sapiens
gaccucaacuaacccuuaa

SEQ ID NO: 174669 - RNA, 19 nt, Homo sapiens
ccauucaucucuaacauau

SEQ ID NO: 174670 - RNA, 19 nt, Homo sapiens
gaaaagagagauuggauuu

SEQ ID NO: 174671 - RNA, 19 nt, Homo sapiens
cacagagccugaauuugua

SEQ ID NO: 174672 - RNA, 19 nt, Homo sapiens
ccaagaagcaugcagagaa

SEQ ID NO: 174673 - RNA, 19 nt, Homo sapiens
gcaggaaggcagaauaaau

SEQ ID NO: 174674 - RNA, 19 nt, Homo sapiens
gaucuccaauugccucuug

SEQ ID NO: 174675 - RNA, 19 nt, Homo sapiens
uggaaaggcuggaggagaa

SEQ ID NO: 174676 - RNA, 19 nt, Homo sapiens
uaggaacucuuaagcaaug

SEQ ID NO: 174677 - RNA, 19 nt, Homo sapiens
ccacugugcuauuacaaau

SEQ ID NO: 174678 - RNA, 19 nt, Homo sapiens
gaggaugauuucagaagga

SEQ ID NO: 174679 - RNA, 19 nt, Homo sapiens
gaaaguaggaacucuuaag

SEQ ID NO: 174680 - RNA, 19 nt, Homo sapiens
gacaauaguuaugccugua

SEQ ID NO: 174681 - RNA, 19 nt, Homo sapiens
caaauuagaaacaccauuc

SEQ ID NO: 174682 - RNA, 19 nt, Homo sapiens
caagaagcaugcagagaag

SEQ ID NO: 174683 - RNA, 19 nt, Homo sapiens
gaaacuggcugaggggaua

SEQ ID NO: 174684 - RNA, 19 nt, Homo sapiens
ggaaaucaccaccuucaca

SEQ ID NO: 174685 - RNA, 19 nt, Homo sapiens
gcagcacugacaauaguua

SEQ ID NO: 174686 - RNA, 19 nt, Homo sapiens
gaaacagggacaaagaaau

SEQ ID NO: 174687 - RNA, 19 nt, Homo sapiens
uaaaugaaguguguuaagg

SEQ ID NO: 174688 - RNA, 19 nt, Homo sapiens
gaagacaccaaguggauuc

SEQ ID NO: 174689 - RNA, 19 nt, Homo sapiens
gagaagaagacaccaagug

SEQ ID NO: 174690 - RNA, 19 nt, Homo sapiens
gcaaauauuagcaaagaag

SEQ ID NO: 174691 - RNA, 19 nt, Homo sapiens
ccuacaagcucuuuagucu

SEQ ID NO: 174692 - RNA, 19 nt, Homo sapiens
gcccacagagccugaauuu

SEQ ID NO: 174693 - RNA, 19 nt, Homo sapiens
acaccuauauauccaagaa

SEQ ID NO: 174694 - RNA, 19 nt, Homo sapiens
aaauacacuuccugcuuaa

SEQ ID NO: 174695 - RNA, 19 nt, Homo sapiens
gcagagaaagaaagggaaa

SEQ ID NO: 174696 - RNA, 19 nt, Homo sapiens
cagaacagaggcauuuaaa

SEQ ID NO: 174697 - RNA, 19 nt, Homo sapiens
gaggagaaccauuacaaca

SEQ ID NO: 174698 - RNA, 19 nt, Homo sapiens
guuaaacccuuaccaacag

SEQ ID NO: 174699 - RNA, 19 nt, Homo sapiens
gaagugguuuccugauaac

SEQ ID NO: 174700 - RNA, 19 nt, Homo sapiens
cugcaaauauuagcaaaga

SEQ ID NO: 174701 - RNA, 19 nt, Homo sapiens
gaucuguucuggguguuga

SEQ ID NO: 174702 - RNA, 19 nt, Homo sapiens
gaacucuuaagcaauggua

SEQ ID NO: 174703 - RNA, 19 nt, Homo sapiens
aguaggaacucuuaagcaa

SEQ ID NO: 174704 - RNA, 19 nt, Homo sapiens
ugauacugaugccauguaa

SEQ ID NO: 174705 - RNA, 19 nt, Homo sapiens
ccagaaacagggacaaaga

SEQ ID NO: 174706 - RNA, 19 nt, Homo sapiens
ccugugcccugcaaauauu

SEQ ID NO: 174707 - RNA, 19 nt, Homo sapiens
gcagagaagaauugguuug

SEQ ID NO: 174708 - RNA, 19 nt, Homo sapiens
gaaccucaccugaccucaa

SEQ ID NO: 174709 - RNA, 19 nt, Homo sapiens
gcccagugcuucuccaaca

SEQ ID NO: 174710 - RNA, 19 nt, Homo sapiens
caccaaaugaggaauguuu

SEQ ID NO: 174711 - RNA, 19 nt, Homo sapiens
aaacagggacaaagaaauc

SEQ ID NO: 174712 - RNA, 19 nt, Homo sapiens
uaaaugcccaguucacuuc

SEQ ID NO: 174713 - RNA, 19 nt, Homo sapiens
gagaaugauaguaauagga

SEQ ID NO: 174714 - RNA, 19 nt, Homo sapiens
cugaagugcuugcagauca

SEQ ID NO: 174715 - RNA, 19 nt, Homo sapiens
ggaaauucauguggaucug

SEQ ID NO: 174716 - RNA, 19 nt, Homo sapiens
gcccugaccgagaaguuua

SEQ ID NO: 174717 - RNA, 19 nt, Homo sapiens
ugaccucaacuaacccuua

SEQ ID NO: 174718 - RNA, 19 nt, Homo sapiens
guacagcccucggccuaca

SEQ ID NO: 174719 - RNA, 19 nt, Homo sapiens
aaagagagauuggauuuug

SEQ ID NO: 174720 - RNA, 19 nt, Homo sapiens
aaaagaggaugauuucaga

SEQ ID NO: 174721 - RNA, 19 nt, Homo sapiens
caggaaggcagaauaaauc

SEQ ID NO: 174722 - RNA, 19 nt, Homo sapiens
ucagaacagaggcauuuaa

SEQ ID NO: 174723 - RNA, 19 nt, Homo sapiens
gggaccaaauugcuucuag

SEQ ID NO: 174724 - RNA, 19 nt, Homo sapiens
gaagaaugggagcugcaaa

SEQ ID NO: 174725 - RNA, 19 nt, Homo sapiens
cuaaggagcaugauuuuaa

SEQ ID NO: 174726 - RNA, 19 nt, Homo sapiens
gcacaccucaugagucuac

SEQ ID NO: 174727 - RNA, 19 nt, Homo sapiens
gaugauuucagaaggagaa

SEQ ID NO: 174728 - RNA, 19 nt, Homo sapiens
gcaaauuagaaacaccauu

SEQ ID NO: 174729 - RNA, 19 nt, Homo sapiens
ggagcgaccagcacacaga

SEQ ID NO: 174730 - RNA, 19 nt, Homo sapiens
gagucuaccugagcauuca

SEQ ID NO: 174731 - RNA, 19 nt, Homo sapiens
gcacacuauuucccucuac

SEQ ID NO: 174732 - RNA, 19 nt, Homo sapiens
uuaagaggcuuuggccaau

SEQ ID NO: 174733 - RNA, 19 nt, Homo sapiens
cagaaacagggacaaagaa

SEQ ID NO: 174734 - RNA, 19 nt, Homo sapiens
gaccaaauugcuucuagga

SEQ ID NO: 174735 - RNA, 19 nt, Homo sapiens
gggcuacucugagaagaag

SEQ ID NO: 174736 - RNA, 19 nt, Homo sapiens
agagaagaauugguuuguu

SEQ ID NO: 174737 - RNA, 19 nt, Homo sapiens
ggcuggaggagaaccauua

SEQ ID NO: 174738 - RNA, 19 nt, Homo sapiens
ugacccagguggcuagcaa

SEQ ID NO: 174739 - RNA, 19 nt, Homo sapiens
ccgcaggaaggcagaauaa

SEQ ID NO: 174740 - RNA, 19 nt, Homo sapiens
agaaacagggacaaagaaa

SEQ ID NO: 174741 - RNA, 19 nt, Homo sapiens
gaaggcagcauuccaugac

SEQ ID NO: 174742 - RNA, 19 nt, Homo sapiens
cugagucccuccaugcaaa

SEQ ID NO: 174743 - RNA, 19 nt, Homo sapiens
ggcuaaaugaaguguguua

SEQ ID NO: 174744 - RNA, 19 nt, Homo sapiens
gcuucuaaaugcccaguuc

SEQ ID NO: 174745 - RNA, 19 nt, Homo sapiens
uugaaaguaggaacucuua

SEQ ID NO: 174746 - RNA, 19 nt, Homo sapiens
uaagaggcuuuggccaaug

SEQ ID NO: 174747 - RNA, 19 nt, Homo sapiens
ggauaucagagcugggaaa

SEQ ID NO: 174748 - RNA, 19 nt, Homo sapiens
uaaauacacuuccugcuua

SEQ ID NO: 174749 - RNA, 19 nt, Homo sapiens
ccagguggcuagcaaauua

SEQ ID NO: 174750 - RNA, 19 nt, Homo sapiens
gagaagaauugguuuguug

SEQ ID NO: 174751 - RNA, 19 nt, Homo sapiens
gcacugagaaugauaguaa

SEQ ID NO: 174752 - RNA, 19 nt, Homo sapiens
gaacagagggaccaaauug

SEQ ID NO: 174753 - RNA, 19 nt, Homo sapiens
ugacaauacugcugccuua

SEQ ID NO: 174754 - RNA, 19 nt, Homo sapiens
gaaacaccauucaucucua

SEQ ID NO: 174755 - RNA, 19 nt, Homo sapiens
uaucagagcugggaaauuc

SEQ ID NO: 174756 - RNA, 19 nt, Homo sapiens
ccacagagccugaauuugu

SEQ ID NO: 174757 - RNA, 19 nt, Homo sapiens
guacuaaggagcaugauuu

SEQ ID NO: 174758 - RNA, 19 nt, Homo sapiens
gccagucucuucugauuaa

SEQ ID NO: 174759 - RNA, 19 nt, Homo sapiens
gcaucuccauguagaauaa

SEQ ID NO: 174760 - RNA, 19 nt, Homo sapiens
uagaagugguuuccugaua

SEQ ID NO: 174761 - RNA, 19 nt, Homo sapiens
gaagcuucaugccagguua

SEQ ID NO: 174762 - RNA, 19 nt, Homo sapiens
ccagaaagcaaucuuguuu

SEQ ID NO: 174763 - RNA, 19 nt, Homo sapiens
gaguaaacccuaucuguga

SEQ ID NO: 174764 - RNA, 19 nt, Homo sapiens
aaacaccauucaucucuaa

SEQ ID NO: 174765 - RNA, 19 nt, Homo sapiens
agaagugguuuccugauaa

SEQ ID NO: 174766 - RNA, 19 nt, Homo sapiens
ucacagcccugaccgagaa

SEQ ID NO: 174767 - RNA, 19 nt, Homo sapiens
gaccucaacuaacccuuaa

SEQ ID NO: 174768 - RNA, 19 nt, Homo sapiens
ccauucaucucuaacauau

SEQ ID NO: 174769 - RNA, 19 nt, Homo sapiens
gaaaagagagauuggauuu

SEQ ID NO: 174770 - RNA, 19 nt, Homo sapiens
cacagagccugaauuugua

SEQ ID NO: 174771 - RNA, 19 nt, Homo sapiens
ccaagaagcaugcagagaa

SEQ ID NO: 174772 - RNA, 19 nt, Homo sapiens
gcaggaaggcagaauaaau

SEQ ID NO: 174773 - RNA, 19 nt, Homo sapiens
gaucuccaauugccucuug

SEQ ID NO: 174774 - RNA, 19 nt, Homo sapiens
uggaaaggcuggaggagaa

SEQ ID NO: 174775 - RNA, 19 nt, Homo sapiens
uaggaacucuuaagcaaug

SEQ ID NO: 174776 - RNA, 19 nt, Homo sapiens
ccacugugcuauuacaaau

SEQ ID NO: 174777 - RNA, 19 nt, Homo sapiens
gaggaugauuucagaagga

SEQ ID NO: 174778 - RNA, 19 nt, Homo sapiens
gaaaguaggaacucuuaag

SEQ ID NO: 174779 - RNA, 19 nt, Homo sapiens
gacaauaguuaugccugua

SEQ ID NO: 174780 - RNA, 19 nt, Homo sapiens
caaauuagaaacaccauuc

SEQ ID NO: 174781 - RNA, 19 nt, Homo sapiens
caagaagcaugcagagaag

SEQ ID NO: 174782 - RNA, 19 nt, Homo sapiens
gaaacuggcugaggggaua

SEQ ID NO: 174783 - RNA, 19 nt, Homo sapiens
ggaaaucaccaccuucaca

SEQ ID NO: 174784 - RNA, 19 nt, Homo sapiens
gcagcacugacaauaguua

SEQ ID NO: 174785 - RNA, 19 nt, Homo sapiens
gaagacaccaaguggauuc

SEQ ID NO: 174786 - RNA, 19 nt, Homo sapiens
gaaacagggacaaagaaau

SEQ ID NO: 174787 - RNA, 19 nt, Homo sapiens
uaaaugaaguguguuaagg

SEQ ID NO: 174788 - RNA, 19 nt, Homo sapiens
gcaaauauuagcaaagaag

SEQ ID NO: 174789 - RNA, 19 nt, Homo sapiens
gagaagaagacaccaagug

SEQ ID NO: 174790 - RNA, 19 nt, Homo sapiens
ccuacaagcucuuuagucu

SEQ ID NO: 174791 - RNA, 19 nt, Homo sapiens
gcccacagagccugaauuu

SEQ ID NO: 174792 - RNA, 19 nt, Homo sapiens
acaccuauauauccaagaa

SEQ ID NO: 174793 - RNA, 19 nt, Homo sapiens
aaauacacuuccugcuuaa

SEQ ID NO: 174794 - RNA, 19 nt, Homo sapiens
gcagagaaagaaagggaaa

SEQ ID NO: 174795 - RNA, 19 nt, Homo sapiens
cagaacagaggcauuuaaa

SEQ ID NO: 174796 - RNA, 19 nt, Homo sapiens
gaggagaaccauuacaaca

SEQ ID NO: 174797 - RNA, 19 nt, Homo sapiens
guuaaacccuuaccaacag

SEQ ID NO: 174798 - RNA, 19 nt, Homo sapiens
gaagugguuuccugauaac

SEQ ID NO: 174799 - RNA, 19 nt, Homo sapiens
cugcaaauauuagcaaaga

SEQ ID NO: 174800 - RNA, 19 nt, Homo sapiens
gaucuguucuggguguuga

SEQ ID NO: 174801 - RNA, 19 nt, Homo sapiens
gaacucuuaagcaauggua

SEQ ID NO: 174802 - RNA, 19 nt, Homo sapiens
aguaggaacucuuaagcaa

SEQ ID NO: 174803 - RNA, 19 nt, Homo sapiens
ugauacugaugccauguaa

SEQ ID NO: 174804 - RNA, 19 nt, Homo sapiens
ccagaaacagggacaaaga

SEQ ID NO: 174805 - RNA, 19 nt, Homo sapiens
ccugugcccugcaaauauu

SEQ ID NO: 174806 - RNA, 19 nt, Homo sapiens
gcagagaagaauugguuug

SEQ ID NO: 174807 - RNA, 19 nt, Homo sapiens
gaaccucaccugaccucaa

SEQ ID NO: 174808 - RNA, 19 nt, Homo sapiens
gcccagugcuucuccaaca

SEQ ID NO: 174809 - RNA, 19 nt, Homo sapiens
caccaaaugaggaauguuu

SEQ ID NO: 174810 - RNA, 19 nt, Homo sapiens
aaacagggacaaagaaauc

SEQ ID NO: 174811 - RNA, 19 nt, Homo sapiens
uaaaugcccaguucacuuc

SEQ ID NO: 174812 - RNA, 19 nt, Homo sapiens
gagaaugauaguaauagga

SEQ ID NO: 174813 - RNA, 19 nt, Homo sapiens
cugaagugcuugcagauca

SEQ ID NO: 174814 - RNA, 19 nt, Homo sapiens
ggaaauucauguggaucug

SEQ ID NO: 174815 - RNA, 19 nt, Homo sapiens
guacagcccucggccuaca

SEQ ID NO: 174816 - RNA, 19 nt, Homo sapiens
ugaccucaacuaacccuua

SEQ ID NO: 174817 - RNA, 19 nt, Homo sapiens
gcccugaccgagaaguuua

SEQ ID NO: 174818 - RNA, 19 nt, Homo sapiens
aaagagagauuggauuuug

SEQ ID NO: 174819 - RNA, 19 nt, Homo sapiens
aaaagaggaugauuucaga

SEQ ID NO: 174820 - RNA, 19 nt, Homo sapiens
caggaaggcagaauaaauc

SEQ ID NO: 174821 - RNA, 19 nt, Homo sapiens
ucagaacagaggcauuuaa

SEQ ID NO: 174822 - RNA, 19 nt, Homo sapiens
gggaccaaauugcuucuag

SEQ ID NO: 174823 - RNA, 19 nt, Homo sapiens
gaagaaugggagcugcaaa

SEQ ID NO: 174824 - RNA, 19 nt, Homo sapiens
cuaaggagcaugauuuuaa

SEQ ID NO: 174825 - RNA, 19 nt, Homo sapiens
gcacaccucaugagucuac

SEQ ID NO: 174826 - RNA, 19 nt, Homo sapiens
gaugauuucagaaggagaa

SEQ ID NO: 174827 - RNA, 19 nt, Homo sapiens
gcaaauuagaaacaccauu

SEQ ID NO: 174828 - RNA, 19 nt, Homo sapiens
gagucuaccugagcauuca

SEQ ID NO: 174829 - RNA, 19 nt, Homo sapiens
gcacacuauuucccucuac

SEQ ID NO: 174830 - RNA, 19 nt, Homo sapiens
uuaagaggcuuuggccaau

SEQ ID NO: 174831 - RNA, 19 nt, Homo sapiens
cagaaacagggacaaagaa

SEQ ID NO: 174832 - RNA, 19 nt, Homo sapiens
gaccaaauugcuucuagga

SEQ ID NO: 174833 - RNA, 19 nt, Homo sapiens
gggcuacucugagaagaag

SEQ ID NO: 174834 - RNA, 19 nt, Homo sapiens
agagaagaauugguuuguu

SEQ ID NO: 174835 - RNA, 19 nt, Homo sapiens
ggcuggaggagaaccauua

SEQ ID NO: 174836 - RNA, 19 nt, Homo sapiens
caacaccaaaugaggaaug

SEQ ID NO: 174837 - RNA, 19 nt, Homo sapiens
ugacccagguggcuagcaa

SEQ ID NO: 174838 - RNA, 19 nt, Homo sapiens
ccgcaggaaggcagaauaa

SEQ ID NO: 174839 - RNA, 19 nt, Homo sapiens
agaaacagggacaaagaaa

SEQ ID NO: 174840 - RNA, 19 nt, Homo sapiens
gaaggcagcauuccaugac

SEQ ID NO: 174841 - RNA, 19 nt, Homo sapiens
cugagucccuccaugcaaa

SEQ ID NO: 174842 - RNA, 19 nt, Homo sapiens
ggcuaaaugaaguguguua

SEQ ID NO: 174843 - RNA, 19 nt, Homo sapiens
gcuucuaaaugcccaguuc

SEQ ID NO: 174844 - RNA, 19 nt, Homo sapiens
uugaaaguaggaacucuua

SEQ ID NO: 174845 - RNA, 19 nt, Homo sapiens
uaagaggcuuuggccaaug

SEQ ID NO: 174846 - RNA, 19 nt, Homo sapiens
ggauaucagagcugggaaa

SEQ ID NO: 174847 - RNA, 19 nt, Homo sapiens
guggguaacuuagaaggau

SEQ ID NO: 174848 - RNA, 19 nt, Homo sapiens
gaaggaagauggaagauua

SEQ ID NO: 174849 - RNA, 19 nt, Homo sapiens
gaaauaaucugcagaaugu

SEQ ID NO: 174850 - RNA, 19 nt, Homo sapiens
ggaaacaucuacugaauuu

SEQ ID NO: 174851 - RNA, 19 nt, Homo sapiens
gcacuagucuuaaauugua

SEQ ID NO: 174852 - RNA, 19 nt, Homo sapiens
gcacuagucuuaaauuuga

SEQ ID NO: 174853 - RNA, 19 nt, Homo sapiens
ggacggaccugaauucuga

SEQ ID NO: 174854 - RNA, 19 nt, Homo sapiens
gaaggcaguuugucaauuu

SEQ ID NO: 174855 - RNA, 19 nt, Homo sapiens
gagauaagauuccaaagaa

SEQ ID NO: 174856 - RNA, 19 nt, Homo sapiens
uaacuaggguuuacuguuu

SEQ ID NO: 174857 - RNA, 19 nt, Homo sapiens
gaauuaggcuguagaacaa

SEQ ID NO: 174858 - RNA, 19 nt, Homo sapiens
gcaagaaaguaaacacauu

SEQ ID NO: 174859 - RNA, 19 nt, Homo sapiens
gaaacuguaucaucaaaga

SEQ ID NO: 174860 - RNA, 19 nt, Homo sapiens
caaauguguuucccaguua

SEQ ID NO: 174861 - RNA, 19 nt, Homo sapiens
gaugguagcacuagucuua

SEQ ID NO: 174862 - RNA, 19 nt, Homo sapiens
agaaacaacugaaagcaua

SEQ ID NO: 174863 - RNA, 19 nt, Homo sapiens
ggacaugcauauuaaggaa

SEQ ID NO: 174864 - RNA, 19 nt, Homo sapiens
caaauggccuucucuuuca

SEQ ID NO: 174865 - RNA, 19 nt, Homo sapiens
caacaaagguuuucacauu

SEQ ID NO: 174866 - RNA, 19 nt, Homo sapiens
caaagugguugagaauaua

SEQ ID NO: 174867 - RNA, 19 nt, Homo sapiens
uauaacaucuccuaacuug

SEQ ID NO: 174868 - RNA, 19 nt, Homo sapiens
gcucugagguaauuucuga

SEQ ID NO: 174869 - RNA, 19 nt, Homo sapiens
gcacugaugaucucugaua

SEQ ID NO: 174870 - RNA, 19 nt, Homo sapiens
ugacuucccuuacaauuga

SEQ ID NO: 174871 - RNA, 19 nt, Homo sapiens
ggaaagaugcauagaaaga

SEQ ID NO: 174872 - RNA, 19 nt, Homo sapiens
cuggaaagcuucacaauug

SEQ ID NO: 174873 - RNA, 19 nt, Homo sapiens
ggugguauguuccuaauga

SEQ ID NO: 174874 - RNA, 19 nt, Homo sapiens
uaacugggcuuucucuaau

SEQ ID NO: 174875 - RNA, 19 nt, Homo sapiens
agaaaugccuucauauaga

SEQ ID NO: 174876 - RNA, 19 nt, Homo sapiens
gagauuugcccauagguua

SEQ ID NO: 174877 - RNA, 19 nt, Homo sapiens
gguaacugaugaaaucuuu

SEQ ID NO: 174878 - RNA, 19 nt, Homo sapiens
ggagguguuugaucaguuu

SEQ ID NO: 174879 - RNA, 19 nt, Homo sapiens
gaaggauucuggaguauac

SEQ ID NO: 174880 - RNA, 19 nt, Homo sapiens
gguuaaacaugguuagaaa

SEQ ID NO: 174881 - RNA, 19 nt, Homo sapiens
gcugguaacugaugaaauc

SEQ ID NO: 174882 - RNA, 19 nt, Homo sapiens
aagauuggcuagagauaua

SEQ ID NO: 174883 - RNA, 19 nt, Homo sapiens
gaucuaugcuguuucuaug

SEQ ID NO: 174884 - RNA, 19 nt, Homo sapiens
caauugagauuugcccaua

SEQ ID NO: 174885 - RNA, 19 nt, Homo sapiens
acagaaacaugucucaauu

SEQ ID NO: 174886 - RNA, 19 nt, Homo sapiens
caucuaaucucauuucaca

SEQ ID NO: 174887 - RNA, 19 nt, Homo sapiens
cgaguuggcuauauaaugu

SEQ ID NO: 174888 - RNA, 19 nt, Homo sapiens
ggaaauaaucugcagaaug

SEQ ID NO: 174889 - RNA, 19 nt, Homo sapiens
gauauaacaucuccuaacu

SEQ ID NO: 174890 - RNA, 19 nt, Homo sapiens
cuaaauguguuacggauga

SEQ ID NO: 174891 - RNA, 19 nt, Homo sapiens
aagaauaggugguauguuc

SEQ ID NO: 174892 - RNA, 19 nt, Homo sapiens
gaaauucagaggacccaua

SEQ ID NO: 174893 - RNA, 19 nt, Homo sapiens
ggauaccuuuauacucuua

SEQ ID NO: 174894 - RNA, 19 nt, Homo sapiens
gggaaauacauguuuguua

SEQ ID NO: 174895 - RNA, 19 nt, Homo sapiens
ucaauuacaugcugacuuc

SEQ ID NO: 174896 - RNA, 19 nt, Homo sapiens
gcuaagagcugauuuuaau

SEQ ID NO: 174897 - RNA, 19 nt, Homo sapiens
guuacgaguuggcuauaua

SEQ ID NO: 174898 - RNA, 19 nt, Homo sapiens
caacagaagaauaagcaua

SEQ ID NO: 174899 - RNA, 19 nt, Homo sapiens
ccacaugacugaggcauau

SEQ ID NO: 174900 - RNA, 19 nt, Homo sapiens
gauauuugcccuugcagua

SEQ ID NO: 174901 - RNA, 19 nt, Homo sapiens
gcaguuccuuuguuucuug

SEQ ID NO: 174902 - RNA, 19 nt, Homo sapiens
gucauugucucccaaagua

SEQ ID NO: 174903 - RNA, 19 nt, Homo sapiens
gaagaggaagucacagaaa

SEQ ID NO: 174904 - RNA, 19 nt, Homo sapiens
ccaaagaacuuagauucau

SEQ ID NO: 174905 - RNA, 19 nt, Homo sapiens
gggauuauuucucaguuga

SEQ ID NO: 174906 - RNA, 19 nt, Homo sapiens
caagauagugugcuuuauu

SEQ ID NO: 174907 - RNA, 19 nt, Homo sapiens
guacauguggucucagaua

SEQ ID NO: 174908 - RNA, 19 nt, Homo sapiens
ucuaauagcuauggaaaga

SEQ ID NO: 174909 - RNA, 19 nt, Homo sapiens
ggccacaucuaaucucauu

SEQ ID NO: 174910 - RNA, 19 nt, Homo sapiens
gaaugaauauggcuuuagg

SEQ ID NO: 174911 - RNA, 19 nt, Homo sapiens
acacacauauguagauuuc

SEQ ID NO: 174912 - RNA, 19 nt, Homo sapiens
caacugcaguauaaaguca

SEQ ID NO: 174913 - RNA, 19 nt, Homo sapiens
gaacaaauggccuucucuu

SEQ ID NO: 174914 - RNA, 19 nt, Homo sapiens
gaaaugccuucauauagac

SEQ ID NO: 174915 - RNA, 19 nt, Homo sapiens
uaacuugaaucacuaacug

SEQ ID NO: 174916 - RNA, 19 nt, Homo sapiens
acagucagauguuuaauca

SEQ ID NO: 174917 - RNA, 19 nt, Homo sapiens
uauauugcaucugcuguua

SEQ ID NO: 174918 - RNA, 19 nt, Homo sapiens
auacuuaggccugaaauua

SEQ ID NO: 174919 - RNA, 19 nt, Homo sapiens
acaaauguguuucccaguu

SEQ ID NO: 174920 - RNA, 19 nt, Homo sapiens
guggauaccuuuauacucu

SEQ ID NO: 174921 - RNA, 19 nt, Homo sapiens
cagaugcugcuauaaauaa

SEQ ID NO: 174922 - RNA, 19 nt, Homo sapiens
ggaguugugucuaucaaag

SEQ ID NO: 174923 - RNA, 19 nt, Homo sapiens
gaagagcgacccucacauc

SEQ ID NO: 174924 - RNA, 19 nt, Homo sapiens
gaaacaacugaaagcauaa

SEQ ID NO: 174925 - RNA, 19 nt, Homo sapiens
uaauagcuauggaaagaug

SEQ ID NO: 174926 - RNA, 19 nt, Homo sapiens
gagcgacccucacaucaag

SEQ ID NO: 174927 - RNA, 19 nt, Homo sapiens
ggugaugggaguuguauuu

SEQ ID NO: 174928 - RNA, 19 nt, Homo sapiens
ucacaugaaagaagaagua

SEQ ID NO: 174929 - RNA, 19 nt, Homo sapiens
ucaaggaaauacaccaguu

SEQ ID NO: 174930 - RNA, 19 nt, Homo sapiens
ggccuucucuuucagcauu

SEQ ID NO: 174931 - RNA, 19 nt, Homo sapiens
ccaagcggcuguacugcaa

SEQ ID NO: 174932 - RNA, 19 nt, Homo sapiens
ggaagucacagaaacaugu

SEQ ID NO: 174933 - RNA, 19 nt, Homo sapiens
ucaaaggagugugugcuaa

SEQ ID NO: 174934 - RNA, 19 nt, Homo sapiens
gcauuugcuuuauucgaaa

SEQ ID NO: 174935 - RNA, 19 nt, Homo sapiens
gaagagagaggaguugugu

SEQ ID NO: 174936 - RNA, 19 nt, Homo sapiens
ggaauggucaggaauuugu

SEQ ID NO: 174937 - RNA, 19 nt, Homo sapiens
caguugagacuuucuuaua

SEQ ID NO: 174938 - RNA, 19 nt, Homo sapiens
uuacagaugcugcuauaaa

SEQ ID NO: 174939 - RNA, 19 nt, Homo sapiens
ggagggaaacaucuacuga

SEQ ID NO: 174940 - RNA, 19 nt, Homo sapiens
acauuacccuaacaaagua

SEQ ID NO: 174941 - RNA, 19 nt, Homo sapiens
gugaaugaauauggcuuua

SEQ ID NO: 174942 - RNA, 19 nt, Homo sapiens
ucacgcauuugcuuuauuc

SEQ ID NO: 174943 - RNA, 19 nt, Homo sapiens
gaagcagucauaaacagaa

SEQ ID NO: 174944 - RNA, 19 nt, Homo sapiens
gagacuuucuuauaugaca

SEQ ID NO: 174945 - RNA, 19 nt, Homo sapiens
guugagacuuucuuauaug

SEQ ID NO: 174946 - RNA, 19 nt, Homo sapiens
ggucauggagaaauaauau

SEQ ID NO: 174947 - RNA, 19 nt, Homo sapiens
gauggauuguuacgaguug

SEQ ID NO: 174948 - RNA, 19 nt, Homo sapiens
gaacagcgccuacaguauu

SEQ ID NO: 174949 - RNA, 19 nt, Homo sapiens
gagaacagcgccuacagua

SEQ ID NO: 174950 - RNA, 19 nt, Homo sapiens
gcuccuggguggaaauuaa

SEQ ID NO: 174951 - RNA, 19 nt, Homo sapiens
gagcugggcuauaauacgu

SEQ ID NO: 174952 - RNA, 19 nt, Homo sapiens
caacggaaauuucauugcu

SEQ ID NO: 174953 - RNA, 19 nt, Homo sapiens
ggcgaaccguccuuucuuu

SEQ ID NO: 174954 - RNA, 19 nt, Homo sapiens
ggcgguaccuggccaugaa

SEQ ID NO: 174955 - RNA, 19 nt, Homo sapiens
ggcagccucuugacucuga

SEQ ID NO: 174956 - RNA, 19 nt, Homo sapiens
ccacagggaccacgagaug

SEQ ID NO: 174957 - RNA, 19 nt, Homo sapiens
uccacgagcugggcuauaa

SEQ ID NO: 174958 - RNA, 19 nt, Homo sapiens
gaaccguccuuucuuucag

SEQ ID NO: 174959 - RNA, 19 nt, Homo sapiens
ggacucgcguucccucucu

SEQ ID NO: 174960 - RNA, 19 nt, Homo sapiens
gcgcagcaacggaaauuuc

SEQ ID NO: 174961 - RNA, 19 nt, Homo sapiens
cagcaacggaaauuucauu

SEQ ID NO: 174962 - RNA, 19 nt, Homo sapiens
agaagcagagcccggauaa

SEQ ID NO: 174963 - RNA, 19 nt, Homo sapiens
aacagcgccuacaguauuu

SEQ ID NO: 174964 - RNA, 19 nt, Homo sapiens
ggagaacagcgccuacagu

SEQ ID NO: 174965 - RNA, 19 nt, Homo sapiens
gcugggcuauaauacguau

SEQ ID NO: 174966 - RNA, 19 nt, Homo sapiens
cgucuggguucucagcuau

SEQ ID NO: 174967 - RNA, 19 nt, Homo sapiens
gcgucuggguucucagcua

SEQ ID NO: 174968 - RNA, 19 nt, Homo sapiens
cacgagcugggcuauaaua

SEQ ID NO: 174969 - RNA, 19 nt, Homo sapiens
cagaagcagagcccggaua

SEQ ID NO: 174970 - RNA, 19 nt, Homo sapiens
ucuggguucucagcuauuu

SEQ ID NO: 174971 - RNA, 19 nt, Homo sapiens
ugugguacgugucugugaa

SEQ ID NO: 174972 - RNA, 19 nt, Homo sapiens
gcgccgagagacuguggua

SEQ ID NO: 174973 - RNA, 19 nt, Homo sapiens
cgaaccguccuuucuuuca

SEQ ID NO: 174974 - RNA, 19 nt, Homo sapiens
gacucugacucuccuccuu

SEQ ID NO: 174975 - RNA, 19 nt, Homo sapiens
caguggaggugggcauugu

SEQ ID NO: 174976 - RNA, 19 nt, Homo sapiens
cagcgccgagugcgaguuu

SEQ ID NO: 174977 - RNA, 19 nt, Homo sapiens
gcgaaccguccuuucuuuc

SEQ ID NO: 174978 - RNA, 19 nt, Homo sapiens
ggagcccucucacguucag

SEQ ID NO: 174979 - RNA, 19 nt, Homo sapiens
gcaguggaggugggcauug

SEQ ID NO: 174980 - RNA, 19 nt, Homo sapiens
aagaguagguguaagauau

SEQ ID NO: 174981 - RNA, 19 nt, Homo sapiens
gaugaagaguuuaaugcaa

SEQ ID NO: 174982 - RNA, 19 nt, Homo sapiens
gaguagguguaagauauuu

SEQ ID NO: 174983 - RNA, 19 nt, Homo sapiens
gcaacaguggagaaucuua

SEQ ID NO: 174984 - RNA, 19 nt, Homo sapiens
caagaguagguguaagaua

SEQ ID NO: 174985 - RNA, 19 nt, Homo sapiens
gcaagaaugggaagaccaa

SEQ ID NO: 174986 - RNA, 19 nt, Homo sapiens
ccaugaaggucacccacuu

SEQ ID NO: 174987 - RNA, 19 nt, Homo sapiens
uggagaaucuuaccauugg

SEQ ID NO: 174988 - RNA, 19 nt, Homo sapiens
gugcaacaguggagaaucu

SEQ ID NO: 174989 - RNA, 19 nt, Homo sapiens
agaguuuaaugcaagagua

SEQ ID NO: 174990 - RNA, 19 nt, Homo sapiens
guguauauauugccaccaa

SEQ ID NO: 174991 - RNA, 19 nt, Homo sapiens
gcgcacugcuccucagagu

SEQ ID NO: 174992 - RNA, 19 nt, Homo sapiens
ugaagaguuuaaugcaaga

SEQ ID NO: 174993 - RNA, 19 nt, Homo sapiens
gagugucgcccaccaugaa

SEQ ID NO: 174994 - RNA, 19 nt, Homo sapiens
ggagaaucuuaccauugga

SEQ ID NO: 174995 - RNA, 19 nt, Homo sapiens
ggaugaagaguuuaaugca

SEQ ID NO: 174996 - RNA, 19 nt, Homo sapiens
gcagcaagggcaagcucua

SEQ ID NO: 174997 - RNA, 19 nt, Homo sapiens
ccuacgaguccuacaagua

SEQ ID NO: 174998 - RNA, 19 nt, Homo sapiens
guggagaaucuuaccauug

SEQ ID NO: 174999 - RNA, 19 nt, Homo sapiens
gcaagggcaagcucuaugg

SEQ ID NO: 175000 - RNA, 19 nt, Homo sapiens
agaaugggaagaccaagaa

SEQ ID NO: 175001 - RNA, 19 nt, Homo sapiens
guauauauugccaccaaau

SEQ ID NO: 175002 - RNA, 19 nt, Homo sapiens
gcaagaguagguguaagau

SEQ ID NO: 175003 - RNA, 19 nt, Homo sapiens
gagaaucuuaccauuggau

SEQ ID NO: 175004 - RNA, 19 nt, Homo sapiens
caacaguggagaaucuuac

SEQ ID NO: 175005 - RNA, 19 nt, Homo sapiens
cuacgaguccuacaaguac

SEQ ID NO: 175006 - RNA, 19 nt, Homo sapiens
ccauuggauuucuuuaacu

SEQ ID NO: 175007 - RNA, 19 nt, Homo sapiens
aguggagaaucuuaccauu

SEQ ID NO: 175008 - RNA, 19 nt, Homo sapiens
agaguagguguaagauauu

SEQ ID NO: 175009 - RNA, 19 nt, Homo sapiens
ucaucgcccugagcaagaa

SEQ ID NO: 175010 - RNA, 19 nt, Homo sapiens
ugcaagaguagguguaaga

SEQ ID NO: 175011 - RNA, 19 nt, Homo sapiens
uaaugcaagaguaggugua

SEQ ID NO: 175012 - RNA, 19 nt, Homo sapiens
cagcaagggcaagcucuau

SEQ ID NO: 175013 - RNA, 19 nt, Homo sapiens
uguauauauugccaccaaa

SEQ ID NO: 175014 - RNA, 19 nt, Homo sapiens
gaguuuaaugcaagaguag

SEQ ID NO: 175015 - RNA, 19 nt, Homo sapiens
gggaauaaaucaugacuua

SEQ ID NO: 175016 - RNA, 19 nt, Homo sapiens
gcagauugcuuuaauuuga

SEQ ID NO: 175017 - RNA, 19 nt, Homo sapiens
gaaggaaaccucuggauaa

SEQ ID NO: 175018 - RNA, 19 nt, Homo sapiens
gaaggaaacuggaauucuu

SEQ ID NO: 175019 - RNA, 19 nt, Homo sapiens
gaagucacgucauuuguuu

SEQ ID NO: 175020 - RNA, 19 nt, Homo sapiens
ggaaaccucuggauaaaug

SEQ ID NO: 175021 - RNA, 19 nt, Homo sapiens
ugaacuagcuaccauauaa

SEQ ID NO: 175022 - RNA, 19 nt, Homo sapiens
caacuguacuggccaauuu

SEQ ID NO: 175023 - RNA, 19 nt, Homo sapiens
ccacgaagccaauauguua

SEQ ID NO: 175024 - RNA, 19 nt, Homo sapiens
gccaauauguuaaguguuu

SEQ ID NO: 175025 - RNA, 19 nt, Homo sapiens
acaaacaucuccagacuaa

SEQ ID NO: 175026 - RNA, 19 nt, Homo sapiens
gaacuuucuuucacgguua

SEQ ID NO: 175027 - RNA, 19 nt, Homo sapiens
gaaguuauuuccaaguuug

SEQ ID NO: 175028 - RNA, 19 nt, Homo sapiens
ugaaggagaucaaugguuu

SEQ ID NO: 175029 - RNA, 19 nt, Homo sapiens
uaacagggacuacguauuu

SEQ ID NO: 175030 - RNA, 19 nt, Homo sapiens
gacaauaacuucuuaaagg

SEQ ID NO: 175031 - RNA, 19 nt, Homo sapiens
gaguacaggugcauauuaa

SEQ ID NO: 175032 - RNA, 19 nt, Homo sapiens
acauauggcuuuaguagua

SEQ ID NO: 175033 - RNA, 19 nt, Homo sapiens
ccaauuaucugauuaagca

SEQ ID NO: 175034 - RNA, 19 nt, Homo sapiens
uaaggaaacuucugauguu

SEQ ID NO: 175035 - RNA, 19 nt, Homo sapiens
gaauagaugugcccuuuua

SEQ ID NO: 175036 - RNA, 19 nt, Homo sapiens
gaaagaacauacaugauac

SEQ ID NO: 175037 - RNA, 19 nt, Homo sapiens
cagcauaucucuacccauu

SEQ ID NO: 175038 - RNA, 19 nt, Homo sapiens
gcuaaaggcuaaacauaug

SEQ ID NO: 175039 - RNA, 19 nt, Homo sapiens
guaguaacacugugauuua

SEQ ID NO: 175040 - RNA, 19 nt, Homo sapiens
ggacauaaaucacagaaaa

SEQ ID NO: 175041 - RNA, 19 nt, Homo sapiens
gaucaaugguuuaacaguu

SEQ ID NO: 175042 - RNA, 19 nt, Homo sapiens
ggagaucaaugguuuaaca

SEQ ID NO: 175043 - RNA, 19 nt, Homo sapiens
ggaaaaggauuuagaggua

SEQ ID NO: 175044 - RNA, 19 nt, Homo sapiens
ggaaauauuugcugugucu

SEQ ID NO: 175045 - RNA, 19 nt, Homo sapiens
gcugggauaugauggguua

SEQ ID NO: 175046 - RNA, 19 nt, Homo sapiens
gaaauacagacucaaguuu

SEQ ID NO: 175047 - RNA, 19 nt, Homo sapiens
gaauagugcugcaauaaac

SEQ ID NO: 175048 - RNA, 19 nt, Homo sapiens
gagaauaugugguguuugg

SEQ ID NO: 175049 - RNA, 19 nt, Homo sapiens
gagcaaacacuuagaaaug

SEQ ID NO: 175050 - RNA, 19 nt, Homo sapiens
ugacagaaguuauuuccaa

SEQ ID NO: 175051 - RNA, 19 nt, Homo sapiens
uaacuagaaccaccaaaua

SEQ ID NO: 175052 - RNA, 19 nt, Homo sapiens
gaaacuggaauucuuugua

SEQ ID NO: 175053 - RNA, 19 nt, Homo sapiens
aaacuugcauucuggcaua

SEQ ID NO: 175054 - RNA, 19 nt, Homo sapiens
uugaacagcuggaggaaua

SEQ ID NO: 175055 - RNA, 19 nt, Homo sapiens
acacuaaguuugcaacauu

SEQ ID NO: 175056 - RNA, 19 nt, Homo sapiens
gcacaaauacaaaguggaa

SEQ ID NO: 175057 - RNA, 19 nt, Homo sapiens
ccacgucaaugcauaaguu

SEQ ID NO: 175058 - RNA, 19 nt, Homo sapiens
gugaauagaugugcccuuu

SEQ ID NO: 175059 - RNA, 19 nt, Homo sapiens
guauugaagucacgucauu

SEQ ID NO: 175060 - RNA, 19 nt, Homo sapiens
ccaaguagcugggauuaca

SEQ ID NO: 175061 - RNA, 19 nt, Homo sapiens
ccuaauaagugaagggaaa

SEQ ID NO: 175062 - RNA, 19 nt, Homo sapiens
guucaacucucauccaaau

SEQ ID NO: 175063 - RNA, 19 nt, Homo sapiens
ggauuuguguguaugugua

SEQ ID NO: 175064 - RNA, 19 nt, Homo sapiens
ucucuucacuuccuucuaa

SEQ ID NO: 175065 - RNA, 19 nt, Homo sapiens
ugaggcaucuuuacaucua

SEQ ID NO: 175066 - RNA, 19 nt, Homo sapiens
aaucaugacuuaucccauu

SEQ ID NO: 175067 - RNA, 19 nt, Homo sapiens
gaagggagggaauaaauca

SEQ ID NO: 175068 - RNA, 19 nt, Homo sapiens
uuacacagccuaaagcuaa

SEQ ID NO: 175069 - RNA, 19 nt, Homo sapiens
ggaauuuguuguguugaaa

SEQ ID NO: 175070 - RNA, 19 nt, Homo sapiens
guacaggugcauauuaauu

SEQ ID NO: 175071 - RNA, 19 nt, Homo sapiens
gcauaaaguuaccuacauc

SEQ ID NO: 175072 - RNA, 19 nt, Homo sapiens
gaagggaaagauaauaaug

SEQ ID NO: 175073 - RNA, 19 nt, Homo sapiens
agccauaccucagauaaua

SEQ ID NO: 175074 - RNA, 19 nt, Homo sapiens
ugagggauauuuagaacuu

SEQ ID NO: 175075 - RNA, 19 nt, Homo sapiens
ggaacaagaugcugaucca

SEQ ID NO: 175076 - RNA, 19 nt, Homo sapiens
gcaaacacuuagaaaugau

SEQ ID NO: 175077 - RNA, 19 nt, Homo sapiens
gugagaauaugugguguuu

SEQ ID NO: 175078 - RNA, 19 nt, Homo sapiens
cagaaguuauuuccaaguu

SEQ ID NO: 175079 - RNA, 19 nt, Homo sapiens
cuucaugguuugcauuuaa

SEQ ID NO: 175080 - RNA, 19 nt, Homo sapiens
gcuuuaugcuugagggaua

SEQ ID NO: 175081 - RNA, 19 nt, Homo sapiens
acaccuccuuuaagauuua

SEQ ID NO: 175082 - RNA, 19 nt, Homo sapiens
gauuacagguacaaugaug

SEQ ID NO: 175083 - RNA, 19 nt, Homo sapiens
caagucccauugucagaaa

SEQ ID NO: 175084 - RNA, 19 nt, Homo sapiens
gaaggagaucaaugguuua

SEQ ID NO: 175085 - RNA, 19 nt, Homo sapiens
caauuacacuugucuuuac

SEQ ID NO: 175086 - RNA, 19 nt, Homo sapiens
uaagugaagggaaagauaa

SEQ ID NO: 175087 - RNA, 19 nt, Homo sapiens
gggaauuuguuguguugaa

SEQ ID NO: 175088 - RNA, 19 nt, Homo sapiens
gaacugaaggagaucaaug

SEQ ID NO: 175089 - RNA, 19 nt, Homo sapiens
gaaaugauagagaacugaa

SEQ ID NO: 175090 - RNA, 19 nt, Homo sapiens
gaaugaugguuuccagcuu

SEQ ID NO: 175091 - RNA, 19 nt, Homo sapiens
ugaaggaaaccucuggaua

SEQ ID NO: 175092 - RNA, 19 nt, Homo sapiens
gggagggaauaaaucauga

SEQ ID NO: 175093 - RNA, 19 nt, Homo sapiens
guaacacugugauuuaucu

SEQ ID NO: 175094 - RNA, 19 nt, Homo sapiens
gggauuacagguacaauga

SEQ ID NO: 175095 - RNA, 19 nt, Homo sapiens
ccaccacgccagcuaauuu

SEQ ID NO: 175096 - RNA, 19 nt, Homo sapiens
gcaagucaggaaucauuaa

SEQ ID NO: 175097 - RNA, 19 nt, Homo sapiens
uaagccacgucaaugcaua

SEQ ID NO: 175098 - RNA, 19 nt, Homo sapiens
ggaaaauaguacacacaua

SEQ ID NO: 175099 - RNA, 19 nt, Homo sapiens
aaggaaaccucuggauaaa

SEQ ID NO: 175100 - RNA, 19 nt, Homo sapiens
ggaauucuacaccuccuuu

SEQ ID NO: 175101 - RNA, 19 nt, Homo sapiens
uaagcauucuuuccacuga

SEQ ID NO: 175102 - RNA, 19 nt, Homo sapiens
ugacaaacaucuccagacu

SEQ ID NO: 175103 - RNA, 19 nt, Homo sapiens
gaaaaggauuuagagguaa

SEQ ID NO: 175104 - RNA, 19 nt, Homo sapiens
uaucauuguuggacauuug

SEQ ID NO: 175105 - RNA, 19 nt, Homo sapiens
gaauuauauugguccagaa

SEQ ID NO: 175106 - RNA, 19 nt, Homo sapiens
ggagugcaguggcaugauc

SEQ ID NO: 175107 - RNA, 19 nt, Homo sapiens
gugaagggaaagauaauaa

SEQ ID NO: 175108 - RNA, 19 nt, Homo sapiens
gggcaucgguuuccaucug

SEQ ID NO: 175109 - RNA, 19 nt, Homo sapiens
aaacuggaauucuuuguac

SEQ ID NO: 175110 - RNA, 19 nt, Homo sapiens
gcauaucucuacccauuuu

SEQ ID NO: 175111 - RNA, 19 nt, Homo sapiens
gcaauacauagaacugaaa

SEQ ID NO: 175112 - RNA, 19 nt, Homo sapiens
gugccaaguucacagauga

SEQ ID NO: 175113 - RNA, 19 nt, Homo sapiens
ccaaagugcugggauuaca

SEQ ID NO: 175114 - RNA, 19 nt, Homo sapiens
cauaaguuguauaggcuaa

SEQ ID NO: 175115 - RNA, 19 nt, Homo sapiens
gggaauaaaucaugacuua

SEQ ID NO: 175116 - RNA, 19 nt, Homo sapiens
gcagauugcuuuaauuuga

SEQ ID NO: 175117 - RNA, 19 nt, Homo sapiens
gaaggaaaccucuggauaa

SEQ ID NO: 175118 - RNA, 19 nt, Homo sapiens
gaaggaaacuggaauucuu

SEQ ID NO: 175119 - RNA, 19 nt, Homo sapiens
gaagucacgucauuuguuu

SEQ ID NO: 175120 - RNA, 19 nt, Homo sapiens
ggaaaccucuggauaaaug

SEQ ID NO: 175121 - RNA, 19 nt, Homo sapiens
ugaacuagcuaccauauaa

SEQ ID NO: 175122 - RNA, 19 nt, Homo sapiens
caacuguacuggccaauuu

SEQ ID NO: 175123 - RNA, 19 nt, Homo sapiens
ccacgaagccaauauguua

SEQ ID NO: 175124 - RNA, 19 nt, Homo sapiens
acaaacaucuccagacuaa

SEQ ID NO: 175125 - RNA, 19 nt, Homo sapiens
gaacuuucuuucacgguua

SEQ ID NO: 175126 - RNA, 19 nt, Homo sapiens
gaaguuauuuccaaguuug

SEQ ID NO: 175127 - RNA, 19 nt, Homo sapiens
ugaaggagaucaaugguuu

SEQ ID NO: 175128 - RNA, 19 nt, Homo sapiens
uaacagggacuacguauuu

SEQ ID NO: 175129 - RNA, 19 nt, Homo sapiens
gacaauaacuucuuaaagg

SEQ ID NO: 175130 - RNA, 19 nt, Homo sapiens
gaguacaggugcauauuaa

SEQ ID NO: 175131 - RNA, 19 nt, Homo sapiens
acauauggcuuuaguagua

SEQ ID NO: 175132 - RNA, 19 nt, Homo sapiens
ccaauuaucugauuaagca

SEQ ID NO: 175133 - RNA, 19 nt, Homo sapiens
uaaggaaacuucugauguu

SEQ ID NO: 175134 - RNA, 19 nt, Homo sapiens
gaauagaugugcccuuuua

SEQ ID NO: 175135 - RNA, 19 nt, Homo sapiens
gaaagaacauacaugauac

SEQ ID NO: 175136 - RNA, 19 nt, Homo sapiens
cagcauaucucuacccauu

SEQ ID NO: 175137 - RNA, 19 nt, Homo sapiens
gcuaaaggcuaaacauaug

SEQ ID NO: 175138 - RNA, 19 nt, Homo sapiens
guaguaacacugugauuua

SEQ ID NO: 175139 - RNA, 19 nt, Homo sapiens
ggacauaaaucacagaaaa

SEQ ID NO: 175140 - RNA, 19 nt, Homo sapiens
gaucaaugguuuaacaguu

SEQ ID NO: 175141 - RNA, 19 nt, Homo sapiens
ggagaucaaugguuuaaca

SEQ ID NO: 175142 - RNA, 19 nt, Homo sapiens
ggaaaaggauuuagaggua

SEQ ID NO: 175143 - RNA, 19 nt, Homo sapiens
gcugggauaugauggguua

SEQ ID NO: 175144 - RNA, 19 nt, Homo sapiens
gaaauacagacucaaguuu

SEQ ID NO: 175145 - RNA, 19 nt, Homo sapiens
gaauagugcugcaauaaac

SEQ ID NO: 175146 - RNA, 19 nt, Homo sapiens
gagaauaugugguguuugg

SEQ ID NO: 175147 - RNA, 19 nt, Homo sapiens
gagcaaacacuuagaaaug

SEQ ID NO: 175148 - RNA, 19 nt, Homo sapiens
ugacagaaguuauuuccaa

SEQ ID NO: 175149 - RNA, 19 nt, Homo sapiens
uaacuagaaccaccaaaua

SEQ ID NO: 175150 - RNA, 19 nt, Homo sapiens
gaaacuggaauucuuugua

SEQ ID NO: 175151 - RNA, 19 nt, Homo sapiens
aaacuugcauucuggcaua

SEQ ID NO: 175152 - RNA, 19 nt, Homo sapiens
uugaacagcuggaggaaua

SEQ ID NO: 175153 - RNA, 19 nt, Homo sapiens
acacuaaguuugcaacauu

SEQ ID NO: 175154 - RNA, 19 nt, Homo sapiens
gcacaaauacaaaguggaa

SEQ ID NO: 175155 - RNA, 19 nt, Homo sapiens
ccacgucaaugcauaaguu

SEQ ID NO: 175156 - RNA, 19 nt, Homo sapiens
gugaauagaugugcccuuu

SEQ ID NO: 175157 - RNA, 19 nt, Homo sapiens
guauugaagucacgucauu

SEQ ID NO: 175158 - RNA, 19 nt, Homo sapiens
ccaaguagcugggauuaca

SEQ ID NO: 175159 - RNA, 19 nt, Homo sapiens
ccuaauaagugaagggaaa

SEQ ID NO: 175160 - RNA, 19 nt, Homo sapiens
guucaacucucauccaaau

SEQ ID NO: 175161 - RNA, 19 nt, Homo sapiens
ggauuuguguguaugugua

SEQ ID NO: 175162 - RNA, 19 nt, Homo sapiens
ucucuucacuuccuucuaa

SEQ ID NO: 175163 - RNA, 19 nt, Homo sapiens
ugaggcaucuuuacaucua

SEQ ID NO: 175164 - RNA, 19 nt, Homo sapiens
aaucaugacuuaucccauu

SEQ ID NO: 175165 - RNA, 19 nt, Homo sapiens
gaagggagggaauaaauca

SEQ ID NO: 175166 - RNA, 19 nt, Homo sapiens
uuacacagccuaaagcuaa

SEQ ID NO: 175167 - RNA, 19 nt, Homo sapiens
ggaauuuguuguguugaaa

SEQ ID NO: 175168 - RNA, 19 nt, Homo sapiens
guacaggugcauauuaauu

SEQ ID NO: 175169 - RNA, 19 nt, Homo sapiens
gcauaaaguuaccuacauc

SEQ ID NO: 175170 - RNA, 19 nt, Homo sapiens
gaagggaaagauaauaaug

SEQ ID NO: 175171 - RNA, 19 nt, Homo sapiens
agccauaccucagauaaua

SEQ ID NO: 175172 - RNA, 19 nt, Homo sapiens
ugagggauauuuagaacuu

SEQ ID NO: 175173 - RNA, 19 nt, Homo sapiens
ggaacaagaugcugaucca

SEQ ID NO: 175174 - RNA, 19 nt, Homo sapiens
gcaaacacuuagaaaugau

SEQ ID NO: 175175 - RNA, 19 nt, Homo sapiens
gugagaauaugugguguuu

SEQ ID NO: 175176 - RNA, 19 nt, Homo sapiens
cagaaguuauuuccaaguu

SEQ ID NO: 175177 - RNA, 19 nt, Homo sapiens
cuucaugguuugcauuuaa

SEQ ID NO: 175178 - RNA, 19 nt, Homo sapiens
gcuuuaugcuugagggaua

SEQ ID NO: 175179 - RNA, 19 nt, Homo sapiens
acaccuccuuuaagauuua

SEQ ID NO: 175180 - RNA, 19 nt, Homo sapiens
gauuacagguacaaugaug

SEQ ID NO: 175181 - RNA, 19 nt, Homo sapiens
caagucccauugucagaaa

SEQ ID NO: 175182 - RNA, 19 nt, Homo sapiens
gaaggagaucaaugguuua

SEQ ID NO: 175183 - RNA, 19 nt, Homo sapiens
caauuacacuugucuuuac

SEQ ID NO: 175184 - RNA, 19 nt, Homo sapiens
uaagugaagggaaagauaa

SEQ ID NO: 175185 - RNA, 19 nt, Homo sapiens
gggaauuuguuguguugaa

SEQ ID NO: 175186 - RNA, 19 nt, Homo sapiens
gaacugaaggagaucaaug

SEQ ID NO: 175187 - RNA, 19 nt, Homo sapiens
gaaaugauagagaacugaa

SEQ ID NO: 175188 - RNA, 19 nt, Homo sapiens
gaaugaugguuuccagcuu

SEQ ID NO: 175189 - RNA, 19 nt, Homo sapiens
ugaaggaaaccucuggaua

SEQ ID NO: 175190 - RNA, 19 nt, Homo sapiens
gggagggaauaaaucauga

SEQ ID NO: 175191 - RNA, 19 nt, Homo sapiens
guaacacugugauuuaucu

SEQ ID NO: 175192 - RNA, 19 nt, Homo sapiens
gggauuacagguacaauga

SEQ ID NO: 175193 - RNA, 19 nt, Homo sapiens
ccaccacgccagcuaauuu

SEQ ID NO: 175194 - RNA, 19 nt, Homo sapiens
gcaagucaggaaucauuaa

SEQ ID NO: 175195 - RNA, 19 nt, Homo sapiens
uaagccacgucaaugcaua

SEQ ID NO: 175196 - RNA, 19 nt, Homo sapiens
ggaaaauaguacacacaua

SEQ ID NO: 175197 - RNA, 19 nt, Homo sapiens
aaggaaaccucuggauaaa

SEQ ID NO: 175198 - RNA, 19 nt, Homo sapiens
ggaauucuacaccuccuuu

SEQ ID NO: 175199 - RNA, 19 nt, Homo sapiens
uaagcauucuuuccacuga

SEQ ID NO: 175200 - RNA, 19 nt, Homo sapiens
ugacaaacaucuccagacu

SEQ ID NO: 175201 - RNA, 19 nt, Homo sapiens
gaaaaggauuuagagguaa

SEQ ID NO: 175202 - RNA, 19 nt, Homo sapiens
gguauguggcccugaauaa

SEQ ID NO: 175203 - RNA, 19 nt, Homo sapiens
uaucauuguuggacauuug

SEQ ID NO: 175204 - RNA, 19 nt, Homo sapiens
gaauuauauugguccagaa

SEQ ID NO: 175205 - RNA, 19 nt, Homo sapiens
ggagugcaguggcaugauc

SEQ ID NO: 175206 - RNA, 19 nt, Homo sapiens
gggcaucgguuuccaucug

SEQ ID NO: 175207 - RNA, 19 nt, Homo sapiens
gugaagggaaagauaauaa

SEQ ID NO: 175208 - RNA, 19 nt, Homo sapiens
aaacuggaauucuuuguac

SEQ ID NO: 175209 - RNA, 19 nt, Homo sapiens
gcauaucucuacccauuuu

SEQ ID NO: 175210 - RNA, 19 nt, Homo sapiens
gcaauacauagaacugaaa

SEQ ID NO: 175211 - RNA, 19 nt, Homo sapiens
ccaaagugcugggauuaca

SEQ ID NO: 175212 - RNA, 19 nt, Homo sapiens
cauaaguuguauaggcuaa

SEQ ID NO: 175213 - RNA, 19 nt, Homo sapiens
uaaguauugugcacuguau

SEQ ID NO: 175214 - RNA, 19 nt, Homo sapiens
auagagaacugaaggagau

SEQ ID NO: 175215 - RNA, 19 nt, Homo sapiens
gaaugcaaguucagagaaa

SEQ ID NO: 175216 - RNA, 19 nt, Homo sapiens
cagaaacuguucaucacua

SEQ ID NO: 175217 - RNA, 19 nt, Homo sapiens
caagaagaaugcaaguuca

SEQ ID NO: 175218 - RNA, 19 nt, Homo sapiens
gaacaguaaaggaagauug

SEQ ID NO: 175219 - RNA, 19 nt, Homo sapiens
gcugugggcucucgucuuc

SEQ ID NO: 175220 - RNA, 19 nt, Homo sapiens
ccaagaagaaugcaaguuc

SEQ ID NO: 175221 - RNA, 19 nt, Homo sapiens
gugagucucuuuggaguga

SEQ ID NO: 175222 - RNA, 19 nt, Homo sapiens
gaacugggaaaguggcuau

SEQ ID NO: 175223 - RNA, 19 nt, Homo sapiens
caucaucuguucgauugaa

SEQ ID NO: 175224 - RNA, 19 nt, Homo sapiens
caacgugggcaucggcuuu

SEQ ID NO: 175225 - RNA, 19 nt, Homo sapiens
caugaacaguaaaggaaga

SEQ ID NO: 175226 - RNA, 19 nt, Homo sapiens
ggauggcccugggacagaa

SEQ ID NO: 175227 - RNA, 19 nt, Homo sapiens
agaaacuguucaucacuau

SEQ ID NO: 175228 - RNA, 19 nt, Homo sapiens
gacugucacucauuuccuu

SEQ ID NO: 175229 - RNA, 19 nt, Homo sapiens
gccaugaacaguaaaggaa

SEQ ID NO: 175230 - RNA, 19 nt, Homo sapiens
gcaaauacggacggguaaa

SEQ ID NO: 175231 - RNA, 19 nt, Homo sapiens
guaccaagggaccuacauu

SEQ ID NO: 175232 - RNA, 19 nt, Homo sapiens
uuuaaagcaucaucuguuc

SEQ ID NO: 175233 - RNA, 19 nt, Homo sapiens
uuacaaugccuacgaguca

SEQ ID NO: 175234 - RNA, 19 nt, Homo sapiens
gaaacccuccugcccaaca

SEQ ID NO: 175235 - RNA, 19 nt, Homo sapiens
agcaucaucuguucgauug

SEQ ID NO: 175236 - RNA, 19 nt, Homo sapiens
ggggcuagcuggagagauu

SEQ ID NO: 175237 - RNA, 19 nt, Homo sapiens
cugggaaaguggcuauuug

SEQ ID NO: 175238 - RNA, 19 nt, Homo sapiens
aaacuguucaucacuaugu

SEQ ID NO: 175239 - RNA, 19 nt, Homo sapiens
uaaagcaucaucuguucga

SEQ ID NO: 175240 - RNA, 19 nt, Homo sapiens
gaucuaaggacccacaaaa

SEQ ID NO: 175241 - RNA, 19 nt, Homo sapiens
gauuuaaagcaucaucugu

SEQ ID NO: 175242 - RNA, 19 nt, Homo sapiens
gaaacuguucaucacuaug

SEQ ID NO: 175243 - RNA, 19 nt, Homo sapiens
ucguugccaugaacaguaa

SEQ ID NO: 175244 - RNA, 19 nt, Homo sapiens
caucuguucgauugaaauu

SEQ ID NO: 175245 - RNA, 19 nt, Homo sapiens
caaauacggacggguaaag

SEQ ID NO: 175246 - RNA, 19 nt, Homo sapiens
aaacccuccugcccaacaa

SEQ ID NO: 175247 - RNA, 19 nt, Homo sapiens
uaccaagggaccuacauug

SEQ ID NO: 175248 - RNA, 19 nt, Homo sapiens
acaauuacaaugccuacga

SEQ ID NO: 175249 - RNA, 19 nt, Homo sapiens
ggaucuaaggacccacaaa

SEQ ID NO: 175250 - RNA, 19 nt, Homo sapiens
agaaugcaaguucagagaa

SEQ ID NO: 175251 - RNA, 19 nt, Homo sapiens
caacgcccagcuuccaaga

SEQ ID NO: 175252 - RNA, 19 nt, Homo sapiens
cguggugagucucuuugga

SEQ ID NO: 175253 - RNA, 19 nt, Homo sapiens
aagaaugcaaguucagaga

SEQ ID NO: 175254 - RNA, 19 nt, Homo sapiens
gaaagugaauucuaucuug

SEQ ID NO: 175255 - RNA, 19 nt, Homo sapiens
ggaaauguuuguugccuua

SEQ ID NO: 175256 - RNA, 19 nt, Homo sapiens
caacagugauugaugauaa

SEQ ID NO: 175257 - RNA, 19 nt, Homo sapiens
caacugaacuuacuacgaa

SEQ ID NO: 175258 - RNA, 19 nt, Homo sapiens
gauauagccuuuacauuug

SEQ ID NO: 175259 - RNA, 19 nt, Homo sapiens
gcaaauggcuacaaaugug

SEQ ID NO: 175260 - RNA, 19 nt, Homo sapiens
ggagagagcaugaauggua

SEQ ID NO: 175261 - RNA, 19 nt, Homo sapiens
ggauaaggcuaacaauuug

SEQ ID NO: 175262 - RNA, 19 nt, Homo sapiens
caacagaguuauuuaagga

SEQ ID NO: 175263 - RNA, 19 nt, Homo sapiens
cccaagagaugaagaauaa

SEQ ID NO: 175264 - RNA, 19 nt, Homo sapiens
caacagacauggaauucuu

SEQ ID NO: 175265 - RNA, 19 nt, Homo sapiens
ugacuaaucuauacuguga

SEQ ID NO: 175266 - RNA, 19 nt, Homo sapiens
gcaaugcacuucauacaca

SEQ ID NO: 175267 - RNA, 19 nt, Homo sapiens
gaacugcccuuccucagau

SEQ ID NO: 175268 - RNA, 19 nt, Homo sapiens
aaugggaggucaauauuua

SEQ ID NO: 175269 - RNA, 19 nt, Homo sapiens
cacauauucuugccaauua

SEQ ID NO: 175270 - RNA, 19 nt, Homo sapiens
gcagggagauuucuuuaag

SEQ ID NO: 175271 - RNA, 19 nt, Homo sapiens
uuacacaccuuuagaauuc

SEQ ID NO: 175272 - RNA, 19 nt, Homo sapiens
gaucaugcuuucacauuau

SEQ ID NO: 175273 - RNA, 19 nt, Homo sapiens
ucacgcagcuggguagaua

SEQ ID NO: 175274 - RNA, 19 nt, Homo sapiens
ggacuuugcuagcuagguu

SEQ ID NO: 175275 - RNA, 19 nt, Homo sapiens
ggauuuaucaacagaguua

SEQ ID NO: 175276 - RNA, 19 nt, Homo sapiens
gaggucagccuacagauaa

SEQ ID NO: 175277 - RNA, 19 nt, Homo sapiens
caacuuugcucuacagauc

SEQ ID NO: 175278 - RNA, 19 nt, Homo sapiens
ggaggucaauauuuaucua

SEQ ID NO: 175279 - RNA, 19 nt, Homo sapiens
gaaagaaugcaaugaagau

SEQ ID NO: 175280 - RNA, 19 nt, Homo sapiens
uaagauagcaacagugauu

SEQ ID NO: 175281 - RNA, 19 nt, Homo sapiens
gguggaaagugaauucuau

SEQ ID NO: 175282 - RNA, 19 nt, Homo sapiens
gcaaacagcgucacagcaa

SEQ ID NO: 175283 - RNA, 19 nt, Homo sapiens
ccacaaauaaucaugcuuu

SEQ ID NO: 175284 - RNA, 19 nt, Homo sapiens
gauaaucaagccacacuaa

SEQ ID NO: 175285 - RNA, 19 nt, Homo sapiens
ugacaugacuccagagcaa

SEQ ID NO: 175286 - RNA, 19 nt, Homo sapiens
gagagagcaugaaugguau

SEQ ID NO: 175287 - RNA, 19 nt, Homo sapiens
agaaaucucugcuguucaa

SEQ ID NO: 175288 - RNA, 19 nt, Homo sapiens
uagcaacagugauugauga

SEQ ID NO: 175289 - RNA, 19 nt, Homo sapiens
ggcaggauuugucagauaa

SEQ ID NO: 175290 - RNA, 19 nt, Homo sapiens
gagcaaauggcuacaaaug

SEQ ID NO: 175291 - RNA, 19 nt, Homo sapiens
gauaggaagaggucaauga

SEQ ID NO: 175292 - RNA, 19 nt, Homo sapiens
gcacaugcuuucuacucuu

SEQ ID NO: 175293 - RNA, 19 nt, Homo sapiens
ccggagcacuacacuauaa

SEQ ID NO: 175294 - RNA, 19 nt, Homo sapiens
gaguuauacuuccaucaaa

SEQ ID NO: 175295 - RNA, 19 nt, Homo sapiens
gcaaagaaagaaugcaaug

SEQ ID NO: 175296 - RNA, 19 nt, Homo sapiens
ugaauucuaucuugcaaug

SEQ ID NO: 175297 - RNA, 19 nt, Homo sapiens
ucaaggacuuugcuagcua

SEQ ID NO: 175298 - RNA, 19 nt, Homo sapiens
gcugagaaauaguuuguag

SEQ ID NO: 175299 - RNA, 19 nt, Homo sapiens
gagaaauaguuuguagcua

SEQ ID NO: 175300 - RNA, 19 nt, Homo sapiens
gauuguaacuucaaagaac

SEQ ID NO: 175301 - RNA, 19 nt, Homo sapiens
gaaguuaugauuacaugga

SEQ ID NO: 175302 - RNA, 19 nt, Homo sapiens
cagagcaaauggcuacaaa

SEQ ID NO: 175303 - RNA, 19 nt, Homo sapiens
agaucaugcuuucacauua

SEQ ID NO: 175304 - RNA, 19 nt, Homo sapiens
acaaauggauacugacaug

SEQ ID NO: 175305 - RNA, 19 nt, Homo sapiens
ggaauccuguguuguuauc

SEQ ID NO: 175306 - RNA, 19 nt, Homo sapiens
caaaugugacuaugucuug

SEQ ID NO: 175307 - RNA, 19 nt, Homo sapiens
gacuaucuguucauaauca

SEQ ID NO: 175308 - RNA, 19 nt, Homo sapiens
gguacuauaucuuuagcuu

SEQ ID NO: 175309 - RNA, 19 nt, Homo sapiens
gcagacaacagacauggaa

SEQ ID NO: 175310 - RNA, 19 nt, Homo sapiens
uagaaaggcucaaguugca

SEQ ID NO: 175311 - RNA, 19 nt, Homo sapiens
gcuuucuacucuucgauua

SEQ ID NO: 175312 - RNA, 19 nt, Homo sapiens
ucacacagaacaauacaaa

SEQ ID NO: 175313 - RNA, 19 nt, Homo sapiens
gauaaaagaggcaaaguaa

SEQ ID NO: 175314 - RNA, 19 nt, Homo sapiens
ggaguuauacuuccaucaa

SEQ ID NO: 175315 - RNA, 19 nt, Homo sapiens
aggauaaggcuaacaauuu

SEQ ID NO: 175316 - RNA, 19 nt, Homo sapiens
uaaguggacuguuuucuuu

SEQ ID NO: 175317 - RNA, 19 nt, Homo sapiens
cacaagaaguuaugauuac

SEQ ID NO: 175318 - RNA, 19 nt, Homo sapiens
gaaaggguauugcuaaaag

SEQ ID NO: 175319 - RNA, 19 nt, Homo sapiens
gaacuuacuacgaacuguu

SEQ ID NO: 175320 - RNA, 19 nt, Homo sapiens
cacaaugacuaaucuauac

SEQ ID NO: 175321 - RNA, 19 nt, Homo sapiens
acaagagucuagaucaguu

SEQ ID NO: 175322 - RNA, 19 nt, Homo sapiens
gguagcacuuuauauguuc

SEQ ID NO: 175323 - RNA, 19 nt, Homo sapiens
auagaugucucacacagaa

SEQ ID NO: 175324 - RNA, 19 nt, Homo sapiens
uggcaggauuugucagaua

SEQ ID NO: 175325 - RNA, 19 nt, Homo sapiens
gagcgacacacaagaaguu

SEQ ID NO: 175326 - RNA, 19 nt, Homo sapiens
cauggauccugccaacuuu

SEQ ID NO: 175327 - RNA, 19 nt, Homo sapiens
auauacagcugucacaaga

SEQ ID NO: 175328 - RNA, 19 nt, Homo sapiens
gguaguauaagucaccuaa

SEQ ID NO: 175329 - RNA, 19 nt, Homo sapiens
gauuagaacaugcuuauac

SEQ ID NO: 175330 - RNA, 19 nt, Homo sapiens
ggaaaacucuaugcaaaga

SEQ ID NO: 175331 - RNA, 19 nt, Homo sapiens
ggaaagugaauucuaucuu

SEQ ID NO: 175332 - RNA, 19 nt, Homo sapiens
gacaguggcaguuggaauu

SEQ ID NO: 175333 - RNA, 19 nt, Homo sapiens
gcaccaggcagacaacaga

SEQ ID NO: 175334 - RNA, 19 nt, Homo sapiens
gcagaggaggacuuaguuu

SEQ ID NO: 175335 - RNA, 19 nt, Homo sapiens
ccuucugccuguugauuua

SEQ ID NO: 175336 - RNA, 19 nt, Homo sapiens
auaauguucuucccacaaa

SEQ ID NO: 175337 - RNA, 19 nt, Homo sapiens
uauaagauagcaacaguga

SEQ ID NO: 175338 - RNA, 19 nt, Homo sapiens
agaacaugcuuauaccuau

SEQ ID NO: 175339 - RNA, 19 nt, Homo sapiens
ggaaaaccauuacaacaca

SEQ ID NO: 175340 - RNA, 19 nt, Homo sapiens
gcacaaauggauacugaca

SEQ ID NO: 175341 - RNA, 19 nt, Homo sapiens
ucuauacugugaugauuug

SEQ ID NO: 175342 - RNA, 19 nt, Homo sapiens
gguaaauccauuccuggua

SEQ ID NO: 175343 - RNA, 19 nt, Homo sapiens
ccaaugggaggucaauauu

SEQ ID NO: 175344 - RNA, 19 nt, Homo sapiens
gggaauauggcuuuuaaua

SEQ ID NO: 175345 - RNA, 19 nt, Homo sapiens
cagcagggagauuucuuua

SEQ ID NO: 175346 - RNA, 19 nt, Homo sapiens
acacauaugcaucagcuaa

SEQ ID NO: 175347 - RNA, 19 nt, Homo sapiens
acacuauaaugcacaaaug

SEQ ID NO: 175348 - RNA, 19 nt, Homo sapiens
gagauauagccuuuacauu

SEQ ID NO: 175349 - RNA, 19 nt, Homo sapiens
gaggauuuaucaacagagu

SEQ ID NO: 175350 - RNA, 19 nt, Homo sapiens
caagagucuagaucaguua

SEQ ID NO: 175351 - RNA, 19 nt, Homo sapiens
ccaucccucuuacucauuu

SEQ ID NO: 175352 - RNA, 19 nt, Homo sapiens
gauaauacuguacuucauc

SEQ ID NO: 175353 - RNA, 19 nt, Homo sapiens
guggaaaggguauugcuaa

SEQ ID NO: 175354 - RNA, 19 nt, Homo sapiens
cagagaggcucauccugua

SEQ ID NO: 175355 - RNA, 19 nt, Homo sapiens
guucaguccucaccuaauu

SEQ ID NO: 175356 - RNA, 19 nt, Homo sapiens
acacagcgcugcagaaugc

SEQ ID NO: 175357 - RNA, 19 nt, Homo sapiens
ggaagcugaucgccaagag

SEQ ID NO: 175358 - RNA, 19 nt, Homo sapiens
ggguuccgguuguugauau

SEQ ID NO: 175359 - RNA, 19 nt, Homo sapiens
ggcaaggacugcgucuuca

SEQ ID NO: 175360 - RNA, 19 nt, Homo sapiens
agacgggccucuacaucug

SEQ ID NO: 175361 - RNA, 19 nt, Homo sapiens
gagacgggccucuacaucu

SEQ ID NO: 175362 - RNA, 19 nt, Homo sapiens
gagacggacaccuuuggaa

SEQ ID NO: 175363 - RNA, 19 nt, Homo sapiens
ccaaguacgagggcuggua

SEQ ID NO: 175364 - RNA, 19 nt, Homo sapiens
ggagacggacaccuuugga

SEQ ID NO: 175365 - RNA, 19 nt, Homo sapiens
acaucugcaugaacaagaa

SEQ ID NO: 175366 - RNA, 19 nt, Homo sapiens
auuguuugcuguuggguuu

SEQ ID NO: 175367 - RNA, 19 nt, Homo sapiens
cgugagguccacuucauga

SEQ ID NO: 175368 - RNA, 19 nt, Homo sapiens
cuacacagcgcugcagaau

SEQ ID NO: 175369 - RNA, 19 nt, Homo sapiens
cggagauugugcuggagaa

SEQ ID NO: 175370 - RNA, 19 nt, Homo sapiens
ggaccuaccaacucuacag

SEQ ID NO: 175371 - RNA, 19 nt, Homo sapiens
gguuccgguuguugauauu

SEQ ID NO: 175372 - RNA, 19 nt, Homo sapiens
gagccugcgcuucgaguuc

SEQ ID NO: 175373 - RNA, 19 nt, Homo sapiens
gcugcagaaugccaaguac

SEQ ID NO: 175374 - RNA, 19 nt, Homo sapiens
ugagcugccugcuguugca

SEQ ID NO: 175375 - RNA, 19 nt, Homo sapiens
gagauugugcuggagaaca

SEQ ID NO: 175376 - RNA, 19 nt, Homo sapiens
gcugccugcuguugcacuu

SEQ ID NO: 175377 - RNA, 19 nt, Homo sapiens
cgagacgggccucuacauc

SEQ ID NO: 175378 - RNA, 19 nt, Homo sapiens
cagagaggcucauccugua

SEQ ID NO: 175379 - RNA, 19 nt, Homo sapiens
guucaguccucaccuaauu

SEQ ID NO: 175380 - RNA, 19 nt, Homo sapiens
ggagcucgcuucccuguuc

SEQ ID NO: 175381 - RNA, 19 nt, Homo sapiens
acacagcgcugcagaaugc

SEQ ID NO: 175382 - RNA, 19 nt, Homo sapiens
ggaagcugaucgccaagag

SEQ ID NO: 175383 - RNA, 19 nt, Homo sapiens
ggguuccgguuguugauau

SEQ ID NO: 175384 - RNA, 19 nt, Homo sapiens
ggcaaggacugcgucuuca

SEQ ID NO: 175385 - RNA, 19 nt, Homo sapiens
agacgggccucuacaucug

SEQ ID NO: 175386 - RNA, 19 nt, Homo sapiens
gagacgggccucuacaucu

SEQ ID NO: 175387 - RNA, 19 nt, Homo sapiens
gagacggacaccuuuggaa

SEQ ID NO: 175388 - RNA, 19 nt, Homo sapiens
gggugucucccaacaggua

SEQ ID NO: 175389 - RNA, 19 nt, Homo sapiens
ccaaguacgagggcuggua

SEQ ID NO: 175390 - RNA, 19 nt, Homo sapiens
ggagacggacaccuuugga

SEQ ID NO: 175391 - RNA, 19 nt, Homo sapiens
acaucugcaugaacaagaa

SEQ ID NO: 175392 - RNA, 19 nt, Homo sapiens
auuguuugcuguuggguuu

SEQ ID NO: 175393 - RNA, 19 nt, Homo sapiens
cgugagguccacuucauga

SEQ ID NO: 175394 - RNA, 19 nt, Homo sapiens
cuacacagcgcugcagaau

SEQ ID NO: 175395 - RNA, 19 nt, Homo sapiens
cggagauugugcuggagaa

SEQ ID NO: 175396 - RNA, 19 nt, Homo sapiens
ggaccuaccaacucuacag

SEQ ID NO: 175397 - RNA, 19 nt, Homo sapiens
gguuccgguuguugauauu

SEQ ID NO: 175398 - RNA, 19 nt, Homo sapiens
gagccugcgcuucgaguuc

SEQ ID NO: 175399 - RNA, 19 nt, Homo sapiens
gcugcagaaugccaaguac

SEQ ID NO: 175400 - RNA, 19 nt, Homo sapiens
ugagcugccugcuguugca

SEQ ID NO: 175401 - RNA, 19 nt, Homo sapiens
gcugccugcuguugcacuu

SEQ ID NO: 175402 - RNA, 19 nt, Homo sapiens
gagauugugcuggagaaca

SEQ ID NO: 175403 - RNA, 19 nt, Homo sapiens
cgagacgggccucuacauc

SEQ ID NO: 175404 - RNA, 19 nt, Homo sapiens
cagagaggcucauccugua

SEQ ID NO: 175405 - RNA, 19 nt, Homo sapiens
ggagcucgcuucccuguuc

SEQ ID NO: 175406 - RNA, 19 nt, Homo sapiens
acacagcgcugcagaaugc

SEQ ID NO: 175407 - RNA, 19 nt, Homo sapiens
ggaagcugaucgccaagag

SEQ ID NO: 175408 - RNA, 19 nt, Homo sapiens
ggguuccgguuguugauau

SEQ ID NO: 175409 - RNA, 19 nt, Homo sapiens
ggcaaggacugcgucuuca

SEQ ID NO: 175410 - RNA, 19 nt, Homo sapiens
agacgggccucuacaucug

SEQ ID NO: 175411 - RNA, 19 nt, Homo sapiens
gagacgggccucuacaucu

SEQ ID NO: 175412 - RNA, 19 nt, Homo sapiens
gagacggacaccuuuggaa

SEQ ID NO: 175413 - RNA, 19 nt, Homo sapiens
ccaaguacgagggcuggua

SEQ ID NO: 175414 - RNA, 19 nt, Homo sapiens
ggagacggacaccuuugga

SEQ ID NO: 175415 - RNA, 19 nt, Homo sapiens
acaucugcaugaacaagaa

SEQ ID NO: 175416 - RNA, 19 nt, Homo sapiens
auuguuugcuguuggguuu

SEQ ID NO: 175417 - RNA, 19 nt, Homo sapiens
cgugagguccacuucauga

SEQ ID NO: 175418 - RNA, 19 nt, Homo sapiens
cuacacagcgcugcagaau

SEQ ID NO: 175419 - RNA, 19 nt, Homo sapiens
cggagauugugcuggagaa

SEQ ID NO: 175420 - RNA, 19 nt, Homo sapiens
ggaccuaccaacucuacag

SEQ ID NO: 175421 - RNA, 19 nt, Homo sapiens
gguuccgguuguugauauu

SEQ ID NO: 175422 - RNA, 19 nt, Homo sapiens
gagccugcgcuucgaguuc

SEQ ID NO: 175423 - RNA, 19 nt, Homo sapiens
gcugcagaaugccaaguac

SEQ ID NO: 175424 - RNA, 19 nt, Homo sapiens
ugagcugccugcuguugca

SEQ ID NO: 175425 - RNA, 19 nt, Homo sapiens
gagauugugcuggagaaca

SEQ ID NO: 175426 - RNA, 19 nt, Homo sapiens
gcugccugcuguugcacuu

SEQ ID NO: 175427 - RNA, 19 nt, Homo sapiens
cgagacgggccucuacauc

SEQ ID NO: 175428 - RNA, 19 nt, Homo sapiens
cagagaggcucauccugua

SEQ ID NO: 175429 - RNA, 19 nt, Homo sapiens
acacagcgcugcagaaugc

SEQ ID NO: 175430 - RNA, 19 nt, Homo sapiens
ggaagcugaucgccaagag

SEQ ID NO: 175431 - RNA, 19 nt, Homo sapiens
ggguuccgguuguugauau

SEQ ID NO: 175432 - RNA, 19 nt, Homo sapiens
ggcaaggacugcgucuuca

SEQ ID NO: 175433 - RNA, 19 nt, Homo sapiens
agacgggccucuacaucug

SEQ ID NO: 175434 - RNA, 19 nt, Homo sapiens
gagacgggccucuacaucu

SEQ ID NO: 175435 - RNA, 19 nt, Homo sapiens
gagacggacaccuuuggaa

SEQ ID NO: 175436 - RNA, 19 nt, Homo sapiens
ccaaguacgagggcuggua

SEQ ID NO: 175437 - RNA, 19 nt, Homo sapiens
ggagacggacaccuuugga

SEQ ID NO: 175438 - RNA, 19 nt, Homo sapiens
acaucugcaugaacaagaa

SEQ ID NO: 175439 - RNA, 19 nt, Homo sapiens
auuguuugcuguuggguuu

SEQ ID NO: 175440 - RNA, 19 nt, Homo sapiens
cgugagguccacuucauga

SEQ ID NO: 175441 - RNA, 19 nt, Homo sapiens
cuacacagcgcugcagaau

SEQ ID NO: 175442 - RNA, 19 nt, Homo sapiens
cggagauugugcuggagaa

SEQ ID NO: 175443 - RNA, 19 nt, Homo sapiens
ggaccuaccaacucuacag

SEQ ID NO: 175444 - RNA, 19 nt, Homo sapiens
gguuccgguuguugauauu

SEQ ID NO: 175445 - RNA, 19 nt, Homo sapiens
gagccugcgcuucgaguuc

SEQ ID NO: 175446 - RNA, 19 nt, Homo sapiens
gcugcagaaugccaaguac

SEQ ID NO: 175447 - RNA, 19 nt, Homo sapiens
ugagcugccugcuguugca

SEQ ID NO: 175448 - RNA, 19 nt, Homo sapiens
gcugccugcuguugcacuu

SEQ ID NO: 175449 - RNA, 19 nt, Homo sapiens
gagauugugcuggagaaca

SEQ ID NO: 175450 - RNA, 19 nt, Homo sapiens
cgagacgggccucuacauc

SEQ ID NO: 175451 - RNA, 19 nt, Homo sapiens
ggauauaccucgccuaaua

SEQ ID NO: 175452 - RNA, 19 nt, Homo sapiens
caaaguaccugaacuguau

SEQ ID NO: 175453 - RNA, 19 nt, Homo sapiens
gcagugaacuuaaagcaaa

SEQ ID NO: 175454 - RNA, 19 nt, Homo sapiens
gcgauacuauguugcauua

SEQ ID NO: 175455 - RNA, 19 nt, Homo sapiens
ggacuuggaucauuuaaag

SEQ ID NO: 175456 - RNA, 19 nt, Homo sapiens
gcgcgagggugcagucuua

SEQ ID NO: 175457 - RNA, 19 nt, Homo sapiens
ggaaggcgauacuauguug

SEQ ID NO: 175458 - RNA, 19 nt, Homo sapiens
caccagaaauucacacauu

SEQ ID NO: 175459 - RNA, 19 nt, Homo sapiens
ucacggacuuggaucauuu

SEQ ID NO: 175460 - RNA, 19 nt, Homo sapiens
ggacuggauuucacuuaga

SEQ ID NO: 175461 - RNA, 19 nt, Homo sapiens
ggacuaaacggcaccagaa

SEQ ID NO: 175462 - RNA, 19 nt, Homo sapiens
gaaagaccacagccgauuu

SEQ ID NO: 175463 - RNA, 19 nt, Homo sapiens
cacaucagcuccacuguug

SEQ ID NO: 175464 - RNA, 19 nt, Homo sapiens
ccaagaguguguauucaga

SEQ ID NO: 175465 - RNA, 19 nt, Homo sapiens
gagaagggacuaggacuaa

SEQ ID NO: 175466 - RNA, 19 nt, Homo sapiens
ggagagagagagagacuga

SEQ ID NO: 175467 - RNA, 19 nt, Homo sapiens
ggaauaugcugauuuuguu

SEQ ID NO: 175468 - RNA, 19 nt, Homo sapiens
uaccugaacuguauaagga

SEQ ID NO: 175469 - RNA, 19 nt, Homo sapiens
uaucaucgcagugaacuua

SEQ ID NO: 175470 - RNA, 19 nt, Homo sapiens
cgucaaaccuauauaagca

SEQ ID NO: 175471 - RNA, 19 nt, Homo sapiens
ggaaagaccacagccgauu

SEQ ID NO: 175472 - RNA, 19 nt, Homo sapiens
ggagcuguauggaucagaa

SEQ ID NO: 175473 - RNA, 19 nt, Homo sapiens
ggacagcccgguuuuguua

SEQ ID NO: 175474 - RNA, 19 nt, Homo sapiens
gagggugcagucuuacuua

SEQ ID NO: 175475 - RNA, 19 nt, Homo sapiens
cuaaacggcaccagaaauu

SEQ ID NO: 175476 - RNA, 19 nt, Homo sapiens
gauauucuaagccaaaguu

SEQ ID NO: 175477 - RNA, 19 nt, Homo sapiens
gguggguucuuauugauuc

SEQ ID NO: 175478 - RNA, 19 nt, Homo sapiens
gacaauuucuucacuugag

SEQ ID NO: 175479 - RNA, 19 nt, Homo sapiens
gacuggauuucacuuagaa

SEQ ID NO: 175480 - RNA, 19 nt, Homo sapiens
aagccaaaguugacaaaga

SEQ ID NO: 175481 - RNA, 19 nt, Homo sapiens
gacaccaucauuauuguuu

SEQ ID NO: 175482 - RNA, 19 nt, Homo sapiens
gaugggaauaugcugauuu

SEQ ID NO: 175483 - RNA, 19 nt, Homo sapiens
cagcuccacuguugccaaa

SEQ ID NO: 175484 - RNA, 19 nt, Homo sapiens
ccugaacuguauaaggaua

SEQ ID NO: 175485 - RNA, 19 nt, Homo sapiens
gcaggaugcgguaccguuu

SEQ ID NO: 175486 - RNA, 19 nt, Homo sapiens
guugacaccaucauuauug

SEQ ID NO: 175487 - RNA, 19 nt, Homo sapiens
uuucauuucugaucaguug

SEQ ID NO: 175488 - RNA, 19 nt, Homo sapiens
uauaauacguacucgucaa

SEQ ID NO: 175489 - RNA, 19 nt, Homo sapiens
gacuuucaguuaauucuca

SEQ ID NO: 175490 - RNA, 19 nt, Homo sapiens
guauaaggauauucuaagc

SEQ ID NO: 175491 - RNA, 19 nt, Homo sapiens
acaaaguaccugaacugua

SEQ ID NO: 175492 - RNA, 19 nt, Homo sapiens
gcugccauacuucgacuua

SEQ ID NO: 175493 - RNA, 19 nt, Homo sapiens
gcuaggaguguguguaugu

SEQ ID NO: 175494 - RNA, 19 nt, Homo sapiens
cgacaaaguaccugaacug

SEQ ID NO: 175495 - RNA, 19 nt, Homo sapiens
uagggccacuugcuugauu

SEQ ID NO: 175496 - RNA, 19 nt, Homo sapiens
ggaugggaauaugcugauu

SEQ ID NO: 175497 - RNA, 19 nt, Homo sapiens
guacucgucaaaccuauau

SEQ ID NO: 175498 - RNA, 19 nt, Homo sapiens
ucugauggcucccuuaggu

SEQ ID NO: 175499 - RNA, 19 nt, Homo sapiens
aaacuuugucgcaugcaua

SEQ ID NO: 175500 - RNA, 19 nt, Homo sapiens
caaaguugacaaagacaau

SEQ ID NO: 175501 - RNA, 19 nt, Homo sapiens
gccacuugcuugauuuauc

SEQ ID NO: 175502 - RNA, 19 nt, Homo sapiens
ggugcagucuuacuuaaaa

SEQ ID NO: 175503 - RNA, 19 nt, Homo sapiens
gcgcuaggaguguguguau

SEQ ID NO: 175504 - RNA, 19 nt, Homo sapiens
aaaguaaccacuauaaagg

SEQ ID NO: 175505 - RNA, 19 nt, Homo sapiens
uuagaaaucuuccccaaug

SEQ ID NO: 175506 - RNA, 19 nt, Homo sapiens
gcgguggguucuuauugau

SEQ ID NO: 175507 - RNA, 19 nt, Homo sapiens
aaacggcaccagaaauuca

SEQ ID NO: 175508 - RNA, 19 nt, Homo sapiens
ucaucgcagugaacuuaaa

SEQ ID NO: 175509 - RNA, 19 nt, Homo sapiens
cgcgguggguucuuauuga

SEQ ID NO: 175510 - RNA, 19 nt, Homo sapiens
gaagggacuaggacuaaac

SEQ ID NO: 175511 - RNA, 19 nt, Homo sapiens
agaagggacuaggacuaaa

SEQ ID NO: 175512 - RNA, 19 nt, Homo sapiens
ccacagccgauuuggcauu

SEQ ID NO: 175513 - RNA, 19 nt, Homo sapiens
gaaaucuuccccaauggua

SEQ ID NO: 175514 - RNA, 19 nt, Homo sapiens
uggguugacaccaucauua

SEQ ID NO: 175515 - RNA, 19 nt, Homo sapiens
ucaguuguacuucauccua

SEQ ID NO: 175516 - RNA, 19 nt, Homo sapiens
ugagagaagaggagagaga

SEQ ID NO: 175517 - RNA, 19 nt, Homo sapiens
caggacuggauuucacuua

SEQ ID NO: 175518 - RNA, 19 nt, Homo sapiens
ucacaucagcuccacuguu

SEQ ID NO: 175519 - RNA, 19 nt, Homo sapiens
ggguugacaccaucauuau

SEQ ID NO: 175520 - RNA, 19 nt, Homo sapiens
gacuaaacggcaccagaaa

SEQ ID NO: 175521 - RNA, 19 nt, Homo sapiens
caguuguacuucauccuau

SEQ ID NO: 175522 - RNA, 19 nt, Homo sapiens
gggccacuugcuugauuua

SEQ ID NO: 175523 - RNA, 19 nt, Homo sapiens
aagaguguguauucagaga

SEQ ID NO: 175524 - RNA, 19 nt, Homo sapiens
aaagaccacagccgauuug

SEQ ID NO: 175525 - RNA, 19 nt, Homo sapiens
ucugaucaguuguacuuca

SEQ ID NO: 175526 - RNA, 19 nt, Homo sapiens
gaguguguauucagagaac

SEQ ID NO: 175527 - RNA, 19 nt, Homo sapiens
ggacucuaccucgggauga

SEQ ID NO: 175528 - RNA, 19 nt, Homo sapiens
gguugacaccaucauuauu

SEQ ID NO: 175529 - RNA, 19 nt, Homo sapiens
agagaagggacuaggacua

SEQ ID NO: 175530 - RNA, 19 nt, Homo sapiens
agggugcagucuuacuuaa

SEQ ID NO: 175531 - RNA, 19 nt, Homo sapiens
aguuguacuucauccuaua

SEQ ID NO: 175532 - RNA, 19 nt, Homo sapiens
gauuuaucaugagagaaga

SEQ ID NO: 175533 - RNA, 19 nt, Homo sapiens
gcuccacuguugccaaacu

SEQ ID NO: 175534 - RNA, 19 nt, Homo sapiens
gacucuaccucgggaugaa

SEQ ID NO: 175535 - RNA, 19 nt, Homo sapiens
gacaaaguaccugaacugu

SEQ ID NO: 175536 - RNA, 19 nt, Homo sapiens
acucgucaaaccuauauaa

SEQ ID NO: 175537 - RNA, 19 nt, Homo sapiens
gcgguaccguuugggaaug

SEQ ID NO: 175538 - RNA, 19 nt, Homo sapiens
gggugcagucuuacuuaaa

SEQ ID NO: 175539 - RNA, 19 nt, Homo sapiens
ugccauacuucgacuuauc

SEQ ID NO: 175540 - RNA, 19 nt, Homo sapiens
aaggauauucuaagccaaa

SEQ ID NO: 175541 - RNA, 19 nt, Homo sapiens
gucacggacuuggaucauu

SEQ ID NO: 175542 - RNA, 19 nt, Homo sapiens
cgagggugcagucuuacuu

SEQ ID NO: 175543 - RNA, 19 nt, Homo sapiens
caugagagaagaggagaga

SEQ ID NO: 175544 - RNA, 19 nt, Homo sapiens
gggaauaugcugauuuugu

SEQ ID NO: 175545 - RNA, 19 nt, Homo sapiens
ccaaaguugacaaagacaa

SEQ ID NO: 175546 - RNA, 19 nt, Homo sapiens
guaccugaacuguauaagg

SEQ ID NO: 175547 - RNA, 19 nt, Homo sapiens
gccauacuucgacuuauca

SEQ ID NO: 175548 - RNA, 19 nt, Homo sapiens
uguacuucauccuauauca

SEQ ID NO: 175549 - RNA, 19 nt, Homo sapiens
uaaacggcaccagaaauuc

SEQ ID NO: 175550 - RNA, 19 nt, Homo sapiens
gagcuguauggaucagaaa

SEQ ID NO: 175551 - RNA, 19 nt, Homo sapiens
ggagauaacaucaguagaa

SEQ ID NO: 175552 - RNA, 19 nt, Homo sapiens
aaacaccucugcucacuuu

SEQ ID NO: 175553 - RNA, 19 nt, Homo sapiens
ggaaauggauacugacaca

SEQ ID NO: 175554 - RNA, 19 nt, Homo sapiens
gagauaacaucaguagaaa

SEQ ID NO: 175555 - RNA, 19 nt, Homo sapiens
ucauuuaacuggcagcaua

SEQ ID NO: 175556 - RNA, 19 nt, Homo sapiens
caauaccuaugcaucauuu

SEQ ID NO: 175557 - RNA, 19 nt, Homo sapiens
caaguacuuucucaagauu

SEQ ID NO: 175558 - RNA, 19 nt, Homo sapiens
ccauuaacagcaacuauua

SEQ ID NO: 175559 - RNA, 19 nt, Homo sapiens
gauaacaucaguagaaauc

SEQ ID NO: 175560 - RNA, 19 nt, Homo sapiens
ccaaguacuuucucaagau

SEQ ID NO: 175561 - RNA, 19 nt, Homo sapiens
ggagauguccgcuggagaa

SEQ ID NO: 175562 - RNA, 19 nt, Homo sapiens
ucaaagccauuaacagcaa

SEQ ID NO: 175563 - RNA, 19 nt, Homo sapiens
gagcuacaaucaccuucaa

SEQ ID NO: 175564 - RNA, 19 nt, Homo sapiens
gaaggcaugugcggagcua

SEQ ID NO: 175565 - RNA, 19 nt, Homo sapiens
caauggugguacacucaua

SEQ ID NO: 175566 - RNA, 19 nt, Homo sapiens
gaaacucuauggcucaaaa

SEQ ID NO: 175567 - RNA, 19 nt, Homo sapiens
guagaaaucggaguuguug

SEQ ID NO: 175568 - RNA, 19 nt, Homo sapiens
guacagcauccuggagaua

SEQ ID NO: 175569 - RNA, 19 nt, Homo sapiens
ggaccaagaaggagaacug

SEQ ID NO: 175570 - RNA, 19 nt, Homo sapiens
cauaaugggaggcaaaugu

SEQ ID NO: 175571 - RNA, 19 nt, Homo sapiens
gccauuaacagcaacuauu

SEQ ID NO: 175572 - RNA, 19 nt, Homo sapiens
gauguccgcuggagaaagc

SEQ ID NO: 175573 - RNA, 19 nt, Homo sapiens
gaaaauggauacaauaccu

SEQ ID NO: 175574 - RNA, 19 nt, Homo sapiens
aaggagaacugcccguaca

SEQ ID NO: 175575 - RNA, 19 nt, Homo sapiens
gaaggagaggauagaggaa

SEQ ID NO: 175576 - RNA, 19 nt, Homo sapiens
gggaaacucuauggcucaa

SEQ ID NO: 175577 - RNA, 19 nt, Homo sapiens
ggacagaaaacacgaagga

SEQ ID NO: 175578 - RNA, 19 nt, Homo sapiens
gaggaaaauggauacaaua

SEQ ID NO: 175579 - RNA, 19 nt, Homo sapiens
auaaugggaggcaaaugua

SEQ ID NO: 175580 - RNA, 19 nt, Homo sapiens
cggaguuguugccgucaaa

SEQ ID NO: 175581 - RNA, 19 nt, Homo sapiens
ggaaaaggagcuccaagga

SEQ ID NO: 175582 - RNA, 19 nt, Homo sapiens
cagcauaaugggaggcaaa

SEQ ID NO: 175583 - RNA, 19 nt, Homo sapiens
ggauagaggaaaauggaua

SEQ ID NO: 175584 - RNA, 19 nt, Homo sapiens
accaaguacuuucucaaga

SEQ ID NO: 175585 - RNA, 19 nt, Homo sapiens
cagaaaacacgaaggaaaa

SEQ ID NO: 175586 - RNA, 19 nt, Homo sapiens
auacaauaccuaugcauca

SEQ ID NO: 175587 - RNA, 19 nt, Homo sapiens
acuuagccaugaacaagaa

SEQ ID NO: 175588 - RNA, 19 nt, Homo sapiens
uauucucuuucaccaagua

SEQ ID NO: 175589 - RNA, 19 nt, Homo sapiens
ggagcuacaaucaccuuca

SEQ ID NO: 175590 - RNA, 19 nt, Homo sapiens
caccucugcucacuuucuu

SEQ ID NO: 175591 - RNA, 19 nt, Homo sapiens
ccaaggagaggacagaaaa

SEQ ID NO: 175592 - RNA, 19 nt, Homo sapiens
uacaauaccuaugcaucau

SEQ ID NO: 175593 - RNA, 19 nt, Homo sapiens
acuauuacuuagccaugaa

SEQ ID NO: 175594 - RNA, 19 nt, Homo sapiens
caguagaaaucggaguugu

SEQ ID NO: 175595 - RNA, 19 nt, Homo sapiens
uacagcauccuggagauaa

SEQ ID NO: 175596 - RNA, 19 nt, Homo sapiens
gagauguccgcuggagaaa

SEQ ID NO: 175597 - RNA, 19 nt, Homo sapiens
aacagcaacuauuacuuag

SEQ ID NO: 175598 - RNA, 19 nt, Homo sapiens
cauuuaacuggcagcauaa

SEQ ID NO: 175599 - RNA, 19 nt, Homo sapiens
ucugcucacuuucuuccaa

SEQ ID NO: 175600 - RNA, 19 nt, Homo sapiens
uaaugggaggcaaauguau

SEQ ID NO: 175601 - RNA, 19 nt, Homo sapiens
acauugugccucagccuuu

SEQ ID NO: 175602 - RNA, 19 nt, Homo sapiens
acaauaccuaugcaucauu

SEQ ID NO: 175603 - RNA, 19 nt, Homo sapiens
uuacuuagccaugaacaag

SEQ ID NO: 175604 - RNA, 19 nt, Homo sapiens
caccagaggccaccaacuc

SEQ ID NO: 175605 - RNA, 19 nt, Homo sapiens
uuaacuggcagcauaaugg

SEQ ID NO: 175606 - RNA, 19 nt, Homo sapiens
agaggaaaauggauacaau

SEQ ID NO: 175607 - RNA, 19 nt, Homo sapiens
gaggauagaggaaaaugga

SEQ ID NO: 175608 - RNA, 19 nt, Homo sapiens
ggaaaccgaguuaagaaga

SEQ ID NO: 175609 - RNA, 19 nt, Homo sapiens
gcgccaagcugggucacua

SEQ ID NO: 175610 - RNA, 19 nt, Homo sapiens
gagugugucuuugagaauu

SEQ ID NO: 175611 - RNA, 19 nt, Homo sapiens
caagcugggucacuacaug

SEQ ID NO: 175612 - RNA, 19 nt, Homo sapiens
gaagggaaaccgaguuaag

SEQ ID NO: 175613 - RNA, 19 nt, Homo sapiens
ucaaaggcaucgucaccaa

SEQ ID NO: 175614 - RNA, 19 nt, Homo sapiens
ccaagucccuuugccagaa

SEQ ID NO: 175615 - RNA, 19 nt, Homo sapiens
gaaaccgaguuaagaagac

SEQ ID NO: 175616 - RNA, 19 nt, Homo sapiens
guacgccucugcucucuac

SEQ ID NO: 175617 - RNA, 19 nt, Homo sapiens
acagcugagugucgcuuua

SEQ ID NO: 175618 - RNA, 19 nt, Homo sapiens
caaaggcaucgucaccaaa

SEQ ID NO: 175619 - RNA, 19 nt, Homo sapiens
gaauuacuacguccuguac

SEQ ID NO: 175620 - RNA, 19 nt, Homo sapiens
agugugucuuugagaauua

SEQ ID NO: 175621 - RNA, 19 nt, Homo sapiens
uaaggagugugucuuugag

SEQ ID NO: 175622 - RNA, 19 nt, Homo sapiens
uuaaggagugugucuuuga

SEQ ID NO: 175623 - RNA, 19 nt, Homo sapiens
gcauuucacagcugagugu

SEQ ID NO: 175624 - RNA, 19 nt, Homo sapiens
ggagugugucuuugagaau

SEQ ID NO: 175625 - RNA, 19 nt, Homo sapiens
gccaggucaugaagggaaa

SEQ ID NO: 175626 - RNA, 19 nt, Homo sapiens
aggagugugucuuugagaa

SEQ ID NO: 175627 - RNA, 19 nt, Homo sapiens
cagcugagugucgcuuuaa

SEQ ID NO: 175628 - RNA, 19 nt, Homo sapiens
caucgucaccaaacuguuc

SEQ ID NO: 175629 - RNA, 19 nt, Homo sapiens
agaagcagcuccucauccu

SEQ ID NO: 175630 - RNA, 19 nt, Homo sapiens
uccuggagguggccaugua

SEQ ID NO: 175631 - RNA, 19 nt, Homo sapiens
agaauuacuacguccugua

SEQ ID NO: 175632 - RNA, 19 nt, Homo sapiens
caagucccuuugccagaag

SEQ ID NO: 175633 - RNA, 19 nt, Homo sapiens
gggaaaccgaguuaagaag

SEQ ID NO: 175634 - RNA, 19 nt, Homo sapiens
aagggaaaccgaguuaaga

SEQ ID NO: 175635 - RNA, 19 nt, Homo sapiens
caaggagggccaggucaug

SEQ ID NO: 175636 - RNA, 19 nt, Homo sapiens
gcugagggacugcucuaca

SEQ ID NO: 175637 - RNA, 19 nt, Homo sapiens
agccuucucuccacagugu

SEQ ID NO: 175638 - RNA, 19 nt, Homo sapiens
augaagggaaaccgaguua

SEQ ID NO: 175639 - RNA, 19 nt, Homo sapiens
uuuaaggagugugucuuug

SEQ ID NO: 175640 - RNA, 19 nt, Homo sapiens
guagagacauccaaauuua

SEQ ID NO: 175641 - RNA, 19 nt, Homo sapiens
gaaaggauuuggagaauug

SEQ ID NO: 175642 - RNA, 19 nt, Homo sapiens
ggaaauaaguccuaggaaa

SEQ ID NO: 175643 - RNA, 19 nt, Homo sapiens
gcacauacauaguuaagaa

SEQ ID NO: 175644 - RNA, 19 nt, Homo sapiens
gaaggcacauacauaguua

SEQ ID NO: 175645 - RNA, 19 nt, Homo sapiens
gcauguaacuucuccuaua

SEQ ID NO: 175646 - RNA, 19 nt, Homo sapiens
gaacagggguuuuacauaa

SEQ ID NO: 175647 - RNA, 19 nt, Homo sapiens
cgaauagccuuaaugaauu

SEQ ID NO: 175648 - RNA, 19 nt, Homo sapiens
gaauugaacucacaaacug

SEQ ID NO: 175649 - RNA, 19 nt, Homo sapiens
caacauagcugagaacucu

SEQ ID NO: 175650 - RNA, 19 nt, Homo sapiens
caagguguguagagaaaua

SEQ ID NO: 175651 - RNA, 19 nt, Homo sapiens
gcaauucauuuguuuccua

SEQ ID NO: 175652 - RNA, 19 nt, Homo sapiens
gaaauaaguccuaggaaau

SEQ ID NO: 175653 - RNA, 19 nt, Homo sapiens
ggaaauuagucaacgcaaa

SEQ ID NO: 175654 - RNA, 19 nt, Homo sapiens
gcaaaguugugaaucaaga

SEQ ID NO: 175655 - RNA, 19 nt, Homo sapiens
gccaguagcuaauuuguug

SEQ ID NO: 175656 - RNA, 19 nt, Homo sapiens
cagauuggcuucccagauu

SEQ ID NO: 175657 - RNA, 19 nt, Homo sapiens
gaagauacauuugcaagag

SEQ ID NO: 175658 - RNA, 19 nt, Homo sapiens
guaugcagauuuauggaua

SEQ ID NO: 175659 - RNA, 19 nt, Homo sapiens
caaagccaguagcuaauuu

SEQ ID NO: 175660 - RNA, 19 nt, Homo sapiens
caaggaaucuguguuugaa

SEQ ID NO: 175661 - RNA, 19 nt, Homo sapiens
ggaaaggauuuggagaauu

SEQ ID NO: 175662 - RNA, 19 nt, Homo sapiens
guagaaggcuaauuguaau

SEQ ID NO: 175663 - RNA, 19 nt, Homo sapiens
gcacaaagauuagcacacu

SEQ ID NO: 175664 - RNA, 19 nt, Homo sapiens
cgacuacacucucuucaau

SEQ ID NO: 175665 - RNA, 19 nt, Homo sapiens
gaaauuagucaacgcaaau

SEQ ID NO: 175666 - RNA, 19 nt, Homo sapiens
gccauugguugccguauuu

SEQ ID NO: 175667 - RNA, 19 nt, Homo sapiens
ggaccgaaauggagagcaa

SEQ ID NO: 175668 - RNA, 19 nt, Homo sapiens
cagcauguauuguuccaaa

SEQ ID NO: 175669 - RNA, 19 nt, Homo sapiens
uuacaaagccaguagcuaa

SEQ ID NO: 175670 - RNA, 19 nt, Homo sapiens
gaggcaaaguugugaauca

SEQ ID NO: 175671 - RNA, 19 nt, Homo sapiens
agacaugacugugaaauuc

SEQ ID NO: 175672 - RNA, 19 nt, Homo sapiens
gaacuucccagcacucgaa

SEQ ID NO: 175673 - RNA, 19 nt, Homo sapiens
gggaugaucugucacuaca

SEQ ID NO: 175674 - RNA, 19 nt, Homo sapiens
gaauuucccuaagcaguug

SEQ ID NO: 175675 - RNA, 19 nt, Homo sapiens
gaaggcuaauuguaaugaa

SEQ ID NO: 175676 - RNA, 19 nt, Homo sapiens
cauguaacuucuccuauau

SEQ ID NO: 175677 - RNA, 19 nt, Homo sapiens
acaaagauuagcacacuua

SEQ ID NO: 175678 - RNA, 19 nt, Homo sapiens
cuaagauucugcacucaaa

SEQ ID NO: 175679 - RNA, 19 nt, Homo sapiens
uuuaaacucugccaugaaa

SEQ ID NO: 175680 - RNA, 19 nt, Homo sapiens
ucgaauagccuuaaugaau

SEQ ID NO: 175681 - RNA, 19 nt, Homo sapiens
ccucaaaccuugccauugg

SEQ ID NO: 175682 - RNA, 19 nt, Homo sapiens
aaagugggaugaucuguca

SEQ ID NO: 175683 - RNA, 19 nt, Homo sapiens
gauauuauuuccggaguuc

SEQ ID NO: 175684 - RNA, 19 nt, Homo sapiens
ccggaguucuucuuucuuu

SEQ ID NO: 175685 - RNA, 19 nt, Homo sapiens
cucacaaacugauguuaua

SEQ ID NO: 175686 - RNA, 19 nt, Homo sapiens
uacacucucuucaaucuaa

SEQ ID NO: 175687 - RNA, 19 nt, Homo sapiens
ccaaauaugacucccuaaa

SEQ ID NO: 175688 - RNA, 19 nt, Homo sapiens
cagaaggguaccaguaaua

SEQ ID NO: 175689 - RNA, 19 nt, Homo sapiens
cgcaagaccuaguggcuaa

SEQ ID NO: 175690 - RNA, 19 nt, Homo sapiens
caauauaguuucccucacu

SEQ ID NO: 175691 - RNA, 19 nt, Homo sapiens
caggaaccauuuaucauca

SEQ ID NO: 175692 - RNA, 19 nt, Homo sapiens
ccagguauccuauuucugu

SEQ ID NO: 175693 - RNA, 19 nt, Homo sapiens
gagaguauccacaaagcaa

SEQ ID NO: 175694 - RNA, 19 nt, Homo sapiens
guggacaccuuugagagua

SEQ ID NO: 175695 - RNA, 19 nt, Homo sapiens
aaacaagggcguucaagga

SEQ ID NO: 175696 - RNA, 19 nt, Homo sapiens
uaaacucugccaugaaauu

SEQ ID NO: 175697 - RNA, 19 nt, Homo sapiens
caucgaauagccuuaauga

SEQ ID NO: 175698 - RNA, 19 nt, Homo sapiens
gacuugcucuucuaggaaa

SEQ ID NO: 175699 - RNA, 19 nt, Homo sapiens
gguauccuauuucuguuau

SEQ ID NO: 175700 - RNA, 19 nt, Homo sapiens
ccauauccuucaccaggua

SEQ ID NO: 175701 - RNA, 19 nt, Homo sapiens
gcuaauuuguugcucuaug

SEQ ID NO: 175702 - RNA, 19 nt, Homo sapiens
aguagaaggcuaauuguaa

SEQ ID NO: 175703 - RNA, 19 nt, Homo sapiens
gaaccaucgcuacaugaaa

SEQ ID NO: 175704 - RNA, 19 nt, Homo sapiens
ggugaaggcuaucucuaca

SEQ ID NO: 175705 - RNA, 19 nt, Homo sapiens
gagacaugacugugaaauu

SEQ ID NO: 175706 - RNA, 19 nt, Homo sapiens
guaccuuaccacagucuua

SEQ ID NO: 175707 - RNA, 19 nt, Homo sapiens
ucuaggcccucaccucaaa

SEQ ID NO: 175708 - RNA, 19 nt, Homo sapiens
uaacuucuccuauaucucu

SEQ ID NO: 175709 - RNA, 19 nt, Homo sapiens
aagagaaggcacauacaua

SEQ ID NO: 175710 - RNA, 19 nt, Homo sapiens
uagcuaauuuguugcucua

SEQ ID NO: 175711 - RNA, 19 nt, Homo sapiens
ggaauugacacaccauuac

SEQ ID NO: 175712 - RNA, 19 nt, Homo sapiens
gaacucacaaacugauguu

SEQ ID NO: 175713 - RNA, 19 nt, Homo sapiens
aaauucacgugcacaaaga

SEQ ID NO: 175714 - RNA, 19 nt, Homo sapiens
cgaaauggagagcaaagaa

SEQ ID NO: 175715 - RNA, 19 nt, Homo sapiens
uaaauacaccugucacuac

SEQ ID NO: 175716 - RNA, 19 nt, Homo sapiens
cgaaagggaccgaaaugga

SEQ ID NO: 175717 - RNA, 19 nt, Homo sapiens
uauaguuucccucacuuua

SEQ ID NO: 175718 - RNA, 19 nt, Homo sapiens
gcauuggaauaaauagauc

SEQ ID NO: 175719 - RNA, 19 nt, Homo sapiens
gaacucaguguaagagaag

SEQ ID NO: 175720 - RNA, 19 nt, Homo sapiens
acacagaaggguaccagua

SEQ ID NO: 175721 - RNA, 19 nt, Homo sapiens
cuaauuuguugcucuaugu

SEQ ID NO: 175722 - RNA, 19 nt, Homo sapiens
gguggugagguauaaguua

SEQ ID NO: 175723 - RNA, 19 nt, Homo sapiens
ggacuugcucuucuaggaa

SEQ ID NO: 175724 - RNA, 19 nt, Homo sapiens
gaauggaggcaaaguugug

SEQ ID NO: 175725 - RNA, 19 nt, Homo sapiens
acaagggcguucaaggaaa

SEQ ID NO: 175726 - RNA, 19 nt, Homo sapiens
aaaccaagcccucaucaca

SEQ ID NO: 175727 - RNA, 19 nt, Homo sapiens
aaauggacuugcucuucua

SEQ ID NO: 175728 - RNA, 19 nt, Homo sapiens
ggagugguguagagacauc

SEQ ID NO: 175729 - RNA, 19 nt, Homo sapiens
cugugaaauuccuaacuua

SEQ ID NO: 175730 - RNA, 19 nt, Homo sapiens
aaccaucgcuacaugaaau

SEQ ID NO: 175731 - RNA, 19 nt, Homo sapiens
agagaaccaucgcuacaug

SEQ ID NO: 175732 - RNA, 19 nt, Homo sapiens
caugaauggugaaggcuau

SEQ ID NO: 175733 - RNA, 19 nt, Homo sapiens
ggaaguacgggcgaaauca

SEQ ID NO: 175734 - RNA, 19 nt, Homo sapiens
uguagagacauccaaauuu

SEQ ID NO: 175735 - RNA, 19 nt, Homo sapiens
cacagaaggguaccaguaa

SEQ ID NO: 175736 - RNA, 19 nt, Homo sapiens
cuauugaaguguguaugua

SEQ ID NO: 175737 - RNA, 19 nt, Homo sapiens
ugaaggcuaucucuacagu

SEQ ID NO: 175738 - RNA, 19 nt, Homo sapiens
caaguccaguuugcaauuc

SEQ ID NO: 175739 - RNA, 19 nt, Homo sapiens
caaagauuagcacacuuaa

SEQ ID NO: 175740 - RNA, 19 nt, Homo sapiens
guagagacauccaaauuua

SEQ ID NO: 175741 - RNA, 19 nt, Homo sapiens
gaaaggauuuggagaauug

SEQ ID NO: 175742 - RNA, 19 nt, Homo sapiens
ggaaauaaguccuaggaaa

SEQ ID NO: 175743 - RNA, 19 nt, Homo sapiens
gcacauacauaguuaagaa

SEQ ID NO: 175744 - RNA, 19 nt, Homo sapiens
gaaggcacauacauaguua

SEQ ID NO: 175745 - RNA, 19 nt, Homo sapiens
gcauguaacuucuccuaua

SEQ ID NO: 175746 - RNA, 19 nt, Homo sapiens
gaacagggguuuuacauaa

SEQ ID NO: 175747 - RNA, 19 nt, Homo sapiens
cgaauagccuuaaugaauu

SEQ ID NO: 175748 - RNA, 19 nt, Homo sapiens
gaauugaacucacaaacug

SEQ ID NO: 175749 - RNA, 19 nt, Homo sapiens
caacauagcugagaacucu

SEQ ID NO: 175750 - RNA, 19 nt, Homo sapiens
caagguguguagagaaaua

SEQ ID NO: 175751 - RNA, 19 nt, Homo sapiens
gcaauucauuuguuuccua

SEQ ID NO: 175752 - RNA, 19 nt, Homo sapiens
gaaauaaguccuaggaaau

SEQ ID NO: 175753 - RNA, 19 nt, Homo sapiens
ggaaauuagucaacgcaaa

SEQ ID NO: 175754 - RNA, 19 nt, Homo sapiens
gcaaaguugugaaucaaga

SEQ ID NO: 175755 - RNA, 19 nt, Homo sapiens
gccaguagcuaauuuguug

SEQ ID NO: 175756 - RNA, 19 nt, Homo sapiens
gaagauacauuugcaagag

SEQ ID NO: 175757 - RNA, 19 nt, Homo sapiens
guaugcagauuuauggaua

SEQ ID NO: 175758 - RNA, 19 nt, Homo sapiens
caaagccaguagcuaauuu

SEQ ID NO: 175759 - RNA, 19 nt, Homo sapiens
caaggaaucuguguuugaa

SEQ ID NO: 175760 - RNA, 19 nt, Homo sapiens
ggaaaggauuuggagaauu

SEQ ID NO: 175761 - RNA, 19 nt, Homo sapiens
guagaaggcuaauuguaau

SEQ ID NO: 175762 - RNA, 19 nt, Homo sapiens
gcacaaagauuagcacacu

SEQ ID NO: 175763 - RNA, 19 nt, Homo sapiens
cgacuacacucucuucaau

SEQ ID NO: 175764 - RNA, 19 nt, Homo sapiens
gaaauuagucaacgcaaau

SEQ ID NO: 175765 - RNA, 19 nt, Homo sapiens
gccauugguugccguauuu

SEQ ID NO: 175766 - RNA, 19 nt, Homo sapiens
cagcauguauuguuccaaa

SEQ ID NO: 175767 - RNA, 19 nt, Homo sapiens
uuacaaagccaguagcuaa

SEQ ID NO: 175768 - RNA, 19 nt, Homo sapiens
gaggcaaaguugugaauca

SEQ ID NO: 175769 - RNA, 19 nt, Homo sapiens
agacaugacugugaaauuc

SEQ ID NO: 175770 - RNA, 19 nt, Homo sapiens
gaauuucccuaagcaguug

SEQ ID NO: 175771 - RNA, 19 nt, Homo sapiens
gaaggcuaauuguaaugaa

SEQ ID NO: 175772 - RNA, 19 nt, Homo sapiens
cauguaacuucuccuauau

SEQ ID NO: 175773 - RNA, 19 nt, Homo sapiens
acaaagauuagcacacuua

SEQ ID NO: 175774 - RNA, 19 nt, Homo sapiens
cuaagauucugcacucaaa

SEQ ID NO: 175775 - RNA, 19 nt, Homo sapiens
uuuaaacucugccaugaaa

SEQ ID NO: 175776 - RNA, 19 nt, Homo sapiens
ucgaauagccuuaaugaau

SEQ ID NO: 175777 - RNA, 19 nt, Homo sapiens
ccucaaaccuugccauugg

SEQ ID NO: 175778 - RNA, 19 nt, Homo sapiens
gauauuauuuccggaguuc

SEQ ID NO: 175779 - RNA, 19 nt, Homo sapiens
ccggaguucuucuuucuuu

SEQ ID NO: 175780 - RNA, 19 nt, Homo sapiens
cucacaaacugauguuaua

SEQ ID NO: 175781 - RNA, 19 nt, Homo sapiens
uacacucucuucaaucuaa

SEQ ID NO: 175782 - RNA, 19 nt, Homo sapiens
ccaaauaugacucccuaaa

SEQ ID NO: 175783 - RNA, 19 nt, Homo sapiens
cagaaggguaccaguaaua

SEQ ID NO: 175784 - RNA, 19 nt, Homo sapiens
cgcaagaccuaguggcuaa

SEQ ID NO: 175785 - RNA, 19 nt, Homo sapiens
caauauaguuucccucacu

SEQ ID NO: 175786 - RNA, 19 nt, Homo sapiens
caggaaccauuuaucauca

SEQ ID NO: 175787 - RNA, 19 nt, Homo sapiens
ccagguauccuauuucugu

SEQ ID NO: 175788 - RNA, 19 nt, Homo sapiens
gagaguauccacaaagcaa

SEQ ID NO: 175789 - RNA, 19 nt, Homo sapiens
guggacaccuuugagagua

SEQ ID NO: 175790 - RNA, 19 nt, Homo sapiens
aaacaagggcguucaagga

SEQ ID NO: 175791 - RNA, 19 nt, Homo sapiens
uaaacucugccaugaaauu

SEQ ID NO: 175792 - RNA, 19 nt, Homo sapiens
caucgaauagccuuaauga

SEQ ID NO: 175793 - RNA, 19 nt, Homo sapiens
gacuugcucuucuaggaaa

SEQ ID NO: 175794 - RNA, 19 nt, Homo sapiens
gguauccuauuucuguuau

SEQ ID NO: 175795 - RNA, 19 nt, Homo sapiens
ccauauccuucaccaggua

SEQ ID NO: 175796 - RNA, 19 nt, Homo sapiens
gcuaauuuguugcucuaug

SEQ ID NO: 175797 - RNA, 19 nt, Homo sapiens
aguagaaggcuaauuguaa

SEQ ID NO: 175798 - RNA, 19 nt, Homo sapiens
gaaccaucgcuacaugaaa

SEQ ID NO: 175799 - RNA, 19 nt, Homo sapiens
ggugaaggcuaucucuaca

SEQ ID NO: 175800 - RNA, 19 nt, Homo sapiens
gagacaugacugugaaauu

SEQ ID NO: 175801 - RNA, 19 nt, Homo sapiens
guaccuuaccacagucuua

SEQ ID NO: 175802 - RNA, 19 nt, Homo sapiens
ucuaggcccucaccucaaa

SEQ ID NO: 175803 - RNA, 19 nt, Homo sapiens
uaacuucuccuauaucucu

SEQ ID NO: 175804 - RNA, 19 nt, Homo sapiens
aagagaaggcacauacaua

SEQ ID NO: 175805 - RNA, 19 nt, Homo sapiens
uagcuaauuuguugcucua

SEQ ID NO: 175806 - RNA, 19 nt, Homo sapiens
ggaauugacacaccauuac

SEQ ID NO: 175807 - RNA, 19 nt, Homo sapiens
gaacucacaaacugauguu

SEQ ID NO: 175808 - RNA, 19 nt, Homo sapiens
aaauucacgugcacaaaga

SEQ ID NO: 175809 - RNA, 19 nt, Homo sapiens
uaaauacaccugucacuac

SEQ ID NO: 175810 - RNA, 19 nt, Homo sapiens
uauaguuucccucacuuua

SEQ ID NO: 175811 - RNA, 19 nt, Homo sapiens
gcauuggaauaaauagauc

SEQ ID NO: 175812 - RNA, 19 nt, Homo sapiens
gaacucaguguaagagaag

SEQ ID NO: 175813 - RNA, 19 nt, Homo sapiens
acacagaaggguaccagua

SEQ ID NO: 175814 - RNA, 19 nt, Homo sapiens
cuaauuuguugcucuaugu

SEQ ID NO: 175815 - RNA, 19 nt, Homo sapiens
gguggugagguauaaguua

SEQ ID NO: 175816 - RNA, 19 nt, Homo sapiens
ggacuugcucuucuaggaa

SEQ ID NO: 175817 - RNA, 19 nt, Homo sapiens
gaauggaggcaaaguugug

SEQ ID NO: 175818 - RNA, 19 nt, Homo sapiens
acaagggcguucaaggaaa

SEQ ID NO: 175819 - RNA, 19 nt, Homo sapiens
aaaccaagcccucaucaca

SEQ ID NO: 175820 - RNA, 19 nt, Homo sapiens
aaauggacuugcucuucua

SEQ ID NO: 175821 - RNA, 19 nt, Homo sapiens
ggagugguguagagacauc

SEQ ID NO: 175822 - RNA, 19 nt, Homo sapiens
cugugaaauuccuaacuua

SEQ ID NO: 175823 - RNA, 19 nt, Homo sapiens
aaccaucgcuacaugaaau

SEQ ID NO: 175824 - RNA, 19 nt, Homo sapiens
agagaaccaucgcuacaug

SEQ ID NO: 175825 - RNA, 19 nt, Homo sapiens
caugaauggugaaggcuau

SEQ ID NO: 175826 - RNA, 19 nt, Homo sapiens
uguagagacauccaaauuu

SEQ ID NO: 175827 - RNA, 19 nt, Homo sapiens
cacagaaggguaccaguaa

SEQ ID NO: 175828 - RNA, 19 nt, Homo sapiens
cuauugaaguguguaugua

SEQ ID NO: 175829 - RNA, 19 nt, Homo sapiens
ugaaggcuaucucuacagu

SEQ ID NO: 175830 - RNA, 19 nt, Homo sapiens
caaguccaguuugcaauuc

SEQ ID NO: 175831 - RNA, 19 nt, Homo sapiens
caaagauuagcacacuuaa

SEQ ID NO: 175832 - RNA, 19 nt, Homo sapiens
gaaaccuauugaagugugu

SEQ ID NO: 175833 - RNA, 19 nt, Homo sapiens
cuagcuguauuucuucuug

SEQ ID NO: 175834 - RNA, 19 nt, Homo sapiens
guguagagacauccaaauu

SEQ ID NO: 175835 - RNA, 19 nt, Homo sapiens
agaacucaguguaagagaa

SEQ ID NO: 175836 - RNA, 19 nt, Homo sapiens
aaucuuguauggcaucgaa

SEQ ID NO: 175837 - RNA, 19 nt, Homo sapiens
cucaauagcuuaaacucau

SEQ ID NO: 175838 - RNA, 19 nt, Homo sapiens
gcaaugugguagaaaauuc

SEQ ID NO: 175839 - RNA, 19 nt, Homo sapiens
gauucaacauagcugagaa

SEQ ID NO: 175840 - RNA, 19 nt, Homo sapiens
gagaaggacugccaaauuu

SEQ ID NO: 175841 - RNA, 19 nt, Homo sapiens
gaacugugauguugucuuu

SEQ ID NO: 175842 - RNA, 19 nt, Homo sapiens
gcacuuacacucuguuuaa

SEQ ID NO: 175843 - RNA, 19 nt, Homo sapiens
gcauagaguugcaugauau

SEQ ID NO: 175844 - RNA, 19 nt, Homo sapiens
agauugagcuugugcauaa

SEQ ID NO: 175845 - RNA, 19 nt, Homo sapiens
gaacaaagaaggagagauc

SEQ ID NO: 175846 - RNA, 19 nt, Homo sapiens
gaccagagccucagcuuaa

SEQ ID NO: 175847 - RNA, 19 nt, Homo sapiens
uuagcuagguuuccauuua

SEQ ID NO: 175848 - RNA, 19 nt, Homo sapiens
gaacaagccugcagcucau

SEQ ID NO: 175849 - RNA, 19 nt, Homo sapiens
gcaaccaugugaagaagaa

SEQ ID NO: 175850 - RNA, 19 nt, Homo sapiens
ccaaauacgcaccgaauaa

SEQ ID NO: 175851 - RNA, 19 nt, Homo sapiens
guagaaaugugaguuguau

SEQ ID NO: 175852 - RNA, 19 nt, Homo sapiens
gcaacuuuaugauuucuga

SEQ ID NO: 175853 - RNA, 19 nt, Homo sapiens
gaacagugagggauacuug

SEQ ID NO: 175854 - RNA, 19 nt, Homo sapiens
ggcauagaguugcaugaua

SEQ ID NO: 175855 - RNA, 19 nt, Homo sapiens
gcgaggccauuaccuguuu

SEQ ID NO: 175856 - RNA, 19 nt, Homo sapiens
ccauuuguguaucauguua

SEQ ID NO: 175857 - RNA, 19 nt, Homo sapiens
gaaucaacguagccaguga

SEQ ID NO: 175858 - RNA, 19 nt, Homo sapiens
gcaaauccaugagccacaa

SEQ ID NO: 175859 - RNA, 19 nt, Homo sapiens
cagcuuaaggguauaguua

SEQ ID NO: 175860 - RNA, 19 nt, Homo sapiens
agaguugcaugauauguaa

SEQ ID NO: 175861 - RNA, 19 nt, Homo sapiens
ccauuuagaucuucauauc

SEQ ID NO: 175862 - RNA, 19 nt, Homo sapiens
uaucuacgcuugauucaca

SEQ ID NO: 175863 - RNA, 19 nt, Homo sapiens
gaacuaaaucugagagaag

SEQ ID NO: 175864 - RNA, 19 nt, Homo sapiens
guuguuguauacccaaaua

SEQ ID NO: 175865 - RNA, 19 nt, Homo sapiens
caaauacgcaccgaauaaa

SEQ ID NO: 175866 - RNA, 19 nt, Homo sapiens
ugauucacauguacucuuu

SEQ ID NO: 175867 - RNA, 19 nt, Homo sapiens
gaucucaccuaugacuuug

SEQ ID NO: 175868 - RNA, 19 nt, Homo sapiens
gcagaguucacuauucuau

SEQ ID NO: 175869 - RNA, 19 nt, Homo sapiens
caaacaaacaggcagaguu

SEQ ID NO: 175870 - RNA, 19 nt, Homo sapiens
gaaaggcaaccaugugaag

SEQ ID NO: 175871 - RNA, 19 nt, Homo sapiens
caaguguagauuucucuua

SEQ ID NO: 175872 - RNA, 19 nt, Homo sapiens
gaccacaauuguucuucaa

SEQ ID NO: 175873 - RNA, 19 nt, Homo sapiens
agagaaggacugccaaauu

SEQ ID NO: 175874 - RNA, 19 nt, Homo sapiens
cauuagaccuucuuaucau

SEQ ID NO: 175875 - RNA, 19 nt, Homo sapiens
gaagaggcgcagaagaaga

SEQ ID NO: 175876 - RNA, 19 nt, Homo sapiens
aagaagaggcgcagaagaa

SEQ ID NO: 175877 - RNA, 19 nt, Homo sapiens
gauguugucuuuuguguug

SEQ ID NO: 175878 - RNA, 19 nt, Homo sapiens
uagcaguccuucacccaaa

SEQ ID NO: 175879 - RNA, 19 nt, Homo sapiens
ucauaucuguugcauggaa

SEQ ID NO: 175880 - RNA, 19 nt, Homo sapiens
gaaaguggccauguacaag

SEQ ID NO: 175881 - RNA, 19 nt, Homo sapiens
gagucuuccugucauugua

SEQ ID NO: 175882 - RNA, 19 nt, Homo sapiens
agaaaugugaguuguauug

SEQ ID NO: 175883 - RNA, 19 nt, Homo sapiens
gcacuaaugcugaucaaaa

SEQ ID NO: 175884 - RNA, 19 nt, Homo sapiens
ugaacuaaaucugagagaa

SEQ ID NO: 175885 - RNA, 19 nt, Homo sapiens
aaacaaacaggcagaguuc

SEQ ID NO: 175886 - RNA, 19 nt, Homo sapiens
aaggagagaucaugaaagg

SEQ ID NO: 175887 - RNA, 19 nt, Homo sapiens
acuauucuaucugccauua

SEQ ID NO: 175888 - RNA, 19 nt, Homo sapiens
caaagaaggagagaucaug

SEQ ID NO: 175889 - RNA, 19 nt, Homo sapiens
cauuguauuuggcacauga

SEQ ID NO: 175890 - RNA, 19 nt, Homo sapiens
aaugugaguuguauuguca

SEQ ID NO: 175891 - RNA, 19 nt, Homo sapiens
guauucuggucaaguuauu

SEQ ID NO: 175892 - RNA, 19 nt, Homo sapiens
ggugguaucugggucugaa

SEQ ID NO: 175893 - RNA, 19 nt, Homo sapiens
caaugaacagugagggaua

SEQ ID NO: 175894 - RNA, 19 nt, Homo sapiens
guuguggcuucuuguguaa

SEQ ID NO: 175895 - RNA, 19 nt, Homo sapiens
guagauuucucuuaauucc

SEQ ID NO: 175896 - RNA, 19 nt, Homo sapiens
gugguauucuggucaaguu

SEQ ID NO: 175897 - RNA, 19 nt, Homo sapiens
aaagaagggcucuguaaca

SEQ ID NO: 175898 - RNA, 19 nt, Homo sapiens
caaaagaagggcucuguaa

SEQ ID NO: 175899 - RNA, 19 nt, Homo sapiens
uagcuagguuuccauuuag

SEQ ID NO: 175900 - RNA, 19 nt, Homo sapiens
ccauuagaccuucuuauca

SEQ ID NO: 175901 - RNA, 19 nt, Homo sapiens
uguuguggcuucuugugua

SEQ ID NO: 175902 - RNA, 19 nt, Homo sapiens
gaaaugugaguuguauugu

SEQ ID NO: 175903 - RNA, 19 nt, Homo sapiens
ucagugacauuuaccaaac

SEQ ID NO: 175904 - RNA, 19 nt, Homo sapiens
ugugacauauucaucaaug

SEQ ID NO: 175905 - RNA, 19 nt, Homo sapiens
aaucugaauuggcuucuca

SEQ ID NO: 175906 - RNA, 19 nt, Homo sapiens
cuucuuaucauccauacua

SEQ ID NO: 175907 - RNA, 19 nt, Homo sapiens
agaguucacuauucuaucu

SEQ ID NO: 175908 - RNA, 19 nt, Homo sapiens
caagaccagcugcgacaaa

SEQ ID NO: 175909 - RNA, 19 nt, Homo sapiens
uagaguugcaugauaugua

SEQ ID NO: 175910 - RNA, 19 nt, Homo sapiens
gaacuguggaacugugaug

SEQ ID NO: 175911 - RNA, 19 nt, Homo sapiens
aaauuauccucaaguguag

SEQ ID NO: 175912 - RNA, 19 nt, Homo sapiens
gucaaguuauugugcugua

SEQ ID NO: 175913 - RNA, 19 nt, Homo sapiens
ggcaaacgcaggcuaagga

SEQ ID NO: 175914 - RNA, 19 nt, Homo sapiens
uugcgucacuuaauccaaa

SEQ ID NO: 175915 - RNA, 19 nt, Homo sapiens
ccacaauuguucuucaaaa

SEQ ID NO: 175916 - RNA, 19 nt, Homo sapiens
gccauuagaccuucuuauc

SEQ ID NO: 175917 - RNA, 19 nt, Homo sapiens
ccgauuaucacgccaagaa

SEQ ID NO: 175918 - RNA, 19 nt, Homo sapiens
ugaaaguggccauguacaa

SEQ ID NO: 175919 - RNA, 19 nt, Homo sapiens
agaaggagagaucaugaaa

SEQ ID NO: 175920 - RNA, 19 nt, Homo sapiens
gaagaugcgaggccauuac

SEQ ID NO: 175921 - RNA, 19 nt, Homo sapiens
gaauuguuaagacugguuu

SEQ ID NO: 175922 - RNA, 19 nt, Homo sapiens
acaguguucuugugguuug

SEQ ID NO: 175923 - RNA, 19 nt, Homo sapiens
uaaaagaccacaauuguuc

SEQ ID NO: 175924 - RNA, 19 nt, Homo sapiens
guauuucacagcacuaaug

SEQ ID NO: 175925 - RNA, 19 nt, Homo sapiens
aaagaaggagagaucauga

SEQ ID NO: 175926 - RNA, 19 nt, Homo sapiens
guaucugggucugaacaaa

SEQ ID NO: 175927 - RNA, 19 nt, Homo sapiens
aagaugaggacagcacuua

SEQ ID NO: 175928 - RNA, 19 nt, Homo sapiens
gaaguugcaaggacuaguc

SEQ ID NO: 175929 - RNA, 19 nt, Homo sapiens
ggccaacuuuucccgauua

SEQ ID NO: 175930 - RNA, 19 nt, Homo sapiens
gcccagagcagcagcaaca

SEQ ID NO: 175931 - RNA, 19 nt, Homo sapiens
gaaggagagaucaugaaag

SEQ ID NO: 175932 - RNA, 19 nt, Homo sapiens
gaauuguguuguuuucuug

SEQ ID NO: 175933 - RNA, 19 nt, Homo sapiens
gagcuugugcauaagaaug

SEQ ID NO: 175934 - RNA, 19 nt, Homo sapiens
gacaagcagcggaggagaa

SEQ ID NO: 175935 - RNA, 19 nt, Homo sapiens
uccaggugcuguugaauuc

SEQ ID NO: 175936 - RNA, 19 nt, Homo sapiens
aagcuguacuuggcaauga

SEQ ID NO: 175937 - RNA, 19 nt, Homo sapiens
gaugaggacagcacuuaca

SEQ ID NO: 175938 - RNA, 19 nt, Homo sapiens
caagaaguugcaaggacua

SEQ ID NO: 175939 - RNA, 19 nt, Homo sapiens
caagaagaggcgcagaaga

SEQ ID NO: 175940 - RNA, 19 nt, Homo sapiens
gagaaggacugccaaauuu

SEQ ID NO: 175941 - RNA, 19 nt, Homo sapiens
gaacugugauguugucuuu

SEQ ID NO: 175942 - RNA, 19 nt, Homo sapiens
gcacuuacacucuguuuaa

SEQ ID NO: 175943 - RNA, 19 nt, Homo sapiens
gcauagaguugcaugauau

SEQ ID NO: 175944 - RNA, 19 nt, Homo sapiens
agauugagcuugugcauaa

SEQ ID NO: 175945 - RNA, 19 nt, Homo sapiens
gaacaaagaaggagagauc

SEQ ID NO: 175946 - RNA, 19 nt, Homo sapiens
uuagcuagguuuccauuua

SEQ ID NO: 175947 - RNA, 19 nt, Homo sapiens
gaacaagccugcagcucau

SEQ ID NO: 175948 - RNA, 19 nt, Homo sapiens
gcaaccaugugaagaagaa

SEQ ID NO: 175949 - RNA, 19 nt, Homo sapiens
ccaaauacgcaccgaauaa

SEQ ID NO: 175950 - RNA, 19 nt, Homo sapiens
gcaacuuuaugauuucuga

SEQ ID NO: 175951 - RNA, 19 nt, Homo sapiens
gaacagugagggauacuug

SEQ ID NO: 175952 - RNA, 19 nt, Homo sapiens
ggcauagaguugcaugaua

SEQ ID NO: 175953 - RNA, 19 nt, Homo sapiens
ccauuuguguaucauguua

SEQ ID NO: 175954 - RNA, 19 nt, Homo sapiens
gaaucaacguagccaguga

SEQ ID NO: 175955 - RNA, 19 nt, Homo sapiens
gcaaauccaugagccacaa

SEQ ID NO: 175956 - RNA, 19 nt, Homo sapiens
cagcuuaaggguauaguua

SEQ ID NO: 175957 - RNA, 19 nt, Homo sapiens
agaguugcaugauauguaa

SEQ ID NO: 175958 - RNA, 19 nt, Homo sapiens
ccauuuagaucuucauauc

SEQ ID NO: 175959 - RNA, 19 nt, Homo sapiens
uaucuacgcuugauucaca

SEQ ID NO: 175960 - RNA, 19 nt, Homo sapiens
gaacuaaaucugagagaag

SEQ ID NO: 175961 - RNA, 19 nt, Homo sapiens
guuguuguauacccaaaua

SEQ ID NO: 175962 - RNA, 19 nt, Homo sapiens
gaucucaccuauacuuugg

SEQ ID NO: 175963 - RNA, 19 nt, Homo sapiens
gguaggaccagcuuauaaa

SEQ ID NO: 175964 - RNA, 19 nt, Homo sapiens
caaauacgcaccgaauaaa

SEQ ID NO: 175965 - RNA, 19 nt, Homo sapiens
ugauucacauguacucuuu

SEQ ID NO: 175966 - RNA, 19 nt, Homo sapiens
gcagaguucacuauucuau

SEQ ID NO: 175967 - RNA, 19 nt, Homo sapiens
caaacaaacaggcagaguu

SEQ ID NO: 175968 - RNA, 19 nt, Homo sapiens
gaaaggcaaccaugugaag

SEQ ID NO: 175969 - RNA, 19 nt, Homo sapiens
caaguguagauuucucuua

SEQ ID NO: 175970 - RNA, 19 nt, Homo sapiens
gaccacaauuguucuucaa

SEQ ID NO: 175971 - RNA, 19 nt, Homo sapiens
gcauggcuuuguuaaggaa

SEQ ID NO: 175972 - RNA, 19 nt, Homo sapiens
agagaaggacugccaaauu

SEQ ID NO: 175973 - RNA, 19 nt, Homo sapiens
cauuagaccuucuuaucau

SEQ ID NO: 175974 - RNA, 19 nt, Homo sapiens
aggaccagcuuauaaagaa

SEQ ID NO: 175975 - RNA, 19 nt, Homo sapiens
gauguugucuuuuguguug

SEQ ID NO: 175976 - RNA, 19 nt, Homo sapiens
uagcaguccuucacccaaa

SEQ ID NO: 175977 - RNA, 19 nt, Homo sapiens
uaaggaagucguauucaga

SEQ ID NO: 175978 - RNA, 19 nt, Homo sapiens
ucauaucuguugcauggaa

SEQ ID NO: 175979 - RNA, 19 nt, Homo sapiens
gaaaguggccauguacaag

SEQ ID NO: 175980 - RNA, 19 nt, Homo sapiens
gagucuuccugucauugua

SEQ ID NO: 175981 - RNA, 19 nt, Homo sapiens
gcacuaaugcugaucaaaa

SEQ ID NO: 175982 - RNA, 19 nt, Homo sapiens
ggguaggaccagcuuauaa

SEQ ID NO: 175983 - RNA, 19 nt, Homo sapiens
ugaacuaaaucugagagaa

SEQ ID NO: 175984 - RNA, 19 nt, Homo sapiens
aaacaaacaggcagaguuc

SEQ ID NO: 175985 - RNA, 19 nt, Homo sapiens
aaggagagaucaugaaagg

SEQ ID NO: 175986 - RNA, 19 nt, Homo sapiens
acuauucuaucugccauua

SEQ ID NO: 175987 - RNA, 19 nt, Homo sapiens
caaagaaggagagaucaug

SEQ ID NO: 175988 - RNA, 19 nt, Homo sapiens
cauuguauuuggcacauga

SEQ ID NO: 175989 - RNA, 19 nt, Homo sapiens
guauucuggucaaguuauu

SEQ ID NO: 175990 - RNA, 19 nt, Homo sapiens
auucagagccucagcuuaa

SEQ ID NO: 175991 - RNA, 19 nt, Homo sapiens
ggugguaucugggucugaa

SEQ ID NO: 175992 - RNA, 19 nt, Homo sapiens
caaugaacagugagggaua

SEQ ID NO: 175993 - RNA, 19 nt, Homo sapiens
guuguggcuucuuguguaa

SEQ ID NO: 175994 - RNA, 19 nt, Homo sapiens
guagauuucucuuaauucc

SEQ ID NO: 175995 - RNA, 19 nt, Homo sapiens
gugguauucuggucaaguu

SEQ ID NO: 175996 - RNA, 19 nt, Homo sapiens
aaagaagggcucuguaaca

SEQ ID NO: 175997 - RNA, 19 nt, Homo sapiens
caaaagaagggcucuguaa

SEQ ID NO: 175998 - RNA, 19 nt, Homo sapiens
uagcuagguuuccauuuag

SEQ ID NO: 175999 - RNA, 19 nt, Homo sapiens
ccauuagaccuucuuauca

SEQ ID NO: 176000 - RNA, 19 nt, Homo sapiens
ucucugaucuccucucucu

SEQ ID NO: 176001 - RNA, 19 nt, Homo sapiens
uguuguggcuucuugugua

SEQ ID NO: 176002 - RNA, 19 nt, Homo sapiens
ucagugacauuuaccaaac

SEQ ID NO: 176003 - RNA, 19 nt, Homo sapiens
ugugacauauucaucaaug

SEQ ID NO: 176004 - RNA, 19 nt, Homo sapiens
ccaaauguagacagcaauu

SEQ ID NO: 176005 - RNA, 19 nt, Homo sapiens
aaucugaauuggcuucuca

SEQ ID NO: 176006 - RNA, 19 nt, Homo sapiens
cuucuuaucauccauacua

SEQ ID NO: 176007 - RNA, 19 nt, Homo sapiens
agaguucacuauucuaucu

SEQ ID NO: 176008 - RNA, 19 nt, Homo sapiens
uagaguugcaugauaugua

SEQ ID NO: 176009 - RNA, 19 nt, Homo sapiens
gaacuguggaacugugaug

SEQ ID NO: 176010 - RNA, 19 nt, Homo sapiens
aaauuauccucaaguguag

SEQ ID NO: 176011 - RNA, 19 nt, Homo sapiens
gucaaguuauugugcugua

SEQ ID NO: 176012 - RNA, 19 nt, Homo sapiens
uugcgucacuuaauccaaa

SEQ ID NO: 176013 - RNA, 19 nt, Homo sapiens
ccacaauuguucuucaaaa

SEQ ID NO: 176014 - RNA, 19 nt, Homo sapiens
gccauuagaccuucuuauc

SEQ ID NO: 176015 - RNA, 19 nt, Homo sapiens
ugaaaguggccauguacaa

SEQ ID NO: 176016 - RNA, 19 nt, Homo sapiens
agaaggagagaucaugaaa

SEQ ID NO: 176017 - RNA, 19 nt, Homo sapiens
gaauuguuaagacugguuu

SEQ ID NO: 176018 - RNA, 19 nt, Homo sapiens
acaguguucuugugguuug

SEQ ID NO: 176019 - RNA, 19 nt, Homo sapiens
uaaaagaccacaauuguuc

SEQ ID NO: 176020 - RNA, 19 nt, Homo sapiens
guauuucacagcacuaaug

SEQ ID NO: 176021 - RNA, 19 nt, Homo sapiens
cucaugaucucaccuauac

SEQ ID NO: 176022 - RNA, 19 nt, Homo sapiens
aagaugaggacagcacuua

SEQ ID NO: 176023 - RNA, 19 nt, Homo sapiens
aaagaaggagagaucauga

SEQ ID NO: 176024 - RNA, 19 nt, Homo sapiens
guaucugggucugaacaaa

SEQ ID NO: 176025 - RNA, 19 nt, Homo sapiens
gaaggagagaucaugaaag

SEQ ID NO: 176026 - RNA, 19 nt, Homo sapiens
gaugaggacagcacuuaca

SEQ ID NO: 176027 - RNA, 19 nt, Homo sapiens
gaauuguguuguuuucuug

SEQ ID NO: 176028 - RNA, 19 nt, Homo sapiens
gagcuugugcauaagaaug

SEQ ID NO: 176029 - RNA, 19 nt, Homo sapiens
ggaccagcuuauaaagaag

SEQ ID NO: 176030 - RNA, 19 nt, Homo sapiens
uccaggugcuguugaauuc

SEQ ID NO: 176031 - RNA, 19 nt, Homo sapiens
aagcuguacuuggcaauga

SEQ ID NO: 176032 - RNA, 19 nt, Homo sapiens
ucucuuaauuccauuugug

SEQ ID NO: 176033 - RNA, 19 nt, Homo sapiens
caguaaagagaacuucaaa

SEQ ID NO: 176034 - RNA, 19 nt, Homo sapiens
caugaucucaccuauacuu

SEQ ID NO: 176035 - RNA, 19 nt, Homo sapiens
gagagaaggacugccaaau

SEQ ID NO: 176036 - RNA, 19 nt, Homo sapiens
caggcagaguucacuauuc

SEQ ID NO: 176037 - RNA, 19 nt, Homo sapiens
acaccugagugcaaauuca

SEQ ID NO: 176038 - RNA, 19 nt, Homo sapiens
ugugucugcuccaaaugua

SEQ ID NO: 176039 - RNA, 19 nt, Homo sapiens
uuauugugcuguacuuugu

SEQ ID NO: 176040 - RNA, 19 nt, Homo sapiens
gagcacaguugagugauuu

SEQ ID NO: 176041 - RNA, 19 nt, Homo sapiens
gaugacagcacuaauucua

SEQ ID NO: 176042 - RNA, 19 nt, Homo sapiens
gcaaaccagucaacaagag

SEQ ID NO: 176043 - RNA, 19 nt, Homo sapiens
cgauggagcucucgaugga

SEQ ID NO: 176044 - RNA, 19 nt, Homo sapiens
acaagugcgucugcaauaa

SEQ ID NO: 176045 - RNA, 19 nt, Homo sapiens
guaaucuacucauccaugu

SEQ ID NO: 176046 - RNA, 19 nt, Homo sapiens
aauaaugaauggaggcaaa

SEQ ID NO: 176047 - RNA, 19 nt, Homo sapiens
cauuggaaguugccaugua

SEQ ID NO: 176048 - RNA, 19 nt, Homo sapiens
gaagagcagcaggaaguaa

SEQ ID NO: 176049 - RNA, 19 nt, Homo sapiens
ggaagggcaagcuaugaaa

SEQ ID NO: 176050 - RNA, 19 nt, Homo sapiens
gaaaacaggguuguauaua

SEQ ID NO: 176051 - RNA, 19 nt, Homo sapiens
ucuccgaacuucucuguug

SEQ ID NO: 176052 - RNA, 19 nt, Homo sapiens
gaaagggaacagaguaaag

SEQ ID NO: 176053 - RNA, 19 nt, Homo sapiens
ugacagcacuaauucuaca

SEQ ID NO: 176054 - RNA, 19 nt, Homo sapiens
caacaggaaucugguagag

SEQ ID NO: 176055 - RNA, 19 nt, Homo sapiens
caacaagaguaagacaaca

SEQ ID NO: 176056 - RNA, 19 nt, Homo sapiens
gcacuaauucuacacucuu

SEQ ID NO: 176057 - RNA, 19 nt, Homo sapiens
gcagcaggaaguaagcuaa

SEQ ID NO: 176058 - RNA, 19 nt, Homo sapiens
cacaagugcgucugcaaua

SEQ ID NO: 176059 - RNA, 19 nt, Homo sapiens
gagaaccaucuuugcauga

SEQ ID NO: 176060 - RNA, 19 nt, Homo sapiens
acaagaguaagacaacaua

SEQ ID NO: 176061 - RNA, 19 nt, Homo sapiens
guaccgagaaccaucuuug

SEQ ID NO: 176062 - RNA, 19 nt, Homo sapiens
gguuguauauagccaugaa

SEQ ID NO: 176063 - RNA, 19 nt, Homo sapiens
aaacaggguuguauauagc

SEQ ID NO: 176064 - RNA, 19 nt, Homo sapiens
ugagcacaguugagugauu

SEQ ID NO: 176065 - RNA, 19 nt, Homo sapiens
gcaaccugguggauaucuu

SEQ ID NO: 176066 - RNA, 19 nt, Homo sapiens
ccagugggacuacguguug

SEQ ID NO: 176067 - RNA, 19 nt, Homo sapiens
ccaaaccagcagcucauuu

SEQ ID NO: 176068 - RNA, 19 nt, Homo sapiens
uaugaaagggaacagagua

SEQ ID NO: 176069 - RNA, 19 nt, Homo sapiens
ccaaggaugacagcacuaa

SEQ ID NO: 176070 - RNA, 19 nt, Homo sapiens
gauuuauccucaccagaca

SEQ ID NO: 176071 - RNA, 19 nt, Homo sapiens
ggauaucuucuccaaagug

SEQ ID NO: 176072 - RNA, 19 nt, Homo sapiens
cagguguugugacuuauuc

SEQ ID NO: 176073 - RNA, 19 nt, Homo sapiens
gaggcaaaccagucaacaa

SEQ ID NO: 176074 - RNA, 19 nt, Homo sapiens
caagugcgucugcaauaau

SEQ ID NO: 176075 - RNA, 19 nt, Homo sapiens
aaagggaacagaguaaaga

SEQ ID NO: 176076 - RNA, 19 nt, Homo sapiens
ggguauagugaccagguua

SEQ ID NO: 176077 - RNA, 19 nt, Homo sapiens
gaagggcaagcuaugaaag

SEQ ID NO: 176078 - RNA, 19 nt, Homo sapiens
uaaggaagggcaagcuaug

SEQ ID NO: 176079 - RNA, 19 nt, Homo sapiens
aaggaugacagcacuaauu

SEQ ID NO: 176080 - RNA, 19 nt, Homo sapiens
gcacaguugagugauuuau

SEQ ID NO: 176081 - RNA, 19 nt, Homo sapiens
guacagacaacaggaaucu

SEQ ID NO: 176082 - RNA, 19 nt, Homo sapiens
aaaacaggguuguauauag

SEQ ID NO: 176083 - RNA, 19 nt, Homo sapiens
gcaggcaaggcuacuacuu

SEQ ID NO: 176084 - RNA, 19 nt, Homo sapiens
gcuaaugcuuauucuuugc

SEQ ID NO: 176085 - RNA, 19 nt, Homo sapiens
ccagucaacaagaguaaga

SEQ ID NO: 176086 - RNA, 19 nt, Homo sapiens
aaaccagucaacaagagua

SEQ ID NO: 176087 - RNA, 19 nt, Homo sapiens
auagugaccagguuauauu

SEQ ID NO: 176088 - RNA, 19 nt, Homo sapiens
caaaccagcagcucauuuu

SEQ ID NO: 176089 - RNA, 19 nt, Homo sapiens
ugaaagggaacagaguaaa

SEQ ID NO: 176090 - RNA, 19 nt, Homo sapiens
gugaccagguuauauugca

SEQ ID NO: 176091 - RNA, 19 nt, Homo sapiens
aaucuacucauccauguug

SEQ ID NO: 176092 - RNA, 19 nt, Homo sapiens
uauguaaucuacucaucca

SEQ ID NO: 176093 - RNA, 19 nt, Homo sapiens
cgucugcaauaaugaaugg

SEQ ID NO: 176094 - RNA, 19 nt, Homo sapiens
acggcaaccugguggauau

SEQ ID NO: 176095 - RNA, 19 nt, Homo sapiens
agacaacaggaaucuggua

SEQ ID NO: 176096 - RNA, 19 nt, Homo sapiens
cagcucaaggguauaguga

SEQ ID NO: 176097 - RNA, 19 nt, Homo sapiens
gcaaguuuaaagaaucugu

SEQ ID NO: 176098 - RNA, 19 nt, Homo sapiens
caaccugguggauaucuuc

SEQ ID NO: 176099 - RNA, 19 nt, Homo sapiens
ccugagcacaguugaguga

SEQ ID NO: 176100 - RNA, 19 nt, Homo sapiens
gggaacagaguaaagaaaa

SEQ ID NO: 176101 - RNA, 19 nt, Homo sapiens
ccucauaccagugggacua

SEQ ID NO: 176102 - RNA, 19 nt, Homo sapiens
gcaggaaguaagcuaaugc

SEQ ID NO: 176103 - RNA, 19 nt, Homo sapiens
ugaagagcagcaggaagua

SEQ ID NO: 176104 - RNA, 19 nt, Homo sapiens
ggcaaaccagucaacaaga

SEQ ID NO: 176105 - RNA, 19 nt, Homo sapiens
aagugcgucugcaauaaug

SEQ ID NO: 176106 - RNA, 19 nt, Homo sapiens
agaaccaucuuugcaugau

SEQ ID NO: 176107 - RNA, 19 nt, Homo sapiens
cugaagagcagcaggaagu

SEQ ID NO: 176108 - RNA, 19 nt, Homo sapiens
gguauagugaccagguuau

SEQ ID NO: 176109 - RNA, 19 nt, Homo sapiens
cugaaugcaaguuuaaaga

SEQ ID NO: 176110 - RNA, 19 nt, Homo sapiens
agcuaaugcuuauucuuug

SEQ ID NO: 176111 - RNA, 19 nt, Homo sapiens
acaguugagugauuuaucc

SEQ ID NO: 176112 - RNA, 19 nt, Homo sapiens
uaagacaacauagccagau

SEQ ID NO: 176113 - RNA, 19 nt, Homo sapiens
cacuaauucuacacucuuc

SEQ ID NO: 176114 - RNA, 19 nt, Homo sapiens
aauaaggaagggcaagcua

SEQ ID NO: 176115 - RNA, 19 nt, Homo sapiens
ucaacaagaguaagacaac

SEQ ID NO: 176116 - RNA, 19 nt, Homo sapiens
ucgauggaaccaaggauga

SEQ ID NO: 176117 - RNA, 19 nt, Homo sapiens
ccucuacccaucagaacuu

SEQ ID NO: 176118 - RNA, 19 nt, Homo sapiens
uaagaaaugucuccuuuga

SEQ ID NO: 176119 - RNA, 19 nt, Homo sapiens
gaagacugcuggaguuaau

SEQ ID NO: 176120 - RNA, 19 nt, Homo sapiens
caaaguggcugugaagaug

SEQ ID NO: 176121 - RNA, 19 nt, Homo sapiens
ucaagcagcugguggaaga

SEQ ID NO: 176122 - RNA, 19 nt, Homo sapiens
ccacaucgacuacuauaaa

SEQ ID NO: 176123 - RNA, 19 nt, Homo sapiens
ccaacgagcuguacaugau

SEQ ID NO: 176124 - RNA, 19 nt, Homo sapiens
gugcuucacuuaagaaaug

SEQ ID NO: 176125 - RNA, 19 nt, Homo sapiens
gauggucccuuguauguca

SEQ ID NO: 176126 - RNA, 19 nt, Homo sapiens
ccucagggcuacagcagua

SEQ ID NO: 176127 - RNA, 19 nt, Homo sapiens
cuuaagaaaugucuccuuu

SEQ ID NO: 176128 - RNA, 19 nt, Homo sapiens
ggaggugcuucacuuaaga

SEQ ID NO: 176129 - RNA, 19 nt, Homo sapiens
gcaggauggucccuuguau

SEQ ID NO: 176130 - RNA, 19 nt, Homo sapiens
agaaacagauaacaccaaa

SEQ ID NO: 176131 - RNA, 19 nt, Homo sapiens
cagaaaagauggaaaagaa

SEQ ID NO: 176132 - RNA, 19 nt, Homo sapiens
ggcaucaguugcuauauau

SEQ ID NO: 176133 - RNA, 19 nt, Homo sapiens
gaaauggagaugaugaaga

SEQ ID NO: 176134 - RNA, 19 nt, Homo sapiens
aaauggagaugaugaagau

SEQ ID NO: 176135 - RNA, 19 nt, Homo sapiens
gcccguagcuccauauugg

SEQ ID NO: 176136 - RNA, 19 nt, Homo sapiens
gagccggucugcaaggaaa

SEQ ID NO: 176137 - RNA, 19 nt, Homo sapiens
gaggagaaagaaacagaua

SEQ ID NO: 176138 - RNA, 19 nt, Homo sapiens
ggaggcaucaguugcuaua

SEQ ID NO: 176139 - RNA, 19 nt, Homo sapiens
gaagagugguaccaagaag

SEQ ID NO: 176140 - RNA, 19 nt, Homo sapiens
aggcaucaguugcuauaua

SEQ ID NO: 176141 - RNA, 19 nt, Homo sapiens
uaaagcacaucgaggugaa

SEQ ID NO: 176142 - RNA, 19 nt, Homo sapiens
gagcgagggucaguuugaa

SEQ ID NO: 176143 - RNA, 19 nt, Homo sapiens
ggaggaugaugaugaugau

SEQ ID NO: 176144 - RNA, 19 nt, Homo sapiens
gauggaggugcuucacuua

SEQ ID NO: 176145 - RNA, 19 nt, Homo sapiens
gcagugacaccaccuacuu

SEQ ID NO: 176146 - RNA, 19 nt, Homo sapiens
ggucguuaccagagauuua

SEQ ID NO: 176147 - RNA, 19 nt, Homo sapiens
gauggcacccgaggcauua

SEQ ID NO: 176148 - RNA, 19 nt, Homo sapiens
caacuacaccugcauugug

SEQ ID NO: 176149 - RNA, 19 nt, Homo sapiens
gaugaugacuccucuucag

SEQ ID NO: 176150 - RNA, 19 nt, Homo sapiens
agagugauguguggucuuu

SEQ ID NO: 176151 - RNA, 19 nt, Homo sapiens
auucaaaccugaccacaga

SEQ ID NO: 176152 - RNA, 19 nt, Homo sapiens
ucacagagacccaccuuca

SEQ ID NO: 176153 - RNA, 19 nt, Homo sapiens
gcauggacaagcccaguaa

SEQ ID NO: 176154 - RNA, 19 nt, Homo sapiens
ccagauggcugugcacaag

SEQ ID NO: 176155 - RNA, 19 nt, Homo sapiens
gcccagacaaccugccuua

SEQ ID NO: 176156 - RNA, 19 nt, Homo sapiens
ggaugaugaugaugaugau

SEQ ID NO: 176157 - RNA, 19 nt, Homo sapiens
cagcccagcuugccaaugg

SEQ ID NO: 176158 - RNA, 19 nt, Homo sapiens
gaguauccauggagaugug

SEQ ID NO: 176159 - RNA, 19 nt, Homo sapiens
ccagacaaccugccuuaug

SEQ ID NO: 176160 - RNA, 19 nt, Homo sapiens
cagauaacaccaaaccaaa

SEQ ID NO: 176161 - RNA, 19 nt, Homo sapiens
ccaaugaacaggcaugcaa

SEQ ID NO: 176162 - RNA, 19 nt, Homo sapiens
gaugaagauagcagacuuu

SEQ ID NO: 176163 - RNA, 19 nt, Homo sapiens
gcauaagaauaucaucaac

SEQ ID NO: 176164 - RNA, 19 nt, Homo sapiens
ugaccaaaguggcugugaa

SEQ ID NO: 176165 - RNA, 19 nt, Homo sapiens
caacguggaguucaugugu

SEQ ID NO: 176166 - RNA, 19 nt, Homo sapiens
caacagagaaagacuuguc

SEQ ID NO: 176167 - RNA, 19 nt, Homo sapiens
gauacuaguuugcuuugcu

SEQ ID NO: 176168 - RNA, 19 nt, Homo sapiens
aagaugaucgggaagcaua

SEQ ID NO: 176169 - RNA, 19 nt, Homo sapiens
gaucuacacccaccagagu

SEQ ID NO: 176170 - RNA, 19 nt, Homo sapiens
uaucuggccuccaagaagu

SEQ ID NO: 176171 - RNA, 19 nt, Homo sapiens
ucgggaagcauaagaauau

SEQ ID NO: 176172 - RNA, 19 nt, Homo sapiens
gaggcuacaagguccguua

SEQ ID NO: 176173 - RNA, 19 nt, Homo sapiens
acacugcgcugguugaaaa

SEQ ID NO: 176174 - RNA, 19 nt, Homo sapiens
ggagaaagaaacagauaac

SEQ ID NO: 176175 - RNA, 19 nt, Homo sapiens
ugaacaggcaugcaaguga

SEQ ID NO: 176176 - RNA, 19 nt, Homo sapiens
ugaugaagauagcagacuu

SEQ ID NO: 176177 - RNA, 19 nt, Homo sapiens
ggacaaugugaugaagaua

SEQ ID NO: 176178 - RNA, 19 nt, Homo sapiens
aaaccugaccacagaauug

SEQ ID NO: 176179 - RNA, 19 nt, Homo sapiens
cuacuucuccgucaauguu

SEQ ID NO: 176180 - RNA, 19 nt, Homo sapiens
ccaaaguggcugugaagau

SEQ ID NO: 176181 - RNA, 19 nt, Homo sapiens
ggucggucaucgucuacaa

SEQ ID NO: 176182 - RNA, 19 nt, Homo sapiens
cuugaagacugcuggaguu

SEQ ID NO: 176183 - RNA, 19 nt, Homo sapiens
gugaaugggagcaagauug

SEQ ID NO: 176184 - RNA, 19 nt, Homo sapiens
uaauuccgauacuaguuug

SEQ ID NO: 176185 - RNA, 19 nt, Homo sapiens
gacaaacccaaccguguga

SEQ ID NO: 176186 - RNA, 19 nt, Homo sapiens
agauggaggugcuucacuu

SEQ ID NO: 176187 - RNA, 19 nt, Homo sapiens
ggauggcacccgaggcauu

SEQ ID NO: 176188 - RNA, 19 nt, Homo sapiens
ucagaaauggagaugauga

SEQ ID NO: 176189 - RNA, 19 nt, Homo sapiens
acagauaacaccaaaccaa

SEQ ID NO: 176190 - RNA, 19 nt, Homo sapiens
cgagcucacuguggaguau

SEQ ID NO: 176191 - RNA, 19 nt, Homo sapiens
gcuacaagguccguuaugc

SEQ ID NO: 176192 - RNA, 19 nt, Homo sapiens
gauuccgucuucucucaug

SEQ ID NO: 176193 - RNA, 19 nt, Homo sapiens
gacaaugugaugaagauag

SEQ ID NO: 176194 - RNA, 19 nt, Homo sapiens
ugacagaggacaaugugau

SEQ ID NO: 176195 - RNA, 19 nt, Homo sapiens
ggaagcauaagaauaucau

SEQ ID NO: 176196 - RNA, 19 nt, Homo sapiens
uagcaggggucucugagua

SEQ ID NO: 176197 - RNA, 19 nt, Homo sapiens
cgauggagccggucugcaa

SEQ ID NO: 176198 - RNA, 19 nt, Homo sapiens
acguggaguucauguguaa

SEQ ID NO: 176199 - RNA, 19 nt, Homo sapiens
guagcaacguggaguucau

SEQ ID NO: 176200 - RNA, 19 nt, Homo sapiens
acaccugcauuguggagaa

SEQ ID NO: 176201 - RNA, 19 nt, Homo sapiens
gcaacuacaccugcauugu

SEQ ID NO: 176202 - RNA, 19 nt, Homo sapiens
gagaaagaaacagauaaca

SEQ ID NO: 176203 - RNA, 19 nt, Homo sapiens
uguaugucaucguggagua

SEQ ID NO: 176204 - RNA, 19 nt, Homo sapiens
gaucgggaagcauaagaau

SEQ ID NO: 176205 - RNA, 19 nt, Homo sapiens
aaagggucguuaccagaga

SEQ ID NO: 176206 - RNA, 19 nt, Homo sapiens
cagagaaagacuugucaga

SEQ ID NO: 176207 - RNA, 19 nt, Homo sapiens
cuaucgggcuggacaagga

SEQ ID NO: 176208 - RNA, 19 nt, Homo sapiens
ugaagagugguaccaagaa

SEQ ID NO: 176209 - RNA, 19 nt, Homo sapiens
uuaauaccaccgacaaaga

SEQ ID NO: 176210 - RNA, 19 nt, Homo sapiens
cgagcgagggucaguuuga

SEQ ID NO: 176211 - RNA, 19 nt, Homo sapiens
caccacaucgacuacuaua

SEQ ID NO: 176212 - RNA, 19 nt, Homo sapiens
cagaggacaaugugaugaa

SEQ ID NO: 176213 - RNA, 19 nt, Homo sapiens
gacagaggacaaugugaug

SEQ ID NO: 176214 - RNA, 19 nt, Homo sapiens
gaguuaauaccaccgacaa

SEQ ID NO: 176215 - RNA, 19 nt, Homo sapiens
gcacauccaguggcuaaag

SEQ ID NO: 176216 - RNA, 19 nt, Homo sapiens
gcaucauaauggacucugu

SEQ ID NO: 176217 - RNA, 19 nt, Homo sapiens
caaaccugaccacagaauu

SEQ ID NO: 176218 - RNA, 19 nt, Homo sapiens
uaagaaaugucuccuuuga

SEQ ID NO: 176219 - RNA, 19 nt, Homo sapiens
gaagacugcuggaguuaau

SEQ ID NO: 176220 - RNA, 19 nt, Homo sapiens
caaaguggcugugaagaug

SEQ ID NO: 176221 - RNA, 19 nt, Homo sapiens
ucaagcagcugguggaaga

SEQ ID NO: 176222 - RNA, 19 nt, Homo sapiens
ccacaucgacuacuauaaa

SEQ ID NO: 176223 - RNA, 19 nt, Homo sapiens
ccaacgagcuguacaugau

SEQ ID NO: 176224 - RNA, 19 nt, Homo sapiens
gugcuucacuuaagaaaug

SEQ ID NO: 176225 - RNA, 19 nt, Homo sapiens
gauggucccuuguauguca

SEQ ID NO: 176226 - RNA, 19 nt, Homo sapiens
ccucagggcuacagcagua

SEQ ID NO: 176227 - RNA, 19 nt, Homo sapiens
cuuaagaaaugucuccuuu

SEQ ID NO: 176228 - RNA, 19 nt, Homo sapiens
ggaggugcuucacuuaaga

SEQ ID NO: 176229 - RNA, 19 nt, Homo sapiens
gcaggauggucccuuguau

SEQ ID NO: 176230 - RNA, 19 nt, Homo sapiens
agaaacagauaacaccaaa

SEQ ID NO: 176231 - RNA, 19 nt, Homo sapiens
cagaaaagauggaaaagaa

SEQ ID NO: 176232 - RNA, 19 nt, Homo sapiens
ggcaucaguugcuauauau

SEQ ID NO: 176233 - RNA, 19 nt, Homo sapiens
gaaauggagaugaugaaga

SEQ ID NO: 176234 - RNA, 19 nt, Homo sapiens
aaauggagaugaugaagau

SEQ ID NO: 176235 - RNA, 19 nt, Homo sapiens
gagccggucugcaaggaaa

SEQ ID NO: 176236 - RNA, 19 nt, Homo sapiens
gaggagaaagaaacagaua

SEQ ID NO: 176237 - RNA, 19 nt, Homo sapiens
ggaggcaucaguugcuaua

SEQ ID NO: 176238 - RNA, 19 nt, Homo sapiens
gaagagugguaccaagaag

SEQ ID NO: 176239 - RNA, 19 nt, Homo sapiens
aggcaucaguugcuauaua

SEQ ID NO: 176240 - RNA, 19 nt, Homo sapiens
uaaagcacaucgaggugaa

SEQ ID NO: 176241 - RNA, 19 nt, Homo sapiens
gagcgagggucaguuugaa

SEQ ID NO: 176242 - RNA, 19 nt, Homo sapiens
ggaggaugaugaugaugau

SEQ ID NO: 176243 - RNA, 19 nt, Homo sapiens
gauggaggugcuucacuua

SEQ ID NO: 176244 - RNA, 19 nt, Homo sapiens
gcagugacaccaccuacuu

SEQ ID NO: 176245 - RNA, 19 nt, Homo sapiens
ggucguuaccagagauuua

SEQ ID NO: 176246 - RNA, 19 nt, Homo sapiens
gauggcacccgaggcauua

SEQ ID NO: 176247 - RNA, 19 nt, Homo sapiens
caacuacaccugcauugug

SEQ ID NO: 176248 - RNA, 19 nt, Homo sapiens
gaugaugacuccucuucag

SEQ ID NO: 176249 - RNA, 19 nt, Homo sapiens
agagugauguguggucuuu

SEQ ID NO: 176250 - RNA, 19 nt, Homo sapiens
auucaaaccugaccacaga

SEQ ID NO: 176251 - RNA, 19 nt, Homo sapiens
ucacagagacccaccuuca

SEQ ID NO: 176252 - RNA, 19 nt, Homo sapiens
gcauggacaagcccaguaa

SEQ ID NO: 176253 - RNA, 19 nt, Homo sapiens
ccagauggcugugcacaag

SEQ ID NO: 176254 - RNA, 19 nt, Homo sapiens
gcccagacaaccugccuua

SEQ ID NO: 176255 - RNA, 19 nt, Homo sapiens
ggaugaugaugaugaugau

SEQ ID NO: 176256 - RNA, 19 nt, Homo sapiens
cagcccagcuugccaaugg

SEQ ID NO: 176257 - RNA, 19 nt, Homo sapiens
ccagacaaccugccuuaug

SEQ ID NO: 176258 - RNA, 19 nt, Homo sapiens
gaguauccauggagaugug

SEQ ID NO: 176259 - RNA, 19 nt, Homo sapiens
cagauaacaccaaaccaaa

SEQ ID NO: 176260 - RNA, 19 nt, Homo sapiens
ccaaugaacaggcaugcaa

SEQ ID NO: 176261 - RNA, 19 nt, Homo sapiens
gaugaagauagcagacuuu

SEQ ID NO: 176262 - RNA, 19 nt, Homo sapiens
gcauaagaauaucaucaac

SEQ ID NO: 176263 - RNA, 19 nt, Homo sapiens
ugaccaaaguggcugugaa

SEQ ID NO: 176264 - RNA, 19 nt, Homo sapiens
caacguggaguucaugugu

SEQ ID NO: 176265 - RNA, 19 nt, Homo sapiens
caacagagaaagacuuguc

SEQ ID NO: 176266 - RNA, 19 nt, Homo sapiens
gauacuaguuugcuuugcu

SEQ ID NO: 176267 - RNA, 19 nt, Homo sapiens
aagaugaucgggaagcaua

SEQ ID NO: 176268 - RNA, 19 nt, Homo sapiens
gaucuacacccaccagagu

SEQ ID NO: 176269 - RNA, 19 nt, Homo sapiens
uaucuggccuccaagaagu

SEQ ID NO: 176270 - RNA, 19 nt, Homo sapiens
ucgggaagcauaagaauau

SEQ ID NO: 176271 - RNA, 19 nt, Homo sapiens
gaggcuacaagguccguua

SEQ ID NO: 176272 - RNA, 19 nt, Homo sapiens
acacugcgcugguugaaaa

SEQ ID NO: 176273 - RNA, 19 nt, Homo sapiens
ggagaaagaaacagauaac

SEQ ID NO: 176274 - RNA, 19 nt, Homo sapiens
ugaacaggcaugcaaguga

SEQ ID NO: 176275 - RNA, 19 nt, Homo sapiens
ugaugaagauagcagacuu

SEQ ID NO: 176276 - RNA, 19 nt, Homo sapiens
ggacaaugugaugaagaua

SEQ ID NO: 176277 - RNA, 19 nt, Homo sapiens
aaaccugaccacagaauug

SEQ ID NO: 176278 - RNA, 19 nt, Homo sapiens
cuacuucuccgucaauguu

SEQ ID NO: 176279 - RNA, 19 nt, Homo sapiens
ccaaaguggcugugaagau

SEQ ID NO: 176280 - RNA, 19 nt, Homo sapiens
ggucggucaucgucuacaa

SEQ ID NO: 176281 - RNA, 19 nt, Homo sapiens
cuugaagacugcuggaguu

SEQ ID NO: 176282 - RNA, 19 nt, Homo sapiens
gugaaugggagcaagauug

SEQ ID NO: 176283 - RNA, 19 nt, Homo sapiens
uaauuccgauacuaguuug

SEQ ID NO: 176284 - RNA, 19 nt, Homo sapiens
gacaaacccaaccguguga

SEQ ID NO: 176285 - RNA, 19 nt, Homo sapiens
agauggaggugcuucacuu

SEQ ID NO: 176286 - RNA, 19 nt, Homo sapiens
ggauggcacccgaggcauu

SEQ ID NO: 176287 - RNA, 19 nt, Homo sapiens
ucagaaauggagaugauga

SEQ ID NO: 176288 - RNA, 19 nt, Homo sapiens
acagauaacaccaaaccaa

SEQ ID NO: 176289 - RNA, 19 nt, Homo sapiens
gcuacaagguccguuaugc

SEQ ID NO: 176290 - RNA, 19 nt, Homo sapiens
cgagcucacuguggaguau

SEQ ID NO: 176291 - RNA, 19 nt, Homo sapiens
gauuccgucuucucucaug

SEQ ID NO: 176292 - RNA, 19 nt, Homo sapiens
gacaaugugaugaagauag

SEQ ID NO: 176293 - RNA, 19 nt, Homo sapiens
ugacagaggacaaugugau

SEQ ID NO: 176294 - RNA, 19 nt, Homo sapiens
ggaagcauaagaauaucau

SEQ ID NO: 176295 - RNA, 19 nt, Homo sapiens
uagcaggggucucugagua

SEQ ID NO: 176296 - RNA, 19 nt, Homo sapiens
cgauggagccggucugcaa

SEQ ID NO: 176297 - RNA, 19 nt, Homo sapiens
acguggaguucauguguaa

SEQ ID NO: 176298 - RNA, 19 nt, Homo sapiens
guagcaacguggaguucau

SEQ ID NO: 176299 - RNA, 19 nt, Homo sapiens
acaccugcauuguggagaa

SEQ ID NO: 176300 - RNA, 19 nt, Homo sapiens
gcaacuacaccugcauugu

SEQ ID NO: 176301 - RNA, 19 nt, Homo sapiens
gagaaagaaacagauaaca

SEQ ID NO: 176302 - RNA, 19 nt, Homo sapiens
uguaugucaucguggagua

SEQ ID NO: 176303 - RNA, 19 nt, Homo sapiens
gaucgggaagcauaagaau

SEQ ID NO: 176304 - RNA, 19 nt, Homo sapiens
aaagggucguuaccagaga

SEQ ID NO: 176305 - RNA, 19 nt, Homo sapiens
cagagaaagacuugucaga

SEQ ID NO: 176306 - RNA, 19 nt, Homo sapiens
cuaucgggcuggacaagga

SEQ ID NO: 176307 - RNA, 19 nt, Homo sapiens
ugaagagugguaccaagaa

SEQ ID NO: 176308 - RNA, 19 nt, Homo sapiens
uuaauaccaccgacaaaga

SEQ ID NO: 176309 - RNA, 19 nt, Homo sapiens
caccacaucgacuacuaua

SEQ ID NO: 176310 - RNA, 19 nt, Homo sapiens
cagaggacaaugugaugaa

SEQ ID NO: 176311 - RNA, 19 nt, Homo sapiens
gacagaggacaaugugaug

SEQ ID NO: 176312 - RNA, 19 nt, Homo sapiens
ccaccuacuucuccgucaa

SEQ ID NO: 176313 - RNA, 19 nt, Homo sapiens
cgagcgagggucaguuuga

SEQ ID NO: 176314 - RNA, 19 nt, Homo sapiens
gaguuaauaccaccgacaa

SEQ ID NO: 176315 - RNA, 19 nt, Homo sapiens
gcacauccaguggcuaaag

SEQ ID NO: 176316 - RNA, 19 nt, Homo sapiens
gcaucauaauggacucugu

SEQ ID NO: 176317 - RNA, 19 nt, Homo sapiens
caaaccugaccacagaauu

SEQ ID NO: 176318 - RNA, 19 nt, Homo sapiens
uaagaaaugucuccuuuga

SEQ ID NO: 176319 - RNA, 19 nt, Homo sapiens
gaagacugcuggaguuaau

SEQ ID NO: 176320 - RNA, 19 nt, Homo sapiens
caaaguggcugugaagaug

SEQ ID NO: 176321 - RNA, 19 nt, Homo sapiens
ucaagcagcugguggaaga

SEQ ID NO: 176322 - RNA, 19 nt, Homo sapiens
ccacaucgacuacuauaaa

SEQ ID NO: 176323 - RNA, 19 nt, Homo sapiens
ccaacgagcuguacaugau

SEQ ID NO: 176324 - RNA, 19 nt, Homo sapiens
gugcuucacuuaagaaaug

SEQ ID NO: 176325 - RNA, 19 nt, Homo sapiens
gauggucccuuguauguca

SEQ ID NO: 176326 - RNA, 19 nt, Homo sapiens
ccucagggcuacagcagua

SEQ ID NO: 176327 - RNA, 19 nt, Homo sapiens
cuuaagaaaugucuccuuu

SEQ ID NO: 176328 - RNA, 19 nt, Homo sapiens
ggaggugcuucacuuaaga

SEQ ID NO: 176329 - RNA, 19 nt, Homo sapiens
gcaggauggucccuuguau

SEQ ID NO: 176330 - RNA, 19 nt, Homo sapiens
agaaacagauaacaccaaa

SEQ ID NO: 176331 - RNA, 19 nt, Homo sapiens
cagaaaagauggaaaagaa

SEQ ID NO: 176332 - RNA, 19 nt, Homo sapiens
ggcaucaguugcuauauau

SEQ ID NO: 176333 - RNA, 19 nt, Homo sapiens
gaaauggagaugaugaaga

SEQ ID NO: 176334 - RNA, 19 nt, Homo sapiens
aaauggagaugaugaagau

SEQ ID NO: 176335 - RNA, 19 nt, Homo sapiens
gcccguagcuccauauugg

SEQ ID NO: 176336 - RNA, 19 nt, Homo sapiens
gagccggucugcaaggaaa

SEQ ID NO: 176337 - RNA, 19 nt, Homo sapiens
gaggagaaagaaacagaua

SEQ ID NO: 176338 - RNA, 19 nt, Homo sapiens
ggaggcaucaguugcuaua

SEQ ID NO: 176339 - RNA, 19 nt, Homo sapiens
gaagagugguaccaagaag

SEQ ID NO: 176340 - RNA, 19 nt, Homo sapiens
aggcaucaguugcuauaua

SEQ ID NO: 176341 - RNA, 19 nt, Homo sapiens
uaaagcacaucgaggugaa

SEQ ID NO: 176342 - RNA, 19 nt, Homo sapiens
gagcgagggucaguuugaa

SEQ ID NO: 176343 - RNA, 19 nt, Homo sapiens
ggaggaugaugaugaugau

SEQ ID NO: 176344 - RNA, 19 nt, Homo sapiens
gauggaggugcuucacuua

SEQ ID NO: 176345 - RNA, 19 nt, Homo sapiens
ggucguuaccagagauuua

SEQ ID NO: 176346 - RNA, 19 nt, Homo sapiens
gauggcacccgaggcauua

SEQ ID NO: 176347 - RNA, 19 nt, Homo sapiens
caacuacaccugcauugug

SEQ ID NO: 176348 - RNA, 19 nt, Homo sapiens
gaugaugacuccucuucag

SEQ ID NO: 176349 - RNA, 19 nt, Homo sapiens
agagugauguguggucuuu

SEQ ID NO: 176350 - RNA, 19 nt, Homo sapiens
auucaaaccugaccacaga

SEQ ID NO: 176351 - RNA, 19 nt, Homo sapiens
ucacagagacccaccuuca

SEQ ID NO: 176352 - RNA, 19 nt, Homo sapiens
gcauggacaagcccaguaa

SEQ ID NO: 176353 - RNA, 19 nt, Homo sapiens
ccagauggcugugcacaag

SEQ ID NO: 176354 - RNA, 19 nt, Homo sapiens
gcccagacaaccugccuua

SEQ ID NO: 176355 - RNA, 19 nt, Homo sapiens
ggaugaugaugaugaugau

SEQ ID NO: 176356 - RNA, 19 nt, Homo sapiens
cagcccagcuugccaaugg

SEQ ID NO: 176357 - RNA, 19 nt, Homo sapiens
ccagacaaccugccuuaug

SEQ ID NO: 176358 - RNA, 19 nt, Homo sapiens
gaguauccauggagaugug

SEQ ID NO: 176359 - RNA, 19 nt, Homo sapiens
cagauaacaccaaaccaaa

SEQ ID NO: 176360 - RNA, 19 nt, Homo sapiens
ccaaugaacaggcaugcaa

SEQ ID NO: 176361 - RNA, 19 nt, Homo sapiens
gaugaagauagcagacuuu

SEQ ID NO: 176362 - RNA, 19 nt, Homo sapiens
gcauaagaauaucaucaac

SEQ ID NO: 176363 - RNA, 19 nt, Homo sapiens
ugaccaaaguggcugugaa

SEQ ID NO: 176364 - RNA, 19 nt, Homo sapiens
caacguggaguucaugugu

SEQ ID NO: 176365 - RNA, 19 nt, Homo sapiens
caacagagaaagacuuguc

SEQ ID NO: 176366 - RNA, 19 nt, Homo sapiens
gauacuaguuugcuuugcu

SEQ ID NO: 176367 - RNA, 19 nt, Homo sapiens
aagaugaucgggaagcaua

SEQ ID NO: 176368 - RNA, 19 nt, Homo sapiens
gaucuacacccaccagagu

SEQ ID NO: 176369 - RNA, 19 nt, Homo sapiens
uaucuggccuccaagaagu

SEQ ID NO: 176370 - RNA, 19 nt, Homo sapiens
ucgggaagcauaagaauau

SEQ ID NO: 176371 - RNA, 19 nt, Homo sapiens
gaggcuacaagguccguua

SEQ ID NO: 176372 - RNA, 19 nt, Homo sapiens
acacugcgcugguugaaaa

SEQ ID NO: 176373 - RNA, 19 nt, Homo sapiens
ggagaaagaaacagauaac

SEQ ID NO: 176374 - RNA, 19 nt, Homo sapiens
ugaacaggcaugcaaguga

SEQ ID NO: 176375 - RNA, 19 nt, Homo sapiens
ugaugaagauagcagacuu

SEQ ID NO: 176376 - RNA, 19 nt, Homo sapiens
ggacaaugugaugaagaua

SEQ ID NO: 176377 - RNA, 19 nt, Homo sapiens
aaaccugaccacagaauug

SEQ ID NO: 176378 - RNA, 19 nt, Homo sapiens
ccaaaguggcugugaagau

SEQ ID NO: 176379 - RNA, 19 nt, Homo sapiens
ggucggucaucgucuacaa

SEQ ID NO: 176380 - RNA, 19 nt, Homo sapiens
cuugaagacugcuggaguu

SEQ ID NO: 176381 - RNA, 19 nt, Homo sapiens
gugaaugggagcaagauug

SEQ ID NO: 176382 - RNA, 19 nt, Homo sapiens
uaauuccgauacuaguuug

SEQ ID NO: 176383 - RNA, 19 nt, Homo sapiens
gacaaacccaaccguguga

SEQ ID NO: 176384 - RNA, 19 nt, Homo sapiens
agauggaggugcuucacuu

SEQ ID NO: 176385 - RNA, 19 nt, Homo sapiens
ggauggcacccgaggcauu

SEQ ID NO: 176386 - RNA, 19 nt, Homo sapiens
ucagaaauggagaugauga

SEQ ID NO: 176387 - RNA, 19 nt, Homo sapiens
acagauaacaccaaaccaa

SEQ ID NO: 176388 - RNA, 19 nt, Homo sapiens
gcuacaagguccguuaugc

SEQ ID NO: 176389 - RNA, 19 nt, Homo sapiens
cgagcucacuguggaguau

SEQ ID NO: 176390 - RNA, 19 nt, Homo sapiens
gauuccgucuucucucaug

SEQ ID NO: 176391 - RNA, 19 nt, Homo sapiens
gacaaugugaugaagauag

SEQ ID NO: 176392 - RNA, 19 nt, Homo sapiens
ugacagaggacaaugugau

SEQ ID NO: 176393 - RNA, 19 nt, Homo sapiens
ggaagcauaagaauaucau

SEQ ID NO: 176394 - RNA, 19 nt, Homo sapiens
uagcaggggucucugagua

SEQ ID NO: 176395 - RNA, 19 nt, Homo sapiens
cgauggagccggucugcaa

SEQ ID NO: 176396 - RNA, 19 nt, Homo sapiens
acguggaguucauguguaa

SEQ ID NO: 176397 - RNA, 19 nt, Homo sapiens
guagcaacguggaguucau

SEQ ID NO: 176398 - RNA, 19 nt, Homo sapiens
acaccugcauuguggagaa

SEQ ID NO: 176399 - RNA, 19 nt, Homo sapiens
gcaacuacaccugcauugu

SEQ ID NO: 176400 - RNA, 19 nt, Homo sapiens
gagaaagaaacagauaaca

SEQ ID NO: 176401 - RNA, 19 nt, Homo sapiens
uguaugucaucguggagua

SEQ ID NO: 176402 - RNA, 19 nt, Homo sapiens
gaucgggaagcauaagaau

SEQ ID NO: 176403 - RNA, 19 nt, Homo sapiens
aaagggucguuaccagaga

SEQ ID NO: 176404 - RNA, 19 nt, Homo sapiens
cagagaaagacuugucaga

SEQ ID NO: 176405 - RNA, 19 nt, Homo sapiens
cuaucgggcuggacaagga

SEQ ID NO: 176406 - RNA, 19 nt, Homo sapiens
ugaagagugguaccaagaa

SEQ ID NO: 176407 - RNA, 19 nt, Homo sapiens
uuaauaccaccgacaaaga

SEQ ID NO: 176408 - RNA, 19 nt, Homo sapiens
cgagcgagggucaguuuga

SEQ ID NO: 176409 - RNA, 19 nt, Homo sapiens
caccacaucgacuacuaua

SEQ ID NO: 176410 - RNA, 19 nt, Homo sapiens
cagaggacaaugugaugaa

SEQ ID NO: 176411 - RNA, 19 nt, Homo sapiens
gacagaggacaaugugaug

SEQ ID NO: 176412 - RNA, 19 nt, Homo sapiens
gaguuaauaccaccgacaa

SEQ ID NO: 176413 - RNA, 19 nt, Homo sapiens
gcacauccaguggcuaaag

SEQ ID NO: 176414 - RNA, 19 nt, Homo sapiens
cagaggagaaagaaacaga

SEQ ID NO: 176415 - RNA, 19 nt, Homo sapiens
gcaucauaauggacucugu

SEQ ID NO: 176416 - RNA, 19 nt, Homo sapiens
caaaccugaccacagaauu

SEQ ID NO: 176417 - RNA, 19 nt, Homo sapiens
ugugggagaucuucacucu

SEQ ID NO: 176418 - RNA, 19 nt, Homo sapiens
uaagaaaugucuccuuuga

SEQ ID NO: 176419 - RNA, 19 nt, Homo sapiens
gaagacugcuggaguuaau

SEQ ID NO: 176420 - RNA, 19 nt, Homo sapiens
caaaguggcugugaagaug

SEQ ID NO: 176421 - RNA, 19 nt, Homo sapiens
ucaagcagcugguggaaga

SEQ ID NO: 176422 - RNA, 19 nt, Homo sapiens
ccacaucgacuacuauaaa

SEQ ID NO: 176423 - RNA, 19 nt, Homo sapiens
ccaacgagcuguacaugau

SEQ ID NO: 176424 - RNA, 19 nt, Homo sapiens
gugcuucacuuaagaaaug

SEQ ID NO: 176425 - RNA, 19 nt, Homo sapiens
gauggucccuuguauguca

SEQ ID NO: 176426 - RNA, 19 nt, Homo sapiens
ccucagggcuacagcagua

SEQ ID NO: 176427 - RNA, 19 nt, Homo sapiens
cuuaagaaaugucuccuuu

SEQ ID NO: 176428 - RNA, 19 nt, Homo sapiens
ggaggugcuucacuuaaga

SEQ ID NO: 176429 - RNA, 19 nt, Homo sapiens
gcaggauggucccuuguau

SEQ ID NO: 176430 - RNA, 19 nt, Homo sapiens
agaaacagauaacaccaaa

SEQ ID NO: 176431 - RNA, 19 nt, Homo sapiens
cagaaaagauggaaaagaa

SEQ ID NO: 176432 - RNA, 19 nt, Homo sapiens
ggcaucaguugcuauauau

SEQ ID NO: 176433 - RNA, 19 nt, Homo sapiens
gaaauggagaugaugaaga

SEQ ID NO: 176434 - RNA, 19 nt, Homo sapiens
aaauggagaugaugaagau

SEQ ID NO: 176435 - RNA, 19 nt, Homo sapiens
gagccggucugcaaggaaa

SEQ ID NO: 176436 - RNA, 19 nt, Homo sapiens
gaggagaaagaaacagaua

SEQ ID NO: 176437 - RNA, 19 nt, Homo sapiens
ggaggcaucaguugcuaua

SEQ ID NO: 176438 - RNA, 19 nt, Homo sapiens
gaagagugguaccaagaag

SEQ ID NO: 176439 - RNA, 19 nt, Homo sapiens
aggcaucaguugcuauaua

SEQ ID NO: 176440 - RNA, 19 nt, Homo sapiens
uaaagcacaucgaggugaa

SEQ ID NO: 176441 - RNA, 19 nt, Homo sapiens
gagcgagggucaguuugaa

SEQ ID NO: 176442 - RNA, 19 nt, Homo sapiens
ggaggaugaugaugaugau

SEQ ID NO: 176443 - RNA, 19 nt, Homo sapiens
gauggaggugcuucacuua

SEQ ID NO: 176444 - RNA, 19 nt, Homo sapiens
ggucguuaccagagauuua

SEQ ID NO: 176445 - RNA, 19 nt, Homo sapiens
gauggcacccgaggcauua

SEQ ID NO: 176446 - RNA, 19 nt, Homo sapiens
caacuacaccugcauugug

SEQ ID NO: 176447 - RNA, 19 nt, Homo sapiens
gaugaugacuccucuucag

SEQ ID NO: 176448 - RNA, 19 nt, Homo sapiens
agagugauguguggucuuu

SEQ ID NO: 176449 - RNA, 19 nt, Homo sapiens
auucaaaccugaccacaga

SEQ ID NO: 176450 - RNA, 19 nt, Homo sapiens
ucacagagacccaccuuca

SEQ ID NO: 176451 - RNA, 19 nt, Homo sapiens
gcauggacaagcccaguaa

SEQ ID NO: 176452 - RNA, 19 nt, Homo sapiens
ccagauggcugugcacaag

SEQ ID NO: 176453 - RNA, 19 nt, Homo sapiens
gcccagacaaccugccuua

SEQ ID NO: 176454 - RNA, 19 nt, Homo sapiens
ggaugaugaugaugaugau

SEQ ID NO: 176455 - RNA, 19 nt, Homo sapiens
cagcccagcuugccaaugg

SEQ ID NO: 176456 - RNA, 19 nt, Homo sapiens
ccagacaaccugccuuaug

SEQ ID NO: 176457 - RNA, 19 nt, Homo sapiens
cagauaacaccaaaccaaa

SEQ ID NO: 176458 - RNA, 19 nt, Homo sapiens
gaguauccauggagaugug

SEQ ID NO: 176459 - RNA, 19 nt, Homo sapiens
ccaaugaacaggcaugcaa

SEQ ID NO: 176460 - RNA, 19 nt, Homo sapiens
gaugaagauagcagacuuu

SEQ ID NO: 176461 - RNA, 19 nt, Homo sapiens
gcauaagaauaucaucaac

SEQ ID NO: 176462 - RNA, 19 nt, Homo sapiens
ugaccaaaguggcugugaa

SEQ ID NO: 176463 - RNA, 19 nt, Homo sapiens
caacguggaguucaugugu

SEQ ID NO: 176464 - RNA, 19 nt, Homo sapiens
caacagagaaagacuuguc

SEQ ID NO: 176465 - RNA, 19 nt, Homo sapiens
gauacuaguuugcuuugcu

SEQ ID NO: 176466 - RNA, 19 nt, Homo sapiens
aagaugaucgggaagcaua

SEQ ID NO: 176467 - RNA, 19 nt, Homo sapiens
gaucuacacccaccagagu

SEQ ID NO: 176468 - RNA, 19 nt, Homo sapiens
uaucuggccuccaagaagu

SEQ ID NO: 176469 - RNA, 19 nt, Homo sapiens
ucgggaagcauaagaauau

SEQ ID NO: 176470 - RNA, 19 nt, Homo sapiens
gaggcuacaagguccguua

SEQ ID NO: 176471 - RNA, 19 nt, Homo sapiens
acacugcgcugguugaaaa

SEQ ID NO: 176472 - RNA, 19 nt, Homo sapiens
ggagaaagaaacagauaac

SEQ ID NO: 176473 - RNA, 19 nt, Homo sapiens
ugaacaggcaugcaaguga

SEQ ID NO: 176474 - RNA, 19 nt, Homo sapiens
ugaugaagauagcagacuu

SEQ ID NO: 176475 - RNA, 19 nt, Homo sapiens
ggacaaugugaugaagaua

SEQ ID NO: 176476 - RNA, 19 nt, Homo sapiens
aaaccugaccacagaauug

SEQ ID NO: 176477 - RNA, 19 nt, Homo sapiens
ccaaaguggcugugaagau

SEQ ID NO: 176478 - RNA, 19 nt, Homo sapiens
ggucggucaucgucuacaa

SEQ ID NO: 176479 - RNA, 19 nt, Homo sapiens
cuugaagacugcuggaguu

SEQ ID NO: 176480 - RNA, 19 nt, Homo sapiens
gugaaugggagcaagauug

SEQ ID NO: 176481 - RNA, 19 nt, Homo sapiens
uaauuccgauacuaguuug

SEQ ID NO: 176482 - RNA, 19 nt, Homo sapiens
gacaaacccaaccguguga

SEQ ID NO: 176483 - RNA, 19 nt, Homo sapiens
agauggaggugcuucacuu

SEQ ID NO: 176484 - RNA, 19 nt, Homo sapiens
ggauggcacccgaggcauu

SEQ ID NO: 176485 - RNA, 19 nt, Homo sapiens
ucagaaauggagaugauga

SEQ ID NO: 176486 - RNA, 19 nt, Homo sapiens
acagauaacaccaaaccaa

SEQ ID NO: 176487 - RNA, 19 nt, Homo sapiens
cgagcucacuguggaguau

SEQ ID NO: 176488 - RNA, 19 nt, Homo sapiens
gcuacaagguccguuaugc

SEQ ID NO: 176489 - RNA, 19 nt, Homo sapiens
gauuccgucuucucucaug

SEQ ID NO: 176490 - RNA, 19 nt, Homo sapiens
gacaaugugaugaagauag

SEQ ID NO: 176491 - RNA, 19 nt, Homo sapiens
ugacagaggacaaugugau

SEQ ID NO: 176492 - RNA, 19 nt, Homo sapiens
ggaagcauaagaauaucau

SEQ ID NO: 176493 - RNA, 19 nt, Homo sapiens
uagcaggggucucugagua

SEQ ID NO: 176494 - RNA, 19 nt, Homo sapiens
cgauggagccggucugcaa

SEQ ID NO: 176495 - RNA, 19 nt, Homo sapiens
acguggaguucauguguaa

SEQ ID NO: 176496 - RNA, 19 nt, Homo sapiens
guagcaacguggaguucau

SEQ ID NO: 176497 - RNA, 19 nt, Homo sapiens
acaccugcauuguggagaa

SEQ ID NO: 176498 - RNA, 19 nt, Homo sapiens
gcaacuacaccugcauugu

SEQ ID NO: 176499 - RNA, 19 nt, Homo sapiens
gagaaagaaacagauaaca

SEQ ID NO: 176500 - RNA, 19 nt, Homo sapiens
uguaugucaucguggagua

SEQ ID NO: 176501 - RNA, 19 nt, Homo sapiens
gaucgggaagcauaagaau

SEQ ID NO: 176502 - RNA, 19 nt, Homo sapiens
aaagggucguuaccagaga

SEQ ID NO: 176503 - RNA, 19 nt, Homo sapiens
cagagaaagacuugucaga

SEQ ID NO: 176504 - RNA, 19 nt, Homo sapiens
cuaucgggcuggacaagga

SEQ ID NO: 176505 - RNA, 19 nt, Homo sapiens
ugaagagugguaccaagaa

SEQ ID NO: 176506 - RNA, 19 nt, Homo sapiens
uuaauaccaccgacaaaga

SEQ ID NO: 176507 - RNA, 19 nt, Homo sapiens
caccacaucgacuacuaua

SEQ ID NO: 176508 - RNA, 19 nt, Homo sapiens
cagaggacaaugugaugaa

SEQ ID NO: 176509 - RNA, 19 nt, Homo sapiens
gacagaggacaaugugaug

SEQ ID NO: 176510 - RNA, 19 nt, Homo sapiens
cagaggagaaagaaacaga

SEQ ID NO: 176511 - RNA, 19 nt, Homo sapiens
cgagcgagggucaguuuga

SEQ ID NO: 176512 - RNA, 19 nt, Homo sapiens
gaguuaauaccaccgacaa

SEQ ID NO: 176513 - RNA, 19 nt, Homo sapiens
gcacauccaguggcuaaag

SEQ ID NO: 176514 - RNA, 19 nt, Homo sapiens
gcaucauaauggacucugu

SEQ ID NO: 176515 - RNA, 19 nt, Homo sapiens
caaaccugaccacagaauu

SEQ ID NO: 176516 - RNA, 19 nt, Homo sapiens
ugugggagaucuucacucu

SEQ ID NO: 176517 - RNA, 19 nt, Homo sapiens
ccgcacauccaguggcuaa

SEQ ID NO: 176518 - RNA, 19 nt, Homo sapiens
uaacagaggucacaaagug

SEQ ID NO: 176519 - RNA, 19 nt, Homo sapiens
gaagguaauugccuaaauc

SEQ ID NO: 176520 - RNA, 19 nt, Homo sapiens
ggaagguaauugccuaaau

SEQ ID NO: 176521 - RNA, 19 nt, Homo sapiens
gaggugagcugggaacaga

SEQ ID NO: 176522 - RNA, 19 nt, Homo sapiens
ggaguggguuaaacacaaa

SEQ ID NO: 176523 - RNA, 19 nt, Homo sapiens
caaauggggugcaugauaa

SEQ ID NO: 176524 - RNA, 19 nt, Homo sapiens
gaucauuccucacgcuuca

SEQ ID NO: 176525 - RNA, 19 nt, Homo sapiens
agaaacagauaacaccaaa

SEQ ID NO: 176526 - RNA, 19 nt, Homo sapiens
ggaaaguuguuuaccucuu

SEQ ID NO: 176527 - RNA, 19 nt, Homo sapiens
cagaaaagauggaaaagaa

SEQ ID NO: 176528 - RNA, 19 nt, Homo sapiens
gcccguagcuccauauugg

SEQ ID NO: 176529 - RNA, 19 nt, Homo sapiens
gaggagaaagaaacagaua

SEQ ID NO: 176530 - RNA, 19 nt, Homo sapiens
gagccggucugcaaggaaa

SEQ ID NO: 176531 - RNA, 19 nt, Homo sapiens
gaacauuccauuugaagca

SEQ ID NO: 176532 - RNA, 19 nt, Homo sapiens
gggaguggguuaaacacaa

SEQ ID NO: 176533 - RNA, 19 nt, Homo sapiens
gcacacacacuccaucuca

SEQ ID NO: 176534 - RNA, 19 nt, Homo sapiens
uaaagcacaucgaggugaa

SEQ ID NO: 176535 - RNA, 19 nt, Homo sapiens
guagggaucuagccacauc

SEQ ID NO: 176536 - RNA, 19 nt, Homo sapiens
gagcgagggucaguuugaa

SEQ ID NO: 176537 - RNA, 19 nt, Homo sapiens
ggaggaugaugaugaugau

SEQ ID NO: 176538 - RNA, 19 nt, Homo sapiens
ggguggugcuggucuguaa

SEQ ID NO: 176539 - RNA, 19 nt, Homo sapiens
caacuacaccugcauugug

SEQ ID NO: 176540 - RNA, 19 nt, Homo sapiens
cauaugaggacgaggagua

SEQ ID NO: 176541 - RNA, 19 nt, Homo sapiens
gcaaauggggugcaugaua

SEQ ID NO: 176542 - RNA, 19 nt, Homo sapiens
gaugaugacuccucuucag

SEQ ID NO: 176543 - RNA, 19 nt, Homo sapiens
auucaaaccugaccacaga

SEQ ID NO: 176544 - RNA, 19 nt, Homo sapiens
gaaaccccaucucuacuaa

SEQ ID NO: 176545 - RNA, 19 nt, Homo sapiens
caacaggaaggaaccagaa

SEQ ID NO: 176546 - RNA, 19 nt, Homo sapiens
ugaguuacguacgaucuuu

SEQ ID NO: 176547 - RNA, 19 nt, Homo sapiens
gcccagacaaccugccuua

SEQ ID NO: 176548 - RNA, 19 nt, Homo sapiens
ggaugaugaugaugaugau

SEQ ID NO: 176549 - RNA, 19 nt, Homo sapiens
gcagucgucacgccuguaa

SEQ ID NO: 176550 - RNA, 19 nt, Homo sapiens
ggguuaaacacaaauagaa

SEQ ID NO: 176551 - RNA, 19 nt, Homo sapiens
ccagacaaccugccuuaug

SEQ ID NO: 176552 - RNA, 19 nt, Homo sapiens
cagauaacaccaaaccaaa

SEQ ID NO: 176553 - RNA, 19 nt, Homo sapiens
gaguauccauggagaugug

SEQ ID NO: 176554 - RNA, 19 nt, Homo sapiens
guacgaucuuucuggcaaa

SEQ ID NO: 176555 - RNA, 19 nt, Homo sapiens
caacguggaguucaugugu

SEQ ID NO: 176556 - RNA, 19 nt, Homo sapiens
ggagggaguggguuaaaca

SEQ ID NO: 176557 - RNA, 19 nt, Homo sapiens
aaacugcucuguaggucau

SEQ ID NO: 176558 - RNA, 19 nt, Homo sapiens
uaauaagcuuugagagcaa

SEQ ID NO: 176559 - RNA, 19 nt, Homo sapiens
gaucuugaagguaaucaug

SEQ ID NO: 176560 - RNA, 19 nt, Homo sapiens
gaggcuacaagguccguua

SEQ ID NO: 176561 - RNA, 19 nt, Homo sapiens
acacugcgcugguugaaaa

SEQ ID NO: 176562 - RNA, 19 nt, Homo sapiens
ggagaaagaaacagauaac

SEQ ID NO: 176563 - RNA, 19 nt, Homo sapiens
aaaccugaccacagaauug

SEQ ID NO: 176564 - RNA, 19 nt, Homo sapiens
gugaaugggagcaagauug

SEQ ID NO: 176565 - RNA, 19 nt, Homo sapiens
guaggucauuggccacugu

SEQ ID NO: 176566 - RNA, 19 nt, Homo sapiens
gcccgaaaccagagccuuu

SEQ ID NO: 176567 - RNA, 19 nt, Homo sapiens
gugcuggucuguaauaagc

SEQ ID NO: 176568 - RNA, 19 nt, Homo sapiens
acagauaacaccaaaccaa

SEQ ID NO: 176569 - RNA, 19 nt, Homo sapiens
aaaauuagcugugcauagu

SEQ ID NO: 176570 - RNA, 19 nt, Homo sapiens
cgagcucacuguggaguau

SEQ ID NO: 176571 - RNA, 19 nt, Homo sapiens
gcuacaagguccguuaugc

SEQ ID NO: 176572 - RNA, 19 nt, Homo sapiens
gaagcugggaaaguuguuu

SEQ ID NO: 176573 - RNA, 19 nt, Homo sapiens
acguggaguucauguguaa

SEQ ID NO: 176574 - RNA, 19 nt, Homo sapiens
guagcaacguggaguucau

SEQ ID NO: 176575 - RNA, 19 nt, Homo sapiens
acaccugcauuguggagaa

SEQ ID NO: 176576 - RNA, 19 nt, Homo sapiens
gcaacuacaccugcauugu

SEQ ID NO: 176577 - RNA, 19 nt, Homo sapiens
cgauggagccggucugcaa

SEQ ID NO: 176578 - RNA, 19 nt, Homo sapiens
gagaaagaaacagauaaca

SEQ ID NO: 176579 - RNA, 19 nt, Homo sapiens
ggugacagagugagugaga

SEQ ID NO: 176580 - RNA, 19 nt, Homo sapiens
cacuuguucuguacuugua

SEQ ID NO: 176581 - RNA, 19 nt, Homo sapiens
aaucauggcaccagucuuc

SEQ ID NO: 176582 - RNA, 19 nt, Homo sapiens
gcaccuguagucccagcua

SEQ ID NO: 176583 - RNA, 19 nt, Homo sapiens
ccuguaaucccagcacuuu

SEQ ID NO: 176584 - RNA, 19 nt, Homo sapiens
gcuggucuguaauaagcuu

SEQ ID NO: 176585 - RNA, 19 nt, Homo sapiens
cgagcgagggucaguuuga

SEQ ID NO: 176586 - RNA, 19 nt, Homo sapiens
gcacauccaguggcuaaag

SEQ ID NO: 176587 - RNA, 19 nt, Homo sapiens
gcaucauaauggacucugu

SEQ ID NO: 176588 - RNA, 19 nt, Homo sapiens
caaaccugaccacagaauu

SEQ ID NO: 176589 - RNA, 19 nt, Homo sapiens
cagaggagaaagaaacaga

SEQ ID NO: 176590 - RNA, 19 nt, Homo sapiens
gccacugucuccacucaca

SEQ ID NO: 176591 - RNA, 19 nt, Homo sapiens
ccucccuucucuucucuuu

SEQ ID NO: 176592 - RNA, 19 nt, Homo sapiens
caagcguuucccagucuua

SEQ ID NO: 176593 - RNA, 19 nt, Homo sapiens
ggucuguaauaagcuuuga

SEQ ID NO: 176594 - RNA, 19 nt, Homo sapiens
guggugcuggucuguaaua

SEQ ID NO: 176595 - RNA, 19 nt, Homo sapiens
ccgcacauccaguggcuaa

SEQ ID NO: 176596 - RNA, 19 nt, Homo sapiens
gcagcaucaaccacacaua

SEQ ID NO: 176597 - RNA, 19 nt, Homo sapiens
gccgagcgagggucaguuu

SEQ ID NO: 176598 - RNA, 19 nt, Homo sapiens
gggcaacuacaccugcauu

SEQ ID NO: 176599 - RNA, 19 nt, Homo sapiens
cggaggaugaugaugauga

SEQ ID NO: 176600 - RNA, 19 nt, Homo sapiens
aagcugggaaaguuguuua

SEQ ID NO: 176601 - RNA, 19 nt, Homo sapiens
ggacauccccagaaaagau

SEQ ID NO: 176602 - RNA, 19 nt, Homo sapiens
gagauguggagccuuguca

SEQ ID NO: 176603 - RNA, 19 nt, Homo sapiens
gugagacucugcguuaaaa

SEQ ID NO: 176604 - RNA, 19 nt, Homo sapiens
ggaggcugaggcaagcuaa

SEQ ID NO: 176605 - RNA, 19 nt, Homo sapiens
caacgucacuggggcuuug

SEQ ID NO: 176606 - RNA, 19 nt, Homo sapiens
uguggagccuugucaccaa

SEQ ID NO: 176607 - RNA, 19 nt, Homo sapiens
gaggugaaugggagcaaga

SEQ ID NO: 176608 - RNA, 19 nt, Homo sapiens
cagcaucaaccacacauac

SEQ ID NO: 176609 - RNA, 19 nt, Homo sapiens
acaccaaaccaaaccguau

SEQ ID NO: 176610 - RNA, 19 nt, Homo sapiens
guggaucucgcaacaggaa

SEQ ID NO: 176611 - RNA, 19 nt, Homo sapiens
cgaucuuucuggcaaaugg

SEQ ID NO: 176612 - RNA, 19 nt, Homo sapiens
ccgcggaacccaaggacuu

SEQ ID NO: 176613 - RNA, 19 nt, Homo sapiens
acucuguggugcccucuga

SEQ ID NO: 176614 - RNA, 19 nt, Homo sapiens
ccuggagcaucauaaugga

SEQ ID NO: 176615 - RNA, 19 nt, Homo sapiens
gaauuggaggcuacaaggu

SEQ ID NO: 176616 - RNA, 19 nt, Homo sapiens
gcaagauuggcccagacaa

SEQ ID NO: 176617 - RNA, 19 nt, Homo sapiens
ccaccuggagcaucauaau

SEQ ID NO: 176618 - RNA, 19 nt, Homo sapiens
uaacagaggucacaaagug

SEQ ID NO: 176619 - RNA, 19 nt, Homo sapiens
gaagguaauugccuaaauc

SEQ ID NO: 176620 - RNA, 19 nt, Homo sapiens
ggaagguaauugccuaaau

SEQ ID NO: 176621 - RNA, 19 nt, Homo sapiens
gaggugagcugggaacaga

SEQ ID NO: 176622 - RNA, 19 nt, Homo sapiens
ggaguggguuaaacacaaa

SEQ ID NO: 176623 - RNA, 19 nt, Homo sapiens
caaauggggugcaugauaa

SEQ ID NO: 176624 - RNA, 19 nt, Homo sapiens
gaucauuccucacgcuuca

SEQ ID NO: 176625 - RNA, 19 nt, Homo sapiens
agaaacagauaacaccaaa

SEQ ID NO: 176626 - RNA, 19 nt, Homo sapiens
ggaaaguuguuuaccucuu

SEQ ID NO: 176627 - RNA, 19 nt, Homo sapiens
cagaaaagauggaaaagaa

SEQ ID NO: 176628 - RNA, 19 nt, Homo sapiens
gaggagaaagaaacagaua

SEQ ID NO: 176629 - RNA, 19 nt, Homo sapiens
gaacauuccauuugaagca

SEQ ID NO: 176630 - RNA, 19 nt, Homo sapiens
gggaguggguuaaacacaa

SEQ ID NO: 176631 - RNA, 19 nt, Homo sapiens
gcacacacacuccaucuca

SEQ ID NO: 176632 - RNA, 19 nt, Homo sapiens
uaaagcacaucgaggugaa

SEQ ID NO: 176633 - RNA, 19 nt, Homo sapiens
guagggaucuagccacauc

SEQ ID NO: 176634 - RNA, 19 nt, Homo sapiens
gagcgagggucaguuugaa

SEQ ID NO: 176635 - RNA, 19 nt, Homo sapiens
ggaggaugaugaugaugau

SEQ ID NO: 176636 - RNA, 19 nt, Homo sapiens
ggguggugcuggucuguaa

SEQ ID NO: 176637 - RNA, 19 nt, Homo sapiens
caacuacaccugcauugug

SEQ ID NO: 176638 - RNA, 19 nt, Homo sapiens
cauaugaggacgaggagua

SEQ ID NO: 176639 - RNA, 19 nt, Homo sapiens
gcaaauggggugcaugaua

SEQ ID NO: 176640 - RNA, 19 nt, Homo sapiens
gaugaugacuccucuucag

SEQ ID NO: 176641 - RNA, 19 nt, Homo sapiens
auucaaaccugaccacaga

SEQ ID NO: 176642 - RNA, 19 nt, Homo sapiens
gaaaccccaucucuacuaa

SEQ ID NO: 176643 - RNA, 19 nt, Homo sapiens
caacaggaaggaaccagaa

SEQ ID NO: 176644 - RNA, 19 nt, Homo sapiens
ugaguuacguacgaucuuu

SEQ ID NO: 176645 - RNA, 19 nt, Homo sapiens
gcccagacaaccugccuua

SEQ ID NO: 176646 - RNA, 19 nt, Homo sapiens
ggaugaugaugaugaugau

SEQ ID NO: 176647 - RNA, 19 nt, Homo sapiens
gcagucgucacgccuguaa

SEQ ID NO: 176648 - RNA, 19 nt, Homo sapiens
ggguuaaacacaaauagaa

SEQ ID NO: 176649 - RNA, 19 nt, Homo sapiens
ccagacaaccugccuuaug

SEQ ID NO: 176650 - RNA, 19 nt, Homo sapiens
cagauaacaccaaaccaaa

SEQ ID NO: 176651 - RNA, 19 nt, Homo sapiens
gaguauccauggagaugug

SEQ ID NO: 176652 - RNA, 19 nt, Homo sapiens
guacgaucuuucuggcaaa

SEQ ID NO: 176653 - RNA, 19 nt, Homo sapiens
caacguggaguucaugugu

SEQ ID NO: 176654 - RNA, 19 nt, Homo sapiens
ggagggaguggguuaaaca

SEQ ID NO: 176655 - RNA, 19 nt, Homo sapiens
aaacugcucuguaggucau

SEQ ID NO: 176656 - RNA, 19 nt, Homo sapiens
uaauaagcuuugagagcaa

SEQ ID NO: 176657 - RNA, 19 nt, Homo sapiens
gaucuugaagguaaucaug

SEQ ID NO: 176658 - RNA, 19 nt, Homo sapiens
gaggcuacaagguccguua

SEQ ID NO: 176659 - RNA, 19 nt, Homo sapiens
acacugcgcugguugaaaa

SEQ ID NO: 176660 - RNA, 19 nt, Homo sapiens
ggagaaagaaacagauaac

SEQ ID NO: 176661 - RNA, 19 nt, Homo sapiens
aaaccugaccacagaauug

SEQ ID NO: 176662 - RNA, 19 nt, Homo sapiens
gugaaugggagcaagauug

SEQ ID NO: 176663 - RNA, 19 nt, Homo sapiens
guaggucauuggccacugu

SEQ ID NO: 176664 - RNA, 19 nt, Homo sapiens
gcccgaaaccagagccuuu

SEQ ID NO: 176665 - RNA, 19 nt, Homo sapiens
gugcuggucuguaauaagc

SEQ ID NO: 176666 - RNA, 19 nt, Homo sapiens
acagauaacaccaaaccaa

SEQ ID NO: 176667 - RNA, 19 nt, Homo sapiens
aaaauuagcugugcauagu

SEQ ID NO: 176668 - RNA, 19 nt, Homo sapiens
cgagcucacuguggaguau

SEQ ID NO: 176669 - RNA, 19 nt, Homo sapiens
gcuacaagguccguuaugc

SEQ ID NO: 176670 - RNA, 19 nt, Homo sapiens
gaagcugggaaaguuguuu

SEQ ID NO: 176671 - RNA, 19 nt, Homo sapiens
acguggaguucauguguaa

SEQ ID NO: 176672 - RNA, 19 nt, Homo sapiens
guagcaacguggaguucau

SEQ ID NO: 176673 - RNA, 19 nt, Homo sapiens
acaccugcauuguggagaa

SEQ ID NO: 176674 - RNA, 19 nt, Homo sapiens
gcaacuacaccugcauugu

SEQ ID NO: 176675 - RNA, 19 nt, Homo sapiens
gagaaagaaacagauaaca

SEQ ID NO: 176676 - RNA, 19 nt, Homo sapiens
ggugacagagugagugaga

SEQ ID NO: 176677 - RNA, 19 nt, Homo sapiens
cacuuguucuguacuugua

SEQ ID NO: 176678 - RNA, 19 nt, Homo sapiens
aaucauggcaccagucuuc

SEQ ID NO: 176679 - RNA, 19 nt, Homo sapiens
gcaccuguagucccagcua

SEQ ID NO: 176680 - RNA, 19 nt, Homo sapiens
ccuguaaucccagcacuuu

SEQ ID NO: 176681 - RNA, 19 nt, Homo sapiens
gcuggucuguaauaagcuu

SEQ ID NO: 176682 - RNA, 19 nt, Homo sapiens
gcacauccaguggcuaaag

SEQ ID NO: 176683 - RNA, 19 nt, Homo sapiens
cgagcgagggucaguuuga

SEQ ID NO: 176684 - RNA, 19 nt, Homo sapiens
gcaucauaauggacucugu

SEQ ID NO: 176685 - RNA, 19 nt, Homo sapiens
caaaccugaccacagaauu

SEQ ID NO: 176686 - RNA, 19 nt, Homo sapiens
cagaggagaaagaaacaga

SEQ ID NO: 176687 - RNA, 19 nt, Homo sapiens
gccacugucuccacucaca

SEQ ID NO: 176688 - RNA, 19 nt, Homo sapiens
ccucccuucucuucucuuu

SEQ ID NO: 176689 - RNA, 19 nt, Homo sapiens
caagcguuucccagucuua

SEQ ID NO: 176690 - RNA, 19 nt, Homo sapiens
ggucuguaauaagcuuuga

SEQ ID NO: 176691 - RNA, 19 nt, Homo sapiens
guggugcuggucuguaaua

SEQ ID NO: 176692 - RNA, 19 nt, Homo sapiens
ccgcacauccaguggcuaa

SEQ ID NO: 176693 - RNA, 19 nt, Homo sapiens
gcagcaucaaccacacaua

SEQ ID NO: 176694 - RNA, 19 nt, Homo sapiens
gauggagcccggucugcaa

SEQ ID NO: 176695 - RNA, 19 nt, Homo sapiens
gccgagcgagggucaguuu

SEQ ID NO: 176696 - RNA, 19 nt, Homo sapiens
gggcaacuacaccugcauu

SEQ ID NO: 176697 - RNA, 19 nt, Homo sapiens
cggaggaugaugaugauga

SEQ ID NO: 176698 - RNA, 19 nt, Homo sapiens
aagcugggaaaguuguuua

SEQ ID NO: 176699 - RNA, 19 nt, Homo sapiens
ggacauccccagaaaagau

SEQ ID NO: 176700 - RNA, 19 nt, Homo sapiens
gagauguggagccuuguca

SEQ ID NO: 176701 - RNA, 19 nt, Homo sapiens
gugagacucugcguuaaaa

SEQ ID NO: 176702 - RNA, 19 nt, Homo sapiens
ggaggcugaggcaagcuaa

SEQ ID NO: 176703 - RNA, 19 nt, Homo sapiens
caacgucacuggggcuuug

SEQ ID NO: 176704 - RNA, 19 nt, Homo sapiens
uguggagccuugucaccaa

SEQ ID NO: 176705 - RNA, 19 nt, Homo sapiens
gaggugaaugggagcaaga

SEQ ID NO: 176706 - RNA, 19 nt, Homo sapiens
cagcaucaaccacacauac

SEQ ID NO: 176707 - RNA, 19 nt, Homo sapiens
guggaucucgcaacaggaa

SEQ ID NO: 176708 - RNA, 19 nt, Homo sapiens
cgaucuuucuggcaaaugg

SEQ ID NO: 176709 - RNA, 19 nt, Homo sapiens
ccgcggaacccaaggacuu

SEQ ID NO: 176710 - RNA, 19 nt, Homo sapiens
acucuguggugcccucuga

SEQ ID NO: 176711 - RNA, 19 nt, Homo sapiens
ccuggagcaucauaaugga

SEQ ID NO: 176712 - RNA, 19 nt, Homo sapiens
gaauuggaggcuacaaggu

SEQ ID NO: 176713 - RNA, 19 nt, Homo sapiens
gcaagauuggcccagacaa

SEQ ID NO: 176714 - RNA, 19 nt, Homo sapiens
ccaccuggagcaucauaau

SEQ ID NO: 176715 - RNA, 19 nt, Homo sapiens
gggaagguaauugccuaaa

SEQ ID NO: 176716 - RNA, 19 nt, Homo sapiens
acacaaggaaggcauuugg

SEQ ID NO: 176717 - RNA, 19 nt, Homo sapiens
guaacagaggucacaaagu

SEQ ID NO: 176718 - RNA, 19 nt, Homo sapiens
uaagaaaugucuccuuuga

SEQ ID NO: 176719 - RNA, 19 nt, Homo sapiens
gaagacugcuggaguuaau

SEQ ID NO: 176720 - RNA, 19 nt, Homo sapiens
caaaguggcugugaagaug

SEQ ID NO: 176721 - RNA, 19 nt, Homo sapiens
ucaagcagcugguggaaga

SEQ ID NO: 176722 - RNA, 19 nt, Homo sapiens
ccacaucgacuacuauaaa

SEQ ID NO: 176723 - RNA, 19 nt, Homo sapiens
ccaacgagcuguacaugau

SEQ ID NO: 176724 - RNA, 19 nt, Homo sapiens
gugcuucacuuaagaaaug

SEQ ID NO: 176725 - RNA, 19 nt, Homo sapiens
gauggucccuuguauguca

SEQ ID NO: 176726 - RNA, 19 nt, Homo sapiens
ccucagggcuacagcagua

SEQ ID NO: 176727 - RNA, 19 nt, Homo sapiens
cuuaagaaaugucuccuuu

SEQ ID NO: 176728 - RNA, 19 nt, Homo sapiens
ggaggugcuucacuuaaga

SEQ ID NO: 176729 - RNA, 19 nt, Homo sapiens
gcaggauggucccuuguau

SEQ ID NO: 176730 - RNA, 19 nt, Homo sapiens
agaaacagauaacaccaaa

SEQ ID NO: 176731 - RNA, 19 nt, Homo sapiens
cagaaaagauggaaaagaa

SEQ ID NO: 176732 - RNA, 19 nt, Homo sapiens
ggcaucaguugcuauauau

SEQ ID NO: 176733 - RNA, 19 nt, Homo sapiens
gaaauggagaugaugaaga

SEQ ID NO: 176734 - RNA, 19 nt, Homo sapiens
aaauggagaugaugaagau

SEQ ID NO: 176735 - RNA, 19 nt, Homo sapiens
gcccguagcuccauauugg

SEQ ID NO: 176736 - RNA, 19 nt, Homo sapiens
gagccggucugcaaggaaa

SEQ ID NO: 176737 - RNA, 19 nt, Homo sapiens
gaggagaaagaaacagaua

SEQ ID NO: 176738 - RNA, 19 nt, Homo sapiens
ggaggcaucaguugcuaua

SEQ ID NO: 176739 - RNA, 19 nt, Homo sapiens
gaagagugguaccaagaag

SEQ ID NO: 176740 - RNA, 19 nt, Homo sapiens
aggcaucaguugcuauaua

SEQ ID NO: 176741 - RNA, 19 nt, Homo sapiens
uaaagcacaucgaggugaa

SEQ ID NO: 176742 - RNA, 19 nt, Homo sapiens
gagcgagggucaguuugaa

SEQ ID NO: 176743 - RNA, 19 nt, Homo sapiens
ggaggaugaugaugaugau

SEQ ID NO: 176744 - RNA, 19 nt, Homo sapiens
gcaagugagagcuuucuga

SEQ ID NO: 176745 - RNA, 19 nt, Homo sapiens
gauggaggugcuucacuua

SEQ ID NO: 176746 - RNA, 19 nt, Homo sapiens
gcagugacaccaccuacuu

SEQ ID NO: 176747 - RNA, 19 nt, Homo sapiens
ggucguuaccagagauuua

SEQ ID NO: 176748 - RNA, 19 nt, Homo sapiens
gauggcacccgaggcauua

SEQ ID NO: 176749 - RNA, 19 nt, Homo sapiens
caacuacaccugcauugug

SEQ ID NO: 176750 - RNA, 19 nt, Homo sapiens
gaugaugacuccucuucag

SEQ ID NO: 176751 - RNA, 19 nt, Homo sapiens
agagugauguguggucuuu

SEQ ID NO: 176752 - RNA, 19 nt, Homo sapiens
auucaaaccugaccacaga

SEQ ID NO: 176753 - RNA, 19 nt, Homo sapiens
gcaugcaagugagagcuuu

SEQ ID NO: 176754 - RNA, 19 nt, Homo sapiens
ucacagagacccaccuuca

SEQ ID NO: 176755 - RNA, 19 nt, Homo sapiens
gcauggacaagcccaguaa

SEQ ID NO: 176756 - RNA, 19 nt, Homo sapiens
ccagauggcugugcacaag

SEQ ID NO: 176757 - RNA, 19 nt, Homo sapiens
gcccagacaaccugccuua

SEQ ID NO: 176758 - RNA, 19 nt, Homo sapiens
ggaugaugaugaugaugau

SEQ ID NO: 176759 - RNA, 19 nt, Homo sapiens
cagcccagcuugccaaugg

SEQ ID NO: 176760 - RNA, 19 nt, Homo sapiens
gauucggucuucucucaug

SEQ ID NO: 176761 - RNA, 19 nt, Homo sapiens
gaguauccauggagaugug

SEQ ID NO: 176762 - RNA, 19 nt, Homo sapiens
ccagacaaccugccuuaug

SEQ ID NO: 176763 - RNA, 19 nt, Homo sapiens
cagauaacaccaaaccaaa

SEQ ID NO: 176764 - RNA, 19 nt, Homo sapiens
ccaaugaacaggcaugcaa

SEQ ID NO: 176765 - RNA, 19 nt, Homo sapiens
gaugaagauagcagacuuu

SEQ ID NO: 176766 - RNA, 19 nt, Homo sapiens
gcauaagaauaucaucaac

SEQ ID NO: 176767 - RNA, 19 nt, Homo sapiens
ugaccaaaguggcugugaa

SEQ ID NO: 176768 - RNA, 19 nt, Homo sapiens
caacguggaguucaugugu

SEQ ID NO: 176769 - RNA, 19 nt, Homo sapiens
caacagagaaagacuuguc

SEQ ID NO: 176770 - RNA, 19 nt, Homo sapiens
gauacuaguuugcuuugcu

SEQ ID NO: 176771 - RNA, 19 nt, Homo sapiens
aagaugaucgggaagcaua

SEQ ID NO: 176772 - RNA, 19 nt, Homo sapiens
gaucuacacccaccagagu

SEQ ID NO: 176773 - RNA, 19 nt, Homo sapiens
ucgggaagcauaagaauau

SEQ ID NO: 176774 - RNA, 19 nt, Homo sapiens
gaggcuacaagguccguua

SEQ ID NO: 176775 - RNA, 19 nt, Homo sapiens
acacugcgcugguugaaaa

SEQ ID NO: 176776 - RNA, 19 nt, Homo sapiens
ggagaaagaaacagauaac

SEQ ID NO: 176777 - RNA, 19 nt, Homo sapiens
ugaacaggcaugcaaguga

SEQ ID NO: 176778 - RNA, 19 nt, Homo sapiens
ugaugaagauagcagacuu

SEQ ID NO: 176779 - RNA, 19 nt, Homo sapiens
ggacaaugugaugaagaua

SEQ ID NO: 176780 - RNA, 19 nt, Homo sapiens
aaaccugaccacagaauug

SEQ ID NO: 176781 - RNA, 19 nt, Homo sapiens
cuacuucuccgucaauguu

SEQ ID NO: 176782 - RNA, 19 nt, Homo sapiens
ccaaaguggcugugaagau

SEQ ID NO: 176783 - RNA, 19 nt, Homo sapiens
ggucggucaucgucuacaa

SEQ ID NO: 176784 - RNA, 19 nt, Homo sapiens
cuugaagacugcuggaguu

SEQ ID NO: 176785 - RNA, 19 nt, Homo sapiens
gugaaugggagcaagauug

SEQ ID NO: 176786 - RNA, 19 nt, Homo sapiens
uaauuccgauacuaguuug

SEQ ID NO: 176787 - RNA, 19 nt, Homo sapiens
gacaaacccaaccguguga

SEQ ID NO: 176788 - RNA, 19 nt, Homo sapiens
agauggaggugcuucacuu

SEQ ID NO: 176789 - RNA, 19 nt, Homo sapiens
ggauggcacccgaggcauu

SEQ ID NO: 176790 - RNA, 19 nt, Homo sapiens
ucagaaauggagaugauga

SEQ ID NO: 176791 - RNA, 19 nt, Homo sapiens
acagauaacaccaaaccaa

SEQ ID NO: 176792 - RNA, 19 nt, Homo sapiens
gcuacaagguccguuaugc

SEQ ID NO: 176793 - RNA, 19 nt, Homo sapiens
cgagcucacuguggaguau

SEQ ID NO: 176794 - RNA, 19 nt, Homo sapiens
gacaaugugaugaagauag

SEQ ID NO: 176795 - RNA, 19 nt, Homo sapiens
ugacagaggacaaugugau

SEQ ID NO: 176796 - RNA, 19 nt, Homo sapiens
ggaagcauaagaauaucau

SEQ ID NO: 176797 - RNA, 19 nt, Homo sapiens
uagcaggggucucugagua

SEQ ID NO: 176798 - RNA, 19 nt, Homo sapiens
cgauggagccggucugcaa

SEQ ID NO: 176799 - RNA, 19 nt, Homo sapiens
acguggaguucauguguaa

SEQ ID NO: 176800 - RNA, 19 nt, Homo sapiens
guagcaacguggaguucau

SEQ ID NO: 176801 - RNA, 19 nt, Homo sapiens
acaccugcauuguggagaa

SEQ ID NO: 176802 - RNA, 19 nt, Homo sapiens
gcaacuacaccugcauugu

SEQ ID NO: 176803 - RNA, 19 nt, Homo sapiens
gagaaagaaacagauaaca

SEQ ID NO: 176804 - RNA, 19 nt, Homo sapiens
aggauucggucuucucuca

SEQ ID NO: 176805 - RNA, 19 nt, Homo sapiens
uguaugucaucguggagua

SEQ ID NO: 176806 - RNA, 19 nt, Homo sapiens
gaucgggaagcauaagaau

SEQ ID NO: 176807 - RNA, 19 nt, Homo sapiens
aaagggucguuaccagaga

SEQ ID NO: 176808 - RNA, 19 nt, Homo sapiens
cagagaaagacuugucaga

SEQ ID NO: 176809 - RNA, 19 nt, Homo sapiens
cuaucgggcuggacaagga

SEQ ID NO: 176810 - RNA, 19 nt, Homo sapiens
ugaagagugguaccaagaa

SEQ ID NO: 176811 - RNA, 19 nt, Homo sapiens
uuaauaccaccgacaaaga

SEQ ID NO: 176812 - RNA, 19 nt, Homo sapiens
cgagcgagggucaguuuga

SEQ ID NO: 176813 - RNA, 19 nt, Homo sapiens
caccacaucgacuacuaua

SEQ ID NO: 176814 - RNA, 19 nt, Homo sapiens
cagaggacaaugugaugaa

SEQ ID NO: 176815 - RNA, 19 nt, Homo sapiens
gacagaggacaaugugaug

SEQ ID NO: 176816 - RNA, 19 nt, Homo sapiens
gaguuaauaccaccgacaa

SEQ ID NO: 176817 - RNA, 19 nt, Homo sapiens
gcacauccaguggcuaaag

SEQ ID NO: 176818 - RNA, 19 nt, Homo sapiens
guacucggcuuagugauua

SEQ ID NO: 176819 - RNA, 19 nt, Homo sapiens
agaaacagauaacaccaaa

SEQ ID NO: 176820 - RNA, 19 nt, Homo sapiens
cagaaaagauggaaaagaa

SEQ ID NO: 176821 - RNA, 19 nt, Homo sapiens
ggacuugguacucggcuua

SEQ ID NO: 176822 - RNA, 19 nt, Homo sapiens
gaggagaaagaaacagaua

SEQ ID NO: 176823 - RNA, 19 nt, Homo sapiens
gagccggucugcaaggaaa

SEQ ID NO: 176824 - RNA, 19 nt, Homo sapiens
gagcgagggucaguuugaa

SEQ ID NO: 176825 - RNA, 19 nt, Homo sapiens
ggaggaugaugaugaugau

SEQ ID NO: 176826 - RNA, 19 nt, Homo sapiens
gcagugacaccaccuacuu

SEQ ID NO: 176827 - RNA, 19 nt, Homo sapiens
gaugaugacuccucuucag

SEQ ID NO: 176828 - RNA, 19 nt, Homo sapiens
auucaaaccugaccacaga

SEQ ID NO: 176829 - RNA, 19 nt, Homo sapiens
ggaugaugaugaugaugau

SEQ ID NO: 176830 - RNA, 19 nt, Homo sapiens
cagauaacaccaaaccaaa

SEQ ID NO: 176831 - RNA, 19 nt, Homo sapiens
gaguauccauggagaugug

SEQ ID NO: 176832 - RNA, 19 nt, Homo sapiens
gaggcuacaagguccguua

SEQ ID NO: 176833 - RNA, 19 nt, Homo sapiens
acacugcgcugguugaaaa

SEQ ID NO: 176834 - RNA, 19 nt, Homo sapiens
ggagaaagaaacagauaac

SEQ ID NO: 176835 - RNA, 19 nt, Homo sapiens
aaaccugaccacagaauug

SEQ ID NO: 176836 - RNA, 19 nt, Homo sapiens
gguacucggcuuagugauu

SEQ ID NO: 176837 - RNA, 19 nt, Homo sapiens
cuacuucuccgucaauguu

SEQ ID NO: 176838 - RNA, 19 nt, Homo sapiens
acagauaacaccaaaccaa

SEQ ID NO: 176839 - RNA, 19 nt, Homo sapiens
gcuacaagguccguuaugc

SEQ ID NO: 176840 - RNA, 19 nt, Homo sapiens
cgagcucacuguggaguau

SEQ ID NO: 176841 - RNA, 19 nt, Homo sapiens
gagaaagaaacagauaaca

SEQ ID NO: 176842 - RNA, 19 nt, Homo sapiens
cgauggagccggucugcaa

SEQ ID NO: 176843 - RNA, 19 nt, Homo sapiens
gcaucauaauggacucugu

SEQ ID NO: 176844 - RNA, 19 nt, Homo sapiens
caaaccugaccacagaauu

SEQ ID NO: 176845 - RNA, 19 nt, Homo sapiens
cgagcgagggucaguuuga

SEQ ID NO: 176846 - RNA, 19 nt, Homo sapiens
cagaggagaaagaaacaga

SEQ ID NO: 176847 - RNA, 19 nt, Homo sapiens
ccaccuacuucuccgucaa

SEQ ID NO: 176848 - RNA, 19 nt, Homo sapiens
gggacgaugugcagagcau

SEQ ID NO: 176849 - RNA, 19 nt, Homo sapiens
gccgagcgagggucaguuu

SEQ ID NO: 176850 - RNA, 19 nt, Homo sapiens
caaccgcacccgcaucaca

SEQ ID NO: 176851 - RNA, 19 nt, Homo sapiens
cggaggaugaugaugauga

SEQ ID NO: 176852 - RNA, 19 nt, Homo sapiens
ggacauccccagaaaagau

SEQ ID NO: 176853 - RNA, 19 nt, Homo sapiens
cugaacagguggugguauc

SEQ ID NO: 176854 - RNA, 19 nt, Homo sapiens
gagauguggagccuuguca

SEQ ID NO: 176855 - RNA, 19 nt, Homo sapiens
uguggagccuugucaccaa

SEQ ID NO: 176856 - RNA, 19 nt, Homo sapiens
acucuguggugcccucuga

SEQ ID NO: 176857 - RNA, 19 nt, Homo sapiens
ccuggagcaucauaaugga

SEQ ID NO: 176858 - RNA, 19 nt, Homo sapiens
gaauuggaggcuacaaggu

SEQ ID NO: 176859 - RNA, 19 nt, Homo sapiens
ccgcggaacccaaggacuu

SEQ ID NO: 176860 - RNA, 19 nt, Homo sapiens
ccaccuggagcaucauaau

SEQ ID NO: 176861 - RNA, 19 nt, Homo sapiens
caucacucccuugccauuu

SEQ ID NO: 176862 - RNA, 19 nt, Homo sapiens
uguuucagcuugcccagau

SEQ ID NO: 176863 - RNA, 19 nt, Homo sapiens
aaacagauaacaccaaacc

SEQ ID NO: 176864 - RNA, 19 nt, Homo sapiens
aggaugaugaugaugauga

SEQ ID NO: 176865 - RNA, 19 nt, Homo sapiens
aggagaaagaaacagauaa

SEQ ID NO: 176866 - RNA, 19 nt, Homo sapiens
ggagaggaacccagaugcu

SEQ ID NO: 176867 - RNA, 19 nt, Homo sapiens
uaagaaaugucuccuuuga

SEQ ID NO: 176868 - RNA, 19 nt, Homo sapiens
gaagacugcuggaguuaau

SEQ ID NO: 176869 - RNA, 19 nt, Homo sapiens
caaaguggcugugaagaug

SEQ ID NO: 176870 - RNA, 19 nt, Homo sapiens
ucaagcagcugguggaaga

SEQ ID NO: 176871 - RNA, 19 nt, Homo sapiens
ccacaucgacuacuauaaa

SEQ ID NO: 176872 - RNA, 19 nt, Homo sapiens
gugcuucacuuaagaaaug

SEQ ID NO: 176873 - RNA, 19 nt, Homo sapiens
gauggucccuuguauguca

SEQ ID NO: 176874 - RNA, 19 nt, Homo sapiens
ccucagggcuacagcagua

SEQ ID NO: 176875 - RNA, 19 nt, Homo sapiens
cuuaagaaaugucuccuuu

SEQ ID NO: 176876 - RNA, 19 nt, Homo sapiens
ggaggugcuucacuuaaga

SEQ ID NO: 176877 - RNA, 19 nt, Homo sapiens
gcaggauggucccuuguau

SEQ ID NO: 176878 - RNA, 19 nt, Homo sapiens
agaaacagauaacaccaaa

SEQ ID NO: 176879 - RNA, 19 nt, Homo sapiens
cagaaaagauggaaaagaa

SEQ ID NO: 176880 - RNA, 19 nt, Homo sapiens
ggcaucaguugcuauauau

SEQ ID NO: 176881 - RNA, 19 nt, Homo sapiens
gaaauggagaugaugaaga

SEQ ID NO: 176882 - RNA, 19 nt, Homo sapiens
aaauggagaugaugaagau

SEQ ID NO: 176883 - RNA, 19 nt, Homo sapiens
gagccggucugcaaggaaa

SEQ ID NO: 176884 - RNA, 19 nt, Homo sapiens
gcccguagcuccauauugg

SEQ ID NO: 176885 - RNA, 19 nt, Homo sapiens
gaggagaaagaaacagaua

SEQ ID NO: 176886 - RNA, 19 nt, Homo sapiens
ggaggcaucaguugcuaua

SEQ ID NO: 176887 - RNA, 19 nt, Homo sapiens
gaagagugguaccaagaag

SEQ ID NO: 176888 - RNA, 19 nt, Homo sapiens
aggcaucaguugcuauaua

SEQ ID NO: 176889 - RNA, 19 nt, Homo sapiens
uaaagcacaucgaggugaa

SEQ ID NO: 176890 - RNA, 19 nt, Homo sapiens
gagcgagggucaguuugaa

SEQ ID NO: 176891 - RNA, 19 nt, Homo sapiens
ggaggaugaugaugaugau

SEQ ID NO: 176892 - RNA, 19 nt, Homo sapiens
gauggaggugcuucacuua

SEQ ID NO: 176893 - RNA, 19 nt, Homo sapiens
gcagugacaccaccuacuu

SEQ ID NO: 176894 - RNA, 19 nt, Homo sapiens
ggucguuaccagagauuua

SEQ ID NO: 176895 - RNA, 19 nt, Homo sapiens
gauggcacccgaggcauua

SEQ ID NO: 176896 - RNA, 19 nt, Homo sapiens
caacuacaccugcauugug

SEQ ID NO: 176897 - RNA, 19 nt, Homo sapiens
gaugaugacuccucuucag

SEQ ID NO: 176898 - RNA, 19 nt, Homo sapiens
agagugauguguggucuuu

SEQ ID NO: 176899 - RNA, 19 nt, Homo sapiens
auucaaaccugaccacaga

SEQ ID NO: 176900 - RNA, 19 nt, Homo sapiens
ccagauggcugugcacaag

SEQ ID NO: 176901 - RNA, 19 nt, Homo sapiens
gcccagacaaccugccuua

SEQ ID NO: 176902 - RNA, 19 nt, Homo sapiens
ggaugaugaugaugaugau

SEQ ID NO: 176903 - RNA, 19 nt, Homo sapiens
cagcccagcuugccaaugg

SEQ ID NO: 176904 - RNA, 19 nt, Homo sapiens
gaguauccauggagaugug

SEQ ID NO: 176905 - RNA, 19 nt, Homo sapiens
ccagacaaccugccuuaug

SEQ ID NO: 176906 - RNA, 19 nt, Homo sapiens
cagauaacaccaaaccaaa

SEQ ID NO: 176907 - RNA, 19 nt, Homo sapiens
ccaaugaacaggcaugcaa

SEQ ID NO: 176908 - RNA, 19 nt, Homo sapiens
gaugaagauagcagacuuu

SEQ ID NO: 176909 - RNA, 19 nt, Homo sapiens
gcauaagaauaucaucaac

SEQ ID NO: 176910 - RNA, 19 nt, Homo sapiens
ugaccaaaguggcugugaa

SEQ ID NO: 176911 - RNA, 19 nt, Homo sapiens
caacguggaguucaugugu

SEQ ID NO: 176912 - RNA, 19 nt, Homo sapiens
caacagagaaagacuuguc

SEQ ID NO: 176913 - RNA, 19 nt, Homo sapiens
gauacuaguuugcuuugcu

SEQ ID NO: 176914 - RNA, 19 nt, Homo sapiens
aagaugaucgggaagcaua

SEQ ID NO: 176915 - RNA, 19 nt, Homo sapiens
gaucuacacccaccagagu

SEQ ID NO: 176916 - RNA, 19 nt, Homo sapiens
uaucuggccuccaagaagu

SEQ ID NO: 176917 - RNA, 19 nt, Homo sapiens
ucgggaagcauaagaauau

SEQ ID NO: 176918 - RNA, 19 nt, Homo sapiens
gaggcuacaagguccguua

SEQ ID NO: 176919 - RNA, 19 nt, Homo sapiens
acacugcgcugguugaaaa

SEQ ID NO: 176920 - RNA, 19 nt, Homo sapiens
ggagaaagaaacagauaac

SEQ ID NO: 176921 - RNA, 19 nt, Homo sapiens
ugaacaggcaugcaaguga

SEQ ID NO: 176922 - RNA, 19 nt, Homo sapiens
ugaugaagauagcagacuu

SEQ ID NO: 176923 - RNA, 19 nt, Homo sapiens
ggacaaugugaugaagaua

SEQ ID NO: 176924 - RNA, 19 nt, Homo sapiens
aaaccugaccacagaauug

SEQ ID NO: 176925 - RNA, 19 nt, Homo sapiens
cuacuucuccgucaauguu

SEQ ID NO: 176926 - RNA, 19 nt, Homo sapiens
ccaaaguggcugugaagau

SEQ ID NO: 176927 - RNA, 19 nt, Homo sapiens
ggucggucaucgucuacaa

SEQ ID NO: 176928 - RNA, 19 nt, Homo sapiens
cuugaagacugcuggaguu

SEQ ID NO: 176929 - RNA, 19 nt, Homo sapiens
gugaaugggagcaagauug

SEQ ID NO: 176930 - RNA, 19 nt, Homo sapiens
uaauuccgauacuaguuug

SEQ ID NO: 176931 - RNA, 19 nt, Homo sapiens
gacaaacccaaccguguga

SEQ ID NO: 176932 - RNA, 19 nt, Homo sapiens
agauggaggugcuucacuu

SEQ ID NO: 176933 - RNA, 19 nt, Homo sapiens
ggauggcacccgaggcauu

SEQ ID NO: 176934 - RNA, 19 nt, Homo sapiens
ucagaaauggagaugauga

SEQ ID NO: 176935 - RNA, 19 nt, Homo sapiens
acagauaacaccaaaccaa

SEQ ID NO: 176936 - RNA, 19 nt, Homo sapiens
gcuacaagguccguuaugc

SEQ ID NO: 176937 - RNA, 19 nt, Homo sapiens
cgagcucacuguggaguau

SEQ ID NO: 176938 - RNA, 19 nt, Homo sapiens
gauuccgucuucucucaug

SEQ ID NO: 176939 - RNA, 19 nt, Homo sapiens
gacaaugugaugaagauag

SEQ ID NO: 176940 - RNA, 19 nt, Homo sapiens
ugacagaggacaaugugau

SEQ ID NO: 176941 - RNA, 19 nt, Homo sapiens
ggaagcauaagaauaucau

SEQ ID NO: 176942 - RNA, 19 nt, Homo sapiens
uagcaggggucucugagua

SEQ ID NO: 176943 - RNA, 19 nt, Homo sapiens
cgauggagccggucugcaa

SEQ ID NO: 176944 - RNA, 19 nt, Homo sapiens
acguggaguucauguguaa

SEQ ID NO: 176945 - RNA, 19 nt, Homo sapiens
guagcaacguggaguucau

SEQ ID NO: 176946 - RNA, 19 nt, Homo sapiens
acaccugcauuguggagaa

SEQ ID NO: 176947 - RNA, 19 nt, Homo sapiens
gcaacuacaccugcauugu

SEQ ID NO: 176948 - RNA, 19 nt, Homo sapiens
gagaaagaaacagauaaca

SEQ ID NO: 176949 - RNA, 19 nt, Homo sapiens
uguaugucaucguggagua

SEQ ID NO: 176950 - RNA, 19 nt, Homo sapiens
gaucgggaagcauaagaau

SEQ ID NO: 176951 - RNA, 19 nt, Homo sapiens
aaagggucguuaccagaga

SEQ ID NO: 176952 - RNA, 19 nt, Homo sapiens
cagagaaagacuugucaga

SEQ ID NO: 176953 - RNA, 19 nt, Homo sapiens
cuaucgggcuggacaagga

SEQ ID NO: 176954 - RNA, 19 nt, Homo sapiens
ugaagagugguaccaagaa

SEQ ID NO: 176955 - RNA, 19 nt, Homo sapiens
uuaauaccaccgacaaaga

SEQ ID NO: 176956 - RNA, 19 nt, Homo sapiens
ccaccuacuucuccgucaa

SEQ ID NO: 176957 - RNA, 19 nt, Homo sapiens
caccacaucgacuacuaua

SEQ ID NO: 176958 - RNA, 19 nt, Homo sapiens
cagaggacaaugugaugaa

SEQ ID NO: 176959 - RNA, 19 nt, Homo sapiens
gacagaggacaaugugaug

SEQ ID NO: 176960 - RNA, 19 nt, Homo sapiens
cgagcgagggucaguuuga

SEQ ID NO: 176961 - RNA, 19 nt, Homo sapiens
gaguuaauaccaccgacaa

SEQ ID NO: 176962 - RNA, 19 nt, Homo sapiens
gcacauccaguggcuaaag

SEQ ID NO: 176963 - RNA, 19 nt, Homo sapiens
gcaucauaauggacucugu

SEQ ID NO: 176964 - RNA, 19 nt, Homo sapiens
caaaccugaccacagaauu

SEQ ID NO: 176965 - RNA, 19 nt, Homo sapiens
cagaggagaaagaaacaga

SEQ ID NO: 176966 - RNA, 19 nt, Homo sapiens
gggacgaugugcagagcau

SEQ ID NO: 176967 - RNA, 19 nt, Homo sapiens
gcauuuagcuggccacaug

SEQ ID NO: 176968 - RNA, 19 nt, Homo sapiens
aaagacaccugguugcuaa

SEQ ID NO: 176969 - RNA, 19 nt, Homo sapiens
aaacuggaccuguauauuu

SEQ ID NO: 176970 - RNA, 19 nt, Homo sapiens
gaugggagccuuuaccuuu

SEQ ID NO: 176971 - RNA, 19 nt, Homo sapiens
uaacacuucuuacgcaaug

SEQ ID NO: 176972 - RNA, 19 nt, Homo sapiens
ggaccuguauauuuguaaa

SEQ ID NO: 176973 - RNA, 19 nt, Homo sapiens
ggacgaggcugaggacaca

SEQ ID NO: 176974 - RNA, 19 nt, Homo sapiens
gaaauuacggguaccugaa

SEQ ID NO: 176975 - RNA, 19 nt, Homo sapiens
gcaccgcaguuuuguuuua

SEQ ID NO: 176976 - RNA, 19 nt, Homo sapiens
caagauguauuuguuguag

SEQ ID NO: 176977 - RNA, 19 nt, Homo sapiens
ggagggaagccgugaauuc

SEQ ID NO: 176978 - RNA, 19 nt, Homo sapiens
ugucggaccuggugucuga

SEQ ID NO: 176979 - RNA, 19 nt, Homo sapiens
ggagagacagcuacacaga

SEQ ID NO: 176980 - RNA, 19 nt, Homo sapiens
gcaucaagcugcggcauca

SEQ ID NO: 176981 - RNA, 19 nt, Homo sapiens
gguucguucuguacuguua

SEQ ID NO: 176982 - RNA, 19 nt, Homo sapiens
guuguagacuuaacacuuc

SEQ ID NO: 176983 - RNA, 19 nt, Homo sapiens
guuaauaguuggaggugau

SEQ ID NO: 176984 - RNA, 19 nt, Homo sapiens
ucaguugguucguucugua

SEQ ID NO: 176985 - RNA, 19 nt, Homo sapiens
gggaagccgugaauucagu

SEQ ID NO: 176986 - RNA, 19 nt, Homo sapiens
guuccgauguuauuagaug

SEQ ID NO: 176987 - RNA, 19 nt, Homo sapiens
ccuaaaagguuguuaauag

SEQ ID NO: 176988 - RNA, 19 nt, Homo sapiens
ugaaagacgaugccacuga

SEQ ID NO: 176989 - RNA, 19 nt, Homo sapiens
ugaugaagaucgcagacuu

SEQ ID NO: 176990 - RNA, 19 nt, Homo sapiens
gaggacaacgugaugaaga

SEQ ID NO: 176991 - RNA, 19 nt, Homo sapiens
agauggagaugaugaagau

SEQ ID NO: 176992 - RNA, 19 nt, Homo sapiens
ccgugaagaugcugaaaga

SEQ ID NO: 176993 - RNA, 19 nt, Homo sapiens
gggcagcugucccuugcuu

SEQ ID NO: 176994 - RNA, 19 nt, Homo sapiens
gagggaagccgugaauuca

SEQ ID NO: 176995 - RNA, 19 nt, Homo sapiens
ccgauguuauuagauguua

SEQ ID NO: 176996 - RNA, 19 nt, Homo sapiens
guacuuggccucccagaag

SEQ ID NO: 176997 - RNA, 19 nt, Homo sapiens
ggacggcacacccuacguu

SEQ ID NO: 176998 - RNA, 19 nt, Homo sapiens
acgcaaugcuucuagaguu

SEQ ID NO: 176999 - RNA, 19 nt, Homo sapiens
gcagguuccgauguuauua

SEQ ID NO: 177000 - RNA, 19 nt, Homo sapiens
gcagauggagagacagcua

SEQ ID NO: 177001 - RNA, 19 nt, Homo sapiens
acaaggagcuagagguucu

SEQ ID NO: 177002 - RNA, 19 nt, Homo sapiens
guagacuuaacacuucuua

SEQ ID NO: 177003 - RNA, 19 nt, Homo sapiens
gaugaucgggaaacacaaa

SEQ ID NO: 177004 - RNA, 19 nt, Homo sapiens
cgacaaggagcuagagguu

SEQ ID NO: 177005 - RNA, 19 nt, Homo sapiens
uaaagacaccugguugcua

SEQ ID NO: 177006 - RNA, 19 nt, Homo sapiens
ucaggguggucucuucuug

SEQ ID NO: 177007 - RNA, 19 nt, Homo sapiens
gagacucagugcagaugga

SEQ ID NO: 177008 - RNA, 19 nt, Homo sapiens
ugcacaaccucgacuacua

SEQ ID NO: 177009 - RNA, 19 nt, Homo sapiens
ugucugagauggagaugau

SEQ ID NO: 177010 - RNA, 19 nt, Homo sapiens
ugaauucaguugguucguu

SEQ ID NO: 177011 - RNA, 19 nt, Homo sapiens
gcaagcugguauuuucaua

SEQ ID NO: 177012 - RNA, 19 nt, Homo sapiens
ucaaagcaagcugguauuu

SEQ ID NO: 177013 - RNA, 19 nt, Homo sapiens
ggaggugauuccagugaag

SEQ ID NO: 177014 - RNA, 19 nt, Homo sapiens
acacacgaccuguacauga

SEQ ID NO: 177015 - RNA, 19 nt, Homo sapiens
gagggacggccaagaaugu

SEQ ID NO: 177016 - RNA, 19 nt, Homo sapiens
cccaacacuuccagcauuu

SEQ ID NO: 177017 - RNA, 19 nt, Homo sapiens
ucaagcacguggaggugaa

SEQ ID NO: 177018 - RNA, 19 nt, Homo sapiens
aaagcaagcugguauuuuc

SEQ ID NO: 177019 - RNA, 19 nt, Homo sapiens
aacuggaccuguauauuug

SEQ ID NO: 177020 - RNA, 19 nt, Homo sapiens
cggaaacuaguguacauuu

SEQ ID NO: 177021 - RNA, 19 nt, Homo sapiens
gcacaaccucgacuacuac

SEQ ID NO: 177022 - RNA, 19 nt, Homo sapiens
ccgagcggauggacaagaa

SEQ ID NO: 177023 - RNA, 19 nt, Homo sapiens
gcacacacgaccuguacau

SEQ ID NO: 177024 - RNA, 19 nt, Homo sapiens
uguacgugcugguggagua

SEQ ID NO: 177025 - RNA, 19 nt, Homo sapiens
gagauggagaugaugaaga

SEQ ID NO: 177026 - RNA, 19 nt, Homo sapiens
gaugcuguguauaugguau

SEQ ID NO: 177027 - RNA, 19 nt, Homo sapiens
cacacgaccuguacaugau

SEQ ID NO: 177028 - RNA, 19 nt, Homo sapiens
gacggcacacccuacguua

SEQ ID NO: 177029 - RNA, 19 nt, Homo sapiens
ugauuccagugaagauauu

SEQ ID NO: 177030 - RNA, 19 nt, Homo sapiens
aauagaugcuguguauaug

SEQ ID NO: 177031 - RNA, 19 nt, Homo sapiens
ccuccaggcuuucccacuu

SEQ ID NO: 177032 - RNA, 19 nt, Homo sapiens
gugcaacggucuccugacu

SEQ ID NO: 177033 - RNA, 19 nt, Homo sapiens
caaccucgacuacuacaag

SEQ ID NO: 177034 - RNA, 19 nt, Homo sapiens
ugaagaugaucgggaaaca

SEQ ID NO: 177035 - RNA, 19 nt, Homo sapiens
gcgcuaacaccaccgacaa

SEQ ID NO: 177036 - RNA, 19 nt, Homo sapiens
caacacuuccagcauuuag

SEQ ID NO: 177037 - RNA, 19 nt, Homo sapiens
caaaccggcaggugcgauu

SEQ ID NO: 177038 - RNA, 19 nt, Homo sapiens
agccuggacugcuaccuuu

SEQ ID NO: 177039 - RNA, 19 nt, Homo sapiens
ggugauuccagugaagaua

SEQ ID NO: 177040 - RNA, 19 nt, Homo sapiens
ccaacacuuccagcauuua

SEQ ID NO: 177041 - RNA, 19 nt, Homo sapiens
gggacccagugcagaaugu

SEQ ID NO: 177042 - RNA, 19 nt, Homo sapiens
uaacccagcgacgaacuuu

SEQ ID NO: 177043 - RNA, 19 nt, Homo sapiens
gugugcagguuccgauguu

SEQ ID NO: 177044 - RNA, 19 nt, Homo sapiens
uagaugcuguguauauggu

SEQ ID NO: 177045 - RNA, 19 nt, Homo sapiens
acaccugcgucguggagaa

SEQ ID NO: 177046 - RNA, 19 nt, Homo sapiens
ggaccuggugucugagaug

SEQ ID NO: 177047 - RNA, 19 nt, Homo sapiens
cuucaaagcaagcugguau

SEQ ID NO: 177048 - RNA, 19 nt, Homo sapiens
ggacccagugcagaaugua

SEQ ID NO: 177049 - RNA, 19 nt, Homo sapiens
gcagcauccggcagacgua

SEQ ID NO: 177050 - RNA, 19 nt, Homo sapiens
caccguagccgugaagaug

SEQ ID NO: 177051 - RNA, 19 nt, Homo sapiens
auagagggacggccaagaa

SEQ ID NO: 177052 - RNA, 19 nt, Homo sapiens
gacccagugcagaauguaa

SEQ ID NO: 177053 - RNA, 19 nt, Homo sapiens
cagugcagauggagagaca

SEQ ID NO: 177054 - RNA, 19 nt, Homo sapiens
gaagaugcugaaagacgau

SEQ ID NO: 177055 - RNA, 19 nt, Homo sapiens
ccaucggcauugacaagga

SEQ ID NO: 177056 - RNA, 19 nt, Homo sapiens
gaccgaggacaacgugaug

SEQ ID NO: 177057 - RNA, 19 nt, Homo sapiens
ggaagccgugaauucaguu

SEQ ID NO: 177058 - RNA, 19 nt, Homo sapiens
ggagccuggucauggaaag

SEQ ID NO: 177059 - RNA, 19 nt, Homo sapiens
gugauuccagugaagauau

SEQ ID NO: 177060 - RNA, 19 nt, Homo sapiens
gaagaugggagccuuuacc

SEQ ID NO: 177061 - RNA, 19 nt, Homo sapiens
aggacaacgugaugaagau

SEQ ID NO: 177062 - RNA, 19 nt, Homo sapiens
ugugcagguuccgauguua

SEQ ID NO: 177063 - RNA, 19 nt, Homo sapiens
gauagagggacggccaaga

SEQ ID NO: 177064 - RNA, 19 nt, Homo sapiens
ggcggagaguuuuaauuuu

SEQ ID NO: 177065 - RNA, 19 nt, Homo sapiens
cuggaccuguauauuugua

SEQ ID NO: 177066 - RNA, 19 nt, Homo sapiens
agugacgucugguccuuug

SEQ ID NO: 177067 - RNA, 19 nt, Homo sapiens
gcauuuagcuggccacaug

SEQ ID NO: 177068 - RNA, 19 nt, Homo sapiens
aaagacaccugguugcuaa

SEQ ID NO: 177069 - RNA, 19 nt, Homo sapiens
aaacuggaccuguauauuu

SEQ ID NO: 177070 - RNA, 19 nt, Homo sapiens
gaugggagccuuuaccuuu

SEQ ID NO: 177071 - RNA, 19 nt, Homo sapiens
uaacacuucuuacgcaaug

SEQ ID NO: 177072 - RNA, 19 nt, Homo sapiens
ggaccuguauauuuguaaa

SEQ ID NO: 177073 - RNA, 19 nt, Homo sapiens
ggacgaggcugaggacaca

SEQ ID NO: 177074 - RNA, 19 nt, Homo sapiens
gaaauuacggguaccugaa

SEQ ID NO: 177075 - RNA, 19 nt, Homo sapiens
gcaccgcaguuuuguuuua

SEQ ID NO: 177076 - RNA, 19 nt, Homo sapiens
caagauguauuuguuguag

SEQ ID NO: 177077 - RNA, 19 nt, Homo sapiens
ggagggaagccgugaauuc

SEQ ID NO: 177078 - RNA, 19 nt, Homo sapiens
ugucggaccuggugucuga

SEQ ID NO: 177079 - RNA, 19 nt, Homo sapiens
ggagagacagcuacacaga

SEQ ID NO: 177080 - RNA, 19 nt, Homo sapiens
gcaucaagcugcggcauca

SEQ ID NO: 177081 - RNA, 19 nt, Homo sapiens
gguucguucuguacuguua

SEQ ID NO: 177082 - RNA, 19 nt, Homo sapiens
guuguagacuuaacacuuc

SEQ ID NO: 177083 - RNA, 19 nt, Homo sapiens
guuaauaguuggaggugau

SEQ ID NO: 177084 - RNA, 19 nt, Homo sapiens
ucaguugguucguucugua

SEQ ID NO: 177085 - RNA, 19 nt, Homo sapiens
gggaagccgugaauucagu

SEQ ID NO: 177086 - RNA, 19 nt, Homo sapiens
guuccgauguuauuagaug

SEQ ID NO: 177087 - RNA, 19 nt, Homo sapiens
ccuaaaagguuguuaauag

SEQ ID NO: 177088 - RNA, 19 nt, Homo sapiens
ugaaagacgaugccacuga

SEQ ID NO: 177089 - RNA, 19 nt, Homo sapiens
ugaugaagaucgcagacuu

SEQ ID NO: 177090 - RNA, 19 nt, Homo sapiens
gaggacaacgugaugaaga

SEQ ID NO: 177091 - RNA, 19 nt, Homo sapiens
agauggagaugaugaagau

SEQ ID NO: 177092 - RNA, 19 nt, Homo sapiens
ccgugaagaugcugaaaga

SEQ ID NO: 177093 - RNA, 19 nt, Homo sapiens
gggcagcugucccuugcuu

SEQ ID NO: 177094 - RNA, 19 nt, Homo sapiens
gagggaagccgugaauuca

SEQ ID NO: 177095 - RNA, 19 nt, Homo sapiens
ccgauguuauuagauguua

SEQ ID NO: 177096 - RNA, 19 nt, Homo sapiens
guacuuggccucccagaag

SEQ ID NO: 177097 - RNA, 19 nt, Homo sapiens
ggacggcacacccuacguu

SEQ ID NO: 177098 - RNA, 19 nt, Homo sapiens
acgcaaugcuucuagaguu

SEQ ID NO: 177099 - RNA, 19 nt, Homo sapiens
gcagguuccgauguuauua

SEQ ID NO: 177100 - RNA, 19 nt, Homo sapiens
gcagauggagagacagcua

SEQ ID NO: 177101 - RNA, 19 nt, Homo sapiens
guagacuuaacacuucuua

SEQ ID NO: 177102 - RNA, 19 nt, Homo sapiens
gaugaucgggaaacacaaa

SEQ ID NO: 177103 - RNA, 19 nt, Homo sapiens
uaaagacaccugguugcua

SEQ ID NO: 177104 - RNA, 19 nt, Homo sapiens
ucaggguggucucuucuug

SEQ ID NO: 177105 - RNA, 19 nt, Homo sapiens
gagacucagugcagaugga

SEQ ID NO: 177106 - RNA, 19 nt, Homo sapiens
ugcacaaccucgacuacua

SEQ ID NO: 177107 - RNA, 19 nt, Homo sapiens
ugucugagauggagaugau

SEQ ID NO: 177108 - RNA, 19 nt, Homo sapiens
ugaauucaguugguucguu

SEQ ID NO: 177109 - RNA, 19 nt, Homo sapiens
gcaagcugguauuuucaua

SEQ ID NO: 177110 - RNA, 19 nt, Homo sapiens
ucaaagcaagcugguauuu

SEQ ID NO: 177111 - RNA, 19 nt, Homo sapiens
ggaggugauuccagugaag

SEQ ID NO: 177112 - RNA, 19 nt, Homo sapiens
acacacgaccuguacauga

SEQ ID NO: 177113 - RNA, 19 nt, Homo sapiens
gagggacggccaagaaugu

SEQ ID NO: 177114 - RNA, 19 nt, Homo sapiens
cccaacacuuccagcauuu

SEQ ID NO: 177115 - RNA, 19 nt, Homo sapiens
ucaagcacguggaggugaa

SEQ ID NO: 177116 - RNA, 19 nt, Homo sapiens
aaagcaagcugguauuuuc

SEQ ID NO: 177117 - RNA, 19 nt, Homo sapiens
aacuggaccuguauauuug

SEQ ID NO: 177118 - RNA, 19 nt, Homo sapiens
cggaaacuaguguacauuu

SEQ ID NO: 177119 - RNA, 19 nt, Homo sapiens
gcacaaccucgacuacuac

SEQ ID NO: 177120 - RNA, 19 nt, Homo sapiens
ccgagcggauggacaagaa

SEQ ID NO: 177121 - RNA, 19 nt, Homo sapiens
gcacacacgaccuguacau

SEQ ID NO: 177122 - RNA, 19 nt, Homo sapiens
uguacgugcugguggagua

SEQ ID NO: 177123 - RNA, 19 nt, Homo sapiens
gagauggagaugaugaaga

SEQ ID NO: 177124 - RNA, 19 nt, Homo sapiens
gaugcuguguauaugguau

SEQ ID NO: 177125 - RNA, 19 nt, Homo sapiens
cacacgaccuguacaugau

SEQ ID NO: 177126 - RNA, 19 nt, Homo sapiens
gacggcacacccuacguua

SEQ ID NO: 177127 - RNA, 19 nt, Homo sapiens
ugauuccagugaagauauu

SEQ ID NO: 177128 - RNA, 19 nt, Homo sapiens
aauagaugcuguguauaug

SEQ ID NO: 177129 - RNA, 19 nt, Homo sapiens
ccuccaggcuuucccacuu

SEQ ID NO: 177130 - RNA, 19 nt, Homo sapiens
gugcaacggucuccugacu

SEQ ID NO: 177131 - RNA, 19 nt, Homo sapiens
caaccucgacuacuacaag

SEQ ID NO: 177132 - RNA, 19 nt, Homo sapiens
ugaagaugaucgggaaaca

SEQ ID NO: 177133 - RNA, 19 nt, Homo sapiens
caacacuuccagcauuuag

SEQ ID NO: 177134 - RNA, 19 nt, Homo sapiens
caaaccggcaggugcgauu

SEQ ID NO: 177135 - RNA, 19 nt, Homo sapiens
agccuggacugcuaccuuu

SEQ ID NO: 177136 - RNA, 19 nt, Homo sapiens
ggugauuccagugaagaua

SEQ ID NO: 177137 - RNA, 19 nt, Homo sapiens
ccaacacuuccagcauuua

SEQ ID NO: 177138 - RNA, 19 nt, Homo sapiens
gggacccagugcagaaugu

SEQ ID NO: 177139 - RNA, 19 nt, Homo sapiens
uaacccagcgacgaacuuu

SEQ ID NO: 177140 - RNA, 19 nt, Homo sapiens
gugugcagguuccgauguu

SEQ ID NO: 177141 - RNA, 19 nt, Homo sapiens
acaccugcgucguggagaa

SEQ ID NO: 177142 - RNA, 19 nt, Homo sapiens
uagaugcuguguauauggu

SEQ ID NO: 177143 - RNA, 19 nt, Homo sapiens
ggaccuggugucugagaug

SEQ ID NO: 177144 - RNA, 19 nt, Homo sapiens
cuucaaagcaagcugguau

SEQ ID NO: 177145 - RNA, 19 nt, Homo sapiens
ggacccagugcagaaugua

SEQ ID NO: 177146 - RNA, 19 nt, Homo sapiens
gcagcauccggcagacgua

SEQ ID NO: 177147 - RNA, 19 nt, Homo sapiens
caccguagccgugaagaug

SEQ ID NO: 177148 - RNA, 19 nt, Homo sapiens
auagagggacggccaagaa

SEQ ID NO: 177149 - RNA, 19 nt, Homo sapiens
gacccagugcagaauguaa

SEQ ID NO: 177150 - RNA, 19 nt, Homo sapiens
cagugcagauggagagaca

SEQ ID NO: 177151 - RNA, 19 nt, Homo sapiens
gaagaugcugaaagacgau

SEQ ID NO: 177152 - RNA, 19 nt, Homo sapiens
ccaucggcauugacaagga

SEQ ID NO: 177153 - RNA, 19 nt, Homo sapiens
gaccgaggacaacgugaug

SEQ ID NO: 177154 - RNA, 19 nt, Homo sapiens
ggaagccgugaauucaguu

SEQ ID NO: 177155 - RNA, 19 nt, Homo sapiens
gugauuccagugaagauau

SEQ ID NO: 177156 - RNA, 19 nt, Homo sapiens
gaagaugggagccuuuacc

SEQ ID NO: 177157 - RNA, 19 nt, Homo sapiens
ggagccuggucauggaaag

SEQ ID NO: 177158 - RNA, 19 nt, Homo sapiens
aggacaacgugaugaagau

SEQ ID NO: 177159 - RNA, 19 nt, Homo sapiens
ugugcagguuccgauguua

SEQ ID NO: 177160 - RNA, 19 nt, Homo sapiens
gauagagggacggccaaga

SEQ ID NO: 177161 - RNA, 19 nt, Homo sapiens
ggcggagaguuuuaauuuu

SEQ ID NO: 177162 - RNA, 19 nt, Homo sapiens
cuggaccuguauauuugua

SEQ ID NO: 177163 - RNA, 19 nt, Homo sapiens
cgucguggagaacaaguuu

SEQ ID NO: 177164 - RNA, 19 nt, Homo sapiens
agugacgucugguccuuug

SEQ ID NO: 177165 - RNA, 19 nt, Homo sapiens
uggagaugaugaagaugau

SEQ ID NO: 177166 - RNA, 19 nt, Homo sapiens
gccgugaauucaguugguu

SEQ ID NO: 177167 - RNA, 19 nt, Homo sapiens
ggaaaugucugaaugucua

SEQ ID NO: 177168 - RNA, 19 nt, Homo sapiens
gcauaugccuggaauaaga

SEQ ID NO: 177169 - RNA, 19 nt, Homo sapiens
gaacuucagugauguaaag

SEQ ID NO: 177170 - RNA, 19 nt, Homo sapiens
gaggagagauaucagauug

SEQ ID NO: 177171 - RNA, 19 nt, Homo sapiens
gaauugauccugugauaaa

SEQ ID NO: 177172 - RNA, 19 nt, Homo sapiens
gaauggagaagauauagua

SEQ ID NO: 177173 - RNA, 19 nt, Homo sapiens
cuaggaauaucuccaauaa

SEQ ID NO: 177174 - RNA, 19 nt, Homo sapiens
ugacauaccuuacugaagu

SEQ ID NO: 177175 - RNA, 19 nt, Homo sapiens
gcagagcccuccugaagau

SEQ ID NO: 177176 - RNA, 19 nt, Homo sapiens
gaagaacucucggaugcaa

SEQ ID NO: 177177 - RNA, 19 nt, Homo sapiens
gcacaugcuugcucuagga

SEQ ID NO: 177178 - RNA, 19 nt, Homo sapiens
ggacugugaugaugaagau

SEQ ID NO: 177179 - RNA, 19 nt, Homo sapiens
ccaauaaagcuguuaacua

SEQ ID NO: 177180 - RNA, 19 nt, Homo sapiens
aagccaagcugaaauauuc

SEQ ID NO: 177181 - RNA, 19 nt, Homo sapiens
uaacuuagccacugaugaa

SEQ ID NO: 177182 - RNA, 19 nt, Homo sapiens
gcaaagagaagcauggaau

SEQ ID NO: 177183 - RNA, 19 nt, Homo sapiens
guaagaacacccacacaaa

SEQ ID NO: 177184 - RNA, 19 nt, Homo sapiens
aggaauaucuccaauaaag

SEQ ID NO: 177185 - RNA, 19 nt, Homo sapiens
agaaggaaaugucugaaug

SEQ ID NO: 177186 - RNA, 19 nt, Homo sapiens
gaagcauguuguucaguug

SEQ ID NO: 177187 - RNA, 19 nt, Homo sapiens
gguuggaaauggaaucaaa

SEQ ID NO: 177188 - RNA, 19 nt, Homo sapiens
gaugugaguccauuuggua

SEQ ID NO: 177189 - RNA, 19 nt, Homo sapiens
gcauguuguucaguuguua

SEQ ID NO: 177190 - RNA, 19 nt, Homo sapiens
ggaagauggaggagagaua

SEQ ID NO: 177191 - RNA, 19 nt, Homo sapiens
gugaguccauuugguaaua

SEQ ID NO: 177192 - RNA, 19 nt, Homo sapiens
caugcuugcucuaggaaua

SEQ ID NO: 177193 - RNA, 19 nt, Homo sapiens
guaaagcaaauccaucaaa

SEQ ID NO: 177194 - RNA, 19 nt, Homo sapiens
ucuaugacauucacucuga

SEQ ID NO: 177195 - RNA, 19 nt, Homo sapiens
gaucagcuuugugcuaaug

SEQ ID NO: 177196 - RNA, 19 nt, Homo sapiens
gcauggaacauacgacauu

SEQ ID NO: 177197 - RNA, 19 nt, Homo sapiens
gaaggaaaugucugaaugu

SEQ ID NO: 177198 - RNA, 19 nt, Homo sapiens
gauguuacuucccgggauu

SEQ ID NO: 177199 - RNA, 19 nt, Homo sapiens
aaacauacaauggcaagua

SEQ ID NO: 177200 - RNA, 19 nt, Homo sapiens
gaagccaagcugaaauauu

SEQ ID NO: 177201 - RNA, 19 nt, Homo sapiens
uuacugaagucucgauuuc

SEQ ID NO: 177202 - RNA, 19 nt, Homo sapiens
gaagauggaggagagauau

SEQ ID NO: 177203 - RNA, 19 nt, Homo sapiens
aaaugcaucuuugguauug

SEQ ID NO: 177204 - RNA, 19 nt, Homo sapiens
cagaagccaagcugaaaua

SEQ ID NO: 177205 - RNA, 19 nt, Homo sapiens
gcucccaucucucucuuug

SEQ ID NO: 177206 - RNA, 19 nt, Homo sapiens
gaagucaagaggacacuga

SEQ ID NO: 177207 - RNA, 19 nt, Homo sapiens
gaagucaaagucaaaggaa

SEQ ID NO: 177208 - RNA, 19 nt, Homo sapiens
uggaaauccugaagucaaa

SEQ ID NO: 177209 - RNA, 19 nt, Homo sapiens
gaaugaagaccaccacaag

SEQ ID NO: 177210 - RNA, 19 nt, Homo sapiens
uguuaaugaugcuguguua

SEQ ID NO: 177211 - RNA, 19 nt, Homo sapiens
gccaggauaugcagcaguu

SEQ ID NO: 177212 - RNA, 19 nt, Homo sapiens
gacauucacucugauaagu

SEQ ID NO: 177213 - RNA, 19 nt, Homo sapiens
cgacugaaucuaugacauu

SEQ ID NO: 177214 - RNA, 19 nt, Homo sapiens
gcacauggcggagcuuaau

SEQ ID NO: 177215 - RNA, 19 nt, Homo sapiens
uaaagcaaauccaucaaac

SEQ ID NO: 177216 - RNA, 19 nt, Homo sapiens
ggaauugauccugugauaa

SEQ ID NO: 177217 - RNA, 19 nt, Homo sapiens
aacuuucacuugcuuguua

SEQ ID NO: 177218 - RNA, 19 nt, Homo sapiens
gcagaaaauuacaccagua

SEQ ID NO: 177219 - RNA, 19 nt, Homo sapiens
uuucuucucucucugcaua

SEQ ID NO: 177220 - RNA, 19 nt, Homo sapiens
guacaggucauucuaugga

SEQ ID NO: 177221 - RNA, 19 nt, Homo sapiens
guuacaggcucaccucaau

SEQ ID NO: 177222 - RNA, 19 nt, Homo sapiens
gaaacucucaucaaacaag

SEQ ID NO: 177223 - RNA, 19 nt, Homo sapiens
uugauaaacugaagcaugu

SEQ ID NO: 177224 - RNA, 19 nt, Homo sapiens
ggaaugaagaccaccacaa

SEQ ID NO: 177225 - RNA, 19 nt, Homo sapiens
gauaaguguggugauguua

SEQ ID NO: 177226 - RNA, 19 nt, Homo sapiens
ucagugauguaaagcaaau

SEQ ID NO: 177227 - RNA, 19 nt, Homo sapiens
cagcagagcccuccugaag

SEQ ID NO: 177228 - RNA, 19 nt, Homo sapiens
aagaaacccuugaaacucu

SEQ ID NO: 177229 - RNA, 19 nt, Homo sapiens
gaagagacgcuugccaaca

SEQ ID NO: 177230 - RNA, 19 nt, Homo sapiens
gacacgugcugcugaacuu

SEQ ID NO: 177231 - RNA, 19 nt, Homo sapiens
caggaguucuucacugaug

SEQ ID NO: 177232 - RNA, 19 nt, Homo sapiens
cugaagaaccuugauaauu

SEQ ID NO: 177233 - RNA, 19 nt, Homo sapiens
ucacugaagaaccuugaua

SEQ ID NO: 177234 - RNA, 19 nt, Homo sapiens
ugauaaguguggugauguu

SEQ ID NO: 177235 - RNA, 19 nt, Homo sapiens
gauaaacugaagcauguug

SEQ ID NO: 177236 - RNA, 19 nt, Homo sapiens
cugaucagcuuugugcuaa

SEQ ID NO: 177237 - RNA, 19 nt, Homo sapiens
ggaggagagauaucagauu

SEQ ID NO: 177238 - RNA, 19 nt, Homo sapiens
gaucuucagguuugcauau

SEQ ID NO: 177239 - RNA, 19 nt, Homo sapiens
uaucugcacuucuccaaag

SEQ ID NO: 177240 - RNA, 19 nt, Homo sapiens
uaacaccugauuuguauuc

SEQ ID NO: 177241 - RNA, 19 nt, Homo sapiens
cauacaauggcaaguagua

SEQ ID NO: 177242 - RNA, 19 nt, Homo sapiens
caguaugcaguauuucuua

SEQ ID NO: 177243 - RNA, 19 nt, Homo sapiens
cuucaaacguccagcucua

SEQ ID NO: 177244 - RNA, 19 nt, Homo sapiens
uaagaacacccacacaaag

SEQ ID NO: 177245 - RNA, 19 nt, Homo sapiens
caucaacaccacagacuau

SEQ ID NO: 177246 - RNA, 19 nt, Homo sapiens
gaauaucuccaauaaagcu

SEQ ID NO: 177247 - RNA, 19 nt, Homo sapiens
gauacugccucaaugucau

SEQ ID NO: 177248 - RNA, 19 nt, Homo sapiens
caaagagaagcauggaaug

SEQ ID NO: 177249 - RNA, 19 nt, Homo sapiens
guccagcucuacauuaaag

SEQ ID NO: 177250 - RNA, 19 nt, Homo sapiens
ggucuacaaccaccucauu

SEQ ID NO: 177251 - RNA, 19 nt, Homo sapiens
gucugaaugucuauaaguu

SEQ ID NO: 177252 - RNA, 19 nt, Homo sapiens
uuugguaacugaacucuuc

SEQ ID NO: 177253 - RNA, 19 nt, Homo sapiens
ggacacugaagaucacaga

SEQ ID NO: 177254 - RNA, 19 nt, Homo sapiens
gaacuuucacuugcuuguu

SEQ ID NO: 177255 - RNA, 19 nt, Homo sapiens
ggauacugccucaauguca

SEQ ID NO: 177256 - RNA, 19 nt, Homo sapiens
gaaccuuaaagcugaguau

SEQ ID NO: 177257 - RNA, 19 nt, Homo sapiens
gaugccagaugauaugaac

SEQ ID NO: 177258 - RNA, 19 nt, Homo sapiens
aaagagaagcauggaauga

SEQ ID NO: 177259 - RNA, 19 nt, Homo sapiens
ucacuugcuuguuaaugau

SEQ ID NO: 177260 - RNA, 19 nt, Homo sapiens
acacuggcaugcauauauc

SEQ ID NO: 177261 - RNA, 19 nt, Homo sapiens
gaguccauuugguaauauu

SEQ ID NO: 177262 - RNA, 19 nt, Homo sapiens
gaaaacaguaugcaguauu

SEQ ID NO: 177263 - RNA, 19 nt, Homo sapiens
gagaagcauggaaugaaga

SEQ ID NO: 177264 - RNA, 19 nt, Homo sapiens
acaggaacauggccuugga

SEQ ID NO: 177265 - RNA, 19 nt, Homo sapiens
uuugcaagcuguagaagga

SEQ ID NO: 177266 - RNA, 19 nt, Homo sapiens
agagaagcauggaaugaag

SEQ ID NO: 177267 - RNA, 19 nt, Homo sapiens
ggacagaccuuaguugaaa

SEQ ID NO: 177268 - RNA, 19 nt, Homo sapiens
gaccuuaguugaaaugaua

SEQ ID NO: 177269 - RNA, 19 nt, Homo sapiens
gagcacaaaugcaguauau

SEQ ID NO: 177270 - RNA, 19 nt, Homo sapiens
cagcauauguguaaagauu

SEQ ID NO: 177271 - RNA, 19 nt, Homo sapiens
ccaaaucucucaaccagaa

SEQ ID NO: 177272 - RNA, 19 nt, Homo sapiens
gaacaguauucaccuaguu

SEQ ID NO: 177273 - RNA, 19 nt, Homo sapiens
ggaccacucuucugcguuu

SEQ ID NO: 177274 - RNA, 19 nt, Homo sapiens
guaaucagcauauguguaa

SEQ ID NO: 177275 - RNA, 19 nt, Homo sapiens
ggccaacacugucaaguuu

SEQ ID NO: 177276 - RNA, 19 nt, Homo sapiens
ggaaacacccacucacuuu

SEQ ID NO: 177277 - RNA, 19 nt, Homo sapiens
ggacagcacugggaaccua

SEQ ID NO: 177278 - RNA, 19 nt, Homo sapiens
aaagaugccuuaauccauu

SEQ ID NO: 177279 - RNA, 19 nt, Homo sapiens
gcaagaugaaugcagauua

SEQ ID NO: 177280 - RNA, 19 nt, Homo sapiens
cagcacagcagacuaguua

SEQ ID NO: 177281 - RNA, 19 nt, Homo sapiens
guauauaggugcuggaugu

SEQ ID NO: 177282 - RNA, 19 nt, Homo sapiens
gcacaaaugcaguauauag

SEQ ID NO: 177283 - RNA, 19 nt, Homo sapiens
gaaggacacagaauggaua

SEQ ID NO: 177284 - RNA, 19 nt, Homo sapiens
uaacuggacuucccaagau

SEQ ID NO: 177285 - RNA, 19 nt, Homo sapiens
gcuaaaugcuguucuuaca

SEQ ID NO: 177286 - RNA, 19 nt, Homo sapiens
gugaagauguugaaagaug

SEQ ID NO: 177287 - RNA, 19 nt, Homo sapiens
ggauugcuuucaucuaauu

SEQ ID NO: 177288 - RNA, 19 nt, Homo sapiens
auaggaagguguuucauuu

SEQ ID NO: 177289 - RNA, 19 nt, Homo sapiens
ccagaagcccuguuugaua

SEQ ID NO: 177290 - RNA, 19 nt, Homo sapiens
gaggugcgcugccuguuga

SEQ ID NO: 177291 - RNA, 19 nt, Homo sapiens
gaucagaggaguaaauaau

SEQ ID NO: 177292 - RNA, 19 nt, Homo sapiens
gaacuguacaugaugauga

SEQ ID NO: 177293 - RNA, 19 nt, Homo sapiens
ggacaaagagauugagguu

SEQ ID NO: 177294 - RNA, 19 nt, Homo sapiens
gaguuugucugcaagguuu

SEQ ID NO: 177295 - RNA, 19 nt, Homo sapiens
ggaaaaugguauaacguua

SEQ ID NO: 177296 - RNA, 19 nt, Homo sapiens
ggagacagguaacaguuuc

SEQ ID NO: 177297 - RNA, 19 nt, Homo sapiens
gggaguacuugcagauaaa

SEQ ID NO: 177298 - RNA, 19 nt, Homo sapiens
caauagccgugcaagauga

SEQ ID NO: 177299 - RNA, 19 nt, Homo sapiens
gaaggaaggacacagaaug

SEQ ID NO: 177300 - RNA, 19 nt, Homo sapiens
cagaagcccuguuugauag

SEQ ID NO: 177301 - RNA, 19 nt, Homo sapiens
agauugagguucucuauau

SEQ ID NO: 177302 - RNA, 19 nt, Homo sapiens
uuaaauggaugucccaaug

SEQ ID NO: 177303 - RNA, 19 nt, Homo sapiens
ucagaggaguaaauaauug

SEQ ID NO: 177304 - RNA, 19 nt, Homo sapiens
guagaagacuuggaucgaa

SEQ ID NO: 177305 - RNA, 19 nt, Homo sapiens
gaauacggguccaucaauc

SEQ ID NO: 177306 - RNA, 19 nt, Homo sapiens
gccaaccucucgaacagua

SEQ ID NO: 177307 - RNA, 19 nt, Homo sapiens
gaaugcagauuacacugau

SEQ ID NO: 177308 - RNA, 19 nt, Homo sapiens
caagaugaaugcagauuac

SEQ ID NO: 177309 - RNA, 19 nt, Homo sapiens
gaccaacguucaagcaguu

SEQ ID NO: 177310 - RNA, 19 nt, Homo sapiens
ccaacgaacuguacaugau

SEQ ID NO: 177311 - RNA, 19 nt, Homo sapiens
gaaaauagcagacuuugga

SEQ ID NO: 177312 - RNA, 19 nt, Homo sapiens
gauagccauuuacugcaua

SEQ ID NO: 177313 - RNA, 19 nt, Homo sapiens
gaaaagaacggcaguaaau

SEQ ID NO: 177314 - RNA, 19 nt, Homo sapiens
cagacuaguuaaucuauug

SEQ ID NO: 177315 - RNA, 19 nt, Homo sapiens
uaaaugcuguucuuacaca

SEQ ID NO: 177316 - RNA, 19 nt, Homo sapiens
ugugggagaucuucacuuu

SEQ ID NO: 177317 - RNA, 19 nt, Homo sapiens
gcagacuaguuaaucuauu

SEQ ID NO: 177318 - RNA, 19 nt, Homo sapiens
cacauaaacggcaguguua

SEQ ID NO: 177319 - RNA, 19 nt, Homo sapiens
gauugagguucucuauauu

SEQ ID NO: 177320 - RNA, 19 nt, Homo sapiens
acaaagagauugagguucu

SEQ ID NO: 177321 - RNA, 19 nt, Homo sapiens
gaggagacguagaguuugu

SEQ ID NO: 177322 - RNA, 19 nt, Homo sapiens
auaaaugucacgcaacuua

SEQ ID NO: 177323 - RNA, 19 nt, Homo sapiens
cuucugaguugcacauuaa

SEQ ID NO: 177324 - RNA, 19 nt, Homo sapiens
guaccagcguccucuuaaa

SEQ ID NO: 177325 - RNA, 19 nt, Homo sapiens
gaagagccaccaaccaaau

SEQ ID NO: 177326 - RNA, 19 nt, Homo sapiens
ggaggagcguugccauuca

SEQ ID NO: 177327 - RNA, 19 nt, Homo sapiens
gaguccagcuccuccauga

SEQ ID NO: 177328 - RNA, 19 nt, Homo sapiens
caaaagauccagccucaua

SEQ ID NO: 177329 - RNA, 19 nt, Homo sapiens
ugaagauguugaaagauga

SEQ ID NO: 177330 - RNA, 19 nt, Homo sapiens
agggauugcuuucaucuaa

SEQ ID NO: 177331 - RNA, 19 nt, Homo sapiens
ggacuucccaagauaaaug

SEQ ID NO: 177332 - RNA, 19 nt, Homo sapiens
aaccaugccuuccucagua

SEQ ID NO: 177333 - RNA, 19 nt, Homo sapiens
ucaagcaguugguagaaga

SEQ ID NO: 177334 - RNA, 19 nt, Homo sapiens
caacacgccucucuucaac

SEQ ID NO: 177335 - RNA, 19 nt, Homo sapiens
gaacaguaacaacaagaga

SEQ ID NO: 177336 - RNA, 19 nt, Homo sapiens
gcaauagccgugcaagaug

SEQ ID NO: 177337 - RNA, 19 nt, Homo sapiens
gaaacacccacucacuuug

SEQ ID NO: 177338 - RNA, 19 nt, Homo sapiens
gcuucugaguugcacauua

SEQ ID NO: 177339 - RNA, 19 nt, Homo sapiens
gaggacagaccuuaguuga

SEQ ID NO: 177340 - RNA, 19 nt, Homo sapiens
ucacaaccaaugaggaaua

SEQ ID NO: 177341 - RNA, 19 nt, Homo sapiens
ccagaggcauggaguacuu

SEQ ID NO: 177342 - RNA, 19 nt, Homo sapiens
ccaaauaccaaaucucuca

SEQ ID NO: 177343 - RNA, 19 nt, Homo sapiens
gaggagcguugccauucaa

SEQ ID NO: 177344 - RNA, 19 nt, Homo sapiens
ugggagaucuucacuuuag

SEQ ID NO: 177345 - RNA, 19 nt, Homo sapiens
gcaggagcaucgcauugga

SEQ ID NO: 177346 - RNA, 19 nt, Homo sapiens
ugucuccacuuguauauau

SEQ ID NO: 177347 - RNA, 19 nt, Homo sapiens
ugucagagauggagaugau

SEQ ID NO: 177348 - RNA, 19 nt, Homo sapiens
ugaagaacacgaccaagaa

SEQ ID NO: 177349 - RNA, 19 nt, Homo sapiens
caucugacaagggaaauua

SEQ ID NO: 177350 - RNA, 19 nt, Homo sapiens
gcacagcagacuaguuaau

SEQ ID NO: 177351 - RNA, 19 nt, Homo sapiens
ccgugaagauguugaaaga

SEQ ID NO: 177352 - RNA, 19 nt, Homo sapiens
uaacaacacgccucucuuc

SEQ ID NO: 177353 - RNA, 19 nt, Homo sapiens
gaaugaagaacacgaccaa

SEQ ID NO: 177354 - RNA, 19 nt, Homo sapiens
ggguaauucuauugggaua

SEQ ID NO: 177355 - RNA, 19 nt, Homo sapiens
gcaccauacuggaccaaca

SEQ ID NO: 177356 - RNA, 19 nt, Homo sapiens
cagauuagccugauucucu

SEQ ID NO: 177357 - RNA, 19 nt, Homo sapiens
cggaggagacguagaguuu

SEQ ID NO: 177358 - RNA, 19 nt, Homo sapiens
aaaguguggucccaucuga

SEQ ID NO: 177359 - RNA, 19 nt, Homo sapiens
gcacuggagccucauuaug

SEQ ID NO: 177360 - RNA, 19 nt, Homo sapiens
gaaaugauagcagaaugug

SEQ ID NO: 177361 - RNA, 19 nt, Homo sapiens
ggugcuggauguauguaaa

SEQ ID NO: 177362 - RNA, 19 nt, Homo sapiens
guaauucuauugggauauc

SEQ ID NO: 177363 - RNA, 19 nt, Homo sapiens
cagaagagccaccaaccaa

SEQ ID NO: 177364 - RNA, 19 nt, Homo sapiens
cauaaacggcaguguuaaa

SEQ ID NO: 177365 - RNA, 19 nt, Homo sapiens
gaguacuccuaugacauua

SEQ ID NO: 177366 - RNA, 19 nt, Homo sapiens
gagaugaugaagaugauug

SEQ ID NO: 177367 - RNA, 19 nt, Homo sapiens
ggacagaccuuaguugaaa

SEQ ID NO: 177368 - RNA, 19 nt, Homo sapiens
gaccuuaguugaaaugaua

SEQ ID NO: 177369 - RNA, 19 nt, Homo sapiens
gagcacaaaugcaguauau

SEQ ID NO: 177370 - RNA, 19 nt, Homo sapiens
cagcauauguguaaagauu

SEQ ID NO: 177371 - RNA, 19 nt, Homo sapiens
ccaaaucucucaaccagaa

SEQ ID NO: 177372 - RNA, 19 nt, Homo sapiens
gaacaguauucaccuaguu

SEQ ID NO: 177373 - RNA, 19 nt, Homo sapiens
ggaccacucuucugcguuu

SEQ ID NO: 177374 - RNA, 19 nt, Homo sapiens
guaaucagcauauguguaa

SEQ ID NO: 177375 - RNA, 19 nt, Homo sapiens
ggccaacacugucaaguuu

SEQ ID NO: 177376 - RNA, 19 nt, Homo sapiens
ggaaacacccacucacuuu

SEQ ID NO: 177377 - RNA, 19 nt, Homo sapiens
ggacagcacugggaaccua

SEQ ID NO: 177378 - RNA, 19 nt, Homo sapiens
aaagaugccuuaauccauu

SEQ ID NO: 177379 - RNA, 19 nt, Homo sapiens
gcaagaugaaugcagauua

SEQ ID NO: 177380 - RNA, 19 nt, Homo sapiens
cagcacagcagacuaguua

SEQ ID NO: 177381 - RNA, 19 nt, Homo sapiens
guauauaggugcuggaugu

SEQ ID NO: 177382 - RNA, 19 nt, Homo sapiens
gcacaaaugcaguauauag

SEQ ID NO: 177383 - RNA, 19 nt, Homo sapiens
gaaggacacagaauggaua

SEQ ID NO: 177384 - RNA, 19 nt, Homo sapiens
uaacuggacuucccaagau

SEQ ID NO: 177385 - RNA, 19 nt, Homo sapiens
gcaagcgccuggaagagaa

SEQ ID NO: 177386 - RNA, 19 nt, Homo sapiens
gcuaaaugcuguucuuaca

SEQ ID NO: 177387 - RNA, 19 nt, Homo sapiens
gugaagauguugaaagaug

SEQ ID NO: 177388 - RNA, 19 nt, Homo sapiens
ggauugcuuucaucuaauu

SEQ ID NO: 177389 - RNA, 19 nt, Homo sapiens
auaggaagguguuucauuu

SEQ ID NO: 177390 - RNA, 19 nt, Homo sapiens
ccagaagcccuguuugaua

SEQ ID NO: 177391 - RNA, 19 nt, Homo sapiens
gaggugcgcugccuguuga

SEQ ID NO: 177392 - RNA, 19 nt, Homo sapiens
gaucagaggaguaaauaau

SEQ ID NO: 177393 - RNA, 19 nt, Homo sapiens
gaacuguacaugaugauga

SEQ ID NO: 177394 - RNA, 19 nt, Homo sapiens
gaguuugucugcaagguuu

SEQ ID NO: 177395 - RNA, 19 nt, Homo sapiens
ggaaaaugguauaacguua

SEQ ID NO: 177396 - RNA, 19 nt, Homo sapiens
ggagacagguaacaguuuc

SEQ ID NO: 177397 - RNA, 19 nt, Homo sapiens
gggaguacuugcagauaaa

SEQ ID NO: 177398 - RNA, 19 nt, Homo sapiens
caauagccgugcaagauga

SEQ ID NO: 177399 - RNA, 19 nt, Homo sapiens
gaaggaaggacacagaaug

SEQ ID NO: 177400 - RNA, 19 nt, Homo sapiens
cagaagcccuguuugauag

SEQ ID NO: 177401 - RNA, 19 nt, Homo sapiens
uuaaauggaugucccaaug

SEQ ID NO: 177402 - RNA, 19 nt, Homo sapiens
ucagaggaguaaauaauug

SEQ ID NO: 177403 - RNA, 19 nt, Homo sapiens
guagaagacuuggaucgaa

SEQ ID NO: 177404 - RNA, 19 nt, Homo sapiens
gaauacggguccaucaauc

SEQ ID NO: 177405 - RNA, 19 nt, Homo sapiens
gccaaccucucgaacagua

SEQ ID NO: 177406 - RNA, 19 nt, Homo sapiens
gaaugcagauuacacugau

SEQ ID NO: 177407 - RNA, 19 nt, Homo sapiens
caagaugaaugcagauuac

SEQ ID NO: 177408 - RNA, 19 nt, Homo sapiens
gaccaacguucaagcaguu

SEQ ID NO: 177409 - RNA, 19 nt, Homo sapiens
ccaacgaacuguacaugau

SEQ ID NO: 177410 - RNA, 19 nt, Homo sapiens
gaaaauagcagacuuugga

SEQ ID NO: 177411 - RNA, 19 nt, Homo sapiens
gauagccauuuacugcaua

SEQ ID NO: 177412 - RNA, 19 nt, Homo sapiens
gaaaagaacggcaguaaau

SEQ ID NO: 177413 - RNA, 19 nt, Homo sapiens
cagacuaguuaaucuauug

SEQ ID NO: 177414 - RNA, 19 nt, Homo sapiens
uaaaugcuguucuuacaca

SEQ ID NO: 177415 - RNA, 19 nt, Homo sapiens
ugugggagaucuucacuuu

SEQ ID NO: 177416 - RNA, 19 nt, Homo sapiens
gcagacuaguuaaucuauu

SEQ ID NO: 177417 - RNA, 19 nt, Homo sapiens
cacauaaacggcaguguua

SEQ ID NO: 177418 - RNA, 19 nt, Homo sapiens
gaggagacguagaguuugu

SEQ ID NO: 177419 - RNA, 19 nt, Homo sapiens
cuucugaguugcacauuaa

SEQ ID NO: 177420 - RNA, 19 nt, Homo sapiens
guaccagcguccucuuaaa

SEQ ID NO: 177421 - RNA, 19 nt, Homo sapiens
gaagagccaccaaccaaau

SEQ ID NO: 177422 - RNA, 19 nt, Homo sapiens
gaguccagcuccuccauga

SEQ ID NO: 177423 - RNA, 19 nt, Homo sapiens
ggaggagcguugccauuca

SEQ ID NO: 177424 - RNA, 19 nt, Homo sapiens
caaaagauccagccucaua

SEQ ID NO: 177425 - RNA, 19 nt, Homo sapiens
ugaagauguugaaagauga

SEQ ID NO: 177426 - RNA, 19 nt, Homo sapiens
agggauugcuuucaucuaa

SEQ ID NO: 177427 - RNA, 19 nt, Homo sapiens
ggacuucccaagauaaaug

SEQ ID NO: 177428 - RNA, 19 nt, Homo sapiens
aaccaugccuuccucagua

SEQ ID NO: 177429 - RNA, 19 nt, Homo sapiens
ucaagcaguugguagaaga

SEQ ID NO: 177430 - RNA, 19 nt, Homo sapiens
caacacgccucucuucaac

SEQ ID NO: 177431 - RNA, 19 nt, Homo sapiens
gaacaguaacaacaagaga

SEQ ID NO: 177432 - RNA, 19 nt, Homo sapiens
gcaauagccgugcaagaug

SEQ ID NO: 177433 - RNA, 19 nt, Homo sapiens
gaaacacccacucacuuug

SEQ ID NO: 177434 - RNA, 19 nt, Homo sapiens
gcuucugaguugcacauua

SEQ ID NO: 177435 - RNA, 19 nt, Homo sapiens
gaggacagaccuuaguuga

SEQ ID NO: 177436 - RNA, 19 nt, Homo sapiens
ucacaaccaaugaggaaua

SEQ ID NO: 177437 - RNA, 19 nt, Homo sapiens
ccagaggcauggaguacuu

SEQ ID NO: 177438 - RNA, 19 nt, Homo sapiens
ccaaauaccaaaucucuca

SEQ ID NO: 177439 - RNA, 19 nt, Homo sapiens
gaggagcguugccauucaa

SEQ ID NO: 177440 - RNA, 19 nt, Homo sapiens
ugggagaucuucacuuuag

SEQ ID NO: 177441 - RNA, 19 nt, Homo sapiens
gcaggagcaucgcauugga

SEQ ID NO: 177442 - RNA, 19 nt, Homo sapiens
ugucuccacuuguauauau

SEQ ID NO: 177443 - RNA, 19 nt, Homo sapiens
ugucagagauggagaugau

SEQ ID NO: 177444 - RNA, 19 nt, Homo sapiens
ugaagaacacgaccaagaa

SEQ ID NO: 177445 - RNA, 19 nt, Homo sapiens
caucugacaagggaaauua

SEQ ID NO: 177446 - RNA, 19 nt, Homo sapiens
gcacagcagacuaguuaau

SEQ ID NO: 177447 - RNA, 19 nt, Homo sapiens
ccgugaagauguugaaaga

SEQ ID NO: 177448 - RNA, 19 nt, Homo sapiens
uaacaacacgccucucuuc

SEQ ID NO: 177449 - RNA, 19 nt, Homo sapiens
gaaugaagaacacgaccaa

SEQ ID NO: 177450 - RNA, 19 nt, Homo sapiens
gcaccauacuggaccaaca

SEQ ID NO: 177451 - RNA, 19 nt, Homo sapiens
cagauuagccugauucucu

SEQ ID NO: 177452 - RNA, 19 nt, Homo sapiens
cggaggagacguagaguuu

SEQ ID NO: 177453 - RNA, 19 nt, Homo sapiens
aaaguguggucccaucuga

SEQ ID NO: 177454 - RNA, 19 nt, Homo sapiens
gcacuggagccucauuaug

SEQ ID NO: 177455 - RNA, 19 nt, Homo sapiens
gaaaugauagcagaaugug

SEQ ID NO: 177456 - RNA, 19 nt, Homo sapiens
ggugcuggauguauguaaa

SEQ ID NO: 177457 - RNA, 19 nt, Homo sapiens
cagaagagccaccaaccaa

SEQ ID NO: 177458 - RNA, 19 nt, Homo sapiens
cauaaacggcaguguuaaa

SEQ ID NO: 177459 - RNA, 19 nt, Homo sapiens
gaguacuccuaugacauua

SEQ ID NO: 177460 - RNA, 19 nt, Homo sapiens
gagaugaugaagaugauug

SEQ ID NO: 177461 - RNA, 19 nt, Homo sapiens
agauggagaugaugaagau

SEQ ID NO: 177462 - RNA, 19 nt, Homo sapiens
ucaagucccaucauagaaa

SEQ ID NO: 177463 - RNA, 19 nt, Homo sapiens
cguucugccuuccuuguua

SEQ ID NO: 177464 - RNA, 19 nt, Homo sapiens
gccacaagccaccauguaa

SEQ ID NO: 177465 - RNA, 19 nt, Homo sapiens
gaaccaugccuuccucagu

SEQ ID NO: 177466 - RNA, 19 nt, Homo sapiens
gaucgaauucucacucuca

SEQ ID NO: 177467 - RNA, 19 nt, Homo sapiens
ggacagaccuuaguugaaa

SEQ ID NO: 177468 - RNA, 19 nt, Homo sapiens
gaccuuaguugaaaugaua

SEQ ID NO: 177469 - RNA, 19 nt, Homo sapiens
gagcacaaaugcaguauau

SEQ ID NO: 177470 - RNA, 19 nt, Homo sapiens
cagcauauguguaaagauu

SEQ ID NO: 177471 - RNA, 19 nt, Homo sapiens
ccaaaucucucaaccagaa

SEQ ID NO: 177472 - RNA, 19 nt, Homo sapiens
gaacaguauucaccuaguu

SEQ ID NO: 177473 - RNA, 19 nt, Homo sapiens
ggaccacucuucugcguuu

SEQ ID NO: 177474 - RNA, 19 nt, Homo sapiens
guaaucagcauauguguaa

SEQ ID NO: 177475 - RNA, 19 nt, Homo sapiens
ggccaacacugucaaguuu

SEQ ID NO: 177476 - RNA, 19 nt, Homo sapiens
ggaaacacccacucacuuu

SEQ ID NO: 177477 - RNA, 19 nt, Homo sapiens
ggacagcacugggaaccua

SEQ ID NO: 177478 - RNA, 19 nt, Homo sapiens
aaagaugccuuaauccauu

SEQ ID NO: 177479 - RNA, 19 nt, Homo sapiens
gcaagaugaaugcagauua

SEQ ID NO: 177480 - RNA, 19 nt, Homo sapiens
cagcacagcagacuaguua

SEQ ID NO: 177481 - RNA, 19 nt, Homo sapiens
guauauaggugcuggaugu

SEQ ID NO: 177482 - RNA, 19 nt, Homo sapiens
gcacaaaugcaguauauag

SEQ ID NO: 177483 - RNA, 19 nt, Homo sapiens
gaaggacacagaauggaua

SEQ ID NO: 177484 - RNA, 19 nt, Homo sapiens
uaacuggacuucccaagau

SEQ ID NO: 177485 - RNA, 19 nt, Homo sapiens
gcuaaaugcuguucuuaca

SEQ ID NO: 177486 - RNA, 19 nt, Homo sapiens
gugaagauguugaaagaug

SEQ ID NO: 177487 - RNA, 19 nt, Homo sapiens
ggauugcuuucaucuaauu

SEQ ID NO: 177488 - RNA, 19 nt, Homo sapiens
auaggaagguguuucauuu

SEQ ID NO: 177489 - RNA, 19 nt, Homo sapiens
ccagaagcccuguuugaua

SEQ ID NO: 177490 - RNA, 19 nt, Homo sapiens
gaggugcgcugccuguuga

SEQ ID NO: 177491 - RNA, 19 nt, Homo sapiens
gaucagaggaguaaauaau

SEQ ID NO: 177492 - RNA, 19 nt, Homo sapiens
gaacuguacaugaugauga

SEQ ID NO: 177493 - RNA, 19 nt, Homo sapiens
gaguuugucugcaagguuu

SEQ ID NO: 177494 - RNA, 19 nt, Homo sapiens
ggaaaaugguauaacguua

SEQ ID NO: 177495 - RNA, 19 nt, Homo sapiens
gggaguacuugcagauaaa

SEQ ID NO: 177496 - RNA, 19 nt, Homo sapiens
caauagccgugcaagauga

SEQ ID NO: 177497 - RNA, 19 nt, Homo sapiens
gaaggaaggacacagaaug

SEQ ID NO: 177498 - RNA, 19 nt, Homo sapiens
cagaagcccuguuugauag

SEQ ID NO: 177499 - RNA, 19 nt, Homo sapiens
uuaaauggaugucccaaug

SEQ ID NO: 177500 - RNA, 19 nt, Homo sapiens
ucagaggaguaaauaauug

SEQ ID NO: 177501 - RNA, 19 nt, Homo sapiens
guagaagacuuggaucgaa

SEQ ID NO: 177502 - RNA, 19 nt, Homo sapiens
gaauacggguccaucaauc

SEQ ID NO: 177503 - RNA, 19 nt, Homo sapiens
gccaaccucucgaacagua

SEQ ID NO: 177504 - RNA, 19 nt, Homo sapiens
gaaugcagauuacacugau

SEQ ID NO: 177505 - RNA, 19 nt, Homo sapiens
caagaugaaugcagauuac

SEQ ID NO: 177506 - RNA, 19 nt, Homo sapiens
gaccaacguucaagcaguu

SEQ ID NO: 177507 - RNA, 19 nt, Homo sapiens
ccaacgaacuguacaugau

SEQ ID NO: 177508 - RNA, 19 nt, Homo sapiens
gaaaauagcagacuuugga

SEQ ID NO: 177509 - RNA, 19 nt, Homo sapiens
gaaaagaacggcaguaaau

SEQ ID NO: 177510 - RNA, 19 nt, Homo sapiens
cagacuaguuaaucuauug

SEQ ID NO: 177511 - RNA, 19 nt, Homo sapiens
uaaaugcuguucuuacaca

SEQ ID NO: 177512 - RNA, 19 nt, Homo sapiens
ugugggagaucuucacuuu

SEQ ID NO: 177513 - RNA, 19 nt, Homo sapiens
gcagacuaguuaaucuauu

SEQ ID NO: 177514 - RNA, 19 nt, Homo sapiens
cacauaaacggcaguguua

SEQ ID NO: 177515 - RNA, 19 nt, Homo sapiens
gaggagacguagaguuugu

SEQ ID NO: 177516 - RNA, 19 nt, Homo sapiens
cuucugaguugcacauuaa

SEQ ID NO: 177517 - RNA, 19 nt, Homo sapiens
guaccagcguccucuuaaa

SEQ ID NO: 177518 - RNA, 19 nt, Homo sapiens
gaagagccaccaaccaaau

SEQ ID NO: 177519 - RNA, 19 nt, Homo sapiens
ggaggagcguugccauuca

SEQ ID NO: 177520 - RNA, 19 nt, Homo sapiens
gaguccagcuccuccauga

SEQ ID NO: 177521 - RNA, 19 nt, Homo sapiens
caaaagauccagccucaua

SEQ ID NO: 177522 - RNA, 19 nt, Homo sapiens
ugaagauguugaaagauga

SEQ ID NO: 177523 - RNA, 19 nt, Homo sapiens
agggauugcuuucaucuaa

SEQ ID NO: 177524 - RNA, 19 nt, Homo sapiens
ggacuucccaagauaaaug

SEQ ID NO: 177525 - RNA, 19 nt, Homo sapiens
aaccaugccuuccucagua

SEQ ID NO: 177526 - RNA, 19 nt, Homo sapiens
ucaagcaguugguagaaga

SEQ ID NO: 177527 - RNA, 19 nt, Homo sapiens
caacacgccucucuucaac

SEQ ID NO: 177528 - RNA, 19 nt, Homo sapiens
gaacaguaacaacaagaga

SEQ ID NO: 177529 - RNA, 19 nt, Homo sapiens
gcaauagccgugcaagaug

SEQ ID NO: 177530 - RNA, 19 nt, Homo sapiens
gaaacacccacucacuuug

SEQ ID NO: 177531 - RNA, 19 nt, Homo sapiens
gcuucugaguugcacauua

SEQ ID NO: 177532 - RNA, 19 nt, Homo sapiens
gaggacagaccuuaguuga

SEQ ID NO: 177533 - RNA, 19 nt, Homo sapiens
ucacaaccaaugaggaaua

SEQ ID NO: 177534 - RNA, 19 nt, Homo sapiens
ccagaggcauggaguacuu

SEQ ID NO: 177535 - RNA, 19 nt, Homo sapiens
ccaaauaccaaaucucuca

SEQ ID NO: 177536 - RNA, 19 nt, Homo sapiens
gaggagcguugccauucaa

SEQ ID NO: 177537 - RNA, 19 nt, Homo sapiens
ugggagaucuucacuuuag

SEQ ID NO: 177538 - RNA, 19 nt, Homo sapiens
gcaggagcaucgcauugga

SEQ ID NO: 177539 - RNA, 19 nt, Homo sapiens
ugucuccacuuguauauau

SEQ ID NO: 177540 - RNA, 19 nt, Homo sapiens
ugucagagauggagaugau

SEQ ID NO: 177541 - RNA, 19 nt, Homo sapiens
caucugacaagggaaauua

SEQ ID NO: 177542 - RNA, 19 nt, Homo sapiens
gcacagcagacuaguuaau

SEQ ID NO: 177543 - RNA, 19 nt, Homo sapiens
ccgugaagauguugaaaga

SEQ ID NO: 177544 - RNA, 19 nt, Homo sapiens
uaacaacacgccucucuuc

SEQ ID NO: 177545 - RNA, 19 nt, Homo sapiens
gcaccauacuggaccaaca

SEQ ID NO: 177546 - RNA, 19 nt, Homo sapiens
cagauuagccugauucucu

SEQ ID NO: 177547 - RNA, 19 nt, Homo sapiens
cggaggagacguagaguuu

SEQ ID NO: 177548 - RNA, 19 nt, Homo sapiens
aaaguguggucccaucuga

SEQ ID NO: 177549 - RNA, 19 nt, Homo sapiens
gcacuggagccucauuaug

SEQ ID NO: 177550 - RNA, 19 nt, Homo sapiens
gaaaugauagcagaaugug

SEQ ID NO: 177551 - RNA, 19 nt, Homo sapiens
ggugcuggauguauguaaa

SEQ ID NO: 177552 - RNA, 19 nt, Homo sapiens
cauaaacggcaguguuaaa

SEQ ID NO: 177553 - RNA, 19 nt, Homo sapiens
gaguacuccuaugacauua

SEQ ID NO: 177554 - RNA, 19 nt, Homo sapiens
gagaugaugaagaugauug

SEQ ID NO: 177555 - RNA, 19 nt, Homo sapiens
agauggagaugaugaagau

SEQ ID NO: 177556 - RNA, 19 nt, Homo sapiens
ccucaagguucucaagguu

SEQ ID NO: 177557 - RNA, 19 nt, Homo sapiens
cagaagagccaccaaccaa

SEQ ID NO: 177558 - RNA, 19 nt, Homo sapiens
ucaagucccaucauagaaa

SEQ ID NO: 177559 - RNA, 19 nt, Homo sapiens
cguucugccuuccuuguua

SEQ ID NO: 177560 - RNA, 19 nt, Homo sapiens
gccacaagccaccauguaa

SEQ ID NO: 177561 - RNA, 19 nt, Homo sapiens
gaaccaugccuuccucagu

SEQ ID NO: 177562 - RNA, 19 nt, Homo sapiens
gaucgaauucucacucuca

SEQ ID NO: 177563 - RNA, 19 nt, Homo sapiens
gggaaacacaagaauauca

SEQ ID NO: 177564 - RNA, 19 nt, Homo sapiens
aaagaacucauucauagga

SEQ ID NO: 177565 - RNA, 19 nt, Homo sapiens
uagaagacuuggaucgaau

SEQ ID NO: 177566 - RNA, 19 nt, Homo sapiens
cgccagagauaucaacaau

SEQ ID NO: 177567 - RNA, 19 nt, Homo sapiens
ccaaaucucucaaccagaa

SEQ ID NO: 177568 - RNA, 19 nt, Homo sapiens
ggaccacucuucugcguuu

SEQ ID NO: 177569 - RNA, 19 nt, Homo sapiens
ggccaacacugucaaguuu

SEQ ID NO: 177570 - RNA, 19 nt, Homo sapiens
gcaaagggaaccauguaua

SEQ ID NO: 177571 - RNA, 19 nt, Homo sapiens
gaggugcgcugccuguuga

SEQ ID NO: 177572 - RNA, 19 nt, Homo sapiens
gggaguacuugcagauaaa

SEQ ID NO: 177573 - RNA, 19 nt, Homo sapiens
ucacuuccaucacaagaaa

SEQ ID NO: 177574 - RNA, 19 nt, Homo sapiens
gaaaaggucugaggacuga

SEQ ID NO: 177575 - RNA, 19 nt, Homo sapiens
gaauacggguccaucaauc

SEQ ID NO: 177576 - RNA, 19 nt, Homo sapiens
caaagggaaccauguauau

SEQ ID NO: 177577 - RNA, 19 nt, Homo sapiens
gaagagccaccaaccaaau

SEQ ID NO: 177578 - RNA, 19 nt, Homo sapiens
ggaggagcguugccauuca

SEQ ID NO: 177579 - RNA, 19 nt, Homo sapiens
uagcagaccuuugguuuua

SEQ ID NO: 177580 - RNA, 19 nt, Homo sapiens
gaacaguaacaacaagaga

SEQ ID NO: 177581 - RNA, 19 nt, Homo sapiens
aagcugagauuacucugaa

SEQ ID NO: 177582 - RNA, 19 nt, Homo sapiens
ccaaauaccaaaucucuca

SEQ ID NO: 177583 - RNA, 19 nt, Homo sapiens
gcaggagcaucgcauugga

SEQ ID NO: 177584 - RNA, 19 nt, Homo sapiens
gaggagcguugccauucaa

SEQ ID NO: 177585 - RNA, 19 nt, Homo sapiens
gaaggccagcugaagagua

SEQ ID NO: 177586 - RNA, 19 nt, Homo sapiens
uaaaguggacgugguauga

SEQ ID NO: 177587 - RNA, 19 nt, Homo sapiens
caucugacaagggaaauua

SEQ ID NO: 177588 - RNA, 19 nt, Homo sapiens
aaggccagcugaagaguaa

SEQ ID NO: 177589 - RNA, 19 nt, Homo sapiens
guagaaggccagcugaaga

SEQ ID NO: 177590 - RNA, 19 nt, Homo sapiens
gcaccauacuggaccaaca

SEQ ID NO: 177591 - RNA, 19 nt, Homo sapiens
acagauaaguaggccauuu

SEQ ID NO: 177592 - RNA, 19 nt, Homo sapiens
aaaguguggucccaucuga

SEQ ID NO: 177593 - RNA, 19 nt, Homo sapiens
gcacuggagccucauuaug

SEQ ID NO: 177594 - RNA, 19 nt, Homo sapiens
cagaagagccaccaaccaa

SEQ ID NO: 177595 - RNA, 19 nt, Homo sapiens
gaagcugagauuacucuga

SEQ ID NO: 177596 - RNA, 19 nt, Homo sapiens
gcccuucacuuccaucaca

SEQ ID NO: 177597 - RNA, 19 nt, Homo sapiens
ccaagcgucaucuguguaa

SEQ ID NO: 177598 - RNA, 19 nt, Homo sapiens
gugcaaagggaaccaugua

SEQ ID NO: 177599 - RNA, 19 nt, Homo sapiens
gggcagccaggguuuauga

SEQ ID NO: 177600 - RNA, 19 nt, Homo sapiens
ugucagagugcacagauaa

SEQ ID NO: 177601 - RNA, 19 nt, Homo sapiens
cauuggaggcuacaaggua

SEQ ID NO: 177602 - RNA, 19 nt, Homo sapiens
aagggaaccauguauauga

SEQ ID NO: 177603 - RNA, 19 nt, Homo sapiens
ucacaagaaagucauuaga

SEQ ID NO: 177604 - RNA, 19 nt, Homo sapiens
ccugugugguggagaauga

SEQ ID NO: 177605 - RNA, 19 nt, Homo sapiens
gagaacaguaacaacaaga

SEQ ID NO: 177606 - RNA, 19 nt, Homo sapiens
cagugaaacuugguacuuc

SEQ ID NO: 177607 - RNA, 19 nt, Homo sapiens
cagagugcacagauaagua

SEQ ID NO: 177608 - RNA, 19 nt, Homo sapiens
guugagggcccuucacuuc

SEQ ID NO: 177609 - RNA, 19 nt, Homo sapiens
gccuguggcuggcuggaaa

SEQ ID NO: 177610 - RNA, 19 nt, Homo sapiens
gagcguugccauucaagug

SEQ ID NO: 177611 - RNA, 19 nt, Homo sapiens
ggggaguacuugcagauaa

SEQ ID NO: 177612 - RNA, 19 nt, Homo sapiens
ccaaccaaauaccaaaucu

SEQ ID NO: 177613 - RNA, 19 nt, Homo sapiens
aguugaggauaccacauua

SEQ ID NO: 177614 - RNA, 19 nt, Homo sapiens
caucacaagaaagucauua

SEQ ID NO: 177615 - RNA, 19 nt, Homo sapiens
aaguggacgugguaugaaa

SEQ ID NO: 177616 - RNA, 19 nt, Homo sapiens
gaaaguguggucccaucug

SEQ ID NO: 177617 - RNA, 19 nt, Homo sapiens
ugagaacaguaacaacaag

SEQ ID NO: 177618 - RNA, 19 nt, Homo sapiens
aaccauguauaugagcuua

SEQ ID NO: 177619 - RNA, 19 nt, Homo sapiens
gcagaccuuugguuuuaaa

SEQ ID NO: 177620 - RNA, 19 nt, Homo sapiens
gacgugguaugaaaugucu

SEQ ID NO: 177621 - RNA, 19 nt, Homo sapiens
uuuaugagcuuugcaugau

SEQ ID NO: 177622 - RNA, 19 nt, Homo sapiens
cagcacuggagccucauua

SEQ ID NO: 177623 - RNA, 19 nt, Homo sapiens
caacaagagagcaccauac

SEQ ID NO: 177624 - RNA, 19 nt, Homo sapiens
cgccaagccugaguccuuu

SEQ ID NO: 177625 - RNA, 19 nt, Homo sapiens
ccaccaaccaaauaccaaa

SEQ ID NO: 177626 - RNA, 19 nt, Homo sapiens
cagcugaagaguaaaggaa

SEQ ID NO: 177627 - RNA, 19 nt, Homo sapiens
aacaauaggacagugcuua

SEQ ID NO: 177628 - RNA, 19 nt, Homo sapiens
gugaucaguuggacuaagg

SEQ ID NO: 177629 - RNA, 19 nt, Homo sapiens
uguagcagaccuuugguuu

SEQ ID NO: 177630 - RNA, 19 nt, Homo sapiens
ggaacccaaugccaaccau

SEQ ID NO: 177631 - RNA, 19 nt, Homo sapiens
gugagaacaguaacaacaa

SEQ ID NO: 177632 - RNA, 19 nt, Homo sapiens
aagagccaccaaccaaaua

SEQ ID NO: 177633 - RNA, 19 nt, Homo sapiens
guaaaguggacgugguaug

SEQ ID NO: 177634 - RNA, 19 nt, Homo sapiens
acacguaccaccuggaugu

SEQ ID NO: 177635 - RNA, 19 nt, Homo sapiens
ugaauacggguccaucaau

SEQ ID NO: 177636 - RNA, 19 nt, Homo sapiens
ggacgugguaugaaauguc

SEQ ID NO: 177637 - RNA, 19 nt, Homo sapiens
ucugacaagggaaauuaua

SEQ ID NO: 177638 - RNA, 19 nt, Homo sapiens
acaacaagagagcaccaua

SEQ ID NO: 177639 - RNA, 19 nt, Homo sapiens
ccgauggugcggaagauuu

SEQ ID NO: 177640 - RNA, 19 nt, Homo sapiens
gccgugaucaguuggacua

SEQ ID NO: 177641 - RNA, 19 nt, Homo sapiens
gaaccauguauaugagcuu

SEQ ID NO: 177642 - RNA, 19 nt, Homo sapiens
cauuagacgguaccaauuc

SEQ ID NO: 177643 - RNA, 19 nt, Homo sapiens
cggaagauuuugucaguga

SEQ ID NO: 177644 - RNA, 19 nt, Homo sapiens
ucauuagacgguaccaauu

SEQ ID NO: 177645 - RNA, 19 nt, Homo sapiens
guuuaugagcuuugcauga

SEQ ID NO: 177646 - RNA, 19 nt, Homo sapiens
ccaacacugucaaguuucg

SEQ ID NO: 177647 - RNA, 19 nt, Homo sapiens
cauacuggaccaacacaga

SEQ ID NO: 177648 - RNA, 19 nt, Homo sapiens
agaagagccaccaaccaaa

SEQ ID NO: 177649 - RNA, 19 nt, Homo sapiens
aaagggaaccauguauaug

SEQ ID NO: 177650 - RNA, 19 nt, Homo sapiens
gacccaaggaccacucuuc

SEQ ID NO: 177651 - RNA, 19 nt, Homo sapiens
gcugaagaguaaaggaaaa

SEQ ID NO: 177652 - RNA, 19 nt, Homo sapiens
guguaaaguggacguggua

SEQ ID NO: 177653 - RNA, 19 nt, Homo sapiens
cguaccaccuggauguugu

SEQ ID NO: 177654 - RNA, 19 nt, Homo sapiens
gaggcuacaagguacgaaa

SEQ ID NO: 177655 - RNA, 19 nt, Homo sapiens
gucauuagacgguaccaau

SEQ ID NO: 177656 - RNA, 19 nt, Homo sapiens
ccacauuagagccagaaga

SEQ ID NO: 177657 - RNA, 19 nt, Homo sapiens
gagauuacucugaaaaugu

SEQ ID NO: 177658 - RNA, 19 nt, Homo sapiens
gcggaggagcguugccauu

SEQ ID NO: 177659 - RNA, 19 nt, Homo sapiens
ggaaaguguggucccaucu

SEQ ID NO: 177660 - RNA, 19 nt, Homo sapiens
ccggagaugaugaggauga

SEQ ID NO: 177661 - RNA, 19 nt, Homo sapiens
acaauaggacagugcuuau

SEQ ID NO: 177662 - RNA, 19 nt, Homo sapiens
ucaguuuaguugaggauac

SEQ ID NO: 177663 - RNA, 19 nt, Homo sapiens
uaguugaggauaccacauu

SEQ ID NO: 177664 - RNA, 19 nt, Homo sapiens
ugagggcccuucacuucca

SEQ ID NO: 177665 - RNA, 19 nt, Homo sapiens
ucagugagaacaguaacaa

SEQ ID NO: 177666 - RNA, 19 nt, Homo sapiens
ucuauuuccucugugcaaa

SEQ ID NO: 177667 - RNA, 19 nt, Homo sapiens
ggacagaccuuaguugaaa

SEQ ID NO: 177668 - RNA, 19 nt, Homo sapiens
gaccuuaguugaaaugaua

SEQ ID NO: 177669 - RNA, 19 nt, Homo sapiens
gagcacaaaugcaguauau

SEQ ID NO: 177670 - RNA, 19 nt, Homo sapiens
cagcauauguguaaagauu

SEQ ID NO: 177671 - RNA, 19 nt, Homo sapiens
ccaaaucucucaaccagaa

SEQ ID NO: 177672 - RNA, 19 nt, Homo sapiens
gaacaguauucaccuaguu

SEQ ID NO: 177673 - RNA, 19 nt, Homo sapiens
ggaccacucuucugcguuu

SEQ ID NO: 177674 - RNA, 19 nt, Homo sapiens
guaaucagcauauguguaa

SEQ ID NO: 177675 - RNA, 19 nt, Homo sapiens
ggccaacacugucaaguuu

SEQ ID NO: 177676 - RNA, 19 nt, Homo sapiens
ggaaacacccacucacuuu

SEQ ID NO: 177677 - RNA, 19 nt, Homo sapiens
ggacagcacugggaaccua

SEQ ID NO: 177678 - RNA, 19 nt, Homo sapiens
aaagaugccuuaauccauu

SEQ ID NO: 177679 - RNA, 19 nt, Homo sapiens
gcaagaugaaugcagauua

SEQ ID NO: 177680 - RNA, 19 nt, Homo sapiens
cagcacagcagacuaguua

SEQ ID NO: 177681 - RNA, 19 nt, Homo sapiens
guauauaggugcuggaugu

SEQ ID NO: 177682 - RNA, 19 nt, Homo sapiens
gcacaaaugcaguauauag

SEQ ID NO: 177683 - RNA, 19 nt, Homo sapiens
gaaggacacagaauggaua

SEQ ID NO: 177684 - RNA, 19 nt, Homo sapiens
uaacuggacuucccaagau

SEQ ID NO: 177685 - RNA, 19 nt, Homo sapiens
gcuaaaugcuguucuuaca

SEQ ID NO: 177686 - RNA, 19 nt, Homo sapiens
gugaagauguugaaagaug

SEQ ID NO: 177687 - RNA, 19 nt, Homo sapiens
ggauugcuuucaucuaauu

SEQ ID NO: 177688 - RNA, 19 nt, Homo sapiens
auaggaagguguuucauuu

SEQ ID NO: 177689 - RNA, 19 nt, Homo sapiens
ccagaagcccuguuugaua

SEQ ID NO: 177690 - RNA, 19 nt, Homo sapiens
gaggugcgcugccuguuga

SEQ ID NO: 177691 - RNA, 19 nt, Homo sapiens
gaucagaggaguaaauaau

SEQ ID NO: 177692 - RNA, 19 nt, Homo sapiens
gaacuguacaugaugauga

SEQ ID NO: 177693 - RNA, 19 nt, Homo sapiens
ggacaaagagauugagguu

SEQ ID NO: 177694 - RNA, 19 nt, Homo sapiens
gaguuugucugcaagguuu

SEQ ID NO: 177695 - RNA, 19 nt, Homo sapiens
ggaaaaugguauaacguua

SEQ ID NO: 177696 - RNA, 19 nt, Homo sapiens
gggaguacuugcagauaaa

SEQ ID NO: 177697 - RNA, 19 nt, Homo sapiens
caauagccgugcaagauga

SEQ ID NO: 177698 - RNA, 19 nt, Homo sapiens
gaaggaaggacacagaaug

SEQ ID NO: 177699 - RNA, 19 nt, Homo sapiens
cagaagcccuguuugauag

SEQ ID NO: 177700 - RNA, 19 nt, Homo sapiens
agauugagguucucuauau

SEQ ID NO: 177701 - RNA, 19 nt, Homo sapiens
uuaaauggaugucccaaug

SEQ ID NO: 177702 - RNA, 19 nt, Homo sapiens
ucagaggaguaaauaauug

SEQ ID NO: 177703 - RNA, 19 nt, Homo sapiens
guagaagacuuggaucgaa

SEQ ID NO: 177704 - RNA, 19 nt, Homo sapiens
gaauacggguccaucaauc

SEQ ID NO: 177705 - RNA, 19 nt, Homo sapiens
gccaaccucucgaacagua

SEQ ID NO: 177706 - RNA, 19 nt, Homo sapiens
gaaugcagauuacacugau

SEQ ID NO: 177707 - RNA, 19 nt, Homo sapiens
caagaugaaugcagauuac

SEQ ID NO: 177708 - RNA, 19 nt, Homo sapiens
gaccaacguucaagcaguu

SEQ ID NO: 177709 - RNA, 19 nt, Homo sapiens
ccaacgaacuguacaugau

SEQ ID NO: 177710 - RNA, 19 nt, Homo sapiens
gaaaauagcagacuuugga

SEQ ID NO: 177711 - RNA, 19 nt, Homo sapiens
gauagccauuuacugcaua

SEQ ID NO: 177712 - RNA, 19 nt, Homo sapiens
gaaaagaacggcaguaaau

SEQ ID NO: 177713 - RNA, 19 nt, Homo sapiens
cagacuaguuaaucuauug

SEQ ID NO: 177714 - RNA, 19 nt, Homo sapiens
uaaaugcuguucuuacaca

SEQ ID NO: 177715 - RNA, 19 nt, Homo sapiens
ugugggagaucuucacuuu

SEQ ID NO: 177716 - RNA, 19 nt, Homo sapiens
gcagacuaguuaaucuauu

SEQ ID NO: 177717 - RNA, 19 nt, Homo sapiens
cacauaaacggcaguguua

SEQ ID NO: 177718 - RNA, 19 nt, Homo sapiens
gauugagguucucuauauu

SEQ ID NO: 177719 - RNA, 19 nt, Homo sapiens
acaaagagauugagguucu

SEQ ID NO: 177720 - RNA, 19 nt, Homo sapiens
gaggagacguagaguuugu

SEQ ID NO: 177721 - RNA, 19 nt, Homo sapiens
cuucugaguugcacauuaa

SEQ ID NO: 177722 - RNA, 19 nt, Homo sapiens
guaccagcguccucuuaaa

SEQ ID NO: 177723 - RNA, 19 nt, Homo sapiens
gaagagccaccaaccaaau

SEQ ID NO: 177724 - RNA, 19 nt, Homo sapiens
ggaggagcguugccauuca

SEQ ID NO: 177725 - RNA, 19 nt, Homo sapiens
gaguccagcuccuccauga

SEQ ID NO: 177726 - RNA, 19 nt, Homo sapiens
caaaagauccagccucaua

SEQ ID NO: 177727 - RNA, 19 nt, Homo sapiens
ugaagauguugaaagauga

SEQ ID NO: 177728 - RNA, 19 nt, Homo sapiens
agggauugcuuucaucuaa

SEQ ID NO: 177729 - RNA, 19 nt, Homo sapiens
ggacuucccaagauaaaug

SEQ ID NO: 177730 - RNA, 19 nt, Homo sapiens
aaccaugccuuccucagua

SEQ ID NO: 177731 - RNA, 19 nt, Homo sapiens
ucaagcaguugguagaaga

SEQ ID NO: 177732 - RNA, 19 nt, Homo sapiens
caacacgccucucuucaac

SEQ ID NO: 177733 - RNA, 19 nt, Homo sapiens
gaacaguaacaacaagaga

SEQ ID NO: 177734 - RNA, 19 nt, Homo sapiens
gcaauagccgugcaagaug

SEQ ID NO: 177735 - RNA, 19 nt, Homo sapiens
gaaacacccacucacuuug

SEQ ID NO: 177736 - RNA, 19 nt, Homo sapiens
gcuucugaguugcacauua

SEQ ID NO: 177737 - RNA, 19 nt, Homo sapiens
gaggacagaccuuaguuga

SEQ ID NO: 177738 - RNA, 19 nt, Homo sapiens
ucacaaccaaugaggaaua

SEQ ID NO: 177739 - RNA, 19 nt, Homo sapiens
ccagaggcauggaguacuu

SEQ ID NO: 177740 - RNA, 19 nt, Homo sapiens
ccaaauaccaaaucucuca

SEQ ID NO: 177741 - RNA, 19 nt, Homo sapiens
gaggagcguugccauucaa

SEQ ID NO: 177742 - RNA, 19 nt, Homo sapiens
ugggagaucuucacuuuag

SEQ ID NO: 177743 - RNA, 19 nt, Homo sapiens
gcaggagcaucgcauugga

SEQ ID NO: 177744 - RNA, 19 nt, Homo sapiens
ugucuccacuuguauauau

SEQ ID NO: 177745 - RNA, 19 nt, Homo sapiens
ugucagagauggagaugau

SEQ ID NO: 177746 - RNA, 19 nt, Homo sapiens
ugaagaacacgaccaagaa

SEQ ID NO: 177747 - RNA, 19 nt, Homo sapiens
caucugacaagggaaauua

SEQ ID NO: 177748 - RNA, 19 nt, Homo sapiens
gcacagcagacuaguuaau

SEQ ID NO: 177749 - RNA, 19 nt, Homo sapiens
ccgugaagauguugaaaga

SEQ ID NO: 177750 - RNA, 19 nt, Homo sapiens
uaacaacacgccucucuuc

SEQ ID NO: 177751 - RNA, 19 nt, Homo sapiens
gaaugaagaacacgaccaa

SEQ ID NO: 177752 - RNA, 19 nt, Homo sapiens
ggguaauucuauugggaua

SEQ ID NO: 177753 - RNA, 19 nt, Homo sapiens
gcaccauacuggaccaaca

SEQ ID NO: 177754 - RNA, 19 nt, Homo sapiens
cagauuagccugauucucu

SEQ ID NO: 177755 - RNA, 19 nt, Homo sapiens
cggaggagacguagaguuu

SEQ ID NO: 177756 - RNA, 19 nt, Homo sapiens
aaaguguggucccaucuga

SEQ ID NO: 177757 - RNA, 19 nt, Homo sapiens
gcacuggagccucauuaug

SEQ ID NO: 177758 - RNA, 19 nt, Homo sapiens
gaaaugauagcagaaugug

SEQ ID NO: 177759 - RNA, 19 nt, Homo sapiens
ggugcuggauguauguaaa

SEQ ID NO: 177760 - RNA, 19 nt, Homo sapiens
guaauucuauugggauauc

SEQ ID NO: 177761 - RNA, 19 nt, Homo sapiens
cauaaacggcaguguuaaa

SEQ ID NO: 177762 - RNA, 19 nt, Homo sapiens
gaguacuccuaugacauua

SEQ ID NO: 177763 - RNA, 19 nt, Homo sapiens
gagaugaugaagaugauug

SEQ ID NO: 177764 - RNA, 19 nt, Homo sapiens
agauggagaugaugaagau

SEQ ID NO: 177765 - RNA, 19 nt, Homo sapiens
ccucaagguucucaagguu

SEQ ID NO: 177766 - RNA, 19 nt, Homo sapiens
cagaagagccaccaaccaa

SEQ ID NO: 177767 - RNA, 19 nt, Homo sapiens
gaaaguuuauggcuucauu

SEQ ID NO: 177768 - RNA, 19 nt, Homo sapiens
ccaaaucucucaaccagaa

SEQ ID NO: 177769 - RNA, 19 nt, Homo sapiens
gaaacccugucucuacuaa

SEQ ID NO: 177770 - RNA, 19 nt, Homo sapiens
ggaccacucuucugcguuu

SEQ ID NO: 177771 - RNA, 19 nt, Homo sapiens
ggccaacacugucaaguuu

SEQ ID NO: 177772 - RNA, 19 nt, Homo sapiens
ccaaugagaucugaaaguu

SEQ ID NO: 177773 - RNA, 19 nt, Homo sapiens
gaaggacacagaauggaua

SEQ ID NO: 177774 - RNA, 19 nt, Homo sapiens
gagccgagaucaugccauu

SEQ ID NO: 177775 - RNA, 19 nt, Homo sapiens
gugaagauguugaaagaug

SEQ ID NO: 177776 - RNA, 19 nt, Homo sapiens
ccagaagcccuguuugaua

SEQ ID NO: 177777 - RNA, 19 nt, Homo sapiens
gaggugcgcugccuguuga

SEQ ID NO: 177778 - RNA, 19 nt, Homo sapiens
gaacuguacaugaugauga

SEQ ID NO: 177779 - RNA, 19 nt, Homo sapiens
ggacaaagagauugagguu

SEQ ID NO: 177780 - RNA, 19 nt, Homo sapiens
gaguuugucugcaagguuu

SEQ ID NO: 177781 - RNA, 19 nt, Homo sapiens
ggagacagguaacaguuuc

SEQ ID NO: 177782 - RNA, 19 nt, Homo sapiens
gggaguacuugcagauaaa

SEQ ID NO: 177783 - RNA, 19 nt, Homo sapiens
gaaggaaggacacagaaug

SEQ ID NO: 177784 - RNA, 19 nt, Homo sapiens
cagaagcccuguuugauag

SEQ ID NO: 177785 - RNA, 19 nt, Homo sapiens
agauugagguucucuauau

SEQ ID NO: 177786 - RNA, 19 nt, Homo sapiens
guagaagacuuggaucgaa

SEQ ID NO: 177787 - RNA, 19 nt, Homo sapiens
gaauacggguccaucaauc

SEQ ID NO: 177788 - RNA, 19 nt, Homo sapiens
guuuauggcuucauugaga

SEQ ID NO: 177789 - RNA, 19 nt, Homo sapiens
gaccaacguucaagcaguu

SEQ ID NO: 177790 - RNA, 19 nt, Homo sapiens
ccaacgaacuguacaugau

SEQ ID NO: 177791 - RNA, 19 nt, Homo sapiens
gaaaauagcagacuuugga

SEQ ID NO: 177792 - RNA, 19 nt, Homo sapiens
gauagccauuuacugcaua

SEQ ID NO: 177793 - RNA, 19 nt, Homo sapiens
gaaaagaacggcaguaaau

SEQ ID NO: 177794 - RNA, 19 nt, Homo sapiens
ugugggagaucuucacuuu

SEQ ID NO: 177795 - RNA, 19 nt, Homo sapiens
gauugagguucucuauauu

SEQ ID NO: 177796 - RNA, 19 nt, Homo sapiens
acaaagagauugagguucu

SEQ ID NO: 177797 - RNA, 19 nt, Homo sapiens
gaggagacguagaguuugu

SEQ ID NO: 177798 - RNA, 19 nt, Homo sapiens
gaagagccaccaaccaaau

SEQ ID NO: 177799 - RNA, 19 nt, Homo sapiens
gaguccagcuccuccauga

SEQ ID NO: 177800 - RNA, 19 nt, Homo sapiens
ggaggagcguugccauuca

SEQ ID NO: 177801 - RNA, 19 nt, Homo sapiens
ugaagauguugaaagauga

SEQ ID NO: 177802 - RNA, 19 nt, Homo sapiens
ucaagcaguugguagaaga

SEQ ID NO: 177803 - RNA, 19 nt, Homo sapiens
caacacgccucucuucaac

SEQ ID NO: 177804 - RNA, 19 nt, Homo sapiens
gaacaguaacaacaagaga

SEQ ID NO: 177805 - RNA, 19 nt, Homo sapiens
ccagaggcauggaguacuu

SEQ ID NO: 177806 - RNA, 19 nt, Homo sapiens
ccaaauaccaaaucucuca

SEQ ID NO: 177807 - RNA, 19 nt, Homo sapiens
ugggagaucuucacuuuag

SEQ ID NO: 177808 - RNA, 19 nt, Homo sapiens
gcaggagcaucgcauugga

SEQ ID NO: 177809 - RNA, 19 nt, Homo sapiens
gaggagcguugccauucaa

SEQ ID NO: 177810 - RNA, 19 nt, Homo sapiens
ugucagagauggagaugau

SEQ ID NO: 177811 - RNA, 19 nt, Homo sapiens
ugaagaacacgaccaagaa

SEQ ID NO: 177812 - RNA, 19 nt, Homo sapiens
caucugacaagggaaauua

SEQ ID NO: 177813 - RNA, 19 nt, Homo sapiens
caaccaaugagaucugaaa

SEQ ID NO: 177814 - RNA, 19 nt, Homo sapiens
ccgugaagauguugaaaga

SEQ ID NO: 177815 - RNA, 19 nt, Homo sapiens
uaacaacacgccucucuuc

SEQ ID NO: 177816 - RNA, 19 nt, Homo sapiens
gaaugaagaacacgaccaa

SEQ ID NO: 177817 - RNA, 19 nt, Homo sapiens
ggguaauucuauugggaua

SEQ ID NO: 177818 - RNA, 19 nt, Homo sapiens
gcaccauacuggaccaaca

SEQ ID NO: 177819 - RNA, 19 nt, Homo sapiens
cggaggagacguagaguuu

SEQ ID NO: 177820 - RNA, 19 nt, Homo sapiens
aaaguguggucccaucuga

SEQ ID NO: 177821 - RNA, 19 nt, Homo sapiens
gcacuggagccucauuaug

SEQ ID NO: 177822 - RNA, 19 nt, Homo sapiens
guaauucuauugggauauc

SEQ ID NO: 177823 - RNA, 19 nt, Homo sapiens
gaguacuccuaugacauua

SEQ ID NO: 177824 - RNA, 19 nt, Homo sapiens
gagaugaugaagaugauug

SEQ ID NO: 177825 - RNA, 19 nt, Homo sapiens
agauggagaugaugaagau

SEQ ID NO: 177826 - RNA, 19 nt, Homo sapiens
cagaagagccaccaaccaa

SEQ ID NO: 177827 - RNA, 19 nt, Homo sapiens
gaucgaauucucacucuca

SEQ ID NO: 177828 - RNA, 19 nt, Homo sapiens
gggaaacacaagaauauca

SEQ ID NO: 177829 - RNA, 19 nt, Homo sapiens
uagaagacuuggaucgaau

SEQ ID NO: 177830 - RNA, 19 nt, Homo sapiens
cgccagagauaucaacaau

SEQ ID NO: 177831 - RNA, 19 nt, Homo sapiens
ggaugggccucucuauguc

SEQ ID NO: 177832 - RNA, 19 nt, Homo sapiens
gcaggagagucacuugaac

SEQ ID NO: 177833 - RNA, 19 nt, Homo sapiens
ugaaagaugaugccacaga

SEQ ID NO: 177834 - RNA, 19 nt, Homo sapiens
gaagaacacgaccaagaag

SEQ ID NO: 177835 - RNA, 19 nt, Homo sapiens
ucugcaagguuuacaguga

SEQ ID NO: 177836 - RNA, 19 nt, Homo sapiens
ggugaaacccugucucuac

SEQ ID NO: 177837 - RNA, 19 nt, Homo sapiens
gaucaugaggucaggaguu

SEQ ID NO: 177838 - RNA, 19 nt, Homo sapiens
gcaguugguagaagacuug

SEQ ID NO: 177839 - RNA, 19 nt, Homo sapiens
ggaaggacacagaauggau

SEQ ID NO: 177840 - RNA, 19 nt, Homo sapiens
ggaaacacaagaauaucau

SEQ ID NO: 177841 - RNA, 19 nt, Homo sapiens
caacgaacuguacaugaug

SEQ ID NO: 177842 - RNA, 19 nt, Homo sapiens
caaugagaucugaaaguuu

SEQ ID NO: 177843 - RNA, 19 nt, Homo sapiens
gauaacaacacgccucucu

SEQ ID NO: 177844 - RNA, 19 nt, Homo sapiens
aaggcaaccuccgagaaua

SEQ ID NO: 177845 - RNA, 19 nt, Homo sapiens
uaaaggcaaccuccgagaa

SEQ ID NO: 177846 - RNA, 19 nt, Homo sapiens
aaugggaguuuccaagaga

SEQ ID NO: 177847 - RNA, 19 nt, Homo sapiens
cauuggaggcuacaaggua

SEQ ID NO: 177848 - RNA, 19 nt, Homo sapiens
guacuccuaugacauuaac

SEQ ID NO: 177849 - RNA, 19 nt, Homo sapiens
cagugggaauugacaaaga

SEQ ID NO: 177850 - RNA, 19 nt, Homo sapiens
gcauaggggucuucuuaau

SEQ ID NO: 177851 - RNA, 19 nt, Homo sapiens
ccugugugguggagaauga

SEQ ID NO: 177852 - RNA, 19 nt, Homo sapiens
gagaacaguaacaacaaga

SEQ ID NO: 177853 - RNA, 19 nt, Homo sapiens
cagugaaacuugguacuuc

SEQ ID NO: 177854 - RNA, 19 nt, Homo sapiens
cgaggcaggcggaucauga

SEQ ID NO: 177855 - RNA, 19 nt, Homo sapiens
gagauggagaugaugaaga

SEQ ID NO: 177856 - RNA, 19 nt, Homo sapiens
gagcguugccauucaagug

SEQ ID NO: 177857 - RNA, 19 nt, Homo sapiens
cgaauucucacucucacaa

SEQ ID NO: 177858 - RNA, 19 nt, Homo sapiens
caacugcaccaacgaacug

SEQ ID NO: 177859 - RNA, 19 nt, Homo sapiens
aguugaggauaccacauua

SEQ ID NO: 177860 - RNA, 19 nt, Homo sapiens
ugaagaugauugggaaaca

SEQ ID NO: 177861 - RNA, 19 nt, Homo sapiens
cggaagcagugggaauuga

SEQ ID NO: 177862 - RNA, 19 nt, Homo sapiens
ggggaguacuugcagauaa

SEQ ID NO: 177863 - RNA, 19 nt, Homo sapiens
ccaaccaaauaccaaaucu

SEQ ID NO: 177864 - RNA, 19 nt, Homo sapiens
gugaaacccugucucuacu

SEQ ID NO: 177865 - RNA, 19 nt, Homo sapiens
gaagaugauugggaaacac

SEQ ID NO: 177866 - RNA, 19 nt, Homo sapiens
ccacggacaaagagauuga

SEQ ID NO: 177867 - RNA, 19 nt, Homo sapiens
gaaaguuuauggcuucauu

SEQ ID NO: 177868 - RNA, 19 nt, Homo sapiens
ccaaaucucucaaccagaa

SEQ ID NO: 177869 - RNA, 19 nt, Homo sapiens
gaaacccugucucuacuaa

SEQ ID NO: 177870 - RNA, 19 nt, Homo sapiens
ggaccacucuucugcguuu

SEQ ID NO: 177871 - RNA, 19 nt, Homo sapiens
ggccaacacugucaaguuu

SEQ ID NO: 177872 - RNA, 19 nt, Homo sapiens
ccaaugagaucugaaaguu

SEQ ID NO: 177873 - RNA, 19 nt, Homo sapiens
gaaggacacagaauggaua

SEQ ID NO: 177874 - RNA, 19 nt, Homo sapiens
gagccgagaucaugccauu

SEQ ID NO: 177875 - RNA, 19 nt, Homo sapiens
gcaagcgccuggaagagaa

SEQ ID NO: 177876 - RNA, 19 nt, Homo sapiens
gugaagauguugaaagaug

SEQ ID NO: 177877 - RNA, 19 nt, Homo sapiens
ccagaagcccuguuugaua

SEQ ID NO: 177878 - RNA, 19 nt, Homo sapiens
gaggugcgcugccuguuga

SEQ ID NO: 177879 - RNA, 19 nt, Homo sapiens
gaacuguacaugaugauga

SEQ ID NO: 177880 - RNA, 19 nt, Homo sapiens
gaguuugucugcaagguuu

SEQ ID NO: 177881 - RNA, 19 nt, Homo sapiens
ggagacagguaacaguuuc

SEQ ID NO: 177882 - RNA, 19 nt, Homo sapiens
gggaguacuugcagauaaa

SEQ ID NO: 177883 - RNA, 19 nt, Homo sapiens
gaaggaaggacacagaaug

SEQ ID NO: 177884 - RNA, 19 nt, Homo sapiens
cagaagcccuguuugauag

SEQ ID NO: 177885 - RNA, 19 nt, Homo sapiens
guagaagacuuggaucgaa

SEQ ID NO: 177886 - RNA, 19 nt, Homo sapiens
gaauacggguccaucaauc

SEQ ID NO: 177887 - RNA, 19 nt, Homo sapiens
guuuauggcuucauugaga

SEQ ID NO: 177888 - RNA, 19 nt, Homo sapiens
gaccaacguucaagcaguu

SEQ ID NO: 177889 - RNA, 19 nt, Homo sapiens
ccaacgaacuguacaugau

SEQ ID NO: 177890 - RNA, 19 nt, Homo sapiens
gaaaauagcagacuuugga

SEQ ID NO: 177891 - RNA, 19 nt, Homo sapiens
gauagccauuuacugcaua

SEQ ID NO: 177892 - RNA, 19 nt, Homo sapiens
gaaaagaacggcaguaaau

SEQ ID NO: 177893 - RNA, 19 nt, Homo sapiens
ugugggagaucuucacuuu

SEQ ID NO: 177894 - RNA, 19 nt, Homo sapiens
gaggagacguagaguuugu

SEQ ID NO: 177895 - RNA, 19 nt, Homo sapiens
gaagagccaccaaccaaau

SEQ ID NO: 177896 - RNA, 19 nt, Homo sapiens
gaguccagcuccuccauga

SEQ ID NO: 177897 - RNA, 19 nt, Homo sapiens
ggaggagcguugccauuca

SEQ ID NO: 177898 - RNA, 19 nt, Homo sapiens
ugaagauguugaaagauga

SEQ ID NO: 177899 - RNA, 19 nt, Homo sapiens
ucaagcaguugguagaaga

SEQ ID NO: 177900 - RNA, 19 nt, Homo sapiens
caacacgccucucuucaac

SEQ ID NO: 177901 - RNA, 19 nt, Homo sapiens
gaacaguaacaacaagaga

SEQ ID NO: 177902 - RNA, 19 nt, Homo sapiens
ccagaggcauggaguacuu

SEQ ID NO: 177903 - RNA, 19 nt, Homo sapiens
ccaaauaccaaaucucuca

SEQ ID NO: 177904 - RNA, 19 nt, Homo sapiens
ugggagaucuucacuuuag

SEQ ID NO: 177905 - RNA, 19 nt, Homo sapiens
gaggagcguugccauucaa

SEQ ID NO: 177906 - RNA, 19 nt, Homo sapiens
gcaggagcaucgcauugga

SEQ ID NO: 177907 - RNA, 19 nt, Homo sapiens
ugucagagauggagaugau

SEQ ID NO: 177908 - RNA, 19 nt, Homo sapiens
ugaagaacacgaccaagaa

SEQ ID NO: 177909 - RNA, 19 nt, Homo sapiens
caucugacaagggaaauua

SEQ ID NO: 177910 - RNA, 19 nt, Homo sapiens
caaccaaugagaucugaaa

SEQ ID NO: 177911 - RNA, 19 nt, Homo sapiens
ccgugaagauguugaaaga

SEQ ID NO: 177912 - RNA, 19 nt, Homo sapiens
uaacaacacgccucucuuc

SEQ ID NO: 177913 - RNA, 19 nt, Homo sapiens
gaaugaagaacacgaccaa

SEQ ID NO: 177914 - RNA, 19 nt, Homo sapiens
gcaccauacuggaccaaca

SEQ ID NO: 177915 - RNA, 19 nt, Homo sapiens
cggaggagacguagaguuu

SEQ ID NO: 177916 - RNA, 19 nt, Homo sapiens
aaaguguggucccaucuga

SEQ ID NO: 177917 - RNA, 19 nt, Homo sapiens
gcacuggagccucauuaug

SEQ ID NO: 177918 - RNA, 19 nt, Homo sapiens
gaguacuccuaugacauua

SEQ ID NO: 177919 - RNA, 19 nt, Homo sapiens
gagaugaugaagaugauug

SEQ ID NO: 177920 - RNA, 19 nt, Homo sapiens
agauggagaugaugaagau

SEQ ID NO: 177921 - RNA, 19 nt, Homo sapiens
cagaagagccaccaaccaa

SEQ ID NO: 177922 - RNA, 19 nt, Homo sapiens
gaucgaauucucacucuca

SEQ ID NO: 177923 - RNA, 19 nt, Homo sapiens
gggaaacacaagaauauca

SEQ ID NO: 177924 - RNA, 19 nt, Homo sapiens
uagaagacuuggaucgaau

SEQ ID NO: 177925 - RNA, 19 nt, Homo sapiens
cgccagagauaucaacaau

SEQ ID NO: 177926 - RNA, 19 nt, Homo sapiens
ggaugggccucucuauguc

SEQ ID NO: 177927 - RNA, 19 nt, Homo sapiens
gcaggagagucacuugaac

SEQ ID NO: 177928 - RNA, 19 nt, Homo sapiens
ugaaagaugaugccacaga

SEQ ID NO: 177929 - RNA, 19 nt, Homo sapiens
gaagaacacgaccaagaag

SEQ ID NO: 177930 - RNA, 19 nt, Homo sapiens
ucugcaagguuuacaguga

SEQ ID NO: 177931 - RNA, 19 nt, Homo sapiens
ggugaaacccugucucuac

SEQ ID NO: 177932 - RNA, 19 nt, Homo sapiens
gaucaugaggucaggaguu

SEQ ID NO: 177933 - RNA, 19 nt, Homo sapiens
gcaguugguagaagacuug

SEQ ID NO: 177934 - RNA, 19 nt, Homo sapiens
ggaaggacacagaauggau

SEQ ID NO: 177935 - RNA, 19 nt, Homo sapiens
ggaaacacaagaauaucau

SEQ ID NO: 177936 - RNA, 19 nt, Homo sapiens
caacgaacuguacaugaug

SEQ ID NO: 177937 - RNA, 19 nt, Homo sapiens
caaugagaucugaaaguuu

SEQ ID NO: 177938 - RNA, 19 nt, Homo sapiens
gauaacaacacgccucucu

SEQ ID NO: 177939 - RNA, 19 nt, Homo sapiens
aaggcaaccuccgagaaua

SEQ ID NO: 177940 - RNA, 19 nt, Homo sapiens
uaaaggcaaccuccgagaa

SEQ ID NO: 177941 - RNA, 19 nt, Homo sapiens
aaugggaguuuccaagaga

SEQ ID NO: 177942 - RNA, 19 nt, Homo sapiens
cauuggaggcuacaaggua

SEQ ID NO: 177943 - RNA, 19 nt, Homo sapiens
guacuccuaugacauuaac

SEQ ID NO: 177944 - RNA, 19 nt, Homo sapiens
cagugggaauugacaaaga

SEQ ID NO: 177945 - RNA, 19 nt, Homo sapiens
gcauaggggucuucuuaau

SEQ ID NO: 177946 - RNA, 19 nt, Homo sapiens
ccugugugguggagaauga

SEQ ID NO: 177947 - RNA, 19 nt, Homo sapiens
gagaacaguaacaacaaga

SEQ ID NO: 177948 - RNA, 19 nt, Homo sapiens
cagugaaacuugguacuuc

SEQ ID NO: 177949 - RNA, 19 nt, Homo sapiens
cgaggcaggcggaucauga

SEQ ID NO: 177950 - RNA, 19 nt, Homo sapiens
gagauggagaugaugaaga

SEQ ID NO: 177951 - RNA, 19 nt, Homo sapiens
gagcguugccauucaagug

SEQ ID NO: 177952 - RNA, 19 nt, Homo sapiens
cgaauucucacucucacaa

SEQ ID NO: 177953 - RNA, 19 nt, Homo sapiens
caacugcaccaacgaacug

SEQ ID NO: 177954 - RNA, 19 nt, Homo sapiens
ugaagaugauugggaaaca

SEQ ID NO: 177955 - RNA, 19 nt, Homo sapiens
cggaagcagugggaauuga

SEQ ID NO: 177956 - RNA, 19 nt, Homo sapiens
aguugaggauaccacauua

SEQ ID NO: 177957 - RNA, 19 nt, Homo sapiens
ggggaguacuugcagauaa

SEQ ID NO: 177958 - RNA, 19 nt, Homo sapiens
ccaaccaaauaccaaaucu

SEQ ID NO: 177959 - RNA, 19 nt, Homo sapiens
gugaaacccugucucuacu

SEQ ID NO: 177960 - RNA, 19 nt, Homo sapiens
gaagaugauugggaaacac

SEQ ID NO: 177961 - RNA, 19 nt, Homo sapiens
gaaaguguggucccaucug

SEQ ID NO: 177962 - RNA, 19 nt, Homo sapiens
ugagaacaguaacaacaag

SEQ ID NO: 177963 - RNA, 19 nt, Homo sapiens
cgacagagcgagacuccau

SEQ ID NO: 177964 - RNA, 19 nt, Homo sapiens
agacuuggaucgaauucuc

SEQ ID NO: 177965 - RNA, 19 nt, Homo sapiens
acaaagacaagcccaagga

SEQ ID NO: 177966 - RNA, 19 nt, Homo sapiens
gcuccuccaugaacuccaa

SEQ ID NO: 177967 - RNA, 19 nt, Homo sapiens
ggacagaccuuaguugaaa

SEQ ID NO: 177968 - RNA, 19 nt, Homo sapiens
gaccuuaguugaaaugaua

SEQ ID NO: 177969 - RNA, 19 nt, Homo sapiens
gagcacaaaugcaguauau

SEQ ID NO: 177970 - RNA, 19 nt, Homo sapiens
cagcauauguguaaagauu

SEQ ID NO: 177971 - RNA, 19 nt, Homo sapiens
gaacaguauucaccuaguu

SEQ ID NO: 177972 - RNA, 19 nt, Homo sapiens
ggaccacucuucugcguuu

SEQ ID NO: 177973 - RNA, 19 nt, Homo sapiens
guaaucagcauauguguaa

SEQ ID NO: 177974 - RNA, 19 nt, Homo sapiens
ggccaacacugucaaguuu

SEQ ID NO: 177975 - RNA, 19 nt, Homo sapiens
ggaaacacccacucacuuu

SEQ ID NO: 177976 - RNA, 19 nt, Homo sapiens
ggacagcacugggaaccua

SEQ ID NO: 177977 - RNA, 19 nt, Homo sapiens
aaagaugccuuaauccauu

SEQ ID NO: 177978 - RNA, 19 nt, Homo sapiens
gcaagaugaaugcagauua

SEQ ID NO: 177979 - RNA, 19 nt, Homo sapiens
cagcacagcagacuaguua

SEQ ID NO: 177980 - RNA, 19 nt, Homo sapiens
guauauaggugcuggaugu

SEQ ID NO: 177981 - RNA, 19 nt, Homo sapiens
gcacaaaugcaguauauag

SEQ ID NO: 177982 - RNA, 19 nt, Homo sapiens
gaaggacacagaauggaua

SEQ ID NO: 177983 - RNA, 19 nt, Homo sapiens
uaacuggacuucccaagau

SEQ ID NO: 177984 - RNA, 19 nt, Homo sapiens
gcaagcgccuggaagagaa

SEQ ID NO: 177985 - RNA, 19 nt, Homo sapiens
gcuaaaugcuguucuuaca

SEQ ID NO: 177986 - RNA, 19 nt, Homo sapiens
gugaagauguugaaagaug

SEQ ID NO: 177987 - RNA, 19 nt, Homo sapiens
ggauugcuuucaucuaauu

SEQ ID NO: 177988 - RNA, 19 nt, Homo sapiens
auaggaagguguuucauuu

SEQ ID NO: 177989 - RNA, 19 nt, Homo sapiens
ccagaagcccuguuugaua

SEQ ID NO: 177990 - RNA, 19 nt, Homo sapiens
gaucagaggaguaaauaau

SEQ ID NO: 177991 - RNA, 19 nt, Homo sapiens
gaacuguacaugaugauga

SEQ ID NO: 177992 - RNA, 19 nt, Homo sapiens
gaguuugucugcaagguuu

SEQ ID NO: 177993 - RNA, 19 nt, Homo sapiens
ggaaaaugguauaacguua

SEQ ID NO: 177994 - RNA, 19 nt, Homo sapiens
caauagccgugcaagauga

SEQ ID NO: 177995 - RNA, 19 nt, Homo sapiens
gaaggaaggacacagaaug

SEQ ID NO: 177996 - RNA, 19 nt, Homo sapiens
cagaagcccuguuugauag

SEQ ID NO: 177997 - RNA, 19 nt, Homo sapiens
uuaaauggaugucccaaug

SEQ ID NO: 177998 - RNA, 19 nt, Homo sapiens
ucagaggaguaaauaauug

SEQ ID NO: 177999 - RNA, 19 nt, Homo sapiens
guagaagacuuggaucgaa

SEQ ID NO: 178000 - RNA, 19 nt, Homo sapiens
gaauacggguccaucaauc

SEQ ID NO: 178001 - RNA, 19 nt, Homo sapiens
gccaaccucucgaacagua

SEQ ID NO: 178002 - RNA, 19 nt, Homo sapiens
gaaugcagauuacacugau

SEQ ID NO: 178003 - RNA, 19 nt, Homo sapiens
caagaugaaugcagauuac

SEQ ID NO: 178004 - RNA, 19 nt, Homo sapiens
gaccaacguucaagcaguu

SEQ ID NO: 178005 - RNA, 19 nt, Homo sapiens
ccaacgaacuguacaugau

SEQ ID NO: 178006 - RNA, 19 nt, Homo sapiens
gaaaauagcagacuuugga

SEQ ID NO: 178007 - RNA, 19 nt, Homo sapiens
gauagccauuuacugcaua

SEQ ID NO: 178008 - RNA, 19 nt, Homo sapiens
gaaaagaacggcaguaaau

SEQ ID NO: 178009 - RNA, 19 nt, Homo sapiens
cagacuaguuaaucuauug

SEQ ID NO: 178010 - RNA, 19 nt, Homo sapiens
uaaaugcuguucuuacaca

SEQ ID NO: 178011 - RNA, 19 nt, Homo sapiens
ugugggagaucuucacuuu

SEQ ID NO: 178012 - RNA, 19 nt, Homo sapiens
gcagacuaguuaaucuauu

SEQ ID NO: 178013 - RNA, 19 nt, Homo sapiens
cacauaaacggcaguguua

SEQ ID NO: 178014 - RNA, 19 nt, Homo sapiens
gaggagacguagaguuugu

SEQ ID NO: 178015 - RNA, 19 nt, Homo sapiens
auaaaugucacgcaacuua

SEQ ID NO: 178016 - RNA, 19 nt, Homo sapiens
cuucugaguugcacauuaa

SEQ ID NO: 178017 - RNA, 19 nt, Homo sapiens
guaccagcguccucuuaaa

SEQ ID NO: 178018 - RNA, 19 nt, Homo sapiens
ggaggagcguugccauuca

SEQ ID NO: 178019 - RNA, 19 nt, Homo sapiens
gaguccagcuccuccauga

SEQ ID NO: 178020 - RNA, 19 nt, Homo sapiens
caaaagauccagccucaua

SEQ ID NO: 178021 - RNA, 19 nt, Homo sapiens
ugaagauguugaaagauga

SEQ ID NO: 178022 - RNA, 19 nt, Homo sapiens
agggauugcuuucaucuaa

SEQ ID NO: 178023 - RNA, 19 nt, Homo sapiens
ggacuucccaagauaaaug

SEQ ID NO: 178024 - RNA, 19 nt, Homo sapiens
aaccaugccuuccucagua

SEQ ID NO: 178025 - RNA, 19 nt, Homo sapiens
ucaagcaguugguagaaga

SEQ ID NO: 178026 - RNA, 19 nt, Homo sapiens
caacacgccucucuucaac

SEQ ID NO: 178027 - RNA, 19 nt, Homo sapiens
gaacaguaacaacaagaga

SEQ ID NO: 178028 - RNA, 19 nt, Homo sapiens
gcaauagccgugcaagaug

SEQ ID NO: 178029 - RNA, 19 nt, Homo sapiens
gaaacacccacucacuuug

SEQ ID NO: 178030 - RNA, 19 nt, Homo sapiens
gcuucugaguugcacauua

SEQ ID NO: 178031 - RNA, 19 nt, Homo sapiens
gaggacagaccuuaguuga

SEQ ID NO: 178032 - RNA, 19 nt, Homo sapiens
ucacaaccaaugaggaaua

SEQ ID NO: 178033 - RNA, 19 nt, Homo sapiens
ccagaggcauggaguacuu

SEQ ID NO: 178034 - RNA, 19 nt, Homo sapiens
gaggagcguugccauucaa

SEQ ID NO: 178035 - RNA, 19 nt, Homo sapiens
ugggagaucuucacuuuag

SEQ ID NO: 178036 - RNA, 19 nt, Homo sapiens
gcaggagcaucgcauugga

SEQ ID NO: 178037 - RNA, 19 nt, Homo sapiens
ugucuccacuuguauauau

SEQ ID NO: 178038 - RNA, 19 nt, Homo sapiens
ugucagagauggagaugau

SEQ ID NO: 178039 - RNA, 19 nt, Homo sapiens
ugaagaacacgaccaagaa

SEQ ID NO: 178040 - RNA, 19 nt, Homo sapiens
caucugacaagggaaauua

SEQ ID NO: 178041 - RNA, 19 nt, Homo sapiens
gcacagcagacuaguuaau

SEQ ID NO: 178042 - RNA, 19 nt, Homo sapiens
ccgugaagauguugaaaga

SEQ ID NO: 178043 - RNA, 19 nt, Homo sapiens
uaacaacacgccucucuuc

SEQ ID NO: 178044 - RNA, 19 nt, Homo sapiens
gaaugaagaacacgaccaa

SEQ ID NO: 178045 - RNA, 19 nt, Homo sapiens
gcaccauacuggaccaaca

SEQ ID NO: 178046 - RNA, 19 nt, Homo sapiens
cggaggagacguagaguuu

SEQ ID NO: 178047 - RNA, 19 nt, Homo sapiens
aaaguguggucccaucuga

SEQ ID NO: 178048 - RNA, 19 nt, Homo sapiens
gcacuggagccucauuaug

SEQ ID NO: 178049 - RNA, 19 nt, Homo sapiens
gaaaugauagcagaaugug

SEQ ID NO: 178050 - RNA, 19 nt, Homo sapiens
ggugcuggauguauguaaa

SEQ ID NO: 178051 - RNA, 19 nt, Homo sapiens
cauaaacggcaguguuaaa

SEQ ID NO: 178052 - RNA, 19 nt, Homo sapiens
gaguacuccuaugacauua

SEQ ID NO: 178053 - RNA, 19 nt, Homo sapiens
gagaugaugaagaugauug

SEQ ID NO: 178054 - RNA, 19 nt, Homo sapiens
agauggagaugaugaagau

SEQ ID NO: 178055 - RNA, 19 nt, Homo sapiens
ucaagucccaucauagaaa

SEQ ID NO: 178056 - RNA, 19 nt, Homo sapiens
cguucugccuuccuuguua

SEQ ID NO: 178057 - RNA, 19 nt, Homo sapiens
gccacaagccaccauguaa

SEQ ID NO: 178058 - RNA, 19 nt, Homo sapiens
gaaccaugccuuccucagu

SEQ ID NO: 178059 - RNA, 19 nt, Homo sapiens
gaucgaauucucacucuca

SEQ ID NO: 178060 - RNA, 19 nt, Homo sapiens
gggaaacacaagaauauca

SEQ ID NO: 178061 - RNA, 19 nt, Homo sapiens
aaagaacucauucauagga

SEQ ID NO: 178062 - RNA, 19 nt, Homo sapiens
uagaagacuuggaucgaau

SEQ ID NO: 178063 - RNA, 19 nt, Homo sapiens
cgccagagauaucaacaau

SEQ ID NO: 178064 - RNA, 19 nt, Homo sapiens
ggaugggccucucuauguc

SEQ ID NO: 178065 - RNA, 19 nt, Homo sapiens
uuuaaaugcugcugucaga

SEQ ID NO: 178066 - RNA, 19 nt, Homo sapiens
uauaggugcuggauguaug

SEQ ID NO: 178067 - RNA, 19 nt, Homo sapiens
ccaaaucucucaaccagaa

SEQ ID NO: 178068 - RNA, 19 nt, Homo sapiens
ggaccacucuucugcguuu

SEQ ID NO: 178069 - RNA, 19 nt, Homo sapiens
ggccaacacugucaaguuu

SEQ ID NO: 178070 - RNA, 19 nt, Homo sapiens
gaggugcgcugccuguuga

SEQ ID NO: 178071 - RNA, 19 nt, Homo sapiens
ggacaaagagauugagguu

SEQ ID NO: 178072 - RNA, 19 nt, Homo sapiens
gaguuugucugcaagguuu

SEQ ID NO: 178073 - RNA, 19 nt, Homo sapiens
gggaguacuugcagauaaa

SEQ ID NO: 178074 - RNA, 19 nt, Homo sapiens
agauugagguucucuauau

SEQ ID NO: 178075 - RNA, 19 nt, Homo sapiens
gaauacggguccaucaauc

SEQ ID NO: 178076 - RNA, 19 nt, Homo sapiens
gaaaagaacggcaguaaau

SEQ ID NO: 178077 - RNA, 19 nt, Homo sapiens
gauugagguucucuauauu

SEQ ID NO: 178078 - RNA, 19 nt, Homo sapiens
acaaagagauugagguucu

SEQ ID NO: 178079 - RNA, 19 nt, Homo sapiens
gaggagacguagaguuugu

SEQ ID NO: 178080 - RNA, 19 nt, Homo sapiens
gaagagccaccaaccaaau

SEQ ID NO: 178081 - RNA, 19 nt, Homo sapiens
ggaggagcguugccauuca

SEQ ID NO: 178082 - RNA, 19 nt, Homo sapiens
gaacaguaacaacaagaga

SEQ ID NO: 178083 - RNA, 19 nt, Homo sapiens
ccaaauaccaaaucucuca

SEQ ID NO: 178084 - RNA, 19 nt, Homo sapiens
gcaggagcaucgcauugga

SEQ ID NO: 178085 - RNA, 19 nt, Homo sapiens
gaggagcguugccauucaa

SEQ ID NO: 178086 - RNA, 19 nt, Homo sapiens
caucugacaagggaaauua

SEQ ID NO: 178087 - RNA, 19 nt, Homo sapiens
caccgcagcugaaggcauu

SEQ ID NO: 178088 - RNA, 19 nt, Homo sapiens
ggguaauucuauugggaua

SEQ ID NO: 178089 - RNA, 19 nt, Homo sapiens
gggaaauuauaccugugua

SEQ ID NO: 178090 - RNA, 19 nt, Homo sapiens
gcaccauacuggaccaaca

SEQ ID NO: 178091 - RNA, 19 nt, Homo sapiens
cggaggagacguagaguuu

SEQ ID NO: 178092 - RNA, 19 nt, Homo sapiens
gaaauuauaccuguguagu

SEQ ID NO: 178093 - RNA, 19 nt, Homo sapiens
aaaguguggucccaucuga

SEQ ID NO: 178094 - RNA, 19 nt, Homo sapiens
gcacuggagccucauuaug

SEQ ID NO: 178095 - RNA, 19 nt, Homo sapiens
guaauucuauugggauauc

SEQ ID NO: 178096 - RNA, 19 nt, Homo sapiens
cagaagagccaccaaccaa

SEQ ID NO: 178097 - RNA, 19 nt, Homo sapiens
ucugcaagguuuacaguga

SEQ ID NO: 178098 - RNA, 19 nt, Homo sapiens
cauuggaggcuacaaggua

SEQ ID NO: 178099 - RNA, 19 nt, Homo sapiens
gagaacaguaacaacaaga

SEQ ID NO: 178100 - RNA, 19 nt, Homo sapiens
cagugaaacuugguacuuc

SEQ ID NO: 178101 - RNA, 19 nt, Homo sapiens
gagcguugccauucaagug

SEQ ID NO: 178102 - RNA, 19 nt, Homo sapiens
ggggaguacuugcagauaa

SEQ ID NO: 178103 - RNA, 19 nt, Homo sapiens
ccaaccaaauaccaaaucu

SEQ ID NO: 178104 - RNA, 19 nt, Homo sapiens
aguugaggauaccacauua

SEQ ID NO: 178105 - RNA, 19 nt, Homo sapiens
ccacggacaaagagauuga

SEQ ID NO: 178106 - RNA, 19 nt, Homo sapiens
gaaaguguggucccaucug

SEQ ID NO: 178107 - RNA, 19 nt, Homo sapiens
ugagaacaguaacaacaag

SEQ ID NO: 178108 - RNA, 19 nt, Homo sapiens
cgccaagccugaguccuuu

SEQ ID NO: 178109 - RNA, 19 nt, Homo sapiens
cagcacuggagccucauua

SEQ ID NO: 178110 - RNA, 19 nt, Homo sapiens
caacaagagagcaccauac

SEQ ID NO: 178111 - RNA, 19 nt, Homo sapiens
aaagaacggcaguaaauac

SEQ ID NO: 178112 - RNA, 19 nt, Homo sapiens
ggaaaagaacggcaguaaa

SEQ ID NO: 178113 - RNA, 19 nt, Homo sapiens
ggaaauuauaccuguguag

SEQ ID NO: 178114 - RNA, 19 nt, Homo sapiens
ccaccaaccaaauaccaaa

SEQ ID NO: 178115 - RNA, 19 nt, Homo sapiens
ccuguguaguggagaauga

SEQ ID NO: 178116 - RNA, 19 nt, Homo sapiens
aacaauaggacagugcuua

SEQ ID NO: 178117 - RNA, 19 nt, Homo sapiens
gugaucaguuggacuaagg

SEQ ID NO: 178118 - RNA, 19 nt, Homo sapiens
ggaacccaaugccaaccau

SEQ ID NO: 178119 - RNA, 19 nt, Homo sapiens
gugagaacaguaacaacaa

SEQ ID NO: 178120 - RNA, 19 nt, Homo sapiens
aagagccaccaaccaaaua

SEQ ID NO: 178121 - RNA, 19 nt, Homo sapiens
cuauugggauauccuuuca

SEQ ID NO: 178122 - RNA, 19 nt, Homo sapiens
ggaggagacguagaguuug

SEQ ID NO: 178123 - RNA, 19 nt, Homo sapiens
acacguaccaccuggaugu

SEQ ID NO: 178124 - RNA, 19 nt, Homo sapiens
ugaauacggguccaucaau

SEQ ID NO: 178125 - RNA, 19 nt, Homo sapiens
uaacaccacggacaaagag

SEQ ID NO: 178126 - RNA, 19 nt, Homo sapiens
ucaagcacguggaaaagaa

SEQ ID NO: 178127 - RNA, 19 nt, Homo sapiens
ucugacaagggaaauuaua

SEQ ID NO: 178128 - RNA, 19 nt, Homo sapiens
acaacaagagagcaccaua

SEQ ID NO: 178129 - RNA, 19 nt, Homo sapiens
ccgauggugcggaagauuu

SEQ ID NO: 178130 - RNA, 19 nt, Homo sapiens
gccgugaucaguuggacua

SEQ ID NO: 178131 - RNA, 19 nt, Homo sapiens
auacgugcuuggcggguaa

SEQ ID NO: 178132 - RNA, 19 nt, Homo sapiens
cggaagauuuugucaguga

SEQ ID NO: 178133 - RNA, 19 nt, Homo sapiens
ccaacacugucaaguuucg

SEQ ID NO: 178134 - RNA, 19 nt, Homo sapiens
cauacuggaccaacacaga

SEQ ID NO: 178135 - RNA, 19 nt, Homo sapiens
agaagagccaccaaccaaa

SEQ ID NO: 178136 - RNA, 19 nt, Homo sapiens
cguaccaccuggauguugu

SEQ ID NO: 178137 - RNA, 19 nt, Homo sapiens
gaggcuacaagguacgaaa

SEQ ID NO: 178138 - RNA, 19 nt, Homo sapiens
gacccaaggaccacucuuc

SEQ ID NO: 178139 - RNA, 19 nt, Homo sapiens
gcggaggagcguugccauu

SEQ ID NO: 178140 - RNA, 19 nt, Homo sapiens
ggucggaggagacguagag

SEQ ID NO: 178141 - RNA, 19 nt, Homo sapiens
ggaaaguguggucccaucu

SEQ ID NO: 178142 - RNA, 19 nt, Homo sapiens
ucaguuuaguugaggauac

SEQ ID NO: 178143 - RNA, 19 nt, Homo sapiens
ccggagaugaugaggauga

SEQ ID NO: 178144 - RNA, 19 nt, Homo sapiens
acaauaggacagugcuuau

SEQ ID NO: 178145 - RNA, 19 nt, Homo sapiens
ccacauuagagccagaaga

SEQ ID NO: 178146 - RNA, 19 nt, Homo sapiens
ugggauauccuuucacucu

SEQ ID NO: 178147 - RNA, 19 nt, Homo sapiens
guguaguggagaaugaaua

SEQ ID NO: 178148 - RNA, 19 nt, Homo sapiens
ucagugagaacaguaacaa

SEQ ID NO: 178149 - RNA, 19 nt, Homo sapiens
uaguugaggauaccacauu

SEQ ID NO: 178150 - RNA, 19 nt, Homo sapiens
ugaggacgcuggggaauau

SEQ ID NO: 178151 - RNA, 19 nt, Homo sapiens
aagccugaguccuuucuuc

SEQ ID NO: 178152 - RNA, 19 nt, Homo sapiens
cacuggagccucauuaugg

SEQ ID NO: 178153 - RNA, 19 nt, Homo sapiens
gcuacaagguacgaaacca

SEQ ID NO: 178154 - RNA, 19 nt, Homo sapiens
aaaagaacggcaguaaaua

SEQ ID NO: 178155 - RNA, 19 nt, Homo sapiens
ggaucaagcacguggaaaa

SEQ ID NO: 178156 - RNA, 19 nt, Homo sapiens
acguagaguuugucugcaa

SEQ ID NO: 178157 - RNA, 19 nt, Homo sapiens
aaauuauaccuguguagug

SEQ ID NO: 178158 - RNA, 19 nt, Homo sapiens
acuggagccucauuaugga

SEQ ID NO: 178159 - RNA, 19 nt, Homo sapiens
gaaggcauugcgcguaguc

SEQ ID NO: 178160 - RNA, 19 nt, Homo sapiens
cggccaacacugucaaguu

SEQ ID NO: 178161 - RNA, 19 nt, Homo sapiens
ccacucuucugcguuugga

SEQ ID NO: 178162 - RNA, 19 nt, Homo sapiens
caaauaccaaaucucucaa

SEQ ID NO: 178163 - RNA, 19 nt, Homo sapiens
cugcaagguuuacagugau

SEQ ID NO: 178164 - RNA, 19 nt, Homo sapiens
ggagccucauuauggaaag

SEQ ID NO: 178165 - RNA, 19 nt, Homo sapiens
uaagcaggagcaucgcauu

SEQ ID NO: 178166 - RNA, 19 nt, Homo sapiens
gcuuggcggguaauucuau

SEQ ID NO: 178167 - RNA, 19 nt, Homo sapiens
ggacagaccuuaguugaaa

SEQ ID NO: 178168 - RNA, 19 nt, Homo sapiens
gaccuuaguugaaaugaua

SEQ ID NO: 178169 - RNA, 19 nt, Homo sapiens
gagcacaaaugcaguauau

SEQ ID NO: 178170 - RNA, 19 nt, Homo sapiens
cagcauauguguaaagauu

SEQ ID NO: 178171 - RNA, 19 nt, Homo sapiens
ccaaaucucucaaccagaa

SEQ ID NO: 178172 - RNA, 19 nt, Homo sapiens
gaacaguauucaccuaguu

SEQ ID NO: 178173 - RNA, 19 nt, Homo sapiens
ggaccacucuucugcguuu

SEQ ID NO: 178174 - RNA, 19 nt, Homo sapiens
guaaucagcauauguguaa

SEQ ID NO: 178175 - RNA, 19 nt, Homo sapiens
ggccaacacugucaaguuu

SEQ ID NO: 178176 - RNA, 19 nt, Homo sapiens
ggaaacacccacucacuuu

SEQ ID NO: 178177 - RNA, 19 nt, Homo sapiens
ggacagcacugggaaccua

SEQ ID NO: 178178 - RNA, 19 nt, Homo sapiens
aaagaugccuuaauccauu

SEQ ID NO: 178179 - RNA, 19 nt, Homo sapiens
gcaagaugaaugcagauua

SEQ ID NO: 178180 - RNA, 19 nt, Homo sapiens
cagcacagcagacuaguua

SEQ ID NO: 178181 - RNA, 19 nt, Homo sapiens
guauauaggugcuggaugu

SEQ ID NO: 178182 - RNA, 19 nt, Homo sapiens
gcacaaaugcaguauauag

SEQ ID NO: 178183 - RNA, 19 nt, Homo sapiens
gaaggacacagaauggaua

SEQ ID NO: 178184 - RNA, 19 nt, Homo sapiens
uaacuggacuucccaagau

SEQ ID NO: 178185 - RNA, 19 nt, Homo sapiens
gcuaaaugcuguucuuaca

SEQ ID NO: 178186 - RNA, 19 nt, Homo sapiens
gugaagauguugaaagaug

SEQ ID NO: 178187 - RNA, 19 nt, Homo sapiens
ggauugcuuucaucuaauu

SEQ ID NO: 178188 - RNA, 19 nt, Homo sapiens
auaggaagguguuucauuu

SEQ ID NO: 178189 - RNA, 19 nt, Homo sapiens
ccagaagcccuguuugaua

SEQ ID NO: 178190 - RNA, 19 nt, Homo sapiens
gaggugcgcugccuguuga

SEQ ID NO: 178191 - RNA, 19 nt, Homo sapiens
gaucagaggaguaaauaau

SEQ ID NO: 178192 - RNA, 19 nt, Homo sapiens
gaacuguacaugaugauga

SEQ ID NO: 178193 - RNA, 19 nt, Homo sapiens
ggacaaagagauugagguu

SEQ ID NO: 178194 - RNA, 19 nt, Homo sapiens
gaguuugucugcaagguuu

SEQ ID NO: 178195 - RNA, 19 nt, Homo sapiens
ggaaaaugguauaacguua

SEQ ID NO: 178196 - RNA, 19 nt, Homo sapiens
gggaguacuugcagauaaa

SEQ ID NO: 178197 - RNA, 19 nt, Homo sapiens
caauagccgugcaagauga

SEQ ID NO: 178198 - RNA, 19 nt, Homo sapiens
gaaggaaggacacagaaug

SEQ ID NO: 178199 - RNA, 19 nt, Homo sapiens
cagaagcccuguuugauag

SEQ ID NO: 178200 - RNA, 19 nt, Homo sapiens
agauugagguucucuauau

SEQ ID NO: 178201 - RNA, 19 nt, Homo sapiens
uuaaauggaugucccaaug

SEQ ID NO: 178202 - RNA, 19 nt, Homo sapiens
ucagaggaguaaauaauug

SEQ ID NO: 178203 - RNA, 19 nt, Homo sapiens
guagaagacuuggaucgaa

SEQ ID NO: 178204 - RNA, 19 nt, Homo sapiens
gaauacggguccaucaauc

SEQ ID NO: 178205 - RNA, 19 nt, Homo sapiens
gccaaccucucgaacagua

SEQ ID NO: 178206 - RNA, 19 nt, Homo sapiens
gaaugcagauuacacugau

SEQ ID NO: 178207 - RNA, 19 nt, Homo sapiens
caagaugaaugcagauuac

SEQ ID NO: 178208 - RNA, 19 nt, Homo sapiens
gaccaacguucaagcaguu

SEQ ID NO: 178209 - RNA, 19 nt, Homo sapiens
ccaacgaacuguacaugau

SEQ ID NO: 178210 - RNA, 19 nt, Homo sapiens
gaaaauagcagacuuugga

SEQ ID NO: 178211 - RNA, 19 nt, Homo sapiens
gauagccauuuacugcaua

SEQ ID NO: 178212 - RNA, 19 nt, Homo sapiens
gaaaagaacggcaguaaau

SEQ ID NO: 178213 - RNA, 19 nt, Homo sapiens
cagacuaguuaaucuauug

SEQ ID NO: 178214 - RNA, 19 nt, Homo sapiens
uaaaugcuguucuuacaca

SEQ ID NO: 178215 - RNA, 19 nt, Homo sapiens
ugugggagaucuucacuuu

SEQ ID NO: 178216 - RNA, 19 nt, Homo sapiens
gcagacuaguuaaucuauu

SEQ ID NO: 178217 - RNA, 19 nt, Homo sapiens
cacauaaacggcaguguua

SEQ ID NO: 178218 - RNA, 19 nt, Homo sapiens
gauugagguucucuauauu

SEQ ID NO: 178219 - RNA, 19 nt, Homo sapiens
acaaagagauugagguucu

SEQ ID NO: 178220 - RNA, 19 nt, Homo sapiens
gaggagacguagaguuugu

SEQ ID NO: 178221 - RNA, 19 nt, Homo sapiens
cuucugaguugcacauuaa

SEQ ID NO: 178222 - RNA, 19 nt, Homo sapiens
guaccagcguccucuuaaa

SEQ ID NO: 178223 - RNA, 19 nt, Homo sapiens
gaagagccaccaaccaaau

SEQ ID NO: 178224 - RNA, 19 nt, Homo sapiens
ggaggagcguugccauuca

SEQ ID NO: 178225 - RNA, 19 nt, Homo sapiens
gaguccagcuccuccauga

SEQ ID NO: 178226 - RNA, 19 nt, Homo sapiens
caaaagauccagccucaua

SEQ ID NO: 178227 - RNA, 19 nt, Homo sapiens
ugaagauguugaaagauga

SEQ ID NO: 178228 - RNA, 19 nt, Homo sapiens
agggauugcuuucaucuaa

SEQ ID NO: 178229 - RNA, 19 nt, Homo sapiens
ggacuucccaagauaaaug

SEQ ID NO: 178230 - RNA, 19 nt, Homo sapiens
aaccaugccuuccucagua

SEQ ID NO: 178231 - RNA, 19 nt, Homo sapiens
ucaagcaguugguagaaga

SEQ ID NO: 178232 - RNA, 19 nt, Homo sapiens
caacacgccucucuucaac

SEQ ID NO: 178233 - RNA, 19 nt, Homo sapiens
gaacaguaacaacaagaga

SEQ ID NO: 178234 - RNA, 19 nt, Homo sapiens
gcaauagccgugcaagaug

SEQ ID NO: 178235 - RNA, 19 nt, Homo sapiens
gaaacacccacucacuuug

SEQ ID NO: 178236 - RNA, 19 nt, Homo sapiens
gcuucugaguugcacauua

SEQ ID NO: 178237 - RNA, 19 nt, Homo sapiens
gaggacagaccuuaguuga

SEQ ID NO: 178238 - RNA, 19 nt, Homo sapiens
gacccaagaugaaauaaaa

SEQ ID NO: 178239 - RNA, 19 nt, Homo sapiens
ucacaaccaaugaggaaua

SEQ ID NO: 178240 - RNA, 19 nt, Homo sapiens
ccagaggcauggaguacuu

SEQ ID NO: 178241 - RNA, 19 nt, Homo sapiens
ccaaauaccaaaucucuca

SEQ ID NO: 178242 - RNA, 19 nt, Homo sapiens
gaggagcguugccauucaa

SEQ ID NO: 178243 - RNA, 19 nt, Homo sapiens
ugggagaucuucacuuuag

SEQ ID NO: 178244 - RNA, 19 nt, Homo sapiens
gcaggagcaucgcauugga

SEQ ID NO: 178245 - RNA, 19 nt, Homo sapiens
ugucuccacuuguauauau

SEQ ID NO: 178246 - RNA, 19 nt, Homo sapiens
gaaccguauucaccuuguu

SEQ ID NO: 178247 - RNA, 19 nt, Homo sapiens
ugucagagauggagaugau

SEQ ID NO: 178248 - RNA, 19 nt, Homo sapiens
ugaagaacacgaccaagaa

SEQ ID NO: 178249 - RNA, 19 nt, Homo sapiens
caucugacaagggaaauua

SEQ ID NO: 178250 - RNA, 19 nt, Homo sapiens
gcacagcagacuaguuaau

SEQ ID NO: 178251 - RNA, 19 nt, Homo sapiens
ccgugaagauguugaaaga

SEQ ID NO: 178252 - RNA, 19 nt, Homo sapiens
uaacaacacgccucucuuc

SEQ ID NO: 178253 - RNA, 19 nt, Homo sapiens
gaaugaagaacacgaccaa

SEQ ID NO: 178254 - RNA, 19 nt, Homo sapiens
ggguaauucuauugggaua

SEQ ID NO: 178255 - RNA, 19 nt, Homo sapiens
gcaccauacuggaccaaca

SEQ ID NO: 178256 - RNA, 19 nt, Homo sapiens
cagauuagccugauucucu

SEQ ID NO: 178257 - RNA, 19 nt, Homo sapiens
cggaggagacguagaguuu

SEQ ID NO: 178258 - RNA, 19 nt, Homo sapiens
aaaguguggucccaucuga

SEQ ID NO: 178259 - RNA, 19 nt, Homo sapiens
gcacuggagccucauuaug

SEQ ID NO: 178260 - RNA, 19 nt, Homo sapiens
gaaaugauagcagaaugug

SEQ ID NO: 178261 - RNA, 19 nt, Homo sapiens
ggugcuggauguauguaaa

SEQ ID NO: 178262 - RNA, 19 nt, Homo sapiens
guaauucuauugggauauc

SEQ ID NO: 178263 - RNA, 19 nt, Homo sapiens
cauaaacggcaguguuaaa

SEQ ID NO: 178264 - RNA, 19 nt, Homo sapiens
gaguacuccuaugacauua

SEQ ID NO: 178265 - RNA, 19 nt, Homo sapiens
gagaugaugaagaugauug

SEQ ID NO: 178266 - RNA, 19 nt, Homo sapiens
agauggagaugaugaagau

SEQ ID NO: 178267 - RNA, 19 nt, Homo sapiens
ggacagaccuuaguugaaa

SEQ ID NO: 178268 - RNA, 19 nt, Homo sapiens
gaccuuaguugaaaugaua

SEQ ID NO: 178269 - RNA, 19 nt, Homo sapiens
gagcacaaaugcaguauau

SEQ ID NO: 178270 - RNA, 19 nt, Homo sapiens
cagcauauguguaaagauu

SEQ ID NO: 178271 - RNA, 19 nt, Homo sapiens
gaacaguauucaccuaguu

SEQ ID NO: 178272 - RNA, 19 nt, Homo sapiens
ggaccacucuucugcguuu

SEQ ID NO: 178273 - RNA, 19 nt, Homo sapiens
guaaucagcauauguguaa

SEQ ID NO: 178274 - RNA, 19 nt, Homo sapiens
ggccaacacugucaaguuu

SEQ ID NO: 178275 - RNA, 19 nt, Homo sapiens
ggaaacacccacucacuuu

SEQ ID NO: 178276 - RNA, 19 nt, Homo sapiens
ggacagcacugggaaccua

SEQ ID NO: 178277 - RNA, 19 nt, Homo sapiens
aaagaugccuuaauccauu

SEQ ID NO: 178278 - RNA, 19 nt, Homo sapiens
gcaagaugaaugcagauua

SEQ ID NO: 178279 - RNA, 19 nt, Homo sapiens
cagcacagcagacuaguua

SEQ ID NO: 178280 - RNA, 19 nt, Homo sapiens
guauauaggugcuggaugu

SEQ ID NO: 178281 - RNA, 19 nt, Homo sapiens
gcacaaaugcaguauauag

SEQ ID NO: 178282 - RNA, 19 nt, Homo sapiens
gaaggacacagaauggaua

SEQ ID NO: 178283 - RNA, 19 nt, Homo sapiens
uaacuggacuucccaagau

SEQ ID NO: 178284 - RNA, 19 nt, Homo sapiens
gcuaaaugcuguucuuaca

SEQ ID NO: 178285 - RNA, 19 nt, Homo sapiens
gugaagauguugaaagaug

SEQ ID NO: 178286 - RNA, 19 nt, Homo sapiens
ggauugcuuucaucuaauu

SEQ ID NO: 178287 - RNA, 19 nt, Homo sapiens
auaggaagguguuucauuu

SEQ ID NO: 178288 - RNA, 19 nt, Homo sapiens
ccagaagcccuguuugaua

SEQ ID NO: 178289 - RNA, 19 nt, Homo sapiens
gaucagaggaguaaauaau

SEQ ID NO: 178290 - RNA, 19 nt, Homo sapiens
gaacuguacaugaugauga

SEQ ID NO: 178291 - RNA, 19 nt, Homo sapiens
ggacaaagagauugagguu

SEQ ID NO: 178292 - RNA, 19 nt, Homo sapiens
gaguuugucugcaagguuu

SEQ ID NO: 178293 - RNA, 19 nt, Homo sapiens
ggaaaaugguauaacguua

SEQ ID NO: 178294 - RNA, 19 nt, Homo sapiens
ggagacagguaacaguuuc

SEQ ID NO: 178295 - RNA, 19 nt, Homo sapiens
caauagccgugcaagauga

SEQ ID NO: 178296 - RNA, 19 nt, Homo sapiens
gaaggaaggacacagaaug

SEQ ID NO: 178297 - RNA, 19 nt, Homo sapiens
cagaagcccuguuugauag

SEQ ID NO: 178298 - RNA, 19 nt, Homo sapiens
agauugagguucucuauau

SEQ ID NO: 178299 - RNA, 19 nt, Homo sapiens
uuaaauggaugucccaaug

SEQ ID NO: 178300 - RNA, 19 nt, Homo sapiens
ucagaggaguaaauaauug

SEQ ID NO: 178301 - RNA, 19 nt, Homo sapiens
guagaagacuuggaucgaa

SEQ ID NO: 178302 - RNA, 19 nt, Homo sapiens
gaauacggguccaucaauc

SEQ ID NO: 178303 - RNA, 19 nt, Homo sapiens
gccaaccucucgaacagua

SEQ ID NO: 178304 - RNA, 19 nt, Homo sapiens
gaaugcagauuacacugau

SEQ ID NO: 178305 - RNA, 19 nt, Homo sapiens
caagaugaaugcagauuac

SEQ ID NO: 178306 - RNA, 19 nt, Homo sapiens
gaccaacguucaagcaguu

SEQ ID NO: 178307 - RNA, 19 nt, Homo sapiens
ccaacgaacuguacaugau

SEQ ID NO: 178308 - RNA, 19 nt, Homo sapiens
gaaaauagcagacuuugga

SEQ ID NO: 178309 - RNA, 19 nt, Homo sapiens
gauagccauuuacugcaua

SEQ ID NO: 178310 - RNA, 19 nt, Homo sapiens
gaaaagaacggcaguaaau

SEQ ID NO: 178311 - RNA, 19 nt, Homo sapiens
cagacuaguuaaucuauug

SEQ ID NO: 178312 - RNA, 19 nt, Homo sapiens
uaaaugcuguucuuacaca

SEQ ID NO: 178313 - RNA, 19 nt, Homo sapiens
ugugggagaucuucacuuu

SEQ ID NO: 178314 - RNA, 19 nt, Homo sapiens
gcagacuaguuaaucuauu

SEQ ID NO: 178315 - RNA, 19 nt, Homo sapiens
cacauaaacggcaguguua

SEQ ID NO: 178316 - RNA, 19 nt, Homo sapiens
gauugagguucucuauauu

SEQ ID NO: 178317 - RNA, 19 nt, Homo sapiens
acaaagagauugagguucu

SEQ ID NO: 178318 - RNA, 19 nt, Homo sapiens
gaggagacguagaguuugu

SEQ ID NO: 178319 - RNA, 19 nt, Homo sapiens
cuucugaguugcacauuaa

SEQ ID NO: 178320 - RNA, 19 nt, Homo sapiens
guaccagcguccucuuaaa

SEQ ID NO: 178321 - RNA, 19 nt, Homo sapiens
ggaggagcguugccauuca

SEQ ID NO: 178322 - RNA, 19 nt, Homo sapiens
gaguccagcuccuccauga

SEQ ID NO: 178323 - RNA, 19 nt, Homo sapiens
caaaagauccagccucaua

SEQ ID NO: 178324 - RNA, 19 nt, Homo sapiens
ugaagauguugaaagauga

SEQ ID NO: 178325 - RNA, 19 nt, Homo sapiens
agggauugcuuucaucuaa

SEQ ID NO: 178326 - RNA, 19 nt, Homo sapiens
ggacuucccaagauaaaug

SEQ ID NO: 178327 - RNA, 19 nt, Homo sapiens
aaccaugccuuccucagua

SEQ ID NO: 178328 - RNA, 19 nt, Homo sapiens
ucaagcaguugguagaaga

SEQ ID NO: 178329 - RNA, 19 nt, Homo sapiens
caacacgccucucuucaac

SEQ ID NO: 178330 - RNA, 19 nt, Homo sapiens
gaacaguaacaacaagaga

SEQ ID NO: 178331 - RNA, 19 nt, Homo sapiens
gcaauagccgugcaagaug

SEQ ID NO: 178332 - RNA, 19 nt, Homo sapiens
gaaacacccacucacuuug

SEQ ID NO: 178333 - RNA, 19 nt, Homo sapiens
gcuucugaguugcacauua

SEQ ID NO: 178334 - RNA, 19 nt, Homo sapiens
gaggacagaccuuaguuga

SEQ ID NO: 178335 - RNA, 19 nt, Homo sapiens
ucacaaccaaugaggaaua

SEQ ID NO: 178336 - RNA, 19 nt, Homo sapiens
ccagaggcauggaguacuu

SEQ ID NO: 178337 - RNA, 19 nt, Homo sapiens
ugggagaucuucacuuuag

SEQ ID NO: 178338 - RNA, 19 nt, Homo sapiens
gaggagcguugccauucaa

SEQ ID NO: 178339 - RNA, 19 nt, Homo sapiens
gcaggagcaucgcauugga

SEQ ID NO: 178340 - RNA, 19 nt, Homo sapiens
ugucuccacuuguauauau

SEQ ID NO: 178341 - RNA, 19 nt, Homo sapiens
ugucagagauggagaugau

SEQ ID NO: 178342 - RNA, 19 nt, Homo sapiens
ugaagaacacgaccaagaa

SEQ ID NO: 178343 - RNA, 19 nt, Homo sapiens
caucugacaagggaaauua

SEQ ID NO: 178344 - RNA, 19 nt, Homo sapiens
gcacagcagacuaguuaau

SEQ ID NO: 178345 - RNA, 19 nt, Homo sapiens
ccgugaagauguugaaaga

SEQ ID NO: 178346 - RNA, 19 nt, Homo sapiens
uaacaacacgccucucuuc

SEQ ID NO: 178347 - RNA, 19 nt, Homo sapiens
gaaugaagaacacgaccaa

SEQ ID NO: 178348 - RNA, 19 nt, Homo sapiens
ggguaauucuauugggaua

SEQ ID NO: 178349 - RNA, 19 nt, Homo sapiens
gcaccauacuggaccaaca

SEQ ID NO: 178350 - RNA, 19 nt, Homo sapiens
cagauuagccugauucucu

SEQ ID NO: 178351 - RNA, 19 nt, Homo sapiens
cggaggagacguagaguuu

SEQ ID NO: 178352 - RNA, 19 nt, Homo sapiens
aaaguguggucccaucuga

SEQ ID NO: 178353 - RNA, 19 nt, Homo sapiens
gcacuggagccucauuaug

SEQ ID NO: 178354 - RNA, 19 nt, Homo sapiens
gaaaugauagcagaaugug

SEQ ID NO: 178355 - RNA, 19 nt, Homo sapiens
ggugcuggauguauguaaa

SEQ ID NO: 178356 - RNA, 19 nt, Homo sapiens
guaauucuauugggauauc

SEQ ID NO: 178357 - RNA, 19 nt, Homo sapiens
cauaaacggcaguguuaaa

SEQ ID NO: 178358 - RNA, 19 nt, Homo sapiens
gaguacuccuaugacauua

SEQ ID NO: 178359 - RNA, 19 nt, Homo sapiens
gagaugaugaagaugauug

SEQ ID NO: 178360 - RNA, 19 nt, Homo sapiens
agauggagaugaugaagau

SEQ ID NO: 178361 - RNA, 19 nt, Homo sapiens
ucaagucccaucauagaaa

SEQ ID NO: 178362 - RNA, 19 nt, Homo sapiens
cguucugccuuccuuguua

SEQ ID NO: 178363 - RNA, 19 nt, Homo sapiens
gccacaagccaccauguaa

SEQ ID NO: 178364 - RNA, 19 nt, Homo sapiens
gaaccaugccuuccucagu

SEQ ID NO: 178365 - RNA, 19 nt, Homo sapiens
gaucgaauucucacucuca

SEQ ID NO: 178366 - RNA, 19 nt, Homo sapiens
gggaaacacaagaauauca

SEQ ID NO: 178367 - RNA, 19 nt, Homo sapiens
ggacagaccuuaguugaaa

SEQ ID NO: 178368 - RNA, 19 nt, Homo sapiens
gaccuuaguugaaaugaua

SEQ ID NO: 178369 - RNA, 19 nt, Homo sapiens
gagcacaaaugcaguauau

SEQ ID NO: 178370 - RNA, 19 nt, Homo sapiens
cagcauauguguaaagauu

SEQ ID NO: 178371 - RNA, 19 nt, Homo sapiens
gaacaguauucaccuaguu

SEQ ID NO: 178372 - RNA, 19 nt, Homo sapiens
ggaccacucuucugcguuu

SEQ ID NO: 178373 - RNA, 19 nt, Homo sapiens
guaaucagcauauguguaa

SEQ ID NO: 178374 - RNA, 19 nt, Homo sapiens
ggccaacacugucaaguuu

SEQ ID NO: 178375 - RNA, 19 nt, Homo sapiens
ggaaacacccacucacuuu

SEQ ID NO: 178376 - RNA, 19 nt, Homo sapiens
ggacagcacugggaaccua

SEQ ID NO: 178377 - RNA, 19 nt, Homo sapiens
aaagaugccuuaauccauu

SEQ ID NO: 178378 - RNA, 19 nt, Homo sapiens
gcaagaugaaugcagauua

SEQ ID NO: 178379 - RNA, 19 nt, Homo sapiens
cagcacagcagacuaguua

SEQ ID NO: 178380 - RNA, 19 nt, Homo sapiens
guauauaggugcuggaugu

SEQ ID NO: 178381 - RNA, 19 nt, Homo sapiens
gcacaaaugcaguauauag

SEQ ID NO: 178382 - RNA, 19 nt, Homo sapiens
gaaggacacagaauggaua

SEQ ID NO: 178383 - RNA, 19 nt, Homo sapiens
uaacuggacuucccaagau

SEQ ID NO: 178384 - RNA, 19 nt, Homo sapiens
gcaagcgccuggaagagaa

SEQ ID NO: 178385 - RNA, 19 nt, Homo sapiens
gcuaaaugcuguucuuaca

SEQ ID NO: 178386 - RNA, 19 nt, Homo sapiens
gugaagauguugaaagaug

SEQ ID NO: 178387 - RNA, 19 nt, Homo sapiens
ggauugcuuucaucuaauu

SEQ ID NO: 178388 - RNA, 19 nt, Homo sapiens
auaggaagguguuucauuu

SEQ ID NO: 178389 - RNA, 19 nt, Homo sapiens
ccagaagcccuguuugaua

SEQ ID NO: 178390 - RNA, 19 nt, Homo sapiens
gaucagaggaguaaauaau

SEQ ID NO: 178391 - RNA, 19 nt, Homo sapiens
gaacuguacaugaugauga

SEQ ID NO: 178392 - RNA, 19 nt, Homo sapiens
gaguuugucugcaagguuu

SEQ ID NO: 178393 - RNA, 19 nt, Homo sapiens
ggaaaaugguauaacguua

SEQ ID NO: 178394 - RNA, 19 nt, Homo sapiens
ggagacagguaacaguuuc

SEQ ID NO: 178395 - RNA, 19 nt, Homo sapiens
caauagccgugcaagauga

SEQ ID NO: 178396 - RNA, 19 nt, Homo sapiens
gaaggaaggacacagaaug

SEQ ID NO: 178397 - RNA, 19 nt, Homo sapiens
cagaagcccuguuugauag

SEQ ID NO: 178398 - RNA, 19 nt, Homo sapiens
uuaaauggaugucccaaug

SEQ ID NO: 178399 - RNA, 19 nt, Homo sapiens
ucagaggaguaaauaauug

SEQ ID NO: 178400 - RNA, 19 nt, Homo sapiens
guagaagacuuggaucgaa

SEQ ID NO: 178401 - RNA, 19 nt, Homo sapiens
gaauacggguccaucaauc

SEQ ID NO: 178402 - RNA, 19 nt, Homo sapiens
gccaaccucucgaacagua

SEQ ID NO: 178403 - RNA, 19 nt, Homo sapiens
gaaugcagauuacacugau

SEQ ID NO: 178404 - RNA, 19 nt, Homo sapiens
caagaugaaugcagauuac

SEQ ID NO: 178405 - RNA, 19 nt, Homo sapiens
gaccaacguucaagcaguu

SEQ ID NO: 178406 - RNA, 19 nt, Homo sapiens
ccaacgaacuguacaugau

SEQ ID NO: 178407 - RNA, 19 nt, Homo sapiens
gaaaauagcagacuuugga

SEQ ID NO: 178408 - RNA, 19 nt, Homo sapiens
gauagccauuuacugcaua

SEQ ID NO: 178409 - RNA, 19 nt, Homo sapiens
gaaaagaacggcaguaaau

SEQ ID NO: 178410 - RNA, 19 nt, Homo sapiens
cagacuaguuaaucuauug

SEQ ID NO: 178411 - RNA, 19 nt, Homo sapiens
uaaaugcuguucuuacaca

SEQ ID NO: 178412 - RNA, 19 nt, Homo sapiens
ugugggagaucuucacuuu

SEQ ID NO: 178413 - RNA, 19 nt, Homo sapiens
gcagacuaguuaaucuauu

SEQ ID NO: 178414 - RNA, 19 nt, Homo sapiens
cacauaaacggcaguguua

SEQ ID NO: 178415 - RNA, 19 nt, Homo sapiens
gaggagacguagaguuugu

SEQ ID NO: 178416 - RNA, 19 nt, Homo sapiens
cuucugaguugcacauuaa

SEQ ID NO: 178417 - RNA, 19 nt, Homo sapiens
guaccagcguccucuuaaa

SEQ ID NO: 178418 - RNA, 19 nt, Homo sapiens
ggaggagcguugccauuca

SEQ ID NO: 178419 - RNA, 19 nt, Homo sapiens
gaguccagcuccuccauga

SEQ ID NO: 178420 - RNA, 19 nt, Homo sapiens
caaaagauccagccucaua

SEQ ID NO: 178421 - RNA, 19 nt, Homo sapiens
ugaagauguugaaagauga

SEQ ID NO: 178422 - RNA, 19 nt, Homo sapiens
agggauugcuuucaucuaa

SEQ ID NO: 178423 - RNA, 19 nt, Homo sapiens
ggacuucccaagauaaaug

SEQ ID NO: 178424 - RNA, 19 nt, Homo sapiens
aaccaugccuuccucagua

SEQ ID NO: 178425 - RNA, 19 nt, Homo sapiens
ucaagcaguugguagaaga

SEQ ID NO: 178426 - RNA, 19 nt, Homo sapiens
caacacgccucucuucaac

SEQ ID NO: 178427 - RNA, 19 nt, Homo sapiens
gcaauagccgugcaagaug

SEQ ID NO: 178428 - RNA, 19 nt, Homo sapiens
gaaacacccacucacuuug

SEQ ID NO: 178429 - RNA, 19 nt, Homo sapiens
gcuucugaguugcacauua

SEQ ID NO: 178430 - RNA, 19 nt, Homo sapiens
gaggacagaccuuaguuga

SEQ ID NO: 178431 - RNA, 19 nt, Homo sapiens
ucacaaccaaugaggaaua

SEQ ID NO: 178432 - RNA, 19 nt, Homo sapiens
gaggagcguugccauucaa

SEQ ID NO: 178433 - RNA, 19 nt, Homo sapiens
ugggagaucuucacuuuag

SEQ ID NO: 178434 - RNA, 19 nt, Homo sapiens
ccagacggauggaguacuu

SEQ ID NO: 178435 - RNA, 19 nt, Homo sapiens
gcaggagcaucgcauugga

SEQ ID NO: 178436 - RNA, 19 nt, Homo sapiens
ugucuccacuuguauauau

SEQ ID NO: 178437 - RNA, 19 nt, Homo sapiens
caccgcagcugaaggcauu

SEQ ID NO: 178438 - RNA, 19 nt, Homo sapiens
ugucagagauggagaugau

SEQ ID NO: 178439 - RNA, 19 nt, Homo sapiens
ugaagaacacgaccaagaa

SEQ ID NO: 178440 - RNA, 19 nt, Homo sapiens
caucugacaagggaaauua

SEQ ID NO: 178441 - RNA, 19 nt, Homo sapiens
gcacagcagacuaguuaau

SEQ ID NO: 178442 - RNA, 19 nt, Homo sapiens
ccgugaagauguugaaaga

SEQ ID NO: 178443 - RNA, 19 nt, Homo sapiens
uaacaacacgccucucuuc

SEQ ID NO: 178444 - RNA, 19 nt, Homo sapiens
gaaugaagaacacgaccaa

SEQ ID NO: 178445 - RNA, 19 nt, Homo sapiens
gggaaauuauaccugugua

SEQ ID NO: 178446 - RNA, 19 nt, Homo sapiens
gcaccauacuggaccaaca

SEQ ID NO: 178447 - RNA, 19 nt, Homo sapiens
cagauuagccugauucucu

SEQ ID NO: 178448 - RNA, 19 nt, Homo sapiens
cggaggagacguagaguuu

SEQ ID NO: 178449 - RNA, 19 nt, Homo sapiens
gaaauuauaccuguguagu

SEQ ID NO: 178450 - RNA, 19 nt, Homo sapiens
aaaguguggucccaucuga

SEQ ID NO: 178451 - RNA, 19 nt, Homo sapiens
gcacuggagccucauuaug

SEQ ID NO: 178452 - RNA, 19 nt, Homo sapiens
gaaaugauagcagaaugug

SEQ ID NO: 178453 - RNA, 19 nt, Homo sapiens
ggugcuggauguauguaaa

SEQ ID NO: 178454 - RNA, 19 nt, Homo sapiens
cauaaacggcaguguuaaa

SEQ ID NO: 178455 - RNA, 19 nt, Homo sapiens
gaguacuccuaugacauua

SEQ ID NO: 178456 - RNA, 19 nt, Homo sapiens
gagaugaugaagaugauug

SEQ ID NO: 178457 - RNA, 19 nt, Homo sapiens
agauggagaugaugaagau

SEQ ID NO: 178458 - RNA, 19 nt, Homo sapiens
ucaagucccaucauagaaa

SEQ ID NO: 178459 - RNA, 19 nt, Homo sapiens
cguucugccuuccuuguua

SEQ ID NO: 178460 - RNA, 19 nt, Homo sapiens
gccacaagccaccauguaa

SEQ ID NO: 178461 - RNA, 19 nt, Homo sapiens
gaaccaugccuuccucagu

SEQ ID NO: 178462 - RNA, 19 nt, Homo sapiens
gaucgaauucucacucuca

SEQ ID NO: 178463 - RNA, 19 nt, Homo sapiens
gggaaacacaagaauauca

SEQ ID NO: 178464 - RNA, 19 nt, Homo sapiens
aaagaacucauucauagga

SEQ ID NO: 178465 - RNA, 19 nt, Homo sapiens
uagaagacuuggaucgaau

SEQ ID NO: 178466 - RNA, 19 nt, Homo sapiens
cgccagagauaucaacaau

SEQ ID NO: 178467 - RNA, 19 nt, Homo sapiens
ggacagaccuuaguugaaa

SEQ ID NO: 178468 - RNA, 19 nt, Homo sapiens
gaccuuaguugaaaugaua

SEQ ID NO: 178469 - RNA, 19 nt, Homo sapiens
gagcacaaaugcaguauau

SEQ ID NO: 178470 - RNA, 19 nt, Homo sapiens
cagcauauguguaaagauu

SEQ ID NO: 178471 - RNA, 19 nt, Homo sapiens
gaacaguauucaccuaguu

SEQ ID NO: 178472 - RNA, 19 nt, Homo sapiens
ggaccacucuucugcguuu

SEQ ID NO: 178473 - RNA, 19 nt, Homo sapiens
guaaucagcauauguguaa

SEQ ID NO: 178474 - RNA, 19 nt, Homo sapiens
ggccaacacugucaaguuu

SEQ ID NO: 178475 - RNA, 19 nt, Homo sapiens
ggaaacacccacucacuuu

SEQ ID NO: 178476 - RNA, 19 nt, Homo sapiens
ggacagcacugggaaccua

SEQ ID NO: 178477 - RNA, 19 nt, Homo sapiens
aaagaugccuuaauccauu

SEQ ID NO: 178478 - RNA, 19 nt, Homo sapiens
gcaagaugaaugcagauua

SEQ ID NO: 178479 - RNA, 19 nt, Homo sapiens
cagcacagcagacuaguua

SEQ ID NO: 178480 - RNA, 19 nt, Homo sapiens
guauauaggugcuggaugu

SEQ ID NO: 178481 - RNA, 19 nt, Homo sapiens
gcacaaaugcaguauauag

SEQ ID NO: 178482 - RNA, 19 nt, Homo sapiens
gaaggacacagaauggaua

SEQ ID NO: 178483 - RNA, 19 nt, Homo sapiens
uaacuggacuucccaagau

SEQ ID NO: 178484 - RNA, 19 nt, Homo sapiens
gcaagcgccuggaagagaa

SEQ ID NO: 178485 - RNA, 19 nt, Homo sapiens
gcuaaaugcuguucuuaca

SEQ ID NO: 178486 - RNA, 19 nt, Homo sapiens
gugaagauguugaaagaug

SEQ ID NO: 178487 - RNA, 19 nt, Homo sapiens
ggauugcuuucaucuaauu

SEQ ID NO: 178488 - RNA, 19 nt, Homo sapiens
auaggaagguguuucauuu

SEQ ID NO: 178489 - RNA, 19 nt, Homo sapiens
ccagaagcccuguuugaua

SEQ ID NO: 178490 - RNA, 19 nt, Homo sapiens
gaucagaggaguaaauaau

SEQ ID NO: 178491 - RNA, 19 nt, Homo sapiens
gaacuguacaugaugauga

SEQ ID NO: 178492 - RNA, 19 nt, Homo sapiens
gaguuugucugcaagguuu

SEQ ID NO: 178493 - RNA, 19 nt, Homo sapiens
ggaaaaugguauaacguua

SEQ ID NO: 178494 - RNA, 19 nt, Homo sapiens
caauagccgugcaagauga

SEQ ID NO: 178495 - RNA, 19 nt, Homo sapiens
gaaggaaggacacagaaug

SEQ ID NO: 178496 - RNA, 19 nt, Homo sapiens
cagaagcccuguuugauag

SEQ ID NO: 178497 - RNA, 19 nt, Homo sapiens
uuaaauggaugucccaaug

SEQ ID NO: 178498 - RNA, 19 nt, Homo sapiens
ucagaggaguaaauaauug

SEQ ID NO: 178499 - RNA, 19 nt, Homo sapiens
guagaagacuuggaucgaa

SEQ ID NO: 178500 - RNA, 19 nt, Homo sapiens
gaauacggguccaucaauc

SEQ ID NO: 178501 - RNA, 19 nt, Homo sapiens
gccaaccucucgaacagua

SEQ ID NO: 178502 - RNA, 19 nt, Homo sapiens
gaaugcagauuacacugau

SEQ ID NO: 178503 - RNA, 19 nt, Homo sapiens
caagaugaaugcagauuac

SEQ ID NO: 178504 - RNA, 19 nt, Homo sapiens
gaccaacguucaagcaguu

SEQ ID NO: 178505 - RNA, 19 nt, Homo sapiens
ccaacgaacuguacaugau

SEQ ID NO: 178506 - RNA, 19 nt, Homo sapiens
gaaaauagcagacuuugga

SEQ ID NO: 178507 - RNA, 19 nt, Homo sapiens
gauagccauuuacugcaua

SEQ ID NO: 178508 - RNA, 19 nt, Homo sapiens
gaaaagaacggcaguaaau

SEQ ID NO: 178509 - RNA, 19 nt, Homo sapiens
cagacuaguuaaucuauug

SEQ ID NO: 178510 - RNA, 19 nt, Homo sapiens
uaaaugcuguucuuacaca

SEQ ID NO: 178511 - RNA, 19 nt, Homo sapiens
ugugggagaucuucacuuu

SEQ ID NO: 178512 - RNA, 19 nt, Homo sapiens
gcagacuaguuaaucuauu

SEQ ID NO: 178513 - RNA, 19 nt, Homo sapiens
cacauaaacggcaguguua

SEQ ID NO: 178514 - RNA, 19 nt, Homo sapiens
gaggagacguagaguuugu

SEQ ID NO: 178515 - RNA, 19 nt, Homo sapiens
cuucugaguugcacauuaa

SEQ ID NO: 178516 - RNA, 19 nt, Homo sapiens
guaccagcguccucuuaaa

SEQ ID NO: 178517 - RNA, 19 nt, Homo sapiens
ggaggagcguugccauuca

SEQ ID NO: 178518 - RNA, 19 nt, Homo sapiens
gaguccagcuccuccauga

SEQ ID NO: 178519 - RNA, 19 nt, Homo sapiens
caaaagauccagccucaua

SEQ ID NO: 178520 - RNA, 19 nt, Homo sapiens
ugaagauguugaaagauga

SEQ ID NO: 178521 - RNA, 19 nt, Homo sapiens
agggauugcuuucaucuaa

SEQ ID NO: 178522 - RNA, 19 nt, Homo sapiens
ggacuucccaagauaaaug

SEQ ID NO: 178523 - RNA, 19 nt, Homo sapiens
aaccaugccuuccucagua

SEQ ID NO: 178524 - RNA, 19 nt, Homo sapiens
ucaagcaguugguagaaga

SEQ ID NO: 178525 - RNA, 19 nt, Homo sapiens
caacacgccucucuucaac

SEQ ID NO: 178526 - RNA, 19 nt, Homo sapiens
gcaauagccgugcaagaug

SEQ ID NO: 178527 - RNA, 19 nt, Homo sapiens
gaaacacccacucacuuug

SEQ ID NO: 178528 - RNA, 19 nt, Homo sapiens
gcuucugaguugcacauua

SEQ ID NO: 178529 - RNA, 19 nt, Homo sapiens
gaggacagaccuuaguuga

SEQ ID NO: 178530 - RNA, 19 nt, Homo sapiens
ucacaaccaaugaggaaua

SEQ ID NO: 178531 - RNA, 19 nt, Homo sapiens
gaggagcguugccauucaa

SEQ ID NO: 178532 - RNA, 19 nt, Homo sapiens
ugggagaucuucacuuuag

SEQ ID NO: 178533 - RNA, 19 nt, Homo sapiens
ccagacggauggaguacuu

SEQ ID NO: 178534 - RNA, 19 nt, Homo sapiens
gcaggagcaucgcauugga

SEQ ID NO: 178535 - RNA, 19 nt, Homo sapiens
ugucuccacuuguauauau

SEQ ID NO: 178536 - RNA, 19 nt, Homo sapiens
caccgcagcugaaggcauu

SEQ ID NO: 178537 - RNA, 19 nt, Homo sapiens
ugucagagauggagaugau

SEQ ID NO: 178538 - RNA, 19 nt, Homo sapiens
ugaagaacacgaccaagaa

SEQ ID NO: 178539 - RNA, 19 nt, Homo sapiens
caucugacaagggaaauua

SEQ ID NO: 178540 - RNA, 19 nt, Homo sapiens
gcacagcagacuaguuaau

SEQ ID NO: 178541 - RNA, 19 nt, Homo sapiens
ccgugaagauguugaaaga

SEQ ID NO: 178542 - RNA, 19 nt, Homo sapiens
uaacaacacgccucucuuc

SEQ ID NO: 178543 - RNA, 19 nt, Homo sapiens
gaaugaagaacacgaccaa

SEQ ID NO: 178544 - RNA, 19 nt, Homo sapiens
gggaaauuauaccugugua

SEQ ID NO: 178545 - RNA, 19 nt, Homo sapiens
gcaccauacuggaccaaca

SEQ ID NO: 178546 - RNA, 19 nt, Homo sapiens
cagauuagccugauucucu

SEQ ID NO: 178547 - RNA, 19 nt, Homo sapiens
cggaggagacguagaguuu

SEQ ID NO: 178548 - RNA, 19 nt, Homo sapiens
gaaauuauaccuguguagu

SEQ ID NO: 178549 - RNA, 19 nt, Homo sapiens
aaaguguggucccaucuga

SEQ ID NO: 178550 - RNA, 19 nt, Homo sapiens
gcacuggagccucauuaug

SEQ ID NO: 178551 - RNA, 19 nt, Homo sapiens
gaaaugauagcagaaugug

SEQ ID NO: 178552 - RNA, 19 nt, Homo sapiens
ggugcuggauguauguaaa

SEQ ID NO: 178553 - RNA, 19 nt, Homo sapiens
cauaaacggcaguguuaaa

SEQ ID NO: 178554 - RNA, 19 nt, Homo sapiens
gaguacuccuaugacauua

SEQ ID NO: 178555 - RNA, 19 nt, Homo sapiens
gagaugaugaagaugauug

SEQ ID NO: 178556 - RNA, 19 nt, Homo sapiens
agauggagaugaugaagau

SEQ ID NO: 178557 - RNA, 19 nt, Homo sapiens
ucaagucccaucauagaaa

SEQ ID NO: 178558 - RNA, 19 nt, Homo sapiens
cguucugccuuccuuguua

SEQ ID NO: 178559 - RNA, 19 nt, Homo sapiens
gccacaagccaccauguaa

SEQ ID NO: 178560 - RNA, 19 nt, Homo sapiens
gaaccaugccuuccucagu

SEQ ID NO: 178561 - RNA, 19 nt, Homo sapiens
gaucgaauucucacucuca

SEQ ID NO: 178562 - RNA, 19 nt, Homo sapiens
gggaaacacaagaauauca

SEQ ID NO: 178563 - RNA, 19 nt, Homo sapiens
aaagaacucauucauagga

SEQ ID NO: 178564 - RNA, 19 nt, Homo sapiens
uagaagacuuggaucgaau

SEQ ID NO: 178565 - RNA, 19 nt, Homo sapiens
cgccagagauaucaacaau

SEQ ID NO: 178566 - RNA, 19 nt, Homo sapiens
ggaugggccucucuauguc

SEQ ID NO: 178567 - RNA, 19 nt, Homo sapiens
gaugaagauugcugacuuu

SEQ ID NO: 178568 - RNA, 19 nt, Homo sapiens
gcacuggagucucgugaug

SEQ ID NO: 178569 - RNA, 19 nt, Homo sapiens
cuggagagcugcuaugcua

SEQ ID NO: 178570 - RNA, 19 nt, Homo sapiens
gcaaauggcguuuuauaaa

SEQ ID NO: 178571 - RNA, 19 nt, Homo sapiens
acacagugcucgaccuuga

SEQ ID NO: 178572 - RNA, 19 nt, Homo sapiens
ucaagaugcucaaagacaa

SEQ ID NO: 178573 - RNA, 19 nt, Homo sapiens
gaaccgcauuggaggcauu

SEQ ID NO: 178574 - RNA, 19 nt, Homo sapiens
cauagggaccucucgaaua

SEQ ID NO: 178575 - RNA, 19 nt, Homo sapiens
cacauugacuacuauaaga

SEQ ID NO: 178576 - RNA, 19 nt, Homo sapiens
ggagagcugcuaugcuaaa

SEQ ID NO: 178577 - RNA, 19 nt, Homo sapiens
ccuaaagacugcagacauc

SEQ ID NO: 178578 - RNA, 19 nt, Homo sapiens
ugaugaagauugcugacuu

SEQ ID NO: 178579 - RNA, 19 nt, Homo sapiens
auacggacaucauccugua

SEQ ID NO: 178580 - RNA, 19 nt, Homo sapiens
auagggaccucucgaauag

SEQ ID NO: 178581 - RNA, 19 nt, Homo sapiens
ucaaagacaacgccucuga

SEQ ID NO: 178582 - RNA, 19 nt, Homo sapiens
gggcugcuuuggccaggua

SEQ ID NO: 178583 - RNA, 19 nt, Homo sapiens
auaacuaccugcuagaugu

SEQ ID NO: 178584 - RNA, 19 nt, Homo sapiens
gaacaucaucaaccugcuu

SEQ ID NO: 178585 - RNA, 19 nt, Homo sapiens
ugaagcacaucgucaucaa

SEQ ID NO: 178586 - RNA, 19 nt, Homo sapiens
gagcaaauggcguuuuaua

SEQ ID NO: 178587 - RNA, 19 nt, Homo sapiens
agagugacguguggucuuu

SEQ ID NO: 178588 - RNA, 19 nt, Homo sapiens
ccaccacauugacuacuau

SEQ ID NO: 178589 - RNA, 19 nt, Homo sapiens
acaccugccugguagagaa

SEQ ID NO: 178590 - RNA, 19 nt, Homo sapiens
gccuagagauugccagcuu

SEQ ID NO: 178591 - RNA, 19 nt, Homo sapiens
ccagaggccuaccuucaag

SEQ ID NO: 178592 - RNA, 19 nt, Homo sapiens
ccucgugagucuagaucua

SEQ ID NO: 178593 - RNA, 19 nt, Homo sapiens
ucucgaauaggcacaguua

SEQ ID NO: 178594 - RNA, 19 nt, Homo sapiens
gagcaggagcugacaguag

SEQ ID NO: 178595 - RNA, 19 nt, Homo sapiens
agacaacgccucugacaag

SEQ ID NO: 178596 - RNA, 19 nt, Homo sapiens
gcacuguggccgucaagau

SEQ ID NO: 178597 - RNA, 19 nt, Homo sapiens
gcauucggcugcgccauca

SEQ ID NO: 178598 - RNA, 19 nt, Homo sapiens
ccacauugacuacuauaag

SEQ ID NO: 178599 - RNA, 19 nt, Homo sapiens
ccgucaagaugcucaaaga

SEQ ID NO: 178600 - RNA, 19 nt, Homo sapiens
cacauacaccugccuggua

SEQ ID NO: 178601 - RNA, 19 nt, Homo sapiens
gagcugcuaugcuaaaccu

SEQ ID NO: 178602 - RNA, 19 nt, Homo sapiens
ccugauggcccaaauguca

SEQ ID NO: 178603 - RNA, 19 nt, Homo sapiens
gcuggugacugaggacaau

SEQ ID NO: 178604 - RNA, 19 nt, Homo sapiens
cugaggaaguggagcuuga

SEQ ID NO: 178605 - RNA, 19 nt, Homo sapiens
ugcagaaucucaccuugau

SEQ ID NO: 178606 - RNA, 19 nt, Homo sapiens
acaagaacaucaucaaccu

SEQ ID NO: 178607 - RNA, 19 nt, Homo sapiens
uggaggcgcuggacaaggu

SEQ ID NO: 178608 - RNA, 19 nt, Homo sapiens
guacgaggcgugcgucucu

SEQ ID NO: 178609 - RNA, 19 nt, Homo sapiens
cuccagcgauucugucuuc

SEQ ID NO: 178610 - RNA, 19 nt, Homo sapiens
gacacaagaacaucaucaa

SEQ ID NO: 178611 - RNA, 19 nt, Homo sapiens
gucaagcucaucccuggua

SEQ ID NO: 178612 - RNA, 19 nt, Homo sapiens
gaggacaaugugaugaaga

SEQ ID NO: 178613 - RNA, 19 nt, Homo sapiens
ggacaaugugaugaagauu

SEQ ID NO: 178614 - RNA, 19 nt, Homo sapiens
cgacacaagaacaucauca

SEQ ID NO: 178615 - RNA, 19 nt, Homo sapiens
gcuggaagccugccgaaaa

SEQ ID NO: 178616 - RNA, 19 nt, Homo sapiens
aggacaaugugaugaagau

SEQ ID NO: 178617 - RNA, 19 nt, Homo sapiens
aaagacaacgccucugaca

SEQ ID NO: 178618 - RNA, 19 nt, Homo sapiens
uaaagacugcagacaucaa

SEQ ID NO: 178619 - RNA, 19 nt, Homo sapiens
acagugcucgaccuugaua

SEQ ID NO: 178620 - RNA, 19 nt, Homo sapiens
ugacugaggacaaugugau

SEQ ID NO: 178621 - RNA, 19 nt, Homo sapiens
uaucuggagucccggaagu

SEQ ID NO: 178622 - RNA, 19 nt, Homo sapiens
agggaaaccugcgggaguu

SEQ ID NO: 178623 - RNA, 19 nt, Homo sapiens
ggagauggaggugaugaag

SEQ ID NO: 178624 - RNA, 19 nt, Homo sapiens
agagauugccagcuuccua

SEQ ID NO: 178625 - RNA, 19 nt, Homo sapiens
gucaagaugcucaaagaca

SEQ ID NO: 178626 - RNA, 19 nt, Homo sapiens
gcccaaaugucaggguucu

SEQ ID NO: 178627 - RNA, 19 nt, Homo sapiens
agauggaggugaugaagcu

SEQ ID NO: 178628 - RNA, 19 nt, Homo sapiens
acguggagcugcugugcaa

SEQ ID NO: 178629 - RNA, 19 nt, Homo sapiens
ccaugaucguccugcagaa

SEQ ID NO: 178630 - RNA, 19 nt, Homo sapiens
gagagcugcuaugcuaaac

SEQ ID NO: 178631 - RNA, 19 nt, Homo sapiens
uccaccacauugacuacua

SEQ ID NO: 178632 - RNA, 19 nt, Homo sapiens
gcugaucggccgacacaag

SEQ ID NO: 178633 - RNA, 19 nt, Homo sapiens
ccauagggaccucucgaau

SEQ ID NO: 178634 - RNA, 19 nt, Homo sapiens
aaagacugcagacaucaau

SEQ ID NO: 178635 - RNA, 19 nt, Homo sapiens
uauaacuaccugcuagaug

SEQ ID NO: 178636 - RNA, 19 nt, Homo sapiens
gauggacaggccuuucaug

SEQ ID NO: 178637 - RNA, 19 nt, Homo sapiens
aggagcaaauggcguuuua

SEQ ID NO: 178638 - RNA, 19 nt, Homo sapiens
ggccgucucugaggaguac

SEQ ID NO: 178639 - RNA, 19 nt, Homo sapiens
ccagguauacggacaucau

SEQ ID NO: 178640 - RNA, 19 nt, Homo sapiens
agacugcagacaucaauag

SEQ ID NO: 178641 - RNA, 19 nt, Homo sapiens
uccaguggcugaagcacau

SEQ ID NO: 178642 - RNA, 19 nt, Homo sapiens
ugacacagugcucgaccuu

SEQ ID NO: 178643 - RNA, 19 nt, Homo sapiens
ugaggacaaugugaugaag

SEQ ID NO: 178644 - RNA, 19 nt, Homo sapiens
gaugaagauugcugacuuu

SEQ ID NO: 178645 - RNA, 19 nt, Homo sapiens
gcacuggagucucgugaug

SEQ ID NO: 178646 - RNA, 19 nt, Homo sapiens
cuggagagcugcuaugcua

SEQ ID NO: 178647 - RNA, 19 nt, Homo sapiens
gcaaauggcguuuuauaaa

SEQ ID NO: 178648 - RNA, 19 nt, Homo sapiens
acacagugcucgaccuuga

SEQ ID NO: 178649 - RNA, 19 nt, Homo sapiens
ucaagaugcucaaagacaa

SEQ ID NO: 178650 - RNA, 19 nt, Homo sapiens
gaaccgcauuggaggcauu

SEQ ID NO: 178651 - RNA, 19 nt, Homo sapiens
cauagggaccucucgaaua

SEQ ID NO: 178652 - RNA, 19 nt, Homo sapiens
cacauugacuacuauaaga

SEQ ID NO: 178653 - RNA, 19 nt, Homo sapiens
ggagagcugcuaugcuaaa

SEQ ID NO: 178654 - RNA, 19 nt, Homo sapiens
ccuaaagacugcagacauc

SEQ ID NO: 178655 - RNA, 19 nt, Homo sapiens
ugaugaagauugcugacuu

SEQ ID NO: 178656 - RNA, 19 nt, Homo sapiens
auagggaccucucgaauag

SEQ ID NO: 178657 - RNA, 19 nt, Homo sapiens
ucaaagacaacgccucuga

SEQ ID NO: 178658 - RNA, 19 nt, Homo sapiens
gggcugcuuuggccaggua

SEQ ID NO: 178659 - RNA, 19 nt, Homo sapiens
auaacuaccugcuagaugu

SEQ ID NO: 178660 - RNA, 19 nt, Homo sapiens
gaacaucaucaaccugcuu

SEQ ID NO: 178661 - RNA, 19 nt, Homo sapiens
ugaagcacaucgucaucaa

SEQ ID NO: 178662 - RNA, 19 nt, Homo sapiens
gagcaaauggcguuuuaua

SEQ ID NO: 178663 - RNA, 19 nt, Homo sapiens
agagugacguguggucuuu

SEQ ID NO: 178664 - RNA, 19 nt, Homo sapiens
ccaccacauugacuacuau

SEQ ID NO: 178665 - RNA, 19 nt, Homo sapiens
acaccugccugguagagaa

SEQ ID NO: 178666 - RNA, 19 nt, Homo sapiens
gccuagagauugccagcuu

SEQ ID NO: 178667 - RNA, 19 nt, Homo sapiens
ccagaggccuaccuucaag

SEQ ID NO: 178668 - RNA, 19 nt, Homo sapiens
gagcaggagcugacaguag

SEQ ID NO: 178669 - RNA, 19 nt, Homo sapiens
ccucgugagucuagaucua

SEQ ID NO: 178670 - RNA, 19 nt, Homo sapiens
ucucgaauaggcacaguua

SEQ ID NO: 178671 - RNA, 19 nt, Homo sapiens
agacaacgccucugacaag

SEQ ID NO: 178672 - RNA, 19 nt, Homo sapiens
gcacuguggccgucaagau

SEQ ID NO: 178673 - RNA, 19 nt, Homo sapiens
gcauucggcugcgccauca

SEQ ID NO: 178674 - RNA, 19 nt, Homo sapiens
ccacauugacuacuauaag

SEQ ID NO: 178675 - RNA, 19 nt, Homo sapiens
ccgucaagaugcucaaaga

SEQ ID NO: 178676 - RNA, 19 nt, Homo sapiens
cacauacaccugccuggua

SEQ ID NO: 178677 - RNA, 19 nt, Homo sapiens
gagcugcuaugcuaaaccu

SEQ ID NO: 178678 - RNA, 19 nt, Homo sapiens
ccugauggcccaaauguca

SEQ ID NO: 178679 - RNA, 19 nt, Homo sapiens
gcuggugacugaggacaau

SEQ ID NO: 178680 - RNA, 19 nt, Homo sapiens
cugaggaaguggagcuuga

SEQ ID NO: 178681 - RNA, 19 nt, Homo sapiens
ugcagaaucucaccuugau

SEQ ID NO: 178682 - RNA, 19 nt, Homo sapiens
acaagaacaucaucaaccu

SEQ ID NO: 178683 - RNA, 19 nt, Homo sapiens
uggaggcgcuggacaaggu

SEQ ID NO: 178684 - RNA, 19 nt, Homo sapiens
guacgaggcgugcgucucu

SEQ ID NO: 178685 - RNA, 19 nt, Homo sapiens
cuccagcgauucugucuuc

SEQ ID NO: 178686 - RNA, 19 nt, Homo sapiens
gacacaagaacaucaucaa

SEQ ID NO: 178687 - RNA, 19 nt, Homo sapiens
gucaagcucaucccuggua

SEQ ID NO: 178688 - RNA, 19 nt, Homo sapiens
gaggacaaugugaugaaga

SEQ ID NO: 178689 - RNA, 19 nt, Homo sapiens
ggacaaugugaugaagauu

SEQ ID NO: 178690 - RNA, 19 nt, Homo sapiens
cgacacaagaacaucauca

SEQ ID NO: 178691 - RNA, 19 nt, Homo sapiens
gcuggaagccugccgaaaa

SEQ ID NO: 178692 - RNA, 19 nt, Homo sapiens
aggacaaugugaugaagau

SEQ ID NO: 178693 - RNA, 19 nt, Homo sapiens
aaagacaacgccucugaca

SEQ ID NO: 178694 - RNA, 19 nt, Homo sapiens
uaaagacugcagacaucaa

SEQ ID NO: 178695 - RNA, 19 nt, Homo sapiens
acagugcucgaccuugaua

SEQ ID NO: 178696 - RNA, 19 nt, Homo sapiens
ugacugaggacaaugugau

SEQ ID NO: 178697 - RNA, 19 nt, Homo sapiens
uaucuggagucccggaagu

SEQ ID NO: 178698 - RNA, 19 nt, Homo sapiens
agggaaaccugcgggaguu

SEQ ID NO: 178699 - RNA, 19 nt, Homo sapiens
ggagauggaggugaugaag

SEQ ID NO: 178700 - RNA, 19 nt, Homo sapiens
gucaagaugcucaaagaca

SEQ ID NO: 178701 - RNA, 19 nt, Homo sapiens
agagauugccagcuuccua

SEQ ID NO: 178702 - RNA, 19 nt, Homo sapiens
gcccaaaugucaggguucu

SEQ ID NO: 178703 - RNA, 19 nt, Homo sapiens
agauggaggugaugaagcu

SEQ ID NO: 178704 - RNA, 19 nt, Homo sapiens
acguggagcugcugugcaa

SEQ ID NO: 178705 - RNA, 19 nt, Homo sapiens
gagagcugcuaugcuaaac

SEQ ID NO: 178706 - RNA, 19 nt, Homo sapiens
ccaugaucguccugcagaa

SEQ ID NO: 178707 - RNA, 19 nt, Homo sapiens
uccaccacauugacuacua

SEQ ID NO: 178708 - RNA, 19 nt, Homo sapiens
gcugaucggccgacacaag

SEQ ID NO: 178709 - RNA, 19 nt, Homo sapiens
ccauagggaccucucgaau

SEQ ID NO: 178710 - RNA, 19 nt, Homo sapiens
aaagacugcagacaucaau

SEQ ID NO: 178711 - RNA, 19 nt, Homo sapiens
uauaacuaccugcuagaug

SEQ ID NO: 178712 - RNA, 19 nt, Homo sapiens
gauggacaggccuuucaug

SEQ ID NO: 178713 - RNA, 19 nt, Homo sapiens
aggagcaaauggcguuuua

SEQ ID NO: 178714 - RNA, 19 nt, Homo sapiens
ggccgucucugaggaguac

SEQ ID NO: 178715 - RNA, 19 nt, Homo sapiens
agacugcagacaucaauag

SEQ ID NO: 178716 - RNA, 19 nt, Homo sapiens
uccaguggcugaagcacau

SEQ ID NO: 178717 - RNA, 19 nt, Homo sapiens
ugacacagugcucgaccuu

SEQ ID NO: 178718 - RNA, 19 nt, Homo sapiens
ugaggacaaugugaugaag

SEQ ID NO: 178719 - RNA, 19 nt, Homo sapiens
ggaaauggauggacugugu

SEQ ID NO: 178720 - RNA, 19 nt, Homo sapiens
gauagacgcugcuacuuug

SEQ ID NO: 178721 - RNA, 19 nt, Homo sapiens
gaugaaagauucgguaguu

SEQ ID NO: 178722 - RNA, 19 nt, Homo sapiens
caauccaacucacuuauaa

SEQ ID NO: 178723 - RNA, 19 nt, Homo sapiens
cagauuuccugucuacuua

SEQ ID NO: 178724 - RNA, 19 nt, Homo sapiens
acacaugacucaaguauuc

SEQ ID NO: 178725 - RNA, 19 nt, Homo sapiens
acaaggaucuacagucuuu

SEQ ID NO: 178726 - RNA, 19 nt, Homo sapiens
caaacaggcuggagacguu

SEQ ID NO: 178727 - RNA, 19 nt, Homo sapiens
gcaaauccaugauaucacu

SEQ ID NO: 178728 - RNA, 19 nt, Homo sapiens
gcaaagacacggugcaaau

SEQ ID NO: 178729 - RNA, 19 nt, Homo sapiens
gaagguagcccagcuugaa

SEQ ID NO: 178730 - RNA, 19 nt, Homo sapiens
gaaagauucgguaguuauu

SEQ ID NO: 178731 - RNA, 19 nt, Homo sapiens
uuaaaccucugaaagcuaa

SEQ ID NO: 178732 - RNA, 19 nt, Homo sapiens
gcaauccaacucacuuaua

SEQ ID NO: 178733 - RNA, 19 nt, Homo sapiens
caucuacuccuaaugguua

SEQ ID NO: 178734 - RNA, 19 nt, Homo sapiens
gaagucaaacagcugauaa

SEQ ID NO: 178735 - RNA, 19 nt, Homo sapiens
gcaaagcuucacuucauuu

SEQ ID NO: 178736 - RNA, 19 nt, Homo sapiens
gagcgggcuuuacuuuauu

SEQ ID NO: 178737 - RNA, 19 nt, Homo sapiens
gauaaucccauucaacaga

SEQ ID NO: 178738 - RNA, 19 nt, Homo sapiens
caauggaguuuauuaccaa

SEQ ID NO: 178739 - RNA, 19 nt, Homo sapiens
gaccugaagcugacaagua

SEQ ID NO: 178740 - RNA, 19 nt, Homo sapiens
agacaacugcugcaucuua

SEQ ID NO: 178741 - RNA, 19 nt, Homo sapiens
acaaguaccgccuaacaua

SEQ ID NO: 178742 - RNA, 19 nt, Homo sapiens
gauggacuguguuucagaa

SEQ ID NO: 178743 - RNA, 19 nt, Homo sapiens
gaaauaugaagcaucgauu

SEQ ID NO: 178744 - RNA, 19 nt, Homo sapiens
ccaacuaccuguggcauug

SEQ ID NO: 178745 - RNA, 19 nt, Homo sapiens
gaaccaguacugcagacua

SEQ ID NO: 178746 - RNA, 19 nt, Homo sapiens
gcagauuuccugucuacuu

SEQ ID NO: 178747 - RNA, 19 nt, Homo sapiens
gagacuugauggcagugua

SEQ ID NO: 178748 - RNA, 19 nt, Homo sapiens
gaacaggauggaucugguu

SEQ ID NO: 178749 - RNA, 19 nt, Homo sapiens
ugacucaaguauucgauau

SEQ ID NO: 178750 - RNA, 19 nt, Homo sapiens
gaagauaaucccauucaac

SEQ ID NO: 178751 - RNA, 19 nt, Homo sapiens
gcugggaaaugagaagauu

SEQ ID NO: 178752 - RNA, 19 nt, Homo sapiens
agagcgggcuuuacuuuau

SEQ ID NO: 178753 - RNA, 19 nt, Homo sapiens
ccuaacauaugccuacuuc

SEQ ID NO: 178754 - RNA, 19 nt, Homo sapiens
caucccauaugcauuaaga

SEQ ID NO: 178755 - RNA, 19 nt, Homo sapiens
ggacuguguuucagaagag

SEQ ID NO: 178756 - RNA, 19 nt, Homo sapiens
ccaggaaccuugcaaagac

SEQ ID NO: 178757 - RNA, 19 nt, Homo sapiens
uaacacaugacucaaguau

SEQ ID NO: 178758 - RNA, 19 nt, Homo sapiens
ggaucugguugguggauga

SEQ ID NO: 178759 - RNA, 19 nt, Homo sapiens
gaaggcaacugugcugaac

SEQ ID NO: 178760 - RNA, 19 nt, Homo sapiens
gcugacaaguaccgccuaa

SEQ ID NO: 178761 - RNA, 19 nt, Homo sapiens
ucugaaagcuaaccagcaa

SEQ ID NO: 178762 - RNA, 19 nt, Homo sapiens
ucacuuauaauccugauga

SEQ ID NO: 178763 - RNA, 19 nt, Homo sapiens
aaaccaaaguagacaagga

SEQ ID NO: 178764 - RNA, 19 nt, Homo sapiens
caaaagaccccauguugaa

SEQ ID NO: 178765 - RNA, 19 nt, Homo sapiens
gacaacugcugcaucuuag

SEQ ID NO: 178766 - RNA, 19 nt, Homo sapiens
cuacuucuaugcucuuuua

SEQ ID NO: 178767 - RNA, 19 nt, Homo sapiens
uugcaaagcuucacuucau

SEQ ID NO: 178768 - RNA, 19 nt, Homo sapiens
ugauagacgcugcuacuuu

SEQ ID NO: 178769 - RNA, 19 nt, Homo sapiens
gggacaaugacaaugauaa

SEQ ID NO: 178770 - RNA, 19 nt, Homo sapiens
gaagauucauuugauaagc

SEQ ID NO: 178771 - RNA, 19 nt, Homo sapiens
aaagaaggauuuggacauc

SEQ ID NO: 178772 - RNA, 19 nt, Homo sapiens
ugaaagauucgguaguuau

SEQ ID NO: 178773 - RNA, 19 nt, Homo sapiens
caauggacuugcaaagcuu

SEQ ID NO: 178774 - RNA, 19 nt, Homo sapiens
ucaacagacucacaauugg

SEQ ID NO: 178775 - RNA, 19 nt, Homo sapiens
ucaauggaguuuauuacca

SEQ ID NO: 178776 - RNA, 19 nt, Homo sapiens
ccuguggcauugcagauuu

SEQ ID NO: 178777 - RNA, 19 nt, Homo sapiens
guugguggaugaacaagug

SEQ ID NO: 178778 - RNA, 19 nt, Homo sapiens
caaguaccgccuaacauau

SEQ ID NO: 178779 - RNA, 19 nt, Homo sapiens
cagagcgggcuuuacuuua

SEQ ID NO: 178780 - RNA, 19 nt, Homo sapiens
gcaaaagaccccauguuga

SEQ ID NO: 178781 - RNA, 19 nt, Homo sapiens
ggacaaugacaaugauaag

SEQ ID NO: 178782 - RNA, 19 nt, Homo sapiens
uggaauggcagaaccagua

SEQ ID NO: 178783 - RNA, 19 nt, Homo sapiens
gaacuggaagacuggaaug

SEQ ID NO: 178784 - RNA, 19 nt, Homo sapiens
agagacaacugcugcaucu

SEQ ID NO: 178785 - RNA, 19 nt, Homo sapiens
aaacagagcgggcuuuacu

SEQ ID NO: 178786 - RNA, 19 nt, Homo sapiens
caacagacucacaauugga

SEQ ID NO: 178787 - RNA, 19 nt, Homo sapiens
cauaauggcaugcaguuca

SEQ ID NO: 178788 - RNA, 19 nt, Homo sapiens
ugaaagcuaaccagcaauu

SEQ ID NO: 178789 - RNA, 19 nt, Homo sapiens
caaaacaucagaagucaaa

SEQ ID NO: 178790 - RNA, 19 nt, Homo sapiens
uaaagaaggauuuggacau

SEQ ID NO: 178791 - RNA, 19 nt, Homo sapiens
cgaugggucuggaaaugga

SEQ ID NO: 178792 - RNA, 19 nt, Homo sapiens
ugccaucccauaugcauua

SEQ ID NO: 178793 - RNA, 19 nt, Homo sapiens
gaaauggauggacuguguu

SEQ ID NO: 178794 - RNA, 19 nt, Homo sapiens
ccaauaagggagcuaaaca

SEQ ID NO: 178795 - RNA, 19 nt, Homo sapiens
gugcaaauccaugauauca

SEQ ID NO: 178796 - RNA, 19 nt, Homo sapiens
acaauggacuugcaaagcu

SEQ ID NO: 178797 - RNA, 19 nt, Homo sapiens
ggacaauggacuugcaaag

SEQ ID NO: 178798 - RNA, 19 nt, Homo sapiens
acagagcgggcuuuacuuu

SEQ ID NO: 178799 - RNA, 19 nt, Homo sapiens
ugauaucacugggaaagau

SEQ ID NO: 178800 - RNA, 19 nt, Homo sapiens
aaaagaccguuucaaaaga

SEQ ID NO: 178801 - RNA, 19 nt, Homo sapiens
ggugguauuccaugaagaa

SEQ ID NO: 178802 - RNA, 19 nt, Homo sapiens
ucaaaagcaucuacuccua

SEQ ID NO: 178803 - RNA, 19 nt, Homo sapiens
gcaauucuuagucuacugu

SEQ ID NO: 178804 - RNA, 19 nt, Homo sapiens
gauaucacugggaaagauu

SEQ ID NO: 178805 - RNA, 19 nt, Homo sapiens
aagauucgguaguuauugu

SEQ ID NO: 178806 - RNA, 19 nt, Homo sapiens
aagauaaucccauucaaca

SEQ ID NO: 178807 - RNA, 19 nt, Homo sapiens
ugacaaguaccgccuaaca

SEQ ID NO: 178808 - RNA, 19 nt, Homo sapiens
aaccaguacugcagacuau

SEQ ID NO: 178809 - RNA, 19 nt, Homo sapiens
gcaguguagauuucaagaa

SEQ ID NO: 178810 - RNA, 19 nt, Homo sapiens
ugggaaagauugucaagac

SEQ ID NO: 178811 - RNA, 19 nt, Homo sapiens
ucaaacagcugauaaaagc

SEQ ID NO: 178812 - RNA, 19 nt, Homo sapiens
caagguggcacuuacucaa

SEQ ID NO: 178813 - RNA, 19 nt, Homo sapiens
gcgaugauccuagugacaa

SEQ ID NO: 178814 - RNA, 19 nt, Homo sapiens
gccaggaaccuugcaaaga

SEQ ID NO: 178815 - RNA, 19 nt, Homo sapiens
uaaaagaccguuucaaaag

SEQ ID NO: 178816 - RNA, 19 nt, Homo sapiens
gaaaucgaugggucuggaa

SEQ ID NO: 178817 - RNA, 19 nt, Homo sapiens
agaaggauuuggacaucug

SEQ ID NO: 178818 - RNA, 19 nt, Homo sapiens
ugauggcaguguagauuuc

SEQ ID NO: 178819 - RNA, 19 nt, Homo sapiens
ggaaauggauggacugugu

SEQ ID NO: 178820 - RNA, 19 nt, Homo sapiens
gauagacgcugcuacuuug

SEQ ID NO: 178821 - RNA, 19 nt, Homo sapiens
gaugaaagauucgguaguu

SEQ ID NO: 178822 - RNA, 19 nt, Homo sapiens
caauccaacucacuuauaa

SEQ ID NO: 178823 - RNA, 19 nt, Homo sapiens
cagauuuccugucuacuua

SEQ ID NO: 178824 - RNA, 19 nt, Homo sapiens
acacaugacucaaguauuc

SEQ ID NO: 178825 - RNA, 19 nt, Homo sapiens
acaaggaucuacagucuuu

SEQ ID NO: 178826 - RNA, 19 nt, Homo sapiens
gcaaauccaugauaucacu

SEQ ID NO: 178827 - RNA, 19 nt, Homo sapiens
gcaaagacacggugcaaau

SEQ ID NO: 178828 - RNA, 19 nt, Homo sapiens
ggaaacagaauaugacuca

SEQ ID NO: 178829 - RNA, 19 nt, Homo sapiens
gaagguagcccagcuugaa

SEQ ID NO: 178830 - RNA, 19 nt, Homo sapiens
gaaagauucgguaguuauu

SEQ ID NO: 178831 - RNA, 19 nt, Homo sapiens
uuaaaccucugaaagcuaa

SEQ ID NO: 178832 - RNA, 19 nt, Homo sapiens
gcaauccaacucacuuaua

SEQ ID NO: 178833 - RNA, 19 nt, Homo sapiens
cagaauaugacucacuuua

SEQ ID NO: 178834 - RNA, 19 nt, Homo sapiens
caucuacuccuaaugguua

SEQ ID NO: 178835 - RNA, 19 nt, Homo sapiens
gaagucaaacagcugauaa

SEQ ID NO: 178836 - RNA, 19 nt, Homo sapiens
gagcgggcuuuacuuuauu

SEQ ID NO: 178837 - RNA, 19 nt, Homo sapiens
gauaaucccauucaacaga

SEQ ID NO: 178838 - RNA, 19 nt, Homo sapiens
caauggaguuuauuaccaa

SEQ ID NO: 178839 - RNA, 19 nt, Homo sapiens
gaccugaagcugacaagua

SEQ ID NO: 178840 - RNA, 19 nt, Homo sapiens
agacaacugcugcaucuua

SEQ ID NO: 178841 - RNA, 19 nt, Homo sapiens
acaaguaccgccuaacaua

SEQ ID NO: 178842 - RNA, 19 nt, Homo sapiens
gauggacuguguuucagaa

SEQ ID NO: 178843 - RNA, 19 nt, Homo sapiens
gaaauaugaagcaucgauu

SEQ ID NO: 178844 - RNA, 19 nt, Homo sapiens
ccaacuaccuguggcauug

SEQ ID NO: 178845 - RNA, 19 nt, Homo sapiens
gaaccaguacugcagacua

SEQ ID NO: 178846 - RNA, 19 nt, Homo sapiens
gaauaugacucacuuuacc

SEQ ID NO: 178847 - RNA, 19 nt, Homo sapiens
gcagauuuccugucuacuu

SEQ ID NO: 178848 - RNA, 19 nt, Homo sapiens
gagacuugauggcagugua

SEQ ID NO: 178849 - RNA, 19 nt, Homo sapiens
gaacaggauggaucugguu

SEQ ID NO: 178850 - RNA, 19 nt, Homo sapiens
ugacucaaguauucgauau

SEQ ID NO: 178851 - RNA, 19 nt, Homo sapiens
gaagauaaucccauucaac

SEQ ID NO: 178852 - RNA, 19 nt, Homo sapiens
gcugggaaaugagaagauu

SEQ ID NO: 178853 - RNA, 19 nt, Homo sapiens
agagcgggcuuuacuuuau

SEQ ID NO: 178854 - RNA, 19 nt, Homo sapiens
ccuaacauaugccuacuuc

SEQ ID NO: 178855 - RNA, 19 nt, Homo sapiens
caucccauaugcauuaaga

SEQ ID NO: 178856 - RNA, 19 nt, Homo sapiens
ggacuguguuucagaagag

SEQ ID NO: 178857 - RNA, 19 nt, Homo sapiens
ccaggaaccuugcaaagac

SEQ ID NO: 178858 - RNA, 19 nt, Homo sapiens
uaacacaugacucaaguau

SEQ ID NO: 178859 - RNA, 19 nt, Homo sapiens
ggaucugguugguggauga

SEQ ID NO: 178860 - RNA, 19 nt, Homo sapiens
gaaggcaacugugcugaac

SEQ ID NO: 178861 - RNA, 19 nt, Homo sapiens
gcugacaaguaccgccuaa

SEQ ID NO: 178862 - RNA, 19 nt, Homo sapiens
ucugaaagcuaaccagcaa

SEQ ID NO: 178863 - RNA, 19 nt, Homo sapiens
ucacuuauaauccugauga

SEQ ID NO: 178864 - RNA, 19 nt, Homo sapiens
aaaccaaaguagacaagga

SEQ ID NO: 178865 - RNA, 19 nt, Homo sapiens
cuacuucuaugcucuuuua

SEQ ID NO: 178866 - RNA, 19 nt, Homo sapiens
gacaacugcugcaucuuag

SEQ ID NO: 178867 - RNA, 19 nt, Homo sapiens
ugauagacgcugcuacuuu

SEQ ID NO: 178868 - RNA, 19 nt, Homo sapiens
gggacaaugacaaugauaa

SEQ ID NO: 178869 - RNA, 19 nt, Homo sapiens
gaagauucauuugauaagc

SEQ ID NO: 178870 - RNA, 19 nt, Homo sapiens
aaagaaggauuuggacauc

SEQ ID NO: 178871 - RNA, 19 nt, Homo sapiens
ugaaagauucgguaguuau

SEQ ID NO: 178872 - RNA, 19 nt, Homo sapiens
ucaacagacucacaauugg

SEQ ID NO: 178873 - RNA, 19 nt, Homo sapiens
ucaauggaguuuauuacca

SEQ ID NO: 178874 - RNA, 19 nt, Homo sapiens
guugguggaugaacaagug

SEQ ID NO: 178875 - RNA, 19 nt, Homo sapiens
caaguaccgccuaacauau

SEQ ID NO: 178876 - RNA, 19 nt, Homo sapiens
ccuguggcauugcagauuu

SEQ ID NO: 178877 - RNA, 19 nt, Homo sapiens
cagagcgggcuuuacuuua

SEQ ID NO: 178878 - RNA, 19 nt, Homo sapiens
ggacaaugacaaugauaag

SEQ ID NO: 178879 - RNA, 19 nt, Homo sapiens
uggaauggcagaaccagua

SEQ ID NO: 178880 - RNA, 19 nt, Homo sapiens
gaacuggaagacuggaaug

SEQ ID NO: 178881 - RNA, 19 nt, Homo sapiens
agagacaacugcugcaucu

SEQ ID NO: 178882 - RNA, 19 nt, Homo sapiens
aaacagagcgggcuuuacu

SEQ ID NO: 178883 - RNA, 19 nt, Homo sapiens
caacagacucacaauugga

SEQ ID NO: 178884 - RNA, 19 nt, Homo sapiens
cauaauggcaugcaguuca

SEQ ID NO: 178885 - RNA, 19 nt, Homo sapiens
ugaaagcuaaccagcaauu

SEQ ID NO: 178886 - RNA, 19 nt, Homo sapiens
caaaacaucagaagucaaa

SEQ ID NO: 178887 - RNA, 19 nt, Homo sapiens
ugaggaugauuuguagaaa

SEQ ID NO: 178888 - RNA, 19 nt, Homo sapiens
uaaagaaggauuuggacau

SEQ ID NO: 178889 - RNA, 19 nt, Homo sapiens
cgaugggucuggaaaugga

SEQ ID NO: 178890 - RNA, 19 nt, Homo sapiens
ugccaucccauaugcauua

SEQ ID NO: 178891 - RNA, 19 nt, Homo sapiens
gaaauggauggacuguguu

SEQ ID NO: 178892 - RNA, 19 nt, Homo sapiens
ccaauaagggagcuaaaca

SEQ ID NO: 178893 - RNA, 19 nt, Homo sapiens
gugcaaauccaugauauca

SEQ ID NO: 178894 - RNA, 19 nt, Homo sapiens
cuauugacccacaaaguuu

SEQ ID NO: 178895 - RNA, 19 nt, Homo sapiens
gaggaugauuuguagaaaa

SEQ ID NO: 178896 - RNA, 19 nt, Homo sapiens
acagagcgggcuuuacuuu

SEQ ID NO: 178897 - RNA, 19 nt, Homo sapiens
ugauaucacugggaaagau

SEQ ID NO: 178898 - RNA, 19 nt, Homo sapiens
agccuucaauggaaauuaa

SEQ ID NO: 178899 - RNA, 19 nt, Homo sapiens
ggugguauuccaugaagaa

SEQ ID NO: 178900 - RNA, 19 nt, Homo sapiens
ucaaaagcaucuacuccua

SEQ ID NO: 178901 - RNA, 19 nt, Homo sapiens
gcaauucuuagucuacugu

SEQ ID NO: 178902 - RNA, 19 nt, Homo sapiens
gauaucacugggaaagauu

SEQ ID NO: 178903 - RNA, 19 nt, Homo sapiens
aagauucgguaguuauugu

SEQ ID NO: 178904 - RNA, 19 nt, Homo sapiens
uugaggagauaacauuuca

SEQ ID NO: 178905 - RNA, 19 nt, Homo sapiens
aagauaaucccauucaaca

SEQ ID NO: 178906 - RNA, 19 nt, Homo sapiens
ugacaaguaccgccuaaca

SEQ ID NO: 178907 - RNA, 19 nt, Homo sapiens
aaccaguacugcagacuau

SEQ ID NO: 178908 - RNA, 19 nt, Homo sapiens
gcaguguagauuucaagaa

SEQ ID NO: 178909 - RNA, 19 nt, Homo sapiens
ugggaaagauugucaagac

SEQ ID NO: 178910 - RNA, 19 nt, Homo sapiens
ucaaacagcugauaaaagc

SEQ ID NO: 178911 - RNA, 19 nt, Homo sapiens
ucuauugacccacaaaguu

SEQ ID NO: 178912 - RNA, 19 nt, Homo sapiens
aacagaauaugacucacuu

SEQ ID NO: 178913 - RNA, 19 nt, Homo sapiens
caagguggcacuuacucaa

SEQ ID NO: 178914 - RNA, 19 nt, Homo sapiens
gcgaugauccuagugacaa

SEQ ID NO: 178915 - RNA, 19 nt, Homo sapiens
gccaggaaccuugcaaaga

SEQ ID NO: 178916 - RNA, 19 nt, Homo sapiens
gaaaucgaugggucuggaa

SEQ ID NO: 178917 - RNA, 19 nt, Homo sapiens
agaaggauuuggacaucug

SEQ ID NO: 178918 - RNA, 19 nt, Homo sapiens
ugauggcaguguagauuuc

SEQ ID NO: 178919 - RNA, 19 nt, Homo sapiens
caagaagacuacacuuuaa

SEQ ID NO: 178920 - RNA, 19 nt, Homo sapiens
gaaaauggcuuuggaaauu

SEQ ID NO: 178921 - RNA, 19 nt, Homo sapiens
ggaggaggauggacuguaa

SEQ ID NO: 178922 - RNA, 19 nt, Homo sapiens
ggacagagaucaugacaac

SEQ ID NO: 178923 - RNA, 19 nt, Homo sapiens
gaaguccaguuccuugaua

SEQ ID NO: 178924 - RNA, 19 nt, Homo sapiens
ccaaauaaauguagacugu

SEQ ID NO: 178925 - RNA, 19 nt, Homo sapiens
gcaaagguguucaguuuca

SEQ ID NO: 178926 - RNA, 19 nt, Homo sapiens
ucaagaagacuacacuuua

SEQ ID NO: 178927 - RNA, 19 nt, Homo sapiens
gcaauucagcuuuguuuaa

SEQ ID NO: 178928 - RNA, 19 nt, Homo sapiens
uggcaaagguguucaguuu

SEQ ID NO: 178929 - RNA, 19 nt, Homo sapiens
gguauaagcucaguggauu

SEQ ID NO: 178930 - RNA, 19 nt, Homo sapiens
gguauucucugaaaucugu

SEQ ID NO: 178931 - RNA, 19 nt, Homo sapiens
gaacugcgcagaagaagau

SEQ ID NO: 178932 - RNA, 19 nt, Homo sapiens
ugaaaucugugguuaugaa

SEQ ID NO: 178933 - RNA, 19 nt, Homo sapiens
gcagauuguucagagauuu

SEQ ID NO: 178934 - RNA, 19 nt, Homo sapiens
gaaucaacauugucccuau

SEQ ID NO: 178935 - RNA, 19 nt, Homo sapiens
guacagcagauaugcaaua

SEQ ID NO: 178936 - RNA, 19 nt, Homo sapiens
caugauaacuguugugagu

SEQ ID NO: 178937 - RNA, 19 nt, Homo sapiens
gaagggaacugcgcagaag

SEQ ID NO: 178938 - RNA, 19 nt, Homo sapiens
guucagagauuuucaauga

SEQ ID NO: 178939 - RNA, 19 nt, Homo sapiens
gaacauauccaugcgcaau

SEQ ID NO: 178940 - RNA, 19 nt, Homo sapiens
gcaaucaugauaacuguug

SEQ ID NO: 178941 - RNA, 19 nt, Homo sapiens
ccagagcccagcagaauuu

SEQ ID NO: 178942 - RNA, 19 nt, Homo sapiens
gauaaaggagaugagaaua

SEQ ID NO: 178943 - RNA, 19 nt, Homo sapiens
caaauucccaaugcaguua

SEQ ID NO: 178944 - RNA, 19 nt, Homo sapiens
cagucuggcuggugguuua

SEQ ID NO: 178945 - RNA, 19 nt, Homo sapiens
acagagaucaugacaacua

SEQ ID NO: 178946 - RNA, 19 nt, Homo sapiens
gcuagucaccaaagaauga

SEQ ID NO: 178947 - RNA, 19 nt, Homo sapiens
gaggauggacuguaauuca

SEQ ID NO: 178948 - RNA, 19 nt, Homo sapiens
gaagccagaaucaacauug

SEQ ID NO: 178949 - RNA, 19 nt, Homo sapiens
ucacuugccuuuguuacuu

SEQ ID NO: 178950 - RNA, 19 nt, Homo sapiens
ucucugaaaucugugguua

SEQ ID NO: 178951 - RNA, 19 nt, Homo sapiens
guccuugaaucuucucuuu

SEQ ID NO: 178952 - RNA, 19 nt, Homo sapiens
uaaaggagaugagaauacu

SEQ ID NO: 178953 - RNA, 19 nt, Homo sapiens
gauaaugggcagggaaauu

SEQ ID NO: 178954 - RNA, 19 nt, Homo sapiens
gcgcaaucaugauaacugu

SEQ ID NO: 178955 - RNA, 19 nt, Homo sapiens
gaggauggaaagacuauga

SEQ ID NO: 178956 - RNA, 19 nt, Homo sapiens
ugacucacuucugacuuua

SEQ ID NO: 178957 - RNA, 19 nt, Homo sapiens
gaaaucugugguuaugaaa

SEQ ID NO: 178958 - RNA, 19 nt, Homo sapiens
guggugguauucucugaaa

SEQ ID NO: 178959 - RNA, 19 nt, Homo sapiens
uggcauggguggugguauu

SEQ ID NO: 178960 - RNA, 19 nt, Homo sapiens
cugacucacuucugacuuu

SEQ ID NO: 178961 - RNA, 19 nt, Homo sapiens
ucugaaaucugugguuaug

SEQ ID NO: 178962 - RNA, 19 nt, Homo sapiens
aaaccugaaugguguauac

SEQ ID NO: 178963 - RNA, 19 nt, Homo sapiens
cagagaucaugacaacuau

SEQ ID NO: 178964 - RNA, 19 nt, Homo sapiens
ucacuucugacuuuaguuu

SEQ ID NO: 178965 - RNA, 19 nt, Homo sapiens
ccuugaaucuucucuuuua

SEQ ID NO: 178966 - RNA, 19 nt, Homo sapiens
ugauaacuguugugaguag

SEQ ID NO: 178967 - RNA, 19 nt, Homo sapiens
ggaacauuauugaaguuac

SEQ ID NO: 178968 - RNA, 19 nt, Homo sapiens
aaauagccguuaugcacaa

SEQ ID NO: 178969 - RNA, 19 nt, Homo sapiens
gguguucaguuucauccuu

SEQ ID NO: 178970 - RNA, 19 nt, Homo sapiens
uuaaugugcuuucaguaca

SEQ ID NO: 178971 - RNA, 19 nt, Homo sapiens
gaagcaagaggcaguaugc

SEQ ID NO: 178972 - RNA, 19 nt, Homo sapiens
ggagaaugaaguccaguuc

SEQ ID NO: 178973 - RNA, 19 nt, Homo sapiens
aaucaacauugucccuauu

SEQ ID NO: 178974 - RNA, 19 nt, Homo sapiens
cacuugccuuuguuacuua

SEQ ID NO: 178975 - RNA, 19 nt, Homo sapiens
ggauggaaagacuaugaaa

SEQ ID NO: 178976 - RNA, 19 nt, Homo sapiens
gaggcaguaugcagauugu

SEQ ID NO: 178977 - RNA, 19 nt, Homo sapiens
uaccaccgcucugauaaug

SEQ ID NO: 178978 - RNA, 19 nt, Homo sapiens
cauguuuguuucuggauug

SEQ ID NO: 178979 - RNA, 19 nt, Homo sapiens
gucccuauuucuaaucaaa

SEQ ID NO: 178980 - RNA, 19 nt, Homo sapiens
gcaguaugcagauuguuca

SEQ ID NO: 178981 - RNA, 19 nt, Homo sapiens
uaucagaguauugggauuu

SEQ ID NO: 178982 - RNA, 19 nt, Homo sapiens
ugauaaaggagaugagaau

SEQ ID NO: 178983 - RNA, 19 nt, Homo sapiens
auaaugggcagggaaauuu

SEQ ID NO: 178984 - RNA, 19 nt, Homo sapiens
gagcugggucucugacuca

SEQ ID NO: 178985 - RNA, 19 nt, Homo sapiens
ggcuuucguuucugcaauu

SEQ ID NO: 178986 - RNA, 19 nt, Homo sapiens
gaaugaaguccaguuccuu

SEQ ID NO: 178987 - RNA, 19 nt, Homo sapiens
caacauugucccuauuucu

SEQ ID NO: 178988 - RNA, 19 nt, Homo sapiens
gaauuucuacgaguugaau

SEQ ID NO: 178989 - RNA, 19 nt, Homo sapiens
ggaagcaagaggcaguaug

SEQ ID NO: 178990 - RNA, 19 nt, Homo sapiens
gggcuagucaccaaagaau

SEQ ID NO: 178991 - RNA, 19 nt, Homo sapiens
gaauuucaaaguuggagau

SEQ ID NO: 178992 - RNA, 19 nt, Homo sapiens
uagccguuaugcacaauau

SEQ ID NO: 178993 - RNA, 19 nt, Homo sapiens
ucaacauugucccuauuuc

SEQ ID NO: 178994 - RNA, 19 nt, Homo sapiens
gggcuuucguuucugcaau

SEQ ID NO: 178995 - RNA, 19 nt, Homo sapiens
gcacgugggacagagauca

SEQ ID NO: 178996 - RNA, 19 nt, Homo sapiens
ggauggacuguaauucaga

SEQ ID NO: 178997 - RNA, 19 nt, Homo sapiens
guauaagcucaguggauuu

SEQ ID NO: 178998 - RNA, 19 nt, Homo sapiens
ggaacugcgcagaagaaga

SEQ ID NO: 178999 - RNA, 19 nt, Homo sapiens
guuaccaccgcucugauaa

SEQ ID NO: 179000 - RNA, 19 nt, Homo sapiens
ggugguauucucugaaauc

SEQ ID NO: 179001 - RNA, 19 nt, Homo sapiens
ucagagauuuucaaugaug

SEQ ID NO: 179002 - RNA, 19 nt, Homo sapiens
ucaaacagcaacaggucaa

SEQ ID NO: 179003 - RNA, 19 nt, Homo sapiens
ccugaaugguguauacuac

SEQ ID NO: 179004 - RNA, 19 nt, Homo sapiens
ugaagggaacugcgcagaa

SEQ ID NO: 179005 - RNA, 19 nt, Homo sapiens
uaacagaggauggaaagac

SEQ ID NO: 179006 - RNA, 19 nt, Homo sapiens
agcaacaggucaagaucaa

SEQ ID NO: 179007 - RNA, 19 nt, Homo sapiens
acauugucccuauuucuaa

SEQ ID NO: 179008 - RNA, 19 nt, Homo sapiens
acauauccaugcgcaauca

SEQ ID NO: 179009 - RNA, 19 nt, Homo sapiens
ggguggugguauucucuga

SEQ ID NO: 179010 - RNA, 19 nt, Homo sapiens
cauugucccuauuucuaau

SEQ ID NO: 179011 - RNA, 19 nt, Homo sapiens
acaaauucccaaugcaguu

SEQ ID NO: 179012 - RNA, 19 nt, Homo sapiens
ucuacgaguugaauauugg

SEQ ID NO: 179013 - RNA, 19 nt, Homo sapiens
caagaggcaguaugcagau

SEQ ID NO: 179014 - RNA, 19 nt, Homo sapiens
aacauugucccuauuucua

SEQ ID NO: 179015 - RNA, 19 nt, Homo sapiens
uuucugcaauucagcuuug

SEQ ID NO: 179016 - RNA, 19 nt, Homo sapiens
cucaagaagacuacacuuu

SEQ ID NO: 179017 - RNA, 19 nt, Homo sapiens
cagcaacaggucaagauca

SEQ ID NO: 179018 - RNA, 19 nt, Homo sapiens
caaagguguucaguuucau

SEQ ID NO: 179019 - RNA, 19 nt, Homo sapiens
caagaagacuacacuuuaa

SEQ ID NO: 179020 - RNA, 19 nt, Homo sapiens
gaaaauggcuuuggaaauu

SEQ ID NO: 179021 - RNA, 19 nt, Homo sapiens
ggaggaggauggacuguaa

SEQ ID NO: 179022 - RNA, 19 nt, Homo sapiens
ggacagagaucaugacaac

SEQ ID NO: 179023 - RNA, 19 nt, Homo sapiens
gaaguccaguuccuugaua

SEQ ID NO: 179024 - RNA, 19 nt, Homo sapiens
ccaaauaaauguagacugu

SEQ ID NO: 179025 - RNA, 19 nt, Homo sapiens
gcaaagguguucaguuuca

SEQ ID NO: 179026 - RNA, 19 nt, Homo sapiens
ucaagaagacuacacuuua

SEQ ID NO: 179027 - RNA, 19 nt, Homo sapiens
gcaauucagcuuuguuuaa

SEQ ID NO: 179028 - RNA, 19 nt, Homo sapiens
uggcaaagguguucaguuu

SEQ ID NO: 179029 - RNA, 19 nt, Homo sapiens
gguauaagcucaguggauu

SEQ ID NO: 179030 - RNA, 19 nt, Homo sapiens
gguauucucugaaaucugu

SEQ ID NO: 179031 - RNA, 19 nt, Homo sapiens
gaacugcgcagaagaagau

SEQ ID NO: 179032 - RNA, 19 nt, Homo sapiens
ugaaaucugugguuaugaa

SEQ ID NO: 179033 - RNA, 19 nt, Homo sapiens
gcagauuguucagagauuu

SEQ ID NO: 179034 - RNA, 19 nt, Homo sapiens
guacagcagauaugcaaua

SEQ ID NO: 179035 - RNA, 19 nt, Homo sapiens
caugauaacuguugugagu

SEQ ID NO: 179036 - RNA, 19 nt, Homo sapiens
gaagggaacugcgcagaag

SEQ ID NO: 179037 - RNA, 19 nt, Homo sapiens
guucagagauuuucaauga

SEQ ID NO: 179038 - RNA, 19 nt, Homo sapiens
gaacauauccaugcgcaau

SEQ ID NO: 179039 - RNA, 19 nt, Homo sapiens
ggagaagagauuuagaauu

SEQ ID NO: 179040 - RNA, 19 nt, Homo sapiens
gcaaucaugauaacuguug

SEQ ID NO: 179041 - RNA, 19 nt, Homo sapiens
gguaacaaccauuagcuuu

SEQ ID NO: 179042 - RNA, 19 nt, Homo sapiens
ccagagcccagcagaauuu

SEQ ID NO: 179043 - RNA, 19 nt, Homo sapiens
gauaaaggagaugagaaua

SEQ ID NO: 179044 - RNA, 19 nt, Homo sapiens
cagucuggcuggugguuua

SEQ ID NO: 179045 - RNA, 19 nt, Homo sapiens
acagagaucaugacaacua

SEQ ID NO: 179046 - RNA, 19 nt, Homo sapiens
gcuagucaccaaagaauga

SEQ ID NO: 179047 - RNA, 19 nt, Homo sapiens
gaggauggacuguaauuca

SEQ ID NO: 179048 - RNA, 19 nt, Homo sapiens
ucacuugccuuuguuacuu

SEQ ID NO: 179049 - RNA, 19 nt, Homo sapiens
ucucugaaaucugugguua

SEQ ID NO: 179050 - RNA, 19 nt, Homo sapiens
uaaaggagaugagaauacu

SEQ ID NO: 179051 - RNA, 19 nt, Homo sapiens
gauaaugggcagggaaauu

SEQ ID NO: 179052 - RNA, 19 nt, Homo sapiens
gcgcaaucaugauaacugu

SEQ ID NO: 179053 - RNA, 19 nt, Homo sapiens
gaggauggaaagacuauga

SEQ ID NO: 179054 - RNA, 19 nt, Homo sapiens
gaaaucugugguuaugaaa

SEQ ID NO: 179055 - RNA, 19 nt, Homo sapiens
guggugguauucucugaaa

SEQ ID NO: 179056 - RNA, 19 nt, Homo sapiens
uggcauggguggugguauu

SEQ ID NO: 179057 - RNA, 19 nt, Homo sapiens
ucugaaaucugugguuaug

SEQ ID NO: 179058 - RNA, 19 nt, Homo sapiens
aaaccugaaugguguauac

SEQ ID NO: 179059 - RNA, 19 nt, Homo sapiens
cagagaucaugacaacuau

SEQ ID NO: 179060 - RNA, 19 nt, Homo sapiens
ugauaacuguugugaguag

SEQ ID NO: 179061 - RNA, 19 nt, Homo sapiens
aaauagccguuaugcacaa

SEQ ID NO: 179062 - RNA, 19 nt, Homo sapiens
gguguucaguuucauccuu

SEQ ID NO: 179063 - RNA, 19 nt, Homo sapiens
uuaaugugcuuucaguaca

SEQ ID NO: 179064 - RNA, 19 nt, Homo sapiens
gaagcaagaggcaguaugc

SEQ ID NO: 179065 - RNA, 19 nt, Homo sapiens
ggagaaugaaguccaguuc

SEQ ID NO: 179066 - RNA, 19 nt, Homo sapiens
cacuugccuuuguuacuua

SEQ ID NO: 179067 - RNA, 19 nt, Homo sapiens
ggauggaaagacuaugaaa

SEQ ID NO: 179068 - RNA, 19 nt, Homo sapiens
uuucacagguaugauagua

SEQ ID NO: 179069 - RNA, 19 nt, Homo sapiens
gaggcaguaugcagauugu

SEQ ID NO: 179070 - RNA, 19 nt, Homo sapiens
ucacagguaugauaguaac

SEQ ID NO: 179071 - RNA, 19 nt, Homo sapiens
uaccaccgcucugauaaug

SEQ ID NO: 179072 - RNA, 19 nt, Homo sapiens
aaacucagguaacaaccau

SEQ ID NO: 179073 - RNA, 19 nt, Homo sapiens
gcaguaugcagauuguuca

SEQ ID NO: 179074 - RNA, 19 nt, Homo sapiens
uaacaaccauuagcuuuug

SEQ ID NO: 179075 - RNA, 19 nt, Homo sapiens
acucagguaacaaccauua

SEQ ID NO: 179076 - RNA, 19 nt, Homo sapiens
ugauaaaggagaugagaau

SEQ ID NO: 179077 - RNA, 19 nt, Homo sapiens
auaaugggcagggaaauuu

SEQ ID NO: 179078 - RNA, 19 nt, Homo sapiens
ggcuuucguuucugcaauu

SEQ ID NO: 179079 - RNA, 19 nt, Homo sapiens
gaaugaaguccaguuccuu

SEQ ID NO: 179080 - RNA, 19 nt, Homo sapiens
gaauuucuacgaguugaau

SEQ ID NO: 179081 - RNA, 19 nt, Homo sapiens
ggaagcaagaggcaguaug

SEQ ID NO: 179082 - RNA, 19 nt, Homo sapiens
gggcuagucaccaaagaau

SEQ ID NO: 179083 - RNA, 19 nt, Homo sapiens
gaauuucaaaguuggagau

SEQ ID NO: 179084 - RNA, 19 nt, Homo sapiens
uagccguuaugcacaauau

SEQ ID NO: 179085 - RNA, 19 nt, Homo sapiens
ggagucugcuucugcuacu

SEQ ID NO: 179086 - RNA, 19 nt, Homo sapiens
gggcuuucguuucugcaau

SEQ ID NO: 179087 - RNA, 19 nt, Homo sapiens
gcacgugggacagagauca

SEQ ID NO: 179088 - RNA, 19 nt, Homo sapiens
ggauggacuguaauucaga

SEQ ID NO: 179089 - RNA, 19 nt, Homo sapiens
guauaagcucaguggauuu

SEQ ID NO: 179090 - RNA, 19 nt, Homo sapiens
ggaacugcgcagaagaaga

SEQ ID NO: 179091 - RNA, 19 nt, Homo sapiens
guuaccaccgcucugauaa

SEQ ID NO: 179092 - RNA, 19 nt, Homo sapiens
ggugguauucucugaaauc

SEQ ID NO: 179093 - RNA, 19 nt, Homo sapiens
ucagagauuuucaaugaug

SEQ ID NO: 179094 - RNA, 19 nt, Homo sapiens
ucaaacagcaacaggucaa

SEQ ID NO: 179095 - RNA, 19 nt, Homo sapiens
ccugaaugguguauacuac

SEQ ID NO: 179096 - RNA, 19 nt, Homo sapiens
ugaagggaacugcgcagaa

SEQ ID NO: 179097 - RNA, 19 nt, Homo sapiens
uaacagaggauggaaagac

SEQ ID NO: 179098 - RNA, 19 nt, Homo sapiens
guaacaaccauuagcuuuu

SEQ ID NO: 179099 - RNA, 19 nt, Homo sapiens
agcaacaggucaagaucaa

SEQ ID NO: 179100 - RNA, 19 nt, Homo sapiens
acauauccaugcgcaauca

SEQ ID NO: 179101 - RNA, 19 nt, Homo sapiens
ggguggugguauucucuga

SEQ ID NO: 179102 - RNA, 19 nt, Homo sapiens
ucuacgaguugaauauugg

SEQ ID NO: 179103 - RNA, 19 nt, Homo sapiens
caagaggcaguaugcagau

SEQ ID NO: 179104 - RNA, 19 nt, Homo sapiens
uuucugcaauucagcuuug

SEQ ID NO: 179105 - RNA, 19 nt, Homo sapiens
caaagguguucaguuucau

SEQ ID NO: 179106 - RNA, 19 nt, Homo sapiens
cucaagaagacuacacuuu

SEQ ID NO: 179107 - RNA, 19 nt, Homo sapiens
cagcaacaggucaagauca

SEQ ID NO: 179108 - RNA, 19 nt, Homo sapiens
caguacagcagauaugcaa

SEQ ID NO: 179109 - RNA, 19 nt, Homo sapiens
cugcaauucagcuuuguuu

SEQ ID NO: 179110 - RNA, 19 nt, Homo sapiens
gcuguugggcuuucguuuc

SEQ ID NO: 179111 - RNA, 19 nt, Homo sapiens
cagguaugauaguaaccaa

SEQ ID NO: 179112 - RNA, 19 nt, Homo sapiens
ggaaagacuaugaaaaugg

SEQ ID NO: 179113 - RNA, 19 nt, Homo sapiens
cagaggauggaaagacuau

SEQ ID NO: 179114 - RNA, 19 nt, Homo sapiens
aaguccaguuccuugauaa

SEQ ID NO: 179115 - RNA, 19 nt, Homo sapiens
uaaaacagacaaugggauu

SEQ ID NO: 179116 - RNA, 19 nt, Homo sapiens
ggaggauggacuguaauuc

SEQ ID NO: 179117 - RNA, 19 nt, Homo sapiens
ggguauaagcucaguggau

SEQ ID NO: 179118 - RNA, 19 nt, Homo sapiens
ggcaguaugcagauuguuc

SEQ ID NO: 179119 - RNA, 19 nt, Homo sapiens
gaccuugucuaguuauuua

SEQ ID NO: 179120 - RNA, 19 nt, Homo sapiens
gcgaucaugugaagcauua

SEQ ID NO: 179121 - RNA, 19 nt, Homo sapiens
gcacuaagguggcggugaa

SEQ ID NO: 179122 - RNA, 19 nt, Homo sapiens
ucacugagcucaucaccaa

SEQ ID NO: 179123 - RNA, 19 nt, Homo sapiens
ggacauggcagcccaggua

SEQ ID NO: 179124 - RNA, 19 nt, Homo sapiens
gaagagugguacuuuggaa

SEQ ID NO: 179125 - RNA, 19 nt, Homo sapiens
guguguauguguugauuua

SEQ ID NO: 179126 - RNA, 19 nt, Homo sapiens
cccagaagcugcccucuuu

SEQ ID NO: 179127 - RNA, 19 nt, Homo sapiens
ggaggaugcuggccuggaa

SEQ ID NO: 179128 - RNA, 19 nt, Homo sapiens
gaauaaacgggaaguguug

SEQ ID NO: 179129 - RNA, 19 nt, Homo sapiens
ccagagcuguucuuccaaa

SEQ ID NO: 179130 - RNA, 19 nt, Homo sapiens
gcacuucccaccucucuga

SEQ ID NO: 179131 - RNA, 19 nt, Homo sapiens
guauguaccucccucacuu

SEQ ID NO: 179132 - RNA, 19 nt, Homo sapiens
caucaacccuggcuuccuu

SEQ ID NO: 179133 - RNA, 19 nt, Homo sapiens
ggaaugggcuguguguucu

SEQ ID NO: 179134 - RNA, 19 nt, Homo sapiens
ccaccucucugaauagugu

SEQ ID NO: 179135 - RNA, 19 nt, Homo sapiens
ccacacggguucaguucaa

SEQ ID NO: 179136 - RNA, 19 nt, Homo sapiens
gcugaagagugguacuuug

SEQ ID NO: 179137 - RNA, 19 nt, Homo sapiens
ugaauaguguguauguguu

SEQ ID NO: 179138 - RNA, 19 nt, Homo sapiens
aacccuggcuuccuugaua

SEQ ID NO: 179139 - RNA, 19 nt, Homo sapiens
ggaaagcgagaccaccaaa

SEQ ID NO: 179140 - RNA, 19 nt, Homo sapiens
guaccucccucacuucucu

SEQ ID NO: 179141 - RNA, 19 nt, Homo sapiens
gaccagaggcgaucaugug

SEQ ID NO: 179142 - RNA, 19 nt, Homo sapiens
cuucccaccucucugaaua

SEQ ID NO: 179143 - RNA, 19 nt, Homo sapiens
ucuauucucuugugucugu

SEQ ID NO: 179144 - RNA, 19 nt, Homo sapiens
caagcacuauuucuuccuu

SEQ ID NO: 179145 - RNA, 19 nt, Homo sapiens
ucacuucucuccuaucacu

SEQ ID NO: 179146 - RNA, 19 nt, Homo sapiens
gaacgcaugaacuacauuc

SEQ ID NO: 179147 - RNA, 19 nt, Homo sapiens
gaauaguguguauguguug

SEQ ID NO: 179148 - RNA, 19 nt, Homo sapiens
ggaaagauugggagaaagg

SEQ ID NO: 179149 - RNA, 19 nt, Homo sapiens
ucgaguaccugcaguccuu

SEQ ID NO: 179150 - RNA, 19 nt, Homo sapiens
ugaauaaacgggaaguguu

SEQ ID NO: 179151 - RNA, 19 nt, Homo sapiens
cagaggcgaucaugugaag

SEQ ID NO: 179152 - RNA, 19 nt, Homo sapiens
guccaggugccaagaauuu

SEQ ID NO: 179153 - RNA, 19 nt, Homo sapiens
ccucacuucucuccuauca

SEQ ID NO: 179154 - RNA, 19 nt, Homo sapiens
uuggaaagauugggagaaa

SEQ ID NO: 179155 - RNA, 19 nt, Homo sapiens
gauucaccaucaagucaga

SEQ ID NO: 179156 - RNA, 19 nt, Homo sapiens
ccauagaguccuagcauca

SEQ ID NO: 179157 - RNA, 19 nt, Homo sapiens
ucagacgugugguccuuug

SEQ ID NO: 179158 - RNA, 19 nt, Homo sapiens
gugcaagaucgcagacuuu

SEQ ID NO: 179159 - RNA, 19 nt, Homo sapiens
uaucacugcuuuccuacuc

SEQ ID NO: 179160 - RNA, 19 nt, Homo sapiens
ggagcagggcuaccacaug

SEQ ID NO: 179161 - RNA, 19 nt, Homo sapiens
caaggacgaugaguacaac

SEQ ID NO: 179162 - RNA, 19 nt, Homo sapiens
ucaaggacgaugaguacaa

SEQ ID NO: 179163 - RNA, 19 nt, Homo sapiens
ccagagggccaggauuuga

SEQ ID NO: 179164 - RNA, 19 nt, Homo sapiens
ucaccaagggcgagaaguu

SEQ ID NO: 179165 - RNA, 19 nt, Homo sapiens
gcagauucaccaucaaguc

SEQ ID NO: 179166 - RNA, 19 nt, Homo sapiens
cugccaagguuccaaguuc

SEQ ID NO: 179167 - RNA, 19 nt, Homo sapiens
uuccacauccugaacaaua

SEQ ID NO: 179168 - RNA, 19 nt, Homo sapiens
gaacccagagggccaggau

SEQ ID NO: 179169 - RNA, 19 nt, Homo sapiens
ggaggagcccaucuacauc

SEQ ID NO: 179170 - RNA, 19 nt, Homo sapiens
cggaggagcccaucuacau

SEQ ID NO: 179171 - RNA, 19 nt, Homo sapiens
uaaguuacaaagucaggaa

SEQ ID NO: 179172 - RNA, 19 nt, Homo sapiens
ucucuccuaucacugcuuu

SEQ ID NO: 179173 - RNA, 19 nt, Homo sapiens
cagauucaccaucaaguca

SEQ ID NO: 179174 - RNA, 19 nt, Homo sapiens
ugugaagcauuacaagauc

SEQ ID NO: 179175 - RNA, 19 nt, Homo sapiens
gaaagauugggagaaagga

SEQ ID NO: 179176 - RNA, 19 nt, Homo sapiens
ucucuugugucuguaaguu

SEQ ID NO: 179177 - RNA, 19 nt, Homo sapiens
cuucuacccucuauucucu

SEQ ID NO: 179178 - RNA, 19 nt, Homo sapiens
uccuaucacugcuuuccua

SEQ ID NO: 179179 - RNA, 19 nt, Homo sapiens
cgugcaagaucgcagacuu

SEQ ID NO: 179180 - RNA, 19 nt, Homo sapiens
ccucuauucucuugugucu

SEQ ID NO: 179181 - RNA, 19 nt, Homo sapiens
cggccugcauccucauuug

SEQ ID NO: 179182 - RNA, 19 nt, Homo sapiens
gaucaugugaagcauuaca

SEQ ID NO: 179183 - RNA, 19 nt, Homo sapiens
gaaagcgagaccaccaaag

SEQ ID NO: 179184 - RNA, 19 nt, Homo sapiens
uggcgcgucucaucaagga

SEQ ID NO: 179185 - RNA, 19 nt, Homo sapiens
caaggacgccugggagauc

SEQ ID NO: 179186 - RNA, 19 nt, Homo sapiens
gcgagaaguuccacauccu

SEQ ID NO: 179187 - RNA, 19 nt, Homo sapiens
uggaaugggcuguguguuc

SEQ ID NO: 179188 - RNA, 19 nt, Homo sapiens
aagcacuauuucuuccuuu

SEQ ID NO: 179189 - RNA, 19 nt, Homo sapiens
caugugaagcauuacaaga

SEQ ID NO: 179190 - RNA, 19 nt, Homo sapiens
gaggcgaucaugugaagca

SEQ ID NO: 179191 - RNA, 19 nt, Homo sapiens
cagagaggcagcugcuuuc

SEQ ID NO: 179192 - RNA, 19 nt, Homo sapiens
acagcaacuucuccucuca

SEQ ID NO: 179193 - RNA, 19 nt, Homo sapiens
ggaacgcaugaacuacauu

SEQ ID NO: 179194 - RNA, 19 nt, Homo sapiens
ccuguucauugcccuguau

SEQ ID NO: 179195 - RNA, 19 nt, Homo sapiens
gcccagguuugagggagaa

SEQ ID NO: 179196 - RNA, 19 nt, Homo sapiens
uuuggcagauucaccauca

SEQ ID NO: 179197 - RNA, 19 nt, Homo sapiens
ugaaugacgggcugugcaa

SEQ ID NO: 179198 - RNA, 19 nt, Homo sapiens
ggcuguguguucugcaaga

SEQ ID NO: 179199 - RNA, 19 nt, Homo sapiens
uaguguguauguguugauu

SEQ ID NO: 179200 - RNA, 19 nt, Homo sapiens
ucuacccucuauucucuug

SEQ ID NO: 179201 - RNA, 19 nt, Homo sapiens
acccagagggccaggauuu

SEQ ID NO: 179202 - RNA, 19 nt, Homo sapiens
cugaauaguguguaugugu

SEQ ID NO: 179203 - RNA, 19 nt, Homo sapiens
gagcacuucccaccucucu

SEQ ID NO: 179204 - RNA, 19 nt, Homo sapiens
gggcagcagaccacuaugg

SEQ ID NO: 179205 - RNA, 19 nt, Homo sapiens
uggaacgcaugaacuacau

SEQ ID NO: 179206 - RNA, 19 nt, Homo sapiens
caucgugaccgaguucaug

SEQ ID NO: 179207 - RNA, 19 nt, Homo sapiens
gggaaagcgagaccaccaa

SEQ ID NO: 179208 - RNA, 19 nt, Homo sapiens
ccugaacaauacugaaggu

SEQ ID NO: 179209 - RNA, 19 nt, Homo sapiens
gggcaaccuacuuguuuua

SEQ ID NO: 179210 - RNA, 19 nt, Homo sapiens
uguaugagcguaugagcau

SEQ ID NO: 179211 - RNA, 19 nt, Homo sapiens
ucaccacacggguucaguu

SEQ ID NO: 179212 - RNA, 19 nt, Homo sapiens
gcauuacaagauccgcaaa

SEQ ID NO: 179213 - RNA, 19 nt, Homo sapiens
aaagcgagaccaccaaagg

SEQ ID NO: 179214 - RNA, 19 nt, Homo sapiens
gaauugaucuugccugaaa

SEQ ID NO: 179215 - RNA, 19 nt, Homo sapiens
gaucuacgaugaacuuuaa

SEQ ID NO: 179216 - RNA, 19 nt, Homo sapiens
ucaacaagcugaugaauga

SEQ ID NO: 179217 - RNA, 19 nt, Homo sapiens
gaaugagucucuaauguug

SEQ ID NO: 179218 - RNA, 19 nt, Homo sapiens
gaaaggaaacugcuauuga

SEQ ID NO: 179219 - RNA, 19 nt, Homo sapiens
gcacagaucaucaagauug

SEQ ID NO: 179220 - RNA, 19 nt, Homo sapiens
ugagguagcugaagguaaa

SEQ ID NO: 179221 - RNA, 19 nt, Homo sapiens
aaaggaaacugcuauugaa

SEQ ID NO: 179222 - RNA, 19 nt, Homo sapiens
gaaguuacaugaugcucuu

SEQ ID NO: 179223 - RNA, 19 nt, Homo sapiens
agccagagcucaaaugaua

SEQ ID NO: 179224 - RNA, 19 nt, Homo sapiens
ggaaacugcuauugaacuu

SEQ ID NO: 179225 - RNA, 19 nt, Homo sapiens
aaaggaaacugcuaucgaa

SEQ ID NO: 179226 - RNA, 19 nt, Homo sapiens
gaaggcagcagaugaggua

SEQ ID NO: 179227 - RNA, 19 nt, Homo sapiens
gaacuaaaggugccaaaug

SEQ ID NO: 179228 - RNA, 19 nt, Homo sapiens
ggaaacugcuaucgaacuu

SEQ ID NO: 179229 - RNA, 19 nt, Homo sapiens
cuacagaaguuacaugaug

SEQ ID NO: 179230 - RNA, 19 nt, Homo sapiens
ccaacgaucauguuaauaa

SEQ ID NO: 179231 - RNA, 19 nt, Homo sapiens
gaacucagacaaauaugaa

SEQ ID NO: 179232 - RNA, 19 nt, Homo sapiens
ggucuaagauggauuaaac

SEQ ID NO: 179233 - RNA, 19 nt, Homo sapiens
ggaauuuagugguuauguu

SEQ ID NO: 179234 - RNA, 19 nt, Homo sapiens
ugaugaagauagcaaauga

SEQ ID NO: 179235 - RNA, 19 nt, Homo sapiens
caauagaaguucaugaagu

SEQ ID NO: 179236 - RNA, 19 nt, Homo sapiens
ggauaaguuugaaaggaaa

SEQ ID NO: 179237 - RNA, 19 nt, Homo sapiens
agaauuggcuuugcagaaa

SEQ ID NO: 179238 - RNA, 19 nt, Homo sapiens
gguacagguuuaaauacua

SEQ ID NO: 179239 - RNA, 19 nt, Homo sapiens
acgaugaacuuuaagauug

SEQ ID NO: 179240 - RNA, 19 nt, Homo sapiens
ucaagccaaugaugauuaa

SEQ ID NO: 179241 - RNA, 19 nt, Homo sapiens
ggucaggucugggagaauu

SEQ ID NO: 179242 - RNA, 19 nt, Homo sapiens
gggcaggaauuuagugguu

SEQ ID NO: 179243 - RNA, 19 nt, Homo sapiens
gaucaggaacucagacaaa

SEQ ID NO: 179244 - RNA, 19 nt, Homo sapiens
ucacugcuccgaauaaauu

SEQ ID NO: 179245 - RNA, 19 nt, Homo sapiens
uaaaggugccaaaugauaa

SEQ ID NO: 179246 - RNA, 19 nt, Homo sapiens
ugacaaggcagcaaagauu

SEQ ID NO: 179247 - RNA, 19 nt, Homo sapiens
gauagcaaaugauauucga

SEQ ID NO: 179248 - RNA, 19 nt, Homo sapiens
cuaaaggugccaaaugaua

SEQ ID NO: 179249 - RNA, 19 nt, Homo sapiens
gcaggaauuuagugguuau

SEQ ID NO: 179250 - RNA, 19 nt, Homo sapiens
cggauaaguuugaaaggaa

SEQ ID NO: 179251 - RNA, 19 nt, Homo sapiens
gaaccaggaagcaguauca

SEQ ID NO: 179252 - RNA, 19 nt, Homo sapiens
guacagguuuaaauacuag

SEQ ID NO: 179253 - RNA, 19 nt, Homo sapiens
cagagcaauuugaucagua

SEQ ID NO: 179254 - RNA, 19 nt, Homo sapiens
gaaguaaaccaggauuaug

SEQ ID NO: 179255 - RNA, 19 nt, Homo sapiens
gaauuuagugguuauguuc

SEQ ID NO: 179256 - RNA, 19 nt, Homo sapiens
ggaacucagacaaauauga

SEQ ID NO: 179257 - RNA, 19 nt, Homo sapiens
aacuaaaggugccaaauga

SEQ ID NO: 179258 - RNA, 19 nt, Homo sapiens
gaaacugcuauugaacuua

SEQ ID NO: 179259 - RNA, 19 nt, Homo sapiens
ggcaggaauuuagugguua

SEQ ID NO: 179260 - RNA, 19 nt, Homo sapiens
gaggugaacuuggcagcaa

SEQ ID NO: 179261 - RNA, 19 nt, Homo sapiens
gcagagcaauuugaucagu

SEQ ID NO: 179262 - RNA, 19 nt, Homo sapiens
guugguacagguuuaaaua

SEQ ID NO: 179263 - RNA, 19 nt, Homo sapiens
gauuggaggugugacagaa

SEQ ID NO: 179264 - RNA, 19 nt, Homo sapiens
gguccaaagugauuuacau

SEQ ID NO: 179265 - RNA, 19 nt, Homo sapiens
ugaaugagucucuaauguu

SEQ ID NO: 179266 - RNA, 19 nt, Homo sapiens
ggugaacccuacucagugu

SEQ ID NO: 179267 - RNA, 19 nt, Homo sapiens
gaucuugccugaaaaugaa

SEQ ID NO: 179268 - RNA, 19 nt, Homo sapiens
gguagcugaagguaaauua

SEQ ID NO: 179269 - RNA, 19 nt, Homo sapiens
gcagagcaguuugacgaau

SEQ ID NO: 179270 - RNA, 19 nt, Homo sapiens
cagaaaggaucaacaagcu

SEQ ID NO: 179271 - RNA, 19 nt, Homo sapiens
uaccaggacuacagaaguu

SEQ ID NO: 179272 - RNA, 19 nt, Homo sapiens
cagagcaguuugacgaaug

SEQ ID NO: 179273 - RNA, 19 nt, Homo sapiens
aagauuggacguacucaua

SEQ ID NO: 179274 - RNA, 19 nt, Homo sapiens
gagcucaaaugauacuuuu

SEQ ID NO: 179275 - RNA, 19 nt, Homo sapiens
cuauugaacuuaagcaucu

SEQ ID NO: 179276 - RNA, 19 nt, Homo sapiens
aacagacucccauuucuua

SEQ ID NO: 179277 - RNA, 19 nt, Homo sapiens
uagcagagcaauuugauca

SEQ ID NO: 179278 - RNA, 19 nt, Homo sapiens
ggugccaaaugauaaguau

SEQ ID NO: 179279 - RNA, 19 nt, Homo sapiens
caggaacucagacaaauau

SEQ ID NO: 179280 - RNA, 19 nt, Homo sapiens
gaugaaugagucucuaaug

SEQ ID NO: 179281 - RNA, 19 nt, Homo sapiens
gcccagaccgugagaucua

SEQ ID NO: 179282 - RNA, 19 nt, Homo sapiens
caugcuggguccaaaguga

SEQ ID NO: 179283 - RNA, 19 nt, Homo sapiens
gaauccaggccaauacaga

SEQ ID NO: 179284 - RNA, 19 nt, Homo sapiens
ucaggaugcuguuccacuu

SEQ ID NO: 179285 - RNA, 19 nt, Homo sapiens
ucaggaacucagacaaaua

SEQ ID NO: 179286 - RNA, 19 nt, Homo sapiens
caaaauuccuuccggauag

SEQ ID NO: 179287 - RNA, 19 nt, Homo sapiens
uaaaggaaacugcuaucga

SEQ ID NO: 179288 - RNA, 19 nt, Homo sapiens
cauuagcaauagagcaauu

SEQ ID NO: 179289 - RNA, 19 nt, Homo sapiens
gcaauagaaguucaugaag

SEQ ID NO: 179290 - RNA, 19 nt, Homo sapiens
uaaugaaggcagcagauga

SEQ ID NO: 179291 - RNA, 19 nt, Homo sapiens
cuaggucuaagauggauua

SEQ ID NO: 179292 - RNA, 19 nt, Homo sapiens
aaacagacucccauuucuu

SEQ ID NO: 179293 - RNA, 19 nt, Homo sapiens
guccaaagugauuuacaua

SEQ ID NO: 179294 - RNA, 19 nt, Homo sapiens
gacaaggcagcaaagauug

SEQ ID NO: 179295 - RNA, 19 nt, Homo sapiens
gcugaugaaugagucucua

SEQ ID NO: 179296 - RNA, 19 nt, Homo sapiens
uugcacagaucaucaagau

SEQ ID NO: 179297 - RNA, 19 nt, Homo sapiens
ucccaacgaucauguuaau

SEQ ID NO: 179298 - RNA, 19 nt, Homo sapiens
ugaagucauuagcaauaga

SEQ ID NO: 179299 - RNA, 19 nt, Homo sapiens
agagcaauuugaucaguau

SEQ ID NO: 179300 - RNA, 19 nt, Homo sapiens
gaaccauguugcugucacu

SEQ ID NO: 179301 - RNA, 19 nt, Homo sapiens
gaacccuacucagugugaa

SEQ ID NO: 179302 - RNA, 19 nt, Homo sapiens
ggugacagcucucaauccu

SEQ ID NO: 179303 - RNA, 19 nt, Homo sapiens
caucccaacgaucauguua

SEQ ID NO: 179304 - RNA, 19 nt, Homo sapiens
guagcugaagguaaauuaa

SEQ ID NO: 179305 - RNA, 19 nt, Homo sapiens
ugaaguaaaccaggauuau

SEQ ID NO: 179306 - RNA, 19 nt, Homo sapiens
ggauagaauaugauaccuu

SEQ ID NO: 179307 - RNA, 19 nt, Homo sapiens
ucacagcagagcaguuuga

SEQ ID NO: 179308 - RNA, 19 nt, Homo sapiens
gguaugacaaggcagcaaa

SEQ ID NO: 179309 - RNA, 19 nt, Homo sapiens
gcaaggugaacccuacuca

SEQ ID NO: 179310 - RNA, 19 nt, Homo sapiens
ugauaccuuuggugaacua

SEQ ID NO: 179311 - RNA, 19 nt, Homo sapiens
gacuacagaaguuacauga

SEQ ID NO: 179312 - RNA, 19 nt, Homo sapiens
ggacuacagaaguuacaug

SEQ ID NO: 179313 - RNA, 19 nt, Homo sapiens
uaugauaccuuuggugaac

SEQ ID NO: 179314 - RNA, 19 nt, Homo sapiens
gaagagaaauccacugaga

SEQ ID NO: 179315 - RNA, 19 nt, Homo sapiens
gaaagaagguauccuagga

SEQ ID NO: 179316 - RNA, 19 nt, Homo sapiens
ggacaugucguucagauuu

SEQ ID NO: 179317 - RNA, 19 nt, Homo sapiens
caggaaggcuggagacuuu

SEQ ID NO: 179318 - RNA, 19 nt, Homo sapiens
aggaauaccugccugcuua

SEQ ID NO: 179319 - RNA, 19 nt, Homo sapiens
ggaaugacagcaucuauga

SEQ ID NO: 179320 - RNA, 19 nt, Homo sapiens
gaacuguccuucgcucuug

SEQ ID NO: 179321 - RNA, 19 nt, Homo sapiens
ugaaguggccgauuuguuu

SEQ ID NO: 179322 - RNA, 19 nt, Homo sapiens
guaaagguccguagugcua

SEQ ID NO: 179323 - RNA, 19 nt, Homo sapiens
gaagggagagaaagagaaa

SEQ ID NO: 179324 - RNA, 19 nt, Homo sapiens
caagcccucuguaguguuu

SEQ ID NO: 179325 - RNA, 19 nt, Homo sapiens
gauccugaauuccagcaaa

SEQ ID NO: 179326 - RNA, 19 nt, Homo sapiens
gaauaggaaaccuguggua

SEQ ID NO: 179327 - RNA, 19 nt, Homo sapiens
gaggacaugucguucagau

SEQ ID NO: 179328 - RNA, 19 nt, Homo sapiens
cugaugaaguggccgauuu

SEQ ID NO: 179329 - RNA, 19 nt, Homo sapiens
ugauuaaacuuccuucucu

SEQ ID NO: 179330 - RNA, 19 nt, Homo sapiens
guccuucgcucuugugaau

SEQ ID NO: 179331 - RNA, 19 nt, Homo sapiens
gacaugucguucagauuug

SEQ ID NO: 179332 - RNA, 19 nt, Homo sapiens
ucaacauccuggaagcuuu

SEQ ID NO: 179333 - RNA, 19 nt, Homo sapiens
gcucagacaggcagauuug

SEQ ID NO: 179334 - RNA, 19 nt, Homo sapiens
agagguagcagucuucuga

SEQ ID NO: 179335 - RNA, 19 nt, Homo sapiens
agagaaagaagguauccua

SEQ ID NO: 179336 - RNA, 19 nt, Homo sapiens
ggaagggagagaaagagaa

SEQ ID NO: 179337 - RNA, 19 nt, Homo sapiens
caucaagcccucuguagug

SEQ ID NO: 179338 - RNA, 19 nt, Homo sapiens
guucagauuuggccaacau

SEQ ID NO: 179339 - RNA, 19 nt, Homo sapiens
gaaagagaaagaagguauc

SEQ ID NO: 179340 - RNA, 19 nt, Homo sapiens
gcucaggaaagaagagaaa

SEQ ID NO: 179341 - RNA, 19 nt, Homo sapiens
augaggagcuccagaaaca

SEQ ID NO: 179342 - RNA, 19 nt, Homo sapiens
ccacugaggacuccgaaga

SEQ ID NO: 179343 - RNA, 19 nt, Homo sapiens
ucaccauccuguauucuuc

SEQ ID NO: 179344 - RNA, 19 nt, Homo sapiens
ugaggacuccgaagaggua

SEQ ID NO: 179345 - RNA, 19 nt, Homo sapiens
ucggcagccuuaugauuaa

SEQ ID NO: 179346 - RNA, 19 nt, Homo sapiens
acaggcagauuugagguuu

SEQ ID NO: 179347 - RNA, 19 nt, Homo sapiens
gaggagcuccagaaacaug

SEQ ID NO: 179348 - RNA, 19 nt, Homo sapiens
aaagagcuauugccaacca

SEQ ID NO: 179349 - RNA, 19 nt, Homo sapiens
ggagaucagaggaggaaau

SEQ ID NO: 179350 - RNA, 19 nt, Homo sapiens
ggaccucucucaccuuuuc

SEQ ID NO: 179351 - RNA, 19 nt, Homo sapiens
gaaguggccgauuuguuuc

SEQ ID NO: 179352 - RNA, 19 nt, Homo sapiens
agaaagagaaagaagguau

SEQ ID NO: 179353 - RNA, 19 nt, Homo sapiens
aagaagguauccuaggaau

SEQ ID NO: 179354 - RNA, 19 nt, Homo sapiens
ggagagaaagagaaagaag

SEQ ID NO: 179355 - RNA, 19 nt, Homo sapiens
caacauccuggaagcuuug

SEQ ID NO: 179356 - RNA, 19 nt, Homo sapiens
aagaagagaaauccacuga

SEQ ID NO: 179357 - RNA, 19 nt, Homo sapiens
ugggaccucucucaccuuu

SEQ ID NO: 179358 - RNA, 19 nt, Homo sapiens
ugaccugcguccugaugaa

SEQ ID NO: 179359 - RNA, 19 nt, Homo sapiens
ggaggaaauggcagcagaa

SEQ ID NO: 179360 - RNA, 19 nt, Homo sapiens
gagaucagaggaggaaaug

SEQ ID NO: 179361 - RNA, 19 nt, Homo sapiens
gaccuaaacggcucagaca

SEQ ID NO: 179362 - RNA, 19 nt, Homo sapiens
gagaaagagaaagaaggua

SEQ ID NO: 179363 - RNA, 19 nt, Homo sapiens
caucucaccauccuguauu

SEQ ID NO: 179364 - RNA, 19 nt, Homo sapiens
gcgggucuacuuucaguga

SEQ ID NO: 179365 - RNA, 19 nt, Homo sapiens
uaggaaaccugugguacca

SEQ ID NO: 179366 - RNA, 19 nt, Homo sapiens
gguggaagggagagaaaga

SEQ ID NO: 179367 - RNA, 19 nt, Homo sapiens
uucggcagccuuaugauua

SEQ ID NO: 179368 - RNA, 19 nt, Homo sapiens
aaaugcaguuucuucaucu

SEQ ID NO: 179369 - RNA, 19 nt, Homo sapiens
gagcuauugccaaccaguu

SEQ ID NO: 179370 - RNA, 19 nt, Homo sapiens
aaagaagguauccuaggaa

SEQ ID NO: 179371 - RNA, 19 nt, Homo sapiens
ucacuccaacucccuuaaa

SEQ ID NO: 179372 - RNA, 19 nt, Homo sapiens
cuggagacuuucacaggaa

SEQ ID NO: 179373 - RNA, 19 nt, Homo sapiens
ggaaggcuggagacuuuca

SEQ ID NO: 179374 - RNA, 19 nt, Homo sapiens
ggucacuccaacucccuua

SEQ ID NO: 179375 - RNA, 19 nt, Homo sapiens
gcuauugccaaccaguuug

SEQ ID NO: 179376 - RNA, 19 nt, Homo sapiens
gaauaccugccugcuuaga

SEQ ID NO: 179377 - RNA, 19 nt, Homo sapiens
agaagguauccuaggaaua

SEQ ID NO: 179378 - RNA, 19 nt, Homo sapiens
gagacuuucacaggaauga

SEQ ID NO: 179379 - RNA, 19 nt, Homo sapiens
gugaggacaugucguucag

SEQ ID NO: 179380 - RNA, 19 nt, Homo sapiens
agguagcagucuucugaaa

SEQ ID NO: 179381 - RNA, 19 nt, Homo sapiens
gcagccuuaugauuaaacu

SEQ ID NO: 179382 - RNA, 19 nt, Homo sapiens
ccuucgcucuugugaauag

SEQ ID NO: 179383 - RNA, 19 nt, Homo sapiens
gguagcagucuucugaaag

SEQ ID NO: 179384 - RNA, 19 nt, Homo sapiens
gacaggcagauuugagguu

SEQ ID NO: 179385 - RNA, 19 nt, Homo sapiens
aaaaugcaguuucuucauc

SEQ ID NO: 179386 - RNA, 19 nt, Homo sapiens
ucuaugaggagcuccagaa

SEQ ID NO: 179387 - RNA, 19 nt, Homo sapiens
cggcagccuuaugauuaaa

SEQ ID NO: 179388 - RNA, 19 nt, Homo sapiens
ggaauaccugccugcuuag

SEQ ID NO: 179389 - RNA, 19 nt, Homo sapiens
cccaagaggaacugaauca

SEQ ID NO: 179390 - RNA, 19 nt, Homo sapiens
gcucugcgggucuacuuuc

SEQ ID NO: 179391 - RNA, 19 nt, Homo sapiens
aagagaaauccacugagaa

SEQ ID NO: 179392 - RNA, 19 nt, Homo sapiens
gagaaauccacugagaaca

SEQ ID NO: 179393 - RNA, 19 nt, Homo sapiens
agagaaagagaaagaaggu

SEQ ID NO: 179394 - RNA, 19 nt, Homo sapiens
gggagagaaagagaaagaa

SEQ ID NO: 179395 - RNA, 19 nt, Homo sapiens
agagaaauccacugagaac

SEQ ID NO: 179396 - RNA, 19 nt, Homo sapiens
uggccaacaucucaucaag

SEQ ID NO: 179397 - RNA, 19 nt, Homo sapiens
cuucaacugugaggacaug

SEQ ID NO: 179398 - RNA, 19 nt, Homo sapiens
caggaaugacagcaucuau

SEQ ID NO: 179399 - RNA, 19 nt, Homo sapiens
ugaugaaguggccgauuug

SEQ ID NO: 179400 - RNA, 19 nt, Homo sapiens
gagguagcagucuucugaa

SEQ ID NO: 179401 - RNA, 19 nt, Homo sapiens
gaacuuagcuguaauucua

SEQ ID NO: 179402 - RNA, 19 nt, Homo sapiens
ccaaggaggugcacuauaa

SEQ ID NO: 179403 - RNA, 19 nt, Homo sapiens
gaaauaaagcagcauauga

SEQ ID NO: 179404 - RNA, 19 nt, Homo sapiens
caacauggauaugacauuu

SEQ ID NO: 179405 - RNA, 19 nt, Homo sapiens
gcaagaagcauaggagaua

SEQ ID NO: 179406 - RNA, 19 nt, Homo sapiens
gcacacagugaucauauua

SEQ ID NO: 179407 - RNA, 19 nt, Homo sapiens
gaaaugcuuugacaaguuc

SEQ ID NO: 179408 - RNA, 19 nt, Homo sapiens
gauaugacauuucacaaca

SEQ ID NO: 179409 - RNA, 19 nt, Homo sapiens
caaagucccuucuguugug

SEQ ID NO: 179410 - RNA, 19 nt, Homo sapiens
caucuaacguuucagugua

SEQ ID NO: 179411 - RNA, 19 nt, Homo sapiens
cuacugacaugcaugguuu

SEQ ID NO: 179412 - RNA, 19 nt, Homo sapiens
ugaaaugcuuugacaaguu

SEQ ID NO: 179413 - RNA, 19 nt, Homo sapiens
guaguugucugcucuuugu

SEQ ID NO: 179414 - RNA, 19 nt, Homo sapiens
gauguaagcaagaagcaua

SEQ ID NO: 179415 - RNA, 19 nt, Homo sapiens
caagaagcauaggagauaa

SEQ ID NO: 179416 - RNA, 19 nt, Homo sapiens
cauuugaacuuagcuguaa

SEQ ID NO: 179417 - RNA, 19 nt, Homo sapiens
caucacaucuggaggaauc

SEQ ID NO: 179418 - RNA, 19 nt, Homo sapiens
cuaguugaaucccuuguaa

SEQ ID NO: 179419 - RNA, 19 nt, Homo sapiens
uugaaucccuuguaacgua

SEQ ID NO: 179420 - RNA, 19 nt, Homo sapiens
aaagacugcuucaccugua

SEQ ID NO: 179421 - RNA, 19 nt, Homo sapiens
gcuauuaucaucuaacguu

SEQ ID NO: 179422 - RNA, 19 nt, Homo sapiens
aaagaacccuacugacaug

SEQ ID NO: 179423 - RNA, 19 nt, Homo sapiens
uuagguagauugacucuuc

SEQ ID NO: 179424 - RNA, 19 nt, Homo sapiens
gucauuagcuauuaucauc

SEQ ID NO: 179425 - RNA, 19 nt, Homo sapiens
gcugaugccucauuucuac

SEQ ID NO: 179426 - RNA, 19 nt, Homo sapiens
gaaaagaacccuacugaca

SEQ ID NO: 179427 - RNA, 19 nt, Homo sapiens
gauugacucuucugcaugu

SEQ ID NO: 179428 - RNA, 19 nt, Homo sapiens
uguguuaccugcucuaaga

SEQ ID NO: 179429 - RNA, 19 nt, Homo sapiens
ccagugugguggccuauga

SEQ ID NO: 179430 - RNA, 19 nt, Homo sapiens
gcagcaaagugaauuucug

SEQ ID NO: 179431 - RNA, 19 nt, Homo sapiens
ucugagcguuccuacuuua

SEQ ID NO: 179432 - RNA, 19 nt, Homo sapiens
gcauuugaaucucguucuu

SEQ ID NO: 179433 - RNA, 19 nt, Homo sapiens
caacaaggccaucacaucu

SEQ ID NO: 179434 - RNA, 19 nt, Homo sapiens
gcaacaaggccaucacauc

SEQ ID NO: 179435 - RNA, 19 nt, Homo sapiens
gggaagaaguaugugcaaa

SEQ ID NO: 179436 - RNA, 19 nt, Homo sapiens
ugacaugcaugguuuaacu

SEQ ID NO: 179437 - RNA, 19 nt, Homo sapiens
aaacuuagguagauugacu

SEQ ID NO: 179438 - RNA, 19 nt, Homo sapiens
gaucaccuacuuacuguau

SEQ ID NO: 179439 - RNA, 19 nt, Homo sapiens
gcaaagucccuucuguugu

SEQ ID NO: 179440 - RNA, 19 nt, Homo sapiens
gcucuuuguccauguguua

SEQ ID NO: 179441 - RNA, 19 nt, Homo sapiens
uuuggaaacuugcaugaaa

SEQ ID NO: 179442 - RNA, 19 nt, Homo sapiens
gagcguuccuacuuuaaag

SEQ ID NO: 179443 - RNA, 19 nt, Homo sapiens
uaacacgaacuuccagaaa

SEQ ID NO: 179444 - RNA, 19 nt, Homo sapiens
ucaaccauauccagccuuu

SEQ ID NO: 179445 - RNA, 19 nt, Homo sapiens
acaacaagauccugugcaa

SEQ ID NO: 179446 - RNA, 19 nt, Homo sapiens
gagaagcugaugccucauu

SEQ ID NO: 179447 - RNA, 19 nt, Homo sapiens
ggaacaugcaggugauuug

SEQ ID NO: 179448 - RNA, 19 nt, Homo sapiens
agaagcugaugccucauuu

SEQ ID NO: 179449 - RNA, 19 nt, Homo sapiens
gauuuccaccuaccgcuua

SEQ ID NO: 179450 - RNA, 19 nt, Homo sapiens
uacauucugucauuagcua

SEQ ID NO: 179451 - RNA, 19 nt, Homo sapiens
ucaccuacuuacuguauuc

SEQ ID NO: 179452 - RNA, 19 nt, Homo sapiens
acauggauaugacauuuca

SEQ ID NO: 179453 - RNA, 19 nt, Homo sapiens
guccuucccuucuuuaaag

SEQ ID NO: 179454 - RNA, 19 nt, Homo sapiens
gcaugccgauugcuuugug

SEQ ID NO: 179455 - RNA, 19 nt, Homo sapiens
gaacccuacugacaugcau

SEQ ID NO: 179456 - RNA, 19 nt, Homo sapiens
ggcacacagugaucauauu

SEQ ID NO: 179457 - RNA, 19 nt, Homo sapiens
cauccuaucugccacacau

SEQ ID NO: 179458 - RNA, 19 nt, Homo sapiens
ugguuuaacuuccucauca

SEQ ID NO: 179459 - RNA, 19 nt, Homo sapiens
gaaguuugacugccacuac

SEQ ID NO: 179460 - RNA, 19 nt, Homo sapiens
gcagaaaagugcuaaucau

SEQ ID NO: 179461 - RNA, 19 nt, Homo sapiens
uagauugacucuucugcau

SEQ ID NO: 179462 - RNA, 19 nt, Homo sapiens
gcaccauggcggagaaguu

SEQ ID NO: 179463 - RNA, 19 nt, Homo sapiens
aagcaacccugcagcaaag

SEQ ID NO: 179464 - RNA, 19 nt, Homo sapiens
ccucauuucuacauucugu

SEQ ID NO: 179465 - RNA, 19 nt, Homo sapiens
ccgugaaucuggccaacaa

SEQ ID NO: 179466 - RNA, 19 nt, Homo sapiens
ugaaaugcaggaucaccua

SEQ ID NO: 179467 - RNA, 19 nt, Homo sapiens
gcaggugauuugggaagug

SEQ ID NO: 179468 - RNA, 19 nt, Homo sapiens
gaagaaguaugugcaaaag

SEQ ID NO: 179469 - RNA, 19 nt, Homo sapiens
gggcacacagugaucauau

SEQ ID NO: 179470 - RNA, 19 nt, Homo sapiens
aggaaucacuuaccaggau

SEQ ID NO: 179471 - RNA, 19 nt, Homo sapiens
gaacaugcaggugauuugg

SEQ ID NO: 179472 - RNA, 19 nt, Homo sapiens
gaacucugcccuuccuucu

SEQ ID NO: 179473 - RNA, 19 nt, Homo sapiens
cacacgacaugcaagaguu

SEQ ID NO: 179474 - RNA, 19 nt, Homo sapiens
aaagcaacccugcagcaaa

SEQ ID NO: 179475 - RNA, 19 nt, Homo sapiens
cgucuuuucucccauuuua

SEQ ID NO: 179476 - RNA, 19 nt, Homo sapiens
ggaagaaguaugugcaaaa

SEQ ID NO: 179477 - RNA, 19 nt, Homo sapiens
caucuggaggaaucacuua

SEQ ID NO: 179478 - RNA, 19 nt, Homo sapiens
gacaaguucugugccaaca

SEQ ID NO: 179479 - RNA, 19 nt, Homo sapiens
acagaaauaaagcagcaua

SEQ ID NO: 179480 - RNA, 19 nt, Homo sapiens
cauacuaacauucuuguag

SEQ ID NO: 179481 - RNA, 19 nt, Homo sapiens
uuugggaaguguagaaaga

SEQ ID NO: 179482 - RNA, 19 nt, Homo sapiens
guagacacacgacaugcaa

SEQ ID NO: 179483 - RNA, 19 nt, Homo sapiens
caccacugcugccugaaau

SEQ ID NO: 179484 - RNA, 19 nt, Homo sapiens
agaccaaguuugccaagca

SEQ ID NO: 179485 - RNA, 19 nt, Homo sapiens
ccagggcugucaucaacau

SEQ ID NO: 179486 - RNA, 19 nt, Homo sapiens
ugacucuucugcauguuuc

SEQ ID NO: 179487 - RNA, 19 nt, Homo sapiens
gccaagaagugugcuggau

SEQ ID NO: 179488 - RNA, 19 nt, Homo sapiens
gaugccucauuucuacauu

SEQ ID NO: 179489 - RNA, 19 nt, Homo sapiens
caccauggcggagaaguuu

SEQ ID NO: 179490 - RNA, 19 nt, Homo sapiens
ggauaugacauuucacaac

SEQ ID NO: 179491 - RNA, 19 nt, Homo sapiens
guacuaacguuugguuucc

SEQ ID NO: 179492 - RNA, 19 nt, Homo sapiens
gcccuuccuucuguucuuu

SEQ ID NO: 179493 - RNA, 19 nt, Homo sapiens
ucaaauaagggcacacagu

SEQ ID NO: 179494 - RNA, 19 nt, Homo sapiens
gaccaaguuugccaagcau

SEQ ID NO: 179495 - RNA, 19 nt, Homo sapiens
gcugucaucaacauggaua

SEQ ID NO: 179496 - RNA, 19 nt, Homo sapiens
gggcugucaucaacaugga

SEQ ID NO: 179497 - RNA, 19 nt, Homo sapiens
uaacuaacacgaacuucca

SEQ ID NO: 179498 - RNA, 19 nt, Homo sapiens
uuagugauguaagcaagaa

SEQ ID NO: 179499 - RNA, 19 nt, Homo sapiens
aaauaagggcacacaguga

SEQ ID NO: 179500 - RNA, 19 nt, Homo sapiens
gguccuucccuucuuuaaa

SEQ ID NO: 179501 - RNA, 19 nt, Homo sapiens
uaacauaugucacgaacuu

SEQ ID NO: 179502 - RNA, 19 nt, Homo sapiens
ggaagaugguuugaaauuu

SEQ ID NO: 179503 - RNA, 19 nt, Homo sapiens
ggaaagacaucugaauuca

SEQ ID NO: 179504 - RNA, 19 nt, Homo sapiens
ccaaagacaaucagaauuu

SEQ ID NO: 179505 - RNA, 19 nt, Homo sapiens
gaaacucacugguggacaa

SEQ ID NO: 179506 - RNA, 19 nt, Homo sapiens
guaaugaccaguuguuauu

SEQ ID NO: 179507 - RNA, 19 nt, Homo sapiens
gugggaagaugguuugaaa

SEQ ID NO: 179508 - RNA, 19 nt, Homo sapiens
gggaagaugguuugaaauu

SEQ ID NO: 179509 - RNA, 19 nt, Homo sapiens
gaacugcuucugugacuug

SEQ ID NO: 179510 - RNA, 19 nt, Homo sapiens
caaagacaaucagaauuuc

SEQ ID NO: 179511 - RNA, 19 nt, Homo sapiens
aaagacaucugaauucaac

SEQ ID NO: 179512 - RNA, 19 nt, Homo sapiens
gaacggcaguggcauaacg

SEQ ID NO: 179513 - RNA, 19 nt, Homo sapiens
gaaagacaucugaauucaa

SEQ ID NO: 179514 - RNA, 19 nt, Homo sapiens
gggaaagacaucugaauuc

SEQ ID NO: 179515 - RNA, 19 nt, Homo sapiens
cgucaagucuaaaccaaga

SEQ ID NO: 179516 - RNA, 19 nt, Homo sapiens
ccagccacauugagacuuu

SEQ ID NO: 179517 - RNA, 19 nt, Homo sapiens
aaaccaagauuaugugacu

SEQ ID NO: 179518 - RNA, 19 nt, Homo sapiens
gauuaugugacuugcaaua

SEQ ID NO: 179519 - RNA, 19 nt, Homo sapiens
caaaaugacugagcgcuuu

SEQ ID NO: 179520 - RNA, 19 nt, Homo sapiens
gauacucacguuugcuuaa

SEQ ID NO: 179521 - RNA, 19 nt, Homo sapiens
cauaacgacugcuuuaacu

SEQ ID NO: 179522 - RNA, 19 nt, Homo sapiens
gcagugcguucagugcaaa

SEQ ID NO: 179523 - RNA, 19 nt, Homo sapiens
aagauuaugugacuugcaa

SEQ ID NO: 179524 - RNA, 19 nt, Homo sapiens
guaaggcacacccaaaugu

SEQ ID NO: 179525 - RNA, 19 nt, Homo sapiens
gagaaguugcugcuuguga

SEQ ID NO: 179526 - RNA, 19 nt, Homo sapiens
cagagaaguugcugcuugu

SEQ ID NO: 179527 - RNA, 19 nt, Homo sapiens
gaggaacggcaguggcaua

SEQ ID NO: 179528 - RNA, 19 nt, Homo sapiens
gcgugcaucuccuuauaug

SEQ ID NO: 179529 - RNA, 19 nt, Homo sapiens
gguaaugaccaguuguuau

SEQ ID NO: 179530 - RNA, 19 nt, Homo sapiens
gcgaugacuuugccuacug

SEQ ID NO: 179531 - RNA, 19 nt, Homo sapiens
uaaggcacacccaaaugua

SEQ ID NO: 179532 - RNA, 19 nt, Homo sapiens
uggcauaacgacugcuuua

SEQ ID NO: 179533 - RNA, 19 nt, Homo sapiens
gaccggcacuggcaugaag

SEQ ID NO: 179534 - RNA, 19 nt, Homo sapiens
cauugagacuuucuucuag

SEQ ID NO: 179535 - RNA, 19 nt, Homo sapiens
uaacgacugcuuuaacugu

SEQ ID NO: 179536 - RNA, 19 nt, Homo sapiens
aggcgugcaucuccuuaua

SEQ ID NO: 179537 - RNA, 19 nt, Homo sapiens
aaucuugccuucugguuuc

SEQ ID NO: 179538 - RNA, 19 nt, Homo sapiens
caagucuaaaccaagauua

SEQ ID NO: 179539 - RNA, 19 nt, Homo sapiens
gaguaaggcacacccaaau

SEQ ID NO: 179540 - RNA, 19 nt, Homo sapiens
cuccuuauauggucaaaug

SEQ ID NO: 179541 - RNA, 19 nt, Homo sapiens
guacagacugcuauuccaa

SEQ ID NO: 179542 - RNA, 19 nt, Homo sapiens
agacuaggcuggcauuuug

SEQ ID NO: 179543 - RNA, 19 nt, Homo sapiens
ggacggagucucgcuuugu

SEQ ID NO: 179544 - RNA, 19 nt, Homo sapiens
uaugugacuugcaauaaag

SEQ ID NO: 179545 - RNA, 19 nt, Homo sapiens
acauugagacuuucuucua

SEQ ID NO: 179546 - RNA, 19 nt, Homo sapiens
agaaguugcugcuugugau

SEQ ID NO: 179547 - RNA, 19 nt, Homo sapiens
uaagaagugcucccucuca

SEQ ID NO: 179548 - RNA, 19 nt, Homo sapiens
ggacuacagguugcugaaa

SEQ ID NO: 179549 - RNA, 19 nt, Homo sapiens
gaccaguuguuauuuacag

SEQ ID NO: 179550 - RNA, 19 nt, Homo sapiens
cgaguaaggcacacccaaa

SEQ ID NO: 179551 - RNA, 19 nt, Homo sapiens
gcauaacgacugcuuuaac

SEQ ID NO: 179552 - RNA, 19 nt, Homo sapiens
caaucuugccuucugguuu

SEQ ID NO: 179553 - RNA, 19 nt, Homo sapiens
ccucuugguucacgccauu

SEQ ID NO: 179554 - RNA, 19 nt, Homo sapiens
gacggagucucgcuuuguc

SEQ ID NO: 179555 - RNA, 19 nt, Homo sapiens
gggacggagucucgcuuug

SEQ ID NO: 179556 - RNA, 19 nt, Homo sapiens
auaagguaaugaccaguug

SEQ ID NO: 179557 - RNA, 19 nt, Homo sapiens
auacucacguuugcuuaaa

SEQ ID NO: 179558 - RNA, 19 nt, Homo sapiens
ugggaaagacaucugaauu

SEQ ID NO: 179559 - RNA, 19 nt, Homo sapiens
cugcuucugugacuuguau

SEQ ID NO: 179560 - RNA, 19 nt, Homo sapiens
gcaacgaaucucucuuugg

SEQ ID NO: 179561 - RNA, 19 nt, Homo sapiens
ugugugcccugcuaugaga

SEQ ID NO: 179562 - RNA, 19 nt, Homo sapiens
cccguugcgucaagucuaa

SEQ ID NO: 179563 - RNA, 19 nt, Homo sapiens
aacgacugcuuuaacugua

SEQ ID NO: 179564 - RNA, 19 nt, Homo sapiens
ucacagcucgcgaugacuu

SEQ ID NO: 179565 - RNA, 19 nt, Homo sapiens
ugccaggaaugcaagaaga

SEQ ID NO: 179566 - RNA, 19 nt, Homo sapiens
ccaagugccaggaaugcaa

SEQ ID NO: 179567 - RNA, 19 nt, Homo sapiens
gaggaccagcugcucugua

SEQ ID NO: 179568 - RNA, 19 nt, Homo sapiens
gacuacagguugcugaaaa

SEQ ID NO: 179569 - RNA, 19 nt, Homo sapiens
ggcccuaggugggaagaug

SEQ ID NO: 179570 - RNA, 19 nt, Homo sapiens
ucacagagagggacgacau

SEQ ID NO: 179571 - RNA, 19 nt, Homo sapiens
ccuacugccugaacugcuu

SEQ ID NO: 179572 - RNA, 19 nt, Homo sapiens
gcccugcuaugagaaacaa

SEQ ID NO: 179573 - RNA, 19 nt, Homo sapiens
gugcaucuccuuauauggu

SEQ ID NO: 179574 - RNA, 19 nt, Homo sapiens
gaaguugcugcuugugauc

SEQ ID NO: 179575 - RNA, 19 nt, Homo sapiens
uugcaacgaaucucucuuu

SEQ ID NO: 179576 - RNA, 19 nt, Homo sapiens
gggagacuguggcugaaaa

SEQ ID NO: 179577 - RNA, 19 nt, Homo sapiens
ccacauugagacuuucuuc

SEQ ID NO: 179578 - RNA, 19 nt, Homo sapiens
ggcauaacgacugcuuuaa

SEQ ID NO: 179579 - RNA, 19 nt, Homo sapiens
ucaagucuaaaccaagauu

SEQ ID NO: 179580 - RNA, 19 nt, Homo sapiens
gaauucaacacagagaagu

SEQ ID NO: 179581 - RNA, 19 nt, Homo sapiens
acgacugcuuuaacuguaa

SEQ ID NO: 179582 - RNA, 19 nt, Homo sapiens
cccgcaagauggaguacaa

SEQ ID NO: 179583 - RNA, 19 nt, Homo sapiens
gaaaagccaggagucaaaa

SEQ ID NO: 179584 - RNA, 19 nt, Homo sapiens
uucucucacugucuauuua

SEQ ID NO: 179585 - RNA, 19 nt, Homo sapiens
cuucacagcucgcgaugac

SEQ ID NO: 179586 - RNA, 19 nt, Homo sapiens
gaaugcaagaagaccauca

SEQ ID NO: 179587 - RNA, 19 nt, Homo sapiens
aaggcacacccaaauguaa

SEQ ID NO: 179588 - RNA, 19 nt, Homo sapiens
ccuuuagugcuuugugaua

SEQ ID NO: 179589 - RNA, 19 nt, Homo sapiens
cuaaaccaagauuauguga

SEQ ID NO: 179590 - RNA, 19 nt, Homo sapiens
acauaugucacgaacuuga

SEQ ID NO: 179591 - RNA, 19 nt, Homo sapiens
ugcuuuaacuguaagaagu

SEQ ID NO: 179592 - RNA, 19 nt, Homo sapiens
cgacugcuuuaacuguaag

SEQ ID NO: 179593 - RNA, 19 nt, Homo sapiens
acugcaagcucuaccucuu

SEQ ID NO: 179594 - RNA, 19 nt, Homo sapiens
aauaagguaaugaccaguu

SEQ ID NO: 179595 - RNA, 19 nt, Homo sapiens
uuagugcuuugugauaguu

SEQ ID NO: 179596 - RNA, 19 nt, Homo sapiens
ugauacucacguuugcuua

SEQ ID NO: 179597 - RNA, 19 nt, Homo sapiens
ugcaacgaaucucucuuug

SEQ ID NO: 179598 - RNA, 19 nt, Homo sapiens
ccaacgaguacucauccaa

SEQ ID NO: 179599 - RNA, 19 nt, Homo sapiens
cauaugucacgaacuugaa

SEQ ID NO: 179600 - RNA, 19 nt, Homo sapiens
cgaggcgugcaucuccuua

SEQ ID NO: 179601 - RNA, 19 nt, Homo sapiens
gcaaguauguguccuuuga

SEQ ID NO: 179602 - RNA, 19 nt, Homo sapiens
cgagggagcuguucuauga

SEQ ID NO: 179603 - RNA, 19 nt, Homo sapiens
gcaaguacauccagacaga

SEQ ID NO: 179604 - RNA, 19 nt, Homo sapiens
gaccaaggcuuuccuauac

SEQ ID NO: 179605 - RNA, 19 nt, Homo sapiens
ggagaacucuuugcaccua

SEQ ID NO: 179606 - RNA, 19 nt, Homo sapiens
ggaccaaggcuuuccuaua

SEQ ID NO: 179607 - RNA, 19 nt, Homo sapiens
agacuucucuuuauagguu

SEQ ID NO: 179608 - RNA, 19 nt, Homo sapiens
gacaauaccuuugccaaca

SEQ ID NO: 179609 - RNA, 19 nt, Homo sapiens
cgacaagggugcucacuac

SEQ ID NO: 179610 - RNA, 19 nt, Homo sapiens
ggacuguucucaggcuuga

SEQ ID NO: 179611 - RNA, 19 nt, Homo sapiens
gagaacucuuugcaccuaa

SEQ ID NO: 179612 - RNA, 19 nt, Homo sapiens
caaaaugucuggucuguac

SEQ ID NO: 179613 - RNA, 19 nt, Homo sapiens
ggauugacauaccgugauc

SEQ ID NO: 179614 - RNA, 19 nt, Homo sapiens
gaauauggaggccaaacau

SEQ ID NO: 179615 - RNA, 19 nt, Homo sapiens
gcaacgagucccuguaugg

SEQ ID NO: 179616 - RNA, 19 nt, Homo sapiens
caccgagugucuucucauu

SEQ ID NO: 179617 - RNA, 19 nt, Homo sapiens
cccggaagcuggaauaugg

SEQ ID NO: 179618 - RNA, 19 nt, Homo sapiens
gguuucaggucuccuaugg

SEQ ID NO: 179619 - RNA, 19 nt, Homo sapiens
ccuacuguguggccuguuu

SEQ ID NO: 179620 - RNA, 19 nt, Homo sapiens
ggaauauggaggccaaaca

SEQ ID NO: 179621 - RNA, 19 nt, Homo sapiens
ccgagugucuucucauuuu

SEQ ID NO: 179622 - RNA, 19 nt, Homo sapiens
gcuccuggaccaaggcuuu

SEQ ID NO: 179623 - RNA, 19 nt, Homo sapiens
caacgagucccuguaugga

SEQ ID NO: 179624 - RNA, 19 nt, Homo sapiens
ccaaggcuuuccuauacca

SEQ ID NO: 179625 - RNA, 19 nt, Homo sapiens
gggagcuguucuaugaaga

SEQ ID NO: 179626 - RNA, 19 nt, Homo sapiens
gccaacaccugugcugagu

SEQ ID NO: 179627 - RNA, 19 nt, Homo sapiens
ccuugaaaguggacuguuc

SEQ ID NO: 179628 - RNA, 19 nt, Homo sapiens
aggcaaguauguguccuuu

SEQ ID NO: 179629 - RNA, 19 nt, Homo sapiens
ugcgugcccugcuaugaaa

SEQ ID NO: 179630 - RNA, 19 nt, Homo sapiens
ccugggaaguccuugaaag

SEQ ID NO: 179631 - RNA, 19 nt, Homo sapiens
cgagugucuucucauuuua

SEQ ID NO: 179632 - RNA, 19 nt, Homo sapiens
gacuguggcuccuuuucua

SEQ ID NO: 179633 - RNA, 19 nt, Homo sapiens
ccuacugugugcccugcua

SEQ ID NO: 179634 - RNA, 19 nt, Homo sapiens
cuaugaagaccgccauuuc

SEQ ID NO: 179635 - RNA, 19 nt, Homo sapiens
ggucccggaagcuggaaua

SEQ ID NO: 179636 - RNA, 19 nt, Homo sapiens
ccuuaaaucuagacuucuc

SEQ ID NO: 179637 - RNA, 19 nt, Homo sapiens
augaagaucccuacugugu

SEQ ID NO: 179638 - RNA, 19 nt, Homo sapiens
cuagacuucucuuuauagg

SEQ ID NO: 179639 - RNA, 19 nt, Homo sapiens
ugugugcccugcuaugaca

SEQ ID NO: 179640 - RNA, 19 nt, Homo sapiens
caaguauguguccuuugaa

SEQ ID NO: 179641 - RNA, 19 nt, Homo sapiens
gugcccugcuaugacaaua

SEQ ID NO: 179642 - RNA, 19 nt, Homo sapiens
gcuaugacaauaccuuugc

SEQ ID NO: 179643 - RNA, 19 nt, Homo sapiens
gguggaggcaaguaugugu

SEQ ID NO: 179644 - RNA, 19 nt, Homo sapiens
gacacuggcaccacaacug

SEQ ID NO: 179645 - RNA, 19 nt, Homo sapiens
guauguguccuuugaagac

SEQ ID NO: 179646 - RNA, 19 nt, Homo sapiens
gaacucuuugcaccuaagu

SEQ ID NO: 179647 - RNA, 19 nt, Homo sapiens
uacacaggguggauugaca

SEQ ID NO: 179648 - RNA, 19 nt, Homo sapiens
gcuuacacaggguggauug

SEQ ID NO: 179649 - RNA, 19 nt, Homo sapiens
gaagaucgcuguucccauu

SEQ ID NO: 179650 - RNA, 19 nt, Homo sapiens
gaagagagccuuaucugua

SEQ ID NO: 179651 - RNA, 19 nt, Homo sapiens
ucgcaacucuugugaauua

SEQ ID NO: 179652 - RNA, 19 nt, Homo sapiens
gaugucaacugcuuaguaa

SEQ ID NO: 179653 - RNA, 19 nt, Homo sapiens
gaggaacuacuucgaauua

SEQ ID NO: 179654 - RNA, 19 nt, Homo sapiens
gaugaagaauggcaaagaa

SEQ ID NO: 179655 - RNA, 19 nt, Homo sapiens
aagaaacucuguccuauug

SEQ ID NO: 179656 - RNA, 19 nt, Homo sapiens
gugcagggcuccaguaaug

SEQ ID NO: 179657 - RNA, 19 nt, Homo sapiens
gaucagggcugcuucuagu

SEQ ID NO: 179658 - RNA, 19 nt, Homo sapiens
aagcguaccuugccuaauu

SEQ ID NO: 179659 - RNA, 19 nt, Homo sapiens
gaacagaagaccacucuca

SEQ ID NO: 179660 - RNA, 19 nt, Homo sapiens
aaacagcucuuugagauau

SEQ ID NO: 179661 - RNA, 19 nt, Homo sapiens
uuaaugaacuaccaucuga

SEQ ID NO: 179662 - RNA, 19 nt, Homo sapiens
cuuauagucuuccaguuua

SEQ ID NO: 179663 - RNA, 19 nt, Homo sapiens
ccaagaaacucuguccuau

SEQ ID NO: 179664 - RNA, 19 nt, Homo sapiens
ccagaucccugaagaagau

SEQ ID NO: 179665 - RNA, 19 nt, Homo sapiens
ggaagaguaccaacacauu

SEQ ID NO: 179666 - RNA, 19 nt, Homo sapiens
gaucaucucaguccacauu

SEQ ID NO: 179667 - RNA, 19 nt, Homo sapiens
aguacugacuuucugauua

SEQ ID NO: 179668 - RNA, 19 nt, Homo sapiens
cgccauccauacucaauua

SEQ ID NO: 179669 - RNA, 19 nt, Homo sapiens
ucauaugacugauuacuca

SEQ ID NO: 179670 - RNA, 19 nt, Homo sapiens
ccaaguugcugucacuguu

SEQ ID NO: 179671 - RNA, 19 nt, Homo sapiens
ggacaugaaguaaauuuag

SEQ ID NO: 179672 - RNA, 19 nt, Homo sapiens
guacugacuuucugauuac

SEQ ID NO: 179673 - RNA, 19 nt, Homo sapiens
gagaaugccuuuugaaaca

SEQ ID NO: 179674 - RNA, 19 nt, Homo sapiens
gcuuauagucuuccaguuu

SEQ ID NO: 179675 - RNA, 19 nt, Homo sapiens
aagagagccuuaucuguau

SEQ ID NO: 179676 - RNA, 19 nt, Homo sapiens
uagaagacauguccaccuu

SEQ ID NO: 179677 - RNA, 19 nt, Homo sapiens
gaagaguaccaacacauuc

SEQ ID NO: 179678 - RNA, 19 nt, Homo sapiens
guaccuugccuaauugaaa

SEQ ID NO: 179679 - RNA, 19 nt, Homo sapiens
aauggcaggugucauauga

SEQ ID NO: 179680 - RNA, 19 nt, Homo sapiens
agaguuggguuccagcuuu

SEQ ID NO: 179681 - RNA, 19 nt, Homo sapiens
caagaaacucuguccuauu

SEQ ID NO: 179682 - RNA, 19 nt, Homo sapiens
gagaguggguaguggugaa

SEQ ID NO: 179683 - RNA, 19 nt, Homo sapiens
ggaaaacuguagucucuga

SEQ ID NO: 179684 - RNA, 19 nt, Homo sapiens
cagaacugauuauuugguu

SEQ ID NO: 179685 - RNA, 19 nt, Homo sapiens
cauccauacucaauuauca

SEQ ID NO: 179686 - RNA, 19 nt, Homo sapiens
ccucguacauuuccaaaca

SEQ ID NO: 179687 - RNA, 19 nt, Homo sapiens
gcaacuuucuaugacauug

SEQ ID NO: 179688 - RNA, 19 nt, Homo sapiens
gugaagcgaucaucucagu

SEQ ID NO: 179689 - RNA, 19 nt, Homo sapiens
aguaaucaguggauauuga

SEQ ID NO: 179690 - RNA, 19 nt, Homo sapiens
uggaauggcaggugucaua

SEQ ID NO: 179691 - RNA, 19 nt, Homo sapiens
gaaacucuguccuauugac

SEQ ID NO: 179692 - RNA, 19 nt, Homo sapiens
ggaacuacuucgaauuacu

SEQ ID NO: 179693 - RNA, 19 nt, Homo sapiens
ugaauuagugccuguuaaa

SEQ ID NO: 179694 - RNA, 19 nt, Homo sapiens
cauguccaccuucugauua

SEQ ID NO: 179695 - RNA, 19 nt, Homo sapiens
aaucgcaacucuugugaau

SEQ ID NO: 179696 - RNA, 19 nt, Homo sapiens
uuacacagcaccacaguga

SEQ ID NO: 179697 - RNA, 19 nt, Homo sapiens
gaaccugcggcauacauug

SEQ ID NO: 179698 - RNA, 19 nt, Homo sapiens
gggauagcaacaaauguaa

SEQ ID NO: 179699 - RNA, 19 nt, Homo sapiens
ggaggaacuacuucgaauu

SEQ ID NO: 179700 - RNA, 19 nt, Homo sapiens
gccagaagcacaagcuauu

SEQ ID NO: 179701 - RNA, 19 nt, Homo sapiens
cacaccaccuccuuacaaa

SEQ ID NO: 179702 - RNA, 19 nt, Homo sapiens
gaggaaaacuguagucucu

SEQ ID NO: 179703 - RNA, 19 nt, Homo sapiens
ccacaccaccuccuuacaa

SEQ ID NO: 179704 - RNA, 19 nt, Homo sapiens
gaacuacuucgaauuacuc

SEQ ID NO: 179705 - RNA, 19 nt, Homo sapiens
guacagagaguggguagug

SEQ ID NO: 179706 - RNA, 19 nt, Homo sapiens
ggcauacauuggagagauu

SEQ ID NO: 179707 - RNA, 19 nt, Homo sapiens
gaccaaccuuccauucaca

SEQ ID NO: 179708 - RNA, 19 nt, Homo sapiens
gcagggcuccaguaaugaa

SEQ ID NO: 179709 - RNA, 19 nt, Homo sapiens
guaaucaguggauauugaa

SEQ ID NO: 179710 - RNA, 19 nt, Homo sapiens
gcaacaaauguaaaugugu

SEQ ID NO: 179711 - RNA, 19 nt, Homo sapiens
ggauagcaacaaauguaaa

SEQ ID NO: 179712 - RNA, 19 nt, Homo sapiens
agacauguccaccuucuga

SEQ ID NO: 179713 - RNA, 19 nt, Homo sapiens
aggagucccugguucauug

SEQ ID NO: 179714 - RNA, 19 nt, Homo sapiens
guuaaaguugccaaucaua

SEQ ID NO: 179715 - RNA, 19 nt, Homo sapiens
auuagugccuguuaaaguu

SEQ ID NO: 179716 - RNA, 19 nt, Homo sapiens
ugugguggcuguugcaaug

SEQ ID NO: 179717 - RNA, 19 nt, Homo sapiens
aguuauagaugaagaaugg

SEQ ID NO: 179718 - RNA, 19 nt, Homo sapiens
gcaacucuugugaauuauu

SEQ ID NO: 179719 - RNA, 19 nt, Homo sapiens
guucauugauggaugucuu

SEQ ID NO: 179720 - RNA, 19 nt, Homo sapiens
caugauguuugacgaagau

SEQ ID NO: 179721 - RNA, 19 nt, Homo sapiens
ugggauagcaacaaaugua

SEQ ID NO: 179722 - RNA, 19 nt, Homo sapiens
accagcaccucguacauuu

SEQ ID NO: 179723 - RNA, 19 nt, Homo sapiens
uguagucucugaguccuuu

SEQ ID NO: 179724 - RNA, 19 nt, Homo sapiens
cgaagaucguugcgagugu

SEQ ID NO: 179725 - RNA, 19 nt, Homo sapiens
gcaaugaagagagccuuau

SEQ ID NO: 179726 - RNA, 19 nt, Homo sapiens
ccaugaagguugugcaaaa

SEQ ID NO: 179727 - RNA, 19 nt, Homo sapiens
gcuaaucgcaacucuugug

SEQ ID NO: 179728 - RNA, 19 nt, Homo sapiens
caaguugcugucacuguuu

SEQ ID NO: 179729 - RNA, 19 nt, Homo sapiens
uaaaguugccaaucauaca

SEQ ID NO: 179730 - RNA, 19 nt, Homo sapiens
cugaauuagugccuguuaa

SEQ ID NO: 179731 - RNA, 19 nt, Homo sapiens
gaagaauggcaaagaacuc

SEQ ID NO: 179732 - RNA, 19 nt, Homo sapiens
ccagaagcacaagcuauuu

SEQ ID NO: 179733 - RNA, 19 nt, Homo sapiens
cagaagaccacucucaucu

SEQ ID NO: 179734 - RNA, 19 nt, Homo sapiens
gcuguucccauuccaagaa

SEQ ID NO: 179735 - RNA, 19 nt, Homo sapiens
ccauccagaucccugaaga

SEQ ID NO: 179736 - RNA, 19 nt, Homo sapiens
cauacucaauuaucagaag

SEQ ID NO: 179737 - RNA, 19 nt, Homo sapiens
uggaggaacuacuucgaau

SEQ ID NO: 179738 - RNA, 19 nt, Homo sapiens
ucagggcugcuucuaguuu

SEQ ID NO: 179739 - RNA, 19 nt, Homo sapiens
gucaacugcuuaguaauca

SEQ ID NO: 179740 - RNA, 19 nt, Homo sapiens
ugaugucaacugcuuagua

SEQ ID NO: 179741 - RNA, 19 nt, Homo sapiens
uaccuugccuaauugaaau

SEQ ID NO: 179742 - RNA, 19 nt, Homo sapiens
agccuuaucuguaugaaca

SEQ ID NO: 179743 - RNA, 19 nt, Homo sapiens
gcuuaguaaucaguggaua

SEQ ID NO: 179744 - RNA, 19 nt, Homo sapiens
ugauuacuguccagcuuau

SEQ ID NO: 179745 - RNA, 19 nt, Homo sapiens
ucucugaguccuuugcuaa

SEQ ID NO: 179746 - RNA, 19 nt, Homo sapiens
gaauggcaggugucauaug

SEQ ID NO: 179747 - RNA, 19 nt, Homo sapiens
ggaauggcaggugucauau

SEQ ID NO: 179748 - RNA, 19 nt, Homo sapiens
gauucagcguuccaaguuc

SEQ ID NO: 179749 - RNA, 19 nt, Homo sapiens
ggauauagguuuccaauua

SEQ ID NO: 179750 - RNA, 19 nt, Homo sapiens
ggaauggccuccucccuua

SEQ ID NO: 179751 - RNA, 19 nt, Homo sapiens
gaaacaagcccuuuaaguu

SEQ ID NO: 179752 - RNA, 19 nt, Homo sapiens
gcaaagccauagcagauuu

SEQ ID NO: 179753 - RNA, 19 nt, Homo sapiens
gaauuacucuccaaguuga

SEQ ID NO: 179754 - RNA, 19 nt, Homo sapiens
uuaaguacauggucaagua

SEQ ID NO: 179755 - RNA, 19 nt, Homo sapiens
cagcacaagugguagguua

SEQ ID NO: 179756 - RNA, 19 nt, Homo sapiens
aacaagcccuuuaaguuua

SEQ ID NO: 179757 - RNA, 19 nt, Homo sapiens
gagccaaacugacuauauc

SEQ ID NO: 179758 - RNA, 19 nt, Homo sapiens
gcuugaagauggaaagaaa

SEQ ID NO: 179759 - RNA, 19 nt, Homo sapiens
guagugauuuggugagaaa

SEQ ID NO: 179760 - RNA, 19 nt, Homo sapiens
gaagauggaaagaaauuug

SEQ ID NO: 179761 - RNA, 19 nt, Homo sapiens
gacaaauccuugaauguuc

SEQ ID NO: 179762 - RNA, 19 nt, Homo sapiens
ggacugaauuacucuccaa

SEQ ID NO: 179763 - RNA, 19 nt, Homo sapiens
gcccagccaucaugacaaa

SEQ ID NO: 179764 - RNA, 19 nt, Homo sapiens
uaauggacuuucaggaauu

SEQ ID NO: 179765 - RNA, 19 nt, Homo sapiens
ugaaggugcuguuuguaga

SEQ ID NO: 179766 - RNA, 19 nt, Homo sapiens
caucugcccugacugaaug

SEQ ID NO: 179767 - RNA, 19 nt, Homo sapiens
gacagaaacaagcccuuua

SEQ ID NO: 179768 - RNA, 19 nt, Homo sapiens
ugacaaauccuugaauguu

SEQ ID NO: 179769 - RNA, 19 nt, Homo sapiens
ggugcuguuuguagacuua

SEQ ID NO: 179770 - RNA, 19 nt, Homo sapiens
agagaugucuuuggguuaa

SEQ ID NO: 179771 - RNA, 19 nt, Homo sapiens
ggacagaaacaagcccuuu

SEQ ID NO: 179772 - RNA, 19 nt, Homo sapiens
caugacaaauccuugaaug

SEQ ID NO: 179773 - RNA, 19 nt, Homo sapiens
cuaauggacuuucaggaau

SEQ ID NO: 179774 - RNA, 19 nt, Homo sapiens
caucgcagcuucagcaucu

SEQ ID NO: 179775 - RNA, 19 nt, Homo sapiens
gagagaugucuuuggguua

SEQ ID NO: 179776 - RNA, 19 nt, Homo sapiens
aguacauggucaaguauua

SEQ ID NO: 179777 - RNA, 19 nt, Homo sapiens
ugccauaaaccucaaguua

SEQ ID NO: 179778 - RNA, 19 nt, Homo sapiens
gaaagcccagccaucauga

SEQ ID NO: 179779 - RNA, 19 nt, Homo sapiens
ucucauaacuuuccaagcu

SEQ ID NO: 179780 - RNA, 19 nt, Homo sapiens
caaguugagagaugucuuu

SEQ ID NO: 179781 - RNA, 19 nt, Homo sapiens
guacauggucaaguauuaa

SEQ ID NO: 179782 - RNA, 19 nt, Homo sapiens
agauucaguuucagucuuu

SEQ ID NO: 179783 - RNA, 19 nt, Homo sapiens
aaacuggaaugacaggaau

SEQ ID NO: 179784 - RNA, 19 nt, Homo sapiens
cugaauuacucuccaaguu

SEQ ID NO: 179785 - RNA, 19 nt, Homo sapiens
ccacuccacuuuguauaga

SEQ ID NO: 179786 - RNA, 19 nt, Homo sapiens
gacugaauguguucuguca

SEQ ID NO: 179787 - RNA, 19 nt, Homo sapiens
caccacuuccuaaaucuua

SEQ ID NO: 179788 - RNA, 19 nt, Homo sapiens
ugaauuacucuccaaguug

SEQ ID NO: 179789 - RNA, 19 nt, Homo sapiens
acagaaacaagcccuuuaa

SEQ ID NO: 179790 - RNA, 19 nt, Homo sapiens
guugaggacugaauuacuc

SEQ ID NO: 179791 - RNA, 19 nt, Homo sapiens
gcuguccuguguagugauu

SEQ ID NO: 179792 - RNA, 19 nt, Homo sapiens
gcuguugaggacugaauua

SEQ ID NO: 179793 - RNA, 19 nt, Homo sapiens
caagugguagguuaacauu

SEQ ID NO: 179794 - RNA, 19 nt, Homo sapiens
acaccgggaugcuugaaga

SEQ ID NO: 179795 - RNA, 19 nt, Homo sapiens
uagaucauguucacugcaa

SEQ ID NO: 179796 - RNA, 19 nt, Homo sapiens
gcuucagcaucuccuguuu

SEQ ID NO: 179797 - RNA, 19 nt, Homo sapiens
gagaugucuuuggguuaaa

SEQ ID NO: 179798 - RNA, 19 nt, Homo sapiens
agugguagguuaacauuag

SEQ ID NO: 179799 - RNA, 19 nt, Homo sapiens
gauccgaggcugggaagaa

SEQ ID NO: 179800 - RNA, 19 nt, Homo sapiens
auccuugaauguucucuua

SEQ ID NO: 179801 - RNA, 19 nt, Homo sapiens
ugaaagcccagccaucaug

SEQ ID NO: 179802 - RNA, 19 nt, Homo sapiens
ccuuaaacccucugccuuu

SEQ ID NO: 179803 - RNA, 19 nt, Homo sapiens
agacaucugcccugacuga

SEQ ID NO: 179804 - RNA, 19 nt, Homo sapiens
gcacuacaccgggaugcuu

SEQ ID NO: 179805 - RNA, 19 nt, Homo sapiens
aauugaaggugcuguuugu

SEQ ID NO: 179806 - RNA, 19 nt, Homo sapiens
ucuaauggacuuucaggaa

SEQ ID NO: 179807 - RNA, 19 nt, Homo sapiens
acaagcccuuuaaguuuau

SEQ ID NO: 179808 - RNA, 19 nt, Homo sapiens
gaauguguucugucacuca

SEQ ID NO: 179809 - RNA, 19 nt, Homo sapiens
caucaugacaaauccuuga

SEQ ID NO: 179810 - RNA, 19 nt, Homo sapiens
gacuuaacacccagugaaa

SEQ ID NO: 179811 - RNA, 19 nt, Homo sapiens
gaucauguucacugcaaug

SEQ ID NO: 179812 - RNA, 19 nt, Homo sapiens
agaaacaagcccuuuaagu

SEQ ID NO: 179813 - RNA, 19 nt, Homo sapiens
gguuaacauuagaauagga

SEQ ID NO: 179814 - RNA, 19 nt, Homo sapiens
gaagauucaguuucagucu

SEQ ID NO: 179815 - RNA, 19 nt, Homo sapiens
gauguuccacuccacuuug

SEQ ID NO: 179816 - RNA, 19 nt, Homo sapiens
agacuuaacacccagugaa

SEQ ID NO: 179817 - RNA, 19 nt, Homo sapiens
uuuccaagcuccaccacuu

SEQ ID NO: 179818 - RNA, 19 nt, Homo sapiens
acaccucuguuuccucuuc

SEQ ID NO: 179819 - RNA, 19 nt, Homo sapiens
acaaauccuugaauguucu

SEQ ID NO: 179820 - RNA, 19 nt, Homo sapiens
caauugaaggugcuguuug

SEQ ID NO: 179821 - RNA, 19 nt, Homo sapiens
cuuaaacccucugccuuug

SEQ ID NO: 179822 - RNA, 19 nt, Homo sapiens
gagugcagguggaaaccau

SEQ ID NO: 179823 - RNA, 19 nt, Homo sapiens
cuugaauguucucuuaaga

SEQ ID NO: 179824 - RNA, 19 nt, Homo sapiens
uaaaagcccuaccuaaaac

SEQ ID NO: 179825 - RNA, 19 nt, Homo sapiens
auuaacagcacaaguggua

SEQ ID NO: 179826 - RNA, 19 nt, Homo sapiens
agaccugcguggugcacua

SEQ ID NO: 179827 - RNA, 19 nt, Homo sapiens
ucguauguguguuuaccua

SEQ ID NO: 179828 - RNA, 19 nt, Homo sapiens
aauggacuuucaggaauuu

SEQ ID NO: 179829 - RNA, 19 nt, Homo sapiens
cugcaaugcuggacacuac

SEQ ID NO: 179830 - RNA, 19 nt, Homo sapiens
gccuuugccuccaccauuc

SEQ ID NO: 179831 - RNA, 19 nt, Homo sapiens
uuaaaagcccuaccuaaaa

SEQ ID NO: 179832 - RNA, 19 nt, Homo sapiens
uagaauaggaauugguguu

SEQ ID NO: 179833 - RNA, 19 nt, Homo sapiens
gugguagguuaacauuaga

SEQ ID NO: 179834 - RNA, 19 nt, Homo sapiens
gcuggacacuacagguauc

SEQ ID NO: 179835 - RNA, 19 nt, Homo sapiens
ggcaucaucccaccacaug

SEQ ID NO: 179836 - RNA, 19 nt, Homo sapiens
ucccuuagcucccuguucu

SEQ ID NO: 179837 - RNA, 19 nt, Homo sapiens
caagcuccaccacuuccua

SEQ ID NO: 179838 - RNA, 19 nt, Homo sapiens
ccacucucgucuucgaugu

SEQ ID NO: 179839 - RNA, 19 nt, Homo sapiens
ucaauugaaggugcuguuu

SEQ ID NO: 179840 - RNA, 19 nt, Homo sapiens
gcuccaccacuuccuaaau

SEQ ID NO: 179841 - RNA, 19 nt, Homo sapiens
ccuugaauguucucuuaag

SEQ ID NO: 179842 - RNA, 19 nt, Homo sapiens
cuccaccacuuccuaaauc

SEQ ID NO: 179843 - RNA, 19 nt, Homo sapiens
uaaguacauggucaaguau

SEQ ID NO: 179844 - RNA, 19 nt, Homo sapiens
uuagcucccuguucuugga

SEQ ID NO: 179845 - RNA, 19 nt, Homo sapiens
aguauuaacagcacaagug

SEQ ID NO: 179846 - RNA, 19 nt, Homo sapiens
caauuaaguacauggucaa

SEQ ID NO: 179847 - RNA, 19 nt, Homo sapiens
auagacaucugcccugacu

SEQ ID NO: 179848 - RNA, 19 nt, Homo sapiens
cgucuucgauguggagcuu

SEQ ID NO: 179849 - RNA, 19 nt, Homo sapiens
ggaauggccuccucccuua

SEQ ID NO: 179850 - RNA, 19 nt, Homo sapiens
gaaacaagcccuuuaaguu

SEQ ID NO: 179851 - RNA, 19 nt, Homo sapiens
gauggcagcuguuuaaaug

SEQ ID NO: 179852 - RNA, 19 nt, Homo sapiens
gaaaggaauuggcaugugu

SEQ ID NO: 179853 - RNA, 19 nt, Homo sapiens
ggagauggcagcuguuuaa

SEQ ID NO: 179854 - RNA, 19 nt, Homo sapiens
gaguauccuuucaguguua

SEQ ID NO: 179855 - RNA, 19 nt, Homo sapiens
ggaauuggcauguguaugu

SEQ ID NO: 179856 - RNA, 19 nt, Homo sapiens
guaaggaaauggaauacug

SEQ ID NO: 179857 - RNA, 19 nt, Homo sapiens
aacaagcccuuuaaguuua

SEQ ID NO: 179858 - RNA, 19 nt, Homo sapiens
gagccaaacugacuauauc

SEQ ID NO: 179859 - RNA, 19 nt, Homo sapiens
gcuugaagauggaaagaaa

SEQ ID NO: 179860 - RNA, 19 nt, Homo sapiens
gaagauggaaagaaauuug

SEQ ID NO: 179861 - RNA, 19 nt, Homo sapiens
gaauugaggacuauggaaa

SEQ ID NO: 179862 - RNA, 19 nt, Homo sapiens
ggaaaggaauuggcaugug

SEQ ID NO: 179863 - RNA, 19 nt, Homo sapiens
ugaggacuauggaaaugua

SEQ ID NO: 179864 - RNA, 19 nt, Homo sapiens
gacagaaacaagcccuuua

SEQ ID NO: 179865 - RNA, 19 nt, Homo sapiens
ggacagaaacaagcccuuu

SEQ ID NO: 179866 - RNA, 19 nt, Homo sapiens
gaauuggcauguguauguu

SEQ ID NO: 179867 - RNA, 19 nt, Homo sapiens
aaacugaauugaggacuau

SEQ ID NO: 179868 - RNA, 19 nt, Homo sapiens
aaacuggaaugacaggaau

SEQ ID NO: 179869 - RNA, 19 nt, Homo sapiens
guguaugcuuugaauguaa

SEQ ID NO: 179870 - RNA, 19 nt, Homo sapiens
uggcagcuguuuaaauguu

SEQ ID NO: 179871 - RNA, 19 nt, Homo sapiens
acagaaacaagcccuuuaa

SEQ ID NO: 179872 - RNA, 19 nt, Homo sapiens
acaccgggaugcuugaaga

SEQ ID NO: 179873 - RNA, 19 nt, Homo sapiens
ggcagcuguuuaaauguuu

SEQ ID NO: 179874 - RNA, 19 nt, Homo sapiens
uaaggaaauggaauacuga

SEQ ID NO: 179875 - RNA, 19 nt, Homo sapiens
ugaguauccuuucaguguu

SEQ ID NO: 179876 - RNA, 19 nt, Homo sapiens
gauccgaggcugggaagaa

SEQ ID NO: 179877 - RNA, 19 nt, Homo sapiens
gcacuacaccgggaugcuu

SEQ ID NO: 179878 - RNA, 19 nt, Homo sapiens
cauguuaugcccagcguuu

SEQ ID NO: 179879 - RNA, 19 nt, Homo sapiens
guucuuggguaaggaaaug

SEQ ID NO: 179880 - RNA, 19 nt, Homo sapiens
aauguaggccaaauuugua

SEQ ID NO: 179881 - RNA, 19 nt, Homo sapiens
acaagcccuuuaaguuuau

SEQ ID NO: 179882 - RNA, 19 nt, Homo sapiens
guuauuaguguaugcuuug

SEQ ID NO: 179883 - RNA, 19 nt, Homo sapiens
agaaacaagcccuuuaagu

SEQ ID NO: 179884 - RNA, 19 nt, Homo sapiens
cugcauucuuucuguauug

SEQ ID NO: 179885 - RNA, 19 nt, Homo sapiens
aaacaccacaaggcuauuu

SEQ ID NO: 179886 - RNA, 19 nt, Homo sapiens
gagugcagguggaaaccau

SEQ ID NO: 179887 - RNA, 19 nt, Homo sapiens
agaccugcguggugcacua

SEQ ID NO: 179888 - RNA, 19 nt, Homo sapiens
aguguaugcuuugaaugua

SEQ ID NO: 179889 - RNA, 19 nt, Homo sapiens
gagauggcagcuguuuaaa

SEQ ID NO: 179890 - RNA, 19 nt, Homo sapiens
ucccuuagcucccuguucu

SEQ ID NO: 179891 - RNA, 19 nt, Homo sapiens
ggcaucaucccaccacaug

SEQ ID NO: 179892 - RNA, 19 nt, Homo sapiens
uguauugaguauccuuuca

SEQ ID NO: 179893 - RNA, 19 nt, Homo sapiens
ccacucucgucuucgaugu

SEQ ID NO: 179894 - RNA, 19 nt, Homo sapiens
aaaggaauuggcaugugua

SEQ ID NO: 179895 - RNA, 19 nt, Homo sapiens
uggguaaggaaauggaaua

SEQ ID NO: 179896 - RNA, 19 nt, Homo sapiens
gcucccuguucuuggguaa

SEQ ID NO: 179897 - RNA, 19 nt, Homo sapiens
uugaguauccuuucagugu

SEQ ID NO: 179898 - RNA, 19 nt, Homo sapiens
aaaacugaauugaggacua

SEQ ID NO: 179899 - RNA, 19 nt, Homo sapiens
uaguguaugcuuugaaugu

SEQ ID NO: 179900 - RNA, 19 nt, Homo sapiens
ccugcauucuuucuguauu

SEQ ID NO: 179901 - RNA, 19 nt, Homo sapiens
cgucuucgauguggagcuu

SEQ ID NO: 179902 - RNA, 19 nt, Homo sapiens
acaugccacucucgucuuc

SEQ ID NO: 179903 - RNA, 19 nt, Homo sapiens
cagagagccaaacugacua

SEQ ID NO: 179904 - RNA, 19 nt, Homo sapiens
cuuugcuccucccauguua

SEQ ID NO: 179905 - RNA, 19 nt, Homo sapiens
gcccuucacugccuuugcu

SEQ ID NO: 179906 - RNA, 19 nt, Homo sapiens
gagagccaaacugacuaua

SEQ ID NO: 179907 - RNA, 19 nt, Homo sapiens
agagccaaacugacuauau

SEQ ID NO: 179908 - RNA, 19 nt, Homo sapiens
gccaacauuuuaguucuuu

SEQ ID NO: 179909 - RNA, 19 nt, Homo sapiens
cgggaugcuugaagaugga

SEQ ID NO: 179910 - RNA, 19 nt, Homo sapiens
aaauuggucacccuaagga

SEQ ID NO: 179911 - RNA, 19 nt, Homo sapiens
gaugagugugggucagaga

SEQ ID NO: 179912 - RNA, 19 nt, Homo sapiens
uauugaguauccuuucagu

SEQ ID NO: 179913 - RNA, 19 nt, Homo sapiens
aaacaaaccuuucaaguuc

SEQ ID NO: 179914 - RNA, 19 nt, Homo sapiens
ucuguuagcugcucacuua

SEQ ID NO: 179915 - RNA, 19 nt, Homo sapiens
ggaagaaguuugauucauc

SEQ ID NO: 179916 - RNA, 19 nt, Homo sapiens
uaaacaauguccucuuuga

SEQ ID NO: 179917 - RNA, 19 nt, Homo sapiens
aaacuucgguugcagauug

SEQ ID NO: 179918 - RNA, 19 nt, Homo sapiens
gcugucacuuucucucuua

SEQ ID NO: 179919 - RNA, 19 nt, Homo sapiens
cuuaaacaauguccucuuu

SEQ ID NO: 179920 - RNA, 19 nt, Homo sapiens
cauuucagguugugcauuu

SEQ ID NO: 179921 - RNA, 19 nt, Homo sapiens
aaacguguguggugcacua

SEQ ID NO: 179922 - RNA, 19 nt, Homo sapiens
ccaguuaccuuugcuguca

SEQ ID NO: 179923 - RNA, 19 nt, Homo sapiens
ugccuuaccuucacuuaaa

SEQ ID NO: 179924 - RNA, 19 nt, Homo sapiens
gucacuuucucucuuauaa

SEQ ID NO: 179925 - RNA, 19 nt, Homo sapiens
acaauguccucuuugagaa

SEQ ID NO: 179926 - RNA, 19 nt, Homo sapiens
gcugcucacuuaaacaaug

SEQ ID NO: 179927 - RNA, 19 nt, Homo sapiens
caaacaggaagucaucaaa

SEQ ID NO: 179928 - RNA, 19 nt, Homo sapiens
gguugcagauugaagcauu

SEQ ID NO: 179929 - RNA, 19 nt, Homo sapiens
gcaaacaggaagucaucaa

SEQ ID NO: 179930 - RNA, 19 nt, Homo sapiens
acaaggugcucagacauga

SEQ ID NO: 179931 - RNA, 19 nt, Homo sapiens
gggaagaaguuugauucau

SEQ ID NO: 179932 - RNA, 19 nt, Homo sapiens
ccaaguugcucuguaugug

SEQ ID NO: 179933 - RNA, 19 nt, Homo sapiens
caaugccacccucaucuuu

SEQ ID NO: 179934 - RNA, 19 nt, Homo sapiens
aaauaaaggcucugugcuu

SEQ ID NO: 179935 - RNA, 19 nt, Homo sapiens
gaaggacauuccccaagaa

SEQ ID NO: 179936 - RNA, 19 nt, Homo sapiens
ccuuucaaguucagaauug

SEQ ID NO: 179937 - RNA, 19 nt, Homo sapiens
guucagaauuggcaaacag

SEQ ID NO: 179938 - RNA, 19 nt, Homo sapiens
cacaaucuacacugccuua

SEQ ID NO: 179939 - RNA, 19 nt, Homo sapiens
acagaacacagaucucuug

SEQ ID NO: 179940 - RNA, 19 nt, Homo sapiens
gagacagaaacaaaccuuu

SEQ ID NO: 179941 - RNA, 19 nt, Homo sapiens
cauucucucugcccaaguu

SEQ ID NO: 179942 - RNA, 19 nt, Homo sapiens
guugcagauugaagcauuu

SEQ ID NO: 179943 - RNA, 19 nt, Homo sapiens
aggaagucaucaaagguuu

SEQ ID NO: 179944 - RNA, 19 nt, Homo sapiens
uaccuuugcugucacuuuc

SEQ ID NO: 179945 - RNA, 19 nt, Homo sapiens
guggugcacuacacaggaa

SEQ ID NO: 179946 - RNA, 19 nt, Homo sapiens
ugaggaaacuucgguugca

SEQ ID NO: 179947 - RNA, 19 nt, Homo sapiens
caugcgaauucuugcuuga

SEQ ID NO: 179948 - RNA, 19 nt, Homo sapiens
guuagcugcucacuuaaac

SEQ ID NO: 179949 - RNA, 19 nt, Homo sapiens
caggaagucaucaaagguu

SEQ ID NO: 179950 - RNA, 19 nt, Homo sapiens
caauguccucuuugagaaa

SEQ ID NO: 179951 - RNA, 19 nt, Homo sapiens
gcguggagaucgagaccau

SEQ ID NO: 179952 - RNA, 19 nt, Homo sapiens
ggaaacuucgguugcagau

SEQ ID NO: 179953 - RNA, 19 nt, Homo sapiens
gcaggaaggaacucaaggu

SEQ ID NO: 179954 - RNA, 19 nt, Homo sapiens
ggugucaucccucccaaug

SEQ ID NO: 179955 - RNA, 19 nt, Homo sapiens
acacaggaaugcuccaaaa

SEQ ID NO: 179956 - RNA, 19 nt, Homo sapiens
uaaaggcucugugcuugac

SEQ ID NO: 179957 - RNA, 19 nt, Homo sapiens
aacaauguccucuuugaga

SEQ ID NO: 179958 - RNA, 19 nt, Homo sapiens
guacacagagggacuugag

SEQ ID NO: 179959 - RNA, 19 nt, Homo sapiens
uagcugcucacuuaaacaa

SEQ ID NO: 179960 - RNA, 19 nt, Homo sapiens
gagggacuugagccaguua

SEQ ID NO: 179961 - RNA, 19 nt, Homo sapiens
uguaguagccuuuccugau

SEQ ID NO: 179962 - RNA, 19 nt, Homo sapiens
caaguugcucuguaugugu

SEQ ID NO: 179963 - RNA, 19 nt, Homo sapiens
aaacaggaagucaucaaag

SEQ ID NO: 179964 - RNA, 19 nt, Homo sapiens
gacuugagccaguuaccuu

SEQ ID NO: 179965 - RNA, 19 nt, Homo sapiens
ccaaugccacccucaucuu

SEQ ID NO: 179966 - RNA, 19 nt, Homo sapiens
aacaggaagucaucaaagg

SEQ ID NO: 179967 - RNA, 19 nt, Homo sapiens
cagaauuggcaaacaggaa

SEQ ID NO: 179968 - RNA, 19 nt, Homo sapiens
gaaacuucgguugcagauu

SEQ ID NO: 179969 - RNA, 19 nt, Homo sapiens
aaguugcucuguauguguu

SEQ ID NO: 179970 - RNA, 19 nt, Homo sapiens
gagggugcagcccagauga

SEQ ID NO: 179971 - RNA, 19 nt, Homo sapiens
caaguucagaauuggcaaa

SEQ ID NO: 179972 - RNA, 19 nt, Homo sapiens
cuacacugccuuaccuuca

SEQ ID NO: 179973 - RNA, 19 nt, Homo sapiens
cgaauucuugcuugaggaa

SEQ ID NO: 179974 - RNA, 19 nt, Homo sapiens
cgucaguguucaugcgaau

SEQ ID NO: 179975 - RNA, 19 nt, Homo sapiens
ugcccaaguugcucuguau

SEQ ID NO: 179976 - RNA, 19 nt, Homo sapiens
gaaggcaggaaggaacuca

SEQ ID NO: 179977 - RNA, 19 nt, Homo sapiens
gcugcucaacuuagaguga

SEQ ID NO: 179978 - RNA, 19 nt, Homo sapiens
aacaaaccuuucaaguuca

SEQ ID NO: 179979 - RNA, 19 nt, Homo sapiens
augccacccucaucuuuga

SEQ ID NO: 179980 - RNA, 19 nt, Homo sapiens
aaucuacacugccuuaccu

SEQ ID NO: 179981 - RNA, 19 nt, Homo sapiens
caggaaugcuccaaaaugg

SEQ ID NO: 179982 - RNA, 19 nt, Homo sapiens
ucaguguucaugcgaauuc

SEQ ID NO: 179983 - RNA, 19 nt, Homo sapiens
cugcucaacuuagagugaa

SEQ ID NO: 179984 - RNA, 19 nt, Homo sapiens
gugcagcccagaugagcuu

SEQ ID NO: 179985 - RNA, 19 nt, Homo sapiens
aaacaaaccuuucaaguuc

SEQ ID NO: 179986 - RNA, 19 nt, Homo sapiens
ucuguuagcugcucacuua

SEQ ID NO: 179987 - RNA, 19 nt, Homo sapiens
ggaagaaguuugauucauc

SEQ ID NO: 179988 - RNA, 19 nt, Homo sapiens
uaaacaauguccucuuuga

SEQ ID NO: 179989 - RNA, 19 nt, Homo sapiens
aaacuucgguugcagauug

SEQ ID NO: 179990 - RNA, 19 nt, Homo sapiens
gcugucacuuucucucuua

SEQ ID NO: 179991 - RNA, 19 nt, Homo sapiens
cuuaaacaauguccucuuu

SEQ ID NO: 179992 - RNA, 19 nt, Homo sapiens
cauuucagguugugcauuu

SEQ ID NO: 179993 - RNA, 19 nt, Homo sapiens
aaacguguguggugcacua

SEQ ID NO: 179994 - RNA, 19 nt, Homo sapiens
ccaguuaccuuugcuguca

SEQ ID NO: 179995 - RNA, 19 nt, Homo sapiens
ugccuuaccuucacuuaaa

SEQ ID NO: 179996 - RNA, 19 nt, Homo sapiens
gucacuuucucucuuauaa

SEQ ID NO: 179997 - RNA, 19 nt, Homo sapiens
acaauguccucuuugagaa

SEQ ID NO: 179998 - RNA, 19 nt, Homo sapiens
gcugcucacuuaaacaaug

SEQ ID NO: 179999 - RNA, 19 nt, Homo sapiens
caaacaggaagucaucaaa

SEQ ID NO: 180000 - RNA, 19 nt, Homo sapiens
gguugcagauugaagcauu

SEQ ID NO: 180001 - RNA, 19 nt, Homo sapiens
gcaaacaggaagucaucaa

SEQ ID NO: 180002 - RNA, 19 nt, Homo sapiens
acaaggugcucagacauga

SEQ ID NO: 180003 - RNA, 19 nt, Homo sapiens
gggaagaaguuugauucau

SEQ ID NO: 180004 - RNA, 19 nt, Homo sapiens
ccaaguugcucuguaugug

SEQ ID NO: 180005 - RNA, 19 nt, Homo sapiens
caaugccacccucaucuuu

SEQ ID NO: 180006 - RNA, 19 nt, Homo sapiens
aaauaaaggcucugugcuu

SEQ ID NO: 180007 - RNA, 19 nt, Homo sapiens
gaaggacauuccccaagaa

SEQ ID NO: 180008 - RNA, 19 nt, Homo sapiens
ccuuucaaguucagaauug

SEQ ID NO: 180009 - RNA, 19 nt, Homo sapiens
guucagaauuggcaaacag

SEQ ID NO: 180010 - RNA, 19 nt, Homo sapiens
cacaaucuacacugccuua

SEQ ID NO: 180011 - RNA, 19 nt, Homo sapiens
acagaacacagaucucuug

SEQ ID NO: 180012 - RNA, 19 nt, Homo sapiens
gagacagaaacaaaccuuu

SEQ ID NO: 180013 - RNA, 19 nt, Homo sapiens
cauucucucugcccaaguu

SEQ ID NO: 180014 - RNA, 19 nt, Homo sapiens
guugcagauugaagcauuu

SEQ ID NO: 180015 - RNA, 19 nt, Homo sapiens
aggaagucaucaaagguuu

SEQ ID NO: 180016 - RNA, 19 nt, Homo sapiens
uaccuuugcugucacuuuc

SEQ ID NO: 180017 - RNA, 19 nt, Homo sapiens
guggugcacuacacaggaa

SEQ ID NO: 180018 - RNA, 19 nt, Homo sapiens
ugaggaaacuucgguugca

SEQ ID NO: 180019 - RNA, 19 nt, Homo sapiens
caugcgaauucuugcuuga

SEQ ID NO: 180020 - RNA, 19 nt, Homo sapiens
guuagcugcucacuuaaac

SEQ ID NO: 180021 - RNA, 19 nt, Homo sapiens
caggaagucaucaaagguu

SEQ ID NO: 180022 - RNA, 19 nt, Homo sapiens
caauguccucuuugagaaa

SEQ ID NO: 180023 - RNA, 19 nt, Homo sapiens
gcguggagaucgagaccau

SEQ ID NO: 180024 - RNA, 19 nt, Homo sapiens
ggaaacuucgguugcagau

SEQ ID NO: 180025 - RNA, 19 nt, Homo sapiens
gcaggaaggaacucaaggu

SEQ ID NO: 180026 - RNA, 19 nt, Homo sapiens
ggugucaucccucccaaug

SEQ ID NO: 180027 - RNA, 19 nt, Homo sapiens
acacaggaaugcuccaaaa

SEQ ID NO: 180028 - RNA, 19 nt, Homo sapiens
uaaaggcucugugcuugac

SEQ ID NO: 180029 - RNA, 19 nt, Homo sapiens
aacaauguccucuuugaga

SEQ ID NO: 180030 - RNA, 19 nt, Homo sapiens
guacacagagggacuugag

SEQ ID NO: 180031 - RNA, 19 nt, Homo sapiens
uagcugcucacuuaaacaa

SEQ ID NO: 180032 - RNA, 19 nt, Homo sapiens
gagggacuugagccaguua

SEQ ID NO: 180033 - RNA, 19 nt, Homo sapiens
uguaguagccuuuccugau

SEQ ID NO: 180034 - RNA, 19 nt, Homo sapiens
caaguugcucuguaugugu

SEQ ID NO: 180035 - RNA, 19 nt, Homo sapiens
ccagcuggguccucuuucu

SEQ ID NO: 180036 - RNA, 19 nt, Homo sapiens
aaacaggaagucaucaaag

SEQ ID NO: 180037 - RNA, 19 nt, Homo sapiens
gacuugagccaguuaccuu

SEQ ID NO: 180038 - RNA, 19 nt, Homo sapiens
ccaaugccacccucaucuu

SEQ ID NO: 180039 - RNA, 19 nt, Homo sapiens
aacaggaagucaucaaagg

SEQ ID NO: 180040 - RNA, 19 nt, Homo sapiens
cagaauuggcaaacaggaa

SEQ ID NO: 180041 - RNA, 19 nt, Homo sapiens
gaaacuucgguugcagauu

SEQ ID NO: 180042 - RNA, 19 nt, Homo sapiens
aaguugcucuguauguguu

SEQ ID NO: 180043 - RNA, 19 nt, Homo sapiens
caaguucagaauuggcaaa

SEQ ID NO: 180044 - RNA, 19 nt, Homo sapiens
cuacacugccuuaccuuca

SEQ ID NO: 180045 - RNA, 19 nt, Homo sapiens
cgaauucuugcuugaggaa

SEQ ID NO: 180046 - RNA, 19 nt, Homo sapiens
cgucaguguucaugcgaau

SEQ ID NO: 180047 - RNA, 19 nt, Homo sapiens
ugcccaaguugcucuguau

SEQ ID NO: 180048 - RNA, 19 nt, Homo sapiens
gaaggcaggaaggaacuca

SEQ ID NO: 180049 - RNA, 19 nt, Homo sapiens
gcugcucaacuuagaguga

SEQ ID NO: 180050 - RNA, 19 nt, Homo sapiens
aacaaaccuuucaaguuca

SEQ ID NO: 180051 - RNA, 19 nt, Homo sapiens
augccacccucaucuuuga

SEQ ID NO: 180052 - RNA, 19 nt, Homo sapiens
aaucuacacugccuuaccu

SEQ ID NO: 180053 - RNA, 19 nt, Homo sapiens
ucaguguucaugcgaauuc

SEQ ID NO: 180054 - RNA, 19 nt, Homo sapiens
cugcucaacuuagagugaa

SEQ ID NO: 180055 - RNA, 19 nt, Homo sapiens
caggaaugcuccaaaaugg

SEQ ID NO: 180056 - RNA, 19 nt, Homo sapiens
gcgacgaacugagcuguaa

SEQ ID NO: 180057 - RNA, 19 nt, Homo sapiens
gaaccagcccuuugucuuc

SEQ ID NO: 180058 - RNA, 19 nt, Homo sapiens
gaccucagcuccagcauac

SEQ ID NO: 180059 - RNA, 19 nt, Homo sapiens
gcacaggccaggucaucaa

SEQ ID NO: 180060 - RNA, 19 nt, Homo sapiens
gaagaugggacagaguuug

SEQ ID NO: 180061 - RNA, 19 nt, Homo sapiens
ggaagaugggacagaguuu

SEQ ID NO: 180062 - RNA, 19 nt, Homo sapiens
gugcaacccugguguucga

SEQ ID NO: 180063 - RNA, 19 nt, Homo sapiens
ggugaucccauccgagcua

SEQ ID NO: 180064 - RNA, 19 nt, Homo sapiens
cauccgagcuaggguaugg

SEQ ID NO: 180065 - RNA, 19 nt, Homo sapiens
aaauagagcgacgaacuga

SEQ ID NO: 180066 - RNA, 19 nt, Homo sapiens
acaugaggcugagcugguu

SEQ ID NO: 180067 - RNA, 19 nt, Homo sapiens
aagaugggacagaguuuga

SEQ ID NO: 180068 - RNA, 19 nt, Homo sapiens
agaccucagcuccagcaua

SEQ ID NO: 180069 - RNA, 19 nt, Homo sapiens
uggaagaugggacagaguu

SEQ ID NO: 180070 - RNA, 19 nt, Homo sapiens
gguuucgcacgguccaaua

SEQ ID NO: 180071 - RNA, 19 nt, Homo sapiens
gcaaaaggaagcugcagau

SEQ ID NO: 180072 - RNA, 19 nt, Homo sapiens
caucagggaccagacuguu

SEQ ID NO: 180073 - RNA, 19 nt, Homo sapiens
agaaccagcccuuugucuu

SEQ ID NO: 180074 - RNA, 19 nt, Homo sapiens
gcgacgaacugagcuguaa

SEQ ID NO: 180075 - RNA, 19 nt, Homo sapiens
gaaccagcccuuugucuuc

SEQ ID NO: 180076 - RNA, 19 nt, Homo sapiens
gaccucagcuccagcauac

SEQ ID NO: 180077 - RNA, 19 nt, Homo sapiens
ucacuggacugagacauga

SEQ ID NO: 180078 - RNA, 19 nt, Homo sapiens
gcacaggccaggucaucaa

SEQ ID NO: 180079 - RNA, 19 nt, Homo sapiens
gaagaugggacagaguuug

SEQ ID NO: 180080 - RNA, 19 nt, Homo sapiens
ggaagaugggacagaguuu

SEQ ID NO: 180081 - RNA, 19 nt, Homo sapiens
gugcaacccugguguucga

SEQ ID NO: 180082 - RNA, 19 nt, Homo sapiens
ggugaucccauccgagcua

SEQ ID NO: 180083 - RNA, 19 nt, Homo sapiens
cauccgagcuaggguaugg

SEQ ID NO: 180084 - RNA, 19 nt, Homo sapiens
aaauagagcgacgaacuga

SEQ ID NO: 180085 - RNA, 19 nt, Homo sapiens
acaugaggcugagcugguu

SEQ ID NO: 180086 - RNA, 19 nt, Homo sapiens
aagaugggacagaguuuga

SEQ ID NO: 180087 - RNA, 19 nt, Homo sapiens
agaccucagcuccagcaua

SEQ ID NO: 180088 - RNA, 19 nt, Homo sapiens
uggaagaugggacagaguu

SEQ ID NO: 180089 - RNA, 19 nt, Homo sapiens
caucagggaccagacuguu

SEQ ID NO: 180090 - RNA, 19 nt, Homo sapiens
agaaccagcccuuugucuu

SEQ ID NO: 180091 - RNA, 19 nt, Homo sapiens
gcaaaaggaagcugcagau

SEQ ID NO: 180092 - RNA, 19 nt, Homo sapiens
gaagcucucuugacuauga

SEQ ID NO: 180093 - RNA, 19 nt, Homo sapiens
aaacuuaaguggcucaaua

SEQ ID NO: 180094 - RNA, 19 nt, Homo sapiens
gaagauaaacccaaagaaa

SEQ ID NO: 180095 - RNA, 19 nt, Homo sapiens
caacaaagaagcccucaua

SEQ ID NO: 180096 - RNA, 19 nt, Homo sapiens
uaaagugucugagcaagua

SEQ ID NO: 180097 - RNA, 19 nt, Homo sapiens
guuauagacuggacuuuaa

SEQ ID NO: 180098 - RNA, 19 nt, Homo sapiens
gaaguggaauuaguggaua

SEQ ID NO: 180099 - RNA, 19 nt, Homo sapiens
gaaggacauuaucaaguuu

SEQ ID NO: 180100 - RNA, 19 nt, Homo sapiens
gguaaugguugauaaaugu

SEQ ID NO: 180101 - RNA, 19 nt, Homo sapiens
agaaggacauuaucaaguu

SEQ ID NO: 180102 - RNA, 19 nt, Homo sapiens
caaagaagcccucauagca

SEQ ID NO: 180103 - RNA, 19 nt, Homo sapiens
ccaaagaaaccaagucuga

SEQ ID NO: 180104 - RNA, 19 nt, Homo sapiens
ggaugaagcucucuugacu

SEQ ID NO: 180105 - RNA, 19 nt, Homo sapiens
caaggugucuaauucagaa

SEQ ID NO: 180106 - RNA, 19 nt, Homo sapiens
gugagcagcugcccaagaa

SEQ ID NO: 180107 - RNA, 19 nt, Homo sapiens
caucagaggucgcuucaca

SEQ ID NO: 180108 - RNA, 19 nt, Homo sapiens
gaaaccaagucugaagaga

SEQ ID NO: 180109 - RNA, 19 nt, Homo sapiens
guuguucacugcugguaua

SEQ ID NO: 180110 - RNA, 19 nt, Homo sapiens
agaaugggcuuacggaaag

SEQ ID NO: 180111 - RNA, 19 nt, Homo sapiens
ucaaacaagugcaaagaag

SEQ ID NO: 180112 - RNA, 19 nt, Homo sapiens
ggaauuaguggauauugau

SEQ ID NO: 180113 - RNA, 19 nt, Homo sapiens
gguuauagacuggacuuua

SEQ ID NO: 180114 - RNA, 19 nt, Homo sapiens
ggguaaugguugauaaaug

SEQ ID NO: 180115 - RNA, 19 nt, Homo sapiens
aaacuuggccuugaagaaa

SEQ ID NO: 180116 - RNA, 19 nt, Homo sapiens
gcauagcugccuuaaaugu

SEQ ID NO: 180117 - RNA, 19 nt, Homo sapiens
guccugauguucaacuauu

SEQ ID NO: 180118 - RNA, 19 nt, Homo sapiens
aaaugucgcuaccaucaga

SEQ ID NO: 180119 - RNA, 19 nt, Homo sapiens
gauaaaacuuggccuugaa

SEQ ID NO: 180120 - RNA, 19 nt, Homo sapiens
aaacaagugcaaagaagaa

SEQ ID NO: 180121 - RNA, 19 nt, Homo sapiens
ccaagaaggacauuaucaa

SEQ ID NO: 180122 - RNA, 19 nt, Homo sapiens
cagaaugggcuuacggaaa

SEQ ID NO: 180123 - RNA, 19 nt, Homo sapiens
gcacagccuugacgucacu

SEQ ID NO: 180124 - RNA, 19 nt, Homo sapiens
guaaaauacuggucaagga

SEQ ID NO: 180125 - RNA, 19 nt, Homo sapiens
caaacaagugcaaagaaga

SEQ ID NO: 180126 - RNA, 19 nt, Homo sapiens
uggaauuaguggauauuga

SEQ ID NO: 180127 - RNA, 19 nt, Homo sapiens
ccacuugguuacagccuau

SEQ ID NO: 180128 - RNA, 19 nt, Homo sapiens
ucaaguuucugcaggaaca

SEQ ID NO: 180129 - RNA, 19 nt, Homo sapiens
augaagcucucuugacuau

SEQ ID NO: 180130 - RNA, 19 nt, Homo sapiens
caaagaaaccaagucugaa

SEQ ID NO: 180131 - RNA, 19 nt, Homo sapiens
agaggucgcuucacaaggu

SEQ ID NO: 180132 - RNA, 19 nt, Homo sapiens
gccaagccuuuaaguuuua

SEQ ID NO: 180133 - RNA, 19 nt, Homo sapiens
caagugcaaagaagaagaa

SEQ ID NO: 180134 - RNA, 19 nt, Homo sapiens
gaugaagcucucuugacua

SEQ ID NO: 180135 - RNA, 19 nt, Homo sapiens
cugaagagacccuggauga

SEQ ID NO: 180136 - RNA, 19 nt, Homo sapiens
caagaaggacauuaucaag

SEQ ID NO: 180137 - RNA, 19 nt, Homo sapiens
uuacacaacuaguuagaac

SEQ ID NO: 180138 - RNA, 19 nt, Homo sapiens
ggaguaggcaaaguuauca

SEQ ID NO: 180139 - RNA, 19 nt, Homo sapiens
aaauguggguaaugguuga

SEQ ID NO: 180140 - RNA, 19 nt, Homo sapiens
ugauaaaugucgcuaccau

SEQ ID NO: 180141 - RNA, 19 nt, Homo sapiens
gacuaugaguaaaggagaa

SEQ ID NO: 180142 - RNA, 19 nt, Homo sapiens
ggucggaguaggcaaaguu

SEQ ID NO: 180143 - RNA, 19 nt, Homo sapiens
aaaaccaacuuucccaaaa

SEQ ID NO: 180144 - RNA, 19 nt, Homo sapiens
ccaagacagcuaacaagga

SEQ ID NO: 180145 - RNA, 19 nt, Homo sapiens
uaccucauguuguaaacuu

SEQ ID NO: 180146 - RNA, 19 nt, Homo sapiens
aaggaagagucaacuggaa

SEQ ID NO: 180147 - RNA, 19 nt, Homo sapiens
ugcuucagcucuaaggaua

SEQ ID NO: 180148 - RNA, 19 nt, Homo sapiens
ggagauugaaccagaaugg

SEQ ID NO: 180149 - RNA, 19 nt, Homo sapiens
ggucuaaaauacuuuccua

SEQ ID NO: 180150 - RNA, 19 nt, Homo sapiens
ggaugaggguccaccaaaa

SEQ ID NO: 180151 - RNA, 19 nt, Homo sapiens
augugaagcuuaaugaaga

SEQ ID NO: 180152 - RNA, 19 nt, Homo sapiens
uggagcagcugcgcaguga

SEQ ID NO: 180153 - RNA, 19 nt, Homo sapiens
aaauacuggucaaggagaa

SEQ ID NO: 180154 - RNA, 19 nt, Homo sapiens
gaaugggcuuacggaaaga

SEQ ID NO: 180155 - RNA, 19 nt, Homo sapiens
cagaaucgaagaucucuag

SEQ ID NO: 180156 - RNA, 19 nt, Homo sapiens
ucacaaggugucuaauuca

SEQ ID NO: 180157 - RNA, 19 nt, Homo sapiens
augccaagccuuuaaguuu

SEQ ID NO: 180158 - RNA, 19 nt, Homo sapiens
aaagggagauguuguucac

SEQ ID NO: 180159 - RNA, 19 nt, Homo sapiens
gaguccugauguucaacua

SEQ ID NO: 180160 - RNA, 19 nt, Homo sapiens
cuucagcucuaaggauauu

SEQ ID NO: 180161 - RNA, 19 nt, Homo sapiens
cuacaagaugggacuguuu

SEQ ID NO: 180162 - RNA, 19 nt, Homo sapiens
ccucauagcacagccuuga

SEQ ID NO: 180163 - RNA, 19 nt, Homo sapiens
ggucccagcuuuugagaga

SEQ ID NO: 180164 - RNA, 19 nt, Homo sapiens
uguggguaaugguugauaa

SEQ ID NO: 180165 - RNA, 19 nt, Homo sapiens
uucacaaggugucuaauuc

SEQ ID NO: 180166 - RNA, 19 nt, Homo sapiens
aacccggacucaacaaaga

SEQ ID NO: 180167 - RNA, 19 nt, Homo sapiens
uaaggucggaguaggcaaa

SEQ ID NO: 180168 - RNA, 19 nt, Homo sapiens
guucacugcugguauacag

SEQ ID NO: 180169 - RNA, 19 nt, Homo sapiens
uaucaaguuucugcaggaa

SEQ ID NO: 180170 - RNA, 19 nt, Homo sapiens
aggcucgacuggagauuga

SEQ ID NO: 180171 - RNA, 19 nt, Homo sapiens
aaagaaaccaagucugaag

SEQ ID NO: 180172 - RNA, 19 nt, Homo sapiens
uccugauguucaacuauua

SEQ ID NO: 180173 - RNA, 19 nt, Homo sapiens
guaaagugucugagcaagu

SEQ ID NO: 180174 - RNA, 19 nt, Homo sapiens
gcaacaaugauaaaacuug

SEQ ID NO: 180175 - RNA, 19 nt, Homo sapiens
acaggaacacuacaagaug

SEQ ID NO: 180176 - RNA, 19 nt, Homo sapiens
guauaaguaaagugucuga

SEQ ID NO: 180177 - RNA, 19 nt, Homo sapiens
auaaaugucgcuaccauca

SEQ ID NO: 180178 - RNA, 19 nt, Homo sapiens
uuaugaaucccuggucuaa

SEQ ID NO: 180179 - RNA, 19 nt, Homo sapiens
agagucaacuggaaaauuc

SEQ ID NO: 180180 - RNA, 19 nt, Homo sapiens
uuaaauguggguaaugguu

SEQ ID NO: 180181 - RNA, 19 nt, Homo sapiens
ccuuuuaccucauguugua

SEQ ID NO: 180182 - RNA, 19 nt, Homo sapiens
guaaaggaagagucaacug

SEQ ID NO: 180183 - RNA, 19 nt, Homo sapiens
ucucuugacuaugaguaaa

SEQ ID NO: 180184 - RNA, 19 nt, Homo sapiens
uaucagaggaugggaugaa

SEQ ID NO: 180185 - RNA, 19 nt, Homo sapiens
guauacaggaacacuacaa

SEQ ID NO: 180186 - RNA, 19 nt, Homo sapiens
aagauaaacccaaagaaac

SEQ ID NO: 180187 - RNA, 19 nt, Homo sapiens
ccucauguuguaaacuuaa

SEQ ID NO: 180188 - RNA, 19 nt, Homo sapiens
cuucacaaggugucuaauu

SEQ ID NO: 180189 - RNA, 19 nt, Homo sapiens
ugaaguggaauuaguggau

SEQ ID NO: 180190 - RNA, 19 nt, Homo sapiens
gaaccagaaugggcuuacg

SEQ ID NO: 180191 - RNA, 19 nt, Homo sapiens
gguucagauucguuucuug

SEQ ID NO: 180192 - RNA, 19 nt, Homo sapiens
gaacagagcaccauaguga

SEQ ID NO: 180193 - RNA, 19 nt, Homo sapiens
gagaagaucugacggaaga

SEQ ID NO: 180194 - RNA, 19 nt, Homo sapiens
gcaauaaaguggaaacaau

SEQ ID NO: 180195 - RNA, 19 nt, Homo sapiens
guacagagaugcccaugau

SEQ ID NO: 180196 - RNA, 19 nt, Homo sapiens
ugucuuggcuggaauauga

SEQ ID NO: 180197 - RNA, 19 nt, Homo sapiens
gggaugaggucugauaaga

SEQ ID NO: 180198 - RNA, 19 nt, Homo sapiens
caaaugcugagcugaaaua

SEQ ID NO: 180199 - RNA, 19 nt, Homo sapiens
gcuauuagauggcacaaag

SEQ ID NO: 180200 - RNA, 19 nt, Homo sapiens
ggagaugaauucagaagag

SEQ ID NO: 180201 - RNA, 19 nt, Homo sapiens
augcugagcugaaauauga

SEQ ID NO: 180202 - RNA, 19 nt, Homo sapiens
gaagcucuaugccaauaug

SEQ ID NO: 180203 - RNA, 19 nt, Homo sapiens
caaggaagguaaauacaag

SEQ ID NO: 180204 - RNA, 19 nt, Homo sapiens
gagcuccgcuuugagauug

SEQ ID NO: 180205 - RNA, 19 nt, Homo sapiens
gaaccuggaucugccuuau

SEQ ID NO: 180206 - RNA, 19 nt, Homo sapiens
uaacaaggcccuagaacug

SEQ ID NO: 180207 - RNA, 19 nt, Homo sapiens
gaauuacaccucaagaguu

SEQ ID NO: 180208 - RNA, 19 nt, Homo sapiens
ggcaccagcucccggauaa

SEQ ID NO: 180209 - RNA, 19 nt, Homo sapiens
gaugaggucugauaagaac

SEQ ID NO: 180210 - RNA, 19 nt, Homo sapiens
ugagugaauuagaccuuua

SEQ ID NO: 180211 - RNA, 19 nt, Homo sapiens
ggccaugugucaucugaaa

SEQ ID NO: 180212 - RNA, 19 nt, Homo sapiens
gaagagaagcuggaacaga

SEQ ID NO: 180213 - RNA, 19 nt, Homo sapiens
gaucgugucuuggcuggaa

SEQ ID NO: 180214 - RNA, 19 nt, Homo sapiens
aauuacaccucaagaguuu

SEQ ID NO: 180215 - RNA, 19 nt, Homo sapiens
gagaugaauucagaagaga

SEQ ID NO: 180216 - RNA, 19 nt, Homo sapiens
ggaagauggcggaaucauu

SEQ ID NO: 180217 - RNA, 19 nt, Homo sapiens
gggcacagguacagagaug

SEQ ID NO: 180218 - RNA, 19 nt, Homo sapiens
guagggaugaggucugaua

SEQ ID NO: 180219 - RNA, 19 nt, Homo sapiens
gcucuaugccaauauguuu

SEQ ID NO: 180220 - RNA, 19 nt, Homo sapiens
aagaagcucuaugccaaua

SEQ ID NO: 180221 - RNA, 19 nt, Homo sapiens
ggccuucucugcugccauu

SEQ ID NO: 180222 - RNA, 19 nt, Homo sapiens
gcugaaauaugaauuacac

SEQ ID NO: 180223 - RNA, 19 nt, Homo sapiens
gagaacauuccaucgugua

SEQ ID NO: 180224 - RNA, 19 nt, Homo sapiens
ccucuucccuuccuccauu

SEQ ID NO: 180225 - RNA, 19 nt, Homo sapiens
gaacuggcacgggcugauu

SEQ ID NO: 180226 - RNA, 19 nt, Homo sapiens
gagcugaaauaugaauuac

SEQ ID NO: 180227 - RNA, 19 nt, Homo sapiens
uauuugagguggaguuguu

SEQ ID NO: 180228 - RNA, 19 nt, Homo sapiens
gcaggcaguccuccaaaga

SEQ ID NO: 180229 - RNA, 19 nt, Homo sapiens
gcuaugccauuucuucucu

SEQ ID NO: 180230 - RNA, 19 nt, Homo sapiens
ggaugaggucugauaagaa

SEQ ID NO: 180231 - RNA, 19 nt, Homo sapiens
guagaagaggcaaguggua

SEQ ID NO: 180232 - RNA, 19 nt, Homo sapiens
gaagaagcucuaugccaau

SEQ ID NO: 180233 - RNA, 19 nt, Homo sapiens
agaggaagauggcggaauc

SEQ ID NO: 180234 - RNA, 19 nt, Homo sapiens
ccacugcuaugccauuucu

SEQ ID NO: 180235 - RNA, 19 nt, Homo sapiens
ggccgugaaugacuuugaa

SEQ ID NO: 180236 - RNA, 19 nt, Homo sapiens
uggaauaugagucuaguuu

SEQ ID NO: 180237 - RNA, 19 nt, Homo sapiens
gagguggaguuguuugagu

SEQ ID NO: 180238 - RNA, 19 nt, Homo sapiens
gaugucuucuggugucaug

SEQ ID NO: 180239 - RNA, 19 nt, Homo sapiens
cuugggagaugaauucaga

SEQ ID NO: 180240 - RNA, 19 nt, Homo sapiens
caaugccacgcuuguauuu

SEQ ID NO: 180241 - RNA, 19 nt, Homo sapiens
gaugacagccgaggagaug

SEQ ID NO: 180242 - RNA, 19 nt, Homo sapiens
acagagaugcccaugauug

SEQ ID NO: 180243 - RNA, 19 nt, Homo sapiens
gggcugauuuccagaaggu

SEQ ID NO: 180244 - RNA, 19 nt, Homo sapiens
ucaaggaagguaaauacaa

SEQ ID NO: 180245 - RNA, 19 nt, Homo sapiens
ugaaggucaucaagagaga

SEQ ID NO: 180246 - RNA, 19 nt, Homo sapiens
uggaguuguuugaguuuaa

SEQ ID NO: 180247 - RNA, 19 nt, Homo sapiens
gaaacuacaggccuucucu

SEQ ID NO: 180248 - RNA, 19 nt, Homo sapiens
gcuaugcuaagcccaauga

SEQ ID NO: 180249 - RNA, 19 nt, Homo sapiens
guggaguuguuugaguuua

SEQ ID NO: 180250 - RNA, 19 nt, Homo sapiens
ccaaugaggaagcacagaa

SEQ ID NO: 180251 - RNA, 19 nt, Homo sapiens
ggacgaaggcgugcugaag

SEQ ID NO: 180252 - RNA, 19 nt, Homo sapiens
aggcaguccuccaaagauu

SEQ ID NO: 180253 - RNA, 19 nt, Homo sapiens
ccacaucaccugcaaacca

SEQ ID NO: 180254 - RNA, 19 nt, Homo sapiens
guccauccauauauauuca

SEQ ID NO: 180255 - RNA, 19 nt, Homo sapiens
ggacagcaacaacgagaag

SEQ ID NO: 180256 - RNA, 19 nt, Homo sapiens
caaugaggaagcacagaaa

SEQ ID NO: 180257 - RNA, 19 nt, Homo sapiens
cagaagagaagcuggaaca

SEQ ID NO: 180258 - RNA, 19 nt, Homo sapiens
ggagcuccgcuuugagauu

SEQ ID NO: 180259 - RNA, 19 nt, Homo sapiens
cuacacuggcuggcuauua

SEQ ID NO: 180260 - RNA, 19 nt, Homo sapiens
agaagguccugcagcucua

SEQ ID NO: 180261 - RNA, 19 nt, Homo sapiens
ugaauuacaccucaagagu

SEQ ID NO: 180262 - RNA, 19 nt, Homo sapiens
ggagaaaggagaacauucc

SEQ ID NO: 180263 - RNA, 19 nt, Homo sapiens
ccaaugccacgcuuguauu

SEQ ID NO: 180264 - RNA, 19 nt, Homo sapiens
uacacuggcuggcuauuag

SEQ ID NO: 180265 - RNA, 19 nt, Homo sapiens
acagagcaccauagugaaa

SEQ ID NO: 180266 - RNA, 19 nt, Homo sapiens
acaaggacaagcucuuuga

SEQ ID NO: 180267 - RNA, 19 nt, Homo sapiens
cuacaaggacaagcucuuu

SEQ ID NO: 180268 - RNA, 19 nt, Homo sapiens
ggaguuguuugaguuuaag

SEQ ID NO: 180269 - RNA, 19 nt, Homo sapiens
augccacgcuuguauuuga

SEQ ID NO: 180270 - RNA, 19 nt, Homo sapiens
cauugcacaugaacauaug

SEQ ID NO: 180271 - RNA, 19 nt, Homo sapiens
gaaagcacaggcccuucga

SEQ ID NO: 180272 - RNA, 19 nt, Homo sapiens
cugguuggaugguggcuuu

SEQ ID NO: 180273 - RNA, 19 nt, Homo sapiens
gcacuguguacuucaagga

SEQ ID NO: 180274 - RNA, 19 nt, Homo sapiens
gaauaugccuacgguucag

SEQ ID NO: 180275 - RNA, 19 nt, Homo sapiens
gaaaaggggaggucaucaa

SEQ ID NO: 180276 - RNA, 19 nt, Homo sapiens
gggagaagaagcucuaugc

SEQ ID NO: 180277 - RNA, 19 nt, Homo sapiens
guaacaaggcccuagaacu

SEQ ID NO: 180278 - RNA, 19 nt, Homo sapiens
ggaagguaaauacaagcaa

SEQ ID NO: 180279 - RNA, 19 nt, Homo sapiens
gcgcauggagaaaggagaa

SEQ ID NO: 180280 - RNA, 19 nt, Homo sapiens
ccauugcacaugaacauau

SEQ ID NO: 180281 - RNA, 19 nt, Homo sapiens
cccuagaacuggacagcaa

SEQ ID NO: 180282 - RNA, 19 nt, Homo sapiens
ggaacagagcaccauagug

SEQ ID NO: 180283 - RNA, 19 nt, Homo sapiens
caccaaaugcugagcugaa

SEQ ID NO: 180284 - RNA, 19 nt, Homo sapiens
uuccaaaucccaccaaaug

SEQ ID NO: 180285 - RNA, 19 nt, Homo sapiens
ggugaaggcuaugcuaagc

SEQ ID NO: 180286 - RNA, 19 nt, Homo sapiens
ugccauuucuucucucugu

SEQ ID NO: 180287 - RNA, 19 nt, Homo sapiens
caugugucaucugaaacua

SEQ ID NO: 180288 - RNA, 19 nt, Homo sapiens
gaugaauucagaagagaag

SEQ ID NO: 180289 - RNA, 19 nt, Homo sapiens
ccgacgguguggcugauga

SEQ ID NO: 180290 - RNA, 19 nt, Homo sapiens
gagugaauuagaccuuuau

SEQ ID NO: 180291 - RNA, 19 nt, Homo sapiens
ugaaggaggagcagaagag

SEQ ID NO: 180292 - RNA, 19 nt, Homo sapiens
gaugagaguuucuggauua

SEQ ID NO: 180293 - RNA, 19 nt, Homo sapiens
gagaaaggcuuguauagga

SEQ ID NO: 180294 - RNA, 19 nt, Homo sapiens
caagaaagcuauuccaaga

SEQ ID NO: 180295 - RNA, 19 nt, Homo sapiens
gaaagcuucugaaucauuu

SEQ ID NO: 180296 - RNA, 19 nt, Homo sapiens
caaaggagaggauuuauuu

SEQ ID NO: 180297 - RNA, 19 nt, Homo sapiens
gaagauaguguccugguua

SEQ ID NO: 180298 - RNA, 19 nt, Homo sapiens
ugacaaagcucuggagaaa

SEQ ID NO: 180299 - RNA, 19 nt, Homo sapiens
gaguggaucuauuuacaua

SEQ ID NO: 180300 - RNA, 19 nt, Homo sapiens
ggagauggauaccaaagaa

SEQ ID NO: 180301 - RNA, 19 nt, Homo sapiens
ggaauaugguuuaucagaa

SEQ ID NO: 180302 - RNA, 19 nt, Homo sapiens
gcauauguauacugguuua

SEQ ID NO: 180303 - RNA, 19 nt, Homo sapiens
guaauucugucauuccuaa

SEQ ID NO: 180304 - RNA, 19 nt, Homo sapiens
gauggaauaugguuuauca

SEQ ID NO: 180305 - RNA, 19 nt, Homo sapiens
ggagugagccagcagcuua

SEQ ID NO: 180306 - RNA, 19 nt, Homo sapiens
agauugagcuccuugauuu

SEQ ID NO: 180307 - RNA, 19 nt, Homo sapiens
ggagagauaugccauuuac

SEQ ID NO: 180308 - RNA, 19 nt, Homo sapiens
gggcaagucuuaaaugugu

SEQ ID NO: 180309 - RNA, 19 nt, Homo sapiens
ggagagggauauucaaauc

SEQ ID NO: 180310 - RNA, 19 nt, Homo sapiens
gaaaggagagggauauuca

SEQ ID NO: 180311 - RNA, 19 nt, Homo sapiens
ccacuugcuugcugacuua

SEQ ID NO: 180312 - RNA, 19 nt, Homo sapiens
gcagauaacaaacaagaaa

SEQ ID NO: 180313 - RNA, 19 nt, Homo sapiens
ugacugaagugcuauaaau

SEQ ID NO: 180314 - RNA, 19 nt, Homo sapiens
uuaaaugacugaagugcua

SEQ ID NO: 180315 - RNA, 19 nt, Homo sapiens
ccaaggaaccauuugcuua

SEQ ID NO: 180316 - RNA, 19 nt, Homo sapiens
caacagaacccacaguaga

SEQ ID NO: 180317 - RNA, 19 nt, Homo sapiens
gcgacagguucucuacuua

SEQ ID NO: 180318 - RNA, 19 nt, Homo sapiens
augcugagcuuauauauga

SEQ ID NO: 180319 - RNA, 19 nt, Homo sapiens
gacaaugacuacugaugaa

SEQ ID NO: 180320 - RNA, 19 nt, Homo sapiens
agaaagugcuggaaguaaa

SEQ ID NO: 180321 - RNA, 19 nt, Homo sapiens
ggacagugccaaugagaaa

SEQ ID NO: 180322 - RNA, 19 nt, Homo sapiens
gaaaagagcaaucagaauu

SEQ ID NO: 180323 - RNA, 19 nt, Homo sapiens
ucgaugaaguucugagaua

SEQ ID NO: 180324 - RNA, 19 nt, Homo sapiens
caccaaagcuguugaaugc

SEQ ID NO: 180325 - RNA, 19 nt, Homo sapiens
gcauauggauugccaaguc

SEQ ID NO: 180326 - RNA, 19 nt, Homo sapiens
gggaucaauuugugaguuu

SEQ ID NO: 180327 - RNA, 19 nt, Homo sapiens
guucugagauacugaaaug

SEQ ID NO: 180328 - RNA, 19 nt, Homo sapiens
gaacagacagucaagcaau

SEQ ID NO: 180329 - RNA, 19 nt, Homo sapiens
caaggaaccauuugcuuaa

SEQ ID NO: 180330 - RNA, 19 nt, Homo sapiens
gagaucauccuaacaaugu

SEQ ID NO: 180331 - RNA, 19 nt, Homo sapiens
gguuagagauggaauaugg

SEQ ID NO: 180332 - RNA, 19 nt, Homo sapiens
gacagguucucuacuuaaa

SEQ ID NO: 180333 - RNA, 19 nt, Homo sapiens
gagaggauuuauuugaaga

SEQ ID NO: 180334 - RNA, 19 nt, Homo sapiens
ccauuugucuuuagucuug

SEQ ID NO: 180335 - RNA, 19 nt, Homo sapiens
gaaguccacagacaucuuu

SEQ ID NO: 180336 - RNA, 19 nt, Homo sapiens
gcagggaagccuaaauuug

SEQ ID NO: 180337 - RNA, 19 nt, Homo sapiens
ggaagauaguguccugguu

SEQ ID NO: 180338 - RNA, 19 nt, Homo sapiens
gaaggccgcugugguggaa

SEQ ID NO: 180339 - RNA, 19 nt, Homo sapiens
ugaacuagggcaagucuua

SEQ ID NO: 180340 - RNA, 19 nt, Homo sapiens
ccaaggaagaggccaauaa

SEQ ID NO: 180341 - RNA, 19 nt, Homo sapiens
ggagaggauuuauuugaag

SEQ ID NO: 180342 - RNA, 19 nt, Homo sapiens
caaggaagaggccaauaaa

SEQ ID NO: 180343 - RNA, 19 nt, Homo sapiens
gagcagggagaggauauua

SEQ ID NO: 180344 - RNA, 19 nt, Homo sapiens
ggauuuauuugaagaugga

SEQ ID NO: 180345 - RNA, 19 nt, Homo sapiens
gccuaaaucuccaguacuu

SEQ ID NO: 180346 - RNA, 19 nt, Homo sapiens
gaaaaggaaucgaaagcuu

SEQ ID NO: 180347 - RNA, 19 nt, Homo sapiens
aaacgaaggagcaacagua

SEQ ID NO: 180348 - RNA, 19 nt, Homo sapiens
gaggaaacgccgaugauug

SEQ ID NO: 180349 - RNA, 19 nt, Homo sapiens
ggccaagauugaaauuuga

SEQ ID NO: 180350 - RNA, 19 nt, Homo sapiens
gcuuaaaccuggaacaucu

SEQ ID NO: 180351 - RNA, 19 nt, Homo sapiens
gaacuagggcaagucuuaa

SEQ ID NO: 180352 - RNA, 19 nt, Homo sapiens
ucuguaguguugacaaaua

SEQ ID NO: 180353 - RNA, 19 nt, Homo sapiens
gauauacgccaacauguuc

SEQ ID NO: 180354 - RNA, 19 nt, Homo sapiens
cgaaggagcaacaguagaa

SEQ ID NO: 180355 - RNA, 19 nt, Homo sapiens
gucagcauaugaggaauua

SEQ ID NO: 180356 - RNA, 19 nt, Homo sapiens
gagugguucugagcaaaua

SEQ ID NO: 180357 - RNA, 19 nt, Homo sapiens
ggaagaggccaauaaagca

SEQ ID NO: 180358 - RNA, 19 nt, Homo sapiens
ggauauacgccaacauguu

SEQ ID NO: 180359 - RNA, 19 nt, Homo sapiens
gaagugcuauaaauguagu

SEQ ID NO: 180360 - RNA, 19 nt, Homo sapiens
caagaacaaugaagaaagc

SEQ ID NO: 180361 - RNA, 19 nt, Homo sapiens
gagaaagugcuggaaguaa

SEQ ID NO: 180362 - RNA, 19 nt, Homo sapiens
caagucagcauaugaggaa

SEQ ID NO: 180363 - RNA, 19 nt, Homo sapiens
ccagugaggccaagauuga

SEQ ID NO: 180364 - RNA, 19 nt, Homo sapiens
cugaagugcuauaaaugua

SEQ ID NO: 180365 - RNA, 19 nt, Homo sapiens
caaagaauccugggagaug

SEQ ID NO: 180366 - RNA, 19 nt, Homo sapiens
cagcauaugaggaauuaaa

SEQ ID NO: 180367 - RNA, 19 nt, Homo sapiens
uacuugagcugaccauuga

SEQ ID NO: 180368 - RNA, 19 nt, Homo sapiens
cuauaaauguagucuguug

SEQ ID NO: 180369 - RNA, 19 nt, Homo sapiens
cuucaugaauuucuccuuu

SEQ ID NO: 180370 - RNA, 19 nt, Homo sapiens
gagauugagcuccuugauu

SEQ ID NO: 180371 - RNA, 19 nt, Homo sapiens
aagcauauguauacugguu

SEQ ID NO: 180372 - RNA, 19 nt, Homo sapiens
gaccuggaguggaucuauu

SEQ ID NO: 180373 - RNA, 19 nt, Homo sapiens
caaaguuuauguccauuac

SEQ ID NO: 180374 - RNA, 19 nt, Homo sapiens
agagauggaauaugguuua

SEQ ID NO: 180375 - RNA, 19 nt, Homo sapiens
gaaccuaaugcugagcuua

SEQ ID NO: 180376 - RNA, 19 nt, Homo sapiens
gaaguuugauuccagucau

SEQ ID NO: 180377 - RNA, 19 nt, Homo sapiens
ccacguguguauuaugguu

SEQ ID NO: 180378 - RNA, 19 nt, Homo sapiens
gcaaugauaaugagcagau

SEQ ID NO: 180379 - RNA, 19 nt, Homo sapiens
gaagaggccaauaaagcaa

SEQ ID NO: 180380 - RNA, 19 nt, Homo sapiens
gaagaaaggagagauaugc

SEQ ID NO: 180381 - RNA, 19 nt, Homo sapiens
ggcgacagguucucuacuu

SEQ ID NO: 180382 - RNA, 19 nt, Homo sapiens
uugcuaaacuguugggaaa

SEQ ID NO: 180383 - RNA, 19 nt, Homo sapiens
aagaaacacucaugggaau

SEQ ID NO: 180384 - RNA, 19 nt, Homo sapiens
guacuugagcugaccauug

SEQ ID NO: 180385 - RNA, 19 nt, Homo sapiens
cgaaagcuucugaaucauu

SEQ ID NO: 180386 - RNA, 19 nt, Homo sapiens
gagauggaauaugguuuau

SEQ ID NO: 180387 - RNA, 19 nt, Homo sapiens
gcaaaccagaauaugcaua

SEQ ID NO: 180388 - RNA, 19 nt, Homo sapiens
ggaacaaaugggaucaauu

SEQ ID NO: 180389 - RNA, 19 nt, Homo sapiens
ccuggaacaucucaccuuu

SEQ ID NO: 180390 - RNA, 19 nt, Homo sapiens
ggaaaauugucaaauggaa

SEQ ID NO: 180391 - RNA, 19 nt, Homo sapiens
acacgcaguugcucgcuuu

SEQ ID NO: 180392 - RNA, 19 nt, Homo sapiens
gcaaauauguaaccugugu

SEQ ID NO: 180393 - RNA, 19 nt, Homo sapiens
ucucuaggguuguuuauua

SEQ ID NO: 180394 - RNA, 19 nt, Homo sapiens
gagaacaaccuaaauuaug

SEQ ID NO: 180395 - RNA, 19 nt, Homo sapiens
ggaccagacuguaagugaa

SEQ ID NO: 180396 - RNA, 19 nt, Homo sapiens
acacacauuugcauuguaa

SEQ ID NO: 180397 - RNA, 19 nt, Homo sapiens
gcauaaauuugagugauug

SEQ ID NO: 180398 - RNA, 19 nt, Homo sapiens
uaaaggugcccaagaaauu

SEQ ID NO: 180399 - RNA, 19 nt, Homo sapiens
gcaaggagggcgagaagaa

SEQ ID NO: 180400 - RNA, 19 nt, Homo sapiens
ucuaagagccgccagauuu

SEQ ID NO: 180401 - RNA, 19 nt, Homo sapiens
ggaaagaggugaaaaugau

SEQ ID NO: 180402 - RNA, 19 nt, Homo sapiens
ugauguauguggucacuaa

SEQ ID NO: 180403 - RNA, 19 nt, Homo sapiens
ggacaugggagauaggaaa

SEQ ID NO: 180404 - RNA, 19 nt, Homo sapiens
uaguaaaggugcccaagaa

SEQ ID NO: 180405 - RNA, 19 nt, Homo sapiens
gguaaaccuugcaaauaug

SEQ ID NO: 180406 - RNA, 19 nt, Homo sapiens
gggacugucugauuauuuc

SEQ ID NO: 180407 - RNA, 19 nt, Homo sapiens
acgcagaccuugagaacaa

SEQ ID NO: 180408 - RNA, 19 nt, Homo sapiens
uuccaugugugcaguauua

SEQ ID NO: 180409 - RNA, 19 nt, Homo sapiens
gaaaaugcgccuugguaua

SEQ ID NO: 180410 - RNA, 19 nt, Homo sapiens
gaauauaagguuuggaagu

SEQ ID NO: 180411 - RNA, 19 nt, Homo sapiens
agaacaaccuaaauuaugg

SEQ ID NO: 180412 - RNA, 19 nt, Homo sapiens
gaagaagaacggcaaguac

SEQ ID NO: 180413 - RNA, 19 nt, Homo sapiens
ggaagucaaauuauaguag

SEQ ID NO: 180414 - RNA, 19 nt, Homo sapiens
guaaaggugcccaagaaau

SEQ ID NO: 180415 - RNA, 19 nt, Homo sapiens
aaaggugcccaagaaauua

SEQ ID NO: 180416 - RNA, 19 nt, Homo sapiens
caugugugcaguauuauaa

SEQ ID NO: 180417 - RNA, 19 nt, Homo sapiens
ugacaagucuaucucuaag

SEQ ID NO: 180418 - RNA, 19 nt, Homo sapiens
uaaccuguguugcgcaaau

SEQ ID NO: 180419 - RNA, 19 nt, Homo sapiens
caguuuguguuguguauau

SEQ ID NO: 180420 - RNA, 19 nt, Homo sapiens
uaacgauugccuucaguuu

SEQ ID NO: 180421 - RNA, 19 nt, Homo sapiens
gacccucuuugccaaguuu

SEQ ID NO: 180422 - RNA, 19 nt, Homo sapiens
gugauacuguggucauaug

SEQ ID NO: 180423 - RNA, 19 nt, Homo sapiens
cgcauaaauuugagugauu

SEQ ID NO: 180424 - RNA, 19 nt, Homo sapiens
ucuaaauagugacugcuuu

SEQ ID NO: 180425 - RNA, 19 nt, Homo sapiens
ccagcagcacuuugaguua

SEQ ID NO: 180426 - RNA, 19 nt, Homo sapiens
cuacaacgcgcucaucaug

SEQ ID NO: 180427 - RNA, 19 nt, Homo sapiens
ugacugcuuugccauuuca

SEQ ID NO: 180428 - RNA, 19 nt, Homo sapiens
aauauaagguuuggaaguc

SEQ ID NO: 180429 - RNA, 19 nt, Homo sapiens
cuaggguuguuuauuauuc

SEQ ID NO: 180430 - RNA, 19 nt, Homo sapiens
cagagcagcacguccauga

SEQ ID NO: 180431 - RNA, 19 nt, Homo sapiens
agaagaagaacggcaagua

SEQ ID NO: 180432 - RNA, 19 nt, Homo sapiens
guacguuuguucagucucu

SEQ ID NO: 180433 - RNA, 19 nt, Homo sapiens
ucaacggcaucuacgaguu

SEQ ID NO: 180434 - RNA, 19 nt, Homo sapiens
gaacggcaaguacgagaag

SEQ ID NO: 180435 - RNA, 19 nt, Homo sapiens
guagugaaauguuaauacc

SEQ ID NO: 180436 - RNA, 19 nt, Homo sapiens
caaagauuggguucuagaa

SEQ ID NO: 180437 - RNA, 19 nt, Homo sapiens
ggacgcagaccuugagaac

SEQ ID NO: 180438 - RNA, 19 nt, Homo sapiens
ccugacaagucuaucucua

SEQ ID NO: 180439 - RNA, 19 nt, Homo sapiens
gggaccagacuguaaguga

SEQ ID NO: 180440 - RNA, 19 nt, Homo sapiens
gccacaaucugucccucaa

SEQ ID NO: 180441 - RNA, 19 nt, Homo sapiens
aaagauuggguucuagaaa

SEQ ID NO: 180442 - RNA, 19 nt, Homo sapiens
auucaaaccugacaagucu

SEQ ID NO: 180443 - RNA, 19 nt, Homo sapiens
cuaacaagguguggagugu

SEQ ID NO: 180444 - RNA, 19 nt, Homo sapiens
uuacacacauuugcauugu

SEQ ID NO: 180445 - RNA, 19 nt, Homo sapiens
gggacaaaauuaacgauug

SEQ ID NO: 180446 - RNA, 19 nt, Homo sapiens
guaguaaaggugcccaaga

SEQ ID NO: 180447 - RNA, 19 nt, Homo sapiens
cacaaucugucccucaaca

SEQ ID NO: 180448 - RNA, 19 nt, Homo sapiens
aagcagggcuggcagaacu

SEQ ID NO: 180449 - RNA, 19 nt, Homo sapiens
ggucauaugcccguguuug

SEQ ID NO: 180450 - RNA, 19 nt, Homo sapiens
acgauugccuucaguuugu

SEQ ID NO: 180451 - RNA, 19 nt, Homo sapiens
gggccagaccaguuacuuu

SEQ ID NO: 180452 - RNA, 19 nt, Homo sapiens
guaaaccuugcaaauaugu

SEQ ID NO: 180453 - RNA, 19 nt, Homo sapiens
gcuuugccauuucauucaa

SEQ ID NO: 180454 - RNA, 19 nt, Homo sapiens
uauaagguuuggaagucaa

SEQ ID NO: 180455 - RNA, 19 nt, Homo sapiens
cagcagcacuuugaguuac

SEQ ID NO: 180456 - RNA, 19 nt, Homo sapiens
gaacuccauccgccacaau

SEQ ID NO: 180457 - RNA, 19 nt, Homo sapiens
gcagcacuuugaguuacaa

SEQ ID NO: 180458 - RNA, 19 nt, Homo sapiens
caacggcaucuacgaguuc

SEQ ID NO: 180459 - RNA, 19 nt, Homo sapiens
cuaaauagugacugcuuug

SEQ ID NO: 180460 - RNA, 19 nt, Homo sapiens
ggucuucuuccaacccuuu

SEQ ID NO: 180461 - RNA, 19 nt, Homo sapiens
gccagcagcacuuugaguu

SEQ ID NO: 180462 - RNA, 19 nt, Homo sapiens
ugagugauuguuaauguug

SEQ ID NO: 180463 - RNA, 19 nt, Homo sapiens
ccgcauaaauuugagugau

SEQ ID NO: 180464 - RNA, 19 nt, Homo sapiens
gucacuaacaggucacuuu

SEQ ID NO: 180465 - RNA, 19 nt, Homo sapiens
cuugagaacaaccuaaauu

SEQ ID NO: 180466 - RNA, 19 nt, Homo sapiens
ccaugugugcaguauuaua

SEQ ID NO: 180467 - RNA, 19 nt, Homo sapiens
ucccauuucuguacguuug

SEQ ID NO: 180468 - RNA, 19 nt, Homo sapiens
caucuacgaguucaucaug

SEQ ID NO: 180469 - RNA, 19 nt, Homo sapiens
gagugauuguuaauguugu

SEQ ID NO: 180470 - RNA, 19 nt, Homo sapiens
aacaagguguggaguguca

SEQ ID NO: 180471 - RNA, 19 nt, Homo sapiens
gcaacaaccacuccuucuc

SEQ ID NO: 180472 - RNA, 19 nt, Homo sapiens
ccaccggccucaccuucau

SEQ ID NO: 180473 - RNA, 19 nt, Homo sapiens
gcaagggcaacuacuggau

SEQ ID NO: 180474 - RNA, 19 nt, Homo sapiens
cauaugcccguguuuguca

SEQ ID NO: 180475 - RNA, 19 nt, Homo sapiens
gagauaggaaagaggugaa

SEQ ID NO: 180476 - RNA, 19 nt, Homo sapiens
aaauauguaaccuguguug

SEQ ID NO: 180477 - RNA, 19 nt, Homo sapiens
ggacaaaauuaacgauugc

SEQ ID NO: 180478 - RNA, 19 nt, Homo sapiens
aagauuggguucuagaaaa

SEQ ID NO: 180479 - RNA, 19 nt, Homo sapiens
cugacaagucuaucucuaa

SEQ ID NO: 180480 - RNA, 19 nt, Homo sapiens
ucaaaccugacaagucuau

SEQ ID NO: 180481 - RNA, 19 nt, Homo sapiens
ucagaaggggacaaaauua

SEQ ID NO: 180482 - RNA, 19 nt, Homo sapiens
uuccaacccuuuaauacau

SEQ ID NO: 180483 - RNA, 19 nt, Homo sapiens
gcgccuugguauacuaagu

SEQ ID NO: 180484 - RNA, 19 nt, Homo sapiens
cuaagagccgccagauuuc

SEQ ID NO: 180485 - RNA, 19 nt, Homo sapiens
agugacugcuuugccauuu

SEQ ID NO: 180486 - RNA, 19 nt, Homo sapiens
gacuguaagugaacguuuu

SEQ ID NO: 180487 - RNA, 19 nt, Homo sapiens
uccaacccuuuaauacauu

SEQ ID NO: 180488 - RNA, 19 nt, Homo sapiens
guggucauaugcccguguu

SEQ ID NO: 180489 - RNA, 19 nt, Homo sapiens
cagaaggggacaaaauuaa

SEQ ID NO: 180490 - RNA, 19 nt, Homo sapiens
gaccuugagaacaaccuaa

SEQ ID NO: 180491 - RNA, 19 nt, Homo sapiens
gagcgacgacguguucauc

SEQ ID NO: 180492 - RNA, 19 nt, Homo sapiens
ggaccagacuguaagugaa

SEQ ID NO: 180493 - RNA, 19 nt, Homo sapiens
acacacauuugcauuguaa

SEQ ID NO: 180494 - RNA, 19 nt, Homo sapiens
gcaaggagggcgagaagaa

SEQ ID NO: 180495 - RNA, 19 nt, Homo sapiens
ggaaagaggugaaaaugau

SEQ ID NO: 180496 - RNA, 19 nt, Homo sapiens
ggacaugggagauaggaaa

SEQ ID NO: 180497 - RNA, 19 nt, Homo sapiens
gggacugucugauuauuuc

SEQ ID NO: 180498 - RNA, 19 nt, Homo sapiens
gaagaagaacggcaaguac

SEQ ID NO: 180499 - RNA, 19 nt, Homo sapiens
gacccucuuugccaaguuu

SEQ ID NO: 180500 - RNA, 19 nt, Homo sapiens
ccagcagcacuuugaguua

SEQ ID NO: 180501 - RNA, 19 nt, Homo sapiens
cuacaacgcgcucaucaug

SEQ ID NO: 180502 - RNA, 19 nt, Homo sapiens
cagagcagcacguccauga

SEQ ID NO: 180503 - RNA, 19 nt, Homo sapiens
agaagaagaacggcaagua

SEQ ID NO: 180504 - RNA, 19 nt, Homo sapiens
ucaacggcaucuacgaguu

SEQ ID NO: 180505 - RNA, 19 nt, Homo sapiens
gaacggcaaguacgagaag

SEQ ID NO: 180506 - RNA, 19 nt, Homo sapiens
gggaccagacuguaaguga

SEQ ID NO: 180507 - RNA, 19 nt, Homo sapiens
gccacaaucugucccucaa

SEQ ID NO: 180508 - RNA, 19 nt, Homo sapiens
uuacacacauuugcauugu

SEQ ID NO: 180509 - RNA, 19 nt, Homo sapiens
cacaaucugucccucaaca

SEQ ID NO: 180510 - RNA, 19 nt, Homo sapiens
aagcagggcuggcagaacu

SEQ ID NO: 180511 - RNA, 19 nt, Homo sapiens
gggccagaccaguuacuuu

SEQ ID NO: 180512 - RNA, 19 nt, Homo sapiens
cagcagcacuuugaguuac

SEQ ID NO: 180513 - RNA, 19 nt, Homo sapiens
gaacuccauccgccacaau

SEQ ID NO: 180514 - RNA, 19 nt, Homo sapiens
gcagcacuuugaguuacaa

SEQ ID NO: 180515 - RNA, 19 nt, Homo sapiens
caacggcaucuacgaguuc

SEQ ID NO: 180516 - RNA, 19 nt, Homo sapiens
ggucuucuuccaacccuuu

SEQ ID NO: 180517 - RNA, 19 nt, Homo sapiens
gccagcagcacuuugaguu

SEQ ID NO: 180518 - RNA, 19 nt, Homo sapiens
caucuacgaguucaucaug

SEQ ID NO: 180519 - RNA, 19 nt, Homo sapiens
ccaccggccucaccuucau

SEQ ID NO: 180520 - RNA, 19 nt, Homo sapiens
gcaagggcaacuacuggau

SEQ ID NO: 180521 - RNA, 19 nt, Homo sapiens
gagauaggaaagaggugaa

SEQ ID NO: 180522 - RNA, 19 nt, Homo sapiens
uuccaacccuuuaauacau

SEQ ID NO: 180523 - RNA, 19 nt, Homo sapiens
gacuguaagugaacguuuu

SEQ ID NO: 180524 - RNA, 19 nt, Homo sapiens
uccaacccuuuaauacauu

SEQ ID NO: 180525 - RNA, 19 nt, Homo sapiens
gagcgacgacguguucauc

SEQ ID NO: 180526 - RNA, 19 nt, Homo sapiens
caugggagauaggaaagag

SEQ ID NO: 180527 - RNA, 19 nt, Homo sapiens
gaacguuuuacacacauuu

SEQ ID NO: 180528 - RNA, 19 nt, Homo sapiens
gcccuacagcuccguguug

SEQ ID NO: 180529 - RNA, 19 nt, Homo sapiens
acagcuccguguugacuca

SEQ ID NO: 180530 - RNA, 19 nt, Homo sapiens
ugaaaaugauccccaaguc

SEQ ID NO: 180531 - RNA, 19 nt, Homo sapiens
ggccagaccaguuacuuuu

SEQ ID NO: 180532 - RNA, 19 nt, Homo sapiens
agaagaacggcaaguacga

SEQ ID NO: 180533 - RNA, 19 nt, Homo sapiens
gcaaggcuccuguuuauuu

SEQ ID NO: 180534 - RNA, 19 nt, Homo sapiens
caaggcuccuguuuauuua

SEQ ID NO: 180535 - RNA, 19 nt, Homo sapiens
uagcaaggcuccuguuuau

SEQ ID NO: 180536 - RNA, 19 nt, Homo sapiens
gaaaggaguuugucuucuc

SEQ ID NO: 180537 - RNA, 19 nt, Homo sapiens
gcgcaagucucccuuuaga

SEQ ID NO: 180538 - RNA, 19 nt, Homo sapiens
caugugagaccaaucauua

SEQ ID NO: 180539 - RNA, 19 nt, Homo sapiens
guacauggccuuuaaaauu

SEQ ID NO: 180540 - RNA, 19 nt, Homo sapiens
gcuucagccucuucuguua

SEQ ID NO: 180541 - RNA, 19 nt, Homo sapiens
gaguuugucuucucuuuca

SEQ ID NO: 180542 - RNA, 19 nt, Homo sapiens
cuacuuucuuucccuaaua

SEQ ID NO: 180543 - RNA, 19 nt, Homo sapiens
gcuccuccguuuaucagua

SEQ ID NO: 180544 - RNA, 19 nt, Homo sapiens
caaagaccgaucuguguaa

SEQ ID NO: 180545 - RNA, 19 nt, Homo sapiens
ggaagccacuguccgucuu

SEQ ID NO: 180546 - RNA, 19 nt, Homo sapiens
caacaugugagaccaauca

SEQ ID NO: 180547 - RNA, 19 nt, Homo sapiens
gcauuugugacacguauuu

SEQ ID NO: 180548 - RNA, 19 nt, Homo sapiens
ugagcgagaucuaccaguu

SEQ ID NO: 180549 - RNA, 19 nt, Homo sapiens
uauuugccguguagaauuu

SEQ ID NO: 180550 - RNA, 19 nt, Homo sapiens
gcagccaucgguaaauaaa

SEQ ID NO: 180551 - RNA, 19 nt, Homo sapiens
gaagaaaagcaacauguga

SEQ ID NO: 180552 - RNA, 19 nt, Homo sapiens
cugcagccaucgguaaaua

SEQ ID NO: 180553 - RNA, 19 nt, Homo sapiens
ggaaaugccaggcgcucaa

SEQ ID NO: 180554 - RNA, 19 nt, Homo sapiens
cagcauuugugacacguau

SEQ ID NO: 180555 - RNA, 19 nt, Homo sapiens
aaagaccgaucuguguaaa

SEQ ID NO: 180556 - RNA, 19 nt, Homo sapiens
acaaagaccgaucugugua

SEQ ID NO: 180557 - RNA, 19 nt, Homo sapiens
guaacuuuguuggcaauau

SEQ ID NO: 180558 - RNA, 19 nt, Homo sapiens
cucccaaccucuacuguaa

SEQ ID NO: 180559 - RNA, 19 nt, Homo sapiens
ugagaccaaucauuaucaa

SEQ ID NO: 180560 - RNA, 19 nt, Homo sapiens
cagcaugugugaccgaaag

SEQ ID NO: 180561 - RNA, 19 nt, Homo sapiens
caaccucuacuguaaacuu

SEQ ID NO: 180562 - RNA, 19 nt, Homo sapiens
gugcgaacaacuugcauuu

SEQ ID NO: 180563 - RNA, 19 nt, Homo sapiens
gaagugacaagagcucaga

SEQ ID NO: 180564 - RNA, 19 nt, Homo sapiens
cgcguaggcuccuccguuu

SEQ ID NO: 180565 - RNA, 19 nt, Homo sapiens
gaaacaaagaccgaucugu

SEQ ID NO: 180566 - RNA, 19 nt, Homo sapiens
gcuuucuucucgagguaua

SEQ ID NO: 180567 - RNA, 19 nt, Homo sapiens
caauauuugccguguagaa

SEQ ID NO: 180568 - RNA, 19 nt, Homo sapiens
gcagccacccgaugucuuc

SEQ ID NO: 180569 - RNA, 19 nt, Homo sapiens
gaagccacuguccgucuuu

SEQ ID NO: 180570 - RNA, 19 nt, Homo sapiens
gccacaaccucucgcucaa

SEQ ID NO: 180571 - RNA, 19 nt, Homo sapiens
caacgagugcuucaucaag

SEQ ID NO: 180572 - RNA, 19 nt, Homo sapiens
ugacugcagccaucgguaa

SEQ ID NO: 180573 - RNA, 19 nt, Homo sapiens
auagcaaggcuccuguuua

SEQ ID NO: 180574 - RNA, 19 nt, Homo sapiens
aaccucuacuguaaacuuu

SEQ ID NO: 180575 - RNA, 19 nt, Homo sapiens
cgaaaggaguuugucuucu

SEQ ID NO: 180576 - RNA, 19 nt, Homo sapiens
gcucaacgagugcuucauc

SEQ ID NO: 180577 - RNA, 19 nt, Homo sapiens
uacauggccuuuaaaauug

SEQ ID NO: 180578 - RNA, 19 nt, Homo sapiens
ccagcgaguucauguucga

SEQ ID NO: 180579 - RNA, 19 nt, Homo sapiens
aggaguuugucuucucuuu

SEQ ID NO: 180580 - RNA, 19 nt, Homo sapiens
gaggauguuuugccuuuug

SEQ ID NO: 180581 - RNA, 19 nt, Homo sapiens
gccacuguccgucuuuaaa

SEQ ID NO: 180582 - RNA, 19 nt, Homo sapiens
augcgcaagucucccuuua

SEQ ID NO: 180583 - RNA, 19 nt, Homo sapiens
gguauaaccgucggcagaa

SEQ ID NO: 180584 - RNA, 19 nt, Homo sapiens
caugaugaacggccacuug

SEQ ID NO: 180585 - RNA, 19 nt, Homo sapiens
gagcgagaucuaccaguuc

SEQ ID NO: 180586 - RNA, 19 nt, Homo sapiens
cguaggcuccuccguuuau

SEQ ID NO: 180587 - RNA, 19 nt, Homo sapiens
aggcuccuguuuauuuauu

SEQ ID NO: 180588 - RNA, 19 nt, Homo sapiens
gagaccaaucauuaucaaa

SEQ ID NO: 180589 - RNA, 19 nt, Homo sapiens
auuuguacauggccuuuaa

SEQ ID NO: 180590 - RNA, 19 nt, Homo sapiens
ucauggccauccagaguuc

SEQ ID NO: 180591 - RNA, 19 nt, Homo sapiens
ccguuuaucaguauuaaug

SEQ ID NO: 180592 - RNA, 19 nt, Homo sapiens
uauagcaaggcuccuguuu

SEQ ID NO: 180593 - RNA, 19 nt, Homo sapiens
ggaguuugucuucucuuuc

SEQ ID NO: 180594 - RNA, 19 nt, Homo sapiens
aaaggaguuugucuucucu

SEQ ID NO: 180595 - RNA, 19 nt, Homo sapiens
ccgaaaggaguuugucuuc

SEQ ID NO: 180596 - RNA, 19 nt, Homo sapiens
gagugcagcauuugugaca

SEQ ID NO: 180597 - RNA, 19 nt, Homo sapiens
ggccagcgaguucauguuc

SEQ ID NO: 180598 - RNA, 19 nt, Homo sapiens
gcguaggcuccuccguuua

SEQ ID NO: 180599 - RNA, 19 nt, Homo sapiens
cagaaagguuaaggcacuu

SEQ ID NO: 180600 - RNA, 19 nt, Homo sapiens
guccgucuuuaaacagaaa

SEQ ID NO: 180601 - RNA, 19 nt, Homo sapiens
aagccacuguccgucuuua

SEQ ID NO: 180602 - RNA, 19 nt, Homo sapiens
gaacgggcucggcuucaac

SEQ ID NO: 180603 - RNA, 19 nt, Homo sapiens
gugagaccaaucauuauca

SEQ ID NO: 180604 - RNA, 19 nt, Homo sapiens
ggugaguauuaaccuuuua

SEQ ID NO: 180605 - RNA, 19 nt, Homo sapiens
gcagucgcccagcaugugu

SEQ ID NO: 180606 - RNA, 19 nt, Homo sapiens
uagagugcagcauuuguga

SEQ ID NO: 180607 - RNA, 19 nt, Homo sapiens
aacaaagaccgaucugugu

SEQ ID NO: 180608 - RNA, 19 nt, Homo sapiens
agccucuucuguuauguuu

SEQ ID NO: 180609 - RNA, 19 nt, Homo sapiens
guauaaccgucggcagaag

SEQ ID NO: 180610 - RNA, 19 nt, Homo sapiens
gaaaugccaggcgcucaag

SEQ ID NO: 180611 - RNA, 19 nt, Homo sapiens
ucaagcccauguacagcau

SEQ ID NO: 180612 - RNA, 19 nt, Homo sapiens
ggucaccuaccaagacauc

SEQ ID NO: 180613 - RNA, 19 nt, Homo sapiens
cgucauggccauccagagu

SEQ ID NO: 180614 - RNA, 19 nt, Homo sapiens
ccucuacuguaaacuuucu

SEQ ID NO: 180615 - RNA, 19 nt, Homo sapiens
gacugcagccaucgguaaa

SEQ ID NO: 180616 - RNA, 19 nt, Homo sapiens
gcuagagugcagcauuugu

SEQ ID NO: 180617 - RNA, 19 nt, Homo sapiens
caguauuaaugguguaacu

SEQ ID NO: 180618 - RNA, 19 nt, Homo sapiens
gcuccuguuuauuuauucu

SEQ ID NO: 180619 - RNA, 19 nt, Homo sapiens
ccucuucuguuauguuuug

SEQ ID NO: 180620 - RNA, 19 nt, Homo sapiens
gaggauauauuugcacuua

SEQ ID NO: 180621 - RNA, 19 nt, Homo sapiens
ucaaugggauuucuucuuu

SEQ ID NO: 180622 - RNA, 19 nt, Homo sapiens
ggauacaggugccaaagaa

SEQ ID NO: 180623 - RNA, 19 nt, Homo sapiens
gacaaccgcuggcaaggua

SEQ ID NO: 180624 - RNA, 19 nt, Homo sapiens
ggauauauuugcacuuaug

SEQ ID NO: 180625 - RNA, 19 nt, Homo sapiens
gaagaugugccaugcguaa

SEQ ID NO: 180626 - RNA, 19 nt, Homo sapiens
caaugugucuaguuuaaga

SEQ ID NO: 180627 - RNA, 19 nt, Homo sapiens
ccacacaccugccacuuag

SEQ ID NO: 180628 - RNA, 19 nt, Homo sapiens
ccaaagaacauuauuaagg

SEQ ID NO: 180629 - RNA, 19 nt, Homo sapiens
gagcgucugucaggauauu

SEQ ID NO: 180630 - RNA, 19 nt, Homo sapiens
gaucuucguugccuucagu

SEQ ID NO: 180631 - RNA, 19 nt, Homo sapiens
uaagaaaacuugugugcuu

SEQ ID NO: 180632 - RNA, 19 nt, Homo sapiens
cguaaggcaucaacgugua

SEQ ID NO: 180633 - RNA, 19 nt, Homo sapiens
ucagcgagaucuaccaguu

SEQ ID NO: 180634 - RNA, 19 nt, Homo sapiens
cagcuagcgggucguauua

SEQ ID NO: 180635 - RNA, 19 nt, Homo sapiens
gugccaaagaacauuauua

SEQ ID NO: 180636 - RNA, 19 nt, Homo sapiens
gccacacaccugccacuua

SEQ ID NO: 180637 - RNA, 19 nt, Homo sapiens
caacuucaaugggauuucu

SEQ ID NO: 180638 - RNA, 19 nt, Homo sapiens
ggccugcacuccagcaugu

SEQ ID NO: 180639 - RNA, 19 nt, Homo sapiens
gaaugccacucgcccuaca

SEQ ID NO: 180640 - RNA, 19 nt, Homo sapiens
ccugcaggcucccacauga

SEQ ID NO: 180641 - RNA, 19 nt, Homo sapiens
gccacaaucucucgcucaa

SEQ ID NO: 180642 - RNA, 19 nt, Homo sapiens
gcacgcggauagcaguaag

SEQ ID NO: 180643 - RNA, 19 nt, Homo sapiens
aaaggaggauauauuugca

SEQ ID NO: 180644 - RNA, 19 nt, Homo sapiens
caaugggauuucuucuuuc

SEQ ID NO: 180645 - RNA, 19 nt, Homo sapiens
agacucaggugggaagaug

SEQ ID NO: 180646 - RNA, 19 nt, Homo sapiens
caacgagugcuucaucaag

SEQ ID NO: 180647 - RNA, 19 nt, Homo sapiens
gacacuacauuuggauaca

SEQ ID NO: 180648 - RNA, 19 nt, Homo sapiens
gugugugugugucuaagaa

SEQ ID NO: 180649 - RNA, 19 nt, Homo sapiens
ggaucgcguuggucacugu

SEQ ID NO: 180650 - RNA, 19 nt, Homo sapiens
acucacacuuugcuuguau

SEQ ID NO: 180651 - RNA, 19 nt, Homo sapiens
gcuaagcacaagauuucaa

SEQ ID NO: 180652 - RNA, 19 nt, Homo sapiens
gcucaacgagugcuucauc

SEQ ID NO: 180653 - RNA, 19 nt, Homo sapiens
gaacucggugcgccacaau

SEQ ID NO: 180654 - RNA, 19 nt, Homo sapiens
ggaagugccaggcgcucaa

SEQ ID NO: 180655 - RNA, 19 nt, Homo sapiens
ccagcgaguucauguucga

SEQ ID NO: 180656 - RNA, 19 nt, Homo sapiens
guuggucacuguuauuugc

SEQ ID NO: 180657 - RNA, 19 nt, Homo sapiens
aaacugggacggauucaag

SEQ ID NO: 180658 - RNA, 19 nt, Homo sapiens
agaaacaaugugucuaguu

SEQ ID NO: 180659 - RNA, 19 nt, Homo sapiens
ucagcuagcgggucguauu

SEQ ID NO: 180660 - RNA, 19 nt, Homo sapiens
gugucuaguuuaagaaagu

SEQ ID NO: 180661 - RNA, 19 nt, Homo sapiens
aagcacaagauuucaagaa

SEQ ID NO: 180662 - RNA, 19 nt, Homo sapiens
gaaacugggacggauucaa

SEQ ID NO: 180663 - RNA, 19 nt, Homo sapiens
guaaggcaucaacguguau

SEQ ID NO: 180664 - RNA, 19 nt, Homo sapiens
ucacacuuugcuuguauuu

SEQ ID NO: 180665 - RNA, 19 nt, Homo sapiens
caggugccaaagaacauua

SEQ ID NO: 180666 - RNA, 19 nt, Homo sapiens
ggacaaccgcuggcaaggu

SEQ ID NO: 180667 - RNA, 19 nt, Homo sapiens
ggccagcgaguucauguuc

SEQ ID NO: 180668 - RNA, 19 nt, Homo sapiens
agagcuacuugcaccagaa

SEQ ID NO: 180669 - RNA, 19 nt, Homo sapiens
aaagugguuuucaguauug

SEQ ID NO: 180670 - RNA, 19 nt, Homo sapiens
gcguuggucacuguuauuu

SEQ ID NO: 180671 - RNA, 19 nt, Homo sapiens
aagauuucguccucaacuu

SEQ ID NO: 180672 - RNA, 19 nt, Homo sapiens
uuaugaccguguauacuca

SEQ ID NO: 180673 - RNA, 19 nt, Homo sapiens
cagacacuacauuuggaua

SEQ ID NO: 180674 - RNA, 19 nt, Homo sapiens
ggcaucaacguguaucugu

SEQ ID NO: 180675 - RNA, 19 nt, Homo sapiens
ucgcguuggucacuguuau

SEQ ID NO: 180676 - RNA, 19 nt, Homo sapiens
gcgucugucaggauauuaa

SEQ ID NO: 180677 - RNA, 19 nt, Homo sapiens
cccagacacuacauuugga

SEQ ID NO: 180678 - RNA, 19 nt, Homo sapiens
aaacuugugugcuuuucaa

SEQ ID NO: 180679 - RNA, 19 nt, Homo sapiens
gggacggauucaagucaca

SEQ ID NO: 180680 - RNA, 19 nt, Homo sapiens
gcgccucgccuuaccucaa

SEQ ID NO: 180681 - RNA, 19 nt, Homo sapiens
uauuaagcccugcgucaug

SEQ ID NO: 180682 - RNA, 19 nt, Homo sapiens
gccaaagaacauuauuaag

SEQ ID NO: 180683 - RNA, 19 nt, Homo sapiens
uagaaacugggacggauuc

SEQ ID NO: 180684 - RNA, 19 nt, Homo sapiens
gauuucguccucaacuuca

SEQ ID NO: 180685 - RNA, 19 nt, Homo sapiens
gaacaacucuccagugaac

SEQ ID NO: 180686 - RNA, 19 nt, Homo sapiens
aauaguagcugucaaaugg

SEQ ID NO: 180687 - RNA, 19 nt, Homo sapiens
ccagugaacgggaauagua

SEQ ID NO: 180688 - RNA, 19 nt, Homo sapiens
acaagaagaucacccugaa

SEQ ID NO: 180689 - RNA, 19 nt, Homo sapiens
gggaauaguagcugucaaa

SEQ ID NO: 180690 - RNA, 19 nt, Homo sapiens
caaauggccuucccuucca

SEQ ID NO: 180691 - RNA, 19 nt, Homo sapiens
gaauaguagcugucaaaug

SEQ ID NO: 180692 - RNA, 19 nt, Homo sapiens
uugaacaacucuccaguga

SEQ ID NO: 180693 - RNA, 19 nt, Homo sapiens
aagcagggcuggcagaaca

SEQ ID NO: 180694 - RNA, 19 nt, Homo sapiens
guccggagcuuucgucuac

SEQ ID NO: 180695 - RNA, 19 nt, Homo sapiens
ccuacaacauguucgagaa

SEQ ID NO: 180696 - RNA, 19 nt, Homo sapiens
gaagaaggacgcggugaag

SEQ ID NO: 180697 - RNA, 19 nt, Homo sapiens
ugaacggcaucuaccaguu

SEQ ID NO: 180698 - RNA, 19 nt, Homo sapiens
gacccggacuccuacaaca

SEQ ID NO: 180699 - RNA, 19 nt, Homo sapiens
gaacagcauccgccacaac

SEQ ID NO: 180700 - RNA, 19 nt, Homo sapiens
gccacaaccucucgcucaa

SEQ ID NO: 180701 - RNA, 19 nt, Homo sapiens
ggaauaguagcugucaaau

SEQ ID NO: 180702 - RNA, 19 nt, Homo sapiens
ucacagaggaucggcuuga

SEQ ID NO: 180703 - RNA, 19 nt, Homo sapiens
ugaaggacaaggaggagaa

SEQ ID NO: 180704 - RNA, 19 nt, Homo sapiens
ggacuccuacaacauguuc

SEQ ID NO: 180705 - RNA, 19 nt, Homo sapiens
gggagauguucgagucaca

SEQ ID NO: 180706 - RNA, 19 nt, Homo sapiens
cagaggaucggcuugaaca

SEQ ID NO: 180707 - RNA, 19 nt, Homo sapiens
agaaggacgcggugaagga

SEQ ID NO: 180708 - RNA, 19 nt, Homo sapiens
cacagaggaucggcuugaa

SEQ ID NO: 180709 - RNA, 19 nt, Homo sapiens
agaagaaggacgcggugaa

SEQ ID NO: 180710 - RNA, 19 nt, Homo sapiens
gcggcgagcagagcuacua

SEQ ID NO: 180711 - RNA, 19 nt, Homo sapiens
gagauguucgagucacaga

SEQ ID NO: 180712 - RNA, 19 nt, Homo sapiens
gcucgucgucccugaguca

SEQ ID NO: 180713 - RNA, 19 nt, Homo sapiens
ggacaggcugcaccucaag

SEQ ID NO: 180714 - RNA, 19 nt, Homo sapiens
cagcguggacaacaucaug

SEQ ID NO: 180715 - RNA, 19 nt, Homo sapiens
caucuaccaguucaucaug

SEQ ID NO: 180716 - RNA, 19 nt, Homo sapiens
ggacaucaagaccgagaac

SEQ ID NO: 180717 - RNA, 19 nt, Homo sapiens
gcaucuaccaguucaucau

SEQ ID NO: 180718 - RNA, 19 nt, Homo sapiens
gaacuuuacugcuaggauu

SEQ ID NO: 180719 - RNA, 19 nt, Homo sapiens
gucgagaacuuuacugcua

SEQ ID NO: 180720 - RNA, 19 nt, Homo sapiens
ggacgaagaagacgaggaa

SEQ ID NO: 180721 - RNA, 19 nt, Homo sapiens
gcuaggauuuccaauuguu

SEQ ID NO: 180722 - RNA, 19 nt, Homo sapiens
ucgccgagcucuguucuua

SEQ ID NO: 180723 - RNA, 19 nt, Homo sapiens
gcgcaggaguuauaaaguc

SEQ ID NO: 180724 - RNA, 19 nt, Homo sapiens
gcaaagccgaccuaugcua

SEQ ID NO: 180725 - RNA, 19 nt, Homo sapiens
gcgggucccucuauuuaug

SEQ ID NO: 180726 - RNA, 19 nt, Homo sapiens
cugcuaggauuuccaauug

SEQ ID NO: 180727 - RNA, 19 nt, Homo sapiens
gccgagcucuguucuuaga

SEQ ID NO: 180728 - RNA, 19 nt, Homo sapiens
uaacagacguguggauuuu

SEQ ID NO: 180729 - RNA, 19 nt, Homo sapiens
guuaacauguuuacacaag

SEQ ID NO: 180730 - RNA, 19 nt, Homo sapiens
gaggcucccuugacguuug

SEQ ID NO: 180731 - RNA, 19 nt, Homo sapiens
gaagaaugccagcgaagca

SEQ ID NO: 180732 - RNA, 19 nt, Homo sapiens
ccaagaacccgcuggugaa

SEQ ID NO: 180733 - RNA, 19 nt, Homo sapiens
ggaguccgccgacauguuc

SEQ ID NO: 180734 - RNA, 19 nt, Homo sapiens
ggagggcgaggacgaagaa

SEQ ID NO: 180735 - RNA, 19 nt, Homo sapiens
gcacuagaggcucccuuga

SEQ ID NO: 180736 - RNA, 19 nt, Homo sapiens
cugcgggucccucuauuua

SEQ ID NO: 180737 - RNA, 19 nt, Homo sapiens
gaaugccagcgaagcaauu

SEQ ID NO: 180738 - RNA, 19 nt, Homo sapiens
gaacagcauccgccacaac

SEQ ID NO: 180739 - RNA, 19 nt, Homo sapiens
ugagcgagaucugugaguu

SEQ ID NO: 180740 - RNA, 19 nt, Homo sapiens
caaccuguguuuuguauca

SEQ ID NO: 180741 - RNA, 19 nt, Homo sapiens
uuagcgcgcucgaggaaga

SEQ ID NO: 180742 - RNA, 19 nt, Homo sapiens
gccacaaccucucgcucaa

SEQ ID NO: 180743 - RNA, 19 nt, Homo sapiens
cgagaucugugaguucauc

SEQ ID NO: 180744 - RNA, 19 nt, Homo sapiens
cauaacagacguguggauu

SEQ ID NO: 180745 - RNA, 19 nt, Homo sapiens
guacuuacugcguauucuu

SEQ ID NO: 180746 - RNA, 19 nt, Homo sapiens
cuaggauuuccaauuguua

SEQ ID NO: 180747 - RNA, 19 nt, Homo sapiens
gagcgagaucugugaguuc

SEQ ID NO: 180748 - RNA, 19 nt, Homo sapiens
auaucgcgcucaucacuau

SEQ ID NO: 180749 - RNA, 19 nt, Homo sapiens
gucccucuauuuaugcaaa

SEQ ID NO: 180750 - RNA, 19 nt, Homo sapiens
gcucugcgggucccucuau

SEQ ID NO: 180751 - RNA, 19 nt, Homo sapiens
cgaggaagaagguaggaau

SEQ ID NO: 180752 - RNA, 19 nt, Homo sapiens
cgaagaagacgaggaagag

SEQ ID NO: 180753 - RNA, 19 nt, Homo sapiens
cuaugacccugagcacuga

SEQ ID NO: 180754 - RNA, 19 nt, Homo sapiens
uagaggcucccuugacguu

SEQ ID NO: 180755 - RNA, 19 nt, Homo sapiens
aggacgagcuggaggaucu

SEQ ID NO: 180756 - RNA, 19 nt, Homo sapiens
gcugcgaauucucggacaa

SEQ ID NO: 180757 - RNA, 19 nt, Homo sapiens
gaggaagaagguaggaauc

SEQ ID NO: 180758 - RNA, 19 nt, Homo sapiens
ggaggaggaggacgacgau

SEQ ID NO: 180759 - RNA, 19 nt, Homo sapiens
ccgccgacauguucgacaa

SEQ ID NO: 180760 - RNA, 19 nt, Homo sapiens
auaacagacguguggauuu

SEQ ID NO: 180761 - RNA, 19 nt, Homo sapiens
ccuacuaccgggagaaguu

SEQ ID NO: 180762 - RNA, 19 nt, Homo sapiens
ugguuaacauguuuacaca

SEQ ID NO: 180763 - RNA, 19 nt, Homo sapiens
guauaucgcgcucaucacu

SEQ ID NO: 180764 - RNA, 19 nt, Homo sapiens
augcaaagccgaccuaugc

SEQ ID NO: 180765 - RNA, 19 nt, Homo sapiens
ggaggaggacgacgaugac

SEQ ID NO: 180766 - RNA, 19 nt, Homo sapiens
uguccagugucgagaacuu

SEQ ID NO: 180767 - RNA, 19 nt, Homo sapiens
gguuaaggcuucuguuuau

SEQ ID NO: 180768 - RNA, 19 nt, Homo sapiens
gaacaaugcaucugacaug

SEQ ID NO: 180769 - RNA, 19 nt, Homo sapiens
ccagaaaccuugagcagau

SEQ ID NO: 180770 - RNA, 19 nt, Homo sapiens
caacuuaccugcagacacu

SEQ ID NO: 180771 - RNA, 19 nt, Homo sapiens
agaugaaccucuacuauga

SEQ ID NO: 180772 - RNA, 19 nt, Homo sapiens
caggagagguggauguuug

SEQ ID NO: 180773 - RNA, 19 nt, Homo sapiens
gagaaacaagguuggauaa

SEQ ID NO: 180774 - RNA, 19 nt, Homo sapiens
gaucugugcucagccaauu

SEQ ID NO: 180775 - RNA, 19 nt, Homo sapiens
gaaacaagguuggauaagc

SEQ ID NO: 180776 - RNA, 19 nt, Homo sapiens
gcucaaggagguuaaguaa

SEQ ID NO: 180777 - RNA, 19 nt, Homo sapiens
gagaugaaccucuacuaug

SEQ ID NO: 180778 - RNA, 19 nt, Homo sapiens
gcaccgaggucuagguaca

SEQ ID NO: 180779 - RNA, 19 nt, Homo sapiens
ccaccaacaugcucagcua

SEQ ID NO: 180780 - RNA, 19 nt, Homo sapiens
guaaauggcagagcuaaga

SEQ ID NO: 180781 - RNA, 19 nt, Homo sapiens
ggaauccacccucuuucua

SEQ ID NO: 180782 - RNA, 19 nt, Homo sapiens
gaagucaccaguggccuua

SEQ ID NO: 180783 - RNA, 19 nt, Homo sapiens
caaggaaggucagugugaa

SEQ ID NO: 180784 - RNA, 19 nt, Homo sapiens
guacguggccgacaacuuc

SEQ ID NO: 180785 - RNA, 19 nt, Homo sapiens
aaucagauguuuccucuag

SEQ ID NO: 180786 - RNA, 19 nt, Homo sapiens
guacuggccacacuuacua

SEQ ID NO: 180787 - RNA, 19 nt, Homo sapiens
gacaagcgccucacucuca

SEQ ID NO: 180788 - RNA, 19 nt, Homo sapiens
ucagccagaucuaccagua

SEQ ID NO: 180789 - RNA, 19 nt, Homo sapiens
ugggaaguguuguuuguuu

SEQ ID NO: 180790 - RNA, 19 nt, Homo sapiens
caccaacuuugcaauagaa

SEQ ID NO: 180791 - RNA, 19 nt, Homo sapiens
ugugugaucucuugggauu

SEQ ID NO: 180792 - RNA, 19 nt, Homo sapiens
gcaaauauagcgaaaucuc

SEQ ID NO: 180793 - RNA, 19 nt, Homo sapiens
guucgacaauggaaauuuc

SEQ ID NO: 180794 - RNA, 19 nt, Homo sapiens
ucaccaacuuugcaauaga

SEQ ID NO: 180795 - RNA, 19 nt, Homo sapiens
uaugugauccucagagauu

SEQ ID NO: 180796 - RNA, 19 nt, Homo sapiens
gcggaacugcccagacaua

SEQ ID NO: 180797 - RNA, 19 nt, Homo sapiens
cagcacugcccaucuguaa

SEQ ID NO: 180798 - RNA, 19 nt, Homo sapiens
uggcaaauauagcgaaauc

SEQ ID NO: 180799 - RNA, 19 nt, Homo sapiens
ccaaggaaggucaguguga

SEQ ID NO: 180800 - RNA, 19 nt, Homo sapiens
gugaguaccugggaagugu

SEQ ID NO: 180801 - RNA, 19 nt, Homo sapiens
cgagaugaaccucuacuau

SEQ ID NO: 180802 - RNA, 19 nt, Homo sapiens
agagaaacaagguuggaua

SEQ ID NO: 180803 - RNA, 19 nt, Homo sapiens
uggccacacuuacuauuga

SEQ ID NO: 180804 - RNA, 19 nt, Homo sapiens
gaacugcccagacauaagc

SEQ ID NO: 180805 - RNA, 19 nt, Homo sapiens
ccacggagccucaggacau

SEQ ID NO: 180806 - RNA, 19 nt, Homo sapiens
gagaaaauguucgacaaug

SEQ ID NO: 180807 - RNA, 19 nt, Homo sapiens
acacauaggcccacacaca

SEQ ID NO: 180808 - RNA, 19 nt, Homo sapiens
gaauccacccucuuucuag

SEQ ID NO: 180809 - RNA, 19 nt, Homo sapiens
agaacucacugaccuucaa

SEQ ID NO: 180810 - RNA, 19 nt, Homo sapiens
acacagacucaccaacuuu

SEQ ID NO: 180811 - RNA, 19 nt, Homo sapiens
gaagagaaaaucagauguu

SEQ ID NO: 180812 - RNA, 19 nt, Homo sapiens
caaauccaggucuauguga

SEQ ID NO: 180813 - RNA, 19 nt, Homo sapiens
gcucaacgacugcuucaag

SEQ ID NO: 180814 - RNA, 19 nt, Homo sapiens
guggauguuugucugagaa

SEQ ID NO: 180815 - RNA, 19 nt, Homo sapiens
gcacugcccaucuguaaaa

SEQ ID NO: 180816 - RNA, 19 nt, Homo sapiens
ccugggaaguguuguuugu

SEQ ID NO: 180817 - RNA, 19 nt, Homo sapiens
ugagaggagugguguguac

SEQ ID NO: 180818 - RNA, 19 nt, Homo sapiens
cacacagacucaccaacuu

SEQ ID NO: 180819 - RNA, 19 nt, Homo sapiens
ugguuaaggcuucuguuua

SEQ ID NO: 180820 - RNA, 19 nt, Homo sapiens
gaaccucuacuaugagaac

SEQ ID NO: 180821 - RNA, 19 nt, Homo sapiens
agagucaaauccaggucua

SEQ ID NO: 180822 - RNA, 19 nt, Homo sapiens
ccauugaacagaugaggaa

SEQ ID NO: 180823 - RNA, 19 nt, Homo sapiens
gggcaccgaggucuaggua

SEQ ID NO: 180824 - RNA, 19 nt, Homo sapiens
ucagauguuuccucuagca

SEQ ID NO: 180825 - RNA, 19 nt, Homo sapiens
gccacaaccugucgcucaa

SEQ ID NO: 180826 - RNA, 19 nt, Homo sapiens
gguggauguuugucugaga

SEQ ID NO: 180827 - RNA, 19 nt, Homo sapiens
aggccaggauggagaauug

SEQ ID NO: 180828 - RNA, 19 nt, Homo sapiens
gagcuaagagucaaaucca

SEQ ID NO: 180829 - RNA, 19 nt, Homo sapiens
ccaauucagcccucacuuc

SEQ ID NO: 180830 - RNA, 19 nt, Homo sapiens
gaaaaggaagagaaaauca

SEQ ID NO: 180831 - RNA, 19 nt, Homo sapiens
ccaaguccuuauucugcuu

SEQ ID NO: 180832 - RNA, 19 nt, Homo sapiens
aguggcaggugcuguacua

SEQ ID NO: 180833 - RNA, 19 nt, Homo sapiens
auggagaauugguugagua

SEQ ID NO: 180834 - RNA, 19 nt, Homo sapiens
gauggagaauugguugagu

SEQ ID NO: 180835 - RNA, 19 nt, Homo sapiens
ucuaugugauccucagaga

SEQ ID NO: 180836 - RNA, 19 nt, Homo sapiens
uggcagagcuaagagucaa

SEQ ID NO: 180837 - RNA, 19 nt, Homo sapiens
gggaaguguuguuuguuuu

SEQ ID NO: 180838 - RNA, 19 nt, Homo sapiens
uauggcaaauauagcgaaa

SEQ ID NO: 180839 - RNA, 19 nt, Homo sapiens
aauccacccucuuucuaga

SEQ ID NO: 180840 - RNA, 19 nt, Homo sapiens
cugcggaacugcccagaca

SEQ ID NO: 180841 - RNA, 19 nt, Homo sapiens
ugugaucucuugggauuuc

SEQ ID NO: 180842 - RNA, 19 nt, Homo sapiens
caaauauagcgaaaucucu

SEQ ID NO: 180843 - RNA, 19 nt, Homo sapiens
cagcuuccuuuccucuaug

SEQ ID NO: 180844 - RNA, 19 nt, Homo sapiens
acagcuuccuuuccucuau

SEQ ID NO: 180845 - RNA, 19 nt, Homo sapiens
ccaggguuauauaaacuag

SEQ ID NO: 180846 - RNA, 19 nt, Homo sapiens
gcagagcagcacuaacagu

SEQ ID NO: 180847 - RNA, 19 nt, Homo sapiens
ggaacugcccagacauaag

SEQ ID NO: 180848 - RNA, 19 nt, Homo sapiens
gaaaauguucgacaaugga

SEQ ID NO: 180849 - RNA, 19 nt, Homo sapiens
caagagaaacaagguugga

SEQ ID NO: 180850 - RNA, 19 nt, Homo sapiens
gcagagcuaagagucaaau

SEQ ID NO: 180851 - RNA, 19 nt, Homo sapiens
caauucagcccucacuucu

SEQ ID NO: 180852 - RNA, 19 nt, Homo sapiens
ucaccaaccucagcaacca

SEQ ID NO: 180853 - RNA, 19 nt, Homo sapiens
cucaacgacugcuucaaga

SEQ ID NO: 180854 - RNA, 19 nt, Homo sapiens
ucacaaaccaccccauuga

SEQ ID NO: 180855 - RNA, 19 nt, Homo sapiens
gcucuguacuggccacacu

SEQ ID NO: 180856 - RNA, 19 nt, Homo sapiens
acucaccaacuuugcaaua

SEQ ID NO: 180857 - RNA, 19 nt, Homo sapiens
ccucuacuaugagaacuuc

SEQ ID NO: 180858 - RNA, 19 nt, Homo sapiens
ucucuccacugccuucugu

SEQ ID NO: 180859 - RNA, 19 nt, Homo sapiens
ucaaauccaggucuaugug

SEQ ID NO: 180860 - RNA, 19 nt, Homo sapiens
gcaggaaaaggaagagaaa

SEQ ID NO: 180861 - RNA, 19 nt, Homo sapiens
gagguggauguuugucuga

SEQ ID NO: 180862 - RNA, 19 nt, Homo sapiens
guuaaggcuucuguuuauc

SEQ ID NO: 180863 - RNA, 19 nt, Homo sapiens
ggacaugccagagagaaaa

SEQ ID NO: 180864 - RNA, 19 nt, Homo sapiens
gcccugagcccagugacaa

SEQ ID NO: 180865 - RNA, 19 nt, Homo sapiens
ucuaugacagccuauguga

SEQ ID NO: 180866 - RNA, 19 nt, Homo sapiens
cuuaacagcuuccuuuccu

SEQ ID NO: 180867 - RNA, 19 nt, Homo sapiens
gguuaaggcuucuguuuau

SEQ ID NO: 180868 - RNA, 19 nt, Homo sapiens
gaacaaugcaucugacaug

SEQ ID NO: 180869 - RNA, 19 nt, Homo sapiens
ccagaaaccuugagcagau

SEQ ID NO: 180870 - RNA, 19 nt, Homo sapiens
caacuuaccugcagacacu

SEQ ID NO: 180871 - RNA, 19 nt, Homo sapiens
agaugaaccucuacuauga

SEQ ID NO: 180872 - RNA, 19 nt, Homo sapiens
caggagagguggauguuug

SEQ ID NO: 180873 - RNA, 19 nt, Homo sapiens
gagaaacaagguuggauaa

SEQ ID NO: 180874 - RNA, 19 nt, Homo sapiens
gaucugugcucagccaauu

SEQ ID NO: 180875 - RNA, 19 nt, Homo sapiens
gaaacaagguuggauaagc

SEQ ID NO: 180876 - RNA, 19 nt, Homo sapiens
gcucaaggagguuaaguaa

SEQ ID NO: 180877 - RNA, 19 nt, Homo sapiens
gagaugaaccucuacuaug

SEQ ID NO: 180878 - RNA, 19 nt, Homo sapiens
gcaccgaggucuagguaca

SEQ ID NO: 180879 - RNA, 19 nt, Homo sapiens
ccaccaacaugcucagcua

SEQ ID NO: 180880 - RNA, 19 nt, Homo sapiens
guaaauggcagagcuaaga

SEQ ID NO: 180881 - RNA, 19 nt, Homo sapiens
ggaauccacccucuuucua

SEQ ID NO: 180882 - RNA, 19 nt, Homo sapiens
gaagucaccaguggccuua

SEQ ID NO: 180883 - RNA, 19 nt, Homo sapiens
caaggaaggucagugugaa

SEQ ID NO: 180884 - RNA, 19 nt, Homo sapiens
guacguggccgacaacuuc

SEQ ID NO: 180885 - RNA, 19 nt, Homo sapiens
guacuggccacacuuacua

SEQ ID NO: 180886 - RNA, 19 nt, Homo sapiens
gacaagcgccucacucuca

SEQ ID NO: 180887 - RNA, 19 nt, Homo sapiens
ucagccagaucuaccagua

SEQ ID NO: 180888 - RNA, 19 nt, Homo sapiens
ugggaaguguuguuuguuu

SEQ ID NO: 180889 - RNA, 19 nt, Homo sapiens
caccaacuuugcaauagaa

SEQ ID NO: 180890 - RNA, 19 nt, Homo sapiens
ugugugaucucuugggauu

SEQ ID NO: 180891 - RNA, 19 nt, Homo sapiens
gcaaauauagcgaaaucuc

SEQ ID NO: 180892 - RNA, 19 nt, Homo sapiens
ucaccaacuuugcaauaga

SEQ ID NO: 180893 - RNA, 19 nt, Homo sapiens
uaugugauccucagagauu

SEQ ID NO: 180894 - RNA, 19 nt, Homo sapiens
gcggaacugcccagacaua

SEQ ID NO: 180895 - RNA, 19 nt, Homo sapiens
cagcacugcccaucuguaa

SEQ ID NO: 180896 - RNA, 19 nt, Homo sapiens
uggcaaauauagcgaaauc

SEQ ID NO: 180897 - RNA, 19 nt, Homo sapiens
ccaaggaaggucaguguga

SEQ ID NO: 180898 - RNA, 19 nt, Homo sapiens
gugaguaccugggaagugu

SEQ ID NO: 180899 - RNA, 19 nt, Homo sapiens
cgagaugaaccucuacuau

SEQ ID NO: 180900 - RNA, 19 nt, Homo sapiens
agagaaacaagguuggaua

SEQ ID NO: 180901 - RNA, 19 nt, Homo sapiens
uggccacacuuacuauuga

SEQ ID NO: 180902 - RNA, 19 nt, Homo sapiens
gaacugcccagacauaagc

SEQ ID NO: 180903 - RNA, 19 nt, Homo sapiens
acacauaggcccacacaca

SEQ ID NO: 180904 - RNA, 19 nt, Homo sapiens
gaauccacccucuuucuag

SEQ ID NO: 180905 - RNA, 19 nt, Homo sapiens
agaacucacugaccuucaa

SEQ ID NO: 180906 - RNA, 19 nt, Homo sapiens
acacagacucaccaacuuu

SEQ ID NO: 180907 - RNA, 19 nt, Homo sapiens
caaauccaggucuauguga

SEQ ID NO: 180908 - RNA, 19 nt, Homo sapiens
gcucaacgacugcuucaag

SEQ ID NO: 180909 - RNA, 19 nt, Homo sapiens
guggauguuugucugagaa

SEQ ID NO: 180910 - RNA, 19 nt, Homo sapiens
gcacugcccaucuguaaaa

SEQ ID NO: 180911 - RNA, 19 nt, Homo sapiens
ccugggaaguguuguuugu

SEQ ID NO: 180912 - RNA, 19 nt, Homo sapiens
ugagaggagugguguguac

SEQ ID NO: 180913 - RNA, 19 nt, Homo sapiens
cacacagacucaccaacuu

SEQ ID NO: 180914 - RNA, 19 nt, Homo sapiens
ugguuaaggcuucuguuua

SEQ ID NO: 180915 - RNA, 19 nt, Homo sapiens
gaaccucuacuaugagaac

SEQ ID NO: 180916 - RNA, 19 nt, Homo sapiens
agagucaaauccaggucua

SEQ ID NO: 180917 - RNA, 19 nt, Homo sapiens
ccauugaacagaugaggaa

SEQ ID NO: 180918 - RNA, 19 nt, Homo sapiens
gggcaccgaggucuaggua

SEQ ID NO: 180919 - RNA, 19 nt, Homo sapiens
gccacaaccugucgcucaa

SEQ ID NO: 180920 - RNA, 19 nt, Homo sapiens
gguggauguuugucugaga

SEQ ID NO: 180921 - RNA, 19 nt, Homo sapiens
aggccaggauggagaauug

SEQ ID NO: 180922 - RNA, 19 nt, Homo sapiens
gagcuaagagucaaaucca

SEQ ID NO: 180923 - RNA, 19 nt, Homo sapiens
ccaauucagcccucacuuc

SEQ ID NO: 180924 - RNA, 19 nt, Homo sapiens
ccaaguccuuauucugcuu

SEQ ID NO: 180925 - RNA, 19 nt, Homo sapiens
aguggcaggugcuguacua

SEQ ID NO: 180926 - RNA, 19 nt, Homo sapiens
auggagaauugguugagua

SEQ ID NO: 180927 - RNA, 19 nt, Homo sapiens
gauggagaauugguugagu

SEQ ID NO: 180928 - RNA, 19 nt, Homo sapiens
ucuaugugauccucagaga

SEQ ID NO: 180929 - RNA, 19 nt, Homo sapiens
uggcagagcuaagagucaa

SEQ ID NO: 180930 - RNA, 19 nt, Homo sapiens
gggaaguguuguuuguuuu

SEQ ID NO: 180931 - RNA, 19 nt, Homo sapiens
uauggcaaauauagcgaaa

SEQ ID NO: 180932 - RNA, 19 nt, Homo sapiens
aauccacccucuuucuaga

SEQ ID NO: 180933 - RNA, 19 nt, Homo sapiens
cugcggaacugcccagaca

SEQ ID NO: 180934 - RNA, 19 nt, Homo sapiens
ugugaucucuugggauuuc

SEQ ID NO: 180935 - RNA, 19 nt, Homo sapiens
caaauauagcgaaaucucu

SEQ ID NO: 180936 - RNA, 19 nt, Homo sapiens
ccaggguuauauaaacuag

SEQ ID NO: 180937 - RNA, 19 nt, Homo sapiens
gcagagcagcacuaacagu

SEQ ID NO: 180938 - RNA, 19 nt, Homo sapiens
ggaacugcccagacauaag

SEQ ID NO: 180939 - RNA, 19 nt, Homo sapiens
caagagaaacaagguugga

SEQ ID NO: 180940 - RNA, 19 nt, Homo sapiens
gcagagcuaagagucaaau

SEQ ID NO: 180941 - RNA, 19 nt, Homo sapiens
caauucagcccucacuucu

SEQ ID NO: 180942 - RNA, 19 nt, Homo sapiens
ucaccaaccucagcaacca

SEQ ID NO: 180943 - RNA, 19 nt, Homo sapiens
cucaacgacugcuucaaga

SEQ ID NO: 180944 - RNA, 19 nt, Homo sapiens
ucacaaaccaccccauuga

SEQ ID NO: 180945 - RNA, 19 nt, Homo sapiens
gcucuguacuggccacacu

SEQ ID NO: 180946 - RNA, 19 nt, Homo sapiens
acucaccaacuuugcaaua

SEQ ID NO: 180947 - RNA, 19 nt, Homo sapiens
ccucuacuaugagaacuuc

SEQ ID NO: 180948 - RNA, 19 nt, Homo sapiens
ucucuccacugccuucugu

SEQ ID NO: 180949 - RNA, 19 nt, Homo sapiens
ucaaauccaggucuaugug

SEQ ID NO: 180950 - RNA, 19 nt, Homo sapiens
gagguggauguuugucuga

SEQ ID NO: 180951 - RNA, 19 nt, Homo sapiens
gcccugagcccagugacaa

SEQ ID NO: 180952 - RNA, 19 nt, Homo sapiens
guuaaggcuucuguuuauc

SEQ ID NO: 180953 - RNA, 19 nt, Homo sapiens
ggacaugccagagagaaaa

SEQ ID NO: 180954 - RNA, 19 nt, Homo sapiens
cagaaaccuugagcagauc

SEQ ID NO: 180955 - RNA, 19 nt, Homo sapiens
ccauggagagacagcauug

SEQ ID NO: 180956 - RNA, 19 nt, Homo sapiens
uuaaggcuucuguuuauca

SEQ ID NO: 180957 - RNA, 19 nt, Homo sapiens
guccaugacugcggaacug

SEQ ID NO: 180958 - RNA, 19 nt, Homo sapiens
gcucagcuacggaggaucu

SEQ ID NO: 180959 - RNA, 19 nt, Homo sapiens
ucaacgacugcuucaagaa

SEQ ID NO: 180960 - RNA, 19 nt, Homo sapiens
acauuuccaggguuauaua

SEQ ID NO: 180961 - RNA, 19 nt, Homo sapiens
ggcucaaggagguuaagua

SEQ ID NO: 180962 - RNA, 19 nt, Homo sapiens
auucagcccucacuucuac

SEQ ID NO: 180963 - RNA, 19 nt, Homo sapiens
cuugggauuucuccuuguu

SEQ ID NO: 180964 - RNA, 19 nt, Homo sapiens
acacacagacucaccaacu

SEQ ID NO: 180965 - RNA, 19 nt, Homo sapiens
cggaacugcccagacauaa

SEQ ID NO: 180966 - RNA, 19 nt, Homo sapiens
uuggauaagcgcuuccuuu

SEQ ID NO: 180967 - RNA, 19 nt, Homo sapiens
uccaagagcuucagcauag

SEQ ID NO: 180968 - RNA, 19 nt, Homo sapiens
uuucaacgcuucccugaug

SEQ ID NO: 180969 - RNA, 19 nt, Homo sapiens
ccgaagagcuccgacaagu

SEQ ID NO: 180970 - RNA, 19 nt, Homo sapiens
ucaacggcaucuaccaguu

SEQ ID NO: 180971 - RNA, 19 nt, Homo sapiens
gccuggacauguuugagaa

SEQ ID NO: 180972 - RNA, 19 nt, Homo sapiens
gaacagcauccgccacaac

SEQ ID NO: 180973 - RNA, 19 nt, Homo sapiens
gccacaaccucucgcucaa

SEQ ID NO: 180974 - RNA, 19 nt, Homo sapiens
ccaagagcuucagcauaga

SEQ ID NO: 180975 - RNA, 19 nt, Homo sapiens
ucccgcagcucuccgaaga

SEQ ID NO: 180976 - RNA, 19 nt, Homo sapiens
caacggcaucuaccaguuc

SEQ ID NO: 180977 - RNA, 19 nt, Homo sapiens
guccaagagcuucagcaua

SEQ ID NO: 180978 - RNA, 19 nt, Homo sapiens
ucuguacggucccgagaga

SEQ ID NO: 180979 - RNA, 19 nt, Homo sapiens
cgcccaugcuguaucugua

SEQ ID NO: 180980 - RNA, 19 nt, Homo sapiens
agaagccucccuacagcua

SEQ ID NO: 180981 - RNA, 19 nt, Homo sapiens
caucuaccaguucaucaug

SEQ ID NO: 180982 - RNA, 19 nt, Homo sapiens
gcaucuaccaguucaucau

SEQ ID NO: 180983 - RNA, 19 nt, Homo sapiens
cgacacgguacuccacuuc

SEQ ID NO: 180984 - RNA, 19 nt, Homo sapiens
guucaugacuuacuugcua

SEQ ID NO: 180985 - RNA, 19 nt, Homo sapiens
ggacacuucuuggagauuu

SEQ ID NO: 180986 - RNA, 19 nt, Homo sapiens
ggacuuauuggguuauuau

SEQ ID NO: 180987 - RNA, 19 nt, Homo sapiens
gaacagcauccgccacaau

SEQ ID NO: 180988 - RNA, 19 nt, Homo sapiens
gggaguuggugggccuuua

SEQ ID NO: 180989 - RNA, 19 nt, Homo sapiens
acaccuggcugccuucuuc

SEQ ID NO: 180990 - RNA, 19 nt, Homo sapiens
ucaaccuucucucauguuu

SEQ ID NO: 180991 - RNA, 19 nt, Homo sapiens
ccgcagacauguucgacaa

SEQ ID NO: 180992 - RNA, 19 nt, Homo sapiens
caucaaccuucucucaugu

SEQ ID NO: 180993 - RNA, 19 nt, Homo sapiens
ucaucaaccuucucucaug

SEQ ID NO: 180994 - RNA, 19 nt, Homo sapiens
gcaaguggcagaacagcau

SEQ ID NO: 180995 - RNA, 19 nt, Homo sapiens
cuuaggacuuauuggguua

SEQ ID NO: 180996 - RNA, 19 nt, Homo sapiens
gaggacacuucuuggagau

SEQ ID NO: 180997 - RNA, 19 nt, Homo sapiens
cuccuggguucaugacuua

SEQ ID NO: 180998 - RNA, 19 nt, Homo sapiens
gccagccucucauuucuuc

SEQ ID NO: 180999 - RNA, 19 nt, Homo sapiens
gccacaaucucacgcucaa

SEQ ID NO: 181000 - RNA, 19 nt, Homo sapiens
gggcugggagaggaaauua

SEQ ID NO: 181001 - RNA, 19 nt, Homo sapiens
gcugggagaggaaauuaga

SEQ ID NO: 181002 - RNA, 19 nt, Homo sapiens
ggaggaggguaccgugaac

SEQ ID NO: 181003 - RNA, 19 nt, Homo sapiens
gcccugaggacacuucuug

SEQ ID NO: 181004 - RNA, 19 nt, Homo sapiens
cuggaaaacuuaggacuua

SEQ ID NO: 181005 - RNA, 19 nt, Homo sapiens
cuucaucaccgaacgcuuu

SEQ ID NO: 181006 - RNA, 19 nt, Homo sapiens
gaaaacuuaggacuuauug

SEQ ID NO: 181007 - RNA, 19 nt, Homo sapiens
gacucaaacuccugcuaca

SEQ ID NO: 181008 - RNA, 19 nt, Homo sapiens
ccgaacgcuuugccuucua

SEQ ID NO: 181009 - RNA, 19 nt, Homo sapiens
ggaaaacuuaggacuuauu

SEQ ID NO: 181010 - RNA, 19 nt, Homo sapiens
ggaguuggugggccuuuag

SEQ ID NO: 181011 - RNA, 19 nt, Homo sapiens
uugcuagcgucccuucauu

SEQ ID NO: 181012 - RNA, 19 nt, Homo sapiens
caccgacuguacuucauca

SEQ ID NO: 181013 - RNA, 19 nt, Homo sapiens
gcuggagcgcuaccuguga

SEQ ID NO: 181014 - RNA, 19 nt, Homo sapiens
ggaggguaccgugaacaga

SEQ ID NO: 181015 - RNA, 19 nt, Homo sapiens
gaccugccagccucucauu

SEQ ID NO: 181016 - RNA, 19 nt, Homo sapiens
cgaacgcuuugccuucuac

SEQ ID NO: 181017 - RNA, 19 nt, Homo sapiens
gaaccugcagccggagcua

SEQ ID NO: 181018 - RNA, 19 nt, Homo sapiens
gacacuucuuggagauuuc

SEQ ID NO: 181019 - RNA, 19 nt, Homo sapiens
caccuccacuuaccugucu

SEQ ID NO: 181020 - RNA, 19 nt, Homo sapiens
gaaagggaggggcgaaaug

SEQ ID NO: 181021 - RNA, 19 nt, Homo sapiens
ucagacuccuggguucaug

SEQ ID NO: 181022 - RNA, 19 nt, Homo sapiens
ccgcgcaaguggcagaaca

SEQ ID NO: 181023 - RNA, 19 nt, Homo sapiens
gaacaagugcuucaucaaa

SEQ ID NO: 181024 - RNA, 19 nt, Homo sapiens
gagagcagcuggaaguuug

SEQ ID NO: 181025 - RNA, 19 nt, Homo sapiens
ggacguaaaucccuaaucu

SEQ ID NO: 181026 - RNA, 19 nt, Homo sapiens
cuaauuagaugacagcaaa

SEQ ID NO: 181027 - RNA, 19 nt, Homo sapiens
caacacagguccacagaca

SEQ ID NO: 181028 - RNA, 19 nt, Homo sapiens
ggacagacagacuaaugua

SEQ ID NO: 181029 - RNA, 19 nt, Homo sapiens
gaucccaccuggcagaauu

SEQ ID NO: 181030 - RNA, 19 nt, Homo sapiens
gaacuacugggaccaagaa

SEQ ID NO: 181031 - RNA, 19 nt, Homo sapiens
aaaggacccugcaccauga

SEQ ID NO: 181032 - RNA, 19 nt, Homo sapiens
ggacaacuucugcuacuuc

SEQ ID NO: 181033 - RNA, 19 nt, Homo sapiens
gagcagggcagaagaugga

SEQ ID NO: 181034 - RNA, 19 nt, Homo sapiens
ccagaaaccggcuaaagga

SEQ ID NO: 181035 - RNA, 19 nt, Homo sapiens
gcagagagaggagaccaaa

SEQ ID NO: 181036 - RNA, 19 nt, Homo sapiens
ccacauccacccagccuuu

SEQ ID NO: 181037 - RNA, 19 nt, Homo sapiens
acaaguggaucacggacaa

SEQ ID NO: 181038 - RNA, 19 nt, Homo sapiens
caaagugccucgggagaag

SEQ ID NO: 181039 - RNA, 19 nt, Homo sapiens
gccacaaccugucucugaa

SEQ ID NO: 181040 - RNA, 19 nt, Homo sapiens
gggcaggacagacagacua

SEQ ID NO: 181041 - RNA, 19 nt, Homo sapiens
gcaggcaccacauacuuau

SEQ ID NO: 181042 - RNA, 19 nt, Homo sapiens
caaccugucucugaacaag

SEQ ID NO: 181043 - RNA, 19 nt, Homo sapiens
ggagcagggugagcuggaa

SEQ ID NO: 181044 - RNA, 19 nt, Homo sapiens
acguaaaucccuaaucuuu

SEQ ID NO: 181045 - RNA, 19 nt, Homo sapiens
ugaagccucccuacucgua

SEQ ID NO: 181046 - RNA, 19 nt, Homo sapiens
uguagugaguguagcugua

SEQ ID NO: 181047 - RNA, 19 nt, Homo sapiens
ccagguacaacaaaugcua

SEQ ID NO: 181048 - RNA, 19 nt, Homo sapiens
gagggcaggcugggacaua

SEQ ID NO: 181049 - RNA, 19 nt, Homo sapiens
acaagugcuucaucaaagu

SEQ ID NO: 181050 - RNA, 19 nt, Homo sapiens
ccaccaauccgcacgugaa

SEQ ID NO: 181051 - RNA, 19 nt, Homo sapiens
aacaagugcuucaucaaag

SEQ ID NO: 181052 - RNA, 19 nt, Homo sapiens
ucacggacaacuucugcua

SEQ ID NO: 181053 - RNA, 19 nt, Homo sapiens
ccaccuggcagaauucaau

SEQ ID NO: 181054 - RNA, 19 nt, Homo sapiens
ggaacuacugggaccaaga

SEQ ID NO: 181055 - RNA, 19 nt, Homo sapiens
caggacagacagacuaaug

SEQ ID NO: 181056 - RNA, 19 nt, Homo sapiens
cagcaaggccaccaagauc

SEQ ID NO: 181057 - RNA, 19 nt, Homo sapiens
cgcaggcaccacauacuua

SEQ ID NO: 181058 - RNA, 19 nt, Homo sapiens
ucaaagugccucgggagaa

SEQ ID NO: 181059 - RNA, 19 nt, Homo sapiens
cgccacaaccugucucuga

SEQ ID NO: 181060 - RNA, 19 nt, Homo sapiens
ugagagcagcuggaaguuu

SEQ ID NO: 181061 - RNA, 19 nt, Homo sapiens
ccagcaaggccaccaagau

SEQ ID NO: 181062 - RNA, 19 nt, Homo sapiens
gcuggaaguuuggguuugg

SEQ ID NO: 181063 - RNA, 19 nt, Homo sapiens
ugucggccaucuacaagug

SEQ ID NO: 181064 - RNA, 19 nt, Homo sapiens
ggcaggacagacagacuaa

SEQ ID NO: 181065 - RNA, 19 nt, Homo sapiens
cagcuggaaguuuggguuu

SEQ ID NO: 181066 - RNA, 19 nt, Homo sapiens
cacaaccugucucugaaca

SEQ ID NO: 181067 - RNA, 19 nt, Homo sapiens
agaauucaauccgccacaa

SEQ ID NO: 181068 - RNA, 19 nt, Homo sapiens
gaagccucccuacucguau

SEQ ID NO: 181069 - RNA, 19 nt, Homo sapiens
cagcugccaucagauucaa

SEQ ID NO: 181070 - RNA, 19 nt, Homo sapiens
ugacugggaggccaucuuc

SEQ ID NO: 181071 - RNA, 19 nt, Homo sapiens
ugggagggaugccgagcuu

SEQ ID NO: 181072 - RNA, 19 nt, Homo sapiens
gacagacagacuaauguag

SEQ ID NO: 181073 - RNA, 19 nt, Homo sapiens
gacguaaaucccuaaucuu

SEQ ID NO: 181074 - RNA, 19 nt, Homo sapiens
guggaucacggacaacuuc

SEQ ID NO: 181075 - RNA, 19 nt, Homo sapiens
cagguacaacaaaugcuaa

SEQ ID NO: 181076 - RNA, 19 nt, Homo sapiens
gguacaacaaaugcuaauu

SEQ ID NO: 181077 - RNA, 19 nt, Homo sapiens
gcuaauuagaugacagcaa

SEQ ID NO: 181078 - RNA, 19 nt, Homo sapiens
caaaugcuaauuagaugac

SEQ ID NO: 181079 - RNA, 19 nt, Homo sapiens
cagagagaguccccaggua

SEQ ID NO: 181080 - RNA, 19 nt, Homo sapiens
agggcaggcugggacauaa

SEQ ID NO: 181081 - RNA, 19 nt, Homo sapiens
caagugcuucaucaaagug

SEQ ID NO: 181082 - RNA, 19 nt, Homo sapiens
agaagaagaucaccuugaa

SEQ ID NO: 181083 - RNA, 19 nt, Homo sapiens
agaagaagguggugaucaa

SEQ ID NO: 181084 - RNA, 19 nt, Homo sapiens
ccaaggaggccgagaagaa

SEQ ID NO: 181085 - RNA, 19 nt, Homo sapiens
gagaagaagaucaccuuga

SEQ ID NO: 181086 - RNA, 19 nt, Homo sapiens
aagcagggcuggcagaaca

SEQ ID NO: 181087 - RNA, 19 nt, Homo sapiens
ugagcgagcagaauuacua

SEQ ID NO: 181088 - RNA, 19 nt, Homo sapiens
ccuacaacauguucgagaa

SEQ ID NO: 181089 - RNA, 19 nt, Homo sapiens
ugaacggcaucuaccaguu

SEQ ID NO: 181090 - RNA, 19 nt, Homo sapiens
cgacugcacgaaauacuga

SEQ ID NO: 181091 - RNA, 19 nt, Homo sapiens
gacccggacuccuacaaca

SEQ ID NO: 181092 - RNA, 19 nt, Homo sapiens
gagaagaagguggugauca

SEQ ID NO: 181093 - RNA, 19 nt, Homo sapiens
gaacagcauccgccacaac

SEQ ID NO: 181094 - RNA, 19 nt, Homo sapiens
gccacaaccucucgcucaa

SEQ ID NO: 181095 - RNA, 19 nt, Homo sapiens
ggacuccuacaacauguuc

SEQ ID NO: 181096 - RNA, 19 nt, Homo sapiens
agaagguggugaucaagag

SEQ ID NO: 181097 - RNA, 19 nt, Homo sapiens
gaagaagguggugaucaag

SEQ ID NO: 181098 - RNA, 19 nt, Homo sapiens
uaccugagcgagcagaauu

SEQ ID NO: 181099 - RNA, 19 nt, Homo sapiens
cggcccagcagcaaacuuu

SEQ ID NO: 181100 - RNA, 19 nt, Homo sapiens
caaggaggccgagaagaag

SEQ ID NO: 181101 - RNA, 19 nt, Homo sapiens
gaagaagaucaccuugaac

SEQ ID NO: 181102 - RNA, 19 nt, Homo sapiens
ccuacgacugcacgaaaua

SEQ ID NO: 181103 - RNA, 19 nt, Homo sapiens
caucuaccaguucaucaug

SEQ ID NO: 181104 - RNA, 19 nt, Homo sapiens
ccgagaagaagaucaccuu

SEQ ID NO: 181105 - RNA, 19 nt, Homo sapiens
gcaucuaccaguucaucau

SEQ ID NO: 181106 - RNA, 19 nt, Homo sapiens
ccaacgugcgggagauguu

SEQ ID NO: 181107 - RNA, 19 nt, Homo sapiens
gaaguacauucguucauuu

SEQ ID NO: 181108 - RNA, 19 nt, Homo sapiens
gcacuauccuguucacgaa

SEQ ID NO: 181109 - RNA, 19 nt, Homo sapiens
cagauaaacuggaguguuc

SEQ ID NO: 181110 - RNA, 19 nt, Homo sapiens
ggacugcacuauccuguuc

SEQ ID NO: 181111 - RNA, 19 nt, Homo sapiens
gcucggaccucuccaccua

SEQ ID NO: 181112 - RNA, 19 nt, Homo sapiens
ccagugcucuccauuagaa

SEQ ID NO: 181113 - RNA, 19 nt, Homo sapiens
ggacaaauuugcaaaagaa

SEQ ID NO: 181114 - RNA, 19 nt, Homo sapiens
gaagacaugugaacuuggu

SEQ ID NO: 181115 - RNA, 19 nt, Homo sapiens
auucacagcuuucagauaa

SEQ ID NO: 181116 - RNA, 19 nt, Homo sapiens
agaaaucucugcucugguu

SEQ ID NO: 181117 - RNA, 19 nt, Homo sapiens
ggcagcgccuuucuucuua

SEQ ID NO: 181118 - RNA, 19 nt, Homo sapiens
ucuaguagccacauuaaua

SEQ ID NO: 181119 - RNA, 19 nt, Homo sapiens
gcaagccacauauguaauu

SEQ ID NO: 181120 - RNA, 19 nt, Homo sapiens
cagauggacuguuuuaaua

SEQ ID NO: 181121 - RNA, 19 nt, Homo sapiens
aggcagcaauuauaucaua

SEQ ID NO: 181122 - RNA, 19 nt, Homo sapiens
ucugagaacuugagaccua

SEQ ID NO: 181123 - RNA, 19 nt, Homo sapiens
guucauuuguccacuguuu

SEQ ID NO: 181124 - RNA, 19 nt, Homo sapiens
ggccaagcgucuaaccuaa

SEQ ID NO: 181125 - RNA, 19 nt, Homo sapiens
aaacuggaguguucagaug

SEQ ID NO: 181126 - RNA, 19 nt, Homo sapiens
agaaguacauucguucauu

SEQ ID NO: 181127 - RNA, 19 nt, Homo sapiens
aaacucagccucuuucugu

SEQ ID NO: 181128 - RNA, 19 nt, Homo sapiens
aaagugaggaggacaaauu

SEQ ID NO: 181129 - RNA, 19 nt, Homo sapiens
gcuccaggcagcaauuaua

SEQ ID NO: 181130 - RNA, 19 nt, Homo sapiens
gaugcugcccugcguauuu

SEQ ID NO: 181131 - RNA, 19 nt, Homo sapiens
gcagcgccuuucuucuuaa

SEQ ID NO: 181132 - RNA, 19 nt, Homo sapiens
caagccacauauguaauuu

SEQ ID NO: 181133 - RNA, 19 nt, Homo sapiens
gugcaagccacauauguaa

SEQ ID NO: 181134 - RNA, 19 nt, Homo sapiens
cuaguagccacauuaauaa

SEQ ID NO: 181135 - RNA, 19 nt, Homo sapiens
aaaccagugcucuccauua

SEQ ID NO: 181136 - RNA, 19 nt, Homo sapiens
guguucagauggacuguuu

SEQ ID NO: 181137 - RNA, 19 nt, Homo sapiens
uuaaggagaugagaggauu

SEQ ID NO: 181138 - RNA, 19 nt, Homo sapiens
agagagaaguacauucguu

SEQ ID NO: 181139 - RNA, 19 nt, Homo sapiens
guacauucguucauuuguc

SEQ ID NO: 181140 - RNA, 19 nt, Homo sapiens
gguaauuucauggcuguua

SEQ ID NO: 181141 - RNA, 19 nt, Homo sapiens
guagccacauuaauaaagu

SEQ ID NO: 181142 - RNA, 19 nt, Homo sapiens
uuaaguagcaggcucacua

SEQ ID NO: 181143 - RNA, 19 nt, Homo sapiens
agaccuagcuccgaguuga

SEQ ID NO: 181144 - RNA, 19 nt, Homo sapiens
ccagagaccaggauccaaa

SEQ ID NO: 181145 - RNA, 19 nt, Homo sapiens
ggaggguccuuggcgguaa

SEQ ID NO: 181146 - RNA, 19 nt, Homo sapiens
ggugcaagccacauaugua

SEQ ID NO: 181147 - RNA, 19 nt, Homo sapiens
caagugaguuauggcaaga

SEQ ID NO: 181148 - RNA, 19 nt, Homo sapiens
gagaaaguccaauaacucu

SEQ ID NO: 181149 - RNA, 19 nt, Homo sapiens
uagagaaaguccaauaacu

SEQ ID NO: 181150 - RNA, 19 nt, Homo sapiens
gagaccaggauccaaauug

SEQ ID NO: 181151 - RNA, 19 nt, Homo sapiens
gcgcacaaccuaggcagua

SEQ ID NO: 181152 - RNA, 19 nt, Homo sapiens
gcagagagaaguacauucg

SEQ ID NO: 181153 - RNA, 19 nt, Homo sapiens
ccaagcgucuaaccuaaag

SEQ ID NO: 181154 - RNA, 19 nt, Homo sapiens
caucggcuguucacacguu

SEQ ID NO: 181155 - RNA, 19 nt, Homo sapiens
uaaguuagggcagucagua

SEQ ID NO: 181156 - RNA, 19 nt, Homo sapiens
cccaaagggugaacuaaag

SEQ ID NO: 181157 - RNA, 19 nt, Homo sapiens
agaccaggauccaaauugu

SEQ ID NO: 181158 - RNA, 19 nt, Homo sapiens
acgaagacaugugaacuug

SEQ ID NO: 181159 - RNA, 19 nt, Homo sapiens
uaaguagcaggcucacuaa

SEQ ID NO: 181160 - RNA, 19 nt, Homo sapiens
gcccguuggugacgccuuu

SEQ ID NO: 181161 - RNA, 19 nt, Homo sapiens
ccaggcagcaauuauauca

SEQ ID NO: 181162 - RNA, 19 nt, Homo sapiens
gccacaaccucacacucaa

SEQ ID NO: 181163 - RNA, 19 nt, Homo sapiens
ugaguuauggcaagagaaa

SEQ ID NO: 181164 - RNA, 19 nt, Homo sapiens
guagcaggcucacuaaaau

SEQ ID NO: 181165 - RNA, 19 nt, Homo sapiens
aggcaguaauccuaaacua

SEQ ID NO: 181166 - RNA, 19 nt, Homo sapiens
gaacagcauccgccacaac

SEQ ID NO: 181167 - RNA, 19 nt, Homo sapiens
acgcagcccuggacccaaa

SEQ ID NO: 181168 - RNA, 19 nt, Homo sapiens
aaccuaaagucccaggauu

SEQ ID NO: 181169 - RNA, 19 nt, Homo sapiens
cagcgccuuucuucuuaaa

SEQ ID NO: 181170 - RNA, 19 nt, Homo sapiens
guucguguccgccauguga

SEQ ID NO: 181171 - RNA, 19 nt, Homo sapiens
aaccagugcucuccauuag

SEQ ID NO: 181172 - RNA, 19 nt, Homo sapiens
ucuuugagcaagugaguua

SEQ ID NO: 181173 - RNA, 19 nt, Homo sapiens
aagccuagccgcuguucua

SEQ ID NO: 181174 - RNA, 19 nt, Homo sapiens
gaggcuccauucacagcuu

SEQ ID NO: 181175 - RNA, 19 nt, Homo sapiens
ggagaugagaggauucaag

SEQ ID NO: 181176 - RNA, 19 nt, Homo sapiens
uauaaggcagagagaagua

SEQ ID NO: 181177 - RNA, 19 nt, Homo sapiens
ggacgugcugguaauuuca

SEQ ID NO: 181178 - RNA, 19 nt, Homo sapiens
cggcagcgccuuucuucuu

SEQ ID NO: 181179 - RNA, 19 nt, Homo sapiens
gugcucuccauuagaaaua

SEQ ID NO: 181180 - RNA, 19 nt, Homo sapiens
gccaagcgucuaaccuaaa

SEQ ID NO: 181181 - RNA, 19 nt, Homo sapiens
caacgacugcuuccucaag

SEQ ID NO: 181182 - RNA, 19 nt, Homo sapiens
cucagccucuuucuguaua

SEQ ID NO: 181183 - RNA, 19 nt, Homo sapiens
gcacaaccuaggcaguaau

SEQ ID NO: 181184 - RNA, 19 nt, Homo sapiens
gcaggacgugcugguaauu

SEQ ID NO: 181185 - RNA, 19 nt, Homo sapiens
gaggaggacaaauuugcaa

SEQ ID NO: 181186 - RNA, 19 nt, Homo sapiens
ccaccuacccggcuuacau

SEQ ID NO: 181187 - RNA, 19 nt, Homo sapiens
caacgcggaggacauguuc

SEQ ID NO: 181188 - RNA, 19 nt, Homo sapiens
gcugggagccugcuacaac

SEQ ID NO: 181189 - RNA, 19 nt, Homo sapiens
uggcuaccgugaaggaaga

SEQ ID NO: 181190 - RNA, 19 nt, Homo sapiens
gcucuccauuagaaauaug

SEQ ID NO: 181191 - RNA, 19 nt, Homo sapiens
ucacagcuuucagauaaac

SEQ ID NO: 181192 - RNA, 19 nt, Homo sapiens
gagaaguacauucguucau

SEQ ID NO: 181193 - RNA, 19 nt, Homo sapiens
agaccgagcaggccacaga

SEQ ID NO: 181194 - RNA, 19 nt, Homo sapiens
ggacgaaaacucauagaca

SEQ ID NO: 181195 - RNA, 19 nt, Homo sapiens
uauucuaguagccacauua

SEQ ID NO: 181196 - RNA, 19 nt, Homo sapiens
cgcacaaccuaggcaguaa

SEQ ID NO: 181197 - RNA, 19 nt, Homo sapiens
ucagccucuuucuguauaa

SEQ ID NO: 181198 - RNA, 19 nt, Homo sapiens
agagaaaguccaauaacuc

SEQ ID NO: 181199 - RNA, 19 nt, Homo sapiens
ccaaagggugaacuaaagu

SEQ ID NO: 181200 - RNA, 19 nt, Homo sapiens
ggugcuggcuaccgugaag

SEQ ID NO: 181201 - RNA, 19 nt, Homo sapiens
ugccggaacucgggccuuu

SEQ ID NO: 181202 - RNA, 19 nt, Homo sapiens
cauuagaaauauggugcaa

SEQ ID NO: 181203 - RNA, 19 nt, Homo sapiens
cagccucuuucuguauaaa

SEQ ID NO: 181204 - RNA, 19 nt, Homo sapiens
ggcaguaauccuaaacuag

SEQ ID NO: 181205 - RNA, 19 nt, Homo sapiens
uaaacuggaguguucagau

SEQ ID NO: 181206 - RNA, 19 nt, Homo sapiens
ucagauaaacuggaguguu

SEQ ID NO: 181207 - RNA, 19 nt, Homo sapiens
gcccagaugugcgcuauua

SEQ ID NO: 181208 - RNA, 19 nt, Homo sapiens
caagucagcuuuccugcaa

SEQ ID NO: 181209 - RNA, 19 nt, Homo sapiens
aagaagaaauccugguuaa

SEQ ID NO: 181210 - RNA, 19 nt, Homo sapiens
ggaccacuuucccuacuuu

SEQ ID NO: 181211 - RNA, 19 nt, Homo sapiens
guagugggcccaacaaauu

SEQ ID NO: 181212 - RNA, 19 nt, Homo sapiens
caacaggagucuaaucaag

SEQ ID NO: 181213 - RNA, 19 nt, Homo sapiens
gaggauggaugcaacugaa

SEQ ID NO: 181214 - RNA, 19 nt, Homo sapiens
gcugggaucaagauuauua

SEQ ID NO: 181215 - RNA, 19 nt, Homo sapiens
gaugugcgcuauuagaugu

SEQ ID NO: 181216 - RNA, 19 nt, Homo sapiens
ggaggaaaugccacacuua

SEQ ID NO: 181217 - RNA, 19 nt, Homo sapiens
ggaagcgcaugacuuugaa

SEQ ID NO: 181218 - RNA, 19 nt, Homo sapiens
caagaagaaauccugguua

SEQ ID NO: 181219 - RNA, 19 nt, Homo sapiens
cagcugggaucaagauuau

SEQ ID NO: 181220 - RNA, 19 nt, Homo sapiens
gaagaaauccugguuaaaa

SEQ ID NO: 181221 - RNA, 19 nt, Homo sapiens
caacaaaggcaauggugaa

SEQ ID NO: 181222 - RNA, 19 nt, Homo sapiens
gcucccugcugccugauua

SEQ ID NO: 181223 - RNA, 19 nt, Homo sapiens
gaagaugaagccacugcua

SEQ ID NO: 181224 - RNA, 19 nt, Homo sapiens
ggaucaagauuauuaacca

SEQ ID NO: 181225 - RNA, 19 nt, Homo sapiens
gcaagaagaaauccugguu

SEQ ID NO: 181226 - RNA, 19 nt, Homo sapiens
ggaaaugcuugugauucaa

SEQ ID NO: 181227 - RNA, 19 nt, Homo sapiens
cggaaaugcuugugauuca

SEQ ID NO: 181228 - RNA, 19 nt, Homo sapiens
gauaauguccccaaucaua

SEQ ID NO: 181229 - RNA, 19 nt, Homo sapiens
gggaggaaaugccacacuu

SEQ ID NO: 181230 - RNA, 19 nt, Homo sapiens
ggauagcuccucuuucuuc

SEQ ID NO: 181231 - RNA, 19 nt, Homo sapiens
caucagaggaggaaccuaa

SEQ ID NO: 181232 - RNA, 19 nt, Homo sapiens
ggucaggaguugaauuugg

SEQ ID NO: 181233 - RNA, 19 nt, Homo sapiens
agaggaagcgcaugacuuu

SEQ ID NO: 181234 - RNA, 19 nt, Homo sapiens
aaagaugaguucugaugga

SEQ ID NO: 181235 - RNA, 19 nt, Homo sapiens
gcaagauccugcuggacau

SEQ ID NO: 181236 - RNA, 19 nt, Homo sapiens
cgcaaaggcuccucaguuc

SEQ ID NO: 181237 - RNA, 19 nt, Homo sapiens
ggaugugaaucuuccuaga

SEQ ID NO: 181238 - RNA, 19 nt, Homo sapiens
cgaaagaugaguucugaug

SEQ ID NO: 181239 - RNA, 19 nt, Homo sapiens
caacaaugcuaauauucac

SEQ ID NO: 181240 - RNA, 19 nt, Homo sapiens
cagcuuuccugcaagaaga

SEQ ID NO: 181241 - RNA, 19 nt, Homo sapiens
gcagggacccagacaagug

SEQ ID NO: 181242 - RNA, 19 nt, Homo sapiens
uaagacacccauuaaggaa

SEQ ID NO: 181243 - RNA, 19 nt, Homo sapiens
gaagugggaggaccuuuua

SEQ ID NO: 181244 - RNA, 19 nt, Homo sapiens
cccagggucuccacaauug

SEQ ID NO: 181245 - RNA, 19 nt, Homo sapiens
ugacuucuguuccuugcuu

SEQ ID NO: 181246 - RNA, 19 nt, Homo sapiens
ucucuuaccuucccugauc

SEQ ID NO: 181247 - RNA, 19 nt, Homo sapiens
gaacaacaaaggcaauggu

SEQ ID NO: 181248 - RNA, 19 nt, Homo sapiens
agacuggcauugacgagaa

SEQ ID NO: 181249 - RNA, 19 nt, Homo sapiens
caaaaugccccaagugaaa

SEQ ID NO: 181250 - RNA, 19 nt, Homo sapiens
ccaacaaugcuaauauuca

SEQ ID NO: 181251 - RNA, 19 nt, Homo sapiens
ggacuguucugcuccucau

SEQ ID NO: 181252 - RNA, 19 nt, Homo sapiens
caacucuucucccucagau

SEQ ID NO: 181253 - RNA, 19 nt, Homo sapiens
cagcaccacucccuugcaa

SEQ ID NO: 181254 - RNA, 19 nt, Homo sapiens
ucaaagaggaaucaucuca

SEQ ID NO: 181255 - RNA, 19 nt, Homo sapiens
caacaaauucauccucauc

SEQ ID NO: 181256 - RNA, 19 nt, Homo sapiens
ccagcugggaucaagauua

SEQ ID NO: 181257 - RNA, 19 nt, Homo sapiens
gaggaaaugccacacuuag

SEQ ID NO: 181258 - RNA, 19 nt, Homo sapiens
gagaggaagcgcaugacuu

SEQ ID NO: 181259 - RNA, 19 nt, Homo sapiens
ggugugagccagcuugaga

SEQ ID NO: 181260 - RNA, 19 nt, Homo sapiens
gcagggugguccguguaaa

SEQ ID NO: 181261 - RNA, 19 nt, Homo sapiens
gcaaaggcuccucaguuca

SEQ ID NO: 181262 - RNA, 19 nt, Homo sapiens
ccgcaaaggcuccucaguu

SEQ ID NO: 181263 - RNA, 19 nt, Homo sapiens
gauuucagcccaguacaaa

SEQ ID NO: 181264 - RNA, 19 nt, Homo sapiens
gacauuggaccagguguuu

SEQ ID NO: 181265 - RNA, 19 nt, Homo sapiens
gaagggugggaacaacaaa

SEQ ID NO: 181266 - RNA, 19 nt, Homo sapiens
aaagaggaaucaucucacu

SEQ ID NO: 181267 - RNA, 19 nt, Homo sapiens
ggagaccugugcagauggu

SEQ ID NO: 181268 - RNA, 19 nt, Homo sapiens
ccaggacuccggccucaaa

SEQ ID NO: 181269 - RNA, 19 nt, Homo sapiens
gcuaauauucacagcauca

SEQ ID NO: 181270 - RNA, 19 nt, Homo sapiens
ugaccugccuggcuuccuu

SEQ ID NO: 181271 - RNA, 19 nt, Homo sapiens
ccagaugugcgcuauuaga

SEQ ID NO: 181272 - RNA, 19 nt, Homo sapiens
ggaggauggaugcaacuga

SEQ ID NO: 181273 - RNA, 19 nt, Homo sapiens
gaccugggguuucaauuga

SEQ ID NO: 181274 - RNA, 19 nt, Homo sapiens
gcaccacucccuugcaaag

SEQ ID NO: 181275 - RNA, 19 nt, Homo sapiens
gcucagcuacucccaggaa

SEQ ID NO: 181276 - RNA, 19 nt, Homo sapiens
ggggauagcuccucuuucu

SEQ ID NO: 181277 - RNA, 19 nt, Homo sapiens
cauuggaccagguguuuaa

SEQ ID NO: 181278 - RNA, 19 nt, Homo sapiens
aagcuuauuuccuuagauc

SEQ ID NO: 181279 - RNA, 19 nt, Homo sapiens
gggaggaccuuuuaagaca

SEQ ID NO: 181280 - RNA, 19 nt, Homo sapiens
uaccacgggucagcucaua

SEQ ID NO: 181281 - RNA, 19 nt, Homo sapiens
ccaguggcuucgaaagaug

SEQ ID NO: 181282 - RNA, 19 nt, Homo sapiens
aagcagaggccuccaagga

SEQ ID NO: 181283 - RNA, 19 nt, Homo sapiens
cgggagaccugugcagaug

SEQ ID NO: 181284 - RNA, 19 nt, Homo sapiens
ucuccaaauuauccucuaa

SEQ ID NO: 181285 - RNA, 19 nt, Homo sapiens
aaugacagccucagcaaga

SEQ ID NO: 181286 - RNA, 19 nt, Homo sapiens
gcgcacggcggaagaugaa

SEQ ID NO: 181287 - RNA, 19 nt, Homo sapiens
gccggaacaugaccaucaa

SEQ ID NO: 181288 - RNA, 19 nt, Homo sapiens
cagcagaaacgaccgaauc

SEQ ID NO: 181289 - RNA, 19 nt, Homo sapiens
aaccagcuaugaugccaaa

SEQ ID NO: 181290 - RNA, 19 nt, Homo sapiens
ggugguccguguaaauagu

SEQ ID NO: 181291 - RNA, 19 nt, Homo sapiens
ccaguuuauuccugagcua

SEQ ID NO: 181292 - RNA, 19 nt, Homo sapiens
ggauuucagcccaguacaa

SEQ ID NO: 181293 - RNA, 19 nt, Homo sapiens
uaucaaggaggaagaaauc

SEQ ID NO: 181294 - RNA, 19 nt, Homo sapiens
gauagcuccucuuucuucu

SEQ ID NO: 181295 - RNA, 19 nt, Homo sapiens
aaagagaguggcaguagug

SEQ ID NO: 181296 - RNA, 19 nt, Homo sapiens
uguauugggucaggaguug

SEQ ID NO: 181297 - RNA, 19 nt, Homo sapiens
ucaauugacuucuguuccu

SEQ ID NO: 181298 - RNA, 19 nt, Homo sapiens
caaaggcaauggugaaaag

SEQ ID NO: 181299 - RNA, 19 nt, Homo sapiens
gaggaccacuuucccuacu

SEQ ID NO: 181300 - RNA, 19 nt, Homo sapiens
agacaucuauacguggauu

SEQ ID NO: 181301 - RNA, 19 nt, Homo sapiens
gcagcgacagguuaagguu

SEQ ID NO: 181302 - RNA, 19 nt, Homo sapiens
caauugacuucuguuccuu

SEQ ID NO: 181303 - RNA, 19 nt, Homo sapiens
cagaagguggguaggauga

SEQ ID NO: 181304 - RNA, 19 nt, Homo sapiens
gccagaagguggguaggau

SEQ ID NO: 181305 - RNA, 19 nt, Homo sapiens
gaaaugcuugugauucaac

SEQ ID NO: 181306 - RNA, 19 nt, Homo sapiens
aggaagcgcaugacuuuga

SEQ ID NO: 181307 - RNA, 19 nt, Homo sapiens
gaacagacauccagacaaa

SEQ ID NO: 181308 - RNA, 19 nt, Homo sapiens
gaauauggcuacacuuaua

SEQ ID NO: 181309 - RNA, 19 nt, Homo sapiens
agaaagaggucuaauagga

SEQ ID NO: 181310 - RNA, 19 nt, Homo sapiens
gaacccggcuagcgagaaa

SEQ ID NO: 181311 - RNA, 19 nt, Homo sapiens
ggagaaagaggucuaauag

SEQ ID NO: 181312 - RNA, 19 nt, Homo sapiens
gaaguucguuuccucugaa

SEQ ID NO: 181313 - RNA, 19 nt, Homo sapiens
ucacagagacugagacaaa

SEQ ID NO: 181314 - RNA, 19 nt, Homo sapiens
ccgcagcucuuccgccuua

SEQ ID NO: 181315 - RNA, 19 nt, Homo sapiens
ggaggcugcuguuagauga

SEQ ID NO: 181316 - RNA, 19 nt, Homo sapiens
caaaugccguuuccacaga

SEQ ID NO: 181317 - RNA, 19 nt, Homo sapiens
gcacaagacuuuugagaga

SEQ ID NO: 181318 - RNA, 19 nt, Homo sapiens
uagaauauggcuacacuua

SEQ ID NO: 181319 - RNA, 19 nt, Homo sapiens
caaaggacaugaguaguca

SEQ ID NO: 181320 - RNA, 19 nt, Homo sapiens
ggaagccgaggcagacuua

SEQ ID NO: 181321 - RNA, 19 nt, Homo sapiens
gggagaaagaggucuaaua

SEQ ID NO: 181322 - RNA, 19 nt, Homo sapiens
uaaauggccuagaauaugg

SEQ ID NO: 181323 - RNA, 19 nt, Homo sapiens
ucaguacccuuuccuaaau

SEQ ID NO: 181324 - RNA, 19 nt, Homo sapiens
gaaugggagaguuggauua

SEQ ID NO: 181325 - RNA, 19 nt, Homo sapiens
acccaacucuguucuauuu

SEQ ID NO: 181326 - RNA, 19 nt, Homo sapiens
caacccaacucuguucuau

SEQ ID NO: 181327 - RNA, 19 nt, Homo sapiens
ccacggaucccgccagaaa

SEQ ID NO: 181328 - RNA, 19 nt, Homo sapiens
caaguucgcuccuggugau

SEQ ID NO: 181329 - RNA, 19 nt, Homo sapiens
gaaagaggucuaauaggau

SEQ ID NO: 181330 - RNA, 19 nt, Homo sapiens
gagccugggugaguucuuu

SEQ ID NO: 181331 - RNA, 19 nt, Homo sapiens
ucgcugcucuuaacuacua

SEQ ID NO: 181332 - RNA, 19 nt, Homo sapiens
ggacuaagcgggcucuauc

SEQ ID NO: 181333 - RNA, 19 nt, Homo sapiens
agacaucuauuaucugcuu

SEQ ID NO: 181334 - RNA, 19 nt, Homo sapiens
ccaagaagcggcugacguu

SEQ ID NO: 181335 - RNA, 19 nt, Homo sapiens
gcacagggccaaccuuagu

SEQ ID NO: 181336 - RNA, 19 nt, Homo sapiens
ucagggagucuauuuauga

SEQ ID NO: 181337 - RNA, 19 nt, Homo sapiens
uuacaaaggcagaaacaaa

SEQ ID NO: 181338 - RNA, 19 nt, Homo sapiens
gagaugaaggcaacacuug

SEQ ID NO: 181339 - RNA, 19 nt, Homo sapiens
gggaugaagaacucuauuu

SEQ ID NO: 181340 - RNA, 19 nt, Homo sapiens
gggagucuauuuaugaagu

SEQ ID NO: 181341 - RNA, 19 nt, Homo sapiens
agaugaaacugcaaagugu

SEQ ID NO: 181342 - RNA, 19 nt, Homo sapiens
agacccugcuuguccaaua

SEQ ID NO: 181343 - RNA, 19 nt, Homo sapiens
uggcuacacuuauacauca

SEQ ID NO: 181344 - RNA, 19 nt, Homo sapiens
gaaacaaagcgcaaagaac

SEQ ID NO: 181345 - RNA, 19 nt, Homo sapiens
cagggagucuauuuaugaa

SEQ ID NO: 181346 - RNA, 19 nt, Homo sapiens
gggaaagccucagcuccuu

SEQ ID NO: 181347 - RNA, 19 nt, Homo sapiens
cuaaauggccuagaauaug

SEQ ID NO: 181348 - RNA, 19 nt, Homo sapiens
ugaaaugggcccaaucugu

SEQ ID NO: 181349 - RNA, 19 nt, Homo sapiens
gaacacauuccgggagaga

SEQ ID NO: 181350 - RNA, 19 nt, Homo sapiens
caacucuguucuauuucuu

SEQ ID NO: 181351 - RNA, 19 nt, Homo sapiens
ggaaugggagaguuggauu

SEQ ID NO: 181352 - RNA, 19 nt, Homo sapiens
cagauaggguaaguaguga

SEQ ID NO: 181353 - RNA, 19 nt, Homo sapiens
ugggagaguuggauuaaca

SEQ ID NO: 181354 - RNA, 19 nt, Homo sapiens
gacccugcuuguccaauau

SEQ ID NO: 181355 - RNA, 19 nt, Homo sapiens
cuaauaggaugggcaggaa

SEQ ID NO: 181356 - RNA, 19 nt, Homo sapiens
acaaacggaugccgagauc

SEQ ID NO: 181357 - RNA, 19 nt, Homo sapiens
ugacagauaggguaaguag

SEQ ID NO: 181358 - RNA, 19 nt, Homo sapiens
ccaacucuguucuauuucu

SEQ ID NO: 181359 - RNA, 19 nt, Homo sapiens
ccuaaauggccuagaauau

SEQ ID NO: 181360 - RNA, 19 nt, Homo sapiens
ggucucccuuucugccuuu

SEQ ID NO: 181361 - RNA, 19 nt, Homo sapiens
gccacaaccucucucucaa

SEQ ID NO: 181362 - RNA, 19 nt, Homo sapiens
ggucgcugcucuuaacuac

SEQ ID NO: 181363 - RNA, 19 nt, Homo sapiens
acagauaggguaaguagug

SEQ ID NO: 181364 - RNA, 19 nt, Homo sapiens
gaagucgcaggccaagauu

SEQ ID NO: 181365 - RNA, 19 nt, Homo sapiens
ggagaaauuaagcggauuc

SEQ ID NO: 181366 - RNA, 19 nt, Homo sapiens
agaaacaaagcgcaaagaa

SEQ ID NO: 181367 - RNA, 19 nt, Homo sapiens
ucaaaggacaugaguaguc

SEQ ID NO: 181368 - RNA, 19 nt, Homo sapiens
gaacagcauccgccacaac

SEQ ID NO: 181369 - RNA, 19 nt, Homo sapiens
cgaggccgacgcagacaua

SEQ ID NO: 181370 - RNA, 19 nt, Homo sapiens
uagaugaaacugcaaagug

SEQ ID NO: 181371 - RNA, 19 nt, Homo sapiens
ccagacccaugaacagaca

SEQ ID NO: 181372 - RNA, 19 nt, Homo sapiens
ggaugaagaacucuauuuu

SEQ ID NO: 181373 - RNA, 19 nt, Homo sapiens
gcaacccaacucuguucua

SEQ ID NO: 181374 - RNA, 19 nt, Homo sapiens
cugcuuguccaauauuaua

SEQ ID NO: 181375 - RNA, 19 nt, Homo sapiens
ggccuuccuucucuauaga

SEQ ID NO: 181376 - RNA, 19 nt, Homo sapiens
agucagaccugccuuccau

SEQ ID NO: 181377 - RNA, 19 nt, Homo sapiens
acagacauccagacaaaug

SEQ ID NO: 181378 - RNA, 19 nt, Homo sapiens
ggugacagauaggguaagu

SEQ ID NO: 181379 - RNA, 19 nt, Homo sapiens
gguguuacuagccucauuu

SEQ ID NO: 181380 - RNA, 19 nt, Homo sapiens
gaugaaacugcaaaguguu

SEQ ID NO: 181381 - RNA, 19 nt, Homo sapiens
caggcuaucccguagauug

SEQ ID NO: 181382 - RNA, 19 nt, Homo sapiens
gggcagaggccuuccuucu

SEQ ID NO: 181383 - RNA, 19 nt, Homo sapiens
ugagcgagaucugcgaguu

SEQ ID NO: 181384 - RNA, 19 nt, Homo sapiens
gggagaaauuaagcggauu

SEQ ID NO: 181385 - RNA, 19 nt, Homo sapiens
caggcgacuuccucucaaa

SEQ ID NO: 181386 - RNA, 19 nt, Homo sapiens
gcagaaacaaagcgcaaag

SEQ ID NO: 181387 - RNA, 19 nt, Homo sapiens
ucagaccugccuuccauuu

SEQ ID NO: 181388 - RNA, 19 nt, Homo sapiens
uuuccuaaauggccuagaa

SEQ ID NO: 181389 - RNA, 19 nt, Homo sapiens
gagugagccuuaacaucca

SEQ ID NO: 181390 - RNA, 19 nt, Homo sapiens
ccuagaauauggcuacacu

SEQ ID NO: 181391 - RNA, 19 nt, Homo sapiens
cugcaaaguguucucagua

SEQ ID NO: 181392 - RNA, 19 nt, Homo sapiens
uaucugcuuugugcuuaaa

SEQ ID NO: 181393 - RNA, 19 nt, Homo sapiens
ggagucuauuuaugaaguc

SEQ ID NO: 181394 - RNA, 19 nt, Homo sapiens
ccaggcauccgcucaguuc

SEQ ID NO: 181395 - RNA, 19 nt, Homo sapiens
agaagcggcugacguugag

SEQ ID NO: 181396 - RNA, 19 nt, Homo sapiens
cuacacuuauacaucaguu

SEQ ID NO: 181397 - RNA, 19 nt, Homo sapiens
ccaggcgacuuccucucaa

SEQ ID NO: 181398 - RNA, 19 nt, Homo sapiens
ucucaguacccuuuccuaa

SEQ ID NO: 181399 - RNA, 19 nt, Homo sapiens
gauuggaggcugcuguuag

SEQ ID NO: 181400 - RNA, 19 nt, Homo sapiens
cguuuccucugaagccuaa

SEQ ID NO: 181401 - RNA, 19 nt, Homo sapiens
ucccguugcuggccacauu

SEQ ID NO: 181402 - RNA, 19 nt, Homo sapiens
aagaagcggcugacguuga

SEQ ID NO: 181403 - RNA, 19 nt, Homo sapiens
agaagucgcaggccaagau

SEQ ID NO: 181404 - RNA, 19 nt, Homo sapiens
gagaaagaggucuaauagg

SEQ ID NO: 181405 - RNA, 19 nt, Homo sapiens
uauauucccugcagaaacc

SEQ ID NO: 181406 - RNA, 19 nt, Homo sapiens
gagcgagaucugcgaguuc

SEQ ID NO: 181407 - RNA, 19 nt, Homo sapiens
ggaaagugauguauaguua

SEQ ID NO: 181408 - RNA, 19 nt, Homo sapiens
gauaagauuuccuacagua

SEQ ID NO: 181409 - RNA, 19 nt, Homo sapiens
gaagacaccuguacaagug

SEQ ID NO: 181410 - RNA, 19 nt, Homo sapiens
ggaauuaugucaacacuca

SEQ ID NO: 181411 - RNA, 19 nt, Homo sapiens
ggauauaugcuaccaauaa

SEQ ID NO: 181412 - RNA, 19 nt, Homo sapiens
uaagccagcuguauuguaa

SEQ ID NO: 181413 - RNA, 19 nt, Homo sapiens
gcaaauggaauagaacuua

SEQ ID NO: 181414 - RNA, 19 nt, Homo sapiens
gcaggaaagugauguauag

SEQ ID NO: 181415 - RNA, 19 nt, Homo sapiens
gaaagcaucucuccagucu

SEQ ID NO: 181416 - RNA, 19 nt, Homo sapiens
ggacaacaacaguaaauuu

SEQ ID NO: 181417 - RNA, 19 nt, Homo sapiens
guacaggucuuuucuauuu

SEQ ID NO: 181418 - RNA, 19 nt, Homo sapiens
gcaaugaugacuuugauaa

SEQ ID NO: 181419 - RNA, 19 nt, Homo sapiens
ucacagcaaugaugacuuu

SEQ ID NO: 181420 - RNA, 19 nt, Homo sapiens
guacaugauugcuuuguga

SEQ ID NO: 181421 - RNA, 19 nt, Homo sapiens
guagcaaccuaaacuguaa

SEQ ID NO: 181422 - RNA, 19 nt, Homo sapiens
gauaaggacugugccauug

SEQ ID NO: 181423 - RNA, 19 nt, Homo sapiens
caaaugauaucaccuaugc

SEQ ID NO: 181424 - RNA, 19 nt, Homo sapiens
uaacugguuuguacacuuu

SEQ ID NO: 181425 - RNA, 19 nt, Homo sapiens
gagagaagcaguccaaaga

SEQ ID NO: 181426 - RNA, 19 nt, Homo sapiens
uaacugacagaccaaauua

SEQ ID NO: 181427 - RNA, 19 nt, Homo sapiens
caaguagccuguuaucaau

SEQ ID NO: 181428 - RNA, 19 nt, Homo sapiens
ccacagaauucacaugaga

SEQ ID NO: 181429 - RNA, 19 nt, Homo sapiens
ccucaugucuugauaaguu

SEQ ID NO: 181430 - RNA, 19 nt, Homo sapiens
gagaagcaguccaaagaug

SEQ ID NO: 181431 - RNA, 19 nt, Homo sapiens
ggagauacauuggauuuua

SEQ ID NO: 181432 - RNA, 19 nt, Homo sapiens
ccaggcaucucauaacaaa

SEQ ID NO: 181433 - RNA, 19 nt, Homo sapiens
ggacuugagugguuuguag

SEQ ID NO: 181434 - RNA, 19 nt, Homo sapiens
uaaauggcuuggugucuuu

SEQ ID NO: 181435 - RNA, 19 nt, Homo sapiens
ggaaaucauucuccaacga

SEQ ID NO: 181436 - RNA, 19 nt, Homo sapiens
gguagcaaauggaauagaa

SEQ ID NO: 181437 - RNA, 19 nt, Homo sapiens
cagauuagauuacuuagca

SEQ ID NO: 181438 - RNA, 19 nt, Homo sapiens
uggaguagcucuuaggaaa

SEQ ID NO: 181439 - RNA, 19 nt, Homo sapiens
gaaauuucaucugcuucua

SEQ ID NO: 181440 - RNA, 19 nt, Homo sapiens
caaacucacuacaccauau

SEQ ID NO: 181441 - RNA, 19 nt, Homo sapiens
ccaaguagccuguuaucaa

SEQ ID NO: 181442 - RNA, 19 nt, Homo sapiens
caaggaaaguuuauacucu

SEQ ID NO: 181443 - RNA, 19 nt, Homo sapiens
ugacagaccaaauuaauug

SEQ ID NO: 181444 - RNA, 19 nt, Homo sapiens
gugagcagguuacacuuaa

SEQ ID NO: 181445 - RNA, 19 nt, Homo sapiens
gcaaagauggccucuacuu

SEQ ID NO: 181446 - RNA, 19 nt, Homo sapiens
gcauuucgcuacccgaguu

SEQ ID NO: 181447 - RNA, 19 nt, Homo sapiens
ugagugguuuguagaauuu

SEQ ID NO: 181448 - RNA, 19 nt, Homo sapiens
gcaaaaguuuccccucaua

SEQ ID NO: 181449 - RNA, 19 nt, Homo sapiens
guauaguuauggacacuuu

SEQ ID NO: 181450 - RNA, 19 nt, Homo sapiens
gagucuacuuuguuacaua

SEQ ID NO: 181451 - RNA, 19 nt, Homo sapiens
gagaagugccugauguuga

SEQ ID NO: 181452 - RNA, 19 nt, Homo sapiens
ggaaaggcaucuggucugu

SEQ ID NO: 181453 - RNA, 19 nt, Homo sapiens
aagauuaaaugccagcuuu

SEQ ID NO: 181454 - RNA, 19 nt, Homo sapiens
caucuggucugucuggaaa

SEQ ID NO: 181455 - RNA, 19 nt, Homo sapiens
caucaagucuucucuagag

SEQ ID NO: 181456 - RNA, 19 nt, Homo sapiens
ugacuuggauggcauguuc

SEQ ID NO: 181457 - RNA, 19 nt, Homo sapiens
ggagguaugagucaguaua

SEQ ID NO: 181458 - RNA, 19 nt, Homo sapiens
ccagaugccuauacaaaca

SEQ ID NO: 181459 - RNA, 19 nt, Homo sapiens
agacauagcugguuuuaga

SEQ ID NO: 181460 - RNA, 19 nt, Homo sapiens
gagauaagcaaucccgaaa

SEQ ID NO: 181461 - RNA, 19 nt, Homo sapiens
gacaacaacaguaaauuug

SEQ ID NO: 181462 - RNA, 19 nt, Homo sapiens
guauauagcccacaucaca

SEQ ID NO: 181463 - RNA, 19 nt, Homo sapiens
gaguugagcuuuagcaaaa

SEQ ID NO: 181464 - RNA, 19 nt, Homo sapiens
ggauggagauacauuggau

SEQ ID NO: 181465 - RNA, 19 nt, Homo sapiens
gaaauccugucaugaaucc

SEQ ID NO: 181466 - RNA, 19 nt, Homo sapiens
ucacuacaccauauaauug

SEQ ID NO: 181467 - RNA, 19 nt, Homo sapiens
aaccaaagcuucccacaca

SEQ ID NO: 181468 - RNA, 19 nt, Homo sapiens
ucucugguuuguacuguua

SEQ ID NO: 181469 - RNA, 19 nt, Homo sapiens
guauguaacugaacuuggu

SEQ ID NO: 181470 - RNA, 19 nt, Homo sapiens
guucugccuugaggaauua

SEQ ID NO: 181471 - RNA, 19 nt, Homo sapiens
ggaacugacggaucacaaa

SEQ ID NO: 181472 - RNA, 19 nt, Homo sapiens
cagguuaugugcugcugua

SEQ ID NO: 181473 - RNA, 19 nt, Homo sapiens
gaacagccaccacucuauc

SEQ ID NO: 181474 - RNA, 19 nt, Homo sapiens
caucuucauuggcuuggua

SEQ ID NO: 181475 - RNA, 19 nt, Homo sapiens
guaacugacagaccaaauu

SEQ ID NO: 181476 - RNA, 19 nt, Homo sapiens
gcuguaaguugugcauuga

SEQ ID NO: 181477 - RNA, 19 nt, Homo sapiens
gaucacaguuuuccaaaug

SEQ ID NO: 181478 - RNA, 19 nt, Homo sapiens
gauauaugcuaccaauaac

SEQ ID NO: 181479 - RNA, 19 nt, Homo sapiens
gaaaugugcaaaugauauc

SEQ ID NO: 181480 - RNA, 19 nt, Homo sapiens
guugaaauccugucaugaa

SEQ ID NO: 181481 - RNA, 19 nt, Homo sapiens
acacuugcuuugucuugua

SEQ ID NO: 181482 - RNA, 19 nt, Homo sapiens
gaaccaaguagccuguuau

SEQ ID NO: 181483 - RNA, 19 nt, Homo sapiens
agaaccaaguagccuguua

SEQ ID NO: 181484 - RNA, 19 nt, Homo sapiens
gcgcuuagacugugacaug

SEQ ID NO: 181485 - RNA, 19 nt, Homo sapiens
caauggaacaucccaagaa

SEQ ID NO: 181486 - RNA, 19 nt, Homo sapiens
gaaacccaaguuccucuaa

SEQ ID NO: 181487 - RNA, 19 nt, Homo sapiens
acucauacuucaucucauu

SEQ ID NO: 181488 - RNA, 19 nt, Homo sapiens
cauaaucugucccuacaca

SEQ ID NO: 181489 - RNA, 19 nt, Homo sapiens
gguucuaauuuccagauaa

SEQ ID NO: 181490 - RNA, 19 nt, Homo sapiens
guuaugugcugcuguagau

SEQ ID NO: 181491 - RNA, 19 nt, Homo sapiens
gagguaugagucaguauaa

SEQ ID NO: 181492 - RNA, 19 nt, Homo sapiens
aaacacuucaggacaauaa

SEQ ID NO: 181493 - RNA, 19 nt, Homo sapiens
ccgcaaagauggccucuac

SEQ ID NO: 181494 - RNA, 19 nt, Homo sapiens
ugccauuacugcaucauaa

SEQ ID NO: 181495 - RNA, 19 nt, Homo sapiens
ugucaacacucauacuuca

SEQ ID NO: 181496 - RNA, 19 nt, Homo sapiens
ggacacuuugcguuucuua

SEQ ID NO: 181497 - RNA, 19 nt, Homo sapiens
uacaaacacuucaggacaa

SEQ ID NO: 181498 - RNA, 19 nt, Homo sapiens
ucaccaacaucauuaacug

SEQ ID NO: 181499 - RNA, 19 nt, Homo sapiens
gaaaucauucuccaacgau

SEQ ID NO: 181500 - RNA, 19 nt, Homo sapiens
ugcuuugucuuguauguua

SEQ ID NO: 181501 - RNA, 19 nt, Homo sapiens
ccacaucacacuugcuuug

SEQ ID NO: 181502 - RNA, 19 nt, Homo sapiens
aaaugggacuugagugguu

SEQ ID NO: 181503 - RNA, 19 nt, Homo sapiens
gaauucacaugagaaccaa

SEQ ID NO: 181504 - RNA, 19 nt, Homo sapiens
uauaagcaguagauacaga

SEQ ID NO: 181505 - RNA, 19 nt, Homo sapiens
gccauuggaaauuucauua

SEQ ID NO: 181506 - RNA, 19 nt, Homo sapiens
gcucaaaugcuaguacuau

SEQ ID NO: 181507 - RNA, 19 nt, Homo sapiens
gcacagaguuggaugaagu

SEQ ID NO: 181508 - RNA, 19 nt, Homo sapiens
gaacuucacuggugcuaag

SEQ ID NO: 181509 - RNA, 19 nt, Homo sapiens
ccacagcgaugucaugaug

SEQ ID NO: 181510 - RNA, 19 nt, Homo sapiens
gacaauagcaacaaguaua

SEQ ID NO: 181511 - RNA, 19 nt, Homo sapiens
cacaagaccuacagagaaa

SEQ ID NO: 181512 - RNA, 19 nt, Homo sapiens
ccaaccagcuccuuuaaca

SEQ ID NO: 181513 - RNA, 19 nt, Homo sapiens
cgaaucagcugacgacagu

SEQ ID NO: 181514 - RNA, 19 nt, Homo sapiens
cacagaauguuguugguuu

SEQ ID NO: 181515 - RNA, 19 nt, Homo sapiens
gcaaugauccgaugauguc

SEQ ID NO: 181516 - RNA, 19 nt, Homo sapiens
gaagacagcacagacuuga

SEQ ID NO: 181517 - RNA, 19 nt, Homo sapiens
ggacagugauaccguuuac

SEQ ID NO: 181518 - RNA, 19 nt, Homo sapiens
ugauaccguuuacagcuua

SEQ ID NO: 181519 - RNA, 19 nt, Homo sapiens
uaacuuugauucccucauc

SEQ ID NO: 181520 - RNA, 19 nt, Homo sapiens
uggacgaccugcuggauaa

SEQ ID NO: 181521 - RNA, 19 nt, Homo sapiens
caacucuccuucucucuuc

SEQ ID NO: 181522 - RNA, 19 nt, Homo sapiens
cagcagagacuguuaaugg

SEQ ID NO: 181523 - RNA, 19 nt, Homo sapiens
guuuacagcuuaacaccuu

SEQ ID NO: 181524 - RNA, 19 nt, Homo sapiens
aagcagacccucaaacuga

SEQ ID NO: 181525 - RNA, 19 nt, Homo sapiens
caagagaacaagccagcua

SEQ ID NO: 181526 - RNA, 19 nt, Homo sapiens
gcaggcaccaugaaucuga

SEQ ID NO: 181527 - RNA, 19 nt, Homo sapiens
cagcuuaacaccuuuguga

SEQ ID NO: 181528 - RNA, 19 nt, Homo sapiens
aagcaggccucaucucaga

SEQ ID NO: 181529 - RNA, 19 nt, Homo sapiens
acacaagaccuacagagaa

SEQ ID NO: 181530 - RNA, 19 nt, Homo sapiens
guacucaacuagugcaaac

SEQ ID NO: 181531 - RNA, 19 nt, Homo sapiens
cagcagcagucuccuguca

SEQ ID NO: 181532 - RNA, 19 nt, Homo sapiens
gcaccaugaaucugaauga

SEQ ID NO: 181533 - RNA, 19 nt, Homo sapiens
ggacaauagcaacaaguau

SEQ ID NO: 181534 - RNA, 19 nt, Homo sapiens
gcucgaaccucugcgaaca

SEQ ID NO: 181535 - RNA, 19 nt, Homo sapiens
gugccaggcugaaggauca

SEQ ID NO: 181536 - RNA, 19 nt, Homo sapiens
cacaaccugucacugcaua

SEQ ID NO: 181537 - RNA, 19 nt, Homo sapiens
caaacugacacaagaccua

SEQ ID NO: 181538 - RNA, 19 nt, Homo sapiens
gggcaaagcagacccucaa

SEQ ID NO: 181539 - RNA, 19 nt, Homo sapiens
gcugauggguuggauuuua

SEQ ID NO: 181540 - RNA, 19 nt, Homo sapiens
gacaaacggcucacucugu

SEQ ID NO: 181541 - RNA, 19 nt, Homo sapiens
gagcgaaacauaaacaaac

SEQ ID NO: 181542 - RNA, 19 nt, Homo sapiens
gacacaagaccuacagaga

SEQ ID NO: 181543 - RNA, 19 nt, Homo sapiens
uaccuucucuuccauguca

SEQ ID NO: 181544 - RNA, 19 nt, Homo sapiens
caaagcagacccucaaacu

SEQ ID NO: 181545 - RNA, 19 nt, Homo sapiens
gugcaaaccugcccgucau

SEQ ID NO: 181546 - RNA, 19 nt, Homo sapiens
caagccagcuaccuucucu

SEQ ID NO: 181547 - RNA, 19 nt, Homo sapiens
gauaagggcgacagcaaca

SEQ ID NO: 181548 - RNA, 19 nt, Homo sapiens
ugaaugaugggcugacuga

SEQ ID NO: 181549 - RNA, 19 nt, Homo sapiens
gcacuuacccuuggaacag

SEQ ID NO: 181550 - RNA, 19 nt, Homo sapiens
ugccacggcugacugauau

SEQ ID NO: 181551 - RNA, 19 nt, Homo sapiens
ccucccagcucuccaagug

SEQ ID NO: 181552 - RNA, 19 nt, Homo sapiens
gugauaccguuuacagcuu

SEQ ID NO: 181553 - RNA, 19 nt, Homo sapiens
gaauguuguugguuugaac

SEQ ID NO: 181554 - RNA, 19 nt, Homo sapiens
ucucuuccaugucacacua

SEQ ID NO: 181555 - RNA, 19 nt, Homo sapiens
guucacgcaccaauucuaa

SEQ ID NO: 181556 - RNA, 19 nt, Homo sapiens
gcuuaacaccuuugugaau

SEQ ID NO: 181557 - RNA, 19 nt, Homo sapiens
acagaauguuguugguuug

SEQ ID NO: 181558 - RNA, 19 nt, Homo sapiens
gcucuagcuucccguauac

SEQ ID NO: 181559 - RNA, 19 nt, Homo sapiens
gcaacaugggcuugaguga

SEQ ID NO: 181560 - RNA, 19 nt, Homo sapiens
gcaacaaguauaccaagag

SEQ ID NO: 181561 - RNA, 19 nt, Homo sapiens
gauaccguuuacagcuuaa

SEQ ID NO: 181562 - RNA, 19 nt, Homo sapiens
cagcaaguggacagugaua

SEQ ID NO: 181563 - RNA, 19 nt, Homo sapiens
aaugggagcuuggaaugug

SEQ ID NO: 181564 - RNA, 19 nt, Homo sapiens
gaccuggacauguucaaug

SEQ ID NO: 181565 - RNA, 19 nt, Homo sapiens
cgaauucugucagcaacau

SEQ ID NO: 181566 - RNA, 19 nt, Homo sapiens
ccagcuaccuucucuucca

SEQ ID NO: 181567 - RNA, 19 nt, Homo sapiens
gcaaaggccggagcuccaa

SEQ ID NO: 181568 - RNA, 19 nt, Homo sapiens
aacaugggcuugagugagu

SEQ ID NO: 181569 - RNA, 19 nt, Homo sapiens
gauccgaugauguccuuug

SEQ ID NO: 181570 - RNA, 19 nt, Homo sapiens
gaacgugaugcuucgcaau

SEQ ID NO: 181571 - RNA, 19 nt, Homo sapiens
aaugaugggcugacugaaa

SEQ ID NO: 181572 - RNA, 19 nt, Homo sapiens
cgagcgaaacauaaacaaa

SEQ ID NO: 181573 - RNA, 19 nt, Homo sapiens
gugcccuacuucaaggaua

SEQ ID NO: 181574 - RNA, 19 nt, Homo sapiens
cuuaacaccuuugugaauc

SEQ ID NO: 181575 - RNA, 19 nt, Homo sapiens
gcaaagcagacccucaaac

SEQ ID NO: 181576 - RNA, 19 nt, Homo sapiens
cuaagcaggccucaucuca

SEQ ID NO: 181577 - RNA, 19 nt, Homo sapiens
ucaaugggagcuuggaaug

SEQ ID NO: 181578 - RNA, 19 nt, Homo sapiens
cgaagacagcacagacuug

SEQ ID NO: 181579 - RNA, 19 nt, Homo sapiens
ccuuggaacagaacucuaa

SEQ ID NO: 181580 - RNA, 19 nt, Homo sapiens
ucccucaucuccacacaga

SEQ ID NO: 181581 - RNA, 19 nt, Homo sapiens
ggaggaggacgaugaagac

SEQ ID NO: 181582 - RNA, 19 nt, Homo sapiens
gggauaaccaacucuccuu

SEQ ID NO: 181583 - RNA, 19 nt, Homo sapiens
agccgugccuugucgaauu

SEQ ID NO: 181584 - RNA, 19 nt, Homo sapiens
gcuaccuucucuuccaugu

SEQ ID NO: 181585 - RNA, 19 nt, Homo sapiens
ggcccgagcgaaacauaaa

SEQ ID NO: 181586 - RNA, 19 nt, Homo sapiens
ugcccuacuucaaggauaa

SEQ ID NO: 181587 - RNA, 19 nt, Homo sapiens
agaaugcaaaccacacaaa

SEQ ID NO: 181588 - RNA, 19 nt, Homo sapiens
gaacucauggaugcugaug

SEQ ID NO: 181589 - RNA, 19 nt, Homo sapiens
gagaaugcaaaccacacaa

SEQ ID NO: 181590 - RNA, 19 nt, Homo sapiens
ccgaggaggaggacgauga

SEQ ID NO: 181591 - RNA, 19 nt, Homo sapiens
acuuggaccuggacauguu

SEQ ID NO: 181592 - RNA, 19 nt, Homo sapiens
agaacaagccagcuaccuu

SEQ ID NO: 181593 - RNA, 19 nt, Homo sapiens
cagccugucaccuucagua

SEQ ID NO: 181594 - RNA, 19 nt, Homo sapiens
cagcucagccagccuguca

SEQ ID NO: 181595 - RNA, 19 nt, Homo sapiens
uggacaauagcaacaagua

SEQ ID NO: 181596 - RNA, 19 nt, Homo sapiens
agaauguuguugguuugaa

SEQ ID NO: 181597 - RNA, 19 nt, Homo sapiens
gggcagccgaggaaauguu

SEQ ID NO: 181598 - RNA, 19 nt, Homo sapiens
cgacuuggaccuggacaug

SEQ ID NO: 181599 - RNA, 19 nt, Homo sapiens
gccgugccuugucgaauuc

SEQ ID NO: 181600 - RNA, 19 nt, Homo sapiens
ccaugcagaccauccaaga

SEQ ID NO: 181601 - RNA, 19 nt, Homo sapiens
caagcacagaguuggauga

SEQ ID NO: 181602 - RNA, 19 nt, Homo sapiens
gaagcacuuacccuuggaa

SEQ ID NO: 181603 - RNA, 19 nt, Homo sapiens
gaaugcaaaccacacaaaa

SEQ ID NO: 181604 - RNA, 19 nt, Homo sapiens
caccaugaaucugaaugau

SEQ ID NO: 181605 - RNA, 19 nt, Homo sapiens
ugaagcacuuacccuugga

SEQ ID NO: 181606 - RNA, 19 nt, Homo sapiens
ggaacuucacuggugcuaa

SEQ ID NO: 181607 - RNA, 19 nt, Homo sapiens
gaaggcaacuuacuguaua

SEQ ID NO: 181608 - RNA, 19 nt, Homo sapiens
gaacauggauggcaaggaa

SEQ ID NO: 181609 - RNA, 19 nt, Homo sapiens
ggaaaugcguguaacagua

SEQ ID NO: 181610 - RNA, 19 nt, Homo sapiens
gaaagaagcuguacguuuu

SEQ ID NO: 181611 - RNA, 19 nt, Homo sapiens
ggauagaaccuuuguauuu

SEQ ID NO: 181612 - RNA, 19 nt, Homo sapiens
ggacauauguggccuugaa

SEQ ID NO: 181613 - RNA, 19 nt, Homo sapiens
ccacgugccuucacacuua

SEQ ID NO: 181614 - RNA, 19 nt, Homo sapiens
gcagguaauuguugacuuu

SEQ ID NO: 181615 - RNA, 19 nt, Homo sapiens
gaaagaagguuuguguguu

SEQ ID NO: 181616 - RNA, 19 nt, Homo sapiens
gauagaaccuuuguauuug

SEQ ID NO: 181617 - RNA, 19 nt, Homo sapiens
caaauggacgggacuauua

SEQ ID NO: 181618 - RNA, 19 nt, Homo sapiens
caaagaagaccauguugua

SEQ ID NO: 181619 - RNA, 19 nt, Homo sapiens
gcacucagcugaccacucu

SEQ ID NO: 181620 - RNA, 19 nt, Homo sapiens
aaagaagguuuguguguuu

SEQ ID NO: 181621 - RNA, 19 nt, Homo sapiens
gugggaagcuuauaaucua

SEQ ID NO: 181622 - RNA, 19 nt, Homo sapiens
caaacgaucaguaagaaua

SEQ ID NO: 181623 - RNA, 19 nt, Homo sapiens
uaacaguacugcaauaauc

SEQ ID NO: 181624 - RNA, 19 nt, Homo sapiens
ggacuuaacccgucauguu

SEQ ID NO: 181625 - RNA, 19 nt, Homo sapiens
gauggcaacuggaacauug

SEQ ID NO: 181626 - RNA, 19 nt, Homo sapiens
gcacaaacgaucaguaaga

SEQ ID NO: 181627 - RNA, 19 nt, Homo sapiens
caacaugaauuacgacaag

SEQ ID NO: 181628 - RNA, 19 nt, Homo sapiens
guucacugcuggccuauaa

SEQ ID NO: 181629 - RNA, 19 nt, Homo sapiens
gucaagauaugaacuaaga

SEQ ID NO: 181630 - RNA, 19 nt, Homo sapiens
ccaaagcaguuucuuguca

SEQ ID NO: 181631 - RNA, 19 nt, Homo sapiens
gcaagcccaacaugaauua

SEQ ID NO: 181632 - RNA, 19 nt, Homo sapiens
uaagauuacuggaaugguu

SEQ ID NO: 181633 - RNA, 19 nt, Homo sapiens
ccaaucagaaggcaacuua

SEQ ID NO: 181634 - RNA, 19 nt, Homo sapiens
ggaauuugauggaaagaag

SEQ ID NO: 181635 - RNA, 19 nt, Homo sapiens
gggaaaagauaauccauuu

SEQ ID NO: 181636 - RNA, 19 nt, Homo sapiens
ggaaagaagguuugugugu

SEQ ID NO: 181637 - RNA, 19 nt, Homo sapiens
ugaccacucucucuagaaa

SEQ ID NO: 181638 - RNA, 19 nt, Homo sapiens
ucacccaacuggaauuuga

SEQ ID NO: 181639 - RNA, 19 nt, Homo sapiens
caaguacccuucugacauc

SEQ ID NO: 181640 - RNA, 19 nt, Homo sapiens
gaucuuuaaugcuuuggaa

SEQ ID NO: 181641 - RNA, 19 nt, Homo sapiens
gaaucaaucgcuguuauuu

SEQ ID NO: 181642 - RNA, 19 nt, Homo sapiens
guagggauuucuaaacuca

SEQ ID NO: 181643 - RNA, 19 nt, Homo sapiens
ggagaucgacacauccuuu

SEQ ID NO: 181644 - RNA, 19 nt, Homo sapiens
caacuggaauuugauggaa

SEQ ID NO: 181645 - RNA, 19 nt, Homo sapiens
caaagcaguuucuugucaa

SEQ ID NO: 181646 - RNA, 19 nt, Homo sapiens
ccuagcaucuugugaguug

SEQ ID NO: 181647 - RNA, 19 nt, Homo sapiens
gggcacaaacgaucaguaa

SEQ ID NO: 181648 - RNA, 19 nt, Homo sapiens
gcaaggaacuguguaaaau

SEQ ID NO: 181649 - RNA, 19 nt, Homo sapiens
agaaagaagcuguacguuu

SEQ ID NO: 181650 - RNA, 19 nt, Homo sapiens
gaacuacaacagcuauaug

SEQ ID NO: 181651 - RNA, 19 nt, Homo sapiens
guguuaagcugacaacugu

SEQ ID NO: 181652 - RNA, 19 nt, Homo sapiens
cauuugggcugucuuguau

SEQ ID NO: 181653 - RNA, 19 nt, Homo sapiens
gaccaaagcaguuucuugu

SEQ ID NO: 181654 - RNA, 19 nt, Homo sapiens
ggacucaacaggacauaug

SEQ ID NO: 181655 - RNA, 19 nt, Homo sapiens
gcaacuggaacauugauug

SEQ ID NO: 181656 - RNA, 19 nt, Homo sapiens
gguuugagauuuagugaca

SEQ ID NO: 181657 - RNA, 19 nt, Homo sapiens
ucuugugaguugcauauua

SEQ ID NO: 181658 - RNA, 19 nt, Homo sapiens
cacaaacgaucaguaagaa

SEQ ID NO: 181659 - RNA, 19 nt, Homo sapiens
uaauaugccuauagcugaa

SEQ ID NO: 181660 - RNA, 19 nt, Homo sapiens
cuugugaguugcauauuaa

SEQ ID NO: 181661 - RNA, 19 nt, Homo sapiens
uaacaggcauacacaagca

SEQ ID NO: 181662 - RNA, 19 nt, Homo sapiens
ccgguggacugcagcguua

SEQ ID NO: 181663 - RNA, 19 nt, Homo sapiens
acuggaacauugauuguaa

SEQ ID NO: 181664 - RNA, 19 nt, Homo sapiens
ggacugcagcguuagcaaa

SEQ ID NO: 181665 - RNA, 19 nt, Homo sapiens
gaccagggccaaccaauca

SEQ ID NO: 181666 - RNA, 19 nt, Homo sapiens
auacauacauuccugaaag

SEQ ID NO: 181667 - RNA, 19 nt, Homo sapiens
gcagaguuauuuuccuaua

SEQ ID NO: 181668 - RNA, 19 nt, Homo sapiens
ucacugcuggccuauaaua

SEQ ID NO: 181669 - RNA, 19 nt, Homo sapiens
aaagcaagcccaacaugaa

SEQ ID NO: 181670 - RNA, 19 nt, Homo sapiens
ccaagggcauugcagaauc

SEQ ID NO: 181671 - RNA, 19 nt, Homo sapiens
guguaacaguacugcaaua

SEQ ID NO: 181672 - RNA, 19 nt, Homo sapiens
gaaaugcguguaacaguac

SEQ ID NO: 181673 - RNA, 19 nt, Homo sapiens
accacucucucuagaaaua

SEQ ID NO: 181674 - RNA, 19 nt, Homo sapiens
gcugaccacucucucuaga

SEQ ID NO: 181675 - RNA, 19 nt, Homo sapiens
agucguccauguacaagua

SEQ ID NO: 181676 - RNA, 19 nt, Homo sapiens
ucaagcagauucgcaagug

SEQ ID NO: 181677 - RNA, 19 nt, Homo sapiens
aagaagguuuguguguuua

SEQ ID NO: 181678 - RNA, 19 nt, Homo sapiens
cagcaggaguggaucaauc

SEQ ID NO: 181679 - RNA, 19 nt, Homo sapiens
gauguucuuucuuguugga

SEQ ID NO: 181680 - RNA, 19 nt, Homo sapiens
aagaagaccauguuguaaa

SEQ ID NO: 181681 - RNA, 19 nt, Homo sapiens
uggauguucuuucuuguug

SEQ ID NO: 181682 - RNA, 19 nt, Homo sapiens
cggaagugcuguugucaca

SEQ ID NO: 181683 - RNA, 19 nt, Homo sapiens
aaagaagaccauguuguaa

SEQ ID NO: 181684 - RNA, 19 nt, Homo sapiens
aaauagaggugggaagcuu

SEQ ID NO: 181685 - RNA, 19 nt, Homo sapiens
ugacuuaugagaaagcaaa

SEQ ID NO: 181686 - RNA, 19 nt, Homo sapiens
ucgaaucaaucgcuguuau

SEQ ID NO: 181687 - RNA, 19 nt, Homo sapiens
ugggcugucuuguauguuu

SEQ ID NO: 181688 - RNA, 19 nt, Homo sapiens
uccuauaucucacaguauu

SEQ ID NO: 181689 - RNA, 19 nt, Homo sapiens
uuuccuauaucucacagua

SEQ ID NO: 181690 - RNA, 19 nt, Homo sapiens
uuucuaaacucaagcagau

SEQ ID NO: 181691 - RNA, 19 nt, Homo sapiens
gaagguuuguguguuuaag

SEQ ID NO: 181692 - RNA, 19 nt, Homo sapiens
gaccaaagugcacggcaaa

SEQ ID NO: 181693 - RNA, 19 nt, Homo sapiens
cgaaucaaucgcuguuauu

SEQ ID NO: 181694 - RNA, 19 nt, Homo sapiens
acagcuauauggacgagaa

SEQ ID NO: 181695 - RNA, 19 nt, Homo sapiens
gaaagacggggaauuaaau

SEQ ID NO: 181696 - RNA, 19 nt, Homo sapiens
gcuguaaccgggucaaugu

SEQ ID NO: 181697 - RNA, 19 nt, Homo sapiens
cugcagacuuggccaaaug

SEQ ID NO: 181698 - RNA, 19 nt, Homo sapiens
acacagaaucauggacuua

SEQ ID NO: 181699 - RNA, 19 nt, Homo sapiens
gcaguuucuugucaauaca

SEQ ID NO: 181700 - RNA, 19 nt, Homo sapiens
ccaaauggacgggacuauu

SEQ ID NO: 181701 - RNA, 19 nt, Homo sapiens
gaauucuggccucaacaaa

SEQ ID NO: 181702 - RNA, 19 nt, Homo sapiens
ucaguuaccucagggaaag

SEQ ID NO: 181703 - RNA, 19 nt, Homo sapiens
aaugguuccuucucucaaa

SEQ ID NO: 181704 - RNA, 19 nt, Homo sapiens
ggauuuuccugcucuauau

SEQ ID NO: 181705 - RNA, 19 nt, Homo sapiens
agaaagcaaagcacuggua

SEQ ID NO: 181706 - RNA, 19 nt, Homo sapiens
gccuauagcugaaaaggaa

SEQ ID NO: 181707 - RNA, 19 nt, Homo sapiens
ccaacaagcuggacuuuga

SEQ ID NO: 181708 - RNA, 19 nt, Homo sapiens
gaaaucagcucaccucacu

SEQ ID NO: 181709 - RNA, 19 nt, Homo sapiens
ugaagaagcuguaccugaa

SEQ ID NO: 181710 - RNA, 19 nt, Homo sapiens
caaccucacugaccuacua

SEQ ID NO: 181711 - RNA, 19 nt, Homo sapiens
gcaagcagguuaucaacga

SEQ ID NO: 181712 - RNA, 19 nt, Homo sapiens
ccaaguuccugucccauuu

SEQ ID NO: 181713 - RNA, 19 nt, Homo sapiens
gcacagaagcccuaugaug

SEQ ID NO: 181714 - RNA, 19 nt, Homo sapiens
ccaacagucugaagaauuc

SEQ ID NO: 181715 - RNA, 19 nt, Homo sapiens
gccaggagcucccagaguu

SEQ ID NO: 181716 - RNA, 19 nt, Homo sapiens
aagaugaccuggcagauga

SEQ ID NO: 181717 - RNA, 19 nt, Homo sapiens
gccaagaggucuacaugug

SEQ ID NO: 181718 - RNA, 19 nt, Homo sapiens
cauccacgcugucaacuug

SEQ ID NO: 181719 - RNA, 19 nt, Homo sapiens
ucaccaaccuggaagaguu

SEQ ID NO: 181720 - RNA, 19 nt, Homo sapiens
gaugaaggcugaccucacu

SEQ ID NO: 181721 - RNA, 19 nt, Homo sapiens
ccaaccagcucuucaucaa

SEQ ID NO: 181722 - RNA, 19 nt, Homo sapiens
gaagaaagaccagaugaag

SEQ ID NO: 181723 - RNA, 19 nt, Homo sapiens
gaauugggacgauguguug

SEQ ID NO: 181724 - RNA, 19 nt, Homo sapiens
uaacaagaaugagcggaaa

SEQ ID NO: 181725 - RNA, 19 nt, Homo sapiens
gaggcugacugcuacauug

SEQ ID NO: 181726 - RNA, 19 nt, Homo sapiens
gggaggagaugggcgauga

SEQ ID NO: 181727 - RNA, 19 nt, Homo sapiens
ggauaaagcagauguggau

SEQ ID NO: 181728 - RNA, 19 nt, Homo sapiens
ugagaaaugcuccgacuuu

SEQ ID NO: 181729 - RNA, 19 nt, Homo sapiens
ucacugcccucagccauuu

SEQ ID NO: 181730 - RNA, 19 nt, Homo sapiens
cacagaagcccuaugauga

SEQ ID NO: 181731 - RNA, 19 nt, Homo sapiens
ggagaucuacuacuggauu

SEQ ID NO: 181732 - RNA, 19 nt, Homo sapiens
ggaugcccuuuaagagaua

SEQ ID NO: 181733 - RNA, 19 nt, Homo sapiens
gagaagaaagaccagauga

SEQ ID NO: 181734 - RNA, 19 nt, Homo sapiens
gaaacacacacgucucuuc

SEQ ID NO: 181735 - RNA, 19 nt, Homo sapiens
caggauguaucguguguau

SEQ ID NO: 181736 - RNA, 19 nt, Homo sapiens
ccaacucucuccacagugu

SEQ ID NO: 181737 - RNA, 19 nt, Homo sapiens
ucaagaccuuucuggauga

SEQ ID NO: 181738 - RNA, 19 nt, Homo sapiens
gcccaaagcugaggaaacu

SEQ ID NO: 181739 - RNA, 19 nt, Homo sapiens
agauguggaugcccuuuaa

SEQ ID NO: 181740 - RNA, 19 nt, Homo sapiens
caacgagaagggcuacuuu

SEQ ID NO: 181741 - RNA, 19 nt, Homo sapiens
ggagaaggccgagggcaaa

SEQ ID NO: 181742 - RNA, 19 nt, Homo sapiens
gagaucuacuacuggauug

SEQ ID NO: 181743 - RNA, 19 nt, Homo sapiens
gugaggagccugagaacuu

SEQ ID NO: 181744 - RNA, 19 nt, Homo sapiens
ccucugagaucaagaagca

SEQ ID NO: 181745 - RNA, 19 nt, Homo sapiens
gcacaugcgguccaaggaa

SEQ ID NO: 181746 - RNA, 19 nt, Homo sapiens
gggcaaagaaggcgaggaa

SEQ ID NO: 181747 - RNA, 19 nt, Homo sapiens
ggaaagggaaggcugagau

SEQ ID NO: 181748 - RNA, 19 nt, Homo sapiens
gcagaagacauccugaaca

SEQ ID NO: 181749 - RNA, 19 nt, Homo sapiens
cuggaacacuugucuguga

SEQ ID NO: 181750 - RNA, 19 nt, Homo sapiens
ugaagggcaugucagaugu

SEQ ID NO: 181751 - RNA, 19 nt, Homo sapiens
ggaguggaacgaagaccua

SEQ ID NO: 181752 - RNA, 19 nt, Homo sapiens
caacgacaucuccuacauu

SEQ ID NO: 181753 - RNA, 19 nt, Homo sapiens
ggagaacgccaagaacaug

SEQ ID NO: 181754 - RNA, 19 nt, Homo sapiens
gaaggccgagggcaaagaa

SEQ ID NO: 181755 - RNA, 19 nt, Homo sapiens
ggauguaucguguguaugg

SEQ ID NO: 181756 - RNA, 19 nt, Homo sapiens
aacgacaucuccuacauug

SEQ ID NO: 181757 - RNA, 19 nt, Homo sapiens
ugcagaagcuggaacacuu

SEQ ID NO: 181758 - RNA, 19 nt, Homo sapiens
cgugaagccuccaauaugg

SEQ ID NO: 181759 - RNA, 19 nt, Homo sapiens
gcucaagaccuuucuggau

SEQ ID NO: 181760 - RNA, 19 nt, Homo sapiens
ccaaagcugaggaaacuug

SEQ ID NO: 181761 - RNA, 19 nt, Homo sapiens
guaccugaauuccaacaag

SEQ ID NO: 181762 - RNA, 19 nt, Homo sapiens
aagaagcuguaccugaauu

SEQ ID NO: 181763 - RNA, 19 nt, Homo sapiens
gagaaaugcuccgacuuuu

SEQ ID NO: 181764 - RNA, 19 nt, Homo sapiens
gaaagggaaggcugagauc

SEQ ID NO: 181765 - RNA, 19 nt, Homo sapiens
gaagaagcuguaccugaau

SEQ ID NO: 181766 - RNA, 19 nt, Homo sapiens
gagccaacagucugaagaa

SEQ ID NO: 181767 - RNA, 19 nt, Homo sapiens
gaagcccuaugaugacgau

SEQ ID NO: 181768 - RNA, 19 nt, Homo sapiens
caaguuggcagaagacauc

SEQ ID NO: 181769 - RNA, 19 nt, Homo sapiens
aggccaaguucaagaauug

SEQ ID NO: 181770 - RNA, 19 nt, Homo sapiens
ugccacagaucaacuacaa

SEQ ID NO: 181771 - RNA, 19 nt, Homo sapiens
agaagcacgugccugaaga

SEQ ID NO: 181772 - RNA, 19 nt, Homo sapiens
gccaacagucugaagaauu

SEQ ID NO: 181773 - RNA, 19 nt, Homo sapiens
gcuagacaauggccaagag

SEQ ID NO: 181774 - RNA, 19 nt, Homo sapiens
caagcagguuaucaacgaa

SEQ ID NO: 181775 - RNA, 19 nt, Homo sapiens
cagaagacauccugaacac

SEQ ID NO: 181776 - RNA, 19 nt, Homo sapiens
gaaacgcgacgccgagaag

SEQ ID NO: 181777 - RNA, 19 nt, Homo sapiens
gcagaagcuggaacacuug

SEQ ID NO: 181778 - RNA, 19 nt, Homo sapiens
caagaugaccuggcagaug

SEQ ID NO: 181779 - RNA, 19 nt, Homo sapiens
caaagaaggcgaggaagca

SEQ ID NO: 181780 - RNA, 19 nt, Homo sapiens
gagcugaugccaagaaugc

SEQ ID NO: 181781 - RNA, 19 nt, Homo sapiens
cgacaucuccuacauugag

SEQ ID NO: 181782 - RNA, 19 nt, Homo sapiens
gcgaugagagcgaggaguu

SEQ ID NO: 181783 - RNA, 19 nt, Homo sapiens
guggaucuguccugcaaug

SEQ ID NO: 181784 - RNA, 19 nt, Homo sapiens
ggaccgagggcuagacauc

SEQ ID NO: 181785 - RNA, 19 nt, Homo sapiens
ggagaucgagguccuggau

SEQ ID NO: 181786 - RNA, 19 nt, Homo sapiens
ucacugaccuacuauaccu

SEQ ID NO: 181787 - RNA, 19 nt, Homo sapiens
ugacgcagcagcaggagaa

SEQ ID NO: 181788 - RNA, 19 nt, Homo sapiens
gagaaugucaaggccauga

SEQ ID NO: 181789 - RNA, 19 nt, Homo sapiens
ggagcugucccugugcaua

SEQ ID NO: 181790 - RNA, 19 nt, Homo sapiens
uggaugcccuuuaagagau

SEQ ID NO: 181791 - RNA, 19 nt, Homo sapiens
guggaugcccuuuaagaga

SEQ ID NO: 181792 - RNA, 19 nt, Homo sapiens
ugaggagccugagaacuuc

SEQ ID NO: 181793 - RNA, 19 nt, Homo sapiens
agaacaugcuggugcugaa

SEQ ID NO: 181794 - RNA, 19 nt, Homo sapiens
acaacgacaucuccuacau

SEQ ID NO: 181795 - RNA, 19 nt, Homo sapiens
caaccagggcaucguguau

SEQ ID NO: 181796 - RNA, 19 nt, Homo sapiens
aaaagaacaucaaguugga

SEQ ID NO: 181797 - RNA, 19 nt, Homo sapiens
gcugucaacuugcgcaacu

SEQ ID NO: 181798 - RNA, 19 nt, Homo sapiens
gaagggcaugucagauguu

SEQ ID NO: 181799 - RNA, 19 nt, Homo sapiens
gaaccugucccgaaaucag

SEQ ID NO: 181800 - RNA, 19 nt, Homo sapiens
caagaggaaguucaucauc

SEQ ID NO: 181801 - RNA, 19 nt, Homo sapiens
uagacggcauggaggguuu

SEQ ID NO: 181802 - RNA, 19 nt, Homo sapiens
gguccgacguguucaucug

SEQ ID NO: 181803 - RNA, 19 nt, Homo sapiens
gcagagaaaauuaacaaga

SEQ ID NO: 181804 - RNA, 19 nt, Homo sapiens
gcacuggccucugcuaccu

SEQ ID NO: 181805 - RNA, 19 nt, Homo sapiens
ucaacugggagaucuacua

SEQ ID NO: 181806 - RNA, 19 nt, Homo sapiens
gacagcggcucccucaacu

SEQ ID NO: 181807 - RNA, 19 nt, Homo sapiens
caagccaucucuaauaaua

SEQ ID NO: 181808 - RNA, 19 nt, Homo sapiens
guaaauccaugguguuauu

SEQ ID NO: 181809 - RNA, 19 nt, Homo sapiens
ccaaaucccucucacaaga

SEQ ID NO: 181810 - RNA, 19 nt, Homo sapiens
gaggaaaugaugagaaaua

SEQ ID NO: 181811 - RNA, 19 nt, Homo sapiens
cagaagaaaucauaaagga

SEQ ID NO: 181812 - RNA, 19 nt, Homo sapiens
gagacaugcugaaauuauu

SEQ ID NO: 181813 - RNA, 19 nt, Homo sapiens
caaugugccuuaacaagaa

SEQ ID NO: 181814 - RNA, 19 nt, Homo sapiens
acacagaauuguuccagua

SEQ ID NO: 181815 - RNA, 19 nt, Homo sapiens
acaagaaugugcagaagaa

SEQ ID NO: 181816 - RNA, 19 nt, Homo sapiens
ccaaagugcuggaauuaca

SEQ ID NO: 181817 - RNA, 19 nt, Homo sapiens
gugaggaaaugaugagaaa

SEQ ID NO: 181818 - RNA, 19 nt, Homo sapiens
gcuacuauguacugccuua

SEQ ID NO: 181819 - RNA, 19 nt, Homo sapiens
gaucuuggcucaccauaac

SEQ ID NO: 181820 - RNA, 19 nt, Homo sapiens
ccugagacaugcugaaauu

SEQ ID NO: 181821 - RNA, 19 nt, Homo sapiens
gaaacucucugcagaacag

SEQ ID NO: 181822 - RNA, 19 nt, Homo sapiens
cacuaugccugacuaauuu

SEQ ID NO: 181823 - RNA, 19 nt, Homo sapiens
caucuaauguucuccuuug

SEQ ID NO: 181824 - RNA, 19 nt, Homo sapiens
aagcaauucuccugccuua

SEQ ID NO: 181825 - RNA, 19 nt, Homo sapiens
ccacuaugccugacuaauu

SEQ ID NO: 181826 - RNA, 19 nt, Homo sapiens
guacuaaucaugugaggaa

SEQ ID NO: 181827 - RNA, 19 nt, Homo sapiens
cagaauuguuccaguacua

SEQ ID NO: 181828 - RNA, 19 nt, Homo sapiens
ggagugcucacaaaggaua

SEQ ID NO: 181829 - RNA, 19 nt, Homo sapiens
gagguaauguuaguaaauc

SEQ ID NO: 181830 - RNA, 19 nt, Homo sapiens
gccauccaauuucucuuua

SEQ ID NO: 181831 - RNA, 19 nt, Homo sapiens
cauaaaggaucagagauuc

SEQ ID NO: 181832 - RNA, 19 nt, Homo sapiens
cuucaaggcucaaugcuau

SEQ ID NO: 181833 - RNA, 19 nt, Homo sapiens
ucaagaacaugucagcaau

SEQ ID NO: 181834 - RNA, 19 nt, Homo sapiens
ugcaagccaucucuaauaa

SEQ ID NO: 181835 - RNA, 19 nt, Homo sapiens
caagaaggguuugaucauc

SEQ ID NO: 181836 - RNA, 19 nt, Homo sapiens
ggcuggauccuauaucuua

SEQ ID NO: 181837 - RNA, 19 nt, Homo sapiens
uacagagccuugauggaua

SEQ ID NO: 181838 - RNA, 19 nt, Homo sapiens
ccaaugcuccaccugcuua

SEQ ID NO: 181839 - RNA, 19 nt, Homo sapiens
gcucaaugcuauucuaacu

SEQ ID NO: 181840 - RNA, 19 nt, Homo sapiens
gcuaauaacaaacuaguca

SEQ ID NO: 181841 - RNA, 19 nt, Homo sapiens
acaagaagaugcccacaag

SEQ ID NO: 181842 - RNA, 19 nt, Homo sapiens
cuaauguucuccuuuggaa

SEQ ID NO: 181843 - RNA, 19 nt, Homo sapiens
acagagccuugauggauaa

SEQ ID NO: 181844 - RNA, 19 nt, Homo sapiens
guagaagacgaaauggaua

SEQ ID NO: 181845 - RNA, 19 nt, Homo sapiens
ggauaaaagucuucauguu

SEQ ID NO: 181846 - RNA, 19 nt, Homo sapiens
gcagucuaauuacauuuca

SEQ ID NO: 181847 - RNA, 19 nt, Homo sapiens
cauauaacgcagucuaauu

SEQ ID NO: 181848 - RNA, 19 nt, Homo sapiens
ccagagguaauguuaguaa

SEQ ID NO: 181849 - RNA, 19 nt, Homo sapiens
ccuacaagaugccaagaga

SEQ ID NO: 181850 - RNA, 19 nt, Homo sapiens
agaaauugguagaaggauu

SEQ ID NO: 181851 - RNA, 19 nt, Homo sapiens
aggguugacuggccuauuu

SEQ ID NO: 181852 - RNA, 19 nt, Homo sapiens
gaaccuugaccgacaugaa

SEQ ID NO: 181853 - RNA, 19 nt, Homo sapiens
ggaaaacuccaucaauaaa

SEQ ID NO: 181854 - RNA, 19 nt, Homo sapiens
gaacagucaccaccaccuu

SEQ ID NO: 181855 - RNA, 19 nt, Homo sapiens
gauaaaagucuucauguug

SEQ ID NO: 181856 - RNA, 19 nt, Homo sapiens
ucauaaaggaucagagauu

SEQ ID NO: 181857 - RNA, 19 nt, Homo sapiens
aaauguaccuauggcaauu

SEQ ID NO: 181858 - RNA, 19 nt, Homo sapiens
ugggaaaacuccaucaaua

SEQ ID NO: 181859 - RNA, 19 nt, Homo sapiens
ucaaugugccuuaacaaga

SEQ ID NO: 181860 - RNA, 19 nt, Homo sapiens
gcucaucggcuguugguau

SEQ ID NO: 181861 - RNA, 19 nt, Homo sapiens
uccaauuucucuuuacuug

SEQ ID NO: 181862 - RNA, 19 nt, Homo sapiens
cagagguaauguuaguaaa

SEQ ID NO: 181863 - RNA, 19 nt, Homo sapiens
cuaaucaugugaggaaaug

SEQ ID NO: 181864 - RNA, 19 nt, Homo sapiens
caagagaagaugcucacuu

SEQ ID NO: 181865 - RNA, 19 nt, Homo sapiens
ugucagcaaugucucuuug

SEQ ID NO: 181866 - RNA, 19 nt, Homo sapiens
auaacaaacuagucagguu

SEQ ID NO: 181867 - RNA, 19 nt, Homo sapiens
aagaagaugcccacaagaa

SEQ ID NO: 181868 - RNA, 19 nt, Homo sapiens
gcgccacuaugccugacua

SEQ ID NO: 181869 - RNA, 19 nt, Homo sapiens
ugagauggaguuucgcuuu

SEQ ID NO: 181870 - RNA, 19 nt, Homo sapiens
ugagacaugcugaaauuau

SEQ ID NO: 181871 - RNA, 19 nt, Homo sapiens
gacauauaacgcagucuaa

SEQ ID NO: 181872 - RNA, 19 nt, Homo sapiens
ugccuuagccuccugagua

SEQ ID NO: 181873 - RNA, 19 nt, Homo sapiens
gagauggaguuucgcuuuu

SEQ ID NO: 181874 - RNA, 19 nt, Homo sapiens
uaguaaauccaugguguua

SEQ ID NO: 181875 - RNA, 19 nt, Homo sapiens
aagacgaaauggauacaga

SEQ ID NO: 181876 - RNA, 19 nt, Homo sapiens
gcagaagaaaucauaaagg

SEQ ID NO: 181877 - RNA, 19 nt, Homo sapiens
ugacuggccuauuuaucug

SEQ ID NO: 181878 - RNA, 19 nt, Homo sapiens
gcccugacccuacaagaug

SEQ ID NO: 181879 - RNA, 19 nt, Homo sapiens
ugaccgacaugaacuguac

SEQ ID NO: 181880 - RNA, 19 nt, Homo sapiens
ggccauccaauuucucuuu

SEQ ID NO: 181881 - RNA, 19 nt, Homo sapiens
gggaaaacuccaucaauaa

SEQ ID NO: 181882 - RNA, 19 nt, Homo sapiens
gcgagacaccugagacaug

SEQ ID NO: 181883 - RNA, 19 nt, Homo sapiens
gaaaucauaaaggaucaga

SEQ ID NO: 181884 - RNA, 19 nt, Homo sapiens
gugcagaagaaaucauaaa

SEQ ID NO: 181885 - RNA, 19 nt, Homo sapiens
ucagcaaugucucuuugug

SEQ ID NO: 181886 - RNA, 19 nt, Homo sapiens
caaaucccucucacaagaa

SEQ ID NO: 181887 - RNA, 19 nt, Homo sapiens
uaaauguaccuauggcaau

SEQ ID NO: 181888 - RNA, 19 nt, Homo sapiens
uaacgcagucuaauuacau

SEQ ID NO: 181889 - RNA, 19 nt, Homo sapiens
gcaauucuccugccuuagc

SEQ ID NO: 181890 - RNA, 19 nt, Homo sapiens
caagaugccaagagaagau

SEQ ID NO: 181891 - RNA, 19 nt, Homo sapiens
acuauggagugcucacaaa

SEQ ID NO: 181892 - RNA, 19 nt, Homo sapiens
uagcaguacuaaucaugug

SEQ ID NO: 181893 - RNA, 19 nt, Homo sapiens
aaucauaaaggaucagaga

SEQ ID NO: 181894 - RNA, 19 nt, Homo sapiens
ccagaaauugguagaagga

SEQ ID NO: 181895 - RNA, 19 nt, Homo sapiens
cugaguagcugggauuaca

SEQ ID NO: 181896 - RNA, 19 nt, Homo sapiens
gcaagccaucucuaauaau

SEQ ID NO: 181897 - RNA, 19 nt, Homo sapiens
augcaagccaucucuaaua

SEQ ID NO: 181898 - RNA, 19 nt, Homo sapiens
aaaugcaagccaucucuaa

SEQ ID NO: 181899 - RNA, 19 nt, Homo sapiens
cuacuaaaccagaaauugg

SEQ ID NO: 181900 - RNA, 19 nt, Homo sapiens
cagcaaagugucucuucaa

SEQ ID NO: 181901 - RNA, 19 nt, Homo sapiens
ggguugacuggccuauuua

SEQ ID NO: 181902 - RNA, 19 nt, Homo sapiens
ucccaaagugcuggaauua

SEQ ID NO: 181903 - RNA, 19 nt, Homo sapiens
caagaacaugucagcaaug

SEQ ID NO: 181904 - RNA, 19 nt, Homo sapiens
auacagagccuugauggau

SEQ ID NO: 181905 - RNA, 19 nt, Homo sapiens
ugccuuaaauguaccuaug

SEQ ID NO: 181906 - RNA, 19 nt, Homo sapiens
gaauuguuccaguacuaug

SEQ ID NO: 181907 - RNA, 19 nt, Homo sapiens
ggaagaagauccagcagaa

SEQ ID NO: 181908 - RNA, 19 nt, Homo sapiens
gcaaauacgucaucugugu

SEQ ID NO: 181909 - RNA, 19 nt, Homo sapiens
gcgcggagcugaccauuga

SEQ ID NO: 181910 - RNA, 19 nt, Homo sapiens
ccaacaaggucaaaguaua

SEQ ID NO: 181911 - RNA, 19 nt, Homo sapiens
gcacccagaccgucaauua

SEQ ID NO: 181912 - RNA, 19 nt, Homo sapiens
ggagacagcugacuucaag

SEQ ID NO: 181913 - RNA, 19 nt, Homo sapiens
gcaggaggcuggcgaguau

SEQ ID NO: 181914 - RNA, 19 nt, Homo sapiens
guauggagaugaagaggua

SEQ ID NO: 181915 - RNA, 19 nt, Homo sapiens
ucacagaaauugaccaaga

SEQ ID NO: 181916 - RNA, 19 nt, Homo sapiens
gaauggcguuuaccugauu

SEQ ID NO: 181917 - RNA, 19 nt, Homo sapiens
caacaagaccaccuacuuu

SEQ ID NO: 181918 - RNA, 19 nt, Homo sapiens
ggacggcacuuucgacauc

SEQ ID NO: 181919 - RNA, 19 nt, Homo sapiens
gcaacuacaucaucaacau

SEQ ID NO: 181920 - RNA, 19 nt, Homo sapiens
caccaucacugacaacaaa

SEQ ID NO: 181921 - RNA, 19 nt, Homo sapiens
caaaguggcauccaagauu

SEQ ID NO: 181922 - RNA, 19 nt, Homo sapiens
gaaccuauaucgucaccau

SEQ ID NO: 181923 - RNA, 19 nt, Homo sapiens
ggagugcuaugucacagaa

SEQ ID NO: 181924 - RNA, 19 nt, Homo sapiens
ccaacaagcccaacaaguu

SEQ ID NO: 181925 - RNA, 19 nt, Homo sapiens
gaucgaaugugacgacaag

SEQ ID NO: 181926 - RNA, 19 nt, Homo sapiens
gaagaagacacacauccaa

SEQ ID NO: 181927 - RNA, 19 nt, Homo sapiens
gcacaccauuaccuacauu

SEQ ID NO: 181928 - RNA, 19 nt, Homo sapiens
gaagguggacguuggcaaa

SEQ ID NO: 181929 - RNA, 19 nt, Homo sapiens
gacaacaccuacacaguca

SEQ ID NO: 181930 - RNA, 19 nt, Homo sapiens
cugcagaguuuaucauuga

SEQ ID NO: 181931 - RNA, 19 nt, Homo sapiens
ucgaguacaucccuuauga

SEQ ID NO: 181932 - RNA, 19 nt, Homo sapiens
uguauggcuucgaguauua

SEQ ID NO: 181933 - RNA, 19 nt, Homo sapiens
ccgcugaccucucggcuuu

SEQ ID NO: 181934 - RNA, 19 nt, Homo sapiens
ggagccaggugacuacgaa

SEQ ID NO: 181935 - RNA, 19 nt, Homo sapiens
ccacgugguucccugcuuu

SEQ ID NO: 181936 - RNA, 19 nt, Homo sapiens
gcacauaccgcugcagcua

SEQ ID NO: 181937 - RNA, 19 nt, Homo sapiens
ugaccuaccugucccaguu

SEQ ID NO: 181938 - RNA, 19 nt, Homo sapiens
gcaacgagcaccugaagug

SEQ ID NO: 181939 - RNA, 19 nt, Homo sapiens
gcaaggcugagaucucuuu

SEQ ID NO: 181940 - RNA, 19 nt, Homo sapiens
cgagacaucaucaguguuu

SEQ ID NO: 181941 - RNA, 19 nt, Homo sapiens
ccacagagccaggcaacua

SEQ ID NO: 181942 - RNA, 19 nt, Homo sapiens
gaccaggaguucacaguca

SEQ ID NO: 181943 - RNA, 19 nt, Homo sapiens
aggcuaagaucgaauguga

SEQ ID NO: 181944 - RNA, 19 nt, Homo sapiens
caucaucaguguuuguaga

SEQ ID NO: 181945 - RNA, 19 nt, Homo sapiens
gcagcuaccucaucuccau

SEQ ID NO: 181946 - RNA, 19 nt, Homo sapiens
gaagggcccuacagcaucu

SEQ ID NO: 181947 - RNA, 19 nt, Homo sapiens
caacaagcccaacaaguuc

SEQ ID NO: 181948 - RNA, 19 nt, Homo sapiens
ggaguucacagucaaauca

SEQ ID NO: 181949 - RNA, 19 nt, Homo sapiens
ucaaggugcugccuacuca

SEQ ID NO: 181950 - RNA, 19 nt, Homo sapiens
gcacgcacaccauuaccua

SEQ ID NO: 181951 - RNA, 19 nt, Homo sapiens
aaaguggcauccaagauug

SEQ ID NO: 181952 - RNA, 19 nt, Homo sapiens
uaagguuacugugcucuuu

SEQ ID NO: 181953 - RNA, 19 nt, Homo sapiens
gacgagcacucugucauga

SEQ ID NO: 181954 - RNA, 19 nt, Homo sapiens
gaaauugaccaagauaagu

SEQ ID NO: 181955 - RNA, 19 nt, Homo sapiens
acaccauccucaucaagua

SEQ ID NO: 181956 - RNA, 19 nt, Homo sapiens
gcacauguuccguguccua

SEQ ID NO: 181957 - RNA, 19 nt, Homo sapiens
caacaagccagcagaguuc

SEQ ID NO: 181958 - RNA, 19 nt, Homo sapiens
cagcugacuucaaggugua

SEQ ID NO: 181959 - RNA, 19 nt, Homo sapiens
aagagcagcuucacaguag

SEQ ID NO: 181960 - RNA, 19 nt, Homo sapiens
gaaaaucccugaaauuagc

SEQ ID NO: 181961 - RNA, 19 nt, Homo sapiens
caacguugguagucauugu

SEQ ID NO: 181962 - RNA, 19 nt, Homo sapiens
gaaggcaagccgaagaaga

SEQ ID NO: 181963 - RNA, 19 nt, Homo sapiens
gggcaaauacgucaucugu

SEQ ID NO: 181964 - RNA, 19 nt, Homo sapiens
gcgauggcauguacaaagu

SEQ ID NO: 181965 - RNA, 19 nt, Homo sapiens
gcaaugacaaugacaccuu

SEQ ID NO: 181966 - RNA, 19 nt, Homo sapiens
ugaagaagcgggcagaguu

SEQ ID NO: 181967 - RNA, 19 nt, Homo sapiens
ccaggcaacuacaucauca

SEQ ID NO: 181968 - RNA, 19 nt, Homo sapiens
agacacacauccaagacaa

SEQ ID NO: 181969 - RNA, 19 nt, Homo sapiens
cuaggugccugcgacuuua

SEQ ID NO: 181970 - RNA, 19 nt, Homo sapiens
cagcugaguucgucgugaa

SEQ ID NO: 181971 - RNA, 19 nt, Homo sapiens
caucaucaacaucaaguuu

SEQ ID NO: 181972 - RNA, 19 nt, Homo sapiens
ccagcaagguggacaucaa

SEQ ID NO: 181973 - RNA, 19 nt, Homo sapiens
gagaagggcccuacagcau

SEQ ID NO: 181974 - RNA, 19 nt, Homo sapiens
gagaggagcgcgugaagca

SEQ ID NO: 181975 - RNA, 19 nt, Homo sapiens
gcaucaaacugguguccau

SEQ ID NO: 181976 - RNA, 19 nt, Homo sapiens
aagauguccugcauggaua

SEQ ID NO: 181977 - RNA, 19 nt, Homo sapiens
caagauguccugcauggau

SEQ ID NO: 181978 - RNA, 19 nt, Homo sapiens
caacaucaacauccucuuc

SEQ ID NO: 181979 - RNA, 19 nt, Homo sapiens
gaagaagcgggcagaguuc

SEQ ID NO: 181980 - RNA, 19 nt, Homo sapiens
aaacugaacccgaagaaag

SEQ ID NO: 181981 - RNA, 19 nt, Homo sapiens
ggacgagcacucugucaug

SEQ ID NO: 181982 - RNA, 19 nt, Homo sapiens
ggacccugauccugcacua

SEQ ID NO: 181983 - RNA, 19 nt, Homo sapiens
caacaaggucaaaguauac

SEQ ID NO: 181984 - RNA, 19 nt, Homo sapiens
ccaacaagaccaccuacuu

SEQ ID NO: 181985 - RNA, 19 nt, Homo sapiens
caggcaacauggugaagaa

SEQ ID NO: 181986 - RNA, 19 nt, Homo sapiens
gcaagcccguuaccaaugc

SEQ ID NO: 181987 - RNA, 19 nt, Homo sapiens
acacacugguggucaaaug

SEQ ID NO: 181988 - RNA, 19 nt, Homo sapiens
caaagcaggcaacaacaug

SEQ ID NO: 181989 - RNA, 19 nt, Homo sapiens
guacgguggugacgagauc

SEQ ID NO: 181990 - RNA, 19 nt, Homo sapiens
gcuaugggccugguauuga

SEQ ID NO: 181991 - RNA, 19 nt, Homo sapiens
caacggcaauggcacuuac

SEQ ID NO: 181992 - RNA, 19 nt, Homo sapiens
cacgagacaucaucagugu

SEQ ID NO: 181993 - RNA, 19 nt, Homo sapiens
cagcaucucaguacuguau

SEQ ID NO: 181994 - RNA, 19 nt, Homo sapiens
gcaaaguggcauccaagau

SEQ ID NO: 181995 - RNA, 19 nt, Homo sapiens
cauggucccuggaaccuau

SEQ ID NO: 181996 - RNA, 19 nt, Homo sapiens
ggacucauaagguuacugu

SEQ ID NO: 181997 - RNA, 19 nt, Homo sapiens
caaaagugaccgccaauaa

SEQ ID NO: 181998 - RNA, 19 nt, Homo sapiens
ccaggaagccggugaagca

SEQ ID NO: 181999 - RNA, 19 nt, Homo sapiens
ccaccuacuuugagaucuu

SEQ ID NO: 182000 - RNA, 19 nt, Homo sapiens
agggagaggugcuggugua

SEQ ID NO: 182001 - RNA, 19 nt, Homo sapiens
cugcuugucuucuuugguu

SEQ ID NO: 182002 - RNA, 19 nt, Homo sapiens
gcaaagcaggcaacaacau

SEQ ID NO: 182003 - RNA, 19 nt, Homo sapiens
gcaguucuauguggauuac

SEQ ID NO: 182004 - RNA, 19 nt, Homo sapiens
gaaugaggacggcacuuuc

SEQ ID NO: 182005 - RNA, 19 nt, Homo sapiens
gcaggcaaaggcaaaguga

SEQ ID NO: 182006 - RNA, 19 nt, Homo sapiens
ggaggugggccaauuccaa

SEQ ID NO: 182007 - RNA, 19 nt, Homo sapiens
gaaccaaacuggaaucaaa

SEQ ID NO: 182008 - RNA, 19 nt, Homo sapiens
ggagaaaucuggaugcauu

SEQ ID NO: 182009 - RNA, 19 nt, Homo sapiens
gaaaucagcugcauugaca

SEQ ID NO: 182010 - RNA, 19 nt, Homo sapiens
gaaaugagguguagggaau

SEQ ID NO: 182011 - RNA, 19 nt, Homo sapiens
ggaagaagauccagcagaa

SEQ ID NO: 182012 - RNA, 19 nt, Homo sapiens
ccaaggaccuggauugaaa

SEQ ID NO: 182013 - RNA, 19 nt, Homo sapiens
gaaugaagauggaaccuau

SEQ ID NO: 182014 - RNA, 19 nt, Homo sapiens
gaaguggucugaaggcaaa

SEQ ID NO: 182015 - RNA, 19 nt, Homo sapiens
ggagagaguucuugugguu

SEQ ID NO: 182016 - RNA, 19 nt, Homo sapiens
ggucaucacuccugaagaa

SEQ ID NO: 182017 - RNA, 19 nt, Homo sapiens
gaaggcccauccaagguua

SEQ ID NO: 182018 - RNA, 19 nt, Homo sapiens
caauaaagauggcacguau

SEQ ID NO: 182019 - RNA, 19 nt, Homo sapiens
caaaggagaugacuuaaaa

SEQ ID NO: 182020 - RNA, 19 nt, Homo sapiens
ggaaucgccuccacuguga

SEQ ID NO: 182021 - RNA, 19 nt, Homo sapiens
caaggagccuggcgaauau

SEQ ID NO: 182022 - RNA, 19 nt, Homo sapiens
guaacuaccugaucagugu

SEQ ID NO: 182023 - RNA, 19 nt, Homo sapiens
gaccacagauuucaagguu

SEQ ID NO: 182024 - RNA, 19 nt, Homo sapiens
ugacuuaccugucccaguu

SEQ ID NO: 182025 - RNA, 19 nt, Homo sapiens
gaccugagcuggcuuugga

SEQ ID NO: 182026 - RNA, 19 nt, Homo sapiens
gugcagaaauccagaaaug

SEQ ID NO: 182027 - RNA, 19 nt, Homo sapiens
ucacauacgucgucaagga

SEQ ID NO: 182028 - RNA, 19 nt, Homo sapiens
gaugggacaugcacaguga

SEQ ID NO: 182029 - RNA, 19 nt, Homo sapiens
ggagagaaguggucugaag

SEQ ID NO: 182030 - RNA, 19 nt, Homo sapiens
uggagaaucuuaagaaaug

SEQ ID NO: 182031 - RNA, 19 nt, Homo sapiens
caagguggcugucacugaa

SEQ ID NO: 182032 - RNA, 19 nt, Homo sapiens
ugaagaggcugcccaacaa

SEQ ID NO: 182033 - RNA, 19 nt, Homo sapiens
gcgaugcagugaaggauuu

SEQ ID NO: 182034 - RNA, 19 nt, Homo sapiens
ccaauaagcccaccuacuu

SEQ ID NO: 182035 - RNA, 19 nt, Homo sapiens
ccacaugucucucaaguac

SEQ ID NO: 182036 - RNA, 19 nt, Homo sapiens
caaaugaaccuacacacuu

SEQ ID NO: 182037 - RNA, 19 nt, Homo sapiens
ucaaauaacggaccaagaa

SEQ ID NO: 182038 - RNA, 19 nt, Homo sapiens
uaaauaugcugaugaagag

SEQ ID NO: 182039 - RNA, 19 nt, Homo sapiens
ccaaggagccuggcgaaua

SEQ ID NO: 182040 - RNA, 19 nt, Homo sapiens
uagggaacaucgccaauaa

SEQ ID NO: 182041 - RNA, 19 nt, Homo sapiens
ccagggagaugccaguaaa

SEQ ID NO: 182042 - RNA, 19 nt, Homo sapiens
gcaaaggagaugacuuaaa

SEQ ID NO: 182043 - RNA, 19 nt, Homo sapiens
cagccaagaucacagauga

SEQ ID NO: 182044 - RNA, 19 nt, Homo sapiens
gcacguaugcugucaccua

SEQ ID NO: 182045 - RNA, 19 nt, Homo sapiens
gcagaagccuguggauaau

SEQ ID NO: 182046 - RNA, 19 nt, Homo sapiens
gaaucaaacgcgacuguaa

SEQ ID NO: 182047 - RNA, 19 nt, Homo sapiens
aaagagccauuguccauga

SEQ ID NO: 182048 - RNA, 19 nt, Homo sapiens
ucucuuaccuucccacaaa

SEQ ID NO: 182049 - RNA, 19 nt, Homo sapiens
gaucgugugaugucaaaua

SEQ ID NO: 182050 - RNA, 19 nt, Homo sapiens
gacgagcacucaguuauga

SEQ ID NO: 182051 - RNA, 19 nt, Homo sapiens
ggaaggugaugucaguguu

SEQ ID NO: 182052 - RNA, 19 nt, Homo sapiens
caccaaagcugcaggaagu

SEQ ID NO: 182053 - RNA, 19 nt, Homo sapiens
gaagaacaccguggaguug

SEQ ID NO: 182054 - RNA, 19 nt, Homo sapiens
caaacgcgacuguaaauug

SEQ ID NO: 182055 - RNA, 19 nt, Homo sapiens
guauuuggcuauuagauca

SEQ ID NO: 182056 - RNA, 19 nt, Homo sapiens
ggucuggacuuggcuauug

SEQ ID NO: 182057 - RNA, 19 nt, Homo sapiens
gaaccuaugacaucuucua

SEQ ID NO: 182058 - RNA, 19 nt, Homo sapiens
cgaauaugcuguucacauc

SEQ ID NO: 182059 - RNA, 19 nt, Homo sapiens
ggacagcacaucuccaaga

SEQ ID NO: 182060 - RNA, 19 nt, Homo sapiens
gaaucgagcccacuggaaa

SEQ ID NO: 182061 - RNA, 19 nt, Homo sapiens
gaagaaagccagggccuau

SEQ ID NO: 182062 - RNA, 19 nt, Homo sapiens
gaacaucuggucagcauca

SEQ ID NO: 182063 - RNA, 19 nt, Homo sapiens
gaaggcaaaugaaccuaca

SEQ ID NO: 182064 - RNA, 19 nt, Homo sapiens
ggacaccacauuccaaaga

SEQ ID NO: 182065 - RNA, 19 nt, Homo sapiens
ggaagaacaccguggaguu

SEQ ID NO: 182066 - RNA, 19 nt, Homo sapiens
gaacaaagaggaggcacaa

SEQ ID NO: 182067 - RNA, 19 nt, Homo sapiens
gaagauggcaccugcaaag

SEQ ID NO: 182068 - RNA, 19 nt, Homo sapiens
aggcaaagauugaguacaa

SEQ ID NO: 182069 - RNA, 19 nt, Homo sapiens
uggcaaaggagaugacuua

SEQ ID NO: 182070 - RNA, 19 nt, Homo sapiens
cagucggaauucuuuauua

SEQ ID NO: 182071 - RNA, 19 nt, Homo sapiens
gcacggucacuguuagaua

SEQ ID NO: 182072 - RNA, 19 nt, Homo sapiens
gcaacgagcaccucaagug

SEQ ID NO: 182073 - RNA, 19 nt, Homo sapiens
caucagagucgaagauaaa

SEQ ID NO: 182074 - RNA, 19 nt, Homo sapiens
uaguggaggugacauauga

SEQ ID NO: 182075 - RNA, 19 nt, Homo sapiens
gaagcuaccaccgacuuua

SEQ ID NO: 182076 - RNA, 19 nt, Homo sapiens
ucaacaaccuggccgaguu

SEQ ID NO: 182077 - RNA, 19 nt, Homo sapiens
guggaaguguuucugcaua

SEQ ID NO: 182078 - RNA, 19 nt, Homo sapiens
aaagcucccuuaaagauau

SEQ ID NO: 182079 - RNA, 19 nt, Homo sapiens
ccaagaagcagacgccaaa

SEQ ID NO: 182080 - RNA, 19 nt, Homo sapiens
ggacgcugauccuccacua

SEQ ID NO: 182081 - RNA, 19 nt, Homo sapiens
gaagauggaaccuaugaca

SEQ ID NO: 182082 - RNA, 19 nt, Homo sapiens
gaauagaagggaaagaugu

SEQ ID NO: 182083 - RNA, 19 nt, Homo sapiens
caagguagccauccucaga

SEQ ID NO: 182084 - RNA, 19 nt, Homo sapiens
caucaugugugacgacgaa

SEQ ID NO: 182085 - RNA, 19 nt, Homo sapiens
aaacgcgacuguaaauugu

SEQ ID NO: 182086 - RNA, 19 nt, Homo sapiens
gagaagggcagcagcuuau

SEQ ID NO: 182087 - RNA, 19 nt, Homo sapiens
gcgagcaguuucccacuug

SEQ ID NO: 182088 - RNA, 19 nt, Homo sapiens
ccaagagccugguaacuac

SEQ ID NO: 182089 - RNA, 19 nt, Homo sapiens
ccugcuugcuguucaaaua

SEQ ID NO: 182090 - RNA, 19 nt, Homo sapiens
gcacacacacaguaaccua

SEQ ID NO: 182091 - RNA, 19 nt, Homo sapiens
gaacaugguggacaaugga

SEQ ID NO: 182092 - RNA, 19 nt, Homo sapiens
caacaagcccaaugucuuc

SEQ ID NO: 182093 - RNA, 19 nt, Homo sapiens
gaauacacacccuuugaga

SEQ ID NO: 182094 - RNA, 19 nt, Homo sapiens
cagcaaagcagguguggaa

SEQ ID NO: 182095 - RNA, 19 nt, Homo sapiens
gcgacaagaacaagacaua

SEQ ID NO: 182096 - RNA, 19 nt, Homo sapiens
caccaucgaugucaaguuc

SEQ ID NO: 182097 - RNA, 19 nt, Homo sapiens
uacauucgaugaccauaaa

SEQ ID NO: 182098 - RNA, 19 nt, Homo sapiens
gagcauacgggccagguuu

SEQ ID NO: 182099 - RNA, 19 nt, Homo sapiens
gcaucaagcucguguccau

SEQ ID NO: 182100 - RNA, 19 nt, Homo sapiens
ccaccuacuuugacaucua

SEQ ID NO: 182101 - RNA, 19 nt, Homo sapiens
ggagaugccaguaaaguca

SEQ ID NO: 182102 - RNA, 19 nt, Homo sapiens
gaagggcagcagcuuauug

SEQ ID NO: 182103 - RNA, 19 nt, Homo sapiens
gguucacucuucagcauuu

SEQ ID NO: 182104 - RNA, 19 nt, Homo sapiens
gcgaacaucuggucagcau

SEQ ID NO: 182105 - RNA, 19 nt, Homo sapiens
cgacaagacugggcgcuau

SEQ ID NO: 182106 - RNA, 19 nt, Homo sapiens
caauaagcccaccuacuuu

SEQ ID NO: 182107 - RNA, 19 nt, Homo sapiens
gaacaagcauucucuguga

SEQ ID NO: 182108 - RNA, 19 nt, Homo sapiens
ggaagaagauccagcagaa

SEQ ID NO: 182109 - RNA, 19 nt, Homo sapiens
caacaaacccaccuacuuu

SEQ ID NO: 182110 - RNA, 19 nt, Homo sapiens
ugaaagagguggcugacuu

SEQ ID NO: 182111 - RNA, 19 nt, Homo sapiens
ucucugagcuggacaguga

SEQ ID NO: 182112 - RNA, 19 nt, Homo sapiens
aggcagagaucaccuguaa

SEQ ID NO: 182113 - RNA, 19 nt, Homo sapiens
gcaagugccucgucacagu

SEQ ID NO: 182114 - RNA, 19 nt, Homo sapiens
ggaugaagaugaugaggau

SEQ ID NO: 182115 - RNA, 19 nt, Homo sapiens
caccaaagaugcuggagaa

SEQ ID NO: 182116 - RNA, 19 nt, Homo sapiens
gcaaguacgucaucaccau

SEQ ID NO: 182117 - RNA, 19 nt, Homo sapiens
gaacaacagcggcuacuca

SEQ ID NO: 182118 - RNA, 19 nt, Homo sapiens
gcaccuacaucaucaacau

SEQ ID NO: 182119 - RNA, 19 nt, Homo sapiens
ccaaugagcccaccuacuu

SEQ ID NO: 182120 - RNA, 19 nt, Homo sapiens
ugacaaggaucgcaccuau

SEQ ID NO: 182121 - RNA, 19 nt, Homo sapiens
aagcggagauugcauuuga

SEQ ID NO: 182122 - RNA, 19 nt, Homo sapiens
ggacaagcccgcugaguuc

SEQ ID NO: 182123 - RNA, 19 nt, Homo sapiens
caagaaagccaucgccuau

SEQ ID NO: 182124 - RNA, 19 nt, Homo sapiens
ggaaccggguguacaaugu

SEQ ID NO: 182125 - RNA, 19 nt, Homo sapiens
gcacguacgcuguguccua

SEQ ID NO: 182126 - RNA, 19 nt, Homo sapiens
caacaaggccaaccgauuc

SEQ ID NO: 182127 - RNA, 19 nt, Homo sapiens
ccagccaccuucacuauug

SEQ ID NO: 182128 - RNA, 19 nt, Homo sapiens
caagcaagguggacaucaa

SEQ ID NO: 182129 - RNA, 19 nt, Homo sapiens
gcacagaggagccagugaa

SEQ ID NO: 182130 - RNA, 19 nt, Homo sapiens
gaugagcauucuguuauga

SEQ ID NO: 182131 - RNA, 19 nt, Homo sapiens
ugaccuaccugucccaguu

SEQ ID NO: 182132 - RNA, 19 nt, Homo sapiens
aggcggagcugaccauuga

SEQ ID NO: 182133 - RNA, 19 nt, Homo sapiens
ucucaaggguggacuggua

SEQ ID NO: 182134 - RNA, 19 nt, Homo sapiens
ggacgcugauccugcacua

SEQ ID NO: 182135 - RNA, 19 nt, Homo sapiens
gcaccuaccacaucaccua

SEQ ID NO: 182136 - RNA, 19 nt, Homo sapiens
ggaugagcauucuguuaug

SEQ ID NO: 182137 - RNA, 19 nt, Homo sapiens
gcaaacagacgcccaagca

SEQ ID NO: 182138 - RNA, 19 nt, Homo sapiens
caacaucaccgacaacaag

SEQ ID NO: 182139 - RNA, 19 nt, Homo sapiens
gaaccaugacgguaccuuu

SEQ ID NO: 182140 - RNA, 19 nt, Homo sapiens
caagcuggaugugcaguuu

SEQ ID NO: 182141 - RNA, 19 nt, Homo sapiens
gcacggagaucagcaagac

SEQ ID NO: 182142 - RNA, 19 nt, Homo sapiens
aagccaagaucgaauguga

SEQ ID NO: 182143 - RNA, 19 nt, Homo sapiens
ccaccuacuuugacaucua

SEQ ID NO: 182144 - RNA, 19 nt, Homo sapiens
gcaccuaugcugucuccua

SEQ ID NO: 182145 - RNA, 19 nt, Homo sapiens
gugaggagguguacgugaa

SEQ ID NO: 182146 - RNA, 19 nt, Homo sapiens
ccuggcaccuacaccauua

SEQ ID NO: 182147 - RNA, 19 nt, Homo sapiens
ccgcugaguucaccauuga

SEQ ID NO: 182148 - RNA, 19 nt, Homo sapiens
ggccuugucugucaccauu

SEQ ID NO: 182149 - RNA, 19 nt, Homo sapiens
gcaagcaugucaccaacag

SEQ ID NO: 182150 - RNA, 19 nt, Homo sapiens
gcagagaucaccuguaagg

SEQ ID NO: 182151 - RNA, 19 nt, Homo sapiens
ccacagccuucacgaaaca

SEQ ID NO: 182152 - RNA, 19 nt, Homo sapiens
ggaaccaggugacuaugag

SEQ ID NO: 182153 - RNA, 19 nt, Homo sapiens
ucacuauugucaccaaaga

SEQ ID NO: 182154 - RNA, 19 nt, Homo sapiens
gacauugacuucgacauca

SEQ ID NO: 182155 - RNA, 19 nt, Homo sapiens
ccugacugcuucccagaua

SEQ ID NO: 182156 - RNA, 19 nt, Homo sapiens
gggacuacauccucauugu

SEQ ID NO: 182157 - RNA, 19 nt, Homo sapiens
aaaugaagcuggagaacgu

SEQ ID NO: 182158 - RNA, 19 nt, Homo sapiens
gacgggacaugcaaaguca

SEQ ID NO: 182159 - RNA, 19 nt, Homo sapiens
agaaaggccugcaccagau

SEQ ID NO: 182160 - RNA, 19 nt, Homo sapiens
gaaagagguggcugacuuc

SEQ ID NO: 182161 - RNA, 19 nt, Homo sapiens
ccuccaaggucugugcuua

SEQ ID NO: 182162 - RNA, 19 nt, Homo sapiens
uaaggugguucccaacaau

SEQ ID NO: 182163 - RNA, 19 nt, Homo sapiens
gaggaugcccgcaaacaga

SEQ ID NO: 182164 - RNA, 19 nt, Homo sapiens
ggccacagccuucacgaaa

SEQ ID NO: 182165 - RNA, 19 nt, Homo sapiens
caucaucaacaucaaguuu

SEQ ID NO: 182166 - RNA, 19 nt, Homo sapiens
ccaacaaacccaccuacuu

SEQ ID NO: 182167 - RNA, 19 nt, Homo sapiens
uuaaggacuuggaaaggaa

SEQ ID NO: 182168 - RNA, 19 nt, Homo sapiens
uggaggaccuugucugugu

SEQ ID NO: 182169 - RNA, 19 nt, Homo sapiens
guucaacggugcccacauc

SEQ ID NO: 182170 - RNA, 19 nt, Homo sapiens
ccaccaagcccauuaagca

SEQ ID NO: 182171 - RNA, 19 nt, Homo sapiens
caacguggaugagcauucu

SEQ ID NO: 182172 - RNA, 19 nt, Homo sapiens
ggacaugcaaagucaccua

SEQ ID NO: 182173 - RNA, 19 nt, Homo sapiens
gaggguggcuuggucaaca

SEQ ID NO: 182174 - RNA, 19 nt, Homo sapiens
gaugcaagaucccuaacag

SEQ ID NO: 182175 - RNA, 19 nt, Homo sapiens
aaaguucagggccuuaaua

SEQ ID NO: 182176 - RNA, 19 nt, Homo sapiens
gcagugacagugacuuaug

SEQ ID NO: 182177 - RNA, 19 nt, Homo sapiens
ggagauugcauuugaggau

SEQ ID NO: 182178 - RNA, 19 nt, Homo sapiens
ggaccucacagcugaaugu

SEQ ID NO: 182179 - RNA, 19 nt, Homo sapiens
caaggugaccgugcucuuu

SEQ ID NO: 182180 - RNA, 19 nt, Homo sapiens
gcgaggugcuggucuacau

SEQ ID NO: 182181 - RNA, 19 nt, Homo sapiens
uaugaggucuccaucaagu

SEQ ID NO: 182182 - RNA, 19 nt, Homo sapiens
gguaugcacccacugagaa

SEQ ID NO: 182183 - RNA, 19 nt, Homo sapiens
ugguggagguccuguauga

SEQ ID NO: 182184 - RNA, 19 nt, Homo sapiens
guucagggccuuaauagca

SEQ ID NO: 182185 - RNA, 19 nt, Homo sapiens
caaagcggagauugcauuu

SEQ ID NO: 182186 - RNA, 19 nt, Homo sapiens
agagguggcugacuucaag

SEQ ID NO: 182187 - RNA, 19 nt, Homo sapiens
cuaaggugguucccaacaa

SEQ ID NO: 182188 - RNA, 19 nt, Homo sapiens
gcacagaaucagacacuac

SEQ ID NO: 182189 - RNA, 19 nt, Homo sapiens
gcaggcaccaacaugauga

SEQ ID NO: 182190 - RNA, 19 nt, Homo sapiens
caaagcaggcaccaacaug

SEQ ID NO: 182191 - RNA, 19 nt, Homo sapiens
ccaggaaccaggugacuau

SEQ ID NO: 182192 - RNA, 19 nt, Homo sapiens
ggacgggacaugcaaaguc

SEQ ID NO: 182193 - RNA, 19 nt, Homo sapiens
guauggcggugaugagauc

SEQ ID NO: 182194 - RNA, 19 nt, Homo sapiens
ccuaugcugucuccuaugu

SEQ ID NO: 182195 - RNA, 19 nt, Homo sapiens
caccuaugcugucuccuau

SEQ ID NO: 182196 - RNA, 19 nt, Homo sapiens
ggccauguggucacuuaua

SEQ ID NO: 182197 - RNA, 19 nt, Homo sapiens
acuaugaggucuccaucaa

SEQ ID NO: 182198 - RNA, 19 nt, Homo sapiens
gguggaagccgcagagauc

SEQ ID NO: 182199 - RNA, 19 nt, Homo sapiens
caucaacugugaggacaug

SEQ ID NO: 182200 - RNA, 19 nt, Homo sapiens
gcacccacacuguccacua

SEQ ID NO: 182201 - RNA, 19 nt, Homo sapiens
acaccuaugugacagacaa

SEQ ID NO: 182202 - RNA, 19 nt, Homo sapiens
caauggugauggcucaugu

SEQ ID NO: 182203 - RNA, 19 nt, Homo sapiens
gcgccagcaugaugaacaa

SEQ ID NO: 182204 - RNA, 19 nt, Homo sapiens
agggagaccugaagcucua

SEQ ID NO: 182205 - RNA, 19 nt, Homo sapiens
gcacguuccgcugcacaua

SEQ ID NO: 182206 - RNA, 19 nt, Homo sapiens
guggaugagcauucuguua

SEQ ID NO: 182207 - RNA, 19 nt, Homo sapiens
gcagagagaugcugacauu

SEQ ID NO: 182208 - RNA, 19 nt, Homo sapiens
ggacguguaugacaaagug

SEQ ID NO: 182209 - RNA, 19 nt, Homo sapiens
gcagaagccuaccagaaau

SEQ ID NO: 182210 - RNA, 19 nt, Homo sapiens
aggaagagauugagauuga

SEQ ID NO: 182211 - RNA, 19 nt, Homo sapiens
agauuaagcugaagauguu

SEQ ID NO: 182212 - RNA, 19 nt, Homo sapiens
ggauuucccuagagauuau

SEQ ID NO: 182213 - RNA, 19 nt, Homo sapiens
agaaggagaugcuggaugu

SEQ ID NO: 182214 - RNA, 19 nt, Homo sapiens
acaguaaggucacaucaga

SEQ ID NO: 182215 - RNA, 19 nt, Homo sapiens
ggcagaagccuaccagaaa

SEQ ID NO: 182216 - RNA, 19 nt, Homo sapiens
caagauugcugacucuaag

SEQ ID NO: 182217 - RNA, 19 nt, Homo sapiens
gugaggagguuaacaucaa

SEQ ID NO: 182218 - RNA, 19 nt, Homo sapiens
ucaaggacguguaugacaa

SEQ ID NO: 182219 - RNA, 19 nt, Homo sapiens
gaaguucucugugcaucug

SEQ ID NO: 182220 - RNA, 19 nt, Homo sapiens
gcaggaagagauugagauu

SEQ ID NO: 182221 - RNA, 19 nt, Homo sapiens
gcucauacccuguccuuuc

SEQ ID NO: 182222 - RNA, 19 nt, Homo sapiens
ucauguagauuaagcugaa

SEQ ID NO: 182223 - RNA, 19 nt, Homo sapiens
caaaaucgcugccccacuu

SEQ ID NO: 182224 - RNA, 19 nt, Homo sapiens
ugacaguggagcagauuua

SEQ ID NO: 182225 - RNA, 19 nt, Homo sapiens
gugagcaguuucuggguaa

SEQ ID NO: 182226 - RNA, 19 nt, Homo sapiens
gaggauuucccuagagauu

SEQ ID NO: 182227 - RNA, 19 nt, Homo sapiens
uacagcagcuuccucaguu

SEQ ID NO: 182228 - RNA, 19 nt, Homo sapiens
gcguggaccugucuaagau

SEQ ID NO: 182229 - RNA, 19 nt, Homo sapiens
cagaggauuucccuagaga

SEQ ID NO: 182230 - RNA, 19 nt, Homo sapiens
caaggucgaugagauugug

SEQ ID NO: 182231 - RNA, 19 nt, Homo sapiens
ggcaaggccuccugucuac

SEQ ID NO: 182232 - RNA, 19 nt, Homo sapiens
cagaagccuaccagaaaua

SEQ ID NO: 182233 - RNA, 19 nt, Homo sapiens
ccaagauugcugacucuaa

SEQ ID NO: 182234 - RNA, 19 nt, Homo sapiens
ugaagaucaugacggagaa

SEQ ID NO: 182235 - RNA, 19 nt, Homo sapiens
uacugacucuggugccuua

SEQ ID NO: 182236 - RNA, 19 nt, Homo sapiens
uuaccaaggucgaugagau

SEQ ID NO: 182237 - RNA, 19 nt, Homo sapiens
agauugagauugagguugu

SEQ ID NO: 182238 - RNA, 19 nt, Homo sapiens
gaucaugacggagaaggaa

SEQ ID NO: 182239 - RNA, 19 nt, Homo sapiens
cccuagagauuaugacguu

SEQ ID NO: 182240 - RNA, 19 nt, Homo sapiens
caaggacguguaugacaaa

SEQ ID NO: 182241 - RNA, 19 nt, Homo sapiens
ccacuuucacugccacuuu

SEQ ID NO: 182242 - RNA, 19 nt, Homo sapiens
gaugcuggaugugaaguuc

SEQ ID NO: 182243 - RNA, 19 nt, Homo sapiens
caguggagcagauuuauca

SEQ ID NO: 182244 - RNA, 19 nt, Homo sapiens
gcaacccaauccucugucu

SEQ ID NO: 182245 - RNA, 19 nt, Homo sapiens
ugccaacccuguacagaau

SEQ ID NO: 182246 - RNA, 19 nt, Homo sapiens
uagauuaagcugaagaugu

SEQ ID NO: 182247 - RNA, 19 nt, Homo sapiens
ggcagaggcugagaagauc

SEQ ID NO: 182248 - RNA, 19 nt, Homo sapiens
ucuggugccuuaucucgaa

SEQ ID NO: 182249 - RNA, 19 nt, Homo sapiens
uaaggucacaucagaagug

SEQ ID NO: 182250 - RNA, 19 nt, Homo sapiens
caacaguaaggucacauca

SEQ ID NO: 182251 - RNA, 19 nt, Homo sapiens
gcagauugccgagggugaa

SEQ ID NO: 182252 - RNA, 19 nt, Homo sapiens
ggaagagauugagauugag

SEQ ID NO: 182253 - RNA, 19 nt, Homo sapiens
caacgaggcgcuggugguu

SEQ ID NO: 182254 - RNA, 19 nt, Homo sapiens
ggucccaacucugcuaagu

SEQ ID NO: 182255 - RNA, 19 nt, Homo sapiens
gacaaaguggacuaucuga

SEQ ID NO: 182256 - RNA, 19 nt, Homo sapiens
ccaucaaggacguguauga

SEQ ID NO: 182257 - RNA, 19 nt, Homo sapiens
gugccaacccuguacagaa

SEQ ID NO: 182258 - RNA, 19 nt, Homo sapiens
ugacucuggugccuuaucu

SEQ ID NO: 182259 - RNA, 19 nt, Homo sapiens
ucagaggauuucccuagag

SEQ ID NO: 182260 - RNA, 19 nt, Homo sapiens
ucaguggagacaacaguaa

SEQ ID NO: 182261 - RNA, 19 nt, Homo sapiens
gugcagcgcaagaaacaga

SEQ ID NO: 182262 - RNA, 19 nt, Homo sapiens
acagcagcuuccucaguuu

SEQ ID NO: 182263 - RNA, 19 nt, Homo sapiens
ccacuuucaucagguuugu

SEQ ID NO: 182264 - RNA, 19 nt, Homo sapiens
cuacaggcccacucucuuc

SEQ ID NO: 182265 - RNA, 19 nt, Homo sapiens
acgaggcgcuggugguuuc

SEQ ID NO: 182266 - RNA, 19 nt, Homo sapiens
guugugguuccgacuauaa

SEQ ID NO: 182267 - RNA, 19 nt, Homo sapiens
gagaagauccgcaaaaucg

SEQ ID NO: 182268 - RNA, 19 nt, Homo sapiens
ugacaaaguggacuaucug

SEQ ID NO: 182269 - RNA, 19 nt, Homo sapiens
ggcguggaccugucuaaga

SEQ ID NO: 182270 - RNA, 19 nt, Homo sapiens
uaccaaggucgaugagauu

SEQ ID NO: 182271 - RNA, 19 nt, Homo sapiens
ggugaagcagguccucuug

SEQ ID NO: 182272 - RNA, 19 nt, Homo sapiens
gauccggcaggaagagauu

SEQ ID NO: 182273 - RNA, 19 nt, Homo sapiens
aggagaugcuggaugugaa

SEQ ID NO: 182274 - RNA, 19 nt, Homo sapiens
guagaccuucuuccugcua

SEQ ID NO: 182275 - RNA, 19 nt, Homo sapiens
aggcagaggcugagaagau

SEQ ID NO: 182276 - RNA, 19 nt, Homo sapiens
uuucugagaugagggucua

SEQ ID NO: 182277 - RNA, 19 nt, Homo sapiens
gaauccuggugccuugaag

SEQ ID NO: 182278 - RNA, 19 nt, Homo sapiens
gcagaggcugagcggauga

SEQ ID NO: 182279 - RNA, 19 nt, Homo sapiens
gcagaagauccggcaggaa

SEQ ID NO: 182280 - RNA, 19 nt, Homo sapiens
ugaggagguuaacaucaag

SEQ ID NO: 182281 - RNA, 19 nt, Homo sapiens
gacaguggagcagauuuau

SEQ ID NO: 182282 - RNA, 19 nt, Homo sapiens
ucagugaggagguuaacau

SEQ ID NO: 182283 - RNA, 19 nt, Homo sapiens
cauggcagacaccaagauu

SEQ ID NO: 182284 - RNA, 19 nt, Homo sapiens
agagagaugcugacauugg

SEQ ID NO: 182285 - RNA, 19 nt, Homo sapiens
ucaucagguuugugucuca

SEQ ID NO: 182286 - RNA, 19 nt, Homo sapiens
caccaagauugcugacucu

SEQ ID NO: 182287 - RNA, 19 nt, Homo sapiens
gggaagcugagugcaagaa

SEQ ID NO: 182288 - RNA, 19 nt, Homo sapiens
auccucagcuucaccauca

SEQ ID NO: 182289 - RNA, 19 nt, Homo sapiens
guuccgacuauaaacagua

SEQ ID NO: 182290 - RNA, 19 nt, Homo sapiens
cacuuucacugccacuuuc

SEQ ID NO: 182291 - RNA, 19 nt, Homo sapiens
guggaccugucuaagauac

SEQ ID NO: 182292 - RNA, 19 nt, Homo sapiens
agacaacaguaaggucaca

SEQ ID NO: 182293 - RNA, 19 nt, Homo sapiens
gagcaguuucuggguaaga

SEQ ID NO: 182294 - RNA, 19 nt, Homo sapiens
gcagcgcaagaaacagauu

SEQ ID NO: 182295 - RNA, 19 nt, Homo sapiens
gaagauccggcaggaagag

SEQ ID NO: 182296 - RNA, 19 nt, Homo sapiens
gcaaaagucagccuucagu

SEQ ID NO: 182297 - RNA, 19 nt, Homo sapiens
ggagaugcuggaugugaag

SEQ ID NO: 182298 - RNA, 19 nt, Homo sapiens
aggauuucccuagagauua

SEQ ID NO: 182299 - RNA, 19 nt, Homo sapiens
cuacagcagcuuccucagu

SEQ ID NO: 182300 - RNA, 19 nt, Homo sapiens
gcgcucauacccuguccuu

SEQ ID NO: 182301 - RNA, 19 nt, Homo sapiens
ucaggaccgggaccaguuu

SEQ ID NO: 182302 - RNA, 19 nt, Homo sapiens
agaaaaguguguagaccuu

SEQ ID NO: 182303 - RNA, 19 nt, Homo sapiens
ucagguuugugucucaucu

SEQ ID NO: 182304 - RNA, 19 nt, Homo sapiens
gguccucaguggagacaac

SEQ ID NO: 182305 - RNA, 19 nt, Homo sapiens
gcacaggcagaggcugaga

SEQ ID NO: 182306 - RNA, 19 nt, Homo sapiens
cucagaggauuucccuaga

SEQ ID NO: 182307 - RNA, 19 nt, Homo sapiens
gagcaaacgugacuuauuu

SEQ ID NO: 182308 - RNA, 19 nt, Homo sapiens
ccaaauggguuucauguua

SEQ ID NO: 182309 - RNA, 19 nt, Homo sapiens
gauaauagcccagcaaaua

SEQ ID NO: 182310 - RNA, 19 nt, Homo sapiens
gaacacagcucaagcaaac

SEQ ID NO: 182311 - RNA, 19 nt, Homo sapiens
gaauguaacuccagauaga

SEQ ID NO: 182312 - RNA, 19 nt, Homo sapiens
gaagaacacuacugcuaaa

SEQ ID NO: 182313 - RNA, 19 nt, Homo sapiens
caacaaggaugcagcacua

SEQ ID NO: 182314 - RNA, 19 nt, Homo sapiens
gaagaaauccuccagaaga

SEQ ID NO: 182315 - RNA, 19 nt, Homo sapiens
gaaagaaagcugagaagaa

SEQ ID NO: 182316 - RNA, 19 nt, Homo sapiens
acaaugcacuacaguauua

SEQ ID NO: 182317 - RNA, 19 nt, Homo sapiens
ggacucaggauauuaguua

SEQ ID NO: 182318 - RNA, 19 nt, Homo sapiens
ggacguaacugaagaggau

SEQ ID NO: 182319 - RNA, 19 nt, Homo sapiens
caaauggguuucauguuaa

SEQ ID NO: 182320 - RNA, 19 nt, Homo sapiens
agaaagggcuucaucauau

SEQ ID NO: 182321 - RNA, 19 nt, Homo sapiens
gcacuuccuuucagaguuu

SEQ ID NO: 182322 - RNA, 19 nt, Homo sapiens
gaaauaguggguuuacaua

SEQ ID NO: 182323 - RNA, 19 nt, Homo sapiens
gaugagagcuccugaguac

SEQ ID NO: 182324 - RNA, 19 nt, Homo sapiens
gcagacaaauccugacuug

SEQ ID NO: 182325 - RNA, 19 nt, Homo sapiens
caaagugcuuguucauuaa

SEQ ID NO: 182326 - RNA, 19 nt, Homo sapiens
uaagagagcuuccguaagg

SEQ ID NO: 182327 - RNA, 19 nt, Homo sapiens
gaagaaauggcaaacaauu

SEQ ID NO: 182328 - RNA, 19 nt, Homo sapiens
gaacaaugcacuacaguau

SEQ ID NO: 182329 - RNA, 19 nt, Homo sapiens
gaacaaagacaaaggacuu

SEQ ID NO: 182330 - RNA, 19 nt, Homo sapiens
acaaagcucugaugacuga

SEQ ID NO: 182331 - RNA, 19 nt, Homo sapiens
uugcauagcuuccaauaaa

SEQ ID NO: 182332 - RNA, 19 nt, Homo sapiens
guagagauguacagugaaa

SEQ ID NO: 182333 - RNA, 19 nt, Homo sapiens
aaagaaagcugagaagaau

SEQ ID NO: 182334 - RNA, 19 nt, Homo sapiens
caacaagagccuggaauua

SEQ ID NO: 182335 - RNA, 19 nt, Homo sapiens
gggaagaaauccuccagaa

SEQ ID NO: 182336 - RNA, 19 nt, Homo sapiens
gugcauaacuauuuaagga

SEQ ID NO: 182337 - RNA, 19 nt, Homo sapiens
gagaaauagugacaaguga

SEQ ID NO: 182338 - RNA, 19 nt, Homo sapiens
gaucugauuucuuacaguu

SEQ ID NO: 182339 - RNA, 19 nt, Homo sapiens
ggagaaggcaugagaaaga

SEQ ID NO: 182340 - RNA, 19 nt, Homo sapiens
ugagaaaucugcucgcuau

SEQ ID NO: 182341 - RNA, 19 nt, Homo sapiens
cuaguaagaugcacugaaa

SEQ ID NO: 182342 - RNA, 19 nt, Homo sapiens
gaagggagcucgucauucc

SEQ ID NO: 182343 - RNA, 19 nt, Homo sapiens
cugaaugucugccuauaua

SEQ ID NO: 182344 - RNA, 19 nt, Homo sapiens
guacaaagcucugaugacu

SEQ ID NO: 182345 - RNA, 19 nt, Homo sapiens
gaaaaggucuucuucugaa

SEQ ID NO: 182346 - RNA, 19 nt, Homo sapiens
gauacucgcuagccucauu

SEQ ID NO: 182347 - RNA, 19 nt, Homo sapiens
gaaccugagcucuaaguaa

SEQ ID NO: 182348 - RNA, 19 nt, Homo sapiens
caagguauuucuccaguug

SEQ ID NO: 182349 - RNA, 19 nt, Homo sapiens
aagauugacuugagaguaa

SEQ ID NO: 182350 - RNA, 19 nt, Homo sapiens
gaugaugucagauauguaa

SEQ ID NO: 182351 - RNA, 19 nt, Homo sapiens
cagcauaccucacuguuca

SEQ ID NO: 182352 - RNA, 19 nt, Homo sapiens
ggaaggagaggaccugaaa

SEQ ID NO: 182353 - RNA, 19 nt, Homo sapiens
gaacaaggcaagaaaccaa

SEQ ID NO: 182354 - RNA, 19 nt, Homo sapiens
aaacaauucugcaguacuu

SEQ ID NO: 182355 - RNA, 19 nt, Homo sapiens
cguaccaacuuaauugaua

SEQ ID NO: 182356 - RNA, 19 nt, Homo sapiens
gaaggagguuaaacucaga

SEQ ID NO: 182357 - RNA, 19 nt, Homo sapiens
gagaaggcaugagaaagaa

SEQ ID NO: 182358 - RNA, 19 nt, Homo sapiens
acaaauggaugaggacuuu

SEQ ID NO: 182359 - RNA, 19 nt, Homo sapiens
aauaaagacugacuaccua

SEQ ID NO: 182360 - RNA, 19 nt, Homo sapiens
acaagagccuggaauuauu

SEQ ID NO: 182361 - RNA, 19 nt, Homo sapiens
gaaagggcuucaucauauc

SEQ ID NO: 182362 - RNA, 19 nt, Homo sapiens
ggcaaacaauucugcagua

SEQ ID NO: 182363 - RNA, 19 nt, Homo sapiens
gagaaaagcaaaaccauua

SEQ ID NO: 182364 - RNA, 19 nt, Homo sapiens
gaaccucggacaagucuaa

SEQ ID NO: 182365 - RNA, 19 nt, Homo sapiens
gaaaggcugagcauaacua

SEQ ID NO: 182366 - RNA, 19 nt, Homo sapiens
acacgaagccuuauuucua

SEQ ID NO: 182367 - RNA, 19 nt, Homo sapiens
aaagaaaggccaagauuug

SEQ ID NO: 182368 - RNA, 19 nt, Homo sapiens
caagagcaaacgugacuua

SEQ ID NO: 182369 - RNA, 19 nt, Homo sapiens
caccauaccuccugcgaaa

SEQ ID NO: 182370 - RNA, 19 nt, Homo sapiens
gaaauuacaaucagagauc

SEQ ID NO: 182371 - RNA, 19 nt, Homo sapiens
gccggaaguuguaugguua

SEQ ID NO: 182372 - RNA, 19 nt, Homo sapiens
caucuggagucuuaaugua

SEQ ID NO: 182373 - RNA, 19 nt, Homo sapiens
ccaauacaaucauagaugu

SEQ ID NO: 182374 - RNA, 19 nt, Homo sapiens
caaagaagaaggaaacaga

SEQ ID NO: 182375 - RNA, 19 nt, Homo sapiens
caaauuauccaguguagau

SEQ ID NO: 182376 - RNA, 19 nt, Homo sapiens
gaagugacaccgagauguu

SEQ ID NO: 182377 - RNA, 19 nt, Homo sapiens
guuagggucuauguauuua

SEQ ID NO: 182378 - RNA, 19 nt, Homo sapiens
gcucugacccuucuacauu

SEQ ID NO: 182379 - RNA, 19 nt, Homo sapiens
agaagcacauguguauuua

SEQ ID NO: 182380 - RNA, 19 nt, Homo sapiens
gacaggaaauaguggguuu

SEQ ID NO: 182381 - RNA, 19 nt, Homo sapiens
ccaacuaccucaagagcaa

SEQ ID NO: 182382 - RNA, 19 nt, Homo sapiens
gaagggcucuguggaaagu

SEQ ID NO: 182383 - RNA, 19 nt, Homo sapiens
ucagaucacuugguuuaaa

SEQ ID NO: 182384 - RNA, 19 nt, Homo sapiens
guuaacaccucagugcaua

SEQ ID NO: 182385 - RNA, 19 nt, Homo sapiens
ccacaagaaugcaaacauc

SEQ ID NO: 182386 - RNA, 19 nt, Homo sapiens
aagaagaccucagucaauu

SEQ ID NO: 182387 - RNA, 19 nt, Homo sapiens
uaaaggcucucuguaugaa

SEQ ID NO: 182388 - RNA, 19 nt, Homo sapiens
gaacacuacugcuaaaucc

SEQ ID NO: 182389 - RNA, 19 nt, Homo sapiens
guaaaugcuuucaaguuca

SEQ ID NO: 182390 - RNA, 19 nt, Homo sapiens
gcauggaguuccugucuuc

SEQ ID NO: 182391 - RNA, 19 nt, Homo sapiens
uagaaagggcuucaucaua

SEQ ID NO: 182392 - RNA, 19 nt, Homo sapiens
ccucagaucacuugguuua

SEQ ID NO: 182393 - RNA, 19 nt, Homo sapiens
gguccuauauuucuaguca

SEQ ID NO: 182394 - RNA, 19 nt, Homo sapiens
gaacgagcacuuccuuuca

SEQ ID NO: 182395 - RNA, 19 nt, Homo sapiens
ccaaucauuugccauuuau

SEQ ID NO: 182396 - RNA, 19 nt, Homo sapiens
gaaauggugaguaaggaaa

SEQ ID NO: 182397 - RNA, 19 nt, Homo sapiens
uagaagcacauguguauuu

SEQ ID NO: 182398 - RNA, 19 nt, Homo sapiens
gcaaagccaccaaccagaa

SEQ ID NO: 182399 - RNA, 19 nt, Homo sapiens
gaaacagaauugagagcau

SEQ ID NO: 182400 - RNA, 19 nt, Homo sapiens
cgacaaaccaauacaauca

SEQ ID NO: 182401 - RNA, 19 nt, Homo sapiens
caaaugcaacguacaaaga

SEQ ID NO: 182402 - RNA, 19 nt, Homo sapiens
caaguuagggucuauguau

SEQ ID NO: 182403 - RNA, 19 nt, Homo sapiens
ggaaauaguggguuuacau

SEQ ID NO: 182404 - RNA, 19 nt, Homo sapiens
acaaggagcccaucacuau

SEQ ID NO: 182405 - RNA, 19 nt, Homo sapiens
ggagaggaccugaaacugu

SEQ ID NO: 182406 - RNA, 19 nt, Homo sapiens
guggcugacucuagaauuu

SEQ ID NO: 182407 - RNA, 19 nt, Homo sapiens
gaaggcaucuacaccauua

SEQ ID NO: 182408 - RNA, 19 nt, Homo sapiens
gaaggagucuggaauagaa

SEQ ID NO: 182409 - RNA, 19 nt, Homo sapiens
gaagauaugugacuuugga

SEQ ID NO: 182410 - RNA, 19 nt, Homo sapiens
ggaaagcuguaaagaagaa

SEQ ID NO: 182411 - RNA, 19 nt, Homo sapiens
ggaaaguggugaagauaug

SEQ ID NO: 182412 - RNA, 19 nt, Homo sapiens
gaaguacaguauauucuug

SEQ ID NO: 182413 - RNA, 19 nt, Homo sapiens
gcaaugauauuugggacua

SEQ ID NO: 182414 - RNA, 19 nt, Homo sapiens
gaauuuaagucguguguuc

SEQ ID NO: 182415 - RNA, 19 nt, Homo sapiens
ggaauucauuucacucuga

SEQ ID NO: 182416 - RNA, 19 nt, Homo sapiens
aaacaugagugaagccaua

SEQ ID NO: 182417 - RNA, 19 nt, Homo sapiens
ggaccaauuuacuugauuu

SEQ ID NO: 182418 - RNA, 19 nt, Homo sapiens
gcaccaggcuguucacaau

SEQ ID NO: 182419 - RNA, 19 nt, Homo sapiens
uaagaaauacccugcuuua

SEQ ID NO: 182420 - RNA, 19 nt, Homo sapiens
gugcaaagcuguucaugug

SEQ ID NO: 182421 - RNA, 19 nt, Homo sapiens
ggacagagauuuucaagga

SEQ ID NO: 182422 - RNA, 19 nt, Homo sapiens
gaagaaguguucagacaag

SEQ ID NO: 182423 - RNA, 19 nt, Homo sapiens
gaacuuuauuggagcauug

SEQ ID NO: 182424 - RNA, 19 nt, Homo sapiens
caagagaaguucagauaca

SEQ ID NO: 182425 - RNA, 19 nt, Homo sapiens
gagcaguacucuaaacaug

SEQ ID NO: 182426 - RNA, 19 nt, Homo sapiens
ugaccaauaugaagaguuu

SEQ ID NO: 182427 - RNA, 19 nt, Homo sapiens
aagaagaccuuacuuuaga

SEQ ID NO: 182428 - RNA, 19 nt, Homo sapiens
gagaggcacucaugucaga

SEQ ID NO: 182429 - RNA, 19 nt, Homo sapiens
gagcugauaaugaacuuua

SEQ ID NO: 182430 - RNA, 19 nt, Homo sapiens
ggacucggaucaaaucuca

SEQ ID NO: 182431 - RNA, 19 nt, Homo sapiens
gacaacaucucauucuaug

SEQ ID NO: 182432 - RNA, 19 nt, Homo sapiens
gaaauacccugcuuuacac

SEQ ID NO: 182433 - RNA, 19 nt, Homo sapiens
ggaauggaauuucuggaau

SEQ ID NO: 182434 - RNA, 19 nt, Homo sapiens
gauaacggauacagcauau

SEQ ID NO: 182435 - RNA, 19 nt, Homo sapiens
aagcacagcucccugaauu

SEQ ID NO: 182436 - RNA, 19 nt, Homo sapiens
cgcaacagcuuauggaauu

SEQ ID NO: 182437 - RNA, 19 nt, Homo sapiens
gaaaguccagcuguuguua

SEQ ID NO: 182438 - RNA, 19 nt, Homo sapiens
gaagcgauguaucagaaug

SEQ ID NO: 182439 - RNA, 19 nt, Homo sapiens
gcaacagcuuauggaauua

SEQ ID NO: 182440 - RNA, 19 nt, Homo sapiens
guaggaaagggauuuauaa

SEQ ID NO: 182441 - RNA, 19 nt, Homo sapiens
cagcaugccugguucaaga

SEQ ID NO: 182442 - RNA, 19 nt, Homo sapiens
gaagaaaguccagcuguug

SEQ ID NO: 182443 - RNA, 19 nt, Homo sapiens
ugggaaaucuucucacuug

SEQ ID NO: 182444 - RNA, 19 nt, Homo sapiens
gcacagaagagaucacaga

SEQ ID NO: 182445 - RNA, 19 nt, Homo sapiens
agagugaagcuaccaauua

SEQ ID NO: 182446 - RNA, 19 nt, Homo sapiens
ggccauccuucccuaauuu

SEQ ID NO: 182447 - RNA, 19 nt, Homo sapiens
aggagaagcuaauaugauu

SEQ ID NO: 182448 - RNA, 19 nt, Homo sapiens
gaauguggauggccguguu

SEQ ID NO: 182449 - RNA, 19 nt, Homo sapiens
uaucaucaguggcaagaaa

SEQ ID NO: 182450 - RNA, 19 nt, Homo sapiens
gaauauuacugugggaaau

SEQ ID NO: 182451 - RNA, 19 nt, Homo sapiens
gaauagaaaggcuaacaga

SEQ ID NO: 182452 - RNA, 19 nt, Homo sapiens
aggaggagcugauaaugaa

SEQ ID NO: 182453 - RNA, 19 nt, Homo sapiens
gcuggcagaugcagaagaa

SEQ ID NO: 182454 - RNA, 19 nt, Homo sapiens
aagaagcgauguaucagaa

SEQ ID NO: 182455 - RNA, 19 nt, Homo sapiens
ccaaaggaauggaauuucu

SEQ ID NO: 182456 - RNA, 19 nt, Homo sapiens
gaucuucucaacuaucuaa

SEQ ID NO: 182457 - RNA, 19 nt, Homo sapiens
caagaaacgacaccggaua

SEQ ID NO: 182458 - RNA, 19 nt, Homo sapiens
gcacucaugucagaacuca

SEQ ID NO: 182459 - RNA, 19 nt, Homo sapiens
gaacgcaacagcuuaugga

SEQ ID NO: 182460 - RNA, 19 nt, Homo sapiens
gaaacgacaccggauacua

SEQ ID NO: 182461 - RNA, 19 nt, Homo sapiens
gaagaagcgauguaucaga

SEQ ID NO: 182462 - RNA, 19 nt, Homo sapiens
ugucagaacucaagaugau

SEQ ID NO: 182463 - RNA, 19 nt, Homo sapiens
caagugcugugcauacaau

SEQ ID NO: 182464 - RNA, 19 nt, Homo sapiens
ucaacaaacagaacuauga

SEQ ID NO: 182465 - RNA, 19 nt, Homo sapiens
gagggcaacuacuuugaga

SEQ ID NO: 182466 - RNA, 19 nt, Homo sapiens
gagugaagcuaccaauuac

SEQ ID NO: 182467 - RNA, 19 nt, Homo sapiens
gcuaacuucuacaaacuga

SEQ ID NO: 182468 - RNA, 19 nt, Homo sapiens
cagaagaagcgauguauca

SEQ ID NO: 182469 - RNA, 19 nt, Homo sapiens
gaugcuaacuucuacaaac

SEQ ID NO: 182470 - RNA, 19 nt, Homo sapiens
ggaagaagaggaggacuug

SEQ ID NO: 182471 - RNA, 19 nt, Homo sapiens
gugaccggcuccucagaua

SEQ ID NO: 182472 - RNA, 19 nt, Homo sapiens
gaagauucguagaggaaca

SEQ ID NO: 182473 - RNA, 19 nt, Homo sapiens
caugagugauuccaacuau

SEQ ID NO: 182474 - RNA, 19 nt, Homo sapiens
gauaugugacuuuggauug

SEQ ID NO: 182475 - RNA, 19 nt, Homo sapiens
gugaagauaugugacuuug

SEQ ID NO: 182476 - RNA, 19 nt, Homo sapiens
ugaauaugaucucaaaugg

SEQ ID NO: 182477 - RNA, 19 nt, Homo sapiens
agagugaugucuggucaua

SEQ ID NO: 182478 - RNA, 19 nt, Homo sapiens
ggacuugaaugugcuuaca

SEQ ID NO: 182479 - RNA, 19 nt, Homo sapiens
ggaagaaguguucagacaa

SEQ ID NO: 182480 - RNA, 19 nt, Homo sapiens
gcuggagaauaccuacuuu

SEQ ID NO: 182481 - RNA, 19 nt, Homo sapiens
uagaagccgucugcguuua

SEQ ID NO: 182482 - RNA, 19 nt, Homo sapiens
caaaugggaguuuccaaga

SEQ ID NO: 182483 - RNA, 19 nt, Homo sapiens
gcaguacucuaaacaugag

SEQ ID NO: 182484 - RNA, 19 nt, Homo sapiens
gcaccagccaggagaauau

SEQ ID NO: 182485 - RNA, 19 nt, Homo sapiens
agaaauacccugcuuuaca

SEQ ID NO: 182486 - RNA, 19 nt, Homo sapiens
caaaucauccugucacaag

SEQ ID NO: 182487 - RNA, 19 nt, Homo sapiens
gaucagccauuuuaugcua

SEQ ID NO: 182488 - RNA, 19 nt, Homo sapiens
gaaagagaggcacucaugu

SEQ ID NO: 182489 - RNA, 19 nt, Homo sapiens
ugaaagagaggcacucaug

SEQ ID NO: 182490 - RNA, 19 nt, Homo sapiens
cuacguugauuucagagaa

SEQ ID NO: 182491 - RNA, 19 nt, Homo sapiens
agaagaaaguccagcuguu

SEQ ID NO: 182492 - RNA, 19 nt, Homo sapiens
uauaagaaauacccugcuu

SEQ ID NO: 182493 - RNA, 19 nt, Homo sapiens
ggaagccacgagaauauug

SEQ ID NO: 182494 - RNA, 19 nt, Homo sapiens
guacuaggaucaggugcuu

SEQ ID NO: 182495 - RNA, 19 nt, Homo sapiens
auagaaaggcuaacagaaa

SEQ ID NO: 182496 - RNA, 19 nt, Homo sapiens
gcaacuacuuugagaugag

SEQ ID NO: 182497 - RNA, 19 nt, Homo sapiens
gaagaccuuacuuuagaaa

SEQ ID NO: 182498 - RNA, 19 nt, Homo sapiens
ugaauugccagccacauuu

SEQ ID NO: 182499 - RNA, 19 nt, Homo sapiens
uaccugaaguacaguauau

SEQ ID NO: 182500 - RNA, 19 nt, Homo sapiens
ggaauauuacugugggaaa

SEQ ID NO: 182501 - RNA, 19 nt, Homo sapiens
gaucaaguguguuuuaauc

SEQ ID NO: 182502 - RNA, 19 nt, Homo sapiens
ggagaagcuaauaugauuu

SEQ ID NO: 182503 - RNA, 19 nt, Homo sapiens
guagaggaacaauuuaguu

SEQ ID NO: 182504 - RNA, 19 nt, Homo sapiens
ggaacacaauuucaguuuu

SEQ ID NO: 182505 - RNA, 19 nt, Homo sapiens
guacuucuacguugauuuc

SEQ ID NO: 182506 - RNA, 19 nt, Homo sapiens
caacaucucauucuaugca

SEQ ID NO: 182507 - RNA, 19 nt, Homo sapiens
gaacacggagauacacuuu

SEQ ID NO: 182508 - RNA, 19 nt, Homo sapiens
acacggagauacacuuugu

SEQ ID NO: 182509 - RNA, 19 nt, Homo sapiens
gccuggagcugcaguguca

SEQ ID NO: 182510 - RNA, 19 nt, Homo sapiens
cgacuucgcugucaaaauc

SEQ ID NO: 182511 - RNA, 19 nt, Homo sapiens
uccgugagcugucugacua

SEQ ID NO: 182512 - RNA, 19 nt, Homo sapiens
acuaccugcuucaagauua

SEQ ID NO: 182513 - RNA, 19 nt, Homo sapiens
cugacuaccugcuucaaga

SEQ ID NO: 182514 - RNA, 19 nt, Homo sapiens
gaggauacguaggcacaca

SEQ ID NO: 182515 - RNA, 19 nt, Homo sapiens
gcgcugaagcccuggauca

SEQ ID NO: 182516 - RNA, 19 nt, Homo sapiens
ggacugcuccuuccaacac

SEQ ID NO: 182517 - RNA, 19 nt, Homo sapiens
caccaaaugugccuuucag

SEQ ID NO: 182518 - RNA, 19 nt, Homo sapiens
agauacacuuugucaccaa

SEQ ID NO: 182519 - RNA, 19 nt, Homo sapiens
ggaucacucgccagaacuu

SEQ ID NO: 182520 - RNA, 19 nt, Homo sapiens
ggauacguaggcacacaga

SEQ ID NO: 182521 - RNA, 19 nt, Homo sapiens
gacuaccugcuucaagauu

SEQ ID NO: 182522 - RNA, 19 nt, Homo sapiens
gaaagugcauccacagaga

SEQ ID NO: 182523 - RNA, 19 nt, Homo sapiens
gggcaggccuggauaauau

SEQ ID NO: 182524 - RNA, 19 nt, Homo sapiens
gcaagaacgugcaucuguu

SEQ ID NO: 182525 - RNA, 19 nt, Homo sapiens
gcaacgagcucuaugacau

SEQ ID NO: 182526 - RNA, 19 nt, Homo sapiens
gcgaauaccuguccuacga

SEQ ID NO: 182527 - RNA, 19 nt, Homo sapiens
gaagacauuugaggaauuc

SEQ ID NO: 182528 - RNA, 19 nt, Homo sapiens
gacaagcacugccacaaga

SEQ ID NO: 182529 - RNA, 19 nt, Homo sapiens
uggaagaucuugucugcua

SEQ ID NO: 182530 - RNA, 19 nt, Homo sapiens
gagcaggcauagacaagaa

SEQ ID NO: 182531 - RNA, 19 nt, Homo sapiens
gcaugaaaguggacaagga

SEQ ID NO: 182532 - RNA, 19 nt, Homo sapiens
cgucaucgcugucuucuuc

SEQ ID NO: 182533 - RNA, 19 nt, Homo sapiens
gcucaccucuugccuucua

SEQ ID NO: 182534 - RNA, 19 nt, Homo sapiens
caacgugucugccauguac

SEQ ID NO: 182535 - RNA, 19 nt, Homo sapiens
gaccugggcucguaugugu

SEQ ID NO: 182536 - RNA, 19 nt, Homo sapiens
gcacuuauaagaaagauca

SEQ ID NO: 182537 - RNA, 19 nt, Homo sapiens
gagcagccauucaucaaca

SEQ ID NO: 182538 - RNA, 19 nt, Homo sapiens
gugaagaucugugacuuug

SEQ ID NO: 182539 - RNA, 19 nt, Homo sapiens
ucucugcacuuauaagaaa

SEQ ID NO: 182540 - RNA, 19 nt, Homo sapiens
ggaggaguuugagcagaua

SEQ ID NO: 182541 - RNA, 19 nt, Homo sapiens
gcagaucaaugaggaguuc

SEQ ID NO: 182542 - RNA, 19 nt, Homo sapiens
uuucuucucugcacuuaua

SEQ ID NO: 182543 - RNA, 19 nt, Homo sapiens
ggaaagaauaagacuguga

SEQ ID NO: 182544 - RNA, 19 nt, Homo sapiens
ugaagacauuugaggaauu

SEQ ID NO: 182545 - RNA, 19 nt, Homo sapiens
acacagaacucuccagcau

SEQ ID NO: 182546 - RNA, 19 nt, Homo sapiens
gaacaucacggaggaguca

SEQ ID NO: 182547 - RNA, 19 nt, Homo sapiens
guggaaggcuccgaggaua

SEQ ID NO: 182548 - RNA, 19 nt, Homo sapiens
cuacugcuaucuacuacaa

SEQ ID NO: 182549 - RNA, 19 nt, Homo sapiens
gaugaagacauuugaggaa

SEQ ID NO: 182550 - RNA, 19 nt, Homo sapiens
ggacaagaggagcaugaaa

SEQ ID NO: 182551 - RNA, 19 nt, Homo sapiens
ggagagcaccgaggucauu

SEQ ID NO: 182552 - RNA, 19 nt, Homo sapiens
ugaccgaccuccuggugaa

SEQ ID NO: 182553 - RNA, 19 nt, Homo sapiens
cuaggucacuucucacaau

SEQ ID NO: 182554 - RNA, 19 nt, Homo sapiens
agagagagaaggcagcaua

SEQ ID NO: 182555 - RNA, 19 nt, Homo sapiens
gcacgagggccacuaugug

SEQ ID NO: 182556 - RNA, 19 nt, Homo sapiens
ccuccaggaugaagacauu

SEQ ID NO: 182557 - RNA, 19 nt, Homo sapiens
agaauaagacugugagcaa

SEQ ID NO: 182558 - RNA, 19 nt, Homo sapiens
gaaaguggacaaggagugu

SEQ ID NO: 182559 - RNA, 19 nt, Homo sapiens
gcuauuucuucuacugcua

SEQ ID NO: 182560 - RNA, 19 nt, Homo sapiens
caaaggcucuguggacaac

SEQ ID NO: 182561 - RNA, 19 nt, Homo sapiens
ggugaagaucugugacuuu

SEQ ID NO: 182562 - RNA, 19 nt, Homo sapiens
gacaagaggagcaugaaag

SEQ ID NO: 182563 - RNA, 19 nt, Homo sapiens
gccuggagcugguggugaa

SEQ ID NO: 182564 - RNA, 19 nt, Homo sapiens
aaagcgacguggugaagau

SEQ ID NO: 182565 - RNA, 19 nt, Homo sapiens
ggaaagcgacguggugaag

SEQ ID NO: 182566 - RNA, 19 nt, Homo sapiens
ggacaccuggaccgaguuu

SEQ ID NO: 182567 - RNA, 19 nt, Homo sapiens
uucauggucugcugaguaa

SEQ ID NO: 182568 - RNA, 19 nt, Homo sapiens
uauccagccucccacaaga

SEQ ID NO: 182569 - RNA, 19 nt, Homo sapiens
gaggacaagaggagcauga

SEQ ID NO: 182570 - RNA, 19 nt, Homo sapiens
gcuaucuacuacaaacuuc

SEQ ID NO: 182571 - RNA, 19 nt, Homo sapiens
gcagcauacgucagcauuu

SEQ ID NO: 182572 - RNA, 19 nt, Homo sapiens
gcucaucuacuucuaugug

SEQ ID NO: 182573 - RNA, 19 nt, Homo sapiens
uuaagacuuucgcuauuuc

SEQ ID NO: 182574 - RNA, 19 nt, Homo sapiens
gaaagcgacguggugaaga

SEQ ID NO: 182575 - RNA, 19 nt, Homo sapiens
ucaagauccucauucacau

SEQ ID NO: 182576 - RNA, 19 nt, Homo sapiens
acaaguguguggucuccaa

SEQ ID NO: 182577 - RNA, 19 nt, Homo sapiens
ucuaugacauccagcuguu

SEQ ID NO: 182578 - RNA, 19 nt, Homo sapiens
ggucacuucucacaauguc

SEQ ID NO: 182579 - RNA, 19 nt, Homo sapiens
cuuuaagacuuucgcuauu

SEQ ID NO: 182580 - RNA, 19 nt, Homo sapiens
guuccuggcuucccgaaag

SEQ ID NO: 182581 - RNA, 19 nt, Homo sapiens
ugagcaagcuggugaucca

SEQ ID NO: 182582 - RNA, 19 nt, Homo sapiens
ggguuaggccuccggauga

SEQ ID NO: 182583 - RNA, 19 nt, Homo sapiens
cagcauacgucagcauuuu

SEQ ID NO: 182584 - RNA, 19 nt, Homo sapiens
cggaggaguuugagcagau

SEQ ID NO: 182585 - RNA, 19 nt, Homo sapiens
cccgggacaucuacaaaga

SEQ ID NO: 182586 - RNA, 19 nt, Homo sapiens
guuacugcuugaccaaaga

SEQ ID NO: 182587 - RNA, 19 nt, Homo sapiens
cuacuacaaacuucaaaga

SEQ ID NO: 182588 - RNA, 19 nt, Homo sapiens
gagcucaagauccucauuc

SEQ ID NO: 182589 - RNA, 19 nt, Homo sapiens
ggaggagucacacgucauc

SEQ ID NO: 182590 - RNA, 19 nt, Homo sapiens
acaggugccuucccagaca

SEQ ID NO: 182591 - RNA, 19 nt, Homo sapiens
caccauggcccuacacauc

SEQ ID NO: 182592 - RNA, 19 nt, Homo sapiens
cugaaagcaucuucgacaa

SEQ ID NO: 182593 - RNA, 19 nt, Homo sapiens
ggaaggcuccgaggauaag

SEQ ID NO: 182594 - RNA, 19 nt, Homo sapiens
ggaggaugcgggaccguau

SEQ ID NO: 182595 - RNA, 19 nt, Homo sapiens
cggcucaucuacuucuaug

SEQ ID NO: 182596 - RNA, 19 nt, Homo sapiens
caacggcauccagcgauuu

SEQ ID NO: 182597 - RNA, 19 nt, Homo sapiens
gagagaaggcagcauacgu

SEQ ID NO: 182598 - RNA, 19 nt, Homo sapiens
gaagaucuugucugcuaca

SEQ ID NO: 182599 - RNA, 19 nt, Homo sapiens
ugucugccauguacaagug

SEQ ID NO: 182600 - RNA, 19 nt, Homo sapiens
uggugaagcugcccgugaa

SEQ ID NO: 182601 - RNA, 19 nt, Homo sapiens
ggagacgcccuuucauggu

SEQ ID NO: 182602 - RNA, 19 nt, Homo sapiens
gacuuucgcuauuucuucu

SEQ ID NO: 182603 - RNA, 19 nt, Homo sapiens
agagacggcacaaggauga

SEQ ID NO: 182604 - RNA, 19 nt, Homo sapiens
gggcuucuccagaccaaga

SEQ ID NO: 182605 - RNA, 19 nt, Homo sapiens
cgcccgaguuccaguggua

SEQ ID NO: 182606 - RNA, 19 nt, Homo sapiens
acaacggcauccagcgauu

SEQ ID NO: 182607 - RNA, 19 nt, Homo sapiens
caacgagcucuaugacauc

SEQ ID NO: 182608 - RNA, 19 nt, Homo sapiens
cagauagagagcaggcaua

SEQ ID NO: 182609 - RNA, 19 nt, Homo sapiens
ggacaaccagacagacagu

SEQ ID NO: 182610 - RNA, 19 nt, Homo sapiens
cuccucaucuucuguaaca

SEQ ID NO: 182611 - RNA, 19 nt, Homo sapiens
caacaaggugggccaggau

SEQ ID NO: 182612 - RNA, 19 nt, Homo sapiens
ggacacccugcaagauguu

SEQ ID NO: 182613 - RNA, 19 nt, Homo sapiens
guaauacaucaaagaguag

SEQ ID NO: 182614 - RNA, 19 nt, Homo sapiens
ccuucuaggucacuucuca

SEQ ID NO: 182615 - RNA, 19 nt, Homo sapiens
gagagcaggcauagacaag

SEQ ID NO: 182616 - RNA, 19 nt, Homo sapiens
ucauggugaucguggaguu

SEQ ID NO: 182617 - RNA, 19 nt, Homo sapiens
ggaggagcaaugcgaauac

SEQ ID NO: 182618 - RNA, 19 nt, Homo sapiens
cacaugcccuggugcucaa

SEQ ID NO: 182619 - RNA, 19 nt, Homo sapiens
gagcaccgaggucauugug

SEQ ID NO: 182620 - RNA, 19 nt, Homo sapiens
gacacgcucuuggucaaca

SEQ ID NO: 182621 - RNA, 19 nt, Homo sapiens
ccaggaugaagacauuuga

SEQ ID NO: 182622 - RNA, 19 nt, Homo sapiens
caucaaagcucgaguugua

SEQ ID NO: 182623 - RNA, 19 nt, Homo sapiens
gaagguuguuggaaaguua

SEQ ID NO: 182624 - RNA, 19 nt, Homo sapiens
ggaaaacucugucauauuu

SEQ ID NO: 182625 - RNA, 19 nt, Homo sapiens
ggagaugucuuguuacuca

SEQ ID NO: 182626 - RNA, 19 nt, Homo sapiens
gcacuggcuuucuuacuaa

SEQ ID NO: 182627 - RNA, 19 nt, Homo sapiens
aauauugccuucacaguua

SEQ ID NO: 182628 - RNA, 19 nt, Homo sapiens
ggaaauuaaugcaaggaaa

SEQ ID NO: 182629 - RNA, 19 nt, Homo sapiens
gcuagagaaugauaacuaa

SEQ ID NO: 182630 - RNA, 19 nt, Homo sapiens
ugaaagaguuugugcuaaa

SEQ ID NO: 182631 - RNA, 19 nt, Homo sapiens
caaacuaugugccaaauuc

SEQ ID NO: 182632 - RNA, 19 nt, Homo sapiens
cagaacauguugagaaauu

SEQ ID NO: 182633 - RNA, 19 nt, Homo sapiens
gaaaguuacagguucauuu

SEQ ID NO: 182634 - RNA, 19 nt, Homo sapiens
ucacagaucucaacuaaaa

SEQ ID NO: 182635 - RNA, 19 nt, Homo sapiens
aaauggugcucuuauagua

SEQ ID NO: 182636 - RNA, 19 nt, Homo sapiens
gcacagaguagauuuacaa

SEQ ID NO: 182637 - RNA, 19 nt, Homo sapiens
uagaugaacuccugaccua

SEQ ID NO: 182638 - RNA, 19 nt, Homo sapiens
gaaagaguuugugcuaaau

SEQ ID NO: 182639 - RNA, 19 nt, Homo sapiens
gaugaacuccugaccuaua

SEQ ID NO: 182640 - RNA, 19 nt, Homo sapiens
ggaagagccuauugacauc

SEQ ID NO: 182641 - RNA, 19 nt, Homo sapiens
cugcaaggcuuuacaauca

SEQ ID NO: 182642 - RNA, 19 nt, Homo sapiens
uaaaagaucuccuaaaugg

SEQ ID NO: 182643 - RNA, 19 nt, Homo sapiens
cagaguagauuuacaaugc

SEQ ID NO: 182644 - RNA, 19 nt, Homo sapiens
caugauaccuacaggagaa

SEQ ID NO: 182645 - RNA, 19 nt, Homo sapiens
caauauaagcauccagaua

SEQ ID NO: 182646 - RNA, 19 nt, Homo sapiens
uuucauagccggcaauaua

SEQ ID NO: 182647 - RNA, 19 nt, Homo sapiens
gaacauggccaagcgaguu

SEQ ID NO: 182648 - RNA, 19 nt, Homo sapiens
caccagaaauuacaagaga

SEQ ID NO: 182649 - RNA, 19 nt, Homo sapiens
uuucacagaucucaacuaa

SEQ ID NO: 182650 - RNA, 19 nt, Homo sapiens
ugaccuauaucaaugcaaa

SEQ ID NO: 182651 - RNA, 19 nt, Homo sapiens
gaaacacauucaauucaag

SEQ ID NO: 182652 - RNA, 19 nt, Homo sapiens
gauuuacaaugcuccaauu

SEQ ID NO: 182653 - RNA, 19 nt, Homo sapiens
gagcccaccugcuuugaga

SEQ ID NO: 182654 - RNA, 19 nt, Homo sapiens
gcaaggcuuuacaaucaga

SEQ ID NO: 182655 - RNA, 19 nt, Homo sapiens
caaaggaagagccuauuga

SEQ ID NO: 182656 - RNA, 19 nt, Homo sapiens
gaaauuacaagagaacaug

SEQ ID NO: 182657 - RNA, 19 nt, Homo sapiens
caccgaacauguugaagaa

SEQ ID NO: 182658 - RNA, 19 nt, Homo sapiens
gaaauggugcucuuauagu

SEQ ID NO: 182659 - RNA, 19 nt, Homo sapiens
ugaugagucuguagugaaa

SEQ ID NO: 182660 - RNA, 19 nt, Homo sapiens
agacaggacucagcugaaa

SEQ ID NO: 182661 - RNA, 19 nt, Homo sapiens
ucaugcaaauuacggcuua

SEQ ID NO: 182662 - RNA, 19 nt, Homo sapiens
gagauucaccgaacauguu

SEQ ID NO: 182663 - RNA, 19 nt, Homo sapiens
cugaaauggugcucuuaua

SEQ ID NO: 182664 - RNA, 19 nt, Homo sapiens
gaccaaagucugcagugua

SEQ ID NO: 182665 - RNA, 19 nt, Homo sapiens
aaagaucuccuaaauggaa

SEQ ID NO: 182666 - RNA, 19 nt, Homo sapiens
ggucugcacuggcuuucuu

SEQ ID NO: 182667 - RNA, 19 nt, Homo sapiens
gaaauuaaugcaaggaaag

SEQ ID NO: 182668 - RNA, 19 nt, Homo sapiens
gcugaaagaguuugugcua

SEQ ID NO: 182669 - RNA, 19 nt, Homo sapiens
gagccagucucuacaaguc

SEQ ID NO: 182670 - RNA, 19 nt, Homo sapiens
accaaagucugcaguguaa

SEQ ID NO: 182671 - RNA, 19 nt, Homo sapiens
auaaacaacuggcucaauc

SEQ ID NO: 182672 - RNA, 19 nt, Homo sapiens
ucauaccucuuucccauau

SEQ ID NO: 182673 - RNA, 19 nt, Homo sapiens
agacuucugugcauuugaa

SEQ ID NO: 182674 - RNA, 19 nt, Homo sapiens
caauauugccuucacaguu

SEQ ID NO: 182675 - RNA, 19 nt, Homo sapiens
gaagaugcacagaguagau

SEQ ID NO: 182676 - RNA, 19 nt, Homo sapiens
gaacuccugaccuauauca

SEQ ID NO: 182677 - RNA, 19 nt, Homo sapiens
caagugcugucuggaagaa

SEQ ID NO: 182678 - RNA, 19 nt, Homo sapiens
guacaagagucuccaucuc

SEQ ID NO: 182679 - RNA, 19 nt, Homo sapiens
ucacauacauagaugaacu

SEQ ID NO: 182680 - RNA, 19 nt, Homo sapiens
caccaagugucaugauaga

SEQ ID NO: 182681 - RNA, 19 nt, Homo sapiens
ggugaucagccgaaucuuu

SEQ ID NO: 182682 - RNA, 19 nt, Homo sapiens
aaugggagguggucacuau

SEQ ID NO: 182683 - RNA, 19 nt, Homo sapiens
gaacauucaaggucaucaa

SEQ ID NO: 182684 - RNA, 19 nt, Homo sapiens
caagcgaguugccauugug

SEQ ID NO: 182685 - RNA, 19 nt, Homo sapiens
cagaagauuauccaaacua

SEQ ID NO: 182686 - RNA, 19 nt, Homo sapiens
guaacaaaaugcucagauu

SEQ ID NO: 182687 - RNA, 19 nt, Homo sapiens
uaagacuucugugcauuug

SEQ ID NO: 182688 - RNA, 19 nt, Homo sapiens
gaugcacagaguagauuua

SEQ ID NO: 182689 - RNA, 19 nt, Homo sapiens
gcucugaccgucuucuuug

SEQ ID NO: 182690 - RNA, 19 nt, Homo sapiens
aagaguuugugcuaaauga

SEQ ID NO: 182691 - RNA, 19 nt, Homo sapiens
gcucaaucaugcaaauuac

SEQ ID NO: 182692 - RNA, 19 nt, Homo sapiens
ggcucaaucaugcaaauua

SEQ ID NO: 182693 - RNA, 19 nt, Homo sapiens
guugauggagcgaaagaua

SEQ ID NO: 182694 - RNA, 19 nt, Homo sapiens
ugcacuggcuuucuuacua

SEQ ID NO: 182695 - RNA, 19 nt, Homo sapiens
ccacuuugaccuucugaaa

SEQ ID NO: 182696 - RNA, 19 nt, Homo sapiens
aggccucacuguacaagua

SEQ ID NO: 182697 - RNA, 19 nt, Homo sapiens
gugaucagccgaaucuuug

SEQ ID NO: 182698 - RNA, 19 nt, Homo sapiens
auaccucuuucccauauaa

SEQ ID NO: 182699 - RNA, 19 nt, Homo sapiens
ucucccagcuccacuucua

SEQ ID NO: 182700 - RNA, 19 nt, Homo sapiens
gaagauuauccaaacuaug

SEQ ID NO: 182701 - RNA, 19 nt, Homo sapiens
aacccaaccuguucucuau

SEQ ID NO: 182702 - RNA, 19 nt, Homo sapiens
acaagucugugguuuccaa

SEQ ID NO: 182703 - RNA, 19 nt, Homo sapiens
gcauccagauauauuuaag

SEQ ID NO: 182704 - RNA, 19 nt, Homo sapiens
ugaaauggugcucuuauag

SEQ ID NO: 182705 - RNA, 19 nt, Homo sapiens
gaaugauaacuaagacuuc

SEQ ID NO: 182706 - RNA, 19 nt, Homo sapiens
gcacuggcucauacugauu

SEQ ID NO: 182707 - RNA, 19 nt, Homo sapiens
ccaagcgaguugccauugu

SEQ ID NO: 182708 - RNA, 19 nt, Homo sapiens
gugcugaaauggugcucuu

SEQ ID NO: 182709 - RNA, 19 nt, Homo sapiens
gccacuggauacacauuug

SEQ ID NO: 182710 - RNA, 19 nt, Homo sapiens
ccauuggcaccagaaauua

SEQ ID NO: 182711 - RNA, 19 nt, Homo sapiens
gauaaacaacuggcucaau

SEQ ID NO: 182712 - RNA, 19 nt, Homo sapiens
aauggaagaugcacagagu

SEQ ID NO: 182713 - RNA, 19 nt, Homo sapiens
ggagauucaccgaacaugu

SEQ ID NO: 182714 - RNA, 19 nt, Homo sapiens
ggaaaguuacagguucauu

SEQ ID NO: 182715 - RNA, 19 nt, Homo sapiens
cuaagacuucugugcauuu

SEQ ID NO: 182716 - RNA, 19 nt, Homo sapiens
uggcuuugcuuguggcuau

SEQ ID NO: 182717 - RNA, 19 nt, Homo sapiens
uaucuucccugcacaucug

SEQ ID NO: 182718 - RNA, 19 nt, Homo sapiens
ucaaaggaagagccuauug

SEQ ID NO: 182719 - RNA, 19 nt, Homo sapiens
caucaagugcugucuggaa

SEQ ID NO: 182720 - RNA, 19 nt, Homo sapiens
ugauggagcgaaagauaaa

SEQ ID NO: 182721 - RNA, 19 nt, Homo sapiens
uucagaacauguugagaaa

SEQ ID NO: 182722 - RNA, 19 nt, Homo sapiens
gcaaagaaauguccuguuu

SEQ ID NO: 182723 - RNA, 19 nt, Homo sapiens
gaaggaaccuguacuaaau

SEQ ID NO: 182724 - RNA, 19 nt, Homo sapiens
caaaggagcugauggcaaa

SEQ ID NO: 182725 - RNA, 19 nt, Homo sapiens
gaagguagcugugauugga

SEQ ID NO: 182726 - RNA, 19 nt, Homo sapiens
gaagauggccgagcaagua

SEQ ID NO: 182727 - RNA, 19 nt, Homo sapiens
ggugaaaucuacagugaaa

SEQ ID NO: 182728 - RNA, 19 nt, Homo sapiens
gcucagauauugcuguuga

SEQ ID NO: 182729 - RNA, 19 nt, Homo sapiens
ccaauuauguugacuacuu

SEQ ID NO: 182730 - RNA, 19 nt, Homo sapiens
gcaaguaucuaucaaucug

SEQ ID NO: 182731 - RNA, 19 nt, Homo sapiens
ugaaagagcucacagaaac

SEQ ID NO: 182732 - RNA, 19 nt, Homo sapiens
guucaaagauccuaaacug

SEQ ID NO: 182733 - RNA, 19 nt, Homo sapiens
uaagaaugcugcucagguu

SEQ ID NO: 182734 - RNA, 19 nt, Homo sapiens
gagcaaguaucuaucaauc

SEQ ID NO: 182735 - RNA, 19 nt, Homo sapiens
gaacuaugaugauggacau

SEQ ID NO: 182736 - RNA, 19 nt, Homo sapiens
aauauggucucacuguaua

SEQ ID NO: 182737 - RNA, 19 nt, Homo sapiens
ggauucaucuaauuucuca

SEQ ID NO: 182738 - RNA, 19 nt, Homo sapiens
caaagaagguagcugugau

SEQ ID NO: 182739 - RNA, 19 nt, Homo sapiens
gaugauagaacaacagaug

SEQ ID NO: 182740 - RNA, 19 nt, Homo sapiens
gaagucauuuccagguaug

SEQ ID NO: 182741 - RNA, 19 nt, Homo sapiens
ucaaagagacggugccaaa

SEQ ID NO: 182742 - RNA, 19 nt, Homo sapiens
ugaaggaaccuguacuaaa

SEQ ID NO: 182743 - RNA, 19 nt, Homo sapiens
gcaaagaagguagcuguga

SEQ ID NO: 182744 - RNA, 19 nt, Homo sapiens
agacguugcagaccaauua

SEQ ID NO: 182745 - RNA, 19 nt, Homo sapiens
gaaccuguacuaaaugaug

SEQ ID NO: 182746 - RNA, 19 nt, Homo sapiens
gcuuugggcuuuauuaucu

SEQ ID NO: 182747 - RNA, 19 nt, Homo sapiens
guucaaaggccaauauuuc

SEQ ID NO: 182748 - RNA, 19 nt, Homo sapiens
ucaaagagaauguggaaga

SEQ ID NO: 182749 - RNA, 19 nt, Homo sapiens
cauaaugcuuugggcuuua

SEQ ID NO: 182750 - RNA, 19 nt, Homo sapiens
ucagagagaacuaugauga

SEQ ID NO: 182751 - RNA, 19 nt, Homo sapiens
cgagcucgccuuagagaua

SEQ ID NO: 182752 - RNA, 19 nt, Homo sapiens
gcaacaggauauaguuucu

SEQ ID NO: 182753 - RNA, 19 nt, Homo sapiens
gcagagugcugucuuugac

SEQ ID NO: 182754 - RNA, 19 nt, Homo sapiens
caaagagaauguggaagau

SEQ ID NO: 182755 - RNA, 19 nt, Homo sapiens
caggauauaguuucucuuu

SEQ ID NO: 182756 - RNA, 19 nt, Homo sapiens
caacuucaaugguccuagu

SEQ ID NO: 182757 - RNA, 19 nt, Homo sapiens
gaaggauucaucuaauuuc

SEQ ID NO: 182758 - RNA, 19 nt, Homo sapiens
caauuauguugacuacuug

SEQ ID NO: 182759 - RNA, 19 nt, Homo sapiens
caucuaauuucucaguuuc

SEQ ID NO: 182760 - RNA, 19 nt, Homo sapiens
aagauucacucguuaaagu

SEQ ID NO: 182761 - RNA, 19 nt, Homo sapiens
ggauauaguuucucuuuuc

SEQ ID NO: 182762 - RNA, 19 nt, Homo sapiens
aaggugaaaucuacaguga

SEQ ID NO: 182763 - RNA, 19 nt, Homo sapiens
aaacuauucugucaaagag

SEQ ID NO: 182764 - RNA, 19 nt, Homo sapiens
ggaggaguguggagguuca

SEQ ID NO: 182765 - RNA, 19 nt, Homo sapiens
agagagaacuaugaugaug

SEQ ID NO: 182766 - RNA, 19 nt, Homo sapiens
uggucucacuguauaaaua

SEQ ID NO: 182767 - RNA, 19 nt, Homo sapiens
aauggaagguugucacuca

SEQ ID NO: 182768 - RNA, 19 nt, Homo sapiens
uggacgagcucgccuuaga

SEQ ID NO: 182769 - RNA, 19 nt, Homo sapiens
gaacaguggaggagaacau

SEQ ID NO: 182770 - RNA, 19 nt, Homo sapiens
gcauaauucuaaacuucug

SEQ ID NO: 182771 - RNA, 19 nt, Homo sapiens
cugcauaauucuaaacuuc

SEQ ID NO: 182772 - RNA, 19 nt, Homo sapiens
ugaaaucuacagugaaaga

SEQ ID NO: 182773 - RNA, 19 nt, Homo sapiens
guguggagguucaaagaga

SEQ ID NO: 182774 - RNA, 19 nt, Homo sapiens
gacccugcaacuccuauua

SEQ ID NO: 182775 - RNA, 19 nt, Homo sapiens
gaccaauuauguugacuac

SEQ ID NO: 182776 - RNA, 19 nt, Homo sapiens
agagaacuaugaugaugga

SEQ ID NO: 182777 - RNA, 19 nt, Homo sapiens
agaauaauauggucucacu

SEQ ID NO: 182778 - RNA, 19 nt, Homo sapiens
gaacagcuguaaaauggau

SEQ ID NO: 182779 - RNA, 19 nt, Homo sapiens
aaaggccaauauuuccaua

SEQ ID NO: 182780 - RNA, 19 nt, Homo sapiens
ugaagucauuuccagguau

SEQ ID NO: 182781 - RNA, 19 nt, Homo sapiens
gagcucgccuuagagauag

SEQ ID NO: 182782 - RNA, 19 nt, Homo sapiens
auaauauggucucacugua

SEQ ID NO: 182783 - RNA, 19 nt, Homo sapiens
uauauucaguuccagacaa

SEQ ID NO: 182784 - RNA, 19 nt, Homo sapiens
ucuggaauauuucaggauu

SEQ ID NO: 182785 - RNA, 19 nt, Homo sapiens
caacaccagcaaagaaaug

SEQ ID NO: 182786 - RNA, 19 nt, Homo sapiens
gcagaccaauuauguugac

SEQ ID NO: 182787 - RNA, 19 nt, Homo sapiens
uaauauggucucacuguau

SEQ ID NO: 182788 - RNA, 19 nt, Homo sapiens
ccaucaaggugaaaucuac

SEQ ID NO: 182789 - RNA, 19 nt, Homo sapiens
gagcccacuugcuuugaga

SEQ ID NO: 182790 - RNA, 19 nt, Homo sapiens
guucuaugcuccgcaaugu

SEQ ID NO: 182791 - RNA, 19 nt, Homo sapiens
guucaaagagaauguggaa

SEQ ID NO: 182792 - RNA, 19 nt, Homo sapiens
ccucauaucccacugaagu

SEQ ID NO: 182793 - RNA, 19 nt, Homo sapiens
gaagugcuguguggaugag

SEQ ID NO: 182794 - RNA, 19 nt, Homo sapiens
ggccuaauuucucugaagu

SEQ ID NO: 182795 - RNA, 19 nt, Homo sapiens
gagguucaaaggccaauau

SEQ ID NO: 182796 - RNA, 19 nt, Homo sapiens
cugaagucauuuccaggua

SEQ ID NO: 182797 - RNA, 19 nt, Homo sapiens
cugcaacuccuauuaguau

SEQ ID NO: 182798 - RNA, 19 nt, Homo sapiens
gauccuaaacuggcuguga

SEQ ID NO: 182799 - RNA, 19 nt, Homo sapiens
gaagauucacucguuaaag

SEQ ID NO: 182800 - RNA, 19 nt, Homo sapiens
uaugaaggaaccuguacua

SEQ ID NO: 182801 - RNA, 19 nt, Homo sapiens
aaacgcauccuggugauug

SEQ ID NO: 182802 - RNA, 19 nt, Homo sapiens
caccacauucuaccucaua

SEQ ID NO: 182803 - RNA, 19 nt, Homo sapiens
acaacuguccuuaguguga

SEQ ID NO: 182804 - RNA, 19 nt, Homo sapiens
cuaugaugauggacauuau

SEQ ID NO: 182805 - RNA, 19 nt, Homo sapiens
aaagaagguagcugugauu

SEQ ID NO: 182806 - RNA, 19 nt, Homo sapiens
cuguugagcugaguaagaa

SEQ ID NO: 182807 - RNA, 19 nt, Homo sapiens
uuucugcucucucuuguuc

SEQ ID NO: 182808 - RNA, 19 nt, Homo sapiens
gauuucugcucucucuugu

SEQ ID NO: 182809 - RNA, 19 nt, Homo sapiens
gacuugagcccacuugcuu

SEQ ID NO: 182810 - RNA, 19 nt, Homo sapiens
gauagaacaacagaugaau

SEQ ID NO: 182811 - RNA, 19 nt, Homo sapiens
gugagaaaauguccagauu

SEQ ID NO: 182812 - RNA, 19 nt, Homo sapiens
agccagaaaugccaucuuc

SEQ ID NO: 182813 - RNA, 19 nt, Homo sapiens
ucaguggccuaauuucucu

SEQ ID NO: 182814 - RNA, 19 nt, Homo sapiens
ccgcucaccuggacaaguc

SEQ ID NO: 182815 - RNA, 19 nt, Homo sapiens
guggagccaucaaggugaa

SEQ ID NO: 182816 - RNA, 19 nt, Homo sapiens
aggaaccuguacuaaauga

SEQ ID NO: 182817 - RNA, 19 nt, Homo sapiens
ggaagauggccgagcaagu

SEQ ID NO: 182818 - RNA, 19 nt, Homo sapiens
gcuguugagcugaguaaga

SEQ ID NO: 182819 - RNA, 19 nt, Homo sapiens
gguucaaaggccaauauuu

SEQ ID NO: 182820 - RNA, 19 nt, Homo sapiens
gcugauggcaaagaaggua

SEQ ID NO: 182821 - RNA, 19 nt, Homo sapiens
gaguguggagguucaaaga

SEQ ID NO: 182822 - RNA, 19 nt, Homo sapiens
ggaaagagccuguauuuaa

SEQ ID NO: 182823 - RNA, 19 nt, Homo sapiens
ccaaagagaugauguguuu

SEQ ID NO: 182824 - RNA, 19 nt, Homo sapiens
gcacuaaucauuucuguuu

SEQ ID NO: 182825 - RNA, 19 nt, Homo sapiens
gcaguacucuguagacauu

SEQ ID NO: 182826 - RNA, 19 nt, Homo sapiens
gaaauagccacuuuaagaa

SEQ ID NO: 182827 - RNA, 19 nt, Homo sapiens
gaaagagccuguauuuaac

SEQ ID NO: 182828 - RNA, 19 nt, Homo sapiens
gaagacaugaugaaugaua

SEQ ID NO: 182829 - RNA, 19 nt, Homo sapiens
gaacucuccuccuucauug

SEQ ID NO: 182830 - RNA, 19 nt, Homo sapiens
gaggaaagagccuguauuu

SEQ ID NO: 182831 - RNA, 19 nt, Homo sapiens
uaagagagcacuaaucauu

SEQ ID NO: 182832 - RNA, 19 nt, Homo sapiens
ugaaauagccacuuuaaga

SEQ ID NO: 182833 - RNA, 19 nt, Homo sapiens
gaacaggucaugaucaguu

SEQ ID NO: 182834 - RNA, 19 nt, Homo sapiens
gaaccuuccucaagaacaa

SEQ ID NO: 182835 - RNA, 19 nt, Homo sapiens
gaagaaaguggccaucauu

SEQ ID NO: 182836 - RNA, 19 nt, Homo sapiens
gcucugaaauagccacuuu

SEQ ID NO: 182837 - RNA, 19 nt, Homo sapiens
uggaagacaugaugaauga

SEQ ID NO: 182838 - RNA, 19 nt, Homo sapiens
aaaagaaccuccugaagua

SEQ ID NO: 182839 - RNA, 19 nt, Homo sapiens
ucucacagaucccaaauug

SEQ ID NO: 182840 - RNA, 19 nt, Homo sapiens
acagcaagauccaggaaua

SEQ ID NO: 182841 - RNA, 19 nt, Homo sapiens
gaaaguggccaucauugga

SEQ ID NO: 182842 - RNA, 19 nt, Homo sapiens
ggaagaaaguggccaucau

SEQ ID NO: 182843 - RNA, 19 nt, Homo sapiens
guaauaaagggaacuugua

SEQ ID NO: 182844 - RNA, 19 nt, Homo sapiens
uaaagaaccagguguauuc

SEQ ID NO: 182845 - RNA, 19 nt, Homo sapiens
acagacagauuacauuguu

SEQ ID NO: 182846 - RNA, 19 nt, Homo sapiens
gcaagauccaggaauauau

SEQ ID NO: 182847 - RNA, 19 nt, Homo sapiens
gagcccaccugcuuugaga

SEQ ID NO: 182848 - RNA, 19 nt, Homo sapiens
cagcagggacuauaaagaa

SEQ ID NO: 182849 - RNA, 19 nt, Homo sapiens
gggcagggcuagcauuuac

SEQ ID NO: 182850 - RNA, 19 nt, Homo sapiens
ccagguguauucaauggaa

SEQ ID NO: 182851 - RNA, 19 nt, Homo sapiens
gaaaagaaccuccugaagu

SEQ ID NO: 182852 - RNA, 19 nt, Homo sapiens
gaaaguuacugacaauacc

SEQ ID NO: 182853 - RNA, 19 nt, Homo sapiens
ugcaauuccuauucuguua

SEQ ID NO: 182854 - RNA, 19 nt, Homo sapiens
gagcacuaaucauuucugu

SEQ ID NO: 182855 - RNA, 19 nt, Homo sapiens
gcaauuccuauucuguuaa

SEQ ID NO: 182856 - RNA, 19 nt, Homo sapiens
caaauuggccauggaaguu

SEQ ID NO: 182857 - RNA, 19 nt, Homo sapiens
cauugacuguguaaucuuu

SEQ ID NO: 182858 - RNA, 19 nt, Homo sapiens
agagagcacuaaucauuuc

SEQ ID NO: 182859 - RNA, 19 nt, Homo sapiens
gaucuuaagagagcacuaa

SEQ ID NO: 182860 - RNA, 19 nt, Homo sapiens
gaccauauuugagggcauu

SEQ ID NO: 182861 - RNA, 19 nt, Homo sapiens
acaaagaacggguaggaaa

SEQ ID NO: 182862 - RNA, 19 nt, Homo sapiens
ggacguagacacacagaag

SEQ ID NO: 182863 - RNA, 19 nt, Homo sapiens
acauuuguauccaguguaa

SEQ ID NO: 182864 - RNA, 19 nt, Homo sapiens
ccacugaaagggaugguaa

SEQ ID NO: 182865 - RNA, 19 nt, Homo sapiens
gauccaggaauauaucauu

SEQ ID NO: 182866 - RNA, 19 nt, Homo sapiens
gacaggggcuuugcuauuu

SEQ ID NO: 182867 - RNA, 19 nt, Homo sapiens
guacuuugccuucuaugga

SEQ ID NO: 182868 - RNA, 19 nt, Homo sapiens
ggcugaagcucuuugcaau

SEQ ID NO: 182869 - RNA, 19 nt, Homo sapiens
uggaugaacucuccuccuu

SEQ ID NO: 182870 - RNA, 19 nt, Homo sapiens
gaaccagguguauucaaug

SEQ ID NO: 182871 - RNA, 19 nt, Homo sapiens
agaaucggcugucuuugau

SEQ ID NO: 182872 - RNA, 19 nt, Homo sapiens
cauuggagcuggugugagu

SEQ ID NO: 182873 - RNA, 19 nt, Homo sapiens
agucaguaauacaguguua

SEQ ID NO: 182874 - RNA, 19 nt, Homo sapiens
agaaccagguguauucaau

SEQ ID NO: 182875 - RNA, 19 nt, Homo sapiens
gggcagcacaaguaauaaa

SEQ ID NO: 182876 - RNA, 19 nt, Homo sapiens
gcagaacaggucaugauca

SEQ ID NO: 182877 - RNA, 19 nt, Homo sapiens
ccacagcagggacuauaaa

SEQ ID NO: 182878 - RNA, 19 nt, Homo sapiens
gagggcagggcuagcauuu

SEQ ID NO: 182879 - RNA, 19 nt, Homo sapiens
gaacggguaggaaaauuaa

SEQ ID NO: 182880 - RNA, 19 nt, Homo sapiens
cugaagcucuuugcaauuc

SEQ ID NO: 182881 - RNA, 19 nt, Homo sapiens
gcgagaccauacagacaga

SEQ ID NO: 182882 - RNA, 19 nt, Homo sapiens
gacaggacguagacacaca

SEQ ID NO: 182883 - RNA, 19 nt, Homo sapiens
ugucuuugaugcuguaaug

SEQ ID NO: 182884 - RNA, 19 nt, Homo sapiens
guuaaucgcuguuuuccuu

SEQ ID NO: 182885 - RNA, 19 nt, Homo sapiens
cagacagauuacauuguuu

SEQ ID NO: 182886 - RNA, 19 nt, Homo sapiens
gcaacaggguauaguuuug

SEQ ID NO: 182887 - RNA, 19 nt, Homo sapiens
caugaucaguuccagaagu

SEQ ID NO: 182888 - RNA, 19 nt, Homo sapiens
cagaacaggucaugaucag

SEQ ID NO: 182889 - RNA, 19 nt, Homo sapiens
ccaggaauauaucauugca

SEQ ID NO: 182890 - RNA, 19 nt, Homo sapiens
cuuaagagagcacuaauca

SEQ ID NO: 182891 - RNA, 19 nt, Homo sapiens
aauuggccauggaaguuua

SEQ ID NO: 182892 - RNA, 19 nt, Homo sapiens
gggcauugacuguguaauc

SEQ ID NO: 182893 - RNA, 19 nt, Homo sapiens
cuugaugccuuuaaaugga

SEQ ID NO: 182894 - RNA, 19 nt, Homo sapiens
ucauguguaucccaaccua

SEQ ID NO: 182895 - RNA, 19 nt, Homo sapiens
ggcauugacuguguaaucu

SEQ ID NO: 182896 - RNA, 19 nt, Homo sapiens
ccugaaguacauacaauuu

SEQ ID NO: 182897 - RNA, 19 nt, Homo sapiens
gaagaaaagaagacaaaga

SEQ ID NO: 182898 - RNA, 19 nt, Homo sapiens
aagagagcacuaaucauuu

SEQ ID NO: 182899 - RNA, 19 nt, Homo sapiens
aauagccacuuuaagaauc

SEQ ID NO: 182900 - RNA, 19 nt, Homo sapiens
ucugaaauagccacuuuaa

SEQ ID NO: 182901 - RNA, 19 nt, Homo sapiens
ucugaaaguuacugacaau

SEQ ID NO: 182902 - RNA, 19 nt, Homo sapiens
ugagggcauugacugugua

SEQ ID NO: 182903 - RNA, 19 nt, Homo sapiens
cagcagaacaggucaugau

SEQ ID NO: 182904 - RNA, 19 nt, Homo sapiens
cuauaaagaaccaggugua

SEQ ID NO: 182905 - RNA, 19 nt, Homo sapiens
gcagggcuagcauuuacaa

SEQ ID NO: 182906 - RNA, 19 nt, Homo sapiens
caacagcaagauccaggaa

SEQ ID NO: 182907 - RNA, 19 nt, Homo sapiens
uguagacauuagucaguaa

SEQ ID NO: 182908 - RNA, 19 nt, Homo sapiens
gguuguacgugaagcagau

SEQ ID NO: 182909 - RNA, 19 nt, Homo sapiens
caagauccaggaauauauc

SEQ ID NO: 182910 - RNA, 19 nt, Homo sapiens
gcugaagcucuuugcaauu

SEQ ID NO: 182911 - RNA, 19 nt, Homo sapiens
cauacagacagauuacauu

SEQ ID NO: 182912 - RNA, 19 nt, Homo sapiens
agaccauacagacagauua

SEQ ID NO: 182913 - RNA, 19 nt, Homo sapiens
cugggcagcacaaguaaua

SEQ ID NO: 182914 - RNA, 19 nt, Homo sapiens
gggcugccauucccacagu

SEQ ID NO: 182915 - RNA, 19 nt, Homo sapiens
caucaggagcugucuggaa

SEQ ID NO: 182916 - RNA, 19 nt, Homo sapiens
ugaaaacuauggcuugaug

SEQ ID NO: 182917 - RNA, 19 nt, Homo sapiens
aaaccacuuuaaaggcaaa

SEQ ID NO: 182918 - RNA, 19 nt, Homo sapiens
agacauuuguauccagugu

SEQ ID NO: 182919 - RNA, 19 nt, Homo sapiens
ugaaaguuacugacaauac

SEQ ID NO: 182920 - RNA, 19 nt, Homo sapiens
gagaccauacagacagauu

SEQ ID NO: 182921 - RNA, 19 nt, Homo sapiens
cuguagacauuagucagua

SEQ ID NO: 182922 - RNA, 19 nt, Homo sapiens
gaaaggaaguugaauaaga

SEQ ID NO: 182923 - RNA, 19 nt, Homo sapiens
guaaggaaaugucauguua

SEQ ID NO: 182924 - RNA, 19 nt, Homo sapiens
caagaaaguugcagugauu

SEQ ID NO: 182925 - RNA, 19 nt, Homo sapiens
caaagaaucugcucuaugc

SEQ ID NO: 182926 - RNA, 19 nt, Homo sapiens
acaagaagaugcuguaguu

SEQ ID NO: 182927 - RNA, 19 nt, Homo sapiens
ucaugaggauuauggauua

SEQ ID NO: 182928 - RNA, 19 nt, Homo sapiens
gggacuaucuccaagaauu

SEQ ID NO: 182929 - RNA, 19 nt, Homo sapiens
acaaaugucuguaaggaaa

SEQ ID NO: 182930 - RNA, 19 nt, Homo sapiens
cuaauucuaucuccaagua

SEQ ID NO: 182931 - RNA, 19 nt, Homo sapiens
gaucuucacuacaggauau

SEQ ID NO: 182932 - RNA, 19 nt, Homo sapiens
caagaaaggaaguugaaua

SEQ ID NO: 182933 - RNA, 19 nt, Homo sapiens
ugagagaagugaugacauu

SEQ ID NO: 182934 - RNA, 19 nt, Homo sapiens
ugauaucgcugccugcaua

SEQ ID NO: 182935 - RNA, 19 nt, Homo sapiens
caaaggacucuguaagaua

SEQ ID NO: 182936 - RNA, 19 nt, Homo sapiens
aaauagagcugucuuugau

SEQ ID NO: 182937 - RNA, 19 nt, Homo sapiens
ggccauuuguuucugauua

SEQ ID NO: 182938 - RNA, 19 nt, Homo sapiens
agaaaccucugcugucuuu

SEQ ID NO: 182939 - RNA, 19 nt, Homo sapiens
ccagucaucuccuaucuga

SEQ ID NO: 182940 - RNA, 19 nt, Homo sapiens
aagcaagucuuucccuuaa

SEQ ID NO: 182941 - RNA, 19 nt, Homo sapiens
ucuccuaucugaauuauug

SEQ ID NO: 182942 - RNA, 19 nt, Homo sapiens
ccucugcucuccaucauaa

SEQ ID NO: 182943 - RNA, 19 nt, Homo sapiens
ugaaauuggugagagauaa

SEQ ID NO: 182944 - RNA, 19 nt, Homo sapiens
uaaaggauccaucuuauca

SEQ ID NO: 182945 - RNA, 19 nt, Homo sapiens
ugacuucccuuuccacgaa

SEQ ID NO: 182946 - RNA, 19 nt, Homo sapiens
ggaugaaccugauuguuac

SEQ ID NO: 182947 - RNA, 19 nt, Homo sapiens
gacagaacauugaaaccuu

SEQ ID NO: 182948 - RNA, 19 nt, Homo sapiens
gauuggagcuggugugagu

SEQ ID NO: 182949 - RNA, 19 nt, Homo sapiens
cagacuagcuugggaaguu

SEQ ID NO: 182950 - RNA, 19 nt, Homo sapiens
gaaaaggaacagcucauua

SEQ ID NO: 182951 - RNA, 19 nt, Homo sapiens
caagcaagucuuucccuua

SEQ ID NO: 182952 - RNA, 19 nt, Homo sapiens
ggaaaugucauguuacagu

SEQ ID NO: 182953 - RNA, 19 nt, Homo sapiens
aggaugaaccugauuguua

SEQ ID NO: 182954 - RNA, 19 nt, Homo sapiens
gaaauuggugagagauaaa

SEQ ID NO: 182955 - RNA, 19 nt, Homo sapiens
gggcuauccuuauaauaug

SEQ ID NO: 182956 - RNA, 19 nt, Homo sapiens
acuuugaccuccugaaaua

SEQ ID NO: 182957 - RNA, 19 nt, Homo sapiens
gagcccaccugcuuugaga

SEQ ID NO: 182958 - RNA, 19 nt, Homo sapiens
ccucaaggaucccagacua

SEQ ID NO: 182959 - RNA, 19 nt, Homo sapiens
ucaaaggacucuguaagau

SEQ ID NO: 182960 - RNA, 19 nt, Homo sapiens
gcacuuugaccuccugaaa

SEQ ID NO: 182961 - RNA, 19 nt, Homo sapiens
ggacuaucuccaagaauuu

SEQ ID NO: 182962 - RNA, 19 nt, Homo sapiens
agaaucugcucuaugcuaa

SEQ ID NO: 182963 - RNA, 19 nt, Homo sapiens
acacuuuccuugacuuuga

SEQ ID NO: 182964 - RNA, 19 nt, Homo sapiens
ggaaguugaauaagagauu

SEQ ID NO: 182965 - RNA, 19 nt, Homo sapiens
uaaacuggauucaagaaag

SEQ ID NO: 182966 - RNA, 19 nt, Homo sapiens
gcaagucuuucccuuaaac

SEQ ID NO: 182967 - RNA, 19 nt, Homo sapiens
caagaucccagaaggcuuu

SEQ ID NO: 182968 - RNA, 19 nt, Homo sapiens
aaaccagcgugauugaauu

SEQ ID NO: 182969 - RNA, 19 nt, Homo sapiens
agaagaugcuguaguuuua

SEQ ID NO: 182970 - RNA, 19 nt, Homo sapiens
ggucagauccugcauaguc

SEQ ID NO: 182971 - RNA, 19 nt, Homo sapiens
uaacgaagcguccagacuu

SEQ ID NO: 182972 - RNA, 19 nt, Homo sapiens
ccucagugauuauucuaaa

SEQ ID NO: 182973 - RNA, 19 nt, Homo sapiens
aaaggaaguugaauaagag

SEQ ID NO: 182974 - RNA, 19 nt, Homo sapiens
gaacacuggaggagacauu

SEQ ID NO: 182975 - RNA, 19 nt, Homo sapiens
ccaagaaaguugcagugau

SEQ ID NO: 182976 - RNA, 19 nt, Homo sapiens
ggaggccauuuguuucuga

SEQ ID NO: 182977 - RNA, 19 nt, Homo sapiens
ccugcuaccucagugauua

SEQ ID NO: 182978 - RNA, 19 nt, Homo sapiens
acagaacauugaaaccuuu

SEQ ID NO: 182979 - RNA, 19 nt, Homo sapiens
aaaggacucuguaagauac

SEQ ID NO: 182980 - RNA, 19 nt, Homo sapiens
gauuaaguauuaccaaagg

SEQ ID NO: 182981 - RNA, 19 nt, Homo sapiens
cuuaaaggauccaucuuau

SEQ ID NO: 182982 - RNA, 19 nt, Homo sapiens
gacaaacacuuuccuugac

SEQ ID NO: 182983 - RNA, 19 nt, Homo sapiens
gcaaacgcgucuuggugau

SEQ ID NO: 182984 - RNA, 19 nt, Homo sapiens
gucuauaagucauuaguga

SEQ ID NO: 182985 - RNA, 19 nt, Homo sapiens
gauuauggaaguuuacuga

SEQ ID NO: 182986 - RNA, 19 nt, Homo sapiens
ggugagagauaaacuacag

SEQ ID NO: 182987 - RNA, 19 nt, Homo sapiens
gaccauguacuccuuauca

SEQ ID NO: 182988 - RNA, 19 nt, Homo sapiens
gcacuggacauuuccugaa

SEQ ID NO: 182989 - RNA, 19 nt, Homo sapiens
cuacuugccucucuucuac

SEQ ID NO: 182990 - RNA, 19 nt, Homo sapiens
ggucacaagaguauucaaa

SEQ ID NO: 182991 - RNA, 19 nt, Homo sapiens
gaugagcugccaaacugua

SEQ ID NO: 182992 - RNA, 19 nt, Homo sapiens
cuaguggccuggaaauuca

SEQ ID NO: 182993 - RNA, 19 nt, Homo sapiens
gagcauaccauggccaaga

SEQ ID NO: 182994 - RNA, 19 nt, Homo sapiens
aaacgcgucuuggugauug

SEQ ID NO: 182995 - RNA, 19 nt, Homo sapiens
gguuugcacuggacauuuc

SEQ ID NO: 182996 - RNA, 19 nt, Homo sapiens
cagggucuauaagucauua

SEQ ID NO: 182997 - RNA, 19 nt, Homo sapiens
caaacacuuuccuugacuu

SEQ ID NO: 182998 - RNA, 19 nt, Homo sapiens
ugacuacauugccuacaug

SEQ ID NO: 182999 - RNA, 19 nt, Homo sapiens
ucacaagaguauucaaagg

SEQ ID NO: 183000 - RNA, 19 nt, Homo sapiens
ccuggaaauucaaguauuc

SEQ ID NO: 183001 - RNA, 19 nt, Homo sapiens
aaggaaaugucauguuaca

SEQ ID NO: 183002 - RNA, 19 nt, Homo sapiens
uauggaaguuuacugaauc

SEQ ID NO: 183003 - RNA, 19 nt, Homo sapiens
gauuggggcuauccuuaua

SEQ ID NO: 183004 - RNA, 19 nt, Homo sapiens
cuugggcgcucuucagauu

SEQ ID NO: 183005 - RNA, 19 nt, Homo sapiens
ucagugggauguugucaca

SEQ ID NO: 183006 - RNA, 19 nt, Homo sapiens
gaaaguugcagugauugga

SEQ ID NO: 183007 - RNA, 19 nt, Homo sapiens
guaagucuuuggcgaggau

SEQ ID NO: 183008 - RNA, 19 nt, Homo sapiens
caccagcaaagacaaauuu

SEQ ID NO: 183009 - RNA, 19 nt, Homo sapiens
aaaggaacagcucauuaaa

SEQ ID NO: 183010 - RNA, 19 nt, Homo sapiens
gccuggaaauucaaguauu

SEQ ID NO: 183011 - RNA, 19 nt, Homo sapiens
uuucuaaacuggauucaag

SEQ ID NO: 183012 - RNA, 19 nt, Homo sapiens
gaggauuauggauuaagua

SEQ ID NO: 183013 - RNA, 19 nt, Homo sapiens
uaugaugguuacaagaaga

SEQ ID NO: 183014 - RNA, 19 nt, Homo sapiens
agagauagagcacagcaaa

SEQ ID NO: 183015 - RNA, 19 nt, Homo sapiens
gccaaacuguauccucugu

SEQ ID NO: 183016 - RNA, 19 nt, Homo sapiens
aaacuggauucaagaaagg

SEQ ID NO: 183017 - RNA, 19 nt, Homo sapiens
ucaaagaaucugcucuaug

SEQ ID NO: 183018 - RNA, 19 nt, Homo sapiens
caucaaaugcuguguggau

SEQ ID NO: 183019 - RNA, 19 nt, Homo sapiens
gaugauggaggcuacugaa

SEQ ID NO: 183020 - RNA, 19 nt, Homo sapiens
augaugagcugccaaacug

SEQ ID NO: 183021 - RNA, 19 nt, Homo sapiens
caaguucugccuucacguu

SEQ ID NO: 183022 - RNA, 19 nt, Homo sapiens
ggagacagcugccauauuu

SEQ ID NO: 183023 - RNA, 19 nt, Homo sapiens
ggaaagagagucauuauaa

SEQ ID NO: 183024 - RNA, 19 nt, Homo sapiens
gaaccugucugcuuugaaa

SEQ ID NO: 183025 - RNA, 19 nt, Homo sapiens
uggaagagcuugcugauuu

SEQ ID NO: 183026 - RNA, 19 nt, Homo sapiens
gaagaucuguggccaauca

SEQ ID NO: 183027 - RNA, 19 nt, Homo sapiens
ccagaaaucuacuuuaaug

SEQ ID NO: 183028 - RNA, 19 nt, Homo sapiens
gaaaggaaaugugaaggaa

SEQ ID NO: 183029 - RNA, 19 nt, Homo sapiens
gaaggaagggccaguauuu

SEQ ID NO: 183030 - RNA, 19 nt, Homo sapiens
gaaaggaguaguucuauga

SEQ ID NO: 183031 - RNA, 19 nt, Homo sapiens
gcccagaaaucuacuuuaa

SEQ ID NO: 183032 - RNA, 19 nt, Homo sapiens
cuaaauauguuuccugaga

SEQ ID NO: 183033 - RNA, 19 nt, Homo sapiens
gguaggugcuuaauaaaug

SEQ ID NO: 183034 - RNA, 19 nt, Homo sapiens
gaaaagaauugcugugauu

SEQ ID NO: 183035 - RNA, 19 nt, Homo sapiens
cuaaagagaugaugugcuu

SEQ ID NO: 183036 - RNA, 19 nt, Homo sapiens
cuacauagauaccauggaa

SEQ ID NO: 183037 - RNA, 19 nt, Homo sapiens
ugugguaggugcuuaauaa

SEQ ID NO: 183038 - RNA, 19 nt, Homo sapiens
gcucuugccuucuuugcua

SEQ ID NO: 183039 - RNA, 19 nt, Homo sapiens
ggaagagcuugcugauuug

SEQ ID NO: 183040 - RNA, 19 nt, Homo sapiens
ugaagaagcagccugauuu

SEQ ID NO: 183041 - RNA, 19 nt, Homo sapiens
gaaaugauggcagaaauau

SEQ ID NO: 183042 - RNA, 19 nt, Homo sapiens
gaucuguggccaaucauua

SEQ ID NO: 183043 - RNA, 19 nt, Homo sapiens
ggagaugaaugucuuugau

SEQ ID NO: 183044 - RNA, 19 nt, Homo sapiens
caagcuggcauuacacuua

SEQ ID NO: 183045 - RNA, 19 nt, Homo sapiens
gggauucacuggaaagaga

SEQ ID NO: 183046 - RNA, 19 nt, Homo sapiens
ccacguaacucuucuucug

SEQ ID NO: 183047 - RNA, 19 nt, Homo sapiens
gcagaguucuugacaugug

SEQ ID NO: 183048 - RNA, 19 nt, Homo sapiens
uagcagaguucuugacaug

SEQ ID NO: 183049 - RNA, 19 nt, Homo sapiens
gauguaugccaaagaauuu

SEQ ID NO: 183050 - RNA, 19 nt, Homo sapiens
gggagaccaugacuaagaa

SEQ ID NO: 183051 - RNA, 19 nt, Homo sapiens
gcuauucacuaguguacuu

SEQ ID NO: 183052 - RNA, 19 nt, Homo sapiens
ggaagccucugaugacaag

SEQ ID NO: 183053 - RNA, 19 nt, Homo sapiens
cagggagacuacauagaua

SEQ ID NO: 183054 - RNA, 19 nt, Homo sapiens
cauugaugcuguuaucuuu

SEQ ID NO: 183055 - RNA, 19 nt, Homo sapiens
aaggaaaugugaaggaauu

SEQ ID NO: 183056 - RNA, 19 nt, Homo sapiens
gaauuugaccuucuaaagu

SEQ ID NO: 183057 - RNA, 19 nt, Homo sapiens
uaucccaacuucaugcaua

SEQ ID NO: 183058 - RNA, 19 nt, Homo sapiens
gagcucagguacucuuuua

SEQ ID NO: 183059 - RNA, 19 nt, Homo sapiens
ggauguaugccaaagaauu

SEQ ID NO: 183060 - RNA, 19 nt, Homo sapiens
caggauguaugccaaagaa

SEQ ID NO: 183061 - RNA, 19 nt, Homo sapiens
ucuaugacuucaacaauga

SEQ ID NO: 183062 - RNA, 19 nt, Homo sapiens
gaagaaggaagggccagua

SEQ ID NO: 183063 - RNA, 19 nt, Homo sapiens
uaggaaccaugucuuuauu

SEQ ID NO: 183064 - RNA, 19 nt, Homo sapiens
ugaaaugauggcagaaaua

SEQ ID NO: 183065 - RNA, 19 nt, Homo sapiens
ucacaccaaugcucaucua

SEQ ID NO: 183066 - RNA, 19 nt, Homo sapiens
ggaaccaugucuuuauuuu

SEQ ID NO: 183067 - RNA, 19 nt, Homo sapiens
gauaagacauauagaugcu

SEQ ID NO: 183068 - RNA, 19 nt, Homo sapiens
ugacauugaugcuguuauc

SEQ ID NO: 183069 - RNA, 19 nt, Homo sapiens
caucaauacuucuaaagag

SEQ ID NO: 183070 - RNA, 19 nt, Homo sapiens
gagaaauaauguuccuaca

SEQ ID NO: 183071 - RNA, 19 nt, Homo sapiens
gagucagcauccaaccuua

SEQ ID NO: 183072 - RNA, 19 nt, Homo sapiens
gaaagugaaaggaaaugug

SEQ ID NO: 183073 - RNA, 19 nt, Homo sapiens
guugagcgcuucaggaaag

SEQ ID NO: 183074 - RNA, 19 nt, Homo sapiens
gugaaaugauggcagaaau

SEQ ID NO: 183075 - RNA, 19 nt, Homo sapiens
uauugucacugcccuguuu

SEQ ID NO: 183076 - RNA, 19 nt, Homo sapiens
guggagagccaacgccaua

SEQ ID NO: 183077 - RNA, 19 nt, Homo sapiens
ccacucagguauuuaaagg

SEQ ID NO: 183078 - RNA, 19 nt, Homo sapiens
cgaaagcauuaauucacuu

SEQ ID NO: 183079 - RNA, 19 nt, Homo sapiens
cuucucgacuuacacauuu

SEQ ID NO: 183080 - RNA, 19 nt, Homo sapiens
gaagggccaguauuuacaa

SEQ ID NO: 183081 - RNA, 19 nt, Homo sapiens
cuuggaaccugucugcuuu

SEQ ID NO: 183082 - RNA, 19 nt, Homo sapiens
ugaaaggaguaguucuaug

SEQ ID NO: 183083 - RNA, 19 nt, Homo sapiens
gcacuccaauccacuaucg

SEQ ID NO: 183084 - RNA, 19 nt, Homo sapiens
uaaaugaugaccugccaaa

SEQ ID NO: 183085 - RNA, 19 nt, Homo sapiens
guuugaccaugaaauguuu

SEQ ID NO: 183086 - RNA, 19 nt, Homo sapiens
guaggugcuuaauaaaugu

SEQ ID NO: 183087 - RNA, 19 nt, Homo sapiens
gaaaggccaacucuugcaa

SEQ ID NO: 183088 - RNA, 19 nt, Homo sapiens
ggcuauagcuuugacuuuc

SEQ ID NO: 183089 - RNA, 19 nt, Homo sapiens
ggaagggccaguauuuaca

SEQ ID NO: 183090 - RNA, 19 nt, Homo sapiens
acauauagaugcuuaagac

SEQ ID NO: 183091 - RNA, 19 nt, Homo sapiens
caagugcugcguagaagaa

SEQ ID NO: 183092 - RNA, 19 nt, Homo sapiens
gcuggcauuacacuuauua

SEQ ID NO: 183093 - RNA, 19 nt, Homo sapiens
ggccaacucuugcaaucau

SEQ ID NO: 183094 - RNA, 19 nt, Homo sapiens
gggcuuggauccugaaucg

SEQ ID NO: 183095 - RNA, 19 nt, Homo sapiens
cuacagaugccuucagaau

SEQ ID NO: 183096 - RNA, 19 nt, Homo sapiens
ugacaagaguaguugaaag

SEQ ID NO: 183097 - RNA, 19 nt, Homo sapiens
uaaagacauugcccucaca

SEQ ID NO: 183098 - RNA, 19 nt, Homo sapiens
ccagggaggaugacauuga

SEQ ID NO: 183099 - RNA, 19 nt, Homo sapiens
aaagugaaaggaaauguga

SEQ ID NO: 183100 - RNA, 19 nt, Homo sapiens
gaugaccugccaaaucgua

SEQ ID NO: 183101 - RNA, 19 nt, Homo sapiens
gcucaucuaccucuggaaa

SEQ ID NO: 183102 - RNA, 19 nt, Homo sapiens
cacugaaucugaagggaaa

SEQ ID NO: 183103 - RNA, 19 nt, Homo sapiens
cuaguguacuugaaacaug

SEQ ID NO: 183104 - RNA, 19 nt, Homo sapiens
caucaagugcugcguagaa

SEQ ID NO: 183105 - RNA, 19 nt, Homo sapiens
aaauauguuuccugagaga

SEQ ID NO: 183106 - RNA, 19 nt, Homo sapiens
gacaugugguaggugcuua

SEQ ID NO: 183107 - RNA, 19 nt, Homo sapiens
gacucucaguuucauauug

SEQ ID NO: 183108 - RNA, 19 nt, Homo sapiens
guugaaaggaguaguucua

SEQ ID NO: 183109 - RNA, 19 nt, Homo sapiens
caauacuucuaaagagaug

SEQ ID NO: 183110 - RNA, 19 nt, Homo sapiens
agacagcugccauauuuga

SEQ ID NO: 183111 - RNA, 19 nt, Homo sapiens
gcugauguguuguucucuu

SEQ ID NO: 183112 - RNA, 19 nt, Homo sapiens
gcacuggccaucacaccaa

SEQ ID NO: 183113 - RNA, 19 nt, Homo sapiens
guaguucuaugacuucaac

SEQ ID NO: 183114 - RNA, 19 nt, Homo sapiens
ugaaauguuuggccugaag

SEQ ID NO: 183115 - RNA, 19 nt, Homo sapiens
guuguucucuucucgacuu

SEQ ID NO: 183116 - RNA, 19 nt, Homo sapiens
gagaugaaugucuuugaug

SEQ ID NO: 183117 - RNA, 19 nt, Homo sapiens
ccauuuguauuaacucauc

SEQ ID NO: 183118 - RNA, 19 nt, Homo sapiens
gacaauaggcaaguuuaug

SEQ ID NO: 183119 - RNA, 19 nt, Homo sapiens
gagacuacauagauaccau

SEQ ID NO: 183120 - RNA, 19 nt, Homo sapiens
ucagggagacuacauagau

SEQ ID NO: 183121 - RNA, 19 nt, Homo sapiens
gccaacucuugcaaucaua

SEQ ID NO: 183122 - RNA, 19 nt, Homo sapiens
gaaagcaucugcaugugaa

SEQ ID NO: 183123 - RNA, 19 nt, Homo sapiens
gcaauaggaucaaugaguu

SEQ ID NO: 183124 - RNA, 19 nt, Homo sapiens
caaaggagcuccgauguga

SEQ ID NO: 183125 - RNA, 19 nt, Homo sapiens
gcauuuggcuugaugguuu

SEQ ID NO: 183126 - RNA, 19 nt, Homo sapiens
gaagguggcuuuugcuuua

SEQ ID NO: 183127 - RNA, 19 nt, Homo sapiens
ggacagaaguggugguaga

SEQ ID NO: 183128 - RNA, 19 nt, Homo sapiens
gcacuuaauucuucccauu

SEQ ID NO: 183129 - RNA, 19 nt, Homo sapiens
uggcuaaccugaccaauaa

SEQ ID NO: 183130 - RNA, 19 nt, Homo sapiens
caaauuggcugaguugaga

SEQ ID NO: 183131 - RNA, 19 nt, Homo sapiens
ucacaucucugagcuauau

SEQ ID NO: 183132 - RNA, 19 nt, Homo sapiens
ggacagaccgugugacaga

SEQ ID NO: 183133 - RNA, 19 nt, Homo sapiens
gaagugggcaguuccauga

SEQ ID NO: 183134 - RNA, 19 nt, Homo sapiens
gcuauauccucauuaguga

SEQ ID NO: 183135 - RNA, 19 nt, Homo sapiens
gcaggaagauucuauaucc

SEQ ID NO: 183136 - RNA, 19 nt, Homo sapiens
ccacagggcugcucuggau

SEQ ID NO: 183137 - RNA, 19 nt, Homo sapiens
gaaggaggaugugguuaau

SEQ ID NO: 183138 - RNA, 19 nt, Homo sapiens
aggcuuagaucaauguaua

SEQ ID NO: 183139 - RNA, 19 nt, Homo sapiens
ggaugugguuaaucuguuu

SEQ ID NO: 183140 - RNA, 19 nt, Homo sapiens
ccaaacacaccucaaauug

SEQ ID NO: 183141 - RNA, 19 nt, Homo sapiens
gaucugaggucauggaacu

SEQ ID NO: 183142 - RNA, 19 nt, Homo sapiens
caaaccagcucauuucaac

SEQ ID NO: 183143 - RNA, 19 nt, Homo sapiens
gcauacaacccucugcuuu

SEQ ID NO: 183144 - RNA, 19 nt, Homo sapiens
gcccagcacuuucugcauu

SEQ ID NO: 183145 - RNA, 19 nt, Homo sapiens
gaaggcgucuuugacaaug

SEQ ID NO: 183146 - RNA, 19 nt, Homo sapiens
caugggcaauaguauauaa

SEQ ID NO: 183147 - RNA, 19 nt, Homo sapiens
ucacggcucuuaaguucuu

SEQ ID NO: 183148 - RNA, 19 nt, Homo sapiens
cuuaaguucuucccaauga

SEQ ID NO: 183149 - RNA, 19 nt, Homo sapiens
gaaagcagccccaguaguu

SEQ ID NO: 183150 - RNA, 19 nt, Homo sapiens
ccagcugccucuucugaaa

SEQ ID NO: 183151 - RNA, 19 nt, Homo sapiens
agaguuagcccaaguauag

SEQ ID NO: 183152 - RNA, 19 nt, Homo sapiens
gaaaggacaccaggaguca

SEQ ID NO: 183153 - RNA, 19 nt, Homo sapiens
ccacuuuccuccacagaug

SEQ ID NO: 183154 - RNA, 19 nt, Homo sapiens
aagcaugagugguggcuaa

SEQ ID NO: 183155 - RNA, 19 nt, Homo sapiens
ugaacaccaucaugccuuu

SEQ ID NO: 183156 - RNA, 19 nt, Homo sapiens
gccaaacacaccucaaauu

SEQ ID NO: 183157 - RNA, 19 nt, Homo sapiens
ccagcaugaugauaauauu

SEQ ID NO: 183158 - RNA, 19 nt, Homo sapiens
ucucacggcucuuaaguuc

SEQ ID NO: 183159 - RNA, 19 nt, Homo sapiens
ggcagaagcucacucuuuu

SEQ ID NO: 183160 - RNA, 19 nt, Homo sapiens
acaaccagcugcagaagau

SEQ ID NO: 183161 - RNA, 19 nt, Homo sapiens
guacauggagcacaacaau

SEQ ID NO: 183162 - RNA, 19 nt, Homo sapiens
gaggagaguuagcccaagu

SEQ ID NO: 183163 - RNA, 19 nt, Homo sapiens
ggaaggcgucuuugacaau

SEQ ID NO: 183164 - RNA, 19 nt, Homo sapiens
caccaggagucacuucuau

SEQ ID NO: 183165 - RNA, 19 nt, Homo sapiens
gaacaccaucaugccuuua

SEQ ID NO: 183166 - RNA, 19 nt, Homo sapiens
cccaguaguuccauucuug

SEQ ID NO: 183167 - RNA, 19 nt, Homo sapiens
cgcccaagcugcuguaugu

SEQ ID NO: 183168 - RNA, 19 nt, Homo sapiens
gugauaaggugggcaggaa

SEQ ID NO: 183169 - RNA, 19 nt, Homo sapiens
uaaccugaccaauaaaguu

SEQ ID NO: 183170 - RNA, 19 nt, Homo sapiens
agaaggaggaugugguuaa

SEQ ID NO: 183171 - RNA, 19 nt, Homo sapiens
uaauauucaugaccugaug

SEQ ID NO: 183172 - RNA, 19 nt, Homo sapiens
guggcuaaccugaccaaua

SEQ ID NO: 183173 - RNA, 19 nt, Homo sapiens
acaccaucaugccuuuaua

SEQ ID NO: 183174 - RNA, 19 nt, Homo sapiens
gagaguuagcccaaguaua

SEQ ID NO: 183175 - RNA, 19 nt, Homo sapiens
caagcaggaagauucuaua

SEQ ID NO: 183176 - RNA, 19 nt, Homo sapiens
ucaaguaccugcccuucgu

SEQ ID NO: 183177 - RNA, 19 nt, Homo sapiens
uaacccaccugcccuuugg

SEQ ID NO: 183178 - RNA, 19 nt, Homo sapiens
guccuaaggccauaguuaa

SEQ ID NO: 183179 - RNA, 19 nt, Homo sapiens
gauuggaggucaccagcau

SEQ ID NO: 183180 - RNA, 19 nt, Homo sapiens
gaggucaccagcaugauga

SEQ ID NO: 183181 - RNA, 19 nt, Homo sapiens
gugagcaucugcccagcaa

SEQ ID NO: 183182 - RNA, 19 nt, Homo sapiens
guagucuucuuuccuguag

SEQ ID NO: 183183 - RNA, 19 nt, Homo sapiens
gggccaaacacaccucaaa

SEQ ID NO: 183184 - RNA, 19 nt, Homo sapiens
ucaccagcaugaugauaau

SEQ ID NO: 183185 - RNA, 19 nt, Homo sapiens
acaacagucuaaccaacaa

SEQ ID NO: 183186 - RNA, 19 nt, Homo sapiens
gcagccagcaguccaccua

SEQ ID NO: 183187 - RNA, 19 nt, Homo sapiens
aaccugaccaauaaaguua

SEQ ID NO: 183188 - RNA, 19 nt, Homo sapiens
caaacacaccucaaauugg

SEQ ID NO: 183189 - RNA, 19 nt, Homo sapiens
gcucuuugaagguggauaa

SEQ ID NO: 183190 - RNA, 19 nt, Homo sapiens
ggaggucaccagcaugaug

SEQ ID NO: 183191 - RNA, 19 nt, Homo sapiens
auaaaucucacggcucuua

SEQ ID NO: 183192 - RNA, 19 nt, Homo sapiens
gaucaccuccauccaggaa

SEQ ID NO: 183193 - RNA, 19 nt, Homo sapiens
auacaacccucugcuuuca

SEQ ID NO: 183194 - RNA, 19 nt, Homo sapiens
ggacuugcuagcccaaaga

SEQ ID NO: 183195 - RNA, 19 nt, Homo sapiens
ucaaugaguucuccaucag

SEQ ID NO: 183196 - RNA, 19 nt, Homo sapiens
ggaaagccaccagauugga

SEQ ID NO: 183197 - RNA, 19 nt, Homo sapiens
ggcaugggcaauaguauau

SEQ ID NO: 183198 - RNA, 19 nt, Homo sapiens
aggcagaagcucacucuuu

SEQ ID NO: 183199 - RNA, 19 nt, Homo sapiens
ugguuuggcuuauggaaga

SEQ ID NO: 183200 - RNA, 19 nt, Homo sapiens
gaaccucacggccuuguac

SEQ ID NO: 183201 - RNA, 19 nt, Homo sapiens
ccagggcucuucagaaagc

SEQ ID NO: 183202 - RNA, 19 nt, Homo sapiens
aaagaaggaggaugugguu

SEQ ID NO: 183203 - RNA, 19 nt, Homo sapiens
gcccaaagaaggaggaugu

SEQ ID NO: 183204 - RNA, 19 nt, Homo sapiens
ggagaguuagcccaaguau

SEQ ID NO: 183205 - RNA, 19 nt, Homo sapiens
gguagcggccacaugguuu

SEQ ID NO: 183206 - RNA, 19 nt, Homo sapiens
cuaugacccuuacccguau

SEQ ID NO: 183207 - RNA, 19 nt, Homo sapiens
gacagaccgugugacagaa

SEQ ID NO: 183208 - RNA, 19 nt, Homo sapiens
gaugguuugguuuggcuua

SEQ ID NO: 183209 - RNA, 19 nt, Homo sapiens
ggcaauaggaucaaugagu

SEQ ID NO: 183210 - RNA, 19 nt, Homo sapiens
gagcuagaccucuccuaca

SEQ ID NO: 183211 - RNA, 19 nt, Homo sapiens
caccaucaugccuuuauaa

SEQ ID NO: 183212 - RNA, 19 nt, Homo sapiens
agaaagcaucugcauguga

SEQ ID NO: 183213 - RNA, 19 nt, Homo sapiens
ggggagcacuuaauucuuc

SEQ ID NO: 183214 - RNA, 19 nt, Homo sapiens
gaggaugugguuaaucugu

SEQ ID NO: 183215 - RNA, 19 nt, Homo sapiens
uauccaagcaggaagauuc

SEQ ID NO: 183216 - RNA, 19 nt, Homo sapiens
ggccagacuuugcuuacca

SEQ ID NO: 183217 - RNA, 19 nt, Homo sapiens
uugagcagcuguacaugga

SEQ ID NO: 183218 - RNA, 19 nt, Homo sapiens
acgaugagauccaggaagu

SEQ ID NO: 183219 - RNA, 19 nt, Homo sapiens
ggcuguaccuggaccacaa

SEQ ID NO: 183220 - RNA, 19 nt, Homo sapiens
ccaagcaggaagauucuau

SEQ ID NO: 183221 - RNA, 19 nt, Homo sapiens
gcaugggcaauaguauaua

SEQ ID NO: 183222 - RNA, 19 nt, Homo sapiens
gcagugauauucuuuguua

SEQ ID NO: 183223 - RNA, 19 nt, Homo sapiens
gaagauaccugcacauuuc

SEQ ID NO: 183224 - RNA, 19 nt, Homo sapiens
ggaagcagguuaaauguuu

SEQ ID NO: 183225 - RNA, 19 nt, Homo sapiens
agaaugaccuuguaaugua

SEQ ID NO: 183226 - RNA, 19 nt, Homo sapiens
gcaauauucucuguacaua

SEQ ID NO: 183227 - RNA, 19 nt, Homo sapiens
ugagagagauguguaauuu

SEQ ID NO: 183228 - RNA, 19 nt, Homo sapiens
ggaggaggcuucaaaggaa

SEQ ID NO: 183229 - RNA, 19 nt, Homo sapiens
gaacgucuaagaucuguua

SEQ ID NO: 183230 - RNA, 19 nt, Homo sapiens
cgaauuugcugaagaugua

SEQ ID NO: 183231 - RNA, 19 nt, Homo sapiens
gaacacaaauuaugcuaag

SEQ ID NO: 183232 - RNA, 19 nt, Homo sapiens
gaaguuagccuuuaucuac

SEQ ID NO: 183233 - RNA, 19 nt, Homo sapiens
gcacugaaguuugauaaau

SEQ ID NO: 183234 - RNA, 19 nt, Homo sapiens
guaagcagcuggagaguuc

SEQ ID NO: 183235 - RNA, 19 nt, Homo sapiens
uaaaggauguucaugaaga

SEQ ID NO: 183236 - RNA, 19 nt, Homo sapiens
gaaugaccuuguaauguaa

SEQ ID NO: 183237 - RNA, 19 nt, Homo sapiens
ccaaagaggcggcacauaa

SEQ ID NO: 183238 - RNA, 19 nt, Homo sapiens
uaacugcucuugggcaaua

SEQ ID NO: 183239 - RNA, 19 nt, Homo sapiens
gcaacaaacugcacaugau

SEQ ID NO: 183240 - RNA, 19 nt, Homo sapiens
caaacccugucaaacauua

SEQ ID NO: 183241 - RNA, 19 nt, Homo sapiens
gaaaugaagaagcuaguaa

SEQ ID NO: 183242 - RNA, 19 nt, Homo sapiens
gcaagcaguuucaauaaag

SEQ ID NO: 183243 - RNA, 19 nt, Homo sapiens
caacaaaccugccacaaaa

SEQ ID NO: 183244 - RNA, 19 nt, Homo sapiens
gaucagaguugacugcaau

SEQ ID NO: 183245 - RNA, 19 nt, Homo sapiens
caaauucccuuccuuccaa

SEQ ID NO: 183246 - RNA, 19 nt, Homo sapiens
ucaaugaagucaccucaaa

SEQ ID NO: 183247 - RNA, 19 nt, Homo sapiens
gaaggucauuuccauguau

SEQ ID NO: 183248 - RNA, 19 nt, Homo sapiens
gcacagggcaugaaaugaa

SEQ ID NO: 183249 - RNA, 19 nt, Homo sapiens
gagauuucaugaacaguuu

SEQ ID NO: 183250 - RNA, 19 nt, Homo sapiens
caauaacaguugcauuuga

SEQ ID NO: 183251 - RNA, 19 nt, Homo sapiens
guaaagaucguaaccagaa

SEQ ID NO: 183252 - RNA, 19 nt, Homo sapiens
gcaaaugugugccaaagag

SEQ ID NO: 183253 - RNA, 19 nt, Homo sapiens
ccagaagacuuacggcaaa

SEQ ID NO: 183254 - RNA, 19 nt, Homo sapiens
gaaaguguucuguuacaaa

SEQ ID NO: 183255 - RNA, 19 nt, Homo sapiens
gggaauguauaguauuuga

SEQ ID NO: 183256 - RNA, 19 nt, Homo sapiens
ccagaaaccugaacucaag

SEQ ID NO: 183257 - RNA, 19 nt, Homo sapiens
gcacuaaguugucucugau

SEQ ID NO: 183258 - RNA, 19 nt, Homo sapiens
gaguuggaguucauucaua

SEQ ID NO: 183259 - RNA, 19 nt, Homo sapiens
ucuguaagcuguuugguuu

SEQ ID NO: 183260 - RNA, 19 nt, Homo sapiens
ggcaugaaaugaacacaaa

SEQ ID NO: 183261 - RNA, 19 nt, Homo sapiens
guacuuugauucacauguu

SEQ ID NO: 183262 - RNA, 19 nt, Homo sapiens
cauaggaaguuagccuuua

SEQ ID NO: 183263 - RNA, 19 nt, Homo sapiens
gaacuaucuucaucugaga

SEQ ID NO: 183264 - RNA, 19 nt, Homo sapiens
cagaauaccuccagugaag

SEQ ID NO: 183265 - RNA, 19 nt, Homo sapiens
gagacgaacucagugauug

SEQ ID NO: 183266 - RNA, 19 nt, Homo sapiens
guuaguggcuucaucaguu

SEQ ID NO: 183267 - RNA, 19 nt, Homo sapiens
gcacauaugcugauugaca

SEQ ID NO: 183268 - RNA, 19 nt, Homo sapiens
ggauauacuucaggaacua

SEQ ID NO: 183269 - RNA, 19 nt, Homo sapiens
uaaaggaaguagaccaguu

SEQ ID NO: 183270 - RNA, 19 nt, Homo sapiens
caugaacaguuuaucguaa

SEQ ID NO: 183271 - RNA, 19 nt, Homo sapiens
gaugauaaagggugaguuu

SEQ ID NO: 183272 - RNA, 19 nt, Homo sapiens
gaccuucacucuaagaugu

SEQ ID NO: 183273 - RNA, 19 nt, Homo sapiens
uuggagagauuacaaauug

SEQ ID NO: 183274 - RNA, 19 nt, Homo sapiens
uaaguugucucugauaaug

SEQ ID NO: 183275 - RNA, 19 nt, Homo sapiens
gggccuaacuugcuuaaag

SEQ ID NO: 183276 - RNA, 19 nt, Homo sapiens
guugacauuuguuugguua

SEQ ID NO: 183277 - RNA, 19 nt, Homo sapiens
gagagaggcuaaaauguuu

SEQ ID NO: 183278 - RNA, 19 nt, Homo sapiens
ggaugugccagaagacuua

SEQ ID NO: 183279 - RNA, 19 nt, Homo sapiens
ggauaugccugcucuuugg

SEQ ID NO: 183280 - RNA, 19 nt, Homo sapiens
gaugagcaguugcgacaga

SEQ ID NO: 183281 - RNA, 19 nt, Homo sapiens
ggaucaggaugcagugaaa

SEQ ID NO: 183282 - RNA, 19 nt, Homo sapiens
gugaugaaguugaggugua

SEQ ID NO: 183283 - RNA, 19 nt, Homo sapiens
caacaaacugcacaugauu

SEQ ID NO: 183284 - RNA, 19 nt, Homo sapiens
gagcagugauauucuuugu

SEQ ID NO: 183285 - RNA, 19 nt, Homo sapiens
agaguugacugcaauaaug

SEQ ID NO: 183286 - RNA, 19 nt, Homo sapiens
caccaaaucguacagauaa

SEQ ID NO: 183287 - RNA, 19 nt, Homo sapiens
gaugcaauccuuacaaaug

SEQ ID NO: 183288 - RNA, 19 nt, Homo sapiens
aaacagaaauugguaccuu

SEQ ID NO: 183289 - RNA, 19 nt, Homo sapiens
gaagauaaguuggaaacac

SEQ ID NO: 183290 - RNA, 19 nt, Homo sapiens
ugaaaugugugugauguga

SEQ ID NO: 183291 - RNA, 19 nt, Homo sapiens
guaguagaccuuacagaaa

SEQ ID NO: 183292 - RNA, 19 nt, Homo sapiens
gguaguagaccuuacagaa

SEQ ID NO: 183293 - RNA, 19 nt, Homo sapiens
aaagcuaugugacugauga

SEQ ID NO: 183294 - RNA, 19 nt, Homo sapiens
uguaaaggauguucaugaa

SEQ ID NO: 183295 - RNA, 19 nt, Homo sapiens
aauaugcacuagucucuuu

SEQ ID NO: 183296 - RNA, 19 nt, Homo sapiens
gacaacagauuggauuuua

SEQ ID NO: 183297 - RNA, 19 nt, Homo sapiens
gaucacucccgaacagaua

SEQ ID NO: 183298 - RNA, 19 nt, Homo sapiens
caauggcgcuuucuacaag

SEQ ID NO: 183299 - RNA, 19 nt, Homo sapiens
gaagauucaauaacaguug

SEQ ID NO: 183300 - RNA, 19 nt, Homo sapiens
gaaauuucacgucauagga

SEQ ID NO: 183301 - RNA, 19 nt, Homo sapiens
cugcauaauucugaaguua

SEQ ID NO: 183302 - RNA, 19 nt, Homo sapiens
uaguagaccuuacagaaau

SEQ ID NO: 183303 - RNA, 19 nt, Homo sapiens
ccacuguucuuuuggauua

SEQ ID NO: 183304 - RNA, 19 nt, Homo sapiens
caaaggacagcaucgcuaa

SEQ ID NO: 183305 - RNA, 19 nt, Homo sapiens
ggucacugcuauugaucua

SEQ ID NO: 183306 - RNA, 19 nt, Homo sapiens
ccaacaaaccugccacaaa

SEQ ID NO: 183307 - RNA, 19 nt, Homo sapiens
ggaguucauucauauuaca

SEQ ID NO: 183308 - RNA, 19 nt, Homo sapiens
uagcagggcugaagagaag

SEQ ID NO: 183309 - RNA, 19 nt, Homo sapiens
acagauggaucccuucaga

SEQ ID NO: 183310 - RNA, 19 nt, Homo sapiens
gaggaggcuucaaaggaaa

SEQ ID NO: 183311 - RNA, 19 nt, Homo sapiens
cagcuugccucgagauuuc

SEQ ID NO: 183312 - RNA, 19 nt, Homo sapiens
gcuaaagugaggaugauaa

SEQ ID NO: 183313 - RNA, 19 nt, Homo sapiens
agacuaagaucgguuaaca

SEQ ID NO: 183314 - RNA, 19 nt, Homo sapiens
gauaaucguccacguaauc

SEQ ID NO: 183315 - RNA, 19 nt, Homo sapiens
ggaaugggucgagguagua

SEQ ID NO: 183316 - RNA, 19 nt, Homo sapiens
cagauuccauuucaugaug

SEQ ID NO: 183317 - RNA, 19 nt, Homo sapiens
gaucuuccucugcuaaauu

SEQ ID NO: 183318 - RNA, 19 nt, Homo sapiens
ucauuuccauguaugcaua

SEQ ID NO: 183319 - RNA, 19 nt, Homo sapiens
gaaugcaugcuuuccauau

SEQ ID NO: 183320 - RNA, 19 nt, Homo sapiens
cagauaaucguccacguaa

SEQ ID NO: 183321 - RNA, 19 nt, Homo sapiens
ccacagagacgaacucagu

SEQ ID NO: 183322 - RNA, 19 nt, Homo sapiens
ggaaaggcaugcuguauua

SEQ ID NO: 183323 - RNA, 19 nt, Homo sapiens
gaagaaagggugacauuua

SEQ ID NO: 183324 - RNA, 19 nt, Homo sapiens
gagcuuugcuguuucauua

SEQ ID NO: 183325 - RNA, 19 nt, Homo sapiens
gaauuuagcuguaacaugu

SEQ ID NO: 183326 - RNA, 19 nt, Homo sapiens
ccagaggacuuucuuguua

SEQ ID NO: 183327 - RNA, 19 nt, Homo sapiens
caaacaagaugcagacuuu

SEQ ID NO: 183328 - RNA, 19 nt, Homo sapiens
gagaauagcugagaagaau

SEQ ID NO: 183329 - RNA, 19 nt, Homo sapiens
gaagccagcugucauauuc

SEQ ID NO: 183330 - RNA, 19 nt, Homo sapiens
gaagauugaccuugacuua

SEQ ID NO: 183331 - RNA, 19 nt, Homo sapiens
gaagagacccugcaaauca

SEQ ID NO: 183332 - RNA, 19 nt, Homo sapiens
uaagagaacugaaggcaaa

SEQ ID NO: 183333 - RNA, 19 nt, Homo sapiens
gcuccaagcugcagucuaa

SEQ ID NO: 183334 - RNA, 19 nt, Homo sapiens
gcaggagacuaaucagaua

SEQ ID NO: 183335 - RNA, 19 nt, Homo sapiens
gagauauucugucaaauga

SEQ ID NO: 183336 - RNA, 19 nt, Homo sapiens
caagguagcugaauauaca

SEQ ID NO: 183337 - RNA, 19 nt, Homo sapiens
gaaagagcccuaaacauug

SEQ ID NO: 183338 - RNA, 19 nt, Homo sapiens
gggaagcacuugugauaaa

SEQ ID NO: 183339 - RNA, 19 nt, Homo sapiens
ggaacguucucuuugguua

SEQ ID NO: 183340 - RNA, 19 nt, Homo sapiens
aaacauggaggaugaauua

SEQ ID NO: 183341 - RNA, 19 nt, Homo sapiens
caucauggauuuaggagua

SEQ ID NO: 183342 - RNA, 19 nt, Homo sapiens
ugaaagagcccuaaacauu

SEQ ID NO: 183343 - RNA, 19 nt, Homo sapiens
gaagccauguuguuaauau

SEQ ID NO: 183344 - RNA, 19 nt, Homo sapiens
gaaagggugacauuuauuu

SEQ ID NO: 183345 - RNA, 19 nt, Homo sapiens
caugaaagaugcaaacuug

SEQ ID NO: 183346 - RNA, 19 nt, Homo sapiens
gaaggcaaauucugugcua

SEQ ID NO: 183347 - RNA, 19 nt, Homo sapiens
aaacaaaggugaugcacuu

SEQ ID NO: 183348 - RNA, 19 nt, Homo sapiens
aaacuaagcucaguaacaa

SEQ ID NO: 183349 - RNA, 19 nt, Homo sapiens
gaugcaaacuugugugauu

SEQ ID NO: 183350 - RNA, 19 nt, Homo sapiens
caaaugagauugauuccau

SEQ ID NO: 183351 - RNA, 19 nt, Homo sapiens
gauuggagcuuugcuguuu

SEQ ID NO: 183352 - RNA, 19 nt, Homo sapiens
ccuaguggcuuccucuuua

SEQ ID NO: 183353 - RNA, 19 nt, Homo sapiens
gcaaagaagagauugguuu

SEQ ID NO: 183354 - RNA, 19 nt, Homo sapiens
gcauaaauacuaccacuuu

SEQ ID NO: 183355 - RNA, 19 nt, Homo sapiens
gaacacgcuuggaaacuau

SEQ ID NO: 183356 - RNA, 19 nt, Homo sapiens
gaaagauaaucccaacaug

SEQ ID NO: 183357 - RNA, 19 nt, Homo sapiens
gaaaguagcaccacugaca

SEQ ID NO: 183358 - RNA, 19 nt, Homo sapiens
ccaacaagaugucucugua

SEQ ID NO: 183359 - RNA, 19 nt, Homo sapiens
aaugaaaucugggcaaaua

SEQ ID NO: 183360 - RNA, 19 nt, Homo sapiens
caacaacauuuacacaguu

SEQ ID NO: 183361 - RNA, 19 nt, Homo sapiens
gcaaagcugugaauuaugc

SEQ ID NO: 183362 - RNA, 19 nt, Homo sapiens
cuaagaagcugaagcacaa

SEQ ID NO: 183363 - RNA, 19 nt, Homo sapiens
ggaaugaaaucugggcaaa

SEQ ID NO: 183364 - RNA, 19 nt, Homo sapiens
ucagaggguucauauuuaa

SEQ ID NO: 183365 - RNA, 19 nt, Homo sapiens
guuuaucacuccucuauuu

SEQ ID NO: 183366 - RNA, 19 nt, Homo sapiens
caauagaaguugcagagaa

SEQ ID NO: 183367 - RNA, 19 nt, Homo sapiens
acaaagagcuagaaaugug

SEQ ID NO: 183368 - RNA, 19 nt, Homo sapiens
gucagaggguucauauuua

SEQ ID NO: 183369 - RNA, 19 nt, Homo sapiens
gcacguggagguuagaaua

SEQ ID NO: 183370 - RNA, 19 nt, Homo sapiens
gaccaaaucugacaaucga

SEQ ID NO: 183371 - RNA, 19 nt, Homo sapiens
ugaaagacuuguaguucua

SEQ ID NO: 183372 - RNA, 19 nt, Homo sapiens
ggaccagucucaagccaaa

SEQ ID NO: 183373 - RNA, 19 nt, Homo sapiens
guagguaaauugacugaga

SEQ ID NO: 183374 - RNA, 19 nt, Homo sapiens
ucaaucauauucacccaua

SEQ ID NO: 183375 - RNA, 19 nt, Homo sapiens
caacgaggcuaaguuaaug

SEQ ID NO: 183376 - RNA, 19 nt, Homo sapiens
gcacggccuuauucucaua

SEQ ID NO: 183377 - RNA, 19 nt, Homo sapiens
ugguugagcuuuauguuua

SEQ ID NO: 183378 - RNA, 19 nt, Homo sapiens
caaguggucuuacauauac

SEQ ID NO: 183379 - RNA, 19 nt, Homo sapiens
caaagccacugcccacaaa

SEQ ID NO: 183380 - RNA, 19 nt, Homo sapiens
cagcagcacucccaaagaa

SEQ ID NO: 183381 - RNA, 19 nt, Homo sapiens
ugacucaaguugucucuuu

SEQ ID NO: 183382 - RNA, 19 nt, Homo sapiens
gagcaucccugcagcugaa

SEQ ID NO: 183383 - RNA, 19 nt, Homo sapiens
acuccaaacucucuaaaua

SEQ ID NO: 183384 - RNA, 19 nt, Homo sapiens
caacaaguggucuuacaua

SEQ ID NO: 183385 - RNA, 19 nt, Homo sapiens
cauacaagguagcugaaua

SEQ ID NO: 183386 - RNA, 19 nt, Homo sapiens
gacagucccuacaauauug

SEQ ID NO: 183387 - RNA, 19 nt, Homo sapiens
caaugaggcugaagaacuu

SEQ ID NO: 183388 - RNA, 19 nt, Homo sapiens
ggaaagaaccaagaccuaa

SEQ ID NO: 183389 - RNA, 19 nt, Homo sapiens
gagaacagcuuugggaauc

SEQ ID NO: 183390 - RNA, 19 nt, Homo sapiens
acaaaugacuccaccuauu

SEQ ID NO: 183391 - RNA, 19 nt, Homo sapiens
gacaauggguagucaaaug

SEQ ID NO: 183392 - RNA, 19 nt, Homo sapiens
uagcaucccuuuccugauu

SEQ ID NO: 183393 - RNA, 19 nt, Homo sapiens
gauaugcauuucucagauu

SEQ ID NO: 183394 - RNA, 19 nt, Homo sapiens
aaauagauguguccugauu

SEQ ID NO: 183395 - RNA, 19 nt, Homo sapiens
ggucuauccuuucauggua

SEQ ID NO: 183396 - RNA, 19 nt, Homo sapiens
gaaucaaugugugaaugua

SEQ ID NO: 183397 - RNA, 19 nt, Homo sapiens
gaagaucccugagaagaag

SEQ ID NO: 183398 - RNA, 19 nt, Homo sapiens
cagagaagaucccugagaa

SEQ ID NO: 183399 - RNA, 19 nt, Homo sapiens
cccauuagccuguauauaa

SEQ ID NO: 183400 - RNA, 19 nt, Homo sapiens
caagaaggcauaaacuaaa

SEQ ID NO: 183401 - RNA, 19 nt, Homo sapiens
gaauguagaaagcuuauga

SEQ ID NO: 183402 - RNA, 19 nt, Homo sapiens
ucacauacuucucaacaga

SEQ ID NO: 183403 - RNA, 19 nt, Homo sapiens
acagagaguuugacaaguu

SEQ ID NO: 183404 - RNA, 19 nt, Homo sapiens
ggagauauucugucaaaug

SEQ ID NO: 183405 - RNA, 19 nt, Homo sapiens
gcacagugaccaaaucuga

SEQ ID NO: 183406 - RNA, 19 nt, Homo sapiens
guagagugccuggcuauua

SEQ ID NO: 183407 - RNA, 19 nt, Homo sapiens
guauaaggcuguggaaguu

SEQ ID NO: 183408 - RNA, 19 nt, Homo sapiens
gaaaguguccaacaaggaa

SEQ ID NO: 183409 - RNA, 19 nt, Homo sapiens
caccagcacugacgaguuu

SEQ ID NO: 183410 - RNA, 19 nt, Homo sapiens
gggaaucugucauuuggaa

SEQ ID NO: 183411 - RNA, 19 nt, Homo sapiens
auagauguguccugauuua

SEQ ID NO: 183412 - RNA, 19 nt, Homo sapiens
uuacaugacuggcagacua

SEQ ID NO: 183413 - RNA, 19 nt, Homo sapiens
ggauggagauauucuguca

SEQ ID NO: 183414 - RNA, 19 nt, Homo sapiens
caccagagcuucuacaaag

SEQ ID NO: 183415 - RNA, 19 nt, Homo sapiens
guaguguugucuuugauaa

SEQ ID NO: 183416 - RNA, 19 nt, Homo sapiens
ggugagacacacuuaaaua

SEQ ID NO: 183417 - RNA, 19 nt, Homo sapiens
uggcaaagcugugaauuau

SEQ ID NO: 183418 - RNA, 19 nt, Homo sapiens
ucacaaugcugauuauuac

SEQ ID NO: 183419 - RNA, 19 nt, Homo sapiens
caaauucugugcuacuuuc

SEQ ID NO: 183420 - RNA, 19 nt, Homo sapiens
gcaguggccuuucaguuca

SEQ ID NO: 183421 - RNA, 19 nt, Homo sapiens
uggagaagaugcuuucaaa

SEQ ID NO: 183422 - RNA, 19 nt, Homo sapiens
gaaagucccuuauugauug

SEQ ID NO: 183423 - RNA, 19 nt, Homo sapiens
ggaaagagaugcgccaauu

SEQ ID NO: 183424 - RNA, 19 nt, Homo sapiens
gaucagagcuccugcacuu

SEQ ID NO: 183425 - RNA, 19 nt, Homo sapiens
gaacaucccugaccugcuu

SEQ ID NO: 183426 - RNA, 19 nt, Homo sapiens
gaugacaccucaauuguug

SEQ ID NO: 183427 - RNA, 19 nt, Homo sapiens
gaacucaaccuuccugaaa

SEQ ID NO: 183428 - RNA, 19 nt, Homo sapiens
gcaagccaauuuccauuaa

SEQ ID NO: 183429 - RNA, 19 nt, Homo sapiens
caaccaagaugcaaauguu

SEQ ID NO: 183430 - RNA, 19 nt, Homo sapiens
ggagucagcugccaagaga

SEQ ID NO: 183431 - RNA, 19 nt, Homo sapiens
gaacagaaauugacaaacc

SEQ ID NO: 183432 - RNA, 19 nt, Homo sapiens
gauauuacaggaucacuua

SEQ ID NO: 183433 - RNA, 19 nt, Homo sapiens
gcagggaaauucuuuggaa

SEQ ID NO: 183434 - RNA, 19 nt, Homo sapiens
ccacagccaucucacauuu

SEQ ID NO: 183435 - RNA, 19 nt, Homo sapiens
ggagacaccuggagcaaga

SEQ ID NO: 183436 - RNA, 19 nt, Homo sapiens
gcaguggucuuaacaaauc

SEQ ID NO: 183437 - RNA, 19 nt, Homo sapiens
gaaggaagcuaccauacca

SEQ ID NO: 183438 - RNA, 19 nt, Homo sapiens
gaccagagaucuuggaugu

SEQ ID NO: 183439 - RNA, 19 nt, Homo sapiens
gaagagacuugcuuugaca

SEQ ID NO: 183440 - RNA, 19 nt, Homo sapiens
caaaugauccuaguaauug

SEQ ID NO: 183441 - RNA, 19 nt, Homo sapiens
gaaucaggcuuuaaacugu

SEQ ID NO: 183442 - RNA, 19 nt, Homo sapiens
gagaagaccggaccaauga

SEQ ID NO: 183443 - RNA, 19 nt, Homo sapiens
ccacuaaccuccaguuugu

SEQ ID NO: 183444 - RNA, 19 nt, Homo sapiens
gcaaaccgcugccaugaag

SEQ ID NO: 183445 - RNA, 19 nt, Homo sapiens
caacauugaucgcccuaaa

SEQ ID NO: 183446 - RNA, 19 nt, Homo sapiens
gcaagcagcaagccaauuu

SEQ ID NO: 183447 - RNA, 19 nt, Homo sapiens
ggaaagucccuuauugauu

SEQ ID NO: 183448 - RNA, 19 nt, Homo sapiens
ggagcucuauuccaccuua

SEQ ID NO: 183449 - RNA, 19 nt, Homo sapiens
gcacaacuucgaauuauga

SEQ ID NO: 183450 - RNA, 19 nt, Homo sapiens
gggcaacucugucaacgaa

SEQ ID NO: 183451 - RNA, 19 nt, Homo sapiens
ggaaccgaauauacaauuu

SEQ ID NO: 183452 - RNA, 19 nt, Homo sapiens
caucucacauuuccaagua

SEQ ID NO: 183453 - RNA, 19 nt, Homo sapiens
gaguaaaccugaagcugaa

SEQ ID NO: 183454 - RNA, 19 nt, Homo sapiens
gaagugauucuaagauuug

SEQ ID NO: 183455 - RNA, 19 nt, Homo sapiens
ucauugcccugaagaauaa

SEQ ID NO: 183456 - RNA, 19 nt, Homo sapiens
ggacuggcauucacugaug

SEQ ID NO: 183457 - RNA, 19 nt, Homo sapiens
ggccaacaaucaacaguuu

SEQ ID NO: 183458 - RNA, 19 nt, Homo sapiens
gaggaaaucugcacaacca

SEQ ID NO: 183459 - RNA, 19 nt, Homo sapiens
gcagcacaacuucgaauua

SEQ ID NO: 183460 - RNA, 19 nt, Homo sapiens
ggugugaacuacaagauug

SEQ ID NO: 183461 - RNA, 19 nt, Homo sapiens
gaagcucucucucagacaa

SEQ ID NO: 183462 - RNA, 19 nt, Homo sapiens
ggaagauguugcagaguug

SEQ ID NO: 183463 - RNA, 19 nt, Homo sapiens
ggucaccuauuacuucaaa

SEQ ID NO: 183464 - RNA, 19 nt, Homo sapiens
gaagagacaacaugaagug

SEQ ID NO: 183465 - RNA, 19 nt, Homo sapiens
ccagagaucuuggauguuc

SEQ ID NO: 183466 - RNA, 19 nt, Homo sapiens
cgagaucagugcauuguug

SEQ ID NO: 183467 - RNA, 19 nt, Homo sapiens
guaauugccuagaaauauc

SEQ ID NO: 183468 - RNA, 19 nt, Homo sapiens
cuucaugccuuuagaugua

SEQ ID NO: 183469 - RNA, 19 nt, Homo sapiens
gaggaaagucccuuauuga

SEQ ID NO: 183470 - RNA, 19 nt, Homo sapiens
ggacaugcauugccuacuc

SEQ ID NO: 183471 - RNA, 19 nt, Homo sapiens
gaagacauaccacguagga

SEQ ID NO: 183472 - RNA, 19 nt, Homo sapiens
cuacacaguuucccauuau

SEQ ID NO: 183473 - RNA, 19 nt, Homo sapiens
agaggaaagucccuuauug

SEQ ID NO: 183474 - RNA, 19 nt, Homo sapiens
gaacaccuuugcagaaguc

SEQ ID NO: 183475 - RNA, 19 nt, Homo sapiens
gcccauagcugagaagugu

SEQ ID NO: 183476 - RNA, 19 nt, Homo sapiens
gcaaugcguugguuuguac

SEQ ID NO: 183477 - RNA, 19 nt, Homo sapiens
gaaguucacucaggucaca

SEQ ID NO: 183478 - RNA, 19 nt, Homo sapiens
ccaacuuccuggugcguua

SEQ ID NO: 183479 - RNA, 19 nt, Homo sapiens
gaaaauggccagaugauga

SEQ ID NO: 183480 - RNA, 19 nt, Homo sapiens
gaaccaagacugagacgau

SEQ ID NO: 183481 - RNA, 19 nt, Homo sapiens
ggaguacaaugucaguguu

SEQ ID NO: 183482 - RNA, 19 nt, Homo sapiens
agacauuacugguuauaga

SEQ ID NO: 183483 - RNA, 19 nt, Homo sapiens
guacaccuguugucauuca

SEQ ID NO: 183484 - RNA, 19 nt, Homo sapiens
cagcacaacuucgaauuau

SEQ ID NO: 183485 - RNA, 19 nt, Homo sapiens
uaaaucaucuuuccaaucc

SEQ ID NO: 183486 - RNA, 19 nt, Homo sapiens
gagaccaccaucaccauua

SEQ ID NO: 183487 - RNA, 19 nt, Homo sapiens
gaaaguacaccuguuguca

SEQ ID NO: 183488 - RNA, 19 nt, Homo sapiens
ggaccacacagaacuauga

SEQ ID NO: 183489 - RNA, 19 nt, Homo sapiens
cgacaggacggacaucuuu

SEQ ID NO: 183490 - RNA, 19 nt, Homo sapiens
caaacuugguggcaacuug

SEQ ID NO: 183491 - RNA, 19 nt, Homo sapiens
ccaaaugauccuaguaauu

SEQ ID NO: 183492 - RNA, 19 nt, Homo sapiens
cagcuuagaguucuucuuu

SEQ ID NO: 183493 - RNA, 19 nt, Homo sapiens
gaaguggucauuucagaug

SEQ ID NO: 183494 - RNA, 19 nt, Homo sapiens
gaagaccggaccaaugaaa

SEQ ID NO: 183495 - RNA, 19 nt, Homo sapiens
ggagaagaccggaccaaug

SEQ ID NO: 183496 - RNA, 19 nt, Homo sapiens
cagaauauguagugagugu

SEQ ID NO: 183497 - RNA, 19 nt, Homo sapiens
gacuggugguuacauguua

SEQ ID NO: 183498 - RNA, 19 nt, Homo sapiens
ggucaguccuacaagauug

SEQ ID NO: 183499 - RNA, 19 nt, Homo sapiens
gauaagaggaauuugguau

SEQ ID NO: 183500 - RNA, 19 nt, Homo sapiens
gugagugucuaugcucuua

SEQ ID NO: 183501 - RNA, 19 nt, Homo sapiens
ucaaguggcugccuucaag

SEQ ID NO: 183502 - RNA, 19 nt, Homo sapiens
gaaagagaugcgccaauug

SEQ ID NO: 183503 - RNA, 19 nt, Homo sapiens
caagaaaguacaccuguug

SEQ ID NO: 183504 - RNA, 19 nt, Homo sapiens
ggaagaaaaucaagaaagu

SEQ ID NO: 183505 - RNA, 19 nt, Homo sapiens
caucacaggguacagaaua

SEQ ID NO: 183506 - RNA, 19 nt, Homo sapiens
ugccaaagcuuuacuacug

SEQ ID NO: 183507 - RNA, 19 nt, Homo sapiens
caucagagaacaaacacua

SEQ ID NO: 183508 - RNA, 19 nt, Homo sapiens
gaauaucucggugccauuu

SEQ ID NO: 183509 - RNA, 19 nt, Homo sapiens
ggagaugagugggaacgaa

SEQ ID NO: 183510 - RNA, 19 nt, Homo sapiens
ccuacacaguuucccauua

SEQ ID NO: 183511 - RNA, 19 nt, Homo sapiens
gaucaaacagaaaugacua

SEQ ID NO: 183512 - RNA, 19 nt, Homo sapiens
gagaugcgccaauuguaaa

SEQ ID NO: 183513 - RNA, 19 nt, Homo sapiens
acacuucugcuuucacuua

SEQ ID NO: 183514 - RNA, 19 nt, Homo sapiens
aaagcaagcccgguuguua

SEQ ID NO: 183515 - RNA, 19 nt, Homo sapiens
gggagcaagucuacagcua

SEQ ID NO: 183516 - RNA, 19 nt, Homo sapiens
acaaaucuccugccuggua

SEQ ID NO: 183517 - RNA, 19 nt, Homo sapiens
gcaguacggccaccaagaa

SEQ ID NO: 183518 - RNA, 19 nt, Homo sapiens
ccugaagccugguguggua

SEQ ID NO: 183519 - RNA, 19 nt, Homo sapiens
uaccauaccaggccacuua

SEQ ID NO: 183520 - RNA, 19 nt, Homo sapiens
gaaggcagcggacgcauca

SEQ ID NO: 183521 - RNA, 19 nt, Homo sapiens
gagugugugugucuuggua

SEQ ID NO: 183522 - RNA, 19 nt, Homo sapiens
caacaacucugauuaacua

SEQ ID NO: 183523 - RNA, 19 nt, Homo sapiens
ggagucagcugccaagaga

SEQ ID NO: 183524 - RNA, 19 nt, Homo sapiens
ccacagccaucucacauuu

SEQ ID NO: 183525 - RNA, 19 nt, Homo sapiens
ggagacaccuggagcaaga

SEQ ID NO: 183526 - RNA, 19 nt, Homo sapiens
gaagagacuugcuuugaca

SEQ ID NO: 183527 - RNA, 19 nt, Homo sapiens
gcaaaccgcugccaugaag

SEQ ID NO: 183528 - RNA, 19 nt, Homo sapiens
gcacaacuucgaauuauga

SEQ ID NO: 183529 - RNA, 19 nt, Homo sapiens
caucucacauuuccaagua

SEQ ID NO: 183530 - RNA, 19 nt, Homo sapiens
gaguaaaccugaagcugaa

SEQ ID NO: 183531 - RNA, 19 nt, Homo sapiens
gaggaaaucugcacaacca

SEQ ID NO: 183532 - RNA, 19 nt, Homo sapiens
caacucugauuaacuauuc

SEQ ID NO: 183533 - RNA, 19 nt, Homo sapiens
gaagagacaacaugaagug

SEQ ID NO: 183534 - RNA, 19 nt, Homo sapiens
cgagaucagugcauuguug

SEQ ID NO: 183535 - RNA, 19 nt, Homo sapiens
ggacaugcauugccuacuc

SEQ ID NO: 183536 - RNA, 19 nt, Homo sapiens
gcccauagcugagaagugu

SEQ ID NO: 183537 - RNA, 19 nt, Homo sapiens
gcaaugcguugguuuguac

SEQ ID NO: 183538 - RNA, 19 nt, Homo sapiens
gagccaacaacucugauua

SEQ ID NO: 183539 - RNA, 19 nt, Homo sapiens
cagcacaacuucgaauuau

SEQ ID NO: 183540 - RNA, 19 nt, Homo sapiens
ggaccacacagaacuauga

SEQ ID NO: 183541 - RNA, 19 nt, Homo sapiens
caaacuugguggcaacuug

SEQ ID NO: 183542 - RNA, 19 nt, Homo sapiens
gacuggugguuacauguua

SEQ ID NO: 183543 - RNA, 19 nt, Homo sapiens
ggucaguccuacaagauug

SEQ ID NO: 183544 - RNA, 19 nt, Homo sapiens
cagaaaccuuggauacuga

SEQ ID NO: 183545 - RNA, 19 nt, Homo sapiens
ccagaaaccuuggauacug

SEQ ID NO: 183546 - RNA, 19 nt, Homo sapiens
caaacaauauguggucaau

SEQ ID NO: 183547 - RNA, 19 nt, Homo sapiens
caauucugaugguuucuuu

SEQ ID NO: 183548 - RNA, 19 nt, Homo sapiens
gaaggcagcggacgcauca

SEQ ID NO: 183549 - RNA, 19 nt, Homo sapiens
gagugugugugucuuggua

SEQ ID NO: 183550 - RNA, 19 nt, Homo sapiens
aaagcaagcccgguuguua

SEQ ID NO: 183551 - RNA, 19 nt, Homo sapiens
cuccuaaucuuaucaauuc

SEQ ID NO: 183552 - RNA, 19 nt, Homo sapiens
gauacugagucuccuaauc

SEQ ID NO: 183553 - RNA, 19 nt, Homo sapiens
gaacgacacauuccacaag

SEQ ID NO: 183554 - RNA, 19 nt, Homo sapiens
gaaaucugcacaaccaaug

SEQ ID NO: 183555 - RNA, 19 nt, Homo sapiens
aaauugacuuguagacuga

SEQ ID NO: 183556 - RNA, 19 nt, Homo sapiens
ccacaagcgucaugaagag

SEQ ID NO: 183557 - RNA, 19 nt, Homo sapiens
ccaugugucuuaccauuca

SEQ ID NO: 183558 - RNA, 19 nt, Homo sapiens
ggaggaagccgagguuuua

SEQ ID NO: 183559 - RNA, 19 nt, Homo sapiens
gaggcaggcucagcaaaug

SEQ ID NO: 183560 - RNA, 19 nt, Homo sapiens
gaggagaguggaaguguga

SEQ ID NO: 183561 - RNA, 19 nt, Homo sapiens
gcuggaugaugguagauug

SEQ ID NO: 183562 - RNA, 19 nt, Homo sapiens
gcaagcccauagcugagaa

SEQ ID NO: 183563 - RNA, 19 nt, Homo sapiens
gcacguguguugggaaugg

SEQ ID NO: 183564 - RNA, 19 nt, Homo sapiens
ggacggacagcacaacuuc

SEQ ID NO: 183565 - RNA, 19 nt, Homo sapiens
gggaugcaguggcugaaga

SEQ ID NO: 183566 - RNA, 19 nt, Homo sapiens
gaaauagaugcaacgauca

SEQ ID NO: 183567 - RNA, 19 nt, Homo sapiens
ccuaaagacuccaugaucu

SEQ ID NO: 183568 - RNA, 19 nt, Homo sapiens
gaaaccugcuccagugcau

SEQ ID NO: 183569 - RNA, 19 nt, Homo sapiens
ggcaaugcguugguuugua

SEQ ID NO: 183570 - RNA, 19 nt, Homo sapiens
gcgaagggaagcaaacuug

SEQ ID NO: 183571 - RNA, 19 nt, Homo sapiens
gcagaagagacaacaugaa

SEQ ID NO: 183572 - RNA, 19 nt, Homo sapiens
gaagacacaaggaaauaag

SEQ ID NO: 183573 - RNA, 19 nt, Homo sapiens
gagauucaugggagaagua

SEQ ID NO: 183574 - RNA, 19 nt, Homo sapiens
gaaggauaaucgaggaaac

SEQ ID NO: 183575 - RNA, 19 nt, Homo sapiens
acaaggaaauaagcaaaug

SEQ ID NO: 183576 - RNA, 19 nt, Homo sapiens
ggacgcaucacuugcacuu

SEQ ID NO: 183577 - RNA, 19 nt, Homo sapiens
guaugugcauggugucaga

SEQ ID NO: 183578 - RNA, 19 nt, Homo sapiens
gggcacaugcugaacugua

SEQ ID NO: 183579 - RNA, 19 nt, Homo sapiens
ggaaaucugcacaaccaau

SEQ ID NO: 183580 - RNA, 19 nt, Homo sapiens
caaccacaauuacacugau

SEQ ID NO: 183581 - RNA, 19 nt, Homo sapiens
ucacuugcacuucuagaaa

SEQ ID NO: 183582 - RNA, 19 nt, Homo sapiens
cgagggagaauaagcugua

SEQ ID NO: 183583 - RNA, 19 nt, Homo sapiens
gugaguaucccacccagaa

SEQ ID NO: 183584 - RNA, 19 nt, Homo sapiens
acagcacaacuucgaauua

SEQ ID NO: 183585 - RNA, 19 nt, Homo sapiens
ggacagcacaacuucgaau

SEQ ID NO: 183586 - RNA, 19 nt, Homo sapiens
uuacagaccuauccaagcu

SEQ ID NO: 183587 - RNA, 19 nt, Homo sapiens
gcaacgaucaggacacaag

SEQ ID NO: 183588 - RNA, 19 nt, Homo sapiens
gcugggcgagggagaauaa

SEQ ID NO: 183589 - RNA, 19 nt, Homo sapiens
ggagaaguaugugcauggu

SEQ ID NO: 183590 - RNA, 19 nt, Homo sapiens
gggcagaagagacaacaug

SEQ ID NO: 183591 - RNA, 19 nt, Homo sapiens
cacaugagacuggugguua

SEQ ID NO: 183592 - RNA, 19 nt, Homo sapiens
cuuaugagcguccuaaaga

SEQ ID NO: 183593 - RNA, 19 nt, Homo sapiens
cagcuguaacccagacuua

SEQ ID NO: 183594 - RNA, 19 nt, Homo sapiens
ugaagagacuugcuuugac

SEQ ID NO: 183595 - RNA, 19 nt, Homo sapiens
gagaucagugcauuguuga

SEQ ID NO: 183596 - RNA, 19 nt, Homo sapiens
gggauaagcagcaugacau

SEQ ID NO: 183597 - RNA, 19 nt, Homo sapiens
uggagagccaugugucuua

SEQ ID NO: 183598 - RNA, 19 nt, Homo sapiens
gacuuacgguggcaacuca

SEQ ID NO: 183599 - RNA, 19 nt, Homo sapiens
gguggagaccugugaguau

SEQ ID NO: 183600 - RNA, 19 nt, Homo sapiens
ggagaucagugggauaagc

SEQ ID NO: 183601 - RNA, 19 nt, Homo sapiens
cagaagagacaacaugaag

SEQ ID NO: 183602 - RNA, 19 nt, Homo sapiens
ggagagccaugugucuuac

SEQ ID NO: 183603 - RNA, 19 nt, Homo sapiens
ugaagacacaaggaaauaa

SEQ ID NO: 183604 - RNA, 19 nt, Homo sapiens
ugagacuggugguuacaug

SEQ ID NO: 183605 - RNA, 19 nt, Homo sapiens
gaagggaagcaaacuuggu

SEQ ID NO: 183606 - RNA, 19 nt, Homo sapiens
ucgaaguauuuaucacuga

SEQ ID NO: 183607 - RNA, 19 nt, Homo sapiens
caagugguccugucgaagu

SEQ ID NO: 183608 - RNA, 19 nt, Homo sapiens
ggagauucaugggagaagu

SEQ ID NO: 183609 - RNA, 19 nt, Homo sapiens
gcugaagacacaaggaaau

SEQ ID NO: 183610 - RNA, 19 nt, Homo sapiens
gaucaggacacaaggacau

SEQ ID NO: 183611 - RNA, 19 nt, Homo sapiens
gcagcggacgcaucacuug

SEQ ID NO: 183612 - RNA, 19 nt, Homo sapiens
gguuuguacuuguuaugga

SEQ ID NO: 183613 - RNA, 19 nt, Homo sapiens
ccauagcugagaaguguuu

SEQ ID NO: 183614 - RNA, 19 nt, Homo sapiens
caaguacacugggaacacu

SEQ ID NO: 183615 - RNA, 19 nt, Homo sapiens
gccaacaacucugauuaac

SEQ ID NO: 183616 - RNA, 19 nt, Homo sapiens
ggucauguaccgcauugga

SEQ ID NO: 183617 - RNA, 19 nt, Homo sapiens
ggcagaagagacaacauga

SEQ ID NO: 183618 - RNA, 19 nt, Homo sapiens
ggaugaugguagauuguac

SEQ ID NO: 183619 - RNA, 19 nt, Homo sapiens
guggagaccugugaguauc

SEQ ID NO: 183620 - RNA, 19 nt, Homo sapiens
gaaguauuuaucacugaga

SEQ ID NO: 183621 - RNA, 19 nt, Homo sapiens
gacagcacaacuucgaauu

SEQ ID NO: 183622 - RNA, 19 nt, Homo sapiens
caacaaauguacagcaaua

SEQ ID NO: 183623 - RNA, 19 nt, Homo sapiens
gcaggucacuuguauguaa

SEQ ID NO: 183624 - RNA, 19 nt, Homo sapiens
cuacaucacugcaauaauu

SEQ ID NO: 183625 - RNA, 19 nt, Homo sapiens
gaaagugcauggaacuauu

SEQ ID NO: 183626 - RNA, 19 nt, Homo sapiens
guacaugcgucaagauuug

SEQ ID NO: 183627 - RNA, 19 nt, Homo sapiens
gaaagaggaugugagaaau

SEQ ID NO: 183628 - RNA, 19 nt, Homo sapiens
gaaaaugacucaccaacaa

SEQ ID NO: 183629 - RNA, 19 nt, Homo sapiens
cagaagaacuugauggaau

SEQ ID NO: 183630 - RNA, 19 nt, Homo sapiens
auaaugagcugcaguaugu

SEQ ID NO: 183631 - RNA, 19 nt, Homo sapiens
gcauuagaguuaugugaaa

SEQ ID NO: 183632 - RNA, 19 nt, Homo sapiens
gaaaaucagugugacaaua

SEQ ID NO: 183633 - RNA, 19 nt, Homo sapiens
ccaaagauacuucguuauu

SEQ ID NO: 183634 - RNA, 19 nt, Homo sapiens
ccaaauauccuaaucuguu

SEQ ID NO: 183635 - RNA, 19 nt, Homo sapiens
gaaauaacucugucuggaa

SEQ ID NO: 183636 - RNA, 19 nt, Homo sapiens
ggauaucuaugaagacaug

SEQ ID NO: 183637 - RNA, 19 nt, Homo sapiens
aaccaaagauacuucguua

SEQ ID NO: 183638 - RNA, 19 nt, Homo sapiens
gcaauaacaccauccagaa

SEQ ID NO: 183639 - RNA, 19 nt, Homo sapiens
gagcuggucugcacacuca

SEQ ID NO: 183640 - RNA, 19 nt, Homo sapiens
gggaugcuauugaguuaaa

SEQ ID NO: 183641 - RNA, 19 nt, Homo sapiens
agaaugggcugauauagau

SEQ ID NO: 183642 - RNA, 19 nt, Homo sapiens
gaaaggaauauuggagaua

SEQ ID NO: 183643 - RNA, 19 nt, Homo sapiens
uaucaaguuuggcaucaua

SEQ ID NO: 183644 - RNA, 19 nt, Homo sapiens
gaacuacaucacugcaaua

SEQ ID NO: 183645 - RNA, 19 nt, Homo sapiens
ggagauacauuggaagauc

SEQ ID NO: 183646 - RNA, 19 nt, Homo sapiens
ccaauacacucuggaaaug

SEQ ID NO: 183647 - RNA, 19 nt, Homo sapiens
cagacuagcucuaaguaau

SEQ ID NO: 183648 - RNA, 19 nt, Homo sapiens
ugaaagaggaugugagaaa

SEQ ID NO: 183649 - RNA, 19 nt, Homo sapiens
ggucugcacacucacauua

SEQ ID NO: 183650 - RNA, 19 nt, Homo sapiens
gcauggaacuauuugaaag

SEQ ID NO: 183651 - RNA, 19 nt, Homo sapiens
guaaccaacuaaugccaaa

SEQ ID NO: 183652 - RNA, 19 nt, Homo sapiens
gucaagauuuguagcagua

SEQ ID NO: 183653 - RNA, 19 nt, Homo sapiens
gaaauccuagcuaaagaaa

SEQ ID NO: 183654 - RNA, 19 nt, Homo sapiens
uaugugaaauccuagcuaa

SEQ ID NO: 183655 - RNA, 19 nt, Homo sapiens
agaguuaugugaaauccua

SEQ ID NO: 183656 - RNA, 19 nt, Homo sapiens
ggagagagaaguccaauac

SEQ ID NO: 183657 - RNA, 19 nt, Homo sapiens
aagaggaugugagaaauaa

SEQ ID NO: 183658 - RNA, 19 nt, Homo sapiens
gaaccaaagauacuucguu

SEQ ID NO: 183659 - RNA, 19 nt, Homo sapiens
gaacuugauggaaugcuuu

SEQ ID NO: 183660 - RNA, 19 nt, Homo sapiens
gaaaaggacacuauaagaa

SEQ ID NO: 183661 - RNA, 19 nt, Homo sapiens
cucaggagcuugaauuuau

SEQ ID NO: 183662 - RNA, 19 nt, Homo sapiens
gaaguuugguucaguaagc

SEQ ID NO: 183663 - RNA, 19 nt, Homo sapiens
gaauauuggagauacauug

SEQ ID NO: 183664 - RNA, 19 nt, Homo sapiens
gaauacagucguuccauca

SEQ ID NO: 183665 - RNA, 19 nt, Homo sapiens
gugaaauccuagcuaaaga

SEQ ID NO: 183666 - RNA, 19 nt, Homo sapiens
cagcaucgacaauggguua

SEQ ID NO: 183667 - RNA, 19 nt, Homo sapiens
ccgggaugcuauugaguua

SEQ ID NO: 183668 - RNA, 19 nt, Homo sapiens
agaagaacuugauggaaug

SEQ ID NO: 183669 - RNA, 19 nt, Homo sapiens
gauuuacaaccaagucaua

SEQ ID NO: 183670 - RNA, 19 nt, Homo sapiens
gaugugagguagccgaagu

SEQ ID NO: 183671 - RNA, 19 nt, Homo sapiens
ucacuuguauguaauggau

SEQ ID NO: 183672 - RNA, 19 nt, Homo sapiens
ggaucuacaugaggaaaug

SEQ ID NO: 183673 - RNA, 19 nt, Homo sapiens
gaaagaagugaacgagcuu

SEQ ID NO: 183674 - RNA, 19 nt, Homo sapiens
cagaaugggcugauauaga

SEQ ID NO: 183675 - RNA, 19 nt, Homo sapiens
aaacuaguaccacauaaug

SEQ ID NO: 183676 - RNA, 19 nt, Homo sapiens
aaagaggaugugagaaaua

SEQ ID NO: 183677 - RNA, 19 nt, Homo sapiens
ggaaaugaacuacaucacu

SEQ ID NO: 183678 - RNA, 19 nt, Homo sapiens
ugaguuaaaugcagccaau

SEQ ID NO: 183679 - RNA, 19 nt, Homo sapiens
gagagugguccuucccuuu

SEQ ID NO: 183680 - RNA, 19 nt, Homo sapiens
guacagggacagagcagaa

SEQ ID NO: 183681 - RNA, 19 nt, Homo sapiens
gagcagaaugggcugauau

SEQ ID NO: 183682 - RNA, 19 nt, Homo sapiens
gauaaugagcugcaguaug

SEQ ID NO: 183683 - RNA, 19 nt, Homo sapiens
gggauaaugagcugcagua

SEQ ID NO: 183684 - RNA, 19 nt, Homo sapiens
ucaggagcuugaauuuauu

SEQ ID NO: 183685 - RNA, 19 nt, Homo sapiens
gccgaaguuugguucagua

SEQ ID NO: 183686 - RNA, 19 nt, Homo sapiens
ugaacuacaucacugcaau

SEQ ID NO: 183687 - RNA, 19 nt, Homo sapiens
ucagaaggaucuacaugag

SEQ ID NO: 183688 - RNA, 19 nt, Homo sapiens
gaagugaacgagcuuuuaa

SEQ ID NO: 183689 - RNA, 19 nt, Homo sapiens
uaacugcaggucacuugua

SEQ ID NO: 183690 - RNA, 19 nt, Homo sapiens
aaaggacacuauaagaaag

SEQ ID NO: 183691 - RNA, 19 nt, Homo sapiens
uaaucaggaugcaaagaau

SEQ ID NO: 183692 - RNA, 19 nt, Homo sapiens
uaaaugcagccaauuauac

SEQ ID NO: 183693 - RNA, 19 nt, Homo sapiens
caaauguacagcaauaaca

SEQ ID NO: 183694 - RNA, 19 nt, Homo sapiens
acaaugaucgugcuguauu

SEQ ID NO: 183695 - RNA, 19 nt, Homo sapiens
uggaccaacuucugaaaga

SEQ ID NO: 183696 - RNA, 19 nt, Homo sapiens
gaucguggucuuuccaaau

SEQ ID NO: 183697 - RNA, 19 nt, Homo sapiens
ggaucguggucuuuccaaa

SEQ ID NO: 183698 - RNA, 19 nt, Homo sapiens
caucgacaauggguuauuc

SEQ ID NO: 183699 - RNA, 19 nt, Homo sapiens
guuaaaugcagccaauuau

SEQ ID NO: 183700 - RNA, 19 nt, Homo sapiens
caagauuuguagcaguaau

SEQ ID NO: 183701 - RNA, 19 nt, Homo sapiens
gguacaugcgucaagauuu

SEQ ID NO: 183702 - RNA, 19 nt, Homo sapiens
uauuggagauacauuggaa

SEQ ID NO: 183703 - RNA, 19 nt, Homo sapiens
agaaaggaauauuggagau

SEQ ID NO: 183704 - RNA, 19 nt, Homo sapiens
acaauggguuauucaggaa

SEQ ID NO: 183705 - RNA, 19 nt, Homo sapiens
gcagcgugaugaaagaagu

SEQ ID NO: 183706 - RNA, 19 nt, Homo sapiens
guccagaucauuuauagug

SEQ ID NO: 183707 - RNA, 19 nt, Homo sapiens
ugagguagccgaaguuugg

SEQ ID NO: 183708 - RNA, 19 nt, Homo sapiens
caucauaggcgaguauuag

SEQ ID NO: 183709 - RNA, 19 nt, Homo sapiens
gcacacucacauuaucuug

SEQ ID NO: 183710 - RNA, 19 nt, Homo sapiens
cuacucagacuagcucuaa

SEQ ID NO: 183711 - RNA, 19 nt, Homo sapiens
ucacacagguauugcuuuu

SEQ ID NO: 183712 - RNA, 19 nt, Homo sapiens
ugacucaccaacaaaugua

SEQ ID NO: 183713 - RNA, 19 nt, Homo sapiens
aaaggaauauuggagauac

SEQ ID NO: 183714 - RNA, 19 nt, Homo sapiens
uaugaagacaugcuagaaa

SEQ ID NO: 183715 - RNA, 19 nt, Homo sapiens
ggaccaacuucugaaagag

SEQ ID NO: 183716 - RNA, 19 nt, Homo sapiens
gaggaaaugaacuacauca

SEQ ID NO: 183717 - RNA, 19 nt, Homo sapiens
gacuagcucuaaguaaugu

SEQ ID NO: 183718 - RNA, 19 nt, Homo sapiens
ggaauauuggagauacauu

SEQ ID NO: 183719 - RNA, 19 nt, Homo sapiens
guggauaucuaugaagaca

SEQ ID NO: 183720 - RNA, 19 nt, Homo sapiens
gugcauggaacuauuugaa

SEQ ID NO: 183721 - RNA, 19 nt, Homo sapiens
gcaucauaggcgaguauua

SEQ ID NO: 183722 - RNA, 19 nt, Homo sapiens
caagaugaguucucuguaa

SEQ ID NO: 183723 - RNA, 19 nt, Homo sapiens
gcacuuccauuaucugaaa

SEQ ID NO: 183724 - RNA, 19 nt, Homo sapiens
gaacuugaagagcuuauua

SEQ ID NO: 183725 - RNA, 19 nt, Homo sapiens
agaaagaucuccuucaguu

SEQ ID NO: 183726 - RNA, 19 nt, Homo sapiens
gaaagugacccucuaguuc

SEQ ID NO: 183727 - RNA, 19 nt, Homo sapiens
gaauggcaucugaguauua

SEQ ID NO: 183728 - RNA, 19 nt, Homo sapiens
agacaagguuuauacguuu

SEQ ID NO: 183729 - RNA, 19 nt, Homo sapiens
gcaagucgcgugauuucua

SEQ ID NO: 183730 - RNA, 19 nt, Homo sapiens
gggcacugcugaauggaua

SEQ ID NO: 183731 - RNA, 19 nt, Homo sapiens
ggaauaagucugcuucaug

SEQ ID NO: 183732 - RNA, 19 nt, Homo sapiens
ggaauaaaaucaagugcua

SEQ ID NO: 183733 - RNA, 19 nt, Homo sapiens
gauaguggcuacagaugug

SEQ ID NO: 183734 - RNA, 19 nt, Homo sapiens
gcuuggaacugcuagauga

SEQ ID NO: 183735 - RNA, 19 nt, Homo sapiens
gcccauggcucugcuauug

SEQ ID NO: 183736 - RNA, 19 nt, Homo sapiens
ggaaagugacccucuaguu

SEQ ID NO: 183737 - RNA, 19 nt, Homo sapiens
caccuuaacuuaugacuca

SEQ ID NO: 183738 - RNA, 19 nt, Homo sapiens
gcacccuggucauuuguaa

SEQ ID NO: 183739 - RNA, 19 nt, Homo sapiens
cagacaagguuuauacguu

SEQ ID NO: 183740 - RNA, 19 nt, Homo sapiens
uugaggagcuuaaggauga

SEQ ID NO: 183741 - RNA, 19 nt, Homo sapiens
guaagacugugguggaguu

SEQ ID NO: 183742 - RNA, 19 nt, Homo sapiens
uguauuaccuccuugaaau

SEQ ID NO: 183743 - RNA, 19 nt, Homo sapiens
gaacugggaagguggcauu

SEQ ID NO: 183744 - RNA, 19 nt, Homo sapiens
gcaccgaggaggccuauga

SEQ ID NO: 183745 - RNA, 19 nt, Homo sapiens
ccacaccugucaaaccaaa

SEQ ID NO: 183746 - RNA, 19 nt, Homo sapiens
ugaccuggccuucauguaa

SEQ ID NO: 183747 - RNA, 19 nt, Homo sapiens
ccaagaguauuaacacuac

SEQ ID NO: 183748 - RNA, 19 nt, Homo sapiens
gaacugagccuugcaucuc

SEQ ID NO: 183749 - RNA, 19 nt, Homo sapiens
ccaggccacuacauacuuu

SEQ ID NO: 183750 - RNA, 19 nt, Homo sapiens
cuacagaugugugucaguu

SEQ ID NO: 183751 - RNA, 19 nt, Homo sapiens
cgaguucuuucaccuacua

SEQ ID NO: 183752 - RNA, 19 nt, Homo sapiens
gaaaagaggccuucgacaa

SEQ ID NO: 183753 - RNA, 19 nt, Homo sapiens
agaccuaggaaaccaauua

SEQ ID NO: 183754 - RNA, 19 nt, Homo sapiens
ccuaggaaaccaauuauga

SEQ ID NO: 183755 - RNA, 19 nt, Homo sapiens
gaaagaucuccuucaguug

SEQ ID NO: 183756 - RNA, 19 nt, Homo sapiens
gaaacagucacguccauag

SEQ ID NO: 183757 - RNA, 19 nt, Homo sapiens
uaacuuaugacucaggauu

SEQ ID NO: 183758 - RNA, 19 nt, Homo sapiens
gcagacaggagcucagaga

SEQ ID NO: 183759 - RNA, 19 nt, Homo sapiens
ggaaacagucacguccaua

SEQ ID NO: 183760 - RNA, 19 nt, Homo sapiens
gugguucucuugguacuuu

SEQ ID NO: 183761 - RNA, 19 nt, Homo sapiens
ggucagagccgcuguacag

SEQ ID NO: 183762 - RNA, 19 nt, Homo sapiens
gguacuuucuugucaaaca

SEQ ID NO: 183763 - RNA, 19 nt, Homo sapiens
gcucuuugcucacccaucu

SEQ ID NO: 183764 - RNA, 19 nt, Homo sapiens
ggucuucaguucuuacaag

SEQ ID NO: 183765 - RNA, 19 nt, Homo sapiens
cuacugaccuggccuucau

SEQ ID NO: 183766 - RNA, 19 nt, Homo sapiens
gaagagcuuauuacaaugg

SEQ ID NO: 183767 - RNA, 19 nt, Homo sapiens
acuuaugacucaggauuua

SEQ ID NO: 183768 - RNA, 19 nt, Homo sapiens
gcagaugcgauuugaagga

SEQ ID NO: 183769 - RNA, 19 nt, Homo sapiens
gaggaggccuaugacauca

SEQ ID NO: 183770 - RNA, 19 nt, Homo sapiens
gcacagcuuggaacugcua

SEQ ID NO: 183771 - RNA, 19 nt, Homo sapiens
cauacugcauucugugcua

SEQ ID NO: 183772 - RNA, 19 nt, Homo sapiens
gagccgcuguacagucuga

SEQ ID NO: 183773 - RNA, 19 nt, Homo sapiens
ugagggcacugcugaaugg

SEQ ID NO: 183774 - RNA, 19 nt, Homo sapiens
gaccuggccuucauguaag

SEQ ID NO: 183775 - RNA, 19 nt, Homo sapiens
ucaguggaguaucaaguug

SEQ ID NO: 183776 - RNA, 19 nt, Homo sapiens
ccugacggcuccuuucuca

SEQ ID NO: 183777 - RNA, 19 nt, Homo sapiens
gccauuugcugccucuaau

SEQ ID NO: 183778 - RNA, 19 nt, Homo sapiens
aaagugacccucuaguuca

SEQ ID NO: 183779 - RNA, 19 nt, Homo sapiens
aauuaugaguggaaaguga

SEQ ID NO: 183780 - RNA, 19 nt, Homo sapiens
ugaauggcaucugaguauu

SEQ ID NO: 183781 - RNA, 19 nt, Homo sapiens
agaacacaguggcugguuu

SEQ ID NO: 183782 - RNA, 19 nt, Homo sapiens
ccauggcucugcuauugga

SEQ ID NO: 183783 - RNA, 19 nt, Homo sapiens
cuucaguucuuacaaguuc

SEQ ID NO: 183784 - RNA, 19 nt, Homo sapiens
cuucaacacuggagaacug

SEQ ID NO: 183785 - RNA, 19 nt, Homo sapiens
ccaccaagaugaguucucu

SEQ ID NO: 183786 - RNA, 19 nt, Homo sapiens
gacaagguuuauacguuuc

SEQ ID NO: 183787 - RNA, 19 nt, Homo sapiens
ugaagagcuuauuacaaug

SEQ ID NO: 183788 - RNA, 19 nt, Homo sapiens
gcuccuuucucaugcaugu

SEQ ID NO: 183789 - RNA, 19 nt, Homo sapiens
ccuaucauguaccgugaaa

SEQ ID NO: 183790 - RNA, 19 nt, Homo sapiens
cagagccgcuguacagucu

SEQ ID NO: 183791 - RNA, 19 nt, Homo sapiens
gagcugugguucucuuggu

SEQ ID NO: 183792 - RNA, 19 nt, Homo sapiens
gcgauuugaaggaggauuu

SEQ ID NO: 183793 - RNA, 19 nt, Homo sapiens
ugacggcuccuuucucaug

SEQ ID NO: 183794 - RNA, 19 nt, Homo sapiens
agaagccagucccagguuu

SEQ ID NO: 183795 - RNA, 19 nt, Homo sapiens
gacagaugccuaugagugu

SEQ ID NO: 183796 - RNA, 19 nt, Homo sapiens
gcacgccaccauucaguca

SEQ ID NO: 183797 - RNA, 19 nt, Homo sapiens
gaacacaguggcugguuuu

SEQ ID NO: 183798 - RNA, 19 nt, Homo sapiens
caagucgcgugauuucuac

SEQ ID NO: 183799 - RNA, 19 nt, Homo sapiens
cgaggaggccuaugacauc

SEQ ID NO: 183800 - RNA, 19 nt, Homo sapiens
acucuaggcucacaggaau

SEQ ID NO: 183801 - RNA, 19 nt, Homo sapiens
cuacuaagucuuucaccuu

SEQ ID NO: 183802 - RNA, 19 nt, Homo sapiens
guauuaacacuacuaaguc

SEQ ID NO: 183803 - RNA, 19 nt, Homo sapiens
caagcccacucuccuccaa

SEQ ID NO: 183804 - RNA, 19 nt, Homo sapiens
ugacuuagaccuaggaaac

SEQ ID NO: 183805 - RNA, 19 nt, Homo sapiens
gaucacacagagaugaaug

SEQ ID NO: 183806 - RNA, 19 nt, Homo sapiens
cacaguggcugguuuuaaa

SEQ ID NO: 183807 - RNA, 19 nt, Homo sapiens
gacccugcccuuagcauga

SEQ ID NO: 183808 - RNA, 19 nt, Homo sapiens
uagccucgcugaccaacau

SEQ ID NO: 183809 - RNA, 19 nt, Homo sapiens
cccagaagguggcuuugga

SEQ ID NO: 183810 - RNA, 19 nt, Homo sapiens
gggaguccuuccacuucaa

SEQ ID NO: 183811 - RNA, 19 nt, Homo sapiens
caauggcucuggguuugga

SEQ ID NO: 183812 - RNA, 19 nt, Homo sapiens
acacacuggcugcuacuaa

SEQ ID NO: 183813 - RNA, 19 nt, Homo sapiens
ggacgacucgguggaaaca

SEQ ID NO: 183814 - RNA, 19 nt, Homo sapiens
ccaagaugaguucucugua

SEQ ID NO: 183815 - RNA, 19 nt, Homo sapiens
cuaauucccuuuugcuuug

SEQ ID NO: 183816 - RNA, 19 nt, Homo sapiens
ucuuucaccuuaacuuaug

SEQ ID NO: 183817 - RNA, 19 nt, Homo sapiens
uaacacuacuaagucuuuc

SEQ ID NO: 183818 - RNA, 19 nt, Homo sapiens
uuucucaccaagaguauua

SEQ ID NO: 183819 - RNA, 19 nt, Homo sapiens
gaugaguucucuguaagac

SEQ ID NO: 183820 - RNA, 19 nt, Homo sapiens
aagaugaguucucuguaag

SEQ ID NO: 183821 - RNA, 19 nt, Homo sapiens
ccacauaugcagcagucaa

SEQ ID NO: 183822 - RNA, 19 nt, Homo sapiens
ggaaauauccuaaaucuga

SEQ ID NO: 183823 - RNA, 19 nt, Homo sapiens
gaaggaaacuacacucuga

SEQ ID NO: 183824 - RNA, 19 nt, Homo sapiens
gagaauccguauugaauuu

SEQ ID NO: 183825 - RNA, 19 nt, Homo sapiens
gaaagagcauuuauugauc

SEQ ID NO: 183826 - RNA, 19 nt, Homo sapiens
ggaaagagcauuuauugau

SEQ ID NO: 183827 - RNA, 19 nt, Homo sapiens
ggaccuggcuuuacuggaa

SEQ ID NO: 183828 - RNA, 19 nt, Homo sapiens
gauagcagcuggagaggaa

SEQ ID NO: 183829 - RNA, 19 nt, Homo sapiens
gagcagcuguuguucauga

SEQ ID NO: 183830 - RNA, 19 nt, Homo sapiens
gcacagaagcuccuagaaa

SEQ ID NO: 183831 - RNA, 19 nt, Homo sapiens
gaaggcaaaucucuuuaug

SEQ ID NO: 183832 - RNA, 19 nt, Homo sapiens
gaggagggaugguguuuga

SEQ ID NO: 183833 - RNA, 19 nt, Homo sapiens
gaaagaauuuggccuggau

SEQ ID NO: 183834 - RNA, 19 nt, Homo sapiens
gaagugaagagacagauuu

SEQ ID NO: 183835 - RNA, 19 nt, Homo sapiens
cguaauggguauauugaua

SEQ ID NO: 183836 - RNA, 19 nt, Homo sapiens
cacaggaaaugaagacaua

SEQ ID NO: 183837 - RNA, 19 nt, Homo sapiens
gcagagcacgguauacuaa

SEQ ID NO: 183838 - RNA, 19 nt, Homo sapiens
gaaauugcuuccaaguuca

SEQ ID NO: 183839 - RNA, 19 nt, Homo sapiens
ccaaugaagugacaagaau

SEQ ID NO: 183840 - RNA, 19 nt, Homo sapiens
uuacacagauaccacauuu

SEQ ID NO: 183841 - RNA, 19 nt, Homo sapiens
gaauuugugugguauguca

SEQ ID NO: 183842 - RNA, 19 nt, Homo sapiens
gagcauuuauugauccauu

SEQ ID NO: 183843 - RNA, 19 nt, Homo sapiens
agaaauugcuuccaaguuc

SEQ ID NO: 183844 - RNA, 19 nt, Homo sapiens
cuacuaacauuacuccaaa

SEQ ID NO: 183845 - RNA, 19 nt, Homo sapiens
ccaaaggagucauucucua

SEQ ID NO: 183846 - RNA, 19 nt, Homo sapiens
guauugaauuuguguggua

SEQ ID NO: 183847 - RNA, 19 nt, Homo sapiens
aggcaaaucucuuuaugaa

SEQ ID NO: 183848 - RNA, 19 nt, Homo sapiens
gcagagacuuugagugaag

SEQ ID NO: 183849 - RNA, 19 nt, Homo sapiens
gacaagaauuuacaaugug

SEQ ID NO: 183850 - RNA, 19 nt, Homo sapiens
gaaguagccuaagaggauu

SEQ ID NO: 183851 - RNA, 19 nt, Homo sapiens
ccaauuggauacuaugaug

SEQ ID NO: 183852 - RNA, 19 nt, Homo sapiens
gaagagacagauuuauguu

SEQ ID NO: 183853 - RNA, 19 nt, Homo sapiens
ccaacuacaucucaauaau

SEQ ID NO: 183854 - RNA, 19 nt, Homo sapiens
uuacagaaauugcuuccaa

SEQ ID NO: 183855 - RNA, 19 nt, Homo sapiens
caaagugcccuacaauguu

SEQ ID NO: 183856 - RNA, 19 nt, Homo sapiens
aagaaaguaugcugacaaa

SEQ ID NO: 183857 - RNA, 19 nt, Homo sapiens
ugacucaucuauagaagga

SEQ ID NO: 183858 - RNA, 19 nt, Homo sapiens
uaugaaacauccacaggaa

SEQ ID NO: 183859 - RNA, 19 nt, Homo sapiens
cuguugagcuagcacauua

SEQ ID NO: 183860 - RNA, 19 nt, Homo sapiens
uaacauuacuccaaagcau

SEQ ID NO: 183861 - RNA, 19 nt, Homo sapiens
uuagugagauugagagaga

SEQ ID NO: 183862 - RNA, 19 nt, Homo sapiens
guggaaauauccuaaaucu

SEQ ID NO: 183863 - RNA, 19 nt, Homo sapiens
gaaauugugaggagcuuug

SEQ ID NO: 183864 - RNA, 19 nt, Homo sapiens
gcugauaagcgaggcauua

SEQ ID NO: 183865 - RNA, 19 nt, Homo sapiens
aaagugcccuacaauguug

SEQ ID NO: 183866 - RNA, 19 nt, Homo sapiens
cgacccugcugacuacuuu

SEQ ID NO: 183867 - RNA, 19 nt, Homo sapiens
ugaaguagccuaagaggau

SEQ ID NO: 183868 - RNA, 19 nt, Homo sapiens
gaagugacaagaauuuaca

SEQ ID NO: 183869 - RNA, 19 nt, Homo sapiens
ucagugcacucuagaaaca

SEQ ID NO: 183870 - RNA, 19 nt, Homo sapiens
guaugucacucagaaagaa

SEQ ID NO: 183871 - RNA, 19 nt, Homo sapiens
uggcguggcuuauauuaau

SEQ ID NO: 183872 - RNA, 19 nt, Homo sapiens
agaccuagaagaacaauuu

SEQ ID NO: 183873 - RNA, 19 nt, Homo sapiens
ucaaagugcccuacaaugu

SEQ ID NO: 183874 - RNA, 19 nt, Homo sapiens
ugagugaaguagccuaaga

SEQ ID NO: 183875 - RNA, 19 nt, Homo sapiens
gauaagcgaggcauuagug

SEQ ID NO: 183876 - RNA, 19 nt, Homo sapiens
gaaaguaugcugacaaaau

SEQ ID NO: 183877 - RNA, 19 nt, Homo sapiens
gagcguggcguggcuuaua

SEQ ID NO: 183878 - RNA, 19 nt, Homo sapiens
gcacauccacucuaccaau

SEQ ID NO: 183879 - RNA, 19 nt, Homo sapiens
uaaugaagauggaaaugag

SEQ ID NO: 183880 - RNA, 19 nt, Homo sapiens
aagcugggaugcagaagaa

SEQ ID NO: 183881 - RNA, 19 nt, Homo sapiens
uggcuuuacuggaaacuuu

SEQ ID NO: 183882 - RNA, 19 nt, Homo sapiens
cugagaacaucaagaaguu

SEQ ID NO: 183883 - RNA, 19 nt, Homo sapiens
gcuggcggguggcuucuuu

SEQ ID NO: 183884 - RNA, 19 nt, Homo sapiens
gaugcucuguuugauauug

SEQ ID NO: 183885 - RNA, 19 nt, Homo sapiens
gaauuuggucuucuugguu

SEQ ID NO: 183886 - RNA, 19 nt, Homo sapiens
caaauugggaucuggaaau

SEQ ID NO: 183887 - RNA, 19 nt, Homo sapiens
cagaggaaauaagguuaaa

SEQ ID NO: 183888 - RNA, 19 nt, Homo sapiens
agagggcgaucuaguguau

SEQ ID NO: 183889 - RNA, 19 nt, Homo sapiens
gaacagaacaaaacuuuca

SEQ ID NO: 183890 - RNA, 19 nt, Homo sapiens
gaauccguauugaauuugu

SEQ ID NO: 183891 - RNA, 19 nt, Homo sapiens
uagagaauccguauugaau

SEQ ID NO: 183892 - RNA, 19 nt, Homo sapiens
caagcagccacaacaagua

SEQ ID NO: 183893 - RNA, 19 nt, Homo sapiens
caaaagcaacccaauagua

SEQ ID NO: 183894 - RNA, 19 nt, Homo sapiens
ugagcuagccaauuccaua

SEQ ID NO: 183895 - RNA, 19 nt, Homo sapiens
cagcggcuauccacuguau

SEQ ID NO: 183896 - RNA, 19 nt, Homo sapiens
cacagaagcuccuagaaaa

SEQ ID NO: 183897 - RNA, 19 nt, Homo sapiens
gauauuguaccaccuuuca

SEQ ID NO: 183898 - RNA, 19 nt, Homo sapiens
gugaagagacagauuuaug

SEQ ID NO: 183899 - RNA, 19 nt, Homo sapiens
gaauuuaugaugcucuguu

SEQ ID NO: 183900 - RNA, 19 nt, Homo sapiens
uuaaauaucaccucacugu

SEQ ID NO: 183901 - RNA, 19 nt, Homo sapiens
guggagaccuagaagaaca

SEQ ID NO: 183902 - RNA, 19 nt, Homo sapiens
ugaagagacagauuuaugu

SEQ ID NO: 183903 - RNA, 19 nt, Homo sapiens
gaaggguggagaccuagaa

SEQ ID NO: 183904 - RNA, 19 nt, Homo sapiens
ugugauagguacucucaga

SEQ ID NO: 183905 - RNA, 19 nt, Homo sapiens
cagguuacccagcaaauga

SEQ ID NO: 183906 - RNA, 19 nt, Homo sapiens
gaaguccuauccagauggu

SEQ ID NO: 183907 - RNA, 19 nt, Homo sapiens
gcgaucuaguguauguuaa

SEQ ID NO: 183908 - RNA, 19 nt, Homo sapiens
acacagauaccacauuuag

SEQ ID NO: 183909 - RNA, 19 nt, Homo sapiens
cugcagagacuuugaguga

SEQ ID NO: 183910 - RNA, 19 nt, Homo sapiens
gugagagacuccaggacuu

SEQ ID NO: 183911 - RNA, 19 nt, Homo sapiens
gcuagccaauuccauagug

SEQ ID NO: 183912 - RNA, 19 nt, Homo sapiens
gcaaauugggaucuggaaa

SEQ ID NO: 183913 - RNA, 19 nt, Homo sapiens
ggaaucuccuucacgaaac

SEQ ID NO: 183914 - RNA, 19 nt, Homo sapiens
aaggaaggguggagaccua

SEQ ID NO: 183915 - RNA, 19 nt, Homo sapiens
gaccuggcuuuacuggaaa

SEQ ID NO: 183916 - RNA, 19 nt, Homo sapiens
gcguggaaauauccuaaau

SEQ ID NO: 183917 - RNA, 19 nt, Homo sapiens
ggcgaucuaguguauguua

SEQ ID NO: 183918 - RNA, 19 nt, Homo sapiens
uaagaaaguaugcugacaa

SEQ ID NO: 183919 - RNA, 19 nt, Homo sapiens
uguuugagcuagccaauuc

SEQ ID NO: 183920 - RNA, 19 nt, Homo sapiens
ccaaugaagcuacuaacau

SEQ ID NO: 183921 - RNA, 19 nt, Homo sapiens
gcuuauaggcguggaauug

SEQ ID NO: 183922 - RNA, 19 nt, Homo sapiens
ggaaaucccugcccuguuc

SEQ ID NO: 183923 - RNA, 19 nt, Homo sapiens
gaucagagcuggcgcaaag

SEQ ID NO: 183924 - RNA, 19 nt, Homo sapiens
gcacaugugucuugagaau

SEQ ID NO: 183925 - RNA, 19 nt, Homo sapiens
acaugugucuugagaauua

SEQ ID NO: 183926 - RNA, 19 nt, Homo sapiens
ccacagcucccaacuauuu

SEQ ID NO: 183927 - RNA, 19 nt, Homo sapiens
gcaaagagcggguacugaa

SEQ ID NO: 183928 - RNA, 19 nt, Homo sapiens
gcaaugaaaucuggacuca

SEQ ID NO: 183929 - RNA, 19 nt, Homo sapiens
gauguuuccuaccuauaua

SEQ ID NO: 183930 - RNA, 19 nt, Homo sapiens
ugacagccacuuugaauaa

SEQ ID NO: 183931 - RNA, 19 nt, Homo sapiens
gagcaauggugggaagauu

SEQ ID NO: 183932 - RNA, 19 nt, Homo sapiens
ccacuguucugugcaauga

SEQ ID NO: 183933 - RNA, 19 nt, Homo sapiens
gacagccacuuugaauaaa

SEQ ID NO: 183934 - RNA, 19 nt, Homo sapiens
ggagcugccugccaaccuu

SEQ ID NO: 183935 - RNA, 19 nt, Homo sapiens
caaagaggacugugagcaa

SEQ ID NO: 183936 - RNA, 19 nt, Homo sapiens
ggauguuuccuaccuauau

SEQ ID NO: 183937 - RNA, 19 nt, Homo sapiens
ggacuucaggguuuaacaa

SEQ ID NO: 183938 - RNA, 19 nt, Homo sapiens
ccaggaagcccauaaggau

SEQ ID NO: 183939 - RNA, 19 nt, Homo sapiens
ggaagaaugccugcuguuc

SEQ ID NO: 183940 - RNA, 19 nt, Homo sapiens
ccgcacaugugucuugaga

SEQ ID NO: 183941 - RNA, 19 nt, Homo sapiens
ccuacaaggucagcaacua

SEQ ID NO: 183942 - RNA, 19 nt, Homo sapiens
aaugaaaucuggacucacu

SEQ ID NO: 183943 - RNA, 19 nt, Homo sapiens
aaagaggacugugagcaau

SEQ ID NO: 183944 - RNA, 19 nt, Homo sapiens
gcaaacggcauuucaucca

SEQ ID NO: 183945 - RNA, 19 nt, Homo sapiens
caaguugcaugagcagugu

SEQ ID NO: 183946 - RNA, 19 nt, Homo sapiens
gccaaccuuuccauuucua

SEQ ID NO: 183947 - RNA, 19 nt, Homo sapiens
cuucaggguuuaacaagug

SEQ ID NO: 183948 - RNA, 19 nt, Homo sapiens
cugccaaccuuuccauuuc

SEQ ID NO: 183949 - RNA, 19 nt, Homo sapiens
ugucgacccuggaggaaga

SEQ ID NO: 183950 - RNA, 19 nt, Homo sapiens
ggaagcccauaaggauguu

SEQ ID NO: 183951 - RNA, 19 nt, Homo sapiens
cugcucagcugaccuccuu

SEQ ID NO: 183952 - RNA, 19 nt, Homo sapiens
gccaagcaccacaaggaaa

SEQ ID NO: 183953 - RNA, 19 nt, Homo sapiens
ggacucacuccuacaaggu

SEQ ID NO: 183954 - RNA, 19 nt, Homo sapiens
acuguucugugcaaugaaa

SEQ ID NO: 183955 - RNA, 19 nt, Homo sapiens
ggagguggcgagguucuau

SEQ ID NO: 183956 - RNA, 19 nt, Homo sapiens
gccaggaagcccauaagga

SEQ ID NO: 183957 - RNA, 19 nt, Homo sapiens
gccuggccuuuccugcuua

SEQ ID NO: 183958 - RNA, 19 nt, Homo sapiens
augaggagguggcgagguu

SEQ ID NO: 183959 - RNA, 19 nt, Homo sapiens
cuaccuauauagauucaac

SEQ ID NO: 183960 - RNA, 19 nt, Homo sapiens
gagcugccugccaaccuuu

SEQ ID NO: 183961 - RNA, 19 nt, Homo sapiens
gcucagacaaggauugcau

SEQ ID NO: 183962 - RNA, 19 nt, Homo sapiens
gaacgccaagcaccacaag

SEQ ID NO: 183963 - RNA, 19 nt, Homo sapiens
ccucugacagccacuuuga

SEQ ID NO: 183964 - RNA, 19 nt, Homo sapiens
ccugccaaccuuuccauuu

SEQ ID NO: 183965 - RNA, 19 nt, Homo sapiens
ccgaggacaaguugcauga

SEQ ID NO: 183966 - RNA, 19 nt, Homo sapiens
uaaacgacaaggacagaca

SEQ ID NO: 183967 - RNA, 19 nt, Homo sapiens
ccccacagcucccaacuau

SEQ ID NO: 183968 - RNA, 19 nt, Homo sapiens
gcgcaaagagcggguacug

SEQ ID NO: 183969 - RNA, 19 nt, Homo sapiens
gaaaucccugcccuguuca

SEQ ID NO: 183970 - RNA, 19 nt, Homo sapiens
gaacgugccccugugcaaa

SEQ ID NO: 183971 - RNA, 19 nt, Homo sapiens
ucugacagccacuuugaau

SEQ ID NO: 183972 - RNA, 19 nt, Homo sapiens
aagauugucgcaccuccua

SEQ ID NO: 183973 - RNA, 19 nt, Homo sapiens
caccgcacaugugucuuga

SEQ ID NO: 183974 - RNA, 19 nt, Homo sapiens
cugacagccacuuugaaua

SEQ ID NO: 183975 - RNA, 19 nt, Homo sapiens
aaaucuggacucacuccua

SEQ ID NO: 183976 - RNA, 19 nt, Homo sapiens
gggaggcucagacaaggau

SEQ ID NO: 183977 - RNA, 19 nt, Homo sapiens
gcaagagcaacuggcacaa

SEQ ID NO: 183978 - RNA, 19 nt, Homo sapiens
ggaaaucccugcccuguuc

SEQ ID NO: 183979 - RNA, 19 nt, Homo sapiens
gaucagagcuggcgcaaag

SEQ ID NO: 183980 - RNA, 19 nt, Homo sapiens
ccacagcucccaacuauuu

SEQ ID NO: 183981 - RNA, 19 nt, Homo sapiens
gcaaagagcggguacugaa

SEQ ID NO: 183982 - RNA, 19 nt, Homo sapiens
gcaaugaaaucuggacuca

SEQ ID NO: 183983 - RNA, 19 nt, Homo sapiens
gauguuuccuaccuauaua

SEQ ID NO: 183984 - RNA, 19 nt, Homo sapiens
ugacagccacuuugaauaa

SEQ ID NO: 183985 - RNA, 19 nt, Homo sapiens
caaaggaucaccugguauu

SEQ ID NO: 183986 - RNA, 19 nt, Homo sapiens
gagcaauggugggaagauu

SEQ ID NO: 183987 - RNA, 19 nt, Homo sapiens
ccacuguucugugcaauga

SEQ ID NO: 183988 - RNA, 19 nt, Homo sapiens
cccaaaggaucaccuggua

SEQ ID NO: 183989 - RNA, 19 nt, Homo sapiens
gacagccacuuugaauaaa

SEQ ID NO: 183990 - RNA, 19 nt, Homo sapiens
ggagcugccugccaaccuu

SEQ ID NO: 183991 - RNA, 19 nt, Homo sapiens
caaagaggacugugagcaa

SEQ ID NO: 183992 - RNA, 19 nt, Homo sapiens
ggauguuuccuaccuauau

SEQ ID NO: 183993 - RNA, 19 nt, Homo sapiens
ggacuucaggguuuaacaa

SEQ ID NO: 183994 - RNA, 19 nt, Homo sapiens
cccaggaacugaacccaaa

SEQ ID NO: 183995 - RNA, 19 nt, Homo sapiens
ccaggaagcccauaaggau

SEQ ID NO: 183996 - RNA, 19 nt, Homo sapiens
ggaagaaugccugcuguuc

SEQ ID NO: 183997 - RNA, 19 nt, Homo sapiens
ccuacaaggucagcaacua

SEQ ID NO: 183998 - RNA, 19 nt, Homo sapiens
aaugaaaucuggacucacu

SEQ ID NO: 183999 - RNA, 19 nt, Homo sapiens
aaagaggacugugagcaau

SEQ ID NO: 184000 - RNA, 19 nt, Homo sapiens
gcaaacggcauuucaucca

SEQ ID NO: 184001 - RNA, 19 nt, Homo sapiens
caaguugcaugagcagugu

SEQ ID NO: 184002 - RNA, 19 nt, Homo sapiens
gccaaccuuuccauuucua

SEQ ID NO: 184003 - RNA, 19 nt, Homo sapiens
cuucaggguuuaacaagug

SEQ ID NO: 184004 - RNA, 19 nt, Homo sapiens
cugccaaccuuuccauuuc

SEQ ID NO: 184005 - RNA, 19 nt, Homo sapiens
ugucgacccuggaggaaga

SEQ ID NO: 184006 - RNA, 19 nt, Homo sapiens
ggaagcccauaaggauguu

SEQ ID NO: 184007 - RNA, 19 nt, Homo sapiens
gguauucccugagaguaca

SEQ ID NO: 184008 - RNA, 19 nt, Homo sapiens
cugcucagcugaccuccuu

SEQ ID NO: 184009 - RNA, 19 nt, Homo sapiens
caccugguauucccugaga

SEQ ID NO: 184010 - RNA, 19 nt, Homo sapiens
ggaacugaacccaaaggau

SEQ ID NO: 184011 - RNA, 19 nt, Homo sapiens
gccaagcaccacaaggaaa

SEQ ID NO: 184012 - RNA, 19 nt, Homo sapiens
ggacucacuccuacaaggu

SEQ ID NO: 184013 - RNA, 19 nt, Homo sapiens
acuguucugugcaaugaaa

SEQ ID NO: 184014 - RNA, 19 nt, Homo sapiens
ggagguggcgagguucuau

SEQ ID NO: 184015 - RNA, 19 nt, Homo sapiens
ucccugagaguacagauuu

SEQ ID NO: 184016 - RNA, 19 nt, Homo sapiens
gccaggaagcccauaagga

SEQ ID NO: 184017 - RNA, 19 nt, Homo sapiens
gccuggccuuuccugcuua

SEQ ID NO: 184018 - RNA, 19 nt, Homo sapiens
augaggagguggcgagguu

SEQ ID NO: 184019 - RNA, 19 nt, Homo sapiens
cuaccuauauagauucaac

SEQ ID NO: 184020 - RNA, 19 nt, Homo sapiens
gagcugccugccaaccuuu

SEQ ID NO: 184021 - RNA, 19 nt, Homo sapiens
gaacgccaagcaccacaag

SEQ ID NO: 184022 - RNA, 19 nt, Homo sapiens
gcucagacaaggauugcau

SEQ ID NO: 184023 - RNA, 19 nt, Homo sapiens
ccucugacagccacuuuga

SEQ ID NO: 184024 - RNA, 19 nt, Homo sapiens
ccugccaaccuuuccauuu

SEQ ID NO: 184025 - RNA, 19 nt, Homo sapiens
ccgaggacaaguugcauga

SEQ ID NO: 184026 - RNA, 19 nt, Homo sapiens
ccaaaggaucaccugguau

SEQ ID NO: 184027 - RNA, 19 nt, Homo sapiens
ccccacagcucccaacuau

SEQ ID NO: 184028 - RNA, 19 nt, Homo sapiens
gcgcaaagagcggguacug

SEQ ID NO: 184029 - RNA, 19 nt, Homo sapiens
gaaaucccugcccuguuca

SEQ ID NO: 184030 - RNA, 19 nt, Homo sapiens
gaacgugccccugugcaaa

SEQ ID NO: 184031 - RNA, 19 nt, Homo sapiens
ucugacagccacuuugaau

SEQ ID NO: 184032 - RNA, 19 nt, Homo sapiens
aagauugucgcaccuccua

SEQ ID NO: 184033 - RNA, 19 nt, Homo sapiens
gggaggcucagacaaggau

SEQ ID NO: 184034 - RNA, 19 nt, Homo sapiens
cugacagccacuuugaaua

SEQ ID NO: 184035 - RNA, 19 nt, Homo sapiens
aaaucuggacucacuccua

SEQ ID NO: 184036 - RNA, 19 nt, Homo sapiens
gcaagagcaacuggcacaa

SEQ ID NO: 184037 - RNA, 19 nt, Homo sapiens
ggaaaucccugcccuguuc

SEQ ID NO: 184038 - RNA, 19 nt, Homo sapiens
gaucagagcuggcgcaaag

SEQ ID NO: 184039 - RNA, 19 nt, Homo sapiens
ccacagcucccaacuauuu

SEQ ID NO: 184040 - RNA, 19 nt, Homo sapiens
gcaaagagcggguacugaa

SEQ ID NO: 184041 - RNA, 19 nt, Homo sapiens
gcaaugaaaucuggacuca

SEQ ID NO: 184042 - RNA, 19 nt, Homo sapiens
gauguuuccuaccuauaua

SEQ ID NO: 184043 - RNA, 19 nt, Homo sapiens
ugacagccacuuugaauaa

SEQ ID NO: 184044 - RNA, 19 nt, Homo sapiens
gagcaauggugggaagauu

SEQ ID NO: 184045 - RNA, 19 nt, Homo sapiens
ccacuguucugugcaauga

SEQ ID NO: 184046 - RNA, 19 nt, Homo sapiens
gugcucacauacaauaauu

SEQ ID NO: 184047 - RNA, 19 nt, Homo sapiens
gacagccacuuugaauaaa

SEQ ID NO: 184048 - RNA, 19 nt, Homo sapiens
ggagcugccugccaaccuu

SEQ ID NO: 184049 - RNA, 19 nt, Homo sapiens
caaagaggacugugagcaa

SEQ ID NO: 184050 - RNA, 19 nt, Homo sapiens
ggauguuuccuaccuauau

SEQ ID NO: 184051 - RNA, 19 nt, Homo sapiens
ggacuucaggguuuaacaa

SEQ ID NO: 184052 - RNA, 19 nt, Homo sapiens
ccaggaagcccauaaggau

SEQ ID NO: 184053 - RNA, 19 nt, Homo sapiens
ggaagaaugccugcuguuc

SEQ ID NO: 184054 - RNA, 19 nt, Homo sapiens
ccuacaaggucagcaacua

SEQ ID NO: 184055 - RNA, 19 nt, Homo sapiens
aaugaaaucuggacucacu

SEQ ID NO: 184056 - RNA, 19 nt, Homo sapiens
aaagaggacugugagcaau

SEQ ID NO: 184057 - RNA, 19 nt, Homo sapiens
gcaaacggcauuucaucca

SEQ ID NO: 184058 - RNA, 19 nt, Homo sapiens
caaguugcaugagcagugu

SEQ ID NO: 184059 - RNA, 19 nt, Homo sapiens
gccaaccuuuccauuucua

SEQ ID NO: 184060 - RNA, 19 nt, Homo sapiens
cuucaggguuuaacaagug

SEQ ID NO: 184061 - RNA, 19 nt, Homo sapiens
cugccaaccuuuccauuuc

SEQ ID NO: 184062 - RNA, 19 nt, Homo sapiens
ugucgacccuggaggaaga

SEQ ID NO: 184063 - RNA, 19 nt, Homo sapiens
ggaagcccauaaggauguu

SEQ ID NO: 184064 - RNA, 19 nt, Homo sapiens
cugcucagcugaccuccuu

SEQ ID NO: 184065 - RNA, 19 nt, Homo sapiens
gccaagcaccacaaggaaa

SEQ ID NO: 184066 - RNA, 19 nt, Homo sapiens
ggacucacuccuacaaggu

SEQ ID NO: 184067 - RNA, 19 nt, Homo sapiens
ggcuggugcucacauacaa

SEQ ID NO: 184068 - RNA, 19 nt, Homo sapiens
acuguucugugcaaugaaa

SEQ ID NO: 184069 - RNA, 19 nt, Homo sapiens
ggagguggcgagguucuau

SEQ ID NO: 184070 - RNA, 19 nt, Homo sapiens
gccaggaagcccauaagga

SEQ ID NO: 184071 - RNA, 19 nt, Homo sapiens
gccuggccuuuccugcuua

SEQ ID NO: 184072 - RNA, 19 nt, Homo sapiens
ccuggcuggugcucacaua

SEQ ID NO: 184073 - RNA, 19 nt, Homo sapiens
augaggagguggcgagguu

SEQ ID NO: 184074 - RNA, 19 nt, Homo sapiens
cuaccuauauagauucaac

SEQ ID NO: 184075 - RNA, 19 nt, Homo sapiens
gagcugccugccaaccuuu

SEQ ID NO: 184076 - RNA, 19 nt, Homo sapiens
ccacagcuguccccuggaa

SEQ ID NO: 184077 - RNA, 19 nt, Homo sapiens
gaacgccaagcaccacaag

SEQ ID NO: 184078 - RNA, 19 nt, Homo sapiens
gcucagacaaggauugcau

SEQ ID NO: 184079 - RNA, 19 nt, Homo sapiens
ccucugacagccacuuuga

SEQ ID NO: 184080 - RNA, 19 nt, Homo sapiens
ccugccaaccuuuccauuu

SEQ ID NO: 184081 - RNA, 19 nt, Homo sapiens
ccgaggacaaguugcauga

SEQ ID NO: 184082 - RNA, 19 nt, Homo sapiens
ccccacagcucccaacuau

SEQ ID NO: 184083 - RNA, 19 nt, Homo sapiens
gcgcaaagagcggguacug

SEQ ID NO: 184084 - RNA, 19 nt, Homo sapiens
cuggugcucacauacaaua

SEQ ID NO: 184085 - RNA, 19 nt, Homo sapiens
gaaaucccugcccuguuca

SEQ ID NO: 184086 - RNA, 19 nt, Homo sapiens
ugaguggccuucgcccaau

SEQ ID NO: 184087 - RNA, 19 nt, Homo sapiens
gaacgugccccugugcaaa

SEQ ID NO: 184088 - RNA, 19 nt, Homo sapiens
ucugacagccacuuugaau

SEQ ID NO: 184089 - RNA, 19 nt, Homo sapiens
aagauugucgcaccuccua

SEQ ID NO: 184090 - RNA, 19 nt, Homo sapiens
cugacagccacuuugaaua

SEQ ID NO: 184091 - RNA, 19 nt, Homo sapiens
aaaucuggacucacuccua

SEQ ID NO: 184092 - RNA, 19 nt, Homo sapiens
gcaagagcaacuggcacaa

SEQ ID NO: 184093 - RNA, 19 nt, Homo sapiens
gggaggcucagacaaggau

SEQ ID NO: 184094 - RNA, 19 nt, Homo sapiens
ggaaaucccugcccuguuc

SEQ ID NO: 184095 - RNA, 19 nt, Homo sapiens
gaucagagcuggcgcaaag

SEQ ID NO: 184096 - RNA, 19 nt, Homo sapiens
ccacagcucccaacuauuu

SEQ ID NO: 184097 - RNA, 19 nt, Homo sapiens
gcaaagagcggguacugaa

SEQ ID NO: 184098 - RNA, 19 nt, Homo sapiens
gaccacagcucuuucuuca

SEQ ID NO: 184099 - RNA, 19 nt, Homo sapiens
gcaaugaaaucuggacuca

SEQ ID NO: 184100 - RNA, 19 nt, Homo sapiens
gauguuuccuaccuauaua

SEQ ID NO: 184101 - RNA, 19 nt, Homo sapiens
ugacagccacuuugaauaa

SEQ ID NO: 184102 - RNA, 19 nt, Homo sapiens
gagcaauggugggaagauu

SEQ ID NO: 184103 - RNA, 19 nt, Homo sapiens
ccacuguucugugcaauga

SEQ ID NO: 184104 - RNA, 19 nt, Homo sapiens
gacagccacuuugaauaaa

SEQ ID NO: 184105 - RNA, 19 nt, Homo sapiens
ggagcugccugccaaccuu

SEQ ID NO: 184106 - RNA, 19 nt, Homo sapiens
caaagaggacugugagcaa

SEQ ID NO: 184107 - RNA, 19 nt, Homo sapiens
ggauguuuccuaccuauau

SEQ ID NO: 184108 - RNA, 19 nt, Homo sapiens
ggacuucaggguuuaacaa

SEQ ID NO: 184109 - RNA, 19 nt, Homo sapiens
ccaggaagcccauaaggau

SEQ ID NO: 184110 - RNA, 19 nt, Homo sapiens
ccacugaccacagcucuuu

SEQ ID NO: 184111 - RNA, 19 nt, Homo sapiens
ggaagaaugccugcuguuc

SEQ ID NO: 184112 - RNA, 19 nt, Homo sapiens
ccuacaaggucagcaacua

SEQ ID NO: 184113 - RNA, 19 nt, Homo sapiens
aaugaaaucuggacucacu

SEQ ID NO: 184114 - RNA, 19 nt, Homo sapiens
aaagaggacugugagcaau

SEQ ID NO: 184115 - RNA, 19 nt, Homo sapiens
gcaaacggcauuucaucca

SEQ ID NO: 184116 - RNA, 19 nt, Homo sapiens
caaguugcaugagcagugu

SEQ ID NO: 184117 - RNA, 19 nt, Homo sapiens
gccaaccuuuccauuucua

SEQ ID NO: 184118 - RNA, 19 nt, Homo sapiens
cuucaggguuuaacaagug

SEQ ID NO: 184119 - RNA, 19 nt, Homo sapiens
cugccaaccuuuccauuuc

SEQ ID NO: 184120 - RNA, 19 nt, Homo sapiens
ugucgacccuggaggaaga

SEQ ID NO: 184121 - RNA, 19 nt, Homo sapiens
ggaagcccauaaggauguu

SEQ ID NO: 184122 - RNA, 19 nt, Homo sapiens
cugcucagcugaccuccuu

SEQ ID NO: 184123 - RNA, 19 nt, Homo sapiens
gccaagcaccacaaggaaa

SEQ ID NO: 184124 - RNA, 19 nt, Homo sapiens
ggacucacuccuacaaggu

SEQ ID NO: 184125 - RNA, 19 nt, Homo sapiens
acuguucugugcaaugaaa

SEQ ID NO: 184126 - RNA, 19 nt, Homo sapiens
ggagguggcgagguucuau

SEQ ID NO: 184127 - RNA, 19 nt, Homo sapiens
gccaggaagcccauaagga

SEQ ID NO: 184128 - RNA, 19 nt, Homo sapiens
gccuggccuuuccugcuua

SEQ ID NO: 184129 - RNA, 19 nt, Homo sapiens
augaggagguggcgagguu

SEQ ID NO: 184130 - RNA, 19 nt, Homo sapiens
cuaccuauauagauucaac

SEQ ID NO: 184131 - RNA, 19 nt, Homo sapiens
gagcugccugccaaccuuu

SEQ ID NO: 184132 - RNA, 19 nt, Homo sapiens
gaacgccaagcaccacaag

SEQ ID NO: 184133 - RNA, 19 nt, Homo sapiens
gcucagacaaggauugcau

SEQ ID NO: 184134 - RNA, 19 nt, Homo sapiens
ccucugacagccacuuuga

SEQ ID NO: 184135 - RNA, 19 nt, Homo sapiens
ccugccaaccuuuccauuu

SEQ ID NO: 184136 - RNA, 19 nt, Homo sapiens
ccgaggacaaguugcauga

SEQ ID NO: 184137 - RNA, 19 nt, Homo sapiens
ccccacagcucccaacuau

SEQ ID NO: 184138 - RNA, 19 nt, Homo sapiens
gcgcaaagagcggguacug

SEQ ID NO: 184139 - RNA, 19 nt, Homo sapiens
gaaaucccugcccuguuca

SEQ ID NO: 184140 - RNA, 19 nt, Homo sapiens
gaacgugccccugugcaaa

SEQ ID NO: 184141 - RNA, 19 nt, Homo sapiens
ucugacagccacuuugaau

SEQ ID NO: 184142 - RNA, 19 nt, Homo sapiens
aagauugucgcaccuccua

SEQ ID NO: 184143 - RNA, 19 nt, Homo sapiens
cugacagccacuuugaaua

SEQ ID NO: 184144 - RNA, 19 nt, Homo sapiens
aaaucuggacucacuccua

SEQ ID NO: 184145 - RNA, 19 nt, Homo sapiens
ugaccacagcucuuucuuc

SEQ ID NO: 184146 - RNA, 19 nt, Homo sapiens
gcaagagcaacuggcacaa

SEQ ID NO: 184147 - RNA, 19 nt, Homo sapiens
gggaggcucagacaaggau

SEQ ID NO: 184148 - RNA, 19 nt, Homo sapiens
ggaaaucccugcccuguuc

SEQ ID NO: 184149 - RNA, 19 nt, Homo sapiens
gaucagagcuggcgcaaag

SEQ ID NO: 184150 - RNA, 19 nt, Homo sapiens
ccacagcucccaacuauuu

SEQ ID NO: 184151 - RNA, 19 nt, Homo sapiens
gcaaagagcggguacugaa

SEQ ID NO: 184152 - RNA, 19 nt, Homo sapiens
gcaaugaaaucuggacuca

SEQ ID NO: 184153 - RNA, 19 nt, Homo sapiens
caagauaguuugcuucucu

SEQ ID NO: 184154 - RNA, 19 nt, Homo sapiens
gauguuuccuaccuauaua

SEQ ID NO: 184155 - RNA, 19 nt, Homo sapiens
gaaaugauuccacaaagau

SEQ ID NO: 184156 - RNA, 19 nt, Homo sapiens
caucugugcugaaaugauu

SEQ ID NO: 184157 - RNA, 19 nt, Homo sapiens
ugacagccacuuugaauaa

SEQ ID NO: 184158 - RNA, 19 nt, Homo sapiens
ggagaaagcuaagccucaa

SEQ ID NO: 184159 - RNA, 19 nt, Homo sapiens
ugaaaugauuccacaaaga

SEQ ID NO: 184160 - RNA, 19 nt, Homo sapiens
uaaacuggcuaucauuugu

SEQ ID NO: 184161 - RNA, 19 nt, Homo sapiens
caaaggaucaccugguauu

SEQ ID NO: 184162 - RNA, 19 nt, Homo sapiens
gagcaauggugggaagauu

SEQ ID NO: 184163 - RNA, 19 nt, Homo sapiens
ccacuguucugugcaauga

SEQ ID NO: 184164 - RNA, 19 nt, Homo sapiens
cccaaaggaucaccuggua

SEQ ID NO: 184165 - RNA, 19 nt, Homo sapiens
ccucaucugugcugaaaug

SEQ ID NO: 184166 - RNA, 19 nt, Homo sapiens
gacagccacuuugaauaaa

SEQ ID NO: 184167 - RNA, 19 nt, Homo sapiens
ggagcugccugccaaccuu

SEQ ID NO: 184168 - RNA, 19 nt, Homo sapiens
caaagaggacugugagcaa

SEQ ID NO: 184169 - RNA, 19 nt, Homo sapiens
ggauguuuccuaccuauau

SEQ ID NO: 184170 - RNA, 19 nt, Homo sapiens
gcugaaaugauuccacaaa

SEQ ID NO: 184171 - RNA, 19 nt, Homo sapiens
gguggucccuacuguguga

SEQ ID NO: 184172 - RNA, 19 nt, Homo sapiens
ggacuucaggguuuaacaa

SEQ ID NO: 184173 - RNA, 19 nt, Homo sapiens
cgcaggaacugaacccaaa

SEQ ID NO: 184174 - RNA, 19 nt, Homo sapiens
aaagcuaagccucaagaua

SEQ ID NO: 184175 - RNA, 19 nt, Homo sapiens
ccaggaagcccauaaggau

SEQ ID NO: 184176 - RNA, 19 nt, Homo sapiens
ggaagaaugccugcuguuc

SEQ ID NO: 184177 - RNA, 19 nt, Homo sapiens
aagcuaagccucaagauag

SEQ ID NO: 184178 - RNA, 19 nt, Homo sapiens
gcccucaucugugcugaaa

SEQ ID NO: 184179 - RNA, 19 nt, Homo sapiens
ccuacaaggucagcaacua

SEQ ID NO: 184180 - RNA, 19 nt, Homo sapiens
cgggaacccugugcucuaa

SEQ ID NO: 184181 - RNA, 19 nt, Homo sapiens
aaagagcucuggccugaac

SEQ ID NO: 184182 - RNA, 19 nt, Homo sapiens
aaugaaaucuggacucacu

SEQ ID NO: 184183 - RNA, 19 nt, Homo sapiens
aaagaggacugugagcaau

SEQ ID NO: 184184 - RNA, 19 nt, Homo sapiens
gauuaaacuggcuaucauu

SEQ ID NO: 184185 - RNA, 19 nt, Homo sapiens
gcaaacggcauuucaucca

SEQ ID NO: 184186 - RNA, 19 nt, Homo sapiens
caaguugcaugagcagugu

SEQ ID NO: 184187 - RNA, 19 nt, Homo sapiens
gccaaccuuuccauuucua

SEQ ID NO: 184188 - RNA, 19 nt, Homo sapiens
cuucaggguuuaacaagug

SEQ ID NO: 184189 - RNA, 19 nt, Homo sapiens
agauuaaacuggcuaucau

SEQ ID NO: 184190 - RNA, 19 nt, Homo sapiens
cugccaaccuuuccauuuc

SEQ ID NO: 184191 - RNA, 19 nt, Homo sapiens
ugucgacccuggaggaaga

SEQ ID NO: 184192 - RNA, 19 nt, Homo sapiens
ggaacccugugcucuaaac

SEQ ID NO: 184193 - RNA, 19 nt, Homo sapiens
ggaagcccauaaggauguu

SEQ ID NO: 184194 - RNA, 19 nt, Homo sapiens
gguauucccugagaguaca

SEQ ID NO: 184195 - RNA, 19 nt, Homo sapiens
cugcucagcugaccuccuu

SEQ ID NO: 184196 - RNA, 19 nt, Homo sapiens
caccugguauucccugaga

SEQ ID NO: 184197 - RNA, 19 nt, Homo sapiens
ggaacugaacccaaaggau

SEQ ID NO: 184198 - RNA, 19 nt, Homo sapiens
gccaagcaccacaaggaaa

SEQ ID NO: 184199 - RNA, 19 nt, Homo sapiens
ggacucacuccuacaaggu

SEQ ID NO: 184200 - RNA, 19 nt, Homo sapiens
acuguucugugcaaugaaa

SEQ ID NO: 184201 - RNA, 19 nt, Homo sapiens
ggagguggcgagguucuau

SEQ ID NO: 184202 - RNA, 19 nt, Homo sapiens
uuaaacuggcuaucauuug

SEQ ID NO: 184203 - RNA, 19 nt, Homo sapiens
gccaggaagcccauaagga

SEQ ID NO: 184204 - RNA, 19 nt, Homo sapiens
ucccugagaguacagauuu

SEQ ID NO: 184205 - RNA, 19 nt, Homo sapiens
gaaagcuaagccucaagau

SEQ ID NO: 184206 - RNA, 19 nt, Homo sapiens
gauaguuugcuucucuuuc

SEQ ID NO: 184207 - RNA, 19 nt, Homo sapiens
gccuggccuuuccugcuua

SEQ ID NO: 184208 - RNA, 19 nt, Homo sapiens
cugaaaugauuccacaaag

SEQ ID NO: 184209 - RNA, 19 nt, Homo sapiens
augaggagguggcgagguu

SEQ ID NO: 184210 - RNA, 19 nt, Homo sapiens
cuaagccucaagauaguuu

SEQ ID NO: 184211 - RNA, 19 nt, Homo sapiens
cuaccuauauagauucaac

SEQ ID NO: 184212 - RNA, 19 nt, Homo sapiens
agaaagcuaagccucaaga

SEQ ID NO: 184213 - RNA, 19 nt, Homo sapiens
gagcugccugccaaccuuu

SEQ ID NO: 184214 - RNA, 19 nt, Homo sapiens
gaacgccaagcaccacaag

SEQ ID NO: 184215 - RNA, 19 nt, Homo sapiens
gcucagacaaggauugcau

SEQ ID NO: 184216 - RNA, 19 nt, Homo sapiens
ccucugacagccacuuuga

SEQ ID NO: 184217 - RNA, 19 nt, Homo sapiens
ccugccaaccuuuccauuu

SEQ ID NO: 184218 - RNA, 19 nt, Homo sapiens
ccgaggacaaguugcauga

SEQ ID NO: 184219 - RNA, 19 nt, Homo sapiens
aagauuaaacuggcuauca

SEQ ID NO: 184220 - RNA, 19 nt, Homo sapiens
ccccacagcucccaacuau

SEQ ID NO: 184221 - RNA, 19 nt, Homo sapiens
gcgcaaagagcggguacug

SEQ ID NO: 184222 - RNA, 19 nt, Homo sapiens
ccaaaggaucaccugguau

SEQ ID NO: 184223 - RNA, 19 nt, Homo sapiens
gaaaucccugcccuguuca

SEQ ID NO: 184224 - RNA, 19 nt, Homo sapiens
gaacgugccccugugcaaa

SEQ ID NO: 184225 - RNA, 19 nt, Homo sapiens
aaacuggcuaucauuuguu

SEQ ID NO: 184226 - RNA, 19 nt, Homo sapiens
ucugacagccacuuugaau

SEQ ID NO: 184227 - RNA, 19 nt, Homo sapiens
aagauugucgcaccuccua

SEQ ID NO: 184228 - RNA, 19 nt, Homo sapiens
cugacagccacuuugaaua

SEQ ID NO: 184229 - RNA, 19 nt, Homo sapiens
aaaucuggacucacuccua

SEQ ID NO: 184230 - RNA, 19 nt, Homo sapiens
gccucaagauaguuugcuu

SEQ ID NO: 184231 - RNA, 19 nt, Homo sapiens
caaagauuaaacuggcuau

SEQ ID NO: 184232 - RNA, 19 nt, Homo sapiens
gcaagagcaacuggcacaa

SEQ ID NO: 184233 - RNA, 19 nt, Homo sapiens
gggaggcucagacaaggau

SEQ ID NO: 184234 - RNA, 19 nt, Homo sapiens
caaggagaagguggaguga

SEQ ID NO: 184235 - RNA, 19 nt, Homo sapiens
ggaaaucccugcccuguuc

SEQ ID NO: 184236 - RNA, 19 nt, Homo sapiens
gaucagagcuggcgcaaag

SEQ ID NO: 184237 - RNA, 19 nt, Homo sapiens
gcacaugugucuugagaau

SEQ ID NO: 184238 - RNA, 19 nt, Homo sapiens
acaugugucuugagaauua

SEQ ID NO: 184239 - RNA, 19 nt, Homo sapiens
ccacagcucccaacuauuu

SEQ ID NO: 184240 - RNA, 19 nt, Homo sapiens
gcaaagagcggguacugaa

SEQ ID NO: 184241 - RNA, 19 nt, Homo sapiens
gcaaugaaaucuggacuca

SEQ ID NO: 184242 - RNA, 19 nt, Homo sapiens
gauguuuccuaccuauaua

SEQ ID NO: 184243 - RNA, 19 nt, Homo sapiens
ugacagccacuuugaauaa

SEQ ID NO: 184244 - RNA, 19 nt, Homo sapiens
gagcaauggugggaagauu

SEQ ID NO: 184245 - RNA, 19 nt, Homo sapiens
ccacuguucugugcaauga

SEQ ID NO: 184246 - RNA, 19 nt, Homo sapiens
gacagccacuuugaauaaa

SEQ ID NO: 184247 - RNA, 19 nt, Homo sapiens
ggagcugccugccaaccuu

SEQ ID NO: 184248 - RNA, 19 nt, Homo sapiens
caaagaggacugugagcaa

SEQ ID NO: 184249 - RNA, 19 nt, Homo sapiens
ggauguuuccuaccuauau

SEQ ID NO: 184250 - RNA, 19 nt, Homo sapiens
ggacuucaggguuuaacaa

SEQ ID NO: 184251 - RNA, 19 nt, Homo sapiens
ccaggaagcccauaaggau

SEQ ID NO: 184252 - RNA, 19 nt, Homo sapiens
ggaagaaugccugcuguuc

SEQ ID NO: 184253 - RNA, 19 nt, Homo sapiens
ccgcacaugugucuugaga

SEQ ID NO: 184254 - RNA, 19 nt, Homo sapiens
ccuacaaggucagcaacua

SEQ ID NO: 184255 - RNA, 19 nt, Homo sapiens
aaugaaaucuggacucacu

SEQ ID NO: 184256 - RNA, 19 nt, Homo sapiens
aaagaggacugugagcaau

SEQ ID NO: 184257 - RNA, 19 nt, Homo sapiens
gcaaacggcauuucaucca

SEQ ID NO: 184258 - RNA, 19 nt, Homo sapiens
caaguugcaugagcagugu

SEQ ID NO: 184259 - RNA, 19 nt, Homo sapiens
gccaaccuuuccauuucua

SEQ ID NO: 184260 - RNA, 19 nt, Homo sapiens
cuucaggguuuaacaagug

SEQ ID NO: 184261 - RNA, 19 nt, Homo sapiens
cugccaaccuuuccauuuc

SEQ ID NO: 184262 - RNA, 19 nt, Homo sapiens
ugucgacccuggaggaaga

SEQ ID NO: 184263 - RNA, 19 nt, Homo sapiens
ggaagcccauaaggauguu

SEQ ID NO: 184264 - RNA, 19 nt, Homo sapiens
cugcucagcugaccuccuu

SEQ ID NO: 184265 - RNA, 19 nt, Homo sapiens
gccaagcaccacaaggaaa

SEQ ID NO: 184266 - RNA, 19 nt, Homo sapiens
ggacucacuccuacaaggu

SEQ ID NO: 184267 - RNA, 19 nt, Homo sapiens
acuguucugugcaaugaaa

SEQ ID NO: 184268 - RNA, 19 nt, Homo sapiens
ggagguggcgagguucuau

SEQ ID NO: 184269 - RNA, 19 nt, Homo sapiens
gccaggaagcccauaagga

SEQ ID NO: 184270 - RNA, 19 nt, Homo sapiens
gccuggccuuuccugcuua

SEQ ID NO: 184271 - RNA, 19 nt, Homo sapiens
augaggagguggcgagguu

SEQ ID NO: 184272 - RNA, 19 nt, Homo sapiens
cuaccuauauagauucaac

SEQ ID NO: 184273 - RNA, 19 nt, Homo sapiens
gcucagacaaggauugcau

SEQ ID NO: 184274 - RNA, 19 nt, Homo sapiens
gagcugccugccaaccuuu

SEQ ID NO: 184275 - RNA, 19 nt, Homo sapiens
gaacgccaagcaccacaag

SEQ ID NO: 184276 - RNA, 19 nt, Homo sapiens
ccucugacagccacuuuga

SEQ ID NO: 184277 - RNA, 19 nt, Homo sapiens
ccugccaaccuuuccauuu

SEQ ID NO: 184278 - RNA, 19 nt, Homo sapiens
ccgaggacaaguugcauga

SEQ ID NO: 184279 - RNA, 19 nt, Homo sapiens
ccccacagcucccaacuau

SEQ ID NO: 184280 - RNA, 19 nt, Homo sapiens
gcgcaaagagcggguacug

SEQ ID NO: 184281 - RNA, 19 nt, Homo sapiens
gaaaucccugcccuguuca

SEQ ID NO: 184282 - RNA, 19 nt, Homo sapiens
gaacgugccccugugcaaa

SEQ ID NO: 184283 - RNA, 19 nt, Homo sapiens
ucugacagccacuuugaau

SEQ ID NO: 184284 - RNA, 19 nt, Homo sapiens
aagauugucgcaccuccua

SEQ ID NO: 184285 - RNA, 19 nt, Homo sapiens
caccgcacaugugucuuga

SEQ ID NO: 184286 - RNA, 19 nt, Homo sapiens
cugacagccacuuugaaua

SEQ ID NO: 184287 - RNA, 19 nt, Homo sapiens
aaaucuggacucacuccua

SEQ ID NO: 184288 - RNA, 19 nt, Homo sapiens
gcaagagcaacuggcacaa

SEQ ID NO: 184289 - RNA, 19 nt, Homo sapiens
gggaggcucagacaaggau

SEQ ID NO: 184290 - RNA, 19 nt, Homo sapiens
ggacugaucuccucaaugu

SEQ ID NO: 184291 - RNA, 19 nt, Homo sapiens
ggaaauggaugccacuucu

SEQ ID NO: 184292 - RNA, 19 nt, Homo sapiens
ccaagagucacuucuaaua

SEQ ID NO: 184293 - RNA, 19 nt, Homo sapiens
ggccaagagucacuucuaa

SEQ ID NO: 184294 - RNA, 19 nt, Homo sapiens
gccaggagcugcacaagga

SEQ ID NO: 184295 - RNA, 19 nt, Homo sapiens
gcucagcucccacaaauga

SEQ ID NO: 184296 - RNA, 19 nt, Homo sapiens
caagagucacuucuaauaa

SEQ ID NO: 184297 - RNA, 19 nt, Homo sapiens
gacuggaccucaggaguua

SEQ ID NO: 184298 - RNA, 19 nt, Homo sapiens
ggacuggaccucaggaguu

SEQ ID NO: 184299 - RNA, 19 nt, Homo sapiens
gacauggucuggaaaugga

SEQ ID NO: 184300 - RNA, 19 nt, Homo sapiens
cauacaaggucagcaacua

SEQ ID NO: 184301 - RNA, 19 nt, Homo sapiens
gaugugcccuuaugcaaag

SEQ ID NO: 184302 - RNA, 19 nt, Homo sapiens
gaaggccucuggagucacu

SEQ ID NO: 184303 - RNA, 19 nt, Homo sapiens
ccucaggaguuaacaagug

SEQ ID NO: 184304 - RNA, 19 nt, Homo sapiens
ggaugugcccuuaugcaaa

SEQ ID NO: 184305 - RNA, 19 nt, Homo sapiens
agagagaggccaacucaga

SEQ ID NO: 184306 - RNA, 19 nt, Homo sapiens
gugaaggccucuggaguca

SEQ ID NO: 184307 - RNA, 19 nt, Homo sapiens
ugugaaugcuggugagaug

SEQ ID NO: 184308 - RNA, 19 nt, Homo sapiens
ggauccagcaggugaauca

SEQ ID NO: 184309 - RNA, 19 nt, Homo sapiens
gggccaagagucacuucua

SEQ ID NO: 184310 - RNA, 19 nt, Homo sapiens
auccagaugugguuugauu

SEQ ID NO: 184311 - RNA, 19 nt, Homo sapiens
ggacaagcugcaugaccaa

SEQ ID NO: 184312 - RNA, 19 nt, Homo sapiens
ggaccacugcggcaagaug

SEQ ID NO: 184313 - RNA, 19 nt, Homo sapiens
gcagggacagaaagacaug

SEQ ID NO: 184314 - RNA, 19 nt, Homo sapiens
ccagaugugguuugauuca

SEQ ID NO: 184315 - RNA, 19 nt, Homo sapiens
uggaucuauugccuacuua

SEQ ID NO: 184316 - RNA, 19 nt, Homo sapiens
ugcagucccuggaagaaga

SEQ ID NO: 184317 - RNA, 19 nt, Homo sapiens
uuagagagaggccaacuca

SEQ ID NO: 184318 - RNA, 19 nt, Homo sapiens
caagagcaacuggcacaga

SEQ ID NO: 184319 - RNA, 19 nt, Homo sapiens
cuggaucuauugccuacuu

SEQ ID NO: 184320 - RNA, 19 nt, Homo sapiens
gaaauggaugccacuucug

SEQ ID NO: 184321 - RNA, 19 nt, Homo sapiens
gaaugcuggugagaugcuu

SEQ ID NO: 184322 - RNA, 19 nt, Homo sapiens
cuuccuggaugugcccuua

SEQ ID NO: 184323 - RNA, 19 nt, Homo sapiens
ugaaucagacguggcgaaa

SEQ ID NO: 184324 - RNA, 19 nt, Homo sapiens
caaugcagucccuggaaga

SEQ ID NO: 184325 - RNA, 19 nt, Homo sapiens
agagucacuucuaauaaac

SEQ ID NO: 184326 - RNA, 19 nt, Homo sapiens
gccaagagucacuucuaau

SEQ ID NO: 184327 - RNA, 19 nt, Homo sapiens
ggaccucaggaguuaacaa

SEQ ID NO: 184328 - RNA, 19 nt, Homo sapiens
gcucucugccgcaccuuug

SEQ ID NO: 184329 - RNA, 19 nt, Homo sapiens
gaccucaggaguuaacaag

SEQ ID NO: 184330 - RNA, 19 nt, Homo sapiens
ccucccgccuguacaacuu

SEQ ID NO: 184331 - RNA, 19 nt, Homo sapiens
cagcagcaacggagguuca

SEQ ID NO: 184332 - RNA, 19 nt, Homo sapiens
gcagucccuggaagaagaa

SEQ ID NO: 184333 - RNA, 19 nt, Homo sapiens
gcaccuuugaguccuacuu

SEQ ID NO: 184334 - RNA, 19 nt, Homo sapiens
ggacggaccugcucaaugu

SEQ ID NO: 184335 - RNA, 19 nt, Homo sapiens
gcaaagagcgcauucugaa

SEQ ID NO: 184336 - RNA, 19 nt, Homo sapiens
gccaggagcugcacaagga

SEQ ID NO: 184337 - RNA, 19 nt, Homo sapiens
gacauggccuggcagauga

SEQ ID NO: 184338 - RNA, 19 nt, Homo sapiens
cacaaaggcuggaauugga

SEQ ID NO: 184339 - RNA, 19 nt, Homo sapiens
ggacauggccuggcagaug

SEQ ID NO: 184340 - RNA, 19 nt, Homo sapiens
gaauuggaccucagggauu

SEQ ID NO: 184341 - RNA, 19 nt, Homo sapiens
gcacaaaggcuggaauugg

SEQ ID NO: 184342 - RNA, 19 nt, Homo sapiens
aauuggaccucagggauua

SEQ ID NO: 184343 - RNA, 19 nt, Homo sapiens
ggaccucagggauuaauga

SEQ ID NO: 184344 - RNA, 19 nt, Homo sapiens
ggaucacugugguaagaug

SEQ ID NO: 184345 - RNA, 19 nt, Homo sapiens
auagacaaauccacaugaa

SEQ ID NO: 184346 - RNA, 19 nt, Homo sapiens
ggagguggccaaguucuau

SEQ ID NO: 184347 - RNA, 19 nt, Homo sapiens
augaggagguggccaaguu

SEQ ID NO: 184348 - RNA, 19 nt, Homo sapiens
ugggaucacugugguaaga

SEQ ID NO: 184349 - RNA, 19 nt, Homo sapiens
ugcagucccuggaagaaga

SEQ ID NO: 184350 - RNA, 19 nt, Homo sapiens
agacaaauccacaugaaaa

SEQ ID NO: 184351 - RNA, 19 nt, Homo sapiens
uaauagacaaauccacaug

SEQ ID NO: 184352 - RNA, 19 nt, Homo sapiens
ccagaugugguuugacuca

SEQ ID NO: 184353 - RNA, 19 nt, Homo sapiens
ccaagcaccacaagacaca

SEQ ID NO: 184354 - RNA, 19 nt, Homo sapiens
uagacaaauccacaugaaa

SEQ ID NO: 184355 - RNA, 19 nt, Homo sapiens
ucacugugguaagauggaa

SEQ ID NO: 184356 - RNA, 19 nt, Homo sapiens
gaacgccaagcaccacaag

SEQ ID NO: 184357 - RNA, 19 nt, Homo sapiens
aaaagcaacuggcacaaag

SEQ ID NO: 184358 - RNA, 19 nt, Homo sapiens
ucucgugggauuauugauu

SEQ ID NO: 184359 - RNA, 19 nt, Homo sapiens
aauagacaaauccacauga

SEQ ID NO: 184360 - RNA, 19 nt, Homo sapiens
uuccaacaaccuauucuaa

SEQ ID NO: 184361 - RNA, 19 nt, Homo sapiens
gaacgugccccugugcaaa

SEQ ID NO: 184362 - RNA, 19 nt, Homo sapiens
cgcaaagagcgcauucuga

SEQ ID NO: 184363 - RNA, 19 nt, Homo sapiens
ccugcaagcgccacuuuau

SEQ ID NO: 184364 - RNA, 19 nt, Homo sapiens
ccucccgccuguacaacuu

SEQ ID NO: 184365 - RNA, 19 nt, Homo sapiens
cucgugggauuauugauuc

SEQ ID NO: 184366 - RNA, 19 nt, Homo sapiens
gcagucccuggaagaagaa

SEQ ID NO: 184367 - RNA, 19 nt, Homo sapiens
auugauuccugauccaaga

SEQ ID NO: 184368 - RNA, 19 nt, Homo sapiens
uaagauggauucucagaua

SEQ ID NO: 184369 - RNA, 19 nt, Homo sapiens
gcaaugagccuuccucuga

SEQ ID NO: 184370 - RNA, 19 nt, Homo sapiens
gcaauaguguguucugauu

SEQ ID NO: 184371 - RNA, 19 nt, Homo sapiens
ggagggagcugacugauac

SEQ ID NO: 184372 - RNA, 19 nt, Homo sapiens
guucugacauuaacaguuu

SEQ ID NO: 184373 - RNA, 19 nt, Homo sapiens
gggauagccucucuuacua

SEQ ID NO: 184374 - RNA, 19 nt, Homo sapiens
ggaaagugaauuugaauga

SEQ ID NO: 184375 - RNA, 19 nt, Homo sapiens
ucagagagcugguaguuag

SEQ ID NO: 184376 - RNA, 19 nt, Homo sapiens
acaguuaucuccagaagaa

SEQ ID NO: 184377 - RNA, 19 nt, Homo sapiens
ggagacagaccaacuagaa

SEQ ID NO: 184378 - RNA, 19 nt, Homo sapiens
gaacaguuaucuccagaag

SEQ ID NO: 184379 - RNA, 19 nt, Homo sapiens
gauggauucucagauauuu

SEQ ID NO: 184380 - RNA, 19 nt, Homo sapiens
aaacacaucuucccuagag

SEQ ID NO: 184381 - RNA, 19 nt, Homo sapiens
ucuauuggguucauuauug

SEQ ID NO: 184382 - RNA, 19 nt, Homo sapiens
ugcccgagcuggugcauua

SEQ ID NO: 184383 - RNA, 19 nt, Homo sapiens
gaagggaaaggaauaagau

SEQ ID NO: 184384 - RNA, 19 nt, Homo sapiens
gggcaagguggaacaguua

SEQ ID NO: 184385 - RNA, 19 nt, Homo sapiens
gaggguuccuguagaccua

SEQ ID NO: 184386 - RNA, 19 nt, Homo sapiens
gaccuuaucugugcgugaa

SEQ ID NO: 184387 - RNA, 19 nt, Homo sapiens
agaccgagcccuuugauga

SEQ ID NO: 184388 - RNA, 19 nt, Homo sapiens
caauaguguguucugauua

SEQ ID NO: 184389 - RNA, 19 nt, Homo sapiens
cagaccaacuagaagauga

SEQ ID NO: 184390 - RNA, 19 nt, Homo sapiens
gagguggucugaauguucu

SEQ ID NO: 184391 - RNA, 19 nt, Homo sapiens
ccugcaagaucccugauga

SEQ ID NO: 184392 - RNA, 19 nt, Homo sapiens
ggaggagggagcugacuga

SEQ ID NO: 184393 - RNA, 19 nt, Homo sapiens
uguggaaagugaauuugaa

SEQ ID NO: 184394 - RNA, 19 nt, Homo sapiens
ccaaccugcugaaggagaa

SEQ ID NO: 184395 - RNA, 19 nt, Homo sapiens
guaguuaguagcauguuga

SEQ ID NO: 184396 - RNA, 19 nt, Homo sapiens
gguaguuaguagcauguug

SEQ ID NO: 184397 - RNA, 19 nt, Homo sapiens
cauggaguguguauuguuc

SEQ ID NO: 184398 - RNA, 19 nt, Homo sapiens
gaaccugucaagagcauca

SEQ ID NO: 184399 - RNA, 19 nt, Homo sapiens
gcagcugauuuuaacaaua

SEQ ID NO: 184400 - RNA, 19 nt, Homo sapiens
gaugagaagucugcuuugc

SEQ ID NO: 184401 - RNA, 19 nt, Homo sapiens
uuacugaucaugcauuguu

SEQ ID NO: 184402 - RNA, 19 nt, Homo sapiens
cuauauccauguacuguag

SEQ ID NO: 184403 - RNA, 19 nt, Homo sapiens
aauaguguguucugauuag

SEQ ID NO: 184404 - RNA, 19 nt, Homo sapiens
gcauggaguguguauuguu

SEQ ID NO: 184405 - RNA, 19 nt, Homo sapiens
ccuagaggguuccuguaga

SEQ ID NO: 184406 - RNA, 19 nt, Homo sapiens
gaaacacaucuucccuaga

SEQ ID NO: 184407 - RNA, 19 nt, Homo sapiens
agacagaccaacuagaaga

SEQ ID NO: 184408 - RNA, 19 nt, Homo sapiens
cgaagggaaaggaauaaga

SEQ ID NO: 184409 - RNA, 19 nt, Homo sapiens
gagaggagaaacacaucuu

SEQ ID NO: 184410 - RNA, 19 nt, Homo sapiens
gaagaccgagcccuuugau

SEQ ID NO: 184411 - RNA, 19 nt, Homo sapiens
aagaugagaagucugcuuu

SEQ ID NO: 184412 - RNA, 19 nt, Homo sapiens
gaagaugagaagucugcuu

SEQ ID NO: 184413 - RNA, 19 nt, Homo sapiens
aagauggauucucagauau

SEQ ID NO: 184414 - RNA, 19 nt, Homo sapiens
caacugagaagccaagacu

SEQ ID NO: 184415 - RNA, 19 nt, Homo sapiens
gagagcugguaguuaguag

SEQ ID NO: 184416 - RNA, 19 nt, Homo sapiens
gcccaagcccucaguggaa

SEQ ID NO: 184417 - RNA, 19 nt, Homo sapiens
uuugacauguggaaaguga

SEQ ID NO: 184418 - RNA, 19 nt, Homo sapiens
gcuauauccauguacugua

SEQ ID NO: 184419 - RNA, 19 nt, Homo sapiens
uaauguuacugaucaugca

SEQ ID NO: 184420 - RNA, 19 nt, Homo sapiens
ucuccuuagucuucucaua

SEQ ID NO: 184421 - RNA, 19 nt, Homo sapiens
gcugaagaccgagcccuuu

SEQ ID NO: 184422 - RNA, 19 nt, Homo sapiens
gcacugcuuacacgucuuc

SEQ ID NO: 184423 - RNA, 19 nt, Homo sapiens
ccaacuagaagaugagaag

SEQ ID NO: 184424 - RNA, 19 nt, Homo sapiens
gcagcgagcaacugagaag

SEQ ID NO: 184425 - RNA, 19 nt, Homo sapiens
uaucuagugcagcugauuu

SEQ ID NO: 184426 - RNA, 19 nt, Homo sapiens
caaaacgcauggagugugu

SEQ ID NO: 184427 - RNA, 19 nt, Homo sapiens
cuugaaagcauccaugugu

SEQ ID NO: 184428 - RNA, 19 nt, Homo sapiens
uugccaaccugcugaagga

SEQ ID NO: 184429 - RNA, 19 nt, Homo sapiens
uuagucuucucauagcauu

SEQ ID NO: 184430 - RNA, 19 nt, Homo sapiens
acgcauggaguguguauug

SEQ ID NO: 184431 - RNA, 19 nt, Homo sapiens
aggagaauccgaagggaaa

SEQ ID NO: 184432 - RNA, 19 nt, Homo sapiens
ggaacaguuaucuccagaa

SEQ ID NO: 184433 - RNA, 19 nt, Homo sapiens
cacccugccucuccucaau

SEQ ID NO: 184434 - RNA, 19 nt, Homo sapiens
uaaccgccacgaugauguu

SEQ ID NO: 184435 - RNA, 19 nt, Homo sapiens
gggcuggcguugugaagac

SEQ ID NO: 184436 - RNA, 19 nt, Homo sapiens
gagcugguaguuaguagca

SEQ ID NO: 184437 - RNA, 19 nt, Homo sapiens
agcaugggcucgccuguca

SEQ ID NO: 184438 - RNA, 19 nt, Homo sapiens
gaccuagggaggaccuuau

SEQ ID NO: 184439 - RNA, 19 nt, Homo sapiens
cuagaggguuccuguagac

SEQ ID NO: 184440 - RNA, 19 nt, Homo sapiens
ugaagaccgagcccuuuga

SEQ ID NO: 184441 - RNA, 19 nt, Homo sapiens
uccagaagaagaagagaaa

SEQ ID NO: 184442 - RNA, 19 nt, Homo sapiens
acauguggaaagugaauuu

SEQ ID NO: 184443 - RNA, 19 nt, Homo sapiens
uggcaauaguguguucuga

SEQ ID NO: 184444 - RNA, 19 nt, Homo sapiens
cucaaguccuuaccucuuc

SEQ ID NO: 184445 - RNA, 19 nt, Homo sapiens
acuagaagaugagaagucu

SEQ ID NO: 184446 - RNA, 19 nt, Homo sapiens
gcugacugauacacuccaa

SEQ ID NO: 184447 - RNA, 19 nt, Homo sapiens
acugagaagccaagacuga

SEQ ID NO: 184448 - RNA, 19 nt, Homo sapiens
cauuaacaguuuuccauga

SEQ ID NO: 184449 - RNA, 19 nt, Homo sapiens
cuacuguguuccuggcaau

SEQ ID NO: 184450 - RNA, 19 nt, Homo sapiens
ggguucauuauuggaauua

SEQ ID NO: 184451 - RNA, 19 nt, Homo sapiens
cuauuggguucauuauugg

SEQ ID NO: 184452 - RNA, 19 nt, Homo sapiens
agaccgagauugccaaccu

SEQ ID NO: 184453 - RNA, 19 nt, Homo sapiens
ggauagccucucuuacuac

SEQ ID NO: 184454 - RNA, 19 nt, Homo sapiens
gagacagaccaacuagaag

SEQ ID NO: 184455 - RNA, 19 nt, Homo sapiens
cgucuccagugccaacuuc

SEQ ID NO: 184456 - RNA, 19 nt, Homo sapiens
ugacauguggaaagugaau

SEQ ID NO: 184457 - RNA, 19 nt, Homo sapiens
ugagguggucugaauguuc

SEQ ID NO: 184458 - RNA, 19 nt, Homo sapiens
agagagcugguaguuagua

SEQ ID NO: 184459 - RNA, 19 nt, Homo sapiens
uguguauuguucccaguga

SEQ ID NO: 184460 - RNA, 19 nt, Homo sapiens
acucccagcugcacugcuu

SEQ ID NO: 184461 - RNA, 19 nt, Homo sapiens
ugccagacauggaccuauc

SEQ ID NO: 184462 - RNA, 19 nt, Homo sapiens
gcaagguggaacaguuauc

SEQ ID NO: 184463 - RNA, 19 nt, Homo sapiens
gacagaccaacuagaagau

SEQ ID NO: 184464 - RNA, 19 nt, Homo sapiens
agauggauucucagauauu

SEQ ID NO: 184465 - RNA, 19 nt, Homo sapiens
uguuacugaucaugcauug

SEQ ID NO: 184466 - RNA, 19 nt, Homo sapiens
uuaaccuggugcuggauau

SEQ ID NO: 184467 - RNA, 19 nt, Homo sapiens
ucuuuucucuuucuccuua

SEQ ID NO: 184468 - RNA, 19 nt, Homo sapiens
gaaaugaguuggccagauu

SEQ ID NO: 184469 - RNA, 19 nt, Homo sapiens
gaaggaacgucuggaguuu

SEQ ID NO: 184470 - RNA, 19 nt, Homo sapiens
ccggagagcuggugacuuu

SEQ ID NO: 184471 - RNA, 19 nt, Homo sapiens
gcacagaaacuuugccauu

SEQ ID NO: 184472 - RNA, 19 nt, Homo sapiens
ucacuugucuccuuucuga

SEQ ID NO: 184473 - RNA, 19 nt, Homo sapiens
ggagugauuuauacuguga

SEQ ID NO: 184474 - RNA, 19 nt, Homo sapiens
cagagaggcucaacaagga

SEQ ID NO: 184475 - RNA, 19 nt, Homo sapiens
caggaagacugcacagaaa

SEQ ID NO: 184476 - RNA, 19 nt, Homo sapiens
ggaaacugcuucuagaaac

SEQ ID NO: 184477 - RNA, 19 nt, Homo sapiens
caugaggauuucuuuauga

SEQ ID NO: 184478 - RNA, 19 nt, Homo sapiens
gcuuauugaucccacauuu

SEQ ID NO: 184479 - RNA, 19 nt, Homo sapiens
ggugaacucuuuagacaca

SEQ ID NO: 184480 - RNA, 19 nt, Homo sapiens
ggaacgaaauaaacuagca

SEQ ID NO: 184481 - RNA, 19 nt, Homo sapiens
ccugacggcuucucucuuu

SEQ ID NO: 184482 - RNA, 19 nt, Homo sapiens
aaagcgagccguugaauug

SEQ ID NO: 184483 - RNA, 19 nt, Homo sapiens
gaaacugcuucuagaaacu

SEQ ID NO: 184484 - RNA, 19 nt, Homo sapiens
ggugugagauccucuuuac

SEQ ID NO: 184485 - RNA, 19 nt, Homo sapiens
cuuggaaacuugauuguug

SEQ ID NO: 184486 - RNA, 19 nt, Homo sapiens
cacagaaacuuugccauug

SEQ ID NO: 184487 - RNA, 19 nt, Homo sapiens
aaacuugauuguugugguu

SEQ ID NO: 184488 - RNA, 19 nt, Homo sapiens
acugagggaucguagauuu

SEQ ID NO: 184489 - RNA, 19 nt, Homo sapiens
cagaaacuuugccauuguu

SEQ ID NO: 184490 - RNA, 19 nt, Homo sapiens
cgaaaggcaauuauaucua

SEQ ID NO: 184491 - RNA, 19 nt, Homo sapiens
ucaugaggauuucuuuaug

SEQ ID NO: 184492 - RNA, 19 nt, Homo sapiens
cagaucaguuggaggaaga

SEQ ID NO: 184493 - RNA, 19 nt, Homo sapiens
uggcggaggugagagauuu

SEQ ID NO: 184494 - RNA, 19 nt, Homo sapiens
acagaaacuuugccauugu

SEQ ID NO: 184495 - RNA, 19 nt, Homo sapiens
gcucagcaccggcuaagga

SEQ ID NO: 184496 - RNA, 19 nt, Homo sapiens
ggagagagacuuggaagag

SEQ ID NO: 184497 - RNA, 19 nt, Homo sapiens
guucugcacuguugccaau

SEQ ID NO: 184498 - RNA, 19 nt, Homo sapiens
cuacggagccugcacuuuc

SEQ ID NO: 184499 - RNA, 19 nt, Homo sapiens
ggaggagaccguagcugaa

SEQ ID NO: 184500 - RNA, 19 nt, Homo sapiens
uggaauuucuggccuccua

SEQ ID NO: 184501 - RNA, 19 nt, Homo sapiens
gcgagccguugaauuggaa

SEQ ID NO: 184502 - RNA, 19 nt, Homo sapiens
caaagcgagccguugaauu

SEQ ID NO: 184503 - RNA, 19 nt, Homo sapiens
cggcuucucucuuuacaca

SEQ ID NO: 184504 - RNA, 19 nt, Homo sapiens
caaucuguaucuuugacaa

SEQ ID NO: 184505 - RNA, 19 nt, Homo sapiens
ugacaguguuaucccaaga

SEQ ID NO: 184506 - RNA, 19 nt, Homo sapiens
ucggugaacucuuuagaca

SEQ ID NO: 184507 - RNA, 19 nt, Homo sapiens
cccauuccuuagcuauuua

SEQ ID NO: 184508 - RNA, 19 nt, Homo sapiens
agaaggaacgucuggaguu

SEQ ID NO: 184509 - RNA, 19 nt, Homo sapiens
gaagacugcacagaaacuu

SEQ ID NO: 184510 - RNA, 19 nt, Homo sapiens
ucugcacuguugccaauaa

SEQ ID NO: 184511 - RNA, 19 nt, Homo sapiens
ccacguggccucucucucu

SEQ ID NO: 184512 - RNA, 19 nt, Homo sapiens
ugaaaugaguuggccagau

SEQ ID NO: 184513 - RNA, 19 nt, Homo sapiens
ucaaggggcuggaaucuca

SEQ ID NO: 184514 - RNA, 19 nt, Homo sapiens
gagaggcucaacaaggaaa

SEQ ID NO: 184515 - RNA, 19 nt, Homo sapiens
gaucccacauuuccauggu

SEQ ID NO: 184516 - RNA, 19 nt, Homo sapiens
uggaaacugcuucuagaaa

SEQ ID NO: 184517 - RNA, 19 nt, Homo sapiens
acccauuccuuagcuauuu

SEQ ID NO: 184518 - RNA, 19 nt, Homo sapiens
gugagauccucuuuacucu

SEQ ID NO: 184519 - RNA, 19 nt, Homo sapiens
guacacuucuucguuuguc

SEQ ID NO: 184520 - RNA, 19 nt, Homo sapiens
gccaaccacaauucaauga

SEQ ID NO: 184521 - RNA, 19 nt, Homo sapiens
gaucccagacccauuccuu

SEQ ID NO: 184522 - RNA, 19 nt, Homo sapiens
ggaauuucuggccuccuaa

SEQ ID NO: 184523 - RNA, 19 nt, Homo sapiens
gcuucucucuuuacacaca

SEQ ID NO: 184524 - RNA, 19 nt, Homo sapiens
aggaacgucuggaguuugu

SEQ ID NO: 184525 - RNA, 19 nt, Homo sapiens
ugucuucgguggacuccuu

SEQ ID NO: 184526 - RNA, 19 nt, Homo sapiens
aaacuuugccauuguugga

SEQ ID NO: 184527 - RNA, 19 nt, Homo sapiens
ggaagacugcacagaaacu

SEQ ID NO: 184528 - RNA, 19 nt, Homo sapiens
acauuuccauggugugaga

SEQ ID NO: 184529 - RNA, 19 nt, Homo sapiens
cagcaccggcuaaggaaga

SEQ ID NO: 184530 - RNA, 19 nt, Homo sapiens
caacccacccucaucucuu

SEQ ID NO: 184531 - RNA, 19 nt, Homo sapiens
agacugcacagaaacuuug

SEQ ID NO: 184532 - RNA, 19 nt, Homo sapiens
gaauuggaaacugcuucua

SEQ ID NO: 184533 - RNA, 19 nt, Homo sapiens
ccgaaaggcaauuauaucu

SEQ ID NO: 184534 - RNA, 19 nt, Homo sapiens
ucucaugaggauuucuuua

SEQ ID NO: 184535 - RNA, 19 nt, Homo sapiens
gugaggggcugugacauuu

SEQ ID NO: 184536 - RNA, 19 nt, Homo sapiens
ggagagcuggugacuuugg

SEQ ID NO: 184537 - RNA, 19 nt, Homo sapiens
gggacacgcggaaccaaga

SEQ ID NO: 184538 - RNA, 19 nt, Homo sapiens
uggaggaccgacuuacuuu

SEQ ID NO: 184539 - RNA, 19 nt, Homo sapiens
uacggagccugcacuuuca

SEQ ID NO: 184540 - RNA, 19 nt, Homo sapiens
agacuuggaaacuugauug

SEQ ID NO: 184541 - RNA, 19 nt, Homo sapiens
auuggaaacugcuucuaga

SEQ ID NO: 184542 - RNA, 19 nt, Homo sapiens
cuccauccgugcugcauga

SEQ ID NO: 184543 - RNA, 19 nt, Homo sapiens
cuggagugauuuauacugu

SEQ ID NO: 184544 - RNA, 19 nt, Homo sapiens
aaacuggcucugauuggaa

SEQ ID NO: 184545 - RNA, 19 nt, Homo sapiens
guuaacccuucguacacuu

SEQ ID NO: 184546 - RNA, 19 nt, Homo sapiens
cugcuggagugauuuauac

SEQ ID NO: 184547 - RNA, 19 nt, Homo sapiens
uucguacacuucuucguuu

SEQ ID NO: 184548 - RNA, 19 nt, Homo sapiens
gaggagaccguagcugaag

SEQ ID NO: 184549 - RNA, 19 nt, Homo sapiens
cugacggcuucucucuuua

SEQ ID NO: 184550 - RNA, 19 nt, Homo sapiens
gcaacccacccucaucucu

SEQ ID NO: 184551 - RNA, 19 nt, Homo sapiens
ccagacccauuccuuagcu

SEQ ID NO: 184552 - RNA, 19 nt, Homo sapiens
ccagccuuguuucugauga

SEQ ID NO: 184553 - RNA, 19 nt, Homo sapiens
guuguuaacccuucguaca

SEQ ID NO: 184554 - RNA, 19 nt, Homo sapiens
ccucugccgagucucaaua

SEQ ID NO: 184555 - RNA, 19 nt, Homo sapiens
ccuugguucugcacuguug

SEQ ID NO: 184556 - RNA, 19 nt, Homo sapiens
gacccauuccuuagcuauu

SEQ ID NO: 184557 - RNA, 19 nt, Homo sapiens
gggagagagacuuggaaga

SEQ ID NO: 184558 - RNA, 19 nt, Homo sapiens
gacggcuucucucuuuaca

SEQ ID NO: 184559 - RNA, 19 nt, Homo sapiens
cugcacuguugccaauaaa

SEQ ID NO: 184560 - RNA, 19 nt, Homo sapiens
ugugagauccucuuuacuc

SEQ ID NO: 184561 - RNA, 19 nt, Homo sapiens
ccugcacuuucaagaggua

SEQ ID NO: 184562 - RNA, 19 nt, Homo sapiens
caaaacaaacaaacacaug

SEQ ID NO: 184563 - RNA, 19 nt, Homo sapiens
ugaagcugauucuguacag

SEQ ID NO: 184564 - RNA, 19 nt, Homo sapiens
gcucggugaacucuuuaga

SEQ ID NO: 184565 - RNA, 19 nt, Homo sapiens
agacugagggaucguagau

SEQ ID NO: 184566 - RNA, 19 nt, Homo sapiens
auuuaucccuuuccugguu

SEQ ID NO: 184567 - RNA, 19 nt, Homo sapiens
cagacccauuccuuagcua

SEQ ID NO: 184568 - RNA, 19 nt, Homo sapiens
gccgggagcugacagagaa

SEQ ID NO: 184569 - RNA, 19 nt, Homo sapiens
ggcccagugugcaagauua

SEQ ID NO: 184570 - RNA, 19 nt, Homo sapiens
gaaauuccggguagauaug

SEQ ID NO: 184571 - RNA, 19 nt, Homo sapiens
gagcagcugucuccugaag

SEQ ID NO: 184572 - RNA, 19 nt, Homo sapiens
ccacucugcuggcucugua

SEQ ID NO: 184573 - RNA, 19 nt, Homo sapiens
gaagcuggaguucauguug

SEQ ID NO: 184574 - RNA, 19 nt, Homo sapiens
gcucaccgcagaagcagua

SEQ ID NO: 184575 - RNA, 19 nt, Homo sapiens
uugcugagcugcagaagga

SEQ ID NO: 184576 - RNA, 19 nt, Homo sapiens
gcagcugucuccugaagag

SEQ ID NO: 184577 - RNA, 19 nt, Homo sapiens
gaaccucgucuucaccuau

SEQ ID NO: 184578 - RNA, 19 nt, Homo sapiens
gcccagcgcucugucauca

SEQ ID NO: 184579 - RNA, 19 nt, Homo sapiens
acacauggcccucccaaga

SEQ ID NO: 184580 - RNA, 19 nt, Homo sapiens
cccaagaccuggcgugauc

SEQ ID NO: 184581 - RNA, 19 nt, Homo sapiens
ccacagugaucaccuccau

SEQ ID NO: 184582 - RNA, 19 nt, Homo sapiens
cagaaauuccggguagaua

SEQ ID NO: 184583 - RNA, 19 nt, Homo sapiens
agucaggccugcagaagga

SEQ ID NO: 184584 - RNA, 19 nt, Homo sapiens
aggagaagcuggaguucau

SEQ ID NO: 184585 - RNA, 19 nt, Homo sapiens
caucaagcccaucagcauu

SEQ ID NO: 184586 - RNA, 19 nt, Homo sapiens
gcgcuguaguggugaaaca

SEQ ID NO: 184587 - RNA, 19 nt, Homo sapiens
gcagaaauuccggguagau

SEQ ID NO: 184588 - RNA, 19 nt, Homo sapiens
gauuaucccgggaacuuug

SEQ ID NO: 184589 - RNA, 19 nt, Homo sapiens
agaaggagaagcuggaguu

SEQ ID NO: 184590 - RNA, 19 nt, Homo sapiens
ccagcgcucugucaucaag

SEQ ID NO: 184591 - RNA, 19 nt, Homo sapiens
agaaauuccggguagauau

SEQ ID NO: 184592 - RNA, 19 nt, Homo sapiens
gaagucaggccugcagaag

SEQ ID NO: 184593 - RNA, 19 nt, Homo sapiens
gagaagcuggaguucaugu

SEQ ID NO: 184594 - RNA, 19 nt, Homo sapiens
gaccuggcgugaucaagac

SEQ ID NO: 184595 - RNA, 19 nt, Homo sapiens
gaaggagaagcuggaguuc

SEQ ID NO: 184596 - RNA, 19 nt, Homo sapiens
gcaggagucacccgcaucu

SEQ ID NO: 184597 - RNA, 19 nt, Homo sapiens
cgaaccucgucuucaccua

SEQ ID NO: 184598 - RNA, 19 nt, Homo sapiens
acagugaucaccuccaugu

SEQ ID NO: 184599 - RNA, 19 nt, Homo sapiens
agaccuggcgugaucaaga

SEQ ID NO: 184600 - RNA, 19 nt, Homo sapiens
caucagacuccuugaacuc

SEQ ID NO: 184601 - RNA, 19 nt, Homo sapiens
ccgcaucucccuccgaauc

SEQ ID NO: 184602 - RNA, 19 nt, Homo sapiens
ccucgaaccucgucuucac

SEQ ID NO: 184603 - RNA, 19 nt, Homo sapiens
gcaccucgaaccucgucuu

SEQ ID NO: 184604 - RNA, 19 nt, Homo sapiens
ggcgugaucaagaccauug

SEQ ID NO: 184605 - RNA, 19 nt, Homo sapiens
gcaccaacaucaucaggaa

SEQ ID NO: 184606 - RNA, 19 nt, Homo sapiens
ggaaccaccuggacgaaga

SEQ ID NO: 184607 - RNA, 19 nt, Homo sapiens
cccaugaacuuacauacua

SEQ ID NO: 184608 - RNA, 19 nt, Homo sapiens
gaagaucgcauggcagaaa

SEQ ID NO: 184609 - RNA, 19 nt, Homo sapiens
gaggguggcuggagugaau

SEQ ID NO: 184610 - RNA, 19 nt, Homo sapiens
ucacaugccuugcaaugga

SEQ ID NO: 184611 - RNA, 19 nt, Homo sapiens
gaucucauguccucuauac

SEQ ID NO: 184612 - RNA, 19 nt, Homo sapiens
gggauacgguggagaagau

SEQ ID NO: 184613 - RNA, 19 nt, Homo sapiens
ucaauacccugcagaccaa

SEQ ID NO: 184614 - RNA, 19 nt, Homo sapiens
guccugagcucuucaccaa

SEQ ID NO: 184615 - RNA, 19 nt, Homo sapiens
gcagaucucauguccucua

SEQ ID NO: 184616 - RNA, 19 nt, Homo sapiens
gcucaggcccagcuuauug

SEQ ID NO: 184617 - RNA, 19 nt, Homo sapiens
gcuuaugacugcaccaaca

SEQ ID NO: 184618 - RNA, 19 nt, Homo sapiens
guucgagucuugcucuuca

SEQ ID NO: 184619 - RNA, 19 nt, Homo sapiens
gaauguauccuccgaagcu

SEQ ID NO: 184620 - RNA, 19 nt, Homo sapiens
uggaagccauggaacugua

SEQ ID NO: 184621 - RNA, 19 nt, Homo sapiens
gaacaucauccacgucacu

SEQ ID NO: 184622 - RNA, 19 nt, Homo sapiens
gccgugcgcaugcucaaua

SEQ ID NO: 184623 - RNA, 19 nt, Homo sapiens
gagcauggaguaccaggau

SEQ ID NO: 184624 - RNA, 19 nt, Homo sapiens
gagcccagcagaucucaug

SEQ ID NO: 184625 - RNA, 19 nt, Homo sapiens
agacgggauucuuuagguu

SEQ ID NO: 184626 - RNA, 19 nt, Homo sapiens
ccugagcucuucaccaagu

SEQ ID NO: 184627 - RNA, 19 nt, Homo sapiens
ugugcugggugguagauuu

SEQ ID NO: 184628 - RNA, 19 nt, Homo sapiens
gccgggagaggaugucuuu

SEQ ID NO: 184629 - RNA, 19 nt, Homo sapiens
caacgcagaccaacagaac

SEQ ID NO: 184630 - RNA, 19 nt, Homo sapiens
uuacauacuaggugccuuu

SEQ ID NO: 184631 - RNA, 19 nt, Homo sapiens
ccaugaacuuacauacuag

SEQ ID NO: 184632 - RNA, 19 nt, Homo sapiens
gucuugcucuucaaugcua

SEQ ID NO: 184633 - RNA, 19 nt, Homo sapiens
gcaacgcagaccaacagaa

SEQ ID NO: 184634 - RNA, 19 nt, Homo sapiens
gagucuugcucuucaaugc

SEQ ID NO: 184635 - RNA, 19 nt, Homo sapiens
uggcuggagugaauuaaag

SEQ ID NO: 184636 - RNA, 19 nt, Homo sapiens
cagaucucauguccucuau

SEQ ID NO: 184637 - RNA, 19 nt, Homo sapiens
ccgaagcuauggccugaag

SEQ ID NO: 184638 - RNA, 19 nt, Homo sapiens
ggguggcuggagugaauua

SEQ ID NO: 184639 - RNA, 19 nt, Homo sapiens
cauuucacaugccuugcaa

SEQ ID NO: 184640 - RNA, 19 nt, Homo sapiens
cauacuaggugccuuuugu

SEQ ID NO: 184641 - RNA, 19 nt, Homo sapiens
gcagaccaacagaacuuca

SEQ ID NO: 184642 - RNA, 19 nt, Homo sapiens
guuugacuaugccgucuuc

SEQ ID NO: 184643 - RNA, 19 nt, Homo sapiens
ugacugcaccaacaucauc

SEQ ID NO: 184644 - RNA, 19 nt, Homo sapiens
gaagcuauggccugaagac

SEQ ID NO: 184645 - RNA, 19 nt, Homo sapiens
ggugggugguguccugaag

SEQ ID NO: 184646 - RNA, 19 nt, Homo sapiens
gcucuucaccaaguacuuc

SEQ ID NO: 184647 - RNA, 19 nt, Homo sapiens
ggacuuggaccggcugaac

SEQ ID NO: 184648 - RNA, 19 nt, Homo sapiens
uaucaucacuuaucuggua

SEQ ID NO: 184649 - RNA, 19 nt, Homo sapiens
cagacaagauggagacaaa

SEQ ID NO: 184650 - RNA, 19 nt, Homo sapiens
gcaacgggcuugugaucug

SEQ ID NO: 184651 - RNA, 19 nt, Homo sapiens
caaagaaauugguauugca

SEQ ID NO: 184652 - RNA, 19 nt, Homo sapiens
caaggcauguacaaagaaa

SEQ ID NO: 184653 - RNA, 19 nt, Homo sapiens
ucacuuaucugguauuugc

SEQ ID NO: 184654 - RNA, 19 nt, Homo sapiens
ugacacagcuaccaauucu

SEQ ID NO: 184655 - RNA, 19 nt, Homo sapiens
cagaauccgugaguuauug

SEQ ID NO: 184656 - RNA, 19 nt, Homo sapiens
ggaguuacaggcaaaguga

SEQ ID NO: 184657 - RNA, 19 nt, Homo sapiens
ccaccaagauccacaagca

SEQ ID NO: 184658 - RNA, 19 nt, Homo sapiens
caagugcccuggccuucuu

SEQ ID NO: 184659 - RNA, 19 nt, Homo sapiens
caucguugcugucaguuau

SEQ ID NO: 184660 - RNA, 19 nt, Homo sapiens
ccaguuaucauucguguga

SEQ ID NO: 184661 - RNA, 19 nt, Homo sapiens
gcucuggaccgcuguguuu

SEQ ID NO: 184662 - RNA, 19 nt, Homo sapiens
ggccguggcugacuucugu

SEQ ID NO: 184663 - RNA, 19 nt, Homo sapiens
gacaagauggagacaaauu

SEQ ID NO: 184664 - RNA, 19 nt, Homo sapiens
ggaccaacgacccuaaaga

SEQ ID NO: 184665 - RNA, 19 nt, Homo sapiens
caucacuuaucugguauuu

SEQ ID NO: 184666 - RNA, 19 nt, Homo sapiens
gcaaggcauguacaaagaa

SEQ ID NO: 184667 - RNA, 19 nt, Homo sapiens
ggacaguagccugcacuuu

SEQ ID NO: 184668 - RNA, 19 nt, Homo sapiens
gguauuugcagucaccuuu

SEQ ID NO: 184669 - RNA, 19 nt, Homo sapiens
uccuggauaucaucacuua

SEQ ID NO: 184670 - RNA, 19 nt, Homo sapiens
gagaauaaacagauaugag

SEQ ID NO: 184671 - RNA, 19 nt, Homo sapiens
cugcagagguggaguuaca

SEQ ID NO: 184672 - RNA, 19 nt, Homo sapiens
agucagaauccgugaguua

SEQ ID NO: 184673 - RNA, 19 nt, Homo sapiens
acaguagccugcacuuuua

SEQ ID NO: 184674 - RNA, 19 nt, Homo sapiens
gcugguuccugugcaaauu

SEQ ID NO: 184675 - RNA, 19 nt, Homo sapiens
cuccucacauugccaguua

SEQ ID NO: 184676 - RNA, 19 nt, Homo sapiens
gccaagaaggugaucauug

SEQ ID NO: 184677 - RNA, 19 nt, Homo sapiens
ggagaauaaacagauauga

SEQ ID NO: 184678 - RNA, 19 nt, Homo sapiens
gcccuggccuucuucaaca

SEQ ID NO: 184679 - RNA, 19 nt, Homo sapiens
acaaagaaauugguauugc

SEQ ID NO: 184680 - RNA, 19 nt, Homo sapiens
ugcaaggcauguacaaaga

SEQ ID NO: 184681 - RNA, 19 nt, Homo sapiens
gcugucaguuaugggcuua

SEQ ID NO: 184682 - RNA, 19 nt, Homo sapiens
aggcauuuccugcuuauuu

SEQ ID NO: 184683 - RNA, 19 nt, Homo sapiens
gacaguagccugcacuuuu

SEQ ID NO: 184684 - RNA, 19 nt, Homo sapiens
ggauuacccacucaucaga

SEQ ID NO: 184685 - RNA, 19 nt, Homo sapiens
cagcuaccaauucuacuuu

SEQ ID NO: 184686 - RNA, 19 nt, Homo sapiens
ggagggacaccugcuguau

SEQ ID NO: 184687 - RNA, 19 nt, Homo sapiens
caucauccgguucaucauu

SEQ ID NO: 184688 - RNA, 19 nt, Homo sapiens
gaccaacgacccuaaagag

SEQ ID NO: 184689 - RNA, 19 nt, Homo sapiens
uaguggacaucaacuuguu

SEQ ID NO: 184690 - RNA, 19 nt, Homo sapiens
cauaguggacaucaacuug

SEQ ID NO: 184691 - RNA, 19 nt, Homo sapiens
gggaggacauuggccuuuc

SEQ ID NO: 184692 - RNA, 19 nt, Homo sapiens
guggcuggauuccggauga

SEQ ID NO: 184693 - RNA, 19 nt, Homo sapiens
guggcugacuucuguuuca

SEQ ID NO: 184694 - RNA, 19 nt, Homo sapiens
ucagaauccgugaguuauu

SEQ ID NO: 184695 - RNA, 19 nt, Homo sapiens
uggcucugcuccucacauu

SEQ ID NO: 184696 - RNA, 19 nt, Homo sapiens
ggcaucauccgguucauca

SEQ ID NO: 184697 - RNA, 19 nt, Homo sapiens
cacauugccaguuaucauu

SEQ ID NO: 184698 - RNA, 19 nt, Homo sapiens
gggagaauaaacagauaug

SEQ ID NO: 184699 - RNA, 19 nt, Homo sapiens
ggcauuuccugcuuauuuu

SEQ ID NO: 184700 - RNA, 19 nt, Homo sapiens
ccuuauagccacagucaga

SEQ ID NO: 184701 - RNA, 19 nt, Homo sapiens
uaucugguauuugcaguca

SEQ ID NO: 184702 - RNA, 19 nt, Homo sapiens
gcuaccaauucuacuuuac

SEQ ID NO: 184703 - RNA, 19 nt, Homo sapiens
ccgugagccuggccaagaa

SEQ ID NO: 184704 - RNA, 19 nt, Homo sapiens
ggaggacauuggccuuucg

SEQ ID NO: 184705 - RNA, 19 nt, Homo sapiens
gaucuggguggcuggauuc

SEQ ID NO: 184706 - RNA, 19 nt, Homo sapiens
gaacuacccagagcaagac

SEQ ID NO: 184707 - RNA, 19 nt, Homo sapiens
agggacaccugcuguaucu

SEQ ID NO: 184708 - RNA, 19 nt, Homo sapiens
ucaggugguggcccuuaua

SEQ ID NO: 184709 - RNA, 19 nt, Homo sapiens
gggcaacgggcuugugauc

SEQ ID NO: 184710 - RNA, 19 nt, Homo sapiens
uuacggguccucuccuuug

SEQ ID NO: 184711 - RNA, 19 nt, Homo sapiens
ugaucuggguggcuggauu

SEQ ID NO: 184712 - RNA, 19 nt, Homo sapiens
guccaucguugcugucagu

SEQ ID NO: 184713 - RNA, 19 nt, Homo sapiens
gauuacccacucaucagaa

SEQ ID NO: 184714 - RNA, 19 nt, Homo sapiens
agaacuacccagagcaaga

SEQ ID NO: 184715 - RNA, 19 nt, Homo sapiens
gagggacaccugcuguauc

SEQ ID NO: 184716 - RNA, 19 nt, Homo sapiens
cagcuucgucucaccuuga

SEQ ID NO: 184717 - RNA, 19 nt, Homo sapiens
caauucuacuuuaccuucu

SEQ ID NO: 184718 - RNA, 19 nt, Homo sapiens
acacagcuaccaauucuac

SEQ ID NO: 184719 - RNA, 19 nt, Homo sapiens
aggcauguacaaagaaauu

SEQ ID NO: 184720 - RNA, 19 nt, Homo sapiens
gggcuuauugccaccaaga

SEQ ID NO: 184721 - RNA, 19 nt, Homo sapiens
accgaggacucaacccaaa

SEQ ID NO: 184722 - RNA, 19 nt, Homo sapiens
gcaguggaugugacaagug

SEQ ID NO: 184723 - RNA, 19 nt, Homo sapiens
ugucaguuaugggcuuauu

SEQ ID NO: 184724 - RNA, 19 nt, Homo sapiens
ucacauugccaguuaucau

SEQ ID NO: 184725 - RNA, 19 nt, Homo sapiens
acaagauggagacaaauuc

SEQ ID NO: 184726 - RNA, 19 nt, Homo sapiens
aggcugagcacaggcauuu

SEQ ID NO: 184727 - RNA, 19 nt, Homo sapiens
gcagacaagauggagacaa

SEQ ID NO: 184728 - RNA, 19 nt, Homo sapiens
uauuugcagucaccuuugu

SEQ ID NO: 184729 - RNA, 19 nt, Homo sapiens
cagucaccaccaucaguua

SEQ ID NO: 184730 - RNA, 19 nt, Homo sapiens
gcccuuauagccacaguca

SEQ ID NO: 184731 - RNA, 19 nt, Homo sapiens
gcucugcuccucacauugc

SEQ ID NO: 184732 - RNA, 19 nt, Homo sapiens
uaggauuacccacucauca

SEQ ID NO: 184733 - RNA, 19 nt, Homo sapiens
agcuaccaauucuacuuua

SEQ ID NO: 184734 - RNA, 19 nt, Homo sapiens
caaaccagugacacagcua

SEQ ID NO: 184735 - RNA, 19 nt, Homo sapiens
gcauguacaaagaaauugg

SEQ ID NO: 184736 - RNA, 19 nt, Homo sapiens
uaucaggugguggcccuua

SEQ ID NO: 184737 - RNA, 19 nt, Homo sapiens
ccaucguugcugucaguua

SEQ ID NO: 184738 - RNA, 19 nt, Homo sapiens
ugcuguaucugcuggcuau

SEQ ID NO: 184739 - RNA, 19 nt, Homo sapiens
uccaggagcagacaagaug

SEQ ID NO: 184740 - RNA, 19 nt, Homo sapiens
ccagugacacagcuaccaa

SEQ ID NO: 184741 - RNA, 19 nt, Homo sapiens
gguauugcaguggauguga

SEQ ID NO: 184742 - RNA, 19 nt, Homo sapiens
cuagaacuacccagagcaa

SEQ ID NO: 184743 - RNA, 19 nt, Homo sapiens
ccacuuugccauucuucau

SEQ ID NO: 184744 - RNA, 19 nt, Homo sapiens
ucaccuccacuuugccauu

SEQ ID NO: 184745 - RNA, 19 nt, Homo sapiens
caccuccacuuugccauuc

SEQ ID NO: 184746 - RNA, 19 nt, Homo sapiens
ucaaagagauguuguucua

SEQ ID NO: 184747 - RNA, 19 nt, Homo sapiens
ggccaaggcugauaguuua

SEQ ID NO: 184748 - RNA, 19 nt, Homo sapiens
gagagaaagugaaaugaaa

SEQ ID NO: 184749 - RNA, 19 nt, Homo sapiens
ucacgaagauauugagaua

SEQ ID NO: 184750 - RNA, 19 nt, Homo sapiens
gaaaaggaauugagaagua

SEQ ID NO: 184751 - RNA, 19 nt, Homo sapiens
gaaugaauaugaagaagug

SEQ ID NO: 184752 - RNA, 19 nt, Homo sapiens
ggaacaaccuauuugcaaa

SEQ ID NO: 184753 - RNA, 19 nt, Homo sapiens
ggacacagguuguagagau

SEQ ID NO: 184754 - RNA, 19 nt, Homo sapiens
ggaaauacaagaagagaaa

SEQ ID NO: 184755 - RNA, 19 nt, Homo sapiens
caucuacccuugagucaua

SEQ ID NO: 184756 - RNA, 19 nt, Homo sapiens
ccacuccucugaaugaaua

SEQ ID NO: 184757 - RNA, 19 nt, Homo sapiens
gaaaagcgguggccaauug

SEQ ID NO: 184758 - RNA, 19 nt, Homo sapiens
gcgggacacuccuaaauuu

SEQ ID NO: 184759 - RNA, 19 nt, Homo sapiens
gcaaugggcuugugaucug

SEQ ID NO: 184760 - RNA, 19 nt, Homo sapiens
gaugagauagcgcauaaua

SEQ ID NO: 184761 - RNA, 19 nt, Homo sapiens
gaagaaguguccuaugagu

SEQ ID NO: 184762 - RNA, 19 nt, Homo sapiens
gaaaguguguuguguguac

SEQ ID NO: 184763 - RNA, 19 nt, Homo sapiens
gcacuggaccgcugcauuu

SEQ ID NO: 184764 - RNA, 19 nt, Homo sapiens
gaaccaauauggauuugca

SEQ ID NO: 184765 - RNA, 19 nt, Homo sapiens
uagaugagauagcgcauaa

SEQ ID NO: 184766 - RNA, 19 nt, Homo sapiens
gauaaguucuaguuuggaa

SEQ ID NO: 184767 - RNA, 19 nt, Homo sapiens
augcacagcucaaguauuu

SEQ ID NO: 184768 - RNA, 19 nt, Homo sapiens
gcuaagaaauagacaguca

SEQ ID NO: 184769 - RNA, 19 nt, Homo sapiens
guccuuaccuugccaguuu

SEQ ID NO: 184770 - RNA, 19 nt, Homo sapiens
guacauuuaucaucucaug

SEQ ID NO: 184771 - RNA, 19 nt, Homo sapiens
gcugauaguuuagaugaaa

SEQ ID NO: 184772 - RNA, 19 nt, Homo sapiens
uaaguggaguugggaaaua

SEQ ID NO: 184773 - RNA, 19 nt, Homo sapiens
aaagagauguuguucuaug

SEQ ID NO: 184774 - RNA, 19 nt, Homo sapiens
gaaaagagagcaugauauu

SEQ ID NO: 184775 - RNA, 19 nt, Homo sapiens
gaauaaaccacacuuaguc

SEQ ID NO: 184776 - RNA, 19 nt, Homo sapiens
gacacagguuguagagaua

SEQ ID NO: 184777 - RNA, 19 nt, Homo sapiens
gcacagcucaaguauuuau

SEQ ID NO: 184778 - RNA, 19 nt, Homo sapiens
gauaagaaccaauauggau

SEQ ID NO: 184779 - RNA, 19 nt, Homo sapiens
gaaguaauuccucugauuc

SEQ ID NO: 184780 - RNA, 19 nt, Homo sapiens
agaaguaauuccucugauu

SEQ ID NO: 184781 - RNA, 19 nt, Homo sapiens
ggaauaaaccacacuuagu

SEQ ID NO: 184782 - RNA, 19 nt, Homo sapiens
gaaggaagcgauccaaugg

SEQ ID NO: 184783 - RNA, 19 nt, Homo sapiens
ggccaagacuuccgagaga

SEQ ID NO: 184784 - RNA, 19 nt, Homo sapiens
cuacuauccuugcuaaguu

SEQ ID NO: 184785 - RNA, 19 nt, Homo sapiens
ggacacauacuguacuuuc

SEQ ID NO: 184786 - RNA, 19 nt, Homo sapiens
ggacuuggaugggauugug

SEQ ID NO: 184787 - RNA, 19 nt, Homo sapiens
gagauaagaaccaauaugg

SEQ ID NO: 184788 - RNA, 19 nt, Homo sapiens
uguguuguguguacauuua

SEQ ID NO: 184789 - RNA, 19 nt, Homo sapiens
ucauugacauccugguuaa

SEQ ID NO: 184790 - RNA, 19 nt, Homo sapiens
ggacaucaaccucuuugga

SEQ ID NO: 184791 - RNA, 19 nt, Homo sapiens
ucacaggaguugguuagaa

SEQ ID NO: 184792 - RNA, 19 nt, Homo sapiens
augaagaaguguccuauga

SEQ ID NO: 184793 - RNA, 19 nt, Homo sapiens
aaacgugauuuaaggagaa

SEQ ID NO: 184794 - RNA, 19 nt, Homo sapiens
gcccugagacuggauaaua

SEQ ID NO: 184795 - RNA, 19 nt, Homo sapiens
caaagagaaacuuguaaug

SEQ ID NO: 184796 - RNA, 19 nt, Homo sapiens
ugacacggcugccaauucu

SEQ ID NO: 184797 - RNA, 19 nt, Homo sapiens
caaaguuggcgcaaacauu

SEQ ID NO: 184798 - RNA, 19 nt, Homo sapiens
gauccucuaucacgaagau

SEQ ID NO: 184799 - RNA, 19 nt, Homo sapiens
ggaagaagagauccaaugg

SEQ ID NO: 184800 - RNA, 19 nt, Homo sapiens
gugaaaguguguugugugu

SEQ ID NO: 184801 - RNA, 19 nt, Homo sapiens
ggcuuuagcuugccgaugu

SEQ ID NO: 184802 - RNA, 19 nt, Homo sapiens
ugagauagcgcauaauaag

SEQ ID NO: 184803 - RNA, 19 nt, Homo sapiens
ugagucauauugaggcauu

SEQ ID NO: 184804 - RNA, 19 nt, Homo sapiens
gacaucaaccucuuuggaa

SEQ ID NO: 184805 - RNA, 19 nt, Homo sapiens
gagaaagugaaaugaaaga

SEQ ID NO: 184806 - RNA, 19 nt, Homo sapiens
gagaaguaauuccucugau

SEQ ID NO: 184807 - RNA, 19 nt, Homo sapiens
aagagaaacuuguaauggu

SEQ ID NO: 184808 - RNA, 19 nt, Homo sapiens
uaaauccagccgucccuua

SEQ ID NO: 184809 - RNA, 19 nt, Homo sapiens
gaacaaccuauuugcaaag

SEQ ID NO: 184810 - RNA, 19 nt, Homo sapiens
gacaaucaacuguuugguu

SEQ ID NO: 184811 - RNA, 19 nt, Homo sapiens
cacaggaguugguuagaau

SEQ ID NO: 184812 - RNA, 19 nt, Homo sapiens
cuacauguauuaagauggu

SEQ ID NO: 184813 - RNA, 19 nt, Homo sapiens
gacacauacuguacuuuca

SEQ ID NO: 184814 - RNA, 19 nt, Homo sapiens
gagcuucaaaugcaaguga

SEQ ID NO: 184815 - RNA, 19 nt, Homo sapiens
guccugauguacuuuaaau

SEQ ID NO: 184816 - RNA, 19 nt, Homo sapiens
ggucauauuauucuucuuc

SEQ ID NO: 184817 - RNA, 19 nt, Homo sapiens
gaguggacuuugcauuuua

SEQ ID NO: 184818 - RNA, 19 nt, Homo sapiens
ggugagagaaagugaaaug

SEQ ID NO: 184819 - RNA, 19 nt, Homo sapiens
cagcucaaguauuuauuca

SEQ ID NO: 184820 - RNA, 19 nt, Homo sapiens
ugugguggcuucuuucuuc

SEQ ID NO: 184821 - RNA, 19 nt, Homo sapiens
gaauuaauaggacuuggau

SEQ ID NO: 184822 - RNA, 19 nt, Homo sapiens
gggaagaagagauccaaug

SEQ ID NO: 184823 - RNA, 19 nt, Homo sapiens
ggggagagguuauaucaga

SEQ ID NO: 184824 - RNA, 19 nt, Homo sapiens
uaauuccucugauucuguu

SEQ ID NO: 184825 - RNA, 19 nt, Homo sapiens
aagauaaguucuaguuugg

SEQ ID NO: 184826 - RNA, 19 nt, Homo sapiens
cacguuagguuugaaaugu

SEQ ID NO: 184827 - RNA, 19 nt, Homo sapiens
gaugagacaaucaacuguu

SEQ ID NO: 184828 - RNA, 19 nt, Homo sapiens
guugggaaauacaagaaga

SEQ ID NO: 184829 - RNA, 19 nt, Homo sapiens
ugagagaaagugaaaugaa

SEQ ID NO: 184830 - RNA, 19 nt, Homo sapiens
cacauuaccauuccucauu

SEQ ID NO: 184831 - RNA, 19 nt, Homo sapiens
acgaagauauugagauaag

SEQ ID NO: 184832 - RNA, 19 nt, Homo sapiens
gcuaagaguuuucuguuuc

SEQ ID NO: 184833 - RNA, 19 nt, Homo sapiens
caaaugcaagugaaagugu

SEQ ID NO: 184834 - RNA, 19 nt, Homo sapiens
caguaacuauuccaaaugg

SEQ ID NO: 184835 - RNA, 19 nt, Homo sapiens
gaucgucggaccuuggauu

SEQ ID NO: 184836 - RNA, 19 nt, Homo sapiens
aaaguuggcgcaaacauuc

SEQ ID NO: 184837 - RNA, 19 nt, Homo sapiens
aaacuacucuugaauuccu

SEQ ID NO: 184838 - RNA, 19 nt, Homo sapiens
ggaguugggaaauacaaga

SEQ ID NO: 184839 - RNA, 19 nt, Homo sapiens
caucugcuaugggcucauu

SEQ ID NO: 184840 - RNA, 19 nt, Homo sapiens
cagaaccaccgcacuguga

SEQ ID NO: 184841 - RNA, 19 nt, Homo sapiens
acauuaccauuccucauug

SEQ ID NO: 184842 - RNA, 19 nt, Homo sapiens
caagauggaaaccaacuuc

SEQ ID NO: 184843 - RNA, 19 nt, Homo sapiens
uuucuacuauccuugcuaa

SEQ ID NO: 184844 - RNA, 19 nt, Homo sapiens
gaauguuaaacuacucuug

SEQ ID NO: 184845 - RNA, 19 nt, Homo sapiens
caucaugaguggacuuugc

SEQ ID NO: 184846 - RNA, 19 nt, Homo sapiens
ggucguaacuuccaagaaa

SEQ ID NO: 184847 - RNA, 19 nt, Homo sapiens
gaaaccaacuucuccauuc

SEQ ID NO: 184848 - RNA, 19 nt, Homo sapiens
gaacuaauuggcauucuaa

SEQ ID NO: 184849 - RNA, 19 nt, Homo sapiens
gaucaucgcugccaaaauu

SEQ ID NO: 184850 - RNA, 19 nt, Homo sapiens
gcaaugggcuugugaucug

SEQ ID NO: 184851 - RNA, 19 nt, Homo sapiens
guccuuaccuuaccaaauu

SEQ ID NO: 184852 - RNA, 19 nt, Homo sapiens
ccaauucucuacgucuuua

SEQ ID NO: 184853 - RNA, 19 nt, Homo sapiens
gcucuggaccgcuguauuu

SEQ ID NO: 184854 - RNA, 19 nt, Homo sapiens
ucacagaaaccacaugauu

SEQ ID NO: 184855 - RNA, 19 nt, Homo sapiens
gcucaaagagauguuguua

SEQ ID NO: 184856 - RNA, 19 nt, Homo sapiens
acagaaaccacaugauuaa

SEQ ID NO: 184857 - RNA, 19 nt, Homo sapiens
cacagaaaccacaugauua

SEQ ID NO: 184858 - RNA, 19 nt, Homo sapiens
ggaguuacaagcaauguga

SEQ ID NO: 184859 - RNA, 19 nt, Homo sapiens
caccauaguccuuaccuua

SEQ ID NO: 184860 - RNA, 19 nt, Homo sapiens
gcucuuugcccacuaguuu

SEQ ID NO: 184861 - RNA, 19 nt, Homo sapiens
ggaaaccaacuucuccauu

SEQ ID NO: 184862 - RNA, 19 nt, Homo sapiens
ugaacuaauuggcauucua

SEQ ID NO: 184863 - RNA, 19 nt, Homo sapiens
guuguuaaauggcaaauac

SEQ ID NO: 184864 - RNA, 19 nt, Homo sapiens
uaaauccagccgucccuua

SEQ ID NO: 184865 - RNA, 19 nt, Homo sapiens
gagacggaguuacaagcaa

SEQ ID NO: 184866 - RNA, 19 nt, Homo sapiens
ggcccuagcugacuucucu

SEQ ID NO: 184867 - RNA, 19 nt, Homo sapiens
ugugguggcuucuuucuuc

SEQ ID NO: 184868 - RNA, 19 nt, Homo sapiens
gauccuccacuucauuauu

SEQ ID NO: 184869 - RNA, 19 nt, Homo sapiens
ggacuacaauaaguacuac

SEQ ID NO: 184870 - RNA, 19 nt, Homo sapiens
gauagacaucaaccuguuu

SEQ ID NO: 184871 - RNA, 19 nt, Homo sapiens
gugccuauguccaucauca

SEQ ID NO: 184872 - RNA, 19 nt, Homo sapiens
ucagugccauccuaccauu

SEQ ID NO: 184873 - RNA, 19 nt, Homo sapiens
ucuguugguucccuuauga

SEQ ID NO: 184874 - RNA, 19 nt, Homo sapiens
aauuucaucuucuggacua

SEQ ID NO: 184875 - RNA, 19 nt, Homo sapiens
cuagcugacuucucuuuca

SEQ ID NO: 184876 - RNA, 19 nt, Homo sapiens
caauaaguacuacgaaugg

SEQ ID NO: 184877 - RNA, 19 nt, Homo sapiens
caucaucacagucugcuau

SEQ ID NO: 184878 - RNA, 19 nt, Homo sapiens
agacggaguuacaagcaau

SEQ ID NO: 184879 - RNA, 19 nt, Homo sapiens
uagagagguugaacguguu

SEQ ID NO: 184880 - RNA, 19 nt, Homo sapiens
guggcuggauuccggauga

SEQ ID NO: 184881 - RNA, 19 nt, Homo sapiens
cugcugugguggcuucuuu

SEQ ID NO: 184882 - RNA, 19 nt, Homo sapiens
acaauaaguacuacgaaug

SEQ ID NO: 184883 - RNA, 19 nt, Homo sapiens
acacugcuguagagagguu

SEQ ID NO: 184884 - RNA, 19 nt, Homo sapiens
uaccaaauuucaucuucug

SEQ ID NO: 184885 - RNA, 19 nt, Homo sapiens
ccaugagucuggccaagag

SEQ ID NO: 184886 - RNA, 19 nt, Homo sapiens
cgucauuccuauguaaguu

SEQ ID NO: 184887 - RNA, 19 nt, Homo sapiens
ggagacggaguuacaagca

SEQ ID NO: 184888 - RNA, 19 nt, Homo sapiens
caucuucuggacuacaaua

SEQ ID NO: 184889 - RNA, 19 nt, Homo sapiens
cuauguaaguuaguucaug

SEQ ID NO: 184890 - RNA, 19 nt, Homo sapiens
ucauucuuguccugauuaa

SEQ ID NO: 184891 - RNA, 19 nt, Homo sapiens
uugcgucauuccuauguaa

SEQ ID NO: 184892 - RNA, 19 nt, Homo sapiens
gggugacacugcuguagag

SEQ ID NO: 184893 - RNA, 19 nt, Homo sapiens
cuucuggacuacaauaagu

SEQ ID NO: 184894 - RNA, 19 nt, Homo sapiens
cuuuaugggucguaacuuc

SEQ ID NO: 184895 - RNA, 19 nt, Homo sapiens
gcagucuggcucaaagaga

SEQ ID NO: 184896 - RNA, 19 nt, Homo sapiens
gaugacgggacucuggauu

SEQ ID NO: 184897 - RNA, 19 nt, Homo sapiens
cagucuggcucaaagagau

SEQ ID NO: 184898 - RNA, 19 nt, Homo sapiens
ugacgggacucuggauuuu

SEQ ID NO: 184899 - RNA, 19 nt, Homo sapiens
gaucuggguggcuggauuc

SEQ ID NO: 184900 - RNA, 19 nt, Homo sapiens
gucauuccuauguaaguua

SEQ ID NO: 184901 - RNA, 19 nt, Homo sapiens
aagagauguuguuaaaugg

SEQ ID NO: 184902 - RNA, 19 nt, Homo sapiens
gguggcuucuuucuucauc

SEQ ID NO: 184903 - RNA, 19 nt, Homo sapiens
cggagucaccuuugucuuc

SEQ ID NO: 184904 - RNA, 19 nt, Homo sapiens
uaccauggccaaggucuuu

SEQ ID NO: 184905 - RNA, 19 nt, Homo sapiens
ugaucuggguggcuggauu

SEQ ID NO: 184906 - RNA, 19 nt, Homo sapiens
cuggaccgcuguauuugug

SEQ ID NO: 184907 - RNA, 19 nt, Homo sapiens
caccaucuguuaccugaac

SEQ ID NO: 184908 - RNA, 19 nt, Homo sapiens
cagaaaccacaugauuaaa

SEQ ID NO: 184909 - RNA, 19 nt, Homo sapiens
gaucuucucauugcuaguc

SEQ ID NO: 184910 - RNA, 19 nt, Homo sapiens
cugauccuccacuucauua

SEQ ID NO: 184911 - RNA, 19 nt, Homo sapiens
cuuaccaaauuucaucuuc

SEQ ID NO: 184912 - RNA, 19 nt, Homo sapiens
auccuccacuucauuauug

SEQ ID NO: 184913 - RNA, 19 nt, Homo sapiens
cuacaauaaguacuacgaa

SEQ ID NO: 184914 - RNA, 19 nt, Homo sapiens
acagcugccucaacccaau

SEQ ID NO: 184915 - RNA, 19 nt, Homo sapiens
gcuucuuucuucaucuguu

SEQ ID NO: 184916 - RNA, 19 nt, Homo sapiens
uggccaaggucuuucugau

SEQ ID NO: 184917 - RNA, 19 nt, Homo sapiens
ucaccauaguccuuaccuu

SEQ ID NO: 184918 - RNA, 19 nt, Homo sapiens
gcacagucaacaccaucug

SEQ ID NO: 184919 - RNA, 19 nt, Homo sapiens
ggccaaggucuuucugauc

SEQ ID NO: 184920 - RNA, 19 nt, Homo sapiens
uggacuacaauaaguacua

SEQ ID NO: 184921 - RNA, 19 nt, Homo sapiens
gaggagacggaguuacaag

SEQ ID NO: 184922 - RNA, 19 nt, Homo sapiens
ucagucgccaugagagaaa

SEQ ID NO: 184923 - RNA, 19 nt, Homo sapiens
ucauuaccauggccaaggu

SEQ ID NO: 184924 - RNA, 19 nt, Homo sapiens
cagaaccaucgcaccauga

SEQ ID NO: 184925 - RNA, 19 nt, Homo sapiens
guggaucuucucauugcua

SEQ ID NO: 184926 - RNA, 19 nt, Homo sapiens
uggagagggcccugacuga

SEQ ID NO: 184927 - RNA, 19 nt, Homo sapiens
cuauguccaucaucacagu

SEQ ID NO: 184928 - RNA, 19 nt, Homo sapiens
ucauuccuauguaaguuag

SEQ ID NO: 184929 - RNA, 19 nt, Homo sapiens
gaaccuaugugaucaacaa

SEQ ID NO: 184930 - RNA, 19 nt, Homo sapiens
gaggaaaucuggaacuuug

SEQ ID NO: 184931 - RNA, 19 nt, Homo sapiens
ggacuaugaugucuccuuu

SEQ ID NO: 184932 - RNA, 19 nt, Homo sapiens
caaagcaggcucuccauuu

SEQ ID NO: 184933 - RNA, 19 nt, Homo sapiens
caaacuggguggagaucua

SEQ ID NO: 184934 - RNA, 19 nt, Homo sapiens
aggaaacgcuggacucuuu

SEQ ID NO: 184935 - RNA, 19 nt, Homo sapiens
gacagcagcucccaaguuc

SEQ ID NO: 184936 - RNA, 19 nt, Homo sapiens
gaugagaccaccuaugaaa

SEQ ID NO: 184937 - RNA, 19 nt, Homo sapiens
gaguacagauuuacacuag

SEQ ID NO: 184938 - RNA, 19 nt, Homo sapiens
cagagugucuauuugauga

SEQ ID NO: 184939 - RNA, 19 nt, Homo sapiens
aagcaaaucuggcuaucuu

SEQ ID NO: 184940 - RNA, 19 nt, Homo sapiens
ggaguggugucuuaacugu

SEQ ID NO: 184941 - RNA, 19 nt, Homo sapiens
gaccaccuaugaaagacua

SEQ ID NO: 184942 - RNA, 19 nt, Homo sapiens
uagaugagaccaccuauga

SEQ ID NO: 184943 - RNA, 19 nt, Homo sapiens
gaaccaacguggccucaac

SEQ ID NO: 184944 - RNA, 19 nt, Homo sapiens
ccaguggaccuaagcguua

SEQ ID NO: 184945 - RNA, 19 nt, Homo sapiens
gugcuaagcugggaaguuc

SEQ ID NO: 184946 - RNA, 19 nt, Homo sapiens
ccgcagagcucacuaaagc

SEQ ID NO: 184947 - RNA, 19 nt, Homo sapiens
ccaagcagccucaauuugu

SEQ ID NO: 184948 - RNA, 19 nt, Homo sapiens
aaaccaaacuggacuuguc

SEQ ID NO: 184949 - RNA, 19 nt, Homo sapiens
ugucuuaacugucaaacug

SEQ ID NO: 184950 - RNA, 19 nt, Homo sapiens
ccaaguuccuccuguuuag

SEQ ID NO: 184951 - RNA, 19 nt, Homo sapiens
ggaaacgcuggacucuuua

SEQ ID NO: 184952 - RNA, 19 nt, Homo sapiens
caagcagccucaauuugug

SEQ ID NO: 184953 - RNA, 19 nt, Homo sapiens
gacaagccauacacguuug

SEQ ID NO: 184954 - RNA, 19 nt, Homo sapiens
aaacuggacuugucuuggu

SEQ ID NO: 184955 - RNA, 19 nt, Homo sapiens
agagcucacuaaagccuua

SEQ ID NO: 184956 - RNA, 19 nt, Homo sapiens
gaagugggcagaguacaga

SEQ ID NO: 184957 - RNA, 19 nt, Homo sapiens
uugaagaccuugcagacaa

SEQ ID NO: 184958 - RNA, 19 nt, Homo sapiens
aaagcagagugucuauuug

SEQ ID NO: 184959 - RNA, 19 nt, Homo sapiens
agacaagccauacacguuu

SEQ ID NO: 184960 - RNA, 19 nt, Homo sapiens
cauacacguuugaggacua

SEQ ID NO: 184961 - RNA, 19 nt, Homo sapiens
gcagagugucuauuugaug

SEQ ID NO: 184962 - RNA, 19 nt, Homo sapiens
ucaaccagauuuggaaugu

SEQ ID NO: 184963 - RNA, 19 nt, Homo sapiens
ucaacaagcagacgccaaa

SEQ ID NO: 184964 - RNA, 19 nt, Homo sapiens
gaaagacuagcagaggaaa

SEQ ID NO: 184965 - RNA, 19 nt, Homo sapiens
uuuccucccucacaugaua

SEQ ID NO: 184966 - RNA, 19 nt, Homo sapiens
ugagaccaccuaugaaaga

SEQ ID NO: 184967 - RNA, 19 nt, Homo sapiens
cacccaggcucucuagaug

SEQ ID NO: 184968 - RNA, 19 nt, Homo sapiens
ggccaagcagccucaauuu

SEQ ID NO: 184969 - RNA, 19 nt, Homo sapiens
ccacaauccuaugaaguag

SEQ ID NO: 184970 - RNA, 19 nt, Homo sapiens
gaggacacuugggcuaugu

SEQ ID NO: 184971 - RNA, 19 nt, Homo sapiens
uacagggcauaacucauuu

SEQ ID NO: 184972 - RNA, 19 nt, Homo sapiens
aaagcaggcucuccauuuu

SEQ ID NO: 184973 - RNA, 19 nt, Homo sapiens
ugucuugguuggccuauuc

SEQ ID NO: 184974 - RNA, 19 nt, Homo sapiens
cagacaagccauacacguu

SEQ ID NO: 184975 - RNA, 19 nt, Homo sapiens
aagcagagugucuauuuga

SEQ ID NO: 184976 - RNA, 19 nt, Homo sapiens
aaccagauuuggaauguca

SEQ ID NO: 184977 - RNA, 19 nt, Homo sapiens
gcaaaucuggcuaucuucu

SEQ ID NO: 184978 - RNA, 19 nt, Homo sapiens
guuaaaugcacgaauagug

SEQ ID NO: 184979 - RNA, 19 nt, Homo sapiens
gccaagcagccucaauuug

SEQ ID NO: 184980 - RNA, 19 nt, Homo sapiens
agacagcagcucccaaguu

SEQ ID NO: 184981 - RNA, 19 nt, Homo sapiens
ugaaagacuagcagaggaa

SEQ ID NO: 184982 - RNA, 19 nt, Homo sapiens
gagugucuauuugaugaau

SEQ ID NO: 184983 - RNA, 19 nt, Homo sapiens
gauuuccucccucacauga

SEQ ID NO: 184984 - RNA, 19 nt, Homo sapiens
gcuaggaagugggcagagu

SEQ ID NO: 184985 - RNA, 19 nt, Homo sapiens
ggaccuaagcguuaugacu

SEQ ID NO: 184986 - RNA, 19 nt, Homo sapiens
acaagcagacgccaaacaa

SEQ ID NO: 184987 - RNA, 19 nt, Homo sapiens
cuuugggaguggugucuua

SEQ ID NO: 184988 - RNA, 19 nt, Homo sapiens
cccaaguuccuccuguuua

SEQ ID NO: 184989 - RNA, 19 nt, Homo sapiens
caagaccccagcuucauua

SEQ ID NO: 184990 - RNA, 19 nt, Homo sapiens
aaaagcagagugucuauuu

SEQ ID NO: 184991 - RNA, 19 nt, Homo sapiens
cggccaagcagccucaauu

SEQ ID NO: 184992 - RNA, 19 nt, Homo sapiens
ccaaacuggacuugucuug

SEQ ID NO: 184993 - RNA, 19 nt, Homo sapiens
ccuaugugaucaacaagca

SEQ ID NO: 184994 - RNA, 19 nt, Homo sapiens
aguggugucuuaacuguca

SEQ ID NO: 184995 - RNA, 19 nt, Homo sapiens
accacaauccuaugaagua

SEQ ID NO: 184996 - RNA, 19 nt, Homo sapiens
ugggcagaguacagauuua

SEQ ID NO: 184997 - RNA, 19 nt, Homo sapiens
gugggcagaguacagauuu

SEQ ID NO: 184998 - RNA, 19 nt, Homo sapiens
ugaggacacuugggcuaug

SEQ ID NO: 184999 - RNA, 19 nt, Homo sapiens
cuaggaagugggcagagua

SEQ ID NO: 185000 - RNA, 19 nt, Homo sapiens
uuccuccuguuuagaauuu

SEQ ID NO: 185001 - RNA, 19 nt, Homo sapiens
acuaugaugucuccuuugg

SEQ ID NO: 185002 - RNA, 19 nt, Homo sapiens
gaaacgcuggacucuuuag

SEQ ID NO: 185003 - RNA, 19 nt, Homo sapiens
ugaggaaaucuggaacuuu

SEQ ID NO: 185004 - RNA, 19 nt, Homo sapiens
ggaagugggcagaguacag

SEQ ID NO: 185005 - RNA, 19 nt, Homo sapiens
uuaugccuauaccugaaua

SEQ ID NO: 185006 - RNA, 19 nt, Homo sapiens
ccacccaggcucucuagau

SEQ ID NO: 185007 - RNA, 19 nt, Homo sapiens
gcuaagcugggaaguucuu

SEQ ID NO: 185008 - RNA, 19 nt, Homo sapiens
gcagacgccaaacaagcaa

SEQ ID NO: 185009 - RNA, 19 nt, Homo sapiens
acaaagcaggcucuccauu

SEQ ID NO: 185010 - RNA, 19 nt, Homo sapiens
uuaccacaauccuaugaag

SEQ ID NO: 185011 - RNA, 19 nt, Homo sapiens
uuaugcagcugaggugugu

SEQ ID NO: 185012 - RNA, 19 nt, Homo sapiens
ucuuaugccuauaccugaa

SEQ ID NO: 185013 - RNA, 19 nt, Homo sapiens
ggauuuccucccucacaug

SEQ ID NO: 185014 - RNA, 19 nt, Homo sapiens
caguggaccuaagcguuau

SEQ ID NO: 185015 - RNA, 19 nt, Homo sapiens
ggucacacagcuaggaagu

SEQ ID NO: 185016 - RNA, 19 nt, Homo sapiens
gaggaaacgcuggacucuu

SEQ ID NO: 185017 - RNA, 19 nt, Homo sapiens
gagaccaccuaugaaagac

SEQ ID NO: 185018 - RNA, 19 nt, Homo sapiens
gcagaguacagauuuacac

SEQ ID NO: 185019 - RNA, 19 nt, Homo sapiens
ggagcagcauguggacucu

SEQ ID NO: 185020 - RNA, 19 nt, Homo sapiens
uugaggaaaucuggaacuu

SEQ ID NO: 185021 - RNA, 19 nt, Homo sapiens
acacguuugaggacuauga

SEQ ID NO: 185022 - RNA, 19 nt, Homo sapiens
agaguacagauuuacacua

SEQ ID NO: 185023 - RNA, 19 nt, Homo sapiens
caaccagauuuggaauguc

SEQ ID NO: 185024 - RNA, 19 nt, Homo sapiens
gaaacagacucuucauauu

SEQ ID NO: 185025 - RNA, 19 nt, Homo sapiens
guaaagccauguuaaauga

SEQ ID NO: 185026 - RNA, 19 nt, Homo sapiens
gaaggucuguggaacaaua

SEQ ID NO: 185027 - RNA, 19 nt, Homo sapiens
gaaggaauuugauugcuuu

SEQ ID NO: 185028 - RNA, 19 nt, Homo sapiens
ggauaaaguuggccaugua

SEQ ID NO: 185029 - RNA, 19 nt, Homo sapiens
gaugaacacuggagaagaa

SEQ ID NO: 185030 - RNA, 19 nt, Homo sapiens
gaagacaucuaugaaucua

SEQ ID NO: 185031 - RNA, 19 nt, Homo sapiens
ggaacuacauucacagaga

SEQ ID NO: 185032 - RNA, 19 nt, Homo sapiens
uaaaguuggccauguauua

SEQ ID NO: 185033 - RNA, 19 nt, Homo sapiens
aaagacaccuuccuaguga

SEQ ID NO: 185034 - RNA, 19 nt, Homo sapiens
gaacaauaccacuccagua

SEQ ID NO: 185035 - RNA, 19 nt, Homo sapiens
gggaaaccaugcuuaaaga

SEQ ID NO: 185036 - RNA, 19 nt, Homo sapiens
ccauaaagucugagaaaua

SEQ ID NO: 185037 - RNA, 19 nt, Homo sapiens
ggccuagacuucugaguaa

SEQ ID NO: 185038 - RNA, 19 nt, Homo sapiens
agaaggaaaugauggaauu

SEQ ID NO: 185039 - RNA, 19 nt, Homo sapiens
aaauaaagcugccggugaa

SEQ ID NO: 185040 - RNA, 19 nt, Homo sapiens
caaaacggaugaguuauua

SEQ ID NO: 185041 - RNA, 19 nt, Homo sapiens
cagucaaggugauauauaa

SEQ ID NO: 185042 - RNA, 19 nt, Homo sapiens
gaacuacauucacagagau

SEQ ID NO: 185043 - RNA, 19 nt, Homo sapiens
caagaccgguuccuuucua

SEQ ID NO: 185044 - RNA, 19 nt, Homo sapiens
guuggaaacuugaagacua

SEQ ID NO: 185045 - RNA, 19 nt, Homo sapiens
gcagagccgugguucuuug

SEQ ID NO: 185046 - RNA, 19 nt, Homo sapiens
cauaaagucugagaaauag

SEQ ID NO: 185047 - RNA, 19 nt, Homo sapiens
agaauucucucuuucaguu

SEQ ID NO: 185048 - RNA, 19 nt, Homo sapiens
gcagagaaacaacuauuau

SEQ ID NO: 185049 - RNA, 19 nt, Homo sapiens
gaagccauucguaguaaua

SEQ ID NO: 185050 - RNA, 19 nt, Homo sapiens
gcaagaauaucuccaaaau

SEQ ID NO: 185051 - RNA, 19 nt, Homo sapiens
ugaugcagcuguugagaaa

SEQ ID NO: 185052 - RNA, 19 nt, Homo sapiens
gaccugugcuuugagauuu

SEQ ID NO: 185053 - RNA, 19 nt, Homo sapiens
gaacacuggagaagaauau

SEQ ID NO: 185054 - RNA, 19 nt, Homo sapiens
aaacaagaccgguuccuuu

SEQ ID NO: 185055 - RNA, 19 nt, Homo sapiens
caugagggcuggugguuug

SEQ ID NO: 185056 - RNA, 19 nt, Homo sapiens
gagaagcccugcuccucuu

SEQ ID NO: 185057 - RNA, 19 nt, Homo sapiens
cuagacuucugaguaauua

SEQ ID NO: 185058 - RNA, 19 nt, Homo sapiens
gaaggaagauaagguggau

SEQ ID NO: 185059 - RNA, 19 nt, Homo sapiens
ggacagucaaggugauaua

SEQ ID NO: 185060 - RNA, 19 nt, Homo sapiens
ucaaccaacugcacaauca

SEQ ID NO: 185061 - RNA, 19 nt, Homo sapiens
gauguauggucauuuggaa

SEQ ID NO: 185062 - RNA, 19 nt, Homo sapiens
gguaaagccauguuaaaug

SEQ ID NO: 185063 - RNA, 19 nt, Homo sapiens
aaacagacucuucauauuc

SEQ ID NO: 185064 - RNA, 19 nt, Homo sapiens
uaugacaggugcccaggua

SEQ ID NO: 185065 - RNA, 19 nt, Homo sapiens
gaaucuagacacgaaauaa

SEQ ID NO: 185066 - RNA, 19 nt, Homo sapiens
gaugaguuauuaucuaugg

SEQ ID NO: 185067 - RNA, 19 nt, Homo sapiens
ucaagagaaucaacagaug

SEQ ID NO: 185068 - RNA, 19 nt, Homo sapiens
ggaacgaccuacauuugag

SEQ ID NO: 185069 - RNA, 19 nt, Homo sapiens
gggaaggucuguggaacaa

SEQ ID NO: 185070 - RNA, 19 nt, Homo sapiens
aagaucagaugcagagaaa

SEQ ID NO: 185071 - RNA, 19 nt, Homo sapiens
gaagaucagaugcagagaa

SEQ ID NO: 185072 - RNA, 19 nt, Homo sapiens
aaaguugccuggugaagga

SEQ ID NO: 185073 - RNA, 19 nt, Homo sapiens
caagugauaggauaaaguu

SEQ ID NO: 185074 - RNA, 19 nt, Homo sapiens
cauuuggaauccuucuuua

SEQ ID NO: 185075 - RNA, 19 nt, Homo sapiens
uuacagaguugaugagaca

SEQ ID NO: 185076 - RNA, 19 nt, Homo sapiens
gcaacuacaaggcuauauu

SEQ ID NO: 185077 - RNA, 19 nt, Homo sapiens
ugugagaaaugucuaauag

SEQ ID NO: 185078 - RNA, 19 nt, Homo sapiens
caacugagagucauauaca

SEQ ID NO: 185079 - RNA, 19 nt, Homo sapiens
ugaaggaauuugauugcuu

SEQ ID NO: 185080 - RNA, 19 nt, Homo sapiens
gauguuggcucaaaacuau

SEQ ID NO: 185081 - RNA, 19 nt, Homo sapiens
ccuaagacauccaaagcuu

SEQ ID NO: 185082 - RNA, 19 nt, Homo sapiens
gcuauauuccuucuaacua

SEQ ID NO: 185083 - RNA, 19 nt, Homo sapiens
gaucagaugcagagaaaca

SEQ ID NO: 185084 - RNA, 19 nt, Homo sapiens
cggaugaguuauuaucuau

SEQ ID NO: 185085 - RNA, 19 nt, Homo sapiens
ccaucaggcuguuauuaug

SEQ ID NO: 185086 - RNA, 19 nt, Homo sapiens
caagagaaucaacagauga

SEQ ID NO: 185087 - RNA, 19 nt, Homo sapiens
acacugcguuggaaacuug

SEQ ID NO: 185088 - RNA, 19 nt, Homo sapiens
uaaggaacgaccuacauuu

SEQ ID NO: 185089 - RNA, 19 nt, Homo sapiens
uaagguagauaaugaagac

SEQ ID NO: 185090 - RNA, 19 nt, Homo sapiens
ccaucugacucaacaggua

SEQ ID NO: 185091 - RNA, 19 nt, Homo sapiens
ucuaauagcccauaaaguc

SEQ ID NO: 185092 - RNA, 19 nt, Homo sapiens
guaacuacaaugaugguaa

SEQ ID NO: 185093 - RNA, 19 nt, Homo sapiens
ggaauccuucuuuaugaaa

SEQ ID NO: 185094 - RNA, 19 nt, Homo sapiens
ggucccagcuccauuugau

SEQ ID NO: 185095 - RNA, 19 nt, Homo sapiens
gaaaccaugcuuaaagauc

SEQ ID NO: 185096 - RNA, 19 nt, Homo sapiens
caacuacaaggcuauauuc

SEQ ID NO: 185097 - RNA, 19 nt, Homo sapiens
gaaacgggacuuugcauac

SEQ ID NO: 185098 - RNA, 19 nt, Homo sapiens
ggaccugugcuuugagauu

SEQ ID NO: 185099 - RNA, 19 nt, Homo sapiens
ggaauuugauugcuuugcu

SEQ ID NO: 185100 - RNA, 19 nt, Homo sapiens
gcucaaaacuauagacuuc

SEQ ID NO: 185101 - RNA, 19 nt, Homo sapiens
auggaagucugcaagaaua

SEQ ID NO: 185102 - RNA, 19 nt, Homo sapiens
gauaaugaagaaccuaaga

SEQ ID NO: 185103 - RNA, 19 nt, Homo sapiens
ccauuugauuugucguaua

SEQ ID NO: 185104 - RNA, 19 nt, Homo sapiens
gagaggagaacaguagauu

SEQ ID NO: 185105 - RNA, 19 nt, Homo sapiens
guucucagauauuugucua

SEQ ID NO: 185106 - RNA, 19 nt, Homo sapiens
aaaugucgaucaagagaau

SEQ ID NO: 185107 - RNA, 19 nt, Homo sapiens
ggaaacuugaagacuauuu

SEQ ID NO: 185108 - RNA, 19 nt, Homo sapiens
cgguaagucucuccaggua

SEQ ID NO: 185109 - RNA, 19 nt, Homo sapiens
caauaccacuccaguagca

SEQ ID NO: 185110 - RNA, 19 nt, Homo sapiens
gagugguuauucauuauuc

SEQ ID NO: 185111 - RNA, 19 nt, Homo sapiens
gaaaugucgaucaagagaa

SEQ ID NO: 185112 - RNA, 19 nt, Homo sapiens
gaacgaccuacauuugaga

SEQ ID NO: 185113 - RNA, 19 nt, Homo sapiens
cuacguggcugaggacaga

SEQ ID NO: 185114 - RNA, 19 nt, Homo sapiens
gaaaugugagaaaugucua

SEQ ID NO: 185115 - RNA, 19 nt, Homo sapiens
ggaaaugugagaaaugucu

SEQ ID NO: 185116 - RNA, 19 nt, Homo sapiens
cuaugaaucuagacacgaa

SEQ ID NO: 185117 - RNA, 19 nt, Homo sapiens
aggcacagauaaugaagaa

SEQ ID NO: 185118 - RNA, 19 nt, Homo sapiens
cugcuggacugaucugaaa

SEQ ID NO: 185119 - RNA, 19 nt, Homo sapiens
gcccauaaagucugagaaa

SEQ ID NO: 185120 - RNA, 19 nt, Homo sapiens
caguuuauccugacauauu

SEQ ID NO: 185121 - RNA, 19 nt, Homo sapiens
gaaugcagagccuaaggaa

SEQ ID NO: 185122 - RNA, 19 nt, Homo sapiens
gaaccuaagacauccaaag

SEQ ID NO: 185123 - RNA, 19 nt, Homo sapiens
cugagagucauauacauua

SEQ ID NO: 185124 - RNA, 19 nt, Homo sapiens
uaagaaagcuauccagauu

SEQ ID NO: 185125 - RNA, 19 nt, Homo sapiens
gggaagaaguaccaaauuu

SEQ ID NO: 185126 - RNA, 19 nt, Homo sapiens
ggccauagcuagccucaua

SEQ ID NO: 185127 - RNA, 19 nt, Homo sapiens
gaaauggguugaugaacuu

SEQ ID NO: 185128 - RNA, 19 nt, Homo sapiens
gagaagaaauggaagaaau

SEQ ID NO: 185129 - RNA, 19 nt, Homo sapiens
gaggaaagguggcaucuug

SEQ ID NO: 185130 - RNA, 19 nt, Homo sapiens
ccaaggagcuccagcacua

SEQ ID NO: 185131 - RNA, 19 nt, Homo sapiens
ccaaagugcugcaguacua

SEQ ID NO: 185132 - RNA, 19 nt, Homo sapiens
caagagaacucaucauaag

SEQ ID NO: 185133 - RNA, 19 nt, Homo sapiens
gagcaugccgucaauaaua

SEQ ID NO: 185134 - RNA, 19 nt, Homo sapiens
caaaggacuucgcccauaa

SEQ ID NO: 185135 - RNA, 19 nt, Homo sapiens
gaagauccauaacuuuaga

SEQ ID NO: 185136 - RNA, 19 nt, Homo sapiens
ggucugaacugaaugaaga

SEQ ID NO: 185137 - RNA, 19 nt, Homo sapiens
ugacuuaacucacaagaga

SEQ ID NO: 185138 - RNA, 19 nt, Homo sapiens
ggaagauccugcacauuga

SEQ ID NO: 185139 - RNA, 19 nt, Homo sapiens
aaacuuggcugaauucaug

SEQ ID NO: 185140 - RNA, 19 nt, Homo sapiens
gaaccuggcucaaguaugc

SEQ ID NO: 185141 - RNA, 19 nt, Homo sapiens
gaaugaagaucaacaggau

SEQ ID NO: 185142 - RNA, 19 nt, Homo sapiens
gggaaggucugguacauau

SEQ ID NO: 185143 - RNA, 19 nt, Homo sapiens
guagggagguuuauucaga

SEQ ID NO: 185144 - RNA, 19 nt, Homo sapiens
gagagaaguuuccagagaa

SEQ ID NO: 185145 - RNA, 19 nt, Homo sapiens
gaagaggcaucucguuugu

SEQ ID NO: 185146 - RNA, 19 nt, Homo sapiens
caacugaaccaucacauuu

SEQ ID NO: 185147 - RNA, 19 nt, Homo sapiens
gcacaaaguauaaagugua

SEQ ID NO: 185148 - RNA, 19 nt, Homo sapiens
gauacacacuugcugauga

SEQ ID NO: 185149 - RNA, 19 nt, Homo sapiens
gcagaauugucaagggaua

SEQ ID NO: 185150 - RNA, 19 nt, Homo sapiens
gaaauagucacccucauga

SEQ ID NO: 185151 - RNA, 19 nt, Homo sapiens
cagaagauccauaacuuua

SEQ ID NO: 185152 - RNA, 19 nt, Homo sapiens
ggaaauggguugaugaacu

SEQ ID NO: 185153 - RNA, 19 nt, Homo sapiens
gugcugaaaugcaggaaua

SEQ ID NO: 185154 - RNA, 19 nt, Homo sapiens
caucagaccuuauauggau

SEQ ID NO: 185155 - RNA, 19 nt, Homo sapiens
gaacucaucauaaguacuu

SEQ ID NO: 185156 - RNA, 19 nt, Homo sapiens
gcagaaauguuugcaagau

SEQ ID NO: 185157 - RNA, 19 nt, Homo sapiens
ccacguaaaucaagccauu

SEQ ID NO: 185158 - RNA, 19 nt, Homo sapiens
gcaacaaccuccaggauac

SEQ ID NO: 185159 - RNA, 19 nt, Homo sapiens
ccaaaggacuucgcccaua

SEQ ID NO: 185160 - RNA, 19 nt, Homo sapiens
gccaauaaaugacaucaga

SEQ ID NO: 185161 - RNA, 19 nt, Homo sapiens
cagaaauguuugcaagaua

SEQ ID NO: 185162 - RNA, 19 nt, Homo sapiens
ccaggacagugaaacaaua

SEQ ID NO: 185163 - RNA, 19 nt, Homo sapiens
guuagaauaugccaugaaa

SEQ ID NO: 185164 - RNA, 19 nt, Homo sapiens
ccaaagcacuacacuacaa

SEQ ID NO: 185165 - RNA, 19 nt, Homo sapiens
gagaagggauuugaugaga

SEQ ID NO: 185166 - RNA, 19 nt, Homo sapiens
cagagaagauuccauuuag

SEQ ID NO: 185167 - RNA, 19 nt, Homo sapiens
ccagagaagauuccauuua

SEQ ID NO: 185168 - RNA, 19 nt, Homo sapiens
cgagagaaguuuccagaga

SEQ ID NO: 185169 - RNA, 19 nt, Homo sapiens
gggaagauccugcacauug

SEQ ID NO: 185170 - RNA, 19 nt, Homo sapiens
gaacgugaaaggcauguuu

SEQ ID NO: 185171 - RNA, 19 nt, Homo sapiens
ugaaagccauccagauuga

SEQ ID NO: 185172 - RNA, 19 nt, Homo sapiens
gcugugaggucugaguuua

SEQ ID NO: 185173 - RNA, 19 nt, Homo sapiens
gugcucaucugcagaauug

SEQ ID NO: 185174 - RNA, 19 nt, Homo sapiens
gaccuuauauggaugaaau

SEQ ID NO: 185175 - RNA, 19 nt, Homo sapiens
gaaacuugccucuggauga

SEQ ID NO: 185176 - RNA, 19 nt, Homo sapiens
gaacuugcaggccuuguuu

SEQ ID NO: 185177 - RNA, 19 nt, Homo sapiens
gcacacauuugaagaagca

SEQ ID NO: 185178 - RNA, 19 nt, Homo sapiens
caacuaaaugcacaaagua

SEQ ID NO: 185179 - RNA, 19 nt, Homo sapiens
gaccgaagaaccaauuaua

SEQ ID NO: 185180 - RNA, 19 nt, Homo sapiens
ccuuagagcugcaauaugu

SEQ ID NO: 185181 - RNA, 19 nt, Homo sapiens
gaacuucgaagcugugcua

SEQ ID NO: 185182 - RNA, 19 nt, Homo sapiens
gaaucucucaucagcauua

SEQ ID NO: 185183 - RNA, 19 nt, Homo sapiens
caagcgacaucccaugaaa

SEQ ID NO: 185184 - RNA, 19 nt, Homo sapiens
gaagauuccauuuagacua

SEQ ID NO: 185185 - RNA, 19 nt, Homo sapiens
ggccuauggucgagauuua

SEQ ID NO: 185186 - RNA, 19 nt, Homo sapiens
agacaucgcugaagucaca

SEQ ID NO: 185187 - RNA, 19 nt, Homo sapiens
ggucugaguuuaaggucua

SEQ ID NO: 185188 - RNA, 19 nt, Homo sapiens
gaacagaagauccauaacu

SEQ ID NO: 185189 - RNA, 19 nt, Homo sapiens
uagcugcuguugaagaaua

SEQ ID NO: 185190 - RNA, 19 nt, Homo sapiens
agaaagcuauccagauuau

SEQ ID NO: 185191 - RNA, 19 nt, Homo sapiens
gauggcaacuacagaauca

SEQ ID NO: 185192 - RNA, 19 nt, Homo sapiens
caacggacaugaguuuguu

SEQ ID NO: 185193 - RNA, 19 nt, Homo sapiens
gcgccaaccuggaugacua

SEQ ID NO: 185194 - RNA, 19 nt, Homo sapiens
cauugucucuaucaaguua

SEQ ID NO: 185195 - RNA, 19 nt, Homo sapiens
ggacagugaaacaauagua

SEQ ID NO: 185196 - RNA, 19 nt, Homo sapiens
aaacaggacccaugaagaa

SEQ ID NO: 185197 - RNA, 19 nt, Homo sapiens
gaaggucugguacauauug

SEQ ID NO: 185198 - RNA, 19 nt, Homo sapiens
ggaagaggcaucucguuug

SEQ ID NO: 185199 - RNA, 19 nt, Homo sapiens
ggugaaagccauccagauu

SEQ ID NO: 185200 - RNA, 19 nt, Homo sapiens
gggacagcauggaagaaua

SEQ ID NO: 185201 - RNA, 19 nt, Homo sapiens
gaaacaggacccaugaaga

SEQ ID NO: 185202 - RNA, 19 nt, Homo sapiens
gacagcagcagaaauguuu

SEQ ID NO: 185203 - RNA, 19 nt, Homo sapiens
gggaacagaagauccauaa

SEQ ID NO: 185204 - RNA, 19 nt, Homo sapiens
gcuggaagccuuugucuau

SEQ ID NO: 185205 - RNA, 19 nt, Homo sapiens
acaagaauguugaccaaug

SEQ ID NO: 185206 - RNA, 19 nt, Homo sapiens
gacaguggcuucuaagucu

SEQ ID NO: 185207 - RNA, 19 nt, Homo sapiens
gguuauaccucagcucauu

SEQ ID NO: 185208 - RNA, 19 nt, Homo sapiens
ccugcuggaugcugaauua

SEQ ID NO: 185209 - RNA, 19 nt, Homo sapiens
gcaggguucugggauguuu

SEQ ID NO: 185210 - RNA, 19 nt, Homo sapiens
cacaagagaacucaucaua

SEQ ID NO: 185211 - RNA, 19 nt, Homo sapiens
ggucgggacuucucucaug

SEQ ID NO: 185212 - RNA, 19 nt, Homo sapiens
gauacgcugucaucccuuu

SEQ ID NO: 185213 - RNA, 19 nt, Homo sapiens
gcacuacacuacaaagaac

SEQ ID NO: 185214 - RNA, 19 nt, Homo sapiens
uaaagaaggacauucaaga

SEQ ID NO: 185215 - RNA, 19 nt, Homo sapiens
uaacaggguucgagauaag

SEQ ID NO: 185216 - RNA, 19 nt, Homo sapiens
cagaggcccuaaauaagaa

SEQ ID NO: 185217 - RNA, 19 nt, Homo sapiens
ggaccucuauuaucaugug

SEQ ID NO: 185218 - RNA, 19 nt, Homo sapiens
caucgccgcugcagaagaa

SEQ ID NO: 185219 - RNA, 19 nt, Homo sapiens
gaauguugguguccuuugu

SEQ ID NO: 185220 - RNA, 19 nt, Homo sapiens
guaaaucaagccauucauu

SEQ ID NO: 185221 - RNA, 19 nt, Homo sapiens
ccugggaccucuauuauca

SEQ ID NO: 185222 - RNA, 19 nt, Homo sapiens
guucucaccuuaugguuug

SEQ ID NO: 185223 - RNA, 19 nt, Homo sapiens
ggacccugguuaaugauga

SEQ ID NO: 185224 - RNA, 19 nt, Homo sapiens
gaagaaacccagcuugaua

SEQ ID NO: 185225 - RNA, 19 nt, Homo sapiens
gaaccaagacgaagaguaa

SEQ ID NO: 185226 - RNA, 19 nt, Homo sapiens
gaagacaaaggaaauguaa

SEQ ID NO: 185227 - RNA, 19 nt, Homo sapiens
cgacagauacugcaaguga

SEQ ID NO: 185228 - RNA, 19 nt, Homo sapiens
gaaccagucuuucaaaaug

SEQ ID NO: 185229 - RNA, 19 nt, Homo sapiens
ggacaggagagccaaauug

SEQ ID NO: 185230 - RNA, 19 nt, Homo sapiens
gaagaagaaaugaucaaga

SEQ ID NO: 185231 - RNA, 19 nt, Homo sapiens
ccugggagcuccacacaaa

SEQ ID NO: 185232 - RNA, 19 nt, Homo sapiens
gcugucaaauuaucugauu

SEQ ID NO: 185233 - RNA, 19 nt, Homo sapiens
caggagagccaaauugaaa

SEQ ID NO: 185234 - RNA, 19 nt, Homo sapiens
gacaggagagccaaauuga

SEQ ID NO: 185235 - RNA, 19 nt, Homo sapiens
gaagaagacaaaggaaaug

SEQ ID NO: 185236 - RNA, 19 nt, Homo sapiens
aagaugacauuccagaaga

SEQ ID NO: 185237 - RNA, 19 nt, Homo sapiens
gauuagauccugugcugaa

SEQ ID NO: 185238 - RNA, 19 nt, Homo sapiens
gagcaaagauaagaaaaga

SEQ ID NO: 185239 - RNA, 19 nt, Homo sapiens
cuaccaagcucgugcucaa

SEQ ID NO: 185240 - RNA, 19 nt, Homo sapiens
agacgaagaguaagaagaa

SEQ ID NO: 185241 - RNA, 19 nt, Homo sapiens
gccgaguacuccuauguga

SEQ ID NO: 185242 - RNA, 19 nt, Homo sapiens
ugucagggaguguuuauuu

SEQ ID NO: 185243 - RNA, 19 nt, Homo sapiens
ggaaccauagccauugaaa

SEQ ID NO: 185244 - RNA, 19 nt, Homo sapiens
ggaaccaagacgaagagua

SEQ ID NO: 185245 - RNA, 19 nt, Homo sapiens
cagaagaagacaaaggaaa

SEQ ID NO: 185246 - RNA, 19 nt, Homo sapiens
gagaagaagaaaugaucaa

SEQ ID NO: 185247 - RNA, 19 nt, Homo sapiens
caggaaccauagccauuga

SEQ ID NO: 185248 - RNA, 19 nt, Homo sapiens
gaaauuucaggaaccauag

SEQ ID NO: 185249 - RNA, 19 nt, Homo sapiens
agaagaagaugaagaaacc

SEQ ID NO: 185250 - RNA, 19 nt, Homo sapiens
ugccuuaucuuucuguguu

SEQ ID NO: 185251 - RNA, 19 nt, Homo sapiens
caaauugaaagccgacaga

SEQ ID NO: 185252 - RNA, 19 nt, Homo sapiens
gagcuuccaagaccacaaa

SEQ ID NO: 185253 - RNA, 19 nt, Homo sapiens
uaaaacagcaggagaagaa

SEQ ID NO: 185254 - RNA, 19 nt, Homo sapiens
ggccucaaauagcugcuuu

SEQ ID NO: 185255 - RNA, 19 nt, Homo sapiens
acaaugggaaccagucuuu

SEQ ID NO: 185256 - RNA, 19 nt, Homo sapiens
gaaccauagccauugaaau

SEQ ID NO: 185257 - RNA, 19 nt, Homo sapiens
gagaagaagaugaagaaac

SEQ ID NO: 185258 - RNA, 19 nt, Homo sapiens
aagagaagaagaugaagaa

SEQ ID NO: 185259 - RNA, 19 nt, Homo sapiens
gacgaagaguaagaagaaa

SEQ ID NO: 185260 - RNA, 19 nt, Homo sapiens
ccaagaccacaaacuuaaa

SEQ ID NO: 185261 - RNA, 19 nt, Homo sapiens
ggagaagaagaaaugauca

SEQ ID NO: 185262 - RNA, 19 nt, Homo sapiens
agaagaagacaaaggaaau

SEQ ID NO: 185263 - RNA, 19 nt, Homo sapiens
gaggcggguucuacagaga

SEQ ID NO: 185264 - RNA, 19 nt, Homo sapiens
gcguucagaugcaauugga

SEQ ID NO: 185265 - RNA, 19 nt, Homo sapiens
guggaacucugagccauuc

SEQ ID NO: 185266 - RNA, 19 nt, Homo sapiens
uccaagaccacaaacuuaa

SEQ ID NO: 185267 - RNA, 19 nt, Homo sapiens
gaacaaugggaaccagucu

SEQ ID NO: 185268 - RNA, 19 nt, Homo sapiens
agaagacaaaggaaaugua

SEQ ID NO: 185269 - RNA, 19 nt, Homo sapiens
gucagggaguguuuauuuc

SEQ ID NO: 185270 - RNA, 19 nt, Homo sapiens
aaagagaagaagaugaaga

SEQ ID NO: 185271 - RNA, 19 nt, Homo sapiens
ccaagacgaagaguaagaa

SEQ ID NO: 185272 - RNA, 19 nt, Homo sapiens
gggaaccagucuuucaaaa

SEQ ID NO: 185273 - RNA, 19 nt, Homo sapiens
acacaaagaaguugaugag

SEQ ID NO: 185274 - RNA, 19 nt, Homo sapiens
ucaagggaaccaagacgaa

SEQ ID NO: 185275 - RNA, 19 nt, Homo sapiens
uuccaagaccacaaacuua

SEQ ID NO: 185276 - RNA, 19 nt, Homo sapiens
gaaauuucagagcuuccaa

SEQ ID NO: 185277 - RNA, 19 nt, Homo sapiens
cgaguacuccuaugugaag

SEQ ID NO: 185278 - RNA, 19 nt, Homo sapiens
aaagaugacauuccagaag

SEQ ID NO: 185279 - RNA, 19 nt, Homo sapiens
gccgacagauacugcaagu

SEQ ID NO: 185280 - RNA, 19 nt, Homo sapiens
aauugaaagccgacagaua

SEQ ID NO: 185281 - RNA, 19 nt, Homo sapiens
agaugacauuccagaagaa

SEQ ID NO: 185282 - RNA, 19 nt, Homo sapiens
gcaggagaagaagaaauga

SEQ ID NO: 185283 - RNA, 19 nt, Homo sapiens
gggaaccuauauacaugca

SEQ ID NO: 185284 - RNA, 19 nt, Homo sapiens
ugaagaaacccagcuugau

SEQ ID NO: 185285 - RNA, 19 nt, Homo sapiens
ucaggaaccauagccauug

SEQ ID NO: 185286 - RNA, 19 nt, Homo sapiens
guacuccuaugugaagucu

SEQ ID NO: 185287 - RNA, 19 nt, Homo sapiens
aaacagcaggagaagaaga

SEQ ID NO: 185288 - RNA, 19 nt, Homo sapiens
gagcuccacacaaagaagu

SEQ ID NO: 185289 - RNA, 19 nt, Homo sapiens
cagaggaaaugcuuuuaca

SEQ ID NO: 185290 - RNA, 19 nt, Homo sapiens
gccuuaucuuucuguguuu

SEQ ID NO: 185291 - RNA, 19 nt, Homo sapiens
ccagaagaagacaaaggaa

SEQ ID NO: 185292 - RNA, 19 nt, Homo sapiens
ccucaaauagcugcuuuau

SEQ ID NO: 185293 - RNA, 19 nt, Homo sapiens
ucacauacucguccagaac

SEQ ID NO: 185294 - RNA, 19 nt, Homo sapiens
caaugaagcaggggacaua

SEQ ID NO: 185295 - RNA, 19 nt, Homo sapiens
guuguugggcguucagaug

SEQ ID NO: 185296 - RNA, 19 nt, Homo sapiens
ggaaccagucuuucaaaau

SEQ ID NO: 185297 - RNA, 19 nt, Homo sapiens
gcgaggagcugccagugua

SEQ ID NO: 185298 - RNA, 19 nt, Homo sapiens
gcaagucccugcccuggaa

SEQ ID NO: 185299 - RNA, 19 nt, Homo sapiens
guuaagcgcugggauauga

SEQ ID NO: 185300 - RNA, 19 nt, Homo sapiens
ugaaggagauucuaaaguc

SEQ ID NO: 185301 - RNA, 19 nt, Homo sapiens
acaguggacuuccuauuaa

SEQ ID NO: 185302 - RNA, 19 nt, Homo sapiens
cuaaaguccucucugguaa

SEQ ID NO: 185303 - RNA, 19 nt, Homo sapiens
agugaacgcuguaaaugua

SEQ ID NO: 185304 - RNA, 19 nt, Homo sapiens
ggaaggaucgacucgguaa

SEQ ID NO: 185305 - RNA, 19 nt, Homo sapiens
cacaguggacuuccuauua

SEQ ID NO: 185306 - RNA, 19 nt, Homo sapiens
ggcuaaaguuaaagagaua

SEQ ID NO: 185307 - RNA, 19 nt, Homo sapiens
gggcuaaaguuaaagagau

SEQ ID NO: 185308 - RNA, 19 nt, Homo sapiens
cuacacagaagaccuauuu

SEQ ID NO: 185309 - RNA, 19 nt, Homo sapiens
ugacuaagaugcccaacca

SEQ ID NO: 185310 - RNA, 19 nt, Homo sapiens
gcgcccaucugcaccauug

SEQ ID NO: 185311 - RNA, 19 nt, Homo sapiens
ugaggaauauaucaucaug

SEQ ID NO: 185312 - RNA, 19 nt, Homo sapiens
gcagugaacgcuguaaaug

SEQ ID NO: 185313 - RNA, 19 nt, Homo sapiens
aaaguuaagcgcugggaua

SEQ ID NO: 185314 - RNA, 19 nt, Homo sapiens
gagcuacacagaagaccua

SEQ ID NO: 185315 - RNA, 19 nt, Homo sapiens
gcacaucauauucuauugu

SEQ ID NO: 185316 - RNA, 19 nt, Homo sapiens
ccggaacaauuacaacuau

SEQ ID NO: 185317 - RNA, 19 nt, Homo sapiens
ggaacaauuacaacuaugu

SEQ ID NO: 185318 - RNA, 19 nt, Homo sapiens
ccuauuuccggaacaauua

SEQ ID NO: 185319 - RNA, 19 nt, Homo sapiens
uaacacaguggacuuccua

SEQ ID NO: 185320 - RNA, 19 nt, Homo sapiens
ucuaaaguccucucuggua

SEQ ID NO: 185321 - RNA, 19 nt, Homo sapiens
uauuagagcuacacagaag

SEQ ID NO: 185322 - RNA, 19 nt, Homo sapiens
guaaauguaagccuauuag

SEQ ID NO: 185323 - RNA, 19 nt, Homo sapiens
cuaaaucccgaaauacaaa

SEQ ID NO: 185324 - RNA, 19 nt, Homo sapiens
gaagcuucgucaucuugga

SEQ ID NO: 185325 - RNA, 19 nt, Homo sapiens
gaggugaaggagauucuaa

SEQ ID NO: 185326 - RNA, 19 nt, Homo sapiens
ugaugugacugcaguagug

SEQ ID NO: 185327 - RNA, 19 nt, Homo sapiens
gaacguuccagauuacucu

SEQ ID NO: 185328 - RNA, 19 nt, Homo sapiens
ccucugcccuccacuuaau

SEQ ID NO: 185329 - RNA, 19 nt, Homo sapiens
gucauucgggcuaaaguua

SEQ ID NO: 185330 - RNA, 19 nt, Homo sapiens
gaacaauuacaacuauguc

SEQ ID NO: 185331 - RNA, 19 nt, Homo sapiens
gauucuagcaauagugauu

SEQ ID NO: 185332 - RNA, 19 nt, Homo sapiens
cauucgggcuaaaguuaaa

SEQ ID NO: 185333 - RNA, 19 nt, Homo sapiens
gcacuauugcacaucauau

SEQ ID NO: 185334 - RNA, 19 nt, Homo sapiens
ccuggaacaugacuaagau

SEQ ID NO: 185335 - RNA, 19 nt, Homo sapiens
cugcuucucucuucucuca

SEQ ID NO: 185336 - RNA, 19 nt, Homo sapiens
gagaagcucccagauccuu

SEQ ID NO: 185337 - RNA, 19 nt, Homo sapiens
aagacuaagugccaugaug

SEQ ID NO: 185338 - RNA, 19 nt, Homo sapiens
uaaaguccucucugguaaa

SEQ ID NO: 185339 - RNA, 19 nt, Homo sapiens
gcaagcagugaacgcugua

SEQ ID NO: 185340 - RNA, 19 nt, Homo sapiens
ucuaguaacggaaacugua

SEQ ID NO: 185341 - RNA, 19 nt, Homo sapiens
ggacggagcugauuuuccu

SEQ ID NO: 185342 - RNA, 19 nt, Homo sapiens
ucccugcccuggaacauga

SEQ ID NO: 185343 - RNA, 19 nt, Homo sapiens
caacuaaaucccgaaauac

SEQ ID NO: 185344 - RNA, 19 nt, Homo sapiens
ccuauuagagcuacacaga

SEQ ID NO: 185345 - RNA, 19 nt, Homo sapiens
gguuucugcuucucucuuc

SEQ ID NO: 185346 - RNA, 19 nt, Homo sapiens
ggacuuccuauuaagacuu

SEQ ID NO: 185347 - RNA, 19 nt, Homo sapiens
uaagugccaugaugugacu

SEQ ID NO: 185348 - RNA, 19 nt, Homo sapiens
gaaggaucgacucgguaaa

SEQ ID NO: 185349 - RNA, 19 nt, Homo sapiens
gaagcucccagauccuugu

SEQ ID NO: 185350 - RNA, 19 nt, Homo sapiens
uaguggaggugaaggagau

SEQ ID NO: 185351 - RNA, 19 nt, Homo sapiens
gugauucuagcaauaguga

SEQ ID NO: 185352 - RNA, 19 nt, Homo sapiens
uaaagacuaagugccauga

SEQ ID NO: 185353 - RNA, 19 nt, Homo sapiens
gagcugauuuuccuaugga

SEQ ID NO: 185354 - RNA, 19 nt, Homo sapiens
gcgcugggauaugaagcuu

SEQ ID NO: 185355 - RNA, 19 nt, Homo sapiens
caucugcaccauugacuuc

SEQ ID NO: 185356 - RNA, 19 nt, Homo sapiens
aaggaaaauugcacuauug

SEQ ID NO: 185357 - RNA, 19 nt, Homo sapiens
agacuaagugccaugaugu

SEQ ID NO: 185358 - RNA, 19 nt, Homo sapiens
cggaacaauuacaacuaug

SEQ ID NO: 185359 - RNA, 19 nt, Homo sapiens
caucuuggacucaguaaaa

SEQ ID NO: 185360 - RNA, 19 nt, Homo sapiens
gggaauuugauccaaggaa

SEQ ID NO: 185361 - RNA, 19 nt, Homo sapiens
ggaggugaaggagauucua

SEQ ID NO: 185362 - RNA, 19 nt, Homo sapiens
cagugaacgcuguaaaugu

SEQ ID NO: 185363 - RNA, 19 nt, Homo sapiens
gugaaggagauucuaaagu

SEQ ID NO: 185364 - RNA, 19 nt, Homo sapiens
ggugaaggagauucuaaag

SEQ ID NO: 185365 - RNA, 19 nt, Homo sapiens
ccaaggaagcggugauugc

SEQ ID NO: 185366 - RNA, 19 nt, Homo sapiens
ucauucgggcuaaaguuaa

SEQ ID NO: 185367 - RNA, 19 nt, Homo sapiens
gugaacgcuguaaauguaa

SEQ ID NO: 185368 - RNA, 19 nt, Homo sapiens
aaagugauucuagcaauag

SEQ ID NO: 185369 - RNA, 19 nt, Homo sapiens
gguggaaggcucuauagcu

SEQ ID NO: 185370 - RNA, 19 nt, Homo sapiens
gggcuaugaagaugaggaa

SEQ ID NO: 185371 - RNA, 19 nt, Homo sapiens
agaccuauuuccggaacaa

SEQ ID NO: 185372 - RNA, 19 nt, Homo sapiens
aaauguaagccuauuagag

SEQ ID NO: 185373 - RNA, 19 nt, Homo sapiens
acacaguggacuuccuauu

SEQ ID NO: 185374 - RNA, 19 nt, Homo sapiens
acuaaaucccgaaauacaa

SEQ ID NO: 185375 - RNA, 19 nt, Homo sapiens
gcucuauagcugagaagug

SEQ ID NO: 185376 - RNA, 19 nt, Homo sapiens
aaaguccucucugguaaac

SEQ ID NO: 185377 - RNA, 19 nt, Homo sapiens
gagcccauacucaucaagu

SEQ ID NO: 185378 - RNA, 19 nt, Homo sapiens
gcuguaaauguaagccuau

SEQ ID NO: 185379 - RNA, 19 nt, Homo sapiens
caguggacuuccuauuaag

SEQ ID NO: 185380 - RNA, 19 nt, Homo sapiens
cgucaucuuggacucagua

SEQ ID NO: 185381 - RNA, 19 nt, Homo sapiens
caugggcuaugaagaugag

SEQ ID NO: 185382 - RNA, 19 nt, Homo sapiens
cuauuucacuaaucaugag

SEQ ID NO: 185383 - RNA, 19 nt, Homo sapiens
cacuauugcacaucauauu

SEQ ID NO: 185384 - RNA, 19 nt, Homo sapiens
ucaaggaacugguauauga

SEQ ID NO: 185385 - RNA, 19 nt, Homo sapiens
gaaugucguuucugcauaa

SEQ ID NO: 185386 - RNA, 19 nt, Homo sapiens
caacaucaccauugcaaua

SEQ ID NO: 185387 - RNA, 19 nt, Homo sapiens
gcagauuccuuguauacau

SEQ ID NO: 185388 - RNA, 19 nt, Homo sapiens
cagauuccuuguauacaua

SEQ ID NO: 185389 - RNA, 19 nt, Homo sapiens
gcugugagcugaccaacau

SEQ ID NO: 185390 - RNA, 19 nt, Homo sapiens
ccaugcagauuccuuguau

SEQ ID NO: 185391 - RNA, 19 nt, Homo sapiens
gcaaucugcugcaauagcu

SEQ ID NO: 185392 - RNA, 19 nt, Homo sapiens
cgacagcacugauuguacu

SEQ ID NO: 185393 - RNA, 19 nt, Homo sapiens
gaacugguauaugaaacag

SEQ ID NO: 185394 - RNA, 19 nt, Homo sapiens
caauagagaaagaagaaug

SEQ ID NO: 185395 - RNA, 19 nt, Homo sapiens
gggaucugguguauaagga

SEQ ID NO: 185396 - RNA, 19 nt, Homo sapiens
ccauugcaauagagaaaga

SEQ ID NO: 185397 - RNA, 19 nt, Homo sapiens
gagaaagaagaaugucguu

SEQ ID NO: 185398 - RNA, 19 nt, Homo sapiens
ggaacugguauaugaaaca

SEQ ID NO: 185399 - RNA, 19 nt, Homo sapiens
caaggaacugguauaugaa

SEQ ID NO: 185400 - RNA, 19 nt, Homo sapiens
caugcagauuccuuguaua

SEQ ID NO: 185401 - RNA, 19 nt, Homo sapiens
gcccagcuacugcuccuuu

SEQ ID NO: 185402 - RNA, 19 nt, Homo sapiens
ugaccaacaucaccauugc

SEQ ID NO: 185403 - RNA, 19 nt, Homo sapiens
cuacugcuccuuuggugaa

SEQ ID NO: 185404 - RNA, 19 nt, Homo sapiens
caucaccauugcaauagag

SEQ ID NO: 185405 - RNA, 19 nt, Homo sapiens
cuccuuuggugaaaugaaa

SEQ ID NO: 185406 - RNA, 19 nt, Homo sapiens
caccauugcaauagagaaa

SEQ ID NO: 185407 - RNA, 19 nt, Homo sapiens
gacagcgacagcacugauu

SEQ ID NO: 185408 - RNA, 19 nt, Homo sapiens
ugcaauagagaaagaagaa

SEQ ID NO: 185409 - RNA, 19 nt, Homo sapiens
ugucguuucugcauaagca

SEQ ID NO: 185410 - RNA, 19 nt, Homo sapiens
agaaagaagaaugucguuu

SEQ ID NO: 185411 - RNA, 19 nt, Homo sapiens
gcaauagagaaagaagaau

SEQ ID NO: 185412 - RNA, 19 nt, Homo sapiens
gugcucaccaugcagauuc

SEQ ID NO: 185413 - RNA, 19 nt, Homo sapiens
cggcugugcucaccaugca

SEQ ID NO: 185414 - RNA, 19 nt, Homo sapiens
aaggaacugguauaugaaa

SEQ ID NO: 185415 - RNA, 19 nt, Homo sapiens
acaucaccauugcaauaga

SEQ ID NO: 185416 - RNA, 19 nt, Homo sapiens
gcaagaaguugauuauaug

SEQ ID NO: 185417 - RNA, 19 nt, Homo sapiens
guggauggaugcauaauua

SEQ ID NO: 185418 - RNA, 19 nt, Homo sapiens
ggcaagaaguugauuauau

SEQ ID NO: 185419 - RNA, 19 nt, Homo sapiens
acacugaguuugacuauga

SEQ ID NO: 185420 - RNA, 19 nt, Homo sapiens
ccagugagcugucagucua

SEQ ID NO: 185421 - RNA, 19 nt, Homo sapiens
uagaagaauugccuaauga

SEQ ID NO: 185422 - RNA, 19 nt, Homo sapiens
ucgcagagauuucuucauu

SEQ ID NO: 185423 - RNA, 19 nt, Homo sapiens
gagccaauaucacaacuau

SEQ ID NO: 185424 - RNA, 19 nt, Homo sapiens
guaaauuggucaggaacua

SEQ ID NO: 185425 - RNA, 19 nt, Homo sapiens
caggucgacuuacaacuua

SEQ ID NO: 185426 - RNA, 19 nt, Homo sapiens
gcagagauuucuucauucu

SEQ ID NO: 185427 - RNA, 19 nt, Homo sapiens
gcugaucucugcauuggaa

SEQ ID NO: 185428 - RNA, 19 nt, Homo sapiens
ggaccagucauucuagaua

SEQ ID NO: 185429 - RNA, 19 nt, Homo sapiens
ccaacuagaugcagugaau

SEQ ID NO: 185430 - RNA, 19 nt, Homo sapiens
ucagguggauggaugcaua

SEQ ID NO: 185431 - RNA, 19 nt, Homo sapiens
gcaaaucucugagcuucau

SEQ ID NO: 185432 - RNA, 19 nt, Homo sapiens
ccacacaauugaaagaaau

SEQ ID NO: 185433 - RNA, 19 nt, Homo sapiens
uaacuaccagccaauauaa

SEQ ID NO: 185434 - RNA, 19 nt, Homo sapiens
gcagugaaucuaagcgaua

SEQ ID NO: 185435 - RNA, 19 nt, Homo sapiens
gacuaugacuuaugcaaug

SEQ ID NO: 185436 - RNA, 19 nt, Homo sapiens
ucuccaaccuucccaaauu

SEQ ID NO: 185437 - RNA, 19 nt, Homo sapiens
ggaagcugaauuauuagua

SEQ ID NO: 185438 - RNA, 19 nt, Homo sapiens
gaccagucauucuagauau

SEQ ID NO: 185439 - RNA, 19 nt, Homo sapiens
ccaacaaccugcucuacau

SEQ ID NO: 185440 - RNA, 19 nt, Homo sapiens
gcacccauuucuuucuuug

SEQ ID NO: 185441 - RNA, 19 nt, Homo sapiens
ggucaucuguggcugcuau

SEQ ID NO: 185442 - RNA, 19 nt, Homo sapiens
ggucaggaacuauuaauuc

SEQ ID NO: 185443 - RNA, 19 nt, Homo sapiens
ucucugagcuucauccaau

SEQ ID NO: 185444 - RNA, 19 nt, Homo sapiens
gaagaauugccuaaugaug

SEQ ID NO: 185445 - RNA, 19 nt, Homo sapiens
gauagaggcagauguguuc

SEQ ID NO: 185446 - RNA, 19 nt, Homo sapiens
caacacccauccaaggaau

SEQ ID NO: 185447 - RNA, 19 nt, Homo sapiens
ugaguuugacuaugacuua

SEQ ID NO: 185448 - RNA, 19 nt, Homo sapiens
agaauugccuaaugauguu

SEQ ID NO: 185449 - RNA, 19 nt, Homo sapiens
caagauucauucucuccaa

SEQ ID NO: 185450 - RNA, 19 nt, Homo sapiens
gacagugcuucuacacauu

SEQ ID NO: 185451 - RNA, 19 nt, Homo sapiens
ugacagugcuucuacacau

SEQ ID NO: 185452 - RNA, 19 nt, Homo sapiens
gcugcuauauccacaucua

SEQ ID NO: 185453 - RNA, 19 nt, Homo sapiens
ugacagcuaucaccuugga

SEQ ID NO: 185454 - RNA, 19 nt, Homo sapiens
uuacauacuugucccucua

SEQ ID NO: 185455 - RNA, 19 nt, Homo sapiens
cuaacuaccagccaauaua

SEQ ID NO: 185456 - RNA, 19 nt, Homo sapiens
gcuaucaccuuggaaagau

SEQ ID NO: 185457 - RNA, 19 nt, Homo sapiens
caacccaugugaagauauc

SEQ ID NO: 185458 - RNA, 19 nt, Homo sapiens
uuaagcaccuuccagaugu

SEQ ID NO: 185459 - RNA, 19 nt, Homo sapiens
cuccaaccuucccaaauua

SEQ ID NO: 185460 - RNA, 19 nt, Homo sapiens
gaaucuaccugcugcucau

SEQ ID NO: 185461 - RNA, 19 nt, Homo sapiens
acauaaacauccacacaau

SEQ ID NO: 185462 - RNA, 19 nt, Homo sapiens
ugaaaugcaagcccaaauu

SEQ ID NO: 185463 - RNA, 19 nt, Homo sapiens
caaagauucugcugguucu

SEQ ID NO: 185464 - RNA, 19 nt, Homo sapiens
uaucacaacuaugccauug

SEQ ID NO: 185465 - RNA, 19 nt, Homo sapiens
gcaaaugcagaaagaaauc

SEQ ID NO: 185466 - RNA, 19 nt, Homo sapiens
caauggaacccaacuagau

SEQ ID NO: 185467 - RNA, 19 nt, Homo sapiens
uaacauaaacauccacaca

SEQ ID NO: 185468 - RNA, 19 nt, Homo sapiens
caaccuucaauaucuguua

SEQ ID NO: 185469 - RNA, 19 nt, Homo sapiens
acauuaggaagcugaauua

SEQ ID NO: 185470 - RNA, 19 nt, Homo sapiens
guaucugaguauugaauga

SEQ ID NO: 185471 - RNA, 19 nt, Homo sapiens
aaguguggcugcuaugaaa

SEQ ID NO: 185472 - RNA, 19 nt, Homo sapiens
cagcagaggauuugacaug

SEQ ID NO: 185473 - RNA, 19 nt, Homo sapiens
cagugaaucuaagcgauaa

SEQ ID NO: 185474 - RNA, 19 nt, Homo sapiens
ccucaucacuguguccaaa

SEQ ID NO: 185475 - RNA, 19 nt, Homo sapiens
ucaauguccuggccuuugu

SEQ ID NO: 185476 - RNA, 19 nt, Homo sapiens
gacaaugaguccagcuaca

SEQ ID NO: 185477 - RNA, 19 nt, Homo sapiens
uaaggcaagaaguugauua

SEQ ID NO: 185478 - RNA, 19 nt, Homo sapiens
auaaacauccacacaauug

SEQ ID NO: 185479 - RNA, 19 nt, Homo sapiens
ccauugaacugagguuugu

SEQ ID NO: 185480 - RNA, 19 nt, Homo sapiens
gguacaacauccucagagu

SEQ ID NO: 185481 - RNA, 19 nt, Homo sapiens
agaaagaaaucagguggau

SEQ ID NO: 185482 - RNA, 19 nt, Homo sapiens
gaagccagccucaccuauc

SEQ ID NO: 185483 - RNA, 19 nt, Homo sapiens
gaacuauuaauuccaugug

SEQ ID NO: 185484 - RNA, 19 nt, Homo sapiens
gcaaguguggcugcuauga

SEQ ID NO: 185485 - RNA, 19 nt, Homo sapiens
guugauauccauaccaaga

SEQ ID NO: 185486 - RNA, 19 nt, Homo sapiens
ccagguuccuuaugugcaa

SEQ ID NO: 185487 - RNA, 19 nt, Homo sapiens
cauaaacauccacacaauu

SEQ ID NO: 185488 - RNA, 19 nt, Homo sapiens
gauguucacaagauucauu

SEQ ID NO: 185489 - RNA, 19 nt, Homo sapiens
gugaaaauguaucugagua

SEQ ID NO: 185490 - RNA, 19 nt, Homo sapiens
ggcaucagcagcuacauga

SEQ ID NO: 185491 - RNA, 19 nt, Homo sapiens
gccuagcuauggcuuagaa

SEQ ID NO: 185492 - RNA, 19 nt, Homo sapiens
caagaacaaggauccauuc

SEQ ID NO: 185493 - RNA, 19 nt, Homo sapiens
gugaaucuaagcgauaaua

SEQ ID NO: 185494 - RNA, 19 nt, Homo sapiens
gcaucugccugcccaugga

SEQ ID NO: 185495 - RNA, 19 nt, Homo sapiens
gaacaucauagugcuagug

SEQ ID NO: 185496 - RNA, 19 nt, Homo sapiens
aaacauccacacaauugaa

SEQ ID NO: 185497 - RNA, 19 nt, Homo sapiens
ccaaauuuauaggacagaa

SEQ ID NO: 185498 - RNA, 19 nt, Homo sapiens
ugucacagcuguaugucau

SEQ ID NO: 185499 - RNA, 19 nt, Homo sapiens
caguugauauccauaccaa

SEQ ID NO: 185500 - RNA, 19 nt, Homo sapiens
gcagaggauuugacaugac

SEQ ID NO: 185501 - RNA, 19 nt, Homo sapiens
gagcaaggugacagagauu

SEQ ID NO: 185502 - RNA, 19 nt, Homo sapiens
aaugcaagcccaaauuuau

SEQ ID NO: 185503 - RNA, 19 nt, Homo sapiens
gccaauaucacaacuaugc

SEQ ID NO: 185504 - RNA, 19 nt, Homo sapiens
ccaggucgacuuacaacuu

SEQ ID NO: 185505 - RNA, 19 nt, Homo sapiens
ucaagaacaaggauccauu

SEQ ID NO: 185506 - RNA, 19 nt, Homo sapiens
ccagaaccuucccaaccuu

SEQ ID NO: 185507 - RNA, 19 nt, Homo sapiens
aggcagauguguucuccaa

SEQ ID NO: 185508 - RNA, 19 nt, Homo sapiens
ucacaacuaugccauugac

SEQ ID NO: 185509 - RNA, 19 nt, Homo sapiens
gcaaacuggagacggcaaa

SEQ ID NO: 185510 - RNA, 19 nt, Homo sapiens
aagaauugccuaaugaugu

SEQ ID NO: 185511 - RNA, 19 nt, Homo sapiens
caaccuggccuuugcugau

SEQ ID NO: 185512 - RNA, 19 nt, Homo sapiens
ggccaucacugggaacauc

SEQ ID NO: 185513 - RNA, 19 nt, Homo sapiens
gaguuugacuaugacuuau

SEQ ID NO: 185514 - RNA, 19 nt, Homo sapiens
aaagcugccuacucuggaa

SEQ ID NO: 185515 - RNA, 19 nt, Homo sapiens
ggugauagaggcagaugug

SEQ ID NO: 185516 - RNA, 19 nt, Homo sapiens
ggaaaugacuacaaacuuu

SEQ ID NO: 185517 - RNA, 19 nt, Homo sapiens
gcaaacagcuaauaggaaa

SEQ ID NO: 185518 - RNA, 19 nt, Homo sapiens
aaacugaucuccacuauga

SEQ ID NO: 185519 - RNA, 19 nt, Homo sapiens
ccaaagaacugccuauaau

SEQ ID NO: 185520 - RNA, 19 nt, Homo sapiens
uaaagcaacuuagaccuua

SEQ ID NO: 185521 - RNA, 19 nt, Homo sapiens
ccaaacauauggccacuuu

SEQ ID NO: 185522 - RNA, 19 nt, Homo sapiens
ugacagaagucccuuugua

SEQ ID NO: 185523 - RNA, 19 nt, Homo sapiens
ggaaaagacuugcuuguaa

SEQ ID NO: 185524 - RNA, 19 nt, Homo sapiens
gauuugagcuuacaggauu

SEQ ID NO: 185525 - RNA, 19 nt, Homo sapiens
ucagagaacuuaagguuga

SEQ ID NO: 185526 - RNA, 19 nt, Homo sapiens
guaugaaagucuugccuua

SEQ ID NO: 185527 - RNA, 19 nt, Homo sapiens
uaagggaaaugacuacaaa

SEQ ID NO: 185528 - RNA, 19 nt, Homo sapiens
caaacucucuucuccauug

SEQ ID NO: 185529 - RNA, 19 nt, Homo sapiens
ggacaaagaaucgcaaauu

SEQ ID NO: 185530 - RNA, 19 nt, Homo sapiens
gaaaggaugaggugaugua

SEQ ID NO: 185531 - RNA, 19 nt, Homo sapiens
ggauccaucuuccugguua

SEQ ID NO: 185532 - RNA, 19 nt, Homo sapiens
cuaaguaguuggaaacaaa

SEQ ID NO: 185533 - RNA, 19 nt, Homo sapiens
gcucaaugauuucugcuuu

SEQ ID NO: 185534 - RNA, 19 nt, Homo sapiens
gguagaagguguccaggaa

SEQ ID NO: 185535 - RNA, 19 nt, Homo sapiens
ggcaguaucccucaucuua

SEQ ID NO: 185536 - RNA, 19 nt, Homo sapiens
aagcugaacugaaacaauu

SEQ ID NO: 185537 - RNA, 19 nt, Homo sapiens
gcaagcaucccacaucuga

SEQ ID NO: 185538 - RNA, 19 nt, Homo sapiens
aaccagaacugccaaauug

SEQ ID NO: 185539 - RNA, 19 nt, Homo sapiens
caggaagucuuguuaguau

SEQ ID NO: 185540 - RNA, 19 nt, Homo sapiens
gggaugugcccuauaauaa

SEQ ID NO: 185541 - RNA, 19 nt, Homo sapiens
ugaaagucuugccuuauuu

SEQ ID NO: 185542 - RNA, 19 nt, Homo sapiens
ugguaaagcugaacugaaa

SEQ ID NO: 185543 - RNA, 19 nt, Homo sapiens
ccaauggacuuaagcuaga

SEQ ID NO: 185544 - RNA, 19 nt, Homo sapiens
ggaaaggaagagagugaua

SEQ ID NO: 185545 - RNA, 19 nt, Homo sapiens
gcaaaugcuccauagcuaa

SEQ ID NO: 185546 - RNA, 19 nt, Homo sapiens
ucaacaaccucaugaguca

SEQ ID NO: 185547 - RNA, 19 nt, Homo sapiens
gaauuacuccuaugaugaa

SEQ ID NO: 185548 - RNA, 19 nt, Homo sapiens
gcacggacuuacaccuauu

SEQ ID NO: 185549 - RNA, 19 nt, Homo sapiens
aggaugaggugauguauug

SEQ ID NO: 185550 - RNA, 19 nt, Homo sapiens
agacuugcuuguaacuuua

SEQ ID NO: 185551 - RNA, 19 nt, Homo sapiens
guuaaucuaugcaaagaga

SEQ ID NO: 185552 - RNA, 19 nt, Homo sapiens
gcaggaagucuuguuagua

SEQ ID NO: 185553 - RNA, 19 nt, Homo sapiens
caacuuagaccuuauuucu

SEQ ID NO: 185554 - RNA, 19 nt, Homo sapiens
cccagaggauuccauauaa

SEQ ID NO: 185555 - RNA, 19 nt, Homo sapiens
uaggagcucugcuuucaaa

SEQ ID NO: 185556 - RNA, 19 nt, Homo sapiens
ggagugagcucuuaauccu

SEQ ID NO: 185557 - RNA, 19 nt, Homo sapiens
aaagguagcugugcagaug

SEQ ID NO: 185558 - RNA, 19 nt, Homo sapiens
gcuaggaugucaaauaguc

SEQ ID NO: 185559 - RNA, 19 nt, Homo sapiens
ccagaggauuccauauaaa

SEQ ID NO: 185560 - RNA, 19 nt, Homo sapiens
gacagaagucccuuuguaa

SEQ ID NO: 185561 - RNA, 19 nt, Homo sapiens
caaagaacugccuauaauu

SEQ ID NO: 185562 - RNA, 19 nt, Homo sapiens
ggaagaagaacaggaagaa

SEQ ID NO: 185563 - RNA, 19 nt, Homo sapiens
uaagguugaugaccaaaug

SEQ ID NO: 185564 - RNA, 19 nt, Homo sapiens
cauguguccuggaaagaua

SEQ ID NO: 185565 - RNA, 19 nt, Homo sapiens
ggcaacaaguggacuauuc

SEQ ID NO: 185566 - RNA, 19 nt, Homo sapiens
caaauagucacaguucuaa

SEQ ID NO: 185567 - RNA, 19 nt, Homo sapiens
ccaaguuuguaguucauuu

SEQ ID NO: 185568 - RNA, 19 nt, Homo sapiens
gaacugaaacaauucucaa

SEQ ID NO: 185569 - RNA, 19 nt, Homo sapiens
cauaaugggcuauucauau

SEQ ID NO: 185570 - RNA, 19 nt, Homo sapiens
ccaaaggccuaccucugaa

SEQ ID NO: 185571 - RNA, 19 nt, Homo sapiens
gaggugauguauugacuca

SEQ ID NO: 185572 - RNA, 19 nt, Homo sapiens
ccucugaccugaccauuuc

SEQ ID NO: 185573 - RNA, 19 nt, Homo sapiens
gugaauuacuccuaugaug

SEQ ID NO: 185574 - RNA, 19 nt, Homo sapiens
gccaaagaacugccuauaa

SEQ ID NO: 185575 - RNA, 19 nt, Homo sapiens
agagaaauuuggacagcua

SEQ ID NO: 185576 - RNA, 19 nt, Homo sapiens
cagacgagcucuccagcaa

SEQ ID NO: 185577 - RNA, 19 nt, Homo sapiens
gaacugccaaauugacaaa

SEQ ID NO: 185578 - RNA, 19 nt, Homo sapiens
ccacagguaugaaagucuu

SEQ ID NO: 185579 - RNA, 19 nt, Homo sapiens
aagacuugcuuguaacuuu

SEQ ID NO: 185580 - RNA, 19 nt, Homo sapiens
agagaaagcguuguccuua

SEQ ID NO: 185581 - RNA, 19 nt, Homo sapiens
gugcagauguggaucaaca

SEQ ID NO: 185582 - RNA, 19 nt, Homo sapiens
caaaugcuccauagcuaaa

SEQ ID NO: 185583 - RNA, 19 nt, Homo sapiens
uauguuagcuugccauuuu

SEQ ID NO: 185584 - RNA, 19 nt, Homo sapiens
gagaaagcguuguccuuac

SEQ ID NO: 185585 - RNA, 19 nt, Homo sapiens
guacuaaggaccuguguuc

SEQ ID NO: 185586 - RNA, 19 nt, Homo sapiens
caagaaugcaucagcugua

SEQ ID NO: 185587 - RNA, 19 nt, Homo sapiens
gaucuccacuaugaagaaa

SEQ ID NO: 185588 - RNA, 19 nt, Homo sapiens
gcaaagagaaaggaaagga

SEQ ID NO: 185589 - RNA, 19 nt, Homo sapiens
ucaaauagucacaguucua

SEQ ID NO: 185590 - RNA, 19 nt, Homo sapiens
guucguaugucugaaauuc

SEQ ID NO: 185591 - RNA, 19 nt, Homo sapiens
gacaagugguacauggaaa

SEQ ID NO: 185592 - RNA, 19 nt, Homo sapiens
gccuauaauuucacuaaga

SEQ ID NO: 185593 - RNA, 19 nt, Homo sapiens
caguaucccucaucuuaug

SEQ ID NO: 185594 - RNA, 19 nt, Homo sapiens
gaagaagaacaggaagaaa

SEQ ID NO: 185595 - RNA, 19 nt, Homo sapiens
ccuaggagcucugcuuuca

SEQ ID NO: 185596 - RNA, 19 nt, Homo sapiens
gcaagguuaccaaacauau

SEQ ID NO: 185597 - RNA, 19 nt, Homo sapiens
gcaaauucuucaaaugacu

SEQ ID NO: 185598 - RNA, 19 nt, Homo sapiens
ugaacauccucaagaguug

SEQ ID NO: 185599 - RNA, 19 nt, Homo sapiens
ugacgcauguuaaucuaug

SEQ ID NO: 185600 - RNA, 19 nt, Homo sapiens
ccaacacggucagaagaaa

SEQ ID NO: 185601 - RNA, 19 nt, Homo sapiens
gaaauucuuggugcucuuu

SEQ ID NO: 185602 - RNA, 19 nt, Homo sapiens
gaagucccuuuguaacauc

SEQ ID NO: 185603 - RNA, 19 nt, Homo sapiens
gaccauuuccucugcaauu

SEQ ID NO: 185604 - RNA, 19 nt, Homo sapiens
ugaauuacuccuaugauga

SEQ ID NO: 185605 - RNA, 19 nt, Homo sapiens
augaaagucuugccuuauu

SEQ ID NO: 185606 - RNA, 19 nt, Homo sapiens
aaagucugcuguagaacaa

SEQ ID NO: 185607 - RNA, 19 nt, Homo sapiens
caccgaaucuguacuaagg

SEQ ID NO: 185608 - RNA, 19 nt, Homo sapiens
gaaaggaaggauccaucuu

SEQ ID NO: 185609 - RNA, 19 nt, Homo sapiens
ggaggaaggaauaaguuug

SEQ ID NO: 185610 - RNA, 19 nt, Homo sapiens
guaauggaguggauugaac

SEQ ID NO: 185611 - RNA, 19 nt, Homo sapiens
ucacaguucuaaguaguug

SEQ ID NO: 185612 - RNA, 19 nt, Homo sapiens
uuaaacugaucuccacuau

SEQ ID NO: 185613 - RNA, 19 nt, Homo sapiens
cauccacucugccuccaaa

SEQ ID NO: 185614 - RNA, 19 nt, Homo sapiens
ucgcaaauucuucaaauga

SEQ ID NO: 185615 - RNA, 19 nt, Homo sapiens
accaaagucugcuguagaa

SEQ ID NO: 185616 - RNA, 19 nt, Homo sapiens
ugaaagccaucaaagaauu

SEQ ID NO: 185617 - RNA, 19 nt, Homo sapiens
gagggaacaugcugagaaa

SEQ ID NO: 185618 - RNA, 19 nt, Homo sapiens
guccaugucuuacuacuuu

SEQ ID NO: 185619 - RNA, 19 nt, Homo sapiens
ggugaaagccaucaaagaa

SEQ ID NO: 185620 - RNA, 19 nt, Homo sapiens
gcgaugauguggcuuugaa

SEQ ID NO: 185621 - RNA, 19 nt, Homo sapiens
guaccauuccuucaaauaa

SEQ ID NO: 185622 - RNA, 19 nt, Homo sapiens
caaauacuuucuucaccaa

SEQ ID NO: 185623 - RNA, 19 nt, Homo sapiens
gggagacagugauaaugaa

SEQ ID NO: 185624 - RNA, 19 nt, Homo sapiens
ucaagaaaccagacuguga

SEQ ID NO: 185625 - RNA, 19 nt, Homo sapiens
gaacaugcugagaaacuga

SEQ ID NO: 185626 - RNA, 19 nt, Homo sapiens
gaaagccaucaaagaauug

SEQ ID NO: 185627 - RNA, 19 nt, Homo sapiens
ccauuugugugacuucauu

SEQ ID NO: 185628 - RNA, 19 nt, Homo sapiens
ggaacaugcugagaaacug

SEQ ID NO: 185629 - RNA, 19 nt, Homo sapiens
gcucuacgccuccuacguu

SEQ ID NO: 185630 - RNA, 19 nt, Homo sapiens
ggagacagugauaaugaaa

SEQ ID NO: 185631 - RNA, 19 nt, Homo sapiens
ugaugaagcugcagaacca

SEQ ID NO: 185632 - RNA, 19 nt, Homo sapiens
caagaaaccagacugugau

SEQ ID NO: 185633 - RNA, 19 nt, Homo sapiens
gcaggugaaagccaucaaa

SEQ ID NO: 185634 - RNA, 19 nt, Homo sapiens
gaacuaccaccaggacuca

SEQ ID NO: 185635 - RNA, 19 nt, Homo sapiens
caaaacauccacuuaaguu

SEQ ID NO: 185636 - RNA, 19 nt, Homo sapiens
gaugauguggcuuugaaga

SEQ ID NO: 185637 - RNA, 19 nt, Homo sapiens
gugaaagccaucaaagaau

SEQ ID NO: 185638 - RNA, 19 nt, Homo sapiens
gaaaccagacugugaugac

SEQ ID NO: 185639 - RNA, 19 nt, Homo sapiens
cagugauaaugaaagcuaa

SEQ ID NO: 185640 - RNA, 19 nt, Homo sapiens
agaucaaccuggagcucua

SEQ ID NO: 185641 - RNA, 19 nt, Homo sapiens
cugagaaacugaugaagcu

SEQ ID NO: 185642 - RNA, 19 nt, Homo sapiens
guaccaaaacauccacuua

SEQ ID NO: 185643 - RNA, 19 nt, Homo sapiens
ugggagacagugauaauga

SEQ ID NO: 185644 - RNA, 19 nt, Homo sapiens
acagugauaaugaaagcua

SEQ ID NO: 185645 - RNA, 19 nt, Homo sapiens
gggaacaugcugagaaacu

SEQ ID NO: 185646 - RNA, 19 nt, Homo sapiens
agagggaacaugcugagaa

SEQ ID NO: 185647 - RNA, 19 nt, Homo sapiens
gugaccacgugaccaacuu

SEQ ID NO: 185648 - RNA, 19 nt, Homo sapiens
gccaucaaccgccagauca

SEQ ID NO: 185649 - RNA, 19 nt, Homo sapiens
gauguggcuuugaagaacu

SEQ ID NO: 185650 - RNA, 19 nt, Homo sapiens
agacagugauaaugaaagc

SEQ ID NO: 185651 - RNA, 19 nt, Homo sapiens
uguaccauuccuucaaaua

SEQ ID NO: 185652 - RNA, 19 nt, Homo sapiens
ugggagagcgggcugaaug

SEQ ID NO: 185653 - RNA, 19 nt, Homo sapiens
aauacuuucuucaccaauc

SEQ ID NO: 185654 - RNA, 19 nt, Homo sapiens
gggguuuccuuuaccuuuu

SEQ ID NO: 185655 - RNA, 19 nt, Homo sapiens
caaggcagugcaugcaugu

SEQ ID NO: 185656 - RNA, 19 nt, Homo sapiens
ugauguggcuuugaagaac

SEQ ID NO: 185657 - RNA, 19 nt, Homo sapiens
caccugggagacagugaua

SEQ ID NO: 185658 - RNA, 19 nt, Homo sapiens
aaaccagacugugaugacu

SEQ ID NO: 185659 - RNA, 19 nt, Homo sapiens
uaucaagaaaccagacugu

SEQ ID NO: 185660 - RNA, 19 nt, Homo sapiens
ccuucaggauaucaagaaa

SEQ ID NO: 185661 - RNA, 19 nt, Homo sapiens
uugugugacuucauugaga

SEQ ID NO: 185662 - RNA, 19 nt, Homo sapiens
ucaacagccuggucaauuu

SEQ ID NO: 185663 - RNA, 19 nt, Homo sapiens
gaagugaagcuuaucaaga

SEQ ID NO: 185664 - RNA, 19 nt, Homo sapiens
gcgaguaucucuucgaaag

SEQ ID NO: 185665 - RNA, 19 nt, Homo sapiens
gagacucacuuccuagaug

SEQ ID NO: 185666 - RNA, 19 nt, Homo sapiens
aagugaagcuuaucaagaa

SEQ ID NO: 185667 - RNA, 19 nt, Homo sapiens
gaagccagcugaagaugag

SEQ ID NO: 185668 - RNA, 19 nt, Homo sapiens
gaugaggaagugaagcuua

SEQ ID NO: 185669 - RNA, 19 nt, Homo sapiens
gggcgaguaucucuucgaa

SEQ ID NO: 185670 - RNA, 19 nt, Homo sapiens
ucaagaagccagcugaaga

SEQ ID NO: 185671 - RNA, 19 nt, Homo sapiens
agacucacuuccuagauga

SEQ ID NO: 185672 - RNA, 19 nt, Homo sapiens
caagaagccagcugaagau

SEQ ID NO: 185673 - RNA, 19 nt, Homo sapiens
ccuggagacucacuuccua

SEQ ID NO: 185674 - RNA, 19 nt, Homo sapiens
caacagccuggucaauuug

SEQ ID NO: 185675 - RNA, 19 nt, Homo sapiens
accaugagcucccagauuc

SEQ ID NO: 185676 - RNA, 19 nt, Homo sapiens
ggaccugccagcaccguuu

SEQ ID NO: 185677 - RNA, 19 nt, Homo sapiens
ccaaauggaaauaaagcuu

SEQ ID NO: 185678 - RNA, 19 nt, Homo sapiens
ggaccaaauggaaauaaag

SEQ ID NO: 185679 - RNA, 19 nt, Homo sapiens
ggaagugaagcuuaucaag

SEQ ID NO: 185680 - RNA, 19 nt, Homo sapiens
uggaccaaauggaaauaaa

SEQ ID NO: 185681 - RNA, 19 nt, Homo sapiens
gcucccagauucgucagaa

SEQ ID NO: 185682 - RNA, 19 nt, Homo sapiens
gcuacgagcgucuccugaa

SEQ ID NO: 185683 - RNA, 19 nt, Homo sapiens
gucaacagccuggucaauu

SEQ ID NO: 185684 - RNA, 19 nt, Homo sapiens
ugaagcuuaucaagaagau

SEQ ID NO: 185685 - RNA, 19 nt, Homo sapiens
gcgggucugucucuugcuu

SEQ ID NO: 185686 - RNA, 19 nt, Homo sapiens
ucucugggcuucuauuucg

SEQ ID NO: 185687 - RNA, 19 nt, Homo sapiens
gaggaagugaagcuuauca

SEQ ID NO: 185688 - RNA, 19 nt, Homo sapiens
cuacgagcgucuccugaag

SEQ ID NO: 185689 - RNA, 19 nt, Homo sapiens
gcaaaguaauagggcuucu

SEQ ID NO: 185690 - RNA, 19 nt, Homo sapiens
gugacuuccuggagacuca

SEQ ID NO: 185691 - RNA, 19 nt, Homo sapiens
gaacagauccggggacucu

SEQ ID NO: 185692 - RNA, 19 nt, Homo sapiens
augaggaagugaagcuuau

SEQ ID NO: 185693 - RNA, 19 nt, Homo sapiens
ggagacucacuuccuagau

SEQ ID NO: 185694 - RNA, 19 nt, Homo sapiens
gggucugucucuugcuuca

SEQ ID NO: 185695 - RNA, 19 nt, Homo sapiens
acagccuggucaauuugua

SEQ ID NO: 185696 - RNA, 19 nt, Homo sapiens
ucucuugcuucaacagugu

SEQ ID NO: 185697 - RNA, 19 nt, Homo sapiens
agaagccagcugaagauga

SEQ ID NO: 185698 - RNA, 19 nt, Homo sapiens
gaccaaauggaaauaaagc

SEQ ID NO: 185699 - RNA, 19 nt, Homo sapiens
gcugggcgaguaucucuuc

SEQ ID NO: 185700 - RNA, 19 nt, Homo sapiens
caucaagaagccagcugaa

SEQ ID NO: 185701 - RNA, 19 nt, Homo sapiens
gugaagcuuaucaagaaga

SEQ ID NO: 185702 - RNA, 19 nt, Homo sapiens
caacagagaugccaugaua

SEQ ID NO: 185703 - RNA, 19 nt, Homo sapiens
caagagaucuguccuuuaa

SEQ ID NO: 185704 - RNA, 19 nt, Homo sapiens
ggagaaacaugcugugaua

SEQ ID NO: 185705 - RNA, 19 nt, Homo sapiens
gaaaggcgcuacauugaga

SEQ ID NO: 185706 - RNA, 19 nt, Homo sapiens
gcagauguuuccuuauaua

SEQ ID NO: 185707 - RNA, 19 nt, Homo sapiens
gaaacaugcugugauauug

SEQ ID NO: 185708 - RNA, 19 nt, Homo sapiens
gaacaggauugugcccuua

SEQ ID NO: 185709 - RNA, 19 nt, Homo sapiens
uggagaagcuaaugaguua

SEQ ID NO: 185710 - RNA, 19 nt, Homo sapiens
ggagcugucugcauuauga

SEQ ID NO: 185711 - RNA, 19 nt, Homo sapiens
caagagccacuauuauuua

SEQ ID NO: 185712 - RNA, 19 nt, Homo sapiens
aagcagauguuuccuuaua

SEQ ID NO: 185713 - RNA, 19 nt, Homo sapiens
guaaugaggugguacuaug

SEQ ID NO: 185714 - RNA, 19 nt, Homo sapiens
ggaaucacuugcaguuauu

SEQ ID NO: 185715 - RNA, 19 nt, Homo sapiens
gauaaacaauguacagaca

SEQ ID NO: 185716 - RNA, 19 nt, Homo sapiens
gcuauaauggugaaaguua

SEQ ID NO: 185717 - RNA, 19 nt, Homo sapiens
gaaggaccaugcugcgaaa

SEQ ID NO: 185718 - RNA, 19 nt, Homo sapiens
gugaagaucuuuaguaacu

SEQ ID NO: 185719 - RNA, 19 nt, Homo sapiens
gaacauuuaccauuccaaa

SEQ ID NO: 185720 - RNA, 19 nt, Homo sapiens
gugugaagaucuuuaguaa

SEQ ID NO: 185721 - RNA, 19 nt, Homo sapiens
caacauaaguggacaucuc

SEQ ID NO: 185722 - RNA, 19 nt, Homo sapiens
ccaagagccacuauuauuu

SEQ ID NO: 185723 - RNA, 19 nt, Homo sapiens
gaaaccauauacugugaau

SEQ ID NO: 185724 - RNA, 19 nt, Homo sapiens
gaacugaggacuauucaag

SEQ ID NO: 185725 - RNA, 19 nt, Homo sapiens
ugagaaggauauugaauca

SEQ ID NO: 185726 - RNA, 19 nt, Homo sapiens
aaggguauauugaagguua

SEQ ID NO: 185727 - RNA, 19 nt, Homo sapiens
gggaaaccauauacuguga

SEQ ID NO: 185728 - RNA, 19 nt, Homo sapiens
ucgaagacuuugcacauuu

SEQ ID NO: 185729 - RNA, 19 nt, Homo sapiens
gaaaugcauguuauaguug

SEQ ID NO: 185730 - RNA, 19 nt, Homo sapiens
gagaaaauacggucaauaa

SEQ ID NO: 185731 - RNA, 19 nt, Homo sapiens
gaucuguccuuuaaauuac

SEQ ID NO: 185732 - RNA, 19 nt, Homo sapiens
gaagggaaaccauauacug

SEQ ID NO: 185733 - RNA, 19 nt, Homo sapiens
cuguagugcuucauauuua

SEQ ID NO: 185734 - RNA, 19 nt, Homo sapiens
gauagagguguaugcaaua

SEQ ID NO: 185735 - RNA, 19 nt, Homo sapiens
gauggaacuucuugugguu

SEQ ID NO: 185736 - RNA, 19 nt, Homo sapiens
caaaagauguggauaaaag

SEQ ID NO: 185737 - RNA, 19 nt, Homo sapiens
gccaugauaucacuucuuc

SEQ ID NO: 185738 - RNA, 19 nt, Homo sapiens
gaaacugugguauaaguga

SEQ ID NO: 185739 - RNA, 19 nt, Homo sapiens
ucuggaaacugugguauaa

SEQ ID NO: 185740 - RNA, 19 nt, Homo sapiens
uaaagccgguucaaacugu

SEQ ID NO: 185741 - RNA, 19 nt, Homo sapiens
ggaauuaugaaaccacuug

SEQ ID NO: 185742 - RNA, 19 nt, Homo sapiens
gcacaggaauuaugaaacc

SEQ ID NO: 185743 - RNA, 19 nt, Homo sapiens
aaucaaagaugugugaguu

SEQ ID NO: 185744 - RNA, 19 nt, Homo sapiens
ugauguaucuggaaacugu

SEQ ID NO: 185745 - RNA, 19 nt, Homo sapiens
gagaagcuaaugaguuauu

SEQ ID NO: 185746 - RNA, 19 nt, Homo sapiens
gauucaaaccugcauauug

SEQ ID NO: 185747 - RNA, 19 nt, Homo sapiens
ugauagagguguaugcaau

SEQ ID NO: 185748 - RNA, 19 nt, Homo sapiens
gcgcagagccacagcaaga

SEQ ID NO: 185749 - RNA, 19 nt, Homo sapiens
agagaucuguccuuuaaau

SEQ ID NO: 185750 - RNA, 19 nt, Homo sapiens
gaggugguacuaugauuaa

SEQ ID NO: 185751 - RNA, 19 nt, Homo sapiens
ugauaucacuucuucuaga

SEQ ID NO: 185752 - RNA, 19 nt, Homo sapiens
aaugcgaccucccugaaua

SEQ ID NO: 185753 - RNA, 19 nt, Homo sapiens
uauaguggcacaggaauua

SEQ ID NO: 185754 - RNA, 19 nt, Homo sapiens
uggaaucacuugcaguuau

SEQ ID NO: 185755 - RNA, 19 nt, Homo sapiens
caugauaucacuucuucua

SEQ ID NO: 185756 - RNA, 19 nt, Homo sapiens
acugacaaaugcaaugaua

SEQ ID NO: 185757 - RNA, 19 nt, Homo sapiens
cugcauugcuguggaauuu

SEQ ID NO: 185758 - RNA, 19 nt, Homo sapiens
agacugauguaucuggaaa

SEQ ID NO: 185759 - RNA, 19 nt, Homo sapiens
ggugugaagaucuuuagua

SEQ ID NO: 185760 - RNA, 19 nt, Homo sapiens
ucaguuggcuuugaacaug

SEQ ID NO: 185761 - RNA, 19 nt, Homo sapiens
aaagugagagugaaccuaa

SEQ ID NO: 185762 - RNA, 19 nt, Homo sapiens
ggagaacugaggacuauuc

SEQ ID NO: 185763 - RNA, 19 nt, Homo sapiens
uggcaaagaaguagaguuu

SEQ ID NO: 185764 - RNA, 19 nt, Homo sapiens
uaguuuaccugugcaaauu

SEQ ID NO: 185765 - RNA, 19 nt, Homo sapiens
ggcaugguauaaggaaaua

SEQ ID NO: 185766 - RNA, 19 nt, Homo sapiens
auucaaaccugcauauugu

SEQ ID NO: 185767 - RNA, 19 nt, Homo sapiens
gauaaaagauggaacuucu

SEQ ID NO: 185768 - RNA, 19 nt, Homo sapiens
uaaacaauguacagacaca

SEQ ID NO: 185769 - RNA, 19 nt, Homo sapiens
ugacaaaugcaaugauaga

SEQ ID NO: 185770 - RNA, 19 nt, Homo sapiens
gagccacuauuauuuaugc

SEQ ID NO: 185771 - RNA, 19 nt, Homo sapiens
cauuggagcuuuggauaga

SEQ ID NO: 185772 - RNA, 19 nt, Homo sapiens
aaaccugcauauugugauu

SEQ ID NO: 185773 - RNA, 19 nt, Homo sapiens
auacuuggguuaugauugu

SEQ ID NO: 185774 - RNA, 19 nt, Homo sapiens
gaugugugaguucuucaua

SEQ ID NO: 185775 - RNA, 19 nt, Homo sapiens
gggcauccguguggacuga

SEQ ID NO: 185776 - RNA, 19 nt, Homo sapiens
gauauugccacauguagau

SEQ ID NO: 185777 - RNA, 19 nt, Homo sapiens
agaaacaugcugugauauu

SEQ ID NO: 185778 - RNA, 19 nt, Homo sapiens
gagaugccaugauaucacu

SEQ ID NO: 185779 - RNA, 19 nt, Homo sapiens
cugaaucaauggaucugua

SEQ ID NO: 185780 - RNA, 19 nt, Homo sapiens
gcagagccacagcaagauu

SEQ ID NO: 185781 - RNA, 19 nt, Homo sapiens
cauaagaaagcagauguuu

SEQ ID NO: 185782 - RNA, 19 nt, Homo sapiens
aaaagccacuguuacauuu

SEQ ID NO: 185783 - RNA, 19 nt, Homo sapiens
gaaagugagagugaaccua

SEQ ID NO: 185784 - RNA, 19 nt, Homo sapiens
ugcgaaaacugucuauuua

SEQ ID NO: 185785 - RNA, 19 nt, Homo sapiens
cccagugucuucacaauca

SEQ ID NO: 185786 - RNA, 19 nt, Homo sapiens
cucaggagcugucugcauu

SEQ ID NO: 185787 - RNA, 19 nt, Homo sapiens
ucaagagaucuguccuuua

SEQ ID NO: 185788 - RNA, 19 nt, Homo sapiens
ugaggugguacuaugauua

SEQ ID NO: 185789 - RNA, 19 nt, Homo sapiens
ugugaguucuucauacuug

SEQ ID NO: 185790 - RNA, 19 nt, Homo sapiens
uauaagugauucaggauac

SEQ ID NO: 185791 - RNA, 19 nt, Homo sapiens
gaaucaauggaucuguaua

SEQ ID NO: 185792 - RNA, 19 nt, Homo sapiens
guguaggccuuccuuugaa

SEQ ID NO: 185793 - RNA, 19 nt, Homo sapiens
caaucagccucgcuuagau

SEQ ID NO: 185794 - RNA, 19 nt, Homo sapiens
uaauugaagggaaaccaua

SEQ ID NO: 185795 - RNA, 19 nt, Homo sapiens
ccugaaaggcgcuacauug

SEQ ID NO: 185796 - RNA, 19 nt, Homo sapiens
guauaagugauucaggaua

SEQ ID NO: 185797 - RNA, 19 nt, Homo sapiens
cgaaaacugucuauuuaug

SEQ ID NO: 185798 - RNA, 19 nt, Homo sapiens
uccaagagccacuauuauu

SEQ ID NO: 185799 - RNA, 19 nt, Homo sapiens
uggaaacugugguauaagu

SEQ ID NO: 185800 - RNA, 19 nt, Homo sapiens
cguguggacugaaucaaug

SEQ ID NO: 185801 - RNA, 19 nt, Homo sapiens
gaaaaccacuauguucaga

SEQ ID NO: 185802 - RNA, 19 nt, Homo sapiens
gaagugcccuuaaggauca

SEQ ID NO: 185803 - RNA, 19 nt, Homo sapiens
ccaaggagguggcuguuaa

SEQ ID NO: 185804 - RNA, 19 nt, Homo sapiens
gauuugaaguuccugaaua

SEQ ID NO: 185805 - RNA, 19 nt, Homo sapiens
uaaccgaguuugcuaaauu

SEQ ID NO: 185806 - RNA, 19 nt, Homo sapiens
ccacagcccuggaauaaau

SEQ ID NO: 185807 - RNA, 19 nt, Homo sapiens
ggacagauuugaggacuga

SEQ ID NO: 185808 - RNA, 19 nt, Homo sapiens
gaaagacgcucaggagaag

SEQ ID NO: 185809 - RNA, 19 nt, Homo sapiens
ggagcgagcugcugguguu

SEQ ID NO: 185810 - RNA, 19 nt, Homo sapiens
gcaacaaccugcucaucga

SEQ ID NO: 185811 - RNA, 19 nt, Homo sapiens
gaaacgagaagugcccuua

SEQ ID NO: 185812 - RNA, 19 nt, Homo sapiens
gaucagggauagcgcuguu

SEQ ID NO: 185813 - RNA, 19 nt, Homo sapiens
gggagaaguugagcaggua

SEQ ID NO: 185814 - RNA, 19 nt, Homo sapiens
ggagaacguuugguacaau

SEQ ID NO: 185815 - RNA, 19 nt, Homo sapiens
cgaguuugcuaaauugaga

SEQ ID NO: 185816 - RNA, 19 nt, Homo sapiens
gcaggugcauggucuucaa

SEQ ID NO: 185817 - RNA, 19 nt, Homo sapiens
ggagacugguuaggacaaa

SEQ ID NO: 185818 - RNA, 19 nt, Homo sapiens
aaacagacagggagaaguu

SEQ ID NO: 185819 - RNA, 19 nt, Homo sapiens
gacacuaggagacugguua

SEQ ID NO: 185820 - RNA, 19 nt, Homo sapiens
gcagaagaaggcacagauu

SEQ ID NO: 185821 - RNA, 19 nt, Homo sapiens
gcacgggccuguagaucag

SEQ ID NO: 185822 - RNA, 19 nt, Homo sapiens
gggaggagguucgggauuc

SEQ ID NO: 185823 - RNA, 19 nt, Homo sapiens
ugaaagacgcucaggagaa

SEQ ID NO: 185824 - RNA, 19 nt, Homo sapiens
gagaagugcccuuaaggau

SEQ ID NO: 185825 - RNA, 19 nt, Homo sapiens
cgacgucccuuggaucaga

SEQ ID NO: 185826 - RNA, 19 nt, Homo sapiens
gcaugcaggccaaggagua

SEQ ID NO: 185827 - RNA, 19 nt, Homo sapiens
caacgugccugagcucauc

SEQ ID NO: 185828 - RNA, 19 nt, Homo sapiens
ggguggugcugggucauua

SEQ ID NO: 185829 - RNA, 19 nt, Homo sapiens
gauaaccgaguuugcuaaa

SEQ ID NO: 185830 - RNA, 19 nt, Homo sapiens
gagaacguuugguacaauc

SEQ ID NO: 185831 - RNA, 19 nt, Homo sapiens
gugcugagccugcccaguu

SEQ ID NO: 185832 - RNA, 19 nt, Homo sapiens
ucuagacacuccuugaaau

SEQ ID NO: 185833 - RNA, 19 nt, Homo sapiens
ggauaaccgaguuugcuaa

SEQ ID NO: 185834 - RNA, 19 nt, Homo sapiens
gaguuugucugccucaagu

SEQ ID NO: 185835 - RNA, 19 nt, Homo sapiens
uaaguacagcugaugguuu

SEQ ID NO: 185836 - RNA, 19 nt, Homo sapiens
ccgccacccugucucagua

SEQ ID NO: 185837 - RNA, 19 nt, Homo sapiens
ccgucccgcuuucauguua

SEQ ID NO: 185838 - RNA, 19 nt, Homo sapiens
gcugggucauuacuucuga

SEQ ID NO: 185839 - RNA, 19 nt, Homo sapiens
ggugcugggucauuacuuc

SEQ ID NO: 185840 - RNA, 19 nt, Homo sapiens
cugaguacccggagccuua

SEQ ID NO: 185841 - RNA, 19 nt, Homo sapiens
gcacagauucgggccaaug

SEQ ID NO: 185842 - RNA, 19 nt, Homo sapiens
aaguacagcugaugguuuc

SEQ ID NO: 185843 - RNA, 19 nt, Homo sapiens
gcaagguuguagucaagag

SEQ ID NO: 185844 - RNA, 19 nt, Homo sapiens
ugaaguuccugaauaacca

SEQ ID NO: 185845 - RNA, 19 nt, Homo sapiens
gaaaugugugugugaugga

SEQ ID NO: 185846 - RNA, 19 nt, Homo sapiens
caacaaccugcucaucgaa

SEQ ID NO: 185847 - RNA, 19 nt, Homo sapiens
gccgugccaucaagucuga

SEQ ID NO: 185848 - RNA, 19 nt, Homo sapiens
cagaagaaggcacagauuc

SEQ ID NO: 185849 - RNA, 19 nt, Homo sapiens
agacacuccuugaaaugug

SEQ ID NO: 185850 - RNA, 19 nt, Homo sapiens
cgagaagugcccuuaagga

SEQ ID NO: 185851 - RNA, 19 nt, Homo sapiens
aaacgagaagugcccuuaa

SEQ ID NO: 185852 - RNA, 19 nt, Homo sapiens
gcugcaagaucgacaagac

SEQ ID NO: 185853 - RNA, 19 nt, Homo sapiens
ccaccugaccucugcaaga

SEQ ID NO: 185854 - RNA, 19 nt, Homo sapiens
aaccgaguuugcuaaauug

SEQ ID NO: 185855 - RNA, 19 nt, Homo sapiens
cccggacacucgccuacua

SEQ ID NO: 185856 - RNA, 19 nt, Homo sapiens
ggaaacagacagggagaag

SEQ ID NO: 185857 - RNA, 19 nt, Homo sapiens
gcaccugggcaacgagaug

SEQ ID NO: 185858 - RNA, 19 nt, Homo sapiens
ggacacucgccuacuaagu

SEQ ID NO: 185859 - RNA, 19 nt, Homo sapiens
cagccuggauuugaaguuc

SEQ ID NO: 185860 - RNA, 19 nt, Homo sapiens
gaacguuugguacaaucga

SEQ ID NO: 185861 - RNA, 19 nt, Homo sapiens
acaaccugcucaucgaaau

SEQ ID NO: 185862 - RNA, 19 nt, Homo sapiens
ggugcauggucuucaagga

SEQ ID NO: 185863 - RNA, 19 nt, Homo sapiens
ucaaguucaucauccucuu

SEQ ID NO: 185864 - RNA, 19 nt, Homo sapiens
gcgagcugcugguguucga

SEQ ID NO: 185865 - RNA, 19 nt, Homo sapiens
cgcaagcgcugucccuucu

SEQ ID NO: 185866 - RNA, 19 nt, Homo sapiens
gagcugcaagggcuucuuc

SEQ ID NO: 185867 - RNA, 19 nt, Homo sapiens
gaaacagacagggagaagu

SEQ ID NO: 185868 - RNA, 19 nt, Homo sapiens
acaagcaccugggcaacga

SEQ ID NO: 185869 - RNA, 19 nt, Homo sapiens
ggauuugaaguuccugaau

SEQ ID NO: 185870 - RNA, 19 nt, Homo sapiens
gggugggaaugcaagugaa

SEQ ID NO: 185871 - RNA, 19 nt, Homo sapiens
cuagacacuccuugaaaug

SEQ ID NO: 185872 - RNA, 19 nt, Homo sapiens
gagguggccgaccagauga

SEQ ID NO: 185873 - RNA, 19 nt, Homo sapiens
gagacccacagcccugaaa

SEQ ID NO: 185874 - RNA, 19 nt, Homo sapiens
gcuuggggauugccacuaa

SEQ ID NO: 185875 - RNA, 19 nt, Homo sapiens
gagggaaggggacagauuu

SEQ ID NO: 185876 - RNA, 19 nt, Homo sapiens
cugcaagguuguagucaag

SEQ ID NO: 185877 - RNA, 19 nt, Homo sapiens
ggcacgggccuguagauca

SEQ ID NO: 185878 - RNA, 19 nt, Homo sapiens
ccacuaaguacagcugaug

SEQ ID NO: 185879 - RNA, 19 nt, Homo sapiens
aggagaacguuugguacaa

SEQ ID NO: 185880 - RNA, 19 nt, Homo sapiens
gcacugcggggacaaauuc

SEQ ID NO: 185881 - RNA, 19 nt, Homo sapiens
aacgagaagugcccuuaag

SEQ ID NO: 185882 - RNA, 19 nt, Homo sapiens
ccgcuuucauguuacuguu

SEQ ID NO: 185883 - RNA, 19 nt, Homo sapiens
ucagggauagcgcuguuga

SEQ ID NO: 185884 - RNA, 19 nt, Homo sapiens
ucugcaagguuguagucaa

SEQ ID NO: 185885 - RNA, 19 nt, Homo sapiens
gcccugaaacagcagaaga

SEQ ID NO: 185886 - RNA, 19 nt, Homo sapiens
ggagaaguugagcagguau

SEQ ID NO: 185887 - RNA, 19 nt, Homo sapiens
caaccugcucaucgaaaug

SEQ ID NO: 185888 - RNA, 19 nt, Homo sapiens
gguguucgaccacaucuac

SEQ ID NO: 185889 - RNA, 19 nt, Homo sapiens
gggauugccacuaaguaca

SEQ ID NO: 185890 - RNA, 19 nt, Homo sapiens
caaguucaucauccucuuc

SEQ ID NO: 185891 - RNA, 19 nt, Homo sapiens
ggccuccugugcagaaugg

SEQ ID NO: 185892 - RNA, 19 nt, Homo sapiens
gcauggacuauucguacga

SEQ ID NO: 185893 - RNA, 19 nt, Homo sapiens
cuaccucuacccugccuuu

SEQ ID NO: 185894 - RNA, 19 nt, Homo sapiens
gaauggccgaccagaccuu

SEQ ID NO: 185895 - RNA, 19 nt, Homo sapiens
ggucaacucuucagaaauu

SEQ ID NO: 185896 - RNA, 19 nt, Homo sapiens
gggaauguccugauacuua

SEQ ID NO: 185897 - RNA, 19 nt, Homo sapiens
uaaaggaacugaguacauu

SEQ ID NO: 185898 - RNA, 19 nt, Homo sapiens
ggaaauggcugagcaucaa

SEQ ID NO: 185899 - RNA, 19 nt, Homo sapiens
gcaacuaucuucugaacau

SEQ ID NO: 185900 - RNA, 19 nt, Homo sapiens
ggagugaaguaaucauuug

SEQ ID NO: 185901 - RNA, 19 nt, Homo sapiens
ggaggcaacuaucuucuga

SEQ ID NO: 185902 - RNA, 19 nt, Homo sapiens
gaacauccgcuauggacua

SEQ ID NO: 185903 - RNA, 19 nt, Homo sapiens
gaacacaacaucuguaugg

SEQ ID NO: 185904 - RNA, 19 nt, Homo sapiens
ggauuugguuggugaauug

SEQ ID NO: 185905 - RNA, 19 nt, Homo sapiens
gcaccagcauugacaaguu

SEQ ID NO: 185906 - RNA, 19 nt, Homo sapiens
gggaggagguggaaggauu

SEQ ID NO: 185907 - RNA, 19 nt, Homo sapiens
ucaaagggaucggcuguuu

SEQ ID NO: 185908 - RNA, 19 nt, Homo sapiens
uaacaaugcugggaauuca

SEQ ID NO: 185909 - RNA, 19 nt, Homo sapiens
cugauaaccuacuugcuua

SEQ ID NO: 185910 - RNA, 19 nt, Homo sapiens
ccaacagucuuucugcaaa

SEQ ID NO: 185911 - RNA, 19 nt, Homo sapiens
ugagauccauugugauuau

SEQ ID NO: 185912 - RNA, 19 nt, Homo sapiens
gaguuugcuuggacuauaa

SEQ ID NO: 185913 - RNA, 19 nt, Homo sapiens
gagugggaauguccugaua

SEQ ID NO: 185914 - RNA, 19 nt, Homo sapiens
ugacaggagugaaguaauc

SEQ ID NO: 185915 - RNA, 19 nt, Homo sapiens
gcaaagggcaggagagcuu

SEQ ID NO: 185916 - RNA, 19 nt, Homo sapiens
guccacagauccagauaaa

SEQ ID NO: 185917 - RNA, 19 nt, Homo sapiens
cacaacaucuguaugguau

SEQ ID NO: 185918 - RNA, 19 nt, Homo sapiens
uaccucaacuacaaagaua

SEQ ID NO: 185919 - RNA, 19 nt, Homo sapiens
ggaauguccugauacuuac

SEQ ID NO: 185920 - RNA, 19 nt, Homo sapiens
uaaccuacuugcuuacuca

SEQ ID NO: 185921 - RNA, 19 nt, Homo sapiens
gagauccauugugauuaua

SEQ ID NO: 185922 - RNA, 19 nt, Homo sapiens
caaagggaucggcuguuua

SEQ ID NO: 185923 - RNA, 19 nt, Homo sapiens
auaacuaccucaacuacaa

SEQ ID NO: 185924 - RNA, 19 nt, Homo sapiens
gaucacaagugggagaugu

SEQ ID NO: 185925 - RNA, 19 nt, Homo sapiens
agauaaaggucucuucauc

SEQ ID NO: 185926 - RNA, 19 nt, Homo sapiens
caccagcauugacaaguuu

SEQ ID NO: 185927 - RNA, 19 nt, Homo sapiens
gccagaaaauggagucuua

SEQ ID NO: 185928 - RNA, 19 nt, Homo sapiens
uaucuacaauggaaucuuc

SEQ ID NO: 185929 - RNA, 19 nt, Homo sapiens
ggcauugucugauguuaca

SEQ ID NO: 185930 - RNA, 19 nt, Homo sapiens
gaggauacuauaacuguga

SEQ ID NO: 185931 - RNA, 19 nt, Homo sapiens
aaagauggacugauuguuc

SEQ ID NO: 185932 - RNA, 19 nt, Homo sapiens
aacuaaagauggacugauu

SEQ ID NO: 185933 - RNA, 19 nt, Homo sapiens
aggaugaggugguaguaaa

SEQ ID NO: 185934 - RNA, 19 nt, Homo sapiens
uaacagcuauaaaccugau

SEQ ID NO: 185935 - RNA, 19 nt, Homo sapiens
gagcuguacgaccuuguua

SEQ ID NO: 185936 - RNA, 19 nt, Homo sapiens
cauccacucuaucuacuug

SEQ ID NO: 185937 - RNA, 19 nt, Homo sapiens
gaagaggaacauccgcuau

SEQ ID NO: 185938 - RNA, 19 nt, Homo sapiens
ggaggagguggaaggauuu

SEQ ID NO: 185939 - RNA, 19 nt, Homo sapiens
ccacagauccagauaaagg

SEQ ID NO: 185940 - RNA, 19 nt, Homo sapiens
agaguuugcuuggacuaua

SEQ ID NO: 185941 - RNA, 19 nt, Homo sapiens
cuacaaagauaacaaugcu

SEQ ID NO: 185942 - RNA, 19 nt, Homo sapiens
gagaugugcaccagcauug

SEQ ID NO: 185943 - RNA, 19 nt, Homo sapiens
ugucaaggaugagguggua

SEQ ID NO: 185944 - RNA, 19 nt, Homo sapiens
aaacaaugccagagcugua

SEQ ID NO: 185945 - RNA, 19 nt, Homo sapiens
gggauuugguuggugaauu

SEQ ID NO: 185946 - RNA, 19 nt, Homo sapiens
uagcaucaguugucaccaa

SEQ ID NO: 185947 - RNA, 19 nt, Homo sapiens
ucuguucucugauaaccua

SEQ ID NO: 185948 - RNA, 19 nt, Homo sapiens
aagaggcgcugcucacugu

SEQ ID NO: 185949 - RNA, 19 nt, Homo sapiens
gauaaaggucucuucaucu

SEQ ID NO: 185950 - RNA, 19 nt, Homo sapiens
gaaaggcuucuugcuguug

SEQ ID NO: 185951 - RNA, 19 nt, Homo sapiens
caacuaucuucugaacauu

SEQ ID NO: 185952 - RNA, 19 nt, Homo sapiens
ccacaaauuuucuuucaug

SEQ ID NO: 185953 - RNA, 19 nt, Homo sapiens
gcuauaaaccugaucugau

SEQ ID NO: 185954 - RNA, 19 nt, Homo sapiens
ggaaauuaucuacaaugga

SEQ ID NO: 185955 - RNA, 19 nt, Homo sapiens
ucaacgaacuucucuucuc

SEQ ID NO: 185956 - RNA, 19 nt, Homo sapiens
aaagggaucggcuguuuau

SEQ ID NO: 185957 - RNA, 19 nt, Homo sapiens
gaaaagaacacaacaucug

SEQ ID NO: 185958 - RNA, 19 nt, Homo sapiens
ucaaccacaugcuauuuag

SEQ ID NO: 185959 - RNA, 19 nt, Homo sapiens
ccauugugauuauaucugu

SEQ ID NO: 185960 - RNA, 19 nt, Homo sapiens
ggaauucaaggagaucuga

SEQ ID NO: 185961 - RNA, 19 nt, Homo sapiens
gcucaaccacaugcuauuu

SEQ ID NO: 185962 - RNA, 19 nt, Homo sapiens
uaucaggucagcagaagaa

SEQ ID NO: 185963 - RNA, 19 nt, Homo sapiens
gauccauugugauuauauc

SEQ ID NO: 185964 - RNA, 19 nt, Homo sapiens
aaaggaacugaguacauua

SEQ ID NO: 185965 - RNA, 19 nt, Homo sapiens
acacaacaucuguauggua

SEQ ID NO: 185966 - RNA, 19 nt, Homo sapiens
gugauucugcucugucuuu

SEQ ID NO: 185967 - RNA, 19 nt, Homo sapiens
ccuacuugcuuacucaaug

SEQ ID NO: 185968 - RNA, 19 nt, Homo sapiens
ggagaugugcaccagcauu

SEQ ID NO: 185969 - RNA, 19 nt, Homo sapiens
caccauggaggauacuaua

SEQ ID NO: 185970 - RNA, 19 nt, Homo sapiens
ucauuugagugcaagaaga

SEQ ID NO: 185971 - RNA, 19 nt, Homo sapiens
guacaucacaaucauuucu

SEQ ID NO: 185972 - RNA, 19 nt, Homo sapiens
cuaaauggaccaaagaucu

SEQ ID NO: 185973 - RNA, 19 nt, Homo sapiens
gugaaguaaucauuugagu

SEQ ID NO: 185974 - RNA, 19 nt, Homo sapiens
aaagaacacaacaucugua

SEQ ID NO: 185975 - RNA, 19 nt, Homo sapiens
accacaugcuauuuaguua

SEQ ID NO: 185976 - RNA, 19 nt, Homo sapiens
acuauaccacucacucuua

SEQ ID NO: 185977 - RNA, 19 nt, Homo sapiens
auaaaggucucuucaucuc

SEQ ID NO: 185978 - RNA, 19 nt, Homo sapiens
gcugggaauucaaggagau

SEQ ID NO: 185979 - RNA, 19 nt, Homo sapiens
ucugagauccauugugauu

SEQ ID NO: 185980 - RNA, 19 nt, Homo sapiens
uaacuaccucaacuacaaa

SEQ ID NO: 185981 - RNA, 19 nt, Homo sapiens
gggaaauggcugagcauca

SEQ ID NO: 185982 - RNA, 19 nt, Homo sapiens
gggcuaucgucgugacaug

SEQ ID NO: 185983 - RNA, 19 nt, Homo sapiens
gcugacaggagugaaguaa

SEQ ID NO: 185984 - RNA, 19 nt, Homo sapiens
ccagauaaaggucucuuca

SEQ ID NO: 185985 - RNA, 19 nt, Homo sapiens
ggcuaucuaugccuccaaa

SEQ ID NO: 185986 - RNA, 19 nt, Homo sapiens
gcuucuugcuguugggaaa

SEQ ID NO: 185987 - RNA, 19 nt, Homo sapiens
uggaaauuaucuacaaugg

SEQ ID NO: 185988 - RNA, 19 nt, Homo sapiens
gaaagaggcgcugcucacu

SEQ ID NO: 185989 - RNA, 19 nt, Homo sapiens
ggacugauuguucccaucu

SEQ ID NO: 185990 - RNA, 19 nt, Homo sapiens
ccaaaauucgcuauguuua

SEQ ID NO: 185991 - RNA, 19 nt, Homo sapiens
uaagccaagucacccuguu

SEQ ID NO: 185992 - RNA, 19 nt, Homo sapiens
ucugauaaccuacuugcuu

SEQ ID NO: 185993 - RNA, 19 nt, Homo sapiens
gaaauggcugagcaucaau

SEQ ID NO: 185994 - RNA, 19 nt, Homo sapiens
cauccgcuauggacuauac

SEQ ID NO: 185995 - RNA, 19 nt, Homo sapiens
gaccauggcuggaggaaga

SEQ ID NO: 185996 - RNA, 19 nt, Homo sapiens
gcagccagaugcacccuua

SEQ ID NO: 185997 - RNA, 19 nt, Homo sapiens
ggaagaagaagaagccuau

SEQ ID NO: 185998 - RNA, 19 nt, Homo sapiens
gaagaagccuauggaugga

SEQ ID NO: 185999 - RNA, 19 nt, Homo sapiens
gaacuaacaauccuagaac

SEQ ID NO: 186000 - RNA, 19 nt, Homo sapiens
gaugagaacuaacaauccu

SEQ ID NO: 186001 - RNA, 19 nt, Homo sapiens
gaagaagaagccuauggau

SEQ ID NO: 186002 - RNA, 19 nt, Homo sapiens
ccagaugcacccuuaggua

SEQ ID NO: 186003 - RNA, 19 nt, Homo sapiens
gugcugaggaugagaacua

SEQ ID NO: 186004 - RNA, 19 nt, Homo sapiens
uggcagacccguccaagaa

SEQ ID NO: 186005 - RNA, 19 nt, Homo sapiens
gcagugcugaggaugagaa

SEQ ID NO: 186006 - RNA, 19 nt, Homo sapiens
gcuggaggaagaagaagaa

SEQ ID NO: 186007 - RNA, 19 nt, Homo sapiens
agaacuaacaauccuagaa

SEQ ID NO: 186008 - RNA, 19 nt, Homo sapiens
gacgagaugcagcgacuau

SEQ ID NO: 186009 - RNA, 19 nt, Homo sapiens
gcgacuauguguguaugug

SEQ ID NO: 186010 - RNA, 19 nt, Homo sapiens
gagaugcagcgacuaugug

SEQ ID NO: 186011 - RNA, 19 nt, Homo sapiens
agaagaagaagccuaugga

SEQ ID NO: 186012 - RNA, 19 nt, Homo sapiens
cgagaugcagcgacuaugu

SEQ ID NO: 186013 - RNA, 19 nt, Homo sapiens
guguguaugugcugaucuu

SEQ ID NO: 186014 - RNA, 19 nt, Homo sapiens
gcagcgacuauguguguau

SEQ ID NO: 186015 - RNA, 19 nt, Homo sapiens
ggcccagccucucaucauc

SEQ ID NO: 186016 - RNA, 19 nt, Homo sapiens
ucucugaagcuucuuggaa

SEQ ID NO: 186017 - RNA, 19 nt, Homo sapiens
gaggaugagaacuaacaau

SEQ ID NO: 186018 - RNA, 19 nt, Homo sapiens
cagcgacuauguguguaug

SEQ ID NO: 186019 - RNA, 19 nt, Homo sapiens
uguaugugcugaucuuugc

SEQ ID NO: 186020 - RNA, 19 nt, Homo sapiens
gaagaagaagaagccuaug

SEQ ID NO: 186021 - RNA, 19 nt, Homo sapiens
cuaacaauccuagaaccaa

SEQ ID NO: 186022 - RNA, 19 nt, Homo sapiens
ccuagaaccaagcuucaga

SEQ ID NO: 186023 - RNA, 19 nt, Homo sapiens
gaugcacccuuagguacag

SEQ ID NO: 186024 - RNA, 19 nt, Homo sapiens
ggagaggccguauuaauua

SEQ ID NO: 186025 - RNA, 19 nt, Homo sapiens
gaucaauccuccaugagua

SEQ ID NO: 186026 - RNA, 19 nt, Homo sapiens
gcagggagaggccguauua

SEQ ID NO: 186027 - RNA, 19 nt, Homo sapiens
ggacagcccaugauuaauu

SEQ ID NO: 186028 - RNA, 19 nt, Homo sapiens
guaaagaauucuccggaaa

SEQ ID NO: 186029 - RNA, 19 nt, Homo sapiens
caagaucaauccuccauga

SEQ ID NO: 186030 - RNA, 19 nt, Homo sapiens
gagcagcuauucuucuuau

SEQ ID NO: 186031 - RNA, 19 nt, Homo sapiens
gaacuucucuuggaggaau

SEQ ID NO: 186032 - RNA, 19 nt, Homo sapiens
gugagaauguuacaauuga

SEQ ID NO: 186033 - RNA, 19 nt, Homo sapiens
gcuauugacugguuugaug

SEQ ID NO: 186034 - RNA, 19 nt, Homo sapiens
ggacauggccucaaacgau

SEQ ID NO: 186035 - RNA, 19 nt, Homo sapiens
gggagaggccguauuaauu

SEQ ID NO: 186036 - RNA, 19 nt, Homo sapiens
gacagcccaugauuaauuu

SEQ ID NO: 186037 - RNA, 19 nt, Homo sapiens
gaccaaggaucacgucaug

SEQ ID NO: 186038 - RNA, 19 nt, Homo sapiens
gacauggccucaaacgauu

SEQ ID NO: 186039 - RNA, 19 nt, Homo sapiens
gcgcggacauggccucaaa

SEQ ID NO: 186040 - RNA, 19 nt, Homo sapiens
ggacagcagcaaagcuaua

SEQ ID NO: 186041 - RNA, 19 nt, Homo sapiens
gaacacaggcuauggaacu

SEQ ID NO: 186042 - RNA, 19 nt, Homo sapiens
aauaugaacuucucuugga

SEQ ID NO: 186043 - RNA, 19 nt, Homo sapiens
gcagauugguauuauuaag

SEQ ID NO: 186044 - RNA, 19 nt, Homo sapiens
ucaagcagauugguauuau

SEQ ID NO: 186045 - RNA, 19 nt, Homo sapiens
cgugguggcuucaauaaau

SEQ ID NO: 186046 - RNA, 19 nt, Homo sapiens
cagcagaguuacagugguu

SEQ ID NO: 186047 - RNA, 19 nt, Homo sapiens
caagcagauugguauuauu

SEQ ID NO: 186048 - RNA, 19 nt, Homo sapiens
cagagcagcuauucuucuu

SEQ ID NO: 186049 - RNA, 19 nt, Homo sapiens
gagaggccguauuaauuag

SEQ ID NO: 186050 - RNA, 19 nt, Homo sapiens
ugacccaccuucagcuaaa

SEQ ID NO: 186051 - RNA, 19 nt, Homo sapiens
cgggacagcccaugauuaa

SEQ ID NO: 186052 - RNA, 19 nt, Homo sapiens
cagcagugguggcuaugaa

SEQ ID NO: 186053 - RNA, 19 nt, Homo sapiens
uugagucuguggcugauua

SEQ ID NO: 186054 - RNA, 19 nt, Homo sapiens
gggugagaauguuacaauu

SEQ ID NO: 186055 - RNA, 19 nt, Homo sapiens
ugacugguuugaugguaaa

SEQ ID NO: 186056 - RNA, 19 nt, Homo sapiens
ggugagaauguuacaauug

SEQ ID NO: 186057 - RNA, 19 nt, Homo sapiens
gcucagcgguguuggaacu

SEQ ID NO: 186058 - RNA, 19 nt, Homo sapiens
gacaacaacaccaucuuug

SEQ ID NO: 186059 - RNA, 19 nt, Homo sapiens
uaaagaauucuccggaaau

SEQ ID NO: 186060 - RNA, 19 nt, Homo sapiens
aagcagcuauugacugguu

SEQ ID NO: 186061 - RNA, 19 nt, Homo sapiens
gauuauacccaacaagcaa

SEQ ID NO: 186062 - RNA, 19 nt, Homo sapiens
gugguggcuucaauaaauu

SEQ ID NO: 186063 - RNA, 19 nt, Homo sapiens
ggaaguuacgguagcaguu

SEQ ID NO: 186064 - RNA, 19 nt, Homo sapiens
gaaugaaugcaaccagugu

SEQ ID NO: 186065 - RNA, 19 nt, Homo sapiens
gacuggaaguguccuaauc

SEQ ID NO: 186066 - RNA, 19 nt, Homo sapiens
gcaacggucucuuuugaug

SEQ ID NO: 186067 - RNA, 19 nt, Homo sapiens
ggaacuucguugcuugcuu

SEQ ID NO: 186068 - RNA, 19 nt, Homo sapiens
gacagcagcaaagcuauaa

SEQ ID NO: 186069 - RNA, 19 nt, Homo sapiens
ggccagagcagcuauucuu

SEQ ID NO: 186070 - RNA, 19 nt, Homo sapiens
aaagaauucuccggaaauc

SEQ ID NO: 186071 - RNA, 19 nt, Homo sapiens
agacaacaacaccaucuuu

SEQ ID NO: 186072 - RNA, 19 nt, Homo sapiens
gucggacuauguaauugua

SEQ ID NO: 186073 - RNA, 19 nt, Homo sapiens
aaucccaccugugagaaua

SEQ ID NO: 186074 - RNA, 19 nt, Homo sapiens
ggacagcagcaaagcuaug

SEQ ID NO: 186075 - RNA, 19 nt, Homo sapiens
gaaguuacgguagcaguuc

SEQ ID NO: 186076 - RNA, 19 nt, Homo sapiens
guccuaaucccaccuguga

SEQ ID NO: 186077 - RNA, 19 nt, Homo sapiens
aaacgauuauacccaacaa

SEQ ID NO: 186078 - RNA, 19 nt, Homo sapiens
gaacaggauaauucagaca

SEQ ID NO: 186079 - RNA, 19 nt, Homo sapiens
gaccgugguggcuucaaua

SEQ ID NO: 186080 - RNA, 19 nt, Homo sapiens
cagcagaaccaguacaaca

SEQ ID NO: 186081 - RNA, 19 nt, Homo sapiens
acaagcaacccaaagcuau

SEQ ID NO: 186082 - RNA, 19 nt, Homo sapiens
guaacuauggccaagauca

SEQ ID NO: 186083 - RNA, 19 nt, Homo sapiens
ggagguggagguaacuaug

SEQ ID NO: 186084 - RNA, 19 nt, Homo sapiens
guggacagcagcaaagcua

SEQ ID NO: 186085 - RNA, 19 nt, Homo sapiens
gcagcuauucuucuuaugg

SEQ ID NO: 186086 - RNA, 19 nt, Homo sapiens
gucuguggcugauuacuuc

SEQ ID NO: 186087 - RNA, 19 nt, Homo sapiens
ccgcagcagugguggcuau

SEQ ID NO: 186088 - RNA, 19 nt, Homo sapiens
uaacuauggccaagaucaa

SEQ ID NO: 186089 - RNA, 19 nt, Homo sapiens
gaaugcaaccaguguaagg

SEQ ID NO: 186090 - RNA, 19 nt, Homo sapiens
cacggacacuucaggcuau

SEQ ID NO: 186091 - RNA, 19 nt, Homo sapiens
aucaaggucucauuugcua

SEQ ID NO: 186092 - RNA, 19 nt, Homo sapiens
gguuugaugguaaagaauu

SEQ ID NO: 186093 - RNA, 19 nt, Homo sapiens
gaugacccaccuucagcua

SEQ ID NO: 186094 - RNA, 19 nt, Homo sapiens
uggcagcgguggcuaugga

SEQ ID NO: 186095 - RNA, 19 nt, Homo sapiens
ggagguggagguggaggua

SEQ ID NO: 186096 - RNA, 19 nt, Homo sapiens
uaccucugguucccauuaa

SEQ ID NO: 186097 - RNA, 19 nt, Homo sapiens
ccuacggacagcagaguua

SEQ ID NO: 186098 - RNA, 19 nt, Homo sapiens
gacagcagaaccaguacaa

SEQ ID NO: 186099 - RNA, 19 nt, Homo sapiens
caagcaacccaaagcuaug

SEQ ID NO: 186100 - RNA, 19 nt, Homo sapiens
gagaauguuacaauugagu

SEQ ID NO: 186101 - RNA, 19 nt, Homo sapiens
caacaccaucuuugugcaa

SEQ ID NO: 186102 - RNA, 19 nt, Homo sapiens
caggauaauucagacaaca

SEQ ID NO: 186103 - RNA, 19 nt, Homo sapiens
ccgaacaggauaauucaga

SEQ ID NO: 186104 - RNA, 19 nt, Homo sapiens
ucucagagcagcagcuaug

SEQ ID NO: 186105 - RNA, 19 nt, Homo sapiens
aguguuacccucguuauuu

SEQ ID NO: 186106 - RNA, 19 nt, Homo sapiens
cagaggaggcuaugaucga

SEQ ID NO: 186107 - RNA, 19 nt, Homo sapiens
ccggaaauccuaucaaggu

SEQ ID NO: 186108 - RNA, 19 nt, Homo sapiens
gaauucuccggaaauccua

SEQ ID NO: 186109 - RNA, 19 nt, Homo sapiens
ccagaacacaggcuaugga

SEQ ID NO: 186110 - RNA, 19 nt, Homo sapiens
gcagaguuacagugguuau

SEQ ID NO: 186111 - RNA, 19 nt, Homo sapiens
cugguuugaugguaaagaa

SEQ ID NO: 186112 - RNA, 19 nt, Homo sapiens
gugcaaggccugggugaga

SEQ ID NO: 186113 - RNA, 19 nt, Homo sapiens
ugaccgugguggcuucaau

SEQ ID NO: 186114 - RNA, 19 nt, Homo sapiens
gcgguuauggcaaucaaga

SEQ ID NO: 186115 - RNA, 19 nt, Homo sapiens
gcagcaccucgggaaguua

SEQ ID NO: 186116 - RNA, 19 nt, Homo sapiens
gcccaugauuaauuuguac

SEQ ID NO: 186117 - RNA, 19 nt, Homo sapiens
cagaacacaggcuauggaa

SEQ ID NO: 186118 - RNA, 19 nt, Homo sapiens
cagcagcaaagcuauaauc

SEQ ID NO: 186119 - RNA, 19 nt, Homo sapiens
ccuaaucccaccugugaga

SEQ ID NO: 186120 - RNA, 19 nt, Homo sapiens
ggccugggugagaauguua

SEQ ID NO: 186121 - RNA, 19 nt, Homo sapiens
uguccuguacccaguguua

SEQ ID NO: 186122 - RNA, 19 nt, Homo sapiens
ccugugagaauaugaacuu

SEQ ID NO: 186123 - RNA, 19 nt, Homo sapiens
caugggccguggaggcuau

SEQ ID NO: 186124 - RNA, 19 nt, Homo sapiens
gaagaaaccuuaaacauag

SEQ ID NO: 186125 - RNA, 19 nt, Homo sapiens
gccaagagcuccauauauu

SEQ ID NO: 186126 - RNA, 19 nt, Homo sapiens
caagacagcuuuccacaug

SEQ ID NO: 186127 - RNA, 19 nt, Homo sapiens
gaaggaaguuggucuuugu

SEQ ID NO: 186128 - RNA, 19 nt, Homo sapiens
uaacuaaggugaagaaucu

SEQ ID NO: 186129 - RNA, 19 nt, Homo sapiens
gaacagauccgcagagagu

SEQ ID NO: 186130 - RNA, 19 nt, Homo sapiens
gagcaggagguaugaauua

SEQ ID NO: 186131 - RNA, 19 nt, Homo sapiens
gaaguagccugaucuuucu

SEQ ID NO: 186132 - RNA, 19 nt, Homo sapiens
gacgaggucuugugauauu

SEQ ID NO: 186133 - RNA, 19 nt, Homo sapiens
guaaucagaugggacagua

SEQ ID NO: 186134 - RNA, 19 nt, Homo sapiens
ggugaaagaagaaaccuua

SEQ ID NO: 186135 - RNA, 19 nt, Homo sapiens
gcaaaugggugcccguauc

SEQ ID NO: 186136 - RNA, 19 nt, Homo sapiens
aaacaaaccaucucuaguu

SEQ ID NO: 186137 - RNA, 19 nt, Homo sapiens
guaccgugcucauugcuaa

SEQ ID NO: 186138 - RNA, 19 nt, Homo sapiens
uaaugaaugugcaaccuaa

SEQ ID NO: 186139 - RNA, 19 nt, Homo sapiens
guaaucuucuuccuccaua

SEQ ID NO: 186140 - RNA, 19 nt, Homo sapiens
ggaguuacaguuacaauug

SEQ ID NO: 186141 - RNA, 19 nt, Homo sapiens
gcaagcagcucggccaugu

SEQ ID NO: 186142 - RNA, 19 nt, Homo sapiens
gcccauaucuacaguacuu

SEQ ID NO: 186143 - RNA, 19 nt, Homo sapiens
gggacuaucugcagguuau

SEQ ID NO: 186144 - RNA, 19 nt, Homo sapiens
uaucagggaguuacaguua

SEQ ID NO: 186145 - RNA, 19 nt, Homo sapiens
gagcaagcauucaccaagu

SEQ ID NO: 186146 - RNA, 19 nt, Homo sapiens
gaaagaagaaaccuuaaac

SEQ ID NO: 186147 - RNA, 19 nt, Homo sapiens
gcagguaccgugcucauug

SEQ ID NO: 186148 - RNA, 19 nt, Homo sapiens
gagggagacuuguucuaga

SEQ ID NO: 186149 - RNA, 19 nt, Homo sapiens
gcucauugcuaaccacugu

SEQ ID NO: 186150 - RNA, 19 nt, Homo sapiens
ugaaguagccugaucuuuc

SEQ ID NO: 186151 - RNA, 19 nt, Homo sapiens
gacggagucuugcucugua

SEQ ID NO: 186152 - RNA, 19 nt, Homo sapiens
uggagaagcuugugguguu

SEQ ID NO: 186153 - RNA, 19 nt, Homo sapiens
ucagaggccuggcaucuuc

SEQ ID NO: 186154 - RNA, 19 nt, Homo sapiens
caagugaagaaucuaauga

SEQ ID NO: 186155 - RNA, 19 nt, Homo sapiens
gagaggaccagguuugaug

SEQ ID NO: 186156 - RNA, 19 nt, Homo sapiens
gggaacagauccgcagaga

SEQ ID NO: 186157 - RNA, 19 nt, Homo sapiens
ggaguacgcggacuugaga

SEQ ID NO: 186158 - RNA, 19 nt, Homo sapiens
gagagauccuuuccugaag

SEQ ID NO: 186159 - RNA, 19 nt, Homo sapiens
caaccuaauuguagcaucu

SEQ ID NO: 186160 - RNA, 19 nt, Homo sapiens
gggaagaggcgcagagugu

SEQ ID NO: 186161 - RNA, 19 nt, Homo sapiens
gaguuacaguuacaauugu

SEQ ID NO: 186162 - RNA, 19 nt, Homo sapiens
ugaaggaaguuggucuuug

SEQ ID NO: 186163 - RNA, 19 nt, Homo sapiens
ugagagauccuuuccugaa

SEQ ID NO: 186164 - RNA, 19 nt, Homo sapiens
gcaggagguaugaauuaaa

SEQ ID NO: 186165 - RNA, 19 nt, Homo sapiens
ggagugcaguggcgugauc

SEQ ID NO: 186166 - RNA, 19 nt, Homo sapiens
ccagauaacuaaggugaag

SEQ ID NO: 186167 - RNA, 19 nt, Homo sapiens
ggagaagcuugugguguuc

SEQ ID NO: 186168 - RNA, 19 nt, Homo sapiens
ccaagagcuccauauauug

SEQ ID NO: 186169 - RNA, 19 nt, Homo sapiens
aacaaaccaucucuaguug

SEQ ID NO: 186170 - RNA, 19 nt, Homo sapiens
uguagcaucuaaugaaugu

SEQ ID NO: 186171 - RNA, 19 nt, Homo sapiens
ccagggcgaugugacguuu

SEQ ID NO: 186172 - RNA, 19 nt, Homo sapiens
gaagugugcagguauaaac

SEQ ID NO: 186173 - RNA, 19 nt, Homo sapiens
gaacucucccucuggucua

SEQ ID NO: 186174 - RNA, 19 nt, Homo sapiens
gcucauaaacugccaagag

SEQ ID NO: 186175 - RNA, 19 nt, Homo sapiens
ugagagagcaggagguaug

SEQ ID NO: 186176 - RNA, 19 nt, Homo sapiens
gggcaggucugagauaaaa

SEQ ID NO: 186177 - RNA, 19 nt, Homo sapiens
gaaaacaaaccaucucuag

SEQ ID NO: 186178 - RNA, 19 nt, Homo sapiens
gugaagaaucuaaugaaug

SEQ ID NO: 186179 - RNA, 19 nt, Homo sapiens
caaguccccuucuguguuu

SEQ ID NO: 186180 - RNA, 19 nt, Homo sapiens
ccgagugggugggcauuaa

SEQ ID NO: 186181 - RNA, 19 nt, Homo sapiens
caagagcuccauauauugg

SEQ ID NO: 186182 - RNA, 19 nt, Homo sapiens
gacguuugcuggcgaugga

SEQ ID NO: 186183 - RNA, 19 nt, Homo sapiens
caggagguaugaauuaaaa

SEQ ID NO: 186184 - RNA, 19 nt, Homo sapiens
gagagcaggagguaugaau

SEQ ID NO: 186185 - RNA, 19 nt, Homo sapiens
ugaaugugcaaccuaauug

SEQ ID NO: 186186 - RNA, 19 nt, Homo sapiens
ccaaagugcugggauuacu

SEQ ID NO: 186187 - RNA, 19 nt, Homo sapiens
gcccguauccagagugauu

SEQ ID NO: 186188 - RNA, 19 nt, Homo sapiens
gcuagucuguguccucucu

SEQ ID NO: 186189 - RNA, 19 nt, Homo sapiens
ggacuuucuuccaccaucu

SEQ ID NO: 186190 - RNA, 19 nt, Homo sapiens
ggaagugugcagguauaaa

SEQ ID NO: 186191 - RNA, 19 nt, Homo sapiens
cuggaagugugcagguaua

SEQ ID NO: 186192 - RNA, 19 nt, Homo sapiens
gaaauccagauaacuaagg

SEQ ID NO: 186193 - RNA, 19 nt, Homo sapiens
ugaaggagcauaugauugc

SEQ ID NO: 186194 - RNA, 19 nt, Homo sapiens
ggugagagagcaggaggua

SEQ ID NO: 186195 - RNA, 19 nt, Homo sapiens
gggaguuacaguuacaauu

SEQ ID NO: 186196 - RNA, 19 nt, Homo sapiens
caacuuccgccuccugugu

SEQ ID NO: 186197 - RNA, 19 nt, Homo sapiens
ggcauggagugguguaaag

SEQ ID NO: 186198 - RNA, 19 nt, Homo sapiens
ggacuugagagauccuuuc

SEQ ID NO: 186199 - RNA, 19 nt, Homo sapiens
ucagggaguuacaguuaca

SEQ ID NO: 186200 - RNA, 19 nt, Homo sapiens
gaaugugcaaccuaauugu

SEQ ID NO: 186201 - RNA, 19 nt, Homo sapiens
ccagggagacuuucugaag

SEQ ID NO: 186202 - RNA, 19 nt, Homo sapiens
uguccucucuguaaucuuc

SEQ ID NO: 186203 - RNA, 19 nt, Homo sapiens
cagugcaaccacaccauua

SEQ ID NO: 186204 - RNA, 19 nt, Homo sapiens
ggcaggccauggacugguu

SEQ ID NO: 186205 - RNA, 19 nt, Homo sapiens
cuaauuguagcaucuaaug

SEQ ID NO: 186206 - RNA, 19 nt, Homo sapiens
cuagagaggaccagguuug

SEQ ID NO: 186207 - RNA, 19 nt, Homo sapiens
agacugaaggagcauauga

SEQ ID NO: 186208 - RNA, 19 nt, Homo sapiens
gaacuagcaaaacaucuuu

SEQ ID NO: 186209 - RNA, 19 nt, Homo sapiens
uauauugggugugaguuca

SEQ ID NO: 186210 - RNA, 19 nt, Homo sapiens
cuccauauauuggguguga

SEQ ID NO: 186211 - RNA, 19 nt, Homo sapiens
gugcccagcccggauauuu

SEQ ID NO: 186212 - RNA, 19 nt, Homo sapiens
gauucuagagggagacuug

SEQ ID NO: 186213 - RNA, 19 nt, Homo sapiens
gauucuaguugggagaguu

SEQ ID NO: 186214 - RNA, 19 nt, Homo sapiens
ugagagccagggagacuuu

SEQ ID NO: 186215 - RNA, 19 nt, Homo sapiens
gagagagcaggagguauga

SEQ ID NO: 186216 - RNA, 19 nt, Homo sapiens
ggacccagccucagaucca

SEQ ID NO: 186217 - RNA, 19 nt, Homo sapiens
guauaaacacacccucugu

SEQ ID NO: 186218 - RNA, 19 nt, Homo sapiens
uggaaaagcugggguaguu

SEQ ID NO: 186219 - RNA, 19 nt, Homo sapiens
gccagcgucuugcucuguu

SEQ ID NO: 186220 - RNA, 19 nt, Homo sapiens
ccaagugaagaaucuaaug

SEQ ID NO: 186221 - RNA, 19 nt, Homo sapiens
cuacaggcacaggccauua

SEQ ID NO: 186222 - RNA, 19 nt, Homo sapiens
aagcgauucuccugucuca

SEQ ID NO: 186223 - RNA, 19 nt, Homo sapiens
ggaaauccagauaacuaag

SEQ ID NO: 186224 - RNA, 19 nt, Homo sapiens
ccaucuaccuggccaauua

SEQ ID NO: 186225 - RNA, 19 nt, Homo sapiens
gggaggaccuguucacuau

SEQ ID NO: 186226 - RNA, 19 nt, Homo sapiens
ggaaccagaugggcgagua

SEQ ID NO: 186227 - RNA, 19 nt, Homo sapiens
ccacagccgucaagggauu

SEQ ID NO: 186228 - RNA, 19 nt, Homo sapiens
gaggaccuguucacuauca

SEQ ID NO: 186229 - RNA, 19 nt, Homo sapiens
gggaggaggcccagaaguu

SEQ ID NO: 186230 - RNA, 19 nt, Homo sapiens
cuacagcucccucaucuuc

SEQ ID NO: 186231 - RNA, 19 nt, Homo sapiens
ggaggaggcccagaaguuc

SEQ ID NO: 186232 - RNA, 19 nt, Homo sapiens
gcgaguacgccacgcugua

SEQ ID NO: 186233 - RNA, 19 nt, Homo sapiens
caccuucuacuucgucuuu

SEQ ID NO: 186234 - RNA, 19 nt, Homo sapiens
gcagaacuaccaccugaac

SEQ ID NO: 186235 - RNA, 19 nt, Homo sapiens
cgacuccccuuuccucaaa

SEQ ID NO: 186236 - RNA, 19 nt, Homo sapiens
cuacuucgucuuugccauu

SEQ ID NO: 186237 - RNA, 19 nt, Homo sapiens
cgggaggaccuguucacua

SEQ ID NO: 186238 - RNA, 19 nt, Homo sapiens
gggcggagacaccaucuac

SEQ ID NO: 186239 - RNA, 19 nt, Homo sapiens
uguaaccacaccaucauga

SEQ ID NO: 186240 - RNA, 19 nt, Homo sapiens
uguacgcccuggccaagau

SEQ ID NO: 186241 - RNA, 19 nt, Homo sapiens
gcccuuccuucuccaccuu

SEQ ID NO: 186242 - RNA, 19 nt, Homo sapiens
ggugucgggagaacauuga

SEQ ID NO: 186243 - RNA, 19 nt, Homo sapiens
cgcuacagcucccucaucu

SEQ ID NO: 186244 - RNA, 19 nt, Homo sapiens
agaacuaccaccugaacga

SEQ ID NO: 186245 - RNA, 19 nt, Homo sapiens
gaaccuuggugugaacuua

SEQ ID NO: 186246 - RNA, 19 nt, Homo sapiens
ggaaauugcugcugucuac

SEQ ID NO: 186247 - RNA, 19 nt, Homo sapiens
gcaaagcaguaauuaguca

SEQ ID NO: 186248 - RNA, 19 nt, Homo sapiens
gaccacgucucuaaauaaa

SEQ ID NO: 186249 - RNA, 19 nt, Homo sapiens
ugacguaauuccaucuuaa

SEQ ID NO: 186250 - RNA, 19 nt, Homo sapiens
caaccaccaugucauuuga

SEQ ID NO: 186251 - RNA, 19 nt, Homo sapiens
guuaagagcucagaguuca

SEQ ID NO: 186252 - RNA, 19 nt, Homo sapiens
gguucuggcugauuuguuu

SEQ ID NO: 186253 - RNA, 19 nt, Homo sapiens
ggacauggccuuuccacau

SEQ ID NO: 186254 - RNA, 19 nt, Homo sapiens
ggugugaacuuaggucuug

SEQ ID NO: 186255 - RNA, 19 nt, Homo sapiens
ugauugaggccaagaguua

SEQ ID NO: 186256 - RNA, 19 nt, Homo sapiens
caggugggaucgacuguaa

SEQ ID NO: 186257 - RNA, 19 nt, Homo sapiens
gaucaucacggcacgguuu

SEQ ID NO: 186258 - RNA, 19 nt, Homo sapiens
uaaaugaggacuucuggaa

SEQ ID NO: 186259 - RNA, 19 nt, Homo sapiens
uaggagaggcugccauaua

SEQ ID NO: 186260 - RNA, 19 nt, Homo sapiens
aggagaggcugccauauau

SEQ ID NO: 186261 - RNA, 19 nt, Homo sapiens
ccagagaccuugccacacu

SEQ ID NO: 186262 - RNA, 19 nt, Homo sapiens
gacauggccuuuccacauc

SEQ ID NO: 186263 - RNA, 19 nt, Homo sapiens
gauguaauacugcaaggaa

SEQ ID NO: 186264 - RNA, 19 nt, Homo sapiens
gcaguaauuagucaaaguu

SEQ ID NO: 186265 - RNA, 19 nt, Homo sapiens
ggauaucgauggcuuagcu

SEQ ID NO: 186266 - RNA, 19 nt, Homo sapiens
gaggacuucuggaacauuc

SEQ ID NO: 186267 - RNA, 19 nt, Homo sapiens
ucagacagguccaaguuca

SEQ ID NO: 186268 - RNA, 19 nt, Homo sapiens
gcaaccaccaugucauuug

SEQ ID NO: 186269 - RNA, 19 nt, Homo sapiens
ccgagaagcuguggaggaa

SEQ ID NO: 186270 - RNA, 19 nt, Homo sapiens
gugaauccauuuaagauac

SEQ ID NO: 186271 - RNA, 19 nt, Homo sapiens
ccacuuugaauguauauga

SEQ ID NO: 186272 - RNA, 19 nt, Homo sapiens
gugcaaagcaguaauuagu

SEQ ID NO: 186273 - RNA, 19 nt, Homo sapiens
gagaggcugccauauauca

SEQ ID NO: 186274 - RNA, 19 nt, Homo sapiens
ugaugguucuggcugauuu

SEQ ID NO: 186275 - RNA, 19 nt, Homo sapiens
ugcaggagcuggacaagga

SEQ ID NO: 186276 - RNA, 19 nt, Homo sapiens
ugacgugucuccucacucu

SEQ ID NO: 186277 - RNA, 19 nt, Homo sapiens
uggccaacccucucucuua

SEQ ID NO: 186278 - RNA, 19 nt, Homo sapiens
gaacauuccaaauauucug

SEQ ID NO: 186279 - RNA, 19 nt, Homo sapiens
gagguaggaggauugauug

SEQ ID NO: 186280 - RNA, 19 nt, Homo sapiens
ugagguaggaggauugauu

SEQ ID NO: 186281 - RNA, 19 nt, Homo sapiens
ucaggccacuuugaaugua

SEQ ID NO: 186282 - RNA, 19 nt, Homo sapiens
aaugaggacuucuggaaca

SEQ ID NO: 186283 - RNA, 19 nt, Homo sapiens
guucagacagguccaaguu

SEQ ID NO: 186284 - RNA, 19 nt, Homo sapiens
ggguuggucccauggguua

SEQ ID NO: 186285 - RNA, 19 nt, Homo sapiens
ggccaacccucucucuuac

SEQ ID NO: 186286 - RNA, 19 nt, Homo sapiens
gugcaccacugggauauca

SEQ ID NO: 186287 - RNA, 19 nt, Homo sapiens
gaaagcaggcaaccaccau

SEQ ID NO: 186288 - RNA, 19 nt, Homo sapiens
ugggaucgacuguaaauga

SEQ ID NO: 186289 - RNA, 19 nt, Homo sapiens
gcugguggcuguguguuuc

SEQ ID NO: 186290 - RNA, 19 nt, Homo sapiens
gcaggcaaccaccauguca

SEQ ID NO: 186291 - RNA, 19 nt, Homo sapiens
gcucacgccuguaauucca

SEQ ID NO: 186292 - RNA, 19 nt, Homo sapiens
gggaucgacuguaaaugag

SEQ ID NO: 186293 - RNA, 19 nt, Homo sapiens
ggaucugguucaacuugga

SEQ ID NO: 186294 - RNA, 19 nt, Homo sapiens
gcugggcacuggauuucug

SEQ ID NO: 186295 - RNA, 19 nt, Homo sapiens
ccgacuacaucaccgagaa

SEQ ID NO: 186296 - RNA, 19 nt, Homo sapiens
ccuaggagaggcugccaua

SEQ ID NO: 186297 - RNA, 19 nt, Homo sapiens
ccaagggugcaaagcagua

SEQ ID NO: 186298 - RNA, 19 nt, Homo sapiens
cugacguaauuccaucuua

SEQ ID NO: 186299 - RNA, 19 nt, Homo sapiens
aaucuacccuccugaaggu

SEQ ID NO: 186300 - RNA, 19 nt, Homo sapiens
cccaggaccaccacuuaua

SEQ ID NO: 186301 - RNA, 19 nt, Homo sapiens
gaagcaacuacgagagguu

SEQ ID NO: 186302 - RNA, 19 nt, Homo sapiens
cggcuugguucaccugaga

SEQ ID NO: 186303 - RNA, 19 nt, Homo sapiens
acagugaauccauuuaaga

SEQ ID NO: 186304 - RNA, 19 nt, Homo sapiens
gacuguaaaugaggacuuc

SEQ ID NO: 186305 - RNA, 19 nt, Homo sapiens
guacggacgcucccacaag

SEQ ID NO: 186306 - RNA, 19 nt, Homo sapiens
cagccagggugcgcuacua

SEQ ID NO: 186307 - RNA, 19 nt, Homo sapiens
cagcgacuccgacaucuuc

SEQ ID NO: 186308 - RNA, 19 nt, Homo sapiens
ggugggaucgacuguaaau

SEQ ID NO: 186309 - RNA, 19 nt, Homo sapiens
gcacgguuuccagauguaa

SEQ ID NO: 186310 - RNA, 19 nt, Homo sapiens
ggcacgguuuccagaugua

SEQ ID NO: 186311 - RNA, 19 nt, Homo sapiens
cugcaaggccugcuggaaa

SEQ ID NO: 186312 - RNA, 19 nt, Homo sapiens
gcaccacugggauaucaug

SEQ ID NO: 186313 - RNA, 19 nt, Homo sapiens
cccauacagugaauccauu

SEQ ID NO: 186314 - RNA, 19 nt, Homo sapiens
acaguuucaucgggauaua

SEQ ID NO: 186315 - RNA, 19 nt, Homo sapiens
gcaaggcuuagaccaguuc

SEQ ID NO: 186316 - RNA, 19 nt, Homo sapiens
gauugaggccaagaguuaa

SEQ ID NO: 186317 - RNA, 19 nt, Homo sapiens
uaagagcucagaguucaga

SEQ ID NO: 186318 - RNA, 19 nt, Homo sapiens
gcugauuuguuugugaugu

SEQ ID NO: 186319 - RNA, 19 nt, Homo sapiens
gcuggaggcugcaccuacu

SEQ ID NO: 186320 - RNA, 19 nt, Homo sapiens
cauacagugaauccauuua

SEQ ID NO: 186321 - RNA, 19 nt, Homo sapiens
gacguaauuccaucuuaau

SEQ ID NO: 186322 - RNA, 19 nt, Homo sapiens
ccaggaccaccacuuauag

SEQ ID NO: 186323 - RNA, 19 nt, Homo sapiens
gaugacgugucuccucacu

SEQ ID NO: 186324 - RNA, 19 nt, Homo sapiens
ccauacagugaauccauuu

SEQ ID NO: 186325 - RNA, 19 nt, Homo sapiens
gggaaauugcugcugucua

SEQ ID NO: 186326 - RNA, 19 nt, Homo sapiens
ggguuaagagcucagaguu

SEQ ID NO: 186327 - RNA, 19 nt, Homo sapiens
cggcacgguuuccagaugu

SEQ ID NO: 186328 - RNA, 19 nt, Homo sapiens
gggugcaaagcaguaauua

SEQ ID NO: 186329 - RNA, 19 nt, Homo sapiens
gagacgcugucccgguaca

SEQ ID NO: 186330 - RNA, 19 nt, Homo sapiens
uggccgcacugcuauuuca

SEQ ID NO: 186331 - RNA, 19 nt, Homo sapiens
uacagugaauccauuuaag

SEQ ID NO: 186332 - RNA, 19 nt, Homo sapiens
ccagaaccuuggugugaac

SEQ ID NO: 186333 - RNA, 19 nt, Homo sapiens
caagggugcaaagcaguaa

SEQ ID NO: 186334 - RNA, 19 nt, Homo sapiens
aauugcugcugucuacaaa

SEQ ID NO: 186335 - RNA, 19 nt, Homo sapiens
caggccacuuugaauguau

SEQ ID NO: 186336 - RNA, 19 nt, Homo sapiens
cagugaauccauuuaagau

SEQ ID NO: 186337 - RNA, 19 nt, Homo sapiens
ccuggucaauauagcaaga

SEQ ID NO: 186338 - RNA, 19 nt, Homo sapiens
ggagaggcugccauauauc

SEQ ID NO: 186339 - RNA, 19 nt, Homo sapiens
gguuaagagcucagaguuc

SEQ ID NO: 186340 - RNA, 19 nt, Homo sapiens
guucucaccucagggguua

SEQ ID NO: 186341 - RNA, 19 nt, Homo sapiens
ugauuuguuugugauguug

SEQ ID NO: 186342 - RNA, 19 nt, Homo sapiens
gaccuugccacacugaauc

SEQ ID NO: 186343 - RNA, 19 nt, Homo sapiens
ccugcaggcucaucucaag

SEQ ID NO: 186344 - RNA, 19 nt, Homo sapiens
acugggauaucauguccaa

SEQ ID NO: 186345 - RNA, 19 nt, Homo sapiens
ggaggaaacuuaagaugaa

SEQ ID NO: 186346 - RNA, 19 nt, Homo sapiens
gaaacccuauggagaauuu

SEQ ID NO: 186347 - RNA, 19 nt, Homo sapiens
gaauagucaucuccuaauu

SEQ ID NO: 186348 - RNA, 19 nt, Homo sapiens
guacggcgcugaucaccua

SEQ ID NO: 186349 - RNA, 19 nt, Homo sapiens
ggaguaaguucuucaaaca

SEQ ID NO: 186350 - RNA, 19 nt, Homo sapiens
ggaguucaguauuuaauga

SEQ ID NO: 186351 - RNA, 19 nt, Homo sapiens
ggaccaaggugaagcaaau

SEQ ID NO: 186352 - RNA, 19 nt, Homo sapiens
caacugagccaacauguga

SEQ ID NO: 186353 - RNA, 19 nt, Homo sapiens
caaguaaccucuucaacug

SEQ ID NO: 186354 - RNA, 19 nt, Homo sapiens
uaaaucaagucccaaauuc

SEQ ID NO: 186355 - RNA, 19 nt, Homo sapiens
gcagaacagugaaagguau

SEQ ID NO: 186356 - RNA, 19 nt, Homo sapiens
gaaggaagccauaguguca

SEQ ID NO: 186357 - RNA, 19 nt, Homo sapiens
gcagaaaugaaauagcuua

SEQ ID NO: 186358 - RNA, 19 nt, Homo sapiens
gagcuacgcuguccacauc

SEQ ID NO: 186359 - RNA, 19 nt, Homo sapiens
gcaaauuugugguuguaga

SEQ ID NO: 186360 - RNA, 19 nt, Homo sapiens
ggacuuuguuguuuggauu

SEQ ID NO: 186361 - RNA, 19 nt, Homo sapiens
uuacuggaccugaaauuua

SEQ ID NO: 186362 - RNA, 19 nt, Homo sapiens
gagagagaaucaagaguag

SEQ ID NO: 186363 - RNA, 19 nt, Homo sapiens
gaagcaaauuugugguugu

SEQ ID NO: 186364 - RNA, 19 nt, Homo sapiens
gagaauuuaucccuuuaca

SEQ ID NO: 186365 - RNA, 19 nt, Homo sapiens
gcaaguaaccucuucaacu

SEQ ID NO: 186366 - RNA, 19 nt, Homo sapiens
ugagagagaaucaagagua

SEQ ID NO: 186367 - RNA, 19 nt, Homo sapiens
guaccucacuuuacauaag

SEQ ID NO: 186368 - RNA, 19 nt, Homo sapiens
gaaaccggaucaguugaga

SEQ ID NO: 186369 - RNA, 19 nt, Homo sapiens
uacuggaccugaaauuuaa

SEQ ID NO: 186370 - RNA, 19 nt, Homo sapiens
gaaagguauugcacuacau

SEQ ID NO: 186371 - RNA, 19 nt, Homo sapiens
gaggcgguuuccugaauuu

SEQ ID NO: 186372 - RNA, 19 nt, Homo sapiens
gagggaaaccggaucaguu

SEQ ID NO: 186373 - RNA, 19 nt, Homo sapiens
acacaacuguucccgauuc

SEQ ID NO: 186374 - RNA, 19 nt, Homo sapiens
cggcugcgcuucaacauca

SEQ ID NO: 186375 - RNA, 19 nt, Homo sapiens
auagucaucuccuaauuug

SEQ ID NO: 186376 - RNA, 19 nt, Homo sapiens
cugaaaagcugcauuuaaa

SEQ ID NO: 186377 - RNA, 19 nt, Homo sapiens
gcacuacauuauggaauca

SEQ ID NO: 186378 - RNA, 19 nt, Homo sapiens
gggaguaaguucuucaaac

SEQ ID NO: 186379 - RNA, 19 nt, Homo sapiens
ugaaagguauugcacuaca

SEQ ID NO: 186380 - RNA, 19 nt, Homo sapiens
uggagaauuuaucccuuua

SEQ ID NO: 186381 - RNA, 19 nt, Homo sapiens
uggauuauaucaccgagaa

SEQ ID NO: 186382 - RNA, 19 nt, Homo sapiens
cgcagcaccuggauuauau

SEQ ID NO: 186383 - RNA, 19 nt, Homo sapiens
aagcaaauuugugguugua

SEQ ID NO: 186384 - RNA, 19 nt, Homo sapiens
gugcagaaaugaaauagcu

SEQ ID NO: 186385 - RNA, 19 nt, Homo sapiens
guauugcacuacauuaugg

SEQ ID NO: 186386 - RNA, 19 nt, Homo sapiens
ggugggacuuuguuguuug

SEQ ID NO: 186387 - RNA, 19 nt, Homo sapiens
gcccagaccgugccaacua

SEQ ID NO: 186388 - RNA, 19 nt, Homo sapiens
gugaauagucaucuccuaa

SEQ ID NO: 186389 - RNA, 19 nt, Homo sapiens
ucacaaguacuaucuguuc

SEQ ID NO: 186390 - RNA, 19 nt, Homo sapiens
ggacgucuuugugccuuau

SEQ ID NO: 186391 - RNA, 19 nt, Homo sapiens
ggcauuacccucugcagaa

SEQ ID NO: 186392 - RNA, 19 nt, Homo sapiens
gaggaaacuuaagaugaau

SEQ ID NO: 186393 - RNA, 19 nt, Homo sapiens
ugcgaagccuggcaaguaa

SEQ ID NO: 186394 - RNA, 19 nt, Homo sapiens
aaucaagaguagcggauga

SEQ ID NO: 186395 - RNA, 19 nt, Homo sapiens
aaugaaacccuauggagaa

SEQ ID NO: 186396 - RNA, 19 nt, Homo sapiens
uuccaaaucucauacacaa

SEQ ID NO: 186397 - RNA, 19 nt, Homo sapiens
uaauauuacucagcacaga

SEQ ID NO: 186398 - RNA, 19 nt, Homo sapiens
ccaaauucauugacuuagg

SEQ ID NO: 186399 - RNA, 19 nt, Homo sapiens
cgcggcagcugcuuuagaa

SEQ ID NO: 186400 - RNA, 19 nt, Homo sapiens
caaauuugugguuguagaa

SEQ ID NO: 186401 - RNA, 19 nt, Homo sapiens
ccuaauuuguuucuucugu

SEQ ID NO: 186402 - RNA, 19 nt, Homo sapiens
gguauugcacuacauuaug

SEQ ID NO: 186403 - RNA, 19 nt, Homo sapiens
gagaaggaagccauagugu

SEQ ID NO: 186404 - RNA, 19 nt, Homo sapiens
ccagugcagaaaugaaaua

SEQ ID NO: 186405 - RNA, 19 nt, Homo sapiens
uguaaccagugcagaaaug

SEQ ID NO: 186406 - RNA, 19 nt, Homo sapiens
acucgcagcaccuggauua

SEQ ID NO: 186407 - RNA, 19 nt, Homo sapiens
ggacucggacgucuuugug

SEQ ID NO: 186408 - RNA, 19 nt, Homo sapiens
ugaggcgguuuccugaauu

SEQ ID NO: 186409 - RNA, 19 nt, Homo sapiens
caauugggcucccuuugcu

SEQ ID NO: 186410 - RNA, 19 nt, Homo sapiens
gaaaagcugcauuuaaauc

SEQ ID NO: 186411 - RNA, 19 nt, Homo sapiens
uaccucacuuuacauaaga

SEQ ID NO: 186412 - RNA, 19 nt, Homo sapiens
uggaggaaacuuaagauga

SEQ ID NO: 186413 - RNA, 19 nt, Homo sapiens
ccggaucaguugagagaga

SEQ ID NO: 186414 - RNA, 19 nt, Homo sapiens
caacuacgagcgcuuugug

SEQ ID NO: 186415 - RNA, 19 nt, Homo sapiens
ugucacuuccacacaauua

SEQ ID NO: 186416 - RNA, 19 nt, Homo sapiens
cugcgaagccuggcaagua

SEQ ID NO: 186417 - RNA, 19 nt, Homo sapiens
gaagagaaggaagccauag

SEQ ID NO: 186418 - RNA, 19 nt, Homo sapiens
ucaagucccaaauucauug

SEQ ID NO: 186419 - RNA, 19 nt, Homo sapiens
cuaccuggcuuucgagaac

SEQ ID NO: 186420 - RNA, 19 nt, Homo sapiens
gcagagggaaaccggauca

SEQ ID NO: 186421 - RNA, 19 nt, Homo sapiens
ucacuuccacacaauuauu

SEQ ID NO: 186422 - RNA, 19 nt, Homo sapiens
ucccaaauucauugacuua

SEQ ID NO: 186423 - RNA, 19 nt, Homo sapiens
ggaaacuuaagaugaauac

SEQ ID NO: 186424 - RNA, 19 nt, Homo sapiens
gaggagggcaguccaagag

SEQ ID NO: 186425 - RNA, 19 nt, Homo sapiens
ccaaggugaagcaaauuug

SEQ ID NO: 186426 - RNA, 19 nt, Homo sapiens
ccaaaucucauacacaacu

SEQ ID NO: 186427 - RNA, 19 nt, Homo sapiens
gcagcuuccaaaucucaua

SEQ ID NO: 186428 - RNA, 19 nt, Homo sapiens
gguucuuccucaccuugua

SEQ ID NO: 186429 - RNA, 19 nt, Homo sapiens
gucaucuccuaauuuguuu

SEQ ID NO: 186430 - RNA, 19 nt, Homo sapiens
agucaucuccuaauuuguu

SEQ ID NO: 186431 - RNA, 19 nt, Homo sapiens
gaaauguauuccugaaaag

SEQ ID NO: 186432 - RNA, 19 nt, Homo sapiens
ccgcugacuucuuucacaa

SEQ ID NO: 186433 - RNA, 19 nt, Homo sapiens
guucuucaaacacccauuu

SEQ ID NO: 186434 - RNA, 19 nt, Homo sapiens
gaggccaaguugucagcuu

SEQ ID NO: 186435 - RNA, 19 nt, Homo sapiens
ucgcagcaccuggauuaua

SEQ ID NO: 186436 - RNA, 19 nt, Homo sapiens
aaagguauugcacuacauu

SEQ ID NO: 186437 - RNA, 19 nt, Homo sapiens
ccugaaauuuaaacugcaa

SEQ ID NO: 186438 - RNA, 19 nt, Homo sapiens
ggaccugaaauuuaaacug

SEQ ID NO: 186439 - RNA, 19 nt, Homo sapiens
aggccaaguugucagcuuu

SEQ ID NO: 186440 - RNA, 19 nt, Homo sapiens
ucuccuaauuuguuucuuc

SEQ ID NO: 186441 - RNA, 19 nt, Homo sapiens
auggagaauuuaucccuuu

SEQ ID NO: 186442 - RNA, 19 nt, Homo sapiens
ggguuuggaugaacuucga

SEQ ID NO: 186443 - RNA, 19 nt, Homo sapiens
gcaggugggacuuuguugu

SEQ ID NO: 186444 - RNA, 19 nt, Homo sapiens
caaggugaagcaaauuugu

SEQ ID NO: 186445 - RNA, 19 nt, Homo sapiens
caagggagcuggauguguu

SEQ ID NO: 186446 - RNA, 19 nt, Homo sapiens
uuucauagcugagugauau

SEQ ID NO: 186447 - RNA, 19 nt, Homo sapiens
gcggaugggugucacaaau

SEQ ID NO: 186448 - RNA, 19 nt, Homo sapiens
uggaagcccuggacggaua

SEQ ID NO: 186449 - RNA, 19 nt, Homo sapiens
ccagagaccuugccacacu

SEQ ID NO: 186450 - RNA, 19 nt, Homo sapiens
ggauggaucacacuagcua

SEQ ID NO: 186451 - RNA, 19 nt, Homo sapiens
ugagugauauuccauugug

SEQ ID NO: 186452 - RNA, 19 nt, Homo sapiens
gcugagugauauuccauug

SEQ ID NO: 186453 - RNA, 19 nt, Homo sapiens
ccgagaagcuguggaggaa

SEQ ID NO: 186454 - RNA, 19 nt, Homo sapiens
gauagugccuguggaugug

SEQ ID NO: 186455 - RNA, 19 nt, Homo sapiens
ugcaggagcuggacaagga

SEQ ID NO: 186456 - RNA, 19 nt, Homo sapiens
ccacugggauaucauguac

SEQ ID NO: 186457 - RNA, 19 nt, Homo sapiens
gacggauacuucaaucuca

SEQ ID NO: 186458 - RNA, 19 nt, Homo sapiens
ggugcaggcugguuugcuu

SEQ ID NO: 186459 - RNA, 19 nt, Homo sapiens
gagaacgggugcccuugag

SEQ ID NO: 186460 - RNA, 19 nt, Homo sapiens
ggaggagggcgaaggguau

SEQ ID NO: 186461 - RNA, 19 nt, Homo sapiens
ggacggauacuucaaucuc

SEQ ID NO: 186462 - RNA, 19 nt, Homo sapiens
ggaugggugucacaaaugc

SEQ ID NO: 186463 - RNA, 19 nt, Homo sapiens
gugcaccacugggauauca

SEQ ID NO: 186464 - RNA, 19 nt, Homo sapiens
gcgaaggguauguguguga

SEQ ID NO: 186465 - RNA, 19 nt, Homo sapiens
gcugguggcuguguguuuc

SEQ ID NO: 186466 - RNA, 19 nt, Homo sapiens
gggcgaaggguaugugugu

SEQ ID NO: 186467 - RNA, 19 nt, Homo sapiens
ccgacuacaucaccgagaa

SEQ ID NO: 186468 - RNA, 19 nt, Homo sapiens
cagauaaugcuguuaacau

SEQ ID NO: 186469 - RNA, 19 nt, Homo sapiens
cugaggaucucggcuguug

SEQ ID NO: 186470 - RNA, 19 nt, Homo sapiens
uggccaggcaugugacuua

SEQ ID NO: 186471 - RNA, 19 nt, Homo sapiens
gaagcaacuacgagagguu

SEQ ID NO: 186472 - RNA, 19 nt, Homo sapiens
gaccucggcgugacucuga

SEQ ID NO: 186473 - RNA, 19 nt, Homo sapiens
cggcuugguucaccugaga

SEQ ID NO: 186474 - RNA, 19 nt, Homo sapiens
gcugggcacuggcuuucug

SEQ ID NO: 186475 - RNA, 19 nt, Homo sapiens
acugggauaucauguacaa

SEQ ID NO: 186476 - RNA, 19 nt, Homo sapiens
cacugaaugucaccugcua

SEQ ID NO: 186477 - RNA, 19 nt, Homo sapiens
ggaucacacuagcuacucu

SEQ ID NO: 186478 - RNA, 19 nt, Homo sapiens
guacggacgcucccacaag

SEQ ID NO: 186479 - RNA, 19 nt, Homo sapiens
cagcgacuccgacaucuuc

SEQ ID NO: 186480 - RNA, 19 nt, Homo sapiens
cagcaguggugugcacaug

SEQ ID NO: 186481 - RNA, 19 nt, Homo sapiens
gaccuugccacacugaaug

SEQ ID NO: 186482 - RNA, 19 nt, Homo sapiens
gcaccacugggauaucaug

SEQ ID NO: 186483 - RNA, 19 nt, Homo sapiens
cggcgugacucugauagug

SEQ ID NO: 186484 - RNA, 19 nt, Homo sapiens
caacugccggcaccuggaa

SEQ ID NO: 186485 - RNA, 19 nt, Homo sapiens
gagacgcugucccgguaca

SEQ ID NO: 186486 - RNA, 19 nt, Homo sapiens
ugagaacgggugcccuuga

SEQ ID NO: 186487 - RNA, 19 nt, Homo sapiens
ugauagugccuguggaugu

SEQ ID NO: 186488 - RNA, 19 nt, Homo sapiens
gagugauauuccauugugu

SEQ ID NO: 186489 - RNA, 19 nt, Homo sapiens
ccugcaggcucaucucaag

SEQ ID NO: 186490 - RNA, 19 nt, Homo sapiens
caugaggggugcaaacaga

SEQ ID NO: 186491 - RNA, 19 nt, Homo sapiens
gcaggcugguuugcuugug

SEQ ID NO: 186492 - RNA, 19 nt, Homo sapiens
ccagacggugcgcagcaua

SEQ ID NO: 186493 - RNA, 19 nt, Homo sapiens
gcagcgacuccgacaucuu

SEQ ID NO: 186494 - RNA, 19 nt, Homo sapiens
gauggugcaggcugguuug

SEQ ID NO: 186495 - RNA, 19 nt, Homo sapiens
gcccaagggagcuggaugu

SEQ ID NO: 186496 - RNA, 19 nt, Homo sapiens
ggaucugguucagcaugga

SEQ ID NO: 186497 - RNA, 19 nt, Homo sapiens
gauaaucaccgcaccguuu

SEQ ID NO: 186498 - RNA, 19 nt, Homo sapiens
ugaaagccauggacggaua

SEQ ID NO: 186499 - RNA, 19 nt, Homo sapiens
gagcaagacuccaucucaa

SEQ ID NO: 186500 - RNA, 19 nt, Homo sapiens
gugaaacccgucucuauua

SEQ ID NO: 186501 - RNA, 19 nt, Homo sapiens
ugaaacccgucucuauuaa

SEQ ID NO: 186502 - RNA, 19 nt, Homo sapiens
gagccaagaucgcgccauu

SEQ ID NO: 186503 - RNA, 19 nt, Homo sapiens
gguucuggcugauuuguuu

SEQ ID NO: 186504 - RNA, 19 nt, Homo sapiens
gauguaauacugcaaagaa

SEQ ID NO: 186505 - RNA, 19 nt, Homo sapiens
ucacauggcucccuauugc

SEQ ID NO: 186506 - RNA, 19 nt, Homo sapiens
ggugaaacccgucucuauu

SEQ ID NO: 186507 - RNA, 19 nt, Homo sapiens
cuaccuggguccucacuuu

SEQ ID NO: 186508 - RNA, 19 nt, Homo sapiens
ugaccacgcugcuguuuca

SEQ ID NO: 186509 - RNA, 19 nt, Homo sapiens
gaugacagguguggugguu

SEQ ID NO: 186510 - RNA, 19 nt, Homo sapiens
gaaacccgucucuauuaaa

SEQ ID NO: 186511 - RNA, 19 nt, Homo sapiens
ccgagaagcuguggaggaa

SEQ ID NO: 186512 - RNA, 19 nt, Homo sapiens
gcugauggcuguguguuuc

SEQ ID NO: 186513 - RNA, 19 nt, Homo sapiens
gaaggaaaggcggaaggua

SEQ ID NO: 186514 - RNA, 19 nt, Homo sapiens
caggaaauauuuggugaug

SEQ ID NO: 186515 - RNA, 19 nt, Homo sapiens
ggaagcuucugccaccaau

SEQ ID NO: 186516 - RNA, 19 nt, Homo sapiens
ugaugguucuggcugauuu

SEQ ID NO: 186517 - RNA, 19 nt, Homo sapiens
ugcaggagcuggacaagga

SEQ ID NO: 186518 - RNA, 19 nt, Homo sapiens
gagagcaucugaaaacaug

SEQ ID NO: 186519 - RNA, 19 nt, Homo sapiens
gacggauacuucaaucuca

SEQ ID NO: 186520 - RNA, 19 nt, Homo sapiens
gcaggagaauggugugaac

SEQ ID NO: 186521 - RNA, 19 nt, Homo sapiens
gagaccauccuggccaaua

SEQ ID NO: 186522 - RNA, 19 nt, Homo sapiens
cacugaaucucaccugcua

SEQ ID NO: 186523 - RNA, 19 nt, Homo sapiens
gaaaggcggaagguagaaa

SEQ ID NO: 186524 - RNA, 19 nt, Homo sapiens
gaagagagcaucugaaaac

SEQ ID NO: 186525 - RNA, 19 nt, Homo sapiens
caaagaaaaccaaugauga

SEQ ID NO: 186526 - RNA, 19 nt, Homo sapiens
cagagaccuuccacacuga

SEQ ID NO: 186527 - RNA, 19 nt, Homo sapiens
ggccucaucuaccuaagga

SEQ ID NO: 186528 - RNA, 19 nt, Homo sapiens
ggacguggccuuuuaacaa

SEQ ID NO: 186529 - RNA, 19 nt, Homo sapiens
agaccauccuggccaauau

SEQ ID NO: 186530 - RNA, 19 nt, Homo sapiens
ggacggauacuucaaucuc

SEQ ID NO: 186531 - RNA, 19 nt, Homo sapiens
agucuucgguggccaggua

SEQ ID NO: 186532 - RNA, 19 nt, Homo sapiens
ggaaacugcaggaggaauc

SEQ ID NO: 186533 - RNA, 19 nt, Homo sapiens
cuuccaagguucaugaguu

SEQ ID NO: 186534 - RNA, 19 nt, Homo sapiens
guaccagacacgcggcaua

SEQ ID NO: 186535 - RNA, 19 nt, Homo sapiens
ccucagaauccagcuguua

SEQ ID NO: 186536 - RNA, 19 nt, Homo sapiens
caaaucccuucacccuguu

SEQ ID NO: 186537 - RNA, 19 nt, Homo sapiens
acuuagugcucaggaaaua

SEQ ID NO: 186538 - RNA, 19 nt, Homo sapiens
gcaaagaaaaccaaugaug

SEQ ID NO: 186539 - RNA, 19 nt, Homo sapiens
cgacagagcaagacuccau

SEQ ID NO: 186540 - RNA, 19 nt, Homo sapiens
ccgacuacaucaccgagaa

SEQ ID NO: 186541 - RNA, 19 nt, Homo sapiens
ccucuagcaucucccagaa

SEQ ID NO: 186542 - RNA, 19 nt, Homo sapiens
aaagccacaucgcauugaa

SEQ ID NO: 186543 - RNA, 19 nt, Homo sapiens
ccagauguaauacugcaaa

SEQ ID NO: 186544 - RNA, 19 nt, Homo sapiens
gauccagugcauccucuuu

SEQ ID NO: 186545 - RNA, 19 nt, Homo sapiens
ucaaagccacaucgcauug

SEQ ID NO: 186546 - RNA, 19 nt, Homo sapiens
gcccaccgguuuccugcaa

SEQ ID NO: 186547 - RNA, 19 nt, Homo sapiens
ugagacuccuccugcaguu

SEQ ID NO: 186548 - RNA, 19 nt, Homo sapiens
aaacccgucucuauuaaaa

SEQ ID NO: 186549 - RNA, 19 nt, Homo sapiens
gaagcaacuacgagagguu

SEQ ID NO: 186550 - RNA, 19 nt, Homo sapiens
accgagaggucauguacaa

SEQ ID NO: 186551 - RNA, 19 nt, Homo sapiens
gacguggccuuuuaacaaa

SEQ ID NO: 186552 - RNA, 19 nt, Homo sapiens
gcaagacuccaucucaaaa

SEQ ID NO: 186553 - RNA, 19 nt, Homo sapiens
cggcuugguucaccugaga

SEQ ID NO: 186554 - RNA, 19 nt, Homo sapiens
gcugggcacucgcuuucug

SEQ ID NO: 186555 - RNA, 19 nt, Homo sapiens
gcauagcucccuggacuuc

SEQ ID NO: 186556 - RNA, 19 nt, Homo sapiens
cagguguggugguuggaaa

SEQ ID NO: 186557 - RNA, 19 nt, Homo sapiens
gaucacaaggucaggagau

SEQ ID NO: 186558 - RNA, 19 nt, Homo sapiens
guacggacgcucccacaag

SEQ ID NO: 186559 - RNA, 19 nt, Homo sapiens
cagcgacuccgacaucuuc

SEQ ID NO: 186560 - RNA, 19 nt, Homo sapiens
ucguggcgcugcugucuga

SEQ ID NO: 186561 - RNA, 19 nt, Homo sapiens
ggaaaggcggaagguagaa

SEQ ID NO: 186562 - RNA, 19 nt, Homo sapiens
ccaccgguuuccugcaaga

SEQ ID NO: 186563 - RNA, 19 nt, Homo sapiens
gucaggagaucgagaccau

SEQ ID NO: 186564 - RNA, 19 nt, Homo sapiens
ccuguaaucccagcacuuu

SEQ ID NO: 186565 - RNA, 19 nt, Homo sapiens
cugcaaggccugcuggaaa

SEQ ID NO: 186566 - RNA, 19 nt, Homo sapiens
ccgagucccucuagcaucu

SEQ ID NO: 186567 - RNA, 19 nt, Homo sapiens
guacacuuccuccuuccuu

SEQ ID NO: 186568 - RNA, 19 nt, Homo sapiens
guucaugaguugccugacu

SEQ ID NO: 186569 - RNA, 19 nt, Homo sapiens
gcugauuuguuugugaugu

SEQ ID NO: 186570 - RNA, 19 nt, Homo sapiens
gaagcuucugccaccaaua

SEQ ID NO: 186571 - RNA, 19 nt, Homo sapiens
caaagccacaucgcauuga

SEQ ID NO: 186572 - RNA, 19 nt, Homo sapiens
gaaauucugcucacuuccu

SEQ ID NO: 186573 - RNA, 19 nt, Homo sapiens
aaggccauauguuuaauca

SEQ ID NO: 186574 - RNA, 19 nt, Homo sapiens
ucccuggacuucugcuuug

SEQ ID NO: 186575 - RNA, 19 nt, Homo sapiens
aagacgaucccacugugua

SEQ ID NO: 186576 - RNA, 19 nt, Homo sapiens
ggccagguaugucccuuac

SEQ ID NO: 186577 - RNA, 19 nt, Homo sapiens
uuccaagguucaugaguug

SEQ ID NO: 186578 - RNA, 19 nt, Homo sapiens
ccgcaccguuuccagaugu

SEQ ID NO: 186579 - RNA, 19 nt, Homo sapiens
gagacgcugucccgguaca

SEQ ID NO: 186580 - RNA, 19 nt, Homo sapiens
ggugaugggccaacugagu

SEQ ID NO: 186581 - RNA, 19 nt, Homo sapiens
uuagugcucaggaaauauu

SEQ ID NO: 186582 - RNA, 19 nt, Homo sapiens
cugggacggucaccuguug

SEQ ID NO: 186583 - RNA, 19 nt, Homo sapiens
aagcuucugccaccaauau

SEQ ID NO: 186584 - RNA, 19 nt, Homo sapiens
ucccuuggccuggcacuua

SEQ ID NO: 186585 - RNA, 19 nt, Homo sapiens
agagcaagacuccaucuca

SEQ ID NO: 186586 - RNA, 19 nt, Homo sapiens
ugauuuguuugugauguug

SEQ ID NO: 186587 - RNA, 19 nt, Homo sapiens
ucugcucacuuccucauuc

SEQ ID NO: 186588 - RNA, 19 nt, Homo sapiens
ggaaggaaaggcggaaggu

SEQ ID NO: 186589 - RNA, 19 nt, Homo sapiens
cgaggcaggcggaucacaa

SEQ ID NO: 186590 - RNA, 19 nt, Homo sapiens
cugauuuguuugugauguu

SEQ ID NO: 186591 - RNA, 19 nt, Homo sapiens
ggaauccagguaccagaca

SEQ ID NO: 186592 - RNA, 19 nt, Homo sapiens
gagguggagcuugcaguga

SEQ ID NO: 186593 - RNA, 19 nt, Homo sapiens
guuuccagauguaauacug

SEQ ID NO: 186594 - RNA, 19 nt, Homo sapiens
cagcugggcacucgcuuuc

SEQ ID NO: 186595 - RNA, 19 nt, Homo sapiens
ccaccgagaggucauguac

SEQ ID NO: 186596 - RNA, 19 nt, Homo sapiens
cagacgggauccagugcau

SEQ ID NO: 186597 - RNA, 19 nt, Homo sapiens
ggagggcgguggacaauaa

SEQ ID NO: 186598 - RNA, 19 nt, Homo sapiens
gcacagaggucaggaagca

SEQ ID NO: 186599 - RNA, 19 nt, Homo sapiens
gggagacuguggaugaaua

SEQ ID NO: 186600 - RNA, 19 nt, Homo sapiens
gggcguagcugugauuuca

SEQ ID NO: 186601 - RNA, 19 nt, Homo sapiens
gcgacuacauuacggagaa

SEQ ID NO: 186602 - RNA, 19 nt, Homo sapiens
gcuucuaccuguccuuuga

SEQ ID NO: 186603 - RNA, 19 nt, Homo sapiens
ggacaucuuugugcccuau

SEQ ID NO: 186604 - RNA, 19 nt, Homo sapiens
gaacguuucugugccaucu

SEQ ID NO: 186605 - RNA, 19 nt, Homo sapiens
ucaacugggugcugagcua

SEQ ID NO: 186606 - RNA, 19 nt, Homo sapiens
cagcaccgcgacuacauua

SEQ ID NO: 186607 - RNA, 19 nt, Homo sapiens
ggagacuguggaugaauaa

SEQ ID NO: 186608 - RNA, 19 nt, Homo sapiens
gcgcgacucggacaucuuu

SEQ ID NO: 186609 - RNA, 19 nt, Homo sapiens
gagcaaaccagcuuguucu

SEQ ID NO: 186610 - RNA, 19 nt, Homo sapiens
ggagcaaaccagcuuguuc

SEQ ID NO: 186611 - RNA, 19 nt, Homo sapiens
auaaacgucugagcaguga

SEQ ID NO: 186612 - RNA, 19 nt, Homo sapiens
gaaugagagccgauaccaa

SEQ ID NO: 186613 - RNA, 19 nt, Homo sapiens
ggaccuugaggguugguuu

SEQ ID NO: 186614 - RNA, 19 nt, Homo sapiens
ccaagucuaugaggaccuu

SEQ ID NO: 186615 - RNA, 19 nt, Homo sapiens
gacuguggaugaauaaugc

SEQ ID NO: 186616 - RNA, 19 nt, Homo sapiens
aaacgucugagcagugaaa

SEQ ID NO: 186617 - RNA, 19 nt, Homo sapiens
cgacuacauuacggagaaa

SEQ ID NO: 186618 - RNA, 19 nt, Homo sapiens
ggcacuggcccuucacuga

SEQ ID NO: 186619 - RNA, 19 nt, Homo sapiens
ccugggagacuguggauga

SEQ ID NO: 186620 - RNA, 19 nt, Homo sapiens
ggugaaggccuggcuggaa

SEQ ID NO: 186621 - RNA, 19 nt, Homo sapiens
gcaugaaugagagccgaua

SEQ ID NO: 186622 - RNA, 19 nt, Homo sapiens
gagagugggagggagguaa

SEQ ID NO: 186623 - RNA, 19 nt, Homo sapiens
gccaauggacggccacugu

SEQ ID NO: 186624 - RNA, 19 nt, Homo sapiens
ggaagggcugggugucgaa

SEQ ID NO: 186625 - RNA, 19 nt, Homo sapiens
gcuggcggcuuuccucacu

SEQ ID NO: 186626 - RNA, 19 nt, Homo sapiens
gaagggcugggugucgaaa

SEQ ID NO: 186627 - RNA, 19 nt, Homo sapiens
agacuguggaugaauaaug

SEQ ID NO: 186628 - RNA, 19 nt, Homo sapiens
ccgauaccaacgcuucuuu

SEQ ID NO: 186629 - RNA, 19 nt, Homo sapiens
cuacauuacggagaaauuc

SEQ ID NO: 186630 - RNA, 19 nt, Homo sapiens
gcuggaagagggugaaagg

SEQ ID NO: 186631 - RNA, 19 nt, Homo sapiens
gcugggugucgaaaucaaa

SEQ ID NO: 186632 - RNA, 19 nt, Homo sapiens
gggagggcgguggacaaua

SEQ ID NO: 186633 - RNA, 19 nt, Homo sapiens
uuuccucacuggcaugaau

SEQ ID NO: 186634 - RNA, 19 nt, Homo sapiens
gaaaugaacuccaaagaca

SEQ ID NO: 186635 - RNA, 19 nt, Homo sapiens
gaacagcuccuuacucuga

SEQ ID NO: 186636 - RNA, 19 nt, Homo sapiens
gacaaacacugccauauug

SEQ ID NO: 186637 - RNA, 19 nt, Homo sapiens
ggaaguugauucuuauuug

SEQ ID NO: 186638 - RNA, 19 nt, Homo sapiens
ggcaauuacugucucauua

SEQ ID NO: 186639 - RNA, 19 nt, Homo sapiens
gaacuuagaaggaaaugaa

SEQ ID NO: 186640 - RNA, 19 nt, Homo sapiens
ccaaagacaugcagaugaa

SEQ ID NO: 186641 - RNA, 19 nt, Homo sapiens
uaacauaucuucagaaucc

SEQ ID NO: 186642 - RNA, 19 nt, Homo sapiens
agaugacccuucuuuauua

SEQ ID NO: 186643 - RNA, 19 nt, Homo sapiens
ucauugaccucaucauuaa

SEQ ID NO: 186644 - RNA, 19 nt, Homo sapiens
gaaauaaagcucagaugga

SEQ ID NO: 186645 - RNA, 19 nt, Homo sapiens
gagaauggacguuugguuu

SEQ ID NO: 186646 - RNA, 19 nt, Homo sapiens
caacaaaggcuguggcuau

SEQ ID NO: 186647 - RNA, 19 nt, Homo sapiens
ccauacaagucuauaauga

SEQ ID NO: 186648 - RNA, 19 nt, Homo sapiens
ggacauccaugacccuaau

SEQ ID NO: 186649 - RNA, 19 nt, Homo sapiens
cugaggaaguugauucuua

SEQ ID NO: 186650 - RNA, 19 nt, Homo sapiens
aaauaaagcucagauggaa

SEQ ID NO: 186651 - RNA, 19 nt, Homo sapiens
gcucugaucuaacaaaaua

SEQ ID NO: 186652 - RNA, 19 nt, Homo sapiens
ggaaaagaauuaccccaua

SEQ ID NO: 186653 - RNA, 19 nt, Homo sapiens
acaaugccaugaacaaauu

SEQ ID NO: 186654 - RNA, 19 nt, Homo sapiens
gaaugagaauggacguuug

SEQ ID NO: 186655 - RNA, 19 nt, Homo sapiens
gaugacccuucuuuauuaa

SEQ ID NO: 186656 - RNA, 19 nt, Homo sapiens
uagaagagcagcuuguuaa

SEQ ID NO: 186657 - RNA, 19 nt, Homo sapiens
gaacugacauaggcuucaa

SEQ ID NO: 186658 - RNA, 19 nt, Homo sapiens
gaacacucaucuuggaauc

SEQ ID NO: 186659 - RNA, 19 nt, Homo sapiens
cagccaaacuguagaugaa

SEQ ID NO: 186660 - RNA, 19 nt, Homo sapiens
ucgaguugcuuaugaaauu

SEQ ID NO: 186661 - RNA, 19 nt, Homo sapiens
gaaauuaugcaaacacuac

SEQ ID NO: 186662 - RNA, 19 nt, Homo sapiens
cagaugacccuucuuuauu

SEQ ID NO: 186663 - RNA, 19 nt, Homo sapiens
ccacagaugacccuucuuu

SEQ ID NO: 186664 - RNA, 19 nt, Homo sapiens
cuucaaacauccaguuauu

SEQ ID NO: 186665 - RNA, 19 nt, Homo sapiens
gacauaggcuucaauuggu

SEQ ID NO: 186666 - RNA, 19 nt, Homo sapiens
cuaaaggugucaacaggaa

SEQ ID NO: 186667 - RNA, 19 nt, Homo sapiens
gcucagaggacauccauga

SEQ ID NO: 186668 - RNA, 19 nt, Homo sapiens
ugaggaaguugauucuuau

SEQ ID NO: 186669 - RNA, 19 nt, Homo sapiens
cuacaaaguucgagagaag

SEQ ID NO: 186670 - RNA, 19 nt, Homo sapiens
cacaaucgauacacagaaa

SEQ ID NO: 186671 - RNA, 19 nt, Homo sapiens
caaaguaccccaauuauga

SEQ ID NO: 186672 - RNA, 19 nt, Homo sapiens
gacauucucuuugauaaca

SEQ ID NO: 186673 - RNA, 19 nt, Homo sapiens
cugcaaacuuccauucuuu

SEQ ID NO: 186674 - RNA, 19 nt, Homo sapiens
cgaguugcuuaugaaauua

SEQ ID NO: 186675 - RNA, 19 nt, Homo sapiens
ccucgcagaucgacuugua

SEQ ID NO: 186676 - RNA, 19 nt, Homo sapiens
agacaaacacugccauauu

SEQ ID NO: 186677 - RNA, 19 nt, Homo sapiens
cagaugaaauucccaugga

SEQ ID NO: 186678 - RNA, 19 nt, Homo sapiens
agaaggaaaugaacuccaa

SEQ ID NO: 186679 - RNA, 19 nt, Homo sapiens
gccaugaacaaauucuuua

SEQ ID NO: 186680 - RNA, 19 nt, Homo sapiens
gaugggagacuguauuuag

SEQ ID NO: 186681 - RNA, 19 nt, Homo sapiens
cggaacagcuccuuacucu

SEQ ID NO: 186682 - RNA, 19 nt, Homo sapiens
gaaccuggagauaucauug

SEQ ID NO: 186683 - RNA, 19 nt, Homo sapiens
cauggaaccuggagauauc

SEQ ID NO: 186684 - RNA, 19 nt, Homo sapiens
ggucgagcuucccauugua

SEQ ID NO: 186685 - RNA, 19 nt, Homo sapiens
cagagugaauugaagaaau

SEQ ID NO: 186686 - RNA, 19 nt, Homo sapiens
ugacauaggcuucaauugg

SEQ ID NO: 186687 - RNA, 19 nt, Homo sapiens
gcugagggcuguggcuuug

SEQ ID NO: 186688 - RNA, 19 nt, Homo sapiens
aaacaaaguaccccaauua

SEQ ID NO: 186689 - RNA, 19 nt, Homo sapiens
ggauuuaggacaucaugaa

SEQ ID NO: 186690 - RNA, 19 nt, Homo sapiens
aauauucacucuccauuag

SEQ ID NO: 186691 - RNA, 19 nt, Homo sapiens
agaccugugugaacuauug

SEQ ID NO: 186692 - RNA, 19 nt, Homo sapiens
gcaggugauuggcgggaaa

SEQ ID NO: 186693 - RNA, 19 nt, Homo sapiens
cuacuacugugaagaggaa

SEQ ID NO: 186694 - RNA, 19 nt, Homo sapiens
acaagaaacagaccagaaa

SEQ ID NO: 186695 - RNA, 19 nt, Homo sapiens
ucacuccagucaacagauu

SEQ ID NO: 186696 - RNA, 19 nt, Homo sapiens
gauagaaacggucaaguac

SEQ ID NO: 186697 - RNA, 19 nt, Homo sapiens
gggaaggacgggccuauau

SEQ ID NO: 186698 - RNA, 19 nt, Homo sapiens
uagaagaagccaccaagaa

SEQ ID NO: 186699 - RNA, 19 nt, Homo sapiens
uggaauuccucuuuaacaa

SEQ ID NO: 186700 - RNA, 19 nt, Homo sapiens
agauagaaacggucaagua

SEQ ID NO: 186701 - RNA, 19 nt, Homo sapiens
ccagaaggcccuauugauc

SEQ ID NO: 186702 - RNA, 19 nt, Homo sapiens
gagaauaacauaucuucag

SEQ ID NO: 186703 - RNA, 19 nt, Homo sapiens
gcaauuacugucucauuag

SEQ ID NO: 186704 - RNA, 19 nt, Homo sapiens
ugaauucacuccagucaac

SEQ ID NO: 186705 - RNA, 19 nt, Homo sapiens
ggauggcuauucuaaaggu

SEQ ID NO: 186706 - RNA, 19 nt, Homo sapiens
cagaaugcccacaaucaaa

SEQ ID NO: 186707 - RNA, 19 nt, Homo sapiens
ggaaaugaacuccaaagac

SEQ ID NO: 186708 - RNA, 19 nt, Homo sapiens
gauauguugaucagccuua

SEQ ID NO: 186709 - RNA, 19 nt, Homo sapiens
uaagacaaacacugccaua

SEQ ID NO: 186710 - RNA, 19 nt, Homo sapiens
gccaaacuguagaugaaga

SEQ ID NO: 186711 - RNA, 19 nt, Homo sapiens
ucaaaccauuucagccaaa

SEQ ID NO: 186712 - RNA, 19 nt, Homo sapiens
gaguguauuuggccacaga

SEQ ID NO: 186713 - RNA, 19 nt, Homo sapiens
cagaaggcccuauugauca

SEQ ID NO: 186714 - RNA, 19 nt, Homo sapiens
ccucaucauuaauaaguga

SEQ ID NO: 186715 - RNA, 19 nt, Homo sapiens
aagagcagcugggaacuga

SEQ ID NO: 186716 - RNA, 19 nt, Homo sapiens
gaagagauaaacgaccaaa

SEQ ID NO: 186717 - RNA, 19 nt, Homo sapiens
aagcugguguguaauauca

SEQ ID NO: 186718 - RNA, 19 nt, Homo sapiens
gaaaagaauuaccccauac

SEQ ID NO: 186719 - RNA, 19 nt, Homo sapiens
caauuacugucucauuagu

SEQ ID NO: 186720 - RNA, 19 nt, Homo sapiens
gaaauggucuggggaagga

SEQ ID NO: 186721 - RNA, 19 nt, Homo sapiens
uggacauucucuuugauaa

SEQ ID NO: 186722 - RNA, 19 nt, Homo sapiens
gcacaaucgauacacagaa

SEQ ID NO: 186723 - RNA, 19 nt, Homo sapiens
acagaugacccuucuuuau

SEQ ID NO: 186724 - RNA, 19 nt, Homo sapiens
ggucuacugcuucaugauu

SEQ ID NO: 186725 - RNA, 19 nt, Homo sapiens
ccaaagaacagauugaaaa

SEQ ID NO: 186726 - RNA, 19 nt, Homo sapiens
caggugaagugaaggacaa

SEQ ID NO: 186727 - RNA, 19 nt, Homo sapiens
gaaggaaaugaacuccaaa

SEQ ID NO: 186728 - RNA, 19 nt, Homo sapiens
gcaaacuuccauucuuuag

SEQ ID NO: 186729 - RNA, 19 nt, Homo sapiens
ucccaggucugucgaguug

SEQ ID NO: 186730 - RNA, 19 nt, Homo sapiens
aaacaaugccaugaacaaa

SEQ ID NO: 186731 - RNA, 19 nt, Homo sapiens
guucauugaccucaucauu

SEQ ID NO: 186732 - RNA, 19 nt, Homo sapiens
ggaaggacgggccuauauc

SEQ ID NO: 186733 - RNA, 19 nt, Homo sapiens
ugggauggcuauucuaaag

SEQ ID NO: 186734 - RNA, 19 nt, Homo sapiens
gaaaugcacucuauuaaug

SEQ ID NO: 186735 - RNA, 19 nt, Homo sapiens
gaagaagacuguuuccaaa

SEQ ID NO: 186736 - RNA, 19 nt, Homo sapiens
gaagacuguuuccaaauaa

SEQ ID NO: 186737 - RNA, 19 nt, Homo sapiens
gagauuaaguccagaaaug

SEQ ID NO: 186738 - RNA, 19 nt, Homo sapiens
gcaaugcuuucuugucuuu

SEQ ID NO: 186739 - RNA, 19 nt, Homo sapiens
agaagacuguuuccaaaua

SEQ ID NO: 186740 - RNA, 19 nt, Homo sapiens
guagagaggugaagguaug

SEQ ID NO: 186741 - RNA, 19 nt, Homo sapiens
gagaguugcuuuugaaaua

SEQ ID NO: 186742 - RNA, 19 nt, Homo sapiens
gguaaaaucuagaagcuua

SEQ ID NO: 186743 - RNA, 19 nt, Homo sapiens
gaaguuaguaccuuugaaa

SEQ ID NO: 186744 - RNA, 19 nt, Homo sapiens
gaacagguggccaaacaaa

SEQ ID NO: 186745 - RNA, 19 nt, Homo sapiens
gaaguucaccuaucccauu

SEQ ID NO: 186746 - RNA, 19 nt, Homo sapiens
caaggaaauuucaacaguu

SEQ ID NO: 186747 - RNA, 19 nt, Homo sapiens
gaagagaguugcuuuugaa

SEQ ID NO: 186748 - RNA, 19 nt, Homo sapiens
gaacguuucauuucucauu

SEQ ID NO: 186749 - RNA, 19 nt, Homo sapiens
gaccagugcucuucaggaa

SEQ ID NO: 186750 - RNA, 19 nt, Homo sapiens
ucaagacuauaaccaagua

SEQ ID NO: 186751 - RNA, 19 nt, Homo sapiens
gguauaaaguuugcucauu

SEQ ID NO: 186752 - RNA, 19 nt, Homo sapiens
gagcauauauguagcuuuu

SEQ ID NO: 186753 - RNA, 19 nt, Homo sapiens
ugauguaucucaagacuau

SEQ ID NO: 186754 - RNA, 19 nt, Homo sapiens
gcagugcaaugggaaguaa

SEQ ID NO: 186755 - RNA, 19 nt, Homo sapiens
gaauggcagugucaggaaa

SEQ ID NO: 186756 - RNA, 19 nt, Homo sapiens
gagaauuaauagcguguga

SEQ ID NO: 186757 - RNA, 19 nt, Homo sapiens
ggugaagguaugagaauua

SEQ ID NO: 186758 - RNA, 19 nt, Homo sapiens
ccaaguagagaaugucaua

SEQ ID NO: 186759 - RNA, 19 nt, Homo sapiens
gcagccuccuuaaauguuu

SEQ ID NO: 186760 - RNA, 19 nt, Homo sapiens
gugaagguaugagaauuaa

SEQ ID NO: 186761 - RNA, 19 nt, Homo sapiens
cagaacagguggccaaaca

SEQ ID NO: 186762 - RNA, 19 nt, Homo sapiens
ggaagugcauugcuaucga

SEQ ID NO: 186763 - RNA, 19 nt, Homo sapiens
gaaauugaaaugcacucua

SEQ ID NO: 186764 - RNA, 19 nt, Homo sapiens
gcauugcuaucgagugcua

SEQ ID NO: 186765 - RNA, 19 nt, Homo sapiens
gcaaugggaaguaaagaga

SEQ ID NO: 186766 - RNA, 19 nt, Homo sapiens
ccagugcucuucaggaaug

SEQ ID NO: 186767 - RNA, 19 nt, Homo sapiens
ggcagaagcuuugcagaug

SEQ ID NO: 186768 - RNA, 19 nt, Homo sapiens
ggaauaggagaccauuuga

SEQ ID NO: 186769 - RNA, 19 nt, Homo sapiens
gaggugaagccauauaaug

SEQ ID NO: 186770 - RNA, 19 nt, Homo sapiens
gcuuaagaauuuacaguuc

SEQ ID NO: 186771 - RNA, 19 nt, Homo sapiens
gauuaaguccagaaaugua

SEQ ID NO: 186772 - RNA, 19 nt, Homo sapiens
acaaggaaauuucaacagu

SEQ ID NO: 186773 - RNA, 19 nt, Homo sapiens
gguaaauugugcaggaaug

SEQ ID NO: 186774 - RNA, 19 nt, Homo sapiens
gaaaggcugaugaugguau

SEQ ID NO: 186775 - RNA, 19 nt, Homo sapiens
aaugggaaguaaagagaua

SEQ ID NO: 186776 - RNA, 19 nt, Homo sapiens
gcuccaguaacuucuauua

SEQ ID NO: 186777 - RNA, 19 nt, Homo sapiens
agacucgacuuauuucaga

SEQ ID NO: 186778 - RNA, 19 nt, Homo sapiens
gcaggacaguugggauuau

SEQ ID NO: 186779 - RNA, 19 nt, Homo sapiens
uguuaaagaugccauacaa

SEQ ID NO: 186780 - RNA, 19 nt, Homo sapiens
gaagagcgguaaaaucuag

SEQ ID NO: 186781 - RNA, 19 nt, Homo sapiens
aauaggagaccauuugauu

SEQ ID NO: 186782 - RNA, 19 nt, Homo sapiens
uugaagaucuugaaguuag

SEQ ID NO: 186783 - RNA, 19 nt, Homo sapiens
uaacucugguugcacgaaa

SEQ ID NO: 186784 - RNA, 19 nt, Homo sapiens
agacaaggcugauuuugaa

SEQ ID NO: 186785 - RNA, 19 nt, Homo sapiens
ccuccugacaguauuauua

SEQ ID NO: 186786 - RNA, 19 nt, Homo sapiens
gaagccauauaaugucuac

SEQ ID NO: 186787 - RNA, 19 nt, Homo sapiens
aaaggcugaugaugguaua

SEQ ID NO: 186788 - RNA, 19 nt, Homo sapiens
gaauuuacaguuccuucaa

SEQ ID NO: 186789 - RNA, 19 nt, Homo sapiens
aagaugaguuggacccauu

SEQ ID NO: 186790 - RNA, 19 nt, Homo sapiens
caaaguaaagaacaggauu

SEQ ID NO: 186791 - RNA, 19 nt, Homo sapiens
gcauccaaguuugccauaa

SEQ ID NO: 186792 - RNA, 19 nt, Homo sapiens
gcacucuauuaaugacaaa

SEQ ID NO: 186793 - RNA, 19 nt, Homo sapiens
ggaaacucauggcuucucu

SEQ ID NO: 186794 - RNA, 19 nt, Homo sapiens
gaagaucuugaaguuagua

SEQ ID NO: 186795 - RNA, 19 nt, Homo sapiens
uggacaugcugguaaauug

SEQ ID NO: 186796 - RNA, 19 nt, Homo sapiens
gggaacguuucauuucuca

SEQ ID NO: 186797 - RNA, 19 nt, Homo sapiens
gaaagguuaaugagcauca

SEQ ID NO: 186798 - RNA, 19 nt, Homo sapiens
gcaggcaaagaaagaaauu

SEQ ID NO: 186799 - RNA, 19 nt, Homo sapiens
aaggaaauuucaacaguuc

SEQ ID NO: 186800 - RNA, 19 nt, Homo sapiens
uaaagaugccauacaagga

SEQ ID NO: 186801 - RNA, 19 nt, Homo sapiens
gaugaugguauaaaguuug

SEQ ID NO: 186802 - RNA, 19 nt, Homo sapiens
uggcuucucucucucuuug

SEQ ID NO: 186803 - RNA, 19 nt, Homo sapiens
augcaaauauggaauagga

SEQ ID NO: 186804 - RNA, 19 nt, Homo sapiens
agacaaaacugccuaaucu

SEQ ID NO: 186805 - RNA, 19 nt, Homo sapiens
gcacuauugcuuuguuuua

SEQ ID NO: 186806 - RNA, 19 nt, Homo sapiens
cgagugcuauaaacaagga

SEQ ID NO: 186807 - RNA, 19 nt, Homo sapiens
gggauuggcagaagcuuug

SEQ ID NO: 186808 - RNA, 19 nt, Homo sapiens
ggaauggcagugucaggaa

SEQ ID NO: 186809 - RNA, 19 nt, Homo sapiens
ggacaugcugguaaauugu

SEQ ID NO: 186810 - RNA, 19 nt, Homo sapiens
acucauggcuucucucucu

SEQ ID NO: 186811 - RNA, 19 nt, Homo sapiens
aaagaugccauacaaggaa

SEQ ID NO: 186812 - RNA, 19 nt, Homo sapiens
acagguggccaaacaaauu

SEQ ID NO: 186813 - RNA, 19 nt, Homo sapiens
gguggugcuuugcauauca

SEQ ID NO: 186814 - RNA, 19 nt, Homo sapiens
uguacuuucuggcacauaa

SEQ ID NO: 186815 - RNA, 19 nt, Homo sapiens
uuaauagcgugugaacaaa

SEQ ID NO: 186816 - RNA, 19 nt, Homo sapiens
gcaaggggcuagaaguuca

SEQ ID NO: 186817 - RNA, 19 nt, Homo sapiens
ggaauguggcugcaagcaa

SEQ ID NO: 186818 - RNA, 19 nt, Homo sapiens
caggacaguugggauuauu

SEQ ID NO: 186819 - RNA, 19 nt, Homo sapiens
guucaccuaucccauuuua

SEQ ID NO: 186820 - RNA, 19 nt, Homo sapiens
cuugaggacuuuguuuaaa

SEQ ID NO: 186821 - RNA, 19 nt, Homo sapiens
uggaauaggagaccauuug

SEQ ID NO: 186822 - RNA, 19 nt, Homo sapiens
gccuauagacacuuaugua

SEQ ID NO: 186823 - RNA, 19 nt, Homo sapiens
acaaggagcuuuuauaacu

SEQ ID NO: 186824 - RNA, 19 nt, Homo sapiens
cagaagcuuugcagaugga

SEQ ID NO: 186825 - RNA, 19 nt, Homo sapiens
ccagugagucugaauguca

SEQ ID NO: 186826 - RNA, 19 nt, Homo sapiens
cauccaaguuugccauaag

SEQ ID NO: 186827 - RNA, 19 nt, Homo sapiens
caguggacaugcugguaaa

SEQ ID NO: 186828 - RNA, 19 nt, Homo sapiens
uaaccaugaugaccugaag

SEQ ID NO: 186829 - RNA, 19 nt, Homo sapiens
ggagagggcagugcaaugg

SEQ ID NO: 186830 - RNA, 19 nt, Homo sapiens
aaacugccuaaucuucuua

SEQ ID NO: 186831 - RNA, 19 nt, Homo sapiens
aggaaaggcugaugauggu

SEQ ID NO: 186832 - RNA, 19 nt, Homo sapiens
gcauauauguagcuuuuag

SEQ ID NO: 186833 - RNA, 19 nt, Homo sapiens
gaauaggagaccauuugau

SEQ ID NO: 186834 - RNA, 19 nt, Homo sapiens
gcagaagcccuggcaauuu

SEQ ID NO: 186835 - RNA, 19 nt, Homo sapiens
gguccaagcuguugcuguu

SEQ ID NO: 186836 - RNA, 19 nt, Homo sapiens
caaccugaauuaaagucua

SEQ ID NO: 186837 - RNA, 19 nt, Homo sapiens
uagcagcacuguccucuuc

SEQ ID NO: 186838 - RNA, 19 nt, Homo sapiens
cagagucccuuaucccuau

SEQ ID NO: 186839 - RNA, 19 nt, Homo sapiens
gcagugcccucuucagcau

SEQ ID NO: 186840 - RNA, 19 nt, Homo sapiens
gaagaaggcauuggguaug

SEQ ID NO: 186841 - RNA, 19 nt, Homo sapiens
ggacuucgaagauguaugg

SEQ ID NO: 186842 - RNA, 19 nt, Homo sapiens
cagaagcccuggcaauuuu

SEQ ID NO: 186843 - RNA, 19 nt, Homo sapiens
gggcuacugugucugguau

SEQ ID NO: 186844 - RNA, 19 nt, Homo sapiens
cuucgaagauguauggaau

SEQ ID NO: 186845 - RNA, 19 nt, Homo sapiens
ccuccuagcucccucuugu

SEQ ID NO: 186846 - RNA, 19 nt, Homo sapiens
ggacucugcacccugauau

SEQ ID NO: 186847 - RNA, 19 nt, Homo sapiens
ggcagaagcccuggcaauu

SEQ ID NO: 186848 - RNA, 19 nt, Homo sapiens
cagcuggacuucgaagaug

SEQ ID NO: 186849 - RNA, 19 nt, Homo sapiens
cugugggccugguuuauuu

SEQ ID NO: 186850 - RNA, 19 nt, Homo sapiens
ugaagaaggcauuggguau

SEQ ID NO: 186851 - RNA, 19 nt, Homo sapiens
ucgaagauguauggaauuc

SEQ ID NO: 186852 - RNA, 19 nt, Homo sapiens
ggagacucuuccgguguaa

SEQ ID NO: 186853 - RNA, 19 nt, Homo sapiens
aggagacucuuccggugua

SEQ ID NO: 186854 - RNA, 19 nt, Homo sapiens
aaugauuccuucccagaug

SEQ ID NO: 186855 - RNA, 19 nt, Homo sapiens
guuccauccuggucucuug

SEQ ID NO: 186856 - RNA, 19 nt, Homo sapiens
ccugucaaccugaauuaaa

SEQ ID NO: 186857 - RNA, 19 nt, Homo sapiens
gcaggccacacacacugua

SEQ ID NO: 186858 - RNA, 19 nt, Homo sapiens
uagccugucuugccaucuu

SEQ ID NO: 186859 - RNA, 19 nt, Homo sapiens
gcucccugcuuuguccuuu

SEQ ID NO: 186860 - RNA, 19 nt, Homo sapiens
ugccaucuuugucuuguug

SEQ ID NO: 186861 - RNA, 19 nt, Homo sapiens
gcauuguggugcccgucuu

SEQ ID NO: 186862 - RNA, 19 nt, Homo sapiens
agucuacacugccuuugug

SEQ ID NO: 186863 - RNA, 19 nt, Homo sapiens
caccugucaaccugaauua

SEQ ID NO: 186864 - RNA, 19 nt, Homo sapiens
cuucccagauggagacuau

SEQ ID NO: 186865 - RNA, 19 nt, Homo sapiens
gcuggacuucgaagaugua

SEQ ID NO: 186866 - RNA, 19 nt, Homo sapiens
ggaguggcugcccuacuga

SEQ ID NO: 186867 - RNA, 19 nt, Homo sapiens
gauggccuccucuggguau

SEQ ID NO: 186868 - RNA, 19 nt, Homo sapiens
gucuuuauaucucuuccuu

SEQ ID NO: 186869 - RNA, 19 nt, Homo sapiens
ccaccugucaaccugaauu

SEQ ID NO: 186870 - RNA, 19 nt, Homo sapiens
aagaaggcauuggguaugg

SEQ ID NO: 186871 - RNA, 19 nt, Homo sapiens
gcuacugugucugguaugg

SEQ ID NO: 186872 - RNA, 19 nt, Homo sapiens
cugucaaccugaauuaaag

SEQ ID NO: 186873 - RNA, 19 nt, Homo sapiens
ggugagguccaagcuguug

SEQ ID NO: 186874 - RNA, 19 nt, Homo sapiens
gacucugcacccugauaua

SEQ ID NO: 186875 - RNA, 19 nt, Homo sapiens
ggagagaucuaugaugaua

SEQ ID NO: 186876 - RNA, 19 nt, Homo sapiens
aaacucaucuucaggaaua

SEQ ID NO: 186877 - RNA, 19 nt, Homo sapiens
gagaugaaguuuacgauga

SEQ ID NO: 186878 - RNA, 19 nt, Homo sapiens
gaagauagaugcugcuaag

SEQ ID NO: 186879 - RNA, 19 nt, Homo sapiens
gcaaaggccagacgucuua

SEQ ID NO: 186880 - RNA, 19 nt, Homo sapiens
gaaauaugguuauguccuu

SEQ ID NO: 186881 - RNA, 19 nt, Homo sapiens
gaggaugucucagucaaua

SEQ ID NO: 186882 - RNA, 19 nt, Homo sapiens
gcacucaacuuuggucauu

SEQ ID NO: 186883 - RNA, 19 nt, Homo sapiens
caacuuccauaacuucuaa

SEQ ID NO: 186884 - RNA, 19 nt, Homo sapiens
gaacagaaagagaaagaaa

SEQ ID NO: 186885 - RNA, 19 nt, Homo sapiens
aaaccaagaccaugacuua

SEQ ID NO: 186886 - RNA, 19 nt, Homo sapiens
ccagagaucuacagguaaa

SEQ ID NO: 186887 - RNA, 19 nt, Homo sapiens
gaacucccaugaagacgaa

SEQ ID NO: 186888 - RNA, 19 nt, Homo sapiens
ggacaaugauggagagauc

SEQ ID NO: 186889 - RNA, 19 nt, Homo sapiens
gaaaugaagaagggaaaua

SEQ ID NO: 186890 - RNA, 19 nt, Homo sapiens
caagaccuauugaagauga

SEQ ID NO: 186891 - RNA, 19 nt, Homo sapiens
ggacaugggagaugaaguu

SEQ ID NO: 186892 - RNA, 19 nt, Homo sapiens
gcaaggagagcaaauugaa

SEQ ID NO: 186893 - RNA, 19 nt, Homo sapiens
gaagauaggaagauagaug

SEQ ID NO: 186894 - RNA, 19 nt, Homo sapiens
ggaguuaccuagcggacaa

SEQ ID NO: 186895 - RNA, 19 nt, Homo sapiens
gcaagcguuucccaaauug

SEQ ID NO: 186896 - RNA, 19 nt, Homo sapiens
gaagcaagcguuucccaaa

SEQ ID NO: 186897 - RNA, 19 nt, Homo sapiens
gaaacaagccaucucuuca

SEQ ID NO: 186898 - RNA, 19 nt, Homo sapiens
aaccagagaucuacaggua

SEQ ID NO: 186899 - RNA, 19 nt, Homo sapiens
caacugcuguagagauuga

SEQ ID NO: 186900 - RNA, 19 nt, Homo sapiens
gccauugccucccuuguuu

SEQ ID NO: 186901 - RNA, 19 nt, Homo sapiens
aaaggaagauaggaagaua

SEQ ID NO: 186902 - RNA, 19 nt, Homo sapiens
caaagaagauuccaaaccu

SEQ ID NO: 186903 - RNA, 19 nt, Homo sapiens
gaagggaaauaugguuaug

SEQ ID NO: 186904 - RNA, 19 nt, Homo sapiens
ggaagaugcugaugauggu

SEQ ID NO: 186905 - RNA, 19 nt, Homo sapiens
gaguggaaguggagggaua

SEQ ID NO: 186906 - RNA, 19 nt, Homo sapiens
cauagaagcauccaaagaa

SEQ ID NO: 186907 - RNA, 19 nt, Homo sapiens
ggaaaagccugacaaggaa

SEQ ID NO: 186908 - RNA, 19 nt, Homo sapiens
ggaaacaagccaucucuuc

SEQ ID NO: 186909 - RNA, 19 nt, Homo sapiens
gaaugugucuucaucaaaa

SEQ ID NO: 186910 - RNA, 19 nt, Homo sapiens
ggaauacaagcaagaaaga

SEQ ID NO: 186911 - RNA, 19 nt, Homo sapiens
gaagaagggaaauaugguu

SEQ ID NO: 186912 - RNA, 19 nt, Homo sapiens
gugaaucucuagaaguuau

SEQ ID NO: 186913 - RNA, 19 nt, Homo sapiens
gaagaugaccaagaaguau

SEQ ID NO: 186914 - RNA, 19 nt, Homo sapiens
uauugaagaugaccaagaa

SEQ ID NO: 186915 - RNA, 19 nt, Homo sapiens
cuguagagauugacuauga

SEQ ID NO: 186916 - RNA, 19 nt, Homo sapiens
caccagaugaugacauuua

SEQ ID NO: 186917 - RNA, 19 nt, Homo sapiens
ggagaaacauaugaagaca

SEQ ID NO: 186918 - RNA, 19 nt, Homo sapiens
gauagaugcugcuaagaac

SEQ ID NO: 186919 - RNA, 19 nt, Homo sapiens
ccaagaccaugacuuaaag

SEQ ID NO: 186920 - RNA, 19 nt, Homo sapiens
aaagaagauuccaaaccua

SEQ ID NO: 186921 - RNA, 19 nt, Homo sapiens
guuauguccuucggaguua

SEQ ID NO: 186922 - RNA, 19 nt, Homo sapiens
gcagagaugagucaaggaa

SEQ ID NO: 186923 - RNA, 19 nt, Homo sapiens
ugacauuuaugaugggauu

SEQ ID NO: 186924 - RNA, 19 nt, Homo sapiens
gaacuuauucaacaaccaa

SEQ ID NO: 186925 - RNA, 19 nt, Homo sapiens
gaugaugacauuuaugaug

SEQ ID NO: 186926 - RNA, 19 nt, Homo sapiens
gcagagcaggaugauauua

SEQ ID NO: 186927 - RNA, 19 nt, Homo sapiens
gauugacuaugauucuuug

SEQ ID NO: 186928 - RNA, 19 nt, Homo sapiens
gagagcaaauugaaaucau

SEQ ID NO: 186929 - RNA, 19 nt, Homo sapiens
ggaacaagacagugaagga

SEQ ID NO: 186930 - RNA, 19 nt, Homo sapiens
cagaugaugacauuuauga

SEQ ID NO: 186931 - RNA, 19 nt, Homo sapiens
gacaaugacuagcacucaa

SEQ ID NO: 186932 - RNA, 19 nt, Homo sapiens
ugaagaugaccaagaagua

SEQ ID NO: 186933 - RNA, 19 nt, Homo sapiens
gaaagaaugaacugagcuu

SEQ ID NO: 186934 - RNA, 19 nt, Homo sapiens
uaacaggcccuauucaagu

SEQ ID NO: 186935 - RNA, 19 nt, Homo sapiens
ccaaagaaagagagaagaa

SEQ ID NO: 186936 - RNA, 19 nt, Homo sapiens
gcaagaaagaacuuauuca

SEQ ID NO: 186937 - RNA, 19 nt, Homo sapiens
gguaaaaccuggugaaucu

SEQ ID NO: 186938 - RNA, 19 nt, Homo sapiens
caugggagaugaaguuuac

SEQ ID NO: 186939 - RNA, 19 nt, Homo sapiens
caagaaguauaugaugaug

SEQ ID NO: 186940 - RNA, 19 nt, Homo sapiens
gagauugacuaugauucuu

SEQ ID NO: 186941 - RNA, 19 nt, Homo sapiens
agacauagaagcauccaaa

SEQ ID NO: 186942 - RNA, 19 nt, Homo sapiens
ccagacgucuuacucaaca

SEQ ID NO: 186943 - RNA, 19 nt, Homo sapiens
caaagaaagagagaagaaa

SEQ ID NO: 186944 - RNA, 19 nt, Homo sapiens
auagaagcauccaaagaaa

SEQ ID NO: 186945 - RNA, 19 nt, Homo sapiens
auggagagaucuaugauga

SEQ ID NO: 186946 - RNA, 19 nt, Homo sapiens
gaaaggcagauguaaaguc

SEQ ID NO: 186947 - RNA, 19 nt, Homo sapiens
acaagacagugaaggagaa

SEQ ID NO: 186948 - RNA, 19 nt, Homo sapiens
gccagcaucucacccauca

SEQ ID NO: 186949 - RNA, 19 nt, Homo sapiens
gaacagaagcaagcguuuc

SEQ ID NO: 186950 - RNA, 19 nt, Homo sapiens
caagccaucucuucacagu

SEQ ID NO: 186951 - RNA, 19 nt, Homo sapiens
caaaccuucuucugaggaa

SEQ ID NO: 186952 - RNA, 19 nt, Homo sapiens
ccagcaauguaccuaaguu

SEQ ID NO: 186953 - RNA, 19 nt, Homo sapiens
ggauggaaaggcagaugua

SEQ ID NO: 186954 - RNA, 19 nt, Homo sapiens
uggugaaucucuagaaguu

SEQ ID NO: 186955 - RNA, 19 nt, Homo sapiens
agaggaagaugcugaugau

SEQ ID NO: 186956 - RNA, 19 nt, Homo sapiens
ccaaacucaucuucaggaa

SEQ ID NO: 186957 - RNA, 19 nt, Homo sapiens
guaccgagaacucccauga

SEQ ID NO: 186958 - RNA, 19 nt, Homo sapiens
gcccaaagaagauuccaaa

SEQ ID NO: 186959 - RNA, 19 nt, Homo sapiens
uaaacuaacaggcccuauu

SEQ ID NO: 186960 - RNA, 19 nt, Homo sapiens
ugauggugcuggaaaucua

SEQ ID NO: 186961 - RNA, 19 nt, Homo sapiens
cuaccucccagaaacauua

SEQ ID NO: 186962 - RNA, 19 nt, Homo sapiens
ggccagacgucuuacucaa

SEQ ID NO: 186963 - RNA, 19 nt, Homo sapiens
caacuugcccaaagaagau

SEQ ID NO: 186964 - RNA, 19 nt, Homo sapiens
gcaauguaccuaaguuugg

SEQ ID NO: 186965 - RNA, 19 nt, Homo sapiens
ggaaacaguacuagcaaag

SEQ ID NO: 186966 - RNA, 19 nt, Homo sapiens
gcaaaagcuuguugugaug

SEQ ID NO: 186967 - RNA, 19 nt, Homo sapiens
aaacuaacaggcccuauuc

SEQ ID NO: 186968 - RNA, 19 nt, Homo sapiens
caggggagauuucaaguuu

SEQ ID NO: 186969 - RNA, 19 nt, Homo sapiens
caaauugacugggguuaaa

SEQ ID NO: 186970 - RNA, 19 nt, Homo sapiens
cagaggaugucucagucaa

SEQ ID NO: 186971 - RNA, 19 nt, Homo sapiens
gacuagcacucaacuuugg

SEQ ID NO: 186972 - RNA, 19 nt, Homo sapiens
gaauacaagcaagaaagaa

SEQ ID NO: 186973 - RNA, 19 nt, Homo sapiens
uaaaacaacugcuguagag

SEQ ID NO: 186974 - RNA, 19 nt, Homo sapiens
ggaagauagaugcugcuaa

SEQ ID NO: 186975 - RNA, 19 nt, Homo sapiens
gaagacaugugguguauau

SEQ ID NO: 186976 - RNA, 19 nt, Homo sapiens
gaaaggagaccaugucaaa

SEQ ID NO: 186977 - RNA, 19 nt, Homo sapiens
aggaagagcucugaaauua

SEQ ID NO: 186978 - RNA, 19 nt, Homo sapiens
ggacucauaugcaagauug

SEQ ID NO: 186979 - RNA, 19 nt, Homo sapiens
ggaauggacucauaugcaa

SEQ ID NO: 186980 - RNA, 19 nt, Homo sapiens
gacagaaccuuguuauuuc

SEQ ID NO: 186981 - RNA, 19 nt, Homo sapiens
gaaguuuacuggauuucuu

SEQ ID NO: 186982 - RNA, 19 nt, Homo sapiens
gcagaagagugguacuuug

SEQ ID NO: 186983 - RNA, 19 nt, Homo sapiens
caaaggaaguuuacuggau

SEQ ID NO: 186984 - RNA, 19 nt, Homo sapiens
gaagagugguacuuuggaa

SEQ ID NO: 186985 - RNA, 19 nt, Homo sapiens
gcucugaaauuaccaaauc

SEQ ID NO: 186986 - RNA, 19 nt, Homo sapiens
ggaaaucccucgagaaucc

SEQ ID NO: 186987 - RNA, 19 nt, Homo sapiens
agacagaaccuuguuauuu

SEQ ID NO: 186988 - RNA, 19 nt, Homo sapiens
gaacaaaggaaguuuacug

SEQ ID NO: 186989 - RNA, 19 nt, Homo sapiens
gaaauuaccaaaucuugug

SEQ ID NO: 186990 - RNA, 19 nt, Homo sapiens
gacaugugguguauauaaa

SEQ ID NO: 186991 - RNA, 19 nt, Homo sapiens
ccaaaccucuguucagugu

SEQ ID NO: 186992 - RNA, 19 nt, Homo sapiens
gaaggaagagcucugaaau

SEQ ID NO: 186993 - RNA, 19 nt, Homo sapiens
aaaggaaguuuacuggauu

SEQ ID NO: 186994 - RNA, 19 nt, Homo sapiens
aaaccucuguucaguguaa

SEQ ID NO: 186995 - RNA, 19 nt, Homo sapiens
gcaggaugcugaucuaaac

SEQ ID NO: 186996 - RNA, 19 nt, Homo sapiens
gaagagcucugaaauuacc

SEQ ID NO: 186997 - RNA, 19 nt, Homo sapiens
gacagaagaugaccugagu

SEQ ID NO: 186998 - RNA, 19 nt, Homo sapiens
ccaaagaugucugggaaau

SEQ ID NO: 186999 - RNA, 19 nt, Homo sapiens
gaagcccgcuccuugacaa

SEQ ID NO: 187000 - RNA, 19 nt, Homo sapiens
gaacagcucggaaggagau

SEQ ID NO: 187001 - RNA, 19 nt, Homo sapiens
caacaauccuagugcuuuc

SEQ ID NO: 187002 - RNA, 19 nt, Homo sapiens
gaaaaugcauuguaucgau

SEQ ID NO: 187003 - RNA, 19 nt, Homo sapiens
guacaacauuacucagaga

SEQ ID NO: 187004 - RNA, 19 nt, Homo sapiens
ugauugggaugauaugaaa

SEQ ID NO: 187005 - RNA, 19 nt, Homo sapiens
ggagagacagguuacauuc

SEQ ID NO: 187006 - RNA, 19 nt, Homo sapiens
caacuggagagacagguua

SEQ ID NO: 187007 - RNA, 19 nt, Homo sapiens
gaagaacgccccacuuuug

SEQ ID NO: 187008 - RNA, 19 nt, Homo sapiens
cggauuggcccgauugaua

SEQ ID NO: 187009 - RNA, 19 nt, Homo sapiens
guaguucccugucacaaag

SEQ ID NO: 187010 - RNA, 19 nt, Homo sapiens
gauaaugggcugugugcaa

SEQ ID NO: 187011 - RNA, 19 nt, Homo sapiens
agacaugugguguauauaa

SEQ ID NO: 187012 - RNA, 19 nt, Homo sapiens
gaacuuccauggcccucau

SEQ ID NO: 187013 - RNA, 19 nt, Homo sapiens
aagcgcagaucaugaagaa

SEQ ID NO: 187014 - RNA, 19 nt, Homo sapiens
aaagggaugccaaggcuua

SEQ ID NO: 187015 - RNA, 19 nt, Homo sapiens
cagaagaugaccugaguuu

SEQ ID NO: 187016 - RNA, 19 nt, Homo sapiens
uagaagacaugugguguau

SEQ ID NO: 187017 - RNA, 19 nt, Homo sapiens
acaucgagcgcaugaauua

SEQ ID NO: 187018 - RNA, 19 nt, Homo sapiens
aaaugcaaauccuauguga

SEQ ID NO: 187019 - RNA, 19 nt, Homo sapiens
gcgcaugaauuauauccau

SEQ ID NO: 187020 - RNA, 19 nt, Homo sapiens
guagaagacauguggugua

SEQ ID NO: 187021 - RNA, 19 nt, Homo sapiens
acagguggcugcaggaaug

SEQ ID NO: 187022 - RNA, 19 nt, Homo sapiens
caaaggugccuauucacuu

SEQ ID NO: 187023 - RNA, 19 nt, Homo sapiens
gcaauguaaggauaaagaa

SEQ ID NO: 187024 - RNA, 19 nt, Homo sapiens
gauagaagacaaugaguac

SEQ ID NO: 187025 - RNA, 19 nt, Homo sapiens
uaccaaaucuuguggacau

SEQ ID NO: 187026 - RNA, 19 nt, Homo sapiens
ugacaaugguggauacuac

SEQ ID NO: 187027 - RNA, 19 nt, Homo sapiens
caagacaaggugcaaaguu

SEQ ID NO: 187028 - RNA, 19 nt, Homo sapiens
gacaaugaguacacagcaa

SEQ ID NO: 187029 - RNA, 19 nt, Homo sapiens
gaccaguccugccucuguu

SEQ ID NO: 187030 - RNA, 19 nt, Homo sapiens
ggccaaaccucuguucagu

SEQ ID NO: 187031 - RNA, 19 nt, Homo sapiens
aggaucagauugcauguga

SEQ ID NO: 187032 - RNA, 19 nt, Homo sapiens
aagacaaggugcaaaguuc

SEQ ID NO: 187033 - RNA, 19 nt, Homo sapiens
ccaacaauccuagugcuuu

SEQ ID NO: 187034 - RNA, 19 nt, Homo sapiens
gagacagaaccuuguuauu

SEQ ID NO: 187035 - RNA, 19 nt, Homo sapiens
ggagaaggaagagcucuga

SEQ ID NO: 187036 - RNA, 19 nt, Homo sapiens
ucaagagacugggaaaugg

SEQ ID NO: 187037 - RNA, 19 nt, Homo sapiens
gaagaugaccugaguuuuc

SEQ ID NO: 187038 - RNA, 19 nt, Homo sapiens
gugaagcauucgagacaga

SEQ ID NO: 187039 - RNA, 19 nt, Homo sapiens
cagguuacauucccagcaa

SEQ ID NO: 187040 - RNA, 19 nt, Homo sapiens
gccaaggacucaccgucuu

SEQ ID NO: 187041 - RNA, 19 nt, Homo sapiens
ugauagaagacaaugagua

SEQ ID NO: 187042 - RNA, 19 nt, Homo sapiens
gcgaucagcaaacauucua

SEQ ID NO: 187043 - RNA, 19 nt, Homo sapiens
ccgaguauaugaacaaagg

SEQ ID NO: 187044 - RNA, 19 nt, Homo sapiens
gauugcaugugacucugaa

SEQ ID NO: 187045 - RNA, 19 nt, Homo sapiens
ugugugcaauguaaggaua

SEQ ID NO: 187046 - RNA, 19 nt, Homo sapiens
guacacagcaagacaaggu

SEQ ID NO: 187047 - RNA, 19 nt, Homo sapiens
agagguaccuuucuuaucc

SEQ ID NO: 187048 - RNA, 19 nt, Homo sapiens
ggauuggcccgauugauag

SEQ ID NO: 187049 - RNA, 19 nt, Homo sapiens
cgcaugaauuauauccaua

SEQ ID NO: 187050 - RNA, 19 nt, Homo sapiens
ucuaugcaguggugucuga

SEQ ID NO: 187051 - RNA, 19 nt, Homo sapiens
uuaccgaucugucugucaa

SEQ ID NO: 187052 - RNA, 19 nt, Homo sapiens
gugaacucuucgucucaua

SEQ ID NO: 187053 - RNA, 19 nt, Homo sapiens
ccaaaggaagagugccaua

SEQ ID NO: 187054 - RNA, 19 nt, Homo sapiens
ggauaaagaagcaacaaaa

SEQ ID NO: 187055 - RNA, 19 nt, Homo sapiens
gaauggaaacacaaaagua

SEQ ID NO: 187056 - RNA, 19 nt, Homo sapiens
cagcuauuguccuuuggaa

SEQ ID NO: 187057 - RNA, 19 nt, Homo sapiens
ccaaggacucaccgucuuu

SEQ ID NO: 187058 - RNA, 19 nt, Homo sapiens
gcaguugcgccaucuguca

SEQ ID NO: 187059 - RNA, 19 nt, Homo sapiens
gaggaagcgcagaucauga

SEQ ID NO: 187060 - RNA, 19 nt, Homo sapiens
cgagacagaaccuuguuau

SEQ ID NO: 187061 - RNA, 19 nt, Homo sapiens
gaaccgcccaggaucagau

SEQ ID NO: 187062 - RNA, 19 nt, Homo sapiens
gggaauggacucauaugca

SEQ ID NO: 187063 - RNA, 19 nt, Homo sapiens
ucgagcgcaugaauuauau

SEQ ID NO: 187064 - RNA, 19 nt, Homo sapiens
aaggaaguuuacuggauuu

SEQ ID NO: 187065 - RNA, 19 nt, Homo sapiens
acacaaaaguagccauaaa

SEQ ID NO: 187066 - RNA, 19 nt, Homo sapiens
cccauuagcuuucaauucc

SEQ ID NO: 187067 - RNA, 19 nt, Homo sapiens
ggaagagcucugaaauuac

SEQ ID NO: 187068 - RNA, 19 nt, Homo sapiens
agaaggaagagcucugaaa

SEQ ID NO: 187069 - RNA, 19 nt, Homo sapiens
agucugacguguggucuuu

SEQ ID NO: 187070 - RNA, 19 nt, Homo sapiens
gaagcgcagaucaugaaga

SEQ ID NO: 187071 - RNA, 19 nt, Homo sapiens
ugccaaggcuuaccgaucu

SEQ ID NO: 187072 - RNA, 19 nt, Homo sapiens
ggcagaagagugguacuuu

SEQ ID NO: 187073 - RNA, 19 nt, Homo sapiens
guuacauucccagcaauua

SEQ ID NO: 187074 - RNA, 19 nt, Homo sapiens
caugugguguauauaaagu

SEQ ID NO: 187075 - RNA, 19 nt, Homo sapiens
gaaaggagaccaugucaaa

SEQ ID NO: 187076 - RNA, 19 nt, Homo sapiens
aggaagagcucugaaauua

SEQ ID NO: 187077 - RNA, 19 nt, Homo sapiens
ggacucauaugcaagauug

SEQ ID NO: 187078 - RNA, 19 nt, Homo sapiens
ggaauggacucauaugcaa

SEQ ID NO: 187079 - RNA, 19 nt, Homo sapiens
gacagaaccuuguuauuuc

SEQ ID NO: 187080 - RNA, 19 nt, Homo sapiens
agagaaagcugaugguuug

SEQ ID NO: 187081 - RNA, 19 nt, Homo sapiens
gaaguuuacuggauuucuu

SEQ ID NO: 187082 - RNA, 19 nt, Homo sapiens
gcagaagagugguacuuug

SEQ ID NO: 187083 - RNA, 19 nt, Homo sapiens
caaaggaaguuuacuggau

SEQ ID NO: 187084 - RNA, 19 nt, Homo sapiens
gaagagugguacuuuggaa

SEQ ID NO: 187085 - RNA, 19 nt, Homo sapiens
gcucugaaauuaccaaauc

SEQ ID NO: 187086 - RNA, 19 nt, Homo sapiens
agacagaaccuuguuauuu

SEQ ID NO: 187087 - RNA, 19 nt, Homo sapiens
gaacaaaggaaguuuacug

SEQ ID NO: 187088 - RNA, 19 nt, Homo sapiens
gaaagcugaugguuugugu

SEQ ID NO: 187089 - RNA, 19 nt, Homo sapiens
gaaauuaccaaaucuugug

SEQ ID NO: 187090 - RNA, 19 nt, Homo sapiens
uaaagaugcuugggaaguu

SEQ ID NO: 187091 - RNA, 19 nt, Homo sapiens
ccaaaccucuguucagugu

SEQ ID NO: 187092 - RNA, 19 nt, Homo sapiens
gaaggaagagcucugaaau

SEQ ID NO: 187093 - RNA, 19 nt, Homo sapiens
aaaggaaguuuacuggauu

SEQ ID NO: 187094 - RNA, 19 nt, Homo sapiens
aaaccucuguucaguguaa

SEQ ID NO: 187095 - RNA, 19 nt, Homo sapiens
gcugaaguguggcuuggua

SEQ ID NO: 187096 - RNA, 19 nt, Homo sapiens
gaagagcucugaaauuacc

SEQ ID NO: 187097 - RNA, 19 nt, Homo sapiens
gacagaagaugaccugagu

SEQ ID NO: 187098 - RNA, 19 nt, Homo sapiens
gaagcccgcuccuugacaa

SEQ ID NO: 187099 - RNA, 19 nt, Homo sapiens
uaacuuaacugugauugca

SEQ ID NO: 187100 - RNA, 19 nt, Homo sapiens
gaacagcucggaaggagau

SEQ ID NO: 187101 - RNA, 19 nt, Homo sapiens
caacaauccuagugcuuuc

SEQ ID NO: 187102 - RNA, 19 nt, Homo sapiens
gaaaaugcauuguaucgau

SEQ ID NO: 187103 - RNA, 19 nt, Homo sapiens
guacaacauuacucagaga

SEQ ID NO: 187104 - RNA, 19 nt, Homo sapiens
ugauugggaugauaugaaa

SEQ ID NO: 187105 - RNA, 19 nt, Homo sapiens
gugauugcaucgaguugua

SEQ ID NO: 187106 - RNA, 19 nt, Homo sapiens
ggagagacagguuacauuc

SEQ ID NO: 187107 - RNA, 19 nt, Homo sapiens
caacuggagagacagguua

SEQ ID NO: 187108 - RNA, 19 nt, Homo sapiens
gaagaacgccccacuuuug

SEQ ID NO: 187109 - RNA, 19 nt, Homo sapiens
cggauuggcccgauugaua

SEQ ID NO: 187110 - RNA, 19 nt, Homo sapiens
gauaaugggcugugugcaa

SEQ ID NO: 187111 - RNA, 19 nt, Homo sapiens
caacauuacucagagaaag

SEQ ID NO: 187112 - RNA, 19 nt, Homo sapiens
gaacuuccauggcccucau

SEQ ID NO: 187113 - RNA, 19 nt, Homo sapiens
aagcgcagaucaugaagaa

SEQ ID NO: 187114 - RNA, 19 nt, Homo sapiens
gcugaugguuuguguuuua

SEQ ID NO: 187115 - RNA, 19 nt, Homo sapiens
cagaagaugaccugaguuu

SEQ ID NO: 187116 - RNA, 19 nt, Homo sapiens
acaucgagcgcaugaauua

SEQ ID NO: 187117 - RNA, 19 nt, Homo sapiens
aaaugcaaauccuauguga

SEQ ID NO: 187118 - RNA, 19 nt, Homo sapiens
gcgcaugaauuauauccau

SEQ ID NO: 187119 - RNA, 19 nt, Homo sapiens
acagguggcugcaggaaug

SEQ ID NO: 187120 - RNA, 19 nt, Homo sapiens
caaaggugccuauucacuu

SEQ ID NO: 187121 - RNA, 19 nt, Homo sapiens
gcaauguaaggauaaagaa

SEQ ID NO: 187122 - RNA, 19 nt, Homo sapiens
gauagaagacaaugaguac

SEQ ID NO: 187123 - RNA, 19 nt, Homo sapiens
uaccaaaucuuguggacau

SEQ ID NO: 187124 - RNA, 19 nt, Homo sapiens
cagagaaagcugaugguuu

SEQ ID NO: 187125 - RNA, 19 nt, Homo sapiens
ugacaaugguggauacuac

SEQ ID NO: 187126 - RNA, 19 nt, Homo sapiens
caagacaaggugcaaaguu

SEQ ID NO: 187127 - RNA, 19 nt, Homo sapiens
gacaaugaguacacagcaa

SEQ ID NO: 187128 - RNA, 19 nt, Homo sapiens
cccacaaacuucuggauug

SEQ ID NO: 187129 - RNA, 19 nt, Homo sapiens
ggccaaaccucuguucagu

SEQ ID NO: 187130 - RNA, 19 nt, Homo sapiens
aggaucagauugcauguga

SEQ ID NO: 187131 - RNA, 19 nt, Homo sapiens
aagacaaggugcaaaguuc

SEQ ID NO: 187132 - RNA, 19 nt, Homo sapiens
ccaacaauccuagugcuuu

SEQ ID NO: 187133 - RNA, 19 nt, Homo sapiens
gagacagaaccuuguuauu

SEQ ID NO: 187134 - RNA, 19 nt, Homo sapiens
ggagaaggaagagcucuga

SEQ ID NO: 187135 - RNA, 19 nt, Homo sapiens
gaagaugaccugaguuuuc

SEQ ID NO: 187136 - RNA, 19 nt, Homo sapiens
gugaagcauucgagacaga

SEQ ID NO: 187137 - RNA, 19 nt, Homo sapiens
gccaaggacucaccgucuu

SEQ ID NO: 187138 - RNA, 19 nt, Homo sapiens
cagguuacauucccagcaa

SEQ ID NO: 187139 - RNA, 19 nt, Homo sapiens
ugauagaagacaaugagua

SEQ ID NO: 187140 - RNA, 19 nt, Homo sapiens
gcgaucagcaaacauucua

SEQ ID NO: 187141 - RNA, 19 nt, Homo sapiens
ccgaguauaugaacaaagg

SEQ ID NO: 187142 - RNA, 19 nt, Homo sapiens
cuugguaccuggaauggaa

SEQ ID NO: 187143 - RNA, 19 nt, Homo sapiens
ccacaaacuucuggauugg

SEQ ID NO: 187144 - RNA, 19 nt, Homo sapiens
ugugugcaauguaaggaua

SEQ ID NO: 187145 - RNA, 19 nt, Homo sapiens
gauugcaugugacucugaa

SEQ ID NO: 187146 - RNA, 19 nt, Homo sapiens
guacacagcaagacaaggu

SEQ ID NO: 187147 - RNA, 19 nt, Homo sapiens
agagguaccuuucuuaucc

SEQ ID NO: 187148 - RNA, 19 nt, Homo sapiens
ggauuggcccgauugauag

SEQ ID NO: 187149 - RNA, 19 nt, Homo sapiens
gugaacucuucgucucaua

SEQ ID NO: 187150 - RNA, 19 nt, Homo sapiens
cgcaugaauuauauccaua

SEQ ID NO: 187151 - RNA, 19 nt, Homo sapiens
ucuaugcaguggugucuga

SEQ ID NO: 187152 - RNA, 19 nt, Homo sapiens
ccaaaggaagagugccaua

SEQ ID NO: 187153 - RNA, 19 nt, Homo sapiens
gaauggaaacacaaaagua

SEQ ID NO: 187154 - RNA, 19 nt, Homo sapiens
cguugugucuggagaagaa

SEQ ID NO: 187155 - RNA, 19 nt, Homo sapiens
aaagaugcuugggaaguug

SEQ ID NO: 187156 - RNA, 19 nt, Homo sapiens
ccaaggacucaccgucuuu

SEQ ID NO: 187157 - RNA, 19 nt, Homo sapiens
cagcuauuguccuuuggaa

SEQ ID NO: 187158 - RNA, 19 nt, Homo sapiens
ggauaaagaagcaacaaaa

SEQ ID NO: 187159 - RNA, 19 nt, Homo sapiens
gaggaagcgcagaucauga

SEQ ID NO: 187160 - RNA, 19 nt, Homo sapiens
cgagacagaaccuuguuau

SEQ ID NO: 187161 - RNA, 19 nt, Homo sapiens
gaaccgcccaggaucagau

SEQ ID NO: 187162 - RNA, 19 nt, Homo sapiens
gggaauggacucauaugca

SEQ ID NO: 187163 - RNA, 19 nt, Homo sapiens
ucgagcgcaugaauuauau

SEQ ID NO: 187164 - RNA, 19 nt, Homo sapiens
aaggaaguuuacuggauuu

SEQ ID NO: 187165 - RNA, 19 nt, Homo sapiens
acacaaaaguagccauaaa

SEQ ID NO: 187166 - RNA, 19 nt, Homo sapiens
cccauuagcuuucaauucc

SEQ ID NO: 187167 - RNA, 19 nt, Homo sapiens
ggaagagcucugaaauuac

SEQ ID NO: 187168 - RNA, 19 nt, Homo sapiens
agaaggaagagcucugaaa

SEQ ID NO: 187169 - RNA, 19 nt, Homo sapiens
aagcugaugguuuguguuu

SEQ ID NO: 187170 - RNA, 19 nt, Homo sapiens
agucugacguguggucuuu

SEQ ID NO: 187171 - RNA, 19 nt, Homo sapiens
gaagcgcagaucaugaaga

SEQ ID NO: 187172 - RNA, 19 nt, Homo sapiens
ggcagaagagugguacuuu

SEQ ID NO: 187173 - RNA, 19 nt, Homo sapiens
guuacauucccagcaauua

SEQ ID NO: 187174 - RNA, 19 nt, Homo sapiens
gaguauaugaacaaaggaa

SEQ ID NO: 187175 - RNA, 19 nt, Homo sapiens
gaaaggagaccaugucaaa

SEQ ID NO: 187176 - RNA, 19 nt, Homo sapiens
aggaagagcucugaaauua

SEQ ID NO: 187177 - RNA, 19 nt, Homo sapiens
ggacucauaugcaagauug

SEQ ID NO: 187178 - RNA, 19 nt, Homo sapiens
ggaauggacucauaugcaa

SEQ ID NO: 187179 - RNA, 19 nt, Homo sapiens
gacagaaccuuguuauuuc

SEQ ID NO: 187180 - RNA, 19 nt, Homo sapiens
gaagggaauuuagauaaug

SEQ ID NO: 187181 - RNA, 19 nt, Homo sapiens
gaaguuuacuggauuucuu

SEQ ID NO: 187182 - RNA, 19 nt, Homo sapiens
gcagaagagugguacuuug

SEQ ID NO: 187183 - RNA, 19 nt, Homo sapiens
caaaggaaguuuacuggau

SEQ ID NO: 187184 - RNA, 19 nt, Homo sapiens
gaagagugguacuuuggaa

SEQ ID NO: 187185 - RNA, 19 nt, Homo sapiens
gcucugaaauuaccaaauc

SEQ ID NO: 187186 - RNA, 19 nt, Homo sapiens
agacagaaccuuguuauuu

SEQ ID NO: 187187 - RNA, 19 nt, Homo sapiens
gaacaaaggaaguuuacug

SEQ ID NO: 187188 - RNA, 19 nt, Homo sapiens
guacaacauuacucaggua

SEQ ID NO: 187189 - RNA, 19 nt, Homo sapiens
gaaauuaccaaaucuugug

SEQ ID NO: 187190 - RNA, 19 nt, Homo sapiens
ccaaaccucuguucagugu

SEQ ID NO: 187191 - RNA, 19 nt, Homo sapiens
gaaggaagagcucugaaau

SEQ ID NO: 187192 - RNA, 19 nt, Homo sapiens
aaaggaaguuuacuggauu

SEQ ID NO: 187193 - RNA, 19 nt, Homo sapiens
gaagggaggcuuacgugaa

SEQ ID NO: 187194 - RNA, 19 nt, Homo sapiens
aaaccucuguucaguguaa

SEQ ID NO: 187195 - RNA, 19 nt, Homo sapiens
gaagagcucugaaauuacc

SEQ ID NO: 187196 - RNA, 19 nt, Homo sapiens
gacagaagaugaccugagu

SEQ ID NO: 187197 - RNA, 19 nt, Homo sapiens
gaagcccgcuccuugacaa

SEQ ID NO: 187198 - RNA, 19 nt, Homo sapiens
gaacagcucggaaggagau

SEQ ID NO: 187199 - RNA, 19 nt, Homo sapiens
caacaauccuagugcuuuc

SEQ ID NO: 187200 - RNA, 19 nt, Homo sapiens
gaaaaugcauuguaucgau

SEQ ID NO: 187201 - RNA, 19 nt, Homo sapiens
ugauugggaugauaugaaa

SEQ ID NO: 187202 - RNA, 19 nt, Homo sapiens
gugaagggaauuuagauaa

SEQ ID NO: 187203 - RNA, 19 nt, Homo sapiens
ggagagacagguuacauuc

SEQ ID NO: 187204 - RNA, 19 nt, Homo sapiens
caacuggagagacagguua

SEQ ID NO: 187205 - RNA, 19 nt, Homo sapiens
gaagaacgccccacuuuug

SEQ ID NO: 187206 - RNA, 19 nt, Homo sapiens
cggauuggcccgauugaua

SEQ ID NO: 187207 - RNA, 19 nt, Homo sapiens
gauaaugggcugugugcaa

SEQ ID NO: 187208 - RNA, 19 nt, Homo sapiens
gaacuuccauggcccucau

SEQ ID NO: 187209 - RNA, 19 nt, Homo sapiens
aagcgcagaucaugaagaa

SEQ ID NO: 187210 - RNA, 19 nt, Homo sapiens
cagaagaugaccugaguuu

SEQ ID NO: 187211 - RNA, 19 nt, Homo sapiens
acaucgagcgcaugaauua

SEQ ID NO: 187212 - RNA, 19 nt, Homo sapiens
aaaugcaaauccuauguga

SEQ ID NO: 187213 - RNA, 19 nt, Homo sapiens
gcgcaugaauuauauccau

SEQ ID NO: 187214 - RNA, 19 nt, Homo sapiens
acagguggcugcaggaaug

SEQ ID NO: 187215 - RNA, 19 nt, Homo sapiens
caaaggugccuauucacuu

SEQ ID NO: 187216 - RNA, 19 nt, Homo sapiens
gcaauguaaggauaaagaa

SEQ ID NO: 187217 - RNA, 19 nt, Homo sapiens
gauagaagacaaugaguac

SEQ ID NO: 187218 - RNA, 19 nt, Homo sapiens
uaccaaaucuuguggacau

SEQ ID NO: 187219 - RNA, 19 nt, Homo sapiens
ugacaaugguggauacuac

SEQ ID NO: 187220 - RNA, 19 nt, Homo sapiens
caagacaaggugcaaaguu

SEQ ID NO: 187221 - RNA, 19 nt, Homo sapiens
gacaaugaguacacagcaa

SEQ ID NO: 187222 - RNA, 19 nt, Homo sapiens
ggccaaaccucuguucagu

SEQ ID NO: 187223 - RNA, 19 nt, Homo sapiens
aggaucagauugcauguga

SEQ ID NO: 187224 - RNA, 19 nt, Homo sapiens
aagacaaggugcaaaguuc

SEQ ID NO: 187225 - RNA, 19 nt, Homo sapiens
ccaacaauccuagugcuuu

SEQ ID NO: 187226 - RNA, 19 nt, Homo sapiens
gagacagaaccuuguuauu

SEQ ID NO: 187227 - RNA, 19 nt, Homo sapiens
ggagaaggaagagcucuga

SEQ ID NO: 187228 - RNA, 19 nt, Homo sapiens
gaagaugaccugaguuuuc

SEQ ID NO: 187229 - RNA, 19 nt, Homo sapiens
gugaagcauucgagacaga

SEQ ID NO: 187230 - RNA, 19 nt, Homo sapiens
cagguuacauucccagcaa

SEQ ID NO: 187231 - RNA, 19 nt, Homo sapiens
gccaaggacucaccgucuu

SEQ ID NO: 187232 - RNA, 19 nt, Homo sapiens
ugauagaagacaaugagua

SEQ ID NO: 187233 - RNA, 19 nt, Homo sapiens
gcgaucagcaaacauucua

SEQ ID NO: 187234 - RNA, 19 nt, Homo sapiens
ccgaguauaugaacaaagg

SEQ ID NO: 187235 - RNA, 19 nt, Homo sapiens
gauugcaugugacucugaa

SEQ ID NO: 187236 - RNA, 19 nt, Homo sapiens
guacacagcaagacaaggu

SEQ ID NO: 187237 - RNA, 19 nt, Homo sapiens
ugugugcaauguaaggaua

SEQ ID NO: 187238 - RNA, 19 nt, Homo sapiens
agagguaccuuucuuaucc

SEQ ID NO: 187239 - RNA, 19 nt, Homo sapiens
ggauuggcccgauugauag

SEQ ID NO: 187240 - RNA, 19 nt, Homo sapiens
cgcaugaauuauauccaua

SEQ ID NO: 187241 - RNA, 19 nt, Homo sapiens
ucuaugcaguggugucuga

SEQ ID NO: 187242 - RNA, 19 nt, Homo sapiens
gugaacucuucgucucaua

SEQ ID NO: 187243 - RNA, 19 nt, Homo sapiens
ccaaaggaagagugccaua

SEQ ID NO: 187244 - RNA, 19 nt, Homo sapiens
ggauaaagaagcaacaaaa

SEQ ID NO: 187245 - RNA, 19 nt, Homo sapiens
gaauggaaacacaaaagua

SEQ ID NO: 187246 - RNA, 19 nt, Homo sapiens
ccaaggacucaccgucuuu

SEQ ID NO: 187247 - RNA, 19 nt, Homo sapiens
cagcuauuguccuuuggaa

SEQ ID NO: 187248 - RNA, 19 nt, Homo sapiens
gaggaagcgcagaucauga

SEQ ID NO: 187249 - RNA, 19 nt, Homo sapiens
cgagacagaaccuuguuau

SEQ ID NO: 187250 - RNA, 19 nt, Homo sapiens
gaaccgcccaggaucagau

SEQ ID NO: 187251 - RNA, 19 nt, Homo sapiens
gggaauggacucauaugca

SEQ ID NO: 187252 - RNA, 19 nt, Homo sapiens
ucgagcgcaugaauuauau

SEQ ID NO: 187253 - RNA, 19 nt, Homo sapiens
aaggaaguuuacuggauuu

SEQ ID NO: 187254 - RNA, 19 nt, Homo sapiens
acacaaaaguagccauaaa

SEQ ID NO: 187255 - RNA, 19 nt, Homo sapiens
cccauuagcuuucaauucc

SEQ ID NO: 187256 - RNA, 19 nt, Homo sapiens
ggaagagcucugaaauuac

SEQ ID NO: 187257 - RNA, 19 nt, Homo sapiens
agaaggaagagcucugaaa

SEQ ID NO: 187258 - RNA, 19 nt, Homo sapiens
agucugacguguggucuuu

SEQ ID NO: 187259 - RNA, 19 nt, Homo sapiens
gaagcgcagaucaugaaga

SEQ ID NO: 187260 - RNA, 19 nt, Homo sapiens
caacauuacucagguaccu

SEQ ID NO: 187261 - RNA, 19 nt, Homo sapiens
ggcagaagagugguacuuu

SEQ ID NO: 187262 - RNA, 19 nt, Homo sapiens
guuacauucccagcaauua

SEQ ID NO: 187263 - RNA, 19 nt, Homo sapiens
gaguauaugaacaaaggaa

SEQ ID NO: 187264 - RNA, 19 nt, Homo sapiens
gcaugaauuauauccauag

SEQ ID NO: 187265 - RNA, 19 nt, Homo sapiens
aaggaagagcucugaaauu

SEQ ID NO: 187266 - RNA, 19 nt, Homo sapiens
cgugaagggaauuuagaua

SEQ ID NO: 187267 - RNA, 19 nt, Homo sapiens
aagggaggcuuacgugaag

SEQ ID NO: 187268 - RNA, 19 nt, Homo sapiens
cuuaaaagauggagaagga

SEQ ID NO: 187269 - RNA, 19 nt, Homo sapiens
gcuauuguccuuuggaaac

SEQ ID NO: 187270 - RNA, 19 nt, Homo sapiens
auaaugggcugugugcaau

SEQ ID NO: 187271 - RNA, 19 nt, Homo sapiens
gaaccuccucugugaagca

SEQ ID NO: 187272 - RNA, 19 nt, Homo sapiens
auccgaaccuccucuguga

SEQ ID NO: 187273 - RNA, 19 nt, Homo sapiens
gaucagcaaacauucuagu

SEQ ID NO: 187274 - RNA, 19 nt, Homo sapiens
gcacagguggcugcaggaa

SEQ ID NO: 187275 - RNA, 19 nt, Homo sapiens
gcacggacaucgccuacaa

SEQ ID NO: 187276 - RNA, 19 nt, Homo sapiens
gcgaagcccucaugaacaa

SEQ ID NO: 187277 - RNA, 19 nt, Homo sapiens
cgucaucgcuugcuacuuc

SEQ ID NO: 187278 - RNA, 19 nt, Homo sapiens
ccagagcggccuaucauuu

SEQ ID NO: 187279 - RNA, 19 nt, Homo sapiens
cggucuacaugaucaaaua

SEQ ID NO: 187280 - RNA, 19 nt, Homo sapiens
gcaccauccucuucaugau

SEQ ID NO: 187281 - RNA, 19 nt, Homo sapiens
uaucucagcuacaaguuuc

SEQ ID NO: 187282 - RNA, 19 nt, Homo sapiens
cauccuaucucagcuacaa

SEQ ID NO: 187283 - RNA, 19 nt, Homo sapiens
gccuagaggugcaccaguu

SEQ ID NO: 187284 - RNA, 19 nt, Homo sapiens
ggccaacucucaguacuuc

SEQ ID NO: 187285 - RNA, 19 nt, Homo sapiens
ccacguacuugguagacau

SEQ ID NO: 187286 - RNA, 19 nt, Homo sapiens
cgacuucacggucuacaug

SEQ ID NO: 187287 - RNA, 19 nt, Homo sapiens
ucaugaugcucuacuucuu

SEQ ID NO: 187288 - RNA, 19 nt, Homo sapiens
gagcggcgugugcuucgua

SEQ ID NO: 187289 - RNA, 19 nt, Homo sapiens
cuacagacuccguauuuua

SEQ ID NO: 187290 - RNA, 19 nt, Homo sapiens
cacaggaggagacgcguuu

SEQ ID NO: 187291 - RNA, 19 nt, Homo sapiens
ucuauccgcuggugaaggu

SEQ ID NO: 187292 - RNA, 19 nt, Homo sapiens
cccuacagacuccguauuu

SEQ ID NO: 187293 - RNA, 19 nt, Homo sapiens
gggcugcaccauccucuuc

SEQ ID NO: 187294 - RNA, 19 nt, Homo sapiens
gaggccaacucucaguacu

SEQ ID NO: 187295 - RNA, 19 nt, Homo sapiens
cagacuccguauuuuauuu

SEQ ID NO: 187296 - RNA, 19 nt, Homo sapiens
aaggugccauccuaucuca

SEQ ID NO: 187297 - RNA, 19 nt, Homo sapiens
gaagcccucaugaacaagu

SEQ ID NO: 187298 - RNA, 19 nt, Homo sapiens
gcucuucguguaccuguuc

SEQ ID NO: 187299 - RNA, 19 nt, Homo sapiens
ucaaggugccauccuaucu

SEQ ID NO: 187300 - RNA, 19 nt, Homo sapiens
acacucgccucaccaacag

SEQ ID NO: 187301 - RNA, 19 nt, Homo sapiens
ccaucgaggccaacucuca

SEQ ID NO: 187302 - RNA, 19 nt, Homo sapiens
caugaugcucuacuucuuc

SEQ ID NO: 187303 - RNA, 19 nt, Homo sapiens
gcugcgaagcccucaugaa

SEQ ID NO: 187304 - RNA, 19 nt, Homo sapiens
gaauaaacuucacccagaa

SEQ ID NO: 187305 - RNA, 19 nt, Homo sapiens
gauggguucucacuauauu

SEQ ID NO: 187306 - RNA, 19 nt, Homo sapiens
guuaggaucuagaacuuug

SEQ ID NO: 187307 - RNA, 19 nt, Homo sapiens
gaucuagaacuuugccuuu

SEQ ID NO: 187308 - RNA, 19 nt, Homo sapiens
ccaacaaccuagaugugaa

SEQ ID NO: 187309 - RNA, 19 nt, Homo sapiens
caaguaggauuacaagcau

SEQ ID NO: 187310 - RNA, 19 nt, Homo sapiens
ggucugcgauccugaaugg

SEQ ID NO: 187311 - RNA, 19 nt, Homo sapiens
caacaaccuagaugugaaa

SEQ ID NO: 187312 - RNA, 19 nt, Homo sapiens
uaauauuggugcccugaug

SEQ ID NO: 187313 - RNA, 19 nt, Homo sapiens
gcagcgucgucauagguaa

SEQ ID NO: 187314 - RNA, 19 nt, Homo sapiens
cgucauagguaauauuggu

SEQ ID NO: 187315 - RNA, 19 nt, Homo sapiens
gaacuuugucuaucacucu

SEQ ID NO: 187316 - RNA, 19 nt, Homo sapiens
ccaaguaggauuacaagca

SEQ ID NO: 187317 - RNA, 19 nt, Homo sapiens
gugaggaggaugaggagua

SEQ ID NO: 187318 - RNA, 19 nt, Homo sapiens
ugucucaaccucccaagua

SEQ ID NO: 187319 - RNA, 19 nt, Homo sapiens
ucacagaugcgaacauagu

SEQ ID NO: 187320 - RNA, 19 nt, Homo sapiens
auucacagaugcgaacaua

SEQ ID NO: 187321 - RNA, 19 nt, Homo sapiens
gcuccgggcugaagauugc

SEQ ID NO: 187322 - RNA, 19 nt, Homo sapiens
gaauccagaacuuugucua

SEQ ID NO: 187323 - RNA, 19 nt, Homo sapiens
gcuacgccacccacaagua

SEQ ID NO: 187324 - RNA, 19 nt, Homo sapiens
guggcugccucgcugauga

SEQ ID NO: 187325 - RNA, 19 nt, Homo sapiens
caaccuagaugugaaaaca

SEQ ID NO: 187326 - RNA, 19 nt, Homo sapiens
uccagaacuuugucuauca

SEQ ID NO: 187327 - RNA, 19 nt, Homo sapiens
agagugcaguggcuauuca

SEQ ID NO: 187328 - RNA, 19 nt, Homo sapiens
gcccagaauccagaacuuu

SEQ ID NO: 187329 - RNA, 19 nt, Homo sapiens
ugcaguggcuauucacaga

SEQ ID NO: 187330 - RNA, 19 nt, Homo sapiens
cagaaggcgguaucgcuuu

SEQ ID NO: 187331 - RNA, 19 nt, Homo sapiens
uggcagcagcgucgucaua

SEQ ID NO: 187332 - RNA, 19 nt, Homo sapiens
ugaggaggaugaggaguag

SEQ ID NO: 187333 - RNA, 19 nt, Homo sapiens
caguggcuauucacagaug

SEQ ID NO: 187334 - RNA, 19 nt, Homo sapiens
ucgcugcugugcccaucua

SEQ ID NO: 187335 - RNA, 19 nt, Homo sapiens
caaccucccaaguaggauu

SEQ ID NO: 187336 - RNA, 19 nt, Homo sapiens
cacagaugcgaacauagua

SEQ ID NO: 187337 - RNA, 19 nt, Homo sapiens
cuacgccacccacaaguau

SEQ ID NO: 187338 - RNA, 19 nt, Homo sapiens
gcagcagcgucgucauagg

SEQ ID NO: 187339 - RNA, 19 nt, Homo sapiens
ccagaauccagaacuuugu

SEQ ID NO: 187340 - RNA, 19 nt, Homo sapiens
cgccgacgaugcccagaau

SEQ ID NO: 187341 - RNA, 19 nt, Homo sapiens
caacuccuagccucaagug

SEQ ID NO: 187342 - RNA, 19 nt, Homo sapiens
cccaacaaccuagauguga

SEQ ID NO: 187343 - RNA, 19 nt, Homo sapiens
cugcugcucuucacuugca

SEQ ID NO: 187344 - RNA, 19 nt, Homo sapiens
cccagaauccagaacuuug

SEQ ID NO: 187345 - RNA, 19 nt, Homo sapiens
gaauaaacuucacccagaa

SEQ ID NO: 187346 - RNA, 19 nt, Homo sapiens
gauggguucucacuauauu

SEQ ID NO: 187347 - RNA, 19 nt, Homo sapiens
guuaggaucuagaacuuug

SEQ ID NO: 187348 - RNA, 19 nt, Homo sapiens
gaucuagaacuuugccuuu

SEQ ID NO: 187349 - RNA, 19 nt, Homo sapiens
ccaacaaccuagaugugaa

SEQ ID NO: 187350 - RNA, 19 nt, Homo sapiens
caaguaggauuacaagcau

SEQ ID NO: 187351 - RNA, 19 nt, Homo sapiens
ggucugcgauccugaaugg

SEQ ID NO: 187352 - RNA, 19 nt, Homo sapiens
caacaaccuagaugugaaa

SEQ ID NO: 187353 - RNA, 19 nt, Homo sapiens
uaauauuggugcccugaug

SEQ ID NO: 187354 - RNA, 19 nt, Homo sapiens
gcagcgucgucauagguaa

SEQ ID NO: 187355 - RNA, 19 nt, Homo sapiens
cgucauagguaauauuggu

SEQ ID NO: 187356 - RNA, 19 nt, Homo sapiens
gaacuuugucuaucacucu

SEQ ID NO: 187357 - RNA, 19 nt, Homo sapiens
ccaaguaggauuacaagca

SEQ ID NO: 187358 - RNA, 19 nt, Homo sapiens
gugaggaggaugaggagua

SEQ ID NO: 187359 - RNA, 19 nt, Homo sapiens
ugucucaaccucccaagua

SEQ ID NO: 187360 - RNA, 19 nt, Homo sapiens
ucacagaugcgaacauagu

SEQ ID NO: 187361 - RNA, 19 nt, Homo sapiens
auucacagaugcgaacaua

SEQ ID NO: 187362 - RNA, 19 nt, Homo sapiens
ugagaaugcggguaagaaa

SEQ ID NO: 187363 - RNA, 19 nt, Homo sapiens
gcuccgggcugaagauugc

SEQ ID NO: 187364 - RNA, 19 nt, Homo sapiens
gaauccagaacuuugucua

SEQ ID NO: 187365 - RNA, 19 nt, Homo sapiens
gcuacgccacccacaagua

SEQ ID NO: 187366 - RNA, 19 nt, Homo sapiens
guggcugccucgcugauga

SEQ ID NO: 187367 - RNA, 19 nt, Homo sapiens
caggugagaaugcggguaa

SEQ ID NO: 187368 - RNA, 19 nt, Homo sapiens
caaccuagaugugaaaaca

SEQ ID NO: 187369 - RNA, 19 nt, Homo sapiens
uccagaacuuugucuauca

SEQ ID NO: 187370 - RNA, 19 nt, Homo sapiens
agagugcaguggcuauuca

SEQ ID NO: 187371 - RNA, 19 nt, Homo sapiens
gcccagaauccagaacuuu

SEQ ID NO: 187372 - RNA, 19 nt, Homo sapiens
ugcaguggcuauucacaga

SEQ ID NO: 187373 - RNA, 19 nt, Homo sapiens
uggcagcagcgucgucaua

SEQ ID NO: 187374 - RNA, 19 nt, Homo sapiens
cagaaggcgguaucgcuuu

SEQ ID NO: 187375 - RNA, 19 nt, Homo sapiens
ugaggaggaugaggaguag

SEQ ID NO: 187376 - RNA, 19 nt, Homo sapiens
caguggcuauucacagaug

SEQ ID NO: 187377 - RNA, 19 nt, Homo sapiens
ucgcugcugugcccaucua

SEQ ID NO: 187378 - RNA, 19 nt, Homo sapiens
caaccucccaaguaggauu

SEQ ID NO: 187379 - RNA, 19 nt, Homo sapiens
cacagaugcgaacauagua

SEQ ID NO: 187380 - RNA, 19 nt, Homo sapiens
cuacgccacccacaaguau

SEQ ID NO: 187381 - RNA, 19 nt, Homo sapiens
gcagcagcgucgucauagg

SEQ ID NO: 187382 - RNA, 19 nt, Homo sapiens
gguggaggcaggugagaau

SEQ ID NO: 187383 - RNA, 19 nt, Homo sapiens
ccagaauccagaacuuugu

SEQ ID NO: 187384 - RNA, 19 nt, Homo sapiens
gugagaaugcggguaagaa

SEQ ID NO: 187385 - RNA, 19 nt, Homo sapiens
cgccgacgaugcccagaau

SEQ ID NO: 187386 - RNA, 19 nt, Homo sapiens
caacuccuagccucaagug

SEQ ID NO: 187387 - RNA, 19 nt, Homo sapiens
cccaacaaccuagauguga

SEQ ID NO: 187388 - RNA, 19 nt, Homo sapiens
gagaaugcggguaagaaaa

SEQ ID NO: 187389 - RNA, 19 nt, Homo sapiens
cugcugcucuucacuugca

SEQ ID NO: 187390 - RNA, 19 nt, Homo sapiens
cccagaauccagaacuuug

SEQ ID NO: 187391 - RNA, 19 nt, Homo sapiens
gaauaaacuucacccagaa

SEQ ID NO: 187392 - RNA, 19 nt, Homo sapiens
gauggguucucacuauauu

SEQ ID NO: 187393 - RNA, 19 nt, Homo sapiens
guuaggaucuagaacuuug

SEQ ID NO: 187394 - RNA, 19 nt, Homo sapiens
gaucuagaacuuugccuuu

SEQ ID NO: 187395 - RNA, 19 nt, Homo sapiens
ccaacaaccuagaugugaa

SEQ ID NO: 187396 - RNA, 19 nt, Homo sapiens
caaguaggauuacaagcau

SEQ ID NO: 187397 - RNA, 19 nt, Homo sapiens
ggucugcgauccugaaugg

SEQ ID NO: 187398 - RNA, 19 nt, Homo sapiens
caacaaccuagaugugaaa

SEQ ID NO: 187399 - RNA, 19 nt, Homo sapiens
uaauauuggugcccugaug

SEQ ID NO: 187400 - RNA, 19 nt, Homo sapiens
gcagcgucgucauagguaa

SEQ ID NO: 187401 - RNA, 19 nt, Homo sapiens
cgucauagguaauauuggu

SEQ ID NO: 187402 - RNA, 19 nt, Homo sapiens
gaacuuugucuaucacucu

SEQ ID NO: 187403 - RNA, 19 nt, Homo sapiens
ccaaguaggauuacaagca

SEQ ID NO: 187404 - RNA, 19 nt, Homo sapiens
uaaggaugcagguaagaaa

SEQ ID NO: 187405 - RNA, 19 nt, Homo sapiens
gugaggaggaugaggagua

SEQ ID NO: 187406 - RNA, 19 nt, Homo sapiens
ugucucaaccucccaagua

SEQ ID NO: 187407 - RNA, 19 nt, Homo sapiens
ucacagaugcgaacauagu

SEQ ID NO: 187408 - RNA, 19 nt, Homo sapiens
auucacagaugcgaacaua

SEQ ID NO: 187409 - RNA, 19 nt, Homo sapiens
gcuccgggcugaagauugc

SEQ ID NO: 187410 - RNA, 19 nt, Homo sapiens
guaaggaugcagguaagaa

SEQ ID NO: 187411 - RNA, 19 nt, Homo sapiens
gaauccagaacuuugucua

SEQ ID NO: 187412 - RNA, 19 nt, Homo sapiens
gcuacgccacccacaagua

SEQ ID NO: 187413 - RNA, 19 nt, Homo sapiens
guggcugccucgcugauga

SEQ ID NO: 187414 - RNA, 19 nt, Homo sapiens
caggugagaaugcggguaa

SEQ ID NO: 187415 - RNA, 19 nt, Homo sapiens
caaccuagaugugaaaaca

SEQ ID NO: 187416 - RNA, 19 nt, Homo sapiens
uccagaacuuugucuauca

SEQ ID NO: 187417 - RNA, 19 nt, Homo sapiens
agagugcaguggcuauuca

SEQ ID NO: 187418 - RNA, 19 nt, Homo sapiens
gcccagaauccagaacuuu

SEQ ID NO: 187419 - RNA, 19 nt, Homo sapiens
ugcaguggcuauucacaga

SEQ ID NO: 187420 - RNA, 19 nt, Homo sapiens
ggguaaggaugcagguaag

SEQ ID NO: 187421 - RNA, 19 nt, Homo sapiens
cagaaggcgguaucgcuuu

SEQ ID NO: 187422 - RNA, 19 nt, Homo sapiens
uggcagcagcgucgucaua

SEQ ID NO: 187423 - RNA, 19 nt, Homo sapiens
ugaggaggaugaggaguag

SEQ ID NO: 187424 - RNA, 19 nt, Homo sapiens
caguggcuauucacagaug

SEQ ID NO: 187425 - RNA, 19 nt, Homo sapiens
ucgcugcugugcccaucua

SEQ ID NO: 187426 - RNA, 19 nt, Homo sapiens
caaccucccaaguaggauu

SEQ ID NO: 187427 - RNA, 19 nt, Homo sapiens
cacagaugcgaacauagua

SEQ ID NO: 187428 - RNA, 19 nt, Homo sapiens
cuacgccacccacaaguau

SEQ ID NO: 187429 - RNA, 19 nt, Homo sapiens
gcagcagcgucgucauagg

SEQ ID NO: 187430 - RNA, 19 nt, Homo sapiens
gguggaggcaggugagaau

SEQ ID NO: 187431 - RNA, 19 nt, Homo sapiens
ccagaauccagaacuuugu

SEQ ID NO: 187432 - RNA, 19 nt, Homo sapiens
cggguaaggaugcagguaa

SEQ ID NO: 187433 - RNA, 19 nt, Homo sapiens
cgccgacgaugcccagaau

SEQ ID NO: 187434 - RNA, 19 nt, Homo sapiens
caacuccuagccucaagug

SEQ ID NO: 187435 - RNA, 19 nt, Homo sapiens
cccaacaaccuagauguga

SEQ ID NO: 187436 - RNA, 19 nt, Homo sapiens
cccagaauccagaacuuug

SEQ ID NO: 187437 - RNA, 19 nt, Homo sapiens
cugcugcucuucacuugca

SEQ ID NO: 187438 - RNA, 19 nt, Homo sapiens
ugagaaugcggguaaggau

SEQ ID NO: 187439 - RNA, 19 nt, Homo sapiens
gggaccagcuuaaguauaa

SEQ ID NO: 187440 - RNA, 19 nt, Homo sapiens
gaaugaauguucuccauga

SEQ ID NO: 187441 - RNA, 19 nt, Homo sapiens
gaaaggagcucugaaucug

SEQ ID NO: 187442 - RNA, 19 nt, Homo sapiens
gaggaggacuacuauuuga

SEQ ID NO: 187443 - RNA, 19 nt, Homo sapiens
gcucauaacaucuuugaaa

SEQ ID NO: 187444 - RNA, 19 nt, Homo sapiens
gucaacaucuucucucuuu

SEQ ID NO: 187445 - RNA, 19 nt, Homo sapiens
gcugacaucuccucuauca

SEQ ID NO: 187446 - RNA, 19 nt, Homo sapiens
agaaagaccuguugcuaga

SEQ ID NO: 187447 - RNA, 19 nt, Homo sapiens
gcaaugggcacugguauuu

SEQ ID NO: 187448 - RNA, 19 nt, Homo sapiens
caucuccucuaucacauua

SEQ ID NO: 187449 - RNA, 19 nt, Homo sapiens
gcugaagccuauuuauuug

SEQ ID NO: 187450 - RNA, 19 nt, Homo sapiens
ggguaaauaugacuccuuu

SEQ ID NO: 187451 - RNA, 19 nt, Homo sapiens
guaaugcacucucaguaau

SEQ ID NO: 187452 - RNA, 19 nt, Homo sapiens
cuaccuguguucauucuua

SEQ ID NO: 187453 - RNA, 19 nt, Homo sapiens
gcagagcaaucaccaccaa

SEQ ID NO: 187454 - RNA, 19 nt, Homo sapiens
gcacagcagguguauacua

SEQ ID NO: 187455 - RNA, 19 nt, Homo sapiens
gacagggucucacuauguu

SEQ ID NO: 187456 - RNA, 19 nt, Homo sapiens
ccugaagacuuacuuauuc

SEQ ID NO: 187457 - RNA, 19 nt, Homo sapiens
gcacagacucuuucagaug

SEQ ID NO: 187458 - RNA, 19 nt, Homo sapiens
auaaagcaguucccuguaa

SEQ ID NO: 187459 - RNA, 19 nt, Homo sapiens
ggagaaaggagcucugaau

SEQ ID NO: 187460 - RNA, 19 nt, Homo sapiens
gcucucaacuccagcaugu

SEQ ID NO: 187461 - RNA, 19 nt, Homo sapiens
gccaagccaugucuaaaug

SEQ ID NO: 187462 - RNA, 19 nt, Homo sapiens
ggacuacuauuugaagcaa

SEQ ID NO: 187463 - RNA, 19 nt, Homo sapiens
uagaagagaugggauuuca

SEQ ID NO: 187464 - RNA, 19 nt, Homo sapiens
uagcugacaucuccucuau

SEQ ID NO: 187465 - RNA, 19 nt, Homo sapiens
caucuacucuuuccaucuu

SEQ ID NO: 187466 - RNA, 19 nt, Homo sapiens
caagggcucugcugacauc

SEQ ID NO: 187467 - RNA, 19 nt, Homo sapiens
ucaauuaggcucugaaauc

SEQ ID NO: 187468 - RNA, 19 nt, Homo sapiens
ggaggugccauaucacgua

SEQ ID NO: 187469 - RNA, 19 nt, Homo sapiens
ggauugaggaggacuacua

SEQ ID NO: 187470 - RNA, 19 nt, Homo sapiens
ucaggaagcugugggcauu

SEQ ID NO: 187471 - RNA, 19 nt, Homo sapiens
caucguauuuccuuggauu

SEQ ID NO: 187472 - RNA, 19 nt, Homo sapiens
guaauucugcuucuaguau

SEQ ID NO: 187473 - RNA, 19 nt, Homo sapiens
caauuaggcucugaaaucu

SEQ ID NO: 187474 - RNA, 19 nt, Homo sapiens
gaagcaaugggcacuggua

SEQ ID NO: 187475 - RNA, 19 nt, Homo sapiens
gcacugguauuuggagcaa

SEQ ID NO: 187476 - RNA, 19 nt, Homo sapiens
uacaucauccuccuuauaa

SEQ ID NO: 187477 - RNA, 19 nt, Homo sapiens
ccaggcugcucuugaauuc

SEQ ID NO: 187478 - RNA, 19 nt, Homo sapiens
aaauaugacuccuuucucu

SEQ ID NO: 187479 - RNA, 19 nt, Homo sapiens
gauccuaacugagaauuuu

SEQ ID NO: 187480 - RNA, 19 nt, Homo sapiens
ggcuggagauccuaacuga

SEQ ID NO: 187481 - RNA, 19 nt, Homo sapiens
gcuagaaguuggguuguuc

SEQ ID NO: 187482 - RNA, 19 nt, Homo sapiens
caagugacaugccauccau

SEQ ID NO: 187483 - RNA, 19 nt, Homo sapiens
gauaaagcaguucccugua

SEQ ID NO: 187484 - RNA, 19 nt, Homo sapiens
ggcucaaccucgucuuuaa

SEQ ID NO: 187485 - RNA, 19 nt, Homo sapiens
gggauccagucaacacauu

SEQ ID NO: 187486 - RNA, 19 nt, Homo sapiens
gagcacauucuuaaaggaa

SEQ ID NO: 187487 - RNA, 19 nt, Homo sapiens
ugaauguucuccaugacuu

SEQ ID NO: 187488 - RNA, 19 nt, Homo sapiens
aaagcaagacuuccaggua

SEQ ID NO: 187489 - RNA, 19 nt, Homo sapiens
cagcuucgccaucggauuu

SEQ ID NO: 187490 - RNA, 19 nt, Homo sapiens
caccaugccaggcuaauuu

SEQ ID NO: 187491 - RNA, 19 nt, Homo sapiens
guaaauaugacuccuuucu

SEQ ID NO: 187492 - RNA, 19 nt, Homo sapiens
cuaaugaagcuauugagaa

SEQ ID NO: 187493 - RNA, 19 nt, Homo sapiens
cuaaucauauuggguaaug

SEQ ID NO: 187494 - RNA, 19 nt, Homo sapiens
ccaaggaaaugaggaugga

SEQ ID NO: 187495 - RNA, 19 nt, Homo sapiens
uaaagccgaccuacagauu

SEQ ID NO: 187496 - RNA, 19 nt, Homo sapiens
gaaagauaaagccgaccua

SEQ ID NO: 187497 - RNA, 19 nt, Homo sapiens
ugacccagauauugcacua

SEQ ID NO: 187498 - RNA, 19 nt, Homo sapiens
gaggaaggaaugaauguuc

SEQ ID NO: 187499 - RNA, 19 nt, Homo sapiens
gggcucugcugacaucuuc

SEQ ID NO: 187500 - RNA, 19 nt, Homo sapiens
cagcacagacucuuucaga

SEQ ID NO: 187501 - RNA, 19 nt, Homo sapiens
ugacaucuccucuaucaca

SEQ ID NO: 187502 - RNA, 19 nt, Homo sapiens
gagaaaggagcucugaauc

SEQ ID NO: 187503 - RNA, 19 nt, Homo sapiens
ccauaucacguacaccaua

SEQ ID NO: 187504 - RNA, 19 nt, Homo sapiens
gauaaagccgaccuacaga

SEQ ID NO: 187505 - RNA, 19 nt, Homo sapiens
uuacaucauccuccuuaua

SEQ ID NO: 187506 - RNA, 19 nt, Homo sapiens
cauuacaucauccuccuua

SEQ ID NO: 187507 - RNA, 19 nt, Homo sapiens
gggcacagcagguguauac

SEQ ID NO: 187508 - RNA, 19 nt, Homo sapiens
uuaaguggauucucuuugg

SEQ ID NO: 187509 - RNA, 19 nt, Homo sapiens
acaaccauccugcucauaa

SEQ ID NO: 187510 - RNA, 19 nt, Homo sapiens
ccgcguagcuggcauacag

SEQ ID NO: 187511 - RNA, 19 nt, Homo sapiens
caccaagccuggaauaacu

SEQ ID NO: 187512 - RNA, 19 nt, Homo sapiens
ugagaaagaccuguugcua

SEQ ID NO: 187513 - RNA, 19 nt, Homo sapiens
cgccucagcucuauuguag

SEQ ID NO: 187514 - RNA, 19 nt, Homo sapiens
gaaccugggcacgcucuuu

SEQ ID NO: 187515 - RNA, 19 nt, Homo sapiens
ggauccagucaacacauua

SEQ ID NO: 187516 - RNA, 19 nt, Homo sapiens
gauauugcacuaggucaaa

SEQ ID NO: 187517 - RNA, 19 nt, Homo sapiens
uuuaguauguggcguauca

SEQ ID NO: 187518 - RNA, 19 nt, Homo sapiens
gcuaaugaagcuauugaga

SEQ ID NO: 187519 - RNA, 19 nt, Homo sapiens
augccagccucaagaaaua

SEQ ID NO: 187520 - RNA, 19 nt, Homo sapiens
ugucucagccuccucagua

SEQ ID NO: 187521 - RNA, 19 nt, Homo sapiens
gaauguucuccaugacuuu

SEQ ID NO: 187522 - RNA, 19 nt, Homo sapiens
guacaccauaugcaaguuu

SEQ ID NO: 187523 - RNA, 19 nt, Homo sapiens
ugaggaggacuacuauuug

SEQ ID NO: 187524 - RNA, 19 nt, Homo sapiens
gaggauggaggaaggaaug

SEQ ID NO: 187525 - RNA, 19 nt, Homo sapiens
uaaguggauucucuuugga

SEQ ID NO: 187526 - RNA, 19 nt, Homo sapiens
gucaaaacauucagguaua

SEQ ID NO: 187527 - RNA, 19 nt, Homo sapiens
gugcauacauguucaucgu

SEQ ID NO: 187528 - RNA, 19 nt, Homo sapiens
gcucugaaucugauaggaa

SEQ ID NO: 187529 - RNA, 19 nt, Homo sapiens
gaaagaccuguugcuagaa

SEQ ID NO: 187530 - RNA, 19 nt, Homo sapiens
ccuccucucucuacuugaa

SEQ ID NO: 187531 - RNA, 19 nt, Homo sapiens
gagggucgccuggcuuauu

SEQ ID NO: 187532 - RNA, 19 nt, Homo sapiens
agaagucguuguaagagau

SEQ ID NO: 187533 - RNA, 19 nt, Homo sapiens
aaacaaccauccugcucau

SEQ ID NO: 187534 - RNA, 19 nt, Homo sapiens
aagcugaagccuauuuauu

SEQ ID NO: 187535 - RNA, 19 nt, Homo sapiens
gaacuccugaccucaagug

SEQ ID NO: 187536 - RNA, 19 nt, Homo sapiens
auuaggcucugaaaucuug

SEQ ID NO: 187537 - RNA, 19 nt, Homo sapiens
gaucgcagaccucaggaau

SEQ ID NO: 187538 - RNA, 19 nt, Homo sapiens
guuggguuguucuggauuu

SEQ ID NO: 187539 - RNA, 19 nt, Homo sapiens
gcaaggagauggugcagaa

SEQ ID NO: 187540 - RNA, 19 nt, Homo sapiens
gagaguggguuuccaguau

SEQ ID NO: 187541 - RNA, 19 nt, Homo sapiens
ccaagaugaugaccaagaa

SEQ ID NO: 187542 - RNA, 19 nt, Homo sapiens
cgugaggccuggcguauuu

SEQ ID NO: 187543 - RNA, 19 nt, Homo sapiens
caacaucgccugcguuauc

SEQ ID NO: 187544 - RNA, 19 nt, Homo sapiens
acacacauauucaucauca

SEQ ID NO: 187545 - RNA, 19 nt, Homo sapiens
gacaacaucgccugcguua

SEQ ID NO: 187546 - RNA, 19 nt, Homo sapiens
cagacgagcugaugaagag

SEQ ID NO: 187547 - RNA, 19 nt, Homo sapiens
cggaaacggucguaacuuc

SEQ ID NO: 187548 - RNA, 19 nt, Homo sapiens
ucagucggauacacacaua

SEQ ID NO: 187549 - RNA, 19 nt, Homo sapiens
acaccaagaugaugaccaa

SEQ ID NO: 187550 - RNA, 19 nt, Homo sapiens
cgggugaccuggccaagaa

SEQ ID NO: 187551 - RNA, 19 nt, Homo sapiens
gaguggguuuccaguauga

SEQ ID NO: 187552 - RNA, 19 nt, Homo sapiens
cagaugacguccgugauga

SEQ ID NO: 187553 - RNA, 19 nt, Homo sapiens
gcugacauccgcaaacaga

SEQ ID NO: 187554 - RNA, 19 nt, Homo sapiens
gauacacacauauucauca

SEQ ID NO: 187555 - RNA, 19 nt, Homo sapiens
caagcuggaggacuucuuu

SEQ ID NO: 187556 - RNA, 19 nt, Homo sapiens
gccauuaaauccgcaaaca

SEQ ID NO: 187557 - RNA, 19 nt, Homo sapiens
gcagacgagcugaugaaga

SEQ ID NO: 187558 - RNA, 19 nt, Homo sapiens
gccaagcacucgagaccau

SEQ ID NO: 187559 - RNA, 19 nt, Homo sapiens
gaccucagcugcacauucc

SEQ ID NO: 187560 - RNA, 19 nt, Homo sapiens
ugaccuacggcaacagaua

SEQ ID NO: 187561 - RNA, 19 nt, Homo sapiens
gugcugagauuugccaaca

SEQ ID NO: 187562 - RNA, 19 nt, Homo sapiens
agagugagcccuucuucaa

SEQ ID NO: 187563 - RNA, 19 nt, Homo sapiens
gggcuauuucgaugaauuu

SEQ ID NO: 187564 - RNA, 19 nt, Homo sapiens
ugacguccgugaugagaag

SEQ ID NO: 187565 - RNA, 19 nt, Homo sapiens
caccaacucugcacuccau

SEQ ID NO: 187566 - RNA, 19 nt, Homo sapiens
gcacccacgugagagaauc

SEQ ID NO: 187567 - RNA, 19 nt, Homo sapiens
gaccugaccuacggcaaca

SEQ ID NO: 187568 - RNA, 19 nt, Homo sapiens
ggagccagaugcacuucgu

SEQ ID NO: 187569 - RNA, 19 nt, Homo sapiens
acacauauucaucaucaug

SEQ ID NO: 187570 - RNA, 19 nt, Homo sapiens
ggauacacacauauucauc

SEQ ID NO: 187571 - RNA, 19 nt, Homo sapiens
ccagggcgaugccuuccau

SEQ ID NO: 187572 - RNA, 19 nt, Homo sapiens
ggaggcagacgagcugaug

SEQ ID NO: 187573 - RNA, 19 nt, Homo sapiens
ucagaugacguccgugaug

SEQ ID NO: 187574 - RNA, 19 nt, Homo sapiens
augagaaggucaagguguu

SEQ ID NO: 187575 - RNA, 19 nt, Homo sapiens
agaguggguuuccaguaug

SEQ ID NO: 187576 - RNA, 19 nt, Homo sapiens
ccacugcugcaccagauug

SEQ ID NO: 187577 - RNA, 19 nt, Homo sapiens
gaugacguccgugaugaga

SEQ ID NO: 187578 - RNA, 19 nt, Homo sapiens
gcguuauccucaccuucaa

SEQ ID NO: 187579 - RNA, 19 nt, Homo sapiens
gauacaagaacgugaagcu

SEQ ID NO: 187580 - RNA, 19 nt, Homo sapiens
acgaggccgucaccaagaa

SEQ ID NO: 187581 - RNA, 19 nt, Homo sapiens
acagauacaagaacgugaa

SEQ ID NO: 187582 - RNA, 19 nt, Homo sapiens
agagaguggguuuccagua

SEQ ID NO: 187583 - RNA, 19 nt, Homo sapiens
agaaccaccuacugcagau

SEQ ID NO: 187584 - RNA, 19 nt, Homo sapiens
ugaugaagagaguggguuu

SEQ ID NO: 187585 - RNA, 19 nt, Homo sapiens
gugaugagaaggucaaggu

SEQ ID NO: 187586 - RNA, 19 nt, Homo sapiens
gagcccaggagcugaguca

SEQ ID NO: 187587 - RNA, 19 nt, Homo sapiens
ccaagcccauccccuauau

SEQ ID NO: 187588 - RNA, 19 nt, Homo sapiens
gaccuggccaagaagaaga

SEQ ID NO: 187589 - RNA, 19 nt, Homo sapiens
gagugagcccuucuucaag

SEQ ID NO: 187590 - RNA, 19 nt, Homo sapiens
uggcugacauccgcaaaca

SEQ ID NO: 187591 - RNA, 19 nt, Homo sapiens
gagcacccacgugagagaa

SEQ ID NO: 187592 - RNA, 19 nt, Homo sapiens
gaggacuccgggaccauug

SEQ ID NO: 187593 - RNA, 19 nt, Homo sapiens
uaugagggcaccuacaagu

SEQ ID NO: 187594 - RNA, 19 nt, Homo sapiens
cagccgucguccucuaugu

SEQ ID NO: 187595 - RNA, 19 nt, Homo sapiens
uccucuauguggagaauga

SEQ ID NO: 187596 - RNA, 19 nt, Homo sapiens
gaggugcaggccaacaaug

SEQ ID NO: 187597 - RNA, 19 nt, Homo sapiens
cagaggugcaggccaacaa

SEQ ID NO: 187598 - RNA, 19 nt, Homo sapiens
auucacgaguccugcauga

SEQ ID NO: 187599 - RNA, 19 nt, Homo sapiens
guaaagaccugcuguacug

SEQ ID NO: 187600 - RNA, 19 nt, Homo sapiens
ggauauaggugggaagaaa

SEQ ID NO: 187601 - RNA, 19 nt, Homo sapiens
caagaaggcugagugaaga

SEQ ID NO: 187602 - RNA, 19 nt, Homo sapiens
caaugaaccugcugauguu

SEQ ID NO: 187603 - RNA, 19 nt, Homo sapiens
aagauaaccuuuggccuua

SEQ ID NO: 187604 - RNA, 19 nt, Homo sapiens
gauccuaugcucuauuuaa

SEQ ID NO: 187605 - RNA, 19 nt, Homo sapiens
aaaggugacuuguuauaga

SEQ ID NO: 187606 - RNA, 19 nt, Homo sapiens
aagaaaaggugacuuguua

SEQ ID NO: 187607 - RNA, 19 nt, Homo sapiens
gaucuucucagccauguuu

SEQ ID NO: 187608 - RNA, 19 nt, Homo sapiens
gcaagaccuucuccuuugu

SEQ ID NO: 187609 - RNA, 19 nt, Homo sapiens
gguauugggagcuguauuu

SEQ ID NO: 187610 - RNA, 19 nt, Homo sapiens
cagcagaucugggaacugu

SEQ ID NO: 187611 - RNA, 19 nt, Homo sapiens
gaaaaggugacuuguuaua

SEQ ID NO: 187612 - RNA, 19 nt, Homo sapiens
cgaaacauccgcaccaaga

SEQ ID NO: 187613 - RNA, 19 nt, Homo sapiens
cgcaagaccuucuccuuug

SEQ ID NO: 187614 - RNA, 19 nt, Homo sapiens
gauaaccuuuggccuuaga

SEQ ID NO: 187615 - RNA, 19 nt, Homo sapiens
uggaagagaucccuuugga

SEQ ID NO: 187616 - RNA, 19 nt, Homo sapiens
ccaguugcuuucccaauug

SEQ ID NO: 187617 - RNA, 19 nt, Homo sapiens
cuacaugagugcccuggaa

SEQ ID NO: 187618 - RNA, 19 nt, Homo sapiens
ccagggcuauggcuauuau

SEQ ID NO: 187619 - RNA, 19 nt, Homo sapiens
ggaguaaagaccugcugua

SEQ ID NO: 187620 - RNA, 19 nt, Homo sapiens
gcagaucugggaacuguga

SEQ ID NO: 187621 - RNA, 19 nt, Homo sapiens
ggguaacagugaccaguga

SEQ ID NO: 187622 - RNA, 19 nt, Homo sapiens
gcugcccucugguuccuua

SEQ ID NO: 187623 - RNA, 19 nt, Homo sapiens
ggaagguccugcggaagug

SEQ ID NO: 187624 - RNA, 19 nt, Homo sapiens
gcuuaaugauuguccagaa

SEQ ID NO: 187625 - RNA, 19 nt, Homo sapiens
ggccaucauucucacugua

SEQ ID NO: 187626 - RNA, 19 nt, Homo sapiens
gaaccuuucacuuuccauu

SEQ ID NO: 187627 - RNA, 19 nt, Homo sapiens
gagaggaggccaucauucu

SEQ ID NO: 187628 - RNA, 19 nt, Homo sapiens
ugacugcuguugccaauac

SEQ ID NO: 187629 - RNA, 19 nt, Homo sapiens
ggguggcgcuggaaguuau

SEQ ID NO: 187630 - RNA, 19 nt, Homo sapiens
acaaugaaccugcugaugu

SEQ ID NO: 187631 - RNA, 19 nt, Homo sapiens
gcucuccacugguuaccuu

SEQ ID NO: 187632 - RNA, 19 nt, Homo sapiens
caucauugguggaagagau

SEQ ID NO: 187633 - RNA, 19 nt, Homo sapiens
ccaagaaggcugagugaag

SEQ ID NO: 187634 - RNA, 19 nt, Homo sapiens
gcagccagucggcagcuua

SEQ ID NO: 187635 - RNA, 19 nt, Homo sapiens
gaccuucuccuuugucaug

SEQ ID NO: 187636 - RNA, 19 nt, Homo sapiens
aaggugacuuguuauagaa

SEQ ID NO: 187637 - RNA, 19 nt, Homo sapiens
ccagaaggcggcuauaaag

SEQ ID NO: 187638 - RNA, 19 nt, Homo sapiens
cugauccuaugcucuauuu

SEQ ID NO: 187639 - RNA, 19 nt, Homo sapiens
cuggguggcugaagugauu

SEQ ID NO: 187640 - RNA, 19 nt, Homo sapiens
gccauggccuguugcuguu

SEQ ID NO: 187641 - RNA, 19 nt, Homo sapiens
gaggaggccaucauucuca

SEQ ID NO: 187642 - RNA, 19 nt, Homo sapiens
uaaugacccuugacuucug

SEQ ID NO: 187643 - RNA, 19 nt, Homo sapiens
caucucaguuuggcacuug

SEQ ID NO: 187644 - RNA, 19 nt, Homo sapiens
ggugacuuguuauagaaga

SEQ ID NO: 187645 - RNA, 19 nt, Homo sapiens
ggugacugcuguugccaau

SEQ ID NO: 187646 - RNA, 19 nt, Homo sapiens
ccuauuuccugccuucaga

SEQ ID NO: 187647 - RNA, 19 nt, Homo sapiens
uccaguugcuuucccaauu

SEQ ID NO: 187648 - RNA, 19 nt, Homo sapiens
ucgcaagaccuucuccuuu

SEQ ID NO: 187649 - RNA, 19 nt, Homo sapiens
cagccuguauuacuucaau

SEQ ID NO: 187650 - RNA, 19 nt, Homo sapiens
gaagaaaaggugacuuguu

SEQ ID NO: 187651 - RNA, 19 nt, Homo sapiens
gggcacuaaugacccuuga

SEQ ID NO: 187652 - RNA, 19 nt, Homo sapiens
gaaacauccgcaccaagau

SEQ ID NO: 187653 - RNA, 19 nt, Homo sapiens
gcuaucagcaaguuuguca

SEQ ID NO: 187654 - RNA, 19 nt, Homo sapiens
cauucucacuguaccacua

SEQ ID NO: 187655 - RNA, 19 nt, Homo sapiens
ccagcucccugauccuaug

SEQ ID NO: 187656 - RNA, 19 nt, Homo sapiens
gaaguuaucaguggcuagu

SEQ ID NO: 187657 - RNA, 19 nt, Homo sapiens
gaagugguuugagccaucu

SEQ ID NO: 187658 - RNA, 19 nt, Homo sapiens
gcacuaaugacccuugacu

SEQ ID NO: 187659 - RNA, 19 nt, Homo sapiens
gggaagguccugcggaagu

SEQ ID NO: 187660 - RNA, 19 nt, Homo sapiens
gcacgagaccccuuucuau

SEQ ID NO: 187661 - RNA, 19 nt, Homo sapiens
cugguuaccuugugguguu

SEQ ID NO: 187662 - RNA, 19 nt, Homo sapiens
gcccucugguuccuuaaug

SEQ ID NO: 187663 - RNA, 19 nt, Homo sapiens
gcuauuaucgcacugugau

SEQ ID NO: 187664 - RNA, 19 nt, Homo sapiens
caggaaacuucugcaguca

SEQ ID NO: 187665 - RNA, 19 nt, Homo sapiens
cagacaaacaggaaacuuc

SEQ ID NO: 187666 - RNA, 19 nt, Homo sapiens
aaacccaacucagcagauc

SEQ ID NO: 187667 - RNA, 19 nt, Homo sapiens
uuuccugccuucagacaaa

SEQ ID NO: 187668 - RNA, 19 nt, Homo sapiens
ggcuagcccugaaccuuuc

SEQ ID NO: 187669 - RNA, 19 nt, Homo sapiens
gcaccauugccaagcacua

SEQ ID NO: 187670 - RNA, 19 nt, Homo sapiens
gcaccucccacgccauugu

SEQ ID NO: 187671 - RNA, 19 nt, Homo sapiens
ugggagcuguauuugguuu

SEQ ID NO: 187672 - RNA, 19 nt, Homo sapiens
ggacagucagcccuuguag

SEQ ID NO: 187673 - RNA, 19 nt, Homo sapiens
ugaaccugcugauguugga

SEQ ID NO: 187674 - RNA, 19 nt, Homo sapiens
agagaucccuuuggacaag

SEQ ID NO: 187675 - RNA, 19 nt, Homo sapiens
uauuugguuucuccucgua

SEQ ID NO: 187676 - RNA, 19 nt, Homo sapiens
ggagcuguauuugguuucu

SEQ ID NO: 187677 - RNA, 19 nt, Homo sapiens
caguugcuuucccaauuga

SEQ ID NO: 187678 - RNA, 19 nt, Homo sapiens
acuaaugacccuugacuuc

SEQ ID NO: 187679 - RNA, 19 nt, Homo sapiens
ggccaguucuuccuuaucc

SEQ ID NO: 187680 - RNA, 19 nt, Homo sapiens
ugggugcucuccacugguu

SEQ ID NO: 187681 - RNA, 19 nt, Homo sapiens
uggcuagcccugaaccuuu

SEQ ID NO: 187682 - RNA, 19 nt, Homo sapiens
gaguaaagaccugcuguac

SEQ ID NO: 187683 - RNA, 19 nt, Homo sapiens
gguagggccugcucuuuuc

SEQ ID NO: 187684 - RNA, 19 nt, Homo sapiens
gucggcagcuuaugcuauc

SEQ ID NO: 187685 - RNA, 19 nt, Homo sapiens
uccagaaggcggcuauaaa

SEQ ID NO: 187686 - RNA, 19 nt, Homo sapiens
aaacuucugcagucaggaa

SEQ ID NO: 187687 - RNA, 19 nt, Homo sapiens
aguuaucaguggcuaguga

SEQ ID NO: 187688 - RNA, 19 nt, Homo sapiens
guccagaaggcggcuauaa

SEQ ID NO: 187689 - RNA, 19 nt, Homo sapiens
aaagagaggaggccaucau

SEQ ID NO: 187690 - RNA, 19 nt, Homo sapiens
gaaagagaggaggccauca

SEQ ID NO: 187691 - RNA, 19 nt, Homo sapiens
agucauagccaacgagagu

SEQ ID NO: 187692 - RNA, 19 nt, Homo sapiens
caugagugcccuggaaguu

SEQ ID NO: 187693 - RNA, 19 nt, Homo sapiens
gguggaagagaucccuuug

SEQ ID NO: 187694 - RNA, 19 nt, Homo sapiens
acagucagcccuuguaggu

SEQ ID NO: 187695 - RNA, 19 nt, Homo sapiens
gacuucugcuggguccuaa

SEQ ID NO: 187696 - RNA, 19 nt, Homo sapiens
auugggagcuguauuuggu

SEQ ID NO: 187697 - RNA, 19 nt, Homo sapiens
gccuguugcuguucaugau

SEQ ID NO: 187698 - RNA, 19 nt, Homo sapiens
cuugugguguuuggaguaa

SEQ ID NO: 187699 - RNA, 19 nt, Homo sapiens
gaagggcaaucacaguguu

SEQ ID NO: 187700 - RNA, 19 nt, Homo sapiens
aagaagacaugcugaaaug

SEQ ID NO: 187701 - RNA, 19 nt, Homo sapiens
uaucaucuguggcauguga

SEQ ID NO: 187702 - RNA, 19 nt, Homo sapiens
ugacugaaauaucaaaugg

SEQ ID NO: 187703 - RNA, 19 nt, Homo sapiens
ccacggaaaccuugaguga

SEQ ID NO: 187704 - RNA, 19 nt, Homo sapiens
cguagagccuccugaaaug

SEQ ID NO: 187705 - RNA, 19 nt, Homo sapiens
gggauucucuggcuuuuaa

SEQ ID NO: 187706 - RNA, 19 nt, Homo sapiens
cgaggaagaucgaccuauc

SEQ ID NO: 187707 - RNA, 19 nt, Homo sapiens
gaaguucucccaauaaagc

SEQ ID NO: 187708 - RNA, 19 nt, Homo sapiens
gaaaacgccugaagaagag

SEQ ID NO: 187709 - RNA, 19 nt, Homo sapiens
aauaugaguuggcgaggaa

SEQ ID NO: 187710 - RNA, 19 nt, Homo sapiens
ggcgagagaccguuuaguu

SEQ ID NO: 187711 - RNA, 19 nt, Homo sapiens
gagauggacccgccaaauc

SEQ ID NO: 187712 - RNA, 19 nt, Homo sapiens
uugagugacugaaauauca

SEQ ID NO: 187713 - RNA, 19 nt, Homo sapiens
gggagcaucugcaggucaa

SEQ ID NO: 187714 - RNA, 19 nt, Homo sapiens
gaaaugauugggccuaugc

SEQ ID NO: 187715 - RNA, 19 nt, Homo sapiens
uugaaguucucccaauaaa

SEQ ID NO: 187716 - RNA, 19 nt, Homo sapiens
gcgagagaccguuuaguuc

SEQ ID NO: 187717 - RNA, 19 nt, Homo sapiens
aauaucaaauggcgagaga

SEQ ID NO: 187718 - RNA, 19 nt, Homo sapiens
aaagaagacaugcugaaau

SEQ ID NO: 187719 - RNA, 19 nt, Homo sapiens
ggagauggacccgccaaau

SEQ ID NO: 187720 - RNA, 19 nt, Homo sapiens
ggaaccagcaacaccugaa

SEQ ID NO: 187721 - RNA, 19 nt, Homo sapiens
ggcccgagcaguucaguga

SEQ ID NO: 187722 - RNA, 19 nt, Homo sapiens
gaccaagacgcuacguaga

SEQ ID NO: 187723 - RNA, 19 nt, Homo sapiens
uuacagccuucugcaaaga

SEQ ID NO: 187724 - RNA, 19 nt, Homo sapiens
ccuaucaucuguggcaugu

SEQ ID NO: 187725 - RNA, 19 nt, Homo sapiens
ugaaaacgccugaagaaga

SEQ ID NO: 187726 - RNA, 19 nt, Homo sapiens
guagagccuccugaaauga

SEQ ID NO: 187727 - RNA, 19 nt, Homo sapiens
ggaaaccuugagugacuga

SEQ ID NO: 187728 - RNA, 19 nt, Homo sapiens
guuggaaaauucuucauug

SEQ ID NO: 187729 - RNA, 19 nt, Homo sapiens
ugaaaugauugggccuaug

SEQ ID NO: 187730 - RNA, 19 nt, Homo sapiens
gggcaaucacaguguuaaa

SEQ ID NO: 187731 - RNA, 19 nt, Homo sapiens
ccgagcaguucagugauga

SEQ ID NO: 187732 - RNA, 19 nt, Homo sapiens
gagagaccguuuaguuccu

SEQ ID NO: 187733 - RNA, 19 nt, Homo sapiens
cuacguagagccuccugaa

SEQ ID NO: 187734 - RNA, 19 nt, Homo sapiens
gaaccagcaacaccugaag

SEQ ID NO: 187735 - RNA, 19 nt, Homo sapiens
gcuccuauguuggaaaauu

SEQ ID NO: 187736 - RNA, 19 nt, Homo sapiens
acggaaaccuugagugacu

SEQ ID NO: 187737 - RNA, 19 nt, Homo sapiens
ccguuuaguuccuaucauc

SEQ ID NO: 187738 - RNA, 19 nt, Homo sapiens
agagaccguuuaguuccua

SEQ ID NO: 187739 - RNA, 19 nt, Homo sapiens
gugugaagaugguccugau

SEQ ID NO: 187740 - RNA, 19 nt, Homo sapiens
aaccuugagugacugaaau

SEQ ID NO: 187741 - RNA, 19 nt, Homo sapiens
aaaccuugagugacugaaa

SEQ ID NO: 187742 - RNA, 19 nt, Homo sapiens
ggugaaaacgccugaagaa

SEQ ID NO: 187743 - RNA, 19 nt, Homo sapiens
agagccuccugaaaugauu

SEQ ID NO: 187744 - RNA, 19 nt, Homo sapiens
ggaaccagcaacucaacgu

SEQ ID NO: 187745 - RNA, 19 nt, Homo sapiens
cuuuacagccuucugcaaa

SEQ ID NO: 187746 - RNA, 19 nt, Homo sapiens
caaucacaguguuaaaaga

SEQ ID NO: 187747 - RNA, 19 nt, Homo sapiens
gagaccguuuaguuccuau

SEQ ID NO: 187748 - RNA, 19 nt, Homo sapiens
ugaaguggaaccagcaaca

SEQ ID NO: 187749 - RNA, 19 nt, Homo sapiens
acguagagccuccugaaau

SEQ ID NO: 187750 - RNA, 19 nt, Homo sapiens
cccgagcaguucagugaug

SEQ ID NO: 187751 - RNA, 19 nt, Homo sapiens
gagugacugaaauaucaaa

SEQ ID NO: 187752 - RNA, 19 nt, Homo sapiens
agacugggugugaguguga

SEQ ID NO: 187753 - RNA, 19 nt, Homo sapiens
uaaaagaagacaugcugaa

SEQ ID NO: 187754 - RNA, 19 nt, Homo sapiens
gaccguuuaguuccuauca

SEQ ID NO: 187755 - RNA, 19 nt, Homo sapiens
caaauccagaggaggugaa

SEQ ID NO: 187756 - RNA, 19 nt, Homo sapiens
gaacagaucucacaagaac

SEQ ID NO: 187757 - RNA, 19 nt, Homo sapiens
gaacaucccuccuuauuuu

SEQ ID NO: 187758 - RNA, 19 nt, Homo sapiens
caacaaagauauagugauc

SEQ ID NO: 187759 - RNA, 19 nt, Homo sapiens
ccacauuccucacuacuaa

SEQ ID NO: 187760 - RNA, 19 nt, Homo sapiens
gaaggagguugcagcauug

SEQ ID NO: 187761 - RNA, 19 nt, Homo sapiens
gaagaugaguugacaccuu

SEQ ID NO: 187762 - RNA, 19 nt, Homo sapiens
gaauaaagagcccuaaguu

SEQ ID NO: 187763 - RNA, 19 nt, Homo sapiens
ccacggaucugacuacuca

SEQ ID NO: 187764 - RNA, 19 nt, Homo sapiens
caaaguguguacaucagua

SEQ ID NO: 187765 - RNA, 19 nt, Homo sapiens
guacaucaguaagaucaua

SEQ ID NO: 187766 - RNA, 19 nt, Homo sapiens
gaagaugcccuuuacugaa

SEQ ID NO: 187767 - RNA, 19 nt, Homo sapiens
ggaagaugcccuuuacuga

SEQ ID NO: 187768 - RNA, 19 nt, Homo sapiens
ggagaaagaggaaacagaa

SEQ ID NO: 187769 - RNA, 19 nt, Homo sapiens
caagaggucucagaucuau

SEQ ID NO: 187770 - RNA, 19 nt, Homo sapiens
ucucaagccuccuccaaua

SEQ ID NO: 187771 - RNA, 19 nt, Homo sapiens
gaagagaaccuugaagcaa

SEQ ID NO: 187772 - RNA, 19 nt, Homo sapiens
uuacuuuacugccugaaua

SEQ ID NO: 187773 - RNA, 19 nt, Homo sapiens
auacagaagugacagcuuu

SEQ ID NO: 187774 - RNA, 19 nt, Homo sapiens
ggaacaucccuccuuauuu

SEQ ID NO: 187775 - RNA, 19 nt, Homo sapiens
uaaauuugccuguuacuga

SEQ ID NO: 187776 - RNA, 19 nt, Homo sapiens
uagaacagaucucacaaga

SEQ ID NO: 187777 - RNA, 19 nt, Homo sapiens
agaaggagguugcagcauu

SEQ ID NO: 187778 - RNA, 19 nt, Homo sapiens
ggaaaguuaccaagagaaa

SEQ ID NO: 187779 - RNA, 19 nt, Homo sapiens
ucaagugucuggagaagga

SEQ ID NO: 187780 - RNA, 19 nt, Homo sapiens
gugccaaccucuuuaguga

SEQ ID NO: 187781 - RNA, 19 nt, Homo sapiens
caaguggagacuauaaaua

SEQ ID NO: 187782 - RNA, 19 nt, Homo sapiens
gcccuaaguuuguacuaaa

SEQ ID NO: 187783 - RNA, 19 nt, Homo sapiens
gaagggaaaguuaccaaga

SEQ ID NO: 187784 - RNA, 19 nt, Homo sapiens
gaagugacagcuuugagaa

SEQ ID NO: 187785 - RNA, 19 nt, Homo sapiens
auaaagagcccuaaguuug

SEQ ID NO: 187786 - RNA, 19 nt, Homo sapiens
aagaugcccuuuacugaaa

SEQ ID NO: 187787 - RNA, 19 nt, Homo sapiens
gaagcucaacaaagauaua

SEQ ID NO: 187788 - RNA, 19 nt, Homo sapiens
gauguccaauucaagauga

SEQ ID NO: 187789 - RNA, 19 nt, Homo sapiens
gacaugagcauccagugua

SEQ ID NO: 187790 - RNA, 19 nt, Homo sapiens
aggaagagauaguuugauu

SEQ ID NO: 187791 - RNA, 19 nt, Homo sapiens
ccacuuugcuguucuuuac

SEQ ID NO: 187792 - RNA, 19 nt, Homo sapiens
gcugugguguucuauggua

SEQ ID NO: 187793 - RNA, 19 nt, Homo sapiens
aagaugaguugacaccuuu

SEQ ID NO: 187794 - RNA, 19 nt, Homo sapiens
ggaagagauaguuugauuu

SEQ ID NO: 187795 - RNA, 19 nt, Homo sapiens
ugaagcaaguggagacuau

SEQ ID NO: 187796 - RNA, 19 nt, Homo sapiens
aaagagcccuaaguuugua

SEQ ID NO: 187797 - RNA, 19 nt, Homo sapiens
gaugaaggcuaucguugag

SEQ ID NO: 187798 - RNA, 19 nt, Homo sapiens
agaguuggaugaccagaaa

SEQ ID NO: 187799 - RNA, 19 nt, Homo sapiens
ugaaggcuaucguugagaa

SEQ ID NO: 187800 - RNA, 19 nt, Homo sapiens
ggaagagucuacccgacau

SEQ ID NO: 187801 - RNA, 19 nt, Homo sapiens
ggcccaagguggaguauuc

SEQ ID NO: 187802 - RNA, 19 nt, Homo sapiens
ugaagguucuggaagcaaa

SEQ ID NO: 187803 - RNA, 19 nt, Homo sapiens
gccaaccucuuuagugaug

SEQ ID NO: 187804 - RNA, 19 nt, Homo sapiens
ccaaggcuauguuugaauc

SEQ ID NO: 187805 - RNA, 19 nt, Homo sapiens
uaaagagcccuaaguuugu

SEQ ID NO: 187806 - RNA, 19 nt, Homo sapiens
gcaaguggagacuauaaau

SEQ ID NO: 187807 - RNA, 19 nt, Homo sapiens
ccaagacccggaccuuuaa

SEQ ID NO: 187808 - RNA, 19 nt, Homo sapiens
gggcgugauugaggaauuu

SEQ ID NO: 187809 - RNA, 19 nt, Homo sapiens
gauaaugaagguucuggaa

SEQ ID NO: 187810 - RNA, 19 nt, Homo sapiens
uaugggagucgucagauua

SEQ ID NO: 187811 - RNA, 19 nt, Homo sapiens
cagggugggagucauauua

SEQ ID NO: 187812 - RNA, 19 nt, Homo sapiens
gcccaagguugaagcaaug

SEQ ID NO: 187813 - RNA, 19 nt, Homo sapiens
auaaagcucuaucgggaaa

SEQ ID NO: 187814 - RNA, 19 nt, Homo sapiens
uaacgucuuucgccuagug

SEQ ID NO: 187815 - RNA, 19 nt, Homo sapiens
uaaccaagcuuuuagaaca

SEQ ID NO: 187816 - RNA, 19 nt, Homo sapiens
gaagagucuacccgacaua

SEQ ID NO: 187817 - RNA, 19 nt, Homo sapiens
ugacauugcccaagguuga

SEQ ID NO: 187818 - RNA, 19 nt, Homo sapiens
gaaacaaaugaaccaguga

SEQ ID NO: 187819 - RNA, 19 nt, Homo sapiens
cauaagcagugaucgagau

SEQ ID NO: 187820 - RNA, 19 nt, Homo sapiens
ugaagaagcagaggaagaa

SEQ ID NO: 187821 - RNA, 19 nt, Homo sapiens
ggauuuaccguccacauuc

SEQ ID NO: 187822 - RNA, 19 nt, Homo sapiens
ucagugcucugcucaucaa

SEQ ID NO: 187823 - RNA, 19 nt, Homo sapiens
ggaucaugcuguucaccaa

SEQ ID NO: 187824 - RNA, 19 nt, Homo sapiens
aauaaagagcccuaaguuu

SEQ ID NO: 187825 - RNA, 19 nt, Homo sapiens
gguguagcccucccacuuu

SEQ ID NO: 187826 - RNA, 19 nt, Homo sapiens
gagcaggugggcaagauga

SEQ ID NO: 187827 - RNA, 19 nt, Homo sapiens
caagcuagaagaccuguug

SEQ ID NO: 187828 - RNA, 19 nt, Homo sapiens
ggaccucaggguucacuuu

SEQ ID NO: 187829 - RNA, 19 nt, Homo sapiens
auacaggcaucuuccuuga

SEQ ID NO: 187830 - RNA, 19 nt, Homo sapiens
gaaagaggaaacagaagag

SEQ ID NO: 187831 - RNA, 19 nt, Homo sapiens
gcacucagcagguuaaagc

SEQ ID NO: 187832 - RNA, 19 nt, Homo sapiens
gaccaaagccggugaucuc

SEQ ID NO: 187833 - RNA, 19 nt, Homo sapiens
ggaucugacuacucacuca

SEQ ID NO: 187834 - RNA, 19 nt, Homo sapiens
gagugaagaugaguugaca

SEQ ID NO: 187835 - RNA, 19 nt, Homo sapiens
gaagcaaguggagacuaua

SEQ ID NO: 187836 - RNA, 19 nt, Homo sapiens
cgagggcgaugaagaagca

SEQ ID NO: 187837 - RNA, 19 nt, Homo sapiens
caagguggaguauucagaa

SEQ ID NO: 187838 - RNA, 19 nt, Homo sapiens
guuugaugcucauggguuu

SEQ ID NO: 187839 - RNA, 19 nt, Homo sapiens
acagagauaucaucagcau

SEQ ID NO: 187840 - RNA, 19 nt, Homo sapiens
uuagugauguccaauucaa

SEQ ID NO: 187841 - RNA, 19 nt, Homo sapiens
ggucugugccaaccucuuu

SEQ ID NO: 187842 - RNA, 19 nt, Homo sapiens
gacauauccuuguucuaca

SEQ ID NO: 187843 - RNA, 19 nt, Homo sapiens
ugacauauccuuguucuac

SEQ ID NO: 187844 - RNA, 19 nt, Homo sapiens
caagaugaaggcuaucguu

SEQ ID NO: 187845 - RNA, 19 nt, Homo sapiens
agauuauacuggagaaaga

SEQ ID NO: 187846 - RNA, 19 nt, Homo sapiens
ccaagaggucucagaucua

SEQ ID NO: 187847 - RNA, 19 nt, Homo sapiens
ucaagccuccuccaauaaa

SEQ ID NO: 187848 - RNA, 19 nt, Homo sapiens
gcuuugacauauccuuguu

SEQ ID NO: 187849 - RNA, 19 nt, Homo sapiens
auaagaggaucaugcuguu

SEQ ID NO: 187850 - RNA, 19 nt, Homo sapiens
gagcugaagacccacauca

SEQ ID NO: 187851 - RNA, 19 nt, Homo sapiens
gagaaaacacgauaaugaa

SEQ ID NO: 187852 - RNA, 19 nt, Homo sapiens
ggcccucccuguucgugua

SEQ ID NO: 187853 - RNA, 19 nt, Homo sapiens
agaaagaggaaacagaaga

SEQ ID NO: 187854 - RNA, 19 nt, Homo sapiens
acccggaccuuuaauacaa

SEQ ID NO: 187855 - RNA, 19 nt, Homo sapiens
accaagacccggaccuuua

SEQ ID NO: 187856 - RNA, 19 nt, Homo sapiens
gaacgagccuuccaacuuc

SEQ ID NO: 187857 - RNA, 19 nt, Homo sapiens
ccagaaauccugcaguuua

SEQ ID NO: 187858 - RNA, 19 nt, Homo sapiens
gggcugcucuguguuaaua

SEQ ID NO: 187859 - RNA, 19 nt, Homo sapiens
cagaaauccugcaguuuaa

SEQ ID NO: 187860 - RNA, 19 nt, Homo sapiens
ggaacgaccuggacuacau

SEQ ID NO: 187861 - RNA, 19 nt, Homo sapiens
ggagggcugcucuguguua

SEQ ID NO: 187862 - RNA, 19 nt, Homo sapiens
aaccugagcuccucugaaa

SEQ ID NO: 187863 - RNA, 19 nt, Homo sapiens
gaucgugaaugagcuggua

SEQ ID NO: 187864 - RNA, 19 nt, Homo sapiens
ggagggacuucacguucaa

SEQ ID NO: 187865 - RNA, 19 nt, Homo sapiens
aaacagcaaugccauggau

SEQ ID NO: 187866 - RNA, 19 nt, Homo sapiens
gagcugggcacuaaccauu

SEQ ID NO: 187867 - RNA, 19 nt, Homo sapiens
ugaacgagccuuccaacuu

SEQ ID NO: 187868 - RNA, 19 nt, Homo sapiens
gcuacgaggugcccuugga

SEQ ID NO: 187869 - RNA, 19 nt, Homo sapiens
cggcaugcggguaguauua

SEQ ID NO: 187870 - RNA, 19 nt, Homo sapiens
gcucuguguuaauaagauu

SEQ ID NO: 187871 - RNA, 19 nt, Homo sapiens
gggacacgcccauuuguga

SEQ ID NO: 187872 - RNA, 19 nt, Homo sapiens
ggacaugguggcugaguuc

SEQ ID NO: 187873 - RNA, 19 nt, Homo sapiens
gagaaccgccuccacuuca

SEQ ID NO: 187874 - RNA, 19 nt, Homo sapiens
ggacuucacguucaacaag

SEQ ID NO: 187875 - RNA, 19 nt, Homo sapiens
gcuacaagcuggagaaccu

SEQ ID NO: 187876 - RNA, 19 nt, Homo sapiens
gcugcuacaucccugcaaa

SEQ ID NO: 187877 - RNA, 19 nt, Homo sapiens
gagggcugcucuguguuaa

SEQ ID NO: 187878 - RNA, 19 nt, Homo sapiens
gaaccugagcuccucugaa

SEQ ID NO: 187879 - RNA, 19 nt, Homo sapiens
gaacgaccuggacuacaug

SEQ ID NO: 187880 - RNA, 19 nt, Homo sapiens
ugccagaaauccugcaguu

SEQ ID NO: 187881 - RNA, 19 nt, Homo sapiens
ccagagcagugcccacaca

SEQ ID NO: 187882 - RNA, 19 nt, Homo sapiens
cuggagggcugcucugugu

SEQ ID NO: 187883 - RNA, 19 nt, Homo sapiens
cggagggacuucacguuca

SEQ ID NO: 187884 - RNA, 19 nt, Homo sapiens
ucaaagauccagcuaacag

SEQ ID NO: 187885 - RNA, 19 nt, Homo sapiens
ccugagcuccucugaaaug

SEQ ID NO: 187886 - RNA, 19 nt, Homo sapiens
gacggcauguggauugaca

SEQ ID NO: 187887 - RNA, 19 nt, Homo sapiens
ggacacgcccauuugugau

SEQ ID NO: 187888 - RNA, 19 nt, Homo sapiens
gcacauccuacuccaugau

SEQ ID NO: 187889 - RNA, 19 nt, Homo sapiens
ugggaaagcugagguuguc

SEQ ID NO: 187890 - RNA, 19 nt, Homo sapiens
acaacagccugcucagucu

SEQ ID NO: 187891 - RNA, 19 nt, Homo sapiens
ccaacaaugagcuggagaa

SEQ ID NO: 187892 - RNA, 19 nt, Homo sapiens
ccacuucacgaucaaagau

SEQ ID NO: 187893 - RNA, 19 nt, Homo sapiens
gcugcucuguguuaauaag

SEQ ID NO: 187894 - RNA, 19 nt, Homo sapiens
gcagcagguaggacaguga

SEQ ID NO: 187895 - RNA, 19 nt, Homo sapiens
acacacaggucaucuuccu

SEQ ID NO: 187896 - RNA, 19 nt, Homo sapiens
agagcguggugcagcagua

SEQ ID NO: 187897 - RNA, 19 nt, Homo sapiens
ggcacauccuacuccauga

SEQ ID NO: 187898 - RNA, 19 nt, Homo sapiens
cuacacacaggucaucuuc

SEQ ID NO: 187899 - RNA, 19 nt, Homo sapiens
gccagaaauccugcaguuu

SEQ ID NO: 187900 - RNA, 19 nt, Homo sapiens
ugagaaccgccuccacuuc

SEQ ID NO: 187901 - RNA, 19 nt, Homo sapiens
cccaggagccguacagcuu

SEQ ID NO: 187902 - RNA, 19 nt, Homo sapiens
acauccuacuccaugauuu

SEQ ID NO: 187903 - RNA, 19 nt, Homo sapiens
gccaggugguggagaacau

SEQ ID NO: 187904 - RNA, 19 nt, Homo sapiens
agcaguaccuggacguugu

SEQ ID NO: 187905 - RNA, 19 nt, Homo sapiens
ggcuggacgugaugaugga

SEQ ID NO: 187906 - RNA, 19 nt, Homo sapiens
guugaugggagagcaguuu

SEQ ID NO: 187907 - RNA, 19 nt, Homo sapiens
gucccugucuccaacuuca

SEQ ID NO: 187908 - RNA, 19 nt, Homo sapiens
cccagcagguccucuccaa

SEQ ID NO: 187909 - RNA, 19 nt, Homo sapiens
caggagccguacagcuuca

SEQ ID NO: 187910 - RNA, 19 nt, Homo sapiens
guugugggauacccguuca

SEQ ID NO: 187911 - RNA, 19 nt, Homo sapiens
cgccuccacuucacgauca

SEQ ID NO: 187912 - RNA, 19 nt, Homo sapiens
accuggagcugggcacuaa

SEQ ID NO: 187913 - RNA, 19 nt, Homo sapiens
caguuucucuccacacacu

SEQ ID NO: 187914 - RNA, 19 nt, Homo sapiens
guucuuugcggaccaguuc

SEQ ID NO: 187915 - RNA, 19 nt, Homo sapiens
cauccuacuccaugauuuc

SEQ ID NO: 187916 - RNA, 19 nt, Homo sapiens
gaaacagacuccaaugaua

SEQ ID NO: 187917 - RNA, 19 nt, Homo sapiens
caucaaagcuagacacuau

SEQ ID NO: 187918 - RNA, 19 nt, Homo sapiens
gagcaaacauggaaugaau

SEQ ID NO: 187919 - RNA, 19 nt, Homo sapiens
gaugcuggauugacauuua

SEQ ID NO: 187920 - RNA, 19 nt, Homo sapiens
uaacgucccuucucauaaa

SEQ ID NO: 187921 - RNA, 19 nt, Homo sapiens
cagaagaccuuggcucuaa

SEQ ID NO: 187922 - RNA, 19 nt, Homo sapiens
gagaguggauuauguuguu

SEQ ID NO: 187923 - RNA, 19 nt, Homo sapiens
ggaggaagcagcccuauga

SEQ ID NO: 187924 - RNA, 19 nt, Homo sapiens
ucucaagacugcuaugaua

SEQ ID NO: 187925 - RNA, 19 nt, Homo sapiens
acaaguagaugcuggauug

SEQ ID NO: 187926 - RNA, 19 nt, Homo sapiens
gauaacgucccuucucaua

SEQ ID NO: 187927 - RNA, 19 nt, Homo sapiens
caagaagccuauucguauu

SEQ ID NO: 187928 - RNA, 19 nt, Homo sapiens
cgaagagugugaaaugaaa

SEQ ID NO: 187929 - RNA, 19 nt, Homo sapiens
ggaagcagcccuaugauca

SEQ ID NO: 187930 - RNA, 19 nt, Homo sapiens
cauaucagcuaaucaaugu

SEQ ID NO: 187931 - RNA, 19 nt, Homo sapiens
gaggagaugguucguguua

SEQ ID NO: 187932 - RNA, 19 nt, Homo sapiens
gccagcgccuuuagaaaua

SEQ ID NO: 187933 - RNA, 19 nt, Homo sapiens
ccaagaagccuauucguau

SEQ ID NO: 187934 - RNA, 19 nt, Homo sapiens
ccaguuagaucucccauca

SEQ ID NO: 187935 - RNA, 19 nt, Homo sapiens
cuagguagauccucaaaug

SEQ ID NO: 187936 - RNA, 19 nt, Homo sapiens
acaaacagguggaauacuu

SEQ ID NO: 187937 - RNA, 19 nt, Homo sapiens
caacaccugguaauacuua

SEQ ID NO: 187938 - RNA, 19 nt, Homo sapiens
gagacaaacagguggaaua

SEQ ID NO: 187939 - RNA, 19 nt, Homo sapiens
aaacagacuccaaugauaa

SEQ ID NO: 187940 - RNA, 19 nt, Homo sapiens
gcgaggaggagaugaauaa

SEQ ID NO: 187941 - RNA, 19 nt, Homo sapiens
guaauaccauuuccacugu

SEQ ID NO: 187942 - RNA, 19 nt, Homo sapiens
ggaccuuucugacauaauc

SEQ ID NO: 187943 - RNA, 19 nt, Homo sapiens
agaauuauguucccaugaa

SEQ ID NO: 187944 - RNA, 19 nt, Homo sapiens
gguaauacuuaucagauuc

SEQ ID NO: 187945 - RNA, 19 nt, Homo sapiens
gccagaaugggaagaauua

SEQ ID NO: 187946 - RNA, 19 nt, Homo sapiens
ucaguugacuccagccuuu

SEQ ID NO: 187947 - RNA, 19 nt, Homo sapiens
aagaaugacuugacacuuc

SEQ ID NO: 187948 - RNA, 19 nt, Homo sapiens
ugaccgaucuccuguggaa

SEQ ID NO: 187949 - RNA, 19 nt, Homo sapiens
caaacagguggaauacuua

SEQ ID NO: 187950 - RNA, 19 nt, Homo sapiens
ccaaaggugucuccaucaa

SEQ ID NO: 187951 - RNA, 19 nt, Homo sapiens
ugugguaucugaacaauuc

SEQ ID NO: 187952 - RNA, 19 nt, Homo sapiens
agacuuaaguggugcuuug

SEQ ID NO: 187953 - RNA, 19 nt, Homo sapiens
caaauuaugugccaaugac

SEQ ID NO: 187954 - RNA, 19 nt, Homo sapiens
ccacgaacauuuccagaag

SEQ ID NO: 187955 - RNA, 19 nt, Homo sapiens
cagaugagagaguggauua

SEQ ID NO: 187956 - RNA, 19 nt, Homo sapiens
cgacaacauuccagcaguu

SEQ ID NO: 187957 - RNA, 19 nt, Homo sapiens
agaagaagauccugugaag

SEQ ID NO: 187958 - RNA, 19 nt, Homo sapiens
gugaagaacuggaugaaaa

SEQ ID NO: 187959 - RNA, 19 nt, Homo sapiens
uaaguggguucguuguauu

SEQ ID NO: 187960 - RNA, 19 nt, Homo sapiens
ccacgagcauuuccaagug

SEQ ID NO: 187961 - RNA, 19 nt, Homo sapiens
gauggagaacucuauguuu

SEQ ID NO: 187962 - RNA, 19 nt, Homo sapiens
gccaagaagccuauucgua

SEQ ID NO: 187963 - RNA, 19 nt, Homo sapiens
ugauagaucuaguucacuu

SEQ ID NO: 187964 - RNA, 19 nt, Homo sapiens
acaagcaccagcugauuua

SEQ ID NO: 187965 - RNA, 19 nt, Homo sapiens
uggauuauguuguuguuga

SEQ ID NO: 187966 - RNA, 19 nt, Homo sapiens
gccaaugacuccaggaaca

SEQ ID NO: 187967 - RNA, 19 nt, Homo sapiens
gcaaauuaugugccaauga

SEQ ID NO: 187968 - RNA, 19 nt, Homo sapiens
ccuggaaacucuuggcauu

SEQ ID NO: 187969 - RNA, 19 nt, Homo sapiens
caagacugcuaugauauuc

SEQ ID NO: 187970 - RNA, 19 nt, Homo sapiens
aauauugccuugccauuuc

SEQ ID NO: 187971 - RNA, 19 nt, Homo sapiens
caugagcgguggugaagug

SEQ ID NO: 187972 - RNA, 19 nt, Homo sapiens
acccaaaccuguccaguga

SEQ ID NO: 187973 - RNA, 19 nt, Homo sapiens
ucgagacucuuccagguuu

SEQ ID NO: 187974 - RNA, 19 nt, Homo sapiens
gaaaauuacgucccaauga

SEQ ID NO: 187975 - RNA, 19 nt, Homo sapiens
caaaugaggcauguaucua

SEQ ID NO: 187976 - RNA, 19 nt, Homo sapiens
gaaaauccaccucuucuga

SEQ ID NO: 187977 - RNA, 19 nt, Homo sapiens
gcagcaguguagcagauga

SEQ ID NO: 187978 - RNA, 19 nt, Homo sapiens
aggcauguaucuauuaguu

SEQ ID NO: 187979 - RNA, 19 nt, Homo sapiens
ugugacaucuguggguuua

SEQ ID NO: 187980 - RNA, 19 nt, Homo sapiens
gcgaagagugugaaaugaa

SEQ ID NO: 187981 - RNA, 19 nt, Homo sapiens
gcuagacacuauuccagau

SEQ ID NO: 187982 - RNA, 19 nt, Homo sapiens
aaaggugucuccaucaagu

SEQ ID NO: 187983 - RNA, 19 nt, Homo sapiens
aaauccaccucuucugaaa

SEQ ID NO: 187984 - RNA, 19 nt, Homo sapiens
aggaggagaugaauaagug

SEQ ID NO: 187985 - RNA, 19 nt, Homo sapiens
gggagacaguccacagaau

SEQ ID NO: 187986 - RNA, 19 nt, Homo sapiens
gaagcagcccuaugaucaa

SEQ ID NO: 187987 - RNA, 19 nt, Homo sapiens
guuacgcaguggccguuua

SEQ ID NO: 187988 - RNA, 19 nt, Homo sapiens
gaaaccacauccagcucau

SEQ ID NO: 187989 - RNA, 19 nt, Homo sapiens
ggaguuauucccaugaugu

SEQ ID NO: 187990 - RNA, 19 nt, Homo sapiens
ccagaacgcaugcugauuc

SEQ ID NO: 187991 - RNA, 19 nt, Homo sapiens
uaaguggugcuuuguggua

SEQ ID NO: 187992 - RNA, 19 nt, Homo sapiens
cagcgaagagugugaaaug

SEQ ID NO: 187993 - RNA, 19 nt, Homo sapiens
caacacuauugaccggauu

SEQ ID NO: 187994 - RNA, 19 nt, Homo sapiens
gaagccuauucguauuauu

SEQ ID NO: 187995 - RNA, 19 nt, Homo sapiens
ucaagacugcuaugauauu

SEQ ID NO: 187996 - RNA, 19 nt, Homo sapiens
ugaagcagauggagaacuc

SEQ ID NO: 187997 - RNA, 19 nt, Homo sapiens
ugacaucuguggguuuaau

SEQ ID NO: 187998 - RNA, 19 nt, Homo sapiens
caagccagcgccuuuagaa

SEQ ID NO: 187999 - RNA, 19 nt, Homo sapiens
cacuguggauuuaaacaaa

SEQ ID NO: 188000 - RNA, 19 nt, Homo sapiens
ucacguaguaauaccauuu

SEQ ID NO: 188001 - RNA, 19 nt, Homo sapiens
aagaagccuauucguauua

SEQ ID NO: 188002 - RNA, 19 nt, Homo sapiens
gaagaaugacuugacacuu

SEQ ID NO: 188003 - RNA, 19 nt, Homo sapiens
ggagacaguccacagaauc

SEQ ID NO: 188004 - RNA, 19 nt, Homo sapiens
acacgacagugaagagaau

SEQ ID NO: 188005 - RNA, 19 nt, Homo sapiens
caacauuccagcaguuuua

SEQ ID NO: 188006 - RNA, 19 nt, Homo sapiens
ugggaaguguuucaaguga

SEQ ID NO: 188007 - RNA, 19 nt, Homo sapiens
ggagaugguucguguuacg

SEQ ID NO: 188008 - RNA, 19 nt, Homo sapiens
gcaaacauggaaugaaugg

SEQ ID NO: 188009 - RNA, 19 nt, Homo sapiens
ugaaacagacuccaaugau

SEQ ID NO: 188010 - RNA, 19 nt, Homo sapiens
uggcagcucuuuacaagca

SEQ ID NO: 188011 - RNA, 19 nt, Homo sapiens
gaugagagaguggauuaug

SEQ ID NO: 188012 - RNA, 19 nt, Homo sapiens
ccaaaccuguccagugaag

SEQ ID NO: 188013 - RNA, 19 nt, Homo sapiens
uagacacuauuccagauau

SEQ ID NO: 188014 - RNA, 19 nt, Homo sapiens
aaugaggcauguaucuauu

SEQ ID NO: 188015 - RNA, 19 nt, Homo sapiens
cgggaagccuggacagaug

SEQ ID NO: 188016 - RNA, 19 nt, Homo sapiens
ggagaaagguggaggagaa

SEQ ID NO: 188017 - RNA, 19 nt, Homo sapiens
gcaacacccucuucuaguu

SEQ ID NO: 188018 - RNA, 19 nt, Homo sapiens
ggaagaacaugcuauccaa

SEQ ID NO: 188019 - RNA, 19 nt, Homo sapiens
uaucaccucuucacaauuu

SEQ ID NO: 188020 - RNA, 19 nt, Homo sapiens
ggaagaagauugcuaccau

SEQ ID NO: 188021 - RNA, 19 nt, Homo sapiens
agucaugucuuuccuauuu

SEQ ID NO: 188022 - RNA, 19 nt, Homo sapiens
ccacugaggucuucacuuc

SEQ ID NO: 188023 - RNA, 19 nt, Homo sapiens
gaaggaggcuggaauugag

SEQ ID NO: 188024 - RNA, 19 nt, Homo sapiens
gaaucuuccuugcuuauga

SEQ ID NO: 188025 - RNA, 19 nt, Homo sapiens
ccaggaagaugaauacaug

SEQ ID NO: 188026 - RNA, 19 nt, Homo sapiens
ggagaaccgugaacuggaa

SEQ ID NO: 188027 - RNA, 19 nt, Homo sapiens
gggcauggcuaucuacaau

SEQ ID NO: 188028 - RNA, 19 nt, Homo sapiens
cauaaucucuuuccaucuu

SEQ ID NO: 188029 - RNA, 19 nt, Homo sapiens
ccacugagaagaucaauga

SEQ ID NO: 188030 - RNA, 19 nt, Homo sapiens
caagaagauuggcuacuau

SEQ ID NO: 188031 - RNA, 19 nt, Homo sapiens
acaagaagauuggcuacua

SEQ ID NO: 188032 - RNA, 19 nt, Homo sapiens
uauccaaucucaucucuug

SEQ ID NO: 188033 - RNA, 19 nt, Homo sapiens
gagugcauuugcuuuauaa

SEQ ID NO: 188034 - RNA, 19 nt, Homo sapiens
caacucacauguccguuau

SEQ ID NO: 188035 - RNA, 19 nt, Homo sapiens
gccaauacccgcagcauuu

SEQ ID NO: 188036 - RNA, 19 nt, Homo sapiens
guacaaggagcgucucuuu

SEQ ID NO: 188037 - RNA, 19 nt, Homo sapiens
gcacauuguuaugcacuuu

SEQ ID NO: 188038 - RNA, 19 nt, Homo sapiens
caacacccucuucuaguua

SEQ ID NO: 188039 - RNA, 19 nt, Homo sapiens
gcauuugcuuuauaaguga

SEQ ID NO: 188040 - RNA, 19 nt, Homo sapiens
cgagugcauuugcuuuaua

SEQ ID NO: 188041 - RNA, 19 nt, Homo sapiens
caacugagauugucaugcu

SEQ ID NO: 188042 - RNA, 19 nt, Homo sapiens
gcauggcuaucuacaaugu

SEQ ID NO: 188043 - RNA, 19 nt, Homo sapiens
aaagaucauugcugagaaa

SEQ ID NO: 188044 - RNA, 19 nt, Homo sapiens
ggaugcagccuuugccuuu

SEQ ID NO: 188045 - RNA, 19 nt, Homo sapiens
gcacuggcccugaacaaga

SEQ ID NO: 188046 - RNA, 19 nt, Homo sapiens
caacgacccuaucaagauc

SEQ ID NO: 188047 - RNA, 19 nt, Homo sapiens
gauauugacgucucuauuc

SEQ ID NO: 188048 - RNA, 19 nt, Homo sapiens
gaucauugcugagaaagag

SEQ ID NO: 188049 - RNA, 19 nt, Homo sapiens
ggaggaaccuaaggaagau

SEQ ID NO: 188050 - RNA, 19 nt, Homo sapiens
gggcuacgguuccauguuc

SEQ ID NO: 188051 - RNA, 19 nt, Homo sapiens
caacaugacaucccaggaa

SEQ ID NO: 188052 - RNA, 19 nt, Homo sapiens
acuaugagauugaguaugu

SEQ ID NO: 188053 - RNA, 19 nt, Homo sapiens
ucucaucucuuguaaauac

SEQ ID NO: 188054 - RNA, 19 nt, Homo sapiens
acaauugguucaagaucua

SEQ ID NO: 188055 - RNA, 19 nt, Homo sapiens
guggauaguugaugagaau

SEQ ID NO: 188056 - RNA, 19 nt, Homo sapiens
ccaaucucaucucuuguaa

SEQ ID NO: 188057 - RNA, 19 nt, Homo sapiens
caucuuacuugcccuucua

SEQ ID NO: 188058 - RNA, 19 nt, Homo sapiens
ccacugucauaaucucuuu

SEQ ID NO: 188059 - RNA, 19 nt, Homo sapiens
gguggcagcuacaagaaga

SEQ ID NO: 188060 - RNA, 19 nt, Homo sapiens
ggaagaaguacgucugguu

SEQ ID NO: 188061 - RNA, 19 nt, Homo sapiens
guaggcaugugcaauuugu

SEQ ID NO: 188062 - RNA, 19 nt, Homo sapiens
ucacagaaacucuuuaucu

SEQ ID NO: 188063 - RNA, 19 nt, Homo sapiens
guacuuucuucccuuaaau

SEQ ID NO: 188064 - RNA, 19 nt, Homo sapiens
guucguaccuggcuugaag

SEQ ID NO: 188065 - RNA, 19 nt, Homo sapiens
cggauggcauggacgcuua

SEQ ID NO: 188066 - RNA, 19 nt, Homo sapiens
gacaauugguucaagaucu

SEQ ID NO: 188067 - RNA, 19 nt, Homo sapiens
gaaucugcuccaagucuua

SEQ ID NO: 188068 - RNA, 19 nt, Homo sapiens
ggaaggaucuccccgaauc

SEQ ID NO: 188069 - RNA, 19 nt, Homo sapiens
uacaacaaccagaccauua

SEQ ID NO: 188070 - RNA, 19 nt, Homo sapiens
ggugguaugcugacaauug

SEQ ID NO: 188071 - RNA, 19 nt, Homo sapiens
ggguaggcaugugcaauuu

SEQ ID NO: 188072 - RNA, 19 nt, Homo sapiens
ucagaagguugccagauca

SEQ ID NO: 188073 - RNA, 19 nt, Homo sapiens
ccagcaggaugcagccuuu

SEQ ID NO: 188074 - RNA, 19 nt, Homo sapiens
gcauggauguccucacucu

SEQ ID NO: 188075 - RNA, 19 nt, Homo sapiens
uguccuagcuguugucugu

SEQ ID NO: 188076 - RNA, 19 nt, Homo sapiens
gcugacaauugguucaaga

SEQ ID NO: 188077 - RNA, 19 nt, Homo sapiens
ggagaagucccggcuguug

SEQ ID NO: 188078 - RNA, 19 nt, Homo sapiens
gaaccuaaggaagauauug

SEQ ID NO: 188079 - RNA, 19 nt, Homo sapiens
gaauuuguggagaaacuaa

SEQ ID NO: 188080 - RNA, 19 nt, Homo sapiens
gcaguccugugccucauca

SEQ ID NO: 188081 - RNA, 19 nt, Homo sapiens
cauugcagcuccaggaaga

SEQ ID NO: 188082 - RNA, 19 nt, Homo sapiens
caugacaucccaggaauuu

SEQ ID NO: 188083 - RNA, 19 nt, Homo sapiens
ccacaucacaacugagauu

SEQ ID NO: 188084 - RNA, 19 nt, Homo sapiens
ccauugcauucauguacua

SEQ ID NO: 188085 - RNA, 19 nt, Homo sapiens
cuauaucacucuuguugug

SEQ ID NO: 188086 - RNA, 19 nt, Homo sapiens
gaauacauggcuuggcauu

SEQ ID NO: 188087 - RNA, 19 nt, Homo sapiens
gggcauggauguccucacu

SEQ ID NO: 188088 - RNA, 19 nt, Homo sapiens
gcaccaaggaugaucuuuc

SEQ ID NO: 188089 - RNA, 19 nt, Homo sapiens
aaacuaaccaagcgacuga

SEQ ID NO: 188090 - RNA, 19 nt, Homo sapiens
ccaggaauuuguggagaaa

SEQ ID NO: 188091 - RNA, 19 nt, Homo sapiens
ccaccaaguaccuauauga

SEQ ID NO: 188092 - RNA, 19 nt, Homo sapiens
ucccaagacugcucccuuu

SEQ ID NO: 188093 - RNA, 19 nt, Homo sapiens
ugagucaugucuuuccuau

SEQ ID NO: 188094 - RNA, 19 nt, Homo sapiens
uguaucaccucuucacaau

SEQ ID NO: 188095 - RNA, 19 nt, Homo sapiens
gggaccaggugaaggcuau

SEQ ID NO: 188096 - RNA, 19 nt, Homo sapiens
gaaaagaucauugcugaga

SEQ ID NO: 188097 - RNA, 19 nt, Homo sapiens
aaugaacucuucguccuuu

SEQ ID NO: 188098 - RNA, 19 nt, Homo sapiens
guacuacccucagucuaca

SEQ ID NO: 188099 - RNA, 19 nt, Homo sapiens
ccaguggacuaugagauug

SEQ ID NO: 188100 - RNA, 19 nt, Homo sapiens
gaaggagaaccgugaacug

SEQ ID NO: 188101 - RNA, 19 nt, Homo sapiens
aagaaggaguggaggaaga

SEQ ID NO: 188102 - RNA, 19 nt, Homo sapiens
cacagaaacucuuuaucuc

SEQ ID NO: 188103 - RNA, 19 nt, Homo sapiens
ugaaggaggcuggaauuga

SEQ ID NO: 188104 - RNA, 19 nt, Homo sapiens
ggaagauauugacgucucu

SEQ ID NO: 188105 - RNA, 19 nt, Homo sapiens
aagauuggcuacuaugaca

SEQ ID NO: 188106 - RNA, 19 nt, Homo sapiens
cagaguuucuucucagauc

SEQ ID NO: 188107 - RNA, 19 nt, Homo sapiens
cuaucaagaucauccuuau

SEQ ID NO: 188108 - RNA, 19 nt, Homo sapiens
gaaucgaacgccacacuca

SEQ ID NO: 188109 - RNA, 19 nt, Homo sapiens
ggacuaugagauugaguau

SEQ ID NO: 188110 - RNA, 19 nt, Homo sapiens
guccgaaucugcuccaagu

SEQ ID NO: 188111 - RNA, 19 nt, Homo sapiens
uuucuucccuuaaaucaug

SEQ ID NO: 188112 - RNA, 19 nt, Homo sapiens
gaagguugccagaucauac

SEQ ID NO: 188113 - RNA, 19 nt, Homo sapiens
cgaaucugcuccaagucuu

SEQ ID NO: 188114 - RNA, 19 nt, Homo sapiens
gaucuuuccugguccaaaa

SEQ ID NO: 188115 - RNA, 19 nt, Homo sapiens
ugucacagaaucuccauuu

SEQ ID NO: 188116 - RNA, 19 nt, Homo sapiens
gcaacacccucuucuaguu

SEQ ID NO: 188117 - RNA, 19 nt, Homo sapiens
ggaagaacaugcuauccaa

SEQ ID NO: 188118 - RNA, 19 nt, Homo sapiens
uaucaccucuucacaauuu

SEQ ID NO: 188119 - RNA, 19 nt, Homo sapiens
ggaagaagauugcuaccau

SEQ ID NO: 188120 - RNA, 19 nt, Homo sapiens
agucaugucuuuccuauuu

SEQ ID NO: 188121 - RNA, 19 nt, Homo sapiens
ccacugaggucuucacuuc

SEQ ID NO: 188122 - RNA, 19 nt, Homo sapiens
gaaggaggcuggaauugag

SEQ ID NO: 188123 - RNA, 19 nt, Homo sapiens
gaaucuuccuugcuuauga

SEQ ID NO: 188124 - RNA, 19 nt, Homo sapiens
ccaggaagaugaauacaug

SEQ ID NO: 188125 - RNA, 19 nt, Homo sapiens
ggagaaccgugaacuggaa

SEQ ID NO: 188126 - RNA, 19 nt, Homo sapiens
gggcauggcuaucuacaau

SEQ ID NO: 188127 - RNA, 19 nt, Homo sapiens
cauaaucucuuuccaucuu

SEQ ID NO: 188128 - RNA, 19 nt, Homo sapiens
ccacugagaagaucaauga

SEQ ID NO: 188129 - RNA, 19 nt, Homo sapiens
caagaagauuggcuacuau

SEQ ID NO: 188130 - RNA, 19 nt, Homo sapiens
acaagaagauuggcuacua

SEQ ID NO: 188131 - RNA, 19 nt, Homo sapiens
uauccaaucucaucucuug

SEQ ID NO: 188132 - RNA, 19 nt, Homo sapiens
gagugcauuugcuuuauaa

SEQ ID NO: 188133 - RNA, 19 nt, Homo sapiens
caacucacauguccguuau

SEQ ID NO: 188134 - RNA, 19 nt, Homo sapiens
gccaauacccgcagcauuu

SEQ ID NO: 188135 - RNA, 19 nt, Homo sapiens
guacaaggagcgucucuuu

SEQ ID NO: 188136 - RNA, 19 nt, Homo sapiens
gcacauuguuaugcacuuu

SEQ ID NO: 188137 - RNA, 19 nt, Homo sapiens
caacacccucuucuaguua

SEQ ID NO: 188138 - RNA, 19 nt, Homo sapiens
gcauuugcuuuauaaguga

SEQ ID NO: 188139 - RNA, 19 nt, Homo sapiens
cgagugcauuugcuuuaua

SEQ ID NO: 188140 - RNA, 19 nt, Homo sapiens
caacugagauugucaugcu

SEQ ID NO: 188141 - RNA, 19 nt, Homo sapiens
gcauggcuaucuacaaugu

SEQ ID NO: 188142 - RNA, 19 nt, Homo sapiens
aaagaucauugcugagaaa

SEQ ID NO: 188143 - RNA, 19 nt, Homo sapiens
ggaugcagccuuugccuuu

SEQ ID NO: 188144 - RNA, 19 nt, Homo sapiens
gcacuggcccugaacaaga

SEQ ID NO: 188145 - RNA, 19 nt, Homo sapiens
caacgacccuaucaagauc

SEQ ID NO: 188146 - RNA, 19 nt, Homo sapiens
gauauugacgucucuauuc

SEQ ID NO: 188147 - RNA, 19 nt, Homo sapiens
gaucauugcugagaaagag

SEQ ID NO: 188148 - RNA, 19 nt, Homo sapiens
ggaggaaccuaaggaagau

SEQ ID NO: 188149 - RNA, 19 nt, Homo sapiens
gggcuacgguuccauguuc

SEQ ID NO: 188150 - RNA, 19 nt, Homo sapiens
caacaugacaucccaggaa

SEQ ID NO: 188151 - RNA, 19 nt, Homo sapiens
ucucaucucuuguaaauac

SEQ ID NO: 188152 - RNA, 19 nt, Homo sapiens
acaauugguucaagaucua

SEQ ID NO: 188153 - RNA, 19 nt, Homo sapiens
guggauaguugaugagaau

SEQ ID NO: 188154 - RNA, 19 nt, Homo sapiens
ccaaucucaucucuuguaa

SEQ ID NO: 188155 - RNA, 19 nt, Homo sapiens
caucuuacuugcccuucua

SEQ ID NO: 188156 - RNA, 19 nt, Homo sapiens
ccacugucauaaucucuuu

SEQ ID NO: 188157 - RNA, 19 nt, Homo sapiens
gguggcagcuacaagaaga

SEQ ID NO: 188158 - RNA, 19 nt, Homo sapiens
ggaagaaguacgucugguu

SEQ ID NO: 188159 - RNA, 19 nt, Homo sapiens
guaggcaugugcaauuugu

SEQ ID NO: 188160 - RNA, 19 nt, Homo sapiens
ucacagaaacucuuuaucu

SEQ ID NO: 188161 - RNA, 19 nt, Homo sapiens
guacuuucuucccuuaaau

SEQ ID NO: 188162 - RNA, 19 nt, Homo sapiens
guucguaccuggcuugaag

SEQ ID NO: 188163 - RNA, 19 nt, Homo sapiens
cggauggcauggacgcuua

SEQ ID NO: 188164 - RNA, 19 nt, Homo sapiens
gacaauugguucaagaucu

SEQ ID NO: 188165 - RNA, 19 nt, Homo sapiens
ggaaggaucuccccgaauc

SEQ ID NO: 188166 - RNA, 19 nt, Homo sapiens
uacaacaaccagaccauua

SEQ ID NO: 188167 - RNA, 19 nt, Homo sapiens
ggugguaugcugacaauug

SEQ ID NO: 188168 - RNA, 19 nt, Homo sapiens
ggguaggcaugugcaauuu

SEQ ID NO: 188169 - RNA, 19 nt, Homo sapiens
ccagcaggaugcagccuuu

SEQ ID NO: 188170 - RNA, 19 nt, Homo sapiens
gcauggauguccucacucu

SEQ ID NO: 188171 - RNA, 19 nt, Homo sapiens
uguccuagcuguugucugu

SEQ ID NO: 188172 - RNA, 19 nt, Homo sapiens
gcugacaauugguucaaga

SEQ ID NO: 188173 - RNA, 19 nt, Homo sapiens
ggagaagucccggcuguug

SEQ ID NO: 188174 - RNA, 19 nt, Homo sapiens
gaaccuaaggaagauauug

SEQ ID NO: 188175 - RNA, 19 nt, Homo sapiens
gaauuuguggagaaacuaa

SEQ ID NO: 188176 - RNA, 19 nt, Homo sapiens
gcaguccugugccucauca

SEQ ID NO: 188177 - RNA, 19 nt, Homo sapiens
cauugcagcuccaggaaga

SEQ ID NO: 188178 - RNA, 19 nt, Homo sapiens
caugacaucccaggaauuu

SEQ ID NO: 188179 - RNA, 19 nt, Homo sapiens
ccacaucacaacugagauu

SEQ ID NO: 188180 - RNA, 19 nt, Homo sapiens
ccauugcauucauguacua

SEQ ID NO: 188181 - RNA, 19 nt, Homo sapiens
cuauaucacucuuguugug

SEQ ID NO: 188182 - RNA, 19 nt, Homo sapiens
ccaccaaguaccuauauga

SEQ ID NO: 188183 - RNA, 19 nt, Homo sapiens
gaauacauggcuuggcauu

SEQ ID NO: 188184 - RNA, 19 nt, Homo sapiens
gggcauggauguccucacu

SEQ ID NO: 188185 - RNA, 19 nt, Homo sapiens
gcaccaaggaugaucuuuc

SEQ ID NO: 188186 - RNA, 19 nt, Homo sapiens
aaacuaaccaagcgacuga

SEQ ID NO: 188187 - RNA, 19 nt, Homo sapiens
ccaggaauuuguggagaaa

SEQ ID NO: 188188 - RNA, 19 nt, Homo sapiens
ucccaagacugcucccuuu

SEQ ID NO: 188189 - RNA, 19 nt, Homo sapiens
ugagucaugucuuuccuau

SEQ ID NO: 188190 - RNA, 19 nt, Homo sapiens
uguaucaccucuucacaau

SEQ ID NO: 188191 - RNA, 19 nt, Homo sapiens
gaaaagaucauugcugaga

SEQ ID NO: 188192 - RNA, 19 nt, Homo sapiens
aaugaacucuucguccuuu

SEQ ID NO: 188193 - RNA, 19 nt, Homo sapiens
guacuacccucagucuaca

SEQ ID NO: 188194 - RNA, 19 nt, Homo sapiens
gaaggagaaccgugaacug

SEQ ID NO: 188195 - RNA, 19 nt, Homo sapiens
aagaaggaguggaggaaga

SEQ ID NO: 188196 - RNA, 19 nt, Homo sapiens
cacagaaacucuuuaucuc

SEQ ID NO: 188197 - RNA, 19 nt, Homo sapiens
ugaaggaggcuggaauuga

SEQ ID NO: 188198 - RNA, 19 nt, Homo sapiens
ggaagauauugacgucucu

SEQ ID NO: 188199 - RNA, 19 nt, Homo sapiens
aagauuggcuacuaugaca

SEQ ID NO: 188200 - RNA, 19 nt, Homo sapiens
cagaguuucuucucagauc

SEQ ID NO: 188201 - RNA, 19 nt, Homo sapiens
cuaucaagaucauccuuau

SEQ ID NO: 188202 - RNA, 19 nt, Homo sapiens
uuucuucccuuaaaucaug

SEQ ID NO: 188203 - RNA, 19 nt, Homo sapiens
gaucuuuccugguccaaaa

SEQ ID NO: 188204 - RNA, 19 nt, Homo sapiens
ugucacagaaucuccauuu

SEQ ID NO: 188205 - RNA, 19 nt, Homo sapiens
ucccuuaaaucaugguauu

SEQ ID NO: 188206 - RNA, 19 nt, Homo sapiens
gaagaacaugcuauccaau

SEQ ID NO: 188207 - RNA, 19 nt, Homo sapiens
gcgcaggacaccaugaaga

SEQ ID NO: 188208 - RNA, 19 nt, Homo sapiens
ugacaucccaggaauuugu

SEQ ID NO: 188209 - RNA, 19 nt, Homo sapiens
cuacgacccuucuaucaac

SEQ ID NO: 188210 - RNA, 19 nt, Homo sapiens
guacgucugguuccucauu

SEQ ID NO: 188211 - RNA, 19 nt, Homo sapiens
cgaaucaucgugggacuuu

SEQ ID NO: 188212 - RNA, 19 nt, Homo sapiens
gcgugaaacucuuugaaaa

SEQ ID NO: 188213 - RNA, 19 nt, Homo sapiens
ucauugugcuuuccuaugg

SEQ ID NO: 188214 - RNA, 19 nt, Homo sapiens
ugagaauccugaccaaagg

SEQ ID NO: 188215 - RNA, 19 nt, Homo sapiens
uguguacuuucuucccuua

SEQ ID NO: 188216 - RNA, 19 nt, Homo sapiens
ggagaaagguggaggagaa

SEQ ID NO: 188217 - RNA, 19 nt, Homo sapiens
gcaacacccucuucuaguu

SEQ ID NO: 188218 - RNA, 19 nt, Homo sapiens
ggaagaacaugcuauccaa

SEQ ID NO: 188219 - RNA, 19 nt, Homo sapiens
uaucaccucuucacaauuu

SEQ ID NO: 188220 - RNA, 19 nt, Homo sapiens
ggaagaagauugcuaccau

SEQ ID NO: 188221 - RNA, 19 nt, Homo sapiens
agucaugucuuuccuauuu

SEQ ID NO: 188222 - RNA, 19 nt, Homo sapiens
ccacugaggucuucacuuc

SEQ ID NO: 188223 - RNA, 19 nt, Homo sapiens
gaaggaggcuggaauugag

SEQ ID NO: 188224 - RNA, 19 nt, Homo sapiens
gaaucuuccuugcuuauga

SEQ ID NO: 188225 - RNA, 19 nt, Homo sapiens
ccaggaagaugaauacaug

SEQ ID NO: 188226 - RNA, 19 nt, Homo sapiens
ggagaaccgugaacuggaa

SEQ ID NO: 188227 - RNA, 19 nt, Homo sapiens
gggcauggcuaucuacaau

SEQ ID NO: 188228 - RNA, 19 nt, Homo sapiens
cauaaucucuuuccaucuu

SEQ ID NO: 188229 - RNA, 19 nt, Homo sapiens
ccacugagaagaucaauga

SEQ ID NO: 188230 - RNA, 19 nt, Homo sapiens
caagaagauuggcuacuau

SEQ ID NO: 188231 - RNA, 19 nt, Homo sapiens
acaagaagauuggcuacua

SEQ ID NO: 188232 - RNA, 19 nt, Homo sapiens
uauccaaucucaucucuug

SEQ ID NO: 188233 - RNA, 19 nt, Homo sapiens
gagugcauuugcuuuauaa

SEQ ID NO: 188234 - RNA, 19 nt, Homo sapiens
caacucacauguccguuau

SEQ ID NO: 188235 - RNA, 19 nt, Homo sapiens
gccaauacccgcagcauuu

SEQ ID NO: 188236 - RNA, 19 nt, Homo sapiens
guacaaggagcgucucuuu

SEQ ID NO: 188237 - RNA, 19 nt, Homo sapiens
gcacauuguuaugcacuuu

SEQ ID NO: 188238 - RNA, 19 nt, Homo sapiens
caacacccucuucuaguua

SEQ ID NO: 188239 - RNA, 19 nt, Homo sapiens
gcauuugcuuuauaaguga

SEQ ID NO: 188240 - RNA, 19 nt, Homo sapiens
cgagugcauuugcuuuaua

SEQ ID NO: 188241 - RNA, 19 nt, Homo sapiens
caacugagauugucaugcu

SEQ ID NO: 188242 - RNA, 19 nt, Homo sapiens
gcauggcuaucuacaaugu

SEQ ID NO: 188243 - RNA, 19 nt, Homo sapiens
aaagaucauugcugagaaa

SEQ ID NO: 188244 - RNA, 19 nt, Homo sapiens
ggaugcagccuuugccuuu

SEQ ID NO: 188245 - RNA, 19 nt, Homo sapiens
gcacuggcccugaacaaga

SEQ ID NO: 188246 - RNA, 19 nt, Homo sapiens
caacgacccuaucaagauc

SEQ ID NO: 188247 - RNA, 19 nt, Homo sapiens
gauauugacgucucuauuc

SEQ ID NO: 188248 - RNA, 19 nt, Homo sapiens
gaucauugcugagaaagag

SEQ ID NO: 188249 - RNA, 19 nt, Homo sapiens
ggaggaaccuaaggaagau

SEQ ID NO: 188250 - RNA, 19 nt, Homo sapiens
gggcuacgguuccauguuc

SEQ ID NO: 188251 - RNA, 19 nt, Homo sapiens
caacaugacaucccaggaa

SEQ ID NO: 188252 - RNA, 19 nt, Homo sapiens
acuaugagauugaguaugu

SEQ ID NO: 188253 - RNA, 19 nt, Homo sapiens
ucucaucucuuguaaauac

SEQ ID NO: 188254 - RNA, 19 nt, Homo sapiens
acaauugguucaagaucua

SEQ ID NO: 188255 - RNA, 19 nt, Homo sapiens
guggauaguugaugagaau

SEQ ID NO: 188256 - RNA, 19 nt, Homo sapiens
ccaaucucaucucuuguaa

SEQ ID NO: 188257 - RNA, 19 nt, Homo sapiens
caucuuacuugcccuucua

SEQ ID NO: 188258 - RNA, 19 nt, Homo sapiens
ccacugucauaaucucuuu

SEQ ID NO: 188259 - RNA, 19 nt, Homo sapiens
gguggcagcuacaagaaga

SEQ ID NO: 188260 - RNA, 19 nt, Homo sapiens
ggaagaaguacgucugguu

SEQ ID NO: 188261 - RNA, 19 nt, Homo sapiens
guaggcaugugcaauuugu

SEQ ID NO: 188262 - RNA, 19 nt, Homo sapiens
ucacagaaacucuuuaucu

SEQ ID NO: 188263 - RNA, 19 nt, Homo sapiens
guacuuucuucccuuaaau

SEQ ID NO: 188264 - RNA, 19 nt, Homo sapiens
guucguaccuggcuugaag

SEQ ID NO: 188265 - RNA, 19 nt, Homo sapiens
cggauggcauggacgcuua

SEQ ID NO: 188266 - RNA, 19 nt, Homo sapiens
gacaauugguucaagaucu

SEQ ID NO: 188267 - RNA, 19 nt, Homo sapiens
ggaaggaucuccccgaauc

SEQ ID NO: 188268 - RNA, 19 nt, Homo sapiens
uacaacaaccagaccauua

SEQ ID NO: 188269 - RNA, 19 nt, Homo sapiens
ggugguaugcugacaauug

SEQ ID NO: 188270 - RNA, 19 nt, Homo sapiens
ggguaggcaugugcaauuu

SEQ ID NO: 188271 - RNA, 19 nt, Homo sapiens
ucagaagguugccagauca

SEQ ID NO: 188272 - RNA, 19 nt, Homo sapiens
ccagcaggaugcagccuuu

SEQ ID NO: 188273 - RNA, 19 nt, Homo sapiens
gcauggauguccucacucu

SEQ ID NO: 188274 - RNA, 19 nt, Homo sapiens
uguccuagcuguugucugu

SEQ ID NO: 188275 - RNA, 19 nt, Homo sapiens
gcugacaauugguucaaga

SEQ ID NO: 188276 - RNA, 19 nt, Homo sapiens
ggagaagucccggcuguug

SEQ ID NO: 188277 - RNA, 19 nt, Homo sapiens
gaaccuaaggaagauauug

SEQ ID NO: 188278 - RNA, 19 nt, Homo sapiens
gaauuuguggagaaacuaa

SEQ ID NO: 188279 - RNA, 19 nt, Homo sapiens
gcaguccugugccucauca

SEQ ID NO: 188280 - RNA, 19 nt, Homo sapiens
cauugcagcuccaggaaga

SEQ ID NO: 188281 - RNA, 19 nt, Homo sapiens
caugacaucccaggaauuu

SEQ ID NO: 188282 - RNA, 19 nt, Homo sapiens
ccacaucacaacugagauu

SEQ ID NO: 188283 - RNA, 19 nt, Homo sapiens
ccauugcauucauguacua

SEQ ID NO: 188284 - RNA, 19 nt, Homo sapiens
cuauaucacucuuguugug

SEQ ID NO: 188285 - RNA, 19 nt, Homo sapiens
gaauacauggcuuggcauu

SEQ ID NO: 188286 - RNA, 19 nt, Homo sapiens
gggcauggauguccucacu

SEQ ID NO: 188287 - RNA, 19 nt, Homo sapiens
gcaccaaggaugaucuuuc

SEQ ID NO: 188288 - RNA, 19 nt, Homo sapiens
aaacuaaccaagcgacuga

SEQ ID NO: 188289 - RNA, 19 nt, Homo sapiens
ccaggaauuuguggagaaa

SEQ ID NO: 188290 - RNA, 19 nt, Homo sapiens
ccaccaaguaccuauauga

SEQ ID NO: 188291 - RNA, 19 nt, Homo sapiens
ucccaagacugcucccuuu

SEQ ID NO: 188292 - RNA, 19 nt, Homo sapiens
ugagucaugucuuuccuau

SEQ ID NO: 188293 - RNA, 19 nt, Homo sapiens
uguaucaccucuucacaau

SEQ ID NO: 188294 - RNA, 19 nt, Homo sapiens
gaaaagaucauugcugaga

SEQ ID NO: 188295 - RNA, 19 nt, Homo sapiens
aaugaacucuucguccuuu

SEQ ID NO: 188296 - RNA, 19 nt, Homo sapiens
gggaccaggugaaggcuau

SEQ ID NO: 188297 - RNA, 19 nt, Homo sapiens
guacuacccucagucuaca

SEQ ID NO: 188298 - RNA, 19 nt, Homo sapiens
ccaguggacuaugagauug

SEQ ID NO: 188299 - RNA, 19 nt, Homo sapiens
gaaggagaaccgugaacug

SEQ ID NO: 188300 - RNA, 19 nt, Homo sapiens
aagaaggaguggaggaaga

SEQ ID NO: 188301 - RNA, 19 nt, Homo sapiens
cacagaaacucuuuaucuc

SEQ ID NO: 188302 - RNA, 19 nt, Homo sapiens
ugaaggaggcuggaauuga

SEQ ID NO: 188303 - RNA, 19 nt, Homo sapiens
ggaagauauugacgucucu

SEQ ID NO: 188304 - RNA, 19 nt, Homo sapiens
aagauuggcuacuaugaca

SEQ ID NO: 188305 - RNA, 19 nt, Homo sapiens
gaaucgaacgccacacuca

SEQ ID NO: 188306 - RNA, 19 nt, Homo sapiens
cagaguuucuucucagauc

SEQ ID NO: 188307 - RNA, 19 nt, Homo sapiens
cuaucaagaucauccuuau

SEQ ID NO: 188308 - RNA, 19 nt, Homo sapiens
uuucuucccuuaaaucaug

SEQ ID NO: 188309 - RNA, 19 nt, Homo sapiens
gaucuuuccugguccaaaa

SEQ ID NO: 188310 - RNA, 19 nt, Homo sapiens
gaagguugccagaucauac

SEQ ID NO: 188311 - RNA, 19 nt, Homo sapiens
ggacuaugagauugaguau

SEQ ID NO: 188312 - RNA, 19 nt, Homo sapiens
ugucacagaaucuccauuu

SEQ ID NO: 188313 - RNA, 19 nt, Homo sapiens
ucccuuaaaucaugguauu

SEQ ID NO: 188314 - RNA, 19 nt, Homo sapiens
gaagaacaugcuauccaau

SEQ ID NO: 188315 - RNA, 19 nt, Homo sapiens
gcgcaggacaccaugaaga

SEQ ID NO: 188316 - RNA, 19 nt, Homo sapiens
ggagaaagguggaggagaa

SEQ ID NO: 188317 - RNA, 19 nt, Homo sapiens
gcaacacccucuucuaguu

SEQ ID NO: 188318 - RNA, 19 nt, Homo sapiens
ggaagaacaugcuauccaa

SEQ ID NO: 188319 - RNA, 19 nt, Homo sapiens
uaucaccucuucacaauuu

SEQ ID NO: 188320 - RNA, 19 nt, Homo sapiens
ggaagaagauugcuaccau

SEQ ID NO: 188321 - RNA, 19 nt, Homo sapiens
agucaugucuuuccuauuu

SEQ ID NO: 188322 - RNA, 19 nt, Homo sapiens
ccacugaggucuucacuuc

SEQ ID NO: 188323 - RNA, 19 nt, Homo sapiens
gaaggaggcuggaauugag

SEQ ID NO: 188324 - RNA, 19 nt, Homo sapiens
gaaucuuccuugcuuauga

SEQ ID NO: 188325 - RNA, 19 nt, Homo sapiens
ccaggaagaugaauacaug

SEQ ID NO: 188326 - RNA, 19 nt, Homo sapiens
ggagaaccgugaacuggaa

SEQ ID NO: 188327 - RNA, 19 nt, Homo sapiens
gggcauggcuaucuacaau

SEQ ID NO: 188328 - RNA, 19 nt, Homo sapiens
cauaaucucuuuccaucuu

SEQ ID NO: 188329 - RNA, 19 nt, Homo sapiens
ccacugagaagaucaauga

SEQ ID NO: 188330 - RNA, 19 nt, Homo sapiens
caagaagauuggcuacuau

SEQ ID NO: 188331 - RNA, 19 nt, Homo sapiens
acaagaagauuggcuacua

SEQ ID NO: 188332 - RNA, 19 nt, Homo sapiens
uauccaaucucaucucuug

SEQ ID NO: 188333 - RNA, 19 nt, Homo sapiens
gagugcauuugcuuuauaa

SEQ ID NO: 188334 - RNA, 19 nt, Homo sapiens
gccaauacccgcagcauuu

SEQ ID NO: 188335 - RNA, 19 nt, Homo sapiens
guacaaggagcgucucuuu

SEQ ID NO: 188336 - RNA, 19 nt, Homo sapiens
gcacauuguuaugcacuuu

SEQ ID NO: 188337 - RNA, 19 nt, Homo sapiens
caacacccucuucuaguua

SEQ ID NO: 188338 - RNA, 19 nt, Homo sapiens
gcauuugcuuuauaaguga

SEQ ID NO: 188339 - RNA, 19 nt, Homo sapiens
cgagugcauuugcuuuaua

SEQ ID NO: 188340 - RNA, 19 nt, Homo sapiens
gcauggcuaucuacaaugu

SEQ ID NO: 188341 - RNA, 19 nt, Homo sapiens
aaagaucauugcugagaaa

SEQ ID NO: 188342 - RNA, 19 nt, Homo sapiens
ggaugcagccuuugccuuu

SEQ ID NO: 188343 - RNA, 19 nt, Homo sapiens
gcacuggcccugaacaaga

SEQ ID NO: 188344 - RNA, 19 nt, Homo sapiens
caacgacccuaucaagauc

SEQ ID NO: 188345 - RNA, 19 nt, Homo sapiens
gauauugacgucucuauuc

SEQ ID NO: 188346 - RNA, 19 nt, Homo sapiens
caacugagaucgucaugcu

SEQ ID NO: 188347 - RNA, 19 nt, Homo sapiens
gaucauugcugagaaagag

SEQ ID NO: 188348 - RNA, 19 nt, Homo sapiens
ggaggaaccuaaggaagau

SEQ ID NO: 188349 - RNA, 19 nt, Homo sapiens
gggcuacgguuccauguuc

SEQ ID NO: 188350 - RNA, 19 nt, Homo sapiens
caacaugacaucccaggaa

SEQ ID NO: 188351 - RNA, 19 nt, Homo sapiens
acuaugagauugaguaugu

SEQ ID NO: 188352 - RNA, 19 nt, Homo sapiens
ucucaucucuuguaaauac

SEQ ID NO: 188353 - RNA, 19 nt, Homo sapiens
acaauugguucaagaucua

SEQ ID NO: 188354 - RNA, 19 nt, Homo sapiens
guggauaguugaugagaau

SEQ ID NO: 188355 - RNA, 19 nt, Homo sapiens
ccaaucucaucucuuguaa

SEQ ID NO: 188356 - RNA, 19 nt, Homo sapiens
caucuuacuugcccuucua

SEQ ID NO: 188357 - RNA, 19 nt, Homo sapiens
ccacugucauaaucucuuu

SEQ ID NO: 188358 - RNA, 19 nt, Homo sapiens
gguggcagcuacaagaaga

SEQ ID NO: 188359 - RNA, 19 nt, Homo sapiens
ggaagaaguacgucugguu

SEQ ID NO: 188360 - RNA, 19 nt, Homo sapiens
guaggcaugugcaauuugu

SEQ ID NO: 188361 - RNA, 19 nt, Homo sapiens
guacuuucuucccuuaaau

SEQ ID NO: 188362 - RNA, 19 nt, Homo sapiens
guucguaccuggcuugaag

SEQ ID NO: 188363 - RNA, 19 nt, Homo sapiens
cggauggcauggacgcuua

SEQ ID NO: 188364 - RNA, 19 nt, Homo sapiens
gacaauugguucaagaucu

SEQ ID NO: 188365 - RNA, 19 nt, Homo sapiens
gaaucugcuccaagucuua

SEQ ID NO: 188366 - RNA, 19 nt, Homo sapiens
ggaaggaucuccccgaauc

SEQ ID NO: 188367 - RNA, 19 nt, Homo sapiens
uacaacaaccagaccauua

SEQ ID NO: 188368 - RNA, 19 nt, Homo sapiens
ggugguaugcugacaauug

SEQ ID NO: 188369 - RNA, 19 nt, Homo sapiens
ggguaggcaugugcaauuu

SEQ ID NO: 188370 - RNA, 19 nt, Homo sapiens
ucagaagguugccagauca

SEQ ID NO: 188371 - RNA, 19 nt, Homo sapiens
ccagcaggaugcagccuuu

SEQ ID NO: 188372 - RNA, 19 nt, Homo sapiens
gcauggauguccucacucu

SEQ ID NO: 188373 - RNA, 19 nt, Homo sapiens
gcugacaauugguucaaga

SEQ ID NO: 188374 - RNA, 19 nt, Homo sapiens
ggagaagucccggcuguug

SEQ ID NO: 188375 - RNA, 19 nt, Homo sapiens
gaaccuaaggaagauauug

SEQ ID NO: 188376 - RNA, 19 nt, Homo sapiens
gaauuuguggagaaacuaa

SEQ ID NO: 188377 - RNA, 19 nt, Homo sapiens
gcaguccugugccucauca

SEQ ID NO: 188378 - RNA, 19 nt, Homo sapiens
cauugcagcuccaggaaga

SEQ ID NO: 188379 - RNA, 19 nt, Homo sapiens
caugacaucccaggaauuu

SEQ ID NO: 188380 - RNA, 19 nt, Homo sapiens
ccauugcauucauguacua

SEQ ID NO: 188381 - RNA, 19 nt, Homo sapiens
cuauaucacucuuguugug

SEQ ID NO: 188382 - RNA, 19 nt, Homo sapiens
gaauacauggcuuggcauu

SEQ ID NO: 188383 - RNA, 19 nt, Homo sapiens
gggcauggauguccucacu

SEQ ID NO: 188384 - RNA, 19 nt, Homo sapiens
gcaccaaggaugaucuuuc

SEQ ID NO: 188385 - RNA, 19 nt, Homo sapiens
aaacuaaccaagcgacuga

SEQ ID NO: 188386 - RNA, 19 nt, Homo sapiens
ccaggaauuuguggagaaa

SEQ ID NO: 188387 - RNA, 19 nt, Homo sapiens
ccaccaaguaccuauauga

SEQ ID NO: 188388 - RNA, 19 nt, Homo sapiens
ucccaagacugcucccuuu

SEQ ID NO: 188389 - RNA, 19 nt, Homo sapiens
ugagucaugucuuuccuau

SEQ ID NO: 188390 - RNA, 19 nt, Homo sapiens
uguaucaccucuucacaau

SEQ ID NO: 188391 - RNA, 19 nt, Homo sapiens
gaaaagaucauugcugaga

SEQ ID NO: 188392 - RNA, 19 nt, Homo sapiens
gggaccaggugaaggcuau

SEQ ID NO: 188393 - RNA, 19 nt, Homo sapiens
guacuacccucagucuaca

SEQ ID NO: 188394 - RNA, 19 nt, Homo sapiens
ccaguggacuaugagauug

SEQ ID NO: 188395 - RNA, 19 nt, Homo sapiens
gaaggagaaccgugaacug

SEQ ID NO: 188396 - RNA, 19 nt, Homo sapiens
aagaaggaguggaggaaga

SEQ ID NO: 188397 - RNA, 19 nt, Homo sapiens
ugaaggaggcuggaauuga

SEQ ID NO: 188398 - RNA, 19 nt, Homo sapiens
ggaagauauugacgucucu

SEQ ID NO: 188399 - RNA, 19 nt, Homo sapiens
aagauuggcuacuaugaca

SEQ ID NO: 188400 - RNA, 19 nt, Homo sapiens
cagaguuucuucucagauc

SEQ ID NO: 188401 - RNA, 19 nt, Homo sapiens
cuaucaagaucauccuuau

SEQ ID NO: 188402 - RNA, 19 nt, Homo sapiens
gaaucgaacgccacacuca

SEQ ID NO: 188403 - RNA, 19 nt, Homo sapiens
ggacuaugagauugaguau

SEQ ID NO: 188404 - RNA, 19 nt, Homo sapiens
uuucuucccuuaaaucaug

SEQ ID NO: 188405 - RNA, 19 nt, Homo sapiens
gaagguugccagaucauac

SEQ ID NO: 188406 - RNA, 19 nt, Homo sapiens
guccgaaucugcuccaagu

SEQ ID NO: 188407 - RNA, 19 nt, Homo sapiens
gaucuuuccugguccaaaa

SEQ ID NO: 188408 - RNA, 19 nt, Homo sapiens
cgaaucugcuccaagucuu

SEQ ID NO: 188409 - RNA, 19 nt, Homo sapiens
ugucacagaaucuccauuu

SEQ ID NO: 188410 - RNA, 19 nt, Homo sapiens
ucccuuaaaucaugguauu

SEQ ID NO: 188411 - RNA, 19 nt, Homo sapiens
gccaguggacuaugagauu

SEQ ID NO: 188412 - RNA, 19 nt, Homo sapiens
gaagaacaugcuauccaau

SEQ ID NO: 188413 - RNA, 19 nt, Homo sapiens
gcgcaggacaccaugaaga

SEQ ID NO: 188414 - RNA, 19 nt, Homo sapiens
ugacaucccaggaauuugu

SEQ ID NO: 188415 - RNA, 19 nt, Homo sapiens
cuacgacccuucuaucaac

SEQ ID NO: 188416 - RNA, 19 nt, Homo sapiens
ugaagaagcucaagugaua

SEQ ID NO: 188417 - RNA, 19 nt, Homo sapiens
ggacugauccuuugaaaua

SEQ ID NO: 188418 - RNA, 19 nt, Homo sapiens
gaaacucagucgugcauua

SEQ ID NO: 188419 - RNA, 19 nt, Homo sapiens
uaaaggaucuccacaaugu

SEQ ID NO: 188420 - RNA, 19 nt, Homo sapiens
gaagaaacuugcaaagaug

SEQ ID NO: 188421 - RNA, 19 nt, Homo sapiens
gaaauucucuggagucauc

SEQ ID NO: 188422 - RNA, 19 nt, Homo sapiens
ggacaugauuuguaaaguu

SEQ ID NO: 188423 - RNA, 19 nt, Homo sapiens
gaacagaacaggaaacaau

SEQ ID NO: 188424 - RNA, 19 nt, Homo sapiens
agacaucaaugaaccaaua

SEQ ID NO: 188425 - RNA, 19 nt, Homo sapiens
gaacaacagaugaaugaaa

SEQ ID NO: 188426 - RNA, 19 nt, Homo sapiens
cagaggagcugauagaaau

SEQ ID NO: 188427 - RNA, 19 nt, Homo sapiens
gaaauuugucugcaagaua

SEQ ID NO: 188428 - RNA, 19 nt, Homo sapiens
gaaccaauaggcaauuuaa

SEQ ID NO: 188429 - RNA, 19 nt, Homo sapiens
gcucuuaccuuuauuacug

SEQ ID NO: 188430 - RNA, 19 nt, Homo sapiens
gaaagcagccaaaguacaa

SEQ ID NO: 188431 - RNA, 19 nt, Homo sapiens
guauagcucuuaccuuuau

SEQ ID NO: 188432 - RNA, 19 nt, Homo sapiens
gcagguucauuguggaaua

SEQ ID NO: 188433 - RNA, 19 nt, Homo sapiens
ucacaaccauuucagauga

SEQ ID NO: 188434 - RNA, 19 nt, Homo sapiens
gaaacagucuggcuuaacu

SEQ ID NO: 188435 - RNA, 19 nt, Homo sapiens
aaguauagcucuuaccuuu

SEQ ID NO: 188436 - RNA, 19 nt, Homo sapiens
agaagaaacuugcaaagau

SEQ ID NO: 188437 - RNA, 19 nt, Homo sapiens
gaucaaccugugcaaauua

SEQ ID NO: 188438 - RNA, 19 nt, Homo sapiens
ggaauugaaccaaaguuaa

SEQ ID NO: 188439 - RNA, 19 nt, Homo sapiens
gaauucagcaugaccgaua

SEQ ID NO: 188440 - RNA, 19 nt, Homo sapiens
gaaccaagacuacaguguu

SEQ ID NO: 188441 - RNA, 19 nt, Homo sapiens
aaacacaucacaaccauuu

SEQ ID NO: 188442 - RNA, 19 nt, Homo sapiens
guguacagguaauuucuua

SEQ ID NO: 188443 - RNA, 19 nt, Homo sapiens
cagucuggcuuaacuauuu

SEQ ID NO: 188444 - RNA, 19 nt, Homo sapiens
gcaaauuauuccagcauca

SEQ ID NO: 188445 - RNA, 19 nt, Homo sapiens
gaaagcagagugcacagaa

SEQ ID NO: 188446 - RNA, 19 nt, Homo sapiens
guuaaaggaucuccacaau

SEQ ID NO: 188447 - RNA, 19 nt, Homo sapiens
gacaugauuuguaaaguuc

SEQ ID NO: 188448 - RNA, 19 nt, Homo sapiens
cagcggaguugaaccguuu

SEQ ID NO: 188449 - RNA, 19 nt, Homo sapiens
ugaaguaucucuaggaaac

SEQ ID NO: 188450 - RNA, 19 nt, Homo sapiens
gaacagaagaaacuugcaa

SEQ ID NO: 188451 - RNA, 19 nt, Homo sapiens
gcagaggagcugauagaaa

SEQ ID NO: 188452 - RNA, 19 nt, Homo sapiens
uggaauaguuuaacaguca

SEQ ID NO: 188453 - RNA, 19 nt, Homo sapiens
ggaaggcuauaggaaagaa

SEQ ID NO: 188454 - RNA, 19 nt, Homo sapiens
cagaacaagugacaagaug

SEQ ID NO: 188455 - RNA, 19 nt, Homo sapiens
ggagugggacugauccuuu

SEQ ID NO: 188456 - RNA, 19 nt, Homo sapiens
gaagaaagcauuguagaac

SEQ ID NO: 188457 - RNA, 19 nt, Homo sapiens
caaagagcgccgaggauuu

SEQ ID NO: 188458 - RNA, 19 nt, Homo sapiens
ggagucaucuggaacuucu

SEQ ID NO: 188459 - RNA, 19 nt, Homo sapiens
ccuacuaccauuaaaguua

SEQ ID NO: 188460 - RNA, 19 nt, Homo sapiens
ccaauaggcaauuuaaaga

SEQ ID NO: 188461 - RNA, 19 nt, Homo sapiens
ucaccacacucaacauuuc

SEQ ID NO: 188462 - RNA, 19 nt, Homo sapiens
gagugggacugauccuuug

SEQ ID NO: 188463 - RNA, 19 nt, Homo sapiens
ccaaggaauugaaccaaag

SEQ ID NO: 188464 - RNA, 19 nt, Homo sapiens
gaacuguacagcuuagugu

SEQ ID NO: 188465 - RNA, 19 nt, Homo sapiens
uauguagucucaaccaaga

SEQ ID NO: 188466 - RNA, 19 nt, Homo sapiens
gggagagaauuauguaguc

SEQ ID NO: 188467 - RNA, 19 nt, Homo sapiens
agaagcacaucuuguugaa

SEQ ID NO: 188468 - RNA, 19 nt, Homo sapiens
ccagaacgaaguuuauuug

SEQ ID NO: 188469 - RNA, 19 nt, Homo sapiens
gcugauagaaauugagauu

SEQ ID NO: 188470 - RNA, 19 nt, Homo sapiens
gauggaacuguacagcuua

SEQ ID NO: 188471 - RNA, 19 nt, Homo sapiens
aagaacaacagaugaauga

SEQ ID NO: 188472 - RNA, 19 nt, Homo sapiens
gaagaagcucaagugauaa

SEQ ID NO: 188473 - RNA, 19 nt, Homo sapiens
gaaauugagauugauggaa

SEQ ID NO: 188474 - RNA, 19 nt, Homo sapiens
ggaauugcccagccaguca

SEQ ID NO: 188475 - RNA, 19 nt, Homo sapiens
ugaucaaccugugcaaauu

SEQ ID NO: 188476 - RNA, 19 nt, Homo sapiens
gaacuucuccgaaaauaug

SEQ ID NO: 188477 - RNA, 19 nt, Homo sapiens
cagaagaaacuugcaaaga

SEQ ID NO: 188478 - RNA, 19 nt, Homo sapiens
ggcaagagauuuguguaca

SEQ ID NO: 188479 - RNA, 19 nt, Homo sapiens
auaaauagaugugcgaaag

SEQ ID NO: 188480 - RNA, 19 nt, Homo sapiens
ggauccagaacgaaguuua

SEQ ID NO: 188481 - RNA, 19 nt, Homo sapiens
ggccauagacaucaaugaa

SEQ ID NO: 188482 - RNA, 19 nt, Homo sapiens
gcagagugcacagaagaaa

SEQ ID NO: 188483 - RNA, 19 nt, Homo sapiens
uaggaaacagucuggcuua

SEQ ID NO: 188484 - RNA, 19 nt, Homo sapiens
aaugaaguaucucuaggaa

SEQ ID NO: 188485 - RNA, 19 nt, Homo sapiens
uguacagucugaugcauga

SEQ ID NO: 188486 - RNA, 19 nt, Homo sapiens
cuacaccuacuaccauuaa

SEQ ID NO: 188487 - RNA, 19 nt, Homo sapiens
caacagaugaaugaaauag

SEQ ID NO: 188488 - RNA, 19 nt, Homo sapiens
ggagagaauuauguagucu

SEQ ID NO: 188489 - RNA, 19 nt, Homo sapiens
gcacuggaaggcuauagga

SEQ ID NO: 188490 - RNA, 19 nt, Homo sapiens
ggacacuguugagguuguu

SEQ ID NO: 188491 - RNA, 19 nt, Homo sapiens
agauggaacuguacagcuu

SEQ ID NO: 188492 - RNA, 19 nt, Homo sapiens
aagaaagcauuguagaaca

SEQ ID NO: 188493 - RNA, 19 nt, Homo sapiens
acagucugaugcaugauuu

SEQ ID NO: 188494 - RNA, 19 nt, Homo sapiens
guucaaggcaagagauuug

SEQ ID NO: 188495 - RNA, 19 nt, Homo sapiens
agccuacgaugaacuauga

SEQ ID NO: 188496 - RNA, 19 nt, Homo sapiens
aaaauaagccuacgaugaa

SEQ ID NO: 188497 - RNA, 19 nt, Homo sapiens
caagaacaacagaugaaug

SEQ ID NO: 188498 - RNA, 19 nt, Homo sapiens
cagaagcacaucuuguuga

SEQ ID NO: 188499 - RNA, 19 nt, Homo sapiens
cuguugagguuguuauuga

SEQ ID NO: 188500 - RNA, 19 nt, Homo sapiens
gagcugauagaaauugaga

SEQ ID NO: 188501 - RNA, 19 nt, Homo sapiens
uuuggaugcucaugaaauu

SEQ ID NO: 188502 - RNA, 19 nt, Homo sapiens
ugcgaaagcagccaaagua

SEQ ID NO: 188503 - RNA, 19 nt, Homo sapiens
cagaccaaguccugcauug

SEQ ID NO: 188504 - RNA, 19 nt, Homo sapiens
cagcuuaguguacagguaa

SEQ ID NO: 188505 - RNA, 19 nt, Homo sapiens
agaagaaagcauuguagaa

SEQ ID NO: 188506 - RNA, 19 nt, Homo sapiens
gauccagaacgaaguuuau

SEQ ID NO: 188507 - RNA, 19 nt, Homo sapiens
agucgugcauuaagauauu

SEQ ID NO: 188508 - RNA, 19 nt, Homo sapiens
gaugaacuaugagaaacuc

SEQ ID NO: 188509 - RNA, 19 nt, Homo sapiens
gcaagucaagaacaacaga

SEQ ID NO: 188510 - RNA, 19 nt, Homo sapiens
uaacagucaggaaggcuaa

SEQ ID NO: 188511 - RNA, 19 nt, Homo sapiens
aaacucagucgugcauuaa

SEQ ID NO: 188512 - RNA, 19 nt, Homo sapiens
aaacaauggccaaauccaa

SEQ ID NO: 188513 - RNA, 19 nt, Homo sapiens
acaaagagcgccgaggauu

SEQ ID NO: 188514 - RNA, 19 nt, Homo sapiens
gaaauacuccagccaugac

SEQ ID NO: 188515 - RNA, 19 nt, Homo sapiens
caaccugugcaaauuauuc

SEQ ID NO: 188516 - RNA, 19 nt, Homo sapiens
ccaaguagauuuacaugua

SEQ ID NO: 188517 - RNA, 19 nt, Homo sapiens
gcagagauauuacagauug

SEQ ID NO: 188518 - RNA, 19 nt, Homo sapiens
gguggaaucugcagaaaua

SEQ ID NO: 188519 - RNA, 19 nt, Homo sapiens
ggccaaauguuguguaaua

SEQ ID NO: 188520 - RNA, 19 nt, Homo sapiens
caacagacauugcugaaga

SEQ ID NO: 188521 - RNA, 19 nt, Homo sapiens
gagacaauguaucgaaaua

SEQ ID NO: 188522 - RNA, 19 nt, Homo sapiens
gaaaugaacauguaguuug

SEQ ID NO: 188523 - RNA, 19 nt, Homo sapiens
ccaaaugaguugauaaaga

SEQ ID NO: 188524 - RNA, 19 nt, Homo sapiens
uaacaggucugguaucuuc

SEQ ID NO: 188525 - RNA, 19 nt, Homo sapiens
caaaggacauguuaaagau

SEQ ID NO: 188526 - RNA, 19 nt, Homo sapiens
gacagcagcuccuaaagaa

SEQ ID NO: 188527 - RNA, 19 nt, Homo sapiens
gcaaauggagcucccuuua

SEQ ID NO: 188528 - RNA, 19 nt, Homo sapiens
guacaaaccuuaauuucuc

SEQ ID NO: 188529 - RNA, 19 nt, Homo sapiens
caaauauggugcugaugua

SEQ ID NO: 188530 - RNA, 19 nt, Homo sapiens
ccacagaaaugaugaaagu

SEQ ID NO: 188531 - RNA, 19 nt, Homo sapiens
gguauaaaccucuguauga

SEQ ID NO: 188532 - RNA, 19 nt, Homo sapiens
gcaaaggacauguuaaaga

SEQ ID NO: 188533 - RNA, 19 nt, Homo sapiens
caagucaucacaauaguua

SEQ ID NO: 188534 - RNA, 19 nt, Homo sapiens
caacaaguauuaacaguac

SEQ ID NO: 188535 - RNA, 19 nt, Homo sapiens
ugaaaucccucuagguuau

SEQ ID NO: 188536 - RNA, 19 nt, Homo sapiens
gacuacagauggauaauug

SEQ ID NO: 188537 - RNA, 19 nt, Homo sapiens
ggagcagccuacaagauaa

SEQ ID NO: 188538 - RNA, 19 nt, Homo sapiens
gaugacagcucuccauugg

SEQ ID NO: 188539 - RNA, 19 nt, Homo sapiens
gcagaggccuacagacaga

SEQ ID NO: 188540 - RNA, 19 nt, Homo sapiens
guauaaaccucuguaugaa

SEQ ID NO: 188541 - RNA, 19 nt, Homo sapiens
gcucugaguucuuguaaca

SEQ ID NO: 188542 - RNA, 19 nt, Homo sapiens
gacaauacaugcugcaaca

SEQ ID NO: 188543 - RNA, 19 nt, Homo sapiens
gaagaaacuguuauaagug

SEQ ID NO: 188544 - RNA, 19 nt, Homo sapiens
gaccgaacaccauuacaua

SEQ ID NO: 188545 - RNA, 19 nt, Homo sapiens
gaugaugaaguucguauuu

SEQ ID NO: 188546 - RNA, 19 nt, Homo sapiens
gacagaaguuggaagcuau

SEQ ID NO: 188547 - RNA, 19 nt, Homo sapiens
gauaaagauuguugaagag

SEQ ID NO: 188548 - RNA, 19 nt, Homo sapiens
ccacagaacacaaucauca

SEQ ID NO: 188549 - RNA, 19 nt, Homo sapiens
gaaacgauucuuacggaaa

SEQ ID NO: 188550 - RNA, 19 nt, Homo sapiens
ggaaggagcagccuacaag

SEQ ID NO: 188551 - RNA, 19 nt, Homo sapiens
gcauggugcugaugucaau

SEQ ID NO: 188552 - RNA, 19 nt, Homo sapiens
gaauuacuccuguagguau

SEQ ID NO: 188553 - RNA, 19 nt, Homo sapiens
ucugaguucuuguaacaua

SEQ ID NO: 188554 - RNA, 19 nt, Homo sapiens
gauguacacacgcaaagua

SEQ ID NO: 188555 - RNA, 19 nt, Homo sapiens
gugcugaugucaaugcaaa

SEQ ID NO: 188556 - RNA, 19 nt, Homo sapiens
gcugggaacuucuccacuu

SEQ ID NO: 188557 - RNA, 19 nt, Homo sapiens
uggaaacucuucuacauca

SEQ ID NO: 188558 - RNA, 19 nt, Homo sapiens
uagcagagauauuacagau

SEQ ID NO: 188559 - RNA, 19 nt, Homo sapiens
ugaugaaagugaccagaaa

SEQ ID NO: 188560 - RNA, 19 nt, Homo sapiens
gccaaauguuguguaauaa

SEQ ID NO: 188561 - RNA, 19 nt, Homo sapiens
agacagaaguuggaagcua

SEQ ID NO: 188562 - RNA, 19 nt, Homo sapiens
ggaaucugcagaaauagaa

SEQ ID NO: 188563 - RNA, 19 nt, Homo sapiens
ggaauuacuccuguaggua

SEQ ID NO: 188564 - RNA, 19 nt, Homo sapiens
gaagaaccaccagcuaaga

SEQ ID NO: 188565 - RNA, 19 nt, Homo sapiens
agaugucccugguagauuu

SEQ ID NO: 188566 - RNA, 19 nt, Homo sapiens
agacauugcugaagaaacu

SEQ ID NO: 188567 - RNA, 19 nt, Homo sapiens
gaacuucuccacuucaucu

SEQ ID NO: 188568 - RNA, 19 nt, Homo sapiens
auaaaccucuguaugaaga

SEQ ID NO: 188569 - RNA, 19 nt, Homo sapiens
caugagcucugaguucuug

SEQ ID NO: 188570 - RNA, 19 nt, Homo sapiens
gugaagaaccaccagcuaa

SEQ ID NO: 188571 - RNA, 19 nt, Homo sapiens
ggaaauuugcacucuauuc

SEQ ID NO: 188572 - RNA, 19 nt, Homo sapiens
aaacucuucuacaucagua

SEQ ID NO: 188573 - RNA, 19 nt, Homo sapiens
aaggacauguuaaagauga

SEQ ID NO: 188574 - RNA, 19 nt, Homo sapiens
gagcaggucaagaugauga

SEQ ID NO: 188575 - RNA, 19 nt, Homo sapiens
gaauacagaaugauagaag

SEQ ID NO: 188576 - RNA, 19 nt, Homo sapiens
cgacagcagcuccuaaaga

SEQ ID NO: 188577 - RNA, 19 nt, Homo sapiens
ggaugaagcaaaucgagaa

SEQ ID NO: 188578 - RNA, 19 nt, Homo sapiens
uaagagacaauguaucgaa

SEQ ID NO: 188579 - RNA, 19 nt, Homo sapiens
ggucagcccaucauuguga

SEQ ID NO: 188580 - RNA, 19 nt, Homo sapiens
agaaccaaaucaacacaaa

SEQ ID NO: 188581 - RNA, 19 nt, Homo sapiens
caaugcaaaggacauguua

SEQ ID NO: 188582 - RNA, 19 nt, Homo sapiens
ggaagcagaggccuacaga

SEQ ID NO: 188583 - RNA, 19 nt, Homo sapiens
gacaacaaguauuaacagu

SEQ ID NO: 188584 - RNA, 19 nt, Homo sapiens
uguaucugcuguucaguuu

SEQ ID NO: 188585 - RNA, 19 nt, Homo sapiens
gcaaaucgagaagcacaaa

SEQ ID NO: 188586 - RNA, 19 nt, Homo sapiens
guacacacgcaaaguaaau

SEQ ID NO: 188587 - RNA, 19 nt, Homo sapiens
agauggacaacaaguauua

SEQ ID NO: 188588 - RNA, 19 nt, Homo sapiens
aaauggagcucccuuuacu

SEQ ID NO: 188589 - RNA, 19 nt, Homo sapiens
acaccacaguuuaucauug

SEQ ID NO: 188590 - RNA, 19 nt, Homo sapiens
gcuauacccaaguagauuu

SEQ ID NO: 188591 - RNA, 19 nt, Homo sapiens
ccaugggaauacagaauga

SEQ ID NO: 188592 - RNA, 19 nt, Homo sapiens
guacagccaugggaauaca

SEQ ID NO: 188593 - RNA, 19 nt, Homo sapiens
agaauacaaucuugaacug

SEQ ID NO: 188594 - RNA, 19 nt, Homo sapiens
cugaagcgcuuugugugua

SEQ ID NO: 188595 - RNA, 19 nt, Homo sapiens
gcaagucaucacaauaguu

SEQ ID NO: 188596 - RNA, 19 nt, Homo sapiens
caauagacaauggaaauga

SEQ ID NO: 188597 - RNA, 19 nt, Homo sapiens
ggagcucccuuuacuacag

SEQ ID NO: 188598 - RNA, 19 nt, Homo sapiens
ugaagcaaaucgagaagca

SEQ ID NO: 188599 - RNA, 19 nt, Homo sapiens
cacaauaguuacagaugga

SEQ ID NO: 188600 - RNA, 19 nt, Homo sapiens
gacuugcucucaucacaau

SEQ ID NO: 188601 - RNA, 19 nt, Homo sapiens
aggagcagccuacaagaua

SEQ ID NO: 188602 - RNA, 19 nt, Homo sapiens
caaaaccccuuuacucugu

SEQ ID NO: 188603 - RNA, 19 nt, Homo sapiens
ucacuuacauagguauuuc

SEQ ID NO: 188604 - RNA, 19 nt, Homo sapiens
ggugaucguuguugguuag

SEQ ID NO: 188605 - RNA, 19 nt, Homo sapiens
gauggauaauuggacuuaa

SEQ ID NO: 188606 - RNA, 19 nt, Homo sapiens
gaacuguacacaacaaagg

SEQ ID NO: 188607 - RNA, 19 nt, Homo sapiens
gagcucccuuuacuacaga

SEQ ID NO: 188608 - RNA, 19 nt, Homo sapiens
aagagacaauguaucgaaa

SEQ ID NO: 188609 - RNA, 19 nt, Homo sapiens
cagcaagucaucacaauag

SEQ ID NO: 188610 - RNA, 19 nt, Homo sapiens
gcugcaacaccacaguuua

SEQ ID NO: 188611 - RNA, 19 nt, Homo sapiens
caacacaaacccagagagu

SEQ ID NO: 188612 - RNA, 19 nt, Homo sapiens
ucaaauauggugcugaugu

SEQ ID NO: 188613 - RNA, 19 nt, Homo sapiens
ggaccgaacaccauuacau

SEQ ID NO: 188614 - RNA, 19 nt, Homo sapiens
gcaauuacccuuaaaacug

SEQ ID NO: 188615 - RNA, 19 nt, Homo sapiens
gaaggagcagccuacaaga

SEQ ID NO: 188616 - RNA, 19 nt, Homo sapiens
ccaaguagauuuacaugua

SEQ ID NO: 188617 - RNA, 19 nt, Homo sapiens
gcagagauauuacagauug

SEQ ID NO: 188618 - RNA, 19 nt, Homo sapiens
gguggaaucugcagaaaua

SEQ ID NO: 188619 - RNA, 19 nt, Homo sapiens
ggccaaauguuguguaaua

SEQ ID NO: 188620 - RNA, 19 nt, Homo sapiens
caacagacauugcugaaga

SEQ ID NO: 188621 - RNA, 19 nt, Homo sapiens
gagacaauguaucgaaaua

SEQ ID NO: 188622 - RNA, 19 nt, Homo sapiens
gaaaugaacauguaguuug

SEQ ID NO: 188623 - RNA, 19 nt, Homo sapiens
ccaaaugaguugauaaaga

SEQ ID NO: 188624 - RNA, 19 nt, Homo sapiens
caaaggacauguuaaagau

SEQ ID NO: 188625 - RNA, 19 nt, Homo sapiens
gacagcagcuccuaaagaa

SEQ ID NO: 188626 - RNA, 19 nt, Homo sapiens
gcaaauggagcucccuuua

SEQ ID NO: 188627 - RNA, 19 nt, Homo sapiens
guacaaaccuuaauuucuc

SEQ ID NO: 188628 - RNA, 19 nt, Homo sapiens
caaauauggugcugaugua

SEQ ID NO: 188629 - RNA, 19 nt, Homo sapiens
ccacagaaaugaugaaagu

SEQ ID NO: 188630 - RNA, 19 nt, Homo sapiens
gguauaaaccucuguauga

SEQ ID NO: 188631 - RNA, 19 nt, Homo sapiens
gcaaaggacauguuaaaga

SEQ ID NO: 188632 - RNA, 19 nt, Homo sapiens
caagucaucacaauaguua

SEQ ID NO: 188633 - RNA, 19 nt, Homo sapiens
caacaaguauuaacaguac

SEQ ID NO: 188634 - RNA, 19 nt, Homo sapiens
ugaaaucccucuagguuau

SEQ ID NO: 188635 - RNA, 19 nt, Homo sapiens
gacuacagauggauaauug

SEQ ID NO: 188636 - RNA, 19 nt, Homo sapiens
ggagcagccuacaagauaa

SEQ ID NO: 188637 - RNA, 19 nt, Homo sapiens
gaugacagcucuccauugg

SEQ ID NO: 188638 - RNA, 19 nt, Homo sapiens
gcagaggccuacagacaga

SEQ ID NO: 188639 - RNA, 19 nt, Homo sapiens
guauaaaccucuguaugaa

SEQ ID NO: 188640 - RNA, 19 nt, Homo sapiens
gcucugaguucuuguaaca

SEQ ID NO: 188641 - RNA, 19 nt, Homo sapiens
gacaauacaugcugcaaca

SEQ ID NO: 188642 - RNA, 19 nt, Homo sapiens
gaagaaacuguuauaagug

SEQ ID NO: 188643 - RNA, 19 nt, Homo sapiens
gaccgaacaccauuacaua

SEQ ID NO: 188644 - RNA, 19 nt, Homo sapiens
gaugaugaaguucguauuu

SEQ ID NO: 188645 - RNA, 19 nt, Homo sapiens
gacagaaguuggaagcuau

SEQ ID NO: 188646 - RNA, 19 nt, Homo sapiens
gauaaagauuguugaagag

SEQ ID NO: 188647 - RNA, 19 nt, Homo sapiens
ccacagaacacaaucauca

SEQ ID NO: 188648 - RNA, 19 nt, Homo sapiens
gaaacgauucuuacggaaa

SEQ ID NO: 188649 - RNA, 19 nt, Homo sapiens
ggaaggagcagccuacaag

SEQ ID NO: 188650 - RNA, 19 nt, Homo sapiens
gcauggugcugaugucaau

SEQ ID NO: 188651 - RNA, 19 nt, Homo sapiens
gaauuacuccuguagguau

SEQ ID NO: 188652 - RNA, 19 nt, Homo sapiens
ucugaguucuuguaacaua

SEQ ID NO: 188653 - RNA, 19 nt, Homo sapiens
gauguacacacgcaaagua

SEQ ID NO: 188654 - RNA, 19 nt, Homo sapiens
gugcugaugucaaugcaaa

SEQ ID NO: 188655 - RNA, 19 nt, Homo sapiens
gcugggaacuucuccacuu

SEQ ID NO: 188656 - RNA, 19 nt, Homo sapiens
uggaaacucuucuacauca

SEQ ID NO: 188657 - RNA, 19 nt, Homo sapiens
uagcagagauauuacagau

SEQ ID NO: 188658 - RNA, 19 nt, Homo sapiens
ugaugaaagugaccagaaa

SEQ ID NO: 188659 - RNA, 19 nt, Homo sapiens
gccaaauguuguguaauaa

SEQ ID NO: 188660 - RNA, 19 nt, Homo sapiens
agacagaaguuggaagcua

SEQ ID NO: 188661 - RNA, 19 nt, Homo sapiens
ggaaucugcagaaauagaa

SEQ ID NO: 188662 - RNA, 19 nt, Homo sapiens
ggaauuacuccuguaggua

SEQ ID NO: 188663 - RNA, 19 nt, Homo sapiens
gaagaaccaccagcuaaga

SEQ ID NO: 188664 - RNA, 19 nt, Homo sapiens
agaugucccugguagauuu

SEQ ID NO: 188665 - RNA, 19 nt, Homo sapiens
agacauugcugaagaaacu

SEQ ID NO: 188666 - RNA, 19 nt, Homo sapiens
gaacuucuccacuucaucu

SEQ ID NO: 188667 - RNA, 19 nt, Homo sapiens
auaaaccucuguaugaaga

SEQ ID NO: 188668 - RNA, 19 nt, Homo sapiens
caugagcucugaguucuug

SEQ ID NO: 188669 - RNA, 19 nt, Homo sapiens
gugaagaaccaccagcuaa

SEQ ID NO: 188670 - RNA, 19 nt, Homo sapiens
ggaaauuugcacucuauuc

SEQ ID NO: 188671 - RNA, 19 nt, Homo sapiens
aaacucuucuacaucagua

SEQ ID NO: 188672 - RNA, 19 nt, Homo sapiens
gagcaggucaagaugauga

SEQ ID NO: 188673 - RNA, 19 nt, Homo sapiens
aaggacauguuaaagauga

SEQ ID NO: 188674 - RNA, 19 nt, Homo sapiens
gaauacagaaugauagaag

SEQ ID NO: 188675 - RNA, 19 nt, Homo sapiens
cgacagcagcuccuaaaga

SEQ ID NO: 188676 - RNA, 19 nt, Homo sapiens
ggaugaagcaaaucgagaa

SEQ ID NO: 188677 - RNA, 19 nt, Homo sapiens
uaagagacaauguaucgaa

SEQ ID NO: 188678 - RNA, 19 nt, Homo sapiens
ggucagcccaucauuguga

SEQ ID NO: 188679 - RNA, 19 nt, Homo sapiens
agaaccaaaucaacacaaa

SEQ ID NO: 188680 - RNA, 19 nt, Homo sapiens
caaugcaaaggacauguua

SEQ ID NO: 188681 - RNA, 19 nt, Homo sapiens
ggaagcagaggccuacaga

SEQ ID NO: 188682 - RNA, 19 nt, Homo sapiens
gacaacaaguauuaacagu

SEQ ID NO: 188683 - RNA, 19 nt, Homo sapiens
uguaucugcuguucaguuu

SEQ ID NO: 188684 - RNA, 19 nt, Homo sapiens
gcaaaucgagaagcacaaa

SEQ ID NO: 188685 - RNA, 19 nt, Homo sapiens
guacacacgcaaaguaaau

SEQ ID NO: 188686 - RNA, 19 nt, Homo sapiens
agauggacaacaaguauua

SEQ ID NO: 188687 - RNA, 19 nt, Homo sapiens
aaauggagcucccuuuacu

SEQ ID NO: 188688 - RNA, 19 nt, Homo sapiens
gaaccuaacagaugaaacg

SEQ ID NO: 188689 - RNA, 19 nt, Homo sapiens
acaccacaguuuaucauug

SEQ ID NO: 188690 - RNA, 19 nt, Homo sapiens
gcuauacccaaguagauuu

SEQ ID NO: 188691 - RNA, 19 nt, Homo sapiens
cugaagcgcuuugugugua

SEQ ID NO: 188692 - RNA, 19 nt, Homo sapiens
ccaugggaauacagaauga

SEQ ID NO: 188693 - RNA, 19 nt, Homo sapiens
guacagccaugggaauaca

SEQ ID NO: 188694 - RNA, 19 nt, Homo sapiens
agaauacaaucuugaacug

SEQ ID NO: 188695 - RNA, 19 nt, Homo sapiens
gcaagucaucacaauaguu

SEQ ID NO: 188696 - RNA, 19 nt, Homo sapiens
caauagacaauggaaauga

SEQ ID NO: 188697 - RNA, 19 nt, Homo sapiens
ugaagcaaaucgagaagca

SEQ ID NO: 188698 - RNA, 19 nt, Homo sapiens
ggagcucccuuuacuacag

SEQ ID NO: 188699 - RNA, 19 nt, Homo sapiens
cacaauaguuacagaugga

SEQ ID NO: 188700 - RNA, 19 nt, Homo sapiens
gacuugcucucaucacaau

SEQ ID NO: 188701 - RNA, 19 nt, Homo sapiens
aggagcagccuacaagaua

SEQ ID NO: 188702 - RNA, 19 nt, Homo sapiens
caaaaccccuuuacucugu

SEQ ID NO: 188703 - RNA, 19 nt, Homo sapiens
ucacuuacauagguauuuc

SEQ ID NO: 188704 - RNA, 19 nt, Homo sapiens
ggugaucguuguugguuag

SEQ ID NO: 188705 - RNA, 19 nt, Homo sapiens
gauggauaauuggacuuaa

SEQ ID NO: 188706 - RNA, 19 nt, Homo sapiens
gaacuguacacaacaaagg

SEQ ID NO: 188707 - RNA, 19 nt, Homo sapiens
aagagacaauguaucgaaa

SEQ ID NO: 188708 - RNA, 19 nt, Homo sapiens
gagcucccuuuacuacaga

SEQ ID NO: 188709 - RNA, 19 nt, Homo sapiens
cagcaagucaucacaauag

SEQ ID NO: 188710 - RNA, 19 nt, Homo sapiens
gcugcaacaccacaguuua

SEQ ID NO: 188711 - RNA, 19 nt, Homo sapiens
caacacaaacccagagagu

SEQ ID NO: 188712 - RNA, 19 nt, Homo sapiens
ucaaauauggugcugaugu

SEQ ID NO: 188713 - RNA, 19 nt, Homo sapiens
ggaccgaacaccauuacau

SEQ ID NO: 188714 - RNA, 19 nt, Homo sapiens
gcaauuacccuuaaaacug

SEQ ID NO: 188715 - RNA, 19 nt, Homo sapiens
gaaggagcagccuacaaga

SEQ ID NO: 188716 - RNA, 19 nt, Homo sapiens
gcagagauauuacagauug

SEQ ID NO: 188717 - RNA, 19 nt, Homo sapiens
gguggaaucugcagaaaua

SEQ ID NO: 188718 - RNA, 19 nt, Homo sapiens
caacagacauugcugaaga

SEQ ID NO: 188719 - RNA, 19 nt, Homo sapiens
gagacaauguaucgaaaua

SEQ ID NO: 188720 - RNA, 19 nt, Homo sapiens
uaacaggucugguaucuuc

SEQ ID NO: 188721 - RNA, 19 nt, Homo sapiens
caaaggacauguuaaagau

SEQ ID NO: 188722 - RNA, 19 nt, Homo sapiens
gcaaauggagcucccuuua

SEQ ID NO: 188723 - RNA, 19 nt, Homo sapiens
caaauauggugcugaugua

SEQ ID NO: 188724 - RNA, 19 nt, Homo sapiens
gcaaaggacauguuaaaga

SEQ ID NO: 188725 - RNA, 19 nt, Homo sapiens
caagucaucacaauaguua

SEQ ID NO: 188726 - RNA, 19 nt, Homo sapiens
caacaaguauuaacaguac

SEQ ID NO: 188727 - RNA, 19 nt, Homo sapiens
gaugacagcucuccauugg

SEQ ID NO: 188728 - RNA, 19 nt, Homo sapiens
gaaugaaagugcguaguau

SEQ ID NO: 188729 - RNA, 19 nt, Homo sapiens
gacaauacaugcugcaaca

SEQ ID NO: 188730 - RNA, 19 nt, Homo sapiens
agcaagcccucaauaaaua

SEQ ID NO: 188731 - RNA, 19 nt, Homo sapiens
gaagaaacuguuauaagug

SEQ ID NO: 188732 - RNA, 19 nt, Homo sapiens
gaccgaacaccauuacaua

SEQ ID NO: 188733 - RNA, 19 nt, Homo sapiens
gaugaugaaguucguauuu

SEQ ID NO: 188734 - RNA, 19 nt, Homo sapiens
ccacagaacacaaucauca

SEQ ID NO: 188735 - RNA, 19 nt, Homo sapiens
gcauggugcugaugucaau

SEQ ID NO: 188736 - RNA, 19 nt, Homo sapiens
gauguacacacgcaaagua

SEQ ID NO: 188737 - RNA, 19 nt, Homo sapiens
gugcugaugucaaugcaaa

SEQ ID NO: 188738 - RNA, 19 nt, Homo sapiens
gcugggaacuucuccacuu

SEQ ID NO: 188739 - RNA, 19 nt, Homo sapiens
uggaaacucuucuacauca

SEQ ID NO: 188740 - RNA, 19 nt, Homo sapiens
uagcagagauauuacagau

SEQ ID NO: 188741 - RNA, 19 nt, Homo sapiens
ggaaucugcagaaauagaa

SEQ ID NO: 188742 - RNA, 19 nt, Homo sapiens
gaagaaccaccagcuaaga

SEQ ID NO: 188743 - RNA, 19 nt, Homo sapiens
agacauugcugaagaaacu

SEQ ID NO: 188744 - RNA, 19 nt, Homo sapiens
agaugucccugguagauuu

SEQ ID NO: 188745 - RNA, 19 nt, Homo sapiens
gaacuucuccacuucaucu

SEQ ID NO: 188746 - RNA, 19 nt, Homo sapiens
gugaagaaccaccagcuaa

SEQ ID NO: 188747 - RNA, 19 nt, Homo sapiens
ggaaauuugcacucuauuc

SEQ ID NO: 188748 - RNA, 19 nt, Homo sapiens
aaacucuucuacaucagua

SEQ ID NO: 188749 - RNA, 19 nt, Homo sapiens
aaggacauguuaaagauga

SEQ ID NO: 188750 - RNA, 19 nt, Homo sapiens
gagcaggucaagaugauga

SEQ ID NO: 188751 - RNA, 19 nt, Homo sapiens
gcaagcccucaauaaauaa

SEQ ID NO: 188752 - RNA, 19 nt, Homo sapiens
agaaugaaagugcguagua

SEQ ID NO: 188753 - RNA, 19 nt, Homo sapiens
uaagagacaauguaucgaa

SEQ ID NO: 188754 - RNA, 19 nt, Homo sapiens
ggucagcccaucauuguga

SEQ ID NO: 188755 - RNA, 19 nt, Homo sapiens
agaaccaaaucaacacaaa

SEQ ID NO: 188756 - RNA, 19 nt, Homo sapiens
caaugcaaaggacauguua

SEQ ID NO: 188757 - RNA, 19 nt, Homo sapiens
gacaacaaguauuaacagu

SEQ ID NO: 188758 - RNA, 19 nt, Homo sapiens
uguaucugcuguucaguuu

SEQ ID NO: 188759 - RNA, 19 nt, Homo sapiens
uagcaagcccucaauaaau

SEQ ID NO: 188760 - RNA, 19 nt, Homo sapiens
guacacacgcaaaguaaau

SEQ ID NO: 188761 - RNA, 19 nt, Homo sapiens
uauagcaagcccucaauaa

SEQ ID NO: 188762 - RNA, 19 nt, Homo sapiens
agauggacaacaaguauua

SEQ ID NO: 188763 - RNA, 19 nt, Homo sapiens
acaccacaguuuaucauug

SEQ ID NO: 188764 - RNA, 19 nt, Homo sapiens
aaauggagcucccuuuacu

SEQ ID NO: 188765 - RNA, 19 nt, Homo sapiens
gcaagucaucacaauaguu

SEQ ID NO: 188766 - RNA, 19 nt, Homo sapiens
caauagacaauggaaauga

SEQ ID NO: 188767 - RNA, 19 nt, Homo sapiens
cugaagcgcuuugugugua

SEQ ID NO: 188768 - RNA, 19 nt, Homo sapiens
cacaauaguuacagaugga

SEQ ID NO: 188769 - RNA, 19 nt, Homo sapiens
ggagcucccuuuacuacag

SEQ ID NO: 188770 - RNA, 19 nt, Homo sapiens
aagagacaauguaucgaaa

SEQ ID NO: 188771 - RNA, 19 nt, Homo sapiens
cagcaagucaucacaauag

SEQ ID NO: 188772 - RNA, 19 nt, Homo sapiens
gcugcaacaccacaguuua

SEQ ID NO: 188773 - RNA, 19 nt, Homo sapiens
caacacaaacccagagagu

SEQ ID NO: 188774 - RNA, 19 nt, Homo sapiens
ucaaauauggugcugaugu

SEQ ID NO: 188775 - RNA, 19 nt, Homo sapiens
ggaccgaacaccauuacau

SEQ ID NO: 188776 - RNA, 19 nt, Homo sapiens
gagcucccuuuacuacaga

SEQ ID NO: 188777 - RNA, 19 nt, Homo sapiens
gcuaagagacaauguaucg

SEQ ID NO: 188778 - RNA, 19 nt, Homo sapiens
ccagauggacaacaaguau

SEQ ID NO: 188779 - RNA, 19 nt, Homo sapiens
gagcuggugugagcagaga

SEQ ID NO: 188780 - RNA, 19 nt, Homo sapiens
gcacaguauggucauuauu

SEQ ID NO: 188781 - RNA, 19 nt, Homo sapiens
ggacaacaaguauuaacag

SEQ ID NO: 188782 - RNA, 19 nt, Homo sapiens
gcugaagaaacuguuauaa

SEQ ID NO: 188783 - RNA, 19 nt, Homo sapiens
gcaacaccacaguuuauca

SEQ ID NO: 188784 - RNA, 19 nt, Homo sapiens
uaacaguaccagcaacaga

SEQ ID NO: 188785 - RNA, 19 nt, Homo sapiens
gaaauuugcacucuauucc

SEQ ID NO: 188786 - RNA, 19 nt, Homo sapiens
ugccuuagcugaagcaucu

SEQ ID NO: 188787 - RNA, 19 nt, Homo sapiens
gcagagaugccagaaccaa

SEQ ID NO: 188788 - RNA, 19 nt, Homo sapiens
cagcacaguauggucauua

SEQ ID NO: 188789 - RNA, 19 nt, Homo sapiens
gcacgagcaggucaagaug

SEQ ID NO: 188790 - RNA, 19 nt, Homo sapiens
ggaauuggucagcccauca

SEQ ID NO: 188791 - RNA, 19 nt, Homo sapiens
ggccacagaagaaguaguu

SEQ ID NO: 188792 - RNA, 19 nt, Homo sapiens
caucaguauuagcuacauu

SEQ ID NO: 188793 - RNA, 19 nt, Homo sapiens
gaagauuuagcagagauau

SEQ ID NO: 188794 - RNA, 19 nt, Homo sapiens
auagcaagcccucaauaaa

SEQ ID NO: 188795 - RNA, 19 nt, Homo sapiens
gcagaaauagaaguaagga

SEQ ID NO: 188796 - RNA, 19 nt, Homo sapiens
cagcuaagagacaauguau

SEQ ID NO: 188797 - RNA, 19 nt, Homo sapiens
caugccagauggacaacaa

SEQ ID NO: 188798 - RNA, 19 nt, Homo sapiens
gaaacucuucuacaucagu

SEQ ID NO: 188799 - RNA, 19 nt, Homo sapiens
caccacaguuuaucauugg

SEQ ID NO: 188800 - RNA, 19 nt, Homo sapiens
cagacuggcugggaacuuc

SEQ ID NO: 188801 - RNA, 19 nt, Homo sapiens
gauauuacagauugcuaug

SEQ ID NO: 188802 - RNA, 19 nt, Homo sapiens
caagaggugguggaacuuu

SEQ ID NO: 188803 - RNA, 19 nt, Homo sapiens
gcagcacaguauggucauu

SEQ ID NO: 188804 - RNA, 19 nt, Homo sapiens
ucagcaagucaucacaaua

SEQ ID NO: 188805 - RNA, 19 nt, Homo sapiens
ccuaacaggucugguaucu

SEQ ID NO: 188806 - RNA, 19 nt, Homo sapiens
caaauggagcucccuuuac

SEQ ID NO: 188807 - RNA, 19 nt, Homo sapiens
uucagaaacuccaguagug

SEQ ID NO: 188808 - RNA, 19 nt, Homo sapiens
ccagcuaagagacaaugua

SEQ ID NO: 188809 - RNA, 19 nt, Homo sapiens
uuggaaauuugcacucuau

SEQ ID NO: 188810 - RNA, 19 nt, Homo sapiens
caacaccacaguuuaucau

SEQ ID NO: 188811 - RNA, 19 nt, Homo sapiens
gagauauuacagauugcua

SEQ ID NO: 188812 - RNA, 19 nt, Homo sapiens
cagaacacaaucaucaaga

SEQ ID NO: 188813 - RNA, 19 nt, Homo sapiens
gauggacaacaaguauuaa

SEQ ID NO: 188814 - RNA, 19 nt, Homo sapiens
uaucugcuguucaguuugg

SEQ ID NO: 188815 - RNA, 19 nt, Homo sapiens
cagagaguccugacacugu

SEQ ID NO: 188816 - RNA, 19 nt, Homo sapiens
gcagagauauuacagauug

SEQ ID NO: 188817 - RNA, 19 nt, Homo sapiens
gguggaaucugcagaaaua

SEQ ID NO: 188818 - RNA, 19 nt, Homo sapiens
caacagacauugcugaaga

SEQ ID NO: 188819 - RNA, 19 nt, Homo sapiens
gagacaauguaucgaaaua

SEQ ID NO: 188820 - RNA, 19 nt, Homo sapiens
caaaggacauguuaaagau

SEQ ID NO: 188821 - RNA, 19 nt, Homo sapiens
gcaaauggagcucccuuua

SEQ ID NO: 188822 - RNA, 19 nt, Homo sapiens
caaauauggugcugaugua

SEQ ID NO: 188823 - RNA, 19 nt, Homo sapiens
gcaaaggacauguuaaaga

SEQ ID NO: 188824 - RNA, 19 nt, Homo sapiens
caagucaucacaauaguua

SEQ ID NO: 188825 - RNA, 19 nt, Homo sapiens
caacaaguauuaacaguac

SEQ ID NO: 188826 - RNA, 19 nt, Homo sapiens
gaugacagcucuccauugg

SEQ ID NO: 188827 - RNA, 19 nt, Homo sapiens
gaaugaaagugcguaguau

SEQ ID NO: 188828 - RNA, 19 nt, Homo sapiens
gacaauacaugcugcaaca

SEQ ID NO: 188829 - RNA, 19 nt, Homo sapiens
agcaagcccucaauaaaua

SEQ ID NO: 188830 - RNA, 19 nt, Homo sapiens
gaagaaacuguuauaagug

SEQ ID NO: 188831 - RNA, 19 nt, Homo sapiens
gaccgaacaccauuacaua

SEQ ID NO: 188832 - RNA, 19 nt, Homo sapiens
gaugaugaaguucguauuu

SEQ ID NO: 188833 - RNA, 19 nt, Homo sapiens
ccacagaacacaaucauca

SEQ ID NO: 188834 - RNA, 19 nt, Homo sapiens
gcauggugcugaugucaau

SEQ ID NO: 188835 - RNA, 19 nt, Homo sapiens
gauguacacacgcaaagua

SEQ ID NO: 188836 - RNA, 19 nt, Homo sapiens
gugcugaugucaaugcaaa

SEQ ID NO: 188837 - RNA, 19 nt, Homo sapiens
gcugggaacuucuccacuu

SEQ ID NO: 188838 - RNA, 19 nt, Homo sapiens
uggaaacucuucuacauca

SEQ ID NO: 188839 - RNA, 19 nt, Homo sapiens
uagcagagauauuacagau

SEQ ID NO: 188840 - RNA, 19 nt, Homo sapiens
ggaaucugcagaaauagaa

SEQ ID NO: 188841 - RNA, 19 nt, Homo sapiens
gaagaaccaccagcuaaga

SEQ ID NO: 188842 - RNA, 19 nt, Homo sapiens
agacauugcugaagaaacu

SEQ ID NO: 188843 - RNA, 19 nt, Homo sapiens
agaugucccugguagauuu

SEQ ID NO: 188844 - RNA, 19 nt, Homo sapiens
gaacuucuccacuucaucu

SEQ ID NO: 188845 - RNA, 19 nt, Homo sapiens
gugaagaaccaccagcuaa

SEQ ID NO: 188846 - RNA, 19 nt, Homo sapiens
ggaaauuugcacucuauuc

SEQ ID NO: 188847 - RNA, 19 nt, Homo sapiens
aaacucuucuacaucagua

SEQ ID NO: 188848 - RNA, 19 nt, Homo sapiens
aaggacauguuaaagauga

SEQ ID NO: 188849 - RNA, 19 nt, Homo sapiens
gagcaggucaagaugauga

SEQ ID NO: 188850 - RNA, 19 nt, Homo sapiens
gcaagcccucaauaaauaa

SEQ ID NO: 188851 - RNA, 19 nt, Homo sapiens
agaaugaaagugcguagua

SEQ ID NO: 188852 - RNA, 19 nt, Homo sapiens
uaagagacaauguaucgaa

SEQ ID NO: 188853 - RNA, 19 nt, Homo sapiens
ggucagcccaucauuguga

SEQ ID NO: 188854 - RNA, 19 nt, Homo sapiens
agaaccaaaucaacacaaa

SEQ ID NO: 188855 - RNA, 19 nt, Homo sapiens
caaugcaaaggacauguua

SEQ ID NO: 188856 - RNA, 19 nt, Homo sapiens
gacaacaaguauuaacagu

SEQ ID NO: 188857 - RNA, 19 nt, Homo sapiens
uguaucugcuguucaguuu

SEQ ID NO: 188858 - RNA, 19 nt, Homo sapiens
uagcaagcccucaauaaau

SEQ ID NO: 188859 - RNA, 19 nt, Homo sapiens
guacacacgcaaaguaaau

SEQ ID NO: 188860 - RNA, 19 nt, Homo sapiens
uauagcaagcccucaauaa

SEQ ID NO: 188861 - RNA, 19 nt, Homo sapiens
agauggacaacaaguauua

SEQ ID NO: 188862 - RNA, 19 nt, Homo sapiens
gaaccuaacagaugaaacg

SEQ ID NO: 188863 - RNA, 19 nt, Homo sapiens
acaccacaguuuaucauug

SEQ ID NO: 188864 - RNA, 19 nt, Homo sapiens
aaauggagcucccuuuacu

SEQ ID NO: 188865 - RNA, 19 nt, Homo sapiens
cugaagcgcuuugugugua

SEQ ID NO: 188866 - RNA, 19 nt, Homo sapiens
gcaagucaucacaauaguu

SEQ ID NO: 188867 - RNA, 19 nt, Homo sapiens
caauagacaauggaaauga

SEQ ID NO: 188868 - RNA, 19 nt, Homo sapiens
cacaauaguuacagaugga

SEQ ID NO: 188869 - RNA, 19 nt, Homo sapiens
ggagcucccuuuacuacag

SEQ ID NO: 188870 - RNA, 19 nt, Homo sapiens
aagagacaauguaucgaaa

SEQ ID NO: 188871 - RNA, 19 nt, Homo sapiens
cagcaagucaucacaauag

SEQ ID NO: 188872 - RNA, 19 nt, Homo sapiens
gcugcaacaccacaguuua

SEQ ID NO: 188873 - RNA, 19 nt, Homo sapiens
caacacaaacccagagagu

SEQ ID NO: 188874 - RNA, 19 nt, Homo sapiens
ucaaauauggugcugaugu

SEQ ID NO: 188875 - RNA, 19 nt, Homo sapiens
ggaccgaacaccauuacau

SEQ ID NO: 188876 - RNA, 19 nt, Homo sapiens
gagcucccuuuacuacaga

SEQ ID NO: 188877 - RNA, 19 nt, Homo sapiens
gcuaagagacaauguaucg

SEQ ID NO: 188878 - RNA, 19 nt, Homo sapiens
ccagauggacaacaaguau

SEQ ID NO: 188879 - RNA, 19 nt, Homo sapiens
gagcuggugugagcagaga

SEQ ID NO: 188880 - RNA, 19 nt, Homo sapiens
gcacaguauggucauuauu

SEQ ID NO: 188881 - RNA, 19 nt, Homo sapiens
ggacaacaaguauuaacag

SEQ ID NO: 188882 - RNA, 19 nt, Homo sapiens
gcugaagaaacuguuauaa

SEQ ID NO: 188883 - RNA, 19 nt, Homo sapiens
gcaacaccacaguuuauca

SEQ ID NO: 188884 - RNA, 19 nt, Homo sapiens
uaacaguaccagcaacaga

SEQ ID NO: 188885 - RNA, 19 nt, Homo sapiens
gaaauuugcacucuauucc

SEQ ID NO: 188886 - RNA, 19 nt, Homo sapiens
ugccuuagcugaagcaucu

SEQ ID NO: 188887 - RNA, 19 nt, Homo sapiens
gcagagaugccagaaccaa

SEQ ID NO: 188888 - RNA, 19 nt, Homo sapiens
cagcacaguauggucauua

SEQ ID NO: 188889 - RNA, 19 nt, Homo sapiens
gcacgagcaggucaagaug

SEQ ID NO: 188890 - RNA, 19 nt, Homo sapiens
ggaauuggucagcccauca

SEQ ID NO: 188891 - RNA, 19 nt, Homo sapiens
ggccacagaagaaguaguu

SEQ ID NO: 188892 - RNA, 19 nt, Homo sapiens
caucaguauuagcuacauu

SEQ ID NO: 188893 - RNA, 19 nt, Homo sapiens
gaagauuuagcagagauau

SEQ ID NO: 188894 - RNA, 19 nt, Homo sapiens
auagcaagcccucaauaaa

SEQ ID NO: 188895 - RNA, 19 nt, Homo sapiens
gcagaaauagaaguaagga

SEQ ID NO: 188896 - RNA, 19 nt, Homo sapiens
cagcuaagagacaauguau

SEQ ID NO: 188897 - RNA, 19 nt, Homo sapiens
caugccagauggacaacaa

SEQ ID NO: 188898 - RNA, 19 nt, Homo sapiens
gaaacucuucuacaucagu

SEQ ID NO: 188899 - RNA, 19 nt, Homo sapiens
caccacaguuuaucauugg

SEQ ID NO: 188900 - RNA, 19 nt, Homo sapiens
cagacuggcugggaacuuc

SEQ ID NO: 188901 - RNA, 19 nt, Homo sapiens
guggugaaccuaacagaug

SEQ ID NO: 188902 - RNA, 19 nt, Homo sapiens
gauauuacagauugcuaug

SEQ ID NO: 188903 - RNA, 19 nt, Homo sapiens
caagaggugguggaacuuu

SEQ ID NO: 188904 - RNA, 19 nt, Homo sapiens
gcagcacaguauggucauu

SEQ ID NO: 188905 - RNA, 19 nt, Homo sapiens
ucagcaagucaucacaaua

SEQ ID NO: 188906 - RNA, 19 nt, Homo sapiens
uggugaaccuaacagauga

SEQ ID NO: 188907 - RNA, 19 nt, Homo sapiens
caaauggagcucccuuuac

SEQ ID NO: 188908 - RNA, 19 nt, Homo sapiens
uucagaaacuccaguagug

SEQ ID NO: 188909 - RNA, 19 nt, Homo sapiens
ccagcuaagagacaaugua

SEQ ID NO: 188910 - RNA, 19 nt, Homo sapiens
uuggaaauuugcacucuau

SEQ ID NO: 188911 - RNA, 19 nt, Homo sapiens
caacaccacaguuuaucau

SEQ ID NO: 188912 - RNA, 19 nt, Homo sapiens
gagauauuacagauugcua

SEQ ID NO: 188913 - RNA, 19 nt, Homo sapiens
cagaacacaaucaucaaga

SEQ ID NO: 188914 - RNA, 19 nt, Homo sapiens
gauggacaacaaguauuaa

SEQ ID NO: 188915 - RNA, 19 nt, Homo sapiens
uaucugcuguucaguuugg

SEQ ID NO: 188916 - RNA, 19 nt, Homo sapiens
gaagauggaucacgucuaa

SEQ ID NO: 188917 - RNA, 19 nt, Homo sapiens
gagcagaaguuguuuauga

SEQ ID NO: 188918 - RNA, 19 nt, Homo sapiens
guaaaggauccucuuauua

SEQ ID NO: 188919 - RNA, 19 nt, Homo sapiens
aagauuggcuacuuuguua

SEQ ID NO: 188920 - RNA, 19 nt, Homo sapiens
caacagcuauggauugguu

SEQ ID NO: 188921 - RNA, 19 nt, Homo sapiens
gaucacgucuaaaccagua

SEQ ID NO: 188922 - RNA, 19 nt, Homo sapiens
ggaauuguccagucaagua

SEQ ID NO: 188923 - RNA, 19 nt, Homo sapiens
uaacauagacaaacaguug

SEQ ID NO: 188924 - RNA, 19 nt, Homo sapiens
uaaccgaagugaagacuga

SEQ ID NO: 188925 - RNA, 19 nt, Homo sapiens
cuacugggcuacguauuua

SEQ ID NO: 188926 - RNA, 19 nt, Homo sapiens
gaaacucccucccuaaggu

SEQ ID NO: 188927 - RNA, 19 nt, Homo sapiens
aaacauaccugccaugcau

SEQ ID NO: 188928 - RNA, 19 nt, Homo sapiens
ggacagccgucauuacaag

SEQ ID NO: 188929 - RNA, 19 nt, Homo sapiens
gagaauauguuguuaugac

SEQ ID NO: 188930 - RNA, 19 nt, Homo sapiens
gcacugggaauuuauuuau

SEQ ID NO: 188931 - RNA, 19 nt, Homo sapiens
gcuauggauugguuuauug

SEQ ID NO: 188932 - RNA, 19 nt, Homo sapiens
gaaguuaugcuuauacaag

SEQ ID NO: 188933 - RNA, 19 nt, Homo sapiens
gauauugggaagcaaauuu

SEQ ID NO: 188934 - RNA, 19 nt, Homo sapiens
gaagcaaauuuggguguga

SEQ ID NO: 188935 - RNA, 19 nt, Homo sapiens
ccucugcacugggaauuua

SEQ ID NO: 188936 - RNA, 19 nt, Homo sapiens
cuggaaggaugaaagguua

SEQ ID NO: 188937 - RNA, 19 nt, Homo sapiens
aguaaaggauccucuuauu

SEQ ID NO: 188938 - RNA, 19 nt, Homo sapiens
aaacagagagccucagcua

SEQ ID NO: 188939 - RNA, 19 nt, Homo sapiens
gcugcuauuuggaaucuuu

SEQ ID NO: 188940 - RNA, 19 nt, Homo sapiens
gguaacagcgccugcguuu

SEQ ID NO: 188941 - RNA, 19 nt, Homo sapiens
acaaacaguugccuccaaa

SEQ ID NO: 188942 - RNA, 19 nt, Homo sapiens
acagagagccucagcuaaa

SEQ ID NO: 188943 - RNA, 19 nt, Homo sapiens
gaccgacugucaagaauag

SEQ ID NO: 188944 - RNA, 19 nt, Homo sapiens
gaaaguaaaggauccucuu

SEQ ID NO: 188945 - RNA, 19 nt, Homo sapiens
guaauucccaucugccuuu

SEQ ID NO: 188946 - RNA, 19 nt, Homo sapiens
gacaaacaguugccuccaa

SEQ ID NO: 188947 - RNA, 19 nt, Homo sapiens
agagaaagauuggcuacuu

SEQ ID NO: 188948 - RNA, 19 nt, Homo sapiens
gugcaaccauagaaccuaa

SEQ ID NO: 188949 - RNA, 19 nt, Homo sapiens
uaacaacugugcucaccau

SEQ ID NO: 188950 - RNA, 19 nt, Homo sapiens
cagaaguuguuuaugaaug

SEQ ID NO: 188951 - RNA, 19 nt, Homo sapiens
agaacugucuuuggaguaa

SEQ ID NO: 188952 - RNA, 19 nt, Homo sapiens
ccacucauuuccacuugaa

SEQ ID NO: 188953 - RNA, 19 nt, Homo sapiens
gcccaugcuugcccacuaa

SEQ ID NO: 188954 - RNA, 19 nt, Homo sapiens
aaaguaaaggauccucuua

SEQ ID NO: 188955 - RNA, 19 nt, Homo sapiens
gagcaucagugccagaaac

SEQ ID NO: 188956 - RNA, 19 nt, Homo sapiens
caagagcagaaguuguuua

SEQ ID NO: 188957 - RNA, 19 nt, Homo sapiens
gcaccuugcuguacaccau

SEQ ID NO: 188958 - RNA, 19 nt, Homo sapiens
gauugaguuugccacagua

SEQ ID NO: 188959 - RNA, 19 nt, Homo sapiens
caaagcugcagauuggaua

SEQ ID NO: 188960 - RNA, 19 nt, Homo sapiens
acaguagacucuggaauug

SEQ ID NO: 188961 - RNA, 19 nt, Homo sapiens
ugacaguccuccgguuaaa

SEQ ID NO: 188962 - RNA, 19 nt, Homo sapiens
gcacgcagaguccaugaug

SEQ ID NO: 188963 - RNA, 19 nt, Homo sapiens
uuacucacauucuguuguu

SEQ ID NO: 188964 - RNA, 19 nt, Homo sapiens
cuacguauuuaaacagaga

SEQ ID NO: 188965 - RNA, 19 nt, Homo sapiens
uaccugccaugcauaauga

SEQ ID NO: 188966 - RNA, 19 nt, Homo sapiens
gauggcaccuugcuguaca

SEQ ID NO: 188967 - RNA, 19 nt, Homo sapiens
gaacuuaaagacaauacca

SEQ ID NO: 188968 - RNA, 19 nt, Homo sapiens
caagaugaacuuaaagaca

SEQ ID NO: 188969 - RNA, 19 nt, Homo sapiens
caacugugcucaccaugac

SEQ ID NO: 188970 - RNA, 19 nt, Homo sapiens
gaccacucauuuccacuug

SEQ ID NO: 188971 - RNA, 19 nt, Homo sapiens
acaggagaauauguuguua

SEQ ID NO: 188972 - RNA, 19 nt, Homo sapiens
ccagaaacucccucccuaa

SEQ ID NO: 188973 - RNA, 19 nt, Homo sapiens
aggagaauauguuguuaug

SEQ ID NO: 188974 - RNA, 19 nt, Homo sapiens
acaguccuccgguuaaaua

SEQ ID NO: 188975 - RNA, 19 nt, Homo sapiens
cacauucuguuguucaguu

SEQ ID NO: 188976 - RNA, 19 nt, Homo sapiens
gaaaagccaaagaaaguaa

SEQ ID NO: 188977 - RNA, 19 nt, Homo sapiens
gaaguuguuuaugaaugga

SEQ ID NO: 188978 - RNA, 19 nt, Homo sapiens
ggaaggaugaaagguuaaa

SEQ ID NO: 188979 - RNA, 19 nt, Homo sapiens
gcagaaguuguuuaugaau

SEQ ID NO: 188980 - RNA, 19 nt, Homo sapiens
ccacaucaauagaucuuuu

SEQ ID NO: 188981 - RNA, 19 nt, Homo sapiens
ccagucaaguacaggagaa

SEQ ID NO: 188982 - RNA, 19 nt, Homo sapiens
aaaccaguaugaccuucuu

SEQ ID NO: 188983 - RNA, 19 nt, Homo sapiens
gaagugaagacugauaucu

SEQ ID NO: 188984 - RNA, 19 nt, Homo sapiens
gcuauggacagccgucauu

SEQ ID NO: 188985 - RNA, 19 nt, Homo sapiens
uaauucccaucugccuuua

SEQ ID NO: 188986 - RNA, 19 nt, Homo sapiens
gauuggcuacuuuguuauu

SEQ ID NO: 188987 - RNA, 19 nt, Homo sapiens
gcuccagucucuccacgau

SEQ ID NO: 188988 - RNA, 19 nt, Homo sapiens
uaugacaguccuccgguua

SEQ ID NO: 188989 - RNA, 19 nt, Homo sapiens
gauucucucucccagacuu

SEQ ID NO: 188990 - RNA, 19 nt, Homo sapiens
agaaguuguuuaugaaugg

SEQ ID NO: 188991 - RNA, 19 nt, Homo sapiens
ccacuaaaauuuggaaguu

SEQ ID NO: 188992 - RNA, 19 nt, Homo sapiens
cuuuauugccucugucuua

SEQ ID NO: 188993 - RNA, 19 nt, Homo sapiens
ccacaccacaucaauagau

SEQ ID NO: 188994 - RNA, 19 nt, Homo sapiens
cauuuccacuugaagagaa

SEQ ID NO: 188995 - RNA, 19 nt, Homo sapiens
gcuggaaggaugaaagguu

SEQ ID NO: 188996 - RNA, 19 nt, Homo sapiens
ggauugggagagcguguaa

SEQ ID NO: 188997 - RNA, 19 nt, Homo sapiens
caagaaaaccuuuaacagu

SEQ ID NO: 188998 - RNA, 19 nt, Homo sapiens
aacaguagacucuggaauu

SEQ ID NO: 188999 - RNA, 19 nt, Homo sapiens
ugauugaguuugccacagu

SEQ ID NO: 189000 - RNA, 19 nt, Homo sapiens
gauuggauauugggaagca

SEQ ID NO: 189001 - RNA, 19 nt, Homo sapiens
agcagaaguuguuuaugaa

SEQ ID NO: 189002 - RNA, 19 nt, Homo sapiens
uuaaaggaccuaugacagu

SEQ ID NO: 189003 - RNA, 19 nt, Homo sapiens
uuaaagacaauaccacugu

SEQ ID NO: 189004 - RNA, 19 nt, Homo sapiens
uuuauugccucugucuuaa

SEQ ID NO: 189005 - RNA, 19 nt, Homo sapiens
ucuacugggcuacguauuu

SEQ ID NO: 189006 - RNA, 19 nt, Homo sapiens
uaacagcgccugcguuuuc

SEQ ID NO: 189007 - RNA, 19 nt, Homo sapiens
ggagaauauguuguuauga

SEQ ID NO: 189008 - RNA, 19 nt, Homo sapiens
ggaaguuaugcuuauacaa

SEQ ID NO: 189009 - RNA, 19 nt, Homo sapiens
gauaacauagacaaacagu

SEQ ID NO: 189010 - RNA, 19 nt, Homo sapiens
gugcuaugccuuuguguuc

SEQ ID NO: 189011 - RNA, 19 nt, Homo sapiens
ccacuugaagagaaagauu

SEQ ID NO: 189012 - RNA, 19 nt, Homo sapiens
gguuguagcagaagaugga

SEQ ID NO: 189013 - RNA, 19 nt, Homo sapiens
ggcuacguauuuaaacaga

SEQ ID NO: 189014 - RNA, 19 nt, Homo sapiens
ggucaagcccgaaacaaaa

SEQ ID NO: 189015 - RNA, 19 nt, Homo sapiens
guaugaccuucuuggacaa

SEQ ID NO: 189016 - RNA, 19 nt, Homo sapiens
ugacauagcuuaccaguag

SEQ ID NO: 189017 - RNA, 19 nt, Homo sapiens
ggaagaguguaguaaauga

SEQ ID NO: 189018 - RNA, 19 nt, Homo sapiens
ccaaauaaguugcuucgaa

SEQ ID NO: 189019 - RNA, 19 nt, Homo sapiens
uuacugggcuacauauuua

SEQ ID NO: 189020 - RNA, 19 nt, Homo sapiens
gaaaggagacaauuaaauc

SEQ ID NO: 189021 - RNA, 19 nt, Homo sapiens
caaauaaguugcuucgaau

SEQ ID NO: 189022 - RNA, 19 nt, Homo sapiens
gacaagcucgaaauaauua

SEQ ID NO: 189023 - RNA, 19 nt, Homo sapiens
gauccaacauguacaguau

SEQ ID NO: 189024 - RNA, 19 nt, Homo sapiens
uaacaacuguccuaacaau

SEQ ID NO: 189025 - RNA, 19 nt, Homo sapiens
gaugaauccuuugaaguaa

SEQ ID NO: 189026 - RNA, 19 nt, Homo sapiens
gcucuagguuaaaucaaua

SEQ ID NO: 189027 - RNA, 19 nt, Homo sapiens
cuucagaggucacuuauau

SEQ ID NO: 189028 - RNA, 19 nt, Homo sapiens
caaaguggcuuaugcaacu

SEQ ID NO: 189029 - RNA, 19 nt, Homo sapiens
caaguuucauucuggcuua

SEQ ID NO: 189030 - RNA, 19 nt, Homo sapiens
cagagucccugcuaaugua

SEQ ID NO: 189031 - RNA, 19 nt, Homo sapiens
gaagauaacauugucauuc

SEQ ID NO: 189032 - RNA, 19 nt, Homo sapiens
gccauggacugguuuauug

SEQ ID NO: 189033 - RNA, 19 nt, Homo sapiens
ccugauggcucuagguuaa

SEQ ID NO: 189034 - RNA, 19 nt, Homo sapiens
ggacuuacaaugcaucuga

SEQ ID NO: 189035 - RNA, 19 nt, Homo sapiens
agaaaucaguagcucauaa

SEQ ID NO: 189036 - RNA, 19 nt, Homo sapiens
ccaagaagaugaggcuaaa

SEQ ID NO: 189037 - RNA, 19 nt, Homo sapiens
gaauugagacccauguuau

SEQ ID NO: 189038 - RNA, 19 nt, Homo sapiens
caacuucagaggucacuua

SEQ ID NO: 189039 - RNA, 19 nt, Homo sapiens
ggaaaggagacaauuaaau

SEQ ID NO: 189040 - RNA, 19 nt, Homo sapiens
caacugccauggacugguu

SEQ ID NO: 189041 - RNA, 19 nt, Homo sapiens
ucagaggucacuuauauuu

SEQ ID NO: 189042 - RNA, 19 nt, Homo sapiens
gucauucucucccaaguuu

SEQ ID NO: 189043 - RNA, 19 nt, Homo sapiens
auggaaagaugaacguuua

SEQ ID NO: 189044 - RNA, 19 nt, Homo sapiens
ccuaggaccugauuuaaag

SEQ ID NO: 189045 - RNA, 19 nt, Homo sapiens
gaaaacagccauugccuuu

SEQ ID NO: 189046 - RNA, 19 nt, Homo sapiens
ugagacccauguuaucuuu

SEQ ID NO: 189047 - RNA, 19 nt, Homo sapiens
gacaucagcucuguucaug

SEQ ID NO: 189048 - RNA, 19 nt, Homo sapiens
gcucauucauguccucuga

SEQ ID NO: 189049 - RNA, 19 nt, Homo sapiens
gaaaucaguagcucauaau

SEQ ID NO: 189050 - RNA, 19 nt, Homo sapiens
gaauauccuucgacuaaac

SEQ ID NO: 189051 - RNA, 19 nt, Homo sapiens
gauggaagauaacauuguc

SEQ ID NO: 189052 - RNA, 19 nt, Homo sapiens
gaagaaaucaguagcucau

SEQ ID NO: 189053 - RNA, 19 nt, Homo sapiens
agaugaauccuuugaagua

SEQ ID NO: 189054 - RNA, 19 nt, Homo sapiens
ucauggaacugcagacaga

SEQ ID NO: 189055 - RNA, 19 nt, Homo sapiens
ggagacaugcauuugcuaa

SEQ ID NO: 189056 - RNA, 19 nt, Homo sapiens
caaugcacuuggaggauuu

SEQ ID NO: 189057 - RNA, 19 nt, Homo sapiens
gcaugacaagcucgaaaua

SEQ ID NO: 189058 - RNA, 19 nt, Homo sapiens
ggaccugauuuaaagugaa

SEQ ID NO: 189059 - RNA, 19 nt, Homo sapiens
gaaagcacuccaugcgaaa

SEQ ID NO: 189060 - RNA, 19 nt, Homo sapiens
ggacucugcuguauaccau

SEQ ID NO: 189061 - RNA, 19 nt, Homo sapiens
ggaaagaugaacguuuaaa

SEQ ID NO: 189062 - RNA, 19 nt, Homo sapiens
gaauucugcuugccguuuc

SEQ ID NO: 189063 - RNA, 19 nt, Homo sapiens
ugaauugagacccauguua

SEQ ID NO: 189064 - RNA, 19 nt, Homo sapiens
gaaaaggcuuccguuauga

SEQ ID NO: 189065 - RNA, 19 nt, Homo sapiens
ugacaaugccaaauaaguu

SEQ ID NO: 189066 - RNA, 19 nt, Homo sapiens
ugacaagcucgaaauaauu

SEQ ID NO: 189067 - RNA, 19 nt, Homo sapiens
ccaugaggcuuacaguuca

SEQ ID NO: 189068 - RNA, 19 nt, Homo sapiens
cuauagccauguacauauu

SEQ ID NO: 189069 - RNA, 19 nt, Homo sapiens
uguguucucugcccuaauu

SEQ ID NO: 189070 - RNA, 19 nt, Homo sapiens
caucagcucuguucaugag

SEQ ID NO: 189071 - RNA, 19 nt, Homo sapiens
cauguuaucuuugggaugu

SEQ ID NO: 189072 - RNA, 19 nt, Homo sapiens
cagaauguccagaauaguu

SEQ ID NO: 189073 - RNA, 19 nt, Homo sapiens
ggacugguuuauugcuguu

SEQ ID NO: 189074 - RNA, 19 nt, Homo sapiens
ggaauucucuccccaaagu

SEQ ID NO: 189075 - RNA, 19 nt, Homo sapiens
aguaacaacuguccuaaca

SEQ ID NO: 189076 - RNA, 19 nt, Homo sapiens
aaaccuaucugccuugcau

SEQ ID NO: 189077 - RNA, 19 nt, Homo sapiens
gaccugauuuaaagugaau

SEQ ID NO: 189078 - RNA, 19 nt, Homo sapiens
gcuaauuugugauccaaca

SEQ ID NO: 189079 - RNA, 19 nt, Homo sapiens
augaauauccuucgacuaa

SEQ ID NO: 189080 - RNA, 19 nt, Homo sapiens
gagaauucuugacagacuu

SEQ ID NO: 189081 - RNA, 19 nt, Homo sapiens
caacaucgaguuccugcuu

SEQ ID NO: 189082 - RNA, 19 nt, Homo sapiens
gauaacauugucauuccua

SEQ ID NO: 189083 - RNA, 19 nt, Homo sapiens
ugguuuagcucuuaaguag

SEQ ID NO: 189084 - RNA, 19 nt, Homo sapiens
ggaagauaacauugucauu

SEQ ID NO: 189085 - RNA, 19 nt, Homo sapiens
acaacuguccuaacaauga

SEQ ID NO: 189086 - RNA, 19 nt, Homo sapiens
acaauuaaauccaguacag

SEQ ID NO: 189087 - RNA, 19 nt, Homo sapiens
gaugggacucugcuguaua

SEQ ID NO: 189088 - RNA, 19 nt, Homo sapiens
gacaaugccaaauaaguug

SEQ ID NO: 189089 - RNA, 19 nt, Homo sapiens
uggcuaacauccaagaaga

SEQ ID NO: 189090 - RNA, 19 nt, Homo sapiens
ccaguucucuccaccaucu

SEQ ID NO: 189091 - RNA, 19 nt, Homo sapiens
ugauacagaacaacgcuua

SEQ ID NO: 189092 - RNA, 19 nt, Homo sapiens
cagauacagauauggaaua

SEQ ID NO: 189093 - RNA, 19 nt, Homo sapiens
gcuuaccaguagaccuuua

SEQ ID NO: 189094 - RNA, 19 nt, Homo sapiens
ggucaguccuugaauugag

SEQ ID NO: 189095 - RNA, 19 nt, Homo sapiens
ggcuacauauuuaaacaga

SEQ ID NO: 189096 - RNA, 19 nt, Homo sapiens
agaaaaggcuuccguuaug

SEQ ID NO: 189097 - RNA, 19 nt, Homo sapiens
ugaauauccuucgacuaaa

SEQ ID NO: 189098 - RNA, 19 nt, Homo sapiens
gaccuuuaauggagacaug

SEQ ID NO: 189099 - RNA, 19 nt, Homo sapiens
cgccagaacccaacaagaa

SEQ ID NO: 189100 - RNA, 19 nt, Homo sapiens
ggaguaacaacuguccuaa

SEQ ID NO: 189101 - RNA, 19 nt, Homo sapiens
agaggucacuuauauuugg

SEQ ID NO: 189102 - RNA, 19 nt, Homo sapiens
cuagaugaauccuuugaag

SEQ ID NO: 189103 - RNA, 19 nt, Homo sapiens
gcuuaauuaugauggaaga

SEQ ID NO: 189104 - RNA, 19 nt, Homo sapiens
ccugauuaauuuccuauuc

SEQ ID NO: 189105 - RNA, 19 nt, Homo sapiens
uaucugccuugcaucauga

SEQ ID NO: 189106 - RNA, 19 nt, Homo sapiens
ucggaaaggagacaauuaa

SEQ ID NO: 189107 - RNA, 19 nt, Homo sapiens
acaucuacgugaccaguuu

SEQ ID NO: 189108 - RNA, 19 nt, Homo sapiens
gaagcuugguacacauaag

SEQ ID NO: 189109 - RNA, 19 nt, Homo sapiens
cuaacaaugacaacucuaa

SEQ ID NO: 189110 - RNA, 19 nt, Homo sapiens
ugagucagcccgaaagaug

SEQ ID NO: 189111 - RNA, 19 nt, Homo sapiens
caugacaagcucgaaauaa

SEQ ID NO: 189112 - RNA, 19 nt, Homo sapiens
ggaagcuugguacacauaa

SEQ ID NO: 189113 - RNA, 19 nt, Homo sapiens
gggaagaguguaguaaaug

SEQ ID NO: 189114 - RNA, 19 nt, Homo sapiens
ugggaagaguguaguaaau

SEQ ID NO: 189115 - RNA, 19 nt, Homo sapiens
agaacuguguuuggaguaa

SEQ ID NO: 189116 - RNA, 19 nt, Homo sapiens
gagauaauccggucuagua

SEQ ID NO: 189117 - RNA, 19 nt, Homo sapiens
ccaacaagcugcucagauu

SEQ ID NO: 189118 - RNA, 19 nt, Homo sapiens
acaaugagguuaacaauuc

SEQ ID NO: 189119 - RNA, 19 nt, Homo sapiens
gaugaaagacugaaauuug

SEQ ID NO: 189120 - RNA, 19 nt, Homo sapiens
gaacaaauccguggaagug

SEQ ID NO: 189121 - RNA, 19 nt, Homo sapiens
agaaaucaguggcucauaa

SEQ ID NO: 189122 - RNA, 19 nt, Homo sapiens
ugacugaagugaagacuga

SEQ ID NO: 189123 - RNA, 19 nt, Homo sapiens
acaagucacuguuacauga

SEQ ID NO: 189124 - RNA, 19 nt, Homo sapiens
caacggaacccuccucuau

SEQ ID NO: 189125 - RNA, 19 nt, Homo sapiens
gaaauuccuuaccuaaagu

SEQ ID NO: 189126 - RNA, 19 nt, Homo sapiens
cagcugaagugguuuauuc

SEQ ID NO: 189127 - RNA, 19 nt, Homo sapiens
ugacagcacugacaacauc

SEQ ID NO: 189128 - RNA, 19 nt, Homo sapiens
uacaacagcugaagugguu

SEQ ID NO: 189129 - RNA, 19 nt, Homo sapiens
gugcaugccugcccacuga

SEQ ID NO: 189130 - RNA, 19 nt, Homo sapiens
gcacugacaacaucacuau

SEQ ID NO: 189131 - RNA, 19 nt, Homo sapiens
gagaauaugucgucaugac

SEQ ID NO: 189132 - RNA, 19 nt, Homo sapiens
cgacugagaccaagaccua

SEQ ID NO: 189133 - RNA, 19 nt, Homo sapiens
gaacccuccucuauacaau

SEQ ID NO: 189134 - RNA, 19 nt, Homo sapiens
gacauggaguacacuauug

SEQ ID NO: 189135 - RNA, 19 nt, Homo sapiens
agaaauuccuuaccuaaag

SEQ ID NO: 189136 - RNA, 19 nt, Homo sapiens
caacagcugaagugguuua

SEQ ID NO: 189137 - RNA, 19 nt, Homo sapiens
ccaaguuugugccuaagaa

SEQ ID NO: 189138 - RNA, 19 nt, Homo sapiens
gcaaccagagcacuguaua

SEQ ID NO: 189139 - RNA, 19 nt, Homo sapiens
ggaaucaagacgacaagaa

SEQ ID NO: 189140 - RNA, 19 nt, Homo sapiens
ccagaaauuccuuaccuaa

SEQ ID NO: 189141 - RNA, 19 nt, Homo sapiens
gaagugguuuauucuugga

SEQ ID NO: 189142 - RNA, 19 nt, Homo sapiens
cagaggcccuggagaugaa

SEQ ID NO: 189143 - RNA, 19 nt, Homo sapiens
gccagaaauuccuuaccua

SEQ ID NO: 189144 - RNA, 19 nt, Homo sapiens
gauaaucacacaaacaagu

SEQ ID NO: 189145 - RNA, 19 nt, Homo sapiens
ggccaaggacacugaauuu

SEQ ID NO: 189146 - RNA, 19 nt, Homo sapiens
gaguaucagugccagaaau

SEQ ID NO: 189147 - RNA, 19 nt, Homo sapiens
gaaagacugaaauuugaug

SEQ ID NO: 189148 - RNA, 19 nt, Homo sapiens
acaaucuccuggcuaguaa

SEQ ID NO: 189149 - RNA, 19 nt, Homo sapiens
aaaauuggcuacuuuguga

SEQ ID NO: 189150 - RNA, 19 nt, Homo sapiens
gaaccaguaugaccuuuug

SEQ ID NO: 189151 - RNA, 19 nt, Homo sapiens
ccaugcauuuggaagauuu

SEQ ID NO: 189152 - RNA, 19 nt, Homo sapiens
caucuuuccugugcucuuu

SEQ ID NO: 189153 - RNA, 19 nt, Homo sapiens
cgacggccauggacugguu

SEQ ID NO: 189154 - RNA, 19 nt, Homo sapiens
uuucugcacugauugaauu

SEQ ID NO: 189155 - RNA, 19 nt, Homo sapiens
cugaagugguuuauucuug

SEQ ID NO: 189156 - RNA, 19 nt, Homo sapiens
cauauucaaucuggucuau

SEQ ID NO: 189157 - RNA, 19 nt, Homo sapiens
ccaucaaccuggccaagga

SEQ ID NO: 189158 - RNA, 19 nt, Homo sapiens
caggaugguucucgcuuga

SEQ ID NO: 189159 - RNA, 19 nt, Homo sapiens
ugacauggaguacacuauu

SEQ ID NO: 189160 - RNA, 19 nt, Homo sapiens
gggauucuuuuccugauua

SEQ ID NO: 189161 - RNA, 19 nt, Homo sapiens
cagaaauuccuuaccuaaa

SEQ ID NO: 189162 - RNA, 19 nt, Homo sapiens
caaugagguuaacaauuca

SEQ ID NO: 189163 - RNA, 19 nt, Homo sapiens
ggaacccuccucuauacaa

SEQ ID NO: 189164 - RNA, 19 nt, Homo sapiens
caacaagcugcucagauug

SEQ ID NO: 189165 - RNA, 19 nt, Homo sapiens
cagcaagguugacaaaauu

SEQ ID NO: 189166 - RNA, 19 nt, Homo sapiens
ucuccaaguuugugccuaa

SEQ ID NO: 189167 - RNA, 19 nt, Homo sapiens
gaccaagaccuacaacagu

SEQ ID NO: 189168 - RNA, 19 nt, Homo sapiens
acaucuacgugaccaguuu

SEQ ID NO: 189169 - RNA, 19 nt, Homo sapiens
agaccuacuugccauguau

SEQ ID NO: 189170 - RNA, 19 nt, Homo sapiens
gacaacaucacuaucuuca

SEQ ID NO: 189171 - RNA, 19 nt, Homo sapiens
caggacagcccgacugaga

SEQ ID NO: 189172 - RNA, 19 nt, Homo sapiens
cgucuguuaugccuuugua

SEQ ID NO: 189173 - RNA, 19 nt, Homo sapiens
gcacuaccuucaacaucgu

SEQ ID NO: 189174 - RNA, 19 nt, Homo sapiens
gcaaagaaaaccagcacua

SEQ ID NO: 189175 - RNA, 19 nt, Homo sapiens
aggagaauaugucgucaug

SEQ ID NO: 189176 - RNA, 19 nt, Homo sapiens
gaagcuaugccuauacaac

SEQ ID NO: 189177 - RNA, 19 nt, Homo sapiens
ccacugugcuuaccaugac

SEQ ID NO: 189178 - RNA, 19 nt, Homo sapiens
gaaaucaguggcucauaac

SEQ ID NO: 189179 - RNA, 19 nt, Homo sapiens
ggacaccuucuuccacaau

SEQ ID NO: 189180 - RNA, 19 nt, Homo sapiens
gaaucaagacgacaagaac

SEQ ID NO: 189181 - RNA, 19 nt, Homo sapiens
gcaugauccgcaaacagua

SEQ ID NO: 189182 - RNA, 19 nt, Homo sapiens
cccuggagaugaagaagaa

SEQ ID NO: 189183 - RNA, 19 nt, Homo sapiens
ggacaccggacaccuucuu

SEQ ID NO: 189184 - RNA, 19 nt, Homo sapiens
uugccacugucaacuauuu

SEQ ID NO: 189185 - RNA, 19 nt, Homo sapiens
ugauugaauuugccacugu

SEQ ID NO: 189186 - RNA, 19 nt, Homo sapiens
cagaccuacuugccaugua

SEQ ID NO: 189187 - RNA, 19 nt, Homo sapiens
gcucuuugccauauucaau

SEQ ID NO: 189188 - RNA, 19 nt, Homo sapiens
uuuggaagcuaugccuaua

SEQ ID NO: 189189 - RNA, 19 nt, Homo sapiens
uaucuucaccagaaucuug

SEQ ID NO: 189190 - RNA, 19 nt, Homo sapiens
acaacccacuuccaucuca

SEQ ID NO: 189191 - RNA, 19 nt, Homo sapiens
uggaagcuaugccuauaca

SEQ ID NO: 189192 - RNA, 19 nt, Homo sapiens
ccacugaaguuuggaagcu

SEQ ID NO: 189193 - RNA, 19 nt, Homo sapiens
ggcaugauccgcaaacagu

SEQ ID NO: 189194 - RNA, 19 nt, Homo sapiens
gacaaaauuucccgcauca

SEQ ID NO: 189195 - RNA, 19 nt, Homo sapiens
uaccuaaaguggcauaugc

SEQ ID NO: 189196 - RNA, 19 nt, Homo sapiens
gucauucugucacaagugu

SEQ ID NO: 189197 - RNA, 19 nt, Homo sapiens
caacccacuuccaucucaa

SEQ ID NO: 189198 - RNA, 19 nt, Homo sapiens
cugagugucccaugcauuu

SEQ ID NO: 189199 - RNA, 19 nt, Homo sapiens
gcuuggagaugcagugacu

SEQ ID NO: 189200 - RNA, 19 nt, Homo sapiens
caacagugucagcaagguu

SEQ ID NO: 189201 - RNA, 19 nt, Homo sapiens
aaucuuggaucgucuucug

SEQ ID NO: 189202 - RNA, 19 nt, Homo sapiens
gaugacagcacugacaaca

SEQ ID NO: 189203 - RNA, 19 nt, Homo sapiens
gauaguggcagugcagcaa

SEQ ID NO: 189204 - RNA, 19 nt, Homo sapiens
ccugugcucuuugccauau

SEQ ID NO: 189205 - RNA, 19 nt, Homo sapiens
ggucuaguacaggagaaua

SEQ ID NO: 189206 - RNA, 19 nt, Homo sapiens
gauaauccggucuaguaca

SEQ ID NO: 189207 - RNA, 19 nt, Homo sapiens
aaagaacaaauccguggaa

SEQ ID NO: 189208 - RNA, 19 nt, Homo sapiens
gacaccuucuuccacaaug

SEQ ID NO: 189209 - RNA, 19 nt, Homo sapiens
gaagugaagacugacaucu

SEQ ID NO: 189210 - RNA, 19 nt, Homo sapiens
ucacuaucuucaccagaau

SEQ ID NO: 189211 - RNA, 19 nt, Homo sapiens
gauccgcaaacaguagaua

SEQ ID NO: 189212 - RNA, 19 nt, Homo sapiens
gaccaccuaucccaucaac

SEQ ID NO: 189213 - RNA, 19 nt, Homo sapiens
acggaacccuccucuauac

SEQ ID NO: 189214 - RNA, 19 nt, Homo sapiens
aacaaucuccuggcuagua

SEQ ID NO: 189215 - RNA, 19 nt, Homo sapiens
acacugacauggaguacac

SEQ ID NO: 189216 - RNA, 19 nt, Homo sapiens
guucauagcugucugcuuu

SEQ ID NO: 189217 - RNA, 19 nt, Homo sapiens
gaacaggcuugaaguaugg

SEQ ID NO: 189218 - RNA, 19 nt, Homo sapiens
ggauaaagaccacaguuaa

SEQ ID NO: 189219 - RNA, 19 nt, Homo sapiens
agaaaucugucucacauaa

SEQ ID NO: 189220 - RNA, 19 nt, Homo sapiens
gaaauggaauacacaaugg

SEQ ID NO: 189221 - RNA, 19 nt, Homo sapiens
gaucaagacugcagaggau

SEQ ID NO: 189222 - RNA, 19 nt, Homo sapiens
aaaugcagcugaaaccaua

SEQ ID NO: 189223 - RNA, 19 nt, Homo sapiens
gacggaagauggguuauuu

SEQ ID NO: 189224 - RNA, 19 nt, Homo sapiens
gagaaauugugcacagaaa

SEQ ID NO: 189225 - RNA, 19 nt, Homo sapiens
aagcaaaucuuccacaguu

SEQ ID NO: 189226 - RNA, 19 nt, Homo sapiens
ggagaaaucagaaagucua

SEQ ID NO: 189227 - RNA, 19 nt, Homo sapiens
gaccacaguuaauaccaua

SEQ ID NO: 189228 - RNA, 19 nt, Homo sapiens
gaacugaggugggaaacca

SEQ ID NO: 189229 - RNA, 19 nt, Homo sapiens
gaagauggguuauuuuaug

SEQ ID NO: 189230 - RNA, 19 nt, Homo sapiens
gaaaucagaaagucuaaug

SEQ ID NO: 189231 - RNA, 19 nt, Homo sapiens
gggaaaccauucaagcaaa

SEQ ID NO: 189232 - RNA, 19 nt, Homo sapiens
ggucaugcaugcccuuuga

SEQ ID NO: 189233 - RNA, 19 nt, Homo sapiens
aaagaaaucugucucacau

SEQ ID NO: 189234 - RNA, 19 nt, Homo sapiens
acaguuugcucgaugguua

SEQ ID NO: 189235 - RNA, 19 nt, Homo sapiens
ggaaaccauucaagcaaau

SEQ ID NO: 189236 - RNA, 19 nt, Homo sapiens
uauauuccgugcauuauga

SEQ ID NO: 189237 - RNA, 19 nt, Homo sapiens
ugacagugauucuuucuca

SEQ ID NO: 189238 - RNA, 19 nt, Homo sapiens
gaaagaaaucugucucaca

SEQ ID NO: 189239 - RNA, 19 nt, Homo sapiens
gggcgaauauauuguuaug

SEQ ID NO: 189240 - RNA, 19 nt, Homo sapiens
gacaaaagguccugagaaa

SEQ ID NO: 189241 - RNA, 19 nt, Homo sapiens
ggaguuaugccuauccaaa

SEQ ID NO: 189242 - RNA, 19 nt, Homo sapiens
ggacauaugccucgaaagg

SEQ ID NO: 189243 - RNA, 19 nt, Homo sapiens
caaaccguaucaagugaaa

SEQ ID NO: 189244 - RNA, 19 nt, Homo sapiens
ugagaaaucaguugaaguu

SEQ ID NO: 189245 - RNA, 19 nt, Homo sapiens
aaccauaucugcagcaaga

SEQ ID NO: 189246 - RNA, 19 nt, Homo sapiens
gcgaauauauuguuaugac

SEQ ID NO: 189247 - RNA, 19 nt, Homo sapiens
gauacuuucuucaggaaug

SEQ ID NO: 189248 - RNA, 19 nt, Homo sapiens
gauaaagaccacaguuaau

SEQ ID NO: 189249 - RNA, 19 nt, Homo sapiens
gugauucuuucucaaguuu

SEQ ID NO: 189250 - RNA, 19 nt, Homo sapiens
gugaaaccaucaaaucaau

SEQ ID NO: 189251 - RNA, 19 nt, Homo sapiens
ugaacaggcuugaaguaug

SEQ ID NO: 189252 - RNA, 19 nt, Homo sapiens
cagcuuaguucaauaugau

SEQ ID NO: 189253 - RNA, 19 nt, Homo sapiens
uaugacagcuccaaauaag

SEQ ID NO: 189254 - RNA, 19 nt, Homo sapiens
ucgaaaggcuucaguugga

SEQ ID NO: 189255 - RNA, 19 nt, Homo sapiens
uauccgaacuggacauaug

SEQ ID NO: 189256 - RNA, 19 nt, Homo sapiens
gaaaccauaucugcagcaa

SEQ ID NO: 189257 - RNA, 19 nt, Homo sapiens
ucaccaauauucaaaugga

SEQ ID NO: 189258 - RNA, 19 nt, Homo sapiens
caagugaaaccaucaaauc

SEQ ID NO: 189259 - RNA, 19 nt, Homo sapiens
gggcaaaccguaucaagug

SEQ ID NO: 189260 - RNA, 19 nt, Homo sapiens
cguauucucuuuccaguca

SEQ ID NO: 189261 - RNA, 19 nt, Homo sapiens
uaacaacuguccucaccau

SEQ ID NO: 189262 - RNA, 19 nt, Homo sapiens
acaauaugaugguaacgaa

SEQ ID NO: 189263 - RNA, 19 nt, Homo sapiens
uaaggacacuauggagaaa

SEQ ID NO: 189264 - RNA, 19 nt, Homo sapiens
gcacaccucggucuuacuu

SEQ ID NO: 189265 - RNA, 19 nt, Homo sapiens
ggagaaauugugcacagaa

SEQ ID NO: 189266 - RNA, 19 nt, Homo sapiens
ggcaaaccguaucaaguga

SEQ ID NO: 189267 - RNA, 19 nt, Homo sapiens
ccacaguuguucaagaauc

SEQ ID NO: 189268 - RNA, 19 nt, Homo sapiens
gccauggacugguucauag

SEQ ID NO: 189269 - RNA, 19 nt, Homo sapiens
aauaugacagcuccaaaua

SEQ ID NO: 189270 - RNA, 19 nt, Homo sapiens
cuucaggaauggaaagaaa

SEQ ID NO: 189271 - RNA, 19 nt, Homo sapiens
ugaaauggaauacacaaug

SEQ ID NO: 189272 - RNA, 19 nt, Homo sapiens
ccagcuuaguucaauauga

SEQ ID NO: 189273 - RNA, 19 nt, Homo sapiens
ggaauggaaagaaaucugu

SEQ ID NO: 189274 - RNA, 19 nt, Homo sapiens
uugcugcugucaacuauuu

SEQ ID NO: 189275 - RNA, 19 nt, Homo sapiens
ccaugagauugguggauuu

SEQ ID NO: 189276 - RNA, 19 nt, Homo sapiens
ggaccuguuucugauguug

SEQ ID NO: 189277 - RNA, 19 nt, Homo sapiens
gggcauuuaacaugguuua

SEQ ID NO: 189278 - RNA, 19 nt, Homo sapiens
ucacguguuuggaucaaga

SEQ ID NO: 189279 - RNA, 19 nt, Homo sapiens
gcaaaucuuccacaguugu

SEQ ID NO: 189280 - RNA, 19 nt, Homo sapiens
gcagacauggauugacaaa

SEQ ID NO: 189281 - RNA, 19 nt, Homo sapiens
gagaaaucagaaagucuaa

SEQ ID NO: 189282 - RNA, 19 nt, Homo sapiens
caauuacgggcgaauauau

SEQ ID NO: 189283 - RNA, 19 nt, Homo sapiens
uuacagaagugaaaacuga

SEQ ID NO: 189284 - RNA, 19 nt, Homo sapiens
ucaguuggaucugcuucua

SEQ ID NO: 189285 - RNA, 19 nt, Homo sapiens
gaaaucugucucacauaau

SEQ ID NO: 189286 - RNA, 19 nt, Homo sapiens
ccaauuugaacaugagaaa

SEQ ID NO: 189287 - RNA, 19 nt, Homo sapiens
cuaaggacacuauggagaa

SEQ ID NO: 189288 - RNA, 19 nt, Homo sapiens
ucaauuacgggcgaauaua

SEQ ID NO: 189289 - RNA, 19 nt, Homo sapiens
gauucuuucucaaguuuca

SEQ ID NO: 189290 - RNA, 19 nt, Homo sapiens
caguugaaguuccgaagga

SEQ ID NO: 189291 - RNA, 19 nt, Homo sapiens
ugucaacuauuucaccaau

SEQ ID NO: 189292 - RNA, 19 nt, Homo sapiens
ucagacggaagauggguua

SEQ ID NO: 189293 - RNA, 19 nt, Homo sapiens
gcaaaccguaucaagugaa

SEQ ID NO: 189294 - RNA, 19 nt, Homo sapiens
aggauaaagaccacaguua

SEQ ID NO: 189295 - RNA, 19 nt, Homo sapiens
gaggauaaagaccacaguu

SEQ ID NO: 189296 - RNA, 19 nt, Homo sapiens
ucaagacugcagaggauaa

SEQ ID NO: 189297 - RNA, 19 nt, Homo sapiens
cuugaaguauggcauguug

SEQ ID NO: 189298 - RNA, 19 nt, Homo sapiens
cgaguuugcugcugucaac

SEQ ID NO: 189299 - RNA, 19 nt, Homo sapiens
caacuguccucaccaugac

SEQ ID NO: 189300 - RNA, 19 nt, Homo sapiens
caaaagguccugagaaauc

SEQ ID NO: 189301 - RNA, 19 nt, Homo sapiens
gcaagagcacuuccaucug

SEQ ID NO: 189302 - RNA, 19 nt, Homo sapiens
gcuuuggaccuguuucuga

SEQ ID NO: 189303 - RNA, 19 nt, Homo sapiens
gacagugauucuuucucaa

SEQ ID NO: 189304 - RNA, 19 nt, Homo sapiens
uaauaugacagcuccaaau

SEQ ID NO: 189305 - RNA, 19 nt, Homo sapiens
aggcagacauggauugaca

SEQ ID NO: 189306 - RNA, 19 nt, Homo sapiens
caauggauguguucuucag

SEQ ID NO: 189307 - RNA, 19 nt, Homo sapiens
caccauaagugcggagugu

SEQ ID NO: 189308 - RNA, 19 nt, Homo sapiens
ugaacaauaugaugguaac

SEQ ID NO: 189309 - RNA, 19 nt, Homo sapiens
uauggcauguugcaaagau

SEQ ID NO: 189310 - RNA, 19 nt, Homo sapiens
uaaagaccacaguuaauac

SEQ ID NO: 189311 - RNA, 19 nt, Homo sapiens
gcacuuccaucugcuucuc

SEQ ID NO: 189312 - RNA, 19 nt, Homo sapiens
gcucgaugguuaugacaac

SEQ ID NO: 189313 - RNA, 19 nt, Homo sapiens
caccaauauucaaauggaa

SEQ ID NO: 189314 - RNA, 19 nt, Homo sapiens
cugcuuugcuuuuguauuu

SEQ ID NO: 189315 - RNA, 19 nt, Homo sapiens
ugaccgccauggacugguu

SEQ ID NO: 189316 - RNA, 19 nt, Homo sapiens
gaagauggcuccagacuga

SEQ ID NO: 189317 - RNA, 19 nt, Homo sapiens
cgacaaagcuggaaagaug

SEQ ID NO: 189318 - RNA, 19 nt, Homo sapiens
gaggaaacuuggacauuua

SEQ ID NO: 189319 - RNA, 19 nt, Homo sapiens
gaacuuauccagucacuuu

SEQ ID NO: 189320 - RNA, 19 nt, Homo sapiens
gaagaguuauuccuccaua

SEQ ID NO: 189321 - RNA, 19 nt, Homo sapiens
gaugaaaggcuucgguuua

SEQ ID NO: 189322 - RNA, 19 nt, Homo sapiens
guucggcacuuucaacuua

SEQ ID NO: 189323 - RNA, 19 nt, Homo sapiens
aaacagagaucauaaagag

SEQ ID NO: 189324 - RNA, 19 nt, Homo sapiens
ucagaaagcuucaagaaca

SEQ ID NO: 189325 - RNA, 19 nt, Homo sapiens
caagaugucccauugauaa

SEQ ID NO: 189326 - RNA, 19 nt, Homo sapiens
gaaaguacuugcaugaucu

SEQ ID NO: 189327 - RNA, 19 nt, Homo sapiens
ggaaaguacuugcaugauc

SEQ ID NO: 189328 - RNA, 19 nt, Homo sapiens
aggaaacucuccaugauua

SEQ ID NO: 189329 - RNA, 19 nt, Homo sapiens
gacaacaucacgauauuua

SEQ ID NO: 189330 - RNA, 19 nt, Homo sapiens
gcagggacgucgaauacaa

SEQ ID NO: 189331 - RNA, 19 nt, Homo sapiens
ccaacuauauugcgagaaa

SEQ ID NO: 189332 - RNA, 19 nt, Homo sapiens
ugaggaaacuuggacauuu

SEQ ID NO: 189333 - RNA, 19 nt, Homo sapiens
ggaacucucugcccaaagu

SEQ ID NO: 189334 - RNA, 19 nt, Homo sapiens
gaauacaaccucagucuca

SEQ ID NO: 189335 - RNA, 19 nt, Homo sapiens
caacuacuauucuuauugg

SEQ ID NO: 189336 - RNA, 19 nt, Homo sapiens
gaaauuaggaaaguacuug

SEQ ID NO: 189337 - RNA, 19 nt, Homo sapiens
cauaaugaccgugaucuua

SEQ ID NO: 189338 - RNA, 19 nt, Homo sapiens
gaucuuggaugggcucuug

SEQ ID NO: 189339 - RNA, 19 nt, Homo sapiens
ugaaagaugagaccaauga

SEQ ID NO: 189340 - RNA, 19 nt, Homo sapiens
ggaguagcuugcuggcuuu

SEQ ID NO: 189341 - RNA, 19 nt, Homo sapiens
guacuugcaugaucuuaca

SEQ ID NO: 189342 - RNA, 19 nt, Homo sapiens
gaaacagagaucauaaaga

SEQ ID NO: 189343 - RNA, 19 nt, Homo sapiens
caaccucagucucaguaaa

SEQ ID NO: 189344 - RNA, 19 nt, Homo sapiens
uaccuucccugcauaauga

SEQ ID NO: 189345 - RNA, 19 nt, Homo sapiens
guccaucgcucacaacaug

SEQ ID NO: 189346 - RNA, 19 nt, Homo sapiens
gagaaacagagaucauaaa

SEQ ID NO: 189347 - RNA, 19 nt, Homo sapiens
uggagaaacuucagcagaa

SEQ ID NO: 189348 - RNA, 19 nt, Homo sapiens
gaucauaaagagcacguuu

SEQ ID NO: 189349 - RNA, 19 nt, Homo sapiens
acacucagaugcccaguau

SEQ ID NO: 189350 - RNA, 19 nt, Homo sapiens
gaugucccauugauaauuc

SEQ ID NO: 189351 - RNA, 19 nt, Homo sapiens
ggaauguucucugguuuua

SEQ ID NO: 189352 - RNA, 19 nt, Homo sapiens
cuaaauaagucaacaaacg

SEQ ID NO: 189353 - RNA, 19 nt, Homo sapiens
cgugaagucauacuaaaua

SEQ ID NO: 189354 - RNA, 19 nt, Homo sapiens
aaaggaagauuggcuacuu

SEQ ID NO: 189355 - RNA, 19 nt, Homo sapiens
gcgagaaacagagaucaua

SEQ ID NO: 189356 - RNA, 19 nt, Homo sapiens
uagaagaccaacuauauug

SEQ ID NO: 189357 - RNA, 19 nt, Homo sapiens
gaaauagaauaggcaaacu

SEQ ID NO: 189358 - RNA, 19 nt, Homo sapiens
gaaacucuccaugauuauu

SEQ ID NO: 189359 - RNA, 19 nt, Homo sapiens
ucagaugcccaguaucaua

SEQ ID NO: 189360 - RNA, 19 nt, Homo sapiens
cagaaagcuucaagaacaa

SEQ ID NO: 189361 - RNA, 19 nt, Homo sapiens
gaauagggagccggugaua

SEQ ID NO: 189362 - RNA, 19 nt, Homo sapiens
guaggcagauuaauaacag

SEQ ID NO: 189363 - RNA, 19 nt, Homo sapiens
guagcuugcuggcuuugaa

SEQ ID NO: 189364 - RNA, 19 nt, Homo sapiens
ucacagggacucuccauau

SEQ ID NO: 189365 - RNA, 19 nt, Homo sapiens
gaccuaccuucccugcaua

SEQ ID NO: 189366 - RNA, 19 nt, Homo sapiens
ggagaagggaagaguuauu

SEQ ID NO: 189367 - RNA, 19 nt, Homo sapiens
cgagaaacagagaucauaa

SEQ ID NO: 189368 - RNA, 19 nt, Homo sapiens
ucaauuacuuuaccaagag

SEQ ID NO: 189369 - RNA, 19 nt, Homo sapiens
gucaauuacuuuaccaaga

SEQ ID NO: 189370 - RNA, 19 nt, Homo sapiens
gcagcuaugcguacccuaa

SEQ ID NO: 189371 - RNA, 19 nt, Homo sapiens
caaaaugucccgaaucgua

SEQ ID NO: 189372 - RNA, 19 nt, Homo sapiens
ucucggcgcugauagaguu

SEQ ID NO: 189373 - RNA, 19 nt, Homo sapiens
gccauggacugguucauag

SEQ ID NO: 189374 - RNA, 19 nt, Homo sapiens
aagauuggcuacuuuguca

SEQ ID NO: 189375 - RNA, 19 nt, Homo sapiens
ccaugcagcuugaggacuu

SEQ ID NO: 189376 - RNA, 19 nt, Homo sapiens
ucacagaugccaaccaguu

SEQ ID NO: 189377 - RNA, 19 nt, Homo sapiens
cuucagauguuuccaagau

SEQ ID NO: 189378 - RNA, 19 nt, Homo sapiens
gaaccaguaccaccugaug

SEQ ID NO: 189379 - RNA, 19 nt, Homo sapiens
augaaaggcuucgguuuaa

SEQ ID NO: 189380 - RNA, 19 nt, Homo sapiens
uuaggaaacucuccaugau

SEQ ID NO: 189381 - RNA, 19 nt, Homo sapiens
aauauugccuugauguuuc

SEQ ID NO: 189382 - RNA, 19 nt, Homo sapiens
uuacaacaguaucagcaaa

SEQ ID NO: 189383 - RNA, 19 nt, Homo sapiens
gaagauuggcuacuuuguc

SEQ ID NO: 189384 - RNA, 19 nt, Homo sapiens
ccaagaugucccauugaua

SEQ ID NO: 189385 - RNA, 19 nt, Homo sapiens
gagaagggaagaguuauuc

SEQ ID NO: 189386 - RNA, 19 nt, Homo sapiens
guucugaaauuaggaaagu

SEQ ID NO: 189387 - RNA, 19 nt, Homo sapiens
ucagauguuuccaagaugu

SEQ ID NO: 189388 - RNA, 19 nt, Homo sapiens
cacagggacucuccauaug

SEQ ID NO: 189389 - RNA, 19 nt, Homo sapiens
aaggaagauuggcuacuuu

SEQ ID NO: 189390 - RNA, 19 nt, Homo sapiens
ucaccugcuucaacuacua

SEQ ID NO: 189391 - RNA, 19 nt, Homo sapiens
guauuuccaugaacuuauc

SEQ ID NO: 189392 - RNA, 19 nt, Homo sapiens
ggagaaacuucagcagaac

SEQ ID NO: 189393 - RNA, 19 nt, Homo sapiens
auagggagccggugauaaa

SEQ ID NO: 189394 - RNA, 19 nt, Homo sapiens
caggaacucucugcccaaa

SEQ ID NO: 189395 - RNA, 19 nt, Homo sapiens
gaaaggcuucgguuuaagg

SEQ ID NO: 189396 - RNA, 19 nt, Homo sapiens
aauggaauguucucugguu

SEQ ID NO: 189397 - RNA, 19 nt, Homo sapiens
gggaauggacaauggaaug

SEQ ID NO: 189398 - RNA, 19 nt, Homo sapiens
gccuugauguuucuauaug

SEQ ID NO: 189399 - RNA, 19 nt, Homo sapiens
cagcaaaauugacaaaaug

SEQ ID NO: 189400 - RNA, 19 nt, Homo sapiens
gcagagagaggaguagcuu

SEQ ID NO: 189401 - RNA, 19 nt, Homo sapiens
uuuccaagaugucccauug

SEQ ID NO: 189402 - RNA, 19 nt, Homo sapiens
cagggacucuccauaugug

SEQ ID NO: 189403 - RNA, 19 nt, Homo sapiens
ggaaacucuccaugauuau

SEQ ID NO: 189404 - RNA, 19 nt, Homo sapiens
caauuacuuuaccaagaga

SEQ ID NO: 189405 - RNA, 19 nt, Homo sapiens
ccaccgccauggacugguu

SEQ ID NO: 189406 - RNA, 19 nt, Homo sapiens
uaaugaccgugaucuuauc

SEQ ID NO: 189407 - RNA, 19 nt, Homo sapiens
gcacaggcgaauacacaau

SEQ ID NO: 189408 - RNA, 19 nt, Homo sapiens
agaaguccaucgcucacaa

SEQ ID NO: 189409 - RNA, 19 nt, Homo sapiens
acacgaagaaauagaauag

SEQ ID NO: 189410 - RNA, 19 nt, Homo sapiens
ggaauggacaauggaaugu

SEQ ID NO: 189411 - RNA, 19 nt, Homo sapiens
gcacccugcucuacaccau

SEQ ID NO: 189412 - RNA, 19 nt, Homo sapiens
caucauauguuagauacac

SEQ ID NO: 189413 - RNA, 19 nt, Homo sapiens
uaggaaaguacuugcauga

SEQ ID NO: 189414 - RNA, 19 nt, Homo sapiens
ucaagaacaagcuggagaa

SEQ ID NO: 189415 - RNA, 19 nt, Homo sapiens
gaagcagccaagaucaaga

SEQ ID NO: 189416 - RNA, 19 nt, Homo sapiens
guucauagcuguuugcuuu

SEQ ID NO: 189417 - RNA, 19 nt, Homo sapiens
gaugagagguugaaguuug

SEQ ID NO: 189418 - RNA, 19 nt, Homo sapiens
uaacacaggugaauacguu

SEQ ID NO: 189419 - RNA, 19 nt, Homo sapiens
gauauacacuccuugcauu

SEQ ID NO: 189420 - RNA, 19 nt, Homo sapiens
cgaauucucuucccaguug

SEQ ID NO: 189421 - RNA, 19 nt, Homo sapiens
caacugagauucugagucu

SEQ ID NO: 189422 - RNA, 19 nt, Homo sapiens
ccaaauaucaucugaagaa

SEQ ID NO: 189423 - RNA, 19 nt, Homo sapiens
gagcuaugcuuaucccaaa

SEQ ID NO: 189424 - RNA, 19 nt, Homo sapiens
caugacaacuccuaauaaa

SEQ ID NO: 189425 - RNA, 19 nt, Homo sapiens
ggacaaacaguaucuagug

SEQ ID NO: 189426 - RNA, 19 nt, Homo sapiens
gacaaacaguaucuaguga

SEQ ID NO: 189427 - RNA, 19 nt, Homo sapiens
caaacaguaucuagugaga

SEQ ID NO: 189428 - RNA, 19 nt, Homo sapiens
caaccugaauucuauaagu

SEQ ID NO: 189429 - RNA, 19 nt, Homo sapiens
gaacaugaaaucaaauugg

SEQ ID NO: 189430 - RNA, 19 nt, Homo sapiens
cacgagagcgcccaucuua

SEQ ID NO: 189431 - RNA, 19 nt, Homo sapiens
cuucaagccuucuccagua

SEQ ID NO: 189432 - RNA, 19 nt, Homo sapiens
ccaugaggcugguuaacuu

SEQ ID NO: 189433 - RNA, 19 nt, Homo sapiens
caacuugcuugaaggcuau

SEQ ID NO: 189434 - RNA, 19 nt, Homo sapiens
gaugggcuacuucaugaua

SEQ ID NO: 189435 - RNA, 19 nt, Homo sapiens
aagaugggcuacuucauga

SEQ ID NO: 189436 - RNA, 19 nt, Homo sapiens
ccacugccauggauugguu

SEQ ID NO: 189437 - RNA, 19 nt, Homo sapiens
gguaguuuaucuuuccaaa

SEQ ID NO: 189438 - RNA, 19 nt, Homo sapiens
ccaugaggcuuaccaucaa

SEQ ID NO: 189439 - RNA, 19 nt, Homo sapiens
gauucaaccuuguguacug

SEQ ID NO: 189440 - RNA, 19 nt, Homo sapiens
aaaggaagaugggcuacuu

SEQ ID NO: 189441 - RNA, 19 nt, Homo sapiens
ggacaaccugaauucuaua

SEQ ID NO: 189442 - RNA, 19 nt, Homo sapiens
guucgcagcugucaacuac

SEQ ID NO: 189443 - RNA, 19 nt, Homo sapiens
caagccuucuccaguauga

SEQ ID NO: 189444 - RNA, 19 nt, Homo sapiens
ugucuuccauuguucagua

SEQ ID NO: 189445 - RNA, 19 nt, Homo sapiens
ggugaauacguuauaauga

SEQ ID NO: 189446 - RNA, 19 nt, Homo sapiens
guccauugcucacaacaug

SEQ ID NO: 189447 - RNA, 19 nt, Homo sapiens
guaagcaugugugggcaaa

SEQ ID NO: 189448 - RNA, 19 nt, Homo sapiens
gcgcccaucuuacaaucaa

SEQ ID NO: 189449 - RNA, 19 nt, Homo sapiens
gaucacuucucugucuuug

SEQ ID NO: 189450 - RNA, 19 nt, Homo sapiens
uuaccaaucuucagacaca

SEQ ID NO: 189451 - RNA, 19 nt, Homo sapiens
caguagaagucccagaaga

SEQ ID NO: 189452 - RNA, 19 nt, Homo sapiens
ccuaauaaacucuucagaa

SEQ ID NO: 189453 - RNA, 19 nt, Homo sapiens
gaaaaggaaggcacaguuu

SEQ ID NO: 189454 - RNA, 19 nt, Homo sapiens
caacuacuuuaccaaucuu

SEQ ID NO: 189455 - RNA, 19 nt, Homo sapiens
gcagcugucaacuacuuua

SEQ ID NO: 189456 - RNA, 19 nt, Homo sapiens
aggacaaccugaauucuau

SEQ ID NO: 189457 - RNA, 19 nt, Homo sapiens
ccacagugacaauaucaaa

SEQ ID NO: 189458 - RNA, 19 nt, Homo sapiens
ucucugcucuuaucgaguu

SEQ ID NO: 189459 - RNA, 19 nt, Homo sapiens
gugucuuucuggauuaaua

SEQ ID NO: 189460 - RNA, 19 nt, Homo sapiens
gugaauacguuauaaugac

SEQ ID NO: 189461 - RNA, 19 nt, Homo sapiens
gggcaugcuuguccacuca

SEQ ID NO: 189462 - RNA, 19 nt, Homo sapiens
ugacaacuccuaauaaacu

SEQ ID NO: 189463 - RNA, 19 nt, Homo sapiens
ugccauggauugguucaua

SEQ ID NO: 189464 - RNA, 19 nt, Homo sapiens
caggugucuuucuggauua

SEQ ID NO: 189465 - RNA, 19 nt, Homo sapiens
guaucuagugagacaauua

SEQ ID NO: 189466 - RNA, 19 nt, Homo sapiens
cucagaacaugaaaucaaa

SEQ ID NO: 189467 - RNA, 19 nt, Homo sapiens
ucaacuacuuuaccaaucu

SEQ ID NO: 189468 - RNA, 19 nt, Homo sapiens
ugucagauguggagaugga

SEQ ID NO: 189469 - RNA, 19 nt, Homo sapiens
cgagagcgcccaucuuaca

SEQ ID NO: 189470 - RNA, 19 nt, Homo sapiens
cauccugacuccaaauauc

SEQ ID NO: 189471 - RNA, 19 nt, Homo sapiens
auacagauauacacuccuu

SEQ ID NO: 189472 - RNA, 19 nt, Homo sapiens
cauugagacuuguguagau

SEQ ID NO: 189473 - RNA, 19 nt, Homo sapiens
ccaaagauacaauggaagu

SEQ ID NO: 189474 - RNA, 19 nt, Homo sapiens
gagcgcccaucuuacaauc

SEQ ID NO: 189475 - RNA, 19 nt, Homo sapiens
cgucuucucugcucuuauc

SEQ ID NO: 189476 - RNA, 19 nt, Homo sapiens
caagaugaauuugucaacu

SEQ ID NO: 189477 - RNA, 19 nt, Homo sapiens
gacaaccugaauucuauaa

SEQ ID NO: 189478 - RNA, 19 nt, Homo sapiens
gaggugcugucacugaagu

SEQ ID NO: 189479 - RNA, 19 nt, Homo sapiens
acaggugaauacguuauaa

SEQ ID NO: 189480 - RNA, 19 nt, Homo sapiens
cugguuaacuuuccuaugg

SEQ ID NO: 189481 - RNA, 19 nt, Homo sapiens
ucagaauaaugcagaaugg

SEQ ID NO: 189482 - RNA, 19 nt, Homo sapiens
caacaugacaacuccuaau

SEQ ID NO: 189483 - RNA, 19 nt, Homo sapiens
ggacugaugagagguugaa

SEQ ID NO: 189484 - RNA, 19 nt, Homo sapiens
caucuuccgaggccaauaa

SEQ ID NO: 189485 - RNA, 19 nt, Homo sapiens
ucgcagcugucaacuacuu

SEQ ID NO: 189486 - RNA, 19 nt, Homo sapiens
gaguauacgauggauguuu

SEQ ID NO: 189487 - RNA, 19 nt, Homo sapiens
aaaauagcauugagacuug

SEQ ID NO: 189488 - RNA, 19 nt, Homo sapiens
guagaagucccagaagaau

SEQ ID NO: 189489 - RNA, 19 nt, Homo sapiens
uaccaucaaugcugacugu

SEQ ID NO: 189490 - RNA, 19 nt, Homo sapiens
aacaugacaacuccuaaua

SEQ ID NO: 189491 - RNA, 19 nt, Homo sapiens
caauaauccuacuccucaa

SEQ ID NO: 189492 - RNA, 19 nt, Homo sapiens
gcauugagacuuguguaga

SEQ ID NO: 189493 - RNA, 19 nt, Homo sapiens
ucacugaagucaaaacaga

SEQ ID NO: 189494 - RNA, 19 nt, Homo sapiens
caacuuuugucuuccauug

SEQ ID NO: 189495 - RNA, 19 nt, Homo sapiens
ccaguaaaauagaccagua

SEQ ID NO: 189496 - RNA, 19 nt, Homo sapiens
aaggaucacuucucugucu

SEQ ID NO: 189497 - RNA, 19 nt, Homo sapiens
cuagugagacaauuaaauc

SEQ ID NO: 189498 - RNA, 19 nt, Homo sapiens
gcauuauucuguggcuaga

SEQ ID NO: 189499 - RNA, 19 nt, Homo sapiens
ucccaaaagugaaaucaua

SEQ ID NO: 189500 - RNA, 19 nt, Homo sapiens
uuauacaccaugaggcuua

SEQ ID NO: 189501 - RNA, 19 nt, Homo sapiens
acaugacaacuccuaauaa

SEQ ID NO: 189502 - RNA, 19 nt, Homo sapiens
auagaaaguugaagauugc

SEQ ID NO: 189503 - RNA, 19 nt, Homo sapiens
ucucagaacaugaaaucaa

SEQ ID NO: 189504 - RNA, 19 nt, Homo sapiens
uagcaguguugaauagcuu

SEQ ID NO: 189505 - RNA, 19 nt, Homo sapiens
gcugucaacuacuuuacca

SEQ ID NO: 189506 - RNA, 19 nt, Homo sapiens
auacacuccuugcauuaug

SEQ ID NO: 189507 - RNA, 19 nt, Homo sapiens
aaugcugacugucccauga

SEQ ID NO: 189508 - RNA, 19 nt, Homo sapiens
agaauaaugcagaauggaa

SEQ ID NO: 189509 - RNA, 19 nt, Homo sapiens
gcuugaaggcuaugacaau

SEQ ID NO: 189510 - RNA, 19 nt, Homo sapiens
cuuccauuguucaguauuu

SEQ ID NO: 189511 - RNA, 19 nt, Homo sapiens
uuuggaagcugagauuguu

SEQ ID NO: 189512 - RNA, 19 nt, Homo sapiens
gaucaccacuguuuuaacu

SEQ ID NO: 189513 - RNA, 19 nt, Homo sapiens
ucuccaguaugaucugauu

SEQ ID NO: 189514 - RNA, 19 nt, Homo sapiens
gagucugaauaauuugaug

SEQ ID NO: 189515 - RNA, 19 nt, Homo sapiens
aacaguaucuagugagaca

SEQ ID NO: 189516 - RNA, 19 nt, Homo sapiens
aaagaucccuuaugucaaa

SEQ ID NO: 189517 - RNA, 19 nt, Homo sapiens
gagagaaguuagacaggua

SEQ ID NO: 189518 - RNA, 19 nt, Homo sapiens
gaucgaaaguuauggcuau

SEQ ID NO: 189519 - RNA, 19 nt, Homo sapiens
agaauaaacuggagaugaa

SEQ ID NO: 189520 - RNA, 19 nt, Homo sapiens
ccaaagaucccuuauguca

SEQ ID NO: 189521 - RNA, 19 nt, Homo sapiens
acagauugcucaaaggaua

SEQ ID NO: 189522 - RNA, 19 nt, Homo sapiens
aaagggagcuagcaaacaa

SEQ ID NO: 189523 - RNA, 19 nt, Homo sapiens
gagaaacauugguuacuuc

SEQ ID NO: 189524 - RNA, 19 nt, Homo sapiens
acacugaggucuguucuaa

SEQ ID NO: 189525 - RNA, 19 nt, Homo sapiens
caacaugccauacgugaaa

SEQ ID NO: 189526 - RNA, 19 nt, Homo sapiens
gcucaaaggauaugacauu

SEQ ID NO: 189527 - RNA, 19 nt, Homo sapiens
uuagacagguagaucuuua

SEQ ID NO: 189528 - RNA, 19 nt, Homo sapiens
cuacuuuccucuucuauug

SEQ ID NO: 189529 - RNA, 19 nt, Homo sapiens
ucuauuggcuuuacuaugu

SEQ ID NO: 189530 - RNA, 19 nt, Homo sapiens
gcaccauguuuacuucaaa

SEQ ID NO: 189531 - RNA, 19 nt, Homo sapiens
ccacgacugucacuaaguu

SEQ ID NO: 189532 - RNA, 19 nt, Homo sapiens
aaucgaacuuccucaauuu

SEQ ID NO: 189533 - RNA, 19 nt, Homo sapiens
cgacuaaguugcauuccuu

SEQ ID NO: 189534 - RNA, 19 nt, Homo sapiens
caaguggucccgaauguuu

SEQ ID NO: 189535 - RNA, 19 nt, Homo sapiens
aaaucgaacuuccucaauu

SEQ ID NO: 189536 - RNA, 19 nt, Homo sapiens
gaaccucacccuagacaau

SEQ ID NO: 189537 - RNA, 19 nt, Homo sapiens
gacaaguggucccgaaugu

SEQ ID NO: 189538 - RNA, 19 nt, Homo sapiens
ugccaaagaucccuuaugu

SEQ ID NO: 189539 - RNA, 19 nt, Homo sapiens
gggagacccugccaaagau

SEQ ID NO: 189540 - RNA, 19 nt, Homo sapiens
ucacgacggugcuuacaau

SEQ ID NO: 189541 - RNA, 19 nt, Homo sapiens
acuacaagauggugucuaa

SEQ ID NO: 189542 - RNA, 19 nt, Homo sapiens
acaccuacuuucugaauga

SEQ ID NO: 189543 - RNA, 19 nt, Homo sapiens
ggacagauugcucaaagga

SEQ ID NO: 189544 - RNA, 19 nt, Homo sapiens
acaagauggugucuaagaa

SEQ ID NO: 189545 - RNA, 19 nt, Homo sapiens
cccuggagaucgaaaguua

SEQ ID NO: 189546 - RNA, 19 nt, Homo sapiens
gacauggucuccgaaguga

SEQ ID NO: 189547 - RNA, 19 nt, Homo sapiens
gaugugaauuccauagaca

SEQ ID NO: 189548 - RNA, 19 nt, Homo sapiens
ucacuaaguuuucgucuaa

SEQ ID NO: 189549 - RNA, 19 nt, Homo sapiens
gagauucagccauccaauu

SEQ ID NO: 189550 - RNA, 19 nt, Homo sapiens
gcacacagcaccaaugaac

SEQ ID NO: 189551 - RNA, 19 nt, Homo sapiens
aaacaaacacaaagagaga

SEQ ID NO: 189552 - RNA, 19 nt, Homo sapiens
uaagagcucuauuaauugc

SEQ ID NO: 189553 - RNA, 19 nt, Homo sapiens
cagguuaucagcucuuuaa

SEQ ID NO: 189554 - RNA, 19 nt, Homo sapiens
ccacugaugacauugaauu

SEQ ID NO: 189555 - RNA, 19 nt, Homo sapiens
gcuuuacuauguacacuga

SEQ ID NO: 189556 - RNA, 19 nt, Homo sapiens
gaaagagacaguggacaga

SEQ ID NO: 189557 - RNA, 19 nt, Homo sapiens
cuauaccacugaugacauu

SEQ ID NO: 189558 - RNA, 19 nt, Homo sapiens
agagaaacauugguuacuu

SEQ ID NO: 189559 - RNA, 19 nt, Homo sapiens
acugaggucuguucuaaug

SEQ ID NO: 189560 - RNA, 19 nt, Homo sapiens
ugaauuccauagacaagug

SEQ ID NO: 189561 - RNA, 19 nt, Homo sapiens
gaagguggaguucacaaca

SEQ ID NO: 189562 - RNA, 19 nt, Homo sapiens
gauuauacacucaccaugu

SEQ ID NO: 189563 - RNA, 19 nt, Homo sapiens
ccgaagugaauauggauua

SEQ ID NO: 189564 - RNA, 19 nt, Homo sapiens
ggaaucacgacggugcuua

SEQ ID NO: 189565 - RNA, 19 nt, Homo sapiens
aaaccuacaugccuucuac

SEQ ID NO: 189566 - RNA, 19 nt, Homo sapiens
gaacugcacccuggagauc

SEQ ID NO: 189567 - RNA, 19 nt, Homo sapiens
aaccacagcugcauguaug

SEQ ID NO: 189568 - RNA, 19 nt, Homo sapiens
uaggguagcugaccaacuc

SEQ ID NO: 189569 - RNA, 19 nt, Homo sapiens
gaaguuagacagguagauc

SEQ ID NO: 189570 - RNA, 19 nt, Homo sapiens
agacuacuuuccucuucua

SEQ ID NO: 189571 - RNA, 19 nt, Homo sapiens
ccaaugagaagaauaaacu

SEQ ID NO: 189572 - RNA, 19 nt, Homo sapiens
cuucuacacugauuacaau

SEQ ID NO: 189573 - RNA, 19 nt, Homo sapiens
cuaaagagaaacauugguu

SEQ ID NO: 189574 - RNA, 19 nt, Homo sapiens
aaucagaguuaguaaugug

SEQ ID NO: 189575 - RNA, 19 nt, Homo sapiens
cgaagugaauauggauuau

SEQ ID NO: 189576 - RNA, 19 nt, Homo sapiens
uuacuggaauggaggagaa

SEQ ID NO: 189577 - RNA, 19 nt, Homo sapiens
aagagacaguggacagauu

SEQ ID NO: 189578 - RNA, 19 nt, Homo sapiens
ugauuaccauggucuguug

SEQ ID NO: 189579 - RNA, 19 nt, Homo sapiens
guggacagauugcucaaag

SEQ ID NO: 189580 - RNA, 19 nt, Homo sapiens
gugccaaugagaagaauaa

SEQ ID NO: 189581 - RNA, 19 nt, Homo sapiens
gaccagagugccaaugaga

SEQ ID NO: 189582 - RNA, 19 nt, Homo sapiens
cugcacugcuuccugguaa

SEQ ID NO: 189583 - RNA, 19 nt, Homo sapiens
caaugaacccagcaacaug

SEQ ID NO: 189584 - RNA, 19 nt, Homo sapiens
gauggguugcuuuguguuu

SEQ ID NO: 189585 - RNA, 19 nt, Homo sapiens
caaccacagcugcauguau

SEQ ID NO: 189586 - RNA, 19 nt, Homo sapiens
gaucgaugucgccagcaua

SEQ ID NO: 189587 - RNA, 19 nt, Homo sapiens
ccugguaaacuauaacaaa

SEQ ID NO: 189588 - RNA, 19 nt, Homo sapiens
aaacacaaagagagaaguu

SEQ ID NO: 189589 - RNA, 19 nt, Homo sapiens
ccuugaaucuucgcagaaa

SEQ ID NO: 189590 - RNA, 19 nt, Homo sapiens
cuauuggcuuuacuaugua

SEQ ID NO: 189591 - RNA, 19 nt, Homo sapiens
caaagaucccuuaugucaa

SEQ ID NO: 189592 - RNA, 19 nt, Homo sapiens
cgacggugcuuacaaugac

SEQ ID NO: 189593 - RNA, 19 nt, Homo sapiens
gggaaaggcccucagaaaa

SEQ ID NO: 189594 - RNA, 19 nt, Homo sapiens
uuaguaauguggacaguac

SEQ ID NO: 189595 - RNA, 19 nt, Homo sapiens
cuacacugauuacaauucu

SEQ ID NO: 189596 - RNA, 19 nt, Homo sapiens
uauccacgacugucacuaa

SEQ ID NO: 189597 - RNA, 19 nt, Homo sapiens
gguaccagacaccuacuuu

SEQ ID NO: 189598 - RNA, 19 nt, Homo sapiens
aagaauaaacuggagauga

SEQ ID NO: 189599 - RNA, 19 nt, Homo sapiens
ugggaaaggcccucagaaa

SEQ ID NO: 189600 - RNA, 19 nt, Homo sapiens
agucacugguguuaauaaa

SEQ ID NO: 189601 - RNA, 19 nt, Homo sapiens
gcaacaugccauacgugaa

SEQ ID NO: 189602 - RNA, 19 nt, Homo sapiens
gaggucuguucuaaugguu

SEQ ID NO: 189603 - RNA, 19 nt, Homo sapiens
gaauaaacuggagaugaau

SEQ ID NO: 189604 - RNA, 19 nt, Homo sapiens
guagaucuuuagcagucuu

SEQ ID NO: 189605 - RNA, 19 nt, Homo sapiens
gguuuuaggucuugcauau

SEQ ID NO: 189606 - RNA, 19 nt, Homo sapiens
uuagacuacuuuccucuuc

SEQ ID NO: 189607 - RNA, 19 nt, Homo sapiens
ccaaugaacccagcaacau

SEQ ID NO: 189608 - RNA, 19 nt, Homo sapiens
ucugauggguugcuuugug

SEQ ID NO: 189609 - RNA, 19 nt, Homo sapiens
cgucuaaagagaaacauug

SEQ ID NO: 189610 - RNA, 19 nt, Homo sapiens
cuaagaagguggaguucac

SEQ ID NO: 189611 - RNA, 19 nt, Homo sapiens
uacaagauggugucuaaga

SEQ ID NO: 189612 - RNA, 19 nt, Homo sapiens
gacaccuacuuucugaaug

SEQ ID NO: 189613 - RNA, 19 nt, Homo sapiens
acaaacaaacacaaagaga

SEQ ID NO: 189614 - RNA, 19 nt, Homo sapiens
agauucagccauccaauug

SEQ ID NO: 189615 - RNA, 19 nt, Homo sapiens
ccucccagcucaaagucaa

SEQ ID NO: 189616 - RNA, 19 nt, Homo sapiens
caacaagccuggagagaua

SEQ ID NO: 189617 - RNA, 19 nt, Homo sapiens
gcacaaugcuagccuauga

SEQ ID NO: 189618 - RNA, 19 nt, Homo sapiens
gauuauaccuugacaaugu

SEQ ID NO: 189619 - RNA, 19 nt, Homo sapiens
gauaagaggcuguccuaua

SEQ ID NO: 189620 - RNA, 19 nt, Homo sapiens
gagaaacauuggcuacuuu

SEQ ID NO: 189621 - RNA, 19 nt, Homo sapiens
auaagaggcuguccuauaa

SEQ ID NO: 189622 - RNA, 19 nt, Homo sapiens
gaucuccucucuucaguga

SEQ ID NO: 189623 - RNA, 19 nt, Homo sapiens
aguaauaugucgcugguua

SEQ ID NO: 189624 - RNA, 19 nt, Homo sapiens
auacacaacugaugacauu

SEQ ID NO: 189625 - RNA, 19 nt, Homo sapiens
gcacugggcagacuaaguu

SEQ ID NO: 189626 - RNA, 19 nt, Homo sapiens
gcaucgauaugguuucuga

SEQ ID NO: 189627 - RNA, 19 nt, Homo sapiens
ccacaguucucuauuguag

SEQ ID NO: 189628 - RNA, 19 nt, Homo sapiens
ggacaaaagugacgcuaaa

SEQ ID NO: 189629 - RNA, 19 nt, Homo sapiens
ugacuugacugaugugaau

SEQ ID NO: 189630 - RNA, 19 nt, Homo sapiens
ugaaggccauugacaugua

SEQ ID NO: 189631 - RNA, 19 nt, Homo sapiens
ucauggcccuucuggaaua

SEQ ID NO: 189632 - RNA, 19 nt, Homo sapiens
gcgccucacauuagaauua

SEQ ID NO: 189633 - RNA, 19 nt, Homo sapiens
aaacauacaugccuuccau

SEQ ID NO: 189634 - RNA, 19 nt, Homo sapiens
gaaaggcuaugacauucgu

SEQ ID NO: 189635 - RNA, 19 nt, Homo sapiens
ggagguacccacuggauga

SEQ ID NO: 189636 - RNA, 19 nt, Homo sapiens
ccuauuuccugaacgauaa

SEQ ID NO: 189637 - RNA, 19 nt, Homo sapiens
gcuguccuauaauguaaua

SEQ ID NO: 189638 - RNA, 19 nt, Homo sapiens
gagauaagaggcuguccua

SEQ ID NO: 189639 - RNA, 19 nt, Homo sapiens
ucacaacuguccucacaau

SEQ ID NO: 189640 - RNA, 19 nt, Homo sapiens
gguuaucccucagcuuuaa

SEQ ID NO: 189641 - RNA, 19 nt, Homo sapiens
gaucgguggucccgcauau

SEQ ID NO: 189642 - RNA, 19 nt, Homo sapiens
guuaagaaccgcaugauuc

SEQ ID NO: 189643 - RNA, 19 nt, Homo sapiens
ucaaugacccuaguaauau

SEQ ID NO: 189644 - RNA, 19 nt, Homo sapiens
acugagcacucucgagaua

SEQ ID NO: 189645 - RNA, 19 nt, Homo sapiens
caugagaacaucuuacuga

SEQ ID NO: 189646 - RNA, 19 nt, Homo sapiens
caaaagugacgcuaaaaua

SEQ ID NO: 189647 - RNA, 19 nt, Homo sapiens
caaugacccuaguaauaug

SEQ ID NO: 189648 - RNA, 19 nt, Homo sapiens
ugagcacucucgagauaaa

SEQ ID NO: 189649 - RNA, 19 nt, Homo sapiens
ggccaugcgccucacauua

SEQ ID NO: 189650 - RNA, 19 nt, Homo sapiens
ggacuagauuccuccucaa

SEQ ID NO: 189651 - RNA, 19 nt, Homo sapiens
uaaguuggaucuccucucu

SEQ ID NO: 189652 - RNA, 19 nt, Homo sapiens
gacaauguacuuucaacaa

SEQ ID NO: 189653 - RNA, 19 nt, Homo sapiens
ggaugaacauugacauugc

SEQ ID NO: 189654 - RNA, 19 nt, Homo sapiens
acacaucaauccaggacaa

SEQ ID NO: 189655 - RNA, 19 nt, Homo sapiens
gaggcuguccuauaaugua

SEQ ID NO: 189656 - RNA, 19 nt, Homo sapiens
aaucacaacuguccucaca

SEQ ID NO: 189657 - RNA, 19 nt, Homo sapiens
cagguuaucccucagcuuu

SEQ ID NO: 189658 - RNA, 19 nt, Homo sapiens
gaaauugagagcuauggau

SEQ ID NO: 189659 - RNA, 19 nt, Homo sapiens
aaacugcaccuuggaaauu

SEQ ID NO: 189660 - RNA, 19 nt, Homo sapiens
gugaaacccucaauuccau

SEQ ID NO: 189661 - RNA, 19 nt, Homo sapiens
ccugaaaggcuaugacauu

SEQ ID NO: 189662 - RNA, 19 nt, Homo sapiens
auaugucgcugguuaaaga

SEQ ID NO: 189663 - RNA, 19 nt, Homo sapiens
aaagaaagcagcugagaag

SEQ ID NO: 189664 - RNA, 19 nt, Homo sapiens
uuaaagagacgguggauag

SEQ ID NO: 189665 - RNA, 19 nt, Homo sapiens
ucaacuacaucuucuuugg

SEQ ID NO: 189666 - RNA, 19 nt, Homo sapiens
acaaacuuaucaccaagaa

SEQ ID NO: 189667 - RNA, 19 nt, Homo sapiens
aaauugagagcuauggaua

SEQ ID NO: 189668 - RNA, 19 nt, Homo sapiens
gacauugccagcaucgaua

SEQ ID NO: 189669 - RNA, 19 nt, Homo sapiens
agagaaacauuggcuacuu

SEQ ID NO: 189670 - RNA, 19 nt, Homo sapiens
ugagagcuauggauacaca

SEQ ID NO: 189671 - RNA, 19 nt, Homo sapiens
agacgcgccucccaacuga

SEQ ID NO: 189672 - RNA, 19 nt, Homo sapiens
ggaauaugcccuagucaac

SEQ ID NO: 189673 - RNA, 19 nt, Homo sapiens
gugcacggagugacuguua

SEQ ID NO: 189674 - RNA, 19 nt, Homo sapiens
gauaugguuucugaaguca

SEQ ID NO: 189675 - RNA, 19 nt, Homo sapiens
gaaggccauugacauguac

SEQ ID NO: 189676 - RNA, 19 nt, Homo sapiens
acaacuguccucacaauga

SEQ ID NO: 189677 - RNA, 19 nt, Homo sapiens
gcaaggguggcauuaggaa

SEQ ID NO: 189678 - RNA, 19 nt, Homo sapiens
aagaggcuguccuauaaug

SEQ ID NO: 189679 - RNA, 19 nt, Homo sapiens
cgauaugguuucugaaguc

SEQ ID NO: 189680 - RNA, 19 nt, Homo sapiens
gggaugaacauugacauug

SEQ ID NO: 189681 - RNA, 19 nt, Homo sapiens
guaauaugucgcugguuaa

SEQ ID NO: 189682 - RNA, 19 nt, Homo sapiens
gguugcuucugcuaaguaa

SEQ ID NO: 189683 - RNA, 19 nt, Homo sapiens
ccuauccugugguccauuu

SEQ ID NO: 189684 - RNA, 19 nt, Homo sapiens
gaaacauuggcuacuuuau

SEQ ID NO: 189685 - RNA, 19 nt, Homo sapiens
agaaacauuggcuacuuua

SEQ ID NO: 189686 - RNA, 19 nt, Homo sapiens
acaauguacuuucaacaag

SEQ ID NO: 189687 - RNA, 19 nt, Homo sapiens
ucagugaaacccucaauuc

SEQ ID NO: 189688 - RNA, 19 nt, Homo sapiens
gcuaaguaaugaauacacu

SEQ ID NO: 189689 - RNA, 19 nt, Homo sapiens
caacuguccucacaaugac

SEQ ID NO: 189690 - RNA, 19 nt, Homo sapiens
aauaaucgccgcugucugu

SEQ ID NO: 189691 - RNA, 19 nt, Homo sapiens
cauuaggaaucacaacugu

SEQ ID NO: 189692 - RNA, 19 nt, Homo sapiens
cugaugacauugaguuuua

SEQ ID NO: 189693 - RNA, 19 nt, Homo sapiens
aaacauuggcuacuuuauc

SEQ ID NO: 189694 - RNA, 19 nt, Homo sapiens
gaacgauaagaagucauuu

SEQ ID NO: 189695 - RNA, 19 nt, Homo sapiens
cuaaagggauguggagagu

SEQ ID NO: 189696 - RNA, 19 nt, Homo sapiens
ccuuggaaauugagagcua

SEQ ID NO: 189697 - RNA, 19 nt, Homo sapiens
ggacucagaaucacaacca

SEQ ID NO: 189698 - RNA, 19 nt, Homo sapiens
gcgccuggaugucaacaag

SEQ ID NO: 189699 - RNA, 19 nt, Homo sapiens
ccaugcgccucacauuaga

SEQ ID NO: 189700 - RNA, 19 nt, Homo sapiens
ugggucuccuucuggauua

SEQ ID NO: 189701 - RNA, 19 nt, Homo sapiens
uaacaggaguaacgaaaau

SEQ ID NO: 189702 - RNA, 19 nt, Homo sapiens
acacaacugaugacauuga

SEQ ID NO: 189703 - RNA, 19 nt, Homo sapiens
ggaaauugagagcuaugga

SEQ ID NO: 189704 - RNA, 19 nt, Homo sapiens
ugaacgauaagaagucauu

SEQ ID NO: 189705 - RNA, 19 nt, Homo sapiens
uaugguuucugaagucaau

SEQ ID NO: 189706 - RNA, 19 nt, Homo sapiens
gugcgcagagugucaauga

SEQ ID NO: 189707 - RNA, 19 nt, Homo sapiens
ggaagcaaggacuagauuc

SEQ ID NO: 189708 - RNA, 19 nt, Homo sapiens
gccaugcgccucacauuag

SEQ ID NO: 189709 - RNA, 19 nt, Homo sapiens
ccauugacauguaccugau

SEQ ID NO: 189710 - RNA, 19 nt, Homo sapiens
cugaaaggcuaugacauuc

SEQ ID NO: 189711 - RNA, 19 nt, Homo sapiens
acaaugaccacaaucaaca

SEQ ID NO: 189712 - RNA, 19 nt, Homo sapiens
ucacaaugaccacaaucaa

SEQ ID NO: 189713 - RNA, 19 nt, Homo sapiens
gaaacccucaauuccauca

SEQ ID NO: 189714 - RNA, 19 nt, Homo sapiens
aaacuugacucuggacaac

SEQ ID NO: 189715 - RNA, 19 nt, Homo sapiens
aggcuguccuauaauguaa

SEQ ID NO: 189716 - RNA, 19 nt, Homo sapiens
caacaagccuggagagaua

SEQ ID NO: 189717 - RNA, 19 nt, Homo sapiens
gcacaaugcuagccuauga

SEQ ID NO: 189718 - RNA, 19 nt, Homo sapiens
gauuauaccuugacaaugu

SEQ ID NO: 189719 - RNA, 19 nt, Homo sapiens
gauaagaggcuguccuaua

SEQ ID NO: 189720 - RNA, 19 nt, Homo sapiens
gagaaacauuggcuacuuu

SEQ ID NO: 189721 - RNA, 19 nt, Homo sapiens
auaagaggcuguccuauaa

SEQ ID NO: 189722 - RNA, 19 nt, Homo sapiens
gaucuccucucuucaguga

SEQ ID NO: 189723 - RNA, 19 nt, Homo sapiens
aguaauaugucgcugguua

SEQ ID NO: 189724 - RNA, 19 nt, Homo sapiens
auacacaacugaugacauu

SEQ ID NO: 189725 - RNA, 19 nt, Homo sapiens
gcacugggcagacuaaguu

SEQ ID NO: 189726 - RNA, 19 nt, Homo sapiens
gcaucgauaugguuucuga

SEQ ID NO: 189727 - RNA, 19 nt, Homo sapiens
ccacaguucucuauuguag

SEQ ID NO: 189728 - RNA, 19 nt, Homo sapiens
ggacaaaagugacgcuaaa

SEQ ID NO: 189729 - RNA, 19 nt, Homo sapiens
ugacuugacugaugugaau

SEQ ID NO: 189730 - RNA, 19 nt, Homo sapiens
ggacuaccaauuacgauuu

SEQ ID NO: 189731 - RNA, 19 nt, Homo sapiens
ugaaggccauugacaugua

SEQ ID NO: 189732 - RNA, 19 nt, Homo sapiens
ucauggcccuucuggaaua

SEQ ID NO: 189733 - RNA, 19 nt, Homo sapiens
gcgccucacauuagaauua

SEQ ID NO: 189734 - RNA, 19 nt, Homo sapiens
cuagacggacuaccaauua

SEQ ID NO: 189735 - RNA, 19 nt, Homo sapiens
aaacauacaugccuuccau

SEQ ID NO: 189736 - RNA, 19 nt, Homo sapiens
gaaaggcuaugacauucgu

SEQ ID NO: 189737 - RNA, 19 nt, Homo sapiens
ggaaaccucuccccaacua

SEQ ID NO: 189738 - RNA, 19 nt, Homo sapiens
ggagguacccacuggauga

SEQ ID NO: 189739 - RNA, 19 nt, Homo sapiens
ccuauuuccugaacgauaa

SEQ ID NO: 189740 - RNA, 19 nt, Homo sapiens
gcuguccuauaauguaaua

SEQ ID NO: 189741 - RNA, 19 nt, Homo sapiens
gagauaagaggcuguccua

SEQ ID NO: 189742 - RNA, 19 nt, Homo sapiens
ucacaacuguccucacaau

SEQ ID NO: 189743 - RNA, 19 nt, Homo sapiens
gguuaucccucagcuuuaa

SEQ ID NO: 189744 - RNA, 19 nt, Homo sapiens
gaucgguggucccgcauau

SEQ ID NO: 189745 - RNA, 19 nt, Homo sapiens
guuaagaaccgcaugauuc

SEQ ID NO: 189746 - RNA, 19 nt, Homo sapiens
ucaaugacccuaguaauau

SEQ ID NO: 189747 - RNA, 19 nt, Homo sapiens
acugagcacucucgagaua

SEQ ID NO: 189748 - RNA, 19 nt, Homo sapiens
caugagaacaucuuacuga

SEQ ID NO: 189749 - RNA, 19 nt, Homo sapiens
caaaagugacgcuaaaaua

SEQ ID NO: 189750 - RNA, 19 nt, Homo sapiens
caaugacccuaguaauaug

SEQ ID NO: 189751 - RNA, 19 nt, Homo sapiens
ugagcacucucgagauaaa

SEQ ID NO: 189752 - RNA, 19 nt, Homo sapiens
ggccaugcgccucacauua

SEQ ID NO: 189753 - RNA, 19 nt, Homo sapiens
ggacuagauuccuccucaa

SEQ ID NO: 189754 - RNA, 19 nt, Homo sapiens
uaaguuggaucuccucucu

SEQ ID NO: 189755 - RNA, 19 nt, Homo sapiens
gacaauguacuuucaacaa

SEQ ID NO: 189756 - RNA, 19 nt, Homo sapiens
ggaugaacauugacauugc

SEQ ID NO: 189757 - RNA, 19 nt, Homo sapiens
acacaucaauccaggacaa

SEQ ID NO: 189758 - RNA, 19 nt, Homo sapiens
gaggcuguccuauaaugua

SEQ ID NO: 189759 - RNA, 19 nt, Homo sapiens
uacgauuucucucuguaua

SEQ ID NO: 189760 - RNA, 19 nt, Homo sapiens
aaucacaacuguccucaca

SEQ ID NO: 189761 - RNA, 19 nt, Homo sapiens
cagguuaucccucagcuuu

SEQ ID NO: 189762 - RNA, 19 nt, Homo sapiens
gaaauugagagcuauggau

SEQ ID NO: 189763 - RNA, 19 nt, Homo sapiens
aaacugcaccuuggaaauu

SEQ ID NO: 189764 - RNA, 19 nt, Homo sapiens
gugaaacccucaauuccau

SEQ ID NO: 189765 - RNA, 19 nt, Homo sapiens
ccugaaaggcuaugacauu

SEQ ID NO: 189766 - RNA, 19 nt, Homo sapiens
auaugucgcugguuaaaga

SEQ ID NO: 189767 - RNA, 19 nt, Homo sapiens
aaagaaagcagcugagaag

SEQ ID NO: 189768 - RNA, 19 nt, Homo sapiens
uuaaagagacgguggauag

SEQ ID NO: 189769 - RNA, 19 nt, Homo sapiens
ucaacuacaucuucuuugg

SEQ ID NO: 189770 - RNA, 19 nt, Homo sapiens
acaaacuuaucaccaagaa

SEQ ID NO: 189771 - RNA, 19 nt, Homo sapiens
aaauugagagcuauggaua

SEQ ID NO: 189772 - RNA, 19 nt, Homo sapiens
gacauugccagcaucgaua

SEQ ID NO: 189773 - RNA, 19 nt, Homo sapiens
agagaaacauuggcuacuu

SEQ ID NO: 189774 - RNA, 19 nt, Homo sapiens
ugagagcuauggauacaca

SEQ ID NO: 189775 - RNA, 19 nt, Homo sapiens
agacgcgccucccaacuga

SEQ ID NO: 189776 - RNA, 19 nt, Homo sapiens
ggaauaugcccuagucaac

SEQ ID NO: 189777 - RNA, 19 nt, Homo sapiens
gugcacggagugacuguua

SEQ ID NO: 189778 - RNA, 19 nt, Homo sapiens
gauaugguuucugaaguca

SEQ ID NO: 189779 - RNA, 19 nt, Homo sapiens
caacuagacggacuaccaa

SEQ ID NO: 189780 - RNA, 19 nt, Homo sapiens
gaaggccauugacauguac

SEQ ID NO: 189781 - RNA, 19 nt, Homo sapiens
acaacuguccucacaauga

SEQ ID NO: 189782 - RNA, 19 nt, Homo sapiens
gcaaggguggcauuaggaa

SEQ ID NO: 189783 - RNA, 19 nt, Homo sapiens
aagaggcuguccuauaaug

SEQ ID NO: 189784 - RNA, 19 nt, Homo sapiens
cgauaugguuucugaaguc

SEQ ID NO: 189785 - RNA, 19 nt, Homo sapiens
gggaugaacauugacauug

SEQ ID NO: 189786 - RNA, 19 nt, Homo sapiens
guaauaugucgcugguuaa

SEQ ID NO: 189787 - RNA, 19 nt, Homo sapiens
gguugcuucugcuaaguaa

SEQ ID NO: 189788 - RNA, 19 nt, Homo sapiens
ccuauccugugguccauuu

SEQ ID NO: 189789 - RNA, 19 nt, Homo sapiens
ucagugaaacccucaauuc

SEQ ID NO: 189790 - RNA, 19 nt, Homo sapiens
gaaacauuggcuacuuuau

SEQ ID NO: 189791 - RNA, 19 nt, Homo sapiens
agaaacauuggcuacuuua

SEQ ID NO: 189792 - RNA, 19 nt, Homo sapiens
acaauguacuuucaacaag

SEQ ID NO: 189793 - RNA, 19 nt, Homo sapiens
gcuaaguaaugaauacacu

SEQ ID NO: 189794 - RNA, 19 nt, Homo sapiens
aauaaucgccgcugucugu

SEQ ID NO: 189795 - RNA, 19 nt, Homo sapiens
caacuguccucacaaugac

SEQ ID NO: 189796 - RNA, 19 nt, Homo sapiens
cauuaggaaucacaacugu

SEQ ID NO: 189797 - RNA, 19 nt, Homo sapiens
cugaugacauugaguuuua

SEQ ID NO: 189798 - RNA, 19 nt, Homo sapiens
cuaaagggauguggagagu

SEQ ID NO: 189799 - RNA, 19 nt, Homo sapiens
aaacauuggcuacuuuauc

SEQ ID NO: 189800 - RNA, 19 nt, Homo sapiens
gaacgauaagaagucauuu

SEQ ID NO: 189801 - RNA, 19 nt, Homo sapiens
ccuuggaaauugagagcua

SEQ ID NO: 189802 - RNA, 19 nt, Homo sapiens
ggacucagaaucacaacca

SEQ ID NO: 189803 - RNA, 19 nt, Homo sapiens
gacuaccaauuacgauuuc

SEQ ID NO: 189804 - RNA, 19 nt, Homo sapiens
ccaugcgccucacauuaga

SEQ ID NO: 189805 - RNA, 19 nt, Homo sapiens
gcgccuggaugucaacaag

SEQ ID NO: 189806 - RNA, 19 nt, Homo sapiens
ugggucuccuucuggauua

SEQ ID NO: 189807 - RNA, 19 nt, Homo sapiens
uaacaggaguaacgaaaau

SEQ ID NO: 189808 - RNA, 19 nt, Homo sapiens
acacaacugaugacauuga

SEQ ID NO: 189809 - RNA, 19 nt, Homo sapiens
ggaaauugagagcuaugga

SEQ ID NO: 189810 - RNA, 19 nt, Homo sapiens
ugaacgauaagaagucauu

SEQ ID NO: 189811 - RNA, 19 nt, Homo sapiens
gugcgcagagugucaauga

SEQ ID NO: 189812 - RNA, 19 nt, Homo sapiens
uaugguuucugaagucaau

SEQ ID NO: 189813 - RNA, 19 nt, Homo sapiens
ggaagcaaggacuagauuc

SEQ ID NO: 189814 - RNA, 19 nt, Homo sapiens
gccaugcgccucacauuag

SEQ ID NO: 189815 - RNA, 19 nt, Homo sapiens
ccauugacauguaccugau

SEQ ID NO: 189816 - RNA, 19 nt, Homo sapiens
caacauggauuauaccuua

SEQ ID NO: 189817 - RNA, 19 nt, Homo sapiens
ccaaaugugucuuguauua

SEQ ID NO: 189818 - RNA, 19 nt, Homo sapiens
gaacugcacucuggaaauu

SEQ ID NO: 189819 - RNA, 19 nt, Homo sapiens
ggacaaguaucaucuaaau

SEQ ID NO: 189820 - RNA, 19 nt, Homo sapiens
gcauagacgucucagguua

SEQ ID NO: 189821 - RNA, 19 nt, Homo sapiens
gaaauauucuguugacauc

SEQ ID NO: 189822 - RNA, 19 nt, Homo sapiens
ucacugagcuuucgguuga

SEQ ID NO: 189823 - RNA, 19 nt, Homo sapiens
gauuauaccuuaaccaugu

SEQ ID NO: 189824 - RNA, 19 nt, Homo sapiens
ggauugagcucccgcaguu

SEQ ID NO: 189825 - RNA, 19 nt, Homo sapiens
caacaauauuggagagaua

SEQ ID NO: 189826 - RNA, 19 nt, Homo sapiens
gcagugugcuuaccuguug

SEQ ID NO: 189827 - RNA, 19 nt, Homo sapiens
gaacauguccuuugugaag

SEQ ID NO: 189828 - RNA, 19 nt, Homo sapiens
gugcuuaccuguugucuga

SEQ ID NO: 189829 - RNA, 19 nt, Homo sapiens
ggauguauguguauauguu

SEQ ID NO: 189830 - RNA, 19 nt, Homo sapiens
gaacauuggauacuucauu

SEQ ID NO: 189831 - RNA, 19 nt, Homo sapiens
gcaguuauguuaucauucu

SEQ ID NO: 189832 - RNA, 19 nt, Homo sapiens
gaagacaaauacacauaca

SEQ ID NO: 189833 - RNA, 19 nt, Homo sapiens
ugacaucgcuggaaguuca

SEQ ID NO: 189834 - RNA, 19 nt, Homo sapiens
gggaacauguccuuuguga

SEQ ID NO: 189835 - RNA, 19 nt, Homo sapiens
cgucucagguuauucguua

SEQ ID NO: 189836 - RNA, 19 nt, Homo sapiens
gaagucaacauggauuaua

SEQ ID NO: 189837 - RNA, 19 nt, Homo sapiens
gcagacacacacauauaua

SEQ ID NO: 189838 - RNA, 19 nt, Homo sapiens
uauuaugccuugagaauga

SEQ ID NO: 189839 - RNA, 19 nt, Homo sapiens
ugaauggcaucucguugua

SEQ ID NO: 189840 - RNA, 19 nt, Homo sapiens
agacuuauaugcccucuau

SEQ ID NO: 189841 - RNA, 19 nt, Homo sapiens
gaaucauccucaugccuuu

SEQ ID NO: 189842 - RNA, 19 nt, Homo sapiens
uaccaggaauucagcaaua

SEQ ID NO: 189843 - RNA, 19 nt, Homo sapiens
ggauccagcuucacuguca

SEQ ID NO: 189844 - RNA, 19 nt, Homo sapiens
gaacgaccgucuuuugaaa

SEQ ID NO: 189845 - RNA, 19 nt, Homo sapiens
gcuguacuauguuaacuga

SEQ ID NO: 189846 - RNA, 19 nt, Homo sapiens
gaauucagcaauauccuuu

SEQ ID NO: 189847 - RNA, 19 nt, Homo sapiens
cuacaucucguauggauuu

SEQ ID NO: 189848 - RNA, 19 nt, Homo sapiens
agaagaagcuugcagaaaa

SEQ ID NO: 189849 - RNA, 19 nt, Homo sapiens
gcacauccaacuacuccua

SEQ ID NO: 189850 - RNA, 19 nt, Homo sapiens
gaggaacauuggauacuuc

SEQ ID NO: 189851 - RNA, 19 nt, Homo sapiens
ugauggaccucaggagaua

SEQ ID NO: 189852 - RNA, 19 nt, Homo sapiens
ggccugauauccaacagaa

SEQ ID NO: 189853 - RNA, 19 nt, Homo sapiens
uaccacaggaugcauauua

SEQ ID NO: 189854 - RNA, 19 nt, Homo sapiens
cgacaugguuuccgaaguc

SEQ ID NO: 189855 - RNA, 19 nt, Homo sapiens
cgaacacagugacacguuu

SEQ ID NO: 189856 - RNA, 19 nt, Homo sapiens
uugcagcuauggacaauuu

SEQ ID NO: 189857 - RNA, 19 nt, Homo sapiens
ggaaauauucuguugacau

SEQ ID NO: 189858 - RNA, 19 nt, Homo sapiens
gcccgacacauauuucuua

SEQ ID NO: 189859 - RNA, 19 nt, Homo sapiens
uuucauagacgcaaccuua

SEQ ID NO: 189860 - RNA, 19 nt, Homo sapiens
cguuguaaguacucuaaua

SEQ ID NO: 189861 - RNA, 19 nt, Homo sapiens
ggaugcauauuaaagaaag

SEQ ID NO: 189862 - RNA, 19 nt, Homo sapiens
caggaugcauauuaaagaa

SEQ ID NO: 189863 - RNA, 19 nt, Homo sapiens
gaggauguauguguauaug

SEQ ID NO: 189864 - RNA, 19 nt, Homo sapiens
gagugacuguacuugauuu

SEQ ID NO: 189865 - RNA, 19 nt, Homo sapiens
guugaaaggcuacgacauu

SEQ ID NO: 189866 - RNA, 19 nt, Homo sapiens
agacuucauuuaacacuga

SEQ ID NO: 189867 - RNA, 19 nt, Homo sapiens
gaacacagugacacguuug

SEQ ID NO: 189868 - RNA, 19 nt, Homo sapiens
cauauccucucguucaguu

SEQ ID NO: 189869 - RNA, 19 nt, Homo sapiens
ccauugacauguaccuuau

SEQ ID NO: 189870 - RNA, 19 nt, Homo sapiens
agcaugcgaugucauauuu

SEQ ID NO: 189871 - RNA, 19 nt, Homo sapiens
ugaacuuucucagcauaua

SEQ ID NO: 189872 - RNA, 19 nt, Homo sapiens
gguggaugcucauggaaau

SEQ ID NO: 189873 - RNA, 19 nt, Homo sapiens
ugauguaacuacuuucugu

SEQ ID NO: 189874 - RNA, 19 nt, Homo sapiens
guaguuuguuucuguuguu

SEQ ID NO: 189875 - RNA, 19 nt, Homo sapiens
gaaagggacaaguaucauc

SEQ ID NO: 189876 - RNA, 19 nt, Homo sapiens
uaauugaaagggacaagua

SEQ ID NO: 189877 - RNA, 19 nt, Homo sapiens
caacugugcugacaaugac

SEQ ID NO: 189878 - RNA, 19 nt, Homo sapiens
gaacuuucucagcauauau

SEQ ID NO: 189879 - RNA, 19 nt, Homo sapiens
cuucacagcucaaaauuaa

SEQ ID NO: 189880 - RNA, 19 nt, Homo sapiens
ucauggaaauauucuguug

SEQ ID NO: 189881 - RNA, 19 nt, Homo sapiens
gccauugacauguaccuua

SEQ ID NO: 189882 - RNA, 19 nt, Homo sapiens
caaaauccccuaugucaaa

SEQ ID NO: 189883 - RNA, 19 nt, Homo sapiens
ugaagaggaacauuggaua

SEQ ID NO: 189884 - RNA, 19 nt, Homo sapiens
cggaugacauugaguuuua

SEQ ID NO: 189885 - RNA, 19 nt, Homo sapiens
ccucaugccuuuauuucug

SEQ ID NO: 189886 - RNA, 19 nt, Homo sapiens
aagaaugaccguucaaaga

SEQ ID NO: 189887 - RNA, 19 nt, Homo sapiens
caucucguauggauuucua

SEQ ID NO: 189888 - RNA, 19 nt, Homo sapiens
gcacaagaagacccaucua

SEQ ID NO: 189889 - RNA, 19 nt, Homo sapiens
caaagaaugaccguucaaa

SEQ ID NO: 189890 - RNA, 19 nt, Homo sapiens
gcagaagaagcuugcagaa

SEQ ID NO: 189891 - RNA, 19 nt, Homo sapiens
aagcagacacacacauaua

SEQ ID NO: 189892 - RNA, 19 nt, Homo sapiens
ugacacguuuggccaguga

SEQ ID NO: 189893 - RNA, 19 nt, Homo sapiens
gcuuaccuguugucugaaa

SEQ ID NO: 189894 - RNA, 19 nt, Homo sapiens
cuacgacauucgccuaaga

SEQ ID NO: 189895 - RNA, 19 nt, Homo sapiens
acaagcagacacacacaua

SEQ ID NO: 189896 - RNA, 19 nt, Homo sapiens
gcaauauccuuugacaacu

SEQ ID NO: 189897 - RNA, 19 nt, Homo sapiens
ggcaaagaaugaccguuca

SEQ ID NO: 189898 - RNA, 19 nt, Homo sapiens
gaagaggaacauuggauac

SEQ ID NO: 189899 - RNA, 19 nt, Homo sapiens
cgucuggucucgaggaaug

SEQ ID NO: 189900 - RNA, 19 nt, Homo sapiens
ugaaugccauagacagaug

SEQ ID NO: 189901 - RNA, 19 nt, Homo sapiens
acagaagccucccgcacaa

SEQ ID NO: 189902 - RNA, 19 nt, Homo sapiens
ggaugcucauggaaauauu

SEQ ID NO: 189903 - RNA, 19 nt, Homo sapiens
uggacaagcuguugaaagg

SEQ ID NO: 189904 - RNA, 19 nt, Homo sapiens
gagaagggcaugggcgauu

SEQ ID NO: 189905 - RNA, 19 nt, Homo sapiens
ggaauucagcaauauccuu

SEQ ID NO: 189906 - RNA, 19 nt, Homo sapiens
cagaagaagcuugcagaaa

SEQ ID NO: 189907 - RNA, 19 nt, Homo sapiens
uagacgcaaccuuaacuua

SEQ ID NO: 189908 - RNA, 19 nt, Homo sapiens
ugaaggagacgguggacaa

SEQ ID NO: 189909 - RNA, 19 nt, Homo sapiens
ccacaggaugcauauuaaa

SEQ ID NO: 189910 - RNA, 19 nt, Homo sapiens
uaccugaucuaaccgaugu

SEQ ID NO: 189911 - RNA, 19 nt, Homo sapiens
cagccaaggcaaagaauga

SEQ ID NO: 189912 - RNA, 19 nt, Homo sapiens
gacagcagcaugcaugaug

SEQ ID NO: 189913 - RNA, 19 nt, Homo sapiens
acacuucuacuguucaauu

SEQ ID NO: 189914 - RNA, 19 nt, Homo sapiens
ggaagacaaauacacauac

SEQ ID NO: 189915 - RNA, 19 nt, Homo sapiens
ugugaacuuucucagcaua

SEQ ID NO: 189916 - RNA, 19 nt, Homo sapiens
caacauggauuauaccuua

SEQ ID NO: 189917 - RNA, 19 nt, Homo sapiens
ccaaaugugucuuguauua

SEQ ID NO: 189918 - RNA, 19 nt, Homo sapiens
gaacugcacucuggaaauu

SEQ ID NO: 189919 - RNA, 19 nt, Homo sapiens
ggacaaguaucaucuaaau

SEQ ID NO: 189920 - RNA, 19 nt, Homo sapiens
gcauagacgucucagguua

SEQ ID NO: 189921 - RNA, 19 nt, Homo sapiens
gaaauauucuguugacauc

SEQ ID NO: 189922 - RNA, 19 nt, Homo sapiens
ucacugagcuuucgguuga

SEQ ID NO: 189923 - RNA, 19 nt, Homo sapiens
gauuauaccuuaaccaugu

SEQ ID NO: 189924 - RNA, 19 nt, Homo sapiens
ggauugagcucccgcaguu

SEQ ID NO: 189925 - RNA, 19 nt, Homo sapiens
caacaauauuggagagaua

SEQ ID NO: 189926 - RNA, 19 nt, Homo sapiens
gcagugugcuuaccuguug

SEQ ID NO: 189927 - RNA, 19 nt, Homo sapiens
gaacauguccuuugugaag

SEQ ID NO: 189928 - RNA, 19 nt, Homo sapiens
gugcuuaccuguugucuga

SEQ ID NO: 189929 - RNA, 19 nt, Homo sapiens
ggauguauguguauauguu

SEQ ID NO: 189930 - RNA, 19 nt, Homo sapiens
gaacauuggauacuucauu

SEQ ID NO: 189931 - RNA, 19 nt, Homo sapiens
gcaguuauguuaucauucu

SEQ ID NO: 189932 - RNA, 19 nt, Homo sapiens
gaagacaaauacacauaca

SEQ ID NO: 189933 - RNA, 19 nt, Homo sapiens
ugacaucgcuggaaguuca

SEQ ID NO: 189934 - RNA, 19 nt, Homo sapiens
gggaacauguccuuuguga

SEQ ID NO: 189935 - RNA, 19 nt, Homo sapiens
cgucucagguuauucguua

SEQ ID NO: 189936 - RNA, 19 nt, Homo sapiens
gaagucaacauggauuaua

SEQ ID NO: 189937 - RNA, 19 nt, Homo sapiens
gcagacacacacauauaua

SEQ ID NO: 189938 - RNA, 19 nt, Homo sapiens
uauuaugccuugagaauga

SEQ ID NO: 189939 - RNA, 19 nt, Homo sapiens
ugaauggcaucucguugua

SEQ ID NO: 189940 - RNA, 19 nt, Homo sapiens
agacuuauaugcccucuau

SEQ ID NO: 189941 - RNA, 19 nt, Homo sapiens
gaaucauccucaugccuuu

SEQ ID NO: 189942 - RNA, 19 nt, Homo sapiens
uaccaggaauucagcaaua

SEQ ID NO: 189943 - RNA, 19 nt, Homo sapiens
ggauccagcuucacuguca

SEQ ID NO: 189944 - RNA, 19 nt, Homo sapiens
gaacgaccgucuuuugaaa

SEQ ID NO: 189945 - RNA, 19 nt, Homo sapiens
gcuguacuauguuaacuga

SEQ ID NO: 189946 - RNA, 19 nt, Homo sapiens
gaauucagcaauauccuuu

SEQ ID NO: 189947 - RNA, 19 nt, Homo sapiens
cuacaucucguauggauuu

SEQ ID NO: 189948 - RNA, 19 nt, Homo sapiens
agaagaagcuugcagaaaa

SEQ ID NO: 189949 - RNA, 19 nt, Homo sapiens
gcacauccaacuacuccua

SEQ ID NO: 189950 - RNA, 19 nt, Homo sapiens
gaggaacauuggauacuuc

SEQ ID NO: 189951 - RNA, 19 nt, Homo sapiens
ugauggaccucaggagaua

SEQ ID NO: 189952 - RNA, 19 nt, Homo sapiens
ggccugauauccaacagaa

SEQ ID NO: 189953 - RNA, 19 nt, Homo sapiens
uaccacaggaugcauauua

SEQ ID NO: 189954 - RNA, 19 nt, Homo sapiens
cgacaugguuuccgaaguc

SEQ ID NO: 189955 - RNA, 19 nt, Homo sapiens
cgaacacagugacacguuu

SEQ ID NO: 189956 - RNA, 19 nt, Homo sapiens
uugcagcuauggacaauuu

SEQ ID NO: 189957 - RNA, 19 nt, Homo sapiens
ggaaauauucuguugacau

SEQ ID NO: 189958 - RNA, 19 nt, Homo sapiens
gcccgacacauauuucuua

SEQ ID NO: 189959 - RNA, 19 nt, Homo sapiens
uuucauagacgcaaccuua

SEQ ID NO: 189960 - RNA, 19 nt, Homo sapiens
cguuguaaguacucuaaua

SEQ ID NO: 189961 - RNA, 19 nt, Homo sapiens
ggaugcauauuaaagaaag

SEQ ID NO: 189962 - RNA, 19 nt, Homo sapiens
caggaugcauauuaaagaa

SEQ ID NO: 189963 - RNA, 19 nt, Homo sapiens
gaggauguauguguauaug

SEQ ID NO: 189964 - RNA, 19 nt, Homo sapiens
gagugacuguacuugauuu

SEQ ID NO: 189965 - RNA, 19 nt, Homo sapiens
guugaaaggcuacgacauu

SEQ ID NO: 189966 - RNA, 19 nt, Homo sapiens
agacuucauuuaacacuga

SEQ ID NO: 189967 - RNA, 19 nt, Homo sapiens
gaacacagugacacguuug

SEQ ID NO: 189968 - RNA, 19 nt, Homo sapiens
cauauccucucguucaguu

SEQ ID NO: 189969 - RNA, 19 nt, Homo sapiens
ccauugacauguaccuuau

SEQ ID NO: 189970 - RNA, 19 nt, Homo sapiens
agcaugcgaugucauauuu

SEQ ID NO: 189971 - RNA, 19 nt, Homo sapiens
ugaacuuucucagcauaua

SEQ ID NO: 189972 - RNA, 19 nt, Homo sapiens
gguggaugcucauggaaau

SEQ ID NO: 189973 - RNA, 19 nt, Homo sapiens
ugauguaacuacuuucugu

SEQ ID NO: 189974 - RNA, 19 nt, Homo sapiens
guaguuuguuucuguuguu

SEQ ID NO: 189975 - RNA, 19 nt, Homo sapiens
gaaagggacaaguaucauc

SEQ ID NO: 189976 - RNA, 19 nt, Homo sapiens
uaauugaaagggacaagua

SEQ ID NO: 189977 - RNA, 19 nt, Homo sapiens
caacugugcugacaaugac

SEQ ID NO: 189978 - RNA, 19 nt, Homo sapiens
gaacuuucucagcauauau

SEQ ID NO: 189979 - RNA, 19 nt, Homo sapiens
cuucacagcucaaaauuaa

SEQ ID NO: 189980 - RNA, 19 nt, Homo sapiens
ucauggaaauauucuguug

SEQ ID NO: 189981 - RNA, 19 nt, Homo sapiens
gccauugacauguaccuua

SEQ ID NO: 189982 - RNA, 19 nt, Homo sapiens
caaaauccccuaugucaaa

SEQ ID NO: 189983 - RNA, 19 nt, Homo sapiens
ugaagaggaacauuggaua

SEQ ID NO: 189984 - RNA, 19 nt, Homo sapiens
cggaugacauugaguuuua

SEQ ID NO: 189985 - RNA, 19 nt, Homo sapiens
ccucaugccuuuauuucug

SEQ ID NO: 189986 - RNA, 19 nt, Homo sapiens
aagaaugaccguucaaaga

SEQ ID NO: 189987 - RNA, 19 nt, Homo sapiens
caucucguauggauuucua

SEQ ID NO: 189988 - RNA, 19 nt, Homo sapiens
gcacaagaagacccaucua

SEQ ID NO: 189989 - RNA, 19 nt, Homo sapiens
caaagaaugaccguucaaa

SEQ ID NO: 189990 - RNA, 19 nt, Homo sapiens
gcagaagaagcuugcagaa

SEQ ID NO: 189991 - RNA, 19 nt, Homo sapiens
aagcagacacacacauaua

SEQ ID NO: 189992 - RNA, 19 nt, Homo sapiens
ugacacguuuggccaguga

SEQ ID NO: 189993 - RNA, 19 nt, Homo sapiens
gcuuaccuguugucugaaa

SEQ ID NO: 189994 - RNA, 19 nt, Homo sapiens
acaagcagacacacacaua

SEQ ID NO: 189995 - RNA, 19 nt, Homo sapiens
gcaauauccuuugacaacu

SEQ ID NO: 189996 - RNA, 19 nt, Homo sapiens
cuacgacauucgccuaaga

SEQ ID NO: 189997 - RNA, 19 nt, Homo sapiens
ggcaaagaaugaccguuca

SEQ ID NO: 189998 - RNA, 19 nt, Homo sapiens
gaagaggaacauuggauac

SEQ ID NO: 189999 - RNA, 19 nt, Homo sapiens
cgucuggucucgaggaaug

SEQ ID NO: 190000 - RNA, 19 nt, Homo sapiens
ugaaugccauagacagaug

SEQ ID NO: 190001 - RNA, 19 nt, Homo sapiens
acagaagccucccgcacaa

SEQ ID NO: 190002 - RNA, 19 nt, Homo sapiens
ggaugcucauggaaauauu

SEQ ID NO: 190003 - RNA, 19 nt, Homo sapiens
uggacaagcuguugaaagg

SEQ ID NO: 190004 - RNA, 19 nt, Homo sapiens
gagaagggcaugggcgauu

SEQ ID NO: 190005 - RNA, 19 nt, Homo sapiens
ggaauucagcaauauccuu

SEQ ID NO: 190006 - RNA, 19 nt, Homo sapiens
cagaagaagcuugcagaaa

SEQ ID NO: 190007 - RNA, 19 nt, Homo sapiens
uagacgcaaccuuaacuua

SEQ ID NO: 190008 - RNA, 19 nt, Homo sapiens
ccacaggaugcauauuaaa

SEQ ID NO: 190009 - RNA, 19 nt, Homo sapiens
uaccugaucuaaccgaugu

SEQ ID NO: 190010 - RNA, 19 nt, Homo sapiens
cagccaaggcaaagaauga

SEQ ID NO: 190011 - RNA, 19 nt, Homo sapiens
ugaaggagacgguggacaa

SEQ ID NO: 190012 - RNA, 19 nt, Homo sapiens
gacagcagcaugcaugaug

SEQ ID NO: 190013 - RNA, 19 nt, Homo sapiens
acacuucuacuguucaauu

SEQ ID NO: 190014 - RNA, 19 nt, Homo sapiens
ggaagacaaauacacauac

SEQ ID NO: 190015 - RNA, 19 nt, Homo sapiens
gaacgaucccgggaacaug

SEQ ID NO: 190016 - RNA, 19 nt, Homo sapiens
ccacggagcugaugaacuu

SEQ ID NO: 190017 - RNA, 19 nt, Homo sapiens
acauggaccuggccaaaua

SEQ ID NO: 190018 - RNA, 19 nt, Homo sapiens
cagacaccauugacauuua

SEQ ID NO: 190019 - RNA, 19 nt, Homo sapiens
gaacgccauuguccucuuc

SEQ ID NO: 190020 - RNA, 19 nt, Homo sapiens
caaguccgcuggccaguuc

SEQ ID NO: 190021 - RNA, 19 nt, Homo sapiens
gcagacaccauugacauuu

SEQ ID NO: 190022 - RNA, 19 nt, Homo sapiens
cggaggacaucgucuacua

SEQ ID NO: 190023 - RNA, 19 nt, Homo sapiens
ucaaggcacuggacgucua

SEQ ID NO: 190024 - RNA, 19 nt, Homo sapiens
gcaccagagcgaugaauga

SEQ ID NO: 190025 - RNA, 19 nt, Homo sapiens
ugaaugacaucggcgacua

SEQ ID NO: 190026 - RNA, 19 nt, Homo sapiens
ccagagcgaugaaugacau

SEQ ID NO: 190027 - RNA, 19 nt, Homo sapiens
ggagagcuacgguuacuca

SEQ ID NO: 190028 - RNA, 19 nt, Homo sapiens
ggaacgccauuguccucuu

SEQ ID NO: 190029 - RNA, 19 nt, Homo sapiens
gaguacgccuuugcucauu

SEQ ID NO: 190030 - RNA, 19 nt, Homo sapiens
acagcaggcucuccuacaa

SEQ ID NO: 190031 - RNA, 19 nt, Homo sapiens
caaccuggacgggcugaua

SEQ ID NO: 190032 - RNA, 19 nt, Homo sapiens
guacgccuuugcucauuuc

SEQ ID NO: 190033 - RNA, 19 nt, Homo sapiens
cagcaucgaccacaucuca

SEQ ID NO: 190034 - RNA, 19 nt, Homo sapiens
gcguguacaucauccaauc

SEQ ID NO: 190035 - RNA, 19 nt, Homo sapiens
ggaguacgccuuugcucau

SEQ ID NO: 190036 - RNA, 19 nt, Homo sapiens
caucgacgcagacaccauu

SEQ ID NO: 190037 - RNA, 19 nt, Homo sapiens
cgacauggaccuggccaaa

SEQ ID NO: 190038 - RNA, 19 nt, Homo sapiens
gcaucgaccacaucucaga

SEQ ID NO: 190039 - RNA, 19 nt, Homo sapiens
gcacuggacgucuacuucu

SEQ ID NO: 190040 - RNA, 19 nt, Homo sapiens
ggaaccugaugggcuccua

SEQ ID NO: 190041 - RNA, 19 nt, Homo sapiens
gcagaaggccaaggucaag

SEQ ID NO: 190042 - RNA, 19 nt, Homo sapiens
ccacgggcaucagccauca

SEQ ID NO: 190043 - RNA, 19 nt, Homo sapiens
ccacggugcugacgaugac

SEQ ID NO: 190044 - RNA, 19 nt, Homo sapiens
caucggaggacaucgucua

SEQ ID NO: 190045 - RNA, 19 nt, Homo sapiens
ggccgucaaugucaucuac

SEQ ID NO: 190046 - RNA, 19 nt, Homo sapiens
ucucagaggccaacaugga

SEQ ID NO: 190047 - RNA, 19 nt, Homo sapiens
caucauccaauccuacaug

SEQ ID NO: 190048 - RNA, 19 nt, Homo sapiens
ggacgugaggaacgccauu

SEQ ID NO: 190049 - RNA, 19 nt, Homo sapiens
agacaccauugacauuuac

SEQ ID NO: 190050 - RNA, 19 nt, Homo sapiens
cagaggccaacauggagua

SEQ ID NO: 190051 - RNA, 19 nt, Homo sapiens
caucucagaggccaacaug

SEQ ID NO: 190052 - RNA, 19 nt, Homo sapiens
gcgacuacgugggcuccaa

SEQ ID NO: 190053 - RNA, 19 nt, Homo sapiens
ccgacggcgugauccugua

SEQ ID NO: 190054 - RNA, 19 nt, Homo sapiens
aguacgccuuugcucauuu

SEQ ID NO: 190055 - RNA, 19 nt, Homo sapiens
caucaccagcuaccacuuc

SEQ ID NO: 190056 - RNA, 19 nt, Homo sapiens
ggaggacaucgucuacuac

SEQ ID NO: 190057 - RNA, 19 nt, Homo sapiens
ugcuggaccuggagagcua

SEQ ID NO: 190058 - RNA, 19 nt, Homo sapiens
gacauggaccuggccaaau

SEQ ID NO: 190059 - RNA, 19 nt, Homo sapiens
uguguucccugcggcguuu

SEQ ID NO: 190060 - RNA, 19 nt, Homo sapiens
gacagcaggcucuccuaca

SEQ ID NO: 190061 - RNA, 19 nt, Homo sapiens
gaaugacaucggcgacuac

SEQ ID NO: 190062 - RNA, 19 nt, Homo sapiens
gacgucuacuucuggaucu

SEQ ID NO: 190063 - RNA, 19 nt, Homo sapiens
gaaacaaagucaacugaga

SEQ ID NO: 190064 - RNA, 19 nt, Homo sapiens
gauuggagcuucaugauag

SEQ ID NO: 190065 - RNA, 19 nt, Homo sapiens
gaaauguuguccaaaguuc

SEQ ID NO: 190066 - RNA, 19 nt, Homo sapiens
gaauggcgaccucucuuua

SEQ ID NO: 190067 - RNA, 19 nt, Homo sapiens
acacuauccugaguaauua

SEQ ID NO: 190068 - RNA, 19 nt, Homo sapiens
ggaguucuaucacuugcuu

SEQ ID NO: 190069 - RNA, 19 nt, Homo sapiens
gaagcccacuauugccuuu

SEQ ID NO: 190070 - RNA, 19 nt, Homo sapiens
ugaacacuauccugaguaa

SEQ ID NO: 190071 - RNA, 19 nt, Homo sapiens
ccagacaauuacugcauuu

SEQ ID NO: 190072 - RNA, 19 nt, Homo sapiens
ugaaaucugugucuguaau

SEQ ID NO: 190073 - RNA, 19 nt, Homo sapiens
ggaaauguuguccaaaguu

SEQ ID NO: 190074 - RNA, 19 nt, Homo sapiens
ggacagcauuccucucucu

SEQ ID NO: 190075 - RNA, 19 nt, Homo sapiens
gcugaccaccagacaauua

SEQ ID NO: 190076 - RNA, 19 nt, Homo sapiens
cggauuagcuaucuuccaa

SEQ ID NO: 190077 - RNA, 19 nt, Homo sapiens
gggaucaccucuguucuga

SEQ ID NO: 190078 - RNA, 19 nt, Homo sapiens
gaguaauuaugaccacaaa

SEQ ID NO: 190079 - RNA, 19 nt, Homo sapiens
gcagcaagagagccuauuu

SEQ ID NO: 190080 - RNA, 19 nt, Homo sapiens
cauuaucccuuuaggaaga

SEQ ID NO: 190081 - RNA, 19 nt, Homo sapiens
ucacagccuuggauuucua

SEQ ID NO: 190082 - RNA, 19 nt, Homo sapiens
guauggcacuggaacuuug

SEQ ID NO: 190083 - RNA, 19 nt, Homo sapiens
ucaaugcccuucauccaau

SEQ ID NO: 190084 - RNA, 19 nt, Homo sapiens
acacuggcauuaucccuuu

SEQ ID NO: 190085 - RNA, 19 nt, Homo sapiens
gcggaaauguuguccaaag

SEQ ID NO: 190086 - RNA, 19 nt, Homo sapiens
guaacuacucccugcuuua

SEQ ID NO: 190087 - RNA, 19 nt, Homo sapiens
gaaaucugugucuguaauu

SEQ ID NO: 190088 - RNA, 19 nt, Homo sapiens
ggaucucacuggaagcuau

SEQ ID NO: 190089 - RNA, 19 nt, Homo sapiens
gaaacucggcuuugcaaca

SEQ ID NO: 190090 - RNA, 19 nt, Homo sapiens
caaagugcaccgacuaguu

SEQ ID NO: 190091 - RNA, 19 nt, Homo sapiens
gcagaggguuugucuuugc

SEQ ID NO: 190092 - RNA, 19 nt, Homo sapiens
ccgcgugucuccuauauca

SEQ ID NO: 190093 - RNA, 19 nt, Homo sapiens
gcuucuauaugcuaaguga

SEQ ID NO: 190094 - RNA, 19 nt, Homo sapiens
ggcauuaucccuuuaggaa

SEQ ID NO: 190095 - RNA, 19 nt, Homo sapiens
gauuagcuaucuuccaaca

SEQ ID NO: 190096 - RNA, 19 nt, Homo sapiens
ggaauacaccauugacauc

SEQ ID NO: 190097 - RNA, 19 nt, Homo sapiens
ccaccucccucuucuucaa

SEQ ID NO: 190098 - RNA, 19 nt, Homo sapiens
gcauuacucgccauugauu

SEQ ID NO: 190099 - RNA, 19 nt, Homo sapiens
ccaagaaacuaaggaaacu

SEQ ID NO: 190100 - RNA, 19 nt, Homo sapiens
uuagcuaucuuccaacaau

SEQ ID NO: 190101 - RNA, 19 nt, Homo sapiens
cuaaaaccaugccuaagua

SEQ ID NO: 190102 - RNA, 19 nt, Homo sapiens
ccaguggaaugaauuugga

SEQ ID NO: 190103 - RNA, 19 nt, Homo sapiens
gcaggagcgacuagaguuu

SEQ ID NO: 190104 - RNA, 19 nt, Homo sapiens
gcaagcguuuuaagaagua

SEQ ID NO: 190105 - RNA, 19 nt, Homo sapiens
guaguaacccaguggaaug

SEQ ID NO: 190106 - RNA, 19 nt, Homo sapiens
cgaccucucuuuagcucaa

SEQ ID NO: 190107 - RNA, 19 nt, Homo sapiens
gugcucuacuggcuuguuu

SEQ ID NO: 190108 - RNA, 19 nt, Homo sapiens
ucaacuuccugaucuacaa

SEQ ID NO: 190109 - RNA, 19 nt, Homo sapiens
caacgacaccuuugagucu

SEQ ID NO: 190110 - RNA, 19 nt, Homo sapiens
gaaauggggaaauauguaa

SEQ ID NO: 190111 - RNA, 19 nt, Homo sapiens
uaacuacucccugcuuuau

SEQ ID NO: 190112 - RNA, 19 nt, Homo sapiens
gaauacaccauugacauca

SEQ ID NO: 190113 - RNA, 19 nt, Homo sapiens
agugaaaucugugucugua

SEQ ID NO: 190114 - RNA, 19 nt, Homo sapiens
caaugcuucuauaugcuaa

SEQ ID NO: 190115 - RNA, 19 nt, Homo sapiens
cagacugaaucaaagaaug

SEQ ID NO: 190116 - RNA, 19 nt, Homo sapiens
aaagugcaccgacuaguug

SEQ ID NO: 190117 - RNA, 19 nt, Homo sapiens
caucugaaauggggaaaua

SEQ ID NO: 190118 - RNA, 19 nt, Homo sapiens
acuacucccugcuuuauau

SEQ ID NO: 190119 - RNA, 19 nt, Homo sapiens
ccaauucaaugcccuucau

SEQ ID NO: 190120 - RNA, 19 nt, Homo sapiens
ccuaaguacaggcggauua

SEQ ID NO: 190121 - RNA, 19 nt, Homo sapiens
gccaacaucaggaagcuuu

SEQ ID NO: 190122 - RNA, 19 nt, Homo sapiens
gugcucaacuuccugaucu

SEQ ID NO: 190123 - RNA, 19 nt, Homo sapiens
aaacuccgccauccucgua

SEQ ID NO: 190124 - RNA, 19 nt, Homo sapiens
acgaugcucuccuggguuu

SEQ ID NO: 190125 - RNA, 19 nt, Homo sapiens
gacgaacgccucuguuaca

SEQ ID NO: 190126 - RNA, 19 nt, Homo sapiens
guaacccaguggaaugaau

SEQ ID NO: 190127 - RNA, 19 nt, Homo sapiens
ccaugauucucuucuguca

SEQ ID NO: 190128 - RNA, 19 nt, Homo sapiens
caaguugugucugauugga

SEQ ID NO: 190129 - RNA, 19 nt, Homo sapiens
ccgcggaaauguuguccaa

SEQ ID NO: 190130 - RNA, 19 nt, Homo sapiens
aggcauuacucgccauuga

SEQ ID NO: 190131 - RNA, 19 nt, Homo sapiens
uaaggaaacucggcuuugc

SEQ ID NO: 190132 - RNA, 19 nt, Homo sapiens
cccagugacuuucuucuuc

SEQ ID NO: 190133 - RNA, 19 nt, Homo sapiens
aaacugcgcccuggcauug

SEQ ID NO: 190134 - RNA, 19 nt, Homo sapiens
ccaaugcuucuauaugcua

SEQ ID NO: 190135 - RNA, 19 nt, Homo sapiens
gcacacugucggaguucua

SEQ ID NO: 190136 - RNA, 19 nt, Homo sapiens
uagauagacacuggcauua

SEQ ID NO: 190137 - RNA, 19 nt, Homo sapiens
agacugaaucaaagaauga

SEQ ID NO: 190138 - RNA, 19 nt, Homo sapiens
caauggauucucacucuug

SEQ ID NO: 190139 - RNA, 19 nt, Homo sapiens
guaauuaugaccacaaacu

SEQ ID NO: 190140 - RNA, 19 nt, Homo sapiens
ggucuccgcggaaauguug

SEQ ID NO: 190141 - RNA, 19 nt, Homo sapiens
uaugcuaagugaaaucugu

SEQ ID NO: 190142 - RNA, 19 nt, Homo sapiens
ugucggaguucuaucacuu

SEQ ID NO: 190143 - RNA, 19 nt, Homo sapiens
cgucugcacuaccaauuca

SEQ ID NO: 190144 - RNA, 19 nt, Homo sapiens
ccuggcaccucauuaagau

SEQ ID NO: 190145 - RNA, 19 nt, Homo sapiens
ggaguuugcugugcucaac

SEQ ID NO: 190146 - RNA, 19 nt, Homo sapiens
aacacuauccugaguaauu

SEQ ID NO: 190147 - RNA, 19 nt, Homo sapiens
cuuuagggcaggauucuua

SEQ ID NO: 190148 - RNA, 19 nt, Homo sapiens
uugcagaggguuugucuuu

SEQ ID NO: 190149 - RNA, 19 nt, Homo sapiens
gccagauugucaccacuga

SEQ ID NO: 190150 - RNA, 19 nt, Homo sapiens
uaucacagccuuggauuuc

SEQ ID NO: 190151 - RNA, 19 nt, Homo sapiens
gcaggcgguuuggcuaugu

SEQ ID NO: 190152 - RNA, 19 nt, Homo sapiens
ccaauggauucucacucuu

SEQ ID NO: 190153 - RNA, 19 nt, Homo sapiens
caccaugauucucuucugu

SEQ ID NO: 190154 - RNA, 19 nt, Homo sapiens
cagcucaguucaccaugau

SEQ ID NO: 190155 - RNA, 19 nt, Homo sapiens
ugauuggagcuucaugaua

SEQ ID NO: 190156 - RNA, 19 nt, Homo sapiens
ucuguaacuuucccaguga

SEQ ID NO: 190157 - RNA, 19 nt, Homo sapiens
uuacaggagugagcaacaa

SEQ ID NO: 190158 - RNA, 19 nt, Homo sapiens
ugaaaucaaugagaagaac

SEQ ID NO: 190159 - RNA, 19 nt, Homo sapiens
guuuggcuauguugccuuu

SEQ ID NO: 190160 - RNA, 19 nt, Homo sapiens
acagcucaguucaccauga

SEQ ID NO: 190161 - RNA, 19 nt, Homo sapiens
gcacuaggccuuggugacu

SEQ ID NO: 190162 - RNA, 19 nt, Homo sapiens
caguauaacaggaggaaga

SEQ ID NO: 190163 - RNA, 19 nt, Homo sapiens
gagaagugcucaaaucaua

SEQ ID NO: 190164 - RNA, 19 nt, Homo sapiens
gaaacaaagucaacugaga

SEQ ID NO: 190165 - RNA, 19 nt, Homo sapiens
ccacagcgguguaaagaaa

SEQ ID NO: 190166 - RNA, 19 nt, Homo sapiens
gauuggagcuucaugauag

SEQ ID NO: 190167 - RNA, 19 nt, Homo sapiens
gaacauguauacagagaag

SEQ ID NO: 190168 - RNA, 19 nt, Homo sapiens
gaaauguuguccaaaguuc

SEQ ID NO: 190169 - RNA, 19 nt, Homo sapiens
gaauggcgaccucucuuua

SEQ ID NO: 190170 - RNA, 19 nt, Homo sapiens
acacuauccugaguaauua

SEQ ID NO: 190171 - RNA, 19 nt, Homo sapiens
gagaacauguauacagaga

SEQ ID NO: 190172 - RNA, 19 nt, Homo sapiens
ggaguucuaucacuugcuu

SEQ ID NO: 190173 - RNA, 19 nt, Homo sapiens
gaagcccacuauugccuuu

SEQ ID NO: 190174 - RNA, 19 nt, Homo sapiens
ugaacacuauccugaguaa

SEQ ID NO: 190175 - RNA, 19 nt, Homo sapiens
guguacagcugaugaguug

SEQ ID NO: 190176 - RNA, 19 nt, Homo sapiens
gcacuauccggacuucuaa

SEQ ID NO: 190177 - RNA, 19 nt, Homo sapiens
ccagacaauuacugcauuu

SEQ ID NO: 190178 - RNA, 19 nt, Homo sapiens
ugaaaucugugucuguaau

SEQ ID NO: 190179 - RNA, 19 nt, Homo sapiens
ggaaauguuguccaaaguu

SEQ ID NO: 190180 - RNA, 19 nt, Homo sapiens
ggacagcauuccucucucu

SEQ ID NO: 190181 - RNA, 19 nt, Homo sapiens
gcugaccaccagacaauua

SEQ ID NO: 190182 - RNA, 19 nt, Homo sapiens
cggauuagcuaucuuccaa

SEQ ID NO: 190183 - RNA, 19 nt, Homo sapiens
gggaucaccucuguucuga

SEQ ID NO: 190184 - RNA, 19 nt, Homo sapiens
gaguaauuaugaccacaaa

SEQ ID NO: 190185 - RNA, 19 nt, Homo sapiens
acagagaagugcucaaauc

SEQ ID NO: 190186 - RNA, 19 nt, Homo sapiens
gcagcaagagagccuauuu

SEQ ID NO: 190187 - RNA, 19 nt, Homo sapiens
cauuaucccuuuaggaaga

SEQ ID NO: 190188 - RNA, 19 nt, Homo sapiens
ucacagccuuggauuucua

SEQ ID NO: 190189 - RNA, 19 nt, Homo sapiens
guauggcacuggaacuuug

SEQ ID NO: 190190 - RNA, 19 nt, Homo sapiens
ucaaugcccuucauccaau

SEQ ID NO: 190191 - RNA, 19 nt, Homo sapiens
acacuggcauuaucccuuu

SEQ ID NO: 190192 - RNA, 19 nt, Homo sapiens
gcggaaauguuguccaaag

SEQ ID NO: 190193 - RNA, 19 nt, Homo sapiens
guaaagaaagccaaaucaa

SEQ ID NO: 190194 - RNA, 19 nt, Homo sapiens
guaacuacucccugcuuua

SEQ ID NO: 190195 - RNA, 19 nt, Homo sapiens
gaaaucugugucuguaauu

SEQ ID NO: 190196 - RNA, 19 nt, Homo sapiens
ggaucucacuggaagcuau

SEQ ID NO: 190197 - RNA, 19 nt, Homo sapiens
gaaacucggcuuugcaaca

SEQ ID NO: 190198 - RNA, 19 nt, Homo sapiens
caaagugcaccgacuaguu

SEQ ID NO: 190199 - RNA, 19 nt, Homo sapiens
gcagaggguuugucuuugc

SEQ ID NO: 190200 - RNA, 19 nt, Homo sapiens
ccgcgugucuccuauauca

SEQ ID NO: 190201 - RNA, 19 nt, Homo sapiens
gcucaaaucauaaguguac

SEQ ID NO: 190202 - RNA, 19 nt, Homo sapiens
gcuucuauaugcuaaguga

SEQ ID NO: 190203 - RNA, 19 nt, Homo sapiens
ggcauuaucccuuuaggaa

SEQ ID NO: 190204 - RNA, 19 nt, Homo sapiens
gauuagcuaucuuccaaca

SEQ ID NO: 190205 - RNA, 19 nt, Homo sapiens
ggaauacaccauugacauc

SEQ ID NO: 190206 - RNA, 19 nt, Homo sapiens
ucgagaacauguauacaga

SEQ ID NO: 190207 - RNA, 19 nt, Homo sapiens
ccaccucccucuucuucaa

SEQ ID NO: 190208 - RNA, 19 nt, Homo sapiens
uaaagaaagccaaaucaag

SEQ ID NO: 190209 - RNA, 19 nt, Homo sapiens
gcauuacucgccauugauu

SEQ ID NO: 190210 - RNA, 19 nt, Homo sapiens
ccaagaaacuaaggaaacu

SEQ ID NO: 190211 - RNA, 19 nt, Homo sapiens
uuagcuaucuuccaacaau

SEQ ID NO: 190212 - RNA, 19 nt, Homo sapiens
cuaaaaccaugccuaagua

SEQ ID NO: 190213 - RNA, 19 nt, Homo sapiens
ccaguggaaugaauuugga

SEQ ID NO: 190214 - RNA, 19 nt, Homo sapiens
gcaggagcgacuagaguuu

SEQ ID NO: 190215 - RNA, 19 nt, Homo sapiens
gcaagcguuuuaagaagua

SEQ ID NO: 190216 - RNA, 19 nt, Homo sapiens
gugcucaaaucauaagugu

SEQ ID NO: 190217 - RNA, 19 nt, Homo sapiens
guaguaacccaguggaaug

SEQ ID NO: 190218 - RNA, 19 nt, Homo sapiens
cgaccucucuuuagcucaa

SEQ ID NO: 190219 - RNA, 19 nt, Homo sapiens
gugcucuacuggcuuguuu

SEQ ID NO: 190220 - RNA, 19 nt, Homo sapiens
ucaacuuccugaucuacaa

SEQ ID NO: 190221 - RNA, 19 nt, Homo sapiens
caacgacaccuuugagucu

SEQ ID NO: 190222 - RNA, 19 nt, Homo sapiens
gaaauggggaaauauguaa

SEQ ID NO: 190223 - RNA, 19 nt, Homo sapiens
uaacuacucccugcuuuau

SEQ ID NO: 190224 - RNA, 19 nt, Homo sapiens
gaauacaccauugacauca

SEQ ID NO: 190225 - RNA, 19 nt, Homo sapiens
agugaaaucugugucugua

SEQ ID NO: 190226 - RNA, 19 nt, Homo sapiens
caaugcuucuauaugcuaa

SEQ ID NO: 190227 - RNA, 19 nt, Homo sapiens
aaagugcaccgacuaguug

SEQ ID NO: 190228 - RNA, 19 nt, Homo sapiens
cagacugaaucaaagaaug

SEQ ID NO: 190229 - RNA, 19 nt, Homo sapiens
gaccacagcgguguaaaga

SEQ ID NO: 190230 - RNA, 19 nt, Homo sapiens
caucugaaauggggaaaua

SEQ ID NO: 190231 - RNA, 19 nt, Homo sapiens
acuacucccugcuuuauau

SEQ ID NO: 190232 - RNA, 19 nt, Homo sapiens
ccaauucaaugcccuucau

SEQ ID NO: 190233 - RNA, 19 nt, Homo sapiens
ccuaaguacaggcggauua

SEQ ID NO: 190234 - RNA, 19 nt, Homo sapiens
gccaacaucaggaagcuuu

SEQ ID NO: 190235 - RNA, 19 nt, Homo sapiens
gugcucaacuuccugaucu

SEQ ID NO: 190236 - RNA, 19 nt, Homo sapiens
aaacuccgccauccucgua

SEQ ID NO: 190237 - RNA, 19 nt, Homo sapiens
acgaugcucuccuggguuu

SEQ ID NO: 190238 - RNA, 19 nt, Homo sapiens
gacgaacgccucuguuaca

SEQ ID NO: 190239 - RNA, 19 nt, Homo sapiens
guaacccaguggaaugaau

SEQ ID NO: 190240 - RNA, 19 nt, Homo sapiens
ccaugauucucuucuguca

SEQ ID NO: 190241 - RNA, 19 nt, Homo sapiens
caaguugugucugauugga

SEQ ID NO: 190242 - RNA, 19 nt, Homo sapiens
aggcauuacucgccauuga

SEQ ID NO: 190243 - RNA, 19 nt, Homo sapiens
uaaggaaacucggcuuugc

SEQ ID NO: 190244 - RNA, 19 nt, Homo sapiens
ccgcggaaauguuguccaa

SEQ ID NO: 190245 - RNA, 19 nt, Homo sapiens
cccagugacuuucuucuuc

SEQ ID NO: 190246 - RNA, 19 nt, Homo sapiens
gaagugcucaaaucauaag

SEQ ID NO: 190247 - RNA, 19 nt, Homo sapiens
aaacugcgcccuggcauug

SEQ ID NO: 190248 - RNA, 19 nt, Homo sapiens
ccaaugcuucuauaugcua

SEQ ID NO: 190249 - RNA, 19 nt, Homo sapiens
gcacacugucggaguucua

SEQ ID NO: 190250 - RNA, 19 nt, Homo sapiens
uagauagacacuggcauua

SEQ ID NO: 190251 - RNA, 19 nt, Homo sapiens
cagcugaugaguugucaaa

SEQ ID NO: 190252 - RNA, 19 nt, Homo sapiens
caauggauucucacucuug

SEQ ID NO: 190253 - RNA, 19 nt, Homo sapiens
guaauuaugaccacaaacu

SEQ ID NO: 190254 - RNA, 19 nt, Homo sapiens
agacugaaucaaagaauga

SEQ ID NO: 190255 - RNA, 19 nt, Homo sapiens
uaugcuaagugaaaucugu

SEQ ID NO: 190256 - RNA, 19 nt, Homo sapiens
ugucggaguucuaucacuu

SEQ ID NO: 190257 - RNA, 19 nt, Homo sapiens
ggucuccgcggaaauguug

SEQ ID NO: 190258 - RNA, 19 nt, Homo sapiens
cgucugcacuaccaauuca

SEQ ID NO: 190259 - RNA, 19 nt, Homo sapiens
ccuggcaccucauuaagau

SEQ ID NO: 190260 - RNA, 19 nt, Homo sapiens
cagagaagugcucaaauca

SEQ ID NO: 190261 - RNA, 19 nt, Homo sapiens
ggaguuugcugugcucaac

SEQ ID NO: 190262 - RNA, 19 nt, Homo sapiens
cuuuagggcaggauucuua

SEQ ID NO: 190263 - RNA, 19 nt, Homo sapiens
gagaagugcucaaaucaua

SEQ ID NO: 190264 - RNA, 19 nt, Homo sapiens
gaaacaaagucaacugaga

SEQ ID NO: 190265 - RNA, 19 nt, Homo sapiens
ccacagcgguguaaagaaa

SEQ ID NO: 190266 - RNA, 19 nt, Homo sapiens
gauuggagcuucaugauag

SEQ ID NO: 190267 - RNA, 19 nt, Homo sapiens
gaacauguauacagagaag

SEQ ID NO: 190268 - RNA, 19 nt, Homo sapiens
gaaauguuguccaaaguuc

SEQ ID NO: 190269 - RNA, 19 nt, Homo sapiens
gaauggcgaccucucuuua

SEQ ID NO: 190270 - RNA, 19 nt, Homo sapiens
acacuauccugaguaauua

SEQ ID NO: 190271 - RNA, 19 nt, Homo sapiens
gagaacauguauacagaga

SEQ ID NO: 190272 - RNA, 19 nt, Homo sapiens
ggaguucuaucacuugcuu

SEQ ID NO: 190273 - RNA, 19 nt, Homo sapiens
gaagcccacuauugccuuu

SEQ ID NO: 190274 - RNA, 19 nt, Homo sapiens
ugaacacuauccugaguaa

SEQ ID NO: 190275 - RNA, 19 nt, Homo sapiens
guguacagcugaugaguug

SEQ ID NO: 190276 - RNA, 19 nt, Homo sapiens
gcacuauccggacuucuaa

SEQ ID NO: 190277 - RNA, 19 nt, Homo sapiens
ccagacaauuacugcauuu

SEQ ID NO: 190278 - RNA, 19 nt, Homo sapiens
ugaaaucugugucuguaau

SEQ ID NO: 190279 - RNA, 19 nt, Homo sapiens
ggaaauguuguccaaaguu

SEQ ID NO: 190280 - RNA, 19 nt, Homo sapiens
ggacagcauuccucucucu

SEQ ID NO: 190281 - RNA, 19 nt, Homo sapiens
gcugaccaccagacaauua

SEQ ID NO: 190282 - RNA, 19 nt, Homo sapiens
cggauuagcuaucuuccaa

SEQ ID NO: 190283 - RNA, 19 nt, Homo sapiens
gggaucaccucuguucuga

SEQ ID NO: 190284 - RNA, 19 nt, Homo sapiens
gaguaauuaugaccacaaa

SEQ ID NO: 190285 - RNA, 19 nt, Homo sapiens
acagagaagugcucaaauc

SEQ ID NO: 190286 - RNA, 19 nt, Homo sapiens
gcagcaagagagccuauuu

SEQ ID NO: 190287 - RNA, 19 nt, Homo sapiens
cauuaucccuuuaggaaga

SEQ ID NO: 190288 - RNA, 19 nt, Homo sapiens
ucacagccuuggauuucua

SEQ ID NO: 190289 - RNA, 19 nt, Homo sapiens
guauggcacuggaacuuug

SEQ ID NO: 190290 - RNA, 19 nt, Homo sapiens
ucaaugcccuucauccaau

SEQ ID NO: 190291 - RNA, 19 nt, Homo sapiens
acacuggcauuaucccuuu

SEQ ID NO: 190292 - RNA, 19 nt, Homo sapiens
gcggaaauguuguccaaag

SEQ ID NO: 190293 - RNA, 19 nt, Homo sapiens
guaaagaaagccaaaucaa

SEQ ID NO: 190294 - RNA, 19 nt, Homo sapiens
guaacuacucccugcuuua

SEQ ID NO: 190295 - RNA, 19 nt, Homo sapiens
gaaaucugugucuguaauu

SEQ ID NO: 190296 - RNA, 19 nt, Homo sapiens
ggaucucacuggaagcuau

SEQ ID NO: 190297 - RNA, 19 nt, Homo sapiens
gaaacucggcuuugcaaca

SEQ ID NO: 190298 - RNA, 19 nt, Homo sapiens
caaagugcaccgacuaguu

SEQ ID NO: 190299 - RNA, 19 nt, Homo sapiens
gcagaggguuugucuuugc

SEQ ID NO: 190300 - RNA, 19 nt, Homo sapiens
ccgcgugucuccuauauca

SEQ ID NO: 190301 - RNA, 19 nt, Homo sapiens
gcucaaaucauaaguguac

SEQ ID NO: 190302 - RNA, 19 nt, Homo sapiens
gcuucuauaugcuaaguga

SEQ ID NO: 190303 - RNA, 19 nt, Homo sapiens
ggcauuaucccuuuaggaa

SEQ ID NO: 190304 - RNA, 19 nt, Homo sapiens
gauuagcuaucuuccaaca

SEQ ID NO: 190305 - RNA, 19 nt, Homo sapiens
ggaauacaccauugacauc

SEQ ID NO: 190306 - RNA, 19 nt, Homo sapiens
ucgagaacauguauacaga

SEQ ID NO: 190307 - RNA, 19 nt, Homo sapiens
ccaccucccucuucuucaa

SEQ ID NO: 190308 - RNA, 19 nt, Homo sapiens
uaaagaaagccaaaucaag

SEQ ID NO: 190309 - RNA, 19 nt, Homo sapiens
gcauuacucgccauugauu

SEQ ID NO: 190310 - RNA, 19 nt, Homo sapiens
ccaagaaacuaaggaaacu

SEQ ID NO: 190311 - RNA, 19 nt, Homo sapiens
uuagcuaucuuccaacaau

SEQ ID NO: 190312 - RNA, 19 nt, Homo sapiens
cuaaaaccaugccuaagua

SEQ ID NO: 190313 - RNA, 19 nt, Homo sapiens
ccaguggaaugaauuugga

SEQ ID NO: 190314 - RNA, 19 nt, Homo sapiens
gcaggagcgacuagaguuu

SEQ ID NO: 190315 - RNA, 19 nt, Homo sapiens
gcaagcguuuuaagaagua

SEQ ID NO: 190316 - RNA, 19 nt, Homo sapiens
gugcucaaaucauaagugu

SEQ ID NO: 190317 - RNA, 19 nt, Homo sapiens
guaguaacccaguggaaug

SEQ ID NO: 190318 - RNA, 19 nt, Homo sapiens
cgaccucucuuuagcucaa

SEQ ID NO: 190319 - RNA, 19 nt, Homo sapiens
gugcucuacuggcuuguuu

SEQ ID NO: 190320 - RNA, 19 nt, Homo sapiens
ucaacuuccugaucuacaa

SEQ ID NO: 190321 - RNA, 19 nt, Homo sapiens
gaaauggggaaauauguaa

SEQ ID NO: 190322 - RNA, 19 nt, Homo sapiens
uaacuacucccugcuuuau

SEQ ID NO: 190323 - RNA, 19 nt, Homo sapiens
gaauacaccauugacauca

SEQ ID NO: 190324 - RNA, 19 nt, Homo sapiens
agugaaaucugugucugua

SEQ ID NO: 190325 - RNA, 19 nt, Homo sapiens
caaugcuucuauaugcuaa

SEQ ID NO: 190326 - RNA, 19 nt, Homo sapiens
aaagugcaccgacuaguug

SEQ ID NO: 190327 - RNA, 19 nt, Homo sapiens
cagacugaaucaaagaaug

SEQ ID NO: 190328 - RNA, 19 nt, Homo sapiens
gaccacagcgguguaaaga

SEQ ID NO: 190329 - RNA, 19 nt, Homo sapiens
caucugaaauggggaaaua

SEQ ID NO: 190330 - RNA, 19 nt, Homo sapiens
acuacucccugcuuuauau

SEQ ID NO: 190331 - RNA, 19 nt, Homo sapiens
ccaauucaaugcccuucau

SEQ ID NO: 190332 - RNA, 19 nt, Homo sapiens
ccuaaguacaggcggauua

SEQ ID NO: 190333 - RNA, 19 nt, Homo sapiens
gccaacaucaggaagcuuu

SEQ ID NO: 190334 - RNA, 19 nt, Homo sapiens
gugcucaacuuccugaucu

SEQ ID NO: 190335 - RNA, 19 nt, Homo sapiens
aaacuccgccauccucgua

SEQ ID NO: 190336 - RNA, 19 nt, Homo sapiens
acgaugcucuccuggguuu

SEQ ID NO: 190337 - RNA, 19 nt, Homo sapiens
guaacccaguggaaugaau

SEQ ID NO: 190338 - RNA, 19 nt, Homo sapiens
ccaugauucucuucuguca

SEQ ID NO: 190339 - RNA, 19 nt, Homo sapiens
caaguugugucugauugga

SEQ ID NO: 190340 - RNA, 19 nt, Homo sapiens
aggcauuacucgccauuga

SEQ ID NO: 190341 - RNA, 19 nt, Homo sapiens
uaaggaaacucggcuuugc

SEQ ID NO: 190342 - RNA, 19 nt, Homo sapiens
ccgcggaaauguuguccaa

SEQ ID NO: 190343 - RNA, 19 nt, Homo sapiens
cccagugacuuucuucuuc

SEQ ID NO: 190344 - RNA, 19 nt, Homo sapiens
gaagugcucaaaucauaag

SEQ ID NO: 190345 - RNA, 19 nt, Homo sapiens
aaacugcgcccuggcauug

SEQ ID NO: 190346 - RNA, 19 nt, Homo sapiens
ccaaugcuucuauaugcua

SEQ ID NO: 190347 - RNA, 19 nt, Homo sapiens
gcacacugucggaguucua

SEQ ID NO: 190348 - RNA, 19 nt, Homo sapiens
uagauagacacuggcauua

SEQ ID NO: 190349 - RNA, 19 nt, Homo sapiens
cagcugaugaguugucaaa

SEQ ID NO: 190350 - RNA, 19 nt, Homo sapiens
caauggauucucacucuug

SEQ ID NO: 190351 - RNA, 19 nt, Homo sapiens
guaauuaugaccacaaacu

SEQ ID NO: 190352 - RNA, 19 nt, Homo sapiens
agacugaaucaaagaauga

SEQ ID NO: 190353 - RNA, 19 nt, Homo sapiens
uaugcuaagugaaaucugu

SEQ ID NO: 190354 - RNA, 19 nt, Homo sapiens
ugucggaguucuaucacuu

SEQ ID NO: 190355 - RNA, 19 nt, Homo sapiens
cgucugcacuaccaauuca

SEQ ID NO: 190356 - RNA, 19 nt, Homo sapiens
ccuggcaccucauuaagau

SEQ ID NO: 190357 - RNA, 19 nt, Homo sapiens
ggucuccgcggaaauguug

SEQ ID NO: 190358 - RNA, 19 nt, Homo sapiens
cagagaagugcucaaauca

SEQ ID NO: 190359 - RNA, 19 nt, Homo sapiens
ggaguuugcugugcucaac

SEQ ID NO: 190360 - RNA, 19 nt, Homo sapiens
cuuuagggcaggauucuua

SEQ ID NO: 190361 - RNA, 19 nt, Homo sapiens
uugcagaggguuugucuuu

SEQ ID NO: 190362 - RNA, 19 nt, Homo sapiens
gccagauugucaccacuga

SEQ ID NO: 190363 - RNA, 19 nt, Homo sapiens
gagaagugcucaaaucaua

SEQ ID NO: 190364 - RNA, 19 nt, Homo sapiens
gaaacaaagucaacugaga

SEQ ID NO: 190365 - RNA, 19 nt, Homo sapiens
gcagauggccuuuaacauu

SEQ ID NO: 190366 - RNA, 19 nt, Homo sapiens
ccacagcgguguaaagaaa

SEQ ID NO: 190367 - RNA, 19 nt, Homo sapiens
cagauggccuuuaacauuu

SEQ ID NO: 190368 - RNA, 19 nt, Homo sapiens
gauuggagcuucaugauag

SEQ ID NO: 190369 - RNA, 19 nt, Homo sapiens
ccaaagagcagcaagguuu

SEQ ID NO: 190370 - RNA, 19 nt, Homo sapiens
gaacauguauacagagaag

SEQ ID NO: 190371 - RNA, 19 nt, Homo sapiens
gaaauguuguccaaaguuc

SEQ ID NO: 190372 - RNA, 19 nt, Homo sapiens
gaauggcgaccucucuuua

SEQ ID NO: 190373 - RNA, 19 nt, Homo sapiens
acacuauccugaguaauua

SEQ ID NO: 190374 - RNA, 19 nt, Homo sapiens
gagaacauguauacagaga

SEQ ID NO: 190375 - RNA, 19 nt, Homo sapiens
ggccagcgcucagacauaa

SEQ ID NO: 190376 - RNA, 19 nt, Homo sapiens
agacauaaaugcccucuuc

SEQ ID NO: 190377 - RNA, 19 nt, Homo sapiens
caacaaaaccgcaaaauau

SEQ ID NO: 190378 - RNA, 19 nt, Homo sapiens
ucacaagccuaaucuguca

SEQ ID NO: 190379 - RNA, 19 nt, Homo sapiens
ggaguucuaucacuugcuu

SEQ ID NO: 190380 - RNA, 19 nt, Homo sapiens
gaagcccacuauugccuuu

SEQ ID NO: 190381 - RNA, 19 nt, Homo sapiens
ugaacacuauccugaguaa

SEQ ID NO: 190382 - RNA, 19 nt, Homo sapiens
guguacagcugaugaguug

SEQ ID NO: 190383 - RNA, 19 nt, Homo sapiens
gcuauuaccagucacaauu

SEQ ID NO: 190384 - RNA, 19 nt, Homo sapiens
gaaauucacaagccuaauc

SEQ ID NO: 190385 - RNA, 19 nt, Homo sapiens
gcacuauccggacuucuaa

SEQ ID NO: 190386 - RNA, 19 nt, Homo sapiens
ccagacaauuacugcauuu

SEQ ID NO: 190387 - RNA, 19 nt, Homo sapiens
ugaaaucugugucuguaau

SEQ ID NO: 190388 - RNA, 19 nt, Homo sapiens
ggaaauguuguccaaaguu

SEQ ID NO: 190389 - RNA, 19 nt, Homo sapiens
ggacagcauuccucucucu

SEQ ID NO: 190390 - RNA, 19 nt, Homo sapiens
gcugaccaccagacaauua

SEQ ID NO: 190391 - RNA, 19 nt, Homo sapiens
cggauuagcuaucuuccaa

SEQ ID NO: 190392 - RNA, 19 nt, Homo sapiens
gggaucaccucuguucuga

SEQ ID NO: 190393 - RNA, 19 nt, Homo sapiens
gaguaauuaugaccacaaa

SEQ ID NO: 190394 - RNA, 19 nt, Homo sapiens
gcagcaagguuuuaaagaa

SEQ ID NO: 190395 - RNA, 19 nt, Homo sapiens
acagagaagugcucaaauc

SEQ ID NO: 190396 - RNA, 19 nt, Homo sapiens
gcagcaagagagccuauuu

SEQ ID NO: 190397 - RNA, 19 nt, Homo sapiens
cauuaucccuuuaggaaga

SEQ ID NO: 190398 - RNA, 19 nt, Homo sapiens
ucacagccuuggauuucua

SEQ ID NO: 190399 - RNA, 19 nt, Homo sapiens
guauggcacuggaacuuug

SEQ ID NO: 190400 - RNA, 19 nt, Homo sapiens
ucaaugcccuucauccaau

SEQ ID NO: 190401 - RNA, 19 nt, Homo sapiens
acacuggcauuaucccuuu

SEQ ID NO: 190402 - RNA, 19 nt, Homo sapiens
guaaagaaagccaaaucaa

SEQ ID NO: 190403 - RNA, 19 nt, Homo sapiens
gcggaaauguuguccaaag

SEQ ID NO: 190404 - RNA, 19 nt, Homo sapiens
guaacuacucccugcuuua

SEQ ID NO: 190405 - RNA, 19 nt, Homo sapiens
gaaaucugugucuguaauu

SEQ ID NO: 190406 - RNA, 19 nt, Homo sapiens
ggaucucacuggaagcuau

SEQ ID NO: 190407 - RNA, 19 nt, Homo sapiens
gaaacucggcuuugcaaca

SEQ ID NO: 190408 - RNA, 19 nt, Homo sapiens
caaagugcaccgacuaguu

SEQ ID NO: 190409 - RNA, 19 nt, Homo sapiens
gcagaggguuugucuuugc

SEQ ID NO: 190410 - RNA, 19 nt, Homo sapiens
ccgcgugucuccuauauca

SEQ ID NO: 190411 - RNA, 19 nt, Homo sapiens
gcucaaaucauaaguguac

SEQ ID NO: 190412 - RNA, 19 nt, Homo sapiens
gcuucuauaugcuaaguga

SEQ ID NO: 190413 - RNA, 19 nt, Homo sapiens
ggcauuaucccuuuaggaa

SEQ ID NO: 190414 - RNA, 19 nt, Homo sapiens
gauuagcuaucuuccaaca

SEQ ID NO: 190415 - RNA, 19 nt, Homo sapiens
ggaauacaccauugacauc

SEQ ID NO: 190416 - RNA, 19 nt, Homo sapiens
ucgagaacauguauacaga

SEQ ID NO: 190417 - RNA, 19 nt, Homo sapiens
gucacugucuuauaauuug

SEQ ID NO: 190418 - RNA, 19 nt, Homo sapiens
ccaccucccucuucuucaa

SEQ ID NO: 190419 - RNA, 19 nt, Homo sapiens
uaaagaaagccaaaucaag

SEQ ID NO: 190420 - RNA, 19 nt, Homo sapiens
gcauuacucgccauugauu

SEQ ID NO: 190421 - RNA, 19 nt, Homo sapiens
ccaagaaacuaaggaaacu

SEQ ID NO: 190422 - RNA, 19 nt, Homo sapiens
uuagcuaucuuccaacaau

SEQ ID NO: 190423 - RNA, 19 nt, Homo sapiens
cuaaaaccaugccuaagua

SEQ ID NO: 190424 - RNA, 19 nt, Homo sapiens
ccaguggaaugaauuugga

SEQ ID NO: 190425 - RNA, 19 nt, Homo sapiens
gugcucaaaucauaagugu

SEQ ID NO: 190426 - RNA, 19 nt, Homo sapiens
gcaggagcgacuagaguuu

SEQ ID NO: 190427 - RNA, 19 nt, Homo sapiens
gcaagcguuuuaagaagua

SEQ ID NO: 190428 - RNA, 19 nt, Homo sapiens
gcagggcagagcuucauuu

SEQ ID NO: 190429 - RNA, 19 nt, Homo sapiens
guaguaacccaguggaaug

SEQ ID NO: 190430 - RNA, 19 nt, Homo sapiens
cgaccucucuuuagcucaa

SEQ ID NO: 190431 - RNA, 19 nt, Homo sapiens
gugcucuacuggcuuguuu

SEQ ID NO: 190432 - RNA, 19 nt, Homo sapiens
ucaacuuccugaucuacaa

SEQ ID NO: 190433 - RNA, 19 nt, Homo sapiens
caacgacaccuuugagucu

SEQ ID NO: 190434 - RNA, 19 nt, Homo sapiens
gaaauggggaaauauguaa

SEQ ID NO: 190435 - RNA, 19 nt, Homo sapiens
uaacuacucccugcuuuau

SEQ ID NO: 190436 - RNA, 19 nt, Homo sapiens
gaauacaccauugacauca

SEQ ID NO: 190437 - RNA, 19 nt, Homo sapiens
gcaaaauauucccacaauu

SEQ ID NO: 190438 - RNA, 19 nt, Homo sapiens
agugaaaucugugucugua

SEQ ID NO: 190439 - RNA, 19 nt, Homo sapiens
caaugcuucuauaugcuaa

SEQ ID NO: 190440 - RNA, 19 nt, Homo sapiens
aaagugcaccgacuaguug

SEQ ID NO: 190441 - RNA, 19 nt, Homo sapiens
gaccacagcgguguaaaga

SEQ ID NO: 190442 - RNA, 19 nt, Homo sapiens
cagacugaaucaaagaaug

SEQ ID NO: 190443 - RNA, 19 nt, Homo sapiens
caucugaaauggggaaaua

SEQ ID NO: 190444 - RNA, 19 nt, Homo sapiens
acuacucccugcuuuauau

SEQ ID NO: 190445 - RNA, 19 nt, Homo sapiens
ccaauucaaugcccuucau

SEQ ID NO: 190446 - RNA, 19 nt, Homo sapiens
ccuaaguacaggcggauua

SEQ ID NO: 190447 - RNA, 19 nt, Homo sapiens
gccaacaucaggaagcuuu

SEQ ID NO: 190448 - RNA, 19 nt, Homo sapiens
gugcucaacuuccugaucu

SEQ ID NO: 190449 - RNA, 19 nt, Homo sapiens
aaagagggacagcauagaa

SEQ ID NO: 190450 - RNA, 19 nt, Homo sapiens
cuuggcagauggccuuuaa

SEQ ID NO: 190451 - RNA, 19 nt, Homo sapiens
aaacuccgccauccucgua

SEQ ID NO: 190452 - RNA, 19 nt, Homo sapiens
acgaugcucuccuggguuu

SEQ ID NO: 190453 - RNA, 19 nt, Homo sapiens
gacgaacgccucuguuaca

SEQ ID NO: 190454 - RNA, 19 nt, Homo sapiens
cagcaagguuuuaaagaaa

SEQ ID NO: 190455 - RNA, 19 nt, Homo sapiens
guaacccaguggaaugaau

SEQ ID NO: 190456 - RNA, 19 nt, Homo sapiens
ccaugauucucuucuguca

SEQ ID NO: 190457 - RNA, 19 nt, Homo sapiens
ccgcggaaauguuguccaa

SEQ ID NO: 190458 - RNA, 19 nt, Homo sapiens
caaguugugucugauugga

SEQ ID NO: 190459 - RNA, 19 nt, Homo sapiens
aggcauuacucgccauuga

SEQ ID NO: 190460 - RNA, 19 nt, Homo sapiens
uaaggaaacucggcuuugc

SEQ ID NO: 190461 - RNA, 19 nt, Homo sapiens
cccagugacuuucuucuuc

SEQ ID NO: 190462 - RNA, 19 nt, Homo sapiens
gaagugcucaaaucauaag

SEQ ID NO: 190463 - RNA, 19 nt, Homo sapiens
ggaaggauaugacaauaaa

SEQ ID NO: 190464 - RNA, 19 nt, Homo sapiens
gcgaugaguucaccaaaua

SEQ ID NO: 190465 - RNA, 19 nt, Homo sapiens
ggucaugucugucuacuuu

SEQ ID NO: 190466 - RNA, 19 nt, Homo sapiens
ggagagaugucuguucuaa

SEQ ID NO: 190467 - RNA, 19 nt, Homo sapiens
gacagacguuugaaauuua

SEQ ID NO: 190468 - RNA, 19 nt, Homo sapiens
ugacagacguuugaaauuu

SEQ ID NO: 190469 - RNA, 19 nt, Homo sapiens
gaaaucugaugaugacuau

SEQ ID NO: 190470 - RNA, 19 nt, Homo sapiens
gaagcgaaguucuguugaa

SEQ ID NO: 190471 - RNA, 19 nt, Homo sapiens
cuacucgacuccuguauuu

SEQ ID NO: 190472 - RNA, 19 nt, Homo sapiens
gccagaacaucuuuaggua

SEQ ID NO: 190473 - RNA, 19 nt, Homo sapiens
gaauaaugcuacacaccuu

SEQ ID NO: 190474 - RNA, 19 nt, Homo sapiens
caucagaucaucaagcaua

SEQ ID NO: 190475 - RNA, 19 nt, Homo sapiens
gcgcaaaugugguaugaca

SEQ ID NO: 190476 - RNA, 19 nt, Homo sapiens
gaugaugacuaugaagauu

SEQ ID NO: 190477 - RNA, 19 nt, Homo sapiens
ccacuuaaauaauccucua

SEQ ID NO: 190478 - RNA, 19 nt, Homo sapiens
ccagugaacgcuaucaaua

SEQ ID NO: 190479 - RNA, 19 nt, Homo sapiens
ggagugaagccaacguuaa

SEQ ID NO: 190480 - RNA, 19 nt, Homo sapiens
gagauuauguggucauguc

SEQ ID NO: 190481 - RNA, 19 nt, Homo sapiens
gcgaaguucuguugaagug

SEQ ID NO: 190482 - RNA, 19 nt, Homo sapiens
gcagaagaaugggauacuu

SEQ ID NO: 190483 - RNA, 19 nt, Homo sapiens
ccuggaggcuuuaucaauu

SEQ ID NO: 190484 - RNA, 19 nt, Homo sapiens
caacguuaauucacacaga

SEQ ID NO: 190485 - RNA, 19 nt, Homo sapiens
caagcaaggacaaagauaa

SEQ ID NO: 190486 - RNA, 19 nt, Homo sapiens
cagaacaucuuuagguauc

SEQ ID NO: 190487 - RNA, 19 nt, Homo sapiens
gaugaguucaccaaauaua

SEQ ID NO: 190488 - RNA, 19 nt, Homo sapiens
agagaugucuguucuaagu

SEQ ID NO: 190489 - RNA, 19 nt, Homo sapiens
uguuuaaucuggucuauug

SEQ ID NO: 190490 - RNA, 19 nt, Homo sapiens
ucccuaagguugacaauug

SEQ ID NO: 190491 - RNA, 19 nt, Homo sapiens
gcaaaugugguaugacaga

SEQ ID NO: 190492 - RNA, 19 nt, Homo sapiens
agagagagaugaagaguac

SEQ ID NO: 190493 - RNA, 19 nt, Homo sapiens
ucuaugugguugauaagua

SEQ ID NO: 190494 - RNA, 19 nt, Homo sapiens
uauggcaccuugcauuauu

SEQ ID NO: 190495 - RNA, 19 nt, Homo sapiens
ggaaaucgcuccccaaggu

SEQ ID NO: 190496 - RNA, 19 nt, Homo sapiens
agacaugggaggauacaua

SEQ ID NO: 190497 - RNA, 19 nt, Homo sapiens
gaucagcaaccauucaaau

SEQ ID NO: 190498 - RNA, 19 nt, Homo sapiens
ucacagcgauggaucucuu

SEQ ID NO: 190499 - RNA, 19 nt, Homo sapiens
agaagaaugggauacuuua

SEQ ID NO: 190500 - RNA, 19 nt, Homo sapiens
ccaacaggaugcugagaau

SEQ ID NO: 190501 - RNA, 19 nt, Homo sapiens
ccauuaaaguccuccgauu

SEQ ID NO: 190502 - RNA, 19 nt, Homo sapiens
ucucugcucugguggagua

SEQ ID NO: 190503 - RNA, 19 nt, Homo sapiens
acaagauccuggaggcuuu

SEQ ID NO: 190504 - RNA, 19 nt, Homo sapiens
gcaagaggcgagagaagga

SEQ ID NO: 190505 - RNA, 19 nt, Homo sapiens
cgauggaucucuuuguauc

SEQ ID NO: 190506 - RNA, 19 nt, Homo sapiens
gaucaucaagcauaagaau

SEQ ID NO: 190507 - RNA, 19 nt, Homo sapiens
cagaagaaugggauacuuu

SEQ ID NO: 190508 - RNA, 19 nt, Homo sapiens
gaagugggcgacacaagau

SEQ ID NO: 190509 - RNA, 19 nt, Homo sapiens
gaaauuuaacagcaccauu

SEQ ID NO: 190510 - RNA, 19 nt, Homo sapiens
gguauggguuuuacugaua

SEQ ID NO: 190511 - RNA, 19 nt, Homo sapiens
gaaauaccaccgaaguagu

SEQ ID NO: 190512 - RNA, 19 nt, Homo sapiens
uaacagcaccauuaaaguc

SEQ ID NO: 190513 - RNA, 19 nt, Homo sapiens
ucacugucaucuuaaacaa

SEQ ID NO: 190514 - RNA, 19 nt, Homo sapiens
gcacaggaagcucagucua

SEQ ID NO: 190515 - RNA, 19 nt, Homo sapiens
caauaaggaugcuguucca

SEQ ID NO: 190516 - RNA, 19 nt, Homo sapiens
ucaugucugucuacuuuga

SEQ ID NO: 190517 - RNA, 19 nt, Homo sapiens
uaagaaauaccaccgaagu

SEQ ID NO: 190518 - RNA, 19 nt, Homo sapiens
gaacaggagcuuggagaca

SEQ ID NO: 190519 - RNA, 19 nt, Homo sapiens
gaguauggcaccuugcauu

SEQ ID NO: 190520 - RNA, 19 nt, Homo sapiens
cccaaggucuccuauguca

SEQ ID NO: 190521 - RNA, 19 nt, Homo sapiens
ggauaugacaauaaacuuc

SEQ ID NO: 190522 - RNA, 19 nt, Homo sapiens
ggucuugacuccaaaaguu

SEQ ID NO: 190523 - RNA, 19 nt, Homo sapiens
gagugaagccaacguuaau

SEQ ID NO: 190524 - RNA, 19 nt, Homo sapiens
acaaccugcuggaaggaua

SEQ ID NO: 190525 - RNA, 19 nt, Homo sapiens
gaagaguacggcuaugagu

SEQ ID NO: 190526 - RNA, 19 nt, Homo sapiens
caaggucuccuaugucaca

SEQ ID NO: 190527 - RNA, 19 nt, Homo sapiens
agugaacgcuaucaauaug

SEQ ID NO: 190528 - RNA, 19 nt, Homo sapiens
cuaugugguugauaaguau

SEQ ID NO: 190529 - RNA, 19 nt, Homo sapiens
gacaugggaggauacauau

SEQ ID NO: 190530 - RNA, 19 nt, Homo sapiens
ccaagcaaggacaaagaua

SEQ ID NO: 190531 - RNA, 19 nt, Homo sapiens
aacaggaugcugagaauuu

SEQ ID NO: 190532 - RNA, 19 nt, Homo sapiens
ugaacgcuaucaauaugga

SEQ ID NO: 190533 - RNA, 19 nt, Homo sapiens
gcucuacccuggcuucacu

SEQ ID NO: 190534 - RNA, 19 nt, Homo sapiens
gauccuggaggcuuuauca

SEQ ID NO: 190535 - RNA, 19 nt, Homo sapiens
ccacgugaagaaauuguuu

SEQ ID NO: 190536 - RNA, 19 nt, Homo sapiens
acaggaugcugagaauuug

SEQ ID NO: 190537 - RNA, 19 nt, Homo sapiens
aaucugaugaugacuauga

SEQ ID NO: 190538 - RNA, 19 nt, Homo sapiens
agcgauggaucucuuugua

SEQ ID NO: 190539 - RNA, 19 nt, Homo sapiens
ugaagugggcgacacaaga

SEQ ID NO: 190540 - RNA, 19 nt, Homo sapiens
uuaaaguccuccgauugaa

SEQ ID NO: 190541 - RNA, 19 nt, Homo sapiens
cauuaaaguccuccgauug

SEQ ID NO: 190542 - RNA, 19 nt, Homo sapiens
gcuacacaccuucaagaga

SEQ ID NO: 190543 - RNA, 19 nt, Homo sapiens
caagaucagcaaccauuca

SEQ ID NO: 190544 - RNA, 19 nt, Homo sapiens
aagcaaggacaaagauaaa

SEQ ID NO: 190545 - RNA, 19 nt, Homo sapiens
gaaaccaagcaaggacaaa

SEQ ID NO: 190546 - RNA, 19 nt, Homo sapiens
ggaaaccaagcaaggacaa

SEQ ID NO: 190547 - RNA, 19 nt, Homo sapiens
gugucuuucuggaucaaua

SEQ ID NO: 190548 - RNA, 19 nt, Homo sapiens
agacaacuuccggagauua

SEQ ID NO: 190549 - RNA, 19 nt, Homo sapiens
gaggcuuuaucaauucuca

SEQ ID NO: 190550 - RNA, 19 nt, Homo sapiens
uccagacacuuucuucaga

SEQ ID NO: 190551 - RNA, 19 nt, Homo sapiens
aauaaacuucggccugaua

SEQ ID NO: 190552 - RNA, 19 nt, Homo sapiens
agaaaucugaugaugacua

SEQ ID NO: 190553 - RNA, 19 nt, Homo sapiens
ggaagcgaaguucuguuga

SEQ ID NO: 190554 - RNA, 19 nt, Homo sapiens
cuauccacgugaagaaauu

SEQ ID NO: 190555 - RNA, 19 nt, Homo sapiens
gcugagaauuuggaaugau

SEQ ID NO: 190556 - RNA, 19 nt, Homo sapiens
gggagggauucuucugcaa

SEQ ID NO: 190557 - RNA, 19 nt, Homo sapiens
cuggaaggauaugacaaua

SEQ ID NO: 190558 - RNA, 19 nt, Homo sapiens
gcuggaaggauaugacaau

SEQ ID NO: 190559 - RNA, 19 nt, Homo sapiens
gaagaaugggauacuuuac

SEQ ID NO: 190560 - RNA, 19 nt, Homo sapiens
gacaacuuccggagauuau

SEQ ID NO: 190561 - RNA, 19 nt, Homo sapiens
aagaaauaccaccgaagua

SEQ ID NO: 190562 - RNA, 19 nt, Homo sapiens
cugagaauuuggaaugaug

SEQ ID NO: 190563 - RNA, 19 nt, Homo sapiens
gcucagaccuggacagaua

SEQ ID NO: 190564 - RNA, 19 nt, Homo sapiens
gaaagggcguauucacaua

SEQ ID NO: 190565 - RNA, 19 nt, Homo sapiens
ggaagaggaugaauaugaa

SEQ ID NO: 190566 - RNA, 19 nt, Homo sapiens
ggaggcagcugaccagaaa

SEQ ID NO: 190567 - RNA, 19 nt, Homo sapiens
gaagauaccugugucuaug

SEQ ID NO: 190568 - RNA, 19 nt, Homo sapiens
ggaaaauccuuuacacuuu

SEQ ID NO: 190569 - RNA, 19 nt, Homo sapiens
gcuaagagaguaugauaaa

SEQ ID NO: 190570 - RNA, 19 nt, Homo sapiens
gguccugugucaucaauaa

SEQ ID NO: 190571 - RNA, 19 nt, Homo sapiens
gauagucgccuucgauuca

SEQ ID NO: 190572 - RNA, 19 nt, Homo sapiens
ggaauaccaaauugacaua

SEQ ID NO: 190573 - RNA, 19 nt, Homo sapiens
caccugcgaugaucacuuu

SEQ ID NO: 190574 - RNA, 19 nt, Homo sapiens
gacaccaucuuccgcaauu

SEQ ID NO: 190575 - RNA, 19 nt, Homo sapiens
caauaaacauggaauacca

SEQ ID NO: 190576 - RNA, 19 nt, Homo sapiens
ccacagaaaucgugacaac

SEQ ID NO: 190577 - RNA, 19 nt, Homo sapiens
gaaaauccuuuacacuuug

SEQ ID NO: 190578 - RNA, 19 nt, Homo sapiens
ggaaagggcguauucacau

SEQ ID NO: 190579 - RNA, 19 nt, Homo sapiens
guaauugacguugacauuu

SEQ ID NO: 190580 - RNA, 19 nt, Homo sapiens
gaggaugaauaugaagauu

SEQ ID NO: 190581 - RNA, 19 nt, Homo sapiens
gaagagcauuugguacaca

SEQ ID NO: 190582 - RNA, 19 nt, Homo sapiens
ucuuggagcuggacucgua

SEQ ID NO: 190583 - RNA, 19 nt, Homo sapiens
guagaagaaugggauacuu

SEQ ID NO: 190584 - RNA, 19 nt, Homo sapiens
gcgaugaucacuuuaaaca

SEQ ID NO: 190585 - RNA, 19 nt, Homo sapiens
uggaagaggaugaauauga

SEQ ID NO: 190586 - RNA, 19 nt, Homo sapiens
gagugaagagcauuuggua

SEQ ID NO: 190587 - RNA, 19 nt, Homo sapiens
gguggaagaggaugaauau

SEQ ID NO: 190588 - RNA, 19 nt, Homo sapiens
ccagauuccucaagaugga

SEQ ID NO: 190589 - RNA, 19 nt, Homo sapiens
cagaaaucauggcggcuuu

SEQ ID NO: 190590 - RNA, 19 nt, Homo sapiens
uggcaggaauuugaagaua

SEQ ID NO: 190591 - RNA, 19 nt, Homo sapiens
ugaauugaguagaagaaug

SEQ ID NO: 190592 - RNA, 19 nt, Homo sapiens
cauggcggcuuuaucaguu

SEQ ID NO: 190593 - RNA, 19 nt, Homo sapiens
gaagauucaucaucaaacc

SEQ ID NO: 190594 - RNA, 19 nt, Homo sapiens
gauuuggaaugacgggaaa

SEQ ID NO: 190595 - RNA, 19 nt, Homo sapiens
cagcauugguccuguguca

SEQ ID NO: 190596 - RNA, 19 nt, Homo sapiens
gcaaagacugucagagcuu

SEQ ID NO: 190597 - RNA, 19 nt, Homo sapiens
gaauugaguagaagaaugg

SEQ ID NO: 190598 - RNA, 19 nt, Homo sapiens
gaaagguggaagaggauga

SEQ ID NO: 190599 - RNA, 19 nt, Homo sapiens
cgacgugacucuuauucuc

SEQ ID NO: 190600 - RNA, 19 nt, Homo sapiens
guacacacuugaccuucug

SEQ ID NO: 190601 - RNA, 19 nt, Homo sapiens
caacgucugcaggugauua

SEQ ID NO: 190602 - RNA, 19 nt, Homo sapiens
acaaguugcuaagagagua

SEQ ID NO: 190603 - RNA, 19 nt, Homo sapiens
gaagagugaagagcauuug

SEQ ID NO: 190604 - RNA, 19 nt, Homo sapiens
gaaaucauggcggcuuuau

SEQ ID NO: 190605 - RNA, 19 nt, Homo sapiens
ggaauaaaaccgaccguaa

SEQ ID NO: 190606 - RNA, 19 nt, Homo sapiens
ucagaaacaccacagaaau

SEQ ID NO: 190607 - RNA, 19 nt, Homo sapiens
aaucauggcggcuuuauca

SEQ ID NO: 190608 - RNA, 19 nt, Homo sapiens
gugaagagcauuugguaca

SEQ ID NO: 190609 - RNA, 19 nt, Homo sapiens
cguccuuccugcucuuuaa

SEQ ID NO: 190610 - RNA, 19 nt, Homo sapiens
gacaacgucugcaggugau

SEQ ID NO: 190611 - RNA, 19 nt, Homo sapiens
aaagacaacaucguuacua

SEQ ID NO: 190612 - RNA, 19 nt, Homo sapiens
acaccgacgugacucuuau

SEQ ID NO: 190613 - RNA, 19 nt, Homo sapiens
cagcugaccagaaaucaug

SEQ ID NO: 190614 - RNA, 19 nt, Homo sapiens
ugaagauaccugugucuau

SEQ ID NO: 190615 - RNA, 19 nt, Homo sapiens
gacaacaucguuacuacau

SEQ ID NO: 190616 - RNA, 19 nt, Homo sapiens
cagaaacaccacagaaauc

SEQ ID NO: 190617 - RNA, 19 nt, Homo sapiens
cgauucaacagcacaauga

SEQ ID NO: 190618 - RNA, 19 nt, Homo sapiens
ggcaggaauuugaagauac

SEQ ID NO: 190619 - RNA, 19 nt, Homo sapiens
cuauggcuaucccaaagaa

SEQ ID NO: 190620 - RNA, 19 nt, Homo sapiens
gacaccgacgugacucuua

SEQ ID NO: 190621 - RNA, 19 nt, Homo sapiens
cugcgaugaucacuuuaaa

SEQ ID NO: 190622 - RNA, 19 nt, Homo sapiens
ugacucuuauucucaacaa

SEQ ID NO: 190623 - RNA, 19 nt, Homo sapiens
cguaauugacguugacauu

SEQ ID NO: 190624 - RNA, 19 nt, Homo sapiens
gaauaaaaccgaccguaau

SEQ ID NO: 190625 - RNA, 19 nt, Homo sapiens
gguacacacuugaccuucu

SEQ ID NO: 190626 - RNA, 19 nt, Homo sapiens
ucccaaagaagaaaugauu

SEQ ID NO: 190627 - RNA, 19 nt, Homo sapiens
aacauggaauaccaaauug

SEQ ID NO: 190628 - RNA, 19 nt, Homo sapiens
gcauugguccugugucauc

SEQ ID NO: 190629 - RNA, 19 nt, Homo sapiens
cgaccguaauugacguuga

SEQ ID NO: 190630 - RNA, 19 nt, Homo sapiens
gcaggaauuugaagauacc

SEQ ID NO: 190631 - RNA, 19 nt, Homo sapiens
gugauuauguugucaugac

SEQ ID NO: 190632 - RNA, 19 nt, Homo sapiens
guauucacauagacaucuu

SEQ ID NO: 190633 - RNA, 19 nt, Homo sapiens
cugcugcuaugaagaaugu

SEQ ID NO: 190634 - RNA, 19 nt, Homo sapiens
gagcgaauaagccuacaag

SEQ ID NO: 190635 - RNA, 19 nt, Homo sapiens
ugggauacuucaccauuca

SEQ ID NO: 190636 - RNA, 19 nt, Homo sapiens
gaccaguagugaccaaucg

SEQ ID NO: 190637 - RNA, 19 nt, Homo sapiens
aagcugaggccagauauug

SEQ ID NO: 190638 - RNA, 19 nt, Homo sapiens
gcaggugauuauguuguca

SEQ ID NO: 190639 - RNA, 19 nt, Homo sapiens
gggaaaauccuuuacacuu

SEQ ID NO: 190640 - RNA, 19 nt, Homo sapiens
ugucaucaauaaacaugga

SEQ ID NO: 190641 - RNA, 19 nt, Homo sapiens
gauucaucaucaaaccaaa

SEQ ID NO: 190642 - RNA, 19 nt, Homo sapiens
ccacggugcugaccaugac

SEQ ID NO: 190643 - RNA, 19 nt, Homo sapiens
ugaagagugaagagcauuu

SEQ ID NO: 190644 - RNA, 19 nt, Homo sapiens
ucuuuaaccuggucuacug

SEQ ID NO: 190645 - RNA, 19 nt, Homo sapiens
gaauguaaaucaggauccu

SEQ ID NO: 190646 - RNA, 19 nt, Homo sapiens
gagcuucuucugcugcuau

SEQ ID NO: 190647 - RNA, 19 nt, Homo sapiens
cagauagucgccuucgauu

SEQ ID NO: 190648 - RNA, 19 nt, Homo sapiens
gcauuugguacacacuuga

SEQ ID NO: 190649 - RNA, 19 nt, Homo sapiens
uaaguguugcucagaguga

SEQ ID NO: 190650 - RNA, 19 nt, Homo sapiens
aagacaacaucguuacuac

SEQ ID NO: 190651 - RNA, 19 nt, Homo sapiens
gaaaaccaaccaccacgaa

SEQ ID NO: 190652 - RNA, 19 nt, Homo sapiens
gccagcaagaacagcauua

SEQ ID NO: 190653 - RNA, 19 nt, Homo sapiens
gaagaggaugaauaugaag

SEQ ID NO: 190654 - RNA, 19 nt, Homo sapiens
gaagaauguaaaucaggau

SEQ ID NO: 190655 - RNA, 19 nt, Homo sapiens
uaaaaccgaccguaauuga

SEQ ID NO: 190656 - RNA, 19 nt, Homo sapiens
gaccguaauugacguugac

SEQ ID NO: 190657 - RNA, 19 nt, Homo sapiens
acauccagauuccucaaga

SEQ ID NO: 190658 - RNA, 19 nt, Homo sapiens
uauacugacugugguuuua

SEQ ID NO: 190659 - RNA, 19 nt, Homo sapiens
gauuauguugucaugacua

SEQ ID NO: 190660 - RNA, 19 nt, Homo sapiens
uugcuaagagaguaugaua

SEQ ID NO: 190661 - RNA, 19 nt, Homo sapiens
ccucagaaacaccacagaa

SEQ ID NO: 190662 - RNA, 19 nt, Homo sapiens
gaucccagacaccaucuuc

SEQ ID NO: 190663 - RNA, 19 nt, Homo sapiens
ggaaauaucuguucugaaa

SEQ ID NO: 190664 - RNA, 19 nt, Homo sapiens
gcaaguaucucuagcauuu

SEQ ID NO: 190665 - RNA, 19 nt, Homo sapiens
ggaggaauguucuguauuu

SEQ ID NO: 190666 - RNA, 19 nt, Homo sapiens
gaugugaacugugaaauaa

SEQ ID NO: 190667 - RNA, 19 nt, Homo sapiens
gaaggacucugaggcuuua

SEQ ID NO: 190668 - RNA, 19 nt, Homo sapiens
gaacaaguggcuuagcuua

SEQ ID NO: 190669 - RNA, 19 nt, Homo sapiens
gcaggauuguugauuauuu

SEQ ID NO: 190670 - RNA, 19 nt, Homo sapiens
ggaaugaugcuuauuagaa

SEQ ID NO: 190671 - RNA, 19 nt, Homo sapiens
acauggaucugucuaaaua

SEQ ID NO: 190672 - RNA, 19 nt, Homo sapiens
ucaaugcacuaacucaaua

SEQ ID NO: 190673 - RNA, 19 nt, Homo sapiens
caugaaggcuugcagaauu

SEQ ID NO: 190674 - RNA, 19 nt, Homo sapiens
gggcuuaugucaauucauu

SEQ ID NO: 190675 - RNA, 19 nt, Homo sapiens
gagaugaaaugugguugua

SEQ ID NO: 190676 - RNA, 19 nt, Homo sapiens
gguaaaggcuuccaguuca

SEQ ID NO: 190677 - RNA, 19 nt, Homo sapiens
guagaagaagucaguauua

SEQ ID NO: 190678 - RNA, 19 nt, Homo sapiens
gaugaaaugugguuguaug

SEQ ID NO: 190679 - RNA, 19 nt, Homo sapiens
ccauuccucuuucaucuua

SEQ ID NO: 190680 - RNA, 19 nt, Homo sapiens
uaacauggaucugucuaaa

SEQ ID NO: 190681 - RNA, 19 nt, Homo sapiens
ccaguaauguugaucacua

SEQ ID NO: 190682 - RNA, 19 nt, Homo sapiens
auaaagaugugaacuguga

SEQ ID NO: 190683 - RNA, 19 nt, Homo sapiens
acacauccauccuaaacua

SEQ ID NO: 190684 - RNA, 19 nt, Homo sapiens
gagcugcccucuccaaauc

SEQ ID NO: 190685 - RNA, 19 nt, Homo sapiens
acaaaucccucgguucuaa

SEQ ID NO: 190686 - RNA, 19 nt, Homo sapiens
caacaggacaagauaauga

SEQ ID NO: 190687 - RNA, 19 nt, Homo sapiens
gagagucgcugucauucug

SEQ ID NO: 190688 - RNA, 19 nt, Homo sapiens
gaacuacagccuccacuug

SEQ ID NO: 190689 - RNA, 19 nt, Homo sapiens
cauauuagcuacccaccaa

SEQ ID NO: 190690 - RNA, 19 nt, Homo sapiens
gacaaucucgccaucuuua

SEQ ID NO: 190691 - RNA, 19 nt, Homo sapiens
ucaggaaugaugcuuauua

SEQ ID NO: 190692 - RNA, 19 nt, Homo sapiens
ggacuacacagccaccaua

SEQ ID NO: 190693 - RNA, 19 nt, Homo sapiens
gaugauuucccuucuguaa

SEQ ID NO: 190694 - RNA, 19 nt, Homo sapiens
aaacuuggcuuugcucaga

SEQ ID NO: 190695 - RNA, 19 nt, Homo sapiens
ggaagucaaugcacuaacu

SEQ ID NO: 190696 - RNA, 19 nt, Homo sapiens
gaaggagaccauuggguaa

SEQ ID NO: 190697 - RNA, 19 nt, Homo sapiens
uagaaguccuagcauuaua

SEQ ID NO: 190698 - RNA, 19 nt, Homo sapiens
ggaauguucuguauuucau

SEQ ID NO: 190699 - RNA, 19 nt, Homo sapiens
gacaggaaauuacacuaga

SEQ ID NO: 190700 - RNA, 19 nt, Homo sapiens
gaaaugauguggaguucac

SEQ ID NO: 190701 - RNA, 19 nt, Homo sapiens
gaaauaaaccaaggcucua

SEQ ID NO: 190702 - RNA, 19 nt, Homo sapiens
cuaaaucucugcagugcuu

SEQ ID NO: 190703 - RNA, 19 nt, Homo sapiens
uaacagagccucaacaacu

SEQ ID NO: 190704 - RNA, 19 nt, Homo sapiens
uacagugacuugacaauga

SEQ ID NO: 190705 - RNA, 19 nt, Homo sapiens
gaucagcuuugccagcauu

SEQ ID NO: 190706 - RNA, 19 nt, Homo sapiens
caaaggaaguagaagaagu

SEQ ID NO: 190707 - RNA, 19 nt, Homo sapiens
caacaaaggaaguagaaga

SEQ ID NO: 190708 - RNA, 19 nt, Homo sapiens
gaggagcauucaucccuuu

SEQ ID NO: 190709 - RNA, 19 nt, Homo sapiens
gagccaaucauauuuguga

SEQ ID NO: 190710 - RNA, 19 nt, Homo sapiens
aauaugggcuuaugucaau

SEQ ID NO: 190711 - RNA, 19 nt, Homo sapiens
ggaguaacauuuucuaguu

SEQ ID NO: 190712 - RNA, 19 nt, Homo sapiens
ggaaggacucugaggcuuu

SEQ ID NO: 190713 - RNA, 19 nt, Homo sapiens
gggcaggauuguugauuau

SEQ ID NO: 190714 - RNA, 19 nt, Homo sapiens
ggaaguagaagaagucagu

SEQ ID NO: 190715 - RNA, 19 nt, Homo sapiens
gcacuucucuucccaacac

SEQ ID NO: 190716 - RNA, 19 nt, Homo sapiens
gaaccucacagcaggauau

SEQ ID NO: 190717 - RNA, 19 nt, Homo sapiens
auacacacauccauccuaa

SEQ ID NO: 190718 - RNA, 19 nt, Homo sapiens
uccaauaaguccuaucauu

SEQ ID NO: 190719 - RNA, 19 nt, Homo sapiens
gaaauaugggcuuauguca

SEQ ID NO: 190720 - RNA, 19 nt, Homo sapiens
cgacaacguugacuacagu

SEQ ID NO: 190721 - RNA, 19 nt, Homo sapiens
ucaaggacauucccaugga

SEQ ID NO: 190722 - RNA, 19 nt, Homo sapiens
ucaaggccaucgaugugua

SEQ ID NO: 190723 - RNA, 19 nt, Homo sapiens
ucaaugaccacacugauga

SEQ ID NO: 190724 - RNA, 19 nt, Homo sapiens
uguagaaguccuagcauua

SEQ ID NO: 190725 - RNA, 19 nt, Homo sapiens
gggaucugcuuuagcuuug

SEQ ID NO: 190726 - RNA, 19 nt, Homo sapiens
ugauaaagaugugaacugu

SEQ ID NO: 190727 - RNA, 19 nt, Homo sapiens
cgccaucuuuaauuucuua

SEQ ID NO: 190728 - RNA, 19 nt, Homo sapiens
guucuaagauacaauggau

SEQ ID NO: 190729 - RNA, 19 nt, Homo sapiens
uaugcuagccaauguauuu

SEQ ID NO: 190730 - RNA, 19 nt, Homo sapiens
uggagaacccguacagaua

SEQ ID NO: 190731 - RNA, 19 nt, Homo sapiens
gguuugcauuuaccucaua

SEQ ID NO: 190732 - RNA, 19 nt, Homo sapiens
ugggcaggauuguugauua

SEQ ID NO: 190733 - RNA, 19 nt, Homo sapiens
gagcagcuucucaacauga

SEQ ID NO: 190734 - RNA, 19 nt, Homo sapiens
ggagaacccguacagauag

SEQ ID NO: 190735 - RNA, 19 nt, Homo sapiens
caacaacuaccuggugauu

SEQ ID NO: 190736 - RNA, 19 nt, Homo sapiens
ccacuuggccuucgugugu

SEQ ID NO: 190737 - RNA, 19 nt, Homo sapiens
ggacaacaaaggaaguaga

SEQ ID NO: 190738 - RNA, 19 nt, Homo sapiens
ugacgaccguguuaucaau

SEQ ID NO: 190739 - RNA, 19 nt, Homo sapiens
cuagauuggucuuacaguu

SEQ ID NO: 190740 - RNA, 19 nt, Homo sapiens
gaaauuacacuagauuggu

SEQ ID NO: 190741 - RNA, 19 nt, Homo sapiens
ugaaggacuugcccuaaca

SEQ ID NO: 190742 - RNA, 19 nt, Homo sapiens
ugucauugcugcuacucua

SEQ ID NO: 190743 - RNA, 19 nt, Homo sapiens
gaaaagaugggcaggauug

SEQ ID NO: 190744 - RNA, 19 nt, Homo sapiens
aacagagccucaacaacua

SEQ ID NO: 190745 - RNA, 19 nt, Homo sapiens
aaggaaauaucuguucuga

SEQ ID NO: 190746 - RNA, 19 nt, Homo sapiens
ucagagagucgcugucauu

SEQ ID NO: 190747 - RNA, 19 nt, Homo sapiens
guagaaguccuagcauuau

SEQ ID NO: 190748 - RNA, 19 nt, Homo sapiens
ggaaauuacacuagauugg

SEQ ID NO: 190749 - RNA, 19 nt, Homo sapiens
agagcgguauuucaccuua

SEQ ID NO: 190750 - RNA, 19 nt, Homo sapiens
cggcagaagugacaagcuu

SEQ ID NO: 190751 - RNA, 19 nt, Homo sapiens
caauucaguuucuaugagu

SEQ ID NO: 190752 - RNA, 19 nt, Homo sapiens
cacagguucucauuccuuu

SEQ ID NO: 190753 - RNA, 19 nt, Homo sapiens
ggcuuuaccuuuccuguca

SEQ ID NO: 190754 - RNA, 19 nt, Homo sapiens
uagacaaucucgccaucuu

SEQ ID NO: 190755 - RNA, 19 nt, Homo sapiens
caggaaugaugcuuauuag

SEQ ID NO: 190756 - RNA, 19 nt, Homo sapiens
aaacaaaucccucgguucu

SEQ ID NO: 190757 - RNA, 19 nt, Homo sapiens
cugcagugcuuauaaaaua

SEQ ID NO: 190758 - RNA, 19 nt, Homo sapiens
guguagaaguccuagcauu

SEQ ID NO: 190759 - RNA, 19 nt, Homo sapiens
gcuacaagugacugaaaua

SEQ ID NO: 190760 - RNA, 19 nt, Homo sapiens
ccaauggugcuacaaguga

SEQ ID NO: 190761 - RNA, 19 nt, Homo sapiens
gacaacaaaggaaguagaa

SEQ ID NO: 190762 - RNA, 19 nt, Homo sapiens
ugacuacagugacuugaca

SEQ ID NO: 190763 - RNA, 19 nt, Homo sapiens
gcaccuaaauccucacuuu

SEQ ID NO: 190764 - RNA, 19 nt, Homo sapiens
ugaaugaccuggacaacua

SEQ ID NO: 190765 - RNA, 19 nt, Homo sapiens
cgacugauguuaguuguua

SEQ ID NO: 190766 - RNA, 19 nt, Homo sapiens
gaagagaaguccacgagau

SEQ ID NO: 190767 - RNA, 19 nt, Homo sapiens
ggaaagugcucuauagucu

SEQ ID NO: 190768 - RNA, 19 nt, Homo sapiens
guacaaccgucucuacauu

SEQ ID NO: 190769 - RNA, 19 nt, Homo sapiens
gaaauucacaugcaccuaa

SEQ ID NO: 190770 - RNA, 19 nt, Homo sapiens
gauaaauacuccaggauca

SEQ ID NO: 190771 - RNA, 19 nt, Homo sapiens
gacauggacuuuacgauga

SEQ ID NO: 190772 - RNA, 19 nt, Homo sapiens
ggcaaugacuccuuaaaga

SEQ ID NO: 190773 - RNA, 19 nt, Homo sapiens
caaacgugcucucuugaaa

SEQ ID NO: 190774 - RNA, 19 nt, Homo sapiens
gaggauagaugaccaugau

SEQ ID NO: 190775 - RNA, 19 nt, Homo sapiens
ccaaaucgccucugacaaa

SEQ ID NO: 190776 - RNA, 19 nt, Homo sapiens
ccaccaaacuggcuuucua

SEQ ID NO: 190777 - RNA, 19 nt, Homo sapiens
acacaaacgugcucucuug

SEQ ID NO: 190778 - RNA, 19 nt, Homo sapiens
gacagaaacucaugcuuca

SEQ ID NO: 190779 - RNA, 19 nt, Homo sapiens
ggauagaugaccaugauuu

SEQ ID NO: 190780 - RNA, 19 nt, Homo sapiens
gacacuuacugguuuaauu

SEQ ID NO: 190781 - RNA, 19 nt, Homo sapiens
ccucaagugucauuacauu

SEQ ID NO: 190782 - RNA, 19 nt, Homo sapiens
cgagacacuuacugguuua

SEQ ID NO: 190783 - RNA, 19 nt, Homo sapiens
ucaacuaccugaccacugu

SEQ ID NO: 190784 - RNA, 19 nt, Homo sapiens
cagagaagcagcuauguga

SEQ ID NO: 190785 - RNA, 19 nt, Homo sapiens
gagagaagcccgacaggau

SEQ ID NO: 190786 - RNA, 19 nt, Homo sapiens
gaacagcuucugaggauag

SEQ ID NO: 190787 - RNA, 19 nt, Homo sapiens
gacgagaaguacaugaaga

SEQ ID NO: 190788 - RNA, 19 nt, Homo sapiens
ugaaagcuaugccuauaca

SEQ ID NO: 190789 - RNA, 19 nt, Homo sapiens
guuagacccuugaugcuau

SEQ ID NO: 190790 - RNA, 19 nt, Homo sapiens
gagaggagcuccccacaga

SEQ ID NO: 190791 - RNA, 19 nt, Homo sapiens
acaaccgucucuacauuaa

SEQ ID NO: 190792 - RNA, 19 nt, Homo sapiens
caagugucauuacauuguu

SEQ ID NO: 190793 - RNA, 19 nt, Homo sapiens
caacggugcugaccauguc

SEQ ID NO: 190794 - RNA, 19 nt, Homo sapiens
ucucagagguugacaugga

SEQ ID NO: 190795 - RNA, 19 nt, Homo sapiens
ggaucucacucucccaguu

SEQ ID NO: 190796 - RNA, 19 nt, Homo sapiens
gagacgaaguccugacauc

SEQ ID NO: 190797 - RNA, 19 nt, Homo sapiens
ucaaggccguggacaucua

SEQ ID NO: 190798 - RNA, 19 nt, Homo sapiens
aaagugcucuauagucuca

SEQ ID NO: 190799 - RNA, 19 nt, Homo sapiens
gaugggaaagugcucuaua

SEQ ID NO: 190800 - RNA, 19 nt, Homo sapiens
gguccagccugaugggaaa

SEQ ID NO: 190801 - RNA, 19 nt, Homo sapiens
acaacuacaugccagagaa

SEQ ID NO: 190802 - RNA, 19 nt, Homo sapiens
gcacuuauuaaccaucuau

SEQ ID NO: 190803 - RNA, 19 nt, Homo sapiens
acgagacacuuacugguuu

SEQ ID NO: 190804 - RNA, 19 nt, Homo sapiens
ucacaacggugcugaccau

SEQ ID NO: 190805 - RNA, 19 nt, Homo sapiens
ccacaucuucuucuucuug

SEQ ID NO: 190806 - RNA, 19 nt, Homo sapiens
gaacuuggaagcaccuaca

SEQ ID NO: 190807 - RNA, 19 nt, Homo sapiens
gagaagcccgacaggauga

SEQ ID NO: 190808 - RNA, 19 nt, Homo sapiens
aaccgucucuacauuaauu

SEQ ID NO: 190809 - RNA, 19 nt, Homo sapiens
ccacagacaacgucauguu

SEQ ID NO: 190810 - RNA, 19 nt, Homo sapiens
caugaggccuggcuuugga

SEQ ID NO: 190811 - RNA, 19 nt, Homo sapiens
cuacaggccauuugcauga

SEQ ID NO: 190812 - RNA, 19 nt, Homo sapiens
caggaaauacgacacugua

SEQ ID NO: 190813 - RNA, 19 nt, Homo sapiens
cccacgccauugauaaaua

SEQ ID NO: 190814 - RNA, 19 nt, Homo sapiens
aacgugcucucuugaaauu

SEQ ID NO: 190815 - RNA, 19 nt, Homo sapiens
gaguuuggauagcaucuca

SEQ ID NO: 190816 - RNA, 19 nt, Homo sapiens
gauagaugaccaugauuuc

SEQ ID NO: 190817 - RNA, 19 nt, Homo sapiens
aaauucacaugcaccuaaa

SEQ ID NO: 190818 - RNA, 19 nt, Homo sapiens
gacgagacacuuacugguu

SEQ ID NO: 190819 - RNA, 19 nt, Homo sapiens
gagguugacauggacuuua

SEQ ID NO: 190820 - RNA, 19 nt, Homo sapiens
gacggcaacuacagugaug

SEQ ID NO: 190821 - RNA, 19 nt, Homo sapiens
ucuucuugcuccaaacuua

SEQ ID NO: 190822 - RNA, 19 nt, Homo sapiens
cgugcucucuugaaauuga

SEQ ID NO: 190823 - RNA, 19 nt, Homo sapiens
caaaucgccucugacaaag

SEQ ID NO: 190824 - RNA, 19 nt, Homo sapiens
guccugacaucaccaaauc

SEQ ID NO: 190825 - RNA, 19 nt, Homo sapiens
ccaaagacaaagacgagaa

SEQ ID NO: 190826 - RNA, 19 nt, Homo sapiens
uccacgagaugucuaagaa

SEQ ID NO: 190827 - RNA, 19 nt, Homo sapiens
cugggucccugacauguuu

SEQ ID NO: 190828 - RNA, 19 nt, Homo sapiens
ccuagaugcuuguaauucu

SEQ ID NO: 190829 - RNA, 19 nt, Homo sapiens
gcaaugacuccuuaaagac

SEQ ID NO: 190830 - RNA, 19 nt, Homo sapiens
auugaaagcuaugccuaua

SEQ ID NO: 190831 - RNA, 19 nt, Homo sapiens
cacgagaugucuaagaaag

SEQ ID NO: 190832 - RNA, 19 nt, Homo sapiens
ccaggacccacccauguuu

SEQ ID NO: 190833 - RNA, 19 nt, Homo sapiens
uacaaccgucucuacauua

SEQ ID NO: 190834 - RNA, 19 nt, Homo sapiens
gacaaagucagaacagcuu

SEQ ID NO: 190835 - RNA, 19 nt, Homo sapiens
ucaagugucauuacauugu

SEQ ID NO: 190836 - RNA, 19 nt, Homo sapiens
gaauuuggaaacccauguu

SEQ ID NO: 190837 - RNA, 19 nt, Homo sapiens
aacagaagcugcgggagaa

SEQ ID NO: 190838 - RNA, 19 nt, Homo sapiens
ccacgccauugauaaauac

SEQ ID NO: 190839 - RNA, 19 nt, Homo sapiens
caaugacuccuuaaagaca

SEQ ID NO: 190840 - RNA, 19 nt, Homo sapiens
gaucugggucccugacaug

SEQ ID NO: 190841 - RNA, 19 nt, Homo sapiens
acucaugcuucaguuuaua

SEQ ID NO: 190842 - RNA, 19 nt, Homo sapiens
ucuccuagaugcuuguaau

SEQ ID NO: 190843 - RNA, 19 nt, Homo sapiens
gcaagucagcccaauucug

SEQ ID NO: 190844 - RNA, 19 nt, Homo sapiens
gggcaaugacuccuuaaag

SEQ ID NO: 190845 - RNA, 19 nt, Homo sapiens
gggaaagugcucuauaguc

SEQ ID NO: 190846 - RNA, 19 nt, Homo sapiens
acaugaagaugcccacaag

SEQ ID NO: 190847 - RNA, 19 nt, Homo sapiens
gcaggaaauacgacacugu

SEQ ID NO: 190848 - RNA, 19 nt, Homo sapiens
uacauugacgagacacuua

SEQ ID NO: 190849 - RNA, 19 nt, Homo sapiens
ggauagcaucucagagguu

SEQ ID NO: 190850 - RNA, 19 nt, Homo sapiens
caagcaagucagcccaauu

SEQ ID NO: 190851 - RNA, 19 nt, Homo sapiens
ggacggcaacuacagugau

SEQ ID NO: 190852 - RNA, 19 nt, Homo sapiens
ugaagaugcccacaagcaa

SEQ ID NO: 190853 - RNA, 19 nt, Homo sapiens
gaaguccacgagaugucua

SEQ ID NO: 190854 - RNA, 19 nt, Homo sapiens
acacagcauuauauuaggu

SEQ ID NO: 190855 - RNA, 19 nt, Homo sapiens
ggagaggaaggaacagaag

SEQ ID NO: 190856 - RNA, 19 nt, Homo sapiens
ccacugugcaggagaggaa

SEQ ID NO: 190857 - RNA, 19 nt, Homo sapiens
gaccauguccaccaucauc

SEQ ID NO: 190858 - RNA, 19 nt, Homo sapiens
aaagcuaugccuauacaga

SEQ ID NO: 190859 - RNA, 19 nt, Homo sapiens
cagaaacucaugcuucagu

SEQ ID NO: 190860 - RNA, 19 nt, Homo sapiens
aagcaagucagcccaauuc

SEQ ID NO: 190861 - RNA, 19 nt, Homo sapiens
gccagagaauggagagaag

SEQ ID NO: 190862 - RNA, 19 nt, Homo sapiens
gaucucacucucccaguuc

SEQ ID NO: 190863 - RNA, 19 nt, Homo sapiens
gacauggacuucacuauga

SEQ ID NO: 190864 - RNA, 19 nt, Homo sapiens
caaauacucuagguugaua

SEQ ID NO: 190865 - RNA, 19 nt, Homo sapiens
gagcagcacucaucucuca

SEQ ID NO: 190866 - RNA, 19 nt, Homo sapiens
gagcacgacuucagcauga

SEQ ID NO: 190867 - RNA, 19 nt, Homo sapiens
uuucguaucuuccagaaua

SEQ ID NO: 190868 - RNA, 19 nt, Homo sapiens
gacaaauacucuagguuga

SEQ ID NO: 190869 - RNA, 19 nt, Homo sapiens
aaagaucguucacucauga

SEQ ID NO: 190870 - RNA, 19 nt, Homo sapiens
gauggaagcuacagugagu

SEQ ID NO: 190871 - RNA, 19 nt, Homo sapiens
gaagccauauccugacaga

SEQ ID NO: 190872 - RNA, 19 nt, Homo sapiens
ccucacagauguccacaaa

SEQ ID NO: 190873 - RNA, 19 nt, Homo sapiens
ggagagcuaugccuauaca

SEQ ID NO: 190874 - RNA, 19 nt, Homo sapiens
ggacauggacuucacuaug

SEQ ID NO: 190875 - RNA, 19 nt, Homo sapiens
ggacagggcagguggaaau

SEQ ID NO: 190876 - RNA, 19 nt, Homo sapiens
guggaaugcuucacucaaa

SEQ ID NO: 190877 - RNA, 19 nt, Homo sapiens
cccaugccauugacaaaua

SEQ ID NO: 190878 - RNA, 19 nt, Homo sapiens
acaaccgucuguacauuaa

SEQ ID NO: 190879 - RNA, 19 nt, Homo sapiens
gaagcuacagugagucuga

SEQ ID NO: 190880 - RNA, 19 nt, Homo sapiens
ccugaugucuucuuuguuc

SEQ ID NO: 190881 - RNA, 19 nt, Homo sapiens
gaaguucccgugcaugugu

SEQ ID NO: 190882 - RNA, 19 nt, Homo sapiens
ucaaggccguggacaucua

SEQ ID NO: 190883 - RNA, 19 nt, Homo sapiens
gaagaagaaaggcaagaca

SEQ ID NO: 190884 - RNA, 19 nt, Homo sapiens
ccacaucuucuucuucuug

SEQ ID NO: 190885 - RNA, 19 nt, Homo sapiens
gcaacaagagcaugaccuu

SEQ ID NO: 190886 - RNA, 19 nt, Homo sapiens
ucacagauguccacaaaau

SEQ ID NO: 190887 - RNA, 19 nt, Homo sapiens
gcagaaaacccaagaggaa

SEQ ID NO: 190888 - RNA, 19 nt, Homo sapiens
ccaaggcuguuccuagaag

SEQ ID NO: 190889 - RNA, 19 nt, Homo sapiens
gccauauccugacagaaga

SEQ ID NO: 190890 - RNA, 19 nt, Homo sapiens
gagaaguucccgugcaugu

SEQ ID NO: 190891 - RNA, 19 nt, Homo sapiens
gagcuaugccuauacagau

SEQ ID NO: 190892 - RNA, 19 nt, Homo sapiens
cuggagagcuaugccuaua

SEQ ID NO: 190893 - RNA, 19 nt, Homo sapiens
ggucccugaugucuucuuu

SEQ ID NO: 190894 - RNA, 19 nt, Homo sapiens
aagaagaaccuugauguga

SEQ ID NO: 190895 - RNA, 19 nt, Homo sapiens
ggaagcugcgggagaaguu

SEQ ID NO: 190896 - RNA, 19 nt, Homo sapiens
gaaaugcccaagccaaguc

SEQ ID NO: 190897 - RNA, 19 nt, Homo sapiens
ucagaaauuucacacaacu

SEQ ID NO: 190898 - RNA, 19 nt, Homo sapiens
cagaauacccaugccauug

SEQ ID NO: 190899 - RNA, 19 nt, Homo sapiens
agaagaaaggcaagacaaa

SEQ ID NO: 190900 - RNA, 19 nt, Homo sapiens
guaugcggcugucaacuac

SEQ ID NO: 190901 - RNA, 19 nt, Homo sapiens
gaagaaaggcaagacaaaa

SEQ ID NO: 190902 - RNA, 19 nt, Homo sapiens
ucccagaccuguucuuugg

SEQ ID NO: 190903 - RNA, 19 nt, Homo sapiens
uaagaagaaccuugaugug

SEQ ID NO: 190904 - RNA, 19 nt, Homo sapiens
cuccaaggcuguuccuaga

SEQ ID NO: 190905 - RNA, 19 nt, Homo sapiens
agaauacccaugccauuga

SEQ ID NO: 190906 - RNA, 19 nt, Homo sapiens
ccagaauacccaugccauu

SEQ ID NO: 190907 - RNA, 19 nt, Homo sapiens
cagaagccauauccugaca

SEQ ID NO: 190908 - RNA, 19 nt, Homo sapiens
cuguacagcaugaggauua

SEQ ID NO: 190909 - RNA, 19 nt, Homo sapiens
caaggcuguuccuagaaga

SEQ ID NO: 190910 - RNA, 19 nt, Homo sapiens
gaauacccaugccauugac

SEQ ID NO: 190911 - RNA, 19 nt, Homo sapiens
ucacgacggugcugaccau

SEQ ID NO: 190912 - RNA, 19 nt, Homo sapiens
caccaccacugacaacauc

SEQ ID NO: 190913 - RNA, 19 nt, Homo sapiens
cccuguaccugcggcauua

SEQ ID NO: 190914 - RNA, 19 nt, Homo sapiens
gcagcacucaucucucaga

SEQ ID NO: 190915 - RNA, 19 nt, Homo sapiens
ggaaaugcccaagccaagu

SEQ ID NO: 190916 - RNA, 19 nt, Homo sapiens
ucuucuugcuccaaacaua

SEQ ID NO: 190917 - RNA, 19 nt, Homo sapiens
gaugagaggcuagcuuucu

SEQ ID NO: 190918 - RNA, 19 nt, Homo sapiens
gaagaucugggucccugau

SEQ ID NO: 190919 - RNA, 19 nt, Homo sapiens
ugacagacggacuuguuga

SEQ ID NO: 190920 - RNA, 19 nt, Homo sapiens
cgacggugcugaccaugac

SEQ ID NO: 190921 - RNA, 19 nt, Homo sapiens
gagcugugccugccagagu

SEQ ID NO: 190922 - RNA, 19 nt, Homo sapiens
agaaauuucacacaacuuc

SEQ ID NO: 190923 - RNA, 19 nt, Homo sapiens
gaucuccuugucucaguuu

SEQ ID NO: 190924 - RNA, 19 nt, Homo sapiens
gcacgacuucagcaugaga

SEQ ID NO: 190925 - RNA, 19 nt, Homo sapiens
cagauggacacgugcugua

SEQ ID NO: 190926 - RNA, 19 nt, Homo sapiens
ucccugaugucuucuuugu

SEQ ID NO: 190927 - RNA, 19 nt, Homo sapiens
acaagagcaugaccuucga

SEQ ID NO: 190928 - RNA, 19 nt, Homo sapiens
auaagaagaaccuugaugu

SEQ ID NO: 190929 - RNA, 19 nt, Homo sapiens
uauaagaagaaccuugaug

SEQ ID NO: 190930 - RNA, 19 nt, Homo sapiens
cgccacaucuucuucuucu

SEQ ID NO: 190931 - RNA, 19 nt, Homo sapiens
ucuccgagguggacaugga

SEQ ID NO: 190932 - RNA, 19 nt, Homo sapiens
gccacaggcuacuggaaag

SEQ ID NO: 190933 - RNA, 19 nt, Homo sapiens
agccaacgcugccagaaag

SEQ ID NO: 190934 - RNA, 19 nt, Homo sapiens
gcuaugccuauacagauga

SEQ ID NO: 190935 - RNA, 19 nt, Homo sapiens
gaagccaacgcugccagaa

SEQ ID NO: 190936 - RNA, 19 nt, Homo sapiens
aacggaagcugcgggagaa

SEQ ID NO: 190937 - RNA, 19 nt, Homo sapiens
ccaagauccggaagggaaa

SEQ ID NO: 190938 - RNA, 19 nt, Homo sapiens
uagaagagggcauagacau

SEQ ID NO: 190939 - RNA, 19 nt, Homo sapiens
agaaaggcaagacaaaaua

SEQ ID NO: 190940 - RNA, 19 nt, Homo sapiens
uauccugacagaagaagaa

SEQ ID NO: 190941 - RNA, 19 nt, Homo sapiens
aguaugcggcugucaacua

SEQ ID NO: 190942 - RNA, 19 nt, Homo sapiens
augcugcacuggaagaaug

SEQ ID NO: 190943 - RNA, 19 nt, Homo sapiens
ggcauuacuggaaggauga

SEQ ID NO: 190944 - RNA, 19 nt, Homo sapiens
aagaagaaaggcaagacaa

SEQ ID NO: 190945 - RNA, 19 nt, Homo sapiens
cucagcagcuucucagagu

SEQ ID NO: 190946 - RNA, 19 nt, Homo sapiens
cugggucccugaugucuuc

SEQ ID NO: 190947 - RNA, 19 nt, Homo sapiens
aggaugagaggcuagcuuu

SEQ ID NO: 190948 - RNA, 19 nt, Homo sapiens
ugauauucccugccuccua

SEQ ID NO: 190949 - RNA, 19 nt, Homo sapiens
ucucggugcuggaguaugc

SEQ ID NO: 190950 - RNA, 19 nt, Homo sapiens
gaucugggucccugauguc

SEQ ID NO: 190951 - RNA, 19 nt, Homo sapiens
gaaaggcaagacaaaauag

SEQ ID NO: 190952 - RNA, 19 nt, Homo sapiens
ggaguaugcggcugucaac

SEQ ID NO: 190953 - RNA, 19 nt, Homo sapiens
cugaggguguucccagaug

SEQ ID NO: 190954 - RNA, 19 nt, Homo sapiens
gccagcaacaagagcauga

SEQ ID NO: 190955 - RNA, 19 nt, Homo sapiens
guuccuagaagagggcaua

SEQ ID NO: 190956 - RNA, 19 nt, Homo sapiens
caacgcugccagaaagaag

SEQ ID NO: 190957 - RNA, 19 nt, Homo sapiens
agagcuaugccuauacaga

SEQ ID NO: 190958 - RNA, 19 nt, Homo sapiens
gcuggagagcuaugccuau

SEQ ID NO: 190959 - RNA, 19 nt, Homo sapiens
gaagggaaauucacacugu

SEQ ID NO: 190960 - RNA, 19 nt, Homo sapiens
guaaauuccuguugucuga

SEQ ID NO: 190961 - RNA, 19 nt, Homo sapiens
ucagagauguaccauguua

SEQ ID NO: 190962 - RNA, 19 nt, Homo sapiens
gcagagacaccuugaagua

SEQ ID NO: 190963 - RNA, 19 nt, Homo sapiens
gagacuaugugucaugauu

SEQ ID NO: 190964 - RNA, 19 nt, Homo sapiens
gacauugacuuccucauug

SEQ ID NO: 190965 - RNA, 19 nt, Homo sapiens
gcagauauaugugagaaau

SEQ ID NO: 190966 - RNA, 19 nt, Homo sapiens
gagaauggcugacaucaac

SEQ ID NO: 190967 - RNA, 19 nt, Homo sapiens
ugacuucucuaaucuguuu

SEQ ID NO: 190968 - RNA, 19 nt, Homo sapiens
uggcaaauccuguuacuua

SEQ ID NO: 190969 - RNA, 19 nt, Homo sapiens
uaaagauggugaugggaua

SEQ ID NO: 190970 - RNA, 19 nt, Homo sapiens
ggaacagaguauauaugua

SEQ ID NO: 190971 - RNA, 19 nt, Homo sapiens
gaaaugcuguuggugagaa

SEQ ID NO: 190972 - RNA, 19 nt, Homo sapiens
gaacagaguauauauguac

SEQ ID NO: 190973 - RNA, 19 nt, Homo sapiens
uacaagagauugcagauau

SEQ ID NO: 190974 - RNA, 19 nt, Homo sapiens
gcacuuggcuuuggaacug

SEQ ID NO: 190975 - RNA, 19 nt, Homo sapiens
cagagucacuauuccauaa

SEQ ID NO: 190976 - RNA, 19 nt, Homo sapiens
ggacauacuccucaacuau

SEQ ID NO: 190977 - RNA, 19 nt, Homo sapiens
gagaagagucgccuuguga

SEQ ID NO: 190978 - RNA, 19 nt, Homo sapiens
gcaacggccucgugauuuc

SEQ ID NO: 190979 - RNA, 19 nt, Homo sapiens
auaacuagaucuccuguaa

SEQ ID NO: 190980 - RNA, 19 nt, Homo sapiens
gagaucugcuuccggcuaa

SEQ ID NO: 190981 - RNA, 19 nt, Homo sapiens
ggcaaauccuguuacuuaa

SEQ ID NO: 190982 - RNA, 19 nt, Homo sapiens
ucaaagcccugaugaugga

SEQ ID NO: 190983 - RNA, 19 nt, Homo sapiens
uugaguacguucuggauua

SEQ ID NO: 190984 - RNA, 19 nt, Homo sapiens
gagaagaauuugagauggu

SEQ ID NO: 190985 - RNA, 19 nt, Homo sapiens
acaagagauugcagauaua

SEQ ID NO: 190986 - RNA, 19 nt, Homo sapiens
gcacaggucauccucgauu

SEQ ID NO: 190987 - RNA, 19 nt, Homo sapiens
ccaaggugcuggacuuuca

SEQ ID NO: 190988 - RNA, 19 nt, Homo sapiens
gagcaacggccucgugauu

SEQ ID NO: 190989 - RNA, 19 nt, Homo sapiens
gcaaauccuguuacuuaaa

SEQ ID NO: 190990 - RNA, 19 nt, Homo sapiens
gauuguacaugacauaagu

SEQ ID NO: 190991 - RNA, 19 nt, Homo sapiens
ggacaaggcaauucagugu

SEQ ID NO: 190992 - RNA, 19 nt, Homo sapiens
gccaggaucuguaaucauc

SEQ ID NO: 190993 - RNA, 19 nt, Homo sapiens
gccaauaccaacauguuua

SEQ ID NO: 190994 - RNA, 19 nt, Homo sapiens
guaaucauccuucgcagaa

SEQ ID NO: 190995 - RNA, 19 nt, Homo sapiens
auaguuggauggucaagua

SEQ ID NO: 190996 - RNA, 19 nt, Homo sapiens
ugaaauugcaccaguguuu

SEQ ID NO: 190997 - RNA, 19 nt, Homo sapiens
accgugagcuggauuuaua

SEQ ID NO: 190998 - RNA, 19 nt, Homo sapiens
aacuagaucuccuguaauu

SEQ ID NO: 190999 - RNA, 19 nt, Homo sapiens
ccaaccagcuuguccaaca

SEQ ID NO: 191000 - RNA, 19 nt, Homo sapiens
agaauucacuuuaccuuca

SEQ ID NO: 191001 - RNA, 19 nt, Homo sapiens
gaguguggcuuaguaauag

SEQ ID NO: 191002 - RNA, 19 nt, Homo sapiens
ccacuggauuggauauuau

SEQ ID NO: 191003 - RNA, 19 nt, Homo sapiens
ccaacagccuggaagagaa

SEQ ID NO: 191004 - RNA, 19 nt, Homo sapiens
acuuaaagcuuguuuguuc

SEQ ID NO: 191005 - RNA, 19 nt, Homo sapiens
gaaccugcuuuccugugaa

SEQ ID NO: 191006 - RNA, 19 nt, Homo sapiens
ugaccaggcucacaacugu

SEQ ID NO: 191007 - RNA, 19 nt, Homo sapiens
gaacugacaaugugauuuu

SEQ ID NO: 191008 - RNA, 19 nt, Homo sapiens
ccaagagaauucacuuuac

SEQ ID NO: 191009 - RNA, 19 nt, Homo sapiens
acacacaggccauuucauu

SEQ ID NO: 191010 - RNA, 19 nt, Homo sapiens
gaauaccucuaugccaaga

SEQ ID NO: 191011 - RNA, 19 nt, Homo sapiens
guggauaucuucaaguucu

SEQ ID NO: 191012 - RNA, 19 nt, Homo sapiens
gaggugggcugcucauguc

SEQ ID NO: 191013 - RNA, 19 nt, Homo sapiens
gaaaauaauuccagcugau

SEQ ID NO: 191014 - RNA, 19 nt, Homo sapiens
agagacaccuugaaguaug

SEQ ID NO: 191015 - RNA, 19 nt, Homo sapiens
cgaggacucuggacaguag

SEQ ID NO: 191016 - RNA, 19 nt, Homo sapiens
gauguaccauguuaaagag

SEQ ID NO: 191017 - RNA, 19 nt, Homo sapiens
caagggaaaugcuguuggu

SEQ ID NO: 191018 - RNA, 19 nt, Homo sapiens
gaacagagucacuauucca

SEQ ID NO: 191019 - RNA, 19 nt, Homo sapiens
gaagaugagagagauaguu

SEQ ID NO: 191020 - RNA, 19 nt, Homo sapiens
gaaauugcaccaguguuug

SEQ ID NO: 191021 - RNA, 19 nt, Homo sapiens
caacauuuccgaagaccuu

SEQ ID NO: 191022 - RNA, 19 nt, Homo sapiens
ugaguguggcuuaguaaua

SEQ ID NO: 191023 - RNA, 19 nt, Homo sapiens
gaaagggccaacucaguca

SEQ ID NO: 191024 - RNA, 19 nt, Homo sapiens
aaacucaacggcauagaaa

SEQ ID NO: 191025 - RNA, 19 nt, Homo sapiens
ugagaaauauaaccuuugg

SEQ ID NO: 191026 - RNA, 19 nt, Homo sapiens
uauauuagagugcccuuaa

SEQ ID NO: 191027 - RNA, 19 nt, Homo sapiens
gggagacuaugugucauga

SEQ ID NO: 191028 - RNA, 19 nt, Homo sapiens
gguguacuauggcuguauu

SEQ ID NO: 191029 - RNA, 19 nt, Homo sapiens
gggaaaacauaauaucuug

SEQ ID NO: 191030 - RNA, 19 nt, Homo sapiens
ugacauugacuuccucauu

SEQ ID NO: 191031 - RNA, 19 nt, Homo sapiens
gacuaugugucaugauuuc

SEQ ID NO: 191032 - RNA, 19 nt, Homo sapiens
uccaagagaauucacuuua

SEQ ID NO: 191033 - RNA, 19 nt, Homo sapiens
uaagaacggugaggagcaa

SEQ ID NO: 191034 - RNA, 19 nt, Homo sapiens
gugacucgcuuagcugaaa

SEQ ID NO: 191035 - RNA, 19 nt, Homo sapiens
ggaaaaggguauacuccaa

SEQ ID NO: 191036 - RNA, 19 nt, Homo sapiens
cagaacagagucacuauuc

SEQ ID NO: 191037 - RNA, 19 nt, Homo sapiens
auucagagauguaccaugu

SEQ ID NO: 191038 - RNA, 19 nt, Homo sapiens
gaaaauaguagcagaguca

SEQ ID NO: 191039 - RNA, 19 nt, Homo sapiens
gcacauuaggaacagagua

SEQ ID NO: 191040 - RNA, 19 nt, Homo sapiens
acacaggccauuucauuga

SEQ ID NO: 191041 - RNA, 19 nt, Homo sapiens
ccaacucagucaccuggaa

SEQ ID NO: 191042 - RNA, 19 nt, Homo sapiens
ccaggaagcaccgccauaa

SEQ ID NO: 191043 - RNA, 19 nt, Homo sapiens
ggagcaaaccgugcaauuc

SEQ ID NO: 191044 - RNA, 19 nt, Homo sapiens
agacugacuucucuaaucu

SEQ ID NO: 191045 - RNA, 19 nt, Homo sapiens
gaagugaugauggaugaga

SEQ ID NO: 191046 - RNA, 19 nt, Homo sapiens
cugaagugaugauggauga

SEQ ID NO: 191047 - RNA, 19 nt, Homo sapiens
cagagaagaauuugagaug

SEQ ID NO: 191048 - RNA, 19 nt, Homo sapiens
gcugaaaccuaaggcaaca

SEQ ID NO: 191049 - RNA, 19 nt, Homo sapiens
cacuuuaccuucagcaguu

SEQ ID NO: 191050 - RNA, 19 nt, Homo sapiens
aaacagagaagaauuugag

SEQ ID NO: 191051 - RNA, 19 nt, Homo sapiens
caagagauugcagauauau

SEQ ID NO: 191052 - RNA, 19 nt, Homo sapiens
gcauggcggcugugccuaa

SEQ ID NO: 191053 - RNA, 19 nt, Homo sapiens
uuaagaagaugagagagau

SEQ ID NO: 191054 - RNA, 19 nt, Homo sapiens
cccgacagccugccuauuu

SEQ ID NO: 191055 - RNA, 19 nt, Homo sapiens
ggagaauggcugacaucaa

SEQ ID NO: 191056 - RNA, 19 nt, Homo sapiens
gaucugcggcuucuugcaa

SEQ ID NO: 191057 - RNA, 19 nt, Homo sapiens
uggccuagcuggagaaugg

SEQ ID NO: 191058 - RNA, 19 nt, Homo sapiens
gaguaugcaagaagaauau

SEQ ID NO: 191059 - RNA, 19 nt, Homo sapiens
gcagagacaccuugaagua

SEQ ID NO: 191060 - RNA, 19 nt, Homo sapiens
gaugguaacugcacacaug

SEQ ID NO: 191061 - RNA, 19 nt, Homo sapiens
ccaagggucuuccuccuaa

SEQ ID NO: 191062 - RNA, 19 nt, Homo sapiens
gagaauggcugacaucaac

SEQ ID NO: 191063 - RNA, 19 nt, Homo sapiens
ugacuucucuaaucuguuu

SEQ ID NO: 191064 - RNA, 19 nt, Homo sapiens
gagcagaaccaaagcauga

SEQ ID NO: 191065 - RNA, 19 nt, Homo sapiens
ggacauacuccucaacuau

SEQ ID NO: 191066 - RNA, 19 nt, Homo sapiens
gagaagagucgccuuguga

SEQ ID NO: 191067 - RNA, 19 nt, Homo sapiens
gagaucugcuuccggcuaa

SEQ ID NO: 191068 - RNA, 19 nt, Homo sapiens
gcacaggucauccucgauu

SEQ ID NO: 191069 - RNA, 19 nt, Homo sapiens
ccaaggugcuggacuuuca

SEQ ID NO: 191070 - RNA, 19 nt, Homo sapiens
ccacuggauuggauauuau

SEQ ID NO: 191071 - RNA, 19 nt, Homo sapiens
ccaacagccuggaagagaa

SEQ ID NO: 191072 - RNA, 19 nt, Homo sapiens
gaaccugcuuuccugugaa

SEQ ID NO: 191073 - RNA, 19 nt, Homo sapiens
caaggaaaauggacauauu

SEQ ID NO: 191074 - RNA, 19 nt, Homo sapiens
agagacaccuugaaguaug

SEQ ID NO: 191075 - RNA, 19 nt, Homo sapiens
aaccaaagcaugauuguga

SEQ ID NO: 191076 - RNA, 19 nt, Homo sapiens
gggucuuccuccuaaauuu

SEQ ID NO: 191077 - RNA, 19 nt, Homo sapiens
uaagaacggugaggagcaa

SEQ ID NO: 191078 - RNA, 19 nt, Homo sapiens
ggagcaaaccgugcaauuc

SEQ ID NO: 191079 - RNA, 19 nt, Homo sapiens
agacugacuucucuaaucu

SEQ ID NO: 191080 - RNA, 19 nt, Homo sapiens
gcagaaccaaagcaugauu

SEQ ID NO: 191081 - RNA, 19 nt, Homo sapiens
ggagaauggcugacaucaa

SEQ ID NO: 191082 - RNA, 19 nt, Homo sapiens
gaucugcggcuucuugcaa

SEQ ID NO: 191083 - RNA, 19 nt, Homo sapiens
uggccuagcuggagaaugg

SEQ ID NO: 191084 - RNA, 19 nt, Homo sapiens
gcauggagggcuucaacuu

SEQ ID NO: 191085 - RNA, 19 nt, Homo sapiens
gagggaguguugguugcua

SEQ ID NO: 191086 - RNA, 19 nt, Homo sapiens
gagacaccuugaaguaugg

SEQ ID NO: 191087 - RNA, 19 nt, Homo sapiens
agaaccugcuuuccuguga

SEQ ID NO: 191088 - RNA, 19 nt, Homo sapiens
ggaccaacagccuggaaga

SEQ ID NO: 191089 - RNA, 19 nt, Homo sapiens
caucaacggccaauaccaa

SEQ ID NO: 191090 - RNA, 19 nt, Homo sapiens
uggagcagauccugguuga

SEQ ID NO: 191091 - RNA, 19 nt, Homo sapiens
cacaggucauccucgauuu

SEQ ID NO: 191092 - RNA, 19 nt, Homo sapiens
uaacugcacacaugguuuc

SEQ ID NO: 191093 - RNA, 19 nt, Homo sapiens
auaccaacaugccaucaga

SEQ ID NO: 191094 - RNA, 19 nt, Homo sapiens
caagggucuuccuccuaaa

SEQ ID NO: 191095 - RNA, 19 nt, Homo sapiens
gagcagauccugguugacu

SEQ ID NO: 191096 - RNA, 19 nt, Homo sapiens
gaagagucgccuugugagu

SEQ ID NO: 191097 - RNA, 19 nt, Homo sapiens
ugacaucaacggccaauac

SEQ ID NO: 191098 - RNA, 19 nt, Homo sapiens
gagcaaaccgugcaauucc

SEQ ID NO: 191099 - RNA, 19 nt, Homo sapiens
uggacauacuccucaacua

SEQ ID NO: 191100 - RNA, 19 nt, Homo sapiens
agagaagagucgccuugug

SEQ ID NO: 191101 - RNA, 19 nt, Homo sapiens
gaaccaaagcaugauugug

SEQ ID NO: 191102 - RNA, 19 nt, Homo sapiens
cauggagggcuucaacuug

SEQ ID NO: 191103 - RNA, 19 nt, Homo sapiens
guaacugcacacaugguuu

SEQ ID NO: 191104 - RNA, 19 nt, Homo sapiens
gguaacugcacacaugguu

SEQ ID NO: 191105 - RNA, 19 nt, Homo sapiens
cagagacaccuugaaguau

SEQ ID NO: 191106 - RNA, 19 nt, Homo sapiens
cuaaucuguuugcuagaga

SEQ ID NO: 191107 - RNA, 19 nt, Homo sapiens
cugcacacaugguuuccaa

SEQ ID NO: 191108 - RNA, 19 nt, Homo sapiens
ggucuuccuccuaaauuuc

SEQ ID NO: 191109 - RNA, 19 nt, Homo sapiens
ggaagugguggacauacuc

SEQ ID NO: 191110 - RNA, 19 nt, Homo sapiens
gcgcacagagacugacuuc

SEQ ID NO: 191111 - RNA, 19 nt, Homo sapiens
cagaaccaaagcaugauug

SEQ ID NO: 191112 - RNA, 19 nt, Homo sapiens
caacggccaauaccaacau

SEQ ID NO: 191113 - RNA, 19 nt, Homo sapiens
gcuggagaauggcugacau

SEQ ID NO: 191114 - RNA, 19 nt, Homo sapiens
ggauauuauuggccuagcu

SEQ ID NO: 191115 - RNA, 19 nt, Homo sapiens
caacagccuggaagagaag

SEQ ID NO: 191116 - RNA, 19 nt, Homo sapiens
gaucugcuuccggcuaaga

SEQ ID NO: 191117 - RNA, 19 nt, Homo sapiens
gaacagacguuaccaauua

SEQ ID NO: 191118 - RNA, 19 nt, Homo sapiens
gaagguggcuccagugauu

SEQ ID NO: 191119 - RNA, 19 nt, Homo sapiens
gauaugagaugguguuuga

SEQ ID NO: 191120 - RNA, 19 nt, Homo sapiens
caacauuacuccauuacua

SEQ ID NO: 191121 - RNA, 19 nt, Homo sapiens
caaccaaagugauugauuu

SEQ ID NO: 191122 - RNA, 19 nt, Homo sapiens
cuaaugagcuucuccaaga

SEQ ID NO: 191123 - RNA, 19 nt, Homo sapiens
ggaagacaaugaagagaga

SEQ ID NO: 191124 - RNA, 19 nt, Homo sapiens
aaacacaaguggaaacuga

SEQ ID NO: 191125 - RNA, 19 nt, Homo sapiens
gacauugacuuccugauug

SEQ ID NO: 191126 - RNA, 19 nt, Homo sapiens
gauuaaaugugaugagaga

SEQ ID NO: 191127 - RNA, 19 nt, Homo sapiens
aaacagggcauccuagaua

SEQ ID NO: 191128 - RNA, 19 nt, Homo sapiens
aaacuaccguucccaaauu

SEQ ID NO: 191129 - RNA, 19 nt, Homo sapiens
gaaacuuccuuugagaauu

SEQ ID NO: 191130 - RNA, 19 nt, Homo sapiens
gagacaaggucaauuucuu

SEQ ID NO: 191131 - RNA, 19 nt, Homo sapiens
gaauaugucacacuaaaga

SEQ ID NO: 191132 - RNA, 19 nt, Homo sapiens
ggaguuggcagaguauuua

SEQ ID NO: 191133 - RNA, 19 nt, Homo sapiens
caaaguggaugucaacuac

SEQ ID NO: 191134 - RNA, 19 nt, Homo sapiens
gcacagguguaaauauagu

SEQ ID NO: 191135 - RNA, 19 nt, Homo sapiens
aggcacagguguaaauaua

SEQ ID NO: 191136 - RNA, 19 nt, Homo sapiens
aaacuuccuuugagaauug

SEQ ID NO: 191137 - RNA, 19 nt, Homo sapiens
gcucuucuguucucaaaug

SEQ ID NO: 191138 - RNA, 19 nt, Homo sapiens
ucaccaagcuguuccacuu

SEQ ID NO: 191139 - RNA, 19 nt, Homo sapiens
ccaaguggcucagaaguuc

SEQ ID NO: 191140 - RNA, 19 nt, Homo sapiens
gcuggucacuggaguaguu

SEQ ID NO: 191141 - RNA, 19 nt, Homo sapiens
gaacaugcccucagcuaag

SEQ ID NO: 191142 - RNA, 19 nt, Homo sapiens
caaagaaggcacaggugua

SEQ ID NO: 191143 - RNA, 19 nt, Homo sapiens
gauuaaagccagaaugaug

SEQ ID NO: 191144 - RNA, 19 nt, Homo sapiens
uggaauaugucacacuaaa

SEQ ID NO: 191145 - RNA, 19 nt, Homo sapiens
ugagaaacuuccuuugaga

SEQ ID NO: 191146 - RNA, 19 nt, Homo sapiens
gaacagacagcgugauucu

SEQ ID NO: 191147 - RNA, 19 nt, Homo sapiens
gaaggcacagguguaaaua

SEQ ID NO: 191148 - RNA, 19 nt, Homo sapiens
cgccauaucuaacauguau

SEQ ID NO: 191149 - RNA, 19 nt, Homo sapiens
ggauaugguuggauuagca

SEQ ID NO: 191150 - RNA, 19 nt, Homo sapiens
auuaugaccuguccuauga

SEQ ID NO: 191151 - RNA, 19 nt, Homo sapiens
auacuaacauguucaccua

SEQ ID NO: 191152 - RNA, 19 nt, Homo sapiens
cagcaaauacuaacauguu

SEQ ID NO: 191153 - RNA, 19 nt, Homo sapiens
gagaacagacguuaccaau

SEQ ID NO: 191154 - RNA, 19 nt, Homo sapiens
gaagauggcucuggggauu

SEQ ID NO: 191155 - RNA, 19 nt, Homo sapiens
gagaacaugcccucagcua

SEQ ID NO: 191156 - RNA, 19 nt, Homo sapiens
ugauaaauguuuggaguug

SEQ ID NO: 191157 - RNA, 19 nt, Homo sapiens
ugaagcgcauguugauaaa

SEQ ID NO: 191158 - RNA, 19 nt, Homo sapiens
ccagaaugauggaguaugg

SEQ ID NO: 191159 - RNA, 19 nt, Homo sapiens
gauuccaucugaucuugaa

SEQ ID NO: 191160 - RNA, 19 nt, Homo sapiens
uugcuacucuucagaauau

SEQ ID NO: 191161 - RNA, 19 nt, Homo sapiens
gcauguugauaaauguuug

SEQ ID NO: 191162 - RNA, 19 nt, Homo sapiens
gagaaacuuccuuugagaa

SEQ ID NO: 191163 - RNA, 19 nt, Homo sapiens
ggaagccucagcacacaaa

SEQ ID NO: 191164 - RNA, 19 nt, Homo sapiens
gcucugcucuccugguuag

SEQ ID NO: 191165 - RNA, 19 nt, Homo sapiens
caucaacagcaaauacuaa

SEQ ID NO: 191166 - RNA, 19 nt, Homo sapiens
caaacuaccguucccaaau

SEQ ID NO: 191167 - RNA, 19 nt, Homo sapiens
caacucaccaagacauuga

SEQ ID NO: 191168 - RNA, 19 nt, Homo sapiens
caaagugauugauuuccau

SEQ ID NO: 191169 - RNA, 19 nt, Homo sapiens
aaagaaggcacagguguaa

SEQ ID NO: 191170 - RNA, 19 nt, Homo sapiens
gcgugauucugauuaaaug

SEQ ID NO: 191171 - RNA, 19 nt, Homo sapiens
ccaaaguggaugucaacua

SEQ ID NO: 191172 - RNA, 19 nt, Homo sapiens
gugauuaaagccagaauga

SEQ ID NO: 191173 - RNA, 19 nt, Homo sapiens
guuuggaguuggcagagua

SEQ ID NO: 191174 - RNA, 19 nt, Homo sapiens
aagcgcauguugauaaaug

SEQ ID NO: 191175 - RNA, 19 nt, Homo sapiens
gcaugccuccuaccucuuu

SEQ ID NO: 191176 - RNA, 19 nt, Homo sapiens
cuaugaaauugcuccagua

SEQ ID NO: 191177 - RNA, 19 nt, Homo sapiens
ccaaagugauugauuucca

SEQ ID NO: 191178 - RNA, 19 nt, Homo sapiens
ccaacucugugacguggaa

SEQ ID NO: 191179 - RNA, 19 nt, Homo sapiens
cauccuagauacuucaauc

SEQ ID NO: 191180 - RNA, 19 nt, Homo sapiens
gaaugagucgccucucgaa

SEQ ID NO: 191181 - RNA, 19 nt, Homo sapiens
cuaacauguucaccuauga

SEQ ID NO: 191182 - RNA, 19 nt, Homo sapiens
gcaaauacuaacauguuca

SEQ ID NO: 191183 - RNA, 19 nt, Homo sapiens
aaauugguguuucugaaug

SEQ ID NO: 191184 - RNA, 19 nt, Homo sapiens
caaauugguguuucugaau

SEQ ID NO: 191185 - RNA, 19 nt, Homo sapiens
gacaaugaagagagaauga

SEQ ID NO: 191186 - RNA, 19 nt, Homo sapiens
gauuacugaugucccgaaa

SEQ ID NO: 191187 - RNA, 19 nt, Homo sapiens
gaucgcacgcuuuaagaug

SEQ ID NO: 191188 - RNA, 19 nt, Homo sapiens
gaugaucgcacgcuuuaag

SEQ ID NO: 191189 - RNA, 19 nt, Homo sapiens
caacagcaaauacuaacau

SEQ ID NO: 191190 - RNA, 19 nt, Homo sapiens
gugcucuucuguucucaaa

SEQ ID NO: 191191 - RNA, 19 nt, Homo sapiens
ggaugucaacuacgcguuu

SEQ ID NO: 191192 - RNA, 19 nt, Homo sapiens
agacauugacuuccugauu

SEQ ID NO: 191193 - RNA, 19 nt, Homo sapiens
ggacgccacguugauguuu

SEQ ID NO: 191194 - RNA, 19 nt, Homo sapiens
acagcgugauucugauuaa

SEQ ID NO: 191195 - RNA, 19 nt, Homo sapiens
aaucaacuuucuacugguu

SEQ ID NO: 191196 - RNA, 19 nt, Homo sapiens
gaggaaauuuugaugcauu

SEQ ID NO: 191197 - RNA, 19 nt, Homo sapiens
aaauauaguagcaggauga

SEQ ID NO: 191198 - RNA, 19 nt, Homo sapiens
caacuacgcguuucuccau

SEQ ID NO: 191199 - RNA, 19 nt, Homo sapiens
uugaagcgcauguugauaa

SEQ ID NO: 191200 - RNA, 19 nt, Homo sapiens
gaaaaugauuccaucugau

SEQ ID NO: 191201 - RNA, 19 nt, Homo sapiens
gaugagagagggaaaauga

SEQ ID NO: 191202 - RNA, 19 nt, Homo sapiens
gacagcgugauucugauua

SEQ ID NO: 191203 - RNA, 19 nt, Homo sapiens
ucccagaagucaaggagaa

SEQ ID NO: 191204 - RNA, 19 nt, Homo sapiens
guuuggauaugguuggauu

SEQ ID NO: 191205 - RNA, 19 nt, Homo sapiens
cuacugagaaacuuccuuu

SEQ ID NO: 191206 - RNA, 19 nt, Homo sapiens
agaaauagaacgccuugga

SEQ ID NO: 191207 - RNA, 19 nt, Homo sapiens
acauugacuuccugauuga

SEQ ID NO: 191208 - RNA, 19 nt, Homo sapiens
gcagaauugcaaccaaaug

SEQ ID NO: 191209 - RNA, 19 nt, Homo sapiens
gaaaggaauggcugcucuu

SEQ ID NO: 191210 - RNA, 19 nt, Homo sapiens
gcuccaguauuugugcuuu

SEQ ID NO: 191211 - RNA, 19 nt, Homo sapiens
guucucaaaugcuaaaugc

SEQ ID NO: 191212 - RNA, 19 nt, Homo sapiens
uaauaaccuugcucaccaa

SEQ ID NO: 191213 - RNA, 19 nt, Homo sapiens
ccuccaagcuugcguacuc

SEQ ID NO: 191214 - RNA, 19 nt, Homo sapiens
agggauugaugcagaauug

SEQ ID NO: 191215 - RNA, 19 nt, Homo sapiens
gaagucaaggagaaaggaa

SEQ ID NO: 191216 - RNA, 19 nt, Homo sapiens
aagccagaaugauggagua

SEQ ID NO: 191217 - RNA, 19 nt, Homo sapiens
gaagacacguugaaaugau

SEQ ID NO: 191218 - RNA, 19 nt, Homo sapiens
gcuccuauguuggaaauuu

SEQ ID NO: 191219 - RNA, 19 nt, Homo sapiens
gaaaagcaaucacaguguu

SEQ ID NO: 191220 - RNA, 19 nt, Homo sapiens
cguagagccuccugaaaug

SEQ ID NO: 191221 - RNA, 19 nt, Homo sapiens
cgaggaagaucgaccuauc

SEQ ID NO: 191222 - RNA, 19 nt, Homo sapiens
gaaaacgccugaagaaggu

SEQ ID NO: 191223 - RNA, 19 nt, Homo sapiens
aauaugaguuggcgaggaa

SEQ ID NO: 191224 - RNA, 19 nt, Homo sapiens
gagauggacccgccaaauc

SEQ ID NO: 191225 - RNA, 19 nt, Homo sapiens
gggagcaucugcaggucaa

SEQ ID NO: 191226 - RNA, 19 nt, Homo sapiens
aagaagacacguugaaaug

SEQ ID NO: 191227 - RNA, 19 nt, Homo sapiens
gaaaugauugggccuaugc

SEQ ID NO: 191228 - RNA, 19 nt, Homo sapiens
aaagaagacacguugaaau

SEQ ID NO: 191229 - RNA, 19 nt, Homo sapiens
ugaagaaggugaaaagcaa

SEQ ID NO: 191230 - RNA, 19 nt, Homo sapiens
ggagauggacccgccaaau

SEQ ID NO: 191231 - RNA, 19 nt, Homo sapiens
ggaaccagcaacaccugaa

SEQ ID NO: 191232 - RNA, 19 nt, Homo sapiens
ggcccgagcaguucaguga

SEQ ID NO: 191233 - RNA, 19 nt, Homo sapiens
gaccaagacgcuacguaga

SEQ ID NO: 191234 - RNA, 19 nt, Homo sapiens
uuacagccuucugcaaaga

SEQ ID NO: 191235 - RNA, 19 nt, Homo sapiens
agaagacacguugaaauga

SEQ ID NO: 191236 - RNA, 19 nt, Homo sapiens
guagagccuccugaaauga

SEQ ID NO: 191237 - RNA, 19 nt, Homo sapiens
ugaaaugauugggccuaug

SEQ ID NO: 191238 - RNA, 19 nt, Homo sapiens
aagacacguugaaaugaug

SEQ ID NO: 191239 - RNA, 19 nt, Homo sapiens
ccgagcaguucagugauga

SEQ ID NO: 191240 - RNA, 19 nt, Homo sapiens
aaagcaaucacaguguuaa

SEQ ID NO: 191241 - RNA, 19 nt, Homo sapiens
gaaccagcaacaccugaag

SEQ ID NO: 191242 - RNA, 19 nt, Homo sapiens
cuacguagagccuccugaa

SEQ ID NO: 191243 - RNA, 19 nt, Homo sapiens
uaaaagaagacacguugaa

SEQ ID NO: 191244 - RNA, 19 nt, Homo sapiens
gugugaagaugguccugau

SEQ ID NO: 191245 - RNA, 19 nt, Homo sapiens
ggugaaaacgccugaagaa

SEQ ID NO: 191246 - RNA, 19 nt, Homo sapiens
ggaaccagcaacucaacgu

SEQ ID NO: 191247 - RNA, 19 nt, Homo sapiens
agagccuccugaaaugauu

SEQ ID NO: 191248 - RNA, 19 nt, Homo sapiens
cuuuacagccuucugcaaa

SEQ ID NO: 191249 - RNA, 19 nt, Homo sapiens
caaucacaguguuaaaaga

SEQ ID NO: 191250 - RNA, 19 nt, Homo sapiens
ugaaguggaaccagcaaca

SEQ ID NO: 191251 - RNA, 19 nt, Homo sapiens
cccgagcaguucagugaug

SEQ ID NO: 191252 - RNA, 19 nt, Homo sapiens
acguagagccuccugaaau

SEQ ID NO: 191253 - RNA, 19 nt, Homo sapiens
agacugggugugaguguga

SEQ ID NO: 191254 - RNA, 19 nt, Homo sapiens
caaauccagaggaggugaa

SEQ ID NO: 191255 - RNA, 19 nt, Homo sapiens
gaagaucgaccuauuauug

SEQ ID NO: 191256 - RNA, 19 nt, Homo sapiens
gaaaaucgaccuauuauug

SEQ ID NO: 191257 - RNA, 19 nt, Homo sapiens
gaggaagaucgaccuauua

SEQ ID NO: 191258 - RNA, 19 nt, Homo sapiens
cgaggaagaucgaccuauu

SEQ ID NO: 191259 - RNA, 19 nt, Homo sapiens
gcuccuauguuggaaauuu

SEQ ID NO: 191260 - RNA, 19 nt, Homo sapiens
gaaggcacguugaaaugau

SEQ ID NO: 191261 - RNA, 19 nt, Homo sapiens
gaaaagcaaucacaguguu

SEQ ID NO: 191262 - RNA, 19 nt, Homo sapiens
cagaugaguuggcgaggaa

SEQ ID NO: 191263 - RNA, 19 nt, Homo sapiens
gaggaaaaucgaccuauua

SEQ ID NO: 191264 - RNA, 19 nt, Homo sapiens
gaaaacgccugaagaaggu

SEQ ID NO: 191265 - RNA, 19 nt, Homo sapiens
gagauggacccgccaaauc

SEQ ID NO: 191266 - RNA, 19 nt, Homo sapiens
aaagaaggcacguugaaau

SEQ ID NO: 191267 - RNA, 19 nt, Homo sapiens
gggagcaucugcaggucaa

SEQ ID NO: 191268 - RNA, 19 nt, Homo sapiens
ggaagaucgaccuauuauu

SEQ ID NO: 191269 - RNA, 19 nt, Homo sapiens
ugaagaaggugaaaagcaa

SEQ ID NO: 191270 - RNA, 19 nt, Homo sapiens
ggagauggacccgccaaau

SEQ ID NO: 191271 - RNA, 19 nt, Homo sapiens
ccaauaauaggucgaucuu

SEQ ID NO: 191272 - RNA, 19 nt, Homo sapiens
ggaaccagcaacaccugaa

SEQ ID NO: 191273 - RNA, 19 nt, Homo sapiens
ggcccgagcaguucaguga

SEQ ID NO: 191274 - RNA, 19 nt, Homo sapiens
gaccaaggcgcuauguaca

SEQ ID NO: 191275 - RNA, 19 nt, Homo sapiens
uuacagccuucugcaaaga

SEQ ID NO: 191276 - RNA, 19 nt, Homo sapiens
acucauauuucacacagau

SEQ ID NO: 191277 - RNA, 19 nt, Homo sapiens
aagaaggcacguugaaaug

SEQ ID NO: 191278 - RNA, 19 nt, Homo sapiens
agaaggcacguugaaauga

SEQ ID NO: 191279 - RNA, 19 nt, Homo sapiens
ccgagcaguucagugauga

SEQ ID NO: 191280 - RNA, 19 nt, Homo sapiens
gaucuuccucgccaacuca

SEQ ID NO: 191281 - RNA, 19 nt, Homo sapiens
aaagcaaucacaguguuaa

SEQ ID NO: 191282 - RNA, 19 nt, Homo sapiens
gaaccagcaacaccugaag

SEQ ID NO: 191283 - RNA, 19 nt, Homo sapiens
ggucuaggccaauaauagg

SEQ ID NO: 191284 - RNA, 19 nt, Homo sapiens
gugugaagaugguccugau

SEQ ID NO: 191285 - RNA, 19 nt, Homo sapiens
aggaagaucgaccuauuau

SEQ ID NO: 191286 - RNA, 19 nt, Homo sapiens
uaaaagaaggcacguugaa

SEQ ID NO: 191287 - RNA, 19 nt, Homo sapiens
ggugaaaacgccugaagaa

SEQ ID NO: 191288 - RNA, 19 nt, Homo sapiens
gaaucucaguagaggaaaa

SEQ ID NO: 191289 - RNA, 19 nt, Homo sapiens
ggaaccagcaacucaacgu

SEQ ID NO: 191290 - RNA, 19 nt, Homo sapiens
ggaaaaucgaccuauuauu

SEQ ID NO: 191291 - RNA, 19 nt, Homo sapiens
cuuuacagccuucugcaaa

SEQ ID NO: 191292 - RNA, 19 nt, Homo sapiens
caaucacaguguuaaaaga

SEQ ID NO: 191293 - RNA, 19 nt, Homo sapiens
ugaaguggaaccagcaaca

SEQ ID NO: 191294 - RNA, 19 nt, Homo sapiens
cccgagcaguucagugaug

SEQ ID NO: 191295 - RNA, 19 nt, Homo sapiens
gaccuauuauuggccuaga

SEQ ID NO: 191296 - RNA, 19 nt, Homo sapiens
agacugggugugaguguga

SEQ ID NO: 191297 - RNA, 19 nt, Homo sapiens
gaugaguuggcgaggaaga

SEQ ID NO: 191298 - RNA, 19 nt, Homo sapiens
caaauccagaggaggugaa

SEQ ID NO: 191299 - RNA, 19 nt, Homo sapiens
agaccaaggcgcuauguac

SEQ ID NO: 191300 - RNA, 19 nt, Homo sapiens
agaggaaaaucgaccuauu

SEQ ID NO: 191301 - RNA, 19 nt, Homo sapiens
gaagaucgaccuauuauug

SEQ ID NO: 191302 - RNA, 19 nt, Homo sapiens
gaggaagaucgaccuauua

SEQ ID NO: 191303 - RNA, 19 nt, Homo sapiens
cgaggaagaucgaccuauu

SEQ ID NO: 191304 - RNA, 19 nt, Homo sapiens
gcuccuauguuggaaauuu

SEQ ID NO: 191305 - RNA, 19 nt, Homo sapiens
gaaggcacguugaaaugau

SEQ ID NO: 191306 - RNA, 19 nt, Homo sapiens
gaaaagcaaucacaguguu

SEQ ID NO: 191307 - RNA, 19 nt, Homo sapiens
gaaaacgccugaagaaggu

SEQ ID NO: 191308 - RNA, 19 nt, Homo sapiens
aauaugaguuggcgaggaa

SEQ ID NO: 191309 - RNA, 19 nt, Homo sapiens
gagauggacccgccaaauc

SEQ ID NO: 191310 - RNA, 19 nt, Homo sapiens
aaagaaggcacguugaaau

SEQ ID NO: 191311 - RNA, 19 nt, Homo sapiens
gggagcaucugcaggucaa

SEQ ID NO: 191312 - RNA, 19 nt, Homo sapiens
ggaagaucgaccuauuauu

SEQ ID NO: 191313 - RNA, 19 nt, Homo sapiens
ugaagaaggugaaaagcaa

SEQ ID NO: 191314 - RNA, 19 nt, Homo sapiens
ggagauggacccgccaaau

SEQ ID NO: 191315 - RNA, 19 nt, Homo sapiens
ggaaccagcaacaccugaa

SEQ ID NO: 191316 - RNA, 19 nt, Homo sapiens
ggcccgagcaguucaguga

SEQ ID NO: 191317 - RNA, 19 nt, Homo sapiens
gaccaaggcgcuauguaca

SEQ ID NO: 191318 - RNA, 19 nt, Homo sapiens
aagaaggcacguugaaaug

SEQ ID NO: 191319 - RNA, 19 nt, Homo sapiens
agaaggcacguugaaauga

SEQ ID NO: 191320 - RNA, 19 nt, Homo sapiens
ccgagcaguucagugauga

SEQ ID NO: 191321 - RNA, 19 nt, Homo sapiens
aaagcaaucacaguguuaa

SEQ ID NO: 191322 - RNA, 19 nt, Homo sapiens
gaaccagcaacaccugaag

SEQ ID NO: 191323 - RNA, 19 nt, Homo sapiens
gugugaagaugguccugau

SEQ ID NO: 191324 - RNA, 19 nt, Homo sapiens
aggaagaucgaccuauuau

SEQ ID NO: 191325 - RNA, 19 nt, Homo sapiens
uaaaagaaggcacguugaa

SEQ ID NO: 191326 - RNA, 19 nt, Homo sapiens
ggugaaaacgccugaagaa

SEQ ID NO: 191327 - RNA, 19 nt, Homo sapiens
ggaaccagcaacucaacgu

SEQ ID NO: 191328 - RNA, 19 nt, Homo sapiens
cuuuacagccuucugcaaa

SEQ ID NO: 191329 - RNA, 19 nt, Homo sapiens
caaucacaguguuaaaaga

SEQ ID NO: 191330 - RNA, 19 nt, Homo sapiens
gaccuauuauuggccuaga

SEQ ID NO: 191331 - RNA, 19 nt, Homo sapiens
ugaaguggaaccagcaaca

SEQ ID NO: 191332 - RNA, 19 nt, Homo sapiens
cccgagcaguucagugaug

SEQ ID NO: 191333 - RNA, 19 nt, Homo sapiens
agacugggugugaguguga

SEQ ID NO: 191334 - RNA, 19 nt, Homo sapiens
caaauccagaggaggugaa

SEQ ID NO: 191335 - RNA, 19 nt, Homo sapiens
agaccaaggcgcuauguac

SEQ ID NO: 191336 - RNA, 19 nt, Homo sapiens
gaagaucgaccuauuauug

SEQ ID NO: 191337 - RNA, 19 nt, Homo sapiens
gaggaagaucgaccuauua

SEQ ID NO: 191338 - RNA, 19 nt, Homo sapiens
cgaggaagaucgaccuauu

SEQ ID NO: 191339 - RNA, 19 nt, Homo sapiens
gcuccuauguuggaaauuu

SEQ ID NO: 191340 - RNA, 19 nt, Homo sapiens
gaaggcacguugaaaugau

SEQ ID NO: 191341 - RNA, 19 nt, Homo sapiens
gaaaagcaaucacaguguu

SEQ ID NO: 191342 - RNA, 19 nt, Homo sapiens
gaaaacgccugaagaaggu

SEQ ID NO: 191343 - RNA, 19 nt, Homo sapiens
aauaugaguuggcgaggaa

SEQ ID NO: 191344 - RNA, 19 nt, Homo sapiens
gagauggacccgccaaauc

SEQ ID NO: 191345 - RNA, 19 nt, Homo sapiens
aaagaaggcacguugaaau

SEQ ID NO: 191346 - RNA, 19 nt, Homo sapiens
gggagcaucugcaggucaa

SEQ ID NO: 191347 - RNA, 19 nt, Homo sapiens
ggaagaucgaccuauuauu

SEQ ID NO: 191348 - RNA, 19 nt, Homo sapiens
ugaagaaggugaaaagcaa

SEQ ID NO: 191349 - RNA, 19 nt, Homo sapiens
ggagauggacccgccaaau

SEQ ID NO: 191350 - RNA, 19 nt, Homo sapiens
ggaaccagcaacaccugaa

SEQ ID NO: 191351 - RNA, 19 nt, Homo sapiens
ggcccgagcaguucaguga

SEQ ID NO: 191352 - RNA, 19 nt, Homo sapiens
gaccaaggcgcuauguaca

SEQ ID NO: 191353 - RNA, 19 nt, Homo sapiens
uuacagccuucugcaaaga

SEQ ID NO: 191354 - RNA, 19 nt, Homo sapiens
aagaaggcacguugaaaug

SEQ ID NO: 191355 - RNA, 19 nt, Homo sapiens
agaaggcacguugaaauga

SEQ ID NO: 191356 - RNA, 19 nt, Homo sapiens
ccgagcaguucagugauga

SEQ ID NO: 191357 - RNA, 19 nt, Homo sapiens
aaagcaaucacaguguuaa

SEQ ID NO: 191358 - RNA, 19 nt, Homo sapiens
gaaccagcaacaccugaag

SEQ ID NO: 191359 - RNA, 19 nt, Homo sapiens
gugugaagaugguccugau

SEQ ID NO: 191360 - RNA, 19 nt, Homo sapiens
aggaagaucgaccuauuau

SEQ ID NO: 191361 - RNA, 19 nt, Homo sapiens
uaaaagaaggcacguugaa

SEQ ID NO: 191362 - RNA, 19 nt, Homo sapiens
ggugaaaacgccugaagaa

SEQ ID NO: 191363 - RNA, 19 nt, Homo sapiens
ggaaccagcaacucaacgu

SEQ ID NO: 191364 - RNA, 19 nt, Homo sapiens
cuuuacagccuucugcaaa

SEQ ID NO: 191365 - RNA, 19 nt, Homo sapiens
gaccuauuauuggccuaga

SEQ ID NO: 191366 - RNA, 19 nt, Homo sapiens
caaucacaguguuaaaaga

SEQ ID NO: 191367 - RNA, 19 nt, Homo sapiens
ugaaguggaaccagcaaca

SEQ ID NO: 191368 - RNA, 19 nt, Homo sapiens
cccgagcaguucagugaug

SEQ ID NO: 191369 - RNA, 19 nt, Homo sapiens
agacugggugugaguguga

SEQ ID NO: 191370 - RNA, 19 nt, Homo sapiens
caaauccagaggaggugaa

SEQ ID NO: 191371 - RNA, 19 nt, Homo sapiens
agaccaaggcgcuauguac

SEQ ID NO: 191372 - RNA, 19 nt, Homo sapiens
gaagaucgaccuauuauug

SEQ ID NO: 191373 - RNA, 19 nt, Homo sapiens
gaagacacguugaaaugau

SEQ ID NO: 191374 - RNA, 19 nt, Homo sapiens
gaggaagaucgaccuauua

SEQ ID NO: 191375 - RNA, 19 nt, Homo sapiens
cgaggaagaucgaccuauu

SEQ ID NO: 191376 - RNA, 19 nt, Homo sapiens
gcuccuauguuggaaauuu

SEQ ID NO: 191377 - RNA, 19 nt, Homo sapiens
gaaaagcaaucacaguguu

SEQ ID NO: 191378 - RNA, 19 nt, Homo sapiens
gaaaacgccugaagaaggu

SEQ ID NO: 191379 - RNA, 19 nt, Homo sapiens
aauaugaguuggcgaggaa

SEQ ID NO: 191380 - RNA, 19 nt, Homo sapiens
gggagcaucugcaggucaa

SEQ ID NO: 191381 - RNA, 19 nt, Homo sapiens
aagaagacacguugaaaug

SEQ ID NO: 191382 - RNA, 19 nt, Homo sapiens
ggaagaucgaccuauuauu

SEQ ID NO: 191383 - RNA, 19 nt, Homo sapiens
aaagaagacacguugaaau

SEQ ID NO: 191384 - RNA, 19 nt, Homo sapiens
ugaagaaggugaaaagcaa

SEQ ID NO: 191385 - RNA, 19 nt, Homo sapiens
gagguggacccgccaaauc

SEQ ID NO: 191386 - RNA, 19 nt, Homo sapiens
ggaaccagcaacaccugaa

SEQ ID NO: 191387 - RNA, 19 nt, Homo sapiens
ggcccgagcaguucaguga

SEQ ID NO: 191388 - RNA, 19 nt, Homo sapiens
gaccaaggcgcuauguaca

SEQ ID NO: 191389 - RNA, 19 nt, Homo sapiens
agaagacacguugaaauga

SEQ ID NO: 191390 - RNA, 19 nt, Homo sapiens
aagacacguugaaaugaug

SEQ ID NO: 191391 - RNA, 19 nt, Homo sapiens
ccgagcaguucagugauga

SEQ ID NO: 191392 - RNA, 19 nt, Homo sapiens
aaagcaaucacaguguuaa

SEQ ID NO: 191393 - RNA, 19 nt, Homo sapiens
gaaccagcaacaccugaag

SEQ ID NO: 191394 - RNA, 19 nt, Homo sapiens
uaaaagaagacacguugaa

SEQ ID NO: 191395 - RNA, 19 nt, Homo sapiens
ggagguggacccgccaaau

SEQ ID NO: 191396 - RNA, 19 nt, Homo sapiens
gugugaagaugguccugau

SEQ ID NO: 191397 - RNA, 19 nt, Homo sapiens
aggaagaucgaccuauuau

SEQ ID NO: 191398 - RNA, 19 nt, Homo sapiens
ggugaaaacgccugaagaa

SEQ ID NO: 191399 - RNA, 19 nt, Homo sapiens
ggaaccagcaacucaacgu

SEQ ID NO: 191400 - RNA, 19 nt, Homo sapiens
cuuuacagccuucugcaaa

SEQ ID NO: 191401 - RNA, 19 nt, Homo sapiens
gaccuauuauuggccuaga

SEQ ID NO: 191402 - RNA, 19 nt, Homo sapiens
caaucacaguguuaaaaga

SEQ ID NO: 191403 - RNA, 19 nt, Homo sapiens
ugaaguggaaccagcaaca

SEQ ID NO: 191404 - RNA, 19 nt, Homo sapiens
cccgagcaguucagugaug

SEQ ID NO: 191405 - RNA, 19 nt, Homo sapiens
agacugggugugaguguga

SEQ ID NO: 191406 - RNA, 19 nt, Homo sapiens
caaauccagaggaggugaa

SEQ ID NO: 191407 - RNA, 19 nt, Homo sapiens
agaccaaggcgcuauguac

SEQ ID NO: 191408 - RNA, 19 nt, Homo sapiens
gaagaucgaccuauuauug

SEQ ID NO: 191409 - RNA, 19 nt, Homo sapiens
gaggaagaucgaccuauua

SEQ ID NO: 191410 - RNA, 19 nt, Homo sapiens
cgaggaagaucgaccuauu

SEQ ID NO: 191411 - RNA, 19 nt, Homo sapiens
gaaggcacguugaaaugau

SEQ ID NO: 191412 - RNA, 19 nt, Homo sapiens
gaaaagcaaucacaguguu

SEQ ID NO: 191413 - RNA, 19 nt, Homo sapiens
gaaaacgccugaagaaggu

SEQ ID NO: 191414 - RNA, 19 nt, Homo sapiens
aauaugaguuggcgaggaa

SEQ ID NO: 191415 - RNA, 19 nt, Homo sapiens
gagauggacccgccaaauc

SEQ ID NO: 191416 - RNA, 19 nt, Homo sapiens
aaagaaggcacguugaaau

SEQ ID NO: 191417 - RNA, 19 nt, Homo sapiens
gggagcaucugcaggucaa

SEQ ID NO: 191418 - RNA, 19 nt, Homo sapiens
ggaagaucgaccuauuauu

SEQ ID NO: 191419 - RNA, 19 nt, Homo sapiens
ugaagaaggugaaaagcaa

SEQ ID NO: 191420 - RNA, 19 nt, Homo sapiens
ggagauggacccgccaaau

SEQ ID NO: 191421 - RNA, 19 nt, Homo sapiens
ggaaccagcaacaccugaa

SEQ ID NO: 191422 - RNA, 19 nt, Homo sapiens
ggcccgagcaguucaguga

SEQ ID NO: 191423 - RNA, 19 nt, Homo sapiens
gaccaaggcgcuauguaca

SEQ ID NO: 191424 - RNA, 19 nt, Homo sapiens
aagaaggcacguugaaaug

SEQ ID NO: 191425 - RNA, 19 nt, Homo sapiens
agaaggcacguugaaauga

SEQ ID NO: 191426 - RNA, 19 nt, Homo sapiens
ccgagcaguucagugauga

SEQ ID NO: 191427 - RNA, 19 nt, Homo sapiens
aaagcaaucacaguguuaa

SEQ ID NO: 191428 - RNA, 19 nt, Homo sapiens
gaaccagcaacaccugaag

SEQ ID NO: 191429 - RNA, 19 nt, Homo sapiens
gugugaagaugguccugau

SEQ ID NO: 191430 - RNA, 19 nt, Homo sapiens
aggaagaucgaccuauuau

SEQ ID NO: 191431 - RNA, 19 nt, Homo sapiens
uaaaagaaggcacguugaa

SEQ ID NO: 191432 - RNA, 19 nt, Homo sapiens
ggugaaaacgccugaagaa

SEQ ID NO: 191433 - RNA, 19 nt, Homo sapiens
ggaaccagcaacucaacgu

SEQ ID NO: 191434 - RNA, 19 nt, Homo sapiens
cuuuacagccuucugcaaa

SEQ ID NO: 191435 - RNA, 19 nt, Homo sapiens
gagcugugaggcagucugu

SEQ ID NO: 191436 - RNA, 19 nt, Homo sapiens
caaucacaguguuaaaaga

SEQ ID NO: 191437 - RNA, 19 nt, Homo sapiens
gaccuauuauuggccuaga

SEQ ID NO: 191438 - RNA, 19 nt, Homo sapiens
ugaaguggaaccagcaaca

SEQ ID NO: 191439 - RNA, 19 nt, Homo sapiens
cccgagcaguucagugaug

SEQ ID NO: 191440 - RNA, 19 nt, Homo sapiens
uauguacagccuccugaaa

SEQ ID NO: 191441 - RNA, 19 nt, Homo sapiens
agacugggugugaguguga

SEQ ID NO: 191442 - RNA, 19 nt, Homo sapiens
caaauccagaggaggugaa

SEQ ID NO: 191443 - RNA, 19 nt, Homo sapiens
agaccaaggcgcuauguac

SEQ ID NO: 191444 - RNA, 19 nt, Homo sapiens
ggacauaucuuacaucaca

SEQ ID NO: 191445 - RNA, 19 nt, Homo sapiens
gcacacagcuccacagguu

SEQ ID NO: 191446 - RNA, 19 nt, Homo sapiens
gaagagaucacgaggaaua

SEQ ID NO: 191447 - RNA, 19 nt, Homo sapiens
guugagaacuuguugcuua

SEQ ID NO: 191448 - RNA, 19 nt, Homo sapiens
gaacagagccaucauucaa

SEQ ID NO: 191449 - RNA, 19 nt, Homo sapiens
gaagaucuguuguccaauc

SEQ ID NO: 191450 - RNA, 19 nt, Homo sapiens
gaauugcagugaugucauu

SEQ ID NO: 191451 - RNA, 19 nt, Homo sapiens
gaaggaggguuugcauuug

SEQ ID NO: 191452 - RNA, 19 nt, Homo sapiens
gagaacuuguugcuuagua

SEQ ID NO: 191453 - RNA, 19 nt, Homo sapiens
uaaagaggcuauuauccaa

SEQ ID NO: 191454 - RNA, 19 nt, Homo sapiens
gaagagaaagcauuccaaa

SEQ ID NO: 191455 - RNA, 19 nt, Homo sapiens
guaugaagcucaagaugug

SEQ ID NO: 191456 - RNA, 19 nt, Homo sapiens
gcagagaguaugcauuaaa

SEQ ID NO: 191457 - RNA, 19 nt, Homo sapiens
gcaccgcacuuuguaauca

SEQ ID NO: 191458 - RNA, 19 nt, Homo sapiens
gagcgagucugcccugaug

SEQ ID NO: 191459 - RNA, 19 nt, Homo sapiens
agagugaggugucagauga

SEQ ID NO: 191460 - RNA, 19 nt, Homo sapiens
cgaaggaggguuugcauuu

SEQ ID NO: 191461 - RNA, 19 nt, Homo sapiens
gaacgacuuugaagaucug

SEQ ID NO: 191462 - RNA, 19 nt, Homo sapiens
caaagccucugauuguugu

SEQ ID NO: 191463 - RNA, 19 nt, Homo sapiens
gcacacagccaaggccuaa

SEQ ID NO: 191464 - RNA, 19 nt, Homo sapiens
uggcagagaguaugcauua

SEQ ID NO: 191465 - RNA, 19 nt, Homo sapiens
caaagaccauugcagagau

SEQ ID NO: 191466 - RNA, 19 nt, Homo sapiens
ugggagaacucgagcauga

SEQ ID NO: 191467 - RNA, 19 nt, Homo sapiens
ggagagcccagcaagauga

SEQ ID NO: 191468 - RNA, 19 nt, Homo sapiens
uagaacaccagaaaucaua

SEQ ID NO: 191469 - RNA, 19 nt, Homo sapiens
ccaggcacaugaagagaaa

SEQ ID NO: 191470 - RNA, 19 nt, Homo sapiens
gagcagcacgccaagauga

SEQ ID NO: 191471 - RNA, 19 nt, Homo sapiens
gaacgccaccacugugaaa

SEQ ID NO: 191472 - RNA, 19 nt, Homo sapiens
ccacgaccaucucgcacua

SEQ ID NO: 191473 - RNA, 19 nt, Homo sapiens
gacaagaugcgggacuuua

SEQ ID NO: 191474 - RNA, 19 nt, Homo sapiens
caccagaaaucauagacuu

SEQ ID NO: 191475 - RNA, 19 nt, Homo sapiens
aggaagagaucacgaggaa

SEQ ID NO: 191476 - RNA, 19 nt, Homo sapiens
gagaacgacuuugaagauc

SEQ ID NO: 191477 - RNA, 19 nt, Homo sapiens
ggacgcgugugacauucaa

SEQ ID NO: 191478 - RNA, 19 nt, Homo sapiens
uccaguccgucgcuaauua

SEQ ID NO: 191479 - RNA, 19 nt, Homo sapiens
cagaaaucauagacuugua

SEQ ID NO: 191480 - RNA, 19 nt, Homo sapiens
caacaccaauguauagaac

SEQ ID NO: 191481 - RNA, 19 nt, Homo sapiens
ccaugaagauguuccagau

SEQ ID NO: 191482 - RNA, 19 nt, Homo sapiens
ccauuaagcugugugacuu

SEQ ID NO: 191483 - RNA, 19 nt, Homo sapiens
gacaagaaagggccaaaga

SEQ ID NO: 191484 - RNA, 19 nt, Homo sapiens
uugaagaucuguuguccaa

SEQ ID NO: 191485 - RNA, 19 nt, Homo sapiens
ggcagagacuggugcagaa

SEQ ID NO: 191486 - RNA, 19 nt, Homo sapiens
ugaaauuugccaaguauga

SEQ ID NO: 191487 - RNA, 19 nt, Homo sapiens
agacuuguauuccaacuuc

SEQ ID NO: 191488 - RNA, 19 nt, Homo sapiens
cagagaguaugcauuaaag

SEQ ID NO: 191489 - RNA, 19 nt, Homo sapiens
uacaucacauccagaauug

SEQ ID NO: 191490 - RNA, 19 nt, Homo sapiens
guauagaacaccagaaauc

SEQ ID NO: 191491 - RNA, 19 nt, Homo sapiens
aagggcagcugguggaauu

SEQ ID NO: 191492 - RNA, 19 nt, Homo sapiens
cgaaggaacagcugauuca

SEQ ID NO: 191493 - RNA, 19 nt, Homo sapiens
acagagccaucauucaaga

SEQ ID NO: 191494 - RNA, 19 nt, Homo sapiens
gcauuaaagaggcuauuau

SEQ ID NO: 191495 - RNA, 19 nt, Homo sapiens
gguuugcauuuguguauga

SEQ ID NO: 191496 - RNA, 19 nt, Homo sapiens
ccaagucucccaucacaga

SEQ ID NO: 191497 - RNA, 19 nt, Homo sapiens
ggucggaguuugagaacca

SEQ ID NO: 191498 - RNA, 19 nt, Homo sapiens
gaacaccagaaaucauaga

SEQ ID NO: 191499 - RNA, 19 nt, Homo sapiens
gcgacacgguucugaagau

SEQ ID NO: 191500 - RNA, 19 nt, Homo sapiens
ccaaagaccauugcagaga

SEQ ID NO: 191501 - RNA, 19 nt, Homo sapiens
ugugaaauuugccaaguau

SEQ ID NO: 191502 - RNA, 19 nt, Homo sapiens
gcaaggagacgugcucauc

SEQ ID NO: 191503 - RNA, 19 nt, Homo sapiens
uuacaucacauccagaauu

SEQ ID NO: 191504 - RNA, 19 nt, Homo sapiens
agaacuuguugcuuaguaa

SEQ ID NO: 191505 - RNA, 19 nt, Homo sapiens
ccaaagccucugauuguug

SEQ ID NO: 191506 - RNA, 19 nt, Homo sapiens
cuccaggucugacaagaaa

SEQ ID NO: 191507 - RNA, 19 nt, Homo sapiens
ucagaacccggacccauuu

SEQ ID NO: 191508 - RNA, 19 nt, Homo sapiens
ucauagacuuguauuccaa

SEQ ID NO: 191509 - RNA, 19 nt, Homo sapiens
gaucuguuguccaaucaag

SEQ ID NO: 191510 - RNA, 19 nt, Homo sapiens
ggacccauuugcugaccuu

SEQ ID NO: 191511 - RNA, 19 nt, Homo sapiens
cgccaccacugugaaauuu

SEQ ID NO: 191512 - RNA, 19 nt, Homo sapiens
gaugcgggacuuuaagauu

SEQ ID NO: 191513 - RNA, 19 nt, Homo sapiens
ugagaacgacuuugaagau

SEQ ID NO: 191514 - RNA, 19 nt, Homo sapiens
gccucgaacuucaguguga

SEQ ID NO: 191515 - RNA, 19 nt, Homo sapiens
gcuccacggcucaguauga

SEQ ID NO: 191516 - RNA, 19 nt, Homo sapiens
gcuauuauccaaugaagag

SEQ ID NO: 191517 - RNA, 19 nt, Homo sapiens
ccggauuuauuucaaguga

SEQ ID NO: 191518 - RNA, 19 nt, Homo sapiens
acaagaugcgggacuuuaa

SEQ ID NO: 191519 - RNA, 19 nt, Homo sapiens
gcacuaugccgucuacaac

SEQ ID NO: 191520 - RNA, 19 nt, Homo sapiens
gaggauggagcgaaacuuc

SEQ ID NO: 191521 - RNA, 19 nt, Homo sapiens
uguaaucagucccgugguu

SEQ ID NO: 191522 - RNA, 19 nt, Homo sapiens
ggaggagcagcaagacauu

SEQ ID NO: 191523 - RNA, 19 nt, Homo sapiens
aagaggcuauuauccaaug

SEQ ID NO: 191524 - RNA, 19 nt, Homo sapiens
guaaccaagggaccauuaa

SEQ ID NO: 191525 - RNA, 19 nt, Homo sapiens
gaaagggccaaagaccauu

SEQ ID NO: 191526 - RNA, 19 nt, Homo sapiens
gaaaagaacagagccauca

SEQ ID NO: 191527 - RNA, 19 nt, Homo sapiens
gagaguaugcauuaaagag

SEQ ID NO: 191528 - RNA, 19 nt, Homo sapiens
augaagauguuccagauuc

SEQ ID NO: 191529 - RNA, 19 nt, Homo sapiens
gaauagucaaugggaagua

SEQ ID NO: 191530 - RNA, 19 nt, Homo sapiens
gcgagaagcaggauaucug

SEQ ID NO: 191531 - RNA, 19 nt, Homo sapiens
acacgguucugaagaucuu

SEQ ID NO: 191532 - RNA, 19 nt, Homo sapiens
gaagagaaggaggcagaga

SEQ ID NO: 191533 - RNA, 19 nt, Homo sapiens
uaagauugaagauggcaaa

SEQ ID NO: 191534 - RNA, 19 nt, Homo sapiens
gcgccaugcugcaggugaa

SEQ ID NO: 191535 - RNA, 19 nt, Homo sapiens
gagaucacgaggaauacaa

SEQ ID NO: 191536 - RNA, 19 nt, Homo sapiens
gcucaugggcccugguguu

SEQ ID NO: 191537 - RNA, 19 nt, Homo sapiens
ucugauuguuguuuccuuu

SEQ ID NO: 191538 - RNA, 19 nt, Homo sapiens
aaagaccauugcagagaug

SEQ ID NO: 191539 - RNA, 19 nt, Homo sapiens
ggcagagaguaugcauuaa

SEQ ID NO: 191540 - RNA, 19 nt, Homo sapiens
cgacuuugaagaucuguug

SEQ ID NO: 191541 - RNA, 19 nt, Homo sapiens
uaacuaugccucgaacuuc

SEQ ID NO: 191542 - RNA, 19 nt, Homo sapiens
gcagagacuggugcagaaa

SEQ ID NO: 191543 - RNA, 19 nt, Homo sapiens
augcgggacuuuaagauug

SEQ ID NO: 191544 - RNA, 19 nt, Homo sapiens
gaagacaguuggccauuua

SEQ ID NO: 191545 - RNA, 19 nt, Homo sapiens
ggaccaaucugacuauaaa

SEQ ID NO: 191546 - RNA, 19 nt, Homo sapiens
gaagaggaaucccaauauu

SEQ ID NO: 191547 - RNA, 19 nt, Homo sapiens
ggaauuuaguggcuaguua

SEQ ID NO: 191548 - RNA, 19 nt, Homo sapiens
gcaaaucaguuauucaugu

SEQ ID NO: 191549 - RNA, 19 nt, Homo sapiens
acacucacguuaacuauua

SEQ ID NO: 191550 - RNA, 19 nt, Homo sapiens
uaaacuaccucuaacacua

SEQ ID NO: 191551 - RNA, 19 nt, Homo sapiens
ggacauugauuauauugga

SEQ ID NO: 191552 - RNA, 19 nt, Homo sapiens
caaggugguugauguuaua

SEQ ID NO: 191553 - RNA, 19 nt, Homo sapiens
ucacugagauguauuuaug

SEQ ID NO: 191554 - RNA, 19 nt, Homo sapiens
ggccauuucuuccuuauuu

SEQ ID NO: 191555 - RNA, 19 nt, Homo sapiens
gcucauaccacucaguuua

SEQ ID NO: 191556 - RNA, 19 nt, Homo sapiens
guucucagauauuggauua

SEQ ID NO: 191557 - RNA, 19 nt, Homo sapiens
cauguacuguguauucuua

SEQ ID NO: 191558 - RNA, 19 nt, Homo sapiens
ggaacucacuccuuugaau

SEQ ID NO: 191559 - RNA, 19 nt, Homo sapiens
gaaaggaggaagcuacgua

SEQ ID NO: 191560 - RNA, 19 nt, Homo sapiens
gaaaacuggugaaucuuua

SEQ ID NO: 191561 - RNA, 19 nt, Homo sapiens
ugaucaaacugguguauuu

SEQ ID NO: 191562 - RNA, 19 nt, Homo sapiens
uagugaagcuccaaacuuu

SEQ ID NO: 191563 - RNA, 19 nt, Homo sapiens
ucacacagcugaugaaugc

SEQ ID NO: 191564 - RNA, 19 nt, Homo sapiens
ugauuuagcuggauggauu

SEQ ID NO: 191565 - RNA, 19 nt, Homo sapiens
cagcugauguaucuaauau

SEQ ID NO: 191566 - RNA, 19 nt, Homo sapiens
ugagguagcucucuucauc

SEQ ID NO: 191567 - RNA, 19 nt, Homo sapiens
cagucaagcuucagaauau

SEQ ID NO: 191568 - RNA, 19 nt, Homo sapiens
gaacucacuccuuugaauu

SEQ ID NO: 191569 - RNA, 19 nt, Homo sapiens
cgacuggccuuaugucaau

SEQ ID NO: 191570 - RNA, 19 nt, Homo sapiens
agaauuggaucaucuccua

SEQ ID NO: 191571 - RNA, 19 nt, Homo sapiens
agaugaugcugccauaaua

SEQ ID NO: 191572 - RNA, 19 nt, Homo sapiens
ggaauuuucuucuggauuu

SEQ ID NO: 191573 - RNA, 19 nt, Homo sapiens
gcauaaugauuugagauug

SEQ ID NO: 191574 - RNA, 19 nt, Homo sapiens
gaaccucaccaucaucauu

SEQ ID NO: 191575 - RNA, 19 nt, Homo sapiens
gcauuaauguggcucuaug

SEQ ID NO: 191576 - RNA, 19 nt, Homo sapiens
gcagauuaauuggguuauu

SEQ ID NO: 191577 - RNA, 19 nt, Homo sapiens
cauagaauacucuggauuu

SEQ ID NO: 191578 - RNA, 19 nt, Homo sapiens
uaacagggcaucauagaau

SEQ ID NO: 191579 - RNA, 19 nt, Homo sapiens
gcaugaagaugagcuguuc

SEQ ID NO: 191580 - RNA, 19 nt, Homo sapiens
gcaggaagaguaaauaaag

SEQ ID NO: 191581 - RNA, 19 nt, Homo sapiens
uaacauaggcuuagcuaca

SEQ ID NO: 191582 - RNA, 19 nt, Homo sapiens
gaaaugcaggauaugauga

SEQ ID NO: 191583 - RNA, 19 nt, Homo sapiens
guagauggcaguaacuuga

SEQ ID NO: 191584 - RNA, 19 nt, Homo sapiens
ugacagcgauggcaguuuc

SEQ ID NO: 191585 - RNA, 19 nt, Homo sapiens
gcagcuggauucucuaugg

SEQ ID NO: 191586 - RNA, 19 nt, Homo sapiens
ugaagacuuuagcacuuua

SEQ ID NO: 191587 - RNA, 19 nt, Homo sapiens
gcacugagcccucccacau

SEQ ID NO: 191588 - RNA, 19 nt, Homo sapiens
guagcucucuucaucuuau

SEQ ID NO: 191589 - RNA, 19 nt, Homo sapiens
ccucacaugugcacuggua

SEQ ID NO: 191590 - RNA, 19 nt, Homo sapiens
acaagaugaugcugccaua

SEQ ID NO: 191591 - RNA, 19 nt, Homo sapiens
caagugagccagugucuuc

SEQ ID NO: 191592 - RNA, 19 nt, Homo sapiens
guaccuauaaggaugauuu

SEQ ID NO: 191593 - RNA, 19 nt, Homo sapiens
aagaggaaucccaauauua

SEQ ID NO: 191594 - RNA, 19 nt, Homo sapiens
gccacacgcuaauacuuaa

SEQ ID NO: 191595 - RNA, 19 nt, Homo sapiens
cuauguagcaaaucaguua

SEQ ID NO: 191596 - RNA, 19 nt, Homo sapiens
ggucuuguaaccacuauaa

SEQ ID NO: 191597 - RNA, 19 nt, Homo sapiens
cugaagaacacuagaagua

SEQ ID NO: 191598 - RNA, 19 nt, Homo sapiens
gaacaguauaugaggcuuu

SEQ ID NO: 191599 - RNA, 19 nt, Homo sapiens
ucccagcccuucccaagua

SEQ ID NO: 191600 - RNA, 19 nt, Homo sapiens
ugaagacaguuggccauuu

SEQ ID NO: 191601 - RNA, 19 nt, Homo sapiens
caugugcacugguaacaga

SEQ ID NO: 191602 - RNA, 19 nt, Homo sapiens
agaauuauuuccgaggaua

SEQ ID NO: 191603 - RNA, 19 nt, Homo sapiens
ccagucaagcuucagaaua

SEQ ID NO: 191604 - RNA, 19 nt, Homo sapiens
aauuggaacucacuccuuu

SEQ ID NO: 191605 - RNA, 19 nt, Homo sapiens
ccucuggcaugcugaauga

SEQ ID NO: 191606 - RNA, 19 nt, Homo sapiens
gguauacacucacguuaac

SEQ ID NO: 191607 - RNA, 19 nt, Homo sapiens
uuaagcagcuggauucucu

SEQ ID NO: 191608 - RNA, 19 nt, Homo sapiens
ggauacgaguggugguuga

SEQ ID NO: 191609 - RNA, 19 nt, Homo sapiens
gccagugucuucaucacaa

SEQ ID NO: 191610 - RNA, 19 nt, Homo sapiens
uaauuuacccuguggaaga

SEQ ID NO: 191611 - RNA, 19 nt, Homo sapiens
gcuacccgcuuccuccaaa

SEQ ID NO: 191612 - RNA, 19 nt, Homo sapiens
ggccuuaugucaaucuuca

SEQ ID NO: 191613 - RNA, 19 nt, Homo sapiens
gaugaaagaagcuaagaag

SEQ ID NO: 191614 - RNA, 19 nt, Homo sapiens
cacuauaacucucugugaa

SEQ ID NO: 191615 - RNA, 19 nt, Homo sapiens
uuagcuggauggauuauau

SEQ ID NO: 191616 - RNA, 19 nt, Homo sapiens
aagaugagcuguucacacu

SEQ ID NO: 191617 - RNA, 19 nt, Homo sapiens
gagcuacagguaugguaua

SEQ ID NO: 191618 - RNA, 19 nt, Homo sapiens
acaacaauuugccaccuuu

SEQ ID NO: 191619 - RNA, 19 nt, Homo sapiens
ucagcugacugccuauuau

SEQ ID NO: 191620 - RNA, 19 nt, Homo sapiens
aacagggcaucauagaaua

SEQ ID NO: 191621 - RNA, 19 nt, Homo sapiens
gugauucagugguuuguuc

SEQ ID NO: 191622 - RNA, 19 nt, Homo sapiens
caaacauuauagaggugua

SEQ ID NO: 191623 - RNA, 19 nt, Homo sapiens
aaauauacgugagcauguu

SEQ ID NO: 191624 - RNA, 19 nt, Homo sapiens
uauagccaaugcuguugua

SEQ ID NO: 191625 - RNA, 19 nt, Homo sapiens
gaaggaagaaaaccugaua

SEQ ID NO: 191626 - RNA, 19 nt, Homo sapiens
cauaauagaaagcugaaga

SEQ ID NO: 191627 - RNA, 19 nt, Homo sapiens
aggagugguuugaguagua

SEQ ID NO: 191628 - RNA, 19 nt, Homo sapiens
gacuacaacuggaccaauc

SEQ ID NO: 191629 - RNA, 19 nt, Homo sapiens
aagaagaggaaucccaaua

SEQ ID NO: 191630 - RNA, 19 nt, Homo sapiens
cauaaugauuugagauugg

SEQ ID NO: 191631 - RNA, 19 nt, Homo sapiens
gauauacccauguaaccaa

SEQ ID NO: 191632 - RNA, 19 nt, Homo sapiens
auagaaagcugaagaacac

SEQ ID NO: 191633 - RNA, 19 nt, Homo sapiens
guucagagccaauucuugu

SEQ ID NO: 191634 - RNA, 19 nt, Homo sapiens
guucauugcaggaagagua

SEQ ID NO: 191635 - RNA, 19 nt, Homo sapiens
cacaaucaguauuauagga

SEQ ID NO: 191636 - RNA, 19 nt, Homo sapiens
cuacguagcucugacugau

SEQ ID NO: 191637 - RNA, 19 nt, Homo sapiens
uaugaacaguugccuuaug

SEQ ID NO: 191638 - RNA, 19 nt, Homo sapiens
ugaaagaagcuaagaagag

SEQ ID NO: 191639 - RNA, 19 nt, Homo sapiens
gagaauuauuuccgaggau

SEQ ID NO: 191640 - RNA, 19 nt, Homo sapiens
gguuuguuccuucuuauuu

SEQ ID NO: 191641 - RNA, 19 nt, Homo sapiens
guacuguguauucuuauga

SEQ ID NO: 191642 - RNA, 19 nt, Homo sapiens
caagugauuuccagcugau

SEQ ID NO: 191643 - RNA, 19 nt, Homo sapiens
cccgacuucuaguaaauua

SEQ ID NO: 191644 - RNA, 19 nt, Homo sapiens
ggaagaagaucccguacaa

SEQ ID NO: 191645 - RNA, 19 nt, Homo sapiens
ccaacaaccucaugccuua

SEQ ID NO: 191646 - RNA, 19 nt, Homo sapiens
gcacagguguccgggauua

SEQ ID NO: 191647 - RNA, 19 nt, Homo sapiens
agaagccucuggauuauua

SEQ ID NO: 191648 - RNA, 19 nt, Homo sapiens
gcagaauccuucaggcuuu

SEQ ID NO: 191649 - RNA, 19 nt, Homo sapiens
uaaggaagcugaaagaaca

SEQ ID NO: 191650 - RNA, 19 nt, Homo sapiens
gcuggaggcuggcuacuug

SEQ ID NO: 191651 - RNA, 19 nt, Homo sapiens
gagaaggccucugggaaga

SEQ ID NO: 191652 - RNA, 19 nt, Homo sapiens
gcagagaaggugcugguaa

SEQ ID NO: 191653 - RNA, 19 nt, Homo sapiens
cccaggcacucauuuauau

SEQ ID NO: 191654 - RNA, 19 nt, Homo sapiens
gcaaugacuaugacacaga

SEQ ID NO: 191655 - RNA, 19 nt, Homo sapiens
gggccacauugcagccuua

SEQ ID NO: 191656 - RNA, 19 nt, Homo sapiens
ggucaucgauaacuuccau

SEQ ID NO: 191657 - RNA, 19 nt, Homo sapiens
gggaggcccugaaugucuu

SEQ ID NO: 191658 - RNA, 19 nt, Homo sapiens
gcuauucagugcugcagau

SEQ ID NO: 191659 - RNA, 19 nt, Homo sapiens
gaaggccucugggaagaag

SEQ ID NO: 191660 - RNA, 19 nt, Homo sapiens
aucgauaacuuccauaaug

SEQ ID NO: 191661 - RNA, 19 nt, Homo sapiens
ccacaggguccaagaguuc

SEQ ID NO: 191662 - RNA, 19 nt, Homo sapiens
cagagaaggugcugguaac

SEQ ID NO: 191663 - RNA, 19 nt, Homo sapiens
gacgggaggcccugaaugu

SEQ ID NO: 191664 - RNA, 19 nt, Homo sapiens
cugaaugucuuuggcaaug

SEQ ID NO: 191665 - RNA, 19 nt, Homo sapiens
ccuacagcgucucuucaaa

SEQ ID NO: 191666 - RNA, 19 nt, Homo sapiens
ugaaugucuuuggcaauga

SEQ ID NO: 191667 - RNA, 19 nt, Homo sapiens
aaguguggauccucagauu

SEQ ID NO: 191668 - RNA, 19 nt, Homo sapiens
gaagcugaaagaacagugu

SEQ ID NO: 191669 - RNA, 19 nt, Homo sapiens
ccuuagggcuggacaggau

SEQ ID NO: 191670 - RNA, 19 nt, Homo sapiens
gcagcucagccacugugua

SEQ ID NO: 191671 - RNA, 19 nt, Homo sapiens
ugccuguggucaucgauaa

SEQ ID NO: 191672 - RNA, 19 nt, Homo sapiens
cuacuugccuguggucauc

SEQ ID NO: 191673 - RNA, 19 nt, Homo sapiens
cagaauccuucaggcuuug

SEQ ID NO: 191674 - RNA, 19 nt, Homo sapiens
gugauguggcagccuguua

SEQ ID NO: 191675 - RNA, 19 nt, Homo sapiens
ccacauugcagccuuaagg

SEQ ID NO: 191676 - RNA, 19 nt, Homo sapiens
gaaugucuuuggcaaugac

SEQ ID NO: 191677 - RNA, 19 nt, Homo sapiens
caggcacucauuuauauug

SEQ ID NO: 191678 - RNA, 19 nt, Homo sapiens
ggacaggaugugugaggau

SEQ ID NO: 191679 - RNA, 19 nt, Homo sapiens
gaaguguggauccucagau

SEQ ID NO: 191680 - RNA, 19 nt, Homo sapiens
ucccaggcacucauuuaua

SEQ ID NO: 191681 - RNA, 19 nt, Homo sapiens
cuggauuauuacagaguua

SEQ ID NO: 191682 - RNA, 19 nt, Homo sapiens
ccucccaggcacucauuua

SEQ ID NO: 191683 - RNA, 19 nt, Homo sapiens
ucagucaccuuggacaaag

SEQ ID NO: 191684 - RNA, 19 nt, Homo sapiens
gcaaguccaaguucuucau

SEQ ID NO: 191685 - RNA, 19 nt, Homo sapiens
ucgauaacuuccauaaugc

SEQ ID NO: 191686 - RNA, 19 nt, Homo sapiens
gaagaagaucccguacaag

SEQ ID NO: 191687 - RNA, 19 nt, Homo sapiens
caguguggcugccggaucu

SEQ ID NO: 191688 - RNA, 19 nt, Homo sapiens
uugaggagauggacauuuu

SEQ ID NO: 191689 - RNA, 19 nt, Homo sapiens
gccgcucuguggaguuuga

SEQ ID NO: 191690 - RNA, 19 nt, Homo sapiens
ucaucgauaacuuccauaa

SEQ ID NO: 191691 - RNA, 19 nt, Homo sapiens
gcagaugguccaggcuaug

SEQ ID NO: 191692 - RNA, 19 nt, Homo sapiens
gcacgggcacaggcuauuc

SEQ ID NO: 191693 - RNA, 19 nt, Homo sapiens
caaguucuucaucgaggaa

SEQ ID NO: 191694 - RNA, 19 nt, Homo sapiens
uuauggcggucauccacuu

SEQ ID NO: 191695 - RNA, 19 nt, Homo sapiens
ccaggcacucauuuauauu

SEQ ID NO: 191696 - RNA, 19 nt, Homo sapiens
cagcucagccacuguguac

SEQ ID NO: 191697 - RNA, 19 nt, Homo sapiens
gcaacagacucuuaacuug

SEQ ID NO: 191698 - RNA, 19 nt, Homo sapiens
gaucaugcauccaaacuga

SEQ ID NO: 191699 - RNA, 19 nt, Homo sapiens
ugaaagccauucuuaguug

SEQ ID NO: 191700 - RNA, 19 nt, Homo sapiens
gaagagaggagacauguca

SEQ ID NO: 191701 - RNA, 19 nt, Homo sapiens
gaaacacuguccucucauc

SEQ ID NO: 191702 - RNA, 19 nt, Homo sapiens
ccaagaccuuccuccguua

SEQ ID NO: 191703 - RNA, 19 nt, Homo sapiens
ggaagugacuggaguuacu

SEQ ID NO: 191704 - RNA, 19 nt, Homo sapiens
gaaacaaguccgagcuauu

SEQ ID NO: 191705 - RNA, 19 nt, Homo sapiens
gaggagacaugucaggaau

SEQ ID NO: 191706 - RNA, 19 nt, Homo sapiens
gcaaacaccuagacucacu

SEQ ID NO: 191707 - RNA, 19 nt, Homo sapiens
ggagacaugucaggaauag

SEQ ID NO: 191708 - RNA, 19 nt, Homo sapiens
gaaagccauucuuaguugu

SEQ ID NO: 191709 - RNA, 19 nt, Homo sapiens
gaagcugccuuggacauca

SEQ ID NO: 191710 - RNA, 19 nt, Homo sapiens
aacuacaacuggucacuua

SEQ ID NO: 191711 - RNA, 19 nt, Homo sapiens
aaacaaguccgagcuauug

SEQ ID NO: 191712 - RNA, 19 nt, Homo sapiens
gcucucagcuucauuuuau

SEQ ID NO: 191713 - RNA, 19 nt, Homo sapiens
gaucaaggagcaaguagug

SEQ ID NO: 191714 - RNA, 19 nt, Homo sapiens
gcacagcccggaccgaaau

SEQ ID NO: 191715 - RNA, 19 nt, Homo sapiens
ccgcguggcucaucuggaa

SEQ ID NO: 191716 - RNA, 19 nt, Homo sapiens
gcagaucucacccuuguca

SEQ ID NO: 191717 - RNA, 19 nt, Homo sapiens
acacuguccucucaucuug

SEQ ID NO: 191718 - RNA, 19 nt, Homo sapiens
uggaaacacuguccucuca

SEQ ID NO: 191719 - RNA, 19 nt, Homo sapiens
caccuagacucacuucaug

SEQ ID NO: 191720 - RNA, 19 nt, Homo sapiens
ggugaaagccauucuuagu

SEQ ID NO: 191721 - RNA, 19 nt, Homo sapiens
gugaaagccauucuuaguu

SEQ ID NO: 191722 - RNA, 19 nt, Homo sapiens
gagaagagaggagacaugu

SEQ ID NO: 191723 - RNA, 19 nt, Homo sapiens
gagggacucuaagaaccua

SEQ ID NO: 191724 - RNA, 19 nt, Homo sapiens
gugcaugaccucccaguga

SEQ ID NO: 191725 - RNA, 19 nt, Homo sapiens
caacaucagcgcucuaguc

SEQ ID NO: 191726 - RNA, 19 nt, Homo sapiens
aggcagaucucacccuugu

SEQ ID NO: 191727 - RNA, 19 nt, Homo sapiens
caagagagcaggaguucca

SEQ ID NO: 191728 - RNA, 19 nt, Homo sapiens
ggagaagagaggagacaug

SEQ ID NO: 191729 - RNA, 19 nt, Homo sapiens
ccacacggugcaaaucuuu

SEQ ID NO: 191730 - RNA, 19 nt, Homo sapiens
gugcaaacaccuagacuca

SEQ ID NO: 191731 - RNA, 19 nt, Homo sapiens
gaaguuccccaacacauaa

SEQ ID NO: 191732 - RNA, 19 nt, Homo sapiens
cagagucccugugcaaaca

SEQ ID NO: 191733 - RNA, 19 nt, Homo sapiens
cacauaaucccaagacugu

SEQ ID NO: 191734 - RNA, 19 nt, Homo sapiens
uggcucaucuggaauucuu

SEQ ID NO: 191735 - RNA, 19 nt, Homo sapiens
gaaccuggccgugucucaa

SEQ ID NO: 191736 - RNA, 19 nt, Homo sapiens
caacaggcaacuacaacug

SEQ ID NO: 191737 - RNA, 19 nt, Homo sapiens
caacucaacaggcaacuac

SEQ ID NO: 191738 - RNA, 19 nt, Homo sapiens
agaaacaaguccgagcuau

SEQ ID NO: 191739 - RNA, 19 nt, Homo sapiens
agacaugucaggaauagau

SEQ ID NO: 191740 - RNA, 19 nt, Homo sapiens
aaacugaagcugccuugga

SEQ ID NO: 191741 - RNA, 19 nt, Homo sapiens
gcaccccucuuccuuaaug

SEQ ID NO: 191742 - RNA, 19 nt, Homo sapiens
ucaaguaaccaccaaguac

SEQ ID NO: 191743 - RNA, 19 nt, Homo sapiens
gacaagccagagcgcguua

SEQ ID NO: 191744 - RNA, 19 nt, Homo sapiens
ggacaugaggcugcuuuca

SEQ ID NO: 191745 - RNA, 19 nt, Homo sapiens
ccacaagagagcaggaguu

SEQ ID NO: 191746 - RNA, 19 nt, Homo sapiens
gaggccugguggagccaua

SEQ ID NO: 191747 - RNA, 19 nt, Homo sapiens
agaccuuccuccguuauga

SEQ ID NO: 191748 - RNA, 19 nt, Homo sapiens
ccucuuccuuaaugaaaug

SEQ ID NO: 191749 - RNA, 19 nt, Homo sapiens
ggucaugguccucaucaca

SEQ ID NO: 191750 - RNA, 19 nt, Homo sapiens
gggcucucaucaccaguau

SEQ ID NO: 191751 - RNA, 19 nt, Homo sapiens
gaccaacacagcagacaca

SEQ ID NO: 191752 - RNA, 19 nt, Homo sapiens
cagaaacaaguccgagcua

SEQ ID NO: 191753 - RNA, 19 nt, Homo sapiens
caacacauaaucccaagac

SEQ ID NO: 191754 - RNA, 19 nt, Homo sapiens
cggcugcucuucuucaaac

SEQ ID NO: 191755 - RNA, 19 nt, Homo sapiens
ggagcccaguacaacauca

SEQ ID NO: 191756 - RNA, 19 nt, Homo sapiens
ccucaucacacacauguca

SEQ ID NO: 191757 - RNA, 19 nt, Homo sapiens
ccaaacaccggcugcucuu

SEQ ID NO: 191758 - RNA, 19 nt, Homo sapiens
guacaacaucagcgcucua

SEQ ID NO: 191759 - RNA, 19 nt, Homo sapiens
gaagcuaccagaccaacac

SEQ ID NO: 191760 - RNA, 19 nt, Homo sapiens
caacuacaacuggucacuu

SEQ ID NO: 191761 - RNA, 19 nt, Homo sapiens
uuaguugugucucugcaau

SEQ ID NO: 191762 - RNA, 19 nt, Homo sapiens
cgcgagaucuccggcuuug

SEQ ID NO: 191763 - RNA, 19 nt, Homo sapiens
acaugaggcugcuuucacu

SEQ ID NO: 191764 - RNA, 19 nt, Homo sapiens
gagagggucaggcagaucu

SEQ ID NO: 191765 - RNA, 19 nt, Homo sapiens
ccuacaggguguggaaguu

SEQ ID NO: 191766 - RNA, 19 nt, Homo sapiens
uuggugaaagccauucuua

SEQ ID NO: 191767 - RNA, 19 nt, Homo sapiens
gggugcaacagacucuuaa

SEQ ID NO: 191768 - RNA, 19 nt, Homo sapiens
cggcgugguuaacuucuuc

SEQ ID NO: 191769 - RNA, 19 nt, Homo sapiens
ugaggcugcuuucacuauc

SEQ ID NO: 191770 - RNA, 19 nt, Homo sapiens
aaauguggcaguccucuca

SEQ ID NO: 191771 - RNA, 19 nt, Homo sapiens
gacaugucaggaauagauu

SEQ ID NO: 191772 - RNA, 19 nt, Homo sapiens
cagaaccugaugcccagua

SEQ ID NO: 191773 - RNA, 19 nt, Homo sapiens
ugcaacagacucuuaacuu

SEQ ID NO: 191774 - RNA, 19 nt, Homo sapiens
aacagacucuuaacuuggu

SEQ ID NO: 191775 - RNA, 19 nt, Homo sapiens
caccagagucccugugcaa

SEQ ID NO: 191776 - RNA, 19 nt, Homo sapiens
cgacggcgugguuaacuuc

SEQ ID NO: 191777 - RNA, 19 nt, Homo sapiens
ucaccgacggcgugguuaa

SEQ ID NO: 191778 - RNA, 19 nt, Homo sapiens
gcgcgagaucuccggcuuu

SEQ ID NO: 191779 - RNA, 19 nt, Homo sapiens
ucaugguccucaucacaca

SEQ ID NO: 191780 - RNA, 19 nt, Homo sapiens
gcuggugguuggugaaagc

SEQ ID NO: 191781 - RNA, 19 nt, Homo sapiens
guuccucacucuuccuuuu

SEQ ID NO: 191782 - RNA, 19 nt, Homo sapiens
ugcaugaccucccagugau

SEQ ID NO: 191783 - RNA, 19 nt, Homo sapiens
ggccgugucucaaguaacc

SEQ ID NO: 191784 - RNA, 19 nt, Homo sapiens
caagaccuuccuccguuau

SEQ ID NO: 191785 - RNA, 19 nt, Homo sapiens
gcaggaguuccaggccuuu

SEQ ID NO: 191786 - RNA, 19 nt, Homo sapiens
caggaucaaggagcaagua

SEQ ID NO: 191787 - RNA, 19 nt, Homo sapiens
acaugucaggaauagauua

SEQ ID NO: 191788 - RNA, 19 nt, Homo sapiens
ccacagccagugccaaguc

SEQ ID NO: 191789 - RNA, 19 nt, Homo sapiens
uacaggguguggaaguuca

SEQ ID NO: 191790 - RNA, 19 nt, Homo sapiens
gcguggcucaucuggaauu

SEQ ID NO: 191791 - RNA, 19 nt, Homo sapiens
ccgacggcgugguuaacuu

SEQ ID NO: 191792 - RNA, 19 nt, Homo sapiens
cguggaacacuaucucaug

SEQ ID NO: 191793 - RNA, 19 nt, Homo sapiens
uuagagcguuagacaggau

SEQ ID NO: 191794 - RNA, 19 nt, Homo sapiens
gggcuggaccaacucaaca

SEQ ID NO: 191795 - RNA, 19 nt, Homo sapiens
ccugugcgcucugguccuu

SEQ ID NO: 191796 - RNA, 19 nt, Homo sapiens
cuucuggucaggagguaua

SEQ ID NO: 191797 - RNA, 19 nt, Homo sapiens
cgucauggcugcuuugaga

SEQ ID NO: 191798 - RNA, 19 nt, Homo sapiens
ucaagggagugauucagua

SEQ ID NO: 191799 - RNA, 19 nt, Homo sapiens
gagccaaggugcugugcuu

SEQ ID NO: 191800 - RNA, 19 nt, Homo sapiens
gaccaguucaucucacuua

SEQ ID NO: 191801 - RNA, 19 nt, Homo sapiens
gccacgcgcugcucauuga

SEQ ID NO: 191802 - RNA, 19 nt, Homo sapiens
gcgccaaugugaagaagug

SEQ ID NO: 191803 - RNA, 19 nt, Homo sapiens
caguucaucucacuuaugg

SEQ ID NO: 191804 - RNA, 19 nt, Homo sapiens
gggaacacacggacuacaa

SEQ ID NO: 191805 - RNA, 19 nt, Homo sapiens
aaacuugugccuccaaugu

SEQ ID NO: 191806 - RNA, 19 nt, Homo sapiens
cagcucagcauccuuggaa

SEQ ID NO: 191807 - RNA, 19 nt, Homo sapiens
cauauccgggugcucaaua

SEQ ID NO: 191808 - RNA, 19 nt, Homo sapiens
gcucaucaccaacucuaau

SEQ ID NO: 191809 - RNA, 19 nt, Homo sapiens
ccuuggaaguggccacgua

SEQ ID NO: 191810 - RNA, 19 nt, Homo sapiens
agggagugauucaguacua

SEQ ID NO: 191811 - RNA, 19 nt, Homo sapiens
ccggugccaucuuccauau

SEQ ID NO: 191812 - RNA, 19 nt, Homo sapiens
guuuauggcagccgcauga

SEQ ID NO: 191813 - RNA, 19 nt, Homo sapiens
ccugagacguggcgacuac

SEQ ID NO: 191814 - RNA, 19 nt, Homo sapiens
aggaugggcuggugucucu

SEQ ID NO: 191815 - RNA, 19 nt, Homo sapiens
auauccgggugcucaauaa

SEQ ID NO: 191816 - RNA, 19 nt, Homo sapiens
ggaacacacggacuacaac

SEQ ID NO: 191817 - RNA, 19 nt, Homo sapiens
ucacuuaugggacagaaag

SEQ ID NO: 191818 - RNA, 19 nt, Homo sapiens
ggugccaucuuccauaucc

SEQ ID NO: 191819 - RNA, 19 nt, Homo sapiens
gagacguggcgacuacaga

SEQ ID NO: 191820 - RNA, 19 nt, Homo sapiens
caucauggaccaguucauc

SEQ ID NO: 191821 - RNA, 19 nt, Homo sapiens
gcacauccaggagcacuac

SEQ ID NO: 191822 - RNA, 19 nt, Homo sapiens
gugcucaucaccaacucua

SEQ ID NO: 191823 - RNA, 19 nt, Homo sapiens
ccaguucaucucacuuaug

SEQ ID NO: 191824 - RNA, 19 nt, Homo sapiens
ggugcucaauaaacuugug

SEQ ID NO: 191825 - RNA, 19 nt, Homo sapiens
gguacaacuggaagagcua

SEQ ID NO: 191826 - RNA, 19 nt, Homo sapiens
ggacugccaccuucuaccu

SEQ ID NO: 191827 - RNA, 19 nt, Homo sapiens
gcgggacugccaccuucua

SEQ ID NO: 191828 - RNA, 19 nt, Homo sapiens
gcucagcauccuuggaagu

SEQ ID NO: 191829 - RNA, 19 nt, Homo sapiens
gggagugauucaguacuac

SEQ ID NO: 191830 - RNA, 19 nt, Homo sapiens
gcucaagggucacgacuua

SEQ ID NO: 191831 - RNA, 19 nt, Homo sapiens
gcacaacuauuucuuaugu

SEQ ID NO: 191832 - RNA, 19 nt, Homo sapiens
ggaaauaucccaccaaguu

SEQ ID NO: 191833 - RNA, 19 nt, Homo sapiens
gaagauaugugaagaagca

SEQ ID NO: 191834 - RNA, 19 nt, Homo sapiens
ggaccagucuauaucauuu

SEQ ID NO: 191835 - RNA, 19 nt, Homo sapiens
gaggagugauggaagcuua

SEQ ID NO: 191836 - RNA, 19 nt, Homo sapiens
gaaggaaucuauccaaggu

SEQ ID NO: 191837 - RNA, 19 nt, Homo sapiens
uaggagagcauauagauua

SEQ ID NO: 191838 - RNA, 19 nt, Homo sapiens
gagagcauauagauuauug

SEQ ID NO: 191839 - RNA, 19 nt, Homo sapiens
cuaauaacauccagauuga

SEQ ID NO: 191840 - RNA, 19 nt, Homo sapiens
ggcagaacauccuagguua

SEQ ID NO: 191841 - RNA, 19 nt, Homo sapiens
caggaacacuuuggucuua

SEQ ID NO: 191842 - RNA, 19 nt, Homo sapiens
agaacaagaugugcuaaua

SEQ ID NO: 191843 - RNA, 19 nt, Homo sapiens
caaaugugcacaaagcuua

SEQ ID NO: 191844 - RNA, 19 nt, Homo sapiens
cgaagcuccuggcuaaaua

SEQ ID NO: 191845 - RNA, 19 nt, Homo sapiens
gcuaauaacauccagauug

SEQ ID NO: 191846 - RNA, 19 nt, Homo sapiens
gauauucuguucuuccuau

SEQ ID NO: 191847 - RNA, 19 nt, Homo sapiens
caacuucccauuucaauau

SEQ ID NO: 191848 - RNA, 19 nt, Homo sapiens
gcuccuggcuaaauacaaa

SEQ ID NO: 191849 - RNA, 19 nt, Homo sapiens
gaacauccuagguuacuga

SEQ ID NO: 191850 - RNA, 19 nt, Homo sapiens
gaacaagaugugcuaauag

SEQ ID NO: 191851 - RNA, 19 nt, Homo sapiens
ggauuagucuagaagaaau

SEQ ID NO: 191852 - RNA, 19 nt, Homo sapiens
cugcgaagcuccuggcuaa

SEQ ID NO: 191853 - RNA, 19 nt, Homo sapiens
ccaggaagagucaacauaa

SEQ ID NO: 191854 - RNA, 19 nt, Homo sapiens
cauaauaggagagcauaua

SEQ ID NO: 191855 - RNA, 19 nt, Homo sapiens
gcaacuucccauuucaaua

SEQ ID NO: 191856 - RNA, 19 nt, Homo sapiens
ggcgaaauauggcuacaga

SEQ ID NO: 191857 - RNA, 19 nt, Homo sapiens
gaauuagccuggaggaacu

SEQ ID NO: 191858 - RNA, 19 nt, Homo sapiens
gcaggugucugggaauuag

SEQ ID NO: 191859 - RNA, 19 nt, Homo sapiens
uauccggacuucaguacua

SEQ ID NO: 191860 - RNA, 19 nt, Homo sapiens
ggaagagucaacauaauag

SEQ ID NO: 191861 - RNA, 19 nt, Homo sapiens
uggaggaggugcaggcuaa

SEQ ID NO: 191862 - RNA, 19 nt, Homo sapiens
gcagcaacuucccauuuca

SEQ ID NO: 191863 - RNA, 19 nt, Homo sapiens
gaaauaucccaccaaguuc

SEQ ID NO: 191864 - RNA, 19 nt, Homo sapiens
gaacacuuuggucuuagua

SEQ ID NO: 191865 - RNA, 19 nt, Homo sapiens
cgaaauauggcuacagaga

SEQ ID NO: 191866 - RNA, 19 nt, Homo sapiens
gaggaacuccgaacccaaa

SEQ ID NO: 191867 - RNA, 19 nt, Homo sapiens
ggaauuggcaggacuuucu

SEQ ID NO: 191868 - RNA, 19 nt, Homo sapiens
ggcagcaacuucccauuuc

SEQ ID NO: 191869 - RNA, 19 nt, Homo sapiens
gaagcuaaaggagauguuu

SEQ ID NO: 191870 - RNA, 19 nt, Homo sapiens
ucacagugcugggaaggaa

SEQ ID NO: 191871 - RNA, 19 nt, Homo sapiens
ccaaguugauagaauuuag

SEQ ID NO: 191872 - RNA, 19 nt, Homo sapiens
uuaguaaccugacuggaau

SEQ ID NO: 191873 - RNA, 19 nt, Homo sapiens
uuaaaggaauucaggaaca

SEQ ID NO: 191874 - RNA, 19 nt, Homo sapiens
caggaagagucaacauaau

SEQ ID NO: 191875 - RNA, 19 nt, Homo sapiens
gcaaaugugcacaaagcuu

SEQ ID NO: 191876 - RNA, 19 nt, Homo sapiens
cgcgagugcuccaguuuaa

SEQ ID NO: 191877 - RNA, 19 nt, Homo sapiens
uagaagaaaugcuguuggu

SEQ ID NO: 191878 - RNA, 19 nt, Homo sapiens
ggagcaguguuugugauug

SEQ ID NO: 191879 - RNA, 19 nt, Homo sapiens
aggaagagucaacauaaua

SEQ ID NO: 191880 - RNA, 19 nt, Homo sapiens
gcgcgagugcuccaguuua

SEQ ID NO: 191881 - RNA, 19 nt, Homo sapiens
gguggaacuugcagaaauc

SEQ ID NO: 191882 - RNA, 19 nt, Homo sapiens
uggcacaacuauuucuuau

SEQ ID NO: 191883 - RNA, 19 nt, Homo sapiens
gugcucaucuucaaacucu

SEQ ID NO: 191884 - RNA, 19 nt, Homo sapiens
gcaaugggacaaaguacug

SEQ ID NO: 191885 - RNA, 19 nt, Homo sapiens
cagucuauaucauuucuug

SEQ ID NO: 191886 - RNA, 19 nt, Homo sapiens
agaaaucugugccaagagu

SEQ ID NO: 191887 - RNA, 19 nt, Homo sapiens
ccugguagauggaaauauc

SEQ ID NO: 191888 - RNA, 19 nt, Homo sapiens
uaaccugacuggaaugaac

SEQ ID NO: 191889 - RNA, 19 nt, Homo sapiens
ggaacacuuuggucuuagu

SEQ ID NO: 191890 - RNA, 19 nt, Homo sapiens
gagcauauagauuauugug

SEQ ID NO: 191891 - RNA, 19 nt, Homo sapiens
uuagggcacuuaggaauug

SEQ ID NO: 191892 - RNA, 19 nt, Homo sapiens
uagcaaaugugcacaaagc

SEQ ID NO: 191893 - RNA, 19 nt, Homo sapiens
gaucuauucccaaguuuua

SEQ ID NO: 191894 - RNA, 19 nt, Homo sapiens
gggcaaagcauguguacag

SEQ ID NO: 191895 - RNA, 19 nt, Homo sapiens
gggauuagucuagaagaaa

SEQ ID NO: 191896 - RNA, 19 nt, Homo sapiens
ggaggugcaggcuaaacua

SEQ ID NO: 191897 - RNA, 19 nt, Homo sapiens
caagagugagcguuacauu

SEQ ID NO: 191898 - RNA, 19 nt, Homo sapiens
ccagugcuuuggucuguug

SEQ ID NO: 191899 - RNA, 19 nt, Homo sapiens
ucaguacuagugcuaauaa

SEQ ID NO: 191900 - RNA, 19 nt, Homo sapiens
gaaacuacuuagggcacuu

SEQ ID NO: 191901 - RNA, 19 nt, Homo sapiens
cuagguuacugaagcuaaa

SEQ ID NO: 191902 - RNA, 19 nt, Homo sapiens
ugaauaaggcagcaacuuc

SEQ ID NO: 191903 - RNA, 19 nt, Homo sapiens
uauguggacuuaaaggaau

SEQ ID NO: 191904 - RNA, 19 nt, Homo sapiens
caccggagaagcaaaguuu

SEQ ID NO: 191905 - RNA, 19 nt, Homo sapiens
gagcaguguuugugauugc

SEQ ID NO: 191906 - RNA, 19 nt, Homo sapiens
cugccaaguugauagaauu

SEQ ID NO: 191907 - RNA, 19 nt, Homo sapiens
gugccaagagugagcguua

SEQ ID NO: 191908 - RNA, 19 nt, Homo sapiens
guacuagugcuaauaacau

SEQ ID NO: 191909 - RNA, 19 nt, Homo sapiens
caacuggccaauacaaauc

SEQ ID NO: 191910 - RNA, 19 nt, Homo sapiens
cuacuuagggcacuuagga

SEQ ID NO: 191911 - RNA, 19 nt, Homo sapiens
gcccagcuuucuagcaaau

SEQ ID NO: 191912 - RNA, 19 nt, Homo sapiens
gcgaagcuccuggcuaaau

SEQ ID NO: 191913 - RNA, 19 nt, Homo sapiens
acaguuguguggagaugaa

SEQ ID NO: 191914 - RNA, 19 nt, Homo sapiens
gcauggaccagucuauauc

SEQ ID NO: 191915 - RNA, 19 nt, Homo sapiens
cgagugcuccaguuuaaga

SEQ ID NO: 191916 - RNA, 19 nt, Homo sapiens
ggaauucaggaacacuuug

SEQ ID NO: 191917 - RNA, 19 nt, Homo sapiens
aagaagauaugugaagaag

SEQ ID NO: 191918 - RNA, 19 nt, Homo sapiens
gugcuccaguuuaagaaga

SEQ ID NO: 191919 - RNA, 19 nt, Homo sapiens
uccaaacacucaagaugug

SEQ ID NO: 191920 - RNA, 19 nt, Homo sapiens
gaagaaggaacugccaagu

SEQ ID NO: 191921 - RNA, 19 nt, Homo sapiens
ccaacuggccaauacaaau

SEQ ID NO: 191922 - RNA, 19 nt, Homo sapiens
guggcacaacuauuucuua

SEQ ID NO: 191923 - RNA, 19 nt, Homo sapiens
aaaguuuguuugcuaccaa

SEQ ID NO: 191924 - RNA, 19 nt, Homo sapiens
uccuauggcuguagaacaa

SEQ ID NO: 191925 - RNA, 19 nt, Homo sapiens
ggagagcauauagauuauu

SEQ ID NO: 191926 - RNA, 19 nt, Homo sapiens
ggcauggaccagucuauau

SEQ ID NO: 191927 - RNA, 19 nt, Homo sapiens
caacauaauaggagagcau

SEQ ID NO: 191928 - RNA, 19 nt, Homo sapiens
gaacugccugguagaugga

SEQ ID NO: 191929 - RNA, 19 nt, Homo sapiens
ccacaguaaauuaaucuuc

SEQ ID NO: 191930 - RNA, 19 nt, Homo sapiens
gaaacuggcuuuauagagu

SEQ ID NO: 191931 - RNA, 19 nt, Homo sapiens
ggucaugccuguacauaaa

SEQ ID NO: 191932 - RNA, 19 nt, Homo sapiens
agacaaugcuguacaguuu

SEQ ID NO: 191933 - RNA, 19 nt, Homo sapiens
ugaagaacaugucaaagaa

SEQ ID NO: 191934 - RNA, 19 nt, Homo sapiens
gaccugggaugcaguagua

SEQ ID NO: 191935 - RNA, 19 nt, Homo sapiens
gacacacaaugaugaauuu

SEQ ID NO: 191936 - RNA, 19 nt, Homo sapiens
gcugcaacuuguuaucuua

SEQ ID NO: 191937 - RNA, 19 nt, Homo sapiens
uaagucacaugaaguaaug

SEQ ID NO: 191938 - RNA, 19 nt, Homo sapiens
ggaagaugcaaauaaguuu

SEQ ID NO: 191939 - RNA, 19 nt, Homo sapiens
ggacacacaaugaugaauu

SEQ ID NO: 191940 - RNA, 19 nt, Homo sapiens
gcauuugcuuccaauugua

SEQ ID NO: 191941 - RNA, 19 nt, Homo sapiens
gaacuggcccaucaauaug

SEQ ID NO: 191942 - RNA, 19 nt, Homo sapiens
uuaaaucccacguguguua

SEQ ID NO: 191943 - RNA, 19 nt, Homo sapiens
caauuguacucauguguga

SEQ ID NO: 191944 - RNA, 19 nt, Homo sapiens
gaacccacccucucucaga

SEQ ID NO: 191945 - RNA, 19 nt, Homo sapiens
ugauguguguuuacaauga

SEQ ID NO: 191946 - RNA, 19 nt, Homo sapiens
gaaggccuauaaacaagug

SEQ ID NO: 191947 - RNA, 19 nt, Homo sapiens
gaacauuuccaccaaacau

SEQ ID NO: 191948 - RNA, 19 nt, Homo sapiens
cugugaaacuggcuuuaua

SEQ ID NO: 191949 - RNA, 19 nt, Homo sapiens
ugaacuggcccaucaauau

SEQ ID NO: 191950 - RNA, 19 nt, Homo sapiens
ugguugaguuuccauauaa

SEQ ID NO: 191951 - RNA, 19 nt, Homo sapiens
ccgugaauccuaucauuua

SEQ ID NO: 191952 - RNA, 19 nt, Homo sapiens
ggcauuugcuuccaauugu

SEQ ID NO: 191953 - RNA, 19 nt, Homo sapiens
gaccagacacagaaacaaa

SEQ ID NO: 191954 - RNA, 19 nt, Homo sapiens
caggaaggccuauaaacaa

SEQ ID NO: 191955 - RNA, 19 nt, Homo sapiens
gguauccuaucuuguacaa

SEQ ID NO: 191956 - RNA, 19 nt, Homo sapiens
ccaaagacuagacagaauu

SEQ ID NO: 191957 - RNA, 19 nt, Homo sapiens
gaccaaagacuagacagaa

SEQ ID NO: 191958 - RNA, 19 nt, Homo sapiens
gggaagcucagacuccuaa

SEQ ID NO: 191959 - RNA, 19 nt, Homo sapiens
gcgaugcugcaacuuguua

SEQ ID NO: 191960 - RNA, 19 nt, Homo sapiens
cgagguugauguagauaau

SEQ ID NO: 191961 - RNA, 19 nt, Homo sapiens
caugaaagggaacauauau

SEQ ID NO: 191962 - RNA, 19 nt, Homo sapiens
guacuuugauccauuuagg

SEQ ID NO: 191963 - RNA, 19 nt, Homo sapiens
ggaccaaagacuagacaga

SEQ ID NO: 191964 - RNA, 19 nt, Homo sapiens
ucagcgagguugauguaga

SEQ ID NO: 191965 - RNA, 19 nt, Homo sapiens
gacaugaaagggaacauau

SEQ ID NO: 191966 - RNA, 19 nt, Homo sapiens
caguaagucacaugaagua

SEQ ID NO: 191967 - RNA, 19 nt, Homo sapiens
cagcgagguugauguagau

SEQ ID NO: 191968 - RNA, 19 nt, Homo sapiens
gcacagguggcauuugcuu

SEQ ID NO: 191969 - RNA, 19 nt, Homo sapiens
ucaggaaggccuauaaaca

SEQ ID NO: 191970 - RNA, 19 nt, Homo sapiens
ucaaagaagucugaagcau

SEQ ID NO: 191971 - RNA, 19 nt, Homo sapiens
guaagucacaugaaguaau

SEQ ID NO: 191972 - RNA, 19 nt, Homo sapiens
aacaagaauucaagucguu

SEQ ID NO: 191973 - RNA, 19 nt, Homo sapiens
agaguauccuuaugguuga

SEQ ID NO: 191974 - RNA, 19 nt, Homo sapiens
gguggugguugugguguuu

SEQ ID NO: 191975 - RNA, 19 nt, Homo sapiens
gcuagaauccguccagucu

SEQ ID NO: 191976 - RNA, 19 nt, Homo sapiens
ucuauuaaguggaaagaag

SEQ ID NO: 191977 - RNA, 19 nt, Homo sapiens
gaacaugucaaagaagucu

SEQ ID NO: 191978 - RNA, 19 nt, Homo sapiens
aagaacaugucaaagaagu

SEQ ID NO: 191979 - RNA, 19 nt, Homo sapiens
acauuuccaccaaacauua

SEQ ID NO: 191980 - RNA, 19 nt, Homo sapiens
caccgucccuucccgagaa

SEQ ID NO: 191981 - RNA, 19 nt, Homo sapiens
caaagacuagacagaauuc

SEQ ID NO: 191982 - RNA, 19 nt, Homo sapiens
guaguaggcacuguugauu

SEQ ID NO: 191983 - RNA, 19 nt, Homo sapiens
ccauuuacauagacauauc

SEQ ID NO: 191984 - RNA, 19 nt, Homo sapiens
gagaaguaauauugugaac

SEQ ID NO: 191985 - RNA, 19 nt, Homo sapiens
acaccugagugauacuaaa

SEQ ID NO: 191986 - RNA, 19 nt, Homo sapiens
gaagaacaugucaaagaag

SEQ ID NO: 191987 - RNA, 19 nt, Homo sapiens
gcucaucugcuucugcuau

SEQ ID NO: 191988 - RNA, 19 nt, Homo sapiens
acagaaacaaacagaauga

SEQ ID NO: 191989 - RNA, 19 nt, Homo sapiens
guacucaugugugauaaaa

SEQ ID NO: 191990 - RNA, 19 nt, Homo sapiens
ccugagugauacuaaagaa

SEQ ID NO: 191991 - RNA, 19 nt, Homo sapiens
ugaauccuaucauuuaugc

SEQ ID NO: 191992 - RNA, 19 nt, Homo sapiens
cgugaauccuaucauuuau

SEQ ID NO: 191993 - RNA, 19 nt, Homo sapiens
agacagaauucaguaaguc

SEQ ID NO: 191994 - RNA, 19 nt, Homo sapiens
aguaggcacuguugauuca

SEQ ID NO: 191995 - RNA, 19 nt, Homo sapiens
uaagcgaugcugcaacuug

SEQ ID NO: 191996 - RNA, 19 nt, Homo sapiens
acacagaaacaaacagaau

SEQ ID NO: 191997 - RNA, 19 nt, Homo sapiens
caguggaagaugcaaauaa

SEQ ID NO: 191998 - RNA, 19 nt, Homo sapiens
ccucaggagucaauucagu

SEQ ID NO: 191999 - RNA, 19 nt, Homo sapiens
gcaucggcguggagaacuu

SEQ ID NO: 192000 - RNA, 19 nt, Homo sapiens
ucaaccaauuguacucaug

SEQ ID NO: 192001 - RNA, 19 nt, Homo sapiens
guuaaaaccaucaccauuu

SEQ ID NO: 192002 - RNA, 19 nt, Homo sapiens
uagaauccguccagucucu

SEQ ID NO: 192003 - RNA, 19 nt, Homo sapiens
uaauuucuaugggaccaaa

SEQ ID NO: 192004 - RNA, 19 nt, Homo sapiens
gagguugauguagauaaua

SEQ ID NO: 192005 - RNA, 19 nt, Homo sapiens
uggaagaugcaaauaaguu

SEQ ID NO: 192006 - RNA, 19 nt, Homo sapiens
aggagucaauucaguguug

SEQ ID NO: 192007 - RNA, 19 nt, Homo sapiens
gugaacuggcccaucaaua

SEQ ID NO: 192008 - RNA, 19 nt, Homo sapiens
acaaugcuguacaguuuua

SEQ ID NO: 192009 - RNA, 19 nt, Homo sapiens
gagcaccaccaaccuguuc

SEQ ID NO: 192010 - RNA, 19 nt, Homo sapiens
gccuguacauaaagcauau

SEQ ID NO: 192011 - RNA, 19 nt, Homo sapiens
uagacagaauucaguaagu

SEQ ID NO: 192012 - RNA, 19 nt, Homo sapiens
ggcaacagccuagugauca

SEQ ID NO: 192013 - RNA, 19 nt, Homo sapiens
guucauccacuacuucuuc

SEQ ID NO: 192014 - RNA, 19 nt, Homo sapiens
gagaaaauggcaugaaaau

SEQ ID NO: 192015 - RNA, 19 nt, Homo sapiens
ccaaacauuauuuccucua

SEQ ID NO: 192016 - RNA, 19 nt, Homo sapiens
aaucaugggacugaauaua

SEQ ID NO: 192017 - RNA, 19 nt, Homo sapiens
guaauggucaugccuguac

SEQ ID NO: 192018 - RNA, 19 nt, Homo sapiens
ggagucaauucaguguugu

SEQ ID NO: 192019 - RNA, 19 nt, Homo sapiens
uaugagauacagucgguuu

SEQ ID NO: 192020 - RNA, 19 nt, Homo sapiens
uuggaagccugucauuaug

SEQ ID NO: 192021 - RNA, 19 nt, Homo sapiens
ggccauuuacauagacaua

SEQ ID NO: 192022 - RNA, 19 nt, Homo sapiens
acaugaaagggaacauaua

SEQ ID NO: 192023 - RNA, 19 nt, Homo sapiens
cauggacacacaaugauga

SEQ ID NO: 192024 - RNA, 19 nt, Homo sapiens
agacaugaaagggaacaua

SEQ ID NO: 192025 - RNA, 19 nt, Homo sapiens
uuaaaaccaucaccauuug

SEQ ID NO: 192026 - RNA, 19 nt, Homo sapiens
ccaccaaccuguucauccu

SEQ ID NO: 192027 - RNA, 19 nt, Homo sapiens
gacuagacagaauucagua

SEQ ID NO: 192028 - RNA, 19 nt, Homo sapiens
aguggaagaugcaaauaag

SEQ ID NO: 192029 - RNA, 19 nt, Homo sapiens
uaacaguggaagaugcaaa

SEQ ID NO: 192030 - RNA, 19 nt, Homo sapiens
ggacaggccuaucuucuau

SEQ ID NO: 192031 - RNA, 19 nt, Homo sapiens
caacggcgcugcccucauu

SEQ ID NO: 192032 - RNA, 19 nt, Homo sapiens
ggagaugguuggcagauau

SEQ ID NO: 192033 - RNA, 19 nt, Homo sapiens
ggagauugaugacagcauu

SEQ ID NO: 192034 - RNA, 19 nt, Homo sapiens
ggauacaguuugccuuuau

SEQ ID NO: 192035 - RNA, 19 nt, Homo sapiens
ggacaacaccuucgucuuc

SEQ ID NO: 192036 - RNA, 19 nt, Homo sapiens
gauacaguuugccuuuaua

SEQ ID NO: 192037 - RNA, 19 nt, Homo sapiens
ggaagcagaccacguuuga

SEQ ID NO: 192038 - RNA, 19 nt, Homo sapiens
uggcagauauuaugaagaa

SEQ ID NO: 192039 - RNA, 19 nt, Homo sapiens
ggaggcguguagcuucuua

SEQ ID NO: 192040 - RNA, 19 nt, Homo sapiens
acaggccuaucuucuauua

SEQ ID NO: 192041 - RNA, 19 nt, Homo sapiens
gcccuggacuucauuaaga

SEQ ID NO: 192042 - RNA, 19 nt, Homo sapiens
gggauacaguuugccuuua

SEQ ID NO: 192043 - RNA, 19 nt, Homo sapiens
ggucacaacucacaaucug

SEQ ID NO: 192044 - RNA, 19 nt, Homo sapiens
cauauaagcguuugucuca

SEQ ID NO: 192045 - RNA, 19 nt, Homo sapiens
gaacggggcaaucauauaa

SEQ ID NO: 192046 - RNA, 19 nt, Homo sapiens
ugacagcauugggaagaua

SEQ ID NO: 192047 - RNA, 19 nt, Homo sapiens
gcaaucauauaagcguuug

SEQ ID NO: 192048 - RNA, 19 nt, Homo sapiens
gcguguagcuucuuaucau

SEQ ID NO: 192049 - RNA, 19 nt, Homo sapiens
gggagaugguuggcagaua

SEQ ID NO: 192050 - RNA, 19 nt, Homo sapiens
ggagacacaagaucaguau

SEQ ID NO: 192051 - RNA, 19 nt, Homo sapiens
ggccuagaaucuccaguug

SEQ ID NO: 192052 - RNA, 19 nt, Homo sapiens
ucagacagggcauugauuu

SEQ ID NO: 192053 - RNA, 19 nt, Homo sapiens
gcaacugggcggucaugaa

SEQ ID NO: 192054 - RNA, 19 nt, Homo sapiens
gcagaccacguuugaagga

SEQ ID NO: 192055 - RNA, 19 nt, Homo sapiens
ccagagagaccccgaauuu

SEQ ID NO: 192056 - RNA, 19 nt, Homo sapiens
gcaagauugucggcaagug

SEQ ID NO: 192057 - RNA, 19 nt, Homo sapiens
ggcccaacaucccugugua

SEQ ID NO: 192058 - RNA, 19 nt, Homo sapiens
caacucacaaucuggaaga

SEQ ID NO: 192059 - RNA, 19 nt, Homo sapiens
gaugacagcauugggaaga

SEQ ID NO: 192060 - RNA, 19 nt, Homo sapiens
ccacugaauacacgauuga

SEQ ID NO: 192061 - RNA, 19 nt, Homo sapiens
caagaucaguauguguaug

SEQ ID NO: 192062 - RNA, 19 nt, Homo sapiens
ccaguuccgucuguccuuu

SEQ ID NO: 192063 - RNA, 19 nt, Homo sapiens
caguuugccuuuauacauc

SEQ ID NO: 192064 - RNA, 19 nt, Homo sapiens
guacagggacugggagaug

SEQ ID NO: 192065 - RNA, 19 nt, Homo sapiens
gggagacacaagaucagua

SEQ ID NO: 192066 - RNA, 19 nt, Homo sapiens
gacagggcauugauuucug

SEQ ID NO: 192067 - RNA, 19 nt, Homo sapiens
gaacuucagacagggcauu

SEQ ID NO: 192068 - RNA, 19 nt, Homo sapiens
gacaacaccuucgucuucu

SEQ ID NO: 192069 - RNA, 19 nt, Homo sapiens
gaccagucucaguuuauuu

SEQ ID NO: 192070 - RNA, 19 nt, Homo sapiens
caacugggcggucaugaac

SEQ ID NO: 192071 - RNA, 19 nt, Homo sapiens
caacaccuucgucuucuuc

SEQ ID NO: 192072 - RNA, 19 nt, Homo sapiens
cguguagcuucuuaucauu

SEQ ID NO: 192073 - RNA, 19 nt, Homo sapiens
gagaugguuggcagauauu

SEQ ID NO: 192074 - RNA, 19 nt, Homo sapiens
agacacaagaucaguaugu

SEQ ID NO: 192075 - RNA, 19 nt, Homo sapiens
gcaccuccgggcugugaaa

SEQ ID NO: 192076 - RNA, 19 nt, Homo sapiens
caacgcccaugccagaaac

SEQ ID NO: 192077 - RNA, 19 nt, Homo sapiens
aagccaaccucacccagau

SEQ ID NO: 192078 - RNA, 19 nt, Homo sapiens
cggauuugaugagugguuu

SEQ ID NO: 192079 - RNA, 19 nt, Homo sapiens
guagcuucuuaucauugua

SEQ ID NO: 192080 - RNA, 19 nt, Homo sapiens
gcccagugaauccgcauuu

SEQ ID NO: 192081 - RNA, 19 nt, Homo sapiens
ccaacgcccaugccagaaa

SEQ ID NO: 192082 - RNA, 19 nt, Homo sapiens
gaagcagaccacguuugaa

SEQ ID NO: 192083 - RNA, 19 nt, Homo sapiens
guuggcagauauuaugaag

SEQ ID NO: 192084 - RNA, 19 nt, Homo sapiens
gaugguuggcagauauuau

SEQ ID NO: 192085 - RNA, 19 nt, Homo sapiens
gagggaugacuuccaguuc

SEQ ID NO: 192086 - RNA, 19 nt, Homo sapiens
ggcaaucauauaagcguuu

SEQ ID NO: 192087 - RNA, 19 nt, Homo sapiens
ggaacggggcaaucauaua

SEQ ID NO: 192088 - RNA, 19 nt, Homo sapiens
gggaagcagaccacguuug

SEQ ID NO: 192089 - RNA, 19 nt, Homo sapiens
acacaccgcaggagauugu

SEQ ID NO: 192090 - RNA, 19 nt, Homo sapiens
ccaguuggcccugcaagug

SEQ ID NO: 192091 - RNA, 19 nt, Homo sapiens
cuacacaccgcaggagauu

SEQ ID NO: 192092 - RNA, 19 nt, Homo sapiens
uguagcuucuuaucauugu

SEQ ID NO: 192093 - RNA, 19 nt, Homo sapiens
uggacaggccuaucuucua

SEQ ID NO: 192094 - RNA, 19 nt, Homo sapiens
gagauugaugacagcauug

SEQ ID NO: 192095 - RNA, 19 nt, Homo sapiens
gaagcacggauuugaugag

SEQ ID NO: 192096 - RNA, 19 nt, Homo sapiens
ccucugugcucgccaucga

SEQ ID NO: 192097 - RNA, 19 nt, Homo sapiens
gcagcaucauggaccucuu

SEQ ID NO: 192098 - RNA, 19 nt, Homo sapiens
aagcagaccacguuugaag

SEQ ID NO: 192099 - RNA, 19 nt, Homo sapiens
cauccgcaauggcuucuac

SEQ ID NO: 192100 - RNA, 19 nt, Homo sapiens
gauggacaggccuaucuuc

SEQ ID NO: 192101 - RNA, 19 nt, Homo sapiens
ugaagcacggauuugauga

SEQ ID NO: 192102 - RNA, 19 nt, Homo sapiens
uuagggagacacaagauca

SEQ ID NO: 192103 - RNA, 19 nt, Homo sapiens
acaguuugccuuuauacau

SEQ ID NO: 192104 - RNA, 19 nt, Homo sapiens
guuaaggaugcaccuguga

SEQ ID NO: 192105 - RNA, 19 nt, Homo sapiens
uaaggaugcaccugugaca

SEQ ID NO: 192106 - RNA, 19 nt, Homo sapiens
ccagaucuaccugcaggaa

SEQ ID NO: 192107 - RNA, 19 nt, Homo sapiens
acacgaagcugccccugau

SEQ ID NO: 192108 - RNA, 19 nt, Homo sapiens
gcacggcaccaccccuuuu

SEQ ID NO: 192109 - RNA, 19 nt, Homo sapiens
gaagagauuuccaagauuu

SEQ ID NO: 192110 - RNA, 19 nt, Homo sapiens
gaucucagcugaacaaauu

SEQ ID NO: 192111 - RNA, 19 nt, Homo sapiens
gcaaugugauuuaagguuu

SEQ ID NO: 192112 - RNA, 19 nt, Homo sapiens
gaucagagcuagauuaaaa

SEQ ID NO: 192113 - RNA, 19 nt, Homo sapiens
caaauaugcuucauuguca

SEQ ID NO: 192114 - RNA, 19 nt, Homo sapiens
ucaacuggcuuacagauuu

SEQ ID NO: 192115 - RNA, 19 nt, Homo sapiens
gaaauaagcaagaugucua

SEQ ID NO: 192116 - RNA, 19 nt, Homo sapiens
caacuggcuuacagauuua

SEQ ID NO: 192117 - RNA, 19 nt, Homo sapiens
gaaauauucugagaccaaa

SEQ ID NO: 192118 - RNA, 19 nt, Homo sapiens
ggagauauaucgucaagag

SEQ ID NO: 192119 - RNA, 19 nt, Homo sapiens
uaugaaagcuuaacagcaa

SEQ ID NO: 192120 - RNA, 19 nt, Homo sapiens
uaagcaagaugucuaauca

SEQ ID NO: 192121 - RNA, 19 nt, Homo sapiens
guaaucagguuuucucuua

SEQ ID NO: 192122 - RNA, 19 nt, Homo sapiens
caagacacaugauagaaga

SEQ ID NO: 192123 - RNA, 19 nt, Homo sapiens
ggaggaaucucauuaagac

SEQ ID NO: 192124 - RNA, 19 nt, Homo sapiens
caauaaaucuucaguucug

SEQ ID NO: 192125 - RNA, 19 nt, Homo sapiens
cagcauagcuuggucuuau

SEQ ID NO: 192126 - RNA, 19 nt, Homo sapiens
caaguugaguguacacaaa

SEQ ID NO: 192127 - RNA, 19 nt, Homo sapiens
acagaacuaugaagaagua

SEQ ID NO: 192128 - RNA, 19 nt, Homo sapiens
gaaauuggaacauaugaug

SEQ ID NO: 192129 - RNA, 19 nt, Homo sapiens
ggucuuauuucuuacugua

SEQ ID NO: 192130 - RNA, 19 nt, Homo sapiens
guacacaaaguuucucaua

SEQ ID NO: 192131 - RNA, 19 nt, Homo sapiens
gugcagcuauuauuccaua

SEQ ID NO: 192132 - RNA, 19 nt, Homo sapiens
gcaagaugucuaaucaaua

SEQ ID NO: 192133 - RNA, 19 nt, Homo sapiens
gaaaucaccugagugucaa

SEQ ID NO: 192134 - RNA, 19 nt, Homo sapiens
gguagauuauggagauaua

SEQ ID NO: 192135 - RNA, 19 nt, Homo sapiens
ggaggaacuuuggaaauug

SEQ ID NO: 192136 - RNA, 19 nt, Homo sapiens
gaacagaugaccuuugcuu

SEQ ID NO: 192137 - RNA, 19 nt, Homo sapiens
uagauaacauggcuagaaa

SEQ ID NO: 192138 - RNA, 19 nt, Homo sapiens
gaacauaugaugcuggaau

SEQ ID NO: 192139 - RNA, 19 nt, Homo sapiens
ggaaucucauuaagacauu

SEQ ID NO: 192140 - RNA, 19 nt, Homo sapiens
ccacagaaaucaccugagu

SEQ ID NO: 192141 - RNA, 19 nt, Homo sapiens
ucaguucuguuguuuauga

SEQ ID NO: 192142 - RNA, 19 nt, Homo sapiens
gcacagggcagauuaucaa

SEQ ID NO: 192143 - RNA, 19 nt, Homo sapiens
acacaaaguuucucauauc

SEQ ID NO: 192144 - RNA, 19 nt, Homo sapiens
gauauaucgucaagaguug

SEQ ID NO: 192145 - RNA, 19 nt, Homo sapiens
gauaaucccauugccuuua

SEQ ID NO: 192146 - RNA, 19 nt, Homo sapiens
gaacggguagccaguauau

SEQ ID NO: 192147 - RNA, 19 nt, Homo sapiens
gaccuuugcuuggauguuu

SEQ ID NO: 192148 - RNA, 19 nt, Homo sapiens
aaagguagauuauggagau

SEQ ID NO: 192149 - RNA, 19 nt, Homo sapiens
uuacaaagguagauuaugg

SEQ ID NO: 192150 - RNA, 19 nt, Homo sapiens
ucgcaucgcuaaugauauu

SEQ ID NO: 192151 - RNA, 19 nt, Homo sapiens
gucaagaguuggucuaaga

SEQ ID NO: 192152 - RNA, 19 nt, Homo sapiens
gcucugauaugaccuaugg

SEQ ID NO: 192153 - RNA, 19 nt, Homo sapiens
acucaaauaugcuucauug

SEQ ID NO: 192154 - RNA, 19 nt, Homo sapiens
cacuugaccuaacugauua

SEQ ID NO: 192155 - RNA, 19 nt, Homo sapiens
gcacacugauguuuacaag

SEQ ID NO: 192156 - RNA, 19 nt, Homo sapiens
gaaauacccaagauucaug

SEQ ID NO: 192157 - RNA, 19 nt, Homo sapiens
acacugauguuuacaagau

SEQ ID NO: 192158 - RNA, 19 nt, Homo sapiens
gaacuaugaagaaguacaa

SEQ ID NO: 192159 - RNA, 19 nt, Homo sapiens
ggagaaaaccuagaaauuu

SEQ ID NO: 192160 - RNA, 19 nt, Homo sapiens
aaagagaaauggacagaag

SEQ ID NO: 192161 - RNA, 19 nt, Homo sapiens
ccaggaaauuugaaaggaa

SEQ ID NO: 192162 - RNA, 19 nt, Homo sapiens
ugaacgugcugucauaaug

SEQ ID NO: 192163 - RNA, 19 nt, Homo sapiens
uaagguuuaucagccauua

SEQ ID NO: 192164 - RNA, 19 nt, Homo sapiens
acgaaucagugucuagaua

SEQ ID NO: 192165 - RNA, 19 nt, Homo sapiens
uggaggaacuuuggaaauu

SEQ ID NO: 192166 - RNA, 19 nt, Homo sapiens
uccaugagcuguguuaauu

SEQ ID NO: 192167 - RNA, 19 nt, Homo sapiens
aaacagaacuaugaagaag

SEQ ID NO: 192168 - RNA, 19 nt, Homo sapiens
ugaagagauuuccaagauu

SEQ ID NO: 192169 - RNA, 19 nt, Homo sapiens
ggaaacgaaucagugucua

SEQ ID NO: 192170 - RNA, 19 nt, Homo sapiens
gaaauggacagaaggaaag

SEQ ID NO: 192171 - RNA, 19 nt, Homo sapiens
uuaauaggcuugcauuucu

SEQ ID NO: 192172 - RNA, 19 nt, Homo sapiens
gacgugaaacugcauagua

SEQ ID NO: 192173 - RNA, 19 nt, Homo sapiens
ggaggcacagggcagauua

SEQ ID NO: 192174 - RNA, 19 nt, Homo sapiens
gaggaacuuuggaaauugu

SEQ ID NO: 192175 - RNA, 19 nt, Homo sapiens
ucaggaaauuggaacauau

SEQ ID NO: 192176 - RNA, 19 nt, Homo sapiens
ucaauuuaauggcaaguga

SEQ ID NO: 192177 - RNA, 19 nt, Homo sapiens
ugaagguccuggagaaaug

SEQ ID NO: 192178 - RNA, 19 nt, Homo sapiens
ccugauagauaaucccauu

SEQ ID NO: 192179 - RNA, 19 nt, Homo sapiens
ucacuugaccuaacugauu

SEQ ID NO: 192180 - RNA, 19 nt, Homo sapiens
gaaauuaacccugcagcau

SEQ ID NO: 192181 - RNA, 19 nt, Homo sapiens
gcucaaaugccaccaccua

SEQ ID NO: 192182 - RNA, 19 nt, Homo sapiens
ccugguaccuagagaauau

SEQ ID NO: 192183 - RNA, 19 nt, Homo sapiens
aaacuacaaugcaaaccuu

SEQ ID NO: 192184 - RNA, 19 nt, Homo sapiens
cauauccuguucaaguuaa

SEQ ID NO: 192185 - RNA, 19 nt, Homo sapiens
guaggaggaaucucauuaa

SEQ ID NO: 192186 - RNA, 19 nt, Homo sapiens
gcacacacacacaaauuuc

SEQ ID NO: 192187 - RNA, 19 nt, Homo sapiens
ggauaaagccacagaagag

SEQ ID NO: 192188 - RNA, 19 nt, Homo sapiens
gacacaaacuacaaugcaa

SEQ ID NO: 192189 - RNA, 19 nt, Homo sapiens
agacagagauuacuuucag

SEQ ID NO: 192190 - RNA, 19 nt, Homo sapiens
ggagauguaagugauuuaa

SEQ ID NO: 192191 - RNA, 19 nt, Homo sapiens
cuagccaccuccuugauuu

SEQ ID NO: 192192 - RNA, 19 nt, Homo sapiens
gaaaagugcagcuauuauu

SEQ ID NO: 192193 - RNA, 19 nt, Homo sapiens
caagauucaugcuacuguu

SEQ ID NO: 192194 - RNA, 19 nt, Homo sapiens
gcuuacagauuuacaugug

SEQ ID NO: 192195 - RNA, 19 nt, Homo sapiens
acggguagccaguauauua

SEQ ID NO: 192196 - RNA, 19 nt, Homo sapiens
ucaugaagguccuggagaa

SEQ ID NO: 192197 - RNA, 19 nt, Homo sapiens
gauauguuccugcugcuuu

SEQ ID NO: 192198 - RNA, 19 nt, Homo sapiens
uaacagacgacuugcagaa

SEQ ID NO: 192199 - RNA, 19 nt, Homo sapiens
gcauagcuuggucuuauuu

SEQ ID NO: 192200 - RNA, 19 nt, Homo sapiens
aaugauauuugccaaguug

SEQ ID NO: 192201 - RNA, 19 nt, Homo sapiens
aaagucgcaucgcuaauga

SEQ ID NO: 192202 - RNA, 19 nt, Homo sapiens
guaaucagugccuggauaa

SEQ ID NO: 192203 - RNA, 19 nt, Homo sapiens
caaauuccacgucacuauu

SEQ ID NO: 192204 - RNA, 19 nt, Homo sapiens
gauaaucuuccuacaacaa

SEQ ID NO: 192205 - RNA, 19 nt, Homo sapiens
ucaccugagugucaauuga

SEQ ID NO: 192206 - RNA, 19 nt, Homo sapiens
caagaaaagugcagcuauu

SEQ ID NO: 192207 - RNA, 19 nt, Homo sapiens
uuuaaugacuuacccaaga

SEQ ID NO: 192208 - RNA, 19 nt, Homo sapiens
gugcugaaauugagcugaa

SEQ ID NO: 192209 - RNA, 19 nt, Homo sapiens
gcaccgggcucucuuauaa

SEQ ID NO: 192210 - RNA, 19 nt, Homo sapiens
aacaauaccugcucauuua

SEQ ID NO: 192211 - RNA, 19 nt, Homo sapiens
gggagacgguuacuuauuu

SEQ ID NO: 192212 - RNA, 19 nt, Homo sapiens
gaggagaacucuugaaauc

SEQ ID NO: 192213 - RNA, 19 nt, Homo sapiens
ggaugaaucuggcucguuu

SEQ ID NO: 192214 - RNA, 19 nt, Homo sapiens
gaagauacuuucuagauac

SEQ ID NO: 192215 - RNA, 19 nt, Homo sapiens
gcuaguacuuuguccauuu

SEQ ID NO: 192216 - RNA, 19 nt, Homo sapiens
gaacugcuguacagagcua

SEQ ID NO: 192217 - RNA, 19 nt, Homo sapiens
ggaagaaacucagcugcaa

SEQ ID NO: 192218 - RNA, 19 nt, Homo sapiens
ccaggaagcuuauguugga

SEQ ID NO: 192219 - RNA, 19 nt, Homo sapiens
gauuggagcuuaggaagaa

SEQ ID NO: 192220 - RNA, 19 nt, Homo sapiens
ggagggaaauggaugaauc

SEQ ID NO: 192221 - RNA, 19 nt, Homo sapiens
aaaugucuauccagaguua

SEQ ID NO: 192222 - RNA, 19 nt, Homo sapiens
gcaagccuuucaaauggua

SEQ ID NO: 192223 - RNA, 19 nt, Homo sapiens
gugaucgcauuauugauua

SEQ ID NO: 192224 - RNA, 19 nt, Homo sapiens
cgacagggcagaccaauga

SEQ ID NO: 192225 - RNA, 19 nt, Homo sapiens
gaaauugaccccauuaaaa

SEQ ID NO: 192226 - RNA, 19 nt, Homo sapiens
ggugggacacuaaauauaa

SEQ ID NO: 192227 - RNA, 19 nt, Homo sapiens
aaacaauaccugcucauuu

SEQ ID NO: 192228 - RNA, 19 nt, Homo sapiens
ggacaggacucggguugug

SEQ ID NO: 192229 - RNA, 19 nt, Homo sapiens
gcaaagcgugccgaaguua

SEQ ID NO: 192230 - RNA, 19 nt, Homo sapiens
gcuggaggcugcccuauag

SEQ ID NO: 192231 - RNA, 19 nt, Homo sapiens
aguauuggcuucauuguga

SEQ ID NO: 192232 - RNA, 19 nt, Homo sapiens
gggaggagguggccuuugu

SEQ ID NO: 192233 - RNA, 19 nt, Homo sapiens
cuaacugccucgacacuuu

SEQ ID NO: 192234 - RNA, 19 nt, Homo sapiens
cagagcagauuggagcuua

SEQ ID NO: 192235 - RNA, 19 nt, Homo sapiens
ggaaggaggacuggaauga

SEQ ID NO: 192236 - RNA, 19 nt, Homo sapiens
gaaagaauguacggucagu

SEQ ID NO: 192237 - RNA, 19 nt, Homo sapiens
gauaucacuuugggucuuu

SEQ ID NO: 192238 - RNA, 19 nt, Homo sapiens
ggugaucgcauuauugauu

SEQ ID NO: 192239 - RNA, 19 nt, Homo sapiens
gaagagaaagcacaaagca

SEQ ID NO: 192240 - RNA, 19 nt, Homo sapiens
gggcaucgccuacuacaug

SEQ ID NO: 192241 - RNA, 19 nt, Homo sapiens
gaugguaucugugaguaug

SEQ ID NO: 192242 - RNA, 19 nt, Homo sapiens
ccgccacgcuucugucuuu

SEQ ID NO: 192243 - RNA, 19 nt, Homo sapiens
cuagaaacguuccuuaugg

SEQ ID NO: 192244 - RNA, 19 nt, Homo sapiens
gugauaagcuucgaaugga

SEQ ID NO: 192245 - RNA, 19 nt, Homo sapiens
aaggaggacuggaaugaaa

SEQ ID NO: 192246 - RNA, 19 nt, Homo sapiens
ucauguacuugcuauauug

SEQ ID NO: 192247 - RNA, 19 nt, Homo sapiens
gguuggaguuuaugaaugu

SEQ ID NO: 192248 - RNA, 19 nt, Homo sapiens
gaaaaugucuauccagagu

SEQ ID NO: 192249 - RNA, 19 nt, Homo sapiens
gauuggaacuugguauuca

SEQ ID NO: 192250 - RNA, 19 nt, Homo sapiens
gaaagugcgaguucuuaga

SEQ ID NO: 192251 - RNA, 19 nt, Homo sapiens
gaaucuggcucguuuuaaa

SEQ ID NO: 192252 - RNA, 19 nt, Homo sapiens
ucaaccagguggagaguga

SEQ ID NO: 192253 - RNA, 19 nt, Homo sapiens
gcccacauguugcacugua

SEQ ID NO: 192254 - RNA, 19 nt, Homo sapiens
ggucagaaccaaacaauac

SEQ ID NO: 192255 - RNA, 19 nt, Homo sapiens
gcugcaagccuuucaaaug

SEQ ID NO: 192256 - RNA, 19 nt, Homo sapiens
ggacaacuuucaguaugug

SEQ ID NO: 192257 - RNA, 19 nt, Homo sapiens
acucagaauucuuuccuaa

SEQ ID NO: 192258 - RNA, 19 nt, Homo sapiens
guuaaaccacagacaguua

SEQ ID NO: 192259 - RNA, 19 nt, Homo sapiens
ccugggagacgguuacuua

SEQ ID NO: 192260 - RNA, 19 nt, Homo sapiens
gcgaggagaacucuugaaa

SEQ ID NO: 192261 - RNA, 19 nt, Homo sapiens
agacagaaaugggaacaga

SEQ ID NO: 192262 - RNA, 19 nt, Homo sapiens
gaaauauucagagcagauu

SEQ ID NO: 192263 - RNA, 19 nt, Homo sapiens
uagaaaugaucgacgagaa

SEQ ID NO: 192264 - RNA, 19 nt, Homo sapiens
gcaaccagaugugugugaa

SEQ ID NO: 192265 - RNA, 19 nt, Homo sapiens
ggacuggaaugaaauugac

SEQ ID NO: 192266 - RNA, 19 nt, Homo sapiens
gugggacacuaaauauaaa

SEQ ID NO: 192267 - RNA, 19 nt, Homo sapiens
gaucaucgucaucuuguau

SEQ ID NO: 192268 - RNA, 19 nt, Homo sapiens
gcaggaaggaggacuggaa

SEQ ID NO: 192269 - RNA, 19 nt, Homo sapiens
gcuagaaacguuccuuaug

SEQ ID NO: 192270 - RNA, 19 nt, Homo sapiens
cuggauggaugaauacaaa

SEQ ID NO: 192271 - RNA, 19 nt, Homo sapiens
uaagagcccuucgaagcaa

SEQ ID NO: 192272 - RNA, 19 nt, Homo sapiens
acacacagaugcucagucu

SEQ ID NO: 192273 - RNA, 19 nt, Homo sapiens
cgcugggccuucagaauua

SEQ ID NO: 192274 - RNA, 19 nt, Homo sapiens
ggucaguucccuaugguuu

SEQ ID NO: 192275 - RNA, 19 nt, Homo sapiens
gcacugucuuugcccgaaa

SEQ ID NO: 192276 - RNA, 19 nt, Homo sapiens
gaaggaggacuggaaugaa

SEQ ID NO: 192277 - RNA, 19 nt, Homo sapiens
ggagucuggugaucgcauu

SEQ ID NO: 192278 - RNA, 19 nt, Homo sapiens
ucacagcaauggagaagag

SEQ ID NO: 192279 - RNA, 19 nt, Homo sapiens
ggaaauauucagagcagau

SEQ ID NO: 192280 - RNA, 19 nt, Homo sapiens
uagaaacguuccuuaugga

SEQ ID NO: 192281 - RNA, 19 nt, Homo sapiens
ggagagaaccuagagaucu

SEQ ID NO: 192282 - RNA, 19 nt, Homo sapiens
cauaaaagcucagaugaug

SEQ ID NO: 192283 - RNA, 19 nt, Homo sapiens
ggagcgaggagaacucuug

SEQ ID NO: 192284 - RNA, 19 nt, Homo sapiens
ggaaguacgacaugaugau

SEQ ID NO: 192285 - RNA, 19 nt, Homo sapiens
gaaaaccccuuaguacugu

SEQ ID NO: 192286 - RNA, 19 nt, Homo sapiens
gaaaaugacagcagacaga

SEQ ID NO: 192287 - RNA, 19 nt, Homo sapiens
gagcuuaggaagaaacuca

SEQ ID NO: 192288 - RNA, 19 nt, Homo sapiens
caaacaauaccugcucauu

SEQ ID NO: 192289 - RNA, 19 nt, Homo sapiens
gcaaggcacggacgacugu

SEQ ID NO: 192290 - RNA, 19 nt, Homo sapiens
cugcaagccuuucaaaugg

SEQ ID NO: 192291 - RNA, 19 nt, Homo sapiens
gagaagagaaagcacaaag

SEQ ID NO: 192292 - RNA, 19 nt, Homo sapiens
guggaugacuacagcaaug

SEQ ID NO: 192293 - RNA, 19 nt, Homo sapiens
gcggugagcuauguuuaca

SEQ ID NO: 192294 - RNA, 19 nt, Homo sapiens
gcgagcugcuacuacugua

SEQ ID NO: 192295 - RNA, 19 nt, Homo sapiens
ugaaagggccacugugugu

SEQ ID NO: 192296 - RNA, 19 nt, Homo sapiens
gaggagagaaccuagagau

SEQ ID NO: 192297 - RNA, 19 nt, Homo sapiens
ggaggacuggaaugaaauu

SEQ ID NO: 192298 - RNA, 19 nt, Homo sapiens
ccucucagccuuccuauca

SEQ ID NO: 192299 - RNA, 19 nt, Homo sapiens
acacagaugcucagucuca

SEQ ID NO: 192300 - RNA, 19 nt, Homo sapiens
uauggugggacacuaaaua

SEQ ID NO: 192301 - RNA, 19 nt, Homo sapiens
gaaacuaauauaccucagu

SEQ ID NO: 192302 - RNA, 19 nt, Homo sapiens
guuuaugaaugucacaaug

SEQ ID NO: 192303 - RNA, 19 nt, Homo sapiens
gcagauuggagcuuaggaa

SEQ ID NO: 192304 - RNA, 19 nt, Homo sapiens
ugaucacguuucacaauga

SEQ ID NO: 192305 - RNA, 19 nt, Homo sapiens
ggucagcgugcuuaagaaa

SEQ ID NO: 192306 - RNA, 19 nt, Homo sapiens
gaaguacgacaugaugaug

SEQ ID NO: 192307 - RNA, 19 nt, Homo sapiens
ggagacgguuacuuauuuu

SEQ ID NO: 192308 - RNA, 19 nt, Homo sapiens
gggcaucugcugacuugaa

SEQ ID NO: 192309 - RNA, 19 nt, Homo sapiens
gaugaaaccuacccaauua

SEQ ID NO: 192310 - RNA, 19 nt, Homo sapiens
gaagagauguuuacaguau

SEQ ID NO: 192311 - RNA, 19 nt, Homo sapiens
caacaaaccuucuccuuau

SEQ ID NO: 192312 - RNA, 19 nt, Homo sapiens
gaagaaagauuuguuacug

SEQ ID NO: 192313 - RNA, 19 nt, Homo sapiens
gaugaguacuuacaugaua

SEQ ID NO: 192314 - RNA, 19 nt, Homo sapiens
gcuagaagcuguaaacaau

SEQ ID NO: 192315 - RNA, 19 nt, Homo sapiens
gcagaauacuugacucauu

SEQ ID NO: 192316 - RNA, 19 nt, Homo sapiens
ggaggcaaaccauuaauua

SEQ ID NO: 192317 - RNA, 19 nt, Homo sapiens
gagacuggguaauuuauaa

SEQ ID NO: 192318 - RNA, 19 nt, Homo sapiens
cagaauacuugacucauuu

SEQ ID NO: 192319 - RNA, 19 nt, Homo sapiens
guaauacacuccacuugaa

SEQ ID NO: 192320 - RNA, 19 nt, Homo sapiens
gauguuggauuuaaugcua

SEQ ID NO: 192321 - RNA, 19 nt, Homo sapiens
guaaugauacuguguguuu

SEQ ID NO: 192322 - RNA, 19 nt, Homo sapiens
gggaagagauguuuacagu

SEQ ID NO: 192323 - RNA, 19 nt, Homo sapiens
gaagcuuggugcaguaauu

SEQ ID NO: 192324 - RNA, 19 nt, Homo sapiens
caaguaaagugauguuugu

SEQ ID NO: 192325 - RNA, 19 nt, Homo sapiens
gaacuacacggcugucgua

SEQ ID NO: 192326 - RNA, 19 nt, Homo sapiens
caucagauauuucuuaugg

SEQ ID NO: 192327 - RNA, 19 nt, Homo sapiens
ccauagaucugaacacguu

SEQ ID NO: 192328 - RNA, 19 nt, Homo sapiens
gcaaagagaaguaaguguu

SEQ ID NO: 192329 - RNA, 19 nt, Homo sapiens
gcagcuaaauguaacuuau

SEQ ID NO: 192330 - RNA, 19 nt, Homo sapiens
cuacaaaggucacaagaca

SEQ ID NO: 192331 - RNA, 19 nt, Homo sapiens
gaaaccaguacuuugaaua

SEQ ID NO: 192332 - RNA, 19 nt, Homo sapiens
ugagagaccuuguuugcaa

SEQ ID NO: 192333 - RNA, 19 nt, Homo sapiens
uacgaucgguuucauauuu

SEQ ID NO: 192334 - RNA, 19 nt, Homo sapiens
gcaaguuucuguuucaaag

SEQ ID NO: 192335 - RNA, 19 nt, Homo sapiens
ucaaggaggcaaaccauua

SEQ ID NO: 192336 - RNA, 19 nt, Homo sapiens
gggagucgcuuccugauca

SEQ ID NO: 192337 - RNA, 19 nt, Homo sapiens
gagcauauacugguuauug

SEQ ID NO: 192338 - RNA, 19 nt, Homo sapiens
ucaacaaaccuucuccuua

SEQ ID NO: 192339 - RNA, 19 nt, Homo sapiens
ggcaaaccauuaauuaugu

SEQ ID NO: 192340 - RNA, 19 nt, Homo sapiens
gaaggaaagaugaaaccua

SEQ ID NO: 192341 - RNA, 19 nt, Homo sapiens
cagaauagcugagaacuac

SEQ ID NO: 192342 - RNA, 19 nt, Homo sapiens
caaagcacaauaacuagua

SEQ ID NO: 192343 - RNA, 19 nt, Homo sapiens
gacccuaucuucucauugu

SEQ ID NO: 192344 - RNA, 19 nt, Homo sapiens
uuacuugucugucaaaugu

SEQ ID NO: 192345 - RNA, 19 nt, Homo sapiens
ggaauuaugucuucaugcu

SEQ ID NO: 192346 - RNA, 19 nt, Homo sapiens
ggaaaccaguacuuugaau

SEQ ID NO: 192347 - RNA, 19 nt, Homo sapiens
gguaaagcauucaagacaa

SEQ ID NO: 192348 - RNA, 19 nt, Homo sapiens
guaaucauuugguuaagug

SEQ ID NO: 192349 - RNA, 19 nt, Homo sapiens
gauauugcauccauagauc

SEQ ID NO: 192350 - RNA, 19 nt, Homo sapiens
caccaccagugucauaaua

SEQ ID NO: 192351 - RNA, 19 nt, Homo sapiens
uaguguagaugaguacuua

SEQ ID NO: 192352 - RNA, 19 nt, Homo sapiens
aaacacugcuuuaaugcuu

SEQ ID NO: 192353 - RNA, 19 nt, Homo sapiens
uuaagcaucugauagaaug

SEQ ID NO: 192354 - RNA, 19 nt, Homo sapiens
gaaauacagaugcagcaaa

SEQ ID NO: 192355 - RNA, 19 nt, Homo sapiens
gauuaugccuugcucuguu

SEQ ID NO: 192356 - RNA, 19 nt, Homo sapiens
gcaaagaaggaaagaugaa

SEQ ID NO: 192357 - RNA, 19 nt, Homo sapiens
caagugacaggauuucuuu

SEQ ID NO: 192358 - RNA, 19 nt, Homo sapiens
gcacgcaucuguaguucca

SEQ ID NO: 192359 - RNA, 19 nt, Homo sapiens
caacauccagaaggaauua

SEQ ID NO: 192360 - RNA, 19 nt, Homo sapiens
aaucaaggauggaaaggaa

SEQ ID NO: 192361 - RNA, 19 nt, Homo sapiens
aagcaugucuuacguggaa

SEQ ID NO: 192362 - RNA, 19 nt, Homo sapiens
gagaaguaaguguucaaua

SEQ ID NO: 192363 - RNA, 19 nt, Homo sapiens
gaucugaacacguuugaau

SEQ ID NO: 192364 - RNA, 19 nt, Homo sapiens
cuacacggcugucguaagu

SEQ ID NO: 192365 - RNA, 19 nt, Homo sapiens
guagaugaguacuuacaug

SEQ ID NO: 192366 - RNA, 19 nt, Homo sapiens
gcaauacugcugaaggaaa

SEQ ID NO: 192367 - RNA, 19 nt, Homo sapiens
ugaauacucugcucaacau

SEQ ID NO: 192368 - RNA, 19 nt, Homo sapiens
gcaauguggugggcaguug

SEQ ID NO: 192369 - RNA, 19 nt, Homo sapiens
caauuuaaguguugaagag

SEQ ID NO: 192370 - RNA, 19 nt, Homo sapiens
caaggaggcaaaccauuaa

SEQ ID NO: 192371 - RNA, 19 nt, Homo sapiens
caugguaucugaacaacau

SEQ ID NO: 192372 - RNA, 19 nt, Homo sapiens
gaucacugcucgguugcua

SEQ ID NO: 192373 - RNA, 19 nt, Homo sapiens
caauacugcugaaggaaau

SEQ ID NO: 192374 - RNA, 19 nt, Homo sapiens
cuacagugagcuaugauua

SEQ ID NO: 192375 - RNA, 19 nt, Homo sapiens
uaaaguuccuuaagcaucu

SEQ ID NO: 192376 - RNA, 19 nt, Homo sapiens
gggauaggaagaaagauuu

SEQ ID NO: 192377 - RNA, 19 nt, Homo sapiens
ccucaacacuauuguaauc

SEQ ID NO: 192378 - RNA, 19 nt, Homo sapiens
ggaagagauguuuacagua

SEQ ID NO: 192379 - RNA, 19 nt, Homo sapiens
ggaugaauacaaggaaaua

SEQ ID NO: 192380 - RNA, 19 nt, Homo sapiens
ggugggcaguuggagauua

SEQ ID NO: 192381 - RNA, 19 nt, Homo sapiens
uggaagcuaugaugaagaa

SEQ ID NO: 192382 - RNA, 19 nt, Homo sapiens
ugucguaaguccagauauu

SEQ ID NO: 192383 - RNA, 19 nt, Homo sapiens
aaaugugccuuucagcaaa

SEQ ID NO: 192384 - RNA, 19 nt, Homo sapiens
uaugggagauccagaagga

SEQ ID NO: 192385 - RNA, 19 nt, Homo sapiens
gacaaccaauuuaaguguu

SEQ ID NO: 192386 - RNA, 19 nt, Homo sapiens
caagacaaccaauuuaagu

SEQ ID NO: 192387 - RNA, 19 nt, Homo sapiens
ugauaaaguuccuuaagca

SEQ ID NO: 192388 - RNA, 19 nt, Homo sapiens
ucugucaaauguuuccuua

SEQ ID NO: 192389 - RNA, 19 nt, Homo sapiens
ggaugaugcuaguguagau

SEQ ID NO: 192390 - RNA, 19 nt, Homo sapiens
ggaucaacuucuauacaau

SEQ ID NO: 192391 - RNA, 19 nt, Homo sapiens
gcaagugacaggauuucuu

SEQ ID NO: 192392 - RNA, 19 nt, Homo sapiens
uggcagagccucagcugua

SEQ ID NO: 192393 - RNA, 19 nt, Homo sapiens
ggugauugcuagaaaccaa

SEQ ID NO: 192394 - RNA, 19 nt, Homo sapiens
gaagcuaugaugaagaaau

SEQ ID NO: 192395 - RNA, 19 nt, Homo sapiens
guaaagcauucaagacaac

SEQ ID NO: 192396 - RNA, 19 nt, Homo sapiens
agagauguuuacaguauga

SEQ ID NO: 192397 - RNA, 19 nt, Homo sapiens
uagcacuacuacagaaauu

SEQ ID NO: 192398 - RNA, 19 nt, Homo sapiens
caaagaaggaaagaugaaa

SEQ ID NO: 192399 - RNA, 19 nt, Homo sapiens
ccacguugcuuagaacugu

SEQ ID NO: 192400 - RNA, 19 nt, Homo sapiens
gaucuccuguauucuuguu

SEQ ID NO: 192401 - RNA, 19 nt, Homo sapiens
caaaagcagcuaaauguaa

SEQ ID NO: 192402 - RNA, 19 nt, Homo sapiens
caacuucuauacaauccau

SEQ ID NO: 192403 - RNA, 19 nt, Homo sapiens
gaggcaaaccauuaauuau

SEQ ID NO: 192404 - RNA, 19 nt, Homo sapiens
agaccuuaauccuguuaua

SEQ ID NO: 192405 - RNA, 19 nt, Homo sapiens
gguggaugaugcuagugua

SEQ ID NO: 192406 - RNA, 19 nt, Homo sapiens
acagugugcucuauucuuc

SEQ ID NO: 192407 - RNA, 19 nt, Homo sapiens
cuuaggagauuuaccacuu

SEQ ID NO: 192408 - RNA, 19 nt, Homo sapiens
ccaaguaaagugauguuug

SEQ ID NO: 192409 - RNA, 19 nt, Homo sapiens
caacagucuugcugaauua

SEQ ID NO: 192410 - RNA, 19 nt, Homo sapiens
aaacaaaggugccaugaug

SEQ ID NO: 192411 - RNA, 19 nt, Homo sapiens
gaucuagccuccaucauga

SEQ ID NO: 192412 - RNA, 19 nt, Homo sapiens
gaucucagcaggccuauaa

SEQ ID NO: 192413 - RNA, 19 nt, Homo sapiens
gauagcaccuuccuguuug

SEQ ID NO: 192414 - RNA, 19 nt, Homo sapiens
gggcagauauagcauuaau

SEQ ID NO: 192415 - RNA, 19 nt, Homo sapiens
ucaacagucuugcugaauu

SEQ ID NO: 192416 - RNA, 19 nt, Homo sapiens
gcaaacgaccaucagcaua

SEQ ID NO: 192417 - RNA, 19 nt, Homo sapiens
gccaggagcuacucaggaa

SEQ ID NO: 192418 - RNA, 19 nt, Homo sapiens
gcacggcccugcagauuuu

SEQ ID NO: 192419 - RNA, 19 nt, Homo sapiens
gauccgggcuguuguugau

SEQ ID NO: 192420 - RNA, 19 nt, Homo sapiens
gcaccuuccuguuugacaa

SEQ ID NO: 192421 - RNA, 19 nt, Homo sapiens
caaacgaccaucagcauau

SEQ ID NO: 192422 - RNA, 19 nt, Homo sapiens
cgauagcaccuuccuguuu

SEQ ID NO: 192423 - RNA, 19 nt, Homo sapiens
acaacccgcugcaggauga

SEQ ID NO: 192424 - RNA, 19 nt, Homo sapiens
caaguaugacaaccucuuu

SEQ ID NO: 192425 - RNA, 19 nt, Homo sapiens
gcugcacgcucauuacuac

SEQ ID NO: 192426 - RNA, 19 nt, Homo sapiens
uugggcagauauagcauua

SEQ ID NO: 192427 - RNA, 19 nt, Homo sapiens
gauguaacgcugccacuca

SEQ ID NO: 192428 - RNA, 19 nt, Homo sapiens
ggacggagaaagugaaagg

SEQ ID NO: 192429 - RNA, 19 nt, Homo sapiens
uagccuccaucaugaagaa

SEQ ID NO: 192430 - RNA, 19 nt, Homo sapiens
uaugacaaccucuuugaga

SEQ ID NO: 192431 - RNA, 19 nt, Homo sapiens
ucuguaaggucaugugcuu

SEQ ID NO: 192432 - RNA, 19 nt, Homo sapiens
cacagggccuugaauccuu

SEQ ID NO: 192433 - RNA, 19 nt, Homo sapiens
gugaugaucuagccuccau

SEQ ID NO: 192434 - RNA, 19 nt, Homo sapiens
ccuggaauuugggcagaua

SEQ ID NO: 192435 - RNA, 19 nt, Homo sapiens
ggaauuugggcagauauag

SEQ ID NO: 192436 - RNA, 19 nt, Homo sapiens
acagggccuugaauccuuu

SEQ ID NO: 192437 - RNA, 19 nt, Homo sapiens
aaacgaccaucagcauauc

SEQ ID NO: 192438 - RNA, 19 nt, Homo sapiens
ggcagcugcacgcucauua

SEQ ID NO: 192439 - RNA, 19 nt, Homo sapiens
gguaugggccagcaguuuc

SEQ ID NO: 192440 - RNA, 19 nt, Homo sapiens
gugcagaucuuugaaaaca

SEQ ID NO: 192441 - RNA, 19 nt, Homo sapiens
guacagccgccaggagcua

SEQ ID NO: 192442 - RNA, 19 nt, Homo sapiens
ggcacggcccugcagauuu

SEQ ID NO: 192443 - RNA, 19 nt, Homo sapiens
uggaaccgauccucagcaa

SEQ ID NO: 192444 - RNA, 19 nt, Homo sapiens
gaccacagggccuugaauc

SEQ ID NO: 192445 - RNA, 19 nt, Homo sapiens
ccaaguaugacaaccucuu

SEQ ID NO: 192446 - RNA, 19 nt, Homo sapiens
gaaaacaaaggugccauga

SEQ ID NO: 192447 - RNA, 19 nt, Homo sapiens
ucaugucggucccugagau

SEQ ID NO: 192448 - RNA, 19 nt, Homo sapiens
ggcagauauagcauuaaua

SEQ ID NO: 192449 - RNA, 19 nt, Homo sapiens
auucaugguuggcuacgaa

SEQ ID NO: 192450 - RNA, 19 nt, Homo sapiens
cagcaaccuuccgggcaaa

SEQ ID NO: 192451 - RNA, 19 nt, Homo sapiens
guaacgcugccacucaugu

SEQ ID NO: 192452 - RNA, 19 nt, Homo sapiens
gaauccuggccuggaauuu

SEQ ID NO: 192453 - RNA, 19 nt, Homo sapiens
cuugaauccuggccuggaa

SEQ ID NO: 192454 - RNA, 19 nt, Homo sapiens
gggugcagaucuuugaaaa

SEQ ID NO: 192455 - RNA, 19 nt, Homo sapiens
ccugagauccgggcuguug

SEQ ID NO: 192456 - RNA, 19 nt, Homo sapiens
gcagaaggacagggagaca

SEQ ID NO: 192457 - RNA, 19 nt, Homo sapiens
uggaauuugggcagauaua

SEQ ID NO: 192458 - RNA, 19 nt, Homo sapiens
caugguuggcuacgaaaug

SEQ ID NO: 192459 - RNA, 19 nt, Homo sapiens
ucagcaggccuauaagagu

SEQ ID NO: 192460 - RNA, 19 nt, Homo sapiens
ggcaaacgaccaucagcau

SEQ ID NO: 192461 - RNA, 19 nt, Homo sapiens
gagacguccuuucccuacu

SEQ ID NO: 192462 - RNA, 19 nt, Homo sapiens
gaauuugggcagauauagc

SEQ ID NO: 192463 - RNA, 19 nt, Homo sapiens
gccacuguccggaaauuca

SEQ ID NO: 192464 - RNA, 19 nt, Homo sapiens
aguaugacaaccucuuuga

SEQ ID NO: 192465 - RNA, 19 nt, Homo sapiens
gagauccgggcuguuguug

SEQ ID NO: 192466 - RNA, 19 nt, Homo sapiens
gaaagaugauggugacuua

SEQ ID NO: 192467 - RNA, 19 nt, Homo sapiens
ggaagggacugccaaaguu

SEQ ID NO: 192468 - RNA, 19 nt, Homo sapiens
ggagaaagcuagaggugaa

SEQ ID NO: 192469 - RNA, 19 nt, Homo sapiens
aaacaaaggugccaugaug

SEQ ID NO: 192470 - RNA, 19 nt, Homo sapiens
gaucuagccuccaucauga

SEQ ID NO: 192471 - RNA, 19 nt, Homo sapiens
gcaauaauccaguaaucua

SEQ ID NO: 192472 - RNA, 19 nt, Homo sapiens
gaucucagcaggccuauaa

SEQ ID NO: 192473 - RNA, 19 nt, Homo sapiens
gauagcaccuuccuguuug

SEQ ID NO: 192474 - RNA, 19 nt, Homo sapiens
gaagggacugccaaaguua

SEQ ID NO: 192475 - RNA, 19 nt, Homo sapiens
ccaaugugcuuucuaaucu

SEQ ID NO: 192476 - RNA, 19 nt, Homo sapiens
cgaggagucugguaacuau

SEQ ID NO: 192477 - RNA, 19 nt, Homo sapiens
gcaaacgaccaucagcaua

SEQ ID NO: 192478 - RNA, 19 nt, Homo sapiens
gcagugagccaucaucaug

SEQ ID NO: 192479 - RNA, 19 nt, Homo sapiens
gaacugcaaccucaaagga

SEQ ID NO: 192480 - RNA, 19 nt, Homo sapiens
ccaaggagucccuaacuuu

SEQ ID NO: 192481 - RNA, 19 nt, Homo sapiens
ccaguaaggucaugugcuu

SEQ ID NO: 192482 - RNA, 19 nt, Homo sapiens
uaggaggccuuagcaauaa

SEQ ID NO: 192483 - RNA, 19 nt, Homo sapiens
ugugguggcucaugccuua

SEQ ID NO: 192484 - RNA, 19 nt, Homo sapiens
gcacggcccugcagauuuu

SEQ ID NO: 192485 - RNA, 19 nt, Homo sapiens
gccaggagcuacucaggaa

SEQ ID NO: 192486 - RNA, 19 nt, Homo sapiens
cugcuucccuugccuauuu

SEQ ID NO: 192487 - RNA, 19 nt, Homo sapiens
gauccgggcuguuguugau

SEQ ID NO: 192488 - RNA, 19 nt, Homo sapiens
gugcuaaccuggauaacug

SEQ ID NO: 192489 - RNA, 19 nt, Homo sapiens
uaaccuggauaacuguaaa

SEQ ID NO: 192490 - RNA, 19 nt, Homo sapiens
ccaguaaucuaaaggaaag

SEQ ID NO: 192491 - RNA, 19 nt, Homo sapiens
cuaggaggccuuagcaaua

SEQ ID NO: 192492 - RNA, 19 nt, Homo sapiens
gcaccuuccuguuugacaa

SEQ ID NO: 192493 - RNA, 19 nt, Homo sapiens
caaacgaccaucagcauau

SEQ ID NO: 192494 - RNA, 19 nt, Homo sapiens
ucuccaaugugcuuucuaa

SEQ ID NO: 192495 - RNA, 19 nt, Homo sapiens
cgauagcaccuuccuguuu

SEQ ID NO: 192496 - RNA, 19 nt, Homo sapiens
gucaugacccugauaguuu

SEQ ID NO: 192497 - RNA, 19 nt, Homo sapiens
ggacucaggagcugcuaaa

SEQ ID NO: 192498 - RNA, 19 nt, Homo sapiens
gcccagaaguucgagacua

SEQ ID NO: 192499 - RNA, 19 nt, Homo sapiens
gagcaggucaggacucaga

SEQ ID NO: 192500 - RNA, 19 nt, Homo sapiens
ggaaguggccagaguagag

SEQ ID NO: 192501 - RNA, 19 nt, Homo sapiens
ggucaggacucagaacagu

SEQ ID NO: 192502 - RNA, 19 nt, Homo sapiens
gagauguaguuuucagaua

SEQ ID NO: 192503 - RNA, 19 nt, Homo sapiens
acaacccgcugcaggauga

SEQ ID NO: 192504 - RNA, 19 nt, Homo sapiens
cagcaaacuuggugaaacu

SEQ ID NO: 192505 - RNA, 19 nt, Homo sapiens
ucaaguaccuauauuuagc

SEQ ID NO: 192506 - RNA, 19 nt, Homo sapiens
gauccugggcacauucuuu

SEQ ID NO: 192507 - RNA, 19 nt, Homo sapiens
ugagagagguguguaaagg

SEQ ID NO: 192508 - RNA, 19 nt, Homo sapiens
gcugagauaggaucacuug

SEQ ID NO: 192509 - RNA, 19 nt, Homo sapiens
gagacuagccugggaaaca

SEQ ID NO: 192510 - RNA, 19 nt, Homo sapiens
caacagucaugacccugau

SEQ ID NO: 192511 - RNA, 19 nt, Homo sapiens
ccagggaacccaacaguca

SEQ ID NO: 192512 - RNA, 19 nt, Homo sapiens
gcagcaaacuuggugaaac

SEQ ID NO: 192513 - RNA, 19 nt, Homo sapiens
caaguaugacaaccucuuu

SEQ ID NO: 192514 - RNA, 19 nt, Homo sapiens
ucaccuugaugacuuccua

SEQ ID NO: 192515 - RNA, 19 nt, Homo sapiens
ggaaagaugauggugacuu

SEQ ID NO: 192516 - RNA, 19 nt, Homo sapiens
uagcaauaauccaguaauc

SEQ ID NO: 192517 - RNA, 19 nt, Homo sapiens
uaacuuucuuaucccauga

SEQ ID NO: 192518 - RNA, 19 nt, Homo sapiens
gcugcacgcucauuacuac

SEQ ID NO: 192519 - RNA, 19 nt, Homo sapiens
cccacugucucucuucuuu

SEQ ID NO: 192520 - RNA, 19 nt, Homo sapiens
caaacuuggugaaacuaca

SEQ ID NO: 192521 - RNA, 19 nt, Homo sapiens
guagagaugcugggacuga

SEQ ID NO: 192522 - RNA, 19 nt, Homo sapiens
gcuccuaugucaccuugau

SEQ ID NO: 192523 - RNA, 19 nt, Homo sapiens
gaaagcuagaggugaacua

SEQ ID NO: 192524 - RNA, 19 nt, Homo sapiens
caaggagucccuaacuuuc

SEQ ID NO: 192525 - RNA, 19 nt, Homo sapiens
ccagugggccuguggcauu

SEQ ID NO: 192526 - RNA, 19 nt, Homo sapiens
gauguaacgcugccacuca

SEQ ID NO: 192527 - RNA, 19 nt, Homo sapiens
gccuguggcauucauauuu

SEQ ID NO: 192528 - RNA, 19 nt, Homo sapiens
gggcauuccuugggacuca

SEQ ID NO: 192529 - RNA, 19 nt, Homo sapiens
uagccuccaucaugaagaa

SEQ ID NO: 192530 - RNA, 19 nt, Homo sapiens
ggacggagaaagugaaagg

SEQ ID NO: 192531 - RNA, 19 nt, Homo sapiens
caagaugggaggauugcuu

SEQ ID NO: 192532 - RNA, 19 nt, Homo sapiens
ucaugacccugauaguuuc

SEQ ID NO: 192533 - RNA, 19 nt, Homo sapiens
gauccugggagauguaguu

SEQ ID NO: 192534 - RNA, 19 nt, Homo sapiens
ggguggagcagcaaacuug

SEQ ID NO: 192535 - RNA, 19 nt, Homo sapiens
gaaguggccagaguagaga

SEQ ID NO: 192536 - RNA, 19 nt, Homo sapiens
uaugacaaccucuuugaga

SEQ ID NO: 192537 - RNA, 19 nt, Homo sapiens
uauccauucugucuuccua

SEQ ID NO: 192538 - RNA, 19 nt, Homo sapiens
gugaugaucuagccuccau

SEQ ID NO: 192539 - RNA, 19 nt, Homo sapiens
gagcagcaaacuuggugaa

SEQ ID NO: 192540 - RNA, 19 nt, Homo sapiens
ccuuagcaauaauccagua

SEQ ID NO: 192541 - RNA, 19 nt, Homo sapiens
gagagagguguguaaagga

SEQ ID NO: 192542 - RNA, 19 nt, Homo sapiens
cuaccucucgguuaucuuu

SEQ ID NO: 192543 - RNA, 19 nt, Homo sapiens
gagaguaugguccucagau

SEQ ID NO: 192544 - RNA, 19 nt, Homo sapiens
gaugacuuccuauccauuc

SEQ ID NO: 192545 - RNA, 19 nt, Homo sapiens
ggagucugguaacuaugga

SEQ ID NO: 192546 - RNA, 19 nt, Homo sapiens
ucacuugggcccaggaguu

SEQ ID NO: 192547 - RNA, 19 nt, Homo sapiens
ccugauaguuucccauaac

SEQ ID NO: 192548 - RNA, 19 nt, Homo sapiens
ggagucccuaacuuucuua

SEQ ID NO: 192549 - RNA, 19 nt, Homo sapiens
caucauggcaucauugcau

SEQ ID NO: 192550 - RNA, 19 nt, Homo sapiens
gaagcccucgucucuacaa

SEQ ID NO: 192551 - RNA, 19 nt, Homo sapiens
cccagaaguucgagacuag

SEQ ID NO: 192552 - RNA, 19 nt, Homo sapiens
ccuguggcauucauauuuc

SEQ ID NO: 192553 - RNA, 19 nt, Homo sapiens
cauaacaaccugggcauuc

SEQ ID NO: 192554 - RNA, 19 nt, Homo sapiens
aaacgaccaucagcauauc

SEQ ID NO: 192555 - RNA, 19 nt, Homo sapiens
cccaaggagucccuaacuu

SEQ ID NO: 192556 - RNA, 19 nt, Homo sapiens
aaaccacaauauccagcaa

SEQ ID NO: 192557 - RNA, 19 nt, Homo sapiens
gcaccugauacuucuguug

SEQ ID NO: 192558 - RNA, 19 nt, Homo sapiens
ggcagcugcacgcucauua

SEQ ID NO: 192559 - RNA, 19 nt, Homo sapiens
gguaugggccagcaguuuc

SEQ ID NO: 192560 - RNA, 19 nt, Homo sapiens
gugcagaucuuugaaaaca

SEQ ID NO: 192561 - RNA, 19 nt, Homo sapiens
gagcacccagaacuccaua

SEQ ID NO: 192562 - RNA, 19 nt, Homo sapiens
cucaggagcugcuaaacuc

SEQ ID NO: 192563 - RNA, 19 nt, Homo sapiens
gauaguuucccauaacaac

SEQ ID NO: 192564 - RNA, 19 nt, Homo sapiens
cagacucucacaugcagua

SEQ ID NO: 192565 - RNA, 19 nt, Homo sapiens
agagagagacuugcuagga

SEQ ID NO: 192566 - RNA, 19 nt, Homo sapiens
gaaagaugauggugacuua

SEQ ID NO: 192567 - RNA, 19 nt, Homo sapiens
ggaagggacugccaaaguu

SEQ ID NO: 192568 - RNA, 19 nt, Homo sapiens
ggagaaagcuagaggugaa

SEQ ID NO: 192569 - RNA, 19 nt, Homo sapiens
aaacaaaggugccaugaug

SEQ ID NO: 192570 - RNA, 19 nt, Homo sapiens
gaucuagccuccaucauga

SEQ ID NO: 192571 - RNA, 19 nt, Homo sapiens
gcaauaauccaguaaucua

SEQ ID NO: 192572 - RNA, 19 nt, Homo sapiens
gaucucagcaggccuauaa

SEQ ID NO: 192573 - RNA, 19 nt, Homo sapiens
gaagggacugccaaaguua

SEQ ID NO: 192574 - RNA, 19 nt, Homo sapiens
ccaaugugcuuucuaaucu

SEQ ID NO: 192575 - RNA, 19 nt, Homo sapiens
gcaaacgaccaucagcaua

SEQ ID NO: 192576 - RNA, 19 nt, Homo sapiens
gcagugagccaucaucaug

SEQ ID NO: 192577 - RNA, 19 nt, Homo sapiens
gaacugcaaccucaaagga

SEQ ID NO: 192578 - RNA, 19 nt, Homo sapiens
ccaaggagucccuaacuuu

SEQ ID NO: 192579 - RNA, 19 nt, Homo sapiens
uaggaggccuuagcaauaa

SEQ ID NO: 192580 - RNA, 19 nt, Homo sapiens
ugugguggcucaugccuua

SEQ ID NO: 192581 - RNA, 19 nt, Homo sapiens
gcacggcccugcagauuuu

SEQ ID NO: 192582 - RNA, 19 nt, Homo sapiens
gccaggagcuacucaggaa

SEQ ID NO: 192583 - RNA, 19 nt, Homo sapiens
cugcuucccuugccuauuu

SEQ ID NO: 192584 - RNA, 19 nt, Homo sapiens
gugcuaaccuggauaacug

SEQ ID NO: 192585 - RNA, 19 nt, Homo sapiens
uaaccuggauaacuguaaa

SEQ ID NO: 192586 - RNA, 19 nt, Homo sapiens
ccaguaaucuaaaggaaag

SEQ ID NO: 192587 - RNA, 19 nt, Homo sapiens
cuaggaggccuuagcaaua

SEQ ID NO: 192588 - RNA, 19 nt, Homo sapiens
caaacgaccaucagcauau

SEQ ID NO: 192589 - RNA, 19 nt, Homo sapiens
ggagagaucuuugaaaaca

SEQ ID NO: 192590 - RNA, 19 nt, Homo sapiens
ucuccaaugugcuuucuaa

SEQ ID NO: 192591 - RNA, 19 nt, Homo sapiens
gucaugacccugauaguuu

SEQ ID NO: 192592 - RNA, 19 nt, Homo sapiens
ggacucaggagcugcuaaa

SEQ ID NO: 192593 - RNA, 19 nt, Homo sapiens
caacggagagaucuuugaa

SEQ ID NO: 192594 - RNA, 19 nt, Homo sapiens
gcccagaaguucgagacua

SEQ ID NO: 192595 - RNA, 19 nt, Homo sapiens
gagcaggucaggacucaga

SEQ ID NO: 192596 - RNA, 19 nt, Homo sapiens
ggaaguggccagaguagag

SEQ ID NO: 192597 - RNA, 19 nt, Homo sapiens
acaacccgcugcaggauga

SEQ ID NO: 192598 - RNA, 19 nt, Homo sapiens
ggucaggacucagaacagu

SEQ ID NO: 192599 - RNA, 19 nt, Homo sapiens
gagauguaguuuucagaua

SEQ ID NO: 192600 - RNA, 19 nt, Homo sapiens
cagcaaacuuggugaaacu

SEQ ID NO: 192601 - RNA, 19 nt, Homo sapiens
ucaaguaccuauauuuagc

SEQ ID NO: 192602 - RNA, 19 nt, Homo sapiens
gauccugggcacauucuuu

SEQ ID NO: 192603 - RNA, 19 nt, Homo sapiens
ugagagagguguguaaagg

SEQ ID NO: 192604 - RNA, 19 nt, Homo sapiens
gcugagauaggaucacuug

SEQ ID NO: 192605 - RNA, 19 nt, Homo sapiens
gagacuagccugggaaaca

SEQ ID NO: 192606 - RNA, 19 nt, Homo sapiens
caacagucaugacccugau

SEQ ID NO: 192607 - RNA, 19 nt, Homo sapiens
ccagggaacccaacaguca

SEQ ID NO: 192608 - RNA, 19 nt, Homo sapiens
gcagcaaacuuggugaaac

SEQ ID NO: 192609 - RNA, 19 nt, Homo sapiens
caaguaugacaaccucuuu

SEQ ID NO: 192610 - RNA, 19 nt, Homo sapiens
ucaccuugaugacuuccua

SEQ ID NO: 192611 - RNA, 19 nt, Homo sapiens
ggaaagaugauggugacuu

SEQ ID NO: 192612 - RNA, 19 nt, Homo sapiens
uagcaauaauccaguaauc

SEQ ID NO: 192613 - RNA, 19 nt, Homo sapiens
uaacuuucuuaucccauga

SEQ ID NO: 192614 - RNA, 19 nt, Homo sapiens
gcugcacgcucauuacuac

SEQ ID NO: 192615 - RNA, 19 nt, Homo sapiens
cccacugucucucuucuuu

SEQ ID NO: 192616 - RNA, 19 nt, Homo sapiens
caaacuuggugaaacuaca

SEQ ID NO: 192617 - RNA, 19 nt, Homo sapiens
guagagaugcugggacuga

SEQ ID NO: 192618 - RNA, 19 nt, Homo sapiens
gcuccuaugucaccuugau

SEQ ID NO: 192619 - RNA, 19 nt, Homo sapiens
gaaagcuagaggugaacua

SEQ ID NO: 192620 - RNA, 19 nt, Homo sapiens
caaggagucccuaacuuuc

SEQ ID NO: 192621 - RNA, 19 nt, Homo sapiens
ccagugggccuguggcauu

SEQ ID NO: 192622 - RNA, 19 nt, Homo sapiens
gccuguggcauucauauuu

SEQ ID NO: 192623 - RNA, 19 nt, Homo sapiens
gggcauuccuugggacuca

SEQ ID NO: 192624 - RNA, 19 nt, Homo sapiens
uagccuccaucaugaagaa

SEQ ID NO: 192625 - RNA, 19 nt, Homo sapiens
ggacggagaaagugaaagg

SEQ ID NO: 192626 - RNA, 19 nt, Homo sapiens
caagaugggaggauugcuu

SEQ ID NO: 192627 - RNA, 19 nt, Homo sapiens
ucaugacccugauaguuuc

SEQ ID NO: 192628 - RNA, 19 nt, Homo sapiens
gauccugggagauguaguu

SEQ ID NO: 192629 - RNA, 19 nt, Homo sapiens
ggguggagcagcaaacuug

SEQ ID NO: 192630 - RNA, 19 nt, Homo sapiens
gaaguggccagaguagaga

SEQ ID NO: 192631 - RNA, 19 nt, Homo sapiens
uaugacaaccucuuugaga

SEQ ID NO: 192632 - RNA, 19 nt, Homo sapiens
uauccauucugucuuccua

SEQ ID NO: 192633 - RNA, 19 nt, Homo sapiens
gugaugaucuagccuccau

SEQ ID NO: 192634 - RNA, 19 nt, Homo sapiens
gagcagcaaacuuggugaa

SEQ ID NO: 192635 - RNA, 19 nt, Homo sapiens
ccuuagcaauaauccagua

SEQ ID NO: 192636 - RNA, 19 nt, Homo sapiens
gagagagguguguaaagga

SEQ ID NO: 192637 - RNA, 19 nt, Homo sapiens
gagaguaugguccucagau

SEQ ID NO: 192638 - RNA, 19 nt, Homo sapiens
gaugacuuccuauccauuc

SEQ ID NO: 192639 - RNA, 19 nt, Homo sapiens
ucacuugggcccaggaguu

SEQ ID NO: 192640 - RNA, 19 nt, Homo sapiens
ccugauaguuucccauaac

SEQ ID NO: 192641 - RNA, 19 nt, Homo sapiens
ggagucccuaacuuucuua

SEQ ID NO: 192642 - RNA, 19 nt, Homo sapiens
caucauggcaucauugcau

SEQ ID NO: 192643 - RNA, 19 nt, Homo sapiens
gaagcccucgucucuacaa

SEQ ID NO: 192644 - RNA, 19 nt, Homo sapiens
cccagaaguucgagacuag

SEQ ID NO: 192645 - RNA, 19 nt, Homo sapiens
ccuguggcauucauauuuc

SEQ ID NO: 192646 - RNA, 19 nt, Homo sapiens
cauaacaaccugggcauuc

SEQ ID NO: 192647 - RNA, 19 nt, Homo sapiens
aaacgaccaucagcauauc

SEQ ID NO: 192648 - RNA, 19 nt, Homo sapiens
cccaaggagucccuaacuu

SEQ ID NO: 192649 - RNA, 19 nt, Homo sapiens
aaaccacaauauccagcaa

SEQ ID NO: 192650 - RNA, 19 nt, Homo sapiens
gcaccugauacuucuguug

SEQ ID NO: 192651 - RNA, 19 nt, Homo sapiens
ggcagcugcacgcucauua

SEQ ID NO: 192652 - RNA, 19 nt, Homo sapiens
gguaugggccagcaguuuc

SEQ ID NO: 192653 - RNA, 19 nt, Homo sapiens
guacagccgccaggagcua

SEQ ID NO: 192654 - RNA, 19 nt, Homo sapiens
gagcacccagaacuccaua

SEQ ID NO: 192655 - RNA, 19 nt, Homo sapiens
cucaggagcugcuaaacuc

SEQ ID NO: 192656 - RNA, 19 nt, Homo sapiens
gauaguuucccauaacaac

SEQ ID NO: 192657 - RNA, 19 nt, Homo sapiens
cagacucucacaugcagua

SEQ ID NO: 192658 - RNA, 19 nt, Homo sapiens
agagagagacuugcuagga

SEQ ID NO: 192659 - RNA, 19 nt, Homo sapiens
uggaaccgauccucagcaa

SEQ ID NO: 192660 - RNA, 19 nt, Homo sapiens
agacuagccugggaaacau

SEQ ID NO: 192661 - RNA, 19 nt, Homo sapiens
ggucaagaugggaggauug

SEQ ID NO: 192662 - RNA, 19 nt, Homo sapiens
aggagcugcuaaacucuuu

SEQ ID NO: 192663 - RNA, 19 nt, Homo sapiens
ggcacggcccugcagauuu

SEQ ID NO: 192664 - RNA, 19 nt, Homo sapiens
ugccagcucuucucaagca

SEQ ID NO: 192665 - RNA, 19 nt, Homo sapiens
agagguguguaaaggagaa

SEQ ID NO: 192666 - RNA, 19 nt, Homo sapiens
caucaagaaccacgccuuu

SEQ ID NO: 192667 - RNA, 19 nt, Homo sapiens
uuucccagcuucucuguga

SEQ ID NO: 192668 - RNA, 19 nt, Homo sapiens
cguccagccugcagcauga

SEQ ID NO: 192669 - RNA, 19 nt, Homo sapiens
gaugaaguccaaguacuca

SEQ ID NO: 192670 - RNA, 19 nt, Homo sapiens
gggagcugaugaaguccaa

SEQ ID NO: 192671 - RNA, 19 nt, Homo sapiens
ucccugaggugaaguaaac

SEQ ID NO: 192672 - RNA, 19 nt, Homo sapiens
acucagacaucaccaucau

SEQ ID NO: 192673 - RNA, 19 nt, Homo sapiens
gcacacacaccaguucaac

SEQ ID NO: 192674 - RNA, 19 nt, Homo sapiens
uuucccggcuucucuguga

SEQ ID NO: 192675 - RNA, 19 nt, Homo sapiens
ugaaguccaaguacucaga

SEQ ID NO: 192676 - RNA, 19 nt, Homo sapiens
ggaggagaccuggcacaca

SEQ ID NO: 192677 - RNA, 19 nt, Homo sapiens
gagcugaugaaguccaagu

SEQ ID NO: 192678 - RNA, 19 nt, Homo sapiens
uugaugggauccuguacga

SEQ ID NO: 192679 - RNA, 19 nt, Homo sapiens
gcccauugaugagcauugg

SEQ ID NO: 192680 - RNA, 19 nt, Homo sapiens
ucaagaaccacgccuuucg

SEQ ID NO: 192681 - RNA, 19 nt, Homo sapiens
ggacugugcugguucauuu

SEQ ID NO: 192682 - RNA, 19 nt, Homo sapiens
gaccucaucuuuccuaaaa

SEQ ID NO: 192683 - RNA, 19 nt, Homo sapiens
caucaagaaccacgccuuu

SEQ ID NO: 192684 - RNA, 19 nt, Homo sapiens
gggcuggacugugcugguu

SEQ ID NO: 192685 - RNA, 19 nt, Homo sapiens
cguccagccugcagcauga

SEQ ID NO: 192686 - RNA, 19 nt, Homo sapiens
ccaugggucuccaggaagu

SEQ ID NO: 192687 - RNA, 19 nt, Homo sapiens
caguggcucaggucuauaa

SEQ ID NO: 192688 - RNA, 19 nt, Homo sapiens
gcuggacugugcugguuca

SEQ ID NO: 192689 - RNA, 19 nt, Homo sapiens
gaugaaguccaaguacuca

SEQ ID NO: 192690 - RNA, 19 nt, Homo sapiens
gggagcugaugaaguccaa

SEQ ID NO: 192691 - RNA, 19 nt, Homo sapiens
acucagacaucaccaucau

SEQ ID NO: 192692 - RNA, 19 nt, Homo sapiens
ugugcugguucauuuagaa

SEQ ID NO: 192693 - RNA, 19 nt, Homo sapiens
gcacacacaccaguucaac

SEQ ID NO: 192694 - RNA, 19 nt, Homo sapiens
ugaaguccaaguacucaga

SEQ ID NO: 192695 - RNA, 19 nt, Homo sapiens
ggaggagaccuggcacaca

SEQ ID NO: 192696 - RNA, 19 nt, Homo sapiens
gacugugcugguucauuua

SEQ ID NO: 192697 - RNA, 19 nt, Homo sapiens
gagcugaugaaguccaagu

SEQ ID NO: 192698 - RNA, 19 nt, Homo sapiens
uugaugggauccuguacga

SEQ ID NO: 192699 - RNA, 19 nt, Homo sapiens
gagccuaggaguucaagac

SEQ ID NO: 192700 - RNA, 19 nt, Homo sapiens
cuacagagcaagaccucau

SEQ ID NO: 192701 - RNA, 19 nt, Homo sapiens
uggcucaggucuauaaucc

SEQ ID NO: 192702 - RNA, 19 nt, Homo sapiens
agcaguggcucaggucuau

SEQ ID NO: 192703 - RNA, 19 nt, Homo sapiens
gcccauugaugagcauugg

SEQ ID NO: 192704 - RNA, 19 nt, Homo sapiens
ucaagaaccacgccuuucg

SEQ ID NO: 192705 - RNA, 19 nt, Homo sapiens
gaacaugccugaacucuaa

SEQ ID NO: 192706 - RNA, 19 nt, Homo sapiens
ggaaagaucccaagucaaa

SEQ ID NO: 192707 - RNA, 19 nt, Homo sapiens
cauagaagcuguagaugaa

SEQ ID NO: 192708 - RNA, 19 nt, Homo sapiens
gaacauagaagcuguagau

SEQ ID NO: 192709 - RNA, 19 nt, Homo sapiens
ugaacaagaugguaucaaa

SEQ ID NO: 192710 - RNA, 19 nt, Homo sapiens
ggaaauucuugcacuguau

SEQ ID NO: 192711 - RNA, 19 nt, Homo sapiens
gggaaauucuugcacugua

SEQ ID NO: 192712 - RNA, 19 nt, Homo sapiens
caguguggcuuaaacauuu

SEQ ID NO: 192713 - RNA, 19 nt, Homo sapiens
caggaaagaucccaaguca

SEQ ID NO: 192714 - RNA, 19 nt, Homo sapiens
ggaauaagaaagagagaga

SEQ ID NO: 192715 - RNA, 19 nt, Homo sapiens
gaagauaaagcucauaagg

SEQ ID NO: 192716 - RNA, 19 nt, Homo sapiens
ggacgaggguaaagaagag

SEQ ID NO: 192717 - RNA, 19 nt, Homo sapiens
gaaaccaaaccuaaggaaa

SEQ ID NO: 192718 - RNA, 19 nt, Homo sapiens
uagcuuccguggacacaua

SEQ ID NO: 192719 - RNA, 19 nt, Homo sapiens
ccacuaaagcuuccacuga

SEQ ID NO: 192720 - RNA, 19 nt, Homo sapiens
caaccaugcugugcuguau

SEQ ID NO: 192721 - RNA, 19 nt, Homo sapiens
ggagaaggcaccacuacug

SEQ ID NO: 192722 - RNA, 19 nt, Homo sapiens
ggaguccacuuuccucucu

SEQ ID NO: 192723 - RNA, 19 nt, Homo sapiens
gcaggacgaggguaaagaa

SEQ ID NO: 192724 - RNA, 19 nt, Homo sapiens
cagaagauaaagcucauaa

SEQ ID NO: 192725 - RNA, 19 nt, Homo sapiens
ccaagaacaugccugaacu

SEQ ID NO: 192726 - RNA, 19 nt, Homo sapiens
uagaugaaaccaaaccuaa

SEQ ID NO: 192727 - RNA, 19 nt, Homo sapiens
acuaaagcuuccacugaua

SEQ ID NO: 192728 - RNA, 19 nt, Homo sapiens
caaacaguguggcuuaaac

SEQ ID NO: 192729 - RNA, 19 nt, Homo sapiens
uaagaaagagagagaagga

SEQ ID NO: 192730 - RNA, 19 nt, Homo sapiens
ccaagugugugugcaaugu

SEQ ID NO: 192731 - RNA, 19 nt, Homo sapiens
cuaaagcuuccacugauaa

SEQ ID NO: 192732 - RNA, 19 nt, Homo sapiens
gaaagagagagaaggaaag

SEQ ID NO: 192733 - RNA, 19 nt, Homo sapiens
ugccugaacucuaagaaau

SEQ ID NO: 192734 - RNA, 19 nt, Homo sapiens
ggagagaaggcaggaagaa

SEQ ID NO: 192735 - RNA, 19 nt, Homo sapiens
gcacuguauccaaguuauu

SEQ ID NO: 192736 - RNA, 19 nt, Homo sapiens
guagaugaaaccaaaccua

SEQ ID NO: 192737 - RNA, 19 nt, Homo sapiens
cacuaaagcuuccacugau

SEQ ID NO: 192738 - RNA, 19 nt, Homo sapiens
caaaauaucgagugaauuc

SEQ ID NO: 192739 - RNA, 19 nt, Homo sapiens
ucauaaggccgcaaccaaa

SEQ ID NO: 192740 - RNA, 19 nt, Homo sapiens
agaaagagagagaaggaaa

SEQ ID NO: 192741 - RNA, 19 nt, Homo sapiens
gaacaagaugguaucaaac

SEQ ID NO: 192742 - RNA, 19 nt, Homo sapiens
aaaccaaaccuaaggaaag

SEQ ID NO: 192743 - RNA, 19 nt, Homo sapiens
acauagaagcuguagauga

SEQ ID NO: 192744 - RNA, 19 nt, Homo sapiens
ggcugaagcuaauaagaag

SEQ ID NO: 192745 - RNA, 19 nt, Homo sapiens
gcaauguuccguucaucug

SEQ ID NO: 192746 - RNA, 19 nt, Homo sapiens
agucaaacaguguggcuua

SEQ ID NO: 192747 - RNA, 19 nt, Homo sapiens
gaugaaaccaaaccuaagg

SEQ ID NO: 192748 - RNA, 19 nt, Homo sapiens
gaauaagaaagagagagaa

SEQ ID NO: 192749 - RNA, 19 nt, Homo sapiens
gucaaacaguguggcuuaa

SEQ ID NO: 192750 - RNA, 19 nt, Homo sapiens
guggacacauaacaaggaa

SEQ ID NO: 192751 - RNA, 19 nt, Homo sapiens
gaaauucuugcacuguauc

SEQ ID NO: 192752 - RNA, 19 nt, Homo sapiens
gcaggaaagaucccaaguc

SEQ ID NO: 192753 - RNA, 19 nt, Homo sapiens
aaggagagaagaaggauga

SEQ ID NO: 192754 - RNA, 19 nt, Homo sapiens
guauccaaguuauuugauc

SEQ ID NO: 192755 - RNA, 19 nt, Homo sapiens
ggacacauaacaaggaaaa

SEQ ID NO: 192756 - RNA, 19 nt, Homo sapiens
ccacuagcccucuuucucu

SEQ ID NO: 192757 - RNA, 19 nt, Homo sapiens
ucaaaggagagaagaagga

SEQ ID NO: 192758 - RNA, 19 nt, Homo sapiens
cggcaaagcaggagaaacu

SEQ ID NO: 192759 - RNA, 19 nt, Homo sapiens
aagcuaauaagaaggauga

SEQ ID NO: 192760 - RNA, 19 nt, Homo sapiens
cugcugaggcugaagcuaa

SEQ ID NO: 192761 - RNA, 19 nt, Homo sapiens
guguuguuauggcaaguuu

SEQ ID NO: 192762 - RNA, 19 nt, Homo sapiens
gagaaggaaaggagagaag

SEQ ID NO: 192763 - RNA, 19 nt, Homo sapiens
gaaggcaagggacgagaca

SEQ ID NO: 192764 - RNA, 19 nt, Homo sapiens
aaccaaaccuaaggaaagu

SEQ ID NO: 192765 - RNA, 19 nt, Homo sapiens
ccaaaagauugaacaagau

SEQ ID NO: 192766 - RNA, 19 nt, Homo sapiens
caauguuccguucaucuga

SEQ ID NO: 192767 - RNA, 19 nt, Homo sapiens
accaugcugugcuguauga

SEQ ID NO: 192768 - RNA, 19 nt, Homo sapiens
aggcugaagcuaauaagaa

SEQ ID NO: 192769 - RNA, 19 nt, Homo sapiens
gagagaaggaaaggagaga

SEQ ID NO: 192770 - RNA, 19 nt, Homo sapiens
ucaaacaguguggcuuaaa

SEQ ID NO: 192771 - RNA, 19 nt, Homo sapiens
aaagaucccaagucaaaca

SEQ ID NO: 192772 - RNA, 19 nt, Homo sapiens
gcaacagcccagccuccaa

SEQ ID NO: 192773 - RNA, 19 nt, Homo sapiens
ccaagcugcugaggcugaa

SEQ ID NO: 192774 - RNA, 19 nt, Homo sapiens
gcucaaaggagagaagaag

SEQ ID NO: 192775 - RNA, 19 nt, Homo sapiens
ugaaaccaaaccuaaggaa

SEQ ID NO: 192776 - RNA, 19 nt, Homo sapiens
uagaagcuguagaugaaac

SEQ ID NO: 192777 - RNA, 19 nt, Homo sapiens
augcugugcuguaugagaa

SEQ ID NO: 192778 - RNA, 19 nt, Homo sapiens
gaggcugaagcuaauaaga

SEQ ID NO: 192779 - RNA, 19 nt, Homo sapiens
acaguguggcuuaaacauu

SEQ ID NO: 192780 - RNA, 19 nt, Homo sapiens
ccugaacucuaagaaaugg

SEQ ID NO: 192781 - RNA, 19 nt, Homo sapiens
caaaggagagaagaaggau

SEQ ID NO: 192782 - RNA, 19 nt, Homo sapiens
cacuguauccaaguuauuu

SEQ ID NO: 192783 - RNA, 19 nt, Homo sapiens
aaacaguguggcuuaaaca

SEQ ID NO: 192784 - RNA, 19 nt, Homo sapiens
gcaagggacgagacaacca

SEQ ID NO: 192785 - RNA, 19 nt, Homo sapiens
gagagaaggcaggaagaag

SEQ ID NO: 192786 - RNA, 19 nt, Homo sapiens
agcuguagaugaaaccaaa

SEQ ID NO: 192787 - RNA, 19 nt, Homo sapiens
caaaccagaagauaaagcu

SEQ ID NO: 192788 - RNA, 19 nt, Homo sapiens
agaacaugccugaacucua

SEQ ID NO: 192789 - RNA, 19 nt, Homo sapiens
gcugugcuguaugagaaga

SEQ ID NO: 192790 - RNA, 19 nt, Homo sapiens
accaaaagauugaacaaga

SEQ ID NO: 192791 - RNA, 19 nt, Homo sapiens
gaaagaucccaagucaaac

SEQ ID NO: 192792 - RNA, 19 nt, Homo sapiens
accugaggcugaccaagaa

SEQ ID NO: 192793 - RNA, 19 nt, Homo sapiens
aaccugaggcugaccaaga

SEQ ID NO: 192794 - RNA, 19 nt, Homo sapiens
aagcugaagagaacauaga

SEQ ID NO: 192795 - RNA, 19 nt, Homo sapiens
ccaagcugaagagaacaua

SEQ ID NO: 192796 - RNA, 19 nt, Homo sapiens
ucuguguggcaaacauuua

SEQ ID NO: 192797 - RNA, 19 nt, Homo sapiens
caacggauuuggucguauu

SEQ ID NO: 192798 - RNA, 19 nt, Homo sapiens
gaauuuggcuacagcaaca

SEQ ID NO: 192799 - RNA, 19 nt, Homo sapiens
gaaaucccaucaccaucuu

SEQ ID NO: 192800 - RNA, 19 nt, Homo sapiens
gaccucaacuacaugguuu

SEQ ID NO: 192801 - RNA, 19 nt, Homo sapiens
ucaagaagguggugaagca

SEQ ID NO: 192802 - RNA, 19 nt, Homo sapiens
gaccugaccugccgucuag

SEQ ID NO: 192803 - RNA, 19 nt, Homo sapiens
gacaacagccucaagauca

SEQ ID NO: 192804 - RNA, 19 nt, Homo sapiens
gggaaacuguggcgugaug

SEQ ID NO: 192805 - RNA, 19 nt, Homo sapiens
caacuuugguaucguggaa

SEQ ID NO: 192806 - RNA, 19 nt, Homo sapiens
ggaguccacuggcgucuuc

SEQ ID NO: 192807 - RNA, 19 nt, Homo sapiens
ggaaaucccaucaccaucu

SEQ ID NO: 192808 - RNA, 19 nt, Homo sapiens
uaaaguacccugugcucaa

SEQ ID NO: 192809 - RNA, 19 nt, Homo sapiens
ugucauguaccaucaauaa

SEQ ID NO: 192810 - RNA, 19 nt, Homo sapiens
ugguuuacauguuccaaua

SEQ ID NO: 192811 - RNA, 19 nt, Homo sapiens
ucaacuacaugguuuacau

SEQ ID NO: 192812 - RNA, 19 nt, Homo sapiens
ggaagcuugucaucaaugg

SEQ ID NO: 192813 - RNA, 19 nt, Homo sapiens
ggucggagucaacggauuu

SEQ ID NO: 192814 - RNA, 19 nt, Homo sapiens
cauguaccaucaauaaagu

SEQ ID NO: 192815 - RNA, 19 nt, Homo sapiens
gaacgggaagcuugucauc

SEQ ID NO: 192816 - RNA, 19 nt, Homo sapiens
ucaagcucauuuccuggua

SEQ ID NO: 192817 - RNA, 19 nt, Homo sapiens
ggaccugaccugccgucua

SEQ ID NO: 192818 - RNA, 19 nt, Homo sapiens
acgggaagcuugucaucaa

SEQ ID NO: 192819 - RNA, 19 nt, Homo sapiens
guuuacauguuccaauaug

SEQ ID NO: 192820 - RNA, 19 nt, Homo sapiens
gaagagagagacccucacu

SEQ ID NO: 192821 - RNA, 19 nt, Homo sapiens
caagagcacaagaggaaga

SEQ ID NO: 192822 - RNA, 19 nt, Homo sapiens
caagcucauuuccugguau

SEQ ID NO: 192823 - RNA, 19 nt, Homo sapiens
gugugaaccaugagaagua

SEQ ID NO: 192824 - RNA, 19 nt, Homo sapiens
gguaaaguggauauuguug

SEQ ID NO: 192825 - RNA, 19 nt, Homo sapiens
gucaacggauuuggucgua

SEQ ID NO: 192826 - RNA, 19 nt, Homo sapiens
caucaucccugccucuacu

SEQ ID NO: 192827 - RNA, 19 nt, Homo sapiens
caacgaccacuuugucaag

SEQ ID NO: 192828 - RNA, 19 nt, Homo sapiens
ggucaucccugagcugaac

SEQ ID NO: 192829 - RNA, 19 nt, Homo sapiens
caugacaacuuugguaucg

SEQ ID NO: 192830 - RNA, 19 nt, Homo sapiens
cugguaaaguggauauugu

SEQ ID NO: 192831 - RNA, 19 nt, Homo sapiens
ugacaacagccucaagauc

SEQ ID NO: 192832 - RNA, 19 nt, Homo sapiens
ugaaccaugagaaguauga

SEQ ID NO: 192833 - RNA, 19 nt, Homo sapiens
uaacucugguaaaguggau

SEQ ID NO: 192834 - RNA, 19 nt, Homo sapiens
caugagaaguaugacaaca

SEQ ID NO: 192835 - RNA, 19 nt, Homo sapiens
ucauguaccaucaauaaag

SEQ ID NO: 192836 - RNA, 19 nt, Homo sapiens
acaacagccucaagaucau

SEQ ID NO: 192837 - RNA, 19 nt, Homo sapiens
gguaugacaacgaauuugg

SEQ ID NO: 192838 - RNA, 19 nt, Homo sapiens
gccucaagaucaucagcaa

SEQ ID NO: 192839 - RNA, 19 nt, Homo sapiens
gcgaugcuggcgcugagua

SEQ ID NO: 192840 - RNA, 19 nt, Homo sapiens
cacaagaggaagagagaga

SEQ ID NO: 192841 - RNA, 19 nt, Homo sapiens
agcaagagcacaagaggaa

SEQ ID NO: 192842 - RNA, 19 nt, Homo sapiens
uaugacaacagccucaaga

SEQ ID NO: 192843 - RNA, 19 nt, Homo sapiens
ugugaaccaugagaaguau

SEQ ID NO: 192844 - RNA, 19 nt, Homo sapiens
gagaacgggaagcuuguca

SEQ ID NO: 192845 - RNA, 19 nt, Homo sapiens
gggaagcuugucaucaaug

SEQ ID NO: 192846 - RNA, 19 nt, Homo sapiens
cgggaagcuugucaucaau

SEQ ID NO: 192847 - RNA, 19 nt, Homo sapiens
aaaguacccugugcucaac

SEQ ID NO: 192848 - RNA, 19 nt, Homo sapiens
gacaacgaauuuggcuaca

SEQ ID NO: 192849 - RNA, 19 nt, Homo sapiens
ugaccucaacuacaugguu

SEQ ID NO: 192850 - RNA, 19 nt, Homo sapiens
ccaaggcugugggcaaggu

SEQ ID NO: 192851 - RNA, 19 nt, Homo sapiens
aagcuugucaucaauggaa

SEQ ID NO: 192852 - RNA, 19 nt, Homo sapiens
ucaacgaccacuuugucaa

SEQ ID NO: 192853 - RNA, 19 nt, Homo sapiens
cugcaccaccaacugcuua

SEQ ID NO: 192854 - RNA, 19 nt, Homo sapiens
ccaaaagggucaucaucuc

SEQ ID NO: 192855 - RNA, 19 nt, Homo sapiens
ccugguaugacaacgaauu

SEQ ID NO: 192856 - RNA, 19 nt, Homo sapiens
cucaagaucaucagcaaug

SEQ ID NO: 192857 - RNA, 19 nt, Homo sapiens
aagcucauuuccugguaug

SEQ ID NO: 192858 - RNA, 19 nt, Homo sapiens
uaucguggaaggacucaug

SEQ ID NO: 192859 - RNA, 19 nt, Homo sapiens
gaacucuggucuccaaauu

SEQ ID NO: 192860 - RNA, 19 nt, Homo sapiens
uaaccuaccugaauguauu

SEQ ID NO: 192861 - RNA, 19 nt, Homo sapiens
guggagagcuuauacagaa

SEQ ID NO: 192862 - RNA, 19 nt, Homo sapiens
agaacaaacugcuccauuu

SEQ ID NO: 192863 - RNA, 19 nt, Homo sapiens
gauuugagcuacaaugaga

SEQ ID NO: 192864 - RNA, 19 nt, Homo sapiens
ggagacagaugaacuggau

SEQ ID NO: 192865 - RNA, 19 nt, Homo sapiens
ggaccaacucuuuguauaa

SEQ ID NO: 192866 - RNA, 19 nt, Homo sapiens
ugacugagcuggaccuuuc

SEQ ID NO: 192867 - RNA, 19 nt, Homo sapiens
gggaccaacucuuuguaua

SEQ ID NO: 192868 - RNA, 19 nt, Homo sapiens
ggaagagaaugaaacuugu

SEQ ID NO: 192869 - RNA, 19 nt, Homo sapiens
guaagaugguggacaagaa

SEQ ID NO: 192870 - RNA, 19 nt, Homo sapiens
gaacaucaaccucaucauc

SEQ ID NO: 192871 - RNA, 19 nt, Homo sapiens
ggaaccagcugcggaguau

SEQ ID NO: 192872 - RNA, 19 nt, Homo sapiens
ccagcuaacuaaugccaua

SEQ ID NO: 192873 - RNA, 19 nt, Homo sapiens
gaacaaacugcuccauuuc

SEQ ID NO: 192874 - RNA, 19 nt, Homo sapiens
gaugugggcucaguaaugu

SEQ ID NO: 192875 - RNA, 19 nt, Homo sapiens
gcucuugcauucucucauu

SEQ ID NO: 192876 - RNA, 19 nt, Homo sapiens
ggaauucccucaccugcau

SEQ ID NO: 192877 - RNA, 19 nt, Homo sapiens
gagcagagccuggaguuug

SEQ ID NO: 192878 - RNA, 19 nt, Homo sapiens
gcacccagcuuggcagaug

SEQ ID NO: 192879 - RNA, 19 nt, Homo sapiens
gaccugaucugccgcuuca

SEQ ID NO: 192880 - RNA, 19 nt, Homo sapiens
gaucgugacccugcuauuu

SEQ ID NO: 192881 - RNA, 19 nt, Homo sapiens
caaagugcccuguaagaug

SEQ ID NO: 192882 - RNA, 19 nt, Homo sapiens
aaacugaggcuuaggaaga

SEQ ID NO: 192883 - RNA, 19 nt, Homo sapiens
gcacguaacacuccuccuu

SEQ ID NO: 192884 - RNA, 19 nt, Homo sapiens
ggacagccgagaauaaugu

SEQ ID NO: 192885 - RNA, 19 nt, Homo sapiens
gagaacaaacugcuccauu

SEQ ID NO: 192886 - RNA, 19 nt, Homo sapiens
uggcagauguggauuugaa

SEQ ID NO: 192887 - RNA, 19 nt, Homo sapiens
gaaguuuaaccaacaguau

SEQ ID NO: 192888 - RNA, 19 nt, Homo sapiens
gauguccucucucagcuau

SEQ ID NO: 192889 - RNA, 19 nt, Homo sapiens
gccaggagcuaaaaccuua

SEQ ID NO: 192890 - RNA, 19 nt, Homo sapiens
agagagaauuggagcugua

SEQ ID NO: 192891 - RNA, 19 nt, Homo sapiens
gaccugagcaccaaugaga

SEQ ID NO: 192892 - RNA, 19 nt, Homo sapiens
gcuccaaacuuccuuucug

SEQ ID NO: 192893 - RNA, 19 nt, Homo sapiens
ccaacaguauaaagccuaa

SEQ ID NO: 192894 - RNA, 19 nt, Homo sapiens
aagacaaagugcccuguaa

SEQ ID NO: 192895 - RNA, 19 nt, Homo sapiens
ccugguggauaaugagaua

SEQ ID NO: 192896 - RNA, 19 nt, Homo sapiens
gcaacgugcugauggacau

SEQ ID NO: 192897 - RNA, 19 nt, Homo sapiens
gaaggucucgugccagguu

SEQ ID NO: 192898 - RNA, 19 nt, Homo sapiens
uguauaaccuaccugaaug

SEQ ID NO: 192899 - RNA, 19 nt, Homo sapiens
ggcagaaguuuaaccaaca

SEQ ID NO: 192900 - RNA, 19 nt, Homo sapiens
gacaaagugcccuguaaga

SEQ ID NO: 192901 - RNA, 19 nt, Homo sapiens
aaucuucacugagcaugua

SEQ ID NO: 192902 - RNA, 19 nt, Homo sapiens
agauaaugcuggcuccaaa

SEQ ID NO: 192903 - RNA, 19 nt, Homo sapiens
ccaagcagacuguuuguca

SEQ ID NO: 192904 - RNA, 19 nt, Homo sapiens
ggaaugcugggaaaugaga

SEQ ID NO: 192905 - RNA, 19 nt, Homo sapiens
uaccugaacuuguccaaca

SEQ ID NO: 192906 - RNA, 19 nt, Homo sapiens
gaccaacucuuuguauaac

SEQ ID NO: 192907 - RNA, 19 nt, Homo sapiens
gggaccaacucaagaccuu

SEQ ID NO: 192908 - RNA, 19 nt, Homo sapiens
gaccugcccugcuucaucu

SEQ ID NO: 192909 - RNA, 19 nt, Homo sapiens
gccugagccugguggauaa

SEQ ID NO: 192910 - RNA, 19 nt, Homo sapiens
ucucucagcuaucacauca

SEQ ID NO: 192911 - RNA, 19 nt, Homo sapiens
gccguuaaguggacaggaa

SEQ ID NO: 192912 - RNA, 19 nt, Homo sapiens
ccuguaagaugguggacaa

SEQ ID NO: 192913 - RNA, 19 nt, Homo sapiens
guaaugugcgagaaaguga

SEQ ID NO: 192914 - RNA, 19 nt, Homo sapiens
gaagagaaugaaacuugug

SEQ ID NO: 192915 - RNA, 19 nt, Homo sapiens
ggccaagccaggaggauuu

SEQ ID NO: 192916 - RNA, 19 nt, Homo sapiens
ccugucagaucaacaaauc

SEQ ID NO: 192917 - RNA, 19 nt, Homo sapiens
ugaagaacaucaaccucau

SEQ ID NO: 192918 - RNA, 19 nt, Homo sapiens
caagacaaagugcccugua

SEQ ID NO: 192919 - RNA, 19 nt, Homo sapiens
ggaaacugaggcuuaggaa

SEQ ID NO: 192920 - RNA, 19 nt, Homo sapiens
gccagaaguugggcgguuu

SEQ ID NO: 192921 - RNA, 19 nt, Homo sapiens
ucucugugcucuugcauuc

SEQ ID NO: 192922 - RNA, 19 nt, Homo sapiens
gguguggguucuccuguuc

SEQ ID NO: 192923 - RNA, 19 nt, Homo sapiens
gcacucucauguugcauac

SEQ ID NO: 192924 - RNA, 19 nt, Homo sapiens
gccaggaggauuugucuga

SEQ ID NO: 192925 - RNA, 19 nt, Homo sapiens
ugggaaugcugggaaauga

SEQ ID NO: 192926 - RNA, 19 nt, Homo sapiens
gccuggaguuugagacuau

SEQ ID NO: 192927 - RNA, 19 nt, Homo sapiens
caggaggauuugucugaga

SEQ ID NO: 192928 - RNA, 19 nt, Homo sapiens
gcagaaguuuaaccaacag

SEQ ID NO: 192929 - RNA, 19 nt, Homo sapiens
cacguaacacuccuccuua

SEQ ID NO: 192930 - RNA, 19 nt, Homo sapiens
gaaacuuguggagagcuua

SEQ ID NO: 192931 - RNA, 19 nt, Homo sapiens
aggaagagaaugaaacuug

SEQ ID NO: 192932 - RNA, 19 nt, Homo sapiens
gcacagauggggaaacuga

SEQ ID NO: 192933 - RNA, 19 nt, Homo sapiens
gcacaacaccaagacaaag

SEQ ID NO: 192934 - RNA, 19 nt, Homo sapiens
agagaagagugaggacuga

SEQ ID NO: 192935 - RNA, 19 nt, Homo sapiens
gaagaacaucaaccucauc

SEQ ID NO: 192936 - RNA, 19 nt, Homo sapiens
ggaccugcccugcuucauc

SEQ ID NO: 192937 - RNA, 19 nt, Homo sapiens
gcucaguaaugugcgagaa

SEQ ID NO: 192938 - RNA, 19 nt, Homo sapiens
ucugagacauuuccaagca

SEQ ID NO: 192939 - RNA, 19 nt, Homo sapiens
cagggacagccgagaauaa

SEQ ID NO: 192940 - RNA, 19 nt, Homo sapiens
caucauccucaccuucaua

SEQ ID NO: 192941 - RNA, 19 nt, Homo sapiens
ccauacaccuuugccaauc

SEQ ID NO: 192942 - RNA, 19 nt, Homo sapiens
gaaacugcuugcggaccuu

SEQ ID NO: 192943 - RNA, 19 nt, Homo sapiens
gcaccaaugagaucagcuu

SEQ ID NO: 192944 - RNA, 19 nt, Homo sapiens
aaugcuggcuccaaacuuc

SEQ ID NO: 192945 - RNA, 19 nt, Homo sapiens
caguauaaagccuaaagaa

SEQ ID NO: 192946 - RNA, 19 nt, Homo sapiens
gguauagugggaacauuug

SEQ ID NO: 192947 - RNA, 19 nt, Homo sapiens
uuacagaggagaacaccaa

SEQ ID NO: 192948 - RNA, 19 nt, Homo sapiens
ucucagcuaucacaucaca

SEQ ID NO: 192949 - RNA, 19 nt, Homo sapiens
gauucaaaccuucauccuu

SEQ ID NO: 192950 - RNA, 19 nt, Homo sapiens
ggcucaaucuugccgagaa

SEQ ID NO: 192951 - RNA, 19 nt, Homo sapiens
ccugaugcuccuugacuua

SEQ ID NO: 192952 - RNA, 19 nt, Homo sapiens
caacagcaucgaggccuuu

SEQ ID NO: 192953 - RNA, 19 nt, Homo sapiens
gggaaccagcugcggagua

SEQ ID NO: 192954 - RNA, 19 nt, Homo sapiens
caugaugugggcucaguaa

SEQ ID NO: 192955 - RNA, 19 nt, Homo sapiens
gcugggaaaugagauacau

SEQ ID NO: 192956 - RNA, 19 nt, Homo sapiens
ucacugagcauguauuuug

SEQ ID NO: 192957 - RNA, 19 nt, Homo sapiens
gagguacagagaagaguga

SEQ ID NO: 192958 - RNA, 19 nt, Homo sapiens
gcuaacuaaugccauaggu

SEQ ID NO: 192959 - RNA, 19 nt, Homo sapiens
gaacagggugugauuaaua

SEQ ID NO: 192960 - RNA, 19 nt, Homo sapiens
gcccaaagaugauauugua

SEQ ID NO: 192961 - RNA, 19 nt, Homo sapiens
caaaggagcuggcguuaca

SEQ ID NO: 192962 - RNA, 19 nt, Homo sapiens
caaauuugcugacuucaug

SEQ ID NO: 192963 - RNA, 19 nt, Homo sapiens
uggcagaccuucaccuuua

SEQ ID NO: 192964 - RNA, 19 nt, Homo sapiens
uggaguaucucacaaagua

SEQ ID NO: 192965 - RNA, 19 nt, Homo sapiens
ugagaaaccucugaaagaa

SEQ ID NO: 192966 - RNA, 19 nt, Homo sapiens
gaaaacagcauugugauua

SEQ ID NO: 192967 - RNA, 19 nt, Homo sapiens
guauuaggcuauuucauug

SEQ ID NO: 192968 - RNA, 19 nt, Homo sapiens
agaaggagaugaacagaga

SEQ ID NO: 192969 - RNA, 19 nt, Homo sapiens
ccaaguagacguagacaaa

SEQ ID NO: 192970 - RNA, 19 nt, Homo sapiens
gaaguuguuccgaauguaa

SEQ ID NO: 192971 - RNA, 19 nt, Homo sapiens
aaacaugccuggguacuug

SEQ ID NO: 192972 - RNA, 19 nt, Homo sapiens
aaagaccucuggccaugua

SEQ ID NO: 192973 - RNA, 19 nt, Homo sapiens
ggccagguauccucuguuu

SEQ ID NO: 192974 - RNA, 19 nt, Homo sapiens
ugugaugagugcuacauua

SEQ ID NO: 192975 - RNA, 19 nt, Homo sapiens
uggaguaucuugccauuug

SEQ ID NO: 192976 - RNA, 19 nt, Homo sapiens
gugcugaucguuccuguua

SEQ ID NO: 192977 - RNA, 19 nt, Homo sapiens
gaucagagucagagaauuc

SEQ ID NO: 192978 - RNA, 19 nt, Homo sapiens
gaaaagaaaucagaaaugg

SEQ ID NO: 192979 - RNA, 19 nt, Homo sapiens
agacaaauuugcugacuuc

SEQ ID NO: 192980 - RNA, 19 nt, Homo sapiens
ccaguuggcugugcuuuga

SEQ ID NO: 192981 - RNA, 19 nt, Homo sapiens
ccagguauccucuguuuga

SEQ ID NO: 192982 - RNA, 19 nt, Homo sapiens
aaucagaaauggaaagugu

SEQ ID NO: 192983 - RNA, 19 nt, Homo sapiens
ggcagcacauggagaauga

SEQ ID NO: 192984 - RNA, 19 nt, Homo sapiens
uggagaugcugcugaauga

SEQ ID NO: 192985 - RNA, 19 nt, Homo sapiens
gaaauugagcacuuuguag

SEQ ID NO: 192986 - RNA, 19 nt, Homo sapiens
cgaggaaugaggacaauuu

SEQ ID NO: 192987 - RNA, 19 nt, Homo sapiens
gagaugaacagagaacauu

SEQ ID NO: 192988 - RNA, 19 nt, Homo sapiens
gugaagagauuccagaaaa

SEQ ID NO: 192989 - RNA, 19 nt, Homo sapiens
gcugaucguuccuguuaug

SEQ ID NO: 192990 - RNA, 19 nt, Homo sapiens
aacagggugugauuaauaa

SEQ ID NO: 192991 - RNA, 19 nt, Homo sapiens
gcacauggagaaugagaug

SEQ ID NO: 192992 - RNA, 19 nt, Homo sapiens
uggcccagcuugauaacua

SEQ ID NO: 192993 - RNA, 19 nt, Homo sapiens
ggacaauuuugacaacuuu

SEQ ID NO: 192994 - RNA, 19 nt, Homo sapiens
gaccaggcauggaguaucu

SEQ ID NO: 192995 - RNA, 19 nt, Homo sapiens
cagcauaguccaagaccua

SEQ ID NO: 192996 - RNA, 19 nt, Homo sapiens
aaauggagaugcugcugaa

SEQ ID NO: 192997 - RNA, 19 nt, Homo sapiens
ucacgaagguuggaauauc

SEQ ID NO: 192998 - RNA, 19 nt, Homo sapiens
ccaaagaugauauuguaga

SEQ ID NO: 192999 - RNA, 19 nt, Homo sapiens
gagggaccgugacucaaug

SEQ ID NO: 193000 - RNA, 19 nt, Homo sapiens
cauauaagaaggaugcaaa

SEQ ID NO: 193001 - RNA, 19 nt, Homo sapiens
caauugguaaggcauauaa

SEQ ID NO: 193002 - RNA, 19 nt, Homo sapiens
gugcugaccaucuauuaaa

SEQ ID NO: 193003 - RNA, 19 nt, Homo sapiens
agggagaucuugugcgaaa

SEQ ID NO: 193004 - RNA, 19 nt, Homo sapiens
gcagauaagagcagagauc

SEQ ID NO: 193005 - RNA, 19 nt, Homo sapiens
ugccaggacugaugagauu

SEQ ID NO: 193006 - RNA, 19 nt, Homo sapiens
gaagaaguuguuccgaaug

SEQ ID NO: 193007 - RNA, 19 nt, Homo sapiens
ugaucaaugugaagagauu

SEQ ID NO: 193008 - RNA, 19 nt, Homo sapiens
aauugaaacugaagggaaa

SEQ ID NO: 193009 - RNA, 19 nt, Homo sapiens
ccugggagaugcuguugaa

SEQ ID NO: 193010 - RNA, 19 nt, Homo sapiens
ggcagaaauugagcacuuu

SEQ ID NO: 193011 - RNA, 19 nt, Homo sapiens
ggaaugaggacaauuuuga

SEQ ID NO: 193012 - RNA, 19 nt, Homo sapiens
gcauggaguaucucacaaa

SEQ ID NO: 193013 - RNA, 19 nt, Homo sapiens
gaugagugcuacauuacag

SEQ ID NO: 193014 - RNA, 19 nt, Homo sapiens
gaccuucaccuuuauuugu

SEQ ID NO: 193015 - RNA, 19 nt, Homo sapiens
uggcagaaauugagcacuu

SEQ ID NO: 193016 - RNA, 19 nt, Homo sapiens
gagcaauugguaaggcaua

SEQ ID NO: 193017 - RNA, 19 nt, Homo sapiens
ucagaaauggaaaguguuu

SEQ ID NO: 193018 - RNA, 19 nt, Homo sapiens
gaucaagcuuuugcuauuu

SEQ ID NO: 193019 - RNA, 19 nt, Homo sapiens
gagaugcugcugaaugaga

SEQ ID NO: 193020 - RNA, 19 nt, Homo sapiens
caaaacuggugauggagua

SEQ ID NO: 193021 - RNA, 19 nt, Homo sapiens
agucaauguuguucaguuu

SEQ ID NO: 193022 - RNA, 19 nt, Homo sapiens
uaacacaguauuaggcuau

SEQ ID NO: 193023 - RNA, 19 nt, Homo sapiens
gaaacaugccuggguacuu

SEQ ID NO: 193024 - RNA, 19 nt, Homo sapiens
caaagaugauauuguagac

SEQ ID NO: 193025 - RNA, 19 nt, Homo sapiens
cuacucuuauguccacuuu

SEQ ID NO: 193026 - RNA, 19 nt, Homo sapiens
gaagggcaagagacuggua

SEQ ID NO: 193027 - RNA, 19 nt, Homo sapiens
guaagggagcaauugguaa

SEQ ID NO: 193028 - RNA, 19 nt, Homo sapiens
ggaguaucuugccauuugu

SEQ ID NO: 193029 - RNA, 19 nt, Homo sapiens
gcaauugguaaggcauaua

SEQ ID NO: 193030 - RNA, 19 nt, Homo sapiens
gaaaucagaaauggaaagu

SEQ ID NO: 193031 - RNA, 19 nt, Homo sapiens
gaaauugaugucugauaag

SEQ ID NO: 193032 - RNA, 19 nt, Homo sapiens
agaaauugagcacuuugua

SEQ ID NO: 193033 - RNA, 19 nt, Homo sapiens
uuaguggucuguaugacuu

SEQ ID NO: 193034 - RNA, 19 nt, Homo sapiens
caugaucaaugugaagaga

SEQ ID NO: 193035 - RNA, 19 nt, Homo sapiens
cugagaaaccucugaaaga

SEQ ID NO: 193036 - RNA, 19 nt, Homo sapiens
ugauaacuauggacagcaa

SEQ ID NO: 193037 - RNA, 19 nt, Homo sapiens
gaaguguucugucgaaaag

SEQ ID NO: 193038 - RNA, 19 nt, Homo sapiens
gcugugcuuugaagaacaa

SEQ ID NO: 193039 - RNA, 19 nt, Homo sapiens
caagaggguucuggaagca

SEQ ID NO: 193040 - RNA, 19 nt, Homo sapiens
aagaaguuguuccgaaugu

SEQ ID NO: 193041 - RNA, 19 nt, Homo sapiens
aaauugagcacuuuguaga

SEQ ID NO: 193042 - RNA, 19 nt, Homo sapiens
gcagaaauugagcacuuug

SEQ ID NO: 193043 - RNA, 19 nt, Homo sapiens
gauugagauuguuggaugu

SEQ ID NO: 193044 - RNA, 19 nt, Homo sapiens
cguuacagcccaaagauga

SEQ ID NO: 193045 - RNA, 19 nt, Homo sapiens
aagagacaaucgaggaaug

SEQ ID NO: 193046 - RNA, 19 nt, Homo sapiens
uuacagaaauggagaugcu

SEQ ID NO: 193047 - RNA, 19 nt, Homo sapiens
ggcagaccuucaccuuuau

SEQ ID NO: 193048 - RNA, 19 nt, Homo sapiens
ugaagguucucgugugucu

SEQ ID NO: 193049 - RNA, 19 nt, Homo sapiens
uaagaaggaugcaaaacug

SEQ ID NO: 193050 - RNA, 19 nt, Homo sapiens
ugaacagggugugauuaau

SEQ ID NO: 193051 - RNA, 19 nt, Homo sapiens
uccagugucuuuuaacuua

SEQ ID NO: 193052 - RNA, 19 nt, Homo sapiens
agaggguucuggaagcaaa

SEQ ID NO: 193053 - RNA, 19 nt, Homo sapiens
gcacuuuauccaagaggaa

SEQ ID NO: 193054 - RNA, 19 nt, Homo sapiens
ggcagcacuuuauccaaga

SEQ ID NO: 193055 - RNA, 19 nt, Homo sapiens
uccaagaccuagccaaugg

SEQ ID NO: 193056 - RNA, 19 nt, Homo sapiens
gaguaucucacaaaguaga

SEQ ID NO: 193057 - RNA, 19 nt, Homo sapiens
ggagaugaacagagaacau

SEQ ID NO: 193058 - RNA, 19 nt, Homo sapiens
cagucaauguuguucaguu

SEQ ID NO: 193059 - RNA, 19 nt, Homo sapiens
gaaauaugcuggucaagaa

SEQ ID NO: 193060 - RNA, 19 nt, Homo sapiens
cagaguggcugucuuaaua

SEQ ID NO: 193061 - RNA, 19 nt, Homo sapiens
ggcaagaucuguuggguua

SEQ ID NO: 193062 - RNA, 19 nt, Homo sapiens
ccaaauagcucugcacaaa

SEQ ID NO: 193063 - RNA, 19 nt, Homo sapiens
gaauaaugcugaccaagaa

SEQ ID NO: 193064 - RNA, 19 nt, Homo sapiens
gcacaucucugccuguuug

SEQ ID NO: 193065 - RNA, 19 nt, Homo sapiens
gaacuaaacuaaagauugc

SEQ ID NO: 193066 - RNA, 19 nt, Homo sapiens
gaagaagccugggugauug

SEQ ID NO: 193067 - RNA, 19 nt, Homo sapiens
gaaacucccucaccuggaa

SEQ ID NO: 193068 - RNA, 19 nt, Homo sapiens
gaagaguucuccauagaca

SEQ ID NO: 193069 - RNA, 19 nt, Homo sapiens
aaauagcucugcacaaauu

SEQ ID NO: 193070 - RNA, 19 nt, Homo sapiens
gcaagaggguacuccauau

SEQ ID NO: 193071 - RNA, 19 nt, Homo sapiens
gaagaggugucgugucugu

SEQ ID NO: 193072 - RNA, 19 nt, Homo sapiens
gagaagaggugucgugucu

SEQ ID NO: 193073 - RNA, 19 nt, Homo sapiens
ggaagaagccugggugauu

SEQ ID NO: 193074 - RNA, 19 nt, Homo sapiens
agaaaugccugacauguau

SEQ ID NO: 193075 - RNA, 19 nt, Homo sapiens
gagauggccagaacauuua

SEQ ID NO: 193076 - RNA, 19 nt, Homo sapiens
guaauccucccacuucuua

SEQ ID NO: 193077 - RNA, 19 nt, Homo sapiens
ggaacuaaacuaaagauug

SEQ ID NO: 193078 - RNA, 19 nt, Homo sapiens
ggaauaaugcugaccaaga

SEQ ID NO: 193079 - RNA, 19 nt, Homo sapiens
gaaaccggagucacaguua

SEQ ID NO: 193080 - RNA, 19 nt, Homo sapiens
gaaagcaugcaaauaaaug

SEQ ID NO: 193081 - RNA, 19 nt, Homo sapiens
gauccagagugccaaguaa

SEQ ID NO: 193082 - RNA, 19 nt, Homo sapiens
gcucaauucugcaaagaga

SEQ ID NO: 193083 - RNA, 19 nt, Homo sapiens
aaacuugaccucaguguaa

SEQ ID NO: 193084 - RNA, 19 nt, Homo sapiens
caagaucuguuggguuaaa

SEQ ID NO: 193085 - RNA, 19 nt, Homo sapiens
gcaaagcuguacaagagau

SEQ ID NO: 193086 - RNA, 19 nt, Homo sapiens
caauugaccuaguccuuga

SEQ ID NO: 193087 - RNA, 19 nt, Homo sapiens
caacaaagccgcaguagcu

SEQ ID NO: 193088 - RNA, 19 nt, Homo sapiens
uaucgcagcuggaaauaug

SEQ ID NO: 193089 - RNA, 19 nt, Homo sapiens
gaguuugacuuacaaggaa

SEQ ID NO: 193090 - RNA, 19 nt, Homo sapiens
ccacuagaguaauuaauca

SEQ ID NO: 193091 - RNA, 19 nt, Homo sapiens
gaaccugcaagcacuuaua

SEQ ID NO: 193092 - RNA, 19 nt, Homo sapiens
ggaaauaugcuggucaaga

SEQ ID NO: 193093 - RNA, 19 nt, Homo sapiens
acacugcccuugcucaauu

SEQ ID NO: 193094 - RNA, 19 nt, Homo sapiens
gauuuagccuugugaggaa

SEQ ID NO: 193095 - RNA, 19 nt, Homo sapiens
gcaauguguguuaaugaua

SEQ ID NO: 193096 - RNA, 19 nt, Homo sapiens
cauccuugcucccuucuuu

SEQ ID NO: 193097 - RNA, 19 nt, Homo sapiens
caaagaagaggccugcaaa

SEQ ID NO: 193098 - RNA, 19 nt, Homo sapiens
cagaaaugccugacaugua

SEQ ID NO: 193099 - RNA, 19 nt, Homo sapiens
gcaauaaacaugauaccau

SEQ ID NO: 193100 - RNA, 19 nt, Homo sapiens
gcaaagagaagaaaauuga

SEQ ID NO: 193101 - RNA, 19 nt, Homo sapiens
gagcugguauucccacuag

SEQ ID NO: 193102 - RNA, 19 nt, Homo sapiens
aagaauggcucccugacaa

SEQ ID NO: 193103 - RNA, 19 nt, Homo sapiens
gguggaggauuacuagaga

SEQ ID NO: 193104 - RNA, 19 nt, Homo sapiens
ggacugcucugcacaucuc

SEQ ID NO: 193105 - RNA, 19 nt, Homo sapiens
caagaggguacuccauaua

SEQ ID NO: 193106 - RNA, 19 nt, Homo sapiens
cugcaaagcuguacaagag

SEQ ID NO: 193107 - RNA, 19 nt, Homo sapiens
caucuggucuucauagcaa

SEQ ID NO: 193108 - RNA, 19 nt, Homo sapiens
aaaagcagcugguuucaaa

SEQ ID NO: 193109 - RNA, 19 nt, Homo sapiens
agacuucccugcuuugguu

SEQ ID NO: 193110 - RNA, 19 nt, Homo sapiens
ggaaugaagccuuuuaauu

SEQ ID NO: 193111 - RNA, 19 nt, Homo sapiens
gguauucccacuagaguaa

SEQ ID NO: 193112 - RNA, 19 nt, Homo sapiens
gcaaagaagaggccugcaa

SEQ ID NO: 193113 - RNA, 19 nt, Homo sapiens
gauacugucgcaacucuuu

SEQ ID NO: 193114 - RNA, 19 nt, Homo sapiens
gaagagauggccagaacau

SEQ ID NO: 193115 - RNA, 19 nt, Homo sapiens
gggagcaauuuauaggaaa

SEQ ID NO: 193116 - RNA, 19 nt, Homo sapiens
ucucuaugcuggaauaaug

SEQ ID NO: 193117 - RNA, 19 nt, Homo sapiens
agagauggccagaacauuu

SEQ ID NO: 193118 - RNA, 19 nt, Homo sapiens
ccagaguccucccugagaa

SEQ ID NO: 193119 - RNA, 19 nt, Homo sapiens
guagcaauguguguuaaug

SEQ ID NO: 193120 - RNA, 19 nt, Homo sapiens
gaugcuggacagauuauuu

SEQ ID NO: 193121 - RNA, 19 nt, Homo sapiens
cauaucagcccuugaggaa

SEQ ID NO: 193122 - RNA, 19 nt, Homo sapiens
ugggugcacuguacacuuu

SEQ ID NO: 193123 - RNA, 19 nt, Homo sapiens
ggaaaccggagucacaguu

SEQ ID NO: 193124 - RNA, 19 nt, Homo sapiens
cagcagaaaugccugacau

SEQ ID NO: 193125 - RNA, 19 nt, Homo sapiens
caagaaaauucagccuuua

SEQ ID NO: 193126 - RNA, 19 nt, Homo sapiens
gguacuccauauacaggua

SEQ ID NO: 193127 - RNA, 19 nt, Homo sapiens
gaagaauggcucccugaca

SEQ ID NO: 193128 - RNA, 19 nt, Homo sapiens
ggucaguguugaagaaugg

SEQ ID NO: 193129 - RNA, 19 nt, Homo sapiens
uauuacugguggaggauua

SEQ ID NO: 193130 - RNA, 19 nt, Homo sapiens
cagauggcguuggaacuaa

SEQ ID NO: 193131 - RNA, 19 nt, Homo sapiens
gcagcugguuucaaagauc

SEQ ID NO: 193132 - RNA, 19 nt, Homo sapiens
gcaagcacuuauagacagu

SEQ ID NO: 193133 - RNA, 19 nt, Homo sapiens
gaggauuacuagagaacau

SEQ ID NO: 193134 - RNA, 19 nt, Homo sapiens
cuucauagcaauggauuua

SEQ ID NO: 193135 - RNA, 19 nt, Homo sapiens
ugauguuguuguuggaaua

SEQ ID NO: 193136 - RNA, 19 nt, Homo sapiens
gcagaaaugccugacaugu

SEQ ID NO: 193137 - RNA, 19 nt, Homo sapiens
agaucaggcuguaaaguug

SEQ ID NO: 193138 - RNA, 19 nt, Homo sapiens
cagaucaggcuguaaaguu

SEQ ID NO: 193139 - RNA, 19 nt, Homo sapiens
ucaagaaaauucagccuuu

SEQ ID NO: 193140 - RNA, 19 nt, Homo sapiens
gcagcccgaguacuuauaa

SEQ ID NO: 193141 - RNA, 19 nt, Homo sapiens
ggaguuugacuuacaagga

SEQ ID NO: 193142 - RNA, 19 nt, Homo sapiens
acccuuacuucaucuauuu

SEQ ID NO: 193143 - RNA, 19 nt, Homo sapiens
uugaagaguucuccauaga

SEQ ID NO: 193144 - RNA, 19 nt, Homo sapiens
gcaguagcuggguuagaua

SEQ ID NO: 193145 - RNA, 19 nt, Homo sapiens
ggccagaacauuuaacugu

SEQ ID NO: 193146 - RNA, 19 nt, Homo sapiens
aaauucagccuuuagcaaa

SEQ ID NO: 193147 - RNA, 19 nt, Homo sapiens
uuacaaggaaucuggagua

SEQ ID NO: 193148 - RNA, 19 nt, Homo sapiens
gguauucucuaugcuggaa

SEQ ID NO: 193149 - RNA, 19 nt, Homo sapiens
caaauaccgccaucucaau

SEQ ID NO: 193150 - RNA, 19 nt, Homo sapiens
auaaaugggucaguguuga

SEQ ID NO: 193151 - RNA, 19 nt, Homo sapiens
gauugaaagcaugcaaaua

SEQ ID NO: 193152 - RNA, 19 nt, Homo sapiens
uaucaaaggagcagacaga

SEQ ID NO: 193153 - RNA, 19 nt, Homo sapiens
ccaggaguuugacuuacaa

SEQ ID NO: 193154 - RNA, 19 nt, Homo sapiens
ccacaccgcccuaacuguu

SEQ ID NO: 193155 - RNA, 19 nt, Homo sapiens
ucagguuucuaaugaucua

SEQ ID NO: 193156 - RNA, 19 nt, Homo sapiens
caaauaaaugggucagugu

SEQ ID NO: 193157 - RNA, 19 nt, Homo sapiens
gcaauggauuuagccuugu

SEQ ID NO: 193158 - RNA, 19 nt, Homo sapiens
ggagcgagaucagaaacuc

SEQ ID NO: 193159 - RNA, 19 nt, Homo sapiens
gaauaaugcugaccaagaa

SEQ ID NO: 193160 - RNA, 19 nt, Homo sapiens
gcacaucucugccuguuug

SEQ ID NO: 193161 - RNA, 19 nt, Homo sapiens
gcacuuggccugauacuga

SEQ ID NO: 193162 - RNA, 19 nt, Homo sapiens
caccacaccuggcuaauuu

SEQ ID NO: 193163 - RNA, 19 nt, Homo sapiens
gcaagaggguacuccauau

SEQ ID NO: 193164 - RNA, 19 nt, Homo sapiens
gaagaggugucgugucugu

SEQ ID NO: 193165 - RNA, 19 nt, Homo sapiens
gagaagaggugucgugucu

SEQ ID NO: 193166 - RNA, 19 nt, Homo sapiens
guaauccucccacuucuua

SEQ ID NO: 193167 - RNA, 19 nt, Homo sapiens
ucaaagaacugaagaugag

SEQ ID NO: 193168 - RNA, 19 nt, Homo sapiens
ggaauaaugcugaccaaga

SEQ ID NO: 193169 - RNA, 19 nt, Homo sapiens
caagugauccuccugcuuu

SEQ ID NO: 193170 - RNA, 19 nt, Homo sapiens
ccaaauagcugggacuaca

SEQ ID NO: 193171 - RNA, 19 nt, Homo sapiens
gauccagagugccaaguaa

SEQ ID NO: 193172 - RNA, 19 nt, Homo sapiens
gcucaauucugcaaagaga

SEQ ID NO: 193173 - RNA, 19 nt, Homo sapiens
gagaauacuggucaucuaa

SEQ ID NO: 193174 - RNA, 19 nt, Homo sapiens
gaacugaagaugagaauac

SEQ ID NO: 193175 - RNA, 19 nt, Homo sapiens
gcaaagcuguacaagagau

SEQ ID NO: 193176 - RNA, 19 nt, Homo sapiens
acacugcccuugcucaauu

SEQ ID NO: 193177 - RNA, 19 nt, Homo sapiens
ugagaauacuggucaucua

SEQ ID NO: 193178 - RNA, 19 nt, Homo sapiens
caaagaagaggccugcaaa

SEQ ID NO: 193179 - RNA, 19 nt, Homo sapiens
gcaaagagaagaaaauuga

SEQ ID NO: 193180 - RNA, 19 nt, Homo sapiens
uguacaaacuguugacuug

SEQ ID NO: 193181 - RNA, 19 nt, Homo sapiens
ggacugcucugcacaucuc

SEQ ID NO: 193182 - RNA, 19 nt, Homo sapiens
caagaggguacuccauaua

SEQ ID NO: 193183 - RNA, 19 nt, Homo sapiens
cugcaaagcuguacaagag

SEQ ID NO: 193184 - RNA, 19 nt, Homo sapiens
gcguuuguaucuauuacua

SEQ ID NO: 193185 - RNA, 19 nt, Homo sapiens
agacuucccugcuuugguu

SEQ ID NO: 193186 - RNA, 19 nt, Homo sapiens
gcguaaguuuggaaaguuu

SEQ ID NO: 193187 - RNA, 19 nt, Homo sapiens
cacauaguguuguauuuga

SEQ ID NO: 193188 - RNA, 19 nt, Homo sapiens
gcaaagaagaggccugcaa

SEQ ID NO: 193189 - RNA, 19 nt, Homo sapiens
guuaucacauaguguugua

SEQ ID NO: 193190 - RNA, 19 nt, Homo sapiens
gguuauagcaauacucaaa

SEQ ID NO: 193191 - RNA, 19 nt, Homo sapiens
gggagcaauuuauaggaaa

SEQ ID NO: 193192 - RNA, 19 nt, Homo sapiens
ucucuaugcuggaauaaug

SEQ ID NO: 193193 - RNA, 19 nt, Homo sapiens
ccaaaaugcugggauuaua

SEQ ID NO: 193194 - RNA, 19 nt, Homo sapiens
gaauacuggucaucuaacu

SEQ ID NO: 193195 - RNA, 19 nt, Homo sapiens
caauaaagucuuaguugga

SEQ ID NO: 193196 - RNA, 19 nt, Homo sapiens
cauaucagcccuugaggaa

SEQ ID NO: 193197 - RNA, 19 nt, Homo sapiens
gguacuccauauacaggua

SEQ ID NO: 193198 - RNA, 19 nt, Homo sapiens
gugauacagucuugguuug

SEQ ID NO: 193199 - RNA, 19 nt, Homo sapiens
cccuauaagucauucagua

SEQ ID NO: 193200 - RNA, 19 nt, Homo sapiens
gcagcccgaguacuuauaa

SEQ ID NO: 193201 - RNA, 19 nt, Homo sapiens
uggccuaaauggcuaugua

SEQ ID NO: 193202 - RNA, 19 nt, Homo sapiens
gguauucucuaugcuggaa

SEQ ID NO: 193203 - RNA, 19 nt, Homo sapiens
caaauaccgccaucucaau

SEQ ID NO: 193204 - RNA, 19 nt, Homo sapiens
ugccucagccucccaaaua

SEQ ID NO: 193205 - RNA, 19 nt, Homo sapiens
caugauagcguaaguuugg

SEQ ID NO: 193206 - RNA, 19 nt, Homo sapiens
ccacaccgcccuaacuguu

SEQ ID NO: 193207 - RNA, 19 nt, Homo sapiens
ucagguuucuaaugaucua

SEQ ID NO: 193208 - RNA, 19 nt, Homo sapiens
ucacauaguguuguauuug

SEQ ID NO: 193209 - RNA, 19 nt, Homo sapiens
aacauacgcuggccuggaa

SEQ ID NO: 193210 - RNA, 19 nt, Homo sapiens
ucauuaacccuauaaguca

SEQ ID NO: 193211 - RNA, 19 nt, Homo sapiens
cagaagcggcucaguuaga

SEQ ID NO: 193212 - RNA, 19 nt, Homo sapiens
ucaaauaccgccaucucaa

SEQ ID NO: 193213 - RNA, 19 nt, Homo sapiens
ggagcaauuuauaggaaag

SEQ ID NO: 193214 - RNA, 19 nt, Homo sapiens
gcccgaguacuuauaauug

SEQ ID NO: 193215 - RNA, 19 nt, Homo sapiens
gaaggccaguggucuugca

SEQ ID NO: 193216 - RNA, 19 nt, Homo sapiens
gaaauccugggcucaagug

SEQ ID NO: 193217 - RNA, 19 nt, Homo sapiens
uucagaaacuggccuaaau

SEQ ID NO: 193218 - RNA, 19 nt, Homo sapiens
agcagaagcggcucaguua

SEQ ID NO: 193219 - RNA, 19 nt, Homo sapiens
cagcagaagcggcucaguu

SEQ ID NO: 193220 - RNA, 19 nt, Homo sapiens
ggcaugagccgcugcacuu

SEQ ID NO: 193221 - RNA, 19 nt, Homo sapiens
cuaaauggcuauguagaac

SEQ ID NO: 193222 - RNA, 19 nt, Homo sapiens
acaggaccauaagcgauua

SEQ ID NO: 193223 - RNA, 19 nt, Homo sapiens
gcagcuggagaaacaauug

SEQ ID NO: 193224 - RNA, 19 nt, Homo sapiens
ggaaaaggggugauuguug

SEQ ID NO: 193225 - RNA, 19 nt, Homo sapiens
auggaaggcuuucaccaaa

SEQ ID NO: 193226 - RNA, 19 nt, Homo sapiens
caaagaguuuauggacaga

SEQ ID NO: 193227 - RNA, 19 nt, Homo sapiens
guugguauguacaaacugu

SEQ ID NO: 193228 - RNA, 19 nt, Homo sapiens
auacuggucaucuaacuuu

SEQ ID NO: 193229 - RNA, 19 nt, Homo sapiens
uagcguaaguuuggaaagu

SEQ ID NO: 193230 - RNA, 19 nt, Homo sapiens
ccuaaauggcuauguagaa

SEQ ID NO: 193231 - RNA, 19 nt, Homo sapiens
ucaguuagaguccagcaaa

SEQ ID NO: 193232 - RNA, 19 nt, Homo sapiens
cuggucaucuaacuuugua

SEQ ID NO: 193233 - RNA, 19 nt, Homo sapiens
cgcccuaacuguugucaug

SEQ ID NO: 193234 - RNA, 19 nt, Homo sapiens
gaccaagaauggcccaaaa

SEQ ID NO: 193235 - RNA, 19 nt, Homo sapiens
ggaaugggagccuauuguc

SEQ ID NO: 193236 - RNA, 19 nt, Homo sapiens
ggagaugguggcccuaaca

SEQ ID NO: 193237 - RNA, 19 nt, Homo sapiens
cuuuggaauuucugcuuua

SEQ ID NO: 193238 - RNA, 19 nt, Homo sapiens
cccaaaaguucuagaguuu

SEQ ID NO: 193239 - RNA, 19 nt, Homo sapiens
gggaaugggagccuauugu

SEQ ID NO: 193240 - RNA, 19 nt, Homo sapiens
uaacagggucuuccucucu

SEQ ID NO: 193241 - RNA, 19 nt, Homo sapiens
guagaacauuucauuaacc

SEQ ID NO: 193242 - RNA, 19 nt, Homo sapiens
cgucggcuuucgugccaua

SEQ ID NO: 193243 - RNA, 19 nt, Homo sapiens
gcccaaaaguucuagaguu

SEQ ID NO: 193244 - RNA, 19 nt, Homo sapiens
uaucaaagaacugaagaug

SEQ ID NO: 193245 - RNA, 19 nt, Homo sapiens
uuccuugcguuaucacaua

SEQ ID NO: 193246 - RNA, 19 nt, Homo sapiens
ccaccacaccuggcuaauu

SEQ ID NO: 193247 - RNA, 19 nt, Homo sapiens
ccuuuggaauuucugcuuu

SEQ ID NO: 193248 - RNA, 19 nt, Homo sapiens
ccucagguuucuaaugauc

SEQ ID NO: 193249 - RNA, 19 nt, Homo sapiens
ggaaggcuuucaccaaacc

SEQ ID NO: 193250 - RNA, 19 nt, Homo sapiens
ucagaaacuggccuaaaug

SEQ ID NO: 193251 - RNA, 19 nt, Homo sapiens
agggagcaauuuauaggaa

SEQ ID NO: 193252 - RNA, 19 nt, Homo sapiens
gugauucaguccaccuuag

SEQ ID NO: 193253 - RNA, 19 nt, Homo sapiens
ggucaucuaacuuuguaau

SEQ ID NO: 193254 - RNA, 19 nt, Homo sapiens
ccuauaagucauucaguau

SEQ ID NO: 193255 - RNA, 19 nt, Homo sapiens
aacaauggcagcccgagua

SEQ ID NO: 193256 - RNA, 19 nt, Homo sapiens
gcaggagugcaaugcuuug

SEQ ID NO: 193257 - RNA, 19 nt, Homo sapiens
gaggugucgugucuguguu

SEQ ID NO: 193258 - RNA, 19 nt, Homo sapiens
gauagcguaaguuuggaaa

SEQ ID NO: 193259 - RNA, 19 nt, Homo sapiens
gcacauuucuuaggauuaa

SEQ ID NO: 193260 - RNA, 19 nt, Homo sapiens
guacaucaguaaagaguuu

SEQ ID NO: 193261 - RNA, 19 nt, Homo sapiens
ggaaggaggaauuauauuu

SEQ ID NO: 193262 - RNA, 19 nt, Homo sapiens
gaagugugcuauauuuaga

SEQ ID NO: 193263 - RNA, 19 nt, Homo sapiens
gcgcauggauuuaugaaga

SEQ ID NO: 193264 - RNA, 19 nt, Homo sapiens
cuaccacucugaucucuua

SEQ ID NO: 193265 - RNA, 19 nt, Homo sapiens
gcaaaggggcugucuauua

SEQ ID NO: 193266 - RNA, 19 nt, Homo sapiens
gaaggaggaauuauauuug

SEQ ID NO: 193267 - RNA, 19 nt, Homo sapiens
ccugguacaucguauauaa

SEQ ID NO: 193268 - RNA, 19 nt, Homo sapiens
ucucuuagcacauuucuua

SEQ ID NO: 193269 - RNA, 19 nt, Homo sapiens
ggaauuauauuugcaaagg

SEQ ID NO: 193270 - RNA, 19 nt, Homo sapiens
gaccuuaauuucauugcua

SEQ ID NO: 193271 - RNA, 19 nt, Homo sapiens
gcucugcacugccauguau

SEQ ID NO: 193272 - RNA, 19 nt, Homo sapiens
ugaagacacucaugcaaga

SEQ ID NO: 193273 - RNA, 19 nt, Homo sapiens
aaagcuagcugcaguguuc

SEQ ID NO: 193274 - RNA, 19 nt, Homo sapiens
gcacugccauguaugaaag

SEQ ID NO: 193275 - RNA, 19 nt, Homo sapiens
ugugaagugugcuauauuu

SEQ ID NO: 193276 - RNA, 19 nt, Homo sapiens
gcgagucggucaaggagaa

SEQ ID NO: 193277 - RNA, 19 nt, Homo sapiens
guagaaauguacaaaugca

SEQ ID NO: 193278 - RNA, 19 nt, Homo sapiens
gagaauuuauggacguugu

SEQ ID NO: 193279 - RNA, 19 nt, Homo sapiens
caaaggggcugucuauuag

SEQ ID NO: 193280 - RNA, 19 nt, Homo sapiens
aaacucacauccauauuac

SEQ ID NO: 193281 - RNA, 19 nt, Homo sapiens
uuaaauaugcggagaaugu

SEQ ID NO: 193282 - RNA, 19 nt, Homo sapiens
uagcacauuucuuaggauu

SEQ ID NO: 193283 - RNA, 19 nt, Homo sapiens
ccaaacugccuuaaacguu

SEQ ID NO: 193284 - RNA, 19 nt, Homo sapiens
gcuguacuuuguauauaga

SEQ ID NO: 193285 - RNA, 19 nt, Homo sapiens
uauggacguuguagaaaug

SEQ ID NO: 193286 - RNA, 19 nt, Homo sapiens
gugaagugugcuauauuua

SEQ ID NO: 193287 - RNA, 19 nt, Homo sapiens
uauauugccucugcuccua

SEQ ID NO: 193288 - RNA, 19 nt, Homo sapiens
uaaauaugcggagaaugua

SEQ ID NO: 193289 - RNA, 19 nt, Homo sapiens
ccagugaggauauuauaau

SEQ ID NO: 193290 - RNA, 19 nt, Homo sapiens
cgacagcuguucauuucca

SEQ ID NO: 193291 - RNA, 19 nt, Homo sapiens
uagaauccauuugucauca

SEQ ID NO: 193292 - RNA, 19 nt, Homo sapiens
uuugagcccuugaccuuaa

SEQ ID NO: 193293 - RNA, 19 nt, Homo sapiens
ugccuuaaacguuguauuu

SEQ ID NO: 193294 - RNA, 19 nt, Homo sapiens
guauagaauccauuuguca

SEQ ID NO: 193295 - RNA, 19 nt, Homo sapiens
ucugaucucuuagcacauu

SEQ ID NO: 193296 - RNA, 19 nt, Homo sapiens
ggccagugaggauauuaua

SEQ ID NO: 193297 - RNA, 19 nt, Homo sapiens
ggaggaauuauauuugcaa

SEQ ID NO: 193298 - RNA, 19 nt, Homo sapiens
ggguggcgauugccuuaga

SEQ ID NO: 193299 - RNA, 19 nt, Homo sapiens
acauguacaucaguaaaga

SEQ ID NO: 193300 - RNA, 19 nt, Homo sapiens
gaagacacucaugcaagaa

SEQ ID NO: 193301 - RNA, 19 nt, Homo sapiens
gcauuuccaaacugccuua

SEQ ID NO: 193302 - RNA, 19 nt, Homo sapiens
cucgacagcuguucauuuc

SEQ ID NO: 193303 - RNA, 19 nt, Homo sapiens
gcccuugaccuuaauuuca

SEQ ID NO: 193304 - RNA, 19 nt, Homo sapiens
acuuaccgauucauucuuu

SEQ ID NO: 193305 - RNA, 19 nt, Homo sapiens
cuccggagcuugacuucuu

SEQ ID NO: 193306 - RNA, 19 nt, Homo sapiens
gggcaggacuuggacaaac

SEQ ID NO: 193307 - RNA, 19 nt, Homo sapiens
uuauggacguuguagaaau

SEQ ID NO: 193308 - RNA, 19 nt, Homo sapiens
ugaagugugcuauauuuag

SEQ ID NO: 193309 - RNA, 19 nt, Homo sapiens
ccacucugaucucuuagca

SEQ ID NO: 193310 - RNA, 19 nt, Homo sapiens
cagugaggauauuauaauc

SEQ ID NO: 193311 - RNA, 19 nt, Homo sapiens
gggaaggaggaauuauauu

SEQ ID NO: 193312 - RNA, 19 nt, Homo sapiens
guuaccaguugcuguacuu

SEQ ID NO: 193313 - RNA, 19 nt, Homo sapiens
cuuagcacauuucuuagga

SEQ ID NO: 193314 - RNA, 19 nt, Homo sapiens
gauucauucuuucacuguu

SEQ ID NO: 193315 - RNA, 19 nt, Homo sapiens
aauaugcggagaauguaua

SEQ ID NO: 193316 - RNA, 19 nt, Homo sapiens
guuuaaauaugcggagaau

SEQ ID NO: 193317 - RNA, 19 nt, Homo sapiens
ggguugccaugguguugaa

SEQ ID NO: 193318 - RNA, 19 nt, Homo sapiens
gccagugaggauauuauaa

SEQ ID NO: 193319 - RNA, 19 nt, Homo sapiens
gcugucuauuagcauauuu

SEQ ID NO: 193320 - RNA, 19 nt, Homo sapiens
ggacgacuacuacgaugag

SEQ ID NO: 193321 - RNA, 19 nt, Homo sapiens
acauccauauuacaccuuu

SEQ ID NO: 193322 - RNA, 19 nt, Homo sapiens
gaaagcuagcugcaguguu

SEQ ID NO: 193323 - RNA, 19 nt, Homo sapiens
ggauuuaugaagacacuca

SEQ ID NO: 193324 - RNA, 19 nt, Homo sapiens
gccgcuaccugaccuacug

SEQ ID NO: 193325 - RNA, 19 nt, Homo sapiens
ccacuuaccgauucauucu

SEQ ID NO: 193326 - RNA, 19 nt, Homo sapiens
cuacuacgaugaggacuac

SEQ ID NO: 193327 - RNA, 19 nt, Homo sapiens
guggguggcgauugccuua

SEQ ID NO: 193328 - RNA, 19 nt, Homo sapiens
ccaauuccaagcuccagaa

SEQ ID NO: 193329 - RNA, 19 nt, Homo sapiens
gcaccgucauugaggacau

SEQ ID NO: 193330 - RNA, 19 nt, Homo sapiens
aaacugccuuaaacguugu

SEQ ID NO: 193331 - RNA, 19 nt, Homo sapiens
ggcaggacuuggacaaacu

SEQ ID NO: 193332 - RNA, 19 nt, Homo sapiens
gugccaguaucgacuuuua

SEQ ID NO: 193333 - RNA, 19 nt, Homo sapiens
ucucgacagcuguucauuu

SEQ ID NO: 193334 - RNA, 19 nt, Homo sapiens
ugggaaggaggaauuauau

SEQ ID NO: 193335 - RNA, 19 nt, Homo sapiens
gcauggauuuaugaagaca

SEQ ID NO: 193336 - RNA, 19 nt, Homo sapiens
caguugcuguacuuuguau

SEQ ID NO: 193337 - RNA, 19 nt, Homo sapiens
uugaggacaugcuggcuau

SEQ ID NO: 193338 - RNA, 19 nt, Homo sapiens
uuuccaaacugccuuaaac

SEQ ID NO: 193339 - RNA, 19 nt, Homo sapiens
uguauagaauccauuuguc

SEQ ID NO: 193340 - RNA, 19 nt, Homo sapiens
gcaggacuuggacaaacuu

SEQ ID NO: 193341 - RNA, 19 nt, Homo sapiens
gaacagucuuaaaauguac

SEQ ID NO: 193342 - RNA, 19 nt, Homo sapiens
ccugaaauguauagaaucc

SEQ ID NO: 193343 - RNA, 19 nt, Homo sapiens
ccaguugcuguacuuugua

SEQ ID NO: 193344 - RNA, 19 nt, Homo sapiens
gcaucucggcccucauuca

SEQ ID NO: 193345 - RNA, 19 nt, Homo sapiens
uacagauuguggccaguga

SEQ ID NO: 193346 - RNA, 19 nt, Homo sapiens
aaggaggaauuauauuugc

SEQ ID NO: 193347 - RNA, 19 nt, Homo sapiens
uugggaaggaggaauuaua

SEQ ID NO: 193348 - RNA, 19 nt, Homo sapiens
ggacguuguagaaauguac

SEQ ID NO: 193349 - RNA, 19 nt, Homo sapiens
uaaacccugguacaucgua

SEQ ID NO: 193350 - RNA, 19 nt, Homo sapiens
augcggagaauguauauug

SEQ ID NO: 193351 - RNA, 19 nt, Homo sapiens
gguugggaaggaggaauua

SEQ ID NO: 193352 - RNA, 19 nt, Homo sapiens
auuccaagcuccagaaacu

SEQ ID NO: 193353 - RNA, 19 nt, Homo sapiens
acgaugaggacuacgauga

SEQ ID NO: 193354 - RNA, 19 nt, Homo sapiens
gaauuuauggacguuguag

SEQ ID NO: 193355 - RNA, 19 nt, Homo sapiens
guugcuguacuuuguauau

SEQ ID NO: 193356 - RNA, 19 nt, Homo sapiens
gcuccuaucaggguugcua

SEQ ID NO: 193357 - RNA, 19 nt, Homo sapiens
gcagcuacgccuacaacca

SEQ ID NO: 193358 - RNA, 19 nt, Homo sapiens
gagcccuugaccuuaauuu

SEQ ID NO: 193359 - RNA, 19 nt, Homo sapiens
gagaauagcuuaugaguua

SEQ ID NO: 193360 - RNA, 19 nt, Homo sapiens
gcagauaagucaacagaaa

SEQ ID NO: 193361 - RNA, 19 nt, Homo sapiens
ggagaaagauagacagaaa

SEQ ID NO: 193362 - RNA, 19 nt, Homo sapiens
ugacauacguugauacuuu

SEQ ID NO: 193363 - RNA, 19 nt, Homo sapiens
gaugaaacgugucuauuug

SEQ ID NO: 193364 - RNA, 19 nt, Homo sapiens
caaagaaucuaccguugaa

SEQ ID NO: 193365 - RNA, 19 nt, Homo sapiens
gaucuggccuugugguuaa

SEQ ID NO: 193366 - RNA, 19 nt, Homo sapiens
ggaccuggccucucugaua

SEQ ID NO: 193367 - RNA, 19 nt, Homo sapiens
gaacaagaagaaacacuuu

SEQ ID NO: 193368 - RNA, 19 nt, Homo sapiens
ggaugaaacgugucuauuu

SEQ ID NO: 193369 - RNA, 19 nt, Homo sapiens
gcaaaugcccaaacaaguu

SEQ ID NO: 193370 - RNA, 19 nt, Homo sapiens
caaagaguagcacuauuua

SEQ ID NO: 193371 - RNA, 19 nt, Homo sapiens
gagcugacauacguugaua

SEQ ID NO: 193372 - RNA, 19 nt, Homo sapiens
ucaaagaguagcacuauuu

SEQ ID NO: 193373 - RNA, 19 nt, Homo sapiens
gcaaaucuccaacucuaaa

SEQ ID NO: 193374 - RNA, 19 nt, Homo sapiens
caacagcacuacacauaag

SEQ ID NO: 193375 - RNA, 19 nt, Homo sapiens
aagcaaaucuccaacucua

SEQ ID NO: 193376 - RNA, 19 nt, Homo sapiens
ugaagaagaucccaugcaa

SEQ ID NO: 193377 - RNA, 19 nt, Homo sapiens
ggacaugaauccagauaac

SEQ ID NO: 193378 - RNA, 19 nt, Homo sapiens
acacauaaguacagaguau

SEQ ID NO: 193379 - RNA, 19 nt, Homo sapiens
gaauccagauaacuacuug

SEQ ID NO: 193380 - RNA, 19 nt, Homo sapiens
gaccuggccucucugauau

SEQ ID NO: 193381 - RNA, 19 nt, Homo sapiens
ggaggaggcugggaaacuu

SEQ ID NO: 193382 - RNA, 19 nt, Homo sapiens
gaagcuaauuugcuaccaa

SEQ ID NO: 193383 - RNA, 19 nt, Homo sapiens
gaacacaguauuuagaaca

SEQ ID NO: 193384 - RNA, 19 nt, Homo sapiens
ugaaacaaauuggucauga

SEQ ID NO: 193385 - RNA, 19 nt, Homo sapiens
gagacaauacagcaaauuu

SEQ ID NO: 193386 - RNA, 19 nt, Homo sapiens
uaaaagcacuccagacauu

SEQ ID NO: 193387 - RNA, 19 nt, Homo sapiens
cagaaacuaugcaggagaa

SEQ ID NO: 193388 - RNA, 19 nt, Homo sapiens
acaugaagcuaauuugcua

SEQ ID NO: 193389 - RNA, 19 nt, Homo sapiens
gcagacaugaagcuaauuu

SEQ ID NO: 193390 - RNA, 19 nt, Homo sapiens
cuaaugauguuacagacuu

SEQ ID NO: 193391 - RNA, 19 nt, Homo sapiens
gacauacguugauacuuug

SEQ ID NO: 193392 - RNA, 19 nt, Homo sapiens
ugaaacgugucuauuugaa

SEQ ID NO: 193393 - RNA, 19 nt, Homo sapiens
cuaacaagcccacaaagaa

SEQ ID NO: 193394 - RNA, 19 nt, Homo sapiens
cagcagacaugaagcuaau

SEQ ID NO: 193395 - RNA, 19 nt, Homo sapiens
gaaggagauuacagcagaa

SEQ ID NO: 193396 - RNA, 19 nt, Homo sapiens
aaagaguacaggaaacuua

SEQ ID NO: 193397 - RNA, 19 nt, Homo sapiens
gaagaagaucccaugcaaa

SEQ ID NO: 193398 - RNA, 19 nt, Homo sapiens
aagaagaucuggccuugug

SEQ ID NO: 193399 - RNA, 19 nt, Homo sapiens
cgaguaaauuguacaguca

SEQ ID NO: 193400 - RNA, 19 nt, Homo sapiens
aaacgugucuauuugaauc

SEQ ID NO: 193401 - RNA, 19 nt, Homo sapiens
caaagcaaaucuccaacuc

SEQ ID NO: 193402 - RNA, 19 nt, Homo sapiens
gaaacaaauuggucaugac

SEQ ID NO: 193403 - RNA, 19 nt, Homo sapiens
ugaagauccuccuugcaaa

SEQ ID NO: 193404 - RNA, 19 nt, Homo sapiens
caucaaagucuucuggaaa

SEQ ID NO: 193405 - RNA, 19 nt, Homo sapiens
aaacuaugcaggagaaauu

SEQ ID NO: 193406 - RNA, 19 nt, Homo sapiens
cuaauuugcuaccaaugaa

SEQ ID NO: 193407 - RNA, 19 nt, Homo sapiens
ugaguuauuucacacauuc

SEQ ID NO: 193408 - RNA, 19 nt, Homo sapiens
gaucuaguguaauucauac

SEQ ID NO: 193409 - RNA, 19 nt, Homo sapiens
gaagauccuccuugcaaau

SEQ ID NO: 193410 - RNA, 19 nt, Homo sapiens
gcuaauuugcuaccaauga

SEQ ID NO: 193411 - RNA, 19 nt, Homo sapiens
cauuuaggauuugcagaua

SEQ ID NO: 193412 - RNA, 19 nt, Homo sapiens
guuauaaggcuaagaagga

SEQ ID NO: 193413 - RNA, 19 nt, Homo sapiens
gguggucucugccaguuau

SEQ ID NO: 193414 - RNA, 19 nt, Homo sapiens
uaacaagcccacaaagaau

SEQ ID NO: 193415 - RNA, 19 nt, Homo sapiens
gcuaacaagcccacaaaga

SEQ ID NO: 193416 - RNA, 19 nt, Homo sapiens
caacagaaagugccugcuu

SEQ ID NO: 193417 - RNA, 19 nt, Homo sapiens
caggaaacuuacuggauga

SEQ ID NO: 193418 - RNA, 19 nt, Homo sapiens
gcgaacacaguauuuagaa

SEQ ID NO: 193419 - RNA, 19 nt, Homo sapiens
caguuuaguucauauguuc

SEQ ID NO: 193420 - RNA, 19 nt, Homo sapiens
gcagaucucccguguggau

SEQ ID NO: 193421 - RNA, 19 nt, Homo sapiens
uguauccacuucuccagua

SEQ ID NO: 193422 - RNA, 19 nt, Homo sapiens
guuacagacuuacguauac

SEQ ID NO: 193423 - RNA, 19 nt, Homo sapiens
uacaugagcugacauacgu

SEQ ID NO: 193424 - RNA, 19 nt, Homo sapiens
gcuuaugaguuauuucaca

SEQ ID NO: 193425 - RNA, 19 nt, Homo sapiens
ccaacagcacuacacauaa

SEQ ID NO: 193426 - RNA, 19 nt, Homo sapiens
acaaauuggucaugacaag

SEQ ID NO: 193427 - RNA, 19 nt, Homo sapiens
gauguuacagacuuacgua

SEQ ID NO: 193428 - RNA, 19 nt, Homo sapiens
ccaaauaucugggguacuu

SEQ ID NO: 193429 - RNA, 19 nt, Homo sapiens
ggagaaaacauuuaggauu

SEQ ID NO: 193430 - RNA, 19 nt, Homo sapiens
ccaguuauaaggcuaagaa

SEQ ID NO: 193431 - RNA, 19 nt, Homo sapiens
gaaacgugucuauuugaau

SEQ ID NO: 193432 - RNA, 19 nt, Homo sapiens
ccagagacaauacagcaaa

SEQ ID NO: 193433 - RNA, 19 nt, Homo sapiens
uccaacagcacuacacaua

SEQ ID NO: 193434 - RNA, 19 nt, Homo sapiens
uuaggaugcugcacaacaa

SEQ ID NO: 193435 - RNA, 19 nt, Homo sapiens
cuuagagaauagcuuauga

SEQ ID NO: 193436 - RNA, 19 nt, Homo sapiens
gcacuacacauaaguacag

SEQ ID NO: 193437 - RNA, 19 nt, Homo sapiens
gaaggaaauuaagugaaac

SEQ ID NO: 193438 - RNA, 19 nt, Homo sapiens
caaaugcccaaacaaguuc

SEQ ID NO: 193439 - RNA, 19 nt, Homo sapiens
aaacgaauuucugaagauc

SEQ ID NO: 193440 - RNA, 19 nt, Homo sapiens
caaaacagguauuacaagu

SEQ ID NO: 193441 - RNA, 19 nt, Homo sapiens
aaucuaccguugaagaaga

SEQ ID NO: 193442 - RNA, 19 nt, Homo sapiens
acaaagaaucuaccguuga

SEQ ID NO: 193443 - RNA, 19 nt, Homo sapiens
gccuugcucugucaacuug

SEQ ID NO: 193444 - RNA, 19 nt, Homo sapiens
gcuaagaaggaaauuaagu

SEQ ID NO: 193445 - RNA, 19 nt, Homo sapiens
ucucuuaucuaugaccaaa

SEQ ID NO: 193446 - RNA, 19 nt, Homo sapiens
uggagaaguuggacaaugg

SEQ ID NO: 193447 - RNA, 19 nt, Homo sapiens
aggcuaagaaggaaauuaa

SEQ ID NO: 193448 - RNA, 19 nt, Homo sapiens
gaugaugcagugaaacgaa

SEQ ID NO: 193449 - RNA, 19 nt, Homo sapiens
ucaucaaagucuucuggaa

SEQ ID NO: 193450 - RNA, 19 nt, Homo sapiens
caccuucuccuucaucaaa

SEQ ID NO: 193451 - RNA, 19 nt, Homo sapiens
gcuagagcuuggccggauu

SEQ ID NO: 193452 - RNA, 19 nt, Homo sapiens
gacaauacagcaaauuucu

SEQ ID NO: 193453 - RNA, 19 nt, Homo sapiens
cagagacaauacagcaaau

SEQ ID NO: 193454 - RNA, 19 nt, Homo sapiens
gaaacuaugcaggagaaau

SEQ ID NO: 193455 - RNA, 19 nt, Homo sapiens
gaaaggccacuuccgaaaa

SEQ ID NO: 193456 - RNA, 19 nt, Homo sapiens
ucaauaugcgaacacagua

SEQ ID NO: 193457 - RNA, 19 nt, Homo sapiens
guucaaagaguagcacuau

SEQ ID NO: 193458 - RNA, 19 nt, Homo sapiens
ucauuaggaugcugcacaa

SEQ ID NO: 193459 - RNA, 19 nt, Homo sapiens
ggagaaggcuugccgagau

SEQ ID NO: 193460 - RNA, 19 nt, Homo sapiens
gagcugggcuuuccucugu

SEQ ID NO: 193461 - RNA, 19 nt, Homo sapiens
cgaagaaacucaagaagca

SEQ ID NO: 193462 - RNA, 19 nt, Homo sapiens
acaaagaugucaacgaaug

SEQ ID NO: 193463 - RNA, 19 nt, Homo sapiens
gguauucccuuccaugaga

SEQ ID NO: 193464 - RNA, 19 nt, Homo sapiens
gcuucgagcucuccucuga

SEQ ID NO: 193465 - RNA, 19 nt, Homo sapiens
gaaucaaccugggaaguag

SEQ ID NO: 193466 - RNA, 19 nt, Homo sapiens
gagaaggcuugccgagaug

SEQ ID NO: 193467 - RNA, 19 nt, Homo sapiens
gacuaucacuccacgaaga

SEQ ID NO: 193468 - RNA, 19 nt, Homo sapiens
cagggaugcugucaugaaa

SEQ ID NO: 193469 - RNA, 19 nt, Homo sapiens
uagacugcaucaacaagua

SEQ ID NO: 193470 - RNA, 19 nt, Homo sapiens
accaagcgcuucuuucuga

SEQ ID NO: 193471 - RNA, 19 nt, Homo sapiens
uauaaacccucgucuggau

SEQ ID NO: 193472 - RNA, 19 nt, Homo sapiens
ccaagagugugaaguccuu

SEQ ID NO: 193473 - RNA, 19 nt, Homo sapiens
ggaaucuggucaucaaggu

SEQ ID NO: 193474 - RNA, 19 nt, Homo sapiens
ccacgaagaaacucaagaa

SEQ ID NO: 193475 - RNA, 19 nt, Homo sapiens
ugaaucaaccugggaagua

SEQ ID NO: 193476 - RNA, 19 nt, Homo sapiens
ccggguagcuuccacuguu

SEQ ID NO: 193477 - RNA, 19 nt, Homo sapiens
cgaggacuguaucaucuga

SEQ ID NO: 193478 - RNA, 19 nt, Homo sapiens
caagauacuuagacugcau

SEQ ID NO: 193479 - RNA, 19 nt, Homo sapiens
gagcuacaccugccacugu

SEQ ID NO: 193480 - RNA, 19 nt, Homo sapiens
ggacgucgggacugaauca

SEQ ID NO: 193481 - RNA, 19 nt, Homo sapiens
acacgaggaugcagugcuu

SEQ ID NO: 193482 - RNA, 19 nt, Homo sapiens
ggacaccugugaggacauc

SEQ ID NO: 193483 - RNA, 19 nt, Homo sapiens
gagguauucccuuccauga

SEQ ID NO: 193484 - RNA, 19 nt, Homo sapiens
gagcgaggacuguaucauc

SEQ ID NO: 193485 - RNA, 19 nt, Homo sapiens
ccuguaacauaucuguaaa

SEQ ID NO: 193486 - RNA, 19 nt, Homo sapiens
aggaaacggugaaagugaa

SEQ ID NO: 193487 - RNA, 19 nt, Homo sapiens
gccuguaacauaucuguaa

SEQ ID NO: 193488 - RNA, 19 nt, Homo sapiens
gcugggcuuuccucuguga

SEQ ID NO: 193489 - RNA, 19 nt, Homo sapiens
ggagcggcuucgccuucua

SEQ ID NO: 193490 - RNA, 19 nt, Homo sapiens
caggaaacggugaaaguga

SEQ ID NO: 193491 - RNA, 19 nt, Homo sapiens
gacgagggcuuugcguaca

SEQ ID NO: 193492 - RNA, 19 nt, Homo sapiens
gagaagacaccaccaucca

SEQ ID NO: 193493 - RNA, 19 nt, Homo sapiens
cuccagaucugccacaaca

SEQ ID NO: 193494 - RNA, 19 nt, Homo sapiens
gcugagagcugggcuuucc

SEQ ID NO: 193495 - RNA, 19 nt, Homo sapiens
gcggcaggcuucucagucu

SEQ ID NO: 193496 - RNA, 19 nt, Homo sapiens
gcugguagcugaguuugac

SEQ ID NO: 193497 - RNA, 19 nt, Homo sapiens
caacuucuucugccugugu

SEQ ID NO: 193498 - RNA, 19 nt, Homo sapiens
uaaauagugagauggacuu

SEQ ID NO: 193499 - RNA, 19 nt, Homo sapiens
gaacuggcugaacggagaa

SEQ ID NO: 193500 - RNA, 19 nt, Homo sapiens
cgcggaaucuggucaucaa

SEQ ID NO: 193501 - RNA, 19 nt, Homo sapiens
ggaccugccaagacauaga

SEQ ID NO: 193502 - RNA, 19 nt, Homo sapiens
cgcgggagguguucgagaa

SEQ ID NO: 193503 - RNA, 19 nt, Homo sapiens
gcuucuuucugacucuaaa

SEQ ID NO: 193504 - RNA, 19 nt, Homo sapiens
guacaagcacagcgacauc

SEQ ID NO: 193505 - RNA, 19 nt, Homo sapiens
cagaugugccggugacuuc

SEQ ID NO: 193506 - RNA, 19 nt, Homo sapiens
gaccucgugcagccuauaa

SEQ ID NO: 193507 - RNA, 19 nt, Homo sapiens
gggaugcugucaugaaaau

SEQ ID NO: 193508 - RNA, 19 nt, Homo sapiens
gcgcuucuuucugacucua

SEQ ID NO: 193509 - RNA, 19 nt, Homo sapiens
guauucccuuccaugagaa

SEQ ID NO: 193510 - RNA, 19 nt, Homo sapiens
uagacuaucacuccacgaa

SEQ ID NO: 193511 - RNA, 19 nt, Homo sapiens
ccaggaaacggugaaagug

SEQ ID NO: 193512 - RNA, 19 nt, Homo sapiens
ggaccucgugcagccuaua

SEQ ID NO: 193513 - RNA, 19 nt, Homo sapiens
ccagaucugccacaacaag

SEQ ID NO: 193514 - RNA, 19 nt, Homo sapiens
ccucaugggcaacuucuuc

SEQ ID NO: 193515 - RNA, 19 nt, Homo sapiens
gacaccaccauccaggaaa

SEQ ID NO: 193516 - RNA, 19 nt, Homo sapiens
uuaccaagcgcuucuuucu

SEQ ID NO: 193517 - RNA, 19 nt, Homo sapiens
uggcacugguagacuauca

SEQ ID NO: 193518 - RNA, 19 nt, Homo sapiens
cuguggcacugguagacua

SEQ ID NO: 193519 - RNA, 19 nt, Homo sapiens
ucuacagccuggacuacau

SEQ ID NO: 193520 - RNA, 19 nt, Homo sapiens
agacaccaccauccaggaa

SEQ ID NO: 193521 - RNA, 19 nt, Homo sapiens
gcauguggcagacaaucuc

SEQ ID NO: 193522 - RNA, 19 nt, Homo sapiens
auacuuagacugcaucaac

SEQ ID NO: 193523 - RNA, 19 nt, Homo sapiens
uacuuagacugcaucaaca

SEQ ID NO: 193524 - RNA, 19 nt, Homo sapiens
gcgaggaucuugugacuua

SEQ ID NO: 193525 - RNA, 19 nt, Homo sapiens
ucaaggaccugcaguauga

SEQ ID NO: 193526 - RNA, 19 nt, Homo sapiens
agaaacagcucgcaaacua

SEQ ID NO: 193527 - RNA, 19 nt, Homo sapiens
caacacaccugagagaauu

SEQ ID NO: 193528 - RNA, 19 nt, Homo sapiens
gaacucgacuugcggagaa

SEQ ID NO: 193529 - RNA, 19 nt, Homo sapiens
gcacaaagcccgcucuguu

SEQ ID NO: 193530 - RNA, 19 nt, Homo sapiens
ggaguuggcucagaugaaa

SEQ ID NO: 193531 - RNA, 19 nt, Homo sapiens
ggaggcagcuggaggagaa

SEQ ID NO: 193532 - RNA, 19 nt, Homo sapiens
gaagaaaggcaaagccaaa

SEQ ID NO: 193533 - RNA, 19 nt, Homo sapiens
gaaaaccucugucaacaaa

SEQ ID NO: 193534 - RNA, 19 nt, Homo sapiens
gaacaaagaccgggagaug

SEQ ID NO: 193535 - RNA, 19 nt, Homo sapiens
gaggcaaguucgagaaauu

SEQ ID NO: 193536 - RNA, 19 nt, Homo sapiens
ucaccgacauuaagaacua

SEQ ID NO: 193537 - RNA, 19 nt, Homo sapiens
ucaagaaccucgugcuaga

SEQ ID NO: 193538 - RNA, 19 nt, Homo sapiens
ucaugaagcuggcacagaa

SEQ ID NO: 193539 - RNA, 19 nt, Homo sapiens
gcuguuagguccugcaguu

SEQ ID NO: 193540 - RNA, 19 nt, Homo sapiens
agacugagcuccacgaagu

SEQ ID NO: 193541 - RNA, 19 nt, Homo sapiens
gaaaucacaacacagagaa

SEQ ID NO: 193542 - RNA, 19 nt, Homo sapiens
gugggagcaugaaguguua

SEQ ID NO: 193543 - RNA, 19 nt, Homo sapiens
ggaaaucacaacacagaga

SEQ ID NO: 193544 - RNA, 19 nt, Homo sapiens
agaaggaggugcaguucaa

SEQ ID NO: 193545 - RNA, 19 nt, Homo sapiens
ccagugaggugguggugaa

SEQ ID NO: 193546 - RNA, 19 nt, Homo sapiens
ugacggguguguccucgua

SEQ ID NO: 193547 - RNA, 19 nt, Homo sapiens
aaaccucugucaacaaaga

SEQ ID NO: 193548 - RNA, 19 nt, Homo sapiens
aaauugaggccaaguauga

SEQ ID NO: 193549 - RNA, 19 nt, Homo sapiens
gggacaagauccacaccuu

SEQ ID NO: 193550 - RNA, 19 nt, Homo sapiens
gcucucaccuccacaugug

SEQ ID NO: 193551 - RNA, 19 nt, Homo sapiens
gaggaagaauggccagauc

SEQ ID NO: 193552 - RNA, 19 nt, Homo sapiens
guaggugccugccuucauc

SEQ ID NO: 193553 - RNA, 19 nt, Homo sapiens
ggcacuaacuucauugaca

SEQ ID NO: 193554 - RNA, 19 nt, Homo sapiens
gagaaauugaggccaagua

SEQ ID NO: 193555 - RNA, 19 nt, Homo sapiens
ugagggcacuguagucaug

SEQ ID NO: 193556 - RNA, 19 nt, Homo sapiens
caauuuaucccaugagcaa

SEQ ID NO: 193557 - RNA, 19 nt, Homo sapiens
gagggacacuccacagaag

SEQ ID NO: 193558 - RNA, 19 nt, Homo sapiens
ugagcgagaugcagaaaca

SEQ ID NO: 193559 - RNA, 19 nt, Homo sapiens
gaaauugaggccaaguaug

SEQ ID NO: 193560 - RNA, 19 nt, Homo sapiens
gauagcagcaaaccaccua

SEQ ID NO: 193561 - RNA, 19 nt, Homo sapiens
ugaagaaccugcggcugaa

SEQ ID NO: 193562 - RNA, 19 nt, Homo sapiens
agaacaaccugacagagau

SEQ ID NO: 193563 - RNA, 19 nt, Homo sapiens
cagaacaaccugacagaga

SEQ ID NO: 193564 - RNA, 19 nt, Homo sapiens
uauaugagcaccagaacaa

SEQ ID NO: 193565 - RNA, 19 nt, Homo sapiens
ugucgaaggugagcuugua

SEQ ID NO: 193566 - RNA, 19 nt, Homo sapiens
gaacuacuacaacgacauc

SEQ ID NO: 193567 - RNA, 19 nt, Homo sapiens
gaaagggaagaaaggcaaa

SEQ ID NO: 193568 - RNA, 19 nt, Homo sapiens
acagaaagagcaccgcaua

SEQ ID NO: 193569 - RNA, 19 nt, Homo sapiens
aaaagucucccacaauuua

SEQ ID NO: 193570 - RNA, 19 nt, Homo sapiens
ucaccaggaugcggaauga

SEQ ID NO: 193571 - RNA, 19 nt, Homo sapiens
ccacugcccugucuuuagg

SEQ ID NO: 193572 - RNA, 19 nt, Homo sapiens
gaagaaggaggugcaguuc

SEQ ID NO: 193573 - RNA, 19 nt, Homo sapiens
ggccaaguaugauaagaag

SEQ ID NO: 193574 - RNA, 19 nt, Homo sapiens
agcaggagcuggccaguga

SEQ ID NO: 193575 - RNA, 19 nt, Homo sapiens
ccagagaaccagccuagga

SEQ ID NO: 193576 - RNA, 19 nt, Homo sapiens
ccaaguaugauaagaagau

SEQ ID NO: 193577 - RNA, 19 nt, Homo sapiens
gugaggugguggugaagaa

SEQ ID NO: 193578 - RNA, 19 nt, Homo sapiens
gggagaaagagcugaaaga

SEQ ID NO: 193579 - RNA, 19 nt, Homo sapiens
gggaggagaugagcgagau

SEQ ID NO: 193580 - RNA, 19 nt, Homo sapiens
ccaggaugcggaaugauuu

SEQ ID NO: 193581 - RNA, 19 nt, Homo sapiens
gagaggcaaguucgagaaa

SEQ ID NO: 193582 - RNA, 19 nt, Homo sapiens
ccgaggagaucaccaggau

SEQ ID NO: 193583 - RNA, 19 nt, Homo sapiens
gaacaaccugacagagaug

SEQ ID NO: 193584 - RNA, 19 nt, Homo sapiens
cagaggacaugagcaagga

SEQ ID NO: 193585 - RNA, 19 nt, Homo sapiens
gaagaacagcaccaucaag

SEQ ID NO: 193586 - RNA, 19 nt, Homo sapiens
gaaagagcaccgcauacag

SEQ ID NO: 193587 - RNA, 19 nt, Homo sapiens
gcacuguagucaugaagcu

SEQ ID NO: 193588 - RNA, 19 nt, Homo sapiens
uaggaaaucacaacacaga

SEQ ID NO: 193589 - RNA, 19 nt, Homo sapiens
gacgagcucuaucggaagu

SEQ ID NO: 193590 - RNA, 19 nt, Homo sapiens
gcagugggagcaugaagug

SEQ ID NO: 193591 - RNA, 19 nt, Homo sapiens
gcgcugugcugccugucuu

SEQ ID NO: 193592 - RNA, 19 nt, Homo sapiens
cagaagacaggguucaaga

SEQ ID NO: 193593 - RNA, 19 nt, Homo sapiens
caaguaugauaagaagaug

SEQ ID NO: 193594 - RNA, 19 nt, Homo sapiens
cacaaagcccgcucuguug

SEQ ID NO: 193595 - RNA, 19 nt, Homo sapiens
caccaaggacagcaaguuu

SEQ ID NO: 193596 - RNA, 19 nt, Homo sapiens
cagagaaccagccuaggaa

SEQ ID NO: 193597 - RNA, 19 nt, Homo sapiens
gaaacacaccgaggagauc

SEQ ID NO: 193598 - RNA, 19 nt, Homo sapiens
agccaaugcucccugauga

SEQ ID NO: 193599 - RNA, 19 nt, Homo sapiens
ggacaacgugggcuucaag

SEQ ID NO: 193600 - RNA, 19 nt, Homo sapiens
acaaagaccgggagaugga

SEQ ID NO: 193601 - RNA, 19 nt, Homo sapiens
uggcagacccucuccagaa

SEQ ID NO: 193602 - RNA, 19 nt, Homo sapiens
cgacaucacccucaacaac

SEQ ID NO: 193603 - RNA, 19 nt, Homo sapiens
gggaggaacgaaacuacuu

SEQ ID NO: 193604 - RNA, 19 nt, Homo sapiens
cagauuuucucuaugcaua

SEQ ID NO: 193605 - RNA, 19 nt, Homo sapiens
ggagaggccaggagagagu

SEQ ID NO: 193606 - RNA, 19 nt, Homo sapiens
uccaggaggugcagcagaa

SEQ ID NO: 193607 - RNA, 19 nt, Homo sapiens
ggcagacccucuccagaag

SEQ ID NO: 193608 - RNA, 19 nt, Homo sapiens
gagggacgaacucgacuug

SEQ ID NO: 193609 - RNA, 19 nt, Homo sapiens
aggcugagcugcggaacaa

SEQ ID NO: 193610 - RNA, 19 nt, Homo sapiens
ggaggaacgaaacuacuuc

SEQ ID NO: 193611 - RNA, 19 nt, Homo sapiens
acauguggguagaagcuuu

SEQ ID NO: 193612 - RNA, 19 nt, Homo sapiens
ccaacacaccugagagaau

SEQ ID NO: 193613 - RNA, 19 nt, Homo sapiens
gaaccagccuaggaacacu

SEQ ID NO: 193614 - RNA, 19 nt, Homo sapiens
gcuggaggauguucuugag

SEQ ID NO: 193615 - RNA, 19 nt, Homo sapiens
agaagaaggaggugcaguu

SEQ ID NO: 193616 - RNA, 19 nt, Homo sapiens
gcagaaacagcucgcaaac

SEQ ID NO: 193617 - RNA, 19 nt, Homo sapiens
auaagaagaugaagaugcu

SEQ ID NO: 193618 - RNA, 19 nt, Homo sapiens
acaaagcccgcucuguuga

SEQ ID NO: 193619 - RNA, 19 nt, Homo sapiens
caucaaggaccugcaguau

SEQ ID NO: 193620 - RNA, 19 nt, Homo sapiens
ucaacaaccuggcccucau

SEQ ID NO: 193621 - RNA, 19 nt, Homo sapiens
gaagaaccugcggcugaaa

SEQ ID NO: 193622 - RNA, 19 nt, Homo sapiens
ggacaugcgggcacugaag

SEQ ID NO: 193623 - RNA, 19 nt, Homo sapiens
gacaagauccacaccuucu

SEQ ID NO: 193624 - RNA, 19 nt, Homo sapiens
uggaagaucuggauggaaa

SEQ ID NO: 193625 - RNA, 19 nt, Homo sapiens
acacugagcuugccacauc

SEQ ID NO: 193626 - RNA, 19 nt, Homo sapiens
ccaagaagcgccugauugu

SEQ ID NO: 193627 - RNA, 19 nt, Homo sapiens
ggacaggccacuaccuaug

SEQ ID NO: 193628 - RNA, 19 nt, Homo sapiens
gaccugcacugccuucauc

SEQ ID NO: 193629 - RNA, 19 nt, Homo sapiens
ggacaggacaggccacuac

SEQ ID NO: 193630 - RNA, 19 nt, Homo sapiens
gaaggaugguauucagacu

SEQ ID NO: 193631 - RNA, 19 nt, Homo sapiens
aagaagcgccugauuguca

SEQ ID NO: 193632 - RNA, 19 nt, Homo sapiens
caggugaaccggccacuga

SEQ ID NO: 193633 - RNA, 19 nt, Homo sapiens
gcucuacccugccucaacu

SEQ ID NO: 193634 - RNA, 19 nt, Homo sapiens
cugcggcacuggccuacua

SEQ ID NO: 193635 - RNA, 19 nt, Homo sapiens
uuagccaccucaugccuuu

SEQ ID NO: 193636 - RNA, 19 nt, Homo sapiens
acccauugcucaacuguau

SEQ ID NO: 193637 - RNA, 19 nt, Homo sapiens
gcggaaggaugguauucag

SEQ ID NO: 193638 - RNA, 19 nt, Homo sapiens
caggacaggccacuaccua

SEQ ID NO: 193639 - RNA, 19 nt, Homo sapiens
caagaugaaugggcagaac

SEQ ID NO: 193640 - RNA, 19 nt, Homo sapiens
cacaggagcagccgaagga

SEQ ID NO: 193641 - RNA, 19 nt, Homo sapiens
gaugguauucagacucgaa

SEQ ID NO: 193642 - RNA, 19 nt, Homo sapiens
caacgccugcggccucuau

SEQ ID NO: 193643 - RNA, 19 nt, Homo sapiens
ucaauucagcagccuauuc

SEQ ID NO: 193644 - RNA, 19 nt, Homo sapiens
gcugaggccuacagacacu

SEQ ID NO: 193645 - RNA, 19 nt, Homo sapiens
cccaagaagcgccugauug

SEQ ID NO: 193646 - RNA, 19 nt, Homo sapiens
uggagacuuugaagacaga

SEQ ID NO: 193647 - RNA, 19 nt, Homo sapiens
cguggaagaucuggaugga

SEQ ID NO: 193648 - RNA, 19 nt, Homo sapiens
guacugcccaucucuacca

SEQ ID NO: 193649 - RNA, 19 nt, Homo sapiens
ccugcggccucuacuacaa

SEQ ID NO: 193650 - RNA, 19 nt, Homo sapiens
cggccucuaucacaagaug

SEQ ID NO: 193651 - RNA, 19 nt, Homo sapiens
ucuuucagguguacccauu

SEQ ID NO: 193652 - RNA, 19 nt, Homo sapiens
acacuguggcggagaaaug

SEQ ID NO: 193653 - RNA, 19 nt, Homo sapiens
gcccaagaagcgccugauu

SEQ ID NO: 193654 - RNA, 19 nt, Homo sapiens
uacccugccucaacugugu

SEQ ID NO: 193655 - RNA, 19 nt, Homo sapiens
ggacgcugaggccuacaga

SEQ ID NO: 193656 - RNA, 19 nt, Homo sapiens
ggcccugacuuuuccagua

SEQ ID NO: 193657 - RNA, 19 nt, Homo sapiens
gguacucagugcaccaacu

SEQ ID NO: 193658 - RNA, 19 nt, Homo sapiens
ugugugaacugcggagcaa

SEQ ID NO: 193659 - RNA, 19 nt, Homo sapiens
cuauuccucucccaagcuu

SEQ ID NO: 193660 - RNA, 19 nt, Homo sapiens
guaaacgggcagguacuca

SEQ ID NO: 193661 - RNA, 19 nt, Homo sapiens
gaaaaggcagcaccagcuu

SEQ ID NO: 193662 - RNA, 19 nt, Homo sapiens
gaacaacaaggacaacuuu

SEQ ID NO: 193663 - RNA, 19 nt, Homo sapiens
gcugaugaguuaauuguuu

SEQ ID NO: 193664 - RNA, 19 nt, Homo sapiens
caaagugcaugcaggagaa

SEQ ID NO: 193665 - RNA, 19 nt, Homo sapiens
ucgaggagcugucaaagug

SEQ ID NO: 193666 - RNA, 19 nt, Homo sapiens
caacaaggacaacuuuaug

SEQ ID NO: 193667 - RNA, 19 nt, Homo sapiens
guugggagcuuugcaauuc

SEQ ID NO: 193668 - RNA, 19 nt, Homo sapiens
aggcuuaacucgcugauga

SEQ ID NO: 193669 - RNA, 19 nt, Homo sapiens
ggacaacuuuauguagaga

SEQ ID NO: 193670 - RNA, 19 nt, Homo sapiens
gggcagaaccgaccacuca

SEQ ID NO: 193671 - RNA, 19 nt, Homo sapiens
acuacaagcugcacaaugu

SEQ ID NO: 193672 - RNA, 19 nt, Homo sapiens
gaagagccggcaccuguug

SEQ ID NO: 193673 - RNA, 19 nt, Homo sapiens
gggcgguccugcacagauu

SEQ ID NO: 193674 - RNA, 19 nt, Homo sapiens
gaaccgaccacucaucaag

SEQ ID NO: 193675 - RNA, 19 nt, Homo sapiens
gcaaggcucguuccuguuc

SEQ ID NO: 193676 - RNA, 19 nt, Homo sapiens
gcccaggccuagcuacuau

SEQ ID NO: 193677 - RNA, 19 nt, Homo sapiens
gacgacaaccaccaccuua

SEQ ID NO: 193678 - RNA, 19 nt, Homo sapiens
aaggacaacuuuauguaga

SEQ ID NO: 193679 - RNA, 19 nt, Homo sapiens
cggaagauguccaacaagu

SEQ ID NO: 193680 - RNA, 19 nt, Homo sapiens
ggccgaagcugcugugacu

SEQ ID NO: 193681 - RNA, 19 nt, Homo sapiens
gagauccauugugcucuaa

SEQ ID NO: 193682 - RNA, 19 nt, Homo sapiens
gcacccagccugcuacaca

SEQ ID NO: 193683 - RNA, 19 nt, Homo sapiens
acaaggacaacuuuaugua

SEQ ID NO: 193684 - RNA, 19 nt, Homo sapiens
gaggcccacucucugugua

SEQ ID NO: 193685 - RNA, 19 nt, Homo sapiens
cgacaaccaccaccuuaug

SEQ ID NO: 193686 - RNA, 19 nt, Homo sapiens
caaggacaacuuuauguag

SEQ ID NO: 193687 - RNA, 19 nt, Homo sapiens
gcucguuccuguucagaag

SEQ ID NO: 193688 - RNA, 19 nt, Homo sapiens
uggcuucccucucugaaau

SEQ ID NO: 193689 - RNA, 19 nt, Homo sapiens
gauccauugugcucuaaag

SEQ ID NO: 193690 - RNA, 19 nt, Homo sapiens
ccaagaagagcaagaaagg

SEQ ID NO: 193691 - RNA, 19 nt, Homo sapiens
uacaagcugcacaauguua

SEQ ID NO: 193692 - RNA, 19 nt, Homo sapiens
ccuguggccucuacuacaa

SEQ ID NO: 193693 - RNA, 19 nt, Homo sapiens
ugacggagagcaugaagau

SEQ ID NO: 193694 - RNA, 19 nt, Homo sapiens
caggaaggaaacaacauuu

SEQ ID NO: 193695 - RNA, 19 nt, Homo sapiens
guggacgucuucuucaauc

SEQ ID NO: 193696 - RNA, 19 nt, Homo sapiens
ggacaguuguuuggagaac

SEQ ID NO: 193697 - RNA, 19 nt, Homo sapiens
acaacaaggacaacuuuau

SEQ ID NO: 193698 - RNA, 19 nt, Homo sapiens
caacgccuguggccucuac

SEQ ID NO: 193699 - RNA, 19 nt, Homo sapiens
gcccugcuaugaaaggaau

SEQ ID NO: 193700 - RNA, 19 nt, Homo sapiens
uccaacaaguccaagaaga

SEQ ID NO: 193701 - RNA, 19 nt, Homo sapiens
ggaagauguccaacaaguc

SEQ ID NO: 193702 - RNA, 19 nt, Homo sapiens
acaggccacugaccaugaa

SEQ ID NO: 193703 - RNA, 19 nt, Homo sapiens
caagaugaaugggcagaac

SEQ ID NO: 193704 - RNA, 19 nt, Homo sapiens
cagacgaaggcaaccauuu

SEQ ID NO: 193705 - RNA, 19 nt, Homo sapiens
cgagguggacgucuucuuc

SEQ ID NO: 193706 - RNA, 19 nt, Homo sapiens
gaacuccuucacucucaga

SEQ ID NO: 193707 - RNA, 19 nt, Homo sapiens
gaaggaagggauccagacu

SEQ ID NO: 193708 - RNA, 19 nt, Homo sapiens
cggaacuccuucacucuca

SEQ ID NO: 193709 - RNA, 19 nt, Homo sapiens
gugagcuggugccugcuuu

SEQ ID NO: 193710 - RNA, 19 nt, Homo sapiens
gggauuggcggguccacuu

SEQ ID NO: 193711 - RNA, 19 nt, Homo sapiens
cagaaccgaccacucauca

SEQ ID NO: 193712 - RNA, 19 nt, Homo sapiens
gcagaaccgaccacucauc

SEQ ID NO: 193713 - RNA, 19 nt, Homo sapiens
gagcuggugccugcuuuga

SEQ ID NO: 193714 - RNA, 19 nt, Homo sapiens
aauguuaacaggccacuga

SEQ ID NO: 193715 - RNA, 19 nt, Homo sapiens
cacucuggcucccaccuuu

SEQ ID NO: 193716 - RNA, 19 nt, Homo sapiens
cggagagcaugaagaugga

SEQ ID NO: 193717 - RNA, 19 nt, Homo sapiens
acaggaaggaaacaacauu

SEQ ID NO: 193718 - RNA, 19 nt, Homo sapiens
cuacagcagcggacucuuc

SEQ ID NO: 193719 - RNA, 19 nt, Homo sapiens
ccaacaaguccaagaagag

SEQ ID NO: 193720 - RNA, 19 nt, Homo sapiens
gagagcaugaagauggaaa

SEQ ID NO: 193721 - RNA, 19 nt, Homo sapiens
ucacugacggagagcauga

SEQ ID NO: 193722 - RNA, 19 nt, Homo sapiens
gagguggacgucuucuuca

SEQ ID NO: 193723 - RNA, 19 nt, Homo sapiens
accggaagauguccaacaa

SEQ ID NO: 193724 - RNA, 19 nt, Homo sapiens
acaagcugcacaauguuaa

SEQ ID NO: 193725 - RNA, 19 nt, Homo sapiens
ucacaggaaggaaacaaca

SEQ ID NO: 193726 - RNA, 19 nt, Homo sapiens
gacaaccaccaccuuaugg

SEQ ID NO: 193727 - RNA, 19 nt, Homo sapiens
ggauuggcggguccacuug

SEQ ID NO: 193728 - RNA, 19 nt, Homo sapiens
gcaugcaggagaagucauc

SEQ ID NO: 193729 - RNA, 19 nt, Homo sapiens
gccacuaccugugcaaugc

SEQ ID NO: 193730 - RNA, 19 nt, Homo sapiens
gagcccugcuaugaaagga

SEQ ID NO: 193731 - RNA, 19 nt, Homo sapiens
ggaaccggaagauguccaa

SEQ ID NO: 193732 - RNA, 19 nt, Homo sapiens
ggccacugaccaugaagaa

SEQ ID NO: 193733 - RNA, 19 nt, Homo sapiens
caccuguugugcaaauugu

SEQ ID NO: 193734 - RNA, 19 nt, Homo sapiens
caaggcucguuccuguuca

SEQ ID NO: 193735 - RNA, 19 nt, Homo sapiens
ucaaguaccaggugucacu

SEQ ID NO: 193736 - RNA, 19 nt, Homo sapiens
gguugggagcuuugcaauu

SEQ ID NO: 193737 - RNA, 19 nt, Homo sapiens
gguggacgucuucuucaau

SEQ ID NO: 193738 - RNA, 19 nt, Homo sapiens
ugcccuggcuggacacaug

SEQ ID NO: 193739 - RNA, 19 nt, Homo sapiens
ccacgccacccaaagaagu

SEQ ID NO: 193740 - RNA, 19 nt, Homo sapiens
ggaggcccacucucugugu

SEQ ID NO: 193741 - RNA, 19 nt, Homo sapiens
acucggaaccggaagaugu

SEQ ID NO: 193742 - RNA, 19 nt, Homo sapiens
ccgggagugugucaacugu

SEQ ID NO: 193743 - RNA, 19 nt, Homo sapiens
aacaacaaggacaacuuua

SEQ ID NO: 193744 - RNA, 19 nt, Homo sapiens
agaacaacaaggacaacuu

SEQ ID NO: 193745 - RNA, 19 nt, Homo sapiens
gcuucgaggagcugucaaa

SEQ ID NO: 193746 - RNA, 19 nt, Homo sapiens
caucaagcccaagcgaaga

SEQ ID NO: 193747 - RNA, 19 nt, Homo sapiens
caaugccuguggccucuac

SEQ ID NO: 193748 - RNA, 19 nt, Homo sapiens
gaaacuaggucugauauuc

SEQ ID NO: 193749 - RNA, 19 nt, Homo sapiens
gaacugcuuucuuucguuu

SEQ ID NO: 193750 - RNA, 19 nt, Homo sapiens
gaacaagucccuguaauug

SEQ ID NO: 193751 - RNA, 19 nt, Homo sapiens
agaccgaacuguuguauaa

SEQ ID NO: 193752 - RNA, 19 nt, Homo sapiens
gaagaaacuaggucugaua

SEQ ID NO: 193753 - RNA, 19 nt, Homo sapiens
gagaaauaguguggaaauu

SEQ ID NO: 193754 - RNA, 19 nt, Homo sapiens
ggucugauauucaaaugga

SEQ ID NO: 193755 - RNA, 19 nt, Homo sapiens
acuacaagcuucacaauau

SEQ ID NO: 193756 - RNA, 19 nt, Homo sapiens
gcaguaucaugaagccuaa

SEQ ID NO: 193757 - RNA, 19 nt, Homo sapiens
acaguuguuugaugcauua

SEQ ID NO: 193758 - RNA, 19 nt, Homo sapiens
gaaauacuguacaaugacu

SEQ ID NO: 193759 - RNA, 19 nt, Homo sapiens
gagaaagagugccucaagu

SEQ ID NO: 193760 - RNA, 19 nt, Homo sapiens
cuacaagcuucacaauauu

SEQ ID NO: 193761 - RNA, 19 nt, Homo sapiens
ggagaaauaguguggaaau

SEQ ID NO: 193762 - RNA, 19 nt, Homo sapiens
gaauaugggagaaauagug

SEQ ID NO: 193763 - RNA, 19 nt, Homo sapiens
ccaagaacagcucguuuaa

SEQ ID NO: 193764 - RNA, 19 nt, Homo sapiens
gcaaaggaaauaccaguuc

SEQ ID NO: 193765 - RNA, 19 nt, Homo sapiens
guacagcuccggacucuuc

SEQ ID NO: 193766 - RNA, 19 nt, Homo sapiens
agaaagagugccucaagua

SEQ ID NO: 193767 - RNA, 19 nt, Homo sapiens
caaaggaaauaccaguucu

SEQ ID NO: 193768 - RNA, 19 nt, Homo sapiens
gaaggcauccagaccagaa

SEQ ID NO: 193769 - RNA, 19 nt, Homo sapiens
guguggaaauuaagaagaa

SEQ ID NO: 193770 - RNA, 19 nt, Homo sapiens
uaaggaauaugggagaaau

SEQ ID NO: 193771 - RNA, 19 nt, Homo sapiens
gaaagagugccucaaguac

SEQ ID NO: 193772 - RNA, 19 nt, Homo sapiens
ugaacaagucccuguaauu

SEQ ID NO: 193773 - RNA, 19 nt, Homo sapiens
guucaccaguugccauuga

SEQ ID NO: 193774 - RNA, 19 nt, Homo sapiens
ccugugggcucuacuacaa

SEQ ID NO: 193775 - RNA, 19 nt, Homo sapiens
aauaagccauucugacuca

SEQ ID NO: 193776 - RNA, 19 nt, Homo sapiens
cccaagaacagcucguuua

SEQ ID NO: 193777 - RNA, 19 nt, Homo sapiens
ccgaacuguuguauaaauu

SEQ ID NO: 193778 - RNA, 19 nt, Homo sapiens
guaggcgaaucauuuguuc

SEQ ID NO: 193779 - RNA, 19 nt, Homo sapiens
caugaaggaugccaagaag

SEQ ID NO: 193780 - RNA, 19 nt, Homo sapiens
gcagaaagcaaaauuaugu

SEQ ID NO: 193781 - RNA, 19 nt, Homo sapiens
ugacucauauccccuauuu

SEQ ID NO: 193782 - RNA, 19 nt, Homo sapiens
gugaacaagucccuguaau

SEQ ID NO: 193783 - RNA, 19 nt, Homo sapiens
uccugaacauugcauauaa

SEQ ID NO: 193784 - RNA, 19 nt, Homo sapiens
gcuguuggcccucugcaaa

SEQ ID NO: 193785 - RNA, 19 nt, Homo sapiens
aaacuaggucugauauuca

SEQ ID NO: 193786 - RNA, 19 nt, Homo sapiens
ucacuguggugucuguguu

SEQ ID NO: 193787 - RNA, 19 nt, Homo sapiens
ccaccgaaagcaaaucauu

SEQ ID NO: 193788 - RNA, 19 nt, Homo sapiens
ggucucuagugcugugaaa

SEQ ID NO: 193789 - RNA, 19 nt, Homo sapiens
gcccgcaccucuucaccuu

SEQ ID NO: 193790 - RNA, 19 nt, Homo sapiens
aagaacagcucguuuaacc

SEQ ID NO: 193791 - RNA, 19 nt, Homo sapiens
gcaggagcaguaucaugaa

SEQ ID NO: 193792 - RNA, 19 nt, Homo sapiens
caguugccauugaggguuu

SEQ ID NO: 193793 - RNA, 19 nt, Homo sapiens
cgagaaagagugccucaag

SEQ ID NO: 193794 - RNA, 19 nt, Homo sapiens
ugggagaaauaguguggaa

SEQ ID NO: 193795 - RNA, 19 nt, Homo sapiens
ggaggaggaaugccaaugg

SEQ ID NO: 193796 - RNA, 19 nt, Homo sapiens
cugcuagucuuaagaacug

SEQ ID NO: 193797 - RNA, 19 nt, Homo sapiens
uaagccauucugacucaua

SEQ ID NO: 193798 - RNA, 19 nt, Homo sapiens
gcaccaaaauaagaaaaga

SEQ ID NO: 193799 - RNA, 19 nt, Homo sapiens
aggccuacaugcuuuguga

SEQ ID NO: 193800 - RNA, 19 nt, Homo sapiens
gcagggagugugugaacug

SEQ ID NO: 193801 - RNA, 19 nt, Homo sapiens
aagaagaaacuaggucuga

SEQ ID NO: 193802 - RNA, 19 nt, Homo sapiens
ggagcucacuguggugucu

SEQ ID NO: 193803 - RNA, 19 nt, Homo sapiens
ccauugaggguuucagaga

SEQ ID NO: 193804 - RNA, 19 nt, Homo sapiens
caaucaguguuaccguuca

SEQ ID NO: 193805 - RNA, 19 nt, Homo sapiens
aagccauucugacucauau

SEQ ID NO: 193806 - RNA, 19 nt, Homo sapiens
ugcaggagcaguaucauga

SEQ ID NO: 193807 - RNA, 19 nt, Homo sapiens
cauccagccuguccuuugg

SEQ ID NO: 193808 - RNA, 19 nt, Homo sapiens
cacaguuguuugaugcauu

SEQ ID NO: 193809 - RNA, 19 nt, Homo sapiens
gaaggcagaaagcaaaauu

SEQ ID NO: 193810 - RNA, 19 nt, Homo sapiens
agaagaaacuaggucugau

SEQ ID NO: 193811 - RNA, 19 nt, Homo sapiens
aagagugccucaaguacca

SEQ ID NO: 193812 - RNA, 19 nt, Homo sapiens
ccugcgggcucuaucacaa

SEQ ID NO: 193813 - RNA, 19 nt, Homo sapiens
uuacugcuagucuuaagaa

SEQ ID NO: 193814 - RNA, 19 nt, Homo sapiens
acucauauccccuauuuaa

SEQ ID NO: 193815 - RNA, 19 nt, Homo sapiens
accgaacuguuguauaaau

SEQ ID NO: 193816 - RNA, 19 nt, Homo sapiens
guuguaggcgaaucauuug

SEQ ID NO: 193817 - RNA, 19 nt, Homo sapiens
aguuguaggcgaaucauuu

SEQ ID NO: 193818 - RNA, 19 nt, Homo sapiens
aacuaggucugauauucaa

SEQ ID NO: 193819 - RNA, 19 nt, Homo sapiens
aagaaacuaggucugauau

SEQ ID NO: 193820 - RNA, 19 nt, Homo sapiens
gagauggcacgggacacua

SEQ ID NO: 193821 - RNA, 19 nt, Homo sapiens
ggaauaugggagaaauagu

SEQ ID NO: 193822 - RNA, 19 nt, Homo sapiens
caggagcaguaucaugaag

SEQ ID NO: 193823 - RNA, 19 nt, Homo sapiens
uacuacaagcuucacaaua

SEQ ID NO: 193824 - RNA, 19 nt, Homo sapiens
ucaaagcaccaaaauaaga

SEQ ID NO: 193825 - RNA, 19 nt, Homo sapiens
cgaaagcaaaucauucaac

SEQ ID NO: 193826 - RNA, 19 nt, Homo sapiens
gcuucacaauauuaacaga

SEQ ID NO: 193827 - RNA, 19 nt, Homo sapiens
guguuaccguucaccaguu

SEQ ID NO: 193828 - RNA, 19 nt, Homo sapiens
ccacaguuguuugaugcau

SEQ ID NO: 193829 - RNA, 19 nt, Homo sapiens
ggguagcuguaaggcauga

SEQ ID NO: 193830 - RNA, 19 nt, Homo sapiens
gaccgaacuguuguauaaa

SEQ ID NO: 193831 - RNA, 19 nt, Homo sapiens
caaagcaccaaaauaagaa

SEQ ID NO: 193832 - RNA, 19 nt, Homo sapiens
uaggucugauauucaaaug

SEQ ID NO: 193833 - RNA, 19 nt, Homo sapiens
ggaggagguggaugugcuu

SEQ ID NO: 193834 - RNA, 19 nt, Homo sapiens
aauuauguuugccacuuug

SEQ ID NO: 193835 - RNA, 19 nt, Homo sapiens
ccauccagccuguccuuug

SEQ ID NO: 193836 - RNA, 19 nt, Homo sapiens
gcaucuggguagcuguaag

SEQ ID NO: 193837 - RNA, 19 nt, Homo sapiens
ugugaacaagucccuguaa

SEQ ID NO: 193838 - RNA, 19 nt, Homo sapiens
uggccacaguuguuugaug

SEQ ID NO: 193839 - RNA, 19 nt, Homo sapiens
ccucagccacuccuacaug

SEQ ID NO: 193840 - RNA, 19 nt, Homo sapiens
caucugugaauaagccauu

SEQ ID NO: 193841 - RNA, 19 nt, Homo sapiens
caccgaaagcaaaucauuc

SEQ ID NO: 193842 - RNA, 19 nt, Homo sapiens
cagaccgaacuguuguaua

SEQ ID NO: 193843 - RNA, 19 nt, Homo sapiens
caagucccuguaauuguug

SEQ ID NO: 193844 - RNA, 19 nt, Homo sapiens
agccacaucucgcccuuca

SEQ ID NO: 193845 - RNA, 19 nt, Homo sapiens
cuacuacaagcuucacaau

SEQ ID NO: 193846 - RNA, 19 nt, Homo sapiens
ccaagaaccugaauaaauc

SEQ ID NO: 193847 - RNA, 19 nt, Homo sapiens
ggaagcggguguuggauuu

SEQ ID NO: 193848 - RNA, 19 nt, Homo sapiens
gguaaugacuccagaacaa

SEQ ID NO: 193849 - RNA, 19 nt, Homo sapiens
gcucaaugcuggauuuaau

SEQ ID NO: 193850 - RNA, 19 nt, Homo sapiens
uaccaaaucugacuccaaa

SEQ ID NO: 193851 - RNA, 19 nt, Homo sapiens
gaacaacaacugggaagaa

SEQ ID NO: 193852 - RNA, 19 nt, Homo sapiens
ggacauaaucacugcguaa

SEQ ID NO: 193853 - RNA, 19 nt, Homo sapiens
ccucuucccuccucaaauu

SEQ ID NO: 193854 - RNA, 19 nt, Homo sapiens
ggacuuggaggauagcaaa

SEQ ID NO: 193855 - RNA, 19 nt, Homo sapiens
gcagggaccauguaucaga

SEQ ID NO: 193856 - RNA, 19 nt, Homo sapiens
aaaugcagcuggcaacuuc

SEQ ID NO: 193857 - RNA, 19 nt, Homo sapiens
cgaaggaucugagaacaag

SEQ ID NO: 193858 - RNA, 19 nt, Homo sapiens
gcccaggccucuugcaaug

SEQ ID NO: 193859 - RNA, 19 nt, Homo sapiens
cgaaugacggcaucuguuu

SEQ ID NO: 193860 - RNA, 19 nt, Homo sapiens
cauaaucacugcguaaucu

SEQ ID NO: 193861 - RNA, 19 nt, Homo sapiens
gaaccugaauaaaucuaag

SEQ ID NO: 193862 - RNA, 19 nt, Homo sapiens
caacugggaagaaacuuga

SEQ ID NO: 193863 - RNA, 19 nt, Homo sapiens
ccacgcauauuaucguugu

SEQ ID NO: 193864 - RNA, 19 nt, Homo sapiens
ccacagcgcagccucauca

SEQ ID NO: 193865 - RNA, 19 nt, Homo sapiens
cccaagaaccugaauaaau

SEQ ID NO: 193866 - RNA, 19 nt, Homo sapiens
guuccucccacgcauauua

SEQ ID NO: 193867 - RNA, 19 nt, Homo sapiens
aagcaggacucuuggaaca

SEQ ID NO: 193868 - RNA, 19 nt, Homo sapiens
gcagagagugugucaacug

SEQ ID NO: 193869 - RNA, 19 nt, Homo sapiens
ggccuccucugccugguaa

SEQ ID NO: 193870 - RNA, 19 nt, Homo sapiens
cagagagugugucaacugu

SEQ ID NO: 193871 - RNA, 19 nt, Homo sapiens
gaaugacggcaucuguuug

SEQ ID NO: 193872 - RNA, 19 nt, Homo sapiens
aacaacaacugggaagaaa

SEQ ID NO: 193873 - RNA, 19 nt, Homo sapiens
cugcaucccuaauaccaaa

SEQ ID NO: 193874 - RNA, 19 nt, Homo sapiens
cgauauguuugacgacuuc

SEQ ID NO: 193875 - RNA, 19 nt, Homo sapiens
gcaucucuccugugaguug

SEQ ID NO: 193876 - RNA, 19 nt, Homo sapiens
gaaggcagagaguguguca

SEQ ID NO: 193877 - RNA, 19 nt, Homo sapiens
ccugugaguuggagacuuc

SEQ ID NO: 193878 - RNA, 19 nt, Homo sapiens
gggaagcggguguuggauu

SEQ ID NO: 193879 - RNA, 19 nt, Homo sapiens
caacaacugggaagaaacu

SEQ ID NO: 193880 - RNA, 19 nt, Homo sapiens
ucccagacguucucaguca

SEQ ID NO: 193881 - RNA, 19 nt, Homo sapiens
gaaaacggaagcccaagaa

SEQ ID NO: 193882 - RNA, 19 nt, Homo sapiens
gagaugggacgggucacua

SEQ ID NO: 193883 - RNA, 19 nt, Homo sapiens
gaccguggguuuugcauug

SEQ ID NO: 193884 - RNA, 19 nt, Homo sapiens
cacugcaucucuccuguga

SEQ ID NO: 193885 - RNA, 19 nt, Homo sapiens
ugcguaaucuucccucuuc

SEQ ID NO: 193886 - RNA, 19 nt, Homo sapiens
cugcaucucuccugugagu

SEQ ID NO: 193887 - RNA, 19 nt, Homo sapiens
gcaccgaaggaucugagaa

SEQ ID NO: 193888 - RNA, 19 nt, Homo sapiens
gggcgagccugugugcaau

SEQ ID NO: 193889 - RNA, 19 nt, Homo sapiens
ucgcagggaccauguauca

SEQ ID NO: 193890 - RNA, 19 nt, Homo sapiens
gguguuggauuuucucaga

SEQ ID NO: 193891 - RNA, 19 nt, Homo sapiens
cuuggaggauagcaaagaa

SEQ ID NO: 193892 - RNA, 19 nt, Homo sapiens
gugaguuggagacuucuuu

SEQ ID NO: 193893 - RNA, 19 nt, Homo sapiens
uaucguuguugccgucguu

SEQ ID NO: 193894 - RNA, 19 nt, Homo sapiens
gcccaagaaccugaauaaa

SEQ ID NO: 193895 - RNA, 19 nt, Homo sapiens
ucccuaauaccaaaucuga

SEQ ID NO: 193896 - RNA, 19 nt, Homo sapiens
uuucucagaugccuuuaca

SEQ ID NO: 193897 - RNA, 19 nt, Homo sapiens
ccaaaacugugggguguga

SEQ ID NO: 193898 - RNA, 19 nt, Homo sapiens
augcuggauuuaauacgua

SEQ ID NO: 193899 - RNA, 19 nt, Homo sapiens
gacauaaucacugcguaau

SEQ ID NO: 193900 - RNA, 19 nt, Homo sapiens
gaccugcgagggagagaga

SEQ ID NO: 193901 - RNA, 19 nt, Homo sapiens
ccugcggccucuacaugaa

SEQ ID NO: 193902 - RNA, 19 nt, Homo sapiens
gcaucuguuugccauguac

SEQ ID NO: 193903 - RNA, 19 nt, Homo sapiens
gcacgagcacacugcaucu

SEQ ID NO: 193904 - RNA, 19 nt, Homo sapiens
ggaagcccaagaaccugaa

SEQ ID NO: 193905 - RNA, 19 nt, Homo sapiens
ggaggauagcaaagaagga

SEQ ID NO: 193906 - RNA, 19 nt, Homo sapiens
gcucgcagggaccauguau

SEQ ID NO: 193907 - RNA, 19 nt, Homo sapiens
uggccuagaccguggguuu

SEQ ID NO: 193908 - RNA, 19 nt, Homo sapiens
ccugggacuuggaggauag

SEQ ID NO: 193909 - RNA, 19 nt, Homo sapiens
gagccuggccugucaucuc

SEQ ID NO: 193910 - RNA, 19 nt, Homo sapiens
cagcgcagccucaucaaaa

SEQ ID NO: 193911 - RNA, 19 nt, Homo sapiens
cucaaugcuggauuuaaua

SEQ ID NO: 193912 - RNA, 19 nt, Homo sapiens
caagaaccugaauaaaucu

SEQ ID NO: 193913 - RNA, 19 nt, Homo sapiens
ggaaagaggggauccaaac

SEQ ID NO: 193914 - RNA, 19 nt, Homo sapiens
uuugcucaaugcuggauuu

SEQ ID NO: 193915 - RNA, 19 nt, Homo sapiens
ccgaaugacggcaucuguu

SEQ ID NO: 193916 - RNA, 19 nt, Homo sapiens
gcagguugguuuacauuaa

SEQ ID NO: 193917 - RNA, 19 nt, Homo sapiens
gaugaagucuguauagugu

SEQ ID NO: 193918 - RNA, 19 nt, Homo sapiens
gaacagcgagcucaaguau

SEQ ID NO: 193919 - RNA, 19 nt, Homo sapiens
ucaaagacuugcucuggua

SEQ ID NO: 193920 - RNA, 19 nt, Homo sapiens
uaacauacacugugacuga

SEQ ID NO: 193921 - RNA, 19 nt, Homo sapiens
caugaggucucuuaucaaa

SEQ ID NO: 193922 - RNA, 19 nt, Homo sapiens
uaacggauagcauuuguaa

SEQ ID NO: 193923 - RNA, 19 nt, Homo sapiens
caacaacacuuuacuaccu

SEQ ID NO: 193924 - RNA, 19 nt, Homo sapiens
caccacaacuaccaccuua

SEQ ID NO: 193925 - RNA, 19 nt, Homo sapiens
caacuuccaccucuucuaa

SEQ ID NO: 193926 - RNA, 19 nt, Homo sapiens
acagcgagcucaaguauuc

SEQ ID NO: 193927 - RNA, 19 nt, Homo sapiens
caaaucuucucucaggaaa

SEQ ID NO: 193928 - RNA, 19 nt, Homo sapiens
agacugcauuguaacuuua

SEQ ID NO: 193929 - RNA, 19 nt, Homo sapiens
uaaacacucugaugaaguc

SEQ ID NO: 193930 - RNA, 19 nt, Homo sapiens
ccagaccacuugcuaugaa

SEQ ID NO: 193931 - RNA, 19 nt, Homo sapiens
ugaaugggauguccuaugg

SEQ ID NO: 193932 - RNA, 19 nt, Homo sapiens
ugaagucuguauaguguga

SEQ ID NO: 193933 - RNA, 19 nt, Homo sapiens
uaaacaggguagcaaacaa

SEQ ID NO: 193934 - RNA, 19 nt, Homo sapiens
ugacugacguuucucaaag

SEQ ID NO: 193935 - RNA, 19 nt, Homo sapiens
ccacaggcagguugguuua

SEQ ID NO: 193936 - RNA, 19 nt, Homo sapiens
gaagucagucggaauuugu

SEQ ID NO: 193937 - RNA, 19 nt, Homo sapiens
ucucaaaguucauauugug

SEQ ID NO: 193938 - RNA, 19 nt, Homo sapiens
uauggaauauugagagaga

SEQ ID NO: 193939 - RNA, 19 nt, Homo sapiens
caagaugggcucuacauag

SEQ ID NO: 193940 - RNA, 19 nt, Homo sapiens
gauguccuauggaaaccua

SEQ ID NO: 193941 - RNA, 19 nt, Homo sapiens
caggguagcaaacaagaua

SEQ ID NO: 193942 - RNA, 19 nt, Homo sapiens
gcuauggaauauugagaga

SEQ ID NO: 193943 - RNA, 19 nt, Homo sapiens
ggccuugccugcuauggaa

SEQ ID NO: 193944 - RNA, 19 nt, Homo sapiens
gaacccgugugcaaugcuu

SEQ ID NO: 193945 - RNA, 19 nt, Homo sapiens
ugacguuucucaaaguuca

SEQ ID NO: 193946 - RNA, 19 nt, Homo sapiens
aagacuugcucugguaaua

SEQ ID NO: 193947 - RNA, 19 nt, Homo sapiens
cuagguaucuguaaacacu

SEQ ID NO: 193948 - RNA, 19 nt, Homo sapiens
acaacuacaucccauuuua

SEQ ID NO: 193949 - RNA, 19 nt, Homo sapiens
aagacugcauuguaacuuu

SEQ ID NO: 193950 - RNA, 19 nt, Homo sapiens
gcauaagauuuaacagcau

SEQ ID NO: 193951 - RNA, 19 nt, Homo sapiens
ugaagucagucggaauuug

SEQ ID NO: 193952 - RNA, 19 nt, Homo sapiens
ccacaacuaccaccuuaug

SEQ ID NO: 193953 - RNA, 19 nt, Homo sapiens
cagguugguuuacauuaau

SEQ ID NO: 193954 - RNA, 19 nt, Homo sapiens
gcucgcugcugcucaguuc

SEQ ID NO: 193955 - RNA, 19 nt, Homo sapiens
gccuuucucuauuuguuaa

SEQ ID NO: 193956 - RNA, 19 nt, Homo sapiens
gggaggacuugcugcuguu

SEQ ID NO: 193957 - RNA, 19 nt, Homo sapiens
gcagcaaucaguguuaaau

SEQ ID NO: 193958 - RNA, 19 nt, Homo sapiens
uucaugaggucucuuauca

SEQ ID NO: 193959 - RNA, 19 nt, Homo sapiens
gaaagagugagagaagaug

SEQ ID NO: 193960 - RNA, 19 nt, Homo sapiens
gugcagcgguccagacagu

SEQ ID NO: 193961 - RNA, 19 nt, Homo sapiens
gcaccaaucccgagaacag

SEQ ID NO: 193962 - RNA, 19 nt, Homo sapiens
gguaauagcaauaauucca

SEQ ID NO: 193963 - RNA, 19 nt, Homo sapiens
aaugggauguccuauggaa

SEQ ID NO: 193964 - RNA, 19 nt, Homo sapiens
uuacaacuacaucccauuu

SEQ ID NO: 193965 - RNA, 19 nt, Homo sapiens
ggaauauugagagagauuu

SEQ ID NO: 193966 - RNA, 19 nt, Homo sapiens
ucaagaugggcucuacaua

SEQ ID NO: 193967 - RNA, 19 nt, Homo sapiens
gagaacagcgagcucaagu

SEQ ID NO: 193968 - RNA, 19 nt, Homo sapiens
caaagacuugcucugguaa

SEQ ID NO: 193969 - RNA, 19 nt, Homo sapiens
aaaccuauuucaccagagu

SEQ ID NO: 193970 - RNA, 19 nt, Homo sapiens
gguagcaaacaagauauuu

SEQ ID NO: 193971 - RNA, 19 nt, Homo sapiens
agcaaucaguguuaaauca

SEQ ID NO: 193972 - RNA, 19 nt, Homo sapiens
guaaacaggguagcaaaca

SEQ ID NO: 193973 - RNA, 19 nt, Homo sapiens
cauauuguguggcugaucu

SEQ ID NO: 193974 - RNA, 19 nt, Homo sapiens
ugccugcuauggaauauug

SEQ ID NO: 193975 - RNA, 19 nt, Homo sapiens
gcucugguaauagcaauaa

SEQ ID NO: 193976 - RNA, 19 nt, Homo sapiens
cagaccacuugcuaugaaa

SEQ ID NO: 193977 - RNA, 19 nt, Homo sapiens
guaaacacucugaugaagu

SEQ ID NO: 193978 - RNA, 19 nt, Homo sapiens
gacauucuuaugcuucuuu

SEQ ID NO: 193979 - RNA, 19 nt, Homo sapiens
aaucaugugcuucuucuga

SEQ ID NO: 193980 - RNA, 19 nt, Homo sapiens
aagaugggcucuacauagg

SEQ ID NO: 193981 - RNA, 19 nt, Homo sapiens
gagcaccaaucccgagaac

SEQ ID NO: 193982 - RNA, 19 nt, Homo sapiens
aacaacacuuuacuaccua

SEQ ID NO: 193983 - RNA, 19 nt, Homo sapiens
uacaagaacaccaauauac

SEQ ID NO: 193984 - RNA, 19 nt, Homo sapiens
gcaaucaguguuaaaucau

SEQ ID NO: 193985 - RNA, 19 nt, Homo sapiens
gcugaaagagugagagaag

SEQ ID NO: 193986 - RNA, 19 nt, Homo sapiens
ccuaacggauagcauuugu

SEQ ID NO: 193987 - RNA, 19 nt, Homo sapiens
ccagaagccaggacuagga

SEQ ID NO: 193988 - RNA, 19 nt, Homo sapiens
gcucaaguauucgggucaa

SEQ ID NO: 193989 - RNA, 19 nt, Homo sapiens
gcuuguggacucuacauga

SEQ ID NO: 193990 - RNA, 19 nt, Homo sapiens
cuuguggacucuacaugaa

SEQ ID NO: 193991 - RNA, 19 nt, Homo sapiens
uguaaacacucugaugaag

SEQ ID NO: 193992 - RNA, 19 nt, Homo sapiens
cuaccuaacggauagcauu

SEQ ID NO: 193993 - RNA, 19 nt, Homo sapiens
uggaauaugugcuggaaaa

SEQ ID NO: 193994 - RNA, 19 nt, Homo sapiens
gacugacguuucucaaagu

SEQ ID NO: 193995 - RNA, 19 nt, Homo sapiens
gcaagacugcauuguaacu

SEQ ID NO: 193996 - RNA, 19 nt, Homo sapiens
ucauggagaagaucacuug

SEQ ID NO: 193997 - RNA, 19 nt, Homo sapiens
ugaaagagugagagaagau

SEQ ID NO: 193998 - RNA, 19 nt, Homo sapiens
ggcagguugguuuacauua

SEQ ID NO: 193999 - RNA, 19 nt, Homo sapiens
acaacacuuuacuaccuaa

SEQ ID NO: 194000 - RNA, 19 nt, Homo sapiens
gcccagaccacuugcuaug

SEQ ID NO: 194001 - RNA, 19 nt, Homo sapiens
gauucucgugccuuuauuu

SEQ ID NO: 194002 - RNA, 19 nt, Homo sapiens
gugauucucgugccuuuau

SEQ ID NO: 194003 - RNA, 19 nt, Homo sapiens
ggugaacccgugugcaaug

SEQ ID NO: 194004 - RNA, 19 nt, Homo sapiens
acacucugaugaagucugu

SEQ ID NO: 194005 - RNA, 19 nt, Homo sapiens
ucuguaaacacucugauga

SEQ ID NO: 194006 - RNA, 19 nt, Homo sapiens
acaaaucuucucucaggaa

SEQ ID NO: 194007 - RNA, 19 nt, Homo sapiens
ggaauucaaaccaggaaac

SEQ ID NO: 194008 - RNA, 19 nt, Homo sapiens
cagaaacgccgagggugaa

SEQ ID NO: 194009 - RNA, 19 nt, Homo sapiens
cacuugaggccauuuggua

SEQ ID NO: 194010 - RNA, 19 nt, Homo sapiens
gcgcugacagaacgugauu

SEQ ID NO: 194011 - RNA, 19 nt, Homo sapiens
aauaauuccauucccauga

SEQ ID NO: 194012 - RNA, 19 nt, Homo sapiens
ugaugaagucuguauagug

SEQ ID NO: 194013 - RNA, 19 nt, Homo sapiens
uuugguuguuccagaauuu

SEQ ID NO: 194014 - RNA, 19 nt, Homo sapiens
ggacccugcuccacuucca

SEQ ID NO: 194015 - RNA, 19 nt, Homo sapiens
caaguauucgggucaagau

SEQ ID NO: 194016 - RNA, 19 nt, Homo sapiens
gagaaagacuuagaacaua

SEQ ID NO: 194017 - RNA, 19 nt, Homo sapiens
gagaaagacuuagaaugua

SEQ ID NO: 194018 - RNA, 19 nt, Homo sapiens
gcacagagaagccagguua

SEQ ID NO: 194019 - RNA, 19 nt, Homo sapiens
gaagccagguuacaaacua

SEQ ID NO: 194020 - RNA, 19 nt, Homo sapiens
gaacauacacagauccuaa

SEQ ID NO: 194021 - RNA, 19 nt, Homo sapiens
ggacgaaccuugacaggau

SEQ ID NO: 194022 - RNA, 19 nt, Homo sapiens
uaaaggagagaaagacuua

SEQ ID NO: 194023 - RNA, 19 nt, Homo sapiens
acaggaauguuuaguguaa

SEQ ID NO: 194024 - RNA, 19 nt, Homo sapiens
aaaggcagcuugaaauguu

SEQ ID NO: 194025 - RNA, 19 nt, Homo sapiens
acacagauccuaaguagaa

SEQ ID NO: 194026 - RNA, 19 nt, Homo sapiens
cuauuuggcuucaaguaua

SEQ ID NO: 194027 - RNA, 19 nt, Homo sapiens
caucuuaccucauuucaag

SEQ ID NO: 194028 - RNA, 19 nt, Homo sapiens
guauuacucucuacuccua

SEQ ID NO: 194029 - RNA, 19 nt, Homo sapiens
uaacuucugcuagguauua

SEQ ID NO: 194030 - RNA, 19 nt, Homo sapiens
gaacuguagugcuuuaaac

SEQ ID NO: 194031 - RNA, 19 nt, Homo sapiens
ggucaauuaucaaagacua

SEQ ID NO: 194032 - RNA, 19 nt, Homo sapiens
guaauuggauuucgcuauc

SEQ ID NO: 194033 - RNA, 19 nt, Homo sapiens
gcguacaggucaauuauca

SEQ ID NO: 194034 - RNA, 19 nt, Homo sapiens
ugaguaacuuggccacuaa

SEQ ID NO: 194035 - RNA, 19 nt, Homo sapiens
caugaacuguagugcuuua

SEQ ID NO: 194036 - RNA, 19 nt, Homo sapiens
gcaggauggacuaucauua

SEQ ID NO: 194037 - RNA, 19 nt, Homo sapiens
gagcauagacuuuauaagc

SEQ ID NO: 194038 - RNA, 19 nt, Homo sapiens
ggacugaacaggccugaug

SEQ ID NO: 194039 - RNA, 19 nt, Homo sapiens
cuaaaugcgaugugaaaua

SEQ ID NO: 194040 - RNA, 19 nt, Homo sapiens
cacaauggcugaugagcuu

SEQ ID NO: 194041 - RNA, 19 nt, Homo sapiens
guacaggucaauuaucaaa

SEQ ID NO: 194042 - RNA, 19 nt, Homo sapiens
ggacugcccugucucuucu

SEQ ID NO: 194043 - RNA, 19 nt, Homo sapiens
guacacagauccaaaauag

SEQ ID NO: 194044 - RNA, 19 nt, Homo sapiens
agagaaagacuuagaaugu

SEQ ID NO: 194045 - RNA, 19 nt, Homo sapiens
cgagacauccugauaguug

SEQ ID NO: 194046 - RNA, 19 nt, Homo sapiens
gcauagacuuuauaagcau

SEQ ID NO: 194047 - RNA, 19 nt, Homo sapiens
ucuauagacuugagaaugu

SEQ ID NO: 194048 - RNA, 19 nt, Homo sapiens
guaacuuggccacuaauaa

SEQ ID NO: 194049 - RNA, 19 nt, Homo sapiens
gugaauguguaccaagaaa

SEQ ID NO: 194050 - RNA, 19 nt, Homo sapiens
uuacaggaauguuuagugu

SEQ ID NO: 194051 - RNA, 19 nt, Homo sapiens
auacacagauccuaaguag

SEQ ID NO: 194052 - RNA, 19 nt, Homo sapiens
uaacuuggccacuaauaau

SEQ ID NO: 194053 - RNA, 19 nt, Homo sapiens
gaagacagacacaaauugg

SEQ ID NO: 194054 - RNA, 19 nt, Homo sapiens
aaaccuaaaugcgauguga

SEQ ID NO: 194055 - RNA, 19 nt, Homo sapiens
ggaggaggcuuccauugcu

SEQ ID NO: 194056 - RNA, 19 nt, Homo sapiens
acaggucaauuaucaaaga

SEQ ID NO: 194057 - RNA, 19 nt, Homo sapiens
aaagcaggauggacuauca

SEQ ID NO: 194058 - RNA, 19 nt, Homo sapiens
gaauguacacagauccaaa

SEQ ID NO: 194059 - RNA, 19 nt, Homo sapiens
gagagaaagacuuagaaug

SEQ ID NO: 194060 - RNA, 19 nt, Homo sapiens
gagcguacaggucaauuau

SEQ ID NO: 194061 - RNA, 19 nt, Homo sapiens
cugaugagcuuuauaacca

SEQ ID NO: 194062 - RNA, 19 nt, Homo sapiens
gcaaggagggcauuauuuu

SEQ ID NO: 194063 - RNA, 19 nt, Homo sapiens
guagugcuuuaaacaauca

SEQ ID NO: 194064 - RNA, 19 nt, Homo sapiens
gcuuguggcuggccucaga

SEQ ID NO: 194065 - RNA, 19 nt, Homo sapiens
ggugaaggccaacacauau

SEQ ID NO: 194066 - RNA, 19 nt, Homo sapiens
gcuaucaguucccauccuu

SEQ ID NO: 194067 - RNA, 19 nt, Homo sapiens
guagaagacagacacaaau

SEQ ID NO: 194068 - RNA, 19 nt, Homo sapiens
guucacgcuucuuugagua

SEQ ID NO: 194069 - RNA, 19 nt, Homo sapiens
gguucauucuccugcuuua

SEQ ID NO: 194070 - RNA, 19 nt, Homo sapiens
uaucauuacuccuccaaca

SEQ ID NO: 194071 - RNA, 19 nt, Homo sapiens
gaccugguauugugcuuuc

SEQ ID NO: 194072 - RNA, 19 nt, Homo sapiens
acaaucaucuccuuaacag

SEQ ID NO: 194073 - RNA, 19 nt, Homo sapiens
uaugguggaugccaaugaa

SEQ ID NO: 194074 - RNA, 19 nt, Homo sapiens
gagacauccugauaguugu

SEQ ID NO: 194075 - RNA, 19 nt, Homo sapiens
gaaagacuuagaacauaca

SEQ ID NO: 194076 - RNA, 19 nt, Homo sapiens
gaggcacccuacaguccua

SEQ ID NO: 194077 - RNA, 19 nt, Homo sapiens
cauuggaccugguauugug

SEQ ID NO: 194078 - RNA, 19 nt, Homo sapiens
caucggaucucggcuugga

SEQ ID NO: 194079 - RNA, 19 nt, Homo sapiens
agaaagacuuagaacauac

SEQ ID NO: 194080 - RNA, 19 nt, Homo sapiens
agagaaagacuuagaacau

SEQ ID NO: 194081 - RNA, 19 nt, Homo sapiens
gagagaaagacuuagaaca

SEQ ID NO: 194082 - RNA, 19 nt, Homo sapiens
agaaagacuuagaauguac

SEQ ID NO: 194083 - RNA, 19 nt, Homo sapiens
uagaagacagacacaaauu

SEQ ID NO: 194084 - RNA, 19 nt, Homo sapiens
caacacauaugaaaaguac

SEQ ID NO: 194085 - RNA, 19 nt, Homo sapiens
uaucaguucccauccuuaa

SEQ ID NO: 194086 - RNA, 19 nt, Homo sapiens
gacuuagaauguacacaga

SEQ ID NO: 194087 - RNA, 19 nt, Homo sapiens
gaaauguugguccuaaucu

SEQ ID NO: 194088 - RNA, 19 nt, Homo sapiens
gaagcaaggagggcauuau

SEQ ID NO: 194089 - RNA, 19 nt, Homo sapiens
aauguugguccuaaucuua

SEQ ID NO: 194090 - RNA, 19 nt, Homo sapiens
aaauuagucaccugaguaa

SEQ ID NO: 194091 - RNA, 19 nt, Homo sapiens
uggcugaugagcuuuauaa

SEQ ID NO: 194092 - RNA, 19 nt, Homo sapiens
cgagcguacaggucaauua

SEQ ID NO: 194093 - RNA, 19 nt, Homo sapiens
gauagugggcagagcagaa

SEQ ID NO: 194094 - RNA, 19 nt, Homo sapiens
aaaggcuguugcugaaauu

SEQ ID NO: 194095 - RNA, 19 nt, Homo sapiens
cugaguaacuuggccacua

SEQ ID NO: 194096 - RNA, 19 nt, Homo sapiens
aaacaaucaucuccuuaac

SEQ ID NO: 194097 - RNA, 19 nt, Homo sapiens
ugcaugaacuguagugcuu

SEQ ID NO: 194098 - RNA, 19 nt, Homo sapiens
gcaucuugcuccagacuac

SEQ ID NO: 194099 - RNA, 19 nt, Homo sapiens
cauucgagcuggaagagau

SEQ ID NO: 194100 - RNA, 19 nt, Homo sapiens
ugaugcugcugacuucauu

SEQ ID NO: 194101 - RNA, 19 nt, Homo sapiens
caauggcugaugagcuuua

SEQ ID NO: 194102 - RNA, 19 nt, Homo sapiens
ugaaggccaacacauauga

SEQ ID NO: 194103 - RNA, 19 nt, Homo sapiens
uaaguagaaccagguaauu

SEQ ID NO: 194104 - RNA, 19 nt, Homo sapiens
cuugaaauguugguccuaa

SEQ ID NO: 194105 - RNA, 19 nt, Homo sapiens
ccucagauacaccuaagaa

SEQ ID NO: 194106 - RNA, 19 nt, Homo sapiens
gaaaagcuggguaucacua

SEQ ID NO: 194107 - RNA, 19 nt, Homo sapiens
acuggucauugaaguauaa

SEQ ID NO: 194108 - RNA, 19 nt, Homo sapiens
gacuggucauugaaguaua

SEQ ID NO: 194109 - RNA, 19 nt, Homo sapiens
gaaagacuuagaauguaca

SEQ ID NO: 194110 - RNA, 19 nt, Homo sapiens
aauaacuucugcuagguau

SEQ ID NO: 194111 - RNA, 19 nt, Homo sapiens
agagaagccagguuacaaa

SEQ ID NO: 194112 - RNA, 19 nt, Homo sapiens
ggcuguugcugaaauugaa

SEQ ID NO: 194113 - RNA, 19 nt, Homo sapiens
gaaggccaacacauaugaa

SEQ ID NO: 194114 - RNA, 19 nt, Homo sapiens
agaagacagacacaaauug

SEQ ID NO: 194115 - RNA, 19 nt, Homo sapiens
uguagaagacagacacaaa

SEQ ID NO: 194116 - RNA, 19 nt, Homo sapiens
gaaggaaucggauauaaca

SEQ ID NO: 194117 - RNA, 19 nt, Homo sapiens
gaagaaggaaucggauaua

SEQ ID NO: 194118 - RNA, 19 nt, Homo sapiens
gcacccagaugauuccuau

SEQ ID NO: 194119 - RNA, 19 nt, Homo sapiens
gaagauaccaagcucaaga

SEQ ID NO: 194120 - RNA, 19 nt, Homo sapiens
ggaaucggauauaacauca

SEQ ID NO: 194121 - RNA, 19 nt, Homo sapiens
caucagggcggaagccuua

SEQ ID NO: 194122 - RNA, 19 nt, Homo sapiens
caacauccuugcccuguca

SEQ ID NO: 194123 - RNA, 19 nt, Homo sapiens
gcugugugcugcuugcuuu

SEQ ID NO: 194124 - RNA, 19 nt, Homo sapiens
aagaaggaaucggauauaa

SEQ ID NO: 194125 - RNA, 19 nt, Homo sapiens
uaggaaagcugggcccaaa

SEQ ID NO: 194126 - RNA, 19 nt, Homo sapiens
gagcacaaguuacaguucu

SEQ ID NO: 194127 - RNA, 19 nt, Homo sapiens
caaaggugguacugacaga

SEQ ID NO: 194128 - RNA, 19 nt, Homo sapiens
cuaaaccgcuccucuaagg

SEQ ID NO: 194129 - RNA, 19 nt, Homo sapiens
ccaauugggugcguaacuu

SEQ ID NO: 194130 - RNA, 19 nt, Homo sapiens
aauggcagcucuuaaagga

SEQ ID NO: 194131 - RNA, 19 nt, Homo sapiens
gaaagugaagggauuugga

SEQ ID NO: 194132 - RNA, 19 nt, Homo sapiens
gcuacuccauucacaccua

SEQ ID NO: 194133 - RNA, 19 nt, Homo sapiens
gaaaagaagagacuaggaa

SEQ ID NO: 194134 - RNA, 19 nt, Homo sapiens
ucaccuggcuacuccauuc

SEQ ID NO: 194135 - RNA, 19 nt, Homo sapiens
gaacaucagcgagacuuca

SEQ ID NO: 194136 - RNA, 19 nt, Homo sapiens
cuacuuaaaucguacuucu

SEQ ID NO: 194137 - RNA, 19 nt, Homo sapiens
cgacagucccaucauugua

SEQ ID NO: 194138 - RNA, 19 nt, Homo sapiens
uuacaguucugggcaguga

SEQ ID NO: 194139 - RNA, 19 nt, Homo sapiens
ugaagaaggaaucggauau

SEQ ID NO: 194140 - RNA, 19 nt, Homo sapiens
ugucgacagucccaucauu

SEQ ID NO: 194141 - RNA, 19 nt, Homo sapiens
gcccaaaacuggagacugu

SEQ ID NO: 194142 - RNA, 19 nt, Homo sapiens
caauugggugcguaacuuu

SEQ ID NO: 194143 - RNA, 19 nt, Homo sapiens
aaucggauauaacaucauc

SEQ ID NO: 194144 - RNA, 19 nt, Homo sapiens
uuaaaucguacuucucuga

SEQ ID NO: 194145 - RNA, 19 nt, Homo sapiens
cagaaguuccagaaaguga

SEQ ID NO: 194146 - RNA, 19 nt, Homo sapiens
aacagaaguuccagaaagu

SEQ ID NO: 194147 - RNA, 19 nt, Homo sapiens
ucaccgagcccugcaguug

SEQ ID NO: 194148 - RNA, 19 nt, Homo sapiens
uccagaaagugaagggauu

SEQ ID NO: 194149 - RNA, 19 nt, Homo sapiens
cgacggauggagcugagua

SEQ ID NO: 194150 - RNA, 19 nt, Homo sapiens
caucagcgagacuucauug

SEQ ID NO: 194151 - RNA, 19 nt, Homo sapiens
ggcacaggccugcuacuga

SEQ ID NO: 194152 - RNA, 19 nt, Homo sapiens
cacaauguccgccuacuca

SEQ ID NO: 194153 - RNA, 19 nt, Homo sapiens
gaaguuccuggaugccuau

SEQ ID NO: 194154 - RNA, 19 nt, Homo sapiens
gguggugugugucugcaau

SEQ ID NO: 194155 - RNA, 19 nt, Homo sapiens
ggccagauacuuugugaag

SEQ ID NO: 194156 - RNA, 19 nt, Homo sapiens
uggagcagauacucaagga

SEQ ID NO: 194157 - RNA, 19 nt, Homo sapiens
gacagucccaucauuguag

SEQ ID NO: 194158 - RNA, 19 nt, Homo sapiens
cgaaggaggacccaauugg

SEQ ID NO: 194159 - RNA, 19 nt, Homo sapiens
uaaaucguacuucucugaa

SEQ ID NO: 194160 - RNA, 19 nt, Homo sapiens
ccagaaagugaagggauuu

SEQ ID NO: 194161 - RNA, 19 nt, Homo sapiens
gggcggaagccuuaaagca

SEQ ID NO: 194162 - RNA, 19 nt, Homo sapiens
guaccugcauccuuguuuu

SEQ ID NO: 194163 - RNA, 19 nt, Homo sapiens
acuggaaccuugcccugaa

SEQ ID NO: 194164 - RNA, 19 nt, Homo sapiens
guacagccacagcaucauc

SEQ ID NO: 194165 - RNA, 19 nt, Homo sapiens
gcugggcuguugaguggau

SEQ ID NO: 194166 - RNA, 19 nt, Homo sapiens
gcucagccugggcauuaaa

SEQ ID NO: 194167 - RNA, 19 nt, Homo sapiens
ggacagcccggagacaucu

SEQ ID NO: 194168 - RNA, 19 nt, Homo sapiens
ccaauggagcggugaaugg

SEQ ID NO: 194169 - RNA, 19 nt, Homo sapiens
gaccuuuccugcccuuggu

SEQ ID NO: 194170 - RNA, 19 nt, Homo sapiens
gaaguuccagaaagugaag

SEQ ID NO: 194171 - RNA, 19 nt, Homo sapiens
cagggccagugugagcuua

SEQ ID NO: 194172 - RNA, 19 nt, Homo sapiens
ucaccaaggacacguuuua

SEQ ID NO: 194173 - RNA, 19 nt, Homo sapiens
ccaacaccaugcucuuugc

SEQ ID NO: 194174 - RNA, 19 nt, Homo sapiens
gguaccugcauccuuguuu

SEQ ID NO: 194175 - RNA, 19 nt, Homo sapiens
cuucauugcccgugaccua

SEQ ID NO: 194176 - RNA, 19 nt, Homo sapiens
acagcucgguggugugugu

SEQ ID NO: 194177 - RNA, 19 nt, Homo sapiens
gauaccaagcucaagauac

SEQ ID NO: 194178 - RNA, 19 nt, Homo sapiens
ccaggcacccagaugauuc

SEQ ID NO: 194179 - RNA, 19 nt, Homo sapiens
ugagcucacuguccguaca

SEQ ID NO: 194180 - RNA, 19 nt, Homo sapiens
caucaccaaggacacguuu

SEQ ID NO: 194181 - RNA, 19 nt, Homo sapiens
uuguagacaucaccaagga

SEQ ID NO: 194182 - RNA, 19 nt, Homo sapiens
gcguaacuuugucgacagu

SEQ ID NO: 194183 - RNA, 19 nt, Homo sapiens
gaucgagggaugcaguaca

SEQ ID NO: 194184 - RNA, 19 nt, Homo sapiens
gguacugacagacccagaa

SEQ ID NO: 194185 - RNA, 19 nt, Homo sapiens
caauguccgccuacucaug

SEQ ID NO: 194186 - RNA, 19 nt, Homo sapiens
uuucaaguccuuccagaga

SEQ ID NO: 194187 - RNA, 19 nt, Homo sapiens
uccuagagaugcagaacug

SEQ ID NO: 194188 - RNA, 19 nt, Homo sapiens
ugauggagcagauacucaa

SEQ ID NO: 194189 - RNA, 19 nt, Homo sapiens
caaggacacguuuuacaaa

SEQ ID NO: 194190 - RNA, 19 nt, Homo sapiens
caguacagccacagcauca

SEQ ID NO: 194191 - RNA, 19 nt, Homo sapiens
gagcucacuguccguacaa

SEQ ID NO: 194192 - RNA, 19 nt, Homo sapiens
acagucccaucauuguaga

SEQ ID NO: 194193 - RNA, 19 nt, Homo sapiens
auaccaagcucaagauacc

SEQ ID NO: 194194 - RNA, 19 nt, Homo sapiens
ccuagugccuauagcuaag

SEQ ID NO: 194195 - RNA, 19 nt, Homo sapiens
gcagacaccccugaugauu

SEQ ID NO: 194196 - RNA, 19 nt, Homo sapiens
cauccgcaccuacaccuau

SEQ ID NO: 194197 - RNA, 19 nt, Homo sapiens
cugaagaaggaaucggaua

SEQ ID NO: 194198 - RNA, 19 nt, Homo sapiens
ugucugcaaugccacauac

SEQ ID NO: 194199 - RNA, 19 nt, Homo sapiens
gggaucgagggaugcagua

SEQ ID NO: 194200 - RNA, 19 nt, Homo sapiens
ugugugggcuccaaguucu

SEQ ID NO: 194201 - RNA, 19 nt, Homo sapiens
agacaccccugaugauuuc

SEQ ID NO: 194202 - RNA, 19 nt, Homo sapiens
gcagggccagugugagcuu

SEQ ID NO: 194203 - RNA, 19 nt, Homo sapiens
cauuaaagggacagaguca

SEQ ID NO: 194204 - RNA, 19 nt, Homo sapiens
cuaccaccuuggccacuuc

SEQ ID NO: 194205 - RNA, 19 nt, Homo sapiens
ccaaggacacguuuuacaa

SEQ ID NO: 194206 - RNA, 19 nt, Homo sapiens
guacugacagacccagaag

SEQ ID NO: 194207 - RNA, 19 nt, Homo sapiens
ugggccagauacuuuguga

SEQ ID NO: 194208 - RNA, 19 nt, Homo sapiens
gaaaugaacaccuugaaua

SEQ ID NO: 194209 - RNA, 19 nt, Homo sapiens
guauauagcuugugagaaa

SEQ ID NO: 194210 - RNA, 19 nt, Homo sapiens
ucacagaagucaugaauaa

SEQ ID NO: 194211 - RNA, 19 nt, Homo sapiens
gggaggaauugguauauua

SEQ ID NO: 194212 - RNA, 19 nt, Homo sapiens
gauaaacacuacccuugua

SEQ ID NO: 194213 - RNA, 19 nt, Homo sapiens
caguaaagcuguagaguuu

SEQ ID NO: 194214 - RNA, 19 nt, Homo sapiens
uauaugaacucaggucuua

SEQ ID NO: 194215 - RNA, 19 nt, Homo sapiens
gaauguauguguaaagugu

SEQ ID NO: 194216 - RNA, 19 nt, Homo sapiens
guaaaucaguuucacauca

SEQ ID NO: 194217 - RNA, 19 nt, Homo sapiens
caacagaucucgagaagac

SEQ ID NO: 194218 - RNA, 19 nt, Homo sapiens
gaagacagcuggcuaaaau

SEQ ID NO: 194219 - RNA, 19 nt, Homo sapiens
caagagguguugccaaaga

SEQ ID NO: 194220 - RNA, 19 nt, Homo sapiens
ggaaagaauuacaguugga

SEQ ID NO: 194221 - RNA, 19 nt, Homo sapiens
gcuugaaacuuguguauca

SEQ ID NO: 194222 - RNA, 19 nt, Homo sapiens
uguaaacgaucauuuguga

SEQ ID NO: 194223 - RNA, 19 nt, Homo sapiens
caagguacauuuaaucagu

SEQ ID NO: 194224 - RNA, 19 nt, Homo sapiens
gauccggaccuaauauaua

SEQ ID NO: 194225 - RNA, 19 nt, Homo sapiens
gacacucucuggcuaauau

SEQ ID NO: 194226 - RNA, 19 nt, Homo sapiens
aacaauggcuugaaacuug

SEQ ID NO: 194227 - RNA, 19 nt, Homo sapiens
ggaggauucuucucucaga

SEQ ID NO: 194228 - RNA, 19 nt, Homo sapiens
gaaaguugauccaagaaaa

SEQ ID NO: 194229 - RNA, 19 nt, Homo sapiens
gaucauuugugaccucaga

SEQ ID NO: 194230 - RNA, 19 nt, Homo sapiens
guaagcaguccacauagua

SEQ ID NO: 194231 - RNA, 19 nt, Homo sapiens
gaaacaagcaaucuauaca

SEQ ID NO: 194232 - RNA, 19 nt, Homo sapiens
uuacacaguuccacuuauu

SEQ ID NO: 194233 - RNA, 19 nt, Homo sapiens
ggacuuggaacacguggua

SEQ ID NO: 194234 - RNA, 19 nt, Homo sapiens
gucaagagguguugccaaa

SEQ ID NO: 194235 - RNA, 19 nt, Homo sapiens
caaagauucacgaagauaa

SEQ ID NO: 194236 - RNA, 19 nt, Homo sapiens
agaaucagcuccuguugga

SEQ ID NO: 194237 - RNA, 19 nt, Homo sapiens
ggaagaaucagcuccuguu

SEQ ID NO: 194238 - RNA, 19 nt, Homo sapiens
acacuacccuuguacuuug

SEQ ID NO: 194239 - RNA, 19 nt, Homo sapiens
acaaguagcucuaggaaaa

SEQ ID NO: 194240 - RNA, 19 nt, Homo sapiens
gaaugagccugugccaaga

SEQ ID NO: 194241 - RNA, 19 nt, Homo sapiens
ggaguucaguuucuggaau

SEQ ID NO: 194242 - RNA, 19 nt, Homo sapiens
aaacauggcugggaggaau

SEQ ID NO: 194243 - RNA, 19 nt, Homo sapiens
ggcaagaagugacaugcuu

SEQ ID NO: 194244 - RNA, 19 nt, Homo sapiens
ucacgaagauaaacacuac

SEQ ID NO: 194245 - RNA, 19 nt, Homo sapiens
ccuagaagcauacaacaaa

SEQ ID NO: 194246 - RNA, 19 nt, Homo sapiens
ggauucuucucucagauug

SEQ ID NO: 194247 - RNA, 19 nt, Homo sapiens
ggaaaguugauccaagaaa

SEQ ID NO: 194248 - RNA, 19 nt, Homo sapiens
ugccaaagauucacgaaga

SEQ ID NO: 194249 - RNA, 19 nt, Homo sapiens
ggaaacaagcaaucuauac

SEQ ID NO: 194250 - RNA, 19 nt, Homo sapiens
gguggugcauguugagauu

SEQ ID NO: 194251 - RNA, 19 nt, Homo sapiens
gguccacguugaauucuga

SEQ ID NO: 194252 - RNA, 19 nt, Homo sapiens
gaaaggaaagaauuacagu

SEQ ID NO: 194253 - RNA, 19 nt, Homo sapiens
guaaagcuguagaguuucu

SEQ ID NO: 194254 - RNA, 19 nt, Homo sapiens
ccaagauccggaccuaaua

SEQ ID NO: 194255 - RNA, 19 nt, Homo sapiens
gaacauagaaaaggcaaua

SEQ ID NO: 194256 - RNA, 19 nt, Homo sapiens
cauaguagacaauggguuu

SEQ ID NO: 194257 - RNA, 19 nt, Homo sapiens
ccggaaaguugauccaaga

SEQ ID NO: 194258 - RNA, 19 nt, Homo sapiens
caggaaccaugauugaaug

SEQ ID NO: 194259 - RNA, 19 nt, Homo sapiens
uaacucacucucauuugua

SEQ ID NO: 194260 - RNA, 19 nt, Homo sapiens
uuacugggcucgugcaauc

SEQ ID NO: 194261 - RNA, 19 nt, Homo sapiens
gaccaggaaccaugauuga

SEQ ID NO: 194262 - RNA, 19 nt, Homo sapiens
gaagaaucagcuccuguug

SEQ ID NO: 194263 - RNA, 19 nt, Homo sapiens
cagacaggaugguaacgaa

SEQ ID NO: 194264 - RNA, 19 nt, Homo sapiens
gaguucaguuucuggaaug

SEQ ID NO: 194265 - RNA, 19 nt, Homo sapiens
gaaucaugaucccacugaa

SEQ ID NO: 194266 - RNA, 19 nt, Homo sapiens
ccaaagauucacgaagaua

SEQ ID NO: 194267 - RNA, 19 nt, Homo sapiens
uugucuagcuguuugauuu

SEQ ID NO: 194268 - RNA, 19 nt, Homo sapiens
cgagaagacagcuggcuaa

SEQ ID NO: 194269 - RNA, 19 nt, Homo sapiens
uuaacucacucucauuugu

SEQ ID NO: 194270 - RNA, 19 nt, Homo sapiens
ggaauugguauauuacaca

SEQ ID NO: 194271 - RNA, 19 nt, Homo sapiens
gcucacagcagauaauucu

SEQ ID NO: 194272 - RNA, 19 nt, Homo sapiens
uggugcauguugagauuua

SEQ ID NO: 194273 - RNA, 19 nt, Homo sapiens
gaaaagaugcccacuccaa

SEQ ID NO: 194274 - RNA, 19 nt, Homo sapiens
cacaagaaaggaaagaauu

SEQ ID NO: 194275 - RNA, 19 nt, Homo sapiens
guuuuaagcugcuguauau

SEQ ID NO: 194276 - RNA, 19 nt, Homo sapiens
ccaguaaagcuguagaguu

SEQ ID NO: 194277 - RNA, 19 nt, Homo sapiens
gcugggcaagguacauuua

SEQ ID NO: 194278 - RNA, 19 nt, Homo sapiens
gaagucaugaauaaacuca

SEQ ID NO: 194279 - RNA, 19 nt, Homo sapiens
gccaaagauucacgaagau

SEQ ID NO: 194280 - RNA, 19 nt, Homo sapiens
aaggaaagaauuacaguug

SEQ ID NO: 194281 - RNA, 19 nt, Homo sapiens
ccaggaaccaugauugaau

SEQ ID NO: 194282 - RNA, 19 nt, Homo sapiens
aaacaaguagcucuaggaa

SEQ ID NO: 194283 - RNA, 19 nt, Homo sapiens
aggaacaaauuacaagugu

SEQ ID NO: 194284 - RNA, 19 nt, Homo sapiens
gaggaacaaauuacaagug

SEQ ID NO: 194285 - RNA, 19 nt, Homo sapiens
caagauccggaccuaauau

SEQ ID NO: 194286 - RNA, 19 nt, Homo sapiens
gccaagauccggaccuaau

SEQ ID NO: 194287 - RNA, 19 nt, Homo sapiens
ggaauuucguaaggcaaga

SEQ ID NO: 194288 - RNA, 19 nt, Homo sapiens
gagaagacagcuggcuaaa

SEQ ID NO: 194289 - RNA, 19 nt, Homo sapiens
gaaacuuguguaucauaug

SEQ ID NO: 194290 - RNA, 19 nt, Homo sapiens
gaggaggaacaaauuacaa

SEQ ID NO: 194291 - RNA, 19 nt, Homo sapiens
aaaggaaacaagcaaucua

SEQ ID NO: 194292 - RNA, 19 nt, Homo sapiens
cagaagucaugaauaaacu

SEQ ID NO: 194293 - RNA, 19 nt, Homo sapiens
uuuguaagcaguccacaua

SEQ ID NO: 194294 - RNA, 19 nt, Homo sapiens
cauaaucacaagaaaggaa

SEQ ID NO: 194295 - RNA, 19 nt, Homo sapiens
acauuucugugacaaguau

SEQ ID NO: 194296 - RNA, 19 nt, Homo sapiens
aaaugaacaccuugaauag

SEQ ID NO: 194297 - RNA, 19 nt, Homo sapiens
ucauguuucucaagcaguu

SEQ ID NO: 194298 - RNA, 19 nt, Homo sapiens
gcugggaggaauugguaua

SEQ ID NO: 194299 - RNA, 19 nt, Homo sapiens
gggcaagguacauuuaauc

SEQ ID NO: 194300 - RNA, 19 nt, Homo sapiens
cccaauaacugaaaauguu

SEQ ID NO: 194301 - RNA, 19 nt, Homo sapiens
uauuacacaguuccacuua

SEQ ID NO: 194302 - RNA, 19 nt, Homo sapiens
gugccaagauccggaccua

SEQ ID NO: 194303 - RNA, 19 nt, Homo sapiens
ucacaagaaaggaaagaau

SEQ ID NO: 194304 - RNA, 19 nt, Homo sapiens
aaacacuacccuuguacuu

SEQ ID NO: 194305 - RNA, 19 nt, Homo sapiens
gggaagacauacggaaugc

SEQ ID NO: 194306 - RNA, 19 nt, Homo sapiens
caaucaagaauguaugugu

SEQ ID NO: 194307 - RNA, 19 nt, Homo sapiens
cuagcuguuugauuucauu

SEQ ID NO: 194308 - RNA, 19 nt, Homo sapiens
ggagagaucuuguaucgua

SEQ ID NO: 194309 - RNA, 19 nt, Homo sapiens
gaacaugggcgauauagua

SEQ ID NO: 194310 - RNA, 19 nt, Homo sapiens
gcagauggauugaauaugu

SEQ ID NO: 194311 - RNA, 19 nt, Homo sapiens
ucacacagcuuauaacaug

SEQ ID NO: 194312 - RNA, 19 nt, Homo sapiens
gcuacaaguuccuaaauaa

SEQ ID NO: 194313 - RNA, 19 nt, Homo sapiens
gcucugugcucuccaauuu

SEQ ID NO: 194314 - RNA, 19 nt, Homo sapiens
ggauucagcuacuuaaaga

SEQ ID NO: 194315 - RNA, 19 nt, Homo sapiens
ggaagaauaucgcuuugau

SEQ ID NO: 194316 - RNA, 19 nt, Homo sapiens
ccucauggauccaaauuaa

SEQ ID NO: 194317 - RNA, 19 nt, Homo sapiens
gauggugguuggaagaaua

SEQ ID NO: 194318 - RNA, 19 nt, Homo sapiens
uaagauuccuucugucaaa

SEQ ID NO: 194319 - RNA, 19 nt, Homo sapiens
gaauaucgcuuugauggau

SEQ ID NO: 194320 - RNA, 19 nt, Homo sapiens
ccacggagucuaagaauuu

SEQ ID NO: 194321 - RNA, 19 nt, Homo sapiens
gaucuuguaucguauuuca

SEQ ID NO: 194322 - RNA, 19 nt, Homo sapiens
cauaugaguuuaagcauuc

SEQ ID NO: 194323 - RNA, 19 nt, Homo sapiens
cagcuaggauucucaaaug

SEQ ID NO: 194324 - RNA, 19 nt, Homo sapiens
gggcgucccuauucucuuu

SEQ ID NO: 194325 - RNA, 19 nt, Homo sapiens
gauauuugguggcucuauu

SEQ ID NO: 194326 - RNA, 19 nt, Homo sapiens
aacaauagcugaggaugua

SEQ ID NO: 194327 - RNA, 19 nt, Homo sapiens
gguguuacguccaugcuuu

SEQ ID NO: 194328 - RNA, 19 nt, Homo sapiens
gcaauguacuaccaagaau

SEQ ID NO: 194329 - RNA, 19 nt, Homo sapiens
ggauaugaauagauuggaa

SEQ ID NO: 194330 - RNA, 19 nt, Homo sapiens
acagggauaugaauagauu

SEQ ID NO: 194331 - RNA, 19 nt, Homo sapiens
guagauaggagaauauguu

SEQ ID NO: 194332 - RNA, 19 nt, Homo sapiens
gaauagauuggaagaaaga

SEQ ID NO: 194333 - RNA, 19 nt, Homo sapiens
uaaaagccauuacguauga

SEQ ID NO: 194334 - RNA, 19 nt, Homo sapiens
cugaagcccugaaauggua

SEQ ID NO: 194335 - RNA, 19 nt, Homo sapiens
uauaagcaguuuagccaaa

SEQ ID NO: 194336 - RNA, 19 nt, Homo sapiens
guugauggaugccgaaaug

SEQ ID NO: 194337 - RNA, 19 nt, Homo sapiens
gaagaugccuugacuuacc

SEQ ID NO: 194338 - RNA, 19 nt, Homo sapiens
ucaaaggccuuggauacaa

SEQ ID NO: 194339 - RNA, 19 nt, Homo sapiens
gagaucuuguaucguauuu

SEQ ID NO: 194340 - RNA, 19 nt, Homo sapiens
gcggagagaucuuguaucg

SEQ ID NO: 194341 - RNA, 19 nt, Homo sapiens
ccaaaucacaagcuucuuu

SEQ ID NO: 194342 - RNA, 19 nt, Homo sapiens
uugcuuuccuggcuaauua

SEQ ID NO: 194343 - RNA, 19 nt, Homo sapiens
ccauggcaauuccagauaa

SEQ ID NO: 194344 - RNA, 19 nt, Homo sapiens
ccacuaaguaucuuguuaa

SEQ ID NO: 194345 - RNA, 19 nt, Homo sapiens
gguuagacuucccaagaaa

SEQ ID NO: 194346 - RNA, 19 nt, Homo sapiens
uggaacaccugaagagcua

SEQ ID NO: 194347 - RNA, 19 nt, Homo sapiens
gauuucagcuccaccagau

SEQ ID NO: 194348 - RNA, 19 nt, Homo sapiens
gaaaaugggagcuguauau

SEQ ID NO: 194349 - RNA, 19 nt, Homo sapiens
gcccugaaaugguaauugu

SEQ ID NO: 194350 - RNA, 19 nt, Homo sapiens
caucaagugucugaaauuc

SEQ ID NO: 194351 - RNA, 19 nt, Homo sapiens
gaauugaagaggccugauu

SEQ ID NO: 194352 - RNA, 19 nt, Homo sapiens
gaauauggagggcaucaga

SEQ ID NO: 194353 - RNA, 19 nt, Homo sapiens
gcaguagugauauaaagaa

SEQ ID NO: 194354 - RNA, 19 nt, Homo sapiens
gcagauuuguguuuuguuu

SEQ ID NO: 194355 - RNA, 19 nt, Homo sapiens
gaagaacauuggagaaaau

SEQ ID NO: 194356 - RNA, 19 nt, Homo sapiens
caccaaagcagaauaaauc

SEQ ID NO: 194357 - RNA, 19 nt, Homo sapiens
caagguuucucaggugauu

SEQ ID NO: 194358 - RNA, 19 nt, Homo sapiens
aaaugaaggugguauugau

SEQ ID NO: 194359 - RNA, 19 nt, Homo sapiens
gcgcagguauaagcaguuu

SEQ ID NO: 194360 - RNA, 19 nt, Homo sapiens
ugugaucucuuguccacua

SEQ ID NO: 194361 - RNA, 19 nt, Homo sapiens
acucauccgugucucauuu

SEQ ID NO: 194362 - RNA, 19 nt, Homo sapiens
guacacaguauuuaagaug

SEQ ID NO: 194363 - RNA, 19 nt, Homo sapiens
ggaauccuagaccauauuu

SEQ ID NO: 194364 - RNA, 19 nt, Homo sapiens
uuacguccaugcuuuauca

SEQ ID NO: 194365 - RNA, 19 nt, Homo sapiens
aaacaugaaggcaauaaga

SEQ ID NO: 194366 - RNA, 19 nt, Homo sapiens
ugacagggauaugaauaga

SEQ ID NO: 194367 - RNA, 19 nt, Homo sapiens
agaaggcuaucucaauuuc

SEQ ID NO: 194368 - RNA, 19 nt, Homo sapiens
gauggaugccgaaauguau

SEQ ID NO: 194369 - RNA, 19 nt, Homo sapiens
cagugaauauuucggacua

SEQ ID NO: 194370 - RNA, 19 nt, Homo sapiens
gaaucaaaggccuuggaua

SEQ ID NO: 194371 - RNA, 19 nt, Homo sapiens
ggagaucgacccguacuug

SEQ ID NO: 194372 - RNA, 19 nt, Homo sapiens
cgcuacaaguuccuaaaua

SEQ ID NO: 194373 - RNA, 19 nt, Homo sapiens
gccgaaauguauacaaaca

SEQ ID NO: 194374 - RNA, 19 nt, Homo sapiens
ggaccuagagggacucaug

SEQ ID NO: 194375 - RNA, 19 nt, Homo sapiens
ggaaaaguagcuucuuaua

SEQ ID NO: 194376 - RNA, 19 nt, Homo sapiens
gaauguggaucugccgaau

SEQ ID NO: 194377 - RNA, 19 nt, Homo sapiens
caagcaagagcuacacuga

SEQ ID NO: 194378 - RNA, 19 nt, Homo sapiens
gcauucaguugauggcaau

SEQ ID NO: 194379 - RNA, 19 nt, Homo sapiens
caaacaggcgcuaccuuga

SEQ ID NO: 194380 - RNA, 19 nt, Homo sapiens
gaagaauaucgcuuugaug

SEQ ID NO: 194381 - RNA, 19 nt, Homo sapiens
gcagauuguuugccuacuc

SEQ ID NO: 194382 - RNA, 19 nt, Homo sapiens
uagagggacucaugaucuu

SEQ ID NO: 194383 - RNA, 19 nt, Homo sapiens
cagauggauugaauauguu

SEQ ID NO: 194384 - RNA, 19 nt, Homo sapiens
uccacuaaguaucuuguua

SEQ ID NO: 194385 - RNA, 19 nt, Homo sapiens
gcagguauaagcaguuuag

SEQ ID NO: 194386 - RNA, 19 nt, Homo sapiens
ggaauacagcuucauaaaa

SEQ ID NO: 194387 - RNA, 19 nt, Homo sapiens
ggauaagucgcuggcauuu

SEQ ID NO: 194388 - RNA, 19 nt, Homo sapiens
ucagcuacuuaaagaguuu

SEQ ID NO: 194389 - RNA, 19 nt, Homo sapiens
cacggagucuaagaauuua

SEQ ID NO: 194390 - RNA, 19 nt, Homo sapiens
guaauuguagcauuucaga

SEQ ID NO: 194391 - RNA, 19 nt, Homo sapiens
gccaguaucucagucuuuc

SEQ ID NO: 194392 - RNA, 19 nt, Homo sapiens
ugagguaccaagauuguuu

SEQ ID NO: 194393 - RNA, 19 nt, Homo sapiens
cuaggauucucaaauggaa

SEQ ID NO: 194394 - RNA, 19 nt, Homo sapiens
gcagcuaggauucucaaau

SEQ ID NO: 194395 - RNA, 19 nt, Homo sapiens
cauaaugggcgucccuauu

SEQ ID NO: 194396 - RNA, 19 nt, Homo sapiens
augaagaugccuugacuua

SEQ ID NO: 194397 - RNA, 19 nt, Homo sapiens
uaucauaguccucuuagau

SEQ ID NO: 194398 - RNA, 19 nt, Homo sapiens
gagagaucuuguaucguau

SEQ ID NO: 194399 - RNA, 19 nt, Homo sapiens
gccaucaagugucugaaau

SEQ ID NO: 194400 - RNA, 19 nt, Homo sapiens
ggaccacagcacugacuuu

SEQ ID NO: 194401 - RNA, 19 nt, Homo sapiens
cagcagauggauugaauau

SEQ ID NO: 194402 - RNA, 19 nt, Homo sapiens
uaagcaguuuagccaaauu

SEQ ID NO: 194403 - RNA, 19 nt, Homo sapiens
aaauugugcuagauucaga

SEQ ID NO: 194404 - RNA, 19 nt, Homo sapiens
aggcggcaguuucauuuaa

SEQ ID NO: 194405 - RNA, 19 nt, Homo sapiens
gaaauaaugagaguuacca

SEQ ID NO: 194406 - RNA, 19 nt, Homo sapiens
gggauaagucgcuggcauu

SEQ ID NO: 194407 - RNA, 19 nt, Homo sapiens
gagaucgacccguacuuga

SEQ ID NO: 194408 - RNA, 19 nt, Homo sapiens
gaacaagcgucacuacauu

SEQ ID NO: 194409 - RNA, 19 nt, Homo sapiens
ugacagagcugacacauag

SEQ ID NO: 194410 - RNA, 19 nt, Homo sapiens
ugaagacaauguacaguua

SEQ ID NO: 194411 - RNA, 19 nt, Homo sapiens
cgaaaggcauguaccauaa

SEQ ID NO: 194412 - RNA, 19 nt, Homo sapiens
ggaauugagugauaaacaa

SEQ ID NO: 194413 - RNA, 19 nt, Homo sapiens
gauacaggcugaagagauu

SEQ ID NO: 194414 - RNA, 19 nt, Homo sapiens
caaccacccuagcuucuua

SEQ ID NO: 194415 - RNA, 19 nt, Homo sapiens
gaacaggagcaacuacuaa

SEQ ID NO: 194416 - RNA, 19 nt, Homo sapiens
ugaaacaacugacugagaa

SEQ ID NO: 194417 - RNA, 19 nt, Homo sapiens
guagacaaauggauacuga

SEQ ID NO: 194418 - RNA, 19 nt, Homo sapiens
caagcuggcuggaaagaaa

SEQ ID NO: 194419 - RNA, 19 nt, Homo sapiens
gaagauccuuucugccauu

SEQ ID NO: 194420 - RNA, 19 nt, Homo sapiens
ggagaggaguuaucaggaa

SEQ ID NO: 194421 - RNA, 19 nt, Homo sapiens
ugaacaagcuggcuggaaa

SEQ ID NO: 194422 - RNA, 19 nt, Homo sapiens
guaaaagucuugggaaaua

SEQ ID NO: 194423 - RNA, 19 nt, Homo sapiens
ggauucagcugacuuugug

SEQ ID NO: 194424 - RNA, 19 nt, Homo sapiens
gcaaaccaccuuauacaga

SEQ ID NO: 194425 - RNA, 19 nt, Homo sapiens
cacccuagcuucuuaguga

SEQ ID NO: 194426 - RNA, 19 nt, Homo sapiens
caacaaagaugcauuuacc

SEQ ID NO: 194427 - RNA, 19 nt, Homo sapiens
uaaagcaaaccaccuuaua

SEQ ID NO: 194428 - RNA, 19 nt, Homo sapiens
guauaauccucacugauga

SEQ ID NO: 194429 - RNA, 19 nt, Homo sapiens
gagcagagucuuagguaaa

SEQ ID NO: 194430 - RNA, 19 nt, Homo sapiens
gaccagagccuuccuguca

SEQ ID NO: 194431 - RNA, 19 nt, Homo sapiens
ggacauggcaucagagauc

SEQ ID NO: 194432 - RNA, 19 nt, Homo sapiens
guacaguuauccauuagau

SEQ ID NO: 194433 - RNA, 19 nt, Homo sapiens
gacccucgcucuuaaacuu

SEQ ID NO: 194434 - RNA, 19 nt, Homo sapiens
gaacagaaggagaggaguu

SEQ ID NO: 194435 - RNA, 19 nt, Homo sapiens
gaccaacuguacuauguga

SEQ ID NO: 194436 - RNA, 19 nt, Homo sapiens
ggaaauauuugggcauugg

SEQ ID NO: 194437 - RNA, 19 nt, Homo sapiens
gcauuuaccucuguaucaa

SEQ ID NO: 194438 - RNA, 19 nt, Homo sapiens
gaagugaaggcgggaauuu

SEQ ID NO: 194439 - RNA, 19 nt, Homo sapiens
caacucaggaaaucucaua

SEQ ID NO: 194440 - RNA, 19 nt, Homo sapiens
caacgggccucgucuagag

SEQ ID NO: 194441 - RNA, 19 nt, Homo sapiens
ucgagaaacuacaagauga

SEQ ID NO: 194442 - RNA, 19 nt, Homo sapiens
gaccagcaguagacaaaug

SEQ ID NO: 194443 - RNA, 19 nt, Homo sapiens
agacauacuugaaauccaa

SEQ ID NO: 194444 - RNA, 19 nt, Homo sapiens
aagagauucugcagacaua

SEQ ID NO: 194445 - RNA, 19 nt, Homo sapiens
ggaguuccuucaaagaugu

SEQ ID NO: 194446 - RNA, 19 nt, Homo sapiens
gcacagggacagugagaga

SEQ ID NO: 194447 - RNA, 19 nt, Homo sapiens
ggaacaagcgucacuacau

SEQ ID NO: 194448 - RNA, 19 nt, Homo sapiens
ggaacaggagcaacuacua

SEQ ID NO: 194449 - RNA, 19 nt, Homo sapiens
cagaaugacuccuggaucu

SEQ ID NO: 194450 - RNA, 19 nt, Homo sapiens
gcauguaccauaagcuaaa

SEQ ID NO: 194451 - RNA, 19 nt, Homo sapiens
ggaguuaucaggaacacuu

SEQ ID NO: 194452 - RNA, 19 nt, Homo sapiens
gcaccuucguguacaauag

SEQ ID NO: 194453 - RNA, 19 nt, Homo sapiens
gggacacuuuagaccauua

SEQ ID NO: 194454 - RNA, 19 nt, Homo sapiens
guucaguucauccagauua

SEQ ID NO: 194455 - RNA, 19 nt, Homo sapiens
uacaggaucuccagacgaa

SEQ ID NO: 194456 - RNA, 19 nt, Homo sapiens
gaaaucucauaagcuggua

SEQ ID NO: 194457 - RNA, 19 nt, Homo sapiens
aauccuaccugaugaacaa

SEQ ID NO: 194458 - RNA, 19 nt, Homo sapiens
gauacugagcagagucuua

SEQ ID NO: 194459 - RNA, 19 nt, Homo sapiens
caucagagauccacaugac

SEQ ID NO: 194460 - RNA, 19 nt, Homo sapiens
gcuaucgucucuuuguuca

SEQ ID NO: 194461 - RNA, 19 nt, Homo sapiens
gaagccaggccacauccua

SEQ ID NO: 194462 - RNA, 19 nt, Homo sapiens
gaagacaauguacaguuau

SEQ ID NO: 194463 - RNA, 19 nt, Homo sapiens
agucuacaaugucccaaua

SEQ ID NO: 194464 - RNA, 19 nt, Homo sapiens
ggcaaauccuaccugauga

SEQ ID NO: 194465 - RNA, 19 nt, Homo sapiens
cuaggaaagugguugaugu

SEQ ID NO: 194466 - RNA, 19 nt, Homo sapiens
gaagagauucugcagacau

SEQ ID NO: 194467 - RNA, 19 nt, Homo sapiens
gagaggccauugaagucuu

SEQ ID NO: 194468 - RNA, 19 nt, Homo sapiens
gaaacuacaagaugaagag

SEQ ID NO: 194469 - RNA, 19 nt, Homo sapiens
aaaggcaugugguacaaug

SEQ ID NO: 194470 - RNA, 19 nt, Homo sapiens
uaaccaaggcauaauugaa

SEQ ID NO: 194471 - RNA, 19 nt, Homo sapiens
ggugcagucucacacuaaa

SEQ ID NO: 194472 - RNA, 19 nt, Homo sapiens
gagcagcaccuucguguac

SEQ ID NO: 194473 - RNA, 19 nt, Homo sapiens
gcaaauccuaccugaugaa

SEQ ID NO: 194474 - RNA, 19 nt, Homo sapiens
gcuaaagcaaaccaccuua

SEQ ID NO: 194475 - RNA, 19 nt, Homo sapiens
gauccuuucugccauuaca

SEQ ID NO: 194476 - RNA, 19 nt, Homo sapiens
ugacugagaagauggagaa

SEQ ID NO: 194477 - RNA, 19 nt, Homo sapiens
caggaacacuugaaacaac

SEQ ID NO: 194478 - RNA, 19 nt, Homo sapiens
uaucgucucuuuguucaga

SEQ ID NO: 194479 - RNA, 19 nt, Homo sapiens
ggacuuggaagcagaugga

SEQ ID NO: 194480 - RNA, 19 nt, Homo sapiens
ucuuaacacucauacuuga

SEQ ID NO: 194481 - RNA, 19 nt, Homo sapiens
aagaugcuguguaacuaaa

SEQ ID NO: 194482 - RNA, 19 nt, Homo sapiens
ugagcagagucuuagguaa

SEQ ID NO: 194483 - RNA, 19 nt, Homo sapiens
ccacucaggagaaguuuau

SEQ ID NO: 194484 - RNA, 19 nt, Homo sapiens
gagagaggccauugaaguc

SEQ ID NO: 194485 - RNA, 19 nt, Homo sapiens
gcuccacggugcagucuca

SEQ ID NO: 194486 - RNA, 19 nt, Homo sapiens
ccacaugacaggcccaaug

SEQ ID NO: 194487 - RNA, 19 nt, Homo sapiens
gacuguaaauugugcaaca

SEQ ID NO: 194488 - RNA, 19 nt, Homo sapiens
gaacacuugaaacaacuga

SEQ ID NO: 194489 - RNA, 19 nt, Homo sapiens
aaaggagauugaaguggaa

SEQ ID NO: 194490 - RNA, 19 nt, Homo sapiens
ggauacaggcugaagagau

SEQ ID NO: 194491 - RNA, 19 nt, Homo sapiens
ugagagagaggccauugaa

SEQ ID NO: 194492 - RNA, 19 nt, Homo sapiens
cauacucccugaagcugaa

SEQ ID NO: 194493 - RNA, 19 nt, Homo sapiens
agaaugagaaugagguuga

SEQ ID NO: 194494 - RNA, 19 nt, Homo sapiens
acacauagaauccgaucaa

SEQ ID NO: 194495 - RNA, 19 nt, Homo sapiens
gcagcaccuucguguacaa

SEQ ID NO: 194496 - RNA, 19 nt, Homo sapiens
cauguauaauccucacuga

SEQ ID NO: 194497 - RNA, 19 nt, Homo sapiens
ucuaugagcaauaauguga

SEQ ID NO: 194498 - RNA, 19 nt, Homo sapiens
cugagaagauggagaacga

SEQ ID NO: 194499 - RNA, 19 nt, Homo sapiens
ugaaguggaacgugugaaa

SEQ ID NO: 194500 - RNA, 19 nt, Homo sapiens
gggcuaucgucucuuuguu

SEQ ID NO: 194501 - RNA, 19 nt, Homo sapiens
uuucaguccucuagaagaa

SEQ ID NO: 194502 - RNA, 19 nt, Homo sapiens
caguucauccagauuauaa

SEQ ID NO: 194503 - RNA, 19 nt, Homo sapiens
uguauaauccucacugaug

SEQ ID NO: 194504 - RNA, 19 nt, Homo sapiens
gagcaauaaugugauuucu

SEQ ID NO: 194505 - RNA, 19 nt, Homo sapiens
guaccacucaggagaaguu

SEQ ID NO: 194506 - RNA, 19 nt, Homo sapiens
aaccaaggcauaauugaaa

SEQ ID NO: 194507 - RNA, 19 nt, Homo sapiens
acgaaaggcauguaccaua

SEQ ID NO: 194508 - RNA, 19 nt, Homo sapiens
ggacauggcuccagagauc

SEQ ID NO: 194509 - RNA, 19 nt, Homo sapiens
ggauauauuuggcccuuua

SEQ ID NO: 194510 - RNA, 19 nt, Homo sapiens
ucaaacaacugccauuaaa

SEQ ID NO: 194511 - RNA, 19 nt, Homo sapiens
ccauaaaguuugcaaagua

SEQ ID NO: 194512 - RNA, 19 nt, Homo sapiens
ggacucgacuuucacauug

SEQ ID NO: 194513 - RNA, 19 nt, Homo sapiens
gcaaacuccucaccuggua

SEQ ID NO: 194514 - RNA, 19 nt, Homo sapiens
gaacucagccgcaguggaa

SEQ ID NO: 194515 - RNA, 19 nt, Homo sapiens
ugcaggagcugaagaauaa

SEQ ID NO: 194516 - RNA, 19 nt, Homo sapiens
agaacaaguugcagaauuu

SEQ ID NO: 194517 - RNA, 19 nt, Homo sapiens
caagaaacaacaugaauga

SEQ ID NO: 194518 - RNA, 19 nt, Homo sapiens
gaacccugauuucauagaa

SEQ ID NO: 194519 - RNA, 19 nt, Homo sapiens
gagaaugacuccuggaucu

SEQ ID NO: 194520 - RNA, 19 nt, Homo sapiens
ggacagggcccaguuaaug

SEQ ID NO: 194521 - RNA, 19 nt, Homo sapiens
gaacagaaagagaagaguu

SEQ ID NO: 194522 - RNA, 19 nt, Homo sapiens
gaaguaccuugcucaccua

SEQ ID NO: 194523 - RNA, 19 nt, Homo sapiens
cgacucagcugacuuugug

SEQ ID NO: 194524 - RNA, 19 nt, Homo sapiens
gcaaaguaaagguuaagua

SEQ ID NO: 194525 - RNA, 19 nt, Homo sapiens
gaacaugugaaacaauuga

SEQ ID NO: 194526 - RNA, 19 nt, Homo sapiens
gaacaggaacgccuucuca

SEQ ID NO: 194527 - RNA, 19 nt, Homo sapiens
caacaugaaugagcaacuu

SEQ ID NO: 194528 - RNA, 19 nt, Homo sapiens
ggauguggcugaugcacuu

SEQ ID NO: 194529 - RNA, 19 nt, Homo sapiens
uagaacaaguugcagaauu

SEQ ID NO: 194530 - RNA, 19 nt, Homo sapiens
gacccucgcucuuaaacuu

SEQ ID NO: 194531 - RNA, 19 nt, Homo sapiens
ggagguuaccgucucuuua

SEQ ID NO: 194532 - RNA, 19 nt, Homo sapiens
ugaaacaauugacugagaa

SEQ ID NO: 194533 - RNA, 19 nt, Homo sapiens
ucaaggauguggaccaaau

SEQ ID NO: 194534 - RNA, 19 nt, Homo sapiens
gugaaacaauugacugaga

SEQ ID NO: 194535 - RNA, 19 nt, Homo sapiens
ucucuaggcuccacaguga

SEQ ID NO: 194536 - RNA, 19 nt, Homo sapiens
caagcuggcugggaagaaa

SEQ ID NO: 194537 - RNA, 19 nt, Homo sapiens
ggaccaacuucacuaugug

SEQ ID NO: 194538 - RNA, 19 nt, Homo sapiens
gaaugacuccuggaucuuu

SEQ ID NO: 194539 - RNA, 19 nt, Homo sapiens
gcacagggacagugagaga

SEQ ID NO: 194540 - RNA, 19 nt, Homo sapiens
gaaaagguacugauaagaa

SEQ ID NO: 194541 - RNA, 19 nt, Homo sapiens
gcauuuguguggacucuca

SEQ ID NO: 194542 - RNA, 19 nt, Homo sapiens
agaaagcagugcagccaaa

SEQ ID NO: 194543 - RNA, 19 nt, Homo sapiens
gcugacagaucgaaucaag

SEQ ID NO: 194544 - RNA, 19 nt, Homo sapiens
gcaccuucguguacaauag

SEQ ID NO: 194545 - RNA, 19 nt, Homo sapiens
agagaagaguuaucaggaa

SEQ ID NO: 194546 - RNA, 19 nt, Homo sapiens
cagccaaacucggaagaaa

SEQ ID NO: 194547 - RNA, 19 nt, Homo sapiens
aauccuaccugaugaacaa

SEQ ID NO: 194548 - RNA, 19 nt, Homo sapiens
acaacugccauuaaacuua

SEQ ID NO: 194549 - RNA, 19 nt, Homo sapiens
caaagcaucaucagauugu

SEQ ID NO: 194550 - RNA, 19 nt, Homo sapiens
gauccuaucugcaauuacg

SEQ ID NO: 194551 - RNA, 19 nt, Homo sapiens
aggaacaugugaaacaauu

SEQ ID NO: 194552 - RNA, 19 nt, Homo sapiens
gaagaguuaucaggaacau

SEQ ID NO: 194553 - RNA, 19 nt, Homo sapiens
cgauugaaguggaacguau

SEQ ID NO: 194554 - RNA, 19 nt, Homo sapiens
gaucagucacucucagaaa

SEQ ID NO: 194555 - RNA, 19 nt, Homo sapiens
uagagaagggugacaauga

SEQ ID NO: 194556 - RNA, 19 nt, Homo sapiens
ggcaaauccuaccugauga

SEQ ID NO: 194557 - RNA, 19 nt, Homo sapiens
gagaggccauugaagucuu

SEQ ID NO: 194558 - RNA, 19 nt, Homo sapiens
gaagagcugaacccugauu

SEQ ID NO: 194559 - RNA, 19 nt, Homo sapiens
acaauugacugagaagaug

SEQ ID NO: 194560 - RNA, 19 nt, Homo sapiens
gaugacuacuuggagcuuu

SEQ ID NO: 194561 - RNA, 19 nt, Homo sapiens
ccaagaaacaacaugaaug

SEQ ID NO: 194562 - RNA, 19 nt, Homo sapiens
ggagaugauggaacagaaa

SEQ ID NO: 194563 - RNA, 19 nt, Homo sapiens
gaaguggaacguauaaagg

SEQ ID NO: 194564 - RNA, 19 nt, Homo sapiens
guaccuugcucaccuagag

SEQ ID NO: 194565 - RNA, 19 nt, Homo sapiens
gagcagcaccuucguguac

SEQ ID NO: 194566 - RNA, 19 nt, Homo sapiens
gcaaauccuaccugaugaa

SEQ ID NO: 194567 - RNA, 19 nt, Homo sapiens
uaccgucucuuuacucaga

SEQ ID NO: 194568 - RNA, 19 nt, Homo sapiens
gagagcaagagacuucaaa

SEQ ID NO: 194569 - RNA, 19 nt, Homo sapiens
ucaggaacaugugaaacaa

SEQ ID NO: 194570 - RNA, 19 nt, Homo sapiens
aaagaagaaugaggagaug

SEQ ID NO: 194571 - RNA, 19 nt, Homo sapiens
gcagaauuccaaagcauca

SEQ ID NO: 194572 - RNA, 19 nt, Homo sapiens
ggauguggaccaaauguuc

SEQ ID NO: 194573 - RNA, 19 nt, Homo sapiens
gaaucuggauguggugugu

SEQ ID NO: 194574 - RNA, 19 nt, Homo sapiens
agaaagagaagaguuauca

SEQ ID NO: 194575 - RNA, 19 nt, Homo sapiens
ccucauugauaacacuaaa

SEQ ID NO: 194576 - RNA, 19 nt, Homo sapiens
gauugaaguggaacguaua

SEQ ID NO: 194577 - RNA, 19 nt, Homo sapiens
gagagaggccauugaaguc

SEQ ID NO: 194578 - RNA, 19 nt, Homo sapiens
gagggacagggcccaguua

SEQ ID NO: 194579 - RNA, 19 nt, Homo sapiens
uccaaagcaucaucagauu

SEQ ID NO: 194580 - RNA, 19 nt, Homo sapiens
ugagagagaggccauugaa

SEQ ID NO: 194581 - RNA, 19 nt, Homo sapiens
caaugggccucgucuagag

SEQ ID NO: 194582 - RNA, 19 nt, Homo sapiens
gcagcaccuucguguacaa

SEQ ID NO: 194583 - RNA, 19 nt, Homo sapiens
gucaaacaacugccauuaa

SEQ ID NO: 194584 - RNA, 19 nt, Homo sapiens
acuuggagcuuucgcuaaa

SEQ ID NO: 194585 - RNA, 19 nt, Homo sapiens
cagaucgaaucaaggcaaa

SEQ ID NO: 194586 - RNA, 19 nt, Homo sapiens
acaguuaccgugagagaaa

SEQ ID NO: 194587 - RNA, 19 nt, Homo sapiens
gaaccauaaaguuugcaaa

SEQ ID NO: 194588 - RNA, 19 nt, Homo sapiens
gaaaauguuggaggaaaua

SEQ ID NO: 194589 - RNA, 19 nt, Homo sapiens
gaacguauaaaggcugaau

SEQ ID NO: 194590 - RNA, 19 nt, Homo sapiens
uggcuuuacuucaggauau

SEQ ID NO: 194591 - RNA, 19 nt, Homo sapiens
agacgacucagcugacuuu

SEQ ID NO: 194592 - RNA, 19 nt, Homo sapiens
gagcugacagaucgaauca

SEQ ID NO: 194593 - RNA, 19 nt, Homo sapiens
gcuccacagugaagucuca

SEQ ID NO: 194594 - RNA, 19 nt, Homo sapiens
aacagaaagagaagaguua

SEQ ID NO: 194595 - RNA, 19 nt, Homo sapiens
gaagaaugaggagaugaug

SEQ ID NO: 194596 - RNA, 19 nt, Homo sapiens
uggaccaacuucacuaugu

SEQ ID NO: 194597 - RNA, 19 nt, Homo sapiens
gaagggugacaaugagaau

SEQ ID NO: 194598 - RNA, 19 nt, Homo sapiens
ugucaaacaacugccauua

SEQ ID NO: 194599 - RNA, 19 nt, Homo sapiens
uaagcagaauuccaaagca

SEQ ID NO: 194600 - RNA, 19 nt, Homo sapiens
aaacaacugccauuaaacu

SEQ ID NO: 194601 - RNA, 19 nt, Homo sapiens
gagguuaccgucucuuuac

SEQ ID NO: 194602 - RNA, 19 nt, Homo sapiens
ccaaagcaucaucagauug

SEQ ID NO: 194603 - RNA, 19 nt, Homo sapiens
ggaacuggaaguagaugga

SEQ ID NO: 194604 - RNA, 19 nt, Homo sapiens
ggaacaacaccuggacaug

SEQ ID NO: 194605 - RNA, 19 nt, Homo sapiens
gcacuucuacagacugauc

SEQ ID NO: 194606 - RNA, 19 nt, Homo sapiens
gcugaugcacuucuacaga

SEQ ID NO: 194607 - RNA, 19 nt, Homo sapiens
guuaccgucucuuuacuca

SEQ ID NO: 194608 - RNA, 19 nt, Homo sapiens
caaauuggcuaaugaagaa

SEQ ID NO: 194609 - RNA, 19 nt, Homo sapiens
gagaagacccucacuagua

SEQ ID NO: 194610 - RNA, 19 nt, Homo sapiens
ggacauggcuccagagauc

SEQ ID NO: 194611 - RNA, 19 nt, Homo sapiens
guacaguucuccauuauau

SEQ ID NO: 194612 - RNA, 19 nt, Homo sapiens
ggacauugcccauggauaa

SEQ ID NO: 194613 - RNA, 19 nt, Homo sapiens
gauacaggcugaagagauu

SEQ ID NO: 194614 - RNA, 19 nt, Homo sapiens
gaguaggaauugaaucaua

SEQ ID NO: 194615 - RNA, 19 nt, Homo sapiens
gaacaggcccgaguacuaa

SEQ ID NO: 194616 - RNA, 19 nt, Homo sapiens
gaggagggaucaugaguug

SEQ ID NO: 194617 - RNA, 19 nt, Homo sapiens
ccacugaagucuauaugaa

SEQ ID NO: 194618 - RNA, 19 nt, Homo sapiens
ggaagacaguguacaguuc

SEQ ID NO: 194619 - RNA, 19 nt, Homo sapiens
agaagacccucacuaguaa

SEQ ID NO: 194620 - RNA, 19 nt, Homo sapiens
gcuauugucucuuuauuca

SEQ ID NO: 194621 - RNA, 19 nt, Homo sapiens
aggcauaacugaaacaauu

SEQ ID NO: 194622 - RNA, 19 nt, Homo sapiens
caaagggaauauggaauuu

SEQ ID NO: 194623 - RNA, 19 nt, Homo sapiens
caaggucuaugagcaauaa

SEQ ID NO: 194624 - RNA, 19 nt, Homo sapiens
gaacucagccgcagugcaa

SEQ ID NO: 194625 - RNA, 19 nt, Homo sapiens
ggaacaggcccgaguacua

SEQ ID NO: 194626 - RNA, 19 nt, Homo sapiens
ggauucagcugacuuugug

SEQ ID NO: 194627 - RNA, 19 nt, Homo sapiens
ugaggaaagucuuagguaa

SEQ ID NO: 194628 - RNA, 19 nt, Homo sapiens
gaacaugugaaacaauuga

SEQ ID NO: 194629 - RNA, 19 nt, Homo sapiens
gaagaguuaucaagaacau

SEQ ID NO: 194630 - RNA, 19 nt, Homo sapiens
caacaaagaugcauuuacc

SEQ ID NO: 194631 - RNA, 19 nt, Homo sapiens
ggaggccacugaagucuau

SEQ ID NO: 194632 - RNA, 19 nt, Homo sapiens
gagcagcacucucguguac

SEQ ID NO: 194633 - RNA, 19 nt, Homo sapiens
ugucaaacauccuagguaa

SEQ ID NO: 194634 - RNA, 19 nt, Homo sapiens
aaagguugcuuaacuucua

SEQ ID NO: 194635 - RNA, 19 nt, Homo sapiens
gacaguugacccugaauua

SEQ ID NO: 194636 - RNA, 19 nt, Homo sapiens
gaaaucauuagcaagagua

SEQ ID NO: 194637 - RNA, 19 nt, Homo sapiens
uuacaaagguugcuuaacu

SEQ ID NO: 194638 - RNA, 19 nt, Homo sapiens
gcagcacucucguguacaa

SEQ ID NO: 194639 - RNA, 19 nt, Homo sapiens
gguaagugguugacauuuc

SEQ ID NO: 194640 - RNA, 19 nt, Homo sapiens
caagaagcaucaucagauc

SEQ ID NO: 194641 - RNA, 19 nt, Homo sapiens
gaccaacuguacuauguga

SEQ ID NO: 194642 - RNA, 19 nt, Homo sapiens
uaacaauuaugcacugugu

SEQ ID NO: 194643 - RNA, 19 nt, Homo sapiens
agagaagaguuaucaagaa

SEQ ID NO: 194644 - RNA, 19 nt, Homo sapiens
gaagugaaggcgggaauuu

SEQ ID NO: 194645 - RNA, 19 nt, Homo sapiens
gaacaaugcccuggacaug

SEQ ID NO: 194646 - RNA, 19 nt, Homo sapiens
ugauggaucucaagcuaaa

SEQ ID NO: 194647 - RNA, 19 nt, Homo sapiens
gaaacaaccauccuagcuu

SEQ ID NO: 194648 - RNA, 19 nt, Homo sapiens
gaggaaagucuuagguaaa

SEQ ID NO: 194649 - RNA, 19 nt, Homo sapiens
ugaaacaauugacugagaa

SEQ ID NO: 194650 - RNA, 19 nt, Homo sapiens
gagaagaguuaucaagaac

SEQ ID NO: 194651 - RNA, 19 nt, Homo sapiens
gaagagaaagagaagaguu

SEQ ID NO: 194652 - RNA, 19 nt, Homo sapiens
caagcuagcugggaagaau

SEQ ID NO: 194653 - RNA, 19 nt, Homo sapiens
ccaaagggaauauggaauu

SEQ ID NO: 194654 - RNA, 19 nt, Homo sapiens
gcauuuaccucuguaccaa

SEQ ID NO: 194655 - RNA, 19 nt, Homo sapiens
cgcauaagcuaaagaucua

SEQ ID NO: 194656 - RNA, 19 nt, Homo sapiens
gugaaacaauugacugaga

SEQ ID NO: 194657 - RNA, 19 nt, Homo sapiens
cuaaagaucuaaacaacag

SEQ ID NO: 194658 - RNA, 19 nt, Homo sapiens
cuaguaaacuucaggaaca

SEQ ID NO: 194659 - RNA, 19 nt, Homo sapiens
uggaggaaaugcaaauaaa

SEQ ID NO: 194660 - RNA, 19 nt, Homo sapiens
gugcugaccuauaucaaug

SEQ ID NO: 194661 - RNA, 19 nt, Homo sapiens
ugacauuucuuacagcaau

SEQ ID NO: 194662 - RNA, 19 nt, Homo sapiens
agacauacuugaaauccaa

SEQ ID NO: 194663 - RNA, 19 nt, Homo sapiens
aagagauucugcagacaua

SEQ ID NO: 194664 - RNA, 19 nt, Homo sapiens
ugaccuauaucaaugcuau

SEQ ID NO: 194665 - RNA, 19 nt, Homo sapiens
gcucugaagccauuacaaa

SEQ ID NO: 194666 - RNA, 19 nt, Homo sapiens
uacaauaggucccaauauc

SEQ ID NO: 194667 - RNA, 19 nt, Homo sapiens
gauuguaaauugugcaaca

SEQ ID NO: 194668 - RNA, 19 nt, Homo sapiens
ucaagaacaugugaaacaa

SEQ ID NO: 194669 - RNA, 19 nt, Homo sapiens
guaagugguugacauuucu

SEQ ID NO: 194670 - RNA, 19 nt, Homo sapiens
gcuaaagcaaaccaucuua

SEQ ID NO: 194671 - RNA, 19 nt, Homo sapiens
ggagagaugccaaggugaa

SEQ ID NO: 194672 - RNA, 19 nt, Homo sapiens
cagaaugacuccuggaucu

SEQ ID NO: 194673 - RNA, 19 nt, Homo sapiens
ucucugggcuccacaguga

SEQ ID NO: 194674 - RNA, 19 nt, Homo sapiens
gggcuauugucucuuuauu

SEQ ID NO: 194675 - RNA, 19 nt, Homo sapiens
gcacucucguguacaauag

SEQ ID NO: 194676 - RNA, 19 nt, Homo sapiens
ccagaaagcuacacaacac

SEQ ID NO: 194677 - RNA, 19 nt, Homo sapiens
uaccuggacugaagauaaa

SEQ ID NO: 194678 - RNA, 19 nt, Homo sapiens
gaaagcuacacaacacuga

SEQ ID NO: 194679 - RNA, 19 nt, Homo sapiens
guacccaacuucaaaauga

SEQ ID NO: 194680 - RNA, 19 nt, Homo sapiens
ucuuaaaggucauacuuga

SEQ ID NO: 194681 - RNA, 19 nt, Homo sapiens
aaagagaagugacagaaac

SEQ ID NO: 194682 - RNA, 19 nt, Homo sapiens
uguauaacaugcaaugaug

SEQ ID NO: 194683 - RNA, 19 nt, Homo sapiens
caagagaagacccucacua

SEQ ID NO: 194684 - RNA, 19 nt, Homo sapiens
gccuagugcugaccuauau

SEQ ID NO: 194685 - RNA, 19 nt, Homo sapiens
aauccuaccugaugaacaa

SEQ ID NO: 194686 - RNA, 19 nt, Homo sapiens
ccugagaccuuuagacagu

SEQ ID NO: 194687 - RNA, 19 nt, Homo sapiens
gaucucaagcuaaagcaaa

SEQ ID NO: 194688 - RNA, 19 nt, Homo sapiens
cauccuaacccaaggcaua

SEQ ID NO: 194689 - RNA, 19 nt, Homo sapiens
ggaaaauccuaccugauga

SEQ ID NO: 194690 - RNA, 19 nt, Homo sapiens
cacuuuaacugaagauaga

SEQ ID NO: 194691 - RNA, 19 nt, Homo sapiens
gcaaaccaucuuauacaga

SEQ ID NO: 194692 - RNA, 19 nt, Homo sapiens
gaucuugcaucauaacacu

SEQ ID NO: 194693 - RNA, 19 nt, Homo sapiens
aagagaaagagaagaguua

SEQ ID NO: 194694 - RNA, 19 nt, Homo sapiens
uaaacagaaucaagaagca

SEQ ID NO: 194695 - RNA, 19 nt, Homo sapiens
uugagaaacuacaagauga

SEQ ID NO: 194696 - RNA, 19 nt, Homo sapiens
acaauuaugcacuguguaa

SEQ ID NO: 194697 - RNA, 19 nt, Homo sapiens
aguguacaguucuccauua

SEQ ID NO: 194698 - RNA, 19 nt, Homo sapiens
caaccauccuagcuuccua

SEQ ID NO: 194699 - RNA, 19 nt, Homo sapiens
gaauuuggaacaaguguca

SEQ ID NO: 194700 - RNA, 19 nt, Homo sapiens
gaggaaaugcaaauaaagu

SEQ ID NO: 194701 - RNA, 19 nt, Homo sapiens
gaagagauucugcagacau

SEQ ID NO: 194702 - RNA, 19 nt, Homo sapiens
ucaagaagcaucaucagau

SEQ ID NO: 194703 - RNA, 19 nt, Homo sapiens
gaaucaagaagcaucauca

SEQ ID NO: 194704 - RNA, 19 nt, Homo sapiens
gaaacuacaagaugaagag

SEQ ID NO: 194705 - RNA, 19 nt, Homo sapiens
cuuaguauauguagacuuc

SEQ ID NO: 194706 - RNA, 19 nt, Homo sapiens
gcaagaguaggaauugaau

SEQ ID NO: 194707 - RNA, 19 nt, Homo sapiens
ggaagguaaagaaaucauu

SEQ ID NO: 194708 - RNA, 19 nt, Homo sapiens
gcauggcgcucaccucuac

SEQ ID NO: 194709 - RNA, 19 nt, Homo sapiens
ggaaagacgagucaaaggu

SEQ ID NO: 194710 - RNA, 19 nt, Homo sapiens
ggagagcgauguggacuac

SEQ ID NO: 194711 - RNA, 19 nt, Homo sapiens
agaaggaguuccacugcaa

SEQ ID NO: 194712 - RNA, 19 nt, Homo sapiens
uagcaccgccuucagcaua

SEQ ID NO: 194713 - RNA, 19 nt, Homo sapiens
gaaggaguuccacugcaaa

SEQ ID NO: 194714 - RNA, 19 nt, Homo sapiens
gcaagggaaagacgaguca

SEQ ID NO: 194715 - RNA, 19 nt, Homo sapiens
cagguucgcuaucagaagu

SEQ ID NO: 194716 - RNA, 19 nt, Homo sapiens
ucagcgaggugcaggugaa

SEQ ID NO: 194717 - RNA, 19 nt, Homo sapiens
gacuacagcucggaugaca

SEQ ID NO: 194718 - RNA, 19 nt, Homo sapiens
ggaagacgacccgaagcaa

SEQ ID NO: 194719 - RNA, 19 nt, Homo sapiens
cuacagcucggaugacaau

SEQ ID NO: 194720 - RNA, 19 nt, Homo sapiens
gcaccgccuucagcauaga

SEQ ID NO: 194721 - RNA, 19 nt, Homo sapiens
gcucaccucuacgcucaug

SEQ ID NO: 194722 - RNA, 19 nt, Homo sapiens
caaugccaauuccaagaca

SEQ ID NO: 194723 - RNA, 19 nt, Homo sapiens
cgccgucgcugaugaugau

SEQ ID NO: 194724 - RNA, 19 nt, Homo sapiens
gaucgcccacgcccucaaa

SEQ ID NO: 194725 - RNA, 19 nt, Homo sapiens
gucagcagguucgcuauca

SEQ ID NO: 194726 - RNA, 19 nt, Homo sapiens
cagcucggaugacaaucug

SEQ ID NO: 194727 - RNA, 19 nt, Homo sapiens
gcaaugccaauuccaagac

SEQ ID NO: 194728 - RNA, 19 nt, Homo sapiens
gggaguagcaccgccuuca

SEQ ID NO: 194729 - RNA, 19 nt, Homo sapiens
cagcagguucgcuaucaga

SEQ ID NO: 194730 - RNA, 19 nt, Homo sapiens
ccacgucuacgggcaagaa

SEQ ID NO: 194731 - RNA, 19 nt, Homo sapiens
gcccacgcccucaaacuca

SEQ ID NO: 194732 - RNA, 19 nt, Homo sapiens
uaucagaagucagcaucag

SEQ ID NO: 194733 - RNA, 19 nt, Homo sapiens
gggaaagacgagucaaagg

SEQ ID NO: 194734 - RNA, 19 nt, Homo sapiens
aaaaguaccucuccuugac

SEQ ID NO: 194735 - RNA, 19 nt, Homo sapiens
ugcuggagcuagagaagga

SEQ ID NO: 194736 - RNA, 19 nt, Homo sapiens
caaaggcuuccuggccaaa

SEQ ID NO: 194737 - RNA, 19 nt, Homo sapiens
ggaacuaucuucuuucauu

SEQ ID NO: 194738 - RNA, 19 nt, Homo sapiens
ggaaagauccaaaggaaua

SEQ ID NO: 194739 - RNA, 19 nt, Homo sapiens
ccaaagagcugccugaaca

SEQ ID NO: 194740 - RNA, 19 nt, Homo sapiens
ccaaagucauggauaagua

SEQ ID NO: 194741 - RNA, 19 nt, Homo sapiens
gcaagacucucugguagaa

SEQ ID NO: 194742 - RNA, 19 nt, Homo sapiens
gaacuaucuucuuucauug

SEQ ID NO: 194743 - RNA, 19 nt, Homo sapiens
gaacaggucagccaacuug

SEQ ID NO: 194744 - RNA, 19 nt, Homo sapiens
gcuaagggcccucuacuaa

SEQ ID NO: 194745 - RNA, 19 nt, Homo sapiens
ugacaaguaugaugauuug

SEQ ID NO: 194746 - RNA, 19 nt, Homo sapiens
uggcaaagcugguuaacaa

SEQ ID NO: 194747 - RNA, 19 nt, Homo sapiens
aaagagagacuccagcuua

SEQ ID NO: 194748 - RNA, 19 nt, Homo sapiens
cgaacaagcuccucuguca

SEQ ID NO: 194749 - RNA, 19 nt, Homo sapiens
gaagacaacuaggauacuu

SEQ ID NO: 194750 - RNA, 19 nt, Homo sapiens
gccacuagcugaagauauu

SEQ ID NO: 194751 - RNA, 19 nt, Homo sapiens
gaagacuguugucaagaaa

SEQ ID NO: 194752 - RNA, 19 nt, Homo sapiens
ccacaaagaauucuaaguu

SEQ ID NO: 194753 - RNA, 19 nt, Homo sapiens
caggaaagauccaaaggaa

SEQ ID NO: 194754 - RNA, 19 nt, Homo sapiens
ucagcaaucucauaaaguu

SEQ ID NO: 194755 - RNA, 19 nt, Homo sapiens
gaauaaagucugcaaggaa

SEQ ID NO: 194756 - RNA, 19 nt, Homo sapiens
caaguaugaugauuugcua

SEQ ID NO: 194757 - RNA, 19 nt, Homo sapiens
ccaagggaaugaucucuga

SEQ ID NO: 194758 - RNA, 19 nt, Homo sapiens
acaccaaagucauggauaa

SEQ ID NO: 194759 - RNA, 19 nt, Homo sapiens
gacaauuuauccacaaaga

SEQ ID NO: 194760 - RNA, 19 nt, Homo sapiens
gaaaggaggacuucacauc

SEQ ID NO: 194761 - RNA, 19 nt, Homo sapiens
uaacaagcgcucagacuuu

SEQ ID NO: 194762 - RNA, 19 nt, Homo sapiens
caagaacuaugugcagauu

SEQ ID NO: 194763 - RNA, 19 nt, Homo sapiens
ugaagacuguugucaagaa

SEQ ID NO: 194764 - RNA, 19 nt, Homo sapiens
gacuccagcuuaaacauuu

SEQ ID NO: 194765 - RNA, 19 nt, Homo sapiens
ucaguuacaccaagaguua

SEQ ID NO: 194766 - RNA, 19 nt, Homo sapiens
ccugaagcauguuuauuaa

SEQ ID NO: 194767 - RNA, 19 nt, Homo sapiens
gcaaggaauucucccaucu

SEQ ID NO: 194768 - RNA, 19 nt, Homo sapiens
gcucagcaaucucauaaag

SEQ ID NO: 194769 - RNA, 19 nt, Homo sapiens
gaaaguaauucuccauucc

SEQ ID NO: 194770 - RNA, 19 nt, Homo sapiens
caacuaggauacuuucuac

SEQ ID NO: 194771 - RNA, 19 nt, Homo sapiens
gaacuggcaaagcugguua

SEQ ID NO: 194772 - RNA, 19 nt, Homo sapiens
cugcauggcugcucugaaa

SEQ ID NO: 194773 - RNA, 19 nt, Homo sapiens
cuaggauacuuucuacuuu

SEQ ID NO: 194774 - RNA, 19 nt, Homo sapiens
ugaagaauauccuguaguc

SEQ ID NO: 194775 - RNA, 19 nt, Homo sapiens
caacugcuguuccauaaac

SEQ ID NO: 194776 - RNA, 19 nt, Homo sapiens
uaagggcccucuacuaaag

SEQ ID NO: 194777 - RNA, 19 nt, Homo sapiens
aaacaaagaugugugugau

SEQ ID NO: 194778 - RNA, 19 nt, Homo sapiens
ucaccacucugucaaauag

SEQ ID NO: 194779 - RNA, 19 nt, Homo sapiens
ugaaugcugugauguugaa

SEQ ID NO: 194780 - RNA, 19 nt, Homo sapiens
ucacuaguccuguacagua

SEQ ID NO: 194781 - RNA, 19 nt, Homo sapiens
aaugaucucugaugaccua

SEQ ID NO: 194782 - RNA, 19 nt, Homo sapiens
aaacucaccuccucuuuac

SEQ ID NO: 194783 - RNA, 19 nt, Homo sapiens
agaacuaugugcagauuau

SEQ ID NO: 194784 - RNA, 19 nt, Homo sapiens
ggugaaugcugugauguug

SEQ ID NO: 194785 - RNA, 19 nt, Homo sapiens
aagagagacuccagcuuaa

SEQ ID NO: 194786 - RNA, 19 nt, Homo sapiens
ugaaaguaauucuccauuc

SEQ ID NO: 194787 - RNA, 19 nt, Homo sapiens
ucacaucucugucacuagu

SEQ ID NO: 194788 - RNA, 19 nt, Homo sapiens
gcuacaauaucuucauaca

SEQ ID NO: 194789 - RNA, 19 nt, Homo sapiens
gcucagacuuugccuccaa

SEQ ID NO: 194790 - RNA, 19 nt, Homo sapiens
ggacuucacaucucuguca

SEQ ID NO: 194791 - RNA, 19 nt, Homo sapiens
gagauugcccacaaacaaa

SEQ ID NO: 194792 - RNA, 19 nt, Homo sapiens
caaaugaugaaaucuguga

SEQ ID NO: 194793 - RNA, 19 nt, Homo sapiens
gccaaguccugugaaagua

SEQ ID NO: 194794 - RNA, 19 nt, Homo sapiens
ccacggaacuggcaaagcu

SEQ ID NO: 194795 - RNA, 19 nt, Homo sapiens
ugacaagggacaagaacua

SEQ ID NO: 194796 - RNA, 19 nt, Homo sapiens
aauaaagucugcaaggaau

SEQ ID NO: 194797 - RNA, 19 nt, Homo sapiens
caaaggaauaugcuaauca

SEQ ID NO: 194798 - RNA, 19 nt, Homo sapiens
uuacugugauucagagauu

SEQ ID NO: 194799 - RNA, 19 nt, Homo sapiens
caaacaaagauguguguga

SEQ ID NO: 194800 - RNA, 19 nt, Homo sapiens
guaaaacucugugacaauu

SEQ ID NO: 194801 - RNA, 19 nt, Homo sapiens
gggcugacccugacugcua

SEQ ID NO: 194802 - RNA, 19 nt, Homo sapiens
guacuugagccaacccuaa

SEQ ID NO: 194803 - RNA, 19 nt, Homo sapiens
uuacuaacauccucuccaa

SEQ ID NO: 194804 - RNA, 19 nt, Homo sapiens
agaguuaucuuucuauggu

SEQ ID NO: 194805 - RNA, 19 nt, Homo sapiens
cacaaaugaugaaaucugu

SEQ ID NO: 194806 - RNA, 19 nt, Homo sapiens
agaauaaagucugcaagga

SEQ ID NO: 194807 - RNA, 19 nt, Homo sapiens
aauagagucugcucacaau

SEQ ID NO: 194808 - RNA, 19 nt, Homo sapiens
caccuccucuuuacuguga

SEQ ID NO: 194809 - RNA, 19 nt, Homo sapiens
ucaacuaccuguuuuaaug

SEQ ID NO: 194810 - RNA, 19 nt, Homo sapiens
gaaaucaaggcucagcaau

SEQ ID NO: 194811 - RNA, 19 nt, Homo sapiens
gcucacaauaugcugcuua

SEQ ID NO: 194812 - RNA, 19 nt, Homo sapiens
caaauagagucugcucaca

SEQ ID NO: 194813 - RNA, 19 nt, Homo sapiens
ccaaaggaauaugcuaauc

SEQ ID NO: 194814 - RNA, 19 nt, Homo sapiens
uccugaagcauguuuauua

SEQ ID NO: 194815 - RNA, 19 nt, Homo sapiens
uccaacugcuguuccauaa

SEQ ID NO: 194816 - RNA, 19 nt, Homo sapiens
caagggacaagaacuaugu

SEQ ID NO: 194817 - RNA, 19 nt, Homo sapiens
gaaguauuccucaguaagg

SEQ ID NO: 194818 - RNA, 19 nt, Homo sapiens
aaucaaggcucagcaaucu

SEQ ID NO: 194819 - RNA, 19 nt, Homo sapiens
gaaagagagacuccagcuu

SEQ ID NO: 194820 - RNA, 19 nt, Homo sapiens
gaaagauccaaaggaauau

SEQ ID NO: 194821 - RNA, 19 nt, Homo sapiens
gcugcaagacucucuggua

SEQ ID NO: 194822 - RNA, 19 nt, Homo sapiens
aagauugcauggccaaaga

SEQ ID NO: 194823 - RNA, 19 nt, Homo sapiens
cuaacauccucuccaaaug

SEQ ID NO: 194824 - RNA, 19 nt, Homo sapiens
ucagccaacuugugaagga

SEQ ID NO: 194825 - RNA, 19 nt, Homo sapiens
acaaugacaaguaugauga

SEQ ID NO: 194826 - RNA, 19 nt, Homo sapiens
cugcugaucuggaggaugu

SEQ ID NO: 194827 - RNA, 19 nt, Homo sapiens
gaguuaucuuucuauggua

SEQ ID NO: 194828 - RNA, 19 nt, Homo sapiens
aagagggccuggaacgaaa

SEQ ID NO: 194829 - RNA, 19 nt, Homo sapiens
ugagauugcccacaaacaa

SEQ ID NO: 194830 - RNA, 19 nt, Homo sapiens
gacccugacugcuaugaca

SEQ ID NO: 194831 - RNA, 19 nt, Homo sapiens
caaguccugugaaaguaau

SEQ ID NO: 194832 - RNA, 19 nt, Homo sapiens
gaacuaugugcagauuauu

SEQ ID NO: 194833 - RNA, 19 nt, Homo sapiens
aaggaacuaucuucuuuca

SEQ ID NO: 194834 - RNA, 19 nt, Homo sapiens
caaagucauggauaaguau

SEQ ID NO: 194835 - RNA, 19 nt, Homo sapiens
ccaggaaacaccaaaguca

SEQ ID NO: 194836 - RNA, 19 nt, Homo sapiens
gaaacaccagccacaggaa

SEQ ID NO: 194837 - RNA, 19 nt, Homo sapiens
gaagauggaauucucugua

SEQ ID NO: 194838 - RNA, 19 nt, Homo sapiens
gaugagagcagacuccauu

SEQ ID NO: 194839 - RNA, 19 nt, Homo sapiens
gaaauagcagcuucucuug

SEQ ID NO: 194840 - RNA, 19 nt, Homo sapiens
ggagagcuaucacgggaau

SEQ ID NO: 194841 - RNA, 19 nt, Homo sapiens
ugaaauagcagcuucucuu

SEQ ID NO: 194842 - RNA, 19 nt, Homo sapiens
auaaagaccugcacaucug

SEQ ID NO: 194843 - RNA, 19 nt, Homo sapiens
ggagaucauuucggagaug

SEQ ID NO: 194844 - RNA, 19 nt, Homo sapiens
ugagagcagacuccauuua

SEQ ID NO: 194845 - RNA, 19 nt, Homo sapiens
gagcgucucaauccacuuu

SEQ ID NO: 194846 - RNA, 19 nt, Homo sapiens
gaccagagcccacuacaac

SEQ ID NO: 194847 - RNA, 19 nt, Homo sapiens
gcuuggagcuucggaguuc

SEQ ID NO: 194848 - RNA, 19 nt, Homo sapiens
gccuauggccgaucuguuu

SEQ ID NO: 194849 - RNA, 19 nt, Homo sapiens
gugugaagauggcugcauu

SEQ ID NO: 194850 - RNA, 19 nt, Homo sapiens
gaagguacacaugacauuc

SEQ ID NO: 194851 - RNA, 19 nt, Homo sapiens
gagagcagacuccauuuac

SEQ ID NO: 194852 - RNA, 19 nt, Homo sapiens
aggagcagcugaccacaga

SEQ ID NO: 194853 - RNA, 19 nt, Homo sapiens
aggaacagcggcagaagua

SEQ ID NO: 194854 - RNA, 19 nt, Homo sapiens
aauagcagcuucucuugag

SEQ ID NO: 194855 - RNA, 19 nt, Homo sapiens
gcagagugagggagaggaa

SEQ ID NO: 194856 - RNA, 19 nt, Homo sapiens
aagauggaauucucuguag

SEQ ID NO: 194857 - RNA, 19 nt, Homo sapiens
cgaagguacacaugacauu

SEQ ID NO: 194858 - RNA, 19 nt, Homo sapiens
ugggauuucugacgaguau

SEQ ID NO: 194859 - RNA, 19 nt, Homo sapiens
ccaggaaccagcugauuca

SEQ ID NO: 194860 - RNA, 19 nt, Homo sapiens
gagcagcugaccacagaug

SEQ ID NO: 194861 - RNA, 19 nt, Homo sapiens
gaggaauaacugugggaaa

SEQ ID NO: 194862 - RNA, 19 nt, Homo sapiens
ggauuucugacgaguauca

SEQ ID NO: 194863 - RNA, 19 nt, Homo sapiens
aggaauaacugugggaaag

SEQ ID NO: 194864 - RNA, 19 nt, Homo sapiens
uaaagaccugcacaucuga

SEQ ID NO: 194865 - RNA, 19 nt, Homo sapiens
gagcuucggaguucugcuu

SEQ ID NO: 194866 - RNA, 19 nt, Homo sapiens
cacuacaacucauccaaca

SEQ ID NO: 194867 - RNA, 19 nt, Homo sapiens
gagaaaggcgggagaacac

SEQ ID NO: 194868 - RNA, 19 nt, Homo sapiens
gccaaucgcaacgaaguuu

SEQ ID NO: 194869 - RNA, 19 nt, Homo sapiens
caagagcuacacccucaau

SEQ ID NO: 194870 - RNA, 19 nt, Homo sapiens
gggagaucauuucggagau

SEQ ID NO: 194871 - RNA, 19 nt, Homo sapiens
cuacgaagguacacaugac

SEQ ID NO: 194872 - RNA, 19 nt, Homo sapiens
cgucaugcacccuaucuau

SEQ ID NO: 194873 - RNA, 19 nt, Homo sapiens
aaauagcagcuucucuuga

SEQ ID NO: 194874 - RNA, 19 nt, Homo sapiens
uggaggccgugaacaccua

SEQ ID NO: 194875 - RNA, 19 nt, Homo sapiens
gccaggaaccagcugauuc

SEQ ID NO: 194876 - RNA, 19 nt, Homo sapiens
uauggccgaucuguuugua

SEQ ID NO: 194877 - RNA, 19 nt, Homo sapiens
cuacaacucauccaacaag

SEQ ID NO: 194878 - RNA, 19 nt, Homo sapiens
cgagaaaggcgggagaaca

SEQ ID NO: 194879 - RNA, 19 nt, Homo sapiens
gaugguuucucugcugaag

SEQ ID NO: 194880 - RNA, 19 nt, Homo sapiens
aauaaagaccugcacaucu

SEQ ID NO: 194881 - RNA, 19 nt, Homo sapiens
ggcuacaggucggcgauga

SEQ ID NO: 194882 - RNA, 19 nt, Homo sapiens
aaauaaagaccugcacauc

SEQ ID NO: 194883 - RNA, 19 nt, Homo sapiens
agauggaauucucuguaga

SEQ ID NO: 194884 - RNA, 19 nt, Homo sapiens
cggauggagugggaaguga

SEQ ID NO: 194885 - RNA, 19 nt, Homo sapiens
gccgaucuguuuguagugu

SEQ ID NO: 194886 - RNA, 19 nt, Homo sapiens
gaggaacagcggcagaagu

SEQ ID NO: 194887 - RNA, 19 nt, Homo sapiens
gaaccuggaggccgugaac

SEQ ID NO: 194888 - RNA, 19 nt, Homo sapiens
uggccgaucuguuuguagu

SEQ ID NO: 194889 - RNA, 19 nt, Homo sapiens
agaccuggaucacgaacuc

SEQ ID NO: 194890 - RNA, 19 nt, Homo sapiens
gauggagugggaagugaga

SEQ ID NO: 194891 - RNA, 19 nt, Homo sapiens
gcgaggaacagcggcagaa

SEQ ID NO: 194892 - RNA, 19 nt, Homo sapiens
cagcugaccacagaugaga

SEQ ID NO: 194893 - RNA, 19 nt, Homo sapiens
gagaacacagagccaacug

SEQ ID NO: 194894 - RNA, 19 nt, Homo sapiens
ggaggugccagaggagaau

SEQ ID NO: 194895 - RNA, 19 nt, Homo sapiens
uacaacucauccaacaaga

SEQ ID NO: 194896 - RNA, 19 nt, Homo sapiens
agacuccauuuacccugaa

SEQ ID NO: 194897 - RNA, 19 nt, Homo sapiens
gcgucucaauccacuuuua

SEQ ID NO: 194898 - RNA, 19 nt, Homo sapiens
ccaguccucccucgucaug

SEQ ID NO: 194899 - RNA, 19 nt, Homo sapiens
guucagauguguuccuuaa

SEQ ID NO: 194900 - RNA, 19 nt, Homo sapiens
gaagauggaauucucugua

SEQ ID NO: 194901 - RNA, 19 nt, Homo sapiens
gaugagagcagacuccauu

SEQ ID NO: 194902 - RNA, 19 nt, Homo sapiens
gaaauagcagcuucucuug

SEQ ID NO: 194903 - RNA, 19 nt, Homo sapiens
ugaaauagcagcuucucuu

SEQ ID NO: 194904 - RNA, 19 nt, Homo sapiens
auaaagaccugcacaucug

SEQ ID NO: 194905 - RNA, 19 nt, Homo sapiens
ggagaucauuucggagaug

SEQ ID NO: 194906 - RNA, 19 nt, Homo sapiens
ugagagcagacuccauuua

SEQ ID NO: 194907 - RNA, 19 nt, Homo sapiens
gagcgucucaauccacuuu

SEQ ID NO: 194908 - RNA, 19 nt, Homo sapiens
gaccagagcccacuacaac

SEQ ID NO: 194909 - RNA, 19 nt, Homo sapiens
gcuuggagcuucggaguuc

SEQ ID NO: 194910 - RNA, 19 nt, Homo sapiens
gccuauggccgaucuguuu

SEQ ID NO: 194911 - RNA, 19 nt, Homo sapiens
gugugaagauggcugcauu

SEQ ID NO: 194912 - RNA, 19 nt, Homo sapiens
ucagauguguuccuuaaaa

SEQ ID NO: 194913 - RNA, 19 nt, Homo sapiens
gagagcagacuccauuuac

SEQ ID NO: 194914 - RNA, 19 nt, Homo sapiens
aggagcagcugaccacaga

SEQ ID NO: 194915 - RNA, 19 nt, Homo sapiens
aggaacagcggcagaagua

SEQ ID NO: 194916 - RNA, 19 nt, Homo sapiens
aauagcagcuucucuugag

SEQ ID NO: 194917 - RNA, 19 nt, Homo sapiens
cgaagucguucagaugugu

SEQ ID NO: 194918 - RNA, 19 nt, Homo sapiens
gcagagugagggagaggaa

SEQ ID NO: 194919 - RNA, 19 nt, Homo sapiens
aagauggaauucucuguag

SEQ ID NO: 194920 - RNA, 19 nt, Homo sapiens
ugggauuucugacgaguau

SEQ ID NO: 194921 - RNA, 19 nt, Homo sapiens
ccaggaaccagcugauuca

SEQ ID NO: 194922 - RNA, 19 nt, Homo sapiens
gagcagcugaccacagaug

SEQ ID NO: 194923 - RNA, 19 nt, Homo sapiens
gaggaauaacugugggaaa

SEQ ID NO: 194924 - RNA, 19 nt, Homo sapiens
ggauuucugacgaguauca

SEQ ID NO: 194925 - RNA, 19 nt, Homo sapiens
aggaauaacugugggaaag

SEQ ID NO: 194926 - RNA, 19 nt, Homo sapiens
uaaagaccugcacaucuga

SEQ ID NO: 194927 - RNA, 19 nt, Homo sapiens
gagcuucggaguucugcuu

SEQ ID NO: 194928 - RNA, 19 nt, Homo sapiens
cacuacaacucauccaaca

SEQ ID NO: 194929 - RNA, 19 nt, Homo sapiens
gagaaaggcgggagaacac

SEQ ID NO: 194930 - RNA, 19 nt, Homo sapiens
gccaaucgcaacgaaguuu

SEQ ID NO: 194931 - RNA, 19 nt, Homo sapiens
caagagcuacacccucaau

SEQ ID NO: 194932 - RNA, 19 nt, Homo sapiens
gggagaucauuucggagau

SEQ ID NO: 194933 - RNA, 19 nt, Homo sapiens
cgucaugcacccuaucuau

SEQ ID NO: 194934 - RNA, 19 nt, Homo sapiens
aaauagcagcuucucuuga

SEQ ID NO: 194935 - RNA, 19 nt, Homo sapiens
uggaggccgugaacaccua

SEQ ID NO: 194936 - RNA, 19 nt, Homo sapiens
gccaggaaccagcugauuc

SEQ ID NO: 194937 - RNA, 19 nt, Homo sapiens
uauggccgaucuguuugua

SEQ ID NO: 194938 - RNA, 19 nt, Homo sapiens
cuacaacucauccaacaag

SEQ ID NO: 194939 - RNA, 19 nt, Homo sapiens
cgagaaaggcgggagaaca

SEQ ID NO: 194940 - RNA, 19 nt, Homo sapiens
gaugguuucucugcugaag

SEQ ID NO: 194941 - RNA, 19 nt, Homo sapiens
aauaaagaccugcacaucu

SEQ ID NO: 194942 - RNA, 19 nt, Homo sapiens
ggcuacaggucggcgauga

SEQ ID NO: 194943 - RNA, 19 nt, Homo sapiens
aaauaaagaccugcacauc

SEQ ID NO: 194944 - RNA, 19 nt, Homo sapiens
agauggaauucucuguaga

SEQ ID NO: 194945 - RNA, 19 nt, Homo sapiens
gccgaucuguuuguagugu

SEQ ID NO: 194946 - RNA, 19 nt, Homo sapiens
gaggaacagcggcagaagu

SEQ ID NO: 194947 - RNA, 19 nt, Homo sapiens
gaaccuggaggccgugaac

SEQ ID NO: 194948 - RNA, 19 nt, Homo sapiens
uggccgaucuguuuguagu

SEQ ID NO: 194949 - RNA, 19 nt, Homo sapiens
agaccuggaucacgaacuc

SEQ ID NO: 194950 - RNA, 19 nt, Homo sapiens
gcgaggaacagcggcagaa

SEQ ID NO: 194951 - RNA, 19 nt, Homo sapiens
cagcugaccacagaugaga

SEQ ID NO: 194952 - RNA, 19 nt, Homo sapiens
gagaacacagagccaacug

SEQ ID NO: 194953 - RNA, 19 nt, Homo sapiens
ggaggugccagaggagaau

SEQ ID NO: 194954 - RNA, 19 nt, Homo sapiens
uacaacucauccaacaaga

SEQ ID NO: 194955 - RNA, 19 nt, Homo sapiens
agacuccauuuacccugaa

SEQ ID NO: 194956 - RNA, 19 nt, Homo sapiens
gcgucucaauccacuuuua

SEQ ID NO: 194957 - RNA, 19 nt, Homo sapiens
ccaguccucccucgucaug

SEQ ID NO: 194958 - RNA, 19 nt, Homo sapiens
cgugaacaccuacgaaguc

SEQ ID NO: 194959 - RNA, 19 nt, Homo sapiens
gaagacagcagaaaugaaa

SEQ ID NO: 194960 - RNA, 19 nt, Homo sapiens
gagaauagaagaacuggua

SEQ ID NO: 194961 - RNA, 19 nt, Homo sapiens
gaacuuggccgcagacaug

SEQ ID NO: 194962 - RNA, 19 nt, Homo sapiens
gaacaccauucuugauaau

SEQ ID NO: 194963 - RNA, 19 nt, Homo sapiens
auacucagcuuucaaugua

SEQ ID NO: 194964 - RNA, 19 nt, Homo sapiens
caaggcagcuggcaacguu

SEQ ID NO: 194965 - RNA, 19 nt, Homo sapiens
ggacacagagcacaucaaa

SEQ ID NO: 194966 - RNA, 19 nt, Homo sapiens
gaucugacauaucugcauu

SEQ ID NO: 194967 - RNA, 19 nt, Homo sapiens
gaagaggucgccauuguug

SEQ ID NO: 194968 - RNA, 19 nt, Homo sapiens
gugcagugguugaugaaua

SEQ ID NO: 194969 - RNA, 19 nt, Homo sapiens
cagaagaggucgccauugu

SEQ ID NO: 194970 - RNA, 19 nt, Homo sapiens
ggagaaauccagaucauuc

SEQ ID NO: 194971 - RNA, 19 nt, Homo sapiens
ggaauaacauugccaaacg

SEQ ID NO: 194972 - RNA, 19 nt, Homo sapiens
uuuaagagguguauucuga

SEQ ID NO: 194973 - RNA, 19 nt, Homo sapiens
gagaugaacaccauucuug

SEQ ID NO: 194974 - RNA, 19 nt, Homo sapiens
gaaauguuaaguccuguaa

SEQ ID NO: 194975 - RNA, 19 nt, Homo sapiens
ugaacaccauucuugauaa

SEQ ID NO: 194976 - RNA, 19 nt, Homo sapiens
caaaaucacugacaggaaa

SEQ ID NO: 194977 - RNA, 19 nt, Homo sapiens
ccugaaaccuuugucuuaa

SEQ ID NO: 194978 - RNA, 19 nt, Homo sapiens
gaaauuggaaagagaacuu

SEQ ID NO: 194979 - RNA, 19 nt, Homo sapiens
ugaaagugcuagauucugu

SEQ ID NO: 194980 - RNA, 19 nt, Homo sapiens
gaggagaaauccagaucau

SEQ ID NO: 194981 - RNA, 19 nt, Homo sapiens
cccaaccuguuuacauuua

SEQ ID NO: 194982 - RNA, 19 nt, Homo sapiens
ugggauguuugaaauguua

SEQ ID NO: 194983 - RNA, 19 nt, Homo sapiens
gacaggaaauaacuauauc

SEQ ID NO: 194984 - RNA, 19 nt, Homo sapiens
guaaauuauuccgaucuga

SEQ ID NO: 194985 - RNA, 19 nt, Homo sapiens
gaauaacauugccaaacgu

SEQ ID NO: 194986 - RNA, 19 nt, Homo sapiens
caaacgucacgaugaauuu

SEQ ID NO: 194987 - RNA, 19 nt, Homo sapiens
gugcuagauucuguuauuu

SEQ ID NO: 194988 - RNA, 19 nt, Homo sapiens
gccaaggaauucauugcuu

SEQ ID NO: 194989 - RNA, 19 nt, Homo sapiens
caucaaaaguucccaaaga

SEQ ID NO: 194990 - RNA, 19 nt, Homo sapiens
ccaaacgucacgaugaauu

SEQ ID NO: 194991 - RNA, 19 nt, Homo sapiens
ccaagaggaacaggaauaa

SEQ ID NO: 194992 - RNA, 19 nt, Homo sapiens
gaaauccagaucauucuca

SEQ ID NO: 194993 - RNA, 19 nt, Homo sapiens
ccagggacuuuauaaacug

SEQ ID NO: 194994 - RNA, 19 nt, Homo sapiens
ccagaagacagcagaaaug

SEQ ID NO: 194995 - RNA, 19 nt, Homo sapiens
ccacgugggauguuugaaa

SEQ ID NO: 194996 - RNA, 19 nt, Homo sapiens
gccagggacuuuauaaacu

SEQ ID NO: 194997 - RNA, 19 nt, Homo sapiens
ggcgagauuucccagaaga

SEQ ID NO: 194998 - RNA, 19 nt, Homo sapiens
cugaaaccuuugucuuaaa

SEQ ID NO: 194999 - RNA, 19 nt, Homo sapiens
gaaagugcuagauucuguu

SEQ ID NO: 195000 - RNA, 19 nt, Homo sapiens
ggucgccauuguugaagaa

SEQ ID NO: 195001 - RNA, 19 nt, Homo sapiens
agugcuagauucuguuauu

SEQ ID NO: 195002 - RNA, 19 nt, Homo sapiens
cagaagacagcagaaauga

SEQ ID NO: 195003 - RNA, 19 nt, Homo sapiens
cuguuuacauuuagcgaua

SEQ ID NO: 195004 - RNA, 19 nt, Homo sapiens
aaagugcuagauucuguua

SEQ ID NO: 195005 - RNA, 19 nt, Homo sapiens
ugccaaacgucacgaugaa

SEQ ID NO: 195006 - RNA, 19 nt, Homo sapiens
gaugaacaccauucuugau

SEQ ID NO: 195007 - RNA, 19 nt, Homo sapiens
auaaacugguugauucaga

SEQ ID NO: 195008 - RNA, 19 nt, Homo sapiens
cuacagcacacuaccagaa

SEQ ID NO: 195009 - RNA, 19 nt, Homo sapiens
gaaguaccccaaccuguuu

SEQ ID NO: 195010 - RNA, 19 nt, Homo sapiens
caacguucccuucaagaca

SEQ ID NO: 195011 - RNA, 19 nt, Homo sapiens
cacgugggauguuugaaau

SEQ ID NO: 195012 - RNA, 19 nt, Homo sapiens
gaucaucuucacaacauca

SEQ ID NO: 195013 - RNA, 19 nt, Homo sapiens
gaugagaugaacaccauuc

SEQ ID NO: 195014 - RNA, 19 nt, Homo sapiens
gaggaacaggaauaacauu

SEQ ID NO: 195015 - RNA, 19 nt, Homo sapiens
uccugaaaccuuugucuua

SEQ ID NO: 195016 - RNA, 19 nt, Homo sapiens
acaccauucuugauaaucu

SEQ ID NO: 195017 - RNA, 19 nt, Homo sapiens
gaugguucuuucucugaug

SEQ ID NO: 195018 - RNA, 19 nt, Homo sapiens
aaggcgagauuucccagaa

SEQ ID NO: 195019 - RNA, 19 nt, Homo sapiens
ggugaaauuggaaagagaa

SEQ ID NO: 195020 - RNA, 19 nt, Homo sapiens
gaccuuuaccagugaugua

SEQ ID NO: 195021 - RNA, 19 nt, Homo sapiens
auaugaaagugcuagauuc

SEQ ID NO: 195022 - RNA, 19 nt, Homo sapiens
ccgcagacaugcugauggu

SEQ ID NO: 195023 - RNA, 19 nt, Homo sapiens
cgugggauguuugaaaugu

SEQ ID NO: 195024 - RNA, 19 nt, Homo sapiens
cugaugagaugaacaccau

SEQ ID NO: 195025 - RNA, 19 nt, Homo sapiens
augaacaccauucuugaua

SEQ ID NO: 195026 - RNA, 19 nt, Homo sapiens
gcuagauucuguuauuuuc

SEQ ID NO: 195027 - RNA, 19 nt, Homo sapiens
aagaggaacaggaauaaca

SEQ ID NO: 195028 - RNA, 19 nt, Homo sapiens
ugaugaauaccaagaggaa

SEQ ID NO: 195029 - RNA, 19 nt, Homo sapiens
ucugacauaucugcauuau

SEQ ID NO: 195030 - RNA, 19 nt, Homo sapiens
ucaagacacagaggagaaa

SEQ ID NO: 195031 - RNA, 19 nt, Homo sapiens
ggaacaggaauaacauugc

SEQ ID NO: 195032 - RNA, 19 nt, Homo sapiens
acagcacacuaccagaaga

SEQ ID NO: 195033 - RNA, 19 nt, Homo sapiens
gugggauguuugaaauguu

SEQ ID NO: 195034 - RNA, 19 nt, Homo sapiens
gggacuuuauaaacugguu

SEQ ID NO: 195035 - RNA, 19 nt, Homo sapiens
uugcuuggcuggugaaagg

SEQ ID NO: 195036 - RNA, 19 nt, Homo sapiens
ccaaccuguuuacauuuag

SEQ ID NO: 195037 - RNA, 19 nt, Homo sapiens
uugcuuugcaugccaauaa

SEQ ID NO: 195038 - RNA, 19 nt, Homo sapiens
uggcaacguucccuucaag

SEQ ID NO: 195039 - RNA, 19 nt, Homo sapiens
cgccauuguugaagaacuu

SEQ ID NO: 195040 - RNA, 19 nt, Homo sapiens
agaggucgccauuguugaa

SEQ ID NO: 195041 - RNA, 19 nt, Homo sapiens
ccaggcgugcccaagauuu

SEQ ID NO: 195042 - RNA, 19 nt, Homo sapiens
auuccgaucugacauaucu

SEQ ID NO: 195043 - RNA, 19 nt, Homo sapiens
uuaguguuguguagccaaa

SEQ ID NO: 195044 - RNA, 19 nt, Homo sapiens
gaggccacauugcuuugca

SEQ ID NO: 195045 - RNA, 19 nt, Homo sapiens
ucacugacaggaaauaacu

SEQ ID NO: 195046 - RNA, 19 nt, Homo sapiens
gacaugcugaugguucuuu

SEQ ID NO: 195047 - RNA, 19 nt, Homo sapiens
cagacaugcugaugguucu

SEQ ID NO: 195048 - RNA, 19 nt, Homo sapiens
ucacgaugaauuugagaga

SEQ ID NO: 195049 - RNA, 19 nt, Homo sapiens
ccagugacuacagcaagua

SEQ ID NO: 195050 - RNA, 19 nt, Homo sapiens
caccauucuugauaaucuu

SEQ ID NO: 195051 - RNA, 19 nt, Homo sapiens
acgaugaauuugagagaca

SEQ ID NO: 195052 - RNA, 19 nt, Homo sapiens
accaagaggaacaggaaua

SEQ ID NO: 195053 - RNA, 19 nt, Homo sapiens
guggugaaauuggaaagag

SEQ ID NO: 195054 - RNA, 19 nt, Homo sapiens
cagcagaaaugaaaagcau

SEQ ID NO: 195055 - RNA, 19 nt, Homo sapiens
ugaaauguuaaguccugua

SEQ ID NO: 195056 - RNA, 19 nt, Homo sapiens
cuagccacgugggauguuu

SEQ ID NO: 195057 - RNA, 19 nt, Homo sapiens
agaugaacaccauucuuga

SEQ ID NO: 195058 - RNA, 19 nt, Homo sapiens
agaagaggucgccauuguu

SEQ ID NO: 195059 - RNA, 19 nt, Homo sapiens
gaaauguccuccaacaaua

SEQ ID NO: 195060 - RNA, 19 nt, Homo sapiens
gcaaggagcugcaguuugg

SEQ ID NO: 195061 - RNA, 19 nt, Homo sapiens
ccacggagcuggugugcaa

SEQ ID NO: 195062 - RNA, 19 nt, Homo sapiens
ggaaauguccuccaacaau

SEQ ID NO: 195063 - RNA, 19 nt, Homo sapiens
ucaagugucuguucgagaa

SEQ ID NO: 195064 - RNA, 19 nt, Homo sapiens
caacagaaccuucgacaag

SEQ ID NO: 195065 - RNA, 19 nt, Homo sapiens
gaccagcaaugacaacaug

SEQ ID NO: 195066 - RNA, 19 nt, Homo sapiens
gagcuggugugcaacagaa

SEQ ID NO: 195067 - RNA, 19 nt, Homo sapiens
ggugauggacuuccuguuu

SEQ ID NO: 195068 - RNA, 19 nt, Homo sapiens
agaaggagguggccaagau

SEQ ID NO: 195069 - RNA, 19 nt, Homo sapiens
ccacacagacuacaaguuc

SEQ ID NO: 195070 - RNA, 19 nt, Homo sapiens
acagaaccuucgacaagua

SEQ ID NO: 195071 - RNA, 19 nt, Homo sapiens
gugauggacuuccuguuug

SEQ ID NO: 195072 - RNA, 19 nt, Homo sapiens
gcuccgugcuggucauuga

SEQ ID NO: 195073 - RNA, 19 nt, Homo sapiens
gaucaacuucuucaucuuc

SEQ ID NO: 195074 - RNA, 19 nt, Homo sapiens
gcugguggcuguccucuac

SEQ ID NO: 195075 - RNA, 19 nt, Homo sapiens
agauugagguccagaagga

SEQ ID NO: 195076 - RNA, 19 nt, Homo sapiens
ugauggacuuccuguuuga

SEQ ID NO: 195077 - RNA, 19 nt, Homo sapiens
gggcaguggucaagugucu

SEQ ID NO: 195078 - RNA, 19 nt, Homo sapiens
ccgcgguguucaugcaaua

SEQ ID NO: 195079 - RNA, 19 nt, Homo sapiens
ccgccaagcucuucuucga

SEQ ID NO: 195080 - RNA, 19 nt, Homo sapiens
ggaggagcguacacacaca

SEQ ID NO: 195081 - RNA, 19 nt, Homo sapiens
gaaggagguggccaagaug

SEQ ID NO: 195082 - RNA, 19 nt, Homo sapiens
gaaccuucgacaaguauuc

SEQ ID NO: 195083 - RNA, 19 nt, Homo sapiens
gcaacagaaccuucgacaa

SEQ ID NO: 195084 - RNA, 19 nt, Homo sapiens
aaauguccuccaacaauaa

SEQ ID NO: 195085 - RNA, 19 nt, Homo sapiens
ccgcucaggugauggacuu

SEQ ID NO: 195086 - RNA, 19 nt, Homo sapiens
gcugguggccucccuagau

SEQ ID NO: 195087 - RNA, 19 nt, Homo sapiens
cugaucaacuucuucaucu

SEQ ID NO: 195088 - RNA, 19 nt, Homo sapiens
cauccacgcgaaucuguuu

SEQ ID NO: 195089 - RNA, 19 nt, Homo sapiens
acaauaaagagcucaagug

SEQ ID NO: 195090 - RNA, 19 nt, Homo sapiens
gcaccacacagacuacaag

SEQ ID NO: 195091 - RNA, 19 nt, Homo sapiens
gcagcuuccaggugaugua

SEQ ID NO: 195092 - RNA, 19 nt, Homo sapiens
cugguggccucccuagauu

SEQ ID NO: 195093 - RNA, 19 nt, Homo sapiens
gcaguggucaagugucugu

SEQ ID NO: 195094 - RNA, 19 nt, Homo sapiens
ggagauugagguccagaag

SEQ ID NO: 195095 - RNA, 19 nt, Homo sapiens
cgaaucuguuugcguccuu

SEQ ID NO: 195096 - RNA, 19 nt, Homo sapiens
uggacuuccuguuugagaa

SEQ ID NO: 195097 - RNA, 19 nt, Homo sapiens
caucuucguccgcaucguu

SEQ ID NO: 195098 - RNA, 19 nt, Homo sapiens
ggagguggccaagauguac

SEQ ID NO: 195099 - RNA, 19 nt, Homo sapiens
ugaucaacuucuucaucuu

SEQ ID NO: 195100 - RNA, 19 nt, Homo sapiens
ccaauaccacggccaacau

SEQ ID NO: 195101 - RNA, 19 nt, Homo sapiens
aacagaaccuucgacaagu

SEQ ID NO: 195102 - RNA, 19 nt, Homo sapiens
guggcugucugcgagauug

SEQ ID NO: 195103 - RNA, 19 nt, Homo sapiens
gcugagagccccuucugaa

SEQ ID NO: 195104 - RNA, 19 nt, Homo sapiens
cagaaccuucgacaaguau

SEQ ID NO: 195105 - RNA, 19 nt, Homo sapiens
gcucuucuucgaccucuuc

SEQ ID NO: 195106 - RNA, 19 nt, Homo sapiens
ggaccagcaaugacaacau

SEQ ID NO: 195107 - RNA, 19 nt, Homo sapiens
ggagcuggugugcaacaga

SEQ ID NO: 195108 - RNA, 19 nt, Homo sapiens
ccugggcaguggucaagug

SEQ ID NO: 195109 - RNA, 19 nt, Homo sapiens
uggcuguccucuacugcuu

SEQ ID NO: 195110 - RNA, 19 nt, Homo sapiens
gauggauggcgaggagauu

SEQ ID NO: 195111 - RNA, 19 nt, Homo sapiens
ccaaagaaauugucagcua

SEQ ID NO: 195112 - RNA, 19 nt, Homo sapiens
guaaugacuuugucuguuu

SEQ ID NO: 195113 - RNA, 19 nt, Homo sapiens
ccuaaacgaugcuauauuu

SEQ ID NO: 195114 - RNA, 19 nt, Homo sapiens
ggaagcuguugccuuauua

SEQ ID NO: 195115 - RNA, 19 nt, Homo sapiens
gcuguugucuuauuaguaa

SEQ ID NO: 195116 - RNA, 19 nt, Homo sapiens
gaugcuugcuuuaacuuua

SEQ ID NO: 195117 - RNA, 19 nt, Homo sapiens
gcacauuucuaccuucuau

SEQ ID NO: 195118 - RNA, 19 nt, Homo sapiens
gcuguugccuuauuaauga

SEQ ID NO: 195119 - RNA, 19 nt, Homo sapiens
gaugugaacuuuauuccuu

SEQ ID NO: 195120 - RNA, 19 nt, Homo sapiens
ccuggaagcuguugccuua

SEQ ID NO: 195121 - RNA, 19 nt, Homo sapiens
gaaagguccauauugguua

SEQ ID NO: 195122 - RNA, 19 nt, Homo sapiens
gcacucaacucauguuugg

SEQ ID NO: 195123 - RNA, 19 nt, Homo sapiens
caaagaaauugucagcuau

SEQ ID NO: 195124 - RNA, 19 nt, Homo sapiens
uaacuuugaugcuugcuuu

SEQ ID NO: 195125 - RNA, 19 nt, Homo sapiens
gaaguguucuuauaaaggu

SEQ ID NO: 195126 - RNA, 19 nt, Homo sapiens
caacucauguuuggcauuu

SEQ ID NO: 195127 - RNA, 19 nt, Homo sapiens
ugaaguugguccuauuuaa

SEQ ID NO: 195128 - RNA, 19 nt, Homo sapiens
gaaguugguccuauuuaaa

SEQ ID NO: 195129 - RNA, 19 nt, Homo sapiens
guacucacacugcaaauaa

SEQ ID NO: 195130 - RNA, 19 nt, Homo sapiens
aaacacaguuauuccauga

SEQ ID NO: 195131 - RNA, 19 nt, Homo sapiens
ggagaagaauuaguguauu

SEQ ID NO: 195132 - RNA, 19 nt, Homo sapiens
gaagggagaagaauuagug

SEQ ID NO: 195133 - RNA, 19 nt, Homo sapiens
auacagggauuuagacauu

SEQ ID NO: 195134 - RNA, 19 nt, Homo sapiens
ggaaagguccauauugguu

SEQ ID NO: 195135 - RNA, 19 nt, Homo sapiens
acauagugcucuucaaauu

SEQ ID NO: 195136 - RNA, 19 nt, Homo sapiens
ggucuuguccucauuguaa

SEQ ID NO: 195137 - RNA, 19 nt, Homo sapiens
aaagugaacugcuaauagu

SEQ ID NO: 195138 - RNA, 19 nt, Homo sapiens
caacauacagggauuuaga

SEQ ID NO: 195139 - RNA, 19 nt, Homo sapiens
gaaauugucagcuauacau

SEQ ID NO: 195140 - RNA, 19 nt, Homo sapiens
caaaaccacugccagauaa

SEQ ID NO: 195141 - RNA, 19 nt, Homo sapiens
caacagacuucacuuuggu

SEQ ID NO: 195142 - RNA, 19 nt, Homo sapiens
acaguaauuugccucauaa

SEQ ID NO: 195143 - RNA, 19 nt, Homo sapiens
acagggauuuagacauuua

SEQ ID NO: 195144 - RNA, 19 nt, Homo sapiens
ucacuuuggucauguuuau

SEQ ID NO: 195145 - RNA, 19 nt, Homo sapiens
uacaguaauuugccucaua

SEQ ID NO: 195146 - RNA, 19 nt, Homo sapiens
uggcagagguauuggguuu

SEQ ID NO: 195147 - RNA, 19 nt, Homo sapiens
caagauggcagagguauug

SEQ ID NO: 195148 - RNA, 19 nt, Homo sapiens
gaugagauggugauuguga

SEQ ID NO: 195149 - RNA, 19 nt, Homo sapiens
ucacuugguuccauuuguu

SEQ ID NO: 195150 - RNA, 19 nt, Homo sapiens
ugacauagugcucuucaaa

SEQ ID NO: 195151 - RNA, 19 nt, Homo sapiens
ggaaggugguggaaugucu

SEQ ID NO: 195152 - RNA, 19 nt, Homo sapiens
gggagaagaauuaguguau

SEQ ID NO: 195153 - RNA, 19 nt, Homo sapiens
gaguauguauguuccugaa

SEQ ID NO: 195154 - RNA, 19 nt, Homo sapiens
gaugcuauuuggguuauga

SEQ ID NO: 195155 - RNA, 19 nt, Homo sapiens
uaaagugaacugcuaauag

SEQ ID NO: 195156 - RNA, 19 nt, Homo sapiens
gaguuuaaguacagugaug

SEQ ID NO: 195157 - RNA, 19 nt, Homo sapiens
ccaugaaguuuaguauuug

SEQ ID NO: 195158 - RNA, 19 nt, Homo sapiens
cauauugguuaucuuccua

SEQ ID NO: 195159 - RNA, 19 nt, Homo sapiens
gagcaucacuugguuccau

SEQ ID NO: 195160 - RNA, 19 nt, Homo sapiens
guauguauguuccugaagu

SEQ ID NO: 195161 - RNA, 19 nt, Homo sapiens
guauuugguugacauagug

SEQ ID NO: 195162 - RNA, 19 nt, Homo sapiens
gugaacugcuaauagugua

SEQ ID NO: 195163 - RNA, 19 nt, Homo sapiens
guuauuccaugaaguuuag

SEQ ID NO: 195164 - RNA, 19 nt, Homo sapiens
uggaagcuguugccuuauu

SEQ ID NO: 195165 - RNA, 19 nt, Homo sapiens
guaauuugccucauaagca

SEQ ID NO: 195166 - RNA, 19 nt, Homo sapiens
ccacuuugaugcuauuugg

SEQ ID NO: 195167 - RNA, 19 nt, Homo sapiens
gaaacacaaacacaguuau

SEQ ID NO: 195168 - RNA, 19 nt, Homo sapiens
agaaacacaaacacaguua

SEQ ID NO: 195169 - RNA, 19 nt, Homo sapiens
guagaugccucaaaauguu

SEQ ID NO: 195170 - RNA, 19 nt, Homo sapiens
ucucagauguccuaaacga

SEQ ID NO: 195171 - RNA, 19 nt, Homo sapiens
uaaaucuagcccaguauaa

SEQ ID NO: 195172 - RNA, 19 nt, Homo sapiens
ugggaagggagaagaauua

SEQ ID NO: 195173 - RNA, 19 nt, Homo sapiens
ggcaagggcugcucaagac

SEQ ID NO: 195174 - RNA, 19 nt, Homo sapiens
acucuagucuuuaguacuu

SEQ ID NO: 195175 - RNA, 19 nt, Homo sapiens
gaagcuguugccuuauuaa

SEQ ID NO: 195176 - RNA, 19 nt, Homo sapiens
aaugcgagguguacagaaa

SEQ ID NO: 195177 - RNA, 19 nt, Homo sapiens
guauucucgugucaacaua

SEQ ID NO: 195178 - RNA, 19 nt, Homo sapiens
aaaccaccagugacauuua

SEQ ID NO: 195179 - RNA, 19 nt, Homo sapiens
agacuucacuuuggucaug

SEQ ID NO: 195180 - RNA, 19 nt, Homo sapiens
ucaacagacuucacuuugg

SEQ ID NO: 195181 - RNA, 19 nt, Homo sapiens
guauugcucugugaauuca

SEQ ID NO: 195182 - RNA, 19 nt, Homo sapiens
auagugcucuucaaauuca

SEQ ID NO: 195183 - RNA, 19 nt, Homo sapiens
cagcgugggccaaauuaaa

SEQ ID NO: 195184 - RNA, 19 nt, Homo sapiens
guaccaacgaucugugaaa

SEQ ID NO: 195185 - RNA, 19 nt, Homo sapiens
uaauuugccucauaagcau

SEQ ID NO: 195186 - RNA, 19 nt, Homo sapiens
cauuguaacuccguauaga

SEQ ID NO: 195187 - RNA, 19 nt, Homo sapiens
gaaggugguggaaugucua

SEQ ID NO: 195188 - RNA, 19 nt, Homo sapiens
aagggaaggugguggaaug

SEQ ID NO: 195189 - RNA, 19 nt, Homo sapiens
guucaacagacuucacuuu

SEQ ID NO: 195190 - RNA, 19 nt, Homo sapiens
cuucaaauucaucccauua

SEQ ID NO: 195191 - RNA, 19 nt, Homo sapiens
ccacagaaacacaaacaca

SEQ ID NO: 195192 - RNA, 19 nt, Homo sapiens
caagaauagggaauuaguu

SEQ ID NO: 195193 - RNA, 19 nt, Homo sapiens
aaccaccagugacauuuaa

SEQ ID NO: 195194 - RNA, 19 nt, Homo sapiens
caauaaaagugguguagug

SEQ ID NO: 195195 - RNA, 19 nt, Homo sapiens
uaacuuuagucccaucucu

SEQ ID NO: 195196 - RNA, 19 nt, Homo sapiens
cuuuauuccuugucacuaa

SEQ ID NO: 195197 - RNA, 19 nt, Homo sapiens
ugacuucgaggaccaaaga

SEQ ID NO: 195198 - RNA, 19 nt, Homo sapiens
uuaaaucuagcccaguaua

SEQ ID NO: 195199 - RNA, 19 nt, Homo sapiens
gcaagauggcagagguauu

SEQ ID NO: 195200 - RNA, 19 nt, Homo sapiens
gaugcuauauuugaugaag

SEQ ID NO: 195201 - RNA, 19 nt, Homo sapiens
aaagguccauauugguuau

SEQ ID NO: 195202 - RNA, 19 nt, Homo sapiens
ugagcuguguccaacguuu

SEQ ID NO: 195203 - RNA, 19 nt, Homo sapiens
ggauuuagacauuuaacuc

SEQ ID NO: 195204 - RNA, 19 nt, Homo sapiens
uguuacagaugugaacuuu

SEQ ID NO: 195205 - RNA, 19 nt, Homo sapiens
uaacauuuccuagaagugu

SEQ ID NO: 195206 - RNA, 19 nt, Homo sapiens
ucccaucucugccacuuug

SEQ ID NO: 195207 - RNA, 19 nt, Homo sapiens
gggcagcgugggccaaauu

SEQ ID NO: 195208 - RNA, 19 nt, Homo sapiens
gaacugacgguggaagaca

SEQ ID NO: 195209 - RNA, 19 nt, Homo sapiens
ccauguagaugccucaaaa

SEQ ID NO: 195210 - RNA, 19 nt, Homo sapiens
gguggaaugucuauguuuu

SEQ ID NO: 195211 - RNA, 19 nt, Homo sapiens
ugaauggccuucucugaaa

SEQ ID NO: 195212 - RNA, 19 nt, Homo sapiens
gaagagccuugggaaacaa

SEQ ID NO: 195213 - RNA, 19 nt, Homo sapiens
ggagugaccuucucaugcu

SEQ ID NO: 195214 - RNA, 19 nt, Homo sapiens
gcuccucucuucccaaauc

SEQ ID NO: 195215 - RNA, 19 nt, Homo sapiens
gaccuucucaugcugauuu

SEQ ID NO: 195216 - RNA, 19 nt, Homo sapiens
gagaagagccuugggaaac

SEQ ID NO: 195217 - RNA, 19 nt, Homo sapiens
gugaauggccuucucugaa

SEQ ID NO: 195218 - RNA, 19 nt, Homo sapiens
caauaaagggcugugauga

SEQ ID NO: 195219 - RNA, 19 nt, Homo sapiens
gcacccagauccgcaugga

SEQ ID NO: 195220 - RNA, 19 nt, Homo sapiens
auaaagggcugugaugagu

SEQ ID NO: 195221 - RNA, 19 nt, Homo sapiens
ccaauaaagggcugugaug

SEQ ID NO: 195222 - RNA, 19 nt, Homo sapiens
agaagagccuugggaaaca

SEQ ID NO: 195223 - RNA, 19 nt, Homo sapiens
gaauggccuucucugaaac

SEQ ID NO: 195224 - RNA, 19 nt, Homo sapiens
agagaagagccuugggaaa

SEQ ID NO: 195225 - RNA, 19 nt, Homo sapiens
uagcuagcccaagccaaua

SEQ ID NO: 195226 - RNA, 19 nt, Homo sapiens
gcagugaauggccuucucu

SEQ ID NO: 195227 - RNA, 19 nt, Homo sapiens
uugcuccucucuucccaaa

SEQ ID NO: 195228 - RNA, 19 nt, Homo sapiens
gcuagcccaagccaauaaa

SEQ ID NO: 195229 - RNA, 19 nt, Homo sapiens
cgaugacccuccccgcaua

SEQ ID NO: 195230 - RNA, 19 nt, Homo sapiens
gggaaacaacuuuuaugaa

SEQ ID NO: 195231 - RNA, 19 nt, Homo sapiens
ucugaaacccugcgucaag

SEQ ID NO: 195232 - RNA, 19 nt, Homo sapiens
ggagaagccuuggauauuu

SEQ ID NO: 195233 - RNA, 19 nt, Homo sapiens
gcaagcagaucuacaacau

SEQ ID NO: 195234 - RNA, 19 nt, Homo sapiens
gcucauagguggcaaguac

SEQ ID NO: 195235 - RNA, 19 nt, Homo sapiens
gaacauccaggcucaguga

SEQ ID NO: 195236 - RNA, 19 nt, Homo sapiens
ggaggaaacugugacugaa

SEQ ID NO: 195237 - RNA, 19 nt, Homo sapiens
gagaagccuuggauauuuc

SEQ ID NO: 195238 - RNA, 19 nt, Homo sapiens
gaagcaggcuaggauguga

SEQ ID NO: 195239 - RNA, 19 nt, Homo sapiens
ugaagaugcugcccaccua

SEQ ID NO: 195240 - RNA, 19 nt, Homo sapiens
gagcagaagggaacaaugu

SEQ ID NO: 195241 - RNA, 19 nt, Homo sapiens
ccacgaugaucuccugcua

SEQ ID NO: 195242 - RNA, 19 nt, Homo sapiens
uggaggagaugcagaaugu

SEQ ID NO: 195243 - RNA, 19 nt, Homo sapiens
gaccggcacugcugagaug

SEQ ID NO: 195244 - RNA, 19 nt, Homo sapiens
ggacauuucccacugaauc

SEQ ID NO: 195245 - RNA, 19 nt, Homo sapiens
ucaggacuuugaugcauuu

SEQ ID NO: 195246 - RNA, 19 nt, Homo sapiens
acagucaccugcagccuaa

SEQ ID NO: 195247 - RNA, 19 nt, Homo sapiens
gcacgaagacaucgauaag

SEQ ID NO: 195248 - RNA, 19 nt, Homo sapiens
caaaccagcccgaggagaa

SEQ ID NO: 195249 - RNA, 19 nt, Homo sapiens
ggaggugucccaagcuuug

SEQ ID NO: 195250 - RNA, 19 nt, Homo sapiens
ggacuuugaugcauuucca

SEQ ID NO: 195251 - RNA, 19 nt, Homo sapiens
gggcuucaccuucuccuuu

SEQ ID NO: 195252 - RNA, 19 nt, Homo sapiens
gaggaggugucccaagcuu

SEQ ID NO: 195253 - RNA, 19 nt, Homo sapiens
gaagaggccagugugaaga

SEQ ID NO: 195254 - RNA, 19 nt, Homo sapiens
ugagacggaugcagaagga

SEQ ID NO: 195255 - RNA, 19 nt, Homo sapiens
gaggacauuucccacugaa

SEQ ID NO: 195256 - RNA, 19 nt, Homo sapiens
ggacaaccccaucauauga

SEQ ID NO: 195257 - RNA, 19 nt, Homo sapiens
ucucggcgguggccuguaa

SEQ ID NO: 195258 - RNA, 19 nt, Homo sapiens
gcggagaagccuuggauau

SEQ ID NO: 195259 - RNA, 19 nt, Homo sapiens
gaugaucuccugcuacuac

SEQ ID NO: 195260 - RNA, 19 nt, Homo sapiens
gagaugcucuucgacuaca

SEQ ID NO: 195261 - RNA, 19 nt, Homo sapiens
gaagaccaaacaccagaug

SEQ ID NO: 195262 - RNA, 19 nt, Homo sapiens
gcacuaacuucagggugau

SEQ ID NO: 195263 - RNA, 19 nt, Homo sapiens
gagcagauccuggcagagu

SEQ ID NO: 195264 - RNA, 19 nt, Homo sapiens
ccaagaaggagaagguaga

SEQ ID NO: 195265 - RNA, 19 nt, Homo sapiens
caacacaaccaggagagaa

SEQ ID NO: 195266 - RNA, 19 nt, Homo sapiens
cggagaagccuuggauauu

SEQ ID NO: 195267 - RNA, 19 nt, Homo sapiens
cugagaugcucuucgacua

SEQ ID NO: 195268 - RNA, 19 nt, Homo sapiens
agaccaaacaccagaugua

SEQ ID NO: 195269 - RNA, 19 nt, Homo sapiens
ggccagcccuacaucuuca

SEQ ID NO: 195270 - RNA, 19 nt, Homo sapiens
ggauauuuccacuucagaa

SEQ ID NO: 195271 - RNA, 19 nt, Homo sapiens
ggaccuggguggcacuaac

SEQ ID NO: 195272 - RNA, 19 nt, Homo sapiens
aaauggaugugguggcaau

SEQ ID NO: 195273 - RNA, 19 nt, Homo sapiens
gacgagagcucugcaaacc

SEQ ID NO: 195274 - RNA, 19 nt, Homo sapiens
cugaguggcuugugauucu

SEQ ID NO: 195275 - RNA, 19 nt, Homo sapiens
guugcucacucaggacuuu

SEQ ID NO: 195276 - RNA, 19 nt, Homo sapiens
gaagggagaggacauuucc

SEQ ID NO: 195277 - RNA, 19 nt, Homo sapiens
agaggacauuucccacuga

SEQ ID NO: 195278 - RNA, 19 nt, Homo sapiens
ggaagcaggcuaggaugug

SEQ ID NO: 195279 - RNA, 19 nt, Homo sapiens
gcugcgagaucaccuucau

SEQ ID NO: 195280 - RNA, 19 nt, Homo sapiens
gaucuccugcuacuacgaa

SEQ ID NO: 195281 - RNA, 19 nt, Homo sapiens
ccaaacaccagauguacuc

SEQ ID NO: 195282 - RNA, 19 nt, Homo sapiens
ccaccuuucucgcuggaau

SEQ ID NO: 195283 - RNA, 19 nt, Homo sapiens
acgaguuccugcuggagua

SEQ ID NO: 195284 - RNA, 19 nt, Homo sapiens
gcaggagcaggaacagaga

SEQ ID NO: 195285 - RNA, 19 nt, Homo sapiens
gcucuucgacuacaucucu

SEQ ID NO: 195286 - RNA, 19 nt, Homo sapiens
gaaaaggaggaaacuguga

SEQ ID NO: 195287 - RNA, 19 nt, Homo sapiens
ccuaagauuguguggguuu

SEQ ID NO: 195288 - RNA, 19 nt, Homo sapiens
cugcugagaugcucuucga

SEQ ID NO: 195289 - RNA, 19 nt, Homo sapiens
gcagaugcuggacgacaga

SEQ ID NO: 195290 - RNA, 19 nt, Homo sapiens
ggacgagagcucugcaaac

SEQ ID NO: 195291 - RNA, 19 nt, Homo sapiens
ggcacgaagacaucgauaa

SEQ ID NO: 195292 - RNA, 19 nt, Homo sapiens
ucagggugaugcuggugaa

SEQ ID NO: 195293 - RNA, 19 nt, Homo sapiens
gcagauccuggcagaguuc

SEQ ID NO: 195294 - RNA, 19 nt, Homo sapiens
gaaggguccagaagggaau

SEQ ID NO: 195295 - RNA, 19 nt, Homo sapiens
ccacugaaucugucugaag

SEQ ID NO: 195296 - RNA, 19 nt, Homo sapiens
guggauggcuccguguaca

SEQ ID NO: 195297 - RNA, 19 nt, Homo sapiens
ugguggcaauggugaauga

SEQ ID NO: 195298 - RNA, 19 nt, Homo sapiens
gagaggggacuuugaaaug

SEQ ID NO: 195299 - RNA, 19 nt, Homo sapiens
gggugaugcuggugaaggu

SEQ ID NO: 195300 - RNA, 19 nt, Homo sapiens
ugaagaggccagugugaag

SEQ ID NO: 195301 - RNA, 19 nt, Homo sapiens
gcaaugccugcuacaugga

SEQ ID NO: 195302 - RNA, 19 nt, Homo sapiens
ggcuucaccuucuccuuuc

SEQ ID NO: 195303 - RNA, 19 nt, Homo sapiens
gcacugcugagaugcucuu

SEQ ID NO: 195304 - RNA, 19 nt, Homo sapiens
gaccaaacaccagauguac

SEQ ID NO: 195305 - RNA, 19 nt, Homo sapiens
gcauuuccacacugucaga

SEQ ID NO: 195306 - RNA, 19 nt, Homo sapiens
ccgcagcgaggacguaaug

SEQ ID NO: 195307 - RNA, 19 nt, Homo sapiens
cagaagggagaggacauuu

SEQ ID NO: 195308 - RNA, 19 nt, Homo sapiens
ggaugcagaaggagaugga

SEQ ID NO: 195309 - RNA, 19 nt, Homo sapiens
gggaagcaggcuaggaugu

SEQ ID NO: 195310 - RNA, 19 nt, Homo sapiens
ccgacucguuggagaacaa

SEQ ID NO: 195311 - RNA, 19 nt, Homo sapiens
gaccuagaccugggccaaa

SEQ ID NO: 195312 - RNA, 19 nt, Homo sapiens
ccuguaagaaggccuguau

SEQ ID NO: 195313 - RNA, 19 nt, Homo sapiens
cagggaagcaggcuaggau

SEQ ID NO: 195314 - RNA, 19 nt, Homo sapiens
gagaacauccaggcucagu

SEQ ID NO: 195315 - RNA, 19 nt, Homo sapiens
caaggccucaggagcagaa

SEQ ID NO: 195316 - RNA, 19 nt, Homo sapiens
caugaagaggccaguguga

SEQ ID NO: 195317 - RNA, 19 nt, Homo sapiens
ggcccugccuggagaacau

SEQ ID NO: 195318 - RNA, 19 nt, Homo sapiens
aggagaagguagagcagau

SEQ ID NO: 195319 - RNA, 19 nt, Homo sapiens
aggaggaaacugugacuga

SEQ ID NO: 195320 - RNA, 19 nt, Homo sapiens
ggacguaaugcgcaucacu

SEQ ID NO: 195321 - RNA, 19 nt, Homo sapiens
gaccaccgacugcgacauc

SEQ ID NO: 195322 - RNA, 19 nt, Homo sapiens
ggagcagaagggaacaaug

SEQ ID NO: 195323 - RNA, 19 nt, Homo sapiens
ggaggaggaccugaagaag

SEQ ID NO: 195324 - RNA, 19 nt, Homo sapiens
ccucgcagcaggugcaaga

SEQ ID NO: 195325 - RNA, 19 nt, Homo sapiens
ugaugcauuuccacacugu

SEQ ID NO: 195326 - RNA, 19 nt, Homo sapiens
gucaccugcagccuaauua

SEQ ID NO: 195327 - RNA, 19 nt, Homo sapiens
gggccucuucccucaguuu

SEQ ID NO: 195328 - RNA, 19 nt, Homo sapiens
cucaggacuuugaugcauu

SEQ ID NO: 195329 - RNA, 19 nt, Homo sapiens
cugcaaugccugcuacaug

SEQ ID NO: 195330 - RNA, 19 nt, Homo sapiens
gcuggagacccaugaagag

SEQ ID NO: 195331 - RNA, 19 nt, Homo sapiens
ccugcagccuaauuacuca

SEQ ID NO: 195332 - RNA, 19 nt, Homo sapiens
gcaagcagaucuacaacau

SEQ ID NO: 195333 - RNA, 19 nt, Homo sapiens
gcucauagguggcaaguac

SEQ ID NO: 195334 - RNA, 19 nt, Homo sapiens
ccaaagcaucuaccucuua

SEQ ID NO: 195335 - RNA, 19 nt, Homo sapiens
ugaagaugcugcccaccua

SEQ ID NO: 195336 - RNA, 19 nt, Homo sapiens
caaagcaucuaccucuuag

SEQ ID NO: 195337 - RNA, 19 nt, Homo sapiens
gagcagaagggaacaaugu

SEQ ID NO: 195338 - RNA, 19 nt, Homo sapiens
ccacgaugaucuccugcua

SEQ ID NO: 195339 - RNA, 19 nt, Homo sapiens
uggaggagaugcagaaugu

SEQ ID NO: 195340 - RNA, 19 nt, Homo sapiens
gaccggcacugcugagaug

SEQ ID NO: 195341 - RNA, 19 nt, Homo sapiens
ucaggacuuugaugcauuu

SEQ ID NO: 195342 - RNA, 19 nt, Homo sapiens
gcacgaagacaucgauaag

SEQ ID NO: 195343 - RNA, 19 nt, Homo sapiens
ggaggugucccaagcuuug

SEQ ID NO: 195344 - RNA, 19 nt, Homo sapiens
ggacuuugaugcauuucca

SEQ ID NO: 195345 - RNA, 19 nt, Homo sapiens
gggcuucaccuucuccuuu

SEQ ID NO: 195346 - RNA, 19 nt, Homo sapiens
gaggaggugucccaagcuu

SEQ ID NO: 195347 - RNA, 19 nt, Homo sapiens
gaagaggccagugugaaga

SEQ ID NO: 195348 - RNA, 19 nt, Homo sapiens
ugagacggaugcagaagga

SEQ ID NO: 195349 - RNA, 19 nt, Homo sapiens
ggacaaccccaucauauga

SEQ ID NO: 195350 - RNA, 19 nt, Homo sapiens
ucucggcgguggccuguaa

SEQ ID NO: 195351 - RNA, 19 nt, Homo sapiens
gaugaucuccugcuacuac

SEQ ID NO: 195352 - RNA, 19 nt, Homo sapiens
gagaugcucuucgacuaca

SEQ ID NO: 195353 - RNA, 19 nt, Homo sapiens
gaagaccaaacaccagaug

SEQ ID NO: 195354 - RNA, 19 nt, Homo sapiens
gcacuaacuucagggugau

SEQ ID NO: 195355 - RNA, 19 nt, Homo sapiens
gagcagauccuggcagagu

SEQ ID NO: 195356 - RNA, 19 nt, Homo sapiens
cugagaugcucuucgacua

SEQ ID NO: 195357 - RNA, 19 nt, Homo sapiens
agaccaaacaccagaugua

SEQ ID NO: 195358 - RNA, 19 nt, Homo sapiens
ggccagcccuacaucuuca

SEQ ID NO: 195359 - RNA, 19 nt, Homo sapiens
ucggagagauggcgaugga

SEQ ID NO: 195360 - RNA, 19 nt, Homo sapiens
ggaccuggguggcacuaac

SEQ ID NO: 195361 - RNA, 19 nt, Homo sapiens
aaauggaugugguggcaau

SEQ ID NO: 195362 - RNA, 19 nt, Homo sapiens
gacgagagcucugcaaacc

SEQ ID NO: 195363 - RNA, 19 nt, Homo sapiens
cugaguggcuugugauucu

SEQ ID NO: 195364 - RNA, 19 nt, Homo sapiens
guugcucacucaggacuuu

SEQ ID NO: 195365 - RNA, 19 nt, Homo sapiens
gcugcgagaucaccuucau

SEQ ID NO: 195366 - RNA, 19 nt, Homo sapiens
ucaggcagcucuccaucca

SEQ ID NO: 195367 - RNA, 19 nt, Homo sapiens
gagagauggcgauggaugu

SEQ ID NO: 195368 - RNA, 19 nt, Homo sapiens
gaucuccugcuacuacgaa

SEQ ID NO: 195369 - RNA, 19 nt, Homo sapiens
ccaaacaccagauguacuc

SEQ ID NO: 195370 - RNA, 19 nt, Homo sapiens
ccaccuuucucgcuggaau

SEQ ID NO: 195371 - RNA, 19 nt, Homo sapiens
acgaguuccugcuggagua

SEQ ID NO: 195372 - RNA, 19 nt, Homo sapiens
gcaggagcaggaacagaga

SEQ ID NO: 195373 - RNA, 19 nt, Homo sapiens
gcucuucgacuacaucucu

SEQ ID NO: 195374 - RNA, 19 nt, Homo sapiens
ccuaagauuguguggguuu

SEQ ID NO: 195375 - RNA, 19 nt, Homo sapiens
cugcugagaugcucuucga

SEQ ID NO: 195376 - RNA, 19 nt, Homo sapiens
ggacgagagcucugcaaac

SEQ ID NO: 195377 - RNA, 19 nt, Homo sapiens
gcagauccuggcagaguuc

SEQ ID NO: 195378 - RNA, 19 nt, Homo sapiens
cuccaaggcuacagcaugu

SEQ ID NO: 195379 - RNA, 19 nt, Homo sapiens
ggcacgaagacaucgauaa

SEQ ID NO: 195380 - RNA, 19 nt, Homo sapiens
ucagggugaugcuggugaa

SEQ ID NO: 195381 - RNA, 19 nt, Homo sapiens
guggauggcuccguguaca

SEQ ID NO: 195382 - RNA, 19 nt, Homo sapiens
ugguggcaauggugaauga

SEQ ID NO: 195383 - RNA, 19 nt, Homo sapiens
gagaggggacuuugaaaug

SEQ ID NO: 195384 - RNA, 19 nt, Homo sapiens
gggugaugcuggugaaggu

SEQ ID NO: 195385 - RNA, 19 nt, Homo sapiens
ugaagaggccagugugaag

SEQ ID NO: 195386 - RNA, 19 nt, Homo sapiens
gcaaugccugcuacaugga

SEQ ID NO: 195387 - RNA, 19 nt, Homo sapiens
ggcuucaccuucuccuuuc

SEQ ID NO: 195388 - RNA, 19 nt, Homo sapiens
gcacugcugagaugcucuu

SEQ ID NO: 195389 - RNA, 19 nt, Homo sapiens
gaccaaacaccagauguac

SEQ ID NO: 195390 - RNA, 19 nt, Homo sapiens
gcauuuccacacugucaga

SEQ ID NO: 195391 - RNA, 19 nt, Homo sapiens
ccgcagcgaggacguaaug

SEQ ID NO: 195392 - RNA, 19 nt, Homo sapiens
ggaugcagaaggagaugga

SEQ ID NO: 195393 - RNA, 19 nt, Homo sapiens
gaccuagaccugggccaaa

SEQ ID NO: 195394 - RNA, 19 nt, Homo sapiens
ccuguaagaaggccuguau

SEQ ID NO: 195395 - RNA, 19 nt, Homo sapiens
caugaagaggccaguguga

SEQ ID NO: 195396 - RNA, 19 nt, Homo sapiens
caaggccucaggagcagaa

SEQ ID NO: 195397 - RNA, 19 nt, Homo sapiens
ggacguaaugcgcaucacu

SEQ ID NO: 195398 - RNA, 19 nt, Homo sapiens
gaccaccgacugcgacauc

SEQ ID NO: 195399 - RNA, 19 nt, Homo sapiens
ggagcagaagggaacaaug

SEQ ID NO: 195400 - RNA, 19 nt, Homo sapiens
ggaggaggaccugaagaag

SEQ ID NO: 195401 - RNA, 19 nt, Homo sapiens
ccucgcagcaggugcaaga

SEQ ID NO: 195402 - RNA, 19 nt, Homo sapiens
ugaugcauuuccacacugu

SEQ ID NO: 195403 - RNA, 19 nt, Homo sapiens
gggccucuucccucaguuu

SEQ ID NO: 195404 - RNA, 19 nt, Homo sapiens
cccaaagcaucuaccucuu

SEQ ID NO: 195405 - RNA, 19 nt, Homo sapiens
cucaggacuuugaugcauu

SEQ ID NO: 195406 - RNA, 19 nt, Homo sapiens
cugcaaugccugcuacaug

SEQ ID NO: 195407 - RNA, 19 nt, Homo sapiens
gcuggagacccaugaagag

SEQ ID NO: 195408 - RNA, 19 nt, Homo sapiens
gcagcucuccauccaagca

SEQ ID NO: 195409 - RNA, 19 nt, Homo sapiens
guaagaaggccuguaugcu

SEQ ID NO: 195410 - RNA, 19 nt, Homo sapiens
ggcuggagacccaugaaga

SEQ ID NO: 195411 - RNA, 19 nt, Homo sapiens
acgaugaucuccugcuacu

SEQ ID NO: 195412 - RNA, 19 nt, Homo sapiens
aggaggaggaccugaagaa

SEQ ID NO: 195413 - RNA, 19 nt, Homo sapiens
ucugcgagacgcuaucaaa

SEQ ID NO: 195414 - RNA, 19 nt, Homo sapiens
gcaagcagaucuacaacau

SEQ ID NO: 195415 - RNA, 19 nt, Homo sapiens
gcucauagguggcaaguac

SEQ ID NO: 195416 - RNA, 19 nt, Homo sapiens
ccaaagcaucuaccucuua

SEQ ID NO: 195417 - RNA, 19 nt, Homo sapiens
ugaagaugcugcccaccua

SEQ ID NO: 195418 - RNA, 19 nt, Homo sapiens
caaagcaucuaccucuuag

SEQ ID NO: 195419 - RNA, 19 nt, Homo sapiens
gagcagaagggaacaaugu

SEQ ID NO: 195420 - RNA, 19 nt, Homo sapiens
ccacgaugaucuccugcua

SEQ ID NO: 195421 - RNA, 19 nt, Homo sapiens
uggaggagaugcagaaugu

SEQ ID NO: 195422 - RNA, 19 nt, Homo sapiens
gaccggcacugcugagaug

SEQ ID NO: 195423 - RNA, 19 nt, Homo sapiens
ucaggacuuugaugcauuu

SEQ ID NO: 195424 - RNA, 19 nt, Homo sapiens
gcacgaagacaucgauaag

SEQ ID NO: 195425 - RNA, 19 nt, Homo sapiens
ggaggugucccaagcuuug

SEQ ID NO: 195426 - RNA, 19 nt, Homo sapiens
ggacuuugaugcauuucca

SEQ ID NO: 195427 - RNA, 19 nt, Homo sapiens
gggcuucaccuucuccuuu

SEQ ID NO: 195428 - RNA, 19 nt, Homo sapiens
gaggaggugucccaagcuu

SEQ ID NO: 195429 - RNA, 19 nt, Homo sapiens
uaacaugcccagaccaaga

SEQ ID NO: 195430 - RNA, 19 nt, Homo sapiens
gaagaggccagugugaaga

SEQ ID NO: 195431 - RNA, 19 nt, Homo sapiens
ugagacggaugcagaagga

SEQ ID NO: 195432 - RNA, 19 nt, Homo sapiens
ggacaaccccaucauauga

SEQ ID NO: 195433 - RNA, 19 nt, Homo sapiens
ucucggcgguggccuguaa

SEQ ID NO: 195434 - RNA, 19 nt, Homo sapiens
gaugaucuccugcuacuac

SEQ ID NO: 195435 - RNA, 19 nt, Homo sapiens
gagaugcucuucgacuaca

SEQ ID NO: 195436 - RNA, 19 nt, Homo sapiens
gaagaccaaacaccagaug

SEQ ID NO: 195437 - RNA, 19 nt, Homo sapiens
gcacuaacuucagggugau

SEQ ID NO: 195438 - RNA, 19 nt, Homo sapiens
gagcagauccuggcagagu

SEQ ID NO: 195439 - RNA, 19 nt, Homo sapiens
cugagaugcucuucgacua

SEQ ID NO: 195440 - RNA, 19 nt, Homo sapiens
agaccaaacaccagaugua

SEQ ID NO: 195441 - RNA, 19 nt, Homo sapiens
ggccagcccuacaucuuca

SEQ ID NO: 195442 - RNA, 19 nt, Homo sapiens
gcuggcagauguguuaaca

SEQ ID NO: 195443 - RNA, 19 nt, Homo sapiens
ucggagagauggcgaugga

SEQ ID NO: 195444 - RNA, 19 nt, Homo sapiens
ggaccuggguggcacuaac

SEQ ID NO: 195445 - RNA, 19 nt, Homo sapiens
aaauggaugugguggcaau

SEQ ID NO: 195446 - RNA, 19 nt, Homo sapiens
gacgagagcucugcaaacc

SEQ ID NO: 195447 - RNA, 19 nt, Homo sapiens
cugaguggcuugugauucu

SEQ ID NO: 195448 - RNA, 19 nt, Homo sapiens
guugcucacucaggacuuu

SEQ ID NO: 195449 - RNA, 19 nt, Homo sapiens
caacugcuacuuggaacaa

SEQ ID NO: 195450 - RNA, 19 nt, Homo sapiens
gcugcgagaucaccuucau

SEQ ID NO: 195451 - RNA, 19 nt, Homo sapiens
ucaggcagcucuccaucca

SEQ ID NO: 195452 - RNA, 19 nt, Homo sapiens
gaucuccugcuacuacgaa

SEQ ID NO: 195453 - RNA, 19 nt, Homo sapiens
ccaaacaccagauguacuc

SEQ ID NO: 195454 - RNA, 19 nt, Homo sapiens
gagagauggcgauggaugu

SEQ ID NO: 195455 - RNA, 19 nt, Homo sapiens
ccaccuuucucgcuggaau

SEQ ID NO: 195456 - RNA, 19 nt, Homo sapiens
acgaguuccugcuggagua

SEQ ID NO: 195457 - RNA, 19 nt, Homo sapiens
gcaggagcaggaacagaga

SEQ ID NO: 195458 - RNA, 19 nt, Homo sapiens
gcucuucgacuacaucucu

SEQ ID NO: 195459 - RNA, 19 nt, Homo sapiens
ccuaagauuguguggguuu

SEQ ID NO: 195460 - RNA, 19 nt, Homo sapiens
cugcugagaugcucuucga

SEQ ID NO: 195461 - RNA, 19 nt, Homo sapiens
ggacgagagcucugcaaac

SEQ ID NO: 195462 - RNA, 19 nt, Homo sapiens
cuccaaggcuacagcaugu

SEQ ID NO: 195463 - RNA, 19 nt, Homo sapiens
ggcacgaagacaucgauaa

SEQ ID NO: 195464 - RNA, 19 nt, Homo sapiens
ucagggugaugcuggugaa

SEQ ID NO: 195465 - RNA, 19 nt, Homo sapiens
gcagauccuggcagaguuc

SEQ ID NO: 195466 - RNA, 19 nt, Homo sapiens
guggauggcuccguguaca

SEQ ID NO: 195467 - RNA, 19 nt, Homo sapiens
ugguggcaauggugaauga

SEQ ID NO: 195468 - RNA, 19 nt, Homo sapiens
gagaggggacuuugaaaug

SEQ ID NO: 195469 - RNA, 19 nt, Homo sapiens
gggugaugcuggugaaggu

SEQ ID NO: 195470 - RNA, 19 nt, Homo sapiens
ugaagaggccagugugaag

SEQ ID NO: 195471 - RNA, 19 nt, Homo sapiens
gcaaugccugcuacaugga

SEQ ID NO: 195472 - RNA, 19 nt, Homo sapiens
ggcuucaccuucuccuuuc

SEQ ID NO: 195473 - RNA, 19 nt, Homo sapiens
gcacugcugagaugcucuu

SEQ ID NO: 195474 - RNA, 19 nt, Homo sapiens
gaccaaacaccagauguac

SEQ ID NO: 195475 - RNA, 19 nt, Homo sapiens
gcauuuccacacugucaga

SEQ ID NO: 195476 - RNA, 19 nt, Homo sapiens
ccgcagcgaggacguaaug

SEQ ID NO: 195477 - RNA, 19 nt, Homo sapiens
guuaacaugcccagaccaa

SEQ ID NO: 195478 - RNA, 19 nt, Homo sapiens
ggaugcagaaggagaugga

SEQ ID NO: 195479 - RNA, 19 nt, Homo sapiens
gaccuagaccugggccaaa

SEQ ID NO: 195480 - RNA, 19 nt, Homo sapiens
ccuguaagaaggccuguau

SEQ ID NO: 195481 - RNA, 19 nt, Homo sapiens
caaggccucaggagcagaa

SEQ ID NO: 195482 - RNA, 19 nt, Homo sapiens
caugaagaggccaguguga

SEQ ID NO: 195483 - RNA, 19 nt, Homo sapiens
ggacguaaugcgcaucacu

SEQ ID NO: 195484 - RNA, 19 nt, Homo sapiens
gaccaccgacugcgacauc

SEQ ID NO: 195485 - RNA, 19 nt, Homo sapiens
ggagcagaagggaacaaug

SEQ ID NO: 195486 - RNA, 19 nt, Homo sapiens
ggaggaggaccugaagaag

SEQ ID NO: 195487 - RNA, 19 nt, Homo sapiens
ccucgcagcaggugcaaga

SEQ ID NO: 195488 - RNA, 19 nt, Homo sapiens
ugaugcauuuccacacugu

SEQ ID NO: 195489 - RNA, 19 nt, Homo sapiens
gggccucuucccucaguuu

SEQ ID NO: 195490 - RNA, 19 nt, Homo sapiens
cccaaagcaucuaccucuu

SEQ ID NO: 195491 - RNA, 19 nt, Homo sapiens
cucaggacuuugaugcauu

SEQ ID NO: 195492 - RNA, 19 nt, Homo sapiens
cugcaaugccugcuacaug

SEQ ID NO: 195493 - RNA, 19 nt, Homo sapiens
gcagcucuccauccaagca

SEQ ID NO: 195494 - RNA, 19 nt, Homo sapiens
gcuggagacccaugaagag

SEQ ID NO: 195495 - RNA, 19 nt, Homo sapiens
guaagaaggccuguaugcu

SEQ ID NO: 195496 - RNA, 19 nt, Homo sapiens
acgaugaucuccugcuacu

SEQ ID NO: 195497 - RNA, 19 nt, Homo sapiens
ucugcgagacgcuaucaaa

SEQ ID NO: 195498 - RNA, 19 nt, Homo sapiens
aggaggaggaccugaagaa

SEQ ID NO: 195499 - RNA, 19 nt, Homo sapiens
ggcuggagacccaugaaga

SEQ ID NO: 195500 - RNA, 19 nt, Homo sapiens
gaaauauucucuccacuuu

SEQ ID NO: 195501 - RNA, 19 nt, Homo sapiens
caacacagcugucuucuug

SEQ ID NO: 195502 - RNA, 19 nt, Homo sapiens
ggcaagcccuguccacaua

SEQ ID NO: 195503 - RNA, 19 nt, Homo sapiens
gaacaacacagcugucuuc

SEQ ID NO: 195504 - RNA, 19 nt, Homo sapiens
ccaaaugggugcugaauac

SEQ ID NO: 195505 - RNA, 19 nt, Homo sapiens
ucacggaggugcagacuau

SEQ ID NO: 195506 - RNA, 19 nt, Homo sapiens
gaagaaaggccacguguac

SEQ ID NO: 195507 - RNA, 19 nt, Homo sapiens
gcuggaaacccuguuauua

SEQ ID NO: 195508 - RNA, 19 nt, Homo sapiens
gaagagagugauugucauu

SEQ ID NO: 195509 - RNA, 19 nt, Homo sapiens
ggacagaaaccucuuuaca

SEQ ID NO: 195510 - RNA, 19 nt, Homo sapiens
cagauggacugcugcauga

SEQ ID NO: 195511 - RNA, 19 nt, Homo sapiens
agaaaccucuuuacaccua

SEQ ID NO: 195512 - RNA, 19 nt, Homo sapiens
aaagaugccuccuggaaau

SEQ ID NO: 195513 - RNA, 19 nt, Homo sapiens
gcaaugugaugcugagauc

SEQ ID NO: 195514 - RNA, 19 nt, Homo sapiens
ucacggaaaucgauacugu

SEQ ID NO: 195515 - RNA, 19 nt, Homo sapiens
gacccaggaucuagacaaa

SEQ ID NO: 195516 - RNA, 19 nt, Homo sapiens
guccguggcuuucucauug

SEQ ID NO: 195517 - RNA, 19 nt, Homo sapiens
ucaugucgguguccuuuaa

SEQ ID NO: 195518 - RNA, 19 nt, Homo sapiens
caaagaugccuccuggaaa

SEQ ID NO: 195519 - RNA, 19 nt, Homo sapiens
gaacaugugggaggaagaa

SEQ ID NO: 195520 - RNA, 19 nt, Homo sapiens
gcucaugugcuucuuggua

SEQ ID NO: 195521 - RNA, 19 nt, Homo sapiens
ggaagaagagagugauugu

SEQ ID NO: 195522 - RNA, 19 nt, Homo sapiens
ggaagugccaccaagauuc

SEQ ID NO: 195523 - RNA, 19 nt, Homo sapiens
gaguacaggugcucaugug

SEQ ID NO: 195524 - RNA, 19 nt, Homo sapiens
ucaaagaugccuccuggaa

SEQ ID NO: 195525 - RNA, 19 nt, Homo sapiens
uagcagagcggaugcagaa

SEQ ID NO: 195526 - RNA, 19 nt, Homo sapiens
agacuggaguucaacauuc

SEQ ID NO: 195527 - RNA, 19 nt, Homo sapiens
gaaguuccagcgugagcua

SEQ ID NO: 195528 - RNA, 19 nt, Homo sapiens
ggauugaggaacugaagaa

SEQ ID NO: 195529 - RNA, 19 nt, Homo sapiens
acagguggcugggaaaguu

SEQ ID NO: 195530 - RNA, 19 nt, Homo sapiens
gauacuguggucuucauuu

SEQ ID NO: 195531 - RNA, 19 nt, Homo sapiens
ucaccgacuuauucugauu

SEQ ID NO: 195532 - RNA, 19 nt, Homo sapiens
uggagcaggugaaagagaa

SEQ ID NO: 195533 - RNA, 19 nt, Homo sapiens
aauauucucuccacuuugg

SEQ ID NO: 195534 - RNA, 19 nt, Homo sapiens
gauccuagagccugacguu

SEQ ID NO: 195535 - RNA, 19 nt, Homo sapiens
caagauugccacccugaug

SEQ ID NO: 195536 - RNA, 19 nt, Homo sapiens
cagccacugucagaugaua

SEQ ID NO: 195537 - RNA, 19 nt, Homo sapiens
gaagugccaccaagauucu

SEQ ID NO: 195538 - RNA, 19 nt, Homo sapiens
ccaagauucugcuggaaac

SEQ ID NO: 195539 - RNA, 19 nt, Homo sapiens
aagaagagagugauuguca

SEQ ID NO: 195540 - RNA, 19 nt, Homo sapiens
ggucugugguggccucuag

SEQ ID NO: 195541 - RNA, 19 nt, Homo sapiens
ugagaaggaacaggugaua

SEQ ID NO: 195542 - RNA, 19 nt, Homo sapiens
cucaugugcuucuugguaa

SEQ ID NO: 195543 - RNA, 19 nt, Homo sapiens
ugaaagagaagaccaacca

SEQ ID NO: 195544 - RNA, 19 nt, Homo sapiens
acagugacauguuuaacca

SEQ ID NO: 195545 - RNA, 19 nt, Homo sapiens
gggaagaagagagugauug

SEQ ID NO: 195546 - RNA, 19 nt, Homo sapiens
gcacgggauugaggaacug

SEQ ID NO: 195547 - RNA, 19 nt, Homo sapiens
aggcugagcucaccaacca

SEQ ID NO: 195548 - RNA, 19 nt, Homo sapiens
ugacauguuuaaccagaag

SEQ ID NO: 195549 - RNA, 19 nt, Homo sapiens
uugaggaacugaagaaggu

SEQ ID NO: 195550 - RNA, 19 nt, Homo sapiens
ucagugaacccauguuucu

SEQ ID NO: 195551 - RNA, 19 nt, Homo sapiens
ggguuuguguggcugaaga

SEQ ID NO: 195552 - RNA, 19 nt, Homo sapiens
gagcauggccagaaaugac

SEQ ID NO: 195553 - RNA, 19 nt, Homo sapiens
agagagugauugucauugg

SEQ ID NO: 195554 - RNA, 19 nt, Homo sapiens
gcagaugcugagaacauug

SEQ ID NO: 195555 - RNA, 19 nt, Homo sapiens
uagagugcauccacaccuu

SEQ ID NO: 195556 - RNA, 19 nt, Homo sapiens
cagugagcauggccagaaa

SEQ ID NO: 195557 - RNA, 19 nt, Homo sapiens
gacagaaaccucuuuacac

SEQ ID NO: 195558 - RNA, 19 nt, Homo sapiens
cggauggcauuccucaugu

SEQ ID NO: 195559 - RNA, 19 nt, Homo sapiens
cccagccacugucagauga

SEQ ID NO: 195560 - RNA, 19 nt, Homo sapiens
cuggaaaucuugcggacau

SEQ ID NO: 195561 - RNA, 19 nt, Homo sapiens
aggagaaacagaaagcuuu

SEQ ID NO: 195562 - RNA, 19 nt, Homo sapiens
ccagugagcauggccagaa

SEQ ID NO: 195563 - RNA, 19 nt, Homo sapiens
ucucaccgacuuauucuga

SEQ ID NO: 195564 - RNA, 19 nt, Homo sapiens
cuagugguuucuacucuca

SEQ ID NO: 195565 - RNA, 19 nt, Homo sapiens
uacaggugcucaugugcuu

SEQ ID NO: 195566 - RNA, 19 nt, Homo sapiens
aagggaacuucauccagaa

SEQ ID NO: 195567 - RNA, 19 nt, Homo sapiens
uaguggagcaggugaaaga

SEQ ID NO: 195568 - RNA, 19 nt, Homo sapiens
agaagaaaggccacgugua

SEQ ID NO: 195569 - RNA, 19 nt, Homo sapiens
cauugcagcaucucaaaga

SEQ ID NO: 195570 - RNA, 19 nt, Homo sapiens
gaagacuggaguucaacau

SEQ ID NO: 195571 - RNA, 19 nt, Homo sapiens
gugauugucauuggcauuu

SEQ ID NO: 195572 - RNA, 19 nt, Homo sapiens
ugaagaggcaggaggaaca

SEQ ID NO: 195573 - RNA, 19 nt, Homo sapiens
ucucauuggugaucacagu

SEQ ID NO: 195574 - RNA, 19 nt, Homo sapiens
uggaaacccuguuauuagc

SEQ ID NO: 195575 - RNA, 19 nt, Homo sapiens
caggguagggagaaauauu

SEQ ID NO: 195576 - RNA, 19 nt, Homo sapiens
ccuccgagcgauccacuuu

SEQ ID NO: 195577 - RNA, 19 nt, Homo sapiens
cauguuggaccuucggauu

SEQ ID NO: 195578 - RNA, 19 nt, Homo sapiens
ggaaacccuguuauuagca

SEQ ID NO: 195579 - RNA, 19 nt, Homo sapiens
cuggaaacccuguuauuag

SEQ ID NO: 195580 - RNA, 19 nt, Homo sapiens
cuuuacaccuaccucauug

SEQ ID NO: 195581 - RNA, 19 nt, Homo sapiens
uuucuacucucaccgacuu

SEQ ID NO: 195582 - RNA, 19 nt, Homo sapiens
caaucacggagaagucaaa

SEQ ID NO: 195583 - RNA, 19 nt, Homo sapiens
gugacauguuuaaccagaa

SEQ ID NO: 195584 - RNA, 19 nt, Homo sapiens
ccacccugaugaagagugu

SEQ ID NO: 195585 - RNA, 19 nt, Homo sapiens
gagaagucaaacccacuga

SEQ ID NO: 195586 - RNA, 19 nt, Homo sapiens
ugggaaaguucaggaagug

SEQ ID NO: 195587 - RNA, 19 nt, Homo sapiens
uagcagcccauaagacugu

SEQ ID NO: 195588 - RNA, 19 nt, Homo sapiens
gauugucauuggcauuucu

SEQ ID NO: 195589 - RNA, 19 nt, Homo sapiens
ggauggcauuccucauguc

SEQ ID NO: 195590 - RNA, 19 nt, Homo sapiens
aaugggugcugaauacagu

SEQ ID NO: 195591 - RNA, 19 nt, Homo sapiens
ggccacugcuuuucuuuga

SEQ ID NO: 195592 - RNA, 19 nt, Homo sapiens
gugcugauuuccgagaugu

SEQ ID NO: 195593 - RNA, 19 nt, Homo sapiens
ggagaaacagaaagcuuuu

SEQ ID NO: 195594 - RNA, 19 nt, Homo sapiens
gcagagcggaugcagaaaa

SEQ ID NO: 195595 - RNA, 19 nt, Homo sapiens
gaagaagagagugauuguc

SEQ ID NO: 195596 - RNA, 19 nt, Homo sapiens
gcucucgaccuagugguuu

SEQ ID NO: 195597 - RNA, 19 nt, Homo sapiens
ggaggaagaagccccguuu

SEQ ID NO: 195598 - RNA, 19 nt, Homo sapiens
gcagacccugggcaucauu

SEQ ID NO: 195599 - RNA, 19 nt, Homo sapiens
gggcauugcagcaucucaa

SEQ ID NO: 195600 - RNA, 19 nt, Homo sapiens
agagaaagcuggaccauga

SEQ ID NO: 195601 - RNA, 19 nt, Homo sapiens
gguccaggcugcccaauuu

SEQ ID NO: 195602 - RNA, 19 nt, Homo sapiens
gcaaggagcugcaggaaaa

SEQ ID NO: 195603 - RNA, 19 nt, Homo sapiens
ccacugcacuggaauaugu

SEQ ID NO: 195604 - RNA, 19 nt, Homo sapiens
gacagaagcuuugguggau

SEQ ID NO: 195605 - RNA, 19 nt, Homo sapiens
uggaauaugucuacaaagg

SEQ ID NO: 195606 - RNA, 19 nt, Homo sapiens
caaccaggcacucaaggaa

SEQ ID NO: 195607 - RNA, 19 nt, Homo sapiens
cagaagcuuugguggauca

SEQ ID NO: 195608 - RNA, 19 nt, Homo sapiens
acuggaauaugucuacaaa

SEQ ID NO: 195609 - RNA, 19 nt, Homo sapiens
ggaucggaaugguggagaa

SEQ ID NO: 195610 - RNA, 19 nt, Homo sapiens
gaaggagggaggcugacaa

SEQ ID NO: 195611 - RNA, 19 nt, Homo sapiens
gcacuggaauaugucuaca

SEQ ID NO: 195612 - RNA, 19 nt, Homo sapiens
gagcaucgagcuggacaug

SEQ ID NO: 195613 - RNA, 19 nt, Homo sapiens
cauugccacugcacuggaa

SEQ ID NO: 195614 - RNA, 19 nt, Homo sapiens
ucggaaugguggagaacuu

SEQ ID NO: 195615 - RNA, 19 nt, Homo sapiens
gaaugguggagaacuucaa

SEQ ID NO: 195616 - RNA, 19 nt, Homo sapiens
ggaaugguggagaacuuca

SEQ ID NO: 195617 - RNA, 19 nt, Homo sapiens
ggaaggagggaggcugaca

SEQ ID NO: 195618 - RNA, 19 nt, Homo sapiens
accaggcacucaaggaaau

SEQ ID NO: 195619 - RNA, 19 nt, Homo sapiens
agaaagagaucaucaagaa

SEQ ID NO: 195620 - RNA, 19 nt, Homo sapiens
cgaaaccacucaugucuuu

SEQ ID NO: 195621 - RNA, 19 nt, Homo sapiens
ccauggagcuggucaauga

SEQ ID NO: 195622 - RNA, 19 nt, Homo sapiens
gcacaacauucucuacuuc

SEQ ID NO: 195623 - RNA, 19 nt, Homo sapiens
ccaagcaggucuauuucua

SEQ ID NO: 195624 - RNA, 19 nt, Homo sapiens
ugagacaccugcccaguuu

SEQ ID NO: 195625 - RNA, 19 nt, Homo sapiens
gaccagaacugcucauuuu

SEQ ID NO: 195626 - RNA, 19 nt, Homo sapiens
ggagagcguuccuggcauu

SEQ ID NO: 195627 - RNA, 19 nt, Homo sapiens
ggacguggcuaccuacaag

SEQ ID NO: 195628 - RNA, 19 nt, Homo sapiens
gaaggaguaucacaucaag

SEQ ID NO: 195629 - RNA, 19 nt, Homo sapiens
ugaaccaccugaaggagua

SEQ ID NO: 195630 - RNA, 19 nt, Homo sapiens
acaccaagcaggucuauuu

SEQ ID NO: 195631 - RNA, 19 nt, Homo sapiens
aauggaaccuguaagugua

SEQ ID NO: 195632 - RNA, 19 nt, Homo sapiens
ggaccagaacugcucauuu

SEQ ID NO: 195633 - RNA, 19 nt, Homo sapiens
ucacggagauugucuucug

SEQ ID NO: 195634 - RNA, 19 nt, Homo sapiens
ugagaaaccuaauauugag

SEQ ID NO: 195635 - RNA, 19 nt, Homo sapiens
gagggaauaauaaagcuuu

SEQ ID NO: 195636 - RNA, 19 nt, Homo sapiens
ggacccaccugaugaacca

SEQ ID NO: 195637 - RNA, 19 nt, Homo sapiens
acacggagcugucccacau

SEQ ID NO: 195638 - RNA, 19 nt, Homo sapiens
agaggacgcucccagagaa

SEQ ID NO: 195639 - RNA, 19 nt, Homo sapiens
ucauggagccugugaagaa

SEQ ID NO: 195640 - RNA, 19 nt, Homo sapiens
acaaauuggugcccgagaa

SEQ ID NO: 195641 - RNA, 19 nt, Homo sapiens
gaguggagaaggacaaauu

SEQ ID NO: 195642 - RNA, 19 nt, Homo sapiens
caauggaaccuguaagugu

SEQ ID NO: 195643 - RNA, 19 nt, Homo sapiens
gcgcaugccuaaggaguau

SEQ ID NO: 195644 - RNA, 19 nt, Homo sapiens
guccagcacuguucuguca

SEQ ID NO: 195645 - RNA, 19 nt, Homo sapiens
ucaagaagcagaaagagau

SEQ ID NO: 195646 - RNA, 19 nt, Homo sapiens
gcccugaccuggaaugucu

SEQ ID NO: 195647 - RNA, 19 nt, Homo sapiens
gcagaaagagaucaucaag

SEQ ID NO: 195648 - RNA, 19 nt, Homo sapiens
cgacgcugauggaguguga

SEQ ID NO: 195649 - RNA, 19 nt, Homo sapiens
caaguaggcccaucuuugg

SEQ ID NO: 195650 - RNA, 19 nt, Homo sapiens
uaaguguaauggcuggaaa

SEQ ID NO: 195651 - RNA, 19 nt, Homo sapiens
acaaguaggcccaucuuug

SEQ ID NO: 195652 - RNA, 19 nt, Homo sapiens
ccauugaccugaagaccau

SEQ ID NO: 195653 - RNA, 19 nt, Homo sapiens
ucacaucaagcacaacauu

SEQ ID NO: 195654 - RNA, 19 nt, Homo sapiens
ugucagaggaugagauaaa

SEQ ID NO: 195655 - RNA, 19 nt, Homo sapiens
gagcguuccuggcauucga

SEQ ID NO: 195656 - RNA, 19 nt, Homo sapiens
augagcaggucaaggguua

SEQ ID NO: 195657 - RNA, 19 nt, Homo sapiens
gaagcugauugagcgcaaa

SEQ ID NO: 195658 - RNA, 19 nt, Homo sapiens
cuucaugucuguucacaag

SEQ ID NO: 195659 - RNA, 19 nt, Homo sapiens
gaggccucauugacaagua

SEQ ID NO: 195660 - RNA, 19 nt, Homo sapiens
gaaagagaucaucaagaag

SEQ ID NO: 195661 - RNA, 19 nt, Homo sapiens
ccaaauuccuguccaugcu

SEQ ID NO: 195662 - RNA, 19 nt, Homo sapiens
gauggagugugagcugaau

SEQ ID NO: 195663 - RNA, 19 nt, Homo sapiens
ucaccuacgccgacgagua

SEQ ID NO: 195664 - RNA, 19 nt, Homo sapiens
cugaggacguggcuaccua

SEQ ID NO: 195665 - RNA, 19 nt, Homo sapiens
ucaugucuguucacaagga

SEQ ID NO: 195666 - RNA, 19 nt, Homo sapiens
cauuuuagcuugagugaug

SEQ ID NO: 195667 - RNA, 19 nt, Homo sapiens
gagcugugccgcaguugug

SEQ ID NO: 195668 - RNA, 19 nt, Homo sapiens
gacaaguaggcccaucuuu

SEQ ID NO: 195669 - RNA, 19 nt, Homo sapiens
gcucuacacaacccucaaa

SEQ ID NO: 195670 - RNA, 19 nt, Homo sapiens
cagaaagagaucaucaaga

SEQ ID NO: 195671 - RNA, 19 nt, Homo sapiens
ggugguggauguggagaau

SEQ ID NO: 195672 - RNA, 19 nt, Homo sapiens
ggagcugucccacaucauc

SEQ ID NO: 195673 - RNA, 19 nt, Homo sapiens
ggcaucugcuuccgcaugu

SEQ ID NO: 195674 - RNA, 19 nt, Homo sapiens
ggacccucauccucacuca

SEQ ID NO: 195675 - RNA, 19 nt, Homo sapiens
uguucgagcucucaaagau

SEQ ID NO: 195676 - RNA, 19 nt, Homo sapiens
ccauuugagaaaccuaaua

SEQ ID NO: 195677 - RNA, 19 nt, Homo sapiens
gaacugcucauuuuagcuu

SEQ ID NO: 195678 - RNA, 19 nt, Homo sapiens
ugucccacaucaucaagaa

SEQ ID NO: 195679 - RNA, 19 nt, Homo sapiens
caucugcuuccgcauguuu

SEQ ID NO: 195680 - RNA, 19 nt, Homo sapiens
gaaccugacccuggaggau

SEQ ID NO: 195681 - RNA, 19 nt, Homo sapiens
gcuacgaaaccacucaugu

SEQ ID NO: 195682 - RNA, 19 nt, Homo sapiens
cgccaucggcuacuucaaa

SEQ ID NO: 195683 - RNA, 19 nt, Homo sapiens
ugaaggaguaucacaucaa

SEQ ID NO: 195684 - RNA, 19 nt, Homo sapiens
ucaagcuacugcggaaaug

SEQ ID NO: 195685 - RNA, 19 nt, Homo sapiens
gcgcaaacaggcccagauc

SEQ ID NO: 195686 - RNA, 19 nt, Homo sapiens
gccaauggaaccuguaagu

SEQ ID NO: 195687 - RNA, 19 nt, Homo sapiens
agggaggccucauugacaa

SEQ ID NO: 195688 - RNA, 19 nt, Homo sapiens
ccaacugucgcgaguacaa

SEQ ID NO: 195689 - RNA, 19 nt, Homo sapiens
ccacuuggagaauguguca

SEQ ID NO: 195690 - RNA, 19 nt, Homo sapiens
gagcugucccacaucauca

SEQ ID NO: 195691 - RNA, 19 nt, Homo sapiens
ugggcuacaucaaggacua

SEQ ID NO: 195692 - RNA, 19 nt, Homo sapiens
cugaaggaguaucacauca

SEQ ID NO: 195693 - RNA, 19 nt, Homo sapiens
gcaugccuaaggaguauau

SEQ ID NO: 195694 - RNA, 19 nt, Homo sapiens
gaaccuguaaguguaaugg

SEQ ID NO: 195695 - RNA, 19 nt, Homo sapiens
uaucccacuuggagaaugu

SEQ ID NO: 195696 - RNA, 19 nt, Homo sapiens
ccaagcggcuccgugugau

SEQ ID NO: 195697 - RNA, 19 nt, Homo sapiens
gggcaaacucuccaaucug

SEQ ID NO: 195698 - RNA, 19 nt, Homo sapiens
ccuacaaggucaauuacac

SEQ ID NO: 195699 - RNA, 19 nt, Homo sapiens
acaaggaagaggacacaga

SEQ ID NO: 195700 - RNA, 19 nt, Homo sapiens
ccuuagagggaauaauaaa

SEQ ID NO: 195701 - RNA, 19 nt, Homo sapiens
ugugucagaggaugagaua

SEQ ID NO: 195702 - RNA, 19 nt, Homo sapiens
ccgaccagcucuacacaac

SEQ ID NO: 195703 - RNA, 19 nt, Homo sapiens
ucaucaagaagcagaaaga

SEQ ID NO: 195704 - RNA, 19 nt, Homo sapiens
aguaucacaucaagcacaa

SEQ ID NO: 195705 - RNA, 19 nt, Homo sapiens
ugaugaaccaccugaagga

SEQ ID NO: 195706 - RNA, 19 nt, Homo sapiens
ucacucacuuccccaaauu

SEQ ID NO: 195707 - RNA, 19 nt, Homo sapiens
gauguucgagcucucaaag

SEQ ID NO: 195708 - RNA, 19 nt, Homo sapiens
gggagcggcagacgauguu

SEQ ID NO: 195709 - RNA, 19 nt, Homo sapiens
gucccagccuucacugugu

SEQ ID NO: 195710 - RNA, 19 nt, Homo sapiens
ucaagcacaacauucucua

SEQ ID NO: 195711 - RNA, 19 nt, Homo sapiens
gagcaggucaaggguuaug

SEQ ID NO: 195712 - RNA, 19 nt, Homo sapiens
caaauuggugcccgagaag

SEQ ID NO: 195713 - RNA, 19 nt, Homo sapiens
ccaauggaaccuguaagug

SEQ ID NO: 195714 - RNA, 19 nt, Homo sapiens
caagaagcagaaagagauc

SEQ ID NO: 195715 - RNA, 19 nt, Homo sapiens
cuacgaaaccacucauguc

SEQ ID NO: 195716 - RNA, 19 nt, Homo sapiens
gcagcccuccauuugagaa

SEQ ID NO: 195717 - RNA, 19 nt, Homo sapiens
uucauucccuggcauuaau

SEQ ID NO: 195718 - RNA, 19 nt, Homo sapiens
ugacaaguaggcccaucuu

SEQ ID NO: 195719 - RNA, 19 nt, Homo sapiens
gaacaugucucuccaacaa

SEQ ID NO: 195720 - RNA, 19 nt, Homo sapiens
caacgaaccugucucauuu

SEQ ID NO: 195721 - RNA, 19 nt, Homo sapiens
gcaauuaacuuccuaaauc

SEQ ID NO: 195722 - RNA, 19 nt, Homo sapiens
ccacagaauugccagauaa

SEQ ID NO: 195723 - RNA, 19 nt, Homo sapiens
gaagaacuacacagauuua

SEQ ID NO: 195724 - RNA, 19 nt, Homo sapiens
gcacagugaccauauuuaa

SEQ ID NO: 195725 - RNA, 19 nt, Homo sapiens
cagagcaaguuguuaauuu

SEQ ID NO: 195726 - RNA, 19 nt, Homo sapiens
gggcuaagaugacuauuuc

SEQ ID NO: 195727 - RNA, 19 nt, Homo sapiens
agaaauugcucucugauga

SEQ ID NO: 195728 - RNA, 19 nt, Homo sapiens
gaaagcaauuaacuuccua

SEQ ID NO: 195729 - RNA, 19 nt, Homo sapiens
acaaagagcccauucauug

SEQ ID NO: 195730 - RNA, 19 nt, Homo sapiens
aaacgauacugguacauuu

SEQ ID NO: 195731 - RNA, 19 nt, Homo sapiens
ccucacagcuggaacaauu

SEQ ID NO: 195732 - RNA, 19 nt, Homo sapiens
gaagauggauacgcuguga

SEQ ID NO: 195733 - RNA, 19 nt, Homo sapiens
caggaaagauggugaaugu

SEQ ID NO: 195734 - RNA, 19 nt, Homo sapiens
cgacagaguugaauguaug

SEQ ID NO: 195735 - RNA, 19 nt, Homo sapiens
gccucuaucuguccaauua

SEQ ID NO: 195736 - RNA, 19 nt, Homo sapiens
cuacacagauuuagugaug

SEQ ID NO: 195737 - RNA, 19 nt, Homo sapiens
gaagaaaucgaaaggauca

SEQ ID NO: 195738 - RNA, 19 nt, Homo sapiens
gcaagcagaccacuuaguu

SEQ ID NO: 195739 - RNA, 19 nt, Homo sapiens
gaacaacgaaccugucuca

SEQ ID NO: 195740 - RNA, 19 nt, Homo sapiens
ucacagaugccuucucuaa

SEQ ID NO: 195741 - RNA, 19 nt, Homo sapiens
gcacgcccauguugauuga

SEQ ID NO: 195742 - RNA, 19 nt, Homo sapiens
acagaugccuucucuaaga

SEQ ID NO: 195743 - RNA, 19 nt, Homo sapiens
ccaacuagaucacauucuu

SEQ ID NO: 195744 - RNA, 19 nt, Homo sapiens
gguaggaggugaggauuga

SEQ ID NO: 195745 - RNA, 19 nt, Homo sapiens
ucagcagacucauacauuu

SEQ ID NO: 195746 - RNA, 19 nt, Homo sapiens
gacauuaggucagccacua

SEQ ID NO: 195747 - RNA, 19 nt, Homo sapiens
gguaguccaugucugauug

SEQ ID NO: 195748 - RNA, 19 nt, Homo sapiens
ccuaagggcagaagaauuu

SEQ ID NO: 195749 - RNA, 19 nt, Homo sapiens
ccagauaucggaagaagaa

SEQ ID NO: 195750 - RNA, 19 nt, Homo sapiens
ggaacuggcugaugucacu

SEQ ID NO: 195751 - RNA, 19 nt, Homo sapiens
ugucuucccucaccguuua

SEQ ID NO: 195752 - RNA, 19 nt, Homo sapiens
ggaaagguucugcaaguug

SEQ ID NO: 195753 - RNA, 19 nt, Homo sapiens
gcaccaccaucauugucua

SEQ ID NO: 195754 - RNA, 19 nt, Homo sapiens
aaagaugacuaccucaaug

SEQ ID NO: 195755 - RNA, 19 nt, Homo sapiens
cagauugccuggaucaaga

SEQ ID NO: 195756 - RNA, 19 nt, Homo sapiens
caauauauaccgcaccuuu

SEQ ID NO: 195757 - RNA, 19 nt, Homo sapiens
gagcaaccauggugauagu

SEQ ID NO: 195758 - RNA, 19 nt, Homo sapiens
ggaaggcuaucagagaaga

SEQ ID NO: 195759 - RNA, 19 nt, Homo sapiens
gacaggcucuggagggaaa

SEQ ID NO: 195760 - RNA, 19 nt, Homo sapiens
cgagagcccugcagaaucu

SEQ ID NO: 195761 - RNA, 19 nt, Homo sapiens
guuguuaauuuguggagua

SEQ ID NO: 195762 - RNA, 19 nt, Homo sapiens
guucguguguaucuguuua

SEQ ID NO: 195763 - RNA, 19 nt, Homo sapiens
caccaggucugucuuugaa

SEQ ID NO: 195764 - RNA, 19 nt, Homo sapiens
gacacaggcagaacuauuu

SEQ ID NO: 195765 - RNA, 19 nt, Homo sapiens
caagaacugugucaugucu

SEQ ID NO: 195766 - RNA, 19 nt, Homo sapiens
gcaaaguggcuguguguuc

SEQ ID NO: 195767 - RNA, 19 nt, Homo sapiens
ggagacacauaucacagau

SEQ ID NO: 195768 - RNA, 19 nt, Homo sapiens
gggaaagguucugcaaguu

SEQ ID NO: 195769 - RNA, 19 nt, Homo sapiens
guguguaucuguuuauuuc

SEQ ID NO: 195770 - RNA, 19 nt, Homo sapiens
uguauggccuucaacauga

SEQ ID NO: 195771 - RNA, 19 nt, Homo sapiens
ugaauaaacgauacuggua

SEQ ID NO: 195772 - RNA, 19 nt, Homo sapiens
gcuacaggcuugcacuaug

SEQ ID NO: 195773 - RNA, 19 nt, Homo sapiens
ccgaggaccuggaaccauu

SEQ ID NO: 195774 - RNA, 19 nt, Homo sapiens
gaagguaggaguguagcua

SEQ ID NO: 195775 - RNA, 19 nt, Homo sapiens
ccaacaacguaguauugaa

SEQ ID NO: 195776 - RNA, 19 nt, Homo sapiens
uaccugagauucgauauau

SEQ ID NO: 195777 - RNA, 19 nt, Homo sapiens
gauuacacgugccucuuga

SEQ ID NO: 195778 - RNA, 19 nt, Homo sapiens
uaaacaggguaaagugaau

SEQ ID NO: 195779 - RNA, 19 nt, Homo sapiens
acacagauuuagugaugaa

SEQ ID NO: 195780 - RNA, 19 nt, Homo sapiens
ggcaggaguuugaggaaga

SEQ ID NO: 195781 - RNA, 19 nt, Homo sapiens
gcaaacucagguauuauga

SEQ ID NO: 195782 - RNA, 19 nt, Homo sapiens
agagcaaguuguuaauuug

SEQ ID NO: 195783 - RNA, 19 nt, Homo sapiens
uuacacauuugacuuccua

SEQ ID NO: 195784 - RNA, 19 nt, Homo sapiens
gccacagaauugccagaua

SEQ ID NO: 195785 - RNA, 19 nt, Homo sapiens
ucaccaggcuccacacugu

SEQ ID NO: 195786 - RNA, 19 nt, Homo sapiens
aagaagaaaucgaaaggau

SEQ ID NO: 195787 - RNA, 19 nt, Homo sapiens
gacaaagagcccauucauu

SEQ ID NO: 195788 - RNA, 19 nt, Homo sapiens
gaaggagacacauaucaca

SEQ ID NO: 195789 - RNA, 19 nt, Homo sapiens
gacauggccuggacuccuu

SEQ ID NO: 195790 - RNA, 19 nt, Homo sapiens
gcccacuacugauuuauuc

SEQ ID NO: 195791 - RNA, 19 nt, Homo sapiens
ggugcccacuacugauuua

SEQ ID NO: 195792 - RNA, 19 nt, Homo sapiens
acaguguugucauuguuua

SEQ ID NO: 195793 - RNA, 19 nt, Homo sapiens
gcccuccgaugaagaacua

SEQ ID NO: 195794 - RNA, 19 nt, Homo sapiens
gagcuaauccugcugucuu

SEQ ID NO: 195795 - RNA, 19 nt, Homo sapiens
gcucaaaugccuccagaug

SEQ ID NO: 195796 - RNA, 19 nt, Homo sapiens
gccacuagauguauuugug

SEQ ID NO: 195797 - RNA, 19 nt, Homo sapiens
caacuagaucacauucuuu

SEQ ID NO: 195798 - RNA, 19 nt, Homo sapiens
ggcaaggaaugaccuguuc

SEQ ID NO: 195799 - RNA, 19 nt, Homo sapiens
augaagaacuacacagauu

SEQ ID NO: 195800 - RNA, 19 nt, Homo sapiens
uaucacagaugccuucucu

SEQ ID NO: 195801 - RNA, 19 nt, Homo sapiens
uccauaauguugacaaaga

SEQ ID NO: 195802 - RNA, 19 nt, Homo sapiens
uacagaaugugaagauguu

SEQ ID NO: 195803 - RNA, 19 nt, Homo sapiens
ccagagagaccaagaugga

SEQ ID NO: 195804 - RNA, 19 nt, Homo sapiens
caugaaagcaauuaacuuc

SEQ ID NO: 195805 - RNA, 19 nt, Homo sapiens
gagcaaaguggcugugugu

SEQ ID NO: 195806 - RNA, 19 nt, Homo sapiens
guccaugucugauuguaau

SEQ ID NO: 195807 - RNA, 19 nt, Homo sapiens
guaggucuguggaacugaa

SEQ ID NO: 195808 - RNA, 19 nt, Homo sapiens
ccggaaggcuaucagagaa

SEQ ID NO: 195809 - RNA, 19 nt, Homo sapiens
caacaaacggguauaucga

SEQ ID NO: 195810 - RNA, 19 nt, Homo sapiens
gaugacuauuuccauaaug

SEQ ID NO: 195811 - RNA, 19 nt, Homo sapiens
ggaagaagaaaucgaaagg

SEQ ID NO: 195812 - RNA, 19 nt, Homo sapiens
ccagaaauguugccccuaa

SEQ ID NO: 195813 - RNA, 19 nt, Homo sapiens
gcaaaguccuggcaaucac

SEQ ID NO: 195814 - RNA, 19 nt, Homo sapiens
ggauugagccacguccuuu

SEQ ID NO: 195815 - RNA, 19 nt, Homo sapiens
caaagaugacuaccucaau

SEQ ID NO: 195816 - RNA, 19 nt, Homo sapiens
ugaagaacuacacagauuu

SEQ ID NO: 195817 - RNA, 19 nt, Homo sapiens
acaacgaaccugucucauu

SEQ ID NO: 195818 - RNA, 19 nt, Homo sapiens
gaaaucgaaaggaucaugu

SEQ ID NO: 195819 - RNA, 19 nt, Homo sapiens
gaacaugucucuccaacaa

SEQ ID NO: 195820 - RNA, 19 nt, Homo sapiens
caacgaaccugucucauuu

SEQ ID NO: 195821 - RNA, 19 nt, Homo sapiens
gcaauuaacuuccuaaauc

SEQ ID NO: 195822 - RNA, 19 nt, Homo sapiens
ccacagaauugccagauaa

SEQ ID NO: 195823 - RNA, 19 nt, Homo sapiens
gaagaacuacacagauuua

SEQ ID NO: 195824 - RNA, 19 nt, Homo sapiens
gcacagugaccauauuuaa

SEQ ID NO: 195825 - RNA, 19 nt, Homo sapiens
cagagcaaguuguuaauuu

SEQ ID NO: 195826 - RNA, 19 nt, Homo sapiens
gggcuaagaugacuauuuc

SEQ ID NO: 195827 - RNA, 19 nt, Homo sapiens
agaaauugcucucugauga

SEQ ID NO: 195828 - RNA, 19 nt, Homo sapiens
gaaagcaauuaacuuccua

SEQ ID NO: 195829 - RNA, 19 nt, Homo sapiens
acaaagagcccauucauug

SEQ ID NO: 195830 - RNA, 19 nt, Homo sapiens
aaacgauacugguacauuu

SEQ ID NO: 195831 - RNA, 19 nt, Homo sapiens
ccucacagcuggaacaauu

SEQ ID NO: 195832 - RNA, 19 nt, Homo sapiens
gaagauggauacgcuguga

SEQ ID NO: 195833 - RNA, 19 nt, Homo sapiens
caggaaagauggugaaugu

SEQ ID NO: 195834 - RNA, 19 nt, Homo sapiens
cgacagaguugaauguaug

SEQ ID NO: 195835 - RNA, 19 nt, Homo sapiens
gccucuaucuguccaauua

SEQ ID NO: 195836 - RNA, 19 nt, Homo sapiens
cuacacagauuuagugaug

SEQ ID NO: 195837 - RNA, 19 nt, Homo sapiens
gaagaaaucgaaaggauca

SEQ ID NO: 195838 - RNA, 19 nt, Homo sapiens
gcaagcagaccacuuaguu

SEQ ID NO: 195839 - RNA, 19 nt, Homo sapiens
gaacaacgaaccugucuca

SEQ ID NO: 195840 - RNA, 19 nt, Homo sapiens
ucacagaugccuucucuaa

SEQ ID NO: 195841 - RNA, 19 nt, Homo sapiens
gcacgcccauguugauuga

SEQ ID NO: 195842 - RNA, 19 nt, Homo sapiens
acagaugccuucucuaaga

SEQ ID NO: 195843 - RNA, 19 nt, Homo sapiens
ccaacuagaucacauucuu

SEQ ID NO: 195844 - RNA, 19 nt, Homo sapiens
gguaggaggugaggauuga

SEQ ID NO: 195845 - RNA, 19 nt, Homo sapiens
ucagcagacucauacauuu

SEQ ID NO: 195846 - RNA, 19 nt, Homo sapiens
ggaagacuaucagagaaga

SEQ ID NO: 195847 - RNA, 19 nt, Homo sapiens
gacauuaggucagccacua

SEQ ID NO: 195848 - RNA, 19 nt, Homo sapiens
gguaguccaugucugauug

SEQ ID NO: 195849 - RNA, 19 nt, Homo sapiens
ccuaagggcagaagaauuu

SEQ ID NO: 195850 - RNA, 19 nt, Homo sapiens
ccagauaucggaagaagaa

SEQ ID NO: 195851 - RNA, 19 nt, Homo sapiens
ggaacuggcugaugucacu

SEQ ID NO: 195852 - RNA, 19 nt, Homo sapiens
ugucuucccucaccguuua

SEQ ID NO: 195853 - RNA, 19 nt, Homo sapiens
ggaaagguucugcaaguug

SEQ ID NO: 195854 - RNA, 19 nt, Homo sapiens
gcaccaccaucauugucua

SEQ ID NO: 195855 - RNA, 19 nt, Homo sapiens
aaagaugacuaccucaaug

SEQ ID NO: 195856 - RNA, 19 nt, Homo sapiens
cagauugccuggaucaaga

SEQ ID NO: 195857 - RNA, 19 nt, Homo sapiens
caauauauaccgcaccuuu

SEQ ID NO: 195858 - RNA, 19 nt, Homo sapiens
gagcaaccauggugauagu

SEQ ID NO: 195859 - RNA, 19 nt, Homo sapiens
gacaggcucuggagggaaa

SEQ ID NO: 195860 - RNA, 19 nt, Homo sapiens
gggaugaaccggaagacua

SEQ ID NO: 195861 - RNA, 19 nt, Homo sapiens
cgagagcccugcagaaucu

SEQ ID NO: 195862 - RNA, 19 nt, Homo sapiens
guuguuaauuuguggagua

SEQ ID NO: 195863 - RNA, 19 nt, Homo sapiens
guucguguguaucuguuua

SEQ ID NO: 195864 - RNA, 19 nt, Homo sapiens
caccaggucugucuuugaa

SEQ ID NO: 195865 - RNA, 19 nt, Homo sapiens
gacacaggcagaacuauuu

SEQ ID NO: 195866 - RNA, 19 nt, Homo sapiens
caagaacugugucaugucu

SEQ ID NO: 195867 - RNA, 19 nt, Homo sapiens
gcaaaguggcuguguguuc

SEQ ID NO: 195868 - RNA, 19 nt, Homo sapiens
ggagacacauaucacagau

SEQ ID NO: 195869 - RNA, 19 nt, Homo sapiens
gggaaagguucugcaaguu

SEQ ID NO: 195870 - RNA, 19 nt, Homo sapiens
guguguaucuguuuauuuc

SEQ ID NO: 195871 - RNA, 19 nt, Homo sapiens
uguauggccuucaacauga

SEQ ID NO: 195872 - RNA, 19 nt, Homo sapiens
ugaauaaacgauacuggua

SEQ ID NO: 195873 - RNA, 19 nt, Homo sapiens
ccgaggaccuggaaccauu

SEQ ID NO: 195874 - RNA, 19 nt, Homo sapiens
gcuacaggcuugcacuaug

SEQ ID NO: 195875 - RNA, 19 nt, Homo sapiens
gaagguaggaguguagcua

SEQ ID NO: 195876 - RNA, 19 nt, Homo sapiens
ccaacaacguaguauugaa

SEQ ID NO: 195877 - RNA, 19 nt, Homo sapiens
uaccugagauucgauauau

SEQ ID NO: 195878 - RNA, 19 nt, Homo sapiens
gauuacacgugccucuuga

SEQ ID NO: 195879 - RNA, 19 nt, Homo sapiens
uaaacaggguaaagugaau

SEQ ID NO: 195880 - RNA, 19 nt, Homo sapiens
acacagauuuagugaugaa

SEQ ID NO: 195881 - RNA, 19 nt, Homo sapiens
ggcaggaguuugaggaaga

SEQ ID NO: 195882 - RNA, 19 nt, Homo sapiens
gcaaacucagguauuauga

SEQ ID NO: 195883 - RNA, 19 nt, Homo sapiens
agagcaaguuguuaauuug

SEQ ID NO: 195884 - RNA, 19 nt, Homo sapiens
uuacacauuugacuuccua

SEQ ID NO: 195885 - RNA, 19 nt, Homo sapiens
gccacagaauugccagaua

SEQ ID NO: 195886 - RNA, 19 nt, Homo sapiens
ucaccaggcuccacacugu

SEQ ID NO: 195887 - RNA, 19 nt, Homo sapiens
aagaagaaaucgaaaggau

SEQ ID NO: 195888 - RNA, 19 nt, Homo sapiens
ggaugaaccggaagacuau

SEQ ID NO: 195889 - RNA, 19 nt, Homo sapiens
gacaaagagcccauucauu

SEQ ID NO: 195890 - RNA, 19 nt, Homo sapiens
gaaggagacacauaucaca

SEQ ID NO: 195891 - RNA, 19 nt, Homo sapiens
gacauggccuggacuccuu

SEQ ID NO: 195892 - RNA, 19 nt, Homo sapiens
gcccacuacugauuuauuc

SEQ ID NO: 195893 - RNA, 19 nt, Homo sapiens
ggugcccacuacugauuua

SEQ ID NO: 195894 - RNA, 19 nt, Homo sapiens
acaguguugucauuguuua

SEQ ID NO: 195895 - RNA, 19 nt, Homo sapiens
gcccuccgaugaagaacua

SEQ ID NO: 195896 - RNA, 19 nt, Homo sapiens
gagcuaauccugcugucuu

SEQ ID NO: 195897 - RNA, 19 nt, Homo sapiens
gcucaaaugccuccagaug

SEQ ID NO: 195898 - RNA, 19 nt, Homo sapiens
gccacuagauguauuugug

SEQ ID NO: 195899 - RNA, 19 nt, Homo sapiens
caacuagaucacauucuuu

SEQ ID NO: 195900 - RNA, 19 nt, Homo sapiens
ggcaaggaaugaccuguuc

SEQ ID NO: 195901 - RNA, 19 nt, Homo sapiens
augaagaacuacacagauu

SEQ ID NO: 195902 - RNA, 19 nt, Homo sapiens
uaucacagaugccuucucu

SEQ ID NO: 195903 - RNA, 19 nt, Homo sapiens
uccauaauguugacaaaga

SEQ ID NO: 195904 - RNA, 19 nt, Homo sapiens
uacagaaugugaagauguu

SEQ ID NO: 195905 - RNA, 19 nt, Homo sapiens
ccagagagaccaagaugga

SEQ ID NO: 195906 - RNA, 19 nt, Homo sapiens
caugaaagcaauuaacuuc

SEQ ID NO: 195907 - RNA, 19 nt, Homo sapiens
gagcaaaguggcugugugu

SEQ ID NO: 195908 - RNA, 19 nt, Homo sapiens
guccaugucugauuguaau

SEQ ID NO: 195909 - RNA, 19 nt, Homo sapiens
guaggucuguggaacugaa

SEQ ID NO: 195910 - RNA, 19 nt, Homo sapiens
gaugacuauuuccauaaug

SEQ ID NO: 195911 - RNA, 19 nt, Homo sapiens
ggaagaagaaaucgaaagg

SEQ ID NO: 195912 - RNA, 19 nt, Homo sapiens
caacaaacggguauaucga

SEQ ID NO: 195913 - RNA, 19 nt, Homo sapiens
ccagaaauguugccccuaa

SEQ ID NO: 195914 - RNA, 19 nt, Homo sapiens
acaacgaaccugucucauu

SEQ ID NO: 195915 - RNA, 19 nt, Homo sapiens
gcaaaguccuggcaaucac

SEQ ID NO: 195916 - RNA, 19 nt, Homo sapiens
ggauugagccacguccuuu

SEQ ID NO: 195917 - RNA, 19 nt, Homo sapiens
caaagaugacuaccucaau

SEQ ID NO: 195918 - RNA, 19 nt, Homo sapiens
ugaagaacuacacagauuu

SEQ ID NO: 195919 - RNA, 19 nt, Homo sapiens
gaacaugucucuccaacaa

SEQ ID NO: 195920 - RNA, 19 nt, Homo sapiens
caacgaaccugucucauuu

SEQ ID NO: 195921 - RNA, 19 nt, Homo sapiens
gcaauuaacuuccuaaauc

SEQ ID NO: 195922 - RNA, 19 nt, Homo sapiens
ccacagaauugccagauaa

SEQ ID NO: 195923 - RNA, 19 nt, Homo sapiens
gaagaacuacacagauuua

SEQ ID NO: 195924 - RNA, 19 nt, Homo sapiens
gcacagugaccauauuuaa

SEQ ID NO: 195925 - RNA, 19 nt, Homo sapiens
cagagcaaguuguuaauuu

SEQ ID NO: 195926 - RNA, 19 nt, Homo sapiens
gggcuaagaugacuauuuc

SEQ ID NO: 195927 - RNA, 19 nt, Homo sapiens
agaaauugcucucugauga

SEQ ID NO: 195928 - RNA, 19 nt, Homo sapiens
gaaagcaauuaacuuccua

SEQ ID NO: 195929 - RNA, 19 nt, Homo sapiens
acaaagagcccauucauug

SEQ ID NO: 195930 - RNA, 19 nt, Homo sapiens
aaacgauacugguacauuu

SEQ ID NO: 195931 - RNA, 19 nt, Homo sapiens
ccucacagcuggaacaauu

SEQ ID NO: 195932 - RNA, 19 nt, Homo sapiens
gaagauggauacgcuguga

SEQ ID NO: 195933 - RNA, 19 nt, Homo sapiens
caggaaagauggugaaugu

SEQ ID NO: 195934 - RNA, 19 nt, Homo sapiens
cgacagaguugaauguaug

SEQ ID NO: 195935 - RNA, 19 nt, Homo sapiens
gccucuaucuguccaauua

SEQ ID NO: 195936 - RNA, 19 nt, Homo sapiens
cuacacagauuuagugaug

SEQ ID NO: 195937 - RNA, 19 nt, Homo sapiens
gaagaaaucgaaaggauca

SEQ ID NO: 195938 - RNA, 19 nt, Homo sapiens
gcaagcagaccacuuaguu

SEQ ID NO: 195939 - RNA, 19 nt, Homo sapiens
gaacaacgaaccugucuca

SEQ ID NO: 195940 - RNA, 19 nt, Homo sapiens
ucacagaugccuucucuaa

SEQ ID NO: 195941 - RNA, 19 nt, Homo sapiens
gcacgcccauguugauuga

SEQ ID NO: 195942 - RNA, 19 nt, Homo sapiens
acagaugccuucucuaaga

SEQ ID NO: 195943 - RNA, 19 nt, Homo sapiens
ccaacuagaucacauucuu

SEQ ID NO: 195944 - RNA, 19 nt, Homo sapiens
gguaggaggugaggauuga

SEQ ID NO: 195945 - RNA, 19 nt, Homo sapiens
ucagcagacucauacauuu

SEQ ID NO: 195946 - RNA, 19 nt, Homo sapiens
gacauuaggucagccacua

SEQ ID NO: 195947 - RNA, 19 nt, Homo sapiens
gguaguccaugucugauug

SEQ ID NO: 195948 - RNA, 19 nt, Homo sapiens
ccuaagggcagaagaauuu

SEQ ID NO: 195949 - RNA, 19 nt, Homo sapiens
ccagauaucggaagaagaa

SEQ ID NO: 195950 - RNA, 19 nt, Homo sapiens
ggaacuggcugaugucacu

SEQ ID NO: 195951 - RNA, 19 nt, Homo sapiens
ugucuucccucaccguuua

SEQ ID NO: 195952 - RNA, 19 nt, Homo sapiens
ggaaagguucugcaaguug

SEQ ID NO: 195953 - RNA, 19 nt, Homo sapiens
gcaccaccaucauugucua

SEQ ID NO: 195954 - RNA, 19 nt, Homo sapiens
aaagaugacuaccucaaug

SEQ ID NO: 195955 - RNA, 19 nt, Homo sapiens
cagauugccuggaucaaga

SEQ ID NO: 195956 - RNA, 19 nt, Homo sapiens
caauauauaccgcaccuuu

SEQ ID NO: 195957 - RNA, 19 nt, Homo sapiens
gagcaaccauggugauagu

SEQ ID NO: 195958 - RNA, 19 nt, Homo sapiens
ggaaggcuaucagagaaga

SEQ ID NO: 195959 - RNA, 19 nt, Homo sapiens
gacaggcucuggagggaaa

SEQ ID NO: 195960 - RNA, 19 nt, Homo sapiens
cgagagcccugcagaaucu

SEQ ID NO: 195961 - RNA, 19 nt, Homo sapiens
guuguuaauuuguggagua

SEQ ID NO: 195962 - RNA, 19 nt, Homo sapiens
guucguguguaucuguuua

SEQ ID NO: 195963 - RNA, 19 nt, Homo sapiens
caccaggucugucuuugaa

SEQ ID NO: 195964 - RNA, 19 nt, Homo sapiens
gacacaggcagaacuauuu

SEQ ID NO: 195965 - RNA, 19 nt, Homo sapiens
caagaacugugucaugucu

SEQ ID NO: 195966 - RNA, 19 nt, Homo sapiens
gcaaaguggcuguguguuc

SEQ ID NO: 195967 - RNA, 19 nt, Homo sapiens
ggagacacauaucacagau

SEQ ID NO: 195968 - RNA, 19 nt, Homo sapiens
gggaaagguucugcaaguu

SEQ ID NO: 195969 - RNA, 19 nt, Homo sapiens
guguguaucuguuuauuuc

SEQ ID NO: 195970 - RNA, 19 nt, Homo sapiens
uguauggccuucaacauga

SEQ ID NO: 195971 - RNA, 19 nt, Homo sapiens
ugaauaaacgauacuggua

SEQ ID NO: 195972 - RNA, 19 nt, Homo sapiens
ccgaggaccuggaaccauu

SEQ ID NO: 195973 - RNA, 19 nt, Homo sapiens
gcuacaggcuugcacuaug

SEQ ID NO: 195974 - RNA, 19 nt, Homo sapiens
gaagguaggaguguagcua

SEQ ID NO: 195975 - RNA, 19 nt, Homo sapiens
ccaacaacguaguauugaa

SEQ ID NO: 195976 - RNA, 19 nt, Homo sapiens
uaccugagauucgauauau

SEQ ID NO: 195977 - RNA, 19 nt, Homo sapiens
gauuacacgugccucuuga

SEQ ID NO: 195978 - RNA, 19 nt, Homo sapiens
uaaacaggguaaagugaau

SEQ ID NO: 195979 - RNA, 19 nt, Homo sapiens
acacagauuuagugaugaa

SEQ ID NO: 195980 - RNA, 19 nt, Homo sapiens
ggcaggaguuugaggaaga

SEQ ID NO: 195981 - RNA, 19 nt, Homo sapiens
gcaaacucagguauuauga

SEQ ID NO: 195982 - RNA, 19 nt, Homo sapiens
agagcaaguuguuaauuug

SEQ ID NO: 195983 - RNA, 19 nt, Homo sapiens
uuacacauuugacuuccua

SEQ ID NO: 195984 - RNA, 19 nt, Homo sapiens
gccacagaauugccagaua

SEQ ID NO: 195985 - RNA, 19 nt, Homo sapiens
ucaccaggcuccacacugu

SEQ ID NO: 195986 - RNA, 19 nt, Homo sapiens
aagaagaaaucgaaaggau

SEQ ID NO: 195987 - RNA, 19 nt, Homo sapiens
gacaaagagcccauucauu

SEQ ID NO: 195988 - RNA, 19 nt, Homo sapiens
gaaggagacacauaucaca

SEQ ID NO: 195989 - RNA, 19 nt, Homo sapiens
gacauggccuggacuccuu

SEQ ID NO: 195990 - RNA, 19 nt, Homo sapiens
gcccacuacugauuuauuc

SEQ ID NO: 195991 - RNA, 19 nt, Homo sapiens
ggugcccacuacugauuua

SEQ ID NO: 195992 - RNA, 19 nt, Homo sapiens
acaguguugucauuguuua

SEQ ID NO: 195993 - RNA, 19 nt, Homo sapiens
gcccuccgaugaagaacua

SEQ ID NO: 195994 - RNA, 19 nt, Homo sapiens
gagcuaauccugcugucuu

SEQ ID NO: 195995 - RNA, 19 nt, Homo sapiens
gcucaaaugccuccagaug

SEQ ID NO: 195996 - RNA, 19 nt, Homo sapiens
gccacuagauguauuugug

SEQ ID NO: 195997 - RNA, 19 nt, Homo sapiens
caacuagaucacauucuuu

SEQ ID NO: 195998 - RNA, 19 nt, Homo sapiens
ggcaaggaaugaccuguuc

SEQ ID NO: 195999 - RNA, 19 nt, Homo sapiens
augaagaacuacacagauu

SEQ ID NO: 196000 - RNA, 19 nt, Homo sapiens
uaucacagaugccuucucu

SEQ ID NO: 196001 - RNA, 19 nt, Homo sapiens
uccauaauguugacaaaga

SEQ ID NO: 196002 - RNA, 19 nt, Homo sapiens
uacagaaugugaagauguu

SEQ ID NO: 196003 - RNA, 19 nt, Homo sapiens
ccagagagaccaagaugga

SEQ ID NO: 196004 - RNA, 19 nt, Homo sapiens
caugaaagcaauuaacuuc

SEQ ID NO: 196005 - RNA, 19 nt, Homo sapiens
gagcaaaguggcugugugu

SEQ ID NO: 196006 - RNA, 19 nt, Homo sapiens
guccaugucugauuguaau

SEQ ID NO: 196007 - RNA, 19 nt, Homo sapiens
guaggucuguggaacugaa

SEQ ID NO: 196008 - RNA, 19 nt, Homo sapiens
ccggaaggcuaucagagaa

SEQ ID NO: 196009 - RNA, 19 nt, Homo sapiens
caacaaacggguauaucga

SEQ ID NO: 196010 - RNA, 19 nt, Homo sapiens
gaugacuauuuccauaaug

SEQ ID NO: 196011 - RNA, 19 nt, Homo sapiens
ggaagaagaaaucgaaagg

SEQ ID NO: 196012 - RNA, 19 nt, Homo sapiens
ccagaaauguugccccuaa

SEQ ID NO: 196013 - RNA, 19 nt, Homo sapiens
gcaaaguccuggcaaucac

SEQ ID NO: 196014 - RNA, 19 nt, Homo sapiens
ggauugagccacguccuuu

SEQ ID NO: 196015 - RNA, 19 nt, Homo sapiens
caaagaugacuaccucaau

SEQ ID NO: 196016 - RNA, 19 nt, Homo sapiens
ugaagaacuacacagauuu

SEQ ID NO: 196017 - RNA, 19 nt, Homo sapiens
acaacgaaccugucucauu

SEQ ID NO: 196018 - RNA, 19 nt, Homo sapiens
gaaaucgaaaggaucaugu

SEQ ID NO: 196019 - RNA, 19 nt, Homo sapiens
ggaagaggccgaugcauaa

SEQ ID NO: 196020 - RNA, 19 nt, Homo sapiens
cagagaagcugcaugguuu

SEQ ID NO: 196021 - RNA, 19 nt, Homo sapiens
gaaaggugauagcauuaaa

SEQ ID NO: 196022 - RNA, 19 nt, Homo sapiens
ggaaguacuugauaaaucu

SEQ ID NO: 196023 - RNA, 19 nt, Homo sapiens
ucaggaagcucaaguuguu

SEQ ID NO: 196024 - RNA, 19 nt, Homo sapiens
cuagaaaggugauagcauu

SEQ ID NO: 196025 - RNA, 19 nt, Homo sapiens
gagcacaguuagcuagaaa

SEQ ID NO: 196026 - RNA, 19 nt, Homo sapiens
gguaugaggucguuaaugg

SEQ ID NO: 196027 - RNA, 19 nt, Homo sapiens
gggaagaggccgaugcaua

SEQ ID NO: 196028 - RNA, 19 nt, Homo sapiens
ugaaggaucucuaugcaau

SEQ ID NO: 196029 - RNA, 19 nt, Homo sapiens
cuaaucaccuucuccguuu

SEQ ID NO: 196030 - RNA, 19 nt, Homo sapiens
gaauaaacuuacagcaaca

SEQ ID NO: 196031 - RNA, 19 nt, Homo sapiens
gauauuaauugcaccaaag

SEQ ID NO: 196032 - RNA, 19 nt, Homo sapiens
cuauuuagcugcagugaug

SEQ ID NO: 196033 - RNA, 19 nt, Homo sapiens
caagagacgcaaauauauu

SEQ ID NO: 196034 - RNA, 19 nt, Homo sapiens
gauccuaacagugaaauuu

SEQ ID NO: 196035 - RNA, 19 nt, Homo sapiens
ucugauaaaugcaaacuga

SEQ ID NO: 196036 - RNA, 19 nt, Homo sapiens
gggcuugauuuaacauuga

SEQ ID NO: 196037 - RNA, 19 nt, Homo sapiens
aaaccaaccuagaaauugu

SEQ ID NO: 196038 - RNA, 19 nt, Homo sapiens
gcaaggcauuguggaaaga

SEQ ID NO: 196039 - RNA, 19 nt, Homo sapiens
gauuggagagugugguuua

SEQ ID NO: 196040 - RNA, 19 nt, Homo sapiens
gagaauccuaguagugaua

SEQ ID NO: 196041 - RNA, 19 nt, Homo sapiens
uuucggagcuggugacuug

SEQ ID NO: 196042 - RNA, 19 nt, Homo sapiens
gggcaucgcuuccuguuuu

SEQ ID NO: 196043 - RNA, 19 nt, Homo sapiens
uuucuuaucccaccaaaua

SEQ ID NO: 196044 - RNA, 19 nt, Homo sapiens
gguaugaaguccucuuugg

SEQ ID NO: 196045 - RNA, 19 nt, Homo sapiens
guggacaccugacgacuau

SEQ ID NO: 196046 - RNA, 19 nt, Homo sapiens
uaaaugugcugcucuucau

SEQ ID NO: 196047 - RNA, 19 nt, Homo sapiens
uaaagaagaggcggaguuu

SEQ ID NO: 196048 - RNA, 19 nt, Homo sapiens
ucaagagacgcaaauauau

SEQ ID NO: 196049 - RNA, 19 nt, Homo sapiens
gauaaaucuuugugguaug

SEQ ID NO: 196050 - RNA, 19 nt, Homo sapiens
aaacuggaaguacuugaua

SEQ ID NO: 196051 - RNA, 19 nt, Homo sapiens
ucacaagauugaaaugcuu

SEQ ID NO: 196052 - RNA, 19 nt, Homo sapiens
guaaagaagaggcggaguu

SEQ ID NO: 196053 - RNA, 19 nt, Homo sapiens
ggacaccugacgacuauau

SEQ ID NO: 196054 - RNA, 19 nt, Homo sapiens
auauaaacaugaccaguga

SEQ ID NO: 196055 - RNA, 19 nt, Homo sapiens
gggagaauccuaguaguga

SEQ ID NO: 196056 - RNA, 19 nt, Homo sapiens
gugcugcucuucauuucaa

SEQ ID NO: 196057 - RNA, 19 nt, Homo sapiens
ucuauaugccucagaauuu

SEQ ID NO: 196058 - RNA, 19 nt, Homo sapiens
ugacgacuauauaaacaug

SEQ ID NO: 196059 - RNA, 19 nt, Homo sapiens
guuaauagugggaggagua

SEQ ID NO: 196060 - RNA, 19 nt, Homo sapiens
gaugagcauuugagacaca

SEQ ID NO: 196061 - RNA, 19 nt, Homo sapiens
ugacuguucuucuuucauc

SEQ ID NO: 196062 - RNA, 19 nt, Homo sapiens
uggaaguacuugauaaauc

SEQ ID NO: 196063 - RNA, 19 nt, Homo sapiens
ggagaauccuaguagugau

SEQ ID NO: 196064 - RNA, 19 nt, Homo sapiens
gaagaggccgaugcauaaa

SEQ ID NO: 196065 - RNA, 19 nt, Homo sapiens
gguaaagcuugagauccua

SEQ ID NO: 196066 - RNA, 19 nt, Homo sapiens
gaagcgguaugaggucguu

SEQ ID NO: 196067 - RNA, 19 nt, Homo sapiens
uagaaaggugauagcauua

SEQ ID NO: 196068 - RNA, 19 nt, Homo sapiens
gaagaaggauacacaaaac

SEQ ID NO: 196069 - RNA, 19 nt, Homo sapiens
caugaaggaucucuaugca

SEQ ID NO: 196070 - RNA, 19 nt, Homo sapiens
gaggcggaguuuccaauag

SEQ ID NO: 196071 - RNA, 19 nt, Homo sapiens
caccaaauacuacuuuaug

SEQ ID NO: 196072 - RNA, 19 nt, Homo sapiens
gcauaaagucagccuguuc

SEQ ID NO: 196073 - RNA, 19 nt, Homo sapiens
gcaguugccagguuuguca

SEQ ID NO: 196074 - RNA, 19 nt, Homo sapiens
acacauacagcccugauga

SEQ ID NO: 196075 - RNA, 19 nt, Homo sapiens
ccaucuauaugccucagaa

SEQ ID NO: 196076 - RNA, 19 nt, Homo sapiens
gagacgcaaauauauugua

SEQ ID NO: 196077 - RNA, 19 nt, Homo sapiens
gauaaaugcaaacugacaa

SEQ ID NO: 196078 - RNA, 19 nt, Homo sapiens
caauaaguuugacguggau

SEQ ID NO: 196079 - RNA, 19 nt, Homo sapiens
ggagugggcacaagacaca

SEQ ID NO: 196080 - RNA, 19 nt, Homo sapiens
caucaagagacgcaaauau

SEQ ID NO: 196081 - RNA, 19 nt, Homo sapiens
ggacuuagcaaaaugagaa

SEQ ID NO: 196082 - RNA, 19 nt, Homo sapiens
ucagagaagcugcaugguu

SEQ ID NO: 196083 - RNA, 19 nt, Homo sapiens
aaggaucucuaugcaauga

SEQ ID NO: 196084 - RNA, 19 nt, Homo sapiens
gcugagggccaucuauaug

SEQ ID NO: 196085 - RNA, 19 nt, Homo sapiens
cuugagauccuaacaguga

SEQ ID NO: 196086 - RNA, 19 nt, Homo sapiens
gagcagguagcaaggcauu

SEQ ID NO: 196087 - RNA, 19 nt, Homo sapiens
ccacuuguuugccaauaag

SEQ ID NO: 196088 - RNA, 19 nt, Homo sapiens
cauacagcccugaugagua

SEQ ID NO: 196089 - RNA, 19 nt, Homo sapiens
agacgcaaauauauuguag

SEQ ID NO: 196090 - RNA, 19 nt, Homo sapiens
cuaauacuguacuguguag

SEQ ID NO: 196091 - RNA, 19 nt, Homo sapiens
gugauucagacuuuccuua

SEQ ID NO: 196092 - RNA, 19 nt, Homo sapiens
acagggugauguaaaugaa

SEQ ID NO: 196093 - RNA, 19 nt, Homo sapiens
gaugugaccugugccaaaa

SEQ ID NO: 196094 - RNA, 19 nt, Homo sapiens
gggaagaugguaugaaguc

SEQ ID NO: 196095 - RNA, 19 nt, Homo sapiens
caagaagaaggauacacaa

SEQ ID NO: 196096 - RNA, 19 nt, Homo sapiens
cuauaugccucagaauuuc

SEQ ID NO: 196097 - RNA, 19 nt, Homo sapiens
cauauucuauagugguuca

SEQ ID NO: 196098 - RNA, 19 nt, Homo sapiens
aagagacgcaaauauauug

SEQ ID NO: 196099 - RNA, 19 nt, Homo sapiens
aucaagagacgcaaauaua

SEQ ID NO: 196100 - RNA, 19 nt, Homo sapiens
caccuggaaucagcacuaa

SEQ ID NO: 196101 - RNA, 19 nt, Homo sapiens
aagcucaaguuguuaaugg

SEQ ID NO: 196102 - RNA, 19 nt, Homo sapiens
ggaucucuaugcaaugagu

SEQ ID NO: 196103 - RNA, 19 nt, Homo sapiens
guaaagcuugagauccuaa

SEQ ID NO: 196104 - RNA, 19 nt, Homo sapiens
aaugcaaacugacaaccuu

SEQ ID NO: 196105 - RNA, 19 nt, Homo sapiens
uagaucuucuugucagaga

SEQ ID NO: 196106 - RNA, 19 nt, Homo sapiens
uauagugguucaucacaag

SEQ ID NO: 196107 - RNA, 19 nt, Homo sapiens
gcagguagcaaggcauugu

SEQ ID NO: 196108 - RNA, 19 nt, Homo sapiens
gaaggaucucuaugcaaug

SEQ ID NO: 196109 - RNA, 19 nt, Homo sapiens
guagcaaggcauuguggaa

SEQ ID NO: 196110 - RNA, 19 nt, Homo sapiens
gaacaagaagaaggauaca

SEQ ID NO: 196111 - RNA, 19 nt, Homo sapiens
gcaaacugacaaccuucaa

SEQ ID NO: 196112 - RNA, 19 nt, Homo sapiens
gguggaagaagcgguauga

SEQ ID NO: 196113 - RNA, 19 nt, Homo sapiens
gccaucccauaaagaagaa

SEQ ID NO: 196114 - RNA, 19 nt, Homo sapiens
ggaguuuccaauagcauau

SEQ ID NO: 196115 - RNA, 19 nt, Homo sapiens
gaagaggcggaguuuccaa

SEQ ID NO: 196116 - RNA, 19 nt, Homo sapiens
ccugacgacuauauaaaca

SEQ ID NO: 196117 - RNA, 19 nt, Homo sapiens
acaccugacgacuauauaa

SEQ ID NO: 196118 - RNA, 19 nt, Homo sapiens
gaauccuaguagugauauu

SEQ ID NO: 196119 - RNA, 19 nt, Homo sapiens
ggacaaaguucuguauaua

SEQ ID NO: 196120 - RNA, 19 nt, Homo sapiens
gaauacaucuuguuucuga

SEQ ID NO: 196121 - RNA, 19 nt, Homo sapiens
ucacauagaucuagucuga

SEQ ID NO: 196122 - RNA, 19 nt, Homo sapiens
uaaaguggcugguuaauuc

SEQ ID NO: 196123 - RNA, 19 nt, Homo sapiens
gguaaaguguuaaggaaua

SEQ ID NO: 196124 - RNA, 19 nt, Homo sapiens
ggaccuggcuacguaauua

SEQ ID NO: 196125 - RNA, 19 nt, Homo sapiens
uaaaugaccucagaucuuu

SEQ ID NO: 196126 - RNA, 19 nt, Homo sapiens
gaaagaacccucaaucaga

SEQ ID NO: 196127 - RNA, 19 nt, Homo sapiens
gagagaaggugaaauaaag

SEQ ID NO: 196128 - RNA, 19 nt, Homo sapiens
cccauaaucucacaauuua

SEQ ID NO: 196129 - RNA, 19 nt, Homo sapiens
ggagaucaguaauuacaaa

SEQ ID NO: 196130 - RNA, 19 nt, Homo sapiens
ggucauccaucaucacuuu

SEQ ID NO: 196131 - RNA, 19 nt, Homo sapiens
gaaacaggauaugcuuuaa

SEQ ID NO: 196132 - RNA, 19 nt, Homo sapiens
caagagaggugcuaucaca

SEQ ID NO: 196133 - RNA, 19 nt, Homo sapiens
ggucagcaguggaguuuaa

SEQ ID NO: 196134 - RNA, 19 nt, Homo sapiens
caacaucucuugagugucu

SEQ ID NO: 196135 - RNA, 19 nt, Homo sapiens
uaacugugcuuguugaaug

SEQ ID NO: 196136 - RNA, 19 nt, Homo sapiens
gugaggcccuuauauaauu

SEQ ID NO: 196137 - RNA, 19 nt, Homo sapiens
gaugcucaccucuauauua

SEQ ID NO: 196138 - RNA, 19 nt, Homo sapiens
gcuaacaaguuugagcuua

SEQ ID NO: 196139 - RNA, 19 nt, Homo sapiens
ggacauguacugagacaaa

SEQ ID NO: 196140 - RNA, 19 nt, Homo sapiens
cuaaauauguccaccaaga

SEQ ID NO: 196141 - RNA, 19 nt, Homo sapiens
gggaggaccuguuguguuc

SEQ ID NO: 196142 - RNA, 19 nt, Homo sapiens
uuaagagccuucaauugua

SEQ ID NO: 196143 - RNA, 19 nt, Homo sapiens
gaacugaggcaucgcgaaa

SEQ ID NO: 196144 - RNA, 19 nt, Homo sapiens
ggaaauaguucaguaucug

SEQ ID NO: 196145 - RNA, 19 nt, Homo sapiens
ucgaugagguuccauguuu

SEQ ID NO: 196146 - RNA, 19 nt, Homo sapiens
cccaggagaucaguaauua

SEQ ID NO: 196147 - RNA, 19 nt, Homo sapiens
acagagugauuguaguuua

SEQ ID NO: 196148 - RNA, 19 nt, Homo sapiens
uauaacaccuuaacaguca

SEQ ID NO: 196149 - RNA, 19 nt, Homo sapiens
gcaauuggacggacuaaau

SEQ ID NO: 196150 - RNA, 19 nt, Homo sapiens
aaagagauaugggaaacua

SEQ ID NO: 196151 - RNA, 19 nt, Homo sapiens
gaauggagaauacaucuug

SEQ ID NO: 196152 - RNA, 19 nt, Homo sapiens
uaugucaugucuuccauua

SEQ ID NO: 196153 - RNA, 19 nt, Homo sapiens
gcucaccucuauauuaguu

SEQ ID NO: 196154 - RNA, 19 nt, Homo sapiens
cugaaaggauuuaaaggua

SEQ ID NO: 196155 - RNA, 19 nt, Homo sapiens
caccaagccuguuugcuaa

SEQ ID NO: 196156 - RNA, 19 nt, Homo sapiens
acaaggaaauaguucagua

SEQ ID NO: 196157 - RNA, 19 nt, Homo sapiens
ccacuaaggugaccagagu

SEQ ID NO: 196158 - RNA, 19 nt, Homo sapiens
acacuuuccucuucuauga

SEQ ID NO: 196159 - RNA, 19 nt, Homo sapiens
caaaauaucuacuguguuc

SEQ ID NO: 196160 - RNA, 19 nt, Homo sapiens
caaaauaggugaggggaua

SEQ ID NO: 196161 - RNA, 19 nt, Homo sapiens
cuaacaaguuugagcuuaa

SEQ ID NO: 196162 - RNA, 19 nt, Homo sapiens
ggaaaccucagagcuauaa

SEQ ID NO: 196163 - RNA, 19 nt, Homo sapiens
ggagaaaggaggagacaga

SEQ ID NO: 196164 - RNA, 19 nt, Homo sapiens
gauaguaguggcucgauuu

SEQ ID NO: 196165 - RNA, 19 nt, Homo sapiens
gaauuagguuucuuugaag

SEQ ID NO: 196166 - RNA, 19 nt, Homo sapiens
ggaaguacguuaucaacac

SEQ ID NO: 196167 - RNA, 19 nt, Homo sapiens
cagagugauuguaguuuaa

SEQ ID NO: 196168 - RNA, 19 nt, Homo sapiens
ggauaugcuuuaagacaga

SEQ ID NO: 196169 - RNA, 19 nt, Homo sapiens
caauuggacggacuaaaua

SEQ ID NO: 196170 - RNA, 19 nt, Homo sapiens
uaaggaagaagcugacuuu

SEQ ID NO: 196171 - RNA, 19 nt, Homo sapiens
agaaacaggauaugcuuua

SEQ ID NO: 196172 - RNA, 19 nt, Homo sapiens
gcuauaaaguggagugaca

SEQ ID NO: 196173 - RNA, 19 nt, Homo sapiens
gauggaacccguugucuau

SEQ ID NO: 196174 - RNA, 19 nt, Homo sapiens
ggucaucucuccugugucu

SEQ ID NO: 196175 - RNA, 19 nt, Homo sapiens
cguuaccucuucauaauuu

SEQ ID NO: 196176 - RNA, 19 nt, Homo sapiens
ggaaugcccugaaacuacu

SEQ ID NO: 196177 - RNA, 19 nt, Homo sapiens
ccagacagauagugaaaca

SEQ ID NO: 196178 - RNA, 19 nt, Homo sapiens
gagcuuuccuaugugauaa

SEQ ID NO: 196179 - RNA, 19 nt, Homo sapiens
ugccagagcucaucacuuc

SEQ ID NO: 196180 - RNA, 19 nt, Homo sapiens
aaacauaagcuaccugaau

SEQ ID NO: 196181 - RNA, 19 nt, Homo sapiens
ugagguggauuuacugaga

SEQ ID NO: 196182 - RNA, 19 nt, Homo sapiens
ucaccaagccuguuugcua

SEQ ID NO: 196183 - RNA, 19 nt, Homo sapiens
aaagagaguuaccggaguu

SEQ ID NO: 196184 - RNA, 19 nt, Homo sapiens
agaauggucucaguguuaa

SEQ ID NO: 196185 - RNA, 19 nt, Homo sapiens
uaagaauggucucaguguu

SEQ ID NO: 196186 - RNA, 19 nt, Homo sapiens
ugaaacagcacguuggaaa

SEQ ID NO: 196187 - RNA, 19 nt, Homo sapiens
gauaauacugucuaggaaa

SEQ ID NO: 196188 - RNA, 19 nt, Homo sapiens
gagugaaacugcgauacaa

SEQ ID NO: 196189 - RNA, 19 nt, Homo sapiens
gacggucucuugacauuuc

SEQ ID NO: 196190 - RNA, 19 nt, Homo sapiens
aagaauggucucaguguua

SEQ ID NO: 196191 - RNA, 19 nt, Homo sapiens
ggaagagcauaguguuugg

SEQ ID NO: 196192 - RNA, 19 nt, Homo sapiens
gugguaaaguguuaaggaa

SEQ ID NO: 196193 - RNA, 19 nt, Homo sapiens
ugaggcccuuauauaauua

SEQ ID NO: 196194 - RNA, 19 nt, Homo sapiens
caacagagagggagaaagg

SEQ ID NO: 196195 - RNA, 19 nt, Homo sapiens
ggagaaucuuacagaguga

SEQ ID NO: 196196 - RNA, 19 nt, Homo sapiens
uaagagccuucaauuguag

SEQ ID NO: 196197 - RNA, 19 nt, Homo sapiens
ggaugaggcuuucuuuuau

SEQ ID NO: 196198 - RNA, 19 nt, Homo sapiens
cuauguggcucuaucaaga

SEQ ID NO: 196199 - RNA, 19 nt, Homo sapiens
gacuaaauauguccaccaa

SEQ ID NO: 196200 - RNA, 19 nt, Homo sapiens
ggaucuggcuguaauaucg

SEQ ID NO: 196201 - RNA, 19 nt, Homo sapiens
uaacugaggcuuagaaagg

SEQ ID NO: 196202 - RNA, 19 nt, Homo sapiens
aguuugagcuuaauaccua

SEQ ID NO: 196203 - RNA, 19 nt, Homo sapiens
ggaguauguugcaaaauaa

SEQ ID NO: 196204 - RNA, 19 nt, Homo sapiens
ggaugaaacggaaucgauu

SEQ ID NO: 196205 - RNA, 19 nt, Homo sapiens
ggaaaugaaagaaagagau

SEQ ID NO: 196206 - RNA, 19 nt, Homo sapiens
gaaacuacuguaucugaug

SEQ ID NO: 196207 - RNA, 19 nt, Homo sapiens
ugaaguaacugaggcuuag

SEQ ID NO: 196208 - RNA, 19 nt, Homo sapiens
aacaggauaugcuuuaaga

SEQ ID NO: 196209 - RNA, 19 nt, Homo sapiens
uggacaaaguucuguauau

SEQ ID NO: 196210 - RNA, 19 nt, Homo sapiens
aacauaagcuaccugaaug

SEQ ID NO: 196211 - RNA, 19 nt, Homo sapiens
caauggagcugggauggau

SEQ ID NO: 196212 - RNA, 19 nt, Homo sapiens
gacuuucccuuggcauaua

SEQ ID NO: 196213 - RNA, 19 nt, Homo sapiens
caaggcagguagaucacuu

SEQ ID NO: 196214 - RNA, 19 nt, Homo sapiens
ccuguaaucccaacacuuu

SEQ ID NO: 196215 - RNA, 19 nt, Homo sapiens
uaagggaaguuuagaugag

SEQ ID NO: 196216 - RNA, 19 nt, Homo sapiens
ccguugaguuucuaaauau

SEQ ID NO: 196217 - RNA, 19 nt, Homo sapiens
gagauaugcauucaagaga

SEQ ID NO: 196218 - RNA, 19 nt, Homo sapiens
acucaugacugaagggaaa

SEQ ID NO: 196219 - RNA, 19 nt, Homo sapiens
aaacggaggucucaucugu

SEQ ID NO: 196220 - RNA, 19 nt, Homo sapiens
ggugcagucuuacaugauu

SEQ ID NO: 196221 - RNA, 19 nt, Homo sapiens
uggcaaagcagcagaaaga

SEQ ID NO: 196222 - RNA, 19 nt, Homo sapiens
gacgauggcucugaacucu

SEQ ID NO: 196223 - RNA, 19 nt, Homo sapiens
ugaacuggauccuggugaa

SEQ ID NO: 196224 - RNA, 19 nt, Homo sapiens
cccguuaucuaugucuuua

SEQ ID NO: 196225 - RNA, 19 nt, Homo sapiens
gcaaagcagcagaaagagu

SEQ ID NO: 196226 - RNA, 19 nt, Homo sapiens
ucacaggucucuggucucu

SEQ ID NO: 196227 - RNA, 19 nt, Homo sapiens
gcaagcccuuuggcaaugu

SEQ ID NO: 196228 - RNA, 19 nt, Homo sapiens
cguuaucuaugucuuuaug

SEQ ID NO: 196229 - RNA, 19 nt, Homo sapiens
gguugacgauggcucugaa

SEQ ID NO: 196230 - RNA, 19 nt, Homo sapiens
ccagaaggcagagaaggaa

SEQ ID NO: 196231 - RNA, 19 nt, Homo sapiens
gcauugccuucuccuggau

SEQ ID NO: 196232 - RNA, 19 nt, Homo sapiens
acggaggucucaucugugu

SEQ ID NO: 196233 - RNA, 19 nt, Homo sapiens
gugcagucuuacaugauug

SEQ ID NO: 196234 - RNA, 19 nt, Homo sapiens
gcucugcuaccuccaagug

SEQ ID NO: 196235 - RNA, 19 nt, Homo sapiens
gugcugggccacccuaugu

SEQ ID NO: 196236 - RNA, 19 nt, Homo sapiens
gaaggcagagaaggaagug

SEQ ID NO: 196237 - RNA, 19 nt, Homo sapiens
ggcaaugugagauuugaug

SEQ ID NO: 196238 - RNA, 19 nt, Homo sapiens
uguaccaccucaccagugu

SEQ ID NO: 196239 - RNA, 19 nt, Homo sapiens
ucaccuacaccaacagcaa

SEQ ID NO: 196240 - RNA, 19 nt, Homo sapiens
gccacccgcugaacuggau

SEQ ID NO: 196241 - RNA, 19 nt, Homo sapiens
ugcaagcccuuuggcaaug

SEQ ID NO: 196242 - RNA, 19 nt, Homo sapiens
ugaaccggcaguuucgaaa

SEQ ID NO: 196243 - RNA, 19 nt, Homo sapiens
ccacccagaaggcagagaa

SEQ ID NO: 196244 - RNA, 19 nt, Homo sapiens
gugucuggaugaucuuugu

SEQ ID NO: 196245 - RNA, 19 nt, Homo sapiens
cuacaaccccguuaucuau

SEQ ID NO: 196246 - RNA, 19 nt, Homo sapiens
gccauccgcaggacagcua

SEQ ID NO: 196247 - RNA, 19 nt, Homo sapiens
ggggugcagucuuacauga

SEQ ID NO: 196248 - RNA, 19 nt, Homo sapiens
gaagaugguuggcugauca

SEQ ID NO: 196249 - RNA, 19 nt, Homo sapiens
uaacuugcauguauccaua

SEQ ID NO: 196250 - RNA, 19 nt, Homo sapiens
uagaugaacuuaugaguga

SEQ ID NO: 196251 - RNA, 19 nt, Homo sapiens
gggaugaaauacuuaauga

SEQ ID NO: 196252 - RNA, 19 nt, Homo sapiens
uaaugaagcucuugcagaa

SEQ ID NO: 196253 - RNA, 19 nt, Homo sapiens
gauagaagacuuagaauag

SEQ ID NO: 196254 - RNA, 19 nt, Homo sapiens
uaacacugcuaaugaaaga

SEQ ID NO: 196255 - RNA, 19 nt, Homo sapiens
ggauagaagacuuagaaua

SEQ ID NO: 196256 - RNA, 19 nt, Homo sapiens
ggagaaguaacugaaauua

SEQ ID NO: 196257 - RNA, 19 nt, Homo sapiens
ugaagaagcauaugagaaa

SEQ ID NO: 196258 - RNA, 19 nt, Homo sapiens
ugaacucuauucuccuuua

SEQ ID NO: 196259 - RNA, 19 nt, Homo sapiens
guugggagauguuguuuau

SEQ ID NO: 196260 - RNA, 19 nt, Homo sapiens
gaagaagcauaugagaaau

SEQ ID NO: 196261 - RNA, 19 nt, Homo sapiens
ugggagauguuguuuauug

SEQ ID NO: 196262 - RNA, 19 nt, Homo sapiens
gaacucuauucuccuuuau

SEQ ID NO: 196263 - RNA, 19 nt, Homo sapiens
ggacaaaauugaacaaaca

SEQ ID NO: 196264 - RNA, 19 nt, Homo sapiens
gugcguaaauucacagaga

SEQ ID NO: 196265 - RNA, 19 nt, Homo sapiens
gagauguuguuuauuguag

SEQ ID NO: 196266 - RNA, 19 nt, Homo sapiens
ggagauguuguuuauugua

SEQ ID NO: 196267 - RNA, 19 nt, Homo sapiens
gagaaacacgaauggguaa

SEQ ID NO: 196268 - RNA, 19 nt, Homo sapiens
gaaagcugcuagugaacuc

SEQ ID NO: 196269 - RNA, 19 nt, Homo sapiens
gaaaauccaggacuuguaa

SEQ ID NO: 196270 - RNA, 19 nt, Homo sapiens
gaaaauggaacuccuaaau

SEQ ID NO: 196271 - RNA, 19 nt, Homo sapiens
caggagaaguaacugaaau

SEQ ID NO: 196272 - RNA, 19 nt, Homo sapiens
guggauagaagacuuagaa

SEQ ID NO: 196273 - RNA, 19 nt, Homo sapiens
caagaugaguuuggugcuu

SEQ ID NO: 196274 - RNA, 19 nt, Homo sapiens
gaauggguaacaacagaaa

SEQ ID NO: 196275 - RNA, 19 nt, Homo sapiens
gaaauuaaugaagcucuug

SEQ ID NO: 196276 - RNA, 19 nt, Homo sapiens
gaacuuaugagugaagaag

SEQ ID NO: 196277 - RNA, 19 nt, Homo sapiens
gggagauguuguuuauugu

SEQ ID NO: 196278 - RNA, 19 nt, Homo sapiens
ugaguuuggugcuuuggaa

SEQ ID NO: 196279 - RNA, 19 nt, Homo sapiens
aagaugaguuuggugcuuu

SEQ ID NO: 196280 - RNA, 19 nt, Homo sapiens
uguuaacacugcuaaugaa

SEQ ID NO: 196281 - RNA, 19 nt, Homo sapiens
aaacacgaauggguaacaa

SEQ ID NO: 196282 - RNA, 19 nt, Homo sapiens
ucacagagaaacacgaaug

SEQ ID NO: 196283 - RNA, 19 nt, Homo sapiens
gugaagaagcauaugagaa

SEQ ID NO: 196284 - RNA, 19 nt, Homo sapiens
acucuauucuccuuuauca

SEQ ID NO: 196285 - RNA, 19 nt, Homo sapiens
gaacuccuaaauaaacuag

SEQ ID NO: 196286 - RNA, 19 nt, Homo sapiens
ucaagaugacacugaguaa

SEQ ID NO: 196287 - RNA, 19 nt, Homo sapiens
gaaacacgaauggguaaca

SEQ ID NO: 196288 - RNA, 19 nt, Homo sapiens
acgaauggguaacaacaga

SEQ ID NO: 196289 - RNA, 19 nt, Homo sapiens
gauguuguuuauuguaguc

SEQ ID NO: 196290 - RNA, 19 nt, Homo sapiens
uaaauuagugguggauaga

SEQ ID NO: 196291 - RNA, 19 nt, Homo sapiens
gaaguugggacaaaauuga

SEQ ID NO: 196292 - RNA, 19 nt, Homo sapiens
agaagcauaugagaaauac

SEQ ID NO: 196293 - RNA, 19 nt, Homo sapiens
guaaauucacagagaaaca

SEQ ID NO: 196294 - RNA, 19 nt, Homo sapiens
ggaacuccuaaauaaacua

SEQ ID NO: 196295 - RNA, 19 nt, Homo sapiens
ugagugaagaagcauauga

SEQ ID NO: 196296 - RNA, 19 nt, Homo sapiens
gaugguuggcugaucaaga

SEQ ID NO: 196297 - RNA, 19 nt, Homo sapiens
ugaacaaacaagaugaguu

SEQ ID NO: 196298 - RNA, 19 nt, Homo sapiens
cuuguacagugucagauga

SEQ ID NO: 196299 - RNA, 19 nt, Homo sapiens
guuaacacugcuaaugaaa

SEQ ID NO: 196300 - RNA, 19 nt, Homo sapiens
gcguaaauucacagagaaa

SEQ ID NO: 196301 - RNA, 19 nt, Homo sapiens
caggaagcguugggagaug

SEQ ID NO: 196302 - RNA, 19 nt, Homo sapiens
augguuggcugaucaagau

SEQ ID NO: 196303 - RNA, 19 nt, Homo sapiens
ugaagaugguuggcugauc

SEQ ID NO: 196304 - RNA, 19 nt, Homo sapiens
agugaacucuauucuccuu

SEQ ID NO: 196305 - RNA, 19 nt, Homo sapiens
gugguggauagaagacuua

SEQ ID NO: 196306 - RNA, 19 nt, Homo sapiens
gacacugaguaacccuuca

SEQ ID NO: 196307 - RNA, 19 nt, Homo sapiens
cgaauggguaacaacagaa

SEQ ID NO: 196308 - RNA, 19 nt, Homo sapiens
acacgaauggguaacaaca

SEQ ID NO: 196309 - RNA, 19 nt, Homo sapiens
ggaagcguugggagauguu

SEQ ID NO: 196310 - RNA, 19 nt, Homo sapiens
ugcguaaauucacagagaa

SEQ ID NO: 196311 - RNA, 19 nt, Homo sapiens
cuguuaacacugcuaauga

SEQ ID NO: 196312 - RNA, 19 nt, Homo sapiens
gagugaagaagcauaugag

SEQ ID NO: 196313 - RNA, 19 nt, Homo sapiens
gaugaacuuaugagugaag

SEQ ID NO: 196314 - RNA, 19 nt, Homo sapiens
gaguuuggugcuuuggaaa

SEQ ID NO: 196315 - RNA, 19 nt, Homo sapiens
ucaccaagcucaacauuua

SEQ ID NO: 196316 - RNA, 19 nt, Homo sapiens
cgagagcgcuuggaaguuu

SEQ ID NO: 196317 - RNA, 19 nt, Homo sapiens
ggaacggccuggugaagga

SEQ ID NO: 196318 - RNA, 19 nt, Homo sapiens
ugaaggaccugcgggagua

SEQ ID NO: 196319 - RNA, 19 nt, Homo sapiens
ucagugacgugcagcuuga

SEQ ID NO: 196320 - RNA, 19 nt, Homo sapiens
gcucaacauuuacuucaag

SEQ ID NO: 196321 - RNA, 19 nt, Homo sapiens
ggucauguggcgccuguuu

SEQ ID NO: 196322 - RNA, 19 nt, Homo sapiens
ggucaucgccugggaggaa

SEQ ID NO: 196323 - RNA, 19 nt, Homo sapiens
caucuacgcuacgcuauac

SEQ ID NO: 196324 - RNA, 19 nt, Homo sapiens
caccaucugucuucuacga

SEQ ID NO: 196325 - RNA, 19 nt, Homo sapiens
ccagagaugccgccaagau

SEQ ID NO: 196326 - RNA, 19 nt, Homo sapiens
gugccuaccugcuguuugg

SEQ ID NO: 196327 - RNA, 19 nt, Homo sapiens
ucuccgugcucuucuuuga

SEQ ID NO: 196328 - RNA, 19 nt, Homo sapiens
gcggcuuccuggccaacua

SEQ ID NO: 196329 - RNA, 19 nt, Homo sapiens
ccgagaagccacugaggaa

SEQ ID NO: 196330 - RNA, 19 nt, Homo sapiens
gagagcgcuuggaaguuuc

SEQ ID NO: 196331 - RNA, 19 nt, Homo sapiens
gggcauccuugugcucuuc

SEQ ID NO: 196332 - RNA, 19 nt, Homo sapiens
cuccaacucugcuccucua

SEQ ID NO: 196333 - RNA, 19 nt, Homo sapiens
cagagaugccgccaagaug

SEQ ID NO: 196334 - RNA, 19 nt, Homo sapiens
acgcuacgcuauacaugga

SEQ ID NO: 196335 - RNA, 19 nt, Homo sapiens
ccaucuacgcuacgcuaua

SEQ ID NO: 196336 - RNA, 19 nt, Homo sapiens
gcagugccacgggacauug

SEQ ID NO: 196337 - RNA, 19 nt, Homo sapiens
gaaacaucgugcgccacau

SEQ ID NO: 196338 - RNA, 19 nt, Homo sapiens
caagcucaacauuuacuuc

SEQ ID NO: 196339 - RNA, 19 nt, Homo sapiens
gcaaggacucgguggucau

SEQ ID NO: 196340 - RNA, 19 nt, Homo sapiens
caucuccgugcucuucuuu

SEQ ID NO: 196341 - RNA, 19 nt, Homo sapiens
aaacaucgugcgccacauc

SEQ ID NO: 196342 - RNA, 19 nt, Homo sapiens
guucaccaagcucaacauu

SEQ ID NO: 196343 - RNA, 19 nt, Homo sapiens
ugaguggacagucgucuuc

SEQ ID NO: 196344 - RNA, 19 nt, Homo sapiens
cugcugcucacccuuauga

SEQ ID NO: 196345 - RNA, 19 nt, Homo sapiens
gcccaucuccgugcucuuc

SEQ ID NO: 196346 - RNA, 19 nt, Homo sapiens
ccucauccugccuccauuu

SEQ ID NO: 196347 - RNA, 19 nt, Homo sapiens
gcgcuuggaaguuucucuu

SEQ ID NO: 196348 - RNA, 19 nt, Homo sapiens
cugcugcugcucacccuua

SEQ ID NO: 196349 - RNA, 19 nt, Homo sapiens
gguuccgccucuacugguu

SEQ ID NO: 196350 - RNA, 19 nt, Homo sapiens
caaggacucgguggucaug

SEQ ID NO: 196351 - RNA, 19 nt, Homo sapiens
gggcauggcuuccaauuua

SEQ ID NO: 196352 - RNA, 19 nt, Homo sapiens
ucaagaagcuguccaagga

SEQ ID NO: 196353 - RNA, 19 nt, Homo sapiens
caacaaggacugauucaau

SEQ ID NO: 196354 - RNA, 19 nt, Homo sapiens
gaaaggaagcguggucauu

SEQ ID NO: 196355 - RNA, 19 nt, Homo sapiens
gaucagccaugaacaagag

SEQ ID NO: 196356 - RNA, 19 nt, Homo sapiens
aaggaagcguggucauuua

SEQ ID NO: 196357 - RNA, 19 nt, Homo sapiens
gaacagaugccugggauag

SEQ ID NO: 196358 - RNA, 19 nt, Homo sapiens
gcaaggaggugaugaaaag

SEQ ID NO: 196359 - RNA, 19 nt, Homo sapiens
gaggccagcucgcuccaaa

SEQ ID NO: 196360 - RNA, 19 nt, Homo sapiens
ugggacagcuggaucauug

SEQ ID NO: 196361 - RNA, 19 nt, Homo sapiens
gcacaacaaggacugauuc

SEQ ID NO: 196362 - RNA, 19 nt, Homo sapiens
guaugaagccuacgagugu

SEQ ID NO: 196363 - RNA, 19 nt, Homo sapiens
gauuugagcacaacaggaa

SEQ ID NO: 196364 - RNA, 19 nt, Homo sapiens
aaaggaagcguggucauuu

SEQ ID NO: 196365 - RNA, 19 nt, Homo sapiens
cuacagagaccaagaccuu

SEQ ID NO: 196366 - RNA, 19 nt, Homo sapiens
gaugaucagccaugaacaa

SEQ ID NO: 196367 - RNA, 19 nt, Homo sapiens
cacccaucauuguauguua

SEQ ID NO: 196368 - RNA, 19 nt, Homo sapiens
gaaaccugcccuucuuugu

SEQ ID NO: 196369 - RNA, 19 nt, Homo sapiens
ucacacccaucauuguaug

SEQ ID NO: 196370 - RNA, 19 nt, Homo sapiens
cccaggacauucaggauga

SEQ ID NO: 196371 - RNA, 19 nt, Homo sapiens
gggagaugaucagccauga

SEQ ID NO: 196372 - RNA, 19 nt, Homo sapiens
aaccugcccuucuuuguug

SEQ ID NO: 196373 - RNA, 19 nt, Homo sapiens
acagguacacguccgauaa

SEQ ID NO: 196374 - RNA, 19 nt, Homo sapiens
gagcugagggagaugauca

SEQ ID NO: 196375 - RNA, 19 nt, Homo sapiens
uucaacaucuccauuccua

SEQ ID NO: 196376 - RNA, 19 nt, Homo sapiens
gagaugaucagccaugaac

SEQ ID NO: 196377 - RNA, 19 nt, Homo sapiens
acagaugccugggauagug

SEQ ID NO: 196378 - RNA, 19 nt, Homo sapiens
gaacgugaagguggauuuc

SEQ ID NO: 196379 - RNA, 19 nt, Homo sapiens
aaaccugcccuucuuuguu

SEQ ID NO: 196380 - RNA, 19 nt, Homo sapiens
ucucaugaccugaaaggaa

SEQ ID NO: 196381 - RNA, 19 nt, Homo sapiens
ugucacacccaucauugua

SEQ ID NO: 196382 - RNA, 19 nt, Homo sapiens
gaugcaaggaggugaugaa

SEQ ID NO: 196383 - RNA, 19 nt, Homo sapiens
cagggaaggcuaaggaaau

SEQ ID NO: 196384 - RNA, 19 nt, Homo sapiens
ucauugcacccaaggagua

SEQ ID NO: 196385 - RNA, 19 nt, Homo sapiens
gcccuucuuuguugucuuc

SEQ ID NO: 196386 - RNA, 19 nt, Homo sapiens
gacgguuccuucagagcaa

SEQ ID NO: 196387 - RNA, 19 nt, Homo sapiens
uaugaagccuacgagugua

SEQ ID NO: 196388 - RNA, 19 nt, Homo sapiens
ggagaugaucagccaugaa

SEQ ID NO: 196389 - RNA, 19 nt, Homo sapiens
ggaacagaugccugggaua

SEQ ID NO: 196390 - RNA, 19 nt, Homo sapiens
ggaagcguggucauuuaug

SEQ ID NO: 196391 - RNA, 19 nt, Homo sapiens
ugggagaccuuggaagugu

SEQ ID NO: 196392 - RNA, 19 nt, Homo sapiens
gacucuaugucuccuguca

SEQ ID NO: 196393 - RNA, 19 nt, Homo sapiens
gcugagcuccgacucuaug

SEQ ID NO: 196394 - RNA, 19 nt, Homo sapiens
cagagacugauggaaguua

SEQ ID NO: 196395 - RNA, 19 nt, Homo sapiens
caaaggggcuccacaugag

SEQ ID NO: 196396 - RNA, 19 nt, Homo sapiens
ccaaggacggcuccacaga

SEQ ID NO: 196397 - RNA, 19 nt, Homo sapiens
ggcauggcuuccaauuuag

SEQ ID NO: 196398 - RNA, 19 nt, Homo sapiens
gcgacacgcuggacaucag

SEQ ID NO: 196399 - RNA, 19 nt, Homo sapiens
ccagggaaggcuaaggaaa

SEQ ID NO: 196400 - RNA, 19 nt, Homo sapiens
gagugugggugcagguagu

SEQ ID NO: 196401 - RNA, 19 nt, Homo sapiens
uuuguugucuucuccaaug

SEQ ID NO: 196402 - RNA, 19 nt, Homo sapiens
gcugggagaccuuggaagu

SEQ ID NO: 196403 - RNA, 19 nt, Homo sapiens
gauuuccugcgcagccuua

SEQ ID NO: 196404 - RNA, 19 nt, Homo sapiens
gcauggcuuccaauuuaga

SEQ ID NO: 196405 - RNA, 19 nt, Homo sapiens
cucuaugucuccugucaaa

SEQ ID NO: 196406 - RNA, 19 nt, Homo sapiens
gcagagacugauggaaguu

SEQ ID NO: 196407 - RNA, 19 nt, Homo sapiens
agggaaggcuaaggaaaug

SEQ ID NO: 196408 - RNA, 19 nt, Homo sapiens
ccuggugcaucucaaguuc

SEQ ID NO: 196409 - RNA, 19 nt, Homo sapiens
ggguaaacuucgaggacau

SEQ ID NO: 196410 - RNA, 19 nt, Homo sapiens
gcucuucaacaucuccauu

SEQ ID NO: 196411 - RNA, 19 nt, Homo sapiens
gcgcagccuuaaccugagu

SEQ ID NO: 196412 - RNA, 19 nt, Homo sapiens
ccaaaggggcuccacauga

SEQ ID NO: 196413 - RNA, 19 nt, Homo sapiens
gcacaucuugcucuucaac

SEQ ID NO: 196414 - RNA, 19 nt, Homo sapiens
gagcuccgacucuaugucu

SEQ ID NO: 196415 - RNA, 19 nt, Homo sapiens
ccaucuccguccucuacaa

SEQ ID NO: 196416 - RNA, 19 nt, Homo sapiens
gagcaaacagcagggagau

SEQ ID NO: 196417 - RNA, 19 nt, Homo sapiens
ggacagcuggaucauugca

SEQ ID NO: 196418 - RNA, 19 nt, Homo sapiens
agaccucccugcggguaaa

SEQ ID NO: 196419 - RNA, 19 nt, Homo sapiens
cauuuaugauguucuggau

SEQ ID NO: 196420 - RNA, 19 nt, Homo sapiens
agagacugauggaaguuag

SEQ ID NO: 196421 - RNA, 19 nt, Homo sapiens
uguauguuauuucccacaa

SEQ ID NO: 196422 - RNA, 19 nt, Homo sapiens
ugcagagacugauggaagu

SEQ ID NO: 196423 - RNA, 19 nt, Homo sapiens
ucuccucucugggugauug

SEQ ID NO: 196424 - RNA, 19 nt, Homo sapiens
ggcuggagcugagggagau

SEQ ID NO: 196425 - RNA, 19 nt, Homo sapiens
ggcacaacaaggacugauu

SEQ ID NO: 196426 - RNA, 19 nt, Homo sapiens
uaacugccacagaggacuu

SEQ ID NO: 196427 - RNA, 19 nt, Homo sapiens
gaugugacgccgacgaaac

SEQ ID NO: 196428 - RNA, 19 nt, Homo sapiens
ccacccucaaguaccauua

SEQ ID NO: 196429 - RNA, 19 nt, Homo sapiens
acaaagaugucuccaauua

SEQ ID NO: 196430 - RNA, 19 nt, Homo sapiens
guaaauaagugucuccuuu

SEQ ID NO: 196431 - RNA, 19 nt, Homo sapiens
gaugcuaucucaacaauaa

SEQ ID NO: 196432 - RNA, 19 nt, Homo sapiens
ggaaacagcuccuaacauc

SEQ ID NO: 196433 - RNA, 19 nt, Homo sapiens
gcaaagauguuauaagaca

SEQ ID NO: 196434 - RNA, 19 nt, Homo sapiens
cagcaaagauguuauaaga

SEQ ID NO: 196435 - RNA, 19 nt, Homo sapiens
caacuuaggcauugaaaua

SEQ ID NO: 196436 - RNA, 19 nt, Homo sapiens
gcaauuuccauuccuauua

SEQ ID NO: 196437 - RNA, 19 nt, Homo sapiens
gaaagacgguacaagguau

SEQ ID NO: 196438 - RNA, 19 nt, Homo sapiens
gggaauauaugcaaugguu

SEQ ID NO: 196439 - RNA, 19 nt, Homo sapiens
gaagaaacaagaacaagaa

SEQ ID NO: 196440 - RNA, 19 nt, Homo sapiens
gaucgacucuaucaauauu

SEQ ID NO: 196441 - RNA, 19 nt, Homo sapiens
caacggugcuaauacgaua

SEQ ID NO: 196442 - RNA, 19 nt, Homo sapiens
ccacaaagaugucuccaau

SEQ ID NO: 196443 - RNA, 19 nt, Homo sapiens
gcaacucuguguuuauauu

SEQ ID NO: 196444 - RNA, 19 nt, Homo sapiens
ccaaacaaaucauacaaga

SEQ ID NO: 196445 - RNA, 19 nt, Homo sapiens
gagaaacugcauuaucuua

SEQ ID NO: 196446 - RNA, 19 nt, Homo sapiens
ugaaagcgauucuccuuga

SEQ ID NO: 196447 - RNA, 19 nt, Homo sapiens
caugauggcuguauaaagu

SEQ ID NO: 196448 - RNA, 19 nt, Homo sapiens
ucucaacguuccauuauuu

SEQ ID NO: 196449 - RNA, 19 nt, Homo sapiens
ggaguaugcuuuaaagucu

SEQ ID NO: 196450 - RNA, 19 nt, Homo sapiens
cuugaguucugaugaauua

SEQ ID NO: 196451 - RNA, 19 nt, Homo sapiens
gagcaaauuagcagauuaa

SEQ ID NO: 196452 - RNA, 19 nt, Homo sapiens
gcauguacuuggagacaaa

SEQ ID NO: 196453 - RNA, 19 nt, Homo sapiens
gagguuggcuuucaauucu

SEQ ID NO: 196454 - RNA, 19 nt, Homo sapiens
uacagucacuuaagcauaa

SEQ ID NO: 196455 - RNA, 19 nt, Homo sapiens
agaaggagaucaaauuaca

SEQ ID NO: 196456 - RNA, 19 nt, Homo sapiens
gcuagaaggagaucaaauu

SEQ ID NO: 196457 - RNA, 19 nt, Homo sapiens
gcccaacuauggauauauu

SEQ ID NO: 196458 - RNA, 19 nt, Homo sapiens
ggaagaaacaagaacaaga

SEQ ID NO: 196459 - RNA, 19 nt, Homo sapiens
gauauaaggccaauuacug

SEQ ID NO: 196460 - RNA, 19 nt, Homo sapiens
agaauaaacugaugcuauc

SEQ ID NO: 196461 - RNA, 19 nt, Homo sapiens
cuaccagguuuaucacaua

SEQ ID NO: 196462 - RNA, 19 nt, Homo sapiens
gaauccaacuuaggcauug

SEQ ID NO: 196463 - RNA, 19 nt, Homo sapiens
cagcagcgauggcucuuug

SEQ ID NO: 196464 - RNA, 19 nt, Homo sapiens
ggagaaguauguaauuuug

SEQ ID NO: 196465 - RNA, 19 nt, Homo sapiens
cuagaaggagaucaaauua

SEQ ID NO: 196466 - RNA, 19 nt, Homo sapiens
gcauugaugugaagacagu

SEQ ID NO: 196467 - RNA, 19 nt, Homo sapiens
gguacaagguauacuggaa

SEQ ID NO: 196468 - RNA, 19 nt, Homo sapiens
agauacaaauccucaguaa

SEQ ID NO: 196469 - RNA, 19 nt, Homo sapiens
caaagaugucuccaauuaa

SEQ ID NO: 196470 - RNA, 19 nt, Homo sapiens
gauuaucgcuccuaaaaga

SEQ ID NO: 196471 - RNA, 19 nt, Homo sapiens
ugaaagacgguacaaggua

SEQ ID NO: 196472 - RNA, 19 nt, Homo sapiens
cugcaacucuguguuuaua

SEQ ID NO: 196473 - RNA, 19 nt, Homo sapiens
ucacugguguggcaaguug

SEQ ID NO: 196474 - RNA, 19 nt, Homo sapiens
ggaauccgaucucugaaac

SEQ ID NO: 196475 - RNA, 19 nt, Homo sapiens
uggagaaacugcauuaucu

SEQ ID NO: 196476 - RNA, 19 nt, Homo sapiens
gaaucauccuuaaacacuu

SEQ ID NO: 196477 - RNA, 19 nt, Homo sapiens
gcagagcauugaugugaag

SEQ ID NO: 196478 - RNA, 19 nt, Homo sapiens
acccaaauguugcuucuuu

SEQ ID NO: 196479 - RNA, 19 nt, Homo sapiens
guaaaaugcaggauuguua

SEQ ID NO: 196480 - RNA, 19 nt, Homo sapiens
caacaucggcgaggaaaug

SEQ ID NO: 196481 - RNA, 19 nt, Homo sapiens
acacuaaggacauuucaaa

SEQ ID NO: 196482 - RNA, 19 nt, Homo sapiens
ccaaauguugcuucuuuaa

SEQ ID NO: 196483 - RNA, 19 nt, Homo sapiens
agagcaaauuagcagauua

SEQ ID NO: 196484 - RNA, 19 nt, Homo sapiens
gcauuuaaccauccaaaca

SEQ ID NO: 196485 - RNA, 19 nt, Homo sapiens
gaagcugugaaauuaagua

SEQ ID NO: 196486 - RNA, 19 nt, Homo sapiens
ucaaacaaccugaauccaa

SEQ ID NO: 196487 - RNA, 19 nt, Homo sapiens
gaguaugcuuuaaagucua

SEQ ID NO: 196488 - RNA, 19 nt, Homo sapiens
ucaauucuguagcauacuu

SEQ ID NO: 196489 - RNA, 19 nt, Homo sapiens
uggagagugugaauuugua

SEQ ID NO: 196490 - RNA, 19 nt, Homo sapiens
caaccugaauccaacuuag

SEQ ID NO: 196491 - RNA, 19 nt, Homo sapiens
gagcauugaugugaagaca

SEQ ID NO: 196492 - RNA, 19 nt, Homo sapiens
cccaaauguugcuucuuua

SEQ ID NO: 196493 - RNA, 19 nt, Homo sapiens
gauucaugauggcuguaua

SEQ ID NO: 196494 - RNA, 19 nt, Homo sapiens
agacugaaacaaugcauuu

SEQ ID NO: 196495 - RNA, 19 nt, Homo sapiens
caguggaucuaaaugagaa

SEQ ID NO: 196496 - RNA, 19 nt, Homo sapiens
gcugugaaauuaaguacca

SEQ ID NO: 196497 - RNA, 19 nt, Homo sapiens
uaaugcaaguggauggaaa

SEQ ID NO: 196498 - RNA, 19 nt, Homo sapiens
guacuaaggcacaaagaca

SEQ ID NO: 196499 - RNA, 19 nt, Homo sapiens
uuacaacacugccuuugca

SEQ ID NO: 196500 - RNA, 19 nt, Homo sapiens
cagagcaaauuagcagauu

SEQ ID NO: 196501 - RNA, 19 nt, Homo sapiens
ugagaauggucaugaucuu

SEQ ID NO: 196502 - RNA, 19 nt, Homo sapiens
guguuuaaaucucaacguu

SEQ ID NO: 196503 - RNA, 19 nt, Homo sapiens
caacacugccuuugcaaca

SEQ ID NO: 196504 - RNA, 19 nt, Homo sapiens
ggagaaacugcauuaucuu

SEQ ID NO: 196505 - RNA, 19 nt, Homo sapiens
gguaguauacuugguaaga

SEQ ID NO: 196506 - RNA, 19 nt, Homo sapiens
gaaagcgauucuccuugag

SEQ ID NO: 196507 - RNA, 19 nt, Homo sapiens
gaaacagcuccuaacauca

SEQ ID NO: 196508 - RNA, 19 nt, Homo sapiens
caaauccucaguaaacuuc

SEQ ID NO: 196509 - RNA, 19 nt, Homo sapiens
guaguauacuugguaagau

SEQ ID NO: 196510 - RNA, 19 nt, Homo sapiens
gcaggauuguuauauacca

SEQ ID NO: 196511 - RNA, 19 nt, Homo sapiens
uuuggaagaugacgauuau

SEQ ID NO: 196512 - RNA, 19 nt, Homo sapiens
gauacaaauccucaguaaa

SEQ ID NO: 196513 - RNA, 19 nt, Homo sapiens
cagauuaaauaguggucuu

SEQ ID NO: 196514 - RNA, 19 nt, Homo sapiens
uagcauacuuggagaaacu

SEQ ID NO: 196515 - RNA, 19 nt, Homo sapiens
gaggcuaccagguuuauca

SEQ ID NO: 196516 - RNA, 19 nt, Homo sapiens
caguaaacuucgucuggaa

SEQ ID NO: 196517 - RNA, 19 nt, Homo sapiens
caucaaaccuaugaaagac

SEQ ID NO: 196518 - RNA, 19 nt, Homo sapiens
caacggaaacaaucauuac

SEQ ID NO: 196519 - RNA, 19 nt, Homo sapiens
auacaaauccucaguaaac

SEQ ID NO: 196520 - RNA, 19 nt, Homo sapiens
uguaaugcauguacuugga

SEQ ID NO: 196521 - RNA, 19 nt, Homo sapiens
gcauaugcaauuuccauuc

SEQ ID NO: 196522 - RNA, 19 nt, Homo sapiens
ggauuguuauauaccauca

SEQ ID NO: 196523 - RNA, 19 nt, Homo sapiens
cuacagucacuuaagcaua

SEQ ID NO: 196524 - RNA, 19 nt, Homo sapiens
guucauaacuuccuaaaac

SEQ ID NO: 196525 - RNA, 19 nt, Homo sapiens
gaagaauaaacugaugcua

SEQ ID NO: 196526 - RNA, 19 nt, Homo sapiens
guaaguuucucuuuucuuc

SEQ ID NO: 196527 - RNA, 19 nt, Homo sapiens
gcuaccagguuuaucacau

SEQ ID NO: 196528 - RNA, 19 nt, Homo sapiens
ugacacaguacauuaacaa

SEQ ID NO: 196529 - RNA, 19 nt, Homo sapiens
gguauucccuucacuauaa

SEQ ID NO: 196530 - RNA, 19 nt, Homo sapiens
guacaacccucgauacugu

SEQ ID NO: 196531 - RNA, 19 nt, Homo sapiens
gcacagaaugguuuguuua

SEQ ID NO: 196532 - RNA, 19 nt, Homo sapiens
acaaauggauucagauuga

SEQ ID NO: 196533 - RNA, 19 nt, Homo sapiens
gaaagaaacacaaauggau

SEQ ID NO: 196534 - RNA, 19 nt, Homo sapiens
caagagaaguauucacaug

SEQ ID NO: 196535 - RNA, 19 nt, Homo sapiens
aaacacaaauggauucaga

SEQ ID NO: 196536 - RNA, 19 nt, Homo sapiens
cggcagagcuccauacuca

SEQ ID NO: 196537 - RNA, 19 nt, Homo sapiens
ugaagaagcucuauaagac

SEQ ID NO: 196538 - RNA, 19 nt, Homo sapiens
agacagagcuggccuccuu

SEQ ID NO: 196539 - RNA, 19 nt, Homo sapiens
cuccaugacuuuagacuua

SEQ ID NO: 196540 - RNA, 19 nt, Homo sapiens
ccucacugaucuuauauuu

SEQ ID NO: 196541 - RNA, 19 nt, Homo sapiens
uaaaggagccaaagucuuc

SEQ ID NO: 196542 - RNA, 19 nt, Homo sapiens
guacagaacaucaucuaug

SEQ ID NO: 196543 - RNA, 19 nt, Homo sapiens
ggaaagaaacacaaaugga

SEQ ID NO: 196544 - RNA, 19 nt, Homo sapiens
gacuuuagacuuagcuuua

SEQ ID NO: 196545 - RNA, 19 nt, Homo sapiens
gcagagcuccauacucauu

SEQ ID NO: 196546 - RNA, 19 nt, Homo sapiens
gcaaucuaaugauaaagga

SEQ ID NO: 196547 - RNA, 19 nt, Homo sapiens
gaagucaccucuacaacac

SEQ ID NO: 196548 - RNA, 19 nt, Homo sapiens
gaagauaugauagcuacaa

SEQ ID NO: 196549 - RNA, 19 nt, Homo sapiens
aaaugugugugcaaucuaa

SEQ ID NO: 196550 - RNA, 19 nt, Homo sapiens
gaaguauucacaugucuau

SEQ ID NO: 196551 - RNA, 19 nt, Homo sapiens
gggcccagcuuccuucaau

SEQ ID NO: 196552 - RNA, 19 nt, Homo sapiens
gagccaaagucuucuagca

SEQ ID NO: 196553 - RNA, 19 nt, Homo sapiens
gacauaugcuaccaaggaa

SEQ ID NO: 196554 - RNA, 19 nt, Homo sapiens
gaagugggacaacuggauu

SEQ ID NO: 196555 - RNA, 19 nt, Homo sapiens
agaagaggcugcugaggau

SEQ ID NO: 196556 - RNA, 19 nt, Homo sapiens
acacaagugcucaggcuua

SEQ ID NO: 196557 - RNA, 19 nt, Homo sapiens
ccauacucauuuaccuuua

SEQ ID NO: 196558 - RNA, 19 nt, Homo sapiens
caaagugcaccugucguua

SEQ ID NO: 196559 - RNA, 19 nt, Homo sapiens
gauaugauagcuacaaagu

SEQ ID NO: 196560 - RNA, 19 nt, Homo sapiens
ucaauugccuauaaagagu

SEQ ID NO: 196561 - RNA, 19 nt, Homo sapiens
ugugugcaaucuaaugaua

SEQ ID NO: 196562 - RNA, 19 nt, Homo sapiens
gaagcucuauaagacauau

SEQ ID NO: 196563 - RNA, 19 nt, Homo sapiens
gaagaagcucuauaagaca

SEQ ID NO: 196564 - RNA, 19 nt, Homo sapiens
gcagaggucaggaaacugu

SEQ ID NO: 196565 - RNA, 19 nt, Homo sapiens
uaaagaguacgaagauaug

SEQ ID NO: 196566 - RNA, 19 nt, Homo sapiens
gccaagaccgucaugugua

SEQ ID NO: 196567 - RNA, 19 nt, Homo sapiens
cccaacaaauuccuccuuu

SEQ ID NO: 196568 - RNA, 19 nt, Homo sapiens
agacauaugcuaccaagga

SEQ ID NO: 196569 - RNA, 19 nt, Homo sapiens
aaagugcaccugucguuaa

SEQ ID NO: 196570 - RNA, 19 nt, Homo sapiens
ccagcuuccuucaaucuga

SEQ ID NO: 196571 - RNA, 19 nt, Homo sapiens
acaugaagaagcucuauaa

SEQ ID NO: 196572 - RNA, 19 nt, Homo sapiens
cauguguaccugccaaaua

SEQ ID NO: 196573 - RNA, 19 nt, Homo sapiens
caagugcucaggcuuauca

SEQ ID NO: 196574 - RNA, 19 nt, Homo sapiens
gagcauccuucagcacaga

SEQ ID NO: 196575 - RNA, 19 nt, Homo sapiens
cagccuccuucaaccuuua

SEQ ID NO: 196576 - RNA, 19 nt, Homo sapiens
agagcuccauacucauuua

SEQ ID NO: 196577 - RNA, 19 nt, Homo sapiens
gagcuuugcacuacaugaa

SEQ ID NO: 196578 - RNA, 19 nt, Homo sapiens
gcucaauugccuauaaaga

SEQ ID NO: 196579 - RNA, 19 nt, Homo sapiens
ccaagaccgucauguguac

SEQ ID NO: 196580 - RNA, 19 nt, Homo sapiens
ucaaaugugugugcaaucu

SEQ ID NO: 196581 - RNA, 19 nt, Homo sapiens
guacgaagauaugauagcu

SEQ ID NO: 196582 - RNA, 19 nt, Homo sapiens
agaguacgaagauaugaua

SEQ ID NO: 196583 - RNA, 19 nt, Homo sapiens
cgguauggcucuccaguuc

SEQ ID NO: 196584 - RNA, 19 nt, Homo sapiens
caaucugagugaauacuuc

SEQ ID NO: 196585 - RNA, 19 nt, Homo sapiens
gagaaguauucacaugucu

SEQ ID NO: 196586 - RNA, 19 nt, Homo sapiens
uuaguggccuccaacaaga

SEQ ID NO: 196587 - RNA, 19 nt, Homo sapiens
gauaaaggagccaaagucu

SEQ ID NO: 196588 - RNA, 19 nt, Homo sapiens
cacagaaugguuuguuuaa

SEQ ID NO: 196589 - RNA, 19 nt, Homo sapiens
cagucuugcuguacaauau

SEQ ID NO: 196590 - RNA, 19 nt, Homo sapiens
agugugagcuccaugacuu

SEQ ID NO: 196591 - RNA, 19 nt, Homo sapiens
gagaccagguaacaggaau

SEQ ID NO: 196592 - RNA, 19 nt, Homo sapiens
gggagaagcucagauugcu

SEQ ID NO: 196593 - RNA, 19 nt, Homo sapiens
gcuuugcacuacaugaaga

SEQ ID NO: 196594 - RNA, 19 nt, Homo sapiens
caaauggauucagauugau

SEQ ID NO: 196595 - RNA, 19 nt, Homo sapiens
acacaaauggauucagauu

SEQ ID NO: 196596 - RNA, 19 nt, Homo sapiens
uacuaccguugaacacuua

SEQ ID NO: 196597 - RNA, 19 nt, Homo sapiens
uaaccuggaucgcauuacu

SEQ ID NO: 196598 - RNA, 19 nt, Homo sapiens
gaauacuucagacaauuuc

SEQ ID NO: 196599 - RNA, 19 nt, Homo sapiens
guauucccuucacuauaaa

SEQ ID NO: 196600 - RNA, 19 nt, Homo sapiens
uuacuaccguugaacacuu

SEQ ID NO: 196601 - RNA, 19 nt, Homo sapiens
ccagagcuuugcacuacau

SEQ ID NO: 196602 - RNA, 19 nt, Homo sapiens
agagaaguauucacauguc

SEQ ID NO: 196603 - RNA, 19 nt, Homo sapiens
ccucugcugucaaaugugu

SEQ ID NO: 196604 - RNA, 19 nt, Homo sapiens
uggcucaauugccuauaaa

SEQ ID NO: 196605 - RNA, 19 nt, Homo sapiens
ugagcuccaugacuuuaga

SEQ ID NO: 196606 - RNA, 19 nt, Homo sapiens
cagccagacuccagagcuu

SEQ ID NO: 196607 - RNA, 19 nt, Homo sapiens
cacaagugcucaggcuuau

SEQ ID NO: 196608 - RNA, 19 nt, Homo sapiens
caaaugugugugcaaucua

SEQ ID NO: 196609 - RNA, 19 nt, Homo sapiens
aagaagcucuauaagacau

SEQ ID NO: 196610 - RNA, 19 nt, Homo sapiens
gcaguuggacaucgguaug

SEQ ID NO: 196611 - RNA, 19 nt, Homo sapiens
gaauuuggaaagaaacaca

SEQ ID NO: 196612 - RNA, 19 nt, Homo sapiens
cuauaaagaguacgaagau

SEQ ID NO: 196613 - RNA, 19 nt, Homo sapiens
ccgcagaggucaggaaacu

SEQ ID NO: 196614 - RNA, 19 nt, Homo sapiens
ggagaccagguaacaggaa

SEQ ID NO: 196615 - RNA, 19 nt, Homo sapiens
acaaagugcaccugucguu

SEQ ID NO: 196616 - RNA, 19 nt, Homo sapiens
gcugguauucccuucacua

SEQ ID NO: 196617 - RNA, 19 nt, Homo sapiens
ccagccuccuucaaccuuu

SEQ ID NO: 196618 - RNA, 19 nt, Homo sapiens
ugucaaaugugugugcaau

SEQ ID NO: 196619 - RNA, 19 nt, Homo sapiens
ucgcauuacuaccguugaa

SEQ ID NO: 196620 - RNA, 19 nt, Homo sapiens
caguuugaauuuggaaaga

SEQ ID NO: 196621 - RNA, 19 nt, Homo sapiens
agaagucaccucuacaaca

SEQ ID NO: 196622 - RNA, 19 nt, Homo sapiens
augaagaagcucuauaaga

SEQ ID NO: 196623 - RNA, 19 nt, Homo sapiens
caauugccuauaaagagua

SEQ ID NO: 196624 - RNA, 19 nt, Homo sapiens
acucacaguuugaauuugg

SEQ ID NO: 196625 - RNA, 19 nt, Homo sapiens
gcauuacuaccguugaaca

SEQ ID NO: 196626 - RNA, 19 nt, Homo sapiens
acagguacaacccucgaua

SEQ ID NO: 196627 - RNA, 19 nt, Homo sapiens
gcuuaucacagcugguauu

SEQ ID NO: 196628 - RNA, 19 nt, Homo sapiens
cuucagcacagaaugguuu

SEQ ID NO: 196629 - RNA, 19 nt, Homo sapiens
ggaaagaacucuguuuaaa

SEQ ID NO: 196630 - RNA, 19 nt, Homo sapiens
gcagugggcuacaaacuuu

SEQ ID NO: 196631 - RNA, 19 nt, Homo sapiens
guaaaugaguguuuccuuu

SEQ ID NO: 196632 - RNA, 19 nt, Homo sapiens
gaaaguggcccaucauuca

SEQ ID NO: 196633 - RNA, 19 nt, Homo sapiens
gcaagaagacuaugcaaau

SEQ ID NO: 196634 - RNA, 19 nt, Homo sapiens
gcacauguagccaauauug

SEQ ID NO: 196635 - RNA, 19 nt, Homo sapiens
aaacauauccacaacauug

SEQ ID NO: 196636 - RNA, 19 nt, Homo sapiens
gcaaagaccgcaggaagaa

SEQ ID NO: 196637 - RNA, 19 nt, Homo sapiens
cagugacgcugcagagaua

SEQ ID NO: 196638 - RNA, 19 nt, Homo sapiens
uaacugagcaagaagacua

SEQ ID NO: 196639 - RNA, 19 nt, Homo sapiens
caaccugacuuccaugcaa

SEQ ID NO: 196640 - RNA, 19 nt, Homo sapiens
ggaaugugguucugaaggu

SEQ ID NO: 196641 - RNA, 19 nt, Homo sapiens
ccagagcccugcuguguuc

SEQ ID NO: 196642 - RNA, 19 nt, Homo sapiens
ggauaaucgugguguaaau

SEQ ID NO: 196643 - RNA, 19 nt, Homo sapiens
gacaucggcuggaaugaau

SEQ ID NO: 196644 - RNA, 19 nt, Homo sapiens
caagaagacuaugcaaauc

SEQ ID NO: 196645 - RNA, 19 nt, Homo sapiens
ccacaacauuggcuugaug

SEQ ID NO: 196646 - RNA, 19 nt, Homo sapiens
uggauaaucucaccgaaau

SEQ ID NO: 196647 - RNA, 19 nt, Homo sapiens
ggaggaagcagugggauga

SEQ ID NO: 196648 - RNA, 19 nt, Homo sapiens
aauuaaagguacaguggua

SEQ ID NO: 196649 - RNA, 19 nt, Homo sapiens
ggucuuucauugcuaguga

SEQ ID NO: 196650 - RNA, 19 nt, Homo sapiens
gauuguguauguuaugugu

SEQ ID NO: 196651 - RNA, 19 nt, Homo sapiens
cggcuggaaugaauggaua

SEQ ID NO: 196652 - RNA, 19 nt, Homo sapiens
gcagacaucggcuggaaug

SEQ ID NO: 196653 - RNA, 19 nt, Homo sapiens
gcaagacucggaaaugauc

SEQ ID NO: 196654 - RNA, 19 nt, Homo sapiens
ccacagagauagucaugcu

SEQ ID NO: 196655 - RNA, 19 nt, Homo sapiens
ccgcccagcuggauucuga

SEQ ID NO: 196656 - RNA, 19 nt, Homo sapiens
gaacacuuugggccacaua

SEQ ID NO: 196657 - RNA, 19 nt, Homo sapiens
cggaaagaacucuguuuaa

SEQ ID NO: 196658 - RNA, 19 nt, Homo sapiens
gaguguggguuguuuaaac

SEQ ID NO: 196659 - RNA, 19 nt, Homo sapiens
uuaaaugccagccugagua

SEQ ID NO: 196660 - RNA, 19 nt, Homo sapiens
guccgccagugcaucauua

SEQ ID NO: 196661 - RNA, 19 nt, Homo sapiens
uaaucucaccgaaaucuuu

SEQ ID NO: 196662 - RNA, 19 nt, Homo sapiens
uacuguagauuguguaugu

SEQ ID NO: 196663 - RNA, 19 nt, Homo sapiens
uaaaugaguguuuccuuuc

SEQ ID NO: 196664 - RNA, 19 nt, Homo sapiens
gaaugaauggauaaucuca

SEQ ID NO: 196665 - RNA, 19 nt, Homo sapiens
uggaaugaauggauaaucu

SEQ ID NO: 196666 - RNA, 19 nt, Homo sapiens
gcagagcuuuuauccauau

SEQ ID NO: 196667 - RNA, 19 nt, Homo sapiens
cugaguaccugaaggaauc

SEQ ID NO: 196668 - RNA, 19 nt, Homo sapiens
gagaagacgaugcagaaag

SEQ ID NO: 196669 - RNA, 19 nt, Homo sapiens
aaaugaguguuuccuuuca

SEQ ID NO: 196670 - RNA, 19 nt, Homo sapiens
gauaaucgugguguaaaug

SEQ ID NO: 196671 - RNA, 19 nt, Homo sapiens
gaucaucaucucauaacug

SEQ ID NO: 196672 - RNA, 19 nt, Homo sapiens
caaaacauauccacaacau

SEQ ID NO: 196673 - RNA, 19 nt, Homo sapiens
gcaacacgguccgcagcuu

SEQ ID NO: 196674 - RNA, 19 nt, Homo sapiens
ccaacgaucuggccaucuc

SEQ ID NO: 196675 - RNA, 19 nt, Homo sapiens
acggaaagaacucuguuua

SEQ ID NO: 196676 - RNA, 19 nt, Homo sapiens
ccagaaggccguguauuuc

SEQ ID NO: 196677 - RNA, 19 nt, Homo sapiens
gcacaggcucuaugagaag

SEQ ID NO: 196678 - RNA, 19 nt, Homo sapiens
gauaaucucaccgaaaucu

SEQ ID NO: 196679 - RNA, 19 nt, Homo sapiens
aaaguccacugcagagcuu

SEQ ID NO: 196680 - RNA, 19 nt, Homo sapiens
cgcaggugcuggacuuuga

SEQ ID NO: 196681 - RNA, 19 nt, Homo sapiens
augcaagacucggaaauga

SEQ ID NO: 196682 - RNA, 19 nt, Homo sapiens
aagguacagugguaucuug

SEQ ID NO: 196683 - RNA, 19 nt, Homo sapiens
guaugcacauguagccaau

SEQ ID NO: 196684 - RNA, 19 nt, Homo sapiens
ugaaaguggcccaucauuc

SEQ ID NO: 196685 - RNA, 19 nt, Homo sapiens
agaagacgaugcagaaagc

SEQ ID NO: 196686 - RNA, 19 nt, Homo sapiens
accagaaggccguguauuu

SEQ ID NO: 196687 - RNA, 19 nt, Homo sapiens
gcacagcucaugggcaaca

SEQ ID NO: 196688 - RNA, 19 nt, Homo sapiens
ugcacaggcucuaugagaa

SEQ ID NO: 196689 - RNA, 19 nt, Homo sapiens
uuuaaaugcucaguucaga

SEQ ID NO: 196690 - RNA, 19 nt, Homo sapiens
aucaucaucucauaacuga

SEQ ID NO: 196691 - RNA, 19 nt, Homo sapiens
caucauucauacccacugu

SEQ ID NO: 196692 - RNA, 19 nt, Homo sapiens
ggaugagaaucggaaugug

SEQ ID NO: 196693 - RNA, 19 nt, Homo sapiens
gcugaguguggguuguuua

SEQ ID NO: 196694 - RNA, 19 nt, Homo sapiens
caggauaaucgugguguaa

SEQ ID NO: 196695 - RNA, 19 nt, Homo sapiens
ccugcuguguucccgauaa

SEQ ID NO: 196696 - RNA, 19 nt, Homo sapiens
ccucgcaggugcuggacuu

SEQ ID NO: 196697 - RNA, 19 nt, Homo sapiens
acaggauaaucguggugua

SEQ ID NO: 196698 - RNA, 19 nt, Homo sapiens
cugaaggaaucugggaauu

SEQ ID NO: 196699 - RNA, 19 nt, Homo sapiens
ggaaugaauggauaaucuc

SEQ ID NO: 196700 - RNA, 19 nt, Homo sapiens
ucgcagacaucggcuggaa

SEQ ID NO: 196701 - RNA, 19 nt, Homo sapiens
guagauuguguauguuaug

SEQ ID NO: 196702 - RNA, 19 nt, Homo sapiens
gagcaagaagacuaugcaa

SEQ ID NO: 196703 - RNA, 19 nt, Homo sapiens
gccugaaaguggcccauca

SEQ ID NO: 196704 - RNA, 19 nt, Homo sapiens
ccuagucuaugccaacgau

SEQ ID NO: 196705 - RNA, 19 nt, Homo sapiens
augcacauguagccaauau

SEQ ID NO: 196706 - RNA, 19 nt, Homo sapiens
ucugaaggcuugaaaacaa

SEQ ID NO: 196707 - RNA, 19 nt, Homo sapiens
cauacccacuguucugaag

SEQ ID NO: 196708 - RNA, 19 nt, Homo sapiens
agacaucggcuggaaugaa

SEQ ID NO: 196709 - RNA, 19 nt, Homo sapiens
ggccguguauuucuucaac

SEQ ID NO: 196710 - RNA, 19 nt, Homo sapiens
acgagaagacgaugcagaa

SEQ ID NO: 196711 - RNA, 19 nt, Homo sapiens
cuguuuaaaugcucaguuc

SEQ ID NO: 196712 - RNA, 19 nt, Homo sapiens
ucaccgaaaucuuuugaug

SEQ ID NO: 196713 - RNA, 19 nt, Homo sapiens
cuguagauuguguauguua

SEQ ID NO: 196714 - RNA, 19 nt, Homo sapiens
gaccagaaggccguguauu

SEQ ID NO: 196715 - RNA, 19 nt, Homo sapiens
gcgcgcagugggcuacaaa

SEQ ID NO: 196716 - RNA, 19 nt, Homo sapiens
aaugaguguuuccuuucaa

SEQ ID NO: 196717 - RNA, 19 nt, Homo sapiens
gaaucggaaugugguucug

SEQ ID NO: 196718 - RNA, 19 nt, Homo sapiens
ccuaagaucguucguccau

SEQ ID NO: 196719 - RNA, 19 nt, Homo sapiens
cgagaagacgaugcagaaa

SEQ ID NO: 196720 - RNA, 19 nt, Homo sapiens
gcuggacuuugacgagaag

SEQ ID NO: 196721 - RNA, 19 nt, Homo sapiens
cgcaaagaccgcaggaaga

SEQ ID NO: 196722 - RNA, 19 nt, Homo sapiens
cgcccuacauccuagucua

SEQ ID NO: 196723 - RNA, 19 nt, Homo sapiens
uauaguaacgugggaauac

SEQ ID NO: 196724 - RNA, 19 nt, Homo sapiens
agauagucaugcugagugu

SEQ ID NO: 196725 - RNA, 19 nt, Homo sapiens
cugcagagcuuuuauccau

SEQ ID NO: 196726 - RNA, 19 nt, Homo sapiens
augaguguuuccuuucaaa

SEQ ID NO: 196727 - RNA, 19 nt, Homo sapiens
ccacaugcacaggcucuau

SEQ ID NO: 196728 - RNA, 19 nt, Homo sapiens
gcuguguucccgauaagau

SEQ ID NO: 196729 - RNA, 19 nt, Homo sapiens
gcaagcagcugaucuguga

SEQ ID NO: 196730 - RNA, 19 nt, Homo sapiens
ggacauauaugcugaacaa

SEQ ID NO: 196731 - RNA, 19 nt, Homo sapiens
guaaagaugcuacuguaua

SEQ ID NO: 196732 - RNA, 19 nt, Homo sapiens
gcaagagcccauauuuaua

SEQ ID NO: 196733 - RNA, 19 nt, Homo sapiens
ccaaauuccucauggcuaa

SEQ ID NO: 196734 - RNA, 19 nt, Homo sapiens
gaacaaaccuguggaugac

SEQ ID NO: 196735 - RNA, 19 nt, Homo sapiens
ggcaagagcccauauuuau

SEQ ID NO: 196736 - RNA, 19 nt, Homo sapiens
gcacggccuuugacuuuga

SEQ ID NO: 196737 - RNA, 19 nt, Homo sapiens
gcaaguuccugguguuugu

SEQ ID NO: 196738 - RNA, 19 nt, Homo sapiens
gcaucaaguuguacaguga

SEQ ID NO: 196739 - RNA, 19 nt, Homo sapiens
gauagcauccucuuucuug

SEQ ID NO: 196740 - RNA, 19 nt, Homo sapiens
ggcgagagcuccuccauca

SEQ ID NO: 196741 - RNA, 19 nt, Homo sapiens
ggagguugauuugcuguuu

SEQ ID NO: 196742 - RNA, 19 nt, Homo sapiens
gaccagcccugccuugaga

SEQ ID NO: 196743 - RNA, 19 nt, Homo sapiens
gaacgacgucuuuggagaa

SEQ ID NO: 196744 - RNA, 19 nt, Homo sapiens
aaacaaaaccucccaauaa

SEQ ID NO: 196745 - RNA, 19 nt, Homo sapiens
caucaaagacaucuacaaa

SEQ ID NO: 196746 - RNA, 19 nt, Homo sapiens
gccaacuccugccaaauaa

SEQ ID NO: 196747 - RNA, 19 nt, Homo sapiens
cgcaucaucuguauccuua

SEQ ID NO: 196748 - RNA, 19 nt, Homo sapiens
uaaagaugcuacuguauac

SEQ ID NO: 196749 - RNA, 19 nt, Homo sapiens
gggaaacccuuaucuugca

SEQ ID NO: 196750 - RNA, 19 nt, Homo sapiens
ccugagggcugucgaguga

SEQ ID NO: 196751 - RNA, 19 nt, Homo sapiens
gcaacgacaucaaagacau

SEQ ID NO: 196752 - RNA, 19 nt, Homo sapiens
aaacggcgcuuccgcaagu

SEQ ID NO: 196753 - RNA, 19 nt, Homo sapiens
ucaaagacaucuacaaacg

SEQ ID NO: 196754 - RNA, 19 nt, Homo sapiens
uguaugagcccauugauga

SEQ ID NO: 196755 - RNA, 19 nt, Homo sapiens
uggagaagcugagcaguga

SEQ ID NO: 196756 - RNA, 19 nt, Homo sapiens
ugaacaaaccuguggauga

SEQ ID NO: 196757 - RNA, 19 nt, Homo sapiens
caaacagaacgacgucuuu

SEQ ID NO: 196758 - RNA, 19 nt, Homo sapiens
uaauucuucugcucuguuu

SEQ ID NO: 196759 - RNA, 19 nt, Homo sapiens
ugguaaagaugcuacugua

SEQ ID NO: 196760 - RNA, 19 nt, Homo sapiens
ccacugaccaaauccuuaa

SEQ ID NO: 196761 - RNA, 19 nt, Homo sapiens
caagagcccauauuuauac

SEQ ID NO: 196762 - RNA, 19 nt, Homo sapiens
cgccaacuccugccaaaua

SEQ ID NO: 196763 - RNA, 19 nt, Homo sapiens
ggaaacccuuaucuugcaa

SEQ ID NO: 196764 - RNA, 19 nt, Homo sapiens
gagaagcugagcagugauu

SEQ ID NO: 196765 - RNA, 19 nt, Homo sapiens
guaguggccuuuggagaug

SEQ ID NO: 196766 - RNA, 19 nt, Homo sapiens
gcaaacagaacgacgucuu

SEQ ID NO: 196767 - RNA, 19 nt, Homo sapiens
uggcaagagcccauauuua

SEQ ID NO: 196768 - RNA, 19 nt, Homo sapiens
uaacuuugacccacccuuu

SEQ ID NO: 196769 - RNA, 19 nt, Homo sapiens
gggaagacguggaggaaaa

SEQ ID NO: 196770 - RNA, 19 nt, Homo sapiens
uggcaaacuucgaugagaa

SEQ ID NO: 196771 - RNA, 19 nt, Homo sapiens
gugggaaacccuuaucuug

SEQ ID NO: 196772 - RNA, 19 nt, Homo sapiens
gaacaugaagcgcaaacag

SEQ ID NO: 196773 - RNA, 19 nt, Homo sapiens
agaaccaggucaacaggaa

SEQ ID NO: 196774 - RNA, 19 nt, Homo sapiens
ggacgaggaauacgaugug

SEQ ID NO: 196775 - RNA, 19 nt, Homo sapiens
uggcacggccuuugacuuu

SEQ ID NO: 196776 - RNA, 19 nt, Homo sapiens
acccuuaucuugcaaagug

SEQ ID NO: 196777 - RNA, 19 nt, Homo sapiens
ggcuaucagugacuuguau

SEQ ID NO: 196778 - RNA, 19 nt, Homo sapiens
gacgccaacuccugccaaa

SEQ ID NO: 196779 - RNA, 19 nt, Homo sapiens
gcaagguggugggcgugaa

SEQ ID NO: 196780 - RNA, 19 nt, Homo sapiens
ugaccugauucccaaauuc

SEQ ID NO: 196781 - RNA, 19 nt, Homo sapiens
ccacacacuuugagacaac

SEQ ID NO: 196782 - RNA, 19 nt, Homo sapiens
ugacuuguaugagcccauu

SEQ ID NO: 196783 - RNA, 19 nt, Homo sapiens
caacaggaagucagacauc

SEQ ID NO: 196784 - RNA, 19 nt, Homo sapiens
cagcaugcgugacgucuac

SEQ ID NO: 196785 - RNA, 19 nt, Homo sapiens
aacaaaaccucccaauaaa

SEQ ID NO: 196786 - RNA, 19 nt, Homo sapiens
caacuccugccaaauaauc

SEQ ID NO: 196787 - RNA, 19 nt, Homo sapiens
gacgaggaauacgauguga

SEQ ID NO: 196788 - RNA, 19 nt, Homo sapiens
ugaugggcauguuugagaa

SEQ ID NO: 196789 - RNA, 19 nt, Homo sapiens
cgagagcuccuccaucaca

SEQ ID NO: 196790 - RNA, 19 nt, Homo sapiens
gggcaaguacauagcuauu

SEQ ID NO: 196791 - RNA, 19 nt, Homo sapiens
gaucuccuaugcacacaac

SEQ ID NO: 196792 - RNA, 19 nt, Homo sapiens
ggaaggcuggccagguuau

SEQ ID NO: 196793 - RNA, 19 nt, Homo sapiens
cauauaugcugaacaaacc

SEQ ID NO: 196794 - RNA, 19 nt, Homo sapiens
caaacuucgaugagaauga

SEQ ID NO: 196795 - RNA, 19 nt, Homo sapiens
gguaaagaugcuacuguau

SEQ ID NO: 196796 - RNA, 19 nt, Homo sapiens
guauaagcguuuucaguug

SEQ ID NO: 196797 - RNA, 19 nt, Homo sapiens
gcuaacgggcagcugguaa

SEQ ID NO: 196798 - RNA, 19 nt, Homo sapiens
cuaccgcacugaugacuac

SEQ ID NO: 196799 - RNA, 19 nt, Homo sapiens
gggcaagaucuacaaagug

SEQ ID NO: 196800 - RNA, 19 nt, Homo sapiens
aaacagaacgacgucuuug

SEQ ID NO: 196801 - RNA, 19 nt, Homo sapiens
acaugaagcgcaaacagaa

SEQ ID NO: 196802 - RNA, 19 nt, Homo sapiens
cagggcaaguacauagcua

SEQ ID NO: 196803 - RNA, 19 nt, Homo sapiens
cgaggaauacgaugugauc

SEQ ID NO: 196804 - RNA, 19 nt, Homo sapiens
guggcaaacuucgaugaga

SEQ ID NO: 196805 - RNA, 19 nt, Homo sapiens
agagccagguguucuguuc

SEQ ID NO: 196806 - RNA, 19 nt, Homo sapiens
guuauccgcaucaucugua

SEQ ID NO: 196807 - RNA, 19 nt, Homo sapiens
ccauugaccagaaguuugu

SEQ ID NO: 196808 - RNA, 19 nt, Homo sapiens
ggagaccacggacccugaa

SEQ ID NO: 196809 - RNA, 19 nt, Homo sapiens
acgggcagcugguaaagau

SEQ ID NO: 196810 - RNA, 19 nt, Homo sapiens
gaaacccuuaucuugcaaa

SEQ ID NO: 196811 - RNA, 19 nt, Homo sapiens
cgacaucaaagacaucuac

SEQ ID NO: 196812 - RNA, 19 nt, Homo sapiens
cgacugcugcggugaagga

SEQ ID NO: 196813 - RNA, 19 nt, Homo sapiens
ugacgucuaccggaaguuu

SEQ ID NO: 196814 - RNA, 19 nt, Homo sapiens
aaaacaaaaccucccaaua

SEQ ID NO: 196815 - RNA, 19 nt, Homo sapiens
ggugggaaacccuuaucuu

SEQ ID NO: 196816 - RNA, 19 nt, Homo sapiens
gucuuuguguucuguggua

SEQ ID NO: 196817 - RNA, 19 nt, Homo sapiens
ccaaucugaugggcauguu

SEQ ID NO: 196818 - RNA, 19 nt, Homo sapiens
gaagcugagcagugauugu

SEQ ID NO: 196819 - RNA, 19 nt, Homo sapiens
gcccauugaccagaaguuu

SEQ ID NO: 196820 - RNA, 19 nt, Homo sapiens
cagguuauccgcaucaucu

SEQ ID NO: 196821 - RNA, 19 nt, Homo sapiens
gaccauggacgaggaauac

SEQ ID NO: 196822 - RNA, 19 nt, Homo sapiens
aaacuucgaugagaaugac

SEQ ID NO: 196823 - RNA, 19 nt, Homo sapiens
acagaacgacgucuuugga

SEQ ID NO: 196824 - RNA, 19 nt, Homo sapiens
gaugggcauguuugagaaa

SEQ ID NO: 196825 - RNA, 19 nt, Homo sapiens
acaaaccuguggaugacau

SEQ ID NO: 196826 - RNA, 19 nt, Homo sapiens
gagguugauuugcuguuuu

SEQ ID NO: 196827 - RNA, 19 nt, Homo sapiens
gcuauugccagcacuacug

SEQ ID NO: 196828 - RNA, 19 nt, Homo sapiens
ggaagucagacaucuacgu

SEQ ID NO: 196829 - RNA, 19 nt, Homo sapiens
gaagggagcuuugucuaua

SEQ ID NO: 196830 - RNA, 19 nt, Homo sapiens
gaucagaguuugacuuuga

SEQ ID NO: 196831 - RNA, 19 nt, Homo sapiens
gaagagcgcugugccagua

SEQ ID NO: 196832 - RNA, 19 nt, Homo sapiens
guaccuauaugcugaauaa

SEQ ID NO: 196833 - RNA, 19 nt, Homo sapiens
ggaagagacuggaauguug

SEQ ID NO: 196834 - RNA, 19 nt, Homo sapiens
guaagcagcucaucuguga

SEQ ID NO: 196835 - RNA, 19 nt, Homo sapiens
gaucaaccguguuaugaaa

SEQ ID NO: 196836 - RNA, 19 nt, Homo sapiens
gaaguacauugcuauaguu

SEQ ID NO: 196837 - RNA, 19 nt, Homo sapiens
gaauaaacccauugaagaa

SEQ ID NO: 196838 - RNA, 19 nt, Homo sapiens
caagaagaaugacaucuau

SEQ ID NO: 196839 - RNA, 19 nt, Homo sapiens
ggaaguacauugcuauagu

SEQ ID NO: 196840 - RNA, 19 nt, Homo sapiens
gaaaugaagcgcaagaaga

SEQ ID NO: 196841 - RNA, 19 nt, Homo sapiens
cagaacugaugauuacuua

SEQ ID NO: 196842 - RNA, 19 nt, Homo sapiens
gucaagacguuauagauuu

SEQ ID NO: 196843 - RNA, 19 nt, Homo sapiens
gcaagaagaaugacaucua

SEQ ID NO: 196844 - RNA, 19 nt, Homo sapiens
gaacugaugauuacuuaga

SEQ ID NO: 196845 - RNA, 19 nt, Homo sapiens
aaacgucgcuucaggaaau

SEQ ID NO: 196846 - RNA, 19 nt, Homo sapiens
cuaaugggauuguuugaaa

SEQ ID NO: 196847 - RNA, 19 nt, Homo sapiens
gaagaaaucauuguacaga

SEQ ID NO: 196848 - RNA, 19 nt, Homo sapiens
uaacaccauuggaagauuu

SEQ ID NO: 196849 - RNA, 19 nt, Homo sapiens
cucaagagcuggauccaua

SEQ ID NO: 196850 - RNA, 19 nt, Homo sapiens
guuaagaugcugcuuuaua

SEQ ID NO: 196851 - RNA, 19 nt, Homo sapiens
ccaaguuccuuauggcuaa

SEQ ID NO: 196852 - RNA, 19 nt, Homo sapiens
gaacagaaagccagaucuu

SEQ ID NO: 196853 - RNA, 19 nt, Homo sapiens
ggaaccaauugaacagaaa

SEQ ID NO: 196854 - RNA, 19 nt, Homo sapiens
guacaacuguggaaaccaa

SEQ ID NO: 196855 - RNA, 19 nt, Homo sapiens
uuacagaacugaugauuac

SEQ ID NO: 196856 - RNA, 19 nt, Homo sapiens
ccacaaguuugguuuaugu

SEQ ID NO: 196857 - RNA, 19 nt, Homo sapiens
guacauugcuauaguuagu

SEQ ID NO: 196858 - RNA, 19 nt, Homo sapiens
caagggaaguacauugcua

SEQ ID NO: 196859 - RNA, 19 nt, Homo sapiens
gucaugcucuugcacuuua

SEQ ID NO: 196860 - RNA, 19 nt, Homo sapiens
guaacucgcuaucuggauu

SEQ ID NO: 196861 - RNA, 19 nt, Homo sapiens
ccaaggagccugagaagga

SEQ ID NO: 196862 - RNA, 19 nt, Homo sapiens
gagaggaagcgaacauaaa

SEQ ID NO: 196863 - RNA, 19 nt, Homo sapiens
ugaauaaacccauugaaga

SEQ ID NO: 196864 - RNA, 19 nt, Homo sapiens
gcuaagugcuauuuaugga

SEQ ID NO: 196865 - RNA, 19 nt, Homo sapiens
ggagaggaagcgaacauaa

SEQ ID NO: 196866 - RNA, 19 nt, Homo sapiens
gaugacaggaucagaguuu

SEQ ID NO: 196867 - RNA, 19 nt, Homo sapiens
gacaacgugugaugacauu

SEQ ID NO: 196868 - RNA, 19 nt, Homo sapiens
ccaagucaaucgaaaguca

SEQ ID NO: 196869 - RNA, 19 nt, Homo sapiens
caaaauggcuccaaaugau

SEQ ID NO: 196870 - RNA, 19 nt, Homo sapiens
cccuucaccuuucuaauua

SEQ ID NO: 196871 - RNA, 19 nt, Homo sapiens
gcacaagggaaguacauug

SEQ ID NO: 196872 - RNA, 19 nt, Homo sapiens
ggucaagacguuauagauu

SEQ ID NO: 196873 - RNA, 19 nt, Homo sapiens
gaagagacuggaauguuga

SEQ ID NO: 196874 - RNA, 19 nt, Homo sapiens
gaaaguucuucauauggau

SEQ ID NO: 196875 - RNA, 19 nt, Homo sapiens
gaaauuuguuagcaucagu

SEQ ID NO: 196876 - RNA, 19 nt, Homo sapiens
cagaagcccuggcaucuag

SEQ ID NO: 196877 - RNA, 19 nt, Homo sapiens
gguauaaugucagugaaug

SEQ ID NO: 196878 - RNA, 19 nt, Homo sapiens
caacgugugaugacauuaa

SEQ ID NO: 196879 - RNA, 19 nt, Homo sapiens
ugguuaagaugcugcuuua

SEQ ID NO: 196880 - RNA, 19 nt, Homo sapiens
uaaagcgggucaaguguag

SEQ ID NO: 196881 - RNA, 19 nt, Homo sapiens
agacuggaauguugacuug

SEQ ID NO: 196882 - RNA, 19 nt, Homo sapiens
gcaguuaccacauucuguu

SEQ ID NO: 196883 - RNA, 19 nt, Homo sapiens
uagcauagccacaaguuug

SEQ ID NO: 196884 - RNA, 19 nt, Homo sapiens
uucaggagauucuaaauug

SEQ ID NO: 196885 - RNA, 19 nt, Homo sapiens
gaaguuaaacaaacauugg

SEQ ID NO: 196886 - RNA, 19 nt, Homo sapiens
ggaaaucagaccagcuuug

SEQ ID NO: 196887 - RNA, 19 nt, Homo sapiens
caaggagccugagaaggaa

SEQ ID NO: 196888 - RNA, 19 nt, Homo sapiens
gcaaggcuaagugcuauuu

SEQ ID NO: 196889 - RNA, 19 nt, Homo sapiens
cgagauguguauaagaaau

SEQ ID NO: 196890 - RNA, 19 nt, Homo sapiens
uuaagaugcugcuuuauac

SEQ ID NO: 196891 - RNA, 19 nt, Homo sapiens
uaaaguugaugagagagaa

SEQ ID NO: 196892 - RNA, 19 nt, Homo sapiens
gaguggcuauucagcauug

SEQ ID NO: 196893 - RNA, 19 nt, Homo sapiens
caucuagccuaaugggauu

SEQ ID NO: 196894 - RNA, 19 nt, Homo sapiens
gcuaauggucagcugguua

SEQ ID NO: 196895 - RNA, 19 nt, Homo sapiens
ccaaauagcauagccacaa

SEQ ID NO: 196896 - RNA, 19 nt, Homo sapiens
aaaugaagcgcaagaagaa

SEQ ID NO: 196897 - RNA, 19 nt, Homo sapiens
ggagaaauugcucgcugua

SEQ ID NO: 196898 - RNA, 19 nt, Homo sapiens
ucaggagauucuaaauuga

SEQ ID NO: 196899 - RNA, 19 nt, Homo sapiens
ccacauucuguucaauuua

SEQ ID NO: 196900 - RNA, 19 nt, Homo sapiens
caaauagcauagccacaag

SEQ ID NO: 196901 - RNA, 19 nt, Homo sapiens
ggacagcauccggaaguuu

SEQ ID NO: 196902 - RNA, 19 nt, Homo sapiens
acagacaacuugagacagu

SEQ ID NO: 196903 - RNA, 19 nt, Homo sapiens
gaguuugacuuugaggaaa

SEQ ID NO: 196904 - RNA, 19 nt, Homo sapiens
gaacauaaagcgggucaag

SEQ ID NO: 196905 - RNA, 19 nt, Homo sapiens
gcagaagcccuggcaucua

SEQ ID NO: 196906 - RNA, 19 nt, Homo sapiens
gugcaucuauaacaccauu

SEQ ID NO: 196907 - RNA, 19 nt, Homo sapiens
cgacacagacaacuugaga

SEQ ID NO: 196908 - RNA, 19 nt, Homo sapiens
gaaaucagaccagcuuugg

SEQ ID NO: 196909 - RNA, 19 nt, Homo sapiens
uaaaagaucggguagaaaa

SEQ ID NO: 196910 - RNA, 19 nt, Homo sapiens
agaaauugcucgcuguaag

SEQ ID NO: 196911 - RNA, 19 nt, Homo sapiens
gcacuuuacagaacugaug

SEQ ID NO: 196912 - RNA, 19 nt, Homo sapiens
gcccuggcaucuagccuaa

SEQ ID NO: 196913 - RNA, 19 nt, Homo sapiens
gcagggcccaaauagcaua

SEQ ID NO: 196914 - RNA, 19 nt, Homo sapiens
gaucaccacccgagucaau

SEQ ID NO: 196915 - RNA, 19 nt, Homo sapiens
ggccaggugaucagaguua

SEQ ID NO: 196916 - RNA, 19 nt, Homo sapiens
ugcgagauguguauaagaa

SEQ ID NO: 196917 - RNA, 19 nt, Homo sapiens
guucaggagauucuaaauu

SEQ ID NO: 196918 - RNA, 19 nt, Homo sapiens
gaaccaagucaaucgaaag

SEQ ID NO: 196919 - RNA, 19 nt, Homo sapiens
ugauuugggucaagacguu

SEQ ID NO: 196920 - RNA, 19 nt, Homo sapiens
agacauagggagucauuug

SEQ ID NO: 196921 - RNA, 19 nt, Homo sapiens
ggaaaugaagcgcaagaag

SEQ ID NO: 196922 - RNA, 19 nt, Homo sapiens
gucagugaauggcaagaaa

SEQ ID NO: 196923 - RNA, 19 nt, Homo sapiens
caggugaucagaguuauuu

SEQ ID NO: 196924 - RNA, 19 nt, Homo sapiens
gacggaauguauccuguca

SEQ ID NO: 196925 - RNA, 19 nt, Homo sapiens
uugaaggcauugauccuaa

SEQ ID NO: 196926 - RNA, 19 nt, Homo sapiens
aagggagcuuugucuauaa

SEQ ID NO: 196927 - RNA, 19 nt, Homo sapiens
agagguaacucgcuaucug

SEQ ID NO: 196928 - RNA, 19 nt, Homo sapiens
ucaaguguagugcaucuuu

SEQ ID NO: 196929 - RNA, 19 nt, Homo sapiens
uaagaaagcauuccgcuaa

SEQ ID NO: 196930 - RNA, 19 nt, Homo sapiens
caaauaugccagaggauua

SEQ ID NO: 196931 - RNA, 19 nt, Homo sapiens
gcagacccaucgccuuuga

SEQ ID NO: 196932 - RNA, 19 nt, Homo sapiens
gcuggugagugacaaagua

SEQ ID NO: 196933 - RNA, 19 nt, Homo sapiens
auagaaggcuggugaguga

SEQ ID NO: 196934 - RNA, 19 nt, Homo sapiens
gaaaaggucaccagauaaa

SEQ ID NO: 196935 - RNA, 19 nt, Homo sapiens
ugucuuaacugcaauacau

SEQ ID NO: 196936 - RNA, 19 nt, Homo sapiens
gcuaaaagguguggaugua

SEQ ID NO: 196937 - RNA, 19 nt, Homo sapiens
gagcagugacucaaauaug

SEQ ID NO: 196938 - RNA, 19 nt, Homo sapiens
aagaaagcauuccgcuaaa

SEQ ID NO: 196939 - RNA, 19 nt, Homo sapiens
cugaaaaggucaccagaua

SEQ ID NO: 196940 - RNA, 19 nt, Homo sapiens
ugagacaacguacgacaaa

SEQ ID NO: 196941 - RNA, 19 nt, Homo sapiens
gguugugucuuaacugcaa

SEQ ID NO: 196942 - RNA, 19 nt, Homo sapiens
gguuuaccauauucuaaga

SEQ ID NO: 196943 - RNA, 19 nt, Homo sapiens
caaauggcagugcuuccua

SEQ ID NO: 196944 - RNA, 19 nt, Homo sapiens
ucaaauaugccagaggauu

SEQ ID NO: 196945 - RNA, 19 nt, Homo sapiens
ugacuugggucugggcuau

SEQ ID NO: 196946 - RNA, 19 nt, Homo sapiens
caaaguagggcaggcaugu

SEQ ID NO: 196947 - RNA, 19 nt, Homo sapiens
gaaggcuggugagugacaa

SEQ ID NO: 196948 - RNA, 19 nt, Homo sapiens
cagcggcucuugcgaugca

SEQ ID NO: 196949 - RNA, 19 nt, Homo sapiens
gucaccagauaaacaaaug

SEQ ID NO: 196950 - RNA, 19 nt, Homo sapiens
gaugaugaccugucguuuu

SEQ ID NO: 196951 - RNA, 19 nt, Homo sapiens
ggucugggcuaugaaacca

SEQ ID NO: 196952 - RNA, 19 nt, Homo sapiens
caacguacgacaaaauauu

SEQ ID NO: 196953 - RNA, 19 nt, Homo sapiens
gacaacguacgacaaaaua

SEQ ID NO: 196954 - RNA, 19 nt, Homo sapiens
aaaggucaccagauaaaca

SEQ ID NO: 196955 - RNA, 19 nt, Homo sapiens
uaaaagguguggauguauc

SEQ ID NO: 196956 - RNA, 19 nt, Homo sapiens
cagcugagacaacguacga

SEQ ID NO: 196957 - RNA, 19 nt, Homo sapiens
uauucaagccaccauuaaa

SEQ ID NO: 196958 - RNA, 19 nt, Homo sapiens
uuuauucaagccaccauua

SEQ ID NO: 196959 - RNA, 19 nt, Homo sapiens
gaaaccaaggaggaacuga

SEQ ID NO: 196960 - RNA, 19 nt, Homo sapiens
ggucaccagauaaacaaau

SEQ ID NO: 196961 - RNA, 19 nt, Homo sapiens
uugcagacccaucgccuuu

SEQ ID NO: 196962 - RNA, 19 nt, Homo sapiens
uuauucaagccaccauuaa

SEQ ID NO: 196963 - RNA, 19 nt, Homo sapiens
ccaaggaggaacugauuuu

SEQ ID NO: 196964 - RNA, 19 nt, Homo sapiens
aaccaaggaggaacugauu

SEQ ID NO: 196965 - RNA, 19 nt, Homo sapiens
aaauaugccagaggauuau

SEQ ID NO: 196966 - RNA, 19 nt, Homo sapiens
gaaagcauuccgcuaaaag

SEQ ID NO: 196967 - RNA, 19 nt, Homo sapiens
uaaacaaauggcagugcuu

SEQ ID NO: 196968 - RNA, 19 nt, Homo sapiens
gcagggagcuagcguauua

SEQ ID NO: 196969 - RNA, 19 nt, Homo sapiens
gaacuaggcucaucagaau

SEQ ID NO: 196970 - RNA, 19 nt, Homo sapiens
ucacagcucugcucuauuu

SEQ ID NO: 196971 - RNA, 19 nt, Homo sapiens
ggaccuugcuggaaacaaa

SEQ ID NO: 196972 - RNA, 19 nt, Homo sapiens
uaagaaagcugucaaugag

SEQ ID NO: 196973 - RNA, 19 nt, Homo sapiens
gaagauacauaugaacgaa

SEQ ID NO: 196974 - RNA, 19 nt, Homo sapiens
ccauggagcuagaauugua

SEQ ID NO: 196975 - RNA, 19 nt, Homo sapiens
ucacauguguuucuucuau

SEQ ID NO: 196976 - RNA, 19 nt, Homo sapiens
gggagaagauacauaugaa

SEQ ID NO: 196977 - RNA, 19 nt, Homo sapiens
caacgaugacucugaauaa

SEQ ID NO: 196978 - RNA, 19 nt, Homo sapiens
gcucugcucuauuuauuau

SEQ ID NO: 196979 - RNA, 19 nt, Homo sapiens
caaagaaugccuagaacaa

SEQ ID NO: 196980 - RNA, 19 nt, Homo sapiens
gaaacaaaggcuuagcaaa

SEQ ID NO: 196981 - RNA, 19 nt, Homo sapiens
ucaaugaguuucuucaaag

SEQ ID NO: 196982 - RNA, 19 nt, Homo sapiens
ccaguguucugauauguga

SEQ ID NO: 196983 - RNA, 19 nt, Homo sapiens
gaggacauucccauaauuu

SEQ ID NO: 196984 - RNA, 19 nt, Homo sapiens
cgaugacucugaauaaugu

SEQ ID NO: 196985 - RNA, 19 nt, Homo sapiens
agaaagcugucaaugaguu

SEQ ID NO: 196986 - RNA, 19 nt, Homo sapiens
ggaaagugcaacgauuaua

SEQ ID NO: 196987 - RNA, 19 nt, Homo sapiens
gucaaugaguuucuucaaa

SEQ ID NO: 196988 - RNA, 19 nt, Homo sapiens
cagcucugcucuauuuauu

SEQ ID NO: 196989 - RNA, 19 nt, Homo sapiens
uaagauccauggagcuaga

SEQ ID NO: 196990 - RNA, 19 nt, Homo sapiens
cagaggacauucccauaau

SEQ ID NO: 196991 - RNA, 19 nt, Homo sapiens
acgcauaccugauugucua

SEQ ID NO: 196992 - RNA, 19 nt, Homo sapiens
uuacaaagaaugccuagaa

SEQ ID NO: 196993 - RNA, 19 nt, Homo sapiens
gaaagugcaacgauuauac

SEQ ID NO: 196994 - RNA, 19 nt, Homo sapiens
acaagaauauggccuucaa

SEQ ID NO: 196995 - RNA, 19 nt, Homo sapiens
auacaugugucccuuauag

SEQ ID NO: 196996 - RNA, 19 nt, Homo sapiens
ggaaacaaaggcuuagcaa

SEQ ID NO: 196997 - RNA, 19 nt, Homo sapiens
aagaaugccuagaacaaga

SEQ ID NO: 196998 - RNA, 19 nt, Homo sapiens
ugucacagcucugcucuau

SEQ ID NO: 196999 - RNA, 19 nt, Homo sapiens
aaacaaaggcuuagcaaac

SEQ ID NO: 197000 - RNA, 19 nt, Homo sapiens
ucagaaucgugacuauuau

SEQ ID NO: 197001 - RNA, 19 nt, Homo sapiens
gagcuagaauuguagaacu

SEQ ID NO: 197002 - RNA, 19 nt, Homo sapiens
gaaagcugucaaugaguuu

SEQ ID NO: 197003 - RNA, 19 nt, Homo sapiens
gaggauguguuugguguuc

SEQ ID NO: 197004 - RNA, 19 nt, Homo sapiens
ugaccucucuguacucuag

SEQ ID NO: 197005 - RNA, 19 nt, Homo sapiens
auaagaaagcugucaauga

SEQ ID NO: 197006 - RNA, 19 nt, Homo sapiens
gaacaagaacuuuucauca

SEQ ID NO: 197007 - RNA, 19 nt, Homo sapiens
cgauuauacuccuggauau

SEQ ID NO: 197008 - RNA, 19 nt, Homo sapiens
ucacccagaugucccuuug

SEQ ID NO: 197009 - RNA, 19 nt, Homo sapiens
guucugauaugugacuuug

SEQ ID NO: 197010 - RNA, 19 nt, Homo sapiens
agaggacauucccauaauu

SEQ ID NO: 197011 - RNA, 19 nt, Homo sapiens
ucaacgaugacucugaaua

SEQ ID NO: 197012 - RNA, 19 nt, Homo sapiens
acagaggacauucccauaa

SEQ ID NO: 197013 - RNA, 19 nt, Homo sapiens
uuucuggacucaacgauga

SEQ ID NO: 197014 - RNA, 19 nt, Homo sapiens
agccugaccuugcuauuug

SEQ ID NO: 197015 - RNA, 19 nt, Homo sapiens
gacagaggacauucccaua

SEQ ID NO: 197016 - RNA, 19 nt, Homo sapiens
gcugggagaagauacauau

SEQ ID NO: 197017 - RNA, 19 nt, Homo sapiens
ugauacaugugucccuuau

SEQ ID NO: 197018 - RNA, 19 nt, Homo sapiens
aacaaaggcuuagcaaaca

SEQ ID NO: 197019 - RNA, 19 nt, Homo sapiens
agaaagagccccaccagua

SEQ ID NO: 197020 - RNA, 19 nt, Homo sapiens
acucaacgaugacucugaa

SEQ ID NO: 197021 - RNA, 19 nt, Homo sapiens
gcgaggugcugggagaaga

SEQ ID NO: 197022 - RNA, 19 nt, Homo sapiens
acaaaggcuuagcaaacaa

SEQ ID NO: 197023 - RNA, 19 nt, Homo sapiens
gcgcucagcacugggauuu

SEQ ID NO: 197024 - RNA, 19 nt, Homo sapiens
aucagaaucgugacuauua

SEQ ID NO: 197025 - RNA, 19 nt, Homo sapiens
agaacuaggcucaucagaa

SEQ ID NO: 197026 - RNA, 19 nt, Homo sapiens
guucacauguguuucuucu

SEQ ID NO: 197027 - RNA, 19 nt, Homo sapiens
gcaugggaaaugaaagauu

SEQ ID NO: 197028 - RNA, 19 nt, Homo sapiens
caucugagcugcgaaucca

SEQ ID NO: 197029 - RNA, 19 nt, Homo sapiens
gggaaagugcaacgauuau

SEQ ID NO: 197030 - RNA, 19 nt, Homo sapiens
caacgugaaggagcuguuu

SEQ ID NO: 197031 - RNA, 19 nt, Homo sapiens
gccgagaagugucuguauc

SEQ ID NO: 197032 - RNA, 19 nt, Homo sapiens
ugaccuugcuauuugaaca

SEQ ID NO: 197033 - RNA, 19 nt, Homo sapiens
gccaugaccucucuguacu

SEQ ID NO: 197034 - RNA, 19 nt, Homo sapiens
gaauuauugauacccugua

SEQ ID NO: 197035 - RNA, 19 nt, Homo sapiens
gauacaugugucccuuaua

SEQ ID NO: 197036 - RNA, 19 nt, Homo sapiens
uaaguuagaugugguuucc

SEQ ID NO: 197037 - RNA, 19 nt, Homo sapiens
ccuucaagcucaaguccaa

SEQ ID NO: 197038 - RNA, 19 nt, Homo sapiens
ggacagcaaggagaagaau

SEQ ID NO: 197039 - RNA, 19 nt, Homo sapiens
ccugugcagugguguuuga

SEQ ID NO: 197040 - RNA, 19 nt, Homo sapiens
caaugaguuucuucaaagg

SEQ ID NO: 197041 - RNA, 19 nt, Homo sapiens
acagcaaggagaagaauga

SEQ ID NO: 197042 - RNA, 19 nt, Homo sapiens
acgauuauacuccuggaua

SEQ ID NO: 197043 - RNA, 19 nt, Homo sapiens
ugggagaagauacauauga

SEQ ID NO: 197044 - RNA, 19 nt, Homo sapiens
cacauguguuucuucuauu

SEQ ID NO: 197045 - RNA, 19 nt, Homo sapiens
cauauagaauugggaacug

SEQ ID NO: 197046 - RNA, 19 nt, Homo sapiens
cagaaucgugacuauuauu

SEQ ID NO: 197047 - RNA, 19 nt, Homo sapiens
ggaaaagccugaccuugcu

SEQ ID NO: 197048 - RNA, 19 nt, Homo sapiens
ggacauucccauaauuuug

SEQ ID NO: 197049 - RNA, 19 nt, Homo sapiens
auugggaacugauacaugu

SEQ ID NO: 197050 - RNA, 19 nt, Homo sapiens
ucaucagaaucgugacuau

SEQ ID NO: 197051 - RNA, 19 nt, Homo sapiens
ucugauaugugacuuugag

SEQ ID NO: 197052 - RNA, 19 nt, Homo sapiens
ggagagcaugcccaggaaa

SEQ ID NO: 197053 - RNA, 19 nt, Homo sapiens
guguuugacugcaaguuca

SEQ ID NO: 197054 - RNA, 19 nt, Homo sapiens
ggggaaagugcaacgauua

SEQ ID NO: 197055 - RNA, 19 nt, Homo sapiens
caaaggcuuagcaaacaau

SEQ ID NO: 197056 - RNA, 19 nt, Homo sapiens
gauguggaccuugcuggaa

SEQ ID NO: 197057 - RNA, 19 nt, Homo sapiens
uauuauugcuccaucaaac

SEQ ID NO: 197058 - RNA, 19 nt, Homo sapiens
gauccauggagcuagaauu

SEQ ID NO: 197059 - RNA, 19 nt, Homo sapiens
ugggaccaauaaucuauau

SEQ ID NO: 197060 - RNA, 19 nt, Homo sapiens
uugauacccuguagugcaa

SEQ ID NO: 197061 - RNA, 19 nt, Homo sapiens
gagaagagaaccccuggaa

SEQ ID NO: 197062 - RNA, 19 nt, Homo sapiens
ucacagaccgagcgagcuu

SEQ ID NO: 197063 - RNA, 19 nt, Homo sapiens
agaaucgugacuauuauug

SEQ ID NO: 197064 - RNA, 19 nt, Homo sapiens
caucagaaucgugacuauu

SEQ ID NO: 197065 - RNA, 19 nt, Homo sapiens
ggagcuguuugagggcauu

SEQ ID NO: 197066 - RNA, 19 nt, Homo sapiens
auauagaauugggaacuga

SEQ ID NO: 197067 - RNA, 19 nt, Homo sapiens
gggagagagugggaguuuc

SEQ ID NO: 197068 - RNA, 19 nt, Homo sapiens
ggcagaagcuccaggauga

SEQ ID NO: 197069 - RNA, 19 nt, Homo sapiens
gcacuuggccucuggauug

SEQ ID NO: 197070 - RNA, 19 nt, Homo sapiens
caaccuggcugccuauaga

SEQ ID NO: 197071 - RNA, 19 nt, Homo sapiens
ggaagugacucauccucuu

SEQ ID NO: 197072 - RNA, 19 nt, Homo sapiens
ugaagacacuggcucauau

SEQ ID NO: 197073 - RNA, 19 nt, Homo sapiens
uagcugggauuauagauug

SEQ ID NO: 197074 - RNA, 19 nt, Homo sapiens
gaggagauccgguucuuga

SEQ ID NO: 197075 - RNA, 19 nt, Homo sapiens
gcaugacuuugucccauuu

SEQ ID NO: 197076 - RNA, 19 nt, Homo sapiens
gccagcagcuugcguuaga

SEQ ID NO: 197077 - RNA, 19 nt, Homo sapiens
gcaauggcguccagcaaca

SEQ ID NO: 197078 - RNA, 19 nt, Homo sapiens
ggagcucaaugaccgcuuu

SEQ ID NO: 197079 - RNA, 19 nt, Homo sapiens
gcacgaagccaacgacuac

SEQ ID NO: 197080 - RNA, 19 nt, Homo sapiens
ucagaggguuguucuccua

SEQ ID NO: 197081 - RNA, 19 nt, Homo sapiens
gaagacacuggcucauauu

SEQ ID NO: 197082 - RNA, 19 nt, Homo sapiens
gcccuaggcuccgucagua

SEQ ID NO: 197083 - RNA, 19 nt, Homo sapiens
gaagugacucauccucuug

SEQ ID NO: 197084 - RNA, 19 nt, Homo sapiens
gcagcuugcguuagaauga

SEQ ID NO: 197085 - RNA, 19 nt, Homo sapiens
caacuccaacuaacaagaa

SEQ ID NO: 197086 - RNA, 19 nt, Homo sapiens
gaauuaaggaagugacuca

SEQ ID NO: 197087 - RNA, 19 nt, Homo sapiens
ggaaacuguugccagagau

SEQ ID NO: 197088 - RNA, 19 nt, Homo sapiens
gacuuugucccauuucuaa

SEQ ID NO: 197089 - RNA, 19 nt, Homo sapiens
gguugugggugaccaguug

SEQ ID NO: 197090 - RNA, 19 nt, Homo sapiens
gaacaaccuggcugccuau

SEQ ID NO: 197091 - RNA, 19 nt, Homo sapiens
gugaagacacuggcucaua

SEQ ID NO: 197092 - RNA, 19 nt, Homo sapiens
ggcaugacuuugucccauu

SEQ ID NO: 197093 - RNA, 19 nt, Homo sapiens
cuguguagcugggauuaua

SEQ ID NO: 197094 - RNA, 19 nt, Homo sapiens
gggcagggcaugacuuugu

SEQ ID NO: 197095 - RNA, 19 nt, Homo sapiens
gcacugcugcugccuuuag

SEQ ID NO: 197096 - RNA, 19 nt, Homo sapiens
gagcagaagcaggauaguu

SEQ ID NO: 197097 - RNA, 19 nt, Homo sapiens
cuacaucgcccuccacauc

SEQ ID NO: 197098 - RNA, 19 nt, Homo sapiens
ccgcagcccugaaagagau

SEQ ID NO: 197099 - RNA, 19 nt, Homo sapiens
uggaaacuguugccagaga

SEQ ID NO: 197100 - RNA, 19 nt, Homo sapiens
cggaguaucugggaacugu

SEQ ID NO: 197101 - RNA, 19 nt, Homo sapiens
ccugauuccuguuguuaug

SEQ ID NO: 197102 - RNA, 19 nt, Homo sapiens
cagcaacuccaacuaacaa

SEQ ID NO: 197103 - RNA, 19 nt, Homo sapiens
agaggaacaucguggugaa

SEQ ID NO: 197104 - RNA, 19 nt, Homo sapiens
ccaaggagcccaccaagcu

SEQ ID NO: 197105 - RNA, 19 nt, Homo sapiens
ugccuaggcugaccuugaa

SEQ ID NO: 197106 - RNA, 19 nt, Homo sapiens
uggagguucucucggagua

SEQ ID NO: 197107 - RNA, 19 nt, Homo sapiens
gggauggagaggucauuaa

SEQ ID NO: 197108 - RNA, 19 nt, Homo sapiens
ucagaaggccaccucaaga

SEQ ID NO: 197109 - RNA, 19 nt, Homo sapiens
aaauguacccaguauucua

SEQ ID NO: 197110 - RNA, 19 nt, Homo sapiens
gcaacuccaacuaacaaga

SEQ ID NO: 197111 - RNA, 19 nt, Homo sapiens
auggagaggucauuaagga

SEQ ID NO: 197112 - RNA, 19 nt, Homo sapiens
gagaaccggaucaccauuc

SEQ ID NO: 197113 - RNA, 19 nt, Homo sapiens
ugggacugcugcuucuuaa

SEQ ID NO: 197114 - RNA, 19 nt, Homo sapiens
ggacgcugguagagaugga

SEQ ID NO: 197115 - RNA, 19 nt, Homo sapiens
caaaauguacccaguauuc

SEQ ID NO: 197116 - RNA, 19 nt, Homo sapiens
guagcugggauuauagauu

SEQ ID NO: 197117 - RNA, 19 nt, Homo sapiens
caccucagccuccugugua

SEQ ID NO: 197118 - RNA, 19 nt, Homo sapiens
ccagcuacaucgagaaggu

SEQ ID NO: 197119 - RNA, 19 nt, Homo sapiens
acaucgagaucgccaccua

SEQ ID NO: 197120 - RNA, 19 nt, Homo sapiens
ccaacuaacaagaaacuca

SEQ ID NO: 197121 - RNA, 19 nt, Homo sapiens
ggauggagaggucauuaag

SEQ ID NO: 197122 - RNA, 19 nt, Homo sapiens
gagaugauggagcucaaug

SEQ ID NO: 197123 - RNA, 19 nt, Homo sapiens
gagguucucucggaguauc

SEQ ID NO: 197124 - RNA, 19 nt, Homo sapiens
gaaacuguugccagagaug

SEQ ID NO: 197125 - RNA, 19 nt, Homo sapiens
cgccucugcuggcacauuu

SEQ ID NO: 197126 - RNA, 19 nt, Homo sapiens
gucuggaucuggagaggaa

SEQ ID NO: 197127 - RNA, 19 nt, Homo sapiens
ccagugagcgggcagagau

SEQ ID NO: 197128 - RNA, 19 nt, Homo sapiens
ccaagcaggagcacaagga

SEQ ID NO: 197129 - RNA, 19 nt, Homo sapiens
acucaaugcuggcuucaag

SEQ ID NO: 197130 - RNA, 19 nt, Homo sapiens
ggagaaccggaucaccauu

SEQ ID NO: 197131 - RNA, 19 nt, Homo sapiens
cagagaugauggagcucaa

SEQ ID NO: 197132 - RNA, 19 nt, Homo sapiens
guagugcccuauuuuacaa

SEQ ID NO: 197133 - RNA, 19 nt, Homo sapiens
cucuugcggucccuucuua

SEQ ID NO: 197134 - RNA, 19 nt, Homo sapiens
ggaacaucguggugaagac

SEQ ID NO: 197135 - RNA, 19 nt, Homo sapiens
cagaagcuccaggaugaaa

SEQ ID NO: 197136 - RNA, 19 nt, Homo sapiens
gacacuggcucauauuccu

SEQ ID NO: 197137 - RNA, 19 nt, Homo sapiens
aaacugaggcacgagcaaa

SEQ ID NO: 197138 - RNA, 19 nt, Homo sapiens
gaacuccugggcucaagca

SEQ ID NO: 197139 - RNA, 19 nt, Homo sapiens
caaguuugcagaccugaca

SEQ ID NO: 197140 - RNA, 19 nt, Homo sapiens
ugguaccgcuccaaguuug

SEQ ID NO: 197141 - RNA, 19 nt, Homo sapiens
ugacuuugucccauuucua

SEQ ID NO: 197142 - RNA, 19 nt, Homo sapiens
gcuugauucucagcacuug

SEQ ID NO: 197143 - RNA, 19 nt, Homo sapiens
gaucaacucaccgccaaca

SEQ ID NO: 197144 - RNA, 19 nt, Homo sapiens
ucugggaacugugccuuug

SEQ ID NO: 197145 - RNA, 19 nt, Homo sapiens
gcagaagcuccaggaugaa

SEQ ID NO: 197146 - RNA, 19 nt, Homo sapiens
ugccagagauggagguucu

SEQ ID NO: 197147 - RNA, 19 nt, Homo sapiens
ccucaccgcagcccugaaa

SEQ ID NO: 197148 - RNA, 19 nt, Homo sapiens
ccucuuccuugcuguguca

SEQ ID NO: 197149 - RNA, 19 nt, Homo sapiens
ggugaagaccguggagaug

SEQ ID NO: 197150 - RNA, 19 nt, Homo sapiens
gugguaccgcuccaaguuu

SEQ ID NO: 197151 - RNA, 19 nt, Homo sapiens
guucuccucuccccucuaa

SEQ ID NO: 197152 - RNA, 19 nt, Homo sapiens
gauggaggaggaggcaauu

SEQ ID NO: 197153 - RNA, 19 nt, Homo sapiens
agcagaagcaggauaguug

SEQ ID NO: 197154 - RNA, 19 nt, Homo sapiens
ucaaugcuggcuucaagga

SEQ ID NO: 197155 - RNA, 19 nt, Homo sapiens
cacaaaauguacccaguau

SEQ ID NO: 197156 - RNA, 19 nt, Homo sapiens
ggacugcugcuucuuaacc

SEQ ID NO: 197157 - RNA, 19 nt, Homo sapiens
ggcagggcaugacuuuguc

SEQ ID NO: 197158 - RNA, 19 nt, Homo sapiens
gcguuagaaugaggaggaa

SEQ ID NO: 197159 - RNA, 19 nt, Homo sapiens
caagcuggcagacgucuac

SEQ ID NO: 197160 - RNA, 19 nt, Homo sapiens
ggaggagauccgguucuug

SEQ ID NO: 197161 - RNA, 19 nt, Homo sapiens
cugggacugcugcuucuua

SEQ ID NO: 197162 - RNA, 19 nt, Homo sapiens
gauugugggaauuaaggaa

SEQ ID NO: 197163 - RNA, 19 nt, Homo sapiens
ccucuggauugugggaauu

SEQ ID NO: 197164 - RNA, 19 nt, Homo sapiens
gaggguuguucuccuagac

SEQ ID NO: 197165 - RNA, 19 nt, Homo sapiens
ugauuccuguuguuaugga

SEQ ID NO: 197166 - RNA, 19 nt, Homo sapiens
cagaaggccaccucaagag

SEQ ID NO: 197167 - RNA, 19 nt, Homo sapiens
ucaccgcagcccugaaaga

SEQ ID NO: 197168 - RNA, 19 nt, Homo sapiens
gaaccuggcuucaguauau

SEQ ID NO: 197169 - RNA, 19 nt, Homo sapiens
gcaaggacguugauugguu

SEQ ID NO: 197170 - RNA, 19 nt, Homo sapiens
cagaguagcugauguagga

SEQ ID NO: 197171 - RNA, 19 nt, Homo sapiens
ggagugauguggcuuugaa

SEQ ID NO: 197172 - RNA, 19 nt, Homo sapiens
ggagugugcugaagaccua

SEQ ID NO: 197173 - RNA, 19 nt, Homo sapiens
gcucugugcugcucacuuu

SEQ ID NO: 197174 - RNA, 19 nt, Homo sapiens
gcagggcacucauuaaagu

SEQ ID NO: 197175 - RNA, 19 nt, Homo sapiens
aaacuucacuuugccuuaa

SEQ ID NO: 197176 - RNA, 19 nt, Homo sapiens
caaaugaaacgcugaagug

SEQ ID NO: 197177 - RNA, 19 nt, Homo sapiens
gggcagggcacucauuaaa

SEQ ID NO: 197178 - RNA, 19 nt, Homo sapiens
agacauggcccaguucaua

SEQ ID NO: 197179 - RNA, 19 nt, Homo sapiens
ggaaguucuuggcggguuu

SEQ ID NO: 197180 - RNA, 19 nt, Homo sapiens
gccauugccuucccacuau

SEQ ID NO: 197181 - RNA, 19 nt, Homo sapiens
gaauaaaacuucacuuugc

SEQ ID NO: 197182 - RNA, 19 nt, Homo sapiens
gcgcuucucucuggccuuu

SEQ ID NO: 197183 - RNA, 19 nt, Homo sapiens
gaagcgggacaccaaguuu

SEQ ID NO: 197184 - RNA, 19 nt, Homo sapiens
gaacagcaaggacguugau

SEQ ID NO: 197185 - RNA, 19 nt, Homo sapiens
gcucaguccuacagggaaa

SEQ ID NO: 197186 - RNA, 19 nt, Homo sapiens
ccagguggcacaaauaaga

SEQ ID NO: 197187 - RNA, 19 nt, Homo sapiens
gggauggcauggagugaug

SEQ ID NO: 197188 - RNA, 19 nt, Homo sapiens
gaccacagggugagaguga

SEQ ID NO: 197189 - RNA, 19 nt, Homo sapiens
ggccagaguagcugaugua

SEQ ID NO: 197190 - RNA, 19 nt, Homo sapiens
gcugcuggcuucuguagag

SEQ ID NO: 197191 - RNA, 19 nt, Homo sapiens
gaaacgcugaagugacuga

SEQ ID NO: 197192 - RNA, 19 nt, Homo sapiens
gcucacuucaucagaguuu

SEQ ID NO: 197193 - RNA, 19 nt, Homo sapiens
aagcucaggucgggucuuu

SEQ ID NO: 197194 - RNA, 19 nt, Homo sapiens
ggccauugccuucccacua

SEQ ID NO: 197195 - RNA, 19 nt, Homo sapiens
uggcccaguucauacauuu

SEQ ID NO: 197196 - RNA, 19 nt, Homo sapiens
acgcugaagugacugagaa

SEQ ID NO: 197197 - RNA, 19 nt, Homo sapiens
gccagagccuguugugucu

SEQ ID NO: 197198 - RNA, 19 nt, Homo sapiens
ggauggcuccugugacuag

SEQ ID NO: 197199 - RNA, 19 nt, Homo sapiens
gagaaccuggcuucaguau

SEQ ID NO: 197200 - RNA, 19 nt, Homo sapiens
gugcugaagaccuaagaaa

SEQ ID NO: 197201 - RNA, 19 nt, Homo sapiens
aagcgggacaccaaguuua

SEQ ID NO: 197202 - RNA, 19 nt, Homo sapiens
ccaggagucucagccuuuc

SEQ ID NO: 197203 - RNA, 19 nt, Homo sapiens
cagagccuguugugucuca

SEQ ID NO: 197204 - RNA, 19 nt, Homo sapiens
cagcaaggacguugauugg

SEQ ID NO: 197205 - RNA, 19 nt, Homo sapiens
ggaacagcaaggacguuga

SEQ ID NO: 197206 - RNA, 19 nt, Homo sapiens
gggcucacuucaucagagu

SEQ ID NO: 197207 - RNA, 19 nt, Homo sapiens
agccaggcaugguuggaua

SEQ ID NO: 197208 - RNA, 19 nt, Homo sapiens
uaaagggagagccagagaa

SEQ ID NO: 197209 - RNA, 19 nt, Homo sapiens
agcaagacauggcccaguu

SEQ ID NO: 197210 - RNA, 19 nt, Homo sapiens
gcccaguucauacauuuau

SEQ ID NO: 197211 - RNA, 19 nt, Homo sapiens
gcugggaugaggcagguaa

SEQ ID NO: 197212 - RNA, 19 nt, Homo sapiens
gcaagacauggcccaguuc

SEQ ID NO: 197213 - RNA, 19 nt, Homo sapiens
ccaaaugaaacgcugaagu

SEQ ID NO: 197214 - RNA, 19 nt, Homo sapiens
cagaacagcagcaagacau

SEQ ID NO: 197215 - RNA, 19 nt, Homo sapiens
gggcucaauucuccacucu

SEQ ID NO: 197216 - RNA, 19 nt, Homo sapiens
gcaguagacagggcuuguu

SEQ ID NO: 197217 - RNA, 19 nt, Homo sapiens
gggccugcgucgacuucaa

SEQ ID NO: 197218 - RNA, 19 nt, Homo sapiens
aaaugaaacgcugaaguga

SEQ ID NO: 197219 - RNA, 19 nt, Homo sapiens
acacagcgcgcuucucucu

SEQ ID NO: 197220 - RNA, 19 nt, Homo sapiens
agacacagcgcgcuucucu

SEQ ID NO: 197221 - RNA, 19 nt, Homo sapiens
aguagcugauguaggagua

SEQ ID NO: 197222 - RNA, 19 nt, Homo sapiens
caagacauggcccaguuca

SEQ ID NO: 197223 - RNA, 19 nt, Homo sapiens
gugcucagcugcauuuccu

SEQ ID NO: 197224 - RNA, 19 nt, Homo sapiens
augaaacgcugaagugacu

SEQ ID NO: 197225 - RNA, 19 nt, Homo sapiens
gcucaggucgggucuuucu

SEQ ID NO: 197226 - RNA, 19 nt, Homo sapiens
gggccagaguagcugaugu

SEQ ID NO: 197227 - RNA, 19 nt, Homo sapiens
ugagaaccuggcuucagua

SEQ ID NO: 197228 - RNA, 19 nt, Homo sapiens
ucacuucaucagaguuuga

SEQ ID NO: 197229 - RNA, 19 nt, Homo sapiens
gaggugcccacagcaggua

SEQ ID NO: 197230 - RNA, 19 nt, Homo sapiens
gugaggagugugcugaaga

SEQ ID NO: 197231 - RNA, 19 nt, Homo sapiens
acagcaaggacguugauug

SEQ ID NO: 197232 - RNA, 19 nt, Homo sapiens
cagcuagccaggcaugguu

SEQ ID NO: 197233 - RNA, 19 nt, Homo sapiens
uguguccuguggucauaaa

SEQ ID NO: 197234 - RNA, 19 nt, Homo sapiens
gagugaccaccaagaggaa

SEQ ID NO: 197235 - RNA, 19 nt, Homo sapiens
ugaggagugugcugaagac

SEQ ID NO: 197236 - RNA, 19 nt, Homo sapiens
ggugagagugagccaggaa

SEQ ID NO: 197237 - RNA, 19 nt, Homo sapiens
ggcccaguucauacauuua

SEQ ID NO: 197238 - RNA, 19 nt, Homo sapiens
ccagagcagcccagcaaca

SEQ ID NO: 197239 - RNA, 19 nt, Homo sapiens
gagagccagagaacucaug

SEQ ID NO: 197240 - RNA, 19 nt, Homo sapiens
cccaguucauacauuuauu

SEQ ID NO: 197241 - RNA, 19 nt, Homo sapiens
gacauggcccaguucauac

SEQ ID NO: 197242 - RNA, 19 nt, Homo sapiens
gaaagaagagugaguguua

SEQ ID NO: 197243 - RNA, 19 nt, Homo sapiens
gaacggagcuuugacugua

SEQ ID NO: 197244 - RNA, 19 nt, Homo sapiens
gaagagaaguugguaauga

SEQ ID NO: 197245 - RNA, 19 nt, Homo sapiens
gagcaaaccucucggauug

SEQ ID NO: 197246 - RNA, 19 nt, Homo sapiens
gaacggagcucggaguuug

SEQ ID NO: 197247 - RNA, 19 nt, Homo sapiens
gaggaggaaucaccauuua

SEQ ID NO: 197248 - RNA, 19 nt, Homo sapiens
gcacagaauuguaaaccuu

SEQ ID NO: 197249 - RNA, 19 nt, Homo sapiens
gaagaaaugagguaccuuu

SEQ ID NO: 197250 - RNA, 19 nt, Homo sapiens
ggaaugcccuucagguuuc

SEQ ID NO: 197251 - RNA, 19 nt, Homo sapiens
gcaagaaggcucacagcua

SEQ ID NO: 197252 - RNA, 19 nt, Homo sapiens
gcccaccucuuccaaauuu

SEQ ID NO: 197253 - RNA, 19 nt, Homo sapiens
gggaaggaauuuaauacuu

SEQ ID NO: 197254 - RNA, 19 nt, Homo sapiens
gcaagagguuccaccagaa

SEQ ID NO: 197255 - RNA, 19 nt, Homo sapiens
gcagacagcacuucaaaug

SEQ ID NO: 197256 - RNA, 19 nt, Homo sapiens
caaaggcgcuggcgucaag

SEQ ID NO: 197257 - RNA, 19 nt, Homo sapiens
gaucuucugguaagcauua

SEQ ID NO: 197258 - RNA, 19 nt, Homo sapiens
gaucaccggcuaccaagua

SEQ ID NO: 197259 - RNA, 19 nt, Homo sapiens
gaacaguuacuucaaagau

SEQ ID NO: 197260 - RNA, 19 nt, Homo sapiens
gagaagacagcacagaauu

SEQ ID NO: 197261 - RNA, 19 nt, Homo sapiens
caaauaggcuccucuacac

SEQ ID NO: 197262 - RNA, 19 nt, Homo sapiens
ccacaguccuucccauuuc

SEQ ID NO: 197263 - RNA, 19 nt, Homo sapiens
gagcagacagcacuucaaa

SEQ ID NO: 197264 - RNA, 19 nt, Homo sapiens
gaagacagcacagaauugu

SEQ ID NO: 197265 - RNA, 19 nt, Homo sapiens
guggacaaaugcuaauauu

SEQ ID NO: 197266 - RNA, 19 nt, Homo sapiens
aagagugaguguuaacuuu

SEQ ID NO: 197267 - RNA, 19 nt, Homo sapiens
agacagcacagaauuguaa

SEQ ID NO: 197268 - RNA, 19 nt, Homo sapiens
gaagagugaguguuaacuu

SEQ ID NO: 197269 - RNA, 19 nt, Homo sapiens
gggaccagaauaaaucuua

SEQ ID NO: 197270 - RNA, 19 nt, Homo sapiens
agacaaaggcaaagucaaa

SEQ ID NO: 197271 - RNA, 19 nt, Homo sapiens
gaagacaaaggcaaaguca

SEQ ID NO: 197272 - RNA, 19 nt, Homo sapiens
gcaagcagcagcuacacaa

SEQ ID NO: 197273 - RNA, 19 nt, Homo sapiens
ucuguugacuccuuucuuu

SEQ ID NO: 197274 - RNA, 19 nt, Homo sapiens
aaagaagagugaguguuaa

SEQ ID NO: 197275 - RNA, 19 nt, Homo sapiens
gcucggaguuugaggacuu

SEQ ID NO: 197276 - RNA, 19 nt, Homo sapiens
gcgcucauuucucgucaaa

SEQ ID NO: 197277 - RNA, 19 nt, Homo sapiens
ggaggaaucaccauuuaca

SEQ ID NO: 197278 - RNA, 19 nt, Homo sapiens
gaagucagacaugaagaaa

SEQ ID NO: 197279 - RNA, 19 nt, Homo sapiens
ccacacaccugcuuaucca

SEQ ID NO: 197280 - RNA, 19 nt, Homo sapiens
uguaagaucugugggaaga

SEQ ID NO: 197281 - RNA, 19 nt, Homo sapiens
agacagcacuucaaaugca

SEQ ID NO: 197282 - RNA, 19 nt, Homo sapiens
ccaaguggcugggucuguu

SEQ ID NO: 197283 - RNA, 19 nt, Homo sapiens
gcucugucuucaacucuuu

SEQ ID NO: 197284 - RNA, 19 nt, Homo sapiens
caccagaagucagacauga

SEQ ID NO: 197285 - RNA, 19 nt, Homo sapiens
caagguggacaaaugcuaa

SEQ ID NO: 197286 - RNA, 19 nt, Homo sapiens
gaaucaccauuuacaaggu

SEQ ID NO: 197287 - RNA, 19 nt, Homo sapiens
ggaccagaauaaaucuuag

SEQ ID NO: 197288 - RNA, 19 nt, Homo sapiens
agucagacaugaagaaaca

SEQ ID NO: 197289 - RNA, 19 nt, Homo sapiens
gagcaagcccucggaguga

SEQ ID NO: 197290 - RNA, 19 nt, Homo sapiens
gagugaguguuaacuuuua

SEQ ID NO: 197291 - RNA, 19 nt, Homo sapiens
gcaggcaugugggaaggaa

SEQ ID NO: 197292 - RNA, 19 nt, Homo sapiens
gcagaagagaaguugguaa

SEQ ID NO: 197293 - RNA, 19 nt, Homo sapiens
cuucaaagauaugugugua

SEQ ID NO: 197294 - RNA, 19 nt, Homo sapiens
agacuauucccuccguuua

SEQ ID NO: 197295 - RNA, 19 nt, Homo sapiens
gaagggaaaugagcaaacc

SEQ ID NO: 197296 - RNA, 19 nt, Homo sapiens
cuauaaaucuuggaggaau

SEQ ID NO: 197297 - RNA, 19 nt, Homo sapiens
uuuacaagguggacaaaug

SEQ ID NO: 197298 - RNA, 19 nt, Homo sapiens
ugaugagguugguaaaugu

SEQ ID NO: 197299 - RNA, 19 nt, Homo sapiens
guggcugggucuguucuua

SEQ ID NO: 197300 - RNA, 19 nt, Homo sapiens
cagaagagaaguugguaau

SEQ ID NO: 197301 - RNA, 19 nt, Homo sapiens
gaaagugccggaccaccau

SEQ ID NO: 197302 - RNA, 19 nt, Homo sapiens
acaaauaggcuccucuaca

SEQ ID NO: 197303 - RNA, 19 nt, Homo sapiens
ggagcugccagaagaaaug

SEQ ID NO: 197304 - RNA, 19 nt, Homo sapiens
agaagaagcagaagagaag

SEQ ID NO: 197305 - RNA, 19 nt, Homo sapiens
caaauggggaccagaauaa

SEQ ID NO: 197306 - RNA, 19 nt, Homo sapiens
uugaugagguugguaaaug

SEQ ID NO: 197307 - RNA, 19 nt, Homo sapiens
ggaaggaaggcucugucuu

SEQ ID NO: 197308 - RNA, 19 nt, Homo sapiens
ccaccucuuccaaauuuaa

SEQ ID NO: 197309 - RNA, 19 nt, Homo sapiens
ccaagaagaagcagaagag

SEQ ID NO: 197310 - RNA, 19 nt, Homo sapiens
aaucuuggaggaaucauuu

SEQ ID NO: 197311 - RNA, 19 nt, Homo sapiens
gguaagcauuauguuuguu

SEQ ID NO: 197312 - RNA, 19 nt, Homo sapiens
gaggaaucaccauuuacaa

SEQ ID NO: 197313 - RNA, 19 nt, Homo sapiens
caaaggcaaagucaaaugg

SEQ ID NO: 197314 - RNA, 19 nt, Homo sapiens
cauccacacuguccacaca

SEQ ID NO: 197315 - RNA, 19 nt, Homo sapiens
ggaacggagcuuugacugu

SEQ ID NO: 197316 - RNA, 19 nt, Homo sapiens
uccacucccuucugacuuu

SEQ ID NO: 197317 - RNA, 19 nt, Homo sapiens
gagcuuugacuguaagauc

SEQ ID NO: 197318 - RNA, 19 nt, Homo sapiens
gccugggccucuucuguga

SEQ ID NO: 197319 - RNA, 19 nt, Homo sapiens
aaagauuucugagcuagca

SEQ ID NO: 197320 - RNA, 19 nt, Homo sapiens
uaaauccgaagggaaauga

SEQ ID NO: 197321 - RNA, 19 nt, Homo sapiens
acacaaauaggcuccucua

SEQ ID NO: 197322 - RNA, 19 nt, Homo sapiens
cugcagauccuaccagguu

SEQ ID NO: 197323 - RNA, 19 nt, Homo sapiens
gcagcaugggcucaaauga

SEQ ID NO: 197324 - RNA, 19 nt, Homo sapiens
cauccacacuggugagaag

SEQ ID NO: 197325 - RNA, 19 nt, Homo sapiens
aaucauuucuccuccucaa

SEQ ID NO: 197326 - RNA, 19 nt, Homo sapiens
ugagcaaaccucucggauu

SEQ ID NO: 197327 - RNA, 19 nt, Homo sapiens
caaugccuguggacaagau

SEQ ID NO: 197328 - RNA, 19 nt, Homo sapiens
aagagaaguugguaaugag

SEQ ID NO: 197329 - RNA, 19 nt, Homo sapiens
gguggacaaaugcuaauau

SEQ ID NO: 197330 - RNA, 19 nt, Homo sapiens
agaggaggaaucaccauuu

SEQ ID NO: 197331 - RNA, 19 nt, Homo sapiens
aggaaugcccuucagguuu

SEQ ID NO: 197332 - RNA, 19 nt, Homo sapiens
caggaaugcccuucagguu

SEQ ID NO: 197333 - RNA, 19 nt, Homo sapiens
ugagaagacagcacagaau

SEQ ID NO: 197334 - RNA, 19 nt, Homo sapiens
ggugcugccuauaaaucuu

SEQ ID NO: 197335 - RNA, 19 nt, Homo sapiens
gaccagaauaaaucuuaga

SEQ ID NO: 197336 - RNA, 19 nt, Homo sapiens
gagagugagaaccaaguga

SEQ ID NO: 197337 - RNA, 19 nt, Homo sapiens
gaugagguugguaaauguu

SEQ ID NO: 197338 - RNA, 19 nt, Homo sapiens
agaagacagcacagaauug

SEQ ID NO: 197339 - RNA, 19 nt, Homo sapiens
ggugguauuuucacuuuga

SEQ ID NO: 197340 - RNA, 19 nt, Homo sapiens
aagaagaagcagaagagaa

SEQ ID NO: 197341 - RNA, 19 nt, Homo sapiens
uuugggugcugccuauaaa

SEQ ID NO: 197342 - RNA, 19 nt, Homo sapiens
gaaguuaccucuuacauuu

SEQ ID NO: 197343 - RNA, 19 nt, Homo sapiens
guacgaaacuguaugauua

SEQ ID NO: 197344 - RNA, 19 nt, Homo sapiens
caacagaacuuuaucauca

SEQ ID NO: 197345 - RNA, 19 nt, Homo sapiens
acacagagcugcuauuaaa

SEQ ID NO: 197346 - RNA, 19 nt, Homo sapiens
gagcauggaugacgaaauu

SEQ ID NO: 197347 - RNA, 19 nt, Homo sapiens
gcucauacuuggacaguua

SEQ ID NO: 197348 - RNA, 19 nt, Homo sapiens
caucaugugugguauauuu

SEQ ID NO: 197349 - RNA, 19 nt, Homo sapiens
gaagcgaaauauuacagua

SEQ ID NO: 197350 - RNA, 19 nt, Homo sapiens
uuaaaugacugcugaauga

SEQ ID NO: 197351 - RNA, 19 nt, Homo sapiens
ggacgaggcuaucauuaug

SEQ ID NO: 197352 - RNA, 19 nt, Homo sapiens
ugaaacggcugccugauuu

SEQ ID NO: 197353 - RNA, 19 nt, Homo sapiens
ggagacagauuguggaguu

SEQ ID NO: 197354 - RNA, 19 nt, Homo sapiens
gaacauaaacuuucuacug

SEQ ID NO: 197355 - RNA, 19 nt, Homo sapiens
uaaaggagauccagagaug

SEQ ID NO: 197356 - RNA, 19 nt, Homo sapiens
ggaaggguuugccaaguuu

SEQ ID NO: 197357 - RNA, 19 nt, Homo sapiens
gaaagaguagugcauuuaa

SEQ ID NO: 197358 - RNA, 19 nt, Homo sapiens
ggagagaguuauccaacaa

SEQ ID NO: 197359 - RNA, 19 nt, Homo sapiens
cagagcugcuauuaaauua

SEQ ID NO: 197360 - RNA, 19 nt, Homo sapiens
caacacagagcugcuauua

SEQ ID NO: 197361 - RNA, 19 nt, Homo sapiens
caagacaccuuuuguauuu

SEQ ID NO: 197362 - RNA, 19 nt, Homo sapiens
gaucaugcuuggauugaaa

SEQ ID NO: 197363 - RNA, 19 nt, Homo sapiens
caagauaccagcuuuacua

SEQ ID NO: 197364 - RNA, 19 nt, Homo sapiens
gaaacuguaugauuaagca

SEQ ID NO: 197365 - RNA, 19 nt, Homo sapiens
caagaaagacgcaaagaga

SEQ ID NO: 197366 - RNA, 19 nt, Homo sapiens
caaaggcuaugacuucgaa

SEQ ID NO: 197367 - RNA, 19 nt, Homo sapiens
gcaacaagauauggauuug

SEQ ID NO: 197368 - RNA, 19 nt, Homo sapiens
caugagagaucacacuuau

SEQ ID NO: 197369 - RNA, 19 nt, Homo sapiens
gaaacuagcaacagaacuu

SEQ ID NO: 197370 - RNA, 19 nt, Homo sapiens
uuacuuauaugcacucuga

SEQ ID NO: 197371 - RNA, 19 nt, Homo sapiens
gcuaugacuucgaaucuga

SEQ ID NO: 197372 - RNA, 19 nt, Homo sapiens
gggaaggguuugccaaguu

SEQ ID NO: 197373 - RNA, 19 nt, Homo sapiens
gauuguggaguucauauua

SEQ ID NO: 197374 - RNA, 19 nt, Homo sapiens
aaaggaagcugcaaucucu

SEQ ID NO: 197375 - RNA, 19 nt, Homo sapiens
gaauuugggugguuugaag

SEQ ID NO: 197376 - RNA, 19 nt, Homo sapiens
ccaaaucugugacuguaga

SEQ ID NO: 197377 - RNA, 19 nt, Homo sapiens
uaaacgaacugcaggagau

SEQ ID NO: 197378 - RNA, 19 nt, Homo sapiens
ccuuguaucuguagucuuu

SEQ ID NO: 197379 - RNA, 19 nt, Homo sapiens
uugccaagcucguuaagua

SEQ ID NO: 197380 - RNA, 19 nt, Homo sapiens
gugaaagaguagugcauuu

SEQ ID NO: 197381 - RNA, 19 nt, Homo sapiens
gagaggaagagucaacuuu

SEQ ID NO: 197382 - RNA, 19 nt, Homo sapiens
gaacaggcaaagacaagaa

SEQ ID NO: 197383 - RNA, 19 nt, Homo sapiens
ggaagccaaugccugcaaa

SEQ ID NO: 197384 - RNA, 19 nt, Homo sapiens
gcauuuaauuggaguaucu

SEQ ID NO: 197385 - RNA, 19 nt, Homo sapiens
ugaaagaguagugcauuua

SEQ ID NO: 197386 - RNA, 19 nt, Homo sapiens
cauccuugcuggugaauug

SEQ ID NO: 197387 - RNA, 19 nt, Homo sapiens
caagauauggauuuggaua

SEQ ID NO: 197388 - RNA, 19 nt, Homo sapiens
cgugaucccuuuacaguug

SEQ ID NO: 197389 - RNA, 19 nt, Homo sapiens
ggaagaugaugauguugca

SEQ ID NO: 197390 - RNA, 19 nt, Homo sapiens
uuugugaaguuaccucuua

SEQ ID NO: 197391 - RNA, 19 nt, Homo sapiens
ugacgaaauucagaaacua

SEQ ID NO: 197392 - RNA, 19 nt, Homo sapiens
ggagugaacauaaacuuuc

SEQ ID NO: 197393 - RNA, 19 nt, Homo sapiens
ggaggacuuugaauaaugg

SEQ ID NO: 197394 - RNA, 19 nt, Homo sapiens
ucagaccagugaaagagua

SEQ ID NO: 197395 - RNA, 19 nt, Homo sapiens
gagaggcuaugauguugau

SEQ ID NO: 197396 - RNA, 19 nt, Homo sapiens
gacagcagauacuuugaug

SEQ ID NO: 197397 - RNA, 19 nt, Homo sapiens
cagaaacacaccagucuuu

SEQ ID NO: 197398 - RNA, 19 nt, Homo sapiens
gaacccaguccugucaaua

SEQ ID NO: 197399 - RNA, 19 nt, Homo sapiens
uuaaggcacuggaugaaga

SEQ ID NO: 197400 - RNA, 19 nt, Homo sapiens
gcugagaggcuaugauguu

SEQ ID NO: 197401 - RNA, 19 nt, Homo sapiens
gaggauacugagaccauua

SEQ ID NO: 197402 - RNA, 19 nt, Homo sapiens
guacagaggauaugauucu

SEQ ID NO: 197403 - RNA, 19 nt, Homo sapiens
caacuacaaagacuugaaa

SEQ ID NO: 197404 - RNA, 19 nt, Homo sapiens
caagugcugucauagaaca

SEQ ID NO: 197405 - RNA, 19 nt, Homo sapiens
ugaugcaagugcugucaua

SEQ ID NO: 197406 - RNA, 19 nt, Homo sapiens
gcaaaacccagcuuauuaa

SEQ ID NO: 197407 - RNA, 19 nt, Homo sapiens
cauguuggguauccuacua

SEQ ID NO: 197408 - RNA, 19 nt, Homo sapiens
uugaggagcugacugaguu

SEQ ID NO: 197409 - RNA, 19 nt, Homo sapiens
caacuuugaugacuauacu

SEQ ID NO: 197410 - RNA, 19 nt, Homo sapiens
gaaagacgcaaagagauca

SEQ ID NO: 197411 - RNA, 19 nt, Homo sapiens
ggagagaggagcuuuaacu

SEQ ID NO: 197412 - RNA, 19 nt, Homo sapiens
ugaaggaucacauaaagga

SEQ ID NO: 197413 - RNA, 19 nt, Homo sapiens
ugacuauacugugaauuug

SEQ ID NO: 197414 - RNA, 19 nt, Homo sapiens
ggauggacgucuuucuauc

SEQ ID NO: 197415 - RNA, 19 nt, Homo sapiens
gaaaggaagcugcaaucuc

SEQ ID NO: 197416 - RNA, 19 nt, Homo sapiens
ucaaaggccuucagagacu

SEQ ID NO: 197417 - RNA, 19 nt, Homo sapiens
ccaagcucguuaaguauau

SEQ ID NO: 197418 - RNA, 19 nt, Homo sapiens
ggucucaauccuuaacaua

SEQ ID NO: 197419 - RNA, 19 nt, Homo sapiens
cacggaaucuugccaaauc

SEQ ID NO: 197420 - RNA, 19 nt, Homo sapiens
auacugagaccauuaagaa

SEQ ID NO: 197421 - RNA, 19 nt, Homo sapiens
ggaggauacugagaccauu

SEQ ID NO: 197422 - RNA, 19 nt, Homo sapiens
gcuggugaauugaaacaug

SEQ ID NO: 197423 - RNA, 19 nt, Homo sapiens
gaacuccagcagaucauga

SEQ ID NO: 197424 - RNA, 19 nt, Homo sapiens
gauaccagcuuuacuaccu

SEQ ID NO: 197425 - RNA, 19 nt, Homo sapiens
gccaagcucguuaaguaua

SEQ ID NO: 197426 - RNA, 19 nt, Homo sapiens
ggcacuggaugaagaaguu

SEQ ID NO: 197427 - RNA, 19 nt, Homo sapiens
gauaaugggacgaggcuau

SEQ ID NO: 197428 - RNA, 19 nt, Homo sapiens
ucuggaagaugaugauguu

SEQ ID NO: 197429 - RNA, 19 nt, Homo sapiens
ugcaagugcugucauagaa

SEQ ID NO: 197430 - RNA, 19 nt, Homo sapiens
cauaaacuuucuacugauc

SEQ ID NO: 197431 - RNA, 19 nt, Homo sapiens
ggagaacccaguccuguca

SEQ ID NO: 197432 - RNA, 19 nt, Homo sapiens
ggacaacugacaauaugau

SEQ ID NO: 197433 - RNA, 19 nt, Homo sapiens
uggcuuugguggauaaauu

SEQ ID NO: 197434 - RNA, 19 nt, Homo sapiens
agagaguuauccaacaauu

SEQ ID NO: 197435 - RNA, 19 nt, Homo sapiens
acagagcugcuauuaaauu

SEQ ID NO: 197436 - RNA, 19 nt, Homo sapiens
ucaccauacuucauucaga

SEQ ID NO: 197437 - RNA, 19 nt, Homo sapiens
gacuguagagugaggaaua

SEQ ID NO: 197438 - RNA, 19 nt, Homo sapiens
gaguacagaggauaugauu

SEQ ID NO: 197439 - RNA, 19 nt, Homo sapiens
gggacgaggcuaucauuau

SEQ ID NO: 197440 - RNA, 19 nt, Homo sapiens
gauguuugcccuuaugaug

SEQ ID NO: 197441 - RNA, 19 nt, Homo sapiens
gaacacaaugagaggaaga

SEQ ID NO: 197442 - RNA, 19 nt, Homo sapiens
guacugauguucaccuuua

SEQ ID NO: 197443 - RNA, 19 nt, Homo sapiens
ggaaacagcugguacugau

SEQ ID NO: 197444 - RNA, 19 nt, Homo sapiens
gaaauucccacucauguuu

SEQ ID NO: 197445 - RNA, 19 nt, Homo sapiens
gaagagugcuugaaauuuu

SEQ ID NO: 197446 - RNA, 19 nt, Homo sapiens
gagaaggaguuaauauuuc

SEQ ID NO: 197447 - RNA, 19 nt, Homo sapiens
caucauagcugcauuaaaa

SEQ ID NO: 197448 - RNA, 19 nt, Homo sapiens
uagcugaaauuccaguuua

SEQ ID NO: 197449 - RNA, 19 nt, Homo sapiens
gggagaagcccaacuguuu

SEQ ID NO: 197450 - RNA, 19 nt, Homo sapiens
gaucucgccuugcggauuu

SEQ ID NO: 197451 - RNA, 19 nt, Homo sapiens
uaagguaacucccauaucu

SEQ ID NO: 197452 - RNA, 19 nt, Homo sapiens
ggauggagcugaacuuugg

SEQ ID NO: 197453 - RNA, 19 nt, Homo sapiens
ccauugcccugaaagaaua

SEQ ID NO: 197454 - RNA, 19 nt, Homo sapiens
aaacaguucugcacucuug

SEQ ID NO: 197455 - RNA, 19 nt, Homo sapiens
ccauucaacuggaacauuu

SEQ ID NO: 197456 - RNA, 19 nt, Homo sapiens
gagaaacaguuccauucaa

SEQ ID NO: 197457 - RNA, 19 nt, Homo sapiens
ggacaccauugcccugaaa

SEQ ID NO: 197458 - RNA, 19 nt, Homo sapiens
cacagaagcugaaauccaa

SEQ ID NO: 197459 - RNA, 19 nt, Homo sapiens
ucccauaucuccuuuaaug

SEQ ID NO: 197460 - RNA, 19 nt, Homo sapiens
ucagaaggcuuugggauau

SEQ ID NO: 197461 - RNA, 19 nt, Homo sapiens
ccacuaacaucccuaacga

SEQ ID NO: 197462 - RNA, 19 nt, Homo sapiens
ggcaauggcuccgauguga

SEQ ID NO: 197463 - RNA, 19 nt, Homo sapiens
guucugcacucuuguacaa

SEQ ID NO: 197464 - RNA, 19 nt, Homo sapiens
ccacgcugauguuuaugua

SEQ ID NO: 197465 - RNA, 19 nt, Homo sapiens
gcagccagccuucccagua

SEQ ID NO: 197466 - RNA, 19 nt, Homo sapiens
agaagucgcucuacaacug

SEQ ID NO: 197467 - RNA, 19 nt, Homo sapiens
aaacaucauagcugcauua

SEQ ID NO: 197468 - RNA, 19 nt, Homo sapiens
aacagcagauugucagaua

SEQ ID NO: 197469 - RNA, 19 nt, Homo sapiens
ccaccagcguguccaauga

SEQ ID NO: 197470 - RNA, 19 nt, Homo sapiens
gggauaugcuguauuuuaa

SEQ ID NO: 197471 - RNA, 19 nt, Homo sapiens
gaaacaucauagcugcauu

SEQ ID NO: 197472 - RNA, 19 nt, Homo sapiens
agaacugccugcgcauuua

SEQ ID NO: 197473 - RNA, 19 nt, Homo sapiens
uaacaucccuaacgagcau

SEQ ID NO: 197474 - RNA, 19 nt, Homo sapiens
ccacugcccuccggguuaa

SEQ ID NO: 197475 - RNA, 19 nt, Homo sapiens
uagaagagugcuugaaauu

SEQ ID NO: 197476 - RNA, 19 nt, Homo sapiens
gacccggaguuuccucuuu

SEQ ID NO: 197477 - RNA, 19 nt, Homo sapiens
uaacucccauaucuccuuu

SEQ ID NO: 197478 - RNA, 19 nt, Homo sapiens
uuugggauaugcuguauuu

SEQ ID NO: 197479 - RNA, 19 nt, Homo sapiens
ggagaagcccaacuguuug

SEQ ID NO: 197480 - RNA, 19 nt, Homo sapiens
cagcagauugucagauaua

SEQ ID NO: 197481 - RNA, 19 nt, Homo sapiens
uuaaagggacaguuuguaa

SEQ ID NO: 197482 - RNA, 19 nt, Homo sapiens
gagaagcccaacuguuuga

SEQ ID NO: 197483 - RNA, 19 nt, Homo sapiens
gcacagaagcugaaaucca

SEQ ID NO: 197484 - RNA, 19 nt, Homo sapiens
cuagaagagugcuugaaau

SEQ ID NO: 197485 - RNA, 19 nt, Homo sapiens
cuacauugaugccaagcuu

SEQ ID NO: 197486 - RNA, 19 nt, Homo sapiens
ccuccaagcuguggucuga

SEQ ID NO: 197487 - RNA, 19 nt, Homo sapiens
aagcugaaauccaaugugu

SEQ ID NO: 197488 - RNA, 19 nt, Homo sapiens
gccaccgugugcaaauuua

SEQ ID NO: 197489 - RNA, 19 nt, Homo sapiens
cagcagggucugagaauga

SEQ ID NO: 197490 - RNA, 19 nt, Homo sapiens
gcccaacuguuugaauuug

SEQ ID NO: 197491 - RNA, 19 nt, Homo sapiens
aagcccaacuguuugaauu

SEQ ID NO: 197492 - RNA, 19 nt, Homo sapiens
ccauucauaucagauguuu

SEQ ID NO: 197493 - RNA, 19 nt, Homo sapiens
guaugaagaaggagaagaa

SEQ ID NO: 197494 - RNA, 19 nt, Homo sapiens
guaaacaguucugcacucu

SEQ ID NO: 197495 - RNA, 19 nt, Homo sapiens
gcccugaaagaauaaauaa

SEQ ID NO: 197496 - RNA, 19 nt, Homo sapiens
cagauugucagauauauuc

SEQ ID NO: 197497 - RNA, 19 nt, Homo sapiens
gcagauugucagauauauu

SEQ ID NO: 197498 - RNA, 19 nt, Homo sapiens
gcaaggagaccaacuucag

SEQ ID NO: 197499 - RNA, 19 nt, Homo sapiens
gaagaacugccugcgcauu

SEQ ID NO: 197500 - RNA, 19 nt, Homo sapiens
agagugggcuuuguggaaa

SEQ ID NO: 197501 - RNA, 19 nt, Homo sapiens
uaacuugggcuguaaagca

SEQ ID NO: 197502 - RNA, 19 nt, Homo sapiens
gauaaagugagcccggaaa

SEQ ID NO: 197503 - RNA, 19 nt, Homo sapiens
caaauuuacaggcacagaa

SEQ ID NO: 197504 - RNA, 19 nt, Homo sapiens
gcuagagaaggaguuaaua

SEQ ID NO: 197505 - RNA, 19 nt, Homo sapiens
uguccacccuauuaucuuu

SEQ ID NO: 197506 - RNA, 19 nt, Homo sapiens
gcaagacgaauuacaucug

SEQ ID NO: 197507 - RNA, 19 nt, Homo sapiens
agaaacaguuccauucaac

SEQ ID NO: 197508 - RNA, 19 nt, Homo sapiens
aaaugcaauucaagccuuu

SEQ ID NO: 197509 - RNA, 19 nt, Homo sapiens
ccuagaagagugcuugaaa

SEQ ID NO: 197510 - RNA, 19 nt, Homo sapiens
ccaguuaacagcagauugu

SEQ ID NO: 197511 - RNA, 19 nt, Homo sapiens
uuuccacgcugauguuuau

SEQ ID NO: 197512 - RNA, 19 nt, Homo sapiens
guuuguaacuugggcugua

SEQ ID NO: 197513 - RNA, 19 nt, Homo sapiens
gaaagcuucuugugauccu

SEQ ID NO: 197514 - RNA, 19 nt, Homo sapiens
agaagagugcuugaaauuu

SEQ ID NO: 197515 - RNA, 19 nt, Homo sapiens
ccgccuggauugcgugaaa

SEQ ID NO: 197516 - RNA, 19 nt, Homo sapiens
ccacauaaccacaaaauca

SEQ ID NO: 197517 - RNA, 19 nt, Homo sapiens
cgacgacauuugcaagaag

SEQ ID NO: 197518 - RNA, 19 nt, Homo sapiens
uggaggcccugaagcagaa

SEQ ID NO: 197519 - RNA, 19 nt, Homo sapiens
gaaaucuggccucggaaca

SEQ ID NO: 197520 - RNA, 19 nt, Homo sapiens
cauaucuccuuuaaugaca

SEQ ID NO: 197521 - RNA, 19 nt, Homo sapiens
cuagagaaggaguuaauau

SEQ ID NO: 197522 - RNA, 19 nt, Homo sapiens
ugagaaacaguuccauuca

SEQ ID NO: 197523 - RNA, 19 nt, Homo sapiens
uaacagaaacaucauagcu

SEQ ID NO: 197524 - RNA, 19 nt, Homo sapiens
gaacaacugccuggaugca

SEQ ID NO: 197525 - RNA, 19 nt, Homo sapiens
ugaagaaggagaagaacug

SEQ ID NO: 197526 - RNA, 19 nt, Homo sapiens
aagcagaagucgcucuaca

SEQ ID NO: 197527 - RNA, 19 nt, Homo sapiens
ggaguuaauauuucuaagg

SEQ ID NO: 197528 - RNA, 19 nt, Homo sapiens
ccagccacauaaccacaaa

SEQ ID NO: 197529 - RNA, 19 nt, Homo sapiens
gacgacauuugcaagaagu

SEQ ID NO: 197530 - RNA, 19 nt, Homo sapiens
gcagaagucgcucuacaac

SEQ ID NO: 197531 - RNA, 19 nt, Homo sapiens
uaaauuucagccuacauug

SEQ ID NO: 197532 - RNA, 19 nt, Homo sapiens
acucccauaucuccuuuaa

SEQ ID NO: 197533 - RNA, 19 nt, Homo sapiens
gcagcugucuaaaggaaaa

SEQ ID NO: 197534 - RNA, 19 nt, Homo sapiens
uaaccacuaacaucccuaa

SEQ ID NO: 197535 - RNA, 19 nt, Homo sapiens
gaaacagcugguacugaug

SEQ ID NO: 197536 - RNA, 19 nt, Homo sapiens
acacaccucuguauuucca

SEQ ID NO: 197537 - RNA, 19 nt, Homo sapiens
caacagugggaacgaccua

SEQ ID NO: 197538 - RNA, 19 nt, Homo sapiens
gguggucccauucauauca

SEQ ID NO: 197539 - RNA, 19 nt, Homo sapiens
aagaacugccugcgcauuu

SEQ ID NO: 197540 - RNA, 19 nt, Homo sapiens
aaacagcugguacugaugu

SEQ ID NO: 197541 - RNA, 19 nt, Homo sapiens
ucuguuuccuguucucuug

SEQ ID NO: 197542 - RNA, 19 nt, Homo sapiens
guacugauguucaccuuua

SEQ ID NO: 197543 - RNA, 19 nt, Homo sapiens
ggaaacagcugguacugau

SEQ ID NO: 197544 - RNA, 19 nt, Homo sapiens
gaaauucccacucauguuu

SEQ ID NO: 197545 - RNA, 19 nt, Homo sapiens
gaagagugcuugaaauuuu

SEQ ID NO: 197546 - RNA, 19 nt, Homo sapiens
gagaaggaguuaauauuuc

SEQ ID NO: 197547 - RNA, 19 nt, Homo sapiens
caucauagcugcauuaaaa

SEQ ID NO: 197548 - RNA, 19 nt, Homo sapiens
uagcugaaauuccaguuua

SEQ ID NO: 197549 - RNA, 19 nt, Homo sapiens
gggagaagcccaacuguuu

SEQ ID NO: 197550 - RNA, 19 nt, Homo sapiens
gaucucgccuugcggauuu

SEQ ID NO: 197551 - RNA, 19 nt, Homo sapiens
uaagguaacucccauaucu

SEQ ID NO: 197552 - RNA, 19 nt, Homo sapiens
ggauggagcugaacuuugg

SEQ ID NO: 197553 - RNA, 19 nt, Homo sapiens
ccauugcccugaaagaaua

SEQ ID NO: 197554 - RNA, 19 nt, Homo sapiens
aaacaguucugcacucuug

SEQ ID NO: 197555 - RNA, 19 nt, Homo sapiens
ccauucaacuggaacauuu

SEQ ID NO: 197556 - RNA, 19 nt, Homo sapiens
gagaaacaguuccauucaa

SEQ ID NO: 197557 - RNA, 19 nt, Homo sapiens
ggacaccauugcccugaaa

SEQ ID NO: 197558 - RNA, 19 nt, Homo sapiens
cacagaagcugaaauccaa

SEQ ID NO: 197559 - RNA, 19 nt, Homo sapiens
ucccauaucuccuuuaaug

SEQ ID NO: 197560 - RNA, 19 nt, Homo sapiens
ucagaaggcuuugggauau

SEQ ID NO: 197561 - RNA, 19 nt, Homo sapiens
ccacuaacaucccuaacga

SEQ ID NO: 197562 - RNA, 19 nt, Homo sapiens
ggcaauggcuccgauguga

SEQ ID NO: 197563 - RNA, 19 nt, Homo sapiens
guucugcacucuuguacaa

SEQ ID NO: 197564 - RNA, 19 nt, Homo sapiens
ccacgcugauguuuaugua

SEQ ID NO: 197565 - RNA, 19 nt, Homo sapiens
gcagccagccuucccagua

SEQ ID NO: 197566 - RNA, 19 nt, Homo sapiens
agaagucgcucuacaacug

SEQ ID NO: 197567 - RNA, 19 nt, Homo sapiens
aaacaucauagcugcauua

SEQ ID NO: 197568 - RNA, 19 nt, Homo sapiens
aacagcagauugucagaua

SEQ ID NO: 197569 - RNA, 19 nt, Homo sapiens
ccaccagcguguccaauga

SEQ ID NO: 197570 - RNA, 19 nt, Homo sapiens
gggauaugcuguauuuuaa

SEQ ID NO: 197571 - RNA, 19 nt, Homo sapiens
gaaacaucauagcugcauu

SEQ ID NO: 197572 - RNA, 19 nt, Homo sapiens
agaacugccugcgcauuua

SEQ ID NO: 197573 - RNA, 19 nt, Homo sapiens
uaacaucccuaacgagcau

SEQ ID NO: 197574 - RNA, 19 nt, Homo sapiens
ccacugcccuccggguuaa

SEQ ID NO: 197575 - RNA, 19 nt, Homo sapiens
uagaagagugcuugaaauu

SEQ ID NO: 197576 - RNA, 19 nt, Homo sapiens
gacccggaguuuccucuuu

SEQ ID NO: 197577 - RNA, 19 nt, Homo sapiens
uaacucccauaucuccuuu

SEQ ID NO: 197578 - RNA, 19 nt, Homo sapiens
uuugggauaugcuguauuu

SEQ ID NO: 197579 - RNA, 19 nt, Homo sapiens
ggagaagcccaacuguuug

SEQ ID NO: 197580 - RNA, 19 nt, Homo sapiens
cagcagauugucagauaua

SEQ ID NO: 197581 - RNA, 19 nt, Homo sapiens
uuaaagggacaguuuguaa

SEQ ID NO: 197582 - RNA, 19 nt, Homo sapiens
gagaagcccaacuguuuga

SEQ ID NO: 197583 - RNA, 19 nt, Homo sapiens
gcacagaagcugaaaucca

SEQ ID NO: 197584 - RNA, 19 nt, Homo sapiens
cuagaagagugcuugaaau

SEQ ID NO: 197585 - RNA, 19 nt, Homo sapiens
cuacauugaugccaagcuu

SEQ ID NO: 197586 - RNA, 19 nt, Homo sapiens
ccuccaagcuguggucuga

SEQ ID NO: 197587 - RNA, 19 nt, Homo sapiens
aagcugaaauccaaugugu

SEQ ID NO: 197588 - RNA, 19 nt, Homo sapiens
gccaccgugugcaaauuua

SEQ ID NO: 197589 - RNA, 19 nt, Homo sapiens
cagcagggucugagaauga

SEQ ID NO: 197590 - RNA, 19 nt, Homo sapiens
gcccaacuguuugaauuug

SEQ ID NO: 197591 - RNA, 19 nt, Homo sapiens
aagcccaacuguuugaauu

SEQ ID NO: 197592 - RNA, 19 nt, Homo sapiens
guaugaagaaggagaagaa

SEQ ID NO: 197593 - RNA, 19 nt, Homo sapiens
guaaacaguucugcacucu

SEQ ID NO: 197594 - RNA, 19 nt, Homo sapiens
gcccugaaagaauaaauaa

SEQ ID NO: 197595 - RNA, 19 nt, Homo sapiens
cagauugucagauauauuc

SEQ ID NO: 197596 - RNA, 19 nt, Homo sapiens
gcagauugucagauauauu

SEQ ID NO: 197597 - RNA, 19 nt, Homo sapiens
gcaaggagaccaacuucag

SEQ ID NO: 197598 - RNA, 19 nt, Homo sapiens
gaagaacugccugcgcauu

SEQ ID NO: 197599 - RNA, 19 nt, Homo sapiens
agagugggcuuuguggaaa

SEQ ID NO: 197600 - RNA, 19 nt, Homo sapiens
uaacuugggcuguaaagca

SEQ ID NO: 197601 - RNA, 19 nt, Homo sapiens
gauaaagugagcccggaaa

SEQ ID NO: 197602 - RNA, 19 nt, Homo sapiens
caaauuuacaggcacagaa

SEQ ID NO: 197603 - RNA, 19 nt, Homo sapiens
gcuagagaaggaguuaaua

SEQ ID NO: 197604 - RNA, 19 nt, Homo sapiens
uguccacccuauuaucuuu

SEQ ID NO: 197605 - RNA, 19 nt, Homo sapiens
gcaagacgaauuacaucug

SEQ ID NO: 197606 - RNA, 19 nt, Homo sapiens
agaaacaguuccauucaac

SEQ ID NO: 197607 - RNA, 19 nt, Homo sapiens
aaaugcaauucaagccuuu

SEQ ID NO: 197608 - RNA, 19 nt, Homo sapiens
ccuagaagagugcuugaaa

SEQ ID NO: 197609 - RNA, 19 nt, Homo sapiens
ccaguuaacagcagauugu

SEQ ID NO: 197610 - RNA, 19 nt, Homo sapiens
uuuccacgcugauguuuau

SEQ ID NO: 197611 - RNA, 19 nt, Homo sapiens
guuuguaacuugggcugua

SEQ ID NO: 197612 - RNA, 19 nt, Homo sapiens
gaaagcuucuugugauccu

SEQ ID NO: 197613 - RNA, 19 nt, Homo sapiens
agaagagugcuugaaauuu

SEQ ID NO: 197614 - RNA, 19 nt, Homo sapiens
ccgccuggauugcgugaaa

SEQ ID NO: 197615 - RNA, 19 nt, Homo sapiens
ccacauaaccacaaaauca

SEQ ID NO: 197616 - RNA, 19 nt, Homo sapiens
cgacgacauuugcaagaag

SEQ ID NO: 197617 - RNA, 19 nt, Homo sapiens
uggaggcccugaagcagaa

SEQ ID NO: 197618 - RNA, 19 nt, Homo sapiens
gaaaucuggccucggaaca

SEQ ID NO: 197619 - RNA, 19 nt, Homo sapiens
cauaucuccuuuaaugaca

SEQ ID NO: 197620 - RNA, 19 nt, Homo sapiens
cuagagaaggaguuaauau

SEQ ID NO: 197621 - RNA, 19 nt, Homo sapiens
ugagaaacaguuccauuca

SEQ ID NO: 197622 - RNA, 19 nt, Homo sapiens
uaacagaaacaucauagcu

SEQ ID NO: 197623 - RNA, 19 nt, Homo sapiens
gaacaacugccuggaugca

SEQ ID NO: 197624 - RNA, 19 nt, Homo sapiens
ugaagaaggagaagaacug

SEQ ID NO: 197625 - RNA, 19 nt, Homo sapiens
aagcagaagucgcucuaca

SEQ ID NO: 197626 - RNA, 19 nt, Homo sapiens
ggaguuaauauuucuaagg

SEQ ID NO: 197627 - RNA, 19 nt, Homo sapiens
ccagccacauaaccacaaa

SEQ ID NO: 197628 - RNA, 19 nt, Homo sapiens
gacgacauuugcaagaagu

SEQ ID NO: 197629 - RNA, 19 nt, Homo sapiens
gcagaagucgcucuacaac

SEQ ID NO: 197630 - RNA, 19 nt, Homo sapiens
uaaauuucagccuacauug

SEQ ID NO: 197631 - RNA, 19 nt, Homo sapiens
acucccauaucuccuuuaa

SEQ ID NO: 197632 - RNA, 19 nt, Homo sapiens
gcagcugucuaaaggaaaa

SEQ ID NO: 197633 - RNA, 19 nt, Homo sapiens
uaaccacuaacaucccuaa

SEQ ID NO: 197634 - RNA, 19 nt, Homo sapiens
gaaacagcugguacugaug

SEQ ID NO: 197635 - RNA, 19 nt, Homo sapiens
acacaccucuguauuucca

SEQ ID NO: 197636 - RNA, 19 nt, Homo sapiens
caacagugggaacgaccua

SEQ ID NO: 197637 - RNA, 19 nt, Homo sapiens
gguggucccauucauauca

SEQ ID NO: 197638 - RNA, 19 nt, Homo sapiens
aagaacugccugcgcauuu

SEQ ID NO: 197639 - RNA, 19 nt, Homo sapiens
aaacagcugguacugaugu

SEQ ID NO: 197640 - RNA, 19 nt, Homo sapiens
ucuguuuccuguucucuug

SEQ ID NO: 197641 - RNA, 19 nt, Homo sapiens
uccaaugugucgggcaaua

SEQ ID NO: 197642 - RNA, 19 nt, Homo sapiens
gcacgaggcucuagaaaug

SEQ ID NO: 197643 - RNA, 19 nt, Homo sapiens
ucacagagcucacgacaaa

SEQ ID NO: 197644 - RNA, 19 nt, Homo sapiens
gagaaacgguccuuuguug

SEQ ID NO: 197645 - RNA, 19 nt, Homo sapiens
gggcuccucuccuaacaua

SEQ ID NO: 197646 - RNA, 19 nt, Homo sapiens
gagcgaaaauguauuauug

SEQ ID NO: 197647 - RNA, 19 nt, Homo sapiens
uaaccaaggcuccaauaaa

SEQ ID NO: 197648 - RNA, 19 nt, Homo sapiens
agaaggagcugcagugucu

SEQ ID NO: 197649 - RNA, 19 nt, Homo sapiens
gguuugacaugacaccuaa

SEQ ID NO: 197650 - RNA, 19 nt, Homo sapiens
uagaaaugcccuucacuuu

SEQ ID NO: 197651 - RNA, 19 nt, Homo sapiens
ccaauaaacgugcuaggaa

SEQ ID NO: 197652 - RNA, 19 nt, Homo sapiens
gcuccucuccuaacauaua

SEQ ID NO: 197653 - RNA, 19 nt, Homo sapiens
acagagcucacgacaaaua

SEQ ID NO: 197654 - RNA, 19 nt, Homo sapiens
cgacuuccaugccaauugu

SEQ ID NO: 197655 - RNA, 19 nt, Homo sapiens
gagagaaacgguccuuugu

SEQ ID NO: 197656 - RNA, 19 nt, Homo sapiens
gaacagccgccugacgaaa

SEQ ID NO: 197657 - RNA, 19 nt, Homo sapiens
gaacauggaggaggagugu

SEQ ID NO: 197658 - RNA, 19 nt, Homo sapiens
ugacaugacaccuaacuau

SEQ ID NO: 197659 - RNA, 19 nt, Homo sapiens
gaaauaauaccccaacaga

SEQ ID NO: 197660 - RNA, 19 nt, Homo sapiens
guaacaaggugaucaaacc

SEQ ID NO: 197661 - RNA, 19 nt, Homo sapiens
ccaaagaguuaagcaugug

SEQ ID NO: 197662 - RNA, 19 nt, Homo sapiens
ggaggagugugagaaguuc

SEQ ID NO: 197663 - RNA, 19 nt, Homo sapiens
uagcugggaucuccgcauu

SEQ ID NO: 197664 - RNA, 19 nt, Homo sapiens
aaccaaggcuccaauaaac

SEQ ID NO: 197665 - RNA, 19 nt, Homo sapiens
caugacaccuaacuaugug

SEQ ID NO: 197666 - RNA, 19 nt, Homo sapiens
gaucuuggcaaacgucuuc

SEQ ID NO: 197667 - RNA, 19 nt, Homo sapiens
aaacggugggauuuauuua

SEQ ID NO: 197668 - RNA, 19 nt, Homo sapiens
ggaaacacacacagacaca

SEQ ID NO: 197669 - RNA, 19 nt, Homo sapiens
gaugagcgaaaauguauua

SEQ ID NO: 197670 - RNA, 19 nt, Homo sapiens
ggaguaacaaggugaucaa

SEQ ID NO: 197671 - RNA, 19 nt, Homo sapiens
gagcucacgacaaauauca

SEQ ID NO: 197672 - RNA, 19 nt, Homo sapiens
gaagaaggagcugcagugu

SEQ ID NO: 197673 - RNA, 19 nt, Homo sapiens
ucucuuuccucauuuccua

SEQ ID NO: 197674 - RNA, 19 nt, Homo sapiens
ucagggacuucaccgagaa

SEQ ID NO: 197675 - RNA, 19 nt, Homo sapiens
aggcgugucugggcucuua

SEQ ID NO: 197676 - RNA, 19 nt, Homo sapiens
gacaugacaccuaacuaug

SEQ ID NO: 197677 - RNA, 19 nt, Homo sapiens
acaccaugcuggccaacaa

SEQ ID NO: 197678 - RNA, 19 nt, Homo sapiens
ccagaugaccucagugaca

SEQ ID NO: 197679 - RNA, 19 nt, Homo sapiens
gaccgagggugaggaguuc

SEQ ID NO: 197680 - RNA, 19 nt, Homo sapiens
guccuuuguuggcuucuuu

SEQ ID NO: 197681 - RNA, 19 nt, Homo sapiens
gcgccaagagcaaccauug

SEQ ID NO: 197682 - RNA, 19 nt, Homo sapiens
caggcuugcuucaaucuuc

SEQ ID NO: 197683 - RNA, 19 nt, Homo sapiens
gaucuccgcauuggauuug

SEQ ID NO: 197684 - RNA, 19 nt, Homo sapiens
gaaugacaacugcaagaag

SEQ ID NO: 197685 - RNA, 19 nt, Homo sapiens
ccugcaaccugaaugacaa

SEQ ID NO: 197686 - RNA, 19 nt, Homo sapiens
uuaacaugaucuuggcaaa

SEQ ID NO: 197687 - RNA, 19 nt, Homo sapiens
agagagaaacgguccuuug

SEQ ID NO: 197688 - RNA, 19 nt, Homo sapiens
gaggaggagugugagaagu

SEQ ID NO: 197689 - RNA, 19 nt, Homo sapiens
ggugggauuuauuuaacau

SEQ ID NO: 197690 - RNA, 19 nt, Homo sapiens
gcugggaucuccgcauugg

SEQ ID NO: 197691 - RNA, 19 nt, Homo sapiens
ccaugaggguccaccuuca

SEQ ID NO: 197692 - RNA, 19 nt, Homo sapiens
gaaggccaacaacuccaaa

SEQ ID NO: 197693 - RNA, 19 nt, Homo sapiens
gcaggacucgggaucuuca

SEQ ID NO: 197694 - RNA, 19 nt, Homo sapiens
aagcuuuccugcugucuuc

SEQ ID NO: 197695 - RNA, 19 nt, Homo sapiens
ucaaggauggagaugguuu

SEQ ID NO: 197696 - RNA, 19 nt, Homo sapiens
cuagaaaugcccuucacuu

SEQ ID NO: 197697 - RNA, 19 nt, Homo sapiens
uccaaagaguuaagcaugu

SEQ ID NO: 197698 - RNA, 19 nt, Homo sapiens
aagcugcgcuccuccuaca

SEQ ID NO: 197699 - RNA, 19 nt, Homo sapiens
uuuguuggcuucuuugcuu

SEQ ID NO: 197700 - RNA, 19 nt, Homo sapiens
gaugaccucagugacagua

SEQ ID NO: 197701 - RNA, 19 nt, Homo sapiens
ccaauugucgagccuccua

SEQ ID NO: 197702 - RNA, 19 nt, Homo sapiens
acaaggcccugcgccaguu

SEQ ID NO: 197703 - RNA, 19 nt, Homo sapiens
gauccgcauccaagcuuaa

SEQ ID NO: 197704 - RNA, 19 nt, Homo sapiens
cccuuucucuuuccucauu

SEQ ID NO: 197705 - RNA, 19 nt, Homo sapiens
cgaaauggaaacacacaca

SEQ ID NO: 197706 - RNA, 19 nt, Homo sapiens
gcugcccugcggacaauua

SEQ ID NO: 197707 - RNA, 19 nt, Homo sapiens
cagcugcccugcggacaau

SEQ ID NO: 197708 - RNA, 19 nt, Homo sapiens
ccuaugaggacaaggagaa

SEQ ID NO: 197709 - RNA, 19 nt, Homo sapiens
ugaaugacaacugcaagaa

SEQ ID NO: 197710 - RNA, 19 nt, Homo sapiens
gacgagacccuccgcucuu

SEQ ID NO: 197711 - RNA, 19 nt, Homo sapiens
ugauccgcauccaagcuua

SEQ ID NO: 197712 - RNA, 19 nt, Homo sapiens
ggaggaggagugugagaag

SEQ ID NO: 197713 - RNA, 19 nt, Homo sapiens
gauuggguuugacaugaca

SEQ ID NO: 197714 - RNA, 19 nt, Homo sapiens
acgagacccuccgcucuuu

SEQ ID NO: 197715 - RNA, 19 nt, Homo sapiens
agagaaacgguccuuuguu

SEQ ID NO: 197716 - RNA, 19 nt, Homo sapiens
gaaagcuacgcagacaaga

SEQ ID NO: 197717 - RNA, 19 nt, Homo sapiens
ugaaagcuacgcagacaag

SEQ ID NO: 197718 - RNA, 19 nt, Homo sapiens
gaacgccauccaggccuuu

SEQ ID NO: 197719 - RNA, 19 nt, Homo sapiens
uuaaccaaggcuccaauaa

SEQ ID NO: 197720 - RNA, 19 nt, Homo sapiens
gcaacaaaacuauggaaau

SEQ ID NO: 197721 - RNA, 19 nt, Homo sapiens
cuucaaggauggagauggu

SEQ ID NO: 197722 - RNA, 19 nt, Homo sapiens
ggugaucaaaccuaacuca

SEQ ID NO: 197723 - RNA, 19 nt, Homo sapiens
ggaucuccgcauuggauuu

SEQ ID NO: 197724 - RNA, 19 nt, Homo sapiens
auacuguugucuauaaugg

SEQ ID NO: 197725 - RNA, 19 nt, Homo sapiens
cagcuggugugggaacuuc

SEQ ID NO: 197726 - RNA, 19 nt, Homo sapiens
ggcacgaggcucuagaaau

SEQ ID NO: 197727 - RNA, 19 nt, Homo sapiens
acagccgccugacgaaaug

SEQ ID NO: 197728 - RNA, 19 nt, Homo sapiens
cgugggcccucaagcuuuc

SEQ ID NO: 197729 - RNA, 19 nt, Homo sapiens
aagcagagaccggacaaga

SEQ ID NO: 197730 - RNA, 19 nt, Homo sapiens
ugaccgagggugaggaguu

SEQ ID NO: 197731 - RNA, 19 nt, Homo sapiens
gggcacgaggcucuagaaa

SEQ ID NO: 197732 - RNA, 19 nt, Homo sapiens
aaacacacacagacacaca

SEQ ID NO: 197733 - RNA, 19 nt, Homo sapiens
cgugcugucuguccugaug

SEQ ID NO: 197734 - RNA, 19 nt, Homo sapiens
aaagcuacgcagacaagaa

SEQ ID NO: 197735 - RNA, 19 nt, Homo sapiens
ugucuguccugaugcugaa

SEQ ID NO: 197736 - RNA, 19 nt, Homo sapiens
cgccuucuuugccagauga

SEQ ID NO: 197737 - RNA, 19 nt, Homo sapiens
acaauuaccaggcgugucu

SEQ ID NO: 197738 - RNA, 19 nt, Homo sapiens
acaaggagaagcccaacug

SEQ ID NO: 197739 - RNA, 19 nt, Homo sapiens
aaacgucuucugccucuuc

SEQ ID NO: 197740 - RNA, 19 nt, Homo sapiens
acacacagacacacacaca

SEQ ID NO: 197741 - RNA, 19 nt, Homo sapiens
gaguaacaaggugaucaaa

SEQ ID NO: 197742 - RNA, 19 nt, Homo sapiens
gaucacgccugguggauuu

SEQ ID NO: 197743 - RNA, 19 nt, Homo sapiens
caacagagcaguccagaug

SEQ ID NO: 197744 - RNA, 19 nt, Homo sapiens
ucaggcagcugcucacuuu

SEQ ID NO: 197745 - RNA, 19 nt, Homo sapiens
gaaaaugaaucucagcaaa

SEQ ID NO: 197746 - RNA, 19 nt, Homo sapiens
acagaaagccgacucauga

SEQ ID NO: 197747 - RNA, 19 nt, Homo sapiens
ccagaugucuacgagcaua

SEQ ID NO: 197748 - RNA, 19 nt, Homo sapiens
ccuaggaacuugugcaaca

SEQ ID NO: 197749 - RNA, 19 nt, Homo sapiens
gaaagccgacucaugaaca

SEQ ID NO: 197750 - RNA, 19 nt, Homo sapiens
aggaacagcucucugauag

SEQ ID NO: 197751 - RNA, 19 nt, Homo sapiens
gcacagcaacucaggaaca

SEQ ID NO: 197752 - RNA, 19 nt, Homo sapiens
gcaggaggagugugaaaug

SEQ ID NO: 197753 - RNA, 19 nt, Homo sapiens
caggaacagcucucugaua

SEQ ID NO: 197754 - RNA, 19 nt, Homo sapiens
cggaggccauugcagcuaa

SEQ ID NO: 197755 - RNA, 19 nt, Homo sapiens
gccaugcuguguacucuca

SEQ ID NO: 197756 - RNA, 19 nt, Homo sapiens
cacccuaccuuugcuguga

SEQ ID NO: 197757 - RNA, 19 nt, Homo sapiens
ccgcagccuugguaacuau

SEQ ID NO: 197758 - RNA, 19 nt, Homo sapiens
aaaugaaucucagcaaacu

SEQ ID NO: 197759 - RNA, 19 nt, Homo sapiens
uguguacucucaaugacaa

SEQ ID NO: 197760 - RNA, 19 nt, Homo sapiens
cagcacagcaacucaggaa

SEQ ID NO: 197761 - RNA, 19 nt, Homo sapiens
aaacugaacaugcucaaac

SEQ ID NO: 197762 - RNA, 19 nt, Homo sapiens
ggacauccuaggaacuugu

SEQ ID NO: 197763 - RNA, 19 nt, Homo sapiens
guaacuaugagcuggaugu

SEQ ID NO: 197764 - RNA, 19 nt, Homo sapiens
ggcagcugcucacuuucuu

SEQ ID NO: 197765 - RNA, 19 nt, Homo sapiens
ugauggcacaccagaauga

SEQ ID NO: 197766 - RNA, 19 nt, Homo sapiens
ggccauugcagcuaagaug

SEQ ID NO: 197767 - RNA, 19 nt, Homo sapiens
gcaaacugaacaugcucaa

SEQ ID NO: 197768 - RNA, 19 nt, Homo sapiens
uccugcaccucuagcauaa

SEQ ID NO: 197769 - RNA, 19 nt, Homo sapiens
cagaaagccgacucaugaa

SEQ ID NO: 197770 - RNA, 19 nt, Homo sapiens
gagcaguccagaugucuac

SEQ ID NO: 197771 - RNA, 19 nt, Homo sapiens
gaccucugccucaaguuug

SEQ ID NO: 197772 - RNA, 19 nt, Homo sapiens
agaccucugccucaaguuu

SEQ ID NO: 197773 - RNA, 19 nt, Homo sapiens
ccaacuuugucagcaaugu

SEQ ID NO: 197774 - RNA, 19 nt, Homo sapiens
acagagcaguccagauguc

SEQ ID NO: 197775 - RNA, 19 nt, Homo sapiens
gcacgcuucccuugauucu

SEQ ID NO: 197776 - RNA, 19 nt, Homo sapiens
cacagaaagccgacucaug

SEQ ID NO: 197777 - RNA, 19 nt, Homo sapiens
caaacugaacaugcucaaa

SEQ ID NO: 197778 - RNA, 19 nt, Homo sapiens
ccugcacgcuucccuugau

SEQ ID NO: 197779 - RNA, 19 nt, Homo sapiens
gagcauaccuggggcugau

SEQ ID NO: 197780 - RNA, 19 nt, Homo sapiens
cagcuaagaugcguuuuca

SEQ ID NO: 197781 - RNA, 19 nt, Homo sapiens
ggaggccauugcagcuaag

SEQ ID NO: 197782 - RNA, 19 nt, Homo sapiens
gcccguaguccugauguug

SEQ ID NO: 197783 - RNA, 19 nt, Homo sapiens
agcaaacccuggaaaauga

SEQ ID NO: 197784 - RNA, 19 nt, Homo sapiens
gauggcacaccagaaugaa

SEQ ID NO: 197785 - RNA, 19 nt, Homo sapiens
cuggauuccugcaccucua

SEQ ID NO: 197786 - RNA, 19 nt, Homo sapiens
cgacccgcuuugcagauca

SEQ ID NO: 197787 - RNA, 19 nt, Homo sapiens
gcuguguacucucaaugac

SEQ ID NO: 197788 - RNA, 19 nt, Homo sapiens
gaacuuaacgucuauuuga

SEQ ID NO: 197789 - RNA, 19 nt, Homo sapiens
aguguuaccugcauuauua

SEQ ID NO: 197790 - RNA, 19 nt, Homo sapiens
ggacugcacuuggagaauu

SEQ ID NO: 197791 - RNA, 19 nt, Homo sapiens
uauaacaacuggacaaaug

SEQ ID NO: 197792 - RNA, 19 nt, Homo sapiens
gauguugggugcagaugua

SEQ ID NO: 197793 - RNA, 19 nt, Homo sapiens
uggcauaucugcaagaauu

SEQ ID NO: 197794 - RNA, 19 nt, Homo sapiens
ggccagaucuucauugugu

SEQ ID NO: 197795 - RNA, 19 nt, Homo sapiens
cgaauggacugaugguuug

SEQ ID NO: 197796 - RNA, 19 nt, Homo sapiens
guaccacgaugaauagcua

SEQ ID NO: 197797 - RNA, 19 nt, Homo sapiens
ucaaacugcuguugucuga

SEQ ID NO: 197798 - RNA, 19 nt, Homo sapiens
acuccgagauuacaacuua

SEQ ID NO: 197799 - RNA, 19 nt, Homo sapiens
gacaagacaucauggaaca

SEQ ID NO: 197800 - RNA, 19 nt, Homo sapiens
agacaaggcugaacugauc

SEQ ID NO: 197801 - RNA, 19 nt, Homo sapiens
uaacauucauggaugcaaa

SEQ ID NO: 197802 - RNA, 19 nt, Homo sapiens
gaacugaaucccucaaaca

SEQ ID NO: 197803 - RNA, 19 nt, Homo sapiens
cagauaaaguacagaaaga

SEQ ID NO: 197804 - RNA, 19 nt, Homo sapiens
gaagacauacagcuaguga

SEQ ID NO: 197805 - RNA, 19 nt, Homo sapiens
gagguuagacgcaauguga

SEQ ID NO: 197806 - RNA, 19 nt, Homo sapiens
ccaaggaaauaaagcaaau

SEQ ID NO: 197807 - RNA, 19 nt, Homo sapiens
gaacugggcuaccuuaacc

SEQ ID NO: 197808 - RNA, 19 nt, Homo sapiens
gcauugguauguucuccua

SEQ ID NO: 197809 - RNA, 19 nt, Homo sapiens
gcucuucagucccuucaaa

SEQ ID NO: 197810 - RNA, 19 nt, Homo sapiens
gguuugaacuuaacgucua

SEQ ID NO: 197811 - RNA, 19 nt, Homo sapiens
uaauguaccacgaugaaua

SEQ ID NO: 197812 - RNA, 19 nt, Homo sapiens
ggaagugacuguggagcuu

SEQ ID NO: 197813 - RNA, 19 nt, Homo sapiens
ggaggugacuuaugcaaac

SEQ ID NO: 197814 - RNA, 19 nt, Homo sapiens
guucagaccuuucuuagac

SEQ ID NO: 197815 - RNA, 19 nt, Homo sapiens
ggacugaugguuugaacuu

SEQ ID NO: 197816 - RNA, 19 nt, Homo sapiens
uaacuguucccaaguguuu

SEQ ID NO: 197817 - RNA, 19 nt, Homo sapiens
caaaaccccuucucuacua

SEQ ID NO: 197818 - RNA, 19 nt, Homo sapiens
gcagcuuccugaugacuug

SEQ ID NO: 197819 - RNA, 19 nt, Homo sapiens
ggacaaaugggcuguaugg

SEQ ID NO: 197820 - RNA, 19 nt, Homo sapiens
uaauuugcccgaagacaua

SEQ ID NO: 197821 - RNA, 19 nt, Homo sapiens
uaacaacccaagauuaaga

SEQ ID NO: 197822 - RNA, 19 nt, Homo sapiens
gaacaaccacuccuaucug

SEQ ID NO: 197823 - RNA, 19 nt, Homo sapiens
gcugagagguaaaauaauu

SEQ ID NO: 197824 - RNA, 19 nt, Homo sapiens
ccaggaggcugaggcauga

SEQ ID NO: 197825 - RNA, 19 nt, Homo sapiens
ccggauaagcuguguguua

SEQ ID NO: 197826 - RNA, 19 nt, Homo sapiens
ccacuugacuggauguauc

SEQ ID NO: 197827 - RNA, 19 nt, Homo sapiens
gcuuagcugucuuucguuu

SEQ ID NO: 197828 - RNA, 19 nt, Homo sapiens
caacggacccugcaagcuu

SEQ ID NO: 197829 - RNA, 19 nt, Homo sapiens
ccaaguauaaugucacuga

SEQ ID NO: 197830 - RNA, 19 nt, Homo sapiens
caaccacuccuaucuguau

SEQ ID NO: 197831 - RNA, 19 nt, Homo sapiens
ggaagagguuagacgcaau

SEQ ID NO: 197832 - RNA, 19 nt, Homo sapiens
ccugaugacuuguaucuca

SEQ ID NO: 197833 - RNA, 19 nt, Homo sapiens
gaucuacuuugauauuugg

SEQ ID NO: 197834 - RNA, 19 nt, Homo sapiens
ccagaucuacuuugauauu

SEQ ID NO: 197835 - RNA, 19 nt, Homo sapiens
gcccagcucagauaaagua

SEQ ID NO: 197836 - RNA, 19 nt, Homo sapiens
gaccggaaauaccuugaug

SEQ ID NO: 197837 - RNA, 19 nt, Homo sapiens
ggccugugcuaccggauaa

SEQ ID NO: 197838 - RNA, 19 nt, Homo sapiens
gaaccaaggaaauaaagca

SEQ ID NO: 197839 - RNA, 19 nt, Homo sapiens
ggaacaaccacuccuaucu

SEQ ID NO: 197840 - RNA, 19 nt, Homo sapiens
acauacagcuagugacgaa

SEQ ID NO: 197841 - RNA, 19 nt, Homo sapiens
aaacacggauucuucacau

SEQ ID NO: 197842 - RNA, 19 nt, Homo sapiens
cgccgcagcuuccugauga

SEQ ID NO: 197843 - RNA, 19 nt, Homo sapiens
ggaaggaucaugcagacau

SEQ ID NO: 197844 - RNA, 19 nt, Homo sapiens
gacugaugguuugaacuua

SEQ ID NO: 197845 - RNA, 19 nt, Homo sapiens
gaggugggcagaucacuug

SEQ ID NO: 197846 - RNA, 19 nt, Homo sapiens
uagaggaaccaaggaaaua

SEQ ID NO: 197847 - RNA, 19 nt, Homo sapiens
gacugcacuuggagaauuu

SEQ ID NO: 197848 - RNA, 19 nt, Homo sapiens
ggucuucauugcagauuuc

SEQ ID NO: 197849 - RNA, 19 nt, Homo sapiens
gaggaaccaaggaaauaaa

SEQ ID NO: 197850 - RNA, 19 nt, Homo sapiens
gaaagacaaggcugaacug

SEQ ID NO: 197851 - RNA, 19 nt, Homo sapiens
cugcaagaauuaaaggaaa

SEQ ID NO: 197852 - RNA, 19 nt, Homo sapiens
ggaagcugguguccuacug

SEQ ID NO: 197853 - RNA, 19 nt, Homo sapiens
ccauuggccuguucuuugu

SEQ ID NO: 197854 - RNA, 19 nt, Homo sapiens
uaucuugucuacaccauca

SEQ ID NO: 197855 - RNA, 19 nt, Homo sapiens
guacgucuaugucaacacu

SEQ ID NO: 197856 - RNA, 19 nt, Homo sapiens
acacugagguggucuucau

SEQ ID NO: 197857 - RNA, 19 nt, Homo sapiens
gaucuucauuguguacuuc

SEQ ID NO: 197858 - RNA, 19 nt, Homo sapiens
uacauuaggcugagaggua

SEQ ID NO: 197859 - RNA, 19 nt, Homo sapiens
gaagaccugggcaacacua

SEQ ID NO: 197860 - RNA, 19 nt, Homo sapiens
caagauccauuggccuguu

SEQ ID NO: 197861 - RNA, 19 nt, Homo sapiens
acauuaggcugagagguaa

SEQ ID NO: 197862 - RNA, 19 nt, Homo sapiens
gaagagguuagacgcaaug

SEQ ID NO: 197863 - RNA, 19 nt, Homo sapiens
gugaguaccauaaggugua

SEQ ID NO: 197864 - RNA, 19 nt, Homo sapiens
acugaugguuugaacuuaa

SEQ ID NO: 197865 - RNA, 19 nt, Homo sapiens
ggugacuuaugcaaacuug

SEQ ID NO: 197866 - RNA, 19 nt, Homo sapiens
aacggacccugcaagcuua

SEQ ID NO: 197867 - RNA, 19 nt, Homo sapiens
gauaaaguacagaaagaca

SEQ ID NO: 197868 - RNA, 19 nt, Homo sapiens
ucugaaauaaugcagcuua

SEQ ID NO: 197869 - RNA, 19 nt, Homo sapiens
gcucagauaaaguacagaa

SEQ ID NO: 197870 - RNA, 19 nt, Homo sapiens
caacagagcaagacuucgu

SEQ ID NO: 197871 - RNA, 19 nt, Homo sapiens
gauuuaacaacccaagauu

SEQ ID NO: 197872 - RNA, 19 nt, Homo sapiens
ugcgaaagcucuaugucuu

SEQ ID NO: 197873 - RNA, 19 nt, Homo sapiens
gcauaucugcaagaauuaa

SEQ ID NO: 197874 - RNA, 19 nt, Homo sapiens
agacuggguugaaggcuau

SEQ ID NO: 197875 - RNA, 19 nt, Homo sapiens
cugaaauaaugcagcuuaa

SEQ ID NO: 197876 - RNA, 19 nt, Homo sapiens
ccuccuaggauaagguuua

SEQ ID NO: 197877 - RNA, 19 nt, Homo sapiens
ucacagacccauucuaugc

SEQ ID NO: 197878 - RNA, 19 nt, Homo sapiens
gguggagaauggaagugaa

SEQ ID NO: 197879 - RNA, 19 nt, Homo sapiens
ggagcaagaccuggcauau

SEQ ID NO: 197880 - RNA, 19 nt, Homo sapiens
gggccaaguuacaggaaau

SEQ ID NO: 197881 - RNA, 19 nt, Homo sapiens
guuguuggccuuucagcua

SEQ ID NO: 197882 - RNA, 19 nt, Homo sapiens
ggacagccgaauagggaaa

SEQ ID NO: 197883 - RNA, 19 nt, Homo sapiens
uaaugcagcuuaaaacaug

SEQ ID NO: 197884 - RNA, 19 nt, Homo sapiens
gagaacugaaucccucaaa

SEQ ID NO: 197885 - RNA, 19 nt, Homo sapiens
agcaagaccuggcauaucu

SEQ ID NO: 197886 - RNA, 19 nt, Homo sapiens
gguggugggugccuguaau

SEQ ID NO: 197887 - RNA, 19 nt, Homo sapiens
cuaauccuccugagucaaa

SEQ ID NO: 197888 - RNA, 19 nt, Homo sapiens
ggacaaggcugacaagcaa

SEQ ID NO: 197889 - RNA, 19 nt, Homo sapiens
gcagagccaugaagaagaa

SEQ ID NO: 197890 - RNA, 19 nt, Homo sapiens
cagcagagcagcacaauaa

SEQ ID NO: 197891 - RNA, 19 nt, Homo sapiens
gagagucccugaagaagau

SEQ ID NO: 197892 - RNA, 19 nt, Homo sapiens
gcgggauccuguucaauaa

SEQ ID NO: 197893 - RNA, 19 nt, Homo sapiens
cguagaggcuuuccgguuu

SEQ ID NO: 197894 - RNA, 19 nt, Homo sapiens
caacaugaccuccgaguuc

SEQ ID NO: 197895 - RNA, 19 nt, Homo sapiens
caaggaaccugacaaccau

SEQ ID NO: 197896 - RNA, 19 nt, Homo sapiens
cugaggaccugaacaacua

SEQ ID NO: 197897 - RNA, 19 nt, Homo sapiens
gagguguucugccgggaua

SEQ ID NO: 197898 - RNA, 19 nt, Homo sapiens
ucacgacaguggagagaaa

SEQ ID NO: 197899 - RNA, 19 nt, Homo sapiens
gcagcagccugucuugugu

SEQ ID NO: 197900 - RNA, 19 nt, Homo sapiens
guuauuuccucagcuauuu

SEQ ID NO: 197901 - RNA, 19 nt, Homo sapiens
gggauccuguucaauaaug

SEQ ID NO: 197902 - RNA, 19 nt, Homo sapiens
gcaauccagggacaagaua

SEQ ID NO: 197903 - RNA, 19 nt, Homo sapiens
gcuggacaguucagugauu

SEQ ID NO: 197904 - RNA, 19 nt, Homo sapiens
uaaccucccuugaccuuca

SEQ ID NO: 197905 - RNA, 19 nt, Homo sapiens
guagaggcuuuccgguuug

SEQ ID NO: 197906 - RNA, 19 nt, Homo sapiens
ggacgcagagccaugaaga

SEQ ID NO: 197907 - RNA, 19 nt, Homo sapiens
cagagcagcacaauaaaug

SEQ ID NO: 197908 - RNA, 19 nt, Homo sapiens
gcagagcagcacaauaaau

SEQ ID NO: 197909 - RNA, 19 nt, Homo sapiens
gaggugguccgcaacauga

SEQ ID NO: 197910 - RNA, 19 nt, Homo sapiens
ccacucacccgaucuccua

SEQ ID NO: 197911 - RNA, 19 nt, Homo sapiens
gcacugcucaccugucugu

SEQ ID NO: 197912 - RNA, 19 nt, Homo sapiens
ccacugcacuggccaucau

SEQ ID NO: 197913 - RNA, 19 nt, Homo sapiens
gagacgcggugcuguacau

SEQ ID NO: 197914 - RNA, 19 nt, Homo sapiens
ggauccuguucaauaauga

SEQ ID NO: 197915 - RNA, 19 nt, Homo sapiens
caccaucaaccucuacuuu

SEQ ID NO: 197916 - RNA, 19 nt, Homo sapiens
ccaaggaaccugacaacca

SEQ ID NO: 197917 - RNA, 19 nt, Homo sapiens
ccucagcuauuuccaccaa

SEQ ID NO: 197918 - RNA, 19 nt, Homo sapiens
ccaucaaccucuacuuugg

SEQ ID NO: 197919 - RNA, 19 nt, Homo sapiens
gaaccugacaaccaugugu

SEQ ID NO: 197920 - RNA, 19 nt, Homo sapiens
gcagcagagcagcacaaua

SEQ ID NO: 197921 - RNA, 19 nt, Homo sapiens
gggcacugcucaccugucu

SEQ ID NO: 197922 - RNA, 19 nt, Homo sapiens
ccucaaaggguacaacuuc

SEQ ID NO: 197923 - RNA, 19 nt, Homo sapiens
accaaauccuccugucuuu

SEQ ID NO: 197924 - RNA, 19 nt, Homo sapiens
caauaaaugaggccacugu

SEQ ID NO: 197925 - RNA, 19 nt, Homo sapiens
gcacuggccaucaucuaca

SEQ ID NO: 197926 - RNA, 19 nt, Homo sapiens
gcaacaugaccuccgaguu

SEQ ID NO: 197927 - RNA, 19 nt, Homo sapiens
gcccucagccuccaaggaa

SEQ ID NO: 197928 - RNA, 19 nt, Homo sapiens
cagccgcucucguccaugu

SEQ ID NO: 197929 - RNA, 19 nt, Homo sapiens
ccgguuauuuccucagcua

SEQ ID NO: 197930 - RNA, 19 nt, Homo sapiens
cagcugaggaccugaacaa

SEQ ID NO: 197931 - RNA, 19 nt, Homo sapiens
gugaggugcugccgucauc

SEQ ID NO: 197932 - RNA, 19 nt, Homo sapiens
gguaaccucccuugaccuu

SEQ ID NO: 197933 - RNA, 19 nt, Homo sapiens
agaagggccugacguacca

SEQ ID NO: 197934 - RNA, 19 nt, Homo sapiens
gagcacccgcugaacauca

SEQ ID NO: 197935 - RNA, 19 nt, Homo sapiens
uugcagcccuguugugugu

SEQ ID NO: 197936 - RNA, 19 nt, Homo sapiens
gacaguggagagaaacauu

SEQ ID NO: 197937 - RNA, 19 nt, Homo sapiens
ccagcaccaucaaccucua

SEQ ID NO: 197938 - RNA, 19 nt, Homo sapiens
cggcccagauugugaagga

SEQ ID NO: 197939 - RNA, 19 nt, Homo sapiens
caccaaauccuccugucuu

SEQ ID NO: 197940 - RNA, 19 nt, Homo sapiens
caacagcaccacacgaaaa

SEQ ID NO: 197941 - RNA, 19 nt, Homo sapiens
ucagcgggauccuguucaa

SEQ ID NO: 197942 - RNA, 19 nt, Homo sapiens
uacaacagcaccacacgaa

SEQ ID NO: 197943 - RNA, 19 nt, Homo sapiens
cccuugaccuucaggagaa

SEQ ID NO: 197944 - RNA, 19 nt, Homo sapiens
gagcagcagagcagcacaa

SEQ ID NO: 197945 - RNA, 19 nt, Homo sapiens
guucggcuaugacgugaag

SEQ ID NO: 197946 - RNA, 19 nt, Homo sapiens
acuacaagcccgaguucua

SEQ ID NO: 197947 - RNA, 19 nt, Homo sapiens
cacccgaucuccuacuaca

SEQ ID NO: 197948 - RNA, 19 nt, Homo sapiens
cuggacaguucagugauuu

SEQ ID NO: 197949 - RNA, 19 nt, Homo sapiens
gacguaccaccgcaucgua

SEQ ID NO: 197950 - RNA, 19 nt, Homo sapiens
gagccaugaagaagaaguu

SEQ ID NO: 197951 - RNA, 19 nt, Homo sapiens
gagcagcacaauaaaugag

SEQ ID NO: 197952 - RNA, 19 nt, Homo sapiens
gguuauuuccucagcuauu

SEQ ID NO: 197953 - RNA, 19 nt, Homo sapiens
caaauccuccugucuuucg

SEQ ID NO: 197954 - RNA, 19 nt, Homo sapiens
agcgggauccuguucaaua

SEQ ID NO: 197955 - RNA, 19 nt, Homo sapiens
gaaaagcugaggucaucaa

SEQ ID NO: 197956 - RNA, 19 nt, Homo sapiens
ggucagcgggauccuguuc

SEQ ID NO: 197957 - RNA, 19 nt, Homo sapiens
agagagucccugaagaaga

SEQ ID NO: 197958 - RNA, 19 nt, Homo sapiens
ccaugaagaagaaguuagu

SEQ ID NO: 197959 - RNA, 19 nt, Homo sapiens
gcugaggaccugaacaacu

SEQ ID NO: 197960 - RNA, 19 nt, Homo sapiens
acgagacgcuggccaucga

SEQ ID NO: 197961 - RNA, 19 nt, Homo sapiens
gcuggacgcagagccauga

SEQ ID NO: 197962 - RNA, 19 nt, Homo sapiens
ucaacuggagacagagaaa

SEQ ID NO: 197963 - RNA, 19 nt, Homo sapiens
cggcagcccuggaaaacaa

SEQ ID NO: 197964 - RNA, 19 nt, Homo sapiens
ggucauugucggccucugu

SEQ ID NO: 197965 - RNA, 19 nt, Homo sapiens
ggaggacaaggcugacaag

SEQ ID NO: 197966 - RNA, 19 nt, Homo sapiens
caguggagagaaacauuga

SEQ ID NO: 197967 - RNA, 19 nt, Homo sapiens
gcaccaucaaccucuacuu

SEQ ID NO: 197968 - RNA, 19 nt, Homo sapiens
ugacagcugaggaccugaa

SEQ ID NO: 197969 - RNA, 19 nt, Homo sapiens
gagcagcagccugucuugu

SEQ ID NO: 197970 - RNA, 19 nt, Homo sapiens
ggagauccgaggcuaugag

SEQ ID NO: 197971 - RNA, 19 nt, Homo sapiens
ggacaaggcugacaagcaa

SEQ ID NO: 197972 - RNA, 19 nt, Homo sapiens
gcagagccaugaagaagaa

SEQ ID NO: 197973 - RNA, 19 nt, Homo sapiens
cagcagagcagcacaauaa

SEQ ID NO: 197974 - RNA, 19 nt, Homo sapiens
gagagucccugaagaagau

SEQ ID NO: 197975 - RNA, 19 nt, Homo sapiens
gcgggauccuguucaauaa

SEQ ID NO: 197976 - RNA, 19 nt, Homo sapiens
cguagaggcuuuccgguuu

SEQ ID NO: 197977 - RNA, 19 nt, Homo sapiens
caacaugaccuccgaguuc

SEQ ID NO: 197978 - RNA, 19 nt, Homo sapiens
caaggaaccugacaaccau

SEQ ID NO: 197979 - RNA, 19 nt, Homo sapiens
cugaggaccugaacaacua

SEQ ID NO: 197980 - RNA, 19 nt, Homo sapiens
gagguguucugccgggaua

SEQ ID NO: 197981 - RNA, 19 nt, Homo sapiens
ucacgacaguggagagaaa

SEQ ID NO: 197982 - RNA, 19 nt, Homo sapiens
gcagcagccugucuugugu

SEQ ID NO: 197983 - RNA, 19 nt, Homo sapiens
guuauuuccucagcuauuu

SEQ ID NO: 197984 - RNA, 19 nt, Homo sapiens
gggauccuguucaauaaug

SEQ ID NO: 197985 - RNA, 19 nt, Homo sapiens
gcaauccagggacaagaua

SEQ ID NO: 197986 - RNA, 19 nt, Homo sapiens
gcuggacaguucagugauu

SEQ ID NO: 197987 - RNA, 19 nt, Homo sapiens
gcccaaaacugucuucuga

SEQ ID NO: 197988 - RNA, 19 nt, Homo sapiens
guagaggcuuuccgguuug

SEQ ID NO: 197989 - RNA, 19 nt, Homo sapiens
ggacgcagagccaugaaga

SEQ ID NO: 197990 - RNA, 19 nt, Homo sapiens
cagagcagcacaauaaaug

SEQ ID NO: 197991 - RNA, 19 nt, Homo sapiens
gcagagcagcacaauaaau

SEQ ID NO: 197992 - RNA, 19 nt, Homo sapiens
gaggugguccgcaacauga

SEQ ID NO: 197993 - RNA, 19 nt, Homo sapiens
ccacucacccgaucuccua

SEQ ID NO: 197994 - RNA, 19 nt, Homo sapiens
gcacugcucaccugucugu

SEQ ID NO: 197995 - RNA, 19 nt, Homo sapiens
ccacugcacuggccaucau

SEQ ID NO: 197996 - RNA, 19 nt, Homo sapiens
gagacgcggugcuguacau

SEQ ID NO: 197997 - RNA, 19 nt, Homo sapiens
ggauccuguucaauaauga

SEQ ID NO: 197998 - RNA, 19 nt, Homo sapiens
caccaucaaccucuacuuu

SEQ ID NO: 197999 - RNA, 19 nt, Homo sapiens
ucucugagcugguggacau

SEQ ID NO: 198000 - RNA, 19 nt, Homo sapiens
ccaaggaaccugacaacca

SEQ ID NO: 198001 - RNA, 19 nt, Homo sapiens
ccucagcuauuuccaccaa

SEQ ID NO: 198002 - RNA, 19 nt, Homo sapiens
ccaucaaccucuacuuugg

SEQ ID NO: 198003 - RNA, 19 nt, Homo sapiens
gaaccugacaaccaugugu

SEQ ID NO: 198004 - RNA, 19 nt, Homo sapiens
ggaaucggugucucuauca

SEQ ID NO: 198005 - RNA, 19 nt, Homo sapiens
gcagcagagcagcacaaua

SEQ ID NO: 198006 - RNA, 19 nt, Homo sapiens
gggcacugcucaccugucu

SEQ ID NO: 198007 - RNA, 19 nt, Homo sapiens
ccucaaaggguacaacuuc

SEQ ID NO: 198008 - RNA, 19 nt, Homo sapiens
accaaauccuccugucuuu

SEQ ID NO: 198009 - RNA, 19 nt, Homo sapiens
caauaaaugaggccacugu

SEQ ID NO: 198010 - RNA, 19 nt, Homo sapiens
gcacuggccaucaucuaca

SEQ ID NO: 198011 - RNA, 19 nt, Homo sapiens
gcaacaugaccuccgaguu

SEQ ID NO: 198012 - RNA, 19 nt, Homo sapiens
gcccucagccuccaaggaa

SEQ ID NO: 198013 - RNA, 19 nt, Homo sapiens
cagccgcucucguccaugu

SEQ ID NO: 198014 - RNA, 19 nt, Homo sapiens
ccgguuauuuccucagcua

SEQ ID NO: 198015 - RNA, 19 nt, Homo sapiens
cagcugaggaccugaacaa

SEQ ID NO: 198016 - RNA, 19 nt, Homo sapiens
gugaggugcugccgucauc

SEQ ID NO: 198017 - RNA, 19 nt, Homo sapiens
agaagggccugacguacca

SEQ ID NO: 198018 - RNA, 19 nt, Homo sapiens
gagcacccgcugaacauca

SEQ ID NO: 198019 - RNA, 19 nt, Homo sapiens
uugcagcccuguugugugu

SEQ ID NO: 198020 - RNA, 19 nt, Homo sapiens
gacaguggagagaaacauu

SEQ ID NO: 198021 - RNA, 19 nt, Homo sapiens
ccagcaccaucaaccucua

SEQ ID NO: 198022 - RNA, 19 nt, Homo sapiens
cggcccagauugugaagga

SEQ ID NO: 198023 - RNA, 19 nt, Homo sapiens
caccaaauccuccugucuu

SEQ ID NO: 198024 - RNA, 19 nt, Homo sapiens
caacagcaccacacgaaaa

SEQ ID NO: 198025 - RNA, 19 nt, Homo sapiens
ggugagcccagaagugaga

SEQ ID NO: 198026 - RNA, 19 nt, Homo sapiens
ucagcgggauccuguucaa

SEQ ID NO: 198027 - RNA, 19 nt, Homo sapiens
uacaacagcaccacacgaa

SEQ ID NO: 198028 - RNA, 19 nt, Homo sapiens
ggccuguucugcaguugga

SEQ ID NO: 198029 - RNA, 19 nt, Homo sapiens
gagcagcagagcagcacaa

SEQ ID NO: 198030 - RNA, 19 nt, Homo sapiens
guucggcuaugacgugaag

SEQ ID NO: 198031 - RNA, 19 nt, Homo sapiens
aaaacugucuucugaggaa

SEQ ID NO: 198032 - RNA, 19 nt, Homo sapiens
acuacaagcccgaguucua

SEQ ID NO: 198033 - RNA, 19 nt, Homo sapiens
cacccgaucuccuacuaca

SEQ ID NO: 198034 - RNA, 19 nt, Homo sapiens
gacguaccaccgcaucgua

SEQ ID NO: 198035 - RNA, 19 nt, Homo sapiens
gagccaugaagaagaaguu

SEQ ID NO: 198036 - RNA, 19 nt, Homo sapiens
cuggacaguucagugauuu

SEQ ID NO: 198037 - RNA, 19 nt, Homo sapiens
gagcagcacaauaaaugag

SEQ ID NO: 198038 - RNA, 19 nt, Homo sapiens
aggaaucggugucucuauc

SEQ ID NO: 198039 - RNA, 19 nt, Homo sapiens
gguuauuuccucagcuauu

SEQ ID NO: 198040 - RNA, 19 nt, Homo sapiens
caaauccuccugucuuucg

SEQ ID NO: 198041 - RNA, 19 nt, Homo sapiens
gaaucggugucucuaucag

SEQ ID NO: 198042 - RNA, 19 nt, Homo sapiens
cgggugagcccagaaguga

SEQ ID NO: 198043 - RNA, 19 nt, Homo sapiens
agcgggauccuguucaaua

SEQ ID NO: 198044 - RNA, 19 nt, Homo sapiens
gaaaagcugaggucaucaa

SEQ ID NO: 198045 - RNA, 19 nt, Homo sapiens
ggucagcgggauccuguuc

SEQ ID NO: 198046 - RNA, 19 nt, Homo sapiens
ccaugaagaagaaguuagu

SEQ ID NO: 198047 - RNA, 19 nt, Homo sapiens
agagagucccugaagaaga

SEQ ID NO: 198048 - RNA, 19 nt, Homo sapiens
gcugaggaccugaacaacu

SEQ ID NO: 198049 - RNA, 19 nt, Homo sapiens
acgagacgcuggccaucga

SEQ ID NO: 198050 - RNA, 19 nt, Homo sapiens
ccaggaaucggugucucua

SEQ ID NO: 198051 - RNA, 19 nt, Homo sapiens
gcuggacgcagagccauga

SEQ ID NO: 198052 - RNA, 19 nt, Homo sapiens
cggcagcccuggaaaacaa

SEQ ID NO: 198053 - RNA, 19 nt, Homo sapiens
ggucauugucggccucugu

SEQ ID NO: 198054 - RNA, 19 nt, Homo sapiens
ugagcugguggacaucaua

SEQ ID NO: 198055 - RNA, 19 nt, Homo sapiens
ggaggacaaggcugacaag

SEQ ID NO: 198056 - RNA, 19 nt, Homo sapiens
caguggagagaaacauuga

SEQ ID NO: 198057 - RNA, 19 nt, Homo sapiens
gcaccaucaaccucuacuu

SEQ ID NO: 198058 - RNA, 19 nt, Homo sapiens
ugacagcugaggaccugaa

SEQ ID NO: 198059 - RNA, 19 nt, Homo sapiens
gagcagcagccugucuugu

SEQ ID NO: 198060 - RNA, 19 nt, Homo sapiens
ggagauccgaggcuaugag

SEQ ID NO: 198061 - RNA, 19 nt, Homo sapiens
ggacaaggcugacaagcaa

SEQ ID NO: 198062 - RNA, 19 nt, Homo sapiens
gaaaccagcuagagacaga

SEQ ID NO: 198063 - RNA, 19 nt, Homo sapiens
gcagagccaugaagaagaa

SEQ ID NO: 198064 - RNA, 19 nt, Homo sapiens
cagcagagcagcacaauaa

SEQ ID NO: 198065 - RNA, 19 nt, Homo sapiens
gagagucccugaagaagau

SEQ ID NO: 198066 - RNA, 19 nt, Homo sapiens
gcgggauccuguucaauaa

SEQ ID NO: 198067 - RNA, 19 nt, Homo sapiens
cguagaggcuuuccgguuu

SEQ ID NO: 198068 - RNA, 19 nt, Homo sapiens
caacaugaccuccgaguuc

SEQ ID NO: 198069 - RNA, 19 nt, Homo sapiens
caaggaaccugacaaccau

SEQ ID NO: 198070 - RNA, 19 nt, Homo sapiens
cugaggaccugaacaacua

SEQ ID NO: 198071 - RNA, 19 nt, Homo sapiens
gagguguucugccgggaua

SEQ ID NO: 198072 - RNA, 19 nt, Homo sapiens
ucacgacaguggagagaaa

SEQ ID NO: 198073 - RNA, 19 nt, Homo sapiens
gcagcagccugucuugugu

SEQ ID NO: 198074 - RNA, 19 nt, Homo sapiens
guuauuuccucagcuauuu

SEQ ID NO: 198075 - RNA, 19 nt, Homo sapiens
gggauccuguucaauaaug

SEQ ID NO: 198076 - RNA, 19 nt, Homo sapiens
gcaauccagggacaagaua

SEQ ID NO: 198077 - RNA, 19 nt, Homo sapiens
gcuggacaguucagugauu

SEQ ID NO: 198078 - RNA, 19 nt, Homo sapiens
gcccaaaacugucuucuga

SEQ ID NO: 198079 - RNA, 19 nt, Homo sapiens
uaaccucccuugaccuuca

SEQ ID NO: 198080 - RNA, 19 nt, Homo sapiens
guagaggcuuuccgguuug

SEQ ID NO: 198081 - RNA, 19 nt, Homo sapiens
ggacgcagagccaugaaga

SEQ ID NO: 198082 - RNA, 19 nt, Homo sapiens
cagagcagcacaauaaaug

SEQ ID NO: 198083 - RNA, 19 nt, Homo sapiens
gcagagcagcacaauaaau

SEQ ID NO: 198084 - RNA, 19 nt, Homo sapiens
gaggugguccgcaacauga

SEQ ID NO: 198085 - RNA, 19 nt, Homo sapiens
ccacucacccgaucuccua

SEQ ID NO: 198086 - RNA, 19 nt, Homo sapiens
gcacugcucaccugucugu

SEQ ID NO: 198087 - RNA, 19 nt, Homo sapiens
ccacugcacuggccaucau

SEQ ID NO: 198088 - RNA, 19 nt, Homo sapiens
gagacgcggugcuguacau

SEQ ID NO: 198089 - RNA, 19 nt, Homo sapiens
ggauccuguucaauaauga

SEQ ID NO: 198090 - RNA, 19 nt, Homo sapiens
caccaucaaccucuacuuu

SEQ ID NO: 198091 - RNA, 19 nt, Homo sapiens
ccaaggaaccugacaacca

SEQ ID NO: 198092 - RNA, 19 nt, Homo sapiens
ccucagcuauuuccaccaa

SEQ ID NO: 198093 - RNA, 19 nt, Homo sapiens
ccaucaaccucuacuuugg

SEQ ID NO: 198094 - RNA, 19 nt, Homo sapiens
gaaccugacaaccaugugu

SEQ ID NO: 198095 - RNA, 19 nt, Homo sapiens
cagagaaaccagcuagaga

SEQ ID NO: 198096 - RNA, 19 nt, Homo sapiens
gcagcagagcagcacaaua

SEQ ID NO: 198097 - RNA, 19 nt, Homo sapiens
gggcacugcucaccugucu

SEQ ID NO: 198098 - RNA, 19 nt, Homo sapiens
ccucaaaggguacaacuuc

SEQ ID NO: 198099 - RNA, 19 nt, Homo sapiens
accaaauccuccugucuuu

SEQ ID NO: 198100 - RNA, 19 nt, Homo sapiens
caauaaaugaggccacugu

SEQ ID NO: 198101 - RNA, 19 nt, Homo sapiens
gcacuggccaucaucuaca

SEQ ID NO: 198102 - RNA, 19 nt, Homo sapiens
gcaacaugaccuccgaguu

SEQ ID NO: 198103 - RNA, 19 nt, Homo sapiens
gcccucagccuccaaggaa

SEQ ID NO: 198104 - RNA, 19 nt, Homo sapiens
cagccgcucucguccaugu

SEQ ID NO: 198105 - RNA, 19 nt, Homo sapiens
ccgguuauuuccucagcua

SEQ ID NO: 198106 - RNA, 19 nt, Homo sapiens
gagaaaccagcuagagaca

SEQ ID NO: 198107 - RNA, 19 nt, Homo sapiens
cagcugaggaccugaacaa

SEQ ID NO: 198108 - RNA, 19 nt, Homo sapiens
gugaggugcugccgucauc

SEQ ID NO: 198109 - RNA, 19 nt, Homo sapiens
agaagggccugacguacca

SEQ ID NO: 198110 - RNA, 19 nt, Homo sapiens
gagcacccgcugaacauca

SEQ ID NO: 198111 - RNA, 19 nt, Homo sapiens
uugcagcccuguugugugu

SEQ ID NO: 198112 - RNA, 19 nt, Homo sapiens
gguaaccucccuugaccuu

SEQ ID NO: 198113 - RNA, 19 nt, Homo sapiens
gacaguggagagaaacauu

SEQ ID NO: 198114 - RNA, 19 nt, Homo sapiens
ccagcaccaucaaccucua

SEQ ID NO: 198115 - RNA, 19 nt, Homo sapiens
cggcccagauugugaagga

SEQ ID NO: 198116 - RNA, 19 nt, Homo sapiens
caccaaauccuccugucuu

SEQ ID NO: 198117 - RNA, 19 nt, Homo sapiens
caacagcaccacacgaaaa

SEQ ID NO: 198118 - RNA, 19 nt, Homo sapiens
ucagcgggauccuguucaa

SEQ ID NO: 198119 - RNA, 19 nt, Homo sapiens
uacaacagcaccacacgaa

SEQ ID NO: 198120 - RNA, 19 nt, Homo sapiens
cuggacaguucagugauuu

SEQ ID NO: 198121 - RNA, 19 nt, Homo sapiens
gagcagcagagcagcacaa

SEQ ID NO: 198122 - RNA, 19 nt, Homo sapiens
guucggcuaugacgugaag

SEQ ID NO: 198123 - RNA, 19 nt, Homo sapiens
acuacaagcccgaguucua

SEQ ID NO: 198124 - RNA, 19 nt, Homo sapiens
cacccgaucuccuacuaca

SEQ ID NO: 198125 - RNA, 19 nt, Homo sapiens
gacguaccaccgcaucgua

SEQ ID NO: 198126 - RNA, 19 nt, Homo sapiens
cccuugaccuucaggagaa

SEQ ID NO: 198127 - RNA, 19 nt, Homo sapiens
gagccaugaagaagaaguu

SEQ ID NO: 198128 - RNA, 19 nt, Homo sapiens
aaaacugucuucugaggaa

SEQ ID NO: 198129 - RNA, 19 nt, Homo sapiens
gagcagcacaauaaaugag

SEQ ID NO: 198130 - RNA, 19 nt, Homo sapiens
gguuauuuccucagcuauu

SEQ ID NO: 198131 - RNA, 19 nt, Homo sapiens
caaauccuccugucuuucg

SEQ ID NO: 198132 - RNA, 19 nt, Homo sapiens
agcgggauccuguucaaua

SEQ ID NO: 198133 - RNA, 19 nt, Homo sapiens
gaaaagcugaggucaucaa

SEQ ID NO: 198134 - RNA, 19 nt, Homo sapiens
agagagucccugaagaaga

SEQ ID NO: 198135 - RNA, 19 nt, Homo sapiens
ggucagcgggauccuguuc

SEQ ID NO: 198136 - RNA, 19 nt, Homo sapiens
ccaugaagaagaaguuagu

SEQ ID NO: 198137 - RNA, 19 nt, Homo sapiens
gcugaggaccugaacaacu

SEQ ID NO: 198138 - RNA, 19 nt, Homo sapiens
acgagacgcuggccaucga

SEQ ID NO: 198139 - RNA, 19 nt, Homo sapiens
gcuggacgcagagccauga

SEQ ID NO: 198140 - RNA, 19 nt, Homo sapiens
ucaacuggagacagagaaa

SEQ ID NO: 198141 - RNA, 19 nt, Homo sapiens
cggcagcccuggaaaacaa

SEQ ID NO: 198142 - RNA, 19 nt, Homo sapiens
ggucauugucggccucugu

SEQ ID NO: 198143 - RNA, 19 nt, Homo sapiens
ggaggacaaggcugacaag

SEQ ID NO: 198144 - RNA, 19 nt, Homo sapiens
caguggagagaaacauuga

SEQ ID NO: 198145 - RNA, 19 nt, Homo sapiens
gcaccaucaaccucuacuu

SEQ ID NO: 198146 - RNA, 19 nt, Homo sapiens
ugacagcugaggaccugaa

SEQ ID NO: 198147 - RNA, 19 nt, Homo sapiens
gagcagcagccugucuugu

SEQ ID NO: 198148 - RNA, 19 nt, Homo sapiens
ggagauccgaggcuaugag

SEQ ID NO: 198149 - RNA, 19 nt, Homo sapiens
gcauagcuguuuaauguua

SEQ ID NO: 198150 - RNA, 19 nt, Homo sapiens
gauaagagaccugaaauua

SEQ ID NO: 198151 - RNA, 19 nt, Homo sapiens
guacagagauacccauugu

SEQ ID NO: 198152 - RNA, 19 nt, Homo sapiens
gugcuaagcuccucaaugu

SEQ ID NO: 198153 - RNA, 19 nt, Homo sapiens
gggaugagaugacacaaga

SEQ ID NO: 198154 - RNA, 19 nt, Homo sapiens
ggaggugucucugcucuaa

SEQ ID NO: 198155 - RNA, 19 nt, Homo sapiens
uugcauagcuguuuaaugu

SEQ ID NO: 198156 - RNA, 19 nt, Homo sapiens
caaaugcccugagugguaa

SEQ ID NO: 198157 - RNA, 19 nt, Homo sapiens
gaugcuaacuugguucuuu

SEQ ID NO: 198158 - RNA, 19 nt, Homo sapiens
ucagauggcuuuccagaug

SEQ ID NO: 198159 - RNA, 19 nt, Homo sapiens
gugcagaacucuccacuuc

SEQ ID NO: 198160 - RNA, 19 nt, Homo sapiens
ucaaguaugugguucauuc

SEQ ID NO: 198161 - RNA, 19 nt, Homo sapiens
uaaaugacccuaacuuugu

SEQ ID NO: 198162 - RNA, 19 nt, Homo sapiens
acagaucgaguucuaauua

SEQ ID NO: 198163 - RNA, 19 nt, Homo sapiens
ggagagugcugcuaaaauu

SEQ ID NO: 198164 - RNA, 19 nt, Homo sapiens
gacuauggcaucuauguua

SEQ ID NO: 198165 - RNA, 19 nt, Homo sapiens
gaacacauucccggugaua

SEQ ID NO: 198166 - RNA, 19 nt, Homo sapiens
ucaaguacuggcuauauua

SEQ ID NO: 198167 - RNA, 19 nt, Homo sapiens
caaagugccuuaaaagaaa

SEQ ID NO: 198168 - RNA, 19 nt, Homo sapiens
gggcaacucuagcaucaga

SEQ ID NO: 198169 - RNA, 19 nt, Homo sapiens
caggacaggugggauauuu

SEQ ID NO: 198170 - RNA, 19 nt, Homo sapiens
uaagagaccugaaauuagc

SEQ ID NO: 198171 - RNA, 19 nt, Homo sapiens
gcuaagcuccucaauguug

SEQ ID NO: 198172 - RNA, 19 nt, Homo sapiens
gaauaaaugacccuaacuu

SEQ ID NO: 198173 - RNA, 19 nt, Homo sapiens
caaucaaugugucauaugu

SEQ ID NO: 198174 - RNA, 19 nt, Homo sapiens
gaacccaaaugugaagaug

SEQ ID NO: 198175 - RNA, 19 nt, Homo sapiens
gcagucagguuguuuacca

SEQ ID NO: 198176 - RNA, 19 nt, Homo sapiens
caacuuggcucggcaugug

SEQ ID NO: 198177 - RNA, 19 nt, Homo sapiens
gaucgaguucuaauuauga

SEQ ID NO: 198178 - RNA, 19 nt, Homo sapiens
aggagaagaugaugacauu

SEQ ID NO: 198179 - RNA, 19 nt, Homo sapiens
gggagacacuauauucaau

SEQ ID NO: 198180 - RNA, 19 nt, Homo sapiens
ggcaggagcaccucaagua

SEQ ID NO: 198181 - RNA, 19 nt, Homo sapiens
aguaugugguucauucuua

SEQ ID NO: 198182 - RNA, 19 nt, Homo sapiens
agucuuaucugugccuuua

SEQ ID NO: 198183 - RNA, 19 nt, Homo sapiens
acaaaugcccugaguggua

SEQ ID NO: 198184 - RNA, 19 nt, Homo sapiens
aagcagaacccaaauguga

SEQ ID NO: 198185 - RNA, 19 nt, Homo sapiens
ucaaacagacuauccauuc

SEQ ID NO: 198186 - RNA, 19 nt, Homo sapiens
ggcaugcuauguaaacuug

SEQ ID NO: 198187 - RNA, 19 nt, Homo sapiens
ggauucagccuaccuuaug

SEQ ID NO: 198188 - RNA, 19 nt, Homo sapiens
ccagaaggcuuuguauugg

SEQ ID NO: 198189 - RNA, 19 nt, Homo sapiens
gcaugaaugugccuuuuaa

SEQ ID NO: 198190 - RNA, 19 nt, Homo sapiens
caaauuugcauagcuguuu

SEQ ID NO: 198191 - RNA, 19 nt, Homo sapiens
gggcuggucccucucauuu

SEQ ID NO: 198192 - RNA, 19 nt, Homo sapiens
ggacaccgagcuagcguuu

SEQ ID NO: 198193 - RNA, 19 nt, Homo sapiens
guccgcagauccugacuuu

SEQ ID NO: 198194 - RNA, 19 nt, Homo sapiens
ccaagaacuucgguccuaa

SEQ ID NO: 198195 - RNA, 19 nt, Homo sapiens
caaagcagaacccaaaugu

SEQ ID NO: 198196 - RNA, 19 nt, Homo sapiens
gcacucagggucaaacaga

SEQ ID NO: 198197 - RNA, 19 nt, Homo sapiens
caaugugucauaugucuuu

SEQ ID NO: 198198 - RNA, 19 nt, Homo sapiens
ggauaagagaccugaaauu

SEQ ID NO: 198199 - RNA, 19 nt, Homo sapiens
agaaagaacagaucgaguu

SEQ ID NO: 198200 - RNA, 19 nt, Homo sapiens
agucagaacuguagacauc

SEQ ID NO: 198201 - RNA, 19 nt, Homo sapiens
gcuccucaauguuggcuuu

SEQ ID NO: 198202 - RNA, 19 nt, Homo sapiens
ucagagguuugaccgaauu

SEQ ID NO: 198203 - RNA, 19 nt, Homo sapiens
gcagagagcagcugugacu

SEQ ID NO: 198204 - RNA, 19 nt, Homo sapiens
gaauugcacacacaaagga

SEQ ID NO: 198205 - RNA, 19 nt, Homo sapiens
ucacagccacggcacauuu

SEQ ID NO: 198206 - RNA, 19 nt, Homo sapiens
gcuggacuauggcaucuau

SEQ ID NO: 198207 - RNA, 19 nt, Homo sapiens
aaaccaaacucuaccuuuu

SEQ ID NO: 198208 - RNA, 19 nt, Homo sapiens
gcaaagcagaacccaaaug

SEQ ID NO: 198209 - RNA, 19 nt, Homo sapiens
gaaugugccuuuuaauuag

SEQ ID NO: 198210 - RNA, 19 nt, Homo sapiens
cagaucgaguucuaauuau

SEQ ID NO: 198211 - RNA, 19 nt, Homo sapiens
gaccaggacaggugggaua

SEQ ID NO: 198212 - RNA, 19 nt, Homo sapiens
ggaguugugggaaauaaga

SEQ ID NO: 198213 - RNA, 19 nt, Homo sapiens
ggagggguauugagcauuu

SEQ ID NO: 198214 - RNA, 19 nt, Homo sapiens
cagggcaacucuagcauca

SEQ ID NO: 198215 - RNA, 19 nt, Homo sapiens
cagauggcuuuccagauga

SEQ ID NO: 198216 - RNA, 19 nt, Homo sapiens
ccaagacucagcugccuaa

SEQ ID NO: 198217 - RNA, 19 nt, Homo sapiens
cccaagaacuucgguccua

SEQ ID NO: 198218 - RNA, 19 nt, Homo sapiens
ccaugcugauugaguuuaa

SEQ ID NO: 198219 - RNA, 19 nt, Homo sapiens
gcaucuauguuaucaacca

SEQ ID NO: 198220 - RNA, 19 nt, Homo sapiens
gcacagccagggcacaguu

SEQ ID NO: 198221 - RNA, 19 nt, Homo sapiens
ucauucaugucaaguaugu

SEQ ID NO: 198222 - RNA, 19 nt, Homo sapiens
aaagaaaucagacaaaugc

SEQ ID NO: 198223 - RNA, 19 nt, Homo sapiens
gcgucacccucguuuacua

SEQ ID NO: 198224 - RNA, 19 nt, Homo sapiens
gaacuguagacaucccaaa

SEQ ID NO: 198225 - RNA, 19 nt, Homo sapiens
ccagggaccucugcugugu

SEQ ID NO: 198226 - RNA, 19 nt, Homo sapiens
acaaugcucucugaugguu

SEQ ID NO: 198227 - RNA, 19 nt, Homo sapiens
gugaauaaaugacccuaac

SEQ ID NO: 198228 - RNA, 19 nt, Homo sapiens
gaccuguugugcuguguau

SEQ ID NO: 198229 - RNA, 19 nt, Homo sapiens
uagccaggaugacgccuuu

SEQ ID NO: 198230 - RNA, 19 nt, Homo sapiens
ucacaaacccaccucuguu

SEQ ID NO: 198231 - RNA, 19 nt, Homo sapiens
uggcaaagcagaacccaaa

SEQ ID NO: 198232 - RNA, 19 nt, Homo sapiens
ggugcuggauguacagaga

SEQ ID NO: 198233 - RNA, 19 nt, Homo sapiens
gucgggaggugucgcauga

SEQ ID NO: 198234 - RNA, 19 nt, Homo sapiens
gucuauaucucgcccaaau

SEQ ID NO: 198235 - RNA, 19 nt, Homo sapiens
gagaagaugaugacauuuu

SEQ ID NO: 198236 - RNA, 19 nt, Homo sapiens
auaaaugacccuaacuuug

SEQ ID NO: 198237 - RNA, 19 nt, Homo sapiens
agacucagcugccuaaucc

SEQ ID NO: 198238 - RNA, 19 nt, Homo sapiens
gcuguaguggccacaaaua

SEQ ID NO: 198239 - RNA, 19 nt, Homo sapiens
ggacuauggcaucuauguu

SEQ ID NO: 198240 - RNA, 19 nt, Homo sapiens
aauguuggcuuucaagaag

SEQ ID NO: 198241 - RNA, 19 nt, Homo sapiens
gauuuccuguguaugcaaa

SEQ ID NO: 198242 - RNA, 19 nt, Homo sapiens
gagagcagcugugacucau

SEQ ID NO: 198243 - RNA, 19 nt, Homo sapiens
agaaggcuuuguauugguu

SEQ ID NO: 198244 - RNA, 19 nt, Homo sapiens
uuagugaucuagaaagaag

SEQ ID NO: 198245 - RNA, 19 nt, Homo sapiens
caaguacuggcuauauuau

SEQ ID NO: 198246 - RNA, 19 nt, Homo sapiens
gcaaucaaugugucauaug

SEQ ID NO: 198247 - RNA, 19 nt, Homo sapiens
gauucagccuaccuuaugu

SEQ ID NO: 198248 - RNA, 19 nt, Homo sapiens
ucucauucaugucaaguau

SEQ ID NO: 198249 - RNA, 19 nt, Homo sapiens
gaaaguagaugucuuaucc

SEQ ID NO: 198250 - RNA, 19 nt, Homo sapiens
ggagaaaguagaugucuua

SEQ ID NO: 198251 - RNA, 19 nt, Homo sapiens
caacgugacucaugaucua

SEQ ID NO: 198252 - RNA, 19 nt, Homo sapiens
gcagagacccugaagauug

SEQ ID NO: 198253 - RNA, 19 nt, Homo sapiens
gaagagacccugcaaagau

SEQ ID NO: 198254 - RNA, 19 nt, Homo sapiens
gcaucgaggugcucaguaa

SEQ ID NO: 198255 - RNA, 19 nt, Homo sapiens
gcaaagggaaauuaaagaa

SEQ ID NO: 198256 - RNA, 19 nt, Homo sapiens
gaaaugagagccaccuaau

SEQ ID NO: 198257 - RNA, 19 nt, Homo sapiens
guacagaggccaccugguu

SEQ ID NO: 198258 - RNA, 19 nt, Homo sapiens
ggagaucccgucuaugauu

SEQ ID NO: 198259 - RNA, 19 nt, Homo sapiens
ugacacagguucugcugaa

SEQ ID NO: 198260 - RNA, 19 nt, Homo sapiens
ggaagcggccacucucuuu

SEQ ID NO: 198261 - RNA, 19 nt, Homo sapiens
caugggaccugaugacuuc

SEQ ID NO: 198262 - RNA, 19 nt, Homo sapiens
aagaggacuucagcaauua

SEQ ID NO: 198263 - RNA, 19 nt, Homo sapiens
caaacccaaucccagagua

SEQ ID NO: 198264 - RNA, 19 nt, Homo sapiens
caucagugcucucaacauc

SEQ ID NO: 198265 - RNA, 19 nt, Homo sapiens
gaacagcugccacccaaca

SEQ ID NO: 198266 - RNA, 19 nt, Homo sapiens
ggaagagacccugcaaaga

SEQ ID NO: 198267 - RNA, 19 nt, Homo sapiens
gagagccaccuaauugauu

SEQ ID NO: 198268 - RNA, 19 nt, Homo sapiens
guacaugacauccgacgaa

SEQ ID NO: 198269 - RNA, 19 nt, Homo sapiens
ggcaggaccuugaggaauc

SEQ ID NO: 198270 - RNA, 19 nt, Homo sapiens
ugaauguccugaccuugaa

SEQ ID NO: 198271 - RNA, 19 nt, Homo sapiens
gagaucccgucuaugauuc

SEQ ID NO: 198272 - RNA, 19 nt, Homo sapiens
aaugagagccaccuaauug

SEQ ID NO: 198273 - RNA, 19 nt, Homo sapiens
cagaguaacuggaaaauuc

SEQ ID NO: 198274 - RNA, 19 nt, Homo sapiens
ucacugagagcauggauga

SEQ ID NO: 198275 - RNA, 19 nt, Homo sapiens
gcacuucacugggcaucga

SEQ ID NO: 198276 - RNA, 19 nt, Homo sapiens
ucacagaggaagagauuga

SEQ ID NO: 198277 - RNA, 19 nt, Homo sapiens
gcgugaugcugguacauga

SEQ ID NO: 198278 - RNA, 19 nt, Homo sapiens
gcagcagccuuguguuugg

SEQ ID NO: 198279 - RNA, 19 nt, Homo sapiens
gggaagagacccugcaaag

SEQ ID NO: 198280 - RNA, 19 nt, Homo sapiens
agagccaccuaauugauuu

SEQ ID NO: 198281 - RNA, 19 nt, Homo sapiens
uuagggaugugcuugcaaa

SEQ ID NO: 198282 - RNA, 19 nt, Homo sapiens
cgaaaugagagccaccuaa

SEQ ID NO: 198283 - RNA, 19 nt, Homo sapiens
caugacauccgacgaaaug

SEQ ID NO: 198284 - RNA, 19 nt, Homo sapiens
cuggagggcuucaaucuca

SEQ ID NO: 198285 - RNA, 19 nt, Homo sapiens
gcuucaacgugacucauga

SEQ ID NO: 198286 - RNA, 19 nt, Homo sapiens
gcaggaccuugaggaauca

SEQ ID NO: 198287 - RNA, 19 nt, Homo sapiens
guucacagaggaagagauu

SEQ ID NO: 198288 - RNA, 19 nt, Homo sapiens
uggcugaggugcuggaugu

SEQ ID NO: 198289 - RNA, 19 nt, Homo sapiens
ccaguuccuuucucccauu

SEQ ID NO: 198290 - RNA, 19 nt, Homo sapiens
uucccagccucauuucuua

SEQ ID NO: 198291 - RNA, 19 nt, Homo sapiens
cacagguucugcugaaugu

SEQ ID NO: 198292 - RNA, 19 nt, Homo sapiens
ggacgaggacgccuuucug

SEQ ID NO: 198293 - RNA, 19 nt, Homo sapiens
gaggccaccugguucuuag

SEQ ID NO: 198294 - RNA, 19 nt, Homo sapiens
gcagguggacagugaguuc

SEQ ID NO: 198295 - RNA, 19 nt, Homo sapiens
cagagacccugaagauugc

SEQ ID NO: 198296 - RNA, 19 nt, Homo sapiens
aagagacccugcaaagauc

SEQ ID NO: 198297 - RNA, 19 nt, Homo sapiens
gaccaacaacuucaucauc

SEQ ID NO: 198298 - RNA, 19 nt, Homo sapiens
gagccaccauccuguagag

SEQ ID NO: 198299 - RNA, 19 nt, Homo sapiens
gaucccgucuaugauucua

SEQ ID NO: 198300 - RNA, 19 nt, Homo sapiens
uggcagagacccugaagau

SEQ ID NO: 198301 - RNA, 19 nt, Homo sapiens
aaaugagagccaccuaauu

SEQ ID NO: 198302 - RNA, 19 nt, Homo sapiens
gacauccgacgaaaugaga

SEQ ID NO: 198303 - RNA, 19 nt, Homo sapiens
cagaggaagagauugaguu

SEQ ID NO: 198304 - RNA, 19 nt, Homo sapiens
gaagcggccacucucuuuc

SEQ ID NO: 198305 - RNA, 19 nt, Homo sapiens
gacccugaagauugcauua

SEQ ID NO: 198306 - RNA, 19 nt, Homo sapiens
aaacccaaucccagaguaa

SEQ ID NO: 198307 - RNA, 19 nt, Homo sapiens
ccggacagcuaaccacucu

SEQ ID NO: 198308 - RNA, 19 nt, Homo sapiens
gauucuaccaucacugaga

SEQ ID NO: 198309 - RNA, 19 nt, Homo sapiens
uggcagcagccuuguguuu

SEQ ID NO: 198310 - RNA, 19 nt, Homo sapiens
ugucaccucuccuccuuca

SEQ ID NO: 198311 - RNA, 19 nt, Homo sapiens
gccgaaggaccaacaacuu

SEQ ID NO: 198312 - RNA, 19 nt, Homo sapiens
ggcccaagauggcuucaac

SEQ ID NO: 198313 - RNA, 19 nt, Homo sapiens
uacaugacauccgacgaaa

SEQ ID NO: 198314 - RNA, 19 nt, Homo sapiens
gcaaacccaaucccagagu

SEQ ID NO: 198315 - RNA, 19 nt, Homo sapiens
ggaccaacaacuucaucau

SEQ ID NO: 198316 - RNA, 19 nt, Homo sapiens
cugaauguccugaccuuga

SEQ ID NO: 198317 - RNA, 19 nt, Homo sapiens
gggaagcggccacucucuu

SEQ ID NO: 198318 - RNA, 19 nt, Homo sapiens
gggcuuccauuugcaaagg

SEQ ID NO: 198319 - RNA, 19 nt, Homo sapiens
ggcccaaccggacagcuaa

SEQ ID NO: 198320 - RNA, 19 nt, Homo sapiens
acuccugccugucuaugaa

SEQ ID NO: 198321 - RNA, 19 nt, Homo sapiens
ccucaucagugcucucaac

SEQ ID NO: 198322 - RNA, 19 nt, Homo sapiens
gguggcagcagccuugugu

SEQ ID NO: 198323 - RNA, 19 nt, Homo sapiens
ggagaugggcagccaagac

SEQ ID NO: 198324 - RNA, 19 nt, Homo sapiens
ugugucaccucuccuccuu

SEQ ID NO: 198325 - RNA, 19 nt, Homo sapiens
ggcagcagccuuguguuug

SEQ ID NO: 198326 - RNA, 19 nt, Homo sapiens
ggagccaccauccuguaga

SEQ ID NO: 198327 - RNA, 19 nt, Homo sapiens
guccauggcagccgaagga

SEQ ID NO: 198328 - RNA, 19 nt, Homo sapiens
ccacguggagaaaguagau

SEQ ID NO: 198329 - RNA, 19 nt, Homo sapiens
ggcagagacccugaagauu

SEQ ID NO: 198330 - RNA, 19 nt, Homo sapiens
ggucaugcagaucuacuuc

SEQ ID NO: 198331 - RNA, 19 nt, Homo sapiens
agaggccaccugguucuua

SEQ ID NO: 198332 - RNA, 19 nt, Homo sapiens
ugaccugggccuugucuuc

SEQ ID NO: 198333 - RNA, 19 nt, Homo sapiens
agugucagcaucuacagua

SEQ ID NO: 198334 - RNA, 19 nt, Homo sapiens
gagaaaguagaugucuuau

SEQ ID NO: 198335 - RNA, 19 nt, Homo sapiens
uggagaaaguagaugucuu

SEQ ID NO: 198336 - RNA, 19 nt, Homo sapiens
acacagguucugcugaaug

SEQ ID NO: 198337 - RNA, 19 nt, Homo sapiens
gacacagguucugcugaau

SEQ ID NO: 198338 - RNA, 19 nt, Homo sapiens
ucaguaaacagggaucuuc

SEQ ID NO: 198339 - RNA, 19 nt, Homo sapiens
ucgaggugcucaguaaaca

SEQ ID NO: 198340 - RNA, 19 nt, Homo sapiens
ugagagccaccuaauugau

SEQ ID NO: 198341 - RNA, 19 nt, Homo sapiens
caacuucaucaucgcuguu

SEQ ID NO: 198342 - RNA, 19 nt, Homo sapiens
gcucaggggcuuccauuug

SEQ ID NO: 198343 - RNA, 19 nt, Homo sapiens
cccauucccagccucauuu

SEQ ID NO: 198344 - RNA, 19 nt, Homo sapiens
gcuuagggaugugcuugca

SEQ ID NO: 198345 - RNA, 19 nt, Homo sapiens
agaggaagagauugaguuc

SEQ ID NO: 198346 - RNA, 19 nt, Homo sapiens
caaccucacacuggagaug

SEQ ID NO: 198347 - RNA, 19 nt, Homo sapiens
ggacaggcaucauccucaa

SEQ ID NO: 198348 - RNA, 19 nt, Homo sapiens
gcccaucucugucccauug

SEQ ID NO: 198349 - RNA, 19 nt, Homo sapiens
ggucgaagcuagugauugg

SEQ ID NO: 198350 - RNA, 19 nt, Homo sapiens
acaacgagcuccuggacuu

SEQ ID NO: 198351 - RNA, 19 nt, Homo sapiens
gcuaagaggguucaacuuc

SEQ ID NO: 198352 - RNA, 19 nt, Homo sapiens
ggaggacauugccaaggaa

SEQ ID NO: 198353 - RNA, 19 nt, Homo sapiens
guagagacgcucaaguuug

SEQ ID NO: 198354 - RNA, 19 nt, Homo sapiens
ggaggccgcaggcuacuaa

SEQ ID NO: 198355 - RNA, 19 nt, Homo sapiens
gaacguguaccaccaccuu

SEQ ID NO: 198356 - RNA, 19 nt, Homo sapiens
gaagguggaggucaucaau

SEQ ID NO: 198357 - RNA, 19 nt, Homo sapiens
uccaaggucugcucggaua

SEQ ID NO: 198358 - RNA, 19 nt, Homo sapiens
gaccaucuuucucuuacug

SEQ ID NO: 198359 - RNA, 19 nt, Homo sapiens
gcacgucccaugugucugu

SEQ ID NO: 198360 - RNA, 19 nt, Homo sapiens
aguccaagauuaaagaaga

SEQ ID NO: 198361 - RNA, 19 nt, Homo sapiens
ccagccaucuguccauuca

SEQ ID NO: 198362 - RNA, 19 nt, Homo sapiens
caacgagcuccuggacuua

SEQ ID NO: 198363 - RNA, 19 nt, Homo sapiens
uagagacgcucaaguuugc

SEQ ID NO: 198364 - RNA, 19 nt, Homo sapiens
cuagcuaucuggccuaucu

SEQ ID NO: 198365 - RNA, 19 nt, Homo sapiens
gcaagggcuguguggagua

SEQ ID NO: 198366 - RNA, 19 nt, Homo sapiens
uuacuguccucuuugucua

SEQ ID NO: 198367 - RNA, 19 nt, Homo sapiens
ggaguacgagcccaacuuc

SEQ ID NO: 198368 - RNA, 19 nt, Homo sapiens
uaagaggguucaacuucuc

SEQ ID NO: 198369 - RNA, 19 nt, Homo sapiens
uggaggacauugccaagga

SEQ ID NO: 198370 - RNA, 19 nt, Homo sapiens
uuguccaucuguccaauua

SEQ ID NO: 198371 - RNA, 19 nt, Homo sapiens
cuaagaggguucaacuucu

SEQ ID NO: 198372 - RNA, 19 nt, Homo sapiens
gcaucauccucaacaacga

SEQ ID NO: 198373 - RNA, 19 nt, Homo sapiens
ggacuauacccuguacuca

SEQ ID NO: 198374 - RNA, 19 nt, Homo sapiens
uuggagcgaugguguauuc

SEQ ID NO: 198375 - RNA, 19 nt, Homo sapiens
aagggagggugaacgugua

SEQ ID NO: 198376 - RNA, 19 nt, Homo sapiens
cagcucauccgccaacaga

SEQ ID NO: 198377 - RNA, 19 nt, Homo sapiens
ucacccaucuguccaucug

SEQ ID NO: 198378 - RNA, 19 nt, Homo sapiens
uaaagaagaggcggacugu

SEQ ID NO: 198379 - RNA, 19 nt, Homo sapiens
caucaacacacccuuugga

SEQ ID NO: 198380 - RNA, 19 nt, Homo sapiens
uguagagacgcucaaguuu

SEQ ID NO: 198381 - RNA, 19 nt, Homo sapiens
ucuguaagcccaucucugu

SEQ ID NO: 198382 - RNA, 19 nt, Homo sapiens
ccaagaccguggccagaac

SEQ ID NO: 198383 - RNA, 19 nt, Homo sapiens
gguucaacuucucaacaga

SEQ ID NO: 198384 - RNA, 19 nt, Homo sapiens
ggaagguggaggucaucaa

SEQ ID NO: 198385 - RNA, 19 nt, Homo sapiens
caucuacaaugugacaaca

SEQ ID NO: 198386 - RNA, 19 nt, Homo sapiens
caucuucaccaucuacaau

SEQ ID NO: 198387 - RNA, 19 nt, Homo sapiens
gcucauccgccaacagauc

SEQ ID NO: 198388 - RNA, 19 nt, Homo sapiens
acccgaagcuccagaaugc

SEQ ID NO: 198389 - RNA, 19 nt, Homo sapiens
ggguucaacuucucaacag

SEQ ID NO: 198390 - RNA, 19 nt, Homo sapiens
ggcgcuggcugucauugug

SEQ ID NO: 198391 - RNA, 19 nt, Homo sapiens
caacuucucaacagagucu

SEQ ID NO: 198392 - RNA, 19 nt, Homo sapiens
ggucugcucggauauugga

SEQ ID NO: 198393 - RNA, 19 nt, Homo sapiens
caaggucugcucggauauu

SEQ ID NO: 198394 - RNA, 19 nt, Homo sapiens
uguauauccuccaguccaa

SEQ ID NO: 198395 - RNA, 19 nt, Homo sapiens
gaccugagagcggccauug

SEQ ID NO: 198396 - RNA, 19 nt, Homo sapiens
cagggaagguggaggucau

SEQ ID NO: 198397 - RNA, 19 nt, Homo sapiens
gauccaucuucgugucugu

SEQ ID NO: 198398 - RNA, 19 nt, Homo sapiens
caagggcuguguggaguac

SEQ ID NO: 198399 - RNA, 19 nt, Homo sapiens
acaggcacgucccaugugu

SEQ ID NO: 198400 - RNA, 19 nt, Homo sapiens
uaucugaccaucuuucucu

SEQ ID NO: 198401 - RNA, 19 nt, Homo sapiens
ggaccagcugggcagauga

SEQ ID NO: 198402 - RNA, 19 nt, Homo sapiens
gcuuggcuuugaccugaga

SEQ ID NO: 198403 - RNA, 19 nt, Homo sapiens
ggugccauucucagcuuua

SEQ ID NO: 198404 - RNA, 19 nt, Homo sapiens
gcguggaggucuucuacac

SEQ ID NO: 198405 - RNA, 19 nt, Homo sapiens
ucuguccaauuaccuguga

SEQ ID NO: 198406 - RNA, 19 nt, Homo sapiens
cagagggcguggaggucuu

SEQ ID NO: 198407 - RNA, 19 nt, Homo sapiens
uggagaccguggccacaga

SEQ ID NO: 198408 - RNA, 19 nt, Homo sapiens
ucugaccaucuuucucuua

SEQ ID NO: 198409 - RNA, 19 nt, Homo sapiens
gcaucuucuuguccauuca

SEQ ID NO: 198410 - RNA, 19 nt, Homo sapiens
ucucggaccugaggaagag

SEQ ID NO: 198411 - RNA, 19 nt, Homo sapiens
caccaucaacacacccuuu

SEQ ID NO: 198412 - RNA, 19 nt, Homo sapiens
gugccauucucagcuuuau

SEQ ID NO: 198413 - RNA, 19 nt, Homo sapiens
aaggucugcucggauauug

SEQ ID NO: 198414 - RNA, 19 nt, Homo sapiens
auccuccaguccaagauua

SEQ ID NO: 198415 - RNA, 19 nt, Homo sapiens
gccgcaggcuacuaagaca

SEQ ID NO: 198416 - RNA, 19 nt, Homo sapiens
gggugccauucucagcuuu

SEQ ID NO: 198417 - RNA, 19 nt, Homo sapiens
caaaggaacagaaguauuc

SEQ ID NO: 198418 - RNA, 19 nt, Homo sapiens
ggaaggacauggacaaggu

SEQ ID NO: 198419 - RNA, 19 nt, Homo sapiens
gaacagaaguauucauucc

SEQ ID NO: 198420 - RNA, 19 nt, Homo sapiens
ggaggaaacacaacagaaa

SEQ ID NO: 198421 - RNA, 19 nt, Homo sapiens
caccagccuuguccuaaua

SEQ ID NO: 198422 - RNA, 19 nt, Homo sapiens
ggacugggcagaucuucaa

SEQ ID NO: 198423 - RNA, 19 nt, Homo sapiens
gggcagcuguggcuucuag

SEQ ID NO: 198424 - RNA, 19 nt, Homo sapiens
caacagggaggaaacacaa

SEQ ID NO: 198425 - RNA, 19 nt, Homo sapiens
uggacaaggucgagacauu

SEQ ID NO: 198426 - RNA, 19 nt, Homo sapiens
aaacacaacagaaauccaa

SEQ ID NO: 198427 - RNA, 19 nt, Homo sapiens
gaggaaacacaacagaaau

SEQ ID NO: 198428 - RNA, 19 nt, Homo sapiens
ccaccagccuuguccuaau

SEQ ID NO: 198429 - RNA, 19 nt, Homo sapiens
ggacaaggucgagacauuc

SEQ ID NO: 198430 - RNA, 19 nt, Homo sapiens
aagcagaccuacagcaagu

SEQ ID NO: 198431 - RNA, 19 nt, Homo sapiens
gggcugcucuacugcuuca

SEQ ID NO: 198432 - RNA, 19 nt, Homo sapiens
ggaacagaaguauucauuc

SEQ ID NO: 198433 - RNA, 19 nt, Homo sapiens
ccaaaggaacagaaguauu

SEQ ID NO: 198434 - RNA, 19 nt, Homo sapiens
ccuaaaggaccuagaggaa

SEQ ID NO: 198435 - RNA, 19 nt, Homo sapiens
aagccuauaucccaaagga

SEQ ID NO: 198436 - RNA, 19 nt, Homo sapiens
gggaggaaacacaacagaa

SEQ ID NO: 198437 - RNA, 19 nt, Homo sapiens
ucaagcagaccuacagcaa

SEQ ID NO: 198438 - RNA, 19 nt, Homo sapiens
acaccuaccaggaguuuga

SEQ ID NO: 198439 - RNA, 19 nt, Homo sapiens
ggaguuugaagaagccuau

SEQ ID NO: 198440 - RNA, 19 nt, Homo sapiens
ugcaccagcuggccuuuga

SEQ ID NO: 198441 - RNA, 19 nt, Homo sapiens
gagggcagcuguggcuucu

SEQ ID NO: 198442 - RNA, 19 nt, Homo sapiens
gaacuacgggcugcucuac

SEQ ID NO: 198443 - RNA, 19 nt, Homo sapiens
gcagugccuucccaaccau

SEQ ID NO: 198444 - RNA, 19 nt, Homo sapiens
ucccaaaggaacagaagua

SEQ ID NO: 198445 - RNA, 19 nt, Homo sapiens
aggaacagaaguauucauu

SEQ ID NO: 198446 - RNA, 19 nt, Homo sapiens
acagaaauccaaccuagag

SEQ ID NO: 198447 - RNA, 19 nt, Homo sapiens
ugacaccuaccaggaguuu

SEQ ID NO: 198448 - RNA, 19 nt, Homo sapiens
cuaccaggaguuugaagaa

SEQ ID NO: 198449 - RNA, 19 nt, Homo sapiens
ucaggaaggacauggacaa

SEQ ID NO: 198450 - RNA, 19 nt, Homo sapiens
ccagccuuguccuaauaaa

SEQ ID NO: 198451 - RNA, 19 nt, Homo sapiens
cgucccugcuccuggcuuu

SEQ ID NO: 198452 - RNA, 19 nt, Homo sapiens
gcaucucccugcugcucau

SEQ ID NO: 198453 - RNA, 19 nt, Homo sapiens
gaaacacaacagaaaucca

SEQ ID NO: 198454 - RNA, 19 nt, Homo sapiens
aguauucauuccugcagaa

SEQ ID NO: 198455 - RNA, 19 nt, Homo sapiens
acuacgggcugcucuacug

SEQ ID NO: 198456 - RNA, 19 nt, Homo sapiens
ggaaacacaacagaaaucc

SEQ ID NO: 198457 - RNA, 19 nt, Homo sapiens
ucccaaccauucccuuauc

SEQ ID NO: 198458 - RNA, 19 nt, Homo sapiens
ggaaggacauggacaaggu

SEQ ID NO: 198459 - RNA, 19 nt, Homo sapiens
ggaggaaacacaacagaaa

SEQ ID NO: 198460 - RNA, 19 nt, Homo sapiens
caccagccuuguccuaaua

SEQ ID NO: 198461 - RNA, 19 nt, Homo sapiens
ggacugggcagaucuucaa

SEQ ID NO: 198462 - RNA, 19 nt, Homo sapiens
gggcagcuguggcuucuag

SEQ ID NO: 198463 - RNA, 19 nt, Homo sapiens
caacagggaggaaacacaa

SEQ ID NO: 198464 - RNA, 19 nt, Homo sapiens
uggacaaggucgagacauu

SEQ ID NO: 198465 - RNA, 19 nt, Homo sapiens
aaacacaacagaaauccaa

SEQ ID NO: 198466 - RNA, 19 nt, Homo sapiens
gaggaaacacaacagaaau

SEQ ID NO: 198467 - RNA, 19 nt, Homo sapiens
ccaccagccuuguccuaau

SEQ ID NO: 198468 - RNA, 19 nt, Homo sapiens
ggacaaggucgagacauuc

SEQ ID NO: 198469 - RNA, 19 nt, Homo sapiens
aagcagaccuacagcaagu

SEQ ID NO: 198470 - RNA, 19 nt, Homo sapiens
acaccuaccaggaguuuaa

SEQ ID NO: 198471 - RNA, 19 nt, Homo sapiens
gggcugcucuacugcuuca

SEQ ID NO: 198472 - RNA, 19 nt, Homo sapiens
ccuaaaggaccuagaggaa

SEQ ID NO: 198473 - RNA, 19 nt, Homo sapiens
gggaggaaacacaacagaa

SEQ ID NO: 198474 - RNA, 19 nt, Homo sapiens
ucaagcagaccuacagcaa

SEQ ID NO: 198475 - RNA, 19 nt, Homo sapiens
ugcaccagcuggccuuuga

SEQ ID NO: 198476 - RNA, 19 nt, Homo sapiens
gagggcagcuguggcuucu

SEQ ID NO: 198477 - RNA, 19 nt, Homo sapiens
gcagugccuucccaaccau

SEQ ID NO: 198478 - RNA, 19 nt, Homo sapiens
gaacuacgggcugcucuac

SEQ ID NO: 198479 - RNA, 19 nt, Homo sapiens
acagaaauccaaccuagag

SEQ ID NO: 198480 - RNA, 19 nt, Homo sapiens
ugacaccuaccaggaguuu

SEQ ID NO: 198481 - RNA, 19 nt, Homo sapiens
ucaggaaggacauggacaa

SEQ ID NO: 198482 - RNA, 19 nt, Homo sapiens
ccagccuuguccuaauaaa

SEQ ID NO: 198483 - RNA, 19 nt, Homo sapiens
gcaucucccugcugcucau

SEQ ID NO: 198484 - RNA, 19 nt, Homo sapiens
gaaacacaacagaaaucca

SEQ ID NO: 198485 - RNA, 19 nt, Homo sapiens
cgucccugcuccuggcuuu

SEQ ID NO: 198486 - RNA, 19 nt, Homo sapiens
acuacgggcugcucuacug

SEQ ID NO: 198487 - RNA, 19 nt, Homo sapiens
ucccaaccauucccuuauc

SEQ ID NO: 198488 - RNA, 19 nt, Homo sapiens
ggaaacacaacagaaaucc

SEQ ID NO: 198489 - RNA, 19 nt, Homo sapiens
ggaaggacauggacaaggu

SEQ ID NO: 198490 - RNA, 19 nt, Homo sapiens
caccagccuuguccuaaua

SEQ ID NO: 198491 - RNA, 19 nt, Homo sapiens
ggacugggcagaucuucaa

SEQ ID NO: 198492 - RNA, 19 nt, Homo sapiens
gggcagcuguggcuucuag

SEQ ID NO: 198493 - RNA, 19 nt, Homo sapiens
uggacaaggucgagacauu

SEQ ID NO: 198494 - RNA, 19 nt, Homo sapiens
ccaccagccuuguccuaau

SEQ ID NO: 198495 - RNA, 19 nt, Homo sapiens
ggacaaggucgagacauuc

SEQ ID NO: 198496 - RNA, 19 nt, Homo sapiens
aagcagaccuacagcaagu

SEQ ID NO: 198497 - RNA, 19 nt, Homo sapiens
acaccuaccaggaguuuaa

SEQ ID NO: 198498 - RNA, 19 nt, Homo sapiens
gggcugcucuacugcuuca

SEQ ID NO: 198499 - RNA, 19 nt, Homo sapiens
ccuaaaggaccuagaggaa

SEQ ID NO: 198500 - RNA, 19 nt, Homo sapiens
ucaagcagaccuacagcaa

SEQ ID NO: 198501 - RNA, 19 nt, Homo sapiens
ugcaccagcuggccuuuga

SEQ ID NO: 198502 - RNA, 19 nt, Homo sapiens
gagggcagcuguggcuucu

SEQ ID NO: 198503 - RNA, 19 nt, Homo sapiens
gaacuacgggcugcucuac

SEQ ID NO: 198504 - RNA, 19 nt, Homo sapiens
gcagugccuucccaaccau

SEQ ID NO: 198505 - RNA, 19 nt, Homo sapiens
ugacaccuaccaggaguuu

SEQ ID NO: 198506 - RNA, 19 nt, Homo sapiens
ucaggaaggacauggacaa

SEQ ID NO: 198507 - RNA, 19 nt, Homo sapiens
ccagccuuguccuaauaaa

SEQ ID NO: 198508 - RNA, 19 nt, Homo sapiens
cgucccugcuccuggcuuu

SEQ ID NO: 198509 - RNA, 19 nt, Homo sapiens
gcaucucccugcugcucau

SEQ ID NO: 198510 - RNA, 19 nt, Homo sapiens
cuaccaggaguuuaaccua

SEQ ID NO: 198511 - RNA, 19 nt, Homo sapiens
acuacgggcugcucuacug

SEQ ID NO: 198512 - RNA, 19 nt, Homo sapiens
accaggaguuuaaccuaga

SEQ ID NO: 198513 - RNA, 19 nt, Homo sapiens
ucccaaccauucccuuauc

SEQ ID NO: 198514 - RNA, 19 nt, Homo sapiens
ggaaggacauggacaaggu

SEQ ID NO: 198515 - RNA, 19 nt, Homo sapiens
caccagccuuguccuaaua

SEQ ID NO: 198516 - RNA, 19 nt, Homo sapiens
ggacugggcagaucuucaa

SEQ ID NO: 198517 - RNA, 19 nt, Homo sapiens
gggcagcuguggcuucuag

SEQ ID NO: 198518 - RNA, 19 nt, Homo sapiens
uggacaaggucgagacauu

SEQ ID NO: 198519 - RNA, 19 nt, Homo sapiens
ccaccagccuuguccuaau

SEQ ID NO: 198520 - RNA, 19 nt, Homo sapiens
ggacaaggucgagacauuc

SEQ ID NO: 198521 - RNA, 19 nt, Homo sapiens
aagcagaccuacagcaagu

SEQ ID NO: 198522 - RNA, 19 nt, Homo sapiens
gggcugcucuacugcuuca

SEQ ID NO: 198523 - RNA, 19 nt, Homo sapiens
ucaagcagaccuacagcaa

SEQ ID NO: 198524 - RNA, 19 nt, Homo sapiens
ugcaccagcuggccuuuga

SEQ ID NO: 198525 - RNA, 19 nt, Homo sapiens
gagggcagcuguggcuucu

SEQ ID NO: 198526 - RNA, 19 nt, Homo sapiens
gaacuacgggcugcucuac

SEQ ID NO: 198527 - RNA, 19 nt, Homo sapiens
gcagugccuucccaaccau

SEQ ID NO: 198528 - RNA, 19 nt, Homo sapiens
gaguuuaggcuggaagaug

SEQ ID NO: 198529 - RNA, 19 nt, Homo sapiens
ugacaccuaccaggaguuu

SEQ ID NO: 198530 - RNA, 19 nt, Homo sapiens
ucaggaaggacauggacaa

SEQ ID NO: 198531 - RNA, 19 nt, Homo sapiens
ccagccuuguccuaauaaa

SEQ ID NO: 198532 - RNA, 19 nt, Homo sapiens
cgucccugcuccuggcuuu

SEQ ID NO: 198533 - RNA, 19 nt, Homo sapiens
acuacgggcugcucuacug

SEQ ID NO: 198534 - RNA, 19 nt, Homo sapiens
acaccuaccaggaguuuag

SEQ ID NO: 198535 - RNA, 19 nt, Homo sapiens
ucccaaccauucccuuauc

SEQ ID NO: 198536 - RNA, 19 nt, Homo sapiens
ggaaggacauggacaaggu

SEQ ID NO: 198537 - RNA, 19 nt, Homo sapiens
caccagccuuguccuaaua

SEQ ID NO: 198538 - RNA, 19 nt, Homo sapiens
ggacugggcagaucuucaa

SEQ ID NO: 198539 - RNA, 19 nt, Homo sapiens
gggcagcuguggcuucuag

SEQ ID NO: 198540 - RNA, 19 nt, Homo sapiens
uggacaaggucgagacauu

SEQ ID NO: 198541 - RNA, 19 nt, Homo sapiens
ccaccagccuuguccuaau

SEQ ID NO: 198542 - RNA, 19 nt, Homo sapiens
ggacaaggucgagacauuc

SEQ ID NO: 198543 - RNA, 19 nt, Homo sapiens
aagcagaccuacagcaagu

SEQ ID NO: 198544 - RNA, 19 nt, Homo sapiens
gggcugcucuacugcuuca

SEQ ID NO: 198545 - RNA, 19 nt, Homo sapiens
cuacagaggcuggaagaug

SEQ ID NO: 198546 - RNA, 19 nt, Homo sapiens
ucaagcagaccuacagcaa

SEQ ID NO: 198547 - RNA, 19 nt, Homo sapiens
gagggcagcuguggcuucu

SEQ ID NO: 198548 - RNA, 19 nt, Homo sapiens
gaacuacgggcugcucuac

SEQ ID NO: 198549 - RNA, 19 nt, Homo sapiens
ucaggaaggacauggacaa

SEQ ID NO: 198550 - RNA, 19 nt, Homo sapiens
ccagccuuguccuaauaaa

SEQ ID NO: 198551 - RNA, 19 nt, Homo sapiens
acuacgggcugcucuacug

SEQ ID NO: 198552 - RNA, 19 nt, Homo sapiens
gggcagaucuucaaucagu

SEQ ID NO: 198553 - RNA, 19 nt, Homo sapiens
ggaaggacauggacaaggu

SEQ ID NO: 198554 - RNA, 19 nt, Homo sapiens
aaacgcagcagaaaucuaa

SEQ ID NO: 198555 - RNA, 19 nt, Homo sapiens
ugaaggagcagaaguauuc

SEQ ID NO: 198556 - RNA, 19 nt, Homo sapiens
caccagccuuguccuaaua

SEQ ID NO: 198557 - RNA, 19 nt, Homo sapiens
uguaccagcuggcauauga

SEQ ID NO: 198558 - RNA, 19 nt, Homo sapiens
ggacugggcagaucuucaa

SEQ ID NO: 198559 - RNA, 19 nt, Homo sapiens
gggcagcuguggcuucuag

SEQ ID NO: 198560 - RNA, 19 nt, Homo sapiens
ugacaccuaucaggaguuu

SEQ ID NO: 198561 - RNA, 19 nt, Homo sapiens
ccaacagccugguguaugg

SEQ ID NO: 198562 - RNA, 19 nt, Homo sapiens
uggacaaggucgagacauu

SEQ ID NO: 198563 - RNA, 19 nt, Homo sapiens
gagcagaaguauucauucc

SEQ ID NO: 198564 - RNA, 19 nt, Homo sapiens
ccaccagccuuguccuaau

SEQ ID NO: 198565 - RNA, 19 nt, Homo sapiens
ggacaaggucgagacauuc

SEQ ID NO: 198566 - RNA, 19 nt, Homo sapiens
gcuggcauaugacaccuau

SEQ ID NO: 198567 - RNA, 19 nt, Homo sapiens
gggcugcucuacugcuuca

SEQ ID NO: 198568 - RNA, 19 nt, Homo sapiens
acaccuaucaggaguuuga

SEQ ID NO: 198569 - RNA, 19 nt, Homo sapiens
cugggcagaucuucaauca

SEQ ID NO: 198570 - RNA, 19 nt, Homo sapiens
gcagcagaaaucuaaccua

SEQ ID NO: 198571 - RNA, 19 nt, Homo sapiens
ggaguuugaagaagccuau

SEQ ID NO: 198572 - RNA, 19 nt, Homo sapiens
gagggcagcuguggcuucu

SEQ ID NO: 198573 - RNA, 19 nt, Homo sapiens
gcagugccuucccaaccau

SEQ ID NO: 198574 - RNA, 19 nt, Homo sapiens
gaacuacgggcugcucuac

SEQ ID NO: 198575 - RNA, 19 nt, Homo sapiens
ggagcagaaguauucauuc

SEQ ID NO: 198576 - RNA, 19 nt, Homo sapiens
uaucaggaguuugaagaag

SEQ ID NO: 198577 - RNA, 19 nt, Homo sapiens
uggcauaugacaccuauca

SEQ ID NO: 198578 - RNA, 19 nt, Homo sapiens
ucaaucaguccuacagcaa

SEQ ID NO: 198579 - RNA, 19 nt, Homo sapiens
ucaggaaggacauggacaa

SEQ ID NO: 198580 - RNA, 19 nt, Homo sapiens
ccugaaggaccuagaggaa

SEQ ID NO: 198581 - RNA, 19 nt, Homo sapiens
ccagccuuguccuaauaaa

SEQ ID NO: 198582 - RNA, 19 nt, Homo sapiens
gccaacagccugguguaug

SEQ ID NO: 198583 - RNA, 19 nt, Homo sapiens
cgucccugcuccuggcuuu

SEQ ID NO: 198584 - RNA, 19 nt, Homo sapiens
gcaucucccugcugcucau

SEQ ID NO: 198585 - RNA, 19 nt, Homo sapiens
gccuguaccagcuggcaua

SEQ ID NO: 198586 - RNA, 19 nt, Homo sapiens
aaucaguccuacagcaagu

SEQ ID NO: 198587 - RNA, 19 nt, Homo sapiens
aguauucauuccugcagaa

SEQ ID NO: 198588 - RNA, 19 nt, Homo sapiens
ccuaucaggaguuugaaga

SEQ ID NO: 198589 - RNA, 19 nt, Homo sapiens
acuacgggcugcucuacug

SEQ ID NO: 198590 - RNA, 19 nt, Homo sapiens
ugaaaacgcagcagaaauc

SEQ ID NO: 198591 - RNA, 19 nt, Homo sapiens
ucccaaccauucccuuauc

SEQ ID NO: 198592 - RNA, 19 nt, Homo sapiens
gaaggagcagaaguauuca

SEQ ID NO: 198593 - RNA, 19 nt, Homo sapiens
gggcagaucuucaaucagu

SEQ ID NO: 198594 - RNA, 19 nt, Homo sapiens
ggaaggacauggacaaggu

SEQ ID NO: 198595 - RNA, 19 nt, Homo sapiens
aaacgcagcagaaaucuaa

SEQ ID NO: 198596 - RNA, 19 nt, Homo sapiens
caccagccuuguccuaaua

SEQ ID NO: 198597 - RNA, 19 nt, Homo sapiens
uguaccagcuggcauauga

SEQ ID NO: 198598 - RNA, 19 nt, Homo sapiens
ggacugggcagaucuucaa

SEQ ID NO: 198599 - RNA, 19 nt, Homo sapiens
gggcagcuguggcuucuag

SEQ ID NO: 198600 - RNA, 19 nt, Homo sapiens
ugacaccuaucaggaguuu

SEQ ID NO: 198601 - RNA, 19 nt, Homo sapiens
ccaacagccugguguaugg

SEQ ID NO: 198602 - RNA, 19 nt, Homo sapiens
uggacaaggucgagacauu

SEQ ID NO: 198603 - RNA, 19 nt, Homo sapiens
acaccuaucaggaguuuaa

SEQ ID NO: 198604 - RNA, 19 nt, Homo sapiens
ccaccagccuuguccuaau

SEQ ID NO: 198605 - RNA, 19 nt, Homo sapiens
ggacaaggucgagacauuc

SEQ ID NO: 198606 - RNA, 19 nt, Homo sapiens
gcuggcauaugacaccuau

SEQ ID NO: 198607 - RNA, 19 nt, Homo sapiens
gggcugcucuacugcuuca

SEQ ID NO: 198608 - RNA, 19 nt, Homo sapiens
cugggcagaucuucaauca

SEQ ID NO: 198609 - RNA, 19 nt, Homo sapiens
gcagcagaaaucuaaccua

SEQ ID NO: 198610 - RNA, 19 nt, Homo sapiens
gagggcagcuguggcuucu

SEQ ID NO: 198611 - RNA, 19 nt, Homo sapiens
gaacuacgggcugcucuac

SEQ ID NO: 198612 - RNA, 19 nt, Homo sapiens
gcagugccuucccaaccau

SEQ ID NO: 198613 - RNA, 19 nt, Homo sapiens
uggcauaugacaccuauca

SEQ ID NO: 198614 - RNA, 19 nt, Homo sapiens
ucaaucaguccuacagcaa

SEQ ID NO: 198615 - RNA, 19 nt, Homo sapiens
ucaggaaggacauggacaa

SEQ ID NO: 198616 - RNA, 19 nt, Homo sapiens
ccugaaggaccuagaggaa

SEQ ID NO: 198617 - RNA, 19 nt, Homo sapiens
ccagccuuguccuaauaaa

SEQ ID NO: 198618 - RNA, 19 nt, Homo sapiens
gccaacagccugguguaug

SEQ ID NO: 198619 - RNA, 19 nt, Homo sapiens
cgucccugcuccuggcuuu

SEQ ID NO: 198620 - RNA, 19 nt, Homo sapiens
gcaucucccugcugcucau

SEQ ID NO: 198621 - RNA, 19 nt, Homo sapiens
aaucaguccuacagcaagu

SEQ ID NO: 198622 - RNA, 19 nt, Homo sapiens
gccuguaccagcuggcaua

SEQ ID NO: 198623 - RNA, 19 nt, Homo sapiens
acuacgggcugcucuacug

SEQ ID NO: 198624 - RNA, 19 nt, Homo sapiens
ucccaaccauucccuuauc

SEQ ID NO: 198625 - RNA, 19 nt, Homo sapiens
ugaaaacgcagcagaaauc

SEQ ID NO: 198626 - RNA, 19 nt, Homo sapiens
caagagaacucaccguauu

SEQ ID NO: 198627 - RNA, 19 nt, Homo sapiens
gggcagaucuucaaucagu

SEQ ID NO: 198628 - RNA, 19 nt, Homo sapiens
aaacacugcugcccucuuu

SEQ ID NO: 198629 - RNA, 19 nt, Homo sapiens
ggaaggacauggacaaggu

SEQ ID NO: 198630 - RNA, 19 nt, Homo sapiens
aaacgcagcagaaaucuaa

SEQ ID NO: 198631 - RNA, 19 nt, Homo sapiens
ugaaggagcagaaguauuc

SEQ ID NO: 198632 - RNA, 19 nt, Homo sapiens
caccagccuuguccuaaua

SEQ ID NO: 198633 - RNA, 19 nt, Homo sapiens
gaacucaccguauucuuca

SEQ ID NO: 198634 - RNA, 19 nt, Homo sapiens
uguaccagcuggcauauga

SEQ ID NO: 198635 - RNA, 19 nt, Homo sapiens
ggacugggcagaucuucaa

SEQ ID NO: 198636 - RNA, 19 nt, Homo sapiens
gggcagcuguggcuucuag

SEQ ID NO: 198637 - RNA, 19 nt, Homo sapiens
ugacaccuaucaggaguuu

SEQ ID NO: 198638 - RNA, 19 nt, Homo sapiens
ccaacagccugguguaugg

SEQ ID NO: 198639 - RNA, 19 nt, Homo sapiens
uggacaaggucgagacauu

SEQ ID NO: 198640 - RNA, 19 nt, Homo sapiens
ggaggaaaauggaugaaug

SEQ ID NO: 198641 - RNA, 19 nt, Homo sapiens
gagcagaaguauucauucc

SEQ ID NO: 198642 - RNA, 19 nt, Homo sapiens
ccaccagccuuguccuaau

SEQ ID NO: 198643 - RNA, 19 nt, Homo sapiens
ggacaaggucgagacauuc

SEQ ID NO: 198644 - RNA, 19 nt, Homo sapiens
gcuggcauaugacaccuau

SEQ ID NO: 198645 - RNA, 19 nt, Homo sapiens
gggcugcucuacugcuuca

SEQ ID NO: 198646 - RNA, 19 nt, Homo sapiens
acaccuaucaggaguuuga

SEQ ID NO: 198647 - RNA, 19 nt, Homo sapiens
ccaagagaacucaccguau

SEQ ID NO: 198648 - RNA, 19 nt, Homo sapiens
cugggcagaucuucaauca

SEQ ID NO: 198649 - RNA, 19 nt, Homo sapiens
gaaacacugcugcccucuu

SEQ ID NO: 198650 - RNA, 19 nt, Homo sapiens
gcagcagaaaucuaaccua

SEQ ID NO: 198651 - RNA, 19 nt, Homo sapiens
ggaguuugaagaagccuau

SEQ ID NO: 198652 - RNA, 19 nt, Homo sapiens
gcagugccuucccaaccau

SEQ ID NO: 198653 - RNA, 19 nt, Homo sapiens
gagggcagcuguggcuucu

SEQ ID NO: 198654 - RNA, 19 nt, Homo sapiens
gaacuacgggcugcucuac

SEQ ID NO: 198655 - RNA, 19 nt, Homo sapiens
ggagcagaaguauucauuc

SEQ ID NO: 198656 - RNA, 19 nt, Homo sapiens
uaucaggaguuugaagaag

SEQ ID NO: 198657 - RNA, 19 nt, Homo sapiens
uggcauaugacaccuauca

SEQ ID NO: 198658 - RNA, 19 nt, Homo sapiens
ucaaucaguccuacagcaa

SEQ ID NO: 198659 - RNA, 19 nt, Homo sapiens
ucaggaaggacauggacaa

SEQ ID NO: 198660 - RNA, 19 nt, Homo sapiens
gcgcuuggccucuccuucu

SEQ ID NO: 198661 - RNA, 19 nt, Homo sapiens
ccugaaggaccuagaggaa

SEQ ID NO: 198662 - RNA, 19 nt, Homo sapiens
ccagccuuguccuaauaaa

SEQ ID NO: 198663 - RNA, 19 nt, Homo sapiens
ggaaaauggaugaaugaga

SEQ ID NO: 198664 - RNA, 19 nt, Homo sapiens
gaggaaaauggaugaauga

SEQ ID NO: 198665 - RNA, 19 nt, Homo sapiens
gccaacagccugguguaug

SEQ ID NO: 198666 - RNA, 19 nt, Homo sapiens
cgucccugcuccuggcuuu

SEQ ID NO: 198667 - RNA, 19 nt, Homo sapiens
gcaucucccugcugcucau

SEQ ID NO: 198668 - RNA, 19 nt, Homo sapiens
aaucaguccuacagcaagu

SEQ ID NO: 198669 - RNA, 19 nt, Homo sapiens
ccuaucaggaguuugaaga

SEQ ID NO: 198670 - RNA, 19 nt, Homo sapiens
ucaccguauucuucauuuc

SEQ ID NO: 198671 - RNA, 19 nt, Homo sapiens
gccuguaccagcuggcaua

SEQ ID NO: 198672 - RNA, 19 nt, Homo sapiens
aguauucauuccugcagaa

SEQ ID NO: 198673 - RNA, 19 nt, Homo sapiens
acuacgggcugcucuacug

SEQ ID NO: 198674 - RNA, 19 nt, Homo sapiens
ucccaaccauucccuuauc

SEQ ID NO: 198675 - RNA, 19 nt, Homo sapiens
ugaaaacgcagcagaaauc

SEQ ID NO: 198676 - RNA, 19 nt, Homo sapiens
gaaggagcagaaguauuca

SEQ ID NO: 198677 - RNA, 19 nt, Homo sapiens
gggcagaucuucaaucagu

SEQ ID NO: 198678 - RNA, 19 nt, Homo sapiens
ggaaggacauggacaaggu

SEQ ID NO: 198679 - RNA, 19 nt, Homo sapiens
aaacgcagcagaaaucuaa

SEQ ID NO: 198680 - RNA, 19 nt, Homo sapiens
ugaaggagcagaaguauuc

SEQ ID NO: 198681 - RNA, 19 nt, Homo sapiens
caccagccuuguccuaaua

SEQ ID NO: 198682 - RNA, 19 nt, Homo sapiens
uguaccagcuggcauauga

SEQ ID NO: 198683 - RNA, 19 nt, Homo sapiens
ggacugggcagaucuucaa

SEQ ID NO: 198684 - RNA, 19 nt, Homo sapiens
gggcagcuguggcuucuag

SEQ ID NO: 198685 - RNA, 19 nt, Homo sapiens
ugacaccuaucaggaguuu

SEQ ID NO: 198686 - RNA, 19 nt, Homo sapiens
ccaacagccugguguaugg

SEQ ID NO: 198687 - RNA, 19 nt, Homo sapiens
uggacaaggucgagacauu

SEQ ID NO: 198688 - RNA, 19 nt, Homo sapiens
gagcagaaguauucauucc

SEQ ID NO: 198689 - RNA, 19 nt, Homo sapiens
ccaccagccuuguccuaau

SEQ ID NO: 198690 - RNA, 19 nt, Homo sapiens
ggacaaggucgagacauuc

SEQ ID NO: 198691 - RNA, 19 nt, Homo sapiens
gcuggcauaugacaccuau

SEQ ID NO: 198692 - RNA, 19 nt, Homo sapiens
gggcugcucuacugcuuca

SEQ ID NO: 198693 - RNA, 19 nt, Homo sapiens
gcugauaggcuggaagaug

SEQ ID NO: 198694 - RNA, 19 nt, Homo sapiens
acaccuaucaggaguuuga

SEQ ID NO: 198695 - RNA, 19 nt, Homo sapiens
cugggcagaucuucaauca

SEQ ID NO: 198696 - RNA, 19 nt, Homo sapiens
gcagcagaaaucuaaccua

SEQ ID NO: 198697 - RNA, 19 nt, Homo sapiens
ggaguuugaagaagccuau

SEQ ID NO: 198698 - RNA, 19 nt, Homo sapiens
gagggcagcuguggcuucu

SEQ ID NO: 198699 - RNA, 19 nt, Homo sapiens
gcagugccuucccaaccau

SEQ ID NO: 198700 - RNA, 19 nt, Homo sapiens
gaacuacgggcugcucuac

SEQ ID NO: 198701 - RNA, 19 nt, Homo sapiens
ggagcagaaguauucauuc

SEQ ID NO: 198702 - RNA, 19 nt, Homo sapiens
uaucaggaguuugaagaag

SEQ ID NO: 198703 - RNA, 19 nt, Homo sapiens
uggcauaugacaccuauca

SEQ ID NO: 198704 - RNA, 19 nt, Homo sapiens
ucaaucaguccuacagcaa

SEQ ID NO: 198705 - RNA, 19 nt, Homo sapiens
ucaggaaggacauggacaa

SEQ ID NO: 198706 - RNA, 19 nt, Homo sapiens
ccugaaggaccuagaggaa

SEQ ID NO: 198707 - RNA, 19 nt, Homo sapiens
ccagccuuguccuaauaaa

SEQ ID NO: 198708 - RNA, 19 nt, Homo sapiens
gccaacagccugguguaug

SEQ ID NO: 198709 - RNA, 19 nt, Homo sapiens
cgucccugcuccuggcuuu

SEQ ID NO: 198710 - RNA, 19 nt, Homo sapiens
gcaucucccugcugcucau

SEQ ID NO: 198711 - RNA, 19 nt, Homo sapiens
gccuguaccagcuggcaua

SEQ ID NO: 198712 - RNA, 19 nt, Homo sapiens
aaucaguccuacagcaagu

SEQ ID NO: 198713 - RNA, 19 nt, Homo sapiens
aguauucauuccugcagaa

SEQ ID NO: 198714 - RNA, 19 nt, Homo sapiens
ccuaucaggaguuugaaga

SEQ ID NO: 198715 - RNA, 19 nt, Homo sapiens
acuacgggcugcucuacug

SEQ ID NO: 198716 - RNA, 19 nt, Homo sapiens
ucccaaccauucccuuauc

SEQ ID NO: 198717 - RNA, 19 nt, Homo sapiens
ugaaaacgcagcagaaauc

SEQ ID NO: 198718 - RNA, 19 nt, Homo sapiens
gaaggagcagaaguauuca

SEQ ID NO: 198719 - RNA, 19 nt, Homo sapiens
gaagcaaccucaguaauuu

SEQ ID NO: 198720 - RNA, 19 nt, Homo sapiens
caacgaaacucuggaaauu

SEQ ID NO: 198721 - RNA, 19 nt, Homo sapiens
gaagaaugcuuaaucagau

SEQ ID NO: 198722 - RNA, 19 nt, Homo sapiens
gacuauaccuccauucaua

SEQ ID NO: 198723 - RNA, 19 nt, Homo sapiens
gaaaucacauaguaaccua

SEQ ID NO: 198724 - RNA, 19 nt, Homo sapiens
caugagaaaucacauagua

SEQ ID NO: 198725 - RNA, 19 nt, Homo sapiens
gaaaguggauaaggaauau

SEQ ID NO: 198726 - RNA, 19 nt, Homo sapiens
ggaaagaaugcccugauua

SEQ ID NO: 198727 - RNA, 19 nt, Homo sapiens
caacaucaguuccagugua

SEQ ID NO: 198728 - RNA, 19 nt, Homo sapiens
gaaagaaugcccugauuau

SEQ ID NO: 198729 - RNA, 19 nt, Homo sapiens
uccaagagcuacauaauuu

SEQ ID NO: 198730 - RNA, 19 nt, Homo sapiens
guacuuugguggccacaua

SEQ ID NO: 198731 - RNA, 19 nt, Homo sapiens
ucaccaagcugcccauauu

SEQ ID NO: 198732 - RNA, 19 nt, Homo sapiens
gaacagaacauagacagaa

SEQ ID NO: 198733 - RNA, 19 nt, Homo sapiens
caacauuucuauagccaaa

SEQ ID NO: 198734 - RNA, 19 nt, Homo sapiens
ggaagcagaucucuuaugc

SEQ ID NO: 198735 - RNA, 19 nt, Homo sapiens
cccaagagcuacguauuua

SEQ ID NO: 198736 - RNA, 19 nt, Homo sapiens
gaaacaaagaguucaagaa

SEQ ID NO: 198737 - RNA, 19 nt, Homo sapiens
uaacagugaugcuauuugu

SEQ ID NO: 198738 - RNA, 19 nt, Homo sapiens
gcaaccagauccacccauu

SEQ ID NO: 198739 - RNA, 19 nt, Homo sapiens
gaacauagacagaagaaac

SEQ ID NO: 198740 - RNA, 19 nt, Homo sapiens
uaacucaccuuaucaugau

SEQ ID NO: 198741 - RNA, 19 nt, Homo sapiens
ggaugguucuggaguauga

SEQ ID NO: 198742 - RNA, 19 nt, Homo sapiens
gaucuugacucacugcaau

SEQ ID NO: 198743 - RNA, 19 nt, Homo sapiens
ugaagcaaaucgaaugaaa

SEQ ID NO: 198744 - RNA, 19 nt, Homo sapiens
ggacaaugccuacuucugu

SEQ ID NO: 198745 - RNA, 19 nt, Homo sapiens
gaacacaaucuuagccauu

SEQ ID NO: 198746 - RNA, 19 nt, Homo sapiens
gaaggaacacucaagaaug

SEQ ID NO: 198747 - RNA, 19 nt, Homo sapiens
ccauacagcuguucuauac

SEQ ID NO: 198748 - RNA, 19 nt, Homo sapiens
caauaacguuuaagccaaa

SEQ ID NO: 198749 - RNA, 19 nt, Homo sapiens
ucagugaggugcucuaugu

SEQ ID NO: 198750 - RNA, 19 nt, Homo sapiens
gcacagaccaacugaacaa

SEQ ID NO: 198751 - RNA, 19 nt, Homo sapiens
caaguucacugucaaacau

SEQ ID NO: 198752 - RNA, 19 nt, Homo sapiens
ggaggugaacacaaucuua

SEQ ID NO: 198753 - RNA, 19 nt, Homo sapiens
caaugcagauauucagaaa

SEQ ID NO: 198754 - RNA, 19 nt, Homo sapiens
caacuggacuuuacugaac

SEQ ID NO: 198755 - RNA, 19 nt, Homo sapiens
agaagaaucucaucucagu

SEQ ID NO: 198756 - RNA, 19 nt, Homo sapiens
caaccucaguaauuuagaa

SEQ ID NO: 198757 - RNA, 19 nt, Homo sapiens
gaagauuucuacuuuccau

SEQ ID NO: 198758 - RNA, 19 nt, Homo sapiens
aaagaagaaucucaucuca

SEQ ID NO: 198759 - RNA, 19 nt, Homo sapiens
agaaugcccugauuauguu

SEQ ID NO: 198760 - RNA, 19 nt, Homo sapiens
caacuuaccaggcaccaaa

SEQ ID NO: 198761 - RNA, 19 nt, Homo sapiens
ccacagggccucauacuca

SEQ ID NO: 198762 - RNA, 19 nt, Homo sapiens
caagaaaacuuccuuaugg

SEQ ID NO: 198763 - RNA, 19 nt, Homo sapiens
auacuuaagugcugcaauu

SEQ ID NO: 198764 - RNA, 19 nt, Homo sapiens
gcuaagagaaguagaaauc

SEQ ID NO: 198765 - RNA, 19 nt, Homo sapiens
uagaggaggugaacacaau

SEQ ID NO: 198766 - RNA, 19 nt, Homo sapiens
uaaaguaucaucaguguag

SEQ ID NO: 198767 - RNA, 19 nt, Homo sapiens
cuacuuugcugcuaugguu

SEQ ID NO: 198768 - RNA, 19 nt, Homo sapiens
acacugaccaagauacuua

SEQ ID NO: 198769 - RNA, 19 nt, Homo sapiens
gcuaagcaauccaaguuca

SEQ ID NO: 198770 - RNA, 19 nt, Homo sapiens
aagcuagaauugaguguuu

SEQ ID NO: 198771 - RNA, 19 nt, Homo sapiens
gcagugauugucuuaauau

SEQ ID NO: 198772 - RNA, 19 nt, Homo sapiens
acacauacagccaagcuua

SEQ ID NO: 198773 - RNA, 19 nt, Homo sapiens
gcagugaccaugagaaauc

SEQ ID NO: 198774 - RNA, 19 nt, Homo sapiens
acgaaacucuggaaauuau

SEQ ID NO: 198775 - RNA, 19 nt, Homo sapiens
caagcuuaauggcugauaa

SEQ ID NO: 198776 - RNA, 19 nt, Homo sapiens
aagcaagcauucagaagaa

SEQ ID NO: 198777 - RNA, 19 nt, Homo sapiens
cuacauaauuauccaggaa

SEQ ID NO: 198778 - RNA, 19 nt, Homo sapiens
ugaccaagauacuuaagug

SEQ ID NO: 198779 - RNA, 19 nt, Homo sapiens
ccagacuccuucaacaauu

SEQ ID NO: 198780 - RNA, 19 nt, Homo sapiens
gagccuaaauucaccaagu

SEQ ID NO: 198781 - RNA, 19 nt, Homo sapiens
agaauggacucaagaaugg

SEQ ID NO: 198782 - RNA, 19 nt, Homo sapiens
acaacagccugacaacauu

SEQ ID NO: 198783 - RNA, 19 nt, Homo sapiens
agaagcaaccucaguaauu

SEQ ID NO: 198784 - RNA, 19 nt, Homo sapiens
uaagguacaagaagcauuu

SEQ ID NO: 198785 - RNA, 19 nt, Homo sapiens
cacaaccacuuccuacuga

SEQ ID NO: 198786 - RNA, 19 nt, Homo sapiens
uuucuuggauuccugauaa

SEQ ID NO: 198787 - RNA, 19 nt, Homo sapiens
gcaaucccuuaauauccua

SEQ ID NO: 198788 - RNA, 19 nt, Homo sapiens
caagaggacauuuacauca

SEQ ID NO: 198789 - RNA, 19 nt, Homo sapiens
ggaaucagacacagacaga

SEQ ID NO: 198790 - RNA, 19 nt, Homo sapiens
ugaaaguggauaaggaaua

SEQ ID NO: 198791 - RNA, 19 nt, Homo sapiens
ccaagagcuacauaauuua

SEQ ID NO: 198792 - RNA, 19 nt, Homo sapiens
gaaggacuaugaaaagcua

SEQ ID NO: 198793 - RNA, 19 nt, Homo sapiens
ugucaaacaucgacuuuua

SEQ ID NO: 198794 - RNA, 19 nt, Homo sapiens
aaacaaaccacaaccacuu

SEQ ID NO: 198795 - RNA, 19 nt, Homo sapiens
ggacguaccagcuguugug

SEQ ID NO: 198796 - RNA, 19 nt, Homo sapiens
guaaugaaacaaagaguuc

SEQ ID NO: 198797 - RNA, 19 nt, Homo sapiens
ggaagggaauaagguacaa

SEQ ID NO: 198798 - RNA, 19 nt, Homo sapiens
gugcagauggugagagaua

SEQ ID NO: 198799 - RNA, 19 nt, Homo sapiens
gaguuucucucaucaugug

SEQ ID NO: 198800 - RNA, 19 nt, Homo sapiens
gcuuaauggcugauaauuu

SEQ ID NO: 198801 - RNA, 19 nt, Homo sapiens
ccaaagugcugggauuaca

SEQ ID NO: 198802 - RNA, 19 nt, Homo sapiens
caagagcuacguauuuaau

SEQ ID NO: 198803 - RNA, 19 nt, Homo sapiens
uuccauggcucuuaauuau

SEQ ID NO: 198804 - RNA, 19 nt, Homo sapiens
gauggacccuauauugaca

SEQ ID NO: 198805 - RNA, 19 nt, Homo sapiens
gaagcaaaucgaaugaaau

SEQ ID NO: 198806 - RNA, 19 nt, Homo sapiens
uagcagugauugucuuaau

SEQ ID NO: 198807 - RNA, 19 nt, Homo sapiens
caagguugaaucacacaua

SEQ ID NO: 198808 - RNA, 19 nt, Homo sapiens
ggauaaggaauaugaagug

SEQ ID NO: 198809 - RNA, 19 nt, Homo sapiens
gcuguuacuuuaauucauc

SEQ ID NO: 198810 - RNA, 19 nt, Homo sapiens
uggaaagaaugcccugauu

SEQ ID NO: 198811 - RNA, 19 nt, Homo sapiens
cagcuaagcaauccaaguu

SEQ ID NO: 198812 - RNA, 19 nt, Homo sapiens
gucuggcaguuuauauuua

SEQ ID NO: 198813 - RNA, 19 nt, Homo sapiens
cuaaacaucauucuugaga

SEQ ID NO: 198814 - RNA, 19 nt, Homo sapiens
gcccuaaacaucauucuug

SEQ ID NO: 198815 - RNA, 19 nt, Homo sapiens
caccaugccaggcuaauuu

SEQ ID NO: 198816 - RNA, 19 nt, Homo sapiens
gauaaugaacagaacauag

SEQ ID NO: 198817 - RNA, 19 nt, Homo sapiens
aacuagaggugagaaauuu

SEQ ID NO: 198818 - RNA, 19 nt, Homo sapiens
ugaacaaaaucaugccuua

SEQ ID NO: 198819 - RNA, 19 nt, Homo sapiens
uuaauccucucauuucuga

SEQ ID NO: 198820 - RNA, 19 nt, Homo sapiens
ccauaccggugugcauuua

SEQ ID NO: 198821 - RNA, 19 nt, Homo sapiens
ccaguuaauccucucauuu

SEQ ID NO: 198822 - RNA, 19 nt, Homo sapiens
gcaagcugcuccaggacau

SEQ ID NO: 198823 - RNA, 19 nt, Homo sapiens
gaacaaaagcaaauggaau

SEQ ID NO: 198824 - RNA, 19 nt, Homo sapiens
caguuaauccucucauuuc

SEQ ID NO: 198825 - RNA, 19 nt, Homo sapiens
auaccggugugcauuuaaa

SEQ ID NO: 198826 - RNA, 19 nt, Homo sapiens
ucucauuucugacccacuu

SEQ ID NO: 198827 - RNA, 19 nt, Homo sapiens
uggguguucuucuuuguga

SEQ ID NO: 198828 - RNA, 19 nt, Homo sapiens
gcagggagagagcaaccaa

SEQ ID NO: 198829 - RNA, 19 nt, Homo sapiens
aaaagcaaauggaauugga

SEQ ID NO: 198830 - RNA, 19 nt, Homo sapiens
cagcaugugggcagaacaa

SEQ ID NO: 198831 - RNA, 19 nt, Homo sapiens
aaauggaauuggagagcau

SEQ ID NO: 198832 - RNA, 19 nt, Homo sapiens
uccaguuaauccucucauu

SEQ ID NO: 198833 - RNA, 19 nt, Homo sapiens
ccaauaaaccuguaaauga

SEQ ID NO: 198834 - RNA, 19 nt, Homo sapiens
gaaacgggauuguacuauc

SEQ ID NO: 198835 - RNA, 19 nt, Homo sapiens
ggaauucacuacaucaucu

SEQ ID NO: 198836 - RNA, 19 nt, Homo sapiens
gcaaaggugcugacaucua

SEQ ID NO: 198837 - RNA, 19 nt, Homo sapiens
gagagugccugucuacaag

SEQ ID NO: 198838 - RNA, 19 nt, Homo sapiens
ggaguccacacuugaauuu

SEQ ID NO: 198839 - RNA, 19 nt, Homo sapiens
gcucagggcagccuccaua

SEQ ID NO: 198840 - RNA, 19 nt, Homo sapiens
aaacgggauuguacuauca

SEQ ID NO: 198841 - RNA, 19 nt, Homo sapiens
cggcaaaggugcugacauc

SEQ ID NO: 198842 - RNA, 19 nt, Homo sapiens
gcacgugggugagcugcaa

SEQ ID NO: 198843 - RNA, 19 nt, Homo sapiens
ugaggucccuguaugucua

SEQ ID NO: 198844 - RNA, 19 nt, Homo sapiens
ggaugagagugccugucua

SEQ ID NO: 198845 - RNA, 19 nt, Homo sapiens
uggcugaggaggaaucuua

SEQ ID NO: 198846 - RNA, 19 nt, Homo sapiens
uuccagggcuucauuguug

SEQ ID NO: 198847 - RNA, 19 nt, Homo sapiens
cagaagccgucuaccugaa

SEQ ID NO: 198848 - RNA, 19 nt, Homo sapiens
gaggaggaaucuuacuucu

SEQ ID NO: 198849 - RNA, 19 nt, Homo sapiens
ugucugcucucauccauuc

SEQ ID NO: 198850 - RNA, 19 nt, Homo sapiens
gccaauaaaccuguaaaug

SEQ ID NO: 198851 - RNA, 19 nt, Homo sapiens
gcccggauuucuucucuca

SEQ ID NO: 198852 - RNA, 19 nt, Homo sapiens
gcacccagaaugugacuuc

SEQ ID NO: 198853 - RNA, 19 nt, Homo sapiens
ggaggacccgugcuaagug

SEQ ID NO: 198854 - RNA, 19 nt, Homo sapiens
ugagagugccugucuacaa

SEQ ID NO: 198855 - RNA, 19 nt, Homo sapiens
gcugcaaacuggccuucga

SEQ ID NO: 198856 - RNA, 19 nt, Homo sapiens
gugaaacgggauuguacua

SEQ ID NO: 198857 - RNA, 19 nt, Homo sapiens
cagaggagaugcccaacac

SEQ ID NO: 198858 - RNA, 19 nt, Homo sapiens
caagaggugaggacugaga

SEQ ID NO: 198859 - RNA, 19 nt, Homo sapiens
accaagaggugaggacuga

SEQ ID NO: 198860 - RNA, 19 nt, Homo sapiens
gcugcuggcugaggaggaa

SEQ ID NO: 198861 - RNA, 19 nt, Homo sapiens
ucaacuuccugccagacaa

SEQ ID NO: 198862 - RNA, 19 nt, Homo sapiens
gaucccacucuuuggaauu

SEQ ID NO: 198863 - RNA, 19 nt, Homo sapiens
gcugagagaggaugagagu

SEQ ID NO: 198864 - RNA, 19 nt, Homo sapiens
ucugagcccuuuccaccuu

SEQ ID NO: 198865 - RNA, 19 nt, Homo sapiens
cugcugggcucaccaugga

SEQ ID NO: 198866 - RNA, 19 nt, Homo sapiens
gcugugaaacgggauugua

SEQ ID NO: 198867 - RNA, 19 nt, Homo sapiens
cuacaucaucuucaacuuc

SEQ ID NO: 198868 - RNA, 19 nt, Homo sapiens
cccagaaugugacuucauc

SEQ ID NO: 198869 - RNA, 19 nt, Homo sapiens
cagcuucuccacuguucua

SEQ ID NO: 198870 - RNA, 19 nt, Homo sapiens
gaugagagugccugucuac

SEQ ID NO: 198871 - RNA, 19 nt, Homo sapiens
gaagccgucuaccugaacu

SEQ ID NO: 198872 - RNA, 19 nt, Homo sapiens
aaucuuacuucuccacagu

SEQ ID NO: 198873 - RNA, 19 nt, Homo sapiens
gauuucuucucucacuuca

SEQ ID NO: 198874 - RNA, 19 nt, Homo sapiens
gagccaauaaaccuguaaa

SEQ ID NO: 198875 - RNA, 19 nt, Homo sapiens
caucaaagggcccauuguc

SEQ ID NO: 198876 - RNA, 19 nt, Homo sapiens
ucuccacagugaagauuau

SEQ ID NO: 198877 - RNA, 19 nt, Homo sapiens
gcagaggagaugcccaaca

SEQ ID NO: 198878 - RNA, 19 nt, Homo sapiens
ucacuucagcucagaguca

SEQ ID NO: 198879 - RNA, 19 nt, Homo sapiens
ggauuucuucucucacuuc

SEQ ID NO: 198880 - RNA, 19 nt, Homo sapiens
gaucaucaaagggcccauu

SEQ ID NO: 198881 - RNA, 19 nt, Homo sapiens
ggggugaacuuugggcuuu

SEQ ID NO: 198882 - RNA, 19 nt, Homo sapiens
ucucauccauuccucuuac

SEQ ID NO: 198883 - RNA, 19 nt, Homo sapiens
gaauucacuacaucaucuu

SEQ ID NO: 198884 - RNA, 19 nt, Homo sapiens
ugaggaggaaucuuacuuc

SEQ ID NO: 198885 - RNA, 19 nt, Homo sapiens
caacuuccugccagacaau

SEQ ID NO: 198886 - RNA, 19 nt, Homo sapiens
ggagccaauaaaccuguaa

SEQ ID NO: 198887 - RNA, 19 nt, Homo sapiens
cugagcccuuuccaccuua

SEQ ID NO: 198888 - RNA, 19 nt, Homo sapiens
ugaaacgggauuguacuau

SEQ ID NO: 198889 - RNA, 19 nt, Homo sapiens
gagugccugucuacaagca

SEQ ID NO: 198890 - RNA, 19 nt, Homo sapiens
cagaggagccaauaaaccu

SEQ ID NO: 198891 - RNA, 19 nt, Homo sapiens
gcucucauccauuccucuu

SEQ ID NO: 198892 - RNA, 19 nt, Homo sapiens
ccacuguucuaugcaaggu

SEQ ID NO: 198893 - RNA, 19 nt, Homo sapiens
ucuuacuucuccacaguga

SEQ ID NO: 198894 - RNA, 19 nt, Homo sapiens
gucuaccucugacuucugu

SEQ ID NO: 198895 - RNA, 19 nt, Homo sapiens
gccaugacccugagcuucu

SEQ ID NO: 198896 - RNA, 19 nt, Homo sapiens
gaccagaaccacaagcaaa

SEQ ID NO: 198897 - RNA, 19 nt, Homo sapiens
gaccuggacugggaugcuu

SEQ ID NO: 198898 - RNA, 19 nt, Homo sapiens
ucuccgaucugcucaucuu

SEQ ID NO: 198899 - RNA, 19 nt, Homo sapiens
ccacaagcaaaccgugaaa

SEQ ID NO: 198900 - RNA, 19 nt, Homo sapiens
ggaccagaaccacaagcaa

SEQ ID NO: 198901 - RNA, 19 nt, Homo sapiens
ucacgguccucuacagucu

SEQ ID NO: 198902 - RNA, 19 nt, Homo sapiens
gcaccaccaccaaccucua

SEQ ID NO: 198903 - RNA, 19 nt, Homo sapiens
gcaaccugcucaccaugcu

SEQ ID NO: 198904 - RNA, 19 nt, Homo sapiens
cuuccugucuucugucuca

SEQ ID NO: 198905 - RNA, 19 nt, Homo sapiens
ccuucucccuucucucuga

SEQ ID NO: 198906 - RNA, 19 nt, Homo sapiens
gcauggccuucuccgaucu

SEQ ID NO: 198907 - RNA, 19 nt, Homo sapiens
ucagggaccagaaccacaa

SEQ ID NO: 198908 - RNA, 19 nt, Homo sapiens
cagcaucuucuucuuccuu

SEQ ID NO: 198909 - RNA, 19 nt, Homo sapiens
ucagugagagcugcaccua

SEQ ID NO: 198910 - RNA, 19 nt, Homo sapiens
gaaccacuauguagaauaa

SEQ ID NO: 198911 - RNA, 19 nt, Homo sapiens
gcaugaagaucaaagauaa

SEQ ID NO: 198912 - RNA, 19 nt, Homo sapiens
caacaacgaucuaaccauu

SEQ ID NO: 198913 - RNA, 19 nt, Homo sapiens
gaauggaacugcaagaaga

SEQ ID NO: 198914 - RNA, 19 nt, Homo sapiens
uaacaucacugucauauac

SEQ ID NO: 198915 - RNA, 19 nt, Homo sapiens
cccagaagcuccugacuua

SEQ ID NO: 198916 - RNA, 19 nt, Homo sapiens
gcaagaagacuacggauau

SEQ ID NO: 198917 - RNA, 19 nt, Homo sapiens
uaaaggauauuguggagaa

SEQ ID NO: 198918 - RNA, 19 nt, Homo sapiens
caagaucccuguagguuca

SEQ ID NO: 198919 - RNA, 19 nt, Homo sapiens
ggguucagcuucuaucaaa

SEQ ID NO: 198920 - RNA, 19 nt, Homo sapiens
ggagacaucuacaguacug

SEQ ID NO: 198921 - RNA, 19 nt, Homo sapiens
ucaaacaucuccaaaggau

SEQ ID NO: 198922 - RNA, 19 nt, Homo sapiens
gaagacuacggauaugaua

SEQ ID NO: 198923 - RNA, 19 nt, Homo sapiens
ggagaaccacuauguagaa

SEQ ID NO: 198924 - RNA, 19 nt, Homo sapiens
gcacaucacagccaauuuc

SEQ ID NO: 198925 - RNA, 19 nt, Homo sapiens
caacuccucucccuucaau

SEQ ID NO: 198926 - RNA, 19 nt, Homo sapiens
gcgaaugccugugaugcua

SEQ ID NO: 198927 - RNA, 19 nt, Homo sapiens
gaauacaaguacucaugga

SEQ ID NO: 198928 - RNA, 19 nt, Homo sapiens
caaaggaugggugaaauuu

SEQ ID NO: 198929 - RNA, 19 nt, Homo sapiens
aaaguucacuggagucuca

SEQ ID NO: 198930 - RNA, 19 nt, Homo sapiens
ggucagguacuaaaggaua

SEQ ID NO: 198931 - RNA, 19 nt, Homo sapiens
aaaccacaaugacaucuug

SEQ ID NO: 198932 - RNA, 19 nt, Homo sapiens
gaaaagugggucaguguua

SEQ ID NO: 198933 - RNA, 19 nt, Homo sapiens
uaucaaacaucuccaaagg

SEQ ID NO: 198934 - RNA, 19 nt, Homo sapiens
caagaagacuacggauaug

SEQ ID NO: 198935 - RNA, 19 nt, Homo sapiens
gggcagcucugaggaacaa

SEQ ID NO: 198936 - RNA, 19 nt, Homo sapiens
gccgauagccguccgcuuu

SEQ ID NO: 198937 - RNA, 19 nt, Homo sapiens
gaggcgaccuugccgauag

SEQ ID NO: 198938 - RNA, 19 nt, Homo sapiens
ggccggagccuacaacuug

SEQ ID NO: 198939 - RNA, 19 nt, Homo sapiens
cagccaauuucacacagua

SEQ ID NO: 198940 - RNA, 19 nt, Homo sapiens
ggcaagacauaccuagaug

SEQ ID NO: 198941 - RNA, 19 nt, Homo sapiens
agagugagauggccugguu

SEQ ID NO: 198942 - RNA, 19 nt, Homo sapiens
aaagacaaauggagaacug

SEQ ID NO: 198943 - RNA, 19 nt, Homo sapiens
gaaaggcaagacauaccua

SEQ ID NO: 198944 - RNA, 19 nt, Homo sapiens
caugcaggcucucucugua

SEQ ID NO: 198945 - RNA, 19 nt, Homo sapiens
gagaaccacuauguagaau

SEQ ID NO: 198946 - RNA, 19 nt, Homo sapiens
caucaauguuagugugaaa

SEQ ID NO: 198947 - RNA, 19 nt, Homo sapiens
caacgagaccaucaauguu

SEQ ID NO: 198948 - RNA, 19 nt, Homo sapiens
cuacggauaugauacucaa

SEQ ID NO: 198949 - RNA, 19 nt, Homo sapiens
aacgagaccaucaauguua

SEQ ID NO: 198950 - RNA, 19 nt, Homo sapiens
uguaacaccuuugaaugaa

SEQ ID NO: 198951 - RNA, 19 nt, Homo sapiens
ucaacgagaccaucaaugu

SEQ ID NO: 198952 - RNA, 19 nt, Homo sapiens
cggauaugauacucaauga

SEQ ID NO: 198953 - RNA, 19 nt, Homo sapiens
gagcacaucacagccaauu

SEQ ID NO: 198954 - RNA, 19 nt, Homo sapiens
uaacaccugagccaucuaa

SEQ ID NO: 198955 - RNA, 19 nt, Homo sapiens
ccaaaggaugggugaaauu

SEQ ID NO: 198956 - RNA, 19 nt, Homo sapiens
uacaaguacucauggagaa

SEQ ID NO: 198957 - RNA, 19 nt, Homo sapiens
ggucaauggaauacaagua

SEQ ID NO: 198958 - RNA, 19 nt, Homo sapiens
ucacuggagucucaacauc

SEQ ID NO: 198959 - RNA, 19 nt, Homo sapiens
gaagagguggguucagcuu

SEQ ID NO: 198960 - RNA, 19 nt, Homo sapiens
ggaauggaacugcaagaag

SEQ ID NO: 198961 - RNA, 19 nt, Homo sapiens
aauccucccuucccugaaa

SEQ ID NO: 198962 - RNA, 19 nt, Homo sapiens
aaacauggagaaccacuau

SEQ ID NO: 198963 - RNA, 19 nt, Homo sapiens
cagcuucuaucaaacaucu

SEQ ID NO: 198964 - RNA, 19 nt, Homo sapiens
caucacagccaauuucaca

SEQ ID NO: 198965 - RNA, 19 nt, Homo sapiens
gagguggguucagcuucua

SEQ ID NO: 198966 - RNA, 19 nt, Homo sapiens
gcaguuucuuaguggugua

SEQ ID NO: 198967 - RNA, 19 nt, Homo sapiens
gaaaccacaaugacaucuu

SEQ ID NO: 198968 - RNA, 19 nt, Homo sapiens
gaucaugagguacaaccaa

SEQ ID NO: 198969 - RNA, 19 nt, Homo sapiens
gagaaaaucagcaugaaga

SEQ ID NO: 198970 - RNA, 19 nt, Homo sapiens
caauuucacacaguacuaa

SEQ ID NO: 198971 - RNA, 19 nt, Homo sapiens
caucuaacaucacugucau

SEQ ID NO: 198972 - RNA, 19 nt, Homo sapiens
gcaucuaacaucacuguca

SEQ ID NO: 198973 - RNA, 19 nt, Homo sapiens
caggagcccuuggucaaug

SEQ ID NO: 198974 - RNA, 19 nt, Homo sapiens
guaacaccuuugaaugaag

SEQ ID NO: 198975 - RNA, 19 nt, Homo sapiens
ccauguccauugcucaaau

SEQ ID NO: 198976 - RNA, 19 nt, Homo sapiens
acaacgaucuaaccauugg

SEQ ID NO: 198977 - RNA, 19 nt, Homo sapiens
caggagcaauggcaaccuu

SEQ ID NO: 198978 - RNA, 19 nt, Homo sapiens
agaacucggugacuucauc

SEQ ID NO: 198979 - RNA, 19 nt, Homo sapiens
acuggagucucaacaucua

SEQ ID NO: 198980 - RNA, 19 nt, Homo sapiens
guacccagacccagaguuc

SEQ ID NO: 198981 - RNA, 19 nt, Homo sapiens
caacaagaucccuguaggu

SEQ ID NO: 198982 - RNA, 19 nt, Homo sapiens
gacauagacgagagaguga

SEQ ID NO: 198983 - RNA, 19 nt, Homo sapiens
acacaguacuaacgaagag

SEQ ID NO: 198984 - RNA, 19 nt, Homo sapiens
cauggagaaccacuaugua

SEQ ID NO: 198985 - RNA, 19 nt, Homo sapiens
ucaacaauaucgcggaaaa

SEQ ID NO: 198986 - RNA, 19 nt, Homo sapiens
caaauuugaaaccacaaug

SEQ ID NO: 198987 - RNA, 19 nt, Homo sapiens
ggucaguguuacuuguugu

SEQ ID NO: 198988 - RNA, 19 nt, Homo sapiens
gggucaguguuacuuguug

SEQ ID NO: 198989 - RNA, 19 nt, Homo sapiens
gaacucggugacuucauca

SEQ ID NO: 198990 - RNA, 19 nt, Homo sapiens
ccaauuucacacaguacua

SEQ ID NO: 198991 - RNA, 19 nt, Homo sapiens
gcccuuggucaauggaaua

SEQ ID NO: 198992 - RNA, 19 nt, Homo sapiens
ccuuggcucugaccuguau

SEQ ID NO: 198993 - RNA, 19 nt, Homo sapiens
gccggagccuacaacuuga

SEQ ID NO: 198994 - RNA, 19 nt, Homo sapiens
ggagucucaacaucuauga

SEQ ID NO: 198995 - RNA, 19 nt, Homo sapiens
acugucauauacaccauaa

SEQ ID NO: 198996 - RNA, 19 nt, Homo sapiens
gucagguacuaaaggauau

SEQ ID NO: 198997 - RNA, 19 nt, Homo sapiens
gcauccugauugccaugaa

SEQ ID NO: 198998 - RNA, 19 nt, Homo sapiens
ggagaacucggugacuuca

SEQ ID NO: 198999 - RNA, 19 nt, Homo sapiens
ccugugaugcuaccauauu

SEQ ID NO: 199000 - RNA, 19 nt, Homo sapiens
ugccugugaugcuaccaua

SEQ ID NO: 199001 - RNA, 19 nt, Homo sapiens
cggaaaauguuaaucacaa

SEQ ID NO: 199002 - RNA, 19 nt, Homo sapiens
cuaacaucacugucauaua

SEQ ID NO: 199003 - RNA, 19 nt, Homo sapiens
gcccagaagcuccugacuu

SEQ ID NO: 199004 - RNA, 19 nt, Homo sapiens
cacaggagcccuuggucaa

SEQ ID NO: 199005 - RNA, 19 nt, Homo sapiens
ugucgucucuucuaucaac

SEQ ID NO: 199006 - RNA, 19 nt, Homo sapiens
cuugucgucucuucuauca

SEQ ID NO: 199007 - RNA, 19 nt, Homo sapiens
aguguuacuuguuguccua

SEQ ID NO: 199008 - RNA, 19 nt, Homo sapiens
cuagcgaucuuggcacugu

SEQ ID NO: 199009 - RNA, 19 nt, Homo sapiens
ugacuuaccagcucauguc

SEQ ID NO: 199010 - RNA, 19 nt, Homo sapiens
gaaauaaccuuggaagaug

SEQ ID NO: 199011 - RNA, 19 nt, Homo sapiens
gaagaagaaugacuggaaa

SEQ ID NO: 199012 - RNA, 19 nt, Homo sapiens
gaagucugcucaggaaaua

SEQ ID NO: 199013 - RNA, 19 nt, Homo sapiens
ggacaagauucaccaacaa

SEQ ID NO: 199014 - RNA, 19 nt, Homo sapiens
ggaagggacuuucaucagu

SEQ ID NO: 199015 - RNA, 19 nt, Homo sapiens
uggaagagcuggaaaggaa

SEQ ID NO: 199016 - RNA, 19 nt, Homo sapiens
ggaaauaaccuuggaagau

SEQ ID NO: 199017 - RNA, 19 nt, Homo sapiens
ggaagaagaaugacuggaa

SEQ ID NO: 199018 - RNA, 19 nt, Homo sapiens
ggaagaugguggccacgaa

SEQ ID NO: 199019 - RNA, 19 nt, Homo sapiens
caagagaacccaaaccaau

SEQ ID NO: 199020 - RNA, 19 nt, Homo sapiens
gaacccaaaccaauaaagu

SEQ ID NO: 199021 - RNA, 19 nt, Homo sapiens
ggacuuucaucagugacua

SEQ ID NO: 199022 - RNA, 19 nt, Homo sapiens
aagaaugacuggaaacaca

SEQ ID NO: 199023 - RNA, 19 nt, Homo sapiens
aagagaacccaaaccaaua

SEQ ID NO: 199024 - RNA, 19 nt, Homo sapiens
ggaagucugcucaggaaau

SEQ ID NO: 199025 - RNA, 19 nt, Homo sapiens
aaggaagucugcucaggaa

SEQ ID NO: 199026 - RNA, 19 nt, Homo sapiens
ccuguuggaucucaugcua

SEQ ID NO: 199027 - RNA, 19 nt, Homo sapiens
agagaacccaaaccaauaa

SEQ ID NO: 199028 - RNA, 19 nt, Homo sapiens
cgauucugcccuucacuua

SEQ ID NO: 199029 - RNA, 19 nt, Homo sapiens
guauugccauggacaagau

SEQ ID NO: 199030 - RNA, 19 nt, Homo sapiens
gcucagaagguccagaaau

SEQ ID NO: 199031 - RNA, 19 nt, Homo sapiens
caucagugacuacaguauu

SEQ ID NO: 199032 - RNA, 19 nt, Homo sapiens
cucagaagguccagaaauc

SEQ ID NO: 199033 - RNA, 19 nt, Homo sapiens
uggacaagauucaccaaca

SEQ ID NO: 199034 - RNA, 19 nt, Homo sapiens
gcagugggacuaggagaga

SEQ ID NO: 199035 - RNA, 19 nt, Homo sapiens
gagaacccaaaccaauaaa

SEQ ID NO: 199036 - RNA, 19 nt, Homo sapiens
ccagucaagcuaauaggaa

SEQ ID NO: 199037 - RNA, 19 nt, Homo sapiens
ggacuaggagagaagaaag

SEQ ID NO: 199038 - RNA, 19 nt, Homo sapiens
cugcgggacuugcugauuc

SEQ ID NO: 199039 - RNA, 19 nt, Homo sapiens
gaagagcuggaaaggaagu

SEQ ID NO: 199040 - RNA, 19 nt, Homo sapiens
ccaagagaacccaaaccaa

SEQ ID NO: 199041 - RNA, 19 nt, Homo sapiens
gcggaagggacuuucauca

SEQ ID NO: 199042 - RNA, 19 nt, Homo sapiens
uaagucgagcccauuguga

SEQ ID NO: 199043 - RNA, 19 nt, Homo sapiens
gaaggagaccccuaucugu

SEQ ID NO: 199044 - RNA, 19 nt, Homo sapiens
aagggacuuucaucaguga

SEQ ID NO: 199045 - RNA, 19 nt, Homo sapiens
gggacuaggagagaagaaa

SEQ ID NO: 199046 - RNA, 19 nt, Homo sapiens
ucagaagguccagaaauca

SEQ ID NO: 199047 - RNA, 19 nt, Homo sapiens
gccaagagaacccaaacca

SEQ ID NO: 199048 - RNA, 19 nt, Homo sapiens
gauucaccaacaagacuuu

SEQ ID NO: 199049 - RNA, 19 nt, Homo sapiens
gacaagauucaccaacaag

SEQ ID NO: 199050 - RNA, 19 nt, Homo sapiens
aucagugacuacaguauug

SEQ ID NO: 199051 - RNA, 19 nt, Homo sapiens
uuucaucagugacuacagu

SEQ ID NO: 199052 - RNA, 19 nt, Homo sapiens
gacuaggagagaagaaaga

SEQ ID NO: 199053 - RNA, 19 nt, Homo sapiens
gaagaaugacuggaaacac

SEQ ID NO: 199054 - RNA, 19 nt, Homo sapiens
aaaaggggaagaagaauga

SEQ ID NO: 199055 - RNA, 19 nt, Homo sapiens
gcuggccagucaagcuaau

SEQ ID NO: 199056 - RNA, 19 nt, Homo sapiens
acaagauucaccaacaaga

SEQ ID NO: 199057 - RNA, 19 nt, Homo sapiens
ggaaggagaccccuaucug

SEQ ID NO: 199058 - RNA, 19 nt, Homo sapiens
aacccaaaccaauaaaguu

SEQ ID NO: 199059 - RNA, 19 nt, Homo sapiens
aagauuugcugcgggacuu

SEQ ID NO: 199060 - RNA, 19 nt, Homo sapiens
uguuggaucucaugcuaag

SEQ ID NO: 199061 - RNA, 19 nt, Homo sapiens
ccaaggaggugacacuuaa

SEQ ID NO: 199062 - RNA, 19 nt, Homo sapiens
gaaacuauauccacaucaa

SEQ ID NO: 199063 - RNA, 19 nt, Homo sapiens
caaaugcgcugccgggauu

SEQ ID NO: 199064 - RNA, 19 nt, Homo sapiens
cgaaagaggugaaagagau

SEQ ID NO: 199065 - RNA, 19 nt, Homo sapiens
ggaguagaauuaagucaga

SEQ ID NO: 199066 - RNA, 19 nt, Homo sapiens
gccgggaguuggaaaguua

SEQ ID NO: 199067 - RNA, 19 nt, Homo sapiens
ggacuaugcugcacccaau

SEQ ID NO: 199068 - RNA, 19 nt, Homo sapiens
ggagagaccauacacaaug

SEQ ID NO: 199069 - RNA, 19 nt, Homo sapiens
gcuauggaaugguuaugaa

SEQ ID NO: 199070 - RNA, 19 nt, Homo sapiens
gagagaccauacacaaugu

SEQ ID NO: 199071 - RNA, 19 nt, Homo sapiens
uagcauggauuuauugagu

SEQ ID NO: 199072 - RNA, 19 nt, Homo sapiens
ucaugaccaucuugauuaa

SEQ ID NO: 199073 - RNA, 19 nt, Homo sapiens
aaacagaccgugaacacaa

SEQ ID NO: 199074 - RNA, 19 nt, Homo sapiens
uguaacggguccuucgaua

SEQ ID NO: 199075 - RNA, 19 nt, Homo sapiens
ggaccaaaggcucaucuug

SEQ ID NO: 199076 - RNA, 19 nt, Homo sapiens
uaacggguccuucgauaug

SEQ ID NO: 199077 - RNA, 19 nt, Homo sapiens
ccauguggcugcagguuuc

SEQ ID NO: 199078 - RNA, 19 nt, Homo sapiens
gaacacaaaacaucaaguu

SEQ ID NO: 199079 - RNA, 19 nt, Homo sapiens
caaguugggauuucauuuc

SEQ ID NO: 199080 - RNA, 19 nt, Homo sapiens
ccacacacgcuauggaaug

SEQ ID NO: 199081 - RNA, 19 nt, Homo sapiens
caguuagcauggauuuauu

SEQ ID NO: 199082 - RNA, 19 nt, Homo sapiens
gggaaauggugaaggaaac

SEQ ID NO: 199083 - RNA, 19 nt, Homo sapiens
gugagaacccagagaagaa

SEQ ID NO: 199084 - RNA, 19 nt, Homo sapiens
ucaguuagcauggauuuau

SEQ ID NO: 199085 - RNA, 19 nt, Homo sapiens
cucaugaccaucuugauua

SEQ ID NO: 199086 - RNA, 19 nt, Homo sapiens
gguguuugcucccgugaca

SEQ ID NO: 199087 - RNA, 19 nt, Homo sapiens
gccauuugguggauuauac

SEQ ID NO: 199088 - RNA, 19 nt, Homo sapiens
uagaaacuauauccacauc

SEQ ID NO: 199089 - RNA, 19 nt, Homo sapiens
agagaagaaugaggccuuu

SEQ ID NO: 199090 - RNA, 19 nt, Homo sapiens
gaaagaggugaaagagauc

SEQ ID NO: 199091 - RNA, 19 nt, Homo sapiens
acauugcacuagaaacuau

SEQ ID NO: 199092 - RNA, 19 nt, Homo sapiens
ccucaugaccaucuugauu

SEQ ID NO: 199093 - RNA, 19 nt, Homo sapiens
ggacuuuggagagaccaua

SEQ ID NO: 199094 - RNA, 19 nt, Homo sapiens
ggaggacgcuggggaaaug

SEQ ID NO: 199095 - RNA, 19 nt, Homo sapiens
cggcuacauugcacuagaa

SEQ ID NO: 199096 - RNA, 19 nt, Homo sapiens
gcggcuacauugcacuaga

SEQ ID NO: 199097 - RNA, 19 nt, Homo sapiens
guaacggguccuucgauau

SEQ ID NO: 199098 - RNA, 19 nt, Homo sapiens
gggcggagacaggcucuaa

SEQ ID NO: 199099 - RNA, 19 nt, Homo sapiens
aacagaccgugaacacaaa

SEQ ID NO: 199100 - RNA, 19 nt, Homo sapiens
aaggccauuugguggauua

SEQ ID NO: 199101 - RNA, 19 nt, Homo sapiens
ucaaccuguucacgucuuu

SEQ ID NO: 199102 - RNA, 19 nt, Homo sapiens
aaguugggauuucauuuca

SEQ ID NO: 199103 - RNA, 19 nt, Homo sapiens
caacgaagucaaggccauu

SEQ ID NO: 199104 - RNA, 19 nt, Homo sapiens
aaacaucaaguuccacaca

SEQ ID NO: 199105 - RNA, 19 nt, Homo sapiens
guucaguuagcauggauuu

SEQ ID NO: 199106 - RNA, 19 nt, Homo sapiens
ccccgugucuguucaguua

SEQ ID NO: 199107 - RNA, 19 nt, Homo sapiens
gcauuggagauucuuagga

SEQ ID NO: 199108 - RNA, 19 nt, Homo sapiens
ggaaauggugaaggaaaca

SEQ ID NO: 199109 - RNA, 19 nt, Homo sapiens
gcugggagcgcaacgaagu

SEQ ID NO: 199110 - RNA, 19 nt, Homo sapiens
gcgucuaccugcacagucu

SEQ ID NO: 199111 - RNA, 19 nt, Homo sapiens
ucaggugcauuggagauuc

SEQ ID NO: 199112 - RNA, 19 nt, Homo sapiens
ggggagagcuggagaacag

SEQ ID NO: 199113 - RNA, 19 nt, Homo sapiens
gcucggcuuugagaucuuc

SEQ ID NO: 199114 - RNA, 19 nt, Homo sapiens
guacgucugcugggacuau

SEQ ID NO: 199115 - RNA, 19 nt, Homo sapiens
gaagucaaggccauuuggu

SEQ ID NO: 199116 - RNA, 19 nt, Homo sapiens
gcacuagaaacuauaucca

SEQ ID NO: 199117 - RNA, 19 nt, Homo sapiens
uccaaggaggugacacuua

SEQ ID NO: 199118 - RNA, 19 nt, Homo sapiens
cacacgcuauggaaugguu

SEQ ID NO: 199119 - RNA, 19 nt, Homo sapiens
cuacauugcacuagaaacu

SEQ ID NO: 199120 - RNA, 19 nt, Homo sapiens
ucaaggccauuugguggau

SEQ ID NO: 199121 - RNA, 19 nt, Homo sapiens
aggcggaagcgauagcaua

SEQ ID NO: 199122 - RNA, 19 nt, Homo sapiens
caaguuccacacacgcuau

SEQ ID NO: 199123 - RNA, 19 nt, Homo sapiens
gaaaacagaccgugaacac

SEQ ID NO: 199124 - RNA, 19 nt, Homo sapiens
uauccgcauucuuggcauu

SEQ ID NO: 199125 - RNA, 19 nt, Homo sapiens
caaggccauuugguggauu

SEQ ID NO: 199126 - RNA, 19 nt, Homo sapiens
uucuggagaugacaacuga

SEQ ID NO: 199127 - RNA, 19 nt, Homo sapiens
gcugaggacacggcaaaug

SEQ ID NO: 199128 - RNA, 19 nt, Homo sapiens
aagcugaggacacggcaaa

SEQ ID NO: 199129 - RNA, 19 nt, Homo sapiens
gagaacccagagaagaaug

SEQ ID NO: 199130 - RNA, 19 nt, Homo sapiens
guuagcauggauuuauuga

SEQ ID NO: 199131 - RNA, 19 nt, Homo sapiens
gaccaucuugauuaauuuc

SEQ ID NO: 199132 - RNA, 19 nt, Homo sapiens
cccagaucgugacccagua

SEQ ID NO: 199133 - RNA, 19 nt, Homo sapiens
gagcuggagaacaggauuc

SEQ ID NO: 199134 - RNA, 19 nt, Homo sapiens
ccgaaagaggugaaagaga

SEQ ID NO: 199135 - RNA, 19 nt, Homo sapiens
gggagugccaggagaccuu

SEQ ID NO: 199136 - RNA, 19 nt, Homo sapiens
guccucuacugcuucauca

SEQ ID NO: 199137 - RNA, 19 nt, Homo sapiens
ucagcguccucuacugcuu

SEQ ID NO: 199138 - RNA, 19 nt, Homo sapiens
aaugugagaacccagagaa

SEQ ID NO: 199139 - RNA, 19 nt, Homo sapiens
gcauucuccuguccaagcu

SEQ ID NO: 199140 - RNA, 19 nt, Homo sapiens
ugugagaacccagagaaga

SEQ ID NO: 199141 - RNA, 19 nt, Homo sapiens
gaaagaggauucaguagua

SEQ ID NO: 199142 - RNA, 19 nt, Homo sapiens
gaaccuacaucaucaguau

SEQ ID NO: 199143 - RNA, 19 nt, Homo sapiens
gaaccuuucucauggauuu

SEQ ID NO: 199144 - RNA, 19 nt, Homo sapiens
gaacuugccuuuucauuuu

SEQ ID NO: 199145 - RNA, 19 nt, Homo sapiens
gaagagaaacugaacaaga

SEQ ID NO: 199146 - RNA, 19 nt, Homo sapiens
gaagacaucuaccaguuuc

SEQ ID NO: 199147 - RNA, 19 nt, Homo sapiens
ugaagcagauugagauaaa

SEQ ID NO: 199148 - RNA, 19 nt, Homo sapiens
gcucauguguucuauguga

SEQ ID NO: 199149 - RNA, 19 nt, Homo sapiens
aagagaaacugaacaagaa

SEQ ID NO: 199150 - RNA, 19 nt, Homo sapiens
aaacaggcuuuagucauua

SEQ ID NO: 199151 - RNA, 19 nt, Homo sapiens
agacaaggcccacagaaua

SEQ ID NO: 199152 - RNA, 19 nt, Homo sapiens
gaauaucauugaacucuuc

SEQ ID NO: 199153 - RNA, 19 nt, Homo sapiens
ccaauaugguguuuacauu

SEQ ID NO: 199154 - RNA, 19 nt, Homo sapiens
guaccuggcucauguguuc

SEQ ID NO: 199155 - RNA, 19 nt, Homo sapiens
gaugauaaccagaauucua

SEQ ID NO: 199156 - RNA, 19 nt, Homo sapiens
gcacauaugguguucaaau

SEQ ID NO: 199157 - RNA, 19 nt, Homo sapiens
ucaacagccuuauucauga

SEQ ID NO: 199158 - RNA, 19 nt, Homo sapiens
ugacaagucuuucccaauc

SEQ ID NO: 199159 - RNA, 19 nt, Homo sapiens
ggagaguguucuuuauuca

SEQ ID NO: 199160 - RNA, 19 nt, Homo sapiens
ggacuugugcuacuauauu

SEQ ID NO: 199161 - RNA, 19 nt, Homo sapiens
cauaugguguucaaauuug

SEQ ID NO: 199162 - RNA, 19 nt, Homo sapiens
gacaaggcccacagaauaa

SEQ ID NO: 199163 - RNA, 19 nt, Homo sapiens
gagcaaaacugggcuaauu

SEQ ID NO: 199164 - RNA, 19 nt, Homo sapiens
gcacuaagauuuuauuugg

SEQ ID NO: 199165 - RNA, 19 nt, Homo sapiens
gguacaagcagauacagua

SEQ ID NO: 199166 - RNA, 19 nt, Homo sapiens
gacuugugcuacuauauuu

SEQ ID NO: 199167 - RNA, 19 nt, Homo sapiens
gauguuugcacuaagauuu

SEQ ID NO: 199168 - RNA, 19 nt, Homo sapiens
cacauaugguguucaaauu

SEQ ID NO: 199169 - RNA, 19 nt, Homo sapiens
ggagugaccagcaacuuug

SEQ ID NO: 199170 - RNA, 19 nt, Homo sapiens
caucauuccucagcuacua

SEQ ID NO: 199171 - RNA, 19 nt, Homo sapiens
gaauaaauacuuccugaac

SEQ ID NO: 199172 - RNA, 19 nt, Homo sapiens
guacucaacagccuuauuc

SEQ ID NO: 199173 - RNA, 19 nt, Homo sapiens
gcaucaagauuccacucaa

SEQ ID NO: 199174 - RNA, 19 nt, Homo sapiens
cugaacaucuuaggucuuu

SEQ ID NO: 199175 - RNA, 19 nt, Homo sapiens
auacauagauaagggcuuu

SEQ ID NO: 199176 - RNA, 19 nt, Homo sapiens
cugaugaccuggagaucua

SEQ ID NO: 199177 - RNA, 19 nt, Homo sapiens
gagcuaaagucagggaauc

SEQ ID NO: 199178 - RNA, 19 nt, Homo sapiens
cuacuacucacauucauuu

SEQ ID NO: 199179 - RNA, 19 nt, Homo sapiens
guccuuaagucccugcuaa

SEQ ID NO: 199180 - RNA, 19 nt, Homo sapiens
aauaagaguuccauuaggu

SEQ ID NO: 199181 - RNA, 19 nt, Homo sapiens
ccaaacugauggugucaau

SEQ ID NO: 199182 - RNA, 19 nt, Homo sapiens
gauaagagaggugcauguu

SEQ ID NO: 199183 - RNA, 19 nt, Homo sapiens
ggauucaguaguacacaua

SEQ ID NO: 199184 - RNA, 19 nt, Homo sapiens
agaguggacuauuaaaugu

SEQ ID NO: 199185 - RNA, 19 nt, Homo sapiens
uaauuacagugcagaacaa

SEQ ID NO: 199186 - RNA, 19 nt, Homo sapiens
acacaguaauucagaacuu

SEQ ID NO: 199187 - RNA, 19 nt, Homo sapiens
caguugggaugucacuuaa

SEQ ID NO: 199188 - RNA, 19 nt, Homo sapiens
aaauaauucuggccaggaa

SEQ ID NO: 199189 - RNA, 19 nt, Homo sapiens
caucaagauuccacucaau

SEQ ID NO: 199190 - RNA, 19 nt, Homo sapiens
gaagcaccaucucuaacuc

SEQ ID NO: 199191 - RNA, 19 nt, Homo sapiens
caucaucaguauccucuuc

SEQ ID NO: 199192 - RNA, 19 nt, Homo sapiens
caauggacuugugcuacua

SEQ ID NO: 199193 - RNA, 19 nt, Homo sapiens
gcuuagaguggacuauuaa

SEQ ID NO: 199194 - RNA, 19 nt, Homo sapiens
guugggaugucacuuaaca

SEQ ID NO: 199195 - RNA, 19 nt, Homo sapiens
cacaauaucauuaccauca

SEQ ID NO: 199196 - RNA, 19 nt, Homo sapiens
gcauguugguauuuaaagu

SEQ ID NO: 199197 - RNA, 19 nt, Homo sapiens
uugaagacaucuaccaguu

SEQ ID NO: 199198 - RNA, 19 nt, Homo sapiens
uagaguggacuauuaaaug

SEQ ID NO: 199199 - RNA, 19 nt, Homo sapiens
ggccaggaauaaauacuuc

SEQ ID NO: 199200 - RNA, 19 nt, Homo sapiens
agaguuccauuaggugaua

SEQ ID NO: 199201 - RNA, 19 nt, Homo sapiens
gcagaccucggccugauga

SEQ ID NO: 199202 - RNA, 19 nt, Homo sapiens
uggagaguguucuuuauuc

SEQ ID NO: 199203 - RNA, 19 nt, Homo sapiens
acaguugggaugucacuua

SEQ ID NO: 199204 - RNA, 19 nt, Homo sapiens
uccauuaggugauacauag

SEQ ID NO: 199205 - RNA, 19 nt, Homo sapiens
aaacugauggugucaaugu

SEQ ID NO: 199206 - RNA, 19 nt, Homo sapiens
ccagcaacuuugauguuug

SEQ ID NO: 199207 - RNA, 19 nt, Homo sapiens
gaccagcaacuuugauguu

SEQ ID NO: 199208 - RNA, 19 nt, Homo sapiens
gggccaauaugguguuuac

SEQ ID NO: 199209 - RNA, 19 nt, Homo sapiens
uccauccacuugcacaaua

SEQ ID NO: 199210 - RNA, 19 nt, Homo sapiens
gaaugguucuguguaugug

SEQ ID NO: 199211 - RNA, 19 nt, Homo sapiens
ggugcauguugguauuuaa

SEQ ID NO: 199212 - RNA, 19 nt, Homo sapiens
ugaacuauauguugaagac

SEQ ID NO: 199213 - RNA, 19 nt, Homo sapiens
caaauuugaaccuuucuca

SEQ ID NO: 199214 - RNA, 19 nt, Homo sapiens
ugguaauuguggcuaaaua

SEQ ID NO: 199215 - RNA, 19 nt, Homo sapiens
ugaaugagcgggugguaau

SEQ ID NO: 199216 - RNA, 19 nt, Homo sapiens
gcaaacaccccuaagaaug

SEQ ID NO: 199217 - RNA, 19 nt, Homo sapiens
ggaagcaccaucucuaacu

SEQ ID NO: 199218 - RNA, 19 nt, Homo sapiens
agagaucccugcccacauc

SEQ ID NO: 199219 - RNA, 19 nt, Homo sapiens
ugaagacaucuaccaguuu

SEQ ID NO: 199220 - RNA, 19 nt, Homo sapiens
gguaauuguggcuaaauau

SEQ ID NO: 199221 - RNA, 19 nt, Homo sapiens
gaagcagauugagauaaag

SEQ ID NO: 199222 - RNA, 19 nt, Homo sapiens
ucagcuucauugcauguaa

SEQ ID NO: 199223 - RNA, 19 nt, Homo sapiens
aaacuacggucauguucag

SEQ ID NO: 199224 - RNA, 19 nt, Homo sapiens
cagucugccuuucguugua

SEQ ID NO: 199225 - RNA, 19 nt, Homo sapiens
uaggcaaacuccuugacaa

SEQ ID NO: 199226 - RNA, 19 nt, Homo sapiens
ugcuuagaguggacuauua

SEQ ID NO: 199227 - RNA, 19 nt, Homo sapiens
cgaagaguuuguuuuguuu

SEQ ID NO: 199228 - RNA, 19 nt, Homo sapiens
ccacuugcacaauaucauu

SEQ ID NO: 199229 - RNA, 19 nt, Homo sapiens
uaaaguaguggauucaaag

SEQ ID NO: 199230 - RNA, 19 nt, Homo sapiens
caacagccuuauucaugag

SEQ ID NO: 199231 - RNA, 19 nt, Homo sapiens
ggccuugaauaucauugaa

SEQ ID NO: 199232 - RNA, 19 nt, Homo sapiens
gaacucaagguugcccaaa

SEQ ID NO: 199233 - RNA, 19 nt, Homo sapiens
gaagguguggcugucagua

SEQ ID NO: 199234 - RNA, 19 nt, Homo sapiens
gagaggugcauguugguau

SEQ ID NO: 199235 - RNA, 19 nt, Homo sapiens
gacauuagaauaccuaggu

SEQ ID NO: 199236 - RNA, 19 nt, Homo sapiens
ucaagauuccacucaauug

SEQ ID NO: 199237 - RNA, 19 nt, Homo sapiens
gcgggaagcaccaucucua

SEQ ID NO: 199238 - RNA, 19 nt, Homo sapiens
guauugaagagcaugguaa

SEQ ID NO: 199239 - RNA, 19 nt, Homo sapiens
gggaaggcgugaggaaagu

SEQ ID NO: 199240 - RNA, 19 nt, Homo sapiens
gaaaauaaugcacauaugg

SEQ ID NO: 199241 - RNA, 19 nt, Homo sapiens
ggaccuacgucuucaacau

SEQ ID NO: 199242 - RNA, 19 nt, Homo sapiens
gaagagaagaagaaagaga

SEQ ID NO: 199243 - RNA, 19 nt, Homo sapiens
ucaacaugcuggagaucua

SEQ ID NO: 199244 - RNA, 19 nt, Homo sapiens
gcauggaagagaagaagaa

SEQ ID NO: 199245 - RNA, 19 nt, Homo sapiens
aggagcagcugaagagaga

SEQ ID NO: 199246 - RNA, 19 nt, Homo sapiens
uggaagagaagaagaaaga

SEQ ID NO: 199247 - RNA, 19 nt, Homo sapiens
ccaacacgguggacugcuu

SEQ ID NO: 199248 - RNA, 19 nt, Homo sapiens
ugaccgugcuguucaucuu

SEQ ID NO: 199249 - RNA, 19 nt, Homo sapiens
gcgagaacgucugcuacga

SEQ ID NO: 199250 - RNA, 19 nt, Homo sapiens
cggaggacuuggccaucua

SEQ ID NO: 199251 - RNA, 19 nt, Homo sapiens
gcugaugacugagcagaac

SEQ ID NO: 199252 - RNA, 19 nt, Homo sapiens
gagcagcugaagagagaga

SEQ ID NO: 199253 - RNA, 19 nt, Homo sapiens
guucaucuuccgcaucuug

SEQ ID NO: 199254 - RNA, 19 nt, Homo sapiens
caccaccaccugcugauga

SEQ ID NO: 199255 - RNA, 19 nt, Homo sapiens
gaggaggagcagcugaaga

SEQ ID NO: 199256 - RNA, 19 nt, Homo sapiens
gcuggaagaagcucaagca

SEQ ID NO: 199257 - RNA, 19 nt, Homo sapiens
gaccuacgucuucaacauc

SEQ ID NO: 199258 - RNA, 19 nt, Homo sapiens
gaccaucuucaucaucuuc

SEQ ID NO: 199259 - RNA, 19 nt, Homo sapiens
gcugcgagaacgucugcua

SEQ ID NO: 199260 - RNA, 19 nt, Homo sapiens
ccacgcccacccucaucua

SEQ ID NO: 199261 - RNA, 19 nt, Homo sapiens
aaacaggacuugaucacaa

SEQ ID NO: 199262 - RNA, 19 nt, Homo sapiens
gaaauaaacaggacuugau

SEQ ID NO: 199263 - RNA, 19 nt, Homo sapiens
gcaccaacgucugcuauga

SEQ ID NO: 199264 - RNA, 19 nt, Homo sapiens
cuaagaagcaguauguaua

SEQ ID NO: 199265 - RNA, 19 nt, Homo sapiens
gcaccuaugucgccagugu

SEQ ID NO: 199266 - RNA, 19 nt, Homo sapiens
uauagaggccuguggcuua

SEQ ID NO: 199267 - RNA, 19 nt, Homo sapiens
gggccaaccugaccacaga

SEQ ID NO: 199268 - RNA, 19 nt, Homo sapiens
ugacggugcucuucaucuu

SEQ ID NO: 199269 - RNA, 19 nt, Homo sapiens
gaccauggagcccguguuu

SEQ ID NO: 199270 - RNA, 19 nt, Homo sapiens
gauggucgccugcgcauuc

SEQ ID NO: 199271 - RNA, 19 nt, Homo sapiens
ggaacccagagccaacuua

SEQ ID NO: 199272 - RNA, 19 nt, Homo sapiens
caucacuccuuccuaguuc

SEQ ID NO: 199273 - RNA, 19 nt, Homo sapiens
uaagaagcaguauguauag

SEQ ID NO: 199274 - RNA, 19 nt, Homo sapiens
gcacugaugggcaccuaug

SEQ ID NO: 199275 - RNA, 19 nt, Homo sapiens
ccauggagccucauugcaa

SEQ ID NO: 199276 - RNA, 19 nt, Homo sapiens
gagcacugaugggcaccua

SEQ ID NO: 199277 - RNA, 19 nt, Homo sapiens
gaugcuugcuggccaugga

SEQ ID NO: 199278 - RNA, 19 nt, Homo sapiens
ucaucucccuggugcuuaa

SEQ ID NO: 199279 - RNA, 19 nt, Homo sapiens
ccauggagcccguguuugu

SEQ ID NO: 199280 - RNA, 19 nt, Homo sapiens
gcacacccacccuggucua

SEQ ID NO: 199281 - RNA, 19 nt, Homo sapiens
aacaggacuugaucacaaa

SEQ ID NO: 199282 - RNA, 19 nt, Homo sapiens
ucaagcuucugaaauaaac

SEQ ID NO: 199283 - RNA, 19 nt, Homo sapiens
aggagaggcuggcgucuuc

SEQ ID NO: 199284 - RNA, 19 nt, Homo sapiens
ggagccucauugcaaguug

SEQ ID NO: 199285 - RNA, 19 nt, Homo sapiens
gcaccuccucagacccuua

SEQ ID NO: 199286 - RNA, 19 nt, Homo sapiens
aagagcggcuggcgcagaa

SEQ ID NO: 199287 - RNA, 19 nt, Homo sapiens
ugaaauaaacaggacuuga

SEQ ID NO: 199288 - RNA, 19 nt, Homo sapiens
cagagcuugugccggauuu

SEQ ID NO: 199289 - RNA, 19 nt, Homo sapiens
uggcuuaugucacccaaca

SEQ ID NO: 199290 - RNA, 19 nt, Homo sapiens
gugcgcagguuguccucaa

SEQ ID NO: 199291 - RNA, 19 nt, Homo sapiens
gagccucauugcaaguugu

SEQ ID NO: 199292 - RNA, 19 nt, Homo sapiens
ucuaagaagcaguauguau

SEQ ID NO: 199293 - RNA, 19 nt, Homo sapiens
caagaucucgguggcagaa

SEQ ID NO: 199294 - RNA, 19 nt, Homo sapiens
gaacccagagccaacuuac

SEQ ID NO: 199295 - RNA, 19 nt, Homo sapiens
cuuccuaguucuacuguuc

SEQ ID NO: 199296 - RNA, 19 nt, Homo sapiens
caacagagggguccugaga

SEQ ID NO: 199297 - RNA, 19 nt, Homo sapiens
cuaccugggccaugucauu

SEQ ID NO: 199298 - RNA, 19 nt, Homo sapiens
gcuuaugucacccaacaga

SEQ ID NO: 199299 - RNA, 19 nt, Homo sapiens
acucgaccgugguggguaa

SEQ ID NO: 199300 - RNA, 19 nt, Homo sapiens
aaauaaacaggacuugauc

SEQ ID NO: 199301 - RNA, 19 nt, Homo sapiens
aagaagcaguauguauaga

SEQ ID NO: 199302 - RNA, 19 nt, Homo sapiens
cucaaacccucuccucaca

SEQ ID NO: 199303 - RNA, 19 nt, Homo sapiens
agaggccuguggcuuaugu

SEQ ID NO: 199304 - RNA, 19 nt, Homo sapiens
auagaggccuguggcuuau

SEQ ID NO: 199305 - RNA, 19 nt, Homo sapiens
gaggagaggcuggcgucuu

SEQ ID NO: 199306 - RNA, 19 nt, Homo sapiens
ugcuuaaccugcuggaguu

SEQ ID NO: 199307 - RNA, 19 nt, Homo sapiens
guuggugguuggacucauc

SEQ ID NO: 199308 - RNA, 19 nt, Homo sapiens
gaccaucuucaucaucuuc

SEQ ID NO: 199309 - RNA, 19 nt, Homo sapiens
ucaucacuccuuccuaguu

SEQ ID NO: 199310 - RNA, 19 nt, Homo sapiens
agaucucgguggcagaaga

SEQ ID NO: 199311 - RNA, 19 nt, Homo sapiens
uaaacaggacuugaucaca

SEQ ID NO: 199312 - RNA, 19 nt, Homo sapiens
cuucaucaucuucauguug

SEQ ID NO: 199313 - RNA, 19 nt, Homo sapiens
ccaugucauuuaccugucu

SEQ ID NO: 199314 - RNA, 19 nt, Homo sapiens
caaaugcguucucuaaguu

SEQ ID NO: 199315 - RNA, 19 nt, Homo sapiens
caacaggaauauccaagaa

SEQ ID NO: 199316 - RNA, 19 nt, Homo sapiens
ggaagggaauggaaggauu

SEQ ID NO: 199317 - RNA, 19 nt, Homo sapiens
uacgaagccuuucagauua

SEQ ID NO: 199318 - RNA, 19 nt, Homo sapiens
gcacucugcucaacaccua

SEQ ID NO: 199319 - RNA, 19 nt, Homo sapiens
gaaacaggguagagggaaa

SEQ ID NO: 199320 - RNA, 19 nt, Homo sapiens
ugacguugcucauuaauuc

SEQ ID NO: 199321 - RNA, 19 nt, Homo sapiens
gaaaccaucccuucccuuu

SEQ ID NO: 199322 - RNA, 19 nt, Homo sapiens
gcaaaugcccugguaugua

SEQ ID NO: 199323 - RNA, 19 nt, Homo sapiens
gacaagcgacgucuuagua

SEQ ID NO: 199324 - RNA, 19 nt, Homo sapiens
caaaugcccugguauguac

SEQ ID NO: 199325 - RNA, 19 nt, Homo sapiens
gggaugagcaggcugauuu

SEQ ID NO: 199326 - RNA, 19 nt, Homo sapiens
acaaaugccuugguaugua

SEQ ID NO: 199327 - RNA, 19 nt, Homo sapiens
ccaaaugcguucucuaagu

SEQ ID NO: 199328 - RNA, 19 nt, Homo sapiens
gcacugucccuccuccuua

SEQ ID NO: 199329 - RNA, 19 nt, Homo sapiens
acaguucaauccaaugaua

SEQ ID NO: 199330 - RNA, 19 nt, Homo sapiens
gaaugacucucucucuaca

SEQ ID NO: 199331 - RNA, 19 nt, Homo sapiens
ucacuguccucuucauauu

SEQ ID NO: 199332 - RNA, 19 nt, Homo sapiens
cacaaacucuacuggaauu

SEQ ID NO: 199333 - RNA, 19 nt, Homo sapiens
caaggaagagcucaaaguu

SEQ ID NO: 199334 - RNA, 19 nt, Homo sapiens
cauuauaugugcucuugaa

SEQ ID NO: 199335 - RNA, 19 nt, Homo sapiens
ucagauuacucaugaaaca

SEQ ID NO: 199336 - RNA, 19 nt, Homo sapiens
auacgaagccuuucagauu

SEQ ID NO: 199337 - RNA, 19 nt, Homo sapiens
gaacugaugcuuucucacu

SEQ ID NO: 199338 - RNA, 19 nt, Homo sapiens
aauauggccucccaacaaa

SEQ ID NO: 199339 - RNA, 19 nt, Homo sapiens
gggagucacuguacacaca

SEQ ID NO: 199340 - RNA, 19 nt, Homo sapiens
gaagaucagacagcgauuu

SEQ ID NO: 199341 - RNA, 19 nt, Homo sapiens
uucaaucccuucagcaaua

SEQ ID NO: 199342 - RNA, 19 nt, Homo sapiens
gaagggaauggaaggauug

SEQ ID NO: 199343 - RNA, 19 nt, Homo sapiens
cacacaaacucuacuggaa

SEQ ID NO: 199344 - RNA, 19 nt, Homo sapiens
uaauauggccucccaacaa

SEQ ID NO: 199345 - RNA, 19 nt, Homo sapiens
caccugggcuggaagaaga

SEQ ID NO: 199346 - RNA, 19 nt, Homo sapiens
uauaugugcucuugaaucu

SEQ ID NO: 199347 - RNA, 19 nt, Homo sapiens
gcugauuuccggugugaua

SEQ ID NO: 199348 - RNA, 19 nt, Homo sapiens
gcagaggauuacaacacaa

SEQ ID NO: 199349 - RNA, 19 nt, Homo sapiens
aaagacgugucccuucuga

SEQ ID NO: 199350 - RNA, 19 nt, Homo sapiens
gcaaggcaaggucagauga

SEQ ID NO: 199351 - RNA, 19 nt, Homo sapiens
guauguaccucuggcaaau

SEQ ID NO: 199352 - RNA, 19 nt, Homo sapiens
guauguaccucuggcaaau

SEQ ID NO: 199353 - RNA, 19 nt, Homo sapiens
caaaugccuugguauguac

SEQ ID NO: 199354 - RNA, 19 nt, Homo sapiens
caauagacagcaugaauca

SEQ ID NO: 199355 - RNA, 19 nt, Homo sapiens
uaccaaaugcguucucuaa

SEQ ID NO: 199356 - RNA, 19 nt, Homo sapiens
acagacaggcagaggauua

SEQ ID NO: 199357 - RNA, 19 nt, Homo sapiens
ggcaaaagcuggccuggaa

SEQ ID NO: 199358 - RNA, 19 nt, Homo sapiens
uaugugcucuugaaucugu

SEQ ID NO: 199359 - RNA, 19 nt, Homo sapiens
agccucagcuuuacaaaug

SEQ ID NO: 199360 - RNA, 19 nt, Homo sapiens
cuucugaacugaugcuuuc

SEQ ID NO: 199361 - RNA, 19 nt, Homo sapiens
ggcagaggauuacaacaca

SEQ ID NO: 199362 - RNA, 19 nt, Homo sapiens
ggccuuaccaacaggaaua

SEQ ID NO: 199363 - RNA, 19 nt, Homo sapiens
ucaaaguucccagccaaua

SEQ ID NO: 199364 - RNA, 19 nt, Homo sapiens
ccuuucagauuacucauga

SEQ ID NO: 199365 - RNA, 19 nt, Homo sapiens
ucaaucccuucagcaauaa

SEQ ID NO: 199366 - RNA, 19 nt, Homo sapiens
ggucaacuguuacguaucc

SEQ ID NO: 199367 - RNA, 19 nt, Homo sapiens
gcucauuaauucuagaaac

SEQ ID NO: 199368 - RNA, 19 nt, Homo sapiens
ucagaugaccuaucagugu

SEQ ID NO: 199369 - RNA, 19 nt, Homo sapiens
gaauauccaagaagcuguu

SEQ ID NO: 199370 - RNA, 19 nt, Homo sapiens
ggaacuugcauuauaugug

SEQ ID NO: 199371 - RNA, 19 nt, Homo sapiens
gccaauagacagcaugaau

SEQ ID NO: 199372 - RNA, 19 nt, Homo sapiens
ggaggugggcuucauugug

SEQ ID NO: 199373 - RNA, 19 nt, Homo sapiens
gugccaagaugggcgauug

SEQ ID NO: 199374 - RNA, 19 nt, Homo sapiens
cagcaugaaucaaggaacu

SEQ ID NO: 199375 - RNA, 19 nt, Homo sapiens
augacucucucucuacaua

SEQ ID NO: 199376 - RNA, 19 nt, Homo sapiens
ccggucaacuguuacguau

SEQ ID NO: 199377 - RNA, 19 nt, Homo sapiens
caaaguucccagccaauag

SEQ ID NO: 199378 - RNA, 19 nt, Homo sapiens
ggcagcacauggcuaagug

SEQ ID NO: 199379 - RNA, 19 nt, Homo sapiens
gcucacuguccucuucaua

SEQ ID NO: 199380 - RNA, 19 nt, Homo sapiens
gcagcuccuuuacaguuca

SEQ ID NO: 199381 - RNA, 19 nt, Homo sapiens
uuacaaaugccuugguaug

SEQ ID NO: 199382 - RNA, 19 nt, Homo sapiens
cuacauaccagcagcauac

SEQ ID NO: 199383 - RNA, 19 nt, Homo sapiens
ccagagggauagaaugacu

SEQ ID NO: 199384 - RNA, 19 nt, Homo sapiens
ucagugugacccuccuuua

SEQ ID NO: 199385 - RNA, 19 nt, Homo sapiens
gcuacugggugcugcagau

SEQ ID NO: 199386 - RNA, 19 nt, Homo sapiens
gcuguuguccucucucgaa

SEQ ID NO: 199387 - RNA, 19 nt, Homo sapiens
gcuagggagucacuguaca

SEQ ID NO: 199388 - RNA, 19 nt, Homo sapiens
ccaauagacagcaugaauc

SEQ ID NO: 199389 - RNA, 19 nt, Homo sapiens
gaaagacgugucccuucug

SEQ ID NO: 199390 - RNA, 19 nt, Homo sapiens
cccacccggucaacuguua

SEQ ID NO: 199391 - RNA, 19 nt, Homo sapiens
cuuuacaaaugccuuggua

SEQ ID NO: 199392 - RNA, 19 nt, Homo sapiens
ccaaggaagagcucaaagu

SEQ ID NO: 199393 - RNA, 19 nt, Homo sapiens
agggauagccagagggaua

SEQ ID NO: 199394 - RNA, 19 nt, Homo sapiens
acaagcgacgucuuaguaa

SEQ ID NO: 199395 - RNA, 19 nt, Homo sapiens
gcagagaaggcagaacugu

SEQ ID NO: 199396 - RNA, 19 nt, Homo sapiens
gcaggagaagcgcaagcua

SEQ ID NO: 199397 - RNA, 19 nt, Homo sapiens
gagucacuguacacacaaa

SEQ ID NO: 199398 - RNA, 19 nt, Homo sapiens
gcacugggagacgaaaguu

SEQ ID NO: 199399 - RNA, 19 nt, Homo sapiens
ccaacaggaauauccaaga

SEQ ID NO: 199400 - RNA, 19 nt, Homo sapiens
ucaauccaaugauagaaac

SEQ ID NO: 199401 - RNA, 19 nt, Homo sapiens
uggaauuccugccaacauc

SEQ ID NO: 199402 - RNA, 19 nt, Homo sapiens
guugcaaccuuuccuucug

SEQ ID NO: 199403 - RNA, 19 nt, Homo sapiens
uuacaguucaauccaauga

SEQ ID NO: 199404 - RNA, 19 nt, Homo sapiens
accagcagccucagcuuua

SEQ ID NO: 199405 - RNA, 19 nt, Homo sapiens
gcucuugaaucuguugucu

SEQ ID NO: 199406 - RNA, 19 nt, Homo sapiens
ugcauuauaugugcucuug

SEQ ID NO: 199407 - RNA, 19 nt, Homo sapiens
gcaagcacugggagacgaa

SEQ ID NO: 199408 - RNA, 19 nt, Homo sapiens
agugacaagcgacgucuua

SEQ ID NO: 199409 - RNA, 19 nt, Homo sapiens
ugucuucauugucuuuaug

SEQ ID NO: 199410 - RNA, 19 nt, Homo sapiens
aaccaucccuucccuuucu

SEQ ID NO: 199411 - RNA, 19 nt, Homo sapiens
acacaaacucuacuggaau

SEQ ID NO: 199412 - RNA, 19 nt, Homo sapiens
aaaguucccagccaauaga

SEQ ID NO: 199413 - RNA, 19 nt, Homo sapiens
gugugacccuccuuuaugg

SEQ ID NO: 199414 - RNA, 19 nt, Homo sapiens
gcaaaggcacuaagaaguu

SEQ ID NO: 199415 - RNA, 19 nt, Homo sapiens
guccagagcugacaacaga

SEQ ID NO: 199416 - RNA, 19 nt, Homo sapiens
agagaaagagcacauauuu

SEQ ID NO: 199417 - RNA, 19 nt, Homo sapiens
gaaaugggcgacuggaguu

SEQ ID NO: 199418 - RNA, 19 nt, Homo sapiens
gaagagcagcggcagcaaa

SEQ ID NO: 199419 - RNA, 19 nt, Homo sapiens
caaaggcacuaagaaguuc

SEQ ID NO: 199420 - RNA, 19 nt, Homo sapiens
gagagaaagagcacauauu

SEQ ID NO: 199421 - RNA, 19 nt, Homo sapiens
ucaaucaguucgaggagaa

SEQ ID NO: 199422 - RNA, 19 nt, Homo sapiens
ggacacuccuuguauuggu

SEQ ID NO: 199423 - RNA, 19 nt, Homo sapiens
aagagacacugccuuccua

SEQ ID NO: 199424 - RNA, 19 nt, Homo sapiens
cggagaaggugucaaagca

SEQ ID NO: 199425 - RNA, 19 nt, Homo sapiens
gauccggucugccuugaag

SEQ ID NO: 199426 - RNA, 19 nt, Homo sapiens
caagggcuaucagcuucua

SEQ ID NO: 199427 - RNA, 19 nt, Homo sapiens
agaaaucccuccacuccau

SEQ ID NO: 199428 - RNA, 19 nt, Homo sapiens
gugggacacuccuuguauu

SEQ ID NO: 199429 - RNA, 19 nt, Homo sapiens
gacgaggccuuucccaucu

SEQ ID NO: 199430 - RNA, 19 nt, Homo sapiens
ccaaugugguggacugcuu

SEQ ID NO: 199431 - RNA, 19 nt, Homo sapiens
gcagcaaaggcacuaagaa

SEQ ID NO: 199432 - RNA, 19 nt, Homo sapiens
gaaaucccuccacuccauu

SEQ ID NO: 199433 - RNA, 19 nt, Homo sapiens
cagacgaucuaaccguaug

SEQ ID NO: 199434 - RNA, 19 nt, Homo sapiens
ccaagccuuucaaucaguu

SEQ ID NO: 199435 - RNA, 19 nt, Homo sapiens
ggacccugcugaggaccua

SEQ ID NO: 199436 - RNA, 19 nt, Homo sapiens
ccacggaggagcaggagaa

SEQ ID NO: 199437 - RNA, 19 nt, Homo sapiens
ggagaaggugucaaagcaa

SEQ ID NO: 199438 - RNA, 19 nt, Homo sapiens
ggaccuacaucugccacau

SEQ ID NO: 199439 - RNA, 19 nt, Homo sapiens
gcgagaacgucugcuacga

SEQ ID NO: 199440 - RNA, 19 nt, Homo sapiens
cagcaaaggcacuaagaag

SEQ ID NO: 199441 - RNA, 19 nt, Homo sapiens
cugccaagccuuucaauca

SEQ ID NO: 199442 - RNA, 19 nt, Homo sapiens
gccaagccuuucaaucagu

SEQ ID NO: 199443 - RNA, 19 nt, Homo sapiens
caagagagaaagagcacau

SEQ ID NO: 199444 - RNA, 19 nt, Homo sapiens
gggauccggucugccuuga

SEQ ID NO: 199445 - RNA, 19 nt, Homo sapiens
gagcugacaacagaugaug

SEQ ID NO: 199446 - RNA, 19 nt, Homo sapiens
ggagaaaaccaucuucauc

SEQ ID NO: 199447 - RNA, 19 nt, Homo sapiens
gaccagggcagcgucaaga

SEQ ID NO: 199448 - RNA, 19 nt, Homo sapiens
gaagaagagaaaaucguuu

SEQ ID NO: 199449 - RNA, 19 nt, Homo sapiens
cuacaucugccacaucauc

SEQ ID NO: 199450 - RNA, 19 nt, Homo sapiens
cagggcagcgucaagaaga

SEQ ID NO: 199451 - RNA, 19 nt, Homo sapiens
ccagagcugacaacagaug

SEQ ID NO: 199452 - RNA, 19 nt, Homo sapiens
agagagaaagagcacauau

SEQ ID NO: 199453 - RNA, 19 nt, Homo sapiens
gcugcgagaacgucugcua

SEQ ID NO: 199454 - RNA, 19 nt, Homo sapiens
agucggagaaggugucaaa

SEQ ID NO: 199455 - RNA, 19 nt, Homo sapiens
cggaggagcaggagaaggu

SEQ ID NO: 199456 - RNA, 19 nt, Homo sapiens
cgugggacacuccuuguau

SEQ ID NO: 199457 - RNA, 19 nt, Homo sapiens
ugaccgagguugggauggu

SEQ ID NO: 199458 - RNA, 19 nt, Homo sapiens
gggcuaucagcuucuagaa

SEQ ID NO: 199459 - RNA, 19 nt, Homo sapiens
uuucccaucucccacauuc

SEQ ID NO: 199460 - RNA, 19 nt, Homo sapiens
ggcagcaaaggcacuaaga

SEQ ID NO: 199461 - RNA, 19 nt, Homo sapiens
gagagaagcaggcagauaa

SEQ ID NO: 199462 - RNA, 19 nt, Homo sapiens
ucaacaagcugcugaguga

SEQ ID NO: 199463 - RNA, 19 nt, Homo sapiens
gcacguggcucaccagcaa

SEQ ID NO: 199464 - RNA, 19 nt, Homo sapiens
ugagaaaucuuccuucauc

SEQ ID NO: 199465 - RNA, 19 nt, Homo sapiens
gaugagaaaucuuccuuca

SEQ ID NO: 199466 - RNA, 19 nt, Homo sapiens
gaagcaggcagauaaguug

SEQ ID NO: 199467 - RNA, 19 nt, Homo sapiens
gcacaagguccacaucuca

SEQ ID NO: 199468 - RNA, 19 nt, Homo sapiens
ccgacagcgucuccaauua

SEQ ID NO: 199469 - RNA, 19 nt, Homo sapiens
gaacuggacagguuuguac

SEQ ID NO: 199470 - RNA, 19 nt, Homo sapiens
gacagcgucuccaauuaug

SEQ ID NO: 199471 - RNA, 19 nt, Homo sapiens
ggccagcacuaguaaagga

SEQ ID NO: 199472 - RNA, 19 nt, Homo sapiens
agaaugagaucaacaagcu

SEQ ID NO: 199473 - RNA, 19 nt, Homo sapiens
caacagcguuugcuaugac

SEQ ID NO: 199474 - RNA, 19 nt, Homo sapiens
cgacagcgucuccaauuau

SEQ ID NO: 199475 - RNA, 19 nt, Homo sapiens
gaauacaagcagaaugaga

SEQ ID NO: 199476 - RNA, 19 nt, Homo sapiens
aggaugaacuggacagguu

SEQ ID NO: 199477 - RNA, 19 nt, Homo sapiens
ggugguggcugcagagagu

SEQ ID NO: 199478 - RNA, 19 nt, Homo sapiens
gaguauggcucucggucau

SEQ ID NO: 199479 - RNA, 19 nt, Homo sapiens
ugaggaggaugugguaaga

SEQ ID NO: 199480 - RNA, 19 nt, Homo sapiens
gagaaaucuuccuucaucu

SEQ ID NO: 199481 - RNA, 19 nt, Homo sapiens
gcugucagauacccugguu

SEQ ID NO: 199482 - RNA, 19 nt, Homo sapiens
gggcugggcuggcugaaaa

SEQ ID NO: 199483 - RNA, 19 nt, Homo sapiens
ccucucaccugaauacaag

SEQ ID NO: 199484 - RNA, 19 nt, Homo sapiens
uaaaggaggaauagugcuu

SEQ ID NO: 199485 - RNA, 19 nt, Homo sapiens
cugaauacaagcagaauga

SEQ ID NO: 199486 - RNA, 19 nt, Homo sapiens
ggagcuagaggccaccuau

SEQ ID NO: 199487 - RNA, 19 nt, Homo sapiens
gacagggaggugugaauga

SEQ ID NO: 199488 - RNA, 19 nt, Homo sapiens
gaaugaggcaggaugaacu

SEQ ID NO: 199489 - RNA, 19 nt, Homo sapiens
ggaugaacuggacagguuu

SEQ ID NO: 199490 - RNA, 19 nt, Homo sapiens
gaggccgucuucauguaug

SEQ ID NO: 199491 - RNA, 19 nt, Homo sapiens
ggcgugaaccggcauucua

SEQ ID NO: 199492 - RNA, 19 nt, Homo sapiens
agaagcaggcagauaaguu

SEQ ID NO: 199493 - RNA, 19 nt, Homo sapiens
ggaguuagggagagagaag

SEQ ID NO: 199494 - RNA, 19 nt, Homo sapiens
ggggauuacucgaucaaaa

SEQ ID NO: 199495 - RNA, 19 nt, Homo sapiens
cagcgucuccaauuaugaa

SEQ ID NO: 199496 - RNA, 19 nt, Homo sapiens
cugcagcucauccuaguuu

SEQ ID NO: 199497 - RNA, 19 nt, Homo sapiens
gcaucugcaucauccucaa

SEQ ID NO: 199498 - RNA, 19 nt, Homo sapiens
uugaggccgucuucaugua

SEQ ID NO: 199499 - RNA, 19 nt, Homo sapiens
acacugugguggaccuaug

SEQ ID NO: 199500 - RNA, 19 nt, Homo sapiens
cguuugcuaugaccaauuc

SEQ ID NO: 199501 - RNA, 19 nt, Homo sapiens
ucggucaucuucaucuuca

SEQ ID NO: 199502 - RNA, 19 nt, Homo sapiens
cucucugccugaaauguua

SEQ ID NO: 199503 - RNA, 19 nt, Homo sapiens
agagagaagcaggcagaua

SEQ ID NO: 199504 - RNA, 19 nt, Homo sapiens
caccgccucucaccugaau

SEQ ID NO: 199505 - RNA, 19 nt, Homo sapiens
ggucaucuucaucuucaga

SEQ ID NO: 199506 - RNA, 19 nt, Homo sapiens
cgucuucaccgucuucaug

SEQ ID NO: 199507 - RNA, 19 nt, Homo sapiens
cagcaacacauagagaaga

SEQ ID NO: 199508 - RNA, 19 nt, Homo sapiens
ggccaccucugccucuagu

SEQ ID NO: 199509 - RNA, 19 nt, Homo sapiens
uaguaaaggaggaauagug

SEQ ID NO: 199510 - RNA, 19 nt, Homo sapiens
ggccugcugaugccacaua

SEQ ID NO: 199511 - RNA, 19 nt, Homo sapiens
ggucaagugcgacgucuac

SEQ ID NO: 199512 - RNA, 19 nt, Homo sapiens
agcaacacauagagaagaa

SEQ ID NO: 199513 - RNA, 19 nt, Homo sapiens
ugagggaguuagggagaga

SEQ ID NO: 199514 - RNA, 19 nt, Homo sapiens
ccacuggguacaagagaug

SEQ ID NO: 199515 - RNA, 19 nt, Homo sapiens
ggcacaagguccacaucuc

SEQ ID NO: 199516 - RNA, 19 nt, Homo sapiens
gagaagcaggcagauaagu

SEQ ID NO: 199517 - RNA, 19 nt, Homo sapiens
guauggcucucggucaucu

SEQ ID NO: 199518 - RNA, 19 nt, Homo sapiens
gcagaaugagaucaacaag

SEQ ID NO: 199519 - RNA, 19 nt, Homo sapiens
aauacaagcagaaugagau

SEQ ID NO: 199520 - RNA, 19 nt, Homo sapiens
gaugaacuggacagguuug

SEQ ID NO: 199521 - RNA, 19 nt, Homo sapiens
aaucuuccuucaucugcaa

SEQ ID NO: 199522 - RNA, 19 nt, Homo sapiens
acaagcagaaugagaucaa

SEQ ID NO: 199523 - RNA, 19 nt, Homo sapiens
gcaacacauagagaagaaa

SEQ ID NO: 199524 - RNA, 19 nt, Homo sapiens
ggacauguggguggagaag

SEQ ID NO: 199525 - RNA, 19 nt, Homo sapiens
ccugcacccuucccucuuc

SEQ ID NO: 199526 - RNA, 19 nt, Homo sapiens
guuugaggccgucuucaug

SEQ ID NO: 199527 - RNA, 19 nt, Homo sapiens
ugacagggaggugugaaug

SEQ ID NO: 199528 - RNA, 19 nt, Homo sapiens
gugaugagaaaucuuccuu

SEQ ID NO: 199529 - RNA, 19 nt, Homo sapiens
cgucuccaauuaugaaacu

SEQ ID NO: 199530 - RNA, 19 nt, Homo sapiens
gagcuagaggccaccuaug

SEQ ID NO: 199531 - RNA, 19 nt, Homo sapiens
cgucuucauguaugucuuu

SEQ ID NO: 199532 - RNA, 19 nt, Homo sapiens
caacacauagagaagaaaa

SEQ ID NO: 199533 - RNA, 19 nt, Homo sapiens
acagggaggugugaaugag

SEQ ID NO: 199534 - RNA, 19 nt, Homo sapiens
uguuccggcuguuguuuga

SEQ ID NO: 199535 - RNA, 19 nt, Homo sapiens
gaaugucacugaauugugu

SEQ ID NO: 199536 - RNA, 19 nt, Homo sapiens
ggagauaaagagugaauuu

SEQ ID NO: 199537 - RNA, 19 nt, Homo sapiens
gaauuugcauccugcugaa

SEQ ID NO: 199538 - RNA, 19 nt, Homo sapiens
gcaagaacgugugcuacga

SEQ ID NO: 199539 - RNA, 19 nt, Homo sapiens
ggacaucgaggagaucaaa

SEQ ID NO: 199540 - RNA, 19 nt, Homo sapiens
gugcuacgaucacuacuuc

SEQ ID NO: 199541 - RNA, 19 nt, Homo sapiens
ucauguacgucuucuaugu

SEQ ID NO: 199542 - RNA, 19 nt, Homo sapiens
gagaugagcaggccgacuu

SEQ ID NO: 199543 - RNA, 19 nt, Homo sapiens
gagaagaagaggaaguuca

SEQ ID NO: 199544 - RNA, 19 nt, Homo sapiens
gacaugagaagaagaggaa

SEQ ID NO: 199545 - RNA, 19 nt, Homo sapiens
gaagaggaaguucaucaag

SEQ ID NO: 199546 - RNA, 19 nt, Homo sapiens
gcauuaugauccucguugu

SEQ ID NO: 199547 - RNA, 19 nt, Homo sapiens
uuaaggacaucgaggagau

SEQ ID NO: 199548 - RNA, 19 nt, Homo sapiens
gucacugaauuguguuauu

SEQ ID NO: 199549 - RNA, 19 nt, Homo sapiens
caaacacuccaccagcauu

SEQ ID NO: 199550 - RNA, 19 nt, Homo sapiens
ccaacacuguggacugcuu

SEQ ID NO: 199551 - RNA, 19 nt, Homo sapiens
gcucaccguccucuucauu

SEQ ID NO: 199552 - RNA, 19 nt, Homo sapiens
guacgucuucuaugucaug

SEQ ID NO: 199553 - RNA, 19 nt, Homo sapiens
ggagacaugagaagaagag

SEQ ID NO: 199554 - RNA, 19 nt, Homo sapiens
guucaugauugcagugucu

SEQ ID NO: 199555 - RNA, 19 nt, Homo sapiens
ccagaagguccgcaucgaa

SEQ ID NO: 199556 - RNA, 19 nt, Homo sapiens
ucacaguguucaugauugc

SEQ ID NO: 199557 - RNA, 19 nt, Homo sapiens
cgucuucuaugucauguac

SEQ ID NO: 199558 - RNA, 19 nt, Homo sapiens
caacacuguggacugcuuu

SEQ ID NO: 199559 - RNA, 19 nt, Homo sapiens
gcugaaugucacugaauug

SEQ ID NO: 199560 - RNA, 19 nt, Homo sapiens
caccagcauuggaaagauc

SEQ ID NO: 199561 - RNA, 19 nt, Homo sapiens
agagugaauuuaaggacau

SEQ ID NO: 199562 - RNA, 19 nt, Homo sapiens
ccaccagcauuggaaagau

SEQ ID NO: 199563 - RNA, 19 nt, Homo sapiens
aagaagaggaaguucauca

SEQ ID NO: 199564 - RNA, 19 nt, Homo sapiens
caagaacgugugcuacgau

SEQ ID NO: 199565 - RNA, 19 nt, Homo sapiens
aaacacuccaccagcauug

SEQ ID NO: 199566 - RNA, 19 nt, Homo sapiens
gcugcaagaacgugugcua

SEQ ID NO: 199567 - RNA, 19 nt, Homo sapiens
ggccuugucccaacacugu

SEQ ID NO: 199568 - RNA, 19 nt, Homo sapiens
gaacgugugcuacgaucac

SEQ ID NO: 199569 - RNA, 19 nt, Homo sapiens
ugcugaaugucacugaauu

SEQ ID NO: 199570 - RNA, 19 nt, Homo sapiens
gauugcagugucuggaauu

SEQ ID NO: 199571 - RNA, 19 nt, Homo sapiens
acuguggacugcuuugugu

SEQ ID NO: 199572 - RNA, 19 nt, Homo sapiens
cuucauguacgucuucuau

SEQ ID NO: 199573 - RNA, 19 nt, Homo sapiens
gagcaggccgacuuugucu

SEQ ID NO: 199574 - RNA, 19 nt, Homo sapiens
ugauugcagugucuggaau

SEQ ID NO: 199575 - RNA, 19 nt, Homo sapiens
cuacacaagcagcaucuuc

SEQ ID NO: 199576 - RNA, 19 nt, Homo sapiens
gaagaagaggaaguucauc

SEQ ID NO: 199577 - RNA, 19 nt, Homo sapiens
ucaccguccucuucauuuu

SEQ ID NO: 199578 - RNA, 19 nt, Homo sapiens
agaagaggaaguucaucaa

SEQ ID NO: 199579 - RNA, 19 nt, Homo sapiens
agaagaagaggaaguucau

SEQ ID NO: 199580 - RNA, 19 nt, Homo sapiens
ccggagacaugagaagaag

SEQ ID NO: 199581 - RNA, 19 nt, Homo sapiens
cuucacaguguucaugauu

SEQ ID NO: 199582 - RNA, 19 nt, Homo sapiens
ggacauagacuuugaaaca

SEQ ID NO: 199583 - RNA, 19 nt, Homo sapiens
gaaacaagcgaauuaacua

SEQ ID NO: 199584 - RNA, 19 nt, Homo sapiens
gaacaagucagaacucaga

SEQ ID NO: 199585 - RNA, 19 nt, Homo sapiens
gacuugaccucucuaaauu

SEQ ID NO: 199586 - RNA, 19 nt, Homo sapiens
guacacacaaucucuguua

SEQ ID NO: 199587 - RNA, 19 nt, Homo sapiens
gaacacugccugguacaua

SEQ ID NO: 199588 - RNA, 19 nt, Homo sapiens
ggaggaagaugugugaguu

SEQ ID NO: 199589 - RNA, 19 nt, Homo sapiens
caaaguaaacguuucaaga

SEQ ID NO: 199590 - RNA, 19 nt, Homo sapiens
gcacauaggcccacacaca

SEQ ID NO: 199591 - RNA, 19 nt, Homo sapiens
gcacaucuuuccaccacaa

SEQ ID NO: 199592 - RNA, 19 nt, Homo sapiens
ugucaugaccugaaauuua

SEQ ID NO: 199593 - RNA, 19 nt, Homo sapiens
gaggagcacuguaauaacu

SEQ ID NO: 199594 - RNA, 19 nt, Homo sapiens
gcgccaagcuguacgacaa

SEQ ID NO: 199595 - RNA, 19 nt, Homo sapiens
gaauccaccucuuguuuua

SEQ ID NO: 199596 - RNA, 19 nt, Homo sapiens
uaaagucaccuauucauuc

SEQ ID NO: 199597 - RNA, 19 nt, Homo sapiens
gauauucccuggaucuagu

SEQ ID NO: 199598 - RNA, 19 nt, Homo sapiens
gaagaugugugaguuaagg

SEQ ID NO: 199599 - RNA, 19 nt, Homo sapiens
gauagaacauccucaagac

SEQ ID NO: 199600 - RNA, 19 nt, Homo sapiens
gacauagacuuugaaacaa

SEQ ID NO: 199601 - RNA, 19 nt, Homo sapiens
ugacagaacccugaaggua

SEQ ID NO: 199602 - RNA, 19 nt, Homo sapiens
gucaugaccugaaauuuag

SEQ ID NO: 199603 - RNA, 19 nt, Homo sapiens
gaacuggucuccccucuuc

SEQ ID NO: 199604 - RNA, 19 nt, Homo sapiens
gugaggagcacuguaauaa

SEQ ID NO: 199605 - RNA, 19 nt, Homo sapiens
gguuauuucuccucucuga

SEQ ID NO: 199606 - RNA, 19 nt, Homo sapiens
gccgggagcuggguuugua

SEQ ID NO: 199607 - RNA, 19 nt, Homo sapiens
gaagggaucaacccaggaa

SEQ ID NO: 199608 - RNA, 19 nt, Homo sapiens
guaaacguuucaagaaucu

SEQ ID NO: 199609 - RNA, 19 nt, Homo sapiens
acucauaacugcaacuuca

SEQ ID NO: 199610 - RNA, 19 nt, Homo sapiens
gaggaagaugugugaguua

SEQ ID NO: 199611 - RNA, 19 nt, Homo sapiens
aaagucaccuauucauuca

SEQ ID NO: 199612 - RNA, 19 nt, Homo sapiens
ggacucacaugcacauagg

SEQ ID NO: 199613 - RNA, 19 nt, Homo sapiens
ccaacagccuggccuugaa

SEQ ID NO: 199614 - RNA, 19 nt, Homo sapiens
gaaauucaggagccaguga

SEQ ID NO: 199615 - RNA, 19 nt, Homo sapiens
caacuucacaguauaguag

SEQ ID NO: 199616 - RNA, 19 nt, Homo sapiens
ggaaagguaagcccucaga

SEQ ID NO: 199617 - RNA, 19 nt, Homo sapiens
caagcgaauuaacuaucua

SEQ ID NO: 199618 - RNA, 19 nt, Homo sapiens
agucaccuauucauucaua

SEQ ID NO: 199619 - RNA, 19 nt, Homo sapiens
gagauuaaaugagguucug

SEQ ID NO: 199620 - RNA, 19 nt, Homo sapiens
ugacuugaccucucuaaau

SEQ ID NO: 199621 - RNA, 19 nt, Homo sapiens
guagugaggcauccacaaa

SEQ ID NO: 199622 - RNA, 19 nt, Homo sapiens
ugagcggugugaacaagua

SEQ ID NO: 199623 - RNA, 19 nt, Homo sapiens
gaacucagagggucguugu

SEQ ID NO: 199624 - RNA, 19 nt, Homo sapiens
gcacuguaauaacuaccuu

SEQ ID NO: 199625 - RNA, 19 nt, Homo sapiens
cuuccagccuucguaauua

SEQ ID NO: 199626 - RNA, 19 nt, Homo sapiens
cacaaucucuguuauucau

SEQ ID NO: 199627 - RNA, 19 nt, Homo sapiens
guaagaaaggugagaagug

SEQ ID NO: 199628 - RNA, 19 nt, Homo sapiens
caguuucccugcuguagaa

SEQ ID NO: 199629 - RNA, 19 nt, Homo sapiens
ggaguuuucucuagauauu

SEQ ID NO: 199630 - RNA, 19 nt, Homo sapiens
ggaugcaaggcuauauuaa

SEQ ID NO: 199631 - RNA, 19 nt, Homo sapiens
uucauacucucacuccuua

SEQ ID NO: 199632 - RNA, 19 nt, Homo sapiens
cacacaaucucuguuauuc

SEQ ID NO: 199633 - RNA, 19 nt, Homo sapiens
acaaggcccuggcaacuag

SEQ ID NO: 199634 - RNA, 19 nt, Homo sapiens
ggucaucacuuggcucagu

SEQ ID NO: 199635 - RNA, 19 nt, Homo sapiens
gcaccaacgucugcuacga

SEQ ID NO: 199636 - RNA, 19 nt, Homo sapiens
gggaugagcagaaggacuu

SEQ ID NO: 199637 - RNA, 19 nt, Homo sapiens
aaagguaagcccucagaaa

SEQ ID NO: 199638 - RNA, 19 nt, Homo sapiens
guuaaggccugaacaaagc

SEQ ID NO: 199639 - RNA, 19 nt, Homo sapiens
uggaugcgcugauagaaca

SEQ ID NO: 199640 - RNA, 19 nt, Homo sapiens
gauccagacccaggcaaua

SEQ ID NO: 199641 - RNA, 19 nt, Homo sapiens
ugccuuugguuaaguuaua

SEQ ID NO: 199642 - RNA, 19 nt, Homo sapiens
gcaacuucacaguauagua

SEQ ID NO: 199643 - RNA, 19 nt, Homo sapiens
caucguggacugcuacauu

SEQ ID NO: 199644 - RNA, 19 nt, Homo sapiens
ggaggaauaacaguucuga

SEQ ID NO: 199645 - RNA, 19 nt, Homo sapiens
aggaagaugugugaguuaa

SEQ ID NO: 199646 - RNA, 19 nt, Homo sapiens
gaggaugcaaggcuauauu

SEQ ID NO: 199647 - RNA, 19 nt, Homo sapiens
ggccagacccaaauggaaa

SEQ ID NO: 199648 - RNA, 19 nt, Homo sapiens
ucacugccaucucaacaca

SEQ ID NO: 199649 - RNA, 19 nt, Homo sapiens
gaaagguaagcccucagaa

SEQ ID NO: 199650 - RNA, 19 nt, Homo sapiens
agaaggacuuugacugcaa

SEQ ID NO: 199651 - RNA, 19 nt, Homo sapiens
gcugugucaugaccugaaa

SEQ ID NO: 199652 - RNA, 19 nt, Homo sapiens
ggacugggaggaagaugug

SEQ ID NO: 199653 - RNA, 19 nt, Homo sapiens
cgacaacgcaggcaagaag

SEQ ID NO: 199654 - RNA, 19 nt, Homo sapiens
gcucuguugccuuugguua

SEQ ID NO: 199655 - RNA, 19 nt, Homo sapiens
uacuagcucuguugccuuu

SEQ ID NO: 199656 - RNA, 19 nt, Homo sapiens
ccacaaaguaaacguuuca

SEQ ID NO: 199657 - RNA, 19 nt, Homo sapiens
ugaggcauccacaaaguaa

SEQ ID NO: 199658 - RNA, 19 nt, Homo sapiens
gaccuugagcugguuauuu

SEQ ID NO: 199659 - RNA, 19 nt, Homo sapiens
cauguagucugcacucaag

SEQ ID NO: 199660 - RNA, 19 nt, Homo sapiens
ugauagaacauccucaaga

SEQ ID NO: 199661 - RNA, 19 nt, Homo sapiens
gaguuaaggccugaacaaa

SEQ ID NO: 199662 - RNA, 19 nt, Homo sapiens
gcuuccagccuucguaauu

SEQ ID NO: 199663 - RNA, 19 nt, Homo sapiens
gaacauccucaagacaguu

SEQ ID NO: 199664 - RNA, 19 nt, Homo sapiens
agaaugaaccugacuagag

SEQ ID NO: 199665 - RNA, 19 nt, Homo sapiens
gcacagggagcagggaguu

SEQ ID NO: 199666 - RNA, 19 nt, Homo sapiens
gagggucguugugaguauu

SEQ ID NO: 199667 - RNA, 19 nt, Homo sapiens
gcuuugcaaucguucaaug

SEQ ID NO: 199668 - RNA, 19 nt, Homo sapiens
acacacaaucucuguuauu

SEQ ID NO: 199669 - RNA, 19 nt, Homo sapiens
uaucagccaaagcauauuu

SEQ ID NO: 199670 - RNA, 19 nt, Homo sapiens
gaucauaaggcuccaugca

SEQ ID NO: 199671 - RNA, 19 nt, Homo sapiens
gcagggaguuuucucuaga

SEQ ID NO: 199672 - RNA, 19 nt, Homo sapiens
gcaggaguccagcggagaa

SEQ ID NO: 199673 - RNA, 19 nt, Homo sapiens
gaagguagggaaagguaag

SEQ ID NO: 199674 - RNA, 19 nt, Homo sapiens
cagcagaccuaaggcaucu

SEQ ID NO: 199675 - RNA, 19 nt, Homo sapiens
aggcuucccugaggacaua

SEQ ID NO: 199676 - RNA, 19 nt, Homo sapiens
acaagcgaauuaacuaucu

SEQ ID NO: 199677 - RNA, 19 nt, Homo sapiens
guacauaguaaaugcucaa

SEQ ID NO: 199678 - RNA, 19 nt, Homo sapiens
guaaacacucaauaaaugg

SEQ ID NO: 199679 - RNA, 19 nt, Homo sapiens
ggagcacuguaauaacuac

SEQ ID NO: 199680 - RNA, 19 nt, Homo sapiens
gagcuaagagacaggaaca

SEQ ID NO: 199681 - RNA, 19 nt, Homo sapiens
caaucucuguuauucauac

SEQ ID NO: 199682 - RNA, 19 nt, Homo sapiens
gcagauccaugucccaaua

SEQ ID NO: 199683 - RNA, 19 nt, Homo sapiens
ggacaucgccuuucucuau

SEQ ID NO: 199684 - RNA, 19 nt, Homo sapiens
gaugaguucuucccugugu

SEQ ID NO: 199685 - RNA, 19 nt, Homo sapiens
ggagagcccugaggaguag

SEQ ID NO: 199686 - RNA, 19 nt, Homo sapiens
gagcguguguggagugaug

SEQ ID NO: 199687 - RNA, 19 nt, Homo sapiens
gaacuggaguaucuuugag

SEQ ID NO: 199688 - RNA, 19 nt, Homo sapiens
ggagcuaagccaugaggua

SEQ ID NO: 199689 - RNA, 19 nt, Homo sapiens
gcucuagcaucucucauag

SEQ ID NO: 199690 - RNA, 19 nt, Homo sapiens
caaacaagacgaccuccuu

SEQ ID NO: 199691 - RNA, 19 nt, Homo sapiens
gacaucgccuuucucuaug

SEQ ID NO: 199692 - RNA, 19 nt, Homo sapiens
caaguacuccacagccuuu

SEQ ID NO: 199693 - RNA, 19 nt, Homo sapiens
gcaagagagaggauucaga

SEQ ID NO: 199694 - RNA, 19 nt, Homo sapiens
aaacaagacgaccuccuuu

SEQ ID NO: 199695 - RNA, 19 nt, Homo sapiens
gagaagaggcaccgagaag

SEQ ID NO: 199696 - RNA, 19 nt, Homo sapiens
gcuccaacgucugcuuuga

SEQ ID NO: 199697 - RNA, 19 nt, Homo sapiens
ggagugaugaccacaagga

SEQ ID NO: 199698 - RNA, 19 nt, Homo sapiens
ggaaagcucaagccaugug

SEQ ID NO: 199699 - RNA, 19 nt, Homo sapiens
gagcguggacaucgccuuu

SEQ ID NO: 199700 - RNA, 19 nt, Homo sapiens
cagucauccuccucucuua

SEQ ID NO: 199701 - RNA, 19 nt, Homo sapiens
ggacuucgacugcaauacu

SEQ ID NO: 199702 - RNA, 19 nt, Homo sapiens
ccaauauaguggacugcuu

SEQ ID NO: 199703 - RNA, 19 nt, Homo sapiens
uaccaccucuuccugcaaa

SEQ ID NO: 199704 - RNA, 19 nt, Homo sapiens
ggagaagaggcaccgagaa

SEQ ID NO: 199705 - RNA, 19 nt, Homo sapiens
acaaggacuucgacugcaa

SEQ ID NO: 199706 - RNA, 19 nt, Homo sapiens
gaaauagugagggccaaug

SEQ ID NO: 199707 - RNA, 19 nt, Homo sapiens
agauccaugucccaauaua

SEQ ID NO: 199708 - RNA, 19 nt, Homo sapiens
ugaguggggucaacaagua

SEQ ID NO: 199709 - RNA, 19 nt, Homo sapiens
gggaggcucuagcaucucu

SEQ ID NO: 199710 - RNA, 19 nt, Homo sapiens
ucaucuaccuggugagcaa

SEQ ID NO: 199711 - RNA, 19 nt, Homo sapiens
ucuagcaucucucauaggu

SEQ ID NO: 199712 - RNA, 19 nt, Homo sapiens
cgggugaccucaucuuucu

SEQ ID NO: 199713 - RNA, 19 nt, Homo sapiens
ggcucuagcaucucucaua

SEQ ID NO: 199714 - RNA, 19 nt, Homo sapiens
ugaacuggaguaucuuuga

SEQ ID NO: 199715 - RNA, 19 nt, Homo sapiens
gggcucugguggacauaug

SEQ ID NO: 199716 - RNA, 19 nt, Homo sapiens
accaugaacuggaguaucu

SEQ ID NO: 199717 - RNA, 19 nt, Homo sapiens
ccgagaccaugugaagaaa

SEQ ID NO: 199718 - RNA, 19 nt, Homo sapiens
ucuauguguuccacucauu

SEQ ID NO: 199719 - RNA, 19 nt, Homo sapiens
ggugggcucugguggacau

SEQ ID NO: 199720 - RNA, 19 nt, Homo sapiens
uccaacgucugcuuugaug

SEQ ID NO: 199721 - RNA, 19 nt, Homo sapiens
cgucugcuuugaugaguuc

SEQ ID NO: 199722 - RNA, 19 nt, Homo sapiens
ggaaauagugagggccaau

SEQ ID NO: 199723 - RNA, 19 nt, Homo sapiens
gcagcucgguuuccuuuuc

SEQ ID NO: 199724 - RNA, 19 nt, Homo sapiens
caugaacuggaguaucuuu

SEQ ID NO: 199725 - RNA, 19 nt, Homo sapiens
caacgucugcuuugaugag

SEQ ID NO: 199726 - RNA, 19 nt, Homo sapiens
gugaugaccacaaggacuu

SEQ ID NO: 199727 - RNA, 19 nt, Homo sapiens
auaguggacugcuucaucu

SEQ ID NO: 199728 - RNA, 19 nt, Homo sapiens
gauccaugucccaauauag

SEQ ID NO: 199729 - RNA, 19 nt, Homo sapiens
ggucaagugccacgcagau

SEQ ID NO: 199730 - RNA, 19 nt, Homo sapiens
gcguggacaucgccuuucu

SEQ ID NO: 199731 - RNA, 19 nt, Homo sapiens
cccgagaccaugugaagaa

SEQ ID NO: 199732 - RNA, 19 nt, Homo sapiens
ccucagagaagaacauuuu

SEQ ID NO: 199733 - RNA, 19 nt, Homo sapiens
uauaguggacugcuucauc

SEQ ID NO: 199734 - RNA, 19 nt, Homo sapiens
uccaagcccucagagaaga

SEQ ID NO: 199735 - RNA, 19 nt, Homo sapiens
ucugggcccugcagcuuau

SEQ ID NO: 199736 - RNA, 19 nt, Homo sapiens
cugcagcucgguuuccuuu

SEQ ID NO: 199737 - RNA, 19 nt, Homo sapiens
gcugcuugcugaguccuau

SEQ ID NO: 199738 - RNA, 19 nt, Homo sapiens
aggagagcccugaggagua

SEQ ID NO: 199739 - RNA, 19 nt, Homo sapiens
gcuucuggauaugaaauuc

SEQ ID NO: 199740 - RNA, 19 nt, Homo sapiens
ccacagcugccaucugcau

SEQ ID NO: 199741 - RNA, 19 nt, Homo sapiens
ucuagaauggaaauaguga

SEQ ID NO: 199742 - RNA, 19 nt, Homo sapiens
accgggagguucaggagaa

SEQ ID NO: 199743 - RNA, 19 nt, Homo sapiens
caucgccuuucucuaugug

SEQ ID NO: 199744 - RNA, 19 nt, Homo sapiens
gacuucgacugcaauacuc

SEQ ID NO: 199745 - RNA, 19 nt, Homo sapiens
gaagaaagcugugaugaag

SEQ ID NO: 199746 - RNA, 19 nt, Homo sapiens
gcaauucugucucuuaaug

SEQ ID NO: 199747 - RNA, 19 nt, Homo sapiens
ggaagguucuguagcuaua

SEQ ID NO: 199748 - RNA, 19 nt, Homo sapiens
gagacaaaccaguauauua

SEQ ID NO: 199749 - RNA, 19 nt, Homo sapiens
caaaugugcuuccagauug

SEQ ID NO: 199750 - RNA, 19 nt, Homo sapiens
gaacauacucaaacacuuu

SEQ ID NO: 199751 - RNA, 19 nt, Homo sapiens
gaacaggacccuaaggaaa

SEQ ID NO: 199752 - RNA, 19 nt, Homo sapiens
gcagguagauggaggaaug

SEQ ID NO: 199753 - RNA, 19 nt, Homo sapiens
gccaauaucuggguguuua

SEQ ID NO: 199754 - RNA, 19 nt, Homo sapiens
ucacucaguucaccaauaa

SEQ ID NO: 199755 - RNA, 19 nt, Homo sapiens
ggaagaauucggauccuua

SEQ ID NO: 199756 - RNA, 19 nt, Homo sapiens
gcaaguaggacuaugcuuu

SEQ ID NO: 199757 - RNA, 19 nt, Homo sapiens
ggauguuucuuacuaugua

SEQ ID NO: 199758 - RNA, 19 nt, Homo sapiens
caacauucauucuuuggaa

SEQ ID NO: 199759 - RNA, 19 nt, Homo sapiens
gagacaaucuuggaauuau

SEQ ID NO: 199760 - RNA, 19 nt, Homo sapiens
gaauuccacucagucauuu

SEQ ID NO: 199761 - RNA, 19 nt, Homo sapiens
caaguagaccuguggcuua

SEQ ID NO: 199762 - RNA, 19 nt, Homo sapiens
cagcaauucugucucuuaa

SEQ ID NO: 199763 - RNA, 19 nt, Homo sapiens
gaaagugguauuccauaaa

SEQ ID NO: 199764 - RNA, 19 nt, Homo sapiens
ggaagaaagcugugaugaa

SEQ ID NO: 199765 - RNA, 19 nt, Homo sapiens
cuaaggaaauucuacauuc

SEQ ID NO: 199766 - RNA, 19 nt, Homo sapiens
auaaagaccucagaagaaa

SEQ ID NO: 199767 - RNA, 19 nt, Homo sapiens
ccucuaagauguaggaaga

SEQ ID NO: 199768 - RNA, 19 nt, Homo sapiens
agaaagugguauuccauaa

SEQ ID NO: 199769 - RNA, 19 nt, Homo sapiens
ggaauuccacucagucauu

SEQ ID NO: 199770 - RNA, 19 nt, Homo sapiens
gaaucgagacuguggaauu

SEQ ID NO: 199771 - RNA, 19 nt, Homo sapiens
gggauaaucuguggacuca

SEQ ID NO: 199772 - RNA, 19 nt, Homo sapiens
ggaaugggauaaacaacuc

SEQ ID NO: 199773 - RNA, 19 nt, Homo sapiens
cacaguggcuuacaaacuu

SEQ ID NO: 199774 - RNA, 19 nt, Homo sapiens
ugagaucuauggccuaaug

SEQ ID NO: 199775 - RNA, 19 nt, Homo sapiens
gcagagacaaaccaguaua

SEQ ID NO: 199776 - RNA, 19 nt, Homo sapiens
gcaugacccuccaaguaga

SEQ ID NO: 199777 - RNA, 19 nt, Homo sapiens
uauaaagaccucagaagaa

SEQ ID NO: 199778 - RNA, 19 nt, Homo sapiens
ugaaagaacccagcaauuc

SEQ ID NO: 199779 - RNA, 19 nt, Homo sapiens
aaacuuggacagcucaaua

SEQ ID NO: 199780 - RNA, 19 nt, Homo sapiens
gauaaucuguggacucacu

SEQ ID NO: 199781 - RNA, 19 nt, Homo sapiens
ccacuuagcacuuacuuca

SEQ ID NO: 199782 - RNA, 19 nt, Homo sapiens
guuauucgcuggcuaagag

SEQ ID NO: 199783 - RNA, 19 nt, Homo sapiens
gaucuauggccuaaugaaa

SEQ ID NO: 199784 - RNA, 19 nt, Homo sapiens
aaacaagaguucccaagag

SEQ ID NO: 199785 - RNA, 19 nt, Homo sapiens
gaaaacaugugagaaacuu

SEQ ID NO: 199786 - RNA, 19 nt, Homo sapiens
caucgaacauacucaaaca

SEQ ID NO: 199787 - RNA, 19 nt, Homo sapiens
cauaacauccugcuccauu

SEQ ID NO: 199788 - RNA, 19 nt, Homo sapiens
ggaacaggacccuaaggaa

SEQ ID NO: 199789 - RNA, 19 nt, Homo sapiens
cauuagaagcuguuuguuu

SEQ ID NO: 199790 - RNA, 19 nt, Homo sapiens
agacaggccuuccacuuag

SEQ ID NO: 199791 - RNA, 19 nt, Homo sapiens
aagacaggccuuccacuua

SEQ ID NO: 199792 - RNA, 19 nt, Homo sapiens
ccagcaauucugucucuua

SEQ ID NO: 199793 - RNA, 19 nt, Homo sapiens
agaaagcugugaugaaguc

SEQ ID NO: 199794 - RNA, 19 nt, Homo sapiens
gaaauucuacauucugucu

SEQ ID NO: 199795 - RNA, 19 nt, Homo sapiens
gaauucggauccuuaccau

SEQ ID NO: 199796 - RNA, 19 nt, Homo sapiens
acaacucaaucuccagaaa

SEQ ID NO: 199797 - RNA, 19 nt, Homo sapiens
auuagaagcuguuuguuuc

SEQ ID NO: 199798 - RNA, 19 nt, Homo sapiens
gauuugagucucugcauga

SEQ ID NO: 199799 - RNA, 19 nt, Homo sapiens
uaagauguaggaagaauuc

SEQ ID NO: 199800 - RNA, 19 nt, Homo sapiens
aaagaccucagaagaaauu

SEQ ID NO: 199801 - RNA, 19 nt, Homo sapiens
aacaagaguucccaagaga

SEQ ID NO: 199802 - RNA, 19 nt, Homo sapiens
uggcuuauuuggaguuuga

SEQ ID NO: 199803 - RNA, 19 nt, Homo sapiens
cgaacauacucaaacacuu

SEQ ID NO: 199804 - RNA, 19 nt, Homo sapiens
cagaaagugguauuccaua

SEQ ID NO: 199805 - RNA, 19 nt, Homo sapiens
ggaaugaccagcaacaaaa

SEQ ID NO: 199806 - RNA, 19 nt, Homo sapiens
acaaaugugcuuccagauu

SEQ ID NO: 199807 - RNA, 19 nt, Homo sapiens
ggacuaugcuuuucaacau

SEQ ID NO: 199808 - RNA, 19 nt, Homo sapiens
caagacaggccuuccacuu

SEQ ID NO: 199809 - RNA, 19 nt, Homo sapiens
ggaaagugaaauucguuau

SEQ ID NO: 199810 - RNA, 19 nt, Homo sapiens
uuuccaaacucgagagauu

SEQ ID NO: 199811 - RNA, 19 nt, Homo sapiens
gguuauaugcaccuuauug

SEQ ID NO: 199812 - RNA, 19 nt, Homo sapiens
gguguccacuguacagaug

SEQ ID NO: 199813 - RNA, 19 nt, Homo sapiens
acuauugauucauggcuua

SEQ ID NO: 199814 - RNA, 19 nt, Homo sapiens
gguguggcuugaucuaaga

SEQ ID NO: 199815 - RNA, 19 nt, Homo sapiens
cugcaugacccuccaagua

SEQ ID NO: 199816 - RNA, 19 nt, Homo sapiens
gcagcuacaagcagacauu

SEQ ID NO: 199817 - RNA, 19 nt, Homo sapiens
ggaguucuucugagaucua

SEQ ID NO: 199818 - RNA, 19 nt, Homo sapiens
aaguagaccuguggcuuaa

SEQ ID NO: 199819 - RNA, 19 nt, Homo sapiens
gaggaaagugaaauucguu

SEQ ID NO: 199820 - RNA, 19 nt, Homo sapiens
agagacaaucuuggaauua

SEQ ID NO: 199821 - RNA, 19 nt, Homo sapiens
gacaaaccaguauauuaug

SEQ ID NO: 199822 - RNA, 19 nt, Homo sapiens
uggcagagacaaaccagua

SEQ ID NO: 199823 - RNA, 19 nt, Homo sapiens
uaauacaggccauaagugu

SEQ ID NO: 199824 - RNA, 19 nt, Homo sapiens
guccggaguucuucugaga

SEQ ID NO: 199825 - RNA, 19 nt, Homo sapiens
gaacccagcaauucugucu

SEQ ID NO: 199826 - RNA, 19 nt, Homo sapiens
guauauaccaguagugaag

SEQ ID NO: 199827 - RNA, 19 nt, Homo sapiens
aaucgagacuguggaauuc

SEQ ID NO: 199828 - RNA, 19 nt, Homo sapiens
cuacuucgucccagcauuu

SEQ ID NO: 199829 - RNA, 19 nt, Homo sapiens
ucugagaucuauggccuaa

SEQ ID NO: 199830 - RNA, 19 nt, Homo sapiens
uaagccacuugcugcauga

SEQ ID NO: 199831 - RNA, 19 nt, Homo sapiens
ucaauggguuggguuacaa

SEQ ID NO: 199832 - RNA, 19 nt, Homo sapiens
gaccucagaagaaauugaa

SEQ ID NO: 199833 - RNA, 19 nt, Homo sapiens
uuauaaagaccucagaaga

SEQ ID NO: 199834 - RNA, 19 nt, Homo sapiens
gaaggugugccaauaucug

SEQ ID NO: 199835 - RNA, 19 nt, Homo sapiens
gaagaauucggauccuuac

SEQ ID NO: 199836 - RNA, 19 nt, Homo sapiens
acaggacccuaaggaaauu

SEQ ID NO: 199837 - RNA, 19 nt, Homo sapiens
uauagcuggugcuguuauu

SEQ ID NO: 199838 - RNA, 19 nt, Homo sapiens
gauguaacaaaugcaagua

SEQ ID NO: 199839 - RNA, 19 nt, Homo sapiens
guagaccuguggcuuaaaa

SEQ ID NO: 199840 - RNA, 19 nt, Homo sapiens
guaauacaggccauaagug

SEQ ID NO: 199841 - RNA, 19 nt, Homo sapiens
caggauguuucuuacuaug

SEQ ID NO: 199842 - RNA, 19 nt, Homo sapiens
gccuuccacuuagcacuua

SEQ ID NO: 199843 - RNA, 19 nt, Homo sapiens
guuugaaccucagauuaau

SEQ ID NO: 199844 - RNA, 19 nt, Homo sapiens
gcaacaaaauucuuaugca

SEQ ID NO: 199845 - RNA, 19 nt, Homo sapiens
gagagaagccagcauauua

SEQ ID NO: 199846 - RNA, 19 nt, Homo sapiens
gaacaagacccuaaagaaa

SEQ ID NO: 199847 - RNA, 19 nt, Homo sapiens
ggaauuaacacaagaguuu

SEQ ID NO: 199848 - RNA, 19 nt, Homo sapiens
gaagaaagccguaaugaag

SEQ ID NO: 199849 - RNA, 19 nt, Homo sapiens
ggaagguucuguugcuaua

SEQ ID NO: 199850 - RNA, 19 nt, Homo sapiens
cacaguagcuuacaaacua

SEQ ID NO: 199851 - RNA, 19 nt, Homo sapiens
gcagguagauggaggaaug

SEQ ID NO: 199852 - RNA, 19 nt, Homo sapiens
ucacucaguuuaccaauaa

SEQ ID NO: 199853 - RNA, 19 nt, Homo sapiens
gaaccgagacuguggaauu

SEQ ID NO: 199854 - RNA, 19 nt, Homo sapiens
uggaacagguugcuucuua

SEQ ID NO: 199855 - RNA, 19 nt, Homo sapiens
ugaaagacuugcuaaagaa

SEQ ID NO: 199856 - RNA, 19 nt, Homo sapiens
ccaaaugucuucaguucuu

SEQ ID NO: 199857 - RNA, 19 nt, Homo sapiens
ugaaacaacugcacuagga

SEQ ID NO: 199858 - RNA, 19 nt, Homo sapiens
gcaaguaggacaaugcuuu

SEQ ID NO: 199859 - RNA, 19 nt, Homo sapiens
ggaacaagacccuaaagaa

SEQ ID NO: 199860 - RNA, 19 nt, Homo sapiens
gcagagagaagccagcaua

SEQ ID NO: 199861 - RNA, 19 nt, Homo sapiens
gagacaaucuuggaauuau

SEQ ID NO: 199862 - RNA, 19 nt, Homo sapiens
gaauuccacuucgucauuu

SEQ ID NO: 199863 - RNA, 19 nt, Homo sapiens
ugagaucuauggccuaauu

SEQ ID NO: 199864 - RNA, 19 nt, Homo sapiens
ggaagaaagccguaaugaa

SEQ ID NO: 199865 - RNA, 19 nt, Homo sapiens
acaagacccuaaagaaauu

SEQ ID NO: 199866 - RNA, 19 nt, Homo sapiens
ccaaaaggcuguugaagaa

SEQ ID NO: 199867 - RNA, 19 nt, Homo sapiens
uggcuuaucuggaguuuga

SEQ ID NO: 199868 - RNA, 19 nt, Homo sapiens
ggaauuccacuucgucauu

SEQ ID NO: 199869 - RNA, 19 nt, Homo sapiens
gaacccagacuacuguuga

SEQ ID NO: 199870 - RNA, 19 nt, Homo sapiens
gaaagugaaauucguuaug

SEQ ID NO: 199871 - RNA, 19 nt, Homo sapiens
gaucuaagaacccagacua

SEQ ID NO: 199872 - RNA, 19 nt, Homo sapiens
gaacuucuuauggcuguua

SEQ ID NO: 199873 - RNA, 19 nt, Homo sapiens
gccaauaucuggguguuug

SEQ ID NO: 199874 - RNA, 19 nt, Homo sapiens
gcagagggaguaagcguuu

SEQ ID NO: 199875 - RNA, 19 nt, Homo sapiens
gaaagcauauagcaguucu

SEQ ID NO: 199876 - RNA, 19 nt, Homo sapiens
uugaaagacuugcuaaaga

SEQ ID NO: 199877 - RNA, 19 nt, Homo sapiens
guaaauguguguuuucuga

SEQ ID NO: 199878 - RNA, 19 nt, Homo sapiens
auaaagagcucugugacuu

SEQ ID NO: 199879 - RNA, 19 nt, Homo sapiens
gaacgugugagaaacuuga

SEQ ID NO: 199880 - RNA, 19 nt, Homo sapiens
ucucgggugugccauaaua

SEQ ID NO: 199881 - RNA, 19 nt, Homo sapiens
gaucuauggccuaauuaaa

SEQ ID NO: 199882 - RNA, 19 nt, Homo sapiens
uaaaccacuugcuacauga

SEQ ID NO: 199883 - RNA, 19 nt, Homo sapiens
cuaauuggagcaagauaua

SEQ ID NO: 199884 - RNA, 19 nt, Homo sapiens
caacaacaaaguucuuaug

SEQ ID NO: 199885 - RNA, 19 nt, Homo sapiens
aaacuugacgaacugaaua

SEQ ID NO: 199886 - RNA, 19 nt, Homo sapiens
cauuagaagcuguuuguuu

SEQ ID NO: 199887 - RNA, 19 nt, Homo sapiens
ccuggaaggugugccaaua

SEQ ID NO: 199888 - RNA, 19 nt, Homo sapiens
gaaacuugacgaacugaau

SEQ ID NO: 199889 - RNA, 19 nt, Homo sapiens
gcacuggaagguucuguug

SEQ ID NO: 199890 - RNA, 19 nt, Homo sapiens
caaaguggaauuaacacaa

SEQ ID NO: 199891 - RNA, 19 nt, Homo sapiens
caacuccacucgcuuucug

SEQ ID NO: 199892 - RNA, 19 nt, Homo sapiens
guuggaugcuugacaaugu

SEQ ID NO: 199893 - RNA, 19 nt, Homo sapiens
auaaaccacuugcuacaug

SEQ ID NO: 199894 - RNA, 19 nt, Homo sapiens
ucacaaaguggaauuaaca

SEQ ID NO: 199895 - RNA, 19 nt, Homo sapiens
ggaaugaccaacaacaaag

SEQ ID NO: 199896 - RNA, 19 nt, Homo sapiens
ucuuauggcuguuacuuug

SEQ ID NO: 199897 - RNA, 19 nt, Homo sapiens
gaaauaguaacuucgucaa

SEQ ID NO: 199898 - RNA, 19 nt, Homo sapiens
uugacgaacugaauauuga

SEQ ID NO: 199899 - RNA, 19 nt, Homo sapiens
uaacacaagaguuuccaaa

SEQ ID NO: 199900 - RNA, 19 nt, Homo sapiens
gugagaaacuugacgaacu

SEQ ID NO: 199901 - RNA, 19 nt, Homo sapiens
gagaacgugugagaaacuu

SEQ ID NO: 199902 - RNA, 19 nt, Homo sapiens
uauagugaguagcauggua

SEQ ID NO: 199903 - RNA, 19 nt, Homo sapiens
auuagaagcuguuuguuuc

SEQ ID NO: 199904 - RNA, 19 nt, Homo sapiens
ugagaaacuugacgaacug

SEQ ID NO: 199905 - RNA, 19 nt, Homo sapiens
agacuugugaccugaaaua

SEQ ID NO: 199906 - RNA, 19 nt, Homo sapiens
gaaauucguuaugccacau

SEQ ID NO: 199907 - RNA, 19 nt, Homo sapiens
ggaacagguugcuucuuac

SEQ ID NO: 199908 - RNA, 19 nt, Homo sapiens
gagggaaaccacuguaauc

SEQ ID NO: 199909 - RNA, 19 nt, Homo sapiens
cagaaagugaaauucguua

SEQ ID NO: 199910 - RNA, 19 nt, Homo sapiens
gcuacaagcagauauucuu

SEQ ID NO: 199911 - RNA, 19 nt, Homo sapiens
gcagcuacaagcagauauu

SEQ ID NO: 199912 - RNA, 19 nt, Homo sapiens
gguuauaugcaccuuauug

SEQ ID NO: 199913 - RNA, 19 nt, Homo sapiens
gggauaaagagcucuguga

SEQ ID NO: 199914 - RNA, 19 nt, Homo sapiens
gguguggcuugaucuaaga

SEQ ID NO: 199915 - RNA, 19 nt, Homo sapiens
aaggauggguggaacaaga

SEQ ID NO: 199916 - RNA, 19 nt, Homo sapiens
cuugugaccugaaauaaag

SEQ ID NO: 199917 - RNA, 19 nt, Homo sapiens
gaggaaugaccaacaacaa

SEQ ID NO: 199918 - RNA, 19 nt, Homo sapiens
aaaguggaauuaacacaag

SEQ ID NO: 199919 - RNA, 19 nt, Homo sapiens
uguaaucugggacaaguua

SEQ ID NO: 199920 - RNA, 19 nt, Homo sapiens
gaccacaguagcuuacaaa

SEQ ID NO: 199921 - RNA, 19 nt, Homo sapiens
guuagaagagcacuguaaa

SEQ ID NO: 199922 - RNA, 19 nt, Homo sapiens
caggagacauugaaagacu

SEQ ID NO: 199923 - RNA, 19 nt, Homo sapiens
agagacaaucuuggaauua

SEQ ID NO: 199924 - RNA, 19 nt, Homo sapiens
ccacucagcacuuacuuca

SEQ ID NO: 199925 - RNA, 19 nt, Homo sapiens
uaagaacccagacuacugu

SEQ ID NO: 199926 - RNA, 19 nt, Homo sapiens
gcuaauuggagcaagauau

SEQ ID NO: 199927 - RNA, 19 nt, Homo sapiens
gaaagacuugcuaaagaag

SEQ ID NO: 199928 - RNA, 19 nt, Homo sapiens
gagaucuauggccuaauua

SEQ ID NO: 199929 - RNA, 19 nt, Homo sapiens
ucugagaucuauggccuaa

SEQ ID NO: 199930 - RNA, 19 nt, Homo sapiens
gacgaacugaauauugaua

SEQ ID NO: 199931 - RNA, 19 nt, Homo sapiens
uaucucgggugugccauaa

SEQ ID NO: 199932 - RNA, 19 nt, Homo sapiens
aaagugaaauucguuaugc

SEQ ID NO: 199933 - RNA, 19 nt, Homo sapiens
gcuguuauucguuggcuaa

SEQ ID NO: 199934 - RNA, 19 nt, Homo sapiens
aacaagacccuaaagaaau

SEQ ID NO: 199935 - RNA, 19 nt, Homo sapiens
gaaggugugccaauaucug

SEQ ID NO: 199936 - RNA, 19 nt, Homo sapiens
uccacucgcuuucugguuu

SEQ ID NO: 199937 - RNA, 19 nt, Homo sapiens
agaaagccguaaugaaguc

SEQ ID NO: 199938 - RNA, 19 nt, Homo sapiens
ggccacagaaagugaaauu

SEQ ID NO: 199939 - RNA, 19 nt, Homo sapiens
acaacaaaguucuuaugca

SEQ ID NO: 199940 - RNA, 19 nt, Homo sapiens
ggaggaaugaccaacaaca

SEQ ID NO: 199941 - RNA, 19 nt, Homo sapiens
cacaagaguuuccaaaaga

SEQ ID NO: 199942 - RNA, 19 nt, Homo sapiens
gauguaacaaaugcaagua

SEQ ID NO: 199943 - RNA, 19 nt, Homo sapiens
acucagcacuuacuucagu

SEQ ID NO: 199944 - RNA, 19 nt, Homo sapiens
gacaggaggaguuaaugga

SEQ ID NO: 199945 - RNA, 19 nt, Homo sapiens
uaucauggcugcuccuuua

SEQ ID NO: 199946 - RNA, 19 nt, Homo sapiens
guaaaggaguggccuguaa

SEQ ID NO: 199947 - RNA, 19 nt, Homo sapiens
ggagagaauuguugauguu

SEQ ID NO: 199948 - RNA, 19 nt, Homo sapiens
gaauggacuucaagguuaa

SEQ ID NO: 199949 - RNA, 19 nt, Homo sapiens
gaaugacccagauauguua

SEQ ID NO: 199950 - RNA, 19 nt, Homo sapiens
ccagauauguuagugauug

SEQ ID NO: 199951 - RNA, 19 nt, Homo sapiens
ggaaugacccagauauguu

SEQ ID NO: 199952 - RNA, 19 nt, Homo sapiens
gacugaagcuagggauuua

SEQ ID NO: 199953 - RNA, 19 nt, Homo sapiens
ggaccucgcucuuauacca

SEQ ID NO: 199954 - RNA, 19 nt, Homo sapiens
caucagcccucaagccaaa

SEQ ID NO: 199955 - RNA, 19 nt, Homo sapiens
gaguagaucugcuaaaauu

SEQ ID NO: 199956 - RNA, 19 nt, Homo sapiens
ccagcuagcuaauuauguu

SEQ ID NO: 199957 - RNA, 19 nt, Homo sapiens
ggacugaagcuagggauuu

SEQ ID NO: 199958 - RNA, 19 nt, Homo sapiens
ccucagcgcuuuccucaug

SEQ ID NO: 199959 - RNA, 19 nt, Homo sapiens
cuaauuauguucacagcaa

SEQ ID NO: 199960 - RNA, 19 nt, Homo sapiens
gcagaagcauuguguacuc

SEQ ID NO: 199961 - RNA, 19 nt, Homo sapiens
gaagcuaggguucuaugaa

SEQ ID NO: 199962 - RNA, 19 nt, Homo sapiens
aaaggaagcuaggguucua

SEQ ID NO: 199963 - RNA, 19 nt, Homo sapiens
ggaaucagcaaguaacuca

SEQ ID NO: 199964 - RNA, 19 nt, Homo sapiens
ugcaaucacuggcgaaauu

SEQ ID NO: 199965 - RNA, 19 nt, Homo sapiens
gugaguggccucuuuauau

SEQ ID NO: 199966 - RNA, 19 nt, Homo sapiens
ugaguggccucuuuauaug

SEQ ID NO: 199967 - RNA, 19 nt, Homo sapiens
auacagaaauccgacagua

SEQ ID NO: 199968 - RNA, 19 nt, Homo sapiens
guuagugauuggcaacuuu

SEQ ID NO: 199969 - RNA, 19 nt, Homo sapiens
gaguaccucugcauugaug

SEQ ID NO: 199970 - RNA, 19 nt, Homo sapiens
ggaugcagguuaugaguac

SEQ ID NO: 199971 - RNA, 19 nt, Homo sapiens
ggaaggaugcagguuauga

SEQ ID NO: 199972 - RNA, 19 nt, Homo sapiens
gcuggaaggaugcagguua

SEQ ID NO: 199973 - RNA, 19 nt, Homo sapiens
cuagagcacuggacaaugg

SEQ ID NO: 199974 - RNA, 19 nt, Homo sapiens
gcgcuuuccucaugggauu

SEQ ID NO: 199975 - RNA, 19 nt, Homo sapiens
augcagauguuggaaauaa

SEQ ID NO: 199976 - RNA, 19 nt, Homo sapiens
gaaaauacaaugcagaugu

SEQ ID NO: 199977 - RNA, 19 nt, Homo sapiens
aagcuaggguucuaugaau

SEQ ID NO: 199978 - RNA, 19 nt, Homo sapiens
cgacaguacugcaaucacu

SEQ ID NO: 199979 - RNA, 19 nt, Homo sapiens
gggaguagaucugcuaaaa

SEQ ID NO: 199980 - RNA, 19 nt, Homo sapiens
gcacugggagcgcuucaug

SEQ ID NO: 199981 - RNA, 19 nt, Homo sapiens
gcaaucacuggcgaaauuu

SEQ ID NO: 199982 - RNA, 19 nt, Homo sapiens
guuauaagcacauguccuu

SEQ ID NO: 199983 - RNA, 19 nt, Homo sapiens
ggagauggcagagcucaug

SEQ ID NO: 199984 - RNA, 19 nt, Homo sapiens
cauggcugcuccuuuauuc

SEQ ID NO: 199985 - RNA, 19 nt, Homo sapiens
gggauucgccagcuagcua

SEQ ID NO: 199986 - RNA, 19 nt, Homo sapiens
gcugaggaacccagaacua

SEQ ID NO: 199987 - RNA, 19 nt, Homo sapiens
ugacaaugcagcugaggaa

SEQ ID NO: 199988 - RNA, 19 nt, Homo sapiens
ggcagacccucagcgcuuu

SEQ ID NO: 199989 - RNA, 19 nt, Homo sapiens
gagccagauuccugcauca

SEQ ID NO: 199990 - RNA, 19 nt, Homo sapiens
gagaauuguugauguugcu

SEQ ID NO: 199991 - RNA, 19 nt, Homo sapiens
gcuagggauuuaugcagau

SEQ ID NO: 199992 - RNA, 19 nt, Homo sapiens
ggaagcuaggguucuauga

SEQ ID NO: 199993 - RNA, 19 nt, Homo sapiens
uugcugacauugaugauuc

SEQ ID NO: 199994 - RNA, 19 nt, Homo sapiens
gcaaggguaccagcuuaga

SEQ ID NO: 199995 - RNA, 19 nt, Homo sapiens
cuaaugaccuccgacacau

SEQ ID NO: 199996 - RNA, 19 nt, Homo sapiens
cagcaaaggacugaagcua

SEQ ID NO: 199997 - RNA, 19 nt, Homo sapiens
uucgccagcuagcuaauua

SEQ ID NO: 199998 - RNA, 19 nt, Homo sapiens
gauaaaccggcaggagauu

SEQ ID NO: 199999 - RNA, 19 nt, Homo sapiens
gcuccuuuauucaugucua

SEQ ID NO: 200000 - RNA, 19 nt, Homo sapiens
gagagaauuguugauguug

SEQ ID NO: 200001 - RNA, 19 nt, Homo sapiens
gaaauuuugcugacauuga

SEQ ID NO: 200002 - RNA, 19 nt, Homo sapiens
gcccaauuauacagaaauc

SEQ ID NO: 200003 - RNA, 19 nt, Homo sapiens
uuaugcagauguuggaaau

SEQ ID NO: 200004 - RNA, 19 nt, Homo sapiens
gaaggaugcagguuaugag

SEQ ID NO: 200005 - RNA, 19 nt, Homo sapiens
aauccugccugcuucauca

SEQ ID NO: 200006 - RNA, 19 nt, Homo sapiens
aaagcccaauuauacagaa

SEQ ID NO: 200007 - RNA, 19 nt, Homo sapiens
gcccagaccuuugcugacu

SEQ ID NO: 200008 - RNA, 19 nt, Homo sapiens
gaggaacccagaacuacau

SEQ ID NO: 200009 - RNA, 19 nt, Homo sapiens
uaaaggaguggccuguaau

SEQ ID NO: 200010 - RNA, 19 nt, Homo sapiens
cuggaaggaugcagguuau

SEQ ID NO: 200011 - RNA, 19 nt, Homo sapiens
gguuaagaagucacauaaa

SEQ ID NO: 200012 - RNA, 19 nt, Homo sapiens
gggcuguagcuaugauaaa

SEQ ID NO: 200013 - RNA, 19 nt, Homo sapiens
cgacacaucagcccucaag

SEQ ID NO: 200014 - RNA, 19 nt, Homo sapiens
ggacaucccuggggcuaga

SEQ ID NO: 200015 - RNA, 19 nt, Homo sapiens
gcuaaaauuugaugguugu

SEQ ID NO: 200016 - RNA, 19 nt, Homo sapiens
gaagcuagggauuuaugca

SEQ ID NO: 200017 - RNA, 19 nt, Homo sapiens
ggauucgccagcuagcuaa

SEQ ID NO: 200018 - RNA, 19 nt, Homo sapiens
augaguaccucugcauuga

SEQ ID NO: 200019 - RNA, 19 nt, Homo sapiens
uaagaagucacauaaaucc

SEQ ID NO: 200020 - RNA, 19 nt, Homo sapiens
gguaaaggaguggccugua

SEQ ID NO: 200021 - RNA, 19 nt, Homo sapiens
gguggaccucgcucuuaua

SEQ ID NO: 200022 - RNA, 19 nt, Homo sapiens
gacagggagacaacuuuga

SEQ ID NO: 200023 - RNA, 19 nt, Homo sapiens
uauauguggcccuuucaaa

SEQ ID NO: 200024 - RNA, 19 nt, Homo sapiens
aaauuuggcagaugguuau

SEQ ID NO: 200025 - RNA, 19 nt, Homo sapiens
caaccuugacugccaggaa

SEQ ID NO: 200026 - RNA, 19 nt, Homo sapiens
uaugaguaccucugcauug

SEQ ID NO: 200027 - RNA, 19 nt, Homo sapiens
acagggagacaacuuugaa

SEQ ID NO: 200028 - RNA, 19 nt, Homo sapiens
aggagagaauuguugaugu

SEQ ID NO: 200029 - RNA, 19 nt, Homo sapiens
ugugaguggccucuuuaua

SEQ ID NO: 200030 - RNA, 19 nt, Homo sapiens
gagcacuggacaauggauu

SEQ ID NO: 200031 - RNA, 19 nt, Homo sapiens
ugguggaccucgcucuuau

SEQ ID NO: 200032 - RNA, 19 nt, Homo sapiens
cgaccucucucaggcuuag

SEQ ID NO: 200033 - RNA, 19 nt, Homo sapiens
ugacccagauauguuagug

SEQ ID NO: 200034 - RNA, 19 nt, Homo sapiens
ccugugaguggccucuuua

SEQ ID NO: 200035 - RNA, 19 nt, Homo sapiens
gcagauguuggaaauaaaa

SEQ ID NO: 200036 - RNA, 19 nt, Homo sapiens
uagacagggagacaacuuu

SEQ ID NO: 200037 - RNA, 19 nt, Homo sapiens
agccaaagcucuccuucag

SEQ ID NO: 200038 - RNA, 19 nt, Homo sapiens
gcugcuccuuuauucaugu

SEQ ID NO: 200039 - RNA, 19 nt, Homo sapiens
caggagagaauuguugaug

SEQ ID NO: 200040 - RNA, 19 nt, Homo sapiens
ccucugcauugaugacugu

SEQ ID NO: 200041 - RNA, 19 nt, Homo sapiens
gaugguuguuacugugaca

SEQ ID NO: 200042 - RNA, 19 nt, Homo sapiens
guagaucugcuaaaauuug

SEQ ID NO: 200043 - RNA, 19 nt, Homo sapiens
guucacagcaaaggacuga

SEQ ID NO: 200044 - RNA, 19 nt, Homo sapiens
uaaccaggagagaauuguu

SEQ ID NO: 200045 - RNA, 19 nt, Homo sapiens
gagcucaaguucuuaauua

SEQ ID NO: 200046 - RNA, 19 nt, Homo sapiens
gaagggaacuaauucagaa

SEQ ID NO: 200047 - RNA, 19 nt, Homo sapiens
gggaaccacuuucuuauuu

SEQ ID NO: 200048 - RNA, 19 nt, Homo sapiens
caagaggccuuugaaauug

SEQ ID NO: 200049 - RNA, 19 nt, Homo sapiens
ccaagaggccuuugaaauu

SEQ ID NO: 200050 - RNA, 19 nt, Homo sapiens
caagaaagauggaagaaaa

SEQ ID NO: 200051 - RNA, 19 nt, Homo sapiens
gaucagauuugcaaguaug

SEQ ID NO: 200052 - RNA, 19 nt, Homo sapiens
guauggagcucaaguucuu

SEQ ID NO: 200053 - RNA, 19 nt, Homo sapiens
gacgugaccugaaaguauu

SEQ ID NO: 200054 - RNA, 19 nt, Homo sapiens
ccaaugccauguucaagaa

SEQ ID NO: 200055 - RNA, 19 nt, Homo sapiens
gcauauagauuguccuuuu

SEQ ID NO: 200056 - RNA, 19 nt, Homo sapiens
caacaacgccaauauagau

SEQ ID NO: 200057 - RNA, 19 nt, Homo sapiens
ccaguggucagucaaauua

SEQ ID NO: 200058 - RNA, 19 nt, Homo sapiens
gcaaguaugucucccuaag

SEQ ID NO: 200059 - RNA, 19 nt, Homo sapiens
uugcagaacuggccuauga

SEQ ID NO: 200060 - RNA, 19 nt, Homo sapiens
gccaagaacuacaccaaug

SEQ ID NO: 200061 - RNA, 19 nt, Homo sapiens
ccaacaugcugcucaagaa

SEQ ID NO: 200062 - RNA, 19 nt, Homo sapiens
ccagguagcugcgaggaaa

SEQ ID NO: 200063 - RNA, 19 nt, Homo sapiens
gagauaagcaccuuucaca

SEQ ID NO: 200064 - RNA, 19 nt, Homo sapiens
gcaagucacuaggaucuuc

SEQ ID NO: 200065 - RNA, 19 nt, Homo sapiens
gacaaguacuggagagaau

SEQ ID NO: 200066 - RNA, 19 nt, Homo sapiens
caacuaacagcacgauuga

SEQ ID NO: 200067 - RNA, 19 nt, Homo sapiens
gaggaaggguuugaaagug

SEQ ID NO: 200068 - RNA, 19 nt, Homo sapiens
caaguuaugugcccauucu

SEQ ID NO: 200069 - RNA, 19 nt, Homo sapiens
guacagaaucuaugacaug

SEQ ID NO: 200070 - RNA, 19 nt, Homo sapiens
ccaaauuauucuccuaugu

SEQ ID NO: 200071 - RNA, 19 nt, Homo sapiens
gaacaugaagaaaccuuau

SEQ ID NO: 200072 - RNA, 19 nt, Homo sapiens
guagaggacuaaccaugug

SEQ ID NO: 200073 - RNA, 19 nt, Homo sapiens
gaagaagggaacuaauuca

SEQ ID NO: 200074 - RNA, 19 nt, Homo sapiens
agacugcggugaugaugaa

SEQ ID NO: 200075 - RNA, 19 nt, Homo sapiens
aaagguagaguucuggaua

SEQ ID NO: 200076 - RNA, 19 nt, Homo sapiens
guggagagauacagccaaa

SEQ ID NO: 200077 - RNA, 19 nt, Homo sapiens
ggaaagcugaccaccacua

SEQ ID NO: 200078 - RNA, 19 nt, Homo sapiens
uugaagaacuugugaaugg

SEQ ID NO: 200079 - RNA, 19 nt, Homo sapiens
ugguggagauugacaagua

SEQ ID NO: 200080 - RNA, 19 nt, Homo sapiens
caaguugugccaaauuauu

SEQ ID NO: 200081 - RNA, 19 nt, Homo sapiens
gacaaacugaagcacauua

SEQ ID NO: 200082 - RNA, 19 nt, Homo sapiens
ugaauggcauguacagaau

SEQ ID NO: 200083 - RNA, 19 nt, Homo sapiens
gaaagcugaccaccacuau

SEQ ID NO: 200084 - RNA, 19 nt, Homo sapiens
gaagugaucaacacaacug

SEQ ID NO: 200085 - RNA, 19 nt, Homo sapiens
ccuguggucuuccucgaua

SEQ ID NO: 200086 - RNA, 19 nt, Homo sapiens
gccaauauagaucugcuua

SEQ ID NO: 200087 - RNA, 19 nt, Homo sapiens
caucuuggguucugacauc

SEQ ID NO: 200088 - RNA, 19 nt, Homo sapiens
gccaugaaguagaggacua

SEQ ID NO: 200089 - RNA, 19 nt, Homo sapiens
gauaagcaccuuucacaac

SEQ ID NO: 200090 - RNA, 19 nt, Homo sapiens
cgaagaagggaacuaauuc

SEQ ID NO: 200091 - RNA, 19 nt, Homo sapiens
gaacauggaacagcugcuu

SEQ ID NO: 200092 - RNA, 19 nt, Homo sapiens
uugcauggauuucuuugaa

SEQ ID NO: 200093 - RNA, 19 nt, Homo sapiens
gguagcagcacgucucuug

SEQ ID NO: 200094 - RNA, 19 nt, Homo sapiens
ccagaagaaugcaggaaag

SEQ ID NO: 200095 - RNA, 19 nt, Homo sapiens
gcauguacagaaucuauga

SEQ ID NO: 200096 - RNA, 19 nt, Homo sapiens
gugaauggcauguacagaa

SEQ ID NO: 200097 - RNA, 19 nt, Homo sapiens
gaaugugguacugcucuua

SEQ ID NO: 200098 - RNA, 19 nt, Homo sapiens
uaaggacuguggccgaaug

SEQ ID NO: 200099 - RNA, 19 nt, Homo sapiens
ccaacuaacagcacgauug

SEQ ID NO: 200100 - RNA, 19 nt, Homo sapiens
caacaugcugcucaagaaa

SEQ ID NO: 200101 - RNA, 19 nt, Homo sapiens
aagguagaguucuggauaa

SEQ ID NO: 200102 - RNA, 19 nt, Homo sapiens
aaaaguugcucauguagaa

SEQ ID NO: 200103 - RNA, 19 nt, Homo sapiens
ggaggaagauacauuuuag

SEQ ID NO: 200104 - RNA, 19 nt, Homo sapiens
gaugaggaaggguuugaaa

SEQ ID NO: 200105 - RNA, 19 nt, Homo sapiens
ccgaagaagggaacuaauu

SEQ ID NO: 200106 - RNA, 19 nt, Homo sapiens
guacuggagagaauacauu

SEQ ID NO: 200107 - RNA, 19 nt, Homo sapiens
gccgaaugcucaccagaau

SEQ ID NO: 200108 - RNA, 19 nt, Homo sapiens
gagcaagacgugaccugaa

SEQ ID NO: 200109 - RNA, 19 nt, Homo sapiens
ggagcucaaguucuuaauu

SEQ ID NO: 200110 - RNA, 19 nt, Homo sapiens
aggaucagauuugcaagua

SEQ ID NO: 200111 - RNA, 19 nt, Homo sapiens
ggaaccacuuucuuauuuu

SEQ ID NO: 200112 - RNA, 19 nt, Homo sapiens
gcccaaagguagaguucug

SEQ ID NO: 200113 - RNA, 19 nt, Homo sapiens
ggaucagauuugcaaguau

SEQ ID NO: 200114 - RNA, 19 nt, Homo sapiens
cuacaccaaugccauguuc

SEQ ID NO: 200115 - RNA, 19 nt, Homo sapiens
ugaugaagaugagugcauu

SEQ ID NO: 200116 - RNA, 19 nt, Homo sapiens
ucucaacaacgccaauaua

SEQ ID NO: 200117 - RNA, 19 nt, Homo sapiens
cgaaugcucaccagaaugu

SEQ ID NO: 200118 - RNA, 19 nt, Homo sapiens
uccaguauguccagaagaa

SEQ ID NO: 200119 - RNA, 19 nt, Homo sapiens
agacgugaccugaaaguau

SEQ ID NO: 200120 - RNA, 19 nt, Homo sapiens
caccacuauuggcaaguua

SEQ ID NO: 200121 - RNA, 19 nt, Homo sapiens
gaaucuaugacauggagaa

SEQ ID NO: 200122 - RNA, 19 nt, Homo sapiens
agcaagacgugaccugaaa

SEQ ID NO: 200123 - RNA, 19 nt, Homo sapiens
aucaaguugugccaaauua

SEQ ID NO: 200124 - RNA, 19 nt, Homo sapiens
aagaacucguggagagaua

SEQ ID NO: 200125 - RNA, 19 nt, Homo sapiens
cagcuucuauagugcuuug

SEQ ID NO: 200126 - RNA, 19 nt, Homo sapiens
aagcugaccaccacuauug

SEQ ID NO: 200127 - RNA, 19 nt, Homo sapiens
caggugugguggagauuga

SEQ ID NO: 200128 - RNA, 19 nt, Homo sapiens
gccaaauuauucuccuaug

SEQ ID NO: 200129 - RNA, 19 nt, Homo sapiens
ccaccacuauuggcaaguu

SEQ ID NO: 200130 - RNA, 19 nt, Homo sapiens
ucaagugggugccagaaac

SEQ ID NO: 200131 - RNA, 19 nt, Homo sapiens
ugacccagguuuccaaguc

SEQ ID NO: 200132 - RNA, 19 nt, Homo sapiens
ggacgccaccugucaccaa

SEQ ID NO: 200133 - RNA, 19 nt, Homo sapiens
gaaacucccgugccaggau

SEQ ID NO: 200134 - RNA, 19 nt, Homo sapiens
gcucaagaaagauggaaga

SEQ ID NO: 200135 - RNA, 19 nt, Homo sapiens
gcucugaaucuuggaauug

SEQ ID NO: 200136 - RNA, 19 nt, Homo sapiens
gacccagguuuccaaguca

SEQ ID NO: 200137 - RNA, 19 nt, Homo sapiens
caucaaguugugccaaauu

SEQ ID NO: 200138 - RNA, 19 nt, Homo sapiens
agcaaggaauggaaugaaa

SEQ ID NO: 200139 - RNA, 19 nt, Homo sapiens
uucaucagcuucuauagug

SEQ ID NO: 200140 - RNA, 19 nt, Homo sapiens
ucaacaacgccaauauaga

SEQ ID NO: 200141 - RNA, 19 nt, Homo sapiens
ccaugauucuauccaguau

SEQ ID NO: 200142 - RNA, 19 nt, Homo sapiens
cugaaaguauuugggaauu

SEQ ID NO: 200143 - RNA, 19 nt, Homo sapiens
gcggugaugaugaagauga

SEQ ID NO: 200144 - RNA, 19 nt, Homo sapiens
gcagaacuggccuaugauc

SEQ ID NO: 200145 - RNA, 19 nt, Homo sapiens
ggacaacacuuccucaaga

SEQ ID NO: 200146 - RNA, 19 nt, Homo sapiens
gaagaaucauguuaccuuu

SEQ ID NO: 200147 - RNA, 19 nt, Homo sapiens
gugcauauaucaacgauuu

SEQ ID NO: 200148 - RNA, 19 nt, Homo sapiens
gaugaagccucuccucuau

SEQ ID NO: 200149 - RNA, 19 nt, Homo sapiens
gaauuuaggaugugcauuu

SEQ ID NO: 200150 - RNA, 19 nt, Homo sapiens
guuauuggcucaucuguga

SEQ ID NO: 200151 - RNA, 19 nt, Homo sapiens
gaaacaaugugaucacucu

SEQ ID NO: 200152 - RNA, 19 nt, Homo sapiens
caaccucacuccacaauca

SEQ ID NO: 200153 - RNA, 19 nt, Homo sapiens
gaaacaucauccagaaguu

SEQ ID NO: 200154 - RNA, 19 nt, Homo sapiens
gaauggagggccaguuaua

SEQ ID NO: 200155 - RNA, 19 nt, Homo sapiens
acaguaacgugcauacaua

SEQ ID NO: 200156 - RNA, 19 nt, Homo sapiens
gaccauguaugaugaugaa

SEQ ID NO: 200157 - RNA, 19 nt, Homo sapiens
gaauauggcagcuacuuug

SEQ ID NO: 200158 - RNA, 19 nt, Homo sapiens
ggaagaaucauguuaccuu

SEQ ID NO: 200159 - RNA, 19 nt, Homo sapiens
gaaaaggaauuuaggaugu

SEQ ID NO: 200160 - RNA, 19 nt, Homo sapiens
gagcugggacugcugguua

SEQ ID NO: 200161 - RNA, 19 nt, Homo sapiens
gaagauggcugggcugaac

SEQ ID NO: 200162 - RNA, 19 nt, Homo sapiens
cagaggauguuugaaauug

SEQ ID NO: 200163 - RNA, 19 nt, Homo sapiens
cuuuaucccuugacauuua

SEQ ID NO: 200164 - RNA, 19 nt, Homo sapiens
gggcgagugugaacuugua

SEQ ID NO: 200165 - RNA, 19 nt, Homo sapiens
gcagcuacuuugccuguga

SEQ ID NO: 200166 - RNA, 19 nt, Homo sapiens
gggcuggaauggaagcuuu

SEQ ID NO: 200167 - RNA, 19 nt, Homo sapiens
gaugaugugguucuguuua

SEQ ID NO: 200168 - RNA, 19 nt, Homo sapiens
cagaauggagggccaguua

SEQ ID NO: 200169 - RNA, 19 nt, Homo sapiens
gggaugaugugguucuguu

SEQ ID NO: 200170 - RNA, 19 nt, Homo sapiens
ggaccaugauguggaauau

SEQ ID NO: 200171 - RNA, 19 nt, Homo sapiens
ugaagccucuccucuauca

SEQ ID NO: 200172 - RNA, 19 nt, Homo sapiens
gcuggaccauguaugauga

SEQ ID NO: 200173 - RNA, 19 nt, Homo sapiens
accaugauguggaauauuu

SEQ ID NO: 200174 - RNA, 19 nt, Homo sapiens
gcucaucugugaccuacga

SEQ ID NO: 200175 - RNA, 19 nt, Homo sapiens
cagcagugaugauccagaa

SEQ ID NO: 200176 - RNA, 19 nt, Homo sapiens
uuaaggguuugguuucuaa

SEQ ID NO: 200177 - RNA, 19 nt, Homo sapiens
caacacuuccucaagauug

SEQ ID NO: 200178 - RNA, 19 nt, Homo sapiens
ugugaucacucugaacaua

SEQ ID NO: 200179 - RNA, 19 nt, Homo sapiens
agacguaugugcccuggaa

SEQ ID NO: 200180 - RNA, 19 nt, Homo sapiens
cugcagggcuggaauggaa

SEQ ID NO: 200181 - RNA, 19 nt, Homo sapiens
ccagaacuaugugcuguga

SEQ ID NO: 200182 - RNA, 19 nt, Homo sapiens
gaacauaacagggaaagcu

SEQ ID NO: 200183 - RNA, 19 nt, Homo sapiens
cagcacagcccaccagcua

SEQ ID NO: 200184 - RNA, 19 nt, Homo sapiens
ggaaggaccggcugcugaa

SEQ ID NO: 200185 - RNA, 19 nt, Homo sapiens
gacaacacuuccucaagau

SEQ ID NO: 200186 - RNA, 19 nt, Homo sapiens
gacccuugaucaauucuga

SEQ ID NO: 200187 - RNA, 19 nt, Homo sapiens
ggaacaggcagcaacauca

SEQ ID NO: 200188 - RNA, 19 nt, Homo sapiens
gaauggaagcuuuaaaggu

SEQ ID NO: 200189 - RNA, 19 nt, Homo sapiens
gaacaugggacgugugaac

SEQ ID NO: 200190 - RNA, 19 nt, Homo sapiens
gagaacaugggacguguga

SEQ ID NO: 200191 - RNA, 19 nt, Homo sapiens
ugaacgccauccagacgua

SEQ ID NO: 200192 - RNA, 19 nt, Homo sapiens
gggaccaccuggaaugugu

SEQ ID NO: 200193 - RNA, 19 nt, Homo sapiens
ugacauuuauccaggugaa

SEQ ID NO: 200194 - RNA, 19 nt, Homo sapiens
gguccuaucccuccaucua

SEQ ID NO: 200195 - RNA, 19 nt, Homo sapiens
gaggaagugugagcccaaa

SEQ ID NO: 200196 - RNA, 19 nt, Homo sapiens
cugcuuggcugcuagagaa

SEQ ID NO: 200197 - RNA, 19 nt, Homo sapiens
ggucuggauuaauggcuuu

SEQ ID NO: 200198 - RNA, 19 nt, Homo sapiens
gugaacuuguacauguuua

SEQ ID NO: 200199 - RNA, 19 nt, Homo sapiens
ccacugauggagcacauaa

SEQ ID NO: 200200 - RNA, 19 nt, Homo sapiens
uauacuggcuggcuagauc

SEQ ID NO: 200201 - RNA, 19 nt, Homo sapiens
ugaggaccaugauguggaa

SEQ ID NO: 200202 - RNA, 19 nt, Homo sapiens
agugugaacuuguacaugu

SEQ ID NO: 200203 - RNA, 19 nt, Homo sapiens
acaaugugaucacucugaa

SEQ ID NO: 200204 - RNA, 19 nt, Homo sapiens
cgaaacaucauccagaagu

SEQ ID NO: 200205 - RNA, 19 nt, Homo sapiens
agaggauguuugaaauuga

SEQ ID NO: 200206 - RNA, 19 nt, Homo sapiens
uaacgugcauacauaucug

SEQ ID NO: 200207 - RNA, 19 nt, Homo sapiens
gcccucaguugaccuuguu

SEQ ID NO: 200208 - RNA, 19 nt, Homo sapiens
cuacaucucaggaagcauu

SEQ ID NO: 200209 - RNA, 19 nt, Homo sapiens
gaagugugagcccaaagga

SEQ ID NO: 200210 - RNA, 19 nt, Homo sapiens
cagugaugauccagaacua

SEQ ID NO: 200211 - RNA, 19 nt, Homo sapiens
ccagaggauguuugaaauu

SEQ ID NO: 200212 - RNA, 19 nt, Homo sapiens
ggaauggaagcuuuaaagg

SEQ ID NO: 200213 - RNA, 19 nt, Homo sapiens
caugggacgugugaacuau

SEQ ID NO: 200214 - RNA, 19 nt, Homo sapiens
gagccacucuggaccuucu

SEQ ID NO: 200215 - RNA, 19 nt, Homo sapiens
gcaaugccacccagaggau

SEQ ID NO: 200216 - RNA, 19 nt, Homo sapiens
gacaguggccaccaugaug

SEQ ID NO: 200217 - RNA, 19 nt, Homo sapiens
cccagaggauguuugaaau

SEQ ID NO: 200218 - RNA, 19 nt, Homo sapiens
gccuuuaucccuugacauu

SEQ ID NO: 200219 - RNA, 19 nt, Homo sapiens
ugaauauggcagcuacuuu

SEQ ID NO: 200220 - RNA, 19 nt, Homo sapiens
gccaggacaguaccaguuu

SEQ ID NO: 200221 - RNA, 19 nt, Homo sapiens
uaaaggugguagugauuuu

SEQ ID NO: 200222 - RNA, 19 nt, Homo sapiens
acauuucacugauuggaau

SEQ ID NO: 200223 - RNA, 19 nt, Homo sapiens
uaugugcccuggaacuuuc

SEQ ID NO: 200224 - RNA, 19 nt, Homo sapiens
ugcgaaacaucauccagaa

SEQ ID NO: 200225 - RNA, 19 nt, Homo sapiens
uuauaacagugcagguuga

SEQ ID NO: 200226 - RNA, 19 nt, Homo sapiens
cuacgaucaucccuccaaa

SEQ ID NO: 200227 - RNA, 19 nt, Homo sapiens
gugaucacucugaacauaa

SEQ ID NO: 200228 - RNA, 19 nt, Homo sapiens
gaccggcugcugaagauga

SEQ ID NO: 200229 - RNA, 19 nt, Homo sapiens
cuuccucccucuaugauau

SEQ ID NO: 200230 - RNA, 19 nt, Homo sapiens
ucacagaugcuuuccuaag

SEQ ID NO: 200231 - RNA, 19 nt, Homo sapiens
gaggauguuugaaauugac

SEQ ID NO: 200232 - RNA, 19 nt, Homo sapiens
ggaaaugggaggauuaccu

SEQ ID NO: 200233 - RNA, 19 nt, Homo sapiens
guaugugcccuggaacuuu

SEQ ID NO: 200234 - RNA, 19 nt, Homo sapiens
gagggccaguuauaacagu

SEQ ID NO: 200235 - RNA, 19 nt, Homo sapiens
agaugaagccucuccucua

SEQ ID NO: 200236 - RNA, 19 nt, Homo sapiens
uggcagcuguggacaagug

SEQ ID NO: 200237 - RNA, 19 nt, Homo sapiens
gcuccuccgacccagauua

SEQ ID NO: 200238 - RNA, 19 nt, Homo sapiens
caggaagcauucacuacuc

SEQ ID NO: 200239 - RNA, 19 nt, Homo sapiens
ggaccauguaugaugauga

SEQ ID NO: 200240 - RNA, 19 nt, Homo sapiens
gagcgaaacaaugugauca

SEQ ID NO: 200241 - RNA, 19 nt, Homo sapiens
gugggaaaugggaggauua

SEQ ID NO: 200242 - RNA, 19 nt, Homo sapiens
ccacccagaggauguuuga

SEQ ID NO: 200243 - RNA, 19 nt, Homo sapiens
gcgaaacaaugugaucacu

SEQ ID NO: 200244 - RNA, 19 nt, Homo sapiens
guaacgugcauacauaucu

SEQ ID NO: 200245 - RNA, 19 nt, Homo sapiens
ggaggcuacuucuauauua

SEQ ID NO: 200246 - RNA, 19 nt, Homo sapiens
guagguaaaucuagaguuu

SEQ ID NO: 200247 - RNA, 19 nt, Homo sapiens
ugauagaacuguacuguuu

SEQ ID NO: 200248 - RNA, 19 nt, Homo sapiens
gagagcaucuggagaacua

SEQ ID NO: 200249 - RNA, 19 nt, Homo sapiens
gaagagagcaucuggagaa

SEQ ID NO: 200250 - RNA, 19 nt, Homo sapiens
ccagauaccuuuaugauca

SEQ ID NO: 200251 - RNA, 19 nt, Homo sapiens
gaaagugcuucaaggguaa

SEQ ID NO: 200252 - RNA, 19 nt, Homo sapiens
ggacugaucccaauucuga

SEQ ID NO: 200253 - RNA, 19 nt, Homo sapiens
gcuacuaucuguccaauug

SEQ ID NO: 200254 - RNA, 19 nt, Homo sapiens
ggagcaaccuacugucuaa

SEQ ID NO: 200255 - RNA, 19 nt, Homo sapiens
ugaacuggcuuguacauuu

SEQ ID NO: 200256 - RNA, 19 nt, Homo sapiens
gcauguugcucaucucuuu

SEQ ID NO: 200257 - RNA, 19 nt, Homo sapiens
guaaccaaauugcaaauga

SEQ ID NO: 200258 - RNA, 19 nt, Homo sapiens
ggaaagauauuugcaaagg

SEQ ID NO: 200259 - RNA, 19 nt, Homo sapiens
gaauacaccaucuccauuu

SEQ ID NO: 200260 - RNA, 19 nt, Homo sapiens
ucacuugaauccauugaaa

SEQ ID NO: 200261 - RNA, 19 nt, Homo sapiens
uuacuuggaucagcauuua

SEQ ID NO: 200262 - RNA, 19 nt, Homo sapiens
caggaaagauauuugcaaa

SEQ ID NO: 200263 - RNA, 19 nt, Homo sapiens
ugucaucaauguaccaaua

SEQ ID NO: 200264 - RNA, 19 nt, Homo sapiens
ccugggaccugauuuauug

SEQ ID NO: 200265 - RNA, 19 nt, Homo sapiens
caagaaauauccgacauag

SEQ ID NO: 200266 - RNA, 19 nt, Homo sapiens
uaacuucauuucccagauu

SEQ ID NO: 200267 - RNA, 19 nt, Homo sapiens
ucuagcaccuuaucuauga

SEQ ID NO: 200268 - RNA, 19 nt, Homo sapiens
gaagaacaauaacuauagg

SEQ ID NO: 200269 - RNA, 19 nt, Homo sapiens
gaggaacaauguccgaguu

SEQ ID NO: 200270 - RNA, 19 nt, Homo sapiens
gcgaugagguggaauacau

SEQ ID NO: 200271 - RNA, 19 nt, Homo sapiens
gauuaaggcuuucuuuggu

SEQ ID NO: 200272 - RNA, 19 nt, Homo sapiens
auaaagagaucuacgaaca

SEQ ID NO: 200273 - RNA, 19 nt, Homo sapiens
ggacaagaauacaccaucu

SEQ ID NO: 200274 - RNA, 19 nt, Homo sapiens
agaaauauccgacauagga

SEQ ID NO: 200275 - RNA, 19 nt, Homo sapiens
gacaccagauguaguauuc

SEQ ID NO: 200276 - RNA, 19 nt, Homo sapiens
gacgauagauaaagagauc

SEQ ID NO: 200277 - RNA, 19 nt, Homo sapiens
gaacuggcuuguacauuuu

SEQ ID NO: 200278 - RNA, 19 nt, Homo sapiens
ucccaauucugaacucuua

SEQ ID NO: 200279 - RNA, 19 nt, Homo sapiens
uaacagacuuugagaacuc

SEQ ID NO: 200280 - RNA, 19 nt, Homo sapiens
ggacagcccuacggaggaa

SEQ ID NO: 200281 - RNA, 19 nt, Homo sapiens
guaaauguacugguaauug

SEQ ID NO: 200282 - RNA, 19 nt, Homo sapiens
gaaagauauuugcaaaggu

SEQ ID NO: 200283 - RNA, 19 nt, Homo sapiens
ccagagugauccuuuccua

SEQ ID NO: 200284 - RNA, 19 nt, Homo sapiens
gacauuggauggagaguag

SEQ ID NO: 200285 - RNA, 19 nt, Homo sapiens
gagaaaagguugucaucaa

SEQ ID NO: 200286 - RNA, 19 nt, Homo sapiens
ccagugagccagaaauuga

SEQ ID NO: 200287 - RNA, 19 nt, Homo sapiens
gcacaaggacguucucaag

SEQ ID NO: 200288 - RNA, 19 nt, Homo sapiens
caccuuaucuaugauguuu

SEQ ID NO: 200289 - RNA, 19 nt, Homo sapiens
ugagggaguuuaucgcaaa

SEQ ID NO: 200290 - RNA, 19 nt, Homo sapiens
cgauaugacucaauagaca

SEQ ID NO: 200291 - RNA, 19 nt, Homo sapiens
uacaccaucuccauuuaua

SEQ ID NO: 200292 - RNA, 19 nt, Homo sapiens
aauacaccaucuccauuua

SEQ ID NO: 200293 - RNA, 19 nt, Homo sapiens
gcaauuggaauaaucacuu

SEQ ID NO: 200294 - RNA, 19 nt, Homo sapiens
ggugagaaauauaaugaca

SEQ ID NO: 200295 - RNA, 19 nt, Homo sapiens
guaugggaguuacaugauu

SEQ ID NO: 200296 - RNA, 19 nt, Homo sapiens
ugagaacucugccuaugug

SEQ ID NO: 200297 - RNA, 19 nt, Homo sapiens
gcaauuaacagacuuugag

SEQ ID NO: 200298 - RNA, 19 nt, Homo sapiens
acaaggacguucucaagug

SEQ ID NO: 200299 - RNA, 19 nt, Homo sapiens
gaauaaauacccauugaac

SEQ ID NO: 200300 - RNA, 19 nt, Homo sapiens
caauuggaauaaucacuug

SEQ ID NO: 200301 - RNA, 19 nt, Homo sapiens
gagcauagacaccaucauc

SEQ ID NO: 200302 - RNA, 19 nt, Homo sapiens
cugaauaaauacccauuga

SEQ ID NO: 200303 - RNA, 19 nt, Homo sapiens
guacaauacuugcauucca

SEQ ID NO: 200304 - RNA, 19 nt, Homo sapiens
ucaguuggcuacuaucugu

SEQ ID NO: 200305 - RNA, 19 nt, Homo sapiens
gaccagaguaugggaguua

SEQ ID NO: 200306 - RNA, 19 nt, Homo sapiens
gcccguguguauaauauga

SEQ ID NO: 200307 - RNA, 19 nt, Homo sapiens
gauccuuuccuacaaauug

SEQ ID NO: 200308 - RNA, 19 nt, Homo sapiens
uggcagacaaugagauuua

SEQ ID NO: 200309 - RNA, 19 nt, Homo sapiens
uaaguguggugagaaauau

SEQ ID NO: 200310 - RNA, 19 nt, Homo sapiens
ggacuggagccauugaaga

SEQ ID NO: 200311 - RNA, 19 nt, Homo sapiens
caaaccauccugacuacaa

SEQ ID NO: 200312 - RNA, 19 nt, Homo sapiens
gaucagcauuuaggaaagu

SEQ ID NO: 200313 - RNA, 19 nt, Homo sapiens
ccagauggaugagggaguu

SEQ ID NO: 200314 - RNA, 19 nt, Homo sapiens
ugaacuaccuaaagcuaau

SEQ ID NO: 200315 - RNA, 19 nt, Homo sapiens
ucugaacucuuaccuugaa

SEQ ID NO: 200316 - RNA, 19 nt, Homo sapiens
gcauagacaccaucaucaa

SEQ ID NO: 200317 - RNA, 19 nt, Homo sapiens
ggcagacaaugagauuuaa

SEQ ID NO: 200318 - RNA, 19 nt, Homo sapiens
cgacauaggagaggagaaa

SEQ ID NO: 200319 - RNA, 19 nt, Homo sapiens
cuaaguguggugagaaaua

SEQ ID NO: 200320 - RNA, 19 nt, Homo sapiens
uucaguaccuuaacaagaa

SEQ ID NO: 200321 - RNA, 19 nt, Homo sapiens
gauguggacaccagaugua

SEQ ID NO: 200322 - RNA, 19 nt, Homo sapiens
gaggcuacuucuauauuag

SEQ ID NO: 200323 - RNA, 19 nt, Homo sapiens
ccgcugagcugggaggaaa

SEQ ID NO: 200324 - RNA, 19 nt, Homo sapiens
gagugauccuuuccuacaa

SEQ ID NO: 200325 - RNA, 19 nt, Homo sapiens
gacacuguuugaagagaaa

SEQ ID NO: 200326 - RNA, 19 nt, Homo sapiens
gauuuggaaugggcaauug

SEQ ID NO: 200327 - RNA, 19 nt, Homo sapiens
cuaagccggaucauauuua

SEQ ID NO: 200328 - RNA, 19 nt, Homo sapiens
aaacauuuacugaggauga

SEQ ID NO: 200329 - RNA, 19 nt, Homo sapiens
caucaucaaugggaaggaa

SEQ ID NO: 200330 - RNA, 19 nt, Homo sapiens
uaugggaguuacaugauug

SEQ ID NO: 200331 - RNA, 19 nt, Homo sapiens
cuucuaagccggaucauau

SEQ ID NO: 200332 - RNA, 19 nt, Homo sapiens
ccaucuccauuuauagaaa

SEQ ID NO: 200333 - RNA, 19 nt, Homo sapiens
gggaccugauuuauugaaa

SEQ ID NO: 200334 - RNA, 19 nt, Homo sapiens
ucucagcccguguguauaa

SEQ ID NO: 200335 - RNA, 19 nt, Homo sapiens
ggacaccagauguaguauu

SEQ ID NO: 200336 - RNA, 19 nt, Homo sapiens
agacagcuauuuaucuaag

SEQ ID NO: 200337 - RNA, 19 nt, Homo sapiens
gaguaugggaguuacauga

SEQ ID NO: 200338 - RNA, 19 nt, Homo sapiens
gggaaaggacaaacccaaa

SEQ ID NO: 200339 - RNA, 19 nt, Homo sapiens
gcaaccuacugucuaagca

SEQ ID NO: 200340 - RNA, 19 nt, Homo sapiens
uaaugacaguugccagaug

SEQ ID NO: 200341 - RNA, 19 nt, Homo sapiens
guggacaccagauguagua

SEQ ID NO: 200342 - RNA, 19 nt, Homo sapiens
ccuccaaacucagacauug

SEQ ID NO: 200343 - RNA, 19 nt, Homo sapiens
ggaugaugcuaaugagucu

SEQ ID NO: 200344 - RNA, 19 nt, Homo sapiens
ugacacuguuugaagagaa

SEQ ID NO: 200345 - RNA, 19 nt, Homo sapiens
gcgaggagcuucaugauug

SEQ ID NO: 200346 - RNA, 19 nt, Homo sapiens
gauaaauccugaugaaaga

SEQ ID NO: 200347 - RNA, 19 nt, Homo sapiens
gaugagauauaucagagua

SEQ ID NO: 200348 - RNA, 19 nt, Homo sapiens
gaauggaguucccaaauca

SEQ ID NO: 200349 - RNA, 19 nt, Homo sapiens
uagcugggauuuacuagua

SEQ ID NO: 200350 - RNA, 19 nt, Homo sapiens
cagauauucuuucgucaua

SEQ ID NO: 200351 - RNA, 19 nt, Homo sapiens
guucuuaacugacuuagga

SEQ ID NO: 200352 - RNA, 19 nt, Homo sapiens
guagaggaauuaucaaauc

SEQ ID NO: 200353 - RNA, 19 nt, Homo sapiens
uauguugucugucaaguuu

SEQ ID NO: 200354 - RNA, 19 nt, Homo sapiens
gaagcaaguuuccaagaag

SEQ ID NO: 200355 - RNA, 19 nt, Homo sapiens
gaguuaaucuuuccuugga

SEQ ID NO: 200356 - RNA, 19 nt, Homo sapiens
gaaucaaacucuucaucau

SEQ ID NO: 200357 - RNA, 19 nt, Homo sapiens
ugaagcaaguuuccaagaa

SEQ ID NO: 200358 - RNA, 19 nt, Homo sapiens
aaacugaaauacuggaaga

SEQ ID NO: 200359 - RNA, 19 nt, Homo sapiens
gguauucggucauugugaa

SEQ ID NO: 200360 - RNA, 19 nt, Homo sapiens
ccuguaauuuccuucaaua

SEQ ID NO: 200361 - RNA, 19 nt, Homo sapiens
gaaccucuguauugcuuuc

SEQ ID NO: 200362 - RNA, 19 nt, Homo sapiens
acauacagcuguugacuca

SEQ ID NO: 200363 - RNA, 19 nt, Homo sapiens
gaaauacuggaagaagaua

SEQ ID NO: 200364 - RNA, 19 nt, Homo sapiens
gcaaaacuguucauuguag

SEQ ID NO: 200365 - RNA, 19 nt, Homo sapiens
gaugaaagagaagaaauga

SEQ ID NO: 200366 - RNA, 19 nt, Homo sapiens
gguaucaggguaauguaua

SEQ ID NO: 200367 - RNA, 19 nt, Homo sapiens
ccauaucaauccauucuca

SEQ ID NO: 200368 - RNA, 19 nt, Homo sapiens
uaacugacuuaggagcaua

SEQ ID NO: 200369 - RNA, 19 nt, Homo sapiens
ugaauggaguucccaaauc

SEQ ID NO: 200370 - RNA, 19 nt, Homo sapiens
guaucaggguaauguauau

SEQ ID NO: 200371 - RNA, 19 nt, Homo sapiens
uaucuugccuccauaucaa

SEQ ID NO: 200372 - RNA, 19 nt, Homo sapiens
cagaguaacuggaguagcu

SEQ ID NO: 200373 - RNA, 19 nt, Homo sapiens
gcuguugacucacaaugau

SEQ ID NO: 200374 - RNA, 19 nt, Homo sapiens
caccagauuugacugcauu

SEQ ID NO: 200375 - RNA, 19 nt, Homo sapiens
ucagggaguuuccagaugu

SEQ ID NO: 200376 - RNA, 19 nt, Homo sapiens
gcuaaacaauuugacauac

SEQ ID NO: 200377 - RNA, 19 nt, Homo sapiens
gacuuaggagcauaacuua

SEQ ID NO: 200378 - RNA, 19 nt, Homo sapiens
ugacuuaggagcauaacuu

SEQ ID NO: 200379 - RNA, 19 nt, Homo sapiens
ugacugcauuugcuaaaca

SEQ ID NO: 200380 - RNA, 19 nt, Homo sapiens
auacuuaucuugccuccau

SEQ ID NO: 200381 - RNA, 19 nt, Homo sapiens
cugaaauacuggaagaaga

SEQ ID NO: 200382 - RNA, 19 nt, Homo sapiens
gaaagagaagaaaugaaag

SEQ ID NO: 200383 - RNA, 19 nt, Homo sapiens
ggaguuuccagaugucuug

SEQ ID NO: 200384 - RNA, 19 nt, Homo sapiens
cuguauugcuuuccuuaaa

SEQ ID NO: 200385 - RNA, 19 nt, Homo sapiens
gagagaaaauugagaugug

SEQ ID NO: 200386 - RNA, 19 nt, Homo sapiens
gaaagcauuccugacauuc

SEQ ID NO: 200387 - RNA, 19 nt, Homo sapiens
ucacaaugauccaaaagaa

SEQ ID NO: 200388 - RNA, 19 nt, Homo sapiens
gcacagguaaaaccaaaua

SEQ ID NO: 200389 - RNA, 19 nt, Homo sapiens
aagcauuccugacauucaa

SEQ ID NO: 200390 - RNA, 19 nt, Homo sapiens
ggaggaauuagaaaacuua

SEQ ID NO: 200391 - RNA, 19 nt, Homo sapiens
gcuggauucugugaucauu

SEQ ID NO: 200392 - RNA, 19 nt, Homo sapiens
gaaaagauaaauccugaug

SEQ ID NO: 200393 - RNA, 19 nt, Homo sapiens
uggaguagcugggauuuac

SEQ ID NO: 200394 - RNA, 19 nt, Homo sapiens
uaucagaguaacuggagua

SEQ ID NO: 200395 - RNA, 19 nt, Homo sapiens
ugaaauacuggaagaagau

SEQ ID NO: 200396 - RNA, 19 nt, Homo sapiens
cuucaugauuguauccaaa

SEQ ID NO: 200397 - RNA, 19 nt, Homo sapiens
cgaggagcuucaugauugu

SEQ ID NO: 200398 - RNA, 19 nt, Homo sapiens
cucaugaaccucuguauug

SEQ ID NO: 200399 - RNA, 19 nt, Homo sapiens
uaucaauccauucucauga

SEQ ID NO: 200400 - RNA, 19 nt, Homo sapiens
gcagauauucuuucgucau

SEQ ID NO: 200401 - RNA, 19 nt, Homo sapiens
auacagcuguugacucaca

SEQ ID NO: 200402 - RNA, 19 nt, Homo sapiens
aaagauuguugccauaggu

SEQ ID NO: 200403 - RNA, 19 nt, Homo sapiens
caguugacauggccuguuc

SEQ ID NO: 200404 - RNA, 19 nt, Homo sapiens
agauaaauccugaugaaag

SEQ ID NO: 200405 - RNA, 19 nt, Homo sapiens
uuacugggaggaauuagaa

SEQ ID NO: 200406 - RNA, 19 nt, Homo sapiens
uggagcauuuacagccuua

SEQ ID NO: 200407 - RNA, 19 nt, Homo sapiens
cauagguaccucugaucua

SEQ ID NO: 200408 - RNA, 19 nt, Homo sapiens
agaaucaaacucuucauca

SEQ ID NO: 200409 - RNA, 19 nt, Homo sapiens
gggcacagguaaaaccaaa

SEQ ID NO: 200410 - RNA, 19 nt, Homo sapiens
auagguaccucugaucuag

SEQ ID NO: 200411 - RNA, 19 nt, Homo sapiens
aucaaacucuucaucauca

SEQ ID NO: 200412 - RNA, 19 nt, Homo sapiens
ugagauauaucagaguaac

SEQ ID NO: 200413 - RNA, 19 nt, Homo sapiens
ggagcuucaugauuguauc

SEQ ID NO: 200414 - RNA, 19 nt, Homo sapiens
ggucagggaguuuccagau

SEQ ID NO: 200415 - RNA, 19 nt, Homo sapiens
gacugcauuugcuaaacaa

SEQ ID NO: 200416 - RNA, 19 nt, Homo sapiens
uagaagugcaguugacaug

SEQ ID NO: 200417 - RNA, 19 nt, Homo sapiens
cagauuuggucagggaguu

SEQ ID NO: 200418 - RNA, 19 nt, Homo sapiens
guauugcuuuccuuaaacu

SEQ ID NO: 200419 - RNA, 19 nt, Homo sapiens
ggagcauaacuuaccugua

SEQ ID NO: 200420 - RNA, 19 nt, Homo sapiens
gucagggaguuuccagaug

SEQ ID NO: 200421 - RNA, 19 nt, Homo sapiens
uaccucugaucuagacaaa

SEQ ID NO: 200422 - RNA, 19 nt, Homo sapiens
uaaauccugaugaaagaga

SEQ ID NO: 200423 - RNA, 19 nt, Homo sapiens
ugacucacaaugauccaaa

SEQ ID NO: 200424 - RNA, 19 nt, Homo sapiens
ugaugaaagagaagaaaug

SEQ ID NO: 200425 - RNA, 19 nt, Homo sapiens
cugcaaaacuguucauugu

SEQ ID NO: 200426 - RNA, 19 nt, Homo sapiens
ucaaacucuucaucaucaa

SEQ ID NO: 200427 - RNA, 19 nt, Homo sapiens
gugaaaaguagaggaauua

SEQ ID NO: 200428 - RNA, 19 nt, Homo sapiens
gauuugacugcauuugcua

SEQ ID NO: 200429 - RNA, 19 nt, Homo sapiens
ucucaugaaccucuguauu

SEQ ID NO: 200430 - RNA, 19 nt, Homo sapiens
cagguaaaaccaaauagua

SEQ ID NO: 200431 - RNA, 19 nt, Homo sapiens
uaucagugggcacagguaa

SEQ ID NO: 200432 - RNA, 19 nt, Homo sapiens
aaucaaacucuucaucauc

SEQ ID NO: 200433 - RNA, 19 nt, Homo sapiens
ucaugaaccucuguauugc

SEQ ID NO: 200434 - RNA, 19 nt, Homo sapiens
ugaggcagauauucuuucg

SEQ ID NO: 200435 - RNA, 19 nt, Homo sapiens
aaucuuuccuuggagcauu

SEQ ID NO: 200436 - RNA, 19 nt, Homo sapiens
guauguugucugucaaguu

SEQ ID NO: 200437 - RNA, 19 nt, Homo sapiens
gcacagcgaggagcuucau

SEQ ID NO: 200438 - RNA, 19 nt, Homo sapiens
caaaacuguucauuguaga

SEQ ID NO: 200439 - RNA, 19 nt, Homo sapiens
uguaucucaugcaguagaa

SEQ ID NO: 200440 - RNA, 19 nt, Homo sapiens
acuguucauuguagaauca

SEQ ID NO: 200441 - RNA, 19 nt, Homo sapiens
cuagguaucaggguaaugu

SEQ ID NO: 200442 - RNA, 19 nt, Homo sapiens
augaaccucuguauugcuu

SEQ ID NO: 200443 - RNA, 19 nt, Homo sapiens
gaggagcuucaugauugua

SEQ ID NO: 200444 - RNA, 19 nt, Homo sapiens
gcuucaugauuguauccaa

SEQ ID NO: 200445 - RNA, 19 nt, Homo sapiens
gaaauggacuucaguggaa

SEQ ID NO: 200446 - RNA, 19 nt, Homo sapiens
ccaagagacuccaggauua

SEQ ID NO: 200447 - RNA, 19 nt, Homo sapiens
ggagagagcucaucagagu

SEQ ID NO: 200448 - RNA, 19 nt, Homo sapiens
gaacaucagugacgugugu

SEQ ID NO: 200449 - RNA, 19 nt, Homo sapiens
gaaacacacuacagaauuc

SEQ ID NO: 200450 - RNA, 19 nt, Homo sapiens
gaaagaauuugcaaacauc

SEQ ID NO: 200451 - RNA, 19 nt, Homo sapiens
gaaguuacccugugaaaug

SEQ ID NO: 200452 - RNA, 19 nt, Homo sapiens
ggaucaagcucaaggauau

SEQ ID NO: 200453 - RNA, 19 nt, Homo sapiens
ggaaagaauuugcaaacau

SEQ ID NO: 200454 - RNA, 19 nt, Homo sapiens
ggagaggagugcagaggua

SEQ ID NO: 200455 - RNA, 19 nt, Homo sapiens
ggaagacccuguuugugaa

SEQ ID NO: 200456 - RNA, 19 nt, Homo sapiens
ggaaauugcugacauugag

SEQ ID NO: 200457 - RNA, 19 nt, Homo sapiens
gcaggaaauugcugacauu

SEQ ID NO: 200458 - RNA, 19 nt, Homo sapiens
cgagaaagcuuggugagaa

SEQ ID NO: 200459 - RNA, 19 nt, Homo sapiens
gauauuaaaugccaacuac

SEQ ID NO: 200460 - RNA, 19 nt, Homo sapiens
gaggccaccuggagaauuu

SEQ ID NO: 200461 - RNA, 19 nt, Homo sapiens
ccagagagguggcagcauu

SEQ ID NO: 200462 - RNA, 19 nt, Homo sapiens
cacggaaacugcgauauua

SEQ ID NO: 200463 - RNA, 19 nt, Homo sapiens
uguaaucucugucaaggua

SEQ ID NO: 200464 - RNA, 19 nt, Homo sapiens
uuaaaggacugauuugaug

SEQ ID NO: 200465 - RNA, 19 nt, Homo sapiens
aggcagagcuggacagauu

SEQ ID NO: 200466 - RNA, 19 nt, Homo sapiens
cacaagaccuucugcauuc

SEQ ID NO: 200467 - RNA, 19 nt, Homo sapiens
gagcauugaugaauugauc

SEQ ID NO: 200468 - RNA, 19 nt, Homo sapiens
gcaccuaaaucuucacaag

SEQ ID NO: 200469 - RNA, 19 nt, Homo sapiens
ucaaggccaugguggauaa

SEQ ID NO: 200470 - RNA, 19 nt, Homo sapiens
caggauggaucacccagua

SEQ ID NO: 200471 - RNA, 19 nt, Homo sapiens
gaggauggcacacuuggua

SEQ ID NO: 200472 - RNA, 19 nt, Homo sapiens
cagcuaucaugauuacaua

SEQ ID NO: 200473 - RNA, 19 nt, Homo sapiens
gaucuuugguugugaguca

SEQ ID NO: 200474 - RNA, 19 nt, Homo sapiens
gaugaaacagucaaugaaa

SEQ ID NO: 200475 - RNA, 19 nt, Homo sapiens
caaguuugcagaugucaua

SEQ ID NO: 200476 - RNA, 19 nt, Homo sapiens
gagagaugcugcagaccuu

SEQ ID NO: 200477 - RNA, 19 nt, Homo sapiens
caugaccuguucuuugaua

SEQ ID NO: 200478 - RNA, 19 nt, Homo sapiens
ggcaucaacuccagcauga

SEQ ID NO: 200479 - RNA, 19 nt, Homo sapiens
cauaaugccacuuugauuu

SEQ ID NO: 200480 - RNA, 19 nt, Homo sapiens
gagaaagcuuggugagaau

SEQ ID NO: 200481 - RNA, 19 nt, Homo sapiens
agacggauuugcuuuggua

SEQ ID NO: 200482 - RNA, 19 nt, Homo sapiens
guauaucucuguaaucucu

SEQ ID NO: 200483 - RNA, 19 nt, Homo sapiens
gaucagcaccugguuugua

SEQ ID NO: 200484 - RNA, 19 nt, Homo sapiens
uuaugugggucaugaauuu

SEQ ID NO: 200485 - RNA, 19 nt, Homo sapiens
gagguuaugugggucauga

SEQ ID NO: 200486 - RNA, 19 nt, Homo sapiens
gaaaagacccuugaaaaug

SEQ ID NO: 200487 - RNA, 19 nt, Homo sapiens
gaaacugcgauauuaaaug

SEQ ID NO: 200488 - RNA, 19 nt, Homo sapiens
uaaagacauuucccuuguu

SEQ ID NO: 200489 - RNA, 19 nt, Homo sapiens
ggauggaucacccaguaua

SEQ ID NO: 200490 - RNA, 19 nt, Homo sapiens
gcccacccauggaaguuua

SEQ ID NO: 200491 - RNA, 19 nt, Homo sapiens
guacauaaugccacuuuga

SEQ ID NO: 200492 - RNA, 19 nt, Homo sapiens
gaagacggauuugcuuugg

SEQ ID NO: 200493 - RNA, 19 nt, Homo sapiens
cuacauggccaagcgauua

SEQ ID NO: 200494 - RNA, 19 nt, Homo sapiens
guggauaaauaugggaaua

SEQ ID NO: 200495 - RNA, 19 nt, Homo sapiens
cuguggagguggauaaaua

SEQ ID NO: 200496 - RNA, 19 nt, Homo sapiens
gaaaccagagaacaaauuc

SEQ ID NO: 200497 - RNA, 19 nt, Homo sapiens
cgucugaacucgcaccuau

SEQ ID NO: 200498 - RNA, 19 nt, Homo sapiens
ggaagacggauuugcuuug

SEQ ID NO: 200499 - RNA, 19 nt, Homo sapiens
ccacggaaacugcgauauu

SEQ ID NO: 200500 - RNA, 19 nt, Homo sapiens
ucacaagaccuucugcauu

SEQ ID NO: 200501 - RNA, 19 nt, Homo sapiens
ccuaaucuguaaucacauu

SEQ ID NO: 200502 - RNA, 19 nt, Homo sapiens
ggaaaucccagggcaaaug

SEQ ID NO: 200503 - RNA, 19 nt, Homo sapiens
ggaaacugcgauauuaaau

SEQ ID NO: 200504 - RNA, 19 nt, Homo sapiens
gcuaggaggguacauaaug

SEQ ID NO: 200505 - RNA, 19 nt, Homo sapiens
gagaucagcaccugguuug

SEQ ID NO: 200506 - RNA, 19 nt, Homo sapiens
ccggauugaugacauauau

SEQ ID NO: 200507 - RNA, 19 nt, Homo sapiens
ucugaugucucgcaccuaa

SEQ ID NO: 200508 - RNA, 19 nt, Homo sapiens
gaauaucgaugcaguucac

SEQ ID NO: 200509 - RNA, 19 nt, Homo sapiens
cagaacgguuugccucauu

SEQ ID NO: 200510 - RNA, 19 nt, Homo sapiens
uuugauaccuugaagauuc

SEQ ID NO: 200511 - RNA, 19 nt, Homo sapiens
ugacauauauggagaucag

SEQ ID NO: 200512 - RNA, 19 nt, Homo sapiens
aaacugcgauauuaaaugc

SEQ ID NO: 200513 - RNA, 19 nt, Homo sapiens
uggaagacccuguuuguga

SEQ ID NO: 200514 - RNA, 19 nt, Homo sapiens
uccgagagcuugagaagga

SEQ ID NO: 200515 - RNA, 19 nt, Homo sapiens
auaaagacauuucccuugu

SEQ ID NO: 200516 - RNA, 19 nt, Homo sapiens
cuacugaccuuuuagcuuu

SEQ ID NO: 200517 - RNA, 19 nt, Homo sapiens
ccucuaauaugccuaaucu

SEQ ID NO: 200518 - RNA, 19 nt, Homo sapiens
aggcuauccuggagacuua

SEQ ID NO: 200519 - RNA, 19 nt, Homo sapiens
gccaagagacuccaggauu

SEQ ID NO: 200520 - RNA, 19 nt, Homo sapiens
aaagacauuucccuuguuc

SEQ ID NO: 200521 - RNA, 19 nt, Homo sapiens
cuaauaugccuaaucugua

SEQ ID NO: 200522 - RNA, 19 nt, Homo sapiens
ggcgagcauugaugaauug

SEQ ID NO: 200523 - RNA, 19 nt, Homo sapiens
agaaacacacuacagaauu

SEQ ID NO: 200524 - RNA, 19 nt, Homo sapiens
ccaaucaucccgucauuuc

SEQ ID NO: 200525 - RNA, 19 nt, Homo sapiens
caacagcuaccacucugaa

SEQ ID NO: 200526 - RNA, 19 nt, Homo sapiens
aaugaugccuggaagaaug

SEQ ID NO: 200527 - RNA, 19 nt, Homo sapiens
gaaagcuuggugagaauga

SEQ ID NO: 200528 - RNA, 19 nt, Homo sapiens
ggagaucagcaccugguuu

SEQ ID NO: 200529 - RNA, 19 nt, Homo sapiens
gagccuacuuaaaccagaa

SEQ ID NO: 200530 - RNA, 19 nt, Homo sapiens
gagaaggauuugugugaac

SEQ ID NO: 200531 - RNA, 19 nt, Homo sapiens
agcaugaccuguucuuuga

SEQ ID NO: 200532 - RNA, 19 nt, Homo sapiens
cagcaugaccuguucuuug

SEQ ID NO: 200533 - RNA, 19 nt, Homo sapiens
gggcagcucccagagauuu

SEQ ID NO: 200534 - RNA, 19 nt, Homo sapiens
ucacugagcugaaguuacc

SEQ ID NO: 200535 - RNA, 19 nt, Homo sapiens
caacaagaggaggaaauuu

SEQ ID NO: 200536 - RNA, 19 nt, Homo sapiens
ggaacuuacuggagaacuc

SEQ ID NO: 200537 - RNA, 19 nt, Homo sapiens
gaaaucccagggcaaaugu

SEQ ID NO: 200538 - RNA, 19 nt, Homo sapiens
ucaauccgcugaagauguc

SEQ ID NO: 200539 - RNA, 19 nt, Homo sapiens
ggacacgagacccuucaaa

SEQ ID NO: 200540 - RNA, 19 nt, Homo sapiens
aggcaagggucuuaaacaa

SEQ ID NO: 200541 - RNA, 19 nt, Homo sapiens
ugagucaucugcagaacug

SEQ ID NO: 200542 - RNA, 19 nt, Homo sapiens
cccaugggcuggagcauau

SEQ ID NO: 200543 - RNA, 19 nt, Homo sapiens
gaucagcauucggcaggaa

SEQ ID NO: 200544 - RNA, 19 nt, Homo sapiens
gggcuccaguuccaucuug

SEQ ID NO: 200545 - RNA, 19 nt, Homo sapiens
gagaagagcuccagagaag

SEQ ID NO: 200546 - RNA, 19 nt, Homo sapiens
gaucaacccucauuuguuc

SEQ ID NO: 200547 - RNA, 19 nt, Homo sapiens
gggauuaaguaacucauaa

SEQ ID NO: 200548 - RNA, 19 nt, Homo sapiens
gcacacagaaucuauggua

SEQ ID NO: 200549 - RNA, 19 nt, Homo sapiens
ggaaugcccucaugaagca

SEQ ID NO: 200550 - RNA, 19 nt, Homo sapiens
gaaccaagggcaaagauga

SEQ ID NO: 200551 - RNA, 19 nt, Homo sapiens
ugaaggagaucuuugacaa

SEQ ID NO: 200552 - RNA, 19 nt, Homo sapiens
gaacugguacacagaauga

SEQ ID NO: 200553 - RNA, 19 nt, Homo sapiens
gaaguguccuuacucuguu

SEQ ID NO: 200554 - RNA, 19 nt, Homo sapiens
gagcaaagauucucaaccu

SEQ ID NO: 200555 - RNA, 19 nt, Homo sapiens
caaagauucucaaccugaa

SEQ ID NO: 200556 - RNA, 19 nt, Homo sapiens
gaagcagcauaaagaauuc

SEQ ID NO: 200557 - RNA, 19 nt, Homo sapiens
caagcuaucuucuuauucu

SEQ ID NO: 200558 - RNA, 19 nt, Homo sapiens
gauucacccucauggcuua

SEQ ID NO: 200559 - RNA, 19 nt, Homo sapiens
gaccagaggcccacaaaga

SEQ ID NO: 200560 - RNA, 19 nt, Homo sapiens
ggacuacuuucccagguau

SEQ ID NO: 200561 - RNA, 19 nt, Homo sapiens
gaauggcuuuggaagacua

SEQ ID NO: 200562 - RNA, 19 nt, Homo sapiens
gaacugaagcagcauaaag

SEQ ID NO: 200563 - RNA, 19 nt, Homo sapiens
caaacuggcagagaaauuu

SEQ ID NO: 200564 - RNA, 19 nt, Homo sapiens
gaagaagaggcccagguaa

SEQ ID NO: 200565 - RNA, 19 nt, Homo sapiens
gcagagaaauuugugaaac

SEQ ID NO: 200566 - RNA, 19 nt, Homo sapiens
ugaagcagcauaaagaauu

SEQ ID NO: 200567 - RNA, 19 nt, Homo sapiens
guacacagaaugaaaggaa

SEQ ID NO: 200568 - RNA, 19 nt, Homo sapiens
caacugaagcgguuugaug

SEQ ID NO: 200569 - RNA, 19 nt, Homo sapiens
cagagaaauuugugaaaca

SEQ ID NO: 200570 - RNA, 19 nt, Homo sapiens
agccaaaucucuaccauug

SEQ ID NO: 200571 - RNA, 19 nt, Homo sapiens
gcuauuaccugcugguuuu

SEQ ID NO: 200572 - RNA, 19 nt, Homo sapiens
gaaacaaggcgaggaggaa

SEQ ID NO: 200573 - RNA, 19 nt, Homo sapiens
ccaaaucucuaccauugca

SEQ ID NO: 200574 - RNA, 19 nt, Homo sapiens
cagaaucuaugguacuuca

SEQ ID NO: 200575 - RNA, 19 nt, Homo sapiens
ggaagaugcuaauucucau

SEQ ID NO: 200576 - RNA, 19 nt, Homo sapiens
aauacaaacuggcagagaa

SEQ ID NO: 200577 - RNA, 19 nt, Homo sapiens
gaagguacaagacauuaca

SEQ ID NO: 200578 - RNA, 19 nt, Homo sapiens
gagggaaacagaaugaaga

SEQ ID NO: 200579 - RNA, 19 nt, Homo sapiens
uucccaagcuaucuucuua

SEQ ID NO: 200580 - RNA, 19 nt, Homo sapiens
gcagcaagacaacuuucua

SEQ ID NO: 200581 - RNA, 19 nt, Homo sapiens
ggaaguggccucucaccau

SEQ ID NO: 200582 - RNA, 19 nt, Homo sapiens
ugaagaagaggcccaggua

SEQ ID NO: 200583 - RNA, 19 nt, Homo sapiens
gaagcgguuugaugaaugg

SEQ ID NO: 200584 - RNA, 19 nt, Homo sapiens
gaacaacugaagcgguuug

SEQ ID NO: 200585 - RNA, 19 nt, Homo sapiens
cagccacccuccucuuuga

SEQ ID NO: 200586 - RNA, 19 nt, Homo sapiens
aguaaaggauuccaaagug

SEQ ID NO: 200587 - RNA, 19 nt, Homo sapiens
cagcaagacaacuuucuaa

SEQ ID NO: 200588 - RNA, 19 nt, Homo sapiens
gggaauggcuuuggaagac

SEQ ID NO: 200589 - RNA, 19 nt, Homo sapiens
cccaagcuaucuucuuauu

SEQ ID NO: 200590 - RNA, 19 nt, Homo sapiens
ccaaguaaaggauuccaaa

SEQ ID NO: 200591 - RNA, 19 nt, Homo sapiens
ggcuggacuuuguucaaua

SEQ ID NO: 200592 - RNA, 19 nt, Homo sapiens
gggcuggacuuuguucaau

SEQ ID NO: 200593 - RNA, 19 nt, Homo sapiens
ccagugagccaaaucucua

SEQ ID NO: 200594 - RNA, 19 nt, Homo sapiens
ccagguaucaggcuuguug

SEQ ID NO: 200595 - RNA, 19 nt, Homo sapiens
aaacgcaugucagggauga

SEQ ID NO: 200596 - RNA, 19 nt, Homo sapiens
gcucaaaacugaaggagau

SEQ ID NO: 200597 - RNA, 19 nt, Homo sapiens
gcaauaccagguucaguuc

SEQ ID NO: 200598 - RNA, 19 nt, Homo sapiens
ucucuacgcugcuaucauc

SEQ ID NO: 200599 - RNA, 19 nt, Homo sapiens
gcaagacaacuuucuaaaa

SEQ ID NO: 200600 - RNA, 19 nt, Homo sapiens
uggcacagaucuuaaacau

SEQ ID NO: 200601 - RNA, 19 nt, Homo sapiens
caagacaacuuucuaaaac

SEQ ID NO: 200602 - RNA, 19 nt, Homo sapiens
auaaagaauuccaggacuu

SEQ ID NO: 200603 - RNA, 19 nt, Homo sapiens
ggaaggcugcguccgaaug

SEQ ID NO: 200604 - RNA, 19 nt, Homo sapiens
uaugacaucuuuccuacuc

SEQ ID NO: 200605 - RNA, 19 nt, Homo sapiens
ggaggcaggaugaagaaga

SEQ ID NO: 200606 - RNA, 19 nt, Homo sapiens
ggacaccaagagaaguuaa

SEQ ID NO: 200607 - RNA, 19 nt, Homo sapiens
ugaagcgguuugaugaaug

SEQ ID NO: 200608 - RNA, 19 nt, Homo sapiens
uaucagaggaugcuugguu

SEQ ID NO: 200609 - RNA, 19 nt, Homo sapiens
aagaagaggcccagguaaa

SEQ ID NO: 200610 - RNA, 19 nt, Homo sapiens
gacagccacccuccucuuu

SEQ ID NO: 200611 - RNA, 19 nt, Homo sapiens
aaacauggagcccuuguca

SEQ ID NO: 200612 - RNA, 19 nt, Homo sapiens
gaaaccgacaggagauuca

SEQ ID NO: 200613 - RNA, 19 nt, Homo sapiens
caaggacagucaggccaaa

SEQ ID NO: 200614 - RNA, 19 nt, Homo sapiens
cagguucaguucuggaaga

SEQ ID NO: 200615 - RNA, 19 nt, Homo sapiens
gcgcgaggauguuuuagaa

SEQ ID NO: 200616 - RNA, 19 nt, Homo sapiens
gaggcaggaugaagaagag

SEQ ID NO: 200617 - RNA, 19 nt, Homo sapiens
gggaaguaauggagaagag

SEQ ID NO: 200618 - RNA, 19 nt, Homo sapiens
gaaggcugcguccgaaugu

SEQ ID NO: 200619 - RNA, 19 nt, Homo sapiens
ggagcagcaagacaacuuu

SEQ ID NO: 200620 - RNA, 19 nt, Homo sapiens
ucaaggagggaauggcuuu

SEQ ID NO: 200621 - RNA, 19 nt, Homo sapiens
gaggaggcaggaugaagaa

SEQ ID NO: 200622 - RNA, 19 nt, Homo sapiens
uaaagaauuccaggacuug

SEQ ID NO: 200623 - RNA, 19 nt, Homo sapiens
ccgaauguacgaacuggua

SEQ ID NO: 200624 - RNA, 19 nt, Homo sapiens
cacagaaucuaugguacuu

SEQ ID NO: 200625 - RNA, 19 nt, Homo sapiens
gcgaggauguuuuagaaga

SEQ ID NO: 200626 - RNA, 19 nt, Homo sapiens
uugcucaucuacauaagaa

SEQ ID NO: 200627 - RNA, 19 nt, Homo sapiens
gugaagguacaagacauua

SEQ ID NO: 200628 - RNA, 19 nt, Homo sapiens
gaaggagaucuuugacaag

SEQ ID NO: 200629 - RNA, 19 nt, Homo sapiens
gagccaaaucucuaccauu

SEQ ID NO: 200630 - RNA, 19 nt, Homo sapiens
uggaagaugcuaauucuca

SEQ ID NO: 200631 - RNA, 19 nt, Homo sapiens
ucuggaagaugcuaauucu

SEQ ID NO: 200632 - RNA, 19 nt, Homo sapiens
cuagaucaacccucauuug

SEQ ID NO: 200633 - RNA, 19 nt, Homo sapiens
ggugguagagcacguccua

SEQ ID NO: 200634 - RNA, 19 nt, Homo sapiens
cagcuccgguggccauaug

SEQ ID NO: 200635 - RNA, 19 nt, Homo sapiens
ggagggaauggcuuuggaa

SEQ ID NO: 200636 - RNA, 19 nt, Homo sapiens
agaaguguccuuacucugu

SEQ ID NO: 200637 - RNA, 19 nt, Homo sapiens
gaagcagcauuccccauug

SEQ ID NO: 200638 - RNA, 19 nt, Homo sapiens
gcuggacuuuguucaauac

SEQ ID NO: 200639 - RNA, 19 nt, Homo sapiens
cauaaccaggccucagaua

SEQ ID NO: 200640 - RNA, 19 nt, Homo sapiens
acauggagcccuugucaga

SEQ ID NO: 200641 - RNA, 19 nt, Homo sapiens
aucagaggaugcuugguua

SEQ ID NO: 200642 - RNA, 19 nt, Homo sapiens
ugacgcaagcucugccuuu

SEQ ID NO: 200643 - RNA, 19 nt, Homo sapiens
guaugucucuucccaagcu

SEQ ID NO: 200644 - RNA, 19 nt, Homo sapiens
ggugaagguacaagacauu

SEQ ID NO: 200645 - RNA, 19 nt, Homo sapiens
gaacacagauuaccgcuua

SEQ ID NO: 200646 - RNA, 19 nt, Homo sapiens
gaaagaagcagaagaaaga

SEQ ID NO: 200647 - RNA, 19 nt, Homo sapiens
gaaugaagcuugugaaucu

SEQ ID NO: 200648 - RNA, 19 nt, Homo sapiens
gaccagauccgaaucauua

SEQ ID NO: 200649 - RNA, 19 nt, Homo sapiens
gcaaacagaugauaaccaa

SEQ ID NO: 200650 - RNA, 19 nt, Homo sapiens
ggauugagauguggaguua

SEQ ID NO: 200651 - RNA, 19 nt, Homo sapiens
guaaugacgucuccaucua

SEQ ID NO: 200652 - RNA, 19 nt, Homo sapiens
ucuuagagcugcaguauuu

SEQ ID NO: 200653 - RNA, 19 nt, Homo sapiens
uaaagaaugugcugaugaa

SEQ ID NO: 200654 - RNA, 19 nt, Homo sapiens
gacgagaucuccagucuau

SEQ ID NO: 200655 - RNA, 19 nt, Homo sapiens
gaacauuuauacacagaga

SEQ ID NO: 200656 - RNA, 19 nt, Homo sapiens
gcaagcagaugauaaagag

SEQ ID NO: 200657 - RNA, 19 nt, Homo sapiens
uuacaugguuuccugcuua

SEQ ID NO: 200658 - RNA, 19 nt, Homo sapiens
gcaaaucuacuauaacaga

SEQ ID NO: 200659 - RNA, 19 nt, Homo sapiens
cagagaagaugguagaaga

SEQ ID NO: 200660 - RNA, 19 nt, Homo sapiens
agaaaggccuggugaaaga

SEQ ID NO: 200661 - RNA, 19 nt, Homo sapiens
gcaaucauuuguuguggaa

SEQ ID NO: 200662 - RNA, 19 nt, Homo sapiens
gaaugagaccagugaauuu

SEQ ID NO: 200663 - RNA, 19 nt, Homo sapiens
cuacagaucccaaauuuga

SEQ ID NO: 200664 - RNA, 19 nt, Homo sapiens
caacagaacuuccgguacu

SEQ ID NO: 200665 - RNA, 19 nt, Homo sapiens
caacucaccugaccugcaa

SEQ ID NO: 200666 - RNA, 19 nt, Homo sapiens
ggaaugagaccagugaauu

SEQ ID NO: 200667 - RNA, 19 nt, Homo sapiens
gagcaucuguauauuguuc

SEQ ID NO: 200668 - RNA, 19 nt, Homo sapiens
gagcuguguucucuuguuu

SEQ ID NO: 200669 - RNA, 19 nt, Homo sapiens
guguauaagugccucuuua

SEQ ID NO: 200670 - RNA, 19 nt, Homo sapiens
gaagaaagagaacccaaga

SEQ ID NO: 200671 - RNA, 19 nt, Homo sapiens
uggaagcacuggaggauaa

SEQ ID NO: 200672 - RNA, 19 nt, Homo sapiens
aagcugacauuccuaaauu

SEQ ID NO: 200673 - RNA, 19 nt, Homo sapiens
gauggaacauuuauacaca

SEQ ID NO: 200674 - RNA, 19 nt, Homo sapiens
cagacagccugcaaacaua

SEQ ID NO: 200675 - RNA, 19 nt, Homo sapiens
gaggcaacaucacugagua

SEQ ID NO: 200676 - RNA, 19 nt, Homo sapiens
gggagcaucuguauauugu

SEQ ID NO: 200677 - RNA, 19 nt, Homo sapiens
ggagccagaucuauacgaa

SEQ ID NO: 200678 - RNA, 19 nt, Homo sapiens
gaagaauccaugagugaaa

SEQ ID NO: 200679 - RNA, 19 nt, Homo sapiens
gaaagagaacccaagauuc

SEQ ID NO: 200680 - RNA, 19 nt, Homo sapiens
ggccaaggaugauucagaa

SEQ ID NO: 200681 - RNA, 19 nt, Homo sapiens
gagcugaaguccaaaggau

SEQ ID NO: 200682 - RNA, 19 nt, Homo sapiens
ucacuuagaccggcauuua

SEQ ID NO: 200683 - RNA, 19 nt, Homo sapiens
ggagaaaggccuggugaaa

SEQ ID NO: 200684 - RNA, 19 nt, Homo sapiens
gaacccaagauucaaguuu

SEQ ID NO: 200685 - RNA, 19 nt, Homo sapiens
ccagagagguuugcaaauc

SEQ ID NO: 200686 - RNA, 19 nt, Homo sapiens
gcaaggaggacguguugaa

SEQ ID NO: 200687 - RNA, 19 nt, Homo sapiens
gagaugaucgggagcguuu

SEQ ID NO: 200688 - RNA, 19 nt, Homo sapiens
aagcagacaucuuuguuga

SEQ ID NO: 200689 - RNA, 19 nt, Homo sapiens
gaggacguguugaagcuuu

SEQ ID NO: 200690 - RNA, 19 nt, Homo sapiens
ucaccucgcucuucucaga

SEQ ID NO: 200691 - RNA, 19 nt, Homo sapiens
ugacuaaggccaaggauga

SEQ ID NO: 200692 - RNA, 19 nt, Homo sapiens
agaaggacaugaacgagaa

SEQ ID NO: 200693 - RNA, 19 nt, Homo sapiens
aaagagaacccaagauuca

SEQ ID NO: 200694 - RNA, 19 nt, Homo sapiens
caaaggaacuaccuaucca

SEQ ID NO: 200695 - RNA, 19 nt, Homo sapiens
agacugcaaucauuuguug

SEQ ID NO: 200696 - RNA, 19 nt, Homo sapiens
cgucaaauguccugucuca

SEQ ID NO: 200697 - RNA, 19 nt, Homo sapiens
gaucccaaaugcaaacaga

SEQ ID NO: 200698 - RNA, 19 nt, Homo sapiens
guaaagcugacauuccuaa

SEQ ID NO: 200699 - RNA, 19 nt, Homo sapiens
auagaagccuugcugauga

SEQ ID NO: 200700 - RNA, 19 nt, Homo sapiens
gguggaguguagagauaua

SEQ ID NO: 200701 - RNA, 19 nt, Homo sapiens
gauaagugccugauugauc

SEQ ID NO: 200702 - RNA, 19 nt, Homo sapiens
agaaagagaacccaagauu

SEQ ID NO: 200703 - RNA, 19 nt, Homo sapiens
ggugaaagaagcagaagaa

SEQ ID NO: 200704 - RNA, 19 nt, Homo sapiens
gaugaaggauuuucgguuu

SEQ ID NO: 200705 - RNA, 19 nt, Homo sapiens
ucaaauguccugucucaug

SEQ ID NO: 200706 - RNA, 19 nt, Homo sapiens
ugacauuccuaaauucugu

SEQ ID NO: 200707 - RNA, 19 nt, Homo sapiens
gaugauggacccagagcua

SEQ ID NO: 200708 - RNA, 19 nt, Homo sapiens
gcuguguucucuuguuuau

SEQ ID NO: 200709 - RNA, 19 nt, Homo sapiens
ggagcuguguucucuuguu

SEQ ID NO: 200710 - RNA, 19 nt, Homo sapiens
ggaaaagguuacaugguuu

SEQ ID NO: 200711 - RNA, 19 nt, Homo sapiens
uaaacaugcugaaggaaag

SEQ ID NO: 200712 - RNA, 19 nt, Homo sapiens
uaucgaaugucugaaagaa

SEQ ID NO: 200713 - RNA, 19 nt, Homo sapiens
gugguggaguguagagaua

SEQ ID NO: 200714 - RNA, 19 nt, Homo sapiens
gaagaugguagaagacugu

SEQ ID NO: 200715 - RNA, 19 nt, Homo sapiens
gcacuuacaacccgccaaa

SEQ ID NO: 200716 - RNA, 19 nt, Homo sapiens
gugccgagcugaaguccaa

SEQ ID NO: 200717 - RNA, 19 nt, Homo sapiens
aacuacagaucccaaauuu

SEQ ID NO: 200718 - RNA, 19 nt, Homo sapiens
uaacuacagaucccaaauu

SEQ ID NO: 200719 - RNA, 19 nt, Homo sapiens
uaaauucugucacgguauc

SEQ ID NO: 200720 - RNA, 19 nt, Homo sapiens
gaagaaauaccggugcaau

SEQ ID NO: 200721 - RNA, 19 nt, Homo sapiens
caaaugcaaacagaugaua

SEQ ID NO: 200722 - RNA, 19 nt, Homo sapiens
gauuaucgaaugucugaaa

SEQ ID NO: 200723 - RNA, 19 nt, Homo sapiens
acaccauuguuccggauua

SEQ ID NO: 200724 - RNA, 19 nt, Homo sapiens
ggguuuaccugccuguaga

SEQ ID NO: 200725 - RNA, 19 nt, Homo sapiens
ucacccagaacacagauua

SEQ ID NO: 200726 - RNA, 19 nt, Homo sapiens
gaagugugccaucggaguu

SEQ ID NO: 200727 - RNA, 19 nt, Homo sapiens
ggaaaauggugcagugaga

SEQ ID NO: 200728 - RNA, 19 nt, Homo sapiens
gaagaccagauccgaauca

SEQ ID NO: 200729 - RNA, 19 nt, Homo sapiens
gcuuggagccagaucuaua

SEQ ID NO: 200730 - RNA, 19 nt, Homo sapiens
gaguuagaaucagaggaua

SEQ ID NO: 200731 - RNA, 19 nt, Homo sapiens
gcauguugauggaagacuu

SEQ ID NO: 200732 - RNA, 19 nt, Homo sapiens
ucugaaauguggcaguauu

SEQ ID NO: 200733 - RNA, 19 nt, Homo sapiens
cugcaagagugacaucaaa

SEQ ID NO: 200734 - RNA, 19 nt, Homo sapiens
gaucgagcuuugaaugaag

SEQ ID NO: 200735 - RNA, 19 nt, Homo sapiens
gaaauaccggugcaaugug

SEQ ID NO: 200736 - RNA, 19 nt, Homo sapiens
ggaaagcaaagcagacauc

SEQ ID NO: 200737 - RNA, 19 nt, Homo sapiens
caaugacacucugcaggaa

SEQ ID NO: 200738 - RNA, 19 nt, Homo sapiens
ugagaccagugaauuuaug

SEQ ID NO: 200739 - RNA, 19 nt, Homo sapiens
aaugagaccagugaauuua

SEQ ID NO: 200740 - RNA, 19 nt, Homo sapiens
gcagauuaccgcauugauc

SEQ ID NO: 200741 - RNA, 19 nt, Homo sapiens
caggcucuccuacuuguua

SEQ ID NO: 200742 - RNA, 19 nt, Homo sapiens
aaggugaggugguaucaug

SEQ ID NO: 200743 - RNA, 19 nt, Homo sapiens
ugacaucaacauucugaaa

SEQ ID NO: 200744 - RNA, 19 nt, Homo sapiens
cuugugcccuggacauuaa

SEQ ID NO: 200745 - RNA, 19 nt, Homo sapiens
gcaaauagggcuucacaua

SEQ ID NO: 200746 - RNA, 19 nt, Homo sapiens
ggacagaacuuugauccuu

SEQ ID NO: 200747 - RNA, 19 nt, Homo sapiens
gacagaacuuugauccuua

SEQ ID NO: 200748 - RNA, 19 nt, Homo sapiens
ggaaaugacuggcaaugca

SEQ ID NO: 200749 - RNA, 19 nt, Homo sapiens
gaggagaaauuugauaaug

SEQ ID NO: 200750 - RNA, 19 nt, Homo sapiens
caacaugagugucuuacug

SEQ ID NO: 200751 - RNA, 19 nt, Homo sapiens
gcacuggucuguccacucu

SEQ ID NO: 200752 - RNA, 19 nt, Homo sapiens
ccaccaagcuaaccucaug

SEQ ID NO: 200753 - RNA, 19 nt, Homo sapiens
ccacacaagugcacguuug

SEQ ID NO: 200754 - RNA, 19 nt, Homo sapiens
guccucgacuugaacauua

SEQ ID NO: 200755 - RNA, 19 nt, Homo sapiens
acacucagcuggacuuugu

SEQ ID NO: 200756 - RNA, 19 nt, Homo sapiens
ggacccaacuugcccaauc

SEQ ID NO: 200757 - RNA, 19 nt, Homo sapiens
aggcucagcuuguguguaa

SEQ ID NO: 200758 - RNA, 19 nt, Homo sapiens
ucacagaucgcauuuccua

SEQ ID NO: 200759 - RNA, 19 nt, Homo sapiens
gagaagccguauguaugua

SEQ ID NO: 200760 - RNA, 19 nt, Homo sapiens
ggagaaauuugauaaugac

SEQ ID NO: 200761 - RNA, 19 nt, Homo sapiens
uauauggacuucccaccua

SEQ ID NO: 200762 - RNA, 19 nt, Homo sapiens
gcaccaaacgcuauacaga

SEQ ID NO: 200763 - RNA, 19 nt, Homo sapiens
ugacacuguuuccugauaa

SEQ ID NO: 200764 - RNA, 19 nt, Homo sapiens
ccucaacucuagugccuaa

SEQ ID NO: 200765 - RNA, 19 nt, Homo sapiens
ggccuugccuggacuuuga

SEQ ID NO: 200766 - RNA, 19 nt, Homo sapiens
gcacgagggcugcaguaaa

SEQ ID NO: 200767 - RNA, 19 nt, Homo sapiens
uagggaaucucauccauca

SEQ ID NO: 200768 - RNA, 19 nt, Homo sapiens
caaauagggcuucacauag

SEQ ID NO: 200769 - RNA, 19 nt, Homo sapiens
cuagagggcuacaggaaga

SEQ ID NO: 200770 - RNA, 19 nt, Homo sapiens
caacucuagugccuaaaga

SEQ ID NO: 200771 - RNA, 19 nt, Homo sapiens
cagcuuguguguaauuaug

SEQ ID NO: 200772 - RNA, 19 nt, Homo sapiens
ccucguagcuuucaucaac

SEQ ID NO: 200773 - RNA, 19 nt, Homo sapiens
cuacugauacucugggaua

SEQ ID NO: 200774 - RNA, 19 nt, Homo sapiens
ccaaugagaagccguaugu

SEQ ID NO: 200775 - RNA, 19 nt, Homo sapiens
cuaccagagucccaaguuu

SEQ ID NO: 200776 - RNA, 19 nt, Homo sapiens
gcaguaaagccuucagcaa

SEQ ID NO: 200777 - RNA, 19 nt, Homo sapiens
gcgagaagccacacaagug

SEQ ID NO: 200778 - RNA, 19 nt, Homo sapiens
gcuaugggccucucaaagu

SEQ ID NO: 200779 - RNA, 19 nt, Homo sapiens
aaauagggcuucacauagg

SEQ ID NO: 200780 - RNA, 19 nt, Homo sapiens
ugagaaugcugccauggau

SEQ ID NO: 200781 - RNA, 19 nt, Homo sapiens
ggagaagccgagccgagua

SEQ ID NO: 200782 - RNA, 19 nt, Homo sapiens
aguaaagccuucagcaaug

SEQ ID NO: 200783 - RNA, 19 nt, Homo sapiens
caucaacuccggccaauag

SEQ ID NO: 200784 - RNA, 19 nt, Homo sapiens
ggacgagggaccuugcauu

SEQ ID NO: 200785 - RNA, 19 nt, Homo sapiens
cugaagaccucuccagcuu

SEQ ID NO: 200786 - RNA, 19 nt, Homo sapiens
cacgagggcugcaguaaag

SEQ ID NO: 200787 - RNA, 19 nt, Homo sapiens
caucagcucugccuauacu

SEQ ID NO: 200788 - RNA, 19 nt, Homo sapiens
gagcugaggcccuucaaag

SEQ ID NO: 200789 - RNA, 19 nt, Homo sapiens
ggagaagcgugagccugaa

SEQ ID NO: 200790 - RNA, 19 nt, Homo sapiens
gauaauaaaggaacugcau

SEQ ID NO: 200791 - RNA, 19 nt, Homo sapiens
gacccaacuugcccaauca

SEQ ID NO: 200792 - RNA, 19 nt, Homo sapiens
ccaguguccucgacuugaa

SEQ ID NO: 200793 - RNA, 19 nt, Homo sapiens
ccgaaggacagguauguaa

SEQ ID NO: 200794 - RNA, 19 nt, Homo sapiens
aagcuccagugaacacaua

SEQ ID NO: 200795 - RNA, 19 nt, Homo sapiens
cagcuagaguccagagguu

SEQ ID NO: 200796 - RNA, 19 nt, Homo sapiens
gcagggagugcagccaaua

SEQ ID NO: 200797 - RNA, 19 nt, Homo sapiens
gacgagggaccuugcauug

SEQ ID NO: 200798 - RNA, 19 nt, Homo sapiens
ggagugcagccaauacaga

SEQ ID NO: 200799 - RNA, 19 nt, Homo sapiens
ggugagaagccauacaugu

SEQ ID NO: 200800 - RNA, 19 nt, Homo sapiens
ucacaagucagguuccuau

SEQ ID NO: 200801 - RNA, 19 nt, Homo sapiens
gcucagcuuguguguaauu

SEQ ID NO: 200802 - RNA, 19 nt, Homo sapiens
agacagugguguggaaaug

SEQ ID NO: 200803 - RNA, 19 nt, Homo sapiens
caguaaagccuucagcaau

SEQ ID NO: 200804 - RNA, 19 nt, Homo sapiens
gggcaacaugagugucuua

SEQ ID NO: 200805 - RNA, 19 nt, Homo sapiens
ugagaagccguauguaugu

SEQ ID NO: 200806 - RNA, 19 nt, Homo sapiens
ggaauuugacucccaagag

SEQ ID NO: 200807 - RNA, 19 nt, Homo sapiens
gagaagccgagccgaguau

SEQ ID NO: 200808 - RNA, 19 nt, Homo sapiens
caucacagaucgcauuucc

SEQ ID NO: 200809 - RNA, 19 nt, Homo sapiens
cgagggaccuugcauugcu

SEQ ID NO: 200810 - RNA, 19 nt, Homo sapiens
caccauccauuucuacagu

SEQ ID NO: 200811 - RNA, 19 nt, Homo sapiens
gaagccguauguauguaag

SEQ ID NO: 200812 - RNA, 19 nt, Homo sapiens
uaauaaaggaacugcauca

SEQ ID NO: 200813 - RNA, 19 nt, Homo sapiens
gggaaucucauccaucaca

SEQ ID NO: 200814 - RNA, 19 nt, Homo sapiens
uggacucucuugaucuuga

SEQ ID NO: 200815 - RNA, 19 nt, Homo sapiens
gugagaagccauacaugug

SEQ ID NO: 200816 - RNA, 19 nt, Homo sapiens
uaaagaguagggaaucuca

SEQ ID NO: 200817 - RNA, 19 nt, Homo sapiens
cuaugggccucucaaagug

SEQ ID NO: 200818 - RNA, 19 nt, Homo sapiens
gagccaagcaccagaaucg

SEQ ID NO: 200819 - RNA, 19 nt, Homo sapiens
guaaagccuucagcaaugc

SEQ ID NO: 200820 - RNA, 19 nt, Homo sapiens
gccugaaucuguguaugaa

SEQ ID NO: 200821 - RNA, 19 nt, Homo sapiens
gagacgccauguucaacuc

SEQ ID NO: 200822 - RNA, 19 nt, Homo sapiens
ggacuucccaccuacugau

SEQ ID NO: 200823 - RNA, 19 nt, Homo sapiens
gagcacgagggcugcagua

SEQ ID NO: 200824 - RNA, 19 nt, Homo sapiens
cuugccagcugaagucuga

SEQ ID NO: 200825 - RNA, 19 nt, Homo sapiens
gacacuguuuccugauaau

SEQ ID NO: 200826 - RNA, 19 nt, Homo sapiens
ccuggacucucuugaucuu

SEQ ID NO: 200827 - RNA, 19 nt, Homo sapiens
gggcaaauagggcuucaca

SEQ ID NO: 200828 - RNA, 19 nt, Homo sapiens
gcuuguguguaauuauguu

SEQ ID NO: 200829 - RNA, 19 nt, Homo sapiens
ugaacauuauggacaagug

SEQ ID NO: 200830 - RNA, 19 nt, Homo sapiens
acaggaagagccagaaguu

SEQ ID NO: 200831 - RNA, 19 nt, Homo sapiens
cccaaccucugucuacuca

SEQ ID NO: 200832 - RNA, 19 nt, Homo sapiens
gccagagggugccaugaag

SEQ ID NO: 200833 - RNA, 19 nt, Homo sapiens
aaugagaagccguauguau

SEQ ID NO: 200834 - RNA, 19 nt, Homo sapiens
gcagacacacuggcgagaa

SEQ ID NO: 200835 - RNA, 19 nt, Homo sapiens
cuacggucaucucuccauu

SEQ ID NO: 200836 - RNA, 19 nt, Homo sapiens
ucuagugccuaaagaguag

SEQ ID NO: 200837 - RNA, 19 nt, Homo sapiens
ccaccaaucaguagcuaug

SEQ ID NO: 200838 - RNA, 19 nt, Homo sapiens
ccucugagacgccauguuc

SEQ ID NO: 200839 - RNA, 19 nt, Homo sapiens
ugagaagccauacaugugu

SEQ ID NO: 200840 - RNA, 19 nt, Homo sapiens
cuucaaagcccaguacaug

SEQ ID NO: 200841 - RNA, 19 nt, Homo sapiens
agcaucagcucugccuaua

SEQ ID NO: 200842 - RNA, 19 nt, Homo sapiens
cagacacacuggcgagaag

SEQ ID NO: 200843 - RNA, 19 nt, Homo sapiens
gggcagcucuggacauacc

SEQ ID NO: 200844 - RNA, 19 nt, Homo sapiens
uacagacagugguguggaa

SEQ ID NO: 200845 - RNA, 19 nt, Homo sapiens
uaacauaccuugucauaga

SEQ ID NO: 200846 - RNA, 19 nt, Homo sapiens
gaauacaugugcugcuuua

SEQ ID NO: 200847 - RNA, 19 nt, Homo sapiens
gcacaccgcugcucaaaga

SEQ ID NO: 200848 - RNA, 19 nt, Homo sapiens
caaaggauaugcagaaaga

SEQ ID NO: 200849 - RNA, 19 nt, Homo sapiens
gaugacagauguuguaaga

SEQ ID NO: 200850 - RNA, 19 nt, Homo sapiens
gauuauaccuggaugauuc

SEQ ID NO: 200851 - RNA, 19 nt, Homo sapiens
ugacagauguuguaagaga

SEQ ID NO: 200852 - RNA, 19 nt, Homo sapiens
gaauaaggcauccaaguau

SEQ ID NO: 200853 - RNA, 19 nt, Homo sapiens
ucaagucacucaaggauuc

SEQ ID NO: 200854 - RNA, 19 nt, Homo sapiens
ugaauaaggcauccaagua

SEQ ID NO: 200855 - RNA, 19 nt, Homo sapiens
gcaaacacaugaccaccau

SEQ ID NO: 200856 - RNA, 19 nt, Homo sapiens
gcacgagggcugcaacaaa

SEQ ID NO: 200857 - RNA, 19 nt, Homo sapiens
guagggagcauuuggguuu

SEQ ID NO: 200858 - RNA, 19 nt, Homo sapiens
aauaaggcauccaaguaua

SEQ ID NO: 200859 - RNA, 19 nt, Homo sapiens
caucaaagagcaaggauug

SEQ ID NO: 200860 - RNA, 19 nt, Homo sapiens
ccaagaagcagcgcaauga

SEQ ID NO: 200861 - RNA, 19 nt, Homo sapiens
ggacaggaaggaaugcaaa

SEQ ID NO: 200862 - RNA, 19 nt, Homo sapiens
gcacuggcuucucugacaa

SEQ ID NO: 200863 - RNA, 19 nt, Homo sapiens
ccgcaucugugaucaagaa

SEQ ID NO: 200864 - RNA, 19 nt, Homo sapiens
ggagaguguauaugaauga

SEQ ID NO: 200865 - RNA, 19 nt, Homo sapiens
guuugaaucugaaugcuau

SEQ ID NO: 200866 - RNA, 19 nt, Homo sapiens
cagacgacguggugcagua

SEQ ID NO: 200867 - RNA, 19 nt, Homo sapiens
ggagaagccauaugugugu

SEQ ID NO: 200868 - RNA, 19 nt, Homo sapiens
cgucaacccugucgccauu

SEQ ID NO: 200869 - RNA, 19 nt, Homo sapiens
gaaucugaaugcuauacug

SEQ ID NO: 200870 - RNA, 19 nt, Homo sapiens
uggcugaccucaaggaaga

SEQ ID NO: 200871 - RNA, 19 nt, Homo sapiens
gugaugaugcgaugucuaa

SEQ ID NO: 200872 - RNA, 19 nt, Homo sapiens
gcaauggccgcuucagaug

SEQ ID NO: 200873 - RNA, 19 nt, Homo sapiens
cuaugaagccuaacucuug

SEQ ID NO: 200874 - RNA, 19 nt, Homo sapiens
ucagaugacagauguugua

SEQ ID NO: 200875 - RNA, 19 nt, Homo sapiens
gcgagaacguggcgaugga

SEQ ID NO: 200876 - RNA, 19 nt, Homo sapiens
gcccucaccuccaucaaug

SEQ ID NO: 200877 - RNA, 19 nt, Homo sapiens
ucaggagaguguauaugaa

SEQ ID NO: 200878 - RNA, 19 nt, Homo sapiens
uaugaagccuaacucuuga

SEQ ID NO: 200879 - RNA, 19 nt, Homo sapiens
gagaguguauaugaaugaa

SEQ ID NO: 200880 - RNA, 19 nt, Homo sapiens
ucuaacauaccuugucaua

SEQ ID NO: 200881 - RNA, 19 nt, Homo sapiens
gacagauguuguaagagaa

SEQ ID NO: 200882 - RNA, 19 nt, Homo sapiens
gcaacaaagccuucuccaa

SEQ ID NO: 200883 - RNA, 19 nt, Homo sapiens
gcacagauuauaccuggau

SEQ ID NO: 200884 - RNA, 19 nt, Homo sapiens
gaaugaggcaucagcaaca

SEQ ID NO: 200885 - RNA, 19 nt, Homo sapiens
gcaguggaaugaggcauca

SEQ ID NO: 200886 - RNA, 19 nt, Homo sapiens
caucugugaucaagaauac

SEQ ID NO: 200887 - RNA, 19 nt, Homo sapiens
gcaccaagagauacacaga

SEQ ID NO: 200888 - RNA, 19 nt, Homo sapiens
uggagaaccugaagacaca

SEQ ID NO: 200889 - RNA, 19 nt, Homo sapiens
aggcugagguggucaucua

SEQ ID NO: 200890 - RNA, 19 nt, Homo sapiens
gaaugaauaaggcauccaa

SEQ ID NO: 200891 - RNA, 19 nt, Homo sapiens
gaaggagaagcucaaguca

SEQ ID NO: 200892 - RNA, 19 nt, Homo sapiens
gcauccaaguauauaugaa

SEQ ID NO: 200893 - RNA, 19 nt, Homo sapiens
uaaggcauccaaguauaua

SEQ ID NO: 200894 - RNA, 19 nt, Homo sapiens
cauuuggguuugaaucuga

SEQ ID NO: 200895 - RNA, 19 nt, Homo sapiens
ucucuggucuuuuggauua

SEQ ID NO: 200896 - RNA, 19 nt, Homo sapiens
caaggcaccgcaucuguga

SEQ ID NO: 200897 - RNA, 19 nt, Homo sapiens
gagaagaaggaguuugugu

SEQ ID NO: 200898 - RNA, 19 nt, Homo sapiens
gauuauuccucagaacaau

SEQ ID NO: 200899 - RNA, 19 nt, Homo sapiens
gauuccagcugucuugucu

SEQ ID NO: 200900 - RNA, 19 nt, Homo sapiens
ggacugugaaagaaaguga

SEQ ID NO: 200901 - RNA, 19 nt, Homo sapiens
gagaagcucaagucacuca

SEQ ID NO: 200902 - RNA, 19 nt, Homo sapiens
gcuaacgagggauuacuuu

SEQ ID NO: 200903 - RNA, 19 nt, Homo sapiens
ggcauccucucuggucuuu

SEQ ID NO: 200904 - RNA, 19 nt, Homo sapiens
cacgagggcugcaacaaag

SEQ ID NO: 200905 - RNA, 19 nt, Homo sapiens
gggagaagaaggaguuugu

SEQ ID NO: 200906 - RNA, 19 nt, Homo sapiens
ggauuauuccucagaacaa

SEQ ID NO: 200907 - RNA, 19 nt, Homo sapiens
gaugagcggcugagaugga

SEQ ID NO: 200908 - RNA, 19 nt, Homo sapiens
gcaucugugaucaagaaua

SEQ ID NO: 200909 - RNA, 19 nt, Homo sapiens
aggagcagcuggugcauca

SEQ ID NO: 200910 - RNA, 19 nt, Homo sapiens
gcauuuggguuugaaucug

SEQ ID NO: 200911 - RNA, 19 nt, Homo sapiens
ucucuaacauaccuuguca

SEQ ID NO: 200912 - RNA, 19 nt, Homo sapiens
aagaauacaugugcugcuu

SEQ ID NO: 200913 - RNA, 19 nt, Homo sapiens
aggagaagcucaagucacu

SEQ ID NO: 200914 - RNA, 19 nt, Homo sapiens
ugaaugcuauacuggauac

SEQ ID NO: 200915 - RNA, 19 nt, Homo sapiens
gaaagaugguagggagcau

SEQ ID NO: 200916 - RNA, 19 nt, Homo sapiens
uuccagcugucuugucuuu

SEQ ID NO: 200917 - RNA, 19 nt, Homo sapiens
gcucaagucacucaaggau

SEQ ID NO: 200918 - RNA, 19 nt, Homo sapiens
uucguggacuccuacaaua

SEQ ID NO: 200919 - RNA, 19 nt, Homo sapiens
acagugcuuuccagccuuu

SEQ ID NO: 200920 - RNA, 19 nt, Homo sapiens
uguaagagaagguuuaugg

SEQ ID NO: 200921 - RNA, 19 nt, Homo sapiens
cagcugcgcaaacacauga

SEQ ID NO: 200922 - RNA, 19 nt, Homo sapiens
ugagugacaccaaccagaa

SEQ ID NO: 200923 - RNA, 19 nt, Homo sapiens
caauggccgcuucagauga

SEQ ID NO: 200924 - RNA, 19 nt, Homo sapiens
caccgcugcucaaagagaa

SEQ ID NO: 200925 - RNA, 19 nt, Homo sapiens
gcagcaacugucugaguga

SEQ ID NO: 200926 - RNA, 19 nt, Homo sapiens
caggagaguguauaugaau

SEQ ID NO: 200927 - RNA, 19 nt, Homo sapiens
cuugaggucucuaacauac

SEQ ID NO: 200928 - RNA, 19 nt, Homo sapiens
uaacgagggauuacuuugg

SEQ ID NO: 200929 - RNA, 19 nt, Homo sapiens
gcgcaauggccgcuucaga

SEQ ID NO: 200930 - RNA, 19 nt, Homo sapiens
gggagcauuuggguuugaa

SEQ ID NO: 200931 - RNA, 19 nt, Homo sapiens
guggacuccuacaauaaug

SEQ ID NO: 200932 - RNA, 19 nt, Homo sapiens
ucaagaaggagaagcucaa

SEQ ID NO: 200933 - RNA, 19 nt, Homo sapiens
gggaagacugcaccaagga

SEQ ID NO: 200934 - RNA, 19 nt, Homo sapiens
ucuacuacuuggaaggaaa

SEQ ID NO: 200935 - RNA, 19 nt, Homo sapiens
uuucaaaggauaugcagaa

SEQ ID NO: 200936 - RNA, 19 nt, Homo sapiens
cauaggacaggaaggaaug

SEQ ID NO: 200937 - RNA, 19 nt, Homo sapiens
ugaacaugaugaccuagag

SEQ ID NO: 200938 - RNA, 19 nt, Homo sapiens
caacgagaaacccuacauc

SEQ ID NO: 200939 - RNA, 19 nt, Homo sapiens
cgagaagcaagaagccaaa

SEQ ID NO: 200940 - RNA, 19 nt, Homo sapiens
agcgguagcugcccaagga

SEQ ID NO: 200941 - RNA, 19 nt, Homo sapiens
agaacaagcagagcaguga

SEQ ID NO: 200942 - RNA, 19 nt, Homo sapiens
guucguggacuccuacaau

SEQ ID NO: 200943 - RNA, 19 nt, Homo sapiens
gcacccacuccaacgagaa

SEQ ID NO: 200944 - RNA, 19 nt, Homo sapiens
gagcagcuggugcaucaca

SEQ ID NO: 200945 - RNA, 19 nt, Homo sapiens
uaacauaccuugucauaga

SEQ ID NO: 200946 - RNA, 19 nt, Homo sapiens
gaauacaugugcugcuuua

SEQ ID NO: 200947 - RNA, 19 nt, Homo sapiens
gcacaccgcugcucaaaga

SEQ ID NO: 200948 - RNA, 19 nt, Homo sapiens
caaaggauaugcagaaaga

SEQ ID NO: 200949 - RNA, 19 nt, Homo sapiens
gaugacagauguuguaaga

SEQ ID NO: 200950 - RNA, 19 nt, Homo sapiens
gauuauaccuggaugauuc

SEQ ID NO: 200951 - RNA, 19 nt, Homo sapiens
ugacagauguuguaagaga

SEQ ID NO: 200952 - RNA, 19 nt, Homo sapiens
gaauaaggcauccaaguau

SEQ ID NO: 200953 - RNA, 19 nt, Homo sapiens
ucaagucacucaaggauuc

SEQ ID NO: 200954 - RNA, 19 nt, Homo sapiens
ugaauaaggcauccaagua

SEQ ID NO: 200955 - RNA, 19 nt, Homo sapiens
gcaaacacaugaccaccau

SEQ ID NO: 200956 - RNA, 19 nt, Homo sapiens
gcacgagggcugcaacaaa

SEQ ID NO: 200957 - RNA, 19 nt, Homo sapiens
guagggagcauuuggguuu

SEQ ID NO: 200958 - RNA, 19 nt, Homo sapiens
aauaaggcauccaaguaua

SEQ ID NO: 200959 - RNA, 19 nt, Homo sapiens
caucaaagagcaaggauug

SEQ ID NO: 200960 - RNA, 19 nt, Homo sapiens
ccaagaagcagcgcaauga

SEQ ID NO: 200961 - RNA, 19 nt, Homo sapiens
ggacaggaaggaaugcaaa

SEQ ID NO: 200962 - RNA, 19 nt, Homo sapiens
gcacuggcuucucugacaa

SEQ ID NO: 200963 - RNA, 19 nt, Homo sapiens
ccgcaucugugaucaagaa

SEQ ID NO: 200964 - RNA, 19 nt, Homo sapiens
ggagaguguauaugaauga

SEQ ID NO: 200965 - RNA, 19 nt, Homo sapiens
guuugaaucugaaugcuau

SEQ ID NO: 200966 - RNA, 19 nt, Homo sapiens
cagacgacguggugcagua

SEQ ID NO: 200967 - RNA, 19 nt, Homo sapiens
ggagaagccauaugugugu

SEQ ID NO: 200968 - RNA, 19 nt, Homo sapiens
cgucaacccugucgccauu

SEQ ID NO: 200969 - RNA, 19 nt, Homo sapiens
gaaucugaaugcuauacug

SEQ ID NO: 200970 - RNA, 19 nt, Homo sapiens
uggcugaccucaaggaaga

SEQ ID NO: 200971 - RNA, 19 nt, Homo sapiens
gugaugaugcgaugucuaa

SEQ ID NO: 200972 - RNA, 19 nt, Homo sapiens
gcaauggccgcuucagaug

SEQ ID NO: 200973 - RNA, 19 nt, Homo sapiens
cuaugaagccuaacucuug

SEQ ID NO: 200974 - RNA, 19 nt, Homo sapiens
ucagaugacagauguugua

SEQ ID NO: 200975 - RNA, 19 nt, Homo sapiens
gcgagaacguggcgaugga

SEQ ID NO: 200976 - RNA, 19 nt, Homo sapiens
gcccucaccuccaucaaug

SEQ ID NO: 200977 - RNA, 19 nt, Homo sapiens
ucaggagaguguauaugaa

SEQ ID NO: 200978 - RNA, 19 nt, Homo sapiens
uaugaagccuaacucuuga

SEQ ID NO: 200979 - RNA, 19 nt, Homo sapiens
ggcgaucacucgaguuugu

SEQ ID NO: 200980 - RNA, 19 nt, Homo sapiens
gagaguguauaugaaugaa

SEQ ID NO: 200981 - RNA, 19 nt, Homo sapiens
ucuaacauaccuugucaua

SEQ ID NO: 200982 - RNA, 19 nt, Homo sapiens
gacagauguuguaagagaa

SEQ ID NO: 200983 - RNA, 19 nt, Homo sapiens
acagcaugcucuacuacua

SEQ ID NO: 200984 - RNA, 19 nt, Homo sapiens
gcaacaaagccuucuccaa

SEQ ID NO: 200985 - RNA, 19 nt, Homo sapiens
gcacagauuauaccuggau

SEQ ID NO: 200986 - RNA, 19 nt, Homo sapiens
caucugugaucaagaauac

SEQ ID NO: 200987 - RNA, 19 nt, Homo sapiens
gcaccaagagauacacaga

SEQ ID NO: 200988 - RNA, 19 nt, Homo sapiens
uggagaaccugaagacaca

SEQ ID NO: 200989 - RNA, 19 nt, Homo sapiens
aggcugagguggucaucua

SEQ ID NO: 200990 - RNA, 19 nt, Homo sapiens
gaaugaauaaggcauccaa

SEQ ID NO: 200991 - RNA, 19 nt, Homo sapiens
gaaggagaagcucaaguca

SEQ ID NO: 200992 - RNA, 19 nt, Homo sapiens
gcauccaaguauauaugaa

SEQ ID NO: 200993 - RNA, 19 nt, Homo sapiens
uaaggcauccaaguauaua

SEQ ID NO: 200994 - RNA, 19 nt, Homo sapiens
caaggcaccgcaucuguga

SEQ ID NO: 200995 - RNA, 19 nt, Homo sapiens
cauuuggguuugaaucuga

SEQ ID NO: 200996 - RNA, 19 nt, Homo sapiens
ucucuggucuuuuggauua

SEQ ID NO: 200997 - RNA, 19 nt, Homo sapiens
gagaagaaggaguuugugu

SEQ ID NO: 200998 - RNA, 19 nt, Homo sapiens
gauuauuccucagaacaau

SEQ ID NO: 200999 - RNA, 19 nt, Homo sapiens
gauuccagcugucuugucu

SEQ ID NO: 201000 - RNA, 19 nt, Homo sapiens
ggacugugaaagaaaguga

SEQ ID NO: 201001 - RNA, 19 nt, Homo sapiens
gagaagcucaagucacuca

SEQ ID NO: 201002 - RNA, 19 nt, Homo sapiens
gcuaacgagggauuacuuu

SEQ ID NO: 201003 - RNA, 19 nt, Homo sapiens
ggcauccucucuggucuuu

SEQ ID NO: 201004 - RNA, 19 nt, Homo sapiens
cacgagggcugcaacaaag

SEQ ID NO: 201005 - RNA, 19 nt, Homo sapiens
gggagaagaaggaguuugu

SEQ ID NO: 201006 - RNA, 19 nt, Homo sapiens
ggauuauuccucagaacaa

SEQ ID NO: 201007 - RNA, 19 nt, Homo sapiens
gaugagcggcugagaugga

SEQ ID NO: 201008 - RNA, 19 nt, Homo sapiens
gcaucugugaucaagaaua

SEQ ID NO: 201009 - RNA, 19 nt, Homo sapiens
aggagcagcuggugcauca

SEQ ID NO: 201010 - RNA, 19 nt, Homo sapiens
gcauuuggguuugaaucug

SEQ ID NO: 201011 - RNA, 19 nt, Homo sapiens
ucucuaacauaccuuguca

SEQ ID NO: 201012 - RNA, 19 nt, Homo sapiens
aagaauacaugugcugcuu

SEQ ID NO: 201013 - RNA, 19 nt, Homo sapiens
aggagaagcucaagucacu

SEQ ID NO: 201014 - RNA, 19 nt, Homo sapiens
ugaaugcuauacuggauac

SEQ ID NO: 201015 - RNA, 19 nt, Homo sapiens
gaaagaugguagggagcau

SEQ ID NO: 201016 - RNA, 19 nt, Homo sapiens
ccacauguacgaacaggau

SEQ ID NO: 201017 - RNA, 19 nt, Homo sapiens
uuccagcugucuugucuuu

SEQ ID NO: 201018 - RNA, 19 nt, Homo sapiens
gcucaagucacucaaggau

SEQ ID NO: 201019 - RNA, 19 nt, Homo sapiens
uucguggacuccuacaaua

SEQ ID NO: 201020 - RNA, 19 nt, Homo sapiens
acagugcuuuccagccuuu

SEQ ID NO: 201021 - RNA, 19 nt, Homo sapiens
uguaagagaagguuuaugg

SEQ ID NO: 201022 - RNA, 19 nt, Homo sapiens
uggcaugacuaccacuaug

SEQ ID NO: 201023 - RNA, 19 nt, Homo sapiens
cagcugcgcaaacacauga

SEQ ID NO: 201024 - RNA, 19 nt, Homo sapiens
ugagugacaccaaccagaa

SEQ ID NO: 201025 - RNA, 19 nt, Homo sapiens
caauggccgcuucagauga

SEQ ID NO: 201026 - RNA, 19 nt, Homo sapiens
caccgcugcucaaagagaa

SEQ ID NO: 201027 - RNA, 19 nt, Homo sapiens
gcagcaacugucugaguga

SEQ ID NO: 201028 - RNA, 19 nt, Homo sapiens
caggagaguguauaugaau

SEQ ID NO: 201029 - RNA, 19 nt, Homo sapiens
cuugaggucucuaacauac

SEQ ID NO: 201030 - RNA, 19 nt, Homo sapiens
uaacgagggauuacuuugg

SEQ ID NO: 201031 - RNA, 19 nt, Homo sapiens
gcgcaauggccgcuucaga

SEQ ID NO: 201032 - RNA, 19 nt, Homo sapiens
gggagcauuuggguuugaa

SEQ ID NO: 201033 - RNA, 19 nt, Homo sapiens
guggacuccuacaauaaug

SEQ ID NO: 201034 - RNA, 19 nt, Homo sapiens
ggcaugacuaccacuauga

SEQ ID NO: 201035 - RNA, 19 nt, Homo sapiens
ucaagaaggagaagcucaa

SEQ ID NO: 201036 - RNA, 19 nt, Homo sapiens
gggaagacugcaccaagga

SEQ ID NO: 201037 - RNA, 19 nt, Homo sapiens
ucuacuacuuggaaggaaa

SEQ ID NO: 201038 - RNA, 19 nt, Homo sapiens
uuucaaaggauaugcagaa

SEQ ID NO: 201039 - RNA, 19 nt, Homo sapiens
cauaggacaggaaggaaug

SEQ ID NO: 201040 - RNA, 19 nt, Homo sapiens
agcgguagcugcccaagga

SEQ ID NO: 201041 - RNA, 19 nt, Homo sapiens
cgagaagcaagaagccaaa

SEQ ID NO: 201042 - RNA, 19 nt, Homo sapiens
ugaacaugaugaccuagag

SEQ ID NO: 201043 - RNA, 19 nt, Homo sapiens
caacgagaaacccuacauc

SEQ ID NO: 201044 - RNA, 19 nt, Homo sapiens
agaacaagcagagcaguga

SEQ ID NO: 201045 - RNA, 19 nt, Homo sapiens
uaacauaccuugucauaga

SEQ ID NO: 201046 - RNA, 19 nt, Homo sapiens
gaauacaugugcugcuuua

SEQ ID NO: 201047 - RNA, 19 nt, Homo sapiens
gcacaccgcugcucaaaga

SEQ ID NO: 201048 - RNA, 19 nt, Homo sapiens
caaaggauaugcagaaaga

SEQ ID NO: 201049 - RNA, 19 nt, Homo sapiens
gaugacagauguuguaaga

SEQ ID NO: 201050 - RNA, 19 nt, Homo sapiens
gauuauaccuggaugauuc

SEQ ID NO: 201051 - RNA, 19 nt, Homo sapiens
ugacagauguuguaagaga

SEQ ID NO: 201052 - RNA, 19 nt, Homo sapiens
gaauaaggcauccaaguau

SEQ ID NO: 201053 - RNA, 19 nt, Homo sapiens
ucaagucacucaaggauuc

SEQ ID NO: 201054 - RNA, 19 nt, Homo sapiens
ugaauaaggcauccaagua

SEQ ID NO: 201055 - RNA, 19 nt, Homo sapiens
gcaaacacaugaccaccau

SEQ ID NO: 201056 - RNA, 19 nt, Homo sapiens
gcacgagggcugcaacaaa

SEQ ID NO: 201057 - RNA, 19 nt, Homo sapiens
guagggagcauuuggguuu

SEQ ID NO: 201058 - RNA, 19 nt, Homo sapiens
aauaaggcauccaaguaua

SEQ ID NO: 201059 - RNA, 19 nt, Homo sapiens
caucaaagagcaaggauug

SEQ ID NO: 201060 - RNA, 19 nt, Homo sapiens
ccaagaagcagcgcaauga

SEQ ID NO: 201061 - RNA, 19 nt, Homo sapiens
ggacaggaaggaaugcaaa

SEQ ID NO: 201062 - RNA, 19 nt, Homo sapiens
gcacuggcuucucugacaa

SEQ ID NO: 201063 - RNA, 19 nt, Homo sapiens
ccgcaucugugaucaagaa

SEQ ID NO: 201064 - RNA, 19 nt, Homo sapiens
ggagaguguauaugaauga

SEQ ID NO: 201065 - RNA, 19 nt, Homo sapiens
guuugaaucugaaugcuau

SEQ ID NO: 201066 - RNA, 19 nt, Homo sapiens
cagacgacguggugcagua

SEQ ID NO: 201067 - RNA, 19 nt, Homo sapiens
ggagaagccauaugugugu

SEQ ID NO: 201068 - RNA, 19 nt, Homo sapiens
cgucaacccugucgccauu

SEQ ID NO: 201069 - RNA, 19 nt, Homo sapiens
gaaucugaaugcuauacug

SEQ ID NO: 201070 - RNA, 19 nt, Homo sapiens
uggcugaccucaaggaaga

SEQ ID NO: 201071 - RNA, 19 nt, Homo sapiens
gugaugaugcgaugucuaa

SEQ ID NO: 201072 - RNA, 19 nt, Homo sapiens
gcaauggccgcuucagaug

SEQ ID NO: 201073 - RNA, 19 nt, Homo sapiens
cuaugaagccuaacucuug

SEQ ID NO: 201074 - RNA, 19 nt, Homo sapiens
ucagaugacagauguugua

SEQ ID NO: 201075 - RNA, 19 nt, Homo sapiens
gcgagaacguggcgaugga

SEQ ID NO: 201076 - RNA, 19 nt, Homo sapiens
gcccucaccuccaucaaug

SEQ ID NO: 201077 - RNA, 19 nt, Homo sapiens
ucaggagaguguauaugaa

SEQ ID NO: 201078 - RNA, 19 nt, Homo sapiens
uaugaagccuaacucuuga

SEQ ID NO: 201079 - RNA, 19 nt, Homo sapiens
ggcgaucacucgaguuugu

SEQ ID NO: 201080 - RNA, 19 nt, Homo sapiens
gagaguguauaugaaugaa

SEQ ID NO: 201081 - RNA, 19 nt, Homo sapiens
ucuaacauaccuugucaua

SEQ ID NO: 201082 - RNA, 19 nt, Homo sapiens
gacagauguuguaagagaa

SEQ ID NO: 201083 - RNA, 19 nt, Homo sapiens
acagcaugcucuacuacua

SEQ ID NO: 201084 - RNA, 19 nt, Homo sapiens
gcaacaaagccuucuccaa

SEQ ID NO: 201085 - RNA, 19 nt, Homo sapiens
gcacagauuauaccuggau

SEQ ID NO: 201086 - RNA, 19 nt, Homo sapiens
caucugugaucaagaauac

SEQ ID NO: 201087 - RNA, 19 nt, Homo sapiens
gcaccaagagauacacaga

SEQ ID NO: 201088 - RNA, 19 nt, Homo sapiens
uggagaaccugaagacaca

SEQ ID NO: 201089 - RNA, 19 nt, Homo sapiens
aggcugagguggucaucua

SEQ ID NO: 201090 - RNA, 19 nt, Homo sapiens
gaaugaauaaggcauccaa

SEQ ID NO: 201091 - RNA, 19 nt, Homo sapiens
gaaggagaagcucaaguca

SEQ ID NO: 201092 - RNA, 19 nt, Homo sapiens
gcauccaaguauauaugaa

SEQ ID NO: 201093 - RNA, 19 nt, Homo sapiens
uaaggcauccaaguauaua

SEQ ID NO: 201094 - RNA, 19 nt, Homo sapiens
caaggcaccgcaucuguga

SEQ ID NO: 201095 - RNA, 19 nt, Homo sapiens
cauuuggguuugaaucuga

SEQ ID NO: 201096 - RNA, 19 nt, Homo sapiens
ucucuggucuuuuggauua

SEQ ID NO: 201097 - RNA, 19 nt, Homo sapiens
gagaagaaggaguuugugu

SEQ ID NO: 201098 - RNA, 19 nt, Homo sapiens
gauuauuccucagaacaau

SEQ ID NO: 201099 - RNA, 19 nt, Homo sapiens
gauuccagcugucuugucu

SEQ ID NO: 201100 - RNA, 19 nt, Homo sapiens
ggacugugaaagaaaguga

SEQ ID NO: 201101 - RNA, 19 nt, Homo sapiens
gagaagcucaagucacuca

SEQ ID NO: 201102 - RNA, 19 nt, Homo sapiens
gcuaacgagggauuacuuu

SEQ ID NO: 201103 - RNA, 19 nt, Homo sapiens
ggcauccucucuggucuuu

SEQ ID NO: 201104 - RNA, 19 nt, Homo sapiens
cacgagggcugcaacaaag

SEQ ID NO: 201105 - RNA, 19 nt, Homo sapiens
gggagaagaaggaguuugu

SEQ ID NO: 201106 - RNA, 19 nt, Homo sapiens
ggauuauuccucagaacaa

SEQ ID NO: 201107 - RNA, 19 nt, Homo sapiens
gaugagcggcugagaugga

SEQ ID NO: 201108 - RNA, 19 nt, Homo sapiens
gcaucugugaucaagaaua

SEQ ID NO: 201109 - RNA, 19 nt, Homo sapiens
aggagcagcuggugcauca

SEQ ID NO: 201110 - RNA, 19 nt, Homo sapiens
gcauuuggguuugaaucug

SEQ ID NO: 201111 - RNA, 19 nt, Homo sapiens
ucucuaacauaccuuguca

SEQ ID NO: 201112 - RNA, 19 nt, Homo sapiens
aagaauacaugugcugcuu

SEQ ID NO: 201113 - RNA, 19 nt, Homo sapiens
aggagaagcucaagucacu

SEQ ID NO: 201114 - RNA, 19 nt, Homo sapiens
ugaaugcuauacuggauac

SEQ ID NO: 201115 - RNA, 19 nt, Homo sapiens
gaaagaugguagggagcau

SEQ ID NO: 201116 - RNA, 19 nt, Homo sapiens
ccacauguacgaacaggau

SEQ ID NO: 201117 - RNA, 19 nt, Homo sapiens
uuccagcugucuugucuuu

SEQ ID NO: 201118 - RNA, 19 nt, Homo sapiens
gcucaagucacucaaggau

SEQ ID NO: 201119 - RNA, 19 nt, Homo sapiens
uucguggacuccuacaaua

SEQ ID NO: 201120 - RNA, 19 nt, Homo sapiens
acagugcuuuccagccuuu

SEQ ID NO: 201121 - RNA, 19 nt, Homo sapiens
uguaagagaagguuuaugg

SEQ ID NO: 201122 - RNA, 19 nt, Homo sapiens
uggcaugacuaccacuaug

SEQ ID NO: 201123 - RNA, 19 nt, Homo sapiens
cagcugcgcaaacacauga

SEQ ID NO: 201124 - RNA, 19 nt, Homo sapiens
ugagugacaccaaccagaa

SEQ ID NO: 201125 - RNA, 19 nt, Homo sapiens
caauggccgcuucagauga

SEQ ID NO: 201126 - RNA, 19 nt, Homo sapiens
caccgcugcucaaagagaa

SEQ ID NO: 201127 - RNA, 19 nt, Homo sapiens
gcagcaacugucugaguga

SEQ ID NO: 201128 - RNA, 19 nt, Homo sapiens
caggagaguguauaugaau

SEQ ID NO: 201129 - RNA, 19 nt, Homo sapiens
cuugaggucucuaacauac

SEQ ID NO: 201130 - RNA, 19 nt, Homo sapiens
uaacgagggauuacuuugg

SEQ ID NO: 201131 - RNA, 19 nt, Homo sapiens
gcgcaauggccgcuucaga

SEQ ID NO: 201132 - RNA, 19 nt, Homo sapiens
gggagcauuuggguuugaa

SEQ ID NO: 201133 - RNA, 19 nt, Homo sapiens
guggacuccuacaauaaug

SEQ ID NO: 201134 - RNA, 19 nt, Homo sapiens
ggcaugacuaccacuauga

SEQ ID NO: 201135 - RNA, 19 nt, Homo sapiens
ucaagaaggagaagcucaa

SEQ ID NO: 201136 - RNA, 19 nt, Homo sapiens
gggaagacugcaccaagga

SEQ ID NO: 201137 - RNA, 19 nt, Homo sapiens
ucuacuacuuggaaggaaa

SEQ ID NO: 201138 - RNA, 19 nt, Homo sapiens
uuucaaaggauaugcagaa

SEQ ID NO: 201139 - RNA, 19 nt, Homo sapiens
cauaggacaggaaggaaug

SEQ ID NO: 201140 - RNA, 19 nt, Homo sapiens
agcgguagcugcccaagga

SEQ ID NO: 201141 - RNA, 19 nt, Homo sapiens
cgagaagcaagaagccaaa

SEQ ID NO: 201142 - RNA, 19 nt, Homo sapiens
ugaacaugaugaccuagag

SEQ ID NO: 201143 - RNA, 19 nt, Homo sapiens
caacgagaaacccuacauc

SEQ ID NO: 201144 - RNA, 19 nt, Homo sapiens
agaacaagcagagcaguga

SEQ ID NO: 201145 - RNA, 19 nt, Homo sapiens
uaacauaccuugucauaga

SEQ ID NO: 201146 - RNA, 19 nt, Homo sapiens
gaauacaugugcugcuuua

SEQ ID NO: 201147 - RNA, 19 nt, Homo sapiens
gcacaccgcugcucaaaga

SEQ ID NO: 201148 - RNA, 19 nt, Homo sapiens
caaaggauaugcagaaaga

SEQ ID NO: 201149 - RNA, 19 nt, Homo sapiens
gaugacagauguuguaaga

SEQ ID NO: 201150 - RNA, 19 nt, Homo sapiens
gauuauaccuggaugauuc

SEQ ID NO: 201151 - RNA, 19 nt, Homo sapiens
ugacagauguuguaagaga

SEQ ID NO: 201152 - RNA, 19 nt, Homo sapiens
gaauaaggcauccaaguau

SEQ ID NO: 201153 - RNA, 19 nt, Homo sapiens
ucaagucacucaaggauuc

SEQ ID NO: 201154 - RNA, 19 nt, Homo sapiens
ugaauaaggcauccaagua

SEQ ID NO: 201155 - RNA, 19 nt, Homo sapiens
gcaaacacaugaccaccau

SEQ ID NO: 201156 - RNA, 19 nt, Homo sapiens
gcacgagggcugcaacaaa

SEQ ID NO: 201157 - RNA, 19 nt, Homo sapiens
guagggagcauuuggguuu

SEQ ID NO: 201158 - RNA, 19 nt, Homo sapiens
aauaaggcauccaaguaua

SEQ ID NO: 201159 - RNA, 19 nt, Homo sapiens
caucaaagagcaaggauug

SEQ ID NO: 201160 - RNA, 19 nt, Homo sapiens
ccaagaagcagcgcaauga

SEQ ID NO: 201161 - RNA, 19 nt, Homo sapiens
ggacaggaaggaaugcaaa

SEQ ID NO: 201162 - RNA, 19 nt, Homo sapiens
gcacuggcuucucugacaa

SEQ ID NO: 201163 - RNA, 19 nt, Homo sapiens
ccgcaucugugaucaagaa

SEQ ID NO: 201164 - RNA, 19 nt, Homo sapiens
ggagaguguauaugaauga

SEQ ID NO: 201165 - RNA, 19 nt, Homo sapiens
guuugaaucugaaugcuau

SEQ ID NO: 201166 - RNA, 19 nt, Homo sapiens
cagacgacguggugcagua

SEQ ID NO: 201167 - RNA, 19 nt, Homo sapiens
ggagaagccauaugugugu

SEQ ID NO: 201168 - RNA, 19 nt, Homo sapiens
cgucaacccugucgccauu

SEQ ID NO: 201169 - RNA, 19 nt, Homo sapiens
gaaucugaaugcuauacug

SEQ ID NO: 201170 - RNA, 19 nt, Homo sapiens
uggcugaccucaaggaaga

SEQ ID NO: 201171 - RNA, 19 nt, Homo sapiens
gugaugaugcgaugucuaa

SEQ ID NO: 201172 - RNA, 19 nt, Homo sapiens
gcaauggccgcuucagaug

SEQ ID NO: 201173 - RNA, 19 nt, Homo sapiens
cuaugaagccuaacucuug

SEQ ID NO: 201174 - RNA, 19 nt, Homo sapiens
ucagaugacagauguugua

SEQ ID NO: 201175 - RNA, 19 nt, Homo sapiens
gcgagaacguggcgaugga

SEQ ID NO: 201176 - RNA, 19 nt, Homo sapiens
gcccucaccuccaucaaug

SEQ ID NO: 201177 - RNA, 19 nt, Homo sapiens
ucaggagaguguauaugaa

SEQ ID NO: 201178 - RNA, 19 nt, Homo sapiens
uaugaagccuaacucuuga

SEQ ID NO: 201179 - RNA, 19 nt, Homo sapiens
gagaguguauaugaaugaa

SEQ ID NO: 201180 - RNA, 19 nt, Homo sapiens
ucuaacauaccuugucaua

SEQ ID NO: 201181 - RNA, 19 nt, Homo sapiens
gacagauguuguaagagaa

SEQ ID NO: 201182 - RNA, 19 nt, Homo sapiens
gcaacaaagccuucuccaa

SEQ ID NO: 201183 - RNA, 19 nt, Homo sapiens
gcacagauuauaccuggau

SEQ ID NO: 201184 - RNA, 19 nt, Homo sapiens
gaaugaggcaucagcaaca

SEQ ID NO: 201185 - RNA, 19 nt, Homo sapiens
gcaguggaaugaggcauca

SEQ ID NO: 201186 - RNA, 19 nt, Homo sapiens
caucugugaucaagaauac

SEQ ID NO: 201187 - RNA, 19 nt, Homo sapiens
gcaccaagagauacacaga

SEQ ID NO: 201188 - RNA, 19 nt, Homo sapiens
uggagaaccugaagacaca

SEQ ID NO: 201189 - RNA, 19 nt, Homo sapiens
aggcugagguggucaucua

SEQ ID NO: 201190 - RNA, 19 nt, Homo sapiens
gaaugaauaaggcauccaa

SEQ ID NO: 201191 - RNA, 19 nt, Homo sapiens
gaaggagaagcucaaguca

SEQ ID NO: 201192 - RNA, 19 nt, Homo sapiens
gcauccaaguauauaugaa

SEQ ID NO: 201193 - RNA, 19 nt, Homo sapiens
uaaggcauccaaguauaua

SEQ ID NO: 201194 - RNA, 19 nt, Homo sapiens
cauuuggguuugaaucuga

SEQ ID NO: 201195 - RNA, 19 nt, Homo sapiens
ucucuggucuuuuggauua

SEQ ID NO: 201196 - RNA, 19 nt, Homo sapiens
caaggcaccgcaucuguga

SEQ ID NO: 201197 - RNA, 19 nt, Homo sapiens
gagaagaaggaguuugugu

SEQ ID NO: 201198 - RNA, 19 nt, Homo sapiens
gauuauuccucagaacaau

SEQ ID NO: 201199 - RNA, 19 nt, Homo sapiens
gauuccagcugucuugucu

SEQ ID NO: 201200 - RNA, 19 nt, Homo sapiens
ggacugugaaagaaaguga

SEQ ID NO: 201201 - RNA, 19 nt, Homo sapiens
gagaagcucaagucacuca

SEQ ID NO: 201202 - RNA, 19 nt, Homo sapiens
gcuaacgagggauuacuuu

SEQ ID NO: 201203 - RNA, 19 nt, Homo sapiens
ggcauccucucuggucuuu

SEQ ID NO: 201204 - RNA, 19 nt, Homo sapiens
cacgagggcugcaacaaag

SEQ ID NO: 201205 - RNA, 19 nt, Homo sapiens
gggagaagaaggaguuugu

SEQ ID NO: 201206 - RNA, 19 nt, Homo sapiens
ggauuauuccucagaacaa

SEQ ID NO: 201207 - RNA, 19 nt, Homo sapiens
gaugagcggcugagaugga

SEQ ID NO: 201208 - RNA, 19 nt, Homo sapiens
gcaucugugaucaagaaua

SEQ ID NO: 201209 - RNA, 19 nt, Homo sapiens
aggagcagcuggugcauca

SEQ ID NO: 201210 - RNA, 19 nt, Homo sapiens
gcauuuggguuugaaucug

SEQ ID NO: 201211 - RNA, 19 nt, Homo sapiens
ucucuaacauaccuuguca

SEQ ID NO: 201212 - RNA, 19 nt, Homo sapiens
aagaauacaugugcugcuu

SEQ ID NO: 201213 - RNA, 19 nt, Homo sapiens
aggagaagcucaagucacu

SEQ ID NO: 201214 - RNA, 19 nt, Homo sapiens
ugaaugcuauacuggauac

SEQ ID NO: 201215 - RNA, 19 nt, Homo sapiens
gaaagaugguagggagcau

SEQ ID NO: 201216 - RNA, 19 nt, Homo sapiens
uuccagcugucuugucuuu

SEQ ID NO: 201217 - RNA, 19 nt, Homo sapiens
gcucaagucacucaaggau

SEQ ID NO: 201218 - RNA, 19 nt, Homo sapiens
uucguggacuccuacaaua

SEQ ID NO: 201219 - RNA, 19 nt, Homo sapiens
acagugcuuuccagccuuu

SEQ ID NO: 201220 - RNA, 19 nt, Homo sapiens
uguaagagaagguuuaugg

SEQ ID NO: 201221 - RNA, 19 nt, Homo sapiens
cagcugcgcaaacacauga

SEQ ID NO: 201222 - RNA, 19 nt, Homo sapiens
ugagugacaccaaccagaa

SEQ ID NO: 201223 - RNA, 19 nt, Homo sapiens
caauggccgcuucagauga

SEQ ID NO: 201224 - RNA, 19 nt, Homo sapiens
caccgcugcucaaagagaa

SEQ ID NO: 201225 - RNA, 19 nt, Homo sapiens
gcagcaacugucugaguga

SEQ ID NO: 201226 - RNA, 19 nt, Homo sapiens
caggagaguguauaugaau

SEQ ID NO: 201227 - RNA, 19 nt, Homo sapiens
cuugaggucucuaacauac

SEQ ID NO: 201228 - RNA, 19 nt, Homo sapiens
uaacgagggauuacuuugg

SEQ ID NO: 201229 - RNA, 19 nt, Homo sapiens
gcgcaauggccgcuucaga

SEQ ID NO: 201230 - RNA, 19 nt, Homo sapiens
gggagcauuuggguuugaa

SEQ ID NO: 201231 - RNA, 19 nt, Homo sapiens
guggacuccuacaauaaug

SEQ ID NO: 201232 - RNA, 19 nt, Homo sapiens
ucaagaaggagaagcucaa

SEQ ID NO: 201233 - RNA, 19 nt, Homo sapiens
gggaagacugcaccaagga

SEQ ID NO: 201234 - RNA, 19 nt, Homo sapiens
ucuacuacuuggaaggaaa

SEQ ID NO: 201235 - RNA, 19 nt, Homo sapiens
uuucaaaggauaugcagaa

SEQ ID NO: 201236 - RNA, 19 nt, Homo sapiens
cauaggacaggaaggaaug

SEQ ID NO: 201237 - RNA, 19 nt, Homo sapiens
ugaacaugaugaccuagag

SEQ ID NO: 201238 - RNA, 19 nt, Homo sapiens
caacgagaaacccuacauc

SEQ ID NO: 201239 - RNA, 19 nt, Homo sapiens
cgagaagcaagaagccaaa

SEQ ID NO: 201240 - RNA, 19 nt, Homo sapiens
agcgguagcugcccaagga

SEQ ID NO: 201241 - RNA, 19 nt, Homo sapiens
agaacaagcagagcaguga

SEQ ID NO: 201242 - RNA, 19 nt, Homo sapiens
guucguggacuccuacaau

SEQ ID NO: 201243 - RNA, 19 nt, Homo sapiens
gcacccacuccaacgagaa

SEQ ID NO: 201244 - RNA, 19 nt, Homo sapiens
gagcagcuggugcaucaca

SEQ ID NO: 201245 - RNA, 19 nt, Homo sapiens
gaagagagcugaaguaaug

SEQ ID NO: 201246 - RNA, 19 nt, Homo sapiens
ggacaaagaugaaagcaaa

SEQ ID NO: 201247 - RNA, 19 nt, Homo sapiens
caacaaggcuuucucaaau

SEQ ID NO: 201248 - RNA, 19 nt, Homo sapiens
gcauaugacuuccgccuua

SEQ ID NO: 201249 - RNA, 19 nt, Homo sapiens
gagaaacugucuuccauuu

SEQ ID NO: 201250 - RNA, 19 nt, Homo sapiens
gagcuuagguucagccuuu

SEQ ID NO: 201251 - RNA, 19 nt, Homo sapiens
gaacagaugugagcgagaa

SEQ ID NO: 201252 - RNA, 19 nt, Homo sapiens
gcacgaagguugcaacaag

SEQ ID NO: 201253 - RNA, 19 nt, Homo sapiens
gaauuacucuggucaguuc

SEQ ID NO: 201254 - RNA, 19 nt, Homo sapiens
gcacuaagcguuacacaga

SEQ ID NO: 201255 - RNA, 19 nt, Homo sapiens
gcaauaggcuuuaggaaaa

SEQ ID NO: 201256 - RNA, 19 nt, Homo sapiens
ggaaacaugugaagacagu

SEQ ID NO: 201257 - RNA, 19 nt, Homo sapiens
gcaacaaggcuuucucaaa

SEQ ID NO: 201258 - RNA, 19 nt, Homo sapiens
ggacacagcccuccacuca

SEQ ID NO: 201259 - RNA, 19 nt, Homo sapiens
gaagaaacgcaaucacuau

SEQ ID NO: 201260 - RNA, 19 nt, Homo sapiens
gcgagaagccucacaaaug

SEQ ID NO: 201261 - RNA, 19 nt, Homo sapiens
gcagaauacuaucaucaga

SEQ ID NO: 201262 - RNA, 19 nt, Homo sapiens
ccacaucccuacauuaauc

SEQ ID NO: 201263 - RNA, 19 nt, Homo sapiens
cacgaaagcugguucauuc

SEQ ID NO: 201264 - RNA, 19 nt, Homo sapiens
uggaauaucuucaugcuau

SEQ ID NO: 201265 - RNA, 19 nt, Homo sapiens
acaagugaauggaauguuu

SEQ ID NO: 201266 - RNA, 19 nt, Homo sapiens
uaacugagauguguuucaa

SEQ ID NO: 201267 - RNA, 19 nt, Homo sapiens
caacagagcuuagguucag

SEQ ID NO: 201268 - RNA, 19 nt, Homo sapiens
ucacgauucucaauaauuc

SEQ ID NO: 201269 - RNA, 19 nt, Homo sapiens
gaaaccauaugugugcaaa

SEQ ID NO: 201270 - RNA, 19 nt, Homo sapiens
gcaaucucaucucaccuaa

SEQ ID NO: 201271 - RNA, 19 nt, Homo sapiens
caaauuccuugcaguuaug

SEQ ID NO: 201272 - RNA, 19 nt, Homo sapiens
gaccugcccuucauuagga

SEQ ID NO: 201273 - RNA, 19 nt, Homo sapiens
cgacagccaugaccuggaa

SEQ ID NO: 201274 - RNA, 19 nt, Homo sapiens
aauaggaguugaagagauu

SEQ ID NO: 201275 - RNA, 19 nt, Homo sapiens
gcugguucauucucuauuu

SEQ ID NO: 201276 - RNA, 19 nt, Homo sapiens
ggaaguggcaccaguggaa

SEQ ID NO: 201277 - RNA, 19 nt, Homo sapiens
gggagaaacugucuuccau

SEQ ID NO: 201278 - RNA, 19 nt, Homo sapiens
gagauuaaacugacuuugu

SEQ ID NO: 201279 - RNA, 19 nt, Homo sapiens
guugagaauuccauaguga

SEQ ID NO: 201280 - RNA, 19 nt, Homo sapiens
gaaagcugguucauucucu

SEQ ID NO: 201281 - RNA, 19 nt, Homo sapiens
guaucaagauggagaugaa

SEQ ID NO: 201282 - RNA, 19 nt, Homo sapiens
aaaccgaccugcccauuca

SEQ ID NO: 201283 - RNA, 19 nt, Homo sapiens
gaaacgcaaucacuaugca

SEQ ID NO: 201284 - RNA, 19 nt, Homo sapiens
ccucauugaucaagaaaga

SEQ ID NO: 201285 - RNA, 19 nt, Homo sapiens
gcccaaguaucauucagaa

SEQ ID NO: 201286 - RNA, 19 nt, Homo sapiens
ccacagcccuugcuuugca

SEQ ID NO: 201287 - RNA, 19 nt, Homo sapiens
gagcugaaguaaugagaag

SEQ ID NO: 201288 - RNA, 19 nt, Homo sapiens
cgagaagccucacaaaugc

SEQ ID NO: 201289 - RNA, 19 nt, Homo sapiens
gaucaaacccgaugaagac

SEQ ID NO: 201290 - RNA, 19 nt, Homo sapiens
gcccaucgcucuccaugau

SEQ ID NO: 201291 - RNA, 19 nt, Homo sapiens
gcccugagcccaaguauca

SEQ ID NO: 201292 - RNA, 19 nt, Homo sapiens
gcaaucagcccugccuuga

SEQ ID NO: 201293 - RNA, 19 nt, Homo sapiens
ucaccacucuccgaucaua

SEQ ID NO: 201294 - RNA, 19 nt, Homo sapiens
ccucacacaucaacaucua

SEQ ID NO: 201295 - RNA, 19 nt, Homo sapiens
gaaacgccuuccaugaaca

SEQ ID NO: 201296 - RNA, 19 nt, Homo sapiens
aacaagagguccaagauca

SEQ ID NO: 201297 - RNA, 19 nt, Homo sapiens
gaaguaaugagaagacauc

SEQ ID NO: 201298 - RNA, 19 nt, Homo sapiens
gcagaugcuugggcagauu

SEQ ID NO: 201299 - RNA, 19 nt, Homo sapiens
aaacguacacuguccauau

SEQ ID NO: 201300 - RNA, 19 nt, Homo sapiens
acugagauguguuucaauu

SEQ ID NO: 201301 - RNA, 19 nt, Homo sapiens
caauaggaguugaagagau

SEQ ID NO: 201302 - RNA, 19 nt, Homo sapiens
caaccaacggaaaucaaua

SEQ ID NO: 201303 - RNA, 19 nt, Homo sapiens
gagcagaaacccuucaaag

SEQ ID NO: 201304 - RNA, 19 nt, Homo sapiens
ggacgucucccaacuccuu

SEQ ID NO: 201305 - RNA, 19 nt, Homo sapiens
ugaaugguaucaagaugga

SEQ ID NO: 201306 - RNA, 19 nt, Homo sapiens
aaacagaacgcauuccaau

SEQ ID NO: 201307 - RNA, 19 nt, Homo sapiens
agaacaagcccacgaguga

SEQ ID NO: 201308 - RNA, 19 nt, Homo sapiens
acacagcccuccacucauc

SEQ ID NO: 201309 - RNA, 19 nt, Homo sapiens
cguagcagcucuucagcaa

SEQ ID NO: 201310 - RNA, 19 nt, Homo sapiens
ggaauaucuucaugcuaug

SEQ ID NO: 201311 - RNA, 19 nt, Homo sapiens
ggagaaacugucuuccauu

SEQ ID NO: 201312 - RNA, 19 nt, Homo sapiens
cgauggagguaguauagga

SEQ ID NO: 201313 - RNA, 19 nt, Homo sapiens
uagcagcucuucagcaagu

SEQ ID NO: 201314 - RNA, 19 nt, Homo sapiens
uaugggaacugucucaaca

SEQ ID NO: 201315 - RNA, 19 nt, Homo sapiens
cagcaacuauuccaacagu

SEQ ID NO: 201316 - RNA, 19 nt, Homo sapiens
uaucaccacucuccgauca

SEQ ID NO: 201317 - RNA, 19 nt, Homo sapiens
cuacauuaaucccuacaug

SEQ ID NO: 201318 - RNA, 19 nt, Homo sapiens
ggacgguguuugccaugga

SEQ ID NO: 201319 - RNA, 19 nt, Homo sapiens
agaagaaacgcaaucacua

SEQ ID NO: 201320 - RNA, 19 nt, Homo sapiens
ucaccuaacugagaugugu

SEQ ID NO: 201321 - RNA, 19 nt, Homo sapiens
aagaaugccuccaggugaa

SEQ ID NO: 201322 - RNA, 19 nt, Homo sapiens
ccucaaagcgggaagaaug

SEQ ID NO: 201323 - RNA, 19 nt, Homo sapiens
ccaaugagaaaccauaugu

SEQ ID NO: 201324 - RNA, 19 nt, Homo sapiens
guggugcaguauuuaaauu

SEQ ID NO: 201325 - RNA, 19 nt, Homo sapiens
gucucgugcuucagaauua

SEQ ID NO: 201326 - RNA, 19 nt, Homo sapiens
gcagagaagccaaugacau

SEQ ID NO: 201327 - RNA, 19 nt, Homo sapiens
cagcaacacuaccucaaag

SEQ ID NO: 201328 - RNA, 19 nt, Homo sapiens
ucaaagcccaguauauguu

SEQ ID NO: 201329 - RNA, 19 nt, Homo sapiens
gcccgucucucuccacaug

SEQ ID NO: 201330 - RNA, 19 nt, Homo sapiens
uggcuccuauggucacuua

SEQ ID NO: 201331 - RNA, 19 nt, Homo sapiens
caucuccgauuccuccauu

SEQ ID NO: 201332 - RNA, 19 nt, Homo sapiens
gaagagauuaaacugacuu

SEQ ID NO: 201333 - RNA, 19 nt, Homo sapiens
gcaaccaacggaaaucaau

SEQ ID NO: 201334 - RNA, 19 nt, Homo sapiens
guauuuaaauucccagaac

SEQ ID NO: 201335 - RNA, 19 nt, Homo sapiens
gaaauggcacacaguccaa

SEQ ID NO: 201336 - RNA, 19 nt, Homo sapiens
gagaagaaacgcaaucacu

SEQ ID NO: 201337 - RNA, 19 nt, Homo sapiens
gaacagcccgaaggaacaa

SEQ ID NO: 201338 - RNA, 19 nt, Homo sapiens
caugagggccguuaccauu

SEQ ID NO: 201339 - RNA, 19 nt, Homo sapiens
ggugaaugguaucaagaug

SEQ ID NO: 201340 - RNA, 19 nt, Homo sapiens
ggucacgauucucaauaau

SEQ ID NO: 201341 - RNA, 19 nt, Homo sapiens
caagagguccaagaucaaa

SEQ ID NO: 201342 - RNA, 19 nt, Homo sapiens
uauggucacuuaucugcaa

SEQ ID NO: 201343 - RNA, 19 nt, Homo sapiens
gaaucaguauuguuacacu

SEQ ID NO: 201344 - RNA, 19 nt, Homo sapiens
gagaggaugagccugaaga

SEQ ID NO: 201345 - RNA, 19 nt, Homo sapiens
gcaagaguuucaaguauaa

SEQ ID NO: 201346 - RNA, 19 nt, Homo sapiens
ggcaagaguuucaaguaua

SEQ ID NO: 201347 - RNA, 19 nt, Homo sapiens
gcgagaagcccuacaagug

SEQ ID NO: 201348 - RNA, 19 nt, Homo sapiens
cggcaagaguuucaaguau

SEQ ID NO: 201349 - RNA, 19 nt, Homo sapiens
ccacguguccggaauaaau

SEQ ID NO: 201350 - RNA, 19 nt, Homo sapiens
cagcaggucucagggaaga

SEQ ID NO: 201351 - RNA, 19 nt, Homo sapiens
gcggcaagaguuucaagua

SEQ ID NO: 201352 - RNA, 19 nt, Homo sapiens
gaaggucccaggugugaca

SEQ ID NO: 201353 - RNA, 19 nt, Homo sapiens
auaacucgcugcuccugaa

SEQ ID NO: 201354 - RNA, 19 nt, Homo sapiens
cauccacacuggcgagaag

SEQ ID NO: 201355 - RNA, 19 nt, Homo sapiens
agccacagcucgcacuuca

SEQ ID NO: 201356 - RNA, 19 nt, Homo sapiens
gcaccacgagccucagcuu

SEQ ID NO: 201357 - RNA, 19 nt, Homo sapiens
gcaggucucagggaagaug

SEQ ID NO: 201358 - RNA, 19 nt, Homo sapiens
cggaaggucccagguguga

SEQ ID NO: 201359 - RNA, 19 nt, Homo sapiens
ugccacguguccggaauaa

SEQ ID NO: 201360 - RNA, 19 nt, Homo sapiens
guggagaucggcagagaca

SEQ ID NO: 201361 - RNA, 19 nt, Homo sapiens
ucuccaagacguagaggaa

SEQ ID NO: 201362 - RNA, 19 nt, Homo sapiens
ggaaggaaaugauauggua

SEQ ID NO: 201363 - RNA, 19 nt, Homo sapiens
gaaacaaugugauucaaga

SEQ ID NO: 201364 - RNA, 19 nt, Homo sapiens
gggcuaggcugcaacuuua

SEQ ID NO: 201365 - RNA, 19 nt, Homo sapiens
gaagaaaccugaugauggu

SEQ ID NO: 201366 - RNA, 19 nt, Homo sapiens
gaaaggaaacaaugugauu

SEQ ID NO: 201367 - RNA, 19 nt, Homo sapiens
ugaaaggccuggcauuuau

SEQ ID NO: 201368 - RNA, 19 nt, Homo sapiens
gaacugggagucaaauuug

SEQ ID NO: 201369 - RNA, 19 nt, Homo sapiens
ggaaugacgcuaauccaaa

SEQ ID NO: 201370 - RNA, 19 nt, Homo sapiens
cuagaagucuuuaguacaa

SEQ ID NO: 201371 - RNA, 19 nt, Homo sapiens
cacaauaccuccacugguu

SEQ ID NO: 201372 - RNA, 19 nt, Homo sapiens
uaucucauguccuugaaua

SEQ ID NO: 201373 - RNA, 19 nt, Homo sapiens
cuacacaagugauguuuau

SEQ ID NO: 201374 - RNA, 19 nt, Homo sapiens
ggauuuaugugagugcuuu

SEQ ID NO: 201375 - RNA, 19 nt, Homo sapiens
ucaaucagcucaacucaag

SEQ ID NO: 201376 - RNA, 19 nt, Homo sapiens
ugacaaggauacugauaga

SEQ ID NO: 201377 - RNA, 19 nt, Homo sapiens
gaaaccugaugaugguaaa

SEQ ID NO: 201378 - RNA, 19 nt, Homo sapiens
ucagugaguuugaccauug

SEQ ID NO: 201379 - RNA, 19 nt, Homo sapiens
gaauugcuguuccugaugu

SEQ ID NO: 201380 - RNA, 19 nt, Homo sapiens
uagaagcacuuuauguuuc

SEQ ID NO: 201381 - RNA, 19 nt, Homo sapiens
gcuagaagcacuuuauguu

SEQ ID NO: 201382 - RNA, 19 nt, Homo sapiens
cagcucaacucaagauuuc

SEQ ID NO: 201383 - RNA, 19 nt, Homo sapiens
gaagaaaggaaacaaugug

SEQ ID NO: 201384 - RNA, 19 nt, Homo sapiens
ccuaagaagucacuggauu

SEQ ID NO: 201385 - RNA, 19 nt, Homo sapiens
gagagcaauucaaaucaug

SEQ ID NO: 201386 - RNA, 19 nt, Homo sapiens
ccacugguuuccuguugua

SEQ ID NO: 201387 - RNA, 19 nt, Homo sapiens
ggagucaaauuugugaaga

SEQ ID NO: 201388 - RNA, 19 nt, Homo sapiens
ugugagugcuuuaaacaaa

SEQ ID NO: 201389 - RNA, 19 nt, Homo sapiens
ccaguagccauauaugaua

SEQ ID NO: 201390 - RNA, 19 nt, Homo sapiens
gaggaggaaggaaaugaua

SEQ ID NO: 201391 - RNA, 19 nt, Homo sapiens
gaaugacgcuaauccaaaa

SEQ ID NO: 201392 - RNA, 19 nt, Homo sapiens
guaaacacuagaagucuuu

SEQ ID NO: 201393 - RNA, 19 nt, Homo sapiens
guggaugacuauauuuaga

SEQ ID NO: 201394 - RNA, 19 nt, Homo sapiens
ggaguaaacacuagaaguc

SEQ ID NO: 201395 - RNA, 19 nt, Homo sapiens
gauggcuacuggauugaaa

SEQ ID NO: 201396 - RNA, 19 nt, Homo sapiens
ccugauggcuacuggauug

SEQ ID NO: 201397 - RNA, 19 nt, Homo sapiens
ggaaaggaaagaacacuag

SEQ ID NO: 201398 - RNA, 19 nt, Homo sapiens
gaaaggccuggcauuuauu

SEQ ID NO: 201399 - RNA, 19 nt, Homo sapiens
acaaggauacugauagaaa

SEQ ID NO: 201400 - RNA, 19 nt, Homo sapiens
gagucaaauuugugaagaa

SEQ ID NO: 201401 - RNA, 19 nt, Homo sapiens
caguagccauauaugauaa

SEQ ID NO: 201402 - RNA, 19 nt, Homo sapiens
gaaagcaggcuaggcaugu

SEQ ID NO: 201403 - RNA, 19 nt, Homo sapiens
caaaucaugcugacaagga

SEQ ID NO: 201404 - RNA, 19 nt, Homo sapiens
cuagaagcacuuuauguuu

SEQ ID NO: 201405 - RNA, 19 nt, Homo sapiens
gcugcaacuuuaucucauu

SEQ ID NO: 201406 - RNA, 19 nt, Homo sapiens
gaaggauccuaagaaguca

SEQ ID NO: 201407 - RNA, 19 nt, Homo sapiens
guuuguggaugacuauauu

SEQ ID NO: 201408 - RNA, 19 nt, Homo sapiens
ucuaauggcucagaaaaua

SEQ ID NO: 201409 - RNA, 19 nt, Homo sapiens
gauugugccucaaaguugu

SEQ ID NO: 201410 - RNA, 19 nt, Homo sapiens
ugaaggauccuaagaaguc

SEQ ID NO: 201411 - RNA, 19 nt, Homo sapiens
ucaguaaaguacaaagugu

SEQ ID NO: 201412 - RNA, 19 nt, Homo sapiens
aaaaugacaucccuaaaga

SEQ ID NO: 201413 - RNA, 19 nt, Homo sapiens
ggaggaaggaaaugauaug

SEQ ID NO: 201414 - RNA, 19 nt, Homo sapiens
ccuuugagauuucagaaga

SEQ ID NO: 201415 - RNA, 19 nt, Homo sapiens
cuaagaagucacuggauuu

SEQ ID NO: 201416 - RNA, 19 nt, Homo sapiens
cuaguguucuuucaguaaa

SEQ ID NO: 201417 - RNA, 19 nt, Homo sapiens
gagugaaggauccuaagaa

SEQ ID NO: 201418 - RNA, 19 nt, Homo sapiens
gcagugcuuuaucucaugu

SEQ ID NO: 201419 - RNA, 19 nt, Homo sapiens
cagaagaaaggaaacaaug

SEQ ID NO: 201420 - RNA, 19 nt, Homo sapiens
gcuacuggauugaaauuuu

SEQ ID NO: 201421 - RNA, 19 nt, Homo sapiens
ggugauuccuacacaagug

SEQ ID NO: 201422 - RNA, 19 nt, Homo sapiens
caacggaaaggaaagaaca

SEQ ID NO: 201423 - RNA, 19 nt, Homo sapiens
ucucauguccuugaauaua

SEQ ID NO: 201424 - RNA, 19 nt, Homo sapiens
cacuugagcugacacacaa

SEQ ID NO: 201425 - RNA, 19 nt, Homo sapiens
gcugucaugugagaaagaa

SEQ ID NO: 201426 - RNA, 19 nt, Homo sapiens
caaggauacugauagaaaa

SEQ ID NO: 201427 - RNA, 19 nt, Homo sapiens
gaaaggaaagaacacuagu

SEQ ID NO: 201428 - RNA, 19 nt, Homo sapiens
uuacuucccuucaaaucug

SEQ ID NO: 201429 - RNA, 19 nt, Homo sapiens
aaugacaucccuaaagaaa

SEQ ID NO: 201430 - RNA, 19 nt, Homo sapiens
caugaugccaguagccaua

SEQ ID NO: 201431 - RNA, 19 nt, Homo sapiens
acucccagcugucauguga

SEQ ID NO: 201432 - RNA, 19 nt, Homo sapiens
ugagagcaauucaaaucau

SEQ ID NO: 201433 - RNA, 19 nt, Homo sapiens
cuucuuggcuuaugaggau

SEQ ID NO: 201434 - RNA, 19 nt, Homo sapiens
uaucagaaaucagcucagu

SEQ ID NO: 201435 - RNA, 19 nt, Homo sapiens
ggugagggaguaaacacua

SEQ ID NO: 201436 - RNA, 19 nt, Homo sapiens
ggguuucaauuccucagaa

SEQ ID NO: 201437 - RNA, 19 nt, Homo sapiens
ggaaacaaugugauucaag

SEQ ID NO: 201438 - RNA, 19 nt, Homo sapiens
agaacugggagucaaauuu

SEQ ID NO: 201439 - RNA, 19 nt, Homo sapiens
gugagugcuuuaaacaaau

SEQ ID NO: 201440 - RNA, 19 nt, Homo sapiens
uaccaaggauuuucuauug

SEQ ID NO: 201441 - RNA, 19 nt, Homo sapiens
guaccguggugagggagua

SEQ ID NO: 201442 - RNA, 19 nt, Homo sapiens
cugcaacuuuaucucauuu

SEQ ID NO: 201443 - RNA, 19 nt, Homo sapiens
cgccaugauucacauuuga

SEQ ID NO: 201444 - RNA, 19 nt, Homo sapiens
gauuuaagagggcaucaau

SEQ ID NO: 201445 - RNA, 19 nt, Homo sapiens
gaagaacugggagucaaau

SEQ ID NO: 201446 - RNA, 19 nt, Homo sapiens
gacccagaguuaccacaau

SEQ ID NO: 201447 - RNA, 19 nt, Homo sapiens
gccaguagccauauaugau

SEQ ID NO: 201448 - RNA, 19 nt, Homo sapiens
gcugacaaggauacugaua

SEQ ID NO: 201449 - RNA, 19 nt, Homo sapiens
caaaauggcaaccuuaaug

SEQ ID NO: 201450 - RNA, 19 nt, Homo sapiens
uaacaaaauggcaaccuua

SEQ ID NO: 201451 - RNA, 19 nt, Homo sapiens
uacuagaguucuuggaaug

SEQ ID NO: 201452 - RNA, 19 nt, Homo sapiens
augaaaggccuggcauuua

SEQ ID NO: 201453 - RNA, 19 nt, Homo sapiens
guucuuggaaugacgcuaa

SEQ ID NO: 201454 - RNA, 19 nt, Homo sapiens
gauucacauuugaugaguu

SEQ ID NO: 201455 - RNA, 19 nt, Homo sapiens
ccucaaaguuguaguaccu

SEQ ID NO: 201456 - RNA, 19 nt, Homo sapiens
ggaggaggaaggaaaugau

SEQ ID NO: 201457 - RNA, 19 nt, Homo sapiens
ccuugaauauaguugugua

SEQ ID NO: 201458 - RNA, 19 nt, Homo sapiens
uuacauaccagaagcaucu

SEQ ID NO: 201459 - RNA, 19 nt, Homo sapiens
uuaauguagugcugugaga

SEQ ID NO: 201460 - RNA, 19 nt, Homo sapiens
aaauggcaaccuuaaugua

SEQ ID NO: 201461 - RNA, 19 nt, Homo sapiens
ggccuggcauuuauucaag

SEQ ID NO: 201462 - RNA, 19 nt, Homo sapiens
ggaaauacuuuaucuguga

SEQ ID NO: 201463 - RNA, 19 nt, Homo sapiens
gauacacucucuagcuuua

SEQ ID NO: 201464 - RNA, 19 nt, Homo sapiens
gaagcagccuccuaauuug

SEQ ID NO: 201465 - RNA, 19 nt, Homo sapiens
gaaaguggcucuucuaacc

SEQ ID NO: 201466 - RNA, 19 nt, Homo sapiens
caaggucaacggcuuauua

SEQ ID NO: 201467 - RNA, 19 nt, Homo sapiens
gcagauagccagacacaug

SEQ ID NO: 201468 - RNA, 19 nt, Homo sapiens
gguaugagcugccaagucu

SEQ ID NO: 201469 - RNA, 19 nt, Homo sapiens
gggaugggcuccucuccua

SEQ ID NO: 201470 - RNA, 19 nt, Homo sapiens
ggagagugcaguaguaauu

SEQ ID NO: 201471 - RNA, 19 nt, Homo sapiens
gaggauugcuucuugugaa

SEQ ID NO: 201472 - RNA, 19 nt, Homo sapiens
agaagcagccuccuaauuu

SEQ ID NO: 201473 - RNA, 19 nt, Homo sapiens
ggaacuacauccaccugaa

SEQ ID NO: 201474 - RNA, 19 nt, Homo sapiens
gcccugaaguggauguaua

SEQ ID NO: 201475 - RNA, 19 nt, Homo sapiens
gggagacggugcagaaaug

SEQ ID NO: 201476 - RNA, 19 nt, Homo sapiens
gagaagcagccuccuaauu

SEQ ID NO: 201477 - RNA, 19 nt, Homo sapiens
uaaagacgcucaagaaucc

SEQ ID NO: 201478 - RNA, 19 nt, Homo sapiens
gucaacggcuuauuaguga

SEQ ID NO: 201479 - RNA, 19 nt, Homo sapiens
gacaucaaaugcagacuug

SEQ ID NO: 201480 - RNA, 19 nt, Homo sapiens
gcacaaugggcaauucuga

SEQ ID NO: 201481 - RNA, 19 nt, Homo sapiens
ugaggaggauugcuucuug

SEQ ID NO: 201482 - RNA, 19 nt, Homo sapiens
gugcagaaauggcgagaau

SEQ ID NO: 201483 - RNA, 19 nt, Homo sapiens
agacagagccgcaaaucaa

SEQ ID NO: 201484 - RNA, 19 nt, Homo sapiens
gaauuuggauacacucucu

SEQ ID NO: 201485 - RNA, 19 nt, Homo sapiens
ccagguauuugaguuguuu

SEQ ID NO: 201486 - RNA, 19 nt, Homo sapiens
guauauacuucacucacuu

SEQ ID NO: 201487 - RNA, 19 nt, Homo sapiens
caugugaugugcaaggaaa

SEQ ID NO: 201488 - RNA, 19 nt, Homo sapiens
gaaaucaugguuguaguga

SEQ ID NO: 201489 - RNA, 19 nt, Homo sapiens
gcaagacagacaucaaaug

SEQ ID NO: 201490 - RNA, 19 nt, Homo sapiens
acacauggcuauccuagag

SEQ ID NO: 201491 - RNA, 19 nt, Homo sapiens
ggucaacggcuuauuagug

SEQ ID NO: 201492 - RNA, 19 nt, Homo sapiens
gugcaguaguaauugauuu

SEQ ID NO: 201493 - RNA, 19 nt, Homo sapiens
gcagaaauggcgagaauac

SEQ ID NO: 201494 - RNA, 19 nt, Homo sapiens
gaggucaucuuugccuuug

SEQ ID NO: 201495 - RNA, 19 nt, Homo sapiens
cuugggagcuuguauauac

SEQ ID NO: 201496 - RNA, 19 nt, Homo sapiens
ccacuugggagcuuguaua

SEQ ID NO: 201497 - RNA, 19 nt, Homo sapiens
ccaccucuccuuggaaaua

SEQ ID NO: 201498 - RNA, 19 nt, Homo sapiens
cagcuggaauuucggaaga

SEQ ID NO: 201499 - RNA, 19 nt, Homo sapiens
gaacuacuggcucauuauc

SEQ ID NO: 201500 - RNA, 19 nt, Homo sapiens
caaauaaugaacagcagaa

SEQ ID NO: 201501 - RNA, 19 nt, Homo sapiens
ggaggugguucugaaagug

SEQ ID NO: 201502 - RNA, 19 nt, Homo sapiens
aagaggaggugguucugaa

SEQ ID NO: 201503 - RNA, 19 nt, Homo sapiens
gaacuuccucaucuuuguu

SEQ ID NO: 201504 - RNA, 19 nt, Homo sapiens
ggaacuccaacaugaacua

SEQ ID NO: 201505 - RNA, 19 nt, Homo sapiens
gugucuggguugcuuauuu

SEQ ID NO: 201506 - RNA, 19 nt, Homo sapiens
uuacagagcucuccuucac

SEQ ID NO: 201507 - RNA, 19 nt, Homo sapiens
ggucaucuuugccuuugug

SEQ ID NO: 201508 - RNA, 19 nt, Homo sapiens
accaggaacuccaacauga

SEQ ID NO: 201509 - RNA, 19 nt, Homo sapiens
caaccggaccuucgaugaa

SEQ ID NO: 201510 - RNA, 19 nt, Homo sapiens
ggauacacucucuagcuuu

SEQ ID NO: 201511 - RNA, 19 nt, Homo sapiens
gcaaccggaccuucgauga

SEQ ID NO: 201512 - RNA, 19 nt, Homo sapiens
gugcaagacagacaucaaa

SEQ ID NO: 201513 - RNA, 19 nt, Homo sapiens
gaggaggauugcuucuugu

SEQ ID NO: 201514 - RNA, 19 nt, Homo sapiens
acacacacacacacacaua

SEQ ID NO: 201515 - RNA, 19 nt, Homo sapiens
auaaugaacagcagaaaga

SEQ ID NO: 201516 - RNA, 19 nt, Homo sapiens
ugacuucucccaucuagug

SEQ ID NO: 201517 - RNA, 19 nt, Homo sapiens
gaccacacgcugucucuug

SEQ ID NO: 201518 - RNA, 19 nt, Homo sapiens
uaggugguguugagaaaga

SEQ ID NO: 201519 - RNA, 19 nt, Homo sapiens
ggugaacuuccucaucuuu

SEQ ID NO: 201520 - RNA, 19 nt, Homo sapiens
guagauuaccugccacuuc

SEQ ID NO: 201521 - RNA, 19 nt, Homo sapiens
agacuguggguguagauua

SEQ ID NO: 201522 - RNA, 19 nt, Homo sapiens
uuaggaauguccagacugu

SEQ ID NO: 201523 - RNA, 19 nt, Homo sapiens
caacggcuuauuagugaaa

SEQ ID NO: 201524 - RNA, 19 nt, Homo sapiens
ggaggauugcuucuuguga

SEQ ID NO: 201525 - RNA, 19 nt, Homo sapiens
ggucaucugcaucguggua

SEQ ID NO: 201526 - RNA, 19 nt, Homo sapiens
ugaacuuccucaucuuugu

SEQ ID NO: 201527 - RNA, 19 nt, Homo sapiens
guucguggcugcaaaagaa

SEQ ID NO: 201528 - RNA, 19 nt, Homo sapiens
gcuggcggcuugagcacuu

SEQ ID NO: 201529 - RNA, 19 nt, Homo sapiens
agagugcaguaguaauuga

SEQ ID NO: 201530 - RNA, 19 nt, Homo sapiens
uggauacacucucuagcuu

SEQ ID NO: 201531 - RNA, 19 nt, Homo sapiens
uguaggugguguugagaaa

SEQ ID NO: 201532 - RNA, 19 nt, Homo sapiens
gcauguacacagccacuug

SEQ ID NO: 201533 - RNA, 19 nt, Homo sapiens
gcaguaguaauugauuuga

SEQ ID NO: 201534 - RNA, 19 nt, Homo sapiens
ggaagcuguuugugugucu

SEQ ID NO: 201535 - RNA, 19 nt, Homo sapiens
caagacagacaucaaaugc

SEQ ID NO: 201536 - RNA, 19 nt, Homo sapiens
gaccaggaacuccaacaug

SEQ ID NO: 201537 - RNA, 19 nt, Homo sapiens
gagagugcaguaguaauug

SEQ ID NO: 201538 - RNA, 19 nt, Homo sapiens
ucucuuagggaaaccaaua

SEQ ID NO: 201539 - RNA, 19 nt, Homo sapiens
uuaaagacgcucaagaauc

SEQ ID NO: 201540 - RNA, 19 nt, Homo sapiens
aaacugaaggccaaucuca

SEQ ID NO: 201541 - RNA, 19 nt, Homo sapiens
gcgaaaucaugguuguagu

SEQ ID NO: 201542 - RNA, 19 nt, Homo sapiens
aaacccaucagacagguaa

SEQ ID NO: 201543 - RNA, 19 nt, Homo sapiens
gccaaucucaugugcaaga

SEQ ID NO: 201544 - RNA, 19 nt, Homo sapiens
ucacacuuggagcuaauua

SEQ ID NO: 201545 - RNA, 19 nt, Homo sapiens
ugagcgaaaucaugguugu

SEQ ID NO: 201546 - RNA, 19 nt, Homo sapiens
gaacuacauccaccugaac

SEQ ID NO: 201547 - RNA, 19 nt, Homo sapiens
aaagggaagcuguuugugu

SEQ ID NO: 201548 - RNA, 19 nt, Homo sapiens
gacucaaacucaaggucaa

SEQ ID NO: 201549 - RNA, 19 nt, Homo sapiens
ccgacggauuccuuuauga

SEQ ID NO: 201550 - RNA, 19 nt, Homo sapiens
gcuuauuucccucaucuug

SEQ ID NO: 201551 - RNA, 19 nt, Homo sapiens
ugucuggguugcuuauuuc

SEQ ID NO: 201552 - RNA, 19 nt, Homo sapiens
gagcgaaaucaugguugua

SEQ ID NO: 201553 - RNA, 19 nt, Homo sapiens
aaacacagagcgggaguga

SEQ ID NO: 201554 - RNA, 19 nt, Homo sapiens
gagcugccgccugguguuu

SEQ ID NO: 201555 - RNA, 19 nt, Homo sapiens
cggauuccuuuaugaguca

SEQ ID NO: 201556 - RNA, 19 nt, Homo sapiens
cgaaaucaugguuguagug

SEQ ID NO: 201557 - RNA, 19 nt, Homo sapiens
gacuguggguguagauuac

SEQ ID NO: 201558 - RNA, 19 nt, Homo sapiens
cagagggacagcagcauga

SEQ ID NO: 201559 - RNA, 19 nt, Homo sapiens
aggccaaucucaugugcaa

SEQ ID NO: 201560 - RNA, 19 nt, Homo sapiens
ccaggaacuccaacaugaa

SEQ ID NO: 201561 - RNA, 19 nt, Homo sapiens
agaggcaugugaugugcaa

SEQ ID NO: 201562 - RNA, 19 nt, Homo sapiens
caauagcgcuuucugguuu

SEQ ID NO: 201563 - RNA, 19 nt, Homo sapiens
ugaaagccauugacauuug

SEQ ID NO: 201564 - RNA, 19 nt, Homo sapiens
cagacacgcuggaguuuaa

SEQ ID NO: 201565 - RNA, 19 nt, Homo sapiens
gcagguagcagauggacua

SEQ ID NO: 201566 - RNA, 19 nt, Homo sapiens
gacaacaaauugcuaagga

SEQ ID NO: 201567 - RNA, 19 nt, Homo sapiens
caacagcuuugguuccauu

SEQ ID NO: 201568 - RNA, 19 nt, Homo sapiens
gaacgugagcugcaacauu

SEQ ID NO: 201569 - RNA, 19 nt, Homo sapiens
cuggaaagcuuuggauaua

SEQ ID NO: 201570 - RNA, 19 nt, Homo sapiens
gagcaucucugcccaaggu

SEQ ID NO: 201571 - RNA, 19 nt, Homo sapiens
ccauggacuugaagaauuu

SEQ ID NO: 201572 - RNA, 19 nt, Homo sapiens
gaauagcacaggaaucuga

SEQ ID NO: 201573 - RNA, 19 nt, Homo sapiens
gagaaggacuugagauacu

SEQ ID NO: 201574 - RNA, 19 nt, Homo sapiens
cuaaggaucucccggaaug

SEQ ID NO: 201575 - RNA, 19 nt, Homo sapiens
aacgugagcugcaacauuu

SEQ ID NO: 201576 - RNA, 19 nt, Homo sapiens
caacagacacgcuggaguu

SEQ ID NO: 201577 - RNA, 19 nt, Homo sapiens
caagguguccuaugugaaa

SEQ ID NO: 201578 - RNA, 19 nt, Homo sapiens
agacaaccauggacuauag

SEQ ID NO: 201579 - RNA, 19 nt, Homo sapiens
ggagaaggccgcuuuaacu

SEQ ID NO: 201580 - RNA, 19 nt, Homo sapiens
gugccaauuugaaacauuu

SEQ ID NO: 201581 - RNA, 19 nt, Homo sapiens
ccaagaagaucgacaaaau

SEQ ID NO: 201582 - RNA, 19 nt, Homo sapiens
gaaagccauugacauuugg

SEQ ID NO: 201583 - RNA, 19 nt, Homo sapiens
ggaauguccucuacagcau

SEQ ID NO: 201584 - RNA, 19 nt, Homo sapiens
ccucggauuuccuggauaa

SEQ ID NO: 201585 - RNA, 19 nt, Homo sapiens
gagaaggccgcuuuaacuu

SEQ ID NO: 201586 - RNA, 19 nt, Homo sapiens
gaucaccacagacaacaaa

SEQ ID NO: 201587 - RNA, 19 nt, Homo sapiens
gcaauagcgcuuucugguu

SEQ ID NO: 201588 - RNA, 19 nt, Homo sapiens
uagaauaugcugccguuaa

SEQ ID NO: 201589 - RNA, 19 nt, Homo sapiens
gaaugggaauguccucuac

SEQ ID NO: 201590 - RNA, 19 nt, Homo sapiens
gagaggacguccacaacca

SEQ ID NO: 201591 - RNA, 19 nt, Homo sapiens
cccauggccuuccucauuu

SEQ ID NO: 201592 - RNA, 19 nt, Homo sapiens
gacaaaauaucccgcauug

SEQ ID NO: 201593 - RNA, 19 nt, Homo sapiens
gguagcagauggacuaacu

SEQ ID NO: 201594 - RNA, 19 nt, Homo sapiens
ggaaugggaauguccucua

SEQ ID NO: 201595 - RNA, 19 nt, Homo sapiens
ucaauacucuucgacucua

SEQ ID NO: 201596 - RNA, 19 nt, Homo sapiens
cccauggacuugaagaauu

SEQ ID NO: 201597 - RNA, 19 nt, Homo sapiens
ugaauacccugacgacucu

SEQ ID NO: 201598 - RNA, 19 nt, Homo sapiens
aagagaaggacuugagaua

SEQ ID NO: 201599 - RNA, 19 nt, Homo sapiens
ggaaagcuuuggauauacg

SEQ ID NO: 201600 - RNA, 19 nt, Homo sapiens
gaaggaagagaaggacuug

SEQ ID NO: 201601 - RNA, 19 nt, Homo sapiens
ggaggaagcggagacauca

SEQ ID NO: 201602 - RNA, 19 nt, Homo sapiens
gaagagaaggacuugagau

SEQ ID NO: 201603 - RNA, 19 nt, Homo sapiens
ggaagagaaggacuugaga

SEQ ID NO: 201604 - RNA, 19 nt, Homo sapiens
uaacaaacagcaauacucu

SEQ ID NO: 201605 - RNA, 19 nt, Homo sapiens
cuggaaaccugaccuguuc

SEQ ID NO: 201606 - RNA, 19 nt, Homo sapiens
ggacguccacaaccaguga

SEQ ID NO: 201607 - RNA, 19 nt, Homo sapiens
ugugaaagccauugacauu

SEQ ID NO: 201608 - RNA, 19 nt, Homo sapiens
gggaauagcacaggaaucu

SEQ ID NO: 201609 - RNA, 19 nt, Homo sapiens
gagacaaccauggacuaua

SEQ ID NO: 201610 - RNA, 19 nt, Homo sapiens
guagagaggacguccacaa

SEQ ID NO: 201611 - RNA, 19 nt, Homo sapiens
cccaagguguccuauguga

SEQ ID NO: 201612 - RNA, 19 nt, Homo sapiens
uccaugagaucaccacaga

SEQ ID NO: 201613 - RNA, 19 nt, Homo sapiens
caccacagacaacaaauug

SEQ ID NO: 201614 - RNA, 19 nt, Homo sapiens
gagaaccuccggauaugau

SEQ ID NO: 201615 - RNA, 19 nt, Homo sapiens
uguguucucagcccuauua

SEQ ID NO: 201616 - RNA, 19 nt, Homo sapiens
acaaacagcaauacucuuc

SEQ ID NO: 201617 - RNA, 19 nt, Homo sapiens
gaaaccugaccuguucuuu

SEQ ID NO: 201618 - RNA, 19 nt, Homo sapiens
caagaagaucgacaaaaua

SEQ ID NO: 201619 - RNA, 19 nt, Homo sapiens
gugaaagccauugacauuu

SEQ ID NO: 201620 - RNA, 19 nt, Homo sapiens
uaaauucaccugcauugag

SEQ ID NO: 201621 - RNA, 19 nt, Homo sapiens
ucaugcaacuggaaagcuu

SEQ ID NO: 201622 - RNA, 19 nt, Homo sapiens
acauuuggauggcaguuug

SEQ ID NO: 201623 - RNA, 19 nt, Homo sapiens
ucuacuggaucaucuacaa

SEQ ID NO: 201624 - RNA, 19 nt, Homo sapiens
agaauaugcugccguuaac

SEQ ID NO: 201625 - RNA, 19 nt, Homo sapiens
gcaccaagcacuacaacac

SEQ ID NO: 201626 - RNA, 19 nt, Homo sapiens
gauacugcaccaagcacua

SEQ ID NO: 201627 - RNA, 19 nt, Homo sapiens
aaaccugaccuguucuuug

SEQ ID NO: 201628 - RNA, 19 nt, Homo sapiens
gccaggaucaggcccaauu

SEQ ID NO: 201629 - RNA, 19 nt, Homo sapiens
caguuugccugcucuuugu

SEQ ID NO: 201630 - RNA, 19 nt, Homo sapiens
cauaacucguggacuacaa

SEQ ID NO: 201631 - RNA, 19 nt, Homo sapiens
ccacugugcucaccaugac

SEQ ID NO: 201632 - RNA, 19 nt, Homo sapiens
ucucauggaucuccuucug

SEQ ID NO: 201633 - RNA, 19 nt, Homo sapiens
acagggagccgugcaggua

SEQ ID NO: 201634 - RNA, 19 nt, Homo sapiens
uuggauauacgaugaauga

SEQ ID NO: 201635 - RNA, 19 nt, Homo sapiens
uguaagugccaauuugaaa

SEQ ID NO: 201636 - RNA, 19 nt, Homo sapiens
gggagccauuguauucuuc

SEQ ID NO: 201637 - RNA, 19 nt, Homo sapiens
ggacuacaaagcacaaagg

SEQ ID NO: 201638 - RNA, 19 nt, Homo sapiens
cccuuuaacaucuggauua

SEQ ID NO: 201639 - RNA, 19 nt, Homo sapiens
acaacaaauugcuaaggau

SEQ ID NO: 201640 - RNA, 19 nt, Homo sapiens
acagacaacaaauugcuaa

SEQ ID NO: 201641 - RNA, 19 nt, Homo sapiens
ggaaaccugaccuguucuu

SEQ ID NO: 201642 - RNA, 19 nt, Homo sapiens
gaucaggcccaauuuuaaa

SEQ ID NO: 201643 - RNA, 19 nt, Homo sapiens
acuauagggucaacaucuu

SEQ ID NO: 201644 - RNA, 19 nt, Homo sapiens
cuaugucacccucggauuu

SEQ ID NO: 201645 - RNA, 19 nt, Homo sapiens
gugaagggucugaaagguu

SEQ ID NO: 201646 - RNA, 19 nt, Homo sapiens
gauggguuacuaccugauu

SEQ ID NO: 201647 - RNA, 19 nt, Homo sapiens
caugagaucaccacagaca

SEQ ID NO: 201648 - RNA, 19 nt, Homo sapiens
ggaggaugaagcuggagaa

SEQ ID NO: 201649 - RNA, 19 nt, Homo sapiens
ugcccaagguguccuaugu

SEQ ID NO: 201650 - RNA, 19 nt, Homo sapiens
ggaucaggcccaauuuuaa

SEQ ID NO: 201651 - RNA, 19 nt, Homo sapiens
cgggagccauuguauucuu

SEQ ID NO: 201652 - RNA, 19 nt, Homo sapiens
gcuggagaaggccgcuuua

SEQ ID NO: 201653 - RNA, 19 nt, Homo sapiens
caacuggaaagcuuuggau

SEQ ID NO: 201654 - RNA, 19 nt, Homo sapiens
ucaccacagacaacaaauu

SEQ ID NO: 201655 - RNA, 19 nt, Homo sapiens
uaagugccaauuugaaaca

SEQ ID NO: 201656 - RNA, 19 nt, Homo sapiens
ccccauaacucguggacua

SEQ ID NO: 201657 - RNA, 19 nt, Homo sapiens
ugaaggaagagaaggacuu

SEQ ID NO: 201658 - RNA, 19 nt, Homo sapiens
acagacacgcuggaguuua

SEQ ID NO: 201659 - RNA, 19 nt, Homo sapiens
ccuuuaacaucuggauuau

SEQ ID NO: 201660 - RNA, 19 nt, Homo sapiens
aaccugaccuguucuuugc

SEQ ID NO: 201661 - RNA, 19 nt, Homo sapiens
agaaggacuugagauacug

SEQ ID NO: 201662 - RNA, 19 nt, Homo sapiens
gcaaagugcucuacaguau

SEQ ID NO: 201663 - RNA, 19 nt, Homo sapiens
ccaaaggucuccuauguaa

SEQ ID NO: 201664 - RNA, 19 nt, Homo sapiens
gaacuuggcuacuguacaa

SEQ ID NO: 201665 - RNA, 19 nt, Homo sapiens
ugaaugaccugauauuuga

SEQ ID NO: 201666 - RNA, 19 nt, Homo sapiens
gaaaccagauuuguucuuu

SEQ ID NO: 201667 - RNA, 19 nt, Homo sapiens
cuacaacacuggaaaguuu

SEQ ID NO: 201668 - RNA, 19 nt, Homo sapiens
caaugcagcuggagaguuu

SEQ ID NO: 201669 - RNA, 19 nt, Homo sapiens
gcaagaaucaggccaaauu

SEQ ID NO: 201670 - RNA, 19 nt, Homo sapiens
gagaugcuaucaagaagaa

SEQ ID NO: 201671 - RNA, 19 nt, Homo sapiens
gaaggaacuuggcuacugu

SEQ ID NO: 201672 - RNA, 19 nt, Homo sapiens
gacagaagaggcagaauaa

SEQ ID NO: 201673 - RNA, 19 nt, Homo sapiens
ggaaggacaucaggauaug

SEQ ID NO: 201674 - RNA, 19 nt, Homo sapiens
gggcaucaccacagucuua

SEQ ID NO: 201675 - RNA, 19 nt, Homo sapiens
gaagauguccacaagaaau

SEQ ID NO: 201676 - RNA, 19 nt, Homo sapiens
agacaacaguggaaugauu

SEQ ID NO: 201677 - RNA, 19 nt, Homo sapiens
gcaugaagauguccacaag

SEQ ID NO: 201678 - RNA, 19 nt, Homo sapiens
ccauuggccuuccucauuu

SEQ ID NO: 201679 - RNA, 19 nt, Homo sapiens
gacaauaaacagacacuuu

SEQ ID NO: 201680 - RNA, 19 nt, Homo sapiens
ggaaucauuucgggauauu

SEQ ID NO: 201681 - RNA, 19 nt, Homo sapiens
ugacagaggagaagauuga

SEQ ID NO: 201682 - RNA, 19 nt, Homo sapiens
cuagguuccugccaaauuu

SEQ ID NO: 201683 - RNA, 19 nt, Homo sapiens
gaauaaggaagaagacguu

SEQ ID NO: 201684 - RNA, 19 nt, Homo sapiens
cacgaugaaugaccugaua

SEQ ID NO: 201685 - RNA, 19 nt, Homo sapiens
aaagugcucuacaguauca

SEQ ID NO: 201686 - RNA, 19 nt, Homo sapiens
aaacuagguuccugccaaa

SEQ ID NO: 201687 - RNA, 19 nt, Homo sapiens
caggacggcuuucugcaaa

SEQ ID NO: 201688 - RNA, 19 nt, Homo sapiens
gcaucuuucuggaaucauu

SEQ ID NO: 201689 - RNA, 19 nt, Homo sapiens
agacagaagaggcagaaua

SEQ ID NO: 201690 - RNA, 19 nt, Homo sapiens
gaugaaugaccugauauuu

SEQ ID NO: 201691 - RNA, 19 nt, Homo sapiens
agacucaccuugaccuuau

SEQ ID NO: 201692 - RNA, 19 nt, Homo sapiens
gaaagaagagaaggaacuu

SEQ ID NO: 201693 - RNA, 19 nt, Homo sapiens
caacaaauugcuacggauu

SEQ ID NO: 201694 - RNA, 19 nt, Homo sapiens
ucacagacccuaucuccuu

SEQ ID NO: 201695 - RNA, 19 nt, Homo sapiens
ugccaaaggucuccuaugu

SEQ ID NO: 201696 - RNA, 19 nt, Homo sapiens
ugacagccuuguuugcauu

SEQ ID NO: 201697 - RNA, 19 nt, Homo sapiens
caagaaucaggccaaauuu

SEQ ID NO: 201698 - RNA, 19 nt, Homo sapiens
cgauuaagguagcagcauu

SEQ ID NO: 201699 - RNA, 19 nt, Homo sapiens
guacaaagcacuacaacac

SEQ ID NO: 201700 - RNA, 19 nt, Homo sapiens
ccugauauuugagugguua

SEQ ID NO: 201701 - RNA, 19 nt, Homo sapiens
gaagaacuuuccgauggau

SEQ ID NO: 201702 - RNA, 19 nt, Homo sapiens
guccagaccuguacaaugc

SEQ ID NO: 201703 - RNA, 19 nt, Homo sapiens
cagaaacgaccauggacua

SEQ ID NO: 201704 - RNA, 19 nt, Homo sapiens
gaagacagaagaggcagaa

SEQ ID NO: 201705 - RNA, 19 nt, Homo sapiens
gaaaguuuaccugcauuga

SEQ ID NO: 201706 - RNA, 19 nt, Homo sapiens
ugaagaacuuuccgaugga

SEQ ID NO: 201707 - RNA, 19 nt, Homo sapiens
gggaaggacaucaggauau

SEQ ID NO: 201708 - RNA, 19 nt, Homo sapiens
gaagaggcagaauaaggaa

SEQ ID NO: 201709 - RNA, 19 nt, Homo sapiens
caacacagaaacaggaaug

SEQ ID NO: 201710 - RNA, 19 nt, Homo sapiens
augaagauguccacaagaa

SEQ ID NO: 201711 - RNA, 19 nt, Homo sapiens
gguuugaccugaccaugau

SEQ ID NO: 201712 - RNA, 19 nt, Homo sapiens
acaauaaacagacacuuug

SEQ ID NO: 201713 - RNA, 19 nt, Homo sapiens
uuaaagguccuccaguaaa

SEQ ID NO: 201714 - RNA, 19 nt, Homo sapiens
agaaggaacuuggcuacug

SEQ ID NO: 201715 - RNA, 19 nt, Homo sapiens
ggcaaagugcucuacagua

SEQ ID NO: 201716 - RNA, 19 nt, Homo sapiens
gaagacguuacucgugaaa

SEQ ID NO: 201717 - RNA, 19 nt, Homo sapiens
gccaaaggucuccuaugua

SEQ ID NO: 201718 - RNA, 19 nt, Homo sapiens
ucacagaaacgaccaugga

SEQ ID NO: 201719 - RNA, 19 nt, Homo sapiens
gauuaagguagcagcauuu

SEQ ID NO: 201720 - RNA, 19 nt, Homo sapiens
ccuagcaucuuucuggaau

SEQ ID NO: 201721 - RNA, 19 nt, Homo sapiens
agacguuacucgugaaagu

SEQ ID NO: 201722 - RNA, 19 nt, Homo sapiens
ccauggacuugaagaacuu

SEQ ID NO: 201723 - RNA, 19 nt, Homo sapiens
aaaccagauuuguucuuug

SEQ ID NO: 201724 - RNA, 19 nt, Homo sapiens
ggaaaguuuaccugcauug

SEQ ID NO: 201725 - RNA, 19 nt, Homo sapiens
agaagaggcagaauaagga

SEQ ID NO: 201726 - RNA, 19 nt, Homo sapiens
ggaaaccagauuuguucuu

SEQ ID NO: 201727 - RNA, 19 nt, Homo sapiens
ggagaugcuaucaagaaga

SEQ ID NO: 201728 - RNA, 19 nt, Homo sapiens
gacuaccgagugaauauuu

SEQ ID NO: 201729 - RNA, 19 nt, Homo sapiens
aaauagaugugcccuacag

SEQ ID NO: 201730 - RNA, 19 nt, Homo sapiens
agauggagaugcuaucaag

SEQ ID NO: 201731 - RNA, 19 nt, Homo sapiens
ggacuaccgagugaauauu

SEQ ID NO: 201732 - RNA, 19 nt, Homo sapiens
aagauguccacaagaaaua

SEQ ID NO: 201733 - RNA, 19 nt, Homo sapiens
guuuguguuugcugccuua

SEQ ID NO: 201734 - RNA, 19 nt, Homo sapiens
uaaaagcgauugacaucug

SEQ ID NO: 201735 - RNA, 19 nt, Homo sapiens
gaaggacaucaggauauga

SEQ ID NO: 201736 - RNA, 19 nt, Homo sapiens
cuucagauuucuuggacaa

SEQ ID NO: 201737 - RNA, 19 nt, Homo sapiens
ucaguguugugcuuguaaa

SEQ ID NO: 201738 - RNA, 19 nt, Homo sapiens
uagcaucuuucuggaauca

SEQ ID NO: 201739 - RNA, 19 nt, Homo sapiens
gaacgccaaaugggauauu

SEQ ID NO: 201740 - RNA, 19 nt, Homo sapiens
gcuuugucuuucuggguua

SEQ ID NO: 201741 - RNA, 19 nt, Homo sapiens
ugagacaacaguggaauga

SEQ ID NO: 201742 - RNA, 19 nt, Homo sapiens
agaaucaggccaaauuuua

SEQ ID NO: 201743 - RNA, 19 nt, Homo sapiens
gaaugaaccggcagcuagu

SEQ ID NO: 201744 - RNA, 19 nt, Homo sapiens
guguugugcuuguaaauac

SEQ ID NO: 201745 - RNA, 19 nt, Homo sapiens
cagaagaggcagaauaagg

SEQ ID NO: 201746 - RNA, 19 nt, Homo sapiens
gauuuguucuuugccaaug

SEQ ID NO: 201747 - RNA, 19 nt, Homo sapiens
gaaucaggccaaauuuuaa

SEQ ID NO: 201748 - RNA, 19 nt, Homo sapiens
ggaaaacaaccuucacaga

SEQ ID NO: 201749 - RNA, 19 nt, Homo sapiens
acacagugaaauugucuuu

SEQ ID NO: 201750 - RNA, 19 nt, Homo sapiens
cccauuggccuuccucauu

SEQ ID NO: 201751 - RNA, 19 nt, Homo sapiens
ucaccacagucuuaacgau

SEQ ID NO: 201752 - RNA, 19 nt, Homo sapiens
caauaaacagacacuuugu

SEQ ID NO: 201753 - RNA, 19 nt, Homo sapiens
gcacuacaacacuggaaag

SEQ ID NO: 201754 - RNA, 19 nt, Homo sapiens
cagacucaccuugaccuua

SEQ ID NO: 201755 - RNA, 19 nt, Homo sapiens
cggcagcuagugaacauuu

SEQ ID NO: 201756 - RNA, 19 nt, Homo sapiens
cgggauauuuccacaagca

SEQ ID NO: 201757 - RNA, 19 nt, Homo sapiens
gaaauagaugugcccuaca

SEQ ID NO: 201758 - RNA, 19 nt, Homo sapiens
ugaagauguccacaagaaa

SEQ ID NO: 201759 - RNA, 19 nt, Homo sapiens
guaauuuuguccuggguuu

SEQ ID NO: 201760 - RNA, 19 nt, Homo sapiens
cgaugaaugaccugauauu

SEQ ID NO: 201761 - RNA, 19 nt, Homo sapiens
ccucaguguugugcuugua

SEQ ID NO: 201762 - RNA, 19 nt, Homo sapiens
ggacaagcauacuacauaa

SEQ ID NO: 201763 - RNA, 19 nt, Homo sapiens
caaauuuccuuccuuguaa

SEQ ID NO: 201764 - RNA, 19 nt, Homo sapiens
ggaucgaucuucugaaauu

SEQ ID NO: 201765 - RNA, 19 nt, Homo sapiens
guacaaguguuuauggaaa

SEQ ID NO: 201766 - RNA, 19 nt, Homo sapiens
acaauggacuauagaguua

SEQ ID NO: 201767 - RNA, 19 nt, Homo sapiens
gugaacauauugcuuagua

SEQ ID NO: 201768 - RNA, 19 nt, Homo sapiens
ggaaugcaguaauagauau

SEQ ID NO: 201769 - RNA, 19 nt, Homo sapiens
agcaugagguuaucuauua

SEQ ID NO: 201770 - RNA, 19 nt, Homo sapiens
ggaaaucucaggcuaagaa

SEQ ID NO: 201771 - RNA, 19 nt, Homo sapiens
gaaaacauccuccucuuua

SEQ ID NO: 201772 - RNA, 19 nt, Homo sapiens
aaacaacaauggacuauag

SEQ ID NO: 201773 - RNA, 19 nt, Homo sapiens
uguaauaucugugcucuaa

SEQ ID NO: 201774 - RNA, 19 nt, Homo sapiens
caagagcauuguuuccuuu

SEQ ID NO: 201775 - RNA, 19 nt, Homo sapiens
gauaagaccaaacuucaaa

SEQ ID NO: 201776 - RNA, 19 nt, Homo sapiens
gcaagagcauuguuuccuu

SEQ ID NO: 201777 - RNA, 19 nt, Homo sapiens
caaagggaaaccuauauuu

SEQ ID NO: 201778 - RNA, 19 nt, Homo sapiens
gaaaacccauugaaguuaa

SEQ ID NO: 201779 - RNA, 19 nt, Homo sapiens
cagcauuguuggaagcuua

SEQ ID NO: 201780 - RNA, 19 nt, Homo sapiens
ugaaggcucuugauguuug

SEQ ID NO: 201781 - RNA, 19 nt, Homo sapiens
aaacaaagggaaaccuaua

SEQ ID NO: 201782 - RNA, 19 nt, Homo sapiens
ggacuccuguucauauuag

SEQ ID NO: 201783 - RNA, 19 nt, Homo sapiens
gacaguggauccaacaaug

SEQ ID NO: 201784 - RNA, 19 nt, Homo sapiens
gagguuaucuauuacucuu

SEQ ID NO: 201785 - RNA, 19 nt, Homo sapiens
ccgcugagcuucccaaagu

SEQ ID NO: 201786 - RNA, 19 nt, Homo sapiens
ucaaauuuccuuccuugua

SEQ ID NO: 201787 - RNA, 19 nt, Homo sapiens
gaaacaacaauggacuaua

SEQ ID NO: 201788 - RNA, 19 nt, Homo sapiens
gcaauaucuugaacagguu

SEQ ID NO: 201789 - RNA, 19 nt, Homo sapiens
guaacuguauacugaauuc

SEQ ID NO: 201790 - RNA, 19 nt, Homo sapiens
gaccuacuccuuucauaaa

SEQ ID NO: 201791 - RNA, 19 nt, Homo sapiens
caacugaugauuuacgauu

SEQ ID NO: 201792 - RNA, 19 nt, Homo sapiens
ccggaucgaucuucugaaa

SEQ ID NO: 201793 - RNA, 19 nt, Homo sapiens
gaaagccaucuuauucuug

SEQ ID NO: 201794 - RNA, 19 nt, Homo sapiens
caaaugaaggacaagcaua

SEQ ID NO: 201795 - RNA, 19 nt, Homo sapiens
gcucuaauaacgauguaua

SEQ ID NO: 201796 - RNA, 19 nt, Homo sapiens
ggaugccauuugauuguaa

SEQ ID NO: 201797 - RNA, 19 nt, Homo sapiens
gagauccugugcaauuaga

SEQ ID NO: 201798 - RNA, 19 nt, Homo sapiens
ggagagcuuugguuacaca

SEQ ID NO: 201799 - RNA, 19 nt, Homo sapiens
gccaaucugugagaacuuu

SEQ ID NO: 201800 - RNA, 19 nt, Homo sapiens
ugugaaggcucuugauguu

SEQ ID NO: 201801 - RNA, 19 nt, Homo sapiens
acaauucucuucaguuagu

SEQ ID NO: 201802 - RNA, 19 nt, Homo sapiens
guuguucucuccuggcuuu

SEQ ID NO: 201803 - RNA, 19 nt, Homo sapiens
caggcucuguggagaaaua

SEQ ID NO: 201804 - RNA, 19 nt, Homo sapiens
uaacaacggacuugggaaa

SEQ ID NO: 201805 - RNA, 19 nt, Homo sapiens
caacuccacuagcaauauc

SEQ ID NO: 201806 - RNA, 19 nt, Homo sapiens
uagaugguauuaucacaga

SEQ ID NO: 201807 - RNA, 19 nt, Homo sapiens
cugcaaauacuacagauaa

SEQ ID NO: 201808 - RNA, 19 nt, Homo sapiens
gcgaauugaucuuuaugca

SEQ ID NO: 201809 - RNA, 19 nt, Homo sapiens
ucauggauuucauuuguug

SEQ ID NO: 201810 - RNA, 19 nt, Homo sapiens
ggaaaacccauugaaguua

SEQ ID NO: 201811 - RNA, 19 nt, Homo sapiens
ucugagaucuaaugacuuc

SEQ ID NO: 201812 - RNA, 19 nt, Homo sapiens
cauaaaugccaaucuguga

SEQ ID NO: 201813 - RNA, 19 nt, Homo sapiens
caaaggcauuccuguugau

SEQ ID NO: 201814 - RNA, 19 nt, Homo sapiens
gaacauauugcuuaguaac

SEQ ID NO: 201815 - RNA, 19 nt, Homo sapiens
gagcauuguuuccuuucug

SEQ ID NO: 201816 - RNA, 19 nt, Homo sapiens
gguuauuggucaguuauga

SEQ ID NO: 201817 - RNA, 19 nt, Homo sapiens
caacggacuugggaaaucu

SEQ ID NO: 201818 - RNA, 19 nt, Homo sapiens
ggaggcaggucggcuuuua

SEQ ID NO: 201819 - RNA, 19 nt, Homo sapiens
gguuaucuauuacucuuuc

SEQ ID NO: 201820 - RNA, 19 nt, Homo sapiens
aaacauccuccucuuuauu

SEQ ID NO: 201821 - RNA, 19 nt, Homo sapiens
aggcauuccuguugaugua

SEQ ID NO: 201822 - RNA, 19 nt, Homo sapiens
agggaaaccuauauuuaug

SEQ ID NO: 201823 - RNA, 19 nt, Homo sapiens
guggagaaauaaaguucaa

SEQ ID NO: 201824 - RNA, 19 nt, Homo sapiens
aauuaugacugcuauggaa

SEQ ID NO: 201825 - RNA, 19 nt, Homo sapiens
cuauagaguuaacaucuuc

SEQ ID NO: 201826 - RNA, 19 nt, Homo sapiens
acagguuauuggucaguua

SEQ ID NO: 201827 - RNA, 19 nt, Homo sapiens
aaagccaucuuauucuugu

SEQ ID NO: 201828 - RNA, 19 nt, Homo sapiens
gagauguccuugucagcau

SEQ ID NO: 201829 - RNA, 19 nt, Homo sapiens
uaauacacagugagcauuu

SEQ ID NO: 201830 - RNA, 19 nt, Homo sapiens
gagcuuugguuacacaacu

SEQ ID NO: 201831 - RNA, 19 nt, Homo sapiens
ugacauuguuucccaugga

SEQ ID NO: 201832 - RNA, 19 nt, Homo sapiens
ggauaagaccaaacuucaa

SEQ ID NO: 201833 - RNA, 19 nt, Homo sapiens
gggaaguaauaaguugaaa

SEQ ID NO: 201834 - RNA, 19 nt, Homo sapiens
gaugguauuaucacagauu

SEQ ID NO: 201835 - RNA, 19 nt, Homo sapiens
ugaccuacuccuuucauaa

SEQ ID NO: 201836 - RNA, 19 nt, Homo sapiens
gugaccuacuccuuucaua

SEQ ID NO: 201837 - RNA, 19 nt, Homo sapiens
aaagugugcuuguguuguc

SEQ ID NO: 201838 - RNA, 19 nt, Homo sapiens
aggacaagcauacuacaua

SEQ ID NO: 201839 - RNA, 19 nt, Homo sapiens
gggacuccuguucauauua

SEQ ID NO: 201840 - RNA, 19 nt, Homo sapiens
gcaagcagauggaaaaggu

SEQ ID NO: 201841 - RNA, 19 nt, Homo sapiens
caaaguuuccuaugugaag

SEQ ID NO: 201842 - RNA, 19 nt, Homo sapiens
gaauaugguaacuguacaa

SEQ ID NO: 201843 - RNA, 19 nt, Homo sapiens
ggaagcuuaccaagagauu

SEQ ID NO: 201844 - RNA, 19 nt, Homo sapiens
aaagaauacugugaaugga

SEQ ID NO: 201845 - RNA, 19 nt, Homo sapiens
caaaaggguugaagcugaa

SEQ ID NO: 201846 - RNA, 19 nt, Homo sapiens
uugcuucccugguggagua

SEQ ID NO: 201847 - RNA, 19 nt, Homo sapiens
uggaaugcaguaauagaua

SEQ ID NO: 201848 - RNA, 19 nt, Homo sapiens
cagcaaagcgaauugaucu

SEQ ID NO: 201849 - RNA, 19 nt, Homo sapiens
gcucuugauguuuggcuua

SEQ ID NO: 201850 - RNA, 19 nt, Homo sapiens
cccaaaguuuccuauguga

SEQ ID NO: 201851 - RNA, 19 nt, Homo sapiens
gcugagcuucccaaaguuu

SEQ ID NO: 201852 - RNA, 19 nt, Homo sapiens
gcaugagguuaucuauuac

SEQ ID NO: 201853 - RNA, 19 nt, Homo sapiens
gaucgaucuucugaaauuc

SEQ ID NO: 201854 - RNA, 19 nt, Homo sapiens
guugguacauauuacacaa

SEQ ID NO: 201855 - RNA, 19 nt, Homo sapiens
aaacuguggcaccuuaauu

SEQ ID NO: 201856 - RNA, 19 nt, Homo sapiens
gcagcaaagcgaauugauc

SEQ ID NO: 201857 - RNA, 19 nt, Homo sapiens
gaagccuauucuaaggaaa

SEQ ID NO: 201858 - RNA, 19 nt, Homo sapiens
cuugauguuuggcuuauug

SEQ ID NO: 201859 - RNA, 19 nt, Homo sapiens
ggaaaacauccuccucuuu

SEQ ID NO: 201860 - RNA, 19 nt, Homo sapiens
caacaauggacuauagagu

SEQ ID NO: 201861 - RNA, 19 nt, Homo sapiens
gggaaaccuauauuuaugu

SEQ ID NO: 201862 - RNA, 19 nt, Homo sapiens
ggacaaaucugaucucuuu

SEQ ID NO: 201863 - RNA, 19 nt, Homo sapiens
gaggaaagguugcagauua

SEQ ID NO: 201864 - RNA, 19 nt, Homo sapiens
gaaaugagcucaaguacau

SEQ ID NO: 201865 - RNA, 19 nt, Homo sapiens
gagauaaaguggcauguua

SEQ ID NO: 201866 - RNA, 19 nt, Homo sapiens
gaacaacuauaugcacuua

SEQ ID NO: 201867 - RNA, 19 nt, Homo sapiens
cgaaauacauugaguuuga

SEQ ID NO: 201868 - RNA, 19 nt, Homo sapiens
agacaugguugguauauua

SEQ ID NO: 201869 - RNA, 19 nt, Homo sapiens
gcacagacaugguugguau

SEQ ID NO: 201870 - RNA, 19 nt, Homo sapiens
gaagaaagcuugugauucc

SEQ ID NO: 201871 - RNA, 19 nt, Homo sapiens
uaagauggcugguaaugaa

SEQ ID NO: 201872 - RNA, 19 nt, Homo sapiens
gcucuaagcuaccaaaguu

SEQ ID NO: 201873 - RNA, 19 nt, Homo sapiens
ugaauaagauggcugguaa

SEQ ID NO: 201874 - RNA, 19 nt, Homo sapiens
ggucuuccaugauuuauuu

SEQ ID NO: 201875 - RNA, 19 nt, Homo sapiens
caucagaacuuugccauuu

SEQ ID NO: 201876 - RNA, 19 nt, Homo sapiens
ggucucaucuuugguaaua

SEQ ID NO: 201877 - RNA, 19 nt, Homo sapiens
ggacuaagauucaacaaac

SEQ ID NO: 201878 - RNA, 19 nt, Homo sapiens
gcuguugacugugcuauua

SEQ ID NO: 201879 - RNA, 19 nt, Homo sapiens
gaaacaagacaguugaauu

SEQ ID NO: 201880 - RNA, 19 nt, Homo sapiens
gaagcuguguuuagugaaa

SEQ ID NO: 201881 - RNA, 19 nt, Homo sapiens
gugaggaguucugauauua

SEQ ID NO: 201882 - RNA, 19 nt, Homo sapiens
uaagauagaccaauucuga

SEQ ID NO: 201883 - RNA, 19 nt, Homo sapiens
ggugguuucugcccaauua

SEQ ID NO: 201884 - RNA, 19 nt, Homo sapiens
gaaugaagaugauaaacca

SEQ ID NO: 201885 - RNA, 19 nt, Homo sapiens
gaauaacacucccauggau

SEQ ID NO: 201886 - RNA, 19 nt, Homo sapiens
gcaguuugcuuuccauguu

SEQ ID NO: 201887 - RNA, 19 nt, Homo sapiens
ugucauaccucgagauaaa

SEQ ID NO: 201888 - RNA, 19 nt, Homo sapiens
gaacauguguauuucuauc

SEQ ID NO: 201889 - RNA, 19 nt, Homo sapiens
gauuagcuguugaccauuu

SEQ ID NO: 201890 - RNA, 19 nt, Homo sapiens
gcuggaagccugcaaagua

SEQ ID NO: 201891 - RNA, 19 nt, Homo sapiens
ggugggcucuguaguuuaa

SEQ ID NO: 201892 - RNA, 19 nt, Homo sapiens
gaaaguaugggaacugcua

SEQ ID NO: 201893 - RNA, 19 nt, Homo sapiens
guacacaccucaaggagau

SEQ ID NO: 201894 - RNA, 19 nt, Homo sapiens
gaaaguggagaucgaaauu

SEQ ID NO: 201895 - RNA, 19 nt, Homo sapiens
gcacacaggacaaaucuga

SEQ ID NO: 201896 - RNA, 19 nt, Homo sapiens
caagacaguugaauugugu

SEQ ID NO: 201897 - RNA, 19 nt, Homo sapiens
uaaaguaagcucuguugua

SEQ ID NO: 201898 - RNA, 19 nt, Homo sapiens
aauauuaccucgugcauug

SEQ ID NO: 201899 - RNA, 19 nt, Homo sapiens
acacaagcauuuagaagaa

SEQ ID NO: 201900 - RNA, 19 nt, Homo sapiens
gaagauuugcuguucuaua

SEQ ID NO: 201901 - RNA, 19 nt, Homo sapiens
ggagacagguagcauuugu

SEQ ID NO: 201902 - RNA, 19 nt, Homo sapiens
aaacguaugugugaaugua

SEQ ID NO: 201903 - RNA, 19 nt, Homo sapiens
gauagaccaauucugauua

SEQ ID NO: 201904 - RNA, 19 nt, Homo sapiens
agugagagcuggcauacua

SEQ ID NO: 201905 - RNA, 19 nt, Homo sapiens
gugaugaucugcugauaug

SEQ ID NO: 201906 - RNA, 19 nt, Homo sapiens
aaacaagacaguugaauug

SEQ ID NO: 201907 - RNA, 19 nt, Homo sapiens
gcacucaaaucuacaggau

SEQ ID NO: 201908 - RNA, 19 nt, Homo sapiens
gcuguuggcugguaauaau

SEQ ID NO: 201909 - RNA, 19 nt, Homo sapiens
uaaaguggcauguuaguga

SEQ ID NO: 201910 - RNA, 19 nt, Homo sapiens
ggguaaagauaaauucaga

SEQ ID NO: 201911 - RNA, 19 nt, Homo sapiens
gaaagugagagcuggcaua

SEQ ID NO: 201912 - RNA, 19 nt, Homo sapiens
cugcugauaugcauuuaua

SEQ ID NO: 201913 - RNA, 19 nt, Homo sapiens
gaucuuguuucucugugua

SEQ ID NO: 201914 - RNA, 19 nt, Homo sapiens
cugaauaugugcaucgaua

SEQ ID NO: 201915 - RNA, 19 nt, Homo sapiens
uuaaugaucuuggaacuga

SEQ ID NO: 201916 - RNA, 19 nt, Homo sapiens
ucaguaaacuccaaagauc

SEQ ID NO: 201917 - RNA, 19 nt, Homo sapiens
acacacacaugcacacaaa

SEQ ID NO: 201918 - RNA, 19 nt, Homo sapiens
caagagauuuguccuccuu

SEQ ID NO: 201919 - RNA, 19 nt, Homo sapiens
gaacuuugccauuugucua

SEQ ID NO: 201920 - RNA, 19 nt, Homo sapiens
gagcaauuguugugacuuc

SEQ ID NO: 201921 - RNA, 19 nt, Homo sapiens
gaugauaaaccacauaauc

SEQ ID NO: 201922 - RNA, 19 nt, Homo sapiens
gaaagaguguauggauaug

SEQ ID NO: 201923 - RNA, 19 nt, Homo sapiens
acacagcuaugaauguauu

SEQ ID NO: 201924 - RNA, 19 nt, Homo sapiens
ggacagaggcauucuacug

SEQ ID NO: 201925 - RNA, 19 nt, Homo sapiens
gaugucagauuuagauucu

SEQ ID NO: 201926 - RNA, 19 nt, Homo sapiens
gcacacaaauggacuucuc

SEQ ID NO: 201927 - RNA, 19 nt, Homo sapiens
gaagaugauaaaccacaua

SEQ ID NO: 201928 - RNA, 19 nt, Homo sapiens
ccaaaguuauucugaaagu

SEQ ID NO: 201929 - RNA, 19 nt, Homo sapiens
gaaauaugccauugcuguu

SEQ ID NO: 201930 - RNA, 19 nt, Homo sapiens
aaaguucccuucugucuuc

SEQ ID NO: 201931 - RNA, 19 nt, Homo sapiens
uuaagagucugcaucaaga

SEQ ID NO: 201932 - RNA, 19 nt, Homo sapiens
gaacugcuacaacuaacaa

SEQ ID NO: 201933 - RNA, 19 nt, Homo sapiens
uuaccuagcuuggaagauu

SEQ ID NO: 201934 - RNA, 19 nt, Homo sapiens
ccucgugcauuguauaauu

SEQ ID NO: 201935 - RNA, 19 nt, Homo sapiens
ggaauaacacucccaugga

SEQ ID NO: 201936 - RNA, 19 nt, Homo sapiens
gaaagguugcagauuauau

SEQ ID NO: 201937 - RNA, 19 nt, Homo sapiens
gaggaguucugauauuaag

SEQ ID NO: 201938 - RNA, 19 nt, Homo sapiens
aaaguaagcucuguuguac

SEQ ID NO: 201939 - RNA, 19 nt, Homo sapiens
gaaauaguuaccaaugcua

SEQ ID NO: 201940 - RNA, 19 nt, Homo sapiens
uauguuggauucaguaaug

SEQ ID NO: 201941 - RNA, 19 nt, Homo sapiens
gaucaaaaccauucuguaa

SEQ ID NO: 201942 - RNA, 19 nt, Homo sapiens
gagcucaaguacaugaaug

SEQ ID NO: 201943 - RNA, 19 nt, Homo sapiens
gaaaugcucuaagcuacca

SEQ ID NO: 201944 - RNA, 19 nt, Homo sapiens
ucaaggagauucugacaac

SEQ ID NO: 201945 - RNA, 19 nt, Homo sapiens
ggaugaagcacugcacuuu

SEQ ID NO: 201946 - RNA, 19 nt, Homo sapiens
ggagaugugucugcacuuc

SEQ ID NO: 201947 - RNA, 19 nt, Homo sapiens
ccaaguagcugcccuuucc

SEQ ID NO: 201948 - RNA, 19 nt, Homo sapiens
gauuaacucuucaaacaac

SEQ ID NO: 201949 - RNA, 19 nt, Homo sapiens
gaucauuccagauuucuug

SEQ ID NO: 201950 - RNA, 19 nt, Homo sapiens
cacccuagcuucaugaugu

SEQ ID NO: 201951 - RNA, 19 nt, Homo sapiens
caaucucccuccauaaugu

SEQ ID NO: 201952 - RNA, 19 nt, Homo sapiens
ugaagaacauguguauuuc

SEQ ID NO: 201953 - RNA, 19 nt, Homo sapiens
uuacagcacucaaaucuac

SEQ ID NO: 201954 - RNA, 19 nt, Homo sapiens
gauaaaccacauaauccua

SEQ ID NO: 201955 - RNA, 19 nt, Homo sapiens
gauuugcuguucuauacaa

SEQ ID NO: 201956 - RNA, 19 nt, Homo sapiens
gaucugcugauaugcauuu

SEQ ID NO: 201957 - RNA, 19 nt, Homo sapiens
cuggaagccugcaaaguaa

SEQ ID NO: 201958 - RNA, 19 nt, Homo sapiens
ugaaagaguguauggauau

SEQ ID NO: 201959 - RNA, 19 nt, Homo sapiens
ugacuucacuaauaaagca

SEQ ID NO: 201960 - RNA, 19 nt, Homo sapiens
ggaaagguugcagauuaua

SEQ ID NO: 201961 - RNA, 19 nt, Homo sapiens
acagguagcauuuguaaga

SEQ ID NO: 201962 - RNA, 19 nt, Homo sapiens
gcagugaucuagucucuuu

SEQ ID NO: 201963 - RNA, 19 nt, Homo sapiens
cuaacgagauucaagauua

SEQ ID NO: 201964 - RNA, 19 nt, Homo sapiens
cggcauggcucaagaguuu

SEQ ID NO: 201965 - RNA, 19 nt, Homo sapiens
gauuggagcucugcaguaa

SEQ ID NO: 201966 - RNA, 19 nt, Homo sapiens
caagagauccucagucaau

SEQ ID NO: 201967 - RNA, 19 nt, Homo sapiens
caaccacacuaacgagauu

SEQ ID NO: 201968 - RNA, 19 nt, Homo sapiens
aagaaucccuuaucaugaa

SEQ ID NO: 201969 - RNA, 19 nt, Homo sapiens
ggaccaacuugcucuuaau

SEQ ID NO: 201970 - RNA, 19 nt, Homo sapiens
aacaagggcuucuggaauu

SEQ ID NO: 201971 - RNA, 19 nt, Homo sapiens
gaaguuugccuguucuaga

SEQ ID NO: 201972 - RNA, 19 nt, Homo sapiens
caacaauucugugaaaggu

SEQ ID NO: 201973 - RNA, 19 nt, Homo sapiens
gaacugcugacgcggcuaa

SEQ ID NO: 201974 - RNA, 19 nt, Homo sapiens
ggacccaauuggagaaauc

SEQ ID NO: 201975 - RNA, 19 nt, Homo sapiens
cggcaugucucuaccucua

SEQ ID NO: 201976 - RNA, 19 nt, Homo sapiens
cccaagagauccucaguca

SEQ ID NO: 201977 - RNA, 19 nt, Homo sapiens
gaaggugguuguguucauc

SEQ ID NO: 201978 - RNA, 19 nt, Homo sapiens
ggaaggugguuguguucau

SEQ ID NO: 201979 - RNA, 19 nt, Homo sapiens
cagcacuucugguggauga

SEQ ID NO: 201980 - RNA, 19 nt, Homo sapiens
uaucugcuacugcccauua

SEQ ID NO: 201981 - RNA, 19 nt, Homo sapiens
caaacaagggcuucuggaa

SEQ ID NO: 201982 - RNA, 19 nt, Homo sapiens
agacuaccagcaaagauua

SEQ ID NO: 201983 - RNA, 19 nt, Homo sapiens
aaugaugaauccacaguug

SEQ ID NO: 201984 - RNA, 19 nt, Homo sapiens
agaagacugugacaaguuc

SEQ ID NO: 201985 - RNA, 19 nt, Homo sapiens
ucaugaaguuugccuguuc

SEQ ID NO: 201986 - RNA, 19 nt, Homo sapiens
ugacgucccuccucaagag

SEQ ID NO: 201987 - RNA, 19 nt, Homo sapiens
ccaagaguguaucugugaa

SEQ ID NO: 201988 - RNA, 19 nt, Homo sapiens
uggaccaacuugcucuuaa

SEQ ID NO: 201989 - RNA, 19 nt, Homo sapiens
acaagggcuucuggaauuu

SEQ ID NO: 201990 - RNA, 19 nt, Homo sapiens
aaacaagggcuucuggaau

SEQ ID NO: 201991 - RNA, 19 nt, Homo sapiens
ccaauuggagaaaucauau

SEQ ID NO: 201992 - RNA, 19 nt, Homo sapiens
cacaguugguuaucugcua

SEQ ID NO: 201993 - RNA, 19 nt, Homo sapiens
ggcaugcguuucuuacugu

SEQ ID NO: 201994 - RNA, 19 nt, Homo sapiens
aaguuugccuguucuagaa

SEQ ID NO: 201995 - RNA, 19 nt, Homo sapiens
ggagaaaucauaugaaaag

SEQ ID NO: 201996 - RNA, 19 nt, Homo sapiens
gcucacugacccucaauug

SEQ ID NO: 201997 - RNA, 19 nt, Homo sapiens
ucagaagacugugacaagu

SEQ ID NO: 201998 - RNA, 19 nt, Homo sapiens
caagaguguaucugugaaa

SEQ ID NO: 201999 - RNA, 19 nt, Homo sapiens
gcaaagauuaaagcaugaa

SEQ ID NO: 202000 - RNA, 19 nt, Homo sapiens
aagcauaguuggucuuggu

SEQ ID NO: 202001 - RNA, 19 nt, Homo sapiens
gcaugucucuaccucuaag

SEQ ID NO: 202002 - RNA, 19 nt, Homo sapiens
ucacugacccucaauuguc

SEQ ID NO: 202003 - RNA, 19 nt, Homo sapiens
ucaauugcccaucaaacaa

SEQ ID NO: 202004 - RNA, 19 nt, Homo sapiens
cagaagacugugacaaguu

SEQ ID NO: 202005 - RNA, 19 nt, Homo sapiens
ccagacuccuucuccacaa

SEQ ID NO: 202006 - RNA, 19 nt, Homo sapiens
ugacgcggcuaaagcagau

SEQ ID NO: 202007 - RNA, 19 nt, Homo sapiens
aacggugccucgagucuuu

SEQ ID NO: 202008 - RNA, 19 nt, Homo sapiens
agauaauccugaacacugu

SEQ ID NO: 202009 - RNA, 19 nt, Homo sapiens
acaugcaucucuccacuca

SEQ ID NO: 202010 - RNA, 19 nt, Homo sapiens
caaaugaugacagcacuuc

SEQ ID NO: 202011 - RNA, 19 nt, Homo sapiens
gcaggagggcccaagagau

SEQ ID NO: 202012 - RNA, 19 nt, Homo sapiens
uagacuaccagcaaagauu

SEQ ID NO: 202013 - RNA, 19 nt, Homo sapiens
ccaguguucuccaccuugu

SEQ ID NO: 202014 - RNA, 19 nt, Homo sapiens
caacuugcucuuaaucaca

SEQ ID NO: 202015 - RNA, 19 nt, Homo sapiens
gaacggugccucgagucuu

SEQ ID NO: 202016 - RNA, 19 nt, Homo sapiens
cccauuagcuaaaaucauu

SEQ ID NO: 202017 - RNA, 19 nt, Homo sapiens
uauuuagacuaccagcaaa

SEQ ID NO: 202018 - RNA, 19 nt, Homo sapiens
uggcaugcguuucuuacug

SEQ ID NO: 202019 - RNA, 19 nt, Homo sapiens
acacuaacgagauucaaga

SEQ ID NO: 202020 - RNA, 19 nt, Homo sapiens
cuacugcccauuagcuaaa

SEQ ID NO: 202021 - RNA, 19 nt, Homo sapiens
caggagggcccaagagauc

SEQ ID NO: 202022 - RNA, 19 nt, Homo sapiens
cgagauucaagauuauuug

SEQ ID NO: 202023 - RNA, 19 nt, Homo sapiens
aagagauccucagucaauu

SEQ ID NO: 202024 - RNA, 19 nt, Homo sapiens
gucaauugcccaucaaaca

SEQ ID NO: 202025 - RNA, 19 nt, Homo sapiens
gcaugcguuucuuacuguu

SEQ ID NO: 202026 - RNA, 19 nt, Homo sapiens
ccaccaaccacacuaacga

SEQ ID NO: 202027 - RNA, 19 nt, Homo sapiens
gaauguguucuuucuaacu

SEQ ID NO: 202028 - RNA, 19 nt, Homo sapiens
gcaaaugaugacagcacuu

SEQ ID NO: 202029 - RNA, 19 nt, Homo sapiens
ucagucaauugcccaucaa

SEQ ID NO: 202030 - RNA, 19 nt, Homo sapiens
cugggaaggugguuguguu

SEQ ID NO: 202031 - RNA, 19 nt, Homo sapiens
cccaauuggagaaaucaua

SEQ ID NO: 202032 - RNA, 19 nt, Homo sapiens
cggaugcagugaucuaguc

SEQ ID NO: 202033 - RNA, 19 nt, Homo sapiens
uauuuaagauggcuaucca

SEQ ID NO: 202034 - RNA, 19 nt, Homo sapiens
gacccucaauuguccucuu

SEQ ID NO: 202035 - RNA, 19 nt, Homo sapiens
ccuucaaucucuagugaca

SEQ ID NO: 202036 - RNA, 19 nt, Homo sapiens
ugccuguucuagaauugua

SEQ ID NO: 202037 - RNA, 19 nt, Homo sapiens
guuugccuguucuagaauu

SEQ ID NO: 202038 - RNA, 19 nt, Homo sapiens
gacuccuucuccacaauga

SEQ ID NO: 202039 - RNA, 19 nt, Homo sapiens
ccaacuugcucuuaaucac

SEQ ID NO: 202040 - RNA, 19 nt, Homo sapiens
gcacuucugguggaugaau

SEQ ID NO: 202041 - RNA, 19 nt, Homo sapiens
caucccaucccaccuugaa

SEQ ID NO: 202042 - RNA, 19 nt, Homo sapiens
gaccaacuugcucuuaauc

SEQ ID NO: 202043 - RNA, 19 nt, Homo sapiens
uuccuucaaucucuaguga

SEQ ID NO: 202044 - RNA, 19 nt, Homo sapiens
ugaauccacaguugguuau

SEQ ID NO: 202045 - RNA, 19 nt, Homo sapiens
ccucaauuguccucuuugg

SEQ ID NO: 202046 - RNA, 19 nt, Homo sapiens
uuauuuagacuaccagcaa

SEQ ID NO: 202047 - RNA, 19 nt, Homo sapiens
ucagugguauuuugaaugu

SEQ ID NO: 202048 - RNA, 19 nt, Homo sapiens
cagacuccuucuccacaau

SEQ ID NO: 202049 - RNA, 19 nt, Homo sapiens
guggaccaacuugcucuua

SEQ ID NO: 202050 - RNA, 19 nt, Homo sapiens
ccuacacuuugaaaacuua

SEQ ID NO: 202051 - RNA, 19 nt, Homo sapiens
ucucauaggaaauguucaa

SEQ ID NO: 202052 - RNA, 19 nt, Homo sapiens
ugaauguguucuuucuaac

SEQ ID NO: 202053 - RNA, 19 nt, Homo sapiens
acccucaauuguccucuuu

SEQ ID NO: 202054 - RNA, 19 nt, Homo sapiens
caauugcccaucaaacaag

SEQ ID NO: 202055 - RNA, 19 nt, Homo sapiens
gcauggcucaagaguuugu

SEQ ID NO: 202056 - RNA, 19 nt, Homo sapiens
caugaaguuugccuguucu

SEQ ID NO: 202057 - RNA, 19 nt, Homo sapiens
agcaaagauuaaagcauga

SEQ ID NO: 202058 - RNA, 19 nt, Homo sapiens
gacuaccagcaaagauuaa

SEQ ID NO: 202059 - RNA, 19 nt, Homo sapiens
ugcagaggcuguggucaug

SEQ ID NO: 202060 - RNA, 19 nt, Homo sapiens
agagauccucagucaauug

SEQ ID NO: 202061 - RNA, 19 nt, Homo sapiens
gaugaauccacaguugguu

SEQ ID NO: 202062 - RNA, 19 nt, Homo sapiens
gcacagccaugaaguauaa

SEQ ID NO: 202063 - RNA, 19 nt, Homo sapiens
gaagaucuaugguugacua

SEQ ID NO: 202064 - RNA, 19 nt, Homo sapiens
gugaaugccuauagaaaua

SEQ ID NO: 202065 - RNA, 19 nt, Homo sapiens
gagaaagucuucaaagugu

SEQ ID NO: 202066 - RNA, 19 nt, Homo sapiens
caaugaagcuucuuacaug

SEQ ID NO: 202067 - RNA, 19 nt, Homo sapiens
gcagucaguugcuugcuua

SEQ ID NO: 202068 - RNA, 19 nt, Homo sapiens
gagagaaacauuaugguua

SEQ ID NO: 202069 - RNA, 19 nt, Homo sapiens
caaaggaacuggaagacuu

SEQ ID NO: 202070 - RNA, 19 nt, Homo sapiens
gaucuaugguugacuaauu

SEQ ID NO: 202071 - RNA, 19 nt, Homo sapiens
gcagaccuaucacaaguuu

SEQ ID NO: 202072 - RNA, 19 nt, Homo sapiens
gcacccagcuucacuaaca

SEQ ID NO: 202073 - RNA, 19 nt, Homo sapiens
caagugaguucuuaguauu

SEQ ID NO: 202074 - RNA, 19 nt, Homo sapiens
cccaagaacuauacugaua

SEQ ID NO: 202075 - RNA, 19 nt, Homo sapiens
cuacucaccugacuuugua

SEQ ID NO: 202076 - RNA, 19 nt, Homo sapiens
gagaagcaguugaccaaau

SEQ ID NO: 202077 - RNA, 19 nt, Homo sapiens
gcaaagcccuaugaaggaa

SEQ ID NO: 202078 - RNA, 19 nt, Homo sapiens
gucaguugcuugcuuauuu

SEQ ID NO: 202079 - RNA, 19 nt, Homo sapiens
ugaaagggauucuaacuac

SEQ ID NO: 202080 - RNA, 19 nt, Homo sapiens
uggcuucucugaugacaua

SEQ ID NO: 202081 - RNA, 19 nt, Homo sapiens
ucaagugaguucuuaguau

SEQ ID NO: 202082 - RNA, 19 nt, Homo sapiens
ggagaaagaaauuaagguu

SEQ ID NO: 202083 - RNA, 19 nt, Homo sapiens
ucuccugacucauuaauaa

SEQ ID NO: 202084 - RNA, 19 nt, Homo sapiens
ccagaucucuacuugaaug

SEQ ID NO: 202085 - RNA, 19 nt, Homo sapiens
aaagcccuguggauaauua

SEQ ID NO: 202086 - RNA, 19 nt, Homo sapiens
gcaagggagguauccguua

SEQ ID NO: 202087 - RNA, 19 nt, Homo sapiens
ggagagaaacauuaugguu

SEQ ID NO: 202088 - RNA, 19 nt, Homo sapiens
caaguagagugucccagaa

SEQ ID NO: 202089 - RNA, 19 nt, Homo sapiens
gcuuaucauucauguauug

SEQ ID NO: 202090 - RNA, 19 nt, Homo sapiens
gaggagugacaguaucuua

SEQ ID NO: 202091 - RNA, 19 nt, Homo sapiens
ggcuuaaccuggugauaaa

SEQ ID NO: 202092 - RNA, 19 nt, Homo sapiens
cccaugaagugcuagauaa

SEQ ID NO: 202093 - RNA, 19 nt, Homo sapiens
caagucagcccguuaagga

SEQ ID NO: 202094 - RNA, 19 nt, Homo sapiens
ggacgcaucucugcuacug

SEQ ID NO: 202095 - RNA, 19 nt, Homo sapiens
ggaggccgacugugacaua

SEQ ID NO: 202096 - RNA, 19 nt, Homo sapiens
guucagggauuugguaaug

SEQ ID NO: 202097 - RNA, 19 nt, Homo sapiens
gaguguagaugaaguaaaa

SEQ ID NO: 202098 - RNA, 19 nt, Homo sapiens
ccacuugggcucccuguuu

SEQ ID NO: 202099 - RNA, 19 nt, Homo sapiens
caagcugagugugaaagua

SEQ ID NO: 202100 - RNA, 19 nt, Homo sapiens
gcacuaugauauuaaugca

SEQ ID NO: 202101 - RNA, 19 nt, Homo sapiens
ccaagaacuauacugauaa

SEQ ID NO: 202102 - RNA, 19 nt, Homo sapiens
ucacuauccucuucacaug

SEQ ID NO: 202103 - RNA, 19 nt, Homo sapiens
caacgcacccagagucaaa

SEQ ID NO: 202104 - RNA, 19 nt, Homo sapiens
cagaugguauugacccaaa

SEQ ID NO: 202105 - RNA, 19 nt, Homo sapiens
uuacagcacugaugugagu

SEQ ID NO: 202106 - RNA, 19 nt, Homo sapiens
gcagguugcaaacaaauau

SEQ ID NO: 202107 - RNA, 19 nt, Homo sapiens
ggauaucgggugcaucuga

SEQ ID NO: 202108 - RNA, 19 nt, Homo sapiens
caagaucauugcugaaggu

SEQ ID NO: 202109 - RNA, 19 nt, Homo sapiens
caaggagguucaccaugga

SEQ ID NO: 202110 - RNA, 19 nt, Homo sapiens
cagaauuugcuuaccauaa

SEQ ID NO: 202111 - RNA, 19 nt, Homo sapiens
ugagaaagucuucaaagug

SEQ ID NO: 202112 - RNA, 19 nt, Homo sapiens
uaaaucaugucagcuaugg

SEQ ID NO: 202113 - RNA, 19 nt, Homo sapiens
gcaaccaugugcugagucu

SEQ ID NO: 202114 - RNA, 19 nt, Homo sapiens
uaagaucaaucccaagaac

SEQ ID NO: 202115 - RNA, 19 nt, Homo sapiens
caugaagugcuagauaaua

SEQ ID NO: 202116 - RNA, 19 nt, Homo sapiens
uuccagaucucuacuugaa

SEQ ID NO: 202117 - RNA, 19 nt, Homo sapiens
agaagcaguugaccaaauc

SEQ ID NO: 202118 - RNA, 19 nt, Homo sapiens
acaccaggguuuggagaua

SEQ ID NO: 202119 - RNA, 19 nt, Homo sapiens
ggaaugacaccaggguuug

SEQ ID NO: 202120 - RNA, 19 nt, Homo sapiens
caagggagguauccguuac

SEQ ID NO: 202121 - RNA, 19 nt, Homo sapiens
guuagcggaucauguacaa

SEQ ID NO: 202122 - RNA, 19 nt, Homo sapiens
gaaagcaugguggaacuau

SEQ ID NO: 202123 - RNA, 19 nt, Homo sapiens
gcugaagaaucuaaaucau

SEQ ID NO: 202124 - RNA, 19 nt, Homo sapiens
uccagaagcugacaagauc

SEQ ID NO: 202125 - RNA, 19 nt, Homo sapiens
ggccuacacucuaugagau

SEQ ID NO: 202126 - RNA, 19 nt, Homo sapiens
caccaggguuuggagauaa

SEQ ID NO: 202127 - RNA, 19 nt, Homo sapiens
cuggaucgcugauaccuau

SEQ ID NO: 202128 - RNA, 19 nt, Homo sapiens
gcaaaaugguggaggcuau

SEQ ID NO: 202129 - RNA, 19 nt, Homo sapiens
agaaagucuucaaagugua

SEQ ID NO: 202130 - RNA, 19 nt, Homo sapiens
uaaagcugguguuaagauc

SEQ ID NO: 202131 - RNA, 19 nt, Homo sapiens
auacaagugugcagugguu

SEQ ID NO: 202132 - RNA, 19 nt, Homo sapiens
uggguugaguguuucauuu

SEQ ID NO: 202133 - RNA, 19 nt, Homo sapiens
acuauccucuucacaugua

SEQ ID NO: 202134 - RNA, 19 nt, Homo sapiens
aagguuagcggaucaugua

SEQ ID NO: 202135 - RNA, 19 nt, Homo sapiens
gaaagaaauuaagguuagc

SEQ ID NO: 202136 - RNA, 19 nt, Homo sapiens
caacaagucaauccaaguc

SEQ ID NO: 202137 - RNA, 19 nt, Homo sapiens
ggcaaagcccuaugaagga

SEQ ID NO: 202138 - RNA, 19 nt, Homo sapiens
aaugaagcuucuuacauga

SEQ ID NO: 202139 - RNA, 19 nt, Homo sapiens
gaaacauuaugguuauucc

SEQ ID NO: 202140 - RNA, 19 nt, Homo sapiens
gccaacaacuccagaagcu

SEQ ID NO: 202141 - RNA, 19 nt, Homo sapiens
guuaagaucaaucccaaga

SEQ ID NO: 202142 - RNA, 19 nt, Homo sapiens
gaaaacauccuuggguuga

SEQ ID NO: 202143 - RNA, 19 nt, Homo sapiens
uuucucuccugacucauua

SEQ ID NO: 202144 - RNA, 19 nt, Homo sapiens
ccaaggcaaagcccuauga

SEQ ID NO: 202145 - RNA, 19 nt, Homo sapiens
gacuucaaauugcaacaug

SEQ ID NO: 202146 - RNA, 19 nt, Homo sapiens
gaauccagaugguauugac

SEQ ID NO: 202147 - RNA, 19 nt, Homo sapiens
uaugauacaguccaaagaa

SEQ ID NO: 202148 - RNA, 19 nt, Homo sapiens
ccagagagccauuuuggua

SEQ ID NO: 202149 - RNA, 19 nt, Homo sapiens
gcgcacagccaugaaguau

SEQ ID NO: 202150 - RNA, 19 nt, Homo sapiens
gugagaagcaguugaccaa

SEQ ID NO: 202151 - RNA, 19 nt, Homo sapiens
ucagggauuugguaaugug

SEQ ID NO: 202152 - RNA, 19 nt, Homo sapiens
ucaaugaagcuucuuacau

SEQ ID NO: 202153 - RNA, 19 nt, Homo sapiens
aaacagugaaugccuauag

SEQ ID NO: 202154 - RNA, 19 nt, Homo sapiens
uggauaccauucucaacaa

SEQ ID NO: 202155 - RNA, 19 nt, Homo sapiens
gaaagucuucaaaguguac

SEQ ID NO: 202156 - RNA, 19 nt, Homo sapiens
ugaaguauaaccugggauu

SEQ ID NO: 202157 - RNA, 19 nt, Homo sapiens
ugaugugaguguagaugaa

SEQ ID NO: 202158 - RNA, 19 nt, Homo sapiens
uugaguggcugaagaaucu

SEQ ID NO: 202159 - RNA, 19 nt, Homo sapiens
uggcuuaaccuggugauaa

SEQ ID NO: 202160 - RNA, 19 nt, Homo sapiens
cugcagaccuaucacaagu

SEQ ID NO: 202161 - RNA, 19 nt, Homo sapiens
ucuucaaaguguacaauga

SEQ ID NO: 202162 - RNA, 19 nt, Homo sapiens
caaaggaacuggaagacuu

SEQ ID NO: 202163 - RNA, 19 nt, Homo sapiens
acacagccaugaaguauaa

SEQ ID NO: 202164 - RNA, 19 nt, Homo sapiens
gagaacagcugccuauguc

SEQ ID NO: 202165 - RNA, 19 nt, Homo sapiens
caaucaagcuucuuacaug

SEQ ID NO: 202166 - RNA, 19 nt, Homo sapiens
gagaagcaguugaccaaau

SEQ ID NO: 202167 - RNA, 19 nt, Homo sapiens
ggaggucgacugugacaua

SEQ ID NO: 202168 - RNA, 19 nt, Homo sapiens
gcaaagcccuaugaaggaa

SEQ ID NO: 202169 - RNA, 19 nt, Homo sapiens
ggaaugacaccaggguuua

SEQ ID NO: 202170 - RNA, 19 nt, Homo sapiens
ccauggagcuagcaaagaa

SEQ ID NO: 202171 - RNA, 19 nt, Homo sapiens
ugaaagggauucuaacuac

SEQ ID NO: 202172 - RNA, 19 nt, Homo sapiens
acaccaggguuuagagaua

SEQ ID NO: 202173 - RNA, 19 nt, Homo sapiens
uggcuucucugaugacaua

SEQ ID NO: 202174 - RNA, 19 nt, Homo sapiens
ccagaucucuacuugaaug

SEQ ID NO: 202175 - RNA, 19 nt, Homo sapiens
gcacacagccaugaaguau

SEQ ID NO: 202176 - RNA, 19 nt, Homo sapiens
gcaagggagguauccguua

SEQ ID NO: 202177 - RNA, 19 nt, Homo sapiens
gaggagugacaguaucuua

SEQ ID NO: 202178 - RNA, 19 nt, Homo sapiens
gaacagcugccuaugucaa

SEQ ID NO: 202179 - RNA, 19 nt, Homo sapiens
ggacgcaucucugcuacug

SEQ ID NO: 202180 - RNA, 19 nt, Homo sapiens
guucagggauuugguaaug

SEQ ID NO: 202181 - RNA, 19 nt, Homo sapiens
gaguguagaugaaguaaaa

SEQ ID NO: 202182 - RNA, 19 nt, Homo sapiens
gcacuaugauauuaaugca

SEQ ID NO: 202183 - RNA, 19 nt, Homo sapiens
gagagaaacauuuugguua

SEQ ID NO: 202184 - RNA, 19 nt, Homo sapiens
cccaagaacuauaccgaaa

SEQ ID NO: 202185 - RNA, 19 nt, Homo sapiens
caacgcacccagagucaaa

SEQ ID NO: 202186 - RNA, 19 nt, Homo sapiens
cagaugguauugacccaaa

SEQ ID NO: 202187 - RNA, 19 nt, Homo sapiens
uuacagcacugaugugagu

SEQ ID NO: 202188 - RNA, 19 nt, Homo sapiens
aaucaagcuucuuacauga

SEQ ID NO: 202189 - RNA, 19 nt, Homo sapiens
cgggagauguccuggauug

SEQ ID NO: 202190 - RNA, 19 nt, Homo sapiens
caagaucauugcugaaggu

SEQ ID NO: 202191 - RNA, 19 nt, Homo sapiens
uccagaagcugauaagauc

SEQ ID NO: 202192 - RNA, 19 nt, Homo sapiens
caccaggguuuagagauaa

SEQ ID NO: 202193 - RNA, 19 nt, Homo sapiens
caaggagguucaccaugga

SEQ ID NO: 202194 - RNA, 19 nt, Homo sapiens
uaaaucaugucagcuaugg

SEQ ID NO: 202195 - RNA, 19 nt, Homo sapiens
gcaaccaugugcugagucu

SEQ ID NO: 202196 - RNA, 19 nt, Homo sapiens
uaagaucaaucccaagaac

SEQ ID NO: 202197 - RNA, 19 nt, Homo sapiens
uuccagaucucuacuugaa

SEQ ID NO: 202198 - RNA, 19 nt, Homo sapiens
agaagcaguugaccaaauc

SEQ ID NO: 202199 - RNA, 19 nt, Homo sapiens
caagggagguauccguuac

SEQ ID NO: 202200 - RNA, 19 nt, Homo sapiens
gaaagcaugguggaacuau

SEQ ID NO: 202201 - RNA, 19 nt, Homo sapiens
gcugaagaaucuaaaucau

SEQ ID NO: 202202 - RNA, 19 nt, Homo sapiens
ggccuacacucuaugagau

SEQ ID NO: 202203 - RNA, 19 nt, Homo sapiens
ggucgacugugacauacug

SEQ ID NO: 202204 - RNA, 19 nt, Homo sapiens
uaaagcugguguuaagauc

SEQ ID NO: 202205 - RNA, 19 nt, Homo sapiens
auacaagugugcagugguu

SEQ ID NO: 202206 - RNA, 19 nt, Homo sapiens
ggcaaagcccuaugaagga

SEQ ID NO: 202207 - RNA, 19 nt, Homo sapiens
guauaucgggugcaucuga

SEQ ID NO: 202208 - RNA, 19 nt, Homo sapiens
gccaacaacuccagaagcu

SEQ ID NO: 202209 - RNA, 19 nt, Homo sapiens
guuaagaucaaucccaaga

SEQ ID NO: 202210 - RNA, 19 nt, Homo sapiens
ccaaggcaaagcccuauga

SEQ ID NO: 202211 - RNA, 19 nt, Homo sapiens
gacuucaaauugcaacaug

SEQ ID NO: 202212 - RNA, 19 nt, Homo sapiens
gaauccagaugguauugac

SEQ ID NO: 202213 - RNA, 19 nt, Homo sapiens
gcagaguuccaagacagua

SEQ ID NO: 202214 - RNA, 19 nt, Homo sapiens
ucagggauuugguaaugug

SEQ ID NO: 202215 - RNA, 19 nt, Homo sapiens
gaacuauaccgaaaaugaa

SEQ ID NO: 202216 - RNA, 19 nt, Homo sapiens
ugaaguauaaccugggauu

SEQ ID NO: 202217 - RNA, 19 nt, Homo sapiens
uugaguggcugaagaaucu

SEQ ID NO: 202218 - RNA, 19 nt, Homo sapiens
ucuuggaggucgacuguga

SEQ ID NO: 202219 - RNA, 19 nt, Homo sapiens
ugaugugaguguagaugaa

SEQ ID NO: 202220 - RNA, 19 nt, Homo sapiens
ucaucaaucaagcuucuua

SEQ ID NO: 202221 - RNA, 19 nt, Homo sapiens
gaaguauaaccugggauug

SEQ ID NO: 202222 - RNA, 19 nt, Homo sapiens
ugucagcuauggccguuug

SEQ ID NO: 202223 - RNA, 19 nt, Homo sapiens
aaagcaugguggaacuauu

SEQ ID NO: 202224 - RNA, 19 nt, Homo sapiens
cuggauugcugauaccuau

SEQ ID NO: 202225 - RNA, 19 nt, Homo sapiens
caagaacuauaccgaaaau

SEQ ID NO: 202226 - RNA, 19 nt, Homo sapiens
gcuuuggcuucucugauga

SEQ ID NO: 202227 - RNA, 19 nt, Homo sapiens
gaucaaucccaagaacuau

SEQ ID NO: 202228 - RNA, 19 nt, Homo sapiens
ugagaacagcugccuaugu

SEQ ID NO: 202229 - RNA, 19 nt, Homo sapiens
ucuaaaucaugucagcuau

SEQ ID NO: 202230 - RNA, 19 nt, Homo sapiens
uauuccagaucucuacuug

SEQ ID NO: 202231 - RNA, 19 nt, Homo sapiens
caacuccagaagcugauaa

SEQ ID NO: 202232 - RNA, 19 nt, Homo sapiens
agaucaaucccaagaacua

SEQ ID NO: 202233 - RNA, 19 nt, Homo sapiens
ugcuaaagcugguguuaag

SEQ ID NO: 202234 - RNA, 19 nt, Homo sapiens
agucaaagccaagaucauu

SEQ ID NO: 202235 - RNA, 19 nt, Homo sapiens
gggccuacacucuaugaga

SEQ ID NO: 202236 - RNA, 19 nt, Homo sapiens
caucguggaggacaaguug

SEQ ID NO: 202237 - RNA, 19 nt, Homo sapiens
aagcugguguuaagaucaa

SEQ ID NO: 202238 - RNA, 19 nt, Homo sapiens
ggaaagcgaggagcagaag

SEQ ID NO: 202239 - RNA, 19 nt, Homo sapiens
gaugggaguauauggaauc

SEQ ID NO: 202240 - RNA, 19 nt, Homo sapiens
cauggacgcaucucugcua

SEQ ID NO: 202241 - RNA, 19 nt, Homo sapiens
gacaguauaucgggugcau

SEQ ID NO: 202242 - RNA, 19 nt, Homo sapiens
aguauaaccugggauugga

SEQ ID NO: 202243 - RNA, 19 nt, Homo sapiens
gaugguggagggcuucuuc

SEQ ID NO: 202244 - RNA, 19 nt, Homo sapiens
caaggcaaagcccuaugaa

SEQ ID NO: 202245 - RNA, 19 nt, Homo sapiens
ggaauccagaugguauuga

SEQ ID NO: 202246 - RNA, 19 nt, Homo sapiens
gugcuaaagcugguguuaa

SEQ ID NO: 202247 - RNA, 19 nt, Homo sapiens
ggagagaaacauuuugguu

SEQ ID NO: 202248 - RNA, 19 nt, Homo sapiens
ggugcuaaagcugguguua

SEQ ID NO: 202249 - RNA, 19 nt, Homo sapiens
uaaauguauugcuguuggu

SEQ ID NO: 202250 - RNA, 19 nt, Homo sapiens
ucaaucaagcuucuuacau

SEQ ID NO: 202251 - RNA, 19 nt, Homo sapiens
cuaaagcugguguuaagau

SEQ ID NO: 202252 - RNA, 19 nt, Homo sapiens
ucuucaaaguguacaguga

SEQ ID NO: 202253 - RNA, 19 nt, Homo sapiens
gcuauggccguuugaccuu

SEQ ID NO: 202254 - RNA, 19 nt, Homo sapiens
ggcugaagaaucuaaauca

SEQ ID NO: 202255 - RNA, 19 nt, Homo sapiens
gcuggaggagugacaguau

SEQ ID NO: 202256 - RNA, 19 nt, Homo sapiens
gaggucgacugugacauac

SEQ ID NO: 202257 - RNA, 19 nt, Homo sapiens
ugagucugaugggaguaua

SEQ ID NO: 202258 - RNA, 19 nt, Homo sapiens
cugaagaaucuaaaucaug

SEQ ID NO: 202259 - RNA, 19 nt, Homo sapiens
caucaagcccugcaaccau

SEQ ID NO: 202260 - RNA, 19 nt, Homo sapiens
aggacaaguuggugaagga

SEQ ID NO: 202261 - RNA, 19 nt, Homo sapiens
ccugagaacagcugccuau

SEQ ID NO: 202262 - RNA, 19 nt, Homo sapiens
ccacauagguuuagagaua

SEQ ID NO: 202263 - RNA, 19 nt, Homo sapiens
ggacagggcuggagucaaa

SEQ ID NO: 202264 - RNA, 19 nt, Homo sapiens
gcacgugucuucucaauga

SEQ ID NO: 202265 - RNA, 19 nt, Homo sapiens
uaagacugcugaagaauua

SEQ ID NO: 202266 - RNA, 19 nt, Homo sapiens
gaagaaggguuacuuugaa

SEQ ID NO: 202267 - RNA, 19 nt, Homo sapiens
ucaaauaacuccucauugu

SEQ ID NO: 202268 - RNA, 19 nt, Homo sapiens
ggaauagcaugucacuaaa

SEQ ID NO: 202269 - RNA, 19 nt, Homo sapiens
gauaagaguuggcuguuca

SEQ ID NO: 202270 - RNA, 19 nt, Homo sapiens
acacgaagcuuaguauaaa

SEQ ID NO: 202271 - RNA, 19 nt, Homo sapiens
gaaggugggcacuggauua

SEQ ID NO: 202272 - RNA, 19 nt, Homo sapiens
ggauaucccuaccuugaaa

SEQ ID NO: 202273 - RNA, 19 nt, Homo sapiens
gcacaccuguaaacggaua

SEQ ID NO: 202274 - RNA, 19 nt, Homo sapiens
gcgaugagcccuuccagua

SEQ ID NO: 202275 - RNA, 19 nt, Homo sapiens
caugaaaccuccaacauca

SEQ ID NO: 202276 - RNA, 19 nt, Homo sapiens
gaacacgaagcuuaguaua

SEQ ID NO: 202277 - RNA, 19 nt, Homo sapiens
caaauaacuccucauugua

SEQ ID NO: 202278 - RNA, 19 nt, Homo sapiens
acacaaagcagaauaguau

SEQ ID NO: 202279 - RNA, 19 nt, Homo sapiens
caaauagucggauuagaaa

SEQ ID NO: 202280 - RNA, 19 nt, Homo sapiens
gcucugaacacgaagcuua

SEQ ID NO: 202281 - RNA, 19 nt, Homo sapiens
gaagaaagcaacgaaugaa

SEQ ID NO: 202282 - RNA, 19 nt, Homo sapiens
ugaagacuuuggagugaua

SEQ ID NO: 202283 - RNA, 19 nt, Homo sapiens
ggaauuaggagagaaggua

SEQ ID NO: 202284 - RNA, 19 nt, Homo sapiens
gggaagaccugacguacuc

SEQ ID NO: 202285 - RNA, 19 nt, Homo sapiens
gacaaugcccgacgucuaa

SEQ ID NO: 202286 - RNA, 19 nt, Homo sapiens
cagaauugcuuguuugcuu

SEQ ID NO: 202287 - RNA, 19 nt, Homo sapiens
ggagaagaaggguuacuuu

SEQ ID NO: 202288 - RNA, 19 nt, Homo sapiens
ggugggcacuggauuaguu

SEQ ID NO: 202289 - RNA, 19 nt, Homo sapiens
gaauggcuuuggucucuug

SEQ ID NO: 202290 - RNA, 19 nt, Homo sapiens
ggacaaugcccgacgucua

SEQ ID NO: 202291 - RNA, 19 nt, Homo sapiens
acaaauagucggauuagaa

SEQ ID NO: 202292 - RNA, 19 nt, Homo sapiens
cauaaccacugcuuccauu

SEQ ID NO: 202293 - RNA, 19 nt, Homo sapiens
uaaccacugcuuccauuua

SEQ ID NO: 202294 - RNA, 19 nt, Homo sapiens
uaaacaaacuguguaacug

SEQ ID NO: 202295 - RNA, 19 nt, Homo sapiens
uuacagaauugcuuguuug

SEQ ID NO: 202296 - RNA, 19 nt, Homo sapiens
gaagcuuaguauaaacuga

SEQ ID NO: 202297 - RNA, 19 nt, Homo sapiens
ccaaguguguggaagaguu

SEQ ID NO: 202298 - RNA, 19 nt, Homo sapiens
aggaauagcaugucacuaa

SEQ ID NO: 202299 - RNA, 19 nt, Homo sapiens
gagaagaaggguuacuuug

SEQ ID NO: 202300 - RNA, 19 nt, Homo sapiens
gaaaguccaggccauguau

SEQ ID NO: 202301 - RNA, 19 nt, Homo sapiens
gagacaaauagucggauua

SEQ ID NO: 202302 - RNA, 19 nt, Homo sapiens
cgaagaaagcaacgaauga

SEQ ID NO: 202303 - RNA, 19 nt, Homo sapiens
gacguacucugguuagguu

SEQ ID NO: 202304 - RNA, 19 nt, Homo sapiens
ccaguugucccgauuguaa

SEQ ID NO: 202305 - RNA, 19 nt, Homo sapiens
gaugagcccuuccaguaca

SEQ ID NO: 202306 - RNA, 19 nt, Homo sapiens
gagaaggacugcgcugcaa

SEQ ID NO: 202307 - RNA, 19 nt, Homo sapiens
uaacucaaaggguggaaua

SEQ ID NO: 202308 - RNA, 19 nt, Homo sapiens
gacuagaccuccagcuguu

SEQ ID NO: 202309 - RNA, 19 nt, Homo sapiens
uagcaaccuuugauccuaa

SEQ ID NO: 202310 - RNA, 19 nt, Homo sapiens
uaauugccauguacaguau

SEQ ID NO: 202311 - RNA, 19 nt, Homo sapiens
uaaaugcccugcucugaac

SEQ ID NO: 202312 - RNA, 19 nt, Homo sapiens
gagucaagauuaagaccuu

SEQ ID NO: 202313 - RNA, 19 nt, Homo sapiens
caguuaaucuugcuuucuu

SEQ ID NO: 202314 - RNA, 19 nt, Homo sapiens
ccacauccgugccuaugau

SEQ ID NO: 202315 - RNA, 19 nt, Homo sapiens
uaagcaagcggcaccagua

SEQ ID NO: 202316 - RNA, 19 nt, Homo sapiens
ggaggagaauggucugaag

SEQ ID NO: 202317 - RNA, 19 nt, Homo sapiens
gcaggaguauacccucaug

SEQ ID NO: 202318 - RNA, 19 nt, Homo sapiens
gcccugcucugaacacgaa

SEQ ID NO: 202319 - RNA, 19 nt, Homo sapiens
gccaggagaagaaggguua

SEQ ID NO: 202320 - RNA, 19 nt, Homo sapiens
agaauggucugaaguacau

SEQ ID NO: 202321 - RNA, 19 nt, Homo sapiens
gaucgaugguacuggagaa

SEQ ID NO: 202322 - RNA, 19 nt, Homo sapiens
gaccugacguacucugguu

SEQ ID NO: 202323 - RNA, 19 nt, Homo sapiens
aaccacugcuuccauuuaa

SEQ ID NO: 202324 - RNA, 19 nt, Homo sapiens
agaagaaggguuacuuuga

SEQ ID NO: 202325 - RNA, 19 nt, Homo sapiens
gcauggagcaggaguauac

SEQ ID NO: 202326 - RNA, 19 nt, Homo sapiens
uaacgauacgcuugacuuu

SEQ ID NO: 202327 - RNA, 19 nt, Homo sapiens
uacaguauguucaaaguca

SEQ ID NO: 202328 - RNA, 19 nt, Homo sapiens
ggauagaggggucaaguua

SEQ ID NO: 202329 - RNA, 19 nt, Homo sapiens
gaaggacugcgcugcaaga

SEQ ID NO: 202330 - RNA, 19 nt, Homo sapiens
ggagugauagcaaccuuug

SEQ ID NO: 202331 - RNA, 19 nt, Homo sapiens
uaauggacauggugagcaa

SEQ ID NO: 202332 - RNA, 19 nt, Homo sapiens
guaaacggauaauggacau

SEQ ID NO: 202333 - RNA, 19 nt, Homo sapiens
guaaacaaacuguguaacu

SEQ ID NO: 202334 - RNA, 19 nt, Homo sapiens
uguuaagacugcugaagaa

SEQ ID NO: 202335 - RNA, 19 nt, Homo sapiens
cacauagguuuagagauaa

SEQ ID NO: 202336 - RNA, 19 nt, Homo sapiens
ugagacaaauagucggauu

SEQ ID NO: 202337 - RNA, 19 nt, Homo sapiens
ggagaauggucugaaguac

SEQ ID NO: 202338 - RNA, 19 nt, Homo sapiens
ucaagcagguguacauguc

SEQ ID NO: 202339 - RNA, 19 nt, Homo sapiens
gggugcaccuguccaauag

SEQ ID NO: 202340 - RNA, 19 nt, Homo sapiens
ggggucaaguuauuaauuu

SEQ ID NO: 202341 - RNA, 19 nt, Homo sapiens
cgaggaggccauugagaaa

SEQ ID NO: 202342 - RNA, 19 nt, Homo sapiens
caucuugcaucgugugugu

SEQ ID NO: 202343 - RNA, 19 nt, Homo sapiens
guaaggacccuaacaagcu

SEQ ID NO: 202344 - RNA, 19 nt, Homo sapiens
cauuccaugugcccaguua

SEQ ID NO: 202345 - RNA, 19 nt, Homo sapiens
cucaaaggguggaauauca

SEQ ID NO: 202346 - RNA, 19 nt, Homo sapiens
gaaggguuacuuugaagau

SEQ ID NO: 202347 - RNA, 19 nt, Homo sapiens
acaagcugguguuauguga

SEQ ID NO: 202348 - RNA, 19 nt, Homo sapiens
uaaauaaaggcaucaagca

SEQ ID NO: 202349 - RNA, 19 nt, Homo sapiens
gcuagagucugagaaagag

SEQ ID NO: 202350 - RNA, 19 nt, Homo sapiens
ggaggccauugagaaacua

SEQ ID NO: 202351 - RNA, 19 nt, Homo sapiens
ccaguacuuuacagucuga

SEQ ID NO: 202352 - RNA, 19 nt, Homo sapiens
acagugagcccaagugugu

SEQ ID NO: 202353 - RNA, 19 nt, Homo sapiens
ggacagugagcccaagugu

SEQ ID NO: 202354 - RNA, 19 nt, Homo sapiens
gacaaauagucggauuaga

SEQ ID NO: 202355 - RNA, 19 nt, Homo sapiens
cuaaaugcccugcucugaa

SEQ ID NO: 202356 - RNA, 19 nt, Homo sapiens
ugugaagacuuuggaguga

SEQ ID NO: 202357 - RNA, 19 nt, Homo sapiens
ggaaucagcaugggagauc

SEQ ID NO: 202358 - RNA, 19 nt, Homo sapiens
uuuguaggguuucuaggua

SEQ ID NO: 202359 - RNA, 19 nt, Homo sapiens
guuacuagcagucacuuga

SEQ ID NO: 202360 - RNA, 19 nt, Homo sapiens
gcacuggauuaguuaacag

SEQ ID NO: 202361 - RNA, 19 nt, Homo sapiens
gagaauggucugaaguaca

SEQ ID NO: 202362 - RNA, 19 nt, Homo sapiens
uaaagagccucguucauuu

SEQ ID NO: 202363 - RNA, 19 nt, Homo sapiens
gaagacaacugccagauac

SEQ ID NO: 202364 - RNA, 19 nt, Homo sapiens
gcaaagcgcuggauuacag

SEQ ID NO: 202365 - RNA, 19 nt, Homo sapiens
caagaucgcugccucucua

SEQ ID NO: 202366 - RNA, 19 nt, Homo sapiens
cauaacaacuucugaaaca

SEQ ID NO: 202367 - RNA, 19 nt, Homo sapiens
gcaagagacuuaaaugacu

SEQ ID NO: 202368 - RNA, 19 nt, Homo sapiens
ccaaagcaguuaaggaaug

SEQ ID NO: 202369 - RNA, 19 nt, Homo sapiens
ggagugcucuguuguuuac

SEQ ID NO: 202370 - RNA, 19 nt, Homo sapiens
gaagguggauuuaguuuug

SEQ ID NO: 202371 - RNA, 19 nt, Homo sapiens
ccacagggccaaagccaua

SEQ ID NO: 202372 - RNA, 19 nt, Homo sapiens
gcaagcagcccugaccuaa

SEQ ID NO: 202373 - RNA, 19 nt, Homo sapiens
cuaaagagccucguucauu

SEQ ID NO: 202374 - RNA, 19 nt, Homo sapiens
aaagauuggcagcuaauua

SEQ ID NO: 202375 - RNA, 19 nt, Homo sapiens
gagaaugaguuggacaguu

SEQ ID NO: 202376 - RNA, 19 nt, Homo sapiens
gugcauagccagucuguga

SEQ ID NO: 202377 - RNA, 19 nt, Homo sapiens
gggccuagcaagagacuua

SEQ ID NO: 202378 - RNA, 19 nt, Homo sapiens
agaaugaguuggacaguuc

SEQ ID NO: 202379 - RNA, 19 nt, Homo sapiens
gaaugaggcagaugggaaa

SEQ ID NO: 202380 - RNA, 19 nt, Homo sapiens
gaaaugugacccucagugu

SEQ ID NO: 202381 - RNA, 19 nt, Homo sapiens
cgucugggcugcaucaaga

SEQ ID NO: 202382 - RNA, 19 nt, Homo sapiens
guucugggcucauuugaag

SEQ ID NO: 202383 - RNA, 19 nt, Homo sapiens
gauuggcagcuaauuauuu

SEQ ID NO: 202384 - RNA, 19 nt, Homo sapiens
gaagugagaguauuaacgu

SEQ ID NO: 202385 - RNA, 19 nt, Homo sapiens
gaaggacccugcggugauc

SEQ ID NO: 202386 - RNA, 19 nt, Homo sapiens
ugaagacaacugccagaua

SEQ ID NO: 202387 - RNA, 19 nt, Homo sapiens
ccguuaacauucucucuaa

SEQ ID NO: 202388 - RNA, 19 nt, Homo sapiens
uaggagugcucuguuguuu

SEQ ID NO: 202389 - RNA, 19 nt, Homo sapiens
caaagaaggaaccuacuca

SEQ ID NO: 202390 - RNA, 19 nt, Homo sapiens
ggaaggacccugcggugau

SEQ ID NO: 202391 - RNA, 19 nt, Homo sapiens
ccggcuaauuuguguauuu

SEQ ID NO: 202392 - RNA, 19 nt, Homo sapiens
cuaccacccuguuacauca

SEQ ID NO: 202393 - RNA, 19 nt, Homo sapiens
gagccucguucauuuccaa

SEQ ID NO: 202394 - RNA, 19 nt, Homo sapiens
caucaaacugccuggauuu

SEQ ID NO: 202395 - RNA, 19 nt, Homo sapiens
gugcaugccuuguccucuu

SEQ ID NO: 202396 - RNA, 19 nt, Homo sapiens
ccacuacccucacugaaaa

SEQ ID NO: 202397 - RNA, 19 nt, Homo sapiens
gauaagaaccgugagaaac

SEQ ID NO: 202398 - RNA, 19 nt, Homo sapiens
ccacugucccuucaaagaa

SEQ ID NO: 202399 - RNA, 19 nt, Homo sapiens
uagcaagagacuuaaauga

SEQ ID NO: 202400 - RNA, 19 nt, Homo sapiens
aagcgaagugagaguauua

SEQ ID NO: 202401 - RNA, 19 nt, Homo sapiens
uuuaggaccugaagaaucu

SEQ ID NO: 202402 - RNA, 19 nt, Homo sapiens
gcuggccucuggaucaaga

SEQ ID NO: 202403 - RNA, 19 nt, Homo sapiens
caucauaacaacuucugaa

SEQ ID NO: 202404 - RNA, 19 nt, Homo sapiens
uucuagauuugcccaauua

SEQ ID NO: 202405 - RNA, 19 nt, Homo sapiens
guuaaggaaugggaacaga

SEQ ID NO: 202406 - RNA, 19 nt, Homo sapiens
caaagcaguuaaggaaugg

SEQ ID NO: 202407 - RNA, 19 nt, Homo sapiens
cuugacauguuaauuccua

SEQ ID NO: 202408 - RNA, 19 nt, Homo sapiens
acaucaaacugccuggauu

SEQ ID NO: 202409 - RNA, 19 nt, Homo sapiens
uauuaggagugcucuguug

SEQ ID NO: 202410 - RNA, 19 nt, Homo sapiens
aguauuugcucuuagucua

SEQ ID NO: 202411 - RNA, 19 nt, Homo sapiens
gggcugaccacguuacuca

SEQ ID NO: 202412 - RNA, 19 nt, Homo sapiens
acacuucugugaugugcuu

SEQ ID NO: 202413 - RNA, 19 nt, Homo sapiens
uaacaacuucugaaacaca

SEQ ID NO: 202414 - RNA, 19 nt, Homo sapiens
ggacggagucucgcuuugu

SEQ ID NO: 202415 - RNA, 19 nt, Homo sapiens
uaagaaccgugagaaacau

SEQ ID NO: 202416 - RNA, 19 nt, Homo sapiens
gauauuaggagugcucugu

SEQ ID NO: 202417 - RNA, 19 nt, Homo sapiens
cugcugggcugaccacguu

SEQ ID NO: 202418 - RNA, 19 nt, Homo sapiens
caagagcgaauucguugug

SEQ ID NO: 202419 - RNA, 19 nt, Homo sapiens
guuucaauguuuacuccua

SEQ ID NO: 202420 - RNA, 19 nt, Homo sapiens
gagacuuaaaugacugaua

SEQ ID NO: 202421 - RNA, 19 nt, Homo sapiens
uaagggagaaugaguugga

SEQ ID NO: 202422 - RNA, 19 nt, Homo sapiens
gugcuugacauguuaauuc

SEQ ID NO: 202423 - RNA, 19 nt, Homo sapiens
uuugaacacuucugugaug

SEQ ID NO: 202424 - RNA, 19 nt, Homo sapiens
ugcaugccuuguccucuua

SEQ ID NO: 202425 - RNA, 19 nt, Homo sapiens
aagauuggcagcuaauuau

SEQ ID NO: 202426 - RNA, 19 nt, Homo sapiens
gagagugcauagccagucu

SEQ ID NO: 202427 - RNA, 19 nt, Homo sapiens
uuacaggcaugagccacua

SEQ ID NO: 202428 - RNA, 19 nt, Homo sapiens
aagcagcccugaccuaagg

SEQ ID NO: 202429 - RNA, 19 nt, Homo sapiens
aauguuuacuccuagagaa

SEQ ID NO: 202430 - RNA, 19 nt, Homo sapiens
gacggagucucgcuuuguc

SEQ ID NO: 202431 - RNA, 19 nt, Homo sapiens
gggacggagucucgcuuug

SEQ ID NO: 202432 - RNA, 19 nt, Homo sapiens
aaagcgaagugagaguauu

SEQ ID NO: 202433 - RNA, 19 nt, Homo sapiens
guuggacaguucuugauag

SEQ ID NO: 202434 - RNA, 19 nt, Homo sapiens
ugccucagccucccaagua

SEQ ID NO: 202435 - RNA, 19 nt, Homo sapiens
ugauaagaaccgugagaaa

SEQ ID NO: 202436 - RNA, 19 nt, Homo sapiens
gaucgcugccucucuaaag

SEQ ID NO: 202437 - RNA, 19 nt, Homo sapiens
ggaguccuguugggugaau

SEQ ID NO: 202438 - RNA, 19 nt, Homo sapiens
ggaagcgucugggcugcau

SEQ ID NO: 202439 - RNA, 19 nt, Homo sapiens
gcuguaccuuugaacacuu

SEQ ID NO: 202440 - RNA, 19 nt, Homo sapiens
ccacccuguuacaucauaa

SEQ ID NO: 202441 - RNA, 19 nt, Homo sapiens
gaaccgugagaaacauguu

SEQ ID NO: 202442 - RNA, 19 nt, Homo sapiens
ugggauaacugugaugaag

SEQ ID NO: 202443 - RNA, 19 nt, Homo sapiens
cuucuuugcguaaccaaua

SEQ ID NO: 202444 - RNA, 19 nt, Homo sapiens
gaagccuggaauagcaaua

SEQ ID NO: 202445 - RNA, 19 nt, Homo sapiens
auaagaaccgugagaaaca

SEQ ID NO: 202446 - RNA, 19 nt, Homo sapiens
uuaugacucucucucuuuc

SEQ ID NO: 202447 - RNA, 19 nt, Homo sapiens
gggaacuaccgcauagaga

SEQ ID NO: 202448 - RNA, 19 nt, Homo sapiens
gcccaagagcgaauucguu

SEQ ID NO: 202449 - RNA, 19 nt, Homo sapiens
gccacugucccuucaaaga

SEQ ID NO: 202450 - RNA, 19 nt, Homo sapiens
uggcagcuguaccuuugaa

SEQ ID NO: 202451 - RNA, 19 nt, Homo sapiens
gucacaaccucugaucuca

SEQ ID NO: 202452 - RNA, 19 nt, Homo sapiens
ccacuacacccagccgauu

SEQ ID NO: 202453 - RNA, 19 nt, Homo sapiens
gauggucucgaucucuuga

SEQ ID NO: 202454 - RNA, 19 nt, Homo sapiens
caaugaaggggcaaaagua

SEQ ID NO: 202455 - RNA, 19 nt, Homo sapiens
cguuaacauucucucuaaa

SEQ ID NO: 202456 - RNA, 19 nt, Homo sapiens
gcagaauggagcgguguga

SEQ ID NO: 202457 - RNA, 19 nt, Homo sapiens
ucauuugaagccuggaaua

SEQ ID NO: 202458 - RNA, 19 nt, Homo sapiens
aguguauccuggagaggua

SEQ ID NO: 202459 - RNA, 19 nt, Homo sapiens
gugagaguauuaacguuuu

SEQ ID NO: 202460 - RNA, 19 nt, Homo sapiens
guuaacauucucucuaaag

SEQ ID NO: 202461 - RNA, 19 nt, Homo sapiens
ggcaagcagcccugaccua

SEQ ID NO: 202462 - RNA, 19 nt, Homo sapiens
gaauugagcaucuguauaa

SEQ ID NO: 202463 - RNA, 19 nt, Homo sapiens
gacaguaccugccuuguga

SEQ ID NO: 202464 - RNA, 19 nt, Homo sapiens
gaacggcauucucuucaau

SEQ ID NO: 202465 - RNA, 19 nt, Homo sapiens
gaaguaaagcccacagaga

SEQ ID NO: 202466 - RNA, 19 nt, Homo sapiens
gcuaugagguccauggaau

SEQ ID NO: 202467 - RNA, 19 nt, Homo sapiens
uauaaucucuuugcaguga

SEQ ID NO: 202468 - RNA, 19 nt, Homo sapiens
gaagugggcagauguaaag

SEQ ID NO: 202469 - RNA, 19 nt, Homo sapiens
ggucaguagcuaagauuua

SEQ ID NO: 202470 - RNA, 19 nt, Homo sapiens
aagaggagcuaauuucguu

SEQ ID NO: 202471 - RNA, 19 nt, Homo sapiens
gaacuuccgugaggcguau

SEQ ID NO: 202472 - RNA, 19 nt, Homo sapiens
uaaagagaccggcaaaguu

SEQ ID NO: 202473 - RNA, 19 nt, Homo sapiens
gagcaucuguauaagaauc

SEQ ID NO: 202474 - RNA, 19 nt, Homo sapiens
aacagaagcugaacuggaa

SEQ ID NO: 202475 - RNA, 19 nt, Homo sapiens
ggcauucucuucaaucaug

SEQ ID NO: 202476 - RNA, 19 nt, Homo sapiens
ccacagagaucuacaaccu

SEQ ID NO: 202477 - RNA, 19 nt, Homo sapiens
guaccugccuugugaagau

SEQ ID NO: 202478 - RNA, 19 nt, Homo sapiens
ugagguccauggaauugua

SEQ ID NO: 202479 - RNA, 19 nt, Homo sapiens
gcaccaaagcgaaacagaa

SEQ ID NO: 202480 - RNA, 19 nt, Homo sapiens
gaaaucauucuugcacauu

SEQ ID NO: 202481 - RNA, 19 nt, Homo sapiens
uagaugcaguuaagacuug

SEQ ID NO: 202482 - RNA, 19 nt, Homo sapiens
guaaagagaccggcaaagu

SEQ ID NO: 202483 - RNA, 19 nt, Homo sapiens
gaggcuaugugguugaugu

SEQ ID NO: 202484 - RNA, 19 nt, Homo sapiens
uuggacaacuggaauguuu

SEQ ID NO: 202485 - RNA, 19 nt, Homo sapiens
guuccuaccuggcugaguu

SEQ ID NO: 202486 - RNA, 19 nt, Homo sapiens
gaauggcuuugugaaauca

SEQ ID NO: 202487 - RNA, 19 nt, Homo sapiens
ccuuugaccucgcugagua

SEQ ID NO: 202488 - RNA, 19 nt, Homo sapiens
gaaaggcuaugagguccau

SEQ ID NO: 202489 - RNA, 19 nt, Homo sapiens
uaccaagccucaacaagug

SEQ ID NO: 202490 - RNA, 19 nt, Homo sapiens
gaaacaugaaguugcacua

SEQ ID NO: 202491 - RNA, 19 nt, Homo sapiens
gcaaaguucacgugacugu

SEQ ID NO: 202492 - RNA, 19 nt, Homo sapiens
cagaagaggagcuaauuuc

SEQ ID NO: 202493 - RNA, 19 nt, Homo sapiens
uugagcaucuguauaagaa

SEQ ID NO: 202494 - RNA, 19 nt, Homo sapiens
ugaauggcuuugugaaauc

SEQ ID NO: 202495 - RNA, 19 nt, Homo sapiens
aaagagaccggcaaaguuc

SEQ ID NO: 202496 - RNA, 19 nt, Homo sapiens
guacggcgguccaguucau

SEQ ID NO: 202497 - RNA, 19 nt, Homo sapiens
gugggcagauguaaagaga

SEQ ID NO: 202498 - RNA, 19 nt, Homo sapiens
ccuauuggauuguggugaa

SEQ ID NO: 202499 - RNA, 19 nt, Homo sapiens
cugaauggcuuugugaaau

SEQ ID NO: 202500 - RNA, 19 nt, Homo sapiens
cuguggaucucaaguacua

SEQ ID NO: 202501 - RNA, 19 nt, Homo sapiens
ggacaacuggaauguuuca

SEQ ID NO: 202502 - RNA, 19 nt, Homo sapiens
cgaauugagcaucuguaua

SEQ ID NO: 202503 - RNA, 19 nt, Homo sapiens
gcucaucaccgguaucaca

SEQ ID NO: 202504 - RNA, 19 nt, Homo sapiens
gcagugaacggcauucucu

SEQ ID NO: 202505 - RNA, 19 nt, Homo sapiens
ccagaagaggagcuaauuu

SEQ ID NO: 202506 - RNA, 19 nt, Homo sapiens
gcaaaacucuaugccuauu

SEQ ID NO: 202507 - RNA, 19 nt, Homo sapiens
gguugauguugcagaauga

SEQ ID NO: 202508 - RNA, 19 nt, Homo sapiens
ugaggcguauaaucucuuu

SEQ ID NO: 202509 - RNA, 19 nt, Homo sapiens
gaagaggagcuaauuucgu

SEQ ID NO: 202510 - RNA, 19 nt, Homo sapiens
cgguccaguucauuuaaua

SEQ ID NO: 202511 - RNA, 19 nt, Homo sapiens
cgaaacagaagcugaacug

SEQ ID NO: 202512 - RNA, 19 nt, Homo sapiens
ugacuguggaucucaagua

SEQ ID NO: 202513 - RNA, 19 nt, Homo sapiens
aaaucauucuugcacauug

SEQ ID NO: 202514 - RNA, 19 nt, Homo sapiens
ccgggaauuugucgagaaa

SEQ ID NO: 202515 - RNA, 19 nt, Homo sapiens
ggacuucguuauagcuacu

SEQ ID NO: 202516 - RNA, 19 nt, Homo sapiens
gccggaggacuucguuaua

SEQ ID NO: 202517 - RNA, 19 nt, Homo sapiens
ucacauucacuuuacuuga

SEQ ID NO: 202518 - RNA, 19 nt, Homo sapiens
gucgaagccuccucugaau

SEQ ID NO: 202519 - RNA, 19 nt, Homo sapiens
cgacugcaccaaagcgaaa

SEQ ID NO: 202520 - RNA, 19 nt, Homo sapiens
gcauucucuucaaucauga

SEQ ID NO: 202521 - RNA, 19 nt, Homo sapiens
cuaccaagccucaacaagu

SEQ ID NO: 202522 - RNA, 19 nt, Homo sapiens
ccggaggacuucguuauag

SEQ ID NO: 202523 - RNA, 19 nt, Homo sapiens
ugaguacacugcggacguu

SEQ ID NO: 202524 - RNA, 19 nt, Homo sapiens
acaugaaguugcacuaugg

SEQ ID NO: 202525 - RNA, 19 nt, Homo sapiens
cggcaaaguucacgugacu

SEQ ID NO: 202526 - RNA, 19 nt, Homo sapiens
ggccuuaucaacucuguga

SEQ ID NO: 202527 - RNA, 19 nt, Homo sapiens
aaggaaacaugaaguugca

SEQ ID NO: 202528 - RNA, 19 nt, Homo sapiens
ugucgaagccuccucugaa

SEQ ID NO: 202529 - RNA, 19 nt, Homo sapiens
gucaguagcuaagauuuac

SEQ ID NO: 202530 - RNA, 19 nt, Homo sapiens
gcgguccaguucauuuaau

SEQ ID NO: 202531 - RNA, 19 nt, Homo sapiens
gacuguggaucucaaguac

SEQ ID NO: 202532 - RNA, 19 nt, Homo sapiens
uaauacgggucgaauugag

SEQ ID NO: 202533 - RNA, 19 nt, Homo sapiens
ugaagugggcagauguaaa

SEQ ID NO: 202534 - RNA, 19 nt, Homo sapiens
aaaauuagccggucaguag

SEQ ID NO: 202535 - RNA, 19 nt, Homo sapiens
ucaugagagucccagaaga

SEQ ID NO: 202536 - RNA, 19 nt, Homo sapiens
cgacuucuagaugcaguua

SEQ ID NO: 202537 - RNA, 19 nt, Homo sapiens
aacaugaaguugcacuaug

SEQ ID NO: 202538 - RNA, 19 nt, Homo sapiens
ucacauugaaggaaacaug

SEQ ID NO: 202539 - RNA, 19 nt, Homo sapiens
cauaguguccgggaauuug

SEQ ID NO: 202540 - RNA, 19 nt, Homo sapiens
gaggacuucguuauagcua

SEQ ID NO: 202541 - RNA, 19 nt, Homo sapiens
gauuuaccuuggacaacug

SEQ ID NO: 202542 - RNA, 19 nt, Homo sapiens
uuuaauacgggucgaauug

SEQ ID NO: 202543 - RNA, 19 nt, Homo sapiens
aaacaugaaguugcacuau

SEQ ID NO: 202544 - RNA, 19 nt, Homo sapiens
cgaagccuccucugaaugg

SEQ ID NO: 202545 - RNA, 19 nt, Homo sapiens
aaaucuggaugccaaacga

SEQ ID NO: 202546 - RNA, 19 nt, Homo sapiens
cggcgguccaguucauuua

SEQ ID NO: 202547 - RNA, 19 nt, Homo sapiens
ugaaggaaacaugaaguug

SEQ ID NO: 202548 - RNA, 19 nt, Homo sapiens
uaagauuuaccuuggacaa

SEQ ID NO: 202549 - RNA, 19 nt, Homo sapiens
ggagcuaauuucguuacuc

SEQ ID NO: 202550 - RNA, 19 nt, Homo sapiens
aggcucacauugaaggaaa

SEQ ID NO: 202551 - RNA, 19 nt, Homo sapiens
caccaaagcgaaacagaag

SEQ ID NO: 202552 - RNA, 19 nt, Homo sapiens
aaguaaagcccacagagau

SEQ ID NO: 202553 - RNA, 19 nt, Homo sapiens
ugacaguaccugccuugug

SEQ ID NO: 202554 - RNA, 19 nt, Homo sapiens
gcacuauggcgaucucacu

SEQ ID NO: 202555 - RNA, 19 nt, Homo sapiens
gagccggaggacuucguua

SEQ ID NO: 202556 - RNA, 19 nt, Homo sapiens
ugguugauguugcagaaug

SEQ ID NO: 202557 - RNA, 19 nt, Homo sapiens
ggaaagugcaggaaauacc

SEQ ID NO: 202558 - RNA, 19 nt, Homo sapiens
ugggaaagugcaggaaaua

SEQ ID NO: 202559 - RNA, 19 nt, Homo sapiens
ugauguugcagaaugauga

SEQ ID NO: 202560 - RNA, 19 nt, Homo sapiens
ccaggaacguggcgcucau

SEQ ID NO: 202561 - RNA, 19 nt, Homo sapiens
guaaagcccacagagaucu

SEQ ID NO: 202562 - RNA, 19 nt, Homo sapiens
gaacaacgcugcuauuaua

SEQ ID NO: 202563 - RNA, 19 nt, Homo sapiens
gaacuucuguguuucuaaa

SEQ ID NO: 202564 - RNA, 19 nt, Homo sapiens
gcaaagagcugugauaaac

SEQ ID NO: 202565 - RNA, 19 nt, Homo sapiens
caauagcaaucacaucuua

SEQ ID NO: 202566 - RNA, 19 nt, Homo sapiens
cagaugaacuuaaagauga

SEQ ID NO: 202567 - RNA, 19 nt, Homo sapiens
ucaaaucagugcucauaua

SEQ ID NO: 202568 - RNA, 19 nt, Homo sapiens
ggaguuuauugccaaauua

SEQ ID NO: 202569 - RNA, 19 nt, Homo sapiens
gagcuugucugacuccuaa

SEQ ID NO: 202570 - RNA, 19 nt, Homo sapiens
gaagaaugguuacgugaga

SEQ ID NO: 202571 - RNA, 19 nt, Homo sapiens
ggagucaaauguagccaua

SEQ ID NO: 202572 - RNA, 19 nt, Homo sapiens
ggaaaucaucuucauagua

SEQ ID NO: 202573 - RNA, 19 nt, Homo sapiens
gguuuagucuugugaauuu

SEQ ID NO: 202574 - RNA, 19 nt, Homo sapiens
gcacucuugugacuaauuu

SEQ ID NO: 202575 - RNA, 19 nt, Homo sapiens
guacauugaugaauucugu

SEQ ID NO: 202576 - RNA, 19 nt, Homo sapiens
caaccucgcuucauugugu

SEQ ID NO: 202577 - RNA, 19 nt, Homo sapiens
ucaggaggcuugaaacauu

SEQ ID NO: 202578 - RNA, 19 nt, Homo sapiens
ccaacuaucugcuugcauu

SEQ ID NO: 202579 - RNA, 19 nt, Homo sapiens
guacaaccauucccauuca

SEQ ID NO: 202580 - RNA, 19 nt, Homo sapiens
guucaucagucacucauuu

SEQ ID NO: 202581 - RNA, 19 nt, Homo sapiens
ugaacuggaugccugaaua

SEQ ID NO: 202582 - RNA, 19 nt, Homo sapiens
aaugugaacuucuguguuu

SEQ ID NO: 202583 - RNA, 19 nt, Homo sapiens
uaaugaagauugacaagga

SEQ ID NO: 202584 - RNA, 19 nt, Homo sapiens
caacugacacaacuccuua

SEQ ID NO: 202585 - RNA, 19 nt, Homo sapiens
gcaccucaauguccuguga

SEQ ID NO: 202586 - RNA, 19 nt, Homo sapiens
acaguaaacuugugauaga

SEQ ID NO: 202587 - RNA, 19 nt, Homo sapiens
cuggaugccugaauaguua

SEQ ID NO: 202588 - RNA, 19 nt, Homo sapiens
caggaggcuugaaacauua

SEQ ID NO: 202589 - RNA, 19 nt, Homo sapiens
gacuagugaugaauagaua

SEQ ID NO: 202590 - RNA, 19 nt, Homo sapiens
gagcaaagagcugugauaa

SEQ ID NO: 202591 - RNA, 19 nt, Homo sapiens
caacgcugcuauuauaaug

SEQ ID NO: 202592 - RNA, 19 nt, Homo sapiens
cauagcaucuaaugucaaa

SEQ ID NO: 202593 - RNA, 19 nt, Homo sapiens
gcacauguaauccaaguga

SEQ ID NO: 202594 - RNA, 19 nt, Homo sapiens
caaguacauugaugaauuc

SEQ ID NO: 202595 - RNA, 19 nt, Homo sapiens
gacaacagauugagguuag

SEQ ID NO: 202596 - RNA, 19 nt, Homo sapiens
gaaugcacauguaauccaa

SEQ ID NO: 202597 - RNA, 19 nt, Homo sapiens
gaacuaaccaagguauuug

SEQ ID NO: 202598 - RNA, 19 nt, Homo sapiens
gggaguuuauugccaaauu

SEQ ID NO: 202599 - RNA, 19 nt, Homo sapiens
gauguaagccugaacaaca

SEQ ID NO: 202600 - RNA, 19 nt, Homo sapiens
gauauuugguggaaguaga

SEQ ID NO: 202601 - RNA, 19 nt, Homo sapiens
gcauauaauucuguaggaa

SEQ ID NO: 202602 - RNA, 19 nt, Homo sapiens
gcaaucacaucuuauaucc

SEQ ID NO: 202603 - RNA, 19 nt, Homo sapiens
ccgaagaccuaacugaaga

SEQ ID NO: 202604 - RNA, 19 nt, Homo sapiens
gaacaacagaugauguaug

SEQ ID NO: 202605 - RNA, 19 nt, Homo sapiens
ugauuuagaugguccaaga

SEQ ID NO: 202606 - RNA, 19 nt, Homo sapiens
gcaguuaaacauacucuug

SEQ ID NO: 202607 - RNA, 19 nt, Homo sapiens
cuaaaugccuagugcaguu

SEQ ID NO: 202608 - RNA, 19 nt, Homo sapiens
ggaaaguggauauauuaga

SEQ ID NO: 202609 - RNA, 19 nt, Homo sapiens
uauccucugugcuuuauuu

SEQ ID NO: 202610 - RNA, 19 nt, Homo sapiens
ugaacuaccugaacgacaa

SEQ ID NO: 202611 - RNA, 19 nt, Homo sapiens
guucggaauuuguuacuau

SEQ ID NO: 202612 - RNA, 19 nt, Homo sapiens
uaacuuaugguucggaauu

SEQ ID NO: 202613 - RNA, 19 nt, Homo sapiens
agaaauugguggguuguaa

SEQ ID NO: 202614 - RNA, 19 nt, Homo sapiens
agacuugagugacccagua

SEQ ID NO: 202615 - RNA, 19 nt, Homo sapiens
agaccuaacugaagaaugg

SEQ ID NO: 202616 - RNA, 19 nt, Homo sapiens
gaaguaagaauaagcuagu

SEQ ID NO: 202617 - RNA, 19 nt, Homo sapiens
gaugauguaugcuggaagu

SEQ ID NO: 202618 - RNA, 19 nt, Homo sapiens
gaggaucaguaggacauuu

SEQ ID NO: 202619 - RNA, 19 nt, Homo sapiens
ugacacaacuccuuaagcu

SEQ ID NO: 202620 - RNA, 19 nt, Homo sapiens
ugacugauauuugguggaa

SEQ ID NO: 202621 - RNA, 19 nt, Homo sapiens
ggagcaaagagcugugaua

SEQ ID NO: 202622 - RNA, 19 nt, Homo sapiens
gaaaguuggagaugaggaa

SEQ ID NO: 202623 - RNA, 19 nt, Homo sapiens
gcucauauacaguaaacuu

SEQ ID NO: 202624 - RNA, 19 nt, Homo sapiens
ucaaacauuucuggacaaa

SEQ ID NO: 202625 - RNA, 19 nt, Homo sapiens
ccaagugaguggagagugu

SEQ ID NO: 202626 - RNA, 19 nt, Homo sapiens
guauacuugugguuaguuu

SEQ ID NO: 202627 - RNA, 19 nt, Homo sapiens
gaugaauucuguaucuucu

SEQ ID NO: 202628 - RNA, 19 nt, Homo sapiens
cauuaaugguuuagucuug

SEQ ID NO: 202629 - RNA, 19 nt, Homo sapiens
uauagaguuugagccauua

SEQ ID NO: 202630 - RNA, 19 nt, Homo sapiens
gcucuaaaauguucucaaa

SEQ ID NO: 202631 - RNA, 19 nt, Homo sapiens
ugauguugccgaagauuua

SEQ ID NO: 202632 - RNA, 19 nt, Homo sapiens
gaaguaaagauaguuggaa

SEQ ID NO: 202633 - RNA, 19 nt, Homo sapiens
cuuggugaguguauucuua

SEQ ID NO: 202634 - RNA, 19 nt, Homo sapiens
uauccuaaaugucagaaga

SEQ ID NO: 202635 - RNA, 19 nt, Homo sapiens
gaaaaugagugagucuuug

SEQ ID NO: 202636 - RNA, 19 nt, Homo sapiens
gaacgacaaccucgcuuca

SEQ ID NO: 202637 - RNA, 19 nt, Homo sapiens
gaagauugacaaggauaaa

SEQ ID NO: 202638 - RNA, 19 nt, Homo sapiens
agucaaauguagccauaaa

SEQ ID NO: 202639 - RNA, 19 nt, Homo sapiens
ccuuaaaucugaguccuuu

SEQ ID NO: 202640 - RNA, 19 nt, Homo sapiens
gcauuguucuuuucaagua

SEQ ID NO: 202641 - RNA, 19 nt, Homo sapiens
uuacaaaucccgugcucua

SEQ ID NO: 202642 - RNA, 19 nt, Homo sapiens
gaaacuagugcugcaagaa

SEQ ID NO: 202643 - RNA, 19 nt, Homo sapiens
gcaguaagagaaacuagug

SEQ ID NO: 202644 - RNA, 19 nt, Homo sapiens
gaaugaaggaaaugagguu

SEQ ID NO: 202645 - RNA, 19 nt, Homo sapiens
gauauuuggcauacuugua

SEQ ID NO: 202646 - RNA, 19 nt, Homo sapiens
cauuaacacuucaauagca

SEQ ID NO: 202647 - RNA, 19 nt, Homo sapiens
uuauagaguuugagccauu

SEQ ID NO: 202648 - RNA, 19 nt, Homo sapiens
uuaaguguguguugcuaaa

SEQ ID NO: 202649 - RNA, 19 nt, Homo sapiens
cuguuuggcuucacuaauu

SEQ ID NO: 202650 - RNA, 19 nt, Homo sapiens
guaggauucugauauuugg

SEQ ID NO: 202651 - RNA, 19 nt, Homo sapiens
gaaauugguggguuguaau

SEQ ID NO: 202652 - RNA, 19 nt, Homo sapiens
aaacuauguucaucaguca

SEQ ID NO: 202653 - RNA, 19 nt, Homo sapiens
cguauuaucacuugucaaa

SEQ ID NO: 202654 - RNA, 19 nt, Homo sapiens
gauguaugcuggaaguaag

SEQ ID NO: 202655 - RNA, 19 nt, Homo sapiens
aaacuucucagguuacuau

SEQ ID NO: 202656 - RNA, 19 nt, Homo sapiens
ccauucccauucagccuua

SEQ ID NO: 202657 - RNA, 19 nt, Homo sapiens
aauagaaaguuggagauga

SEQ ID NO: 202658 - RNA, 19 nt, Homo sapiens
ggauaaacgccugguggua

SEQ ID NO: 202659 - RNA, 19 nt, Homo sapiens
gaacuggaugccugaauag

SEQ ID NO: 202660 - RNA, 19 nt, Homo sapiens
gcauugguguaauauaugg

SEQ ID NO: 202661 - RNA, 19 nt, Homo sapiens
gcuucauuguguauaguua

SEQ ID NO: 202662 - RNA, 19 nt, Homo sapiens
cauaaauucucgugaacua

SEQ ID NO: 202663 - RNA, 19 nt, Homo sapiens
caacugcacauuuguauau

SEQ ID NO: 202664 - RNA, 19 nt, Homo sapiens
gaagugaugcuccucuuug

SEQ ID NO: 202665 - RNA, 19 nt, Homo sapiens
cauguuacccgaugaagua

SEQ ID NO: 202666 - RNA, 19 nt, Homo sapiens
guaauagcaugguuugcaa

SEQ ID NO: 202667 - RNA, 19 nt, Homo sapiens
ggacuuacaguuugagaug

SEQ ID NO: 202668 - RNA, 19 nt, Homo sapiens
gacaaucuccauucgcaua

SEQ ID NO: 202669 - RNA, 19 nt, Homo sapiens
ucaguggacuuacaguuug

SEQ ID NO: 202670 - RNA, 19 nt, Homo sapiens
gcaggaggaccuacuaauc

SEQ ID NO: 202671 - RNA, 19 nt, Homo sapiens
ucgcauaaauucucgugaa

SEQ ID NO: 202672 - RNA, 19 nt, Homo sapiens
guacaaacaacugcacauu

SEQ ID NO: 202673 - RNA, 19 nt, Homo sapiens
cuucaacugucccaacauu

SEQ ID NO: 202674 - RNA, 19 nt, Homo sapiens
uggguuuguuguuguaaua

SEQ ID NO: 202675 - RNA, 19 nt, Homo sapiens
cucgugaacuacuuguuua

SEQ ID NO: 202676 - RNA, 19 nt, Homo sapiens
ggacauguuacccgaugaa

SEQ ID NO: 202677 - RNA, 19 nt, Homo sapiens
uacaaacaacugcacauuu

SEQ ID NO: 202678 - RNA, 19 nt, Homo sapiens
uaagaacuguacaaacaac

SEQ ID NO: 202679 - RNA, 19 nt, Homo sapiens
cuacuggguuuguuguugu

SEQ ID NO: 202680 - RNA, 19 nt, Homo sapiens
cauaaaugacuucaacugu

SEQ ID NO: 202681 - RNA, 19 nt, Homo sapiens
ggaccuacuaaucuugaaa

SEQ ID NO: 202682 - RNA, 19 nt, Homo sapiens
gcuccugcgugaagugaug

SEQ ID NO: 202683 - RNA, 19 nt, Homo sapiens
caacugucccaacauuaga

SEQ ID NO: 202684 - RNA, 19 nt, Homo sapiens
gaggaccuacuaaucuuga

SEQ ID NO: 202685 - RNA, 19 nt, Homo sapiens
aaacuaauagcuucuacug

SEQ ID NO: 202686 - RNA, 19 nt, Homo sapiens
gacuucaacugucccaaca

SEQ ID NO: 202687 - RNA, 19 nt, Homo sapiens
caaucuccauucgcauaaa

SEQ ID NO: 202688 - RNA, 19 nt, Homo sapiens
ggaggaccuacuaaucuug

SEQ ID NO: 202689 - RNA, 19 nt, Homo sapiens
gaugcuccucuuugccuua

SEQ ID NO: 202690 - RNA, 19 nt, Homo sapiens
gugaagugaugcuccucuu

SEQ ID NO: 202691 - RNA, 19 nt, Homo sapiens
caggaggaccuacuaaucu

SEQ ID NO: 202692 - RNA, 19 nt, Homo sapiens
ccucuagguggcccauuua

SEQ ID NO: 202693 - RNA, 19 nt, Homo sapiens
aggaggaccuacuaaucuu

SEQ ID NO: 202694 - RNA, 19 nt, Homo sapiens
ccucuuugccuuacuccua

SEQ ID NO: 202695 - RNA, 19 nt, Homo sapiens
ucucgugaacuacuuguuu

SEQ ID NO: 202696 - RNA, 19 nt, Homo sapiens
auuaggcgcuguaugacaa

SEQ ID NO: 202697 - RNA, 19 nt, Homo sapiens
cgugaacuacuuguuuaua

SEQ ID NO: 202698 - RNA, 19 nt, Homo sapiens
gcucaguggacuuacaguu

SEQ ID NO: 202699 - RNA, 19 nt, Homo sapiens
uaucauauuaggcgcugua

SEQ ID NO: 202700 - RNA, 19 nt, Homo sapiens
ucaacugucccaacauuag

SEQ ID NO: 202701 - RNA, 19 nt, Homo sapiens
uaugguuuguuguaagaga

SEQ ID NO: 202702 - RNA, 19 nt, Homo sapiens
ugaagugaugcuccucuuu

SEQ ID NO: 202703 - RNA, 19 nt, Homo sapiens
caguggacuuacaguuuga

SEQ ID NO: 202704 - RNA, 19 nt, Homo sapiens
gggacauguuacccgauga

SEQ ID NO: 202705 - RNA, 19 nt, Homo sapiens
ucuugaaagggacauguua

SEQ ID NO: 202706 - RNA, 19 nt, Homo sapiens
ucuacuggguuuguuguug

SEQ ID NO: 202707 - RNA, 19 nt, Homo sapiens
guaugacaaucuccauucg

SEQ ID NO: 202708 - RNA, 19 nt, Homo sapiens
cuuauccacugcuccucua

SEQ ID NO: 202709 - RNA, 19 nt, Homo sapiens
gaguuuugccucuaucaua

SEQ ID NO: 202710 - RNA, 19 nt, Homo sapiens
aauagcuucuacuggguuu

SEQ ID NO: 202711 - RNA, 19 nt, Homo sapiens
aaucuccauucgcauaaau

SEQ ID NO: 202712 - RNA, 19 nt, Homo sapiens
cuccauuauucccuucuaa

SEQ ID NO: 202713 - RNA, 19 nt, Homo sapiens
uaaauucucgugaacuacu

SEQ ID NO: 202714 - RNA, 19 nt, Homo sapiens
acaaucuccauucgcauaa

SEQ ID NO: 202715 - RNA, 19 nt, Homo sapiens
cucaguggacuuacaguuu

SEQ ID NO: 202716 - RNA, 19 nt, Homo sapiens
guuguaauagcaugguuug

SEQ ID NO: 202717 - RNA, 19 nt, Homo sapiens
uagaguauguccguaucau

SEQ ID NO: 202718 - RNA, 19 nt, Homo sapiens
uccucuagguggcccauuu

SEQ ID NO: 202719 - RNA, 19 nt, Homo sapiens
cugaccaucuucaccuguu

SEQ ID NO: 202720 - RNA, 19 nt, Homo sapiens
ugaggaggagcuuccagaa

SEQ ID NO: 202721 - RNA, 19 nt, Homo sapiens
cauuagaguauguccguau

SEQ ID NO: 202722 - RNA, 19 nt, Homo sapiens
caccuguuccgcagagaaa

SEQ ID NO: 202723 - RNA, 19 nt, Homo sapiens
gaagaugguuucagcuuua

SEQ ID NO: 202724 - RNA, 19 nt, Homo sapiens
ucacagcacuccauguuua

SEQ ID NO: 202725 - RNA, 19 nt, Homo sapiens
gagcagauaucaucaaagu

SEQ ID NO: 202726 - RNA, 19 nt, Homo sapiens
cagaaugccugcagaaugu

SEQ ID NO: 202727 - RNA, 19 nt, Homo sapiens
ggagugugcuggagaagug

SEQ ID NO: 202728 - RNA, 19 nt, Homo sapiens
gagccgagguggaucuuga

SEQ ID NO: 202729 - RNA, 19 nt, Homo sapiens
gaaauucaaagcagaccua

SEQ ID NO: 202730 - RNA, 19 nt, Homo sapiens
caggagaaaugguagaaga

SEQ ID NO: 202731 - RNA, 19 nt, Homo sapiens
cagcaauucauaagcauua

SEQ ID NO: 202732 - RNA, 19 nt, Homo sapiens
ccacaaaucacccagaaug

SEQ ID NO: 202733 - RNA, 19 nt, Homo sapiens
gaugguuucagcuuuaaua

SEQ ID NO: 202734 - RNA, 19 nt, Homo sapiens
caggaggaguugcugagua

SEQ ID NO: 202735 - RNA, 19 nt, Homo sapiens
agaagaugguuucagcuuu

SEQ ID NO: 202736 - RNA, 19 nt, Homo sapiens
gaacucauaaccucauugu

SEQ ID NO: 202737 - RNA, 19 nt, Homo sapiens
aaccaacacuugcaccuuu

SEQ ID NO: 202738 - RNA, 19 nt, Homo sapiens
gaaaugguagaagagcuua

SEQ ID NO: 202739 - RNA, 19 nt, Homo sapiens
gaauguagccgugaguuca

SEQ ID NO: 202740 - RNA, 19 nt, Homo sapiens
cggagcagauaucaucaaa

SEQ ID NO: 202741 - RNA, 19 nt, Homo sapiens
uuacagcaauucauaagca

SEQ ID NO: 202742 - RNA, 19 nt, Homo sapiens
ggguaagacuguggaaguu

SEQ ID NO: 202743 - RNA, 19 nt, Homo sapiens
ugccacagguuaaguuuau

SEQ ID NO: 202744 - RNA, 19 nt, Homo sapiens
ggugacaggagaaauggua

SEQ ID NO: 202745 - RNA, 19 nt, Homo sapiens
ccacagguuaaguuuauuu

SEQ ID NO: 202746 - RNA, 19 nt, Homo sapiens
uuacaaaggagauguggaa

SEQ ID NO: 202747 - RNA, 19 nt, Homo sapiens
ccagaaugccugcagaaug

SEQ ID NO: 202748 - RNA, 19 nt, Homo sapiens
acucauaaccucauuguuc

SEQ ID NO: 202749 - RNA, 19 nt, Homo sapiens
caauggguauucagaacau

SEQ ID NO: 202750 - RNA, 19 nt, Homo sapiens
gaacguggugacaggagaa

SEQ ID NO: 202751 - RNA, 19 nt, Homo sapiens
gcagugggcagaaugaucu

SEQ ID NO: 202752 - RNA, 19 nt, Homo sapiens
gaaacuuguccgugccaaa

SEQ ID NO: 202753 - RNA, 19 nt, Homo sapiens
gcagaccuacucagggauu

SEQ ID NO: 202754 - RNA, 19 nt, Homo sapiens
gcucugacaccgccaugaa

SEQ ID NO: 202755 - RNA, 19 nt, Homo sapiens
ccagcugagugccgucauu

SEQ ID NO: 202756 - RNA, 19 nt, Homo sapiens
ggauguggccaauggguau

SEQ ID NO: 202757 - RNA, 19 nt, Homo sapiens
cucauaaccucauuguuca

SEQ ID NO: 202758 - RNA, 19 nt, Homo sapiens
gaaugccuguguccucucu

SEQ ID NO: 202759 - RNA, 19 nt, Homo sapiens
ugagauggcagccgugaug

SEQ ID NO: 202760 - RNA, 19 nt, Homo sapiens
cagaacucauaaccucauu

SEQ ID NO: 202761 - RNA, 19 nt, Homo sapiens
gccaauggguauucagaac

SEQ ID NO: 202762 - RNA, 19 nt, Homo sapiens
gauggcagccgugauguca

SEQ ID NO: 202763 - RNA, 19 nt, Homo sapiens
aagaugguuucagcuuuaa

SEQ ID NO: 202764 - RNA, 19 nt, Homo sapiens
caagcacgcaggaggaguu

SEQ ID NO: 202765 - RNA, 19 nt, Homo sapiens
ucucucccuuucuuuguuu

SEQ ID NO: 202766 - RNA, 19 nt, Homo sapiens
caaaggagauguggaaaac

SEQ ID NO: 202767 - RNA, 19 nt, Homo sapiens
caucaaagugggaguugga

SEQ ID NO: 202768 - RNA, 19 nt, Homo sapiens
gcaccuucacguuucgaaa

SEQ ID NO: 202769 - RNA, 19 nt, Homo sapiens
ggacacugugggcacguuu

SEQ ID NO: 202770 - RNA, 19 nt, Homo sapiens
aagcggagcagccucaaga

SEQ ID NO: 202771 - RNA, 19 nt, Homo sapiens
cagaacauuuuguggaauu

SEQ ID NO: 202772 - RNA, 19 nt, Homo sapiens
ugccacaaaucacccagaa

SEQ ID NO: 202773 - RNA, 19 nt, Homo sapiens
uggaagcucuuugccacaa

SEQ ID NO: 202774 - RNA, 19 nt, Homo sapiens
ugucacagcacuccauguu

SEQ ID NO: 202775 - RNA, 19 nt, Homo sapiens
cauaaccucauuguucaaa

SEQ ID NO: 202776 - RNA, 19 nt, Homo sapiens
acuuguccgugccaaauuu

SEQ ID NO: 202777 - RNA, 19 nt, Homo sapiens
gacaggagaaaugguagaa

SEQ ID NO: 202778 - RNA, 19 nt, Homo sapiens
gugccaaauuuccugaaca

SEQ ID NO: 202779 - RNA, 19 nt, Homo sapiens
aaacuuguccgugccaaau

SEQ ID NO: 202780 - RNA, 19 nt, Homo sapiens
ggaccucaagcucgacuuc

SEQ ID NO: 202781 - RNA, 19 nt, Homo sapiens
gaagggccacaucaucucu

SEQ ID NO: 202782 - RNA, 19 nt, Homo sapiens
ucacguuucgaaauucaaa

SEQ ID NO: 202783 - RNA, 19 nt, Homo sapiens
uaaguuuauuugccuggau

SEQ ID NO: 202784 - RNA, 19 nt, Homo sapiens
cacuugcaccuuucucuuu

SEQ ID NO: 202785 - RNA, 19 nt, Homo sapiens
ggaacggacggaagcucaa

SEQ ID NO: 202786 - RNA, 19 nt, Homo sapiens
ggaauguuuucgggucaua

SEQ ID NO: 202787 - RNA, 19 nt, Homo sapiens
uggccaacauggacacugu

SEQ ID NO: 202788 - RNA, 19 nt, Homo sapiens
gugccacagguuaaguuua

SEQ ID NO: 202789 - RNA, 19 nt, Homo sapiens
caucaucguggccaacaug

SEQ ID NO: 202790 - RNA, 19 nt, Homo sapiens
cugcugcccagaacucaua

SEQ ID NO: 202791 - RNA, 19 nt, Homo sapiens
guggaauucgugaaacuug

SEQ ID NO: 202792 - RNA, 19 nt, Homo sapiens
aagaagaugguuucagcuu

SEQ ID NO: 202793 - RNA, 19 nt, Homo sapiens
ccuguguccucucuucugu

SEQ ID NO: 202794 - RNA, 19 nt, Homo sapiens
ggaauucgugaaacuuguc

SEQ ID NO: 202795 - RNA, 19 nt, Homo sapiens
uggaauucgugaaacuugu

SEQ ID NO: 202796 - RNA, 19 nt, Homo sapiens
ccaauggguauucagaaca

SEQ ID NO: 202797 - RNA, 19 nt, Homo sapiens
gccuggauguggccaaugg

SEQ ID NO: 202798 - RNA, 19 nt, Homo sapiens
gcaggagggcaacauucau

SEQ ID NO: 202799 - RNA, 19 nt, Homo sapiens
aggaggaguugcugaguac

SEQ ID NO: 202800 - RNA, 19 nt, Homo sapiens
acaccgccaugaacaagca

SEQ ID NO: 202801 - RNA, 19 nt, Homo sapiens
gaacggacggaagcucaag

SEQ ID NO: 202802 - RNA, 19 nt, Homo sapiens
caugcugggaggaauguuu

SEQ ID NO: 202803 - RNA, 19 nt, Homo sapiens
agaaaugguagaagagcuu

SEQ ID NO: 202804 - RNA, 19 nt, Homo sapiens
ggccaauggguauucagaa

SEQ ID NO: 202805 - RNA, 19 nt, Homo sapiens
guucaaaccaacacuugca

SEQ ID NO: 202806 - RNA, 19 nt, Homo sapiens
cagcaggagggcaacauuc

SEQ ID NO: 202807 - RNA, 19 nt, Homo sapiens
gguaagacuguggaaguuc

SEQ ID NO: 202808 - RNA, 19 nt, Homo sapiens
ucuacgggaugagcucuga

SEQ ID NO: 202809 - RNA, 19 nt, Homo sapiens
cuucacguuucgaaauuca

SEQ ID NO: 202810 - RNA, 19 nt, Homo sapiens
aggaguugcugaguacaga

SEQ ID NO: 202811 - RNA, 19 nt, Homo sapiens
cuuuggaacuggagcagau

SEQ ID NO: 202812 - RNA, 19 nt, Homo sapiens
gccacagguuaaguuuauu

SEQ ID NO: 202813 - RNA, 19 nt, Homo sapiens
ucaagauccucuacaagua

SEQ ID NO: 202814 - RNA, 19 nt, Homo sapiens
gaacgugacauccaucaug

SEQ ID NO: 202815 - RNA, 19 nt, Homo sapiens
gggaagagcacguucauca

SEQ ID NO: 202816 - RNA, 19 nt, Homo sapiens
gaucaucuacucacacuuc

SEQ ID NO: 202817 - RNA, 19 nt, Homo sapiens
gaagagcacguucaucaag

SEQ ID NO: 202818 - RNA, 19 nt, Homo sapiens
ccaccggcaucaucgagua

SEQ ID NO: 202819 - RNA, 19 nt, Homo sapiens
ucaccaagcucgucuacca

SEQ ID NO: 202820 - RNA, 19 nt, Homo sapiens
gcacguucaucaagcagau

SEQ ID NO: 202821 - RNA, 19 nt, Homo sapiens
guacgucagugccaucaag

SEQ ID NO: 202822 - RNA, 19 nt, Homo sapiens
ggaagagcacguucaucaa

SEQ ID NO: 202823 - RNA, 19 nt, Homo sapiens
ggagagcaaagcccuguuc

SEQ ID NO: 202824 - RNA, 19 nt, Homo sapiens
ggaguacaaccuggucuga

SEQ ID NO: 202825 - RNA, 19 nt, Homo sapiens
ccagaacuccuccgucauc

SEQ ID NO: 202826 - RNA, 19 nt, Homo sapiens
gagcagaacaaggccaaug

SEQ ID NO: 202827 - RNA, 19 nt, Homo sapiens
uuucuggccuugacuuaug

SEQ ID NO: 202828 - RNA, 19 nt, Homo sapiens
uggauccacugcuuugaga

SEQ ID NO: 202829 - RNA, 19 nt, Homo sapiens
ccaagcucgucuaccagaa

SEQ ID NO: 202830 - RNA, 19 nt, Homo sapiens
ccauggagacgcucaagau

SEQ ID NO: 202831 - RNA, 19 nt, Homo sapiens
gagaacgugacauccauca

SEQ ID NO: 202832 - RNA, 19 nt, Homo sapiens
ucgcgcaccuucucaccuu

SEQ ID NO: 202833 - RNA, 19 nt, Homo sapiens
caucaucgaguacccuuuc

SEQ ID NO: 202834 - RNA, 19 nt, Homo sapiens
caagauccucuacaaguac

SEQ ID NO: 202835 - RNA, 19 nt, Homo sapiens
cguguugccugagcgauga

SEQ ID NO: 202836 - RNA, 19 nt, Homo sapiens
acaaguacgagcagaacaa

SEQ ID NO: 202837 - RNA, 19 nt, Homo sapiens
cagcgaauacgaccaaguc

SEQ ID NO: 202838 - RNA, 19 nt, Homo sapiens
ugaccaccuucgagcauca

SEQ ID NO: 202839 - RNA, 19 nt, Homo sapiens
gucauccucuuccucaaca

SEQ ID NO: 202840 - RNA, 19 nt, Homo sapiens
gcucaagauccucuacaag

SEQ ID NO: 202841 - RNA, 19 nt, Homo sapiens
ccaccgacacggagaacau

SEQ ID NO: 202842 - RNA, 19 nt, Homo sapiens
cgacagcgacaagaucauc

SEQ ID NO: 202843 - RNA, 19 nt, Homo sapiens
acgccgagaucgagaagca

SEQ ID NO: 202844 - RNA, 19 nt, Homo sapiens
ggagguggacguggagaag

SEQ ID NO: 202845 - RNA, 19 nt, Homo sapiens
cucaagauccucuacaagu

SEQ ID NO: 202846 - RNA, 19 nt, Homo sapiens
gagcaugacuucguuauua

SEQ ID NO: 202847 - RNA, 19 nt, Homo sapiens
acaacaagcucuucuucaa

SEQ ID NO: 202848 - RNA, 19 nt, Homo sapiens
gggagucggugaaguacuu

SEQ ID NO: 202849 - RNA, 19 nt, Homo sapiens
agaaggcgcugcuggaguu

SEQ ID NO: 202850 - RNA, 19 nt, Homo sapiens
ggaucggccagcugaauua

SEQ ID NO: 202851 - RNA, 19 nt, Homo sapiens
gagauaagcuuggcauucc

SEQ ID NO: 202852 - RNA, 19 nt, Homo sapiens
caacaacaagcucuucuuc

SEQ ID NO: 202853 - RNA, 19 nt, Homo sapiens
ggaaagccaccaagggaau

SEQ ID NO: 202854 - RNA, 19 nt, Homo sapiens
cagcugaauuacuuuccua

SEQ ID NO: 202855 - RNA, 19 nt, Homo sapiens
gaagauccccuuuaagaug

SEQ ID NO: 202856 - RNA, 19 nt, Homo sapiens
gaaagccaccaagggaauu

SEQ ID NO: 202857 - RNA, 19 nt, Homo sapiens
gaaccugaaggacaucaug

SEQ ID NO: 202858 - RNA, 19 nt, Homo sapiens
ccacguuccucaagcagau

SEQ ID NO: 202859 - RNA, 19 nt, Homo sapiens
gugaagaccgugagcauca

SEQ ID NO: 202860 - RNA, 19 nt, Homo sapiens
ccuuuaagaugguggaugu

SEQ ID NO: 202861 - RNA, 19 nt, Homo sapiens
ggagcaugacuucguuauu

SEQ ID NO: 202862 - RNA, 19 nt, Homo sapiens
gaucacguccauccuguuc

SEQ ID NO: 202863 - RNA, 19 nt, Homo sapiens
agcaugacuucguuauuaa

SEQ ID NO: 202864 - RNA, 19 nt, Homo sapiens
cguguuccaugcugugaaa

SEQ ID NO: 202865 - RNA, 19 nt, Homo sapiens
agaagugguuccagugcuu

SEQ ID NO: 202866 - RNA, 19 nt, Homo sapiens
gcaaguccacguuccucaa

SEQ ID NO: 202867 - RNA, 19 nt, Homo sapiens
ugagaagcaugggauguuc

SEQ ID NO: 202868 - RNA, 19 nt, Homo sapiens
ggacaucaugcugcaguga

SEQ ID NO: 202869 - RNA, 19 nt, Homo sapiens
gcgacaccaucuucgacaa

SEQ ID NO: 202870 - RNA, 19 nt, Homo sapiens
ggcauuccuuggcaguauu

SEQ ID NO: 202871 - RNA, 19 nt, Homo sapiens
cgagauaagcuuggcauuc

SEQ ID NO: 202872 - RNA, 19 nt, Homo sapiens
ucggccagcugaauuacuu

SEQ ID NO: 202873 - RNA, 19 nt, Homo sapiens
ucgagaccaucgucaacaa

SEQ ID NO: 202874 - RNA, 19 nt, Homo sapiens
ucacguccauccuguucau

SEQ ID NO: 202875 - RNA, 19 nt, Homo sapiens
guacuuccuggacaacuug

SEQ ID NO: 202876 - RNA, 19 nt, Homo sapiens
caacaagcucuucuucaac

SEQ ID NO: 202877 - RNA, 19 nt, Homo sapiens
gacaccaucuucgacaaca

SEQ ID NO: 202878 - RNA, 19 nt, Homo sapiens
aggagaaccugaaggacau

SEQ ID NO: 202879 - RNA, 19 nt, Homo sapiens
gauaagcuuggcauuccuu

SEQ ID NO: 202880 - RNA, 19 nt, Homo sapiens
ugaagaccgugagcaucaa

SEQ ID NO: 202881 - RNA, 19 nt, Homo sapiens
uggcauuccuuggcaguau

SEQ ID NO: 202882 - RNA, 19 nt, Homo sapiens
gagaccaucgucaacaaca

SEQ ID NO: 202883 - RNA, 19 nt, Homo sapiens
gccgcgaguucgaccagaa

SEQ ID NO: 202884 - RNA, 19 nt, Homo sapiens
gcagcaagccacucuucca

SEQ ID NO: 202885 - RNA, 19 nt, Homo sapiens
aagaagauccccuuuaaga

SEQ ID NO: 202886 - RNA, 19 nt, Homo sapiens
gaauuguggagcaugacuu

SEQ ID NO: 202887 - RNA, 19 nt, Homo sapiens
caagggaauuguggagcau

SEQ ID NO: 202888 - RNA, 19 nt, Homo sapiens
caacgucuccaucauucuc

SEQ ID NO: 202889 - RNA, 19 nt, Homo sapiens
cuucaacgucuccaucauu

SEQ ID NO: 202890 - RNA, 19 nt, Homo sapiens
agaccaucgucaacaacaa

SEQ ID NO: 202891 - RNA, 19 nt, Homo sapiens
caugacuucguuauuaaga

SEQ ID NO: 202892 - RNA, 19 nt, Homo sapiens
uguggagcaugacuucguu

SEQ ID NO: 202893 - RNA, 19 nt, Homo sapiens
uucaacgucuccaucauuc

SEQ ID NO: 202894 - RNA, 19 nt, Homo sapiens
ugauggccuucgagaacaa

SEQ ID NO: 202895 - RNA, 19 nt, Homo sapiens
gcaguauucugaaaaugag

SEQ ID NO: 202896 - RNA, 19 nt, Homo sapiens
agggaauuguggagcauga

SEQ ID NO: 202897 - RNA, 19 nt, Homo sapiens
gaccaucgucaacaacaag

SEQ ID NO: 202898 - RNA, 19 nt, Homo sapiens
gcaugacuucguuauuaag

SEQ ID NO: 202899 - RNA, 19 nt, Homo sapiens
ccuuggcaguauucugaaa

SEQ ID NO: 202900 - RNA, 19 nt, Homo sapiens
ccacuggcaucaacgagua

SEQ ID NO: 202901 - RNA, 19 nt, Homo sapiens
gaagucagagcguaagaaa

SEQ ID NO: 202902 - RNA, 19 nt, Homo sapiens
gcacauccgucauccucuu

SEQ ID NO: 202903 - RNA, 19 nt, Homo sapiens
ggagagccucgcauuguuu

SEQ ID NO: 202904 - RNA, 19 nt, Homo sapiens
gaaggagagccucgcauug

SEQ ID NO: 202905 - RNA, 19 nt, Homo sapiens
ccaccuggcuaccuauuuc

SEQ ID NO: 202906 - RNA, 19 nt, Homo sapiens
ccuauaaagugaccacguu

SEQ ID NO: 202907 - RNA, 19 nt, Homo sapiens
gguaacagaccgcuggaaa

SEQ ID NO: 202908 - RNA, 19 nt, Homo sapiens
cgugcgggcugaaauuaaa

SEQ ID NO: 202909 - RNA, 19 nt, Homo sapiens
agucagagcguaagaaaug

SEQ ID NO: 202910 - RNA, 19 nt, Homo sapiens
gaauuccaccugcucgauu

SEQ ID NO: 202911 - RNA, 19 nt, Homo sapiens
ugacucaguuucccuccuu

SEQ ID NO: 202912 - RNA, 19 nt, Homo sapiens
ucaacaggauccucuugga

SEQ ID NO: 202913 - RNA, 19 nt, Homo sapiens
gaacauccgcaaggucuuc

SEQ ID NO: 202914 - RNA, 19 nt, Homo sapiens
cauccucuuucucaacaaa

SEQ ID NO: 202915 - RNA, 19 nt, Homo sapiens
aaagugaccacguuugaga

SEQ ID NO: 202916 - RNA, 19 nt, Homo sapiens
gcaccuucaucaagcagau

SEQ ID NO: 202917 - RNA, 19 nt, Homo sapiens
ugaaggagagccucgcauu

SEQ ID NO: 202918 - RNA, 19 nt, Homo sapiens
gaacgugaucgcccucauc

SEQ ID NO: 202919 - RNA, 19 nt, Homo sapiens
gcuggccgcucucuucucu

SEQ ID NO: 202920 - RNA, 19 nt, Homo sapiens
ccacagacacacagaacau

SEQ ID NO: 202921 - RNA, 19 nt, Homo sapiens
gguucauccuggacaugua

SEQ ID NO: 202922 - RNA, 19 nt, Homo sapiens
ccucccaccuggcuaccua

SEQ ID NO: 202923 - RNA, 19 nt, Homo sapiens
gagagccucgcauuguuug

SEQ ID NO: 202924 - RNA, 19 nt, Homo sapiens
aggagagccucgcauuguu

SEQ ID NO: 202925 - RNA, 19 nt, Homo sapiens
gcccuugcuugacucaguu

SEQ ID NO: 202926 - RNA, 19 nt, Homo sapiens
auaaagugaccacguuuga

SEQ ID NO: 202927 - RNA, 19 nt, Homo sapiens
cuaguguccuggucuaucu

SEQ ID NO: 202928 - RNA, 19 nt, Homo sapiens
gccagaagucagagcguaa

SEQ ID NO: 202929 - RNA, 19 nt, Homo sapiens
cgagaucaaccugcuguga

SEQ ID NO: 202930 - RNA, 19 nt, Homo sapiens
gucauccucuuucucaaca

SEQ ID NO: 202931 - RNA, 19 nt, Homo sapiens
ggacucuggcgcacucuag

SEQ ID NO: 202932 - RNA, 19 nt, Homo sapiens
guuugggacuauccuggaa

SEQ ID NO: 202933 - RNA, 19 nt, Homo sapiens
ucaagcagaugcggaucau

SEQ ID NO: 202934 - RNA, 19 nt, Homo sapiens
gggaugccaggguggauga

SEQ ID NO: 202935 - RNA, 19 nt, Homo sapiens
gauccauuguuucgagaac

SEQ ID NO: 202936 - RNA, 19 nt, Homo sapiens
ggaauuccaccugcucgau

SEQ ID NO: 202937 - RNA, 19 nt, Homo sapiens
uauaaagugaccacguuug

SEQ ID NO: 202938 - RNA, 19 nt, Homo sapiens
ucaguuucccuccuuugaa

SEQ ID NO: 202939 - RNA, 19 nt, Homo sapiens
accaggagaucaacaggau

SEQ ID NO: 202940 - RNA, 19 nt, Homo sapiens
guauuuauucccucaccuu

SEQ ID NO: 202941 - RNA, 19 nt, Homo sapiens
aaggagagccucgcauugu

SEQ ID NO: 202942 - RNA, 19 nt, Homo sapiens
cgugaucgcccucaucuac

SEQ ID NO: 202943 - RNA, 19 nt, Homo sapiens
cuaccuauuuccccaguuu

SEQ ID NO: 202944 - RNA, 19 nt, Homo sapiens
ucgauucagccguguacua

SEQ ID NO: 202945 - RNA, 19 nt, Homo sapiens
ccauggagcggcugcagau

SEQ ID NO: 202946 - RNA, 19 nt, Homo sapiens
gacucaguuucccuccuuu

SEQ ID NO: 202947 - RNA, 19 nt, Homo sapiens
aaaccaaccugcggaucgu

SEQ ID NO: 202948 - RNA, 19 nt, Homo sapiens
cuauaaagugaccacguuu

SEQ ID NO: 202949 - RNA, 19 nt, Homo sapiens
uuuauucccucaccuucug

SEQ ID NO: 202950 - RNA, 19 nt, Homo sapiens
gguuugcggacgagagaaa

SEQ ID NO: 202951 - RNA, 19 nt, Homo sapiens
uccgcaaggucuucaagga

SEQ ID NO: 202952 - RNA, 19 nt, Homo sapiens
guaaguaguuuccaaguua

SEQ ID NO: 202953 - RNA, 19 nt, Homo sapiens
gaaauuguuugacagcaua

SEQ ID NO: 202954 - RNA, 19 nt, Homo sapiens
gaccaaaguuguucuguuu

SEQ ID NO: 202955 - RNA, 19 nt, Homo sapiens
agaaugaaauggacgauua

SEQ ID NO: 202956 - RNA, 19 nt, Homo sapiens
cagaauagcucaaccaaau

SEQ ID NO: 202957 - RNA, 19 nt, Homo sapiens
ggugauggcuuuggaaaua

SEQ ID NO: 202958 - RNA, 19 nt, Homo sapiens
gaauagcucaaccaaauua

SEQ ID NO: 202959 - RNA, 19 nt, Homo sapiens
gaagaggaguguaaacaau

SEQ ID NO: 202960 - RNA, 19 nt, Homo sapiens
caaauuacaucccgacuca

SEQ ID NO: 202961 - RNA, 19 nt, Homo sapiens
guaccuagcauacaugaua

SEQ ID NO: 202962 - RNA, 19 nt, Homo sapiens
uacauuagauuccacguua

SEQ ID NO: 202963 - RNA, 19 nt, Homo sapiens
gaauacaccugccuuugga

SEQ ID NO: 202964 - RNA, 19 nt, Homo sapiens
ggaccuuucuuaaauguga

SEQ ID NO: 202965 - RNA, 19 nt, Homo sapiens
caaaccaaaugaguacuua

SEQ ID NO: 202966 - RNA, 19 nt, Homo sapiens
gaaagauagugguguacaa

SEQ ID NO: 202967 - RNA, 19 nt, Homo sapiens
gagaguaccagcuuaauga

SEQ ID NO: 202968 - RNA, 19 nt, Homo sapiens
guucauguccuguaaauuu

SEQ ID NO: 202969 - RNA, 19 nt, Homo sapiens
caaaguuccuuaaaugugu

SEQ ID NO: 202970 - RNA, 19 nt, Homo sapiens
ccacaaagaagcacauauu

SEQ ID NO: 202971 - RNA, 19 nt, Homo sapiens
gaugauuucugcauaagug

SEQ ID NO: 202972 - RNA, 19 nt, Homo sapiens
aagcugggcucuaguauau

SEQ ID NO: 202973 - RNA, 19 nt, Homo sapiens
cggaagaaguggauucauu

SEQ ID NO: 202974 - RNA, 19 nt, Homo sapiens
ucacuggguugaaguauau

SEQ ID NO: 202975 - RNA, 19 nt, Homo sapiens
auacugagcuuugauagaa

SEQ ID NO: 202976 - RNA, 19 nt, Homo sapiens
ccacagauacuaagaaugu

SEQ ID NO: 202977 - RNA, 19 nt, Homo sapiens
ucaagaauaugcaggauca

SEQ ID NO: 202978 - RNA, 19 nt, Homo sapiens
ggaagaaguggauucauug

SEQ ID NO: 202979 - RNA, 19 nt, Homo sapiens
gauuauaugugugcucaaa

SEQ ID NO: 202980 - RNA, 19 nt, Homo sapiens
ggaaauauacacccacuuc

SEQ ID NO: 202981 - RNA, 19 nt, Homo sapiens
agaggcagcugcauauauu

SEQ ID NO: 202982 - RNA, 19 nt, Homo sapiens
ucucagaacuagagugaaa

SEQ ID NO: 202983 - RNA, 19 nt, Homo sapiens
gaaaggacacaaaggaaau

SEQ ID NO: 202984 - RNA, 19 nt, Homo sapiens
gcaguggucuacaguaaca

SEQ ID NO: 202985 - RNA, 19 nt, Homo sapiens
gguaaguaguuuccaaguu

SEQ ID NO: 202986 - RNA, 19 nt, Homo sapiens
gcgaucaucuucuguguag

SEQ ID NO: 202987 - RNA, 19 nt, Homo sapiens
gaucugagcggaagaagug

SEQ ID NO: 202988 - RNA, 19 nt, Homo sapiens
caacagaucccgagaguac

SEQ ID NO: 202989 - RNA, 19 nt, Homo sapiens
gaucaaacacauaugaaga

SEQ ID NO: 202990 - RNA, 19 nt, Homo sapiens
gccuuuggaucaacuauuu

SEQ ID NO: 202991 - RNA, 19 nt, Homo sapiens
uuacagcccuuaucuagau

SEQ ID NO: 202992 - RNA, 19 nt, Homo sapiens
gcugggcucuaguauauug

SEQ ID NO: 202993 - RNA, 19 nt, Homo sapiens
ucaugagaauuauggguua

SEQ ID NO: 202994 - RNA, 19 nt, Homo sapiens
gaggauauacugucuuaga

SEQ ID NO: 202995 - RNA, 19 nt, Homo sapiens
gcaaaugcaucugggacuu

SEQ ID NO: 202996 - RNA, 19 nt, Homo sapiens
acagauacauccauuauac

SEQ ID NO: 202997 - RNA, 19 nt, Homo sapiens
gguucuagcugaagaugaa

SEQ ID NO: 202998 - RNA, 19 nt, Homo sapiens
guggaaagauaguggugua

SEQ ID NO: 202999 - RNA, 19 nt, Homo sapiens
auaaagagauuguggaaag

SEQ ID NO: 203000 - RNA, 19 nt, Homo sapiens
cugaggauauacugucuua

SEQ ID NO: 203001 - RNA, 19 nt, Homo sapiens
uuacuacguuugccaguuu

SEQ ID NO: 203002 - RNA, 19 nt, Homo sapiens
gacagacuauuacuacguu

SEQ ID NO: 203003 - RNA, 19 nt, Homo sapiens
cuaagaaugugcaguuugu

SEQ ID NO: 203004 - RNA, 19 nt, Homo sapiens
gaaguauauuugugugugu

SEQ ID NO: 203005 - RNA, 19 nt, Homo sapiens
caaagaagcacauauuggu

SEQ ID NO: 203006 - RNA, 19 nt, Homo sapiens
ccacuugcuugagauuaua

SEQ ID NO: 203007 - RNA, 19 nt, Homo sapiens
gaaggacaguguuaaagcu

SEQ ID NO: 203008 - RNA, 19 nt, Homo sapiens
aagcaguggucuacaguaa

SEQ ID NO: 203009 - RNA, 19 nt, Homo sapiens
ggacacaaaggaaauauac

SEQ ID NO: 203010 - RNA, 19 nt, Homo sapiens
gaagaggcagcugcauaua

SEQ ID NO: 203011 - RNA, 19 nt, Homo sapiens
aacaagugguuuacagaua

SEQ ID NO: 203012 - RNA, 19 nt, Homo sapiens
gauagacuuuggugacuca

SEQ ID NO: 203013 - RNA, 19 nt, Homo sapiens
cugcauauauucaauguca

SEQ ID NO: 203014 - RNA, 19 nt, Homo sapiens
gugaagcuguguaugaaau

SEQ ID NO: 203015 - RNA, 19 nt, Homo sapiens
gaaauggacgauuacacuu

SEQ ID NO: 203016 - RNA, 19 nt, Homo sapiens
gaaugacagacuauuacua

SEQ ID NO: 203017 - RNA, 19 nt, Homo sapiens
ugaaugacuuggacagaau

SEQ ID NO: 203018 - RNA, 19 nt, Homo sapiens
guacaauugugaagcagau

SEQ ID NO: 203019 - RNA, 19 nt, Homo sapiens
gcagcaacacagaauguaa

SEQ ID NO: 203020 - RNA, 19 nt, Homo sapiens
agaaguggauucauugcuu

SEQ ID NO: 203021 - RNA, 19 nt, Homo sapiens
caaguuacguguugucacu

SEQ ID NO: 203022 - RNA, 19 nt, Homo sapiens
gcugauauaaugcaagauu

SEQ ID NO: 203023 - RNA, 19 nt, Homo sapiens
cagcauauguaacaacaag

SEQ ID NO: 203024 - RNA, 19 nt, Homo sapiens
gaaagcaugaaauuguuug

SEQ ID NO: 203025 - RNA, 19 nt, Homo sapiens
cagcauacuauuugaauga

SEQ ID NO: 203026 - RNA, 19 nt, Homo sapiens
uaaagagauuguggaaaga

SEQ ID NO: 203027 - RNA, 19 nt, Homo sapiens
gaagcuguguaugaaauuc

SEQ ID NO: 203028 - RNA, 19 nt, Homo sapiens
ggaaacauuacagcccuua

SEQ ID NO: 203029 - RNA, 19 nt, Homo sapiens
gcucggugcuggugaaucu

SEQ ID NO: 203030 - RNA, 19 nt, Homo sapiens
aaagaaaggacacaaagga

SEQ ID NO: 203031 - RNA, 19 nt, Homo sapiens
gacagcauauguaacaaca

SEQ ID NO: 203032 - RNA, 19 nt, Homo sapiens
guaacaccauccagucaau

SEQ ID NO: 203033 - RNA, 19 nt, Homo sapiens
gcuagauacugagcuuuga

SEQ ID NO: 203034 - RNA, 19 nt, Homo sapiens
aaauggacgauuacacuua

SEQ ID NO: 203035 - RNA, 19 nt, Homo sapiens
ugaccaaaguuguucuguu

SEQ ID NO: 203036 - RNA, 19 nt, Homo sapiens
gaaauauacacccacuuca

SEQ ID NO: 203037 - RNA, 19 nt, Homo sapiens
gaaugacuuggacagaaua

SEQ ID NO: 203038 - RNA, 19 nt, Homo sapiens
gcagcauacuauuugaaug

SEQ ID NO: 203039 - RNA, 19 nt, Homo sapiens
gauuauucaugauguguca

SEQ ID NO: 203040 - RNA, 19 nt, Homo sapiens
gggaagauaacaagaagga

SEQ ID NO: 203041 - RNA, 19 nt, Homo sapiens
uggcugauaugaaugcauu

SEQ ID NO: 203042 - RNA, 19 nt, Homo sapiens
aagagauuguggaaagaua

SEQ ID NO: 203043 - RNA, 19 nt, Homo sapiens
gaaauccugaacuuuauuc

SEQ ID NO: 203044 - RNA, 19 nt, Homo sapiens
cgacuccgcuuaggaagug

SEQ ID NO: 203045 - RNA, 19 nt, Homo sapiens
cacguuagauuugguuuga

SEQ ID NO: 203046 - RNA, 19 nt, Homo sapiens
gaauaugcaggaucaaaca

SEQ ID NO: 203047 - RNA, 19 nt, Homo sapiens
ggagggauccuaagagcau

SEQ ID NO: 203048 - RNA, 19 nt, Homo sapiens
cguuagauuugguuugaaa

SEQ ID NO: 203049 - RNA, 19 nt, Homo sapiens
gugauggcuuuggaaauaa

SEQ ID NO: 203050 - RNA, 19 nt, Homo sapiens
gcagcugcauauauucaau

SEQ ID NO: 203051 - RNA, 19 nt, Homo sapiens
gaacuagagugaaaacuac

SEQ ID NO: 203052 - RNA, 19 nt, Homo sapiens
gcucuaagaugaucgacaa

SEQ ID NO: 203053 - RNA, 19 nt, Homo sapiens
gauagcaucugcaacaaca

SEQ ID NO: 203054 - RNA, 19 nt, Homo sapiens
gccgagcgcucuaagauga

SEQ ID NO: 203055 - RNA, 19 nt, Homo sapiens
ccagcuacauccagaguaa

SEQ ID NO: 203056 - RNA, 19 nt, Homo sapiens
gaccuacacuucaagaugu

SEQ ID NO: 203057 - RNA, 19 nt, Homo sapiens
ggacugcggccucuucuga

SEQ ID NO: 203058 - RNA, 19 nt, Homo sapiens
gcaaagacaccaaggagau

SEQ ID NO: 203059 - RNA, 19 nt, Homo sapiens
cgacucagcugccuacuac

SEQ ID NO: 203060 - RNA, 19 nt, Homo sapiens
ucaaggaccuacacuucaa

SEQ ID NO: 203061 - RNA, 19 nt, Homo sapiens
caucauggccauugucaaa

SEQ ID NO: 203062 - RNA, 19 nt, Homo sapiens
cuaagaugaucgacaagaa

SEQ ID NO: 203063 - RNA, 19 nt, Homo sapiens
gagacacacuucaccuuca

SEQ ID NO: 203064 - RNA, 19 nt, Homo sapiens
ugaacgaccuggagcguau

SEQ ID NO: 203065 - RNA, 19 nt, Homo sapiens
gcccaaguccaaauguuua

SEQ ID NO: 203066 - RNA, 19 nt, Homo sapiens
ggaccuacacuucaagaug

SEQ ID NO: 203067 - RNA, 19 nt, Homo sapiens
ggucugagcggaagaagug

SEQ ID NO: 203068 - RNA, 19 nt, Homo sapiens
gaagagcaccaucgucaag

SEQ ID NO: 203069 - RNA, 19 nt, Homo sapiens
gcucugggcugaccauggu

SEQ ID NO: 203070 - RNA, 19 nt, Homo sapiens
ggccaccgccgaauuugua

SEQ ID NO: 203071 - RNA, 19 nt, Homo sapiens
gggaauaccagcucaacga

SEQ ID NO: 203072 - RNA, 19 nt, Homo sapiens
acaagaaggaccuguuuga

SEQ ID NO: 203073 - RNA, 19 nt, Homo sapiens
ucacagccaucaucuucug

SEQ ID NO: 203074 - RNA, 19 nt, Homo sapiens
ugucugagaugcugguaau

SEQ ID NO: 203075 - RNA, 19 nt, Homo sapiens
gaagccugcccuugucuga

SEQ ID NO: 203076 - RNA, 19 nt, Homo sapiens
gcaacaccauccaguccau

SEQ ID NO: 203077 - RNA, 19 nt, Homo sapiens
ccucuuuccucucuuuguu

SEQ ID NO: 203078 - RNA, 19 nt, Homo sapiens
ggaccugaauaagcgcaaa

SEQ ID NO: 203079 - RNA, 19 nt, Homo sapiens
agacacacuucaccuucaa

SEQ ID NO: 203080 - RNA, 19 nt, Homo sapiens
gggcaucuguucugguuuu

SEQ ID NO: 203081 - RNA, 19 nt, Homo sapiens
ggaagagcaccaucgucaa

SEQ ID NO: 203082 - RNA, 19 nt, Homo sapiens
gcaccaucgucaagcagau

SEQ ID NO: 203083 - RNA, 19 nt, Homo sapiens
cagcccaaguccaaauguu

SEQ ID NO: 203084 - RNA, 19 nt, Homo sapiens
ucaagaacaaccugaagga

SEQ ID NO: 203085 - RNA, 19 nt, Homo sapiens
cuacauccagaguaaguuu

SEQ ID NO: 203086 - RNA, 19 nt, Homo sapiens
gaggagaagaucacacaca

SEQ ID NO: 203087 - RNA, 19 nt, Homo sapiens
gagcaugaagcuauucgau

SEQ ID NO: 203088 - RNA, 19 nt, Homo sapiens
acacaggggccaacaaaua

SEQ ID NO: 203089 - RNA, 19 nt, Homo sapiens
cgucacagccaucaucuuc

SEQ ID NO: 203090 - RNA, 19 nt, Homo sapiens
ggagaugaaccgcaugcau

SEQ ID NO: 203091 - RNA, 19 nt, Homo sapiens
cuugagcgccuaugacuug

SEQ ID NO: 203092 - RNA, 19 nt, Homo sapiens
gaugggccaccgccgaauu

SEQ ID NO: 203093 - RNA, 19 nt, Homo sapiens
ucacagacacguccaucau

SEQ ID NO: 203094 - RNA, 19 nt, Homo sapiens
gaucguggagacacacuuc

SEQ ID NO: 203095 - RNA, 19 nt, Homo sapiens
gggcgguugucuacagcaa

SEQ ID NO: 203096 - RNA, 19 nt, Homo sapiens
acacguccaucauccucuu

SEQ ID NO: 203097 - RNA, 19 nt, Homo sapiens
ccauugucuuguucuguga

SEQ ID NO: 203098 - RNA, 19 nt, Homo sapiens
ucuccucuuuccucucuuu

SEQ ID NO: 203099 - RNA, 19 nt, Homo sapiens
uaaccauugucuuguucug

SEQ ID NO: 203100 - RNA, 19 nt, Homo sapiens
cugggcaucuguucugguu

SEQ ID NO: 203101 - RNA, 19 nt, Homo sapiens
gcugguaauggccauggua

SEQ ID NO: 203102 - RNA, 19 nt, Homo sapiens
ccaucugcuucccugagua

SEQ ID NO: 203103 - RNA, 19 nt, Homo sapiens
agaugaaccgcaugcauga

SEQ ID NO: 203104 - RNA, 19 nt, Homo sapiens
gggccaacaaauaugauga

SEQ ID NO: 203105 - RNA, 19 nt, Homo sapiens
caacaacaagugguucaca

SEQ ID NO: 203106 - RNA, 19 nt, Homo sapiens
ggagaucuacacgcacuuc

SEQ ID NO: 203107 - RNA, 19 nt, Homo sapiens
caaagacaccaaggagauc

SEQ ID NO: 203108 - RNA, 19 nt, Homo sapiens
ggaccuguuugaggagaag

SEQ ID NO: 203109 - RNA, 19 nt, Homo sapiens
aaggcgugcucccugauga

SEQ ID NO: 203110 - RNA, 19 nt, Homo sapiens
cuucaaggaccuacacuuc

SEQ ID NO: 203111 - RNA, 19 nt, Homo sapiens
gaacgaccuggagcguauu

SEQ ID NO: 203112 - RNA, 19 nt, Homo sapiens
acaccaagaacgugcaguu

SEQ ID NO: 203113 - RNA, 19 nt, Homo sapiens
aguuugaggaccugaauaa

SEQ ID NO: 203114 - RNA, 19 nt, Homo sapiens
guacacaggggccaacaaa

SEQ ID NO: 203115 - RNA, 19 nt, Homo sapiens
ccccucagcuccaaacgua

SEQ ID NO: 203116 - RNA, 19 nt, Homo sapiens
ggagaagaucacacacagu

SEQ ID NO: 203117 - RNA, 19 nt, Homo sapiens
caagaaggaccuguuugag

SEQ ID NO: 203118 - RNA, 19 nt, Homo sapiens
aacaagugguucacagaca

SEQ ID NO: 203119 - RNA, 19 nt, Homo sapiens
agcaugaagcuauucgaua

SEQ ID NO: 203120 - RNA, 19 nt, Homo sapiens
guuugaagccugcccuugu

SEQ ID NO: 203121 - RNA, 19 nt, Homo sapiens
ggaggaaugccggcaguac

SEQ ID NO: 203122 - RNA, 19 nt, Homo sapiens
agccugcccuugucugaga

SEQ ID NO: 203123 - RNA, 19 nt, Homo sapiens
cugaauaagcgcaaagaca

SEQ ID NO: 203124 - RNA, 19 nt, Homo sapiens
uaaguuugaggaccugaau

SEQ ID NO: 203125 - RNA, 19 nt, Homo sapiens
acaacaagugguucacaga

SEQ ID NO: 203126 - RNA, 19 nt, Homo sapiens
ucgauagcaucugcaacaa

SEQ ID NO: 203127 - RNA, 19 nt, Homo sapiens
gggcgucacagccaucauc

SEQ ID NO: 203128 - RNA, 19 nt, Homo sapiens
gaaaugguguuguugauaa

SEQ ID NO: 203129 - RNA, 19 nt, Homo sapiens
gaaauacugucuucuguuu

SEQ ID NO: 203130 - RNA, 19 nt, Homo sapiens
ggaaaguucugcaauaaga

SEQ ID NO: 203131 - RNA, 19 nt, Homo sapiens
gaagacaaaugaagagaau

SEQ ID NO: 203132 - RNA, 19 nt, Homo sapiens
gauguuaacuguaguaauc

SEQ ID NO: 203133 - RNA, 19 nt, Homo sapiens
aaagucagcuucuuggaua

SEQ ID NO: 203134 - RNA, 19 nt, Homo sapiens
gcaauaagauucuaguucu

SEQ ID NO: 203135 - RNA, 19 nt, Homo sapiens
ccaaauuacugcugaugua

SEQ ID NO: 203136 - RNA, 19 nt, Homo sapiens
ccaaggagaucuauacuca

SEQ ID NO: 203137 - RNA, 19 nt, Homo sapiens
gagaauggguuuagguaga

SEQ ID NO: 203138 - RNA, 19 nt, Homo sapiens
gaugaucgaccgcaacuua

SEQ ID NO: 203139 - RNA, 19 nt, Homo sapiens
aaugagaccugguggaaua

SEQ ID NO: 203140 - RNA, 19 nt, Homo sapiens
caaacaaucuuaacuaugc

SEQ ID NO: 203141 - RNA, 19 nt, Homo sapiens
caacuguagucuuucuaua

SEQ ID NO: 203142 - RNA, 19 nt, Homo sapiens
gagaccugguggaauauua

SEQ ID NO: 203143 - RNA, 19 nt, Homo sapiens
gggaauaucagcucaauga

SEQ ID NO: 203144 - RNA, 19 nt, Homo sapiens
aaacagaaccagugacuuu

SEQ ID NO: 203145 - RNA, 19 nt, Homo sapiens
ucaaagaccuauacuucaa

SEQ ID NO: 203146 - RNA, 19 nt, Homo sapiens
ggaauuggaagaacuacua

SEQ ID NO: 203147 - RNA, 19 nt, Homo sapiens
gaauaucccagucuaacua

SEQ ID NO: 203148 - RNA, 19 nt, Homo sapiens
gaaaugagaccugguggaa

SEQ ID NO: 203149 - RNA, 19 nt, Homo sapiens
ugacuuugcugcuacauau

SEQ ID NO: 203150 - RNA, 19 nt, Homo sapiens
gaggaugaauguaaacaau

SEQ ID NO: 203151 - RNA, 19 nt, Homo sapiens
gauaugugaucaugauuca

SEQ ID NO: 203152 - RNA, 19 nt, Homo sapiens
ugagaaacaucuaaagugu

SEQ ID NO: 203153 - RNA, 19 nt, Homo sapiens
cgaagaaugugcaguuugu

SEQ ID NO: 203154 - RNA, 19 nt, Homo sapiens
gaauacacagguuccaaua

SEQ ID NO: 203155 - RNA, 19 nt, Homo sapiens
gaacuagcaggagugauua

SEQ ID NO: 203156 - RNA, 19 nt, Homo sapiens
agaaugugcuuuagccuuu

SEQ ID NO: 203157 - RNA, 19 nt, Homo sapiens
ggagaucuauacucacuuc

SEQ ID NO: 203158 - RNA, 19 nt, Homo sapiens
cuaaugaaaugguguuguu

SEQ ID NO: 203159 - RNA, 19 nt, Homo sapiens
gcaguucagugccuuuguu

SEQ ID NO: 203160 - RNA, 19 nt, Homo sapiens
gaagaccacaggcauugua

SEQ ID NO: 203161 - RNA, 19 nt, Homo sapiens
guaccgauguuaacuguag

SEQ ID NO: 203162 - RNA, 19 nt, Homo sapiens
gcugcuacauauuuacuaa

SEQ ID NO: 203163 - RNA, 19 nt, Homo sapiens
ccacagacacgaagaaugu

SEQ ID NO: 203164 - RNA, 19 nt, Homo sapiens
gaacuucaauauguagcuu

SEQ ID NO: 203165 - RNA, 19 nt, Homo sapiens
ggccaaagaucagaacgaa

SEQ ID NO: 203166 - RNA, 19 nt, Homo sapiens
ugauguagguggccaaaga

SEQ ID NO: 203167 - RNA, 19 nt, Homo sapiens
gcuuaugguugaagguuaa

SEQ ID NO: 203168 - RNA, 19 nt, Homo sapiens
gaacuacuaaagugugauu

SEQ ID NO: 203169 - RNA, 19 nt, Homo sapiens
uggaagaacuacuaaagug

SEQ ID NO: 203170 - RNA, 19 nt, Homo sapiens
gccaugggcugcacguuga

SEQ ID NO: 203171 - RNA, 19 nt, Homo sapiens
gauguaguaugauaaaguc

SEQ ID NO: 203172 - RNA, 19 nt, Homo sapiens
gagaaacaucuaaagugua

SEQ ID NO: 203173 - RNA, 19 nt, Homo sapiens
guccaucauugcaaucaua

SEQ ID NO: 203174 - RNA, 19 nt, Homo sapiens
ucuuuaagcuuaugguuga

SEQ ID NO: 203175 - RNA, 19 nt, Homo sapiens
cuuaaaugcuuauggaaga

SEQ ID NO: 203176 - RNA, 19 nt, Homo sapiens
ggaauguggacuuuauuga

SEQ ID NO: 203177 - RNA, 19 nt, Homo sapiens
gcagcugccuauauucaau

SEQ ID NO: 203178 - RNA, 19 nt, Homo sapiens
acagaaacuucaaucauuc

SEQ ID NO: 203179 - RNA, 19 nt, Homo sapiens
gaccuauacuucaagaugu

SEQ ID NO: 203180 - RNA, 19 nt, Homo sapiens
gcucaaugauucugcuuca

SEQ ID NO: 203181 - RNA, 19 nt, Homo sapiens
aaacaggguugguaguugu

SEQ ID NO: 203182 - RNA, 19 nt, Homo sapiens
uaaacaggguugguaguug

SEQ ID NO: 203183 - RNA, 19 nt, Homo sapiens
ggaaauacugucuucuguu

SEQ ID NO: 203184 - RNA, 19 nt, Homo sapiens
aaacacauuucaccuucaa

SEQ ID NO: 203185 - RNA, 19 nt, Homo sapiens
caaucauucucuuccuuaa

SEQ ID NO: 203186 - RNA, 19 nt, Homo sapiens
caagauguuugauguaggu

SEQ ID NO: 203187 - RNA, 19 nt, Homo sapiens
ggaagacaaaugaagagaa

SEQ ID NO: 203188 - RNA, 19 nt, Homo sapiens
uugcuuguguggaaaguua

SEQ ID NO: 203189 - RNA, 19 nt, Homo sapiens
gaguaaagagcccagguuu

SEQ ID NO: 203190 - RNA, 19 nt, Homo sapiens
auaguuggcggcaguauua

SEQ ID NO: 203191 - RNA, 19 nt, Homo sapiens
cugcugauguaguaugaua

SEQ ID NO: 203192 - RNA, 19 nt, Homo sapiens
aagcauggauguuagugaa

SEQ ID NO: 203193 - RNA, 19 nt, Homo sapiens
cuaacuacauuccaacuca

SEQ ID NO: 203194 - RNA, 19 nt, Homo sapiens
gcaauacuauacaguccau

SEQ ID NO: 203195 - RNA, 19 nt, Homo sapiens
uauggaagaugugaaguug

SEQ ID NO: 203196 - RNA, 19 nt, Homo sapiens
gacagcauuuguaauaaca

SEQ ID NO: 203197 - RNA, 19 nt, Homo sapiens
ugacagcaauuaucuucug

SEQ ID NO: 203198 - RNA, 19 nt, Homo sapiens
gcagauccagggaauauca

SEQ ID NO: 203199 - RNA, 19 nt, Homo sapiens
uaacuagucuuuucuggaa

SEQ ID NO: 203200 - RNA, 19 nt, Homo sapiens
uauauucaaugccaguuug

SEQ ID NO: 203201 - RNA, 19 nt, Homo sapiens
ucaaucauucucuuccuua

SEQ ID NO: 203202 - RNA, 19 nt, Homo sapiens
uggauuggauucuauuuca

SEQ ID NO: 203203 - RNA, 19 nt, Homo sapiens
ggaagaacuacuaaagugu

SEQ ID NO: 203204 - RNA, 19 nt, Homo sapiens
gaauuggaagaacuacuaa

SEQ ID NO: 203205 - RNA, 19 nt, Homo sapiens
gcuacucggugcuggagaa

SEQ ID NO: 203206 - RNA, 19 nt, Homo sapiens
ccacaggcauuguagaaac

SEQ ID NO: 203207 - RNA, 19 nt, Homo sapiens
aauguggacuuuauugaga

SEQ ID NO: 203208 - RNA, 19 nt, Homo sapiens
acacagguuccaauacaua

SEQ ID NO: 203209 - RNA, 19 nt, Homo sapiens
auacacagguuccaauaca

SEQ ID NO: 203210 - RNA, 19 nt, Homo sapiens
gaccacaggcauuguagaa

SEQ ID NO: 203211 - RNA, 19 nt, Homo sapiens
guaaacaggguugguaguu

SEQ ID NO: 203212 - RNA, 19 nt, Homo sapiens
gcuuacagaugguauaacu

SEQ ID NO: 203213 - RNA, 19 nt, Homo sapiens
guaaagagcccagguuugc

SEQ ID NO: 203214 - RNA, 19 nt, Homo sapiens
uauuaacagugcaugcuuu

SEQ ID NO: 203215 - RNA, 19 nt, Homo sapiens
uuggaaaguucugcaauaa

SEQ ID NO: 203216 - RNA, 19 nt, Homo sapiens
cagcaauuaucuucugugu

SEQ ID NO: 203217 - RNA, 19 nt, Homo sapiens
uggcagugcugaagaagga

SEQ ID NO: 203218 - RNA, 19 nt, Homo sapiens
cagaugguauaacuguauu

SEQ ID NO: 203219 - RNA, 19 nt, Homo sapiens
gguuugcuccuguuuguaa

SEQ ID NO: 203220 - RNA, 19 nt, Homo sapiens
gaaguugaggugcugcauu

SEQ ID NO: 203221 - RNA, 19 nt, Homo sapiens
gcagcagcaugcagaaucu

SEQ ID NO: 203222 - RNA, 19 nt, Homo sapiens
gaaaagauaccaaggagau

SEQ ID NO: 203223 - RNA, 19 nt, Homo sapiens
auaaagaggaguccguuaa

SEQ ID NO: 203224 - RNA, 19 nt, Homo sapiens
gguaaaagcaccauuguga

SEQ ID NO: 203225 - RNA, 19 nt, Homo sapiens
agaacuagcaggagugauu

SEQ ID NO: 203226 - RNA, 19 nt, Homo sapiens
ucuauacuguggacuaaug

SEQ ID NO: 203227 - RNA, 19 nt, Homo sapiens
ugcugaaacuguugcauuu

SEQ ID NO: 203228 - RNA, 19 nt, Homo sapiens
gaaagcaucuggaacaaca

SEQ ID NO: 203229 - RNA, 19 nt, Homo sapiens
ggcauagucuucuuucuua

SEQ ID NO: 203230 - RNA, 19 nt, Homo sapiens
ggaugcaccucaagcagua

SEQ ID NO: 203231 - RNA, 19 nt, Homo sapiens
uaaagcaauucucguguaa

SEQ ID NO: 203232 - RNA, 19 nt, Homo sapiens
ucucuaaacuuucccuaua

SEQ ID NO: 203233 - RNA, 19 nt, Homo sapiens
ggagaagaucccaaaguua

SEQ ID NO: 203234 - RNA, 19 nt, Homo sapiens
agaaagagcgccuggcuua

SEQ ID NO: 203235 - RNA, 19 nt, Homo sapiens
gaggagaacuugguagaug

SEQ ID NO: 203236 - RNA, 19 nt, Homo sapiens
ucacugacuuugaauauuc

SEQ ID NO: 203237 - RNA, 19 nt, Homo sapiens
cuaaagcaauucucgugua

SEQ ID NO: 203238 - RNA, 19 nt, Homo sapiens
caaaauguguccugucuaa

SEQ ID NO: 203239 - RNA, 19 nt, Homo sapiens
gaaaauggauccagugcuu

SEQ ID NO: 203240 - RNA, 19 nt, Homo sapiens
gaccauuucuaucaucuug

SEQ ID NO: 203241 - RNA, 19 nt, Homo sapiens
gaagaaacgccugcucuga

SEQ ID NO: 203242 - RNA, 19 nt, Homo sapiens
gaagauaacaacaccaaca

SEQ ID NO: 203243 - RNA, 19 nt, Homo sapiens
gagaagcaguugcagaaag

SEQ ID NO: 203244 - RNA, 19 nt, Homo sapiens
ggaauucuuugaccaugug

SEQ ID NO: 203245 - RNA, 19 nt, Homo sapiens
gcaaugaguacuauaauac

SEQ ID NO: 203246 - RNA, 19 nt, Homo sapiens
ugaauuagagcuacuuuga

SEQ ID NO: 203247 - RNA, 19 nt, Homo sapiens
gagaagaucccaaaguuac

SEQ ID NO: 203248 - RNA, 19 nt, Homo sapiens
ugaagacuauuucccagaa

SEQ ID NO: 203249 - RNA, 19 nt, Homo sapiens
gcacgucaauggguuuaau

SEQ ID NO: 203250 - RNA, 19 nt, Homo sapiens
guucugacaucugggauuu

SEQ ID NO: 203251 - RNA, 19 nt, Homo sapiens
aggagaagaucccaaaguu

SEQ ID NO: 203252 - RNA, 19 nt, Homo sapiens
gaaggcaugcuuugagaga

SEQ ID NO: 203253 - RNA, 19 nt, Homo sapiens
gaugcuaucgugacaauug

SEQ ID NO: 203254 - RNA, 19 nt, Homo sapiens
uaaagaugcuaucgugaca

SEQ ID NO: 203255 - RNA, 19 nt, Homo sapiens
agaagcaguugcagaaaga

SEQ ID NO: 203256 - RNA, 19 nt, Homo sapiens
uagauucucuuuguuguug

SEQ ID NO: 203257 - RNA, 19 nt, Homo sapiens
gcagaaaaccuaccacauu

SEQ ID NO: 203258 - RNA, 19 nt, Homo sapiens
uagcuucuguugucauuga

SEQ ID NO: 203259 - RNA, 19 nt, Homo sapiens
ucuaucaucuuguucuuga

SEQ ID NO: 203260 - RNA, 19 nt, Homo sapiens
caagauaugcuggcagaaa

SEQ ID NO: 203261 - RNA, 19 nt, Homo sapiens
gagaagauaacaacaccaa

SEQ ID NO: 203262 - RNA, 19 nt, Homo sapiens
gugaaggcaugcuuugaga

SEQ ID NO: 203263 - RNA, 19 nt, Homo sapiens
gaccagaccaucucuuuca

SEQ ID NO: 203264 - RNA, 19 nt, Homo sapiens
gaagacuauuucccagaau

SEQ ID NO: 203265 - RNA, 19 nt, Homo sapiens
caacgaauaccagcugauu

SEQ ID NO: 203266 - RNA, 19 nt, Homo sapiens
cccagaauaugcaaauuau

SEQ ID NO: 203267 - RNA, 19 nt, Homo sapiens
gaaaagcaccaucgucaaa

SEQ ID NO: 203268 - RNA, 19 nt, Homo sapiens
gagagucccuggaucuuuu

SEQ ID NO: 203269 - RNA, 19 nt, Homo sapiens
aaauggauccagugcuuua

SEQ ID NO: 203270 - RNA, 19 nt, Homo sapiens
agaaacgccugcucugaau

SEQ ID NO: 203271 - RNA, 19 nt, Homo sapiens
gcgacagagugaccagaaa

SEQ ID NO: 203272 - RNA, 19 nt, Homo sapiens
gcugcaggcugacgagaga

SEQ ID NO: 203273 - RNA, 19 nt, Homo sapiens
ccacggccgucucugauuc

SEQ ID NO: 203274 - RNA, 19 nt, Homo sapiens
ggagcccaauuauucauuc

SEQ ID NO: 203275 - RNA, 19 nt, Homo sapiens
ccauuucuaucaucuuguu

SEQ ID NO: 203276 - RNA, 19 nt, Homo sapiens
ucacagcuaucauuuacgu

SEQ ID NO: 203277 - RNA, 19 nt, Homo sapiens
gaugucacagcuaucauuu

SEQ ID NO: 203278 - RNA, 19 nt, Homo sapiens
aaaccuaccacauucacua

SEQ ID NO: 203279 - RNA, 19 nt, Homo sapiens
cauucucccuuuauugauu

SEQ ID NO: 203280 - RNA, 19 nt, Homo sapiens
gaagaucccaaaguuacaa

SEQ ID NO: 203281 - RNA, 19 nt, Homo sapiens
ugucacagcuaucauuuac

SEQ ID NO: 203282 - RNA, 19 nt, Homo sapiens
uuacggaccauuucuauca

SEQ ID NO: 203283 - RNA, 19 nt, Homo sapiens
ucagcaaugaguacuauaa

SEQ ID NO: 203284 - RNA, 19 nt, Homo sapiens
cuucuguugucauugaaua

SEQ ID NO: 203285 - RNA, 19 nt, Homo sapiens
ccucagguuugguugugua

SEQ ID NO: 203286 - RNA, 19 nt, Homo sapiens
gcaguaugagcucuuguga

SEQ ID NO: 203287 - RNA, 19 nt, Homo sapiens
ucccagaauaugcaaauua

SEQ ID NO: 203288 - RNA, 19 nt, Homo sapiens
uuaacgaugucacagcuau

SEQ ID NO: 203289 - RNA, 19 nt, Homo sapiens
ugagagauccaacgaauac

SEQ ID NO: 203290 - RNA, 19 nt, Homo sapiens
caacauggugauucgagaa

SEQ ID NO: 203291 - RNA, 19 nt, Homo sapiens
gaccagggcgucgaugaaa

SEQ ID NO: 203292 - RNA, 19 nt, Homo sapiens
gcaccaucgucaaacagau

SEQ ID NO: 203293 - RNA, 19 nt, Homo sapiens
cagaaaaccuaccacauuc

SEQ ID NO: 203294 - RNA, 19 nt, Homo sapiens
gaagacgcaacaccagaug

SEQ ID NO: 203295 - RNA, 19 nt, Homo sapiens
cagcuugguugacuacaca

SEQ ID NO: 203296 - RNA, 19 nt, Homo sapiens
ccacauucacuacugcaaa

SEQ ID NO: 203297 - RNA, 19 nt, Homo sapiens
ccauuuaguugggaguuug

SEQ ID NO: 203298 - RNA, 19 nt, Homo sapiens
gcauagucuucuuucuuag

SEQ ID NO: 203299 - RNA, 19 nt, Homo sapiens
ccaucucgcugccgucugu

SEQ ID NO: 203300 - RNA, 19 nt, Homo sapiens
acgaauaccagcugauuga

SEQ ID NO: 203301 - RNA, 19 nt, Homo sapiens
aagaaacgccugcucugaa

SEQ ID NO: 203302 - RNA, 19 nt, Homo sapiens
uuugagagauccaacgaau

SEQ ID NO: 203303 - RNA, 19 nt, Homo sapiens
gaucagacuacaucaagag

SEQ ID NO: 203304 - RNA, 19 nt, Homo sapiens
aagaugcuaucgugacaau

SEQ ID NO: 203305 - RNA, 19 nt, Homo sapiens
caaaccaccgacucucauu

SEQ ID NO: 203306 - RNA, 19 nt, Homo sapiens
ucgagaagcaguugcagaa

SEQ ID NO: 203307 - RNA, 19 nt, Homo sapiens
ccggugacggcaaacauua

SEQ ID NO: 203308 - RNA, 19 nt, Homo sapiens
gcuacaacauggugauucg

SEQ ID NO: 203309 - RNA, 19 nt, Homo sapiens
gcuaucgugacaauuguuu

SEQ ID NO: 203310 - RNA, 19 nt, Homo sapiens
aaagcaccaucgucaaaca

SEQ ID NO: 203311 - RNA, 19 nt, Homo sapiens
gccauuuaguugggaguuu

SEQ ID NO: 203312 - RNA, 19 nt, Homo sapiens
cgaucagacuacaucaaga

SEQ ID NO: 203313 - RNA, 19 nt, Homo sapiens
aagcaauucucguguaaaa

SEQ ID NO: 203314 - RNA, 19 nt, Homo sapiens
cuccaacucucuauugcuu

SEQ ID NO: 203315 - RNA, 19 nt, Homo sapiens
cgucucugauucucccuuu

SEQ ID NO: 203316 - RNA, 19 nt, Homo sapiens
uguagcuucuguugucauu

SEQ ID NO: 203317 - RNA, 19 nt, Homo sapiens
ugacugugcacaauacuuc

SEQ ID NO: 203318 - RNA, 19 nt, Homo sapiens
cccuaucacugacuuugaa

SEQ ID NO: 203319 - RNA, 19 nt, Homo sapiens
cagacuacaucaagagcau

SEQ ID NO: 203320 - RNA, 19 nt, Homo sapiens
caauuucgaucagacuaca

SEQ ID NO: 203321 - RNA, 19 nt, Homo sapiens
gaauuagagcuacuuugag

SEQ ID NO: 203322 - RNA, 19 nt, Homo sapiens
ccucaggcauuugaauuag

SEQ ID NO: 203323 - RNA, 19 nt, Homo sapiens
aagagcgccuggcuuacaa

SEQ ID NO: 203324 - RNA, 19 nt, Homo sapiens
gaacgacgcgaggccaaca

SEQ ID NO: 203325 - RNA, 19 nt, Homo sapiens
aaacuuucccuauacuuag

SEQ ID NO: 203326 - RNA, 19 nt, Homo sapiens
cgaugucacagcuaucauu

SEQ ID NO: 203327 - RNA, 19 nt, Homo sapiens
ccuuacagccauuuaguug

SEQ ID NO: 203328 - RNA, 19 nt, Homo sapiens
gagaagacgugaaacagua

SEQ ID NO: 203329 - RNA, 19 nt, Homo sapiens
gaaacccacuucacauuca

SEQ ID NO: 203330 - RNA, 19 nt, Homo sapiens
caacgacucugccaaauac

SEQ ID NO: 203331 - RNA, 19 nt, Homo sapiens
gaacacccaucguauaagg

SEQ ID NO: 203332 - RNA, 19 nt, Homo sapiens
gcgagaagaucaagaaguc

SEQ ID NO: 203333 - RNA, 19 nt, Homo sapiens
gcaagaaguggauccauug

SEQ ID NO: 203334 - RNA, 19 nt, Homo sapiens
ccaaagacgugaaauuacu

SEQ ID NO: 203335 - RNA, 19 nt, Homo sapiens
aaagaacacccaucguaua

SEQ ID NO: 203336 - RNA, 19 nt, Homo sapiens
gagcaaggcgauugagaaa

SEQ ID NO: 203337 - RNA, 19 nt, Homo sapiens
ugacguugaucuccuggua

SEQ ID NO: 203338 - RNA, 19 nt, Homo sapiens
aagauggaauguaguguuu

SEQ ID NO: 203339 - RNA, 19 nt, Homo sapiens
cgccaaagacgugaaauua

SEQ ID NO: 203340 - RNA, 19 nt, Homo sapiens
ggacgucacggccaucauu

SEQ ID NO: 203341 - RNA, 19 nt, Homo sapiens
gaucugaacgcaagaagug

SEQ ID NO: 203342 - RNA, 19 nt, Homo sapiens
caaaaccacuggcaucgua

SEQ ID NO: 203343 - RNA, 19 nt, Homo sapiens
gaccaauccuaugucauuu

SEQ ID NO: 203344 - RNA, 19 nt, Homo sapiens
guagaaugcuguagaaucc

SEQ ID NO: 203345 - RNA, 19 nt, Homo sapiens
aaacaaacauacccaucug

SEQ ID NO: 203346 - RNA, 19 nt, Homo sapiens
ggagcaaggcgauugagaa

SEQ ID NO: 203347 - RNA, 19 nt, Homo sapiens
caucgaauauggugauaag

SEQ ID NO: 203348 - RNA, 19 nt, Homo sapiens
aguugagucuucacauuua

SEQ ID NO: 203349 - RNA, 19 nt, Homo sapiens
cuacauccaagcacaauuu

SEQ ID NO: 203350 - RNA, 19 nt, Homo sapiens
aacaaguucuucaucgaua

SEQ ID NO: 203351 - RNA, 19 nt, Homo sapiens
aagaacacccaucguauaa

SEQ ID NO: 203352 - RNA, 19 nt, Homo sapiens
cuuaaucugugcugaagaa

SEQ ID NO: 203353 - RNA, 19 nt, Homo sapiens
ccuaugucauuucuacuuu

SEQ ID NO: 203354 - RNA, 19 nt, Homo sapiens
gauggaauguaguguuuac

SEQ ID NO: 203355 - RNA, 19 nt, Homo sapiens
gaucaguuuccuagucuuu

SEQ ID NO: 203356 - RNA, 19 nt, Homo sapiens
agaaguggauccauugcuu

SEQ ID NO: 203357 - RNA, 19 nt, Homo sapiens
ccacagacacgaauaacau

SEQ ID NO: 203358 - RNA, 19 nt, Homo sapiens
ucaacgacucugccaaaua

SEQ ID NO: 203359 - RNA, 19 nt, Homo sapiens
ucaugugcuuuguagcuua

SEQ ID NO: 203360 - RNA, 19 nt, Homo sapiens
cgcaagaaguggauccauu

SEQ ID NO: 203361 - RNA, 19 nt, Homo sapiens
ucaagaaccuccacuucag

SEQ ID NO: 203362 - RNA, 19 nt, Homo sapiens
uuaguugagucuucacauu

SEQ ID NO: 203363 - RNA, 19 nt, Homo sapiens
gaucaagaagucaccuuug

SEQ ID NO: 203364 - RNA, 19 nt, Homo sapiens
ggagaagacgugaaacagu

SEQ ID NO: 203365 - RNA, 19 nt, Homo sapiens
cauccaagcacaauuugaa

SEQ ID NO: 203366 - RNA, 19 nt, Homo sapiens
gaaaggcugacgccaagau

SEQ ID NO: 203367 - RNA, 19 nt, Homo sapiens
gagcugcuuucugccauga

SEQ ID NO: 203368 - RNA, 19 nt, Homo sapiens
uuaaauaccacaagaugga

SEQ ID NO: 203369 - RNA, 19 nt, Homo sapiens
cgccgaguacuauguauua

SEQ ID NO: 203370 - RNA, 19 nt, Homo sapiens
caugugcuuuguagcuuaa

SEQ ID NO: 203371 - RNA, 19 nt, Homo sapiens
gacugacggcuguguauuu

SEQ ID NO: 203372 - RNA, 19 nt, Homo sapiens
uagaaacccacuucacauu

SEQ ID NO: 203373 - RNA, 19 nt, Homo sapiens
caacaaguucuucaucgau

SEQ ID NO: 203374 - RNA, 19 nt, Homo sapiens
uaacaacaaguucuucauc

SEQ ID NO: 203375 - RNA, 19 nt, Homo sapiens
acuaauacccaaacccuaa

SEQ ID NO: 203376 - RNA, 19 nt, Homo sapiens
ccaauccuaugucauuucu

SEQ ID NO: 203377 - RNA, 19 nt, Homo sapiens
acagaucaguuuccuaguc

SEQ ID NO: 203378 - RNA, 19 nt, Homo sapiens
cgaguacuauguauuacca

SEQ ID NO: 203379 - RNA, 19 nt, Homo sapiens
gcucggggcuggagaauca

SEQ ID NO: 203380 - RNA, 19 nt, Homo sapiens
ccaucugcuuuccugaaua

SEQ ID NO: 203381 - RNA, 19 nt, Homo sapiens
gcaccauugugaagcagau

SEQ ID NO: 203382 - RNA, 19 nt, Homo sapiens
acgccaagaugguguguga

SEQ ID NO: 203383 - RNA, 19 nt, Homo sapiens
guagaaacccacuucacau

SEQ ID NO: 203384 - RNA, 19 nt, Homo sapiens
cagaucaguuuccuagucu

SEQ ID NO: 203385 - RNA, 19 nt, Homo sapiens
gcucuucgacuccaucugu

SEQ ID NO: 203386 - RNA, 19 nt, Homo sapiens
gagcggagcaaggcgauug

SEQ ID NO: 203387 - RNA, 19 nt, Homo sapiens
ggacagccuggaucggauu

SEQ ID NO: 203388 - RNA, 19 nt, Homo sapiens
ucuguagaaugcuguagaa

SEQ ID NO: 203389 - RNA, 19 nt, Homo sapiens
acucuuugcuguugacguu

SEQ ID NO: 203390 - RNA, 19 nt, Homo sapiens
caucugcuuuccugaauac

SEQ ID NO: 203391 - RNA, 19 nt, Homo sapiens
acaacaaguucuucaucga

SEQ ID NO: 203392 - RNA, 19 nt, Homo sapiens
ccacuggcaucguagaaac

SEQ ID NO: 203393 - RNA, 19 nt, Homo sapiens
ccaagauggugugugaugu

SEQ ID NO: 203394 - RNA, 19 nt, Homo sapiens
ugacggcuguguauuucug

SEQ ID NO: 203395 - RNA, 19 nt, Homo sapiens
aagcacaauuugaaagcaa

SEQ ID NO: 203396 - RNA, 19 nt, Homo sapiens
caucgauaccuccaucauu

SEQ ID NO: 203397 - RNA, 19 nt, Homo sapiens
aaagauggaauguaguguu

SEQ ID NO: 203398 - RNA, 19 nt, Homo sapiens
uaguugagucuucacauuu

SEQ ID NO: 203399 - RNA, 19 nt, Homo sapiens
gaccaucugcuuuccugaa

SEQ ID NO: 203400 - RNA, 19 nt, Homo sapiens
gacuuaaucugugcugaag

SEQ ID NO: 203401 - RNA, 19 nt, Homo sapiens
ccuuugccguguuggauuu

SEQ ID NO: 203402 - RNA, 19 nt, Homo sapiens
acacuuugggcaucgaaua

SEQ ID NO: 203403 - RNA, 19 nt, Homo sapiens
caccauuucaaccauauuu

SEQ ID NO: 203404 - RNA, 19 nt, Homo sapiens
aauccuaugucauuucuac

SEQ ID NO: 203405 - RNA, 19 nt, Homo sapiens
gaccucuuguccuguauag

SEQ ID NO: 203406 - RNA, 19 nt, Homo sapiens
ucaccgacaucaucauugc

SEQ ID NO: 203407 - RNA, 19 nt, Homo sapiens
cguagaaacccacuucaca

SEQ ID NO: 203408 - RNA, 19 nt, Homo sapiens
gccaagauggugugugaug

SEQ ID NO: 203409 - RNA, 19 nt, Homo sapiens
acucaccauuucaaccaua

SEQ ID NO: 203410 - RNA, 19 nt, Homo sapiens
caucaucauugccaacaac

SEQ ID NO: 203411 - RNA, 19 nt, Homo sapiens
aaaccgcucacccaacaaa

SEQ ID NO: 203412 - RNA, 19 nt, Homo sapiens
aaacccacuucacauucaa

SEQ ID NO: 203413 - RNA, 19 nt, Homo sapiens
gcugcuuucugccaugaug

SEQ ID NO: 203414 - RNA, 19 nt, Homo sapiens
caagauggugugugaugug

SEQ ID NO: 203415 - RNA, 19 nt, Homo sapiens
uguaagacacacagccuuu

SEQ ID NO: 203416 - RNA, 19 nt, Homo sapiens
acugaccucuuguccugua

SEQ ID NO: 203417 - RNA, 19 nt, Homo sapiens
caagcacaauuugaaagca

SEQ ID NO: 203418 - RNA, 19 nt, Homo sapiens
cacggacucuuugcuguug

SEQ ID NO: 203419 - RNA, 19 nt, Homo sapiens
gaauacacaggccccaaua

SEQ ID NO: 203420 - RNA, 19 nt, Homo sapiens
gacuccaucuguaacaaca

SEQ ID NO: 203421 - RNA, 19 nt, Homo sapiens
ggcaucgaauauggugaua

SEQ ID NO: 203422 - RNA, 19 nt, Homo sapiens
ucgaauauggugauaagga

SEQ ID NO: 203423 - RNA, 19 nt, Homo sapiens
ggcuuguacugaccucuug

SEQ ID NO: 203424 - RNA, 19 nt, Homo sapiens
gggcugcggcuuguacuga

SEQ ID NO: 203425 - RNA, 19 nt, Homo sapiens
aaagcaccauugugaagca

SEQ ID NO: 203426 - RNA, 19 nt, Homo sapiens
agacgcagccgccuacauc

SEQ ID NO: 203427 - RNA, 19 nt, Homo sapiens
aucgauaccuccaucauuc

SEQ ID NO: 203428 - RNA, 19 nt, Homo sapiens
ccacagggaucaucgaaua

SEQ ID NO: 203429 - RNA, 19 nt, Homo sapiens
ccacagaguuugaguaaau

SEQ ID NO: 203430 - RNA, 19 nt, Homo sapiens
caauaaggcucaugcacaa

SEQ ID NO: 203431 - RNA, 19 nt, Homo sapiens
gcaacaagaugugcuuaga

SEQ ID NO: 203432 - RNA, 19 nt, Homo sapiens
acaauuaguucgagaaguu

SEQ ID NO: 203433 - RNA, 19 nt, Homo sapiens
gcaaggcucucuuuagaac

SEQ ID NO: 203434 - RNA, 19 nt, Homo sapiens
aagcaaggcucucuuuaga

SEQ ID NO: 203435 - RNA, 19 nt, Homo sapiens
uaaggcucaugcacaauua

SEQ ID NO: 203436 - RNA, 19 nt, Homo sapiens
ggagagaguggcaagagua

SEQ ID NO: 203437 - RNA, 19 nt, Homo sapiens
uaguagcgcuuagugaaua

SEQ ID NO: 203438 - RNA, 19 nt, Homo sapiens
uuccagaacuccucgguua

SEQ ID NO: 203439 - RNA, 19 nt, Homo sapiens
cgacgagaauaucaauuau

SEQ ID NO: 203440 - RNA, 19 nt, Homo sapiens
uggagaaggugucugcuuu

SEQ ID NO: 203441 - RNA, 19 nt, Homo sapiens
gcacauuuccucucuaucu

SEQ ID NO: 203442 - RNA, 19 nt, Homo sapiens
gaacccagacagugacaaa

SEQ ID NO: 203443 - RNA, 19 nt, Homo sapiens
gaaaauggauacacugcuu

SEQ ID NO: 203444 - RNA, 19 nt, Homo sapiens
ggacuguauuucuguggaa

SEQ ID NO: 203445 - RNA, 19 nt, Homo sapiens
ggccaaaggucagagagaa

SEQ ID NO: 203446 - RNA, 19 nt, Homo sapiens
acaaguaugagcacaauaa

SEQ ID NO: 203447 - RNA, 19 nt, Homo sapiens
aggcaaaccuugugacuca

SEQ ID NO: 203448 - RNA, 19 nt, Homo sapiens
gagcguguccacagaguuu

SEQ ID NO: 203449 - RNA, 19 nt, Homo sapiens
aaucauguauucccaucua

SEQ ID NO: 203450 - RNA, 19 nt, Homo sapiens
uaucugacucuaccaaaua

SEQ ID NO: 203451 - RNA, 19 nt, Homo sapiens
aacagaggaugcugaagua

SEQ ID NO: 203452 - RNA, 19 nt, Homo sapiens
cagcacauuuccucucuau

SEQ ID NO: 203453 - RNA, 19 nt, Homo sapiens
guacagucccagcacauuu

SEQ ID NO: 203454 - RNA, 19 nt, Homo sapiens
gaaaaugucaccucuauca

SEQ ID NO: 203455 - RNA, 19 nt, Homo sapiens
gagaauccauauguagaug

SEQ ID NO: 203456 - RNA, 19 nt, Homo sapiens
gcaagaguacguuuaucaa

SEQ ID NO: 203457 - RNA, 19 nt, Homo sapiens
ugucaccucuaucauguuu

SEQ ID NO: 203458 - RNA, 19 nt, Homo sapiens
cacaagagggacuguauuu

SEQ ID NO: 203459 - RNA, 19 nt, Homo sapiens
caagaugugcuuagaguuc

SEQ ID NO: 203460 - RNA, 19 nt, Homo sapiens
ccaggcagcccgagaauuc

SEQ ID NO: 203461 - RNA, 19 nt, Homo sapiens
gauacucugaugaagauaa

SEQ ID NO: 203462 - RNA, 19 nt, Homo sapiens
cacagaguuugaguaaaua

SEQ ID NO: 203463 - RNA, 19 nt, Homo sapiens
cgaauaccccuuugacuua

SEQ ID NO: 203464 - RNA, 19 nt, Homo sapiens
acgacgagaauaucaauua

SEQ ID NO: 203465 - RNA, 19 nt, Homo sapiens
caagagggacuguauuucu

SEQ ID NO: 203466 - RNA, 19 nt, Homo sapiens
ccaagcugguguaucagaa

SEQ ID NO: 203467 - RNA, 19 nt, Homo sapiens
guacguuuaucaagcagau

SEQ ID NO: 203468 - RNA, 19 nt, Homo sapiens
aaacagaggaugcugaagu

SEQ ID NO: 203469 - RNA, 19 nt, Homo sapiens
gucaugcacucacaaagau

SEQ ID NO: 203470 - RNA, 19 nt, Homo sapiens
ucgacuacuucccagaaua

SEQ ID NO: 203471 - RNA, 19 nt, Homo sapiens
gaauccauauguagaugca

SEQ ID NO: 203472 - RNA, 19 nt, Homo sapiens
ucaagaucccauacaagua

SEQ ID NO: 203473 - RNA, 19 nt, Homo sapiens
ugaauaugaucaaguucug

SEQ ID NO: 203474 - RNA, 19 nt, Homo sapiens
ggcaagaguacguuuauca

SEQ ID NO: 203475 - RNA, 19 nt, Homo sapiens
uaugauagacgacgagaau

SEQ ID NO: 203476 - RNA, 19 nt, Homo sapiens
guagaugcaauaaagaguu

SEQ ID NO: 203477 - RNA, 19 nt, Homo sapiens
cgacuacuucccagaauau

SEQ ID NO: 203478 - RNA, 19 nt, Homo sapiens
guccacagaguuugaguaa

SEQ ID NO: 203479 - RNA, 19 nt, Homo sapiens
gaacuccucgguuauucug

SEQ ID NO: 203480 - RNA, 19 nt, Homo sapiens
ccagaacuccucgguuauu

SEQ ID NO: 203481 - RNA, 19 nt, Homo sapiens
cggaggcacuuuggaagaa

SEQ ID NO: 203482 - RNA, 19 nt, Homo sapiens
aaugucaccucuaucaugu

SEQ ID NO: 203483 - RNA, 19 nt, Homo sapiens
aggauacucugaugaagau

SEQ ID NO: 203484 - RNA, 19 nt, Homo sapiens
ucuaucauguuucuaguag

SEQ ID NO: 203485 - RNA, 19 nt, Homo sapiens
aacaagaugugcuuagagu

SEQ ID NO: 203486 - RNA, 19 nt, Homo sapiens
ugauagacgacgagaauau

SEQ ID NO: 203487 - RNA, 19 nt, Homo sapiens
ggaggcacuuuggaagaau

SEQ ID NO: 203488 - RNA, 19 nt, Homo sapiens
ggugggcuauugaagauac

SEQ ID NO: 203489 - RNA, 19 nt, Homo sapiens
gagcgaggaggccaaggaa

SEQ ID NO: 203490 - RNA, 19 nt, Homo sapiens
cagaacuccucgguuauuc

SEQ ID NO: 203491 - RNA, 19 nt, Homo sapiens
auccaggaaugcuaugaua

SEQ ID NO: 203492 - RNA, 19 nt, Homo sapiens
gaaggugucugcuuuugag

SEQ ID NO: 203493 - RNA, 19 nt, Homo sapiens
gcucaugcacaauuaguuc

SEQ ID NO: 203494 - RNA, 19 nt, Homo sapiens
gaggcacuuuggaagaaug

SEQ ID NO: 203495 - RNA, 19 nt, Homo sapiens
ccaaaggucagagagaaga

SEQ ID NO: 203496 - RNA, 19 nt, Homo sapiens
cacauuuccucucuaucuu

SEQ ID NO: 203497 - RNA, 19 nt, Homo sapiens
aagagggacuguauuucug

SEQ ID NO: 203498 - RNA, 19 nt, Homo sapiens
agaguacguuuaucaagca

SEQ ID NO: 203499 - RNA, 19 nt, Homo sapiens
gcucucuuuagaacaauua

SEQ ID NO: 203500 - RNA, 19 nt, Homo sapiens
gagaaguugauguggagaa

SEQ ID NO: 203501 - RNA, 19 nt, Homo sapiens
gcacaauuaguucgagaag

SEQ ID NO: 203502 - RNA, 19 nt, Homo sapiens
auaccucccuccugauguu

SEQ ID NO: 203503 - RNA, 19 nt, Homo sapiens
aaggcucucuuuagaacaa

SEQ ID NO: 203504 - RNA, 19 nt, Homo sapiens
ucaccucuaucauguuucu

SEQ ID NO: 203505 - RNA, 19 nt, Homo sapiens
caagaguacguuuaucaag

SEQ ID NO: 203506 - RNA, 19 nt, Homo sapiens
caggauacucugaugaaga

SEQ ID NO: 203507 - RNA, 19 nt, Homo sapiens
caugcacucacaaagauaa

SEQ ID NO: 203508 - RNA, 19 nt, Homo sapiens
ucuaguagcgcuuagugaa

SEQ ID NO: 203509 - RNA, 19 nt, Homo sapiens
aaaugucaccucuaucaug

SEQ ID NO: 203510 - RNA, 19 nt, Homo sapiens
gagaaggugucugcuuuug

SEQ ID NO: 203511 - RNA, 19 nt, Homo sapiens
cagcggaggcacuuuggaa

SEQ ID NO: 203512 - RNA, 19 nt, Homo sapiens
cacucaagaucccauacaa

SEQ ID NO: 203513 - RNA, 19 nt, Homo sapiens
gaucaucgaauaccccuuu

SEQ ID NO: 203514 - RNA, 19 nt, Homo sapiens
uauugaagauacacaagag

SEQ ID NO: 203515 - RNA, 19 nt, Homo sapiens
gcggaggcacuuuggaaga

SEQ ID NO: 203516 - RNA, 19 nt, Homo sapiens
caacaagaugugcuuagag

SEQ ID NO: 203517 - RNA, 19 nt, Homo sapiens
gagaaccgaauggaggaaa

SEQ ID NO: 203518 - RNA, 19 nt, Homo sapiens
auaaggcucaugcacaauu

SEQ ID NO: 203519 - RNA, 19 nt, Homo sapiens
caaagugucauuuucagaa

SEQ ID NO: 203520 - RNA, 19 nt, Homo sapiens
gcaaaacaaagcugauuuc

SEQ ID NO: 203521 - RNA, 19 nt, Homo sapiens
ccagcacauuuccucucua

SEQ ID NO: 203522 - RNA, 19 nt, Homo sapiens
agaggaugcugaaguacag

SEQ ID NO: 203523 - RNA, 19 nt, Homo sapiens
acacaagagggacuguauu

SEQ ID NO: 203524 - RNA, 19 nt, Homo sapiens
ggaccugaacccagacagu

SEQ ID NO: 203525 - RNA, 19 nt, Homo sapiens
ggagucagacaaugagaac

SEQ ID NO: 203526 - RNA, 19 nt, Homo sapiens
uuaucugacucuaccaaau

SEQ ID NO: 203527 - RNA, 19 nt, Homo sapiens
ccagacagugacaaaauua

SEQ ID NO: 203528 - RNA, 19 nt, Homo sapiens
ggacuacuuuccagaauuu

SEQ ID NO: 203529 - RNA, 19 nt, Homo sapiens
gaaaguccuugcugggaaa

SEQ ID NO: 203530 - RNA, 19 nt, Homo sapiens
gcaaguggauccagugcuu

SEQ ID NO: 203531 - RNA, 19 nt, Homo sapiens
gaagauugaggacuacuuu

SEQ ID NO: 203532 - RNA, 19 nt, Homo sapiens
gagaugaguuucugaggau

SEQ ID NO: 203533 - RNA, 19 nt, Homo sapiens
ugacuucccucccgaauuc

SEQ ID NO: 203534 - RNA, 19 nt, Homo sapiens
gaacgugccugacuuugac

SEQ ID NO: 203535 - RNA, 19 nt, Homo sapiens
agaagcagcugcagaagga

SEQ ID NO: 203536 - RNA, 19 nt, Homo sapiens
gcaugcaccuucgucagua

SEQ ID NO: 203537 - RNA, 19 nt, Homo sapiens
aaacguaauuguacaagca

SEQ ID NO: 203538 - RNA, 19 nt, Homo sapiens
cauagggcaugauuaacaa

SEQ ID NO: 203539 - RNA, 19 nt, Homo sapiens
cagcagcagcaaacaaaua

SEQ ID NO: 203540 - RNA, 19 nt, Homo sapiens
guaauuguacaagcaguua

SEQ ID NO: 203541 - RNA, 19 nt, Homo sapiens
ugaggauccugcauguuaa

SEQ ID NO: 203542 - RNA, 19 nt, Homo sapiens
gaggacuacuuuccagaau

SEQ ID NO: 203543 - RNA, 19 nt, Homo sapiens
gaugaacgugccugacuuu

SEQ ID NO: 203544 - RNA, 19 nt, Homo sapiens
caaagugcaggacaucaaa

SEQ ID NO: 203545 - RNA, 19 nt, Homo sapiens
caaccaaagugcaggacau

SEQ ID NO: 203546 - RNA, 19 nt, Homo sapiens
gguaaaagcaccauuguga

SEQ ID NO: 203547 - RNA, 19 nt, Homo sapiens
ccugacuucuggaaucuuu

SEQ ID NO: 203548 - RNA, 19 nt, Homo sapiens
ugaaagaggcgauugaaac

SEQ ID NO: 203549 - RNA, 19 nt, Homo sapiens
augaggauccugcauguua

SEQ ID NO: 203550 - RNA, 19 nt, Homo sapiens
gagaugggcgucacuacug

SEQ ID NO: 203551 - RNA, 19 nt, Homo sapiens
gcugggugcuggagaaucu

SEQ ID NO: 203552 - RNA, 19 nt, Homo sapiens
gacuacauccugaguguga

SEQ ID NO: 203553 - RNA, 19 nt, Homo sapiens
gaauuugcucgcuacacua

SEQ ID NO: 203554 - RNA, 19 nt, Homo sapiens
ccauagggcaugauuaaca

SEQ ID NO: 203555 - RNA, 19 nt, Homo sapiens
gcaccauugugaagcagau

SEQ ID NO: 203556 - RNA, 19 nt, Homo sapiens
gggcaugauuaacaaagca

SEQ ID NO: 203557 - RNA, 19 nt, Homo sapiens
caacgaguaccagcugauu

SEQ ID NO: 203558 - RNA, 19 nt, Homo sapiens
ccaaagugcaggacaucaa

SEQ ID NO: 203559 - RNA, 19 nt, Homo sapiens
gcugcugggugcuggagaa

SEQ ID NO: 203560 - RNA, 19 nt, Homo sapiens
gaaagaggcgauugaaacc

SEQ ID NO: 203561 - RNA, 19 nt, Homo sapiens
agaauuugcucgcuacacu

SEQ ID NO: 203562 - RNA, 19 nt, Homo sapiens
ugaacgugccugacuuuga

SEQ ID NO: 203563 - RNA, 19 nt, Homo sapiens
ugaugaacgugccugacuu

SEQ ID NO: 203564 - RNA, 19 nt, Homo sapiens
aaacagcagcagcaaacaa

SEQ ID NO: 203565 - RNA, 19 nt, Homo sapiens
cagcagcagcuacaacaug

SEQ ID NO: 203566 - RNA, 19 nt, Homo sapiens
ucgagaagcagcugcagaa

SEQ ID NO: 203567 - RNA, 19 nt, Homo sapiens
ugagaaggcaaccaaagug

SEQ ID NO: 203568 - RNA, 19 nt, Homo sapiens
agaugaggauccugcaugu

SEQ ID NO: 203569 - RNA, 19 nt, Homo sapiens
ggagaugggcgucacuacu

SEQ ID NO: 203570 - RNA, 19 nt, Homo sapiens
aggacuacuuuccagaauu

SEQ ID NO: 203571 - RNA, 19 nt, Homo sapiens
aaagcaccauugugaagca

SEQ ID NO: 203572 - RNA, 19 nt, Homo sapiens
uggacuacauccugagugu

SEQ ID NO: 203573 - RNA, 19 nt, Homo sapiens
aagaggcgauugaaaccau

SEQ ID NO: 203574 - RNA, 19 nt, Homo sapiens
gcagcagcaaacaaauaaa

SEQ ID NO: 203575 - RNA, 19 nt, Homo sapiens
ugaggacuacuuuccagaa

SEQ ID NO: 203576 - RNA, 19 nt, Homo sapiens
guucagaguggacuacauc

SEQ ID NO: 203577 - RNA, 19 nt, Homo sapiens
aacagcagcagcaaacaaa

SEQ ID NO: 203578 - RNA, 19 nt, Homo sapiens
cuacugcuacccucauuuc

SEQ ID NO: 203579 - RNA, 19 nt, Homo sapiens
ugacugccaucaucuucgu

SEQ ID NO: 203580 - RNA, 19 nt, Homo sapiens
ugacuucuggaaucuuuga

SEQ ID NO: 203581 - RNA, 19 nt, Homo sapiens
uguccugacuucuggaauc

SEQ ID NO: 203582 - RNA, 19 nt, Homo sapiens
acgaguaccagcugauuga

SEQ ID NO: 203583 - RNA, 19 nt, Homo sapiens
gcuacgaacgcuccaacga

SEQ ID NO: 203584 - RNA, 19 nt, Homo sapiens
auuguguugugcagcauua

SEQ ID NO: 203585 - RNA, 19 nt, Homo sapiens
gcagcgugaggccaacaaa

SEQ ID NO: 203586 - RNA, 19 nt, Homo sapiens
gcgaugaacgccgcaagug

SEQ ID NO: 203587 - RNA, 19 nt, Homo sapiens
agucaacuuccacauguuu

SEQ ID NO: 203588 - RNA, 19 nt, Homo sapiens
agcagcagcaaacaaauaa

SEQ ID NO: 203589 - RNA, 19 nt, Homo sapiens
gaugaguuucugaggauca

SEQ ID NO: 203590 - RNA, 19 nt, Homo sapiens
gggaggacaaccagaccaa

SEQ ID NO: 203591 - RNA, 19 nt, Homo sapiens
gaaucuuugagaccaaguu

SEQ ID NO: 203592 - RNA, 19 nt, Homo sapiens
uggacaagaucgacgugau

SEQ ID NO: 203593 - RNA, 19 nt, Homo sapiens
gaggauccugcauguuaau

SEQ ID NO: 203594 - RNA, 19 nt, Homo sapiens
gauccagugcuucaacgau

SEQ ID NO: 203595 - RNA, 19 nt, Homo sapiens
agaaggacaagcaggucua

SEQ ID NO: 203596 - RNA, 19 nt, Homo sapiens
gcagcaaacaaauaaaaug

SEQ ID NO: 203597 - RNA, 19 nt, Homo sapiens
gugaaacguaauuguacaa

SEQ ID NO: 203598 - RNA, 19 nt, Homo sapiens
ccaucucugugauccuguu

SEQ ID NO: 203599 - RNA, 19 nt, Homo sapiens
gccagcagcagcuacaaca

SEQ ID NO: 203600 - RNA, 19 nt, Homo sapiens
cacuacugcuacccucauu

SEQ ID NO: 203601 - RNA, 19 nt, Homo sapiens
gcaccucucucgagucuua

SEQ ID NO: 203602 - RNA, 19 nt, Homo sapiens
ggacuacuuuccagaauuu

SEQ ID NO: 203603 - RNA, 19 nt, Homo sapiens
gaaaguccuugcugggaaa

SEQ ID NO: 203604 - RNA, 19 nt, Homo sapiens
gcaaguggauccagugcuu

SEQ ID NO: 203605 - RNA, 19 nt, Homo sapiens
gaagauugaggacuacuuu

SEQ ID NO: 203606 - RNA, 19 nt, Homo sapiens
gagaugaguuucugaggau

SEQ ID NO: 203607 - RNA, 19 nt, Homo sapiens
ugacuucccucccgaauuc

SEQ ID NO: 203608 - RNA, 19 nt, Homo sapiens
gaacgugccugacuuugac

SEQ ID NO: 203609 - RNA, 19 nt, Homo sapiens
ggauucaggugcuggagaa

SEQ ID NO: 203610 - RNA, 19 nt, Homo sapiens
gcgccgagcucgccauaau

SEQ ID NO: 203611 - RNA, 19 nt, Homo sapiens
gcaugcaccuucgucagua

SEQ ID NO: 203612 - RNA, 19 nt, Homo sapiens
guucuuaaguggucaggaa

SEQ ID NO: 203613 - RNA, 19 nt, Homo sapiens
gccgagcucgccauaauua

SEQ ID NO: 203614 - RNA, 19 nt, Homo sapiens
aaacguaauuguacaagca

SEQ ID NO: 203615 - RNA, 19 nt, Homo sapiens
cauagggcaugauuaacaa

SEQ ID NO: 203616 - RNA, 19 nt, Homo sapiens
agacagaacuuuccccuuu

SEQ ID NO: 203617 - RNA, 19 nt, Homo sapiens
cagcagcagcaaacaaaua

SEQ ID NO: 203618 - RNA, 19 nt, Homo sapiens
guaauuguacaagcaguua

SEQ ID NO: 203619 - RNA, 19 nt, Homo sapiens
ugaggauccugcauguuaa

SEQ ID NO: 203620 - RNA, 19 nt, Homo sapiens
gaggacuacuuuccagaau

SEQ ID NO: 203621 - RNA, 19 nt, Homo sapiens
gaugaacgugccugacuuu

SEQ ID NO: 203622 - RNA, 19 nt, Homo sapiens
caaagugcaggacaucaaa

SEQ ID NO: 203623 - RNA, 19 nt, Homo sapiens
caaccaaagugcaggacau

SEQ ID NO: 203624 - RNA, 19 nt, Homo sapiens
gaccgagccugaagacgau

SEQ ID NO: 203625 - RNA, 19 nt, Homo sapiens
gccagcuucucaccucaua

SEQ ID NO: 203626 - RNA, 19 nt, Homo sapiens
gcagugagaaggcaaccaa

SEQ ID NO: 203627 - RNA, 19 nt, Homo sapiens
ccucauaggguguaccuuu

SEQ ID NO: 203628 - RNA, 19 nt, Homo sapiens
gguaaaagcaccauuguga

SEQ ID NO: 203629 - RNA, 19 nt, Homo sapiens
ccugacuucuggaaucuuu

SEQ ID NO: 203630 - RNA, 19 nt, Homo sapiens
ugaaagaggcgauugaaac

SEQ ID NO: 203631 - RNA, 19 nt, Homo sapiens
augaggauccugcauguua

SEQ ID NO: 203632 - RNA, 19 nt, Homo sapiens
gagaugggcgucacuacug

SEQ ID NO: 203633 - RNA, 19 nt, Homo sapiens
gacuacauccugaguguga

SEQ ID NO: 203634 - RNA, 19 nt, Homo sapiens
gaauuugcucgcuacacua

SEQ ID NO: 203635 - RNA, 19 nt, Homo sapiens
gcucaagcccgaggacaaa

SEQ ID NO: 203636 - RNA, 19 nt, Homo sapiens
ccauagggcaugauuaaca

SEQ ID NO: 203637 - RNA, 19 nt, Homo sapiens
gcaccauugugaagcagau

SEQ ID NO: 203638 - RNA, 19 nt, Homo sapiens
guccagauucuccuuguuu

SEQ ID NO: 203639 - RNA, 19 nt, Homo sapiens
gggcaugauuaacaaagca

SEQ ID NO: 203640 - RNA, 19 nt, Homo sapiens
caacgaguaccagcugauu

SEQ ID NO: 203641 - RNA, 19 nt, Homo sapiens
ccaaagugcaggacaucaa

SEQ ID NO: 203642 - RNA, 19 nt, Homo sapiens
ucugcacgcucucaaguug

SEQ ID NO: 203643 - RNA, 19 nt, Homo sapiens
aggaagaguucgacuacga

SEQ ID NO: 203644 - RNA, 19 nt, Homo sapiens
gcacgaggaggcagaccuu

SEQ ID NO: 203645 - RNA, 19 nt, Homo sapiens
gagcucgccauaauuacaa

SEQ ID NO: 203646 - RNA, 19 nt, Homo sapiens
gaaagaggcgauugaaacc

SEQ ID NO: 203647 - RNA, 19 nt, Homo sapiens
agaauuugcucgcuacacu

SEQ ID NO: 203648 - RNA, 19 nt, Homo sapiens
ugaacgugccugacuuuga

SEQ ID NO: 203649 - RNA, 19 nt, Homo sapiens
ugaugaacgugccugacuu

SEQ ID NO: 203650 - RNA, 19 nt, Homo sapiens
aaacagcagcagcaaacaa

SEQ ID NO: 203651 - RNA, 19 nt, Homo sapiens
gggaggagacagaacuuuc

SEQ ID NO: 203652 - RNA, 19 nt, Homo sapiens
cagcagcagcuacaacaug

SEQ ID NO: 203653 - RNA, 19 nt, Homo sapiens
gacagaacuuuccccuuuu

SEQ ID NO: 203654 - RNA, 19 nt, Homo sapiens
ugagaaggcaaccaaagug

SEQ ID NO: 203655 - RNA, 19 nt, Homo sapiens
agaugaggauccugcaugu

SEQ ID NO: 203656 - RNA, 19 nt, Homo sapiens
ggagaugggcgucacuacu

SEQ ID NO: 203657 - RNA, 19 nt, Homo sapiens
aggacuacuuuccagaauu

SEQ ID NO: 203658 - RNA, 19 nt, Homo sapiens
uggacuacauccugagugu

SEQ ID NO: 203659 - RNA, 19 nt, Homo sapiens
aagaggcgauugaaaccau

SEQ ID NO: 203660 - RNA, 19 nt, Homo sapiens
gugagaaggcaaccaaagu

SEQ ID NO: 203661 - RNA, 19 nt, Homo sapiens
aaagcaccauugugaagca

SEQ ID NO: 203662 - RNA, 19 nt, Homo sapiens
gcagcagcaaacaaauaaa

SEQ ID NO: 203663 - RNA, 19 nt, Homo sapiens
cauccggcgucacuaaugg

SEQ ID NO: 203664 - RNA, 19 nt, Homo sapiens
cgaggaagaguucgacuac

SEQ ID NO: 203665 - RNA, 19 nt, Homo sapiens
ugaggacuacuuuccagaa

SEQ ID NO: 203666 - RNA, 19 nt, Homo sapiens
guucagaguggacuacauc

SEQ ID NO: 203667 - RNA, 19 nt, Homo sapiens
aacagcagcagcaaacaaa

SEQ ID NO: 203668 - RNA, 19 nt, Homo sapiens
cuacugcuacccucauuuc

SEQ ID NO: 203669 - RNA, 19 nt, Homo sapiens
ugacugccaucaucuucgu

SEQ ID NO: 203670 - RNA, 19 nt, Homo sapiens
ugacuucuggaaucuuuga

SEQ ID NO: 203671 - RNA, 19 nt, Homo sapiens
uguccugacuucuggaauc

SEQ ID NO: 203672 - RNA, 19 nt, Homo sapiens
acgaguaccagcugauuga

SEQ ID NO: 203673 - RNA, 19 nt, Homo sapiens
gcuacgaacgcuccaacga

SEQ ID NO: 203674 - RNA, 19 nt, Homo sapiens
auuguguugugcagcauua

SEQ ID NO: 203675 - RNA, 19 nt, Homo sapiens
uagaguacgaggaagaguu

SEQ ID NO: 203676 - RNA, 19 nt, Homo sapiens
gcgaugaacgccgcaagug

SEQ ID NO: 203677 - RNA, 19 nt, Homo sapiens
agucaacuuccacauguuu

SEQ ID NO: 203678 - RNA, 19 nt, Homo sapiens
agcagcagcaaacaaauaa

SEQ ID NO: 203679 - RNA, 19 nt, Homo sapiens
gaugaguuucugaggauca

SEQ ID NO: 203680 - RNA, 19 nt, Homo sapiens
gggaggacaaccagaccaa

SEQ ID NO: 203681 - RNA, 19 nt, Homo sapiens
gaaucuuugagaccaaguu

SEQ ID NO: 203682 - RNA, 19 nt, Homo sapiens
uggacaagaucgacgugau

SEQ ID NO: 203683 - RNA, 19 nt, Homo sapiens
gaggauccugcauguuaau

SEQ ID NO: 203684 - RNA, 19 nt, Homo sapiens
gauccagugcuucaacgau

SEQ ID NO: 203685 - RNA, 19 nt, Homo sapiens
gugccuagaguacgaggaa

SEQ ID NO: 203686 - RNA, 19 nt, Homo sapiens
gcagcaaacaaauaaaaug

SEQ ID NO: 203687 - RNA, 19 nt, Homo sapiens
gugaaacguaauuguacaa

SEQ ID NO: 203688 - RNA, 19 nt, Homo sapiens
ccaucucugugauccuguu

SEQ ID NO: 203689 - RNA, 19 nt, Homo sapiens
gccagcagcagcuacaaca

SEQ ID NO: 203690 - RNA, 19 nt, Homo sapiens
cgagaccgaguccgaaauc

SEQ ID NO: 203691 - RNA, 19 nt, Homo sapiens
ggugugugccuaagaggau

SEQ ID NO: 203692 - RNA, 19 nt, Homo sapiens
gcaacagcgauggcaguga

SEQ ID NO: 203693 - RNA, 19 nt, Homo sapiens
cacuacugcuacccucauu

SEQ ID NO: 203694 - RNA, 19 nt, Homo sapiens
cgagcucgccauaauuaca

SEQ ID NO: 203695 - RNA, 19 nt, Homo sapiens
ggacuacuuuccagaauuu

SEQ ID NO: 203696 - RNA, 19 nt, Homo sapiens
gcaguaagcucaucgacaa

SEQ ID NO: 203697 - RNA, 19 nt, Homo sapiens
gaaaguccuugcugggaaa

SEQ ID NO: 203698 - RNA, 19 nt, Homo sapiens
gcaaguggauccagugcuu

SEQ ID NO: 203699 - RNA, 19 nt, Homo sapiens
gcagacagaugcgcaaaga

SEQ ID NO: 203700 - RNA, 19 nt, Homo sapiens
gaagauugaggacuacuuu

SEQ ID NO: 203701 - RNA, 19 nt, Homo sapiens
gcaaagaagcccuggagaa

SEQ ID NO: 203702 - RNA, 19 nt, Homo sapiens
gcagucaacuucucuuaca

SEQ ID NO: 203703 - RNA, 19 nt, Homo sapiens
gagaugaguuucugaggau

SEQ ID NO: 203704 - RNA, 19 nt, Homo sapiens
ugacuucccucccgaauuc

SEQ ID NO: 203705 - RNA, 19 nt, Homo sapiens
gaacgugccugacuuugac

SEQ ID NO: 203706 - RNA, 19 nt, Homo sapiens
caacuuacuccgcaacuuu

SEQ ID NO: 203707 - RNA, 19 nt, Homo sapiens
ggaggaagcagcagagaug

SEQ ID NO: 203708 - RNA, 19 nt, Homo sapiens
agaagaagcuaugcccuuu

SEQ ID NO: 203709 - RNA, 19 nt, Homo sapiens
gcaugcaccuucgucagua

SEQ ID NO: 203710 - RNA, 19 nt, Homo sapiens
gcagagaagaaacgcagua

SEQ ID NO: 203711 - RNA, 19 nt, Homo sapiens
aaacguaauuguacaagca

SEQ ID NO: 203712 - RNA, 19 nt, Homo sapiens
cauagggcaugauuaacaa

SEQ ID NO: 203713 - RNA, 19 nt, Homo sapiens
cagcagcagcaaacaaaua

SEQ ID NO: 203714 - RNA, 19 nt, Homo sapiens
aagaagcuaugcccuuuga

SEQ ID NO: 203715 - RNA, 19 nt, Homo sapiens
guaauuguacaagcaguua

SEQ ID NO: 203716 - RNA, 19 nt, Homo sapiens
ugaggauccugcauguuaa

SEQ ID NO: 203717 - RNA, 19 nt, Homo sapiens
gcuaugcccuuugaguuug

SEQ ID NO: 203718 - RNA, 19 nt, Homo sapiens
gaggacuacuuuccagaau

SEQ ID NO: 203719 - RNA, 19 nt, Homo sapiens
auacagcccuccaccagaa

SEQ ID NO: 203720 - RNA, 19 nt, Homo sapiens
caaagaagcccuggagaag

SEQ ID NO: 203721 - RNA, 19 nt, Homo sapiens
gaugaacgugccugacuuu

SEQ ID NO: 203722 - RNA, 19 nt, Homo sapiens
caaagugcaggacaucaaa

SEQ ID NO: 203723 - RNA, 19 nt, Homo sapiens
caaccaaagugcaggacau

SEQ ID NO: 203724 - RNA, 19 nt, Homo sapiens
ggaagcagcagagauggaa

SEQ ID NO: 203725 - RNA, 19 nt, Homo sapiens
gcaacuuacuccgcaacuu

SEQ ID NO: 203726 - RNA, 19 nt, Homo sapiens
gguaaaagcaccauuguga

SEQ ID NO: 203727 - RNA, 19 nt, Homo sapiens
ugaggagacuaugccauuu

SEQ ID NO: 203728 - RNA, 19 nt, Homo sapiens
ccugacuucuggaaucuuu

SEQ ID NO: 203729 - RNA, 19 nt, Homo sapiens
ugaaagaggcgauugaaac

SEQ ID NO: 203730 - RNA, 19 nt, Homo sapiens
augaggauccugcauguua

SEQ ID NO: 203731 - RNA, 19 nt, Homo sapiens
gagaagaaacgcaguaagc

SEQ ID NO: 203732 - RNA, 19 nt, Homo sapiens
gaagcgcgcagagaagaaa

SEQ ID NO: 203733 - RNA, 19 nt, Homo sapiens
cagagaggcugcagucaac

SEQ ID NO: 203734 - RNA, 19 nt, Homo sapiens
gaagaagcuaugcccuuug

SEQ ID NO: 203735 - RNA, 19 nt, Homo sapiens
gaagcuaugcccuuugagu

SEQ ID NO: 203736 - RNA, 19 nt, Homo sapiens
ugaccagccugcccagaga

SEQ ID NO: 203737 - RNA, 19 nt, Homo sapiens
gagaugggcgucacuacug

SEQ ID NO: 203738 - RNA, 19 nt, Homo sapiens
gacuacauccugaguguga

SEQ ID NO: 203739 - RNA, 19 nt, Homo sapiens
aaagaugggcuacaugugu

SEQ ID NO: 203740 - RNA, 19 nt, Homo sapiens
gaauuugcucgcuacacua

SEQ ID NO: 203741 - RNA, 19 nt, Homo sapiens
gaggagacuaugccauuug

SEQ ID NO: 203742 - RNA, 19 nt, Homo sapiens
gaaaagaugggcuacaugu

SEQ ID NO: 203743 - RNA, 19 nt, Homo sapiens
ccauagggcaugauuaaca

SEQ ID NO: 203744 - RNA, 19 nt, Homo sapiens
gcaccauugugaagcagau

SEQ ID NO: 203745 - RNA, 19 nt, Homo sapiens
guaagcucaucgacaaaca

SEQ ID NO: 203746 - RNA, 19 nt, Homo sapiens
gaaacgcaguaagcucauc

SEQ ID NO: 203747 - RNA, 19 nt, Homo sapiens
gggcaugauuaacaaagca

SEQ ID NO: 203748 - RNA, 19 nt, Homo sapiens
caacgaguaccagcugauu

SEQ ID NO: 203749 - RNA, 19 nt, Homo sapiens
ccaaagugcaggacaucaa

SEQ ID NO: 203750 - RNA, 19 nt, Homo sapiens
ccagagaggcugcagucaa

SEQ ID NO: 203751 - RNA, 19 nt, Homo sapiens
gaaagaggcgauugaaacc

SEQ ID NO: 203752 - RNA, 19 nt, Homo sapiens
ggagaagcgcagacagaug

SEQ ID NO: 203753 - RNA, 19 nt, Homo sapiens
gcggagaagcgcagacaga

SEQ ID NO: 203754 - RNA, 19 nt, Homo sapiens
ugucagaccuccuucuaac

SEQ ID NO: 203755 - RNA, 19 nt, Homo sapiens
agaauuugcucgcuacacu

SEQ ID NO: 203756 - RNA, 19 nt, Homo sapiens
ugaacgugccugacuuuga

SEQ ID NO: 203757 - RNA, 19 nt, Homo sapiens
aggagacuaugccauuuga

SEQ ID NO: 203758 - RNA, 19 nt, Homo sapiens
gcugucagaccuccuucua

SEQ ID NO: 203759 - RNA, 19 nt, Homo sapiens
ugaugaacgugccugacuu

SEQ ID NO: 203760 - RNA, 19 nt, Homo sapiens
aaacagcagcagcaaacaa

SEQ ID NO: 203761 - RNA, 19 nt, Homo sapiens
ucuaggugcuggagaaucu

SEQ ID NO: 203762 - RNA, 19 nt, Homo sapiens
ucagaccuccuucuaacuu

SEQ ID NO: 203763 - RNA, 19 nt, Homo sapiens
cagcagcagcuacaacaug

SEQ ID NO: 203764 - RNA, 19 nt, Homo sapiens
agacagaugcgcaaagaag

SEQ ID NO: 203765 - RNA, 19 nt, Homo sapiens
ugagaaggcaaccaaagug

SEQ ID NO: 203766 - RNA, 19 nt, Homo sapiens
agaugaggauccugcaugu

SEQ ID NO: 203767 - RNA, 19 nt, Homo sapiens
aaacaacuccaggacgaaa

SEQ ID NO: 203768 - RNA, 19 nt, Homo sapiens
cagagaagaaacgcaguaa

SEQ ID NO: 203769 - RNA, 19 nt, Homo sapiens
ugagcuugauggagaagga

SEQ ID NO: 203770 - RNA, 19 nt, Homo sapiens
ggagaugggcgucacuacu

SEQ ID NO: 203771 - RNA, 19 nt, Homo sapiens
aggacuacuuuccagaauu

SEQ ID NO: 203772 - RNA, 19 nt, Homo sapiens
uggacuacauccugagugu

SEQ ID NO: 203773 - RNA, 19 nt, Homo sapiens
aagaggcgauugaaaccau

SEQ ID NO: 203774 - RNA, 19 nt, Homo sapiens
aaagcaccauugugaagca

SEQ ID NO: 203775 - RNA, 19 nt, Homo sapiens
gagaggcugcagucaacuu

SEQ ID NO: 203776 - RNA, 19 nt, Homo sapiens
cagaagcgcgcagagaaga

SEQ ID NO: 203777 - RNA, 19 nt, Homo sapiens
ccgcaacuuucucgugcaa

SEQ ID NO: 203778 - RNA, 19 nt, Homo sapiens
cgacacucccgucaacaug

SEQ ID NO: 203779 - RNA, 19 nt, Homo sapiens
gagagagcgagcagagaga

SEQ ID NO: 203780 - RNA, 19 nt, Homo sapiens
gcagcagcaaacaaauaaa

SEQ ID NO: 203781 - RNA, 19 nt, Homo sapiens
cugaggagacuaugccauu

SEQ ID NO: 203782 - RNA, 19 nt, Homo sapiens
gcucaucgacaaacaacuc

SEQ ID NO: 203783 - RNA, 19 nt, Homo sapiens
ugaggacuacuuuccagaa

SEQ ID NO: 203784 - RNA, 19 nt, Homo sapiens
guucagaguggacuacauc

SEQ ID NO: 203785 - RNA, 19 nt, Homo sapiens
aacagcagcagcaaacaaa

SEQ ID NO: 203786 - RNA, 19 nt, Homo sapiens
cagaccuccuucuaacuuc

SEQ ID NO: 203787 - RNA, 19 nt, Homo sapiens
cuacugcuacccucauuuc

SEQ ID NO: 203788 - RNA, 19 nt, Homo sapiens
ugacugccaucaucuucgu

SEQ ID NO: 203789 - RNA, 19 nt, Homo sapiens
ugacuucuggaaucuuuga

SEQ ID NO: 203790 - RNA, 19 nt, Homo sapiens
uguccugacuucuggaauc

SEQ ID NO: 203791 - RNA, 19 nt, Homo sapiens
acgaguaccagcugauuga

SEQ ID NO: 203792 - RNA, 19 nt, Homo sapiens
gcuacgaacgcuccaacga

SEQ ID NO: 203793 - RNA, 19 nt, Homo sapiens
aagcuaugcccuuugaguu

SEQ ID NO: 203794 - RNA, 19 nt, Homo sapiens
auuguguugugcagcauua

SEQ ID NO: 203795 - RNA, 19 nt, Homo sapiens
ggacuacuuuccagaauuu

SEQ ID NO: 203796 - RNA, 19 nt, Homo sapiens
gaaaguccuugcugggaaa

SEQ ID NO: 203797 - RNA, 19 nt, Homo sapiens
gcaaguggauccagugcuu

SEQ ID NO: 203798 - RNA, 19 nt, Homo sapiens
gaagauugaggacuacuuu

SEQ ID NO: 203799 - RNA, 19 nt, Homo sapiens
gagaugaguuucugaggau

SEQ ID NO: 203800 - RNA, 19 nt, Homo sapiens
ugacuucccucccgaauuc

SEQ ID NO: 203801 - RNA, 19 nt, Homo sapiens
gaacgugccugacuuugac

SEQ ID NO: 203802 - RNA, 19 nt, Homo sapiens
agaagcagcugcagaagga

SEQ ID NO: 203803 - RNA, 19 nt, Homo sapiens
gcaugcaccuucgucagua

SEQ ID NO: 203804 - RNA, 19 nt, Homo sapiens
aaacguaauuguacaagca

SEQ ID NO: 203805 - RNA, 19 nt, Homo sapiens
cauagggcaugauuaacaa

SEQ ID NO: 203806 - RNA, 19 nt, Homo sapiens
cagcagcagcaaacaaaua

SEQ ID NO: 203807 - RNA, 19 nt, Homo sapiens
guaauuguacaagcaguua

SEQ ID NO: 203808 - RNA, 19 nt, Homo sapiens
ugaggauccugcauguuaa

SEQ ID NO: 203809 - RNA, 19 nt, Homo sapiens
gaggacuacuuuccagaau

SEQ ID NO: 203810 - RNA, 19 nt, Homo sapiens
gaugaacgugccugacuuu

SEQ ID NO: 203811 - RNA, 19 nt, Homo sapiens
caaagugcaggacaucaaa

SEQ ID NO: 203812 - RNA, 19 nt, Homo sapiens
caaccaaagugcaggacau

SEQ ID NO: 203813 - RNA, 19 nt, Homo sapiens
gguaaaagcaccauuguga

SEQ ID NO: 203814 - RNA, 19 nt, Homo sapiens
ccugacuucuggaaucuuu

SEQ ID NO: 203815 - RNA, 19 nt, Homo sapiens
ugaaagaggcgauugaaac

SEQ ID NO: 203816 - RNA, 19 nt, Homo sapiens
augaggauccugcauguua

SEQ ID NO: 203817 - RNA, 19 nt, Homo sapiens
gagaugggcgucacuacug

SEQ ID NO: 203818 - RNA, 19 nt, Homo sapiens
gcugggugcuggagaaucu

SEQ ID NO: 203819 - RNA, 19 nt, Homo sapiens
gacuacauccugaguguga

SEQ ID NO: 203820 - RNA, 19 nt, Homo sapiens
gaauuugcucgcuacacua

SEQ ID NO: 203821 - RNA, 19 nt, Homo sapiens
ccauagggcaugauuaaca

SEQ ID NO: 203822 - RNA, 19 nt, Homo sapiens
gcaccauugugaagcagau

SEQ ID NO: 203823 - RNA, 19 nt, Homo sapiens
gggcaugauuaacaaagca

SEQ ID NO: 203824 - RNA, 19 nt, Homo sapiens
caacgaguaccagcugauu

SEQ ID NO: 203825 - RNA, 19 nt, Homo sapiens
ccaaagugcaggacaucaa

SEQ ID NO: 203826 - RNA, 19 nt, Homo sapiens
gcugcugggugcuggagaa

SEQ ID NO: 203827 - RNA, 19 nt, Homo sapiens
gaaagaggcgauugaaacc

SEQ ID NO: 203828 - RNA, 19 nt, Homo sapiens
agaauuugcucgcuacacu

SEQ ID NO: 203829 - RNA, 19 nt, Homo sapiens
ugaacgugccugacuuuga

SEQ ID NO: 203830 - RNA, 19 nt, Homo sapiens
ugaugaacgugccugacuu

SEQ ID NO: 203831 - RNA, 19 nt, Homo sapiens
aaacagcagcagcaaacaa

SEQ ID NO: 203832 - RNA, 19 nt, Homo sapiens
cagcagcagcuacaacaug

SEQ ID NO: 203833 - RNA, 19 nt, Homo sapiens
ucgagaagcagcugcagaa

SEQ ID NO: 203834 - RNA, 19 nt, Homo sapiens
ugagaaggcaaccaaagug

SEQ ID NO: 203835 - RNA, 19 nt, Homo sapiens
agaugaggauccugcaugu

SEQ ID NO: 203836 - RNA, 19 nt, Homo sapiens
ggagaugggcgucacuacu

SEQ ID NO: 203837 - RNA, 19 nt, Homo sapiens
aggacuacuuuccagaauu

SEQ ID NO: 203838 - RNA, 19 nt, Homo sapiens
aaagcaccauugugaagca

SEQ ID NO: 203839 - RNA, 19 nt, Homo sapiens
uggacuacauccugagugu

SEQ ID NO: 203840 - RNA, 19 nt, Homo sapiens
aagaggcgauugaaaccau

SEQ ID NO: 203841 - RNA, 19 nt, Homo sapiens
gugagaaggcaaccaaagu

SEQ ID NO: 203842 - RNA, 19 nt, Homo sapiens
gcagcagcaaacaaauaaa

SEQ ID NO: 203843 - RNA, 19 nt, Homo sapiens
ugaggacuacuuuccagaa

SEQ ID NO: 203844 - RNA, 19 nt, Homo sapiens
guucagaguggacuacauc

SEQ ID NO: 203845 - RNA, 19 nt, Homo sapiens
aacagcagcagcaaacaaa

SEQ ID NO: 203846 - RNA, 19 nt, Homo sapiens
cuacugcuacccucauuuc

SEQ ID NO: 203847 - RNA, 19 nt, Homo sapiens
ugacugccaucaucuucgu

SEQ ID NO: 203848 - RNA, 19 nt, Homo sapiens
ugacuucuggaaucuuuga

SEQ ID NO: 203849 - RNA, 19 nt, Homo sapiens
uguccugacuucuggaauc

SEQ ID NO: 203850 - RNA, 19 nt, Homo sapiens
acgaguaccagcugauuga

SEQ ID NO: 203851 - RNA, 19 nt, Homo sapiens
gcuacgaacgcuccaacga

SEQ ID NO: 203852 - RNA, 19 nt, Homo sapiens
auuguguugugcagcauua

SEQ ID NO: 203853 - RNA, 19 nt, Homo sapiens
gcagcgugaggccaacaaa

SEQ ID NO: 203854 - RNA, 19 nt, Homo sapiens
gcgaugaacgccgcaagug

SEQ ID NO: 203855 - RNA, 19 nt, Homo sapiens
agucaacuuccacauguuu

SEQ ID NO: 203856 - RNA, 19 nt, Homo sapiens
agcagcagcaaacaaauaa

SEQ ID NO: 203857 - RNA, 19 nt, Homo sapiens
gaugaguuucugaggauca

SEQ ID NO: 203858 - RNA, 19 nt, Homo sapiens
gggaggacaaccagaccaa

SEQ ID NO: 203859 - RNA, 19 nt, Homo sapiens
gaaucuuugagaccaaguu

SEQ ID NO: 203860 - RNA, 19 nt, Homo sapiens
uggacaagaucgacgugau

SEQ ID NO: 203861 - RNA, 19 nt, Homo sapiens
gaggauccugcauguuaau

SEQ ID NO: 203862 - RNA, 19 nt, Homo sapiens
agaaggacaagcaggucua

SEQ ID NO: 203863 - RNA, 19 nt, Homo sapiens
gauccagugcuucaacgau

SEQ ID NO: 203864 - RNA, 19 nt, Homo sapiens
uaauggagacagugagaag

SEQ ID NO: 203865 - RNA, 19 nt, Homo sapiens
gcagcaaacaaauaaaaug

SEQ ID NO: 203866 - RNA, 19 nt, Homo sapiens
gugaaacguaauuguacaa

SEQ ID NO: 203867 - RNA, 19 nt, Homo sapiens
ccaucucugugauccuguu

SEQ ID NO: 203868 - RNA, 19 nt, Homo sapiens
gccagcagcagcuacaaca

SEQ ID NO: 203869 - RNA, 19 nt, Homo sapiens
acagugagaaggcaaccaa

SEQ ID NO: 203870 - RNA, 19 nt, Homo sapiens
cacuacugcuacccucauu

SEQ ID NO: 203871 - RNA, 19 nt, Homo sapiens
ggagaucuauucccacaug

SEQ ID NO: 203872 - RNA, 19 nt, Homo sapiens
gaagagugccucgaguuua

SEQ ID NO: 203873 - RNA, 19 nt, Homo sapiens
gaucucaacuuccggaugu

SEQ ID NO: 203874 - RNA, 19 nt, Homo sapiens
ucaagcagaugaagauuau

SEQ ID NO: 203875 - RNA, 19 nt, Homo sapiens
ggaagagugccucgaguuu

SEQ ID NO: 203876 - RNA, 19 nt, Homo sapiens
gcacagacucagcaauaaa

SEQ ID NO: 203877 - RNA, 19 nt, Homo sapiens
gaacgucaaauuugucuuc

SEQ ID NO: 203878 - RNA, 19 nt, Homo sapiens
gaaagaggacgcugagaag

SEQ ID NO: 203879 - RNA, 19 nt, Homo sapiens
caagaccacuggcaucauc

SEQ ID NO: 203880 - RNA, 19 nt, Homo sapiens
gcacauggcagacacuauc

SEQ ID NO: 203881 - RNA, 19 nt, Homo sapiens
ucaaggagaaccucaaaga

SEQ ID NO: 203882 - RNA, 19 nt, Homo sapiens
aagagugccucgaguuuau

SEQ ID NO: 203883 - RNA, 19 nt, Homo sapiens
ugaaagaggacgcugagaa

SEQ ID NO: 203884 - RNA, 19 nt, Homo sapiens
gaagagcaccaucgucaag

SEQ ID NO: 203885 - RNA, 19 nt, Homo sapiens
cuucaaggaucucaacuuc

SEQ ID NO: 203886 - RNA, 19 nt, Homo sapiens
ucaccgacaucaucaucaa

SEQ ID NO: 203887 - RNA, 19 nt, Homo sapiens
gcacgaugcccaaggagau

SEQ ID NO: 203888 - RNA, 19 nt, Homo sapiens
caauaaaccuuugcaucag

SEQ ID NO: 203889 - RNA, 19 nt, Homo sapiens
ccaucgugcucuuccuuaa

SEQ ID NO: 203890 - RNA, 19 nt, Homo sapiens
gucaagcagaugaagauua

SEQ ID NO: 203891 - RNA, 19 nt, Homo sapiens
gagaucuauucccacauga

SEQ ID NO: 203892 - RNA, 19 nt, Homo sapiens
acgcacagacucagcaaua

SEQ ID NO: 203893 - RNA, 19 nt, Homo sapiens
acacgcagaacgucaaauu

SEQ ID NO: 203894 - RNA, 19 nt, Homo sapiens
ggcgugaccugcaucaucu

SEQ ID NO: 203895 - RNA, 19 nt, Homo sapiens
cgcagaacgucaaauuugu

SEQ ID NO: 203896 - RNA, 19 nt, Homo sapiens
caucaaggagaaccucaaa

SEQ ID NO: 203897 - RNA, 19 nt, Homo sapiens
acgcagaacgucaaauuug

SEQ ID NO: 203898 - RNA, 19 nt, Homo sapiens
cgacguccaucgugcucuu

SEQ ID NO: 203899 - RNA, 19 nt, Homo sapiens
agacgcaguucuccuucaa

SEQ ID NO: 203900 - RNA, 19 nt, Homo sapiens
ggaagagcaccaucgucaa

SEQ ID NO: 203901 - RNA, 19 nt, Homo sapiens
gcaccaucgucaagcagau

SEQ ID NO: 203902 - RNA, 19 nt, Homo sapiens
cgcacagacucagcaauaa

SEQ ID NO: 203903 - RNA, 19 nt, Homo sapiens
gcaucuguuucccggacua

SEQ ID NO: 203904 - RNA, 19 nt, Homo sapiens
gcagaacgucaaauuuguc

SEQ ID NO: 203905 - RNA, 19 nt, Homo sapiens
gaccuggagcgccugguaa

SEQ ID NO: 203906 - RNA, 19 nt, Homo sapiens
ggagaaccucaaagacugu

SEQ ID NO: 203907 - RNA, 19 nt, Homo sapiens
ggaggacgacgaagugaac

SEQ ID NO: 203908 - RNA, 19 nt, Homo sapiens
gcuaguggaggacgacgaa

SEQ ID NO: 203909 - RNA, 19 nt, Homo sapiens
ggacggguacucgcuggaa

SEQ ID NO: 203910 - RNA, 19 nt, Homo sapiens
acucagcaauaaaccuuug

SEQ ID NO: 203911 - RNA, 19 nt, Homo sapiens
agaaccaccugcucacucu

SEQ ID NO: 203912 - RNA, 19 nt, Homo sapiens
gggcgugaccugcaucauc

SEQ ID NO: 203913 - RNA, 19 nt, Homo sapiens
agaggacgcugagaaggau

SEQ ID NO: 203914 - RNA, 19 nt, Homo sapiens
ugaccacacucaacaucca

SEQ ID NO: 203915 - RNA, 19 nt, Homo sapiens
gaguuuaucgccaucaucu

SEQ ID NO: 203916 - RNA, 19 nt, Homo sapiens
cccggaagcugaugcacau

SEQ ID NO: 203917 - RNA, 19 nt, Homo sapiens
agacuguggccucuucuga

SEQ ID NO: 203918 - RNA, 19 nt, Homo sapiens
ggccagugcugaggagaag

SEQ ID NO: 203919 - RNA, 19 nt, Homo sapiens
ccacacucaacauccagua

SEQ ID NO: 203920 - RNA, 19 nt, Homo sapiens
gccaugaccacacucaaca

SEQ ID NO: 203921 - RNA, 19 nt, Homo sapiens
agacucagcaauaaaccuu

SEQ ID NO: 203922 - RNA, 19 nt, Homo sapiens
gaagaaccaccugcucacu

SEQ ID NO: 203923 - RNA, 19 nt, Homo sapiens
ugaccugcaucaucuucau

SEQ ID NO: 203924 - RNA, 19 nt, Homo sapiens
acgagagccugcaccuguu

SEQ ID NO: 203925 - RNA, 19 nt, Homo sapiens
gcaccucagcaucuguuuc

SEQ ID NO: 203926 - RNA, 19 nt, Homo sapiens
aagaggacgcugagaagga

SEQ ID NO: 203927 - RNA, 19 nt, Homo sapiens
cacgcagaacgucaaauuu

SEQ ID NO: 203928 - RNA, 19 nt, Homo sapiens
cgacacgcagaacgucaaa

SEQ ID NO: 203929 - RNA, 19 nt, Homo sapiens
gcgcaccucagcaucuguu

SEQ ID NO: 203930 - RNA, 19 nt, Homo sapiens
caaggagaaccucaaagac

SEQ ID NO: 203931 - RNA, 19 nt, Homo sapiens
ggagaucuauucccacaug

SEQ ID NO: 203932 - RNA, 19 nt, Homo sapiens
gaagagugccucgaguuua

SEQ ID NO: 203933 - RNA, 19 nt, Homo sapiens
gaucucaacuuccggaugu

SEQ ID NO: 203934 - RNA, 19 nt, Homo sapiens
ucaagcagaugaagauuau

SEQ ID NO: 203935 - RNA, 19 nt, Homo sapiens
ggaagagugccucgaguuu

SEQ ID NO: 203936 - RNA, 19 nt, Homo sapiens
gcacagacucagcaauaaa

SEQ ID NO: 203937 - RNA, 19 nt, Homo sapiens
gaacgucaaauuugucuuc

SEQ ID NO: 203938 - RNA, 19 nt, Homo sapiens
gaaagaggacgcugagaag

SEQ ID NO: 203939 - RNA, 19 nt, Homo sapiens
caagaccacuggcaucauc

SEQ ID NO: 203940 - RNA, 19 nt, Homo sapiens
gcacauggcagacacuauc

SEQ ID NO: 203941 - RNA, 19 nt, Homo sapiens
ugaggugccugaauucaug

SEQ ID NO: 203942 - RNA, 19 nt, Homo sapiens
cuucugaggugccugaauu

SEQ ID NO: 203943 - RNA, 19 nt, Homo sapiens
gcccagaggauucaggaua

SEQ ID NO: 203944 - RNA, 19 nt, Homo sapiens
ucaaggagaaccucaaaga

SEQ ID NO: 203945 - RNA, 19 nt, Homo sapiens
aagagugccucgaguuuau

SEQ ID NO: 203946 - RNA, 19 nt, Homo sapiens
ugaaagaggacgcugagaa

SEQ ID NO: 203947 - RNA, 19 nt, Homo sapiens
gaagagcaccaucgucaag

SEQ ID NO: 203948 - RNA, 19 nt, Homo sapiens
cuucaaggaucucaacuuc

SEQ ID NO: 203949 - RNA, 19 nt, Homo sapiens
ucaccgacaucaucaucaa

SEQ ID NO: 203950 - RNA, 19 nt, Homo sapiens
gcacgaugcccaaggagau

SEQ ID NO: 203951 - RNA, 19 nt, Homo sapiens
caauaaaccuuugcaucag

SEQ ID NO: 203952 - RNA, 19 nt, Homo sapiens
ccaucgugcucuuccuuaa

SEQ ID NO: 203953 - RNA, 19 nt, Homo sapiens
uaagggaggguacuguuga

SEQ ID NO: 203954 - RNA, 19 nt, Homo sapiens
gucaagcagaugaagauua

SEQ ID NO: 203955 - RNA, 19 nt, Homo sapiens
gagaucuauucccacauga

SEQ ID NO: 203956 - RNA, 19 nt, Homo sapiens
acgcacagacucagcaaua

SEQ ID NO: 203957 - RNA, 19 nt, Homo sapiens
caaaggguccaaaguccaa

SEQ ID NO: 203958 - RNA, 19 nt, Homo sapiens
ggaauaucccucccacaca

SEQ ID NO: 203959 - RNA, 19 nt, Homo sapiens
acacgcagaacgucaaauu

SEQ ID NO: 203960 - RNA, 19 nt, Homo sapiens
ggccugggcucagcaaaca

SEQ ID NO: 203961 - RNA, 19 nt, Homo sapiens
ggcgugaccugcaucaucu

SEQ ID NO: 203962 - RNA, 19 nt, Homo sapiens
cgcagaacgucaaauuugu

SEQ ID NO: 203963 - RNA, 19 nt, Homo sapiens
caucaaggagaaccucaaa

SEQ ID NO: 203964 - RNA, 19 nt, Homo sapiens
gcaccaucgucaagcagau

SEQ ID NO: 203965 - RNA, 19 nt, Homo sapiens
acgcagaacgucaaauuug

SEQ ID NO: 203966 - RNA, 19 nt, Homo sapiens
ggaagagcaccaucgucaa

SEQ ID NO: 203967 - RNA, 19 nt, Homo sapiens
cgacguccaucgugcucuu

SEQ ID NO: 203968 - RNA, 19 nt, Homo sapiens
agacgcaguucuccuucaa

SEQ ID NO: 203969 - RNA, 19 nt, Homo sapiens
cgcacagacucagcaauaa

SEQ ID NO: 203970 - RNA, 19 nt, Homo sapiens
gcaucuguuucccggacua

SEQ ID NO: 203971 - RNA, 19 nt, Homo sapiens
gcaggacccuuccccaaau

SEQ ID NO: 203972 - RNA, 19 nt, Homo sapiens
gugcccaacugaccaaucu

SEQ ID NO: 203973 - RNA, 19 nt, Homo sapiens
cauccagcaccaaaucuuu

SEQ ID NO: 203974 - RNA, 19 nt, Homo sapiens
gaucagcccagaggauuca

SEQ ID NO: 203975 - RNA, 19 nt, Homo sapiens
cccaguauuucaucaagga

SEQ ID NO: 203976 - RNA, 19 nt, Homo sapiens
gcagauccacacaccacuu

SEQ ID NO: 203977 - RNA, 19 nt, Homo sapiens
caucaaggacagggaauau

SEQ ID NO: 203978 - RNA, 19 nt, Homo sapiens
ccccauaccucccacagua

SEQ ID NO: 203979 - RNA, 19 nt, Homo sapiens
cccagaggauucaggauag

SEQ ID NO: 203980 - RNA, 19 nt, Homo sapiens
gcagaacgucaaauuuguc

SEQ ID NO: 203981 - RNA, 19 nt, Homo sapiens
gaccuggagcgccugguaa

SEQ ID NO: 203982 - RNA, 19 nt, Homo sapiens
ggacggguacucgcuggaa

SEQ ID NO: 203983 - RNA, 19 nt, Homo sapiens
gaacuaucagggacaaagg

SEQ ID NO: 203984 - RNA, 19 nt, Homo sapiens
ggauucaggauaggacaaa

SEQ ID NO: 203985 - RNA, 19 nt, Homo sapiens
ggagaaccucaaagacugu

SEQ ID NO: 203986 - RNA, 19 nt, Homo sapiens
ggaggacgacgaagugaac

SEQ ID NO: 203987 - RNA, 19 nt, Homo sapiens
gcuaguggaggacgacgaa

SEQ ID NO: 203988 - RNA, 19 nt, Homo sapiens
acucagcaauaaaccuuug

SEQ ID NO: 203989 - RNA, 19 nt, Homo sapiens
agaaccaccugcucacucu

SEQ ID NO: 203990 - RNA, 19 nt, Homo sapiens
gggcgugaccugcaucauc

SEQ ID NO: 203991 - RNA, 19 nt, Homo sapiens
gaguuuaucgccaucaucu

SEQ ID NO: 203992 - RNA, 19 nt, Homo sapiens
agaggacgcugagaaggau

SEQ ID NO: 203993 - RNA, 19 nt, Homo sapiens
ugaccacacucaacaucca

SEQ ID NO: 203994 - RNA, 19 nt, Homo sapiens
cccggaagcugaugcacau

SEQ ID NO: 203995 - RNA, 19 nt, Homo sapiens
acaguacccugggcugguu

SEQ ID NO: 203996 - RNA, 19 nt, Homo sapiens
agacuguggccucuucuga

SEQ ID NO: 203997 - RNA, 19 nt, Homo sapiens
ggccagugcugaggagaag

SEQ ID NO: 203998 - RNA, 19 nt, Homo sapiens
guuaagggaggguacuguu

SEQ ID NO: 203999 - RNA, 19 nt, Homo sapiens
caaccugccaccucaccaa

SEQ ID NO: 204000 - RNA, 19 nt, Homo sapiens
ccacacucaacauccagua

SEQ ID NO: 204001 - RNA, 19 nt, Homo sapiens
gccaugaccacacucaaca

SEQ ID NO: 204002 - RNA, 19 nt, Homo sapiens
agacucagcaauaaaccuu

SEQ ID NO: 204003 - RNA, 19 nt, Homo sapiens
gaagaaccaccugcucacu

SEQ ID NO: 204004 - RNA, 19 nt, Homo sapiens
gacaccagcuauggccaau

SEQ ID NO: 204005 - RNA, 19 nt, Homo sapiens
guacuguugacaccagcua

SEQ ID NO: 204006 - RNA, 19 nt, Homo sapiens
ugaccugcaucaucuucau

SEQ ID NO: 204007 - RNA, 19 nt, Homo sapiens
acgagagccugcaccuguu

SEQ ID NO: 204008 - RNA, 19 nt, Homo sapiens
ggacaacaggauggugugu

SEQ ID NO: 204009 - RNA, 19 nt, Homo sapiens
aagaggacgcugagaagga

SEQ ID NO: 204010 - RNA, 19 nt, Homo sapiens
gcaccucagcaucuguuuc

SEQ ID NO: 204011 - RNA, 19 nt, Homo sapiens
cacgcagaacgucaaauuu

SEQ ID NO: 204012 - RNA, 19 nt, Homo sapiens
cgacacgcagaacgucaaa

SEQ ID NO: 204013 - RNA, 19 nt, Homo sapiens
gcgcaccucagcaucuguu

SEQ ID NO: 204014 - RNA, 19 nt, Homo sapiens
caaggagaaccucaaagac

SEQ ID NO: 204015 - RNA, 19 nt, Homo sapiens
ggagucaccugcaucauuu

SEQ ID NO: 204016 - RNA, 19 nt, Homo sapiens
gaaaguccaucucagcauu

SEQ ID NO: 204017 - RNA, 19 nt, Homo sapiens
cgagagagcugcagaauac

SEQ ID NO: 204018 - RNA, 19 nt, Homo sapiens
ucaaagaaaucuacaguca

SEQ ID NO: 204019 - RNA, 19 nt, Homo sapiens
gguaacaacuccuaugaug

SEQ ID NO: 204020 - RNA, 19 nt, Homo sapiens
ggaggaugcugauaaggaa

SEQ ID NO: 204021 - RNA, 19 nt, Homo sapiens
caaccuggcugacuccauu

SEQ ID NO: 204022 - RNA, 19 nt, Homo sapiens
gaaaugugcugcaguccau

SEQ ID NO: 204023 - RNA, 19 nt, Homo sapiens
gauacucaaucccaacuuu

SEQ ID NO: 204024 - RNA, 19 nt, Homo sapiens
ggacugcggccucuucuaa

SEQ ID NO: 204025 - RNA, 19 nt, Homo sapiens
guucaaggcuaucaucuau

SEQ ID NO: 204026 - RNA, 19 nt, Homo sapiens
caggaaaccuuacgagaga

SEQ ID NO: 204027 - RNA, 19 nt, Homo sapiens
cagcauauguaaccacaaa

SEQ ID NO: 204028 - RNA, 19 nt, Homo sapiens
cagaauaccagcuuaauga

SEQ ID NO: 204029 - RNA, 19 nt, Homo sapiens
ggagauggaguauacauga

SEQ ID NO: 204030 - RNA, 19 nt, Homo sapiens
ucacauacaggaaaccuua

SEQ ID NO: 204031 - RNA, 19 nt, Homo sapiens
aaagaaaucuacagucaca

SEQ ID NO: 204032 - RNA, 19 nt, Homo sapiens
gcgaaaagaugucaaagaa

SEQ ID NO: 204033 - RNA, 19 nt, Homo sapiens
gaagaucauucaccaggau

SEQ ID NO: 204034 - RNA, 19 nt, Homo sapiens
cuuggaaucuggguaauua

SEQ ID NO: 204035 - RNA, 19 nt, Homo sapiens
acaaagaacuggccaagag

SEQ ID NO: 204036 - RNA, 19 nt, Homo sapiens
gguggaagaugacgaagug

SEQ ID NO: 204037 - RNA, 19 nt, Homo sapiens
gggcagagauccgagagaa

SEQ ID NO: 204038 - RNA, 19 nt, Homo sapiens
gcaggaggaugcugauaag

SEQ ID NO: 204039 - RNA, 19 nt, Homo sapiens
ccaaggagcuagaaaagaa

SEQ ID NO: 204040 - RNA, 19 nt, Homo sapiens
uaacaacuccuaugaugau

SEQ ID NO: 204041 - RNA, 19 nt, Homo sapiens
gaaaucuacagucacauga

SEQ ID NO: 204042 - RNA, 19 nt, Homo sapiens
gcauauguaaccacaaauu

SEQ ID NO: 204043 - RNA, 19 nt, Homo sapiens
ggauggcuauucaccagaa

SEQ ID NO: 204044 - RNA, 19 nt, Homo sapiens
cugaguaccucccuaguga

SEQ ID NO: 204045 - RNA, 19 nt, Homo sapiens
caccauuccucagguauaa

SEQ ID NO: 204046 - RNA, 19 nt, Homo sapiens
gcuaucaucuauggaaaug

SEQ ID NO: 204047 - RNA, 19 nt, Homo sapiens
guacugguuuuccaacuua

SEQ ID NO: 204048 - RNA, 19 nt, Homo sapiens
cacagaaugucaaauuugu

SEQ ID NO: 204049 - RNA, 19 nt, Homo sapiens
ucucucaccugccaucgua

SEQ ID NO: 204050 - RNA, 19 nt, Homo sapiens
cuuacuaccugaaccaauu

SEQ ID NO: 204051 - RNA, 19 nt, Homo sapiens
uuaaugacuccgcaucuua

SEQ ID NO: 204052 - RNA, 19 nt, Homo sapiens
gcagaauaccagcuuaaug

SEQ ID NO: 204053 - RNA, 19 nt, Homo sapiens
uaucaucuauggaaaugug

SEQ ID NO: 204054 - RNA, 19 nt, Homo sapiens
ucaaggcuaucaucuaugg

SEQ ID NO: 204055 - RNA, 19 nt, Homo sapiens
ggaagaugacgaagugaau

SEQ ID NO: 204056 - RNA, 19 nt, Homo sapiens
gggagucaccugcaucauu

SEQ ID NO: 204057 - RNA, 19 nt, Homo sapiens
aagaaugccuggaguucaa

SEQ ID NO: 204058 - RNA, 19 nt, Homo sapiens
caaagugggauagcuauug

SEQ ID NO: 204059 - RNA, 19 nt, Homo sapiens
gaauuacagacccugagua

SEQ ID NO: 204060 - RNA, 19 nt, Homo sapiens
gaaagagcaccaucgucaa

SEQ ID NO: 204061 - RNA, 19 nt, Homo sapiens
gggagucucagucaaugua

SEQ ID NO: 204062 - RNA, 19 nt, Homo sapiens
guaacaacuccuaugauga

SEQ ID NO: 204063 - RNA, 19 nt, Homo sapiens
gcagagauccgagagaaag

SEQ ID NO: 204064 - RNA, 19 nt, Homo sapiens
gaagaaugccuggaguuca

SEQ ID NO: 204065 - RNA, 19 nt, Homo sapiens
ucaccaggauggcuauuca

SEQ ID NO: 204066 - RNA, 19 nt, Homo sapiens
ccacacugggcaucgauua

SEQ ID NO: 204067 - RNA, 19 nt, Homo sapiens
uaaagagccaguuccuuga

SEQ ID NO: 204068 - RNA, 19 nt, Homo sapiens
cuacagauacacagaaugu

SEQ ID NO: 204069 - RNA, 19 nt, Homo sapiens
aaagagcaccaucgucaaa

SEQ ID NO: 204070 - RNA, 19 nt, Homo sapiens
ugacaagacggcaaauaug

SEQ ID NO: 204071 - RNA, 19 nt, Homo sapiens
uaaacaggcuuggaaucug

SEQ ID NO: 204072 - RNA, 19 nt, Homo sapiens
cgaagugaaucguaugcau

SEQ ID NO: 204073 - RNA, 19 nt, Homo sapiens
guaccucccuagugagcaa

SEQ ID NO: 204074 - RNA, 19 nt, Homo sapiens
acacagaaugucaaauuug

SEQ ID NO: 204075 - RNA, 19 nt, Homo sapiens
gcuccgauccagagucaaa

SEQ ID NO: 204076 - RNA, 19 nt, Homo sapiens
guagggagucucagucaau

SEQ ID NO: 204077 - RNA, 19 nt, Homo sapiens
gcaccaucgucaaacagau

SEQ ID NO: 204078 - RNA, 19 nt, Homo sapiens
gacaagacggcaaauaugg

SEQ ID NO: 204079 - RNA, 19 nt, Homo sapiens
gcaugagucuuugcaucug

SEQ ID NO: 204080 - RNA, 19 nt, Homo sapiens
ccucaccauuccucaggua

SEQ ID NO: 204081 - RNA, 19 nt, Homo sapiens
ugaugcaguuacagauauu

SEQ ID NO: 204082 - RNA, 19 nt, Homo sapiens
gaagaugacgaagugaauc

SEQ ID NO: 204083 - RNA, 19 nt, Homo sapiens
ugacugcaacuguauuuca

SEQ ID NO: 204084 - RNA, 19 nt, Homo sapiens
gcugacaagacggcaaaua

SEQ ID NO: 204085 - RNA, 19 nt, Homo sapiens
cuacuuccauuguccucuu

SEQ ID NO: 204086 - RNA, 19 nt, Homo sapiens
ccucagugccuaugauaug

SEQ ID NO: 204087 - RNA, 19 nt, Homo sapiens
gugcuccgauccagaguca

SEQ ID NO: 204088 - RNA, 19 nt, Homo sapiens
caaguugggauacucaauc

SEQ ID NO: 204089 - RNA, 19 nt, Homo sapiens
cagaaugucaaauuugugu

SEQ ID NO: 204090 - RNA, 19 nt, Homo sapiens
gauccgagagaaagaagug

SEQ ID NO: 204091 - RNA, 19 nt, Homo sapiens
caagagguccaaggagcua

SEQ ID NO: 204092 - RNA, 19 nt, Homo sapiens
gacugcaacuguauuucau

SEQ ID NO: 204093 - RNA, 19 nt, Homo sapiens
ucaccauuccucagguaua

SEQ ID NO: 204094 - RNA, 19 nt, Homo sapiens
cuucuaauccucaccauuc

SEQ ID NO: 204095 - RNA, 19 nt, Homo sapiens
uugaugcaguuacagauau

SEQ ID NO: 204096 - RNA, 19 nt, Homo sapiens
ccuacagccugcucucuca

SEQ ID NO: 204097 - RNA, 19 nt, Homo sapiens
gaugguaacaacuccuaug

SEQ ID NO: 204098 - RNA, 19 nt, Homo sapiens
caugacugcaacuguauuu

SEQ ID NO: 204099 - RNA, 19 nt, Homo sapiens
ggaguauacaugacugcaa

SEQ ID NO: 204100 - RNA, 19 nt, Homo sapiens
ucuauaaacaggcuuggaa

SEQ ID NO: 204101 - RNA, 19 nt, Homo sapiens
ccucagguauaaguucuau

SEQ ID NO: 204102 - RNA, 19 nt, Homo sapiens
gaugcaguuacagauauua

SEQ ID NO: 204103 - RNA, 19 nt, Homo sapiens
gcauuuguuuuccagagua

SEQ ID NO: 204104 - RNA, 19 nt, Homo sapiens
uuacuaccugaaccaauua

SEQ ID NO: 204105 - RNA, 19 nt, Homo sapiens
ggcgacagcucaacaaccu

SEQ ID NO: 204106 - RNA, 19 nt, Homo sapiens
gagauggaguauacaugac

SEQ ID NO: 204107 - RNA, 19 nt, Homo sapiens
cauauguaaccacaaauuc

SEQ ID NO: 204108 - RNA, 19 nt, Homo sapiens
gcccucagugccuaugaua

SEQ ID NO: 204109 - RNA, 19 nt, Homo sapiens
cugacaagacggcaaauau

SEQ ID NO: 204110 - RNA, 19 nt, Homo sapiens
acagauacacagaauguca

SEQ ID NO: 204111 - RNA, 19 nt, Homo sapiens
gagggagucaccugcauca

SEQ ID NO: 204112 - RNA, 19 nt, Homo sapiens
cuaccugaaccaauuagaa

SEQ ID NO: 204113 - RNA, 19 nt, Homo sapiens
ucgagagagcugcagaaua

SEQ ID NO: 204114 - RNA, 19 nt, Homo sapiens
ggaguucaaggcuaucauc

SEQ ID NO: 204115 - RNA, 19 nt, Homo sapiens
ggacacguguuguacauaa

SEQ ID NO: 204116 - RNA, 19 nt, Homo sapiens
ccacauuucugcaaacaua

SEQ ID NO: 204117 - RNA, 19 nt, Homo sapiens
caaaugcaguugaguauuc

SEQ ID NO: 204118 - RNA, 19 nt, Homo sapiens
cuaagugucuugguauuua

SEQ ID NO: 204119 - RNA, 19 nt, Homo sapiens
ggucugcauuggauuguua

SEQ ID NO: 204120 - RNA, 19 nt, Homo sapiens
gcaaaugaacaauagcuaa

SEQ ID NO: 204121 - RNA, 19 nt, Homo sapiens
caagggccguguguaaaua

SEQ ID NO: 204122 - RNA, 19 nt, Homo sapiens
ccaaggacgugaagagaug

SEQ ID NO: 204123 - RNA, 19 nt, Homo sapiens
ggccaaaucucgugguguu

SEQ ID NO: 204124 - RNA, 19 nt, Homo sapiens
gcuacgaccugaaacucua

SEQ ID NO: 204125 - RNA, 19 nt, Homo sapiens
gcaguguccucuuguuaau

SEQ ID NO: 204126 - RNA, 19 nt, Homo sapiens
cggcaaagcucagaggaaa

SEQ ID NO: 204127 - RNA, 19 nt, Homo sapiens
gcaaaauccucuaaaaugu

SEQ ID NO: 204128 - RNA, 19 nt, Homo sapiens
gggagcaaaugaacaauag

SEQ ID NO: 204129 - RNA, 19 nt, Homo sapiens
cuacuagucugauguuuua

SEQ ID NO: 204130 - RNA, 19 nt, Homo sapiens
acggauagauugcuaggua

SEQ ID NO: 204131 - RNA, 19 nt, Homo sapiens
agucaaagguugucuacuu

SEQ ID NO: 204132 - RNA, 19 nt, Homo sapiens
ccaguaacauccaguuugu

SEQ ID NO: 204133 - RNA, 19 nt, Homo sapiens
ggaggccgcugucuacauc

SEQ ID NO: 204134 - RNA, 19 nt, Homo sapiens
gaaagucaaagguugucua

SEQ ID NO: 204135 - RNA, 19 nt, Homo sapiens
cgacauauuuaaagaaggu

SEQ ID NO: 204136 - RNA, 19 nt, Homo sapiens
caagagcaccaucgucaaa

SEQ ID NO: 204137 - RNA, 19 nt, Homo sapiens
gggauuggaugaaagucaa

SEQ ID NO: 204138 - RNA, 19 nt, Homo sapiens
agaacaaucucaaguacau

SEQ ID NO: 204139 - RNA, 19 nt, Homo sapiens
cgaguggcacgauuuauuu

SEQ ID NO: 204140 - RNA, 19 nt, Homo sapiens
gaacaauagcuaagugucu

SEQ ID NO: 204141 - RNA, 19 nt, Homo sapiens
aaacgaguggcacgauuua

SEQ ID NO: 204142 - RNA, 19 nt, Homo sapiens
gcaacaaggagaccaagga

SEQ ID NO: 204143 - RNA, 19 nt, Homo sapiens
ucaaguacauuggccuuug

SEQ ID NO: 204144 - RNA, 19 nt, Homo sapiens
aacaacaacugguucauca

SEQ ID NO: 204145 - RNA, 19 nt, Homo sapiens
guuguuaucuggacgaucu

SEQ ID NO: 204146 - RNA, 19 nt, Homo sapiens
gaggauaaccagacaaguc

SEQ ID NO: 204147 - RNA, 19 nt, Homo sapiens
guagauagacacacacaca

SEQ ID NO: 204148 - RNA, 19 nt, Homo sapiens
uaacauccaguuugucuuc

SEQ ID NO: 204149 - RNA, 19 nt, Homo sapiens
gcucagcaccauuucauuc

SEQ ID NO: 204150 - RNA, 19 nt, Homo sapiens
acacacacaugcacacaca

SEQ ID NO: 204151 - RNA, 19 nt, Homo sapiens
ucacagccaucaucuucug

SEQ ID NO: 204152 - RNA, 19 nt, Homo sapiens
aagguugucuacuuuaaga

SEQ ID NO: 204153 - RNA, 19 nt, Homo sapiens
gagacuggcuggaaaugcu

SEQ ID NO: 204154 - RNA, 19 nt, Homo sapiens
auagauugcuagguagaua

SEQ ID NO: 204155 - RNA, 19 nt, Homo sapiens
gagaucuacucccacuuca

SEQ ID NO: 204156 - RNA, 19 nt, Homo sapiens
ggagcucaccuucaagaug

SEQ ID NO: 204157 - RNA, 19 nt, Homo sapiens
gcuaagugucuugguauuu

SEQ ID NO: 204158 - RNA, 19 nt, Homo sapiens
auagcuaagugucuuggua

SEQ ID NO: 204159 - RNA, 19 nt, Homo sapiens
cuagguagauagacacaca

SEQ ID NO: 204160 - RNA, 19 nt, Homo sapiens
ggacaugaccacgggcauu

SEQ ID NO: 204161 - RNA, 19 nt, Homo sapiens
gcaccaucgucaaacagau

SEQ ID NO: 204162 - RNA, 19 nt, Homo sapiens
ccaagggccguguguaaau

SEQ ID NO: 204163 - RNA, 19 nt, Homo sapiens
caaaugaacaauagcuaag

SEQ ID NO: 204164 - RNA, 19 nt, Homo sapiens
ccucugcaguguccucuug

SEQ ID NO: 204165 - RNA, 19 nt, Homo sapiens
ucucucugcuccaaagaaa

SEQ ID NO: 204166 - RNA, 19 nt, Homo sapiens
acagaacaaucucaaguac

SEQ ID NO: 204167 - RNA, 19 nt, Homo sapiens
caucaacaccucacucauc

SEQ ID NO: 204168 - RNA, 19 nt, Homo sapiens
gaugaaagucaaagguugu

SEQ ID NO: 204169 - RNA, 19 nt, Homo sapiens
gaacaaucucaaguacauu

SEQ ID NO: 204170 - RNA, 19 nt, Homo sapiens
gcagggcugaggcaaggua

SEQ ID NO: 204171 - RNA, 19 nt, Homo sapiens
uacagaacaaucucaagua

SEQ ID NO: 204172 - RNA, 19 nt, Homo sapiens
gcaagagcaccaucgucaa

SEQ ID NO: 204173 - RNA, 19 nt, Homo sapiens
uggcacgauuuauuucaaa

SEQ ID NO: 204174 - RNA, 19 nt, Homo sapiens
cuacgaggauaaccagaca

SEQ ID NO: 204175 - RNA, 19 nt, Homo sapiens
cugaaacucuacgaggaua

SEQ ID NO: 204176 - RNA, 19 nt, Homo sapiens
cacgacauauuuaaagaag

SEQ ID NO: 204177 - RNA, 19 nt, Homo sapiens
ggaccuugccgcugaccaa

SEQ ID NO: 204178 - RNA, 19 nt, Homo sapiens
ggcaaaauccucuaaaaug

SEQ ID NO: 204179 - RNA, 19 nt, Homo sapiens
caacaacaacugguucauc

SEQ ID NO: 204180 - RNA, 19 nt, Homo sapiens
gcagaggucagagcgcaaa

SEQ ID NO: 204181 - RNA, 19 nt, Homo sapiens
acaagggccagaacacgua

SEQ ID NO: 204182 - RNA, 19 nt, Homo sapiens
cgccgcagcugacuauauc

SEQ ID NO: 204183 - RNA, 19 nt, Homo sapiens
acaaggagaccaaggagau

SEQ ID NO: 204184 - RNA, 19 nt, Homo sapiens
gguugucuacuuuaagaaa

SEQ ID NO: 204185 - RNA, 19 nt, Homo sapiens
gccaagggccguguguaaa

SEQ ID NO: 204186 - RNA, 19 nt, Homo sapiens
aacaauagcuaagugucuu

SEQ ID NO: 204187 - RNA, 19 nt, Homo sapiens
aaugaacaauagcuaagug

SEQ ID NO: 204188 - RNA, 19 nt, Homo sapiens
gauuccagcuuuucuucua

SEQ ID NO: 204189 - RNA, 19 nt, Homo sapiens
guggcacgauuuauuucaa

SEQ ID NO: 204190 - RNA, 19 nt, Homo sapiens
caaaacgaguggcacgauu

SEQ ID NO: 204191 - RNA, 19 nt, Homo sapiens
ggauagauugcuagguaga

SEQ ID NO: 204192 - RNA, 19 nt, Homo sapiens
cgccaagggccguguguaa

SEQ ID NO: 204193 - RNA, 19 nt, Homo sapiens
gccugagacuggcuggaaa

SEQ ID NO: 204194 - RNA, 19 nt, Homo sapiens
ucucugcuccaaagaaauu

SEQ ID NO: 204195 - RNA, 19 nt, Homo sapiens
gacaugaccacgggcauug

SEQ ID NO: 204196 - RNA, 19 nt, Homo sapiens
gucacaaggucacuacaag

SEQ ID NO: 204197 - RNA, 19 nt, Homo sapiens
gcgccugccuauggugaaa

SEQ ID NO: 204198 - RNA, 19 nt, Homo sapiens
caacaacugguucaucaac

SEQ ID NO: 204199 - RNA, 19 nt, Homo sapiens
gagcaagggcgagaucaca

SEQ ID NO: 204200 - RNA, 19 nt, Homo sapiens
gggguuuucugcuuuguuu

SEQ ID NO: 204201 - RNA, 19 nt, Homo sapiens
caaguacauuggccuuugc

SEQ ID NO: 204202 - RNA, 19 nt, Homo sapiens
gcaucccgcucaccaucug

SEQ ID NO: 204203 - RNA, 19 nt, Homo sapiens
acaccucacucauccucuu

SEQ ID NO: 204204 - RNA, 19 nt, Homo sapiens
cacuuugccuuccugaguu

SEQ ID NO: 204205 - RNA, 19 nt, Homo sapiens
gagcaaaugaacaauagcu

SEQ ID NO: 204206 - RNA, 19 nt, Homo sapiens
cugcaguguccucuuguua

SEQ ID NO: 204207 - RNA, 19 nt, Homo sapiens
ucacuuugccuuccugagu

SEQ ID NO: 204208 - RNA, 19 nt, Homo sapiens
cagacgucaucauacagaa

SEQ ID NO: 204209 - RNA, 19 nt, Homo sapiens
cagcggcuacgaccugaaa

SEQ ID NO: 204210 - RNA, 19 nt, Homo sapiens
acauaagccucugcagugu

SEQ ID NO: 204211 - RNA, 19 nt, Homo sapiens
ccaaaucucgugguguuuc

SEQ ID NO: 204212 - RNA, 19 nt, Homo sapiens
ccaucugcuuucccgagua

SEQ ID NO: 204213 - RNA, 19 nt, Homo sapiens
ugggagcaaaugaacaaua

SEQ ID NO: 204214 - RNA, 19 nt, Homo sapiens
caaccugccccuucacuuu

SEQ ID NO: 204215 - RNA, 19 nt, Homo sapiens
gaaauaaccucuuacaguu

SEQ ID NO: 204216 - RNA, 19 nt, Homo sapiens
gcaaagagaauacaaauga

SEQ ID NO: 204217 - RNA, 19 nt, Homo sapiens
gcacauaucggaagcagua

SEQ ID NO: 204218 - RNA, 19 nt, Homo sapiens
ggagggaaguuuauaauag

SEQ ID NO: 204219 - RNA, 19 nt, Homo sapiens
gauaacauuugcuccauuu

SEQ ID NO: 204220 - RNA, 19 nt, Homo sapiens
gcacuaagaucggaagaug

SEQ ID NO: 204221 - RNA, 19 nt, Homo sapiens
gaaguuggagggaaguuua

SEQ ID NO: 204222 - RNA, 19 nt, Homo sapiens
gcaaacgacugcuguugga

SEQ ID NO: 204223 - RNA, 19 nt, Homo sapiens
acacaaacguggcauagaa

SEQ ID NO: 204224 - RNA, 19 nt, Homo sapiens
gcaacucucucucagauca

SEQ ID NO: 204225 - RNA, 19 nt, Homo sapiens
ugagugagcuugaccaguu

SEQ ID NO: 204226 - RNA, 19 nt, Homo sapiens
uaaauucagucccugguuu

SEQ ID NO: 204227 - RNA, 19 nt, Homo sapiens
aagguaaacuugaguguaa

SEQ ID NO: 204228 - RNA, 19 nt, Homo sapiens
accaggagcucaugacuua

SEQ ID NO: 204229 - RNA, 19 nt, Homo sapiens
aaagaucucugugcuguaa

SEQ ID NO: 204230 - RNA, 19 nt, Homo sapiens
gaagcuggaugcaagauag

SEQ ID NO: 204231 - RNA, 19 nt, Homo sapiens
uaaagcaguuugacaugaa

SEQ ID NO: 204232 - RNA, 19 nt, Homo sapiens
ccacgagucugacaucaau

SEQ ID NO: 204233 - RNA, 19 nt, Homo sapiens
ugggauagcuuccucaaga

SEQ ID NO: 204234 - RNA, 19 nt, Homo sapiens
ucaaaugcgugaucagaga

SEQ ID NO: 204235 - RNA, 19 nt, Homo sapiens
ucucugauguugucaauga

SEQ ID NO: 204236 - RNA, 19 nt, Homo sapiens
ggagaugucaugagccuuu

SEQ ID NO: 204237 - RNA, 19 nt, Homo sapiens
ucucugugcuguaaacuaa

SEQ ID NO: 204238 - RNA, 19 nt, Homo sapiens
ugaagagccugcccuccua

SEQ ID NO: 204239 - RNA, 19 nt, Homo sapiens
cagagaauccuucaccuuu

SEQ ID NO: 204240 - RNA, 19 nt, Homo sapiens
gaagguaaacuugagugua

SEQ ID NO: 204241 - RNA, 19 nt, Homo sapiens
gagagcauauccuauccaa

SEQ ID NO: 204242 - RNA, 19 nt, Homo sapiens
ggauaacauuugcuccauu

SEQ ID NO: 204243 - RNA, 19 nt, Homo sapiens
gagugagcuugaccaguua

SEQ ID NO: 204244 - RNA, 19 nt, Homo sapiens
uauaauagccuaacacuac

SEQ ID NO: 204245 - RNA, 19 nt, Homo sapiens
ccaaauuucagucauguuu

SEQ ID NO: 204246 - RNA, 19 nt, Homo sapiens
ggucaucguguccaaauuu

SEQ ID NO: 204247 - RNA, 19 nt, Homo sapiens
agaaauaaccucuuacagu

SEQ ID NO: 204248 - RNA, 19 nt, Homo sapiens
cgucugggaugcacucaaa

SEQ ID NO: 204249 - RNA, 19 nt, Homo sapiens
gucaugagccuuucucuug

SEQ ID NO: 204250 - RNA, 19 nt, Homo sapiens
cagcagacgaccacguuua

SEQ ID NO: 204251 - RNA, 19 nt, Homo sapiens
gcugagggcuuuguucauc

SEQ ID NO: 204252 - RNA, 19 nt, Homo sapiens
uuggguggguuuacucuua

SEQ ID NO: 204253 - RNA, 19 nt, Homo sapiens
ccaccaguguauuugaauu

SEQ ID NO: 204254 - RNA, 19 nt, Homo sapiens
gccauuugcuucuuuccaa

SEQ ID NO: 204255 - RNA, 19 nt, Homo sapiens
ggaagcuggaugcaagaua

SEQ ID NO: 204256 - RNA, 19 nt, Homo sapiens
aaacuugaguguaauuguc

SEQ ID NO: 204257 - RNA, 19 nt, Homo sapiens
gaaagaucucugugcugua

SEQ ID NO: 204258 - RNA, 19 nt, Homo sapiens
ucucucagaucacaaacaa

SEQ ID NO: 204259 - RNA, 19 nt, Homo sapiens
gagggaaguuuauaauagc

SEQ ID NO: 204260 - RNA, 19 nt, Homo sapiens
agagaauccuucaccuuug

SEQ ID NO: 204261 - RNA, 19 nt, Homo sapiens
gcauugaagagcacuaaga

SEQ ID NO: 204262 - RNA, 19 nt, Homo sapiens
gcaggaugguaaacuuauc

SEQ ID NO: 204263 - RNA, 19 nt, Homo sapiens
caaaugaaaccccuucuuu

SEQ ID NO: 204264 - RNA, 19 nt, Homo sapiens
cgagggcgcugagacaaau

SEQ ID NO: 204265 - RNA, 19 nt, Homo sapiens
ggaacuaacgccaguagca

SEQ ID NO: 204266 - RNA, 19 nt, Homo sapiens
auaaagcaguuugacauga

SEQ ID NO: 204267 - RNA, 19 nt, Homo sapiens
aaaguucuguugcaaacga

SEQ ID NO: 204268 - RNA, 19 nt, Homo sapiens
agaaucgcaugcuguagaa

SEQ ID NO: 204269 - RNA, 19 nt, Homo sapiens
gagaauccuucaccuuugc

SEQ ID NO: 204270 - RNA, 19 nt, Homo sapiens
guaauaaagcaguuugaca

SEQ ID NO: 204271 - RNA, 19 nt, Homo sapiens
cugcaacauucuauacaaa

SEQ ID NO: 204272 - RNA, 19 nt, Homo sapiens
ggaagaugagugagcuuga

SEQ ID NO: 204273 - RNA, 19 nt, Homo sapiens
caacuuaagaaccagauuc

SEQ ID NO: 204274 - RNA, 19 nt, Homo sapiens
ccuccuauauggauucuuc

SEQ ID NO: 204275 - RNA, 19 nt, Homo sapiens
aauaaccucuuacaguugu

SEQ ID NO: 204276 - RNA, 19 nt, Homo sapiens
auaaugaucucagacuuuc

SEQ ID NO: 204277 - RNA, 19 nt, Homo sapiens
gaagaugagugagcuugac

SEQ ID NO: 204278 - RNA, 19 nt, Homo sapiens
aaagcaguuugacaugaaa

SEQ ID NO: 204279 - RNA, 19 nt, Homo sapiens
uuggauagucagucaauua

SEQ ID NO: 204280 - RNA, 19 nt, Homo sapiens
gugcuuggauagucaguca

SEQ ID NO: 204281 - RNA, 19 nt, Homo sapiens
gcacacaaacguggcauag

SEQ ID NO: 204282 - RNA, 19 nt, Homo sapiens
gcaggaggccgagcaacuu

SEQ ID NO: 204283 - RNA, 19 nt, Homo sapiens
gggauagcuuccucaagau

SEQ ID NO: 204284 - RNA, 19 nt, Homo sapiens
guucgucucuggugcuugu

SEQ ID NO: 204285 - RNA, 19 nt, Homo sapiens
gcaaggaagcuggaugcaa

SEQ ID NO: 204286 - RNA, 19 nt, Homo sapiens
cauccugucuaucuucuca

SEQ ID NO: 204287 - RNA, 19 nt, Homo sapiens
gaacuaacgccaguagcau

SEQ ID NO: 204288 - RNA, 19 nt, Homo sapiens
gcgguggccuggauaacau

SEQ ID NO: 204289 - RNA, 19 nt, Homo sapiens
caggaggccgagcaacuua

SEQ ID NO: 204290 - RNA, 19 nt, Homo sapiens
gucagucaauuauuugugu

SEQ ID NO: 204291 - RNA, 19 nt, Homo sapiens
caggaaagcaugugcagau

SEQ ID NO: 204292 - RNA, 19 nt, Homo sapiens
ggucucaaaugcgugauca

SEQ ID NO: 204293 - RNA, 19 nt, Homo sapiens
gucaugaccugugcauaug

SEQ ID NO: 204294 - RNA, 19 nt, Homo sapiens
cuucauagcagcaguagug

SEQ ID NO: 204295 - RNA, 19 nt, Homo sapiens
gcgcugagacaaauuuaca

SEQ ID NO: 204296 - RNA, 19 nt, Homo sapiens
caugagagcauauccuauc

SEQ ID NO: 204297 - RNA, 19 nt, Homo sapiens
cagccaaacucugggaugu

SEQ ID NO: 204298 - RNA, 19 nt, Homo sapiens
uggcaggacacacagguua

SEQ ID NO: 204299 - RNA, 19 nt, Homo sapiens
gagccugcccuccuauaug

SEQ ID NO: 204300 - RNA, 19 nt, Homo sapiens
ggagggagagggagugaag

SEQ ID NO: 204301 - RNA, 19 nt, Homo sapiens
uagaaucgcaugcuguaga

SEQ ID NO: 204302 - RNA, 19 nt, Homo sapiens
ggauagucagucaauuauu

SEQ ID NO: 204303 - RNA, 19 nt, Homo sapiens
uggagggaaguuuauaaua

SEQ ID NO: 204304 - RNA, 19 nt, Homo sapiens
gguaaacuugaguguaauu

SEQ ID NO: 204305 - RNA, 19 nt, Homo sapiens
gcuggaugcaagauagaua

SEQ ID NO: 204306 - RNA, 19 nt, Homo sapiens
aaacgacugcuguuggauu

SEQ ID NO: 204307 - RNA, 19 nt, Homo sapiens
gauguugucaaugauguaa

SEQ ID NO: 204308 - RNA, 19 nt, Homo sapiens
ucuugaagguggcauugaa

SEQ ID NO: 204309 - RNA, 19 nt, Homo sapiens
gauguaauaaagcaguuug

SEQ ID NO: 204310 - RNA, 19 nt, Homo sapiens
gaagagccugcccuccuau

SEQ ID NO: 204311 - RNA, 19 nt, Homo sapiens
ccgagcaacuuaagaacca

SEQ ID NO: 204312 - RNA, 19 nt, Homo sapiens
gaagcauucauauuuccuu

SEQ ID NO: 204313 - RNA, 19 nt, Homo sapiens
aauguuaaccagaagguaa

SEQ ID NO: 204314 - RNA, 19 nt, Homo sapiens
ucacuggccacgagucuga

SEQ ID NO: 204315 - RNA, 19 nt, Homo sapiens
gacaacaucugcuccaucu

SEQ ID NO: 204316 - RNA, 19 nt, Homo sapiens
ugagugagcuggagcaacu

SEQ ID NO: 204317 - RNA, 19 nt, Homo sapiens
ucaaugcaguggcuuucuu

SEQ ID NO: 204318 - RNA, 19 nt, Homo sapiens
guacucccaugacaacauc

SEQ ID NO: 204319 - RNA, 19 nt, Homo sapiens
caacaucugcuccaucuac

SEQ ID NO: 204320 - RNA, 19 nt, Homo sapiens
cucaagaucuggaacuaau

SEQ ID NO: 204321 - RNA, 19 nt, Homo sapiens
cuggguaccugucguguug

SEQ ID NO: 204322 - RNA, 19 nt, Homo sapiens
ccaugaauccgacaucaau

SEQ ID NO: 204323 - RNA, 19 nt, Homo sapiens
gacuucaacugcaacaucu

SEQ ID NO: 204324 - RNA, 19 nt, Homo sapiens
gugggcaccuggcaaagau

SEQ ID NO: 204325 - RNA, 19 nt, Homo sapiens
acucaacacugacccagau

SEQ ID NO: 204326 - RNA, 19 nt, Homo sapiens
ggccaugaauccgacauca

SEQ ID NO: 204327 - RNA, 19 nt, Homo sapiens
gcaccuggcaaagaucuau

SEQ ID NO: 204328 - RNA, 19 nt, Homo sapiens
gauuccaugugccgacaga

SEQ ID NO: 204329 - RNA, 19 nt, Homo sapiens
cgacuucaacugcaacauc

SEQ ID NO: 204330 - RNA, 19 nt, Homo sapiens
caagaucuggaacuaaugg

SEQ ID NO: 204331 - RNA, 19 nt, Homo sapiens
gggacuccuuccucaagau

SEQ ID NO: 204332 - RNA, 19 nt, Homo sapiens
gauggccgcacguuugugu

SEQ ID NO: 204333 - RNA, 19 nt, Homo sapiens
gccagcagacaguggguuu

SEQ ID NO: 204334 - RNA, 19 nt, Homo sapiens
ggacuccuuccucaagauc

SEQ ID NO: 204335 - RNA, 19 nt, Homo sapiens
aacaucaucuguggcauca

SEQ ID NO: 204336 - RNA, 19 nt, Homo sapiens
augggaagcucaucaucug

SEQ ID NO: 204337 - RNA, 19 nt, Homo sapiens
auaaaggagccaauuccaa

SEQ ID NO: 204338 - RNA, 19 nt, Homo sapiens
ccucaagaucuggaacuaa

SEQ ID NO: 204339 - RNA, 19 nt, Homo sapiens
cuuccuggaugacaaccaa

SEQ ID NO: 204340 - RNA, 19 nt, Homo sapiens
ccacuaagcuuucuccuuu

SEQ ID NO: 204341 - RNA, 19 nt, Homo sapiens
gcagaagacuguauuugug

SEQ ID NO: 204342 - RNA, 19 nt, Homo sapiens
ccagaucaguccuuucuaa

SEQ ID NO: 204343 - RNA, 19 nt, Homo sapiens
uaagacaccugcaauaaag

SEQ ID NO: 204344 - RNA, 19 nt, Homo sapiens
gguguucucuucuauauuc

SEQ ID NO: 204345 - RNA, 19 nt, Homo sapiens
gaucaguccuuucuaaucu

SEQ ID NO: 204346 - RNA, 19 nt, Homo sapiens
gaaagccugugcugacguu

SEQ ID NO: 204347 - RNA, 19 nt, Homo sapiens
ugacuucaaucucuucauu

SEQ ID NO: 204348 - RNA, 19 nt, Homo sapiens
gguccuggcccucuucuua

SEQ ID NO: 204349 - RNA, 19 nt, Homo sapiens
gagcugaggagcacaguuu

SEQ ID NO: 204350 - RNA, 19 nt, Homo sapiens
ccucacagccucucccuua

SEQ ID NO: 204351 - RNA, 19 nt, Homo sapiens
gcaaagaacugccccaucu

SEQ ID NO: 204352 - RNA, 19 nt, Homo sapiens
ggacaucaacgccaucugu

SEQ ID NO: 204353 - RNA, 19 nt, Homo sapiens
gauugcagaugccaggaaa

SEQ ID NO: 204354 - RNA, 19 nt, Homo sapiens
cagguguucucuucuauau

SEQ ID NO: 204355 - RNA, 19 nt, Homo sapiens
ggaccugccgucagacuuu

SEQ ID NO: 204356 - RNA, 19 nt, Homo sapiens
ggacaccuggccaagauuu

SEQ ID NO: 204357 - RNA, 19 nt, Homo sapiens
cuaagacaccugcaauaaa

SEQ ID NO: 204358 - RNA, 19 nt, Homo sapiens
ccuaagacaccugcaauaa

SEQ ID NO: 204359 - RNA, 19 nt, Homo sapiens
cgucgcagcugagggagua

SEQ ID NO: 204360 - RNA, 19 nt, Homo sapiens
ugaggaggcuggagaaagg

SEQ ID NO: 204361 - RNA, 19 nt, Homo sapiens
gcaugggacugugccuuug

SEQ ID NO: 204362 - RNA, 19 nt, Homo sapiens
ucauucagguguucucuuc

SEQ ID NO: 204363 - RNA, 19 nt, Homo sapiens
ggaaguggaaggcagugaa

SEQ ID NO: 204364 - RNA, 19 nt, Homo sapiens
gcacugggccacugauucu

SEQ ID NO: 204365 - RNA, 19 nt, Homo sapiens
cacagccucucccuuaaug

SEQ ID NO: 204366 - RNA, 19 nt, Homo sapiens
gggcagaccuguccauccu

SEQ ID NO: 204367 - RNA, 19 nt, Homo sapiens
gugccaagcucugggaugu

SEQ ID NO: 204368 - RNA, 19 nt, Homo sapiens
cgggugccauucccacuaa

SEQ ID NO: 204369 - RNA, 19 nt, Homo sapiens
caucaacgccaucuguuuc

SEQ ID NO: 204370 - RNA, 19 nt, Homo sapiens
gcagcagaagacuguauuu

SEQ ID NO: 204371 - RNA, 19 nt, Homo sapiens
acuaagcuuucuccuuuga

SEQ ID NO: 204372 - RNA, 19 nt, Homo sapiens
gcuggugucuggccuagag

SEQ ID NO: 204373 - RNA, 19 nt, Homo sapiens
uauucaugcuuucuccuuu

SEQ ID NO: 204374 - RNA, 19 nt, Homo sapiens
gacuucaacugcaaugucu

SEQ ID NO: 204375 - RNA, 19 nt, Homo sapiens
accaggagcugaucugcuu

SEQ ID NO: 204376 - RNA, 19 nt, Homo sapiens
gauucuaagcugcugguaa

SEQ ID NO: 204377 - RNA, 19 nt, Homo sapiens
gccauucccacuaagcuuu

SEQ ID NO: 204378 - RNA, 19 nt, Homo sapiens
gacaccuggccaagauuua

SEQ ID NO: 204379 - RNA, 19 nt, Homo sapiens
auucagguguucucuucua

SEQ ID NO: 204380 - RNA, 19 nt, Homo sapiens
cauccucucuggccacgau

SEQ ID NO: 204381 - RNA, 19 nt, Homo sapiens
cagcagaagacuguauuug

SEQ ID NO: 204382 - RNA, 19 nt, Homo sapiens
ccagagccacuaccuuugu

SEQ ID NO: 204383 - RNA, 19 nt, Homo sapiens
ggcugugucuccugacuuc

SEQ ID NO: 204384 - RNA, 19 nt, Homo sapiens
auucuaagcugcugguaag

SEQ ID NO: 204385 - RNA, 19 nt, Homo sapiens
ucagguguucucuucuaua

SEQ ID NO: 204386 - RNA, 19 nt, Homo sapiens
gucaugaccugugccuaug

SEQ ID NO: 204387 - RNA, 19 nt, Homo sapiens
ugggacagcuuccucaaaa

SEQ ID NO: 204388 - RNA, 19 nt, Homo sapiens
gggcagaccaggagcugau

SEQ ID NO: 204389 - RNA, 19 nt, Homo sapiens
gacaucaacgccaucuguu

SEQ ID NO: 204390 - RNA, 19 nt, Homo sapiens
gcugaggagcacaguuuga

SEQ ID NO: 204391 - RNA, 19 nt, Homo sapiens
ucaguccuuucuaaucuca

SEQ ID NO: 204392 - RNA, 19 nt, Homo sapiens
gacuucaaucucuucauuu

SEQ ID NO: 204393 - RNA, 19 nt, Homo sapiens
caaaucccgugagggcaau

SEQ ID NO: 204394 - RNA, 19 nt, Homo sapiens
caccugcaauaaaguguag

SEQ ID NO: 204395 - RNA, 19 nt, Homo sapiens
caacgccaucuguuucuuc

SEQ ID NO: 204396 - RNA, 19 nt, Homo sapiens
acuucaaucucuucauuuc

SEQ ID NO: 204397 - RNA, 19 nt, Homo sapiens
gagacugggcagcagaaga

SEQ ID NO: 204398 - RNA, 19 nt, Homo sapiens
cuuccuggaugacaacaau

SEQ ID NO: 204399 - RNA, 19 nt, Homo sapiens
ucacagccucucccuuaau

SEQ ID NO: 204400 - RNA, 19 nt, Homo sapiens
gaaguggaaggcagugaac

SEQ ID NO: 204401 - RNA, 19 nt, Homo sapiens
gaccugccgucagacuuuc

SEQ ID NO: 204402 - RNA, 19 nt, Homo sapiens
uuucugcucacacagguua

SEQ ID NO: 204403 - RNA, 19 nt, Homo sapiens
cgacuucaacugcaauguc

SEQ ID NO: 204404 - RNA, 19 nt, Homo sapiens
ucuccugacuucaaucucu

SEQ ID NO: 204405 - RNA, 19 nt, Homo sapiens
ggcagcagaagacuguauu

SEQ ID NO: 204406 - RNA, 19 nt, Homo sapiens
gggcagcagaagacuguau

SEQ ID NO: 204407 - RNA, 19 nt, Homo sapiens
cucacagccucucccuuaa

SEQ ID NO: 204408 - RNA, 19 nt, Homo sapiens
acaucaacgccaucuguuu

SEQ ID NO: 204409 - RNA, 19 nt, Homo sapiens
gcucacacagguuaucucu

SEQ ID NO: 204410 - RNA, 19 nt, Homo sapiens
cagaucaguccuuucuaau

SEQ ID NO: 204411 - RNA, 19 nt, Homo sapiens
ggagcaacugcgucaggaa

SEQ ID NO: 204412 - RNA, 19 nt, Homo sapiens
ccuguacccucccauacuc

SEQ ID NO: 204413 - RNA, 19 nt, Homo sapiens
ggggacaccuggccaagau

SEQ ID NO: 204414 - RNA, 19 nt, Homo sapiens
gcguuuggcccugugacua

SEQ ID NO: 204415 - RNA, 19 nt, Homo sapiens
cagagccacuaccuuuguc

SEQ ID NO: 204416 - RNA, 19 nt, Homo sapiens
cacuaagcuuucuccuuug

SEQ ID NO: 204417 - RNA, 19 nt, Homo sapiens
ggacagcuuccucaaaauc

SEQ ID NO: 204418 - RNA, 19 nt, Homo sapiens
ucaacgccaucuguuucuu

SEQ ID NO: 204419 - RNA, 19 nt, Homo sapiens
caagaagcagauugcagau

SEQ ID NO: 204420 - RNA, 19 nt, Homo sapiens
cagcagaccugaugacuua

SEQ ID NO: 204421 - RNA, 19 nt, Homo sapiens
gaacagcacuaugaguauu

SEQ ID NO: 204422 - RNA, 19 nt, Homo sapiens
uggaacagcuuaagauuga

SEQ ID NO: 204423 - RNA, 19 nt, Homo sapiens
gagguuaucugaagcacaa

SEQ ID NO: 204424 - RNA, 19 nt, Homo sapiens
gcuuguggcuucaggauga

SEQ ID NO: 204425 - RNA, 19 nt, Homo sapiens
guaaagccauuugaagaau

SEQ ID NO: 204426 - RNA, 19 nt, Homo sapiens
gguaaagccauuugaagaa

SEQ ID NO: 204427 - RNA, 19 nt, Homo sapiens
ucucacaacuccucccuuu

SEQ ID NO: 204428 - RNA, 19 nt, Homo sapiens
gugaacagcacuaugagua

SEQ ID NO: 204429 - RNA, 19 nt, Homo sapiens
caugugagguuaucugaag

SEQ ID NO: 204430 - RNA, 19 nt, Homo sapiens
ggguaaagccauuugaaga

SEQ ID NO: 204431 - RNA, 19 nt, Homo sapiens
cuucugugcucuccucuga

SEQ ID NO: 204432 - RNA, 19 nt, Homo sapiens
gaggguaaagccauuugaa

SEQ ID NO: 204433 - RNA, 19 nt, Homo sapiens
gagauaugaggcacccuuu

SEQ ID NO: 204434 - RNA, 19 nt, Homo sapiens
gguggaacagcuuaagauu

SEQ ID NO: 204435 - RNA, 19 nt, Homo sapiens
gaacagcuuaagauugaag

SEQ ID NO: 204436 - RNA, 19 nt, Homo sapiens
gcacccauuucaggcagaa

SEQ ID NO: 204437 - RNA, 19 nt, Homo sapiens
ccugaugacuuacugugau

SEQ ID NO: 204438 - RNA, 19 nt, Homo sapiens
gcagcagaccugaugacuu

SEQ ID NO: 204439 - RNA, 19 nt, Homo sapiens
uuccuuaggucaguaauug

SEQ ID NO: 204440 - RNA, 19 nt, Homo sapiens
ggaacagcuuaagauugaa

SEQ ID NO: 204441 - RNA, 19 nt, Homo sapiens
ccggugaacagcacuauga

SEQ ID NO: 204442 - RNA, 19 nt, Homo sapiens
uagcauccuucauccuuca

SEQ ID NO: 204443 - RNA, 19 nt, Homo sapiens
guggaacagcuuaagauug

SEQ ID NO: 204444 - RNA, 19 nt, Homo sapiens
gccagcuugugucggauaa

SEQ ID NO: 204445 - RNA, 19 nt, Homo sapiens
gauaugaggcacccuuugc

SEQ ID NO: 204446 - RNA, 19 nt, Homo sapiens
ggaggguaaagccauuuga

SEQ ID NO: 204447 - RNA, 19 nt, Homo sapiens
ucggugaccugcucagaca

SEQ ID NO: 204448 - RNA, 19 nt, Homo sapiens
caagaugguggaacagcuu

SEQ ID NO: 204449 - RNA, 19 nt, Homo sapiens
agucacugcuucugcauca

SEQ ID NO: 204450 - RNA, 19 nt, Homo sapiens
ggagcuacugggaggguaa

SEQ ID NO: 204451 - RNA, 19 nt, Homo sapiens
ggcccacccucaccuaucu

SEQ ID NO: 204452 - RNA, 19 nt, Homo sapiens
ugaacagcacuaugaguau

SEQ ID NO: 204453 - RNA, 19 nt, Homo sapiens
gggaugggccagguucuug

SEQ ID NO: 204454 - RNA, 19 nt, Homo sapiens
cagcuugugucggauaaag

SEQ ID NO: 204455 - RNA, 19 nt, Homo sapiens
gccugaccaugugagguua

SEQ ID NO: 204456 - RNA, 19 nt, Homo sapiens
ggcagcagcagaccugaug

SEQ ID NO: 204457 - RNA, 19 nt, Homo sapiens
cacgcaagaugguggaaca

SEQ ID NO: 204458 - RNA, 19 nt, Homo sapiens
gaccugcucagacaaugga

SEQ ID NO: 204459 - RNA, 19 nt, Homo sapiens
uaccagccauccagacagu

SEQ ID NO: 204460 - RNA, 19 nt, Homo sapiens
cccauuuccuaccaccuuu

SEQ ID NO: 204461 - RNA, 19 nt, Homo sapiens
gugaugcccacgccuguga

SEQ ID NO: 204462 - RNA, 19 nt, Homo sapiens
ccaggggccuccuuuccua

SEQ ID NO: 204463 - RNA, 19 nt, Homo sapiens
ucuccugggcccuuccuua

SEQ ID NO: 204464 - RNA, 19 nt, Homo sapiens
caaggcccacccucaccua

SEQ ID NO: 204465 - RNA, 19 nt, Homo sapiens
ccugggcccuuccuuaggu

SEQ ID NO: 204466 - RNA, 19 nt, Homo sapiens
cugaugacuuacugugaug

SEQ ID NO: 204467 - RNA, 19 nt, Homo sapiens
gguaccagccauccagaca

SEQ ID NO: 204468 - RNA, 19 nt, Homo sapiens
cagauacuuucagcugcaa

SEQ ID NO: 204469 - RNA, 19 nt, Homo sapiens
ugcuugagcugcagaaacu

SEQ ID NO: 204470 - RNA, 19 nt, Homo sapiens
gggccuccuuuccuauagu

SEQ ID NO: 204471 - RNA, 19 nt, Homo sapiens
uaacaaaugugccauguaa

SEQ ID NO: 204472 - RNA, 19 nt, Homo sapiens
gaaagcagcugcagagguu

SEQ ID NO: 204473 - RNA, 19 nt, Homo sapiens
ggaagauccucucaucauu

SEQ ID NO: 204474 - RNA, 19 nt, Homo sapiens
aaagagggcaugucuaaua

SEQ ID NO: 204475 - RNA, 19 nt, Homo sapiens
gagcauuggugugcauuaa

SEQ ID NO: 204476 - RNA, 19 nt, Homo sapiens
ugaaagagggcaugucuaa

SEQ ID NO: 204477 - RNA, 19 nt, Homo sapiens
gcauuaagguacucaaucu

SEQ ID NO: 204478 - RNA, 19 nt, Homo sapiens
cugaguagcugggaucaua

SEQ ID NO: 204479 - RNA, 19 nt, Homo sapiens
aagagggcaugucuaauaa

SEQ ID NO: 204480 - RNA, 19 nt, Homo sapiens
ccaaagcgcugggauuaca

SEQ ID NO: 204481 - RNA, 19 nt, Homo sapiens
ccacaggauuggaaugguu

SEQ ID NO: 204482 - RNA, 19 nt, Homo sapiens
ggaugucccuuguuucagu

SEQ ID NO: 204483 - RNA, 19 nt, Homo sapiens
gaagauccucucaucauuc

SEQ ID NO: 204484 - RNA, 19 nt, Homo sapiens
gagggcaugucuaauaaca

SEQ ID NO: 204485 - RNA, 19 nt, Homo sapiens
auugugggcugcaguaaua

SEQ ID NO: 204486 - RNA, 19 nt, Homo sapiens
gacaacaacccacaggauu

SEQ ID NO: 204487 - RNA, 19 nt, Homo sapiens
gcgggaagauccucucauc

SEQ ID NO: 204488 - RNA, 19 nt, Homo sapiens
gaccaacugaaacauauaa

SEQ ID NO: 204489 - RNA, 19 nt, Homo sapiens
gaccaugcaugcucuaaac

SEQ ID NO: 204490 - RNA, 19 nt, Homo sapiens
caccacacccagcuaauuu

SEQ ID NO: 204491 - RNA, 19 nt, Homo sapiens
aacaucaguuuccaaguuu

SEQ ID NO: 204492 - RNA, 19 nt, Homo sapiens
gggaagauccucucaucau

SEQ ID NO: 204493 - RNA, 19 nt, Homo sapiens
gcauuggugugcauuaagg

SEQ ID NO: 204494 - RNA, 19 nt, Homo sapiens
caagucaucugagcauugg

SEQ ID NO: 204495 - RNA, 19 nt, Homo sapiens
ucuaauaacagcaccacua

SEQ ID NO: 204496 - RNA, 19 nt, Homo sapiens
gaaguucuuuuguaccauu

SEQ ID NO: 204497 - RNA, 19 nt, Homo sapiens
ggaaugguuuucuuuuguu

SEQ ID NO: 204498 - RNA, 19 nt, Homo sapiens
gcauuuccaucauccuagu

SEQ ID NO: 204499 - RNA, 19 nt, Homo sapiens
acucaaucuuccaacaaua

SEQ ID NO: 204500 - RNA, 19 nt, Homo sapiens
guacucaaucuuccaacaa

SEQ ID NO: 204501 - RNA, 19 nt, Homo sapiens
gguacucaaucuuccaaca

SEQ ID NO: 204502 - RNA, 19 nt, Homo sapiens
gggcuugucuuauguuucc

SEQ ID NO: 204503 - RNA, 19 nt, Homo sapiens
gaaagagggcaugucuaau

SEQ ID NO: 204504 - RNA, 19 nt, Homo sapiens
caacugaaacauauaacgu

SEQ ID NO: 204505 - RNA, 19 nt, Homo sapiens
ugguggaugucccuuguuu

SEQ ID NO: 204506 - RNA, 19 nt, Homo sapiens
ccaagucaucugagcauug

SEQ ID NO: 204507 - RNA, 19 nt, Homo sapiens
uggagcagcuaaagaugga

SEQ ID NO: 204508 - RNA, 19 nt, Homo sapiens
gggcugcaguaauauaagg

SEQ ID NO: 204509 - RNA, 19 nt, Homo sapiens
ccaccacacccagcuaauu

SEQ ID NO: 204510 - RNA, 19 nt, Homo sapiens
uugaccaacugaaacauau

SEQ ID NO: 204511 - RNA, 19 nt, Homo sapiens
aauaacaaaugugccaugu

SEQ ID NO: 204512 - RNA, 19 nt, Homo sapiens
ugucuuauguuuccaucug

SEQ ID NO: 204513 - RNA, 19 nt, Homo sapiens
guggaugucccuuguuuca

SEQ ID NO: 204514 - RNA, 19 nt, Homo sapiens
acaacaacccacaggauug

SEQ ID NO: 204515 - RNA, 19 nt, Homo sapiens
acaucaguuuccaaguuua

SEQ ID NO: 204516 - RNA, 19 nt, Homo sapiens
caugcaugcucuaaaccuu

SEQ ID NO: 204517 - RNA, 19 nt, Homo sapiens
gaaugguuuucuuagcaua

SEQ ID NO: 204518 - RNA, 19 nt, Homo sapiens
aaacuaugccuaaauaucc

SEQ ID NO: 204519 - RNA, 19 nt, Homo sapiens
uccagugccugcaucagaa

SEQ ID NO: 204520 - RNA, 19 nt, Homo sapiens
cuaacuccgugugugauga

SEQ ID NO: 204521 - RNA, 19 nt, Homo sapiens
cagugguccuacaaaggua

SEQ ID NO: 204522 - RNA, 19 nt, Homo sapiens
aaagauggaagccuguaug

SEQ ID NO: 204523 - RNA, 19 nt, Homo sapiens
cuaauaacagcaccacuag

SEQ ID NO: 204524 - RNA, 19 nt, Homo sapiens
caacaacccacaggauugg

SEQ ID NO: 204525 - RNA, 19 nt, Homo sapiens
aauaacagcaccacuagca

SEQ ID NO: 204526 - RNA, 19 nt, Homo sapiens
ugaccaacugaaacauaua

SEQ ID NO: 204527 - RNA, 19 nt, Homo sapiens
uacucaaucuuccaacaau

SEQ ID NO: 204528 - RNA, 19 nt, Homo sapiens
ugacagcaguccccuaugu

SEQ ID NO: 204529 - RNA, 19 nt, Homo sapiens
guaauauaaggaccuguuc

SEQ ID NO: 204530 - RNA, 19 nt, Homo sapiens
gugggcugcaguaauauaa

SEQ ID NO: 204531 - RNA, 19 nt, Homo sapiens
uggucaggcuggucucaaa

SEQ ID NO: 204532 - RNA, 19 nt, Homo sapiens
guucuguauuuccugcauu

SEQ ID NO: 204533 - RNA, 19 nt, Homo sapiens
cucaaucuuccaacaauaa

SEQ ID NO: 204534 - RNA, 19 nt, Homo sapiens
ggagugaggcauggugaca

SEQ ID NO: 204535 - RNA, 19 nt, Homo sapiens
caucaguuuccaaguuuau

SEQ ID NO: 204536 - RNA, 19 nt, Homo sapiens
uaaagauggaagccuguau

SEQ ID NO: 204537 - RNA, 19 nt, Homo sapiens
ggucuccccucuccaaaug

SEQ ID NO: 204538 - RNA, 19 nt, Homo sapiens
acaaaugugccauguaaaa

SEQ ID NO: 204539 - RNA, 19 nt, Homo sapiens
ucagugguccuacaaaggu

SEQ ID NO: 204540 - RNA, 19 nt, Homo sapiens
cgugguggaugucccuugu

SEQ ID NO: 204541 - RNA, 19 nt, Homo sapiens
gcacaggggcaguagaaug

SEQ ID NO: 204542 - RNA, 19 nt, Homo sapiens
uaacuccgugugugaugaa

SEQ ID NO: 204543 - RNA, 19 nt, Homo sapiens
gggcggacaccgaagucaa

SEQ ID NO: 204544 - RNA, 19 nt, Homo sapiens
agacaacaacccacaggau

SEQ ID NO: 204545 - RNA, 19 nt, Homo sapiens
gagaccaugcaugcucuaa

SEQ ID NO: 204546 - RNA, 19 nt, Homo sapiens
ggaaugguuuucuuagcau

SEQ ID NO: 204547 - RNA, 19 nt, Homo sapiens
ggauuggaaugguuuucuu

SEQ ID NO: 204548 - RNA, 19 nt, Homo sapiens
aaugugccauguaaaagua

SEQ ID NO: 204549 - RNA, 19 nt, Homo sapiens
cuucguggcauucaauuuc

SEQ ID NO: 204550 - RNA, 19 nt, Homo sapiens
ucucuaacuccguguguga

SEQ ID NO: 204551 - RNA, 19 nt, Homo sapiens
cacaggauuggaaugguuu

SEQ ID NO: 204552 - RNA, 19 nt, Homo sapiens
gcacagaaccggaaacuua

SEQ ID NO: 204553 - RNA, 19 nt, Homo sapiens
uaacacaugugccauaaua

SEQ ID NO: 204554 - RNA, 19 nt, Homo sapiens
caagagagcuacauuugaa

SEQ ID NO: 204555 - RNA, 19 nt, Homo sapiens
ccaggcagcugcagacuug

SEQ ID NO: 204556 - RNA, 19 nt, Homo sapiens
aaacugagaccuccuggua

SEQ ID NO: 204557 - RNA, 19 nt, Homo sapiens
acacaugugccauaauaua

SEQ ID NO: 204558 - RNA, 19 nt, Homo sapiens
ccaaaccacuccuuaugau

SEQ ID NO: 204559 - RNA, 19 nt, Homo sapiens
gcagaaugcucaacaugac

SEQ ID NO: 204560 - RNA, 19 nt, Homo sapiens
gccauaauauacaaacuuc

SEQ ID NO: 204561 - RNA, 19 nt, Homo sapiens
cgucaguccuuaacaucua

SEQ ID NO: 204562 - RNA, 19 nt, Homo sapiens
ggaguaucuucaaguacaa

SEQ ID NO: 204563 - RNA, 19 nt, Homo sapiens
gaagaaagugguucaacag

SEQ ID NO: 204564 - RNA, 19 nt, Homo sapiens
uguaacacaugugccauaa

SEQ ID NO: 204565 - RNA, 19 nt, Homo sapiens
uggaguaucuucaaguaca

SEQ ID NO: 204566 - RNA, 19 nt, Homo sapiens
gcuuaucccuguaacacau

SEQ ID NO: 204567 - RNA, 19 nt, Homo sapiens
acuggaguaucuucaagua

SEQ ID NO: 204568 - RNA, 19 nt, Homo sapiens
cugcagacuugaaacaguu

SEQ ID NO: 204569 - RNA, 19 nt, Homo sapiens
ccggaaacuuagagacaaa

SEQ ID NO: 204570 - RNA, 19 nt, Homo sapiens
caugugccauaauauacaa

SEQ ID NO: 204571 - RNA, 19 nt, Homo sapiens
gcugcagacuugaaacagu

SEQ ID NO: 204572 - RNA, 19 nt, Homo sapiens
cuuaugauccagugauauu

SEQ ID NO: 204573 - RNA, 19 nt, Homo sapiens
ugacuggaguaucuucaag

SEQ ID NO: 204574 - RNA, 19 nt, Homo sapiens
cccaaaccacuccuuauga

SEQ ID NO: 204575 - RNA, 19 nt, Homo sapiens
gauccagugauauucaaga

SEQ ID NO: 204576 - RNA, 19 nt, Homo sapiens
aaguacaaaucccuucaga

SEQ ID NO: 204577 - RNA, 19 nt, Homo sapiens
cgucgccgcuaugaagaaa

SEQ ID NO: 204578 - RNA, 19 nt, Homo sapiens
caaaagcuuaucccuguaa

SEQ ID NO: 204579 - RNA, 19 nt, Homo sapiens
uccuuaugauccagugaua

SEQ ID NO: 204580 - RNA, 19 nt, Homo sapiens
ugcagaaugcucaacauga

SEQ ID NO: 204581 - RNA, 19 nt, Homo sapiens
uucaagagagcuacauuug

SEQ ID NO: 204582 - RNA, 19 nt, Homo sapiens
caaaccacuccuuaugauc

SEQ ID NO: 204583 - RNA, 19 nt, Homo sapiens
ucccaaaccacuccuuaug

SEQ ID NO: 204584 - RNA, 19 nt, Homo sapiens
cacagaaccggaaacuuag

SEQ ID NO: 204585 - RNA, 19 nt, Homo sapiens
gagcacagaaccggaaacu

SEQ ID NO: 204586 - RNA, 19 nt, Homo sapiens
gggcaucauucaguaauua

SEQ ID NO: 204587 - RNA, 19 nt, Homo sapiens
gaggugacaucaugaaguu

SEQ ID NO: 204588 - RNA, 19 nt, Homo sapiens
ggaaugcuuuguguuguuu

SEQ ID NO: 204589 - RNA, 19 nt, Homo sapiens
cgucugaccucaugagcua

SEQ ID NO: 204590 - RNA, 19 nt, Homo sapiens
gagaauuggccauugguaa

SEQ ID NO: 204591 - RNA, 19 nt, Homo sapiens
gaacagcuacgcauagaag

SEQ ID NO: 204592 - RNA, 19 nt, Homo sapiens
uaacuguguucucauaugu

SEQ ID NO: 204593 - RNA, 19 nt, Homo sapiens
ggcagggcaucauucagua

SEQ ID NO: 204594 - RNA, 19 nt, Homo sapiens
ucacuggaaugcuuugugu

SEQ ID NO: 204595 - RNA, 19 nt, Homo sapiens
cccauggccuucucaguuu

SEQ ID NO: 204596 - RNA, 19 nt, Homo sapiens
ggcgggaggugacaucaug

SEQ ID NO: 204597 - RNA, 19 nt, Homo sapiens
ggcaauaguuccgggagaa

SEQ ID NO: 204598 - RNA, 19 nt, Homo sapiens
ccagagugauggcagacaa

SEQ ID NO: 204599 - RNA, 19 nt, Homo sapiens
ggagaauuggccauuggua

SEQ ID NO: 204600 - RNA, 19 nt, Homo sapiens
ucucauauguucucucucu

SEQ ID NO: 204601 - RNA, 19 nt, Homo sapiens
gucagccacuaacaacaua

SEQ ID NO: 204602 - RNA, 19 nt, Homo sapiens
gcaucaaggucuccaaagc

SEQ ID NO: 204603 - RNA, 19 nt, Homo sapiens
gcauagaagccgggauuga

SEQ ID NO: 204604 - RNA, 19 nt, Homo sapiens
agaauuggccauugguaaa

SEQ ID NO: 204605 - RNA, 19 nt, Homo sapiens
ccuuguagguggagaugaa

SEQ ID NO: 204606 - RNA, 19 nt, Homo sapiens
gcagggcaucauucaguaa

SEQ ID NO: 204607 - RNA, 19 nt, Homo sapiens
gcgaugggguaacaauuuu

SEQ ID NO: 204608 - RNA, 19 nt, Homo sapiens
ggaggugacaucaugaagu

SEQ ID NO: 204609 - RNA, 19 nt, Homo sapiens
gguggaacagcuacgcaua

SEQ ID NO: 204610 - RNA, 19 nt, Homo sapiens
gggaaagggaggugacuuc

SEQ ID NO: 204611 - RNA, 19 nt, Homo sapiens
guucucauauguucucucu

SEQ ID NO: 204612 - RNA, 19 nt, Homo sapiens
gagcuacugugagcaacau

SEQ ID NO: 204613 - RNA, 19 nt, Homo sapiens
uggaaugcuuuguguuguu

SEQ ID NO: 204614 - RNA, 19 nt, Homo sapiens
uagggucacuggaaugcuu

SEQ ID NO: 204615 - RNA, 19 nt, Homo sapiens
uggaacagcuacgcauaga

SEQ ID NO: 204616 - RNA, 19 nt, Homo sapiens
cccggaagcugguggaaca

SEQ ID NO: 204617 - RNA, 19 nt, Homo sapiens
gcgcaucaaggucuccaaa

SEQ ID NO: 204618 - RNA, 19 nt, Homo sapiens
ggaacagcuacgcauagaa

SEQ ID NO: 204619 - RNA, 19 nt, Homo sapiens
caaugucagccacuaacaa

SEQ ID NO: 204620 - RNA, 19 nt, Homo sapiens
auaacuguguucucauaug

SEQ ID NO: 204621 - RNA, 19 nt, Homo sapiens
caauaguuccgggagaauu

SEQ ID NO: 204622 - RNA, 19 nt, Homo sapiens
cuucauagggucacuggaa

SEQ ID NO: 204623 - RNA, 19 nt, Homo sapiens
ccaaaaccuuuaauuccaa

SEQ ID NO: 204624 - RNA, 19 nt, Homo sapiens
ggguagaauggaccuugua

SEQ ID NO: 204625 - RNA, 19 nt, Homo sapiens
ccauggccuucucaguuug

SEQ ID NO: 204626 - RNA, 19 nt, Homo sapiens
gcaauaguuccgggagaau

SEQ ID NO: 204627 - RNA, 19 nt, Homo sapiens
uguagguggagaugaauuu

SEQ ID NO: 204628 - RNA, 19 nt, Homo sapiens
aaacaaaacaucucaaguc

SEQ ID NO: 204629 - RNA, 19 nt, Homo sapiens
cgggagaauuggccauugg

SEQ ID NO: 204630 - RNA, 19 nt, Homo sapiens
gguagaauggaccuuguag

SEQ ID NO: 204631 - RNA, 19 nt, Homo sapiens
cauagaagccgggauugag

SEQ ID NO: 204632 - RNA, 19 nt, Homo sapiens
acuguguucucauauguuc

SEQ ID NO: 204633 - RNA, 19 nt, Homo sapiens
acgcauagaagccgggauu

SEQ ID NO: 204634 - RNA, 19 nt, Homo sapiens
aauaguuccgggagaauug

SEQ ID NO: 204635 - RNA, 19 nt, Homo sapiens
ucaguaauuagcucaaaca

SEQ ID NO: 204636 - RNA, 19 nt, Homo sapiens
caugagcuacugugagcaa

SEQ ID NO: 204637 - RNA, 19 nt, Homo sapiens
ucacagauauucaugaguu

SEQ ID NO: 204638 - RNA, 19 nt, Homo sapiens
cugcagagcuucaacagua

SEQ ID NO: 204639 - RNA, 19 nt, Homo sapiens
uugaagagcuuggaaauaa

SEQ ID NO: 204640 - RNA, 19 nt, Homo sapiens
aaaugcaccucuuucauaa

SEQ ID NO: 204641 - RNA, 19 nt, Homo sapiens
caacugaugucuugauuuu

SEQ ID NO: 204642 - RNA, 19 nt, Homo sapiens
gcaccucuuucauaaguga

SEQ ID NO: 204643 - RNA, 19 nt, Homo sapiens
gaccagaaaguacaaauug

SEQ ID NO: 204644 - RNA, 19 nt, Homo sapiens
ggaauaucauguauguuuc

SEQ ID NO: 204645 - RNA, 19 nt, Homo sapiens
ggaggaagaauaggcuuua

SEQ ID NO: 204646 - RNA, 19 nt, Homo sapiens
gagccuagauccugugcuu

SEQ ID NO: 204647 - RNA, 19 nt, Homo sapiens
gggagcagauucuuagcaa

SEQ ID NO: 204648 - RNA, 19 nt, Homo sapiens
ggaaugccuucaagcacaa

SEQ ID NO: 204649 - RNA, 19 nt, Homo sapiens
ugaagagcuuggaaauaaa

SEQ ID NO: 204650 - RNA, 19 nt, Homo sapiens
gaaguuugcugaggaaugc

SEQ ID NO: 204651 - RNA, 19 nt, Homo sapiens
cgaugugccuuugauuuaa

SEQ ID NO: 204652 - RNA, 19 nt, Homo sapiens
uaaaugggaagauugcuuu

SEQ ID NO: 204653 - RNA, 19 nt, Homo sapiens
gccuagauccugugcuuua

SEQ ID NO: 204654 - RNA, 19 nt, Homo sapiens
ugggaagauugcuuuauuu

SEQ ID NO: 204655 - RNA, 19 nt, Homo sapiens
ccuggaauaucauguaugu

SEQ ID NO: 204656 - RNA, 19 nt, Homo sapiens
gaugugccuuugauuuaau

SEQ ID NO: 204657 - RNA, 19 nt, Homo sapiens
gacgaugugccuuugauuu

SEQ ID NO: 204658 - RNA, 19 nt, Homo sapiens
ggcuguacuuaaagaaaua

SEQ ID NO: 204659 - RNA, 19 nt, Homo sapiens
ggagcagauucuuagcaaa

SEQ ID NO: 204660 - RNA, 19 nt, Homo sapiens
ggauacauuauucguguuu

SEQ ID NO: 204661 - RNA, 19 nt, Homo sapiens
gcagauucuuagcaaacuu

SEQ ID NO: 204662 - RNA, 19 nt, Homo sapiens
gaggaagaauaggcuuuau

SEQ ID NO: 204663 - RNA, 19 nt, Homo sapiens
aaaugaagaccagaaagua

SEQ ID NO: 204664 - RNA, 19 nt, Homo sapiens
ccuguggccugguccuaua

SEQ ID NO: 204665 - RNA, 19 nt, Homo sapiens
acgaugugccuuugauuua

SEQ ID NO: 204666 - RNA, 19 nt, Homo sapiens
aaaacugggugaaggaaua

SEQ ID NO: 204667 - RNA, 19 nt, Homo sapiens
agagauauuucagcccuuu

SEQ ID NO: 204668 - RNA, 19 nt, Homo sapiens
gggugaaggaauagaauuu

SEQ ID NO: 204669 - RNA, 19 nt, Homo sapiens
cauaagugaguuacuaaga

SEQ ID NO: 204670 - RNA, 19 nt, Homo sapiens
gcugaggaaugccuucaag

SEQ ID NO: 204671 - RNA, 19 nt, Homo sapiens
aguuguggcuguacuuaaa

SEQ ID NO: 204672 - RNA, 19 nt, Homo sapiens
augggaagauugcuuuauu

SEQ ID NO: 204673 - RNA, 19 nt, Homo sapiens
aaaaugcaccucuuucaua

SEQ ID NO: 204674 - RNA, 19 nt, Homo sapiens
aaccuuaccaccaaacaua

SEQ ID NO: 204675 - RNA, 19 nt, Homo sapiens
guaguuguggcuguacuua

SEQ ID NO: 204676 - RNA, 19 nt, Homo sapiens
auucaugaguuucuacuug

SEQ ID NO: 204677 - RNA, 19 nt, Homo sapiens
agagaaguuugcugaggaa

SEQ ID NO: 204678 - RNA, 19 nt, Homo sapiens
gagcagauucuuagcaaac

SEQ ID NO: 204679 - RNA, 19 nt, Homo sapiens
cacagauauucaugaguuu

SEQ ID NO: 204680 - RNA, 19 nt, Homo sapiens
gaagagcuuggaaauaaaa

SEQ ID NO: 204681 - RNA, 19 nt, Homo sapiens
uggcuguacuuaaagaaau

SEQ ID NO: 204682 - RNA, 19 nt, Homo sapiens
uucuauaccuggaauauca

SEQ ID NO: 204683 - RNA, 19 nt, Homo sapiens
gccuucaagucucaagaaa

SEQ ID NO: 204684 - RNA, 19 nt, Homo sapiens
agcacaaagugaugaauga

SEQ ID NO: 204685 - RNA, 19 nt, Homo sapiens
gauacauuauucguguuug

SEQ ID NO: 204686 - RNA, 19 nt, Homo sapiens
gauuuaauuugggacacuu

SEQ ID NO: 204687 - RNA, 19 nt, Homo sapiens
ucugaagacucgagagaag

SEQ ID NO: 204688 - RNA, 19 nt, Homo sapiens
gggaggaagaauaggcuuu

SEQ ID NO: 204689 - RNA, 19 nt, Homo sapiens
ugaagacucgagagaaguu

SEQ ID NO: 204690 - RNA, 19 nt, Homo sapiens
aaucacagauauucaugag

SEQ ID NO: 204691 - RNA, 19 nt, Homo sapiens
gaagacucgagagaaguuu

SEQ ID NO: 204692 - RNA, 19 nt, Homo sapiens
uaccuggaauaucauguau

SEQ ID NO: 204693 - RNA, 19 nt, Homo sapiens
gaagaccagaaaguacaaa

SEQ ID NO: 204694 - RNA, 19 nt, Homo sapiens
uucaugaguuucuacuuga

SEQ ID NO: 204695 - RNA, 19 nt, Homo sapiens
caaauugcugggaggaaga

SEQ ID NO: 204696 - RNA, 19 nt, Homo sapiens
uccuggaaguuauuuauuc

SEQ ID NO: 204697 - RNA, 19 nt, Homo sapiens
uaugggagcagauucuuag

SEQ ID NO: 204698 - RNA, 19 nt, Homo sapiens
cuaauuaugggagcagauu

SEQ ID NO: 204699 - RNA, 19 nt, Homo sapiens
gggaagauugcuuuauuuu

SEQ ID NO: 204700 - RNA, 19 nt, Homo sapiens
agaccagaaaguacaaauu

SEQ ID NO: 204701 - RNA, 19 nt, Homo sapiens
caccaaacauaccaaaaug

SEQ ID NO: 204702 - RNA, 19 nt, Homo sapiens
uuacguuucucugcuuugu

SEQ ID NO: 204703 - RNA, 19 nt, Homo sapiens
ggcaaccgccuacgagaca

SEQ ID NO: 204704 - RNA, 19 nt, Homo sapiens
augcaccucuuucauaagu

SEQ ID NO: 204705 - RNA, 19 nt, Homo sapiens
ugaggaaugccuucaagca

SEQ ID NO: 204706 - RNA, 19 nt, Homo sapiens
cuuauaaacuguuguuccu

SEQ ID NO: 204707 - RNA, 19 nt, Homo sapiens
cgacgaugugccuuugauu

SEQ ID NO: 204708 - RNA, 19 nt, Homo sapiens
cuaaaugggaagauugcuu

SEQ ID NO: 204709 - RNA, 19 nt, Homo sapiens
auccugugcuuuacucuga

SEQ ID NO: 204710 - RNA, 19 nt, Homo sapiens
aaaugggaagauugcuuua

SEQ ID NO: 204711 - RNA, 19 nt, Homo sapiens
auaccuggaauaucaugua

SEQ ID NO: 204712 - RNA, 19 nt, Homo sapiens
uuaugggagcagauucuua

SEQ ID NO: 204713 - RNA, 19 nt, Homo sapiens
uagccaaaaucacagauau

SEQ ID NO: 204714 - RNA, 19 nt, Homo sapiens
ucgacgaugugccuuugau

SEQ ID NO: 204715 - RNA, 19 nt, Homo sapiens
gacccacagaacauuguaa

SEQ ID NO: 204716 - RNA, 19 nt, Homo sapiens
cccaucguguauauaaaug

SEQ ID NO: 204717 - RNA, 19 nt, Homo sapiens
aagcacaaagugaugaaug

SEQ ID NO: 204718 - RNA, 19 nt, Homo sapiens
gaacauuacuugagcauga

SEQ ID NO: 204719 - RNA, 19 nt, Homo sapiens
gggagaaacugcauccuaa

SEQ ID NO: 204720 - RNA, 19 nt, Homo sapiens
gcagcuguguuauuucaua

SEQ ID NO: 204721 - RNA, 19 nt, Homo sapiens
aaaggcagcuguguuauuu

SEQ ID NO: 204722 - RNA, 19 nt, Homo sapiens
ggaaggaagaaugaaauua

SEQ ID NO: 204723 - RNA, 19 nt, Homo sapiens
gcagagaguaucagaugua

SEQ ID NO: 204724 - RNA, 19 nt, Homo sapiens
ggacccagucucaaacuua

SEQ ID NO: 204725 - RNA, 19 nt, Homo sapiens
ugacacuucuuucaguaua

SEQ ID NO: 204726 - RNA, 19 nt, Homo sapiens
uaaagggaauuccagaaga

SEQ ID NO: 204727 - RNA, 19 nt, Homo sapiens
gacccagucucaaacuuaa

SEQ ID NO: 204728 - RNA, 19 nt, Homo sapiens
gagcagagaguaucagaug

SEQ ID NO: 204729 - RNA, 19 nt, Homo sapiens
gagaguaucagauguacaa

SEQ ID NO: 204730 - RNA, 19 nt, Homo sapiens
gcaugacacuucuuucagu

SEQ ID NO: 204731 - RNA, 19 nt, Homo sapiens
gcagaguucucagguccua

SEQ ID NO: 204732 - RNA, 19 nt, Homo sapiens
aaacuuaacccucaucuag

SEQ ID NO: 204733 - RNA, 19 nt, Homo sapiens
caugacacuucuuucagua

SEQ ID NO: 204734 - RNA, 19 nt, Homo sapiens
gagcaugacacuucuuuca

SEQ ID NO: 204735 - RNA, 19 nt, Homo sapiens
ugacaagcgucccggagaa

SEQ ID NO: 204736 - RNA, 19 nt, Homo sapiens
gaacuauauugaagaacgu

SEQ ID NO: 204737 - RNA, 19 nt, Homo sapiens
uaaggaaggaagaaugaaa

SEQ ID NO: 204738 - RNA, 19 nt, Homo sapiens
ggaagaacuaguuguuuua

SEQ ID NO: 204739 - RNA, 19 nt, Homo sapiens
ucgaagauuugccagagaa

SEQ ID NO: 204740 - RNA, 19 nt, Homo sapiens
caucuuugcucacuaugca

SEQ ID NO: 204741 - RNA, 19 nt, Homo sapiens
cauaugugcuacucaucuu

SEQ ID NO: 204742 - RNA, 19 nt, Homo sapiens
guaaagggaauuccagaag

SEQ ID NO: 204743 - RNA, 19 nt, Homo sapiens
gagaaacugcauccuaagu

SEQ ID NO: 204744 - RNA, 19 nt, Homo sapiens
caagaaccccuuuaaagaa

SEQ ID NO: 204745 - RNA, 19 nt, Homo sapiens
gacacuucuuucaguauau

SEQ ID NO: 204746 - RNA, 19 nt, Homo sapiens
gaguaucagauguacaauu

SEQ ID NO: 204747 - RNA, 19 nt, Homo sapiens
gauaaaaccaacaugcuuu

SEQ ID NO: 204748 - RNA, 19 nt, Homo sapiens
cuaaguggaagaacuaguu

SEQ ID NO: 204749 - RNA, 19 nt, Homo sapiens
uaaauaacuugggagaaac

SEQ ID NO: 204750 - RNA, 19 nt, Homo sapiens
uggaagaacuaguuguuuu

SEQ ID NO: 204751 - RNA, 19 nt, Homo sapiens
gagagcagagaguaucaga

SEQ ID NO: 204752 - RNA, 19 nt, Homo sapiens
uaagagagcagagaguauc

SEQ ID NO: 204753 - RNA, 19 nt, Homo sapiens
aggcagcuguguuauuuca

SEQ ID NO: 204754 - RNA, 19 nt, Homo sapiens
acaagugucuaaauguucu

SEQ ID NO: 204755 - RNA, 19 nt, Homo sapiens
gaaaaugccugcccuucac

SEQ ID NO: 204756 - RNA, 19 nt, Homo sapiens
acucaucuuugcucacuau

SEQ ID NO: 204757 - RNA, 19 nt, Homo sapiens
gcauaugugcuacucaucu

SEQ ID NO: 204758 - RNA, 19 nt, Homo sapiens
uugagcagcuucgcaaaga

SEQ ID NO: 204759 - RNA, 19 nt, Homo sapiens
caaacuuaacccucaucua

SEQ ID NO: 204760 - RNA, 19 nt, Homo sapiens
uauauugcuugaugcuuca

SEQ ID NO: 204761 - RNA, 19 nt, Homo sapiens
gaagacaagaaccccuuua

SEQ ID NO: 204762 - RNA, 19 nt, Homo sapiens
gcuuggacccagucucaaa

SEQ ID NO: 204763 - RNA, 19 nt, Homo sapiens
gccaggccuucaguuguuu

SEQ ID NO: 204764 - RNA, 19 nt, Homo sapiens
cauccuaaguggaagaacu

SEQ ID NO: 204765 - RNA, 19 nt, Homo sapiens
gacaagaaccccuuuaaag

SEQ ID NO: 204766 - RNA, 19 nt, Homo sapiens
aaagggaauuccagaagac

SEQ ID NO: 204767 - RNA, 19 nt, Homo sapiens
uucaguauauugcuugaug

SEQ ID NO: 204768 - RNA, 19 nt, Homo sapiens
ugagcagcuucgcaaagaa

SEQ ID NO: 204769 - RNA, 19 nt, Homo sapiens
guggaagaacuaguuguuu

SEQ ID NO: 204770 - RNA, 19 nt, Homo sapiens
ggagaaacugcauccuaag

SEQ ID NO: 204771 - RNA, 19 nt, Homo sapiens
aagaaccccuuuaaagaaa

SEQ ID NO: 204772 - RNA, 19 nt, Homo sapiens
acaagaaccccuuuaaaga

SEQ ID NO: 204773 - RNA, 19 nt, Homo sapiens
acaacaagugucuaaaugu

SEQ ID NO: 204774 - RNA, 19 nt, Homo sapiens
gacaagcgucccggagaaa

SEQ ID NO: 204775 - RNA, 19 nt, Homo sapiens
cuacucaucuuugcucacu

SEQ ID NO: 204776 - RNA, 19 nt, Homo sapiens
ugggagaaacugcauccua

SEQ ID NO: 204777 - RNA, 19 nt, Homo sapiens
gaauuccagaagacaagaa

SEQ ID NO: 204778 - RNA, 19 nt, Homo sapiens
ucgcaaagaagugaaguug

SEQ ID NO: 204779 - RNA, 19 nt, Homo sapiens
cagagaguaucagauguac

SEQ ID NO: 204780 - RNA, 19 nt, Homo sapiens
uaaguggaagaacuaguug

SEQ ID NO: 204781 - RNA, 19 nt, Homo sapiens
uuuaaggaaggaagaauga

SEQ ID NO: 204782 - RNA, 19 nt, Homo sapiens
agaaacugcauccuaagug

SEQ ID NO: 204783 - RNA, 19 nt, Homo sapiens
ggaauuccagaagacaaga

SEQ ID NO: 204784 - RNA, 19 nt, Homo sapiens
ucagauguacaauuaugga

SEQ ID NO: 204785 - RNA, 19 nt, Homo sapiens
uuuaagagagcagagagua

SEQ ID NO: 204786 - RNA, 19 nt, Homo sapiens
gggaauuccagaagacaag

SEQ ID NO: 204787 - RNA, 19 nt, Homo sapiens
acuuaacccucaucuagca

SEQ ID NO: 204788 - RNA, 19 nt, Homo sapiens
gugucuaaauguucugaag

SEQ ID NO: 204789 - RNA, 19 nt, Homo sapiens
aagugaaguugcagagaca

SEQ ID NO: 204790 - RNA, 19 nt, Homo sapiens
caaauguugugaagaagua

SEQ ID NO: 204791 - RNA, 19 nt, Homo sapiens
gcugugugauuucauaaua

SEQ ID NO: 204792 - RNA, 19 nt, Homo sapiens
caaaggaggcugugugauu

SEQ ID NO: 204793 - RNA, 19 nt, Homo sapiens
gugaagaaguaagagauua

SEQ ID NO: 204794 - RNA, 19 nt, Homo sapiens
aaaggaggcugugugauuu

SEQ ID NO: 204795 - RNA, 19 nt, Homo sapiens
gaggcugugugauuucaua

SEQ ID NO: 204796 - RNA, 19 nt, Homo sapiens
aaagaaugcuaguuuccaa

SEQ ID NO: 204797 - RNA, 19 nt, Homo sapiens
gaaugcuaguuuccaaaug

SEQ ID NO: 204798 - RNA, 19 nt, Homo sapiens
uggcgaggauccacuggua

SEQ ID NO: 204799 - RNA, 19 nt, Homo sapiens
uuccaaauguugugaagaa

SEQ ID NO: 204800 - RNA, 19 nt, Homo sapiens
aauugaagauggaaguuga

SEQ ID NO: 204801 - RNA, 19 nt, Homo sapiens
gcgaggauccacugguaaa

SEQ ID NO: 204802 - RNA, 19 nt, Homo sapiens
agaacgaucuggcgaggau

SEQ ID NO: 204803 - RNA, 19 nt, Homo sapiens
uaagagauuacguugaaga

SEQ ID NO: 204804 - RNA, 19 nt, Homo sapiens
gaaaaggacaaauugaaga

SEQ ID NO: 204805 - RNA, 19 nt, Homo sapiens
aaagaugccaguaaucaau

SEQ ID NO: 204806 - RNA, 19 nt, Homo sapiens
aaugcuaguuuccaaaugu

SEQ ID NO: 204807 - RNA, 19 nt, Homo sapiens
cuggaaagaaugcuaguuu

SEQ ID NO: 204808 - RNA, 19 nt, Homo sapiens
ggacaaauugaagauggaa

SEQ ID NO: 204809 - RNA, 19 nt, Homo sapiens
cuaagcauguacgugaauu

SEQ ID NO: 204810 - RNA, 19 nt, Homo sapiens
aagaugccaguaaucaaua

SEQ ID NO: 204811 - RNA, 19 nt, Homo sapiens
gggcaucccagaggacaaa

SEQ ID NO: 204812 - RNA, 19 nt, Homo sapiens
ugacagaaaaggacaaauu

SEQ ID NO: 204813 - RNA, 19 nt, Homo sapiens
gcucaagaaagaagugaca

SEQ ID NO: 204814 - RNA, 19 nt, Homo sapiens
caaauugaagauggaaguu

SEQ ID NO: 204815 - RNA, 19 nt, Homo sapiens
uaagcauguacgugaauuu

SEQ ID NO: 204816 - RNA, 19 nt, Homo sapiens
cagaaaaggacaaauugaa

SEQ ID NO: 204817 - RNA, 19 nt, Homo sapiens
ccaaauguugugaagaagu

SEQ ID NO: 204818 - RNA, 19 nt, Homo sapiens
gacagaaaaggacaaauug

SEQ ID NO: 204819 - RNA, 19 nt, Homo sapiens
agaugccaguaaucaauau

SEQ ID NO: 204820 - RNA, 19 nt, Homo sapiens
gaccagcucaagaaagaag

SEQ ID NO: 204821 - RNA, 19 nt, Homo sapiens
uugaggaccugacagaaaa

SEQ ID NO: 204822 - RNA, 19 nt, Homo sapiens
agaaugcuaguuuccaaau

SEQ ID NO: 204823 - RNA, 19 nt, Homo sapiens
gaaaggaaaucaaggagua

SEQ ID NO: 204824 - RNA, 19 nt, Homo sapiens
aaagguggcugucugauaa

SEQ ID NO: 204825 - RNA, 19 nt, Homo sapiens
acacaaagcaucuugguua

SEQ ID NO: 204826 - RNA, 19 nt, Homo sapiens
aaagaucccugaacaaaug

SEQ ID NO: 204827 - RNA, 19 nt, Homo sapiens
gaaagguggcugucugaua

SEQ ID NO: 204828 - RNA, 19 nt, Homo sapiens
guaaagaucccugaacaaa

SEQ ID NO: 204829 - RNA, 19 nt, Homo sapiens
ggacaagaaucccuucaag

SEQ ID NO: 204830 - RNA, 19 nt, Homo sapiens
gaguaaagaucccugaaca

SEQ ID NO: 204831 - RNA, 19 nt, Homo sapiens
agaaggaccuguugaagau

SEQ ID NO: 204832 - RNA, 19 nt, Homo sapiens
gagaaggaccuguugaaga

SEQ ID NO: 204833 - RNA, 19 nt, Homo sapiens
cuaggaggcucaaacacua

SEQ ID NO: 204834 - RNA, 19 nt, Homo sapiens
gaacuaggaggcucaaaca

SEQ ID NO: 204835 - RNA, 19 nt, Homo sapiens
uggagcagcugaagaaaga

SEQ ID NO: 204836 - RNA, 19 nt, Homo sapiens
cacaaagcaucuugguuaa

SEQ ID NO: 204837 - RNA, 19 nt, Homo sapiens
acacaagaauuccgauuuc

SEQ ID NO: 204838 - RNA, 19 nt, Homo sapiens
caaagcaucuugguuaagg

SEQ ID NO: 204839 - RNA, 19 nt, Homo sapiens
ccagauggccugaugacaa

SEQ ID NO: 204840 - RNA, 19 nt, Homo sapiens
gaacugucaccuucucuuc

SEQ ID NO: 204841 - RNA, 19 nt, Homo sapiens
gagaaagguggcugucuga

SEQ ID NO: 204842 - RNA, 19 nt, Homo sapiens
gaauuccgauuuccaaagc

SEQ ID NO: 204843 - RNA, 19 nt, Homo sapiens
ggaacacucugaggacagu

SEQ ID NO: 204844 - RNA, 19 nt, Homo sapiens
gagcuaggagaacuucgua

SEQ ID NO: 204845 - RNA, 19 nt, Homo sapiens
caagaauuccgauuuccaa

SEQ ID NO: 204846 - RNA, 19 nt, Homo sapiens
aaacacuacuuaccugagu

SEQ ID NO: 204847 - RNA, 19 nt, Homo sapiens
gcauuuccacgccagagua

SEQ ID NO: 204848 - RNA, 19 nt, Homo sapiens
uaaagaucccugaacaaau

SEQ ID NO: 204849 - RNA, 19 nt, Homo sapiens
gaggcucaaacacuacuua

SEQ ID NO: 204850 - RNA, 19 nt, Homo sapiens
gcgagaaggaccuguugaa

SEQ ID NO: 204851 - RNA, 19 nt, Homo sapiens
ggccaucugcuuuaucuga

SEQ ID NO: 204852 - RNA, 19 nt, Homo sapiens
uaggagaacuucguaaggu

SEQ ID NO: 204853 - RNA, 19 nt, Homo sapiens
gcugaagaaagaagugaaa

SEQ ID NO: 204854 - RNA, 19 nt, Homo sapiens
gccaucugcuuuaucugaa

SEQ ID NO: 204855 - RNA, 19 nt, Homo sapiens
cagauggccugaugacaac

SEQ ID NO: 204856 - RNA, 19 nt, Homo sapiens
caucacagaaugaguaaag

SEQ ID NO: 204857 - RNA, 19 nt, Homo sapiens
gggaagggaaggaggagaa

SEQ ID NO: 204858 - RNA, 19 nt, Homo sapiens
aaacgauccuuuucucaaa

SEQ ID NO: 204859 - RNA, 19 nt, Homo sapiens
uaucauguccuacccuaug

SEQ ID NO: 204860 - RNA, 19 nt, Homo sapiens
caucugcuuuaucugaaga

SEQ ID NO: 204861 - RNA, 19 nt, Homo sapiens
ggaagggaaggaggagaaa

SEQ ID NO: 204862 - RNA, 19 nt, Homo sapiens
caacucuuuucucccauua

SEQ ID NO: 204863 - RNA, 19 nt, Homo sapiens
gagugucugucccucuuca

SEQ ID NO: 204864 - RNA, 19 nt, Homo sapiens
ccaaagcgggaaaggaaau

SEQ ID NO: 204865 - RNA, 19 nt, Homo sapiens
caacacaaagcaucuuggu

SEQ ID NO: 204866 - RNA, 19 nt, Homo sapiens
aaacacaagaauuccgauu

SEQ ID NO: 204867 - RNA, 19 nt, Homo sapiens
aagaguuugugaaguuaug

SEQ ID NO: 204868 - RNA, 19 nt, Homo sapiens
acucucauccuaggaauaa

SEQ ID NO: 204869 - RNA, 19 nt, Homo sapiens
gcucaaacacuacuuaccu

SEQ ID NO: 204870 - RNA, 19 nt, Homo sapiens
cugaugacaacaagaguuu

SEQ ID NO: 204871 - RNA, 19 nt, Homo sapiens
gauccaaugggcaacacaa

SEQ ID NO: 204872 - RNA, 19 nt, Homo sapiens
gagaacuucguaaggugaa

SEQ ID NO: 204873 - RNA, 19 nt, Homo sapiens
gcuaggagaacuucguaag

SEQ ID NO: 204874 - RNA, 19 nt, Homo sapiens
ucacagaaugaguaaagau

SEQ ID NO: 204875 - RNA, 19 nt, Homo sapiens
aacacaagaauuccgauuu

SEQ ID NO: 204876 - RNA, 19 nt, Homo sapiens
caucuugguuaaggagguu

SEQ ID NO: 204877 - RNA, 19 nt, Homo sapiens
guacguggaggcccaagca

SEQ ID NO: 204878 - RNA, 19 nt, Homo sapiens
gaagaacuaggaggcucaa

SEQ ID NO: 204879 - RNA, 19 nt, Homo sapiens
uccuaggaauaaagcauuu

SEQ ID NO: 204880 - RNA, 19 nt, Homo sapiens
ggugugagaagccugcaau

SEQ ID NO: 204881 - RNA, 19 nt, Homo sapiens
ccagagggcaguccuuagg

SEQ ID NO: 204882 - RNA, 19 nt, Homo sapiens
gccaagcccaagucuccua

SEQ ID NO: 204883 - RNA, 19 nt, Homo sapiens
agagugagcuaggagaacu

SEQ ID NO: 204884 - RNA, 19 nt, Homo sapiens
caagaguuugugaaguuau

SEQ ID NO: 204885 - RNA, 19 nt, Homo sapiens
uccuguuccuagucauuua

SEQ ID NO: 204886 - RNA, 19 nt, Homo sapiens
gguccuguuccuagucauu

SEQ ID NO: 204887 - RNA, 19 nt, Homo sapiens
gguccugucccuccauauc

SEQ ID NO: 204888 - RNA, 19 nt, Homo sapiens
cugagugucugucccucuu

SEQ ID NO: 204889 - RNA, 19 nt, Homo sapiens
gauaagcugauggcaugga

SEQ ID NO: 204890 - RNA, 19 nt, Homo sapiens
gagcagcugaagaaagaag

SEQ ID NO: 204891 - RNA, 19 nt, Homo sapiens
gaaggaccuguugaagaug

SEQ ID NO: 204892 - RNA, 19 nt, Homo sapiens
ggcaacacaaagcaucuug

SEQ ID NO: 204893 - RNA, 19 nt, Homo sapiens
cgggaaaggaaaucaagga

SEQ ID NO: 204894 - RNA, 19 nt, Homo sapiens
cagcgagaaggaccuguug

SEQ ID NO: 204895 - RNA, 19 nt, Homo sapiens
gcaggauggcccaggaucu

SEQ ID NO: 204896 - RNA, 19 nt, Homo sapiens
ggaaaguccucgcugauca

SEQ ID NO: 204897 - RNA, 19 nt, Homo sapiens
gaacgagcuuccaagacua

SEQ ID NO: 204898 - RNA, 19 nt, Homo sapiens
caucauauccgcaggcuua

SEQ ID NO: 204899 - RNA, 19 nt, Homo sapiens
gcuaugagauguccaagga

SEQ ID NO: 204900 - RNA, 19 nt, Homo sapiens
uuucagaccuacuuucuua

SEQ ID NO: 204901 - RNA, 19 nt, Homo sapiens
gacauccaguugugaauuu

SEQ ID NO: 204902 - RNA, 19 nt, Homo sapiens
gaaacgugguuacaagaca

SEQ ID NO: 204903 - RNA, 19 nt, Homo sapiens
gaggaugagugcugaguuc

SEQ ID NO: 204904 - RNA, 19 nt, Homo sapiens
cgccagcacuuuaugagua

SEQ ID NO: 204905 - RNA, 19 nt, Homo sapiens
guacagagcagccaacagu

SEQ ID NO: 204906 - RNA, 19 nt, Homo sapiens
gagaaacucagcuacuuga

SEQ ID NO: 204907 - RNA, 19 nt, Homo sapiens
guaugugacuggagaacuu

SEQ ID NO: 204908 - RNA, 19 nt, Homo sapiens
cagaugaacugaggugaga

SEQ ID NO: 204909 - RNA, 19 nt, Homo sapiens
gaagcauuauuuccaucaa

SEQ ID NO: 204910 - RNA, 19 nt, Homo sapiens
gagaaacgugguuacaaga

SEQ ID NO: 204911 - RNA, 19 nt, Homo sapiens
agagaaacgugguuacaag

SEQ ID NO: 204912 - RNA, 19 nt, Homo sapiens
gggagucugugacccauca

SEQ ID NO: 204913 - RNA, 19 nt, Homo sapiens
gcuacgacccaaaucgaua

SEQ ID NO: 204914 - RNA, 19 nt, Homo sapiens
gaaaguccucgcugaucaa

SEQ ID NO: 204915 - RNA, 19 nt, Homo sapiens
gaagauugcucgggaugcu

SEQ ID NO: 204916 - RNA, 19 nt, Homo sapiens
cuacuucccucccagauac

SEQ ID NO: 204917 - RNA, 19 nt, Homo sapiens
gggcagagaaacgugguua

SEQ ID NO: 204918 - RNA, 19 nt, Homo sapiens
ggccauacccgauacuuuc

SEQ ID NO: 204919 - RNA, 19 nt, Homo sapiens
gagcagcagcagacugauu

SEQ ID NO: 204920 - RNA, 19 nt, Homo sapiens
gugguugccuggaagcauu

SEQ ID NO: 204921 - RNA, 19 nt, Homo sapiens
caacuggcccaacccaaga

SEQ ID NO: 204922 - RNA, 19 nt, Homo sapiens
ggaggaggaggaagaggaa

SEQ ID NO: 204923 - RNA, 19 nt, Homo sapiens
gccagcacuuuaugaguau

SEQ ID NO: 204924 - RNA, 19 nt, Homo sapiens
gcagagaaacgugguuaca

SEQ ID NO: 204925 - RNA, 19 nt, Homo sapiens
gauauccgacauccaguug

SEQ ID NO: 204926 - RNA, 19 nt, Homo sapiens
gacaucguccugcuuauca

SEQ ID NO: 204927 - RNA, 19 nt, Homo sapiens
ccaaggcggcucggaauga

SEQ ID NO: 204928 - RNA, 19 nt, Homo sapiens
ggcggaaagucgugagugu

SEQ ID NO: 204929 - RNA, 19 nt, Homo sapiens
aggcuacagugaacagaaa

SEQ ID NO: 204930 - RNA, 19 nt, Homo sapiens
caaggcggcucggaaugau

SEQ ID NO: 204931 - RNA, 19 nt, Homo sapiens
gaauuucccgccagcacuu

SEQ ID NO: 204932 - RNA, 19 nt, Homo sapiens
ggacauccgggagguguau

SEQ ID NO: 204933 - RNA, 19 nt, Homo sapiens
cccaagagcgcuacaagga

SEQ ID NO: 204934 - RNA, 19 nt, Homo sapiens
cccgauacuuucagaccua

SEQ ID NO: 204935 - RNA, 19 nt, Homo sapiens
gggccauacccgauacuuu

SEQ ID NO: 204936 - RNA, 19 nt, Homo sapiens
gcagcuggcgggagaagau

SEQ ID NO: 204937 - RNA, 19 nt, Homo sapiens
ccacaggauccuaguagug

SEQ ID NO: 204938 - RNA, 19 nt, Homo sapiens
ucugacaucguccugcuua

SEQ ID NO: 204939 - RNA, 19 nt, Homo sapiens
gggcuuacuccucugagaa

SEQ ID NO: 204940 - RNA, 19 nt, Homo sapiens
gauaccgacugcauuuuga

SEQ ID NO: 204941 - RNA, 19 nt, Homo sapiens
cgacauccaguugugaauu

SEQ ID NO: 204942 - RNA, 19 nt, Homo sapiens
uauccgacauccaguugug

SEQ ID NO: 204943 - RNA, 19 nt, Homo sapiens
gagguagagaggagaaaga

SEQ ID NO: 204944 - RNA, 19 nt, Homo sapiens
ccaaggagcaacuaaugag

SEQ ID NO: 204945 - RNA, 19 nt, Homo sapiens
gcucaguucuggacuuucc

SEQ ID NO: 204946 - RNA, 19 nt, Homo sapiens
aagauuguuugcuuuguag

SEQ ID NO: 204947 - RNA, 19 nt, Homo sapiens
uggcucaguucuggacuuu

SEQ ID NO: 204948 - RNA, 19 nt, Homo sapiens
ccaccccaauugugaauaa

SEQ ID NO: 204949 - RNA, 19 nt, Homo sapiens
cagagaaacgugguuacaa

SEQ ID NO: 204950 - RNA, 19 nt, Homo sapiens
cauacccgauacuuucaga

SEQ ID NO: 204951 - RNA, 19 nt, Homo sapiens
aguccucgcugaucaaugg

SEQ ID NO: 204952 - RNA, 19 nt, Homo sapiens
uguguggguuucccuaaug

SEQ ID NO: 204953 - RNA, 19 nt, Homo sapiens
ggagcuaugagauguccaa

SEQ ID NO: 204954 - RNA, 19 nt, Homo sapiens
guccaaggagcaacuaaug

SEQ ID NO: 204955 - RNA, 19 nt, Homo sapiens
ccucccagauacuuucguu

SEQ ID NO: 204956 - RNA, 19 nt, Homo sapiens
ggccucaucuucccaucuc

SEQ ID NO: 204957 - RNA, 19 nt, Homo sapiens
gauacuuucagaccuacuu

SEQ ID NO: 204958 - RNA, 19 nt, Homo sapiens
gcacuuuaugaguauguga

SEQ ID NO: 204959 - RNA, 19 nt, Homo sapiens
gacaaacgggagcggaaga

SEQ ID NO: 204960 - RNA, 19 nt, Homo sapiens
gggaaaguccucgcugauc

SEQ ID NO: 204961 - RNA, 19 nt, Homo sapiens
agcacaaucuggagacaug

SEQ ID NO: 204962 - RNA, 19 nt, Homo sapiens
ggugagagcggcuguucca

SEQ ID NO: 204963 - RNA, 19 nt, Homo sapiens
gaugggcugcgcuccaguu

SEQ ID NO: 204964 - RNA, 19 nt, Homo sapiens
uggagcagcagcagacuga

SEQ ID NO: 204965 - RNA, 19 nt, Homo sapiens
ccaagagcgcuacaaggau

SEQ ID NO: 204966 - RNA, 19 nt, Homo sapiens
ggcuuacuccucugagaaa

SEQ ID NO: 204967 - RNA, 19 nt, Homo sapiens
ugugaagccugggcagaga

SEQ ID NO: 204968 - RNA, 19 nt, Homo sapiens
gauccuaguagugucuuga

SEQ ID NO: 204969 - RNA, 19 nt, Homo sapiens
aagagagggcuucaagaug

SEQ ID NO: 204970 - RNA, 19 nt, Homo sapiens
ccuuggagcuaugagaugu

SEQ ID NO: 204971 - RNA, 19 nt, Homo sapiens
gaggugagagcggcuguuc

SEQ ID NO: 204972 - RNA, 19 nt, Homo sapiens
gaggagguagagaggagaa

SEQ ID NO: 204973 - RNA, 19 nt, Homo sapiens
ccuacuucccucccagaua

SEQ ID NO: 204974 - RNA, 19 nt, Homo sapiens
gagucugugacccaucaua

SEQ ID NO: 204975 - RNA, 19 nt, Homo sapiens
cacaggauccuaguagugu

SEQ ID NO: 204976 - RNA, 19 nt, Homo sapiens
gcuguguggguuucccuaa

SEQ ID NO: 204977 - RNA, 19 nt, Homo sapiens
gaaaggagcucuggaaagu

SEQ ID NO: 204978 - RNA, 19 nt, Homo sapiens
ccacagagauccaggcuuu

SEQ ID NO: 204979 - RNA, 19 nt, Homo sapiens
gaacaugugagcuuaagua

SEQ ID NO: 204980 - RNA, 19 nt, Homo sapiens
ggagacacauuucauuaga

SEQ ID NO: 204981 - RNA, 19 nt, Homo sapiens
ugaaagaguugaagaccaa

SEQ ID NO: 204982 - RNA, 19 nt, Homo sapiens
gcauucaugugccuuagaa

SEQ ID NO: 204983 - RNA, 19 nt, Homo sapiens
cauguaaugucaagcaauu

SEQ ID NO: 204984 - RNA, 19 nt, Homo sapiens
ugauacagaugcuagcuuu

SEQ ID NO: 204985 - RNA, 19 nt, Homo sapiens
gcaagugucucugaguuuc

SEQ ID NO: 204986 - RNA, 19 nt, Homo sapiens
aggcaagacugaaggauaa

SEQ ID NO: 204987 - RNA, 19 nt, Homo sapiens
auaauaaagugcuguguug

SEQ ID NO: 204988 - RNA, 19 nt, Homo sapiens
gagacacauuucauuagaa

SEQ ID NO: 204989 - RNA, 19 nt, Homo sapiens
uagauugcaugcuauugua

SEQ ID NO: 204990 - RNA, 19 nt, Homo sapiens
uggaaagucugauugaaga

SEQ ID NO: 204991 - RNA, 19 nt, Homo sapiens
caugugagcuuaaguacuc

SEQ ID NO: 204992 - RNA, 19 nt, Homo sapiens
caagacugaaggauaaaua

SEQ ID NO: 204993 - RNA, 19 nt, Homo sapiens
acaccaaguugcacauauu

SEQ ID NO: 204994 - RNA, 19 nt, Homo sapiens
cagcaagugucucugaguu

SEQ ID NO: 204995 - RNA, 19 nt, Homo sapiens
uaacuacuuugaacagugu

SEQ ID NO: 204996 - RNA, 19 nt, Homo sapiens
gagcuuaaguacucauuuu

SEQ ID NO: 204997 - RNA, 19 nt, Homo sapiens
gaagaccaauccacaacag

SEQ ID NO: 204998 - RNA, 19 nt, Homo sapiens
ucagaaauccuuacaccaa

SEQ ID NO: 204999 - RNA, 19 nt, Homo sapiens
uccaagagauagucaaaga

SEQ ID NO: 205000 - RNA, 19 nt, Homo sapiens
cuaauuugauugugcauuc

SEQ ID NO: 205001 - RNA, 19 nt, Homo sapiens
ggaaugaaagaguugaaga

SEQ ID NO: 205002 - RNA, 19 nt, Homo sapiens
cuaaugauguccuguccuu

SEQ ID NO: 205003 - RNA, 19 nt, Homo sapiens
gaaacugggcagaagaaga

SEQ ID NO: 205004 - RNA, 19 nt, Homo sapiens
acuccuagcuggccuuauu

SEQ ID NO: 205005 - RNA, 19 nt, Homo sapiens
cuuaacagaugacucaguu

SEQ ID NO: 205006 - RNA, 19 nt, Homo sapiens
cuugauaagggaugaauua

SEQ ID NO: 205007 - RNA, 19 nt, Homo sapiens
auaaagugcuguguuguga

SEQ ID NO: 205008 - RNA, 19 nt, Homo sapiens
aaagagagaugccgaaaau

SEQ ID NO: 205009 - RNA, 19 nt, Homo sapiens
ggaaagagagaugccgaaa

SEQ ID NO: 205010 - RNA, 19 nt, Homo sapiens
gaagauaggaaaacagaaa

SEQ ID NO: 205011 - RNA, 19 nt, Homo sapiens
gcauaguccauuugcagua

SEQ ID NO: 205012 - RNA, 19 nt, Homo sapiens
aaagugcuguguugugaau

SEQ ID NO: 205013 - RNA, 19 nt, Homo sapiens
ggcagaagaagauuuaaau

SEQ ID NO: 205014 - RNA, 19 nt, Homo sapiens
gggcagaagaagauuuaaa

SEQ ID NO: 205015 - RNA, 19 nt, Homo sapiens
ucucaggaaugaaagaguu

SEQ ID NO: 205016 - RNA, 19 nt, Homo sapiens
guacucaaccuacuucaag

SEQ ID NO: 205017 - RNA, 19 nt, Homo sapiens
gaaauccuuacaccaaguu

SEQ ID NO: 205018 - RNA, 19 nt, Homo sapiens
gcaaaaugaugaacuugau

SEQ ID NO: 205019 - RNA, 19 nt, Homo sapiens
ccauuacuaacaugacuua

SEQ ID NO: 205020 - RNA, 19 nt, Homo sapiens
gacgguaucuaaugauguc

SEQ ID NO: 205021 - RNA, 19 nt, Homo sapiens
aaacugggcagaagaagau

SEQ ID NO: 205022 - RNA, 19 nt, Homo sapiens
ggguagccauguaauguca

SEQ ID NO: 205023 - RNA, 19 nt, Homo sapiens
ggacuaacuacuuugaaca

SEQ ID NO: 205024 - RNA, 19 nt, Homo sapiens
ggucugggacuaacuacuu

SEQ ID NO: 205025 - RNA, 19 nt, Homo sapiens
gaccaguguuugauuuagu

SEQ ID NO: 205026 - RNA, 19 nt, Homo sapiens
cauaguccauuugcaguau

SEQ ID NO: 205027 - RNA, 19 nt, Homo sapiens
gcaguaaugcuaggcaaga

SEQ ID NO: 205028 - RNA, 19 nt, Homo sapiens
gucuggaucuaauuugauu

SEQ ID NO: 205029 - RNA, 19 nt, Homo sapiens
gacugaaggauaaauagaa

SEQ ID NO: 205030 - RNA, 19 nt, Homo sapiens
gggacuaacuacuuugaac

SEQ ID NO: 205031 - RNA, 19 nt, Homo sapiens
gugugacgguaucuaauga

SEQ ID NO: 205032 - RNA, 19 nt, Homo sapiens
cauaauaaagugcuguguu

SEQ ID NO: 205033 - RNA, 19 nt, Homo sapiens
gaguuucagugucuguaug

SEQ ID NO: 205034 - RNA, 19 nt, Homo sapiens
agccagagauuccuaguag

SEQ ID NO: 205035 - RNA, 19 nt, Homo sapiens
ugacucaguucucucuauc

SEQ ID NO: 205036 - RNA, 19 nt, Homo sapiens
cccauuaaauaccuguaaa

SEQ ID NO: 205037 - RNA, 19 nt, Homo sapiens
ggggaaauguuaaggcaaa

SEQ ID NO: 205038 - RNA, 19 nt, Homo sapiens
gaccauuacuaacaugacu

SEQ ID NO: 205039 - RNA, 19 nt, Homo sapiens
uaggcaagacugaaggaua

SEQ ID NO: 205040 - RNA, 19 nt, Homo sapiens
aaauuaacuuggagacaca

SEQ ID NO: 205041 - RNA, 19 nt, Homo sapiens
gugacgguaucuaaugaug

SEQ ID NO: 205042 - RNA, 19 nt, Homo sapiens
gacucugacuuccaucuuc

SEQ ID NO: 205043 - RNA, 19 nt, Homo sapiens
cccaguggcuaagaaacua

SEQ ID NO: 205044 - RNA, 19 nt, Homo sapiens
uaacagaugacucaguucu

SEQ ID NO: 205045 - RNA, 19 nt, Homo sapiens
uuggagacacauuucauua

SEQ ID NO: 205046 - RNA, 19 nt, Homo sapiens
uaacuuggagacacauuuc

SEQ ID NO: 205047 - RNA, 19 nt, Homo sapiens
ggugugacgguaucuaaug

SEQ ID NO: 205048 - RNA, 19 nt, Homo sapiens
gaggaaacugggcagaaga

SEQ ID NO: 205049 - RNA, 19 nt, Homo sapiens
agauuucaauguccuggaa

SEQ ID NO: 205050 - RNA, 19 nt, Homo sapiens
gcucuggaaagucugauug

SEQ ID NO: 205051 - RNA, 19 nt, Homo sapiens
aaggagcucuggaaagucu

SEQ ID NO: 205052 - RNA, 19 nt, Homo sapiens
gaaugaaagaguugaagac

SEQ ID NO: 205053 - RNA, 19 nt, Homo sapiens
gaaagagagaugccgaaaa

SEQ ID NO: 205054 - RNA, 19 nt, Homo sapiens
ggcuuuguauuauuucuag

SEQ ID NO: 205055 - RNA, 19 nt, Homo sapiens
aaacagaaaagucacagua

SEQ ID NO: 205056 - RNA, 19 nt, Homo sapiens
acagaugacucaguucucu

SEQ ID NO: 205057 - RNA, 19 nt, Homo sapiens
uaguccauuugcaguauaa

SEQ ID NO: 205058 - RNA, 19 nt, Homo sapiens
gucugggacuaacuacuuu

SEQ ID NO: 205059 - RNA, 19 nt, Homo sapiens
cgaccaguguuugauuuag

SEQ ID NO: 205060 - RNA, 19 nt, Homo sapiens
gaaacccaacgcuucgaau

SEQ ID NO: 205061 - RNA, 19 nt, Homo sapiens
agagauagucaaagagguu

SEQ ID NO: 205062 - RNA, 19 nt, Homo sapiens
uucagugucuguauguaaa

SEQ ID NO: 205063 - RNA, 19 nt, Homo sapiens
caggugugacgguaucuaa

SEQ ID NO: 205064 - RNA, 19 nt, Homo sapiens
uagccucuuucccaucaaa

SEQ ID NO: 205065 - RNA, 19 nt, Homo sapiens
agaggaaacugggcagaag

SEQ ID NO: 205066 - RNA, 19 nt, Homo sapiens
gccgaaaauuugauugauu

SEQ ID NO: 205067 - RNA, 19 nt, Homo sapiens
gagagaugccgaaaauuug

SEQ ID NO: 205068 - RNA, 19 nt, Homo sapiens
agagagaugccgaaaauuu

SEQ ID NO: 205069 - RNA, 19 nt, Homo sapiens
aaccuugucuggaucuaau

SEQ ID NO: 205070 - RNA, 19 nt, Homo sapiens
uacaccaaguugcacauau

SEQ ID NO: 205071 - RNA, 19 nt, Homo sapiens
agaaauccuuacaccaagu

SEQ ID NO: 205072 - RNA, 19 nt, Homo sapiens
uaaauccauugggccagaa

SEQ ID NO: 205073 - RNA, 19 nt, Homo sapiens
ugaaaggagcucuggaaag

SEQ ID NO: 205074 - RNA, 19 nt, Homo sapiens
uccaucuucugcaggguua

SEQ ID NO: 205075 - RNA, 19 nt, Homo sapiens
ggagcuacuuuucuuaaca

SEQ ID NO: 205076 - RNA, 19 nt, Homo sapiens
gccauguaaugucaagcaa

SEQ ID NO: 205077 - RNA, 19 nt, Homo sapiens
cccauggccucccaaguga

SEQ ID NO: 205078 - RNA, 19 nt, Homo sapiens
auccacagcucuuccuuga

SEQ ID NO: 205079 - RNA, 19 nt, Homo sapiens
gcccaguggucccuucaca

SEQ ID NO: 205080 - RNA, 19 nt, Homo sapiens
gcugcugacugcccaccuu

SEQ ID NO: 205081 - RNA, 19 nt, Homo sapiens
gaaggagccaucucaucca

SEQ ID NO: 205082 - RNA, 19 nt, Homo sapiens
gcugguacccuggaggaaa

SEQ ID NO: 205083 - RNA, 19 nt, Homo sapiens
aguggucccuucacaggaa

SEQ ID NO: 205084 - RNA, 19 nt, Homo sapiens
caauaaagugugagguucu

SEQ ID NO: 205085 - RNA, 19 nt, Homo sapiens
ccgccauccuccaauaaag

SEQ ID NO: 205086 - RNA, 19 nt, Homo sapiens
gaaugaagcugcucuuaaa

SEQ ID NO: 205087 - RNA, 19 nt, Homo sapiens
gaaaugaucagauaaccua

SEQ ID NO: 205088 - RNA, 19 nt, Homo sapiens
guaaaucacuucuucuuuc

SEQ ID NO: 205089 - RNA, 19 nt, Homo sapiens
gcacucaccaugaaaguua

SEQ ID NO: 205090 - RNA, 19 nt, Homo sapiens
caagacugauugcuuauaa

SEQ ID NO: 205091 - RNA, 19 nt, Homo sapiens
ggacagaacacuaacacua

SEQ ID NO: 205092 - RNA, 19 nt, Homo sapiens
ggucuaagcugcucaagau

SEQ ID NO: 205093 - RNA, 19 nt, Homo sapiens
uaucuaaccuucuguggua

SEQ ID NO: 205094 - RNA, 19 nt, Homo sapiens
gaauauauuuguccagugu

SEQ ID NO: 205095 - RNA, 19 nt, Homo sapiens
ccuuugaucuuucacauua

SEQ ID NO: 205096 - RNA, 19 nt, Homo sapiens
ucaguuggauugauucuaa

SEQ ID NO: 205097 - RNA, 19 nt, Homo sapiens
cagauuaacugacaugaug

SEQ ID NO: 205098 - RNA, 19 nt, Homo sapiens
gcagucaguuggauugauu

SEQ ID NO: 205099 - RNA, 19 nt, Homo sapiens
cuaguuuccuuaugcauua

SEQ ID NO: 205100 - RNA, 19 nt, Homo sapiens
gaagaaagagaaagggaaa

SEQ ID NO: 205101 - RNA, 19 nt, Homo sapiens
ucaagcuggugauuuaaua

SEQ ID NO: 205102 - RNA, 19 nt, Homo sapiens
gcauuugccacuucauuua

SEQ ID NO: 205103 - RNA, 19 nt, Homo sapiens
uaaagaagcaacacagaaa

SEQ ID NO: 205104 - RNA, 19 nt, Homo sapiens
ggaauuugguauugguuug

SEQ ID NO: 205105 - RNA, 19 nt, Homo sapiens
caagaacaauauaccaaga

SEQ ID NO: 205106 - RNA, 19 nt, Homo sapiens
gcaaaguucucaguuaucu

SEQ ID NO: 205107 - RNA, 19 nt, Homo sapiens
ggacacagaagaaagagaa

SEQ ID NO: 205108 - RNA, 19 nt, Homo sapiens
uuacagcaguuacacagua

SEQ ID NO: 205109 - RNA, 19 nt, Homo sapiens
gacuauccuucuucacuua

SEQ ID NO: 205110 - RNA, 19 nt, Homo sapiens
gacagaacacuaacacuaa

SEQ ID NO: 205111 - RNA, 19 nt, Homo sapiens
gagcacggcugaagacucu

SEQ ID NO: 205112 - RNA, 19 nt, Homo sapiens
uuagcacucuguuggauua

SEQ ID NO: 205113 - RNA, 19 nt, Homo sapiens
cuagaugagucagaacuua

SEQ ID NO: 205114 - RNA, 19 nt, Homo sapiens
auucaagacugauugcuua

SEQ ID NO: 205115 - RNA, 19 nt, Homo sapiens
gaagcucuguccugggaaa

SEQ ID NO: 205116 - RNA, 19 nt, Homo sapiens
caaguuaaccuuugaucuu

SEQ ID NO: 205117 - RNA, 19 nt, Homo sapiens
guacaggacuggucuaagc

SEQ ID NO: 205118 - RNA, 19 nt, Homo sapiens
aaacauggacuuuagauuc

SEQ ID NO: 205119 - RNA, 19 nt, Homo sapiens
gauccucaguagugucuuu

SEQ ID NO: 205120 - RNA, 19 nt, Homo sapiens
guuugauccugaaauguua

SEQ ID NO: 205121 - RNA, 19 nt, Homo sapiens
gaccuugucuggaaagauc

SEQ ID NO: 205122 - RNA, 19 nt, Homo sapiens
caaaggcuaagauaaugua

SEQ ID NO: 205123 - RNA, 19 nt, Homo sapiens
cagcaaaggcuaagauaau

SEQ ID NO: 205124 - RNA, 19 nt, Homo sapiens
ggaagaguguugugaaagc

SEQ ID NO: 205125 - RNA, 19 nt, Homo sapiens
ucugcaaaguucucaguua

SEQ ID NO: 205126 - RNA, 19 nt, Homo sapiens
acagaacacuaacacuaaa

SEQ ID NO: 205127 - RNA, 19 nt, Homo sapiens
ugacacggguccuucauca

SEQ ID NO: 205128 - RNA, 19 nt, Homo sapiens
ggaccacaguuauacaucu

SEQ ID NO: 205129 - RNA, 19 nt, Homo sapiens
uaggaagaguguugugaaa

SEQ ID NO: 205130 - RNA, 19 nt, Homo sapiens
gcugguaauucuggacaua

SEQ ID NO: 205131 - RNA, 19 nt, Homo sapiens
cuaaagaaggcagaaauaa

SEQ ID NO: 205132 - RNA, 19 nt, Homo sapiens
gaaguggacacagaagaaa

SEQ ID NO: 205133 - RNA, 19 nt, Homo sapiens
gauuggaucaguaagauug

SEQ ID NO: 205134 - RNA, 19 nt, Homo sapiens
ccuaaguggucccaauuug

SEQ ID NO: 205135 - RNA, 19 nt, Homo sapiens
gaacacuaacacuaaauag

SEQ ID NO: 205136 - RNA, 19 nt, Homo sapiens
caaacuuguuggcauuaga

SEQ ID NO: 205137 - RNA, 19 nt, Homo sapiens
aagcaaacuuguuggcauu

SEQ ID NO: 205138 - RNA, 19 nt, Homo sapiens
caauaagaaugcaccaucu

SEQ ID NO: 205139 - RNA, 19 nt, Homo sapiens
gaccacaguuauacaucuu

SEQ ID NO: 205140 - RNA, 19 nt, Homo sapiens
cugcaaaguucucaguuau

SEQ ID NO: 205141 - RNA, 19 nt, Homo sapiens
agaaugaagcugcucuuaa

SEQ ID NO: 205142 - RNA, 19 nt, Homo sapiens
gagugacgguuacuuucuu

SEQ ID NO: 205143 - RNA, 19 nt, Homo sapiens
acucugaccuugucuggaa

SEQ ID NO: 205144 - RNA, 19 nt, Homo sapiens
ugacuauccuucuucacuu

SEQ ID NO: 205145 - RNA, 19 nt, Homo sapiens
uaaguggucccaauuugaa

SEQ ID NO: 205146 - RNA, 19 nt, Homo sapiens
caugaaaguuaaagaagca

SEQ ID NO: 205147 - RNA, 19 nt, Homo sapiens
gcauauggcccugaucaga

SEQ ID NO: 205148 - RNA, 19 nt, Homo sapiens
gaaugcaccaucuaaguca

SEQ ID NO: 205149 - RNA, 19 nt, Homo sapiens
uuaaguaucucagggacaa

SEQ ID NO: 205150 - RNA, 19 nt, Homo sapiens
ugguaauucuggacauaua

SEQ ID NO: 205151 - RNA, 19 nt, Homo sapiens
gcacggcugaagacucuaa

SEQ ID NO: 205152 - RNA, 19 nt, Homo sapiens
ucacaaugguggcaucaag

SEQ ID NO: 205153 - RNA, 19 nt, Homo sapiens
uaaugcuucuuucuuguug

SEQ ID NO: 205154 - RNA, 19 nt, Homo sapiens
ucuaaagaaggcagaaaua

SEQ ID NO: 205155 - RNA, 19 nt, Homo sapiens
uaucaugacugacuuuuga

SEQ ID NO: 205156 - RNA, 19 nt, Homo sapiens
gcauggauuggaucaguaa

SEQ ID NO: 205157 - RNA, 19 nt, Homo sapiens
uaaaggggcuggaugaugu

SEQ ID NO: 205158 - RNA, 19 nt, Homo sapiens
cuaagcugcucaagauuca

SEQ ID NO: 205159 - RNA, 19 nt, Homo sapiens
ucacuucuucuuucucuuu

SEQ ID NO: 205160 - RNA, 19 nt, Homo sapiens
ccugugacguuuccaucua

SEQ ID NO: 205161 - RNA, 19 nt, Homo sapiens
cugcugaggugcuacaguu

SEQ ID NO: 205162 - RNA, 19 nt, Homo sapiens
acugauugcuuauaaggaa

SEQ ID NO: 205163 - RNA, 19 nt, Homo sapiens
gguuugauccugaaauguu

SEQ ID NO: 205164 - RNA, 19 nt, Homo sapiens
aaacagugccucuccugaa

SEQ ID NO: 205165 - RNA, 19 nt, Homo sapiens
uaacuaguuuccuuaugca

SEQ ID NO: 205166 - RNA, 19 nt, Homo sapiens
gcaaacuuguuggcauuag

SEQ ID NO: 205167 - RNA, 19 nt, Homo sapiens
gcuggaugauguuguguuc

SEQ ID NO: 205168 - RNA, 19 nt, Homo sapiens
cccaguaaaucacuucuuc

SEQ ID NO: 205169 - RNA, 19 nt, Homo sapiens
augguaugcuggagaguua

SEQ ID NO: 205170 - RNA, 19 nt, Homo sapiens
cuuuaaugcuucuuucuug

SEQ ID NO: 205171 - RNA, 19 nt, Homo sapiens
ccuuaugcauuaaugugua

SEQ ID NO: 205172 - RNA, 19 nt, Homo sapiens
gcaaaggcuaagauaaugu

SEQ ID NO: 205173 - RNA, 19 nt, Homo sapiens
gguaacaagcuccuuaaag

SEQ ID NO: 205174 - RNA, 19 nt, Homo sapiens
ccacaguuauacaucuuca

SEQ ID NO: 205175 - RNA, 19 nt, Homo sapiens
gaaaguuaaagaagcaaca

SEQ ID NO: 205176 - RNA, 19 nt, Homo sapiens
ugucagacccaguaaauca

SEQ ID NO: 205177 - RNA, 19 nt, Homo sapiens
guaugucuuuccaaugguu

SEQ ID NO: 205178 - RNA, 19 nt, Homo sapiens
cugcuggacucccuacuau

SEQ ID NO: 205179 - RNA, 19 nt, Homo sapiens
gaccuuuaaugcuucuuuc

SEQ ID NO: 205180 - RNA, 19 nt, Homo sapiens
gacgguuacuuucuuccuu

SEQ ID NO: 205181 - RNA, 19 nt, Homo sapiens
guuaaccuuugaucuuuca

SEQ ID NO: 205182 - RNA, 19 nt, Homo sapiens
uccaaugguuauccuguuu

SEQ ID NO: 205183 - RNA, 19 nt, Homo sapiens
caagcuggugauuuaauaa

SEQ ID NO: 205184 - RNA, 19 nt, Homo sapiens
ccagcaaaggcuaagauaa

SEQ ID NO: 205185 - RNA, 19 nt, Homo sapiens
gcuggacucccuacuaugu

SEQ ID NO: 205186 - RNA, 19 nt, Homo sapiens
ucacauggcuugaagagua

SEQ ID NO: 205187 - RNA, 19 nt, Homo sapiens
caacaacacuuacaucuuc

SEQ ID NO: 205188 - RNA, 19 nt, Homo sapiens
gaaaguacccacauaauca

SEQ ID NO: 205189 - RNA, 19 nt, Homo sapiens
aacaagcacugguuaauua

SEQ ID NO: 205190 - RNA, 19 nt, Homo sapiens
gcagggaaauauuuaaaug

SEQ ID NO: 205191 - RNA, 19 nt, Homo sapiens
gcacgccucuuucugauga

SEQ ID NO: 205192 - RNA, 19 nt, Homo sapiens
ccacaguucuugauuauuc

SEQ ID NO: 205193 - RNA, 19 nt, Homo sapiens
guaaacccauucagauaaa

SEQ ID NO: 205194 - RNA, 19 nt, Homo sapiens
gaacaagcacugguuaauu

SEQ ID NO: 205195 - RNA, 19 nt, Homo sapiens
ccagaaggcuuuccagaau

SEQ ID NO: 205196 - RNA, 19 nt, Homo sapiens
uauguaagcuugaccuaaa

SEQ ID NO: 205197 - RNA, 19 nt, Homo sapiens
uaucaaaguuccacuguug

SEQ ID NO: 205198 - RNA, 19 nt, Homo sapiens
caaguaccauuguugauug

SEQ ID NO: 205199 - RNA, 19 nt, Homo sapiens
gggccacaguucuugauua

SEQ ID NO: 205200 - RNA, 19 nt, Homo sapiens
gaccacaccuggaagaguu

SEQ ID NO: 205201 - RNA, 19 nt, Homo sapiens
ugucaggacucgaagauuu

SEQ ID NO: 205202 - RNA, 19 nt, Homo sapiens
agagacagcuguaugaguu

SEQ ID NO: 205203 - RNA, 19 nt, Homo sapiens
guaccauuguugauugaua

SEQ ID NO: 205204 - RNA, 19 nt, Homo sapiens
ggacacuccugaggucuuu

SEQ ID NO: 205205 - RNA, 19 nt, Homo sapiens
gcaauguguuaaacuguga

SEQ ID NO: 205206 - RNA, 19 nt, Homo sapiens
gcaauucucagaucaaugu

SEQ ID NO: 205207 - RNA, 19 nt, Homo sapiens
gugguaagguugcaaauuc

SEQ ID NO: 205208 - RNA, 19 nt, Homo sapiens
ucucuggucucuuccuuua

SEQ ID NO: 205209 - RNA, 19 nt, Homo sapiens
gaccagaucacuaacauug

SEQ ID NO: 205210 - RNA, 19 nt, Homo sapiens
cagauguccugguggaaua

SEQ ID NO: 205211 - RNA, 19 nt, Homo sapiens
ccaaauacuuucccagcaa

SEQ ID NO: 205212 - RNA, 19 nt, Homo sapiens
gaccugggaucaaaccaaa

SEQ ID NO: 205213 - RNA, 19 nt, Homo sapiens
gaacgaacaagcacugguu

SEQ ID NO: 205214 - RNA, 19 nt, Homo sapiens
ggaaaguacccacauaauc

SEQ ID NO: 205215 - RNA, 19 nt, Homo sapiens
aagaugaacuaucgguuaa

SEQ ID NO: 205216 - RNA, 19 nt, Homo sapiens
ugacuuggguccuacuauu

SEQ ID NO: 205217 - RNA, 19 nt, Homo sapiens
gaugaacuaucgguuaaug

SEQ ID NO: 205218 - RNA, 19 nt, Homo sapiens
aaagaugaacuaucgguua

SEQ ID NO: 205219 - RNA, 19 nt, Homo sapiens
ucagaucaaugugugguua

SEQ ID NO: 205220 - RNA, 19 nt, Homo sapiens
acacuuacaucuucuauac

SEQ ID NO: 205221 - RNA, 19 nt, Homo sapiens
gaaacaagaacuucaacau

SEQ ID NO: 205222 - RNA, 19 nt, Homo sapiens
gaggggaacugcaguagua

SEQ ID NO: 205223 - RNA, 19 nt, Homo sapiens
gauuauuccucuugugguu

SEQ ID NO: 205224 - RNA, 19 nt, Homo sapiens
ggccacaguucuugauuau

SEQ ID NO: 205225 - RNA, 19 nt, Homo sapiens
guaagaacaaguaccauug

SEQ ID NO: 205226 - RNA, 19 nt, Homo sapiens
acaggaaaguacccacaua

SEQ ID NO: 205227 - RNA, 19 nt, Homo sapiens
ccaagacuccaaugacuaa

SEQ ID NO: 205228 - RNA, 19 nt, Homo sapiens
ggacagcugcaccucagua

SEQ ID NO: 205229 - RNA, 19 nt, Homo sapiens
caaaggaccuguguagcau

SEQ ID NO: 205230 - RNA, 19 nt, Homo sapiens
gaacucugcccauguguca

SEQ ID NO: 205231 - RNA, 19 nt, Homo sapiens
gagcugaaucauccaagua

SEQ ID NO: 205232 - RNA, 19 nt, Homo sapiens
gaagauccaagaaccaaau

SEQ ID NO: 205233 - RNA, 19 nt, Homo sapiens
uaggaaagaugaacuaucg

SEQ ID NO: 205234 - RNA, 19 nt, Homo sapiens
ugacagauguuuuggcuaa

SEQ ID NO: 205235 - RNA, 19 nt, Homo sapiens
caaauacuuucccagcaau

SEQ ID NO: 205236 - RNA, 19 nt, Homo sapiens
gugaagaugcuuauaacaa

SEQ ID NO: 205237 - RNA, 19 nt, Homo sapiens
uaaauaagacacagaugga

SEQ ID NO: 205238 - RNA, 19 nt, Homo sapiens
gaucaaaccaaaucagaca

SEQ ID NO: 205239 - RNA, 19 nt, Homo sapiens
ggaccuguguagcauuuca

SEQ ID NO: 205240 - RNA, 19 nt, Homo sapiens
ggcaaacucuccucucagu

SEQ ID NO: 205241 - RNA, 19 nt, Homo sapiens
gguuaaagacugaauuugu

SEQ ID NO: 205242 - RNA, 19 nt, Homo sapiens
ggucuuuguucucacugua

SEQ ID NO: 205243 - RNA, 19 nt, Homo sapiens
uggaugggauguccuuauu

SEQ ID NO: 205244 - RNA, 19 nt, Homo sapiens
caagaaacaagaacuucaa

SEQ ID NO: 205245 - RNA, 19 nt, Homo sapiens
cagaaugucuuugcaccaa

SEQ ID NO: 205246 - RNA, 19 nt, Homo sapiens
ggagguguuuguagaaguc

SEQ ID NO: 205247 - RNA, 19 nt, Homo sapiens
gaacuucaacauccaugga

SEQ ID NO: 205248 - RNA, 19 nt, Homo sapiens
cccaagcucuguucauguu

SEQ ID NO: 205249 - RNA, 19 nt, Homo sapiens
guaggugucuguagcuagu

SEQ ID NO: 205250 - RNA, 19 nt, Homo sapiens
gaacuaucgguuaaugaug

SEQ ID NO: 205251 - RNA, 19 nt, Homo sapiens
gaugggauguccuuauugc

SEQ ID NO: 205252 - RNA, 19 nt, Homo sapiens
uguaaacccauucagauaa

SEQ ID NO: 205253 - RNA, 19 nt, Homo sapiens
ggcuuuaaguccuguuuga

SEQ ID NO: 205254 - RNA, 19 nt, Homo sapiens
ucacacagccucugcagau

SEQ ID NO: 205255 - RNA, 19 nt, Homo sapiens
uugaugaccuuguggagaa

SEQ ID NO: 205256 - RNA, 19 nt, Homo sapiens
agacuccaaugacuaauuc

SEQ ID NO: 205257 - RNA, 19 nt, Homo sapiens
caggaaaguacccacauaa

SEQ ID NO: 205258 - RNA, 19 nt, Homo sapiens
cagaaggcuuuccagaaug

SEQ ID NO: 205259 - RNA, 19 nt, Homo sapiens
cacauggcuugaagaguaa

SEQ ID NO: 205260 - RNA, 19 nt, Homo sapiens
gagaggugccaguaacuug

SEQ ID NO: 205261 - RNA, 19 nt, Homo sapiens
uccaagaaccaaauacuuu

SEQ ID NO: 205262 - RNA, 19 nt, Homo sapiens
uguggaauuugcaguauug

SEQ ID NO: 205263 - RNA, 19 nt, Homo sapiens
acaagagacagcuguauga

SEQ ID NO: 205264 - RNA, 19 nt, Homo sapiens
ggacacacacaaacacaca

SEQ ID NO: 205265 - RNA, 19 nt, Homo sapiens
ucgaggaccugggaucaaa

SEQ ID NO: 205266 - RNA, 19 nt, Homo sapiens
gacaagagacagcuguaug

SEQ ID NO: 205267 - RNA, 19 nt, Homo sapiens
uggagaaacuggucaagag

SEQ ID NO: 205268 - RNA, 19 nt, Homo sapiens
aaacaagaacuucaacauc

SEQ ID NO: 205269 - RNA, 19 nt, Homo sapiens
gcacggaagcauggugaaa

SEQ ID NO: 205270 - RNA, 19 nt, Homo sapiens
uuacugguaugccuuggaa

SEQ ID NO: 205271 - RNA, 19 nt, Homo sapiens
ucaaaggaccuguguagca

SEQ ID NO: 205272 - RNA, 19 nt, Homo sapiens
ugucagcauuguggaauuu

SEQ ID NO: 205273 - RNA, 19 nt, Homo sapiens
guggcaaacucuccucuca

SEQ ID NO: 205274 - RNA, 19 nt, Homo sapiens
cagcaauucucagaucaau

SEQ ID NO: 205275 - RNA, 19 nt, Homo sapiens
agaugcagguggacuagaa

SEQ ID NO: 205276 - RNA, 19 nt, Homo sapiens
uaacaucacauggcuugaa

SEQ ID NO: 205277 - RNA, 19 nt, Homo sapiens
gcuacgaccuaaauaagac

SEQ ID NO: 205278 - RNA, 19 nt, Homo sapiens
ccaaaucagacaagcaaga

SEQ ID NO: 205279 - RNA, 19 nt, Homo sapiens
agaaggcuuuccagaaugu

SEQ ID NO: 205280 - RNA, 19 nt, Homo sapiens
cacccaagcucuguucaug

SEQ ID NO: 205281 - RNA, 19 nt, Homo sapiens
aaggaccuguguagcauuu

SEQ ID NO: 205282 - RNA, 19 nt, Homo sapiens
ucagauaaauggcaguacu

SEQ ID NO: 205283 - RNA, 19 nt, Homo sapiens
uggacuaccugacagaugu

SEQ ID NO: 205284 - RNA, 19 nt, Homo sapiens
caaguaagaacaaguacca

SEQ ID NO: 205285 - RNA, 19 nt, Homo sapiens
ccaagaaccaaauacuuuc

SEQ ID NO: 205286 - RNA, 19 nt, Homo sapiens
gaacacgaauuuccauuua

SEQ ID NO: 205287 - RNA, 19 nt, Homo sapiens
uaaagaagcugaaggaaga

SEQ ID NO: 205288 - RNA, 19 nt, Homo sapiens
gcacaugacucugguagua

SEQ ID NO: 205289 - RNA, 19 nt, Homo sapiens
gagaaggaaugaacagaua

SEQ ID NO: 205290 - RNA, 19 nt, Homo sapiens
gagaugaaauggaugaauu

SEQ ID NO: 205291 - RNA, 19 nt, Homo sapiens
gaacuuaucaggagaagaa

SEQ ID NO: 205292 - RNA, 19 nt, Homo sapiens
guacaagugucuaaacauu

SEQ ID NO: 205293 - RNA, 19 nt, Homo sapiens
ggaagacucugcagaagga

SEQ ID NO: 205294 - RNA, 19 nt, Homo sapiens
caaaccaccuagaacuuua

SEQ ID NO: 205295 - RNA, 19 nt, Homo sapiens
caaggaaacucuggaauau

SEQ ID NO: 205296 - RNA, 19 nt, Homo sapiens
gaaagaagacguuaucaca

SEQ ID NO: 205297 - RNA, 19 nt, Homo sapiens
gaauaacacugaccugaca

SEQ ID NO: 205298 - RNA, 19 nt, Homo sapiens
ggaagcagcuccagagaag

SEQ ID NO: 205299 - RNA, 19 nt, Homo sapiens
gcacgaaccagagaacuua

SEQ ID NO: 205300 - RNA, 19 nt, Homo sapiens
aggaaacucuggaauauaa

SEQ ID NO: 205301 - RNA, 19 nt, Homo sapiens
gaauggagccaaagagaaa

SEQ ID NO: 205302 - RNA, 19 nt, Homo sapiens
gccagaagcuagaagaauu

SEQ ID NO: 205303 - RNA, 19 nt, Homo sapiens
gaacagauacggaaguuag

SEQ ID NO: 205304 - RNA, 19 nt, Homo sapiens
ggaaucaguugccucaaug

SEQ ID NO: 205305 - RNA, 19 nt, Homo sapiens
gagcagaauuuggaggaua

SEQ ID NO: 205306 - RNA, 19 nt, Homo sapiens
gaggaagaguggaauaaau

SEQ ID NO: 205307 - RNA, 19 nt, Homo sapiens
ucacacagcuacagaagga

SEQ ID NO: 205308 - RNA, 19 nt, Homo sapiens
gaaaugaagaaccagagua

SEQ ID NO: 205309 - RNA, 19 nt, Homo sapiens
gccacaauauugaaucuaa

SEQ ID NO: 205310 - RNA, 19 nt, Homo sapiens
uauaagaugucaugguuug

SEQ ID NO: 205311 - RNA, 19 nt, Homo sapiens
ugaaauggaugaauuagag

SEQ ID NO: 205312 - RNA, 19 nt, Homo sapiens
gcagcuacauuuccacaga

SEQ ID NO: 205313 - RNA, 19 nt, Homo sapiens
gacaguaucuccacuuuac

SEQ ID NO: 205314 - RNA, 19 nt, Homo sapiens
ccacagugcugcuaauauc

SEQ ID NO: 205315 - RNA, 19 nt, Homo sapiens
gaaacuugcagaagauaaa

SEQ ID NO: 205316 - RNA, 19 nt, Homo sapiens
ucaaggaaacucuggaaua

SEQ ID NO: 205317 - RNA, 19 nt, Homo sapiens
gagaagaacacgugcaaga

SEQ ID NO: 205318 - RNA, 19 nt, Homo sapiens
gaaugaauaugaacguucu

SEQ ID NO: 205319 - RNA, 19 nt, Homo sapiens
ugagacaacuggagcaaga

SEQ ID NO: 205320 - RNA, 19 nt, Homo sapiens
gaaugcagcuagcuuggau

SEQ ID NO: 205321 - RNA, 19 nt, Homo sapiens
gaauuuccuucagcuuuaa

SEQ ID NO: 205322 - RNA, 19 nt, Homo sapiens
auaaacgucuucuguacua

SEQ ID NO: 205323 - RNA, 19 nt, Homo sapiens
gcaggaagaacaccaaaug

SEQ ID NO: 205324 - RNA, 19 nt, Homo sapiens
caagaacuccugaaagaga

SEQ ID NO: 205325 - RNA, 19 nt, Homo sapiens
ugcaagaacuccugaaaga

SEQ ID NO: 205326 - RNA, 19 nt, Homo sapiens
gaaaauggaacaagaauug

SEQ ID NO: 205327 - RNA, 19 nt, Homo sapiens
agaagaaagucuagggaaa

SEQ ID NO: 205328 - RNA, 19 nt, Homo sapiens
cagaugaguuagaagcuuu

SEQ ID NO: 205329 - RNA, 19 nt, Homo sapiens
gaccugagauggcaaacau

SEQ ID NO: 205330 - RNA, 19 nt, Homo sapiens
uaaccugacagccauaaua

SEQ ID NO: 205331 - RNA, 19 nt, Homo sapiens
gagaagagacuagaacaga

SEQ ID NO: 205332 - RNA, 19 nt, Homo sapiens
gagcagagagaucauguga

SEQ ID NO: 205333 - RNA, 19 nt, Homo sapiens
agacaguuaucccuuguuu

SEQ ID NO: 205334 - RNA, 19 nt, Homo sapiens
gaauguacuugucuuggau

SEQ ID NO: 205335 - RNA, 19 nt, Homo sapiens
auaaugagcucuucgaagu

SEQ ID NO: 205336 - RNA, 19 nt, Homo sapiens
gaagcacucucagucaaug

SEQ ID NO: 205337 - RNA, 19 nt, Homo sapiens
gagacuagaacagaacuua

SEQ ID NO: 205338 - RNA, 19 nt, Homo sapiens
uaacgaaauuuccaugaag

SEQ ID NO: 205339 - RNA, 19 nt, Homo sapiens
acuggagccucuaaauuua

SEQ ID NO: 205340 - RNA, 19 nt, Homo sapiens
ccauuuaacugguguucuu

SEQ ID NO: 205341 - RNA, 19 nt, Homo sapiens
gaacuccaaucagauguca

SEQ ID NO: 205342 - RNA, 19 nt, Homo sapiens
gccaaaggcagcuacauuu

SEQ ID NO: 205343 - RNA, 19 nt, Homo sapiens
uaacuggagccucuaaauu

SEQ ID NO: 205344 - RNA, 19 nt, Homo sapiens
acacgcauuugcaacguua

SEQ ID NO: 205345 - RNA, 19 nt, Homo sapiens
uuuagaggauccaucuuua

SEQ ID NO: 205346 - RNA, 19 nt, Homo sapiens
uaagccagauccuguguug

SEQ ID NO: 205347 - RNA, 19 nt, Homo sapiens
ucacacauuugcaagagaa

SEQ ID NO: 205348 - RNA, 19 nt, Homo sapiens
gagcucuccuuccauguug

SEQ ID NO: 205349 - RNA, 19 nt, Homo sapiens
cuaacgaaauuuccaugaa

SEQ ID NO: 205350 - RNA, 19 nt, Homo sapiens
gcagcuagcuuggaugucu

SEQ ID NO: 205351 - RNA, 19 nt, Homo sapiens
gagaacaugcucaaggaaa

SEQ ID NO: 205352 - RNA, 19 nt, Homo sapiens
gcccuuggcccacauuuaa

SEQ ID NO: 205353 - RNA, 19 nt, Homo sapiens
ggagcgaggucacaacucu

SEQ ID NO: 205354 - RNA, 19 nt, Homo sapiens
caacagagcaagggcauug

SEQ ID NO: 205355 - RNA, 19 nt, Homo sapiens
cagcagcuuuccauugauu

SEQ ID NO: 205356 - RNA, 19 nt, Homo sapiens
ggagagaugaaauggauga

SEQ ID NO: 205357 - RNA, 19 nt, Homo sapiens
guccgaaacuugcagaaga

SEQ ID NO: 205358 - RNA, 19 nt, Homo sapiens
gaucacagcccuggaacaa

SEQ ID NO: 205359 - RNA, 19 nt, Homo sapiens
gaagcuugaaauugcauua

SEQ ID NO: 205360 - RNA, 19 nt, Homo sapiens
ggaagaguggaauaaauau

SEQ ID NO: 205361 - RNA, 19 nt, Homo sapiens
aaagauggaucagcuugaa

SEQ ID NO: 205362 - RNA, 19 nt, Homo sapiens
gcuugaaauugcauuagaa

SEQ ID NO: 205363 - RNA, 19 nt, Homo sapiens
aagagaagcuugaaauugc

SEQ ID NO: 205364 - RNA, 19 nt, Homo sapiens
gcagacaguuaucccuugu

SEQ ID NO: 205365 - RNA, 19 nt, Homo sapiens
ccaccugucuucuacugaa

SEQ ID NO: 205366 - RNA, 19 nt, Homo sapiens
ggaagaauggagccaaaga

SEQ ID NO: 205367 - RNA, 19 nt, Homo sapiens
agaagagacuagaacagaa

SEQ ID NO: 205368 - RNA, 19 nt, Homo sapiens
ugacuuugcuuccgaugga

SEQ ID NO: 205369 - RNA, 19 nt, Homo sapiens
gcacuuugacuuguauaaa

SEQ ID NO: 205370 - RNA, 19 nt, Homo sapiens
ccuccugcauguugaauuu

SEQ ID NO: 205371 - RNA, 19 nt, Homo sapiens
caggaaagaaucucuaaga

SEQ ID NO: 205372 - RNA, 19 nt, Homo sapiens
uuggauagguugcugguaa

SEQ ID NO: 205373 - RNA, 19 nt, Homo sapiens
guacuugucuuggauaggu

SEQ ID NO: 205374 - RNA, 19 nt, Homo sapiens
aaacaggugcagaaaguaa

SEQ ID NO: 205375 - RNA, 19 nt, Homo sapiens
aaagagaagcuugaaauug

SEQ ID NO: 205376 - RNA, 19 nt, Homo sapiens
uaaugcacuuugacuugua

SEQ ID NO: 205377 - RNA, 19 nt, Homo sapiens
caacuuugaguaccuuaaa

SEQ ID NO: 205378 - RNA, 19 nt, Homo sapiens
aagaagacguuaucacaca

SEQ ID NO: 205379 - RNA, 19 nt, Homo sapiens
aggaagaguggaauaaaua

SEQ ID NO: 205380 - RNA, 19 nt, Homo sapiens
ggaaagaaucucuaagacu

SEQ ID NO: 205381 - RNA, 19 nt, Homo sapiens
cagccucgauggagacauu

SEQ ID NO: 205382 - RNA, 19 nt, Homo sapiens
ugaauguacuugucuugga

SEQ ID NO: 205383 - RNA, 19 nt, Homo sapiens
gcaccugaauccucuaacu

SEQ ID NO: 205384 - RNA, 19 nt, Homo sapiens
gaaacucuggaauauaaga

SEQ ID NO: 205385 - RNA, 19 nt, Homo sapiens
gaauaugaacguucuuuac

SEQ ID NO: 205386 - RNA, 19 nt, Homo sapiens
gaaacugugucucuacuaa

SEQ ID NO: 205387 - RNA, 19 nt, Homo sapiens
caacagaaccaagaaauua

SEQ ID NO: 205388 - RNA, 19 nt, Homo sapiens
ggacaaugcugcuacucua

SEQ ID NO: 205389 - RNA, 19 nt, Homo sapiens
gagaaggaauguagcauga

SEQ ID NO: 205390 - RNA, 19 nt, Homo sapiens
agaaggaggugcugcauaa

SEQ ID NO: 205391 - RNA, 19 nt, Homo sapiens
gcaggaagcucagggcaaa

SEQ ID NO: 205392 - RNA, 19 nt, Homo sapiens
ucaauggucuuguuuguga

SEQ ID NO: 205393 - RNA, 19 nt, Homo sapiens
gcaaagcgguggccgagau

SEQ ID NO: 205394 - RNA, 19 nt, Homo sapiens
gcaugcagcuuaacuugga

SEQ ID NO: 205395 - RNA, 19 nt, Homo sapiens
gggcugagaucacgccauu

SEQ ID NO: 205396 - RNA, 19 nt, Homo sapiens
gagaauaucagcagaggaa

SEQ ID NO: 205397 - RNA, 19 nt, Homo sapiens
agucaacccuuuacccuua

SEQ ID NO: 205398 - RNA, 19 nt, Homo sapiens
gaaggaauguagcaugagu

SEQ ID NO: 205399 - RNA, 19 nt, Homo sapiens
uuguaaagcugacuaauga

SEQ ID NO: 205400 - RNA, 19 nt, Homo sapiens
gaauaucagcagaggaaua

SEQ ID NO: 205401 - RNA, 19 nt, Homo sapiens
gcaagagaaaucagaauug

SEQ ID NO: 205402 - RNA, 19 nt, Homo sapiens
caacaaggaguuaaccaaa

SEQ ID NO: 205403 - RNA, 19 nt, Homo sapiens
aaagcuggccacuaaauua

SEQ ID NO: 205404 - RNA, 19 nt, Homo sapiens
ugacggaacuccugcuuca

SEQ ID NO: 205405 - RNA, 19 nt, Homo sapiens
ggaguuaaccaaagagaga

SEQ ID NO: 205406 - RNA, 19 nt, Homo sapiens
cagagcaggugcacacauu

SEQ ID NO: 205407 - RNA, 19 nt, Homo sapiens
gcucaauggucuuguuugu

SEQ ID NO: 205408 - RNA, 19 nt, Homo sapiens
ucuaaaagcuggccacuaa

SEQ ID NO: 205409 - RNA, 19 nt, Homo sapiens
caagagaaaucagaauugg

SEQ ID NO: 205410 - RNA, 19 nt, Homo sapiens
acaaggaguuaaccaaaga

SEQ ID NO: 205411 - RNA, 19 nt, Homo sapiens
cagcaaagccugaagaagu

SEQ ID NO: 205412 - RNA, 19 nt, Homo sapiens
agagggagcugggaaagaa

SEQ ID NO: 205413 - RNA, 19 nt, Homo sapiens
caaaagaaguuagagauga

SEQ ID NO: 205414 - RNA, 19 nt, Homo sapiens
cagcuuaacuuggaagaau

SEQ ID NO: 205415 - RNA, 19 nt, Homo sapiens
gcaguuacagguucacauu

SEQ ID NO: 205416 - RNA, 19 nt, Homo sapiens
gaaacaacagaaccaagaa

SEQ ID NO: 205417 - RNA, 19 nt, Homo sapiens
ggagucgguuagacaacua

SEQ ID NO: 205418 - RNA, 19 nt, Homo sapiens
gaaagaaggagagucugaa

SEQ ID NO: 205419 - RNA, 19 nt, Homo sapiens
cugcagagcggauuuguaa

SEQ ID NO: 205420 - RNA, 19 nt, Homo sapiens
aaucagaauuggaagagaa

SEQ ID NO: 205421 - RNA, 19 nt, Homo sapiens
gcaaugaggaccugaagca

SEQ ID NO: 205422 - RNA, 19 nt, Homo sapiens
gagaaggaggugcugcaua

SEQ ID NO: 205423 - RNA, 19 nt, Homo sapiens
gaagcaagagaaaucagaa

SEQ ID NO: 205424 - RNA, 19 nt, Homo sapiens
gaaggagagucugaagauc

SEQ ID NO: 205425 - RNA, 19 nt, Homo sapiens
gcagaaagaaggagagucu

SEQ ID NO: 205426 - RNA, 19 nt, Homo sapiens
caaugucccuaaucucaug

SEQ ID NO: 205427 - RNA, 19 nt, Homo sapiens
gaaucaugaugcugacaau

SEQ ID NO: 205428 - RNA, 19 nt, Homo sapiens
guagacaggugcagaugag

SEQ ID NO: 205429 - RNA, 19 nt, Homo sapiens
gagaggagaaggaauguag

SEQ ID NO: 205430 - RNA, 19 nt, Homo sapiens
cuacaaauggagagagaua

SEQ ID NO: 205431 - RNA, 19 nt, Homo sapiens
caagaacacccaaagcaau

SEQ ID NO: 205432 - RNA, 19 nt, Homo sapiens
gaccauagggauccucgua

SEQ ID NO: 205433 - RNA, 19 nt, Homo sapiens
ggagagacagacaccauug

SEQ ID NO: 205434 - RNA, 19 nt, Homo sapiens
gcagagcggauuuguaaag

SEQ ID NO: 205435 - RNA, 19 nt, Homo sapiens
aagaaagaaugccaccaaa

SEQ ID NO: 205436 - RNA, 19 nt, Homo sapiens
uaccaucccuucucaguca

SEQ ID NO: 205437 - RNA, 19 nt, Homo sapiens
ggagaaggcagaccugaag

SEQ ID NO: 205438 - RNA, 19 nt, Homo sapiens
guaaagcugacuaaugaga

SEQ ID NO: 205439 - RNA, 19 nt, Homo sapiens
ugaaacaacagaaccaaga

SEQ ID NO: 205440 - RNA, 19 nt, Homo sapiens
aaccaagacuuucucauca

SEQ ID NO: 205441 - RNA, 19 nt, Homo sapiens
auggguaacuuaugguaua

SEQ ID NO: 205442 - RNA, 19 nt, Homo sapiens
agagaaaucagaauuggaa

SEQ ID NO: 205443 - RNA, 19 nt, Homo sapiens
gcaguaacccugagacaac

SEQ ID NO: 205444 - RNA, 19 nt, Homo sapiens
agagaaagcugaguuacag

SEQ ID NO: 205445 - RNA, 19 nt, Homo sapiens
ccagaacccugcugaugag

SEQ ID NO: 205446 - RNA, 19 nt, Homo sapiens
gagacgagcuuggcugaac

SEQ ID NO: 205447 - RNA, 19 nt, Homo sapiens
gagcaggugcacacauuga

SEQ ID NO: 205448 - RNA, 19 nt, Homo sapiens
agaagaaggcagacaggua

SEQ ID NO: 205449 - RNA, 19 nt, Homo sapiens
ccagcuauguaacaaacaa

SEQ ID NO: 205450 - RNA, 19 nt, Homo sapiens
gaauagcccugguguuccu

SEQ ID NO: 205451 - RNA, 19 nt, Homo sapiens
gcaggagaaucgcuugaac

SEQ ID NO: 205452 - RNA, 19 nt, Homo sapiens
gcagaugaggugaagauca

SEQ ID NO: 205453 - RNA, 19 nt, Homo sapiens
gaggguagaggaacuggaa

SEQ ID NO: 205454 - RNA, 19 nt, Homo sapiens
gggaggaggaggaggauga

SEQ ID NO: 205455 - RNA, 19 nt, Homo sapiens
ggaugcagcagaugucaga

SEQ ID NO: 205456 - RNA, 19 nt, Homo sapiens
gaaauugaaacaacagaac

SEQ ID NO: 205457 - RNA, 19 nt, Homo sapiens
gaaggagaggguagaggaa

SEQ ID NO: 205458 - RNA, 19 nt, Homo sapiens
uuagacaacuacaaaugga

SEQ ID NO: 205459 - RNA, 19 nt, Homo sapiens
gaaaucagaauuggaagag

SEQ ID NO: 205460 - RNA, 19 nt, Homo sapiens
aaagaaagaaugccaccaa

SEQ ID NO: 205461 - RNA, 19 nt, Homo sapiens
uuaccgggcugacgagaau

SEQ ID NO: 205462 - RNA, 19 nt, Homo sapiens
gccaagaguugcaggaaac

SEQ ID NO: 205463 - RNA, 19 nt, Homo sapiens
ugagcgagcugaaggaaac

SEQ ID NO: 205464 - RNA, 19 nt, Homo sapiens
gagauaaauaugcggagaa

SEQ ID NO: 205465 - RNA, 19 nt, Homo sapiens
uaacuuggaagaauugcaa

SEQ ID NO: 205466 - RNA, 19 nt, Homo sapiens
ggaccugaagcaagagaaa

SEQ ID NO: 205467 - RNA, 19 nt, Homo sapiens
guaacaaacaaacaacuca

SEQ ID NO: 205468 - RNA, 19 nt, Homo sapiens
uggaugaaaccaagacuuu

SEQ ID NO: 205469 - RNA, 19 nt, Homo sapiens
gggcugacgagaaugauga

SEQ ID NO: 205470 - RNA, 19 nt, Homo sapiens
ugagagaggagaaggaaug

SEQ ID NO: 205471 - RNA, 19 nt, Homo sapiens
gaacuccugcuucaacagu

SEQ ID NO: 205472 - RNA, 19 nt, Homo sapiens
acaaacaacucaauaucac

SEQ ID NO: 205473 - RNA, 19 nt, Homo sapiens
aaaccaagacuuucucauc

SEQ ID NO: 205474 - RNA, 19 nt, Homo sapiens
ggacuccagcuauguaaca

SEQ ID NO: 205475 - RNA, 19 nt, Homo sapiens
gaaagaaugccaccaaaag

SEQ ID NO: 205476 - RNA, 19 nt, Homo sapiens
cggaucaguuggaagaaga

SEQ ID NO: 205477 - RNA, 19 nt, Homo sapiens
gcagcugcuucgugagaug

SEQ ID NO: 205478 - RNA, 19 nt, Homo sapiens
aggaggagaugaaggugaa

SEQ ID NO: 205479 - RNA, 19 nt, Homo sapiens
aggaggugcugcauaauca

SEQ ID NO: 205480 - RNA, 19 nt, Homo sapiens
acaaauggagagagauaaa

SEQ ID NO: 205481 - RNA, 19 nt, Homo sapiens
ccauagggauccucguauc

SEQ ID NO: 205482 - RNA, 19 nt, Homo sapiens
accaagaaauuacggauca

SEQ ID NO: 205483 - RNA, 19 nt, Homo sapiens
caacagcucaauggucuug

SEQ ID NO: 205484 - RNA, 19 nt, Homo sapiens
caaugcugcuacucuacaa

SEQ ID NO: 205485 - RNA, 19 nt, Homo sapiens
cggcaucucagaaucauga

SEQ ID NO: 205486 - RNA, 19 nt, Homo sapiens
gaaguuggcucuugaauua

SEQ ID NO: 205487 - RNA, 19 nt, Homo sapiens
gaacgugucugaaggguua

SEQ ID NO: 205488 - RNA, 19 nt, Homo sapiens
ccaaagugcuggaauuaua

SEQ ID NO: 205489 - RNA, 19 nt, Homo sapiens
gagcagggcuuccaaagaa

SEQ ID NO: 205490 - RNA, 19 nt, Homo sapiens
gauauuagcugguuugaca

SEQ ID NO: 205491 - RNA, 19 nt, Homo sapiens
gaacagaagcagaagauga

SEQ ID NO: 205492 - RNA, 19 nt, Homo sapiens
ggaagaagguaccgaggaa

SEQ ID NO: 205493 - RNA, 19 nt, Homo sapiens
ccagaaggcucuuaucaau

SEQ ID NO: 205494 - RNA, 19 nt, Homo sapiens
gcaaacagcccgugggaaa

SEQ ID NO: 205495 - RNA, 19 nt, Homo sapiens
ggagacugcugcucugaaa

SEQ ID NO: 205496 - RNA, 19 nt, Homo sapiens
ggaaacgucggaaacuuua

SEQ ID NO: 205497 - RNA, 19 nt, Homo sapiens
gaagaucacaauuagcuuu

SEQ ID NO: 205498 - RNA, 19 nt, Homo sapiens
ggaaugaccaacucuuaaa

SEQ ID NO: 205499 - RNA, 19 nt, Homo sapiens
gagaugaagaccaaacaua

SEQ ID NO: 205500 - RNA, 19 nt, Homo sapiens
gcacauggcggaccuugaa

SEQ ID NO: 205501 - RNA, 19 nt, Homo sapiens
ccaggugaaucucgucaua

SEQ ID NO: 205502 - RNA, 19 nt, Homo sapiens
ggagguggaucagaaagaa

SEQ ID NO: 205503 - RNA, 19 nt, Homo sapiens
gcaagacgcugcuggaaaa

SEQ ID NO: 205504 - RNA, 19 nt, Homo sapiens
gacaucaagucauuuguga

SEQ ID NO: 205505 - RNA, 19 nt, Homo sapiens
gaaacaaaucgaagaguug

SEQ ID NO: 205506 - RNA, 19 nt, Homo sapiens
agaaggcucuuaucaaugu

SEQ ID NO: 205507 - RNA, 19 nt, Homo sapiens
gagacgagauggaaacaca

SEQ ID NO: 205508 - RNA, 19 nt, Homo sapiens
gagaagaauuagcuaucaa

SEQ ID NO: 205509 - RNA, 19 nt, Homo sapiens
ugucggagcugaagaacaa

SEQ ID NO: 205510 - RNA, 19 nt, Homo sapiens
ugagugaggugaagaagga

SEQ ID NO: 205511 - RNA, 19 nt, Homo sapiens
ucacuucccuguuccauuc

SEQ ID NO: 205512 - RNA, 19 nt, Homo sapiens
aaagagaaauccaguccuu

SEQ ID NO: 205513 - RNA, 19 nt, Homo sapiens
agaaacaaaucgaagaguu

SEQ ID NO: 205514 - RNA, 19 nt, Homo sapiens
ccaaugaggcgcugaagaa

SEQ ID NO: 205515 - RNA, 19 nt, Homo sapiens
gaacaguuucuccaacaaa

SEQ ID NO: 205516 - RNA, 19 nt, Homo sapiens
gaacgucaagucugaguug

SEQ ID NO: 205517 - RNA, 19 nt, Homo sapiens
agaaggagaugaagaccaa

SEQ ID NO: 205518 - RNA, 19 nt, Homo sapiens
ugacugaccugcagaacau

SEQ ID NO: 205519 - RNA, 19 nt, Homo sapiens
gaucagaaagaaagagaaa

SEQ ID NO: 205520 - RNA, 19 nt, Homo sapiens
ggaaggccaucacggaaca

SEQ ID NO: 205521 - RNA, 19 nt, Homo sapiens
ggcaggagcugaugcaagu

SEQ ID NO: 205522 - RNA, 19 nt, Homo sapiens
cuaaggagcuggcccucaa

SEQ ID NO: 205523 - RNA, 19 nt, Homo sapiens
gaggaaacgucggaaacuu

SEQ ID NO: 205524 - RNA, 19 nt, Homo sapiens
gaaacauucccaggagaua

SEQ ID NO: 205525 - RNA, 19 nt, Homo sapiens
ggaacaguuucuccaacaa

SEQ ID NO: 205526 - RNA, 19 nt, Homo sapiens
cauugaggcugacauguug

SEQ ID NO: 205527 - RNA, 19 nt, Homo sapiens
ggucaccagugcauuaugu

SEQ ID NO: 205528 - RNA, 19 nt, Homo sapiens
ugaauuagagcacgagaaa

SEQ ID NO: 205529 - RNA, 19 nt, Homo sapiens
gagcaguaccagaggcuua

SEQ ID NO: 205530 - RNA, 19 nt, Homo sapiens
gcaaggagccccucaagaa

SEQ ID NO: 205531 - RNA, 19 nt, Homo sapiens
ggagauagcacaguuccaa

SEQ ID NO: 205532 - RNA, 19 nt, Homo sapiens
aaacacacuugcagucguu

SEQ ID NO: 205533 - RNA, 19 nt, Homo sapiens
agaauuagcuaucaaaucc

SEQ ID NO: 205534 - RNA, 19 nt, Homo sapiens
ugaaacagcucaccuugac

SEQ ID NO: 205535 - RNA, 19 nt, Homo sapiens
gcucuuggcuguugcugau

SEQ ID NO: 205536 - RNA, 19 nt, Homo sapiens
uaagugugcuugggaauuc

SEQ ID NO: 205537 - RNA, 19 nt, Homo sapiens
aaagagaguccucaaguug

SEQ ID NO: 205538 - RNA, 19 nt, Homo sapiens
acaauuagcuuuucacaug

SEQ ID NO: 205539 - RNA, 19 nt, Homo sapiens
ccacagagacacagucaga

SEQ ID NO: 205540 - RNA, 19 nt, Homo sapiens
agaggaggcuggaagaguu

SEQ ID NO: 205541 - RNA, 19 nt, Homo sapiens
gcauugaggcugacauguu

SEQ ID NO: 205542 - RNA, 19 nt, Homo sapiens
gaaaaugggagacacagua

SEQ ID NO: 205543 - RNA, 19 nt, Homo sapiens
ucaagaauccagaggcuuu

SEQ ID NO: 205544 - RNA, 19 nt, Homo sapiens
aagaccagcucaucaguga

SEQ ID NO: 205545 - RNA, 19 nt, Homo sapiens
ugucugagguggauggaaa

SEQ ID NO: 205546 - RNA, 19 nt, Homo sapiens
ggaauauccucacggaaaa

SEQ ID NO: 205547 - RNA, 19 nt, Homo sapiens
ggagggaaauguguuagag

SEQ ID NO: 205548 - RNA, 19 nt, Homo sapiens
ggaggacgagcuucaagaa

SEQ ID NO: 205549 - RNA, 19 nt, Homo sapiens
gcgauucuccugccucauu

SEQ ID NO: 205550 - RNA, 19 nt, Homo sapiens
agaugaagaccaaacauaa

SEQ ID NO: 205551 - RNA, 19 nt, Homo sapiens
cuaguucccugaggucuuu

SEQ ID NO: 205552 - RNA, 19 nt, Homo sapiens
ggagugcaguggcgugauc

SEQ ID NO: 205553 - RNA, 19 nt, Homo sapiens
gaaacagcuuuggccaaga

SEQ ID NO: 205554 - RNA, 19 nt, Homo sapiens
gaagaaacaaaucgaagag

SEQ ID NO: 205555 - RNA, 19 nt, Homo sapiens
uuagagaaguuaagagaag

SEQ ID NO: 205556 - RNA, 19 nt, Homo sapiens
gucaggcacuuaaagagaa

SEQ ID NO: 205557 - RNA, 19 nt, Homo sapiens
gaaacgcaacugugcucua

SEQ ID NO: 205558 - RNA, 19 nt, Homo sapiens
gcagugaaguugggaguac

SEQ ID NO: 205559 - RNA, 19 nt, Homo sapiens
caccacaccagccuaauuu

SEQ ID NO: 205560 - RNA, 19 nt, Homo sapiens
caucuggguucaagcgauu

SEQ ID NO: 205561 - RNA, 19 nt, Homo sapiens
gaaugagagccaaggacua

SEQ ID NO: 205562 - RNA, 19 nt, Homo sapiens
cacaacagcauccuagaaa

SEQ ID NO: 205563 - RNA, 19 nt, Homo sapiens
auccugagcucauguuaaa

SEQ ID NO: 205564 - RNA, 19 nt, Homo sapiens
caacguaacuugguuuuca

SEQ ID NO: 205565 - RNA, 19 nt, Homo sapiens
gaaguugggaguacugcuu

SEQ ID NO: 205566 - RNA, 19 nt, Homo sapiens
uggaauauccucacggaaa

SEQ ID NO: 205567 - RNA, 19 nt, Homo sapiens
gaagugggaaugauggaau

SEQ ID NO: 205568 - RNA, 19 nt, Homo sapiens
cuucuaccuuccagaguua

SEQ ID NO: 205569 - RNA, 19 nt, Homo sapiens
ucaagucauuugugaguca

SEQ ID NO: 205570 - RNA, 19 nt, Homo sapiens
aaugggagguggaucagaa

SEQ ID NO: 205571 - RNA, 19 nt, Homo sapiens
caacagcauccuagaaaca

SEQ ID NO: 205572 - RNA, 19 nt, Homo sapiens
gagcugaagaacaacauga

SEQ ID NO: 205573 - RNA, 19 nt, Homo sapiens
caagagggaggcagaccua

SEQ ID NO: 205574 - RNA, 19 nt, Homo sapiens
caggagcucuuggcuguug

SEQ ID NO: 205575 - RNA, 19 nt, Homo sapiens
gcuugggaauuccuuaaau

SEQ ID NO: 205576 - RNA, 19 nt, Homo sapiens
gggcagaagugggaaugau

SEQ ID NO: 205577 - RNA, 19 nt, Homo sapiens
gggagaggcugcguaacug

SEQ ID NO: 205578 - RNA, 19 nt, Homo sapiens
gagaaauccaguccuugaa

SEQ ID NO: 205579 - RNA, 19 nt, Homo sapiens
ucacggaacagaagcagaa

SEQ ID NO: 205580 - RNA, 19 nt, Homo sapiens
guacuuccuuguuugucuu

SEQ ID NO: 205581 - RNA, 19 nt, Homo sapiens
agagaagaauuagcuauca

SEQ ID NO: 205582 - RNA, 19 nt, Homo sapiens
ccacaaccgaguucuaguu

SEQ ID NO: 205583 - RNA, 19 nt, Homo sapiens
cuagggcacuucacgaugu

SEQ ID NO: 205584 - RNA, 19 nt, Homo sapiens
uccagaggcuuuaggaaga

SEQ ID NO: 205585 - RNA, 19 nt, Homo sapiens
ugaagaaacaaaucgaaga

SEQ ID NO: 205586 - RNA, 19 nt, Homo sapiens
gaacuaaccugucagauuu

SEQ ID NO: 205587 - RNA, 19 nt, Homo sapiens
gagaacagauucacaauuu

SEQ ID NO: 205588 - RNA, 19 nt, Homo sapiens
gcaaggagauuguuagauu

SEQ ID NO: 205589 - RNA, 19 nt, Homo sapiens
ggaacaauguacacuauua

SEQ ID NO: 205590 - RNA, 19 nt, Homo sapiens
gaaauagaguccuuaaaug

SEQ ID NO: 205591 - RNA, 19 nt, Homo sapiens
ggaaauacaugaaauccaa

SEQ ID NO: 205592 - RNA, 19 nt, Homo sapiens
gcaaagaacuuaauugaac

SEQ ID NO: 205593 - RNA, 19 nt, Homo sapiens
gaagcacaauuccacauua

SEQ ID NO: 205594 - RNA, 19 nt, Homo sapiens
guagaugacugguccaaua

SEQ ID NO: 205595 - RNA, 19 nt, Homo sapiens
uaacauggcugaaggaaga

SEQ ID NO: 205596 - RNA, 19 nt, Homo sapiens
gaaagaagagcuuaaagaa

SEQ ID NO: 205597 - RNA, 19 nt, Homo sapiens
gagaauagcagaauuaaga

SEQ ID NO: 205598 - RNA, 19 nt, Homo sapiens
acaaugaucuggaguuuaa

SEQ ID NO: 205599 - RNA, 19 nt, Homo sapiens
gagauuagcagucuuagua

SEQ ID NO: 205600 - RNA, 19 nt, Homo sapiens
gaaaaggagucuuguauaa

SEQ ID NO: 205601 - RNA, 19 nt, Homo sapiens
caagauggaugaacagaaa

SEQ ID NO: 205602 - RNA, 19 nt, Homo sapiens
ggcaguaccucauuguuua

SEQ ID NO: 205603 - RNA, 19 nt, Homo sapiens
aaacaacgauuacgaaaug

SEQ ID NO: 205604 - RNA, 19 nt, Homo sapiens
ggaguuugaugcaucuuua

SEQ ID NO: 205605 - RNA, 19 nt, Homo sapiens
gaaaggagcaucagcaaga

SEQ ID NO: 205606 - RNA, 19 nt, Homo sapiens
caugaaagcugaacuugaa

SEQ ID NO: 205607 - RNA, 19 nt, Homo sapiens
caaaugagcuaaucaacau

SEQ ID NO: 205608 - RNA, 19 nt, Homo sapiens
gaacuuaauugaacagcuu

SEQ ID NO: 205609 - RNA, 19 nt, Homo sapiens
cggcuuaccuuuccuauuu

SEQ ID NO: 205610 - RNA, 19 nt, Homo sapiens
uaacacaguugaagaaaga

SEQ ID NO: 205611 - RNA, 19 nt, Homo sapiens
gcaagaaacguuaaagaaa

SEQ ID NO: 205612 - RNA, 19 nt, Homo sapiens
gaaaguagcucuugaaaag

SEQ ID NO: 205613 - RNA, 19 nt, Homo sapiens
gaaagaccuucgaauguug

SEQ ID NO: 205614 - RNA, 19 nt, Homo sapiens
gaagauaagcggaagguuu

SEQ ID NO: 205615 - RNA, 19 nt, Homo sapiens
gcaaagaggaggaguuaaa

SEQ ID NO: 205616 - RNA, 19 nt, Homo sapiens
gaaauccaauuacaggaaa

SEQ ID NO: 205617 - RNA, 19 nt, Homo sapiens
gcacaaugaucuggaguuu

SEQ ID NO: 205618 - RNA, 19 nt, Homo sapiens
gcacagaagacgacuuuaa
